United States Patent 7,630,836 (POLYNUCLEOTIDES) - sequence listing, part 6

SEQ ID NO: 961 - DNA, 2649 bp, Streptomyces avermitilis
  CDS (1)..(2649)
gtgcagcatccacgtcagggacccccatctcgccacacccgacgaagcctcggcagatcgctggccctcaccatgacagccgtcctcggcgcggcaggcctggccctgtcccccgccgcctccgccgacagcggccccacgaccgccgacccgaccgaggcccacgggctcaagggcgagtactacactcaatccgcgcccggagctttcgacttcgccgagctgaaggccaccggcttcgatcccgggctcgacttcgactcgctcgagtcccgtctctcggcggccacaggccgggccgacgacgtctccgtccgctggaccggcgaggtcgtccccgagaagtcgggccccaccaccttctcgatcaccggcgacaacggcttccggctctgggtcgacggaaagctcaccatcgaccactgggtcgacgactgggacagggaacagacctcgcagcccgtcgatctgacggccggccgggcctacgacatcaaggtcgagtacttcgagcacttcggcggctccaacctccacctgcgctggacaccaccgggcggcagcaagtccgccgtgccccagtcggcgttccgcctacccgacgggttcgactacaacggcgccctctcggcgaccgtcctcggtgacgggcgcaccgttcgtctggacttcccgcaggccctcgcctccgcccccgccacggtgctcgaccacctcacggtcaccagcggcggcaagtggcccctgagttccgtcaagaccgacccgtccgacgcccgggcgctcctcgtcggcctcggcgaacccgtcgtcggcaacaaggccggtacggccaagggcggcgtcaacgtcacctacgacggcaagggcgccctggccgacaccagcggcacaccggtcaaggccttctggtccagcggacccaacaagtcgacctacgaactgcgcaccaagtgggccgaccaggtgggccccaagaacgccctgcccgagtatccgcgtccccagctgacccgcaaggcctggcagaacctcaacgggacctggcagttcgccggcgccaaggccggcgaggagccgcccaccggcaggactctcgccgagaggatcctggtgccgtatccggtcgagtcacagctctcgggcatcgagcgccatgaggaccgcatgtggtaccggcgcaccttcaccgtcccggccgactggaaggtcggccacggcaagcggctgcggctcaacttcggagccgtcgactggcagtccgaggtgtacgtgaacggcaccaaggtcgccgaacacaagggcggctacgacaagttcagcgccgatgtcaccgacgcgctgaagccggggcgcacccaggaactcatcgtcggtgtctacgatcccaccgacgcgcagggcggcgagaacccgcccctgggcaagcagcgtctcgaccccagcggtatctggtacaccccgtcctccggcatctggcagacggtctggatggagccggtcgcagccgaccacgtcgacacgctcaagctcactcccgacgtcgaaacgagcaccctcaccgtcgagccgaagggggtacgcgacggcctcgccgtgaccgcgacggcgtacgacgggaagaagaaggtcgcaacggtccggggacgcaccggcacacccctcacgctcaagctcgccgagccccgtctgtggtctcccgacgaccccttcctctacgacctcaaggtcgacgtcggcgccgaccgcgtcggcagctacttcgggatgcgctccatcgccgtggagaaggtcgacggaacaccgcgcaccgtcctcaacggcaagcccgtcttcatgatggccacgctcgaccagggtttctggcccgacggcctgcacaccgcgccgaccgacgacgcccttgcccacgatctgaagatgcacaagcagatgggcttcaactccgtgcgcaagcacatcaaggtggagcccgaccgctggttctactgggcggacaggctcggactcctggtgtggcaggacatgcccgcgatgaccgccggggtgaacccgaacgccgcctcccgcgccgagtacgagcgcgagatgaagcagctgatcgacgagcacatcagcagcccctcggtcgtcatgtgggtgaccttcaacgagggctggggccagtacgacgaggcccgcatcgccgaccaggccaaggcgtgggacccgacccggctggtcaacagcatgtcggggctcaacctcggggttgacggcggcaccggcgacgtcatggacgagcacggctaccccagccccgcgctgccgccgcaccccgacggcagacgggccctggtcagcggcgagtacggcggcctcggcctgggagttcccggacacgcctggtcggtgcagatgtcgtacgtggatgtcgaccccgccgcgtacaccgacacgtatctggcccggctcgacgaggttcgcaggcttgcctgccggggcggcaatggagccgtctacacccagatctccgacgtggagggcgagctcaacggcctgatgacctacgaccgcaagatcgtcaagcctgatgtgcagcggctcaggaccgcgcacgaggcactgatcgaggcagtggcgcagtccacgctcccgtgcgccacgtcc

SEQ ID NO: 962 - DNA, 819 bp, Streptomyces avermitilis
  CDS (1)..(819)
atgggcacttttaccaccgatgacggcacagagattttctacaaggactggggcagcggaccgcccgtcgtgttcagccacggctggccgctcaacgccgacgcctgggacgttcaactgcgtctggtggccgagaacggctatcgcgcggttgcccacgaccgccgtgggcacggccgctcgggccagccgtggaacggcaaccacatggacacctacgccgacgacctctcgcagttgatcggcgccctggatctgcgggacgcggttgtcgtcggccactccaccggcggcggtgaagtggcccgttacatcggccggcacggcagcggccgcgttgccaaggcggtcctggtgggagccgttcccccgatcatgctgaagaccgacgccaacccggaggggctcccgatcgaagccttcgacgccatccgtgcgggcgtcctgagcaaccgcgcccagtactactgggacttgtcggatcagttctacggtttcaatcggcccggcgccgaaggcacggacggggtacggcgcgcgttctggttgtggagcatgcaggtgggactcaaggcggcctacgactgcatcgagcagttctcggaacaggatttcaccgaggacctgcggcgcatcgacgtaccgaccttcatcgcgcacggcgacgccgaccagatcgtccccctcgtggcgtcggcacccaaatctgccgaactcgtcaaagacgcgacgttgaaggtctattcgggggcgccgcacggtctgaccggggcatacgagcaggaattcaacgctgacctgctgaacttcatccgtggc

SEQ ID NO: 963 - DNA, 1704 bp, Streptomyces avermitilis
  CDS (1)..(1704)
atgggtgagggggagaccggcagacgggtcgtggacaaccgcttcgaactggaggcccggctcgggggcggcgggatgggcaccgtgtggcgggcccgtgatctgctgctgcaccggagcgtggccgtcaaggaagtacggccgccggacgtggacttcgccgagtacgacccggacggcgcgcacctgctgcgcgaacgggtcctgcgcgaggctcgtgccctggccagggtcgaacatccgaacgtggtgacgatccaccacatcgtcgacggcggcgagggcacctacccatggatcgtcatggaactcgtcggcggcgggtcgctggccgaccggctcgctcgtgggccgatgaccccggcggaggccgcgcacatcgggcgcggagtgctcgcagccctgcgtgcggcgcacgccgcaggagtgcagcaccgcgacgtgaaacccgccaacgtgctgctgcgccccgatggcagtccggtgctcacggacttcgggatcgccgcgatccgcgagtccaccactctgaccgccacgggatcgatcatcggcacgcccgactacatggcgccggagcgcgtcacgggcgatcggggtggccccggtgcggacctgtggtcgctggcgatgatgctgtacgtcgctgtcgaggggcaccatccgctgcgccgggggacgacgctggccacgcttgccgcggtgctccacgacgacgtaccgcaccccgtgaaggccggtccgttgacgccggtactcacgcgagtgctcgtgcgtgaccccgcagcgcggccggacgccgaggccttcgaccggatgctcgccgccgtggcggaagccggtcccggggccgagcccacgtcctacccactcgcacccccggtcccggcaccgccgcccgcgaccacggaatccgggcttgtcggagcgtcgcggaacccgagggaccacctgaggcggccggcgcgggaaccacgggacgccgtaccggacccgcgtccaccactggggtccgacgccgaccgtctcggaacgcgtacggtcacccgtcggccgggacgggcacggctcatcgtggtggcctccgtcgccggtgcgtcgctcgtgggcgggctggtctggcggacgctgcccggaggccaggacggagccgcggcgtcgcccggggcctcccgcgaaacggagcacgccccggcagcgcccacgaccgtgacacagaagccgacggaccaggagtcggacagcgagaccaccgacctgctcaccccggccggcatccgggcctcgatcaaggccatcgagaaggagaccggacgggacagcttcggtgacttctccgtctacccggaccatgtctcggcgtcggtcatggtcgagggcagccgtacccgctacgacacctacacctaccgtgtcgaccgcggcgtggaaaagggcatcatcaagggcacgctggcgggtggccgacagccggtgagtctgaagaatttccagtgggacatggttcccgcgctgctcgcccgtgcggagagggcgctgaaggtcgagaagccgacggcccgctacctgctggtccggcagccggacaacgtattcggcactcctgcgggcatggcggtctatctgagcaacgactaccgggagggcggctacctggaggccgacacgcaaggcaaggtgaccaaggtgatgccggccgccgga

SEQ ID NO: 964 - DNA, 333 bp, Streptomyces avermitilis
  CDS (1)..(333)
gtgctcaaggagatcgccacccgtttccgtacccgggaggtgcggagcgggcaggtcctcttcgaggccgggcagcccgtcacggaggcatatgtgatcgcccacggccggttcacccgctacaccgccggcaagtacggcgaggaggaaaccatcggggtcgtcaccgacggcgaccagatgggcgacgaggccatcggccagtcggaccctctgtggctgagctcggtccgggccgagacggcgggcgtggtgctcgtgctcccctgggacgtcgtcacggagttcaccgagcgggtgccgtccctcgcggcgcacctagtagggctccgt

SEQ ID NO: 965 - DNA, 1152 bp, Streptomyces avermitilis; identical to SEQ ID NO: 318
  CDS (1)..(1152)

SEQ ID NO: 966 - DNA, 783 bp, Streptomyces avermitilis
  CDS (1)..(783)
gtggagcaaatcgagcggctgcgccgggaacacaagtggtccgcagcacgcatcaccttcgaactctcggcccagggcatccagatcagtcgccggaccatcacgcgacatctggaacagctcgggctgagtcgccgtcggttcatcgatccggacggggagtccaaccgcacagcgcggcagatcatcgcccaccgcccgggtcacatggtgcacatcgacgtcaagaaagccggccgcatccccgatggcggaggctggcgagtccacggccgcggaagcacgcaggccaaatctgcagaacggcagaaacgccgaaccggccgtcgcggctacatctacctgcactccgccatcgacggcttttcgcgtctggcctacaccgaggcactgccaaacgagaaggccaccaccgccattgcattcatgcaccgcgctcgcgtctggttcgcagcgcatggcatcaccaccatcgagcggatcgtcaccgacaacggagcctgctaccgagccgatgccttcgctcgcgcgctgcttggagcacggcaccaacgcatcaccccatacacacctcgccacaacggcaaagtggagcggtaccaccgcatcctcgccgaggaattcctctacgcccggagctggcaatgcgagcaagaacgctcagatgcgctccgcgtctggaacatccactacaactaccaccgcccacacggggcagctggaaaccagccaccggcaatccgcctgcccatgaccgtcaccaacgtcctgtcctcatacacc

SEQ ID NO: 967 - DNA, 231 bp, Streptomyces avermitilis
  CDS (1)..(231)
atgaccgggaagagaccgtcgcttcaccgcaacgccccgctgtctgttgaaggccggcgccgcctcgtcgaacgctgtaagtcgcgcccgatcgcccacgtggccgcggagatggggatctcaagagcgtgcgcgtcgaaatgggtaaaccggttccgccgctacggtgaacttggcctgcacgaccggtcctccgcgcctcgccaccaaccgacagccacgccggcgcgg

SEQ ID NO: 968 - DNA, 1389 bp, Streptomyces avermitilis
  CDS (1)..(1389)
gtgaaaatcagctcgcacgcggtagcggggatgttggggacctggcaggaggggccggggccggcgcatcaacgtctctccgacaggctgcgtctgctcatcctggatggacgcctctttcttggtgcggccctgccgagtgagcgtgacctggctgtcgcgctcggcaccagcaggaccaccgtcggtaccgcgttccgcacgctggtcgagcacggatacctcgccacacaggcgcgtaccagggcgacggtacgactgcctgatgacaccactcccgagcacttggtcggcacggacgcagagaccatcgacctgtcttttgccgcgccggctgcgcccgtagaaatcctccacgccgcgttcgcgacggctctcgaacagctgccacgtcatttcgagcggcacggctacgaccgatacggcaccgctgagctgcgcgaagcagtcgcccgatggtatcagcggagaggactgcccacccggcccgatcacatcctgatcaccaacggcgcgcagcacgctctagcgcttctgacgcgcgtactcctgtcgccacgcgacaaagtcctcatcgaccatccgacctacccgcacgcgatcacgacgttcactcaagcgcgcgcccgtcttctacccgtcgccgtgacgtcttccggctgggacaccgagcaactccaagcagcagggcaagccgcgaatctggcctacctgatacctgactttcacaacccgaccgggatgtgcatgcccacgagcgtgcgccaacagctcaggctcgcgtgtcccactgtcgtcgacgagacgatgaccgatctggctctggacgttccgagccccgaacccctcgcgctgcacatgccgacggccatcagcatcggctccgtgtccaagagcgtctggggcggcctacgcacaggctggattcgcgcgctgccctctctcctggaacgtgtcgaacaagcccgtcccaccacagacctcggcacccccgtcgtagaacagctcgccacagccgtcctcctgaacgagcaccagacccagcggcccgacacgctccagcaactcagatcgcaacgtgacgccctgtggcaagcactcaccgaacacctaccgaacgtccacgccccgcagccagctggcggcgtgacgctatgggcagccttccccgggcccgtcagctcgcggctggcagccatggcgcctgaccacggagtgaccatcgcggccggcccacgattcgggatcggaggcgcgttcgaacgcaacatccgactgccgtacacgctcccttcgagtcaactagcccaggcaatccgcagactcgcgcaggcagcacaggcactcgcacaaggcgctaccggtactcacaccctcgcgcccatcgca

SEQ ID NO: 969 - DNA, 615 bp, Streptomyces avermitilis
  CDS (1)..(615)
atgaaccgcaagggcgaggccgacgtcccggtgcaggccggtcacgtgggcgagccgtccttgaacggcggcttcgtcgactacgacctcgccccgcgcgaatacgagttgtccctcacccagaccgtgctgcgcgtacacacccgggtcgcggatctctacaacgagccgatgaaccagaccgagcagcaactccgcctgaccatcgaggagatccgcgagcgccaggagtgggagctcctcaacaaccgcgaattcgggctgctgcacaacgccgactacggccagcgcatcagcacgttcaccggcccgcccactccggacgatctcgacgagctgctctgcatgcgccgcaagacccggctcttcctcgcccacccgaaggccatcgcggccttcttccggcagtgcaaccggcgcggcctggtgcccggcaccgcgaacatcgacgggcacgagctgcccgccggcgcggcgtcccgttgctcccctgcggcaagatcccggtcaccccgcagcacaccagcagcatcatcgcgctgcgcaccggggaggccgaccaaggcgtcatcggcctctatcagaccggcatcccggaggagtaccagcccggtc

SEQ ID NO: 970 - DNA, 267 bp, Streptomyces avermitilis
  CDS (1)..(267)
ttgctcccctgcggcaagatcccggtcaccccgcagcacaccagcagcatcatcgcgctgcgcaccggggaggccgaccaaggcgtcatcggcctctatcagaccggcatcccggaggagtaccagcccggtctgaacgtgcggttcatgggcatcgacaccgccgcgatcatccgctacctcgtcaccgcccacttctcgctggccatcctcgtcccggacgcggcggggatcctggaaaacgtacagatcggccggaccgccgaa

SEQ ID NO: 971 - DNA, 2073 bp, Streptomyces avermitilis
  CDS (1)..(2073)
atggagcaccgaatgagcgcgtcaccgcttcccggtacctcgttcgcgccgccgggaccgcacgacatcgccggcaccgtgcgggcccggcgtggcggggcgatccccgggctcaggtatcggccggcggtccccgccgatcccgcgaaggtcgcggagaccgatcgcaggctggaggcatgggcccgccggctcgacgtgttccccgaggcgtggttcggggatttcgcggggttccagttcggccgggccgtggtgctccagcacccgggtgccgcggacgtggagcgcctcaccgtcgccggcaaactgctgctcgccgagaacatcgtcgacgactgctactgcgaggaccggggtggttcaccgcgcggtctcggcggccggctgatcacggcccagtccgcgatcgacccctaccacggcactcccgaggcggaggagcagtggcggcacggcatgcaggccgacgggccgctgcgctcgtaccactgggccgtcaaggactacgccaccctcgccacgcccagccagacggaccgcctcgtccacgacatcgcccggctgcacctggggtacctcgccgaggcggcctgggcggagacacgccatgtgccgcgggtgtgggagtacctggtgatgcggcagttcaacaacttccgtccctgtctgtccatcgtcgaggtggcatgccaccaacacccaccgctaccacctgccgaactactggtaaccactactgacagtacgtcaaatgcactgcgaggagccactgttgaccaccgcccccgacgccgtcacggcagcaccggtaccgacccagtccacgtaccagtcccgcgtcgcggactactggaacgccgaggagaacccggtcaacctcgaactcggcaagatcgacgatctgtaccaccaccactacggggtcggggccgtcgactactccgtgctcgacgagcccgacccctcgcggcgccacgagaggatcaccgccgagctgcaccgactggaacacgcccaggccgaactgctggccggccacctcagccccctctcccccgccgaccgcgtcttcgacgccggctgcggtcgcggcggcggcagcgtcgtggcgcacctgcggtacggctgccacgccgacggcgtcacgatctccgccaagcaggccgacttcgccaacgaacaggcccgcaagcgggacatcggcgacaaggtgcgctaccaccaccgcaacatgctcgacacgggcctgccgaccggggcgttcgcggcctcgtggaacaacgaatccaccatgtacgtcgagctggagctgctgttcgccgaacatgccaggctgctgcgtcgcggcggacgctgtgcggtgatcatcgggtgctacaacgacacctacgggagggcctcacgcgaagtgtccctcatcaacgcccactacatctgcgacatccatccacggtcggcatacttccgggccatggcccgcaaccggctggtccccgtgcacgtcgaggatctcaccggagccgcgctgtcctactgggagctgcgcaagcggtccgaccggctggccaccggcatcgaggactcgttccggaccgcgtacaagaacggcagcttccagtacctgctgatcgtggccgaccgcgtctgaggccacagaacgccgcccctgtcccgccgccgcggcacgacggcggaccaggtgtacgtcccccgggggagggccactgtccgacagatgtcacggagtggccaacagcgactccaaggccaccgcggtatccggatgacggccgatcagttgcccgcccgccgggccgggatcggctgtctgccacgtaccgtcgcagcccagcaggctcgccaccgcgtcgcacgtcgcggggtgggcggcgagcagcgcgacgttgcggccctcgcccgcgcgcccgcccgggcgcgcggtgtcgggcaacggctgggcccgccacggcggcacccacgcgtccagctcccccagccggccggggaagatccgcccggcttcacggatcaggagcggggcgagctccgcgccgttggagcgcagggtgc

SEQ ID NO: 972 - DNA, 894 bp, Streptomyces avermitilis
  CDS (1)..(894)
atgcactgcgaggagccactgttgaccaccgcccccgacgccgtcacggcagcaccggtaccgacccagtccacgtaccagtcccgcgtcgcggactactggaacgccgaggagaacccggtcaacctcgaactcggcaagatcgacgatctgtaccaccaccactacggggtcggggccgtcgactactccgtgctcgacgagcccgacccctcgcggcgccacgagaggatcaccgccgagctgcaccgactggaacacgcccaggccgaactgctggccggccacctcagccccctctcccccgccgaccgcgtcttcgacgccggctgcggtcgcggcggcggcagcgtcgtggcgcacctgcggtacggctgccacgccgacggcgtcacgatctccgccaagcaggccgacttcgccaacgaacaggcccgcaagcgggacatcggcgacaaggtgcgctaccaccaccgcaacatgctcgacacgggcctgccgaccggggcgttcgcggcctcgtggaacaacgaatccaccatgtacgtcgagctggagctgctgttcgccgaacatgccaggctgctgcgtcgcggcggacgctgtgcggtgatcatcgggtgctacaacgacacctacgggagggcctcacgcgaagtgtccctcatcaacgcccactacatctgcgacatccatccacggtcggcatacttccgggccatggcccgcaaccggctggtccccgtgcacgtcgaggatctcaccggagccgcgctgtcctactgggagctgcgcaagcggtccgaccggctggccaccggcatcgaggactcgttccggaccgcgtacaagaacggcagcttccagtacctgctgatcgtggccgaccgcgtc

SEQ ID NO: 973 - DNA, 2811 bp, Streptomyces avermitilis
  CDS (1)..(2811)
atgagcggcacgcacgggcagaccttcgaagagctgcgcggacagttgcaggaggccgccgcgacgttctccgacgggcccgacgccctggagggcatcctcctcggcatcgtcgacgacgtcgaccgcgcggtgcgcgagccactggagatcttccccgtctgccaccactcgcccgcctcggcgctcgcgatggcacgccgcctgcgggagaagcggccgaaggtcgtgtacctggagttgtgcgaggacatggcgcccctgctgaccgaactgcgcaactgccgactgccggtggcggtgcaggcgttcgcgaccgaggtcgacggcttcccggccgactggtccccgctgtcggtggtcgcaccgatcaccgaggcctcggccgagtaccaggcaatcgcctacgcactggacacgccgggcgtcgaactggtcctcgtcgaccgttcctcggaccatgtcttccagtgggactcgcgcgggacgcactccgccgaggccggcgccgatccaggggcgtcggacgcaccgcccgtcgaggaggaggccgcactgcacggcgacgcggtcggcgtggagatcggcgacctgcggccgcgcttcgccgaactggaggaacacctgctgcaccacggcagggtgcggcactggtcggagtggtggcaccagtacgtcgaactgcccctcggcgacagcgatcacgacacctatcgccaggtcatgctcctgatcggcagcctcttcagacgccttgcccccggcgacccccaccgggtgcgcgtggacgaggaccgcgaacgctacatgtggaccaggatgcgcgaacacctggccgcgaccggcaccgatgccgcggactgcctttacgtctgcggtgccttccacgcggccagtcgcgtcgcggagttcggcgtccacggcaccgacaccttcgagatcggtccgcgcagtgccaccaggtggcagcacggcctcattccgtccagccacgcggcgatcgagacgcagttcggcctcgcctccggctcggtgtcgatcgccgcgacggtgtgggcgaagaacgtcaggcgcacgcgcgtggagcccttccgcctggcgggacaggcgggcgcgaagacgtcgaaggccaagaagaccgcggtcgcggccgcccccgtgccggcggccgcgaactcggacaagctgaccggcttcctgcggcgaccgcccgtcctggaccggctcgacgagaccgaactgctcggctggtcggtggagatcgtgcgcgccgcgcgccgcaacggctatctcgcctccaccgctgacgccatcgcggtgttcgagacgtccatcctgctggccgggatgcgcgatcgggccagacccacgccgtacgacttccaggacgcggcggtcacctgcatcgagaaggacaccgtgccgggccggcgcgatgtgcgccgcctcgtcgacatcatgatgggcggcgaccggatcggccaggtcggttacgacgcgctgccaccactggcccgcgacgtgcacgaccggctcgcgccgctgaacctgaagttgcagcagcgcggcgtccagcgggcgttgctggacatatcctcccagccgcaactggagcagtgctccgacgtgctgtggatgctgcggtacctgatgccgcagggcacggcccggcccatcatgggtgagcggcggctcggcgagcggccgatccaggagtcgtgggacctggcgctgggcacccaccagcgcgcgctcatcgagctcggctacgagggtgtcagcatcgagcaggtcctggagcagcgcctgcgccgcacggcgtacgggccgcacgccaccacggcgaccgtcctggaggccatcgaggacgcgacgctgcacctgcgcagccgccgcctcaccgacgagctgggcacccgcgccctcgaggtgctgtcggccgaacgcagcgtcgacggcgcaccggaggtgctgcgccgggtgcggcggctgctggcgtactaccgcaccagcgagccggtgctgccaccgtggatcgagtccttcgtcaagaccggatacgcgcactactgcaccctgctgccgacggcgttcaccgacgacgacgccaccgtccgccaggtcgcggcgatgctgggattcctgttcggcatggagagcctggcgctgtcgctgggctgcgaccgaacccagctggagctgtccgtcgcgcagtcgcatccgcaggagccgtcgaaggtggcgctgctgtgggcggctcaggtacagctcggacatctctcccgcgcggaccttcgcacacgctgcgacgaactgctggacaaccccatggtggtgcctgcctatccgcgttacctcagcggattcgtgcacgcgctggaaccggtgccggggctggccgacctcgtcgtggaggcagtgtcgaacgcgttcggacgcctgccggacccggtgctgctgccgtggctgcccaccctcatcagcaccctgcgctccaacggcgcggagctcgccccgctcctgatccgtgaagccgggcggatcttccccggccggctgggggagctggacgcgtgggtgccgccgtggcgggcccagccgttgcccgacaccgcgcgcccgggcgggcgcgcgggcgagggccgcaacgtcgcgctgctcgccgcccaccccgcgacgtgcgacgcggtggcgagcctgctgggctgcgacggtacgtggcagacagccgatcccggcccggcgggcgggcaactgatcggccgtcatccggataccgcggtggccttggagtcgctgttggccactccg

SEQ ID NO: 974 - DNA, 1113 bp, Streptomyces avermitilis
  CDS (1)..(1113)
gtgatgtccgacctgttgcgcgcccccgccgagatcaagtacgccgaggaactggactggctggagtccatcgacgacaaccccaagcccttctcctggcgcctgtccccgaagatggtccgcctgttcatcctgggctccgagcgctccgacggcctggagcgggagatctcgcagaagtggttcggcgaccgcagtttcgtcgagcgctccatcgtcacgctggcctccgaccgtggactgctgctcatcggcgaccccggcaccggcaagagctggctggccgagctgttgtccgccgcgatctgccgcaactccacgctggtcgtgcagggcacggccggcaccaccgaggatcacatcaaatactcctggaacgtgtccatggtcatcgccaagggccagtcgcgggagtcgatgatcccctcgccgatcatgacggcgatggagaccggcgcgatcggccggttcgaggaactcacccgttccaccagtgacgttcaggacgcgctgatctcgatcctgtccgagaaatacgtctcggttcccgaactggacagcgacagcgtcgtcttcgcccagcccggcttctcgatcatcgccacggccaacagccgtgaccggggcgtcaatgacctgtcctcggcactcaagcgccgcttcaacttcgtacgcatcccggtgatgacgaacaggaagagcgaggcggagatcgtccgcttccgcaccgaggaactgctccggcgccaccagatcgagctggacgtgccgccgacgctgctcgacgtgctgttgcagagcttcgccgacctgcgtgcctccgcggccgcggccggcagcgacgacgagaagctggagtccgcgctgtccaccgccgaacagatcggcgtcctcgaggacgcgatcctgcacagcaacttcttcggcgagcgcgccctgaccgcccgcacgctggcctcctcgctcgtcgggtcactggcccggcgcgagcccgaggacctggccatcctcaacaagtacctgcacggcgtcgtcgagccgcgcggcaaggaagagggcggatcctggccggagttcctggagggcggccgcgacgcgatcgccaccctctca

SEQ ID NO: 975 - DNA, 1434 bp, Streptomyces avermitilis
  CDS (1)..(1434)
atgaccgagcggacgaccgaacacacgcccgagcagaacgcggaggcggactcggacgagaaccgtcgccaggttctctactggcggctcctcgcccgtctcttcgaccacgaagaacaggcgacgctggagtcggcgagcctcgctgtcgtcgaggacatcggtctgccgtccgggctgttggacccggggacctccgtcgactcgatcgtgcagcgccacccggagctggcctccgaattcgacggtctgatggtgcccgagcccgagcccgacgacgacggacgcgaccgggccgccgaagtacggcgtgcggccctggtgtcgaaggtgctgctcaacgtcttcgccgccggatccggcaccgtcaccgccggacagctgtcgcgctggcagtccgacgcggggtggctggagcgagcgctcggctgccggccgggcgaactgcgcgggggacgcccgggaggagggcgcgcggggcgaggcgccggtccggccggcaccggcggtcgcggtgcgacgcccgacctcggccgtctgattcccgcgatcggcccggaactcggtgccatcgaggccgatctcgtgaagcggatgcacttgcgtgaggtcctcgccgatcccaccctcgccgcacagctgaccccgagcatgtcgctgatcgaacagctgctgcgcgacaagaacaatctgtccggcgtcgcgctggccaatgccaaggctctgatccgccgcttcgtcgacgaggtggccgaggtgctgcgcacccaggtggcgcaggccacggccggcgcgctggaccgctccgtcccacccaagcggaccttccgcaacctggacctcgatcgcacgatctggaagaacctcaccaactggagcccggaggaggagcggctgtacgtcgaccgcctctactaccggcacaccgcccgcaagacgacgccccaacggctgatcgtcgtcgtggaccagtcgggctcgatggtcgactcgatggtgaactgcaccatcctggcgtcgatcttcgccgggctgccgaaggtggacgtccacctgatcgcgtacgacacccgtgccatcgacctgaccccttgggtgagcgacccgttcgagatgctgctgcgcaccaacctcgggggcggcaacgacggacccgtcgccatggccatggcccgcccgaagatcaccgaaccgcggagcaccgtgatggtgtggatctcggacttctatgagttcgaccgctcccagccgctgttcgaaggcatcgaggcggtccaccgctccggggtgaagttcatcccggtcggctcggtgaccagctccggtcgccaggaggtcaacccctggttccgggagcgcttcaaggcccttggcacgccggtggtctccggccacatccgcaagctcgtccacgaactcaagacgttcctcgct

SEQ ID NO: 976 - DNA, 1398 bp, Streptomyces avermitilis
  CDS (1)..(1398)
atgcgcaccgacctgctcaccgaacccatggccgggctcgacgaagccctggccgcggtcgatggcttcgaccggacgctcgtcggcggcctgctccggccccagcccgcccaggccgccgacctgaaccaactcgcctgcgccgtcgcggggacaccgctggcctccagggtcgcggaggccgccgacaaggcggcggccggagccgcgagcgaggaccacttcgtcgccctggccgccgcccgcacggcactgctcggctccgtccacgacgccctcatgacccgcgtcgacgaggtgatcggtcgcacccgcggtgaggcgacggcctcgacgcccggcgagcggcacatggtgaacctgctggccgccgcccgctcctggctctgcgatctggcgcgcgccggatggcagggcatcgatcacgaggtggtgtcggcatcggcgcaggtcgtctcgtcgatgctcccggacccctccctgcgccgcctggcgacgctcctcgacggcttcgccgccgaactcgccgcctcctgccccggggcggccctcaagcgaatgccggtacgccgctggggagatgtgtggtcgcgtgcgatgctcctgacggtgcccggcgccgccgacgcgcccacgaccgctcccgccaccggccgcctgctgcccctcggtgtcgacgtgcacgaacacgcgaccgccgcgcaggcccaggtccacgccgtgttcgagcccgcggacggcagcgcgccccgcctggtacgcgccagtgtctcggtgccgaagccggacacggtcgtcggagccggtgtctggcagctgctccgcccgcacatgtcgctcctggccgccgcaggcgaaggccgttcgatggagctccacgccatgccgatcaccgccgaaggcgacctgatctggagtgatgaacaagggcgccccggtgagcccgccgaccccttcgccaccgcccgcgtcgtcctgcccaccgcgaccgccgcacacaccgcgccgcttcaccggcatccggcgggcatcgccgtaccggtgttcctggagggctacgccgtccacaaggacggcgacgtactgacgttcaacacggccggacacggacacggacacggactcgccgtcgaggccgaccgggtcccgaccaccggcccgctgacccccgaggccgtcgcgctgtcgaacgcgtgcatcggcctgctgcgctgggacaccggggcgttcagcgtccaaccgctcgccgtcgagacgaccgtgcggaagaaggctgtcgcggtccacgccggagcatgggccggcggcacggccgacaagacgggcgccaaggccgagaaggccgccaccgaggctgtggcggtgttgcgtgagcgcgccggaaggctgctgaggaaa

SEQ ID NO: 977 - DNA, 603 bp, Streptomyces avermitilis
  CDS (1)..(603)
gtgaactccgcctgtgatcggcgttgtcagtggtcgccactatgttcagccgtgtctcgccgctctggcgcgagagccccttggtgcaaaggagatggtgcgttgtcggattgggagaagtccagcatggcgcgcgtgataccgcccgcgcgaccgcgcaagctcgcgaaggtcccgttcgtcgaacttgccgacggacgcctgcaaggcgtggtgtccagcggatcggacatcgagcgggtctacgtctcatcggtcgcggccggcagctacgcgttcgcgtgcagcaccaacaacaaccgtccctgcggcggcgctcggggctcgttctgcaaccacatcaaggccctgatcaacgaggcggtgctgcagtacggcgtcgagcgcgtcgtccgctacctgcgtgtggacatcgcggacgaggagcggagcgcacagggcatcgccgcggagatgagcggaaccaacccgccacagggggacgccaaggccgccgcttgggtcttcagccggttcctgcgccacctggcctacctggaactcgccccgaccaccgcgccgttgcccgagatgcagtggttcccgccgaccagggcggtggcg

SEQ ID NO: 978 - DNA, 921 bp, Streptomyces avermitilis
  CDS (1)..(921)
atgccgaccactcccccggacggacgctccgggatcgacgctgccctggtgagccgtctgatcgcggcgcagttccctcagtggagcggcctgccggtgaccccggtggacatcgacggctgggacaaccgcacctatcgcctgggcgacgacatgacggcccgtctgcccaccgccgccggctacgttccagcggtcaccaaggaacacgagtggcttcccaggctcgcaccatcgctgccggtcgccatcccgccgatcctggcgatgggcgtcccgggtgagggatatccgttcccgtggtccgtacgcggctggctccccggtgagcgagccgatcgagggcgcatcgacgacctgtcgcagttcgcggtctcggtagccgagttcgtcctcgcgctccagcgctgcgacaccaccggcggcccgctcgccggggaacacagctggtaccggggcgcgtcaccggcccattacgacgacgagacccgccgttgcctggccgccctcgagggacgtgtcgacactgaccgtgcggccaccgtctggggcgccgccctcgccgccccgtgggatgggaaccccgtgtggttccacggcgacgtcggcgcgggcaacctcctggtcgcagacgggaaactcgcggctgtcatcgacttcggcacatccggtgtcggcgatccggcctgcgacctggtgatcgcatgggggatgttctccggcgacagtcgggacgcgttccgccgtgctgtcggccaagacgagggcacctgggcacgggctcgcgggtgggctctctggaaaagcctgctgaccctggccgagtgcatcgacaccgatccggaacaggccgccgtcaaccgacgtctgatcggtcacgtgctcgaggatcaccgccgcttcgcccagccaagcgtggcg

SEQ ID NO: 979 - DNA, 453 bp, Streptomyces avermitilis
  CDS (1)..(453)
atgcggacacacacagtgaaaacgttggttacgctctgtgcggctgtatcgctcgcggcagccacgggatcgtcctccgctgccccgccgaccgcgcgggccgtgaaacagcagcccgaacgcaccgtgcttgtcgactgtttctggaaaccgaacgtacgccccaccgacttcatcctcgcctgcggtgacggcaacagccgtctgtcctcgctcaagtggtcgcactggaacctgaactcggcgacagccaagggcttcaacctggtgaacgactgcaagccgtactgcgcggcgggcaagttccactcgtacgcggtcgtcgtgcggctcgaccacccgcagccctggaagaagcgcccgcaggtccagcactacacccagatgagcctcgtctacaccgacaacaggccggacgggttcgagcgaacggtcacctaccccctgtggaac

SEQ ID NO: 980 - DNA, 444 bp, Streptomyces avermitilis
  CDS (1)..(444)
atgagtgtcgcggctctgccggcctcggcagaccaggatcgccagccccaccggcagcgggtggagatcagcaacgtccactacgacgctccgggccgcgacgaccgcagcaaccgctccctcaaccaggagtgggtggacatcaccaacaccggccgccactccgtcaacctcgacgactggaccctgagcaaccgcgacggccgcacctacaccttccaccacctgcgcctggagggccactccaccgtccgggtccacaccggcaacggccgggacacccaccgtgacgtctaccaggatcgccgccacgaggtgtggaacgaccgctccgacaccgcgacgctgcgcaacgaccacggtcgtgtcatcgacacggcgtcctgggggcgcggcagccacgagcggcggggtgggcacgaggggcacggtcacagccgccgc

SEQ ID NO: 981 - DNA, 1179 bp, Streptomyces avermitilis
  CDS (1)..(1179)
gtgccacggacccccagtccgtggcacgcctccttttcgcgtggtgcgcatacgcgtgcgcgagcgggttactcggtgtccatggctcggctaccgaaaatcggacacaaggaccacgaggcgcgtcggagcgacaccacggatgccgcccccgcccccgcctccggccgtccggagaccgcccaggagacggacgagcagttcggtccggacgaacaggtggagcaggcagcgccggaggcgccgacgaagctgcccaaacggtcgtggggtgcggtgctcaaaggcagtctgcgggagttcaaggacgatgagctgaccgaccgcgcggcggcgttgacgtactacggggtgctggcgctgtttcccgcactgctggtgctggtgtcgctgctgggcatcaccggcaagtcgaccaccgacaaggtgctgaccaacgtccagaagctcgcccccggctcggcccgggacatcatcacccgggccgtggagcaactgcagaacaacgccggcaccggctcggtcgtggccatcatcggtctggttctggcggtgtggtcggcgtccggctacgtggcggcgttcatccgcgcgtccaacgcggtctacgacattcccgagggccgtccggtgtggaagatcctgcccatccgggtgggcgtgacggtcgtcctgatggtgctggccgtgatcagcgcactgatcgtggtcttcaccggcggtctggcgcgccaggccggagatgccctcggtatcggtgacaccgcgctgaccgtgtggtcgatcgccaagtggcccgtgctggtcatcctggtcacgctcatgatcgcgatcctgtactgggccagtccgaacgcgaaggtgaagggctggcggtggatcaccccgggcagcttcctggccctggtgatctggatgatcgcctccgccgggttcgcgttctacgtcgccaacttcgcctcgtacaacaagacctacggcaccatggcaggcgtcatcgtcttcctggtctggctgtggatcaccaacctggccatcctgctgggcctggaattcgacgcggagaccgcacgtcagcgcgccatcatcggcggccacccgcccaaggccgagccgtacacccagcctcgtgacacccgcgcctgggacgagcaggaccgacgccgcatggacgacgtc

SEQ ID NO: 982 - DNA, 426 bp, Streptomyces avermitilis
  CDS (1)..(426)
atgtcacacgaacagcagtaccaggacgagtctcagctgcccgcgaccaccgcccagctgaaccacaccgccgtctacgccggcgaccgccgtctctccgcagagttcctcgccgcgattctcgggttgaaggtcggcgctccgttcgggccgttcctgcccgtcgacctcggcaacggcgtgacgctcgactactacgagaagaccggcgagccgatccagtcgcagcactacgcgttcctcgtgcccgacgcgcagttcggcggcatgatcgcccgtctggaggcggtcggggtcacctactacgccgaccccaaccacaccgaacccggccagatcaaccgtctcttcggcggtcgcggcgcgtacttcgccgacccggacggccacaacatggagatcatgacccggccctacatccggcct

SEQ ID NO: 983 - DNA, 1293 bp, Streptomyces avermitilis
  CDS (1)..(1293)
gtgaacagacacatatctttcgaacgactgcacaacttccgtgacctgggcggctatacgaccgcggacggacgcgtggtgcggtgggggcggctgttccgctccgactcactgggcaagctcacgggcgaggagtgggaacgctttctcgccctcggtatcggcacggtcatcgacctgcgctacccctgggagatcgacgccaagggacgcgtccccgagcacccggcgttcacctatcacaacctcagcatcgagcaccgtccctacgatcaagcgggcctcgggccggatgtggagaccgggccgttcctcgccgagaagtacatggaagtggcccacgacggcgtcaaggaactgcgtcaggtcgtcgaagtgatcgcggccgtcgccacctccacagacgagtccgtggtgttccactgtgcgtccggcaaggaccgcaccgggctggtggccgcactcgtcctggctctcctgggcgtccccgagtcgcagatcgtcgaggacttcaccctcaccgaactcgccaccgaacgcctgctggccgactggcgggccgaccatcccggccaggaaccgacctggcccggctacggacgtgcccccgccgatgtcatgcgcctgttcctcgacgcgctgacgcaccagcacggatcgatggccgattacgcccgcgacctgttgaggatcgacgagggcctgatcgcggccctgcgccgcaacctgctcgaaccagccgcggaacccgaattgaccttccggcgcgcggaccaccgcgacctgccggaactcgtccgtctccgcgacagcgccgcccgctggcagatcgcccgcgggatcgaccagtggaagccgggacaactcggcgaggatcacttccgggcgcggctggccgacggcgagatctggatcgccaccctcggccccaccggcccgaccgccggtgcctgggaactgtggtgggacgatcccgcggcctggggcccacagcccccgagcgccgggtatgtgcaccggctgatgaccgaccggcgcaccgcaccgccgggcaccggacgcctgatgctcgccgaggccgaacgccgcatcgccgagaccggccggaccttgtgccgtctggactgcctggccagcaacccgcggctacggcagtactacgagacagcggggtacacggtcgtcggcgagcagtcgtcgaaggacggcggcctgggcaacacctacgcggtgacgctgctggagaaaacagttccggaggcactgaccccgcggagcacgaaaccggctcgc

SEQ ID NO: 984 - DNA, 432 bp, Streptomyces avermitilis
  CDS (1)..(432)
atgaacgaatcagagctttcgccggagggcggtcggcccgtggacctgtacctcgacctgctccgcattcggatggccccagcggactacgagctgctgctccgcatggtcgaaccggcgctcaaggcggtcgaggaccagagtgcgggtccgatcgagctgagcctcgagggcgcggagggcagcactgtctcccaggagatccgggacgaggcgtccctcgttctcgcggtcgccgtcaccgggcgcctggacaaccagatcgtcgaaatcgagaccgaggaggtgggacccgtcaggatcgtgacggacgcggacaccgcggtcgatccggaccggcgcagggagatcgccgacttcatcggtgaacggcaccgtcaggacgaggagctgcggggcatcgcggaggtgagcggcctgcccaccgacgtc

SEQ ID NO: 985 - DNA, 669 bp, Streptomyces avermitilis
  CDS (1)..(669)
gtgggtgacacgccccgaaccgaccgcgcgaacaacgccgacgtcgaacgcgagttccaggtcttctacgcggcccactacgcccaactggtcgcccagggaacgatgttgagcgacagcctccaagaggccgaggacgccgcgcaggaagcctgcatggcggcgatggccaaatgggacacgatccggtccccgtaccactggaccaagaaggccatgagtcgcaaactcgtccgcgaccgtcaaatgcgcagggcccgctggtaccgacggctgctgccgcagtcaccccccgacctggagatcccggtgccgccccgctcctcggtcgatgagcggatgcgcgccctcgacgtcctggccgcgctgcggcaactgccgccgcgccagcgccaggtcatgatcctcctcgccgaatgcgaactggatcaccaggagatcgcggagctgctcggcacgactcccaacaacgtcggcgtgaacgtccatcacgcccgccgcaagcttcgactcctgctcggtcagggctccgagccggtgccgacgggcgactcactggactccgtccgacgcgacgaccccctgtacgccctcatccactccacggccgtgtggctgcgacagggaatccacgccaaacagcgcgcggaccggaaggagggaaaccgg

SEQ ID NO: 986 - DNA, 273 bp, Streptomyces avermitilis
  CDS (1)..(273)
ttgttcgcgcggtcggttcggggcgtgtcacccacggtcctcaccccggccctgatgacgagcaccggtctcctgggccgcggccgtaccggagcgtacggtcagcacggcgcctcccgagcgtcggtcgacgaggaccgcgtccgggccgcagtgcccgacgagatccacgagcatgcgggcgcgggtctcctcggccgcccgtgcggcctgcctccgcaccatgtccccggccaagcgcagcacccctcccacggcgagcagcagtaccgc

SEQ ID NO: 987 - DNA, 1872 bp, Streptomyces avermitilis
  CDS (1)..(1872)
gtgagccaccacattcgcctggccttggcggccatcctcctggtcaccttctacgctgcggtcgccctcaccatcctgatctgggtgacgctggtcatcctcatgtttgacgtagcgggctccgtctgggcgaccaccctcccggtcaccgggttcctgttctgtgcgggcacggccgtccctgtgtacgcgctgggcgacgcggcgcgccgttcgctcttcctggtggacacaccgtccaccccgtccctggaggtgggccgcggtcgggcggcggcgctgcacgcgctcgtcgatgacctcgccgagcggctagggatctccgagccggtgcgcatccgtctccacacggccgtgggggccgaggcggtggacgaggacacccggttcctgggactgtcggccgggaaccacgtcctgtccgtcggccttcccctgctggccgcccttccgcaccgtcagatccgcgccgtcatggctcatgagctcgcccatctgtcgctgcgtcaccatcgcgtccgcgccttcactctccgtctggaaaccagcctgaccgtcgcccgcgagtccctgatctcgttcggaacggcaaacggcctcgtcggcatgtacgtcggcctcccgcaggcgatgatcggcctctacatccggctgttccggtggcttgtccagcccgtacgcaggcggcaggagctggaggccgaccatacggctgcccggctctgcggcgcgcccacgctcgcggaggccctggccaaccgggccgtggtggagccgctgtggatcgagttccaccgcatgtatctggacgcggctccggacggcgtcctgcctgccgaccccttccgggcattcgcccgcacgatggcggaccccggagtccaggacaggctccccgccctgcgcgcgcggatggtcgaggcgcccgccgcacagaacgaattcggcccgtcgcaccctcatttggcgtatcgcctgcgccgtctcacgaagggacacgagcccgctgccgccatcgcgtgccggcccgacgccgcccttctgcccgatctgctccccggccagatcgccggcctgctggcacgttacgtcggcgcgagcacgcttccgtggcaggactggatcgaccggtgggtggatgccaggaacgcggtcctggtcgagcccctgtgtgcggccgtccgtacgctcgtcggcccggaacatcagccggtcgcgctccaccaggtgctgcacctgctggaggcgggacagcgcatgcccctggcccgggctctcgccgggagggtgccggaggctcaccgggagcctgacgatccgctggccctgctgtcggcggcgctgctcgcgctggtcaagagccggctcacggaacggccaggtcctgggtcgcccctgcctcaactggtgagggacgccgtgttgcagccgagccacgtctcgcggctctctctccatctggcggggtgcggtgtcgacgagaccgcacccgcgcaggacaccccagaaacggggcagcatccctcggacgagccggaacaagccggttactcgacggccaaggtgtccggcggcatcccggaagcgggccgcagggtcatttcctcggtccgcgcggtcaccctcaccgtgctgatcgtcgtggtggccgtgggaggtctgcgctggaccacgcgcgacaagcccgcattcgtacctcccacccgcgtcaccccgacctactcaccggtctacccgatcagccctcccctgccgtcgcagccgtacgctccgctgccctcggcatccgcctaccccttcaaccccgaggatcggttccgcctcccctctcccgtcctgacgccgcccgacttctacctgagtgccactccg

SEQ ID NO: 988 - DNA, 1098 bp, Streptomyces avermitilis
  CDS (1)..(1098)
atgagcctgtacacggtgggcgtggaggaggagtacctgctgctggaccccgccacgaggcttccgatgccggctgccgagcaggtacgagccgctgccggcctggagccgatcgcgggggaggacgagatacagcccgagctgtccgaggcgcaggtcgaggtcgccactccggtgtgcaccagcctggacgagataggcggccacctggtgcggctgaggcacgtcctggggcgtgcggccgagagcaacggatgccggctcgcggcctgtggtacgccgccgatcaaggaagaatcgccgccgccgctgaccaacaacccgcgctaccgggccatgcgcgcgcaggctccgcaactggtcgcggagcagctggtctgcggcacacacgtccacgtcggtgtgcccgatccggagatcggggtggccgtcctgaaccggatccggttgtggctgcccgtactggtggccatgtcggcgaactcgcccttctgggcggggcacgacaccggcttcgccagctggcgcacggtgatcttcggacgctggccggtaagtggaccaccgccgcacttcgccgatctggccgatcacgagaagcgggtgcagcaactgctgacctgcggggtgatcttcgaccccggccagctctactggcaggcgcgcctctccagccgctatccgaccgtcgaagtgcgctgtctggatgtccagctgagggctgacgacgcggtgatgttcgcggggatcgtccgtgcgctcgtcgccaccgcgatcaatgacgcgaaagccggtgtgccggtgccgtcttgcccgcccgaactgctccagggcgccaactggcacgcggcccggcacggactgagcggctcgctgatcgactacgagggccgccgccgcagtgccggcgacgtgctgtcccagctgatggaccacatcggccccgccctggacgctgccgacgacagccgggaggtggcgtcactggtgcaccgtctgctgcgcgaaggaacccccgcggaccggcaacgccgcgcgctgctgcggggaggcctgcgcgctgtcaccgacttgatcatcaccgagagtgcggtgacc

SEQ ID NO: 989 - DNA, 1368 bp, Streptomyces avermitilis
  CDS (1)..(1368)
atggttcacagacacgtcggagcaggctgtgccggcctgagtgtgctcgccacactcgtactgaccgggctgcccgcggcagcggccatcgagccgcccggcccggcgcccgcgccctcggccgttcagccgctcggtgccggcaacccgtcaaccgcggtactcggcgcacttcagcgcgatctgcacctgacggacacgcaggccaagacgcgcctggtgaacgagatggaggcgggtacgcgggccggccgtctccagaatgcgctgggcaagcacttcgccggcgcctgggtgcacggcgccgcttccgccgatctcaccgtcgcgaccacccatgccacggacatccccgccatcaccgccggtggcgcgacggccgtggtcgtgaagaccgggctggacgacctcaagggcgccaagaagaagttggacagtgctgtggcccacggcggcacggccgtcaacacgccggtccggtacgtcgacgtgcgcaccaaccgggtgacgctccaggcgagaagccgcgccgccgcggacgcgctcatcgcagccgccggcgtggactccgggctggtggacgtcaaggtgtccgaggaccggccgcgcgccctgttcgacatccggggcggcgacgcctactacatcgacaacaccgctcgctgctccgtcgggttctccgtcaccaagggcaaccagcagggcttcgccaccgcagggcactgcgggcgggcgggcgccccgaccgccggcttcaacgaggtggctcaaggcaccgtccaggcctccgtcttccccggtcacgacatggcgtgggtgggcgtcaacagtgactggaccgcgactcccgacgtcgcgggggcggccggccagaacgtctcgatcgccggctcggtgcaggccatcgtgggggccgcgatctgtcggtcgggttccaccaccggctggcactgcggaacggtcgaggagcacgacaccagcgtcacctacgaggagggcaccgtcgacggcctgacccgcacgacggtgtgcgccgagccgggcgactccggtggctccttcgtctcgggctcccaggcccagggcgtcacgtcgggcggctccggggactgcacacgtggcgggacgacctattaccagccggtcaacccgatcctcagcacgtacgggctcaccctcaagacgagcacggctccgaccgacacgcccagcgatccggtcgaccagagcggcgtctgggcggcgggccgggtctacgaggtcggagcgcaggtgacgtacgccggtgtcacgtaccagtgcctgcagtcgcatcaggcgcagggcgtgtggcagcccgccgccacaccggccctgtggcagcgtctc

SEQ ID NO: 990 - DNA, 1632 bp, Streptomyces avermitilis
  CDS (1)..(1632)
gtgccggacgcggtagtgatcggggccggccccaacggactcgtcgcggcgaacctgctggccgacgccggctggagcgtcacagtgctcgaggaacaggacgagcccggcggcgcggtccgccatgacaacggcgtcgacccggacttcaccaccgacctcttcagctcgttctatcccctcgccgccgcctcgcccgtactcgccgggctgcacctggaacgcgagggcttgcgctggagccatgcgccacgggtgctggctcaccccctgtccgacggccggtgcgccgtgctcgggcgcgacctcgacgacaccgccgcttccctcgacaccttcgccgacggtgacggtgccgcgtggcgcgagctgcacgacgtgtgggagcggctgcgccccgacctgctggacgccctgttcacgccgttccctccggtccgcgccggagctcgcctggccgcgcgcctccgggccggcggcgggctgcgtctggcgcgctcactggtcctgccggtgcgacgcctgggcgaggaggagttccgtggcgagggcggcaggctcctgctcgcgggcaacgccctgcacgccgacctcgcgcccgaggccgcgggaagcggcggattcggctggctgatgtccatgctgggccagacctacggtttcccggtacccgtcggtggctccggcgccctcacctcggcgctgacccagcggctgcaccggcgcggtggcgttctgcggtgcgggcagcgggtcagcgaagtggtggtccggcagggcagggcggtggccgtacgcacggccggaggcgagacggtccccgcacgccgggccgtactcgcggacgtgtccgtgcccgccctgtacggcacattggtgggcagcgcccaccttcccgcccaggtcctggccgatctgcgacggttccagtgggacttcgccaccttcaaggtcgactgggccctcgacggccccgtgccgtggcaggccgacgccgcatcggccgcgggcaccgtccacctcgcggacggcgtcgacgaactgacccggttcgccgcgcagatcgccatgcgccaggtgccggaccggccgttcgcgctgttcgggcagatgacgacggcggatgccacccggtcacccgaaggcaccgaagccgcctgggcgtacacccatgtcccgcaccggatcgcgggcgacgccggcgacgcaggactggcgggaacgtgggacgcgcgggaacaggagctcatggccgaccgcgtcgagcgacaggtcgagcggttcgcacctggtttccggtccctgatccgcgcgcggcggatcctggccccgcccacgctccagtccctgaacgccaatctgtacggaggtgccatcaacggtggcaccacggccctgcatcagcagctcgtcttccggcccattccgggaacggggcgcccggagacgccggtggccaacctgttcctggcgtcggcgggagcccacccgggaggcggcgtgcacggagccccgggcgccaacgcggcccgggccgccctgcgcaagcacctgccgagcggcctgacccgcgcccagcgtcttttgacccgccgtaaccgcaagggagaacgcgacaccggcttcggcggc

SEQ ID NO: 991 - DNA, 474 bp, Streptomyces avermitilis
  CDS (1)..(474)
gtggccgtacgccatcgagtcatcaagagaagtccccgcgatgtctgggccgtgctggcagacggcacccgctacggcgactgggtcgtcgggacgtccgcctcgtaccccgtgcgcggggagtggccgcaggtgcattccgcgatctgctacgaggtacggatcggctttctcaccctcaccaacgaaacggtcgtacgcgcatgtgtcgacggacgtgaactggaactggaagcgcaggccggcccgctcggttcggcccggatcgccatcgaggtgcggccctggggcgaacactcgctcgtgatcatcgatgagcaccccctgaagggggtcggcggcaccctgcacaacgtgggagtggaagcgttgatccagctccggcaccgttccatgctcggtcgcctggcagaggtgtgcgagaaggagcaccaaggtaccgagcaggcccggggcgcgtccccgctcaggtca

SEQ ID NO: 992 - DNA, 876 bp, Streptomyces avermitilis
  CDS (1)..(876)
gtgaaggacggcccgctgcacggccgcaccgtggtggtgaccggagccgcacgaggagtgggcgccgccctggcccgtcacctctcccgacgcggcgcccggctggcactggtgggccatgagaaggacgcgctcgacgcgctggtggccgaggtgtgcacccgggcgatcgcgtgggaggccgacgtcaccgacgacgccgccctggacggcgtcgcccgtgaagtgcgtgggcgcctcggcataccgtcggtcgtgatcgccaacgcgggtgtcgccgagggcggtccgttcgctgattcggacgccgcctcgtggcggcgggtgatcgacgtcaatctgaccggcagcgcgatcaccgctcgcgccttcctcccggatctgctgaccacggcgggctacttccttcagatcgcctcgttggcgtcgatcggcgccgcaccgatgatgagcgcgtactgcgcctccaaggcaggcgtggaggccttcgcccactcgctgcgggccgaactggcgtaccagcgcgtcgccgtgggcatcgcctacatcaactggaccgacaccgacatgatccgtgacgccgaccagcaagccgtgctgcgtgagttgcgtgcgcatatgccgccgcccgcccgccgtgtctatccggtggacaccgttgccacgcggttggtacgggcgatcgagcggcgccgcacctcggtgtacgtacccgcttggctcagggccgctcaggtggcccgcgccgcgctgccgcccctggtgatgcgcctgtctcgccacgccctgccccggctggccgcgcgtgaggtgttacgtcccactggactgctcggtgccggtgggcaggccgaccgcacatcgggcgccggaccg

SEQ ID NO: 993 - DNA, 348 bp, Streptomyces avermitilis
  CDS (1)..(348)
atgctttcgcactccatcgagcacggcgtcctggtgatcaccctgcacaccgatcccggaatcggccgacgagccgcgctctcccatgagatcaccgatctggtgcacgcctacagcccgctcccggtggtcatcgtgctcgacatgccggaggtgggaagcgccaccgtcagtgccatcctccgggcgcagcgcatgtgccatcacctgggcgtcctgatgtccgtctccacccacagcgccgctacccggcggatcctggaggccaactgcgacacgggcgggacccgcctcgtggtccacgcccgcaccgacgtcgccatcgcggcggcgttcacggcggcggcg

SEQ ID NO: 994 - DNA, 417 bp, Streptomyces avermitilis
  CDS (1)..(417)
atggctcagctggttcgcgagatcatgacgagcgacatcaccatggtggaaccgcagacgtcggtggtagaggtcgcccgcctgatgcgcgagcaggacatcggagccgttgtcgtcgccgagaacggccgactgcgcgggctggtcacggaccgggacctggtggtccgagccctggccgacggcggcagcgtggacgatcgcaccgtgtacagcgcgtgcagtgccgagttggtcagtgtcgctccggacgacgacgtggaccgggccgtgtacctgatgggcgcgcgagcggtgcgacggatgctggtggtggaggacggtcggctggtgggcatcgtctccctgggagacgtggccgtcgcacggcatgcggactcggccctgggcgacatcagtgccgccgacccgaaccac

SEQ ID NO: 995 - DNA, 279 bp, Streptomyces avermitilis
  CDS (1)..(279)
atggtgggaattctcgcctggattctgattggtttgctggccggcgccattgccaagctgctcctcccgggcaaggacccgggcggcatcatcgtgaccatgctgatcggcatcgccggtggtctgctgggtggctggctgggcaaggtcatcttcaaggtcgactcgatcgacggcttcttcgacctgtcgacgtggatcgccgccatcgtcggctcgctcatcctgctcctgctctaccgggccgtcacgggcaaccggcgctcgcacaggcacgcg

SEQ ID NO: 996 - DNA, 525 bp, Streptomyces avermitilis
  CDS (1)..(525)
atgcgatccacacagatgagacgcctcggtctcgccgccgtattcgccctcgtcctcgccctgttcgggctggcgccctcggcgagcgcggccgacccgggcccggccgacctgacgttcgccacggacagcgccaccacccagccgggcggcacggtgaaactgtcgatgacaatcaccaacaacaagacctacgacatctggttcatctaccagacgatcgagccgacctggctgaccacccagcggcccgacctgaagtacagcttcaccggctgcagcctggccacggccgccggcagcaccccctgttccggcaccggccccgccaacctgggcaccaactacggcgccaccatcccgcccggccagagccgcaccgtgacgctcacgctgcaggtcgccgccgactccggctgcaacggcaacatcggcttctactcgtactactacgccgagttcagcgacagcacgaacaccagcggcggtccggcctacacgcccgagacccgcgtgctctgctcc

SEQ ID NO: 997 - DNA, 2133 bp, Streptomyces avermitilis
  CDS (1)..(2133)
atgaagcggaccattcgcacgaccgcgctcacagtgggcgcgctcatagcctcgctcggcttacctgccggtgcggcacacgccgacgccaccacgccccgcatcgatctgcgggtcctggtcgtgagcgacggcggtccgtccacggacgccatcacagccgagctggacgcggccggcaccccgtacaccgaagtcgacctggagcagtccgggcggcccgtgatcgacgccggtttcctggcggacacggttgacggcaggccgcgcgccaagttccaggccgtcgtcctgcccaacgacaacccgttcccggcgaactcggccgagatggcggcgctggcgtcctacgagcagacgtacgccatcccgcaggtcgacgcctacacctacgcgcgtccggaagccgggctccagtaccccgtccacggcggctactccgggaccgtcgacggtgtgcaggcgcaggtcacggcggccggcaaggcggggccgttcggttatctcgacgcggccgtgccgttcgaggacaactccccgaccgtgggcgagagttacgcctacctctcgacccctgccgccggagcggacttcaccccgtacgtcgacgcgcccattcccggaaagtccacccggggttcgctcgtgggcgagtaccggcacgacgggcggcgcgaactcgtcgtcacgttcgtctacaaccagtaccagcagcagttccggctgctggcgcgcggcatcgtggagtggatgaccgggggcgtacacctcggcgcctcccgcaactacttcgccgtccacgtcgacgacgtcttcgccgccgacgaccgctgggacaccgagctcaactgcacgcccggcgacatcgactgcgcgcagggcgaaggcgtccccaacccgatccgcatgaccccgtcggacgtcgactacgccaccgcgtgggagagcagacgcaacttcaccctcgacctggccttcaacggcgtcggcagcgtggaacagcgcgaggagaacaacggcgtcgaccagctcgccgacaagctgatcgcggaccgcgaccgcttccgctggctcaaccacacctacacgcacgccttcctcggctgccggcaggacaccagcgtggtgccgtggaagtgcgccaccaacaccgacggcagcaccgagtgggtcagccgcgccgaggtctccgccgagatcgccaacaaccgcctctgggcccagtcggccggactgcccctggacaacgacgagttggtgaccggtgaacactccgggctgaaactgtctccccagcagcccgaggacaatcccaatctggcactcgccctcgccgacaacggcgtcgagtggctcggctcggacaactcccgcgaacccgaccagcgtcaggtcggtccggccaccaccgtctcccgctatccgatgaacgtcttctacaacgccgggcgggcggccgagcaggtcgacgagtacaactggatctacaccagccgcgcccagggcggcagcggcatctgcgaggaccactccgacacctccacctgcctgacggccccgctggccaccaccacgggctacgccgactacatcgtgccgctggagaccaggatcgacctcgggcacgtgctcgccaacgaccccaagccgcacttcatccaccagtcgaacctggccgaggaccgcatcgcctacccggtcctcgacggcgtcctcgacgggtacaacgacctgttcgcggacaacacccccgtggtgaacctgcggatgaaggacatcggaaccgagttgcaaagacgcgccgcctggaaggcggcgatccaggccggccaggtcaccgcctaccgcatcggcgacacggtgaccgtcgaggcgccggacggggtggcggcgaccgcgaccatgcccaccggcacgaccaacggcagcgccggcttcggcgacgcgtacgcgggcgaggtgtcgggctggaccacgtccgccggccggccgctcaccttcaccctgccgtcgtccgtcccctcactgtccgccaccgtcgccggccaggacaaggcgccggcgacgcgcaccacgccgcacacccgcgtcccggccggcgtgaccgagcaggtgccgtacaccccggagcac

SEQ ID NO: 998 - DNA, 1539 bp, Streptomyces avermitilis
  CDS (1)..(1539)
atgcacgttcaccacggcgcgcgacgccccggcgctacgcgcgtcaccctgctcaccgaaggaacgtatccgcacagtcacggcggcgtgagcgtctggtgcgaccaactcgtcggcggcatgcccgatatcgacttcgacgtcatcgccgtcaccggcaccggacgcgaaccgatcgtgtgggacattcccggacatgtctctcgggtcgcggcggtccccatgtgggggcccgcgcccgaaggccgcgcgccccgtgggcgccgccggaaccggctcgccagcgcctacgagcagttcctcaccgccctgctcgacccgtgtgcggaggacaggttcggcaccgccctctacgtgatggcgcgggccgcggcggacgggatgctgagtccgttcctgcgcggcgaccgggcgatcagcatcctcaccgccgtgtggaaccgacctgggctggccgtgcgcgaggcccggccgaccctgcacgacgccatcaccgccaccgccctgctggaacacgccctgcgcccgctggccacgccgctgccgcgggacggggtggcgcacgcggtcagcggcggtgtcgccgcgctgccgggactggccgcgctcgaacggcacggcgtcccgctgctggtgaccgagcacggcgtgtatctgcgcgagcgctacctcggctaccgcaccgccccctaccgctggcccgtgaaggccgtcgtcctgggcttcttccggctgctggccgaagagacctacctgcgggcggcactgatcacaccgggcaaccgctacaaccggctgtgggaggaacagggcggcgcggaccccgagtcgatccgcaccgtctacaacggcgtggaccccgccgcgttcccgccggccggccccgagccggacgcacccaccctcagctgggccggccgggtcgaccccatcaaggacctggagaccctgatccgcgccttcgccctcgtacggtcccaactacccgaggcgcggctgcggttgttcggcggcacaccgcgcggcggcgaggcctaccgggagcggtgcgaggcgttggccgccgaactcggtcatgcggaagcggtcacgttcgagggccgcgtcgacgacatcaaggacgcctacgccgccggcaacgtcgtgatgctctccagcatcagcgagggtttccccttcaccctgatcgaggccatgtcctgcgggcgggctaccgtctccacggacgtgggcggcgtacgggaggccgtgggcgacaccggtctcgtcgttccgccgcgcgatccggccgccatggccgccgccgcgctgaagctgctgggtgatcccgagcggcgccggtcgatgggcgaggcggcacggctgcgggtgatcgagcagttcacgctgcggcagaccgtcgacaccttccgctccatctacctggagctgtcggcgcccggccggacgacacggcgcgacccatggacgcccgacgccgacgccggtctctcgacgacggccggccccgcggccgcgagaatggggagcctggccgga

SEQ ID NO: 999 - DNA, 1404 bp, Streptomyces avermitilis
  CDS (1)..(1404)
atgagcggaccgatggcactcgaacccggcggcacggaacaggacacgctggccctcagactcgccgaggaccgccccctcgccccgcgaccgccggacgaccacaccgtcgccctgcgcctgccgggccgcggcaccgactccgacgcggtcgaccggctcgccgccgaactggccgaccgcatagggcccgccgtccactcctacgaggtggccgcgctgctggagtcggagggactgacggcggagacgatccaggagcggtacgggcacgcgaacctgttcgcgctcgcctccacgctgtacgcgcgcgtaccgcgtacctaccccgagcccccgcggccggccgacccatggcgcccggaccatgtgcgatgcgcactgcggggagcgctgttcgcgctgccgggactcgcctatctgctcaccgggcggctgtggcacgccgaacgcgacacgtccgtgctgatcgtggccgggctcgtctcctgggcctggggccaggcgctgggacaccgggcctatctgcgcatgaccacgggacggcgggaagcgggccgcacgctcctcaaaggcgcacccctgggtgccgcggcggccacgctggccggggcggtgttcgccggggccggcacggtggccctgatcgcggccgcgcagtcggtgtacctctcggcggccggcgtgctgctggtgctgggccgcgagcggctgctgctggccgcgctcacaccggtgatcgccggtgcggtggtgctgccctggtgggaaccgggccccgtactgcgggccgggctgccgctgctagcgctcctcgccgcgaccgccgcggccggctggtcgctgcgggtcaccctcgcggcctcccccgccccgggcgccacccggcccgggctgctgcggtcgctgccgtacggcctgttcggcctcgccgcgggggtgctggtgctgctggagggccgccggcacccgtacgccgtgatcgtgctgaccctgagcatggggccggccgagtggctgctgtaccgctaccgcgggatgtcggtggccgcactacgggcgaccgcgacaccggccgccttcctgctgcgttcggccggcgtcctcggcttctgcctgctcgcctatctccttccgctgctcccggcggcgctgctcaccggtgccgagccggcccccttgctgctgctcgcggcgaccctgtggaccgcgctgctgctccaggccttcggcgtggcctggccgccggccggggtgtgcctcgcggccgccggcggggccggggcgatcaccttgttccatctcccaccgggcgctgccgcgctgtcgctgtgctgcggcgcggccgccctgtgtctcacggcgtgcgcgctgcggctgctcgggcggcccgccgcgcacgcc

SEQ ID NO: 1000 - DNA, 792 bp, Streptomyces avermitilis
  CDS (1)..(792)
ttgacccccgcaccgctcgccgccgtcaccggagccgagggtttcatcggctcgcacctcaccgaggcgctggtcgcctccgggcaccgggtgagggccatggcgcaatacaactccttctcctcctacggctggctggagaccctgcccgcggacgtcctcgaccacgtcgagatcgtcctcggcgacgtccgcgaccccggctcggtccgcgggctcgtcgaaggcgccgactgcgtctaccacttggccgccctcatcgcgatcccgtactcctaccaggcgccgcacagctacgtggacaccaacgtcaccggcacgctcaacgtgctggaggccgtacgggccctcggcacaccccgcctcgtgcacacctccaccagcgagacctacggcaccgcgcagaccgtgccgatcaccgaggaccaccccatcaacacccagtccccgtacgccgcgtccaaggcgggcggggaccggctcgccgacagctatcacgcgagcttcgacaccccggtggtgacgctgcgcccgttcaacaccttcggcccgcgccagtcgatgcgggcggtgatccccagcgtcatcggccaggtggcggccggcgcgcgcaccctcaccctcggcgacctgcgccccacccgcgacttcacctatgtcaaggacaccgcgcaggccttcctcgcggtgggcaccgcgcccgccgcgcaggtggtgggccggaccttcaacgccggcaccggcggcgagatctcggtcggtgacctggtcgggggcttgatcgggcaaggg

SEQ ID NO: 1001 - DNA, 216 bp, Streptomyces avermitilis
  CDS (1)..(216)
gtgaatggacgcctccctcgacgtggcgcggaggacgcgcagcgcatccggcccgccaactccgaggtgatgcggctggtcgccgacgcgagccgcctgaacgcggcgaccggctggagcccggcccacgacctggagcagggtctcgcgcacaccgtggagttcttccgcgacccggccaacctcgcccgctacaagaccggcatctacaacatc

SEQ ID NO: 1002 - DNA, 711 bp, Streptomyces avermitilis
  CDS (1)..(711)
atgcacgcagtgatactggcgggaggcaagggcgtccggctgcggccctacaccaccgcgctgcccaagccgctcgtgcccatcggcgaccagcacgccatcctggagatcgtgctgcgccaactcgccgcggccggcttcaccggctgcaccatcgccatcggtcacctgggcgagatcatccgcgcctacgtcggtgacggctcccagtggggcatggccgtcgactacgccaccgaggagagtcccctgggcaccatgggcccgctgctcaccatgcgcgagcgtctgcccgagtcgttcctggtgatgaacggcgacatcctcaccgacctcgactacgccgacgtcctccggcagcaccgggactcgggcgcaccgctgacgatcgccacgtacgcccgcaaggtacacatcgacttcggggtcctgaccacccaggccggccgggtcgtcgggttcaccgagaagccgagcatggactaccgcgtctccatgggcgtgtacgggctgtcccggaagacgctcgacggctacacccccgggctgccgctcggcttcgacgagctggtgctggatctgctcaagacgccgaacctgccgcacgcgtacgacttcgacgggtactggctcgacatcggccggcccgacgactacgaccgggccaacgccgagttcaccactcgcaagtcgctgttgctcaagggagcc

SEQ ID NO: 1003 - DNA, 924 bp, Streptomyces avermitilis
  CDS (1)..(924)
atgcgcattctcgtcctgggcttcaccggctatctgggccgtcacgtcgtcgagcggctgcgcgccctgccgggcacacgggtgctcggcggcggccgctcggcgggcgcggagttcggcatcgacctcgccaccgctcgcccggacacgctggcgaaggccctggcgtcggccgcgcccgacgccgtgatcaactgcgcgggcgcgaccggcggggacgccgtgaccctcgccgaagtcaactcccgtggccccgccgtcctgtgcgcggcgctgcgggaggcggcgccctccgcgcgcctcgtccatctgggctcggccgccgagtacggccccggcacccgaggcatcagggtgaccgagtcggcggccacccgtccccttaccccgtacggcgccaccaagctcgccggcacgatcacgatcaccacctccggcctcgacgcggtggtactgcgggtgggcaaccccgtggggcccggtgccccgctcaccgggctgcccggccgggtcgccggactgctgctcgcgtcaggcggtgacccggacgcggtgatccggctgggtgacctgtcggcccaccgcgacttcgtggacgtacgcgacgtggcgcgggccgcggtgctcgcggcgacggcaccggcgccgctgccgcgcgtcctcaacatcggcagcgggagcgccgtgccggtgcgcgacctggtcgcggcgctgacacacgtcgcgggattcccggggagggtggaggagaagggcggcggatccgcacgttcggcagaggtctcctggcagtgttccgacatcggcgccgccggtgacaccctcggctggcggccgtcgtacaccctcgacgcctccctggccgcgctgtgggcggcggtcagggaggggccgtcgccccggctggacgggggccgcgcgccg

SEQ ID NO: 1004 - DNA, 660 bp, Streptomyces avermitilis
  CDS (1)..(660)
gtgagcctcctgatcccgctgtacgtccacccggccgaggacccgggcgcgtggcaccgcctgatcacggcggccgaccgtacgtacgccgtcgtgctcaacccggcgaacggaccgggcacgagccccgacccggccttcgccgcggcggccggcgcgctgcgggccgcgggcgcccgcctgctcggttacgtcgacaccaactatggcgcgcgtacggcggccgaggtcgcggacgatgtcgtgcggcaccgggagtggtacgcggccgacggctgtttcctcgaccgggtgacctccgcaccggccgaacttcccctctgcaaaaggctggtgcagaccgtacggcggctcggcgcctcgccggtcgtgctgaatccgggcgtccatccggcgccgggatacgcccgcctcgccgatctggtggtcaccttcgaaggccactggtccacctacgtgtcggcgttcagcagaccggcatggaccctgcggcacccgccggagcggttctgccacctcgtctatggcgtgcccgaggccctcgtacccctcgccgtgcgcaccgcacgcgagcgcggcgcggccgtgtgcggaccggtcacgggcgaaatccccaacccctggacgcgactgacacccgccctgggcgagacggagcaa

SEQ ID NO: 1005 - DNA, 456 bp, Streptomyces avermitilis
  CDS (1)..(456)
atgaacagcgatcacgacggcccggaccgtgaccaccagcgtcccgcgggtgtcagcgacgagacagtggaagccctaggcgcactgtccaaggcgctggagacgaccgagcgggcccgcggccacctgtactccttccatcagctgaccggcggtgcggatctggaactcggtcacgcggtcgaactgctgcgcagagccggccaccaccggtcggccgaccgggtcgagaaggagatcctgggccgcaacgtcatcccggggcactggacgttccagatcatcgagtcctacaacgacacctactacgagccgttcaaggctctcgaacgcagcgtgctgaacgagctggccgaaggccgcgaccacctgtacgaggcggagatgaaggaagcccgccgcacgcacggccaccgcgaccacaccgcccgccccgacagccctggaacccccacc

SEQ ID NO: 1006 - DNA, 360 bp, Streptomyces avermitilis
  CDS (1)..(360)
gtgccccatccggcagaacggtcccgccacgggcggggctggttcgaaaagctggccgaggcggcctccaatctcaccagttctccggtcttctactgtttctgtctgctcctggtgttcgcgttcatcgtggcgcacgcagtcggtctcgagctgacgtggcagctgctgatcggggacatcatgaccgccgtcaacctgctgctgctggccctgctgaagaactccgagcgacgcgccgagcatgccatccagcacaaactcgacagcatcgccgccgcgctgctcgaacagcgcgagggccacagtcgccaggcgcacgaagagctccgtaaagcgatcggcatcgaggacgaattc

SEQ ID NO: 1007 - DNA, 546 bp, Streptomyces avermitilis
  CDS (1)..(546)
gtgagtttgatcgagcgcagacagcggtcgtccgacgaggcgcgcacttctcaggaggggcgtgcgagcgactccggtacacgtgcggacgagggcgaatccgagcaggagcgggtcaaccggcggtggcaggagatccttcaggaaacccgtgtcgcgcagaccggggtgcagatcctgttcggcttcctgctcagtgtcgccttcaccccgctgttccgggagctgggaacgttcgaccggggcgtctatgtcgcggccgtcctcctcggggccgctgcgaccggcgcgctcatagcgcccgtgtcgatccaccgtttcctctccggccagcggatgaaggatgaactcgtcgcggccgccgggcgcttgatgatgggcggcatcgtactgctcgcgctcaccatcggatgcaccgtcctgctcatcctgcacgcggtcctgcccagttcactcgccgagatcctggccggtgccgtgatgctgtggttcgcgttctgctggtatctgctgccctggatactgcggtcgcgcgccgacaagggg

SEQ ID NO: 1008 - DNA, 1500 bp, Streptomyces avermitilis
  CDS (1)..(1500)
atgctgccccctcgtcccggggcgacgcggttcaacggagcacgaccccccacgaccgccgtcgtgggcggcggcatcgccggactggcggccgcgaccgcgttggccgaacggggagtacgcgtcaccctctacgaacgacagccggacctcggcggccgcctctccggccggccggtcggccttcgggacggctccacggtgacgatgagccgcggtttccatgccttcttccgccagtactacaacctgcgcgggctgctgcgccggaccgatccgcggctggagcgcctgacggctctgcccgactatccgctccggcacagtgccgggctgcacgacagcttccgccgggtcccgcgtaccccgccgtggagcgcgctcggattcgtcgcgctcagccccacgttcggccttcgggacctgatccgcatgaacccggtggcggcgctgcccctgctcgacgtcagcgtccccgatgtgtacacgcgtctggacgccgtcagcgcccacgacttcctgcggtcgatccgtttccccgaggccgcgcaccatctggcgttcgaggtgttctcccgcagcttcttcgcggaccccagggagctgtccgcggccgagatggcgctgatgttccacatctacttcctgggttcctccgaaggactgctcttcgacgtgccggacgaaccgttcccgaccgccctgtgggaccccctcgccggctatctgctgcggcaccgcgtcgaggtgcgcacctcgacgtcggtcgagagcgtcgcccccacgagggacggcgggttcgccgtcgccacgccggaggagacggggcgtcatgacacggtcgtgctggccctggacgcggggggcctgcggtccctggccggccgctccccgaccctggccgacgccccgtggcgcgagcggatggcgcggctgcgcaacgctccgccgttcctggtgtcgcgcctgtggctcgaccggcccgtcgcccgggaccggcccggtttcctgggcaccagcggatacgggaccctggacaacgtcagtgtgctggagcgctgggagggcgaggccgcccgctggtcggctcgtaccggcggatccgtggtggagctccacgcgtacgcgctgccggaggacgcggtccgcgaggtggagcagaagcgcatgctcgaacagctgtgccgggtgtacccggagacgcgggcggcgacggtcgtcgacgagcggcacgaatggcgggccgactgcccgctgttccccgtcggcggataccacgaccgaccgaccgtacgcacccctgaaccgggactggtggtggccggtgacctggtgcgcaccggcctgcccgtagcgctgatggaacgcgccgcgaccagcggtttcctcgccgcgaacgccctgttggagcgttggggcgtgcgcggtcagacgctgtggacggtaccggacggagggcgtagcgctgtgctgcgacgggtggcgcggtgggggagcgca

SEQ ID NO: 1009 - DNA, 729 bp, Streptomyces avermitilis
  CDS (1)..(729)
atgaccctgcttcgcgacgcggatctggccgccgcgttcgaccgcgccgcccgcagctacgacactctggtggcggccaatcccggctaccacgcccaccttcggcgctccgcccgacgcctcggtctgccgcacggcgggagcggaacgcgcgtgctcgatctcggctgcggtacgggtgcctcgaccgccgcactcgccgcggtcctgccgggcgccgagatcaccgcggtggacgcctccgccggcatgctggaacgggcggccgccaagccctggccggaccgcgtgacctttgtgcacgccccggcggaacgcctgaccgaggcgggggtcgagggaccgttcgacgcggtgttcgccgcctacctcttccgcaacgcggccgcccccgacagcgtcctcaccgcggtgcacgacgtgctggcaccgcagggacggctggcggtccacgactacacgctcagcggtcgcgccagggaccgaacggtgtggacggtcgtatgcggaggcatcgtgctgcccgtggccacggccctcggcgacggacggctgtaccgccacctgtggcgcagcgtcgtcgagttcgacacggcggacgagttcgccggccgcgtccgggcggccgggttcgactgcgtacgggtgctgccgctgccggggtggcagacgggcatcacccacaccgtcgtcggcaggcgcgcgggcaccgacacggcaaccggccga

SEQ ID NO: 1010 - DNA, 1191 bp, Streptomyces avermitilis
  CDS (1)..(1191)
gtgctggaggcggacgtcgcgatcgtgggcgcgggagccgcgggactgtccctggcccaccgcctggcatgccctgtccgcggggcgccccgcatctcggtggtcctgctggaggccccgccgggccccctgaggccgccgaggcgcacgtggtgcttctgggagcggggccccggccggtacgacgccgctgtcaccgcgtcatggcagcgcctgcgggtccgcgcccccggcgggcggccgatcgagggcgacatcacgccgctgcggtacaagatgatccggtcggacgacttcgaggctctgatggcgcacgacctcgcgctgagcgggggcgtccagcgcgtcgaggcgacggtcgaagcggtggagggcgtgcccgggggtgccgaggtgtatgcgtacaccgccgccgggcgcccgctgccggtgcgtgcccgctgggtcttcgactcgcgcccgctcggcagcctcccggcggcccgcaccacgctgttgcagcatttccacggctggttcgtccgctccgatctgccggtcttcgaccccggcaccgtggagctcatggacttccgcacaccccagcccccgcgaggactgtcgttcggatacgtgctgcccaccggccgccggcaggcgctggtggagtacacggagttctcgcccgccgtcctgccgcggtccgcctacgaggcggccctgcggcactacacgcgagacatcctccacctgccgggcctggagatcgtctcgaccgagacgggcgtgattcccatgaccgacgcgccgttcgcccggcagaccgcggcgtcggtcttccggatcggcgccgcgggaggtgcgacacgcccgtcgacgggatacaccttcgccgccgtgcagcgccagacgcgcgccgtcgcggccgccctgtgccgcggccgccgcccgctgccgccgccggcccattccgcccgctcccgcgccatggacgccgtgctgctgcgcgccctggacagcggccggatcggcggtgcggccttcttcgcgcggctcttctcacgggtgcccatggagcggctgctgcgcttcctcgacggctgcacgcacctccacgaggacctctccatcggggtgcacacccccgtactcccgatgctccgctccgccgcggagctgccgtacctgccccgccgtccctttcccgggccg

SEQ ID NO: 1011 - DNA, 1137 bp, Streptomyces avermitilis
  CDS (1)..(1137)
gtgggccgacttctcgaccgcttcctggcggagcgcgtggcgcgggcggcggccctcgacccggtgttcgcccacgacatcgccgagcgcgtggcgcggttcaccctggacggcggcaagcgcacccggtcccagttcgtgtggtgggcgcaccgggcgtgcggcggaccggccgccggggcggaggcggccctgcgggtcggtgccgccctcgaactcatccagacgtgcgcgctggtgcacgacgacgtgatggacggctcccggctgcgccgcggccggcccgcgctgcacacggacgtgagtgcccagtacgccgacgccgtcctgcccgccccgggcacacgcttcggtgaggcggccgcgatcctcgccggagacctggctctcgcctgggcggacgacgtggtggcggacaccgacctggcaccggacccggggcgcagggtgcgcgaggtgtggagctgcctgcggatggaaatggtggccgggcagtacctggacatccagggccaggcgacctcgtcgcattccgaggcccgcgcgatgcgcgccgcctgcctcaagagcgcgctgtactccgtgcagcggccgctcgaactcggtgccgccctcgccggggcggacaccgccacgactcaggcgttgtgctcggcgggccggtgcgtcggcttggccttccagctccgcgacgacctccacgacgtcttcgaggaaccccggcgcaccggcaagccgtcgggcggtgacatccgggcgggcaaacccacctacctcgtcgccgtggcgcgggcccgggccgaagcggccggcgaccgcggcgccctcgccgtactgcggcgctcgctcggttgcgccgatctgtccgacgcggacctcgcccgggtgcgggacgtcctggtcaccaccggcgcgcgtgacacggtcgaggccgagatcgaccggctggtggcccagggcctgcgccacatgggcgccgcctcactcgcccccgagggacgacgccatctggacgcactgctccgttcagcggccggtgcgccctcggtccgccggcaggcccctgacgcgtcccgctccgagaacgggatgcccgtatcgctgctgctcaccgccacggccgagggggcctcccga

SEQ ID NO: 1012 - DNA, 1539 bp, Streptomyces avermitilis
  CDS (1)..(1539)
atgaacaggacactgcgcgggcgcaccgaccacgtcgtggtcgtcggtgccggactcgccgggctttccgccgctctgcaccttctcggtgccggtcgccgggtcaccgtcgtcgaacgcgatctcctgcccggaggccgcgccggacgtctggtgcgcggcggctacctcatcgacaccggtcccacggtgctgaccatgcccgacctcgccgacgaggccttcgcggcggtcggcgacagcctgcgcgaccgtgtcgacctgatcccgctgcaccctgcctaccgggcccgcttcgccgacggcagcaccctcgacgtgcacaccggcgccgaggcgatggaagcggagatcgaacgcttcgccggagcacgtgaggcggccggctaccgacagctgcgcgactggctcgagcggctgtaccgggcgcagatgcggcgcttcatcgactccaacttcgactcccccctccagttgctgacccccgatctggcgcgtctggcggcgctcggcggattcggccgactggacgcgcgcatcggccgccatctgcgggacgagcgcctgcgacgcgtcttctccttccaggccctgtacgcgggcgtaccgccggcccgggccctcgccgcctacgccgtcatcgcctacatggacaccgtggccggtgtgtactttccccggggtggcatgcacgccctgccgcgggccatggcggacgccgccgcgcaggcgggtgccgaactgcgcttcggacaggacgtcacccggctggagcgggccggtgaccgcatcaccgccgtcgtgacggcgtacgaccggattccgtgcgacgccgtcgtcctcacccccgatctgcccgtcacctaccgcctgctcggccgtgcgccgcgacgcccgttgcggatcaggaactcgccgtccgccgtggtcctgcacgcgggcaccgaccggacctggcccgggctcgcccaccacacgctctccttcggcgcggcgtggggccgcacgttcgacgaactcacccgcaccgggggcctgatgagcgatccgtccctgctcatcacgcgtcccaccgccaccgacccgggcctcgcgccgcccggccgccatctccactacatcctcgccccctgtccgaacacggacatcgggccgagcgccgccgcatggggcgacctggcgccgcgctaccgggacagcctcctgacggaactggaggcccgaggtctcgacggcatcggatccgccgtcgaagaggagtgcctggtcacaccggccgactgggcggcccagggacacgccgcgggcacgcccttctcggcggcccacaccttcgcgcagaccggcccgttccgtccgcgcaacctggtacgcgggaccgcgaacgccgtgctcgccggctgcggcaccacgcctggtgtcggcgtgccgaccgtgctgctgtccggcaagctggccgcagcccgtgtcaccggtggcacgaggcgcacaccccgccgtatgcccgcctcccgcaccgcgagcggaaggacgctttca

SEQ ID NO: 1013 - DNA, 1026 bp, Streptomyces avermitilis
  CDS (1)..(1026)
atgaccgaccgcgaactcgatgcggcgggcatcaccgacccgtcgctgcgcaaggcctacacgcactgccgccggctcaacgcgcggcacggcaagacgtacttcctcgccaccagactgctgccggtcgaacgccggcccgccgtgcacgccctctacggattcgcacgctgggccgacgacatcgtcgactccctggacaccaccgtcggccccgctgtgcgctcggcggcgctcggccgcctccaggagagcctgcggacgggactgcgtgagggacacagcaccgagccggtggtcctggcgctcgccgagacggcccggcggtacgcgatcgaccaccagcacttcagtgacttcatgacggccatgcgcagcgacctggaggtcaccggctacgagacctacgccgacctgcgcggctacatgcacggttcggccgcggtgatcgggctgcagatgctgccggtgctcgggaccgtggtcccgcgtgaggaggccgcaccccacgcggcggccctgggagtggcgttccagctgaccaacttcctgcgggacgtgggcgaggacctggaccgcggccgcgtctatctgcccgccgacctgttgcgcgcccacggcgtcgaccgggacctgctgcgctggagcagggacaccggccgccgggaccgccgtatcacccgtgcgctcaaggccgttgagggcctgacccgcggtgtgtaccgcgaggcggcgccggggcttgcgatgctcgacccggtggcgcgcccgtgcatccggacggcgttcgtgctgtacggcgggatcctggacgccatcgccgacgacgggtacgcggtcgtccaccgccgtgccgtggtgccgcgccggcgccgtgccgcggtggcgctggacggtctcgtacgcctgggcgtggcccgtctgggatcccgcgccgacgcgcggctgcccaccctgcccgatccgtggcggcttcccgccctggtgccgaggtcctcgccccggccggcacatgaggaggtcgca

SEQ ID NO: 1014 - DNA, 1077 bp, Streptomyces avermitilis
  CDS (1)..(1077)
atgacccctgaccgcaccgaccgtcctgcccggcgccgacgctacccgctctcgttgcgcaggcatccgattcgctgggaggaccagcgtccgacctggcgcgacgcgcggcccgccgtgatcgcggaggcgctgaagcgggcgcaggcacgaccatcgggcaactggtacgtcgtcggcgccacccgtgatgtgcgggaggaccgccctctggcgcgcaccgtggccggccttgaggtcgtcgtctggcgggacggcgaagggcggctggtcgccgggccaggtgtctgcccccatctcggtgcaccgctgcgggacagccccgtgcgctgcggcacgctcatgtgtcgctggcacggactcgccctgagcggcacgccgttcgcgggctgggaaccgctgcccgtgcacgacgacggcgtgctggtgtgggtacggctggacgaggtcggcggtgagcgaccgctcgaggccccggtggtaccggccaggcctgccctgtcgggtgccgtgtcggccgtctacgtcggcgtcggaatctgcgaacccgaggatgtcgtcgccaaccgcctggacccctggcacggcgcatggttccacccgtactccttcgtcgacctcaccgtcgtcacgcccggggaaaccgtcgcacctgaggaaggagaaacggagggtgtagagacggggggtgacgaggcggagggcgccgagacggaggacggatttaccgtcgacgtgtctttcaagatcgctggacggctggtcgtcccggtgcgggccgtcttcaccgctccggagccccgcacggtcgtgatgcgcatcgcggagggggaggggcggggctccgtcgtcgagacccatgccaccccgctcggccctgacgaccggggcaggccgcgcacggccgtggtcgaggccgtgctggcgtcgtccgaccgccgcgggttcgccgtggcgcgcgcgatggccccggtgctgcggccactcatgcgcgctgccgccggacgcctgtggcgcgacgacctggcgtacgcggagcggcgccggcacctgcgctccacgggccgcttccccggc

SEQ ID NO: 1015 - DNA, 2097 bp, Streptomyces avermitilis
  CDS (1)..(2097)
atgagtggggagcatacgttggcacgccgtacccgcacacgacggcttctgggaaccatcggcgtcaccgccctggccaccggggcagccctggtcaccgctccaccgacgaacgcgcagaccccggcggcagcggcgaccgctgccgtcacggtccagcccgacccctcgtaccgagcggacagattcgagggctggggcaccagcctggtctggttcgccaacgccaccggcgactatcccgcggagatacgcgagaagctggccgagctcctcttcgacgacgacggcctcgccctgaacatcgcccgctacaacatcggcggcggcaacgcccccgacgtcaaggactacctccgggccggcggagcggtcgagggctggtggaacgccccggcgggcaccacccgtgaggacaccgactggtggagcgccgacgacgccgccgactggaaccccaacgccgacgcgacccagcggtggtgggtggaccggatcaagaacgacatcgaccactgggagacgttcagcaactccccgccctggttcatgaccgccagcggctatgtgtcgggcggcttcaactccagcgaagaccagctcaaggccgactccgtcgacgacttcgccgcctatctggcaggcgcgaccaagcggctggagaaggcgcacggcatcaaggtcgacaccctcgacccgttcaacgaacccaacacgggctattggggtacgcgcctgggatccgacggccggcccgtcggcggccgtcaggaaggggctcacatcggcccggagctccagcagaaggtgatccgcgcgctggcccccgccctgaagaaggcgaagaccggcacgaagatctccgcgatggacgagaccaacccgaacctcttcgcgcagaactggaactcctacccccaggacgtgcgcgatctcgtcggccagatgaacgtccacacttacggcaccggcggccggaccagcgtgcgcgacctggccaaggcggcggacaagccgctgtggatgagcgaggtcgagggcgactggggcgacggccagagcttcacggacatgcggcccggcctcgggcttgcccagcagatggtcgacgacctgcgcgaactcgagcccaaggcctgggtgttctggcagccggtcgaggactacgacaacatgaagcccggcggtgagtccgccaagggcggcaactggggcagcatccagctcccgttcagctgcacctccgcggacaccctggccacctgccccgtccacacgaacacgaagttcgacaccgcccgcaacttcacccactacatcaagccgggcgaccgactgatcaggaccgacgacacctccagcgccgccgcggtctccacgaagggcaacgcggcgacggtcgtccacgtcaacaagaccaccagcgcccgcaccgtcacgatcgacctgtccaagttcggccacatcacccgcgacgcgaccgtgactcccgtggtcaccagcgccgcaggcaagctcgaacgacaggcccccgtcgaggtcaccggcagccgggccgcggtcaccgtacccgcccagtccgtgacgtccttcctcgtcaagggagtgtccggcgtcgcgaaggacgccgcgctcctgtgcaaggggcacacctaccagctgaccggcgtccagagcggcaaggccctcaccgtcgcggacgacggcacccagctcgtcatcaggaccgcgggtacggatgcggccgggaccgggcagcagtggcaggtgcgtcagatcagcggcgacaccgggaaccggcagcggtacgtgttcaccaaccccgcggcaggaaagcgcctggccgttcgtgacggcgcgccggtgctggaggcggaccgcggccaccgtgacaaggccacccagtggatcatgtcgaccaccggcgacggcacctggaccctcgtcaacgccgccaccggcaggctcctcgaggtcggcggccaggccaccaccgacggagccgccgtcacgacatggacgccgaactccggatccaaccaacggtggtcggtcaccgacgtgaccgaccagaacggatctcggtcgagcgggctg

SEQ ID NO: 1016 - DNA, 2040 bp, Streptomyces avermitilis
  CDS (1)..(2040)
atgatctccaccctcctgtcccagctgaacgggccggacggtgaccgcacgccacgcctcgcgtacggcgccgactacaaccccgagcagtggccgcgcgaggtgtgggaggaagacatccggctgatgcgcgaggccggcgtcaacatcgtctcggtggggatcttctcctgggcccgcatccagccggcccagggccagtgggacttcgcctggctcgacgacgtcatggacctgctgcacgcgggcggcatcggggtcgacctggccacggcgaccgcgtccccgccgccctggctcgccacggcacacccggagatcctcccggtgaccgcctccggcgagacggtgtggccgggggcgcggcagcactggcgtcccacgtcccccgtcttccgcacgcacgccctgcgcctggtgcggaagctggcggagcggtacgcggaccatcccgcgctggtggcatggcacgtctccaacgagctgggctgccacaacatctacgactactccgacgacgccgcccgtgccttccgcgactggctgcgcgcccgctacaccacgctcgacgccctcaaccacgcctggggaaccgcgttctggtcccagtactacagcgactgggaccagatcctgccgccccggctggccgcctcccacccgaaccccacgcagcagctggacttcaagcgcttctcctccgacgcgctgaaggcgtacctgcgcgcggagcgggacctgctgcgcgagatcacgcccgaggttccggtcaccaccaacttcatggtgatgggccgcaccaagggcatgaactacgccgactgggcccaggagatcgacttcgtctccaacgaccactacgtctcgcccgggcctcaggaccgggacgagctgtccttctccgccaacctcgtcagcggcatagccggcggacgcccgtggttcctcatggagcactccaccagcgccgtcaactggcagcccgtcaacctggccaaacggcccggcgacctggcccgcgactccctgctgcacgtcgcgcacggcgccgacgccgtgtgcttcttccagtggcgccagtcggcggcaggcgccgagaagtaccactcggcgatggtgccgcacgccggacccgacagcgaggtcttccgcgcggtgaccgccctcggcggcacccttcggacgctggccccggtcgccgggaccgagcgtgaaccggcgcgggtcgggatcgtcttcgactgggagtcctggtgggcgagtgagcaggactcccaccccacctccctgctcgactaccgccgggaggcgctcgactggtactccgccctcctcgccctcggcatccgggccgacgtcgtcaccccgcaggccgacctcgaccggtaccagctcctgatcacgccggtgctgcacgtggtccccgcggcactggccaaggaactcacccgctatgccgagaacggcgggcacctggtcaccacgtacttctccggtgtcgtggacgagaacgaccacatctggctgggcggataccccggagccctgcgcgatctgctcggcatccgcgtcgaggagttcggcccgctgctcgacggcgacacggtcgcactggacgacgccgccacgggcaccctgtggaccgaccggatcaccgtcaccgaccccgaggtggaggtcctggcccggtaccgcaccggtacgtacgccggccaccccgccgtcacccgccgtgcggtgggccggggttcggccgcgtatgtgtccacccggctgggaccggacggcctcaccgcactgctgccgaagctgctcggccctgccgcggtcggcagtgaactgcccgacggcgtagggggagacgtcgaactgatcgtgcgccgcggcgccggcagccgctatctgttcctggtcaaccggaccgacgggacggtgccgctgaccggactcgccggggaactcctgatcggccgggcagaggacgacggcaccgtggtgctgtccccccgggatgtcgccgttctgcggcagcccacccgc

SEQ ID NO: 1017 - DNA, 1335 bp, Streptomyces avermitilis
  CDS (1)..(1335)
atgcgcagaacgacccgccgcctgatgcgcggcctcgccgtcctctccgtcctcgccctcggggcgaccgcctgtggcggctccgacgacgacagcgccgaccagaagccggtctccgccggggacatccaggcggccctgaagaagggcggcacggtcacggtctgggcctgggagcccacgctcaagacggtcgccgccgacttcgagaagaagtaccccaaggtcaagatcaacctcgtcggcgagcggtccggcgacaagcactacaccgcgctgtcgaacgccatctcggccgagaagggcgttcccgacatcgcgcaggtcgagtacttcgcgctggggcagtacgcgctcaccaagggcctcaccgacctgacccccttcggcgcggacaagctcaaggccaagtacacccccggcccgtggaacgccgtgagcgagggtgacaaggtctacggcctgcccatggactccggccccatggcgctgttctacaacaagaaagtcttcgacaagtacaaggtcgcggtgccgaccacctgggacgagtacgtcgaggcggcccgcaagctgcacaaggccgatcccaaggtctacatcgccgccgacgccggcgacgcgggcctgaccaccagcatgctgtggcaggccggttcgcgtccctaccaggtcgacggcaccaaggtgaagatcgacttcgccgacgcgggcgccaagaagtacaccgacacctggcagaagctcatcgacgagaagctcgtcgcacccatctacggctggaccgacgactggtacaagggcctgggcgacggcaccatcgccaccctgcccagcggcgcctggatgcccgccaacttcgtcaccggcgtgccgaaagcctctggcgactggcgagccgcccccctgccggcctggaccaagggcgacaaggcgagcgcggagaacggcggcagctccctcaccgtgcccgagctggccaagaacaaggaactcgcctacgccttcgtcgagtacgcgaacgccggcgacggtgtgcagacccgcatcaagcagggcgccttccccgcgaccaccgcggaactccagtccaccgagttccagaacaccaagttcgactacttcggtgggcaggaagccaacaagatcttcgccgactcggccgccaacgtcgccgacgactggtcgtacctgcccttccagcagtacgccaactcgatcttcaacgacaccgtcggcaaggcgtacatctcgaagaccaagctggccgacgccctgaagtcctggcaggacgcctccgtcaagtacggcaaggaacagggcttcaccgtcgag

SEQ ID NO: 1018 - DNA, 954 bp, Streptomyces avermitilis
  CDS (1)..(954)
atgagcagcacgagcagccccgtcaccaccgactcccagcccgcatccgttccggccaccggcccgaccaagggcgcgccccgactgcgcacgccccgcaagcatgttcccggacgccccaagcgcagcgtgccgctgaccctgctcaccggcctggtcctgctctacaccctggtgcccttggcgtggctggtcatcagcgccaccaagacccaggaagggctggccgactcctccggactgtggttcgcccatgacttcgccctctgggacaacatcagccagacgttcacctacgacgacggcatcttcgtccgctggttgctgaacaccctgctgtacgtcgtgctcggggccggcggtgccaccctcctggcgatcctgggcggctacgcgctggcgaagttcaccttccccggaaagcgcgccgtcttcgccgtggtcatcggcgccgtcgccgtcccgggcaccgccctcgcggtgcccaccttcctgatgttcagcaagatggggctgaccgacacaccgtgggcggtgatcatcccctcgctcgtctcgcccttcggcctgtatctgatgtgggtcttcgccaccgaagccattcccgtcgaactcctcgaggccgcccgcatcgacggagcgggcgaggtgcgcaccttcttccaggtcgccctgccgctgctcgcccccggcatcgtgaccgttctgctgttcaccacggtcgcgacctggaacaactacttcctgccgctgatcatgctcaaggacccggactggtaccccctgaccctcggcctgagcgcctggaacgcccaggccgagacgatcggcggcgatgtgatcttcaacctggtgatcaccggctcgctgctcaccatcgtcccgctgatcatcgcgttcctgctgttgcagaagtactggcagtccgggctcgccgccggaagcgtcaaggaa

SEQ ID NO: 1019 - DNA, 924 bp, Streptomyces avermitilis
  CDS (1)..(924)
atgacgacgctacaaccctcagcggctgtatcacggcccccggcccggcctccgtcgaagcgggaccgccgctcgtggacagggtgggggttcataggccccttcgcggtggtcttcgcctttgtcttcctggctccgatcgtctattcgatctacctcagcgtcttccgcacccagctcatcggcggcacgaccttcgtgggcctggacaactaccaacaggccctgcacgacgaccagttctgggcctcgctcggacgggtctcgctctttctggccgtacaggtgccgatcatgctgggcatcgccctgctgatcgccctcgccctggacagcgggcgcctctacggcaaggacttcttccgcatagcgatcttcctgccgtacgcggtgcccgccgtggtggccaccctgatgtggggcttcatgtacggcacccgcttcggtctcgtcggggacatcaacgaggccttcggcgtcaccctgcccgacccgctctccaccgacctggtcctggcgtcgatcggcaacatcgtcacctgggagttcgtcggctacaacatgctgatcttctactccgcgctgcgggtcatcccgaactcgctgtacgaggccgcggagatcgacggcgccggacagatccgcgtcatcaccgccatcaagctccccgccatccgcggtgccctcgtcatcgcgacgatcttctcgatcatcggcagcttccagctcttcaacgagccgaacatcctgcggccattggcgcgcaacgccatcacgacggactacaccccgaacttcttcacctactcactgtccttcaacggccagcagcacaactactccgcggcggtcgccatcatcatggggctgatcaccatggtcatcgcctatgccgtgcagctccgcggcatgcgcaagggagcg

SEQ ID NO: 1020 - DNA, 1077 bp, Streptomyces avermitilis
  CDS (1)..(1077)
gtgaacacggcggacagcggctcgacgagcgtgccgcgggcactgacgcgcatggatgaacagagcgcccggcgcagacagagtgcgtccatggcggatgtcgcccgcctggccggcgtctcctcgcagaccgtctcccgcgtgtccaacggctacgcgggcgtcaccgaagagacccggcaagaggtcctggcggccatgaaggagctgggctaccggcccaacagtgcggcccgggccctcaagcgcggcgagttccgcaccatcggtgtcatcacgttcaacctttccaccacgggcaacatgcggaccctggaggcgatcgccacctccgcggcgcaggaggggtacgccgtcacgctcctgcccgtggccgtccccacccaggacgaggtgcacggcgccttctcccgtctgggagagctcgccgtcgatgccgtcatcatcatcatggaagtgcaccttctcgatgcggcgaccatctccttgcccccgcacgtccaggtcgccgtcgcggactcggacgccggtgaccgttacaccgtggtcgacaccgaccaggcgggcggagcccgcgcggccgtgcggcacctgttggaactcggtcaccgcacgatctggcatctggccggtcccgaggagtcgtacgcggcgcagcgccgtgccgacgcgtggcgcgccgaactcatcgaggcgggccgcgtcccgcccgccgtggtacgaggcgactggtcggcggagtccggctatcaggcggggctgcggatcgccgacgaggaggactgtacggcggtgttcgccgccaacgaccagatggcgctggggctgttgcgggccctgcacgagcgcggccggagaattccggaggacgtcagcgtcatcggcttcgacgacatccccgaggccggctccttcctgcctcccctgaccactgttcaccaggacttcgcggaagtggggcgactgtgtgtgcagggtgtcctgcggcggatgcgccacgacgcggcagaacacggcaccacgctcgtacccacgaaactcgtggtccgtgacagcacggcaccgcccccttcgcgg

SEQ ID NO: 1021 - DNA, 315 bp, Streptomyces avermitilis
  CDS (1)..(315)
gtgaccacctacgtcatcaccattcccggcacgttcctgcgggacccgagcgacgacgtgcgctccgctctcgtgcgactgctgcggccggccgacccgcaccacacctccctggggcagcaggaagacctggatctcctcaccgtcaacgacgacaacaccttcagcatccgcctggaggtgacagccgacgacagccgtaacgcggaagaggatgccaaacggacagccgcatccgcgctgcgcgaggccggattcgctcctgatgaagcaccgctcggcccggccacggtgacaggcatcgacaaccaggcc

SEQ ID NO: 1022 - DNA, 2277 bp, Streptomyces avermitilis
  CDS (1)..(2277)
gtgaggacagtgacgcggccgagccggacgggcacctgggaccgattcacagcatccgaccccgggctgctgcggctcatggccgggctgcggaccgtgggtgccatcgcgctcacccttgccgtcctggcccttctccgtgccgatgtcagtcacatggtggccggttccatggcggccatggtcgccaccttcgcagtcaaggacaaacagcggcgcgaacaggcggtcaccctcgcgctcggtctgcccgtggcgctcaccgcgatgtcgctgggagcgctgctcaacacccacgtcatcgccggtgacctcttcttcatcgcgctgatcttcgccgcggtctacagccgccggttcggtgaccgcggtatggcactgggtctgatcgggtttcaggtctacttcgtgtcactgttcgtcagagccaccttctccgcgctgcccgggctgtgcgggacgctcgccatcgcgttcgcctgtagcgcggtggtgcggttcggcctggtggtcgagacgcccgagcgcattctggagcggctgcgccgggcgttccgggctcgcctcgcccaactggtgtccgcccagatcgagctgctcgacgccggccccgcccgcctggagaaggccttggaggacgtacgcctgcacaccgcgcgcctccacgagaccgcgttgatgatccaggggcggctggacgagggcaccagcgacagcgccaccgcctcgctcgtacagcgccgcgtcgcggacgccgagatcgccgccgaacgactcggtgttctgctgctcagcgcccgaagcgccgaacgcgccgacacgctgaccctgcacctgccgaacgcgccgctgccggcacccggcgactggccgcgagcgcaggacgacgtcacggccacactgcgccgtgatctccacgcgctgcgtatgctcgtcctccgcccggtctcgcacgaccgcggccccgcggtggcccatctgcgcaaccggctgctcggctaccgcgacgaagagaacctgccgcgcgcctcggccgcggtccaggacgtcttccgcggcatcggagaggcggcgcgctccgtcctgggcctgcggctggccgtcgacggaccccaggacgagtccgacgacacacccgcgacgacccgctcccgtgaggagctggacgccgaggacgtcgccatcgcgggggccgaggagaaggagccggacgacgacggacccacggggctgaagcgtcccacgacccggtccgccgtccaggtgtcggtgggctcggccctggcgatcgtcggcggcgagttcctttccagccagcgctggtactgggcggtgctgacctgctgggtcgtcttcctgaacacggcgtccaccggagagatcctcgtcaagggctaccgacggctcctgggcaccgtgctcggggtcgtcgccggggtcgccctggcgggcctggtcggcaaccgcacctggctcgcgttcgtactcgtgctgctcttcatcttcgcgatgttctacagcgcgccgctgtcgtacgccctgatgtccttcttcgtcacggccatgctggggttgctgtacacgctcctcaacacctacagccccgaggtgctcgtcctgcgcatcgcggagaccgcgctcggtgccgcctgcggcgtcatcgcggccgtactggtcctgcccgtgaacacggatcgccgtaccgacgaactcctcggcacggtgctgagccggctcggggacgtcaccgacgccgcggtggagcagctgagcggcgggcccgcgctcgatctgctggacaaggcccgggacctcgacacggcactggacgatctgcggtcctccacgcagccgctgacccacccgatcaccccgctgcgggcccgccgccagaccgcgcgctatctcgtggctctcctggagacatgcgcctatcacgcgcgttcgctggcggcgacggccgaactcctgccctacagcaagaccgtcgccgccgatccgcgtctcaagagggccgggcggcgtatcgccgacaacatcggcgtactcgtcgcccgggtcgaggacgagggcagcgaaggtgtggtcgagaccggcgccagcctcgccgccatgctggaggcggacactgagggtgccacgcggcccgaccgggtcacgagccgtgtcctgaggcatttgcaacgcctggacgagggagtggtcggtctcgcccgcccgctcggagtgtcggtctcgtccccggaccgtgagtcctcccggggccgcgtcggctcg

SEQ ID NO: 1023 - DNA, 816 bp, Streptomyces avermitilis
  CDS (1)..(816)
atgaaccgtcgtccacgccgcgcagcccatgtcttcgtctccaccctggcggcaggcgcgctgctcaccaccgcggggtgctcggaggacggaaacagccggggcagttcggaggccgtgtccagcccttccgccgagctctcggcctccccgctggtcaaggagtccccggcggcctcgaccgcgcccgcactcaccacggaacaggcccagaccgcgctgctcaccaataccgatctgggctcggagtggacccagagcaaggccgctgagtcctggcgggccaccatggtcaagggcaagacgaacctcgccgagtgccagaagctgctcgacgccctggtctcgggggaactgctgggcgatccctcgggttcgagggcggtgacgggcttcgcggacagcgacaacgacgcccagatgcgctacgaggtcgccgcgtacgaccacgccgccctggacaagtcgttcgactggctgaagtcggtgcccgtgacgtgtgaccagttcacggccaccgacacccccgtgggcacacagacggtccaggtcgtcgagacgtcgctgcccagcgcgggcgacgaccgtcagggactgcagatgaccgcgaccggcgcactggagggcacgccgttcacgctgaccatggacatcgccgccgtacgcgtcggcgacaacgccatcagcctgaccaacggcggcctcggcggcgccgacagcgactccacgagccaggccgtccaactgggcgcgcaacgcctcacggacgtcctcgccgggaagaccccggccgagcagccacccggtcagcaggac

SEQ ID NO: 1024 - DNA, 1071 bp, Streptomyces avermitilis
  CDS (1)..(1071)
gtgaccgtgacgcgtgtcggcctggtcatgcacggaggtcgtgcgcaggccggggacgccgcgaggatcgtgcgtggctggtgcgcggaacgcggcgtgcactgtgcggacatcgacgtgtggcgggacgacacccggcacagtgcccgcgaggaggtcgcggcggcgggcaatccggatctgatcgtcacgctgggcggagacggcacgttcctgcggggtgcgcggctcgccgcggagaatgacgccctggtcctcggcgtcgatctcggccgggtgggtttcctgacagaggtgcccgccgccgctgtgtgcgaggcgctggaggccgtccaggaggaccggatcacggtcgagagccgcatgctgctgacgctccgcgcgtcccgtcgtctacaggtgcccaccggcatggaagctctgctgcgatacgggcggggccccctcctgccgcccccgcgggtgcgtaccgactgtgcggagggcgatgactggggcatcgcgctgcacgtcaccgcgctcaacgacatcgtcctggagaagctggcgagggaccggcaggtgtcggtcggcgtctatctcgccggccggctgctggcctcctactccgccgacgcgctgctggtggccacgcccaccggctcgacggcctacagcttcgccgcgggcggtccggtcgtctcgccgcgcgccgaggctctgatcttcaccccggtcgccccgcacatggcgttcaaccgctccgtcgtcgccgcccccgacgagccgatcgcactgcgggtactggaccgctcggggccggccgcggtcagcgtcgacggacagttgcgcggtgtgctcgacccgggggactggatcggtgtgtacgcggctccgcgccggctgaaagcggtccggttggggcccatggacttctacggccgtctgcgtgaacgcatgaacctgaccgacgccccggccgcggtcgccgacgggcaggccgccccgctgtggccggtgaccagtgctccgccggccgatctggcgcatctgaccctgcccccagggcccggtgacacgccgtccgcctcg

SEQ ID NO: 1025 - DNA, 792 bp, Streptomyces avermitilis
  CDS (1)..(792)
atgcacatcgatctgaaaggccgcaccgcactggtgaccggctccacgcagggcatcggcgcggcgatcgccgtcggacttgcccgggccggcgcccgggtgggcgtcaacggccgctcccgggagcgggtcgagtcagccgtcgcctcgctggccgtggaggcgccgggcgccgatctggtggcggtgaccgcggacgtggccacggaggagggcgcggccgcggtggaggacgcgctgccgcaggtggacattctcgtcaacaatctcggaatcttcggtgccaaggacccgctggagatcaccgatgacgagtggcggcgctacttcgaggtgaacgtgctcgccgcggtgcgcctgactcgcatgttcctgccgggaatggccgaacgtggctggggccgcgtccagtacctcgccagtgactcggcggtggccgtgcccgcggagatgatccactacggcatgtccaagacggcactgctcgcggtgagccgaggattcgccaaacaggcggcgggcaccggggtcacggtgaattccgtcatcgcgggccccacgcacaccggcggggtcgaggacttcgtctacgagctcgtggaccgggaggtgccctgggacgaggcgcagcggaccttcatgcgtgagcggcgcccgcagtccttgctccagcggctgatcgagccggaggagatcgccaacatggtcgtctacctcagctccgagcaggcttcggccacgaccgggggagccctgcgtgtcgacggcggatacgtcgactcgatcctgccg

SEQ ID NO: 1026 - DNA, 2373 bp, Streptomyces avermitilis
  CDS (1)..(2373)
gtgcggcgccttcccgctcagcgcgattcccggccgcccgcaccccgtcgggccgctctctcggcccccttcacaggccgaccgtcgcagaaggagaagcccttgtcacggccccctcgctcctcgcatcgacgcagatacacagccgcgttggccctcaccaccgccggcacgctgttcgccgccgggtttcagaccggcgtcgcgtccgccgccccccgcgaccccggtcatgcgaagatcgcagccactccgagggctggtgcagccccggcgaagctgtctcccgcgaagcatgccgcgctcctgaagagcgcgaccgccgcagtcggcgacaccgcgaagagcctcggcctcggcgccaaggagaagctgatcgtcaaggacgtcgcgaaggacgccgacggcaccacgcacacccgctacgagcgcacgtacgcgggcctgccggtcctcggcggcgacctggtcgtgcacctcaggaacggcggccgcacgacggtgtccgaggccaccaaggccaccgtcagggttccggccgtcaccgccaaggtcagctccgccacggccgcgggcaaggcggttgcggccgccaagaaggccgatgccaagcatcccaagatcgacggcgcgccacggctggtcgtctgggccgccggagccaagccggtcctggcctgggagtcggtggtcgagggcgtccagcacgacggcacgccgagcgagctccatgtcatcaccgacgccacctcgggcaaggcggtcttcgacttcgaggacgtacgcaccggtacgggcaccggccagttcagcggaaccgttccgctcggcagcacgctctccggctccacgtacgagctggtggacgccgaccgtgcggggcaccgcacctacgacctgaaccagggcacctcgggcaccggcaccctgttcacagatgacaacgatgtctggggggacggcacccagagcaaccggcagaccgccggcgtggacgtcgccttcggcgccgcggccacctgggactactacaaggacgttttcggccgcaacggcatacgcaacgacggcgtggccgcctacagccgcgcgcactacggcaacgcgtacgtcaacgccttctggtccgacacctgcttctgcatgacctacggggacggcgcgagcaacacgcacccgctgaccgctctggacgtcgccgcgcacgagatgagccacggcgtcaccagcgccaccgccaacctcacgtactcgggtgagtccggcggcctcaacgaggcgacctcggacatcttcgccgcggccgtggagttccacgccgacctgcccgccgacgtgcccgactacctggtcggcgagaagatcgacatccgcggcaacggcacccccctgcgctacatggacaagccgtccaaggacgggtcctcccgcgactcctgggattcctcgctgggcagcatcgacgtccactactcctccggcccggccaaccacttcttctatctgctctcggagggcagcggcgccaagaccgtcaacggcgtctcctacgacagccccacgtccgacggcaaggccgtgaccggcatcggcatcgagaacgcccagcggatctggtaccgggcactcaccacctacatgacctccaccaccaactacgccggcgcccgcgtcgcgaccctccaggcagcggccgacctgttcggtgcctacagcgacacctacctcgccgtcgccgccgcgtgggccgggatcaacgtcggcgaccggatagcgctcggcgtcaacatcgccccgatcgccgaccagaccagcggcgtcggccaggaggtctccctgcagaccgacgcctacaccaccaactcgggtgccggtctcacctacgcggccaccggcctgccggacggtctgacgctcagcgacaccgggctgatctccggggttccgaccaccgccggcaccagtgaggtgacactgacggtcacggacagcaccggcacggccgcctcggtgagcttcagctggagggtggcgcacatctacgccaacggcacccgcgtcgacatccccgacgccggagccgcggtggagtccccgatcgtcatcaccggccagaccggcaacgcctcggcgaccacccaggtctacgtcaagatcgtccacacataccgcggtgacctcacggtcgacctggtcggccccgacggcaccgtctactcgctgctgaaccacagcggcggttccgccgacaacgtcgaccagaccttcacggtcgacgcctccgcgcagccggtcgacggcacctggaaactgcgggtccgtgacaccgcctcgatcgacgtcggctacctccagcaatggcagctcacgccc

SEQ ID NO: 1027 - DNA, 942 bp, Streptomyces avermitilis
  CDS (1)..(942)
gtgagcggcatgtccgcccttgaactgatccgtatcgtctcccgcgactcacccatggcactggcccaggtggcgcgcgtccgcgccgaactggccgcgctccatccccgcacgcgcaccgaagtcgtggccgtgaagacgaccggtgacaagtggatgggggatctgtccaaggtcgacggcaagggcgcgttcaccaaggaggtcgatgccgcactgctcgcgggcgaggcggatctcgcggtgcactgcgtcaaggacgtccccgccgaccggccgctcccggcgggcaccatgttcgccgcgttcctcaagcgggacgacatccgcgacgccctcgtccaccccggcgggctcaccctcgacgaacttccgccgggtacccggatcggaacctcctcggtgcgccgcgtcgcccaactggccgccgcgtacccccacctggagtgcgtgccgtttcggggcaacgccaaccggcggctggagaagctcgcggccggcgaggccgacgccctgctgctcgcggtgtccggcctcgaacgcatcggccgcgaggacgtgatcaccgaagtcctggagcccgagaccatgatgccgccgatcggcgcgggcatcctggccctccagtgccgggagggcgacaccggcctcatcgagaccatcagcgaactcggcgacccgggcacccaccgcgaggccaccgcggagcgcatgttcctgcacgttctccaggggcactgcaattcgcccatcgccggctacgcccgaaccgaacgcaatggtgaactgtccctgcgcgccagcgtgttcaccctggacggcaagacggtcctgaacgcccacgagtgggcgggccgcctcgacccggcgacgctcggcacctccgtggccgtcgccctgctgcgtcagggcgcccgcgagctgatcgacgacatcccgcac

SEQ ID NO: 1028 - DNA, 942 bp, Streptomyces avermitilis
  CDS (1)..(942)
gtgaccgcagacacacaggtcgatgtgaccgcagacacacagcaggacggaacctccatgcctggaacgcactcatcgcgccgcgcgacgcggggactggcgacggccgtggccgccggggcagtgctcacggcgttcgcgtcggccacccccgccgaggcgagcaccgccgccgcgtccgtcggcggctcacaggtgacgtgcacctcgcagcggccaggactggcgggccggctgtcgcaggacatcgccgacgccctccgtggacgccatggcgcctcggcgctcgccctgtacgaccgctccacgaagacctcctgcgcgtaccgggccgacgcggccttcgactcggcgagcgtggtcaaggtcacgatcctgggggcgctgctgcgtcaggcggctgaggaacatcgccggctgacccctcgcgaggtgaaactgaccaccgccatgatcaccaagtcggacaacgcctcgaccaatgccctgtggcatcaagtaggggccgccggcgtccggcacttcctgactctggccggaatgcgggacaccgttcccggcccgaagggctactgggggcggacccggatcacagccgccgaccagctgaagctgctccgactgctcacctcggacaactcggtcctcgatcgaaacgcccgcgcctatgcccttcgcctgatgaaccgagtgatccccgggcagcgatggggcgcgccgaccggggcaccctcgacgacgaccgtgcacgtcaagaacggctggctgccgcgtgagaccaacggctggcgggtgcacagcgtgggcgtgttcaccggcggcgggcacgactacgggatggctgtgctctcgcacggcaaccgcacgatggacgacggcatcgccaccgtggagcgcgccgcccgcgccgtcaaccacgacctgaacctgccgaccgcctcg

SEQ ID NO: 1029 - DNA, 273 bp, Streptomyces avermitilis
  CDS (1)..(273)
gtgacggacctggacgtctccgcgctcgggaagtccaccgtccgctccacggtcctggtgaacccggtcccggccgaccactactacgttgccggacacccggtgcgggaggccaccggtgcccatgtggaggtgagtatcacggcgggcaccaacaacgccgacgagaaggcgcggttcatcgccggggcgtacaacggcatcacacagttcgaccactaccggcacgcgccgcggcccgtcgccaccccggacggacgcaatcgaatgcct

SEQ ID NO: 1030 - DNA, 570 bp, Streptomyces avermitilis
  CDS (1)..(570)
gtgatcctcccccacgccggctcggccctcgcggcgacggacgcgatctgcgacgccgccacccggcacgacgcgaccaccggcggcacggtgcgcctcgccgccgaccccacggtccgccagggcctgctgccctcactgccgcgtcactggtccgagcatctgccggccatccgcgtccgggtcttcgaaggcagcggcgaggagacggagacctggctcgcgagcgcggccgcggacgccgccgtcgtggtcgacccgccggccggaagcggcgcgcaggagtacaccccggcccatcgcgtacgggacctcgggacgctcatcagcatggcccaggccggtctcggcgtctcgatcctgccggaggtgtcacggccgttgatcccccgggacctcgtcctggtgcgtgtcgcaccgcaccacagcaggagactcgccccgtgcggaccgcggaaacgtccatggcccccgcagtgcgtgctctcgtggactccgtggcccggtttccgacgggcgcgaccagcctcgtgtgccgacctcatggcaccgaccggaactcccctcccg

SEQ ID NO: 1031 - DNA, 1278 bp, Streptomyces avermitilis
  CDS (1)..(1278)
gtgaccatccaactctacgaggaccgaccggccggtcggcatgcggccgtcccccacggcagcctcctccgccgggtctacgcgccgcgtgccttcgacgcgctcgccttctccatgtccacgtacgccatgccgctcctggtgctggccacgaccgactccgcccggctgaccgggctggccttcgcgctggagtggatcccgcgagtggcggccttcggcctggccggtgacctggtcgaccggcgcggggccgcggtcgtgttcttcctcgcctccctggcccgggcgatcgtggtggcggcgggggccgttgcgctgatcatgctccagcgggggacggcggagacggtcgtcgtgatggcgctggctgccggaaccggaaccctgacacagttcagcttcatcgccaatgaagcggtgggcgcgatcgtcagccgccgtacggacacccaggcgcacaaggtgcaggccgttctgatcggcatcgaccagacggcgacgctcaccggccccgcgctgggaggcgtactgctgctggcggggccgacccgcatgctcgtggtcctgggcgtgctgtcctgtctggcggcagctctcgccctgcagaccccgccgaccccacttcgcggctcggggcgccacaacaagcggccggaagcaggtctcaaggcgggctggcgcaccttgcgctcgctgcccgcactgggctgtctggtggccggactgagcatctccaatctcgcgctcgggctgctccagtccgccagtccgatcatcgtggtcgagcgcttcggtctgtctcccgcggccgtcggcaccctctggtcggccgccgcggcatccacgctcctcgcggtagccgtctgccggttcgcactcggccggctggggctgtggggagtcggtgccgtctgctccaccatcgcgtccgcggcctgtctcgccctggcccaggctcccacgtacctcgcctacgtcgtactcatggcactcttcatggccggtgacggtggcctgaccgtcgtcctgcgcacactccggtcgcttctcatcccggcggccgtcttcggcagcaccctctccctgaccatcctgcttctgctgctgcccttcccggtcgcggggatcctggtcgccgtcacaccgccctgggcactcggccacgtgatcgccgtgtgcgccgcgctgcaagccgtcgccctggggatcgtcttcctgcgcctgcgcacggatccggtcctgcgcgcctccggcaagccggaacaggccacggcc

SEQ ID NO: 1032 - DNA, 1443 bp, Streptomyces avermitilis
  CDS (1)..(1443)
atgagacgtctcaccgtccgcctgttcaccgcggtcctcgccgcactggccctgctcaccatgggtacgcccgcccacgcgaccgccccggcctcgccctccgtgaccttcaccaacccgctcgccgagaagcgtgccgatccgcacatcttcaagcacaccgacggctactactacttcaccgccaccgtgccggagtacgaccgcatcgtgctgcgccgggccaccacgctccagggtctggccaccgcccccgagaccaccatctggaccaagcacgccagcggtgtgatgggcgcccacatctgggcgccggagatccacttcatcgacggcaagtggtacgtgtacttcgccgccgggtcgaccagcgacgtgtgggcgatccggatgtacgtcctggagagcggcgccgcgaacccgctgaccggcagctggaccgagaagggccagatcgccacgccggtgtcctccttctcgctcgacgccaccaccttcgtcgtgaacggcgtccgtcatctcgcctgggcgcagcgcaatcccgccgaggacaacaacaccagcctcttcatcgccaagatggccaacccctggaccatcagcggcacgccgaccgagatctcccagcccacgctgtcctgggagaccgtcggctacaaggtcaacgagggtccggccgtcatccagcacggcggcaaggtcttcctgacctattcggcgagcgccaccgacgccaactactgcctgggcatgctgagcgcgtccgcctccgccgatctgctcaacgccgcctcctggacgaagagttcccagcccgtgttcaagaccagtgaggcgaccggccagtacggcccaggccacaactccttcactgtctccgaggacggaaagtccgacatcctcgtctaccacgaccgcaactacaaggacatcagcggcgacccgctcaacgaccccaaccgccgcacccgcctccagaaggtctactggaacgccgacggcacccccaacttcggtattcccgtggccgatggcgtcaccccggtccgcttctcctcgtacaactacccggaccgctacatccgccactgggacttccgggcgcgcatcgaggcgaacgtcaccaacctcgccgactcgcagttccgggtggtcacaggtctggccggcagcggcacgatctccctcgaatcggccaactacccgggctactacctccgccacaagaactacgaggtatgggtggaaaagaacgacggctcatcagccttcaagaatgacgcgtccttctctcggcgggcgggcctggccgactccgcggacggcatcgctttcgagtcgtacaactatcccggccgctacctgcggcactacgagaacctgctgcgcatccagccggtcagcaccgccctcgaccggcaggacgccacgttctacgcggaa

SEQ ID NO: 1033 - DNA, 1533 bp, Streptomyces avermitilis
  CDS (1)..(1533)
ttgcgcacagtgttcggtatttcgaacttactgtctccggagggtacccacgtgttccgcacccgccactggttcgtcctcggggcagcgctgctggccctgctcgcctcgctcgtcccggcccagtccgtcgccgcggccgggggacggccgtacaccaaccccgtcaaggcgcagaagggcgccgacccctggctggagtactacaacggcaactactacctggtgacgacctcgttcaccaacgagctgaccatgcgcaagtcgccgacgctggccgggctggccacggctcccagcgtccagatctggtcggacaccacctccggccgcaacgcgaacttctgggctccggagatccacttcttcaacggcaagtggtacctgtactactcgggggcgcagagcggagccgcctgctgcgacacccagcgcacccatgtcctggagagcgcgggcgccgacccgatgggcccgtacacgtacaagaacagcctcaccggctccaacctcaaccccggcggctggctgatcgacgccagcgtgctccagtacaacagcaagctgtacctggtgggcagcggctccatcaacggcagtacgcagagcctggtcatcgcgccgatgagcaacccgtacacgctgagcagttcctccttcaccgtcatctccagccccacgctgagctgggagacgtccggcgccccggtcaacgagggccccgagccgctgtatcacgacggcaggacgttcctgacgttctccgccagctactgccagaccgcggactacaaactcggtcagctcgaactgaccggcggcgacccgctctccccagcgtcctggaccaagaagcagaacccggtcttccagcgcgatgacgcggccggggtctacggccccgggcacaacgggttcttcacctcacccgacggcaccgagaactggatcgtctaccacgcgaacagctccgcgagcggcggctgtggaaacggccgtacgacacgggcgcagaagttcacctggaacgccgacggcacaccgaacttcggcaccccggtcgcgaccggcaccaccctcgcgggcccctccggggagaccgcggcaaccccgacggcgtacacgatcgtcaaccgcaacagcggcaagtgcctggacgtcgaaggcggcaacaccgccgacggcaccgacatcttccagtggacgtgcggcggcggcgccaaccagaagtggcggatcgaggaccagggcaccgacaccagccggctggtcaatgtcgccaccggcaaggtcatggacaccgccgactgctccaccgccgacggtgcggacctcagacagtggtcctggctcaacaacaactgccagagattccggctcgtccacaccggaagcgactacgtgcggatcacgaacgcgaacagcggcaaggtcgccgacgtggccgactgcggcaccggcgacggcaccgacgtacgccagtggacctggctcgacaacgcctgccagcagtggcagctcaagcccaccgtc

SEQ ID NO: 1034 - DNA, 672 bp, Streptomyces avermitilis
  CDS (1)..(672)
atgcctgccgtcaccaccgccgcaagctcccgccccgctgaccggctcgccgtcgaccgggtcgtccgccggcggcttcccgtggccctgctcgctgtcgtcaccgtcgctctcgccatgtcggcctggcatgcgaaagaccccactacctggctgctggagaccgtgtgggcgtgggtgggtctgccgctggtcgtgctgctgcgcaggcggttcccgctcaccagcctgctgtactgtctgctcgccgcgcacgccctggtcctcgcggtgggcggccactacacctatgccgaggtgccggccggtgactgggtgcgcgactggctggacctctcccgcaacccctacgaccgtttcggccacctcatgcagggcttcgtgcccgccgtcctggtacgggagatcctcacccgcacgtcgccgctgcgcggcagccggtggcttgcgcccctgaccgtgtgcgcctgcctcgccttcagcgcggtcttcgaactcctggagtgggccgcggccgttgcgggagggcatgccgccgacgcgttcctggccacccagggcgatgtgtgggacacccagtgggacatgttctgcgcgctgatcggagccgtctgctcactgctgctgctcagccgcgcacacgaccgccgactcgcccggctcgacggccgc

SEQ ID NO: 1035 - DNA, 540 bp, Streptomyces avermitilis
  CDS (1)..(540)
atgcgcaccggttcgacggaacagctgagcgcggagcgcacaggccgtacgccgtccgcgggggtggagaaagcgacgcccctcaaggccctggggcgggtgccatggcaggacatcaaggactccagcggctctgcggcggccatcccgctgctgctcagcagtgtcgcgtggggtgacgccgcgaccgccagggccgctctcagcgacttgcgggaacgaatctgccagtacggcttcgtggtggagcaggccacggccgccacggtgcccttcctctgggagctcgcacagcttccccaggtcagctgccgggcgcagatcatccagttgctcaggaacatagccgacgcccggcagtgggagagcacggccgccctctatccgaagttgctcaaccaccgcgaaaatcccgtggtctgggagcgtcaggcgcggcaggccgtgcgtgcccggcgcagcgtcgtcgagcaactgctcgccgaggacgacgccgagatcacccaggccacgacggaactcgcccgcgcactgggcgcg

SEQ ID NO: 1036 - DNA, 228 bp, Streptomyces avermitilis
  CDS (1)..(228)
gtgccaacagcgccgaacggagtacaggccagctcattggccgcccggtggatcaagagtcggcacagcaacgccgagggcaactgcgtcgaggtggccgccctcgacggcggcggcatcgcgatgcgcaactcccgcgatcccgaggggcccgccctcgtctacacatcggccgaagtggccgccttcctggccggcgcgaaggacggggagttcgaccatctgctg

SEQ ID NO: 1037 - DNA, 918 bp, Streptomyces avermitilis
  CDS (1)..(918)
atgtccgccgagtcacatcgcgtctcccgcctcgaaccgtatctggaccgggccgagccggcccccacactcttgaagatgctggtcggtgtccagctggcgggctgccgtgacgacgccggcctctcccaggagcaggcggcacgagccctggggttcagtccggcgaagctgtctcggatcgaagcgggcaagggccgccgaccacccaccgagggcgatgtccgcgcgctgctgcaactctacgggaccgacgcctacgaggcttcggtactactgaaactgctacagcgcgccggggagccgggatggtggcagcgctacgacaagcggttgatgcccgagtggttcgaccggctggtcgggctccaggaagcagccgccaccatccgtaccttcgagatccagtacgttcccggcctcctgcagactccggcctacacccgtgccgtggtgcagcgcggtctgccgacggcgtcggccgtcgaggtacagcgccgggtcgaactccgcacgcgccgccaggagatgctgctgcgcgcggacgccccgcgactgtgggcgatcgtcgatgaatcggtactgctgcgtgtcctgggcagccgtgacgtgatgcgcgagcagctcgagcacctcatcgggatggcgcggcgtcccgaggtgaccgtacagatcgtgccgctggacgtgaccaacgcgtcggcgccggccatccccgtcacgtatctccgcttcgacgggctcgatctgcccgacatcgtctacctggagcacataaagagcgccaacttcctggaggaccgggacgagacggaggagtaccggctgaccctcgaccggctggccgacgaggctctcgacccgcacgagtccctgaacctgatgcgcgccacgctggaacagcgctacgccgatacg

SEQ ID NO: 1038 - DNA, 816 bp, Streptomyces avermitilis
  CDS (1)..(816)
atgcagagcggtaagcaactgtccacgtcgatcgatgccacggtaccgaccgccgcgcgcatgtacgaccactacctgggcggcaaggacaactacgcggccgaccgggcagcttgcgaggaactcgacaaggtcgtccccagcacgcgcccgctggcggtgaacaaccggcggttcctgcggcgggtcgtcgggacgctggcggccgagtacggaatcaggcagttcctcgaccacggatccgggctgcccacccaggacaacgtccaccaggtcgcgcagcgcgtcgatcccaccgcgcacgtggtgtacgtcgacaacgacccgatggttctggtgcacggccgggcgctgctcgaacaggacgagcgcacggtggtcatccaggccgacatgcgggacacggaggggatcttctcgcatcccgacacgaagcgtctgatcgacttctcggagccggttgccgcgctcttcgtgtcggtcatgcactgcctgccggacggtgacaccgacggtccgcccgcgctggcccggcgcgtggccgaacgcctggtgcccggcagcttcatggtgatgtgtcagctggtcagcgaagacgcccagatccgtgacttcgtcaccgatttcatggaccgtacgacgcaggggagctggggccgtgtgcgtcaggagaaggacgtcgtcgacctgttccaggggatggacatcctggagccggggctggtggacgtgtccacctggcgaccggactccgaggtggcgcctcgtcagctcacgcaggagtggatcgagttcggcggagtcggccgcattcgg

SEQ ID NO: 1039 - DNA, 855 bp, Streptomyces avermitilis
  CDS (1)..(855)
atgcacactcgccgtatcggtgatgtcgaggtcagcgctgtcggcctgggcgggatgcccatgtcgatcgaggggcggccggacgagacacgttcgctcgccaccatccatgccgcgctcgacgccggcgtgacactgatcgacaccgcggacgcctatcaccgggacgccgacgacgtcggtcacaacgaagccctgatcgccaaggccctcggctcccacgaccgtggtccggacgtcctggtcgccacgaagggcggtcatctgcgtcctggcgacggcagttggacgctggacggcactccccggcacatcaaggaggcctgcgaggcctcgctccgccgcctcggcgtcgaggccatcgggctctaccagttccaccgtcccgacccggaggtcccctacgcggagtccgtcggcgcgctgcgggatctgctggacgaggggaagatccgcatggccgggatctccaatgccgacccggaccagatccggcaggcccacgagatcctcggcggcagactggtctccgtacagaaccagttctccccggccttccgctccagcgaaccggagctgcggctgtgcgacgcgctcggcgtcgcgttcctgccctggagtcccttcggcggcagctcccgggcccgtgaactgggctccgcatacgctccgttcgcgcggatcgccgaggtccacggggtcagcccgcagcgggtgtgcctggcctggatgctcgccaagtcgccggtcgtcgtgccgatcccgggggccagccgccccgacaccatccgcgactcggcagccgccccggacctcgtactcaccgtcgaggagctcgcggaactggacgccgcc

SEQ ID NO: 1040 - DNA, 891 bp, Streptomyces avermitilis
  CDS (1)..(891)
atgcgtatgggactgctcgggacaggaccgtgggcacaggcagtccacgcccccgcgctgagggggcacgacgacctggagttcgtcggggtctggggtcgtcgcccggaggcggccgcatcgctggccgaccggcacggcacccgtgcgtacgacgacgtcgacgccctgctcgccgatgtcgacgcggtggccgtcgccctgcctccggcggtccaggccgagctggcggtgcgcgcggcgcgggcgggctgccatctgctgctcgacaagccgatcgccacgaccgtccccgacggccgggccgtcgtcgaggcggccgagcgggccggcgttgcctccgtcgtcttcttcaccacccgcttccagtccgagacggaggcctggatcagcgaacagggagccgcgaaggggtggttcaccgcacgggcgcagtggctcggtgcggtgttcaccagtgacagcccgttcgccgcgtcgccctggcgacgcgagaagggagccctgtgggacgtcggcccgcacgccctgtccgtgctgctgccggtgctcggcgacgtcaggcgcgtggcggccgccgcacgcggaccgcgggacaccgcgcatctgatcctcgaacacgccggcggggcgaccagcacgctgaccctgagtctcaccgccccgcccgccgccgcaggggccttggtcgagttgcgcggtgagaccggcgtgacggtcctgcccaacagctccacgagcgctctcgacgccttcgcccgagccatcgacgccctccgcaccgcggctcgcaccggccgtccgcacccctgtgacgcgtcgttcggtctgcgcgtgagcgaggtactcgccgaggccgaagcgcgtttggccggggactcccccgcgcag

SEQ ID NO: 1041 - DNA, 807 bp, Streptomyces avermitilis
  CDS (1)..(807)
gtgagcgagcaggacagcccgtcgggcggatcggccgtgctgaacaccggtgtggcccacaacgcgcgggtgtggaactactggatcggcggcaaggacaactatcaggtcgaccaggaggtcggtgagcaggtcgccgccatgttcccggtgatccgcgatgtcgcccgcgcggaccgcgccttcctggggcgtgtggtgcggcacctgaccgccgagtgcgggatgcggcagttcatggacatcggcaccggactgccgaccctggacaacacccatgagatagcccagcggatcgcccccgacgcacgcatcgtgtacgtcgacaacgaccccacggtgctcgtccatgcccgcgccctgctgcggagcacccccgagggagccaccgactacatcgacgccgacgcccacgacccggaaacgatcatccggggggccgcggcgaccctcgacttcggccggcccgtggccgtcatgatgctggggattctcaacttcgtcctcgacaccgctcgggcgcgggacatcgtgcgccggatcatggccgcggttccctccggcagccatctcgtcctgacccaccccaccacggacgccggcctcggcggcgagggcaacgtcgcggccatgaagttctggaacgacaacgccaccccgcccatcaccgcccgcagccgggaggaggtcgccgcgttcttcgacggactggacctgatccccccgggcatcgtctcgtgctcgcggtggcgctccgactccaccgccgacgtgctgccgcagttcggagtggtggccgtgaagccc

SEQ ID NO: 1042 - DNA, 1197 bp, Streptomyces avermitilis
  CDS (1)..(1197)
gtgttcgagagattcagacgccgggcgctggccccgctcgtcacgaccgcgctggcagctgcgctgctcacgatcggcggtccgccgtcggccgaggccgcggtccccgccacgatcccgctgaaagtgaccaacagctccggccgcggcgaaccggtgtacatctacaacctcggaaccctgctgacgaccggtcagcagggctgggccgacgcgaacggcgcgttccacgcctggcccgcgggcggcaacccgcccacccccgcacccgacgcctccatccccggaccggcggcgggacagacgaagacgatccggatccccaagttctcgggacggatctacttctcctacggacagaagctcgtgttcaagctgaccaccggcggcctggtgcagcccgccgtgcagaacccgagcgatcccaaccgcgacatcctcttcaactggtccgagtacacgctcaatgactccggcctgtggatcaacagcacccaggtcgacatgttctccgcgccctacgcggtgggcgtgcagcggtccgacggcagcaccgtcaacaccggccacctcaagtcgggaggctacaacgggttcttcaccgctctgcgcggccagccgggcggctgggccaacctgatccagacccgctccgacggcaccgtcctgcgggcgctgtccccgggccacggactggagaccggggcgctgcccgcttccgtcatggacgactacgtcaaccgcgtctggcagaagtacagttcgtcgacgctgacggtcaccccgttcacggaccagccgaacaccaagtactacggccgggtgtcgggcggcgtcatgaacttcaccaacagtgcgggagccgtcgtcaccagcttccagaagccggacgcggacagcatcttcggctgccacaaactgctcgacgccccgaacgacctggtgcgggggccgatctcgcgcacgctgtgcgcgggcttcaaccgctccactctcatcacgaaccccaaccagcccgacaccacgacggccggcttctaccaggacgtcgtgaccaaccactacgcgcggaagatccacgcccagatggccgacggcaaggcgtacgcgttcgccttcgacgacgtgggcaaccaggagtccctcgtgcacgacggcaacccgctccaggcctacctcacgctcgacccgttcagc

SEQ ID NO: 1043 - DNA, 2049 bp, Streptomyces avermitilis
  CDS (1)..(2049)
atgcacgggtactcgaccggaagcggtgacgagatcaccgcggcccccggaggactgctggacctgttgcaggtcgccgccgtggttctgaacggcgacggccgcatcgtgctgtggagccccgaggctcagcagctgctcgggtacgccgcggaagaggcgctggggcgctacgccgacgacctcctggtgtcaccggacagccagcagcgggcccgggagctgttcgcgcaggtgcgctcgggatccagctgggccggagtcttcccgctcctgcacagcgacggcacggaacgccgggtggagttccgcaccatgcggctgcacgacatccacggacagatgcacctgctggggctggcggcgaacgcgacgaccgtccggggcgtggaacgggatctcgccctgtcgcacagcctggtgaaccagacgccggtgggcatcgcggtcttcgacaccgagctgcgctgggtgggcgtcaatccggccctggagcggatcaacggtctgccggaggaggcggtactgggacgccgtgtcggagaagtgctgccgaatctggacgtcgaggtcatcgagtcccgcatgcggcacgtcctggtcagcggcaaatccctgctcgaccagcagaccgtcggccgtacgccagccgacacgcaggaccgggcctactcggagtcgtaccaccgcatcgaggactccgacggccgcgtgctcggtctggcgatggccgttctggacatcaccgagcgacagcaggcggcagccgaagccgcccaggcgcgcgagcacctcgccgtgatcgcggacgcgggcgtacgcatcggcaccacactggatctgtcgcagaccgctcgggaactcgccgatgtggcggtaccgcagctggccgacctggccgccgtagacgtgctcgaagcggtggtcgcccacggagtcaccgccgccgtcacgggggaagcgcacgcggagttcagggcgctggccgtcgcggccggttacctcaccgacgcgatccacgcggcggacccggtgggggagctggcctcctacagctcgtcccgcatcatcacccagtgcgtccgtgaagccaggcccatcctggtggaacatgtcgacccggggatgatgcggcgcatcgccagggactcccacgccgcccaggcgctgcgcgtcgccggggtccactcctacctcgccgttccgctggtggcccgcggtgaagtgctcggcaccctcagcctgtaccgcaccatcaacgcgcgccccttcgacgaacaggaccgcgtcctcgcctcggaattcgcggcgcgcgcggcgatctgcgtggacaacgcccgcctctacggacgcgaacgaagcgcggccctcacgctccagcgcagtctgctgccgcccgcgcccgcgcagcaggagggcctcgacatcgcggcccgctacctcccggcgctgagcgaggtcggcggggactggtacgacgtgctgccgctgggccgcggacggacgggcctggtcgtgggggacgtgatgggcaagggcgtccaggccgcggcgatcatgggccagttgagcagcgccacgcgcgccctggcccggctcgacctgcccccggccgagctgctgcgccacctcgacgacatcgcgggctccctcggcgatgcgatcgcgacctgcgtctacgcggtgtgcgacctccggcagggcacctgcgagctctccagcgccggccacctgccacccgtcatggtccggcccgacggcggggcggaactcctcgacgtccccggcggcgtaccgctcggcgtcgggggcgtggacttcggcaccgtgcggcacgagctggcgccgggcaccctgctcgccctctacacggacgggctggtggagaaccgcacggagtccatcgacaccggcatggggaccatgacgcgccttctccagggcgcccggaactcgctggaggcgaccagcgacatgctgctgagcgcgctgcggcccgagcccgacgacgacgtggcgctcctgctggtccgcactcgcgccgaaggg

SEQ ID NO: 1044 - DNA, 735 bp, Streptomyces avermitilis
  CDS (1)..(735)
atgagtggtccaccgccttccggcccgtcctcagcggacggcacgtccgacgaagcctggccggagctcgccgaccggctggccgtcatggcgcgggatctgctcgcgcaggagtccctccaggccaccgtcgaccgcatcgccttccacgcggtcggtctgatcgagggatgcgacgtctccggcattctcaccctgagccgcaagaacgtgcagacactcaccgccaccgacgacgtcgtacgcaggtccgacgcgatccagggcgagctgggcgagggcccgtgtttcaacgccgtcaccgacgaggaacccgttcagcgcatccccgacctgcgcaccgccggggaccgctggccccgctacgcgccgcaggccgcggagctgggcatccgcagtgccatgggattccggctgttcacccgccaccacacgctgggcgccctgaacctgtactcgttccggccgaacgccttctccgagcgtgacgagcacctgggctggctgcttgcctctcatgccgccgtcgccttcgcctacgcccgcacggaggagcaactacagaccgccctgcgctcgcgcgacgagatcggccaggcgatcgggatcgtcatggaacgcttccacctgggccaggacgaggccttcgagctgctgaagaagacatcgcaggacctgaacatcaaactgcgggacgtcgccaccaagatcaccccgtcggacggaactccgggc

SEQ ID NO: 1045 - DNA, 441 bp, Streptomyces avermitilis
  CDS (1)..(441)
atgaccggacccgccaagaacctgcctcagctgttcctcgaggcgaaacgctggttcgacgacgcgctgctggccagcatgcgggcggcgggcgagcagccggtcagcatcgcccagggcgccgtcttcgccgtactggacgacgaggggacctccatctccgagctcgcccgccggatcggcatcacccgccagaccgcccaccaggccgtgcacgggctgatcggcatggggctgctggaacaggtgtcggatcccgcctccgcccgcagcagcctggtccgcaccaccgcggaagggacccgagtccaccagcgcgcccagaccgcgctcgcgctcatcgagcaggtcctggccgaccggatcggcgccgacgcggccaccgccctgcggcgggccctgagcgagccctgggggcagcccccctcggtcgaggcgccc

SEQ ID NO: 1046 - DNA, 435 bp, Streptomyces avermitilis
  CDS (1)..(435)
atgacccagaaccgcaacgttgacggtgtgcccgagggtcggggcatgacacccgcagagttccgggtcgtgcgggagttcctgggcctgaccggcggctggctggccgagcacgtgggggtttcaccgaacaccgtggagcggtgggagcagggcgaggagcggattcccgcggccgtccgaggggccctcggagacctcgggcgactcaccggggagttcgtcgccgaggtggtgaacagcctggtggacctccccgagcccgggatcgtcacctaccgggacgacgccgaataccatgccgcccacccggaatccggttatccggccgcctggcaccgcgcggtggtcgcgcgtgtggcccaggagattcccggcctctccatcgcctacgcgagcgacgtcgtctccgaggacgtgaaggtgtccgcggag

SEQ ID NO: 1047 - DNA, 1563 bp, Streptomyces avermitilis
  CDS (1)..(1563)
atgtccggagaccagcatgccgccacgaacggtttcgtcgcaccacccatgccgtccgccccgccgcccgccccgccggaccgcccgcgtgccgccgccgtggcgctgctcaacctcagtggcctcggcatcggttacgcgctcatccgccgctgggtcccgatggccgcgtgctggatcgcgaccggggtcctgctgttgctggcgctgcctgccgacccggacggtgtcggaggcggcctgctcaccgtgtacgtcgtcgttctcctgctggccgcggtgcacggcgcgttcgtcggcctgcgtacccggttggtctggcccccgcggtctcctgttgccgtccttctcggcctggccctcctcgccgtaccggtcggcggctccgtcctctatcggtcggcgcgggaggaggccacccagcagatgctcctcgaccggctcgagcgcgccgacggcctcgtccggagcggtggacagaagtcgttcggcaccgcccagtccgactaccgcgaagcgctgcgcgtctacggcgggctcagagccgaccacccggactcccgcgcggcccgcaaggtgccgggccggctcacgtcgttctacgagacggtcggtgccgcctatgcgcggaaggactactgcgccgcgatagcgccgctcacgtatctgcgcacggttccgcggaccctggacaagaaggatctcggctccttggcggcctggcccgacgaccgtctggccgcctccctctacgagtgcgggacggacggcctcgccggggccgacgtgacctgggaagggcacttcagcactctcctgaccaccttccccgactcgccgcaggccaagaagatcgagccggaggtccgcgcggccgtcgacaaggaggccgggaacctgcgcggcagcgagccgtgcgcggccgtcgagcggctgcagggtctcagctcccaggtggcccgcctgccgggggacaaggccggcgtggccgatgccctcgcgcgggacgccggccgggccggcaagagcgcggacgcgggggcgtacgcctgcggtgtggaccagtacaaggacggggaattcgacgcggcgcgcacgacgctgagcgagttcgccgacagcaataaacacgacaagaaccgggcacgtgcccgaaagatcgccatcgccgcggaggtcgcgctcaaggtgcccgcagcgggcaagcgcctgcccacgacggcgtccggcggaagcatctcggtgaccgtcaagaacgacagtcccgacgacatcacggtcctgtacacgggccccgtgaccggaagcttcaccctcaagggctgcggcggctgcacggcgtactcgaccgccagcaccctcctgctgggcttcaacccctgcaacgacagcggcaagcactacccgcagcggacgatcactctgccggtcggcaccacgtacttcctgcacaagccgatgggcgactccagcgcgactcccgcgtccgacacggccaagcttcggtccggttacctctacacggagtgcgcctacacgacgaaggggttcggcctgggatct

SEQ ID NO: 1048 - DNA, 921 bp, Streptomyces avermitilis
  CDS (1)..(921)
atggccacacctgtgcgccgaatgccaccgatgcgccgcaggcgcgccttcgacctccggtcgacggccctgttcttcggcctgctcgccgttgtcctgagcgtcgcgggtttcgccgtccgagccgcggcccgtgtggtcgaacagcgcccgggactggtcatgatcctgtgcctcatcggggtaccggcagcggtcgtctgccgacaaggccgccggcggttctccgcggccagggcggcacgccgggtcgccgccgcactcgacgacgcaacgcatacggcgctggacgcgctggaaacggcacagcccgtcgctcccgctcccgctccggtcccggaccgactcgcgacgcccgtgcccacctcgcgggacaccaccgtggtcattctgcccggcgaggccgaagggaccgtcgagctcgaaacgatcgaccacgaagcgatcgaccacgaagagttcgatgacgacgcgttcgattacgacgccctggacgccgacgagttcgagcaggccgtagcggcgctgtgtgagcgggacggctgctccgacgtcgaagtcgtcggcggggccggagacctcggcgccgacgtggtggccacggccccggacgggcgacgcgtcgtcatccagtgcaagcgctactgcgacaccaacaaggtcggctctcaggaccttcagcgattcggcggcacctgcttcaccgtgcaccaggcccaggtggccgtcgtgatcaccaccagcgacttcaccactccggccaccgagtacgccgaccagtgcgggatcctctgcttcgaccggcaggccctgctggcatggagcgacggcacgggcccgcagccgtggggagaggaggtcgccgtcggcgacccctgggccggcgacgggcccctggagggcccttgcgcgcggcagggc

SEQ ID NO: 1049 - DNA, 957 bp, Streptomyces avermitilis
  CDS (1)..(957)
atgggaaccgccgtgcacgtcccgcagacccgggacatgatcggggaggagctctccggcgacgaggcgctgaccgcgttgcgtcgctacggcggcctgcgactgctcgtcgactcgttcgcccggttccgttacgccgacggcttctcccatgcgcgcgccctcgggttccaagtggtgctgggcatggtgccgttcacgatcgcgctggtcggcgtcgccaccacggtgcacacggagagcgtcgggcagatcgtcgaactcactctcgcccggatcgtgccgggtgccagcgccgacgtggtcaaggacgccctggccgggacgcgtcgcaccgcccacgccagcctctggagcaccgtcgcactgtgggtcggcctggctttcgccgtgctgaatctggcctcggcgatgggccaggtcgagcgaggtgccaaccgcatctacggcgtcgagcaagaccggcccgccctccacaagtacggccgctcggtgctgctcgccctcgccgcgggcgtgcccatggtcctcggattcctggtcctcgtcgccggccgggccgtcggtgaatcggtcgtggaggcgttcggctggtcccacggccggctcgactggtggggaccgctcgaagtcccgctcggagcggcgctcgcctggatcgcttccgccgtgatcctgcggtggtcgccgcgccgggtgcagccgggctacacctggcttgccttcggctcagcggttcatctggtgctgtgggtcggcgccacctggctgctggcgctctacgtcgccaagagcggttccttcggcgccctctacgggccgctcaccgcgttcgtcgcgctgctgctgtgggccaatctgaccggtgtcgcgctgttcctcggcatcgcgttcgccgcccagctggaggccgcccgcgccggtatcacctcggccgtgaaaccggatcccgggcca

SEQ ID NO: 1050 - DNA, 1209 bp, Streptomyces avermitilis
  CDS (1)..(1209)
gtgacttacgacgtcggcgcgcttcgcgcgcaattccccgcgctgcgggccggtaccgcgcacttcgacggcccgggcggcacccagatacccgagccggtcatcgcggccatcgcggatgccatgagcaacccgttgtcgatccggggcgcggaggtgctcggcgagaccaatgcggagacgatcgtccaggagttccggcaggcgatggccgacctgctgggcgcggccgccccgggcatcgtcctcggccgcagcgccacgcagttgacgtacgacttctcccgcgtactcgccaggacctgggcacccggtgacgagatcgtggtcagccggctggaccacgacgccaacatccgcccatggctccaggcggccgaacaggccggtgtccatgtccggtgggccgacttcgacccggccacgggcgagctgcccgccgcggccgtgggcgaggtgctgtcggaccgcacccggctggtcgcggtgaccgccgcctccaacctgatcggtacgtgccccgccgtcgcggagatcgccgacctggtccaccggtccggtgccctgctctacgtcgacggagtgcactacgccgcgcacaacttcgtcgatgtcacgcagctgggggcggacttcttcgtgtgctcgccgtacaagttcttcggaccccatcacggggtcctcgcggcctctcccgaactgctggagacgctccgccccgacaaactgctcccctccaccgacgccgtcccggagcgcttcgaactcggcaccctgccctacgagttcctcgccggcacccgggccgcggtcgacttcctggccggccttgccaccggcgccgccgtcaccggagacagacgtgatcgcctgcggtccgcgtacgccgccgtggaacggcacgagaccgcgttgcgggagcgcatcgagaaggaactgtccctgctggacggtgtgacgatccactcccgggcagccgagcgcacccccacgctgctgctcacgttcgccgaccgcagcgcgacgcgggcctaccacttcctggcacggctgggcgtccatgcgcccgccggatccttctacgccctggaggcgtcccggcatctcggtctcggggacagcggcggtctgcgggtgggcctgtcgccctacaacgacgcgagtgacgcggagcggctcctggaggggctcaccgcgttcctggcctcg

SEQ ID NO: 1051 - DNA, 876 bp, Streptomyces avermitilis
  CDS (1)..(876)
atggaaaggtacgcatccgcggtctccggggtgcgcgaacggctgggcgcgatgcttttcagccgtgtcgccggccccgaggggcccgcgaaccgcgaccgcatccatcacgctcccgggcctcgctggttcgggccggaccggcccatccggaccgtccacggcgacgcctcgatgtacatcggaggactgcgcgccctcctgctgcagtctctgcatcccttggcgatggccgcggtggccgcccactccggataccagggcgatccctggggcagactccagcgcaccagcacgttcctcgccgtcaccaccttcggaaccgccgacgacgcccaggcggccgtcgaccgcgtccgtgccgttcacgaggcggtacgcggcaccacggacaggggcgagccgtaccacgcggccgatccgcatctgctcggctgggtgcacgtcgccgaggtcgacagctttctccgcgcccaccagcgatacggggagcaaccgctggacgacgccggctgcgacgggtacgtcgacgacaccgcgcacatcgcagccgccctcggtgtgctgaatccaccgaggaaccgtgcggaactggtcgagcggctgcacgcgtaccgtcccgagctgcgggccacggcggaggccgcagcggcggcccgtttcctcctcctccatccgccactgcccctggccgtccggccgccgtacgccgtcctggcggcgaacgcggtcgccgatctgccgccatgggcgcgcggcccgctcggccttccgcgggtcccggtactcgagcccaccgctgtccgactggccggccacgcactgacgaggaccatccggtgggtgatgaccgcaccctccgcgcccaggccgacc

SEQ ID NO: 1052 - DNA, 285 bp, Streptomyces avermitilis
  CDS (1)..(285)
atgacgagttacggcagtccctccacggcctcctccggatcgcgcaccaacggtcttgcgatcgcgagtctcatctgcgggatcgtcggggttttcttcctcagcgtgatcctcggcccgatagccatcgtgctgggcgtggtcgccctgcggcaggcggggggcaagggcggtggcggcatggcgaaggccggagtcgtgctgggcatcgtggacctgatcctgttcgcggttttcatggccgtggccgcgtccaacggtggtttcgcctggtacgtcggaggc

SEQ ID NO: 1053 - DNA, 1212 bp, Streptomyces avermitilis
  CDS (1)..(1212)
atgctcgagtcggttgcagctgaaccccggcgcgccgcggcgacggaccaggcgggcaccgaggcacgcaagcagcgtctgcgaagacgtctggagagactcatcggtatcgccgcgaccgagggcaacgagctcgtacccctgcgcaacggtgacgagatcttccccgccatgctccgagccatccgtacggccgagcacaccgtcgacatgatgacgttcgtgtactggcgcgggcagatagcgcgggacttcgcggccgcactggcggagcgtgcccgcgcgggagttcgcgtgcggctgctcctggacggcttcggtgccaagcagatcgaggagggcctcctcgagtccatgaactccgccggcgtagaggtcgcctggttccgcaaaccgctgtggctgtcccccctcaagcagaaccaccgctgccatcgcaaggtgctcgtcgtggacgagcacaccgctttcaccggcggcgtcggcatcgccgaggagtggggcggcgacgcccgcaatccctccgaatggcgcgacacccatgtgcaggtccgcggtccggccgtcgacggcatcgccgccgccttcgcccagaactgggcggagtgccacgacgagctgttcgacgagcgggaccgcttcaccgagcacgagcagtccggtcgggcaaccgtccaggtggtccggggctcggccagcttcggctggcaggacatgcagaccctcgtccgggtcatgctcgcctcggccgaggagcgcttccgcctgtccaccgcctatttcgcgccggacagctacttcgtcgacctgctgtgcgcgaccgcccgccgtggcgtacaggtgcagatcctgctgcccggcccgtatacggaccagcgggcgtgccggctcgccggtcagcactactacggcacgcttctggatgccggggtggagatccgccagtaccagccgacgatgctccacaccaagatcatgaccgtggacggggtcgccgccctgatcggctccagcaacttcaaccgccgctcgatggagcacgacgaggagatcatgctcgccgtgctggacgagaccttcacggcggccctggaccgggacttcgaggaggaccgggagcgggccgaggccatcgtcgcggcacgctggaagcaccgctcccctgtgcagcgcctcaaagaggcgatcgtcgctcccgtacgccgtttcctc

SEQ ID NO: 1054 - DNA, 1071 bp, Streptomyces avermitilis
  CDS (1)..(1071)
gtgtctgcagcgcgaccggccgactgcgctgaaccggcggtgccggtccggcgcccgtgtcccggccgtccgtaccgggacctcagttccgcaccgggcaccgccgttcgcgccgagccgacgactccgctcccgcccttcgccctccgcacctgtgcgtgccagaccccggggagagacatgtccgtcaacgccttgaccgcagttccgtccgcacgatccataccggccacgtcggcctttcgggggaggatcggctgcgacgcgcgcagcggccactatcccgtgccgggccggtatcgcctccacctgtcgccgtcgtgtccgcactgtctgaagatcgccgtcgcccacagcctgctcggactcgaggacgcctgcccggtgacgctgctgcccgcggtgcccgacggacccggcggagagcactccgcgctacgcccgctgtacgaggcgagtgcgcaccggtatgccggagccgccgtggcgccggtgctcagcgacgactggtcgggccggatcgtgagcacgcacgcgccggacatcatgcgcgacctggcccggcgtttcggcggggagcggcctccgctgtacccgaagggcatggaggcggagatcgaggccgtcggacatctgtgtgagcagggcatcaacgcgacggcccagcgggccggacgcgcggatgccgacgacgcggagcgggacagcgcgctgggctccctgctgcgcacgctgcgttcgctggaagggcggctggcccgccaggactacctcctgggcgaccggttgaccgcggccgacatcgagttgtgggtgagcctggtgcagctcgacaccgtgcaccgctggcacctggacgcctccgctgtgcaccgcgtcgccgatcacccggcgctctgggcctacgcgcggcggctggccggcgaccccgccttcggagcccacctcgatctcgacggcatcgcccgccggcatcacgcacattgccgtgggctggaggccgcgggcgccgcggtacagatcgtggagtgggccgcacacgcgccggacaggaccgcctcgcggcagggg

SEQ ID NO: 1055 - DNA, 567 bp, Streptomyces avermitilis
  CDS (1)..(567)
atgcgggtacgcggtcaccaagtgctgatcctgacgtgcgcagcggcgctgctgggggcaacggcggcctgcggcggggcagggaccgccacgaagcggcccggcaccgcccgcaccgcaccttcacatgcccgcttcgacgcggagatctcgctgcccgacggccgccgcgtaggcatgtactacgccaccggacgcggcctcgtggagcagcaccggggcaccggcagcgcggcctggagcacaccgcatctgctgcaccggaccacgtccgatccctgccagagcctgcggctcaaggcgttcgggaccacggtcgcggccatcgcgaactggggggtgtactgcgccgacggtgaaccaccgacggagtccctcgccgcggtcggtaccggaaacctctcggagtgggacaccgatgtcacccccgacttcgacggttgggatgccgtgaaggcctcggaagagacgggcgagctgagtttcaccaatggctccgtcgagtcggtcacgaggctgcgctggcgccggacggaggggttctccgacgtggaggagatcccccgg

SEQ ID NO: 1056 - DNA, 678 bp, Streptomyces avermitilis
  CDS (1)..(678)
atggatctcaagcacgccgtcgcagtggtcaccggagccaaccgggggctgggacgccatatcgcggagcagctcctcgagcgcggcgccacggtgtacgcggcggcccgccgaccggagacggtcgacctgcccggcgcgatcccgctgcgtctggacatcaccgacccggagtcggtccgggaggcggcccgtacggcatccgatgcgacgctcctggtgaacaacgccggtatctcgacgcacacgcagctggtttccggcgatctggagtccgtgcgcctggaactggagacgcacttcttcggaacccttcagacgacccgggccttcgccccggtcatcgaggccaacggcggcggggcgatcctcaatgtgctctcggtcctgtcgtgggtgcacccggcgggctacggcgcctacagcgcgggcaaggcggcggcctggtcgctgaccgactcggtacgcgaggaactggcgccgcgcggcatcaccgtcagcgctctgcacgtcgggtacatggacaccgacatggccgagtacgtggccccggagcagaagacggcccccgcgctcgtcgccgcccaggctctggaggggatcgagaagggcctgccggaaatcctggccgacgatctgtcgcgtcaggtcaagcagcagctgagcgcggtggccggc

SEQ ID NO: 1057 - DNA, 555 bp, Streptomyces avermitilis
  CDS (1)..(555)
atgggccgcgtatcgaaggaacaggcacgcgagaaccggcagcgtgtcgttgccaccgcctctcgcctgatgcgtcaacagggcaccgacggtgtcagtgtcgccgacctgatgaaggccgccgggctgacccacggcggcttctacaagcagttcgcctccaaggaggccctgatcgacgaggccaccgcgcatgccttcggcaccgtggaagaacagctcggcgacgggctccaggcccatgagggcgactccgccgcagctcgcacagccttcatcgaccactacctctcccccgagcaccgcgacgacatggccgacggctgccccacggccgccctcgccgccgacatggcccgcggcccggaggaaagcgccgcgcacgagacctatgtcgagggagtgcgccgtttcgccgctcggctcgccggcgccgacgacgacggcctcgcccgtctgagcaccctggtcggcgccctcgtcctcgcccgggccgtcaaggacgacccgctctccgacgacctcctcgaggccgcccgccgacagctgctcccc

SEQ ID NO: 1058 - DNA, 1038 bp, Streptomyces avermitilis
  CDS (1)..(1038)
atgatccggttcacgatgatgcccggcgaggacggcgactgcctgctgctggagtacggcgacggcaccttcctgcgccggatcctcctcgacggcggccgcagcggcacgtatccgcgcatccggcccacactcgcgggcctcgacggtctggtcgacgtcctcgtcgtcacccatgtcgaccaggaccaccttctgggcgtgctcgccctgctgaacgaccccgacagatcggtggagttcggggacgtgtggttcaacgggttcgatcacctcctcgagttcgaggggttcggtgctcaggacggcgagaagctcaccagcgcccttgtggagcagaagctgccgtggaacgacgcgttcggcgggctgagtgtcgaagtcgggcgggagctcgtgtggttcgacgacggatccacggtggacgtgctctcgcccgaccgcggtcaactggagagcctggcgccggactgggtcaaggaatgcgcgaagcacggcctgatcccgggccgcgatcccgacgagatccccctggtgcccggcttcgagcacttcgggggagtgaacgtggaggagctggccgcacgcccgttccggccggacacgtcgaagaccaacctcacgagcatcggcctgctcttcgagttcgagggcaagcgcatcatcctgaccggtgacgccgacgaccggcggctggtgcggtcgatacggcccagggccgaggcggagggcggacgcctgcacgtcgacgtcctcaaggtggcccaccacggcagcgatcacaacctctcgaaggacctgcttgatctgatcgactgcgaccgctacctgatatcgaccagcggcgcccggcacgaccaccccaacgccatcgccgtcgcacggatcctcaagcacggcggcgcgaagaaggagatcgtgttcaactaccgtgatcgcgcggcgatatgggacgtcgacagcctcaaggaccgcttcggctacacggtgacggcaccggcaccggacgctgaggacgggttcgtgagcttcgagctg

SEQ ID NO: 1059 - DNA, 1278 bp, Streptomyces avermitilis
  CDS (1)..(1278)
atgagtggctgcctgagcgtgaccgtcgcgctggccctcgacgaatccgacctctccgccggcgccaaggtcgtcggcaacatctactcgaccgacggcaacggtgtcacccatcgcaacgtcgtgttcccctgcgggatgtcggccgtgccggcgcggtacgaggtcgatcccggccggtacatcgtgtcggccacgctgccgtcaggcacggtgctttccagggatgccgaggccagggagggcgaggacaccccggtgacgctgcgcacggcgccttcgccctacgcgtcacattcctggcagtacctcatgggcaacatcgaggcctacgagacctatcacgacagtgcgacgattcctgtgccccggtcccgggggtcgcgctccggggtgtgggaagggctcgtccaaccggggcacgcggtgttcgtcggcgacccgaagcccacgagttaccacttcgactcgatgctcaagctggccgacgggccggccgaacggccgaccgtcttcgagatcgcccagtccgcgccccggtccgttcccagtctcgcgctgggtgacgcggccgcacgcctgtaccggttcggcgcgcacggaccggtcgacgagcacggcacgcccacacggtggggcgggcccacgggccctcggcagttcctggtcgtctcactggccggcaaggagtacgtcgtcaccctgccggcgccatggggctccgcgcagatcgaggtgctggtcaacgagcgtcagagtcccaccggcagcgcggtctcggtggccgtgcgggaccgccgggtggggcccgccctgggatacatgtcccgaggcgccttcgacgcggcggcgaccctggtcagggacgcggaggcattgctctacgccaagatggagaacccgctcgcggcggtggcgggcgcgtacgtgctggtcggcagcgagctgacggaacgtccacagcgctgggacccgtggctcgaccatctgcggcacgagttcgactggatgggcgacggatccctgctgtgggccatgcgccagctgcgccgggcgcacaccgagacgcagttgcgggcggcccgcgacgggctcgtcgaggccttcgaccgcggtgtgccggtcttcaccctgggcctgagccggctcatccacggactctccgaattccccgacgaccccgagtgcgctcggcggctcgaccaggctcgccgcctgtcgtggcgtgtcgacctgcgcgagcccttcgtgatcgtcgccctccgagggagaccgcaa

SEQ ID NO: 1060 - DNA, 1170 bp, Streptomyces avermitilis
  CDS (1)..(1170)
atggccggttctgtgatccacctcgatgagaatgccgggcctccggccacccacggactggtcgtcggtgtcggcaaatacccccatctcgagggcggcgaggctccggtagcggattcggacggcatgcggcagctcagctcaccgcctctctccgcccgtgccttcgcgaggtggctgctcgccgagtaccacgacccgcagcggccgctcggcagcgtctcgctgctgctgagcgaggaacagccggccccgttcgtgaacccccgtaccgggaccgcccacgaggtcgaggtcgccaccatcgacaacatcctcgccgcggtcacacagtggtacgaccggggcgacagccacgtcgacaaccggctcgtcttctacttctgcggacacggcatctcgcagggcgacgacatggcgctcctcgccgccgacatcttcgccgacccgcacaaccccctcaacggcgcactggacttcgcgggcctgatgaacggactcaagcgctgcaaggcctcccagcaggtcttcttcctcgacgcctgccgctccaactccgacgtgctcatcgaggcttcgggcacgcgcttcgccggacggacgccgctcggggcgggggcccgaccgctggaccttccccgacggttccacatcccttactacgccaccctgtccggcgaccagtcgcacgcccggcccgggcaggtgagcctgttcacggaggcgctgctcaagagcctcgccggtgcggcgagcgacgaccccgaaggcgactggcgggtcaacaccgcccatctgctggaggcgatcgaccacttcatgcaccagccctgcttcgccggcatggtcgcgggcgtccaggtccccgcggtgggtgaactgccggtgttcgtcctccaccagctggccggtccgccggtcgtcccggtctacgtgggctgcgaccccgcacaggacaacgcggaggccgagttcgtgtgcctcgaaggcggacgcgagcggctgcgccggacactgaacgacgtcgacgacaccgatccggagagcgaatgggccattgaactgagcttcggcgactacgacttcgaggcgaggctcggcgagcgggacgtacggacgaagaccatcaccgtccgcccggtgttccgccgggtgcacctggtgaagtca

SEQ ID NO: 1061 - DNA, 1164 bp, Streptomyces avermitilis
  CDS (1)..(1164)
atggccgagaaccccggcggcaccaatctggtcgtctgcctcgacggcacgggtaaccaattgaaggcgaaaggaaataccaacgtcatccggctgtacgagatgctggacctcgccgaccccgaacggcagatcgcgttctacgaccccggtgtcggcaccttctccgccgcgggcgcgtggacgcccgtcagccgccgtctctcgagactcttcggtctcgccttcggctccggaatgaagaccaacctggccgaggcctacacgtacctgatgaaccattacgcgcccggcgaccgcatctacatcttcggtttcagccgcggcgcctatacggcacgcgcccttgtgggcatgctcaagacgatcggtctgatgcggcccggcatggagaacctcgtgccgtacgccgtgtccgtctacgcgaagaacaaggactggacccagaaggactgggaccaactccaccacttcgcgggcgccttcagcaacgcggtcgacgggcggatcggcatccccgtccactacctcgggatctgggactccgtgaaggccgcgggtgtcctgcggtggaacctgcggtggccgtacacccgtcaactccccaacgtccgaaggatccgccacgccgtgtcgatcgacgagaagcgccggccctaccgcgagtacctcgtcacggcgggcaccaagaagcagacggcgccggcctcggtcgagcaggtgtggttcgccggtgtccactccgatgtaggcggcaccttcgacgacgacccgcggctgcccaccgtctccctcaagtgggtcgtggacggcgccctcgcggcaggcctcctcgtgaagaccggggcgtacgcgcgtgaggtgaccctcggacccgagcacgcgctgggcgaggtgcaccggatgggccggatctgggccctgctcagctaccggcaccgcagggtcccgccggacgcgcatgtccacgcgagcgtgcgggcacggctggcaggggatccgggctacggggaccggatcccggcgacggcggtctgggccgacagcgactggctcagcccctcgccggaatcggcgccgcggcgggcgacgcccgacgacggaacccgagccgcctccggtcccctcggcggacgaacggcggcaaggcgtccgccccgctgg

SEQ ID NO: 1062 - DNA, 378 bp, Streptomyces avermitilis
  CDS (1)..(378)
gtgtcccggtcggaacgctcatccctgctactcgccggcctgttggccaccgcgggcgtcgctcacttcgccgcaccacggcagttcgacgcgaccattccgcgcgctctgccggggaagccccggacctggacgtacgcgagcggcatcgccgaactggcgctggcggccggggtggcgctgccccgtacgcggcgtgccgcggcgctcgccaccgccgccttcttcgtcggcgtgttccccgccaacgtccagatggccgtggactggcgtcaccgccccgcacccctcaggaccgcggccctcgcgcggcttcccctccaggtgccgctcgtgctgtgggcgcgtggcgtggccaagggcgcggagggccggtca

SEQ ID NO: 1063 - DNA, 465 bp, Streptomyces avermitilis
  CDS (1)..(465)
atgacgcgtcgtgtggatgtcggcgacaaggtcgaggacttcgtcctgccggacgagaccggtacgccccggcaactgtcggacctggtcgccgacgggccggtggtgctgttcttctatcccgccgcgctgaccgccggctgcaccgcggaagcatgccacttccgggatctggccgcggagttcgccgccgccggcgcgcggccggtgggaatcagcggtgatccggtcgaccgccagcaggagttcgccggacagcacacgctcggcttcccgctgctgtccgacgaggacggaacgatccgtgagcggttcggcgtgaagcgcggcttctccctggcgcccaccaagcgcgtcaccttcgtcatcgccgaggaccgcacggtcctggaggtggtgcgcagcgaactgcgcatgagcgcgcacgccgaccgggccctcaccgccctgcgcgcgcaccggagc

SEQ ID NO: 1064 - DNA, 1281 bp, Streptomyces avermitilis
  CDS (1)..(1281)
atgagcgctgcctcgtaccggcgccgggcggcgggcgtcgtctcagcggtgatcctggcggtctgcggacccctgacggtctcctcgtcggcgcagacgcaggcgcaagcgccgacgggcacggcggggaccccggccgccgcgcagtccaagcactccgtggtcacctggggcgcgagtgccgaccggcagagcgccgggcccgccgaccgcagttaccggttgatcgtgcgcaccagcgtcggcggcacgaacatgcgtatccggctgtccaacgccttcggtgaccacccggtgaccttcgcgaacgcgtacgcggggctgcggaagcagggtgcggagctggtccacggctccaaccggaagctgtccttcgacggggccgcgtccgtcaccgtcccggccggtgagaccgtgctcagcgatccgctgcccggaaagctggccgctcagagcgatctggtcgtcagcctgtacgtgacaggcgcccagggaccgacgaccggtcacgggatggccatgcagaccaattacgcgaccgcgggcgaccacgccgccgaggagggcgcggccaactggaccgacccgatgggctcctggtactggctggacgccgtcgatgtggagacatccacggcggtcagctcggtggtggccctcggcgactccatcaccgacggatgggcctcgaccacggacgggaaccgccgctggcccgactatctcgcccgacggctccaggccgcgtccggcagcactgtgaagggagtggcgaacgagggcatttcgggcaacaaggtgctcgcggacggcgccggtgaggccgcgctgaagaggctccagcgtgatgtgctctcccagcccggggtcagcacggtgttcctgttcgaaggcatcaacgacatcaaggcccactccggcgtcacggtggaggacatgatcgccggctatcaggagatcatcgaccgggcgcacacggcgggcaagtgcgtcgtcggcgcgaccgtcatgccgttcaagggctggtacgagtacgacgacgcctccgaggccgtgcgccagggcgtcaacgactggatcaggaacagcggcgcgctcgacgccgtgacggatttcgacaagatcacgcgcagtccgtacgaccagcagcggatcctgccgttcttcgacggcggcgaccacctgcatcccaacgacaaggggatgcaggcgatggccgacgcggtcgacctcaaggcgctcggctgccgggcgacgggcgggacacaggcagcgcgcggc

SEQ ID NO: 1065 - DNA, 2412 bp, Streptomyces avermitilis
  CDS (1)..(2412)
gtggacatccagcagaccgcaccacgcgacaacaaacccagccgcagaggcttcctcgctctcgccgccgccggcgcggccaccgcactcggtggtctgcccgccttcaccgcctcggcggcccccttccgccccaccgagtcgcccatgctgtccgcggccgacgccgcgaagaaccagctgtggtggggcgctcccggctcctcccactcgatgatcgagcaggggctgccggtcgggaacggacgcctcggggcgctcgcgagcaacgaccccgcccatgaacttctgatgatcaccgacgccaccctgtggaccggccatctcaacgacaagctccagagcgacggccagttcccctacggccgcgacgacttcggctccttgaccctgctggccaagctcacggtcgccatccccgaccacgacctgggaagcgtcgacaactaccgccgttccctggacatggcccagggcctggtcagcacctcgtacgacatctccggcgtgacctaccggcggcaggtcttcgccagccgccccgacgacgccatcgtcctgtacttctcccagcagggcggcggcgcctacacgggcaccgtctccctcgccggcacccacggcgagtccaccaccgccaacagcgcggggcgctacgcgtcgttcggcgcctccttcgccaacggcctgaagtacggcgccgccgtcaccgcccacagcagcaccggcagggtccgcgtcgacggtacgtcgatctccttcagcggctgcaaggacctcaccgtcgtcgtcagcggcggcaccaactacgcgtccgacgcggccgcgaagttccgcgacccttccgtggacccgcagcgcctcgccaggaccaaggtcctcaaggcggccggccacccgacgagcaccctgctgcacacacatgtcgccgacttccgcgccgtgttcggacagctggacatcaacctcggcacctcgtccgccgcgcagcgcgaactggacacctgggagcggctgcaggcacgccaccgggacgacctccccgacccggaactcgaggccgcctacctgcagttcggccgctatctgatgatctccggatcgcggggcagcctgccgatgggcctccagggcccgtggctggacggcaacgacccggactggatggccgactaccacagcgacatcaacatccagatgaactactggatggcggaccgggcgggcctgtccgagtgtttcgacgccttcacggactactgcctcgcgcagttgtcctcctggacggacgtcacccagcggctgttcaacgactccaccaaccgataccgcaactccagcggcaaggtcgccggctggaccgtcgccttctccaccaacccctatggcgggtccggctggtggtggcacccggccggcaacgcctggctctgccagagcctgttcgagcactacgagtacacccaggaccgcgcctatctcaagaagatctacccgctcctcaagggcgccgtggagttctgggacgcacgtctcatcaccacgaccgtcaccgacgcgtccggcgcgaagcgcgaggtcctgatcgacgacagcgactggtcgcccgagcacggcccgcaggacgccaagggcaacacgtatgcccaggaactggtgtggggcctcttcggaaacttccacaccgcttccgagctgctcgccaaggacgccgcccaccggaagaccgtcgacggtctgcgcgagcgcctgtacctgcccgtggtcagccccaagaccggctggctggaggagtggatgtcgcccgacaacctcggcgagaccacgcaccggcacctctccccgctcatcaacctgttccccggcgaccgcatccgtccggacggctccacgccgaaggacatcgtcgacggcgcgaccgccctcctcacggcgcgcggcatgaacagtttcggctgggccaacgcctggcgcagcctgtgctgggcgaggctgaagaacgcggacaaggcgtaccagctggtcgtcaacaacctgaagccgtcggtcaacggaaccaacggcaccgcgatgaacctcttcgacatctacgaggtggagacgggccgcggcatcttccagatcgaggcgaacttcggcacccccgccgcgatcgtcgagatgctggtctactcgcggcccggccatatcgagctgctccccgcgctgcccgccgcctgggcggcatccggctcggtgtccggcgtgggcgtgcgcggcggcttcgtcgcggatctcagctggaagaacggcaaggtcacccgggcgacgctgaagagcgtgggcggccgccgcacgaccgtcgtcgcgggcggcgcctcgcggaagatcagcctcaagcccggtgagtccgtcacgctgcggaacctcgga

SEQ ID NO: 1066 - DNA, 1824 bp, Streptomyces avermitilis
  CDS (1)..(1824)
atggggtcatcctcgtacgccgtcatacccggagccgccccgcgctccggccgccgctccataagagccgtcctcgtcctcgccctcaccgcgggtgtcgcgacggtcgtcccggccgcccaggcggacacgagcacgcccgccgccgctccggtcgccgccaagccgtacatgggctggtcgagctggagcatgcagtcgtcgaagtacccgggcctcaacccggacggcgactacagctatctcaccgaggcgaacgtcctgaagcagacggacgccctcgcctcgaagctgaagaagtacggctacgaccacgtcaacatcgacgccggctggtggatggacaagaactggaagacccagttcgaccagtacggccggcagacgcccgacccggtccgcttcccccacggcatgaagtcggtcgccgaccacatccactccaagggcctcaaggcgggcatctacctgcccgtcggcctggagaagggggcgtacggcgacggcaagacgccgatctcgaaggcccccggctgcaccaccgccgacatcgtctactcggacctgcgcaccaccaacggctgggacaacgcctacaagatcgacttcgacaagtcctgcgcgcagaagtacatcgactcgcaggcgcagatgttcgcggactggggctacgacttcctcaagctggacggggtgggcccgggctcgttcaagtccggtgacaactacaacaacgtcgccgacgtcgccgcctggcagaaggccatcgccgccaccggccgcccgatccacctcgagctctcctggtcgctcgacatcggccacgccgccgactggaagaagtactccaacggctggcgcatcgacaccgacatcgagtgctactgcaacaccctggtcacctgggagaactcggtcaacgaccgatgggacgacgccccggcgtggagcagcaaggcgggccccggcggctggaacgacctcgacgccatcgatgtcggcaacggcgagatggacggcctcaccaaggccgagcggcagagctacatgacgctgtgggccatcaacaagtcgccgctgttcaccggtgacgacctcaccaagctggacagctacggcgtctccctgctcaccaacaaggaagtcatcgccgtcgatcagaacacctcgcccgtcgcgcgtccggtcaccccggtcggcgaccagcaggtctggggcaccaagaacgccgacggcagctacaccgtcgccctgttcaacctcggcgactcgccggcctccgtcaccgcccactgggcttcgttcggattcaccggcaacgcctccgtgcgtgacctgtggaacaagacgaacctcgggacccacaagaacaagatcaccgaggcgctgcccgcacatggctcgcggctgttcacgatcaagcccggcggcggcaccctggcgaccacgggctacgaggccgaggccgcggccaacaccctgtcgggcaacgcctccgtcggcggatgtgacgcctgctccggcggcaagaaggtcggcaacctgtacaccggcggcaagctgcggatcaacgacatcacggtgaagaaggacgggatctacaccgtcaaggtcgcctacgtcagcggcgacccccgctcggtgaccgtcctgtccaacagcggtaacggcacgagcctgaagttcccctccacgggcgactggagcacggccgagaccgtcagtgtccaactggcactgaaggcgggctcgaacaccatcacgttcgacagcggcagcggatacgcacccgacatcgacaggatcgtcgttccgcagtccgtc

SEQ ID NO: 1067 - DNA, 819 bp, Streptomyces avermitilis
  CDS (1)..(819)
atgctgggcggcatcgccctgctgtggctcgtcccgctgctgtgggcgatgtacacgtcgctgcggccctactcggacaccgcgaagcacggctatctctcctggccccacagcctcggcttcgacaacttcacggacgcctgggaccagtccgggatgccgcacttcttctggaactccgtcctcatcacggtcccgtcggtgctgttcaccctgctgttctcgtcggcggtcgccttcttcgtctcccgcttcgacttccgctggaacatcgttctgctgatgctgttcaccgcgggcaatctcctgcccgcgcaggtcctcgtcaccccgctgtaccggctctacctcctcgtcccgctgccgcagtggatgagcgactcgctccttctctacaactcggcctggggcatcatcgccatccacatcgcctaccagtccgggttctgcaccttcctgctcagcaactacatgaagacgatcccgaaggagatctccgaggcggcgctcgtggacggcgcccccgtgtggcggcagttcttccagatcatcctgccgctgtgccgcccggcgttcgcggccctggcgacgctcgaatcgatctggatctacaacgacttcttctggccgctcgcgctgatcgagaccggcgacaagcgccccgtcacctccgccctggcgaacctccagggtgcgtacttcaccaatcccaacctcatcgcggccggtgctctgatgaccgcgatccccacactgctggtgtacttcgcgctccagcgccaattcatcagcggactcaccatcggttcgggcaagggc

SEQ ID NO: 1068 - DNA, 951 bp, Streptomyces avermitilis
  CDS (1)..(951)
gtgtcctccgcgccctccgtgtcctccgcgcccgcgtctcccgcaccgcgaaaggcccgcccccgccgcctcggccccggcgaccggatctttctgaccgtcatcatcggcatcccgctcgcggccctgctcttcttcgtctggctgcccgcactggcctccctgtggctgtccttcaccacctgggacggcatcgacctggtcgacatccactgggtcggcctggacaactaccaggagatcttcaccaactacccgccgttctggccggcggtgcggcacaacgtggcctggctgctgttcacggccctgctgcccaccccgttcggcatcttcctcgcctaccagctcgaccggaagatccgcttcacgagggtctaccagaccgcgatcttcctgccgatggtgctctccctggccgtggtgggcttcatctgggagatcatctacaaccccgacaccgggctcctcaacggcctcctgaacgcggccggttcgggccaccacatcgactggctcggcaaccccgacctcaacctgtgggccgtcctggtcgcctccggctggcggcacaccggctacatcatgattctctacctggccggcctgaagggcttcgacccggcgctcaaggaagccgccgcgctcgacggggccaacggacggcagaccttcctgcgggtggtcttcccggccctgagaccggtcaacgtcatcatcctggtcatcacggtcatggagtccctgcggtccttcgacgtcgtctacgtcctcggcggcggaatcggaagcaagccgggcatggagctcctgtccctcctcatcaccgacaacatcctcggcgagtccagtcacatcggttacggttccgccctcgcggtcgtcctgctcgtggtctcccttgccgccatcgggacgttcctcgtccagaacttccgcaaggaggaccag

SEQ ID NO: 1069 - DNA, 1341 bp, Streptomyces avermitilis
  CDS (1)..(1341)
atgacgcagcagagccgcaaccccctggctgcgcggggacccggccgtcccccgacggccggggtgactcccggccgccgctcggtggtcggcggggtgttcggcctcggcgcggcagtactgggcgcgccccttctgaccgcgtgcggcgggggagcgggggccgatccgaagacggtcaccttcggttccaacggcgcggacgccactcccaagtccgcctacgccgcggtgaccaaggcgttcaccaaggacagcggtctgacggtgaagacgaacaccgtggaccacgacaccttccagaaaagcatctccacctatctgcagggcaccccggacgacgtcttcacctggttcgccggctaccgcatgcagtacttcgcaaagaagaagctgtgcagcccgctcgacgaggtgtgggacaagataggcgccggtttcagcgacgccaccaagcagctctcgcgtggcgaggacggcaagtactacttcgtgccgctgtacaactacccgtgggccgttttctatcgcaagagcgtgttcaaggagcgcggctaccaaatcccgcagaagtggagcgagttcatcgcgctcgcgaagcagatgaagaaggacgggctctccccgatcgcctccggatacggcggcggcgacagctggagcattctcggcgccttcgactacgtcaacatgcggaccaacggctacgacttccacatgtccctgatgcgcggcaaggtctcctggaccgacaagcgtgccgtcgccacgctcgatcactggcgtgaactggccccgcactaccagcagggagccggtggccgctcctggcaggacgccgcccagtcgctgctcgacaagaagtccggcatggccgtcatcggactgttcctcggccagcagatcaccgacgagaaaatccgcagcgacatcgacttcttccccttccccgagatcgacgccacccacggccaggatgccgtcgaggcccccaccgacggcttcatgctcagccggcggcccaagaacgaggacggcgccaagaagttcctggagttcctcggcggggcccgcaccgaggaggtgtacatgggcgtcgacccgagcaacctcgccgtcaacgaggaggccgacaccggctcgtacaacgcgctgcagaagaagtccgccgacctcatcgcctccgccaagcacatcagccagttcgcggaccgtgacagcgacccgggcttcatctccaccgtcgtgctccccggcctgacccagtggctcggccaccccgacgacggcgcagggacgctgaagaagatcgagtcccagcgctcgcgtttcttcaccgcc

SEQ ID NO: 1070 - DNA, 1176 bp, Streptomyces avermitilis
  CDS (1)..(1176)
atgcgctcgacctctcgcaccgaggcgttcccggcccacacgccggccgccgcccagatcttcaccaccgtgctgtcccacggcccgctcacgcggtcggagatagcggggcggacccggctgtcggcggcggcggtcaccaaggcggtccggcctctcatcgaggccggctatctggtggaggacgcggacgacgacgcgcggcagccgtcgctagggcggcccgccaacccggtgcaggtcgacggagggcgggcgctgttcatcggagtgaaggtgacgggcgacgaactcatcgccgtactcaccgatctgtgctgccgcatccgggtcgcccggcatctgcccctgacgtcgcgcgaccccggggcggtgctcgcctccatcacggccctcgtacaggaactgctgacggaggcggacggcttcggcgtcgcggtccacgggctcggcatcgcggtgtcgggtgacgtcgaccgggccgccggcgtcgtgcgctactcgccctttctggagtggagcgatgtccccctggccgaactggcctcgctggccacggggttgccggtcaccgtcgacaacgacgtacgggcactgacggtcgccgagcagtggttcggcgccggggtgggcctgtccgacttcgcggtggtgaccgtcggcgccggcatcggctgcggtctcgtcgtccacggccatgtggtgtccggggcgcacggagtggccggcgagatcggccatgtggccatcgacccggccggcccgccgtgccactgcggcaaccgcggatgcgtcgaggcgatcgccgccgactcggcgatcgtcggcaggatccgcgaggtgaccggcatcgaggtcgccgacaccgcggaggccgtggacctcgcgcacgccggaaaccccggagcccgcgaggtgtacgcccgagcgggggacgcgatcggccgcggcatcgccacggtcgccaacctcctgggtcccgaacgcgtgatcatctcgggcgagggcctggccgcctacgacctgttcgccgagcagatccgcgaggcgttcgccgcggcggccttcgggtcggccgcccggtgcgacctacagacccgcccgctgcccttcgaggagtgggcgcgcggggcggcggccaccgcgattcagtccttcatcagatcagacacgtac

SEQ ID NO: 1071 - DNA, 2130 bp, Streptomyces avermitilis
  CDS (1)..(2130)
atgtcgctgatctccttcgccccgcacagcggggtctggctgctgaccaccccgcacacgtcgtacgcactacggatcgacgcgtcgggtgccccctgccatctcgcgtggggaccgaggctgacgctcgcggcggccgaggaactcgccgtccccgagccacccgctgccagcagcttcgagggcagaccgagtgtgggagaggaactccccgtcgacggcggggtccgctacgggccgccgtcgcttcaggtgcgcttcgcggacgggagccgcgccttcgaatggcagcccaccggccaccgggtgcacgagagcgccgacggcgcgcacgagctggtcctgttcttccgcgaccgccgctaccccttgcaggtggcgctgcattaccgggtgcgcgccgacaccgacgtcatcgaacggtggacggtcgtgcgcaacggcggggacgagcccgtgaccctgctgcgcgccgactcggccgcctggacccttcccccgctggcggactaccggctcagccatgtcaccgggcagtggtccgccgagagccggctgcgccgcgaccgactgccgtacggcgagaccgtgctgaccagccgtcgcggcatcaccagccatcacacgaacccctggctgatggtcgactccggtgaggccacggaggaccacggccgggtctggagcgcggcgctcgcctggagcgggagctggcgcatcaccacacagcgcaccccggacgggcggaccggcttcaccggaggcgtcgggcacgacggcacgggcgtaccgctgactccgggcgaggagttcaccgctcccgcgttcgccggcctgttcaccgccgacggcttcggcgcggccagtcgtgcctggcacgcgtacacgctggcccatgtgctgccccacccggacgaaccggtgccggtgctctacaactcgtgggaggccacgggcttcgatgtcgacgaggtcggccagaaggcgctcgcggaacgggccgccgccctcggcgtcgagttgtacgtcgtcgacgacggctggttcggcgggcgccgcagcgaccgggccgggctcggtgactggactcccgctcccgaccgcttccccgacggactgggcccgctggccgacagggtgcgcgaactggggatgcgcttcgggctgtgggtggagcccgaaatggtcaacccggacagcgacctgtaccgggcgcacccggactgggtactgcacctgcccgaccgctcccgctcggagctgcgcaaccagctcgtcctcaacttcgcccgccgcgacgtcgccgactgggcgtacggctggctgaccgaactcgtcggcgcccaccggatcgacttcctcaagtgggacatgaaccgcgccttcagcgaagccggctggccggggcagcaggacggcgcggaccggctcggcacgcagtacgtgcgccatctctacggggtgatcgaccgtctccgcgcggaccacccggggctgcggatcgagtcgtgcagcgggggcggcggccggatcgacctcgggatcctggggcgtacggaccagacatgggcctcggacaacaccgatgccgccgaccggctgtggatccagcacggattcagccagatctatcccgcgcgcaccatggggtgctgggtgaccgacgcgcccaaccagttcaccggccgtgggctcccgctgcggttccgcttccacgccgcgatggcgggggcgctgggcatcggcggggatctggcgcgctggtcggaggaggaactgcgggaaggggccgcgctggtcaccgagtacaagaaggtgcgccatctcgtgcagcacggcaggctcgatcggctgtcgccgccttccggccagtcgcccgcggtcgtgcagtacacctcggcggacggctcggagtcactggtgctcgcctggcgcggcgtcccgcgtcccggcgacgccgacctgccggtacggctgagggcactgactccggcggcccggtaccgcgacagccgcaccggcaccgtgcaccatgcctccgtcctgggcgactacggcctgcgcctcgacctgccggccggcgactggtccagcgtggcgatgcatctcgtacgggagccggaggcggtc

SEQ ID NO: 1072 - DNA, 645 bp, Streptomyces avermitilis
  CDS (1)..(645)
atggctggtgggctgctcctgagcggcgcgatcgccgccctcttcaccaccgcacttcccgtaggggacccgtcgggcgggttcaccgacccgcccccggacaagatcgtcatcaaggtcgccaccgtgaacggctccggctgccccgccgggaccgccgcggtcgcggtctcgccggacaacacggccttcaccgtgacgtacagcaactacctggcccaggtcggaggcaacgccgaccccaccgcgttccgcaagaactgccagctcaacctgctcgtccacgtcccgcagggcttcacgtacgccgtcgcgagcgcggactaccgaggcttcgccgcccttcagcgcggcgccaccagcacggagaaggcctcgtactacttccagggctcgtcgaacacggcttccatcacgcaccccttcagcggcccgtacaacgacaactggcaggccacggacaccacggactgggcccaactggtctgggccccctgcggtgttcagcgcaacttcaacatcaacaccgagctccgcgtcaacgccggcacctccactcccggcagttcgagcttcatgacgatggactcgaccgacggtgacatcagcacgatctaccacctggcctggaaggagtgcccgaag

SEQ ID NO: 1073 - DNA, 582 bp, Streptomyces avermitilis
  CDS (1)..(582)
atgcccccgcacagcccctcggatctcccccgggcgcccggcccgccaccggccgaggccctcagctatggaccggccggagccacctgccccggcgacgagtcctggcacgcggacggcgaggggtaccgccgctacgaccggaccgtcgtcatcggacacggcgacgcccactggcgcgcggcagcggacgcggtcctccactggggcatcaagcggcgcagcggctttcgcgtcacgccccggtccggcgcgggcgagcgggtcaccgagggtgccgaataccggatcaccgcagccatcgggccgctcgccgtgcacgaacccgtccgggtcgtcgccgtggtcgtcacgcccgagcgatgcggcttcgcctacggcaccctgcccggccaccccgtctcgggcgaggaggccttcgtcgtccaccggactcccgacggcgcggtcgcgctgactctccggtccctgacccgccccgcgccgagcggcccatggcgcgcactgttcccgttgctcctcgtggcgcagcgcttctaccgccgccgttacctgcgctcccttcgcgccgtcgcaccccgc

SEQ ID NO: 1074 - DNA, 4341 bp, Streptomyces avermitilis
  CDS (1)..(4341)
gtgctccggcgtggttttcaggcctttcacaggagctcttggggagcgggacgagggacgagggtgggcatgaacagcaagacagccgaggccgagagccgcacaccgggtgatcaggagttgcgtcagctgctcgccggactgaccgcggtacgggacggggacttcggtacccggctgcccgacgacaccgacgggctgctgggcgagatcgccaccgtcttcaacggcatgatcgaccagttgtccgtgttcacgtcggaagtgacacgcgtggcccgcgaggtgggcaccgagggcactctgggcgggcaggcggaggtgccgggagtctccggcacctgggccgatctgaccgactccgtgaacgccatggcgggcaatctcaccacgcaggtgcgcgacatcgcgcaggtggcgaccgcggtggccaagggcgacctctcgcagaagatcgacgtaccggcgcgcggcgagatcctggagctgaaggagaccgtcaacacgatggtcgaccagctctccgccttcgccgacgaggtcacccgcgtcgcgcgcgaagtcggcagtgaagggcgcctgggcgggcaggcccaggtccccggcgtcggaggcgtgtggcgcgacctcaccgattccgtcaacctgatggcgggcaacctgaccgcgcaggtccgtaacgtcgcccaggtgaccaccgccgtggccaagggcgacctctcccagaagatcaccgtggacgcccgcggcgagatcctggaactgaagaacaccatcaacacgatggtcgaccagctctccgccttcgccgacgaagtcacccgcgtcgcccgggaagtcggcaccgacggacgtctcggcgggcaggccgatgtgaaggacgtccggggcacctggcgtgatctcaccgattcggtgaacttcatggcgggcaacctgaccgcccaggtccgctccatcgcccaggtcgccaccgccgtggccaagggcgacctctcccagaagatcaccgtggacgcccgcggcgagatcctggagctcaaggacaccatcaacacgatggtcgaccagctctccgccttcgccgacgaagtcacccgcgtcgcccgggaagtcggcaccgccggcaacctgggcggccaggcgaccgtacgcggcgtctccggtacctggaaggacctcaccgacaacgtcaacgtcatggcgtccaacctcacgggtcaggtccgttcgatcgcccaggtcgccaccgccgtggcccgcggtgacctgtcgcagaagatcacggtcgaggccaagggcgaggtcgccgcgctcgccgacgtcatcaacaccatggtcgacaccctgtccgcgttcgccgacgaggtcacccgcgtcgcccgcgaggtcggcaccgagggacggctgggcggccaggcgcacgtgccgaacgtggcgggcacctggaaggacctcaccgacaacgtcaactcgatggcgaacaacctgaccggtcaggtgcgcaacatcgccctggtgacgaccgccgtcgccaacggtgacctgtcgaagaagatcgacgtcgacgcccgcggcgagatcctggaactcaagaccaccatcaacacgatggtggaccagctctcctcgttcgcggccgaggtcacccgcgtcgcccgcgaggtcggcagcgagggcaggctcggcggccaggccgaggtggagggcgtctccggtacctggaagcggctcaccgagaacgtcaacgaactggcgggcaacctgacccgccaggtcagggccatcgccgaggtggccagtgccgtcgccgagggcgacctcacccgctcgatcaccgtcgacgcctccggggaggtggccgaactcaaggacaacatcaactcgatggtcggctccctgcgcgagaccacccgggccaaccaggagcaggactggctgaagtccaacctggcgcgcatctcgggcctcatgcaggggcaccgtgacctcgcggtcgtggccgagctcatcatggaggagctgacgccgctggtctccgcccagtacggcgccttctatctcgcggaggagaccggccggggcacccagctgcgactgatcggctcctacggctatcccgacgacacacagcgtcccgaccgcatcccgctcgggcgctccctggtcggccaggccgcgcgcaatcggcgtcccatcaccgtcgacgacctgccgcccgcctatgtgaccatctcctccggtctcgggcagatctcgccgaccgcgctgaaggtcctgcccatcgtggtcgacgaacaggtactgggcgtcatcgaactggcctcggtcacccgcttcacccagatccacgaggacttcctgggacagttgatggagaccatcggggtcaacgtcaacaccatcgtcgccaatggccgtacggacgagctgctcggcgagtcccagcggctgacggccgaacttcagtccaggtccgaggagttgcaggtacagcaggacgaactgcagcgctccaacgccgagctggaggagaaggccacgctgctggccactcagaaccgcgacatcgaggcgaagaacctgcagatcgaacaggcccgccaggagctggaggcacgggcacagcagctgtcgctcgcctcgaagtacaagtcggagttcctggccaacatgagccacgaactgcgtactcccctcaacagcctgctgatcctcgcccagttgctggcacagaacccgtcccacaacctcactccgaagcaggtcgagtacgcggggatcatccactcggcgggttccgacctgctgcagctgatcaacgacatcctcgacctgtcgaaggtcgaggccggcaagatggacatctctcccgaacgcgtcgccctgcgccgtctgctcgactatgtagaagcgacgttccggccgatgacgagccagaagagcctcgaattcaccatgagcaccgccccgggcgtccccgtggacctgctcaccgacgattcccggctgcggcaggtgctgcgcaatctgctctcgaacgccgtcaagttcaccgaacgcggcggcgtcggactgcacatcgagccggccgtcgaccagaacatccctgccgccgtccaccgcggtggcgccgtcgtggccttccacgtcaaggacaccggaatcggcattcccgagcagcagttggagacgatcttcggagcgttccagcaggcggacgggaccacgagccgcaagtacggcggaaccggactcggactgtccatcacccgcgagatcgcccatctgctcggtggtgcggtcaccgtggacagcacacccggacagggcagcacgttcactctctatctgccggtcgcccgcgccgacttcgaggagctcgcccagggagcccagcccggtgaggcgagccagggggacggtgcggccgaccacccccgggggtcccaagccctcaccggtgccggcgggcccacgcaccgcaggcgccggatcctggtcgtcgaggagcggccccggggtctgctgaccctcgtcgcggagagcaccgtggccaacctgacgagaggacaccacggcggcgatccgcgtgaagtcatcgacgtcaccaccacggtggacgcccaggaggcggccggcgccctggcggcggaaccgtgccactgcgtggtcctcgaactcggcatgtcgggcggtgaggcctcacggttcctcgacgccctggacggggaccccgcgctggcctccgtacccgtcctggtccacaacggacaacgcgccgacgtgacgctggatccggcactgcggtcccgttccgcggcccgctcgctggagatcttctccagcctcgacgagctgcgggaacggatcgccctgcatctgtcggccgaggaacccggggacgtgctgcccctcgtccgcccggagaagccccagccggagcagacgctggtggtggacggcaccttcaccggccggaccgtcctcgtcgtcgacgacgacgcccgcaacctcttcgcgctcagcgggatcctggaactccacggattcaaggtgctgcacgcggagaacggcaggaagggcgtcgacaccctgctcgctcatcccgagatctgcctggtgctgatggacgtgatgatgcccgagatggacggctacgcggcgaccacggaaatccggagcatgtcccagtacaccgaccttccggtcgtcgccgtcaccgcgaaggcgatgcccggcgaccgggagaaggccctgcagtccggagccagtgactacgtcaccaagccggtcgacgcgaacgacctcatcgcctgcgtccgacgctggctgtccgcc

SEQ ID NO: 1075 - DNA, 2496 bp, Streptomyces avermitilis
  CDS (1)..(2496)
gtgaccactccccaccagcccggtgaacccgcccggggcgaggagccgttcggctcccccactcgcccgccggcctttgtcgagttgccccaccagagcacgtcaccttccgagccgagcgcaacggcggacggggtggcgagtgccgaggcgcagtccgtcgccggccggctcgcgacgaccgtcgagcggctgcggcgcgaggtctgggcggcccaggccgccgcggacggacgcgctctcctcgaactcgcgaagggaatcctgatcgagcgcctcggcttcggtccgacggaggccgcccggcatctgacggccctggccgagcgggccggcgtgccaccgctcgaactcgcggtcgacgtcatcaatcaggcggcccgcgaccggctctcggagatcgccacggagctcgtcgccgactcggccgctcttcccgagcgtgccgacgcccgggaccgttcgtccacggccgtccggttgcgtgcggcagagagcggcgccctggcggcggacgacgcgcagtccgtcgccgactccctgctccagcacgcgctggctccgctcggcgcgagcgccgtggccgtatgggcggcacgggccgacggctccctcacgctcgcgggcagcgcgggattctccagggccgagtccgcccgctggtgctacatcccgccgggcgtggcgaccgtcgccaggcaggcgctcaccgagcgcggtacgcagtggttcccctcgctgaccgaggcggatgttccgtccatcggccgcagtgaattcccggacggcggcagggtcgccgtccccgccggcaccggcggtcgtatccacggtgtgctggagatcagctggcccgctcccctggcaccgcagcccccgcagatcgtgcggcaggtcgaagccctggccgagctgtgcgcccacaccctcgagacgcagaccccgttggccggtccctccccggtcggagagccgcgcgccctggcggcctcctcggaactggtgcacctggccgaaggactgcacgatccggctctggtcctcgtaccgcacgccgatgacaacgggtacctggtcgacttccgcatcgactacgtcaacgggcgtttcctcgacccggcgggacgcccgcgcagcgccgtgaacggtgcgctgttcctggaggcctatcccatggccgccggggacagcgaactcttcgagcagatcgagcgggtgtacgccaccggggagccgttccgcgcccagcggatgacgctcacggcgctggtggagcaggtaccgctgtccgccgtcgccgacattcacgtcagtcggcacggcagcagcctcatcctcatctggcgcctcgagaacgaggccgcacgccttgccagcctcctgcagaacgcccagcggctgggacgtatcggcggcttcgaggagaacctgctcaccgacgagatcacctggaacagccagttgtacgcgctcttcgggcggcccacgtacagctctccggtgcctgtgcaggagctggcggcccatgcccatccggacgacaccgtggccatcggccgattcctgcggaccatagtgcaccaccgccgccccgcctcggcggccttccggctccagcgcccggacggcgtgacccggcacatgcgggtggtggcggagcctgtcctggacgcggacaagcggctgctcgccgtccgcggcgcctaccaggacatctccgcacagcactggaccgaggtggccctcgccgtcacccgcgaccagctcgcgcacaccgagcagcaggccgccgagcgcaatcggctggctctccagctgcagcacgccatcatgcccccgacccaggcgccgctggagatcccacagctccagctcgcggtccggtaccggcccgccgagaccgatcaactggtcggaggcgactggtacgacgccgtcgtcctgccctccaagctggtgctcctgtgcgtcggcgacgtcgccggccacggaatcgaggccgcgacgagcatggtcgtcctgcgcaacgcgctgcgtggcctcgcggtgaccggcgcagggccggcccaactgctgtcctggctcaacatcgtcgcccaccatctgaccggagcggtgacggccacggccgtgtgcggtctgtacgatccgtcccgccgcgtcctgcgctgggcgcgggcgggtcacctcccgcccgtcgtggtccgcggcccggaggccaccccgctgcctctcgtacgagggatgctgctcggtgcggtggcggaggccacgtacgaggaggaggaagtgtccctggagcccggcgacaccctgctgatgtacaccgacggcctgatcgagcggcgcgacgtgtccgtggaagaggcgctggcccagctgctcatcaccgcccgggcacagacgccgagcctgtcccatcagctggaccggctgctcacctacagcaggtcggacacggacgacgacacatgcatcgtgggcatccgcgtgtcg

SEQ ID NO: 1076 - DNA, 885 bp, Streptomyces avermitilis
  CDS (1)..(885)
atgacagccgtggccgcacccgccgcgacccgcaccactgggcagcacccgaccgcaccggcacacgaggtcgaactcgacgccatcgccgacccgttggcggtgagcccgaaggacgcgcgcgagctctctcgccacttcttcgcccgcctgtccgtgctcgaggagggcactcaggactaccagtacgtgcgcaacaccctcatagagatgaacctgacgctcgtcaggtacgcggcctcgcgcttccgcagccgaggctccggtgagatggaagacatcgttcaggtcggaacgatcggcctgatcaaggccatcgaccggttcgagctgtcgcgggaggtcgagttcgcgtccttcgccgtcccctacatcgtgggcgagatcaagcgcttcttccgggacaccagctgggccgtccatgtgccgcggcgcctccaggaggcacgggtggagctggcccaggccaccgacgaactcagccggcgcaccggccgcactccgacggtacgggaactggcggagctcatgtccctgaccgaggaggaggtcatcgaggcgcgcaaggcggcgaacgcctaccggagctcctccctggacgcgtccctctccggcgacgggtccgccgacaacgagtcggtcctcgccgacttcatcgggcgggaggaaacggcgctggagctgatcgaggacatgcactccctcgcgcccctcgtcgctcagctcgacgaacgtgaccggcggatcctgcatctgcggttcgtcgacgaactcacccaggcgcagatcggggaacggctgggcatctcccagatgcacgtctcacgcctgatcaacaagatcatcaccacgctgcgtgcgggactgctcagcgagtgcacgggc

SEQ ID NO: 1077 - DNA, 171 bp, Streptomyces avermitilis
  CDS (1)..(171)
gtggctggcgatcagaaggccaaggcaaagatggaacaggccaagggcaaggccaaggcggcggccggccgtgccgtgggcaacgagcggatggccgccgagggacaggcggagaagtcgaagggtgacgcccgccaggcgaaggagaagacgaaggacgtcttcaagcac

SEQ ID NO: 1078 - DNA, 330 bp, Streptomyces avermitilis
  CDS (1)..(330)
gtgagtgacaacatctcgtccttcgttccgaccgccggccacactccggacgcggatctggcgggataccgggtcgaggccgccgacgggcgcgtcggcaaggtcgacaaacagtcccgtctggtcgactcccagtacgttctcgtcgacaccggagtgtggatcttcggcaggaaggtgatgctgccggccgccggcatcaccggcgtcgaccacgaggagaagaagatcgtggtggcgcggaccaaggccgagatcaagggatcgcccgagttcgacgagggcaagcacctcggtgatcccgcgcaccgcgatcagctcgacggccat

SEQ ID NO: 1079 - DNA, 198 bp, Streptomyces avermitilis
  CDS (1)..(198)
gtgccaccgacgagaggagatgccatgctcggcatcgttgcagcagtactgttcttcatcgccttcctcatcaatgcggccgacatcgcgacgaacgacgtcttcacctccaccaatttcatgctgatcgggctggccctgctgtccctccatgtcgcgggcatcggctccggctgggcgagccggagccgcagacgc

SEQ ID NO: 1080 - DNA, 375 bp, Streptomyces avermitilis
  CDS (1)..(375)
gtgtcgacggaacaagcccccctgtccattgatgtgacgctcccccgggaggacgtcgcacttgtcaccgtcaaggggttcttggacgtcgacacggggaccgagctccaccaccatctcgccaaccagatgcatcacggtcggcgacatctgctgctggacctctccgcggttcccttcatggattcgtccggcatcaacatcatcctcaaggcctacaaggagacgcgccgcgtcgagggcagcgtgcgcctcatcgatcccgctccggcggtgcagcggatcctcgacctcaccggcgtgagtctgacggttccgtccgccaagagcctcgacgaagccctcgccgagacgggcgatgcgacggaccggcag

SEQ ID NO: 1081 - DNA, 474 bp, Streptomyces avermitilis
  CDS (1)..(474)
gtgacgtcctccagcacgcgcccgcaccccactgaggtggcgcgtgtgacctcagaggcggccgaactgctggaaatcctgtgggggcgcgcctcgacagcgcctgtttccgcctcccagctgcgtgtgctcttcattctcgagcacaacgagggcatcaatctgcgcacccttgccgacgcactcggctccagcccgccgtcgaccagcagactctgcgaccggctccaggcggtggggttcgtggagcgcgcggtgagcgcgaccagccgccgtgagctgtgcctgtatctgagccatcggggcagctcgttcctggccgaggtgcggtcacgccgcgagagtgccctggagtccgtgctggcacggatgcccgccgccaagcgaacggcactcctgcaagggctcgaagccttctgcgccaccgcggcggcgcagatccaggagcacgagggagcggacgcccgcacggcg

SEQ ID NO: 1082 - DNA, 1185 bp, Streptomyces avermitilis
  CDS (1)..(1185)
gtgaacagattcgtggcagtcgaacgggctctgcgcaccgcggctccccaccagttgctggacgcgctccgcgaggtgctgcgcaaccggtacgcggccgagtccgtcgagttcctcctggccgactacggggtcacggtcctgcagcccctctcccccgaggtctccgccactggccccgtcccgctgcacgacagccgggccggccgggccttcggtgcccaggagcccttcctggaggagccggccgacggcctggcccgcgtgcatctgccggtgacggtacggggcgaccggctcggcgtcctcaccgtcacgctgccctccgaggacgtgaaggactcgctgcccgagctccgcgagatcgccgaggtcctgggccacgcggtgatcgtggccgagcgggacaccgacgtgtacgtacaggcacggcgcaaggaccggctcacgctggcggccgagatgcagtggcagctgctccccggccgttcctgctcccggccggagtacgcgctcggtgcccagctcgagcccgcgtacgcgatcttcggtgacaacttcgactggtccgccgaccccgaccgcctgatgctctacatcaccaacggcatgggcgagggcatcgaggcctccctgctgaccagtctgggcatcaacgcgctgcgcaacgcacggcgggcggggatccccatcgaggatcaggcggccctcgccgatcaagccgtctacgcccagtaccgcggcacgtcatatctggccgtgctcctggtcgagttcgagctgtccaccggccgcatgaaggtggtcgacgcgggctcgccccgcatgctgcggctgcgcggcagaagcgtcgaagcggtggatttcgaggcccagttgccgctgggcatgttcgaggagaccgactacgtcgcgcaggagttccacgtcgaaccgggtgaccgtctcgtcttcgtgagcgacggtgtgcacggcgtcgccgcgccggggggtgagacgtacggggagaaggcgttgaccagggccatcaccgccacgaggctgctttcggcggcggaggtgccccacgcggtcctcagagagctgtccggccaccgcggcggcccgtcgcccgcggacgacgcactcgtcgtatgcctggactggtacggccgccgaggggcctccccggctcccgaaggtgat

SEQ ID NO: 1083 - DNA, 897 bp, Streptomyces avermitilis
  CDS (1)..(897)
gtgacggatcaggagccggtggcacaccacgaggcgccgacacaggcgctcggggactttctgcgacgccgccgcgagcagatcgcccagcgctgggccgacgaggcactgttccgcacggtcttcacggtgtcccgcgacgaggccgtggaagcggccggggccgtggtggaggcactcgccgcggtggcgttctcggagcggatcgagaacctgggagccaccggcttcgccgccgtgcgggaacagctcggacgcatggcggccgcgcgctcccgggcaggcgcctcggccgaccagatcgccgacgacgtgtcggcgctgcgcccctcgatcacggaactcctgaacgccgacctgtccgaggcgccggacgaggacgcccgcgagctgctgatcactctcaccgtcctcctgggcaccctgcgactcgtcgtcctggagacggtgctgaccgccggcgaggaactcatcgaacggcagcgtctccaactgctcgaagtggccacgcccgtcatcaaactgtggaccggcatcgtcgccgtgcccctcatcggcaccctcgacagcgcccgcagccaggtggtgatggagagcctcctggacgccgtcgtcgcgcagcaggcccggttcgccattctggacatcaccggcgtaccgaccgtcgactccttggtggcacagcacctgatgaagacggtggcagcggcgcgcctcatgggggccgagtgcatcgtctcgggcatccggccggcgatcgcgcagaccatcgtgcacctcgggatcgacctgggcaccgttgtgacccgtgcgagcctcgcggacgcactcggttacgccctgcaccggcagggcgccgtgatcgtcgatcaggcgtcggccggtgggatccagcag

SEQ ID NO: 1084 - DNA, 417 bp, Streptomyces avermitilis
  CDS (1)..(417)
gtgatcggcgaccccctcggccgaccaggcatccatgtacccgtactcaaactcggcaatgtccttctcgtcaccctccagggcgacctgcacgaccacgccgcggaacagttgcagcaggacatcggcgaggccgtcgcgagcagcgccgtgacgggcgtcgtcatcgacgtctccggcgtggagatcgtcgactccttcctcggcagggtgttcgcggagatcgccgcgaccgcccggctgctggccgcgcagaccatcgtggccggtatgcggcccgcggtcgccatcaccctggtcgagctgggcctgaccctgcccggactgcggacggcgctcgacgccgagcaggccatgcggctgctgaccgggacaccaccgcacctgccgcacgttccaggccgccgggagagcgcg

SEQ ID NO: 1085 - DNA, 393 bp, Streptomyces avermitilis
  CDS (1)..(393)
atggatctcgcatgggtgcggcagcatgtgcggcaggcggccgccgagctcggtttcggcctggtggatcagaccaaactggtcaccgcggccagcgagctcgcccgcaacacactcatccacggcggaggggggcaggtccagtgcactcccctcgagatcggccggtcccgggggcttcgcctcaccttcagcgacgaaggaccgggaatcgccgacatcgagcaggcgctgggcgacggctacacctcgggcggcgggctcgggctggggctcggcggtgcccggcggctggtgcacgagttctccatcgacagccgtccgggagaggggacttcggtcaccgtcatctgctggtccgcgggtgcgccgcacacgcgagaggagacgcga

SEQ ID NO: 1086 - DNA, 1071 bp, Streptomyces avermitilis
  CDS (1)..(1071)
atgacacgcgtccgagaagtgcccgtgcacgactcgacccgcgtccgggacgtccgggtggccgccgaggctacggcccggcaggcggggctcgatgaggaccgcaccgccgcagccgcgctcgtggccaccgaactcgccaccaacctgctcaagcacgcgggcggcggccggatactgatcgactccgtggacgcgtacctcgggcccccgacggcgtcacccgaccctgtcgtacagatcgtggccatcgaccacggccccgggatcaccgatctgcccgccgcgctgggagacggcttctccaccgcctcgtcgctgggcgcgggactgggcacatgccggcgggtcgccgacgcgttcgacctgcacagctcgccgggccggggcaccgtcgccctggcccggatccatggcgcggccaagagccgggccgaacgccacgagcggcgcgccgacgctccggtccgggccggcgggatcaacatccctctcgcgggcgccgatgtgtcgggcgacgcctgggcctgcgtacgcgccgccgatcgcgtcactctgctcctggccgacggcctgggccacggccccggtgcggcccacgcctcggacgctgccgtggagcagctgcaccgctccgcacacctgtctccgccggagctgctcgcgcagctgcacaccgccctccgtgacacccggggtgccgccgtcgcggtcgcccaactcgacctggccgccgggagtctgtccttctccggcatcgggaacgtcggcgcccggctgcgctccggcgacagctggaagccgctcctgtcccaccccgggatcgtcggcgcacaccgtccggcgcggatgccccatcaccgggtgccgtggacggacgacagcctcctcgttctgcacagtgacggcctgcccagccggtggacccctccgcccgccgtcccgctcggcgccctggaccccgcggtgacggccgccgcgatcgtccgcgacgccagcagttccgcccggcccgtacgcgacgacaccgcggtggcggtgctgtcctccacgccaccggacccacgacca

SEQ ID NO: 1087 - DNA, 1740 bp, Streptomyces avermitilis
  CDS (1)..(1740)
atgacccacacctggtacatcagcaccgtcaccgacgcggccggtgcccggatcgccgtcgcgcgcctcgcggccgcccacggcgtccccgtcctcgaccgcacccgcctggtcaccgcgctgaccgcgcagctgcggcagtgcctcaccaagggcggcgcctggcgactcgtcctggagaccgtcgccccggcggccggccaggagcacggccggctcgacgtcaccctgtgtccgggccgggacggcaccgcagccgagcggccggcctggcacgcggccgtcgacttcaccgaaccgggcgacctcgacgcggtcgcccgggtggcggccgaccccgcgaccctggccgacgcgctcttcggcgcggacgaagacaccgcacgggtcatggagaagctcaccgaacaggaagcgctggtcgccttccaccgtgaggagctgcaccagacgaaccagggcgtcctcgccctgcacgccgaactcgacgcggccggcgaggcccagcgcgaacttttcgccgccgaacgggaggcgcgtcaggaggcggagaaggcgcgccacaggctgacctttctggccgacgccagcgcggccctgacctcctctctcaaccatgaggagatcctgcgccggctcccggaactcctgaccccggcctatgccgagagcgtcgatgtgtggctgttcgcggacgaggacaagcagcgacagagtccccgccccgcggcggccgtcaccgccgcgcgtaccggccgcccccagtacgccgccgagcaccccggtggcctgcccggtgtggacgacgtacccccgtccgccctgcgccccgaccggcccctgctctgcatcccgctgcccattcgccgggcgcccctgggcgtgatgacgctcacgccaccgggcgagcggtgggacccggacgacgccgtgatgcttctcgaactggcccgcagagcgggcatcgcgatcgacaacgcgcagcgcttcgagcacagccgcgacatcgccgaaacactgcaacgcgccctgctgaccgacttgcccacgacgcccggactacacctggccgcccgctatcttccggccacgcacggactgaacatcggcggcgactggtacgacgccttccggcagccggacgggagtctgatcaccgtcatcggcgacgtcaccgggcacggtctgcacgccgccgtgatgatgagccagctgcgcaccgcgctgcgtgcctacgccgtcgacggaggcagcccgggccagctcctcacgcggctgcacctgttcctccaccatctgcagccggacctgtacgcgacggcggtcatcgcccgtttccgccccgacgagccgacggtcacctgggccgccgccggtcatcccccaccggtgctgcgcctgcccgacgggcgcgtacgcacgctggacgccaagccgggcgcgatgctgggcatcccgctgggccaggacatcggcgaccacaccgtacggatgccgcccggctcgacgctcgccctgtacacagacgggctcgtcgagcggcgcgctcacgggatagacccgggtatcgggcgtctggccacggcgctctcggccctgcgcggcccggacctggacgaggacctggacgcctccgccgaccggatcctcgacccactgctgtgcgactcggagcgcgacgacgacatatgccttctgctctgtcacatcgacagcgagccggtgccggcgcttcactcc

SEQ ID NO: 1088 - DNA, 504 bp, Streptomyces avermitilis
  CDS (1)..(504)
gtgcgggatgagagggagccgagtgacgcagctgatgcgggccgtcgccccgaggcggtggcccggcaggtcgcggacgcggtggagaacctcgtgaccctgtggaccgcggccgccgaggccgtcagcccgcgcctgtccgcctaccagctgaaagccctccgagccgtgtggcaccggtcggaactcaatctcacggcactggccgacaccctcgggatcgcactgcccgcggccagccggctctgcgaccggctcgaggccgcgggcctgctggagcggatgtcgcatccccgcaaccggcgcgagctgcagttgcgggtcaccccgcacggacggcgggtcctcctggaggtcgcggagcggaggtcacggagccttgcgaccgtgctcgccgccatgcccccggcgcagcggacgtcgctggagcacggtctgcacgccttccacgaagcccgtgcccgtcccggggcgggcggggacaggcaccggcgcgctcaggag

SEQ ID NO: 1089 - DNA, 432 bp, Streptomyces avermitilis
  CDS (1)..(432)
atgtcaaccaagccgcgtcgggaaagccccttgcccactgaagacgtcaggagcctcaccgccgccttcgacggcgacctgcggaacgtgaccgacgcccggctcgccgcggaaggctttctgcggactctggcgcgggcttcacccccgacgagccccgagtgcgagcacgatgtcctgctggtggtgaacgagttggccgccaacgccgtccagtacgcgcccggccccttcacactgcgtatgcgcacgaccttcgacggggtccatgtcacgctgcgggacaccagcacgacacgaccggcgccgcgccccttccatcccagccggggcggtggcggaatcggctggcacctcgtgcagtcgctgtgcacgcaggtgagcgtggtcgtgcatcccgaggggaaggacatccacgtcttcctgccctgg

SEQ ID NO: 1090 - DNA, 498 bp, Streptomyces avermitilis
  CDS (1)..(498)
gtgcaggacgttcgcaacggagtcctgtcgtggcgaggccgccctctccgcccgcgcggaggtgagcggtggccggcgcgcaccgcacgctcgcccggcctcgcggcacggctcctcggcagggaaggaaacggcgtgagcatcgacggaccgtggttctacgagccggcaaccggccacatggagggacaggacctgacagggttcacagtcgaggcgaccgacgggacgatcgggcaggtggaccggcaggccgatgacgtgggcatgcggcacctggtcgtcgacaccggggtgtgggtgttcggcaagagcgttctgatccccgtgggcgtgatcacgggcatcgacacccaggcgcggcagatcactctggcgtgcacgaaggaggaagtgaaagcggctccgctcttccgcaccgacagcgagacgctggacccggagtacctgggcagcgtcggcgcgtattaccgagagcttcctcgagaccggaccgag

SEQ ID NO: 1091 - DNA, 393 bp, Streptomyces avermitilis
  CDS (1)..(393)
atgaccacctcttcctccccgtacttcaccactacggccgacgcggactccacggtggccgtggtgcgcgtcgccggtgacctggactacgagtcgtgccacgcattcgtgcgcgccacggaactgttgctcgccgagcggcgcgagaccggcccgccgctgtccgccctgcggctggacttcgcggaactgagctccgtcgactccatgggcctgtccgccctcctcatggtccgtcgtcgtacggacgcggcgggcgtcagcctgtacctggacgagcgccctgcctgcctggagcgcctcctggagatcacgggcacgctcgaccacctcaccgcgccgtgcgtcgccgacgacgccggtgaagccgacgaacagcggcccggcacgggc

SEQ ID NO: 1092 - DNA, 483 bp, Streptomyces avermitilis
  CDS (1)..(483)
atggtcatctcgctctggcagcaagtatcgaaagaacaggctccgggcaggcatgccacgccacgttgccgcgtcacgtgggaaggcggcaccgcgaccgcagtggaggggcgcaccgcgtcgtcgaatttcctgtccgaggtccaagaggccgatggcacccccttgccggaccgactcgtcggtgacatccagctggtcgtcagtgaactggtcaccaacgcgatacggcacgccccaggcccctgtgggttgcaggtggagctgtccgcggacggccgtgcggtacgcgtggccgtctgggacacgtcgagcaagatgccgactccccggccgcgggacgcgtgccggatcggcgggcacgggctggagatcgtgcgcgcggtcagccggtccgtcatcgtgcagcccggttcgcccggcaaacaggtcaccgcggagatcgagctcccgcagccggcccgcggcgagtccgcttcctgg

SEQ ID NO: 1093 - DNA, 1923 bp, Streptomyces avermitilis
  CDS (1)..(1923)
atgcacaacttcgggctccctccgtcggccacgccggtcatgacgggagggctcgccgacagcgtcttcgagacggcgctcggcaatcccggactgccgcagatcgcccggcgctcccacgactccccgggcacctggacccaggtgagcgcggcccagttgcgcgacgaggtcgtcgacctggccaggggactcatcgcgtccgggatccgcccgggcaaccgagtggccatcatgtcgcgcacccgttacgagtggaccgtgctcagctgcgcgctgtggtcactgggcgccgagatcgtgcccctctatccgaactcgtcgcacgaacaggtcgcctggatcctcaaggacgccgactgcgtcggggtgctcgtcgaggacgaacagggcgtcatgacggtcgggtcggtgtgcgcggggctgccccggctgcgacacgtctggcagctggactccggctccctggacgaactggtcgagcggggccggccggtgccggccgcgacggtcgactcgctgcgccggatcgtgctgcccgactccaccgccgtcatcgcctacacctccggtacgagcggacaccccagggggtgcgcgctgagccatcgcagtctggccagcacctgcgacacgctgctggacggatggcggcacaccgcggcctcgcccggcgagcagccggccgtcctcgccttcctccccttctcccatgtgtacggcctcatggtccagggcctgtgcctgcggggcggcctgctgatggggcacgagcccgatctgcgcgcggagtccctggccgccgcgttccggtccttccgccccacctatctgtacgccgtgccctccgtcttcgagaagatctacaagagcttcctcacggcggccgagcgcacgggccggggcacgttgttcgagcgggccgcgcggacggcccaggactacgccgaagccgccgaacagcagcggctggggacggggccggggccgggcttcgacctgaagctccaacacgccttgtacgaaagggctgtgtaccgcaaactccgcgactcgctgggcggcaggatctgcggagccgtctcgggcggctcacccctcaaccgcgaactcaccctcttctacgcgggaatcgggatcatggtccacgacggctacggcctgaccgagaccagcgggggcatcaccgcccagcccgtgggccgggagaagttcggaaccgtggggcggcctctgcccggcacggacatccaggtcgccgaggacggcgagatcctggtccgcgggccatcggtgttccagggctacgtcaacgacatcccgggcacccgggcgtccctgcgcgacggctggctcgcgaccggcgacctcggccgcctcgactccgagggctatctgtcgatcacgggccgtaagaaggacaccatcgtcacgagcagcggcaagagcgtcgcgccgtcggtcctcgaagagcgacttcgggtgcatccgctgatccaccaggccgtgatcgtcggcgagaaccggccctgtgtgggcgccttgatcaccctggaccccgactatctgccgcactggcgcacgatggtggccgcccaggccgacgcgccgagccgggaggcacgcgagcagaacgcggtgctgcaggaggtcacgcgggccgtcgccgcggccaacagcttcgtctcgcgctccgaatccatccgcgtcttccgcatcctcccggagcccttcgacccagccaacggattgctcacgccctccatgaagctgcgcagggacgtgatcgtgcgccggtacgccaccgagatcgacgccatgtaccagtcgtcggcgcggacgagagtgaagtccctctcggacgaacccgtgagctgggaagagcacgaagagaacgaggacgacgtgttccggcgggtccgg

SEQ ID NO: 1094 - DNA, 735 bp, Streptomyces avermitilis
  CDS (1)..(735)
gtgccgtgcaccccgggctcggcggcgatccgtccgccgaagtcactccagcaggagatccacgtgaaccaccatcgaaagcctcgtaccagctccgtcttcagtcaacgcgccgtccgcgtgggcctgttcgccgcgggggccgccgggatggcgaccgccgtgcccgcgcaggccgccacgggggtgccacagcactccgcggtcgccgccgaccagacgttcagccgcgccgacttccgccaccacagccagaccaaggactccttcaccgtgcgccagctcggcacggtcaacgccgccacggtccgcaaccaggcgaatgccgtcggcgtgggctgctcggtcgacgaccgctgccgctcggtggccctgtccttccagatcgtcaccatgtccggcgaccagacccatctcaacgcggtcaaccggggcgacgccgtcaacaagcactgcgacggctgccagaccctggccggcgcctaccagttcgtcgtctccaccccgcgccccttcagcctggacgcgcaggcccagcgacagctcgccgacatccaccggcgactggacgacctgacccgttcgacgctcccggccaccgaggtcaaggcgcgggccgacgcgctggccggcgaggtgaacaccgtgctgcacgacgcggtggcgggcgcgcccaagggggacgagcggcccaccgtcaccgtccatcgccacctggacggctggcccggccac

SEQ ID NO: 1095 - DNA, 1758 bp, Streptomyces avermitilis
  CDS (1)..(1758)
atgacgctgctgggggacaagaccgcatcgccgtacgacaccgggacgccggttccggggccggggggcatggcggtgacgtacgagcaggtcgcgacgggcggcctgcccgtggccggcctggagaggccggtggtgccgcggctgagcgcgggcctcaagctgcacggcgagtaccagggatcgggcttcaccgagcccaagtacatcgcccgccggggggacgggcaggtggtgcagctgtcgcggctgctgcatctggtcgcgtcgtcggtcgacggcagccgcgacatcgagacgatcgcccaccgggtgagcggccgtttcgggcgtgaggtcagtgcggacaacgtccgctatctgatcgagcagaagctggacccgctgggcgtgacggtccccgaggggcgggaggaggaagacatatccgcgccccggtccgacctgctgctggcgctcaagggccaccgggtcatcttcaacgaacgccgggtggccacgatcgccggcgccctggcgtggctgcaccgcccggtggtcgttctggccgtcctggcggggatcgccgtcctggacgtctggctgttcgcgttcttcggcgcgatcacgcccgtgctggaggtgctggaccagccggtcctgctgctggtcgtcttcgtgctgaccgtggcctccctggtgttccacgagttcggtcacgcctcggcctgccgctacggcggcgcccgccccgggtgcatcggctgcggcctcttcctgatctggccttccatgtacacggacgtcaccgacgtctaccggatcgggcgggtcggccgactgcgcaccgacctgggcggggtctacttcaacgtcgtcttcatgctggccatggccggcgcctacgccctcagcggccaggccttctttctggccgccgtgtacctggggcacttcgagatcctcgaacagctgatgcctgccgtacggctcgacggctactacatcctcggcgatctcgccggagtccccgatctctacgggaagatcaagccgatcctcctcagcctggtacccggcaggaccggccgcaaggcccgcaaggaggtcgcggcactcaagcgttcggcccggaccatcgtcgccacctgggtgctgaccatggttccgctgctgctcggcgaactcggctacgcgctgtggaacctgccccggatcgttgccacgatgacccgctcgctgaccgagcaactgctcggtaccggcggcgccttcgcccacggcgagatcgccgccgggctggtcggcgtcgtcggctgcgtgatgctgctgtgcccgatggccggcgtggtctatctgtccgtgaaactcggcggacgcctgtggcggggcgccgtgaagtccacggccgggcggccccggctgcgcgtcgccctgtgcgccctgagcctggccgccctgtccgggctcgcctacgcctgggtgtccggtatgactcccgaaccgctgccgaagcggcccccgatcgcgccgatcctccagcccggcgtgtccacctccgcaccaccggcccggcacgcgaccacacccggcccggacgacaacacccccgtccgcggcgtccaccacggctccggccggcgcggccacgccgggcggttcggcagacccgtccgcctcggcgagcccgtcggactccaggagcccgcggcccagcgcgtcggggaccgcgtccgaggagaccgtcgggaagccgaccggcagcccggccgcgagcgg

SEQ ID NO: 1096 - DNA, 240 bp, Streptomyces avermitilis
  CDS (1)..(240)
atggtcaatgtgaaaggacacgccatgagcatggacgccagtgagctggaagccgagtccgcggagctgctgccgggccgtgaggccctgggacggctgaagttcagcttcggcaagacggtgaacgtcaccaagcacgtcgccaacgtctccgcgcacaacgagtcggccgcgctcaatgaccactcgtcgtggtcggtggctcagtcgcaggccgcccagtcgatcaacatcactcag

SEQ ID NO: 1097 - DNA, 306 bp, Streptomyces avermitilis
  CDS (1)..(306)
ttggacagcacgtccgacggagttggacatgatccggggggacctgaccgtgtccgacgggaacacttctcgattcctgagggggaattgatcatgatggatcctcgtgagctggaagccgagtccgcggagctgctgccgggccgtgaggcgctcggccggctgaagttcagcttcggcaagacggtgaacgtcaccaagcacgtcgccaacgtctccgcgcacaacgagtcggccgcgctcaacaaccactcgtcgtggtcggtggcggactcgggcgccgcccagtccatcaacatcgcccac

SEQ ID NO: 1098 - DNA, 393 bp, Streptomyces avermitilis
  CDS (1)..(393)
gtggccaacgcactgcagcagatcatccgtgacaggctggacagcgagcgctggtcctacggcgaggtcgcccgccgcggcaacatcccgcgttccaccgtccatcacctggccaccaccgaccacatggcgcggatgccccagccggccaccctcgaaggcctcgcgctgggcctcgggctgcccctgggggccatccgccaggccgccgcggaggcctgtggcatccacctctacgccgccggagccgagcccccgagagcggccggcggcacctccgccgaccctgacgtggaggtgctcatcgccagcctccagcggctctcgtccgacgaccgccgccatgtcgccgccctcgtcgagtcactgctcaaccgcgcccccggcacgtcc

SEQ ID NO: 1099 - DNA, 294 bp, Streptomyces avermitilis
  CDS (1)..(294)
gtgagccgcacgccccgggtcatctggggggaacaattgctcttcgtacacggcggccccaccaccgccatcgtcaaaggaccgacgggagagtccgtcgtcctgctctccggcgagttgcccgcaaatctcacggacgcgtccataggcgaactgctcgacctcgccgcggccgtgctcaccgagggagaactcgccctcttcgaacagtgcctgaccacgctccgccgcggcgagggccccactccccagcgcatcgaggtcaacggcgccgtcatgacggtctaccgggac

SEQ ID NO: 1100 - DNA, 828 bp, Streptomyces avermitilis
  CDS (1)..(828)
gtgcggatccacatcagtgcggacatggaaggcatcaccggactcgtcggcgccgacgacgtccagcccggcgggcgggactacgagcgggggcgctcgatgatggccgaggacgtcaacgccgccgtccgtggcgcggtcgcggccggtgccaccgacatcgtcgtcaatgacgcgcacggccccatgcgcaatctgctgcccgaggccctgcacccggcggcccgcctcatccgcggcaggcccaagcagatgggcatgctcgaaggcctcacccgcgaacacgacgccatgatctgtgtcggctaccacgcgcgggccggtgcgctcggcgtgctgagccacagcttcatggggcacgagatcgaggacatgtggctggacggccggcccgtgggcgagatcgggctcgcccaggccaccgcggcgacgctcggcgtgccgctggtggcactcaccggagacgacgccgcctgcgcggaggccaccgcgtgggacgactcgatcaccaccgtccccgtgaagtacgcacatgatcgcttcgccgcggaactccgcccggccgcggaggcgcgccaggccatcgaggaagcggtcaccgccgctctctccgcggtaccggaagcacccttggtgcccgcgaacccgcgtaccctcaccgtccgttggcagtcggcatccgtcgcctccaccctgctgggcatcccaggagtcaccaccccggacagccgaacagcggaggcacacggcgaactccccgcgctgtaccggctcttcggcgtatggatgcgggtggcggcgtcgctgggcaatcaaccgccctactgc

SEQ ID NO: 1101 - DNA, 918 bp, Streptomyces avermitilis
  CDS (1)..(918)
gtgaagcccgtcgcgggacacatcggcgccgagatcaggggagtcgacctggcagggcccatggacgactcggtggtcgccgagatccgggcggcggtgctgcgctggaaggtggtgttcttccgggaacagcggctggatcacacctcccatgtcgcgttcgcgcggcggttcggcgagccggtctccctcaggtcgcgcggcagtgcgtcgcccccggacttccccgaggtcgagacgacggccgaccggctggaactgggtgagcggtacggcatggaccacgccgagtggctgcggcggcgccgccattcgctgctgcggggctggcactgcgaccacggtgcccggatcgacccgccggccgccaccgtcctgcgtgccgagaccgtgccgccctacggcggtgacacgacctggtccaatctggcggccgcctacgccggtctctcgaagccggtacgcgacttcgtcgacggcctgcgcgccgagcaccggctgggggtcgggtatcaggcgcggcccggcgacgacgcgtacgtacggcatctgctggaccatcagaccgcgtcggagcatccactcgtacgggtgcacccggagaccggcgagcgcgtgctgttcgtcaacggctactacgtggagcagatccaggacgtgtcccgtacggagagccgcgcgctcctcgacatgctgctgggcgaggcgacccggcccgagtacaccgtgcggttccgctgggagccggggagcgtcgccttctgggacaaccgggccaccatccatctggccccgagcgacacggcccacctcgaccacccccgggtcatgcaccgcgtgatgctcgccggtgacatcccggtcggtgtggacggcaaaccgtcggcaccgatcgccggcaccgagccggagcgctgg

SEQ ID NO: 1102 - DNA, 528 bp, Streptomyces avermitilis
  CDS (1)..(528)
gtgcgcgagcccaacgtgatcggcgactggcaggagtacgaggacgagtacgccggcctgcgcgtccgcgtccacggcttggaggaagcggagcctccgcggggccgtgacgacgctgccgaagggctgacctacttccgcttccgggtgaccgtcgagaaccgcgcgagcgaacccgtcgacatccacttcgaagacggccagctcgacatccgcaccggccccgacggcgtgagcgcgttcctcgactggcgcaactcgcagttcatcgaggggttcgacctctacccgctgcgccgcgccaccgctgtcctgtacgccgccggcgcggacacctcgctgacccgggtggacatccagatccacctcaaggcggacgacgagtggaccggccggtacctgtggtcgggcgacatgtccctgcccgtgggctcggcagagtcgggcgtacggtgcgagggcgccgtggagagcctggtcggccaggtcagcaatttcctgcgcgaagaagcggaacagggacccggc

SEQ ID NO: 1103 - DNA, 681 bp, Streptomyces avermitilis
  CDS (1)..(681)
gtggtcggtgaattcaccccgcttgatcagcgatcaagccgtgcgcagccacgatccccgccagggggtgaaggcggcgtttggggacgtgttgcacatcacgctcaccggtgccgctcgtcaccgcccgtgaaccacggggcgccgcccgccggaccggcggtggctggcagaattccgggcatggccccgatcacacccgcgcgtgccctgctgctgctcgtctgtgggctggtctgcctcctcaccgcctccggagctctcatcggcgcgctcttcggtggcgcgaaggccgccctcgtcgcggccgcctgcgcgggcgtggccggtctgctcgccacgctcctcgtgcgccggcgtgcgctggcccacttcgccgcggcgcagcgggaggccggggtccgcggatacgccgagggaatcgcgcacggcgtcctcctgcacgtgaccgcctacgaagccgccgtgtttccgcatacgggacccacgggggtgacacccgaggagcgtgccgcacgccgtaccgtcgcctaccggatggccgcgctggaggaggtgcccaggctcgtccgggaggccgccgccgacgcgctcgccgttctcgacgaggccgaccgcgcgcgtgccgaggaagcggtcgcgcaactcgcttccgtcgtacgccggcagtacgcccgcccc

SEQ ID NO: 1104 - DNA, 1407 bp, Streptomyces avermitilis
  CDS (1)..(1407)
gtgaccgtagaagacagaggcataccgtccgacccgccggcgccgtcgcggcgcgggatactgcgggccctgctcgcgctgcccgccacggcgctcgtgtggggcgaaatgccgggggcggtgggttcggcggccgcggcggcgccgtcgaaggggtatgccacgcggtacaccatcgtgccgttcctcaacagcgacgacggcgtcgtgaacgtctatcagtccgacgacgccaccgacttccggctgctcaaggccaccgcgtacaccccgccgagcaaccggatccgcgacgccagtgtcttcaagcacaccaacggctactactacctcacctacaccacgcacacctggcaggacgtcagcaccaccatcgggttcgcgcgcagctccgaccgggtgaactggaccttcctgtacgaccacaccgtccccctcacgaacctgtcccgcgcgtgggcgcccgagtggttcgtcgacagcgacggcagcgtgaacgtcatcgtgtcctgctcggccaccgacaacgagtggatcttcaccccgtatctgctcaaggccaccaacaccgggctcacctcgtggtccgcgcccgtggccctgtccggcatcggcgccaaccacatcgacacgtacatcgtgaagatcggctccacctatcacgccttcaccaagaacgagacggccaagtacatcgagtacgccaccgccaccagcctcacgggcccgtacacgatcagcaggaccggcgactgggcgggctggggcagctatcgcgagggcccctcggtggtgcggctcgacaacggcgggtggcggatcttcttcgacggctacggcgacggcacctactacttcagcgacagctacgacaccttcgccacctggaccgcgccgaaggcactggccggcatctcgggcaccgcacgtcacttcaccgtcgtcaaggagacggtctccggcggtgtcagcctctccaccggcgtcagccgctccttccagtccgtcaactacccgacccgctactggcaggagcagtcctccctgctcaacctgcccgtggtgagctccgccgccagcagcgcggagaaggcggcgtcggcgttcacggtcgtggcgggcctcgccgacgccggcgggtactccttccgggacgcggccggaaactatctgcgccactacgactaccgtgcccgcttcgacgccgacgacggaacgccgacgttcgccaaggacgccacgtacgtcgcgcgaacgggcacggccgccggctccgtccgcttcgagtcgtacaactacccgggctactatctgcgccactacaactaccagctgcgcgtggaccccacggacggcaccgaccagttccgccaggacagctccttcaacccggtcaccgcctgggcc

SEQ ID NO: 1105 - DNA, 1737 bp, Streptomyces avermitilis
  CDS (1)..(1737)
atgcctgcattcatggccgacagcggcgagcacacggcggtccgggatccgatcggcccggtcccgccggcgagcggggaggacgattcccggaggccggcgggccttggccggcggctgcggcggtaccggcggtggctgctggtgtgcgcggtggccgcgttgctggcccagatggcggtcgcgatgatcaccacggcggtggaacagacgcccaccatcgacgagccggtgtacgcgggcacggccgtggtctacgtgcaacagcacagcctgcgttacaaccccgagcacccgccgctcggcaagctcatcatcgcgaccgggatggcggtcgcccggccccatctcgcgccggggttcgtgggcgaccagggcgagctgggacggcatctgctgtacgagtccggcaacgacccctggcgggtcatgttctgggcgcggctgccggtgatcgtcgtgacgctgctcctcggtctcgtggtcttcgcgttcgcgcgtgatctcgtcggcgccgtgggcgggctggcggcgctcgcgctgtacgcgttctcgcccgatgtcgtcgcgcacgggtcgctggccacgctcgacgtgcccgccgccgggttcgtgctgacggcggcctggctggtgtggcgggcgcggcgccggccgctgccgtatctgccgctcgccgggctggcgacgggcgccgccctggcgacgaagatgagcaccctgccggtggttccggtgctgatgtgtcttgccgggtggtcgttctggtgcgcccggcggaccgacggccccgagccacgggagcgggcgcggctcgcgggccgggccgcggcggtggccgccggtgtggcgctggtcgcggtggtggtcgtgtgggccacctatctcgtcgtcgatccacggctgcggtggaccgcgtccgggcatgtgccgacggtgcacggcctgcgtgggctgctcgtcgagtggctgccgttcccggaggcgtaccgggacgggatgcgcgtccagttcggcttcgagaacgcgacctggcacggcttcctgttcggccggctctactccggctccctgtggtactacctgcccgccgcgctgatcgtgaagacgccgctgggcatgctgggcctgtggctggcgggcgtcggcgtcatggcggcggtgccgcggctgcgggcggcggcggggtacgtggtccttccgcccgccgtcctgctggccgcggccatgaccggctcacgtgatctcggcgtgcgctacgccctgttcatgccggtgttcctcgcggtcgccgccgcctgcgtactcgccctgcggcggtggtgggcacatctcgcggtggcggtgctggtcgggttcgtcgccgtcagttcggtgcggacgtttcccttgtatctgccgtactccaacgaggcgttcggcgggcccgccgagacccatctgcggctgcacgactcgaacgtcgactggggccaggacctcgggcggctggccgaccggctgcggcagcggtatcccggcgagaaggtctggctcgtgtacaagggcagcggtgtgcccgccgcgtacggcatcaccgcctccgacccgcgcaaggtggcgcccggccgggtgcacgggctgctcgtcgtgtcggactcgtcgatcgccaaggccgagggccggttcgcgcggctgatcgacagcagcgaggcgatcgacgaggtcggacactccatcacggtcttccgccggaag

SEQ ID NO: 1106 - DNA, 1362 bp, Streptomyces avermitilis
  CDS (1)..(1362)
gtggcgaccgtccccgtggcgctcgcggcgctgctggcggccgcgggcccggcggcggccggcaccgtgggctcgtccggagcaggagacccgtacttccccctcgcgggcaacggcggctacgacgtgcgccactacggcctgagcctcggctacgacccgagcaccggccacctcgacggaaaggcggtcatcaccgcccgggccacccagcgcctcacccgtctcgacctcgacctctcgggcctgaaggtcaccggcatcacggtcgaccacaccaaggccgccttccggcgcgacggccaggaactcgtcgtcaccccgcgccacgccctgcaccgccggcaggaattccgcgtcaccgtcacctaccagggcaagcccaaaccggtcaccgaccccgacggctcgctcgacggctggatccccaccgacgacggcgcgttcgtcgcgggggagccccagggcgcgatgacctggttccccgcgaacaaccaccccagcgacaaggcgtcgtacgacatcaccatcacggtgcccaaggggcgcaccgccgtctccaacggcgtccttctgggacagcggaccgcccacggccgtacgaccttccgctggcgtcagtccgagccgatggccgcctatctggccaccgcgacggtcggcacgttcaaggtcgagcggtacacgaccccggacggcctgaaggtctacaacgccgtcgacccgcgcgaggcgaccgcggcaacaccggtgctcaagaagctgccctccgtgctcgcctgggagagcggcgttttcggcccgtacccctacaaggccgccggtgccgtcgtcgaccgtgccccgaacgtcggctacgcgctggagacccagacccgcccggtgtacgacagcgcccccgatctgagcaccctcgtccacgaaagcgcccaccagtggttcggcgactccgtcacactgacccgctggcgggacatctggctcaacgagggtttcgcgacatacgccgagtggctctacgccgaacagcacggcggcaggaccgctcagcagatcttcgacgccctgtacgcgtccccggcgggcgacgacctgtgggcgttcccgcccgccgaccccggcagcggagcccatatcttcgaaactcccgtctacgcccgtggcgccatggccctgcagaagctccgcacggcggtcggcgacaagaccttcttccgcgtcctgcgcacctgggccaccgaccaccggggcggccacggaacgacggccgagttcacccggttggcggagcggctctccggcaaggacctcgaccagttgttccacacgtggatcggtacggcgggcaagccgtcctctccc

SEQ ID NO: 1107 - DNA, 342 bp, Streptomyces avermitilis
  CDS (1)..(342)
gtggcccagccccccgctgccgaacgagccgctggagccgggatcccagcgccgtcgattctggtcctctcgccgtttgcttcctgcgtggtgcagctcgtacggcatgagccgttcactctcgaccgccgcgtgcggcacttcgtcgggttcccgcatctcacgcatttcgtgtactgcaccggattcggggagcttgggctgctcgtccgagcgaggccggtccgattccgtacggcgcaccgatatgccgagccggacggcccagatcagtccgccggcgatcaccagaccgccaacaaaagcggcaaacacgttgagtacatcactcgacgcggccag

SEQ ID NO: 1108 - DNA, 1344 bp, Streptomyces avermitilis
  CDS (1)..(1344)
atgtatcgagcaaccaggaactccgtggacacgagtgagagcagcaccgacgacagcaccggcccagacaccgcggcgcccagcgtgcccccggcaccggcgcgaggggcccgcccgggctggcgccgctgggcgatggacaccaggccgctgcggcgccccgcctaccgccgcctgtggtcctcgaccatcgtcacctccgtcggcagccagctcaccgccgtcgccgtgcccaagcagatctacgacatcaccggctcgtcggcatgggtgggctacgccagcctcgccggcctcctcccgctcgtcgtcttcgccctgtggggcggcgcgatcgccgacagcatggaccgccgcaagctgctcctgatcaccaactccggcatagccgtcacctccctgctgttctggacccaggccgtcaccggggtcgactcggtgttcgtcctgatggcgctgctcgccctccagcaggccttcttcggcctcaactccccggcccgcaccgcctccatcgcccggctggtccccgcggacgaactgcccgcggcgaacgccctcggctccaccgtcatgcagacgggcctggtggcaggaccgctcctggccggcgccctcatccccgtcatcggcctgtccgagctctatctgctcgacgccctggccctgtgcgccacggtgtgggcggtcgtacggctccccgcgctgccgcccctgacgaccccggcgtccggccgcgccggctggcgggcgatagccgagggcttccgctacatctcgctgcacaaggtcctgctgctctccttcctcgccgacatcatcgcgatggtcctcggcatgccccgggccctgttcccgcagctcgccgcgcagacgtacgcgccctacggggagggcctcgcgctcggcctgctgttcgcggcgatccccatcggtgccgtggccggcggcctgatgtcgggcacgttctcgcgcgcccgcaggcacggcctcatggtgatcgcggccgtcgtcgcctggggcgccgcggtcaccggcttcggcctgagtacgaacctctggatcgcggtggccttcctcgccgccgccggagtcgccgacatggtctcgatggtcttccgcggtgccatcctgctgtcggcggtcaccgacgagatgcgcggccgcatgcagggcgtgttcaccgtcgtggtcgcgggcggcccacgcctcgccgacgttctgcacggcaccgcgggctcggtcttcggggcgcgcgcggccgtcgcgggcggtggactcctggtcgtcgtcgccaccctggccctggccttcgccacaccggccctgcgcacctaccggatc

SEQ ID NO: 1109 - DNA, 609 bp, Streptomyces avermitilis
  CDS (1)..(609)
atgaccaacgccctgaccaccgccgccgccggattcggcaccggcctctccctcatcgtcgccatcggcgcccagaacgccttcgtcctgcgccagggcatccgccgcgacgccgtgctcgcggtggtggggatctgcgccctgtccgacgcgttgctcatcgcgctcggcgtcggcggtgtgggcgcggtcgtggtggcctggccccgggcgctgacggcggtcgcgctggtcggcggcgcgttcctgctggtctacggcgccctggcggcgcgccgggtgttccgtccggcgggcctgcgggcggagggcgcgccggagggctcccgcagacgcgccgtactcacctgcctggccctcacctggctcaacccgcacgtctacctcgacaccgtcttcctcctcggctcgatcgcggccgaccgcggctcactgcgctggaccttcggtctcggcgcggccctcgcgagcctgtgctggttcgccgccctcggcttcggctcacggctgctcggccgcttcctggcgcgcccgtcggcatggcgggtgctggacgccctggtggccgcgacgatgctcacgatgggcgccaccctgatcgccggcgtc

SEQ ID NO: 1110 - DNA, 954 bp, Streptomyces avermitilis
  CDS (1)..(954)
gtgatggcggagctccctctcgacctggtacgcaccctgctcgccgtggtggacgagggcacgttcgacgccgccgcgagcgccctgcatgtgactccttcggcggtcagccaacgggtcaaggctctggagcggcgcacggggcgggtgctgctgatgcggacgaagccggtacgtccgaccgagtcgggcgaggccgtcgtgcggttcgcgcgccggctggcccgcctcgaactcgacgcccgcgccgaactcggcatgaccggttccgaggagccgacccggctgtcgatcgcggtgaactccgattcactggccacgtggttcctcccggcgctggcccgcgtgcccgaggaactgcggctgtcctacgaactgcgccgcgaggaccaggaccacacggccgcgctgctgcgcgagggcctggtgatggccgcggtgacctcgtcgccggacccggtgaccggctgctccgtacaaagtctcgggcggatgcggtacatggcggtggccggcccgggcttcgccgcgcggtggctcggtgaccggccggacgtgccgctgcggcaggtgctcgcagacgcgcccgtggtgtgcttcgaccggcgcgacgaccttcaggacggctttgtacgggggcttcggcgtggtcggggcggcgcgagcgcgctgcggcacttcgtgccgacgtcggagggatttgtcgacgcggtcgccgccgggatgggctggggcatggtgccgcaggtgcaggcagagccgctcctgcgggcggggcggctcgtgcacctcgccacggaccggcccatcgacgtaccgctgtactggcagcagtggaagctcgactcccccgcgctgtcggccgtggcggaggcggtggcttccgcggccgccgcggccctcgacggcgggagccaatggccgcacgtcacctccgccgtcaccggccgggga

SEQ ID NO: 1111 - DNA, 2241 bp, Streptomyces avermitilis
  CDS (1)..(2241)
atgtcaacagccagcggagacccgacaacagggacggccgacttctttgcggcgcccctggcggatgcctcgctccccgaggagtgggagagcggccaacaggcggtcaccgagcaggccaccaatccggcgagcggcaccgacgagatgtcggcgcccgaagagcaggtcacaaggacatccgcgacaccactgcccggcgcaccgaacggcgccgccgcgctcccctaccgtcccacccgcggccgctaccgcagcagcggcggcggcttccacctggagttgcgggtcgacgtcgacagcacggcgggcggcccgaaggtcctcaacaggatcagcggggacttcttcagcaccagcggcgccacgacgacgtactacgggtcgttggtcgtgcacgcgcccaccgtcacccggtccgccacccaggtggtcatcagcggcctgggcacctacacctggcaggccggcgccccgatcgtccgggtgaccattccgcggcgccggatcaaccagccgcagggcaccgccaccgtgcagttcctcaccacctccaaccagcccggcgccggctacacctgcgggtacgtctccccgtacttccgcaccgtccagtgggagcaggactcggtcaccggcaggattccgttcctctcctacgacaccgggtcgctcccgcagccgccgaacagtcccgcccgggcgctcaccgtgccccgcgcgtacgccgaggccggtatcgagctgctcatgtccggcaccgccaacaccatcgccgacagcccgggcggctggaccaacaccgaactgcacggcgccatgcagaccaacttcagcctgtggcgcgacgccccgcagtggaaggtgtggctgctggtagccggcagctacgaaggcatggcgggggtgcgcggcatcatgttcgacgccgccgactccttccagcggcagggctgcgcggtcttctacgacctgatcaagggcaccgacgccgagtcgcagcgcgcccagctgcgcacgtacgtccatgaactcggccactccttcaacctgctgcactcctggcagaagaacctggcgcagccgccggcgccgctcggtccgcagaacggcttcggcgatctgtcctggatgaactacccgcagaactacctgccgccgacgggcaccggcggggcggccgcgtactggggcgccttcccgttccagttcacggacaacgagctggtccacctgcggcacggcttctaccgcgacgtcgtcatgggggccaacgccttcggtatcggtgccgccgacatcgaaccggaactgttcgacgagcccctcgccgacgagtccgggctgcgcctggacctgcgggtcaccaagagcggcttcgcgttcggcgaacccgtcgtcgtggagctgaagctggacacgacggacctgcgcggccgctccacccacgaccacctccacccggacgacgaactcgtccacatcgccatccggcagccctccgggcgtaccgtgctctaccggccgctgctgcgccgctgcgtcgaccaggacgcgaccgtacgtctggacaccgaccggccggcgatctacagcagcgcctacatcggctacggccgcgacgggcactacttccagcagcccggcacctatcagctgcgcgcctcctatctggcgtccgacggctcccggatcgtctcgccggtgctgcgtctccacgtccggcaccccgtcagccagagcgacatcgagctcgccgagctgatgatgggtgaggaacagggcacgatcctcgccctgcgcggctccgactcgccgtcgctacaagccggcaacgacgccctccaggaggtcatcgagcggcacgccaaccacccgttcgccgtgtacgcgcggctcgccaaggggctcaacttcgagcacgagttcaagagcctgagccccgacaaggccggcctgaacgtgcgtcccccggacaccaagtccgggatcgagcagctcagtcaggtcgtgaaggtctccgagcagggcaagggggtcgacaacctgaccctcaacctggccacgcggcgactggcccgtgcctacgcccgccagggcgatctggaagaggccggctccaccctcgaccgactggtccggcacttcgacaccccggcgttcaagccgtacgtcgtggacgcggtccgcagtcaggcggactccacgaaggcccggctgctggccgagttcggcgacagc

SEQ ID NO: 1112 - DNA, 573 bp, Streptomyces avermitilis
  CDS (1)..(573)
gtgcgcggcctctgtggcagcatcgcgtacaggccccggaccggggcggggaaggagccggacgtgctcgatctcgtcctgtacgggccccaggggccgcagccgctcggcggttccgcgccggtccgggcgaaggtgcggaactcgggtgaacgtgctgtgtggatcgccggggtgctcgacgggtccgaggacggcatccgctttccgcactatctccccgccgtcaccctcgccgacggcggacgcaccgtcgcccggcccggcccggccgaggacccgctcgtcgggccgttgcgggtgggccatctgcttcggctggcgcccggggagtcgttcgatcccacggccggtgccgggtgcctgccgctgacgaccttcgccgcgttcgccccccaagcccccggccgctaccggtacacgctcaccctctccaccgaggcggggcgtcccgaggagtggctgggcggtttcggtctgccgtccggggccgagcgggaggaattgctggacctgatcgcgcgggtcccccggatcaccgtgtcggccgctccgctgatcctggagttccgc

SEQ ID NO: 1113 - DNA, 834 bp, Streptomyces avermitilis
  CDS (1)..(834)
atgccccactcgattccacagcccggcctttcgttctgcctcgcggcgcatccggtgcccgcgcccgcgggaagcggccgcccggcaacggcgacgctggatgtgtcgccgcaggcgcgggtggcggcgcaggtgcgttccgcgctggaggcggtgttcgaggccgtcgaggagacgcgggcggacacggcggcgttgctggcgcaagtggccgggctgggtcgtcggccggcgaccgtggatctggccgggctgcggccggggcttcatctgcggctggcgcggcaggagctggtctcgggggtggggttcgtggccgcgccggggctgctgggcgatgtgccgacgtggctggagtggtggcagaccggtgcggacggggcgctgcggccgttgctgctcgacctggacccgcggcagtcggcgtactcggattacacgcactgggactggttcgcgctgccccgtgacaccgggcgccgggcggtggccgggccgtatgtggactatctgtgttccgaggagtacagcctcaccctgtccgcgccggtgcaggtggaggggcggttcgcgggggtggccgcggcggatgtgtatctgcggcacttcgagacggccgtgatgcccctgctgcaacggctgccgggcccggcgcacctggtcaacgcgcgcggccgggtcgccgcctccgccgaccccgcacacctggccggctccctcaccaagggccccgacttcgccgccgtcctcacccaggcccggccggaacacttcgacggcctgcacctgatgccctgcgacggcgtccccctcgtcctcgtcatggccgagcgg

SEQ ID NO: 1114 - DNA, 1296 bp, Streptomyces avermitilis
  CDS (1)..(1296)
gtgatccgtggcgccccaacagaatccggtattccgtccccttcagccccttcctttcacctctcccccccacacccacacaccgtggagatttccttgcgtttgcacagatccttcaaagccgcggccgcggccggcgccctgctgctcgtcagcggctgcggattgttcacggagtcggacgcctcgtcctcggcgtacggtctcaacccgccggatctcaaggcgcagtcgaagctcggcaagaccgagggccaggtcaacctcatcgcctgggccggctacgtcgaggacggctccaacgaccccaaggccgactgggtcagcagtttcgagcagcggaccggctgccaggtcaagtccaaggtcgcggccagctcggacgagatggtcaagctgatgaagacgggcaactacgacgcggtctccgcgtcgggcgacgcctccctgcgtctcatcgcctccggcgacgcggctccggtcaacaccgacctcgtgcccaactaccaggacgtcttcttcggtctgaagaagcaggcctggaactcgttcgacgggcagccgtacgggatcccgcacggacgcggcgccaatctcctgatgtacaacacgcagcaggtgaagcccgccccgacctcgtggtcggcggtcttcgacgacgcgtcgccccacaaggggcacgtcacggcgtacgactcgccgatctacatagcggacgcggccctgtatctgcgcgagacccagccgggcctcaacatcgagaatccctatgcgctcgaccaggaccagttcgacgccgccgtggccctgctgaaggaccagaacgcgaacgtcggcgagtactggagtgactacctcaaggaggtctccgccttcaagagcggcgactccacggtcggcaccacctggcaggtgatcgccaacctcgccgccgacgaaggcgccaaggtcaaggccgtcctgcccatcgaaggcgccaccggctggtccgacacctggatgatctccgccaaggcgaagcaccccaactgtgcctacaaatggatgaactggatcatctctccgaaggtcaacgccgaggtcgccgagtactacggcgaggcgccgtcgaacatcaaggcgtgcgacgagatcagcgacgacgcgttctgcgacacgtaccacgcgacggacgagggctactggaaggacatcgcgttctggacgacgccgatcgagcagtgcctcgacgggcggacggaagtgaaatgcgtgccttacgccaagtgggtccaggcctggaccgagatcaagggc

SEQ ID NO: 1115 - DNA, 1494 bp, Streptomyces avermitilis
  CDS (1)..(1494)
gtgcgcaagcgtgagcgtgggacggtgctcggagtcgacatcggcacgtccagcagcaagggtgtcctcgtcgaccaggacggaacggtgctcgccaccgccgtacgaccgcacaccgtcagccgtccacgacccgggcacgtggagctggacgcccgcgtgtggtgggacgagttcgcctccctcgcccgtgagctgaccggccggggcagcgaggtgaccgcggtcggcgtcagcggcatgggcccctgtgtcgccctcaccgacgaggccgacacgccgttgcacccggcgatcctgtacggcgtcgacacccgtgcgacggagcagatcgcccggctggaagccgagttggggcgggaggccgtcctggaacgctgcgggtccctgctctccacccaggccgtcggtcccaagatcgcctggctggcggagcacgcacccgacgtcatcgcccgcgcccgccggctgtacatgccgagttcgtatctcgtgcgccggctcaccggggcgtacgtgctcgaccaccactccgcgagccagtccgtcccgctctacgactccgtcgcccaggagtggtacgcgccctgggcccggcacatcgcgccctggatcgaactgccgcggctcggctggccgggggacatcgccggccacctcaccgccgaggcggccgccaccaccggactgcccgcgggcgtccccgtcgtcaccggcacgatcgacgcctggtcggaggcgctgagcgtgggagcccagtgcaccggggacctcatgctcatgtacggcagcaccatgttcctgatcaacacggtgaccgaacgcctgctggtcccgcaactctggagcaccgtcggcgcgttgcccggcacgcgcaacctcgcgggcggcatggcgacctccggtgtgatcaccgactggctgcgggagttgttcggcggccccgagcacagcgcgctcctcgccgaggcggaggccgcggggcccggcgcgaaggggctgctcatgctgccgtacttcgcgggggagcggaccccggtcgccgacccggacgcccgcggcgtgatcgccgggctgacggtggagcacacgcgcggcgatctgtaccgggccgcgctggaggcgaccgcgttcggcgtccggcacaacgccgaggcgatgcgggcggccggcgcggacgtccaccgggtcgtcgccgtcggcggcggaacccgcggcggactgtggacccggatcgtctccgacgtcaccggcctggaacaggagatcaggaccgtcacgctcggagcgagctacggcgccgcgttcctggccgcgcaggcggtcggcgacgcggacatcgacgcctggaatccggtacgggagcaggtcgcccccgacgcccggctacggccccgctacgacgacctgtacgacctgtatctgcgcctgtatccggcgacccgggacatcgggcacgcgctcgcccggcagcagcgcgacatcgccgcttcc

SEQ ID NO: 1116 - DNA, 675 bp, Streptomyces avermitilis
  CDS (1)..(675)
atgaagggtgacctgttttccagtgaccacatggtggagcccgccgtcgcgccgggcatgaccgtgcagaacgccaagtccatcaagtacgccgtgaacggcgacatgctcgcgcggcagggggcgatgatcgcctatcgcgggaacctgcagttcgagcgcaagggccagggcgtgggcggcatgctcaagcgggcggtcaccggcgaggggctgccgctcatgaccgtgcgcgggcagggcgaggcctggttcgcgcacgaggcgcagaactgcttcgtcgtgggcatcgagccgggtgacgtgttcaccgtcaacggccgcaatgtcctgtgcttcgactcgacgctgacgtacgagatcaagacggtgaagggcgcggggatcagcggcggcgggctgttcaacagtgtcttcaccgggcacggcaagctggggctgatctgcgagggcaaccccctggtgatacccgtgtcgcagcagcagcccgtgtacgtggacaccgacgcggtggtgggctggaccgcccatctgcacacctcgctgcaccgttcgcagtccatcgggtcgatgctgcgcggcggttcgggcgaggcggtgcagctgaagctggagggcgacgggtacgtcgtcgtacggcccagtgaggcgacgccgcagaaggtgcagcagcac

SEQ ID NO: 1117 - DNA, 1782 bp, Streptomyces avermitilis
  CDS (1)..(1782)
gtgcgtagaccccacatacgtggcgtggccatcgccatcgccgtgacgacggcggccacgctcccggcggtcccggctgtcgccgacgcgcccgccctcgccgcggctgcggcctcctcgccggtggacgcggcccgggcggcagcgttcgcccacgcgtccgccaccggcgtctcccggggggacaccctggaggcgaaggacgtcctgaccgacccggacggcaagcagcacgtccgtttcgtgcgcacccaccagggcctgccggtcctcggcggtgacctggtcgtccacctcaccaagcgctcgacgtacctcggtgtgacccgcgccgccgaccacacggtcaagccggccgccgccggccaggcgaagctgacgcccgcgcaggccgagcagaaggccgccgcggccgcccagggcgacgccaccgaggccgcactcgtcgtggacgcgcgggacggcggctccgccctcgcctaccaggtgcgggtgaccgacagcaagaccacggaggccaccggctcccgcacggtcgtcgtcgacgccgtcaccggccgcatccgcagcaacacccccgacagcgacgagttcatctcgccctcgctggcccagaccctgcgcgagcggggcgagacggcgaaccccgcgaccggcaccgccgactccgcgctcaccggctcctcgcttctgacgggcatctccggggccgcgagctacccgcgcaaggcctccggcaccggtacctccctcttcgtcggcaaggtggggctgagcaccacccagaccgcccgcacgagcttcctcctcaaggactccacccgctggggcaccgagacccgggacgccaaggggcagtacctcgaagccttctcgcgcggcaagaagttcaccgacaagaacaacaagtggggcaccggcaagaccagtagccgccagagcgccgcggtcgacgcccagtacggcgtcaccaagaccctggacttctacaagaagacgttcgggcgcaagggcatcaagaacaacagcaccggcgcccgcgcgatggttcacttcggcaccaaggtcggcaacgctttctgggactccgcctgcggctgcatgctgtacggggacggggacggcgacctcttcaagaagccgctggtcgtcctggacgtcaccggccacgagctgacccacggtgttgtcgacgccaccgccgccctcgaacccacccgcgtggaccgggacggcaaccagttcggtgagccgggctcgctgaacgagtcgctcgcggacatcttcggcacggggatggagttcgcgaccaacaactccaaggacgcgggtgactacctcgtcggcgagaagctcggcctggaccagaagttcctgcgccgtctcgacgagccctcgcgcgacaagctcgaggggaccatcgactactggtcgcccgagacgtacgacaccgaggtccacgccggctccggtgtctcctcgcacgccttctacctgctggccgagggaagcggcaggaagacgatcggcggggtgaagtacaactcgcccacctccgacggctcgacggtcaccggcatcggccgggccaaggccctcgcgatcttctaccgggcgctgacccgctacatggtctccacgacggacttccacgacgcgcgcaacgcgacgctgaaggccgccaccgacatgtacggcgccgacagcatcgagtaccagacggtcgacaaggcctgggccggggtcaacgtgacctccgccaacaccccgtccaccggacgc

SEQ ID NO: 1118 - DNA, 1032 bp, Streptomyces avermitilis
  CDS (1)..(1032)
atgaccaccctgacgacggccctgaaggccggtcccgaagcgcccgccatattgcaccgctgccgtgaactggtcgccccggccctggccgaggccgtcggcgggatgcatccatggatgcgggagatggccgactacgcgctgggccgtggcgcggcgggcggcgccccggccgcgcacagtcagggcaagggcgtacggcaggcgctcgccgtgctgggggcggaggccgccggagggccggcggaagccggcgtaccggccgccgtggcggtcgaactcgtgcacaccttctcgctgttgcacgacgacatcatggacggcgacgcgatgcgccgaggccgcccggcgctgtggaaggcgtacggcacgggccccgccgtcctggcgggcgacgccctgttcgccctggccgtgcagacgctgaccaccgcgtccgcgcccggagccgcgcaccggctgagcgcggccctcggtgacctggtgcgggggcaggccgacgacctgctgttcgcccaccggccctggaccgggcccgaggcggtgagcgtcgccgagtacgaggcgatggccgagcacaagacgggatcgctgctcggctgcgctctcgcgctgggcgcccacctcgcgggtgcgccggaggagacggccgccgtgctggaccggacgggacgtcatctcggagtggcgttccagatcgtcgacgatctgctgggcatctggggtgatcccgcggtcaccggcaaacccgtccacggcgatctgcgtcaggggaagaagacctttccggttctcgccgcgctggccaccccctccggctccgcgctcgagggtctcctcacggcccgcgacgacaccgcggtggtgcgggcggcggccgttgtggaacaggcgggcgggcgctcggccgcgctgcgggaggcccgccgtcatctcaccgtggcgcacggactcctggcctccgtccagccggccccgcgtcccgccgccgacctgcgcaccctgctctccgccctcagccggcgcacgatc

SEQ ID NO: 1119 - DNA, 1056 bp, Streptomyces avermitilis
  CDS (1)..(1056)
atgtacggcaaggccttcgccccggagtaccagggcgctctgaccaccctctcggtgaactcctcgctgaccgacgtcctggccgcgggcaccgaacagctgcgcgccgcggagcgcgccggggcgcggggcgaggcggcccgctccggtctggcggtggccgaggcgcaccgccggctcggccaggtcgcggacgcggagcgggcctggaaggcgagctaccgcaccgcccgcgaggccggcgacaccggcgcgatggcgtgggcgctgtggagtggcggcaccctggcccgccagcggggcgccctgcctctggcctggcggctgctgcgactggccgccgaactcggcaagcacgcgggcgatgtcgtcgtacgtggctattcgctcgcgggaatggcggaaaccggtcggatccagggcgattacgaggccgtcaccaccctgcacgagcagctcctcgccgaggccaggaaacgcggcgaggcgcgccacaccgtctgggccctggagggcatcgcccagatacaccgcaacaccggctcgtacgacaccgcgtacgccatgttcgaggaggcggccgcgatcgccgcgggcgccgaggaccgccgcggtcacgcctgggccctgcgcggtctcgccgacatcgtctccgtgcgcgaccgggaccccgagcgcgcgctggccctgctcggtgaggccgaggtctcctgccgggagatgaacctcgtcagcgcgctggcctacaaccacaagatgcgcggcaacgtcctctaccgcgccgggcgttacgcggaggcccgggaggtctacgcgcaggcgctcgccgagttcgacgggatgagcgagccacgcggccgggccctggcccgcctcggcctggtcaagtccctggcccgcctgggccgcgaccgtgccgagaccggtgccgagctggacgaactcgtcggcgtgctggacggcatcggcctgcggcacggccgggagctcatccgtggggcgcgcgaggaactcggtctcgcgccgcggtcgtcggccggtcgggaggccggccga

SEQ ID NO: 1120 - DNA, 624 bp, Streptomyces avermitilis
  CDS (1)..(624)
atgtccacgcacctccagggatcgctcttcgaccagaccgacgaactcgggctcggcccgctggacggcctgcgacggaccgtcctgggtgccggggcctggatcgatctgctgccgggctggctcagcggcgccgacgccctgttcgaacggctcgccgccgacgtgccgtggcgggcggagcgacggaagatgtacgaccagacggtcgacgtgccccggctgctcgcgtactaccgggcgggcgacacgctgccgcaccccgtcctcgccgaggctcgcgacgcactgtccgcgcactacgtggccgagctcggcgaaccgttcaccacggccgggctctgctactaccgcgacggccgcgacagcgtggcctggcacggcgaccggatcggccggggcgcccgcgaggacacgatggtcgcgatcctctccgtgggcgcgccccgcgatctggccctgcgtccgcgcggcggcggcgacgtcctgcggcgcccgctcggacacggcgacctgatcgtgatgggcggctcctgccagcggacgtgggaacacgccatccccaagagcacccgggcggccgggccccggatcagcatccagttccggccgagcggcgtgaac

SEQ ID NO: 1121 - DNA, 585 bp, Streptomyces avermitilis
  CDS (1)..(585)
atgaccactccctccgccgccaccccgccggccgccgccccggcgcgccgtgacgccgaggcgaccaaggcggccatcctccgcgcggcccgccatctgctggcccgccacgcccacgcggacatcaccctcaaggcggtcgcggaccgggccggggtcagcccgccgctgatactgaagtacttcggcaacaaggacgcgctcttcgcccgcgtgatgtccttcgaggccgatgtcccggacctgctggacgcgcccctcgacgacctcggccggcacatggtccggcatgtgctggtcggccagaccgagcggggcgccgaccccgtcctgcgcatcgtcttcgcacccctccagggcgaacagggcgacatcctgcgcgccaacttccgcgcccaggtcggcgaccgcctcgccgagcgactggccggccccgacgccggtctgcgtgccgaactcgcggtgagcgcgctgctcggcctcggtgtcatgttcggcatcgcccgcggcacccatctgcgtgccgccgccatcgacgacatcgtcgaccgctacgccccggccgtgcagatgcacctcacgccc

SEQ ID NO: 1122 - DNA, 1554 bp, Streptomyces avermitilis
  CDS (1)..(1554)
gtgaattcctattcacctcccttcttcacgtcggctgccgcccctggagtgaccatggtcccgatatccaccccgtccgaccggtccgcgacccccgacggaccggccggacggccgggtgtccgcgaccggctgacggtccccgtcctggcgttcggcggaatcctcatggccgtcatgcagacggtcgtggtgccgctgctgcccgacctgccgcgcctgaccggcgcttccgcgggcgccgtctcctggatggtcaccgccaccctgctctccggcgcggtgctgaccccggtgctcggccgggccggcgacatgtacggcaagcggcgggttctgctcgccgccctcgcgctgatgaccctgggctcgctgctgtgcgccgtcacctccgacatccgcgtgctcatcgccgcgcgggccctccagggcgcggcggccgccgtcgtaccgctgtcgatcagcatcctgcgcgacgaactcccgcccgagcgcacgggttccgcggtggccctgatgagttccaccgtgggcatcggcgccgcgctcggtctgccgatcgccgcgatgatcgtgcagtacgccgactggcacgtcatgttctgggcgaccaccgggctcggcgccggcggactggcactggcgtggtgggcggtgcgcgagtcgcccgtccggcagccgggccgcttcgacacgctgggtgcgctggggctggccgcgggcctggtctgcctgctcctcggtgtgtcgcagggcgggcagtggggctggaccagtccgcggatcgtcggcctgctcgtggcctgcgtactcgtactgacgctgtggtggttccagcagtggcgggccccgcggcccctggtggacctgaagctggcctcccgcccccgggtcgccctgccgcacgtggccgcgctgctgaccggattcgccttctacggcaactcgctggtcacggcgcagctggtgcaggcgcccaaggccaccggctacggactcgggctgtccatcgtgcagaccggtctgtgcctgctgcccggcggcgtcatcatgctgctgttctcgccggtctcggcgcgcatctcggccgcccgcggcccgcgcgtgacgctggcactcggggccgcggtcatcgccgtcggctacgccgtgcgcatcgcggacagccgcgacctgtggatgatcatcgtgggcgccacggtcatcgcggtcggcacgaccctcgcctactcggccctgcccaccctgatcctgcgtgccgtgcccgccggacagaccgcctccgccaacggcgtcaacgtcctgatgcgcaccatcggccaagccgtgtgcagcgcggcggtcgccgccgtcctggtccaccacaccagcctggtgggaggcgccccggtacccaccctgcacggctatctgctggcgttcgcgatggcgggtacggtcgcagtgatggcctgcgccgccgccctcgtcatccccggggaccccgactcccacggcacgcgacgggcccgcggccgtacccggccgtcccacgacgaggcgctggaaggagca

SEQ ID NO: 1123 - DNA, 1203 bp, Streptomyces avermitilis
  CDS (1)..(1203)
gtgaagatcgcgtgcgtcggcggcggacccgcaagcctgtacttctcgatcctgatgaagcgccaggacccgtcccacgacatcaccgtccacgagcggaaccccgccggatcgacctacggctggggcgtgacctactggagcggcctgctcgacaaactccgcgggagtgaccccgagtcggcgctcgccgtcagcgagaactccgtccgctggagcgacggagtcgcccacgtccggaaccgcaccacggtccaccacggcgacgagggcttcggcatcggccgccgcagattcctcgacgtactggccgaccgggcccggtccctgggcgtccgcatcgagtacgagcatgagatcggcgccgacgacccactgcccgaggccgatctggtcgtcgccggcgacggggtcaacagcgtgctgcgcggccgctacgccgaccacttcggcagcgagaccgtgctcggccgcaaccgctacatctggctcggcaccaccaaggtcttcgactcgttcaccttcgcctttgtggagagcgaacacggctggatctggtgctacggctatggattcagcgacggccacagcacctgcgtcatcgagtgctccccggaaacctggaccgggctcggcctcgaccgggccagcgaggccgacggtctcgccctgctggagaagctcttcgccgacgtcctcgacgggcacgagctgatcggccgggcgcagagcgacggtgccgcccagtggctgaacttccgcaccctcaccaaccgcacctggcatcgcgacaacctcgtcctgatcggcgacgccgcccacaccacccactactccatcggcgcgggcaccaccctcgccctggaggacgccatcgccctcgccgaagccctgagcgcgcaccgcgacctgccgggcgcgctcgccgcctacgagcgggaacgcaagtccgcgctcctgcacatccagagcgcggcccggctcagcgcccagtggtacgagaacctcccgcgctacatccgccttccgcccccgcagatgttcgccctgctcggccagcgccattccccgctgctgccgtacgtgcctccgcagctctactaccggatcgaccgggcggccggacaactggaggcgctgcgcaggctcaagcgctggctggggccgcgactggcgcgtaccgtccaggcgcgcacgggccgg

SEQ ID NO: 1124 - DNA, 465 bp, Streptomyces avermitilis
  CDS (1)..(465)
gtgacgcatccgcccgccggcccggtcctggccgcactcgtctcccgggcgaccgggggccgctactggcgactggaccggccgggcgccggtctcgacgccgaggcgatgcacatcccgccgggtgcggcggccgagccgcccggtgaccgctcgcgggacgtcctcgtgatcgccctcgacgggggcggccggctccggacaccgggcggatggctggagttggcacccccggccgccgtgtggctgccccccgccgctggataccggctgcacgcgggggaggcggggctgcactgcgtgaccgtacgcccgcgccgtccggccgctcccccggccctgccgacgacgggggcgaccggagagcccgcatgcctgctgcaccaggtctgcgccgagtgcggacgtatggccacggagagcgacgcccgctactgcaatcgctgcgggaaccccctggagcgg

SEQ ID NO: 1125 - DNA, 354 bp, Streptomyces avermitilis
  CDS (1)..(354)
atgcccgaactcacccgccgtcatgccctcggggccgccgccgccctggcggccgtggccggcactcaggcccttgccgctccgtccgcgtccgcggccgggcaccacgggggtccccagccgttcgacgaggtctatcaggggcgccgaatagagggccgcgcgaccgggggcggtcatcaccacggctccgggtacggcgtgttcatcgacgggatggaactgcacgtgatgcagaacgtcgacggcagctggatcagcgtcgtcagccactacgaccccgtggccaccccgcgcgccgccgcccgcgccgcggtcgtggagcttcagggcgcgccgctcgtccccttcaac

SEQ ID NO: 1126 - DNA, 822 bp, Streptomyces avermitilis
  CDS (1)..(822)
atgaccgtacgcaagaaccaggcgaccctgacggccgacgagaagcggcgcttcgtcgacgcgctcgtggcgctcaagcgcagtggccgctacgacgagttcgtcacgacccacaacgccttcatcatgggcgacaccgacagcggcgaacgcacgggccatcgttcgccttccttcctgccctggcaccgcagatttttgatcgagttcgagcaggcgctccaggcggtcgacccgtcggtcgcgctgccgtactgggactggagcaccgaccgcacggcgcgtgcctccctgtgggcgcccgacttcctcggcggcagcggacgcagcctggacggccgggtgatggacgggccgttcgcggcgtccaccggcaactggccggtcaacgtgcgggtcgacagccgtacgtatctgcggcgcacgctcggcggcggcgggcgcgagctgccgacccgggcggaggtcgactccgtgctcgcgatgtccacgtacgacatggccccgtggaacagcgcgtcggacgggttccgcaaccatctcgagggctggcgcggtgtgaacctgcacaaccgcgtccacgtctgggtcggcggccagatggccaccggggtctcccccaacgacccggtcttctggctccaccacgcctacatcgacaggctctgggcccagtggcagagccgccacccgggctccggttatgtgccgacgggcggcacgccgaacgtcgtcgacctgaacgagaccatgaagccgtggaacgacgtacgccccgcggacctgctggaccacaccgcgcactacacgttcgacaccgtc

SEQ ID NO: 1127 - DNA, 708 bp, Streptomyces avermitilis
  CDS (1)..(708)
atgatcgggggcatgtctgaacgtgtggtggccgcctgtgacggggcgtcgaagggaaaccccggaccggccggatgggcctgggtcgtcgccgacggcgaggagaccccgacccgctgggcggccggggcgctcggcacggccacgaacaacgtggccgaactcaccgcgctggagcgcttgttgagcgcgatggatccggacgtcccgctggagatccggatggactcccagtacgcgatgaaggccgtcacgacctggctgcccggctggaagcgcaagggctggaagacggccgcggggaagccggtcgccaaccaggaactggtcgcccgcatcgacgaactgctcgacggacgctccgtcgagttccgttacgtccccgcgcaccaggtcgacggcgaccggctcaacgacttcgccgaccgtgccgccagccaggcggcgatcgtccaggaaccggcgggcagcgagtacggctccccggagccgccgaagtcgcccgacaccgtcgcggccggctccgcgggtcgcggcgctcccgccaagaagcgtgcctccgcgcgcaccgccaagacgagcacgcgcacgatcaaggcgaagttccccggccgctgtgtctgcggccgcccctacgcggcgggcgagcccatcgccaagaacgcgcagggctggggccacccggagtgccgtaccgccgacgacgtc

SEQ ID NO: 1128 - DNA, 489 bp, Streptomyces avermitilis
  CDS (1)..(489)
atgaaaccgttgaccggcagcaccaccgaccaggcaccggccgatccggccgccaccgacgacgtgttggccacccagcccatcggctactggagcggtctggcccacacggcggtcacccggcagctgcgggacgccatggccaggatcgacgtcacacagccgcagtactgggtgctcaaccgcgtgcacggcgggcccgcggcgccgggccgggaggaggtggtcacccagctgacgcccctcgcggacgggccgcacgagatcgcgcgggtcgtcgaccagctgcttcaccggggctggcttcggatcgacgccggacagcgcctgcgtctcaccgacaccggggaggctgccaggaagcggctgcgtgagctggtgaccgagctgcgcgcggtggtccacgagggcatcagcgacgaggagtacgtgaccgcgctcaaggtgctgcgcacgatgatcgccaacgtcgagggcgatgcgggctgc

SEQ ID NO: 1129 - DNA, 795 bp, Streptomyces avermitilis
  CDS (1)..(795)
atggccgtataccccgagggaaagccctgttgggccgacgcgatgttcagcgatgtcgagggggccaagaccttctacggcgatgtgctcggctggacgttcggcgagtcgtcgtccgagtacggcaactacacacaggcgtacgccgacgggaaggcggtcgccgccgtcgtaccgcccatgcccggacaggaggggcactccgcctggtgcctgtacttcgcgtctcccgacgccgccgcgaccgcccgaaagatccgggacaacgggggtgaggtgctgatggagccgatgcaggtcggcgatttcggcaccatggccctggcccgtgagccgagcggtgccgtcttcggcgtctggcagcccggcgtccacaagggcttcgaggcgacggccgtgccgggcgcgtactgctgggccgaggtcttcacccgtgagcccgagaagcccgacgcgttcttcccggccgtcttcccgctcaccgcccagcagatcgaggacgaggcggtcgacttcaggatcttcagcgtcggcgaggacgcggtcctcggccggatgaagatgacggacgacttcccgcccgaggttccgtccttcatcaacgtctacttcacggtcgaggacgtcgacgcggccgtcgcgaaggcgaccgagcacggtggcatcctgcggttcggaccgatggacagcccgttcggccgtttcgcggcgctgagcgacccgcagggcgcgtccttcgccgtcatcgacatcaagaccacccagggcgagctgcccaagctgaccgacgtgtcc

SEQ ID NO: 1130 - DNA, 1002 bp, Streptomyces avermitilis
  CDS (1)..(1002)
atgtgggcatgggaagtggagcggccgggtccgatcgaggacggtccgctgcggttcgtggagcggccggtcccggtaccgggacccggtgagctgctcgtgcgggtgcgcgcctgcggggtgtgccgtaccgacctgcacgtcagcgagggcgacctgccggtgcaccggccccgggtgacacccgggcacgaggtcgtgggcgtggtggcgggacggggcgcggacgccggcggctacgcggtcggggaccgggtgggggtggcctggctgcgccgtacggacggcacctgccggtactgcgtgcgcggggccgagaacctctgtccggcgtccgagtacaccggatgggacacggacggcggctacgccgagtacacgaccgtcccggccgcgttcgcgtaccggctgcccaccgacgtcgacgacgtggcgctggcgccgctgctgtgcgcgggcatcatcggctaccgggcgctggtgcgggcgtcgctgccaccgggcgggcgactcggtctgtacgggttcggcggcagtgcccacctgtgcgcacaggtcgcgctcgcacagggcgccaccgtgcacgtactgacccgggacccggcctcgcagcggctcgcgctcgccctcggggccgcctcggcgggcggggcgtacgacaccccgccggagccgctggacagcgcgatcctgttcgcgccggccggcggtctggtgccggtcgcgctgcgggccctggaccgcggcggggtgctgtcggtcgccggcatccatctgagcgacaccccgccgctgtgctacgaacgcgagctgttctacgagaaggagctgcgcagcgtcacctcgaacacgcgcgcggacggccgggagttcctggagctggcggcccggtacggggtccgggccacgacgcacacctatcccttgtccgaggcgcagcaggccctgcgggatctgaaggcgggccgcttcgacggggcggccgtcctggtcaacgacgtc

SEQ ID NO: 1131 - DNA, 1299 bp, Streptomyces avermitilis
  CDS (1)..(1299)
gtgcggctccggcctgcgcgtgcgtggatggatccaggcgtgtggtggcggaggtggcccgcgatggacgacgtggacagtgcgaacgcgccgtccggcgcgttcgacgccgtcgaagcgatcggcaccaccctcgacgagcgcaccacgtgcgcggaactcgccacgtacgtgtgccggaagacgggcgaggccgccgcggtggacctgctgcccgtcgacgttccggccgcgccgcccatgccgcacgcgccgcagccggccctgacccgggtggccaccgcgggccggagcgggctgctggcgtcgtggggcgtcgagggcccgcggccgctggccgtgcgggcgctggacgaggggcatccgatcaccgcctcgatggatctgtccggccgtgtcccccggcaggtgatgacggtgccgctgctggcccacggccgtctctacggggtgctgctcgtggtccggcagggtccggcgttcacggaccgggacacggcggtcacgcacttcgcggcccgcctcgccgccgtccacctggggcacgcccggcagcacgggaccgtccgcagcacggcgctcgacctgcagcgggccctgctggccgagccgggccggccgcatccgaacctctccctggcgacccgctatctgcccgcgggaggcggggccctcgtcggcggggactggttcgagaccatccggctgcactacgggcggacgctgctggtgatgggcgacgtcatgggccacggcctggaggcagcggtggacatgaacgcctaccgttcgatgctgcgctacgtcgcctcgaccgacctgccgccccaccgggtgctgcgccggctggacgcggcggtggccgaggacggcatccgccgcccggccacctgtctgctggtgcgggtcgacccggcgcgcgggtcggtcgcgctggccagtgccgggcacctgccgcccgtcgtgttcagcggggacggcaccggcgaactcctcgacgtgcccgtcggccctccgctggccacgggagtgggtggctacgagccggcgacgcggcctctggcggccgacgagaccctggtgatgttcaccgacgggctggtggagcggcgcagagaggacatcgacgtgtccctcgcacggctggccggactgcggctgccgcccggcgcggtcgtcgaggagatcctctcccggctcctcgcacacctcgacgcccggaacgccgaggacgacgtcgccgtactggccgcgcgcatccgccgacggcccatggtgaaccgggacgctcacgcaggc

SEQ ID NO: 1132 - DNA, 906 bp, Streptomyces avermitilis
  CDS (1)..(906)
atgcggaagccgtggatcgtggggatagtgctgggcgtgctgctgctcggcgcgtgcggggatccggcgtccgggcccgagggggccccgcccgcgcccgaggtgcgggggacatcggcggccacgcgtcagggcgccgccgcctctccgagggcgagcgcgtcggtgcgggcccccaccgtgctgtacctcggcgactcgctcgcgatggagaaccagaaggtcctcggcggcctgctgcgggacgggctgcacgcgaagtacacgagcgccccctactccgggaccacgctgtgcgactacctggaaggcaccgccgtgcggtcgctggtcccggccgcggacaaggccgccgccctggtccgctcgacacaccccgacttcgtggtgcttcagttctggggcaactcctggggctacacgccgtgcatggacgggatcacctacgacgcggcccgttcgaagtacttcgcgcggtacgcggcggacgcgaagacgctgaccgagcagatcgccgcggcgggcggcgcccgacggcccaaggtggtctgggtgttgcagggccccgacccgatcacccccgaccgcgtccgccgtgtgaacgcgctctacgaggagcgcgcccgcacctcggacggcctcgtcgccgacgcggggaaggcggtgagcccggccaccggccgctacacctggtcgcagtacctgccgtgcacggcgtacgaacacgcccacgcggcgtactgcacccagccgggacgcgaccgtaccgccctccaccgcgacgacgactacctgcacttctgtctggcgcccacgacgtccacaccgaaaccctgtccggcccgctcccccggcatcctgcgcatcgcccgcgcgatcgcccgggcgatcggagcgcacctgggc

SEQ ID NO: 1133 - DNA, 2562 bp, Streptomyces avermitilis
  CDS (1)..(2562)
gtgaacccatccctcggcagacggcacttcctcgccgccaccggtacggccgcggcggcagcgaccgtggccaccggtggcgccggcgcagcacacgccgccaccggagccgccccgaccaccgccggcaccggcaccgacaccgacaccggcaccggcaccggcaccggcacgcgccccttcccgctcggcgcggtgactctcctggacggcccgttccgcgacaaccagcggcgcaactccgcctatctgcgcttcgtcgacatcgaccggctgctgcacaccttccgcaccaatgtcggcctgcccagtgacgccgagccgtgcggcggctgggaggggccgggcgtggaactgcgcggtcactccaccggccatctgctgtccggactggccctcgcccatgcgagcacgggcgaggaggcactgcgcgacaagggccgccggctcgtcgccgcgctcgccgagtgccagtcggcggcgcccgcggccggcttcggcacgggctatctgtccgcgttcccggagagcttcttcgaccggctggaggcgggcagcggcgtctgggcgccgtactacaccatccacaagatcatggccgggctcgtcgagcagtaccggctggtcggcgtcggccaggccctggaggtcgtgctccggcaggcgcggtgggtcgacgagcggaccgcgaaactgtcgtacgagcagatgcagcgcgtgctggagacggagttcggcggcatgaacgacgtgctcgccgacctgcacgccctcaccggtgacccccgatggctcgatgtcgccgagcgcttcacccacgcccgcgtcttcgatccgctggccgggaaccaggacaaactggcgggactgcacgccaacacccagataccgaagatggtcggcgcgctgcggctgtgggaggagggccgggcggaccgctaccgcaccgtcgcggagaacttctggcagatcgtcaccgatcaccacacctatgtcatcgggggcaacagcaacggcgaggcgttccacgaaccggacgtcatagcgggccagttgtccgacaacacctgcgagaactgcaacagctacaacatgctcaaactgacccggctgctgcacttccacgcgccggaccggaccgacctgctcgactactacgaacgcactctgctcaaccagatgctgggcgagcaggaccccgactccgagcacggcttcgccatctactacaccggcctggctcccggatcgttcaaacggcagccgtccttcatgggccccgacccggacgtctactcgaccgactacgacaacttctcctgcgaccacggcacgggcatggagaccccggcgaagttcgccgacacggtctactcgcacgacggccggagtctgcgggtcaacctcttcgtcccgtccgaggtcgtctggcgggcgaagggcatcagctggcggcagacgacgcgcttccccgaccggtcctccaccacgctgaccgtcagttcgggccgggccgcacaccggctcctgatccgcgtcccctcctgggccgccggtgcccgggcgacgctcaacggccgcgccctgcccgaccgtccgcagcccggctcatggctcgccctggagcgggtctggcgcaccggggaccgcgtagaggtgtccctgcccatgcgcacggccgtcgaggcgacccccgacgaccccgacgtgcaggcggtggtgcacggcccggtggtgctggccggggcgtacggcgaccgggcgaacccgtggctgccgcggctggacgtgacctccgtgcggcaggaggcgcgggaaccgctgcgcttcaccgcccgcgccgacggcgaggaggtcacgctgctgccggtcgcccgcgtgcaccaccagcactactccgtgtactggctcaccggcgaaccgccctccccgcccccggagttcgcggcctggcaccgcttcgacgagaccacgggcagcacggccgccgacgccaccgggaacggcaggacggcccggctgagcggcggcacctcctggtcggcgtccggccacgacggcggagcggtgtcgctggacggcgccgacggccatgtcgccctggccgacgacctgttggcgggtgccgccgcccactcgctcgccacctgggtccggctggacgggaaccccggtacctggagccggatcttcgacatcggcaccggcgtcaccgccaacatgttcctgaccccgctcagcggcagcggcaccctgcgatacgccatcaccgccggcggcgcgggcggcgaacagcgcatcgacgcggagccgctgcccaccgggcgctgggtgcacgtggccgtgacctacggcagtggcacggcggtcctgtacgtggacggcacggaggcgggccgcaatgtgaacgtgacggtggagccgcgccacttcggcaatcacctccgcgccggatacctcggcaggtcccagtacgccgacccgtacctcaagggcgcgctcgacgacttccgcgtgtacggcaggacactgaccgccaccgaggtcgcgtcactggcctcg

SEQ ID NO: 1134 - DNA, 480 bp, Streptomyces avermitilis
  CDS (1)..(480)
atgcccgccgaaggattcaccacctgtctgtggttcgacggccaggccgaggaagcggccgactactacgtgtcggtcttcaagaactcccggctcggccgggtcggccgctaccccgaaggcggaccgggccccgccggatccgtcatggtcgtggagttcgtggccaacggacagaagttcgtcgccctgaacggcggcccgcagttcaccttcagcgaagccgtctccttccagatcttctgcgacgaccaggacgaggtggaccactactggaacaggctcaccgagggtggcggcgagggcggtccgtgcgggtggctgaaggacaggtacggcctgtcctggcaggtcgtcccggcgaagctcatcggcatgatcggcgatgcggaccccgagaaggcggcccgcacgtccaaggccatgatggagatgggcaagctggacatcgccgccctggagaaggcgtacgagggcgag

SEQ ID NO: 1135 - DNA, 651 bp, Streptomyces avermitilis
  CDS (1)..(651)
atgactccactcaccacggggtggcatccagccctttcaccgcgggccgaggagggcgacaccccgccctcgcgcttcgacgaccatctggcggcacaactgctcgcccagcggatcgtgctcctggggacacaggtggacgaggtgtcggcgaaccgggtctgtgcgcagttgctgctgctgtccgccgaggactcgcgcaccgacatcagcctgtacatcaacagcccgggcgggtccgtcaccgcgggcctcgccatctacgacaccatgcggctcatccccaacgacgtgtccacgctcgccatgggcttcgccgccagcatggggcagttcctgctcagcgtcggcgcggccgggaagcggttcgcgctgccgaacgcgcggatcatgatgcaccagccgtcggcgggcatcggcgggaccaccgcggacatcgagatccaggcggagaacctggagttcacgaagaaggcgatcgagcggatcaccgcggagcacacggggcagagcgaggagaccatctcccgcgacggcgaccgggaccgctggttcacggccgagcaggccaaggagtacgggatggtcgaccgggtggtggagtcactcgacgacgtccgcccgaccgcctcgcgccgacggatggggctg

SEQ ID NO: 1136 - DNA, 600 bp, Streptomyces avermitilis
  CDS (1)..(600)
atgggttcgtacacgattccgaacgtcgtcgagcggaccccgcagggcgagcggtcgtacgacgtcttcagccggctgctctccgagcggatcatcttcctcggtacggagatcgacgacggagtggccaacgtcgtcatcgcgcaactcctccatctggagtcggcgaacccggagcacgagatcgcgatctacatcaactcgcccgggggatccttcacttcactgatggcgatctacgacacgatgacgttcgtgcaggccccgatctcgacgttctgcgtcgggcaggcggcctcgacggcggcggtgctgctcgcgggcggtgacccgggccggcggttcgtgctggagcacgcccgggtcctgctcggccagccggccagcggcggacgtcagggcacggtctcggacctcagtctccaggccaaggagatgatccggatccgctcccaggtggaggaggtgctctcccggcacacgcggcacgacatcgcgaccctgcgcgccgacatggaccgggacaaggtgttcaccgcgcaggaggccgtcgcgtacgggctcgccgacgaggtgctcagccggcggctcgcggtcgtc

SEQ ID NO: 1137 - DNA, 453 bp, Streptomyces avermitilis
  CDS (1)..(453)
gtgagcaatcaagcgccgaacgaagcccgcgtcatcgccctgcgcccggcgagcgccccgccccgaagtccgaacgccgcgcgcgttcccgtcaccgccccgggccgcgccccgcagcggccgggacagcggccggccgcccccgcggccaaggagcccttgtggcgcgacctcgtcggtgacgtgctgcggcgcgagcggctcgcacaggagcgcacgctcaaggacgtggccgacgcggcccggatctcgatgccgtacctgtcggagctggagcgcggccgcaaggaggcctcctccgaggtcctcgcggccgccgcccaggccctcggactcggcctgacggatctcctttccctcgcccaccacgagctgacccgccatacccggacgaggccggcccggggacgcaccgcgccgaccgcgcggtacgacggcatgtgcctcgccgcc

SEQ ID NO: 1138 - DNA, 1467 bp, Streptomyces avermitilis
  CDS (1)..(1467)
gtgcgcaagaaccgttcggccgccctcgccgcggcctcatttcttctgatgaccggagcgggcatcgccgccgccccgtccgcgtacgccggaacacccggcggtacgcacgcgaacgaccgcaacagcgacttcaacggcgacggttacgaggacgtgctggtcggcgctccgggagcgacggtcagcggcaagaagggcgccggtctcgtcaccgtgcagtacgggtcgtcgagaggaatcggcaccaccaacgcggcccgcttcagccagtccacggccgacgtcgcgggcgccgccgagaccggtgacgcgttcggccgggcggtcgccaccggcgacctcgacggcgacgggtacgacgacgcgatcgtcggcgtgcccggtgaggacctcggtaccaccaaggacgcgggcggtgtcgccgttctgtggggctccaagtccgggctgtcgggcgccgccagcgactggctggagacccaggagcccaccgccgacgagcagttcggcagcgcgctcgccgcggcccacttcaccgatgagacgccgggcgacctgctcgccgtactcgaccgcgacgacctggagctgttcgggtacgactccgcggcgcaggcctcgctgaagcagcggtcgcagcagcggctctcggcacgcgccgaccagcgcgacatcctgcccacgtcgctgaccaccggcgactacgacgacaacgggtacgccgacctcgtcgtgtccggcgtgaccgtgggcgacgagccggggcacggctggtcctcgctgctgacggggcacgctgacgggctgtcgtacgaacgcgatctacgaggcggaccggtcgccgcgtccggggacatcaacaacgacggctacgacgacctggtgaccggtgagccgcactcccccaacgacgtgtacggcgagacacgcacgggcggtgtggtcggcgtgcgtctcggcggcccggacgggcccgcggccgatcccgactggtggacgcaggagtcggccggcgtacccggcaccgcggaggtcggcgacggctggggcaccgacctgtcggtcgcggacaccgatggcgacgggtacgcggacgtggcgatcggcgcctccggcgaggacatcggcacggtggccgacgcgggcgccgtgtgggtgctgcgcggctcggccggcgggctcaccgcggccggggccaagtcgtgggaccagaactcggcggacgtaccgggcgtggcggagaagggcgacaaatggggcgcccaggtccggttgaccgacccgaaccgcgacggacgcttcgggctgctcgcctcggcgcccggcgagaacgccggcgacggcttcgtctgggtcctgtcggcgggcaccggcgggatcacggcttcgggctcctggacgtacggcgcggacacgctcggcgcgccctccgtggccgcggcgttcggcgcggcgatcgacgaa

SEQ ID NO: 1139 - DNA, 225 bp, Streptomyces avermitilis
  CDS (1)..(225)
gtgctgatggcccaccccgccgtgctgcgcaatctcgtggagcagtacgagaccctgcgcgccctgcacgccgagaacggcagtacggaagtgcgacagcgcatggacgacgcggcctacacgctctgcgtatcgaccggtacgaaggacgtggaggccgcgctcgtcgccgcccgccgtcgactgcccctggcacgcaccaaggaggactcgctgctcaccacg

SEQ ID NO: 1140 - DNA, 885 bp, Streptomyces avermitilis
  CDS (1)..(885)
atggacaccgccatgagcaggtcgatggtcaaggacgaggcgacccggaccgcgactggtgaggggtcgctgccacatatcgtggatccgcgtaccgtggctcctcgtgacgcgcgggagctgtcccgccagttcttccggcgcctgagcgaactcgaagagggcacacacgactaccagtacgcccgcaacaccctgatcgagatgaacatgtcgctggtgcggttcgcggcgggacgcttccgcaaccgtggggacgacatggaggacatcgtccaggtcggcatgatcggcctcatcaaggcgatcgaccggttcgagatctctcgcgaggtcgagttcacctccttcgcgctgccgtacatcgtcggcgagatcaagcgtttcttccgcgacacgacgtgggcggtccatgtgccgcgccgcctccaggagttgcgggtcgagctggccaaggcgcgcgaggaactgtcgagccggctggaccgcgagcccagcgtcgccgagctcgccaccctgatgaacctgtccgagaacgaggtcgtcgaggcccagatcgcctccaacgggtacaactcgtcgtcgctggacgccgcgctctccggggacgaccaggagggcgaagccgtcctggccgacttcatcggcgaggaggacgacggcatgcagctggtcgaggacttccacaccctcgcgcccctggtcgccgagctcagtgaccgcgaccggcagatcatccacatgaggttcgtggaggaggccacccaggcggacatcggcgcccggctcggctgctcccagatgcatgtctcccgtctgatcaagcggatcatcgagcagctgcgcacgggcatgctctccgatctgcatcgggtcgagagcgcc

SEQ ID NO: 1141 - DNA, 1491 bp, Streptomyces avermitilis
  CDS (1)..(1491)
ttgccgaccggtagatccgtcgatacgcaaggggtgggcccagtggcttccgaacgcacggcttggctgcgacaagggggcggcaccggccgccgcgtcgccaccgcattcgaggcggggcggagcgggacgtccgggtggcgtcggaccgtcggaggcgggctcgtatgggtcggcgccgccgcactgctcggcgtgtccgggcagcgcacggcgcgccgggcggcgatgcggggcatcggagccgtggccatggcgtcggccgtcacccgcacgctcgcgcgtccgaccgcccaccgggcagaggccccgcacgcggcgggacccgccgcgtcagccgccgcgttcgccgcgggcgtcgtgttggaagcgccccggtacggtctcctcgtcgccccggccgccgcggccctgacggcggcccgcatccgttccggggcccgccaccccggcgatgtggcggtcgggaccgccatcggcatcggcgccgccgcgctcaccgcacgctggtggccggtcaagcccgagacggcggccgccgcggcgccgccccgcaggcccgcgccggcactggccgacggagccggactccatgtggtcgtcaacccctcgtccggcgtctcgcggagcaccgacgcggacgacgccgtgggccgcctgcgctcgctcctgcccaaggccgagttcctggtgccgcaggagggccaggaactgccggaactcctcgaacgggccgcccggcaggcgaaggaagcgggcggcgcgctcggcgcctgcggcggcgacggcacgatcaacgcggcgacggaggtggccgctcggctcggtgtaccgctcgcggtgttccccggcggcaccttcaaccacttcgccgtggacctgggaaaccagacgatggaggacgtcgcacgcgccgtgtgcgacggggacgcgatcgtcgccgacgtcggctgcgcccgcgttcccgacggccccgagcagttgttcctcaacaccttcagtctcggtgtctactccgacctcgtgcacgcccgtgagcagctggagaagcggatcggcaaatggcccgccctcgtcgtcggactggcgcgcgtgctcgcggcgggcagccccgtcagcgtctcggtgaacggccgccccaagcgcctgtggctgctgttcgcgggcaacggcatctaccacccggccggcttcgcgcccacgtaccgcacccagctcgacgacggcctcctcgacgtccgtgccgtggacgccggcacgccactggccaggacacggctgctgctcgcggtgctcaccgggactctgcacaactcgcgggtgctgaccaccgcgcaggtgcgcggcctccggctcgaagtcctgaagggcgacccgcggttctcgtacgacggagaggtgacccgggcggccgcaccccggctcgtcctggacaagcggaccagggcggtgaccctctaccggcccgcggagaaggaccagtggctgcgc

SEQ ID NO: 1142 - DNA, 456 bp, Streptomyces avermitilis
  CDS (1)..(456)
atgatcgagagcttggacggagcagtgatacctactgacttcgacatgcccgtggagccgctgcggcgggcggcccactacacgggggaactggggtccatcgccgaggcccgggccttcgccgcgctgttcctcgaacagctgcggtccgagtggtgcgcgcccatcgacgcccgtgccgacggcgacctgcttctcgtggtgagcgaactggtcaccaacgccgaccggcacagccacggcccgtacatcctcgagctggagggcaccgacgcctccgtgaccgtcacggtgtacgacagcagcgccgcgctgcccaggcgctaccccccggaccccggacgcgtgggtatgcacggactggagatcgtccatgtgctggcggccgcggtgaccgtggagcgagtgccggtcgggaagtgcgtcagggccgtcatggagctgccgaaacagtcg

SEQ ID NO: 1143 - DNA, 1428 bp, Streptomyces avermitilis
  CDS (1)..(1428)
atgagatgccgctcatccctacgcagggaagaagagctcgtgagcgtcgaaccgccggccggccgccccacaggacccccctcgggcccgttgtcgggtcccacgcagcagcggcccgtccagccgagcggccgccccgtccggagctcgtcgggcggcgacgcgggcagcggggggtccgcgggatccggcggtggcggcggcccgtccggtcccctcgggccgggcgacgcgggcaaggagcccgaacgctggtggaagtccgcaccccgggtggctctgatggccaccgccgtcgtggtcgccgtagtggccgccctcgtcctcacccgctcccacggcacgtccaccgccggcaagggcggcgaggtcttcctccaggccgccggcaagtcgggcccctaccccttcacggagtccacggcgaacgagagttccacggcccccctgaccccggccccggcgagcacgtcggcgtccgcccaggcggcgcgcggtatcgacggctccgagcccggtctctacggcggcacccgcaaggtctccagctgcgacgtggagaagcagatcaaggcgctccgggcggcccccgagaagaaccgtgccttcgcctcggtggagggcatcgcgccgtccgaggtccctgcctatctgcggtcgctcacccccgtgcaactgcgcgtggacacctgggtcaccaaccacggcttccgcaacggcgtggcgaccccgtaccaggcggtgctacaggccggcaccgcggtcctcgtcaacagccgcggcgtgccccgggtgcgctgcgcctgcggcaacccgctcctgtacccggtcccgcagacgaccaggcccaggcagacgggcgacacgtgggcctcgtaccggccgcagaacgtcgtgttcgtcacgcccgcgccgacggccatcaacgtgttcgtgatgttcgacccggaccacgacgaatggttccaccgccggcgcggcgacaagggccgacatgacgagaagaccgatccgccgcggcatcggccgtccccgtcgttgagcgcctcgatgctcccgccggactcctcctcgccgaagccgcactccccgtcctcgaagtcgccggagccgtcgtcgtcgtccccatcggttccgtcgtccccgaactcgtcgcgcgagtcgtcacccgagtcgtactccgagcctcccacgaccgagcccaagaccaccgagcccccgaccaccgagcccaagaccaccgagcctccgaccaccgagcccgagagcaccgagcgcaagaccaccgagcccccgacgaccgagcccccgacgaccgagcccaccaccaccgagccgccgtcgccgggtgtcgtgtcgcccgagaccaccagcgagtccgacaccacctacagtgccccggagccggccgcgaccccgccgtcgtac

SEQ ID NO: 1144 - DNA, 1254 bp, Streptomyces avermitilis
  CDS (1)..(1254)
gtggcccgcccgggccggtcggcgttcgcccggcacggctgggtccaggccctcgcgacggtactggccgggctgatcgtcatggtggtgaccgccgcgctcggactgttggcggcgggtgcggccggccttcccggcaacgcgttcgtgagcgtcgacgcggccaccgtggtgacggcggtcggcggcaccgtgaagctctcgggcgacgcgggggcgatcgccgacacgaaggccgggctgaccgtgatgcccctgtccgtctcgctcgccggggtgctgacgatcgccgcgggcttcctgcggcacctgcggcaccgggccgtcgccggcgcgcgcgaactcgccggctggtccgcccgcatcgccgtcgtgtggctggtggcgctcgtcggcctcacgttcacggcccgtcacacgttcacgatctccctggggaacgggatgatcggcgacatcggcgagctcttcggcgtcgctccgaaggtcggcttcaccacggacgtacccctcaccctgctcttcggactgctgtggctggtgggtgtgttcgtcctcgccctgctggtgtcgcgcggtgcgccgctgccggcccgggtcgtgcgcttccaggagtcggtgcgtccggcggcgtacgcgatggtcgtgctgctgctcgcgtatgtcgtcctggggatcgtgatcgggctggtcgtggcggcgagccgcgggcacaccgccgagacgttcgcggtgattctgctggggatgccgaacctggtgtggctcgccctcacgatcggtctgggtgccacctggaacggccgggtggacgggccgttcggtctgcccatgccgcatctgctcgacgaggtcctgcgcacgccggacgtcgccacgctcgatctgcgctcgctcgcccactacgacggccgggtgtggtggctggtcgtcgtcgacgccgtgctgatcctggcggccgcgttcgtgatggcggtgcggtcaccggcgcggatacgggcctggcagcacgccctgcacatggcggtcgcgctgacgctgacggtgctcatgatctgtctcgtcgcccgcgtctacgcccatttcggcctctcgctcctcggcatcggagatatcgacggcggcctgtccggagtgctgttcctgaagcccaggctctggaccgcgctcggctgggccgtgctgtgggggctggtcaccggcttcctcggcgcgctgctcgccaggcccgtgcaccggcgaggcgaagtcgcc

SEQ ID NO: 1145 - DNA, 1017 bp, Streptomyces avermitilis
  CDS (1)..(1017)
gtgccgccgacctcacgacccttgcggaagctgggcttcttgaccatcggcctgttcgacggggccgaccccggccgaggccacgagtcgaccctcgggatcatcgaactgggcgagcaactcggcttcgacagcgcgtgggtgcgccaccgtcatctgcagtacggcatctcctctcccgtcgcggtgctggcggcggcctcgcagcgcaccaggcgcatcgaactgggcacggccgtcatccccctgggctgggagaacccgctgcggctcgcggaggacctcgcgacggtcgacatcctcttgggcggccgcctcaacccgggtgtcagtgtcggccccccgatgcactacgaccaggtcaaagaggcgctctaccccgacaccgcggacgccgaggacttcggctacgagcgggtacggcggctgctggacctcgtacgcggcgagccggccaccgacttcagcggcgtcgagggcttcgaggtgttctccgaccgcgtccagccccactcacccggtctgggccgccgcatgtggtacggcggcgggagtctgcggtcggcgcagtgggccggtgagcacgggatgaacttcctcaccagcagtgtcgtgaaggcggaggagtccgaggacttcgccggcatccagctctcgcacatccgcgccttccgcgcccatcaccccgacggcgaccgcgcccgtgtctcccaggggctcgtcgtcatccccacggactccgcctcgccggagcagcgcgcgaagtacacggcgtacgtcgagaagcggactccgcgcaccgtcacgccgcagggaccggcacgcatgatgttcgcgcccgacatcgtcggcacctccgccgagatcgccgaacggctccacgcccacgcggccttccaggaggtggacgaggtcgcgttcgcgctgccgttctccttcgaacacgccgactacgtgcagatcctcactgacatcgccacccggctgggcccggcactcggctggcaggcggccacc

SEQ ID NO: 1146 - DNA, 972 bp, Streptomyces avermitilis
  CDS (1)..(972)
atggccggcccgtcgcacggcacgggcctgtcctcggagcggccctccgagctgatcggcaagcagatcgcgagctaccgcatcgaacgcgagatcgcccgcggcggcatggccgtcgtctaccgcgccagggacctgcggctggaccggaccgtcgcgctgaagctgctcgcgcccgagctggcgctcaacgacaccttccgccggcggttcacacacgagtcgcgggtggccgccgccatcgaccatccgaacatcgtgccggtcttcgaggcgggcgagacggagggcgtcctgtacatcgccatgcgcttcgtctcagggcgcgatctgcgtcatctgctcgaccgggagggcccgttgccgttctcggccggcgtccgtatcgccctccaggtggcctccgcgctggacgccgcgcacgaccacggactggtgcaccgggacgtcaaacccggcaacatcctggtggcccggggcacggacagcgaccatcccgagcatgtgtatctcacggacttcggcctgaccaagaggtcgctgacggtgaccgggttcacgatcccgggccagttcgtgggcacgctggactacgtcgcgccggaacagatctgcgggaagccggtggacggccgctgcgacgtctacggcttcgggtgcgtcgtctacgagatcctggccgggacgccgccgttctgtcgcgacgacgagatggcgctgctgtgggcccaccagcacgacgagccgccacgcctgagccgcaggcgccccgacctgggcccgcaggtcgacgaggtgatggccaaggcgctcgccaagagccccgaggaccgctacgactcgtgcctcgcgttcgtggccgcgctgcgtaccgcgggggcaggcgccggcccgcaaagacacccgccgaagcggaccggtcccaccacgatccccgaaccaccgcgctgggcccggccggttttccgccgc

SEQ ID NO: 1147 - DNA, 594 bp, Streptomyces avermitilis
  CDS (1)..(594)
atgactgcccccggattccgcccgacccacgtcgtcccccaggacgggatgcccgcctgggaggccccggacgtcgcccggcccaccgtgccgctcgacgcgctgctgcccgtccagctcgtcgaccggcgcggcgactgggggcacgtggtgtgcgccaacggctggtcggcgtgggtcgacggccggctcctggtcagcgtgccgcagccaccgcccgccgcgcccggctctcccgttcgcgcggaggacccgcgccccctgctcgcccacgtcgaagaggcgctcggccgctatcgcggcgcggcggaggaactggcgggcggaagcctggacggggagagctttcgcagccttacccacgggctgcggatcggggtggtcgtcgacggggagtcgatgtggctgtacgacgccgagcacgagcggtgggagtactgcgacggcacccggctgagcacgtacgccgccgagggcgacacgccgggcccggtcccggcggagccgacccgcgtcgtccaggacgccgtcccggacggctcccggtccgcggacggcctcgcccggtacttccccgacgacacggacgacctc

SEQ ID NO: 1148 - DNA, 2340 bp, Streptomyces avermitilis
  CDS (1)..(2340)
atgggagagcggccggtcgcgccgactgcacccgagctcgtcctcgagaccgagacgggctccacggtgatgagcccgagccgcgactatcacgtcggacgcgacccctcgagcgacatcgtcctggacgacgtccgggtctcgtggcaccacgcggtgctgagcgtcgaggccgaccactggacgctcgaggacgagcacagcaccaacggcacctacgccgacggccgccgcatccacgagtggggcgtcggaccgggcagcgagatccgcttcgggaacccctccgacggcccgcgcgccgtcctcgtcgactgcgcgcggctcgcaaccgagcatccctccgccgtcttcatgccctccgccaccggcacgttccggcagccgacgaccgtacggccgctgcccacccgcacggtccgtatcggccgcggcggcggcaacgacctggacatcgacgacctcatggtctcccaccggcacgcggaactacaggcgctgccggacggcacatacgagatcgtcgacctcggcagccacaacggcacctacctcaacggccagcccgtcacccgcgccccggtcacgcccggtgacatcgtcgggatcggccactccgtgttctgcctcgtcggcgaccagttgcaggagtacgtcgacaccggcgaggtctccctcgacgtccgcgacctcaccgtcgagctcgaccacgaccacaagatcctcctcgaccaggtctccttcccggtcggtgagaaatgcctgctcgccgtcatcggccccagcggctccggcaagtccaccctgctgaacgccctgaccgggcagcgtcccgccgaccggggcacggtcctgtacgacggccgcgacctctaccgcgactacgccgagctgcgccggcgcatcggactcgtcccgcaggacgacatcctgcacgcccagctgaccgtgcacagggccctcgggtacgccgccgagctgcgcttcccacaggacaccgagaaggcggaacgcagggcgcgggtcgacgaggtgatccgcgagctgggcctggaacaacgtgccgaccagcccatccacagcctctccggcggccagcgcaaaagggtcagcgtcgccctcgaactgctcaccaagccgtcactgctcttcctcgacgagcccacctccgggctcgacccgggcatggaccggtcggtgatgcatatgctgcgcggcctcgccgacgacggccgcaccgtcatcgtcgtcacgcacagcgtgctcagcctggacgtctgcgaccggctgctcgtcctcgccccgggcggcaccgtcgcctactacggtccaccggacgagaccctgcccttcttcggcttcgtccagtggccggaagcgttcgaggccttcgaacacgaccgcgaccgggactgggcgggggaataccgcgactcactccagcacgagcagtacatcgagggcgtcggcacaccgccctacctgccgtcggccgccccggcggcagccgtcggaccgccgccgaaggcgcagagctggggcgcccagctcggcacgctcgtacggcgctacgcggccacgctctccgccgaccgcacgttcctcgccatcatgatcgcgctgccgttcgtgatgggcgccatggcccgggcgctggccggcgggaaactgacccaggagaccgccatgaacgcgctgctcatcctgtgcgtcggcggcgtgctgaccggcgcggccaacgccgtgcgcgagctggtcaaggagcgcgcgatccatcagcgggagcgggccgtcgggctgtccaggtcggcgtacctgatgtccaaggtggtcgtcctcggcacgatcaccgtgctccaggccattgtgctcaccctggtcgccctgctcggcgtcgacctcgacgcgcccggcggcgagggcgtcctcatgccaccgctcgtggagctcaccctcgccgtcgccctgctctccttcaccgcgatgatgctgggcctcctcgtctcggccctggtgcgaagggaggaggtcaccatgccgctcctggtactcctcgcgatcgtccaagtggtcttctgcggtgccctgctgaagctcaacggggtggcggtgatccagcagctgtcctggctggtgccctcgcggtgggcgctgggcgccatggcgggcacgatcggactcgcccggatcgtgcccggcgacctcaccggagacccgctgttcagacgctcggcgggcgtgtggctgctcgacatggggatgctcgtcgtgctgtccctcgtcttcgggtacgcggtggaccggctgttgcgccggcacgaacccctggtcatgcggaag

SEQ ID NO: 1149 - DNA, 408 bp, Streptomyces avermitilis
  CDS (1)..(408)
gtgcacgacgaattcctgtgccatgtcaccgcgtacggcatatgcggcggtcagcgcgtcggagtgcccctggggacgtatcgcgcgcccaccctggcgctggccctgtggtggatgcgtgaccgtgcctcatggatcgccgagcggctcgatccccaccccgacaacccgaacttcccgccgaactccatcgcccccgtcgcggagaccgtccccgacgtgccgagcctgctgcgggcatggtgcggcgacgcgatccagcaggagctggtcgcggacgaattggccgcaggccggctcgtccgcatcgccaccagcgacgacaccaccgagtacgagctgttggcggagtccgtggacgcgctgcggatgcagcggttcgtgcccgcgctctccacccccgcggcc

SEQ ID NO: 1150 - DNA, 384 bp, Streptomyces avermitilis
  CDS (1)..(384)
atgagcacgaacagcaaccgctacgagtccgccgtcgcccgctacttcgaggcctggaacgcgggtgaccaggacgcgctcaccaaggcggtcgccgccgcctggaccgaggacgggagctacaccgacccgctggccgatgtcaggggccacgagcagatcacggccgtgatcgcggcggcgcacgagcagttcccggggttcgccttccggctcaccggcacggtcgacgggcaccacgacatcgcccgcttcgcctgggagctggtgaacgaggcggacggctcggcacccgtcgccgggtccgacgtgatcaccctggacggcgaggaccgcatccggagcgtgcaggggttcctggaccgcgtgccggccggagccgcc

SEQ ID NO: 1151 - DNA, 993 bp, Streptomyces avermitilis
  CDS (1)..(993)
ttgtacaccgcagattccgcccgatatgaggccatgccgtaccgccgcaccggacgcagcggtctgaagctccccgcgctgtcgctcggcctgtggcacaacttcggccccgaccggccggtggagacccagcggcagatcctgcgccgcgccttcgacctcggcatcacgcacttcgacctggccaacaactacggtccgccgcccggtgccgccgagtcggccctcggtgacgccctgagggcggacttcgcgccctaccgcgacgagctggtcatctcgaccaaggccggccatctgatgtggccgggcccgtacggcgagtggggctcgcgcaagtacctgctctcctcgctcgaccagagcctcacccgaatgggcctggaccacgtcgacatcttctactcgcaccgccccgacccggagactcctctggaggagacgatgggcgccctgcactcggcggtccagcagggcaaggcgctgtacgccggcgtctccaactactcgccggagcagacccgggaggccgcccgcatcctcggcgaactgggcaccccgctcctcatccaccagccgcgctactcgatgctcgaccgccgtcccgaggaaggcctcctggacaccctcgacgaactgcagatcggctccatcgcctactccccgctggagcagggcctgctgaccggccgctacctcgacggcatcccggaggactcgcgcgccgcgagcgacagcccgttcctcagcgcggacacggtcaccgaggatctcgtacgacagctgcgcgccctcgacgacatcgccaagtcccgcggccagaccctcgcccagctcgccctggcctgggtcctgcgcggcggccgggtcacctccgccctcatcggtgcgagcagcgcccggcaggtggaggacagcgtggcggccacccgcacgctggacttcgacgcggaggaactggcccggatcgaggcgatcatcaagccgaggccc

SEQ ID NO: 1152 - DNA, 876 bp, Streptomyces avermitilis
  CDS (1)..(876)
atggaactgcgccaccttcagcatttcgtcgccgtcgccgaggaccagcacttcacccgggcagccgaacggctgatggtgtcgcagtcggggctgtccgcctcgatccgcgccctggagcgggagctccaggccccgctgttcgtccgcaccacccgcagtgtcacgctcaccgaggccggccgcgcgctgctgggcgaggcggagcggatcctggcccaggtccgggcggctcacgacgcggtggcggccgtgcagggcgtgctgcgcggcacgctctcgctgggcaccgagcagtgcatcgccggggtgcatgtggcccggctgctcgccgggttccggcggcagcatccggatgtggagatccggttgcgccaggcgggctcgggtgcgctggcggaggaagtcgccgccgggcgtctcgatctggccttcgcggtccggacggagacggacaccgaccagttgcgctccgtgccactgaccggcgagccgatgaccgtgctctgccacccgacccacccgctcgcgacggccggcgcggtcatgccggaggacctgggcggtgaggcgttcgtcgacttccacccggactgggggccgcgccgcatcaccgacgccgccttcgccgccgcgggcgtgaggaggaccgtcgcgctggaggtcaatgatgtgcacagcctgctcgacctggtcgaggagggtctcggcgtcgccgtggtgccccggcacttccggcacaagcgtgaggcgctcacggctcttccgctgaagggcacgggcgagacggtgtacgagaccgtcgccatccttcctccctccgcggccaccagtccggcggcccgggcgctgatgaccttgctggaagaggagttc

SEQ ID NO: 1153 - DNA, 513 bp, Streptomyces avermitilis
  CDS (1)..(513)
atgcacgcaaaggacgtcctcaccgacgcgtacagccgcatccaggaagaagtgcacgccgccgtcgagggcctggcgcctgacgtcctcaacgcccggcccgccgacgacgccaactccatctcatggctcgtctggcatctcacccgtgtccaggacgaccacctggccgatgcctcagggctcgaccaggtctggccggcccagggctgggacaagcgcttcggactcgacctgccccgccgggacacgggatacggccacagcccccggcaggtggcgaaggtgcgggtggactcgggcgagctcctgctcgggtactacgacgccgtgcacgaacagtcgctggagttcatccgcgggctcaccgccaaggacctggagcgtgtcgtggacgagcgctggacgccggccgtcacgctgggcgcacggctcgtgagcgtcctggccgacgatctgcaacacgtcggccaggccgcctacgtacgagggctccttcagagcgcggcctcg

SEQ ID NO: 1154 - DNA, 1062 bp, Streptomyces avermitilis
  CDS (1)..(1062)
atgaccgcgctcgacatcgacaccatccgccggctccccaaggccgtgctgcacgaccacctcgacggcggtctgcgccccgccaccctggtggagctggcacaggcggtcggccacacactgcccaccacggacccgcaggcgctggccgactggtactacgaggccgccaactccggtgacctggtgcgctacatagcgaccttcgagcacaccctcgccgtgatgcagacccgtgaaggcctgctgcgcaccgccgaggagtacgtcctggacctggccgccgacggtgtcgtctacggcgaggtgcgctacgcccccgagctgatgctgaagggcgggctgaccctgtccgaggtcgtcgagaccgtgcaggagggcctggcggcgggcatggccaaggcggcggccgcgggcaccccggtccgggtgggcacactgctgtgcgggatgcgtatgttcgaccgcacccgggagaccgccgacctggccgtcgccttccgcgacgcgggtgttgtcggcttcgacatcgcgggtgccgaggacggtttcccgcccgccgaccacctggacgccttcgagcacctgcgccgggagaacgtccccttcaccatccacgccggtgaggcgcacggtctgcccagcatccaccaggccctccaggtgtgcggcgcccagcgcatcggccacggcgtgcgcatcaccgaggacatcgtcgacggcaagctcggccggctcgcgggctgggtgcgcgatcgccgcgtcgccctggagatgtgcccgacctccaacctccagacgggcgccgccacgtcgatcgccgagcaccccatcacggccctgaaggacctcggcttccgcgtcaccctcaacaccgacaaccgtctggtgtcgggcacgacgatgacccgtgagatgtccctgctggtcgaggaggcgggctggagcacggacgatctgcgcacggtcacggtgaacgccctcaagagcgcgttcctccccttcgacgagcgcaacgccctcatccaggacgtagtgcttcccggctacgaggccgcgctc

SEQ ID NO: 1155 - DNA, 405 bp, Streptomyces avermitilis
  CDS (1)..(405)
atgagacgcatcgccctggtgaccctcgttgtcgacgactacgacgaggcgatccgcttctacaccgaggccctcgggttccgcctcgcggaggacgagtcgcggcccgacggctcccgctgggtcgtcgtcgagccgggatcggcggccgccggcaccggactgctgctcgcccgcgccaagggcgacgcgcagcgcggccggatcggcgaccagaccggcggacgcgtcggcttcttcctgcacaccgacgacttcgcccgcgaccacgcacggatgcgcgccgcgggcgtggccttcctggaagagccgcggtacgagccgtacggcgcggtcgccgtcttccaggacctgtacggaaaccgctgggacctgctccagcccgcgcccgcccccaccgctcac

SEQ ID NO: 1156 - DNA, 915 bp, Streptomyces avermitilis
  CDS (1)..(915)
gtgatcctcctgctgttgatcccggtcgcgctgcccttcgcgatgcccgtactggcccggcgggcgctcgaccgtctcgcgcccacggccgcgctgtggatgctgacctgctccgcggtcgtgctcgcgggcagttccctggtcgcgctcggcgcgttcgtcctgaccggcctgctcgaagtccccctgttcgcggccctcggcgagctggtgcaccccctgcgcacggcgtcgaacatgttcgtcgtaccggcggccgccttctccgtcggcgccctcgccgtctgtctgtggacgctggtccgtacggtcgtgcggcagtcccgtgccttccgggcggcgaccagtgcggccgacgaccggcacaccgcgggcgacctgtgcgtcatcgactcgccccagccggacgcgtacgccctgccgggcaggccgcaccggatcgtcgtcaccaccgggatgctccgcagtctcggcccggacgagcgcgaggcgctgttcgcgcacgagcgggcccacaacgcgggcggccaccactacttcctcgtcgccgccgaactcgccgcgcactgccacccgggactgcgcgccgccggcgacgccatccggctcgcggtggagcgggtggccgacgaggccgcacgccgcggccgtcggggaccggcggctgaccgcccgggcgatcggccgggccgccctggccgtgcgggccgcccacagcgaccgcccctcgttcgcgcccgcggtggccacgggtcccgtgccgcagcgggttgcggccctgctgtcggtgccgcgcccgccccgtcgcgcagcgcgccggatggccgccctgctggtcgcctgcgcggccctgtccgtctgtgcctcggcgacgggagtcatcggcttccaccatcaggtcgaggtcgcgcaagg

SEQ ID NO: 1157 - DNA, 369 bp, Streptomyces avermitilis
  CDS (1)..(369)
atggccgaagcgaaggacgaacgccgaccggcgggcgaactcgaagccaccgtcatggccgcgctgtgggccgcgggcgtgccccggaccccggggcaggtgcagctcggcctcggcgcggggctggctcgtacgacggtgaccacgatcctctcccggctgcatgagaagggcatcgtcggacgcgagcgccatggccgcggctacgcctacttccccgttcaggacgccccgggcctgaccgcccggcgtatgcacaccgagctcgaccgggacagcgaccggcacaccgccctcgcgcggttcgtcgcccagctcagcgaagacgacgagcgagtcctgcgggacctgctggaatccggtgaacag

SEQ ID NO: 1158 - DNA, 849 bp, Streptomyces avermitilis
  CDS (1)..(849)
atgaagcgcgaggacgcctccgacctcgccggctcgacggcggtgggcgcgctggtggccttcgtactgctggcgctcaccgtgtccggccgggcgggcgacccgctgttcggggacgcggacctgttcgactggtcggtcacccatcgccccccggtcgccgtcgcagtggcacgtgcagtgacgtacacgggcacgggcttcattccctacgcactggtcgtcctggccgggctcctggtgggccgcacggcgcggcagcggctcttctccgtcgccgccgcgctcctctgcctggccgccggccaggccgtccggtacggcgtgatgtccctgatcgcccgcccgcggcccgcgacggcgggctggtccacgcatgcctccggctggtccttcccgtccggtcacaccacgacgtccgcgatcaccgcggggctgctcgttctcgcggtcctggcgcgcgccccgcgcggcagaggtccgctcgccgtggccatcggctgctggggtgttctggtcggactcacccgcgtctatctgggcgtccactggttctcggacgtcctgggcggctggctgttcgccctgtgctggctgagcctgagcgcctacgtcgtcacccgcatcgctcctcccgtcctccacgagatagcggcctcccgtcaccgcccaggtcctacgacggaagagcgccgccatgactcccccaccagcaccgaagaccccctcgaccctgctccgccgccatctcggacgggccgtcggcgcggcctatctcgccgccgcgaccgcgccgggaccagggatgtggctgcgtcatccgcaccggatcgccgtcgtcggccttcc

SEQ ID NO: 1159 - DNA, 1050 bp, Streptomyces avermitilis
  CDS (1)..(1050)
atgactcccccaccagcaccgaagaccccctcgaccctgctccgccgccatctcggacgggccgtcggcgcggcctatctcgccgccgcgaccgcgccgggaccagggatgtggctgcgtcatccgcaccggatcgccgtcgtcggccttcctgacttatccctgaacacggccccgttcctgctgtcgctcgtcctgttcactgccggactgcaggtccccccgcgggatctcggtcggctggtcggacgaccggccgccctgctgaccggtctcgcgctgcatctgctcgcgccgctgctcatcgtgccgggggtggcgttcgccctgcgccagtcccccgacagcgacggcggcagcgggctggtcgccgcgatgatcctggtcgtcgcgatgcccgtggccgccggggccacggtgtggacgggcgcgggcgaaggagaccagtccacgaccgtcgggctcgtgctcgcgtccacgctcgccagtccgctgaccgtcccgttcaccgtgacggccctgtgtcccctgctcagcgccgactacgcggacaccctggccggggcggcccgcatcgcggggagcgggttcgcgctcacgggagtcgtgctgccctgcgccgccggtctggtggcccggctcgccctgccccgccgcgccctggacgcactcctgcacgcggcggtccccacggcggccttgggctcgctcctgctgacgtacgtcaacgccagcggcgtactcggccccttcctcacccggccccggccggtcctgctcgcggcggcgctggccgtcgccgcgacggtgtgcgggctgtccttcgccctgggccggatcacggcccgcgtactgcgcctcgacgcccacgccggggcctcggtgacgctcgcctgcgggatgaacaacagcagcgcgagcgccgtgctgatcacgacggcgctgcccgaccggccgcaggtgctgctgcccgtcctcgcgtacggcctgttgcagaaggtggcggcgggccgtgtcgtacggggcggtcaccactccggaagaggtgcg

SEQ ID NO: 1160 - DNA, 1203 bp, Streptomyces avermitilis
  CDS (1)..(1203)
atgaccccaagcgacgaagcaatcatgtgcccgttcgacttcagcaagggcctggagttcgatccctcgctcgcggagctcatggcccgcgattccatcacccgcatccggctgccgtacggcgatgccgacgcctggctggtcaccgggttcgacgcggtgcggcaggtgaccaccgatcagcggttcagccgggcggggatcatgggctccgactatccccggctgacaccggagcccatcgtctccccggagtcgatcaatgtggtggacccgccgcacagcagccgtctgcgccgcctggtatcgcaggccttcaccaaggggcatgtggagcggatgagacggagaatcgtccggctcgcggacacgctgctcgacgagatggccgcgcaggggccgccggcggatctggcgcaccacttgtcgaaccggctcccgcagcacaccatctgcgacgttctcgggatcgaacaggacgactggccccggatggagcagtacgtgcaccaactgctctccaccggcccggacagccgccagagcgccgcgacggccaaatccgagctgcgggagtacttcggcggactggtcgaaaagcggcggagctcccccgggaacgacctgatcagcgcgttggccgccgccaaggacggcgaggacgtactcgacgaccaggaactggcggtcatggcgctgacgctgatgctcagcgggcacgacacggccacctgccagatcagcaacatctgctatctcctcctcacccgtcccgagctgatgaagcacctcaggagccggccggacacgctgaccgccgtcctgaacgagatgctccgcttcattcccttccgcaagggggtcggcattccccgggtggcggtggaggacgcggaggtggacggggtgaagatccgggcgggtgacttcgtccatgtgtcgtacctgacggcgaaccgtgacccggagcgctacccggacccggacgccatcgacccggaccggccgtccctgccgcacatgaccttcggctggggcggacaccggtgcatcgccgtgccgctggccatggcggagctggaagtggccatcgggcggttgctggagcggttcccggagttgcggctggccgtaccgccggaggaagtgcgctgggacacggagacgatccgacgcttcccgatcgagctgcccgtggcctgg

SEQ ID NO: 1161 - DNA, 921 bp, Streptomyces avermitilis
  CDS (1)..(921)
gtgtgccacactccccggatgacctcggaaacgatcaccgcggaggccgcgggcacctggaaactcggcgacctgtccgtcaaccgcgtcggcttcggcgcgatgcggctgacgggcagtgccgccttccacctcggcacaccaagtgaccgcgaacggtcggtcacggtgctgcggcgggcgctcgaactcggcgtcaaccacatcgacacggccgccttctacttctcctcgctgcgctccgcgaacgagttgatcaacagtgcgctggcgccgtacccggacgacctggtgatcgtcacgaaggtcggcccgtaccgggactacacgggggagtggggcaccgcggcccgccccgaccaactgcgcggccatgtcgaggagaacctgcgccagctcggccgcgaccacctcgacgtggtgaacctccggcgtatgcggcaggactcgatcgccgagcacttcggggcgctcgccgaactgcgcgaagcaggtctgatccggcacctcggcatctcctgcgtggaaccccggcacctcgccgaggcgcaggcgatcgcgccggtggtgtgcgtgcagaaccagtacgggctccactcgccggatgccggggccgacacgatgctgcggatgtgcggcgaacagggcatcgcgttcgtgccgttcttcgcgatcgccggggagggcggtgcgcagggctccagcggcagcgaggacgacgagatccgcgccgtcgcgcgggcgcacgaggccacgcccgcgcaggtgcggctggcgtggaccctccagcagggtccgcacgtgctggccatccccggcaccggcaacccggaccaccttgcggcgaacgtggccgcgggcgccatcaggctcacggccgacgagctggcgcgccttgacgccgcgtaccggcacggggga

SEQ ID NO: 1162 - DNA, 1392 bp, Streptomyces avermitilis
  CDS (1)..(1392)
atgaagggcatcgtgacagtgatgcgaaccccccgcgccttgctcgccgcgaccgccacgaccgccgcgctggccgtcgtcgtcgccgtccccacccccgccgtgtccgcccaagtccccaccggcggtgcctacttcgttcagagtgccgtcaccggtctcaacgccgccgacaacgcgggagcagtcgaacagcacaacccgaagggcaacgaggaccaccagcagtggaatctgcggacgagcggatccgcgtacctgctggagagtaccgacacagccggcagctgcctcggccgttccggcgaccaggccagaacggtcgtgtgcaccagcgccgacgcggcctgggagatcaccccggccggtaccgaccagtacacgctcaaggcgccgggaaccgaccgtcatctgaccgtcggcgcgaaaccctccgggtcgaactaccccgcccagttggccatcggttcggcggggagtctggcctcctggtacctgaccccggtcaccccctcggtcaaccccatgccgtcccctgaccaacgcaccctggaccaggtcacgttcctcaccgcccacaacgcgtacgccaacggcgtggacggcggtttcgcaccgcccttcgtcaacctggtgcccaaccagacgcgcggcatcaaccagcaactgaccgacggcgtacgcggattcatgatggacatccatcagacctcggacggcgcgatcctctgccacaacagctgcaccctggtcagcaaaccggtcgccctctgggtcgacatccagcgcatggtggacttcctcaagcagcaccccgaccaggtcgtcaccgtgtttctcgaggactacgtcgacccgggcgtcctgcgcagtgaactcgcccgcgtcagcggactgtccgacgtgctgtaccggcccgaccggacgggtgtgcggcaaagcggctggcccaggatggcggacctgatcgccgccaaccaccggctgctgatcttcacggaccacagccgctcctccgacgagtccgccgggctcacccgggacagcttcggggtgatgtaccagcgggagtggacggtcgagaactactggtccatggggtcgggcctcggctcctccgactggtcctgctacagccgctggtacggcgccgacaccaacatcccgctgacgtacaccgaatccgccttccgcccgctcttcgtcatgaaccacttccgcgacgcggcgatcgcctccacggccacgacggacaacaccaaactcgccgaccgcgcccagcggttctgccggccggcggcccggaagaagcccaacttcctcgccgtggaccgctatgacctgggcaacccgacgtcggccgtggacaccctgaacacatacacgtatccg

SEQ ID NO: 1163 - DNA, 603 bp, Streptomyces avermitilis
  CDS (1)..(603)
atgactacaccgcgggatttgttgatcgtcgccatggacgtggggtccagccgttatgtggagccgggcgatctgtcgctcgccctcgcgggagccgaggtgatcgatctcctcggcgccggggccctcaccctggagggcgatcgcatcgtgtcgaacaaccagtggacactgggtgatcgcctgctggacgaggccgcgtcgtcactcgttcggcagccgccccacgagccggtcgaggactggctgtggcgccggggccgcggcctgtcccaggcatatctggccgccctggagacggaaggacaagtcgcccggcaacccggccgctggctccccgtccggaccggccgcacggcactggtcgactcacccgcccggcgccacgccgccgaccgctgggcatcgggcgagcccgtcctggccgtcctcgcggccgccgccggaatccacgacctgccgaccgaggactccccgagcatcgccgacgaggcggtcgtgacggtgctcgccgccgtcaacgacgcggtgatggagctggaagccgtacgccagcggcgatccatcgaagaagcggccttcgacaacatctggcgaggcccc

SEQ ID NO: 1164 - DNA, 789 bp, Streptomyces avermitilis
  CDS (1)..(789)
gtgacacaaccggcaatcgcggagggcctgttggcctggaacccggacagcggactgacccgtggtctggcggccgacacccggctgctggccgcggactcgtggctgctgcgcgacggactggtgcgcggcttcgaccgccaccgtgagcgttttcggcgcgcctgcgccgagtgcggtgcgccgccgctcgatcaactcaccgcattctggcgggagatgacggcggtcctgccacgggcggggacgtggttcccgcgggtcgagctggtcagaggatccctccagctgaggctactgctcaggcacgcgccgcctctcgccaccgaggtgcgggtgtgggcggccgggcagcccgatccgcggaccgtgccccggcgcaagggcccggatctggacgccctgggccgggtgcggctgcgggccggcgggcagggggcggaggaggccgtgctgatcacgccctccggggtggtgctggaagcggcgaactccagcatcctgtggtgggaggacgacaccctctgcatgccaccgccgcagctgccggtcctggccggggtcaccgtcggccttgtccaggagcgggccctgaggacggggatccggctcgcgcaccgcgagcggacgccggcggagctggccggccgtgaggtgtggctggtgaacgctctgcacggaattcggcccgtggtggaatggacgggccggccgatgaacgccgggttcgctgtgcgtgccccggaatggcgggaatggctggacggcatcctggagccgctgcctgac

SEQ ID NO: 1165 - DNA, 156 bp, Streptomyces avermitilis
  CDS (1)..(156)
atgtcacagcccctcttcgccggccccggttcttgtccgggaccggtgttccggcaggccgcagaccgtcacggagccgtcttcggcaccctggaccggccgctgggcatccaccccggcctcgggaccgacctcggccacaccgtgccggccggg

SEQ ID NO: 1166 - DNA, 1524 bp, Streptomyces avermitilis
  CDS (1)..(1524)
atgagggcgccgctgcccaccctgagtccggccgaagcgggcacgtccgacaacctcgcggccgtactcgccggccgggccgagcgccgtggctggaccgggcgccccgcgttccgccagggccaccaggtctggacccacggcgaggtgcacgacctcgcggcccgcacggccaccgtgctcgccgagcacggagtccgcccgggcgaccgggtactgctcgcgctgcccgactccctcgcctgggtgacggctttcctcgccaccgcccgtctcggcgccgtcgcggtccccgtcaaccccgaactcaccccggccgagcacgagttcatggccgacgacgccgaggccgcgctgtgcgtgaccggaccggggctggagagacgcttcgcgcaccggcggcggctgggcgccgatcagctggtcgcgctcgccggcaccgcctcgcccgccgccgacgcccacccggtcgggccgcgcaccccgctgtacatccagtacacctccggtactacgggcagacccaagggcgtcgtccactgtcacggcgacccggggacttaccacgaactcatcggccgacggctgctgcggatcaccgcggacgacgtcaccctctcggtgtccaagctgttcttcgcctacgggttcggcaacgccttcgtcttcccgctgttctccggctcctccgccgtactggtcgacgggcgcccgacccccgcggccgtcgacggactcgtcgcccggcaccgggtgaccctgctctactccgtcccgtcggcgtacgccgccctcgtggcggaccgggcggtcgggcacatggcgtgtttcgcgtccgtacgggccgcggtgtcggccggcgagggcatgcccgccgggttggcggagcaggtcgccgagctgctcggcgcgcccgttctggagcagctcggctccaccgaggccgggcacgcgttctgcgccaacagcttcgaccaccatcacccggggaccgtcggccgcccggtgcccggcttcgaggtggagctgcgggaccgctcggggcgccccgtgggggcgggcgaggagggtgaactgtgggtacgcggaccttcgttgacgcccggctatctgaacctgcccgaggagacggaccgcaccctcgtcggcggctggctcgccacccgggaccgggcccgtcgggaaccggacggcacctaccggcacctcggccggaccgacgacatggagacggtcggcggcagcaccgtctccccgctggaggtggaggccctgctggggactcatccggcggtcagggagatcgcggtcgcggccgtcaccgacgcgcgcggcgcgggcaggctccgggccttcgtcgtgcccgtcactccgatacccgtaggtcttgaggccgacctggtctgcctggcccgcgacaacctggccgcggtccaggtcccccgcagcgtcagcttcgtacccacgctgccgcgtaccgccaccgggaagctccgccgccacctcgtccgccagggcgcgtgg

SEQ ID NO: 1167 - DNA, 2196 bp, Streptomyces avermitilis
  CDS (1)..(2196)
gtgaagaccctgctcatcgacaattacgactcgtacacgtacaacctgttccagctgatcgccgaggtgaacggcgaggagccggtggtcgtcctcaatgacgccccgccggacgacattccggatctccgggatttcgccaacgtggtggtgtcgccggggcccggacaccccgcgaagagacgtgacttcggcatcgtcggcgagctgctcgccgcggcccccgtgcccgtgctgggcgtctgcctcggccaccagggcatcgcggcgggggagcgggcctgggtgaccccggcaccggagccccgccacggccatctgtccaccgtccggcacaacggccaggacctgttcgagggcctgccccagcagttcaccgcggtccgctaccactccctgtcggtacgggaaccgctgccactgagcctggagcccaccgcctgggcggaggacggcgtgctgatgggactgcggcaccgctcccggccgctgtggggggtgcagttccacccggagtccgtcctcaccgagttcggccaccggatgttcgtgaacttccgcgagctgacggcctcccgcgcccgcgagactcgcacggccaaggcccgtacgtccggaacgcgcacgaccgagccccccgtgcggcccccgtccccaagcgccgagggggccggggcagcacccgccgtgctggtcccccggccccgtcgcgtggccccgtcccaccgccttcacacccggcggatcgacgtggccgtggacgccgaggcggccttcacccggatgtacaccgacgcgccccgcgcgttctggctcgacagctcccgggtcgaggagggacagtcccgtttctcgttcttcggtgacggcaccggaccgctggccgagttcgtacggtacgacgtcgagagcggcctctgtgagatcgagcggcccgggcggcccgtgcgcaaggtcagggccagcgtcttcgactacctgaaacggcagttggtgacccgtcaggtggatgccacgggactgccgttcgacttcaccggcgggtatgtgggctacttcggctacgaggtgaaggccgactgcggttccgtcaaccgtcatcgggcccgaactcccgacgcctgctggctgttcgccgaccggctgatcgcagtggaccatcaggacggagccacctacgccgtctgtctcgccgagaacacccggcagggcgcacagcaagcggccgactggctcgacgcggcgatggcccagctcagtttcgtgtcctcggccaagccgaccgccccgccgcggccgacggcaccccgcctcgatgccgtggagccgtggctggtccgcgaccgtacgacctacctcgcggacatcgggacctgcaagcgggaactcaaggacggcaccagttacgagatctgtctgaccaacgcggccaggctgcccgccccgtacgacccctacgacttctaccgggtactgcgtcgtctcgacccggcgccgtacgcggcctatctgcggttcggtgacctcgatgtggccggctcgtcccccgagcgttttctgcggatcacccgcgacggcgtcgccgaggccagacccgtcaagggcaccgcgccccgcggcgagcggccggaggaggacgcccggctacgggacgcgctcaccacggacgacaagacccgcgcggagaacctggtgatcgtcgacctgctccgcaacgacctgggccgggtctgccggaccgggacggtgaaggtcacccgcctgatggcgaccgagacgtgcgccaccgtgcaccagttggtctccaccgtcgaggggcggctgcgcgagggcatcggagcggtggactgcgtacgtgtctgcttccccggaggttcggtgaccggggcgccgaaactgcgcacgatggagatcatcgactcgctggagaccgaggcccgcggggtgtactccggagccatcggctacttcgggtgcagtgggggcgcggacctcgccatcgccagccgcacggccgtgttcaccgacggggagatgcacctcggcgcgggcggtgcgatcgtcctcggctccgatccggtcggcgagtacgacgagatgctgctgaagacggccgcaccgatgcgcgcccaccgcgaccggatcgccggcctgcggcccgccgcccgcacgctcccgctgaaggaggcggtccga

SEQ ID NO: 1168 - DNA, 561 bp, Streptomyces avermitilis
  CDS (1)..(561)
ttgaacaggcggcgcccttgtctcgtatccgaaggggtgaccaggaattccgttaccgtcgccggggcgtatcacgtggtgccgggccgtgagtcaggcttccactcctgggggtgggcccttctgtgggcgagcgcgggacagtcagggtttctcggtggtggcgtgctggtcgggggaggggcggagtggcatgtggtctaccgcttcggctgcggtggttccgcccgggactgggacgcctcggtcaccggaatccagtggtcggcccgcgcggacgagctcgcccgggaggccggggaccggattgtgcacggctcgacggcctggttcgactcggggaccgtcaccccggccgcaccgcgtccgccaccgaaatggaaactgcggttcgtcgatgtgagcacggttttcccgccggtacttctcttcaacctggccgtgctcccctgtcttggcagcctcaattctctcatccgcactccgtcgcttcaggcattcctggccggcccgaacggtggactgcgcaaggctgagaacgaacaaagggaggtgggcggg

SEQ ID NO: 1169 - DNA, 1683 bp, Streptomyces avermitilis
  CDS (1)..(1683)
gtgacttggcgtgcttttctcatcacgcaaagacaaggaagtgccatgtcccccgactcagcggacagggctacggctcgcgccgtctggtccgacttctgtgcggtctcacccagcccggaactgcgggaccggctgcggagcgatctccaacgcatacgtgagaccaacaccggactcgccgcccacatagcgccggcccgtacccctcgccggcccggcttcgacgacggcacgatcattccccccgaggagttccccgccggaactcccgcggccagaatccgcgccgccgccgccgagcgcgccccactgcgggggaccgtccgggtgatcgtggtcctggtggacttccccgacaaggagctgacggccaccgcccagcacttcagggacctcttcttctcggagaacacgctggaacacggcagcgtgcgggactacttcaaagaggtcacccacggcctggtcagcatctcgggcgaggtcgtcggcccggtcacgctgccgcacacactcgcctggtacgccaacaacaacttcgggatcggccgtccctccggtgaggcccgggccaacatcatggccagggacgccgccatccaggccgacccgtcgatcaactacgccccgtacgacaacgacggcaacggtttcgtcgacgccttcgtcctcgtgcacgcgggcgaaggcggcgaggtcaccggtgagcccggcgatctgtggtcccacaagtggaccctgcccaagccctacccctcggacggcgccaagatctacggctacctcaccatcccggaggacgccaagatcggcgtctgcgcgcacgagctcggccaccttctcttcggcttccccgacctctacgacatcgacggcacctccgaaggagtcggcgactggtgcctcatgagcgggggttcatggggtggaggcggcgacatccccgtccatccctccgcctggtgcaaggcccaacagcagtgggtctccacccagcgcgtcacaaccgacggaacgctggcgctgcctgatgtgaagaacggcttcgaggtgcaccagctgtggaagcgcggcgccccgggccgcgagtacttcctgctggagaaccggcagcagaccggctacgacaggtccctgcccgccccggggctgctcatctggcacgtggacgagaaccagcccgacaacagcgacgagaaccactacaaggtggggctcgtacaggccgacggctgtcgcgccctggaacagggaggcaaccgcggcgacgagggcgacccctacccgggaagcacgggcaacaccgccttcaccaatggcagcgatccgtcctcccactcctacgccggagccgagaccggggtgtccatcaccggcgtctcggcacccggtgaggtgatgacggcccacgtgtcactggcccccagcccgaccgagcgcatgaccaccgagcgcatgacggccgagcgcatgacagcggcagcaggcaccggcgcccgggccgagaccacccccgaactcgccggcgagatcctggagatacaggcccggctggcggcgatggagcaagacctcgcgagcatcgcctccaaggtcctcactcccctcgtccacacggggatgcagtccgacgcggcccagatgacggcggcacacggcaacggccgaccgataccgcag

SEQ ID NO: 1170 - DNA, 306 bp, Streptomyces avermitilis
  CDS (1)..(306)
atggtgcaggcgatcgagaacctgaccaccttgcgaatccgcctgatcagcagggccccgcacccccggctcgccgaatgggaccaggtggcggccgacatcctcgatgccgacccggtgcggggctacgccgacctgctgtcgcaccgtgtgggcgggcgcgtggagctggcgatacgccgcgacctcctcgacggcgcggctcccggtgcggtcatccggctgcgggccaagctcgccgccggcgagatcgtggccgaaccgcacccgccacctggggagttcaccatcacgcccgcgacgccg

SEQ ID NO: 1171 - DNA, 399 bp, Streptomyces avermitilis
  CDS (1)..(399)
atggccgcccggtcgcccgcaagcacccggcttcaggataaaggaggcgccatgtccctgaatctcaagaacaactaccaccaaccggtctgggcgatggtcgaatggcaccacccgaactgctccgacggcggagactggatgaagaagggctggtggaaaatcggccccgggcagacctcgaccgttttcggcgatgacgtccacgcggtgaacccgatctggtactgctacgcgcactcgagcgacggtctcgaatggcgggaccgctttcaggaactcgttccgacccatgccttcgagtggtgttcgaacaccgccgacacgagttcgcggacgatcctcatgaacgagttcgtcgtgagccgcccgaaccacgtgcacacgtttttggcgccg

SEQ ID NO: 1172 - DNA, 588 bp, Streptomyces avermitilis
  CDS (1)..(588)
ttggacgacatggtggtcgtccgcccgaggcaccccctgcccgggtccctccactttcctgtcaggagaacgctcatgaccctcgccgtcgaaaccggcctgtggcagctcgaccggaccgcctccaccgtcgccgtccggcacaagacgatgtggggtctggtcaccgtcaagggcgccttcacctcgatcagcggtcagggtgaggtcgagcccgacggcaccgcccacggcacgatcaccctggaggccgcttccctcgacacgaagaacgccaagcgcgacacgcatctgcgctccgccgacttcttcgatgtcgagaaccaccccgagatcacgttcgccgtacgcaccgccgaagccggcccgggcgacactgttcaggtggccggccagctgaccgtgcgcggcatcagccggccccagtcgttcacggcgcgcgtcacgcgggcggactccgacgcgatcacgctggcggccgagttcaccgcggaccgcgaccagttcggcatgggctggaaccagctgagcatgatgcgcggcctgaccacggtcacggcgaccctccgcctcacgcgcgcggcggcc

SEQ ID NO: 1173 - DNA, 498 bp, Streptomyces avermitilis
  CDS (1)..(498)
atggccgaaccctctgctcccgcggacctgcccgagcacgtccagacgccccaggacgggctgctgccggccgaacttcgggcgtggatgctgctgctcgccgcgaccggcgcgatcgagcagcagctgcgcgccgtcgtcaaagacgccctcgggatctcccacgacgagttcctggtgctgtgcctgctcgcggaccagcccggcagcggcctgcgcatgacgcggatcgcggaacttctgggccgccccaagacccggctgacctaccaggtcgcctgcctccagcacgcgggcctggtcactcggcagtcggtgtgcggcgacaagcgcggggtccaggtcaccctcaccgacaaggcgcgtcgcgcgctcagcgaggcctccgtaccgatggccgacgccgtcagcgaggccctcgcccgtaccatcggccccgcccagcgcgaagcgatgtacggcctgctgcccaccgattcctgcccgcccgacgacgcg

SEQ ID NO: 1174 - DNA, 768 bp, Streptomyces avermitilis
  CDS (1)..(768)
gtgacaggctccgaggtaaccccttcattccggctcgcatacgtccccggcgtgacaccggccaagtgggtgcggatctggaacgagcggctgcccgacatccccctgaccctcatcccggtacccgctgccgaggcgtccgacctgctccgtgacggtggcgccgacgccgggttcgtacggctgccgaccgaccgcaccgacctcagcgcgatccccctctacgccgagacgacggtggtcgtggtcccgaaggaccacctcgtggcggcggtcgacgaggtgtccgcggaggatctggccgatgacatcgtgctgcaccccctggacgacaccctggactgggagcacctgcccggtcggcccgcgatcgagcgccccgccacgacggcggacgccgtcgagctggtggcggcgggagtcggactgctcctcgtcccgcagtcgctcgcccgcctgcaccaccgcagggacctcacctaccggacggtcacggacgcccccgagtcgcgcgtcgccctctcgtggcgggaggacgagaccaccgacctggtggaggacttcatcggcatcgtccgcgggcgcaccgccaacagctcacgcgggcgttcccagaccccgccggagccgaaggcttcgaaggccaagcgctccgacgcgagcggggcgcggcggaagcccgcggccgggaagacgaccggcaagagcacgcgcagcggagggggcggcgccaagccgggcaagcgaggcaagccgcgccgtcggtcc

SEQ ID NO: 1175 - DNA, 405 bp, Streptomyces avermitilis
  CDS (1)..(405)
atgacgtcgcaccagaccacccagaccatgaagcccgccaccgcggcgaagaagctgggtgtgtacctcgaggccacccccgccgagttccaggagggtgtcgtctcgcgcagcgagttgaacgcgctgcaggccgatccgcccgagtggctccaggagctgcggcgcaacggcccgcacccccggccggtggtcgcggcgaagctgggcgtctccatcgccggtctcgcgcgcggcggagtcacggacgcgctcaccacggagcagatcgacgccctgaagcaggaccagcccgagtggcttcggaaggagcgcgccacccaggccgaggtccggaaggagtcggcgcgcatcaaggagcagcaggagcagaaggcgaaggacgcggcgcggggcgatcgccgc

SEQ ID NO: 1176 - DNA, 1323 bp, Streptomyces avermitilis
  CDS (1)..(1323)
gtgaacgaccgcacccccgagcagcccgccgacaccgtggcccggctgcgcgccactttccgcaccggccgtaccaagcccgtcgagtggcgcacggaccagctggaccgactgcgcgagatgctcacgacacatggcgcggacctcgccgccgccctccacgcggacctgggcaagagcagcaccgaggcctaccgcacggagatcgacttcaccgtccgcgagatcgaccacacgctttcccacctcggcacctggctgcgccccgagtccgccccggtcccgccgcacctcggtgacgacgcgacggcctggacgcagtacgaccccctcggcgtcgtgctggtcatcgctccctggaactatccggcgcagcttctgctcacgccgatgatcggcgcgctggccgcgggcaacgcggtcgtcgtcaagcccagcgagctggcccccgccacctcggccgtcctcgcgcgtctgctgccgcagtacctcgacaccgatgcggtcgccgtcgtcgagggcggcatcccggagaccaccgccctgctcgccgagcgcttcgaccacatcttctacaccggcaacggcgtggtcggccgcatcgtgatgcgcgccgccgccgagcacctgaccccggtcacactcgaactgggcggcaagtccccggtgttcgtcgaccgcgacgcggacctcgccgtcgtcgccgaccgtctcgcgcgcggcaagttcctcaacgcgggccagacctgcgtcgcccccgactacgtcctgaccgacccggagaccggccgcgccctggagacggagctcgcccgcgccgtctcgtcgctctacggccccgaaccggagacctccggcgagtacgggcgcatcgtcaacgaacgtcacttcgaccggctcagtggcctgctcgactccggccgggtcgtcaccggcggcggcagcgaccgtacggccaagtacatcgcgccgaccgtcctcgccgacgtcgaccccgagtcgcccgtgatgcgggaggagatcttcggcccgatcctgccgatcgtcacggtgccgggcctggacgaggcgatcgacttcatcaacgaccgcgacaagcccctcgccctgtacgtcttcaccgcgtccggcacgacccggcagcgcatcgccgccgagacgtcctccggagggctcggctacggcctgccgctcgcccatctcaccgtctccgacctgccgttcggcggcgtgggggagagcggtatgggcaactaccacggccgctactcgatcgagacgttcagtcaccgcaaggcggtgctggagaagccgctgagcgtc

SEQ ID NO: 1177 - DNA, 462 bp, Streptomyces avermitilis
  CDS (1)..(462)
atgaggatgaggagcaggatgcccaccccacctccgcgtcggccccatgacctgatgcagctgctcacgcgggccgagcgactggccgcgcgccacctccaggcggtgctggacgaggacggctgctcgctggacgcctggcgggtgctcgccctgctctccgacggcgaggggcaccacatgacggcggtcgccgaagcggccttcctgccgcccgcgaccttgaccaagctgaccgaccacctcgtcgaccagaacctcgtccaccgccgggtcgaccccctcgaccgacgccgcatcctcgcctacctcaccccgcgcggccggacgtactggcgccggctcgaccgcgagatccgcgcgcggtggcctgtgctcagcgacggcgacgacgaactgctgcgggccctgctggaccggctggcgggcacgctcgacggggcggccgtggaatcgggcctc

SEQ ID NO: 1178 - DNA, 1110 bp, Streptomyces avermitilis
  CDS (1)..(1110)
atgttccggcacgatccccctgcgcccgactggttcacggtcgacgactccgtgctccgcgtggcgctcgtatttcccctccaggggtcggcggggatcttcggaccgacctgcgaactctgtgcgcggctggccgcggaggaggtcaaccgggcgggcggggtgctcggcaaggagctgcggctgctgcccgtcgacggcggcgcgccgccgcgcgagatcgccgaccgggtcgcggcgttggtcgacctgggcgtcgtgcagggcgtcacgggctggcacatctcctcggtgcgacaggcgctggcgccgaggatcgctcatcgtgtgccgtacgtctacaccgccctgtacgagggcggtgagcacaccgccggtgtgtttctgacgagcgagaccccgcgcgatcaactgcgacccgccatgcggctgttggcgcgtgagcgcggggtacgtcgctggttcgtcatcggcaacgactatgtgtggccccgccgtaccgcgcgggcggcgcactcgtacgcacgcgagtgcggcgggagcatcggcggggaggtctatctgccgctggggacccacgacttcgagcccgtgctgcggcgcatcgaacggtcggacgcggacgcggtgctcatgctgctggtcggcagtgacgcggtgcgcttcaaccgggcgttcgccgcggccgggctcgacgggcggtgtctcaggctgagcacgctgatggacgagaacatgctgctggcgagcggtccggcggcgaccgcggacctctacagcaccgccgggttcttcgcctcgctggcgaaccaggacacgctcgacttccacggccggtacgcggcgcggtacggcgtcgaggcgccggccctcggcagtctcggcgaatcctgttacgagggagtgctgttgctggccgcgctcatcgggcgggccgggacgctggaggtgtcggccatcggagcggcggcggacaccgtgtcgtacgagggtccgcgcgggctgctgcggctgcggggcgggcatgtccggcagcgcatctatctggcgcgggcggacggcctcgacttcgacgtggtcgccgaactcgatctccacagttcccgccct

SEQ ID NO: 1179 - DNA, 1299 bp, Streptomyces avermitilis
  CDS (1)..(1299)
ttgtccagcggtcccagcggttccagccgttccagcggttccagcggttccagcggttcccgtattctccgacgccggttcatggccggtacggccgcgctcgcggccgtcgtcgcactctccgcgtgcggcgccaagaccgacgcgggcggctcgtccgacaaggccgcccaggcggacgtgagcggcgacacggtcaaggtcggtctgctcaactcgctgtccggcaccatggcgatcagcgaggtgaccgtacgcgactcgctgaagctggcgatcgacgagatcaacgcctcgggcggagtgctcggcaagaagatcaagccgatcagcgaggacggcgcctccgactggccgacgttcgccgagaaggcgagcaagctcatcaaggaggaccgggtcgcggccaccttcggctgctggacctccgcgagccgcaaggccgtcaagccggtcttcgagaagaacaagtcgctgctgttctaccccgtgcagtacgagggactggaggagtccccgtacatcttctacacgggcgcgaccaccaaccaacagatcgtcccggcgctcgactacctcaagagccagggcaagaagaagatctacctggtcggcagcgactacgtcttcccgcgcaccgccaacaagatcatcaaggcgtacgcgaaggccaacggcatgacggtgctgggcgaggactacgcgccgctgggctccaccgagttcagcacgatcgccaacaaggtgaaggcggccaaggcggacgcggtcttcaacacgctcaacggcgactcgaacgtggccttcttcaaggagtacaagtcggccggcctgaccgccaagagcatgccggtcgtctcggtgtcgatcgccgaggaagaggtcaagtcgatcggatcgcagtacctggcgggccagttgacggcctggaactactaccagaccaccccgggcgcggcgaacaccaagttcgtgaaggcgtacaaggccaagtacggccagggcaagccgaccagcgacccgatggaggccgcgtacacctcggtctacctgtggaaggcgatggtcgagaaggcgaagtccttcgacccggagaaggtgaaggcggcctccgacggcatcaccttcgacgcgccggagggcaaggtcaccgtcgacggggcctcgcagcacatccgcaagacggcccgcatcggcaggatcggcaccgacggcctgatcgagcaggtgtgggactccgggaagccgatcaagccggacccgttcctcaagggctactcctgggcctccggcctctcc

SEQ ID NO: 1180 - DNA, 894 bp, Streptomyces avermitilis
  CDS (1)..(894)
atgaccgtcatcttcggtcagaccttcaccggcatcagcatcggtgccgttctgctgctcatcgcgctcggcctctcgctcaccttcggtcagatgaacgtcatcaacatggcccacggcgagttcatcatggccggcgcctacaccacatacgtcctgcagaagtccatttccagcgccggattgtcgcttctggtcgcgctgcccgtcgcatttctcgtctcgggcgcactcggggcgttgctggaatggctgctgatccgccggctgtatctgcggccgctcgacacacttctcgtcacctggggcgtctccctgatgctccagcaactcgcccgggacatcttcggcgcaccgaatgtgcagacacgggcgcccgagctcctcaccgggaacatcacggtcatcggcggtgacgacccgctcaccttcgccaacagccggctgttcatcctcgggctggccatcgccgcggtggtcgcgctgtcgctgacgctgcggctgaccccgctcggccggcgcatccgggccgtggtgcagaaccgggatctggccgaggtgtccggcatctccaccggccgggtcgatcgcacggccttcttcatcggctccgggctcgccggggtcgccggggtcgcgctgacgctggtcggtccgatcgggcccaccatgggcaccaacgtgatcatcgacgccttcctggtgatcgtggtcggcggcatcgggcagctcaagggcagtgtgatcgtcgccttcgtgctcggcgtgctccagtcggtcctcgagtactcgaccacggtcagcgtcgcgaaggtgctggtgctggtcgccatcgtcgctttcctccagtggcggccccaggggctgtacaccctgcgcacgaggagtctcgta

SEQ ID NO: 1181 - DNA, 1107 bp, Streptomyces avermitilis
  CDS (1)..(1107)
atgaccgggtcccgaacgtcgttcctcaaggggcgctccacccgggcggcggccggcttcacgggagccgccgtcgcgctcttcgccgtcgccccgctcgccctctccgacttccggctggggctactcgccaagtacctgtgcaccgcgatggtcgccgtcggcatctgcctggcctggggccgcggcgggctgctgacgctcgggcagggggtgttcttcgggctcggcggctacgcgatggcgatgcatctgaagatcgtggacgccgggcccggcaccattcccgacttcatgcagttgtacggcaccgccaccgaactgccctggtggtggcgaccgttcgccaacccggtgttcgcgctcgcggcgaccgtgctgctgccgatggccgtcgccgccgtcctcggttcgttcatcttccggcgccgggtcaagggcgcgtacttcgcgatcctcagccaggcactggccgccgcgttcgcgatctggctggtgggccagcaggccacgaccggtggcaccaacggactcaccgacatccagggcttcttcggctacgacctcgacgaccccgtcaaccagcggatggtgtacttcgtcatcgccgcggccctgctcctcctgatcgccctggcccgccagctcatccacagccggtacggcgaactcctggtcgccgtacgggactcggaggagcgcgtgcgcttcctcgggtacaacccggcgaacgtgaagctcgtcgcgtatgtggtggccgccggcatggcgggcctcgcgggcgccctcttcgtccccgccgtcggcatcatctcccccgcgctgatcgggatcgtgccgtccatcgagctggtcatcggcgccgcggtcggcggccgggcgagcctggccggcgcggtgctcggggcgatcgcggtcgcctgggccaagacggccctgtcggaggagttcccggcggcctggacgtacttccagggtctgctgttcatcgtggcgctggcgttcctgccgggcggtctcgcctcgctggtggggatcgcacggcggcgcagggcctcacgggtgtccgccgacacggcgcccgtccttcccgtgggagaagcggca

SEQ ID NO: 1182 - DNA, 804 bp, Streptomyces avermitilis
  CDS (1)..(804)
atgagtgagctgtcggaccgtgcgggcctcccgggcctcgaaatacggcaactgcgggtgtccttcgacggattcaccgccgtggacggtgtggacctcgacgtcaggccgggtgacctgcgcttcctcatcgggccgaacggtgcgggcaagaccacgctggtggacgcggtcaccggcctggtgaaggcggacggctcggtgcgcttcgggggcgcggaactgctcggacggagcgtgcaccggatcgcccggtccgggatcgggcgtacgttccagacggccaccgtcttcgaggagttgacggtgctccagaacctggacatcgcggcgggcgcgggccggagcgtgctgacgatgctgcggcgccgcacgggtgtaccggagtccgtcgcgcgggccctggagacggtcgggctcacggagctcgccgacagcccggccgggacgctcgcgcacggccagaagcagtggctggagatcggcatgctgctcgtgcaggacgtacggctgctgctgctcgacgagccggtggccgggatgagccacgacgaacgccagtccaccggtgagctgttggagcggatcagcgaggagcggaccgtggtcgtcatcgagcatgacatggacttcatgcggtccttcgcgcgcagcgtgagcgtgctgcacgcgggcagggtgctgagcgaggggacggtggccgacgtgcaggcggaccccaaggtgcaggaggtgtacctcgggcacgcgccccaggagtccaccaccgccgagccggccgcgggcgtggccgtacaggaggcg

SEQ ID NO: 1183 - DNA, 693 bp, Streptomyces avermitilis
  CDS (1)..(693)
gtgatgctggagatcgacgacgttcacgtcggctaccaccgcagcaccgtcctgcacggcgtctgtgtcgaggtgccgaaggacggcgtcgccgccgtgctcgggcacaacggcgccggcaagagcaccctgctgcgcgccgcggtcgggctgctgacccccgcgcgcggcgccgtacgcctggacggggaggacatcacgcgccgcaagccccatgagcgggtggcgcgcggcatggcgtacgtaccccaggggcagcaggccttccctcacctcaccaccgccgagaacctccagctggtcgcggacggacgcaggcgcggcaaggcggcgatcgccgaggcgctggatctgttcccggcgctgcgggcgctgtcgaaccgccgcgcgggtctgctctcgggcgggcagcggcagcaactcgccatcgcccgcgccctggtgacggagcctcggattctgctcctggacgaaccgaccgagggcatccagccgtcggtcgtggccgagatcgaggagacgattctcgccctcgccgcccgcggtgggctctcggtgctgctggtcgaacagcacgtgggcttcgcgatgcgggcggcgcagcggtactgcgtcctggaggcggggcgggtcacgtcctttggcgcgggcgggcaggaggcggagcggtcggtgcgggaggcgctgagcgtg

SEQ ID NO: 1184 - DNA, 1188 bp, Streptomyces avermitilis
  CDS (1)..(1188)
atggccgtcggtgtcgaggaggtcttccgcgcggagtacggccgcgcggtcgccgtcctggtccgcttcctcggcgacatcgacctcgccgaggaagcggtccaggacgccttcaccaccgcactgcggacgtggccggagagcggagtcccgccgagcccggccggctggatcatcaccaccgcgcggaacagggcgatcgaccggctgcgccgcgagtccacgcgcgaggcccgccacgccgaagcggcccagctgtacgcgcccggcacaccggccgaggagggccccgtgcgcgacgaccggctccgcctcatcttcacctgctgccaccccgcgctcgccacccaggcacaggtcgcgctgacgctgcggctgctcggcggcctcaccacggcgcagatcgcccgcgccttcctcgtgcccgaacccaccatggcgcagcgtctggtccgcgccaaggccaagatccgcgacgcccgcatcccgtaccgcatcccgcgcgatgccgacctcccggaccgcgtcaggggcgtgctcgccgtcgtctacctcatcttcaacgagggctacggcggccgcgaggacctgtgcgccgaggccctgcgcctcggccgtctcctggccgagctgatgccggacgagccggaggtcatcggcctgctcgcgctgatgctgctgatcgaggcgcgccgcccggcccgtgagacgcccgagggcaccctgatcctgctggccgaccaggaacgcggccggtgggagcgcggcctgatcgccgagggccaggcgctcgtacgccgctgcctgcgacgcgatcagcccgggccgtaccagatccaggccgcgatcaacgccgtccacagcgacgcgcctaccgctgccgccaccgactggcgccagatcctcgcgctctacgaccagctgatggccctggcccccagcccggtggtcgccctgaaccgcgccgtcgccgtcgccgagaccgcgggcccgcagccggccctcgacctcgtcgacgcgctcgacctcgacggctaccacgccttccacgcggtccgtgccgacctgctcaggcgcctgggccgcggcaccgaagccgtgcgggcctacgaggcggccatcgcccgcacggacaacgcggccgaacgcgggtatctggagcgccgcagggcggaactcacgccggag

SEQ ID NO: 1185 - DNA, 390 bp, Streptomyces avermitilis
  CDS (1)..(390)
gtgaaagaccaccccgtgggagatcaccgaggaggacacatcatgaagcactacctgctcagcgtcatgcagccggccggcgagccgcccgcccccgaggtcctggaagggatcatgcacaacctcgacgtcttccacgcggaactgcgcgaggcgggcgcctgggtgttcgccgggggactgcacggcccggagacggccaccgtgctgcgggccgaggagggcggcgatgtcctgatcaccgacggcccgtacaccgagagcaaggagtacctcggcgggatctgcctcatcaaggcccccgacctcgacgccgccctcgagtggggccgcaaggcgacactggcgacgacgctcccgatcgaggtacgccccttcatgggcgaggcc

SEQ ID NO: 1186 - DNA, 1059 bp, Streptomyces avermitilis
  CDS (1)..(1059)
atgaccactccaccggatccgcatccgctcgtcgccggggcgcgccggctcgccgccgaggtgctggcgccccgcgcggagcaggtggaccaggagggggtgcccgcgagcagtatcgaggcggtcaagcggtcggggctgctcgggctgagcgcgccggtggagtacggcgggtcggcggcgccggccgccgtggcccgcgagaccgcggagatcctggccggggcctgctgttcgacgtggttcgtgcagacccagcaccacacgccggtgatgaccctggccaagagcgaactgcctgtgcgggagtggttgttggggccgttggcgaggggggagctgctgtccggggtggcgtacgcccagttgcgcgcgtatccccgtgttccggtgcgggtcacccgggagcgcggcggctggcgcttcgacgggacggtgccctggtacacgggctgggggctcaacgacgtgatgctgctggccggggtcacggacacggacgaagcgctcttcgccttcaccgaggcccgtgcgcagccggggttgcgcccgtcgccgccgatgcggctcgcggcgctgaccgccgcgcgcacggtgtcactggaactggacggcctgtggctgcccgaggaggcggtggcgctgcggacgccgtacgagacctgggcggctgccgaccggcccaagaacaccaacgccggacccgccgtcttcgggatcaccgcgtcggcgctcggcctgctggcggacggcgatccggccgcgcaggagtccgcgcgggtcctgcgcggccggctcgacgaggtccggcggcacgcgtacgcgctggccgaccaccccgtgccgtcggagcggatcgaggaacggctggtggtcaagacacgcgcctacgacctgatgcgcgcggccacgaccgcggccgtggtggccgggggcggccgggccatggacctcggcagccccgcgcagcggctggcgcgggaggggatgttcctgctcgtgcagggacagacggccgaggtacgcacggcgcacctcgggtccttggccgcgccgtac

SEQ ID NO: 1187 - DNA, 195 bp, Streptomyces avermitilis
  CDS (1)..(195)
gtggcggttgcatgtgcggtgacatccgatccgaccgctggaggcgcggtggccgagcccgtccgtgtgcgcagactgaccgaccacgaggggcagaagctgcagcagatcgtgcgccggggcagcacgagttcggtgcgctaccggcgggcgatgatgctgctggcctccgctggagggggcaccggcagcgga

SEQ ID NO: 1188 - DNA, 1041 bp, Streptomyces avermitilis
  CDS (1)..(1041)
atgagcgagatgcagtggccgtgcaccgacccccgccccgacccgagcgccgacgcggccgggcggcaccgcatcgccgtcctcgccctgcccggcgtcccgcccttcgaactcggcatcccctcccgcgtcttcggcagcgtcctggacgccggctcacgcccgctgtacgaggtcaccgtctgcaccgccgacggcgccccggtcctcagcgacgccgggttcaccgtgcagcccgcggccggtcccgaggccctggccgccgcggacaccgtgatcgtcccgcccacgcacgccatgcccgagctgggccgcggcggcccgctgccgcccgaggtcaccgcggccatcgccggcatccggcccggcacccgcctggtgtccatctgcaccggctcctacgtcctggccgccgcgggcctcctcgacggccggcccgccaccacccactggcacctcgcccccgagttccgccgcgcctacccccgcgtcaaggtcgacgaggaggtcctcttcgtcgacgacggcgacgtcctgacctccgcgggcgtcgccgccggcgtcgacctgtgcctgcacatgatccgccgcgaccacggcgccgccgccgccaaccgcgccgcccgcatgtgcgtcgtcccgccctggcgggacggcggccaggcccagtacatcgaccgcccggtgcccgaacccaccgtcgccaccaccaccgccacccgcgcctgggccctggaacacctcggcgaacccctctccctgaaccgcctggccgaacacgcccggatgagcctgcgctccttcacccgccgcttccgcgacgaggtcggcatgacccccgtgcagtggctcaccgcgcaacgcctggaactggccaagcagttgctggagaccaccgacctgtccatcgacctggtcgcccaccgctgtggcttcggctccgccaactccctgcgcgcccacatgcgcaccgccttcggtgtctcacccgcctcctaccgccgcaccttccataccgacgacctggtggaagcgggcgtc

SEQ ID NO: 1189 - DNA, 924 bp, Streptomyces avermitilis
  CDS (1)..(924)
atgcgtgcggtggtcgtggagcagtggggcggaccggaggtgctcgtggagcgtgaggtcgcccggcccgagccgggactgaacgaggtcctggtgcgggtccacgcggccggtgtgaacccggtggacttcaagacccgggccagcggggccctgatcgagtggggcgaggtcccggcggtcggctgggacgtctccggcaccgtggaggccgtcggaccgggcgtggggatgttccgccccggggacgaggtgtacggcatgccgctgttcccgcggcaggcgggcgcctacgccgagtacgtcgtcgccccggcccgccacctcgcgcccaagccggcgaacctcacccacgtgcaggcggcggcgctgccgctggccgcgctgaccgcctggcaggccctggtggacaccgccggggtgcgcgccggtgagcgggtgctggtgcacgcggcggccggcggggtcggccacctggccgtgcagatcgccaaggcccgcggcgcgtacgtcatcggcacggccagcgccggcaagcacgacctgctgcggcagctgggcgcggacgaggtgatcgactaccgcacggtccgcttcgaggacgccgtcggggacgtggacgtggtgctggacgggctcggcggccagaacgccgagcgatccctgacggtgctgcgcccgggcggtcggctgatcaccctgcccggccccgacgacgtccccgccgacgtccccggccacgtgcgggcggtgtggatgctggtcgagcccgaccacctgggtctgcgcgagatcgccgccctggccgagcggggcgcgctcacgcccgtggtcgagaccgtcgtcccgctggccgaggccgcgaaggcgcacgagatcggcgagcagggccgcaccaccgggaagatcgtcctgagcgtcgcc

SEQ ID NO: 1190 - DNA, 993 bp, Streptomyces avermitilis
  CDS (1)..(993)
atgcgagcgttcgtcgtcaccaagtacaaggagccgctgcaagaggcggacgtccccgaacccaccgtgggggagcacgacgtgctcgtccgggtggaggccgccggactgaacccgctggatgagaaaatccgcgccggtgagttcaagcagatcctgccctacaagctgccgctgattctgggcaacgacgtcgcgggcaccgtcatcagcgtcgggacggcagttcgcggcttcaagcccggagacgaggtctacgcccggccccaccaggaccgcatcggcacgttcgccgagcgcatcgccatagcggaagacgacctggcgctcaagcccgcttccatcagcatggaagaggccggctcgctgccgctggcggcgctcacggcgtggcaggcgctggtggagcgcgggaaggtgcggccagggcagaaggttctcatccacgccggcgccggcggggtcggttcgatcgcgatccagctcgccgcacacctcggggcgagcgtcgccacgaccgccagcggttccaacgcggacttcgtgcgcgcgctcggcgcggacacggtgatcgattaccgcagccaggacttcgagcagctcctgaccggctacgacctggtgctggacagcctcggtggtgagaatctcgagaagtccctgcgggtgctcaagcccggcggcaaggccatcgggatcgccggtcccccggaccccgcgttcgcccgcgaggccggcctgaacccgctgctgcgcctggcggtcgcaggcatgagcggcaagatccgcaggcaggccaagaagctcggcgtgacgtatgagttcctgttcatgcgcgccagcggcgaccagctccgccagatcaccactctcatcgaccagggcgtggtgcgtccggtcgtgggaaaggtggtcggcttcgaccagaccccgcaggcgctgcagtccctgtcccagggcggcatccgcggcaaggccgtcatcggcagcagc

SEQ ID NO: 1191 - DNA, 600 bp, Streptomyces avermitilis
  CDS (1)..(600)
atgtctgtcgcctcccagtcggtcggacggcgcgagcggaacaagcaggagaaactcgaccgcatcgtcgctgccgcaagtgaactgttcgccgaacacggcgtcgatgaggtcacgacccagcagatcgctgaccaggccgacatcggcaccgggaccctgttcctttatgccaagaccaagggcgaactcctcctccttgtccagaacgccaagtacgtcgaagcacttgagcagggccgggcggacgccgagaccgtccccggcgtgctggacgcggtgctggcgatcctccggccgatcgtcgagtgcaaccgcatccagatcgacaacggacgcacctacctgcgagagatggtcttcggcgaccccgaggagccccggcacggcgcggcactggccatcgtcgcgcagaccgaggaggccgtcgccgccgtgctgcgccgagacgaacgggtcgcagagggcgacgccgcgacgctggcacacatcgtgtccgccgtgatgttcctcagcatggcggcgagcgtgaacatcgccttgagcgtcgaggagatcgtgcaggacatccgcaggcaggtcgacgtcctgctgcctcgc

SEQ ID NO: 1192 - DNA, 252 bp, Streptomyces avermitilis
  CDS (1)..(252)
atgtcgatcaccggttggcgagcacgggagttcagctccctgttcgccgatctcggtgaggggttggatgatctgggggtgcccgaggggcagccgttcctgatcagtccggcgggcgtgtacgacgtggcgctgaaccggtatttctcggtgtggctggcgttcgccgtggaacacccaggccgcccatgtccgggacctgcgcacgtacttcgacttcctgtggttcgcgcgaggcaggcgggactggcg

SEQ ID NO: 1193 - DNA, 1119 bp, Streptomyces avermitilis
  CDS (1)..(1119)
gtggccgagcccgtccgtgtgcgcagactgaccgaccacgaggggcagaagctgcagcagatcgtgcaccggggcagcacgagttcggtgcgctaccggcgggcgatgatgctgctggcctccgctggaggaaaacgggtgccggtgatcgcacagctggtgcaggccgacgaggacaccgtccgggatgtgatccacgcgttcaacgagaagggcctggcctgcctggaccctcggtgggcgggaggccgtccccgccaactcaagtctgacgaagaggacttcgtcgtccagacagccaccacctgcccggtcaagctcggccagccttttactcgctggtcactgcgcaagctcgtcgcctacctgcgcaaagtccacggccgggtgattcgcatcggccgtgaggcgttacggtgcctgctcgcccgccgcggcgtcaccttccagcgcaccaagacctggaaggagtccccggaccccgaacgggagacgaagctggaccgtatcgagcacgtcctggaccgcttcccggaccgggtattcgccttcgatgagttcggcccactcgggatccggcccatcggcggcagctgctgggccgaacagacccggcccgaccggctgccggccacctaccatcgcacccacggcgtccggtacttccatggctgctactcggtgggcgacgaccgtctgtggggcgtgaaccgccgcaagaagggttccgggaacacgctggccgcgctgaaatcgatccgcgccgcccggcccgacggcgcaccgatctacgtgatcctggacaacctgtccgcccacaagggcgccgacatccgccgctgggcaaagaagcacaaggtcgagctgtgcttcaccccgacctacgcctcctgggcgaacccgatcgaggcgcacttcggaccactgcggcagttcaccatcgccaactcccaccaccccaaccacaccgtccagaccagggccctgcactcctacctccgctggcgcaacgccaatgcccgccactgcgacgtcctggccgccgaacgcaaggaacgcgcccgcatccgcagcgagaaaggcacccgatggggcggacgccccctcacaaccgcagcc

SEQ ID NO: 1194 - DNA, 1179 bp, Streptomyces avermitilis
  CDS (1)..(1179)
gtgtccctcacctttcactggttcctccccaccaacggcgacagccgccatgtcgtcggcggcggccacggcaccccggccaccgcctccggccgggaccggccgcccacggtggcgtatctgagccagatcgcccgcgccgccgaggacctgggcttcgtcggcgcgctcacgcccaccggtgcctggtgcgaggacgcctggctgaccaccgcgatggtctcgcagcagaccgagcgcctgaagttcctggtcgccttccgccccggcttcgtctcgcccacgctggccgcgcagatggcgtccaccttccagcgccagaccggcggacggctcctgctcaacgtggtcacgggcggcgagagccacgaacagcgcgcctacggcgacttcctcgacaaggacgcccgctaccgtcgtaccggcgaattcctgcaaatcgtccgggagttgtgggagggcaagaccgtcgacctggccggtgagcacctccaggtcgaggacgccaggctggcgcgcgtccccgacccggtccccgaggtctacttcggtggttcctcacccgtggcgggcgaggtcgccgcccggtacgtcgacgtctacctcacctggggcgagccacccgcgcaggtcgccgagaagatcgcctgggttcgcgggctggccgcggaacagggccgtacgctccgcttcggcatccggctgcacgtcatcacccgcgacacctccgagcaggcctgggccgaggcgcaccggctcctcgacggcttcgacccggagacggtcaagtcggtgcaggccgggctcgcccgcagcgagtcggagggacagcagcgcatgctcgccctgcacggcggcggcctcccccaagctctcgactccgctcgagcaggggggacccccaccgggctggagatccaccccaatctgtgggcgggcatcggcctggtgcgcgggggcgcgggcaccgccctggtcggcagccacgaggaggtcgccgagcgcatcgccgagtaccaccgcctcggcatcgacgagttcgtactctccggatatccgcacctggaggaggcgtactggttcggcgagggcgtcctgccgaggctggccgcacagggactgtggcagcacccgttcgcgaagccggcggcccccgcggcacaggtgccgttcgcgagc

SEQ ID NO: 1195 - DNA, 1182 bp, Streptomyces avermitilis
  CDS (1)..(1182)
atgcccgcccatgtcatcgccgacgacgccgaagccctgtccgtcgccgccgcgctcgccgacgagttccgtgccggggcgtccggccgggacgccgaacgccgcctgccacgcgccgagttggaccggctgtccgcctcggggctgctcgcggtcaccgtgcccgccgagcacggcggcgccgacgtacgccaggagaccctcgccgagatcttccggctgctcgcctcggccgacgccagcctcgcccagatcccgcagaaccacttcgtctacgtcaatgtgatccgccgccaggggatcgaggaacagcggaagttcttcttcgccgaggtgctcgccgggcggcgcttcggcaacgcccagtccgaggcgggcacccggcacgtccaggacatccgcacccggctggcaccgcggcccgacggctcgtaccttctgaccggggtcaagcactactccaccggcgctctgttcgccgactggatcccggtgctggcccgagcggagaacgacgacctgcacgtcgcgtacgtcccccgggacgccgacggcgtgacggtcgtcgacgactgggacggcatggggcagcgcacgacggccagcggcacggtccgcctggaggccgtgtccgtccccgccgaccgcgtcctcccgcaccacctcaccttccagggaccccaactgcacggggctgttgctcagttgctgcacgccgccatcgacgccggaatcgccgcgggcgcgctggccgaggccgccgagttcgtacggacgaaaagccgcccctggttcgagagcggtgccgagaccgccgccgaggacccgctgctgatccagcgattcggcgaactcgccatccaggtaagggcgtcggacgcgcttctcgtggccgccgcccgtgccgtcgacgcggcccgtgccgatctcaccgacgactcggcggccgaggcctccctcgcggtggccgccgccaaggtgcacaccgcgagcaccgccgtcgaggtggcgggcgccctcttcgaggtgtccggcacccgctcggccctcaactccctcaatctgcaccggcattggcgcgacgcgcgcacccacaccctgcacgacccggcccgctggaagatccagcacatcggccgccacgtactcaacggcaccaagccgccccgccacggcctgctc

SEQ ID NO: 1196 - DNA, 552 bp, Streptomyces avermitilis
  CDS (1)..(552)
atggccaccgtcctgtccgtctccggcagcccctccgtctcctcccgcaccaaccgtctgctgcgccacctggacacccggctggtcgcgcagggccatgaggtgatcccgctcgacgtccgcaccatccccgcggaagccctgctcggcgccgacttccgccaccccgccatcgtcgaggccaccgaactgttcgcacgcgtcgacggtgtggtcatcggcacccccgtctacaaggccgcctactccggggtcctcaaggcgctgctcgacctgctcccgcagtacgccctcaccggcaagaccgtgctgccgctggccaccggcggcaccaccgcccatgtcctggcgatcgactacgcgctgcgccccgtgctcaactccatgggcgcggcgcacatagtgcagggctggttcaccctcgacaaggacatcacggcgggcgaggacggctccctcaccgtcgcaccggccgccgccgaggccctcacccaggtggtcgaccagttctcggcggccctgggccgcacgcccctgctggccgcggcgggc

SEQ ID NO: 1197 - DNA, 1119 bp, Streptomyces avermitilis
  CDS (1)..(1119)
atgcccgcagaacccgtccgcttcgcctactgggtccccaacgtcagcggcggcctcgtcaccagcaggatcgagcagcgcaccgactggggctacgactacaaccgcgaactcgccgtcctcgccgagaacaacggcttcgactacgccctcagccaggtccgctacatggccagttacggcgccgagttccagcacgagtcgaccagcttcagcctcgccctgctgctcgccacccagcgcctcaaggtcatcgccgccgtccacccgggcctgtggcacccgggcgtgctggccaagctcggcgccaccgccgaccacctctccaacggccgcttcgcggtcaacgtggtcagcggctggttcaagggcgagttcaccgcgctcggcgagccctggctggagcacgacgaacgctaccgccgctccgaggagttcattcgcgccctgcgccagatctggaccgaggaccacaccgaactcgccggcgacttctaccggttgcgcgacttctccctgaagcccaagcccctcaacacccccgagcggccgcacccggagatcttccagggcggcaactccacggccgcgcgggcgatggccggccgggtctccgactggtacttctccaacggcaaggacttcgacggggtcgtcgaacagatcgcggacgtacgcaactcggcggcccaggccggccgcacggcaccgaagttcggcctcaacggcttcctcatcgcccgcgacaccgagaccgaggcccgcgagaccctccgcgagatcgtcgcccaggccgacaccgatgccgtcgagggtttcggcgccgccgtgaagcaggcggggcagtccaccggcgacggcaagggcatgtggcaggactccagcttcgaggacctcgtccagtacaacgacggcttccgcacggggctgatcggcacccccgagcagatcgccgagcggatcgtcgcctacaagcgcctcggcgtcgacctcctcctcctcggcttcctgcactaccacgaggaggtcgagtacttcggccgccgcgtgctgcccctcgtacgcgagctggaggcccaactgccggaaagcgaggcggagtccgtccccgttcacgcc

SEQ ID NO: 1198 - DNA, 918 bp, Streptomyces avermitilis
  CDS (1)..(918)
atgcggacagagcagctcgaatacatagcggcggtcacccggctgggttcgctgcgccgcgcggccgaggaactccacctctcccagcccgcgttgagtgagaccgtacggaatctcgagcgcgagctgggtgtcgacctcctggagcgcaagcgctccggtgcccggatgagcgcggagggccgcgagctgctgccgcacatcatcaatgtgctggacgcggtggaccggctgcgcggcgccgcgggcgagcagcaccgcatcagccgcatggtgcgcctgggcacggtgaacgcggcgaccgtgccgctgctcatcccggtggtccgggagttccgcgcggcgcatccgctgacccaggtggaggtggtcggcgcccagcagtcggagatccaccggtcgttgctggagggcggtttcgacctcggtctggtgaaccatctcgacggggacgacgtggccgccgacttcgagaccaccgaactgctgcgcggacggccggtggtgtgcgtacgaccggacagtcccctggcgtcccggaccacggtgtcggtgtccgacctgctcgccgagccgctgatcgccatgcgctccggttatgtgatgcaccggttcgtccaccggctcctggagggacactccccgtcgttctcgtactccaccgacggcgccgagatgggcaagctgatggtcgccgaggggctgggcgccacggtgctgcccgacttcagcgtgatcgacgatcctctggagcgccggggtgcgatcacctaccgcccgctcgcggacgactcgactcaggtgctgctgatgctccagcggcgcagggcggagtcggtgccgcaagcggcccagggtctgtacgagacgttcgtgggcagggccgaggcgctcggcgggacactgaccggccgcccc

SEQ ID NO: 1199 - DNA, 147 bp, Streptomyces avermitilis
  CDS (1)..(147)
gtgcgccgggccgcacgcgacccgacgcgccgaccgaacgcgatgcggcgcgctgcgccggtgtccctctcctgggcccggggcggtgcccgccccctgggcccgggacggcaaccgacgcgtaggcccgggacggcgacccgcccg

SEQ ID NO: 1200 - DNA, 1572 bp, Streptomyces avermitilis
  CDS (1)..(1572)
atgaggagaagggcacatgacgctgcgcgagggagccgagaacacatgagcagtgacgacacccggccggggctgcgctgcctggtgaccggcgccacgggatacatcggggggcggctcgtcccggaacttctcgcagagggccaccaggtgcgttgtctggcccgctcgcccagaaagctgcgcgaccatccctgggcgggcgacgtggacgtgatgcgaggcgatgtcacccaccccgagtcggtcggcgaagcgatgcgcggcatcgacgtcgcgtactacctggtccacgcgctcggcacgggcagtgacttcgaggagaccgaccggaagtccgcacgtgtcttcggggagcaggccaaggcagcgggcgtccagcgcatcgtctatctcggcggcctcaccccggcaggcgtaccggagaaggagctgtccccgcatctgcggtcccgggccgaggtcggccacatcctgctggactcggacgtaccgaccacggtgctgcgggccgcggtcatcatcggctccggctcggcctccttcgagatgctgcgctacctcaccgaacgcctgccggtgatggtcacccctagctgggtgcgcacccggatccagcccatcggcgtacgggacgtactgcgcgccctcgtgggcagtgcccggatgccggccgacgtcaatcgcgccttcgacctcggcggacccgaggtgctgacgtacctggacatgatgcgcaggtacgcggcgatcgcggggcttccgcgtcggctgatcgtgcccgtgcccgtgctcactccccggctctccagtcactggatcgggctggtcacaccggtgccgcggtcgatcgcgcgcccgctcaccgagtcgctgcgccatgaggtcgtctgccacgagcacgacatcgcccgctacgtgccggacccgccggggcggccgatcggcttcgacgactcggtccggctggccctgcaacgcgtacgggacgcccaggtgacgacccggtggtcgtcggcgtcggtgccgggcgcgcccagcgacccgctgcccaccgaccccgactgggcgggcggcagcctctacaccgaccggcgtgagctggccgtcgacgcctcgcccgaggccctgtggcgggtcgtcgagggcatcggcggggacaacggctggtactccttcccgctggcctgggccgtacgcggctggctcgaccggctggtgggcggggtcggactgcgtcgcggccgccgtgacgccgcccggctgcgggtcggcgactcgctggacttctggcgggtcgaggagatcgagccgggccgtctgctgcggctgcgcgccgagatgcggctgcccggtctggcctggctggagatgtacgccgagccgggcgccgacggcggcagccgctatcgccagcgtgccctcttccatccgcacgggctgctgggtcacgcctactggtggagcgtgtcgccgtttcacgccgtggtgttcggcggcatggcacgcaacatcgcgcgcgccgcggccaaggacgcgaccgaccgggcgggagcgcacgagcccgcgggg

SEQ ID NO: 1201 - DNA, 1371 bp, Streptomyces avermitilis
  CDS (1)..(1371)
atgaacgtctcggtcgtcctgttcacctccgacctgcgtctgcacgaccatccgccgctgcgggcggccctggacggcgcgcgtcaggtggtgcccctgttcgtgcgcgaccgggccgtcgacggggccgggttcgccgcccccaaccggctggcgttcctcgccgactgtctgcgagacctcgacgccgggctgcgcgagcgcggcgggcgactggtgctccgctccggcgacgtggtcgaccaggtgtgcaaggtggcggccgaggcggacgccgacgaggtgcatctggcggccggggtcagcgcgtacgcccaccggcgcgagcagcggctgcggtcggccctggaggcggacgggcgtcgactgcacgtccacgagacggtgatcaccgcggtggcgccgggtgccgtcaccccgtcctcctcggaccacttcgccgtcttcaccccgtacttccggcactgggagcgggagcatctgcgcgacgcgctcggcgcgccgcgcggcgtgcgggtgccggagagcgtgggctcggaacggcttcccacccgcacggaactgtccggactgtcgcaggggctggcggcgggcggcgaggaggagggcaggaagcggctcatggcctggctgcgcggcggcatcacggcgtacgaggaccgccatgacgacctggccggcgacgccacttcccacctctccccccacctgcacttcggcacgctgtcccccgtcgaactcgtccaccgggcgcggcggacgggcggccccggcgccgaggccttcgtacggcagctcgcgtggcgcgacttccactaccaggtgctggccgcacggcccgacgcggccaccgcggactaccgcggccgcggcgaccgatggcggtccgaggccgcggcgcgggaggaggtcgaggcgtggcggacgggccgcaccggctacccggtgatcgacgcggcgatgcgccaactgcggcacgagggctggatgcacaatcgtggccgtctgctgaccgcgagcttcctcaccaagacgctgtacgtggactggcgggtcggcgcccgccacttccttgagctgctggtggacggcgatgtcgccaacaaccagctcaactggcagtggatggccggaaccggcaccgacacccggcccaaccgtgtcctcaatccggtcacccaggccaagcggtacgacccggacggcgcgtacgtccggcgctgggtgccggaactcgaaggactccggggagcggccgtgcacgagccctggaagctcaagggactcgaccgcgccgcgtacgactaccccgacccgatcgtcgaactcgccgacggtctggcccgcttccggcacgcccgcggacgcgac

SEQ ID NO: 1202 - DNA, 1251 bp, Streptomyces avermitilis
  CDS (1)..(1251)
gtgatcaccatgtccgtcatccgtgatgccccggacgtcctggtgatcggggcgggcctggcgggactcgcctgtgcccgggacctgtcggaggcgggccacaccgtacgggtgctggaggcctgcgacggagtcggcgggcggatgcgctccgatcgtcacgacgggttcgtcatcgaccgcggcttccaggtcttcaacacgtcctacccccaggtacggcggcgcctgaccctgcgggacctgcggctgcggcccttcaccgcgggggtgctggtgcacacgaaccgcggggcgctgcgcttcggcgacccgtcccgcagcccgcacacgttctccgatctgctgccggggcggctcgcgggcccccgcgacctcgcggccctcggcatcctgacggctcgcgacatgctggcccccgtacggtcgttgaagcgcggcgctgaccacaccacgcggtccgcgctggcgggcgccgggttctccgaggagttcgtcgagcgcttcttccggccgttcctgtcgggagtcttcctggaagaccgactggagacctccagccggttcttccatctggtctggcgcagcatgctgcgtggcactctctgcctgcccaccgaagggatcggtgccgtgccccgcgcgctcgccgaccgcctgccgtccgggaccgtgcgcctcgggacgcccgtcggcacgctcaccgacgacggtgtcgcactcaccgacggcaccgtactcccggcacatgccgtggtggtggcaacaggacccggccccgccgcgtccctgctgcccggcctggacgtgcccgcctaccgtgtcgtcaccacgtactaccacgcggccgcgcggcccccgctcggcgaaccgaccctcctcacggatgccgggcgccgcttcctcaacacctgtgtgctcagcgaggtcgtccccggttacgcgccgaagggcaccgccctcgtcgccacctcggttctcggcgaggacgccgaaggccgcgaacccctcgtacgcgacgcactggccgaggcgtacggcatcgacaccggccgctgggacctgctgacggcgcgtacgattccggacgccctgcccgtcatgacgcccccgcagtccctgagccgcacctcacgagtggcaccgggccggtatgtgtgcggagatcaccgtgccaccggctcggtccagggagcgctggcctcgggcgcccgcgccgcccgcgaggtgctgcacgacctcgacggccgg

SEQ ID NO: 1203 - DNA, 1041 bp, Streptomyces avermitilis
  CDS (1)..(1041)
atgagcgagtccacgcgcgcggaaggccggccgggcgggctccggcccggtaccgcggccgtcgacgacaccgggctgacgaccggagccctggcacgccggctcggggtgtcaccaacgacgctgcgttcctgggaccgcagatacggcgtggggccccagatccgtgccgacggacgccaccgccgctggtcgccccaggacgtggcgatgctggagacgatgtgccggctgacctcggccggagtaccgcccgccgaggcggcgcgcgtggccaaggaaggcggcggctcgtcgtcgcccacccccgctcagccggaggcggccggggcgcccgccgtccgcgtacgctcgcacgcgggcggcacgctgcccctcggcgacgtgcgtcaggagtgccgcggactggcccgggccgccgtgcggctcgacgccccggccgtcgaggaccagctgacctcgtccgtggagcggcacggcctcaccgtcgcctgggcggaggtgatggtgccgacgctgcacgccgtcggacgcaagtgggagtcgtccggtgaccgctatgtcgaggtcgagcacctgctgtcctggcacatctccaccgcgctccgccgggtccttgcgcccgtccgccccggcgaccgggacgccgccggtcccgtggtcctcgcgtgcgtccccggcgaacagcacacgctgccgctggaggcgctcaacgccggactgatcgaactcggtctgcccacccgtatgttcggcgcggccgtaccggtggaggcgctgaccgcggcggtacggcggctgggtccggcggccgtggtgctgtgggcgcaggcgcgctccacggcgagcctcccgctggccaggcacgtcgccgcgacgcagtggggcgtgaagggtgcgcgcaggcacccgctggtgatgctgggcggccaggggtgggcggggcgttcggcgcagggcatgctcagaccgccgggtctgcgagaggcgctcgacgcgctcgccgccacgtacgaaggcgcggcttccgggccgcggggc

SEQ ID NO: 1204 - DNA, 612 bp, Streptomyces avermitilis
  CDS (1)..(612)
atgaccgcacagccgaccaccgcacacgcgcgagcaacggacgtgcccctgtgggtgccggtggaggagtcgctcgcggacgaggaactggcccggggcctgatgaacggcgacgaggcctgcctgaccgccgcctaccaccggtggtcggcactggtacacacgctggcccggcgcaccctgggcgacgtcagggaggccgaggacgtcacccagcaggtgttcctcggcgtgtggcgcggccgtgcggcctaccgaccggagcgcggtgccctcggcggctggatcgtcggcatcaccagacggaagatcgccgacgccctggccgcgcggacccgccgccgcgacctggtcacctcggccggttcggtcatgttgctcgccgacggcgcgggcgaactgccggaggcggccctggaccgggtgctggtccggcacgagctggctaagctgcccgcgccccagcaacaggtgctccggctggccttcttcgaggacctgacccagacgcagatcgcccggcgcaccggctggccgctgggaacggtcaagagtcatgcccggcgcggactgcgccagctgcgccgctgtctgcaacaggaggcgaccgcc

SEQ ID NO: 1205 - DNA, 1017 bp, Streptomyces avermitilis
  CDS (1)..(1017)
gtggaacggcatacgtcggtacccgccaggagactgtcatggctgcgccgtctgccggccctggcaacgggaaccggccgcgcgacaggccccgtccttccttcgggtgcgcccgcggcaccgcacggcgtcacggacgtaccaaaggcccgtgtgcacgggtcctggcgggtccggcgggcggcgttgcgccggaccccggtgtcgatgtggcgggacgacgtgtccgactgggcggcggcattgacgtactacgcgatcctcgccctgttgccggccatgctgatggccgtctccctgatcggactggtcagtccccgcgtcaccgacgacctgatcgcgcatgtcaccgcctgggcgcccgcggagtcgggaaacaccctgcacggctcgctgcgccacctcgccggtgaacggtcggccgcgctgaccgtggccatcgggggtggcgtcagtgcgctgtggtcggcgtccagctacctggccgtgttccggcgcgcgctgcacgcccagcacggcatcgaggacacccggcccgcgctgcgcacggcgccccgcattctgctgacggccgtgaccctgctggcgctgctgttcgtcagcgccctgctgctcgtgctcagcggttcgctgctggaggcgctggggcggcgggccgggctgggcggcgccggtgccgccgcgtggacgctgctgcggtggccggcgctgctggcactggtggcgcttttggtgctggtcctgttccgcacgggtccgcgggaggtccgcgagctgcggcacgccctgcccgggggcatgctcgccgcgctgctgtggctgaccgcgtcggcgggcttcaccgcgtacgcctccggtctgggcgcctacagcaagctgtacggatcgctcgccggcgtgatcgtcttcctggtctggctctgggtgtccaatctggccctgctggccggcgcccagttcacggccgagctgacccgagcggaacgtgccgcgcaagctcccagggatcgtgggcgc

SEQ ID NO: 1206 - DNA, 870 bp, Streptomyces avermitilis
  CDS (1)..(870)
gtgagccgagcgaacacccggcggcgcaaaggggaaacaaccgtgcggatccaccatctgaactgcggctccatgcgaaccatcgacaccgacgcggggagcctgcccgccgtgtgtcactgcctgctcgtcgagaccgaccgtgacggcctcgtcctcgtcgagagcggcatcggcacggccgacgtggcgcgccccgaacagaatctcggcgcggacttcctcggccgggcccagcccgtgctggacctggcggagaccgcgctgcaccaggtgaccgggctgggcttccggccggagggcgtacggcacatcgtgctcagccacctcgacctcgaccacgcgggaggtctgtccgacttcccctgggccaaggtccacctgaccgaggccgaacaccgcgccgcgatggcggcgcccggcgcccaccccgaggaccgcgtccgctaccgccccgcccagtgggcgcaccgcccgcactgggtgacgtatccggaagcccagggcgacccctggttcggcttcgacgcggtccggccgctggacgggctggacgcggagatcctgctcgtgcccctcggcggtcacacccgaggccacagcgcgatcgccgtccgggacaccgggcgctggctgctgcactgcggcgacgcctactacttccaccgcgagatcgaccccgacgacccacgggggcaccccggcatggacatccttcagcagatcaccgaggtggaccggcccctgcgcctcggcaaccacgcccgcctgcgggagttggtgcgccggcacggcgacgaggtggaggtcttcagcgcccacgatccctgggagcttgcgcggcacgttccgctcgggtcagctcggccg

SEQ ID NO: 1207 - DNA, 597 bp, Streptomyces avermitilis
  CDS (1)..(597)
atgagcccgcgcaagtccgttgccgaagccgccgccacccgcgaccgcatcatcgagcgcgccttcaccctggcctccgccgagggcctcgaaggcctcaccatcggccgcctcgcgaccgacctgggcatgagcaaggcgggggtgatcggtcacttcggcaccaaggaagcgctccaactcgccgtactcgaagcggcggtcgaccgcttccggcaacgggtaccggggcgcgcggtgggcgcgcggccgggcaccgagcgactgtcgcgcgcgctccacgagtggatcgactacatgaccgagagcgagggccacgggggctgcttcctcacctccgtggcgagcgagttcgacggccgccccggcccggtgcgcgacgcggtgctcgacgcgctgtcccgctggaccgcttacgtcaccggggagttgagcacggcggtcgaagccggccggctgccgccgctgaccgatgtcgaccagctcgccttcgagctgaacggggtgatcctcgcggccgaccagtccatccagctgcaccgcgacccccaggcccccgaccgggcacgccgcgccatcggccgcctcctgaagcgc

SEQ ID NO: 1208 - DNA, 438 bp, Streptomyces avermitilis
  CDS (1)..(438)
atggccaacgtctcgcacaccagaggtgacatagccagccaccctgatgtaccagaaatgcgggaacgatacgcccgcatgctcggtggtcgcgatgtggtgctcgtcgacggaccggtgttcctgctcggtctgtactgcgccgcatccccctggatactccactacacgacaagccagcccgcgctcgcgacgcacaacctgatcatgggcatcgccataggcctgctggccctcggattcaccagcacaccggagaggatgtacggcctgagctgggccatgtgcgcgatcggcgcatggatgatcatctcgccgtggatcgtcggcaccagcccggacaccggagtcgtgctcaacagcatcatcatcggcgtcctgaccgtggtgctgggagcactgtgcgcggtcacgacgacgaggaacacgccccgcacg

SEQ ID NO: 1209 - DNA, 1251 bp, Streptomyces avermitilis
  CDS (1)..(1251)
atggccgatcacactgtcgcggtgagtcgaaccgtcagcgcatgggtgacatcgggtgcggacttcctcggtgtcgccggcccctttcccgtggatgtcccgtggtggtccgaggccgagcaggtcgtcggggagttggccggcctgctcggggtcccggtactggtactgcggctgctgaccgtggagggcggcgacggcgggcgggacggccatgtgacgtaccacgtcgaagcactgggcagccccgcaccggggacgctgcgccaactgcccgtcgacgatgccctgttgcacggtcacgagtcgctgcgctcgccatgggcgcgagccgagggcctgcgggagctgatcgactgggcgtccgggacgctgcgcgacgccgggcggcccgtgaccgggccggtcgagcagcggcggtcgtggaacctggccggcctcttccggctgcccaccgaggacggccggttctggctcaaggccaccgcgcatttcgccgcggacgagggcgcggtcatcgccgcgttcgcccgggtcgacccgggtttggtgccgacggtgctgggctcgggccaggggcgcatcctcatggaacacgtaccgggcgaggactgctggggcgcctcacccgagactgtcacggccgcgacggagcggctcgtggcagcgcaagccgccctggcgtcgacgcgcccggccgccctgcgggactggcgcgcaccggccctggccgcacggatcgacgtgctgctcgacggcccggtcgcaccggacctgacacctcaagagctgtccgcggcacgcgcactggcggaccgctgggccctgctcgccgagtgcgggctgcccgacaccgccgtccacggcgacttccatcccggcaactggcgcagtgacggcggctcgccggtcgtcgtggacttcgccgacgcgtactggggcaacccggtcttcgacggtctgcgcgtccacgaattcctgcccgagtcggcacggccggcagcggcccgtgcctggatcgccgcctggacccggcactcccgcggaagcgacccggcccgcgccctcgcgatcgcggagccgctcgcccatctcgccctggcggtgcgctaccaggagttcctggacggtatcgaaccgtcggagcgcaggtaccacgagggagaccccgcggcggaggtccgcaaggcgctgcggtgcgccgaggcgcccagtccgtacctcgcgccggccgcgagcaacgcagaccgc

SEQ ID NO: 1210 - DNA, 1467 bp, Streptomyces avermitilis
  CDS (1)..(1467)
atgtccggtagcccaggtagtccgccgcccgagggtggcttcgtccgccgtgtcggcctgttccaggccaccacgatcaacatgagccagatgtgcggcatcggtccgttcgtgacgatccccctgatggtcgccgcgttcggcggcccgcaggcggtgatcggcttcgtcgcgggcgcggtgctggccctcgcggacgggctcgtgtgggccgaactgggcgcggccatgcccggttcgggcggcagctacgtctatctgcgccaggccttccagtaccgcaccggacggctgatgccgttcctgttcgtctggacggcgatgctcttcatcccgctgatcatgtccacgggtgtggtcggtttcgtgcagtacctcggctacctggccccggacatgggccggaccaccggtgacctggtcggagtaggcatcatcgccctggtggtgatgctgctgtggcggggcatcgagaacatcgcgcggatcaccgccgtgatgtggacggtgatgatcgcctcggtcctgctggtgatcgtggccgcggcgagcgacttcagcgcgcacctggccttcacctatccggcgcacgccttcgaaccgaccagcggccacttctgggtcggcttcgccgcgggcctgaccatcggcatctacgactacctcggctacaacaccaccgcgtacatgggcgccgagatcaaggacccggggcgcaccctgccgcgctcgatcctcttctccatcctcggcatcatggcgatctacctgctgctgcagatcggcacgctcggcgtcatcgactggcaccggatgaccgacgcgggcgacatcgcctccacctccgtggcctccgccgtcctggagaagacctggggcaagggcgccgccgacacggtcacggtcctcatcctcatcaccgccttcgcctcggtcttcaccggcctgctgggcggctccagggtcccgtacgacgccgcccgcgaccgcgtctttttccgcccgtacgccaagctccactccaggcaccgcttccccatgctgggcctggccaccatgggcgtcatcacggcgatcggcttcctgatcggccgtcacaccgacctggccacgctgatccagctcctgaccacggtgatggtgatcgtgcaggcgctggcccagatcgtcgccctcaccgtcctgcgcaagcggcagccgaccctgcgccgcccgtaccggatgtggctctaccccctgcccagtgtgatcgccctggtgggctggctggtcatctacgggtacgccgacaagaactccccgggccgccaccccatcgaatggtcactcgcctgggtggcgctcggctgtgtcgccttcgtcgtgtgggcgcgcctggagaaggtctggccgttcggccccagggagatcgcggaggagtacctcacggcagcggctccggacgcggacgcggagccggcgcagacc

SEQ ID NO: 1211 - DNA, 1197 bp, Streptomyces avermitilis
  CDS (1)..(1197)
atgcgtgagaatggtgcgatgcccgccagtgatgccgcagaccagccggaacagccatggagccgtcggcggctgcgcagcaccaacgagcggctgctcctcgaccggctgcgggccaccggcgccgcgtcccgcgctcagctcgcccgcgagacgggtctgtcgaagccgacggtgtcgagcgcgctggcggccctggaggaggcgggtctcgtgcacgaggtcggcacgcacgcaccggagcggggccggacagcggtcctgtacgcccccgatccggccgccggacacgccctgggcatcgacatcggccgcagctggctgcgcgtcgcggtcgccaatctggacggcgaggtggtggcccgcgccgatgtgcgcaaccgggcccgcacttccggcgccctggccgacctcgtggtcgccaccgcccggcaggtggtcgccaattccggtgtcgggcacgacgaggtggcccacgcggtggtgggcacgcccggtgtgtacgacgaacagcggcggcgggtgcggtacgcgatgcacctgccgggctggggccgggccgggctgttcgaccggatgcgcgaggagctgggcataccgctggaggtccacaacgacgccaatctggccgcgctgggcgagtacacgtacggcgtcggcgcgggcagccggctgttcacgtacatcatgatcggcaccggtctcggcatgggcgtcgtcagcgaggggcggctgttcaccggcgcgcacggcggagccggcgagatcgggttcctgccgtggccggggcagcggaagccggagacgttggaggacgcggtgtcgggcgtggccgtcgtcgagtccgcgcggcggttcggcatgagcgggcagctcacggcgaaggccgtcttcgacgcggcacggcagggaaatccggcagcggtcagggccgttcggctggagggcgagcgaatagcgcacaccgtggcggcggctgcggccgtactggaccccgacctggtggtgctcggcggcggcgtgggccacagcctcgacctgctgctgcgccccgtgcgcgagacgctgcgcacgctcacgccgctgcgcccgaagatcgtgccgagccggctgggcgaggacgcggtgctgctcggcgcggtggcgacggcgctggggacggcccgggacgtcgttttcgagcgacgctcggcctcc

SEQ ID NO: 1212 - DNA, 2712 bp, Streptomyces avermitilis
  CDS (1)..(2712)
gtgttccaccgtcctgcctcagtacggcgcttcgtcacgaccgccgtggccctgggcctgctgagcacgctctcgacgggcgcccgggccggagcccgcacccacgagccgcccccgcgcccgaccactgtctcctcgactgcgggcagcaccaccgcgctgaccggctacgcgatccagtccacggcgaaggtcaccgaccccgcggccgccgtctcctcccccggctacccggcgagcggctggtacccggccggtgcccgctccaccgtgctcgcggcgctgctggccggcgggaagtacgccgacccgttctactcgaccaaccagcagaagattccgaaggccgacttccaggtgccgtggtggtaccgctcggacttcacggtcgccgacacctccgcccgtacgtatctggacttcagcggggtgatctcggcggccgacgtcttcgtcaacggacgtcagatcgccaggtccgccgacgtggcgggcgcctacacccgtcacgaactggacgtcacctcactggtgcgggagggcgcgaacacggtcgccttccgtatccagcccaacaaccccaacaagaacctgaccatgggctggatcgactggctcgagccgccgcccgaccagaacatgggcatcgtccgtgatgttctcgtgcgccgcggcggcccggtcgccctgcgcgacgcccacgtgatcacgcggctcgacgtgccgtcgctcgccaccgcggacctgacggtcaaggcgcgggcccgcaacgactcggacgcggccatcaccgccaccgtctccggcagcgtcggcgccacgtcgttccgcaggtccgtcgctctcgccgcccacgagacgaagacggtcaccttcacaccggccgacactcccgggctgcacctcacctcgccgcgggtgtggtggcccgcgggcatgggcggccagcccctgtacgcgctggacctcagcgcgtccgtctccgaaaccgtctccgacacggtgcacgagagcttcggcatccgggatgtgaaggccccgctcaactccgacggcgcacggcagtacagcgtcaacggccgcaggcttctcatcaagggcggcggctggtcgccggacgagttcctgcgctgggacagcacgtacgtcgaggaccggctccggtacgcgctcgacctcggcctcaacaccatccgcctggaaggccacatcgagccggacgagttcttcgacctggcggaccggtacggcatcctcacgctgccgggctgggagtgctgcaacaaatgggagggcaacgtcaacggcagcggatccggtgacgagtggaccgcggccgactatccggtcgccaaggcgtcgatggccgccgaggccgcccggctgcgcgaccacccgagcgtcgtctcgttcctcatcggcagcgacttcgcccccgacgcgaagatcgagaagacctacctcgacgccctgaaggcagccgactggccgacccccgtagtcgcggccgcctccgacaagtcctcgccggtcagcggcagttcgggcatgaagatgaccggcccgtacgactggatcccgccgaactactggtacgccaagcgcgagggcggcgccaccggcttcaactccgagacgagcgcggggccggacatccccacgctcgacaccctgcgccgcatgatgaccccggccgagctggacaccctctggaagaacccgggcgccaagcagtaccaccgctcaccgtcgtcggtcttcggcaccctgaagatctacgacgccgcgctcgccggacggtacggcgccccgaccggcctcacggactacgtacgcaaggcgcagctcgcccagtacgagaacgtgcgcgcgcagttcgaggcgtacgggcggggcgccaccgacgcctcgaagcccgcgaccggcgtcatctactggatgttcaacagcggctggacctcgctgcactggcagttgctggaccggtacctcgaccagggcggcgcgtacttcggggcgaagaaggccaatgagccgctgcacgtgcagtactcgtacgacgaccggtcggtcgtggtggtgaacaaccggcccgccgccgtctccggactcacggcccgggtcaccctcttcaacaccgacggaacgcagaagtacgacaagagcgcgaccggcctgagcgtggccggcgacggtgcgcacagcaccgcgctcacgctgccgtcgtcggtgagcggactgtcgacgacgtatctcgcccgcctggtcctcaccgactcggcgggcaaggaggtcagccgcaacgtctactggctgtccacccggcccgacaccctcgactgggcgcacaccgactggtactacacgccgacgacgagctacgccgacctcaagggcctcggctcgatggcgcgggtgccggtctcggcgacggcgtcgacgacggcgggcacggacggcgcgtccacgacgacggtcacggtgcggaacacgggaagcggcaggaccccgtcactgttcacggacgtgcacctcgtcgactcgaaggggaagcccgtcctgcccgttcagtggtccgacaacgaggtgagcctgtggccgggtgagtcggccaccctcacggtgacgtaccggacggccgatctgcacgggtccgcgcccagggtgcgggtctccgggtggaacacggcggagcagaccgtcccggcggcc

SEQ ID NO: 1213 - DNA, 1446 bp, Streptomyces avermitilis
  CDS (1)..(1446)
atgctcggattcagaagatcccgccccagactcaccacggcgctggccgtgttcggactgctcgccacgggcgcggccgtccaggcgtccatcgccgccccggcccacgcggccaccacgcaccgcgtcctgttcgacaacggccacgcggagacggccggcaacgccgactggatcgtctccaccagccagcccgacccgctcggccaggactcctccccgtcctcggaaaccgactggacgggcgcgctctcctcctggggcgtcgccctgcagaagaccggcaactacagcctgaagacgctcccttcgggcagcagcctcagctacggcggctccaccaccaccgatctgtcgaacttcgacacgctggtcctgcccgagccgaacacgctgttcacgacggccgagaagaccgcgatcatgacgttcgtgaagaacggcggcggcctgttcatggtctccgaccacacgggtgccgaccgtaacaacgacggctacgacgcggtcgaggtcctcaacgacctgatgaccgacaacagcgtcgacagcaccgacccgttcggcttctccatcgactcgctgagcgtcagctccgactacccgtcggcgatcagcgacagcagcgacgcggtcctgcacggctccttcggcaccgtcaccaagagcctgatcgccagcggtacgacggccaccctcaagcccgccgacaactcgtccgtcaaggggctgctctaccgcaccggatactccggcaacaccggagccttcttcgccaccagcaccttcggcagcgggcgggtcgcgttctggggcgacagctcaccgatcgacgacggcaccggccagtccggcaacacgttgtacgacggctggaacgacaccggcgccaccaacgccgccctcgccctcaacgccaccgaatggctggtcggcgcgagcagcggcggcgatgacgggggtggtggcggcacctgcaccgcggcccagctcctcggcaacaacggcttcgagtccggcgccaccacctggaccgcgagcagcgatgtcatcaccaactccagcggcgagtccgcccgtaccggctcctactacgcctggctcgacggatacggctccgcccgcaccgacaccctgtcccagtcggtgaccatcccctccggctgcaccacggccaccctcagtttctacctccacgtggacacggccgagacgaccacgagcacggcgtacgacacgctcaaggcgcaggttctcaacagcggcggcacggtcctgtccaccctcgccacctactcgaacctgaacgcggcgagcggctacacgcagcgcagtttcagcctcgcgagctacgccgggcagaccgtcaccgtcaagttcaccggcaccgaaggctccacgctccagacgtcgttcgtcctcgacgacacggcgctcaccgtgagc

SEQ ID NO: 1214 - DNA, 261 bp, Streptomyces avermitilis
  CDS (1)..(261)
atggagatctcgggcatcatcagtgccatcgtgatcggcatcgtcatcggcattctgggcaggctcgtcgtcccgggacgccagcgcatcggcatcctgctgacgattctcgtcggcatcgtggcggccttgatcggctccgcgatcgcgggcgccttcgatgtggccgacacgaacggcgtcgactggatcgaatggctcatccagatcggtctggcggcgctgggcgtcgcggcactggaccggacacgggctcgccgc

SEQ ID NO: 1215 - DNA, 984 bp, Streptomyces avermitilis
  CDS (1)..(984)
gtgctcccctttcctccccgtgccaaattgcaggtcaaccgccgtggcggctacgttctgcgggcttcgccccaccgtccgcctccttgtcgccacggagagaccttgcctctgcgcctcacccccctgaccgatcccgaaccgaagccgtcgagccggcggctggcctggctggcctccgacgacgacggcgtccccgtggggtcggcctttctccggttgttcacgaaggagggccaggagcatctcgccgagctcgaaggcgccgtgcaccccgaggagcggcggcagggcgtgggcggccgcctgctcgacgcggccgtcgccgccgcgcggggcgaggggcgacggtcgctgatcgcccaggcccaggagggctcccccggcgatcgcttcctcgcggcgcgcggcttccgccgggtgctggccctgacctacgcccgactgccgctggccgacgccgggttcgaccgtatcgccaagatcgtcgaacagccgcactccggctacgagttgacgcgctgggacggcacggtcccggcccgtctcgcgcagaccttcgccgactcgcggcgcgcgatggacgacatgccgatggaggacaccgactacggcacggtcgcctgggacgtggaacgggtcgtggccgcggccgcggcgatcgccgagcgcggcgaactgctgcacacggtcgcggcggtggactcgacggacggctcgatcgtcggattctccgagctcgtggtgccgggcgacggtcggggcgacgctcagcactacggcaccggcgtgctgccggagcaccgcggtcacggtctcgggctgtggatgaaggccgagtcgatccggtacgcccgcgagcggcacccggaactcgccggtctgctcacggacacggcggacagcaacaccccgatgatcgccatcaacgactcgctcggctaccgtcccacgcacacggcggtggagtaccagctggagctg

SEQ ID NO: 1216 - DNA, 771 bp, Streptomyces avermitilis
  CDS (1)..(771)
atggatcacgctgcggtactcgccctgttcgaccgggacatgcgggaaggggcgcggccggacgggcccggcgcccggatcgagcgtgtgcccggcgtggtgcggcaggtcgcctccgaacacggctggaacggcgtcgtctggtccggcctggacgaggcgagtgccgacgcggcgatcgccgagcagcagcgctacttcgccgggctcggccgcgagttcgagtggaagctgtacggccacgacctgccggaggacctcggccggcggctgcgggcggccggattcacggcggcgcccgaggagaccctgatggtcgccgaggtcgccgacctcaccctcgacgtcgaaccgcccgacggcgtacgcatcgtgcccgtgacggaccgggcgggcgtcgacctcgtggccgacgtccatgagaaggccttcggcaccgacagcacacggatgcggcaccaactgctcgcccaggtcacggacgatccggacgcggtcgtcgccgtcgtggccctggccggcgacgaaccggtgagcgcggcccggatggaactcgtccccggcacacgcttcgccggcctgtggggcggcggcacggtcgagggcgagcgcggccgcggcatctaccgggccctggtcgcccaccgcgccaaggtcgccgccgaccgtggctatcgctacgtccaggtcgacgccaccagccagagccgcccggtcctcgcccggctcggcttcgagcccctcaccaccacgacaccgtacgtctcgccg

SEQ ID NO: 1217 - DNA, 528 bp, Streptomyces avermitilis
  CDS (1)..(528)
atggtgttcggggtcgccacggtcgccgggatctggaccgtcggcgccctgatcgacgcgcacctgcgccggaccctgctgtgcgcgctcgctctgatcggggcgaccctgctcgccctcggccggtacgcggaccggccggccgtgctgctgatctcggtcgcgctgtggggcgcggcgttcggcggggcgccgacgctgatccagacggccctggtcgacgcctcggggcccgccgacgcggatgtggccacatcgctgcagaccaccgtgtacaacgcgggcatcgcgggcgggtcgctcacgggcggcctcgtgctggacggtgcgggggcgggggcgctgccctggaccgcgctgcccctggtcgcggccgcactcaccgtggtcgccctgggccgccggcggggcttcccggcgctgcgcccgtccgacgacgcgcgctcctcggggcaagggccgagccctgcccgtggctgcacaccccgctcggggaactcacggtcaccgcgaccgccgccggtgtcg

SEQ ID NO: 1218 - DNA, 849 bp, Streptomyces avermitilis
  CDS (1)..(849)
atgatgacctctccgggtcccgatgacctcgtcgtcacccaggcctcgctcgacgactggcccgtcgtcgtcgggtgggcggcggacgagggctggaatccggggctgtccgacgcccccagcttcttcgcccaggaccccgagggcttcttcgtcggccggatcgccggcgaaccggtctcggcgatctcggtcgtcaattacggcgccgactacgcctttctggggttctacctcgtacgccccgacctgcggggccgcggctacggcctgaccacctggaagacggcgctcgctcacgccggcgaccgcacggtcggcctggacggcgtgccggcgcagcaggacaactaccggcagtccggtttcgagctcgcccaccgcaccgcccggtacaccggaaccgttccggcggccgagccggcttcgggagtccgccccgccgaggcggccgacctggccgccgtcgcggcgtacgacagcgcctgctccccggccgaccgcccgcgctttctggaacactggctggccggccccggccaccgcaccttcgtccgcctcgtcgacggccgcctcaccggctacggcgtggttcgtccggccctcgactccctgcgggtcggccccctgttcgccgactccgccgaggacgcccgcgccctgttcacggcgctgaccgccgacgcgggcgagatcgccatggacatccccgagacgaacacggcggccgtggccctggcccgggaagcgggtctgacgccgtccttcgagacggcccgcatgtacaccggaccggtgcggccgttcgcggccgaccgcgtgtacgggatcacctcgctggaactcggc

SEQ ID NO: 1219 - DNA, 678 bp, Streptomyces avermitilis
  CDS (1)..(678)
atgaaacgggttacccggaatggattgatcgctgcggccgccgcctcgggcgccttggccgtggtcatgccggcgtacgccgactccgcggcggacggcagcgcggcgggctcgcccgggctcctctccggcaacaccatccagctgccggtgcacgtccccgtgaacgtgtgcgggaacaccgcgaacgtcgtcgggttcctcaacccggcagcgggcaacgcctgcgccaacgaggggcacggcagtccttcgggaggcgccgccgacgggggcgctgccgccccgggcgcgtccgcccagggaagcggaaaggattctccgggggtggtttcgggaaacagtgtgcagctcccggtccatctcccggtcaatgtcagcggcaacaccgtgaacgtggtcggcgtcggcaacgcggccgtcggcaacgagtccaccaacacatccggcgggcggccccaccacccccaccaccccgggcacgcccggccgaagcccgccgcgccgccgaaggcgcccgcgcccgcacggccggccctcccgaacacggccgcgcgacccggggcctccctggctcgaacgggcgcggacgagaccgtgcccgccgtcgccgcgagcgcggccctgctgctgggcggggcggtgctgtaccggcgcttccgggccggcgcgcggcgc

SEQ ID NO: 1220 - DNA, 1635 bp, Streptomyces avermitilis
  CDS (1)..(1635)
gtgcgggcgtacctggaggcgttcatgctgtccacgcacaggcgctgcgcggtcgccggcgcggtcgtcgcggccgcgtcgaccgcggcgctggccctgctgggggccggtctgccgtcggtcgtaccggccgccgacgaacccgatctgtcccgcttctacgcgcagaagatcacgtgggccgcctgcaagggcgacggcatgcccaaggacctccagtgcgggaaggtgaccgtgccgctcgactacgcgaggcccgacgccggcacgctcgacgtggcgctggcccgctaccgggcgacgggcaagtcccggggatccgtactgctgaacttcggcggtcccggcgcggcgggcatcggcgcactcgccggcgacggcaacgacttcatgggcctcaccaacggctacgacgtggtgacgttcgacccgcgcggggtcgggcagtcgtcccccgtcagctgtggcgaagggagcaccgaggccttcgccgagctggacgcgagcctcgacaccggcgatccgcaggccgccctcaagcagttgcggaaggtggccgacgagtgcgcgaagcactccggtcccgtgctgccgtacataggcacgatcaacgcctcgcgggacatggacgtgatgcgcgcggcgctcggcgacaagaagctcaactatctgggcttctcgtacggcacacggctgggcgcggtgtacgcggcccagttcccgaagaaggtcggccggatggcgctggacggcgtggacacgctcaccgagccgctggccgagcaggggctggtgagcgccgagggccagcagaccgcgctggacagcttcatcacctggtgcgtcaaggacatcgcctgccccttcggccaggattcgcgttcggcacggcagcaggtcgtgcggctcgtccagtcgctggaccaggaccccgtaccggcggacttcggccagcagctctcggggcaggatctggtgggcgccatcggacaggcgctctacagcaagcaaatgtggcccaccctggaaggggcactggccaatctcgtgcagaacggcgacgcgagcggggtcctgcgtctcgcgagcggcggcatggccatgccggatctgccccggacgggcgaccggccgtccggccggccgagccccgggccgagcggcgggctggtcgccccggcggacgtgcccgtcgacaacccgtcggccgcgctgatggccatcacctgcgcggacacccccgaccggcccaccgccgaacaggtcacccgggacatggacaagctgcgcgcggcctacgaggaggcgtcgcccgtcttcggccggtaccggctcaccgaggtgctgatctgctacggccgccccaagggcacggacttcatccgggacgaggtgcgtgccgtcgacaccccgaagatgctgctcgtcggcacgcgcggcgacccggcgaccccgtaccgctggaccctggagaccgccaagcgcctcggcgactctgcggtcgtcctcgacaacaagggcgagggccacaccgggtacgggtcctctcgctgcgcgagccagaagatcgacgcgttcctgctgtacggctccctgccggccaacggcagctcctgcggcccggaagcggaccgc

SEQ ID NO: 1221 - DNA, 1593 bp, Streptomyces avermitilis
  CDS (1)..(1593)
atgggtttcactcgtggtgtgcgccggttcctgttgctgctgttcgtcgccctcggcgcggccggggcgctggtcctgtcgtgcgccgtctcgtcgtggtggtggatcgccgcgggtctgctgctgccgctcaccgcgctcggggtgtgggacctggtgcagacccgccactcgctgctgcggaactacccgctgctcggacatctgcggttcttgacggagccgccgcggcccgagccgcggcggtacttcgccgaagggcaccacgaagggcgtccgtacggccgcgccgtgcgcagcatcgtccacgagcgggccgagggcgtcgccaccgaggaaccgttcggcacggaacgggatgtgtacgccgccgggtacgagttcctgatgccgtccctgcgcccggtggaaccgcccgaggatcccccggtggtgcgcgtcggcggcccggactgcacccagccgtacgacatggcgctgctgaacgtctccgcgatgagcttcgggtcgctgtcggcgaacgcgatcctggcgctcaacaagggggcggcgctgggtggtttcgcgaccgacaccggagagggcggtctgtcggagtaccacctgcgcggcgggggcgatctcatctgggagatcggcacggggtacttcggctgccggacctccgacggcggcttcgacgagcgggagttcgcggacaaggtggcgctgccggaggtcaagtgcgtgtcgctgaagctctcgcagggggcgaagcccggcaccggggcggtgctgcccggcgtcaaggtgagcgcggagatcgcgcgggcgcgtgctgtgccggtgggcgagaccgtggtctcgccgccgtgtcaccggatgttctcgacgccgcgcgaactcgtgctcttcctcgcccgcataagggagttggcacacggcaagccgaccggcgtcaagctgtgcgtgggctcgcgccggcagttcctcgcggtgtgcaaggccatgctggcggaggggatcactcccgacttcgtcgtggtcgacggcgcggagggcggcaccggggccgcgccgccggagttcgccggccggctgggcacccccctcaccgagggcctggtcaccgtgcacaacgcgctggccggcaccgggctgcgggaccgcgtccggatcggggcgagcggcaaggtcgccaccggtgcggacatcgtcaagcggctgctccagggcgcggactacacgaacgcggcccgcgccatgatgttcgcggtcggctgcgtccaggcccggcgctgccacaccaacacctgtccggtcggggtcacgacccaggatccacgccgggtccgcgcactcgacgtggccgacaagtccgagcgcgtccaccgcttccagcgggccacggtgcggagcgcggcccggatcatggccgcgatgggcgtacgtgacccggccggcctcgcgcccgggatgctgctgcggcgcacggactcgacgacggtcctgtcgtacgccgagttgtacgagtggctgccgccgggcgtactgctcgcccagccacccccgtcgtgggaagcggactggacggcggcggacccggattcgttc

SEQ ID NO: 1222 - DNA, 1095 bp, Streptomyces avermitilis
  CDS (1)..(1095)
atggagcatgccctcagtccctcatccctcgccgagctgcgccgcccgcggccctatcccgccgtgtccgtgctgacgccgacgcatcgccgcgagcccgacaacgcgcaggacccggtgcggctgcgcaatatgctcgccgacgccaagaagcagctggaggccgatcccgcgatcacccgcgagcggcgcaccgatgtgtccgcgcagctcgatctggcgctcgcggaggtcgatctcgcgcacgccgaggacggtctggccatcttcgcggcccccggtgaacaccaggtgtggtcgctggcgcgttccgtgccggagcgcgtggtgctgtcggacaccttcctgacccgcaatctcgtggccgcgcaggccgccgagcggccgttctgggtgctgtcggtctccgccgaccgggtgacgctgtggaacggcggcgcgggccgtgtcgccaaggaacgcaccgggggctttcccatggcccggagcctggaggccccgaacgccgagcgcaaggagcgcgtcggcgacctgcccagcaccttccgcgatgagcgcacccggcacttcctgcgcgacgccgacatcgcgatgagtgccgtcctgcgcgcacaccctcgcccgctgtacgtcaccggcgagcaggcggcgctctcgctgctcgacgagatcggctcggtcaccaaggatgccgcccacgtcccgcacggcggcctcgcccacgcgggccccgacgcggtgtgggcggcggtccggccgctgatcgacgccgaggaccggaagaacgtcgacacggtgatcagggacctcgaaacggcccgtggccgcaaagatttcgcggcgggcgtcgacgaggtctggcagaacgccggggacggccgcatccggctgctggccgtcgaggagaactaccgcgtgacggtccgcgacaacggcggcgaccatctggtaccggccgcgagcgatgacctcgacgcccgggaggacatcgtggacgagatcgtcgaacagtgcctggagacgggtgccgaggtgcgcttcgtccccgacggctccctcggggaggcccggggcatcgccggggtgctgcgctac

SEQ ID NO: 1223 - DNA, 1029 bp, Streptomyces avermitilis
  CDS (1)..(1029)
gtgagtcagcttctcggcgttgcggtactgggtgcggggcacatgggggccgaccatatacgtcgtctcgacagcgtggtgagcggggccagggtcgcggccgtggcagatccggcgaaggagcgggccgaggaggccgtggccggcctcgacggcgtcttggtgcacaccgaggtggcggccgctctcgacgcgccgggcgtcgaggcggtgctgatcgcctcacccggacccgcgcacgaggaggcgctgctcgcggccttcgcacgcgggctcccggtgctctgcgagaagccgatggtgccggactcggcgggcgcgctacggatcgtggaggcggaggcacggctcgggcggcggctcgcccaggtcgggttcatgcgccggtacgacgccgagtacatggggctcaagtcgctgctggacagcggaaggctgggccgcccgctgatgctgcactgcacgcaccgcaatgtgtcgtccccgcccggcttcacctccgccatgctgatcaacagctccgtgtcgcacgagatcgacgcggcgcgctggctgctgggccaggaactcaccgcggtcaccgtgctgcgtccgcggccgtccgcgcatgccccggaaggtctgctggatccgcagttcgtgctgttcgagaccgccggaggcgccctggtggacgtggagatcctcgtcaactccggcttcggctaccaggtgcgctgcgaggcggtctgcgaggccgggagcgtgcggatcggggacgcgcacacgatggtggtgaccagcgcgggcggcgcgtaccaggaagtggcccaggactacctcgtacggttcgcggacgcgtacgaccgcgaggtgcgggagtgggtggacgccacccgccggggccaggtcaccgggccgagcgcctgggacggctacgcggcctccgtcgtcgccgaggcgggggtgcgggcacaggacaccggcgaccggatgaccgtcgaactcgccccgcgtccggatctgtacggccagaacccgatcagccgc

SEQ ID NO: 1224 - DNA, 1467 bp, Streptomyces avermitilis
  CDS (1)..(1467)
atgccgtcccatctctctgcggatcgccccgccgcccagccgcccccgcgcggcacggtcgacgcgctcatctcgcagacgcggcgactgcgcggcgacgtggacgccgtacgacgtgacgcgcccgcggacggcacggacccgcaaggccgctggcagcgcgcactgtgcgatctggcggtacatcaactcaacgatctggacgcgcacttggcgcagttgcgggacggaccacagcccgcgccggccgccccctccaccgccggccccgccgagcgagccgtgcccaccgccccccggagcggctccctgctcagccgcgtcggctccgccgagtggaacctgctgacggacgaggcgacatggtccggcgagctgtatcagatcctcggccgtgatccggccgctcccccgctcaccctcgacgaactgccgtccttcgtgcacgacgaggaccggccgaggctgacggcgatggtcaccgactgcctgatcgacgcgaagccgatagacggggagttccgcatcgtgcgccccgacggcggcgtgcgcaccgtgcacatgatgggcgagcccgtcctcgacgcccacggcagcaccgcctcgatgtgggccgtgctgcgggacgtcagcgaactgcaccgcagccagcggacggtgagcgagacccatgactcgctgcaacaccaacggcacctcgcgcagaccgagcaccggctcgccgtcgagctacaggagtccgtactgccgccatggcgcgcctccctgcggctcccgcaccagggccccgaaacgctggacctggccgcccactatctcccctcgtcgtcgagcgcgctgatcggcggcaactggtacgacgcgctcgaactgcccgacacccagatgctgttgagcgtcggcgacctcaccgggcacggggtcgccgtgacctcgggcatggcgatgctgctcggcaccctgcgcggcctggccatggcgggtacccagccgggtcagctcatgcaatggctcaacggactgctcgacgcctccgtccagcccgccctgggcagcgccgtctgctgccgctatcaacccgagacgcgcgtactcacctgggcacaggcaggccaccccgccccgctgctgttccgcaacgggacggggcgcctgctggcagcaccggacggcgtgctgctcggagcgacctcgggtgccgcctacgggcaggccgaggagaccctccaagcgggcgacctgctgctcctgcacaccgacgggctggtcccgcggcgatgggcggacccccgctcgagcgaagccgagagtgggggaggaacggcggccgtccaaaggctgctcgacctggccccgcgcttcgacggggtccgcacggcccagcactgcgtacggacggtggtggaagagttcggcgagacggagcgcgaggacgacgcctgcgtgctcgtcgccagggtcgtctcc

SEQ ID NO: 1225 - DNA, 1494 bp, Streptomyces avermitilis
  CDS (1)..(1494)
gtgagcggacaacccaacactcgtctctcggacctgttcggcctggccggctggtccaagggcgaactcgcgaggctggtcaaccggcaggcggcggccatgggccacccccagctggcgaccgacacctctcgggtgcggcggtggatcgacacgggagagattccgcgcgatccggtgccgcgagtgctggcggccctgttcaccgagcgtctcggccgtgtcgtgaccatcgaggacctcggtctggcccggcacgggcgtatggggagacggcagagcgacgggagtgtggaacatcccgacgggatgccgtgggcgcccgaccgtacggctgcggtcctcaccgaattcacgggaatggacctcatgctcaaccgacgcggcttggtgggcgcgggcgtcgcgctcaccacaggatccgcactcagcagcgccatgcacgactggttgcacaccgatccgaccctcgcggcggacgctcccgaactcgacgatcccctgcacgccgaccctgctgggttcgaccgctacgaggctgcccccatcgggtcgcaggagatcgaggaactggagcgttcggtcgaggtgttccgggcctgggacgcggcccgcggtggcgggctgcagcgcaaggctgtggtgggacagctcaacgaagtgggaggcatgctctcctaccggcacccggaccatcttcagcggcgcctgtggggcgtcgccgccaacctggccgttctcgcgggttggatgtcgcacgacgtcggcctggagcccacggcccagaagtacttcgtcatcgccgcccacgcggcccgtgagggaggcgaccggccccgtgccggggaggcgctctcccgtgccgcccgtcagatggtgcacctcggccggcccggtgaggcactcgacctgatgaagctcgccaagtccggctcgggtgacgaggtactgccccgcacccaggccatgctctacaccatcgaggcctgggcacaggcggccatgggcaaggggcaggccatgcggcgcaccctcggcgaggcggaggacctgttcgtctccgaccggggcgacgtgccgccgccgagctggatgcagatgttcgacgaggcggatctgcacgggatgcaggccctggcctatcgcaccctcgccgagcacgagccgggagcggcgatcatggcgcagcgccacgccaaggaggcgctgcacctgagggagtcgggccgggaccggtcgaagatcttcgaccacatctccctcgcgtccgcctgcttcatcgccgacgatccggaacaggcggaccggtacgcacggctggccctgacgtcgatggggtcgaactcctcccagcgcacctgggaccggctgcgcgagatgtaccggctcaccgcggagtactccagctacccgaagatccaggatctgcgtgaggagatcaaactctccctccccaagaactcgtcgaagttcaggggcggcagcgcacgggcg

SEQ ID NO: 1226 - DNA, 1140 bp, Streptomyces avermitilis
  CDS (1)..(1140)
atgtacacagcatcgtcctccgtgtccgcaccgccccggtcgctccacccccgccagccgggcagcagcggcccctacctcgaccccgcgcgacccgcggcgcccctgctcggtgccggtcggtcgcggcgcgttccggggctcggcacccaaccgctcagcgggagaatcgacttgtccggcccccagggcgcccagctgcgcacggcgatcgcgtcggtgcaccggatctgtccggagttcactccggtgcaggtactgcgccgcagcgggcgctccgtactcctcgtcggcacgacggggcgcagcacggccgtcgccaagtgtttacttgaccactcccccatctgggcggagcggatccggcacgaaatagctgcataccgctcgttcgtccggcaccgcccgcccgtgcgggtgccccggctgatcgcggcggacccggacaactgcacgctggtgatcgagcggatgccgggccgggtggccgcgctccagcggcatccggcggaggccccgccccgcgccgacatccgggcggccctgggcgcgctctgccgggtgaacgcgtggcggccgccggcggggacgttcgacgccccgctgaactacgcggagcggatctcccgcttccatgagctgggtcttctcacggaccgggacatgggggatctgcagaagctgatgcacggcatcgcccactcggcgggccggcagggcatgggccagttctgccacggtgacgctctcctgtcgaacatcctcctctcaccggccggtccagtgctggtggactgggagcacgcgggctggtatctgccggggtacgacctggcgacgctgtgggcggtcctcggtgacgccccggtggcgcggcgccagatcagtcagctcgcacagtccgcggggcccgcggcacgcgacgccttcctggtgaacctgatgctcgtactgacccgagagatccgtacctacgagacggccgtgcagcgttcgatgcacgacgtgaccccggcggcaccgggccaggcccacccggctgctgcgccgtccggcgaggaacagcggctgctgctgcggcggctgcacgacgactgtcagatggcccggcgggccgttcgagcggcagtcggcactcgc

SEQ ID NO: 1227 - DNA, 1977 bp, Streptomyces avermitilis
  CDS (1)..(1977)
ttgcgaggatccgccaccgacccccggtccaccgtcggtcacagacgcgcgcgcggagcggcgggtgccgtcgcctcggcggcgctgctgctgccgctgctcggcgcggctccgtccccgggcgccgccccggactcctccgccgagctccagcgggcgttcgccacggcgtccgccgaccaccaggtaccgcagagcgtgctgctcggtgtctcctacctccagtcccgctgggacacgcacgccggcgcgccgagcgtctcgggcggctacggcccgatgcatctcacggacgcccgcagcgcgatcgccggggccccgcaccacagcgcgggcacggaggacgcccgcggtgacgaggcgcgtacggccctgctgcccaccaccgaggtgccggagaactcccagctccccgcccgcctcaagacgttgccgaaggcagccgagctgaccgggatcccggccgagcggctgcgtacggacgccgccgccaacatcgaggggggtgccgccctgctcgccgccgcgcagaagaagctcggcgagcccctcagcggtgacgcggccgactggtacggggcggtggccgtgttctcgggcgcggacgacaccgccacggcggccgcgtacgcccgtgatgtgtacgacgtgatccgcgagggtgcgcggcgcaccacggacgccggtcagagcgtgacgctggccgccgagcccgggtcggctcccgacaccgcgcagctcgggcgcgccgggctgcgttccgtctccgccgatggcacggaatgccccaagtccctggcctgcgagtggattccggcaccgtacgaagagttcggcgacaacgactacggcaatcacgacctgggcgaccggccggcctcgcagagcatcaggtacctcgtcatccacgacacggaaggccgctgggacggtgtcatcaacctcgtccaggaccccacctatgtgtcgtggaactacacgctgcgctccacggacgggcacgtcgcccagcatgtgaaggcgaaggacgtggcctggcacgcgggcaactggtacatcaacgccaagtcgatcggtctggagcacgagggcttcctcgcctcgccggacgcctggtacacggaggcgatgtaccggtcgtcggcgcggctggtgaagtacctggccaggaagtacggcattccgctggaccggcagcacgtcctcggtcacgacaacgtgccgggcccgaccaccgcgacgattccgggcatgcacacggaccctggcccgtactgggactggcggcactacttccggctgctcggcaggcccttccacgccacggcgggccggggcggcgggctggtgacggtcctgccggacttcaccgccaaccagccggtctacaccggctgcgtcaccgcgggcctgccctgcgcgtcccacggctccagcgaggtacgtctgtacagcggccccgacgagaccgcgcccctgatcaaggacatcggtctgcggcccaagggcgacgattcgacgatcgatgtgaacgacgtgggttcgcgggtctccaccgggcagcggtacgcggtcgccgaccgtgcgggggactggacggcgatctggtacctgggccagaaggcctggttcaagaacccgaagaagcagccgacggcggtgaacgcgtcggggctcgtggtcacgccaagggcgggactcacggacatccccgtgtacggccgcgcctacccggagaaggaggcctatccggccggtgtgcccgcgcagtcggtctcaccgctgccgtacaaactgctcgagggccagaagtacgcgatcggggacgaggtgccgggcgagtactactacgcggtcaccttcgacacgccctcgcacaaggtcgtgaccggcacggaccgctactacgagatccagttcggccaccgggtggcgttcgtgcgggcggccgatgtgcaggtcgtttcgtcgaggtcg

SEQ ID NO: 1228 - DNA, 495 bp, Streptomyces avermitilis
  CDS (1)..(495)
atgtccttcctccgccgccgcagcgccactcccgccggtcctgacttcgacgtactggccatggacccgggcgactggccgggcaatctcggcgcgggcctgctgcccgcccccgacggcagctgccagggcgtcttcctgcgctacgacctgttcggcggccgcggccccgcgatgatcatcggcaatctgccggagggctccccggcccgcgacgtcgccgagtcggaggtccccttcgaggtggcccagctgctgatcgcgctggagaacgaggaggaggtgaccgtcgtcgggaccgaggacatgccggtgatgcagggggacaacctcctgatcgtccgccgcctcaagctctccgagggccggatctcctgtgtgcagttcgaccgcagcgacaaggtcctggtgaccatcgccgcctgggaccgcccgatcacggacgacctgtacgcactgctgaagcccctgcccgcggagctcttccagcagggc

SEQ ID NO: 1229 - DNA, 258 bp, Streptomyces avermitilis
  CDS (1)..(258)
gtggtgggcgaccgggtcgccgggccgagcgcgcgcgacgcgtcccggccggcggtgatgcgctccagggccggctgcccgaagccgcagggccggctgcccgagccggtgatgccgcagaccgcatcgcatcgcatcggtggtgaacagcgcgccgagccggtccggattcccggcgtcggacaagttcccatgcggggcgaacagttcggcgatcgccgtgggtcgtcgaagccgggcgccaggagaatcctgctg

SEQ ID NO: 1230 - DNA, 240 bp, Streptomyces avermitilis
  CDS (1)..(240)
gtggccgagagcaccatcaaggagcatccactcgcgggctgggacaagccggaactggacctcagcaaggccgagtggcaatccagcagccgaggacggggagacgtccagatcgcctttgtcgaggggttcatcgccatgcgcaacagcggccgccccgagagcccctctctgatcttcacacccgcggaatggggcgcgttcgtctcgggggcccgcgaaggggagttcgacctgacg

SEQ ID NO: 1231 - DNA, 1164 bp, Streptomyces avermitilis
  CDS (1)..(1164)
atgagcaaggagcccgtggccgtcgtgggcatcggccagaccaggcacgtggccgcccggcgggacgtctcgatcgcgggccttgtccgagaggcggcccaacgggcccttttggacgccgagttgacatgggccgacatcgacgccgtggtcatcggcaaggcgcccgacttcttcgagggcgtcatgatgcccgagctgtacctcgccgacgcgctcggcgcggtgggcaagcccatgctgcgggtgcacacggccggctcggtcggcggctccaccgccctcgtcgccacgaacctgatcgcgggccgcgtccacggcaccgtcctgaccctggcctacgagaagcagtccgagtccaacgccatgtggggcctgtccctgccgatccccttccagcagcccctgctcgccggggcgggcggcttcttcgcaccgcacgtacgcgcgtacatgcggcgcagcggcgcccccgacaccgtgggctccctggtcgcgtacaaggaccgccgcaacgcactgaagaatccgtacgcgcacctccatgaacacgacatcaccctggagaaggtccaggcgtccccgatgctgtgggacccgatccgctactcggagacctgcccgtcctccgacggcgcctgcgcgatgatcctcaccgaccgtgcgggcgcggcccgttcgccgcggccgcccgcgtggctgcacggcggcgcgatgcgcagcgagccgaccctcttcgccggcaaggacgcggtctcaccgcaggccggcaaggactgcgcggccgacgtctaccggcaggcggggatcacggacccgcgccgggagatcgacgccgtggagatgtacgtgccgttctcctggtacgagcccatgtggctggagaacctcggcttcgccgacgagggcgagggctggaagctcaccgagtccggggtgacggaactcgacggggacctgcccgtcaacatgtcgggcggggtcctctccaccaatccgatcggcgcctccggcatgatccgcttcgcggaagcagcgcttcaggtgcgcggccaggccggagaacaccaggtggaaggggctcgcagggtgctcgggcacgcgtacggcggcgggtcgcagttcttctcgatgtggctggtcggggcggagcccccggtcttg

SEQ ID NO: 1232 - DNA, 1047 bp, Streptomyces avermitilis
  CDS (1)..(1047)
gtgacgcgcgagatcgccgtagtcgccttcgggcagaccgaccaccggcgcaccagcgacgagctctccgaggtggagatgctcatcccggtcctgcacgacgtcctcggccaggccggcctgaagaccggcgacatcggcttcacctgctcgggctccacggactacctcgcgggccgcgccttctccttcaccatggcgctcgacggggtgggcgcctggccgccgatctccgagtcacatgtggagatggacggggcgtgggcgctgtacgaggcgtggacgaagctgctgaccggcgacgccgacaccgcgctcgtgtacgcgtacgggaagtcgtcacccggctctgtacgcgacgtcctgacccggcagctcgacccgtactacgtggcgccgctgtggccggactccgtggccctggccgcccttcaggcgcaggcgctcatcgacgcggggcacgccgacgagcccgcactggccggtgtcgcggcccgcagccgtgcgtcggccgccaccaactcccatgcgcagctgagcggttcggtgccgcagggggactatgtcgtacgtcccctgcgtaccggcgactgcccgcccgtcggcgacggagccgccgccgtcgtcctcgcggcgggggatcgggcgcgccggctgtgcgcgcggcccgcctggatccggggcatcgaccaccgtatcgaggcacacgccctcggtgtccgtgacctgaccgactcgccctccacccgcctggccgccgagaaggcgggcgtcttcgaacgccccgtcgacaccgccgagctgtacgcgcccttcacctcccaggaggtggtcctgcgcagggcgctgcggctcgacgaccgcgtgaccgtcaacccgtccgggggcgcactggccgccaacccgatcatggcggccggactgatccgcatcggcgaggccgccgcccgcatccaccgcggcgagtccgaccgcgcgctcgcccacgcgacctcgggtccctgcctgcaacagaacctggtcgccctactcgaaggagacccgcga

SEQ ID NO: 1233 - DNA, 918 bp, Streptomyces avermitilis
  CDS (1)..(918)
gtggagttccccttcacccgctcactcggccccgtccagagcgccttcctcaccggtctgcgcgagcgcgtgctcctcggcgtgaagaccggcgacgggcgcacactcgtcccacccgtcgagtacgaccccgtcaccgccgaggagatccacgacctcgtcgaagtcgcccccaccggcaccgtcaccacctgggcctggaaccacgccccgcgccgcggccagcccctcgacacccccttcgcctgggtcctggtcaggctcgacggcgccgacacggccctcctccacgccctcgacgccgccggccccgacgccgtacacagcggcctgcgcgtccgcgtccgctgggccgcgcaacgctccggagccatcacggacatcgcctgcttcgaaccgtacgactccggcgacgacgcggcggccgaacccaccggccacgacggccggttcgccgacccggtgaccggcatcgtcgccccggcccgtctcgactacgtctactcacccggccgcgcgcagtccgcccacctcgacgccctcgccgaacagcggaccgtcggtgaacgctgcccctcctgccgcaaggtctacgtcccgcccaggggggcctgccccacctgcggtgtcgccacatccgaagcggtcgaagtgggcccgcgcggcacggtcaccacgtactgcatcgtcaacatcaaagcgaagaacctcgacatcgaagtgccgtacgtctacgcgcacatcgcactggacggcgcggacctcgcgctgcacggccgcatcggcggcatcccctacgaccaggtgcgcatgggtctgcgcgtcgagccggtatggacggacggcgggcgtcaccccgaccactaccggcccaccggcgaacccgacgcggactacgagacgtacaaggagctgctg

SEQ ID NO: 1234 - DNA, 774 bp, Streptomyces avermitilis
  CDS (1)..(774)
gtgcggcgcgagggcgccacactggtgctcacgctcaacaggcccgaggccaggaacgcgctctcgctgccgatgctggtcggcctgtacgacggctgggtcgaggccgacgaggacgacgcggtccgctcggtcgtgctcaccggcgcgggcggtgccttctgcgccgggatggacctcaaggccctggccggccaggggatggaagggcagcagtaccgggaccggctccaggccgaccccgatctgcactggaaggcgatgctgcgccaccaccgtccccgcaaacccgtgatcgccgccgtcgagggcccctgtgtcgcgggcggcaccgagatcctccagggcaccgacatccgggtcgccggcgagtccgcgaccttcgggctgttcgaggtcaggagggggctgttcccgatcggaggctccacggtccgcctccagcgccagatcccgcggacccatgccctggagatgctgctgaccggacgcccgtacccggcgcgggaggcggccggcatcgggctcgtcggccatgtcgtccccgacgggaccgccctcgccgcggccctggagatcgccgggcggatcaacgcctgcggaccgctcgccgtcgaggccgtcaaggcctccgtgtacgagaccgcggagatgaccgagaccgacggactcgcggccgagctgaagcgcggctggccggtcttcgacaccgccgacgccaaggaaggcgcccgcgccttcgccgagaagcgcccgcccgtgtacaggcgcacc

SEQ ID NO: 1235 - DNA, 1752 bp, Streptomyces avermitilis
  CDS (1)..(1752)
gtgcgggaccagtacaagagttttctgacagacagtcagatttcttgtcccggggcccttcccagttgcgtcggcctttgctctgatgaccgtcgagccgatggatgccaggcgtgcccggggtcaggaggagcggtggagtacaaccttgccgacctgttcgagtcggtcgtcgacgtggtccccgaccgcgaggccctcgtgtacctcgaccaccccggcacgggcgcggagcgccgtctcggctacgcggagctggacgcggcggccaaccgcgtcgcgcaccatctgatcgacagcgggattcgccccggcgagcacctcgggctccacctctacaacggcgtcgagtacctgcagacggtcctcggctgcctgaaggcccggatcgtcccggtcaacgtcaactaccgctatgtagaggaggagttggtctacctctaccgggacgcggatctggtggcgctggtcttcgacgcggagttcaccgagcgggtggcggcggcgctgccgcagacggagaagctgcggcacctggtgcgggtggggaccccgacatccggcgccggtccgctgcccgtggtggagttcgccgacgccgaggcggccgggtctccagggcgcgggttcccggcccgctcggcggacgaccagttcatcatctacaccggcgggacgaccgggatgcccaagggggtgatgtggcggcaggaggatctgttcttctcgggtctgggcgggggcgctccgacgggcgagccggtgaagacgcctgaggaactggccgagcgggtggcggcgggcggggagggcatcaccttcttccccgctcccccgctgatgcacggcacctcgacgctgacggccttcatcggcttcaacttcggccagcgggtcgtcatccaccgcaagttcgtgccggaggaagtcctgcggacgatagagaaggagcgggtcaccagcatgtcgctggtcggcgacgccatgctgcggccgctgatcgacgcgctgagcgggcccatgaaggggaccgactgctcctccatgttcagtgtgtcgtcgtccggggcgatcatgtcggagaccgtgcgcgcccagttccaggcgctcgtgccgaacgtgatgctgctgaacaacttcggctcgtcggaatccggcttcaacggcacggcgacccctgactcgggcccggaccgcggcttccggatccgggtcaactcccgtacccaggtggtggatccggccacgcacgagcccgtcgcggtgggcgagcccggccgcatcgcacagcgcggccatgtgcccctcggctactacaacgacccgaagaagaccgccgagacgttcttccgcaagggtgacgagcggtgggtgctgctcggcgacatggcgaccgtcgacgaggcgggcgtcgtcaccgtcctcggccgtggctcccagtgcatcaacacgggtggggagaaggtgtatccggaggaggtcgagcaggcgctcaagtcgcatccggacgtgtacgacgtcctggtggccggggtgccggacaccacgtggggcagtcatgtcgcggcggtggtgcagctgcgcgagggcgcgggacggccgtccctggaggagatccagacccactgccgcacccgtctggcgggctacaagatcccccggcaactggtcatcactagcaccatccaacgctcgccgagcggcaaggcggactaccgctgggcacggtcggtggcggcggaggccgaccgc

SEQ ID NO: 1236 - DNA, 771 bp, Streptomyces avermitilis
  CDS (1)..(771)
gtggcacatctcagcgatccgcatctgacgaccgggctgctcgccgtggaccgagtcgccgccttctcccgggccctgcgctgcgtcctggccctcgacccgcgacccgcctgcgtggtcgtcaccggtgatctggtcgaccggggcgaggccgaggagtacgaggtgctgcgcgaggtcatcgcgcgcttcccgctcccggtgcacctcgtgccgggcaaccacgacgatcccggcaccctgctggaagccttcggcggcggccctcatacgggcggcgcccgtgcgttcccgtacgccgtggagtatccgaacgccaccgtggtggtcctgagctccacggtccccggggctccctcgggccggctcggcgacgagcagctcgaccggctggaggagctcctgtccaggcgcccggaggtgcccgccttcgtgtgtctgcaccatccgccggtcgacatcggcatcccgtacctggacggcatgaacctggcggacgccgacgcgttcggcgaagtgatcggacggcatccgcaggtcgtacgcgtactggcgggccatgtgcaccgggcggtcaccggggagttcgcgggcagcacgatggtcaccgcgcccagcacctacttgcagagcaatctgaacctgcgcgtcggcggaccggtgggatacgtcgacgaaccgacggcgttcctgctgcaccacctcaccggcacggggtgcgtgacacacaccgctcaggtcagccacgcgggcgggctcatcggggggtac

SEQ ID NO: 1237 - DNA, 1050 bp, Streptomyces avermitilis
  CDS (1)..(1050)
atggaccccctctcatcttccgatccggcccggctcgcgagcgagcagcgcaggctgcgactgcaggttctcggcctcaataccgtcgaggcggaggccacgttcgaccgcatcgcgcgactcgcggccagcttcacccagtctccgttggccatggtcaacttcatcaacgacgaacggcagatgttccgcggcatgtacgtgccgtccggttcgcccgacgacaaggtgagcccggagagcggaggcatcgccttcgatctgagcaacctctcccgggaagcgcccggcgactacggattctgcccccatgtggtggcccagggttcccaactggctctggacgacgtcttcgactacccgcgcttcaagggcaacccgctggtgaacgacctgggcgtgcgttcctacctcggcaccccgctgcgggacaacacaggcatgatcctcggcaccgtgtgcgtcgccgacatgaagccccgcacctgggaccgcggtcttcgcgagggcatgcaggagctcaccgagaccctgctgtccgacttcaagctgcgtgacagcctgctcgcccagcagcaggagctgttcgccgtcttcgacggtgcgccgttcccgatcatgctcaccgagggccccgaccatctgctgcgctacgccaatggcaagcagggctcggccttcggcctggtcccgcagttcagccccgggcggcacgtcctgcccggcctcgaggcgataggcgtcttcggcgcgatggacgacgccttccacacgggacaggcggccacgctggcccgggcgtcgatccagacgtacgactcccacaccctccaggacttcaacttcctgtgcacaccggtgcgcacgtccccggccgccccgatcagcggtgtgctcacggtggccatgaacaccaccgggcaggacttcgcgggatccgagcagcgggccttcgcggccaatgtccaggagcggttcgagcggctgggcgcgggtggcctgccgggagggatgcccgggcagcgcgcggagagcgccgggtaccgcggc

SEQ ID NO: 1238 - DNA, 2004 bp, Streptomyces avermitilis
  CDS (1)..(2004)
atgcggcaaggtcaactgcgccatcgcgtacggacagtggcgaaggatcgaaagggattgctcatgaacaggtcggacgtggacgcacggtcggtggctgtgatcggcatggcctgccggctccccggcgcgtcggggaccgacgaactgtgggccctgctgcgggacggcgtggacgccaccagcgagacccctcctgaacgttacgacgtggacgccctgcactccgtcgcccccggaccgggaggcatcgccagccgcagagcgggctatgtcggccaagtcgcggatttcgatgccgagttcttcgggatgtccgccaacgaggcggtggaactcgacccgcagcagcggctgttgctgatgaccgcctgggaggccctggaggacgcgggccggcggcccgacctgctggcgggcacccggaccggcgtgttcgtcggcaatgcccgcgcggactacctggaactcgccctgcggcagggcccggaggcggccacggcctcccagctgaacaacttccggtcgctgttgccggcccgcctgtcgcacttcttcgacttccgcggacccagcatcgtcgtggacacggcctgctcctcctcgctggtggccgtgcaccaggccgtacagagcctgcgcgccggagagagtcccctggcgctggccgccggggtgaacatcacgctccgcccggacgagggcctcgtgatgacgcaggccgacgccatggctgccgacggccgaagcaagttcggcgacgcgcacgccgacgggcacgcccccagtgacgcggtggccgtcgtcgtactgaagcgcctggcggacgccctggccgacggcgaccgcatacgcgccgtcatccagggcagcgccgtcggcaacgacggccgtaccagcgacaccgtcctcaatccgtcgctgaccggccagctcgaggtgctgcgatgggcgtacgaggacgcgggggtgaaccccgccgatgtcgactacgtcgaggcgcacggctccggatcgcccgccctcgacccgctggaactgggcgccctgggcagggtgctgggcgagggccggcccgccgaccggccgctgctcgtcggctcggtcaagacgaacatcgggcacgcggaggcagcaggcggactggccggactgatcaagacggtgctctgcctggagcacggccagatcccggccagcctccacctcgacaccccgaacccccaggtcgcctgggacgaactgccgctggtggtaccgggcaaactgctcgacctccccgagctggaccggccggccgtcgccggggtctgcgggcagggctcctcggccctcaacgcccatgtggtgatccggcaggccgaccccgcctggtccgcgtccgcgccgccgggccgggccaagccgtacgtcctcgcgctctccgcgcgcagcgccgcggccctggaggcgctggcccggtcgtacgccgaccatctgggcccggacggcgcgggcaccgcgtacgcgctgcgcgacatctgcttcagcgcggccacccggcgtcagcaccatgagcaccggctggccgtcatcggttcgacgcacgcggagatcgcggcggcgctcaccggatcgccggggctgggcggcaggccgctgtcggccgtcgccgagcgctaccgcaggggcgaggacgtggactgggggaaggtgttcgggcgctccggccgcttcgtgccgctgccccactacccctggcagaccaagcgctactggcccggcgaggagcacgcgcaggacggcggcgatctggcgtcctgggtcctgcgcgagcacgcccgcaccggcttcgacgacggctccacgctcaccgagatcgggatcgactccctggcgaaactgcggatcgtcgtcgaactgaccaagcggtccagccaggacgtcgacccggaggagttcggccggctgcgcaccgtcggcgaactccgccggtggacgcggtccctggaggcagcggcccga

SEQ ID NO: 1239 - DNA, 1545 bp, Streptomyces avermitilis
  CDS (1)..(1545)
atgagcgatccgcagaacctgtacgcctggttcgcccgctcggcggccgcgtacggcgacgagtgcaccgcgctggagatcggcgacgaccggctctcctacggtgcgctgcgtgacctggcggagcggctcgccggccgtctggtcgcggcggccggcggcaccccgccgcgccgggtcggcctgctggcgagccgttcggtgaccgcgtacgccggttatctcgccgtgctgcgggccggtgcgaccgtcgtgccgctcaaccccgagcacccgtccgcgcgcacccgcgacatcgtcgaagcggcggggctcgagctggtgctggccgacgccccggcggccggcgcggacctcggcgtgcccgtcctcgtggcgggccccgaggaactggcggccctcgcggccctcgtggacgagccggtgcccgaactgccggacgcgcggaccggtcctgacgacatcgcgtacatcatcttcacgtccggttcgaccggcgcgcccaagggcgtaccgatcctgcaccgcaacatctgcgcctatctcggtcaggttgccccgcgctacgacatcgagcccggcagccgcctctcccagtccttcgagctgaccttcgacggctccgtgcacgacctgttcgtcgcctgggcgggcgggggaacgctcgtggtgccgatgcgcagccagctgctgtcaccggtgaagacgatcaacagcctgcggctgacgcactggttctccgtgccgtcgctgatctccttcgcctcgcgcctcggcacgctcgagccgggcagcctgccgacactgcggtggagcatcttcggcggcgagccgctgaccctggcggcggcccgggagtggcgggcggccgcgccggacagccgcctcgaagtcctctacgggccgacggaactcaccatctcgtgcaccgcgtaccggttccccgacgatcttgcggactggccgaagacgcccaacggcacggctccgatcggcacgtgctacccgttcctggatctgctgctgctcgacgcggacgaccggccgagcgacagcggcgaactgtacgtacgcggcccgctgaggttccccggctatctggacccggcgaacaacgcgggacgcttcctgacgtccgctcagcaccccgccaccgaggaaccactgaccgaccgccactggtaccgcaccggagaccgcgtcgccatgcgggacgggcacctggtccatctcggacggaccgaccaccaggtcaagatccgcggccaccggatcgaactcggcgagatcgaggcgatgctgcggcagcagcccggcgtccgggacgcgatcgtcctcgcggtgccggcctccgacggcgagccggagctggaggccgcggtcagcggcaccggctgcgtccccgaccggctctactcggcactgggcgaccggctgccgccgtacatgctgccccgccggatcgccgtcctcgaccagctgccgctcaaccccaacgggaagatcgaccgacgggccctgctcgccgaactgggacgctcccgc

SEQ ID NO: 1240 - DNA, 1182 bp, Streptomyces avermitilis
  CDS (1)..(1182)
atgttcgacgccatcgtggtaggcgcgcgctgcgccggagcgtccaccgccatgctgctcgcccgctcggggtaccgggtactcctgctggaccggtcggcggccggctccgacaccctctccacccatctcgtccaccagccgggcgtcgcggctctcgcccgttgggggctcctggagaacgtacgggcctcggggtgcccgccgctggaccgggcggtctacgaggtggccgacatccacctcgaaggctgcgccaggggtgtggaggggcagcgtgcctcgtacgctccccggcgccatgtcctggacgccatcctggtcgacgcggccgtcgcggcgggcgtcgagttccgcgaccgctgccaggtcaccggcctgctgcgggacggcaccgggcgcgtcgtcggcgtggagggcagacacggcggccgctccttcaccgagcgggcccggctggtgatcggcgcggacggcatgcgctccaccgtcgcccggctggtcgaggcgccgtacaccgtgacggatccacggctgacctgcgcgtactacacgtactggccggacgtgccggccaccctggaactgtacgagcgcaccgggagctgggtggccgccgtggccaccaacgacgcggcgaccctcgttctcgcctacttcccgcaggtccgcttcgaggaggtccgcaccgacgcgcgcggcgcctatctggagcagatacgcaccaccgcgccggccctgcacgagcggctgcggggcaaggagcccgccgagcggctgcgcggtacgggtgaccagcagaacttcttccggcaggcgacgggacccggctgggtgcttgtcggcgactccggacaccacaaggactccatcaccgcgcgcgggatcagcgacgcgttcctccaggtcgacaccctcgtccggcacgtggacggtccgctcggcggcgacccggtccgactcgacgcggcgctggagaagttcgccgaggaacgcgacagcgcgctcaccccgggttacgaatccacgctggcggtcgcccggctggcgccgcacgagcagcgcctctccctgctgcgggccgtgcagacggatccggaactcaccgcgatctacttcgacatggtcgccgggatcggctccgcgggtgccctctacacacccaagctgcttgccctgctc

SEQ ID NO: 1241 - DNA, 2664 bp, Streptomyces avermitilis
  CDS (1)..(2664)
gtgcccgcggtctgtctcaccggactctggggatacacggcggccggactcgtcgacgagcaactccaactgcactccgacgcggatcgggcctcctccgtcgcccggccggcccaggacgtgctgtcccggctgcagaccgagcgccggctgaccgcggtctggcaggcgagccgcacgaagaccgcccgtacggagctggacggcgcccgcgacgagaccgacgccgccgtcgccgcgttccggcgcagttcctcctccgcgctggacacctcctcgctccagcggcggaccaggctgttcgacgaggctctcgacaccctttccggccgccgcgaggcgatcgacggccgcaccctcagtacgggcgacacgttcgagttgtacaccgacaccgtgtcccgcggtatcggcgtcctcaccgcggccgtacacagcgacgacggccggctcgcgcggggcggcaacgcgacggtgtccctggcccacatcacggagatgctctcgcgcgaggacgcgctcatctccggcgcgctgccgtcccgtcggatgaccgccacgacccgcgcccagttcggccagtatctggcgatccagcgcgagttccgcgcgggcctggacatccacgacctccctgccggtgcggccgccacctacacgcagctcacggacagcgccaagtggaccaccctgggcacggtcgagaagtccgtgaccaccggccggggcacggggctgcccggtcaggcctcgtcctggccgacggccaccgagcccgtcgtcggcggcctgcagtcgctgggcgcggactccgcggacggtctgtccgacctggccgccgaccacgccgacgacctgctgctcggcatgctcctgggcacggccgcgacgctggccgccctggccggcggtgcggtactggccctgcgcgcccggcgctcgacgctcggccgggtctccgagctccaggcgcacgtcgagcagctgtccggcagctggctgccccagcttctggcccgaatacagaacggcgagcgggtcgagccggccacgctcgccccgcacggagagcaggcgaccgacgagctggagcggctggccgcggccatcgaccagctgggccgggtggccggggacaccgccgtacggcagagcctgggccgcgagggcacggagaaggtcttcgcccagctcattcgccgtacgcagatcctgatccaccggctgatctcgctccttgacgacctcgagcgcaagcacgaggactcggacctgctcaaggacatcttcaaggtcgaccatctcgcgacccgggtgcggcggcacgcggagaacctggtgattctcagcggctccccgcccagccgccggctgaccgctcccgtctcgatcaccgacgtgatgcgcggcgcggtcgcggagacggagcagtacaccagggtcaaggtgaagaacctccccgcggaccggcgcctcgccctggccggccgggccgtcgcggacgtcacccatctgctcgccgaactgatcgagaacggcacgagcttctcgccaccggacacccaggtgttcgtcagcgccacgaaggtcgccaagggcctggccgtgcacgtcgaggaccacggcctcggcatgccgcaggacctgcgcgaccacgcgaacgacctgctcgcccacccgccgcggctggacatgacggccctgggcgaggacccgcggctcgggcacttcgtggtggcccggctggccgaacggcacaagatcaaggtggagctgcgcgagtccgtctacggcggcaccctcgtgatcgtgctcctgccggccgccctgctcgaagaggtggcctcgccggttctcgaccagctcaagtcggccgccgtcgctgccaacagggcagtcgcggccgaggcctcccgggcggtcgcggggacggacgacttcgctgtcgtgggcgccgagggcatgccgctcgtgggctcggccatcggatcggccggccacagcctcgacgcgggcgtcacgatcggcggcgtcgacgcgctcacgcacacgcgccttccggaccacagcggcttccccgagtacggaggtgcgggcctcttgccggccgcctcggaccaccccgccccggctcccggacccaacgcctcctgggcaccgccccgggagcaccccgcgccccagggccaccgcaccgagccgggcggcctcggaccacaggccgggcagcccgcacaccccggagcacatgccggacaccacggatcgcgggccggattcaccgagccgcagagcggtttcaccgagccgcggtccgggccaccgtcccggcacgaacccggtgccggaagcgggggtcccgcccccgcccgggaggaggcgcccgcacgcagtgcggcgcgcccgctgaccaccccgcaggtcctgccgcaacggaccaggggagccagcctggcgcagcaactgcgcagggaggcggagcaggcacagggccgacccgacggtgagggagacaagggcgtcatctccccggacgcgtcggcccgcgcgatgatcgcaattcagcaggggctgaagcgggcccggatgtccgagaccgacgagccgaccggtgcggacggccggcagcagacggatccgagggaccccggtgcccatcaactg

SEQ ID NO: 1242 - DNA, 447 bp, Streptomyces avermitilis
  CDS (1)..(447)
gtgaggaaacgttacgtaatgactgagcaggtacaatccggtccccggctggactggctcctcgacggactggtggaccggataccggagatccgctgtgccatcgtgctgtccggggacggccttctcatcggcaagtcgaagaacctgcgccgcgacgacgccgagcacctgtccgcggtcggttcgggcatgcacagcctcgcccggggcgccgcgcgccacttccacggcggggaggtgcagcagacggtcatccagatggaccgggcgttcctcttcgtcaccgccgcgggccggggtgcgcggctggccgccatcgcctcggagcaggtggacgtggggatgatggccttcgagatgggcacgctcgtcaagcaggtgggccagtacctgagtgccgcaccgcgcgtggagaccccctccgccggacacattcaggatgcc

SEQ ID NO: 1243 - DNA, 372 bp, Streptomyces avermitilis
  CDS (1)..(372)
atgcctgaaccccgatggctcgacgatgcggaggccgggcgtcacttacggccgtacgccatcacgggcgggcgcacccgccacagtcagcacaccttcacattgatcacgctggttgtcgcgcggtccgcgcatgagttcgatcacgaccatctggagccggagtcggtccagatcctcgaactctgccgggatcgcgcggtggcggtcgccgagatcgccgcgcacctggacctgccggtgagcgtggtgaagatcctctgcggagatctgctcaacgcctccctcgtcatcgtccaggcgccgcccgggcaggaggaccaaccgagcgtggaactcatcgaaagggtgatggatggtatccgtcagctc

SEQ ID NO: 1244 - DNA, 597 bp, Streptomyces avermitilis
  CDS (1)..(597)
atggtatccgtcagctctgagcccgtcatgccgacggcgctcaagattctgatcgcgggcggattcggcgtgggcaagacgaccatggtgggctcggtcagcgaggtgcccccgctggagaccgaggagcggatgaccgcggtgagcctcggcgtcgacgatctgtccggagtcgagggcaagaagtcgacgacggtcgccatggacttcggccggatcaccatcgcgccggagctggtgctgtacctgttcggtacgcccggccaggaccgcttctggttcatgtgggacgacctggcgaccggtgccctcgcggccatcgtcctcgcggacacccgtcggctggacgcctcgttcgcgtcgatcgacttcttcgaggcgcgtgacatcccgttcgccgtgggggtcaactgcttcgacggccggcgggactgctcggccgagcaggtgcggacggcgctggatctggatccgtcgacgccggtgctgctgtgcgacgtacgcgaccgtggttccagcaagtcggtgctgctcgccgtgttggaggcggcgcgtgcgcaggcggccgcgcgtctcgctccgctgggcggcggtcaa

SEQ ID NO: 1245 - DNA, 834 bp, Streptomyces avermitilis
  CDS (1)..(834)
atgccgaacttcagcgcccccgacgggaccgaactcgcctatcacacgcggggggagggagaaccgctcgtcgtgctgccgggcggggcgatgcgggcctccgcctatctcggggacctgggcggactcggtgcccggcgccggctcgtgctgctcgacctgcgcggaaccggggactccgcggagccggcggacccggcgacgtaccggtgtgaccgtctcgtcgacgacgtcgaggcgctgcgggtccatctgggcctcgagcgcatggatgtgctggcgcactcggcgggcggcaacctcgccatgctctacgcggcccggtacccggagcggatcgcacggctggcgctgatcaccgccaccccgtgggccgtcgggatgggcgtgcggggcgaggaccggctggcggcggcccggctgaggaagggagagccctggttcgaggcggccttcccggccttcgaggcgtggctggcggagagcggcgactgggaccctgtcttcgagcccttcttctacgggcgttgggacgacgccgcccgcgcccacgccgccggtggcgaggagcagaccaacgacgaggcgggggaccggtacggctcggcgggtgcctacgacccgcccgctacccgggccgcgctcgccggactcaccgcgcccgtcctcgtgtacgcgggcgaactcgacggcggcccccgccccgagctcgcccggcgggtcgccgacgtcttcccggccgccgagttcgcggtgcagccgggcggcggccactacccgtggctggacgaccccgggtggttcaccgcccgggtcgaggcgttcctcgcccgg

SEQ ID NO: 1246 - DNA, 1293 bp, Streptomyces avermitilis
  CDS (1)..(1293)
atggcggatgcgcgggacctgctggacgagggagaacggctcgacccggacgggctgcggacgctgcaactggagcggctgcgcgcctcgctgcggcatgcgtacgcgcacgtgcccttctaccgggagtccttcgacaaggcgggcgtacgtcccgacgactgccgcacgctcgacgatctcgcccgcttcccgttcaccgtgaaggcggaccttcgggagaactatccgtacgggatgttcgccgtgccccaggaccggatccggcgcatccacgcgtccagtggcacgaccggccgccccacggtcgtcggctacacggagaacgacctctccatgtggtcggacatggtggcccgctcgatccgggcggcgggcggccgacccggcgacaaggtgcatgtggcctacgggtacggcctgttcaccggcggactcggcgcgcactacggcgccgaacgcctcggctgtacggtcatccccgcgtccggcggtatgacggcacgccaggtccagctgatccaggacctgaaacccgagatcatcatggtgaccccttcgtacatgctgacgctcctcgacgagttcgagcgccagggcgtcgacccgcgcggcacctccctgcgcgtcggaatcttcggggccgagccctggaccgaggagatgcggcgggagatcgaggagcgcttcgcgatcgacgccgtcgacatatacgggctgtccgaggtgatcgggcccggtgtggcgcaggagtgcgtggagaccaaggacgggctgcatgtgtgggaggaccacttctttcccgaggtggtcgacccgatcaccggggaggtgctgcccgacggtgcggagggtgagctggtcttcacctcgctcaccaaggaggccatgcccgtgatccggtaccggacacgggacctgacccggctgctgcccggtacggcccgggtcttccggcggatggagaagatcaccggccgcagtgacgacatggtcatcctgcggggcgtcaatctcttccccacccagatcgaggagatcgtgctgcgtacgccgggcgtggcaccgcacttccagctgcgtctcacccgggaaggccgcctcgactcgctcaccgtacgggcggaggcccgggccggtgccacgcccgagcagcgcgacgcggccgcgggcgtcatcgccgcggccgtgaaggacggcatcggcgtctcggtcgcggtcgagatcgtcgaaccggagtcgctggagcggtcggtgggcaagatcaggcggatcgtggacctgcgacctcgg

SEQ ID NO: 1247 - DNA, 1497 bp, Streptomyces avermitilis
  CDS (1)..(1497)
atgacggcgggaccaagcgtcacggtcgacggggtgctgcggcgcagcgcccggcggaccccggcacgcagggcgatccactaccgcgaccgttcctggacctacgcggaactcgacgaggccgtctcccgtgccgcccgcgccctgcgcgagacgggactcgcccccggcgaccgggtcggcgcctacggccacaactcggacgcgtatctgatcggcttcctggcctgcgcccgcgcggggctggtgcatgtgccggtcaatcagaacctgaccggcgacgatctggcgtacatcgtcgaccagtccggtgccacgctggtgctcacggacccggacctcgccgggaatctggccgacggggtccggaccctggcactgcgcgacgcggacgactccctgctcacccggctcgccacgacggctcagtacgacggtgcggagccgcgcggcgaggacctggcgcagttgctctacacctcgggcaccaccgcgcttcccaagggcgcgatgatgacgcaccgtgcgctggtccaggagtacctgagcgcgatcgccgccctcgatctgagcgcgggcgaccggcccgtgcactcgctgccgctctaccactcggcgcagatgcatgtgttcctgctgccgtatctcgcggtcggcgccgagaacgtcatcctcgacgcacccgacgccgagcagatcttcgacctcgtcgaagcgggccgcgcggacagcctcttcgccccgcccaccgtgtggatcggcctgtcgaaccgccccgacttcgcgacccgcgacctgagcgggctgcgcaaggcgtactacggggcgtcgatcatgccggtgcccgtactggagcggctgaaggaacggctgcccgagctggcgttctacaactgtttcgggcagagcgagatcggcccgctgtccatggtcctcggacccgacgagcacaagaggcggatggactcctgcgggcgccccgtgctgttcgtcgaggcgcgggtcgtcgacgagtccggcaaggaggtggccgacggggagcagggagaaatcgtctaccgctcgtcgcagttgtgcgagggctactgggacaagccggaagagacggccgaggccttccgggacggctggttccgctcaggggacctcgccgtgcgggacgcggccgggtacttcaccgtcgtcgaccgggtgaaggacgtcatcaactccggtggcgtactggtcgcttcgcggcaggtcgaggacgcgctgtacacacatgagggggtcgcggaggccgctgtcatcgggctgcccgacgaacggtggatcgaggcggtcaccgcggtcgtcgtcgcgcgcggcgaggtcaccgaggccgaactcctcgcccacgcacgcgagaagctcgcccacttcaaggcgcccaagcgggtgctgttcgtggacgagctgccgcgcaacgcgagcgggaagatcctcaagcgggagttgcgggaccggttcgcggaggcg

SEQ ID NO: 1248 - DNA, 1548 bp, Streptomyces avermitilis
  CDS (1)..(1548)
gtgagcgtgccccccaacggcttctggtcccaggccgccgcggacccggagcgtacggtcctgatcgcccccgacggcgaggagtggaccgccggacgactgcacgcttcggtcaaccggctggtgcacggactgcgcgccgcgggcctcgaacgcggcgacgccttcgcggtcgtcctgcccaacggtgtcgagttcttcaccgcgtatctggccgcgtcccaggccggcctctacctcgtccccgtcaaccaccatctcgtcggccccgagatcgcctggatcgtcgccgactccggcgccaaggtgctcatcgcgcacgagcggttcgcggactccgcgcgccacgccgccgacgaggcgaaactgccagcagagcagaggtacgcggtcggcgcgatcgacggcttccggccgtacgccgaactcctcgacggacagcccgggtcggcgcccgccgaccgcacccttggctgggtcatgaactacacctcgggcaccacgggccggccgcgcggcatccggcgaccgctgcccggcaagctgcccgaggagacatacctcggcggcttcctcgggatcttcggcatcaagccgttcgagggcaatgtgcacctggtctgctcgccgctgtaccacacggcggtgctccagttcgcgggcgcgtccctgcacatcgggcaccgtctggtcctgatggacaaatggacgcccgaggagatgctccgcctcatcgacacccacaggtgcacgcacacacacatggtcccgacccagttccaccgcctgctggcactccccgaggaggtgaaggggcgttacgacgtctcgtcgatgcggcacgccatccacggcgccgcgccctgccccgaccatgtgaagcgggcgatgatcacgtggtggggcgacagtgtggaggagtactacgccgccagtgagggcggcggcgccttcgccaccgccgaggactggctgaagaagcccggcacggtcggcaaggcctggcccatcagcgaactcgcgatcttcgacgacgaaggcaaccggctgccggcgggtgaactcggcaccgtctacatgaagatgagcaccggcggattctcgtaccacaaggacgaggccaagacgaagaagaaccgcatcggcgacttcttcaccgtcggcgacctgggctgtctcgacgaggagggctatctcttcctccgcgaccgcaagatcgacatgatcatctccggcggggtcaacatctacccggcggagatcgaggcggcgctgctcgcccaccccgccgtcgccgacgcggccgccttcggcatcccgcacgacgactggggcgaggaggtcaaggcggtggtggagcctgccccggggcacgacccgggcccggcgctcgccgccgacatcctcggccactgcgaacagcggctcgccgggtacaagcgccccaagagcgtcgacttcatcgagacgatgccgcgcgaccccaacgggaagctgtacaagcggcggctgcgggatccgtactgggagggacgcacccgaaaggtg

SEQ ID NO: 1249 - DNA, 1107 bp, Streptomyces avermitilis
  CDS (1)..(1107)
atgcagacggagctgagcaagagactgggagtcgagcacgccatcttcggcttcacgccgtttcccgccgtcgccgcggccatcagccgggccggcggtttcggtgtgctcggcgcggtccgctacaccgcaccggacgacctcaagcgcgacctcgactggctcgaggcgaacgtcgacggaaaaccgtacggcctggatgtcgtcatgcccgccaagaaggtggagggcgtcacggaggccgacgtcgaggcgatgatccccgaggggcaccggcagtacgtcagggacaccctggccaagtacggcgtgccggagctggcggagggcgaggtgtccggctggcgcatcaccgggtggatggagcgggtggcccgcacccagctcgacgtcgccttcgactacccgatcaagctgctcgccaacgcgctcggctcgccgccgggtgacgtcgtcgagcgcgcccacggccagggcgtgctcgtcgcggcgctcgcgggcagcgcccggcacgcccgcaagcacgccgaggcgggcatcgacgtcgtcgtcgcccagggctacgaggccggcggccacaccggcgacatcgcctccatggtgctcacccccgaagtcgtcgacgccgtcgacccgttgcccgtcctggccgcgggcggcatcggcagcgggcgacaggtggccgccgcgctgagcctgggcgcccagggcgtgtggctgggctccctctggctgaccacgacagaggccgaactcccctcgcccgcgctgatccggaaactgctcgccgccggctccggcgacaccgtccgctcccgagccctgaccggcaagccggcccggcagctgcgcaccgagtggaccgacgcctgggacgacccgaacgggcccggcacgctccccatgcccctccagggactgctggtcgccgaggcggtctcccgcatccagaagtacgaggtcgagccgctgctcggcacgcccgtcgggcagatcgtcggacgcatgaacagcgagcgcagcgtccaggccgtcttcgacgacctgacacggggcttcgagcgggccgtcgaccgcgtcaaccgcatcgccggaaggagtcagcag

SEQ ID NO: 1250 - DNA, 1845 bp, Streptomyces avermitilis
  CDS (1)..(1845)
atgaccgaagacacggcggacagcgggacgggcgggcgtggacccacccgccgtcacctggtcagacgtgcgctggccctgggcggcgccctggccgtcgcccctttcccggccggccccgcgaaggccgttccaccgcctcgccacccccaccgcaccctgcggcacggctcccccgaacgcgccggactgctcccggaccacctccgcggactcgtcaccgacgccgagtccttcctcggcccctcccccacgcacccctggtacgccggtgccgtgctgctcgcggggcggggcgacacggtggccctgcatcagcccatcggcacggcggtgcgctactcggcgtacgacgcgaagaccgacacgggcgtcgagttcccggccgagcggcagatcccgatggccacggacaccgtcttcgacctcgcctcggtgtcgaagctgttcacctcgctgctcgccgtgcagcaactggagcgcggcgcgctggagctggaggccagggtcgcctcgtacctcccggacttcgccggcgcgggcaagcaggacgtcaccatccgtcaactcctcacccacacctcgggtttccgcgcctggctgcctctctacaaggcaccgagccgcgcggagaagctgcgcctcatctggaacgaggcaccgctcagcccgccgggcaccaagtacctctactcggatctgaacctgatctcgctccagctcgtcctggaagagatcaccggtcaccctttggacgccctgctccgcgacgagatcaccgctccgctcggcctgcgcagcacccgctacaacccgcccgccgcctggaaaccgaggatcgcggcgacggaggacgcacgcccgccgtggtccgggctcgaccgcggactcgtctggggcgaggtgcacgacgagaacgccttcggcttcggcggagtggcaggccacgcgggtgtcttctcctgcgcatgggacctcgcggtcctcggccggaccctgctcaacggcggcacgtacgggcacacccgcatcctggcgccggagtcggtggagctgctgttcaccgacttcaacaccgccttccccggcgacgagcacgggctcggcttcgagctctaccagcactggtacatgggcgcgatggccaccccgcgcaccgccgggcacaccggcttcaccggcacctcgctcgtcctcgacccgacgacggactccttcctgatcgtgctgggcaactccgttcatcccgtgcgcacttggcgatccggctccgctccccgggcggccgcggggaaccatctggcgcgagccgtccaggtccggcccgcgcgcggacgtacgtcctggttctcgggcatggcgaccgcggcctccgcgacgctgacactgcccgagctcgacacggccggtaccgcggataccgccgaaaccaccggcaccgccgacagcaccaccgccgacagcggggggcggcttcgctgcgccctgtggtgggacaccgaaccccggtcggacaccctcttcctggaggcctcggccgacgacggcgcgagctggcagccggtgccgttcacgaccgcgtgtgacggggaggaggcgcgggagcaccccacgggctcggtcaccggctggtcggggcgggtgtggcaccggctccacgcggacctgccgcgggcgcgccggctgacgctgcggtggcggtacacgaccgaccggttgtacgtgggccggggcgcgtacgtcgacgcggtgcgggtcgagtccggcggccgggtcctcttcgacgaggcacgtccgacggacgcggcgcgcatcgaggcggcaggctggacgccgtccgagaac

SEQ ID NO: 1251 - DNA, 510 bp, Streptomyces avermitilis
  CDS (1)..(510)
ttgtccatttttgttgtgccgaccggggatgtgccgcaaatggcccaccgtgacggtcacgaaccgtcgttcacgccgtggaggcggaccggggtgaccgggctgctggaggatgactccgggcgcgtcaccggcgtccggtacgtcgacgagcacggctcgccgggcgagctggccgccgacctcaccgtcgcctgcgacggacgcgactcgtcggtccgccgggcggccggactcgagccctcgtacttcgaagtccccatggacgtctggcaggtgcgcgtccccgcccgtgatccgctcaaggagggccgggtctcgctgaccgtccgggacggccagttcgccgccacgctggaccgcggcgactactaccagacgtcctatctcatcaagaagggcacggacggcgcactccgccccatggcatcgagtggttccgcgaccggctcggcgagctgctcggctgggaccgtacggcgacggacgccatccgctcctgggacgacg

SEQ ID NO: 1252 - DNA, 633 bp, Streptomyces avermitilis
  CDS (1)..(633)
gtggcgatgagttcgcgtcgcggggaccgcacccccaccttcaccgagcaggcccgccgcaggcagatcatcgagtgcaccatcgacctgatctccacgcagggctatccggcgacctcgctctcggccatcgcggaggcggccggactctcgaaggccgcgatcctttaccacttctcgtccaaggacaacctgaccaaggcgacgttcgcgtacgtgctggagcagttccgggcgttcgtcaccgagcgtgtcctcgtggcgtccgacccgcgggccgccgtggtcgcgtacgtccgggcgatggtcggctaccagcaggccaaccgccgccatgtgcgcgtgatcaccgagatgctcctcggcgacgggggcgggacgcggttgaaggagcccggcggccatgacacgggcggccgctgggaagagctcgcggccttgctgacgacgggacagaaggccggtgacttccgggagttcgacgcccaggtcacgtctttggccatcggcggcgcgatcgatggggtggtcgcgcactggctctcccaccccgaactcgacctggacgcggcggcggacgagctggagacgttcacactgaacgccatcgagtgccgcaccccacgacgacgc

SEQ ID NO: 1253 - DNA, 1599 bp, Streptomyces avermitilis
  CDS (1)..(1599)
gtgctaccaagaaccatggctgctgatgagggacacgtacccggtcgattcgacgccgtgatcgtcggcgggggccacaacgggctggtcgccgccgcctacctggcccgcgccgggcggtccgtgctggtcctggagcggctggggaacaccgggggcgccgcggtgtccacgcggcccttcgccggcgtagacgcccggctgtcgcgctactcgtacctggtcagcctgttgccccggaagatcgtgcgggacctcgggctcgacttccgggtgcggggccgcacggtgtcctcgtacacgcccgccgagcggcacgggcggcccaccggactgctcgtcggcggcggcgagcgccgcacccgtgaggccttcggccggctgaccggctccgcgcgcgagtacgagtcctggcagcgcttctacggcatgacgggccgtgtcgcccggcaggtgttccccacgctcaccgagcccctgccctcgcgcgacgagctgcgccgacgcgtcgacgacgaggacgcgtggcgcgtgctgttcgaggagccgatcggtgccgccatcgaggagaacttcaccgacgacctggtccgcggggtcgtcctcaccgacgcgctcatcggcaccttcgccgacgcccacgacccctccctgcggcagaaccgctgcttcctctaccacatcatcggcggtgggaccggcgcctgggacgtgcccgtcggcggcatgggcgcgctcaccgacgcgctggccgccgccgcccgggacgccggcgcggtgctcgccaccgggcacgaggcggtccgcatcgagaccgacggacgctcggccgaggtcacctaccgcgacgcggacggggaagggaccgtctccgcccgccacgtcctcgtcaacgccgcaccgcaggagctggcccgcctcaccggcgacagcccgcccgtcccagccgagggtgcccagctcaaggtgaacatgctgctcaagcggctgcccgcactgcgcgacaccgccgtcgacccgcgcgaggcgttcgccggcaccttccacatcgccgagggctatgagcagctcgcggctgcccacgcccaggccgccgccgggtcgttgcccgaggcgccgccctccgagatctactgccactcgctcaccgacccgaccatcctcggcccggacctggtcgaacagggctaccagaccctcaccctcttcggtctgcacacgcccgcgcggctgttcgaacgcgacaacgagggcgtacgggaggagctgctgaagtcgactctcgcgcagctggacgcccacctcgccgaaccgctcgtggactgtctggcgaccgacgcggaggggcgcccctgtatcgaggccaagtctccgctggacctcgagcgcgatctgcggctgcccggcggcaacatcttccaccgcgacctcgccttcccctacgcacaggagggcacgggccgctggggcgtggagaccgcgcacgcgaatgtactgctgtgcggggcgggcgccgtgcgcggcggcggggtgagcggggtgccggggcacaacgcggcgatggccgccctggaagacgtcggggagcgtgcgctggga

SEQ ID NO: 1254 - DNA, 2262 bp, Streptomyces avermitilis
  CDS (1)..(2262)
atggcggacaccaggctggtccagggccggtaccggctgctcgacctgatcgggcgcggtggcatgggcgaggtgtggcgggcgagagacgagtcgctgggccgtcaggtcgccgtgaagtgcctcaagcctctcagcacgcaccacgaccagtccttcacgcgcgtcctgcgggagcggtttcggcgcgaggcccgggtggccgccgccctccagcaccgcggggtgaccgtcgtccacgacttcggcgagtccgacggggtgctgtttctggtgatggaactgctggagggccgcaacctcagccagctcctggaggacaacaagcaccatccgctgccggtcgccgatgtcgtcgagatcgccgagcaggtcgccgccgccctcgcgtacacccatcaacagggcatcgtccaccgtgatctgaagcccgccaacatcatgcggctcgccgacggcaccgtgaagatctgcgacttcggcatcgcccgcctcggccacgacatcggcttcaccgcacgcctcaccggcaccggcatcgcgatgggcacaccgcactacatgtcgccggagcagatcagtggctccccggtcgaccagcgcagcgacctctattcgttcggctgcgtgctgtacgagatcgccaccggggcgccgccgttcgacctcgacgacgcctgggcgatcctcatcgggcaccgcgacaccccgcccgatccgccgcgcggccaccgtcccgaactgcccgcgtacttcgagaagatcatcctcgacctgctcgccaagctgcccgacgagcgtccgcacgacgcccgcgagctggcccgccgcatcggcgccggacgcggcacgcccgcctatgtgccgaccgtggtgacgtcgtccccgctgccggacctgtcggcgcccccggccccgtcgcgcccggagcggcggctgtcccgcgagccccggctgccctcctggacccgcgggatgaccaccggccacaaggccaccggaaccggcctcggcgccgccccgccggacgccggcgcgggcctcaccggcgaatgggtcgcccgccccgacacgggccgcgccccggcacccgtacgcagtgaacgccccaccccctcacccgagttggtgagcaccctcaccgggcgccacaacgcggggctgagccttgggcggctcggccgctgggcggaggcgggggaggtgcaccgtgccgtcgccgccgagcgcgaacacgccctcggccccgaccaccccgacacactcgccagccgctacgaggtcggcttcacgctcagccgcaccggccgccccgccgacgcgctgcgcgagtacgcgcacgtggcccaggccagggagcgggtgctcggcgccgaccaccccgagacgctggccgcccggcaggaaatggcctacgtactgggccagttggggcagcacttcgacgcgcaccaggtgtacacgtcggtgctcgccgcccgtgagcgcaccatgggccccgaccacccggacaccctgcgctgccgccacaacctcgccttcaacctgagccggctcggtcgcctggaggactcgtaccgcatggcccgcgaagtggccgccgcccgggcccgggtgctcggcgcgacccaccccgacacactggtcacccggtacgaagtcgcctacgcgctcggccagttgggccgctggcccgaggccctggcggcgtatcaggaggtcgccgaggcccgcgcgcaggccctcggccccgaccacgcggacacgctcgccgcccgctacgaggtcggtatcagcctcggccggctgggccgcagcgccgaggccctgaagctctaccgcgacctcgtcgaggaccgtacccgcgtccacggccccgcccatcccgagaccctgcgcgcccgccacggcctcggcgtcaacctcggccggctcggccgctgggaggaggcgctcgccgagtcccgtgacgtgtgcgccctccgcgagcgggtgctgggcgccgatcacccggacacgctcgtcagccgccgcgaggtcgccgtcggcctcggctggctcggccgctggtccgacgccctcaccgagtaccgacacgtcgccacggcccgcgaacacgtcctcggccccgaccaccccgacaccctcgccagccgcaacgacgaggcccactgtctggaacagctgggccgggggcaggaggcggtggagctgtaccggcgagtggcggcgttacggcagcggcgcgcgtcgggcggccac

SEQ ID NO: 1255 - DNA, 855 bp, Streptomyces avermitilis
  CDS (1)..(855)
gtggaggcctctcacgcaggtgacccggggctcttcggcccgtcctcggtggcctggcagatgcacggcgaccccatgatgtgggtcgccggaatccgcgcgctctacctccaggccctgcacccgcgagtggtgcgcggggtcctgcagaactccgacttccggcgcgacgcctggggccggctgatgcgcaccgccgacttcgtcggcacgacgacctacggcagcaccgaggccgccgagcgggccggggcccgggtgcggaagatccacagcatgctggcggcgaaggaccccggcacgggggagcggtacggggtcgacgagccggacctgctgctctgggtgcactgcgccgagatcgactcctatctgcacgtcctgcgccgctcgggggtcccgctgaccgacgcgcaggccgaccgctacatcgccgaacaccgggtcaccgcacgcctggtggggctcgacccgggcggcgtaccgggggaccgggccgggctcgccgcgtacttcgagaaggtgcggccggaactgaccgccggtccggaggcgcgagaggtggacgacttcctgcagagcccgcccatccacccgttgctcatcccggcgcgcgccctgctgtggcggcgcgtggctcatctggcgtacgccgctctgccgccgtacgcccatgagctgtacggccgaccggggccgccgcccgccacggtgacccggcgcctgcgttgcaccggcaccttgctgcgctgtgttcccgcacgtctgcgctggcaactcccgcccaaacacattatccgggccatgtcacggctcggccccggctcgcgcccggcaccgtacaaactcggcgca

SEQ ID NO: 1256 - DNA, 1176 bp, Streptomyces avermitilis
  CDS (1)..(1176)
gtgcatctcgaatacacgcccgagcagcagcggttgcgcaccgaactgcgcggctacttcgccgatctggtgccgggaaacgcctatgcccgctacaccgacccggccgcgcagaaacgcttctaccgcgacaccgtccgccggctcggcagggacggctggctcggcgtgggctggcccaaggagtacggcgggcgcggactgacgcccatcgagcagttcatcttcttcgacgaggcggcccaggcgggcgtgcccctgcccctgatggcactcaacaccgtcggcccgacgatcatgcggttcggcacggacgagcagaaggcgtacttcctgccgaagatcctctccggcgagatcgacttcgcgatcggctacagcgagccggacgcgggcacggacctggccgcactgaagacgaaggccgtcagggacggcgacgagtacctcgtcaacggccagaagatctggacgacgaacggcgacacggccgactgggtgtggctcgccgtccgcacggatcccgacgccccgccgcacaagggcatcaccatgctgctcgtgccgacctccgaccccggctactcctgcaccctcatcaccaccctcgcctcgcacgacaccaccgcgagctactacgaggacatccgcgtccccgtctcccgccgggtcggcgaggagaacaagggctggcggctgataaccaaccagctcaaccacgagcgcgtcaccctcgccgcgcacggcacgatggcgatccgggccctgcgcgacgtacagcgctgggcgatggagaccaagctcgcggacggccgccgggtcgtcgacctcccctgggtgcgccgcgatctcgcgcggacccacaccaggctcgacgcgatgaagctcctcaactggcagatggtgaacgccgtccaggaaggcacgctcaccccccaggacgcctcggccgtcaaggtctacggctccgaggcccgccgggacgcgtacgcctggctgatggagatcgtcgccgcggccggcgctctcaaggagggctcggcgggcgcggtgctccacggtgaactggaacgcggctaccgttcggcggtcatcttcaccttcggcggcggcaacaacgagatccagcgcgagatcatctcgtggatcggtctggggatgccgcgcgtgcggcgt

SEQ ID NO: 1257 - DNA, 456 bp, Streptomyces avermitilis
  CDS (1)..(456)
gtgacttcgacgacctctcgcaggaccgcccgcgcggcctcccgcattccctcccggacgacccccgggacaccccctgatccattccccgacggggcctctccacaggaactcttccggttcctggaggaccgcttcacctgcgcgcaggcctgcaccgaatgtgcgcgggcgtgcgccctgcgggcgagcttcgccggtccggacggaccggaggggcaggaactcgtgcgccgcaagggcatcatgtgcgcggaagtgtgcgacgcgacctgccgggtgctgtccgagcaggcccggcaggacgaggaaaccctgcgcatccaactggagtggtgccggaccgtctgcctcgagtgcgcgcacgtcttcgacgaccaccccggagcggagaacagcgcgaaggcctgccgtgaatgcgcccaggcctgtgcggacttcatggcgaccctcgtc

SEQ ID NO: 1258 - DNA, 399 bp, Streptomyces avermitilis
  CDS (1)..(399)
atgcatcccttccgcaaggcggtcgaggccggcgaccacgccgcgatcgaggcgttgctggccgaggacgtcgtcttcaccagccccgtcgccttcaagccctacccgggaaaggcgatcaccgcggccatcctgcggggcgtcagccgcgtcttcaccgacttccgctacgtccgcgagatcgccggcgccgagggccgcgaccatgcgctcgtcttcgaggcgaaagtgggcgacaagacgatcaccggctgcgacttcctgcacttcgacgaggacggcaggatcgacgacttcatgatcatggtccgcccgctgacggcggccgtggccctgtccgaggcgatgggcgcccagttcgaccgcatcgcacgcgaggcggcacagggcgcgggcgcg

SEQ ID NO: 1259 - DNA, 564 bp, Streptomyces avermitilis
  CDS (1)..(564)
atggcattgcgcaacgcggtcctcgccgccctcctggagggcgaggcatcgggatacgacctggcgaagagcttcgacgcgtcggtggccaacttctggatggcgaccccgcagcagctgtaccgggagctggaccgcatggagtccgacgggctgatcgaggcccggctggtgcggcaggaacggcgcccgaacaagcggctgttctccctgacggcagcgggccgggcggcgctgcgcgacttcacggccacgccgtcgaggccgaccgcgatccgggacgagttgctggtcaaggtccactccgtcgacgacggcgacaccgaggccgtacgggcggcgatcgccgagcgcctggagtgggcgcgcgcgaaactggcccgctacgaccgcatccgcacccgtctgctggacggccgcggtgaggaggagttcctggccgacgccgagcgcgtgggcccgtacctcaccctcctgcgcggccgcgctttcgaacgggagaacatcgagtgggcggagcgggccctgcgggtcctcgaacaacgccccgcgcacaggtcgcgc

SEQ ID NO: 1260 - DNA, 624 bp, Streptomyces avermitilis
  CDS (1)..(624)
gtggggcgtcgtatcacccaacgacgcgaagagctcggtctgacccgggaggaaacggccggccgggccggtacggacccgggctacctccagtacctggaagaacaggccaccgccctgccgagcaccaacgtcctcatccggctcgccgacgccctggagaccaccgtggtggccctgcggggcggcgacgcggaccttccaccgggcgtgggccgggcggccgcccatcccgagctgctcgagctgagcgacgaggagtgccgggcacggttgtcgacgcacggggtcggcaggctcgcggtggacactcccaccggccccgtcatcgtccccctgaactacagcgtcgtcgacggggtcgtctgcttcaggacagcggccgacagcgagccggcggcgtccgcgggctcccgggtcgccttcgaggtcgaccacatcgacgaggcgctcagccagggctggagcgtgctcgtacgcggcctcgcccggctggtgacggaccccgacaccctgcgccggctggcggaactggcgtacagcggcccgtgggccggcggtgagcgcgacacctgggtgtgcgtcgatcccgtcggcgtcaccggccggcggatcgtggtccgc

SEQ ID NO: 1261 - DNA, 1068 bp, Streptomyces avermitilis
  CDS (1)..(1068)
atgaaagcactcgttttccacggatccggagagtcagtctgggaggacgtggcggaccccggtatccaggacgccggcgacgcgatcgtccgtgtcgacaccgtcaccatctgcgggacggacctgcacattctcaagggggatctcccggaggtacgccccggcaccgtgctcggtcacgaggccgtcggtgagatcgtcgaaacgggcggcgacgtacgcacggtccgccccggcgaccgtgtcctcgtctcgtgcatcacggcgtgcggccgctgccgcttctgccgcgagtcggcgtacgggcagtgccgcggcggcggaggctggatcctcggccacctgatcaacggcacgcaggccgaatacgtccgcgtgccccacgccgatctgtccgtgcatccgctgcccggggcgatggacagcaaggacgccgttctgctggccgacatcctccccaccgcctacgaggtgggcgtgctcaatgggcgggtacggcccggagacaccgtcgtcgtggtcggtgcgggccccgtcggtctcgccgccgtcgccacgtcccgcctctacacacccgagaagatcatcgcggtggacctcgccccggcccggctggacgcggccaaacgcctcggcgcggacgcggtggccgtcgcgggcgaggaagccgagccactggtcgccgacctcaccctggggctcggggccgacgtcgtcatcgaagcggtcggggtgcccgagaccttcgagatgtgcacgcgcatggtgcggccgggcgggcacgtggccaacgtcggcgtgcacggcaggcccgcggtgctgcacctcgaagacctgtggatcaagaacgtgacgatcaccaccggactggtcgacacgcgctccactccgaccctgctgcgcatgatggccgccggccacctgcccgcgtcgtccatggtcacccacaccttcccgctggacgccatggaggaggcgtacgacgtcttctcgagggccgccgataccggcgcgctcaaggtcgtcctcggtgagcagcagcacgacgtcctgatggtcagggcggcc

SEQ ID NO: 1262 - DNA, 2379 bp, Streptomyces avermitilis
  CDS (1)..(2379)
atgccccaggtcgaacatcagaacagcaccgtactgaccgacgacgaactgcgcacgttggacgcccactggcgggcggccaactatctcgccgccggccagatctatctgctggccaacgcgctgctgaccgaacccctcagccccgcgcacatcaagccgaggctgctcggccactgggggacctcgcccggcctcaacctcgtccacacccatctcaaccgcgtcatcaaggcccgcgatctggacgcgctgtgcgtgtggggcccggggcacggcgggccggccgtgctggccaactcctggctcgagggcagctacagcgagacctacccggacatctcccgtgacgccgcgggcatggggaagctgttcaggcagttctcgttccccggcggagtgccgagtcatgtcgcgccggagacgcccggctcgatccacgagggcggtgagctcggctactcgctcgctcacgcgtacggcgcggccttcgacaatccggacctgctcgtcgcctgtgtgatcggcgacggcgaggcggagaccggcccgctcgccgcctcctggcactcgaacaagttcctcgacccggtccacgacggtgccgtgctccccatcctccacctcaacggctacaagatcgccaacccgacggtgctgtcccgcatcccggagcccgaactcgacgagctgctgcgcggatacggccatgaaccactccacgtcaccggcgacgacccgcaccaggtccaccgtgccctggccgaggccttcgaccgggccctggaccgcgtcgccctgatgcagcgcacggcccgcgaggagggcgcgaccgagcggatccgctggccgatgatcgtgctgcgcacaccgaagggctggaccggacccgcggaggtcgacggccggcccgtcgagggcacctggcgcgcccaccaggtccccctgcccgaagtgcgtgagaaccccgagcacctgcgccagctggagggctggctgcgctcgtaccggcccgaggaactcttcgacgccgacggccgccccacggccgacgtgctggcctgcgtgccgcacggtgccaggcgactgggcgccaccccgcacgccaacggcggcctcctcctacggccgctgccgatcccgcccctcgaccggttcgccgtggccgtcgacaagcccggcgcgaccctgcacgagcccacgcgggttctgggcgacctcctcgaacaggtcatgaaggacacctccgcccgtcgcgacttccggctcgtgggccccgacgagaccgcctccaaccggctggacgccgtcttcgacgcgagcggcaaggcctggcaggcccagacccttccggtcgacgaacacctcgaccggcacggccgggtgatggagatcctctccgaacacacctgccagggctggctggagggctatctcctgaccggccgccacggactgttctcctgctacgaggcgttcgtgcacatcgtcgactcgatggtcaaccagcacatcaagtggctgaagacgtcacgggagttggcgtggcgcgcgccgatcgcctccctcaactatctgctcacctcacacgtctggcgtcaggaccacaacggtttctcgcaccaggacccgggcttcgtcgaccacgtcctcaacaagagccccgaggccgtacgggtgtatctgccgccggacgccaacaccctgctgtcggtggcggaccacgtcctgcgcagccgtgactacgtgaacgtggtcgtggcgggcaagcagccgtgcttcgactggctgtcgatggaacaggcccgggcccactgcgcgcgcggggcggggatctgggagtgggcggggacgcagaacgacggcgaaccggacgtggtgctggcctgcgcgggcgatgtgccgacccaggaggtcctggccgcctcggcactgctgcgccggcatctgcccgccctcgccgtccgggtggtgaacgtggtcgacatgacgcggctgctgccgcgcgaggcacacccgcacgggatgagcgacttcgagtacgacgggcttttcaccaccgacaagccggtcatcttcgcgtaccacggctatccctggctgatccaccgcctcgcctattcccgcaccggtcacgggaacctccatgtgcggggctacaaggagatgggcaccaccacgaccccgttcgacatggtcgtccgcaacgacctcgaccgctaccggctggtcatggacgtcgtcgaccgtgtccccggcctcggcgtacgcgccgccgccgtccgccagacgatggccgacgcacgtacccggcaccacgcctggatccgcgagcacggcaccgacctgcccgaggtcgcgaactggacgtgggaggcg

SEQ ID NO: 1263 - DNA, 801 bp, Streptomyces avermitilis
  CDS (1)..(801)
atggccggcaagaagacggcgagggtgccgcgcgccgcatacgagcaggaactgctgcgcctgcagaccgagttggtgaagctgcaggaatgggtgcgggcggagggcgcccgtctggtcatcgtgttcgagggccgggacgcggccggcaagggcagcacgatcaaacgggtggcggaacatctcaatccgcggcaggcacggatcgtggcgctgccgaagccgaccgagcgtgagcgcacccagtggtatttccagcggtacgtcgagcatctgccggccgccggggagatcgtgttgttcgaccggagctggtacaaccgcgccggtgtcgagcacgtcatgggtttctgcaccaaggaggagcaccagctcttcctgcggcaatgtccgatcttcgaacggatgctggtcgaggaggggatcctgctgcgcaagtactggttctcggtgagcgacgccgtgcagcaggagcggttccggcgccggatgaaggatccgacgcggcgctggaagctctcgccgatggacctggagtcgatcacccgctgggaggcctactcgcgggcgaaggacgagatgctcgtccatacggacatctcggaggctccgtggttcgtcgtggagagcgacgacaagcggcgggcgcggctgaacatgatggctcatctgctcggctccgtgccctactacgaggttccgccgccggtcctcgaactgccgcgccgcccgccgtcgaccggctacgagcgaccgccacgcgatctgcagacctacgtgcccgaccacgcggcgagcctc

SEQ ID NO: 1264 - DNA, 870 bp, Streptomyces avermitilis
  CDS (1)..(870)
atggagcttcccctggtcgtgggggtcgacggctccgagtcgagtatgcgcgccgtggactgggcggcggacgaggccgctctgcgcggggttccgctgcggctggtctacgcgtcgctgtgggagcggtacgaaggggccgcgctcgccgacgggctcggcaggcctccggagcaggtgatcgccgacgacatcgtcgaggcagccgcgcagcgcgcccaccgccgccacgcggacgtgaagatctccaccgatgtgctgcccgaggagccggcccccgccctgctgcgggagggcaacgaggccttcgcgctggtcctggggtcgcggggccgcagcgggctcgccgagctgctcctcggctcggtgtccctggccgtggccgcccgcgcctactgcccggtgatcgtgctgcgcggcagccaggacaaccgggccggggcgggtggccatcggcgcatcgtcctcgccgtcggcgaggaaccggacgacccggccgccgtgcggttcgccgtcgcggaggcgcgggcacggggctgtgcggtggaggccgtacgggcctggcgccgccccgctcgcgaggccctgggccacccgctgtcctcccgaagggcggcccggctgcacgaagagcgggccacggaggtgctggaagcggtactgagcggggccccgccggatgtcgaactgcgccggcgcgcggtcgagggcccggcccgcaaggtgctgctggacgcctcggccaccgccgacctgctcgtcgtcggcgcccggcgccatcccggacactccgggctccagctcggccgggtcgcccacgcgatgctgcatcactccgcctgcccggtcgccgtcgtaccgcaccggggg

SEQ ID NO: 1265 - DNA, 351 bp, Streptomyces avermitilis
  CDS (1)..(351)
gtgaggccacggccgccggggacacccggtggattcggtgaggccgtcaccttcgggcgatggtgcggcgcacacaccgccctcgcgctcaccgtgaccgaggacgccttcgccgccgtccgttcgggcccacggcgtcgcggcaggctcagtcctggtcacccggccggcgcacggcacgaccaggttccgatcttcgacacggtgctcggcggcacctcggcgctgggccccgtcgccgctacgcggcaggagctgcggaggtcttccggccgctcgcggcgggccgtaccagggcggtccgtgagtggcggccgctcgcctccgtcaccgaggtgtccgacgatgtgc

SEQ ID NO: 1266 - DNA, 3150 bp, Streptomyces avermitilis
  CDS (1)..(3150)
gtgctgcggcccgggcgtgcccgcggcaggcgggcccgaccgcctgccgagtggccggcggtcacctgggcgggtggtggtgcggctcgcgttcccccgccggtcacgcttccgcgcgccggttgcggaacgccccgggctccgcttggcatggccgccgggcggagaaacgggagtgggatgagggcactgcggtgggccggggacgcgcagcgcgtgcgcaaactgtggtgggcggccgcgttggtggccaccggcctggctcaggtcgccgtcaccgtgctcgccgacggcaagagcgtgatcgagcggtggacgcccgctctggggctcgtggtctccgtgctggggctgctgtccaccctgacgcagagcgagtccggtaccggggagggccgcggcacggactggctgaagggccgggccgacgccctggccgaggtggtgcaggacatgtgggcggccgaggcgcggctgcgcaggttgcaggatccggaaccgctgcccgtccggtggtctgcggtggacgcgccgctggccgaccacgacgagaacgtgcggcggggcgccgaggcacacaccgccctgagatcgggacagttgagcgatgcccgcgccgccttcctctccgttccgtcccgtcgggtggtcgtgctggggcagcccgggtcggggaagacggttctggcgctgagcctgaccctggagctgctggcggcccggcagcccggagacgccgtccccgtcgtgctgcccgtcgggacctgggacgccgtccgcgaaccgctgcgcgtctggacggccgctcggatcgcggccgacttcccggccctggcggcgggagtgccgggcggcggcacactggcggacgccctggtcgccgcccgtctggtgctgccggtcctcgacggattcgacgaactgcccgaggcgcagcggacgccggcgatgcgccgcctcaacgccgaactggacgccgactcgcccctgtacctcaccagcaggaccgacgcctacgccgccaccgtggaggcctgcgacgtgctcacggccgcggcggtcgtcgaactctccccactgcggctgaccgatgccgcgtcctatctgacccggacttcgcgtcccagacgcatgccggacggccggatcggcacggcctggagcgcgacactggctcgtctggccgcgcccggcgggccgcccgaggacgccctgcggcaggtgctgagccgacccctcatggtcgccatggcccgcgcggtgcacggtgacggcggccgcgatcccggacaactgctggacggccggttccgtacggccgcccagatcgaggagcacctgctcaccgccttcgtaccggcggtgttcggcgacaccagcggatcgtgccgcacgaccgaggacgcccagcggtggctcgggttcctcgcccgtcacctgcggaaccgggacaccgggcagttcgcctggtgggagttgcagagcgcggtgccgcggatcgtgcggctgctggcgccgggggcgctggccgcgtgcttgtccgccgtggtggccggcgccgtcatgacactggtggcaccgcacacgatgatcgacctctgggccgacggcgaactgtacgaactcgtcggcaacgcctcaggagtcgtcgccggttgcgtggtggggctggccgtcctcatcgaccgcaccggcaggacctcactgcgggtactgatggcgaaggccgccctggcggccgccaccctgggcatcctcatcggtgtcacggccgagcccctctacggcgcctccatcgccgacctgggggacgcctggctcttccggtttctgtccggtgtgctcttcggcacggccgtgtcggcggtgttcgcggtggccggagtcaccgcttgccccgctccgctggggctgccctgggccgggccgacggtcgcccgccacgtcggtgtggctgccctcctggtcctgtccggcgtggcgatcctggtcatggaccccctctccccggccggcggtctgtggcgggcgagcgcggcggccgtcgtcgcgtgcgcggccgtggtggccgtcatccgcatccggcggcgcggaccgcgagggtctcgccaccgggtgccgggccgggagcaggtccggcggttctgccaggggctggtccgcggcacggccgcctgcctcctggtcggtctggcactcggtcccgccatcggagccgtgatgggcaccgtcatcgaatggcgggccacacgcgccggaaccgtacacaccgatgccgccgccctggacgcgcgcaccggaatccgccgcgcgaccaccggcgcatggaccttcgaggcctaccccgacggcaccaagacggcccggcccgccgagccggtcagggtggtcctgatggtgaacgtccgcaacccggcacaggcgtggacgtatgcgccacccgggcccggcgcggcatgccacgcggtggaccggcggtgcagcacggccctcgcccgggtgcggttcaccacgcgggacgggatctggcacgtccggatcgccggtcacgacgcgcgcgacctcaccctcctgtcgtccctgcacccgccggccgcctggtggttctggcagatcggccgttggggcctggtggagaactgcgtcaagggaggcatcgtctcgggcctcgtcctggggctcatcggaggctgcgcctgcggcgtctaccgctggctcgacacacccgccgacctgacccgcgccacgagtccgcccgccggcctgcgaggtgaccggctcgccgtgctgaccaggggtgcggccgccaccgtcgccgggtccgccgccggcggcctgttgctgctgaccacgcccgaccgttacgggatgcacgggatgtcactccaaatggcgcttgtcatgggcccgttggcgttgagcctgagcgcgtacggccgcctgaccgtcgcaaggatgtggctcggcgccacgggacagctgccgtggcgcctgatggccttcctgcacgaggcccacctgcggggcgtgctccggcagtccggcgcacgctacgagttccggcatcttcggttgcaggagtgccttgcggcccgggcggaaaggggcgagagtgaggccacggccgccggggacacccggtggattcgg

SEQ ID NO: 1267 - DNA, 531 bp, Streptomyces avermitilis
  CDS (1)..(531)
gtggcgcgggccggaacacaggaacatgctggaagcggcaggtccgtacccacgtcctggaggcccgtcatgaacgctccccccacgtccagcatgctccgggcgctgccgtcggagcaccggcagcagctgatgcgggtcgctctggaggtgtccttccccgaggggacgcgcctgttcgaggagggcgcacgcgcggaccgcttctgggtgatccgcaccggcgcgatcgatctcgacatgcacgttccgggccgcaaggcggttgtcatcgagactctccggcacaacgaactcgtcggctggtcctggctgttcgcgccgcacacctggcacctgggcgccgagacgacgacgccggtacgggcgtacgagttcgacgccgtggcggtccgggcgatgtgccaggaggactccgcgctgggtctcgcggtcgcgcattgggtgggcgagatcctcgctcaccgcctgcggtcgacccgcacccggctgctggacctgcacgccccctacggcagcggcagccgtcac

SEQ ID NO: 1268 - DNA, 825 bp, Streptomyces avermitilis
  CDS (1)..(825)
atgtcgaacgtttcgttaccccgcgacgaaggccgcgcccacgtggcccggctccgcaccgatgtgtcgcactcggcccgcatctggaactactggctgggcggcaaggacaactaccccgtcgacgaggaagtcggcgatcagatcctgggtttcgtaccggccctgccccggtccgccgtggccgaccggcagttcctcgcgcgcgccgtggggttcctcgccggcgaggcgggcatccggcagttcctggacatcggcacaggactgcccacggtcgacaacacccatgaggtcgcccagcgggtcgacccgacctgccgaatcgtttatgtggacaacgaccccatcgtgctccggcacgcccacgccctgctcaccagcacccccgagggggccacggactacatcgacgccgatgtgcacgacccggacgccatcctggaacgcgccgcccgcaccctggacttcagccggccggtcgccctcacgatgctcggcgtcgtcaacttcatcatggacaccgaccgggcccgggccatcgtccggcggcttctggacggtgtgccgtccggcagctatctggtgatctcccatcccaccaccgaggtggacggcgaggcgatgacggaagcggtgcgctactggaacagccagggctcggcgccgatgaccctgcgcacccgcgaggagctgctgcggctcttcgacggcgtggatgtgctcgagccgggtgtcgtctcgtgctcgcgctggcgcccggccccgtcggggaaggacgagatcgtggacgtgacgcacttctgcggcgtggccaagaagccg

SEQ ID NO: 1269 - DNA, 708 bp, Streptomyces avermitilis
  CDS (1)..(708)
atgacagcaacactgatcaccggagcgaacaagggtctcggcttcgagaccgcccgccggctcatcgccgcgggccacaccgtctacatcggaagccgggacgccgaacgcgggcgtcgggccgccgagcggctgggcgcgcgggcggtccggctcgatgtcaccgacgacgcgtccgtggcggccgcggcgaagaccatcgaggccgacggagggctggacgtactggtcaacaacgccggcatccaagaagagatgggtgacgacaacgtcgtgatcggcgcggcggacgtgaccgtcgacgtgatgcgacagacgttcgagacgaacgtcttcggcatggtgcgcgtcacccacgcgtttctcccgctgctgcggagttccgccgccccggtcgtggtcaacgtcagcagcggtctggcctcgctgacccgggccaccatcccgggcgacccggcgtacacctacccgggcttggcctacccggcctcgaagaccgcggtcaacatgatcaccgtgcagtacgcgaaggcgttcccgaacatgcggatcaacgcggtggagcctggctacaccaagaccgacctgaacggaaacagcggtgtccagaccgtcgagcagggcgccgagatcatcgtgcgtatggcgcaggtggaccctgatggccccaccggaggctacttcgatgccgacggcatccttccctgg

SEQ ID NO: 1270 - DNA, 1101 bp, Streptomyces avermitilis
  CDS (1)..(1101)
atgaccccccgccgcctgcccgccccgctgctggacgccatagtcgtcgcggtggcgctgctagacgtctgggtccatttcgactcggacgagccggggcgcatggcgtgcgccgtggcagcggccttcgctctggtgctgcgccgtcgcctgccgctgctgaccttcctgctcaccctgcccgccgtcctgttctccgacgcgatcctcgccgcactgatcgcgctgtacacactcgcctcactcacccgccaccgtgtcctgctggccgcctgcgccacggcgttcacgttgagcagcatgtcctcgtggccgtcaccgacgttcgacctgtcggagaccgcgaccctgatcacgctggggtacaccggggcgacggcggtcgctccggtcttcctcggccagctcgtccaggcccggcgtgatctgtcgttgcgactcgccgagatctccgcggcgcgtgaccacgagcggctcctgaccgaccagaccgtgctggccaaggagcgcgcgcagctcgcgcgggagatgcatgacgtggtctcccaccaggtcagcctgatcgcggtgcgggccggagcactccaggtcggcacccaggacgccgacgtcaaggaagccgcggccacgatccggcggctgagcgtgcagaccctggacgaactgcggcacatggtcagcgtcctgcgcgcctccggaggccgccccacggagctgacaccgcagccgtccctggccgacctccagcggctggtcgacaacagcggcatcgaggccgaacttcaggcggacatgcctgacggccttccgcccacagtccagcgcgccatctaccgcaccgtccaggaagcgctgaccaacgcacgcaagcacgcccccggcaccaccgcgacggttcgtatccgccaggagaacggcgccgtccgtgccacggtcaccaataccgcaccgacccggcccgctctgcccctgcccagcgcgcactacggcctgatcggcctgcgtcagcgcgccgcactcctcggtggcaccgtcacctccggccccacggccgacggcggctacgaactgcgcctggagcttccggccgacggcacgtcg

SEQ ID NO: 1271 - DNA, 678 bp, Streptomyces avermitilis
  CDS (1)..(678)
gtgagtggagcatgcgtgatccgggtattggtcgtcgacgacgaggccctgattcgtacgggtttccagcacatcctcgacacggcggacgacatcgaggtcgtggcggcggttcctggcggccaggcgcttcagacggcacaggagatacgacctgatgtcgtgctgctcgacatccggatgccggacgtcgacggcctcaccctcctggcctgcctccgtcggctgccgcaccctccggtggtggccatgctcacgaccttcgacatggacgaatacgtggccacggcacttcgctcgggcgccgccggcttcctgctcaaggacaccgaccccgaggggcttccgttcctcgtgcggaccctggccgacggtggcaccgtgctggcgtccaaggtcacccggacggtcgtggacggctatctgaacgccggaccccaggagcccgctgcccgcagcctcgccgcactgaccgaccgcgagcgcgccgtactcgtcctcatcgccgagggactgtccaacgccgacatcggcacccggatgcacctgagcaccggcaccgtcaaagaccatgtgagcgccatcctcacgaaactgaaggtggacggccgcgtccaggcagccctgctcgccgaacgggccggccttctcaagccaccacgggaccaggagggggaa

SEQ ID NO: 1272 - DNA, 1227 bp, Streptomyces avermitilis
  CDS (1)..(1227)
atgacgcacgtcgtagcagaggccgcgccggccgaggcgatgtcggctgcgcgggcaggcccttcccgtacgtcgtccacaggacggctgatcggcctcgacctggcccgtggcctggcggttatcggcatgtacacggcccacctcggtaccgacccctcggagggcggcccactgggctgggtgacggaggtgacccgtgggcggttccccgcactgttcgctctgctggccgggttcaccctgatcattctcaccggtcggccacagccgcggaccgggcgcgcggggcgccaggccatgggcagggtactgatccgctccgccgtgctgatcgccctgggatatgccctggcgtacctggacaccccgatcgacgtgatcctcgccgcctacggagtgatcttcgccctcgcccttccgctgtaccggctgcgcgcctccaccctggccgtcatcgccgcggcgatgacgctcgtaatgccccccgtcgtgtatctgctgcgggccgcggtcgagggcggcagctgggccgatgccgtgatcgccaacgatcctctggcccgggtcaccggttcggacgggatcctcgaattgttcatcaccggcgagtacccggtactgacctggctgcccttcgtcatcgccgggatggcggtggcgcggctcgacctcagccggcccggtatccgcgccaggatcgccctcctcggcggcgcacttgccgtactcggttacggcggctcctggctggccctgcacctggttccgggcgcgcaggccaccgtgagcgcggcgacggacggcgggtcggcgtcatcggcctggtggtccgatgccgtcggcgaccccaccaccagtaccccggactggatgctggtggccgcgccgcacagccagacgacctggtcgatcctgggcaacaccggcttcgccctcgtgatcctcgctgtctgcctcatcgccacggaccggtcggcgcgcctgcggtggttcgccacacccgtcaccgcggtcggctccgtcgccctcaccgcctatgtcggtcacatcgtggccatcaaggccctgggcatggacgacgtgccgacctccgacgccctggcggtcctgatcggtttcgcctcggtcgccatgctgctggccctcgcctggacccgggtcttccggcgcggaccactggaatacctggtgcacgccgccaccacacccgcccgtctgatcaac

SEQ ID NO: 1273 - DNA, 651 bp, Streptomyces avermitilis
  CDS (1)..(651)
atgacagtccgcctgacattcatgtgcgcgacagccgggggcaccaccagggatgcggtcttcggtgacggtctcctcagtgagcgcggcctgcgccgggcacgcgccgccggcgcaacactccccccgtactcgctggccatccgtgcgccgtcggtccgctgcgcgcagaccgcttacgccctcggcctgccgaccacactcgagcccgcactgcgcgacctcgactacggcacgtggcggggccgcacagtcggcgaggtcgtcgcggacgaaccgtacggttactccgcctggcttacggacccggatgccgcgccacacggaggcgagtccgtacgccggctctgccgccgaatcgccaactggctgagcagcgtgccgccttacccgggccgcgcgttggtcatcacggaaccgtcggtggtccgggcctcgctcgtccatgctctgtccgcaccagtgacagccttccggcatttcgatgtgccgcccctgtccacggtctcccttaccttgagcgacggccactggatcgtccggcccggccgtgtcaccccggacagagtcggcaccagtcgcgctgttcccacgccctatgacgccgccgagggccggacggcgctcctgtggggcgaggcgaccccggcg

SEQ ID NO: 1274 - DNA, 990 bp, Streptomyces avermitilis
  CDS (1)..(990)
atgaagatgctcatcaacgtcgcggagacggtggtcgcggacgcgctgcgggggatggcggccgcgcatccggagctgacggtggacgtggagaagcgggtgatcgtccggcgcgacgcaccggtggccggaaaggtcgggctcgtctccggcggcggctcgggacacgagccgctccacggcggcttcgtgggcccgggcatgctctcggcggcctgtcccggcgaggtcttcacgtctcccgtgccggaccagatggtgcgggccgcggccgccgtggacagcggcgcgggtgtgctgttcatcgtgaagaactacacgggtgacgtcctgaacttcgacatggcggcggaactcgccgaggacgagggcgttcaggtcgcgaaagtcctggtcaatgacgatgtcgccgtcaccgacagcctgtacacggccggccggcgcggcacgggcgcgaccttgttcgtcgagaagatcgcgggcgccgccgccgaggagggcgcgccccttcagcgggtcgaggcactggcccggcaggtcaacgagaacgcgcgcagcttcggtgtcgccctgagcgcctgcaccaccccggccaagggcagccccaccttcgacctcccggacggcgagctggagctgggtgtcggcatccacggcgagccgggccgggagcggcgcgcgatgatgacctcgcgggagatcgccgacttctcggtgcacgcgatcctggaggaccttaatccgagcaaccccgtgctggtcctggtcaacggtatgggagcgaccccactcctggagctgtacggcttcaacgcggaggtgcagcgggtgctggtggagcgcggtgtcccggtggcacgcacgctcgtcggcaactacgtcacctcgctcgacatggccggcgcctccgtcaccctgtgccaggtcgacgaggagctgctgcgtctgtgggacgcgccggtgagcacgcccggcctccgctggggcatg

SEQ ID NO: 1275 - DNA, 597 bp, Streptomyces avermitilis
  CDS (1)..(597)
gtgctcgatgccgacttcttccgccgttggatgacggcgaccgccgcgtccgtcgaccgcgaggccgagcggctcaccgccctcgactcgccgatcggcgacgccgaccacggcagcaatctccagcgggggttccacgccgtggcggtcacgctggagaaggaggcgccggacacgcccggcgccgtcctcgtgctcgccgggcggcagctcatctcgacggtgggcggcgcctccgggccgctgtacggcacgctgctgcgccgcaccggcaaggagctcggggacacggccgaggtcaccgaggaacagctgacggacgcgctgcgcgcgggcgtggacgcggtgatgcagctcggcggagccgcgcccggcgacaagaccatgatcgacgcgttggttcccgcggtcgacgcgctcagtgactcgttcgccgccggccgggccgcggccgaggagggcgccgtcgcgacgacgcccttgcaggcccgcaagggccgggcgagctatctgggcgagcggagcatcgggcaccaggatcccggtgccacctcctcggcgctcctgatcgccgcgctcgaggaggcctccgttgag

SEQ ID NO: 1276 - DNA, 414 bp, Streptomyces avermitilis
  CDS (1)..(414)
ttgagtgacaccacggacaagctcgtcggcatcgtgctggtctcgcacagcgcggacgtcgccacctcggtcgccgaactggccaaggggctggccgggggcggcacgaccgcgccggtggggcccgcgggcggcatcccgggcggcggcctcggcaccagcgccgagctgatctcggccgcggccgcctccgtggaccagggcgccggggtggccgtgctcatggacctgggcagcgcgatcctcaccgtgaaggccctgctcgcggaaggcgacgagctgccggagaacacccggctggtcgacgcccccttcgtcgagggcgcggtcgccgcggtcgtcaccgcctcggcgggcggtgacctggcggcggtggaggcggccgccacggaggcgtactcctatcgcaaggaa

SEQ ID NO: 1277 - DNA, 771 bp, Streptomyces avermitilis
  CDS (1)..(771)
atgtcccccacgagagggtccctcatcgtgcgtgtccagtcgctgacgctggtcgcggccagtgccgccctggtcgcccccacgacgtcgccacccgtcgtccggacccacgaagtggcccggacccacgaagccgcccggacacgtgaagccgccgggacccgtgaaccggcggcggcagcgcgtgagggcaccgtcctcgccgccgatctgctcgcaaaggtacgcgactgcgctcccgtctcgaacgggcgctaccgcagcgacgacggcgcgccggccgacattcccgtctgcggccggcgcgacgccgtgttctggaaggccgacatggacatcgactgcgacgggcggcccggcctgctgtgcaacgagagcaccgacccgtcgttctccgacgccaccgcgtttcagcagtccgacggccgtcagctgaatgccgagaccctgccgtacatcgtcgtgcccaccgcgggcgatatctgggaccaccgcgagcatggcgtccggggtggttcggtcgccgccgtgatctaccaggaccgggtccagtacacggtcgtcggcgacaccggaccgcacgacatcatcggcgaggcctcgtacgccaccgcccaggccctcggcatccgccccgacccacgtggcggcggcaccgactccggggtgacgtacatcgtcttcaagaactccgccgtgtcgcccatcgagaaccacgtcgaggccgtggcccaaggagaggcgctggcccgcgagttcctccgccagaac

SEQ ID NO: 1278 - DNA, 1029 bp, Streptomyces avermitilis
  CDS (1)..(1029)
atggcatacaggtacagaccaatcccgtcgagggaagggggacccgtgcgccgactggtgcgacgccttcgtgtgccggtgatctgcggctcgctgttcctgacggtgtcctgcgggtggggcggacaggacggcggccgggacgggccgctgccctcggccccgatgggcgtcacggccgcggccggcagcgcgaccagcgtgcacgtcatgtggaaccaggtgtccgggggcccgaaggtcgccgggtacgaggtatatcgcggcaccacgaaggtgaaggacgtaccgggtgcggagcacatggtggacatcaccaggctcaagccctcgacgacgtacgtcttcaccgtccgggcacgggacgatgcggggaacgccgggctgccgagcgcgaaggtgcgcgccaccacgcccgcggccgtcgccgccgatcaccgggcccccacccggccgggacggcccagcggcaaggcggtcgggagccgggcggcccagctgaactgggcgcgctcgacggacgaccggggggtggcctcgtacgacatctaccagggcacctcgaagatccacagcgtcggcggcgggcagacggcgaccgtcgtgacggggctgcggccgggcacccgctactccttcaccgtccgggcccgcgacgccgccgacaacgtctcggccgcgagcgcctccgtacggctgaccaccgccggcggggcggacgacggacggggcaccgcgcccacccgattccgcgccgggacccaccgcgccgacggggcgtactacatcgacctgtcctggtcgccgccggacacggacggagtgatcaccgagtaccagatccacctcgacggccgtccggcgacctcgctcgtgtggggcggcaagccgccacgcggcaaggccacgtacagcttctacctgggacgggacgccggcgccagacaccgggtgcggatccgggcgaagctgccggacggcacgtggggcggcttctccgacgagcggaccgtgaccacggggggacgc

SEQ ID NO: 1279 - DNA, 534 bp, Streptomyces avermitilis
  CDS (1)..(534)
atgcgcactattcagctgttcagccgttccggcctggccgtggcggccgccgcgcttcctctcaccctcgcctcccccgcggccgccgcctggaattcagggatctcggtgagcaccagcggaagcaacgtttcggtcgccaccaccacgtgcaccccgttcaacggcagcctgggcaacgcctcgctgctctccagcggccaggcgaacttcacccaggggcgcctggcgatgctgaccgggtcgaacatcagccagtccggcgtctggtccaacgtgagtccgggcacgtacacggtcgtggtggtctgcgcgaacggttcgacggccggcacccagtccatcatcgtctccggcagctcgacgcccaccatctccgcgacggcctcgccctcgcgcggggtcatgggcggtgtcggcgggtccgtcgagcactacggcaccatcaccttcgcggtgggcgcggccctggtggccgtcggcgccgtggcgacgggctggtatctgcgccgccgcaccaagccgtaccggctc

SEQ ID NO: 1280 - DNA, 543 bp, Streptomyces avermitilis
  CDS (1)..(543)
atgtcactcccgcacgcgatcctcaccgccctgctagagaagccgtcgtcggggctcgagctgacccgccgcttcgacaagtcgatcggttacttctggtcggcgacgcatcagcagatctatcgcgagctgggaaaactggaggccgagggctacatccgcgcgctgcccacgcagcagccggcccgcgggcagaagaaggcgtacgaggtgctgcccgccggtcgcgccgaactcgcccgctggaccgccgccgcccaggaacccaagcccctgcgcgacacgctattgctgcggctgcgcgcctcggcggtggtcggcaccgaggggatcgaggacgacctgcgtcggcatctagccctgcaccagcggcagttgacggagtacgaggagatccaggaccgcgacttcgggcccggcaaggacacgccgcaggaccggctgaggcatctcgtgctgcgcgccggcatcgacctggagacgttctggacgcagtggctgacccatgcgctggcggagttcgaggagttgcccgcgcacgag

SEQ ID NO: 1281 - DNA, 2013 bp, Streptomyces avermitilis
  CDS (1)..(2013)
atgagccgttacccgcacctgctgaacccgctcgacctgggcttcaccagcctgcccaaccgcgtcctcatgggctccatgcacgtgggcctggaggaggccgagcgcggcttcgagcgcatggcggagttctacgcggcccgggcgcgcgggggagtgggcctgatcgtcaccggaggcatcgcgcccaacgacgcgggacgcccctacgagggcggcgccaagctcaccaccgaggcggaggccgagcagcacaccgccatcacggaggccgtgcaccgcgagggcgggaagatcgcgatgcagatcctccacttcgggcgctacgcctatcaccaggacctcgtcgcgcccagcgccctccaggcgccgatcagccccttcccgccgcacgcgctgacggacgccgagatcgagcggaccatcgacgactacgcgcgcaccgcccgtctggcgcggcaggccgggtacgacggcgtcgagatcatgggctccgagggctacctcatcaacgagttcatcgccacccagaccaaccggcgcgaggaccgctggggcggctcgtacgagaaccgcatgcgcttccccgtcgagatcgtccgccgcgtccgcgaggcggtcggcgaggacttcatcatcatctaccggctgtcgatgctcgacctggttcccggcggatcgtccctggacgaggtcatcaccctcgcccaggccgtcgaggcggccggagcgaccatcatcaacaccggcatcggctggcacgaggcccggatccccaccatcgcgacctccgtgccgcgcggcgcgtacgcctgggtgaccaagaaggtcatgggtgccgtctccgtccccctcgtcaccaccaaccgcatcaacacccccgagttggctgagcagttgctcgccgaggggcacgcggacatggtctcgatggcccgcccgatgctcgccgaccccgacttcgtcgccaaggccgtggccggacgcccggaggccatcaacacctgcatcggctgcaaccaggcctgcctcgaccacaccttcggcgggaagatcacctcctgcctggtcaacccgcgcgcctgccacgagaccgagctgatcctgtccccgacccggctgcgcaagcgggtcgccgtggtgggcgccggtccggccgggctggcctgcgcggtcagcgcggccgaacgcgggcacgacgtcacgctcttcgacgccgcgagcgagatcggcggccagctcaacgtcgcccgcaaggtccccggcaagcaggagttcgacgagacactccgctacttccgtacccagctcgaacagcacggcgtcgacgtgcggttgaacacccgcgtcacctccgagcaggtcgcggcgtacgaggaggtcgtggtcgccaccggcgtcagcccgcgcacccccgagatcccgggcatcgaccacccgagcgtgctcggctacctcgacgtcctgcgcgacggcgccccggtgggcgaccgcgtcgcggtcctcggcgccggcggcatcggcttcgacgtcgccgagtacctcaccgacagcggcgacaaggcgagcgaggacccggcgacgtacttccgcagctggggcgtcgacatggactaccgcgcacccggcggcctcggcgcacccgagcggcccgccccgccgcgcacggtccacctcctccagcgcaagacctccaaggtcggcgccggactcggcaagaccacgggctggatccaccgcaccgagctcaagcaccgtggcgtcaccatggtcccgggcgtccagtacgaccggatcgacgacgccgggctgcacatcaccgtcgacgggcacagccaggtcctggaggtcgacaccgtcgtcctgtgcaccgggcaggatccgcgccgcgacctgtaccaggaactgatcgccgcgggccaccgcgcgcacctcatcggcggcgcggacgtggccgccgaactggacgccaagcgcgccatcaagcagggcacggagctggcggccgcgctg

SEQ ID NO: 1282 - DNA, 816 bp, Streptomyces avermitilis
  CDS (1)..(816)
atgccaccactttcttccgcttcttcttccgcttccgccgtcgtggccgcgctccgttcggccggctgtgtcttcgccgaggacgaggcggagctgatcctctccaccgcccgcacgcccggcgagatcgccacgatggtcgagcggcgcgccgcgggtctgccgctcgaacacgtcctgggctgggccgggttccacggcctgcgcatcaccgtggatcccggcgtcttcgtgccccgccgccgtaccgagttcctcgtcgatctggcggtctccctcgcgcgtgaggtgtccgtcgtcgtggacctgtgctgcggctcgggtgccgtcgccgccgcactggccgcgtcgctcgacggccccgaactgcacgccgccgacatcgacccggcggccgtgcgctgcgcccgccgcaacctcgccgcctgcggcggtcacgtccacgagggcgacctgttcaccgccctccccggccacctgcgcggccgcgtggacatcctggccgccaacgtgccgtacgtgcccaccgatgaggtcggcctcctgccgccggaggcccgcgaccacgaacccctggtcgccctggacggcggctcggacggcctcgacatcctgcgccgggtcaccgccgaggcctcccggtggctgtcccccggcggctcgctgctcgtcgagacgagtgagcgccaagcgtccctggccgtcgagacgttcacccgcggcggcctggacgcccggctcgccgtctcggaggagctctgcgccaacgtcgtgatcggcaccagacctgggcgggcgtcggagccccagggggcg

SEQ ID NO: 1283 - DNA, 1116 bp, Streptomyces avermitilis
  CDS (1)..(1116)
ttgtataagccaacctttaggagggttcacatggacaccgggctgcggtcgccggcgctgcgtcatgtgctcacgcacctggtcacccccctgctgatgtgtctcggcatggggctggcctacatgggcgcgttcgtgacaccggagccgaaccatctgcccgtcgccgtcgtcggggccgccccggaggcgaaggtcttcgcccagacggtcaaggacgaggccggggacaagctcgacgtacggaccgtcgcgagccgtgccgaggcggtcgacctgctgaagtcccgtgacatcacgggcgcctatgtgccgagcgcgaagacgcccgaactggtcgtcgccacggccgcgtccgacatgggtgccaccgccgtcgagaaggtcttcacgcccgtcgccgcccagcgggacgtcccgctcaaggtcaccgacgtggcgccgccggccgccgacgaccccacgggccagggactgttcttcctgctcatcgcggtgagcatcggctcgtacgcctcggtcgccgcgctcggcgccgcgggctccacgctgcccatgagggcccgggcgctgctggccgccggagtctccggcgtggtgagcgtcatcggtgcgctgctggccggacccgtgttccacctcgcgcaccacgacctgctgacggtgtgggggatgagctggctctactcggcgggcatcctcttcatcggcgtgggcctccacacgttcctcaagcgctggaccaccctcgccatgatggtgctcttcgtgatgctcaacttcaccagctccggcggcctgttccgccccgagctgcagaacggcttcttcggcaccctgcacgccttctggaacggcgccggattcgtggaaggcgtccgcagcctcctgtacttcggccgggacggcctgtcgggcgacgtgtggaggctggtggtctggctgctggccggtctggtgctcaccgccgtggccggcgcggtggagcgcgtacgggcccgtgcggccgcaccccggcgcacgcacgcgaagccggtgggcgtgacgtcggcggagaaggcggccggggaggagccggccgacgccgaggaggagttggaggagtccgtcggtgtc

SEQ ID NO: 1284 - DNA, 528 bp, Streptomyces avermitilis
  CDS (1)..(528)
gtgaagacagtcgaagggcccgatgagaccgttgtcaccgtcgaggaacccggcgcgcacggcgcgcacggcgggtcggacgcggaggcggccgtcgagaccatccagcgcgagatgacggccttcgcccgccgtgcccgggcctcggcgggccggatgcaccccgagttgtcgctggtgtcgtacaccctgctcgggcacctggaggagagcggcggctgccgcgccacggacctcgccacgcactacacactcgacaagtccacggtgagccgtcaggtggcggcactggagcgcacggggctcatcgagcggcggctcgatcccgaggaccaccgggtacaggtgctgcatctgacacaggcgggccgaaggatcctggcccaggtcaccgagagccgccgggaggcgttccacgagcgcctcgccgactggccgaaggaggatctggagcgtttcgcggcctatctgctgcgctacaacgcggcggcgggcgagggcccgctcaaggagaggtcggcggacggc

SEQ ID NO: 1285 - DNA, 903 bp, Streptomyces avermitilis
  CDS (1)..(903)
atgagcgcacaggacaccgacggccgcgcgccggaggaggccggacggagcgccggggaccgcgtcccgcaggtgcgcgggcggagcgccgagggccatgtgctggatgtgagggggcagagcgacgaccgtcgcgccctcgacgtgagcggcgagaccgcagcgcgtcccgcacgggacatcgccggcccgcgcccggagcgccacgtcctcgacaaccccgcgctcgcctcgctcaccggcccgcacgcccacttcgccgaacgccggggccgtgtcctgcgctaccccgtcgacgtctcgccgtggctgggcctgcccgacgagcccgatgccgacgactgggccgatctcgccgcgctggtcgggcccggtgaagaggcgcccctcgccgggttccgcggccgggccccggacggctgggaggtgaccttcgacatcgcgggcgtccagctcgtcgacaacgggatcgcggcggccccggacgcggaggcggtacgcctcggccccgaggacgtgcccgagatgctggacctggtcgagcgcaccaggcccggccccttcctgccacgcaccgtggaactcggcacctatctcgggatccgccggggcggcgccctcgtcgcgatggcgggggagcggctgcatccgccgggctggaccgagatcagcgcggtctgcaccgacccggagttccgcggcgagggcctggccggccgattggtcctggccgtcgcccacggcatccgcgaacgcggcgagaccccgttcctgcacaccggcgcgggcaacaccaacgccatccgcctctacgaggccctgggcttccggctgcgccgcacgaccaggttcctcgcggcccgggtgcccgagcacgtgccggccggccgccaagtgggtgtc

SEQ ID NO: 1286 - DNA, 918 bp, Streptomyces avermitilis
  CDS (1)..(918)
atgcccaaggcgtacgtgttcacgcggtacggcggcccggagaccgaggcgctcgtcgatctggaccggccgagcgccggcccgggacagctcgtcgtcgcggtgcgcgcggcgggcgtgaacccggtcgactggaagcagcgcaccggttaccggcgccccggcggcccggcccgcgaactgcccgccgtcttcggcaacgaggtatccggcgtcgtcgaggagaccggcgagggcgtgaccggcttcgccgtcggcgacgaggtcttcggcaacccggtggccggcggatacgcccagtacgcggtgctgccggtgacgacgaccgcgcacaaacccgccgggctgtccttcacggacgccgcgaccctgcccgtcgcggcggcgaccgcgtacgacggcgtccgccagctcggcctgccctccggtgcgacgctgctgatcaccggcgcgggcgggggcgtgggtgtcgcggccgtccagctcgctcgggccgcgggactgcgggtcgtgggggtcgcgagcgaggccaagaaggacctcgtcgaatcgctcagcgccgtgcacgtgccctccggtcccgagctggccgagcgggtgcgcgcggcggctccgggcgacgtggacgctgtgttcgacctcgtcggcggcgaggtcctggaggccgcggccacgctgctcaccgaccgcacgaagctgatcaccggcgccgaccgggagaccgtcgcgcggctgggcggcgcgccggtggcacgggcccgcaccgcggccgtgctggacgccgtggccgcgctcgccgtcggcggtgagctgaagccgtacgtgacgcggacattcccgctcgaactggccgccgaggccctgcgcacggtcgaggaaggccacgcccgcggcaaggtcgtgatcgaggtcgccgaa

SEQ ID NO: 1287 - DNA, 603 bp, Streptomyces avermitilis
  CDS (1)..(603)
atgaacgtcacccgaggcttcacggggcgcccgcgcgtccatcatcccggactgccgcccggccagtacgacgcgggcgacgactggcccgtcctgtccgccgaggtcacgccggacctggcggcggccgactggtccttccggatcgacggtctggtggccgagccgcgcacctggagctgggacgcggcgcacgcgctggcgccgtccgcctacgagggcgacatccactgcgtgaccagctggtcgaagttcggggtgcgcttcgggggtgtgtcgctggacgcgttcctgggtctcgtacgcccggacgcgaccgccacccacgccgtcgcctactcgcacaccgggtacaccacgaacctgccgctgacggatctcaccggggggcgcgcctggatcgcgtgggagtacgacggcaggccgctgcccgccgagcacggcggcccggcgcggctgctcgtgccgcatctgtacttctggaagagcgccaagtggatcgcgggcctcaggatcctcgaccacgacgagccgggcttctgggagcagaacggctatcacgcccgcggcaacccctgggaagagcagcgttactccggtgac

SEQ ID NO: 1288 - DNA, 753 bp, Streptomyces avermitilis
  CDS (1)..(753)
gtgactgagaccttcgtacccccgacccggttcgccgtgcccggccggatcgccgtgagcaaccgggcagcggccgtctggcagaccgccacgctcaccgagatccgccgtgagacgccgcacgccgccaccttccggttcgcggtgcccggctggcagggccatctgcccggccagcacctgatgctgcggctgacggccgaggacggctacggggcgcagcggcactactcgatcgcgtcgccgcccgaggacgccgggcacatcgagctgacgctggaccatgtcgagggcggcgaggtctccggctggttccacacggtggccgagcccggtgacgaggtgcaggtgcgcggtccgctcagcggcttcttcgcgtggcccggcgaccggcccgcgctgctgatcggcgcgggctccggtgtcgtaccgctgatgtcgatggtgcgccatcaccgggcgcaggggtcgacggtgccgttgcggctgctcgtctcggcgcgcagcccgcaggagctgatctacgcccgcgagtacggcgacgagaccacgcccgtcttcacccgcgacgccgcggcgggggtgcccgtgggccgtatgtcggccgcccatgtggcgccgctcctggaccgggcgcctcctggtgggtgggaggcctatgtgtgcggctccaacgggttcgcggagcatgcctcgcggctgctcgtcgaggccggtcagccggtgcaccgtatccggatcgagcgcttcggc

SEQ ID NO: 1289 - DNA, 885 bp, Streptomyces avermitilis
  CDS (1)..(885)
atgacctccggcacccgcaccatcaccgtcggcatcgacggatcgcgcaccggcctcgacgccgccgactgggccgcacgcgaggccgaacgccgccgactcccgctgcgcctgctgcacgcgggcgccgaaccgcccgtccccgcccccgtgccggacgtcgacctgcccgcgcgcaccgccctcgaccgggccgcggtccaactggcttacgcgcacccggcgttggacatcatcgcccgccgtaccgagacacccgcggtcccggcgctgctggcggcggcagcggaggcggagacgctcgtcctcggctcccggggattcaccggattcgcgggattcctcgtgggctcggtggccctcgccgtcgcggcccgcgccgcgcgcccggtcgtgctcgtgcgcacgggcgaactggccgaggacgagcggatgccggccgacgacggcacaccgcccggccgggccgcgtatctgccggtcgtcctcggcctcgacctggaccacccggccgaccggctgatcgcctacgccttcgaggcggcggccgtgcgctcggcgccgctgcacgtggtgcacacctggacgacactcccgccgacgggacacgcgcccggagcgccgctgcccggcgacgcggccgagcgggaggagggcgcgcggcggacgctgacgacgacgctgcaaccctggcggcacaagtttccggggaccgacgtcctggagcgggtgatccccggtcatcccggacaccacctgctcagggcgtccatccgggccgggctcctggtgatcggccgccgtacgtcggcaccgggcctgggccgggccgcccgctccctgatccaccacgcaggctgtccggtggccgtggtcccgcactgc

SEQ ID NO: 1290 - DNA, 864 bp, Streptomyces avermitilis
  CDS (1)..(864)
gtggggatgttgtggcggcggggagggcgcaccggggtgttcccggcggcggtgggggcacccggggtgctgggcatccttcgccatgcgggctccttctcctcacgcgaccgatgcgcgggttccacggggtgcgcggatcagtcgtacaggcggacaatcagcaccaggccccttgtgggcgctgccgtcgggcgcaccgcgccgggagaggtgtacctgccgggccaggttccgttcggccccttcccgggccgggcggaggcggcgaggaggtcggacatgcgaacccggatgcggtaccggtatgaacgtcgtaatccgctgcggcgccgctcggacgtcgtcgaggcgtggacggccctggtcgtcgccgtgctgctgttcgtcgccgcgccgctcgccggtgcggccgtgggctggtgggcgtacgacagctcgcactcgctcgccacggcccagcgggccgagcggcggcatgtctccgcgaccctcgtcgagaacgctcccgccgcggtcccgtccgtccaggacagcaaggagccgctgtaccaggtgaaggtgcgctggaccgagccgggccggggcgcgcgcaccggaccggccatggtcccggcgggctccctgcgcggcgaacggaccgatgtgtggctggacggccggggcaggagcgtcgcgccgccggtgaccgacaccctggtctggcagcacgcggtgacgtcgggcgtgtggaccacgggcggcgtcgtgggcctggtcctgctcgcccggatcgccgagcgccggatcgccgaacggcaccgcatggccgagtgggaggaggaatgggcgcgtacgggcccggagtggaggaagcggaccgcg

SEQ ID NO: 1291 - DNA, 966 bp, Streptomyces avermitilis
  CDS (1)..(966)
atggccctgttcgacctgcctctcgaccagctccgcggttatcgcagcgcgtcggccgagcccgaggacttcgacgccttctgggccaagacgctccaggaggcccgccagtacgacctcggtccccgtttcgagccggtcgagacgcacctcgagacggtcgaggtgtacgacgtcacgttcgccgggttcgacggtcacccggtgaagggctggctgacgctgcccgcccgggcgaacgcgccgctgccgacggtcgtggagttcatcgggtacggcggcggacgcggccttccgcacacgcatctgctgtgggcctcggccggcttcgcgcacttcgtgatggacacacggggccagggcagcgcgtggggcggcggtgacactcccgacccggtgggcagcgggcccgctttccccggattcatgacccggggggtggaggaccccgaaagctactactaccggcggctgttcaccgacggcgtccgtgccgtggaggcggcccgggcccatcccctgaccgactccgcccgcgtcgcggccgtcggcaccagccagggcggcggcatcacgatcgcggtgggcggcctggtccccgacctggccgcggtcgcgccggacgtgccgttcctgtgcgacttcccgcgcgcgacgacgctgacggaccgcgacccgtaccgcgagatcggcaggtacctcaagacgaaccgcggccgcacggagcaggtgcagcgcacgctgtcctacttcgacggcgtgcacttcgccgcccgcgggagcgctcccgcgctcttctccgcggccctcgaggaccagacgtgcccgccgtccaccgtcttcgccgccttcaacgcgtgggcgcacgccgacaaggcgatcgaggtgtacgacttcaacgaccacgagggcggcggcccctatcaggaggcggcacagctgcgctggctgccggaccgtcttcga

SEQ ID NO: 1292 - DNA, 417 bp, Streptomyces avermitilis
  CDS (1)..(417)
atgagcatgagccgggcggcgacggccgaggcggcccggcggttcgtggcggtgtgggagcgggcctgggcggcgcacgacgtggacgcgatcgtcggcctgtacgccgaggactgcgtccaccgctcgatgccgttccgcgagccgcaccggggccgcgccgcactcgccgagtacatccgctggtcgttcgcggccgagcggacccaggacgtgcgcttctccgagcccgtcgtcggcgacgacgggctcgcggtcgcggagttccgggtgctggccgaggaggacggcacgccctcgacactcgccggctgcgtcttcgtacgcttcgacgcgagcggcctggccgtggagacccgtgactactggcacaccgtcacaggccacaaggagcccaccggttcgatgttcctgagg

SEQ ID NO: 1293 - DNA, 1164 bp, Streptomyces avermitilis
  CDS (1)..(1164)
atgtcccagcaggtgccacaggttcaaggccggtgcgacgagcgcttcacggcggtgcgcgaggcgttcgaggggaacttccgcgagcggggtgagctgggggcggcggtggccgtcacgctcggcggcgagaccgtggtggatctgtggggcggctgggccgacgcggcgcgcacccgcccctgggagcgggagacgctggtcaacgtgtggtcgacgtcgaagggcccgacgtccctctgcgcgcacatcctggccgaccgcgggctgctcgacttcgacgccccggtggccgcgtactggccggagttcgcggcggcgggcaaggagtccgtcctcgtacggcatctgctgtcgcaccgcgcgggcctcgcgggactgcgcgagccgcattccgtcgagcagctgtacgactgggagctgaccgcgcagcggcttgcggcgcaggagccctggtgggagccgggaacgcggtccggttatcacgcgatgacgttcggcttcctcgtcggcgaggtggtgcgacgggtgtcggggctgctgccgggtgccttcctggagcgggaggtgaccgggccgctcgccatcgacttcacgatcgggctgccggagaaggaggcggaccgggccgcggagctggtgcatccgcgggccgcggcgaccagtgaacaggcggcgatcttctcccagttggcgccggtggccctggccgcgctgctcaaccccgtggtcggcgccaccgagggcaacaccgagcagtggcgggccgcggagatcccggcggcgaacggccacggcacggcgcgcgcggtcgccgcgctgtacgggatcttcgccgggcggggctcgtgggacggacggccgatactctcccccgaggccgccgagcgggtgcgcgagggccagggcagctgccgtgacctggtgctgggtgccgggttcgagagtgagacggagatcggcctcggcctctggctcagcgggtccaacggatcgtacggtcccaacccgaaggctttcggtcacgacggcttcggcggctcctgcggtctcgccgacccggaggcgggtgtctcgctggggtacgtgatgaaccgcatgggcccgcacatcgccgacgacccaaggaagatggcgcttgtcgacgccctgtaccgcgcgctc

SEQ ID NO: 1294 - DNA, 750 bp, Streptomyces avermitilis
  CDS (1)..(750)
ttgtcaccaggaggcgcggacatggcccgctccaccacatccgaccacgacccgctctactggaggatcgcccacgatctactcggcgaactgcgcgacggaaccattccgccgggggaacgactgcccggcgagcggcacttggccacgcacttcggggtcagccgcgagaccgtgcgacaggccctgcagatgctgcgccgcgacgggctggtcgccacggaccgccggggcagccacgcgacgctgcccggcgccacggccgaacccggcgccgacgccgcccacatgccgtcgctcaccttccccgtgggcgcgcagaccacggagccctgccgggcgaccgtcacctgggaagaaccccccgcggagcacgccctggccctggggctcgctccgcggcggccgacgctcgtacatcgctacgagtcggtcgcggccgacggcagcgggctgcgtacggccctgacgtcgttctccgtcgtcgcggtcacggaggtcgcggagctggcccgctaccgcgaccgcgcggacggctcggcggcggcccagctgtggcgcgcgtacgactggatgcgcaaggcggggctgacgctgcaccaccgtgactcgatcacccagttccccccgtcggtacgggtcacccggcgcgtgcacgaccagcatcaccgtccactggagatcacggaccttgtcgcggatgcccgactggacgccctggtctacgagttcaccctgccggcggccggc

SEQ ID NO: 1295 - DNA, 741 bp, Streptomyces avermitilis
  CDS (1)..(741)
atgttctcaccgcacggtcccaccctccgcgaactggccgttcaggccctgtcgtccgtcgagcacggctatgacctgctcgcacccaagttcgaccacacgccgttccggaccccggactcggtcctggaagcggtcgagggtgccttggagccgatggggccgttcgaccgcgggctcgacctgtgctgcggcaccggggcaggcgtcgacgtgctgcgtacggtgtgccgggaaggcgtcaccggggtcgacatcagcgcggggatgctggcggtgggacgggagcaggcgcgggccgtcggccagcccgacgtcacatgggtccgcggtgatgcccgcgcgctgccgttcggccccgtgttcgacctggtcgtgagcttcggcgccttcgggcacttcctgccggccgagctgcccggtctgttcgctcaggtccactccgtgctgcggcccggcgggcggttcgcgttccccgtcgcggccccgccgcgccccgcctcgccctggtactgggccctgctgggcttcgacacggcgatgcgggtgcgcaacgccctgtggcgtccgccgttcgtcatgtactaccgggccttccgcctcggagacgtacgccgggaactggtgcgcgccggattccgggtggagctcgtcgccctgcccgggttcggacagcggcccgacggaagcccgcgctgccggatggtcgtggccacccgggagagcggtacggccggggcg

SEQ ID NO: 1296 - DNA, 1587 bp, Streptomyces avermitilis
  CDS (1)..(1587)
atgacttcgttccgtcccgcccccgcatggctggccgacgccgtcttctaccagatctatccgcagtcgttcgccgattccgacggcgacggcatcggcgacttcaacgggatcgtccagcgcctcgaccacctcgtgtggctgggcgtcaccgccgtctggctcaacccgtgcttcgtctccccgttccgcgacgcggggtacgacgtctccgactacctgaacgtcgcgccccgctacggctcggccgacgacctggccgagctggtcgacgaggcgggccgccgaggtatccgcgtccttctcgacctcgtcgccggtcacacctccgacgaacacccgtggttcacggcctcggcgaacgacccggacgaccaccgctacatctgggcgcccgagggccgcccggacggcttcgtcacctcgcccggcacccgtccgggcgcgtatctcccgaacttcttcgacacccagcccgctctcaacttcggctacggtcgcaagaacccggccgagccctggcgacagccggtcgacgccgcgggcccgcgcgccaaccgcgaggcactgcgcacgatcatggaccactggctgggtctgggcctggccggtttccgcgtggacatggcggcatcactcgtcaaggacgaccccggcaggacggagacggccaggatctggacggagctgcggcactggctggacacggctcacccggacgcggtgctgctgtcggagtggggcgagcccgaggtgtccgtcccggccggcttccacacggacttcttcctccagttcggcggcgcgacggacggcctgcccctgcgctcgctgtggagcaacggcgacggcacggtcaacgaggcctgggacccgctggactgcttcttcgacgcgagcggcaagggctcgccgcgccccttcgtcgaggcgtggcgcaaggcctccgacgccgtcggggccaccggcttcgtctccctgcccaccgccaaccacgacttctcccgcctcaactgcggtccgcgcacggccgagcagctccccgcggcgttcgccttccagctgacctggccgacactgccggcgatctactacggcgacgagatcggcatgcgctacgtcgggggcctgcccgacaaggagggcagcgtgctgggcccccgctacaaccgcgcgggctcgcgcaccccgatgcagtgggacgacggtccgggcgcgggcttctccacggccccggccgaccggctctacctgccgctcgacccgtccccggaccgcccgacggtggccgcccagcgcgccgacgacggctcgctcctccatctggtgcgccgcctcgtcgccctgcgcgcgagcacccccgcactcggctcgggcggctcggtggaggtgctgcacacggggtaccccttcgtgtacgtccggggcggccgctatctcgtggtcgtcaacccgcagcgcaacgaggtgcgttgcccctacgacgccacgcgggaggcacgcgcgctggaggcgtccggcgtgcgggtcggcaacggcaccatcgaggctgaagggttctcgtacggcgtcttcgacctgggccgg

SEQ ID NO: 1297 - DNA, 1329 bp, Streptomyces avermitilis
  CDS (1)..(1329)
gtgcgcggggtaccgcgagcaggcagactcgtccgtcgtacggccccgacccgacgccgcagtcaggagacctcgttggacacctcgtccggcacgcagccgcaccgcatggacccggccggcggctgtccgcacgccgacaacgcgcggctgctcgcgcggggcgccgtcgcgccggttctcctgcccggtgacatcgaaggcatggcggtcctcgggcacgacgcgctcaaggagttcctcgcgcaccccgaagtggccaagaacgcacggcacttcaccgcgctgcaagaggggcggaccgcgccggggtggccgctgctgaccttcgccaccgtgcaggggatgacaaccgccgacggtgaggaccaccggcggctcagatcgctggtgagcaaggccttcaccgcccgccgggtggagcgactgcgaccgtggatagaggagttgacgtccgcgctgctcgacggtctcgggcgcgcggccgaggagggcggccaggtcgccgatctacgagcgcacttcgcgctgcccctgcccatgggtgtgatcggtgaactgctcggcgtcgacgccgagcaccgggaccgactgcaccacctgtcgaaccaggtggtggccacggacatcgggcccgagcaggccatcgccgccaaccgggagctggtggccgtcctgagcacggtggccgccgcccgggccgagcgcccgggcgacgacctcaccagtgcgctgatcgccgcccgggacgagggcggcgaccggctcagccagcaggaactcatcggcaccctggtcctgatgatcatcgccgggcacgagaccacgctgaacctcatcaccaacgccgtacgcgcgctgtgcggcaaccgcgaccagctggagctggtgcgcaaaggagacgccggctggccggacgtcgtcgaggagaccctgcgctgggacgcccccgtcagctacttcccgttccgctacccggtgcgcgatctgacggtcgacggcaccgtcatccccgcgggcacccccgtcctggccggctactcggccgccggacgcgacccggccgcacacgggccggacgccgaccggttcgacgtcacccggcccgccaggtccgagaccacgcgccacctgtcgctcgggcacggcgcccattactgcctcggcgcgccgctggcccggatggaggccaccatcgccctggagcggctgttcacccgcttccccgacctcgaactcgccgtccccgaggcggaactggcgcgccactccagcttcgtgggcaacagcgtgcgggcgctcccggtgcggccgggagtcccccggagc

SEQ ID NO: 1298 - DNA, 1221 bp, Streptomyces avermitilis
  CDS (1)..(1221)
ttgacaggggaggcggggcgcgcgacggtggtcggcatggtcgatgccgggatcgtcgaacgcgtacgagcactgcgaccgctgatccgggagaacgcgctgcgcgccgagcgtgagcggcgggtgccggacgaggtcgtcgaggcgctgaccggcaccgggatccaccgtatgaacgtgccgcgccgctacggcggtcaccagactccgctgcggacccaggtcgacgctttcgccgagatcgccgccgagtgcgcttccaccgcgtggatgacgctgagtcaggcgggcgtctcgtacatcgcggcgctcttccccgacgaggcgcaggacgagttcttcaccggccccggcggcccggacgtcaggatcggcgggacgctgatccccggtgccacggcggtgccgtacggcggcggctaccgcgtcagcggcacctccgccttcgccaccggctgccatcacgcggactggcacctgctgacgaccgcggtggccgccgccgacggacagctcccgccggggccgccggagatcaggtgggccgccgtccccatggccgagctggagatactggacgactggcacgtcacggggctggccggcagcgggagcaacacggtcgtggcccgtgacgtcttcgttcccgcgcaccgcatgctcgcggtcgggccgatgctcgccgggcggttcccgtcgaaggccaacgcggacgaccccttctaccgtatgccggtactgctgctgttctgcgcctggtcggccccggtggcccttggcctggcccgggcggcggtggcggagttcaccgagcgcatccaccggcgcggcatcacgtacaccttccacgagcggcagaacgaagccacggtcacccatctccaggtggccgaggccgagatgagggtcggcggtgccgagctgcacctggcccggctgaccgccgagatcgaggccaaggcccgcgacgacctcccgtacaccccgctggagcgggcgcgcatccgggccgagagcggttatgtgacccggatctgccgggaggccgtcgacctgctcgccgccgcgagcggagcctcctcccttcaccaggaggtgcccatgcaacgcatcacccgcgacatccacgcgctgtgtctgcactccttcgtcaaccccaccaccaacatggagatctacggccgcgtgctgtccggcatggacccgggtactcccttcctg

SEQ ID NO: 1299 - DNA, 1137 bp, Streptomyces avermitilis
  CDS (1)..(1137)
atgaccaccacactcgaacaccctcccgtacagcagcagctcccggcccacgccaccggtgtcctcgacatcgcacagggcgggcaggggtacctgcgcaccgggaactgcctgcccactccgaacgacctccaggtccccgccgcgctgatccgccgtcacggcctgcgcaagggcgacgtcgtcgaaggcgtacgcggcggccagcgcggcctcaccgaggtggcgtcggtcaacggccgcgcccccgagcagctgcgcggccgcccccacttccgtgacctcaccccgctgcacccccgcgaacggatccggctcgaacaccccgcgggcgggctgtccacccgggtgatcgacctgatcgccccggtcggcaagggccagcgcgggctcatcgtcgccccgcccaagaccggcaagaccgtgctgctccagcagatcgccgcggccgtcgccgggaaccaccccgagtgccacctgatggtggtgctgctcgacgagcgccccgaggaagtcaccgacatgcggcggtccgtgcgcggcgaggtgtacgcctcgaccttcgaccgggcaccgaagcagcacatcgcgctcgccgaactcgtcgtcgaacgggccaagcggctcgtcgaacagggccaggacgtcgtcatcctcctggactcgctcacccggctgtgccgggcgcacaacaacacggccgccgccggaggccgcacgctcagcggtggtgtcgacgctgccgcgctccagggccccaagcggttcttcggcgcggcgcgcctggccgaggagggcggttcgctcaccatcctcgccacggccctggtggagaccggctcccgcgccgacgacttcttcttcgaggagctcaagagcacgggcaacatggaactccgcctcgaccgcgcaccggccgccaagcggatctacccggccgtcgacatcaccccgtccggcacccgccgcgaggaactcctgctgccttcggccgagttggccgccgtacgaggactgcgccgcgccctgcagacccgggacggccaggccaacctcgaaaccctcctggagcgcctgcgcgccacgccggacaacacggccttcctgcgccaggtccagccgacgctgcccgccgca

SEQ ID NO: 1300 - DNA, 1164 bp, Streptomyces avermitilis
  CDS (1)..(1164)
gtgtccggtatgactatcagattctcatcccgcatggttggctcctgctccgccctctgcgtggtcggcgcactcgctctggtgccgggcccggccgtcgcccgcaccggcgtcgaccctgctgccccaaaacccacggcgttgcagccgccgccgctgtaccggtccggcacgcaggtgcggccacgggccggggcacccgaggtcccgaacgtgtcggcgctgtcgtggctggtggccgacgcgggcaccggcgatgtgctcgcctcgcacgacgcgcaccgcccgctgccgcccgccagcaccctcaagacgctcttcgccctcaccatgctccccacgctgcccggcggcatccggcacaccgtcgcggagcgggaactggagggactcggcgacggcagcagcacggtcggcgtcacggaaggacagacgtaccaggtcacggacctgtggcgcggaatcttcctgcactccggcaacgacgccgtgcacgtactggcctcgatgaacggcggctgggacaccacggcccaccagatgcaggccaaggcccgcgccctgggcgccctcgacacccatgtcgtctcccccgacggctacgacgcaccggggcagacgtcgtccgcctacgacctcgcgatcttcggccgggccggtctgaaccgcgaggacttcgcccggtactgctccaccgtcgatgccacgttcccgggcaacggtggggcgtacgagatccagaacaccaaccggctgctgaccggcgccgacgggatcgcgccgtatcccggcctgatcggcgtcaagaacggctacaccagcaacgcgggcaacacactcgtggccgccgcgcgccggggcggccgcacgctcgtcgtcacggtgctgaaccctcagtcgggcggcggcttggccgtgtacgaggaggctcgctcactgctcgactgggggttcggcgccgccgggcgcgtcgaccccgtcgggtcgctgctctccgcgcgcaccgtggcgcaggcgggccccgccacgccggatgccgtcatggcgcaggacggtggcggtcccggctggccggtgacgggagcgatcgcgggtgcggccgccgtgggcgcgggggccgtggtgctggcgctgcgcttcaagggcgggcggtccgggcggcgc

SEQ ID NO: 1301 - DNA, 1380 bp, Streptomyces avermitilis
  CDS (1)..(1380)
gtgagactgccgcacaccgaccgggggcggctcgccctcgtgctgcccctcgccaccgccgtcgccgtcttcaccgccaccgtgccgctgctgcgcgactggttcgacctgcgcgtctactacgggaccgtcgacgcgtgggtgcaccacggcggccgtatctacgactaccgggtgccggggacgacgtacggattcacctatccgccgttcgcggccctcggcatgctgccgatggccctggtcggcctgccgacggcggtcgcgctcgcgctgctgctcaacctcgcggcgacggccgcggtgctgctgatcctcaccgggcccgctctgcggcgccacggctggttcggctgggccctggccggctgtgcgctggcgctgctcgaaccggtccgcgacaccgtcagcttcggccaggtcaaccttctgctgctggccctcgtgctcggcgacgcctggctgctgtccaccgggcgcgggcgccgggcgggcgtcggcatcggcctcgcgacggccgtcaaactgacgcccgcgctcttcatcggtctgctgctgctcgcccgccgctggcgggccgcggccgtcgcgacggcggtcgccggggccgccaccgcgctcgcggcgtgggcggcgccggacgcctcccgcttctactggacccgggcggtgtgggacaccgcccgcgtcggccgcctcgactatgtctccaaccagtcgctgcaaggcgtcctggcacggctcgcggcaccgggcgaaccgagccgtgcggtctgggcggtggcggtcgtgctggtcctggccgtctgggcccggcgcacccaccgcgccctgcgggcgggcgactggcgggccgccttcgccctcaccggcctggccgcctgcctggtcagcccgatcacctgggtgcaccatctggtctggctgctcccgtccttcgccgtcctgtggcgccgacgcctgccgcgggtcgccggcactctgtacgtggtgctgtgcagcagcgtcgtctggctgtggttcgacgacgcgtccggcgtcgacgggttcctcggcagcaacacctatgtgtgggtcactctcggactgctgctgcggctgccggtcggtcagcgccgcccggaccgcccgcccttgaagcgcagcgccagcaccacggcccccgcgcccacggcggccgcacccgcgatcgctcccgtcaccggccagccgggaccgccaccgtcctgcgccatgacggcatccggcgtggcggggcccgcctgcgccacggtgcgcgcggagagcagcgacccgacggggtcgacgcgcccggcggcgccgaacccccagtcgagcagtgagcgagcctcctcgtacacggccaagccgccgcccgac

SEQ ID NO: 1302 - DNA, 1398 bp, Streptomyces avermitilis
  CDS (1)..(1398)
gtgttggccatggctttccccgtcgatctccgccgctgtcaggccctcggcctggccggcaccgccttcctcgcggcgggcggtgagacggccggggccctgccggcccgcgagctgatcgcccccgagtccgggcgcgcggcgctcggactggtcggcgtgtacttcggcgtcgttctgctgatcgccgcgtgggcgctgctgggcacagtcgtacgaggccccgaaccgcccaccgtgcgctcgctcctgggggtgctcgccgcctgggcggcgccgctcctgctggcaccgcccctgttcagccgcgacgtctacagctacctcgcccagggcgccatggtcgacgcccacatcgacgtgtacgcgtacggccccgcgcggctcggcgggccgctcgcggaccaggtggccccggtctggcagcacacgccgaccccgtacggaccggtcttcctcgccgtcgcctcggccctgtccggcctgacgcgcggcgagctgccggccgggctgctcggcatgcggctggtcgcactgctcggggtggcgctgatggcggcggcactgccccggctcgcccggcacagcggcgtcgacccggccgccgcgctgtggctcggcgctctccacccgctggtgctgctgcatctggtcgcgggggcgcacaacgacgccgtcatgctggggctgctcggcgccggactggtggccgcgcgcggccggtggcacgtcctgggcgtcgtcctcgtgacgctggccgcgctggtcaaggcgccggcggtgctcggcctggtcgccgtggtggcattgcgccgacacgtcggtgtggcgcgggcggtggcgacgaccacggccggcgcgctcgccacgaccgccctggccaccgccgtcgccggtacgggatacggctggatcgccgccctcaagacccctgtctcgccccacaactggtcgcccaccagcgtcctcggccgtgccaccggcgccctgctggagaacctcggcagcgatctcgcgcccctcgccctgccggcctggcaggcggccggactcgtggcgaccacggccgccgtcctgttcatctggctgcggctgcggcccggcccggtctacgcgctcgggctgagcctggccgtggtggccgtcctcggccccgcgatccggccctggtacgcgctgtggggcctgttcctcatcgcggcggccgcccccagcggttccctgcgccaccgtgtcgccgccgctgtcggctgcgtgctcgcgctcgcggtgctgcccaacggcggaccgccggacaccgcgcaggtggtcctggccgtctccggtggtgtgctcgccctggtcgtgctctggcaggctcatcagacggcgcgggcaccggtgccggggcggaccgcg

SEQ ID NO: 1303 - DNA, 939 bp, Streptomyces avermitilis
  CDS (1)..(939)
atggtgatcatgtccgcgtcctggtcgtcccacgccttccagccggtcctggagcgcatcgccgacgagatcgagcgcaccccggggcgcggccggcccgccgactacattccggcgctggccgcctgcgacccgcgccgcttcggcatggccgtcgcggagctcgacggcacggtgtacggcgtgggggactggcggcagccgttctccacgcagtccatcaccaaggtgttcaccctcgccctcgacctggcccgcgagggcgacgccctgtgggagcacgtgggccgcgaaccctccggcaacccgttcaactcgctggtccagctggagtacgagagcggcatcccgcgcaacccgttcatcaacgcgggcgccctcgtcgtcaccgaccggctccagacacagaccggcgacgcggccgggtcgctcctggagttcctgcgcgccgagagcggcaacccccggctgaccttcgaccaggacgtcgccgcctccgaggccgcgcacggcgaccggaacgccgcgctcggccacttcatggcgtcgtacggcaatatcgacaactccgtgccggtgctcctcgaccagtacttccggcagtgctccatcgaggcgtcctgcgccgacctggcgctcgccaccggcttcctggcccggcacggcatccgcgccgacggctcccggctgctcacccagagccaggccaagcaggtcaacgcggtcatgctgacctgcggcacgtacgacgcggcgggcgacttcgcctaccgcgtgggcctgcccggcaagagcggcgtcggcggcggcatcatcgcggtcgtccccggccgctgcacgctgtgcgtgtggagcccgggcctcgacgagcgcggcaactcggtggcgggcgtcgcggccctcgaccgcttcacgaccctgacgggcgtgtcggtgttc

SEQ ID NO: 1304 - DNA, 1410 bp, Streptomyces avermitilis
  CDS (1)..(1410)
atgaccgccgcagcccaccgcagcgaacacgacctgctcggagaccgcgacgtccccgccgaggcgtactggggcatccactccctgcgcgccaaggagaacttccccatcacggggacgccgatctccacgtacccgcatctgatcgacgccctcgccgccgtgaaggaggccgccgccctcgccaacgaggaactcggcctgctggagccgaagaaggccgcggccatcgtggccgcctgccgggagatccgggacggcaagctgcacgaccagttcgtcgtcgacgtcatccagggcggcgcgggcacctcgacgaacatgaacgccaacgaggtcatcgccaaccgggcccttgaactgctcggccacgccaagggcgagtaccggcacctgcaccccaacgaggacgtcaacctcggccagtcgaccaacgacgtctacccgaccgccgtgaagatcgcgaccgtgttcgcggtgcgcggtctgctcaaggccatggcggtgctccaggacgccttcgcccgcaaggccgtcgagttccgtgacgtgctgaagatgggccgcacccagctccaggacgcggtgcccatgacgctggggcaggagttctccgcgtacgccgtcatgctcgacgaggaccgcagccggctcgccgaggccgtcgaactgatccacgagatcaacctgggcgccacggcgatcggcaccggactcaacgcgcccgccggatacgccgagtcggcccgccgccagctcgccgccctcaccgggctgccgctggtcaccgccgccaacctggtcgaggccacccaggactgcggtgccttcgtccagatgtcgggggtgctcaagcggatcgccgtcaagctctccaagagctgcaacgacctgcggctgctgtcgtccgggccgcgcgcggggctcaacgagatcaacctgccgccggtacaggccggttcgagcatcatgcccggcaaggtcaacccggtcatccccgaggtcgtcaaccaggtcgccttcgaggtcatcggcaacgacgtcgcgatcaccatggccgccgaggcggggcagctccagctcaacgccttcgagccgatcatcctgcactcgctgtccgagagcatcacgcatctgcgggccgcctgcctgacgctcgccgagcggtgcgtcgacgggatcacggccaacaccgaggaactgcgcgccgccgtggagaactccatcggcctggtgaccgccctcaacccgcacatcgggtacacggcggccaccgccatcgccaaggaggccctcgccaccgggcgcggggtcgccgaactcgtcctggagaagggcctgttgccggccgaccggctcgcgtcgctgctgcggcccgaggtgctcgcgggcagcggctccccgcagatc

SEQ ID NO: 1305 - DNA, 984 bp, Streptomyces avermitilis
  CDS (1)..(984)
gtgatccgggagcccctgcacacccccgtcgcccacctcgtacgcgaaggggtcatcgagggcatccactacgggtccgtcgtggtgctcggcgccgacgggaacgtggacctgcagatcggcgacatcgaggcggccttctatccacgctcggccctcaagcccgtacaggccgtggcgatgctgcgggccgggctgcccctcgacggggaactgctctcgctggccgccgccagccactccggcgaggagcggcatctggccggcacccggcggatcctggagcgggccgggctcaccgaggacgatctgcgcaatgtgcccgacctgccgttcgacccggtcgtgcgggagtcctgggtgcgccaggggcggctgccgtcccggctcgcccagaactgctccggcaagcacgcggccatgctgtacacggcgaagctcaacggctggtccctcgacgactgtctcgatcccgcgcacccgctccagcaggccatcgccgagatcgtcgaggacctcacagggcaggccatcgccaaggtgaccgtcgacggctgcggcgcccccctcttctccgtctccctgcacggcctggcgcgagccgcggcccggatcaccaccgcgccttcggggaccccggaggcgcgggtggccgacgcgatgcgcgagcacgccgagatggcctccggcaccggacgcgacgtcgccgcgctgatgcgggccgtgcccggactgctcgccaaggacggcttcgagggcgtacaggtcgccgcgctcccggacggccgcgccgtcgccgtcaagatcgccgacggcgcgaaccgggcgcgtgtcccggtcgccgcggccgccctcgcgcgcgccggtgtcgacccggcggcgctcgccgagttcgcgggcgagccgctgctcggcggcggccggccggtcggcggcgtccggcccgtccgcgctctcgatcccctcacccggcacacgtactcc

SEQ ID NO: 1306 - DNA, 1458 bp, Streptomyces avermitilis
  CDS (1)..(1458)
gtgagcgagcagtccctcaaaggcgaggcccaaggcgcgatacggaccgggacgcagccctcgcggcacgtcgacgccggagacgcgggctacgccaagtccctgaagtcccggcacgtcaacatgatcgccatcggcggcgccatcggcaccgggctcttcctcggcgcgggcggtcgcctcgccgacgcgggaccgtccctcttcgtcgcgtacgcggtctgcgggatcttcgccttcctcgtcgtccgggcgctcggcgaactcgtcctgtaccggccctcctccggcgccttcgtgtcgtacgcccgggagttcctcggcgagaagggcgcgtacacggccggctggatgtacttcctcaactgggccaccaccggtatcgccgacatcaccgcggtggccgtctacacccactactggggcatgttctccgacatcccgcagtgggtgatcgcactgatcgcgctcgccgtcgtcctcaccgtgaacctgatctccgtacgcatgttcggcgaactggagttctggttcgcgatcatcaaggtcagcgcgctcgtcgtcttcatgctcatcggcatcttcctgctggtcacccagcacccggtcgacggccaccaccccggcccgtccctgatcaccgaccacggcggcatcttcccccacggcctgctgccgatgctgctgatcatccagggcgtcgtcttcgcgtacgcctccgtcgagctggtcggtgtcgcggcgggcgagaccgagaaccccgagaagatcatgccgaaggcgatcaactcgatcatgtggcgcgtcggcctcttctacgtcggctcggtcgtcctgctgtcgatgctgctgccctggaacaagtacaccgccggccagagccccttcgtgaccgtcctctccaacatcggcgtcccggcggcgggcggcgtgatgaacctcgtcgtcctcaccgcggccatgtcctcgctcaactccggcctgtactccaccggccgcatcctgcgctccatggccatgtccggctccgcgccgaagttcaccggcgtgatgagccgcagccaggtcccctacggcggcatcctgctcaccagcggcatctgtatcctcggcgtcggcctcaacttcgtggtcccggccgacgccttcgagatcgtgctcaacttcgcggcgatcggcatcctcgccacctggggcatgatcatgctctgccacctcatgttctggcggaagacccgcaccggcgagctgtccaggccgagctaccgcctccccggctcgccgtggaccgagatcgtcaccatcggcttcctcgtcagcgtgctcgtcctgatgtacgccgacggcggcgccggccgtacgacggtgctgtgcctgccgctgatcgcggcggcgctggtggccggctggtacggcgtacgcggccgggtcgcccgcaaggcctccggagcggacgcg

SEQ ID NO: 1307 - DNA, 765 bp, Streptomyces avermitilis
  CDS (1)..(765)
gtgaacctgtcagacagccagacaggtggtgcggtaccgcggcgcgtcagcgccatggaagcggtgctcagccaccttcgcggcgccatcgagcgcggcgactacgccatcggcgagaagcttccctccgaggccgagctgtgccgacgcctggaagtcagcaggccggtgctccgcgaggccctgcgcgccctccaggtgatggggctgaccgcgtcccgcaccggcaagggcaccttcgtcctggctcacacggtcgaggaccccaccttcggcgactacgtggccagcgacctgctggaagtccgccgccacgtcgagatcccggtcgccgggtacgcggcgctgcggcgcactcccgagaacctcgaccacctcgcccatctcctggaccgcatggagcgggagacggacaccaccgcgtgggtcgcgatggacacgctcttccacctcacggtcgccgaggccgcccagaacccggtcttccgccgggtgatcgaggagatccgcgacgcgctggcgcgtcagtcggccttcctcaacgaactgggcggccgtcgcgaacagtccaaccgcgagcaccgggcgatcgtcgaggcgctgatcgaccgcagcgagcacgacgcggtggaggccatgtcccaccacctggaccgcgtcgagacgaccctcaccgacatcgtgcgcaccccgcgcacggacacccccacccagatccccacggactccacggcaccatccccttcggaaggcggaccccaggcg

SEQ ID NO: 1308 - DNA, 831 bp, Streptomyces avermitilis
  CDS (1)..(831)
atgagcgtcatcaacgtcggtcaggccgtcgtcctcggagccgtcgagggcgtgaccgagttccttcccgtctcctccaccggccacctcaagatcaccgaggggctgatggggattcccgtcgacgacaacgccgtcgtcgggttctcggccgtcatccaggtcggcgcgatcgcggccgtgctcgtgtacttcttcaaggacatcgtgcggatcgtctccgcgtggggacgcggactgcgcaaccgcgacgagcgtcaccaccacgactacaagttcgcctggtgggtcatctacgccaccatcccgatcgtgatcgtgggcctggccgccaagtccctcatcgagggcccgctcgcctcgctgtgggtggtcgcggcctcgctgatcgtcggcagtggcgtgatgtgggcggcggaccagatgggccggcacaagcgcggcgaggacgacacctccttcaaggacgcgatgctggtcggcagctcccagatcctcgcgctgctctttccgggcttctcccgctccggcgccacgatgtccaccgcgctcatcctcgacctcgaccgcgtcgccgccacccgcctctccttcttcctcggcatccccgccctcaccggagccggcctgtacgagctgaaggacgccctgggcacgggcgtgggcgtcgccccgctggccgtcggcacgatcgtgtccttcgtggtcgcgtacggctccatctcctggctgctgaagttcgtcgccaagcactccttcaacgccttcgtgatctaccggatcgtcatcggcgtgctgctcctgggcctgctcggcacgggtgtgctcagc

SEQ ID NO: 1309 - DNA, 372 bp, Streptomyces avermitilis
  CDS (1)..(372)
gtgaattggctgctggtgatcgccggtgccatggtcggcgcgcccctgcggtacgtgaccgaccggatggtgcagctcaggcatgacgccgtcttcccctggggtaccttcgccatcaacgtcacgggctgtctcgtcctcggcctcctgaccggcgcggcctcggcgggcgtcgcctccccgcacctggagctcctcctcggcacgggtctgtgcggggcgctgacgacatactcgacgttctcgtacgagacactacggctcaccgagaccggcgcggggttctacgctgccgccaacgcgatcgcgagtgtggcggcggggctcggcgcggcattcgccggggtctggttcgcccaggctctgtgggcg

SEQ ID NO: 1310 - DNA, 240 bp, Streptomyces avermitilis
  CDS (1)..(240)
atgacaaggctcacaggcggcgcgctccgcgtgacggtcctcatcggcgagagcgacacctggcaccacaagccgctctacacggagatcgtgcaccgcgcccacgcggccggactggcgggagcgagcgtcttccggggaatcgagggcttcggcggctccgcgctgatcctcgacgactgcgaggtcatccggtacgcggcccgcgagaacccgggccggaaaggtgagaagtcgttg

SEQ ID NO: 1311 - DNA, 474 bp, Streptomyces avermitilis
  CDS (1)..(474)
atgacagtcccgcaccccgaaagcgtcggcgaacccggcatcgccgtacgcgcccccgcccgacggcgctccgcctggcacggccaggcccccgtcgtggcggtcgtcgcgctcggcggcggcatcggcggcaccgcccggtacgcggccgcgctgctgtggcccacgcagtcgggcggattcccctggaccaccttctgggtcaacgtcgtcggctgcgccgtgatcggcgtcttcatggtcgtgatcaccgatgtgtggccggcccaccgactggtacggcccttcttcggcaccggggtgctcggcggcttcaccaccttctcgacgtacgccgtcgacatccagaagctggtcgacgcgggccatccacgcaccgcgctggcctacctcgccgcgaccctgctcgcggccctcgcggcggtccggctcgcggcgacggcggcccgccgcgtcctcgtacggaggcggcga

SEQ ID NO: 1312 - DNA, 285 bp, Streptomyces avermitilis
  CDS (1)..(285)
atgctgaagctacccatcagcgagaaacgcctggagatcctggagtggctgaaggacccggccgcacactttccgccggaccggcacggcgacctcgtcgaggacggcgtcaccgcggcggccgtcgcggtgaagctcggcgtccgcagagcggtcgccgacacccatctcggcctcctcgccggcatcggtctcctgcgcacgaagaggatccgccgacgcacgtactaccgccgcgacgaagtccgcatcgccgaggtcggacgcatgttcgagaagggctgg

SEQ ID NO: 1313 - DNA, 1566 bp, Streptomyces avermitilis
  CDS (1)..(1566)
atgttccacgcgagacgcgccctacgggccctgctgataccgctcttcgcaggtctggcgctcaccaccctgcccgccacctcggcacgggccgccgccacgctcaccaatcccggcttcgagtcggacggcaccggcaccgcgacgccggccggctggtcgacgtactcggcggccggccagaacgccgcctccttcaccgagtccggtgggcgcagcggcagttaccgcctcacgcactggtcggcctcggcctacaaggtcgagacgtaccagtacctgtccgggctggccaacgggaactacacgctcaccgcctgggtccgctcgggcggcggccagaactccgcctatctggcgctgaagaactgcggaggcaccgagcagcgcacggacctgccggtgtccgccggcggctggatccggatcgtgacccccgtcgcggtgaccggcaaccagtgcacgatcagcgtcaactccgacgccaacgcgggcaactggctcaacgtcgacgacctgaccttcacctccggcacgaccggactcggcatcaagggctccgacatctcgtcgctggccaagagcgaggcgttcggcggtgtctacaagaccggctccggcacgaccggcgacgccctcaccatcctcaagtccgccggtatgaactacgcccgcctcaaggtgtgggtgaacccggccgacggctacaacaacaagacgcgcgtcctcgccatggccaagcgcgtcaaggcgcagggcatgaagctgctcgtcgacttccactactcggacacctgggccgacccgggcgcgcagagcaagccggccgcctgggccgggcactcgtacagccagctcaagacggacgtctacaaccacacgtacgacgtcctgagcgccctcaagtcgcagggcaccacggccgacatggtgcagatcggcaacgagatcaacggcggcatgctgtggtccgagggctccacggacaactggccgcagctcgccggcctgctcaactccggctacagcgcgaccaaggcggtctcctcgtccacggtcgtggcgctgcacctcgccaagggcggcgacctcgcgggaacccgcgcgtggttcgacaaggcggtggcgggcggcgtgaacttcgacgccatcggtctgtcgtactacggttactggcacggttcgctgtacgacttccagaccacgttggacgacgcggcgtcccggtacggcaagccggtcttcctcgccgagacggcctaccccttccgtctcgacagcgacgactcgctcaccaaccagatcgacaccaccggtgagctggtgtccggttacgccgccaccacggccgggcagtccgcctggctgcgcgacgtgatgaacatcgtggaggccgtgcccaacggccgtggcctcggcgtcttctactgggaggccacctggacggcggtcaccggcaacggctgggacccggccgacgcggcctccggcaacggctgggagaaccaggccctgttcggctacgacgacaaggcgctgccggcgatgacgttgttcagccaccgc

SEQ ID NO: 1314 - DNA, 2019 bp, Streptomyces avermitilis
  CDS (1)..(2019)
atgccggagaccacccccaagggcctcaccaggctcgccttcggtggggactacaaccccgagcagtggccggaaaccgtatggcaggaggacgtccggctgatgcgagaggccggcgtcaccatggtgagcgtcggcatcttctcctgggcactgctcgaaccctcgccgggcgcctacgacttcggctggctcgaccgcctgctcgacctgctgcacgagaacggcatccgcgcggacctcggcacgcctacggtggcaccgcccgcctggttctaccgcgcccaccccgaagcgctgccggtgaccgccgacggcacccgctacgagttcggctcccgcggcgccatctgccacagcaacgcggactaccgggccgccgccgcgaacatcaccacccggctcgccacccgctacgccgagcaccccgccctcgcgctgtggcacgtccacaacgagtacggcgtccccgtctcggcctgctactgcgagagctgcgccgcccatttccgccgctggctcacggacacctacggaacgatcgacgccctcaacgaggcatggggcaccgccttctggggccagcgctacgccggcttcgaccagatcaacccgccgcgcctgacgcccacggtcggcaatccgggccaggcgctcgaccacaagcggttcgccgacgccaccatgcgcgagaacttcgtcgccgagcgggacatcctgcaccgcctcgcgcccggcatcccggtgaccaccaacttcatgaccgccctgagccagtgcgactccgtggactactgggcctggggccgcgaggtcgacctcgtcaccaacgaccactacctgatcaccgacggccgccgcacccacgtcaacctcgcgatggccgccgacctcacgcgttccgtggcgagcggcgccccctggctgctgctcgaacactccacctcgggcgtcaactggcagccccacaaccccgccaaggctcccggccagatggcccgcaactccctcgcccatgtggcacgcggctccgagggcgcgatgttcttccagtggcggcagtcccggcgcggcgcggagaagttccactcgtcgatgctgccgcacggcggcacggacacacgggtgtggcgcgaggtggtcgaactcggctcctccgtcgactcgttgcgttcgatccgcgggacccggacccgcgccgacgtggccgtcctgtgggactggcagtcctggtgggcgcagaacctccagtggcgccccagcgaggaccacgatccgcgcgagcgtgccgacgcgttctacgaggcgctctacgaccgccacctgaccgtcgacttcgcgcacccggaagccgacctgtcggcctacccgctggtcgtcgtgcccgcgctctacctgatgaccgaggccgccgggaacaacctcgaggagtacgtcgagaacggcggcacccttgtcgtctcctacttctccggcatcgtcgacgagcacgacgccgtgcacgacggcccctacccgggcgccctgcgtgacgtactcggcctgaccgtcgaggagttctcgccgctcctgaaggacgaccggatccgcgtcaccggccccgacggctccgagctcacgggcgacgtgtggagcgagttcgtggtgccccgcggcgccgagaccgtctggacgtacgccgacgggctcaccgcgggccaccccgcggtcacccggcaccggttcggcgagggctccgcctggtacgtctccacccggctgaccgcccagggcctcgacgcccttctgggccgggccgccgacgacgcccggatcgcgccgcgcgccgatctgccccgcgatgtcgaagtggtgtgccgcacgggcgagtccggcaccttcctgttcgccgtcaaccacaccgcgctcgacaccaaggtgccgctcgacgcccacggcaccgagctgctcacgggtgagcgcgccgccggacaggtgtccgtgcccgcgggcgccgtcagggtcgtacgactcgacggc

SEQ ID NO: 1315 - DNA, 1317 bp, Streptomyces avermitilis
  CDS (1)..(1317)
atgccaaacacgaagcactgccgcctcgtggccaccgccctcgccgtcgcgctcggcgccaccacgctcgccgcctgcggctcgtccgacgacgacagcgacgcccggtcggggcccgcctcgctgacgtactggacctggacgccgggcatggacaaggtcgtggacctgtggaacaagggcccgggcaagaagcagcagatcaccgtcacggtgaagaagcaggcgtccggcgacaccctggtcaccaagatcctcaccgcgcacaaggccaagaaggcgcccgacctggtgcaggccgagtaccaggcgctgccgaccctggtcagcaatgacgccctcgccgacatctcgaagaacgcgggcgacgcgaagggcaagttcgccgagggcgtctggcagcagaccacgctcggctcggacgcggtctacgcgataccgcaggacatcgggccgatgatgttctactaccgcgaggacctcttcaagaagtacggcctgacggtgccgacgacctgggagcagttcgcgaagaccgcccgcgcgctgaagcacaaggccccggacaaggacctcaccaccttctcctccaacgactccggcctcttcgcgggtctcgcgcagcaggccggcgccaagtggtggaccacctcgggccagaagtggaaggtcggcatcaacgacgcggcgtcgcagaaggtcgccgacttctggggcgggctcgtcaaggagggggcgatcgacaaccagccgatgtacaccccggcctggaacaaggcgctcaacaccggcaagcagatcgcctgggtgagcgcggtgtgggcgccgggcacgctgaccagcggcgcgcccgacaccaagggcaagtggaagatggccccactgccccagtggggcgacagcgacagcgtcaccggcagctggggcggttcgtcgaccgccgtcaccacggactcgaagcaccaggcggccgccgcgaagttcgcgacctggctgaacacggatcccaaggcgctgaccgccctcgcgaaggagagcggcatctacccggccgccaccacggcgcagaccagtgacgcgttccaggaaccgccggccttcttctccaaccagccggacttctacccgcaggccgcgaagatcgccaagacgaccgcgccgtccgcctggggcccgaacgtgaacgtcgcgtacacgaccttcaaggacgccttcgccgccgccgccaagaacaagtcggacttcggtgccgccctggccaagatgcaggacgacacggtcgccgacctgaagaagcagggcttcgaggtctccgag

SEQ ID NO: 1316 - DNA, 921 bp, Streptomyces avermitilis
  CDS (1)..(921)
gtgaccagtgcgcgccggacgtcgtacggggtcaagggggccccgtacgccttcctcctccccgcggcgaccctcttcgcgctgttcttcgcactgcccatcgggtacgcggtctggctcagtctccacaaggtgcgcgtctttggcctcggcctgggagcgggcgcccggaaagaggtctgggcgggcctggagaactacaccgacgccctcaccgactccgcgctgctccacggcgcgctgcgcgtggtcggctacggtgccatcgtcgtcccggtgatgctcggcctcgccctggtgttcgcgctgatgctcgacaccgaccgggtccggctggcccccttcacccggctcgcgatcttcctgccgtacgccattcccggcgtcgtggcggcgctgctctggggcttcctgtacctgccggacgtcagcccgttctactacgtgctgaacgggctcggcctgccgcagcccgacctgctggacggcggcccgctgtatctcgccctgtcgaacatcgcggtgtggggcggcaccggcttcaacatgatcgtcatctacacctcgctccaggccatcccggtggaggtgtacgaggcggcgaagctggacggcgccaccccgctccagatcgcgctgaagatcaagatcccgatggtggctccgtcgctggtgctcaccttcttcttctcgatcatcgcgacgctccaggtgttcagcgagccgaccaccctcaaaccgctcaccaactccgtttccacgacctggagtccgctgatgaaggtgtaccaggacgccttcggcaagggcgacatctacgcggccgccgcagaggccgcgatcatcgccgtcgtcacgctcgttctgtccttcggcttcctgcgggccgcgaactccggcaacaagcaggaggaagcacga

SEQ ID NO: 1317 - DNA, 903 bp, Streptomyces avermitilis
  CDS (1)..(903)
atgagttctcttgcgctgcgcaagtccgcaccggccgccggtacgacgcccggcaccgcccagggtccgccgctgcgccgccggatcgccctggtcccgacgctgacgctgctgctcggcgccctgtactgcctgctgccggtcgcctgggtggtgatcgcggccaccaagtcgggccgtgagctgttctccaccttcaccttcctgccgggcaccggcttcacccagaacctcaaggacctcaacgcctaccgcgacggcctctactggacgtggatgggcaactcggccctctacgcgggcctcggcgccctcctgtcgacggccgtgtcggcgctcagcggctacgcgctcgcggtctaccgcttccgcggccgcgagaccgtcttcaacgtcctgatggcgggcgtactgatgccgccggtcatcctcgcgatcccgcagtacctgctgctggccaaggcggacctcacggattcgtacgcgtccgtgctgctgccgctgatcctgtccccgtacggcgtgtacctcgcccggatctacgcgagtgccgcggtgcccggtgacgtcgtcgaggccgggcggatggacggggcgagcgagtggcggatcttcatccggatcgcgctgccgatgatggtgcccggcctggtgacggtgttcctgttccagttcgtcgccgtctggaacaacttcctgctgccgtacatcatgctcagcgacgacgagaagttccccatcacgctcggtctgttcacgctcctcgagcagggcgccaacaccccggcgttgtacacgctggtgatcactggggccacgctggcggtcctcccgctgatcgccctgttcctggtcatccagcggttctggagtctggatctgctgtccggggccgtaaagtca

SEQ ID NO: 1318 - DNA, 1029 bp, Streptomyces avermitilis
  CDS (1)..(1029)
atgaccatgcacgcgacgggcggcaggcgcaggccgccgacgatccatgacgtggcgcgcgaggccggtgtctcgcgcggcacggtgtcccgggtactcaacggcgggcactacgtcagcccggcggcgcaagaggcggtcaacgccgccatccgcaggacgggctacgtcgtgaaccggcacgcccgctccctgatcaccgggcggtccgactcgatcggcttcctgctgaccgagcctcaggagcggttcttcgaggaccccaacttcaatgtgctgctgcgcggctgtacgcaggcgctggcctcgcacgacatccctctgctgctcatgctcgccggcaccaaggacgaacggcggcgcataacgcggtacatcacggcgggccatgtcgacggggtgctgctggtctccagccactcgggcgatccggtcgcggaggagctgcgggaggcgggcgtaccgctggtcgcctgcggcaagccgatcgggctgggctccaaggtgagttacgtcgcggcggacgaccgggacggcgcccgtgacatggtgcgccatctgctgtcgctgggccgccgccgcgtcggcgtggtcaccggaccgctcgacactccgggcggtgtggagcggctcgcgggctaccgggaggtgctcgccgaggcgggcctcgagtacgacgagcggctcgtcgtccccggcgactacagccgggcgagcggtgcggccggcgccgagcggctgctggagcgggcgccggagatcgacgcggtcttcgtggcgtccgacctgatggcgcagggtgtgctgacggtgctccgacaggccgggcgccgggtccccgaggacgtggccgtgggcggcttcgacgactcccccgccgccaccgcgtccactccgtcgctcaccaccatccgccagccctgggaccggatcagcaacgagatggtacgcgtgctgctggcccagatcggcggcgaggacccggcggcggtgatcctgcccacggagctggtcaggcgggagtcgact

SEQ ID NO: 1319 - DNA, 354 bp, Streptomyces avermitilis
  CDS (1)..(354)
atgaccgccggcctcaagaccatcatctaccccgtcaaggatctcgctcgggcgaaggcgctgttcggcgcgctgctgggcgtggagccctacgcggacgaaccgtattacgtgggcttcaaggacgcggggcaggacgtcgggctcgaccccaacggacacgccaaggggatgaccggcccggtgccctactggcacgtgaccgacatcaggtcccgcctgtcggccctcctgaacgccggggccgagccccttcaggacgtccaggacgtcggcggcggccggctgatcgccttcgtgaaggacgcggacgggaacctcatcgggctcatccaggagccggccgcacaccag

SEQ ID NO: 1320 - DNA, 387 bp, Streptomyces avermitilis
  CDS (1)..(387)
atggcagcgaaaacgaccggtgcccggctcgaggagcagtggcgggacatcctgtcggtgcacgcccgcacgatgtgcgagatcgaccgtgcgctccacccgtacggcctcggcgccagcgacttcgaggtactcgacatcctcgcgacggagtcggccgaggccggcgaccagtgccgtgtgcagaacatcgccggccgggtccatctgagccagagcgccctgtcccgcctgatcggccggctggcgaaggacggtctggtggagcgctccgtctgcgaggaggaccggcgcggagtgtgggtcgccctcacccgcaagggacgcgacctgcacgccgaggcactgccgctgcaacgggccgccctggcccgcgtgttgaacgcc

SEQ ID NO: 1321 - DNA, 1026 bp, Streptomyces avermitilis
  CDS (1)..(1026)
gtggaacccggtgtgatcaccgccgttctggaccgtgcggccggtgcgcacgggctgcggtacgcgcccgatccggcgagcgcggccctgtcgacgatcggcgggaacatcgcgaccaacgcgggcggtctgcgctgcgcgaagtacggcgtgacccgggacagcgtgctgggtctggaggcggtgctcgcggacggcacggtcgtgggcacgggccgccgtacggtcaagggcgtgaccggctacgacctcaccgccctgctcaccggctccgagggcaccctggcggtgatcacgtcggcgactgtacggctgcggcccgtgccggtggcgacggccacgctcgccgccttcttcgactccttcgaggcggccgccgaggcctcgtacgcgatcggccgggccggtatcgagcccgcgctcgcggaactggtcgacggtccggtcctgcacgccatcgacccggcgctgcgggagcgcggcgcggcgctgctgctcgtgcagtgcgacggcgcgggcgcggccgccgaggcggaagtggtcgcccgggtgctcgcgccgtccgccacggccgtcgagacgaccacggaccctgtcgaggccgagtccctgctcgccgcccgacggctcgccctgcccgctctcgaacggctcggacgcccgctcatcgaggacatcgcggtgccccgctcccggctcgcggaggccgttcgcgagatccgcgccatctccgcacgccatgacgtgcccgtcttcaccatcgcgcacgcggcggacgggaacctgcacccgatcatcgtggtggaccggtccctgccggggctccccgacgcggcctgggaggcggcgggcgagatcttcgcactggccctgcggctgggcggcacgctgacgggtgagcacggcgtgggcgtcctgaagcggcagtgggtggcggacgaactggggcccgcggcccacgcgttgcaacggaggatcaaacgggcgttcgaccccaggggggtccttaaccccggaaagtgcctt

SEQ ID NO: 1322 - DNA, 417 bp, Streptomyces avermitilis
  CDS (1)..(417)
atggacacaccctcgaacgaccgcccgacgcccgagaccgccgccgcagcgcaggaggcgctgaccgcactctccgtccacacgatggacacggaggcgctggacacgctggccgacagcgaggtgctggtgcccgtccccgacgacgccgccgagccggacgcctccgacccctcgatcgtggccctgcccgtcctggaggagtcgggcggcgaacagaccgtgcccgtgttcacctcggagccggccatggccgaactgctgccgttcgtctcgcgctaccgggtggtgccgctcggcgcgctcgcctcgcagtggccgtccgccggtctctcgctcgccatcgacgccggctcaccgcacggactgacgctcgactccgacggcgtacgcaccctgctggcccggccctccgcg

SEQ ID NO: 1323 - DNA, 1191 bp, Streptomyces avermitilis
  CDS (1)..(1191)
atgggagatatggatgcccgccgtgtgtcagtggaccgcctcgtggggcggtcgtcgggccaggggctggtggcgatcccgctcgcgctgatcgtggtgatcaccgtggtggacatccactccccttcgaccatccatctgggtccgttgctggtcatcgcacccgcactcaccgcctccatcgccgggccgcggctgaccgctctggtcggggtggtggctgtggccgcccaggtgttcatcgcggtgttccacggcgggctggccacggccaaccacatcgcgcagatcatcgccctgtccgtgctctccgcactggtggtcttcgtctgccatgtacgggagcggcgggatcgggagctgagccgggcgcgatcggtggccgagacggcgcagttggctctgctgcggccgccgccccgccggatcgggccgttgcgcgtcgcctggctgtacatgaccgccgaggacgagacccagatcgggggcgacctcttcgcggtcgcccgcgccgcccacccctccacccgggtgatcatcggcgacgtccgcggcaagggcctggcctccatcggcgaggcatcggtggtgctgggctcgttccgtgagggcgcccaccgctacgccaccctgcccgagctgacggcggcgctcgaggtgagcgtgtgccgggacctggaggacgtggccgatacgaggcacgaccccggagagcacttcaccaccgcactcgtactcgacatccccgacgacgactcacaggccgagatgatcgactgcggccatcccccacccctgctgctgcacgatcaccaggtcacggtcctgtacccccgccgtcccgtacccccgctgggcatgtgcgaactgcccgccgcgagccaccgcaccgacccgttcgccttcgaacccgacgacatcctcctgctctacaccgatggcgtcatcgaagcccgctcaccaacgggcgccttctacccactcgccgagcgggtcgcctccttccccacctccagccccgacaccctgctgcgccacatccacgatgacctgctccaccacatcggcggccaacccgccgacgacgccgccctcctgatcatcgaacgcaccgcctcccacctccaccggccgcacctcccggcccgcaccctggacggccgccggcggatccaccacggtggatcctct

SEQ ID NO: 1324 - DNA, 495 bp, Streptomyces avermitilis
  CDS (1)..(495)
atgcagggaaaccagacatcggtgatgaccgccgtgcacggccggttgcccgggtcacgggccggcgcctcaccgcggcgggccgagggcaggcaccggcgttccggacggcgagggggccggtggcatcgcaggctgctcgcctatcgcgatgtcgagctggtgcagtgccccgcgcctgacggccggggtgaggactgtctgctgctggtgcacatccgcaaggtggtcggccgggtgacgtatcaggcgtgtgacgagtgcgccgagggcgtgatcaccgatgtggtcctcgatgggccgttccgcgacagcgggctgggcacgagggcgctgctgcatctgcgctcccggcatcccggtgtcacctggcgcaccacgctcgaccatcgcctcacgcgtggtctgctgcgccggatgcgcatccccaggacagtcgttgacggaagttgttcccacgtgcgcgctgctgtcgttgcccaggccgccggcggc

SEQ ID NO: 1325 - DNA, 996 bp, Streptomyces avermitilis
  CDS (1)..(996)
atgtgggacacccttgcccagtgggcgagatatcgcagttcaggggcggcctctatccgccgccgggttagcatcccggccatgaccgacgccctgctttccggaccgctcgtcgacgacgcctggctcgcggcccacctcgacgacccccgactggtcgtcctcgacgccaccgcgctgctgccgtcgccccgccacgacggcgaccaccggtccggcagcggccacgcccagtgggccgagcgccacatcccgggctcccgccacgccgacctcacgggtgacctgtccgaccacgaggcgccgtaccacttcgcggtcccgtctccgagggcgctggccgacgctctccagcggctcggtgtgcgcgacggctccgaggtcgtcgcgtacgacagcggcggcggcatctgggcggcccggctgtggtggatgctgcggtcgatctccgtaccggcggcggtacttgacggagggtgggccgtctgggaggagggcgggcacccggtcgcccacggcgacgagacgggtgccgtgcgggtctcgcggccgctcacgccggtacctcgtcccgatgtgtggaccggtatcgacgaggtggccgccatcagtcgaggtgagcgtcccggcacactggtgtgcgccctgccgcccggcggcttcgacggctctgccgccacgcgctacagccgccggggccacattcccggcagcctcagcctcccgggacgcggtctgctcgatgccaccgggcgactcctgccccgctccgaactcgcccggcgcaccggcgcagttctccaggacgccgagtcgcccgtcgtcctctactgcggtggtggcatctcggccgccggcaccgcactcgccctgacgctgctcggccgtgaggacatcagcctgtacgacggttcgctggaagagtggtccggggacctgtccaggccgatcaggctgggtcatcagctgggtgatcagcggctgggtgatcagcgg

SEQ ID NO: 1326 - DNA, 933 bp, Streptomyces avermitilis
  CDS (1)..(933)
atgtcgcacgtccgagtcatgctcgactacttccacccttggccgaattcggccggtttgtacgtcgcccgggagcgcggctggtaccgcgaggccggcctcgacgtggaactcgccgtccaggacccgggacgtggcgacacccttgagtacctggcccgcggcgaggtggacctcggcctcttcccgcccaatcgcctcctcgcgcgccgggccgcccacgcccagcccctgctcgccgtcgccgccgtcaaccaccgcgccctggaggcggtacagaccgcccgctccaccggcatcacgcgccctcgcgacctcgccgggcgccgcctcgcctacaacccgacgccccgcggccgcgccatggtccggcacctggtcgcgaccgacggcggcgacccggacgcggtgatcaccgtcgattcgggctaccgcgaactcaccgtcgacgacatagcggccggcgaggccgacgccaccttcggcaactactggtcctgggacgccctgcgcggcgatctgcccgaagagcaccggctgacctggccggtcgacgagatcggcgcaccccgctaccacagctacctcctcggcacgagcgaggccttcgccgacaccgagcccggcctgatacgcgccttcctgtccgccaccgcccgcggctacgccgccgcggccgccgaacaggaccgcgcgcaagcgctgttggagcgggtgattccgtacttctcccgccccctgatcgcccgctccctggccctcgtcgccccgacctggaccggcgccgacgcacgctggggcgtcatcgacgagacccgcatgggcccgtacgccgactggctcgcccggcacggcgccatcgcgcacgcccgcgactgggcgtcgtcctacacgaacgaactgctcgaaaccaccgccccggcggtcagcaca

SEQ ID NO: 1327 - DNA, 1035 bp, Streptomyces avermitilis
  CDS (1)..(1035)
atgagaccccgtacgaccgccctgctcgccctggccaccgccgccgccctcaccgcgaccggctgcgcagcccaggactccacctccgccgcgacgaagaacggcaccacccaggtcaccctggccctggactggacgcccaacaccaaccacaccggcatctacgtcgcccagcagaaggggtggttcaaggacgccgggatcgacctgcggatcgtgccgtacggctcgaccgcacccgagacgctcgtcgcgaaccacaaggcggacttcggaatctcgtaccaggagggcgtcaccaccgcgcgctccgcgggccaggacatcacctccgtgtacgccgtcacacagaagacgaacgtcacggtctccgtgcgcgccgaccgtgacgacatcaagtcccccaaggacctggacggcaagacgtacgccggcttcggcgccccgtacgagaaggccctgctccagaaggtcatccaggaggacggcggcaagggcgacttcaagcaggtcacgctgaacacctcggcgtacgcggcgctgtacgcgggcaaggcggacttcgcgatgccgatgccgacctgggagggcctggaggcgaagctgacgggcaagcccctcaaggacttccagctcgccgaccacggcttcccggccatctactcgacgctcgtcgcctcctccgggcagtacctgaagcagaaccccgaagtcgccaagaagttcctggccgtggtcgacaaggggtacgagtacgccgccggccatcccggccgggccgccgacctcctcatcgcggcgaacaagagcacgctcaccaacaccgaactggtcaagaagagcgagacgttgctcgccaaggagtactaccgcgccgccgacggcacgatcggcacccagaccgccgagcgctggcaggacttcgccgacttcgagttcagggccgggctgctgacggacaagaacggcaagaagctcaccaaggcccccgacgcctccacctacttcaccgacgcgtacctcccggacacgaag

SEQ ID NO: 1328 - DNA, 771 bp, Streptomyces avermitilis
  CDS (1)..(771)
gtgagggcggtcctgcgtgccgtctggccgccgctcctcgtcctcgtcgtgctcgtgaccggctggcagtggtacgtgagtgccgccggtgtcgacccgacggtgctgcccggccccggtcgcgtgctgtccgaggggtggtcaaaccgtaccgatctgtgggaccagaccctgcccaccctccaggagaccctgctcggcttcgcgctctccttcgccgccgcctggctggtggccgtggtgctggacttctccgccgtggcccggcggggcctgtatccgctcctggtggcctcgcagaccatcccgatcgtcgccgtcgcgccgctgctgatcatctggttcggcttcggactgctgccgaagatgctggtggtgacgctgacgacgttcttcccgctcgcggcgaacctggcggcgggcttcgccgccaccgaccgcgacgcgatgcggctgctgcgctcgctgggcacgggccggctgcgcgccttccgtctggtccgcgtcccgagcgcgctgccgcacttcttcaccgggctgcgcgtgagcatcacgtacgccgtcgtcggcgccgtcttcgccgagtacgcgggcgcggagaagggcctcgggatctatatgcaggcgcagaagagcgcgttccgcacggacctggtgttcgcggcggtcaccgtgaccgcgctgctgagcatcgccctgttcggggcgacctgtctgctccagcggctcgtgctgccgtgggagcgggcgctggtgaaggagggcacgtca

SEQ ID NO: 1329 - DNA, 825 bp, Streptomyces avermitilis
  CDS (1)..(825)
gtgggagcgggcgctggtgaaggagggcacgtcatgagtctcgaagtgcgcggagcgggcaaggcgttcggcacgctcgaagtgctgcgcgagctcgaactcagcgtgcggccgggcgagttcgcggccgtcatcggtccgagcggcagcggtaagagcaccctcttcaacctgatctcagggctggacacccccacctccggcgagatcctcgtcgacggcgccccggcgtcggtggcctccggcaaggtcgcgtacatgccgcagaaggacctgctgttcccctggcgcaccgtgctcgacaacaccgcgctgggactcgaggcgcagggcgtacggaagaaggaggcgcggcgccgggcgggcgagctcttcgaggccttcggcctggacggcttccagtcctcctaccccttccagctcagcggcggtatgcggcagcgcgcggccctgctgcgcaccgtcgtcctggaacggcccgtgctgctgctcgacgagccgttcggcgcgctcgactcactcacccgcaccgagatgcagctgtggctggccgacatgtggcagcgctatcgctggaccgtcgtcctggtcacgcacgacatccgcgaggccgtgctgctggccgacaccgtgcatgtgctctcgccccggccggccaccgtcgtcgagcgcgtcgaggtgccgcgctccggtccgcgcggcctggacgccctcgccgaaccggagttcgcggcgaccgaaagacgtgtcctggacgctctgcgcggcccgaccgcggtgacagcggcggtcacgaccgccatgacaacagcggtgagcgcgacg

SEQ ID NO: 1330 - DNA, 1122 bp, Streptomyces avermitilis
  CDS (1)..(1122)
gtgagttcacatcttgcgcacggcatgggaaccgaaccggtcgagcccgactggcccccgctgaccgaggccgaggtggcggatgtcgtgggaccgtcgcgggtggtgtggcgcagcccgcgcccgctgtcggcggccgctgtcgtcgaacgcgggggacgccgcctgttcgtcaagcggcatcacctgagcgtgcggacgcccgaaggcctcgcggaggagcatgccttcctgcggcatctgcgcgaacgcggggctccggtggtggaggtgctggacgtcgcgacacggcaggagtgggtgtacgaggtccactcggccggcctgggcacggatctgtaccgggacgatctgtcctggtcgccgttccggtccagcacacacgcacgggccgcgggcgcggcgctcgcccggctccatctggccgcggacggattcgaggcgccccgccggattccgcagccgctggtggcctcgttcacgatcttcgccgcggacgaccccggtacagccctggagcggtacgtggccgagcggcccgccctggccggggcgctggcggaccatccgtggcgtgcggacacccgccgtgtcctgctgcccctcttcgagcgcttggccccgcatctgccccttctggagcctctctggacccacaacgactggcatgcctcgaacctgttgtgggacgcctccggagaggtctccaccgtgctcgacttcgggatgagcgaccgcacgaccgccgtccacgacctggccacggcgatcgaacgcaacgccgtccaatggctgcaaccaggctttccggtgcgcgagcaggacgtcgacgcgctcctggacggctaccagtccgttcggccactcaccgtgtccgagtcggcggcactgcccgagctgctccctctggtgcacgcggagttcgcgctgtccgagatgggctacttccacggcatcaccgggtccgcggagaatacgcggctcgcgtacgcgtacctggtcgaccacgccgagtggttcaccggcgacgccggctcgcacctggtcgacagggtgcggcaccgggcagccgccgcgccgaagcctccccctgccggaaggccgctctcggatgcctcctcc

SEQ ID NO: 1331 - DNA, 1467 bp, Streptomyces avermitilis
  CDS (1)..(1467)
atgctcccgggagaaggtcacgccgcccggcgggtgttgatggtgtgcatggcggccggggtcacgaccctgctcgaccagtcggtcctcaacatcgcggtaccggcgctgcgtcagtcactggaggcgggttccaccgatgtgcaatggatcgtcgccggatactcgctgacgttcggtctcatgctcgtgcccggtggcagcctcggcgatgtgcacgggcgcaaaggcctgttcctggtgggcctgtcggtcttcgttctcttcggcgtgatcgccgccaccggtgtgcggccggagatggtgatcgccgcacggctgatgcagggcgccggggccggcctcgtcaactcccaggtcatcggcacccttcaagatgtcttcaccggccaggaccgggctcgcgcgctaggcctgtacgccgtcaccggcgggctcgccgcggcactgggaccggcgctcggcggcacgctcgtcgcggccttcggcccggagctcgggtggcggctgtgtctgctcctgagcacaccctgcggagtgatcactctctggctcgcggccctttggcttccgcgggcgcggcggcccgacggacgaagtcggctcgactggtgggggctgctgtgggtgggtgcgctgacgttgacgctgatgctgcccttcatcagcacaccgagcagcggcggcgaggcggcgctgtgggccggcgccgcagtcgtcctgaccgcctgcttcgttctggggcagcgactgcgcgtacgggcggggcgggcgccgctggtgcatccgtcgctcgcccgctcgcttccgtacacgctcgggacggccgttgcgatggcgagcttcgggtcctcgctggccgcgacgctcgtcctgaccatgttcctgcagagcggtctcgggctttccgctccggccgcggcactggtcactctcccggcggcgctggccatggggggcgcgtcggcggtggcgtggcgcacggtccgccgccttgggccgcacacggtcacgctgggactcgccctggggatcctcgcgctgctcgcggcggccgcgggcgccgtcatcgcatcgcgcaccgcgctcccgtgggtgctcgccgccgttcagttgtgctccggtgccgcctcgggcctcaccgtctcacccaaccaggcccaagtgctccagcacgccccggccgaggccgcgggcgtggcgggcggcattctccagatggcccagcgcatcgccgcggcggtggccctgagcgcggtctccgggagctatctgcgcggcgtggccggggcggcgggtgcgccccgtgcggctttcgcccacgccatgctcatctgtgccgctctgctcgccctggccgtcgccctgtccttgttgcgctctcaccgcacgggcccgcggcgccctcctacgctgctggctcccgggcacccgcaagccacacccgcacccgttcacgaggaaccg

SEQ ID NO: 1332 - DNA, 1203 bp, Streptomyces avermitilis
  CDS (1)..(1203)
atgcaggcgcaccgggacgagttcatcgccaagctggtcgccaccacggaggcggagatctcccagctggaacacgacgaaccgctgcgcggactgctggaagccagcatcaccgagaacatcgtcacctccctgcacgtcgtcatcaaccgcatcgatccggggaccgtcgacgcccccgcctcggccgtctcgtacgcccgccgcctcgcccagcgagacgtcccgctctcggccctgctgcgcgcctaccgcctcggccatgcgcagagcctggatctggtcctcggcgaggcggtccgactgaacctgccggacatcgccggcaccctcatcaccctggtcagcctcagctcggcctatgtggaccgggtctgcgaccagatcgcccgcgtctacgaggaggagcgcgaacgctgggtgggcacccgcggtgtactgcgccggcactgggtcactcagctcctcgacaatcccagggtggatcagcggcaggccgaggccgccctcggctaccggttgtccggcagccatctgggcgtggagggctggctcgacggcaccgcggcgaccaccgaccccaccgccgttttcgaccggctggcctcgctgctgcacaccgtgctgcgcgcccacggccgccccctgctgatccacaccgacgaggccggcgtccggatctggcttgccgtcaggcccgactgcccggtggacgccgacacggtggccgccgaactggccgacgccgcgctgccggtgcgggtcgccctcggcagcgtccgcccgggactcgacggtttccgtcgcagcacgcgtgccgccgcccgtgcgaaggccctcgccctctccgcgggacccaccgcgccccgggcggtcgccttcgcccgcgtcgctcccgtcgccctcctggtcgacgagccccgcgaactggccgacttcgtctccgacaccctcggcgacctcgccgtcgacgatccccgcaacgaagtcctccgcgagacgctccgcgtcttcctcgccaccaaccgcagctacgccgccaccgcggaccacttgacggtccaccgcaacaccgtccactaccgcgtccagcgcgccgtcgaccactaccgactcgacctcgacgccaacgccttcgacctccacttcgccctcaacgtctgccgctggcacggcgggaaggtcctgcgacccaagggaaaa

SEQ ID NO: 1333 - DNA, 1413 bp, Streptomyces avermitilis
  CDS (1)..(1413)
atgagtgacgcgatcgtggtgggggccgggccgaacgggctggccgccgccgtcgccctggcgcggcggggcctgaaggtgacggtcctggaggccgccgacgagatcggcggcggcacccggaccagcgaactgaccgttcccgggctgctgcacgaccactgctccgccgtgcacccgctgggcgtcggctcgccgttcctgcggaccctcggcctggagcggtacggcgtcacctgggcgtggcccgacgtcgacctggcccatccactggacggcgggcgggccggggtgctggtccgttccatggagcggaccgtgcgcggactcggcccggacggcccggcctgggagcggctgttcgccccgctggccgaggacttcgacgcactcaccgaggatctgctgcgtccggtcccccatctgcccgcccacccggtggagctggcccgcttcgggctccgggcgctccagccggccacgacggtggcccggcgctggcgcggtgcggaggccagggcgctgttcgcgggggcggcggcgcacctgatgcatccactgacggggcccaccagttccgcggtggggctgatgctcgtcggcgccgcccaccgcttcggctggccggtcgcccgcggcgggtcgcgcaccatcaccgatgcgctggccgcactgctcgcccagctcggcgggaccatcgagacgggggtgcgggtggactccctggaccaactcgccgccgcccggatcgtcatgctcgacaccgcgcccggcgcggcggcacggatctgcggcgaccggctgcccggccgggtgcgcagcgcctacgagggctggcggcacggcccggccgcgttcaaggtggacctcgccgtccaggacggcatcccctggacccatgaggcatgccgccgcgcgggcaccgtgcacctgggcggcaccctggaagaggtcgtccgcaccgaggcgcagaccgcaggggggcggatgcccgagcgcccgttcgtcctggtcggccagcagtacctcgccgaccccagccgctcccgcggcgacgtccacccgatctgggcgtacgcgcacgtcccgcacggctatcccggtgacgccaccgaggcggtcctgcggcagatcgagcggttcgcaccgggcttcagggaccggatcgtggggatcgcggcgcgctcgaccgccgaactggcccgctccaacacgaacttcgtcggcggcgacatcgtcggcggtgccaacaccgcacggcaggtcgcgctgcgcccccgcgtggccctcgacccctacagcaccggcatccccggcgtctacctgtgctcggcggccaccccgcccggcgccggggtgcatggcatgtgcggtgcgaacgccgcccgatccgcgctgcggtacctcgaccgg

SEQ ID NO: 1334 - DNA, 1740 bp, Streptomyces avermitilis
  CDS (1)..(1740)
atgggattcctcgcaccgaacatggcggacgtcgacatccggcagtggcgcacccgcccgtaccagcaacgcatcaggccgctcgccgagcactgggccgggcacggcttcggtacccccggcatcgtgcacctgctgtacctggtgaagatcacggcgtacgcgctcggcggcatcgcggtcgtctccctgacccccggcgtcggcggcatcgcgcacttcggctcatggtgggccgagccgctcgtctaccagaaactcgtcgtctggacgctgttgtacgaggttctgggcctcggctgcggctccggcccgctcagctcacacttcctgccgccggtcggcgccttcctgcactggctgcgccccggcaccgtacggctgccaccgtggccggacaggatcccgttcacctcggggacccggcggacggcggccgatgtgaccctgtacgcggcggtgctgggggcggccgggtggctgctgtgcgcaccgggcggcccgggggcggccggcgtggcggctccgtggcgcgtcgccgtgctcgccgcggcactcgcgctgctcgggctgcgcgacaagaccgtcttcctcgccgctcgcgccgagcactacggactgacactgctggtcttcctcttcccggcggccgacatgaccgccgcactgaagctgatcatgctcgccctgtggtggggcgccgccacctccaagctcaaccgccacttcccgttcgtggtggcggtgatgatcagcaacagtccgctgcgtcccgcctggctcaagcgccggctgtaccggcactaccccgacgatctgcggccgtccggcctggccgccgcggccgcgcacggcggcacggtcatcgagtacgtggtgccgctggtcctggtgctctcgcacggcgggaccgtcaccaccgtcgcgctggccgtgatggtcgtcttccacctgcacatcatgtcgaccttcccgatgggcgtgccgctggagtggaacgtcttcttcatctactcggcgctcgtcctcttcggccacgacgccgcggtcggtgccttcgcgctgcactccccggcgctggccgcggtgttggtgctgagcctggtcatggtcccggtgctcggccatgtccgccccgacctggtgtcgttcctcccttcgatgcgctactacgccggcaactgggccaccggcctgtggtgtttccgcaagggcaccgagcaccggctcaacgagcacatcgtcaaggcgtccggtctgcccgtcgaccagctcacccgcctgtacggcgccgacaccgccgagctcgtgctgcaccaggggctggcctggcgcgccatgcacagccacggccgcgcgctggtcgggctgctgccgcgagccgtggacgacgtggagtcctacgatgtacgcgagggcgagatggtggcgggagcggtcctcggctggaacttcggcgacggccatctgcacaacgagcagctggtggccgccgtgcagcagcggtgcggcttcgcgccgggcgagctgcgcgtcgtcctgctcgagtcgcagccgacgcaccgctcgcgccagcactaccgcatcgtggacgcggcgagcggcctgatcgaggagggctatgtgaacgtgcgggacatggtggtccggcagccctggctcgacgacgacacgcccgcgatccccgtcgagcccatcgaggcaccgcgaccggtgaccgaggcggcggccgcacatgag

SEQ ID NO: 1335 - DNA, 1455 bp, Streptomyces avermitilis
  CDS (1)..(1455)
atgcacagtgcggaactgccagatctgcgggcccgacaggacgcggacggtgcctgtatagctgacgacgcggcagatctggacaacgcggcgttcgcccggcgggtgcgccgggcggcgtcggccctgcgggcgcggggcgtcggacgcggcgacgtggtggcgctgctgctgcccaacacggcggacttcgtcgtcgcgctcttcgccgcctggcggctcggcgccgctgtcaccccggtcaacccggcactcaccgagagcgaggtgcggtaccaactcggcgacgcgggagccgcggtggccgtcaccgccggaccgtcaccgctcgccggggcgctgcccgtggccgagctgagcaccggccccgaggacacgaccgccccggagacggacgcgggcgcgctcgccctgctgatctacaccagcggcagcaccgggcgccccaagggtgtgatgctcgaccacgccaacctcgccgccatggcggagatgatgaccggcaccgcccggctgaccgagaccgaccacagcctgctgatcctgccgctgttccacgtcaacgggatcgtggtcggcgtgttgtccccgctgctggccggcggccgggtcacggtggccgggcggttccgggcggagaccttcttcgacctggtcgccacggtccgcccgacctgcttctccgcggtcccggcgatctactcgatgctcgccgaactgccggaccacgtacggcccgacacctcgtcggtacggttcgccgcctgcggggcggcgccgatgccggccgcgctcatcgagcggttcgagcgccgctacgacatcccggtcctggagggctacggcctctccgaggggacctgcgcctccaccaccaacccgctgtacggccggcgcaagcccgggacggtcggactgccgttgcccggacagcaggtcgccgtcatggacccgcagggccggatcgccccagcgggggcgaccggtgaggtggtggtacgcggtcccaacgtgatgcgcggctatctgggccgcccggaggagaccgcccgcaccgtgatcgacggctggctgcacacgggcgatgtcggccgcttcgacgaggacggctatctggtgctggtcgaccgcatcaaggacctgatcatccggggcggcgagaacatctaccccaaggagatcgagaccgtcctcggcgaccaccccgaggtgctggaagccgccgtcgtgggcgccgccgaaccgcggctcggcgaggtaccggtggccttcgtggcgctgcgcccgggcgcgtcggccaccacggccgacctgctcgaccactgccgggcgcggctggccgagttcaaagtgccgacggggatcaccctcgtcggccggctccccaggaaccccgtcggcaagacggacaagcccgcgctccggtccgggaccaccgccctcaccacggccggc

SEQ ID NO: 1336 - DNA, 1209 bp, Streptomyces avermitilis
  CDS (1)..(1209)
atgaccgccctgctgcccgagaagacatccgtcgacgagcggttggccgccgacttctacgacatcgagtcgctgctgccgccgcatgagcgcgaactgctgacgcacgcccgggcgttcatgcgcaccgaggtcaagccgctggtcaacgagtactgggcgaagggcgagttcccccgcgagctcatcggcaagttccgcgacctcggactcgcgggcgttccctacgaggggtacggcgacccgctgccggccgggagcaatctgctggtcggcatgctgtcgatggagtacacccgcaccgacgcctccagtgccacgttcttcggcgtacacagcggcctggcgatgtacagcatctaccgcggcggcgaccaggagcagcgagaccgctggctgccctcgatggccgcgctggacaccatcggcgccttcgcgatgaccgaacccctcggcggctccgacgtggccggcggcatgcggaccacggctcgccgggacggggagaactgggtgctcaacggcgccaagcggtggatcggcaacgcgacgttcgccgatctggtggtggtctgggcccgcgacgaggcggacggcaaggtcaagggcttcgtggtggagaagggcaccccgggcttctccccggtgaagatcgagaacaagatcgcgttcaggatcgtggagaacgccgagatcaccctgaccgacgtcaaggtgcccgaggccaaccgcctccagcgcatcgactccttccgcgacgtggcggagatcctccgcgccacccgcagcggggtcgcctggcaggccctcggcgtgatgctcggcgcctacgagctggcgctgggctacgccaaggagcgcaagcagttcggccgcccgatcgcacggttccagatggtgcaggacctgttggtcaagagcctcggcaacatcaccgcctgctggggcatgctggtccagctcgcgcgactccaggacgccggtgtcttccgcgacgagcactcctcgctggcgaaggcgttcgtcacctcgcggatgcgcgaagtggtggcgtggtgccgggagatcttcggcggcaacgggatcgtgctcgactacgacatcgcccggttcttcgccgacgcggaggcgatctactccttcgaaggcacccgtgagatgaacacgctcatcgtcggcaaggcggtcaccggcgagagcgccttcgtc

SEQ ID NO: 1337 - DNA, 954 bp, Streptomyces avermitilis
  CDS (1)..(954)
atgaccaagccattcaccgccgccgcggtggtcggcgccgggacgatcggactgtcctgggccgcgctcttcgcggggcacggcatacgggtacggatcaccgacccgcgaccggacctggccgaggcggtcgccgaggcactcgaccaggcggccgggcagctggccgcccagggcctggacgtgcacggcctcgccgagcgggtgctgatcgccgacgacctcgccgacgcggtgcgcgacgccgacgtcgtccaggagaacggccccgagaacgccgccttcaagcgggaactgttcaccgacctggtcggtaccgcccccgcgcacgcgctgttgctcagctcctcctcggcgatccccgccacggcgttcacggacaccatcgaggacgccggccggatcctgatcggccaccccttcaacccgccgcacctggtgccgctggtggaggtggtgcccggcgagcgcacctcggaggagagcgtggcgcgggccgtggagttctaccgcttcgtcggccgggtcccggtcgtggaacgcaaggagatccccgggttcgtcggcaaccgcctccagaacgccctcagccgggaggcgatctacctcgtcgagcagggcgtcgtcagcccggcggaactggacaccgtgatggtgaactcgctcggcctgcgctgggccacggtgggcccgttcctcggcgcgcacctcggcggcggccccggcggctaccggcacatggccgagcacatcggcgtgtcgatgcagaagatgtgggactcgctcggccgccccgagcagagccccgaacacgtcgaacggctggtcgaggccgtcgagaacgcctacggctcccgctcctacgccgacctcagccaggagcgcgacgcccggcagatcgccgtgctgtccgcccgggacagcgccacccacctggagaaggagacccggtca

SEQ ID NO: 1338 - DNA, 753 bp, Streptomyces avermitilis
  CDS (1)..(753)
atgaatcagcaggacgtgccccggcacttcgcgacgccgctggccaacccggcctatccgccggtcgtgccgcggttcaccaaccgcgagtacctcaacatcgtctaccgcaccgaccacgaggccctgcgcgcggtggtgccggaaccgttggagatcgacgaaccgctggtgcgcttcgaggtcatgcggatgggcgacgtcagcgggtacggcccgtacaccgagtcgggccaggcgatcccggtcacctaccagggggagcggggcgagtacctgcacgccatgtacctggacaaccttccggccatcacctccggccgcgaggccagtgcctaccccaagaccgccggctcgcccggcctctacgccgaacacggcgcgctggtcggcgtcctcgacgtcggcacgctccgggtggcgaccgccaccatgggctacaagcactacgagttgtcggtcgaggaggccgtggcccaggtcggtgtgccgacctacatgctcaagctggtccccggcttcgacggggcgccgcaggtcgcgcagttggtgcgcaacgagatcaccgacatcacggtgaagggtgcctggaccggccccgcccggcttcagctgttccagcacgtgctggcgccgctggccgatctgccggtgcgcgaggtcatctccgccagccacatcctcaccgatctgaccctcgcgccggtcaagccggtccacgactacctggcccaccccgcgtaccccacgcgg

SEQ ID NO: 1339 - DNA, 768 bp, Streptomyces avermitilis
  CDS (1)..(768)
atgcacagcaccaccgaggtgcggaccgagaccatcggttcgtccctgctcatcaccatcgaccggccgaaggcgcgcaacgcggtcaacgccgccgtagccactcaacttgctttcgccatagaccagttggaggcggaccccgccctgcgcgcagcggtgctcaccggcgcccagggcacgttcagcgccgggatggacctcaaggccgcgctggccggtgaatcgcccgagatcccggggcgcggcttcggcgggctcacccgggcgcggaccaccaagccgctgatcgcggccgtcgagggctgggcgatgggcggcggattcgaactggccctgggctgcgatctgatcgtcgccgcggacgacgccaggttcggtctgccggaggtcggccgcgggctgatcgcggcgggcggcggagtgatccggctgcccaagcgcatcccgtaccacctggcgatggaactgctgctcaccggcgagccggtctccggcgaacgggccggacagctcggcatcgccaaccgtgtggtcgcggcgggggagaccgtcgccaccgcactgcacctggccgagcggatcgcgcagaacgccccgctggccctggccgccgtcaagaacctcgtccgcgccgcggacggcgcgcccgaggaggaggcgttcgccgtacaggggcggctgatggccactctcgcggcctccgccgacgtgcgcgagggcatgaccgccttcaccgagcgccgctccccggtctggcagggccgg

SEQ ID NO: 1340 - DNA, 1167 bp, Streptomyces avermitilis
  CDS (1)..(1167)
atgatggacagcacgaccgcaggcgacaccggtccgctcaacggcgtgcgggtgatcgatctgtcgacggtggtgatggggccctacgcggcgcagatcctgggcgacctcggcgccgacgtcatcaagatcgagtccccgtccgacaccgtacgggtgggcccctaccgcaccacacccggcatgaccccgctcaacctcaacgtcaatcgcaacaagcgcagcgtgtcgttgaacctgaaggacgacgccgaccgggcacgggccctggagctgatcgacagcgccgacgtgctcgtcaccaacatgcgccccggcgccctcgcccgcctcggcctcgcccacgccgacgtcgccgcccgcaaccccggcctggtctacgcccacgcccaggggttccgcagcgactccgaccgggccggcaacgcggcctacgacgagacggtgcaggccgcctccggactcgtggacgtggccaaccgggcgctgggcaccccggcgtatctgccgacgatcatcggcgacaaggtctgcgcgctgaccatcgtctacacggtgctcgccgcgctggtccaccgcggccccaccggcgccggccagtacatcgagatcccgatgaccgacacgctcatcgccttcaacctcgtcgagcacctggcgggccatgtcttcgagccgccggagggtcccaccgggttcccgctgtcgatgaagcgcgggcaccgcgcggtgcccaccagggacggcctcgcctgcgtcatcccgtacaacccgcagaacttccgggacttcttcctcgccgccgatcgcgccgacctcgccgcggacccgcgggtcaacggcgaggccgtcgccgatgacgacgtcgacgcgctgatggaactggtgggggagtgctcgccgagcatgaccaccgaggagtgggcccgggtctgcgccaagcacagcatcccgatggcacccgtgctcgagctcgagcgagccgccgaggacccgtatgtgcgcggcggccggctgctggatgtggtggaccaccccagcgagggcgccatccgcacggtcggcatccccgtgcggttctccgccaccccgggatcggtccgccggctcgccccgctgcccggccagcacaccgaagaggtcttcggcgagctcgccaccggccgc

SEQ ID NO: 1341 - DNA, 909 bp, Streptomyces avermitilis
  CDS (1)..(909)
gtggacatgctgcacctgcgttacttcgtcgccgtcgccgaggaactcaacttctcgcaggcggcgcgcaagttgcacatggcggcctctccgctgagccagcggatcaaggatctggaacgcgaactcggctacgagctcttcgagcgcaccacccaccgggtcgacctgaccccggcgggctccgcactgctgccgatggcgcgcgacatcctggagcgggtcaacgcgattccctggcggctgagcgaggcggtgcggccgcggctggacaggctgttcatcgggatgcccgcaggagtgcatccgctgctgcgggagcgggtccggctgctggaggacgcctgccgggaggtgtgcgaactcaagcgctggcccggtacgtcggcggatctcgcggacgccgtgcacgacgggaggctggcgatggcgctggtccggctgccggtctccgatcccgcgctggagatcatcgaggtgatgcgggagcggctgggtgccgcggtgccggccgaccggttcgcggggcgggcgtcggtcaccctggacgagctggccgatctgtcctatgtggccacgccgaacgacgccaccccggcctatttcgaggaaatcgacgcccatctgaattccgtcggcgtgaagaaaaggatccgcataaatatggcggattattcgggaagctcggaattgatttcgtccggcatggcgttctcgatgaccatgctctcgccggagagtccgatgcatctgtaccggctggacaatgtggttgtactgcccgtcgaggacttccaaccggccctggtgacaggcctgttgttccgtagggaccgagcggacgacggcggtgacctgagtgacgtcgccgcgcgggcgcggcagatcttccacgaggtcatctccgtc

SEQ ID NO: 1342 - DNA, 1401 bp, Streptomyces avermitilis
  CDS (1)..(1401)
ttgctcctcccccctccatgcacgccggctcggcttccggagctccccatgcagacttcgtcctgtgctcccgcgcgcagaccatcgaccggtgccgcccgctcccggacggctctcggcctggtcgtcgccttgctcgcagcctgcttcgtcgccatgacgccctcgcccgcgtgggccgccgacctgctgctgtcgcaggggcggcccgccacggcgtcctcgaccgagagttcggccttccccgcagccgcggcggtcgacggggacccgggcacccgctggtcctcggccttcgccgatccccagtggctccaggtggacctcggctccgtccagcagatcacccgcgtcggcctgcgctgggaagccgcctacgccacggcctaccagctccagacgtccaccaacgcgagcagctggacgacgatctactccaccaccacagccgccggcggcacccagagcctgcccgtcaccggcagtggccgctatgtgcgcatcctcgcaacggcgagggccactcaatacggccactccctgtgggagttcgaggtgtacgggcccggcggcacccctccgcaggacgacttctggggcagcaccagcgacattccccccgcgaacaacgccgtccaagtgaagatcctcaaccgcaccaacggaaagtaccccgacagccaggtgtactggagcttcaacggccaggtccactccatcgccgaacagccctacctcgacatgccggcgaactccgcggggcgcatgtacttccacctgggcacacccgacagcccctactacgacttcatcgagttcacggtcggcaacaacgtcttcaacggcaacaccacccgggtcgacgccttcggcctcaagctcgccgtgcgactgcacaccaaggacaactacgacgtcgaggtcggcgagaaccggcagaccttcgccgaggaccgcgccgccaccttccagcgcttcaccgacgcggtcccggccgagttcaaggtactgacccggacccagggcccgtaccggatcatcgcgcccggcagtgacccgagcttccgcgcgggcggcgccaacgccaactacttcacctcctacgcccagtccgtcggcgtcaacgcggccacctccgacatcttcggctgcgccgcctccttggccggccaccccgacgtgtgcgcggccctcaaccggcacgtggccacgctgccggcctcccagcaagccgatccggcccagtactacaaggcggcgccggcgaactactacgccaagttctggcacgacaacgccatcaaccgcctcgcctacggctttccctacgacgacgtggcgagtcagtcgtccttcatctcgcacagcaacccgcagtggctgctggtcgcggtgggctgg

SEQ ID NO: 1343 - DNA, 1389 bp, Streptomyces avermitilis
  CDS (1)..(1389)
atggtcaaccacgccaccggcgcgcccgctctcgcgcgctccctcaccctcagagccgtcaccctgttcggtctcgcctacatgactccactgatcgtgctgggcaccttcggtgtggtcgccgccgacaccgggggcgcggtcccgaccgcgtacctgctcgccctggtcgccatgctgttcacggcccacagctacgggaagatggccgccgcgtatcccgtcgccggctccgcctacacctacgtccgcaaggcgatcgacgggcggctcggcttcctcgtcggctgggtgaccctgctcgactacttcttcctgccgatggtcatctggctgatcggcggggcgtatctccaggcgcagttccccgctgtgccgagctggatatggatcatcggcttcatcgccgtcaccaccgtgctgaacatccggggcatcaagaccgccgagcgcgtcaacgacctgctcatggtcttccaggtgctggtcatcggcatcttcgtcgtcctctccctgcgtcacgtcctccacatcggcggcgccggtgcgctggcgagcggcgcgcccttcgccaacggcgcgaccaccgcggccggcatctcggcgggtgccgccatcgccgcgtactccttcctcggcttcgacgcggtcaccacgctgacggaggagacggtcgacccgaagcgcaccatgccgcgcgccatcctgctcacggcgctgatcggcggcggcatcttcgtcctggtcgcctacaccacgcagctcgcccacccgggcagctccttcgacgaccccagctccgccgccttcgagatcgcgaagagcatcggcggcgacctgttctcgtcggtgttcctggccgggctcgtggtcgcgcagttcgcctccggcatcgccgcgcaggcgagcacctcacgactgctgtacgcgatgggccgcgacggcgccctccctcgcaaggtcttcgcccgcctccacgagcgctaccgcacccccgcgctcaacatcgtgctgaccggcgcggtcggcctgatcgccctgcgcctggacgtggccacctcgacgtccttcatcaacttcggcgcgttcgtcgccttcaccttcgtcaacgtgtccgtactcgccatgtacatacggcgtcggcgcgccggggacaccctgaatccgctgtcgtacgtcgtcgcccccgcgatcggcgcggtcgtggacctctacctgctgtacaacctcgacggcagggcgctcaccctgggcctgatctggttgggcctcggcgtggtgtacctggcctacctgacccggatgttccgcgtcccgccgccggaaatgtcgttcacacctgcggattcggacgaggcccaggtcgcgggggccctgcagaacacgaag

SEQ ID NO: 1344 - DNA, 867 bp, Streptomyces avermitilis
  CDS (1)..(867)
atgtcccgccccctgcccctcgctctcgcccagctccccccgcggcccgcacatgccccgctcagcgggttcgcggctgaggcggagagcattctcgcccggttcccgcacacccgcatggcggtcttccccgagctgcacctgtgcggcgtcgacgccctcggcgccgaggcgcacgagcagctgcgggagatcgcggaacccctggacggaccccgggtcaaggagctcgccgagcttgccggggatctgggggtgtggctgctcccgggctcggtgtgcgagcgcgggccggccggggaactgttcaacaccgccctggccttctccccgcaggggcgtctggcggcctggtaccgcaaggtgttcccctggcggccgagcgagccctacgatcccggcgaccggttcgtggtcttcgacgtcccggaggcggggcggatcggcttcgcgatctgctacgacgcctggttcccggaggtcgcccgccatctggcgtggcgcggcgccgaggtcatcgtcaaccccgtgatgaccaccaccagcgaccgcgcccaggaggtcgtcctggcccgcgccaacgccatcgtcaaccaggtccacgtggtcagcgtgaacaccgcgggccccctgggcagcgggcacagcctggtcgtcgaccccgagggccggatccgggcagaggcgcccggcgacggcaccgccatcctcaccgacgtgatcgatctggacgacgtgacccgcgtccggacccacggcaccgcaggcgtgaaccgcatgtgggaccagttcaccgacaccgacgcgcccatcgaactgccgctgtacggcggccgtatcgacccgcgcacctggcgtcccggagcc

SEQ ID NO: 1345 - DNA, 768 bp, Streptomyces avermitilis
  CDS (1)..(768)
atgcctggcagtgacaacgtcccgaccaccggcctcaccgccctcgaactcagcggtgtgcgcaggctgtccgccctggaagcggtacgcgcccggatcgctctcgccgtcgacctgggcctgctctcccccggcgagcgcctgcccggcaccgcacagatcgcccgggccctcgacgtcagcgagatcaccgctcgccgcgccctggtctccctgtgcggcgacggcgtactggaacgccgccgtggccgtaacggcggcaccctcgtcgccgcccaccccaccccgggcacggtcctcaccacggagacctaccgcacggccaccgacgccgtgcaccggctgatcgaccaccggctggccctggagtgcggcatcgcccacctcgcgtcggtccgcgccagtggcgaagacctgtccgagctccaggaaatcgtcgaggaaatggaccgcgcgcccagctgggcggagttccacggctgcgacgagcgcttccacctccggctcgccgaggcgaccggcgtcccctcgatcaccggcccctacggcgcggtcctgcgcgagctctaccgctactaccttccctaccccgtggacgcgctgcgcgcctccaaccgcgagcaccgcgacctcctcgacgcgctgcgccgtcaggacaccgccgcggcgagcgaggccgcccggcaccatgtggaaacactgcgccacaccatgttcgtaggcctgctgagcgcatccgccgacaccggaaccgtcgccccgggaagc

SEQ ID NO: 1346 - DNA, 1020 bp, Streptomyces avermitilis
  CDS (1)..(1020)
atgagtacttatcgagcagcgcaggtggccgccgcgagcggtccgttcgagatcgtccagcgtgaggtgccgcggcccggccccggccatgtccggatcgccgtggacgcctgcgggatctgccacagcgactccgtcttcgtcgacgccctgttgccgggcgtccggtttccgctggtccccgggcatgagatcgccgggcacatcgacgagctcggcgagggaacggacatcagctggcaggtgggcgaccgggtggcggtgggctggttcggcggcagctgcggccactgcccgccctgcagacagggcgacttcgtcgtgtgccagaacctgaaggtccccggatgggcgtacgacggaggctacgccgaggcggtgatcgcaccggccgacgccctggcccggatccccgacgcgctggcggcgaccgacgcggcacccctgggctgcgcgggagtgaccacgtacaacgggctgcgacgcagctccgcgcggccgggcgatctcgtcgccgtcctcggcatcggtggcctcggccacctgggggtgaagtacgcggccgccatgggcttcgagaccgtggccatcgcccgcggatccgacaaggccgacttcgccaagcagctcggcgcacaccactacatcgacagcacggcggacaccaccgtcgcggatgcgctgcagtccctcggcggcgccaaggccgtgctggccaccgccgccaactcggacgccatcacggcgaccgtggatgggctcgcgccccgcggcgagctggtggccatcggtgtggacgccgagccgctgggcatcagcccgaaccagctgctcatgggcggcaagatcatccgcggtcatccgtccggcaccgcgcaggacgtgcaggacaccatggcgttcagcgccctgcacgggatccggccgatgaccgagaccgtgccgctggaccaggccgatgaggcgtaccggaagatgatgtccggcgccgcccgcttccgcatggtgctcaccaccggc

SEQ ID NO: 1347 - DNA, 699 bp, Streptomyces avermitilis
  CDS (1)..(699)
atgcacctcggagtcatcggagccaccggcaccatcggcagtcgtgtcgtcaccgaagccctcgcccgggggcaccacgtcacggccttcacgcgcgactcgacgcagatcgacgaggaccgcgggaacgtcgtctggaagagcctcgacgtgctcgacgccgcgagcgtcgccgccggcatatccggcctcgacgtgttgatcagtggattccagcccggcaacgcggccaaggacatcgccgacaccgtggcccgctccatcgccgatcccacggtgtacgccactgccgcgcgatccctgctgaaggcgctggagagtcacccccggacccgtctgatcgtcatcggtggtgccggcagcctggagatcgagcctggagtcgtacgtgcggactccgacgagctcctgcactcgagtctcgacgcgcttggcctgccgaggcagtacgcggctgcggtgcgcggccatcgggacgcgctgaacgtgctgcgcacgtccaaccggctgtggacctacttcagccccgcggaggacatcgctcccggcgagcgcacgggccggttccggaccggcggcgatcagccggttctcgacgcggaggggcgtagccgcatctcggtggaggacgcggccgtcgcactcgtcgacgaggccgaactgccccgcttcgtccaacgccgcttcacgatcggctat

SEQ ID NO: 1348 - DNA, 750 bp, Streptomyces avermitilis
  CDS (1)..(750)
atgtacggcactcaccatcgtgacgctgtagagtcagcgactgtgggaaagaccaatgggcgccgcgagcgactgcgagccgaaacgaccgccgagatcaagagggtcgcgctcgaactgatggccacaggcgggcccgacgcgatcacgctgcgggccatcgcccgcgagatgggcatgacggccaacgccatctacggctacttcgccacccgcgacgacctggtcaccacgctgatcaacgatgtgtacacctcgttggtcgacaccgtggacaccgcctgggagaccgcacccgcccaggatccggccgcccggatccaggcatgggcgtgcgccttcagaggctgggccctggccggccccgagggcttccggctcatttacggcgaccccgtacccggctaccggccccccgcggggggcgccgccccggacgccgcccaccgcgtctgcaagggcatcaccgcactggcggccgcagcctggccgcacgccgaacaccgctacgcggacagcgacttctcctggtccgacttcgacaccggcctcctggacaaggtccgcccggccttcccggaactgcctccggcggcggtggccctcgcgctgcgcatctggagccacctgcacggcctgatctcactggagatctacggccacctgcagacccagaccctcaacccggacaaactcttccgcgaggaactggcccagctcatccgctccttgagcatgaccccccagggg

SEQ ID NO: 1349 - DNA, 255 bp, Streptomyces avermitilis
  CDS (1)..(255)
gtgctggcccctcaggcatgtccggccccggggcacgcgtcaccacgaggatcgtgccggccgcgaggtcccggcacgctcgcggcgatgaccagtacggccaacagcggatcgagcgtctcgatgacgaccccccacttcctgccgacgatctcgctgccggcgatctcctcgccggcgccgacgccctggctcgcggcggcacactgcttccctctcacgcagtttcggatcaccacgttctcgtcgctgccg

SEQ ID NO: 1350 - DNA, 1023 bp, Streptomyces avermitilis
  CDS (1)..(1023)
atgagtggttggaccttattcgaactctcacccgggggaactgccgatccggacaccggagttgccgcggtgtcccgcatccccggtcacatggaagtctggtgggtgggccccaacggctcggtggaaggcgcctattggtacgacggccacccctgggcccgctatcagatcgccccgaacggcagcgcggggggagcgagccggatcaccgcggtgtcccgcatccccggccacatggaaatctggtgggtgggccccaacggctcggtggaaggcgcctattggtacgacggccacccctgggcccgttaccagatcgccccgaacggcagcgcccggcgccatgggatcacggcggtctcccgcatccccggccacatggagctgtggtggatcggccccaacgcctcggtggaaggcgcctattggtacgagggcagctcgtgggcgcggtaccagatcgccccgaacgacagcgccgcgctgaacggaggcatcacggcggcgtcccggatccagggcagcatggaactgtggtgggtgggccccaacgaatcggtggaaggcgcctactggtacgacggccacccctgggcccgctaccagatcgccccggccggctccgcgtccgccgtcggcggcatcaccgcggtctcccgcatcccgggccacatggaggtctggtgggtgagccgcaacgagtccgtcgagggggcgtactggtacgagggcagccagtgggcccgctaccagatcgccccgaacggcagcggctaccggggctccgacctcaccgtggtctcccgcgtcccgggccacatggagctgtggtggacgggcaccgacaactcggtccagggcgcctactggtacgacggccacccctgggcccgctaccagctggcccccgccggcgcctcgtccggcgacggcatcgcctccgtgtcgcggatccccggcagcatggaggtctggtggctgaccgggcgccagtccatcgaggacggctactggtacgag

SEQ ID NO: 1351 - DNA, 480 bp, Streptomyces avermitilis
  CDS (1)..(480)
gtgaagatgtccggcggagtcgagtgggccctgcattgctgcgtcgtgctcacatcggttgaggagcctgtccccgcgacccggctggcggagctgcacgacgtctcggcaagctatctggccaagcagttgcaggcgctctctcgcgccgggctcgtgcgttcggtgcagggcaaggcgggcggttacgtgctcacccgggaacccgcctctatcacggtgctcgatgtggtcgaagcggtcgacggtcccgaccaggccttcacctgcacggagatccgtcagaggggtccactggccacaccggccgagtcgtgcgccgtaccctgtgcgatcgcccgcgcgatgaccggggcggacgcggcctggcgagcggcgttgcgagccgtctcgatcgccgatctggtccagaacgtccgctcggacagcggccccggcgcgatggccggcatcagcgcgtggctgtccgcgccggacgcc

SEQ ID NO: 1352 - DNA, 726 bp, Streptomyces avermitilis
  CDS (1)..(726)
atgaagttcgcggtcatcggcggtaccgggctgatcgggtcgcaggtcgtcaagaatctgaacgccgccgggcacgaggcggtaccgcactcgcagtccaccggaatcgacgtcatcagcggtcagggactggaccaggcggtggcgggggccgacgtcatcgtcaacctgacgaactccccgaccttcgacgaagcctccccggccttcttccagacctcgatggacaacctcctggccgcgggccggaaagccggcgtccgtcacttcgtcatcctctcgatcgtcggcgtggaccaggtgccggagctggactactaccgggccaaggcgctccaggagaaaatcctcgcggccggaccgatcccctactcgatcgtccgcgcgacgcagttcatggagttcatcgacgcggtcctgtcctggaccgcggacggcgacaccgtccggctgcccgccacgccgatccagccgatcgccgccaaggacgtggccgacgcggtggccgaagtcgccgcgggcgccccgctggggggcattcgcaacgtcgccggccccgagatcttctccctggacgagctgggccggatcaccctgtcccacaagtccgacggccgcaccgtcgtcaccgaccccaccgccggcatgttcggcgccgtcaagggtgacgtcctcaccgacaaggacgcccacctcgcccccacccactacgccgactggctctcc

SEQ ID NO: 1353 - DNA, 1080 bp, Streptomyces avermitilis
  CDS (1)..(1080)
gtgacgtcctcaccgacaaggacgcccacctcgcccccacccactacgccgactggctctcctgaaccgctcgcgccctccccggcgcgcggacctcacgagctggtgctccccgcaaccgagccggctgcggggagcgggatgcgtccaatggagtggaacagcgctaaccgattcacctcagtgggcaataaaggccgagacgctgcccagcgacaggagaagcgcatgtccagccgtcggccaccacggagggacccgcgaagccatgcgcacggaccggcacgacgttggtggcgccgacactggaaagccggtaccgccgtcctttcggcgctcttcgtcgcgaccgcgagcccgctgatctacgacgcgatcaagagcgggacttcggcgatcgtggaaggcgacaggccgcccttcgcatggacgacacaagtggactcgccggaagatgccgggtgcaagtcctatgtcttcgactctgacgcgaagatgtcggctccctcgcccaacgaggactggcaggtttgggcaacccgccagggaggaaccgccgccaatctgacaaccatccggctcaccctgcaagggcgctccgccagcagtgtcgtcctccacggcctccgagtggacgtggaatcgaaaagcaggcccaaagggtccgtgtacgacctcggcctcagctgcggcgggctgacatctcgaaatttcgacatcaatctcgatgaccccgaagtcgctccggcatcgcgcgccggcgatgacggaactcctgctgcgcgtttcccctatcggatttcatccacagagccggaggtattcctggtccacgctcgtaccgagaattgtgattgcaggtttcacctgaacctcgactggaccagcggagaccgcaaagggaccctgcgaatcggcgacggaaagaatgcctttcgcgtcatcgggacgcagcggcttcggtggttcgagctggacatggacaagcagcaatgggtgaaacagccggttgtggacaccgttccaggagccgaactcggccgactggtaaagcgatcggatgttcggagggaagcggcc

SEQ ID NO: 1354 - DNA, 540 bp, Streptomyces avermitilis
  CDS (1)..(540)
gtggttgaccccgcaccggagcacccgtaccccgacggccaccgaccggacgaggcgcccgcaccacacgcactgctcgagcccgtgctcggcctcctgggttcttggtacggccggggcgagggcgggtacccgacgctcaccggggacttcgggtacgcgcaggagctgaccttcagtcacgacggccgccccttcctgcgctacgaggcccgggcctggctgctcgacgccgatgacgcaccgctgcgtccgtcggcccgggagtgcggctggtggcggcttcagcccgacggccgggtggaggcgctgatcacccagccgaccggcatcgcggagatcatggtcgggcgtgcgaccggcaacacgatcgacctctcgacccatgaggtcgccctcgctcccacggccaagaaggtcaacgccacccgccgccgctacaccctgaccgacgacgacacgctcacgttccaccacgacctcgaggcggtcggccagccgatgcagcaccatctctcggcacggctgcgacgtagaggc

SEQ ID NO: 1355 - DNA, 2850 bp, Streptomyces avermitilis
  CDS (1)..(2850)
gtggggcagtccagagcagactcgaagagaccgacgggattatccagagcacgaagaagcggcatttccggtgcggcggcgcttatcggcgtcgccgcactcgtcgtctcggcggtccccgccgacgcgaaggcggggggaccggtgccgccgccgagcccgggagagctgatcccggggcagaagacggcgacgcccgcactggtggagggcctccgggagcaggctccggcggcgcggaacgccgcgggcgcggcgcgcgcgtacctcgccgcgaagcaggaccgctaccggatcgcggacccgggccgcgacctggagcccctggggaccgtcacggccgacggccaggagaccgtgcgactgcggcagaggtaccacggcatcccggtcctgggcggccagtacgtcgtacgcatggagaagcaggacggcggacgggtcgtcaccggcacctcgggcaagtacttcaccggtctgcggaccggcaccacggccgaggtcgacgacgcgctcgccgtcgagcgggcggtcgacgcggtgctggcccggctcggcgcggagaagttcaccgcgtacggggaggacgacgagggcaagaaggacgcgacgccgctcaccggcacctcccacggcctggtcgtgctgcccaccggcacgggcgtactcgcccggcacgtcaccgtgcggggcgcggacccggcgcgcggtgagccggtgctgcgcgaggtgtacgtcgacgcgcaggccggatatccggtgctccagtacagcggtatccggacgttcgacgcgcccgggacgaccgccgaggggagcgcggcgagccaccccgcgcaggaacccaccgaacccgcccccggcgagacgggctccggcgtcaagctggacggcaaacccgtcgaactacaggtcacccacgacgacacgcgcgccgcctacgtcctgcgcgaccactcccgcatccacaacgacaccgcggacgtcctcgccacctgggacgcgcgcggcaagtgggcctccgacgtggtcggcaactggcccgccgaccttcaggagttcgcctcgccgaccccggccttcggcgccgaggcgaccgaggcgggggcggtggacgcgcactgggccgccgggcaggtgtacgactactacaagaacaagcacggccgggacagcctcgacgggcggggcatgtcgatcaactccctcgtcgggacgaccgattacgggcagccgtatgtcaacgccttctgggacggccagaagatggtgtacggcaacggcgacgccgaataccgtccgctcgccgccggactggacgtcgtagggcacgaaatgacccacggcgtcgtcgaccactccgccgacctcgtctacgcgggccagtccggcgccatgaacgaggcgatcgcggactacttcggcaacgccatcgagacggatgtgcacggcatagccatggccgacccggactcggggctgctgggtgaggcgctctgccggaccaggacgccgcgcgagtgcgcggtccgcgacctgaacgacgggcggaccaccgccaagtccttcctcggtgtggggttcggcaccgacaacggcggtgtccacctcaactccacgatcttctccggtgcgttgtgggacatccgcgaggacgtcggccccactctcgccgacaagatcgtgtacaaggcgctcacggagtacctcaccccgctcgacggcttcacccaggggcgggacgcggtgatcgccgccgccagggctctggggaccggcggcaaggacctcacggccgtccagcgggccttcaacgcccatggcatcgtgcccaactgggagctggcgctgggcgtcgactccgacctgctgatcgagcgcgtcaacacctacgactcccaactgggcgcgggcggcgactggtggacggccgccacgtccaacgaggagggctccgaggcgtactcggtgtgggccgggcgcacggacggcacgggccagctgaaactgatgagccccaacgacggccgctaccacgtgaatccggccacggacggcaagaccgtggtgtggcaggcgcacgggacctccggcgtggacatcctcgcccggcccctcgcgggcggcccggtgaagacgttgtggcacggccggagtgtgggcggcgcgctggacgtcgacggtgacgtggtggccttcgcgtacaacaaccacggcggaagagccggcgtggcctacctgagtctgaaggacccggcgaacgtggtcacgatcggtgggggcacgtaccaccgggcgaccttcccgtcgctgagccacggcaaggtcgtctaccaggaccggcagcgggtgagcgccgtgtacgagaccaccacccgggtggtcgatgtggcgaccggtgaggacaaggtgatccagcgggccgccccgggggcgagcctcggcccgacggccgtcaccggcgatcacgtctactggctgctcgacgagatcgatcagaacggcacgacggccctgcgccgtgccgggctcgacggctcgggcatcacggacctcagcccggagaccggcccggagtccctgaacgtcttcgatctgacggcctccgagggggcggtgacagtggacgcccggacgccggaccccgcgttccgcaacgagtcgctggccaagctctggcagttctcagcggagggcaagggcgatggcgtacgcaagagccgggtctcctgcaaccggggtgagcagctgtcggccgccgcggcatccggcacccaagtggtgtggctcgacgcgacgaccggcatcagcaatgtggtgacccggacccggccgagcggtacgtgcggc

SEQ ID NO: 1356 - DNA, 801 bp, Streptomyces avermitilis
  CDS (1)..(801)
atgaccgtcaagggcgggaccgccgtcgcgcggagagaacagacggacggcgccacgctccagggcaaggtggcgatcgtcaccggcggtgccggcggactgggccgggccacggcgctggcgctcgggaaggcgggggcccgggtggtcgtcgcggacctcgacccgcagggcggcaaggaggtggccgacctggtcggcggccacttccgcgcctgtgacgtctccgacctcgacgccaaccgcgcgctggtggacttcgcccaggagcagtacggcggcgtcgacatcgcgttcctcaacgcgggcgtgacgaccggatgcggcgtcggcgaggacttcgacctggcccgctaccgccgggcgatgggcgccaacctcgacggtgtggtcttcggcacccacgcggtgctgccggcgctgcgagcccgcggcggagggtcgatcgtggcgaccgcgtccctggccggtctggcggcggtaccgctcgatcccctgtacgcggccaacaagcatgcggtagtgggcctcgcacgctccctggggcaggctctcgcgccggagaacgtgcgcttcaacgcggtctgcccggggtacgccgagtcacggatcatcgacgacctgcgtgacatgctcgccgagcagggactgccggtcatcccggctcaggccgtggcggacacggtgctgcggatcgtcaccggcgacggcacgggggagtgctggttcgtccaggccgaccgcgaaccggagccgttccgcttccgcaacgtccccggcccgggcaagcccgccggtacc

SEQ ID NO: 1357 - DNA, 954 bp, Streptomyces avermitilis
  CDS (1)..(954)
gtgaagcccgacgactgggagcattgttccgggcccgtcgaggaaccgggtccgggccggttcgcgggccggacgcgtgtcatctccctggatccggccatgcggggctggctggacgaccgcccctcctacctgccgcccgtgggcatcggcgaggtgatgcgcgccgggtcggtcatcgaggtcaccgcgtccaaccaccccgacttccagcccggtgatcacgtggtcggcacgttcggcgtccaggagcacgtggtctccgacggcaagggcgccatgaagatcgacacctccctcgccccgccctcgacgtatctgggggcgctgggcatgcccggcatgaccgcctacttcggcctgctggaggtcggggcgctgaaggacggcgagaccgtcgtggtgtcgggggcggccggcgcggtcggcagcatggtgggtcagatcgcgaaggccaagggctgccgggtcgtgggcatcgccggagggccggagaagtgcgccctgctcaccgacgagctgggattcgacgcggcgatcgactaccgcaccgaggatgtcaggaaagcactgcgcgggcatgcccccgacggcatcgacgtctacttcgacaacgtcggaggggacatcctcgacgccgccctgacccggctggcgatgcacgcgcgcgtcgtggtctgcggcgcgatcagtcagtacaacaacgccacaccggtcaagggcccctcgaactacctctcgctgctggtgcgccgcgcccgcatggagggcctcgtcgtcttcgactacgccaagcgctacccgcaggccacgcaggagatctccggctggatcggcgccggccacatcaaggtcaaggagcatgtggtgagggggaccgtggacgacttccccgagaccttgcagatgctcttccgcagcgagaacgtcggcaagctcgtgctggagctggca

SEQ ID NO: 1358 - DNA, 537 bp, Streptomyces avermitilis
  CDS (1)..(537)
atgacacacgccgacgacaaccggtacccgccagcagcaccaccgggatggccgcagccgcggaccgcgccccatgagaacgcccctcggcacgagccgtacggatatgacgcccctcggcacgactcgtacggatacgacacccctcgccgcgactcgtacggatacgacgcctctccgtacgacccgtacgggcaagcccctcggcaccggccgtccacgcacgagccccatcggcaccatgccgacctcgccgccctccgctcggcctaccgcgtgctccgccgggtgtccactctcaccgcgctcggctccttcgtggtgtacgtggtgctctcctgctacgcgccggacctgatggggtccaagatcgccggggagctgagcctgggcatggccctgggggtcctccagctcatcgtcaccttcgcggcggtcctctggtacggacgcagcgcacaacgttccgtggacccgctggcgcgggtggtcagggagcgggcggtccggccgggccgggacgccgaggtggcgaga

SEQ ID NO: 1359 - DNA, 1614 bp, Streptomyces avermitilis
  CDS (1)..(1614)
atgaacgacttcagctccgggacgcaggcgaccgtcctgatcctgttcaccgccctggtcaccctcacgctgctgatgtgcgtgatggcgggaccggaccgcgacgacctgacgaacttctacaccggctacctctcgctcaccccgctcaagaacggcctggcgatcgcgggcgactacatttccgcggccacggtgctgagcaccaccggcatcatcgcgctcgccggatacgacggcgacgtgctggcggtcagcaccgccatgtcgctggtgctgctgatgttcctgctggccgaacccctgcgcaacgccggcaggttcaccatgggagacgtcctggcccgcaacatgcccgggcgggccgtccgtatcgcctcctgcgtggtgacgctcgcggcgaccctccccttcctggtcgtccagctctccggggccgggtcgctgctcaccttcatcctgggcatcccgcacctgtcgggcgccagaacggtgtgcatcgtcctcgtcggcagcttgatgatcatttacgcggcgatcggcggcatgcgcggcaccgcactcatccagatgatcaagatcgtgcttctgctgggcaccagcgtcgccctcgccgccctggtcctgaaccgcttcgactggaaccccggcgacctgctccgggccgcccagcgcggcagcggcgcgggcccggccttcctccagcagggcctgcaactgggcacctcggccggcagccggctggacttcgtcagtctccagatcaccgtggtactcggcgtggcctgcctgccgcacatcacgatgcgcctgttctccgcgcgggacgtgcccgccgtgcgccgctccatgtcgtgggcggtcggcacggtcaccacgttctgcctgctcgtgatcgtcatgggcacgggcgcggcggcgctcgtgggatcgcggtacatcaccgcggccgacccgcacggcaggacgtccgtgctcatgctgtcccaggtgctcggcggcgatgccgactccgcgggggcgacgatcctctacgcggccatggcgggcacggtgttcatcaccctgctgtcctcggtcgcggggatgaccctggccgcggcctcgtcactcgcccacgacctgttcgcccatgcggcgcggcggggacaggcggcgccgcgcacggagatgacggtcgcggcgtggacgagcgtggctgtgggaaccgtcgccatcacgctctccaccctggtccagcactgggacgtcggcgtactgaccacgctggcgatctgcatcggggcgtcggcggtggcccccgcgctgacgtactccctgttctggcgaggcttcacgcgcaccggcctgctcgggagcctctacggcggcgcggcctgcgcgctggtgctgatggtcttctcccaggccgtttcgggtacgccgtccgccgtgttcccgaaggccgacttcgctctgttcccgatgcagtcgaccggcctggtctccataccgttcggctacctggcgggctggctgggcagccgtctcgaccgccggcgccgcgccgccgagagccgcgagaaccagcggctgtacgaggagagcgaggcacggctgctcgccgccgccgaa

SEQ ID NO: 1360 - DNA, 1077 bp, Streptomyces avermitilis
  CDS (1)..(1077)
ttggccggatacgtcactaatctgtcattgcagccagtgcgactcccgatacaggctgtgaccgtgctagagcgacgtgttgttgtggtggtgtatgcgggcgcgctggccctggacatcaccggaccgattgaagtgttcgataccgccaaccggctccttcctcccgcgggtgccccctaccggatcgacttggtgtcccccgacgcaccactggtgcgcacgagttcgggagtgagggtggaggcctctccgctggacgcggggcagggcccgatcgacacgctcctcgtgccgggcggatggagtctcgacaacgcgctccgggaccgggcgctggtctcctggatcggccgggcagcggcccggtcgcaccgagtcgcctccgtatgcggcggatcctttctgctggccgaggcgggtctgctcgacggcagacgcgccaccacgcactgggcatacagcgaggcgatggcctgccgctacccggacgtgacggtggacgccgagccgatcttcgtctgggacggccccttcgtgacgtcagcgggcgtgtcgaccgggatcgacatggcgctggccctggtcgaggccgatcacggagcggcgctcgcgctggagacggcgcggtttctggtgctgttcctcaagcggcacggaggacagtcccagttcagcgccatcctcgacgcccagttggccgaccatccgccgatccggaccgcacaggagtggatcctggacaacctgcacaaccccttacccgtggccgagatcgcgaggcgggccaacatgagcctgcgcaacttcgcccgggtcttcagacgcgaggtgggcacgaccccgggccagtacgtcgagcggacgcggatcgcccgcgcacgcgagctgctggaaaccaccgatctgacgatcggccagatagcgggccgctgcggattcgccgcccccgagaccttcttccgctccttcggacgcaccctgggactcaccccgaaggagtaccggcaccgctttcaggtcatctcgccatccggcctcatcgaccggcaccacgagacggacaggagccccgca

SEQ ID NO: 1361 - DNA, 1794 bp, Streptomyces avermitilis
  CDS (1)..(1794)
atgaccacccccacctcggacatacgctcgggcataccctcggacttacccgaggcaggaacggtacgcctggtcgaccacctggccggggaactcgccagggcgggcgtcacccacatgttcggcgtcggcggcgcgaacatcgaggacctgtacgacgccgttcaccgcggccgcgccgtccacggcgtcgtcgccaaacacgagttctccgccgtcacgatggccgacggatacgcccgaaccaccgggcgcctcggtgtggtcgccgccacctcgggcggtggcgcgatgaatctcgtaccgggcctggcggaggcgtacgcctcccgggtacccgtgctggccctggtcgggcagccgccgaccggccaggaaggccacggggcgttccaggactccagcggcagggcgggctccttcgacgcccgggaggtcttcaccccggtctcccggttctgtgcccgggtcgagaacgccgactcgctcacggagttactgccccgggcgatggcggcggcacaggcccatccgcgaggtcctgcggtgctgctgctgcccaaggacgtgcagcaggcacggatccaggtgcccggtcgcggcgcgacgccgacaccaggcatgccggagccggagccgacggcagaggcggcgtggctcgactccgcggtcctcaccgccgtgtcggacaccctgcgcggggccggccgcgtcctcgtcatcgccggtgaagacgtggccgccgcggacgcgcgggcggagctggccgaactggccggacgtctcggggcgtgggtggcggtcacccccgacgccaaggatgtcttcgacaaccgtgatccccggttcgcaggtgtggccggggtgatgggccatgccaacgtcgaggagtgtctgcggcgggccgacgtgtgcctgctggccggtacccggctgccgctcctggcacgcggcggcctcgaccgggccctggccgccaccgaggtcgtgtgcctcggtcccgaaccgccgttcgtggcgggcaccgcactgggcgggaacctgcgggacgcgctgcgcgcggtgaccggccggctcccgccgcgcccacgtgcctgcccggagcacgccggtccgctccccacccccacgccgagcccggtttctcaggcccgtgggcgacccatcccctatgcccaggcggtcgccgcggtggaggcggccctcccccaggacgcgcacgtcttcgtggacgccggcaacgcgggggccagcgcggtccatctcctgccggctccgcgccacggccgcttcgtggtggcggtcggcatgggcggcatgggctacaccttcggcgcggggatcggcgccgcgctcgccaccggccgacgcacctacgtactcgccggcgacgggtccttcttcatgcacgggatggaagtgcacacggccgtggagtacgccgcacccgtgaccttcgtcgtcttcaacaacaacgcccacgccatgtgcgcggtgcgtgaggagttcctccagggcggcgtccgcagcgacgacctgttcgcccggaccgacctcgccgccggggtggccgccgccttcccgtccctggaggtcacgggggccgacgacgctgcgcagctgcgtcaggcgctgctgcgcagcaatgcgggcggcggcccggcgttcgtcgcactggactgcgacccgggggagatccccccgttccttcccttccagtccttcaccgaagccaccgagaacgccaccgagaacaaggagagcccagttgaacgaggaatcgtccacgttggc

SEQ ID NO: 1362 - DNA, 651 bp, Streptomyces avermitilis
  CDS (1)..(651)
ttgaacgaggaatcgtccacgttggctgacatccccggtctgatgcggatcgagaatcccggcaaggaggagctgaccgcccactgcatggagctcactcacgccgtctacccccaccatcaggtctacgggcagtactgcaccatccacgcgtacgtcgactgcccaccggagcgggcctacgactacctgcgccagggccaccacctggaggagtggacctgcagcctgcgggacttcgcgcccgccggcccaccgggactgtgggtcggccacgaccggctcgaggacgacaccaggatctactgcgaggtggtcgccaaccccgaggccatgaccgtggactaccactgctcctgggaccagggcgagaagctgtggatgatctacctgatgcgcgtcgtaccggcccgcctggtgctcgacaagccggggtcggtgatcacctggaccaactgccggcacccctactacgacgacaacccgcaccccggcgcggctccccgcccggaccggccctgggtgggcgactactgggatctcttctacgcggggcacaccgtggagatgaacaacctcaaggcgatcctggaacaccgccaccgcaacggactgcccgtcaacgtggctccgccgacggcggtggcgcgg

SEQ ID NO: 1363 - DNA, 1017 bp, Streptomyces avermitilis
  CDS (1)..(1017)
gtgaccacggtcagcctcaccgacgtcgcgagctaccttcccggcgagccggtccccgcggagttctacaccgactaccccggagccgaggacaagctccgcaaccaccccatgttcaaggtcccgccgtcgcggcaccacgtggccgcggacgagtccaacgcggacatggtcgagcgcgccgtacagcctctgatcgagcggcacggcagggacgagatccgtggcgtcgacgtgctgttggtgcacagccagctgccggacctgccgttcgtgggcgccggcaccgaggtggcacgccggttgggcctgaacccggagtggctcgtcgacgtggccaacgcgggctgcgcgtccttcgtgtacatgctgaagctggcccggcagatcctcacgaccaccgacgcgaagacggcgctgatctgcaacgcgcagagcgccgcgggccagtgcttcacccagtccgaggtgcgcaggctcgcccaggccgcgatcccgggcgacggctgcggtgtggggtatgtgacgacgtcggccgacaccccggtccttgacgtggagacccggcacatcggcgagtacgccggggacatgaccgtggcggtcgacgacggccgcaagtactgggaaccgggagagtcccagctgcggatcgggttcaccgacgccagcgtcgccaaggtcctggcacgcgggaaccgtctggtaccggaggtggtcacggacctgtgccgacggctcggcgtggcgaccgccgacatcgacgtcctcatcaccaaccagcccaaccgcacgttcctgcggaactggcgggaggcgctgcaactgccgcccgaacggcatctgaacaccttcgatcagtacgggaatctgttcggagcggcgatcccgatcaccctggaccgcgcgatccgctcacggcaggtcgaggacggcgacctggtggtgctgggaggtttcgcccacgcgggcgacttcgccggtgcgaccgccgtccgctggcacggcgggcgggga

SEQ ID NO: 1364 - DNA, 1092 bp, Streptomyces avermitilis
  CDS (1)..(1092)
atggacgtcccggtgctgcaccgactggccctgaacgaaagcccgtaccccccgctgccctcggtccgcaaggcgatgcgacgggccgtcgcacaggcccaccggtacccgcagttctaccccgacgacctcaccgaactgatcgccgcgtggtgccgggtgacccccgaccgcgtcgtggtcggcagcggatcggtgggcgtcgcactccagttgctccaggcggtcgtcgagcacggcgacacgatggcctacgcctggcgtaccttcgacgcgtatcccctgctggccgccatggtcggcgctcatcccgttcccgtacccctgtcgccggacggacaacaggatctgggcgccctgctcgcggcgctcgaccaccgcacccgtgtcgtggtgctgtgcaatccgcacaaccccaccggaagcctggtcaccgcggacgatctgtcggcgttcctgcgtcaggtccccccacgcgtcaccgtgctcctcgacgaggcgtacgtggagttcgcccgcggtcccggcctgccggacacacccgcgctcctgggcgcgcaccccaacctgctggtcctgcgcaccttctccaaggcctacggcctcgtcgccctgcgggtcggttacggactcggcgcccccgacctggtggcgcggatccgccggcaacagctgcccttcgggatcaacgcggtggcgacggcggcggtgcgggcctcgctgcgggccgacggcgagctgcgcctacgtgtggacaccgtcgtcgccgaacgcgaacggctccggcacgaactcgtcgacctcggctggcgcgttcgcccgggccacgccaactctgcctggctcgacgcgccggatccgatcgacgagggcgccgcggcactcaccgccgccggtgtccaggcgcgccactaccccggcgagggactccggctcaccgtcggcagccgcaaggcgaacgacgccgtgctcgccgcgctggcgggagtcggccgacacacggcgtccggcaggcgcgcctcgtccgcagcacccgacgggacggtcgccgcccatcggcgaccgccggtgagcgggcagcggccggacgga

SEQ ID NO: 1365 - DNA, 795 bp, Streptomyces avermitilis
  CDS (1)..(795)
atgaagatctcggaccaccccgaccacggatccggtttcgccccggtcgaccatcgcacggcggtcgcggcggagaccgcccgattcgtcgcagtggtcaaggacgccgacctggcgacagcggtacccggttgccccggctggacgctggccgacctcgtcaagcacacaggcagcgtccagcggtggttctcggtgctgttgcgggcgcgcatccaggaacccccgcaaaagcgtgaagtggacctgcggttccctgacgaggagggcggatacgccgactggctggccgagagcgcgaccgtggccgcggaagccttcgcggccaccgacccgaacctgccgatgtgggcgtggggcgtcgaccagcacgcccgcttctgggcccgccggatgctcttcgagaccctgctgcaccgggccgacgccgagctggcgctcggcctgcggcccacgatcgaccgcccgctcgcggtcgacgggatcgatgagttcctcgtcaacctgcccttcgccgccttcttcgcccccaaggtggccaacctgcgcggccccgacaggaccatccgcttccgcgccaccgacggggacgacgactggctcgtccgtctgcggcccgacggcttcgggctcgacacgacccacccgaccgaggacaccgctgccgcgaccgtccggggaaccgcgaccgacttgctcctcctcgcatacggccgcctgccctacgacgcggaggccctcgcgcacgagggggacgagggcctcctggcccactggttcgccaactccgccttc

SEQ ID NO: 1366 - DNA, 171 bp, Streptomyces avermitilis
  CDS (1)..(171)
gtgcgcggaggcggcatcggagccgtcagtgagccgtcctcgccgctcgttctcgtgcaacccgtccctgagctcccgttcggcggtgtcggcgtgcgggccggtgatccggcggacacctccctcgacatggccagccactcccacaccatcctcagccggccgctcggc

SEQ ID NO: 1367 - DNA, 1506 bp, Streptomyces avermitilis
  CDS (1)..(1506)
gtgtctcacgcacagcacgcggtgccccgacgacactcaggagacaccgtggtcgtcctggcgctcgggcttgccgccatggtcgtctcgatgatgcagaccctggtcgtcccggtcctgggcatcatccagagcgacctggaggtcaccacggcaaacgtcagctgggtgaccacggccacgctcctgtcggccgccgtgttcaccccgctgctcggccgcttcggcgaccagcacggcaagaagcccaccctcgtcggcgttctgctcgtgatgatcgccggttcggtgctcgccgccaccaccacctcgctgacctggctgatcgtcggccgcgtgatgcagggagcggcgaccgcgatcttcccgctcgccctctccgtcctgcgcgaagagatcaagccggagaagttgcacggggccatggccctggtcagtggcacactcgcgttcggcagcggactcgcgctggtcggcgcggggctcctcacccagggctccgaccccgactaccaccgggtcttctggctcgcggtggcgctcgcggtgatggcgttggcaggtgtgctgttcgccgtgcccgcttcccggacgaagacgggcggccggacggactggctgggtgcgttcaccctggcgatgttgctggtgctgctgcttctgcccatctcgcaggggcacgagtggggatggacgtccggccgtacgctcggcgcgttcgtcggggcgatcgtcatggcggtggtgtgggtcatcaccgagagccgggtcaaggaaccgatggtcgacatgcggatgttcgcccatcggcccgtcctcttcaccaacctggccggactgctgctgggcttcgcgatgttcacccagttcatcggcgtctcgtacctcgtccagatgcccgaagacgtcgccggctacggcttcggcgcttccgtgctggcggcgtccgtcgtgtatctgctgccgaccacactcgtttcgctcgtgggcgctcagttcggcggcgtcctggtgcgccggctcggcgcccgcgtcacgctggctgccggggcctgcttcggagtgctcggcttcacgtggctgagcgccgcgcacgacgccactgcctcggtgatcggcgcgggcatggtcatcggactggcgatcagcttcggttacgcctccatgcccgcgctcatcgtggccagcgtcccggcccaccagaccggcatcgccaacggcatcaactccatctcccgctcggtcggcagcgccgtcgcgagcgcggtgatcacctcgctgctggcgtcgaagaccatcccgcttccggacgggatgcccgcgctgccgcaggagagccagttcacgttgagcttcaccatcgccggagcggcgttcgtcctggtggtggcagtcgccctggtcggactcaaggcggcgcatgcgcctcgtacgcccgtgctgaggaaggtcacgcagtccgggacgccgcagtccgcagaggtggaagccgacgccgaactcgtg

SEQ ID NO: 1368 - DNA, 435 bp, Streptomyces avermitilis
  CDS (1)..(435)
atgacaggaaccccccgcatcgacacggcccagctcatggagctgctctcggtgtcgctggctgcctactacggcgacttcacggtcgccgccgcgagcgaaagcctcacggccagccagggcaagacgctgaacgtgctgcgtcggggacccgcgtccatgagcgtcctggccaccacgctgacctgcgacgcctccaacatgaccgggatcgtcgaccggctggagaagcgcggtctggtgcgccgcgagcccagcccttccgatcggcgcgtcaagaacgtcatcctcaccgccgagggcgagcgggtcatcgacgtgatccgcgggaagatgcacgccacgctcgccggcctgaacagactcagcgcgcaggagcgggacaccctgtacgcgctgctggagcgtgctttcaccgcacagctcgctgccgcc

SEQ ID NO: 1369 - DNA, 780 bp, Streptomyces avermitilis
  CDS (1)..(780)
atggcaggactggatctcaccggtcgcaccgccgtcgtcacgggcgcctcgcgcggtatcgggctggcgatcgcgcaggccatcgccgccgccggcggaaacgtcgtcctcacctcccggtcccaggaggcggctgacgccgccgcggcccgggtcgggggcacggcggtgggcgtcggtgcgcacgcggtcgacgaggaagcggcccggcgctgtgtcgatctgacgctcgagcgcttcgggagcctggacatcctcgtcaacaacgcgggaaccaacccggctttcgggcccgtcatcgaccaggaccacggccggttcgccaagaccttcgacgtgaacctgtgggctcccgtcctgtggacgggtttggccacgcgggcctggatgggcgagcacggcggcgcgatcgtcaacaccgcgtcggtgggcggcatggccttcgaggcgaacatcgggttgtacaacgcgtcgaaggccgcgctgatccacctcacgaagcaactggccctggaactctcgccgaaggttcgcgtcaacgcggtggcgccgggtgtggtgcgcacgaagctggccgagtctctgtggaaggagcacgagcaggccgtgtccgccgcgacggcactcgggcgcataggggagcctgccgacatcgcctcggcggtcgcctttctcgtctcggacgccgcgagttggatcaccggcgagacgatggtgatcgacggcgggcagctcctcggtgacgcgctcccgttcagggaaggagccggcatcggcctt

SEQ ID NO: 1370 - DNA, 1263 bp, Streptomyces avermitilis
  CDS (1)..(1263)
atgtccctgttcgagatgtcggaccgcgccaagaaataccaggcggaactgctcgagttcatggattcgcatgtctaccccgctgaggcggtgtaccacgagcagatgagcgcttcgggtgacccgcacttccaccccccggtcatcgaggagctcaaggcggaggcgcggggacgcggactgtggaacctcttccacccgcacccggaatggggccccgggctgacgaacctcgaatacgcgccgctggcggagatcatggggcgcagccacatcgcctccgaagcgtgcaactgcaatgctcccgacaccggcaacatggaggtgctcacgctgttcggcagcgacgagcacaaggagaagtacctcaagcccctgctcgacgggacgatggcctcggccttcgcgatgaccgagccgcgtgtcgccagctccgacgccaccaacatcgagttgcggatggagcgcgacggcgacgagtacgtactcaacggccgcaagtggttcgcgtccaacgccctgcaccgcaactgcaaagtgctcatcgtcatggggaagacggaccccaccgctgatccgcaccgccagcagtcgatgatggtcgtcccgatcgacgcccccggggtcacggtgatgcgcggcctgctggtgttcggctaccaggaccgtgaggggcacgccgaaatcgacttcaccgacgtacgggtgccggccaaggacgtcctcaagggcgagggagagggcttcgcgatcagccaggcccggctcgggcccggtcgtatccaccactgcatgcgggccatcggcgcggccgagcgggcgctggagctgatgtgccgacgcgcgcagtcacgggtgacattcggcagtccggtcgccgagcggtccaacatccaggactggatcgcggaagcgcgtatcgacatcgagatgatccgcctgctcacgttcaaggccgcgtatctgatggacacggtcgggaacaagggggcgcgcaccgagatcgcggccatcaaggtggccgccccgaacatcgcgttgaagatcatcgaccgcgcgatccaggtgcacggagcggcgggcgtgagcgaggacttcccgctggcgatgatgtacgcgcagctgcggacactgcggctcgcggacggtcccgacgaggtccacaagcgagccatcgccaggcatgaactgggccggtaccgcgacgccgccggggcggccggcggcacggtcacccccggcggtcacaaggcagtggtgagc

SEQ ID NO: 1371 - DNA, 726 bp, Streptomyces avermitilis
  CDS (1)..(726)
atgacgatgacgtcggattcaagtagagtttccaggatggacaccactgggcccgaggagatcgacggcgagaaggtaccgcccgtggcgcccctctcgcaccttcgcgagccgcctacgacgaagcgcggagcgcggacccgggccgctctggtgaaggccgcgcggaaggtgttcgaacgggacggctacctcgacacccgcctgaccgacatcaccaaagaggcgcaatgcgcggcgggatccttttacacctacttcaccaacaaggaagaggtgcttgccgccgtcctcctggaggcgcaggaggacatgatgcaccccggcatgagccgggtgcagggtagcgacgatccctatgcggtactcgaggcgagcaatcgcgcgtatctcgaggcgtacaaacggaatgcgaagctgatggcgctgctcgagcaggtcgcacaggtggagccggagttccgtacgttccggagccggcgcgctgacgcgttcatccgccgcaatgcgcgcggcatcgctgaccttcaggcacggggtgtcgcagaccgtggggtcgatccgctgatggcctcccgtgcgctgtcgggcatggtcagcgtcatggcctacaacgccttcgtgctcggcgaacggcacgaggaagatgcgccggtggacttcgaggagctcgtgtccacggtcacccggctctgggcgaacgccctgcggttccccggccacggc

SEQ ID NO: 1372 - DNA, 645 bp, Streptomyces avermitilis
  CDS (1)..(645)
gtgaatacggtgtcgaacgtggcggaaaagacccgaaccgcggtcctggtggacttcggcggggtcatcacctccagtgtgttgcgggctttcaccgacttcggtgcctcgctcggcggcgacccgcgcctgccgctggacctcctcggccgggaccagccgtcacgcacccttctggccgaccacgagtgcggccgtatcgacgccgaagcctttgagcgaggattcgccgaacgtctccgcgtccacggcgccgacgtaccggccgaggggctgacggcccggatgcaagcgggaatgtcgatcgaccaggacatgctcgcgctgctcggtggtcttcgagccgccggccatccggttgctctcgtatccaattcgttcggtaccggaacctacgacggcgtcgacctcgccgctgttgccgatgtggtcgtcatctccgccgaggtcgggatccgtaagccctcccggcggatctacgcgatcgcatgtgaacgcctcggcatcgaccccgaggaggcggtcatgatcgacgatctgcggcagaacctcgacggagcggcacggatcggaatcgggggcgtcctgcacaccagcgccgccgacacccgccgccaactcgccgaacgcttcgggatcaccgcc

SEQ ID NO: 1373 - DNA, 1197 bp, Streptomyces avermitilis
  CDS (1)..(1197)
atgagggaagcagtcatcgtttcgacggcacggacgccgatcggaaaggcctaccggggcgcgttcaacgacacccaggcgcaggaacttgccgcccatgccctttcgcacgcggtgcggcgcgccgggctcgagggaggtgaggtcgaggatgtgatcttcggctgcgccgtgcagcagggatcctccggtggcaacgtggcgcgtcaggccgctctccgtgccggacttccggacaccgtgtcgggcatgacggtcgaccggcagtgctcgtcgggcctgatggccattgcgacggccgccaagcagattgtcacggacggcatgcaggtcgctgtcggcggcggtgtcgagtcgatctccttggtgcagaacgaccgcatgaacacccaccgcatggcggatccctggctggtcgagcacaagccgagtatctacatgccgatgttgcagacggcggagatcgtcgccgaacgttacggcgtgagccgggaacgccaggacgagttcgcgctggtgtcacagcagcgcaccgcggcggcgcaggaggccggccggttcgaccgcgagatcgtggcgctcggcagcgtcaagaaggtcctcgacaagcagaccggcgaggtgcgggacgaggaggtcaccctgacccgggacgagggcaaccgcgcgtcgacgacgctcgaaggtctggccgggctggcgccggtgcttccggacggtcaggtgagcgcgcattccagcgtgacggcgggcaactcctcgcagttgtcggacggggcttcggcgtcggtactgatggagtcgaaggaggccgagcgccgcggactggaaccgctgggcgtctaccggggtatgaccgttgccggttgtgggccggacgagatgggcatcggtccggtgttcgccattccgaaactgctgaagcagcacgacctcaccatggacgacatcggcctgtgggaactcaacgaggcgttcgcttcccaggcgttgtactgccgtgacgaactgcatatcgacccggagcggttcaacgtcgacggcggcgcgatctcggtcggtcatccgtacggaatgaccggtgcccggctggtggggcatgccctcatcgagggcaagcgccgaggtgtccggtatgtggtggtctcgatgtgcgtcggcggcggcatgggcgcggccggactgttcgaggtcgtc

SEQ ID NO: 1374 - DNA, 1110 bp, Streptomyces avermitilis
  CDS (1)..(1110)
atgaatcccgtccgctacgaggactaccggcccaccgaacgcccgtcctaccaggaggagatggaagcagtcgtcgcccaggtggcgcgtcgtacgcgcgcctcggtcgagcgcgagaccgtcggccgcgctgtccgcaccgcccacggaaagacctacggcctcctcaaggccacggtcacgattggtgacaaccccggcgtctacgggcagggaatcttcgcccgcccgaccgcgtacgacgccgtcgtccgctactcgaacggcttgggccacttccgccccgaccaccagctgggcgcggcgtgcggaatgggcatcaagctgttcggagtcgacggcccctcgctgctggacgacgaacgagacagcggcaccttcgacctcaacctgatcaacaacgatgtcttcttcgcgaacacggcctacgactatatggtgatcgaggagctgttcgccgaattgcccgaggcgctcgtggacccggcccgccgcaagacctggatggcggagttcctgacccgccggcagacgctcaccgatcccggcagctggctgtgggacgaactgctcgccatgctgtcgttcaccagtgtcccgcgcaggaacctgctgtcgtacagctacaacagcatgggcgccttccggtacggcgaccacatcgccaagatccgtaccgtgccgaccgccgcgtccctggcctccctcacgcaccagatcgtggacgtgcgcgcggacaacgaggcgttccggcgcaccctggtggccgaggccgccgagcgagaccactccttcgagctccaggtccagctcaacaccgatctggcccgtatgccggtggacaacacgtccgtcaggtggcccgaggatctgtccccctgggggacggtcgcccgggtggacatcccgcgccaggacatcggcgggaacgacaacctggcggccgccgacgccacgtcgatcacgccgtggcgatcacgccaggaacaccggcccatcggcgagattcagcgggtgcggcaggaggtgtaccggcgttcgtccatcgaacggcaccgcatcaacggacaagagcggcgcgaaccggccggcagcgctgagctgctgggc

SEQ ID NO: 1375 - DNA, 1368 bp, Streptomyces avermitilis
  CDS (1)..(1368)
atgaccgaggtggtcgcggacgtcgccaccgccctcgccgccgcgctgccgggccgggtggtcaccgaccgggacgcgatggaggcctaccgccgtgaccagtgcctgctggctcccgcggggcgcccggcggcggtggtgcgcgctcgctcgaccgatgacgtgatcaccacgctgcgcacagccggcgaccatcacgccccagtggtgacccggggggccggcaccgggttggccggcgcggccaatgcgatcgacggctgcgtcgtcctctcgctcgccgcgatggaccggatcctcgccctggacgtgcctggccgcacggcaacggtcgagccgggcgtactgaccggcgatctcgacgcccgagcccgccagcacggcctgtggtatccgccggacccgggaagcaaggcgatctccaccatcggcggcaacctggcgaccaacgcgggcggcatgtgctgcgccaagtacggggtcaccgccgaccatgtcgcctcgctgacggccgtactcgccgatggccgcgtgatccgtaccggtccgccgacccgcaagaacgtcgccgggctcgacctcacccggctcctcgtcggctccgaaggcaccctggcggtgatcgtggacgccaccgtgcgactgcgaccgttcccggtggccaccgcgacggtggtggccacgttcccgacacctcgacaggcggtcgacaccgtgctgcggatcgcggcggtcgccgacccagcggtggtggagctcatggaccgcacctgcatgggcgccgtcaatcgcctgacacgcatggggttggacgagtcggccggggcgctcctgctcgtccagtgcgacgggccgtccgccggtcaggaggccgccacctgcgccaggctggccgaagccggtggcgccaccgaagcgctgcacaccgccgacccggcggaaggcgagatgttcatgcaggccagacgaatggtgtaccccgcgttggagaggctgggcaccacactgctcgacgatgtcggcgtcgcggttcaggacctcccccgattgcttgccgcgatcgagcgaaccgccgccgagcacgatgtgctggtcggcaccttcggccacgccgccgacggcaacctgcatccgaccgtcgtctacgacgccgccgaccgtgacgcggcagaccgcgccggtgccgctttcgacgacatcgtggccgccgcgctcgctctcggcggcacgatcaccggcgagcacggcgtgggctcactcaagacacgctacctcgacgcacaactcggtcccaccgagctggagttgatgaccggcatcaaggccgtcttcgaccccgcggacctcctcaacccgggacgcgcgtat

SEQ ID NO: 1376 - DNA, 708 bp, Streptomyces avermitilis
  CDS (1)..(708)
gtgcgcggtatgacgatttcgccggtatcgcgcgtgcccttgagtctcgacgtggctcagcgcctgcgggcggccatcctcgacggcacatttcccgccgacaccgagctgcccacggaaaccgaactcgcccagtccttcggtgtcgggcggtccaccgtccgcgaggcgctgcgggtgttgcaggcgcacggtctgatcagcggcgcggacaccgtttccaccgcgcgtccgcgcgtcacccacgagcgcacggcgggcgcggcgggcctggcgctgagcaccgctctgcaggtcggcgcgatcccgctggccgacctggtggcgctgcgcacgctgctggaggcggaggcgatacggcagaccacggccgtgccggatgcggctcggtcctgcctggtgaccatggcggcagcggtggagaacgccgacatccagaccttccacgccgctgacgtggacttccatgggcaactggcctacgccggcggtaatcaggcgctggggttcgtcatcggcgtgctgcgcgactgcatcgccggctacctgctcgacgcgctcgccgcggtggccgatcggggcacggtgctcgcgcgtctgctcgccgaacaccaggcgatcgtcgacgcgctggacgcgggcgagaccgaccgcgccgccgagttggtcgtggctcacgtccgcggcttctacgagccgcagacgcca

SEQ ID NO: 1377 - DNA, 705 bp, Streptomyces avermitilis
  CDS (1)..(705)
ttgtctgtttgtcagacaaggagctaccgtggttctcgctgtgcctcaggacacaaggccactacctcaaagacgcggaagtcaggtgtcgccatgaccgagaagctcgagctcgacccggccaggaccgcgatcgtgctcatcgagtaccagaacgagttcaccagcgacggcggcgtgctgcacggggcggtcgccgacgtcatgcagcacaccgggatgcttgccaacaccgtcgccgtggtcgacgccgcccggcaggccggagtaccgatcatgcacgcgccgatcacgttcgcggagggctacggcgagctgacccgacacccgtacggcatcctcaaaggcgtcgtggacgggaaggcgttcgtgaagggcacgtggggcgcggccatcgtcgacgagctggctccggtgaacggggacatcgtcatcgagggaaagcgcgggctcgacaccttcgccagcaccaacctcgatttcatcctgcgcagcaagggcgtcgacacgatcgtcctcggcggcttcctcaccaactgctgcgtggagtcgaccatgcgcaccggttacgagcgcggcttccgggtgatcaccctgaccgactgcgtcgccgccacctcgcaggaggagcacaacaacgcgatctcctacgacttcccgatgttctcggtgccgatgacctctgccgacgtcatcgccgccctg

SEQ ID NO: 1378 - DNA, 1275 bp, Streptomyces avermitilis
  CDS (1)..(1275)
gtggaccggccgccggccgatccccatggcccctcgcccttgtgcacctcactcacggagcgcgacatgccatcggaccggatacgtgagctgatcgggcggggcgccgcggtggccgcgcgtgctccggaggagtggctgcgcgagatcgaggacgccactttgtcggcggagtacctgcaagccctggccgatgacccggatctcaccgctcagatccgccgcaccagccgcgccaacgtcctgcactgggcgacgtggaacgtgcgcagcccaggtgctccggtgccggcgaacgtcggcccggaagccttggccaccgcccgggagctggtccgccgcgggctgaacgactcggccttgcagtcctaccgcagcggtcagaacgcggcctggctgcgctggatgtcgatcgctttcgagctgacgtccgaccccgcagagctgcgggagctgctggatgtctccacccggtcgatctcggcgttcgtcgacgccaccatcgccgcggtctccgcacagatccaggcggagcgcgacgagctgacccgcggtacgaatgccgagcgccgagaggcggtgaccttgctgctcaacggggcgccgatccacccggacagggcctcggcccggctcggctaccgggtggagcagacccataccgcggccatcgtatggagtgacgccgcggagtcggacctgggcgatctggagcgcgcggccgacgccctggccaaagccgccggcgtgtcccgcttcctcagtgtgacggccggtgccgcgatgctgtgggtgtggctgccttctgccgcgctgccggcgacgaaccggctggagcgacacctggacagccatcccactgcccgggcagccctcggcagtaccgggcacggcgtggaaggctttcgccgcagtcacctcgacgcgatgaccacgcagcgcatgatggcgcgcctgcacaccgtccgctccgtggcccgtttcgaaacggtcgagatcgttgctctggtgacgcgggaaccgcagcaggccgaccagttcgtacggcgtaccctgggcggactcgccacgggtgcgccggagctgcgtgaggcggtggccgcctacatccacgaggaatgcaacgccacccgggcggcagcccgcctcttcacccaccgaaacaccctgctccgccgactcgagcgagcccagcgcctcctgccccacccgctggcggggaacacggtgcgcatcgcggtcgccctcgacgtcctgcactggcgcggcgacgga

SEQ ID NO: 1379 - DNA, 1527 bp, Streptomyces avermitilis
  CDS (1)..(1527)
atgtccgtctctgaggcaccgacagctaccgagcacatcgatgtgctgatcgtcggtgccggcatctccggcatcggggcggcccactacctgcaaagcgagcacccgcagcgcggctacgcgattctggagacgcgtggcgcgctgggcggcacctgggacctgttccgctacccgggcatccgctcggactccgacctgcacaccttcggctacgccttcaagccctgggaagaggaggccatcgcccgcggcgacaagatcctcgcctacctgcacgaggccgccgcggaggacggcatcgacaagaaggtgcgcttccaccacacggtgcgcggcgccgcctggtcgagtaccgaggctcgctggacggtccaggtcgagcgcaccgacaccggcgagcggctgagcctgtcgtgcaaatggctgttctgcgccggcggctactaccgctacgaccaggggtacaccccgcacttcgagggcatcgagcggttcgagggcctgatcgtgcatccgcagcactggcccgaggacctcgactaccgcggcaagcgggtcgtggtgatcggcagcggcgccacggcggtcaccctcgtgccggccatggcgggcacggccgcccatgtgacgatgcttcagcgcacccccacctacatcttgcccgtccccgccacggacaagatcgcccagctcctgcgcaaggtcctgggccgacgccgcgggtatgcgtggacacggcgcaagaacatcgcccagcaagccgcgatctggcggttctgccagcgcttcccgcgcagcgcccggcggctgatccgctgggtcaacacccgtcggctgcccaagggctatccggtcgaggagcacttcgacccgccctacgatccgtgggaccagcgtatgtgcgtggtgccggacggcgacctcttcgaggcgctgagcaacagcagcgcctcgatcgtcaccgaccggatcgacaccttcaccgaacgcggcatcagcctgtcctccgggcgcaggctggaagccgacatcatcgtgaccgcgaccgggctgaacgtgcaggcactcggcggtatccagctcaccgtggacgggacgaaggtgcacctgccggacaaggtcgcgttcaagggcatgatgctgtccggggtgcccaacttctcgttctccgtcggctacaccaactcctcctggacactgaaggtcggcctgctgtgcgagcacttctgccgcctgctcgactacatggacgcccacggccacaccatctgctgcccggagctgagcgaccccgacatgcccacccgcccgctgctcgacttcgaagccggctacatcaagcggggcatcgaccacctgccgcgccaaggcaccgaggaaccgtggctgatgtcgatgaactaccaggccgacgtcaaactcctgcgggaagactccgtggaggacgagaacctctgcttctcctcccccaccgccaccccccgcccggcgcgcggcctccaggcgacggcacacctggaacca

SEQ ID NO: 1380 - DNA, 2559 bp, Streptomyces avermitilis
  CDS (1)..(2559)
atggcatcagcctggtcccccaccaggcgtgggagcagggagcgacccacccgggtccgcgtcacgacggtcgcgggccgcgtgcgaagaaccggagtggacgacataggtatccgatacgaggtggtgtccggggtggaaaagcggatgacggtgctcagcgagagtggggacgatccgttcgctctgcaccacgccgcctcggtggtgctcgacgaccgggggaccgtggtcggctggagccggcgggcccaggagttgctcggctacccggagtccgcggtgatcggccgtccggccttcgatgtcctgatcgatcccggcagcctgccggccgccaaggacgccgcggcgacgtgcaggagggacggaggctggttcggcgtactggcggtgcggcacagcagcgggcggctcgtggagatgggtttccgggcacgtgcgctgctgcgcggtgaccatgtccgcgaatggttcctcgtcggggcacccgcggcggaggtcctcgagtggcaaagggaccgcgcggtcctcgacggattgttccgccggtgcccgatcggtctggtcgtgcacagccccgagctgacgattctgcgggtcaacagggcgatcgaacggttcaccggaattccggccgcctcctttcggggaatgcccacgggcgccctgctggtcgccgaggacgcgcggacatccgtggaccgggtccgccaggtggtggagaccggaagatcacaggtctccaccgagcagtacgcccgcctggagcgggatccggcacgcgtgcgggccgcgtccgtctcggccttccggctggaggatcccgccggccgggtcctgggggtggccgagacggtcgaggacgtcaccgaacgccatcgggcccgccttcgcctggcgctcctcaaccaggccggcgcccgcatcggatcgacgctcgacgtgcgggagacggcccgcgaactcgcggatgtgatggtcccccacctggccgaccacgtatcggtggacctgtcgccaccggtgatgcgcggcgaggagccggcgcaggcgccgacggggcccgtcgcacgggtggcggtccgcggcgtcgtggcccggcagcccgacctcgagtacccggaaggggagccggtgcagttcgcacccggcacaccgcaggccggctgtctggccgacgggcgtccggtcctggaaccggtcctttcgcccgactggttcttggcagaaccgcgtcagggcgagcacgcaccggacctgtcagcccattccctgatcgtggtgccactggccgcgcgcggcctggtactgggcgtgatgagcctgtggcgatcgcggcaccccgagccgttcgagcccgacgatctcaccctggcccaggaactcgcctcgcgcgccgcggtcagcatcgacaacgcccgacgcttcacccaacagcagcagaccgcgtccaccctgcaacgcaccctgctgccgaggacggttccgcaccagccggccgtcgaagtggcccctcgctacctcccggccagtacggcgtccggccccggcggtgactggttcgacgtcatcccgttgtccggggccagggtcgcactcgtcgtcggcgacgtggtgggccacggactgcacgccgctgccacgatgggccggctgcgtacggccgtgcacaccctcgccaccctcgacctggaaccggacgaggtcctctcccgactggacgacctggtcaacctcctggccgcggaacaagagacagccggcgaaggacccgcgggcgagcagatcgtcggcgccacctgcctgtacgccgtctatgaccccgtttcccggcaatgctccgcggcgcgcgccggccaccccctaccggtcgtgaccacaccggacgggcaggccggtttgctcgacctgcctccaggcccaccgctgggcctgggcggcctgccgttcgaggcccgggagatcgagctggccgagggcagcctgcttacgctctacaccaacggactcatcggcgaacgccacatcgacgtcgacacgggcttgcaacggctgcgcacagcgctcacgcacccggcggaccccttggagaagacatgccaggcggttgtcgactccctcgtgcccgcacagcccgctgacgacatcgccctgctcatcgcacgcacccgggtactgccaccggagaacgtcgcgtcctggcaactgccgctggagccgaccgccgccgcccaggccagagcgctcgccacggcccagctcagtcaatggggactggaacacctggcgttcaccaccgaattgatcgccagtgaactggtcaccaacgcctaccgatacgccggcggcccggtgaccctgcggctcatccgtgaacgatgtctcgtctgcgaggtcgccgacgccagccacacctcaccccatctgcggcgcgcccgcacgaccgatgagggcggtcgcggcctgttcctggtggcccagatgaccgagcgctggggcacccgctactcccgcgagggcaagaccgtctggaccgaacagccgctgctcgggctg

SEQ ID NO: 1381 - DNA, 1788 bp, Streptomyces avermitilis
  CDS (1)..(1788)
gtgttaatgccccgccaacaacccggaagctcactgagagcagccagagagctctacctggaagtcaccaaggatccaagcgcccggccgctcgtggtggcctcatggcatcgctcgatggaataccaggtgaagtcgggcagcctcgaggctccgtacctggacaaccccaatctggacagccccctcgcaagggccgcgctgccgatccaggacaggctgcacgagcagctcgccgacgacccggtctccacgatgatcacggaccgtaacggtgtggtcctgtcccggaaggtctcgcacgagggcctgacgacgaacctcaaccgcgtgcacctggcccccggccatgtgttcgccgagcgctacgtgggcaccaacggcatcgggaccgcgctggccagcggccgcccggtgatgatcgccggaatggagcactacgtcgaggcgctgcgggacttccactgcgcggccgtaccgatcctgcatcccacccggcgcaccctgctgggagccttcaacctcaccaccatccgccagggctccggcggcatgctgatggccttcgcccgctcggtcgcggcccagatcgaggccgagatcgcggcgatcacctcgcggcgcgagcgggctctgttccaggactacatggaggcgtgctcctcgacgcgcccgggacccgtgctggccctcaaccgcgatgtcgtcatgatgaacgagccgctcagtgccgccgtgaccgggccggatcactatgcgctgctcgatcacgcccgtgagatcgccgaccatccccggctcgaggggacccgcagcatcgccctgccctcgggacgggtcgccgaactcagggtcagtcgctgtcggcgcgaggacagtgacgcgggcgccgtcttccgagtccggctgatcggacggctccagcccacatctgcgggttccgcctcgcccgcccgctccagcctgggactggtgggctcgtccccgcactggctgcgcgcggtcgccgacagcgaagcagcgttcgtcgccgggacctggcttcatctcctgggcgaagccggcgtcggcaagaggacgctggtcgcggccctgcaccgggcccacggcgccggacgccggctggagatgacacaagcgccgccgtcggattcaccggccgtcaccgagcgctggctgcacgacatcggagagctgcttgtcgtgccgtccaccgtgctcgtcctgagcgacgtccacctgttgggcgaccagctgcggcagcggctggcggacctgctggtgcggctggacggcagcgcgagtgggcagctggtcatgatctgccagccgtcgatggtcggtgccgacgaccacctcgaccagctctgtggcgcctcggtggaggtgcctcccctgcgtcatcggtatggggacatcgagcacctggcgcggttgttcctgcgcaagtaccggccgagcggcgagaacacgttctccccggatgcgctggccctgcttcagcgatgcccctggccggagaacgtccggcagctcgagacggtgatccgcggcctggcgcgacggccttccggccggatgatccacgtggaggacctgccgccggaatgccgggtgtcctcgcacaaggtcctgaccaccatcgaggcgctggaacgcgacgccattctgcgcgggttgctggaccgcaactccaacgtccagcggaccgcgcaggacctcgggatctcccgcgccacgatgtaccgcaagatgcgccgctacgggatcgtcccgtcgagcctgacg

SEQ ID NO: 1382 - DNA, 1023 bp, Streptomyces avermitilis
  CDS (1)..(1023)
atgaaagccgtgcaggtcatcgagtacgacgagccgcccgcgctcgtggacgtaccggacccgcagatcaccggcccgctggatgtgatcgtgaagatcgggggcgccggagtctgccggaccgatctgcacatcctcgaaggacagtggaaggacaagagcggggtcgcccttccgtacacgatcggtcatgagaacgccggctgggtcgccgaggtcgggcaggccgtgacccacgtcaaggtcggtgacccggtcatcctgcacccgctggtgacctgcggtctgtgccgcgcctgccgggccggcgacgacgtgcactgcatgaactcggcattccccggcatcgacaccgccgggggctacgccgagtacctgaagaccaacgcccgctccatcgtgcccctcgccccgtccctggagccggcctcggtggcggccctggccgacgccgggctcacggcgtaccacgccgtcgccaaggcggcgcgggtgctgcggcccggtgacaaggccgtggtcatcggcgccggcggactcgggcacatcgggattcaggtgctgcgggccctgtcgccggtcgagatgatcgtcatcgaccgcagcccggaggccctcgcgctggccaaggaactgggcgccgaccacacgctcgtcgcggacggaagcgaggccgaacgcgtacgggacctcaccgcggggcacggggcggaggccgtcctggacttcgtcggcgaagggggcgccgtcgagacgggagtggcctgcctgcgccgcaacggcaattaccacgtcatcggttacggcggccgtctgaacgtgccgacgatcgacgtcatctccacggagatcaacttcatcggcaacctcgtcgggtcctacaacgacctctccgagctgatggtcctggcggcccagggcaaggtcaccctgcacacccagcgctaccccctcgcctccttccggcaggccctcgacgacctggacaccggggccgtacgcggccgagcgatcttgatcccc

SEQ ID NO: 1383 - DNA, 1599 bp, Streptomyces avermitilis
  CDS (1)..(1599)
atgcgtacgagaccctacaagcggttcgccgccgtcgcggccgtcgcggcgctgaccgccaccgcgtgcaccgccccggaccaggcacaggaagggccgaaggacaaggccccgctcttcaagctcggctcgcagatcagctacgagaagtacggcaaggactacccggacaccaaggtggaggacgtcccggggccgtgcagctatgaggcgatcagccggaaggactactccgggcagacgctgaagatcatcagccatgccgtgccggtaatcggcgagccgactcagctgcacgccaagcagttcgaggagatcaccggggcgaaggtcgaggtggtcaacgtccccttcggtgagctgcaccagaagatcctcacgccccttcaggcgggccagcccgcctacgacgtgatgttctacccctcgctgtggataggcgacctggccccgtacctcgcgccggtgccgaagaagtatctgaacactcccggcatgaaggacgtcacgggtacctatatggacgtggcgacttggaacaggaaggtcgtgcagtaccccatggacggggaccggcactacctcaaggtccgcaccgacgtgctgaacgaccccaagcagcaggcggcctacaaggcggccacgggcaaagagctgagagttccgaagacctgggacgaataccaggacgtcgccaagttcttcagcggcaaggacttcgacggcgacggcaagcgcaactacggcagcgccgaggtgaccaagcgcgacgatctgacgttctccgccttcatcagccgggcggcgccgtatgtgaagaacccggacgtcaagggcggtgtcttcttcgacctcgagaccatgaagccgctgatcaacacgcccggcttcgtccgcgccctggacgacatggtgaaggccaagtcgacctgggcacccggtggcgccaacttcggcctgggagacgagatcttctccttcggcggcggccagacgctgatgtcgtactcgtgggacgacgccttcatccaggcccagcagcccgacagcaggatccgtaacaaggtgcaggcggcgccactgcccgggtccagcgaggtctacaaccgcaccaccaagtcgtgggacacgaaggcgaaccaggctccctacttcacctggggctggacttcggcggtggccaaggcctcacgccaccagcagatggcgttcgactacctgtgcttcttcagcaacgaggccaacaccgccctcgacctgaccatcggccggttcggcgtcaacccctaccgctactcccacttcgacccgagcttctgggagaggctgggctgggacccgaaggtcgccaagtcgtacgtgaagacgctctccggtatggaggagagccgcaaccgcgtcttcgacctgcgcgttcccggtgtcaaccagtacatgtccgcgctggccaacggcgtcgccgcggcgctggcgggccaggactccccgcaggacgcgctggacggcgtggccggggaatggtccaagatcaccggtcagatcggcaaggacaaggtccagagcgcctatcgcaacgtggtcgcgctcgaggacaactcc

SEQ ID NO: 1384 - DNA, 936 bp, Streptomyces avermitilis
  CDS (1)..(936)
gtggccggaccggaccggccggccacccgggggcgcccgcccccttccgcaaggagaaccatggacggcctgcgccggcacaagagcatgttcctgctgccgggactgctcacactctttctgatcatcattttcccgcttctgttcaccatccgggtcagcttctccggctggaacgtcagcaaccctcagatggacttcatcggaggcgccaactacaccgcgatgctgcacgacagccgtttctgggcctccatcacccggctgatcctgctggcgggcggcacggtcctgatccagtacgtcatcggattcggtatggccctgctggtctggcgcgaggcgcgcggccgcagattctggcgggtgctctttctcgtccccatgatgaccacgcccgtggtgatggccgccatctggcagacgatcttccatgagtcactggggccggcgaacgatctgctggggatgctgggcctgacgaacattccctggctcaccgagtcgggtccggcgctggtcgcgctgatgaccgtcgaggtctggcagtggacccccttcatgttcctgttgctgctggccggtctgctcagccttcccaaggaaccgttcatggccgccgcgatcgacggcgccggcacctggcgcaccttctggaaggtgaccttcccgctgatggcaccggtctcggtcgcggcgatcgtcatccggctgatcgaggcgtccaagctctccgacagcgtctacgtactgacgtccggcgggccgggatcctccacggagaccccgggttactacctctacatccaggggctccgcgatcagcagaccggctacggcggggcgatgtccctgacctacctcgtcctgatgatcgtcacgctcacggtcgtcgccgccctgctcaccagggccttcaagctgaagggggactca

SEQ ID NO: 1385 - DNA, 843 bp, Streptomyces avermitilis
  CDS (1)..(843)
atgaggtcgcgcctttatcccgtgttcaagtacaccgtgatcgcgctgtgggcctgcttcgtcgcgggaccgttcctctgggccatgacgaccagcttcaagaacgccaacgccgtccagggcggtcccacctacatcccctgggtgcagtacaagcccaccctgaccggctggcacaacatcttcggcggggccggcggtatcgatgtggtccagcccttcgtcaacagcgccgtcatcaccatcgccgcgtccgccatcagcctggccctggggtccctggccgcctacgcgctgtcccggtaccggttcaagctgggtttcatcaagaacagcgacatcgtcttcttcttcgtctcccaacggatcatgccgcccgtcgtcctggtgatccccttcttctacctccttcagtggggcggcctcctggacagcatcccgggcctggtcatcgtgacggtcgcgctgctgctgccgatcgcggtgtgggtgatggtggacttcttcaacggcatcccccgggagatcgacgagatggcgatgctggacggctgccccccgttccagaccttcgtgcgggcgatcctgccgaactccctgcccgggctgaccgtggcggcgatgttctgcgccgtgttcggctggaacgacttcttcttcgccttccggctgaccttcaccgaggtccagacgctgccccaggcggtcgtcgccctcaactcctccattccaccgtggtggacgctgtccgccgccgcgctcttcggcgtggcaccgctgatcctgctcgccctctgggtggagcgtctgctgtccaagggcaacctgtcgggagccgtccga

SEQ ID NO: 1386 - DNA, 1086 bp, Streptomyces avermitilis
  CDS (1)..(1086)
atgaacctgcatgccactgatctgtgcctgaccgtcgacggcgtcgaccacctcaagaacgtgaccgccaccttccggccgggccggctccacaccgtcatcggccggacgatggccgggaagacgacgctgctgcgggccctggccggcctgcagaaagtggactccggctcgctgacccgggcgggagccgacttcctcaagacgccggtgtggcggcgcgacaccgccatggtctaccagcagttcatcaactacccgcatctcaacgtgttcgacaacgtggccttcccgctgaagcgggccgggctgtcacgggacgtgatccggcgacgggcccggcagagcctggcgagcgtgggactcgcggacttcgagaagcgcaagccctcccagctctccggcggccagcagcagcgcgtcgcgatggctcgcgccctggcccgcgataccggcatcctcctgctcgacgagccactggcgaacctggactacaagttgcgcgaacaactccgcgacgagttcaaggccctcttctcggaccagggcgacacgatcgtcatctacacgaccaccgaacccgccgaggcgatgatgctcggggacgtggtcctggtcatgcacgaggggcggatcctccagaccggcaccccgcaggaggtcttcgaacgcccggcgaccaccacggtggcgtccatcatcaacgacccgcccatgaacatcttcgcgggccggatcgagggcggtcaggtcacggtggccggcttccaggccacgcacatctccgcgcacctggccgacctgcccgacggtacgtaccagttcggactgcgcgccaccgacgtcggcctggcttccagcggggtcgagggcgaggtcaccttcgtcgagatctccggctccgagaccttcgtccatgtggtcgtcggcgagacccccttcgtcgtacagatcgagggcatccacgacgtcgccctcggcgacctggtcagacttcggctccgtcccgaccggctgttcgccttcgacgagcaggggacgctcgtgcgaacaccttcatacgatctcgcttcagtggaagggcgc

SEQ ID NO: 1387 - DNA, 1077 bp, Streptomyces avermitilis
  CDS (1)..(1077)
atggcgcagttggacatcgtcgacgtcgggcacgcgtacgcgccgggtgccgaggaggagcagtgggctctcaaaccgctgaggctgaccttcgagtccggcaagacctatgcgctggtcggaccctcgggctgcggcaagacgacgctgctgaacatcctgtccggcctggtcagaccatcccggggacaggtgctgttcgacggcgtcgacgtcaccgccctgcccacgaaggcgcgcaacatcgcccaggtcttccagttccccgtcatctacaagtcgatgacggtctacgagaacctcgccttcccgctggaatgccggcgctgggacaaggcgaggatcgacgccaaggtccggcaggtcgccgaggccctggacctgcacgaccggctgaggcagcccgctcgcgggctcaccgccgacgacaaacagctgatctcactcggccgcggcctggtccgtgacgacgtggcggccgtcctgatggacgagccgctcaccgtgatcgacccgcagctgaagcactcgctgcggcgcaagatccgagagatcaccgagcagttccggcccacggtgatctacgtgacgcacgaccagtacgaggcgatgagcttcgcgcaggaagtgctcgtcatgaaggacggccgcgccgtacagcaaggcacccccgagcagctcttcgaggcgccctcctccacctacgtcggctacttcatcggctcaccggcgatgaacttcctgaccgtggaccggaacgagaggcccttcgcactgggcggccggacgctgtccgttgcctgggacatcccccagggcacgaccgacgtccaggtcggcgtccggcccgaacacgtcaaggtcgtcaccgaccccggccccaacaccttccccggccggctgcggagcgtcagcgaccacggcgcgcagcgcgtgctcgaggtcgaggtcgccgggcaactcgtcagggccaagactccgcgggaggagggagttcccctcggcgaggcggtcctcgtacacctgccgcgcgccaaggtccttccgtacgcggacggtcagttggtactccggtcg

SEQ ID NO: 1388 - DNA, 2382 bp, Streptomyces avermitilis
  CDS (1)..(2382)
gtgcctaccagatggggagtgacgcacctaactcgtatgcagtggggtgaagggtgccattgcgctactgggggacacatgtcggagatatcgacagcaatcgacgccctgctgcaagcccggctgcggcagttacccgaggtggaacgcgaaagtgcgcgctggcacacgctgggcgagcgcctcgccgagttggcggacgcactcgccgatctgcgggcgcacaccaccatggacgccgaactggtggcggccctgacccttcctcagctgacggagacccagctgtccgtagcgcaagcagcggactcattcagagtgatcgcctcccgcttcacccgggcaacggtcaacatcggtgtgagcggcgcggcgcgcatgggcaagagcaccctgctgcagtcgatctcaggcctcgacgacaaccagattccgaccggtcacggcatcccggtcaccgcggtccgcagccggatcttccactcacctgcggtgcggcgggccgagttggagatgcacagcccggagagcttcctcgcgacggtgatctccccgctgcacgcggcgctcgatctctcccccgtgccgcgtacggtcgccgaattcggccgctgggtctatccggaagtcctgccggacacccgggacagggtgctgctgacccggctgcgtgaactgcagagtgccctgacgtcgtacgagccgctactgaccggcggtgtcagaacggtgccgctggaggaggtgcggccgttcgtggcgtacccgacccatgaggagatcaccaaggcgggcgagcgggtgggacgtgcctatgcggcggtgcgcgaggcccgcatcgagtgcgccttcccgcatgagcatgtggccaggatcggcatcgtggacctgccgggcctcggggaggtggtcgcggacgccgaccggcggcatgtcgcgggtctgcgcaacgaggtcgacgcggtgctggtggtcaagcgttcctccgacacctcctcgtacttcgacgagacggacaccgccggactcggccttctcgaggaggtacggggattcgtgcgcagcaccggggaattcacctacttggtgcacaacgccgatccggacaagccccacctcgcggagaacctccgcggcgatctgctgcgcaatgtcaacgggggcgaaccggaccgcttcttcaccgtcttcgagaccgacgtacgcgacccggagcgggtcggccgggaggtgctcggtcccctgttgaaacggatggcggaggggctgcccgtcatggacgccgaggtgctcgccggcatccgcacccaggcctcatccgtacgggaccgtgtccgcctgcagctcaccgatctgcgtctggcgctggaccaggtggcacagcgggctggagttccggaggaagtcaacgacgccaaggccgcgcagttgcgcagcgctgtcgccaggcggttgcgcgggctggtcgccgaactggccgcggaggcgcacggctcgatggtaggtccgggcttcggcgaagcgcttgagaaggcatacgagggcgtactcgagtggatccaggacggcttcggcaagggcacggacgcctggcgggaggaggcgctgacctgcatgatcaccgaaggccactcggcggcgttcgcggggccggaattcagcagggtccgggtcgagatcagccgccgcttcgcggccctggacgacttcttcacggcacgcctcaacgccgcctggaaccgtactgccgcgatgctcgccgccgagtgcggagcgcttttccagcgtaatgacagcaggcaggcggacagtgtctccagctccgacgacgccactgccacaccctccgcccaccccggacgcgatgtcctcgccgagctggccgaactgttcgcccgttcctcccagccgtgcccgggtcttgcctccgcggtcgacagtctgctggacgtacggctggagtaccgcaccctgctctacccccgggtacgccccgagctcgccccgctgaacctccaggtcactcacccgaacacgggcgagcagatgcagcaggtggcggttcccctgaccgcagagggggccgagcatctccacgagctgttcaacagccttgccgagcaggcggcgttccggatcaagcagtcgctgtcccaggaagccgcggtgcctgcggctgtcatccacgcgctggtggagcagttcgaggacaccctgatccggtccggcacgtcggtcatggaattccggcggttcgtccgttcgtaccgcaacgacctgtggccggcggagttcaaggggatcgacgaggccaacagccgcttcgcccgcgtcctccgcgttgtacaggacatctccgacgtactcgatgaggagcagccg

SEQ ID NO: 1389 - DNA, 1143 bp, Streptomyces avermitilis
  CDS (1)..(1143)
gtgacggacgaacactcggtcttcgagtacaagatcggcttgctggcccccagccgcgtgggcaagagcacgctgatcgccggcctgctcaccgagggccaacagcagctggcacaggactcctcggtacacctgctcaccgcggaccggcccaccaagaaccggctggccgccacctacaacctggtctccggagcgctcaaggcccggatgttcgagccgggcctcgtgcccagtaccagcgatccttcctggttccggctgctgctggaagcacgggggcaagacctgcagatccggttcgacatcctcgactacccgggtgcgtggctggaaggagccggcgaaggcaccgaggacgagcagaaatggaacgaatgcgaggcgttcctcgccgacagctccgtgctcatcctcccgatcgattcggtgctgctcatggactccggtgacgaccacgcgcatctgctcgcctctcacctctccgtattccagatcaaccaggccgtactcagatgggcgaagaaccggcgggagctgtccggtgagcccgcgatgatcgtgttctgcccggtcaagtgcgagacgtacctgtcggacagcggcagtctccaggatcacgcgggtacgttgcggggcaaggtggtcgaccagttcagcgatgtactcaagacggtccgggacgcggccccgcacgcggcggtccgctacctcccgatcgataccttcggctgtgtagagctcgtctcggcccgctggatccatgcccagggatctcccggcggcgagatgctcgtgcccaagtaccgggtccggccacccggccagatcgtccggaagggactggacgacctcctcaccctgctctgccggcaactggtcgacaccgcgcgggcgcagagcgagcggacgacagccgcgaagcagacggcggccctgaattcccgaaaccacgcggagttgagggagggcttcttccgcgacctgtggctgaacttcaacggcgaacgcaaccgtcgcaggcacacagccgccaccgacgagaggctgttcgccatgtcgcagcggaccactcagtcgctcttcgacgtgctcaccgccctggccgggcgggagagcgggccccgtctgcaccacctgagc

SEQ ID NO: 1390 - DNA, 900 bp, Streptomyces avermitilis
  CDS (1)..(900)
gtgcacgtttatcttcgtacccggggtgtgccgcgcaaactggactacggcttcctcggcgccgcaccaggaagccgctggtgggacacatactcggagctcaccgccaccgagcgtccctgcttgctcgccgtcacgtcgaagggccgctggcgggtactgatcagcggggtgccctccacccgaaccgactccgtgggcacccttgtctactacaccctggtcctcgacggctctccttctccggccggaacggtggggccccggcaggaccggcccacggtgttggcgctcgcgtcacgttggctggacgacatcgcccgtcacccggagggccgcggggtgctgtccgagctcctggacggtctgtgttccagcgcggaggtggatcggctgctggccgcccgccactcggagctcaccaccgagcgcgcggagctcaccgcccggctcgccaccgcgctggcatccctgagccccgccccatccctgaaccccgccccgtccgtcccgtccgcgcaggacagcggcgccccttctcccgtcctgctcacggagcgctggatcgccggacggacagcaccgggcgccgacgcggccttcctggcccgactgtcctcgctgctgtccggggaggacgggcaggcgcacctgctcaacctggtctcgtccgccgaagacatcaccacactgcctcagaagccagggctgctggccgtactcattgagggcggcatggtcggcgaccccgcgatgccggccgaggcgcttccgaagctgccttcggaggtcgtcgccagtgccccaaaagcacggtggcgggcggcaatggttcccacagtgctgaccgccttgatcctgctgttggtggccctggtgctggtcgccggcaactggacc

SEQ ID NO: 1391 - DNA, 405 bp, Streptomyces avermitilis
  CDS (1)..(405)
gtgcaggtctcggtcgaactccgggcaccgagacggcgtctgacgttcttttccgcggccacctatcaaaaagagtggctggagcccgattccctgctggccttccgctgtgaattcgtcgcggacgaagcgcggaccgggcaccccgtgcgggccctccttctcgcgcggctggccgtcggccgagcccgagtattcaattacgaaacggcccgctacgaattcggccgggtagaggacctcgacttcgccgtatctttggatggtgagacggtgtacgaggcatacggtgcccggccgatggaggaggacagggggctgactttcaaggacgagaccggttactggaccacgatccgcccgataacgtccgccctgaagcaggcagtgcgcgatgagaatccg

SEQ ID NO: 1392 - DNA, 447 bp, Streptomyces avermitilis
  CDS (1)..(447)
gtgacagcatgtcagcccgccgaacagggctcatcgtccagagccgcgcgggcggaaccggtgaagtctttcaaccgcgccctggcttcgagcacgtgtgcagcgtgcctgtctctccatgtgtcggtcccagctcctcgcaggctgtcggcgtgccaggagaagagatcggacaaggcaatgccgagagccgtcgtcagagcgtccgcggactcgacaaccgccgtggacccctccaccgccacagtggacgcggcgcggcgagccgcgctcaccagattctcggccgccctgatgcgctccatcgcctcttcgaggtgcacgggacctgcgccactcagcgctgtccaagccccccgcaagccttcctcggccgccaccgcctcggtgatcagtgcgctgtacgcggcctggcgaacttctcggcgccatcggtggtgctccaag

SEQ ID NO: 1393 - DNA, 984 bp, Streptomyces avermitilis
  CDS (1)..(984)
gtgaaggcccgcccgctcggtcgtacgagcgtccgtgtcagcacgctggggttcggcgccgcccccctcggcaatctctacggcccgatcgacgactgccaggcacaggccaccctcaaggccgcctgggacgtgggagtgcgctactacgacaccgccccgcactacggcctcggactgtccgaacggcggctcggcgatgccctcgcccaccgtccacggtcggagttcaccatctccaccaaggtcggccgactgctggaaccccacccggcacccaccggatccgacctgacggcaggaggcttcgccgtacccgacacgctggtccgccgccccgactactcacgggacggtgtactgcgaagtctggaaggcagcctgaatcgcctgcgcctggaccatgtggacatcgtctacgtccatgatcccgacgatcatctggacgccgccctcgaccatgccctgcccgcgttgacggctctgcgcgaccaaggtgtcatcggtgccgtcggtgtcggcatgaacgcggtcgccccgctgctgcgcgtcgtcgcggaggcggaggccgacgcagtgatggtggccgggcggtggacccttctcgaccgcaccgctcgccccttgctggacgcgtgcgccgaacgtggggtcgcggtggtggccgccgccccgttcaactccggtctgctcagccgtcctcaccccgcgaatgacgccaccttcgactacggccccgcctcggaatcggcactgcgtcgtgctcggctccttgccggggtgtccggtcgacacggcaccgcacttccccacgccgccctgcggtttccgctgcgcgaccccagcgtggcctgcgtggtcgcaggtttccgtacctctgaggaggtcgtctccgctgcccgctgggccaccaccgatctgaccggggaagcatggctggacctcgacacggcagccacatgggcggcagagatcccgccctcg

SEQ ID NO: 1394 - DNA, 831 bp, Streptomyces avermitilis
  CDS (1)..(831)
gtgcgtatcgatgctcatcaccacctgtgggatctgtcagttcgcgatcagccgtggaccagcgacgtgcccgcgctgcgccggaccttcaccgccgctgaactcaggccggctctcgaacggaacgcgatcgacgccaccgtcgtcgtacagaccatcgccgtgccgcaggagacaccggaactgctggccctgacgtgcacggacccgcaggtgcgggcggtcgtgggctggaccgacctgaccgaacccggcatcgccgaccgcctcgcggaactgcgggagcaacccggcggatccgcgctcgtcggtatccggcacggcatccaggacgagaccgacccgcagtggccggcgcgccccgaggtccgccgcggcatcacgtcggtcgcggcagcgggtctcgtctacgaccttctcgtccgccccgaccaactgccctccgcggtgcgggccgtgcgcgagttgcccgacgtccggttcgtgctggatcacgccggcaatcccgtcgtgagtccggacggcctcgtctcctggaccgcgctgctgacggatctggccgagtgcccgaatgtgacggtgaagctgtccggcctggtcacccggaccggcggggacccggccgcggctctgcgcccctacgcggacgtattgttcgagacgatgggaccggaccgcctcatgtacggttcggactggccggtctgcctgctcgccgccgagtacgacgaagtggtggccgtcgccgaatcgctcaccgaggagctcagcgccgacgaacgggaagcggtcttcgggacaacggccgcgcgctggtacggaatcccctcg

SEQ ID NO: 1395 - DNA, 774 bp, Streptomyces avermitilis
  CDS (1)..(774)
ttgggcgactcaacacaggctcctggcaaggcagatgacgcgacgtcacgtccctaccgtccggggtatgaactggtcgcggagcaactgctggactacatcgcccaggagaacctgcggcccggcgaccgcctccccaccgaacagggcctggcccagatcctgggagcgtcccgcaacgtcacccgggaggccgtgaaggtcctggccgccatcggccggctcaatgtgcggcggggcgccggtatcttcgtcgccgcctcggtcggcgggctgctggacgacgaactctcgcacttccggccgaccagcatggaagacgtccgcatgctcctggactaccgcaaggtgatcgagtcggagacagcacgccgtgccgcctccctcgccaccccgatcgaggtccgggccatacgggagagcgcggagagctccctggcagcggccacgatgaacgacgtggacaccttcgccaaggctgatgcggccttccacgacgcggtgggcgccgcctcgcacaacgtgttcctgaggtcgagtgtcgccggtgtgaggcgcttggcatcccagtccgacgtgctgctcttccacggtgacgtgcccggatcgctggaagtcgccgcgggtcagcatgtggccatagcggaggcggtcgccgcgggggcggccgatctcgccgagcggctgatggtggaacacatcggcaccacacagagccagttcgagaagaagattcgcgaccggctgttcagtcccgacgccgacacggcccct

SEQ ID NO: 1396 - DNA, 3387 bp, Streptomyces avermitilis
  CDS (1)..(3387)
atgtgccgcagcacagcggtcgagccgcccatcgccctgggagtcccggtggacgaccgggactcccaggtatcacccccctcaggcgattggatacgtgtgtctcatccgtctgcgcgcaggcgcgtcttcgcgccgctgcgaagaagtttcacggccgccttctcggtggccgcagtggcagccctgctgactgccgtgccggcccaggcggctcccccaccgccggacatcgatgtctatgtctctccagccggccgggacgtgggctcaggtagcgccgcacaccctttcaggacgctcgagcacgcgcgggaccacgtgcgcgacgtcaggcggaacgccaaaggcgacatccatgtccggctcatgtccggtacctaccggctcagccgtacgttcgccctgaccgcccgggactccggccgcgacggacacaagatcgtctacgaggccgcccccggcgcacatccggtgatcagcggaggcgagcgaataaccggctgggttccggccggcggagcaggacgggtctacaaggccaaggtgggcgacatcgacacccgccagctgtatgtggacggcgagctggagacccgggcgcgcagcgccaagaacccctccggcttcagcaagacgtccaccggctacaccttcaccgacaccggcctcaacgcctacaagcgtccctcggacctggaggtcgtcagctcctggggctggaagctgatgcgctgccccgcgcagtcgatcgccgacaacaagatgacgatgcagcagccgtgttggcacaacgcgcatctccagcggggccaggagatccagaacccgacctggctggagaacgcccgcgaactgctggacacgcccggtgagtggtacctggacaagggcgagggcgagatctactacatgcccaaggccggccaggacctgtccaccgcgaccgtcaccgtgccgcgcgtgcaggacctggtggacctcgacggcaccaggaccgacccggtcagcaacgtgtccttccgaggcgtcaccttctcctactccacctggctcgcgcccagttcctttgagggcctcatcgagggccaggccggcttccggatggtcggccacgaccccgacttcgacgcgacccgcctgaagtggcagaagacgcccggcgccgtcaatgtcagctacggccacggcatcggcttcgagggcaacaccttcacccatctcggcgcggtcgggctcaacctgaacaccggtacccagggctccgacatcacgggcaacgtcttccgccagatcgccgccaccggcatccagatcggcggggtcgcggtgatcgacgctcatcccgacgactcccgggacatcaccaaggacaccagggtcgacaacaacgtggtcaccaaggtcgccgaccagtacaacggctccatcggcatcctggccggctacaccgaccacaccgtgatcacccacaacaaggtctacgacctgccctacaccggcatctccgtcggctggggctggggcctcaccgacaagggcggcaacagcaactactccccggggaatctgggcgtgccgatctgggacacccccacgaccagccgcgacaccgaggtcacggacaacgagatctacgacatcatgaagtcgcaggccgacggcggtgccgtctacacactcagcaccgaccccggcggcgtggtgtccggcaactacatccacggcataccgtcgcccgcctacggcgcgatctaccacgacgaaggcagccggtactggacgaacaccggcaacgctctgtgcgacgtcgcataccagtggctgttcctcaaccacggcatggacatcgacgccacaggcaacttcaccacccagcccgcctactccgcccaggccaacagcacgggcagcaccatcagcggcaacaccactgtgggttcctgcggccaactgccggcctccgtggtcaacaacgcgggcctccagccgagttaccgccacctcgacccgggccccgacgtcgccgaccaccaggcgccgagcaggcccggcactccgagcgcggtcaccgatttcccgacggtggcagacctcacctgggccgcatccaccgacgacacctcggtcacgggctactccgtccaccaggacggcaagctgatcagcgccaccgggaagacctcggtgcgccttccgggcctgaccgccgggaagacgtacgccttccagatcaccgcccgtgacgccgccggcaacgagtcaggtcccggcccgacactgcacgtcaccatgccctcaggcacggacctcgccctcaagaagtccctcaccgcctcgtcgtactcggagaacaacaccccggaaaaggcggtggacggagacctgtccacgcgctgggcccagggcctgggcctgcccgatccgtcctggatccaggtcgatctcggtgcgccgtacgacgtgaacggcgcgatcacgaccttcgagaaggccagcgggtacaagtaccgcatcgaggtgtcacccgacgaggtccactggaagacactcgcggaccacaccgccgcgaacaccacggcggcgaccgactacgcccacacggacgatccggtcacgggccgtttcgtgcggctgaccgtcaccggatccagctggaacggcggcagcatctacgacttccaggtctacggcactcccaggaccgtcacggaccacacggcccctacggcacccggacagcccacggtcaagccgctgctgcccggcctggtggacgtcagctggtccgcggccaccgatgacaccggcgtgaccagttacgtcgtctaccgggacggcaagcggatcggtgtcaccgacgccacgacactgcgggtttccggcctgaccgcggacacggagtactccttcaccgtcgtggcacgcgacaaggcgctgaacgcctccgaccccggcaaggcggctgtcgtcaccacgccggccgaccacgacctggccctggacaagcaggtcaccgcctcgtcgtcgtactccaaggactacgcgcccgagaaggcggtggacggggatctctccacccgctgggcacagggcgcgggcctgcccgacccgtcctggatccgggtcgacctgggcaaggacaccggggtctccagcgtggtgaccaccttcgagaaggccggcggctacaagtaccgcctggagtactccaccgacggcacgacctggtccatcttcgaggaccacacctccgacgccacctcgtcgtcagccgtccactccttcgccgacaaacccgtcaccgcacgctacctgcgcctgaccgtcaccgattccagcgggaacggcggcagcgcctacgggctccaggcgtacggcggcttc

SEQ ID NO: 1397 - DNA, 1095 bp, Streptomyces avermitilis
  CDS (1)..(1095)
atgaagatcacccatgtcgaggtacaccggatcgatgttccggcagccagtccgcccttccgctggcgcgacgggctgagcggaagcgctccggtgggcgacggcgcggtcctgcacatcgggacggacgagggagccgagggagtgtcggtattcgctcgtccgggcgcctactccaccctgcgggacctggtggaccgggtctttcgtgcggaactggtcggagccgacccgttccagcgggaatggctgtggcaccgggtgtgggagctggaccgtatccacgaactcccgctccccaccctgggcctcatcgacatcgccttgtgggacctggccggccgctaccacggcgagccggtctggcgtctgctcggcggcttccgggaagccatccccgcctacgcctccacctcgacgttctccagcgtcgcggagttcctcgacgtggcggaccagtgcctggccctggggtatcgcggtatcaaactgcacgcctggggcgacgcccgccgtgacgcggaactgtgcctggccctgcgcgaccacgtcggtccggacgtccctctcatgtacgacgggtcggcgggcttcgacctgcccgacgcgatccggctggggcgggccctctccgaggccgactacctctggtacgaggagccgatccgcgaattcagcatctcggcctatcagcggctcgccgaggccgtggacgtaccgcttctggtggccgagacctccgacggggcgcacatgaacgcggcggacttcatccgggccggtgccgccaccttcggtgtccgggccggcaccactctccggggcggtatcaccggcgccatgcgcaccgcgcatctcgcggacgccttccggctgcgggccgaggtgcacggttcggacatccccaaccaccacctgtgcatggccatctccaacaccacctactacgagtccctggtgacctcggtgaacgttgtccgtgagcgccacgtggacgaccagggcctggtgcacgcccccgcggggcctggcatagcccttcctctcgacttcggctacggcaacgaactcctgccgttcgtcgagcagccgcgc

SEQ ID NO: 1398 - DNA, 1383 bp, Streptomyces avermitilis
  CDS (1)..(1383)
atggagtcttcccgatctccgagaaccggccggcgtcactcgctgctccgcaccgcggcagtcacgctgtccctggccaccacggccgcccttgcaggctgcgccagcgccgacaccaccacccgttcctcctccgggcagtcggcgttcaagccggccgcgcagaaggagggctcgcggataacggtgtgggccgactcgaccagactgccgtcggtgcaggcgtaccagaagtcgcaccccgacgtgaagatgaagatcgtcacgtacgacggcggagccgacggatcgacgtatctccagtcgaaggtgcagttgttcgacaggaccggcagcgggtggccggacgtggtgttcggcacgccgaccgacgtgacctgggcgtcggaggccaccaagcccgacgcgcggccgttcgccgcgcccctggacgagaagctcgtaccgcagagcaccctggacgaattcgccaagggttcgctgacgccctgtgaattcgacggccacacctactgcatgcgcaacgacatcgcgcaggtcctcctctggtacaacaagtccctcatggacaagtggggttacaaggtccccaccacctgggaggactacgaggccctcggcaagaaggtcgccaaggaccatccgggctatctggtcggctcggtcggtgacaccaactcccacgagtcgtacttctggtcggggcagtgccccgcgttcagcctggtgaagcccgacaccctgcgcaccgacctgcgggacccgaagtgcacccggatggcgaagctgctggacgacctgatcggcgccaaggccatcgccacacagggcttcttcagccagggattcgccgagaacagcggcggcaaggtcctgatggcctacggcccttcttggtacggccagtacctcttcaaggccggcttcaagactccggccaagcagatcgccgcggcgccccctctggcatggaagggagagagcacgaccgccacgggcaacgtcggcggcggcgtgtggatggtgtcctcgcacagcgccaacctcaaggcgtccacggacctggtcacctggctgaccacctccgacgagaaccaggccggcgcgcccacctatccggcctacacccaggccgcgaaggcctggctggccaacccggccaacaggaactacttcgccaatgatgtgagcgagccgttcgagcaggccgcgaacgaggtgtggaccggctggtcgaacaccaggttctcggactccaccgcctggtccagtgtcgtcctcccggctctgacctccggaaagagcctgaccgagacgctgccggcctggcagcgggagatcgcgggcgaggccaagagccagggctacaaggtggtcgatcag

SEQ ID NO: 1399 - DNA, 930 bp, Streptomyces avermitilis
  CDS (1)..(930)
gtgaccttgctggagaccgagcctgtcgccgtctcccccgtgcgccgcggcaccacgccgcggcgcacgggccgcggtcgcgcgggctacttcttcgtcgccggctacgcgctgctgctgctcgcgttcggcgtcttccccaccgggtacgcgttctacctcgcgctcaccaatgaccggggccagttcaccgggctcaaccagttcgtgaaggtcgtccaagactaccgcttcgccccggccttcacccacatgctgatctatctggtcatgtggctggtgaccctcgtcgtcctggtcgtgctgaccgccgtggtgctgcgcagccgcgtgcgtccgggcacatcggcgctcttccgcttcctgtactacattcccggcgccctcgccggagtggcgagcgttctggtctggctgttcatgctggaccccgatgtcagcccggtgtcctggctgctcaccgccatggggttgaagacgttcgccgctgtcctggcgcccggcaacctgccgctgatcctcatgttgatcgccttctggaccggtgccggaggctggatggtcgtgatgtacggggctttgaacaacatccccgacgacgtgctggaagcggcccgcatggatggcgcgggcccgtggcgcaccgcctggcacatccagatcccgatgatccggcagtggatcgtctacatgacgatcatggctttcgcgacgggcacccagctgttcgtggagccccagcttctccagaccgccagcctcggcagggtgagccccacctggtcgccgaaccagctcgcctacgtctacgccttccagcagggcgacttcaacggcgccgccgccatctccgtcgtcctcctcgccgtgggcctcctcgccgccgggctgctggtcgctcgctcgaacctgttcaagttggatgagaaa

SEQ ID NO: 1400 - DNA, 912 bp, Streptomyces avermitilis
  CDS (1)..(912)
atgacacagaccgctgtcttcctgacggccgtgaggcggcgtatccgtccttccaggaccctgcccttcctggtcgtaggactcctcctggccttgctgctgttgttcttcgtgctgccggtgatctggctgctgctgacaccgtcgaagaccgccggcgaagtggtgcgggacaaccccctctccttcggttcgttccatcagatcggcacggcctggcggcacctgttcgccttccaggacggcgccatgacgagatggctgcgcaactcggccgtctactcgggcggttcgctcatcctgacgctggccgtcagcgttccggccggctacgcgctggcgctgacgaatttccggggacgcaagacgctcctcgtgatcaccctggtcaccatgatcatgccgcaggccaccctggtgctgccgatcttcctggagctcaaccgcttccatctgatcggcaccatctggtcggtgatactccctttctccttctatccgttcggcgtgtatctggtctacatctacttcgggagcagcctccccagggacctgctgtccgccgcgcggatcgacggctgcacggagtggcagctcttctcccgcatcgcgctcccgctcgccaagccggtggtcggactggtcgcgttcttcagcttcgtgggcaactggaacaacttcttcctgccctacctcgtcctgccgaacagcgagcagttccccgtccaggtgggcctgaaccaactgctgacctcgacgccgtccttcaaccccgtcgccggcgccggactgaacgtcaccatccccgaactcgccctggccatcctcatcgccatcctgccggtgctggtgctgttcgtcttctcgcagcgcaccctggtgtccgggatgctcgccggagcgagcaaggaa

SEQ ID NO: 1401 - DNA, 1692 bp, Streptomyces avermitilis
  CDS (1)..(1692)
gtgtaccggctcgatccgcgctacgcccccgccccgcaggccgtcctccacacgggatggcaggcagtggcctcccaactccccgacggccccgtggtggtggccatcgacgggcccccgtccgtcgactggtccctcctcggtgatcgcctcgaaaacgagctgaccggacgcggtacccccgtcactctgctcgacatacggagccattacgcacggccggcacacgtcaggagccgcaccgaacacccggcggacgccgacgacccctacttccgcaggctcgccgacaatccccttgacgacctcttcgagatcctcccggtatccgcaccgccgacggaagggctgctcctcgtctacgggcccggcgccgccctcgtggagcacgacctgctctggtacgccgatgtgcccaagcgatacgcggaggccgccgtcggcgcgggtgagccgggcgtcaacctcggtctgccgggtgagaagcccgacttcaggcggctgttctacatcgactggccgatgctcgaccagcaccgcgacgcgctcgcacaccgcctcgacgcctggctcgacatgcagagccccgaccacccggcgtggatcgacggagcaggcctgcgcgccacatacgccgcgctggcccgcaagcccgtccgcacccgcccgtacttcaactccacgccctggggaggccattgggcccagcgcgagctcggattcaaccccaactgccgcaacacagcgctcggctacgaactgatcgcgcccgaggccggcatcctcatcggcaccggaccggaggaccaggccgaggtgccgttccaactcctgtgtgtgctggaaccgttgagcgtgctgggggcagaggggcacgcccaattcggcacgtccttcccgatccgcttcgactacctggacaccgtcggcggcggcagcctctccgtgcactgccacccgaaggagtcgtacatgcgggagcgtttcggctgggcgtacacccagcacgagacgtactacctgaccctcggcagcaccgacaccaaggtcttcctcggcctgcgcgaggacgccgacgtcgacgtcttccgcaaggaggtggagagggccgtcaccgacggagtccccatggaccccgaggaccacgtcctcgccttccccgccgaacagggccggctgttcatgatcccggcgggcaccccgcacgccagcggcgcgggcaacctcgtactggagatcagcgccaccccctacctgtacagcctcaggttctacgactggctgcgacccggcgccgacggcaacccgcgccccctgccctacgagcacgggttcgccaacctggagaccggacgccgcggcacggccgtcgcccgcgacctggttcaagagccgcgcaccctgcgcgagggcaccggctggcgggaggaggtcatcggcgcgctggccgagatgttctacgaggtcaggaggttcgtgctcgacgccggcgccgaggcgaccgacgacacgcagggacggttccacatcctgaacgtggtcgaaggggaaggcgtcacggtgcacacggcggccggagaccgacacgaactcgcctacgcggagacactcaccgtgccggccgcggtcggccgctacaccctgcgagcgactggcgtcggcccggtgcgtgtcgtgaaggcgctggtccgt

SEQ ID NO: 1402 - DNA, 966 bp, Streptomyces avermitilis
  CDS (1)..(966)
ttgattccggtcctggagatcggcggcacccatgtcaccgcggcgctcgtcgacctgcgcgacgggcgtgtcaccaaccgtacgcgcgagccgctcgacgcggacggcgatgccgacgacatcctcggcaccgtacgacactgcgccgacgggctgtcggtgcctccgggtgcgcggtggggcgtggcggtgcccgggccgttcgactacgcgagggggatcgccctcttcaagggcgtgggcaagttcgacgccctgtacgggatggacgtgcgagcagccttcctcgaaggactacggcagcgccccgccgacgtcgtgttcctcaacgacgcccacgccttcctgaccggcgagtggtccgcgggcaccgtccgcgggcaccaccgcgccgtgggcatcacgctcggcaccggtgtcggctcggcgtttctcgccgacggccgcatctgcgccaacggtcccggcgtgccacccgagggtcggatggacctgaccgagatcgacgatcggccgctggaggacaccgtctcacgccgggcgatcctcgcccgttatggcgaccccgccgccgatgtacacgacatcgccggacgagccagagcgggggaggcgcgggcccggcgggtgctggacgacgtcttcaccggactgggcgtcgtgctgggcccgcgcctggtggacttcggcgcgaccgccctggtcgtcggaggctccatagcccgctcctgggacctcgtcgcgcccgctctgtccgctggcctcgtgaccgggggctggacgccgaactccccacacgccgacgcggattcactgcctcccggagcccccgagtgccccgtaggagacgcgccccctggtccgggtggcacctcggcggcaggcgcacagcgcactcgtacgatgaagcctgccggccccgcggggaacgccgcactggtgggcgcggcccgtgcggcgggggcg

SEQ ID NO: 1403 - DNA, 951 bp, Streptomyces avermitilis
  CDS (1)..(951)
ttgccaccgtcagcctttggaggatacatgcctgcgaacagcgcacgcaccgtccatctgctcgtcgcactcgccctgttggccggtgctgccgttgctggctgcggcggcgagaaggaggacggcagtcgtggagcggaggtcggtgacggcaactcggcgtcaccgcaggtgaaggtccgagccggtcaggtcgccgacgcctgggacggatccaaggccgccgagatctggcacaagggctactacccgatgggggaggtggtgcagctgcccgggactggccttcacaacgacgccgacaagcgcgcctacaagaccggcaactttctcctgcgcggcggcctccccgccagcttccacaaagacgggcaggtgaggtgggggagcggaggctcgctcacgctgccgctgatgggggcgcagaaggcgtacatggctctggaccgcgacagcagtgacggaccgcacctcgtcgcgactggggcgaagctgggcgagatgaccctgaccaccagccgtgggccggcgaccgtcccggcctggctgttcacgctggagggctatgacaccccgctcaagcgggtcgccgtcagcccgtcgaagctccccgagcctccgatcaagccggccaaggggatgtccaccaatgtgctggcgccgctgggcgggctggtgcaggtcgccggggacggtcggtccgtcaccgtggtggccactcacggatcctgtgacgacggtcccgctgtggacgtgctggagacgggcggcagcgtggtgttgtccgcatctgtcgtcggggcgaaggacggcgcctgcaccagcgagttgggtggcgagaaggtgaccgtgaagctgggccggccggtcggcaaccgcattctcctggacgcatccacggggcgaccggtgccgtacagcaagtggcctgagacctcgcccagctggagc

SEQ ID NO: 1404 - DNA, 228 bp, Streptomyces avermitilis
  CDS (1)..(228)
atgcggcccaggaccggggctacgctttacaaggtgatcgagaccagcctctgcgacatgtacggcgacagcggtggggctatgttcacaggggctattgccctgggaatcacgtccggtggcaactatgtcgacgagccctgcggcgatacggacgcgcaacccgaccgcgtgaccgactaccagccggtgcagggggtgctcaatacgcacaacctcgccgtctac

SEQ ID NO: 1405 - DNA, 522 bp, Streptomyces avermitilis
  CDS (1)..(522)
gtgacggcgggagcgatggcactgtccggtgccttcggttccggcccggacagcggacctcgcggaccggttgaagccgaggccctgtccgctttcccgctggagaacacgaccgactgggtctcctacggcgatcacgtggcggtcatccacgtcgacaacgaaaagatcagtcccgtcccggacaaggcgaaggagcacggcgaggggcacgtggaccgcactggccgtgtcgtcatcgacaaagtcctctacaaccgctcagggtcccctgaactgccgtcttccttcaccacgcagttggccggcctgtggtgggaggacggcgtgggcacgcgggagttcaacttccgcggtacctcccgtctcgagtcagggcacagctacatcgccgtcctagtctgggacgaggatgtgcagggctttgaggccgccgcccttggcggcgtccttcccttcgacaagggcactgttggcctgggagaaatcgacggcaagacccgtcaaagcctgccgcccgac

SEQ ID NO: 1406 - DNA, 738 bp, Streptomyces avermitilis
  CDS (1)..(738)
ttggaggacctgcggcggtcgggctggtcatcggccccatgtgttccactcgcctggggaggatcgaccgtgacctccgatcacgacctgctctggcgtcgctgcgcgcacctgggccgtgtcctgctgcctgtggtggacgaggaggcgtggcgccaggcccgcctcctcgtccaccaggaggcgtggcgccaggcccgccgccacgagcacctggaggcctggggcatcaacatcgtggaaggcgagcggctgatcgagctcttcgcggccctggccgcccatgccgtcacggtcgacatttctgcatctgccgcagaaatcgacgtcctacctccgagcgtggtggctgacgcggcaaccggtaaacgcgatctcgagctgctcgccggactcccggacaccttcgccgacggccgcgacgaactcgccgtcaaggtcttccggctgtacacctacaggggtgggcagtacagccgccggcttttccagctgagcacagaactgcgccgtgcgctgatcgtcctgcgcggcacgcgcaacgcgcggatcctcgcattcgccggctccgcgtcgctcttggacactccagcgccggtcgagcaccagcgaccgcatgccgcgcaccaccttcgaaccgcaccagtgctcatacgccgtggcgtcaagagtggccaggactacggcacctgcccgcgagctacaacacgcaaggcttcactgcggcggcgatgcctg

SEQ ID NO: 1407 - DNA, 1431 bp, Streptomyces avermitilis
  CDS (1)..(1431)
gtgtccggacacgtacccgtccccaccgaacacccggaagtggtgcacatggcctccgcagcaaccgctcccccgccacccgccagcctcaagcgcatcgtcgccgcgagcctcatcggcaccaccatcgagtggtacgacttcttcctgtacggttccgccgccgcgctcgtcttcaacaagctgttcttcccgggctccgaccccctggtcggcacgctgctgtccttcctgacgtacgccgtggggttcgccgccaggccgctgggcgctctcgtcttcgggcactacggcgaccggctcggccgaaagaaactgctggtcctgagcctgctcctgatgggcggggcgacctttgcgatcggtctgctgcccacgcactcgaccgtcggcagcgccgctccggtcctgctgaccacgctgcggctggtgcagggcttcgcgctcggcggcgaatggggcggcgcggtgctgctcgtctccgagcacggagacgcgcggcgccgcgggttctgggcctcgtggccgcagaccggggcacccgccgggcaactcctcgccaccggtgtgctgtcgctgctcaccgccgtactgtcggacgcggcgttcgtctcctggggctggcgcatccccttcctgctctccggtgtcctggtgatcgtcggtttgtggattcgtctgtctgtcgatgaatcacccgtgttccagcaggcgctggcccgcgcggaggcccgcagcgcggcaccggacgccgtcgcggagaagctcccgctggtgtccgtgctgcggcaccactggcgggacgtgctggtcgcgatgggcgcccgcatggcggagaacatcagctactacgtgatcaccgcgttcatcctcgtgtacgcgacgacatcggccggtgtgtcccggcagacggcactcaacgcggtgctcatcgcctccgccgtgcacttcgcggtcatcccggcctggggcgcgctctcggaccggatcggccgccggcccgtctatctgctgggcgcggccggggtcggcctgtggatgttccccttcttctcactcatcgacacgggcggcttcggcaacatgatcctggccgtgaccgtcggactcgtactgcacggggcgatgtacgcaccccaggcggcgttcttctccgagatgttcgcgacgcggatgcgctactcgggtgcgtccatcggcgcccagttcgcctccgtcgcggccggtgcgcccgctccgctcatcgcgaccgcgctgctctccgactacggcaactccaccccgatctccctgtacgtgatcgcggccgtcgtcctgacgctgatcgcggtgggcgcggcgaaggagacccgcagtcgcgacctggccgcggtcgaccccgtgacggacgcggaacccgccgcggcacgggcagccgacgcgcccgccgtc

SEQ ID NO: 1408 - DNA, 1935 bp, Streptomyces avermitilis
  CDS (1)..(1935)
atgtctcgcgatcacgtgcagtccccccagcgctccggcgaggcagcggccaccggccccaaggcgccgttcctggagctcctggcccggggcgcgtccgccgacgcgtacgagcagccggtgcttctcgcccgcgccgagggcctgtctcccgagcgggtcgccgcgctggagcggaccaagcgcctcgcgctgcgcgtgcgctcggagatggagggcagacggcgccgtgaggccgagctgtccgctctcttcgaaacagcccatgacctggccggactgcgtgacctcgacgccgtgctacaggcgatcgtccagcgggcccggtcgctgctgggcaccgacgtcgcgtacctgaccttgcacgacgaggctgagggcgacacctatatgagggtcaccgagggctcggtcgccgcgcgcttccagcaactgcggctcgggatgggagaggggctcggcggcctcgtcgcccagaccgcccgcccctacgtgacccccgactacttcaacgacgagcgcttccagcacacccgcgtcatcgacgggggcgtacgggacgaagggctggtggcgatcctcggcgtgcccctcatgatcgggccgcaggtcatcggtgtgctgttcgccgcggaccgccgcgcccgtgtcttcgaacgcgaacagatcgcgctgctcggctcgttcgccgcactggccgccgccgccatcgacaccgccaacctgctcaccgagacccgctcggcactggaccggcttgcccgtgccaacgagatcatccgggatcgcagcggagtgatcgagcgcgcgtcggacgtccatgaccggctcgccgagctcgtcctgcgcggtggcggcgtccacgacgtggccgcggcggtctcccaagtgctcgacggtacggtcgagttcgccgaggccgtggtcacaccggccgtggccctggaggcatcccgcgccgagggccacgccgtgcggcacggggacgactggatcgccgccgtggcggccggcggggagctcctcggtgcgctggtgctgcgcggccatccgggcctcgaccccgtcgaccagcgcaccctggagcgcgccgcgatggtcacctcactgttgctgctcgccagacgctcggcatccgaggccgaacagcgcgtccgtggcgagctgctggacgacctgctcgacgcccgtgaccgcgacccgcgactgctgcgcgagcgggcctggcggttgcacgccgatctggacgccacccatgtggtcctggccgcccgtctcgacggcgcggcggccgacgccgaccaggaggcgtccgcgcgccgacgcctgtggtcggccgcgtcccatctggcggccacccggcacggactggccgccgcccgcgacggcggcaccgttctgctgctgcccctcgatcccggggacaccgcgacgacgctggcccgtcgcacggcgggacagctcgggaccgccgttcacgagccggtcaccgtcggtgcctccgcgcccgtggagagcctcgccgaccacccggacgtggtgggggccgcctatgcggaggggcagcgatgcctcgacgcgctgcgcctgctcggccgggcaggggagggagccgccgccgaggacttcgggttcctcggcctgctgctcgccggcgaccgggacatctccggcttcgtcgggcgcacgatcgggccggtggtcgcgtatgacgaacggcggggcaccgacctcctgcacaccctggacgcgtacttcgcctgcgggatgagcccggcacgcaccaaggacgaactgcacgtccatgtgaacacggtggcgcaacggctggagcgggtgggccggctcctcggcgacgactggcagagcccggcccgcgcgctggagatacaactggccctgcgtctgcaccggttgtcgtcacccgcacggccc

SEQ ID NO: 1409 - DNA, 798 bp, Streptomyces avermitilis
  CDS (1)..(798)
atgaacgcgcccctggtcctccccggcccgcacgccacctccctcgacctcggcggtcggaccgccctggtcaccggcgccgcaggcggcatcggcagggcctgtgcgctgcggctggccgccgccggggccaaggtgagagcggtcgaccgcgaccccgagggcctggacaccctcgccgaagccgcacggggcctcgcgggcacggtcgagcctcaggtcctcgacctcaccgatctggacgccgcggaactctccgccgcgggaaccgacgtccttgtcaacaacgccgggctccaactggtccgtcccatcgaggagttcccgccggaggccttccacaccgtgctgacggtcatgctggaggcacccttccggctcatccgcggtgccctgccccacatgtatggacagggctgggggcggatcgtcaatgtgtcgtcggtgcacgggctgcgcgcctcggcgttcaaatcggcgtacgtggcggcgaagcacggcctggaggggctctcgaagaccgccgcgctcgaaggcgcgccgcacggcgtcacctcgaactgtgtgaaccccgcctatgtgcgcaccccgctggtcgagaaacagctcgtcgaccaggcagcggcgcacgggatccccgaggagcgcgtgctgtccgaggtgctgctccgggacagcgcggtcaagcggctcatcgagccggcggaggtcgccgaggcggtggcctatctgtgcagcccgcaggcgtccttcatcaccggtacgtcgctggcgctggacggcggctggaccgcacac

SEQ ID NO: 1410 - DNA, 471 bp, Streptomyces avermitilis
  CDS (1)..(471)
atggctactcccgacttcatacgcaccatccgggcctccgcgggccaccagctgctctggctccccggagtcaccgccatcgtcctcgacgacgacggcagggtgctgctggggcgccgctccgacacccgcacatggtcggtgatcggcggcatccccgaccccggagagcagcccgcggcctgcgccgtgcgggaggtgtacgaggagacggccgtgcggtgcgtcgtcgaacgggtcgtccttgtgcaggccctggagccggtgacgtacgacaacggtgacacctgccagtacatggacatcacgttccggtgccgggccgtcggcggcgaggcgcgcgtcaacgacgacgagtcactcgaggtcggctggttcccgttggacgccctgccggagctgaacgagttcgggctgctccggatcaagcaggcgctgtcggatggacccacatggttcgaccctatgacc

SEQ ID NO: 1411 - DNA, 1617 bp, Streptomyces avermitilis
  CDS (1)..(1617)
gtgaccgtcaccgcaacctccgtagacgagccggaacagctcgaaccccaggccgcgcccgcgtcgcgcggtgccagacgggtacggcgactcgttccggccgccgccgcgacgctctccggagtgctgctgtacgtcagcttcccgccccgcaccctgtggtggctggcccttccggcgttcgcggttttgggctgggcgctgcgggaccgcacctggaaggcgggcctcggcctcggctatctgttcggcctcggcttcctgctgccgctgctcgtgtggaccggcgtcgaggtcggccccggcccgtggctcgcgctcgccgtggtggaggcggtcttcgtcgccctcgtcggcgcgggcatcgccatggtgtcgcggctgcccgcctggccgctgtgggcggccgcgctgtggatcgcgggcgaggcggcacgcgcgcgtgcgccgttcggcggcttcccctggggcaagatcgccttcggccaggccgacggtgtcttcctgccgctcgccgcggccggcggcaccccggtcctcggattcgccgtcgtcctgtgcggtttcgggctgtacgagatcgtgcgccaggtcgtcgacgggcgccgcaccggagtcgtacggcgtggggccgctgccgtggcgctgctgagtgtggccgtcccggtggtgggcgccctcgccgcccggtccctggtcagcgacaaggccgaggacggcaccgcgaccgtcgcggtcatccagggcaatgtgccgcgctcggggctcgagttcaacgcccagcggcgcgccgtgctcgaccaccacgcgcgcgagaccgagcgtctggccgcgaagatcaaggcgggcaaggtcgcgcagcccgacttcgtgctgtggccggagaactcctccgacatcgacccgttcaccaaccccgacgcgcgtgccgtgatcgacagtgcggccaaggcggtcggcgtccccatctcggtcggcggtgtcgtcgaacgggacggcaagctctacaacgaacagatcctgtgggaccccgccaagggggccctggacacgtacgacaaacggcaggtccagccgttcggcgagtaccttccgctgcgctcgctgctcggcgccatcaacaagaactggacctcgatggtgcgccaggacttcagccggggcaccgagccgggcgtgttcaccatggcgggcaccaaggtcggcctcgccacctgctacgaggccgcgttcgactgggcggtgcgggacaacatcacccacggcgcgcagatcatctcggtgcccagcaacaacgcgacgttcgaccgcagcgagatgacctaccagcagctcgccatgtcccgggtccgcgccgtggagcacagccgcaccgtcacggtgccggtgaccagcggtgtgagcgccgtgatcatgccggacgggaagatcacgcagaagaccgggatgttcgtggccgactcactcgtgcagaaggtgccgctgcgctcctcccagacccctgccacccggctcgggatcctgcccgagatggtcctggtactggtggcggcgggcgggctcggctggtcggtcgccgccgtggtccgcgggcggcggaacgacgcccttcagggc

SEQ ID NO: 1412 - DNA, 1131 bp, Streptomyces avermitilis
  CDS (1)..(1131)
gtgccccgagcctctgacgtgcggccggatgcggccggaccggccggggcccgtcacaggtcggggggcggctgggtggggtccacggggacggaagcggcggccggtacgacggccgccgacgacagacgcaacgtatccgacgcgacaggcatcgccgtactcgccgcatgtgccacctggtcgttggtcacggccgccgcacggggcggtcggcccgaaggtgtcctgctcgcggtgctcgccgtctccgccggctacgcctcggggcggatctgcggggcgctcctgccggtcgcgacgccctgcgccggggcactggccgggctcggtctggtgctcgcggccccgcacggcacggcgggcctccagggctcctcgccgctcggccctgcgggcgcgaccgccgcgctgctgacgctctgcgcgggagcggcgtgctgcgcggcgtgggcggcgcgtccttcggcatcgcggctcgcgctgcggctgctggccgccgccatcacggtgaccgcggcggctctcggttccctgaccggcttcgcggcctgcgccggagtgctgctctgctcgtcggccgccgaccggatgcggcgccgtggcccggggctggcctgcctggcgctcggcaccgcgctggtgagcgcgacagcctgggcgatcgccgagaacgtactgcctgccgggctgaccacggccctggaaggccagctcacagagcgccggatcctgttgtggcgcgacgcgctccgtctggcccgccaggatccggtgctcggcgcggggcctggacgcttcggggagctgagccctacggccgcgcagtcgctgctgcccgacggcaagccgcattccgcgccgctgcaacaggcggccgagcagggtctgctcggcgtggcactgctcgcggcagtgttctgctgggtgctgtacgcgctgtggcgcagcccgcgcgccacgccgatcgcgctcaccgcgggcgcctccctcaccgcgctggcggccatcgccacggtgggggacgcactgagcttcaccacggtgacggcgggagcggggctgctggcggggatcgccacggcacggccgcttctcagtggggaggcggaaggcgagcgcggggcggac

SEQ ID NO: 1413 - DNA, 543 bp, Streptomyces avermitilis
  CDS (1)..(543)
atgagggaccacccccacgacgaagacgtcccgctcaccgaggtctggacgggacgcgcgaccaatcgtgcccaatggctgctggcgctcggcggtgccgccttcctggcgctcggtgtcgagctggccgtcgactcggcgtggacgtcgggcatcgccccgctcgtgatggccgtcgtgggctgcatcgcggccggactgctggtcatcttcgggacgctcgcattcgtgcacgtcgcggtgaaggtcgaccaggactgcctggaagtgcgctgcggccatatcggtctgccgcgccgccgtatccctctcgcgcaggtcgcgggcgccgagttcgtggcccgcgtcaccccgtgtcagtggggtggctggggctatcgctggcggcccgagaagggcaccgcggtcgtggtccgtcgcggcgagggcgtggtgctgcgcctctgggacggccacacgttcaccatcacggtggacaacgcggaagcggcggtacggatcattcgcgaccggctgcactcgaccattccgggtgccgcgcac

SEQ ID NO: 1414 - DNA, 783 bp, Streptomyces avermitilis
  CDS (1)..(783)
gtgaagatcgcgctccttgactccggaatcgggctgctcgcggcagccgccgcggtacgtcgactgcggcccgacgccgatctcgttctctcctcggaccccgccagcgtgccgtggggaccgcgcactccacaggacgtgacggaacgttccctcgccgtcgccgaggcggccgccgcgcaccgcccggacgcgctgatcgccgcctgcaacaccatgtcggtgcacgcccttcccgcgttgcgggcccgcttcgaacccggactgccggtcatcggcaccgttccggcgatcaagcccgccgcggcgagtggcggtccggtggcgatctgggcgacgcccgccaccaccggcagcccgtaccagcgcggtctcattcgggagttcgccgacggagtggcggtcaccgaggtgccgtgtcccggcctcgccgacgccgtggagcacgcgaacgaagcggccatcgacgccgcgatcgccgcggccgcggagcgcaccccggacgatgtaagggtcgttgtcctgggctgcactcattacgaactcgtcgccgagcgtattcgcgccgccgtgcagaagccgggccttccgccgctcgtcctgcacggttccgcaggagcggtggccgcgcaggcgctgcgcaggatcggcgagctgcccgcgcccgaggcacccatgggcgcctccctcaccgtgctcctcggcgggcgcgaggaaacgctgcccgcaccggcactcgcgtacgaggaaggccagctgctgcagaccctcagcacagcgcgt

SEQ ID NO: 1415 - DNA, 1173 bp, Streptomyces avermitilis
  CDS (1)..(1173)
gtgagcgccgttgtgtggatcgccgccggatcactgaccgcctggctgtggctgctgctcggccagggcttcttctggcgtacggacgtgcgtctgcccccacgcgtggagcccgccgactggccgtccgtcggcgtcgtggtgccggcgcgcgacgaggccggcgtgctcccggacagcctgccgtcgctcctcgcccaggactacccggggcgtgccgaaatcttcttggtggacgacgacagctcggacggcaccggggccctcgccctggagctcgcggagcggcacggcgggcttccgctcaccgtcgactcccccggcgcgcccccgccgggctggaccggcaagctgtgggccgtacgtcatggcatcggtctcgcacgcgcgcgtgaccccgaattccttctgctgacggacgccgacatcgcgcacgcaccggacagcctgcgggagctggtggcggccgcgcgtaccggcggcttcgatctcgtctcgcagatggcccggctgcgcgtggagagtgtgtgggagcggctggtcgtgccggccttcgtctacttcttcgcgcagctctaccccttccgacggatcgggacgaagggggctcggacggccgccgccgcgggcggctgcgtactgctgcgcacggacgccgccgagcgggcccggattccggacgcgatcaggcacgccgtcatcgacgacgtggcgctcgccagggtggtcaagggcgacgggggccacatctggctgggccttgccgaacgagtcgacagcgtgcgcccgtatccgcggctgcacgacctgtggcgcatggtctcccgcagcgcgtacgcccagctgcggcacagtccgctgctgctggtcggcaccgtgctgggtctcgtcctggtgtatctcgtcccgccgggcgctctcttcgtgggcctcgccgcggggagcgcgccgacgatggcggcgggagggatcgcatggctggtgatgaccggaacgtacctcccgatgctgcgctactaccgccagcccctgtggctcgctccgctactgccggtgaccgcgttcctgtacctcctcatgacggtcgattcggcggtgcagcactaccggggacgtggtgcagcctggaagggccgcacctacgcccgtcccggcaccgccttcgaggaacgg

SEQ ID NO: 1416 - DNA, 1323 bp, Streptomyces avermitilis
  CDS (1)..(1323)
gtgatgggggcggacatgacaatgccaaaaggatcgaatattccggtgccgacgaccgcgctgcgcgtcgaggtgggccgtcgctcaggaccgggcgggcccgacgtggacgcctcggcgcttctgctcgtctccggaaaggtccgttctgacggcgacttcgtcttctacaaccagccggcgcactcctccggcgcggtgcggcacgagggaacgcgggaggcgggcggtcaggtgaccgacacgctcttcgtcgacctcgcacgcgtggagcccgccatcgagagagtggtgctcgccgcctccgccgacggcggaacgttcgggcaggtgccgggcctgtacattcgcgtcgtcgatgcgcgccagggctccgaggtcgcccgtttcgaccccaccgcgaccgtcgagacagccttcgtcctcggggagttctaccgccgtcagggcgcctggaagttccgcgccgtgggacagggctacggaagcggactcgaaggactggcgaaggacttcggcatcaccgtggacgagccgcagcacctattgccgaccccacggcatactcgcgtcggccggcccgccgaagcacagtccccgcaggccgccgcccctccgccggccggcccgcccgtgcccctgccgcccccgccgatgaccgtgccgcccgccgcctccccgaccccggtgcgcctgagcaaggtcacgctcaccaaggaggcgccctcggtctcgctcaccaagcagggcggtacgtccggcgccctgcgcgtgaacctcaactggcagatgcgcaagcagttctccgggtggggcggcaagcgcggccgggccgtcgcgacgcacgcggacctcgacctcgacctgtgcgccctgtacgagctgtccgacggccgcaagggagtcgtccaggcgctcggcaacgccttcggttcgctgtaccggcccccgtacatccatctcgacggcgacgaccgctccggcgccgtggcgagcggcgagaacctcaccgtcaacctcgaccacaagcagagcttccgccgcatcctcgtcttcgtgaccatctacgaaggtgcccgctccttcgccgacctgcacgccacggtcacccttcagccgcagaacggggccgcggtcgacttctcgctcgacgagtgcaccgtcccctcgaccgtgtgcgcgctggccctcatcaccaacaccggcgccgacctgctcgtccagcgcgaggcccgctatctgatcccggagcgcggggtcagcccgcagcgcacgatcgaccacgcctacgggtggggcatgaactggacccccggccggaag

SEQ ID NO: 1417 - DNA, 438 bp, Streptomyces avermitilis
  CDS (1)..(438)
atgacctccccccgctccacctatggcggcggttactactccgcgtcgcccttcccggacactccgatctacgactcgctcgtcgccgagcggggcaccccgcagatcgccccgatccgggtcccctccgcttatgacgcgagcaacaacctgcccgcgctcccctcggctctgcccgctctgccggccggtccctcccagcaggtccccgcctacggatatccgcaggcccaacagcccgccccgctgcagcaggcgcccaccgcctacatcccgcagcaggccgccgccccgcgcggctacccgggcgcccagccgcagcagccgcgcccgatggcggccggcacgggttacgaggcgatgcgccccgcggccccgcgccccgccccggctccttaccaggacccgtacaacaacggacagcagtaccgcggatac

SEQ ID NO: 1418 - DNA, 822 bp, Streptomyces avermitilis
  CDS (1)..(822)
atggggaacgcggagctgcactcgattcacatccatccggtcaaggcgttccggggccagtcgccccgggaggccgtcgtggagccgtgggggttggccggagaccggcgctgggtgcttgtcgacgatgggggcaaggtcgtcacccaacgccaggaaccacgcctggccctggccaccgccgagctcctgcccggcggtggcgtccggctgtccgcgcccggacacgagccggtctccgtccctgtgccggagccggccgtcacgacgacgctggacatcttcggcgacaaggtggaggcagtcgtcgccgacgacaccgcacatgcctggtgcagcacctatctgggcgccgacgtgcgcctcgtgcacatggacgaccccgccacccgccggcccgtcgatcccgactacgcgcgcccgggcgagaccgtcagctttgccgacggctatccgctgctggtcaccaccctcgcctccctggactccctcaacgacctgatcgcacaaggtgatcatcccgacgagggcccgctgcccatgaaccgcttccggccgaacgtcgtcgtggcgggcaccgcggcctgggccgaggacgactggtcacggatagccatcggcgaggtgaccttccgggtcaccaagatgtgcgggcgctgtgtcgtgaccaccaccgaccaaagcaccgccgggcgcggcaaggagccgctgcggaccctcggccgccaccgccgcttcggcaaggacctggccttcgggcagaacctcgtgccggaaagccccggcacggtgcgcgtcggcgaccgtgtgcggatcctcgaa

SEQ ID NO: 1419 - DNA, 603 bp, Streptomyces avermitilis
  CDS (1)..(603)
atgcgagcgatcggaggcctctggcgctggcggcacaatccgctgcgccgtacgaccgacctgatcgaggcctgggtgacgctgaccgccctcctgctgatcctcgtcgccgtgcccgtcatcggtgccgtggtcggagcggtcgcgcaggacgcccttcagcagtccgtgcgggaccagcaccgggcccggcacgaaacggtggccaccgtcgtcaagaagctcaaccgcggcccgctggaccccgatcccgagacctcgtcggcgcgggacgcgcacagccgcgtgctggccgcctggacgggacccgacggctcggcgcaccacggcgcggtgctggcggacctcaagaccccgcaccgcggcgaccacttcactctctggaccgaccagcagggccgcatggtgggccgcccgttggacaccgccaccgcgacgacgcacgccatgctggccgggttcggcgcggccgcgatgtcggcgggactcgtcgaaggcggcagacggctgatcgtctggcgcatggtccgccgcagatatgcccgttgggaccaggcgtgggacagggcgggcccggactggggcaggaccggcgccggcagc

SEQ ID NO: 1420 - DNA, 2436 bp, Streptomyces avermitilis
  CDS (1)..(2436)
atggcacagggcacggtccaggtgacgcacaccggcacgtcgaggtggcgccgccgtacgggtgagtacgcatcgctcgccgccgccctggaggccgcgggcgacggtgacgtcctcacggtcgctcccggcacctaccgggaaaacctcgtcgtccagcgggcggtgacgctgcgcggccccgagggctcccccggctccgtgcgcatcgccccggtggacggggtgccgctgaccgtgcgcgcctccgccgtggtccaggacctgcacgtggagggccaggacgcggccgcgcccgcggtcctcgtcgaggagggcacgccggagctgatggacgtgcggatcgtcacgcggtccgcggtcggcatcgaggtacggggcggcgcgcgccccacggtgcggcgttgcacggtcgacaatcccgcgggcatcggcatcgccgtactggacggcggcggcggggtgttcgaggagtgcgagatcgtggccgcgggccagtcgggcgtcgcggtgcgcgggggcggccatccccgcctggagcgctgccgggtgcaccacgcctcgggcgccggcctgtcggtcaccggtgagaactccgccctggaggccgtcggttgcgagatctacgagatcaagggctccggggtgcaggccaccgggcgggccacggcacatctcaccgactgcgatgtgcaccgtacgacggcggacggcgtcacgctcgacacggacgcggtgctgacgctcgccgactgccgcatccacgacgtccccgagaacgcggtcgacctgcgctcacgctcggtgctcacgctgacccgcaccaccgtgcggcagttcgggcgcaacggtctgtccgtctgggacccgggcacccgcgtggacgccaaccagtgcgagatcttcgacagcacgggcgactatcccgcggtctggatcagcgacggcgccaccgccgtactcgaggcatgcagggtgcacgacgtgccggacgcgctgttcgtcctggaccgcggctcgcgtgcggacgtcgtcgacagtgacctctcgcaggtgcgcaacacggccgtgtcggtcagcgacggcgccaccgcgcagctcgacgactgccgcatccgggacgcggcgacgggcgcctggttccgcgaccacggcagcggcggcacgctgtcgggctgcacggtggacggcacacagacgggtgtgatcgtcacgaagggcgccgaccccaccatcgagcgctgcacggtgacttcaccggccgaggcgggcttctacgtgtccgccgggggccgcggcagcttccacaactgccgggtgacggacagcggcggctacggcttccatgtcatcgacggctgccgtgcgacgctgaagaagtgccgcacggagcggtgcgcgcgcggcggctacgagttcgcggacggcgggcccggcgcaccgggcggaggcggtgcgatcgtcgaggactgcaccagcgacgagagcgccggtctgcgtcccccggcccaggcgaccgccgtcgagacgaccagccagtcgcccggcctgctgggcgcgatccccggccagcgcatcaccgagcacgaaccgcacatcgcggccgccccggagcccgagcagccctcgcgcacgtcgaaggcggtgctcggtgagctcgacacactggtcggcctggagagcgtcaagcgcgaggtccgtgccctcaccgacatgatcgaggtgggccgccgccggcagcaggcggggctcaaggcggcctccgcccgccgccatctggtgttcacgggctctcccggcaccggcaagacgacggtcgcccggctctacggcgagatcctcgcctcgctcggcgtcctggagaagggtcatctcgtcgaggtgtcccgggtcgacctggtcggcgagcacatcggatcgacggccatccgcacccaggaggccttcgacaaggcccgcggcggggtgctgttcatcgacgaggcgtacgcgctgtcccccgaggactcggggcgcgacttcggccgtgaggcgatcgacacgctggtgaagctgatggaggaccaccgggacgcggtcgtggtgatcgtcgcgggctacacggccgagatggagcggttcctgacggtcaaccccggtgtggcgtcccgtttctcgcggaccatcaccttcagcgactatgggcccgaggaactgctgcggatcgtggagcagcaggccgaggagcacgagtaccggctgacgcccggcgcgggcgaggcactgctgaagtacttcacggcgattccgaaggggcccgcgttcggcaacgggcgtacggcacggcagaccttcgaggcgatggtcgagcggcacgcgggccgggtcgcccagctcgacgagcccagcactgacgatctgaccctgctctacccggaggacctgccggagctgccc

SEQ ID NO: 1421 - DNA, 2331 bp, Streptomyces avermitilis
  CDS (1)..(2331)
atgctgaacgatccgcggaccgtgcggatcaccggcgacggaaccgcggcggtctaccggcgcgccgacgacgccgacgcggagcggcggcccggcgaccaccggggcaccccggtcccggaggcgtacgtctggtgcaacctcacctccgggaatggcgcccgcgccctgtggctcttgctgctgcccttcatggtgatcaacctcgcgcactggatgcgtcccgcgacgcgcggccggaagcggacggtgcgcctgtacgggctgctggtccggctcatcggcctcaccctcaccgtgctgctggtggcggccgcctgcgaggtcgcactggacctcgccgcctggcagtgcgccggcacgcacgcctgcgccgagaagcactcctggctgggcttcctgtcacccgtcgcctccggcggctggtggagccagcccggacgccgcctcgccctggccgccctggcaccggccgcgctcaccggcctgctctggtacctctcccaccgcacctggagcgcgtacgagtcccagcagccgatctcccgccgggccgagcccgaagaagagacccaccgcacggccctcggccgcccgggcttctggtacggccgccgcctggtggccaggctgcgcgccgcgcacaccgccgcgggctttctgaccgtggccgcggcggtcggcgcctccgccgtccgtcacgacagccgggccggcggcccggccgccctccaatggctggccgggcttctcgccgcaactcttgtcgggggcgcggtcgttgtggtctgggtcgtctgccgcaggggccgcaccgagaaccggctcgaccgggaactcgacggaacactggtgcgccggctgcccaggggcgcccttgcgctgctcgcgctcaccatgctgtacgccgggtggtcccgccccggctggcactcgacgggccggctgcccggcgacatgacgttcggcgggatcgccttgacgcagggcctggtcgtgatcgcgctcggggtggtcgcccgggtgctgtaccgcaccctcccccaggctgtcggctccgctccagcagggggcacccccaccgaagcgcgcaccgcgatgcgcggcctcgccggacccgccgtcgcgatgctggcctgcgcgctcggcagcgtgatgtccggaggcatctcccagcgggtcgccgactggctggacggcagcgggggtgtcatgaccggcccgcccgtcctgctcacctggcaggcctccgcgatcccgccgctgctgatcgtcctgctcgtgctgttcgcctggctggcccggcgcacctggctgctgcggcgcgccgagatggacgccgtggagcgcgaccaccacggggagccgcaggacacgacccgcacccgccgtatcgcgagcacccgagcgatggccgccctcaccgaccgggcacccctcgtcgtgggcatcacgtccaccgtgacgctgctcctgggcgcggccgccctggtcggcgccgcggccaccggtgacgttcccggcagggcggcccgcggcacgtactccttcgtccagggcagcgccgacaccgcgcaggggctcggctcctggctgatcagcttcggcttcatactcttcgtcacctggggccgccgcgcctacaaggaccccgccgcgcggcgcaccatcggcatcctgtgggacgtcggcacgttctggccgcgtgccgcccaccccttcgccccaccctgctacgccgagcgggctgtgcccgacctgacctggcgcatggccacctggacccgtgcgacgggcggacggctcgtcctctccggccactcccagggcagcgtgctcgcggccgccgcggcctggcagctgaagccctcggaacgcaggagggtcgggctgctgacgtacgggtctccgctggagcggctgtacgggcgctggtttcccgcccacttcggtccggcggccctcagcgccctgcaccgcgaggtcgactgctggcgcaatctgtaccggctcaccgatcccatcggcgggcccgtccggctgcccggtgactgcggcccgcaggtcgaccgggccccgctgcgggatccgctcgcctacggccgcacggaggagcatccgctgcccgcgccgatcctcgggcacgggggctaccaggcggatccggcgttcgcggaggaacgggagcggctgctggcgcggttgcgcccggacgtgccgggaccgcgcgcccggggcgccgccggggaccagggcgtgggtggggatcaggacgtgggtggggatcagggcggcgccggagatcagggcagctccggcaggtcctccggg

SEQ ID NO: 1422 - DNA, 828 bp, Streptomyces avermitilis
  CDS (1)..(828)
gtgagtgagaatcagaacctcctcgcggagcagcgtcgcgccctcatcctcgacgaggtgcgaaggcgcggcggcgtccgtgtcaacgagctgacccgcaagctcggcgtgtccgacatgacggtccgccgcgatctggacgccctcgcccgtcagggtgtgctggagaaggtgcacggcggcgcggtgccggtggtcgaggcgagcacgcacgagcccggcttcgaggccaagtcgggtctggagctgacggccaaggaggacatcgcgcgagccgcggccgagctggtcgcaccgggcacggcgatcgcgctctccgggggtacgacgacgtacgcgctggcccatcagctcgtcgacgtgccggacctgacggtggtgaccaactcggtgcgcgtggccgacgtcttccacgcggcgcagcgcacttcgggtcagcggcagggcgccgccacggtcgtgctgacgggcggagtgcgtacgccgtccgactcgctggtggggcctgtcgccgaccaggcgatcgtggcgctccacttcgacgtgctgttcctgggagtgcacggcatatcggtcgaggcgggcctgtcgacgccgaacctggcggaggcggagacgaaccggcgacttgtgcagtcggcacggcgcgtcgtcgtggtcgccgaccacaccaagtggggcacggtgggcctgagttcgttcgcatcgctggatcaggtcgacacgctggtgaccgacgccggactgccggccggggcgcgcgcggaggtctcggagcacctgcggcgtctggtggtggccggggagcccggggacggtacagacatc

SEQ ID NO: 1423 - DNA, 477 bp, Streptomyces avermitilis
  CDS (1)..(477)
atggcacgccgtctgcgcccggtcgggctcgacttcactcagatcgctcccgtgtgtctggtgttcgcccgcgaggtggccgcgcccccgaagacggtcttccgtgcgctggcggaggacgtcgggggctggagcgagtggttcggcgcggtcacctccgcccggccggtcgaggacggcgccgggcgggaggtccggctcaagggcgggacccgcttccgggagacggtcgtcgtggcgaaaccggccgaggtgtacgcgtaccgggtcgacgagacgaacgctcccgggatgtccgcgctcctcgaggagtggcggctgacgccggccggtacgggcacccgggtgcagtggaccttcgcggccgacgggcccgcggtcttccggttcgtggtgaacctggggcgagcgggtctggggcgcgcgttccgggacgcggtgacctcgctggaccggcggctggcggccacgcgcgcg

SEQ ID NO: 1424 - DNA, 1122 bp, Streptomyces avermitilis
  CDS (1)..(1122)
gtgagcactccccgtaccactcatcccggcgaaaccctcgatgtcgaccacagcgacgccgactaccggagctggctcaaggaagccgtccgtaaggtccaggccgacgccaaccgctcggccgacacgcatctgctgcgcttcccactgcccgaggagtggggaatcgacctgtacctcaaggacgagtcgacccatcccaccggcagcctcaagcaccggctcgcccgctcgctgttcctgtacggactctgcaatggctggatccggcccggccgcccggtcatcgaggcgtccagcggctcgacggccgtctccgaggcctatttcgcgaagctgatcggcgtgcccttcatcgcggtcatgccccgcacgacgagcgccgagaagtgccgcctgatcgagttccacggcgcgcagtgccacttcgtggacgactcgcgcaagatgtacgaggagtccgccgccctcgccgcggagaccggcggccactacatggaccagttcacctacgcggaacgggccacggactggcgcggcaacaacaacatcgccgaatccatcttccgtcagctggagctggagcggttcccggagcccacgtggatcgtcgccacggcaggcaccggcggcacctcggcgaccctcgcccgctacgtccactacatgcagcacgacacccgcatctgtgtggccgatccggagaactcgtgcttcttcgagggctggacgaccggcgatccggacgtcacctgcgactgcggctcgcgcatcgagggcatcggcagaccccgtatggagcccagcttcgtgcccggcgccatcgaccggatgatgaaggtccccgacgcggccagcgtcgccgcggtacgcgccctggaacaggccatgggccgcaaggccggcggctcgaccggcacgggcctgtggagcgccctgaagatcgtcgcggagatggtcgccgaggggcgccgggggagcgtggtgaccctgctgtgcgacccgggcgaccgctacctggacaagtactactcggacgcgtggctggccgagcaggggctggacatcgcgccgtacacggcggcgatcgactcgctgctggcgacgggggtctggcgggac

SEQ ID NO: 1425 - DNA, 321 bp, Streptomyces avermitilis
  CDS (1)..(321)
atggcggagccggagttcacggccacaggcgtgcggatcgggaagaggctgcgctcgctcacccgggccgggcaggtccggatcagcggcggcaggcttgagctgctcaccagctacggcagcgagatcgacagcgcgccggtgcaggcggtgcgcgcgtcgaagccctggttcgcccctgaggaccgggcgttggcggatgtcaacggcacccgctattcgctgaccctcggcgagcacgatcccgcgcccgggaagccgggtccgccgtcggcacgccggttcatagaggcggtccgcaaggcgtccgggcgccgtagc

SEQ ID NO: 1426 - DNA, 513 bp, Streptomyces avermitilis
  CDS (1)..(513)
gtgatcagcaaaccaagcaggcactgcacggtagagctccaagcccttccgtcgcggatcggccaggtccgcagaatcgtctctgcgcagttgcgctactggcatctcgaccccttgatagaccaggccgcactcggtgtgaccgagctgctgtccaacgtccaccgccatgcccagcccgacaagacgtgcatcgtggagatggagctgctgctggaccggctcacggtctcggtgcacgatcacgacccccggctgcccgtggtgcgggacgcggaaccgtcggccacctccgggcgcggcctcgccatggtcgccgcggtgagcgagagctggggggtgcggccggaaggcgagtccgggaaggtcgtgtggttcacgctcccggccccctccgcgacggcgctgcccacacgtccgccgcgcgacatcggccgacccgtgcccgttctcaggcgcgcggtcgacgggcgcaggtccgaacacgctcccgcccggtccgccgttgccggc

SEQ ID NO: 1427 - DNA, 309 bp, Streptomyces avermitilis
  CDS (1)..(309)
atgcagaccctggcgaactgggacggcgggcccggcccgtggattccgttcttcccgctgatctgggcggccgtcgtgatcggcgtcgtgaccgtcctgcgccgcaccgtgaggcgcggacgcggcggaccgtggggtggcggagcgtggggcgccatgggcgacggccgcccgacgggcgactcgccgatcgccgtgctcggccggcgcttcgcctccggtgagatcgacgaggacgagtactggcgtcggctctccgtcctggacgagcagttcggccgcctgggcaagggcggcgcggcatccgtc

SEQ ID NO: 1428 - DNA, 573 bp, Streptomyces avermitilis
  CDS (1)..(573)
atgtacagtcacggtatgagcacccaggagcgactgatcgagtccacccgcgagctgctgtgggaacgcggttacgtgggcaccagccccaaggcgatcctggagcgcgcgggcgccggccagggcagcatgtaccaccacttcaagggcaagcccgatctggcgctgaccgcgatccgccgcaccgccgaggaactgcgggctgccgcggagggcgcgctgagcggtccgggcacgccgtacgagcgcatcgaggcgtatctgcgccgcgagcgcgacgccctgcgcggctgtccgatcgggcggctgacgatggacccggacgtggtggcgagcgaggaactgcgcgcccccgtcgacgagacgatcgactggctgcgcgagcagctggccgggatcgtcgaagagggaaaggaacaagggcagttcgcgcagtcgctggacgccgaggagatcgccgcgaccatcctcgcgaccgtccagggcggctatgtcctggcacgcgccgccggctcaccggcagccttcgacacgggcgtgcgcggcctgctctccctgctgcgccccccgcca

SEQ ID NO: 1429 - DNA, 582 bp, Streptomyces avermitilis
  CDS (1)..(582)
gtgcacgccatgcagtacgagctgacccttcccgccgactacgacatggacatcatccgcagccgggtgtcccgcctcggtcatgcgctcgaccactgggacggcctcggattcaaggcgtatctgatgcgtgagcgcggcgtggacggctcgccggtcaaccagtacgcgccgttctacctgtggaacacggtcgagggcatgaactccttcctctggggaggcgccttccaggggatcgtcgacgacttcgggcgaccgccggtgcagcagtggacagggctgtcgtacgaggaggggggcgccgccggctccccggccagggtcgcggtgcggcaccggcggcgggtgcccgagggggcgcggctgaccgggctgatgcaggacgcggtgcgggaggctcagcagctggccgcgctggacggcgtggtgggcgcggccgccgccgtggatccgcggcgctgggagctggtgcacttctcgctctgggagcatgacgcgccgaaggcggcgggtgaggtcttccaggtgctgcacctgtcggcgccgggccgggcgagcctgccgcgggggcgtcagtgg

SEQ ID NO: 1430 - DNA, 909 bp, Streptomyces avermitilis
  CDS (1)..(909)
gtggtgagcacggtccgcaccgtgctcggggacgtgctccccgagcacctgggcgtctgcgacgcgcacgatcacctcttcttcggcagccctcaactcccgggacaggaactgcgggacgcgtccgccgcccgggcggaactggccgccttccgcgagcagggcggcgggagcgtggtgcagtggacgccgtacggcctgggccggcgcgccgcggacctgccgctgctgtcccgtgacacgggcgtgcacgtggtggccgcgaccggactgcaccaggccgtccactacgacgccgggacgctcgccgagctgcgcggccggctggccgacacgttcgtcgccgaactcacgaccggcatcggcccgtccggggtccgggccgggctgatcaaggtcgccggcggcttccacgccctcgacgcgcacgcccgctggacgatgaccgcggccgccgaggcccaccacgcgacgggcgcgcccatcgcggtgcacctggagcttggcacgggcgcgctcgacgtcctcgacctgctgtgcggtgagtcgggtgtgccgccgcaccgggtgatcctcggtcacctgaaccgctcccccgatttcacggtgcaccgccaggccgcggaggcgggcgccttcctcgcctttgacggcccgtcacgcgccaatcacgccaccgactggcgcatgcccgacgcgctacgggccctcgccgaggcgggcttcggccatcggctgctgctcggcggcgacacgacgaccgcggcggcgcgctcggtcaacggcggccctggactcccgtatctgctgcgccgactgcgcccgcggctcgaacaggccctggggaaggacctggtgggacggatcttcaccgagaatccggggcgggccttcggggtggaatggcgc

SEQ ID NO: 1431 - DNA, 1242 bp, Streptomyces avermitilis
  CDS (1)..(1242)
atgaatggcaaggcgggcccccgggtggcgggggaagggaacacacggacgcggctggaccggggacgcggtgcgctcgggccggcgctggagctggtgcacacgggacgtgcgccgacgcgggccgtgctcaccgccgagctgggggtcacccgggcgaccgccggagcggtggccgcggagctggaggccctgggactgatccgtgtcgacgcgcacccgggcgccgccgccggctcgcagggccgcccctcgcaccggctggaggtcgccgagaacgggccggtggcgctcgccgcccaggtgcacgccgacggattccgggccgcgctcgtcggtctgggcgggcgcatcgtcgccaccgcgcccggctgtgagaccgtcgacgccgacccggcgaaggtgctcggctcggtggtcgaggcgggcgccgagctgctcgaggagaccggacggcgctgtgtcggggccgggctcgccgtgccgtccgccgtcgccgagccggagggcctcgcgctcaacccgctgcacctggcctggccggcgggcgcgcccgtccgccagatcttcgccgagcgcgtccgcgcggcgggcatcacgggccccgccttcgccgccaacgacgtcaacctcgccgccctcgccgagcaccggcacggcgccggccgcggctcccgtgacctgctgtgcgtggccaccggacaccgtggggtgggcggcgccctggtcctcgacgggcgtctgcacaccggcagttcgggactcgcgctggaagtcgggcatctgacggtcaaccccgagggcggccgcccctgccactgcggcagccgcggctgcctcgacgtggaggcggatccgctggccttcctcaccgcggccggccgcgaccccggccccgaggtctcgctgctccagcaggccaacgacctgatccgcacccagtacgccgacccgtatgtgcggacggcgacgcaggcgctgatcgaccggctgggcctcggactcgccggactcgtcaacatcctcaacccggaccgcatcatcctcggcggcctgcaccgcaccctgctcgacgccgacccggaccggctgcgcgccgtcgtcgccgaccgcagcctgtggggccagagcggcggcgtaccgatcctcccctgcaccctcgaccacaacagcctcgtgggcgccgcggagttggcgtggcagccggtactggacgatccgctcgcggccctggccgggacc

SEQ ID NO: 1432 - DNA, 666 bp, Streptomyces avermitilis
  CDS (1)..(666)
atggacgccgagctgttcccgcgaagccgcgcacaggtcgcaccggacgcggtccatgtgccggactgggcggacgcgggccggcagcggcggttcctggcggcctgccgcgactgggcccgcccaccggccggcctgcgcaccgtccacacccccggcggcggcacgatgacctcccggcaggtctgcctcggctggcactggtatccctacgggtacgcccgtacggtcgtcgacggcgacggcgcccccgtgaagccgctcccggactggctggcggagctcggccgcgacgcggtgtccgacgccctcggcccgcaggcggtgccgccggtcccgtacgacatcgctctgatcaacttctacggcgccgacgcccgtatgggcatgcaccgcgacagcgacgagaagtccggcgcgccggtcgtctcgctcagcgtcggcgacacctgcgtcttccgcttcggcaacgcgcggacccggacccggccgtacacggacgtggaactgcgcagcggcgatctgttcgtgttcggcggcgcgagccggctcgcgtaccacggggtaccgagggtgtacgcggacacggcgccgcccgagttggggctcgtgggccggctgaacatcacgctgcgggtgagcggcttccaggacccgtccggcgaa

SEQ ID NO: 1433 - DNA, 1140 bp, Streptomyces avermitilis
  CDS (1)..(1140)
atgaacgacccgatgaccacgccctggggcgcgtacgcgctcgcccgcttccccgaggatccacgcgaccggctgcgtgcctgggacgcctccgacgcgtatctcctgcggcacctcgcggcgagcggcactccgctctcgggatcggtggtcgtgctcggcgaccggtggggtgcgctcaccacggcgctcgcggcgcaccggccgacgcagatcaccgactcgttcctcgcccgggaggcgacccgggagaatctcggccgggccggcgtcgacccgtcctcggtccggctgctgaccacgcgggacaccccgccggagcggatcgacgtgctgctcgtacgcgtcccgaagagtctggcgctcctggaggaccagctgcaccgtctcgcgccaggggtgcacgaggggacggtcgtcgtaggcgccgggatggtcaaggagatccacacctcgacgctgaagctgttcgagcggatcctcggcccgacccgtacctcgctcgccgagcagaaggcccggctgatcttctgcaccccggacccggggctcgtacgggacccgaatccatggccgtaccgctatcggctccccgacggcgtcggcccgttgtcggggcggcccgtgaccaaccacgccggcgtcttctgcgccgaccggctcgacatcggcacccggttcttcctgcggcacctcccgcgcgtgagcggggccgagcgtgtggtggacctgggctgcggcaacggagtcgtcggtacggcggtcgcgctgaccgagcccgaggccgaggtgctgttcgtggacgagtcgtaccaggcggtggcctcggcacgggagacgttccgggcgaacgcggacgggaccgccgagttcctggtgggcgacggtctttccggggtacccgccgcgagcgtcgacgtcgtcctcaacaacccgccgttccactcccaccaggcgaccacggacgccaccgcctggcgcatgttcacgggggcgaagcgcgcgctgcggccgggcggcgagctgtgggtgatcggcaaccgccacctcggctaccacctgaagctgcgccgcctgttcggcaacagtgaactggtcgcgagcgacgcgaagttcgtggtgctccgggccgtcaagaag

SEQ ID NO: 1434 - DNA, 903 bp, Streptomyces avermitilis
  CDS (1)..(903)
gtgccactggcagcaaccggtgacctcatcgccggagccaccgcggaccacaccgccgtcgccgcgttcaacatcatcaccctggagcacgtcgaggccgtcatcgcgggcgcggagtccgtcggcgcgccggtcgtcctccagatcagcgagaacgccgtcaagttccgctacggccgtctgctcccgctggcccgggccgcggccgcggccgccgaacgggcgtcggtggcggtcgcactccatctcgaccacgtccagagcgacgacctgctgcgccaggcgcccggcgccggattcggctccgtgatgtacgacgcggcccggctgccgtacgccgagaacctcgcggcgacccgcgccgccgccgactgggcacatgcccgagggctctggatcgaggccgagttgggacaggtcggcggcaagaacggcgagccgccgctggacgcgcacgcggccggagcccgcaccgatccggccgaggcgcgcgccttcgtggccgactccggagtggacgcactggccgtggcgatcggcagctcgcacgcgatgacctcgcgcacggccgcgctcgaccacggtctgctcaggcggctcgccgcgcagctggacgtaccgctcgtcctgcacggctcctccggcctgccggacgacgaactggcggcggccgtcacgggcggcatagccaaggtcaacatcgggaccgcgctgaacctcgcgatgaccagagcgatcagggagttcctcgccgcacatcccgacgcggtcgactcacgcaagtacctcagtgtggggcgggaggcgatggcggccgcggcggcggagctcatcgcggtgctgcgggccgccggcggcccgcagcaccggacgaccggctcgggtagcgggacgcctacttct

SEQ ID NO: 1435 - DNA, 948 bp, Streptomyces avermitilis
  CDS (1)..(948)
ttgtgctcgaaaggccgctatatcttgcatgaaagtgcatcgctggggaggggttacggcatgagccatgtcgagaacgagctgaacagccaacccgcctgctggacccgcgccgccacggaggcggccgagtacgcgggagcactgcccgcgacgggggagcgggtagccgtcgtggggtgcggaacctcgttcttcatggcgcaggccgtcgccgcgctgcgggaacaggccggacagggggagacggacgccttcgccgcctccgaattcccgcccggacgcgcgtacgaccgtgtcgtcgcgctcacccgctccggcaccaccaccgaggtcctcgcgctcctcgccgaactccggggccgtacccgcacgacggccgtcaccgcggacccgcgcacccccgtgatggagtcggcggacgaggtcgtcgtgctcgactacgcggacgagcggtcggtcgtgcagacccggttcgcgaccaccgccctcaccctgctccgcgcccacctcggcctgcacaccgacgccgtggtcgccgacgcccgcaccgccctggacactccgctgcccgaagggctcgtcgagtgcacgcagttcaccttcctcgggcgcggctggaccgtcgggctcgcgaacgaggccgggctcaagatgcgcgaggccgcactggcgtggacggaggcctatccggcgatggagtaccggcacggccccatcagcatcaccacccgggggaccgccacctggatgctcggcgaggcacccgaaggactggccgaacaggtccgggaaaccggcggactgtgggtggccggcggtctcgacccgctcgccgaactcgtccgcgcacagcggctcgcggtcgccgtggccgccgcccgcggactcgaccccgaccggccgcgccatctgacccgctcggtgatactcgcccccgccgcccgc

SEQ ID NO: 1436 - DNA, 777 bp, Streptomyces avermitilis
  CDS (1)..(777)
atgtcgcgcgacgcccgctggaagacactgctggaactgctcgtcgagcggggccggctggatgtcgaggaggcggcggcccagctggaggtgtcggcggcgacgatccggcgcgacttcgaccagctcgccgagcagcagatgctggtgcgcacgcgcggcggcgcggtcgtgcacggcgtctcgtacgaactgccgctgcgctacaagacggcccgccacgcctccgagaagcagcgcatcgcgaaggcggtggccgagctgatcgcccccggcgaggcagtggggctgaccggaggcaccaccaccaccgaagtggcgcgggcgctggccgtgcgcggcgacctcgcgtccggctcgcccgcgctgaccgtggtcaccaacgccctcaacatcgccaacgagctggccgtacgacctcagttcaagatcgtggtgaccggcggggtcgcgcgcccgcagtcgtacgagctggtcgggccgctcgcggacggcgtgctcggccagatcaccctcgacgtcgccgtgctcggcgtggtcgccttcgacgccgcgcacggcgcggccgcgcacgacgaggcggaggccgcgatcaaccggctgctgtgcgagcgcgccgagcgcgtggtggtcgccgcggactccagcaagctgggccggcgtgcgttcgcccggatctgcgcgacggaggcggtggacacgctggtcacggacgcgccggtgagcgaggacacggtgcgccgcttcgcggaggcgggcgtggaggtcgtcgcggtc

SEQ ID NO: 1437 - DNA, 867 bp, Streptomyces avermitilis
  CDS (1)..(867)
atgacaaccggccatttcacatccgtcgaggacgtctccgcacgcctcgcggagaccggctatctggcgtcccccgcggtcgccaccaccgtcttcctcgccgaccgtctgggcaagcccctgctggtggagggccccgcgggagtgggcaagacggagctggcgaaggcggtggccgaggtcgcgggcgcctcgctgatccggctccagtgctacgagggcgtcgacgagtcgcgcgcgctgtacgagtggaaccacgccaaacagctgctgcgcatcagcgcgggccgtgacgagacgtgggacgaggcgcgcacggacatcttcggcgaggagttcctgctcccgcgcccgctgctcaccgccatccgcggcgacgagccgaaggtgctgctgatcgacgagaccgacaaggccgacgtcgaggtggagggcctgttgctggaggtgctgagcgacttccaggtcaccgtccccgagctgggcacgatcaccgcgacgcgccgcccgttcgtggtgctcacctcgaacgcgagccgcgagctgtccgaggcgctgcgccggcggtgcctgttcctccacatcggcttccccgacgaggagttggagtgccgcatcgtacggctgaaggtgccgggcctcgacgcggcactggccgagtcggtggtacgggtggtcggtgcgctgcgcgagatggatctgcgcaaggtcccgtccgtcgccgagaccatcgactgggcgcgcacgctcctcgcgctcggcgccgacaccctcgacgagaccgtcgtacgcgacagcctcggcgtactcctcaagcaccaggaagacatcctcaaggcgtccgccaagctcgacctggacgccgtg

SEQ ID NO: 1438 - DNA, 1371 bp, Streptomyces avermitilis
  CDS (1)..(1371)
gtgaaggcgccggccgcgtccggtgtgcccgaacggctgaccgcgctcgtccaggcgctgcgctcgcacggcatccggatcgggaccggcgagaccgtggacgccgcacgggccctggaggcgctgggcctggccgaccgcgagtatctgagggaggggctcgcctccgcgctgttgcacggcaccgggcagcgggccgtgttcgacccggtcttcgatctctactttccgcgcggtgtcggagtaccggagcccggcagcggtccggccccggaccgggacgagctgcgggaccggatcgccgccgccctcgccgcgggcgatgaggcgctcctcggccagttggcggccgaggcggtgaacggcttcggggggtacgggagttcaccggggtcggacggctggtcgtcgtaccagacgctcgaccggctgcgtccacagaccctgctcgcccgcgtccgcgcgagtgtcctggcacaggccacggacagcgggttcgccgaccggttgctcgacgacgagatccgccggcgtatcgaggagttccgccggcaggtgcgcaccgaggcacggcgcagggtcgccgagcggcgcggggcggacgagatcgcccgccggggtgtcgccccgaccgccgaccgggtcgacttcctcttcgccggacgcgcccaactcgccgaactgcggcggacggtgcagcccctggcgcgcaaactggccacccggctggccgcgcgccgccgccgtgcctcccgcggcaccatcgacctgcgccggaccctgcgcggctcgctgtcgacgggcggcgtgcccatgcgcccggtcctgcgccgacgccgtccggtccgtcccgaactggtgctgctgtgcgacgtgtccggctccgtggccggcttctcggacttcaccatgctgctcgtgcaggcgctgcacgaccagttcagcaaggtgcgggtgttcgccttcgtcaaccggatcgacgaggtgaccggcctggtcgtccgcggtgcggccgacccggaggggctcggtgcccgcatcatggcgcaggccgccctgacgggctggcacgacagcagcgactacggcgtctcgctgggcgagttcgcggagcggtacgccgacgcggtcgggccccgggcgtcggtgttcgtcctcggtgacgcccggacgaacaggagcgacccgaaccttcccgccctgcgccgcgtcgccgaacgggcccggcgggtctactggttgaaccccgagccgcacacccagtggggcacgggcgactccgcggccctcgcctacgccgaggtcgtcgagatgcacgaatgccgcaacgcccggcagctcggcgagctcgtcgcgcgtctgcttccggtg

SEQ ID NO: 1439 - DNA, 2040 bp, Streptomyces avermitilis
  CDS (1)..(2040)
atgcgcagatcggctcgtacggctccggcggcactcacgcctctggccgatcacgtcgaccccgcctggctgccgtccgaggcgttccgcgcgctcggctcccggcgcaccgtcgtgtgcgggaccggggcgctcgtcgacaccgtgcacggtgaagtggcgtgggcgtgcggggcgttcggcggttcggtggtgcgtgccgaggagccggcggacgaccggccatgcgacctgctgctgcacctcggcgaacgcctggacgcacccgagccgctcggcgacgaggggttcacgctggtgcggcggcggggccggacgacggtgaccgccgcggggcagcgcgggctgctctacgggctgttccatgtcgtacggctgggcgaggccgcgttcggtgcctcgcgagcccgcgaggcgcaccgtcccgcgctggcgtcgcgcatgctcgaccactgggacaacgtggcggtccacccggtgatgggacaggtggagcgcggctacgcgggcggctcactgttctggcgggacggccgggcgcgcggcgacctggagcgagtgcggacgtacggacggctgctcgcggcctgcgggatcaacgcggtcgccgtgaacaacgtgaacgtgcacgcgacggaggcgcacctgctgaccgaccggatcggcgaagtggccgagatcgcgggcgcgttgcgcccctacgggatcaggacgcagctgtcggtcaccttcgcggcacccctggtcctcggcggcctggcgacggccgacccgctggacgaggcggtgcgcgcgtggtgggccgaggcgaccggccgggtgtacgcggcgattcccgacttcggcgggtacgtggtgaaggcggactcggaagggcagccggggccgttcgcctacggccgcagtcacgcggacggcgcgaacctcctcgccgacgcgctcgccccgtacggcggcaccgtgcactggcgggccttcgtctacgaccaccggcaggactggcgggaccggtcgacggaccgggcgcgcgccgcgtacgaccacttcgtgccgctcgacggccgcttccgggacaacgcggtcctccaggtgaagcacgggccgatggacttccaggtgcgtgagcccgtctccccggtcatcggcgccatgccgcgcacccggctcgcggtggaggtgcaggccacccaggagtacaccggccagcaacggcatgtgtgcgcgctcgcgccgatgtggagccaggtgctgcggtggcgccccgagggggcgacggggacgagtgtcggggagctggcgcgcggcggactggtggcggtgtcgaacgccggcgacgacccgtactggaccgggcaccccctcgcccaggccaatctctacacggtggggcggctgggctggcagccggacgccgacccgttcggcctgctggacgagtggatcgacctgaccttcacgcccgcgcgcaccgaggctccggagcgactggtcgccggactgcgcgcggtgctgtaccgctcctggcgtacgtacgagaagtacaccgccccgctcggcgtgggcttcatggtgcagccgggacaccactacgggccgagcgtggacggctacgagtacagcccgtggggcacgtaccacttcgccgaccgggacggcgtcggggtcgaccgcacgcgcgccaccggtaccgggtacgcggggcagtacgccaagccgtgggcggaggtgtacgagtcgccggacacctgccccgacgaactgctgctgttcttccaccatgtgccgtacgggcatgtgctgcacagtggcaggacggtgatccagcacatctacgacacgcacttcgagggcgtggccgaggtcgaggaggcccggcaggtgtgggcctcgctcgtggacctggtggagcctgcgcggcacacgcgggtggcggagcggtacgaggagcagctccgcggcgcccgcgagtggcgcgatcacatcaacagctacttcttccggaagtccggggtgccggacgcgcacggtcgccggatccac

SEQ ID NO: 1440 - DNA, 2034 bp, Streptomyces avermitilis
  CDS (1)..(2034)
atgaccgcgcccggcatcggcaagatcccctacggcggcgactacaacccggagcagtggcccgaggccgtccgggacgacgaccaccgcctgttcacccaggcccggatcgacaccctcaccgtcggggtgttcgcctggtccctcactcaacccgccgaggacgcctacgacttcggcgtcctcgacggcatcctggagcgcgccgccgccgagggccgccgcgtctgcctggccaccggcaccgccgcccttccgccgtggctggcccgcgcccaccccgacgtcaaccgcaccgacttcgagggccgccgccaccgctacggccagcgccacaacttctgccccagctcacccgcctacaagagcgcggccaccgccctggccggccgggtcgccgagcgctacgcgggccatccggcgctgctcgcctggcacatcggcaacgagtacggcggcgcctgctactgcgacctgtgcgccgaggccttccgccgctggctgcgcgaacaccacggcggcctcgacgccctcaacgacgcctggtacacggcctactggtcgcaccgctacaccgactgggaccagatcgagccgcccagcgcgctcaccgagcactggcgcggccccgaccacaccgccttccagggcatcaccctggactacctgcgcttcaccacggacgcgctgctcggctgcttcctcgccgagaaggaggcgatccgcgagcacagtcccgagacgcccgtcaccaccaacttcatgggcatgtaccgcccgctcgactaccaccgctgggcgccccacctggacttcgcctcctgggacaactacccgcccctggacgccccgccgacctggccggcgctcgcccacgacctgatgcgcggcctcaaggacggcgcccccttctggctgatggagcaggccccgtccaccacggcctgccgcgacgtcaacccgctgcggcgccccggcgaactgcgcctcgcgagctggcaggccgtcgcccacggcgccgacgccgtcctctacttccagctgcgcgcctcgcgtggcgcctgcgagaagtacttcggcgcggtcatcgggcacgcgggccgcgacgacacccgggtgttccgtgaagtgagccacctgggaagggagtttgagctcctcggcgacaccccgctcggcgcccgcacccccgcccgtaccgccctcctcttcgactgggacagctggtgggccctggagatctccgacggcccctcccggcttgtccggtaccaggatcaggtgcacgcctactaccgggccgcccgcgaggccggcgccgacatcgacgtcgtaccggtgaccgccggcctccgcgcgtacgacgtggtgctcgcgcccgccctgcacatggtcaagggtgatctcgccggccgcctcgaagccgtggccgcacgcggcggcacggtgctcaccaccttcctctcgggccgcgtcgacacccacgaccgggccttcctggccgacgtccccggcccgctggcgccgctcatgggcatccgcgtcgacgagtgggacgcccgcccggcggacaccgcccacccggtgaccctgggggacgacaaagacgtcgtgcacacggacgcacggctggtcttcgagatcgtcctcccgcgaggcgccgagccggttggcacgtatcaggccgacttctacgcgggcaccccggccgtcacccgtcaccgcttcggcgaacgcgggggcgagggctggtacgtcgccacggccctggcacagcccggcgtcgactgggtggtacgccgcgtcctcgcccgccacgacctgatcggcccgtacgccgaccacccggccgtggagaccgccacgcgtgtcgcccccgacggaacccgcctgctgttcctcctcaaccacgcgcccgaaccggcccgcctgaccgcccacgccaccgccaccgacctgctgaccggcaagcggtccgagcggtccgagccgctcaccctcgacccgctcggcgtggcggtactacggcttcgg

SEQ ID NO: 1441 - DNA, 759 bp, Streptomyces avermitilis
  CDS (1)..(759)
gtggtgggacgagcggcgcctgctgggctccccggtggagccgcgatgagcgtcgtggacgaaggccgggccggcgaaacccgaagcccccgcacccggtccttcggcgacggcccgctctcccgtgccgccgccctggtccacaccctgctcaccgtggaggtgatgctgctcaccgccgcgtcgccgggcctcggcgccctgctcgtcctcgggcccgacccgtccggtctgccgctcgccgcggcctgtctgctgccgctgggccccgccctcgcggccgccgtgtacgcgctgcaccaccgcggccgcgacctcaccgacctgcacccggcccgcgactactggcgcggctggcgcctgaacgcccggcccgccctgaagatctggaccccgctgctcgcctggctcaccgtcatcgccttctgcctgacccatttcgccgtcggcgggctgcccggctggtgggccgccctgctggccgtcatcggcctcggctgcttgctctggggcgcccacgccctcgtcctcacctccctgttcaccttccgcaccgcggacacctgtcgcctcgccgcgtacttcctgctccggcacgtcagggccaccctcggcgccgcctccctgatcgtcctcaccaccggcctcaccctgctcgccaccgaggccctgcccgctctgctcgcccccctcctgctgctgtccctgttgcacgcctgccgtccggtgatcaccgaaaccgaggaggacttcaccgca

SEQ ID NO: 1442 - DNA, 1521 bp, Streptomyces avermitilis
  CDS (1)..(1521)
gtgatcagcgtccccgccgaggcgaccggacggctctccgacgcctggcgcgcctgcgtcggcacgggccgcatcgaactggccctgcgccgcgactaccaggactccctcgcgctgctccagcgcgagatcggcttccggtacatccgggggcacgggctgctgtccgacggcatgggcgtgtaccggccgtacgcgtacgagggggcgcggcgtgtgcaccactcgttcacctacgtcgatcaggtcgtcgacgcctacctgggtctgcatgtccgccccttcctcgaactcggcttcatgcccacggagttggcgagcggcgaccagacggtcttctggtggcgcggcaatgtcaccccgccccgctcgtacgacgagtgggcgcggctcgtgcgggcgacgctcacgcacctcgtcgaccgctacggcatcgaggaggtgcgcacctggccgatcgaggtgtggaacgagccgaacctcaccgacttctggcaaggggccgacgaggccgagtaccaccgcctgtacgaggtgaccgcgcgcacggtgaaggacgtggacgcctccctccaggtgggcggcccggcgatctcgcccggcgccgacgagtggctgctccggtttgccgagttcgcggagcgccgcgaggtcccggtcgacttcgtgtcgcggcacgcgtacacctcgggaccggcccggccggtgcccttcggcgcgtaccagaccctcgccccggcgcggcggctgctcgaccagttcgcccggccgcgcgagcagctcaagggcacgagatacaccgaactcccggtccacatcaccgagttcaactcctcctaccgtccggacaatccgatccacgacaccgcgttccacgccgcctacctggcgcccgtactcgcggcgggcggcgaccacgcggactcgttctcgtactggacgttcagtgacatgttcgaggagtccggtgtgcccaccgcgctgttccacggcggtttcgggctgctcacccaccgccaggtcaagaagcccacgtaccacctgtacgcgttcatggcccggatgggggaggaactgctggagcgcggcgacgaccatctcgtcacccgccaccccgacggtcgggtcaccgtactggcctgggcgcccgtcgacgagaccggccgcacaccgggcccggaccggcacaccctgcggctgtccgtgcccgtgggcaggaggccgcgcggcgccgccttcgtccggcgctccaccgtggacgaggagcacggcaacgcgtggaccgcgtggcggcacatgggcggcccgcgctcgccccggccccaccagatcgatctgctgcacgaggccgccgaacccgcccgcagccatctgcgcctccccgtcgaggacttccgcgccgacctcggcctcaccctcgcccgccacgaggtcaccctggtggagctgagccccgtcgaggacgagacaccgccgtggtgggacgagcggcgcctgctgggctccccggtggagccgcga

SEQ ID NO: 1443 - DNA, 1647 bp, Streptomyces avermitilis
  CDS (1)..(1647)
gtgaagaacaccggacagctgtcccgcagaggcctgctcgccgtggccgggttcgcgggcctcgccgccctgacgggctgcggcagcggcgacggggaggcggacacgaaggacctctccaagaagcgggccggcgcgatgaagaactacggggcgggggaccagttcaaggccaccaaggcgctcaccttcacgatcctgcacaacgacatgccgacctacccgatgaagcgcgactggctgttctggaaggaggtcaccgagcgaaccggcgtcaccctcaagccgacctcggtccccgccagcgactacgacaagaagcgaagcctgctcatcggcgcgggcgacgcgccgttactgatccccaagacgtacccgggccaggagaccgcgttcgtgtcctccggggccatcctgccggtcagcgagtacgtcaggctcatgccgaacttccgggcgaaggtcgagaagtggggactcgagggcgacctggacagcatccggcaggccgacggcaactactacgtcctgcccggcctgcacgagaaggtcaagtccggctactcgctctccttccgtacggacgtcctgaagaagcacggcctcgacctgccgaccacctgggatcaggtctacgacgtgctgaaggcgctcaaggccgcgtacccggacgtctatccgttctccgaccgctggggccagcccacaccgggcggcgcgctcctcaactacctgggaccggcgttcggcacgaaggccggctggagctacgccaacaccgcctgggacaccaaggcacggaagtacgtcttcaccggggcgacggacgagtaccggcagatgctcgagtacctgcgcaagctcgtcgccgagaagctgatggaccccgagagcttcacccagtccgacgacgacgcggtgcggaagctgctgtccgggaagtccttcgtcatcagcgccaacccgcaggaactggtgcagaactaccgctacaacctgggtaaacaggtcaagggcgcgaccatcgagatgatcccggtgccgatcggcccgaccggcgaggtgatcgtgggcagccgcctggagaacggcctgatggtcgccggcagggccgccgagggcgacagcttcgtcgccatgatgcagttcgtggactggctgtggtactcggacggcggacaggagttcgccaagtacggcgtcgagggcgtcacctacaccagctcgggagcgggccgctacaaggtcgcggacggcatcagctacatgggctccgacccctccgcgccgaaggacctgcagaaggactacgggttcaccaacggcgagttcgcctacggcggctcctgggccctggtgtcctcctcgttctccccggacgagaaggcgttccaggacgccatggcgggacgcaagctcctcccggtcgacccggcccacccgctgaaggccgacgagcaggagcaggcgacgctttgggacacgccgctcaaggaccacgtcacgcagaacacactgaagttcgccctcggcaagcgcccgatgagcgaatgggacgcctacctcgccgaactcaaggccaagaacatgcagcggtacatcgacctgcacaacacggcgtacgagcgcttcaagaaggagcacggg

SEQ ID NO: 1444 - DNA, 924 bp, Streptomyces avermitilis
  CDS (1)..(924)
gtggtgaccctctccgacgggcgcccgcgccgccctgcccgcccgcgtctctcggccggccggccgtcccgcggccaccgcgtcttccaggcggtcaacgggctgatcctgaccggcgtcgtggccgtcacgctctacccgttcgtcaacatcgtcgcccgctcgttcagcgccgaggaccgcatccgggccggccaggtgaacctgctccccgagggcttcaacctcaccacctacaagatcgtcctcaaggacgggatgttctggcggaactacggcaacacggtcctgtacaccgtggtcgccaccgccatcgccatggtgctcaccacctgctacgcctacgtgctggccaaaccgcacctcaagggccgcggcgcgctcgtcggcgtcgccgtgttcaccatgttcttctccggcggcctgatcccgaactacgtactgatcaccggcctcggcatgaagaacacgctgtgggcgatggtgatcccgaacgcgatcagcgtcttcaacctcctggtgatgaaggcgttcttcgagagcctgccgaccgagctggaggaggccgcgcagatcgacggcctcagcacctacggcatcctgctgcggatcgtgctgccgctgtccaaggcggtcatcgcaacgatggtgctcttctactcggtgtcgttctggaactcctggttcggggccttcctgtacctggacagggccgaggagatgccggtcacggtctatctgcgcaacctcatcgcgggcgcgaccggcggcgagaacgccggggcggacctggaacagctcacccaggtcgcggcgaacatccagtcggtgacgatcgtgctcaccgcgctgccgatcctcctcgtgtacccgttcgtccagcgctacttcgtctccggcgtgacgctcggcgccgtcaagggc

SEQ ID NO: 1445 - DNA, 996 bp, Streptomyces avermitilis
  CDS (1)..(996)
atgaccagccccaccgctgtggaccccacgcccggcgcgcggaatccatcgccgtccgagcacactgcaccccggccgcgccggcggcccgcaccccgccgcacctggcggcaggcgctgcgccgtgactggcagctgtattcgctggtcgtgctgccgctgctgttcctgctggtgttccgctatctgccgatgatcggcaacgccatcgccttccgtcgcttcgaaccgggcggctccatgctgggcgagcggtgggtcggcctgcgctatgtgcgcatgttcctgaccgatccgacgttctggcaggtgttcaccaacacgatgtggctgggcgcgctgaccctggtgttctgcttcccggtgccgatcgtgctggcgctgttgctcaacgaggtccgcacccgtgcgctgaaacgtttcgtgcagtcggtgtcgtaccttccgcacttcctgtccatcgtgatcgtcgcgggcgtcaccatgcagatgctcgccaccgacggcccggtcaaccatgccctgaaggcgttcggccaggcgcccgtcaggttccttcaggagcccgactggttccgcgcggtctacgtcggctcggagatctggcagaccgcgggctggggcaccatcctctacctcgccgccctcaccaccatcgacgaggacctgtacgaggccgcgcgcatcgacggagcgggccgctggaagcagatctggcacgtcgccctgcccggcatccgccccaccatgatcacgctgctgatcctcaacatcggcacgttcatggccgtcggcttcgagaaggtcctgctcctctacaacccgctgacgtatcccaccgccgacgtgatctccacgtacctctaccgcaccggcgtcgagtccaacagcttcagctacgccgcggccatcggcctgttcgaagcggtcatcggcctggtcctgatcttctccgccaaccagctctcgcgccgcacagtggggaccagcctgtgg

SEQ ID NO: 1446 - DNA, 999 bp, Streptomyces avermitilis
  CDS (1)..(999)
ttgcgaggtgccgtgcccgcattcgatctaccaccggccgaactggagaaccaccgccccgccccccacgagcccgccgatttcgacgccttctggcaggccaccctgaaggagtccgggcaggccgagccggtcctgtccgtgcggccgttcgacagcggcctgcggctggtcgagacctgggacgtgaccttccgcggcttcgccggcgacccggtgcgcgcctggtacacccggcccgccgaagccccgcgaccgctgccggccgtcgtcgagtacgcggggtacggacgcgggcgcggactcccgcacgagcggctcacctgggcggccgccgggtacgcccatctcctcatggacaaccggggccagggcgaccagtacgggtgcggcggcgacacccccgacccgcacgccacggcaccgagcggcccgggtccggccgtacgcggactgctggacccgcgcgactaccactaccggcgcctgatcaccgacgcggtgcgcgccgtcgccgccctgcgcgcgctgccgggggtggacggctcacgggtggcggcggtcggcaacagccagggcgggggactcgctctcgccgtcgccgggctcgtccccgacctcgcggccgtactggtcagcgcgcccttcctgtgcggcatccggcgcgccctcgaactcaccgacgccgccccgtacggtgagatcaccgcctatctcgccgtgcaccgcggcgccgaggcggctgcgtatcgcaccctctcctacgtcgagggcgtctccttcgcccggcgcgcgaccgcccccgcgcacttcgggatcggtctgcgcgacacggtctgcccgccgagcggcgcctacgccgcgtacaaccgctacgccgaactcaccggccacgaccccttgaaggagatccacccctacccgttcaaccagcacgaaggcggcgacgccgtccatgtgcgccgccaactcacttggctcgacggcatcctgggcggc

SEQ ID NO: 1447 - DNA, 1221 bp, Streptomyces avermitilis
  CDS (1)..(1221)
gtggtacgcggcaggccatcggaatcgcggcgttccatcgccctcgtgcactgggcctttccccctacggtcgggggtgtcgagtcacatctcgccgactacgccggccggctgacccgccggggataccaggtgaccctgctgaccggtgaggcccggccgcagcccgtcgaccgggtcgagatcctcacacatccgctgctgcggctcgcggagtaccaccatgccgccctgggtgagaacagccgcacgggaaggtggctgacgccggtcgaacagcgtcgggcggccgaactccacgagtggctcgcccgggtcgtggacgcgcgcgacatccgaatcgtgcacgggcacaacctgcatcacttctcgccggtccccgccctcgccctcaaccggcttcgggaacagagcggtacgaccttgttgcacacgtaccacagcgtctggcccgaggatccgtggacagcgcagttctgccgttcctgggacggccactacgtggtgtccgactacctcgcgttcgcctgccgcactcatctcggcatccgggcccggcgcacctatctggggatcgccaccgacaggttccggagtctgccgcccccgcggagcgacggcccccacaccgtgctcctgcccgctcgtctcatccccaacaaaggcgccgagctggctgtccgcatgctcgacacactcaggcggaccggcctgagcgtacggcttgtgctgacaagtcctcaggaggtcgtcgactggcacgaggagcagcaggggttcctcgaccgtctcaaccggttgatcgacggcctgggactgcgcccccacgtggacctggtcccgacccccaaggaactgatgccacggctctacgcgcgtgcccacgtcgtcgtctacccctcggactatcccgagcccctggggctggcgccgctggaggcgatgtccgccgggcgtcccgtcgtggtcaccgcgaccggcggtctgccggaggccgtcctgcacgaccggaccgggtacgtggtgaccccgggcgacctggaacagctcagtgaccgggtacgccgactgctcctcgacccggccttgtcgaagcggctggggcgagaggggcgcagacacgtggagcgccagttcaacctcgacacgtacgtcgacaagatgtgcgccaactactccgccctcctggacgaacgcgtcgagggcctgccgcggatcggg

SEQ ID NO: 1448 - DNA, 2199 bp, Streptomyces avermitilis
  CDS (1)..(2199)
gtgatcgactccgcctcccccgaggtcggcctccagccgtttctgcacaccagggtgatctgcctggccgccccgtcgttcgcgctgtcggccaccgacggacagttgcggggcaccggagtcgacggcttctacgaccaggaccggcggctgctccacacgctgagagtgctcgtcaacgggcaggaaccggagccggtcgaccacggccagcagggtccccgcgaggccgtgttccgggcgatgtgccgacagcccggcgatccgacgtcggccccctggctgctggtcacccgggaacgtgcggtgcggcggccgggaagcggggaatcgggcgacgtcatccggctgcacaacgtcaactctcaggaggcgcggttcaccctctccgtggtggccgcgaccgatctcgccgacgtcgccacggtcaaggcgggagccccggtcgacgacgtcggctgcgagcaggtggagggcgtcgcccgaggcgtgcgctggctgtgcccgcgggacaagagccgggtcctgctccgcgccgaggccctcaccacgtcggcggacggccggacggcaccggcgggcggcctgcccaagccggagctcctgctcgaccgggagcaccccggccgtgcggagttccgctggcagctgtgccttcagccggacgaggagtggtccgtacgcctgttgctccagggcaagaccaccaccgtggcgggccatcccgtaccacctcggctcggcgtgccctggcagaccccggaggtgaccgggcacgagcgcatggcggcgttgctgaagaggggactggccgatctggaggcgttgcgcctcgccgagcggagcagcgccgccggggagcgtgaggatcagttcgtggctgccggatgtccctggttcctgggtctgttcggccgcgacagcatctgggcggcccggatgatgcttccgctcggcacggatctcgcccgcggcacgctgtggaccctggcccgtcgccagggggagcggcacgactcgttcaccgaggaggcccccggacgcatcctgcacgaactgcgtccggccgagacacggcacggggacggcatggtcctgccggcccgctactacggctccgtggacgcgacaccgctcttcgtcgtgctgctgcacgaagcctggaaatggggtcttcccgagaaagaactgaagctgctgctgccccacgcccgggccgccatgaaatgggtggagggcgccatgggcggcgaccacctgatccgctacggcaagggcagggccaacggcctgctccaccagggctggaaggactctcccgacgcggtccgcgacgccgagggacggcacatcgagccgcccatcgccctgtgcgaggtgcagggctacgcttaccaggcggcgatggcgtacagcgacatcctcaccgccctcggggacgggggcggtgaggccgagcggtggcaggagcgcgcctgccgactgcgcgccgccttccaccggtccttctggatcaccgagcccaagggccggcgctatccggccatcgccgtcgacgccgaagggcaccccgtcagcggactgacctccaacatggggcatctgctgaactccgggatcctcctcgacgacgaggaacgccggcaggtggccgaggccctcgtctcggaggaactgcggacgccctggggaatccgcacccgttccgctcggctgccggggttcaatcccttcagctatcacgggggttcggtctgggcgcacgactcggccatcgcggtccacgggctcgccaccgcggggttcgccgccgaggccgcggcgctgatcgacggcatgctcgacgcggccgcgcacttcgaccaccaactgcccgagctctacgccgcctacccctcaccccgcttcggccggccggccccgttcccgccgtcctgccgcccccaggcgtgggcagcggcctcggccacgctcctctgctccgcgatgctcggtctcgaagccgacgttccgcgccgccggctgacggtacggccgatcgcgccctcgctcatgggcctgaattccccctactctgttcgggggttgaggctcggtgcggacacggtggacgtccgcgtcgacacccacggcggcaccgaggtgctcggcatcgacggcaagcactggcacatcgccgcccccgccccctgcacgacc

SEQ ID NO: 1449 - DNA, 3033 bp, Streptomyces avermitilis
  CDS (1)..(3033)
ttgttgctctcatcgggggacggtgttggacggggggatcccatgcgccgtagtaaccgggtgcggcgacgcctggaccaggtactggtgttcacgggagcggcggtcgccgcgggggcgggaacaggggtcaagttcgtcgacggcggcgtccaagccctgctgatctgtctgctggccggcgggaccggcatcggcgcgtacgccgcgaactccctgcgcgcccgcgccggcgggcccccgccccatgtcctgatcagtcacccggacggcgacgaaccctgggcactctggctggcgtggcggctgcggcgcatcgggtatctgacctccacccggtcctgggcggccacggagcgtaccgtgccgcccccgccggaggtggccccggaccacgaactgatcatcctctcccgggcgttggacgacgcgggtcccgccacggaggagacccgtccgtcccgcacgcggggcaggaccgtcctggccctggcgaccacccaccgcgatcccgcgctgaccaggtgggcggggtacgaggtgctcagcctggcgggccgcaccgccgccgaggcagccgccaccgtcgacgcccggctgcaccacgccggtgcgggcccccggcccgactacaccgccccccacgtggccggcgaggccgaaccacgctacccgggcgaaggcgccctggtcaccaatctccagccgcgcggcgtctcgcacttcacggcccggcgtacggaactcgccctgctgcgggaggtcctgggcagggtgaacgtctccggcgacggacggatctgcgcgatccacggcctgagcggcatcggcaagaccagactcgcactggagtacgcccgccggtacgaggatctgttcgacgtcatctggatggtcgaggccagccatcccccgaccgcgcgggcgagcctcatcgccctggcccgcgcgctccaggaacggcgggagcggcagccgggtgcggtggcggcccaggaggaacgcgacccggagcagacgctgcgccgcctgctcctcaacgagctgcccaggaccaagtcactgctgatctacgacggggccgaggacgattcggccatccgcgagttactgcccgacgccaggaacggcggccaggtcctgatcacctcggtcagccccgcctggcagcggatcgccccgcatcgcatcgccctcgaggagttctccgccgaggaagcggtggccttcctgagggacgcgagcggtgtcgacgacgtgaccggcctggggcgcatcgtcgaacgtctggggcggttacccctcccgctcgaacacgccgccgcctatctgcgccagtcgcccgacatcgactcctatctgcgcgcgctggagctgccctccagcctgaccccgcccgcccgtgccgatgtgagcccgagcggcgccgaggcgtggatcctctccttcaaccaggtcgaagcgaaggacgaggtcgccggtctgctcctgcgtctgtgcgcgttcctggccccgcaaggcatccccagctacttcttcgacaacgcggcggaccgcaccgacctgctcccggcggcgctctgcgagagcgtgacggagccggcgcgttacctgcggatcacgggtaccgcgaagagctactccctgctgacgggtgagggccagctggtcatgcacaccagggtgcaggccgtcatccgcgaggcgatgacggcccacgagcgctcggtccacgcggccgacgcggcccgcctggtcaacgggtggttcccggaggatccggaccgtgtcaggacctggccccagtgcgtcgaactgctcccgcacgcccgcgtggtgctgggccactgccgggaccactcggtggtcgacgagaacaccgccaccctgttgcagagcgtgggtgagtacttccgggcgcagggcgaccacaacgaggcggagcggctcctgatggaagccctgcaccagcgggaacgcctcagagaccgctcgcacccgctggtcgccgacaccttgttctgcatcagccggctcaaggtgctgcgcgccgagttgccggaggcgcgggacttcgccgagcgcgccctcgacatccgcacccggctgctcggcgagggggacctccgcacactcgacagccggttgcaactgggcgaggtgctgcgcgaactgggtgacttcgcggcggcgtccgcggtcgtggaacagacgatccggcgcctgcgcagaaggggcgacgccgacccggtgaaggtggccgagagcctgcgcgacctgggtgtcgtccgctggcggcagggacggctcccggagtcgatcggccaccaccgagaggcgctccagttgctcgaacagaccccgggaggcggtgagcgggcccggcgtgacgacaccgcgtcggtgcacgaggcactggggctggccctgctcgactcccgtgatctggaagcggccgaacaccacctgaggaccgcgttggccgtcctcaaggacgcgaagtacgccgagggccaccccctcgtcctgtcctcctccgtccatctcggcgagaccctcaggcaacgggcgatgcggtatcgcgggcgcggcgaccagcgcgccggtgcccgggagcgttcgtccccgggggacctcgaggccgcgcgtctgctgggcgaggcgaagcggaccttcgaccgcgtactgtccgcaccgcatatgaacggggaccatccggaccgcgcctgcgccctcgtccgctacgcgcatctgctgctcgaccagggcaacagcgaagcggccatgacggaggtgacgaacgcgcaccggatctacaccgacaagtacggctcccggcatccctacgtggccgaggcctgctaccgcagggcactcatccacaagaagcggggacagttgcagaaggcgctcgaggatctcgaaacggggcgagagatctatctgggcgtgcaccccgccgatcatcccctgctgcggcaactggacgacgaactccaggatgtctccgccgccgcgaccggagaccatccg

SEQ ID NO: 1450 - DNA, 1197 bp, Streptomyces avermitilis
  CDS (1)..(1197)
gtgccgcaaataaacaaaacctgttcgcccagcgtcgtgccgaacaccgacctcacccggctccgcgtcgccctcaccgtcttcttcgccctggacggcttcgtcttcgccggctgggtcgtccggattccggccatcaaggagcagacgggcgcgtcggcgagcacactcggactcgcgctgctcggagtctcggccggtgcggtgatcaccatgatgctcaccggacgcctctgccgccgcttcggcagccacccggtgacggtggtctgcggcgtcctgctgtcggtgagcgtcgcgctgccgccgttgacgcactccgtaccggccctgggcgcggtgctcctggtcttcggagcggcgtacggcgggatcaacgtggcgttcaacagcgcggccgtcgatctggtgaccgcgctgcacaggcctgtgatgccgagcttccacgccgccttcagcctcggcgggatggtcggcgccgggctcggcggactggtcgccgcccatctgtcccccacccaccatctgctcgccctcaccatggtcggcctgctggtgacggcggtcgcggggcgcaccctgctccgtcacgagcccccggtgccgccggaccgcccgcgacaggaggaacacgcccggcggcctctcgacggccgtacgcgcggactggtcctcgtcttcggcctcatcgcgctctgcacggcgttcggggagggcgcgatggccgactggggcgccctgcacctggagcaggacctggacgcccacccgggcgtcgcggccgccggctactcctgcttcgccctcgccatgacggccggccggctgagcggaacggcactcctcgaacggctgggccggacccgcaccgtggtcgtgggcggcacgaccgccgcggccggcatgctcctcggcgcgctcgccccctcggtgtgggcggcactgctcggcttcgcggtcacggggctcggcctcgcgaacctgttcccggtcgccgtcgaacgcgccggcgcgctggcgggcccgagcggagtcgcgatcgcctccacgctcggatacggcggcatgctcctcgggccgcccgcgatcggcttcatggcggactggtactccctgccggcggcactcacgagcgtggcggcactcgcggcggtggccgcggcgatcggcttcgtgacacggcgtacgacggcagac

SEQ ID NO: 1451 - DNA, 1479 bp, Streptomyces avermitilis
  CDS (1)..(1479)
atgacctctccgctcaccacctccgtgtccgggggacgctggacccctcggctgtggggcaccctgctggtgctctgcgccgcgatgttcctggacgcgctggacgtgtcgatggtcggcgtcgccctgccgtccataggctccgaactcgacctctccacctcgacgctccaatggatcgtcagcggctacatcctgggatacggcggactgctcctcctcggcggacgcaccgccgacctgctgggccgccgccaggtcttcctggtggccctgggcgtcttcgcgctcgcctcgctgctcggcggcctcgtcgactcggggccgctgctgatcgccagccgcttcatcaagggcctgagcgccgcgttcaccgcgccggcgggcctgtcgatcatcaccacgaccttcgccgagggcccgctgcgcaatcgcgcgctctccatctacaccacctgcgcggccaccggcttctcgatgggtctcgtgctgtccggactgctcaccgaagccagctggcgcctcaccatgctgctgcccgcgcccatcgcggtgatcgcgctgctcgcgggtctgaagctgctccctcgcagcgaacgcgagaaggaccacaacggctatgacatccccggcgccatcctcggcaccgcgtcgatgctgctgctcgtcttcaccgtcgtggaggcccccgaggccggctgggcgtcggcccgcacgctgctctccttcctcgccgtcgccgccctgctcacggtcttcgtccgggtcgagcggcgatcaccgggtcccctgatccggctcggggtgctgcgctccggcagtcagatccgggcacagctgggcgcgatggcgttcttcggctcgtacgtcggtttccagttcctggtgacgctctacatgcagtcgttgctcggctggtcggcgctgcacaccgcgctcgccttcctgcccgccggcgcactggtcgcgctgtcctccacgaaggtcggggccgtcgtcgaccgcttcggcaccccgcgcctcatcgcggcgggcttcgcgctgatggtcgtcggatacgcgctgttcctgcgcatcagcctcgatccttcgtacgcggcggtcattctgccgacgatgctactgatcggcgcggcctgcgcgctggtcttcccctcgctcaacatccaggccaccaacggtgtggacgaccacgagcagggcatggtctccggcctgctcaacacctcggtgcaggtgggcggcgcgatcttcctggcggtcgtgacggccgtggtcacggcgaacgcgcccgagggctcctccccgcaggcggtgctggacagttaccgccccggtctgatcgtggtgaccgggatcgccctcgcgggcctgctgatcactctcacgggactgcggacgcggcgcacccaggcgtccgtcgtggtcgcggagtcaccccagaaggcgccggaggcggagcgcgtggcagtacacgac

SEQ ID NO: 1452 - DNA, 513 bp, Streptomyces avermitilis
  CDS (1)..(513)
gtggtgagcggagaggtcatagggaagacagtacatgcgcatgcattgaatgcaaatgcatttaattccgatgcaacaaactcgattttttgctaccgtgcgtccatggcggcgaagaaggccgagcaagtgctcgtggaccagtggcgcgggattctcgcggtgcatgcgcgtacgttgtgcgagctcgaccgcgagttgcacccgcatggtctgggcgccagtgacttcgaggtgctcgacgtgctggccgagggtgccgcgccggacggcggcagcggctaccgcgtgcaggagatcgccgaccgcgtccatctcagtcagagcgccctgtcccggctgatcggccgcctggagaaggacggcctcgtgacgcgcgggatgtgcccggaggaccggcgcggcgtgcaggtgtgcctcaccccgaagggccgcgccctgcgtgacgaggtgctgccggtgcagcgcgcggtgctgacgcggatgctggcgggcgacgcggccgagtgcggc

SEQ ID NO: 1453 - DNA, 663 bp, Streptomyces avermitilis
  CDS (1)..(663)
gtgatccgggtactgctcgccgacgaccagtcgctggtcagggcggggttcaaggcgctgctcgacgcacagccggacatcgacgtggccggcgaggccgccgacggcgaggaggccttgcgcaaggtgcgcgaactgcgcccggacgtcgtgctgatggacatccgcatgccgttcctcgacggcctggcggcgacccgccggatcaccgacgacgcggacctcgggcacgtcaaggtggtcatgctcaccaccttcgaactcgacgagtacgtcttcgaggcgatccgctccggtgcctccggcttcctcgtcaaggacaccgagccggacgaactcctgcgtgcggtaagggcggtggtccagggcgacgcactgctctcgcccggggtgacccggcggctgatctccgagttcgcggcccgctccaaggcgccggcggccgccgactccctcgccggactcaccgagcgggagcgggaggtgatggcgctggtcggtttcggtctgtccaacgacgagatcggccgccgcctggtcgtcagtcccctcaccgccaagacgcacgtcagccggacgatggtcaagctgggtgcccgcgaccgggcccaactcgtggtgctggcctacgagtcggggttggtgcggccgggctggctgggc

SEQ ID NO: 1454 - DNA, 1335 bp, Streptomyces avermitilis
  CDS (1)..(1335)
atggaggaacagcgcgcgaacgcccaggggtggcggcacggaccaccgtggtggcgccgctgggtcgacgaccggcgccagggccgtggccgcggtccccgtctgccgtggcgctcgacggcgctgctcaccgtcctggtactcgtcggctcggacttcgccgcgcacgtgcaggaggggggccgtgcgccgctggaccccttcgcgcgcgcactgctgctcctcggttcggccctcctgctgtggcggcatcgccatccggtgcccgtcgtcttcggtacggcggcggccgcgatgctgtatctgggtgccggatatgcgtacgggccggtgttcctcatcgtcgccgtcggctgctacagcgcggttgtcgccgggcaccgcagggccgcgtggaccgcggtcggcatgctctgggccggacatgtggtggtgtcgcactggctctaccggtggctgccgccctccggggacgcgcccgccccctgggggcaggagatcgtcatcgtcacctgggtggtggcgatcatggcggtgtcggagctggcacggctacgccgtgagcagtgggcccgcgaacgcgccgagcgggcacaggcggcccggcggcgcgccgacgaggagcggctgcggatcgcccgcgaactgcacgacgtcctcgcgcacagcatctcggtgatcaacgttcaggcgggcgtcggtctcgcgctgctcgactccgaccccgagcaggcgcgcacggcgctcaccatcatcaaggcggccggcaaggaggcgttgggagaggtgcggcacgtactcgacaccctgcgcacgcccgacgaagcgccgcgtgcgccggcgcccgggctcgaccggctgtcggaactggtcgagcaggcggcgagcgcggggttgacggtcgagatcgagggcgaggtgccgaagctcgcgcccggcaccgatctcgccgccttccggatcgtccaggaggcactgacgaacgtcgtacggcattcgggatcgcggcacgcgcgcgtgctgatcgacgacggccggggcgacaccggcggtgacctcccaggtgacgcgcgggccggcactcgggtcgacccccacgcgagcacgcagggcggcacccagggcgtactgcgtctccgtatcgacgacgacgggcccgcggccggcgtcgacgcgggcggcagtgggaacgggctcgccggaatgcgcgaacgggccgccgcgctgggtggcacgatcgaggcgggaccgcgcgccgacggcggtttccgggtgcttgccgtactgccgttcagggcgccgcccgaggagacccttcagatcaaggaggaccgg

SEQ ID NO: 1455 - DNA, 648 bp, Streptomyces avermitilis
  CDS (1)..(648)
atggccggagtcaaggagagtccccgagagcggtaccgggcccaggtgcgctcggagatcaaggaacgggcctgggagcagatcgccaccgcgggcgcgtcagggctgtccctgaacgcgatcgccaagcagctgggcatgagcggcccggcgctctaccgctacttcgccggccgcgacgaactgatcaccgagctgatccgggacgcctaccgcagcctcgcggacgccttccgcgccgccgccgagtcgggcgccgacctcgtaggactggcgcacgcgatgcgcgactgggcactcggcgacccccagcggtacttcctcgtctacggcacgcccgtacctggctatcacgcacccgaggacgtcaccgcgatcgcctcggagatcatgtcgaccctgctcgacgcgtgtgcggcggcgccgggcgcggccccgcacggcgacgcgttcgacgaacacctcgcggaccaccgcccatgggcggccgaccaccccgccccgcccgcggtcctgcacacggcgctggccttctggacccgtctgcacggcgtcctgtccctggaactcgccggccacttcacgggcatgggcttcgacccggccgcgctcttcgcagccgagatcgacgacctgtcggccacgcgg

SEQ ID NO: 1456 - DNA, 1041 bp, Streptomyces avermitilis
  CDS (1)..(1041)
atggaaggcgtcatcgcgagcagggaactcctcgaggtcgtgctgcccggcacggtggaaccggaggggcttcagctccggtaccgggcgctaccggccccggaagccgggcagatcctgatcgcgatggaggccaccggcgtctccttcgccgagcagcagatgcgccgcggccggtactacgaccagccgccgttccccttcgtcccgggctacgacctggtcggcaccgtgcgcgcggccggcagcggagtcactcccggcctggtcggcaagcgggtggccgccttgacgaaggtcggtggctgggccagtcatgtggtgatcgacgcggcggacgcggtggaggtgcccgccggcgtcggggcggctgaggcggagacactggtggtcaacggaatcaccgcgtggcagatgctccaccgcaaagcccgggtgcgcgccgggcagacagtcctcgtccatggagccaacggcggcgtgggcacggtcctcgtgcagctcgcgcgcgccgcgggcgtgaaggtgatcggcacggcgtccgcgcgccatcacgacgccctgcgtgaactgggcgtgaccccggtcgactaccgcaccgaggacgtccccggccgggtccgcgaactggctccgaacggggtggacgccgtgttcgaccacgtcggcggacggagcgtgatcgactcctggcggctgctcgcaccgggcggcaccctcgtctcctacggcagcgccgccacccgggacgacacgggctccaagcagtggcccgtactgaagatcctcggccgggtgtggctgtggaacaccctgccgaacggccgtcgcgcgtacttcttcaacgtctgggcgggccgcgccctgagcaagaaccgcttccgcgcccggctgcgcgccgacctcaccgaggtgttcgcggccctccagcgcgacgaggtcaccgccaggatcgccgccaggctcccgctcgcgcgcgtcgccgaagcgatgcggctggcggagtcggggacggtcgccggcaaggtcgtgctgatcccg

SEQ ID NO: 1457 - DNA, 732 bp, Streptomyces avermitilis
  CDS (1)..(732)
atgagcaccgcacgaggagcccgcgcccgagcccggaccgaagtgaccgccgcgatcaaggacgaggcgcgcagacaactcgctgcggaaggcgccgccaggctctcgctgcgggccgtcgcccgcgagctaggcatggtctcctccgcgttgtaccgctacttccccagccgcgacgacctgttgaccgccctcatcatcgacgcctacgactccctcggtgagaccgccgaggcggcgcacgccaagggttccgacgcggcgaaccatgcccagcggtgggtcgccgtgtgcgaggcggtgcgcggttgggcgctggctcatccgcacgagtacgcgctgatctacggttcgccggtgcccggttacgtagcgcccgacaccaccgtgccggccgcgtcccgcgtcggcctggttctcatgggcatcgtccgcgacgcgcaccagggacccggtgtcgtcggctcgcggctgcccgccgaactcgagcccgaggcccggcggatggccgccgatctcgcgccggaccttccgccggcgacggtcgtggcgctcgtcgcggcctgggcgaagctcttcgggctggtcggcttcgagctgttcggccagttccaccggttggtcgaggaccgtgagccgttcttccggcacgccgccgcccagctcgcccacgacgtgggtctggtcttcaccgggccgaccccgccgcgcggcgggagtaagcaggggccc

SEQ ID NO: 1458 - DNA, 549 bp, Streptomyces avermitilis
  CDS (1)..(549)
gtgcccataactgagagcactgctcttgctttggagcgccgatctcatgcacactcctctcaagcgagagcaccgctctccaaagcgtcgggagtcagcatgtcgtcgtccccgtactacctccagggcagccggttcaccatccgcatgaacggcgtcatcggctggctcgcccgccgcggattcagcctcaagggcacggccgagctctcggtgcgcggccgcaagagcgggcagcagcagcgcatccccgtcaacccgcacccgtacgagggcgccgaatacctggtctcggcccgcggccactcccagtgggtgcgcaacatgcgcgtcgcgggaggcggtgagctgcgggtcggccgcacggtgcgcgcgttcaccgcggtggaacttcccgacgaggagaagctccccgtcctgcgggcctacctcgagaagtggggctgggaggtcaaccagtacttcaagggcgtgacggccaagtcaaccgacgaggagctgatcgcggccgcccccgaccacccggtgttccggatcacggtcaagccg

SEQ ID NO: 1459 - DNA, 1203 bp, Streptomyces avermitilis
  CDS (1)..(1203)
gtgagcagcgagaactcttcgacggacgacgcgcagcaggtttgggatgtcgtcgtggtcggcgcggggcccgcgggcgcctcggccgcctatgcggcagcggtcgcgggacgcagtgtcctgctcctcgagaaggcggagctgccccgttacaagacgtgcggcggcggcatcatcggcccttcgcgtgacgcgttgccacccggcttcgagctgcccttccaggaccgggtgcacgcggtcacgttctcgaacaacggccggttcacgcgcacccgtcgctccaagcagatgctgttcggcctgatcaaccggcccgagttcgaccagcagctcgtcgagcacgcacagaaggcgggcgccgaactccgtacgggtgtcacggtctcgcgggtcgagcagcacgggtccgccgtaccggaccgccgcacggtcgccgtcgtccttcagggcggcgattccctgctcgcgcgggccgtcgtcggggcggacggcagcgccagccggataggcgcgcatgtcggtgtgaagctcgaccaggtcgacctcggcctggaggtggagatcccggtgccggagaccgtcgccgaggattggcaggggcgggtcctgatcgactgggggccgatgcccggcagttacggctgggtgttccccaagggggacacgctcaccgtcggtgtgatctcggcgcgaggtgaaggtgccgccaccaagcggtacttggaggacttcatcgcccggctcggcctcgccggtttcgaaccgagcatctcctcaggtcacttgacccgctgccgtgccgacgactcgccgctgtcgcgcgggcgggtgctggtgtgcggtgacgcggccgggctcctcgagccgtggacccgggagggcatctccttcgcgctgcggtcgggacggctggcgggggagtgggcggtccgtatcgccgaggcccacgacgccgtggacacgcggcgccaggccctgaactacgccttcgcgatcaaggcggggctgggcgtcgaaatgagcgtcggcaagcgcatgctcacggcgttcgagcgccgtcccggcatgttccacgcggcgctcaccggcttcaggcccgcctggaaggcgttcgcgcagatcacccggggtgccacctcgctcggcgaactcgtccgcagccacccgatggcggggcgtgtcctgacctcgctggatcgg

SEQ ID NO: 1460 - DNA, 1353 bp, Streptomyces avermitilis
  CDS (1)..(1353)
atgtcgtcgaatccggtcgccgagaccgtcgcctccctgatgccgcgggcgaaagcggagctcaccgagctggtggccttcaagtcggtggcggacttcgaccagttcccgaagagccagagcgagggtgccgccaagtgggtcgcggaggcgctgcgcgacgagggcttccaggacgtggcactgctcgacaccccggacggcacacagtcggtgtacgggttcctgcccggcccggcgggcgcgaagaccgtgctgctgtacgcgcactacgacgtgcagccgccgctggacgagacggcctgggtcagcccgcccttcgagctgaccgagcgcgacggccgctggtacgggcgcggttccgccgactgcaagggcggcgtcgtcatgcacctgctggccctgcgtgcgctcaaagcgaacggtggcgttccggtgaacgtcaaggtgatcgccgagggctcggaggagcagggtaccggtggtctcgagcggtacgccgagcagcaccccgagttgctgaccgccgacgccatcgtcatcggcgacgcgggcaacttccgggtgggtcagccgacggtcacgtcgacgctgcgcggtatgacgctcgtccgcgtgaaggtcgacacgctcgcaggcaacctgcactcggggcagttcggcggcgcggcgcccgatgcgctgggcgcgctgatccgcgtactggactcgctgcgggctgaggacggatcgaccaccgtcgacgggctgaccggcgacgcccggtgggaggggctgcggtacgaggaggagcagttccgcaaggacgccaaggtgctcgacggcgtggagctgatcggttccggcgccgtcgccgaccgcatctgggcgcgtccggccgtcaccgtgctcggcatcgactgcccgccggtcgtcggggcgaccccgtccgtgcaggccggcgcccgggcgctggtgagtcttcgggtgccgccgggcgtggacgcggccgaggcggccaagctgctccaggcccacctggaggcgcacacaccgtggggcgcgcgggtgagcacggagcagatcggccagggccaggcgttccgtgcggacaccaccagcccggcgtacgcggcgatggccgaggcgatgtcggtcgcctacccgggccaggagatgcagtacgcgggccagggcggctccatcccgctgtgcaacacgctcgcctccctgtacccgcaggcggagatcctgctgatcggcctgagcgagccggaggcgcagatccacgccgtgaacgagagcgtgtctccggaggagctggagcggctctcggtggcggaggccctgttcctgcgcaactacgcggcggtc

SEQ ID NO: 1461 - DNA, 747 bp, Streptomyces avermitilis
  CDS (1)..(747)
atggccctctacgttcgcctcatgcaggtcatcgaagtcctctcggggcgtaccgcactccatctgctgcgcttcgccgtcggccaggcgtatctctggtgcgacggcgacgagtcgacgctgatcgatgcgggtgcggtcggctcggccgcctcgatcgtccaggcgctcaccggcatcgggcgtcgccccgaggacgtacgacgcatcgtgctgacccacttccacgaggaccacgcgggcggggcgggcgagttcgcggcgttgagcggcgctcgtgtgtcggcccaccggctggacgcgccggtcgtacggggcgagctccccggaccgccgccggtgttcgaggactgggagcgaccgatccatgccggggtgagcaagctcctgccggagcggtcccccgaccaggtgcggcccgaggccgtcgccgaactgtccgacggcgatgtcctggacttcggcggtggcgcacgcgtcgtccacgccccggggcacacggccgggagtgtcgccttccatctccccgagcacggcgtgctgttcacgggagacgccgtcgcggcctcgcccgtcgacggccgcgtcatgctcggcgtgttcaacgtcgaccgggcccaggccgtcgactcgttccgccgactggcatcactcgacgcggacatcgcctgcttcggccacggcggtccggtggtcggcgctgccgctggggcgctgcgcgcgtcggcgcggacgtacgacgaggtg

SEQ ID NO: 1462 - DNA, 1038 bp, Streptomyces avermitilis
  CDS (1)..(1038)
gtgatcgtctggatcaacggtgcgttcggtgcggggaagaccaccaccgcacgggaactgatcgaactgatcccgaacagcgcgctcttcgaccccgaggtcatcggcggcgcactcacgcacctgctgccgcccaaacgcctcgccgaggtcggcgacttccaggacctgccgatctggcgacggctcgtggtcgacaccgcggccgcgatgctcgccgatctcggtggtgtcctggtggttccgatgaccctgctgcgacaggagtaccgcgacgagatcttcggtggcctcgcctcccggcgcattcccgtacgccatgtcctcctcgccccggcggaaacgatcctgcgggagcgaatagccgagcgggagatccccgcagacctggctgacggcgagatgcgggtacggcagtggtcgtacgaccacatcgagccctaccgggccgccctcgccgcctggctcaccgccgacgcccaccccgtcgacaccagcgccctcaccccgtacgagaccgccctgcggatcgccgaggccgtgcgcaccggggacgcgcccgcgtgcgacatcgtgcagacccccgagccgaccgccgagaccctcgccgcgggtgtgctcctcttcgacgaacaggaccgggtactgctcgtcgaccccacctacaaagccggctgggagttccccggaggtgtcgtcgaacccggcgaggcgcccgcacgggccggcatgcgcgaggtcgccgaggagaccggcatccggctcgacgaggtaccccggctcctcgtcgtcgactgggaagcgcctgtgccgccgggctacggcggactgcgcttcctcttcgacggagggctcctcgacagccatgaggccggacgcctggtgctgcccgggcccgaactgcgcgactggcgcttcgtcaccgaggaggaggcggccgggctgctgccgcccgtgcggtacgaacggctccgctgggcgctgcgcgcacgcgagcgcggtgcggcgctgtatctggaggccgggatcccgctcggc

SEQ ID NO: 1463 - DNA, 192 bp, Streptomyces avermitilis
  CDS (1)..(192)
atgaagaagcgcagcatgctcgccatcgcctccctcgccgccgggttcgtcgtcgccgcagtcactccgtcccacgccgtggacggcgacgtaatcggtgatctgaacgtcaacgacacgatcagcaccgtcgaccacaccatcaacagcgacagcctggccgtggacgacaacgccctgggacggaaaggc

SEQ ID NO: 1464 - DNA, 2046 bp, Streptomyces avermitilis
  CDS (1)..(2046)
atgcgtcacccctacgcccgcacaacccgcacaacccgcacaacccgcacaacccgccgaagagtcgtcggagcgctcaccgcaggactgttgtgtacggccgggctcgcggcgccggccctcgccgctcccgccgccggtccggtctcgccccggccggccgacagcctcgccctcaccccgccgatgggcttcaacaactggaactccacgggatgccgaccggagttcaacgaggacatggtcaaggggacagccgacatcttcgtcgagaagggtctcaaggacgccgggtaccagtacgtcaacctggacgattgctgggccctgccggcccgggactcgaacggcaagttggtgccggatcccgctcgattcccgggtggaatcaaggcggttgccgactatgtgcactccaaagggctcaagctcggcatctacaccagcgcgggcaccaagacatgcaacgaagccggtttcccgggcgcgctgggccacgagtacagcgacgcccaacagttcgcggactggggcgtcgactacctcaagtacgacaactgcaacaaccagggtgtcgacgcgaagctccgctacaccacgatgcgtgacgcgctgaaggccacggggcgccccatcgtctacagcctctgcgagtggggcgagaacaagccctgggagtgggcgtcggacgtcggacagctgtggcgtacgaccggggacatcagcgacagttggggctcgatgctgtcgatcctcaagcagaatctgcccctcgcgccgtacgccggtcccggccactggaacgacccggacatgctggaggtcggcaacagcggcatgaccgacaccgagtaccgcacccacttctcgatgtggtcgatcatggccgcgccgctgctcatcggctcggacctgcgcaaggcgtccgccgcgaccttcgacatcctcgacaacaaggaggtcatcgccgtcgaccaggacccgctgggcaagcagggcacggtgctctcctccgagggcggacgctgggccgtcaccaaggagatgaaggacggcagccgggcggtggccctcttcaacgagacggacagcgcacagcggatcaccaccaccgcgcaggccgtaggactgccgaaggcacacgcgtacacgctgcgcgatctgtggcagcacaggagctacaacaccgccggcacgatctcggcgaccgtcccggcgcacgggacggtcctcgtacgggtctcggccgacgccgcatgggccaagaacccgcccgccgtcgaactgggcgtggacggcagcccgttgctggaggcgggcaggacggtcgccctgacctcggcgctcaccgacctcggccgtacgcccgcgaagcgtgtctccgtgacactgagcgggccccgggggtggcgggtgagggcgacctcgccgaccaccgcgggcacggtgccgacaggccgttcgctgcgcacgaagtggaaggtcaccgcgcccgacggcacggccgccggctcgtacgacctgacgctgaaggcgacctaccgctcgccgacgggggtacgcgccgagaccctggtgccgctcgcggcgtccgtggtgccggccccgccctcgggcgtctcctacctcggggacctgccctggatgtcgacgaccaacggctggggcccggtggagcgcaacaccagcaacggtgagagcgccgccggcgacggtcgtccgatcactgtcgacggcgtcgtccacgccaaggggatcggtgtgcacgccgagagcaccatcgcgtactacaccggcaggtcgtgcgagacagtcaccgcggacgtgggggtcgacgacgagcaggacaccaatggcagcgtcaccttcgagatctgggcggacggcaccagagtcgcctcgaccggggtcctgaccaccgcgatgccggcgcgaccgctctcggccgatgtgaccggcgcccaggtggtccggctggtcgtcaccgacggcggcaacggcatcacctcggaccacgcggactgggcggacgccaagctcagctgc

SEQ ID NO: 1465 - DNA, 957 bp, Streptomyces avermitilis
  CDS (1)..(957)
atgcacaccgacctcgtggccgcgctcgacatcggcggcaccaagatcgccggagcgctggtggacggccacggccggatcctgttgcgtgcccagcgcgccacgcccgcgcaggaggacggcgacaccgtgatgggtgccgtcgaggacgtcataggcgagttgaccggctcctcgctgtggggcggggcgacggccgtcggcatcggcagcgcgggccccgtggacgcctccgcgggcacggtgagccccgtgaacgtgccggggtggcgcgactacccgctggtcgagcgggtccgcaaggccacggcggggctgcccgtcgagctgatcggcgacggtgtggcgatcacggcggccgagcactggcagggcgcggctcgcggccacgacaacgcgctgtgcatggtcgtgtccaccggcgtcggcggtggcctggtcctcggcgggcagttgcactcgggccccaccggcaacgcgggccacatcgggcacatcagcgtggacctcgacggcgacctgtgcccatgcggttcccgcggctgcgtggagcgcatcgcgagcggacccaacatcgcgcgccgcgcgctggagggcggctggcagccgggccccgacggtgacacctcggccgccgcggtggccgccgccgcgcgggcgggcgacccggtggccgtggcctccttcgagcgggcggcccaggcgctggccgcggggatcgccgcgaccgcgaccctcgtcgaggtcgacatcgccgtcatcggcgggggagtgggcaaggcgggggatgtcctcttcacgccgctgcgggccgcgctgcgggactacgccaccctgtcgttcgtgcagcggctgaccgtgacgcccgcgcagatgggcacggacgccggtctggtcggcgccgcggcggccgcgctcagcaggaagccgagcgcgaccgccgtcggggtgagcggc

SEQ ID NO: 1466 - DNA, 1035 bp, Streptomyces avermitilis
  CDS (1)..(1035)
gtggcagagaccgcccgcagagccgagaaccgctacggcaaccgtccgaccatgaaggacgtggcggcgcgtgccggtgtcggcctgaagacggtctcccgcgtagtcaacggcgagccgggcgtcacccccgacacggagcgccgcgtccaggaggcgatcgacgcgctgggcttccgccgcaacgacagcgcgcgggtgctgcgcaagggcagcaccgcgagcatcggcctggtcctggaggatctcgccgaccctttctacggccctctcagtcgcgcggtcgaggaggtcgcccgggcccacggcgccctgttgatcaacggttccagcgccgaggacccggaccgcgagcaggagctggcgctggccctgtgcgcacggcgcgtggacgggctcgtcgtcatccccgccggtgacgaccaccgctatctggagcccgagataaaggcgggcgtcgccacggtgttcgtggaccgccccgccggacgcatcgacgccgacgccgtactgtcggacagcttcggcggtgcccgcgccggcgtcgcccatctcatcggccacggccaccgccggatcggcttcatcggtgacatgccccgcatccacaccgccgtcgagcggctgcgcggctaccgggccgcgatggaggacgcgggcataccggtcgaggactcctggatgtccctgggcgtcaccgatcccgagcgggtgcgccgggccgccgagaagatgctgtcgggcccctcccccgtcaccgcggtcttcgcgggcaacaaccgcgtgaccgtcaccgtcgtacgtgtcctcgccgagcacggccgccgcatcgccctcgtcggcttcgacgacttcgaactcgccgacctcctccagccgggcgtcacggtcgtcgcgcaggacgcggccgccctcggccgtacggccgccgagcgcctgttccggcagctggacggctcgctcgtcactcccgagcgcatcgagctcccgacccggctgatcacccgcggctcgggcgagctcccgccggcggac

SEQ ID NO: 1467 - DNA, 1317 bp, Streptomyces avermitilis
  CDS (1)..(1317)
atgggagggtgtgggatgggtcagggccagcaggagaaggtggcgacgagcctcgcgggcgccgtcagcgagggaatcagcgccaccctcgccccggtcgacgcggaactggagcgccgctacccgggagaccccggcacccgccagcccgtccacacggtgtacgtacccggtgacgtgttcgccgccgacaccatccgctcctggggcgaccgcgccctcgccgcgctcgacgaacacgccccggacgccgcctccttcgccaccgcactcggcctcgccgaggagctcgccgcgccggtctacgaccgcgtacgcgccaagctggaacgtgagcccatcgaggacctgcgtgtcgacttcgaggacggctacggcccgcgccccgacgccgaggaggacgaggccgccgcgcgtgcggcccggctgatcgccgaggcgtaccggaacggcacggcggccccgtacatggggatccgcatgaagtgcatggaggcgccggtacgcgaccggggcattcgtacgctcgacgtcttcctgacggggctgatggaagcgggcggtctgcccgacgggctggtcctgacgctgccgaaggtgacgtacgccgagcaggtcaccgcgatggtccggctcctcgaggccttcgagaaggcccgcggtctcgaaccgggacggctcgggttcgagatccagatcgagaccagccagtccatcctcgccaccgacggcaccgcgaccgtggcccggatgatccaggccgccgagggccgcgccaccggactgcactacggcaccttcgactacagcgcctgcctcggcgtcagcgccgcctaccaggccagcgaccacccggccgccgaccacgccaaggcgatcatgcaggtcgcggccgccggtaccggggtgcgcgtctgtgacggctccaccaacgtccttccggtcggcccgaccgagcaggtccacgacgcctggcggctgcactacgggctcacgcggcgggctctggcccgcgcctactaccagggctgggacatgcatccgggccacatcccgacccggtacgcggccgtgttcgcgttctaccgcgagggcttcgagcaggcggcggcacggctctcgcggtacgccgaccgcgcgggcggagacgtcatggacgagcccgcgaccgccaaggcgctcagcggctatctgctgcgcggcctggactgcggcgccctcgacgtcgcggaggtcgccgaggcgaccggtctgacccggaccgacctggagggcttcgcggggcccaggcggggcgacctgacggcgtccgcgaag

SEQ ID NO: 1468 - DNA, 909 bp, Streptomyces avermitilis
  CDS (1)..(909)
gtgaccgaaggaggacgcgtgtcgaacaccagccgagtgacccgccgcacggggctcagaaccgcggcggccgtcgcggcggccttacccctgctcagtgcctcgcccgcctccgcctcgcggaaccgaggccgccgcctggacgtgatgacgttcaacctgcgcttcgcgagcgcctcggaaccccacagctgggccgttcgccgccccgtcatgcgcgagctgctgcgccgggagcggccccacgtcatcggcacccaggaggggctctaccagcaggtgcgtgacatcgaggccgacctgggcccgcactacgactggatcggcacgggccgcgcgggcggcagccgcgacgagttcatggcggtcttctacgacacccgcaggctcgccccgctggagtacgaccacttctggctctccgacacccctgacgtgatcggttcgaacacctggggcggcggctccatccgcatggtcacccgggtccgcttccgcgatctggcggacggcgaccggccgttccatttcctcaacacccacctggacaacgcgagtcagtacgcacgcgcgcgtgccgccgccctgatcgccgaccggatcgcgggcctcgaccgctcccagccgctcgtggtgaccggcgacttcaacgccgccgcgcacaagaacgcggtctacgagacgatgctgggcgccggactcgtggacacctgggacacggccgccgaacgcggcaagctgtacgggacgttccacggctacaagccgctggtgccggacggcgaccgcatcgactggatcctggcctcgcccggagtggccgcgcactgcgcgtcgatcaacgcgttctcgtcgaacggtcagttccccagcgaccatctgcccgtgcaggcgtccctgcgcctggcc

SEQ ID NO: 1469 - DNA, 960 bp, Streptomyces avermitilis
  CDS (1)..(960)
atggctgaagttctcgtctacgtcgaccacgtggacggtgccgtccgcaagcccaccctggagcttttgacgctggcccgccgcatcggcgagccggtcgccctcgccctcggctccggcgcggagaacaccgccgccgcgctcgccgagcacggtgcgggcaaggtcctcacgcacgatgccgccgagtacgccgactacctggtcgtaccgaaggtggacgcgctccaggccgcctacgaggccgtgtccccggccgccgtgctgatcccgtcgtccgccgagggcaaggagatcgccgcccgcctcgcggtgcgcatcggctccggcatcatcaccgacgccgtcgacctggaggccggtgacgagggtccggtggccacgcagtcggcgttcgccgcctcgttcaccaccaagtcccgtgtctccaagggcaccccggtcatcacggtcaagccgaactcggctcccgtggaggccgccccggccgccggcgccgtcgaggccctgtcggtctcgttctcggacaaggcgaccggcaccaaggtcaccggccgtaccccgcgcgagtcgaccggccgcccggagctgaccgaggccgcgatcgtggtctccggcggccgcggtgtcaacggcgccgagaacttcgcgatcatcgaggcgctcgccgactccctcggcgccgctgtcggtgcctcgcgtgccgcggtggacgccggctggtacccgcactccaaccaggtcggccagaccggtaaggccgtctcgccgcagctgtacatcgcctccggcatctcgggcgcgatccagcaccgcgccggtatgcagacctcgaagacgatcgtggcgatcaacaaggacgccgaggccccgatcttcgacctggtcgactacggcgtggtcggcgacctcttcgatgtcgtcccgcagctcaccgacgaggtcaagacccgcaagggc

SEQ ID NO: 1470 - DNA, 792 bp, Streptomyces avermitilis
  CDS (1)..(792)
gtgagcttgaggatcgttgtcactgtgaagtacgtgcccgacgccactggcgaccggcacttcgcggaggacctgaccgtcgaccgggacgacgtggacggtctgctctcggagctcgacgaatacgcggtggagcaggcgctgcagatcgccgacgacgccgacgacgccgacgacgccgagatcaccgttctcacggtcggccccgaggacgcgaaggacgcgctgcgcaaggcgctttcgatgggtgccgacaaggcgatccacgtcgaggacgacgacctgcacggcaccgacgtgatcggtacgtcgctggtgctggcgaaggcgatcgagaaggccggctacgacctggtgatctccggcatggcgtcgaccgacggcacggcgggcgtggtgccggcgctgctggccgagcgtctgggtgtcccgcaggtgaccctgctgtccgaggtgtcggtcgaggacggtgtcgtgaagggccgccgggacggcgactccgcctccgagcagctggaggcctccctccccgccgtcgtgtcggtcaccgaccagtcgggtgaggcgcgttacccgtccttcaagggcatcatggcggccaagaagaagccggtggagtcctgggacctgtccgacctcgacctcgaggcggaggaggtcggcctggagggtgcctggaccaaggtcgactccgcgaccgagcgtccggcgcgcaccgccggcacgatcgtcaaggacgagggcgagggcggcaagcagctcgctgagttcctcgcgggccagaagttcatc

SEQ ID NO: 1471 - DNA, 504 bp, Streptomyces avermitilis
  CDS (1)..(504)
atgacggccacgcccgacctcggcacccagctcgcctcccccgacctgctgcgctccgtcttccgccgccacgcggccggagtcgccgtcatcacggcccggggcgatgggggccccgtcggcttcaccgccacctcgctcacctcggtctccgccgagcccccactcgtctcgttcggcatcggcgtcggcgcgtccagctggcccgcgatctccgagaccgcccacgtcggcgtccacatactcggcgagcaccagcaggaactggccggtgtcttcgccaagagcggcgccgaccgcttcggcgcgtccacgggctggcgcgagggcccggaaggcgtacccgtgctcgacgacgtgctcgcctggctggtgtgcagggtcgtggcacgcgttcccgcgggcgaccaccgcatcgtcctcgcggaggtcgtcctgggtgacccgacaggcgccggacggccgctcctctatcaccaggggcgcttcagcggcctccgtgac

SEQ ID NO: 1472 - DNA, 411 bp, Streptomyces avermitilis
  CDS (1)..(411)
atgaccggacttgtggtgtgcgtggtggtgctcgtggtggcgagcgcgtacggagtgctgcatcggcggcggagcgggagagtgagagtgcgcgggcgcgacggcggaaagcacctcggcgcggcggagttgggggaggggctcggcgaacgggccacactcgtccagttctccagcgccttctgcgcgccgtgccgggccacccggcgggtcctcacggaggtggccgggctggttcccggggtcacccatgtggagatcgacgccgaggaccggctcgaactcgtccgcgaactcgacatcatcaagacgccgacggtgctcgtcctcgacgcggaggggcggatcgtgcggcgcgcaacggggcagccccgcaaggcggatgtcatcgccgcgctgggagaggcggtc

SEQ ID NO: 1473 - DNA, 414 bp, Streptomyces avermitilis
  CDS (1)..(414)
atggacattgatgtgagggggccgcgcttcggggcggccgtgacgaccgtcgtgctggcggtggtgctgatcaccggcagcgcctggctgctggcctggcagacgctggccttcgcgctgggcgcggcgggcggtgccgggcgctcgccgtacgggtggctgttccggaaggtcgtgcgcccccgcttggggccgccgacggagttcgaggcgcccgatccgccgcggttcgcgcagacggtcgggctcggcttcgccgccgtgggtctcgtcggctacacggtggggccgccgtggctgggcctcgccgcgacgggatgcgcgctcgcggccgccttcctcaatgccgcgttcgggtactgcctcggctgcgagctttacctgctggtgcgcagggtgacggtgcgagcggag

SEQ ID NO: 1474 - DNA, 726 bp, Streptomyces avermitilis
  CDS (1)..(726)
atggcagagcttgtctaccgtcccgtcgtcggtctcgcccaaacgttgttcaaggcctgggacctcaagatcgactgcaagggatcggagaacattccgcgctcgggcggcgccgtgctggtcagcaaccacatcagctatctggacttcatcttcgacggcctggccgccctgccgcagaagcgtctggtgcgtttcatggcgaaggagtcggtcttccggcacaagatctccggtccgctgatgcggggcatgaagcacatcccggtggaccgcaagcagggtgagacggcgtaccagcacgcgctggactcgctgcgctccggcgagatcgtcggtgtcttccccgaggcgaccatctcgcagtcgttcaccctcaagagcttcaagtcgggtgccgcgcgcatggcccaggaggccggcgtcccgctgatcccgatggccctgtggggcacccagcgcctgtggaccaagggccacccgaagaacttcaagcgcagccacacccccatcacgatccgggtcggggagccggtcgaggctccgaccgaccagtacgcgggcgcgatcacgcggcggctgcgcgagcgggtccaggagctgctggaggccgctcagcgcgcctatcccgtacgccccaagggtccggacgacacctggtggatgccggcccatctcggcggcacggcaccgacccccgaagaggtgaaggcggccgaggcccgc

SEQ ID NO: 1475 - DNA, 690 bp, Streptomyces avermitilis
  CDS (1)..(690)
atgacgctcacgctcaccgtgtccgacgaggtgcgcgccctcgcacccggcttcacccatgtcgccgtcgaggcgcacggactgctcaacgggcccagtaacgaaggtactgcggcactcctcgaggacgcggcgcgtcggctcgccgtacgcctcgacggtcgcgccccgcacgaggacccgcacatggcggcctggcgtgaggtgtacacggcgttcggctccaagccgtcgcgcacccgcaactccgccgaggcgctggcgaagcgggccctcgccgatgccggactgccccgtatcaacatgctcgtcgacctctacaacgcggtcagcgtcgcccatctgatcccggtcggcggtgaggacctcgaccgcgtccagggcggaatgcgtcttgtgcgggccacgggcgacgaggagttcgtgacggtggccgcgggtgaggaggccgtcgaacaccccgacgccggtgaggtcgtgtggtgcgacgacgccggtgtcacctgccgccgctggaactggcgccagggaccgcggacccggctcacggaggagtcggcctcggcggtcttcctgctggagagtctcgcccccatgccggtggcccacctcgaggcggcggctgccgagctcgcggaactgctcgagaagttcagcccgggggcgcggatcaccgtccgcgccccggtg

SEQ ID NO: 1476 - DNA, 597 bp, Streptomyces avermitilis
  CDS (1)..(597)
gtggtcgcatttctatgctctgcgggtatggagctgacgcaggagaccccggacctgtccgcctacttggccgctggcgaggtcatcgatcatcaccatccgcgggtgcgggagacggctgcgcgcttggccgagcaggccgtggactcgtatgcctatgcgcgatcggcgtacgaattcgtacgggacgccatcccgcactcggcggactccggagacctgcgcgtcacctggcgcgcctccgacgtcctggccgagggcaccggaatctgtcacgccaaggcccacgcgctggccgcgctgctgcgggccgaggacatccccacggcgctctgctaccagaagctcgacctggtgcacgggctggtcgccgtgcggttcgacggcgcgtggcaccggcaggatccccgcggaaacaagccgggggtcgacgcccggttctcgctcgacggggagcggctggccttcactcccgatcccgagtccaatgagttggactatccagttctgtatgctgaacctcatccggcggttctgggcgctctccaagccgcgcacgaccggccgcacctgtggaagacgctccccaccgcactc

SEQ ID NO: 1477 - DNA, 1068 bp, Streptomyces avermitilis
  CDS (1)..(1068)
gtgaaccctcctaagaccgacgcccggcggcatcacgacccggaggtacgtggcttcgccagcgacaactacgcgggggcccaccccgaggtgctcgccgccctggccctggccaacggcgggcaccagatcgcgtacggcgaggacgagtacacggacaacctccagcgcatcgtccgcagccacttcggcgccggcgccgaggcgttccccgtcttcaacggcaccggcgcaaacgtcgtcgccctccaggcggtcaccgaccgctggggcgcggtgatctgcgcggagagcgcgcacatcaacgtggacgagggcggcgcccccgagcgcatgggcggcctcaaactcctcaccgtgcccacgcccgacggcaagctcacgcccgagctgatcgaccggcaggcgtacggctgggacgacgagcaccgtgcgatgccgcaggtcgtctcgatcgcccagaacaccgaactgggcaccgtctacacgcccgacgagatccgcgcgatctgcgaccacgcccacgggcacggcatgaaggtgcacctcgacggcgcccggatagccaacgcggccgcctcgctgaacgtccccatgcggacgttcaccaacgcggtcggcgtcgacatcctctccctgggcgggacgaagaacggcgcgctgttcggcgaggccgtcgtggtcatcaaccaggacgccgtcagccacatgaagcacctgcgcaagctgtccatgcagctggcctcgaagatgcgtttcgtctcggtgcagctggaggcgctgctcgccaaggatctgtggctgcgcaacgcccggcacgccaacgagatggcccagcggctcgcggagggcgtgcgcgcggtccacggcgtggagatcctctacccggtgcaggccaacgcggtcttcgcgcgtctcccgcacgacgtgagtgagcgcctgcagaagcactaccgcttctacttctggaacgaggccgcgggcgacgtccgctggatgtgcgccttcgacacgaccgaggacgacgtcgacggattcgtggcggcgctcaaggaggagatggcccgg

SEQ ID NO: 1478 - DNA, 744 bp, Streptomyces avermitilis
  CDS (1)..(744)
atgaggaacggtgctctcagcggtgcggtgatcgcggtggccggcgcgggcggacccgccggacgcgcgacactcgtccggctcgccgacgcgggcgcgaccgtcgtcggctccgacaacgaccccgagcggctcgcggaagccgtcgacgcggcccgctacgggcacggcggcgccaccgtcgtcggggacacggtcgacctgttcgacctggagtcgacccgggactgggccacgcgcatcgagaaggacttcggccgcgtcgacggcctggtccatctcgtcggcggctggcgcggcagcgagaccttcaccaagacgatcctggacgactgggacttcctcgagctgctgctcatccgcaccgtgcagcacacctccctcgcgttccacgaggccttgcagcgcagcgaccgtggccggtacctcctgatcagcgcctcgagcgcgagcaggcccaccgcgggcaatgccgcctacgcctccgccaaggccgccgccgaggcgtggacgctggcccttgccgactacttccgcaaggcgggcggcgagagcgggccgacgtccgcggctgccgtcctggtggtcaaggcactggtgcacgacgcgatgcgcgccgagcgccccaatgcgaagttcgcgggcttcaccgacgtcaaggagctggccgaggccatcgccggtgtctgggagcagtccgccgccgaagtgaacggaaaccgtctgtggctgaccgagaagccg

SEQ ID NO: 1479 - DNA, 1395 bp, Streptomyces avermitilis
  CDS (1)..(1395)
atgacggaaattcttgtgcaggagcgttcggaggagcaggttcctccgcaggtcagggtggtggagcacccggcttggcccgtgctcaaggatgccgtggagcagattcggccatggcagtcgaaggacggctccatcgacttcgaggccgagggcgcgccggacgcctccgacgccgaactggccgtccgccgtgccatagacgcggtcgaggagctctccccgctgctcccgcacgacgccgcctaccacgcggccttggtgaaggacctgcgccgctggtccgacgacgggttcaaggtgcccgacttcctggactcgctgctggccttccagcccgcggggcaccgccgggacggcctccagcacctggtcgtcttcccgatgtacacgcagaacggcaacccggaccgcaacttcgaagcggtcgtgctgcgcatggtctggccggactggctcgccgagctggaggcgacccgctacgacaacccgctgttctgcggcattaccttcgaggacttcacggcgggctacgacacgaactcggcggtcctcttcccggagaccatcgccgtgcgcgaggcccccgagcgcttcagctggggcggcatcttctgcgaccgcgaggccgcccgttttcgcgccgtgaccgacgcggccgtcgacaccctgggcctggagctgcccgcggacatcgccgccatggtccacgaccagcagcgctgtgagcaggccttcgtgctgtgggacatggtccacgaccgcacccacagccacggtgacctgcccttcgacccgttcatgatcaagcagcgccagccgttctggatgtacggcctcgaagagctgcgctgtgacctgaccgccttcaaggaggccgtgaagctggaggccgacggcttcccgcagggccgtgacgtgcagtacgcggtgctcttcgaccggatgttccgcttcccggtcaccggtgagcgcgtgcgcaactacgacggcctcggcgggcagctgctcttcgcctacctgcacaagcacgacgtcgtccgctggacggacaacaagctgcacatcgactggcagcgtgccccgcaggtcaccaacgagctgtgcgccgagatcgaggacctctaccgggccggcatcgaccgccccaagctcgtccactggttcaaggcgtacgagctggtctccacctacctcgccccgcaccccggctcccgctgggccaagggcccggacgccctcgacctgacccagcccccgcgcaagctcgtggacgacgtgctcccggacgagtttccgctgagcatgttctatgaggcgctcgccaagaagctgaagaacgtgattgcctccaccaagggcatcacggcgacgagtgccgagcgggccgccgcg

SEQ ID NO: 1480 - DNA, 489 bp, Streptomyces avermitilis
  CDS (1)..(489)
atggggccccgcccaacggcggcccgggccgtacagccggtccgcgtcacccctgggtgggcgcgtcacgcggaggttgaccgaggtcgcgggcatgcgcctggcatgaaactgacgaatggtcatatggcatgcgcccccgggatgttcggctcttcgggaggtgacttcatgccgccggccgacgccgtcaaggagcactctcccgacctcggcggcagtgtcgccgacggccgaggcccgccggcacctagccgccgcgtcggcgacctggcctacgccgcgaagctccgtgtgaccggggtgccggtcacctgtagtcggtatccggccatgctccatggattcctcggcctcgccgaaccccttgccgaacctctcgccgaacccgtcgcggacgcccgggatgcccagcggtcgatagcggaagtcgtcgcctctacggtgtccggcaggaaaaagagcggtgaaggcgggggtgaggcagga

SEQ ID NO: 1481 - DNA, 681 bp, Streptomyces avermitilis
  CDS (1)..(681)
ttgaacttcctcaccatcggtcaccgcggagtcatgggcaccgagcccgagaacaccctccgttccttcgtcgccgcccagcgtgcgggcctcgacctgatcgaactcgatctgcatctgagcaaggacggggccctcgtcgtcatgcacgacgccgaggtggaccggacgaccgacggcacgggaccgatcgccgagaagaccctcgccgagctgcggacgctggacgcgggccggggcgagcgcgtccccgtcttcgaggaggtcctcgacgccgtcagcgcaccgctccaggccgagatcaaggacgtggcggcggcgcgggcgctggccgaggtgatgaaccgcagggacctggtcgcccgggtggaggtgctctcgttccacgacgcggccatcgccgagatctcccgcctcgtgccgggggtacgcaccgccctggtcgccagccgctacggcaccgacgtcgtcgaccgtgccacggcggtcggcgccaccacgctcgtgctcaacatccggcggctgacgctggagatcgtcgagcacgcgcgcaaggcggacctgaggatcatcggctgggtggtgaacacccaggaccatctgcggctcgtccgggcgctgcaactggacggcgcgaccaccgactacccggagatcaaacgcaccggccgtttcaccgca

SEQ ID NO: 1482 - DNA, 537 bp, Streptomyces avermitilis
  CDS (1)..(537)
atggacaccgccgccaccggactgaccttccgcgacgccaccgacgccgacgtcgacgcgctggtcgcgctgatcgagtcggcctatcgcggggacgccagccgggccggctggaccaccgaggcggacatcctggaagggcagcggaccgaccccgagggcgtgcgcgcggtgatcaagtcgtcggacagccgactgctcaccgtcgagcgggccggcgcggtcgtcgcctgctgccagctcgaacaccgcggtgaccacgcctacttcggcatgttcgcggtgagccccgccctccagggcggtggcctcggcaaggtgatcatcggggaggcggagcgggcggcccgcgaggcctggggcgtcgccgcgatgcacatgaccgtgatctccgtacgcgacgacctcatcgcctggtacgagcggcgcggctaccgccgtacgggagagacgacccccttcccgtacggcgacgagcgcttcggcgttccgcagcgcgacgacctggagttcgagctgctggtcaagccgctggcg

SEQ ID NO: 1483 - DNA, 390 bp, Streptomyces avermitilis
  CDS (1)..(390)
atggtccacgtactgagcagccgcacccttctgcgccccaccgacccggaacgctcccgcgccttctacggcgagaagctgggcctcgccgtctaccgcgagttcggcacgggccccgagcgcggcacggtctacttcctcggcggcggctttctggaggtcgcgggccgctcggacagcccgccgtcaccggccctgaaactgtggctccaggtgcctgacgcgggcacggtgcacgaggagctgaagaacgccggcgtcgagatcgtccggccaccggtacgggagccgtggggcctgatcgagatgtggatcgcggacccggacggtacggagatcgtgctcgtggagatcccggcggaccatccgctgcggtaccggcccgggatc

SEQ ID NO: 1484 - DNA, 762 bp, Streptomyces avermitilis
  CDS (1)..(762)
atgaagctcgacaggccggtgaccggcgggccctgctggaccgagctgggcaccagtgatctggaggcggccaagcggttctacaccgacctgttcggctggcggctggagaccgaccctcggcaggaggccggcggctataccgtcgcgcacctcggcgacgcggccgtcgcggcgatctccccgcggtacgaggagtcgcagccggtcgcctggaacgtgtcgttctcggtggcggacgcggacgcggccgtcgccacggtgcgggacgcgggcggcacggtggtgctgggcccgatggacgtgttcgacgtcggccgtttcgcggtggcgtccgatccgggcggcgcggccttccagctgtggcagccacgggccttccccggcgcggggctgttcaacgcgcccggctcgctcggctgggtggagctgctgacgcgggctgccgagcaggccacggcgttctacacgaccgtgttcggctggagtgtcaacgcctccgagcactacacacagtggggtgtcggcggcgccgacttcggcggcatggtgacgatggacgagcagttcccgcctcaggtgccgtcgcactggctgccgtacttcgcggtcgaggacgtggacgccaccgcgcacgacgcgaccgaggcgggcggcagcgtactcatggagcccacgtccgtgccggacggaccacggatcgccgtcctgcgggacgcgcagggcgcggccttcgggatccatgtgggcggcgaggagggc

SEQ ID NO: 1485 - DNA, 516 bp, Streptomyces avermitilis
  CDS (1)..(516)
atgtgcgccatgacccatggactggtcctgtcgcccgggtcgggccgccggatgggtacgtccggcatgacgctcaaggtgggggccgacgtctcggcccgatggtcggtgttcgaggccgatgtggagccggggttcgacgtgggggcacacctgcacgacgaagcggaggaactgttctacatactcgacggcgaactcgatctgctggccttcgagccgcggatcagggcgtccggcgactggcgggcctgggagtccggcaccggtcacaaggtcgtccgcggcggcccgggcagcatgatgtacgtgccttcgggatgcccgcacgcgttcgccaaccccggctcggtgcccgcccggatgctcttcctcgcggcgccggccggccatgagctctacatccgggagatcgccgacatcctcgacgccccgggcccgcccgaccagagagcgatcgccgaggcacgcacacgccatggcatccaccagctcacgccgatgaagcccggtggt

SEQ ID NO: 1486 - DNA, 594 bp, Streptomyces avermitilis
  CDS (1)..(594)
atgacggcagcggacggacggacggacaccgggggcggcacggcgggcgggcggccgcacaccggcagcggcgccgacgggggcggtgcggcggcgcacgacaccgtggccgccgtggtgcgccagtggcgggccgtccgtcccgacatcgacaccggacccatggagatcatcgggcgcatcaaccgctgcgcggccctcctccagcaggccgaggacgccccgctgcgccgcgtcgggctgacccgtcccgagttcgacgtcctcggcacgctgcgccgcaccggccatgagctgacgcccggcgagatcgcccgcgagaccttctcctccggggccgccgtcaccaagcgcctcaagcagctgaccgagcgcggcctggtcgaacggcgcggagacgcccgcgaccgccgcgtggcccacgtccggctcacggacgccgggcgcgagctggtcgacggcatccttcccgagcagctttcctacgagagcgccgtactgtccggcctcgacggcgaagggcagggtgaactcgcgggcctgctcggcgaattgctggtccagctggagggcaggctcggcgtgccgcgcggc

SEQ ID NO: 1487 - DNA, 1659 bp, Streptomyces avermitilis
  CDS (1)..(1659)
atgagcagtgcgacccccaccacctcccgcgtccgtccgctccccctcgtgggcgtgctgcgcctcggccggccctccgacatctggttcaaacccgccctgagcgtggtcgccgcggtcacaccgcccaacctgaccctccttgcgctcggccgcctcgatctggcgatgtacacgatggccgggtcgctctgtgccctctacgcgcacaaccgcccgtacgccgcccgggcccgtgccctcgcctgggtggtgctcgggatgatcggcgggctcgcggtcgccctgatcgcggcgtcgctcaccaccagcgccgtcgtgctggtcaccgtgggggcgctgctggccgccgcgcagaaggcggtgtgcgacgcgacccgcatcggcccgcccgggcatgtcgtgctcaccttcatcagctccgcttccttgttcgcgccggggaccctcggccaggtccccggacatctggcgctcgcggtcgccgcgggtgcctgggcctggatcgtgggcatggcccccggtctcgtacggccgcacgggcccgagcggcgcgccaccgcccatgccctgaacgccgcggccgcgtacgccgagacacggggcaccggcgacggacatgcccgggcccgcgccggtgcggccgccgccgtgcacgcggcctggcagtcgctgctgtccaccggcgcccgtaccgcgccccgccgtgccctcgaacggctcgtcgtgcgcgccgaggtcgcgctcgccgtgcccgcggacgccgaagccgggcagctgcgcgcctgggcccgcgagctgcgcggcaaggggccgatcccgatcccgcgcgtcccgcgggctggcgacggcacgacggacgaactgctcggtgtggaagccgaactcgacagccccgcacggccgttgctcagccggctcggccccctcgcgcccatcgcgctgcgcaccgccctcgggtgcgccctcgccggatacgtcgcgctcgccctcggcgtcggccgcccctactgggcgctggtcacggccgcctcgctctaccaggccaacgtcacgctcacctggagccgtggcatccagcgcgtagtcggcaacctcgtgggcgtcctcgccttcgccgcgatcgccccgctcgcgcatctcggcccggcggccctcgtgctgagctgcctcgccctcaacttcggcgccgaggcactcatcggccgcaactactggctcggcagcgtgtgcgtgaccccgatggccctgctcatcaccgagttcgcgcacctccaggaacccggcgagctgatgaccgaccgggtcgtggacaccctcgtcggggccctggtgggcttcgtcgcggcggtcgcggtgaccaaccggcgggccggcgaccgcatcgagctcgccctcgacgccctggaaagcgcccgggagcacgcggcgaagaccgtcaccgccgagcaccctgagcccggggccctggagtccgcccgccgcgagctggccgccgcggtcgtggatctgcgggccaccacggacgccgcggccggcgagtggtggcagcgcgccctgccggaggagcgggtggtgctcgccgagcaggccggacaccgtacgctcgcggcgacggtacgacggcagggactgcacaccacggagggtgcaccggca

SEQ ID NO: 1488 - DNA, 546 bp, Streptomyces avermitilis
  CDS (1)..(546)
gtgcacggatcggcttcgcccggctggctgctcgtcgcgctgtgcgcggcgaccgggacctactgtctgctgcggatgcgcagcggcgtcgaggagcagcgccgggccgcgggcggcgaggcgctgatggggttcggcatggcggccatggccgtaccggccgcggtggccgccccaccccggtgggcctggctggcgtacgcggtggtcttcggcgcggccggcgtacgggccctgtggggggcgcagaccggcgcacaccatctgcaccatctggtgggcgcgttcgcgatggcctacatggcgggggtgatggcagcgtcccccgcgcaccacgagcacggtgccgcctccgggctgccgccggtgacaggggtgctgctgctctacttcgcggggtacgtgctgtggtccggggtgcggctgataccggtggcgtccgtggcggggggcggccggagcgtcggctggggcgaccggcccgaactggcgcgggcctgcagactctccatggggatcgccatggtcgccatgctcctcacactc

SEQ ID NO: 1489 - DNA, 933 bp, Streptomyces avermitilis
  CDS (1)..(933)
atgatggtccccgcggcactgttgctgctcggcgccctgaccgccgtcgtcgcgccgcggctgctcgccctggccgactggccggaccgtgaaccggtggtcgccctgtgggtgtggcagtgcgtggtggcggccgtactggtgtgctgcgcgctgtcgatgaccctgagcgcggccgccgcgtgggtggccgtgcgcggtcatgtgttcgccggggcgccgcacccggtcgtggaggcgtacgcgctgagcaccgggggttcctgggcgtcgacgaccgccgtgatgctcgcgggcggcggcgtgtggagcgcggcgatgctggtccgtgagatcgcccgggcccgggcccgccgccggcagcgccgggccgaacttctcgtacgcgcaccgctgttgcccggcgaggaacccggtgccgatcggctcgtggtgctggagggcgagcggcccgatgcctggtggctgcccggggccgcgccccagctcgtcatcaccacggccgcgttgcgccggctcaaggggcggcagctggacgccgtcctcgcccatgagcaggggcacgcacaggcccggcacgactggctgctgcactgttcgggcgcgctggcgggcggctttccccaggtgccggtcttcgccgcgttccgcgacgagatgcaccgactggtcgaactcgccgccgacgacgtggcgtcccgccggttcggccgcctcacgatcgccctggcgctggtggaactcaacgaggaccggggcgtgttcggcccctgcccgaccccgcaggcccacgttccgcagcgtgtccaccgcctgctcactcccccggaccgcctcacggccgcgcgccggctgcaactgacggcggccgcggcgctggtgccggtgattccggtactggtggcgttcgtaccgggactgcgggcgctcggg

SEQ ID NO: 1490 - DNA, 681 bp, Streptomyces avermitilis
  CDS (1)..(681)
atgcactccccgcccgtcggctcgccgccccgaccgccccgtccccgggccgccgcgcgcgccgtggtggtgctcgccgccgcgtccgcgctggtcgtcctgctggtcgccctcccctggcaaccgctcatcgccctcgacggcgacatctcgcgcgccacacaccgctgggccgtggacgaacccggtgtcacccacgccttccgcatcctgacggactgggtgtgggacccgctgacgatgcggctcgcgtgtgcggcggccgtcgtgtggctggtgtggcggcactccgcgtggcggctcgcgctgtgggtggcggccgcgtgcgcgctgggcacgctgctgcaacaggtcctcaaggccgcggtcgaccgtgcccgtcccgtgtggcctgatcccgtggactcggcccactacacggccttcccctcgggccacgccatgacggccacggtggtgtgcgggctgctcctgtggctgctgcgcctgtacggcgccgggcgcgcactgtggcgtacgggcgtcgcgctggcggcggtctccgtcgtgggagtcggtctgacccgcgtatggctgggtgtgcactggccgtcggacgtgctcggcggctggctgctcggggcgctggtggtggcgggcgcgatggcgtcgtacgggcggtggcacggctcagggcccgct

SEQ ID NO: 1491 - DNA, 696 bp, Streptomyces avermitilis
  CDS (1)..(696)
atggcgatcaaaggtgtgctcttcgacttctccggaacgctcttccgtatcgagtccaccgagtcctggctgcgcgcggcgctcaccgcggccgaagtccccctgccggaaccggagttgatccggaccgccgaggaactggagtcggtgggcgcgctgcccggcggggcgctcccgtcccagccgctgcccgcccgcctcgccgagctgtgggaggtccgtgaccgcagcgccgcccagcaccgggccgcgtacaccggcatcgcccgtcaggtgccgctcccggatccacgcctccacgacgcgctgtacgaccgccacatggccccggcggcgtggtccccctaccccgacgcggccgaggtgctcggcgcactgcgcgagcgcggggtcgccgtgggggtggtcagcaacatcggctgggatctgcggccggtcttccgtgcgcatggcctcgccccgcacgtgggcgcgtacgtcctgtcgtacaagcacggcatccagaaaccggacacccgcctgttcgccctcgcctgcgaggcgctcggcgtcgccccgcaggacacgctgatggtcggcgacgaccgccgcgcggacggcggcgcggcggccctgggctgcggagtgcacttcgtggaccatctcccggccccggaacgcccggacggcctccggccggtactggaactggtcggc

SEQ ID NO: 1492 - DNA, 717 bp, Streptomyces avermitilis
  CDS (1)..(717)
atgtccccgcgcagcgcctcggtcaatgaagagttgcgccggcgttcccgggaacggcttctgcaggcggccgtggagctggtgagcgagcgtggctacgaggcgacgacgctcggcgacatcgctgaccgggcgggctcggcacgggggctggtgtcgtactacttccccggcaaacgacagctcgtccagtccgccgtgcaccggttgatgcaccgcacgcttcaggaggcgctggaccgtgagccgcgtaccgaggacggcagggagcggatggcgcgggccatcgacgcgatcctgggcctcgcccgggaccagcccgtgctgatgcgccagcacatggcgggcatcctgcaagccgagggcttcatgcagtgtcctgagcagcggcggctggcggaactgctgcgcgagacggtcgcccgtcgcggctcgccggacgccgccaccgactatccgatgctgcgcgccctgctgatgggcgcggtctacgcggccctggtgccgggggctccgatgcccctgcccgtgctgcgggccgagttgttcaagcggtacggcctcgactgggagacaggcgccccgccggccccggagggggccgacgggacgtgcggcacggatctgtcgcgctttttcgcgacggagagccgagccggtgaggacgagggccggccgaagccgccggactccgtccccgggacgcgtcagtcgaag

SEQ ID NO: 1493 - DNA, 1500 bp, Streptomyces avermitilis
  CDS (1)..(1500)
gtgaccctgttgaacgaaccccgaaggcggcgcagatccacgggagttgccgccgccgcggcgggactcctggccgcgttgctcacggcaggcccggcggccgccacccccgaccccggggacggcgccgtgacgcagaaggaggtctcccggagcgcacaggctcaggtcagggcggcgatgtccgacggcgagatacccggccaggacgaggtcgtccactccgacaacatcgaacacgtcgccaacatccccaaggaggctttcaccggcttcaactcggacctggccttccagggcaagtacgcgttcgccggcaactacgacggcttccgcatcttcgacatcagcaacccgagggcccccaggacggtcgcccaggtgctgtgccccggctcgcagaacgacatctccgtctcgggcgacctcctcttcctgtccaccgactcctcgcgcagcgacagctcctgcaacagcaccacacagcccgcgaccgagaagtcctcctgggagggcatgaaggtcttcgacatcagcgacaaggcgaacccgaagtacgtcgccgcagtcgagaccgcctgcggttcgcacacgcacgcgctggtgccggaacgcaggaacgtctacgtctacgtgtcctcgtactcgccgaacgccgccttccccgactgccagccgccgcacgacggcatctcggtcatcaaggtgccgcgcaaggcgccggagaaggcggccgtcgtcagcttcccggtgctgttcccgggtgagggccaggacggcgggggcaaccccggctcgcccaccaaccccggcgtcgccaaaaccaccggctgccacgacatcaccgtcctgccctcgaaggacctcgcggcgggcgcctgcatgggcgacggcatcctgttctccatcaaggatccggagcacccgaaggtcctcgaccaggtcgaggacaacgtcaacttcgcgttctggcactcggccaccttcaaccagaaggccaacaaggtcgtgttcaccgatgagttgggcggcggtggcgcggccacctgcaacgcgacggtcgggccgaaccgcggagccgacggcatctacgacatcgtcggcaagggcgagaagcgcaagctcgtcttcaagagctactacaagatcccccgccaccaggcggacaccgagaactgcgtggcccacaacggctcgctgatcccggtcaagggcaaggacctcatggtccaggcgtggtaccagggcggggtctcggtctgggacttcaccgactcggcccaccccgaggagatcgcctacttcgagcgcggtccgctgtccaccgggacgctctcggtcggcggctcgtggtccgcgtactactacaacggttacatctactcgaacgacatcgccaagggcttcgacgtcctgaagatcaccgaccggcggaccgaccccgcgaagcgggtccgtctgcgtgagctcaacgtccagacgcagccggactacttcgac

SEQ ID NO: 1494 - DNA, 717 bp, Streptomyces avermitilis
  CDS (1)..(717)
atgcggagatcaacaggtggcaacgtactcgtcacaaacgttcctgatccctctcgcgccctcaacagccgtgtccgccaaatgacttgggccacggtgtcactggccgtcgtggcgctcgcgctctcgggatgcgactccggatcggattcccccacggacgtcaagtccggtgcggcgagcggcccttcggtgatcgtgcccggcaagcccggagacgcgaacgagacgctctccgccgaggacgccgcgaagcggcggaccgacgacgactcccccaacacggcggacttctcctacgcacgcatgatgatcgagcaccacacccaggccctggagatgaccgaactcgccccgaagcgggccgagtcgggcaaggtgaaacgactggccgagcggatcgcggccgcgcaggggcccgaaatcgcctccatggaagcctggttgaagtcgcacggcggcgagcggaagagcacctcgcacgcacacgacacgatgcccggcatggcgagcgccgcacagctgaagacgttgcgggcggcgaagggccgggcattcgacgagctgttcctgacgctcatgatcacgcatcacgacggggcgatcaccatggccaccgaggtgaagtcgcagggcaacaacatccagatcgaggagatggccgacgatgtgatcgcgcagcagaccagcgagctcggccggatgcgcgacctgcca

SEQ ID NO: 1495 - DNA, 462 bp, Streptomyces avermitilis
  CDS (1)..(462)
gtgtccgttcggcgcgcgtgggaggtgcgggagcacgaggtcaccacgtcctggttcgacgtctgcctggccttcgccgacggggcccgggtcgacgtcctcgcggtgctggccgaggggggtgtcttcgtcgaggacgtacgcgcccagccgccgctgtcgctcgacgacctgacggcactggctgactggatcgagggcccgctgttcgaggcctgcggcggggagcccgggccgtcgggcgagccggaggaggcgtcgtcgcgccatgcccggccggcctggccgcgcggcatcgaggggcggcgcctcgtcgccgaggagtatctcgccgcccagggcgaggggatcgacccggtgctcgcggtgatgtgcgcgaccgggcacagccgccgcagggcgctcaggctgatcgccggggcgcgtgacgcgggattcctgacaccacgtcacgtccggcgc

SEQ ID NO: 1496 - DNA, 1344 bp, Streptomyces avermitilis
  CDS (1)..(1344)
gtgctgcatgtcgccgtcgtaggttcggggccgagcggggtctacaccgcccagggcctcgtccagcaggactccggggtgcgcgtcgacgtcctggaccgactgccgtgcccgtacggcctggtgcgctacggggtggcgcccgaccacgaaaagatcaagtccctgcagaacaatctgcggacggtcctcgaacatgagcgggtgcgtttcctcggcggcgtccggatcggcccggacggggtgccggccacccggctgcgggagctgtaccacgcggtcgtctactgcgtgggcgccgccaccgaccgccatctgggcatcccgggcgaggaactgcccgggagctggtcggcgaccgagttcgtgtcctggtacagcgcccacccggactccgtcgccgacggcttcgtacgcggggcgcggtcggccgtggtgatcggcgtcgggaacgtggcggtggacgtcacccggattctggctcgcggaccgagcgagctgagccccaccgacatgccccaggcggcgctcacggcactggccgccagccgggtcaccgacatccacatggtcggacggcgcggtccgtcgcaggcccgcttcaccaccaaggagctgcgcgagctgggcgcgctgccggacaccgatgtcgtcgtggaccagcgggagctggcgctcgatccggcgtacgccgatccttccgggctgcccgccgcccagcgccgcaatgtggaggtgctgcgggcatgggccgaggcgccgccgaagggcgctccgcgtcgtatccggccgcggttcttcctgcggcccgtcgaactgctcgacggcggcgggcacgtgggtgcggtgcgtttcgagcggacggcgccggacgggcgcggcggggtggcgggcaccgggcagtacgaggacatcgaggcgcagctcgtgctgcggtccgtgggctatcgcggggtgccgctggaggggctgccgttcgacgcggagcagggcacggtgccgcatctcgcggggcgcgtgctgcgcgacggagcggtctccccgggcgagtacgtggcggggtggatcaagcgcggtccgaccggcgtgatcggcaccaaccggccctgcgccaaggagacggtgacctcgctgctcgcggacgcccccgttctcgtacggcgggaggtgccggacgatcccatggcggtgctgcgtgcggaggggctgcgaccggtcgagtgggcggggtggcaggccatcgagcgcgccgaggcggagctgggcgcatcactggggcggaacgtggtcaagcttcccgactgggcggcacttcgggcggcagctgcggggaccgcggcgcac

SEQ ID NO: 1497 - DNA, 1353 bp, Streptomyces avermitilis
  CDS (1)..(1353)
atggcaacgaccgcatccgtgcatcccgtcgacgaggtcccgcccatacgccagttggccgccttcgggctccagcatgttctcgcgatgtacgcgggcgcggtggccgttccgctgatcgtgggcagcgcgatgaagctgtcggccgcggacctggcttatctgatcaccgccgacctgctggtgtgcgggatcgcgacgctcatccagtgcgtgggtttctggcgcttcggggtacggctgccgatcatgcagggctgcaccttcgccgccgtgtcgccgatggtgctcatcggcacgacgggcggcggactgcccgcgatctacggttccgtgatcgtcgcgggcctcgcgatcgcgctcctcgctccggtcttcgggaagctgctgcggttcttcccgccgctcgtcaccggcacggtgatcctgatcatcggcgtctcgctgctgccggtcgcgggcaactgggccgcgggcggccagggggcgaagggcttcggtgagccgaagaacctggcgctcgccggattcgtgctgctggtggtgctgggcgtgcagcggttcgcgccggcgttcctgagccggatcgccgtactgatcggcatcgtggtggggctcgcggtcgcggtgccgttcggcttcaccgacttcggcggggtcggcgacgccgactggctcggcatcagcacgcccttccacttcggtacgcccaccttccacgcctccgcgatcgcgtcgatgctggtggtcgcgctggtgacgatgaccgagaccaccggtgacctcatcgcggtcggcgagatgacggaccgcggggtcgagccgcgtatgctcgccgacgggctgcgggccgacggcctgtccaccgtcctcggcggtgtcttcaacaccttcccgtacacggcgtacgcgcagaacgtgggcctggtgggcatgacccgggtgcgcagccgctgggtcgtcgccgccgcgggcggcatgctggtgctgctgggcctgctgcccaagctgggcgcggtggtcgcggcgataccggcgccggtcctgggcggcgcgggcctggtgatgttcggaacggtcgccgcgagcgggctgaagacgctggcgcgggtcgacttcaaggacaacgacaacctcacggtggtggccgtttcggtggcggtggggatgctgccggtgggggtgccgacgatctacgcgcagttcccggactggttccagaccgtcatgaacagcggcatcagtgccggctgcctgactgcgatcgtattgaatctgctcttcaaccaccttccggggaaggccggttcgcccgcgaaggccgccgagcccgacgaggcctcaggcaccgcc

SEQ ID NO: 1498 - DNA, 357 bp, Streptomyces avermitilis
  CDS (1)..(357)
gtgacgaccgccgccccgaccgcacgcagtcgcgccctcgcgcaccccgcccgcgaggagatccgcctggaagccgtgctgcacgcgctgtccgacccgatgcggctccagatcgtgcgagagctcgccgccgatggcgacgagctctcctgttcgcacttcgacctgccggtcaccaagtccaccaccacgcaccacttccgggtgctgcgcgagagcggagtgatccggcagatctaccggggcacggccaagatgagcggcctgcgcaaggacgacctggacgcgctgttccccggcctcctcgacagcgtcctcaccgcgtgcgcccaccaggccgaccggctaggcggtgcc

SEQ ID NO: 1499 - DNA, 1077 bp, Streptomyces avermitilis
  CDS (1)..(1077)
gtgagcgcgctcttcgagccctacagcctgcgcgatctgaccatccccaaccgggtgtggatggccccgatgtgtcagtactccgcggcgccacagggccctgcggccggcgccccgcacgactggcacttcgcgcactacgcggcgcgcgccaccggcggcacgggcctgatcgtcgtcgaggcgaccgccgtctcgcccgagggccgcatcagcccgtacgacctcggcatctggaacgacacccaggtcgaggcgttccgccggatcacccgcttcctcgcggcccagggcacggtgcccgcgatccagctcgcacacggcggccggaaggcctccacggaccgcccctggaagggcggcgcgccgctcgccgccgacgagcacggctggcagccgctcggaccgagcccggtcgcgttcgacgagaggcacccggtgccgaccgaactgtcggtcgccgagatccggcagatcgtcggccagttcgcggacgcggcgcggcgcgccctggcggccggtttcgagatcgccgagatccacggcgcccacggctacctgatcaacgagttcctctccccgcactccaaccgccgcaccgacgagtacggcggctcgtacgagaaccgcgtccgcttcgccctcgaggtcgtcgacgccgtacgggaggtgtggccggccgggaagccgctgttcttccgcgtctcggccaccgactggctggacgagggcggctggaccgccgacgacacggtccgcttcgcggccgagctccaggcgcacggcgtggacctcctcgacgtctcgacgggcggcaacgcctcgggtgtacgcatcccgaccgggcccggctaccaggtccccttcgcggcccgggtgaaggccggaacctccctgccggtggccgccgtcggcctcatcacggacgccgagcaggccgagaagatcctcgccaacggggaggcggacgcgatcctgctgggccgtgaactcctgcgcaatccgtcgttcgcccggctcgcggcccgggaactgggcggcgacgtccatgtccccgcccagtaccaccgctccgtc

SEQ ID NO: 1500 - DNA, 909 bp, Streptomyces avermitilis
  CDS (1)..(909)
ttgagcagtgaaatcgacgtccttgtcctgggaggtgccggggtcgacacgatcgtgcaggtgcccgagctgccgctcccgtacgcggacagctacatggtgcccgcgatcgagacccgggcggggcagaccggcgacttcgtggcggtcggcgtgcatgcgctggggctgcgcacgcaccacatcgacatgatcggggacgaccgggagggcgacctggtccgcgcgctccaccgcgaccggggaatcggactcaccgaagtgccgctgtccgcgggtacgaagcgggcggtgaatctcgtgggccccgacgggcgccgcctgtcgctgtacgacgacagccgcgcaccggacgaggagcggctgcccccgcccacggtggccgccctggccgcggcgagccggcacgcccatgtggcgatcacccacccctgcgcggacgctcttcccacgctgcgcgagacgggggtgagcatctccaccgatctgcacaactgggacggtgtccaggcgtatcacgaggcgttcgcccacgaggccgacatcgtgttcctgtcgaccaccgccctggcgaacccggagaagaccatgcggcagatcgccgagcgcggccgggcccgggaggtcgtcgccacggcgggggccgaaggggcgtatctgctggccgacggcgaggtgacacacatccccaccgtcacacccccggccccggtggtggactccaacggggcgggcgacgccttcgcctcgggctacctcttcggccggctggcgggcgagccacccaggcgctgcgccctgtacggttcgatcgccggagcctacgcctgcacggtaccggcgacgagggcggacgccatcggccgggagcaactgctggccacggcagcggagttgacgaacaggccg

SEQ ID NO: 1501 - DNA, 627 bp, Streptomyces avermitilis
  CDS (1)..(627)
atgtcggcattccgtggtccccaggcatggaggtcgcgatggcggcgcaagcccctggcgcgatggcggcgcaaccccctgtggcgatggcggcgcaaccagctgcggcgccgcagcgacgtgctggaggcgtgggtcctgttctcggcctggaccgtcaccgtgctctgcggtgtgctgacggggctcgcggcggcacactccgtcgagcagggcctcgcccgggaacgcgccgagtggcgccccgtccgcgccctggtcgccgaggacgcgcccgagtcgtccgccgcggcctcgtccggcgccgaccgggtgtgggcgaaggtccgctggaccacggcgaacggttcgacgcactccggccaggcgcgcgtcgccgccggcagcgccacgggcaccccggtgaccgtgtggacggaccgcgacggccttctggtgaccaagcccgtgcccccctccgaggcgcaggtgcgcggcgtcacggtcggccttctcgtgggggtcagcgcggcggccgggccgttcgtgggcgggcggctggtccggggacgtctggagcggcggcggatggagcggtgggacgaggactgggcacggttcgggccgatgtgggggcgtaagacgggc

SEQ ID NO: 1502 - DNA, 1140 bp, Streptomyces avermitilis
  CDS (1)..(1140)
gtggtggggtgcagactggcccgtatctggaacaacgttgttgcggaggtggccgccatggccgaggtactgctcaccgtgggcacacgcaaggggctcttcgtcggacggcggcggggcggcgcctgggagttcgacgagagcccgtacttcaacgcgcaggccgtgtactcggtcgccatcgacacccgggacaaggcgccgcggctgctggtcggcggggacagcgcgcactggggcccgtccgtcttccactccgacgacctgggccggacctggaccgagccaccgcagccggccgtcaagttccccaaggacacgggcgcttcgctggagcgggtgtggcagctgcacccggcggccgccgagccggacgtggtgtacgcgggtacggaaccggccgcgctgtaccgctccgaggaccggggcgagagcttccggctcgtacgtcccctgtgggagcaccccacccgcgacagatgggtgccgggcggcggtggcgagggcctgcacaccgtcatcaccgacaagcgggacccgagcgccgtgacggtggccgtctccacggccggcgtgttccgcacgcacgacggcggcgcgagctgggcaccgtccaactccggggtctccgcggtgttcctgcccgatccgaacccggagttcggacagtgcgtgcacaagatcgcacaggacgcggcgactccggaccggctgtatctgcagaaccactggggggtgtacagaagtgacgacgcgggcggccactggacggacatcggcgagggcctgccgtccacgttcgggttcgcggccgccgcccatccgcaccgcggggacacggcgtacgtcttcccgatcaacgcggacgcggaccgtgtcccggcggaccgccgatgccgtgtcttccgcacggcggacgcgggcgaaagctgggagccgctcacggccgggctgccggacgaggaccactacggcacggtgctgcgcgacgcgctgtgcacggacgacgcggacccggcgggcgtgtacttcggcaatcgcaacggagaggtgtacgcatcggcggacgacggcgacagctggcggcaactggcctcgcatctgccggacgtgctgtgcgtacgcgcggcggtggtcggg

SEQ ID NO: 1503 - DNA, 1761 bp, Streptomyces avermitilis
  CDS (1)..(1761)
atgcatccgtgttctcccaggctggtcggtgtccccgcccccgaccgttttggagtactcatgggcacgcagtggaacgccgtggacggtcgcatccggacgaccgcccgcggacacgccgtgctgaacagtccgcggctgaaccggggcaccgccttcacccggcaggagcggcaggaactgggcctggtgggtctggtgccgccgcaggtgctgacgcaggaccagcaggccgcccgcgcctacacgcagttccgttcccagcccaacgacctcgccaagaacgtgtatctgacggcgctgcgcgaccgcaacgaggtgctgttccaccggctgctcggcgaccacctcgccgagatgctgcccatcgtgtacaccccgaccgtcggcaccgcgatcgagcgctacagctatgagtaccgccgcccgcgcggcgtgtacctgtcggtcgacgcgcccgaggacatcgagcgcaccctgcgcgcgtccgggctgggcgccgacgacgtcgacctgatcgtggcgaccgacggcgaggcgatcctcggcatcggcgactggggggtgggtggcatcgacatcgcggtggggaaactcgccgtctacaccgccgccgcgggcgtggacccggcccgcactctggcggtgatgctggacgtgggcaccaaccgccaggagctgctggacgacccgctctatctggggaaccggcacccgcgcgtggaccgggagagctatgacgccttcatcgacgcgtacgtcaccgcggccaccgagctgttccccgacgccctgctgcactgggaggacttcggcccggccaacgcccgccgcatcctggaccggtaccgcgagaaggtccgcaccttcaacgacgacatccagggcaccggcgcggtcaacctggccgccgtgctctccggtgtgcgcgccggcggtgtcccgctgcgcgaccaccgcgtcgtgctcttcggcgccggtaccgccggcatcgggatcgccgaccagctccgcgacgccctgatcgccgacgggctgacgccgcaggaggccaccgaccgcatctgggccgtggaccgccacggcctgctcgccgaggaccagcaggggctgcacgacttccagctgcgctacgtccgtcgcggcgccgagatcgccggctggcggcgcgacgacgccctcggcggcgttccgctggccgaggtcgtcgaccgggtgcgcccgagcgtcctgatcggcgcgtccgggcagggcggggccttcaccgaggacatcgtccgcgccatggccgcgcacaccgaccgcccgatcatcctgcccatgtccaaccccacccggctggccgaggccgtccccgccgacctgctgacctggaccgacggccaagcgctgatcgccaccggcagccccttcgacccggtggaggtcgacggcgtcacccaccacatcgggcaggccaacaacgcgctggtcttccccggcctggggctgggcgccgtcgtcgcccgcgccgagcgcatcaccgacggcatgctcgtcgcctcggcacgcgccgtcgcggagcagaccgacgccacggcgccgggcgtgccggtgctgcccctgatcgaccggctgcgggacacctccgccgcggtggccgtggccgtggcccgcgccgccgtcgaggacggcgtcgcccgggagaccgtcgacgacgcggtcgaggagcgggtccgcgcggccatgtggcagccggagtacccgccgatcgaggccgtc

SEQ ID NO: 1504 - DNA, 1083 bp, Streptomyces avermitilis
  CDS (1)..(1083)
atggacccagccatgtctttcgccgagatcttcaccgtcgtggtgccggtcttcctcgtcatcgcggtcggctacggcaccggccgccgcgcgctcttcgacgccggcggagcacaggcgctgcgcgagttgaccatgcaactcgcccttccggccgccctgttgctgagcatctggcagacaccgcggcgggtgctggtcgagcagctgcccctggtgggccttctcgccttcgggctgctcggggtgtacgccgtcctgctcggcgtcctgcgcctcgccggccgtcgtccgctgcggcgggcggccctgttcgcactggcgtgcgtccagccgcagtacgccttcatgggtacgtccatcctcgggggcctgttcggtaccgcgcaggccgccgtgccgatcgccgtcgcgggcatcctcgtcaacgtcgtcctcgacccggtcgtcctgatactgctcggcatgccggaacacccggcgtcccggacagccgcgaccgcggcagccgccacctccgcggtacggcggccggccctggtgaccgtcggcggcggcgcgcctggggaatccgtggaagccgccgccccggtggccgccggggacgcgtcgcccgagcaccgtccctccgtgctgcgcaccgtcgggcacgcgctgcgcgagccgttctgctggggcccggtcctgggtctgatcctgtcggtcggcggggtcggtgtgccgaaggtcgccggcacctcgctgaccctgctcgccggggccgcgtcggccgccgcgctgctgtatgtcggcgtctccgtgtcccggatcggccgcccgaagctgacccccgcggtgtgggcgatcgccctcaccagcgtcgtcgtcctgccgctgctcgtctacggtgcgggtctggccatggcctccgcggccgacgccgcccaggccgcgctgatcgtcgcgttccccgtctcccccgtccctctgatgttcgccgcccgtcacggctcgaaggccgacgtgcggaccatcggctccgccgtcgtactgagcctgctcctctccttcgtcaccctcccgctgctcatcgaactgatcggc

SEQ ID NO: 1505 - DNA, 1755 bp, Streptomyces avermitilis
  CDS (1)..(1755)
atgacaccgacagccgacacgcgaccggaacgtccgccccgcacgtcccgtatgcggtggccgcgttccgccgccggctgcacgcccgtacgcctgcccctcgcggcggcggcgcggggtgccgtcgccctcgcgctgccgctgctcgtcgggctgcgcacggggtgggtggtgccgtccgtgatcgcggcgatcggcgccctgtggggcgtgagccaggacggctccgatccctaccgggtacgggtgcggcggctgggctggaccggcctgtccagcgcgctcggcctgctcgccggtgaactcgccctgcgcagcggggagccggcggccgtggcgggctgtctggtggctgccgcgctcgtggcgggcaccgtcggcctgcgggggcggatcgcgtccgtttcgggcatgcatctgctgctcggcgtgacgatcggcagtggcatccccgtgccgggaccgtggtggcagccgccgctggccctgctcgccggtgtcgccctcgtcctcgcgctgtccgcggccccgtggctgtggcgtcggcaccacgtcgagcgggccgccgtgctcgccgtgtaccggagcgcgggcgaggcactggccgcggccggcacccctcgcgccgaggaggcccggcgacggatgacgctggccctcaaccacgcccatgaggtgatggccgcccatctcgcgccgcgcgcccggcagcgacagcagtcggaagtccgggagctgatccgggcgttccactgcgccgtacggctgggcgaggccgtgacggcggtggtgtgggaggcccgtccgctcccgcccgccgtgaccggcgtaccgcagcagctgtccgagcgcctgctgccgggacggggctcggctcccgccgcggcagatacggcggcggagcaggcggtgccggcagtcgatgccggttcaccgggcaggcgggccctggccgaactgtgcgcgaccgtcgacggcgcaccggaccccgccgacctgacgctggatctgccggcgcgttcgtggcccgggcgggcggcacgtctgcgctatgccacgctgctcgcgggctgtgtgctcaccgcccatctgctcgccgaggccctgcacggtgcccgcggttactggctccccatgacggtggccttcgtctacaagcccgacttcggcccggtgttcacccgggcgctgcaccgctgcgccggcacggtcgtcggcgttgccgccatcggcgcggtgtccctggcggcgaccggcacctacaccgtgatcggcgtcgtggccgtcttcggcgccctgatggccgtcggcgtgcgccatcactacgcgctcgccacgctgggcctgaccgcggtcgtgttcgtgctcgtcgacctgctcggagaccaccgggcgctgtacggcacacgcatcctcgacaccgtcctggcctccgcgctggtgctcgtcgcgcacttcgcggtgtggcccgactccgcggcgaaccgggccgaggcgcagaccgaggccgccgtcgccgccgcccgccgctaccgcgaggtcgctccggaagcaggcctggtccagcggcagtcactgcgccgcgccgcgtaccaccagctggccgaggcacgccgggccgtcgcgcacgcccgcggtgaaccggctcgccccggccggccactgcccgactgggaggacacgatcacgacggccgaacggctctgcgacagggtgaccgcgcaggcggtggcgggcgcggcgggcccggcccga

SEQ ID NO: 1506 - DNA, 936 bp, Streptomyces avermitilis
  CDS (1)..(936)
atgaggaggaagaatgcacgcatggacctccaggtactccgctccttccaggccgtggcagagggaacgacggtgaccgacgccgcggcggacgcccgtatcacccagcccgccctgtcgcgggccctgaaccggctcgaggacgaggtcggcgcggaactcttccagcgcgtcggacgcgtactgcgcctcaccccggccggacgggtgttcaaggagtacgtcgacgcggtgctcgacagctacgaccggggccggcgagccgtggcggagatcgtcgacccggacgcgggtgcggtgtcgctggccttcctgcacaccctgggcacctggctggtgcccaggcttgtcacggacttccggcaggcgttcccgcaggcccggttcgagctgcaccaggacggcgagatcggactgacccggcacctcctcgacgccaccgcggacctgatcatcaccagcagcgagcccgcccaccccctgatcacctggcggcgtctcctggtggagccactacggctggccgtccccgcccggcaccggctggccaggcggcgccgggcccgtctggccgaggtggccgaggagccgttcatcctgctcaagcccgggtacgggctgcgcggcatcagcgagacgttgtgcctcgaggccggcttcaccccgctcgtcggcttcgagggcgaggaggtggagaccttgcggggcctggtcgccgccggtctgggtgtgtccctgatcccgtcgtcgccggacagcacgacgcccccggactccccgatccgctacctggagatcaccgacgtacacggtgcccgggacatcggcatcgcctggctgagctcccgtgccctgccaccgatcacccggcgtttcctcgatcacgccctgaagtcggccgccgcacccgcggcttcacaagcgacctcgcgcgcc

SEQ ID NO: 1507 - DNA, 297 bp, Streptomyces avermitilis
  CDS (1)..(297)
atgatcatctttggcaccaggggatacctgtaccagctcgcgatgctgacgctcgtgtgcggccgttgcggcaatccctccgcgcacacgctcaggaagcgcgtcacgaagttcacgcttttcttcgtgccgctgttcccgttctcgacgaagtacacgacgcagtgcaccttctgcggtgcggagcagaaagtgaccaaggagcaggcggagcggctacaggcgcagggcgcgcacggccacggcggtcagacgtacgggcagcagtcgcagcaaccgcagcagccgtaccagtcc

SEQ ID NO: 1508 - DNA, 711 bp, Streptomyces avermitilis
  CDS (1)..(711)
atgagctctcaaggccagaaggtcgcggtcatcaccggcgcgtcgcagggcatcggcgccgcactggtcgacgcctaccgcaagctcggctacgccgtcgtcgccacctcgcgcacgatcgcccccgtcaacgacgcgggcgtcctgaccgtccagggcgacatcgcctacccggccaccgccgaacgcgtcatctccaccggcgtcgagcgattcggtcgtatcgacaccttggtcaacaacgcgggcgtcttcgtcgccaagcccttcaccgactacacccaggacgactacgccaccgtgaccggggtgaacctcgccggcttcttccgcatcacccagctggccctggagcacatgctctcccagggcggcggccacatcgtcaacgtcaccaccagcctggtcgacaacgccgactccaacgtcccctccgtgcttgcctcgttgaccaagggcggcctgcagtccgccaccaagtccctcgccatcgaatacgccacgcgcggcatacgcagcaacgccgtctcgccgggcgtcatcaagacgcccatgcattccgaggagacgcacgaggcgctcgccgccctgcatccggtcggccggatgggcgagcagagtgacatcgtcgacgcggtgatcttcctggagaacgccccgttcgtcaccggcgagatcctccacgtcgacggcggccagagcgccgggcac

SEQ ID NO: 1509 - DNA, 978 bp, Streptomyces avermitilis
  CDS (1)..(978)
atgagtgacaagatcgccctgtcgacgtggcccacaccgctggagcccatgccccgtctggcggcggcactgggcctcggcgagaacgacctctggatcaaacgggacgacctcatcggcctgggcggcggtggcaacaaggtccgcaaactggaatggaccgtcggcgccgccctcgcggcaggcgcggacaccctggtcaccaccggcgccgcgcagagcaaccacgcccgcctcaccgcggccgccggcgcccgcctgggactcgacgtcgtactcgtcttccccggcactcccgacagcgccacgcacggctccggcaacctcgttctcgacagcctcttcggagccagggtccactgggccggagacggcggcccgagcacgatgggtgacgtcgccgacgaggtctgccggcagctgcgccgcgatggagcacgccctcatctcatccccttcggggggtcaagtcccctcggggcgcggggatacgtggaaggcggcgaggaactgcgctcccaactgcccgacgtggaccacgtcgtggtcgccctcggttccggcggcaccatggcgggactggtcggcgcactcggggagcaacgcgtcctcggcgttcactgcggggcggtggcagagccggccgccaccgtcgccgacctcgcgggcccactcacccgccgcagcatcaccccggaatccctgcgccttcgcaccgaccaggtgggtgcgggatacggagtgcttcatgagccggtcctggaagcgatgcgaaccgccgcaggcaccgagggcatcgtcctggatccggtctacagcgggcgcgccatggccggcctgatcgccgcggtgcgggacggcgacatccgcccggcccagcgcaccgtatttcttcacaccggggggctcccgggcctgttcgggcatacggagaccgtgcagcgctccgtcagcaccctgcgctcctacgaggtcgag

SEQ ID NO: 1510 - DNA, 606 bp, Streptomyces avermitilis
  CDS (1)..(606)
gtgacgagctttgcacgggtcaggatcacctgtcaagatggtgacgtgaatctggatcatgtctttgtgtgcgggaacccggctctcgacttcgccgccacgctgcgcgctcggcgctcgctgcggttcgagatgttcgcgtcgccggaccgactggatgcctggtaccgggagtccggtgtcgtcgacgccgtctcccccagtcaggaggccgacgtcgagcaggcggtggcggtacgggaggccatctacgagctggtcaccgcccggcgcctcggggaggcctacgccgatgaggcgctctccgtggtgaacggcgcggcccggaaacctcccgcgacgccgcagctcaccgccgcggggcggcgaacggacgcgacgccggaagaagcgctgtccaccgtggcgcgacatgccgtcgaggtcctgagcggaccggatgtgccgctgctcaaggagtgcggcaatcccgaatgcacccgcgtctacatcgaccggtcacgaggcatgcgccggcagtggtgcggcatggagtcgtgcgggaacaagctcaaggccgcggcctaccgcgcccgcaagaaggaggcccaagcacccgcctcccgc

SEQ ID NO: 1511 - DNA, 534 bp, Streptomyces avermitilis
  CDS (1)..(534)
gtggtctccgtgaccggttatctgatcaccaaccgtgaacgcaacaagtcgccgttgccgccgcaggccgagtgggcgtggtggtaccagtactacttcagcacggagaggggtctgctcggactccaggcgaacgcccatgaccttgccaggctcatctggaagttcaactcccccacctgggacttcgacgacgccacgttcgaccgtacggcggcggccttcgacaatcccgactacgtcagcatcgtgatccacaactaccgctggcggctgggcctggccgagggcgaccctcggtacgaccgcctcgagaaccgacttgccgcaggtcccgtcatcggcgtgcccacggtcaccctggacggggaacgggatccctttactcctgccggggacggctcgtcctatcgcgacaagttctccggcccgtacgcccaccggactctgaaaaacatcggccacaacgtgccgcaggaagcacccgaggcctttgccgaagccgtcgtcgaagcggacgggctcggtcaccgt

SEQ ID NO: 1512 - DNA, 441 bp, Streptomyces avermitilis
  CDS (1)..(441)
gtggacatgaaactcgagattgcggtggtgccggtcgccgatgtcgaccgagccaaggacttctaccaggctctggggtggcggctcgacgccgacgtcgccgacggtgaggacttccgggtggtgcagttcaccccgcccggctcgccgtgctcgatcatcttcggcaccggggtcacctcggccgcgccgggctctacgcaaggcttgcacctcatcgtctccgacatcgaggcggcccatgccgagctcaccgatcgcggcgtcaaggtgagcgaggtgttccacgacgcgagcggggtgttccaccgcgccgggaacgaggggcgggtaccgggcccggacccggaacgtcgcagctatgcctcgtacctctcgttcagcgatccggacggcaacggctggctgctccaggagatcacggagcggtttccgggccgg

SEQ ID NO: 1513 - DNA, 618 bp, Streptomyces avermitilis
  CDS (1)..(618)
atgggacgtaccagtgatgcccgggagaagatcctcaccgccgcgcagtcgctcatcgagctgcggggctactcggcgttgggtacggccgagatctgtaaggtcgcaggcgtgccgaagggcagcttctattacttcttcgagtccaaggaagcgctcgccctcgcggttctcgacgagcactgggccacccagcgccgcgagtggacccgcatcctgagcggcgaggccgagccgctccagcgcctgcggcagctcttcgaggagaccgaggccggccagcgtgccgggcagcagagctgcggcaccgtctccgggtgcatgttcgggaatctgaccctggagatgagcaaccagaccgaagccatccgtgagcgcctgcaacagatcttcgacgcgcaggtcgacatggtggaagaagtcatcatcggagcccgggagcgcggtgaagtcgccgtgagtgatactcgcgagggcgcgcgctccgttgtcgcccagctcgagggccaggtgctcttcgccaagctctacaacgacaccgggcgcctcaagcccctctggacgaactgtctcgccatcctcggtgcccgtatgcctgaggaggtgtcggccgcgaat

SEQ ID NO: 1514 - DNA, 651 bp, Streptomyces avermitilis
  CDS (1)..(651)
atggaaacccgacagcacgccaccggtaggggtcccgccggcacccggcagccggtcacggtgcggctgttcggcggaccgaccgcactgatcgagaccggcggcctgcggctgctgaccgaccccgccttcgacgcccccggccccgccaccggcggcacccgcgccctggccaagtcccgccaccccgcaggggcggccgaggggatcggcacaccccacgccgtacttctctcgcacgaccggtccgtcgacatcgacaacctcggcttcgccggacgccacctgctcccaacggtcgtctccggcgttccggcccgagccgggcgccacacccaacggagaaacatcatgcgtgagttcctggtcgagatcaccaccaccatccccgaaggcaccgaaccggccgaggtcgaccggcgccgtgccgccgaagcggtccgggccgaggaactggccgccaccggcaacctgttccggctgtggcgcccggtcggcgagctgcgcagcatcggcgtgtggcgcgccgcggacgaggacgagcttcacgagaaggtgctcggcacgctgccgctgcgctcgtggatgacgctcaccgtcacccctctcgagtcccaccccaacgacccgggcagagccgacgccaccgcg

SEQ ID NO: 1515 - DNA, 912 bp, Streptomyces avermitilis
  CDS (1)..(912)
gtggagctgcgccaactgcggtacttcctcgcggtcgccgaagagctgaacttcggccgggccgccgagcggttgctgatcgccggaccctccctgtcccagcagatcaagacgctcgaacgcgacctgggggtacgactgttcgatcgcgaccgccgctccgtgtctctcactccggccggtacggccctgctgccgtacacccgctccctgctcgaaagggccgacgacctccagcgccgtgcccgtcggctgggcggatcggagccggtccggctcggctacgtcaactggctccccgccgacctgaccgcccgcgcctccgcggtggcccaactgcacatcgacgcctgggtcgcgccctcgcacgcccaggccgcccgggtcgccgacggcagcctcgacctcgccgtgtgctgggtgcggaacgaggacctggaacggcacggcctgcgagcccggctcatcggtgccgatcggctgtacgcggtcaccaccggcagcgaccccagcggtgtcggcgcccaggacaccgtggtcctgctcgacgacgacaccacatcctggtcgtcgtggaacgtctacgccgaacaactggcccatgacaccggcgcccgcacggtacgcatctccgacggcggcgtcacgggccccgcgttcttcgaccatgtccgccgcggccgccgtccggtcgtcaactctcccaagggccagaccacaccgctgccgccggacctggtccagcgtcccgtgatcgcgcccaagatctactggacctggtctctggtctggcgcagcagcgaagtccgcgccgcggtactcgccgtcgtcgacaccctcaccgacggcgtcggcgacctcggaatccatgccccggacgcctggctgcccgacggagacccgtacaagcgg

SEQ ID NO: 1516 - DNA, 675 bp, Streptomyces avermitilis
  CDS (1)..(675)
gtggcaccacgacctttgcatgaactcgttgaagcaggctgggcgaaggctcttgaccctgtggccggacgcatcgcggcgatgggggacttcctccgggccgaggtggctgccggccggacctatctccccgccggggcgaatgtgctgagggcctttcagcagcccttcgacgacgtccgcgttctgattgtcggtcaggacccctatcccacgccggggatggccatcgggctgagcttcgcagtgtcacccgaggtgcgttcgttgccgggaagcctggagaacatcttccgggaactgcacacggacttggggctgcccaggccgtccaacggcgatctgacgccatggaccgagcagggggtgctgctgctcaacagggcgctgacgacggccccccgcaagccggcggcgcaccggggcaagggctgggaagaggtgacggagcaggcgatccgggcactggtggcgcgcggtacgccgctggtgtcggtcctgtgggggcgggacgcccgcaatctgcggccgctgctcggggatctcccggcgatcgagtccgcacatccctcgccgatgtcggccgatcgcgggttcttcggctcacgtcccttcagccgggccaatgaactcctggtccgccagggtgcgcagccggtggactggcgcctgcct

SEQ ID NO: 1517 - DNA, 1056 bp, Streptomyces avermitilis
  CDS (1)..(1056)
gtgacacccacaggcgcggcgccgggcggtagggacgggacgccggacggcccgggaccacgtgccgatcccaccgcggctgccggacgttcggatgtcgtcctcgccgtggactccgggggttccggactgcgggccgttctggccgcgcgcggcggcgggggcgcggctctgtcggcgccgctcgtgtcgaaggagccggtgcgcaccggacctcgcggtatcgatgccgggcagctgctggagcacctgctgcccatggcacggcagttgctggccgacgccgaggcgggcggaccgtgcgcggtggcgatcggagcggccggcttcgccaccctcggcgacgggttgcgcgccgaactgccctccgcgctggcccgggagctcggcgtaccgagggtcgccctcgccgccgacgccgtcaccgcctacacgggcgccctcggcgtccggcccggcgcggtggtcgcggcaggcaccggtctcatcgccgtcggcacggatctccgaagctggcgccgggcggacggctggggccatctgctgggcgactgtggcagcggggcgtggatcgggcgggccggtctcgaggcggcgctgcgggcccacgacggacggccgggcggctctccgcggctgctggcgcgggccgaggagaggttcggtccggtcgcctctctgcccggcaagctctatccgcgcaccgaccgcccggccgtgctcgcctccttcgcacccgaagtggccgcctgcgcaccgggcgacccggtctcggcgggcgtcctgcgcacggcggcccggcacatggcggagtccgcggccgccgtctgcccggcctcggggcatccccaagtcgccctcaccggcggcctgttcaaaatgggcgccccgctcctcgtaccactgggggaggaactggccgtccagctcccgcacgcacggcgggtgacggcggaaggcgacccgttgcacggcgccgtgcgcatcgccctcgacctggccgccggttcgctcactctcccgtgcgacgagcacatgctgtacgtggtgaccgag

SEQ ID NO: 1518 - DNA, 921 bp, Streptomyces avermitilis
  CDS (1)..(921)
atgagctcccccactgggcccgcgtccggcctgcctgtacgaatgccgcgaccccgccagcccgggcggcaccgccgtccggaacccctggcggctcccgagggcgcgcccgcgctcgtcctcgcggtgccgggcacccccagcgccgccacgcgcagcctcgccgaggaggtcgtgagcatcgcgcgctccgagctgcccggcctcgacgcccggatcggctacctggacggggacacctccgagttccccacgcttcagtccgtgctcgtgcgcaccttcgaggagcgcaccgcccgcttcgaacaggcccgcgccgccggtatggacgtcaaggagcccgacggccccgtcgccgtcgtggtgcccctgctcgcgggaccggacagcgcgctgctgcgccaggtccgccaggcggtcatggacagccgtatcgcggccgatctgaccgatgtcctcggcccgcacccgctgctcgccgaggcgctccacgtgcgcctctccgaggccggtctggcccgcgccgaccgggccaggctgttcaccgtggccacggccgcggacggcatcatcctggcctccgtgggtggcgacgaggccgtgcaggcggccgggatcaccggcatgctgctcgccgcgcggctcgccgtgccggtgatggcggcggcgctggacgaagagggctcgatcgcggccaccgccgagcagctgcgttcctcgggctcgcagcagctggcgctcgcgccgtacctgatcggcccggagatcgacgcggggctgctggacgcggccgcccaggaggcgggctgctccgccgccgaggccctcggcccgtacccggcgatcggcaagctcgtgctcgccaagtacacgacggcgctcggtatcgccccgcagcagccgcagggcgcgcccgtccgc

SEQ ID NO: 1519 - DNA, 1038 bp, Streptomyces avermitilis
  CDS (1)..(1038)
gtgacagacggcggcaggcggcgacgacgggcgttcatcgggtcgttcacggcggcgggaggtctcggcgtgctcaccgcggccgtggacgaggacaccggcgcgctgacggtcctgggcggcgcggacggcgtacccgacccgtcgtacctcgccctgtcaccggacggaggcatgctctacgcggtcagcgagacggccgacggcgcggtggccgcgtaccgcgtggaggacgacaagccggaactgaccgctccgccggtcccggtcggcggcagcgggcccacccatctcagcgtgcacgccggtcacgtcctgatcgccaactacggctccggcagtgtcaccgccgttcccctgcgcgccgacggcaccccggcggacgagggggccactgtcctccagcatgccggcgcgggcccggaccccaagcgccagcagagtccgcacgcccaccaggtgctgcccgacccgagcggccggtggatcgtcagtgtcgacctcggcacggactcggtgcgggtgtgcatcctgcacggcggtgcactcgccgtgcaccgcgagatcgcgctgcggcccggttcgggcccccgccatctggccttccacccggacggcgaccgcgcgtacgtactgaacgaactgacacccatggtcaccgtctgccgctgggaccccgccgacggagcgttgaagccggtcgcggagacacccgtgctgcccggcgcccccgaaggcgacgcctacccgtccggaatcgtcgtctcgcccgacggccgcttcgtatggaccgcgacgcgcggcaaggacgtgatctccgtgctcgcggtcgagaaggacggactgcgcctggtcacgacggtgccgtgcggaggagcctggcctcgggcgctgaccctcgcggggcgtttcctgtacgtcgcgaacgagcggtcggggaacgtcacctggttcgccgtcgacccgacgacggggctgccacgcaggggcggctcgatcgaggcgccggcggcgtcctgcgtggtcttcgaccgggtc

SEQ ID NO: 1520 - DNA, 1815 bp, Streptomyces avermitilis
  CDS (1)..(1815)
atgcggaacttcccacgccgacacggcgacggaagtaccggaagcgccgggaatacggctggtacgggaagcaccgggtcccggccgcagtggccggaggagccaggaggctggctcgaccgggcccgggcccaccgtgacggcgcggatacggatcccccggcatcccacgagcccgccaccggcggcgcgggacgtggcctgcggaccgcggagccgcctgatacgggccagggcctgcggaccgccacgggacagggcccgcgcatggccgacccatccggtgtcgggcggggccggggcgtatggacggccgacggatccggtaccggatcgatcacgggcctccagggccgcttactggccgacgctccgccggaaagtgccgcgagtcgaccgggcggggacgcgcgcgatcggcacggcgcgccctcccgcgcacgcggctggagcacggagacgtggtgcgcgccgcacggtcgcaaggacaccgcgggggagtccgagcacagaccccctgggccgaccctcccaggcgcccgcgggtggggcgcggcgcgcacccgcggtgaccgcccggacgggcatccggaccacccgaccggcagccccaccaccgacgggccggcccggcccgcccggcccgaccggcgtgaagaaggcgacggccatgacgggcacgagggccaggacggtcacgacgggcacgatctcctctgcgccgccaccgcgttcctcaccctccaccacaccgaagaacgcctcggcgacccggcccgccgcatcgccgccgcgcacgcggagatcgcggagacagggacgtaccgacacaccacggaagaactggtcttcggcgcccgggtcgcctggcggaacgccaatcgatgcatagggcggctgtactggcactccctgtgcgtacgcgaccgccgggacgtgcgggacgcaaaggacgtcgccgaggcttcggcggaccacctgcgggaggccacccgggacggccgtatccgcgccctgatcacggtgttcgcacccgacgcgcccggccgtccaggaccgcggatctggaacgagcagctcatccggtacgccggctacgcccgccccggcggcgcagtcaccggtgacccgcgcaacgccggtctgaccgcgctcgcccgtcgcctcggctggcccggcggccccggcagcccgttcgacgtgctgccgctgatcgtgcagagcgcgggcgaccggccccgttggttcacgctgcccgaggacgccgtgctcgaagtggcgctcacgcaccccgagtacccctggtggcggtcgctcggactgcgctggcacgcggtgcccgccctggccggcatgtgtctggagagcggcggcatctgctacccggcggcccccttcaacggctggtacatgggtaccgagatcggcgcccgcaacctcgccgacgccgaccgctacgacctcctgccgcacctcgccgaccgcctcggcctcgacacccgcagcgaccgctccctgtggaaggaccgcgcgctcgtcgagctcaaccgctccgtcctgcactccttcgaccgcgccggtgtcaccgtcaccgatcaccacaccgagtcccttcgtttcctcacccacctggaccgcgaggagcgcaagggccgccgggtcggtgccgactggtcctggatcgtgccgccgatctccggcagcgccaccccggtcttccaccgcacgtacgagacggtggaacggcaccccgcctacgtccaccatccggaggcgctggcccgggcgcgcggtgagatcgacgagattctggtc

SEQ ID NO: 1521 - DNA, 222 bp, Streptomyces avermitilis
  CDS (1)..(222)
atgtccggaccactgcccgtgatcgtgtcgccgccctcgccgacgggcggacggcgcgtccgtgtggacggggagatcctgggactcgcgtacaacctgggggatgtcgccgagttcctccgtcgggccgggatggacatggagccggtgcaggtggccgtctcaccgctgatcgactggcgcggtgtggggccggagtactgggggccggagacgcgagcc

SEQ ID NO: 1522 - DNA, 348 bp, Streptomyces avermitilis
  CDS (1)..(348)
ttgacatccgaggcatacgagcgccctgcggcccaggaaccgtatgagcaggaactctccaaggcccgactggaggatgagaacctccagctcaagcaggcggtgctgtcgcacgccacgatcgaccaggcgatcggtgtcgtcgtcgtgctgggcgggctggcacccggccggagctgggacgtcctgcgggaggtttcgcagcgcaccaacatcaagctgagacacgtggcggaactgatcatcgactgggcccagacgggtgatctgcccagggacatccgcgaggaactcgagagcgggctgcgacaggcgaaatgccgggtcgacggaggagacgggccgctc

SEQ ID NO: 1523 - DNA, 474 bp, Streptomyces avermitilis
  CDS (1)..(474)
atggccgtcgacgaactcgacacccgcatcctgcggttgctgctcgagcagccgcgcaccagcgtgcgcgagtacgcacgcatcctcggcgtggcccgtggcacgctccaggcccgcctcgaccggctggagcgggacggagtcatcaccggcacgggtccggccctctcccccgccgccctcggccacccggtgctcgcgttcgtgcacatcgaggtcacccagggccatctcgacgacgtgggcgacgcgctcgcggccgtaccggagatcgtcgaggcgttctcgatcaccggcggcggcgatctgctgacccgggtggtcgcgcgggacaacgggcatctggaggacgtgatccagtcgctgatcagcatgccgggcgtggtgcgcacccgcaccgaggtggcactgcgcgagcgcgtaccgcaccggctgctgccgctggtggagtcgatcggccgcacggccgccaag

SEQ ID NO: 1524 - DNA, 693 bp, Streptomyces avermitilis
  CDS (1)..(693)
atgagcactctcggcaccacgtcggtcgtcttcgatctcgacggaactcttgtggacagcgagcccaactattacgaggcgggccggcacctcctcgccgagcagggcgtcacggacttcacctgggcggaccacgagcagtacgtcggcatcagcacccaggagagcctggagctgtggaaggagcggtacggcgtcgaggccccgctcgacgacctcctcgcggacatgaaccgccgttatctggcgctggcccgcgcctccacgccggtctacccggagatgcggaagttcgtggaactgctggccggcgagggcgtgccgatggccgtggcctccggttcgtcgccggaggccatcgaggcgatcctgacgggcacgggcctggcgtcgtggctcaccaccgtcgtctccgccgacgaggtcgcccggggcaagcccgcccccgacgtcttcctggaggcggcgcgccggctcggggtgtccccggcggactgtgtggtcctggaggacgccgcccctggggccgcggccgcgcacgccgcccgaatgcgctgcatcgcgatcccctacgtcgccgcccaggccgacgacccggcgttcgcgaccgcggggctactggtgcgcggcggccagaccgagttcaccgcgcgggcggcgtacgagtggctggcgcgctcgacaccgtcttcc

SEQ ID NO: 1525 - DNA, 1158 bp, Streptomyces avermitilis
  CDS (1)..(1158)
gtgcttgacatcgccgaggagctgaaccgctgggtcggggaggggcgcggcttcgccgtggccacggtcgtggccgtcggcggcagcgcgccccgcccgccgggcgccgccctcgccgtcgactccgacggcacggtcatcggctccgtctccggcggctgtgtggaagcagcggtgtacgacagttgcgtccaggcgctccaggacggcaccaccgtcctggagcggttcggctacagcgacgacgacgccttcgcggtggggctcacctgcggcggggtcatcgaggtcctggtcacgccggtcggcgtggacgcacctggccggaccgtgttcgcggcggccctctcggccgccgcccggggggaggccgcggcggtcgtccgcgtgtcccgggggcccgccgaactgctcggccgggccctgctggtccacccggacggatcgtacgaaggaggtctcgacgggcatccccggctggaccggacggcggtggccgaggcccgcgcgatgctggacacgggccgcaccggcacggtcgaggtctcggagagcggagcgcgctgcccgggcggactgacgctgttcgtcgagtcgagcgtgccgccgccccggatgatcgtcttcggggccgtcgacttcgccgccgcgctggtgcgcaccggcaagttcctcggctatcacgtgaccgtgtgcgatgcccgtcccgtcttcgccacccgggtccgcttccccgaggcggacgacctcgtggtcgactggccgcaccgctacctccgggacacgccgaccgacgagcgcacggtgctgtgcgtgctcacccatgacgccaagttcgacgtgccgctgctcgtggaggccctgcggctgccggtcgcgttcgtcggcgcgatgggctcgcgccggacccacgaggaccgcgaccgcagactccgcgaggccggcctcaccccacgtgaactgtcccggctgcgctcaccgatcggcctcgacctcggcgcccgtacgcccgaggagaccgccctgtccatcgcggcagagatcgtcgcggcccgacggggcgggacgggcgtaccactgaccggctcaccgaccccgatccaccacgacctgtccgatgcccccggcccggtgaccgcggggacgagggcggtcgga

SEQ ID NO: 1526 - DNA, 1485 bp, Streptomyces avermitilis
  CDS (1)..(1485)
gtgtgggtggccggcgagctggcccagctgttctccctcgacccggcctcggtgcgggtgcggtcggagcacgtgggcggcggcttcgggtccaagggggtgcgcccgcaccaggtggccgccgtcatggccgcaacggttctgcaccgccccgtcagagtcgtactgacccgtcggcagatgttctcgctggtcggctaccgcagccccacggcgcagcggatcaggctcggtgccgaccccgacgggcggctgcgggccttcgaccaccaggcgcagagcctcacgtcgaccgtgcacgagttcgtcgagtcgagcgccgtcctcggccgtgtgctgtacgacgccgacgcgcaccgcaccactcatcgcctcgtacggctcgacgtgccgaccccgacctggatgcgtgcgccgggcgaggcgccgggctcgttcgcgctggagtcggcgctcgacgaactcgcggagaagtgcggcctggacccgatcgccctgcgcgcgcgcaacgaacccggggcgggccctgtgtccgggctgccgttcagcagccgcaatgtgctcgcctgcttcgaggagggcgcccgcaggttcggctgggcggaccgcgatccgcgtcccggcgtgcgccgcgaggggcgctggctgctcgggaccggtacggcggccgccacgtacccctcgggggtcggcccgtccacggcggcggtgaccgcggaggcggacggcaccttcaccgtgcggatcaacgcggcggacatcgggaccggagcacggaccgcgctgaccctgatcgccgcggaggcgctggccgccgagccgggacgcgtccgcgtgcacatcggggacagcgacctcggtccggcgatgttcgccggcggctcgatgggcacccgctcctgggcctgggcggtgacggccgcggcgggcgagctgcgggagcggctggccctgggcggcggcattccgccggaggggatcaccgcacggtcggacaccaccgaggccgtcggcggcctcgcgaagaaggaacggcactccttcggagcgcagttcgccgaggtcgcggtcgacaccaccaccggcgaggtacgcgtacggcggatgctcggcatcttcgccgcgggccggatcgtcaacccgctcaccgcgcgcagccagttcctcggcggcatggtctggggtctgtccatggcgctgcacgaggaggccgtcagggaccattcctcgggcggcctcgtcggcgccgacttcgcgggctaccacttcgccgcgaacgccgacgtccctctgctcgaggcggactgggtggaggaccccgacccggacgacccggtcgggatcaagggcatcggcgagatcggcgtggtcggtggcgcggcggcgatcgccaacgcggtctggcacgcgaccggcgtacgccaccggcagctcccgatcaggcccgaccgtgtcctgctggcggcggagggatccaggagtgct

SEQ ID NO: 1527 - DNA, 2157 bp, Streptomyces avermitilis
  CDS (1)..(2157)
atgaccacgaccacccagggcgccgcccgggcgacgggtgccgtcggaaccgcgcacacccgcgtcgagggccgcgacaaggtcaccggagcggcacgctacgccggagagattccgtacgacgaactggcccacggctggctggtgttgtccaccgtcgcccgtggccgtgtccgcacggtcgagtccgaccccgtcctcgcgatgccgggtgtcctcgccgtcctgcaccacgccaacgcgccgcgcgtcaccaccgactacatcggcatcgtggggcgtcccgacccggccctggggatcttccaggacgaccgggtgccgtacgtcggctggccggtggcgctcgtcgtggccgagacttcggagcaggccagggaagcggccgaggcactggtcgtccgctacgacgaggagccgcacgacgtcgagttcttcgccgggcatcccggtctgtacacgccgcaggacagcccgctcgtgcaggcggaggcggtgaagggcgacgtggaggccgaactggcggcgtccgacgtcgtcgtggacgcggagtacgccactcccggaggcgtaccactgcccgctggagccgcacgcggcgacggcccgctgggacagcggccggctcgacgtcgtcgactccaaccagagcaccgtgtgggtggccggcgagctggcccagctgttctccctcgacccggcctcggtgcgggtgcggtcggagcacgtgggcggcggcttcgggtccaagggggtgcgcccgcaccaggtggccgccgtcatggccgcaacggttctgcaccgccccgtcagagtcgtactgacccgtcggcagatgttctcgctggtcggctaccgcagccccacggcgcagcggatcaggctcggtgccgaccccgacgggcggctgcgggccttcgaccaccaggcgcagagcctcacgtcgaccgtgcacgagttcgtcgagtcgagcgccgtcctcggccgtgtgctgtacgacgccgacgcgcaccgcaccactcatcgcctcgtacggctcgacgtgccgaccccgacctggatgcgtgcgccgggcgaggcgccgggctcgttcgcgctggagtcggcgctcgacgaactcgcggagaagtgcggcctggacccgatcgccctgcgcgcgcgcaacgaacccggggcgggccctgtgtccgggctgccgttcagcagccgcaatgtgctcgcctgcttcgaggagggcgcccgcaggttcggctgggcggaccgcgatccgcgtcccggcgtgcgccgcgaggggcgctggctgctcgggaccggtacggcggccgccacgtacccctcgggggtcggcccgtccacggcggcggtgaccgcggaggcggacggcaccttcaccgtgcggatcaacgcggcggacatcgggaccggagcacggaccgcgctgaccctgatcgccgcggaggcgctggccgccgagccgggacgcgtccgcgtgcacatcggggacagcgacctcggtccggcgatgttcgccggcggctcgatgggcacccgctcctgggcctgggcggtgacggccgcggcgggcgagctgcgggagcggctggccctgggcggcggcattccgccggaggggatcaccgcacggtcggacaccaccgaggccgtcggcggcctcgcgaagaaggaacggcactccttcggagcgcagttcgccgaggtcgcggtcgacaccaccaccggcgaggtacgcgtacggcggatgctcggcatcttcgccgcgggccggatcgtcaacccgctcaccgcgcgcagccagttcctcggcggcatggtctggggtctgtccatggcgctgcacgaggaggccgtcagggaccattcctcgggcggcctcgtcggcgccgacttcgcgggctaccacttcgccgcgaacgccgacgtccctctgctcgaggcggactgggtggaggaccccgacccggacgacccggtcgggatcaagggcatcggcgagatcggcgtggtcggtggcgcggcggcgatcgccaacgcggtctggcacgcgaccggcgtacgccaccggcagctcccgatcaggcccgaccgtgtcctgctggcggcggagggatccaggagtgcttgacatcgccgaggagc

SEQ ID NO: 1528 - DNA, 990 bp, Streptomyces avermitilis
  CDS (1)..(990)
atgagggagttcgactatcagcgggcgttcgacgtcccgggcgcggtcgcgttgctcggcgccgatcccgacgcgcgcttcctcggcggcggcaccaatctcgtcgacctgatgaagtccggcgtggagcggcccggccgtctcgtcgacgtacgtgagcttcccctggacctcgtcgagccgaccccggaaggcggactgcgcatcggcgccaccgtcaccaacagcgatcttgccgtccaccccgacgtgcggcgtcgctacccggcgttggcgcaggccgtcctggccggcgcctcgggccagctgcgcaacatggccaccgtcggcgggaacctgctccagcgcacccgctgcggctacttcaccgacctcgcccaaccctgcaacaagcgtctccccggcagcggttgccccgccgtcgagggcgagcaccacaaccacgcgatcctcggcgcctccgcccactgcgtggccacccatccctcggacatggcggtggcgctcgccgccttcgacgcggtcgtctcgtacgaaaccgcggacggagaaggggagttggcactcgcggacttctatctgcccgtcggtgacaccccgcaccgggagaccgccctgccgccgggtgcgctgatcaccggcgtcaccctcccgccgagcccggtcgccgccgtctcgcgctatcggaaggtgcgcgaacgggcgtcgtacgcgttcgcgatcggctcgctcgccgccgccctcgacgtccaggacggcgtcgtacgcgaggtgcgcctcgccttcggcgcggtcgcgtcccggccgtggcgggcccggacggccgagcgggcgctgaccgggcgcccggcgagcgccgaggcgttcgccgccgccgcggacgccgaactgggcgccgccgaggtcctgccgcacaacggatacaaggtgccgctgctgcgcaacctcgtcgtggccgtgttgaccgaactcaccgaggaggccgcccga

SEQ ID NO: 1529 - DNA, 570 bp, Streptomyces avermitilis
  CDS (1)..(570)
atggccccatcgacgtccagcgccatcaccctcaacatcaacggggagaaacacacgctgcccgtcgaccatcgcaccaccctgctcgacgcgctgcgcgagcggctcgatctgacgggtaccaagaagggctgtgaccagggccagtgcggtgcctgcacggtgctcctcgacggacgccgggccgtctcctgcctgcagttggcggtggccgccgaggggcgcgtcatcaccaccatcgaaggcgtggcggacggtgagcaactccacccggtgcagcaggcgttcctcgacctcgacggctaccagtgcggatactgcaccccgggccagatctgttcggccatcgcggtgatcgaggagcacgcggcgggctggccgagcgccgtgaccgccgacgtacgtcccgaagcgggagcgccaccgctcaccgccgacgagatccgcgaacggatgagcggcaacctctgccgctgcggtgcctatgtgtccatagtccaggcggtcgcgcgggcggccgaggcgcacgcggccgacgctcaggcggccgaggtcaaaggggccgcggca

SEQ ID NO: 1530 - DNA, 594 bp, Streptomyces avermitilis
  CDS (1)..(594)
atgccggaaggaggacgggtgcagcagaagaaggaagcaccgctgcgctcggacgcgcaacggaatcgcgagcgcatcctggaagtcgccctggcggagctgacgtgctcggcggacgccccgctcagcgcgatcgcgaagaaggcgggcgtcgggcaggggacgttctaccgcaacttccccaaccgcgaggccctcgtcctggagatctaccgctacgagatgcagcaggtcgccgacaccgcggcccagttgttgcggacccgcgcaccggacgaggccctgcgggagtggatggaccggctcgcccagttcgccatggccaaggcaggcatggccgaggcgattcgcaaggcgaccagcgcgccgggcagcccggccaaaccggggcacgaaccggtgaccgcggccgccgcgctcctgctggacgcgaacgaatcggccggcacgatccgccccggggtgacccccgacgacttcatcctcgccatcgccggcctctggcagatcgacccgcacggcgactggcagccacgcgccgcccgccttctggacctggtcatggacggcctgcgcaccggggcacgcgggcgc

SEQ ID NO: 1531 - DNA, 888 bp, Streptomyces avermitilis
  CDS (1)..(888)
atgaccgacaccctcaccgtgagcgtcctcggcaccggaatcatgggagcggcgatggcccgcaacctcgcccgggccggacacaccgtccgggcctggaaccgcacccgcgccaaggccgagccgctggccgccgacggtgcgcacatcgccgacaccccggccgaggccgtggagggcgccgacgtcgtcctcaccatgctgcacgacggtgacgccgtcctgggcgtcatgcgccaggccgcccccgccctgcgccccgggaccgcctggatccagtcgaccaccgccggcctcgacgccctcaccggcctcgccgacttcgcccgcgagcaccggctggccttcttcgacgcccccgtcctcggcacccgccagcccgccgaagccggacagctcgtcgtcctcgccgccggccccacggagagccgggagaccgtgacgcccgtgttcgacgccgtcggctcccgcacgctgtggaccggcgaggacggcgcggccggcagtgccacccgcctcaagctcgtggccaacagttgggtcatcgccgccaccaacgccaccggagaggtcctcgccctggccaaggccctcggcgtggacccgcagaacttcttcgacgccatcgccggcggccccctcgacatgggctatctgcacgccaaggccgacctcgtcctcaacaacggtctcaccccggccagcttcgccgtgagcacggccgaaaaggacgcccgcctgatcgtccaggccggacaggagcacggcgtccgcctcgacggagccgaggcctccgccgaacgcctccaccgcgccgccgcccagggccacgccgacgaagacatggccgcggtctactacgccagcttcgacgagacacggaccccc

SEQ ID NO: 1532 - DNA, 1698 bp, Streptomyces avermitilis
  CDS (1)..(1698)
ttgttgacaatatcgcgtcgggtcttttacgttcgcaagcgcaagatcagcacagagcgcggccgtgaatgggagagatcaatgaagcacagggcaatgaagcgcaggaccgtcgtcatgggagtcggcgcggcagccggcgtcgtggcggccggcggattcgccttgagcgcgcaggcgtcgggtacgtccggttccaagtcctcggattcttcggacgcgttggttttcgacaaggacgctttcacggttttgacgacgaccatcaccacggacgggggtgacaaggaggtcaagtatcacttctacaaggcgatcacctatgtcgccaagccggtggacgagaagtaccagagcctgaatgtgagtgttccggtcgagatcgacgggacggcggtggatgcgacgaacgcgccgatcctgttcgcgaactcggtgggcggctacatgccgtcgtcggtggcggacgcgaccggggtgggcggcgccgcgatgaccggcatgcccggcggcggcgcgagcgcgtcgcccagcgcctcggcgtcggccggtacgggtgcgggcgaggtgcagtccggcggcaacgggcaggtgaatgccggcggtgagatggtcaacaacggcaagctggccctggcggccggctatgtggtcgtcgagccgggtgcgcgcgggcggacactgacggattccagtggcacgtactacgggacggcaccggccgcgatcgtggacctgaaggccgcggtgcgctacgtccgcttcaacaagggccgcatccccggcaacacggcccggatcgtctcctccggcaccagcgcgggcggcgcgctctcggcgctgctgggcgcgtccggcgacagccccctctacgacagctacctgaaggatctcggggcggccgaggccagcgacgcgatcttcgccagcggcgactggtgcccgatcacggatctggagcacgccgacatggcctacgagtggaactggggtgccaacaagctgagcaccggcacactcgtcgaccagagcgtctccaaggaactgagcaccgccttcgccgactaccaggcctccctcaggctgcgcgccaagggcttcggcgcgctgaccgcacgcaatctggacgactacctgctgcgcacctaccttcagccgtccgccaccacttacctcaagggcctgtcggagacggagcggtcgacgtatctggcggcgaacacgttcatcacctgggacgggaccgtcgcgaccttcacctgggccgacttcctgacccatgtgggagcgcggaagaaggacacgcccgcgttcgacgcgttcgacctgtccgcgggcgagaacaacgagttcggcaccggaaccacccaggcccgccacttcaccctgtacagcctgcggcacgagaagggcggcagcgcccggctggacagcgaccttcccaccaagctcgatctgatgaacccgatgtaccacctcgtcaaggagcagaacccccaccggtccaagcactggtggatccgggtcggcaccaaggacagcgacacctccctgtccgtcgtcggcaacctcgccgcgagcctggaacagctcggcgacgacgtcgacacgctctactactgggaccagggccacggcgccaacaccgacgccgccgacttcatcacctggatcgccaaggtcaccggctacaagaag

SEQ ID NO: 1533 - DNA, 1293 bp, Streptomyces avermitilis
  CDS (1)..(1293)
gtggtgcaggcggcagtcgggggaggggcaccggtcatggcgacccgcatcgaacaggtagggcaggcgctgccggagcggcgtccggagctcgacgccatccggatgctcgtggtgttcgggctgatcttcttccactcggccctcgtcttcgcgacggacgacgactactacgtcaagaactccgagaccacgcaagtcatcatgatcctggccggcttcgcggtcgtctgggcgatgccggtgctgttcctgatctccggcctgggctcgtggtactcgctgcgccgccgcggcgcggcgggcttcgtcaaggaacgcctgttgcgcctgggcgtgccgctggtcttcgccaccctcgtcctgaaccccctgccgcagtggctgcgcctgcgctccgcggaccccggctacgacgagtcctacctcgccttcctccctcacttctacgacgtgcatgtcgaactcgccgagttccccttcctcttgcagggcgagcacttcgagaccggccacctctggttcgtggtgctgctgctcgccttctccctgatgctggcgttcctgttccgcgtgctcgcggcggatcgcctccgacccgtcaccgaccggctggcgcaggccaccttccgcgtccgcggggcgatccttctgccggcgcttccgctcgccctgctctgcgccttcgccggcctggaggaggactacgccggctggcatcgctgggcctatctggtgttcttcgccgcgggctgcgccctcgccgccgatgaccgcgtccgcaccgccatgcgccgggccgcggtgccggccggccggctggggggtgtcctgttcgccctgtccggccccggcttcgccgtcgcggacgagcccttcaccgagatgaccgccctgggcatggcgacccgcgcgttcttcggggcggccggctggtgcctggtcgtcgccatcctcggccacctcgaccggcgccgcgcggcgcgggccgtcggccggactcccgacccgctctcttccgggcgccaccgcgtgtacgcctacctgggcgccgccgtgctgccggtctacgtactgcaccagcccgtcgtcgtggccgtcgcgtacttcgtcgtgggctggaacgccccgatccccgtcgaatacgcggtgatcgtgatcatctccctggctgtcaccctgtcggtctacgagctcctggtgcggcgcacgcgtgtgacgcggttccttctcggaatgcgggtcaatacacctgaccgaccgccacggcccgggacttccccgcgctcccgc

SEQ ID NO: 1534 - DNA, 597 bp, Streptomyces avermitilis
  CDS (1)..(597)
gtgggcgttccggcggtcgccggctgcatgcctgttcgcctcggccgcctatcgccgtccggaggcaggtacatggggaaggtgctcggcgatgtcggcgggtcggaaggagcttccggccacgggcagccggccacctgggtcgggggggggctcaagctgggcctgggagtgctgctcgcgctgttcggtgtccggctgtggcaccggcgccccagggacgtctcccaggcgcgactgccgaagtggatggccgcgatcgacagcttcaccccagtcaagatcttcgggctcgcgctgctgctgtcggcggccaacatcaagaacgccacgttcaccatcgccgcgagcgcctcgatcagctcgtccgggattccgttggggcagcagatcggggcgctggcggtgttcgtggtcatcgcgtctctggggatcctggcgccgctggcggtcttcctgatcgcgggagagcgagcacggaacacgctcgacggctggaagaactgggccgcacagcacaacatccccgtgatggcggtgctgtgtttcgtgatcgggctgaagctgctcggggacggcatcgccatcctcaccggt

SEQ ID NO: 1535 - DNA, 552 bp, Streptomyces avermitilis
  CDS (1)..(552)
gtggccgaggagacggccgcgccaaaagccgacgccgcagcaccgaggagtttcacgttgagcgacacgacagcaggtcccgtgggcacgcggggcacgcgggtcttcatcgacaagcagagcccgaaggcctatcacgcgttggtcgaaacctccgaggcggtccgcgcggtcgccgccgacgcggggctggaccgtgtgctcgtggagctgatcaatctccgcgtgtcgcagatcaacggctgtgcgtactgcctcagcctgcacacgaaggcagcgctgcgggtgggtgagactacccagcgcctcggtgtgctggcggcgtggcgcgacaccgaactgttcacatcacgggaacgcgcggccctcgccctggcggaggtgaccaccgaccccgcggacgccaccgcgcaggagcacgcctacgacgccgcccgccaggttctcaccgacgacgagatctccgcggtgatctgggtggcggtcaccatcaacgctttcaaccgggtctccatcatgagcaagcaccctgtgcgcgggatcccccaccag

SEQ ID NO: 1536 - DNA, 468 bp, Streptomyces avermitilis
  CDS (1)..(468)
atgcggatctccgtctcctcggacatggacgaacccgtggcccgctctctgctcgcggaactgcgcggccgcggccacgaggtcgtggcgcacggcgcgctgcgccccggcgacgacacgcggtgggcggcgtgctcggcggcggcggcccgggaggtcgccaccgggacgtcggaccaggcggtcgtgtgctgctggaccggcacgggcgcgtcgatcgccgcgaacaaggtgcccggcgtgcgggcggctctgtgcacggacgcgtacacggcggacggcgcacgccgctggaacgacgccaacgtgctggcgctcagcctgcggctgacgtcccagcccctgctcagggagatcctcgacgcctggttcgccgccgaggccggcgaggacgccgacgaccgggagaacgtggcgcacgtcgggcggctggacgcggacaggaccgggggcgccgccgaccgcggg

SEQ ID NO: 1537 - DNA, 798 bp, Streptomyces avermitilis
  CDS (1)..(798)
atgccgcagctcgctgtcgacggcgcaggaatgacgtacgacgacgagggcccgcacgacggtgacggcggtgtgcctctggtgttcatccacggctggacggccgaccggcaccgctgggaccaccagatggcgcacttcgccgacaagcgccgggtggtccggctcgacctgcgcgggcacggggagagcgggggttcggcgcggacgatcgacgagctggccggggacgtcatcgctctcctcgaccacctggagatcgaccggttcatacccgtcggccactcgatgggcgggatgatcgcgcagaccctcgcgctcgcccaccccgagcggatcgagcgcctggtgctggtgaactcgatcagccggatgacctacagccgggggcgggggctgctgatggcggcgtccacgctggtgccgttcaagctgttcgtcgccgccaacatccagcgggcgttcgcccccggtcacccgcgcgaggaggtccgggagtacatccgggcctcctcggcgacgccgcgggacgtggtcatgacgtactacgcggccatgcggtccttcgacgtcctcgaccgggtcggcgagatccggatgcccaccctgctggtgcacggctactacgacatccagttgcccgtctcacagatgctgcggatggcgaaggactacccggacgcggtggtccggatcgtggacgccggccacgaactgccggtggagaagcccgcggagctgacctcggcgctggaccggttcgtgaccggccaagtgggaggcgtccagctcgtcggc

SEQ ID NO: 1538 - DNA, 1134 bp, Streptomyces avermitilis
  CDS (1)..(1134)
atgatcttcaggacgaccgactccaccaccaggccggcgctccgcagggtcaggaccaccacgaccctgcgcccgctccaccaccgcctcgatcccgcgcgcgtcgaggagatccccttccgcgcgggggacggggtccggctcggcctgacccgcgtcgacagcggcgagcccgaccggcccgcggtgctgctcctgcacggacacaccgcgtccgccgacatgttcttgctgcccgagacccgcaacctcgtcgacgccctcctcgacgacggctacgagccctggctgctcgactggcgcggcagttgccggctgccgtacaacgagaccggccagaagtacacgtacgacgacgtcgccctgtacgacatccccgcggccgtctcccacatccgcgggcgcatcggcgaccggccgttgttcgtggtcgcccactgcatcggctcgctcacgctgtcgctgagcatgacggcggggctggtgccggggctcgcgggcgtcgtgtcgcagggcgtgttcctgacgccgaagctcgcgggccggacctcgctgcggatgtcggtggccggagagctgctgaaaacccggatcgatcacatcccggtcgacttccgcaaggtgggcctctggtcgaagtacacgccgctgttcgcactggcctcccgcaaggcgagctgcccggacccgacctgtcagatcctgcacaactcggcgtgggggacgggcgcctcgctgttcgtgcacgagcacctgtccgaggccacccacgaccggctcgccgagctgctaggccccgcgccgctgtggatcctgccgcatctgcgccggatcgagctggcccgcagcgtggtccgctggcacgacaccgaccaccgctaccgggagttgccgcagaacgcgctggacgcggccggccgtatcgacaccccggtcctgctgatcgcgggcagcgagaacgggctgtggctcgactcccagaagctctgtcacgacgtactcgcgcgcaggcagccgtacttggacgtctcgtacaccgagattcccggctacggtcacctcgacacgttcctcggccggggcgccgccctcgacgtgttcggtcacattctcgacttcctgggcgaacggcgg

SEQ ID NO: 1539 - DNA, 2526 bp, Streptomyces avermitilis
  CDS (1)..(2526)
atgcgtgaggtgaacgagggcgcgtcggcgtaccccggacagcgggcgaccggcgagtcgatcgaacggggcggcggcgggctcagcgtgagcgacctgctggccaaggtcatgacggccgccgcgccccagccgaccggcagcggtacggagtcggggcccggcgccggtccgacggccggtccgtcgctcgatgtggacggcctcgccgtcgccgtcgccgccaccgcgggccgctatctgcctggggggcacctgtcgccggacagtgacttcttcgacgccgggggcacgtccgtgcacgccgtggaactcgtcgcggagctggaacgcgagctgggcatggagatcgccctggacgacgtgttcgccgacgcccggccgcgcaccctcgcccggcggtggctgtcggccggcggcgccccggccgcccactcagcaactccggcgaccccggagcccaccgcggccggcgtcgccgcgacgggcgtcaccgcgattggcgccactgcggccggtgccgccgtggccggtgccaccgcggccggcgtcgccgcgaccccgggcctcctcccgctctccgccgcgggcacccgtccggcgcccgccccgagcggcctccccgtcccgtccccccgcaccccaccggcggtggcggccaccccgccgcccgggagcggcgacgccccctactccaccgcccgccgcgaggacctcgaccagatcctggccgacctcgcgctcgccgatcgcctgccctggaccggcgcgcccgagccgctgccgccgcgccggatcctgctgaccggcgcgaccggcttcctcggcagccacatgcttctcgacctgctgcggcacagcgacgcccacgtctactgcctggtccgcgccgccgacgaggaggcggccaccgcccggctgggccaggcgctgaagggctacgagctgccctggtcgtcggaggtccgccgccgggtgaccgtgctccccggagacatccggcacccgcgcctcggcctgtccgacgacctgtggaacaccctcgcccacgagctggacagcgtcgtcggcgtggcggcggccgtggacttcctgcgcggctacccctcgctgcggcagagcaacgtcctcggcgcgctgaccctggccgaactggcggcgaccggccggcccaagccgctgcaccacatctcctcgatcgcggtcttcaacgaggtcggcatcaccgccatgggcgaggacgacccgctcgcccgcgtagaccggctcgtcgcgggctacgaccagacgaagtggaccgccgaagtcgcgctgcggcgagcccgcgaccacggtctgctggtcacggcgatgcgcccgggcggcatcggcggccacaccaggaccggcgcctacaacccccaggacctcagcagcggcctcatctcggccttcggccgcttccgcaccgtgcccgcgttccgctacctgaacgcggccccggtggactgggtgagccgggtcgcggtcggcgtcatctgcgaacccgacgcctggggctacgactacaacctgaccggcgtgcccaacaccctcgacgacgtcgtacaggacatggcgctcggcggcatgcacgtgcgcgtacaggactgggacgagtggcgcaccgacgccctggcccgcctggaggccgacccggtgcccgaactcgccttcctgacaagggtgttgcggagccccaccgccctcaagctgtgcgaggcgacactgaagggcccggcggcccacgacgaccgcaccgccgcgctcgtcgaggcgctcgggctcgggcccgcggcccgctacgacgcccaggcgcagctcaggacgttcgagcggctggcccgcgacggcctcgcccggctgccgcacaaggacgaccagccgtacctgtggttctccgagaggaccgagggcggcgtcggcccggtcggcgcccccgccgacaccccctgctcgatggcgctcaccctgtccatcgcgagcatgtaccagctggtgaaggagcgccgggtggacgtcagcggcgagctggtgtgcgcggcggtgcaccccgagccgctgacggtggagcgcggtgacgtctggatccgccccgaggagggcatcccggaacagcacggtatgcgacatcaactcctgcgctaccggctggagttgcgtgacaccgacggcggccactggtggctcgagggccacaagtacgcccgggcccgccgcgacgtgtggcggcagacccgcgcgctgaccgtcgagatcggccgtgcgggcgaaccggcgcgactgacgggcgaggtcgtcgtaccggcggacagctatgtgcgcgaccagatcgacggcatcaaggtcgacccgcgcctgaccagccaggagaagcgggccgccaagctgacctggctcgcctggttcggccttgaggtgggccgcggtctgctcggccccttcgcccgggtcgccgcggacctgctcgacctgcgccgcaacccgaccctcacggagcgcaaccga

SEQ ID NO: 1540 - DNA, 14427 bp, Streptomyces avermitilis
  CDS (1)..(14427)
gtgcgggcctggctgtcggcggccgtcgccgacgcggccgggctccaggcgccggtcatcgacctggaccggccgatagccgaattcggcctcagctcccgccagttggtcactctggccgcggaactctcccagcggatcgaccggcccctgaacccgtccctcgtcttcgaccaccccaccatcgcggggatcgccgaggcggtcttcgacgaaagtcccgtcggcgcgacggcggcggacccggcgcctgcggacgcgccgcccgcacgggcggacgacgacatcgccatcgtctccatggcctgccgcttccccggcggcgccgacgaccccgaggcgctgtggcggctgctgaccgcgggcgaggacgccatctcggaggtgcccgcgggccgttgggacacccaggggctctacgaccccgacccggaggccaccggcaaggcgtacaccctgcggggcggcttcctctccgacatcgaccgtttcgacgcgtccttcttcggaatctcaccgcgcgaggccgcggccatggacccgcagcagcggctgctcctcgggaccgcctgggagacgatcgaacgtgccgggatcgtcccggagacgctgaacggcagctccacgggcgtctacatcggtctgtacgacagcggataccaggcctcggcctcactgggtcggctcgacgggcacgtcggcaccggctccgcgtccagcgtggcctccggccgcatctcctacaccctcggcctccagggcccggcggtgaccgtcgacaccgcctgctcctcctccctcgtcgccctgcacctggcggcgcgggcgctggcggacggcgagtgcgacctcgcgctgacgggcggcgccaccctgctggtgaccccgcgcgggcacgtcgagttcagcaggctgcgcgggctgtcgccgtccgggcggtgcagcccgttctccaccgaggcggacggcgtggtgtgggccgagggctgcggtctggtcctgctcaagcggctcgcggacgcgcgccgggacggcgaccgggtcctcgcggtcgtcaaggggtcggcgatcaaccaggacggccgcagccagggcctcagcgccccgagcggcccggcgcaggagcgggtgctgcgcgccgccctggacgccgccgggctccggccagacgacctggactacgtcgaggcgcacggtacgggcacgccgctcggcgaccccatcgagggccgggcgctgaccgccgtcttcgggccgggccgccccgccgaccggccgctcggcgtcggctccctgaagtccaacctcggtcacacacaggccgcggcgggcatcggcggcgtcatcaagacggtgctggccctcggccaccaactgctcccggcatcgctgcacgccgagaccccgaccgaacacatcgactgggcgggcggcggcctgcgcgtgcacagcaccgcggcggggtggccgcgcgacgtcgaccgggtgcggcgggccggagtgagcgcgttcgggatcagcggtacgaacgcgcacgtggttctggaggaggcaccgcacgacctgacgcggcccacgggcgagccgcagagtcccgagcagccgacggccgaagagaccgctccccacctgcccgctccccacctgccagccccccacctgaccggaaagaccctcttcccgctctccgcccgcaccctccccgccctccggggccaggccggccgtctcctcgaagcgctcagcgcggatccgcagacgccgctgcccgaggcggccgccacgctggcccaccaccgcacgcacttcgagcaccgggccgtcgtccaggcgggcgaccgcgacgaactgctgaccgcactgcgcgggctggccgagggacagccggacaccgacagggtcgccggcccccaacaagccctccccccggggaagctggccttcgtcttccccggccaaggcgcccagtggaccggcatggcccgcgatctgctggaccgctccccggtgttcgcggacgaactcgaccgctgcgacgccgccctgcgcccgttcaccacctggtcggtggcggccgtcctgcgcggcgacgcgggcgccccgtcgccggaccgggtggacgtcgtccagccggtcctcttcgccgtgatgatgtccctggccgccgtgtggcgggcccgtggcgtacggccggacgccgtgatcgggcacagccagggcgaggtcgccgcggcctgcgtcgccggggcgctcagcctcaacgacgcggcggcggtggtcgccctgcgcagccaggccctgaccgagctgtccggcaccggagccatggccgtcgtcgccctgccgcacaccgaggtcgaggcccacctcgccggcctcgacggccgggtgtccgtcgcagccgtgaacagcggccggtccacggtgatcgccggcgacgtggagccactggaagccctgctcgccgacctcgaccggcagcaggtgttcgtccgccgcctcgacgtcgactacgcctcccacagcgcccaggtcgagcaggtccgcgcggccgtcctcgacgaactcgacgggatcaccacctgcccgacgtccgtcgcctggtactccacggtcctgggcgaaccggtcaccgaggaactggaagccgactactggtacaccaacctccgggaacccgtccgcttcgcgcccaccgtggaacgcatggcggccgacggctaccggtacttcgtggaactcagcccccatccgtccctgctcaccgccctgcgcaccgtcgtcgaagacgccgatgccgccgaggccgctgaagacacagcccccgacctggtcgccgtcggatcgctccgtcgcgacgaggacgggcccgcctgcctggaccgggccgccgccgaactccacgtccacggacggcggatcgactggcgccgtctggtcgccgacgcaccccgcgcggatctgccgacgtacgcctgggacccgcagcgccactggatcgaaccggaagcggccgccggcgcccccggtctcttcgaccgtgccgcgcatccgttgctcggcatccagttgcagtcggcggacgagacccgctggaccttccgcaacgagtggtccccggccaccgccgactggctgcccgaccacgccgtgttcggccggaccgtggtgtcgggcacgacgctgatggaactgtgccgcgccgcgctcgccgtggcccgcccggacgccccgggggacgtcaccgacctgttcctcctgacgcccctcaccctgcccgggtccggcacggtcgaggtgtccgtcgaggtggtcaccgccggtcccgtaccggagatcaccgtgcacagccgtccgcgcggccaggagggcacgggctggaccctgcacgccaccgcgtcggcggccgaggccgctccggtgacgcaagggcccttgccggtgtggccggaggcggccgggacggcctggagccccaagacgtacgagcggctggcccgcctcggcctcggctacggcccggccttccagggcgtacgggcggcggtgacgaccggcgacggcgagctgctggccaggctctcgctgccgaccgtggcccgcgatgtcgccgacccctacccgctccacccggcggtgctggacgccgcactgcacgtggccgccgtgttcgacgcgggcgacgcgtccgacggccgggtgctgctgccggtcgcggtgggccgctgcgtcctgccgcacggcggagcgaccgaactgaccgcgcgcgtaaggcggtcgggcggttccgggacggacctcacgctcgacgtgacgctgtgggacgccgacggaatcccggcgggccgcctggagggcgtacggctgcgggccgcgaacccggcggacctgggcaccggctccgagaacgggcggcacctgtacgaggtggcgtggacggccgtacccgaggagcccgccggggcgccgggcaccgagtggaccgtcctcggcgacccctcggacccggaggccgcggcggccctgcgcggcctcgcggcggcggggatcacggtgggcgagacgggcgcggacgtccgcgtacggttctggccgcgcccggcgtccgacgtcgaaccggccgccgcggcacaggagttggcggccacggcactggccgaactccaggcgctgctcgccctccccgaggacgaggcgcccacccggacggtttgggtgacccatggcgcggtcgcggccggcgagggggacacggtgcccggcctcgcccagtcggtgctgtggggcctcgcccgcagcgcccgcaccgaacaccccggcctcgggctgaccctgctcgacctcgacggctccgatcccgggggtgccctgccggtcgccgtcgcgtacgccggtgaacccgaactcgcgctccgggcaggcacgttgctcgtcccgcggctggtgcgggcccgcgccgcacaggcgttgccgatcccggccgatgaccactacgagctggccggcctcccggcggacgtgaccctgcgcgcggtggcgccccgggccctggcccccggccaggtccggatccaggtgcacgcggcacgcgtacacccctccggtgacgacgcgccggacgccgtgtcggccggtgtgctcaccgaggtcggcgccgacgtcgagggactcgccctcggcctgcgggtcgtcgccgtcgccgacaccgcgcccggctccgcggcggtcgccgacgcgcggctggtcgtggcgctcccggacggcctgccgttcaccaccgcggtcacgctgcccggggaacacgccgatgccgtcgcaccaggccgcgcagagctcggtgcggctctgcgcgaggccgtcgcgtcggtcgccgccgggcacacgcgtcccacgcgcccgcgggcgtggcccgtcaccgccgcgcgcgaggcgatacggagaggcggccccgtcgtcctcgacctggtcggccgccccaccctggcgcccaccgacggcacggtgctgatcaccggcggcctgggcgcggtcggccggcacatcgcccggctcctcgccgaacacggcgtcccccggctgctgctgacctcccgtcagggcgccgacgacccgcgcgccgccgaggtgcgagcggaactggccgcgctcggcgccgaggtcgaggtggcggcgtgcgacgtcgcggacgccgcggccctggccgacgtactcggccgcatcggcgacgagttgccgctgcgcggcgtcgtgcactgcgcgggcgtcctggccgacggggtggtcgccgagctgacgcccgaacgcctcacgcgggtcctgcgccccaaggtcgacggcgccgcccatctgcaccggctcaccgccgacgtaccgctcgacctgttcctgctggtctcctccgccgccggcgtcctcggcaccgcggggcagagcaactacgcggcggccaatgtcttcctcgaccaactggcccaccatcgccgggcgctgggcctgcccggcgtctcggtctccttcggcgcctgggcgggcgagggactggccgccgaacacgccgacctggaacggatggcccgcctcggccaccgcgccctcacccccgaccagggccgcgaactcgtcgaactctccctgcgccggggcgcaccgcacctggtcgcctggtccctggacctgccccgcctgcgcgagacgacggcggccggcgacgacacggcggcggccttgtggcgctcgctgctccccgcgccccgcaccggccaggacggcgccgacggcctggcggaccgcctggcccggctgccggaggccgaacgcgccgaacgcgtcctggccctggtccgcgaggaggcctcccgcgccctgggcctgcgctcggcccagtcggtccgccccgaccagccgctgcgcgaactcggcatggactcggtcacggcggtcgaactgcgcaaccgcatcggcacccgcatcggcgccaagctccccgccaccctgctgttcgaccaccccacgccgtcccggctcgccgagtacctgctgaccacagcgctcgcgacggccggccggccggcccgccggaccgcacccggcgcccagccggcccgcacggcgacgcccgcgtccgacgagccggtggccgtggtgagcatggcctgccgcctgcccggcggggtgagcgacccggagggtctgtggcacctggtcgcccagggccgtgacgcggtcggcccgttcccggcgggccgctgggacgtggagtcgctgtacgaccccgacccggaggccctcggcaagtcgtacgcccgggaaggcggtttcctggacggcatcgagtccttcgacgcgggcttcttcgggatcaccccgaaggaagcggcggccatggacccgcagcagcggctgctgctggagatggcgtgggaggcactggagcgcgccggtaccgtgcccgccgaactggcgggcagcaccaccggtgtgtacgtcggcatgttcggcagcgactatctcgcgggctcccggctcgaccagctggacgggtacgtcggtacggggtcggcgctgagcgtggcctcgggccggctctcgtacgcgctggggctgcacggtcccgcgttgacggtggacacggcgtgctcgtcgtcgctggtcgcgacgcacctggcggcgcaggcactgcggtcgggcgagtgcgacctggcgctcgccggtggtgtgacgttgatggtgacgcccgggaccttcgtggagttcagccgccttcggggcctgtccccgaccggccgctgccgctcgttctccgacgacgccgacggcgccgtctgggccgagggcgcgggcatgctcgtactgaagcggctgagcgacgcgcggcgggacggcgaccaggtgctggcggtgctgcgtggcacggccgtcaaccaggacggccgcagccaggggctgtccgcgccgaacggcccggctcaggaacaggtgatccggcgggcgctggagctgtccgcactgggcgccgccgacatcgactacgtcgaggcgcacggcacgggaaccacactgggcgacccgatcgaggcgaacgcgctgtcggaggtcttcggcgactcgcgtcccgagaaccgtccgctgtacctcgggtcgctcaagtccaacatcgggcatgcgcaggcggcctcgggcgtgctcgggctgatcaaggtggtgcagtcgctgcggcacgggaccctgccgcgcaccctgcacgcgggcacgcccagtcagcacgtcgactgggacggcagcggcctgcacctgctccaggaggcggtggactggccgtcgtcgggggagcgggtgcggcgggccggcgtgagcgccttcgggatcagcggcaccaacgcgcatgtgatcgtggaggaggcaccaccaccggccgcgacggagccgaacgccgaacccatgcccgggaagcggctgttcgcactgtccgggcgcagtgaggccggcgtgcggggccaggccgcgcgactggcccagtacctgaccgaggacgtcgccctgcccgacgtcgcccacaccctggcgcggcaccgcagccacttcgagcggcgcacggcgatcgtggcggccgaccgggacgaactgcgcgccgcgctcgacgcgctggcgaccggacggacaccgctcgtgccgccccgcgaggagcagacgggcaaagtggccttcgtcttcgccgggcacgggggccagtggccgggcatgggcgtggagttgatggccggctcggatgccttccgcgaggagctggcccgcatcgacgaggcggttcggcggcacgtcggctggtcggtgctcaacgtgctgcgggcaccggaggaaatcgccccgctcgaccggaccgagttccttcagccggtgctgttcgcggtcaacgcggcgctggccgccgcctggcgtgcgctcggcatcaccccggacgccgtgatcgggcacagcctgggcgagatcgccgccgcgtacagcgcgggcgccctcaccctggacgctgccgtgaccgtggtgaccaggcgtgcccaggccgtcgtaccgctggcgggcaagggcgggatgctgagcgtggaactgccgcgcgcgcaggtggaggagctgctcgcgccgtacgcgggacggctgttcgtcgcggcggtcaacagcgcgcacgccaccgccgtctcgggcgacgccgaggcactggccgaggtgctccaccgactcgaggagcggaagatccccgcccggcgactgtcgacgccgttcgcctcgcacacccctttgatggatccgctccgcgaggaactgctcgaccggttcgccgatgtgcggggcgcgcggacgccgaccccgctgtactcgacggtgctggccgagcccgtgcccggggaccggctcgacgccgcgtactggtacgcgaacctcagggagcccgtccgtttcgcggacacggtccggcggatgctggacgacggctaccgctacttcgtcgagctgagcccgcacccgtcgctcggcccctcgatcgaggcggtggcggccgaggcaggcatcgacgcggtcggcgtcggctcgctgcgccggcagcaggacgggcgcgacattctgctgcgcaggctgggggagttgtacgcggccgggcacacgcccgactggccggtgctgttcccgacggggcgccgggtcgacctgcccacgtacgccttcgcccgcgaacgccactggctcgcgcccgccccggcctccccggcgggcggcggggggccgctcctcggcacccacgtcgaggccagcgacgagcccgaccggcacctcttccagagcgacctggacctgcgcgacagccgcttcgcctacctgaccgaccaccgggtcaccggcgacgtctggctgcccggcgccgccttcctcgacatggcactggaagccgcttccgcgctgcaggacggcggcgaggtgcggctggccgacgtcaggttcctgcggccgctgcgtctggacgagggtcggcccgtgcggctgcaactggtcctgcggcccgccgaggacggcgtccgggacttcaccatcgcctccgcggtcaccggtgagcggcgtacccgctgggagcggcacgtcagcggacgcgtcacggtcaccgccggggaacccatggccgatgcgcggctcgccgtcctgcgtgagcagtgcaccgaacaggtcgacctgccgggtgtctacgcccggctcgccgccctcggcatcgactacggccccgccttccggggcctggaggagggccgccgcacacactccgcggcgctcggccggctggccgcgcaccccgcagccggtcatctgctgcaccccgcggtcctcgacgccgccttccatacggccgcgctgccgggcgacgcgcccgagggccgggcgttcgtgcccgccgggttcggacggctgcggttcaccgggctgcgcaccacgcccgtgtgggtgacctgcgagctgcggtccatggccggcgacaccgcgaccctggacctgcggctctgggacgagaacgagcaactcgtcctggaagcggaggagttcgagctggccgcgctctccccactggacggcgcgctcttcgagacccgctggcagccgcgcccgcccgcgcaggagccgcccgccacgggcagttggctgatcctggcggacgagacgggcgtggccgtcgagctcgccgagcggctgggctcgtcggtaccgcatgtcatcgtccgcaggggcgaggcgttcggcgtcgaaggacccggccggtacgtcctcgatccggccgatccgcagcaactggcgcacctgctcgacgaggccttcgcggacgggctgcccgagcgggtggtccagttgtccgcgctcgacgctccggcgatcggggaggcccgtacggcggagcaagcggcccggctgtgctgcctgagcaccctgcacctggtgcggacgctcgccgaccgtcccgagggccgggcccctcgtctcttcgtggtcgtacggggcagccaggccgtgggcgacagcacacaggtgacgcaccctcagcaggcgctcgcctggggcttcggtctcgcggtggcgcaggagtacccggagctggcgaccacgctgatcgacctgccgtccacggacggcgtcgacgccctgtgggagcagctccggcacgcggacgacgaacggctggtcgcactgcgggacacgggacgtctggtgccgcgcctggctcgtacgcgcccggacgacggcggtcacggtgagctcaccccggacggcgtgtacctgatcaccggcggtctgggcggcctcggtcgcgtggtcgccgagcggctggtccgccgtggtgcccgcagactggccctgctgagccgaggcaggcccggcgcggacgccgcgggctggatcaagggcctcgaagagcgcggcgtcaccgtgcacctcgcccgcgccgacgtcgccgaccgtgccggtctgacggccgcgctggcggccctgcggcgtgacgccggaccggtcgccggagtcgtccacgcggccggtgtgctcgacgacgccacggtcgcgaacctcacggacgaacgcgtcctgcgcgtgctcgcccccaaggttctgggcaccaccctgctcaccgagctgatcccggaagccgggaacctggtcctgttcgcctcggcggccggtcttctgggctcggccgggcagagcccgtactcggcggcgaacgccttcctcgacgcctgggcgcaccacctttcccgtaccgaccgccgggcgctgagcctcgactggggtgcctgggccggcgtcggcatggtcgccgagtccggcacccgggccgacgagaccagccggtcgggtctggtcgccttctcccccgacgagggcggggaactgttcgagcgggtgctggccacgtcccggcgccagctcgcgcccatcgccctggactgggagatgctggcgctcgacgcggacgcggcgcggacccgcccgctcctgggtgacctggtcaccgtcccgacgggtggggcggactcggacgacctcgtcaagaaggtgttcgcggcgacgacggaccacgaccgtgccgtacggctcgaagcgtacgtacgggccagggtcggcgaggtctgcggaggtgccgtggacgtgtccgggaccacggtcctcaaggaactgggcctggactccctcatgctcgtccggctgcgcaacgccttcgcccgcgagctgggcgtcgaactcccggccgccgcgatgttctcggcgtccgacatccgcggcctcgtacgggccctggtcgcggccctgcccgagcgggacaccgtgacaccggagcagccggccgacgtcacctcggaagtgctggaagtgccggagaccgaactgcggcccgcgacccgcgatgtcgtacgactgctgcgcagcgcccagccgggcatgccgggcgcggcgcacgccgtcggcctggcggtgcggctcaccacgccgaccacccgcgagacgctcaccggcatcctcacccggctcgtcgcacggcacgcggccctgcggaccgcgatcgtgcccggtgccgaaggcgggcggcagctgcgggtggaccgggagccggcgaacccggtgctgcgctggacggacgtggccgccgacgtggaactcgacgccggcgaccggctgcgggaactgctcgagtcaccgttcgacctgacgaccgcggcgctgtggcggttcgaactgctcgacggtggtgcgcggggacagatcctggtgttcggcgcgcaccacgcggtgagcgatcttcagtcgctgctgctcgtggcgggggagatcgacgccgaactgtccggcacctcgctcggcgacaccgtcaccaaccgcgacatagacctgctgatccaggcccagcgcaccgaggggaccgtgccgaccggcgacgggccaggtgctgccgccgcggtcgagtggcgcgaggccttccacggcagtggccgtctcgacctgacactcaccagggagcgcccggccgcgcggtcgtaccgggccggcagtgtgaccgtggcgatccccgacgggctcatggagcgggtgtcggcagccgcgagcgggctagccgtcacgcccgccgccttctgcctcggcacactcaccgtgctgctggcacacaggcgcgagcgtgagcgcttcgtgctggccgtgcccgtggacacgcgcatccacgccgacgcgtacgacgcggtgggcttcttcggcgtgccggtgccgttccctgccgaggcgggggcaggcgagccggtcgagcaggtgctgcgccgcaccgacggccgcctcgagaaggtcctcgcgaagggtgccatgttctcggacgtcctgccgacgctggcgaagcaggggctgtaccggccgaacgcgccgctggtggaggtgtacttcaactacgtacgctcctcggcggggcgcctgacgaacctggaggtgctgccggccgggacgggctggtcggacctcgacctgatgatcaccatgacgccggacgcgggccggatccggctcgaccacaacctcgacatcctggacgcggcggccaccacggacctgggggaggagttcctgcggctgctcgcccgggcggtggaggatccgacggcaccggtgcgtacgacggccgcgagcgaagccccggcagcgacggaagtcctggtcgcgtccgaagtcccgcccgcggccgaagccctggcggtgagcgaagcgccggcagcgacggaagtcccgcccgcgaccgaagtcccgcccgccggcgagcccgctgtcgtcccgccgcgtccgctcgccgtcgccgccaccttcgccctgggcaatctgccgctgatgtgcgagttggcgtgcaacgagggggcgggggcacgggacggcggtgtgacggtcgcggaggcgccgtaccaccatgtgctcgcgagcctgcgggatccttccggcgtcttcgcggacccggccacggcggtgggcgtggtgctgctgcgggcggcggacctggaacggttcgggccggtcgacgacgcgctgctcgccgagctccgcaccgagtacccggccgcgctgcgggccctgtccgagcggacccggaagccgctgatcgtcggcttcccgccgtccgcgcgcgccgacgaccgcctcgagcgctgggacagcgaggtcgccgccgagctggccgggctgcccggcatcgcggtgctgggccccgacgactggacccggcaccacgccgtcggggaacgcttcgacgaacggaccgagaagctcgcccacctccccttcaccccggacttccaggcggcggtggccctgcgcctggccgacgtcgtacgagcggtgcggcgccccgcgccgaaggtgatcgcggtggacggggacgagaccctgtggggcggtgtcgccggggagatcggcccggaggcggtggacctgaccggtccgcgtgccctgctggcgcgcaggctgctgcagtggcgtgccgcgggtgcgctgctggcgctggtcagcaacaacgacgaggacacggtccgggccgtcctggaccgcccggacagcctgctgaaggcggagcacttcagcgtgctctccgccgcctggggcccgaagtcgggtcgcctggccgaggcggcgcgcacgctcaacctcggtacggacagtttcctgttcctcgacgacaacccggtcgagatcgcgggggtgcggtccgcgttgccggaggtgctgtcggtgacctgcccgccgacggccgaactggacgagttcctgggccggttgtggccgctggtcccggcggctgcgacggccgaggacgggctgcgggcacggttctacgagcaggagcgggagcgggacgccgtccgcgaacacgccggtttcgaagagttcctcgcccagctggagctggaggtagacatccgggccctgtccgcggccgacgtccagcgggccgagcaactcgtccgtcgtaccaaccagttcactctccgcgcccggtcggccgacggcggcgatctcacccggtggcgggagtgcggcgaggtgtggacggccgcggcccgggaccggttcggcgactacggccagatcggcctgctcgccgtccgcccgggagagggccaactcgacgtactggcctggatgatgagctgccgggcgctcggccggggtgtcgaggagcgcctgttgcggtggctggccgaccgcgccgaggaactgggctgcgcgaaggtacggctgacggcggagcgcaccccgcgcaacgttccggcccgtcgtctggtcgccgcgctcggcggcggtgaccaggacgacgcgtatctggagaccgtggtcacaccggaccaactgcgggccttccggtcctggcagcagcag

SEQ ID NO: 1541 - DNA, 1722 bp, Streptomyces avermitilis
  CDS (1)..(1722)
atggctcgatccctggtcgacttactgaccaagcacgcctcgcaccagcccgaccggaccgcctaccgctatctcgtcacgggcgaccgtgacggagagatccaggacatctcgtacgggcggctggccgaacggtcccgcgccgtcgcctcctggcttcaggagcgcggcctggccggctcccgcgccatgctgctgtatccgcccggtctcgagttcatctgcggctacctgggctgcctttcggccggggtcgtcgccgtgccgggcgtgcccccgcagggccggtcgcagaaccaccgcgccctgacccggatgaagcgcctgatcgccgacgcggacgccaaggtgatcctgggcggccgtgaggtgatcgccgccctgggcaccatggcggagcacctgcccgaactggccgagatcacctgcgtcgccaccgaggacatcccggacgcggcggccggctcctggcgcgaacccgacctcaccgccgactcggtcgccttcctccagtacacctcagggtcgacctccgctccgcgcggcgtgatggtgacccacgggaacctgctggacaacgaacgggtcatcacggaacggatgggccacactcccgacaccatcgcggagtacgaccacgaactgttcgtcagctggctgcccgtgtaccacgacatgggcctcatcggcccggtgctgaacacggtctacctcggcgcgaccgccacactcttctcgccgctgcacttcctccagcagccgcagcgctggctgaccgccctcagccactaccgcccgcacaccagcggcggccccaacttcgcgtacgagctgtgcctgaagcaggccactcccgacctcctcgacggcctcgacctgagccggtggaaggtcgccttcaacggcgccgaaccggtgcgggccgccaccctgcggcggttcaccgagacgttcggcacggccgggttccgtcgcgaggcgctctacccgtgctacgggctggccgaagccaccctgatggtcaccggcggctcggtggcggccccgcccactctgatcgaggcccccgagaccggaccgcacgccggcgcggcggacgcggcggcggtcggctccggccggcccggccccggtgtgaccctggtgatcgccgacccggagcggcagcaggaactgcccgacggcgaggtcggcgagatctgggtcctgggcgcgagcgtcgccaagggctactggcgcaacaccctcgccacccgcgagagcttccgcgccaccctgaagaaccgtgagggccgcttcctgcggaccggcgacctcggcttcctgcgtgacggcgaactgttcgtcaccggccgcctcaaggacctgatcgtcatcgacggacgcaaccactacccgcaggacctggagctgtcggcggagatgtcccacccggcgctgcggcccggctgcaccgccacgttctccgtggacggcggagtggagggcgaacagcccgtcatcgtcgccgaggcggccccggaggcggcggacgagttcgagaagatcaccgaccggatccgcagcgcgatcggcgaggcccacggactgtcggtgcgtgatgtcgtgctggtccatcccggcaccatccccaagacgtccagcgggaagatccagcgccgcgcctccaggacggcgtacctcgacggcaccctctccgtggtcggcgcggccgccacgaga

SEQ ID NO: 1542 - DNA, 678 bp, Streptomyces avermitilis
  CDS (1)..(678)
gtgatcaacagtggcaatgggactgattacgagagcatgcggttcgaccgcagaggtcaggccgaggccttcgacgccatcggcgaccgctacgacgaggccttcccgcacaaggagggccaggtttccgtcggcgaatggctgatcggatccctgccgccgcgatcccgcgtgctggatctgggctgcggcaccggaatgccgaccgcgcgccagctgacggacgccggcttcgacgtggtgggcgtcgacctgtccggcgggatggtggaactcgcccgcgcgtatgtcccgggtgcgacgttccaccagttggacgtcgccgacctgcgaccgggcggctctcgcgacctgggccgcttcgacgccgtcgcggccttcttctccctgctgatgctcccgcgccccgagattccgctcgcgctgctgacggtccgccatctcctcgttcccggcggcctgttcgccctcgcgatggtggaagccgatgtggacgacttctccatcccgttcgtcggacacaccatccgggtctccggctacctgcgggaggacctgcacacggtcatcgagaccgcgggcttcgagatcgtcaaggagttctcctacacctatgccccctcggtcgccgacgtccctcccgaggaacaggtcttcctctgctgcagacggcgcggc

SEQ ID NO: 1543 - DNA, 1980 bp, Streptomyces avermitilis
  CDS (1)..(1980)
gtgacggagcaccacacccctcatgaaggcccggcccaggcctcccggcagtccggcggcccgctgagcggggccgggcctgtcgcacccgtcacgcccatgggcccgcgggtcacccggacgccccagccgccccccgcgcacggccgccacgacgggggcaggcccgggcagccgggaaaggggccggtcaccccgtcccgtgccgacaccgggcgacacgcgccggaaggggacgctcccgaagcggagtacgccgagggagcggtgccggacagcaccgggccgcagaccgaccgactcaggtatctcgacgtggcgacccggcagatcgcccgcgggatggacctggacgagacgctccgagaactgcaccgggcagccgttcccgcgttcgcggacgtgatattcatccatctgcacgatccgctgccggtcggcgacgagaagtcggccgcgcccgtggccctgcaactgcacagcatcgaccggacgccggagcccgcccacaccggctggtctcgtatgcccgctccgacgagtcttcccctgccctcggatgtggccgagcgcgtccatctcaccgccaccggccggctcgcgacgctcctgctggccgggcggccggcgttcggcgacgcgccggggatcgcgcccgcggtggccgagttgctcgggcccgtggcgagcgtgcccggggctctgccgccgggccgcagactggtcatcgctcccctgcacggccgccaccacgtcatgggcaccgtcgttctcctgcgccggcccgaccggcccgccttcaccggtgacgacctgctggtcgcctcccagctcgcgacccacaccgctctcggcgtccagaaggcggtgatgtacggacacgaggcgtcggtggcggacacccttcagcacaccatgctcccgtcgtcgctgcccgaacccaccggcgtccggctggccagccgatacctgcccgcctcgaagaccgctcaggtcggcggcgactggtacgacgcgatcccgctgcccggcagccgcgtcgcgctgatcgtcggcgacgtcatgggccactccatgacctccgccgcgatcatgggccagctgcgcaccagcgtgcagaccctcgccgggctggacctgcctccggacgaggtcctgcaccatctcgacgagcaggcccagcgcctgggcagcgaccacatcgcgacctgcctctacgccatctacgacccgatatcgcaccggctgctcatggcgagcgccggccacccgcccgcggtgctcctgcaccccgacggccgcggggaagtactccgcatcccgccgggcgccccgatcggcgtcggcggcgtcgccttcgaatccgtggagatgcccgcgcccaccggggcgacccttctgctgtacaccgacggcctggtcgagtcccgcgagacggacgtgggaacgggcgtcgaggcgctgcgtgcccgtctccaggccactgccgacgggcgcgccgccccctcgctggaacggctgtgcgaccaagtgctgggcacgttggggccgggcacccgggacgacgacatcgcgctgctcgccgcccggttcgagggcttccctccggacagcgtggggtactggttcctggccccccacccgctgaccgcgcggcaggcacgccggctgacccgcaggacgctgcggcgctgggggctggagtccctgctcgattcgacggaactcatggtcagcgaggtcgtgacgaacgccgtgcggttcgcctcacggcccatcgcgctgcggctgctccgcaccgacgtgctccgctgcgaggtgaccgacgactcccctcaggtgccccggatgcggcatgccgagccaggtgacgagggcggccgcggcctgtttctggtcaatcaactcgcgcggcgctggggagcgacgcggctgagcacgggcaaggtggtctggttcgagcagctgatcccgaagaag

SEQ ID NO: 1544 - DNA, 1410 bp, Streptomyces avermitilis
  CDS (1)..(1410)
gtgccttctcctcacgcatggccggattgtttcactacctgtccagtcggccagtggtacgggcgtcccgcctcacgaagggtgacgggtatggaagacacaaccggacacccccgcaatgctcagggacaccgcgcctggtgggtagccgccgtcgccggactggccatcgtggtcgccggtgccttttccacgatgcccggcatcctccaaggccccctgcaccgggagttccactggtccaggggctccatcggcctcgccgcctccgtgaacatggtcctctacggcgtcaccgcccccttcgcggcggccctgatggaccgcttcggcatccgccgggtggtcgtcgccgccctcagtgccgtcgccggcggcgccctgctcaccacggtgatgaacgcctcctggcagttcaccctcttctggggcttcctcgtcggtctgggcaccggttccctggcgatgaccttcggcgccacggtcaccaaccgctggttcgtacagcggcgcggcctggtgaccggaatgctctcctcgggcagcgtgctgggccagttggtcttcctgccggcgctgtcctggaccatcgaccactacgactggcgccccgccctcatcactctcgccctggtggccctggccaccgctcccctcgtccggctcacgctgcgggaccatccggccgacctcggccaacgcccctacggcagcgacgccttcgtccccaagccgcctccggtgaccggtgccgcccgtcgcacggtcaccgtgctgcgtgactcggcgcggacccgtccgttctggctgctcgccgctctgttcgcgatctgcggcgcctccaccaacggcatcatgtggacccacttcgccccggccgcccacgatcacggcatgccggtgaccaccgcctccacgctgctggccgtcatcggtgtcttcaacgtcgccggcaccatcggctcgggctggctgaccgaccgcgtggacgcccgccgtctgctcgccgtcttcttcaccctccgcggcgtcctgctcgtcactctgccgctgctgatggccgcgaccgtcaacccgcccatgatggtcttcgtcgtcgtcttcggcctcctggacctcgccacggtcccgcccgtcatcgccctgtgccgccagttccacggtgcggacagcgcgatcgtcttcggctggaccaacgcggcccatcaggtcggcgccgccctggccgcccttctcggcggcgtcgcccgcgacgcgttcggcagttacgacttcgtctgggtactcctgggcgccgcctgcgcggccgccgccctgctcgccctcgtcatccagcggccctccgcgccccggagcaccgaactccgggacactcctgtcccgagcacggcggactgcgcaaccggccgg

SEQ ID NO: 1545 - DNA, 957 bp, Streptomyces avermitilis
  CDS (1)..(957)
gtgcgccccgggctgcttccgatggaactgggcatcgtgcaccgcctgttcggcacagcgcgcggagcggacggccggcgcctgtatgcggtggtgacctgcgctcccgtgcccggcgagatcaccaccgacaccgacttcacgatcaacgtgccctgcgggcccgaagcgctggagggtgccgacacagtgatcgttcctgcggccgtggaggactacaccccgcagaaacgggggcagttggccgccccggtgcgtgccgctctggcccggatccccgacggtgcgcggctggcttcgatctgcaccggatcgttcgtcctcgccgccgccgggctgctggcgggccgccgggcgacgacgcactggaagtcctgcgaggaactgcgcacgctgtacccggagatcgacgtcgaccccgacgtgctgtacaccgacgaccggggtgtgctgacgtccgcgggtgtcgccgccgggatcgatctgtgtctgcacatgatccgcagtgatcacggcgcggaagtggcgaacaccgtggcccgcgacaccgtcgtaccgccccatcgcgagggcggacaggcccagtacatcgaacagcccatccgtgaacccgcggatgcctccacagccgccgcccgcacctacgcgctgcggcatctggaacagccgctcgtcctggaggatctcgcgcgggaggcgtcgatgagcgtgcggaccctgagccgcaagttccgccaggagaccgggatgacgcccatccagtggctggcccaccagcgcctccagcacgcccgtcggctcctggagcagaccgatgaaccggtggaccgcgtcgcggcccgggccggattcggcaccggcaccgcgatgcgccagcgcttcagagaaacgctcggcgtgtcaccgcgcgcgtaccgccataccttccgagggacggcgcggcggcatgcgcccggc

SEQ ID NO: 1546 - DNA, 420 bp, Streptomyces avermitilis
  CDS (1)..(420)
atgtccgatgccttcaccactcgcgtcctgaacgtcgcctccggctcgcaggagacggtcgtcgacctgacccacgactgcgaggccttcctccgcgacacggcggccggccgcgacggcctcctgaacgtcttcgtcccgcacgccacggccggtgtcgcgatcatcgaaacgggcgccggcagcgacgacgacctcctcgccgccctgcacaccctgctccccgctgacgaccgctggcagcaccgccacggcagccccggccacggccgtgaccacgtactcccggccgtcgtggccccacacgcgacccttccggtcatcgacggcaggctgcaactggggacctggcagtcggtgtgtctggtggacacgaaccaggacaatcccaaccgtcaggtgcggctgagctttcttggc

SEQ ID NO: 1547 - DNA, 804 bp, Streptomyces avermitilis
  CDS (1)..(804)
gtgcccgcgctcgaacccatcgtccccgcctccacccgccgcacccgcgtcccgcgctggctgcgccgcacctccggcccggtcctgctgctccttctgtggcaactcctcagcagcacgggcgtgttgacctccgacgtccttgcctcgcccgggcggatcgcccaggtcgcccgtgatctcgtcgtcgacggctcgctgccgaacgcgatgggcgtctcgcttcagcgggtcgcggtcgggctgctgttcggggccgccatcggcaccgggctcgcgctggtctccggcctgttccgggccggcgaggacctggtggacgcgagtgtccagatgctgcggaccgtgccgttcgtcggcctgatcccgctgttcatcatctggttcggcatcggcgaggcgccgaagatcgcgatcatcacgctcggcgtgtccttcccgctctacctgaacgtctacgccggtatccgtggcgtcgactcccagctcatcgaggccggagagtccctcggcctgtcccgctgggggctcgtgcggcatgtggtgcttccgggtgcgctgcccggcgccatgaccgggctgcgttactcgctcggcatcgcctggctggcgctcgtcttcgccgagcagatcaacgcggacgccgggatcggcttcctcatggtgcaggcacgggacttcctgcggaccgacgtgatcgtggtctgcctgatcgtctacgccttcctcggcctgctggccgatttcgtcgtccgctccctcgaaaggctgctgctgcaatggcgaccgacgttcaccggccgt

SEQ ID NO: 1548 - DNA, 780 bp, Streptomyces avermitilis
  CDS (1)..(780)
atggcgaccgacgttcaccggccgttgagtacacagaaggccgcgaccgcggcggcccaggcgtccacggctgccgcctccgccgtacgggtggacggcctgacccgctccttcgacggccgtgccgtcatcgacaaccttgaactcgacgtccgcccgggcgagttcgtcgctctcctcggtcgcagtggctgcggcaagtccaccctgctgcgcatcctcgccgggctcgaccgcgacatcgagggcacggtgctggtgccgcgccgcaaggccgtcgcgttccaggccccccggctgatgccgtggaagaaggtgtggcgcaacgtcctgctcgggctgcccggaaagcccgagcgtgccgtcgccgagcaggcgctgaccgaggtcggcctcgcccaccgctcccacgcctggcccaagaccctctccggcggcgaggcccagcgcgcctcgctggcacgtgcgctggtccgcgaacccgatctgctgctgctcgacgagccgttcggcgcgctcgacgcgctcactcgcatcaaggcccagcggctcgtcggcgaactctggcaacgccggggctgcgccgtcctgttggtcacgcacgacgtcgaggaggcggtactgctcgccgaccgtgtcctcgtgatggacgacggcgtcatcgcgtacgagacggaggtcgagctggaccgcccgcgcgacatcaccgacccccggttcgcagaactgcgcgccgaactgctggagcggctcggtgtcgacaccgccgcagaggccgcc

SEQ ID NO: 1549 - DNA, 1026 bp, Streptomyces avermitilis
  CDS (1)..(1026)
atgcgacgacgcctcgcccccgctctgctcctccccttccccctgctactggccgcctgcggcgggaattcggcggccggcacctcgacgggcggcaggacggacggcaaggggtccctcacgctcaacgtcggggaccagaagggtggttccgaagcggttctgcgggccgccggagagctcaagaacctgaactacaagatcaagtggtcgacgttcacgtccggaccaccgcttctggaggccatcaacgccaaggccgtcgacatcggcggcgtcggcaacaccccgcccgtcttcgcggccggcgccggctcgaagatctcggtggtggccgcctggcacggcacgtccaagggcgaggccgtcctcgtaccgaagaactcgtcgctgcggaagcccgaggaactcaagggcaagtccgtcgccgtggcgcagggttcgtccgcgcactaccagctggtcgcctcgctcgaaaaggccggtctgaagctgagcgacgtgaaggtcaagtacctccagcccgccgacgcgctggccgcgttcaccagcggcaaggtggacgcctgggcggtgtgggacccgtacacctcgcaggtgctccaggcgaagcagggccgggcgctggtcgatggcgacggtgtggtcaacggcctcagcttccaggtggcggcgccctccgcgctcgcggacaagaagaagagcgcggccgtcaaggactacctggagcggctgcggcgcgcccaggactgggtctatgagcaccccgccgcctgggcgaaggtctgggcgaaggacaccgggctgccgtacgaggtggcgctggcctcggtgaagcgcaccaacgccagccgtgtccccgtcgccgtcgacaagccgctcatcgcctccgagcagcagatcgcggacaccttcaccggtctgaagctcatcccgaagaaggtcgacttcgccgacttcgtggacacgcgcttcaacggcggcctgcccgcttccaccagcacgccccgcgtctacaaggactcc

SEQ ID NO: 1550 - DNA, 1152 bp, Streptomyces avermitilis
  CDS (1)..(1152)
atgaccgtccatctccactggttcctgccgaccggcggcgacggccgcaccctcgtggaccggcacgcctacgcctccaacagtgccgacctcgcacggccggtcaagggcgtacgcccgcccgacatcgagtatctcgcgcagatcgccaaggccgccgagcagttgggcttcgaggcggtactgacgccgaccggcacctggtgcgaggacgcctggctgacgacggtggcgctcgcccagcacaccgagcggctgaagttcctggtcgcgttccggccgggcgtcatctcgccgacgctcgccgcgcagatggcggcgacctaccagcggatcacccggggccggctgctgctcaatgtcgtcaccggtggcgactccaccgagcagcggcgcttcggcgaccatctcgaccacgaccggcggtacgcgcgtacggacgagttcctctcggtcgtccgcggggtgtggagcggacgtccgtacgacttcgacggggcgcactaccaggtcgagggcgggctgaccgcggtaccgcccgacccgctgccggagatcttcttcggtggctcgtcggccgccgcgggtccggtcgcggcccggcacgcggatgtgtatctgacctggggcgaacctcccgagcaggtcaaggagaagatcgaccggatccgttcgctggccgagcgcgaggggcggacggtgcgcttcggcatccggctgcacaccatctcgcgcgacgcgtccgccgaggcctggtcgaccgcgcaccggctcctcgacgacctcgacgcggacacgatcgccgccgcgcagacggcgctcgggcgcagcgagtcggtgggtcagcagcgcatgctggccctgcacggcggctcgcgcgaccggctggaaatctcgccgaacctgtgggcgggcgtgggtctcgtgcgcggtggtgcgggcaccgctctcgtgggcagtcatgccgaggtcgccgaccggatcgaggaatatcacgcgctgggcatcgagcacttcgtgctctccggctatccgcatctggaggaggcgtactggttcggggagggcgtgatccccgacctggcggctcgtgggctgctgccccctgtgacggcagggggtggctcgccgctgctggtcgcgggtggccgc

SEQ ID NO: 1551 - DNA, 1086 bp, Streptomyces avermitilis
  CDS (1)..(1086)
gtgaacaacatcggggtaccggcgcgcgaagtcgacgtggtcgtcacaggcgctgggcaggcaggtctgtccagcgcctttcacctgcggcgcacgggtttcgaaccggaacgggacttcgtggtcctggaccacgccccgcgtccgggcggcgcctggcagttccggtggccgtcgctgacgtaccgcaaggtgcacgggatgcatgcgctgcccggcatggagctgacggacgccgatccttcgcggccgtcctccgaggtcatcgccgagtacttcgacacctacgagcgcaccttcgacctgcgggtgcgccggccggtcgacgtcacggccgtgcgcgagggtgagggcgggcgcctgctcgtccagacctccgacggcacgtgggcgacccgggcgctcatcaacgccaccggcacctgggaccggccgttctggccgcgctatccgggccaggagtcgttccgggggaggcagttgcacacggcccagtaccccggccccgaggagttcgccgggcagcgggtggtcgtcgtgggcggcggcgcgtccggcacccagcacctgatggagatcgctccctacgcggcctcgaccacctgggtgaccaggcgtccgccggtctttcgcgagggtccgttcagcgaggacgtggggcgggcggccgtggcgatggtggaggagcgggtccggcgggggctgccgccgcggagcgtcgtctcggtcaccgggctgccgctgaacgacgccgtccgacgcgcgatcgcggacggcgtcctggaccggctgccggtgttcgaccggatcaccccggacggcgtggagtgggacgacggacggcgcgtggccgccgacgtcatcctgtgggcgaccggcttccgcgccgcgatcgaccatctggccccgctgcggctgcgcgcgccgggcggcgggatccgcgtcgagggcacccgtgtggtcgccgatccgcggatccacctggtcggatacggcccgtcggccagcacgatcggcgccaaccgggcgggccgggcggcggtacgggacatcaggcggctgctggcgggagagcccctcaccgtg

SEQ ID NO: 1552 - DNA, 843 bp, Streptomyces avermitilis
  CDS (1)..(843)
atgcagatgaacactccgccacggagcacgattcgactgacgcgccggggccggggcgccctgatcgcgaccggagccgtcgtggcggccaccgccgtggcggtgccgctgctgatcctgaagagcgacgggcccacgcggcccacctccctcgtgatccccgagggctggcgttccggacagatctacgaggccgtcgacaaggccctcgaactgcccgcgggaactaccaggaagtccctcgccaaggcgaacctcaagctgccgggcgacgcggagggcaacccggagggctacctcttcccggcgacgtacccccttgagaaggcgacgcctgagtccctgctgcgggccatggtcgacaccgcgaacaagaagttccgcggcagcccgatcaccgcgggggcgcagcgcaacgcgatgaccatgtatcaggccgtcaccatcgcgagcatcgcccagtccgaggcggcgaccaaggccgacatgggcaaggtcacccgggtcgtcttcaaccggctggagcgggggatgccgctccagatggactccaccatcaactacgcgatgaaccgctccacgctgaacaccacggtggccgacacgaagctggacagcccctacaactcgtaccagcgcatggggttgccgcccacgccgatcgccaaccccggcgaggacgcgatgcgcgccgcggtcaatccgacgccgggggactggctgtacttcgtcacggtcaagccgggcgacacccgcttcacgtcgagctacgaggagcatcagaagaacgtcgccgagttcaaccggaaccgccggagtccgtcgccgtcgccgtcgcaccgg

SEQ ID NO: 1553 - DNA, 1797 bp, Streptomyces avermitilis
  CDS (1)..(1797)
atgcatcccgaccgacccacctggaccccgtcacccgccgccaccgaacagccgcgacaggtgcgccgcattctgaagctcttccggccctaccgcggccggctcgcgatcgtcgggctgctggtcggcgccgcctcgctcgtctccgtcgccacgcccttcctcctgagggagatcctggacgtcgcgatcccgcagggccgcaccggtctgctgagcctgctcgcgctgggcatgatcgtcagctcggtcgtcaccagcatcttcggcgtgctccagaccctgatctccacgaccgtcggccagcgcgtcatgcacgacctgcgcaccgccgtctacggccggctccagcgcatgtcgctcgccttcttcacccggacccgcaccggagaggtccagtcccgcatcgccaacgacatcggcggcatgcaggcgacggtcacctcgaccgccacctccctggtctccaatctgaccagtgtcgtcgccacgatcgtcgcgatggccgccctcgactggcggctcaccgccgtgtcgctgctcctgctgccgctcttcgtgtggatcagccgccgcgtcggcaacgagcgcaagaagatagccacccagcgccagaagcagatggccacgatggcggccacggtcaccgagtcgctctccgtcagcggcatcctgctgggccgcacgatgggccgcgccgactccctcacccagtcgttcgcggacgagtccgagagcctcgtcgacctcgaagtgaagtcgaacatggcgggccgctggcgcatggccgtcatcagcatcgtcatggccgcgatgcccgccgtcatctactggaccgcgggcatcgccctgcaactcggcggcccctcggtgtcgatcggcacgctcgtcgccttcgtctcgctccagcagggcttgttccggccgaccgtgagcctgctctccaccggcgtccagatccagacctcgctggcgctcttccagcgcatcttcgagtacctcgacctgcccatcgacatcaccgagccggaccagcccgtccacctcgaccaggtcaagggtgagatccgcttcgagggcgtcgagttccactacgacgacaagagcggcccgatcctccagggcatcgacatccgcgtccccgcgggcggcagcctcgccgtcgtcggccccaccggctccggcaagtccaccctcagccatctggtgccgcggctgtacgacgtcacgggcggccgcgtcacgctcgacggtgtagacgtgcgcgacctggacttcgacacgctcgcgcgcgcggtcggcgtcgtctcccaggagacgtacctcttccatgcctcggtcgccgagaacctgcgcttcgccaagccggacgccaccgacgaggagttgtacgcggcggcgcgggcagcccagatccacgaccacatcgcctccctgtccgacgggtacgacacggtcgtcggcgagcgcggccatcgcttctccggcggcgagaagcagcgcctggccatcgcccgcaccatcctgcgcgacccgccggtcctcatcctcgacgaggcgaccagcgccctcgacacacgcaccgagcgcgccgtccaggaagccatcgacgcactctcggccaaccgcacgacgctcaccatcgcccaccggctgtccaccatccggggcgccgatcagatcgtggtcctggacgccgggcgcgcggtcgaacgcggcacgcacgaggaactgctggagcgggacggccgttacgcggccctggtgcgccgagacgcccaactggagccgacaaga

SEQ ID NO: 1554 - DNA, 453 bp, Streptomyces avermitilis
  CDS (1)..(453)
atgaccacccccgatcccgacggcctgctcgccgagcagttgctgcggctcacccgccgtgtgcaccgcatccagaagcgccatctggagcagcgcggcctcggcatcacaccggcccagtcccggctgctgcgcaccctcgcgcactacagctcaccgccccgcatggcggacctcgcccagcgtctcgaggtggtgccgcgggccgtgacgacgctcgtcgacggcctggaggcgagcggcaaggtgcgccgggtgcccgacccgaccaaccgtcgcgtgatccggatcgaggtcaccgacgagggccgcaaggcgctgcacgaactgcgcggcgcgcgccggtcggcggcggaggagatcctggcccccctgaccgacgaccagcgcgaggtgctcggggggctgctggacacgttggtggacggcgcaccggaaggggagcggcactgc

SEQ ID NO: 1555 - DNA, 255 bp, Streptomyces avermitilis
  CDS (1)..(255)
atgatttacacggacgtgacgcacgcgtatccgagcaccaatcttctcggcaactgtgtcgccgtcttcgcggtgtcccgctgggagggcgcgttggacacggcgcgggcgaagaaggtgctggacggcgagatcgcgttcgtaccggacgacgacgaccacgctccgcggaccgacgccgagactccggaagccgaagccgcgaagccgacggtgccggcccggtcggtcaaggagcccgcacccgaggtcggc

SEQ ID NO: 1556 - DNA, 1623 bp, Streptomyces avermitilis
  CDS (1)..(1623)
atgtccatgctcgtcggggtaattctcgtggcgagcaccctcctcggggcgagtcccgcaccagcggcaggcaagcacaccgccgaggccacgccgtccgccgagcccgccccacccgccgaattcggcaccgactggcacgacccgctgaccgcggccccgccgatcgggaaacccgccaccagatcctgccaggtcaccgtcgccgaggcacagttccgcgacttcacgccgtaccggggcacatatgcgccgccgcgtggctgcggcgaccgctggagcagggtcgtgctgcggctcgacggcaaggtgcgggggcggcagttcgaccgcctcggctacctgcacatcggcggcgtcgagatcctccgcacctccacccccgagccttcgcccgacggcatcgagtggtccgtcgagaaggacgtcacccggtacagcgacacgttccggcagagccgcgacgtggagatgctcatcggcaacgtcgtcgacgacacgtacaccggagtcatcgacgtcagggccacgctgaccttctacgcggccgaccgcacgaacggaccggcggcgacccccgaccgcgtcctcaccctcgccgacgggacgaccctcaccacaccccgcaacagcgaacgcatcgtcgccgaggtgtacgccaccggctcggggggcggctgcgaggagttctggtacctgacggtgccggactcggcgccgtactcctgcaaggcggacaaggggccctaccgcgaggtgcagatcaaggtggacggccaactggccggaatcgccgcaccgttcccgaccgtgtggaccggcggctggtcgaaccccttcctctggtacgtgattccgggaccgcgcgccttcgacgtcaagccgatcgagtacgacctcacacctttcgccgggctgctcaacgacggccgtccgcaccgggtcgacgtctccgtcgtcggcgttcccgaggggcaggccggctggagcgcaccggtcaacgtcctcgtctggcaggacacgaagagcacacgggtcaccggcgcactcaccgcccacaaggcggcagacctcgccaactccaccacgtacacgcccggttcggaacatcgcctggacaccgagggcggccaccggctgacggtcgccggatatgtgaacacctcgcacggccgggtgacgaccaccgtgagccgcaccctcgccaccacctccgcacaccgctggaccgacggcgagaacatggacggcctccaagccgtctggaacgacgacgagtcggtcaccgccgacgggcgcggaccggaccggacgacgcgtatccggcgcacgtacacgatggacggcaccaccacgctcggccccgacgaccggctgcggagcgccctgacgctcggcgaccgggcgacggccgtcgagtcgcgtggtggccggcgcaccgcgtggtcccggctcgacgacacctacacgggtgatgccacgtatacggcgaacgtgccgcgcgaccagcgccacgcggtcgccacgacgagcgagcgctaccggctgagcggttcggcgggctgctacgaccgcaacctcgtcaccgtgcagggggtgttgacgcgtgaccgcagcgactgc

SEQ ID NO: 1557 - DNA, 822 bp, Streptomyces avermitilis
  CDS (1)..(822)
atggccgggaagcagggggccgtgcgcaatcgcccggaacgtggtgcgacgatggttcgcatgcgaattggcggtgcgagcggtgcggtacgcgcgggggtcgtggcggcgacctgcggtgtccttctgatgtccctgacggcctgcggtggttcggacgggtcgaacgcggcgaagggcggcggcggatcgggcggcaaggcgggctccggttcggggcagtccaaggcgcccaccgtcgatctgctccgcatcccggacgtcggcgaccggctacagaacaagatcccggccaactcgcgccaggtcgtggcggtctacggcgagggcaaggactcggcggactccacgatcgtgctgtacacgaagaacggctccacctgggaccagacccgcagctgggaagggcacaacggcaagaagggctggaccaccgaccaccacgagggtgacaagcgcagccccgtcggtgtgttcacgctcagcgacgcgggcggtgtcctcgccgatccgggcgcggagctcccgtacacgcagtcggcgtccttccaggctccgcactactggtccaggtcgcactggcacgacttcgactacgtcatcgccatcgactacaaccgggtcaagggcaccgcgccgaacgacccgacccgccccgaaggccagtcgaagggcggcagcatctggctgcacatggaccacgccggcggtacgtcggcctgtgtgagcctgtccaagtccggtatggagtatctgctgcgcacgctcgacccgaaccagcaccctgtggtggtgatgggggacaaggcggacctcaaggcc

SEQ ID NO: 1558 - DNA, 1860 bp, Streptomyces avermitilis
  CDS (1)..(1860)
atgcagattcaagaccttccgtatcccgacccaggtgtgccggacgcgcgctcgggtccccgattcctttggtggctcttccggaatcagctgggcggccagctgacgagcctcgcctggggtctgctgcacttcctggccgtttccgggctgccgttctgcgtcggcctcgccgtccaggcggtggtggaccgctcgggcacccgactcgccctgaccggcgggctgatcgtgctgtgcggcgcgggcctcgccctgggcgaatccatgctgcaccgggccgccgtcaccaactggatcaccgccgccgcccgcgtccagcagctgctggcccgcaggaccgcgcagctcggctccgccctgacccggcgggtcgcggccggcgagatcgtcgcggtctccacgggcgacgtcgagaagatcggctggttcgtcgagggcgtctcgcggttcaccgcggcggccgtgaccgtcgtggtggtctgtgtcgggctcgtcgtgtaccagcccgccctcggcgtcgtcgtcgccgtcggcgtaccggtgctggcactcgccgtgctgccgctgctgccccgggcgacccgccgcgccgacgtccagcgcgagaaggcgggccgtgccaccgagttggcctcggacacggtcgcgggcctgcgggtgctgcgcggcatcggcggcgaggagctgttcctcgaccgctatcgccgggcctcgcaggaggtccgcagggcggccgtgcgcagcgcccgaatgtggtcgctgatctcggcgatccaggtgctgctgccggggctgctgatgatcgcggtcatctggcgcggcgtgcatctggccgtcgacggccggatcaccgtcggtgaactcgtcaccgtgtacagcgcggtgatgctgctcacctatccgttgcggcacttcgaggagatcgccatggcgtactccttctcgcgcccgtccgccaggcgcgcggcgcgcgtgctgtcgctggagcgcgccacggacacggcgggatcgcgcgaggcggacgtgccggacggagatctgtacgaccccgcgaccgggctgctcgcgcccgccgagcggctcaccgccgtggtgtgcggcgacccggacgcggcgggcgtgctggccgagcggctgggcggccacccgtccgaagaaggcacctcggtgctgctcggcggcgtgccgctggacgaacttccactcgactccgcccgcaccgccgttctggtccaggacaaggatccggtgctgctgtccggttcgctgcgcgaactcctcgacgtacccgcgtcgggagaggtgagtgccgccgaggcgctggccgcagcccagtgcggcgacgtcctggaggcgctcgcccaggggtcgctggaggccgaggacccgatggacgcgcggatcaccgagcgtggccggtctctgtccggcgggcagcgccagcggctcgcgctggcccggtcgctgatcacggacccggaggtgctcgtcctggacgagccgacgtccgccgtcgactcgcacaccgaggcccggatcgccgacggcatccgcggcctgcgcacgggccgcaccacggtcgtcttcacctcctcaccgctgctcctggaccgcgcggaccgggtcgtactggtgcacgagggcgaggtggtggcggtcggcgcgcaccgcgaactggtgcacagcgagccccgctaccgggccgtcgtcacccgcgaggtggacgcagaggccgcccgaagcggcgtactgacagacgaccgggccgccgtgggcggcgtgctcgcgggcgaagaagccgccatgggcggcgtactgcacgagatcgacgaactggaagagatcgaggagaccgca

SEQ ID NO: 1559 - DNA, 1779 bp, Streptomyces avermitilis
  CDS (1)..(1779)
atgatcggcgtggcgccaccggcgtacgacccggccgccccgacaacggcgaacaccctgccggtcggcgcccccgcgaccgtacgcgcctacgtggccgaactgttccgacggcaccgccgtgcctttctgatcctcatcgcggtcaacacggtggccgtcgtcgcctcgatggccggtccctacctgctgggcgcggtcgtcgagcgggtctcggaccacacgcgcgaactccacctggagcgcaccgccgcactgttcgttctcgcgctcgtcgtgcaggccgtgttcgtacgggaggtgcggctgcggggggccatgctcggcgagcggatgctggccgatctgcgcgaggacttcctcgtacggtcggtcgggcttccccccggcgtgctcgaacgggccggcacgggtgatctgctgtcccgcatcaccacggacatcgaccgcctcgccaacgcgatgcgcgaggccgtgccgcagctgaccatcggcgtcgtgtgggtcgcgctgctgctcggcggcctcgccgtcacggcaccgccgctggcgcccgccgtgctgctcgccgtgccgctgctggtgatcggctgccgctggtacttcaagcgcgcgccgtccgcctaccggtcggaggccgcgggatacgccgccgtcgccgccgtcctcgccgagaccgtcgacgccggtcgcaccgtggaggcccaccgcctcggcggccggcgcatcgacctgtcggaccggcgggtcaaggagtggacggcctgggagcggtacaccctgtggctgcggacggtgctcttcccggtcgtcaacctcacccacgtcaccgtgctgtgctcggtcctgatgatcggcggggtgttcgtcctgcaaggctggatcgacgtcggccagctgaccaccggcgcgctcatcgcgcagatgctcgtcgaccccatcggcatgatcctgcgctggtacgacgagcttcaggtcgcccaggtctcgctggcgcgcctggtcggcgtccgggacgtcgagccggtcgcgggcgacgagtcgctcgccccggacggccgcgacgtgcacgccgaccgggtccacttcggctaccgcgccggagtcgacgtcctgcgcaaggtgtccctggaggtcgcgcccggcacccggctggccctggtcggcccgtccggcgcgggcaagtcgaccctgggcaggctgctcgccggcatctacgcgccccgcgacggccgcatcaccctgggcggcgccgagctgtcccggatgccggccgagcgggtccgctcccacgtggccctggtcaaccaggagcaccacgtcttcgtgggctccctgcgcgacaacctgctcctcgcgcgcaccggcgccggcgacgccgagctgtgggcggcgctgggcgcggtcgacgcagacggctgggcgcaggcgctggacgacggcctcgacaccgaggtcggctcgggcggactcgcgctcaccccggcccaggcccagcagatcgcgctggcccggctggtcctggccgatccgcacacgctggtcctggacgaggcgacctcgctcctcgacccgcgcgcggcccgccatctggagcggtccctggcccgcgtcctcgacggccgcaccgtcgtcgccatcgcccaccggctgcacaccgcccacgacgccgacgtcatcgccgtcgtcgagaacgggcagatcagcgagctgggcagccacgaccagctggtcgcggccgacggagcgtacgcggcgctgtggaggtcctggcacggg

SEQ ID NO: 1560 - DNA, 468 bp, Streptomyces avermitilis
  CDS (1)..(468)
gtggacagcgccgagggatggggagacgacgtctatcagcccgacggatccgagatacaggaggactcgggactgctcgacaccgaggacaccctggtctccgacggtgtgagcgacccgctcgaccggggctggtcatcaccggaccggccgtgggcggtggagcgctccgacgtgaccgcggccgagcgccgccacggcgagacgctggaccagcgcctcgcggaagaactccccgacatcgcggagcctgacggcgacggcatcggcgactgtccggacggcgacggcgaacccctggacaacgaggtgggcgcggcccgctccggtcggctcgtggctcccgacgaaggggcgcacgaggacgaggagaacgggctgatcgccaccgacgtgggcatcgacggcgctgccgcctcggccgaggaggcagcgatgcacatcgtcgacgaggacgccctgtccggc

SEQ ID NO: 1561 - DNA, 273 bp, Streptomyces avermitilis
  CDS (1)..(273)
atgcagcaggacaagcagcccgactaccaccccgtcgtcttccgcgaccgcgccgccggctatgccttcctcacccggtccaccgcgaccagcgacaagaccatcgagtgggacgacggagagacctacccggtggtggacgtggagatctcctcggagagccacccgttctacaccgggaaggcacggacggtggactcggagggccgcatcgcccagttcgagcggcgctacggaagcacgggaccgggctccgacgggggcggtgcggcc

SEQ ID NO: 1562 - DNA, 2658 bp, Streptomyces avermitilis
  CDS (1)..(2658)
atggccctgtcccgccccatccttctgctgccgctgcccagttgcccgtgtgctctgacgctctgtcggcgccacagcgtagcgttcgcgatcttcgtgcgggcatccgattcccccctcgggtgcgatgacaggcaagatgggggcgtgacccttatcgatcagctgccgcagaccgcagaccccgacgccctctacgaagccttcgagtcgtgggccggggaacgcggtctcaccctctatccccaccaggaggaggcgctgatcgaggtggtctcgggtgcgaatgtgatcgtgtcgacgcccaccgggtccggcaagagcatgatcgccgcgggcgcgcacttcgccgccctcgcccgggacgaggtcaccttctacaccgcgccgatcaaggcgctcgtgtcggagaagttcttcgagctgtgcaagctcttcggcaccgagaacgtcggcatgctcaccggcgacgcgtccgtgaacgccgacgcgcccgtcatctgctgcaccgccgaagtcctcgcgtccatcgccctgcgcgacggcaggcaggcggacgtcggccaggtcgtcatggacgagttccacttctacgccgaggccgaccgcggctgggcctggcagatcccgatcctggagctgccgcaggcccagttcatcctgatgtcggcgacgcacggcgacgtctcgatgttcgagaaggacctcacccgccgcaccggccgccccacggcggtggtccgctcggcgacccggcccgtgccgctctcctacgagtacgtggtgactccgctgacggagacgatcaccgagctgctcgcgaccaagcaggcccccgtctacatcgtgcacttcacccaggcgcaggccgtggagcgggcgcaggcgctgatgagcatcaacatgtgcacgcgggaggagaaggacaagatcgccgagctgatcggcaacttccgcttcaccaccaagttcggccgcaatctctcccgctacgtgcgacacggcatcggtgtgcaccacgccggcatgctgcccaagtaccgccgtctcgtggagaagctggcccaggccggtctgctgaaggtcatctgcggcacggacaccctgggcgtcggcgtgaacgtccccatccgcaccgtgctgttcaccgcgctgacgaagtacgacggcacccgggtgcgcacgctgcgagcgcgtgagttccaccagatcgcggggcgcgccgggcgtgccggcttcgacacggcgggcttcgtggtggcccaggcgccggagcacgtcgtcgagaacgagaaggcgcttgccaaggccggtgacgacccgaagaagcgccgcaaggtggtccgcaagaaggcgcccgagggtttcgtcggctggacggagaacaccttcgagaagctcatctcctccgatccggagccgctcacctcccgtttccgggtcacccacacgatgctgctggcggtgatcgcccggccgggcaacgccttcgacgcgatgcgccatctgctcgaggacaaccacgagccgcgcaagcagcagctgaggcacatccgacgggccatcgccatctaccgctcgcttctcgacggtggcatcgtggagaagctggacgagccggacgcttccggccgcatcgtgcgcctcaccgtcgacctgcagcaggacttcgctctcaaccagccgctgtcgaccttcgcgctggccgcgttcgaactcctcgacccggagtccccgtcctacgccctcgacatggtctccgtggtcgagtcgacgctcgacgacccgcggcagatcctcgccgcccagcagaacaaggcgcgcggcgaggcggtggccgcgatgaaggcggacggcgtcgagtacgaggagcgcatggagcggctccaggacgtctcctaccccaagccgctggaggagctgctcttccacgcgtacgacacgtaccgcaagagccacccgtgggtcggtgaccatcccctgtcgccgaagtccgtcatccgcgacatgtacgaacgcgcgatgtccttcaccgagttcgtctccttctacgaactcgcccgcaccgagggcatcgtgctgcgctacctcgccagcgccttcaaggccctcgaccacaccgtccccgacgacctcaagtccgaggacctcgaggacctgatcgcctggctcggcgagatggtgcgccaggtcgactccagcctgctggacgagtgggagcagctcgccaacccggaggagatgacggccgaggaggcccaggagaaggccgaccaggtcaagccggtcaccgcgaacgcacgcgccttccgcgtcctcgtccgcaacgccatgttccgccgcgtcgaactcgccgccctcgaccacgtcgaagagctgggcgagatggactccgactccggctgggacgcggacgcgtggggcgaggccatggacaagtactgggacgagtacgaggagctgggcaccgggccggacgcccgcggcccccggctgctgatgatcgaggaggagccgcagaacgggctgtggcgcgtccgccagaccttcgccgaccccaacggcgaccacgactggggtatcagcgcggaggtcgacctcgcggcgtccgacgcggagggccgtgccgtcgtcaaggtcaccgccgtcggccagttg

SEQ ID NO: 1563 - DNA, 792 bp, Streptomyces avermitilis
  CDS (1)..(792)
atgatgggaccagcacactcactgtcgggggcggcggcctggctcggcgtcggagcggcggcggccgcggcgggccacacgatgccctggccggtcctgctggtcggcgcgctgatctgcgcgggtgctgctctggcccccgatctggatcacaaggcggccacgatctcgcgggccttcggccccatctcacgaaccctgtgcgagatcgtcgacaagctgtcgtacgccgtctacaaggggaccaggaagcagggcgacccacgcaggtcgggtggtcaccgtacgctgacgcacacatggctgtgggcggtgctgataggtgcgggtgcgtcggtcctggccatcaccggtggccgctgggccgtgctcgcgcttctcttcgtgcacatggttctggccatcgaggggctgctgtggcgggcggcccgcggttcgagcagcgacgtcctggtgtggctgctggccgcgaccagcgcctggatcctcgcgggagtcctggacaagccgggcaacggttccgactggctgttcacggcgccgggccaggagtacctgtggctcggactgccgatcgttctgggtgccctggtgcacgacatcggggacgctctgacggtctccggctgcccgatcctgtggccgatcccggtgggccgcaagcgctggtacccggtggggccgcccaaggcgatgcggttccgggcgggcagctgggtcgagctgaaggtgctgatgccggtgttcatgctgctgggcggggtgggctgcgcggcggcgctgaacttcatc

SEQ ID NO: 1564 - DNA, 864 bp, Streptomyces avermitilis
  CDS (1)..(864)
atgacgaacccagccgagaggctcgtcgacctgctcgacctggagcagatcgaggtcaacatcttccgtggtcgcagtccgcaggagtccctccagcgggtcttcggcggccaggtggcgggccaggccctggtggccgccggccgcaccacggagggcgaccggccggtgcactcgctgcacgcgtacttcctgcgcccgggcatacccggcgtgcccatcgtgtaccaggtcgaacgggtccgcgacggacggtccttcacgacccgccgggtcaccgcggtgcagcagggccgcacgatcttcaatctgaccgcctccttccacaagtctgaagaggggagcttcgagcaccagttgccgccggcccgcgaggtcccggaaccggagtcgctgccgacggtgacgcaggagatccaggagtatctcggcgcactccccgagacgttggagcgcatggcccgacgtcagcccttcgacatccgctatgtggaccggctgcgctggaccgccgaggaggtcaaggacgccgagccgcgcagcgcggtgtggatgcgggccgtcggcccgctgggcgacgatccgctggtgcacacctgcgcgctcacctacgcgagcgacatgactcttctcgacgccgtccgcatccccgtcgaaccgctgtggggtccccgcggcttcgacatggcgtcgctggaccacgccatgtggttccaccgtccgttccgcgcggacgagtggttcctctacgaccaggagtcgccgatcgcggtgggcggccgcggactggcccgcggacgcatctacgacctggaggggcgcctgctcgtctcggtcgtccaagagggactcttccggccgctg

SEQ ID NO: 1565 - DNA, 1008 bp, Streptomyces avermitilis
  CDS (1)..(1008)
atgtccggagacacgatcacgcaatccaccacgtcacagaccgccacgtcacagaccatgccgtcacagaccgccacgtcacaggccgtgccgtcacagaccgcgccgtcacggaccatcaggtcgaagaccgccatgtcgactcccgtcgcactcacccgagccgcgcgggaactggggctcaggcgaggcgagttcgagctggccgtacagctcgggtacgtccgtacggtcccggacgacaagggaggaggaccgcgcgtcgcccgagcggagatcgaccgggtgcgagacgaagacggcttccccgaagcactgcgggagcgcgtcacggtcttgggcacccgggacggcgcggcgctcatgggagtgacgcccgccaggttcacccgcttcgcgcgtctgggactggtggtcccggtgaagttctacctcaaccgctacagggccgtggtctggctgtatctggccgaagagctacggcagttcgccgccggaaaggagaacacccgactgctgagcggccgtactccggaagggttgcgcgatcaactcgacgcgggcctggatctgcggccccgcaactggcgcgggcgacacctgggattccagctgcggcagaccgaggatccgtgggagaaggccgccgtcgtggcatcgctgctcgaccccgcccaagtcgcggagatcgtccaggacccttacgagcgtgccctgctgaaccggctcaggcccgcgcggtccgcccacgacacccacgactccccggcagccgtgctcaccgcgaggatcatgacggcggacgcccccgacgagatcggctggctgcgggccgacctgagccagtcgctcgccgaagcccgggagcaccggccggctccgcgcccttcccagggcgtccccgacgagcggccgcccgagacgacgaccgccgtggatctcgcaggcgcgagcgaggaggcgcagcgatcgggtggcttgttcggatggctgcgccgcagaaacccc

SEQ ID NO: 1566 - DNA, 414 bp, Streptomyces avermitilis
  CDS (1)..(414)
atggcgcagaacacggggctcggctggctgctggacgacttgaccgagcgcgtcgaacatgtgcgacacgcgctggtgctgtccaacgacggactggtgaccggggcgagcacgggcctgcgacgcgaggacgccgagcatctcgcggccatctcgtcgggactgcacagcctggccaagggctcgggccggcacttcggtgccgggcgcgtgcgccagaccatgatcgagttcgacgacgcggtcctcttcgtcaccgcggcgggcgaaggcagctgtctcagcgtgctgagcgcggccgaggcggacatcgggcaggtcgcctacgagatgactctgctcgtgaaccgtgtcggcgagcacctcggcgtggacgcacgccagccggagaagaaaacgccgaccgtagatctc

SEQ ID NO: 1567 - DNA, 435 bp, Streptomyces avermitilis
  CDS (1)..(435)
atgggcggcatggcacagaagatgaccgaagaggaatggcgggcgttcgtctcgcacggcacccgtaccgggaaactgtccacggtgcgcgccgacggcaggccgcatgtggcaccgatctggtttctgctggacggggacgacctggtgttcaacacggcgcgggacagcgtcaagggccggaatctcgcccgggacggccgggccgccctgtgtgtcgacgaggaccggccgccgttcgccttcgtcgtgttccaggggcaggccgagctgtcggaggacctcgacgaggtgcgcctctgggccacgcgactcggcgcccgctacatgggcgaggagcgggccgaggagttcggcagtcgcaacggcgtgccgggggaactcctcgtccgcctgcggatcgacaaggtgctggcgtactcggcggtcgccgac

SEQ ID NO: 1568 - DNA, 603 bp, Streptomyces avermitilis
  CDS (1)..(603)
atggtctccgagaactccgacgccacgaatgtcgagacgaccgccctggcgttgaagatactggtcgccggcggattcggcgtgggcaagaccaccatggtgggcgcggtcagtgagatcaggccgctgcggaccgaggaactgctgagcgaggcggggcagtcggtggacgacaccgacggagtggaccagaaggtcaccacgactgtcgccatggacttcggccgcatcaccatcagatccggcctctccctgtacctcttcggcaccccgggccaggaccggttctggttcctctgggacgagctgtcgcagggcgccctcggcgcggtcgtcctcgcggacaccagacggctcgaggactgctttccggcagtggactacttcgagcaccggcacatcccgttcgtggtggccgtcaactgcttcgcgggcgcccgcacctacggtgcccacgacgtgtcgcgtgccctcgacctcgaccagggcacgcccgtggtgctctgtgacgcccgcgaccgcgactcgggcaaggaggtgctgatccggctcgtcgagtacgccgggcggatgcacaccgcccggctgctggactcagtgggc

SEQ ID NO: 1569 - DNA, 411 bp, Streptomyces avermitilis
  CDS (1)..(411)
atgaccgaggacaggccaggctccgcgctgcaagcgggcagccagtggtacgacaacgaggccggaccactcgtgcgcccctacgccatgacgggcggccgcaccaaacccggccccaccggggtgcgcttcgacctcatcgcgctcgtcaccctcgacacggccgcgccccgcgtcgacgacgacacgtcactgggcccggagcaccgcgccctcatcgacctgtgccgcgtcgagacacagtccgtcgccgaactcgccgcgggcgccgacctgcccgtgggagtcgtcagggtcctcctcggcgacctgttggagctgggctgtgtcaccgtcagccgcccggtgccgcccgcacaactgcccgacgagcggatcctgcgcgaagtcatcgcaggcctgagggcgctg

SEQ ID NO: 1570 - DNA, 435 bp, Streptomyces avermitilis
  CDS (1)..(435)
atgatccaggacccgggcatgaaggccgaccagcggcccggcgaactcgactggctgctggacgacttggtcctgcgggtggcagaggtacggcacgcggtggtgctgtcgaacgacggcctcgcggtcggcgcctccgcggacctcaggcgcgaggacgcggagcacctcgcggccgtcgcctccggttttcacagtctggccaagggcaccggccgtcacttcggcgccggcggagtgcgtcagaccatggtggagatggacgacggcttcctgttcgtggcggccgcgggcgacggctcctgcctcgccctcctcaccgccgtcacggccgacatcggcctggtggcgtacgagatggcgcggctggtgaagcgcgtcggcgagcacctgtacacaccggcgcggatcgccgcgcggccgcccaccgccgga

SEQ ID NO: 1571 - DNA, 2550 bp, Streptomyces avermitilis
  CDS (1)..(2550)
atgcgtacatcccgtaggaccccatcagccggcgccgagccgccgtcccggcccccggtgcgcggccggcgcgcccacgcgggccagcccgccgacgaggacaccgggaccgacgagaccgtcaccgccgcatcggccgactcacccgtgggcgcgggacggtggggcgtgcgtccccggaccgtccgggccaagatcgtctgcctgttgatggtgcccgtcgtctcgctgctcgccctctgggcgtacgccactgtcagcacggcccaggacgtggcacggctgcgccaggtccagcaggtcgacacgacagtgcgagcgccggtcgccgccgccgtggccgcgctccaggccgagcgcgcggccgccgtacgccacgtgattgatccctccgcagaaccggacagcggcttccggacgctcgcggcacgcaccgaccgggcggtggacaagctgcggctcggcggacaccacaccgtcgccgacggcgccgacctccccgcccaagtgcccgggcgcctggagaccttcgtcagcggagccgagcaactgcgctccctgcgcggcgcggtgctcgaacgccgggcccgctgggacgagaccttcgggcagtacaccaggacgatcgcggcggccttcggcgtcggcggcgcgctcaccggcatccaggacgccgatctcggctccgacgcgcgcgtactgctcgaattctcccgtgcgggcgaggcgctggcccaggaggacgcggtgctgtccagcgcgcggctcgcgggcaccctcgacggcgaacggctgcggctgttcaccggcgccgtggacactcggcgtaccctgaccgactccgcggtcgcggacctgagcgaacgcgaacgagccgcctggcaaggcgtcgcgacggggcgcgcgtacgccgacgtacgcaccgccgaggacaaggtgctcgccaaccgtcccggagccaggcggatcgccgccgccccgcaagccacctgggacccggcccacgcgcgcgtgcaggagggcatgcggaccatcgaggcggacgcgggacgcggcgtcgcggaccgggccgaccccctcacccgcggcctgctcacgccggccggcgccgctgtcctcttcggactcgccgccgtggccgcttcactggtcatctccgtccgtatcggtcgcggcctcgtcatcgagctgatcagcctccgcaacagcgccctggagatcgcccgccgcaaacttccgcaggccatgcgcaagttgcgggccggagaagagatcgacgttcgcgccgaagccccgccggggccgcccgccgaggacgagaccggacaggtcgccgaagccctgagcaccgtgcaccgcgccgcgctgcgcgccgccgtcgaacgcgcggaactcgccagcggcatctccggagtcttcgtcaacctcgcccgccgcagtcagatcctggtgcaccggcagctcagcctgctggacagcatggaacgcaggtcggaggaccccaacgagctgagcgacctcttccggctcgaccacctgaccacccgcatgcggcgccacgcggagagcctgatcatcctctccggggccgcacccggccgggcctggcgcatgcccgtctcgctgacgaacgtggtccgcgcggccgtgtccgaagtcgaggactacgcgcgcgtggaggtacgacaacttcccgaggcctccgtcgtcggagccgcggtcgccgacctcacccacctcatggccgagatcgtcgagaacgccgcccagttctcgccgccccacacacgcgtgcgcgtcaccggcgaacccgtcggcaacggatacgccgtcgaggtcgaggaccggggactgggcatgggcaaggagacactcgccgaggccaaccgccgtatcgaacagtccgaggccctcgacctcttcgacagtgaccggctcggcctcttcgtggtcagcaggctcgccgcccggcacggcatcaaggtgcacctgcggacctcgccctacggcgggaccaccgccgtcgtgctgctgcccaccgcactgctgcacagcggcacggcggagcgtgtcccccgtgcggccgacaccgggcgggacgcggaacccgcgtacgcgcgcgtggccgccgcctcgcaccagtccgtccagcaggcggtcgggcgacccgcactggtgccccccgtgcacgccgccgtggaagcagccccggacaccacgcccgagaatccgccgcccggcgtcgccaccctacggctgcaccgccccccggacgcggagggcccggaggccggggaacaggacgaccccgaaggctcggacgaccttccgcgacgggtacggcaggcgagtctcgcaccccagttgcgccgacagcgccccgaggaaccggcgccacacacccacggggtccgggacgacgaggagcgcacccccgaactcgtacgggaccgcatggcggcctaccgggacggctgggcgcgcggcggcggccgctcacccggccgtgcggccggccccgccggtgacagcagcgaaggagaccccgca

SEQ ID NO: 1572 - DNA, 729 bp, Streptomyces avermitilis
  CDS (1)..(729)
gtgctgtcgtatgtgatggcctgcatcggcgcagccctcgggctgcgctgcaccgtccgcgcgctcggcgccaccgggcgatcgcgccggaactggctgatcaccgcggcctccgcgatcggcaccggcatctggaccatgcacttcgtggccatgctcggcttcagcgtcagcggcaccgagatccgctacaacgtgccactgaccattctcagcctgctggtcgccatggtcgtcgtcggcaccggggtcttcgccgtcggctacggccgggaccgcgcccgggcgctcttcctcgggggcctcaccaccggtctcggcgtcgccagcatgcactacctgggcatggcggcgctgcggctgcacggcgtcgtgcactacgacccggtgctcgtcggactctccgtcctgatcgccgtggtcgcggcgaccgcggccctgtgggcggccctcaacatccagtcgccgatcgccgtcgccgtcgcctccctcgtcatgggcgtggcggtgagcagcatgcactacaccggaatgatcgcggtccgcgtgcgcgtcagccctgccggggaggtcctgcccggggccacggcgatgcagttcatcttccccctcgccgtcggcctcgggtcctacctcttcctgacatcggcgttcgtcgcgctgtcgccgaccgccggagagcgcgaggcatccgcgtcggcccagcagccggtggagagcgtcgcccgc

SEQ ID NO: 1573 - DNA, 606 bp, Streptomyces avermitilis
  CDS (1)..(606)
atgcggtgcatgagcgacgaccacacacacgtccaggagttcttcgaggcgcgggccgccgactgggacagccggttccccgacgacgggcccgcgcacgcggccgcggtcgccgagctggggctgcgcgagggcgaccgcgtgctcgacgcgggctgcgggacgggacgcgccctgccgtcgctgcgtgccgccgtcgggtcctccggtgtggtcgtcggcgtcgatctgaccccggccatgctggcggccgccgcacgggccggcaggggacgcgacgggcacctcctgctcgccgacgtgaccaggctgcctctgggcacggaatcactcgacgccgtgttcgcggccggtctcatcgcccatctccccgaaccggcggagaacctgagggagttggcgcgagtggtgcgagccggcggcactctcgcgctcttccacccgatcggccgggcggcgctcgcggcgcgccaggggcggcagatcaccccggacgatcttcgcgcggaggccaacctcggcccgctgcttgccggttccggctggcgtatgacgtcgtacgtcgacgaggacgcccggttcctggcgctggccgtacgcgtgaag

SEQ ID NO: 1574 - DNA, 756 bp, Streptomyces avermitilis
  CDS (1)..(756)
atgaagcaggctgagttcgacggcaggggaagcatgatccggtggacggagacgccgggcttcgaaccggcacgcgtgtacgtgcacgggctgggctcggcctcgacggtgtaccacgcgcacatcgcggcgcggcccgaaatggccggccgccgcacgctgttcgtggatctcccgggacacggcatcagcgaccggcccgcggactacggctacaccctggaggaccacgcggacgcgctctccgccgcgctggacgaggccggggtgagcggggcggagatcgtcgcccacagcatgggcggggcggtcgccatcgtgctggcccaccggcgacccggtctcgtctcgcgactggtgctgtccgaggccaacctcgatccgtaccctcccgtcaaggccggcagcagtggcatcgcctcgtacgaggaggccgactacgtcgacaacggtggccacgcgcgcgtgctggacaagatcgggcccacctgggcggcgacgatgcgactcgccgacccgcgcgccctccatcgcaccgcggtgaacctcgcacgcggcacgacccccacgatgcgccgcctcctggaaggaatgaccgcggaccgcgtctatctccagggcgaactgagcggtgaagtcgagggcaggcgggacctggaggcggcgggtgtacgtgtggtgaccgtgcccggcgccggccacaacgtcatgttcgacaacccggacgcctttgccgcagaggtcgtcggcgtgccc

SEQ ID NO: 1575 - DNA, 540 bp, Streptomyces avermitilis
  CDS (1)..(540)
atgcgcagcatgctggagttggccatcctcggatttctgtacgacgcgccgctgcacggctacgagctgcgcaaacgcatcacggccctgacggggcacgtgcgacccatcgccgagagcacgctgtatcccgcgatcaagcggctggagacggccggtctgctgaagcgggcgacggagccgggctccgtggcggccccgcgtcacgtcctcacactcaccgaggacggcaggcgcgagctgcgccggcggctggcggaaccggttcagcgcgacatcaccgacgagaaccgctggttcacggtgctcgccttcctcaggcacctggccgaccccacggctcaggccgccgtcctgcggcgccgactggccttcctggaggaacccgcgagcttcttctacgagggcgaccggccgctgcgcgcggaggaactcgacgaccccttccggcgcggcattctcaccatcgcgcgggccacgagccgggccgagctggactggctgcggaccacgatcggctcactcgacgggagcggtggc

SEQ ID NO: 1576 - DNA, 903 bp, Streptomyces avermitilis
  CDS (1)..(903)
gtgaagcgcttcgagcggctcgaacagatccgtcggatggacccggagaaggacgcgctgaagatctaccggctgaccgcggcctacgagttcccatgggacttcacccgggctctggagctggcgctgtaccgcacgtacgccgtcccgagcatcgggcggctgctcgccgagacggccgaactcacggaccgcacacagaagcgctacgacgacaccgcgctgcttctcgacgccgtcgtcgagcacggcttcgacggtgcggaagggcgcagcgcgatccgccggatcaaccagatgcaccgcagctacgacatcagcaacgacgacatgcggtacgtgctgtccacgttcgtggtgatgcccagacggtgggtcgacgcctacgcctggcgcaggctctcccggcacgaggtcgtcgccaccaccgtgtactaccgcactctggggcggcacatgggcatcaaggacatcccagggacctacgaggagttcgaggactgtctcgacacctacgaagaggcccatttcgcctgggacgcggatgcgcgccgggtcgccgacgcgacgctgggcctgatgacctcctggtatcccggccctctcgcgccgctgttgcgcacctccacgttcgccctgctcgacgaaccgctcctgcgggccttccggtacgagccgccgggcgccgccacccgtgcgttggtgcgccgcgcggtgcgggcacggggccggatggtgcgtctgctgccgccgcgccgggcgccgcacttcgcgcggcgcaactgggaggtcaagggctatccgaacggctaccgcgtcggcgagctcggcaccactccggtgccgggggtgaggggctgtccggtccggcactcggggacgtcagccaccgctcccgtcgag

SEQ ID NO: 1577 - DNA, 339 bp, Streptomyces avermitilis
  CDS (1)..(339)
atgggtgaggggcgacgtcagtcgcacagggggaaggcggcacagatgttcggcagactccgcacgtccttcagcaggtttcgcaactccatgcgtgtggaggcggccccgcgcgggggcaagcagaaccacaacctgttcgaagcggccgccgcctatgtggccgcgtgcgccgaggacgaccaggagcggatggacgaggccgcgacctgggtgtcgcccgaggcgctgtcgttcggggtgagcgagctggcgtgccgggccgtcatcgcgctcgcgcgggaacgcgacgagtcgtcgcggaccgtggcgcggaccctcctcgggctgcccatggcc

SEQ ID NO: 1578 - DNA, 879 bp, Streptomyces avermitilis
  CDS (1)..(879)
atggccgggacggacgaagagaccgtcgccgcccaggacgacgcgctgtatgtgctgacggcggtgctgttgacgcccgcgaagtttcccagcgtgttgggtgacgactatccggaagcctgcgcggcgctcggtctggcgccgctcgccgacgggtacggcctcgtgctcggccaggacggagatggcgcgcggtggaccgtcgtcatcgacgatgtgtcgctggtggccgtggccatcgcgtcatgggactgcggcatggagtacgacctgtcgcccgaggagcacacggtcgtcgccgcgctgcccggctggcccctggcggtcgccgtcgcggcccccggtgtgccggctccgcatgatccctcgcccgaggtcacggatctcgagccgctgcgtccgccggactgcgagacctggggttccgcgcagcggcgcctgggtgcggacgagatcgcgctccagtgggcgacctggcgggggcagatcggcgacgactacttcacgaaccggaacggcgaagcgtcggccgaggaacccgtgaaagccgacgacggtgacggcaacaacgagaacgacgccggcgacgacaacgtcgacagccggaacacgccgcgtcgcggcatccgccgtgtcctcgcggaggcgcgctcgtacgtggacactccgccgccgctgggccgtgtccggtcctccttcgcgcccggcgacgcccgcaccctgcgtgcggacgggcccggctggtccatcgtggcccggacggacgacatcgcgttcgtcctgctcgacgaggagcccggagaggtccttccggtgggccgtggtcccgagctgcccggccttctggaggcactcgacaagatggcggtccgcccggcc

SEQ ID NO: 1579 - DNA, 234 bp, Streptomyces avermitilis
  CDS (1)..(234)
atgcacccgttctcaggacagagagcggcagtggccgcgaaggaggcgacatacatgtcgaagaacgcgaagatcgccaccggcggtgtggtggtcgggctcatcctgtggatctggcttccctggtgggccgccctcctgatcatcctgggagtgccggccgccgcgtatctggcactggaccccgcacagcggcgcaggctgcgccgtgtcacgcgcaaggaactcggccgc

SEQ ID NO: 1580 - DNA, 1059 bp, Streptomyces avermitilis
  CDS (1)..(1059)
atgccccacatcgcagcagtcgccacggagccacctccgggcacactctccggacagcacgcgggcagtgaattcgcgcccctgttgcgcaccgtgaaggggcagggcctgctggagcggcgacacggctggtacgcgcgcgagatcgccctgaacgccctggccctggcgtcggtcgtgacgggcgtcctgctgatgggtacctcctggtgggtgctgctcctcgccccggtgctcgccgtgctctccacgcgcaccgcgttcataggtcacgacgccggtcactcccagatcaccggcgacaagtccgtcagccgcctcatcggactgatccacggcaaccttctcctcggcatgagctatgcgtggtggaacgacaagcacaaccgtcaccacgccaaccccaaccacatcgacaaggaccccgacgtcgccgccgacgtcctggtcttcaccagtgagcaggcgagggaacgggtgggcttccgacgctggctcacccgcaaccaggcctggctgttcttcccgctcaccctcctcgaaggcattgccctcaaggtgtccggcttccaggacctgcgccgtcagccgccgcgcgaacggacggtggaggccctgctcctggtctcgcacgtcatcggctacgcctgcctgctgctcgtctccatgtcccccggcaaggccctcgccttcgccgccgtccatcaggcactcttcggtctccacctgggcctgtccttcgcacccaaccacaagggcatggaaatgcccgaccccgacgccacacgcttgggccacctgcgccgacaggtcctcacctcgcgcaacgtccggggcggtccgctgaccgactggttcctcggcggactcaactaccagatcgagcaccatctgttcccgagcatgccccgcccccacttgcgcctcgcccagcccctggtacgcgcccactgccgcgaaacgggtatctcctacgtggaggccgggctcgtcgactcctaccggcaggccctgcgccacatgcgcgaggtgggcgagcctctgcggagccagtaccca

SEQ ID NO: 1581 - DNA, 2937 bp, Streptomyces avermitilis
  CDS (1)..(2937)
atgcccgcggcgacccccgccgagatcaccgaagtggcccgctgctgtgccgtgttcatgcccgccgaaccggcccgcaccggtcgcgtcgccttctggcggcccgacggcgacgcaccgcccgccgtcgcgggcggctcggtcgaagagctgaccgtcgttctgcccggcgacgagggtgtcgaacgggtcgccgtaccggccgtgctgctgtcggtgcgtgccgctctgccggtcctcacgcgcgcgcgtgctgccgcgcacacccaccgggcgaccgcgttctggggcaccgccggagtgctcgcgctgcaactcgtggcgcgggggctgctgctgcccggcctgaccgccggcgaccacgatgcgtggcgggcgggtccgctgcgcgccgaggacctggaccgcatccgtgacctggccgccgcgatgccgcccgaggcgcacgccgtgccgtgggccgacaccgagccgctgcggctgcccggccccgagccgctgctgcgcgccttcctcgacgcggtcgccgacaccctgccccgctcccccgccgcgccgctggcggcgggcggcccggccttcgcggcgcgagagccgcagcaggtgcccgaacagcgggcctgggccgcggacgtcgccgccgggcacgacgccggcgtacggatctccctgcgcgtcgaggtaccggggctcgcgtcgatcgcacccggggaggcgggctcggccgcgtcgcgagcggaagcatcggccaggccgcaggagaggtcgtccccgggcccggaggagacggcgtcgaccggatcggcggcggtgcaccccgccttgcgcgccgtactgcaagtgcacagtgtgagcgaccccgcgctcgttgcggacgcctccgccgtgtgggccggggcgcgggccttcgggccgcgcgcgcggatggacgtcctgctcgcgctgcaccgtgcggcccgggcctgggcgccgctcgccccgctgctctcggccgccgtaccggacacggtcgacctcgcggacgacgaggcggccgaactcctcggtgagggctcccggatgctggccgcggccggtgtcgacgtgcactggcccaaggaactcgcgcgcccgctgacagcccgggcggtcatcggcccgccggacggcgggcaggggaaggaccgagccgcgtcggacgtgccgtcgttcctgtccgccgacgcgctgctcgccttcagctggtggttcgcgctgggcgaccagcagctcacgcgggcggagctggacacgctcgccgaggcgaaccgccccctcgtgcggctacgcgaccagtgggtcctggtcgacccgcgggaggtgcgtcgcgcccgcgcgcagcaggaccgcaaggtcacacccatcgacgcgctcagcgccgttctgacgggctccacggaggtcgacggccgccgggtcgacgtccgggccacgggatggctcgcggccctgcgggagcggcttgcggccccggaggggcaggcgccggtcgcgcagcccgccgcgctcgccgcgacgctgcgggactatcagctgcgcggcctcggctggctggcccggatgacctcactggggctgggcgggtgtctcgccgacgacatgggcctgggcaagacgatcaccctgatcgccctccatctgcaccggcagtccgacgattcggcggccggcccgacgctcgtcgtctgcccgacctccctgatgggcaactggcagcgggagatcgagcggttcgcgcccggcacgccggtgcgccgcttccacggctccgcgcgcagcctggacggggtggcggacggcgggttcgtactcaccacgtacggcacgatgcgcctcgatgcggagcggctcgccgaggcgcggtggggcatggtcgtcgcggacgaggcacagcacgtgaagaacccctactcggccacggcccgggcgctgcgcacgatcggcgcacacgcgcgcgtggcgctcaccggcactccggtggagaacaacctctccgaactgtgggcgatcctcgactggacgacacccggcctgctcggcacgctcggcagcttccgcacgcggtacgcgcaggcagtcgagggcggccgggaccccgcggcggcggagcggctcgcccggctcctggggccgttcctgctgcggcgccgcaagtcggatccgggtatcgcgccggaactgccgccgaagaccgagaccgaccgcaccgtgtcactcaccaaggagcaggcgggtctctacgaggcggtggtgcgcgagacactcgcggagatctccggcgccgacagcatggcgcggcgcggcctgatcgtgaagctgctgaccgggctgaagcagatctgcaaccacccggcgcagttcctcaaggaggagcggccgaacatcgcgggccgctccggaaagctggaactgctggacgagttgctcgacaccatcctctccgagggggcgggtgtcctggtcttcacgcagtacgtgcggatggcccgcctgctcgaacggcacctggcggcgcgcggagtgccgtcgcagttcctgcacggcggcacgcccgtccacgagcgggaggcgatggtgcaccgcttccaggagggcgaagtgcccgtcttcctgctgtcgttgaaggccgccggaacgggactgaacctgacccgggcggaacacgtcgtgcactacgaccgctggtggaacccggccgtcgaggcgcaggccaccgaccgcgcctaccgcatcggccagacccggccggtgcaggtgcaccggctgatcgcggagggcaccatcgaggaccgcatcgccgacatgctgctgcgcaagcgggagttggccgatgccgtgctcggttccggggagtccgcgctgacggagctgaccgatgcccaactggccgacctggtggaactgcgagggggcgcacga

SEQ ID NO: 1582 - DNA, 1275 bp, Streptomyces avermitilis
  CDS (1)..(1275)
atgaaggaccgggacgaggaacgtacgttcgcgccgttgccgcccgcacacgggcggggtttcgcccggacctggtggggccaggcctggttgagggccctggaggacgccgcgctggactcggagcaggtgaggacgggccgtcggctcgcgcgcgcgggcgccgtgggagccgtgtcggtgcgccccggaggcgtcacggccgtcgtccaggaccacgaccacaccgcgcaccgcgccgacgtactactccaggagctgtccgaggagcagtgggaccgcttcctggacatgaccgtcgaacgggccgggcacatcgcggcgctgctcgaccgtgagatgccgccgcatctggtcgaggacgcggcggccgccggagtcgaactcctgccgggcctcggcgatctggaggccacatgcgactgcgacgcctgggaccactgcgggcacaccgccgcgctctgctaccagatggcgcgcctgctggaccaggatccgtttgtgctgctgctgatacgggggcgcggcgagagcgagttgctccacgctctccaggcccgcagcgccgtctcccctcaggagccgtcggccccggacaggcccctggagggcgtggacgccgccgagacgtacgcgaccggattccttcttcctccgctgcccgggcctccggaactgcccgcggagccggggctgccgccttccctggacaccgaggtgcccccggcgcccggcgtcgatccggacgcgctggggttcctggccgcacgcgccgcgcacgaggcgcaccgactgctcgccgaggccctgcggacggggcatgaacagcacgtggccgaggaggagttgacgcccgccgaggacgcggtccggctcgcggccggcgccccgggaacgaccgtcgcggcccggctcgccgacggtacgggccgtgacggtgaaggactggcggcggccgtacgcgcctggcactgcgggggcgtggccgcactggccgtactcgaggacgactggacggcggagccggaagcactctcacgcgcgcgtgccgccctggagtcgtcctgggacgaggacgagcgcccccgtctgcgggcgtcgggcaaccgctggagcgtggtcggcgggcgggcgcaggtccgtctgggggcggagggccggtggtggccgtaccgaaaggaacgtggccgctggctgcccgcgggcccggcggcccaggatccggcgacggcgctggcgctggcgctggcagcgacggacggggaagaaagaggc

SEQ ID NO: 1583 - DNA, 1281 bp, Streptomyces avermitilis
  CDS (1)..(1281)
gtgaccgtaacgatcgctccgtccgaagcggccgttccgcctgccgaagagacgtccgcagacgaggagttctgggtcgagccacccgcgtccggcgatgtcgcaccgtcgggtgacgctgcaccgtcgagcgaggtcgcgtcgtcgggtgacgcggctgcgtcgggtgacgctgcgcccatggagggttccgcgtcgatggaggactccgcatcgacggagagctccgcatcgaaggagggctccgcggcgacggagaactccgcccctgtcctcgacgtgcccgagccggtggcccgggacgcccgtgagttcggggtgtacgcgcggaccggcggctgggcgttcgcgttgaaggtggcgcgcagcgtgcggcccggcgggcagtcggccgaggagacgcccaaggtgtccgcgaaggagttcgccgcactggcgggctgctcggcggagcgggtcatgcgctactacaaggcctgggacaaggcggccgacgacgggatcgtcccgcacttcgaggtgctggttcccggcgcggacatcgagctgccggacgcggacgtgtggctgtcgtactacacctcgcgctccagcgccgcctcggagcgcgggaccgcgatcgcggcggcggcccaggcggagggcatccggccgaccaaggcgctggaggtcgccgagaacccgaccgcgctgcgggccgcgatcctcgccgacccctccaccgcccaggcggcccgcgccgcgctgctcgaccggctcaaggaggacccggccctgcagacggagctggcgcgcgacatcgccaggaccgacgagctgaagaaggcggtcgccaccgagacccgggccgccgaccgcatcggatacgtgcgccagatcgtcgagaacggtcaggtcaagacgccggccgggcagacgatcgacgcccccgccgagctgcgggcggaggccgagcggcatctgtccctcatcgacgagctggacgacgacgaagaggccggacagtgggccacggacgcgtacgacaccgtgaaggacctcgtcgcccagacggtcgccgccgaccctgaactgcgcctccaggagcgccgtacgaagttctacagcagcctccagagggcgacgagggtcttcgaggagctgaccttcgacgacgtcgacgacctcgacacgatctacgaggacgacatgctccagcgccttgaggagctccagcaggccatcacgatgtgcatcaccactctgcgcaaggcggccccggcggcggagtcggccgaggcg

SEQ ID NO: 1584 - DNA, 1605 bp, Streptomyces avermitilis
  CDS (1)..(1605)
atgaccgccgcgctgacggccgcgaagcaggggctgagctgcgtcgtcgtggagaaggcggccaccttcgggggctcggcggcgcggtccggcgcgggcatctggattccgaacaaccccgtcatcctcgccgcgggcgtccccgacaccccggcgaaggccgccgcctacctcgcggcggtcgtcgggcccgacgtctccgccgaccggcagcgcgccttcctcggccacggacccgccatgatctccttcgtcatggcgaacagcccgctccgcttccgctggatggaggggtacagcgactactaccccgagctctccggcgggctgccgaacggccgctccatcgaacccgaccagctcgacgggaacatcctcggcgccgaactcgcccacctgaacccgtcgtacatggccgtcccggccggcatggtcgtcttcagcgccgactacaagtggctcaccctgtccgcggtcagcgccaagggcctcgccgtcgccgcggaatgcctggcccgcgggaccaaggcggccctcctcggccagaagcccctcaccatggggcagtcgctggccgcgggtctgcgcgccggcctgctcgccgcccaggtgccggtgtggctgaacaccccgctgaccgatctgtaccgggagaacgggacggtcaccggggcagtggtggccaagggcggctcggccggtctggtcagggcccggcacggggtcgtcgtcggctccggcgggttcgagcacaacgcggccatgcgcgaccagtaccagcgccaacccatcggcaccgcgtggaccgtgggcgccaaggagaacaccggcgacggcatccgggccggcgagcgggctggcgccgcgctcgacctgatggacgacgcctggtggggaccgacgatcccgctgcccgaccagccctacttctgtcttgccgaacgcaccctgcccggcggcctcctcgtcaacgccgccggagcgcggttcgtcaacgaagccgccccctacagcgacgtcgtccacaccatgtacgagcggaacccgaccgccccggacatcccggcctggctgatcgtcgaccagaactaccgcaaccgctacctcttcaaggacgtcgcgccgacgctcgcgttccccggctcctggtacgactccggcgccgcgcacaaggcctggaccctggacgccctcgccgggcggatcggcatgcccgcggccgccctgcgggccaccgtcaaccggttcaacagcctggccctgagcggcgacgacaccgacttccagcgcggcgacagcacgtacgaccactactacaccgaccccgcgatcgtgccgaactcctgtctggcccccctgtggctggccccgtactacgctttcaagatcgtcccgggggatctcggcaccaagggaggcctgcgcacggacgcacgcgcgcgtgtgctgcgcgcggacggctcggtgatccccggcctgtacgcggcggggaacgccagtgccgcggtgatggggcacagctatgcgggcgcgggctcgacgatcgggccggcgatgaccttcgggtacatcgccgccctggacatcgcggctgcggccggaagc

SEQ ID NO: 1585 - DNA, 492 bp, Streptomyces avermitilis
  CDS (1)..(492)
ttgtccccgtgcggccgattgtcagtggctcctggcacgatctccggcatgggagttcgctacgactacttcgccgctgccgacgacgccggggccctggcccgccttcacggggacctgggggcggtcgacgacgagttcggcctgacgggtctcaagggagcggacccggatctcatcctcgggccggtcgaagcgggcctcaccgggcgttccgtggcggaggtggaggacgacccgcgttttacgcgcctgatcagtgatccgcaggccgaggaccgttgcctggtcactctcaccgggacattgcgtgatgccctggccggggcgcggccggagcgcctggggcagaccgccatgacggtggtgtccggccccgaggactcggcgggctgggacgcggacctgctcgccgacttccttcagcggctggccgagctgagcaggcacgcgcgcgtgacgcaccaacagctctactgcctcatatcgttg

SEQ ID NO: 1586 - DNA, 966 bp, Streptomyces avermitilis
  CDS (1)..(966)
atgcagtttgtgaagctcggttcgacgggcctggatgtgtcccggatctgcgtgggctgcatgagtttcggccttcccgaccgtgggccccacgagtggaccctcgacgaggaggcctcgcggccgctgatccggcaggcgctggaggccgggatcaacttcttcgacacggcgaacgtctactccgacggcaccagcgaggagatcgtcggccgtgccctggcggacttcgcacgccgtgaggagatcgtcctcgcgaccaaagtcaacggcagcatgcacgaaggacccaacggccacggcctgtcccgcaaggcgatcatgacggagatcgacaacagcctgcgccgcttggggaccgactacgtcgacctgtaccagatccaccgctgggatccgaccacccccgtcgaggagacgatggaggccctgcatgacgtggtcaaggcgggcaaggcccgttatgtcggggccagttcgatgtacgcctggcagttctccaaggcccagtacaccgcccggctgaacggctggacgcggttcgtctccatgcagaaccactacaacctcctctaccgagaagaggagcgcgagatgctgccgctgtgcgaggaccagggggtcggcgtgctgccctggagcccgttggctcggggccgtctcacgcgggatcgcgacgtcaccaccgcccgcagccggaccgacgagttcggcaagaccctgtaccggcagggcgacgacgagatcgtcgacgccgtggcccggatcgccgccgaccgtggtgtgccgcgggcccgggtcgccctcgcctggctgctgcaccaacgcgcggtgacggcaccgatcgtcggcgccaccaagccggcgcatctcgacgacgcggtcgccgcgctcgacctggaattgtccgagaaggagatcgagcagttggagcagccgtacgtacccagggccatcagcggtcac

SEQ ID NO: 1587 - DNA, 852 bp, Streptomyces avermitilis
  CDS (1)..(852)
atggctcatggcatttccctccacatcggactcaacggcgtcgaccgcaccaaatacggtgggtgggacggcaagctcatcgcctgcgagaacgacgcacgcgacatggaacagctcgccaaggaagccgggatcaaagagcgcacaacgctgctcacccccgaggcgacggtcgacaacatcaccgctgagctgcgcaaggcggcgaaggtcctcacagccggcgacctcctgctcttcagctactcgggccacggcgggcaggtacccgacctcaatggccccgaggacgagtcggaccggctcgacgagaccatgtgtttcttcgaccgggagtacatcgacgacgagctgtacaaggaattcgagggattcgccgagggcgttcggattctctgcttccttgactgctgccacagcggcagtggcatcagggtgcgagaaattctctcgccggaggccatggaagaacagttccagacgaccgaccccaaccaggtcgagacaacggccaggatcatgcccctggacatgcaggctgagatgtacgaccggaacaaggagttcttcgacgacatccagcgcaagctcaacgccaaggacaaccgcgacctcggcgcgaccgccctgctcatctcggcctgccaggacaatcagctggcagccgacggcctgcgtaacggtctgttcaccgcgaccgtgcttcaggtctggaacggcggcaagttcacgggcgggtacaaggcgtttcaccgcgagatcctcaagcagatgccggccatccagagcccgaatctgttcatcaccggccgggccaacaaccggttcatcacggagcggcctttcacgctc

SEQ ID NO: 1588 - DNA, 564 bp, Streptomyces avermitilis
  CDS (1)..(564)
gtgtcccgaagggggcgcagggcgcgggacaattgcggtatgaacgggacatccgaagtacatgcggacggcgggcgggaccgggacgcggaggggcgggcgcggaacgccaggccgcgggacgggctgggccggcctctcccctacggggtggacggggtggcgcgccagccggaaggcgtcgtacgcagccccatggacaccgtcaccgaggcgcaggccctgctggacgccgggaagcccttccatgcccacgaggtgttcgaggacgcctggaagtccgggcccgaggaggagagcggcctgtggcgcggcctggcccagctcgccgtgggcctcacacacgcggcccgggggaatacgacaggcggcgcccggctgcttcggcgcggcgcgggtgccgtcgaggagtgggcctcgcgggcgggtcgggaccggccctacggcatggacctgacggacgtcgtcgcctgggcgcgggacttggccgcggacgtggaacgcgacgaggaggccatcgacgcgggggcgtcggcgccacggttgcgggggagcacgccccgg

SEQ ID NO: 1589 - DNA, 768 bp, Streptomyces avermitilis
  CDS (1)..(768)
gtgcgaaagattcttgtcatcggtatcggtgcgggcgaccccgaccagctgaccttgcaggcggtcaaggcgctgaggagcacggacgtgttcttcatcctggacaagggcgaggtgaagtcggacctcgtccagctccgccgtgacatgctcgacgcgcacatacaggaggggacgtaccggctggtcgaggcgcgtgaccccgagcgcgaccgggccgccggcggcgccgcgtactcccccgccgtcggggactggcgcagcgcccgcgccgagatctacgagcggctcatcaccgacgagctgggcgaggacgagtgcggggcgttcctcgtgtggggcgaccccgcgctgtacgacagcacgctcggcattctggaggagatcctggagcggggcgcggtggcgttctcgtacgacgtcgtgcccggcatcagcagcgtctccgcgctcgtggccaagcaccgcaccgggctcaaccgggtcgcgcggccggtccagatcaccacgggccggcgcctcgcggagggcttccccgaggatgtcgacgacgtggtggtgatgctcgacgcccaccagaccttccggcggtacgccgaccaggacatcgacatctactggggcgcgtacataggcacgccggacgagatcctcgcctccggccccatcgcggaggcggcccctcgcatcgagctgctgcgcgcggaggcccgggagcggaagggctggatcatggacacgtacttgctgcgcaggcatccgcgggat

SEQ ID NO: 1590 - DNA, 744 bp, Streptomyces avermitilis
  CDS (1)..(744)
atgtccctgcacgtcctggtcctcggcggcaccaccgaggcacgtgaactcgctgcgtcgctcgcaccgcgccccggtgtgcgcgtgaccacgtcgctggcggggcgtgtctcccggcccgggacggtggaaggggacgtacgcatcggtgggttcggcggggcgcaggggctggccgcgtggctgggcgagcaccgtgtcgacgcggtcgtcgacgccacgcaccccttcgccgcgggcatcacggcgaacgcggcccgggccgcggcggcgaccggagtgccggcggtcgtcctgcgccggccgggctggcggccggggcccggggaccgctggcacgcggtcgcttcactcccggcggctgcggacctcctgccggaactcggccgccgcgtgttcctcaccacgggccgcctcggcctcgcggccttcgcgcaccaggccgaactgcacttcgtcgtccgttcggtggagtcgcccgagccgccgatgccgccggacacggaggtggtgctggcgcggggaccgttcacggtggccgacgaactcgggctgctgcgcgagcaccgcgtcgacgtcctcgtgacgaaggacagcgggggagcggcgaccgcggcgaaactcaccgccgcgcgggaactcgggctgccggtcgtcgtcgtacgccgcccgccgctgccggagggcgtgaccgccgtcccggacgtcgccggagcgctggctcggctcggcctcagcctgccg

SEQ ID NO: 1591 - DNA, 771 bp, Streptomyces avermitilis
  CDS (1)..(771)
atgaacacgatgacgctttggcacataaccccgtgggagttcgccgccctcgccgccgcggccctgctcgtcggcttctcgaagaccgctgtgagcggggccaacacggtcagtctcgcgatcttcgcggccgtcctgcccgcccgcgcctccaccggcgtactcctgcccatcctgatcgtcggtgacgtcctcgcggtcctcacctaccggcggcacgcccactggcccacgctgtggcggctgttcccggccgtcgcggcgggcgtcgtgttcggcacactgttcctggtgtgggcggacgacgggatcgtacggacgtcgatcggcgcgatcctgctgctgatggcggcggtcacggtctggcgccgacggactgcggacaggaccggggaaccggaggcggtggccacgcgcacgggccggatcaaggcccgctcgtacggtgtcctcggcggcttcaccacgatggtcgcgaacgcgggcggcccggtgatgtccctgtatctcctctccgcgggcttccggaagctcggcttcctgggcacctcggcgttcttcttcctcatcgtcaacgtgtccaaggtgcccttcagcgtgggcctcggtctgatcgacggccactcactgctgctggacgcggcactcgccgtcttcgtcgtaccgggcgccctcatcggcaagtgggcggtgaaccgcatcaaccagcggctgttcgaacagctcgtgatcgcggcgaccgtggtgggaggggcccagctcctgctgcgc

SEQ ID NO: 1592 - DNA, 1509 bp, Streptomyces avermitilis
  CDS (1)..(1509)
atggccgccaccctctccctcgccgcgatcctcgccgagaacgcccgccgccgccccgagaagacggcgctcgtcgagggcgagctgcgcctcaccttcgccgaggtgtggcagcgcgcccgcgcccaggccggcgccctcgtcggtctcggcgtacggccgggggaccgggtggcgctcatggcgcccaacaccgccgacttcccccacgcctactacgcgatcgccgcggccggcggtgtggtcgtcccggtccatctcctgttgtcggcgtccgaggtcgagcacgtcctgaaggacagtggcgccacactgctcctgtgccaccccgcgcaggccgagaccggtacggccgccgctcaggccgtcggcgtccaagtcatcacgctgggcgccgagttcgagaagctggccaggatcgccgagccgctgccctcgtacgtcacccgcgcggcggacgacccggccgtcgtgttctacaccagcggaaccaccggcgtccccaagggcgccgtgctcagccacttcaacctggtcatgaacgcgaccgtcaacgccttcgacgccaacgacatccgccccgacgacgtcgccctcggcgctctcccgctgtttcacgccttcggccagacggtctccatgaactccacctggcgcgcgggcgcgacgctcgtcctgctcccgcgcttcgacgcggcgcgcgcgatcgagctgatggtgaaggagggggtgaacacgttccacggtgtcccgacgatgttcgtcgccctggcgggcgccgccgcagccatggacgcgctgcccgagctgcgcgtctgcgtgtcgggcggcgcctcgctgccactcgccgtactggaacgcttcgaggaggcgttcggcgcgaagatctacgaggggtacgggctgtcggagacctcgccgaccgcgaccgtgaaccagcccgttttcggcaccagggcgggcaccatcgggcacccgctgtggggcgtggacgtcgagatcgcgcgtgccgaggtcgaaggacgcgtcgaactgctgccgcccggcgagctgggcgaggtcgtcgtccggggccacaacgtcttctccggttacctcggccgccccgaagccaccgccgagacgctcgtcgacggctggctgcgcaccggcgacctcggcaccaaggacgacgagggcttcctgcggatcgtcgaccgcaagaaggacgtcatcatccgcggcggctacaacgtctacccgagggaggtcgaggaggtgctcctgcgccaccccggcgtcgcccaggccgccgtgatcggactgccggacgagctgcacggcgaagaggtgtgcgcggtcgtcgtacgcgccacgggcgccgtcccggaggccgccgagatcaccgagtggtcgaaggagcatctggggcggcacaagtacccgcggcgcgtcgagttcacggacgccctgccgctgggcccgagcatgaagatcctcaagcgggagctgagggtgcggtacgcacaa

SEQ ID NO: 1593 - DNA, 1185 bp, Streptomyces avermitilis
  CDS (1)..(1185)
gtgcgtcccgtccacttcgcggcagctcgccgcacccccatcggcaagctgcgcggcgccctgtccgtcgtgcggcccgacgacctcgcggcgacggtgatacgcggtctgatcgccgacctgcccgggctcgacccggcccgtatcgacgacgtgtactggggcgcggccaaccaggccggcgaggacaaccgcaatgtcgcccgcatggccgccctcctcgccgggctgcccgagtcggtgcccggcgccacggtcaaccggctctgtgcctccggtctggaggcggtgaccacggccgcccgcacgatcgccgccggcgaggccgacatcgtgctcgcgggcggctccgagtccatgagccgcgcccccttcgtgctgccccgcccggacgaggccctgccgcaccgcatcgagaccgtcgacacccggctcggctggcgcctggtcaacccggccatgaaggaactgcacggcctgctctccatgggtgagaccgccgaggaggtcgccgaacggtacgcggtcccgcgcgaacgccaggacgagttcgcgctgcgcagtcaccggcgcgccgcggacgcccgcaagaacgggtacttcgacgacgagctgctgcccgtcacccggcccgacggcgtggtcgtcgccgacgacgagtgcgtacgcgaggacacctcgtacgagaagctgtcccgtctcaagccggtgttccgccagggcggcaccgtcaccgccggcaatgcctcgccgatgaacgacggagcggccggactcctcctcgtcagcgaggaggccctgaacgagctgggtctggagtccctgggacagtacgtcgccggcgcctcggccggtgtccatcccgacgtcatgggtatcggccccgtgcccgcgaccgagaaggccctggctcgcgtcggctggacgatcggcgacatcgaagaggccgagttcaacgaggcgttcgccgcccaggccctcgcctgcgtggaccgcctcggcatcgacccggagctcgtcaaccccaccggcggcgccatcgccctcggtcacccgctcggctgctcgggcgcccgcatcctcaccacgctgctccaccgcatgcgccgcaccggcgcggcccgcggcctggccacgatgtgcgtcggggtcgggcagggcagtgcgatcctcgtcgaacgccac

SEQ ID NO: 1594 - DNA, 480 bp, Streptomyces avermitilis
  CDS (1)..(480)
atgccggttgtgaagagcacgctccccgagcccgcccgccaggtcgtcggcgaggccctgcagcagacgctggtcgatctgctcggactctcgctcatcgggaagcaggcccactggaacatcgtcggaccgaggttccgctcgatccatctccagctcgacgaagtggtgtcgacggcccgtacgtacgccgacacggtggccgagcgggcggcggcgctcggcgtctcccccgacggccggcccgagaccgtcgccgcgtccttcggtctgcagggtccgaaggacggctggctgcgggacaccgaggtcgtacggctgctcgtcgaggcgctggaggcgacggtcggagggctgcgtgagcggatcgccgtcacggagaaggccgatccggtcacccaggacctgctgatcgggctcaccgccgaactggagaagcagtactggatgttccaggcggaggactggccgcgcgacaac

SEQ ID NO: 1595 - DNA, 645 bp, Streptomyces avermitilis
  CDS (1)..(645)
atgcagcaggaccgtcgcatcatcggggaactgatcgccgcgcacggcaccacgtacgccgatgaggcgggcatccggctcaaggatgccccgcagccgctgtaccggctcctggtcatggcctgtctgctcagcgcccggatccgcagttcggtcgccctcgccgccacgcgcgcgctgtacgacgccgggttgcgcgatccgcgccgtatggccgaggccgactggcaggaacgggtcgacgcgctgggacgcggcggctaccggcgttacgacgagcgcaccgcgacccagctcggcgagggtgccgagctgctgatcgagcgctggggcggggacctgcggcggatgcgggacgaggcggacggcaaggtccccgagctgcgcaggctgctgcgggagattccggggatgggtccggccggcgcggacatcttcctgcgcgaagtgcagcacgtctggccgggggtggcgccgcacctggacaacaaggcgctgtccggtgccgagcggctcggactcccgaaggatccccggaagctgatggaacgtgccggtgacaccgagccggccgttctggccgccgcgttggtccgggtggccctggacaagaagtcggcgcgggaagtgctcgcgcgggtcggt

SEQ ID NO: 1596 - DNA, 1236 bp, Streptomyces avermitilis
  CDS (1)..(1236)
gtgagcgacggatcgcgtcgtcccggctccggttccggccgtggtcgaggtcgcggggggcgacggatgcggtacatcgtgctggggagccggcctgcgcacggggtgggggcggtggcacgggcgcgcaccgcagagaaggcgacgcggcgtgccggggaccgcgacggcgtgaccgtgaaccacgggctgcgggtggccgcggcgtacgcatggcggctgctggtggtcggggtggccgtgtacgtgggcttcatgaccctggggcggttgcagctggtcgccgtggcgctgttcctcgcgctggtcgtgaccgcggtgctgcgtccgccggccggactgctggcgcggcggctgccgagggccgcggcggtggcggtgagcgtggtgggcagcctggtggtggcgctggggctgctggcgctggtcggcggcctggtggcgggcgagtgggaccagctgggccgggagttcggcgggggcctcgggcggatcgaacgatggctggaaggccctcccttccatgtggaccccgccgtgatgtcggatcttcagggcaaggtgagctccttcgtttcggagcaccgctcccagctgatcagcagcgcgctgagcggcgccgggcgcgtggtcgaggtgctcaccgcagcggtgctcgcgctgttctgctccattttcttccttcactccggggacaactactggcactggttcctggcgcggctgccggagggcgcacgggaaccctggggccgcgcgggacgggcggcgtggcggacgttcgccggatacacgcgggggatcatcatcgtcgcggccagcaatgcggtgctggtcgggatcgccctgttcgcgctgcaggtgccgctggccctgccgctgacgctgctggagttcttcgccgcgttcattcccctggtgggttcgcccatcgcgctggccgtggccacggtcgtcgccctggcctcacgggggccggtcgtcgcgatcgcggtgctcgccctgatcgtggtcgtcggccagatcgagggtcatctgctgcacccgctggtgatgagctgggcggtccggctgcaccccgtggtcgtggccctctccgtcatcgccggcagcatcctggccggggtgatcggcgcggtggtggctgtcccgatggtgtcggtcgcctggtccgtgctcagcgtgctgcgtcctccgcacgagccgggcgcgggtcaccccgggcggtcaccgggc

SEQ ID NO: 1597 - DNA, 534 bp, Streptomyces avermitilis
  CDS (1)..(534)
gtgtgccgcatgtccacaccctctccgccctcgctgccggccgcctcggcctcgccggaagtgaccgggatcgagcgggccctgacccggatcacgtatctgagtacgcgggctcggcagcatgaacgtctgatggcgctggcgggggttccgctggaccgggccgcggtggcgttgctgcggcagatctcggacaccgagccgttgcggccgggggagctggcccatcggctcggtgtggaggcttcgcatgtgacgcggcaggtgcagcagttggagaagtccggttacgtcactcgtgtcccggatcctgacgaccggcgggctcagcgtattcagctgacgtccaccggccgggaggcggtggaccgcatccgtgaggccggtgcgcgcggcatgcagatggcgctggccgaatggtcccccgaggaactgcggcaactggccaccctcttccaccggatggtcgacgacttcctctcctacgcggtcgacgacgccgagcaggagcccgcggcaacggcccactccgcc

SEQ ID NO: 1598 - DNA, 1215 bp, Streptomyces avermitilis
  CDS (1)..(1215)
gtgaaacgcattctggtcgtcggagcctcggcggccggcctcacggccgccgagacgctgcgccgcgaggggtacgacggcacgatcaccctcgtcggcgacgaatgccacgccccctatgaccggccgccactgtccaagcagttgctggccgcggagtgggaacccgagcggctcgccctgcggacgccgggcgacctggaggcactcgacctcgacctgcggctcggcgtcgcggcgaccgggctggacgtgacggaccgtacggtgcgtctggccgacggctcgtcggtgccgtacgacggtctgatcgtggccaccggagtgcgcccgcgccggctgcccggggagggcgcgcatgtgctgcgcacggtggacgacgccctcgcgctgcgggaccggctcgggccgggcacgcggctggtcgtggtcggggccggcttcctcggggcggaggccgccgccgtggcccggcgtctgggagcggacgtgaccctcctcgaacccgcaccggtgccgctggcccacgcggtcggcgcggaggtgggtgaggtgctgtcgcgggcccatctggagcacggtgtggagctgcgcaccggagtcaccgtgaccgaggtgaccgacgagggggtgcggctcgcggacggcgaggtggtcgaggcggacgagatcctggtcgccatcggctgtctgcccaacaccgagtggctgaagggcagcggactgacgctgggcgacggtctggtctgcgacgcgtacggcgaagccgcgcggagcgtgtacggcgccggggacgtcgcccgctggcacaacccgctgttcggggtgtccatgaggatcgagcaccgcaccaacgcggccgagcacggcatggccgccgcccgcaacctcctccgccccgaggcgcgcagaccgttcgcgccggtgccgtacttctggtcggaccagtacgacatgaagattcaggcgtacggctacttccgggcccacgacgagacggtggtcgtggagggggacctggccgaacgccggttcgtcgccgcgtaccgcaccggtgaccggctgaccggagccctcgcggccggcctgccgcccagggcgatccgccgctggcgccaggcgatcgcggccggcgcgacctggcgggaggccgtgcgggacaacatcagcccggcaacggccccttggggcagcgtactgccggagaaaattact

SEQ ID NO: 1599 - DNA, 195 bp, Streptomyces avermitilis
  CDS (1)..(195)
atgcgtgtggaactggacgaaccgaagtgcgtggcatcggggcagtgcgtcgtggccgcccccgaggtgttcgaccagcgggacgacgacggcgtcgcgatcctgctggacgaggaacccgccgccggactccacgacggcgtacgagaggccgcggcggtctgcccggcggcggcgatccgactggtggaacgg

SEQ ID NO: 1600 - DNA, 1239 bp, Streptomyces avermitilis
  CDS (1)..(1239)
atggccgatgccctggcgggccgcgcgcccgacgccaccccgccggtcgccgcgtacccgatgccccgggcggtgagctgcccgctcgccccgccgcccgccctgcaaccgttgcgcgacgagcagccgatcaccaaggtgcggatctggaacggcagcacgccctggctcatcacccgccacgccgatcagcgcgccctgctcaccgacccccgcgtcagcaacgacgaccgcgatcccggcttcccctacgtgaacgcgcaccgcgcggagatcgcgcacgcgaccccgaggctcatcaccaacaccgacgcaccggaacacacccggctgcgccggacggtcaacgcacctttcctcatcaagcggatcgaggccatgcggcccgccgtccagcggatcgtcgacggtctgatcgacgacatgctggacggaccgaacccggccgatctcctcaccgcgctcgcgctgcccgtgccgtccctggtcatcgcccagttgctcggtgtgccgtacgcggaccacgagttcttccagcgcaacagcaacctcgtgctcgacaactccgttccggccgaggaggcgcgggcggcgagcggggccctcgccgcctacctcgacaccctgctcgcggagaagaccgccgcccccgacgcggacgtgctgtccgagatgggcggccggatcaaggccggcgagatgacgcaccgcgaggctgtccacatgggcgtcgccatgctcatcgccggacacgagaccaccgcgacgatgatcagcctcggcaccctcgccctgctcgaacacccggagcagctggccgtgctgcgggacgccgaggacccgaaggtgatcgcggccgcggtggaggaactgctgcgctatctgaccatcgtccactccggcatccgccgggtcgccaaggaggacatcgagatcggcgaccgggtcatcggcgccggggacggccttctgttcgatctgcacgccgcgaactgggactcggaggcctttcccgaggccgaccggctggacctgagccgtcccgcccgccaccaccaggcattcggctacgggccccaccagtgtctgggacagtcgctggcccggctggagctccaggtcgtctacggcacgctctaccgccgcttccccacactgcgtctggccgccccgatcgaccggctcgcgttccaccacaccggcaccacctacggcgtccgctgtctgcccgtcacctgg

SEQ ID NO: 1601 - DNA, 702 bp, Streptomyces avermitilis
  CDS (1)..(702)
atgtacggcagagccagtgagagacccttgctcgcccgcggagacgggcggcacgtactgattgtcgtagacgacccggagatcgccgaactgctgtcgacgaccatggaactggcgggctttcggatcagcgtggcggatacggcgggcgaggcggtggcgcggctcgtgaagcgtcggttcgacctcgtggtcctcgacgcggacctctcggacatgacggaactcgcgcaggagccccgcctcgccgtcgtcgagcgcccgcgggtgctgctcctggccgagtacgactccctggaccggctgctgcccgagctggggccgggggagacggactatgtcaccaagccccttcggatcgccgaagtcctggccagagcgcaggtcttactgcacggcaggcggcgggtgcgccgggagggcacactgggctacggggatctggtgctcgacgacagcacctgccaggcgtggcgtggacagcgggcgctcgacctgacgcccgcggagtaccggctgctgcgccacctgctcgtcaacgcgaacaaggtgctctcgaaggagcggatcggccggttcgtccggggcgagttccgcgggggcaacgcgatcgaacagctcgtctcccgggtgcgacgcaaggtcgaccgggacgggccgccgctgatccacacccgccggggcttcggctactggctgggg

SEQ ID NO: 1602 - DNA, 768 bp, Streptomyces avermitilis
  CDS (1)..(768)
gtgccggacttctccagcagggcaggcgtcgcgttcgtcgcggggggcaccggcgggatcggcgcggcgatcgtccgtacgctggcgcggcggggcagcgacgtggtgttcacgtaccgctcccagcaggccgctgccgacggtctcgccggtgaggccgaggcgtacggacgccgcgtcgtggcggttcggctcgacctgggcgacgaggcggccacggcgcgggccgtgtccggggccgccggaacgccgggcgggctccacaccctcgtgtacgcggcgggcccgcacgtaccgatggtgcatctgagcagggtgtcgccgagtcaataccatgcccaactcgcggcggacgcgggggcgttcttcaacctggtccatcccgcgctgccgccactgcgtgagagccggggcagcatcgtcgccgtcaccaccgtggccacccgccggttcccggtccgcgacggactgtcgtcgggcacgaagggggcggtcgaggcggtcgctcgggcgctggccgccgaagagggacgctacggcgtacgcgtcaactgtgtcgcgcccggcatgctgaccgacggcatggccgcacgcctgatcgagtccggcgaactcgacgaggcggcgctggagatcacccggggcaacatcccgctgcgccgcttcggcgatgcgacggacatcgcggaagcggtcgcgttcctggcctcggaccgcgccggctacatcaccggccagtccctgggtgtcgacggcgggtacagcgtc

SEQ ID NO: 1603 - DNA, 1326 bp, Streptomyces avermitilis
  CDS (1)..(1326)
atgtcctcctcccacctgtccgctcgcggcagcagactggccgcgctggtcgtcggcctgtgctggctggtcgtcctcttcgacggcctcgacatgttcgtctacggcgccgtgctgccccacatgctggaggagcacgccctcggcctcgagccgtcccaggccggcgacctcggcagctacgccaccttcggcatgctgatcggcgccctgtccgcgggtacggtcaccgactgggtcggccgcaagaaggtcatcctcagctgcaccgcggtgttctcgctcgcctccgccctgtgcgcggtcgcccccagcatcggtgtcttcggactcggccgcttcatcgccggcctcggcctcggcggcctgctgcccaccacgatcacgatggtcgccgagtacgccccgcgcggtcgcggcgccctgatcgtcggcatgctgatgaccgcccatcaggccggcggcatcctctcgggcttcgtgggtctgtggaccggcggcgcgggcggctggcgcgtcgcctactggatctgcgtggtcccgctgttcatcggagtgccgctggtcgccaagttcctgccggagtcgatgagcttcctgctcgcccggggccgcaccgaggaagcccgtgaactcgcccgccgctacgacgtcgacatgcccgcccccgaggcggagcgccccgccgccggggagcgctggagcgccctcgccgcactgttccgcggcaacctgtggcgcaccaccctgctgttctggctggcctccttctgcggactgctgctcgtgtacggcgtcagcaactggctgcccaccatgatgcgcggcgctggctacgagctcggctcctccctgtcgttcgtcatcgtcatcaacctcggcggcatcgtgggcatgctggtcgccggccgcttctccgaccgctacggcgcgccgctcgtcgccaccatctggttcgcggccaccgccgtcggcgtctacctgctcggcattcacatgccgctcgcgctcacctacgtggtggtcttcctcaccggcctgttcctcttcagcgcccaggccatgatctacgcggcggtggccggccgctccggtgccgacaaccgcgccacggccgtgggctgggtgtccggcatcggccgcttcggagccgtcttcgggccgtggctcggcggccagctcgtcgcgagcaaggccgagggctggggcttcaccgccttcgccgtcgccgccgtcctggccaccgtgttcgtgagcctcaccggcctgcgcagcccgcggcggacgcaggggagcaccgctccgcagcggctgtccaccaccggc

SEQ ID NO: 1604 - DNA, 948 bp, Streptomyces avermitilis
  CDS (1)..(948)
atgactccgcccctcggagacatcgcccacctcgggcacgtcgaactgctcaccccggacctggaccgcagtgtccggttcttcaccgacatcctcgggctgaccgtcaacggcacctccggagactccgtctacctgcggacctgggacgactacgagcaccacagtctgatcctcaccgcgcacgggaagccggggatgcgccgcacggccctgcgcgcctccagcgaggaggcccttcagcgccgggtcaaggatctggagaacaccggccgcgggggtcgctgggtcgaggacgaaccgggcatcggcccgctgtacgtctccagtgatcccgacggccacgaactcgccctgtattgggagagcgagtggtacgaggcaccgcccgagctgaagccgggtctgaagaaccagccccaggccaagcccggccagggcgtgggcgtgcgccgcctggaccacgtcaacttcctcgcctccgacgtcgcggccaacgcggccttcacccgggaggtgctcggcgcccgcgccaccgagcagatcgtgctcgacagcgggaaggtggccgcccagtggctcaccttcaccaacaagtcgtacgacgtcgtctacacctcggactggacgggttccagcggacggctgcaccacgtcgcgttcgcgaccgacaaccgtgacgacatcctgcgcgccgccgacctctgcctcgacaacgacgtgttcatcgagaccggtccgcacaagcacgccatccagcagacgttcttcctgtacgtctacgagccgggcggcaaccgcatcgagctgtgcaacccgctcacccgtctggtgctggcccccgactggccgctgatcacctggaccgaggccgagcgggccaaggggcaggcctggggcctgaagaccatcgagtccttccacacccacggcacaccgcccgtcgac

SEQ ID NO: 1605 - DNA, 1071 bp, Streptomyces avermitilis
  CDS (1)..(1071)
atgctcatgcgcggcggcacctccaagggggcctacttcctggccgaggacctgcccgccgacgccggcgcgcgcgacgacctgctgctgcgcgtcatgggcagccccgatccgcgccagatcgacggcctgggcggggcgcatcccctgaccagcaaggtggccgtcgtctccgtctccgccgaccccgaggcggacgtcggctatctgttcctccaagtcggcgtcgacaccgcccaggtgaccgaccggcagaactgcggcaacctgctcgccggggtcggccccttcgccgtggaacgcgggctggtcgccccgggggacgcggagacgtccgtacggatccgcatgctcaacaccggggacctggccgtcgcgacctttcccaccccggggggacgcgtcgactacaccggctcggccgagatctccggtgtgccggggaccgccgccccggtggtcatcgagttcccgccgggcggcagtccgctgctgcctacagggctggcccgtgacgtcgtcgccggcaccccggtgacctgcgtggacaacggaatgccgaccgtgttgatcgccgcttcctcactgaacgtcaagggctacgaggaccccaaggacctggaggaggatgtggccctcgccgaccggctccgggcgatccggctggaggccggacggctgatggggctcggtgacgtcgacggcaccaccgtgcccaaactcagcctcctggcaccgcccctgcacggcggcgcgatcatgacccgcaccttcatcccggtgcgctgccacacctccatcggtgtcctgggcgccgcgagtgtggccgccgggctgcgcgtcgaggggggcgtcggccaggacctggcgcgcctgcccgcacacggggaccgattgcgcatcgagcaccccaccgggttcctcgacctcgaaaccagcatcgagcacggcgccgcgggcgcagtgccggtggcccgccggaccgccgtcgtgcgtaccgcgcgaaagatcttcgacggcaccgtcttcccccggtccgccgcaaccgcgccgacacccgcgcgccacagc

SEQ ID NO: 1606 - DNA, 708 bp, Streptomyces avermitilis
  CDS (1)..(708)
atgagcggcgtgatcgtcaccaacccgcccaaggcggatgcgaaggacgtcgagtcgctgtccggctacggcgtggccacggtccacgaggcgctcggccgcagcggcctcctcggccccgacctgcgccccatccagcagggcgtacggatctgcggcagcgccgtcaccgtactcagctggcccggcgacaacctcatgatccacgcggcggtggagcagtgcggcgagggcgacctcctggtcgtcaccaccacctctccctccaccgacggcatgttcggcgagctgttcgccaccgccctccaacggcggggcgtgcgcggcctggtgaccaacgcgggcgtgcgggacaccgaagaactgcgtgagatgggcttcccggtgtgggcgagggccgtgagctcccagggcaccgtgaaggccaccggcggctcggtcaacgtaccggtcgcgatcggcgggcagacggtccggcccggcgatgtgatcctcgccgacgacgacggtgtcatgtgtgtgccccgcgagcggtccgcccgggccgtcgaggcgtccgccgcccgcaccgccaaggaagaggcgtcccgcgccgccttcgccaagggcgagctgggcctcgaccgctacggactgcgcgacaccctcgcccggctcggcgtcgagtaccgcacctacgaggagtacgcccgcgaggaggcgggctcg

SEQ ID NO: 1607 - DNA, 747 bp, Streptomyces avermitilis
  CDS (1)..(747)
atgacgcacggcaacgcgcccgccaccccacggtccacactcgtcatcaccgcgcacgccggggacttcgtgtggcgagcgggcggagccatcgccctggcggcgtcccgcggcgagaaggtcaccatcgcgtgtctgaccttcggtgagcgcggcgaatccgccaaggcgtggcgcgagggcaagtcgctggaggagatcaaggggatccggcgcgaggaggccgagaaggcggccgccaccctcggcgccgaggtcgtcttcttcgacgccggcgactaccccctgctcgccacgcccgagttgaccgaccggctggtggccgttcaccggcaggcccagccggacgtcgtgctcacccaccccctcgacgacccctacaacggcgaccacccggcggcggctcggatggccctggacgcgcgcgtgctcgcccaggccatcggctacccggcccccggggagatcatcggggccccgccggtgttcttcttcgagccgcaccagcccgagatgtgcgggttcaagccggaggtcctcctcgacatcaccgaggtgtgggagaccaagcgcaaggccatggagtgcctggccgcccagcagcacctgtgggactactacaccgacctgggcaagcgccgcggtgtccagctcaagcgcaacgccggacccaacctcggtctgccgcacgccacgtacgccgaggcgtacatgcgtccctacccgcaggtcacgggggagctggca

SEQ ID NO: 1608 - DNA, 648 bp, Streptomyces avermitilis
  CDS (1)..(648)
atgccgaaggaagcccgtccgagcactggagagcaggccaagcagcatgcgttgacgcagctgcggcaggcgatcctgcacggcgagatggcaccggcgcagcggctggtggagaacgaactcgccgaacagttcggtgtgacgcgggccagcatccgggcggcgctcatcgatctggcggccgaagggctggtggagcggatccgcaaccgcggttcgcgggtgcgggtggtgaccgtggaggaagcggtcgccatcaccgagtgccgcatggtcctcgaagggctgtgcgcggccaaggcggccgtcgcggccagcgacgagcagctgaccgagctcgcggacctgggcgcggcgatgaccaaggccgtggccgacggcgagccggtgacgtactcggagctcaaccatgaactgcacgacaggatccgggagttctccgggcagcagacggccgtggagctactggagcggctcaacgcgcaactggtgcgccatcgcttccagttggcgctgagaccggggcgtccgcagcactccctgaacgagcacctgtccatgatcgaagcgatcagggacagggacccgcaggcggccgaggtggccgtccgcgcccacctcaccagcgtgatcgaggcgctgcgcgac

SEQ ID NO: 1609 - DNA, 1494 bp, Streptomyces avermitilis
  CDS (1)..(1494)
atggccggaaccagcgacccgaccgcgggagccggctcgccgggcgggaagccctcggaacccggctgggtgccggactccaagttccgcaaggacatggggccgtgggcgaacttcgcactcggcttcacctacctgtcacccgtcgtcagtacctacaccttgttcggcaccgcgctcgccgcgggcggaccgcccatgatctgggcgttcctgctggccggtgccggccagttcctcgtcgccctcgtcttcggcgaggtcgtggcgcagtaccccatcgccggaggcgtctatccctgggcccggcgcctgtggggcccgcggtgggcctggatgaccggctgggtctatatgtgggcgctcctggtcacgatcacctcggtggcgtacggggcaggcccgtacatcgcgatcctgctcggcttcgcgccgaccgtgcacacgaccgtcgggtgcacggtggtcctcatcgtggtggccgccctgatcaactacgcgggaaccagggctctttcgtgggcggccgtcatcggtttcaccggggaactggtcggggcgctggtcgtcggcatctacctgctggtcacccatcgcgagcacggcatcggcgtcatcttcgactccttcggcgccgagggcgacggcagctacctgccggcgttcctcggcgcggccatcatcggcttctaccagtactacgggttcgaggcctgcggcgacaccgcggaggaggtcgagcaccccggccgtgtcatcccccgggccatgcgccgcacgatctacgtgggcggcgccgcggccaccttcacctgcctcacgctcctgctgtcggtgacggactaccgggccgtcatctccggcaaggacaccgaccccgtggtgcgcgtgctgtacgacgcgatgggcgaagtgggcgccaggctcgtgatgggggtcgtcctcatctcgttcctgtcctgcaccgtcagccttcaggcggcggcgggccggctcatctactcgtacgcacgcgaccgcatgatcttcgggcacaagctgctggagcggttctccccggcacgggccgtacccacctacgcgctgctcgtcgcggccgtcgtgcccgcgctgatcgccttcggctcgctggtgtcggagaacgccctcacgaagatcgtctcgttcgcgatcctcggtatctacgcctcgttccagatggtcgtcctggccgcgctgcgagcccgcctcaagggctgggaacccgcgggcgagttcactctgggccgcttcgggctcgtcgtgaacgccgccgccctggcctacgggatcttcgccatcatcaacatctgctggcctcgaaatccggaacagccgtggttcgacaactacgtcgtgctgctgtgcggaggcgtcgtcctgatcaccggcctgctgtacatggtgaccacccgccaccacgggcgcggcgaggctccgtcgggagacgcgatcccttgtgacggtacttccgtc

SEQ ID NO: 1610 - DNA, 1542 bp, Streptomyces avermitilis
  CDS (1)..(1542)
gtgacggacgaaccggaatacgactacgtcatcgtcggcgggggcacggccggatgcgttctggcggcccgcctgacggaggaccccgactgccgcgtctgcgtcatcgagggcggtcccagcgacgtgggcgacgagcggatcctgcgcctgcgcaactggatcaacctgctcggctcggagttcgactacggctacacgaccgtggaacagccgcgcgggaactcgcacattctgcattcccgggcccgcgtcctcggcggctgctcctcgcacaacacggtcatcagcttccttccgctgcccgaggacctcgacgactgggtcgacaggggctgcaccggctggggtccggacgtgctgctgccgtaccgtcatcgcctccagaaccggatcgtgccggtcgccgacaaggaccgcaatccgatcgcccgcgatttcgtgaccgccgccgcttcggccctcggggtcccggtgatcgaggacttcaacgcgcggccgttcgccgaaggcgccggattcttctccctggcgtacgagccggagagcaaccggcgctcctccgcctccgtcgcctatctgcaccccgtgctggaccgccccaacctgacgctccggctggagacatgggcgtacgggctgctgccggacggtgacggccgtctcacccgcgtccaggtccggcagagcgacggcaccaccgcgacggtgcgagccgcgcgcgacatgctgctgtgcgcgggagcgatcgacacaccgcgcctgctcctgctgtccggcgtggggcccgcgcagcagctccgcgatctcggcatcgaggtgcgggcggatgtgccgggcgtcggcgagaacctcctcgaccaccccgagtcggtcatcgtctgggagacgcacggcccgctgcccccgaactcggccatggactcggacgcgggactgttcctgcgccgcgctccgcgcgggccgcgcccggacctgatgttccacttctaccaagtcccgttcacggtcaacaccgaacggctcggccacccggcgatcgagcacggcgtctgtatgacaccgaacgtacccagagcccgctcggtgggacggatgtggctggccgacgcggacccgacgcggcagccctgcctggacttccggtacttcaccgaccccgagggctacgacgagaagaccatcgtcgacggactcgggatcgcccgggaagtggccgccgccgcaccgttgcgggactggctgaaacgggaggtcgcgccgggaccggacatccgcacggacgccgaactgtccgcgtacggaaggaaagccgcgcacaccgtctaccacccggccggcacctgccggatgggcgcggacgacgatccgctggccgtcctcgacccgcagctgcgggtgcgcggcgtcagcggagtgcgagtcgtcgacgcgtccctgttcccgacgatgcccaccatcaacccgatgctgaccgtgctgctggcagcggaacgcgcggtcgatctgatcaaggggacgcggcagcccggagaggcacgc

SEQ ID NO: 1611 - DNA, 1464 bp, Streptomyces avermitilis
  CDS (1)..(1464)
atgcccgatctgttcatcgacggtgagtgggtccggggcgcgacaggcacgacacgggaggtggtcaatcccttcgacgcgaccgttgtccgcagtgtcgacgagggcgatgccacggacgtcgaccgcgcggtgacagcggccaggcgggccttccacgccgctgactgggcggccgcgccgacacagcgacgggcggacgtcctgttccgggtggcggagtacctcctgcgggacatcgaggagatcgcgcgggacgagaccctgaacacgggcaagacccttgccgaagcccggatcgacgtcaaggacgtgtcgaacgccttccgctacttcgccgagatggccggcaaggacgcgggacgcgtcgtcgacgccggcccggacgttctcagccgcgtcgtccacgaacccgtcggggtctgcgcgctgatcgccccctggaactatccactgctccaggcttcttggaaggtcgcaccggcgctcgccgcgggcaacacgttcgtcctcaaaccgagcgagatcaccccgctcacgaccatcgccatgatgcggctcatcgaggaggcgggcgcacctcccggagtggccaatctcgttctcggcgccggcgccaccgtcgggtcggcgatgacggtgcacccggaggtggacctggtgtccttcacgggcggtctgggaaccggccgccggatcatggagtcggcggcccgcgaggtgaagaacatcgccctggaactgggcggcaagaacccgaacgtcgtcttcgacgacgcggacttcgaggccgcggtcgaccacacgctcgacgcgtccttcctgcactccgggcaggtctgctcggccggctcacggctgctggtgcaggactcctggcacgaccgcttcgtccgggaactcgccgaccgtgcctcccgcatccggctcggcaacggcctcgacccgcacaccgagagcggtccgctcagctccgccgaacaccgggccaaggtggagaagtacatcgacctcggccggtccgagggagcacggctggtgaccgggggccggcgccccgacgacccggacctcgcacacggcttcttcctgctgccgacgatcttcgacgactgcgaccggtccatgcgcatcgtccaggaggaggtcttcggaccggtggtcaccgtcgagacgttccgtaccgaggacgaagcggtcgagctcgcgaacgacacccgctacgggctcgcggcaggtgtgtggaccggcgaggcgagccgggcgcagcgtgtcgccgcccggctgcggcacggcacggtgtggatcaacgacttccacccgtatctcccccaggcggagtggggcggctacgggcagtcgggcgtgggacgtgagctgggacccacgggcctgcgcgaataccaggagatcaagcacatctaccagaacctctctcccggcccctccggctggttcaagggc

SEQ ID NO: 1612 - DNA, 708 bp, Streptomyces avermitilis
  CDS (1)..(708)
atgacgatcacgacggaacgcggttcccagcagtacgcgtacaccgacctgccccggctgatggggctgatgaccggcgacgagaagcacgggcccgccgcgacgtccacgctggacgcgctgtgggtgctctacgaccgtgtgctgcgcgtcgctcccgagcgggtggacgagccggggcgggaccggttcctgctgtccaaggggcacgggccgatggcgtactacgccgttctcgccgccaaggggttcctgccggtcgactggctgccggacttcggctcgtacgactcgccgctcgggcaccaccccgaccgcgtcctggtgccgggcgccgagatcggcagcgggtcgctcggccacgggctgcccatcgccgtgggcacggccctggggctgcgggcccagggactaggcgagccgcgcgtctgggtgctgaccggcgacgccgaactcgacgaggggagcaatcacgaggcgatcgcgtacgccggtgccgccggcctcgaacgcctgcacaccatcgtgatcgacaactcctccgccacccacgccctgaccggcgggatcgccgcccgcttcgaggcggccggctgggccaccacgaccgtcgacggccacgaccacgaggccttgcacgccgccttcaccgcgccccacgagggccggccgctcgcagtcgtcgcccgtgtccgcccgaaggacgcc

SEQ ID NO: 1613 - DNA, 909 bp, Streptomyces avermitilis
  CDS (1)..(909)
atggacaccatgcgtgaccgtttcgcccccgtcgtctcccggctgctcgacgaggacccccgggtcgtggtcgtcctcgccgagatcggcaaggacggcttcaccgaggcccggcgcaggcatcccgaccgggtgatcaacgtcggtatccgcgaacagctcctggtcggagccggtgcggggctcgccctgaccgggctgcggccggtgctgcacacgttcgccagttttctggtcgagcggcccttcgagcaggtcaagctggatctcggccaccaggacgtgggcgcggtcctcgtcagcgccgcggcctccttcgactggcccgccggcggctacacccatatgtcgcccggtgacgtggccctcctggacacgctggacggctggaccatgcacgtccccggtcatccggacgaggcggagacgctgctcaggcacgccgtggccgcgggcgacgacaaggtgtacgtacggctgtccgtgcagtcgaacgcgcggcgccgcgccgtcgacggcgagcgcttcctgaccgtccgcgagggacgcgcgggcgtggtcgtcgccgtcggcccgctgctcgaccccgtgctcgaagccaccgagggactcgacgtcaccgtcctgtacgcgaccaccgtccgccccttcgacgccgtcgccctgcgccgggccacggagaccgcgggcaccgatgtcgtcctggtcgagccgtacctggcggggacctcgaccgccgccgcgaacgacgcgctccacgatgtgccgcaccgtgtgctcggcctcggcgtgggccggcccgagctgcgccgctacggcagcgtcgacgagcacatggcggcccatgggctggacgcgggatcgctgcggcagcggatcgcggagttcgcgggcgccccggcgcgcgcc

SEQ ID NO: 1614 - DNA, 486 bp, Streptomyces avermitilis
  CDS (1)..(486)
gtgtgccgccggccctgtagggggcggcggcacggtacggcgccgctgtcggctgtcggctgtcggtgtcggctgtgggccgtccgctcccgcagggcgttgtcggtggcgttggttacggtgcgactcatgctggatgccgaagacgtacgccgtatcgccctctccctgccggacaccacggagaaggtcgcctggaacatgcccaccttcagggtcgcgggcaagatgttcgccaccgtgccggaggacgagacctccatcgccgtgcgctgccccaaggaggagcgcgacgaactcgccctggcggagccccggaagttctggatcgccgaccacgaggccggcttcgcctgggtgcgggtccggctcgtggcgctggaggacgaggccgaactgcgcgacatcctcgccgactcctggcggcaggcggctccgccccgactgatcgacgcccacccggagttggggcttccggccgcggac

SEQ ID NO: 1615 - DNA, 903 bp, Streptomyces avermitilis
  CDS (1)..(903)
atgatcgaggcgcggcggctccacatcctccgtgcggtggccgaccaccgcacggtgacggcggctgccgccgcgctgtatctcacgccctccgcggtctcccagcagctgaccgccctggaacaggagaccggccaccgcctcgtcgagcgcagcgcccgaggtgtacgcctcaccccggccggcgagatcctgcttggtcacacccacgccgtactcgctcaactggagcgcgccgaggccgagttggcggcgtacagcgcgggctccgcgggcacggtcacgctcgcctccttcgccacgggcatcggcctcgtcgtcgcgcccgccctggcccggctcgccacgaccgcgcccggcatccggatccgcgtccaggacgccgagggggacgccagcctgccgatggtcctcgaccggcaggtcgacgtcgcggtcgccgtcgagtaccggggtgcgcccgacgccgacgatccgcgcctcacgcacatcccgctgtacgcggagcccttcgacgccgtagtccccgtcacccaccgcctcgccgacacggccgaggtcccgctcgccgaactggccaaggatccctggatcggcccgtaccccggcaacccctgccatgacgtggtggtcctggcctgcgagaacgccggattccagccgcgcctcgaacactcctcggacgacttccgcgcggtcgtcgccctcgcctcggccgacgcgggggtggccctggtgccacgctcggcgctgcgcggcatggagctgacgggcgtggtcgtgcggcccgtcgacggggtcgcgcccacgcgccgggtcttcgcggccgtacgccgtggcgcggagaaccatccgctgatccggccggtcctcgacgcgctggcggaggccgcgaccgtggac

SEQ ID NO: 1616 - DNA, 1194 bp, Streptomyces avermitilis
  CDS (1)..(1194)
atgatgttcgattccgtacgcgacgatctgcgcaccaccctcgacgagatccggaccgccggtctgcacaagcccgagcgcgtcatcggcaccccgcagtccgccaccgtgagtgtcacggcgggcggccgccccggcgaggtcctcaacttctgcgcgaacaactacctcggcctcgccgaccatcccgaggtcatcgccgccgcccacgaggcgctcgaccgctggggctacggcatggcctccgtgcgcttcatctgcggtacgcaggaggtgcacaaggagctggagcggcggctgtccgcattcctcggccaggaggacacgatcctctactcctcctgcttcgacgccaacggaggcgtcttcgaaaccctcctcggcgccgaggacgcggtcatctccgacgccctcaaccacgcgtcgatcatcgacgggatccggctgtccaaggcccgccgcttccggtacgcgaaccgcgacatggccgatctggagcgacagctgaaggaggcttcgggtgcccggcgccggctgatcgtcaccgacggcgtcttctccatggacggctacgtggccccgctgcgggagatctgcgacctcgccgaccgctacgacgcgatggtcatggtcgacgactcgcacgcggtcggcttcgtcggccccggcggacgcggcactcctgagctgcacggcgtgatggaccgcgtcgacatcatcaccggcaccctcggcaaggcgctcggcggcgcgtccggcggttacgtcgccgcccgtgccgagatcgtcgccctgctgcgccagcgctcgcgcccgtacctcttctcgaacacgctcgctccggtgatcgcggcggcctccctcaaggttctggacctgctggagtcggcggacgacctgcgcgtgcggctcgccgagaacaccgcgctgttccgttcccggatgacggaggagggcttcgacatcctccccggcgaccatgcgatcgcgccggtcatgatcggcgacgcggccgtggccggccgcctggccgagctgctcctggagcgcggcgtctacgtcatcggcttctcgtacccggtggtcccgcaggggcaggcccgcatccgcgtccagctgtccgccgcgcactcgacggacgacgtgaaccgggccgtggacgccttcgtgtccgcgcgcgcggagctggaggcc

SEQ ID NO: 1617 - DNA, 1026 bp, Streptomyces avermitilis
  CDS (1)..(1026)
ttgaaggcgctggtcaaggagaaggcggagcccgggctctggctcatggacgtcccggagcccgagatcgggcccggcgacgtactgatcaaggtcctcaggaccgggatctgcggcaccgacctgcacatccggtcctgggacggctgggcgcagcaagccgtccgtaccccgctcgtgctcggtcacgagttcgtcggtgaggtcgtcgagaccggccgcgacgtcgtcgacatcaaggccggtgaccgggtcagcggcgagggccacctggtctgcggcaagtgccgcaactgccaggccggacgccgtcatctgtgccgtgcgacggtcgggctcggcgtcggccgggacggggcgttcgccgagtacgtggccctgcccgcggccaacgtctgggtgcaccgcgttcccgtcgacctcgacgtggccgcgatcttcgacccgttcggcaacgccgtgcacacggccctgtccttcccgctggtcggcgaggacgtgctcatcaccggggcgggcccgatcggcctgatggcggccgccgtggcccgtcacgccggcgcccgcaacgtcatgatcaccgacgtcagcgaggagcgcctggaactcgcccgcaagatcggcgtgagcctcgccctgaacgtcgccgacacgaccatcgccgacggccagcgcgcgctcggcctgcgcgagggcttcgacatcggtctggagatgtccggccgccccgaggccatgcgcgacatgatcgccaacatgacgcacggcggccgcatcgccatgctcggtctgccgtcccaggagttccccgtcgactgggcccggatcgtcacctccatgatcacgatcaagggcatctacggccgcgagatgttcgagacctggtacgcgatgtccgtcctcctcgaaggcggcctcgacctcgctcccgtgatcaccggccggtacggctaccgcgactacgaggcggcgttcgccgacgcggcgagcggccgcggcggcaaggtcatcctcgactggaccctc

SEQ ID NO: 1618 - DNA, 579 bp, Streptomyces avermitilis
  CDS (1)..(579)
atgagctacgacccaccgcgtccgatcggccggctgctgctgacgcccgaggacaaggacgcccccgagcgcgtacgacggctgcgccgcctcgggctcggcgaacgcccggagcccgtcttcgacgccttcgcggaccggctcgcggaggtcgcggcggtgccgtacgcgatggtcaacttcatcgacgagaaccggcagttcttcgcgggcctgcacgcacccgacggcacggggtcgggcggtcggcccgccgcggacggcgcggaaccacccgacgtgcgccgctacatggcccgcgactacggcttctgcccccatgtcgtggtccggcgcaaggctctcgtcctggaggacgtctgcgactacccccgcttcgccgggaacccggtcgtcgacgagatcggcatccgctcttacctcggcgccccgctcatcgaccgcacgggtatcgccctcggcacgatctgcgtcgtcgacatcgagccgcgcccgtgggggagagccggcctggagaccatcaaggcgctggcggcggagctggtcgagcagatcggacggcgggagagcggcgggatc

SEQ ID NO: 1619 - DNA, 546 bp, Streptomyces avermitilis
  CDS (1)..(546)
gtggccggagggttcggagtcggcaagacgaccttcgtcggcgcggtgagcgagatcgcgccgctcagcacggaggagctgctcaccacggtcggcgccgcgaccgacaatctcgacgggatcgagaacaaggtcgagacgaccgtggcgatggacttcggccgcatcaccctcgaccccgaacacgtgctctacctgttcggcacgcccggacagcagcggttctggttcatgtgggacgaactctccgagggtgcgctcggcgcggtgatcctcgccgacacccgtcgactggaggactgtttcgccgccgtcgacttcttcgagcagcgtggtcttgccttcatcgtggcgatcaacgacttcgacggcggctaccggtacgaccccgcggaggtacgcgcggccatcgacctggacccgcacattcccgtcgtgcgctgcgacgcccggatctccagctcgggcgtacagaccctgctcacgctcgtacggcatctcctcgcccacgccccggcgaccgccccgagccacggagcccacaca

SEQ ID NO: 1620 - DNA, 318 bp, Streptomyces avermitilis
  CDS (1)..(318)
gtgcgcccgtacacggtcagcaacggcaggacacggccgaccacggcgctcgatctcctgtcgcaggtgatggccaccggggtcacccccctcggctacctcggccccgagcacacccaggcactcgaactgtgccgggcgcccgtctcggtcgccgaggtggccgcccatctgaagctgccggcggcggtcaccaaggtgctgctgtccgacctcgtcgactgcggggcgctcaccacgaaacccccggagttctaccacaaccccactgaccggtctcttctggaggcagtgctcgatggactacgacgacagctc

SEQ ID NO: 1621 - DNA, 432 bp, Streptomyces avermitilis
  CDS (1)..(432)
atggcgagcgatgccccgaccggccatgtatccgatctcgactggctgatgagcggcctcgtgcagcgcgtaccgcacaccacgagcgcggttctcctctcctgcgacggcctcgtgaagtcggtccacggcctcgacccggacagcgccgaccacatggcagccctggcctccggcctctactccctcggccgcagcgcgggcatccgcttcggggacggcggagacgtacggcaggtcgtcgtcgaactcgactcgaccctgctgttcgtgtccaccgcgggttccggcacctgtctcgccgtgctcgcgggccgcgaggccgacgcggcggtcctcggctacgagatggcgatgctggtcaagagcgtgcggccgtatctgatgacggcgccccggcaggccgccgcgcagcccccggcgatgcggcct

SEQ ID NO: 1622 - DNA, 1551 bp, Streptomyces avermitilis
  CDS (1)..(1551)
atgtctcacctccgcgcaccggccgcacgcgcagaccgccgtgagggcgggcggcacggacggccggtcgcccgcaccgtcccctcgctgcccgagacccacatacggccccagttgctgcgcctggcggtactgccgcccatcgcggtggccctcagtggctgcgccgccgtgctcttcaccgtccgctccaccggcgcccggcccgatctcaccctgtgggccgtgctcgccggagccttcggcgtggccctcgcgggcatcgtgatcgccgccgtggccgccgaccgcgccgccaggtccgtacgcgaccgcctcggcgccctgcgcgccgacggcgcccgcggcgaggccgagctgcgcgcgctcgtcgagacgctgcgccgtggcgaggcgccgcccgtccgcgccccccgtgcggcgcccgcggcggacgccgacgagttcgagctggtcgcggccgagctggcgcgcgcccacgacggcgccgtcaccgccgtcgtgcaggccgcgcagctctccagccaggcgggcagcgaacagaaggtcgaggtcttcgtcaatctcgcccggcgcctccagtcgctcgtgcaccgcgagatctcgatcctcgacgagctggagaacgagatcgaggacccggacctgctcaagggcctcttccacgtcgaccacctcgccacccgcatccggcgccacgccgagaacctcgccgtgctcggcggcgccgtctcgcgccggcagtggagcaagcccgtctccatgacggaggtgctgcgctccgcgatcgccgaggtcgagcagtactcgcgggtcaagctggtgccgccgatcgacggcactctgcgcgggcacgccgtcgccgacgtcatccatctgctggccgaactcgtcgagaacgccacggtgttctcggccccgcacacccaggtgctgctgcgcgtcaacctcgtcacctcggggctcgccgtcgaggtcgaggaccgcggcctcggcatgccgctcagcgaacagaacaagatgaacaccctgctcaccgaccccgaccaggtgaacgtcgccagcctgctccaggacggccgcatcggcctgttcgtggtctcgcagctcgcgcgccggcacggcatccacgtgcggctgcagagcaacatctacggcggcgtccaggcggtgctcgtcgtaccgcaggaactgctgggcgcggtgcccggcggacccggtgaagcaccgcggacgctgccccagggcatgaacggcggggcggccgcgcaggcggtgaccggaggcggacagcagacgcagtcacggactccgcaggccccggggaccctccagaccccgcagaatccgccgccgggcccaggagcacatcgcgccccaactccgcgacggccccccgccgttgccccgccaggacgccggccggtacatcggacacgaccccggcctgatggcggcgttccaacgcggcatcggactcgccgaggcgcagcagcagttggagacggtcccgtcggcgccggacgcggcccccgagccgtacagggccca

SEQ ID NO: 1623 - DNA, 1218 bp, Streptomyces avermitilis
  CDS (1)..(1218)
gtgaccggtttccgtctcccgagctccgggctccgcgcagtgcggcccgccgccttcggcgcggatccgagcggtgagcgcctggagcgcatccgcagatcacccaatttcgtggacggctccttcgtgaacccggagggcacccgcacccgccccgccggcggctccacgctggagctggcgaaggtgttcctccgcaaggaggagcgcacccgccgctccccggccggcacggtcccggtgcaccccacgaccttcgccgacctcgccaggcctccggcgagcggactgcggctgacctggatggggcactccagcgtgctcgccgagatcgacggccaccgggtgctcttcgacccggtctggggcgagcgctgttccccgttcgacttcgtcgggcccaagcggctgcaccccgtgccgctgccgctggccgccctcggcccggtcgacgtcgtcgtcatctcccacgaccactacgaccacctggacctgcccacgatcaaggccctggccggtacggacacggtcttcgcggtgccgctcggcgtcggcgcccacctggagcactggggcgtctccccggaccggctgcgcgagctggactggaacgagtcgacgaaggtgggcggcatctccctgaccgccacccccgcccgtcacttctgcggccgcggcctgcgcaacgtccagcacaccctctgggcctcctgggccgtcgcgggcgacacccaccggatctaccacagcggtgacacgggttacttcggaggcttcaaggacatcggtgccgaacacggcccgttcgacgccacgatgatccagatcggcgcgttcagtgagttctggcccgacattcatatgacccccgaggagggcatgcgcgcccacctcgaccttcagggcggccggcccggcggagtgatgctgccgatccactgggcgacgttcaacctggcgccgcacccgtgggtcgagcccggcgaggggacgatcaccgccgcccgcgcggccggcgcgcgcatcgccctgccccgccccggcgagcccttcgaacccacggccgagaccgtgccgtccgagccctggtggcgcggtgtggccgttaccccgcagggcgggtggcccgccgtcgggccgatcccgggcgatacgccgcgtgacatccccgagggcgccgtggagggcaccggagagccggagaccgtcgccgcgggc

SEQ ID NO: 1624 - DNA, 780 bp, Streptomyces avermitilis
  CDS (1)..(780)
atgtggagtcggtcaggccttccattatggtcggcccctctgacagcgccgggtcgagcgtgtcacagcgcgatgtcccggcacacagcgcgtcgttcgggcctggatgtcacatccgccacgccccgtccgtcgtaccaacgagggcacccgctcaggagtgccccggacgacgtactggaggtggcccccgtggcccgtgtctccctaaccccgcggcgcacgttcttcttccgcatcgtggagtggtattcgaagcggacgtacggcaaggtcctcgatcccggcaaggcactcgcccaccatccgcgcgtgctgtgggcggacctgcgcttcgagcagtcggtggccaagtggaaccggctcgacccggatctgaaggcgctcgccgagatgacggcggccgcgacgatcggctgcgcctggtgcatggacttcggctactgggtgagcagggagcgcgggatggcccgggagaagctgctcgacgtaccgtcgtggcgcgacagtgcggcgtacacccccctggagcgggacgtcatggagtacgccgaggcgatgaccctcaccccgcccgccgtggaggacgacctcgccgcccgcctcgtcgaccggctcggcgagccggccttcgtcgaactgacggcgatggtggcggtggagaacctgcgttcgcgcatcaattcggcgctggggctgacaagccagggcttcaaggactcctgcgacgtgccgagcgccgaggagcggacggcgtccccccgggccgtgcggcaagat

SEQ ID NO: 1625 - DNA, 1176 bp, Streptomyces avermitilis
  CDS (1)..(1176)
atgaccgcccccttgatgacgctcgcgtggaccgaccacgtcaccggacggcaggggtacctcgtcgtggaccgcctcgtgcggggagtctccagcggcggactgcggatgcgcccgggctgcaccctggacgaggtcgccgggctcgcccgcggcatgaccatgaaggaggccctgcattacaaccccgagggccgctacatccccctgggcggcgccaagggcggtatcgactgcgatccgcgctcgccggaggcgtacggcctgctcgtgcgctatctgcgcgccatgcggccgtacatcgagagctgctggaccaccggcgaggacctcggcctcacccaggacctcgtcgaccgggccgcggccgaggcggggctcgtctcgtccattcaggccgtgtatcccctgctcgacgacgaggccacggcgcgcaagcggctcgcggacgccttcgcggtcgaggtggacgggatcgggctcgacgagctggtcggcgggtgcggggtcgccgagtccctgctggccgccctggaccgggccgccgtgccgtacgcgggtacgcgggtcgccgtgcagggactgggcaccatgggcggggcgaccgcgcggttcctcgcgcgcgcggggctcacgatcgtcgccgtcgccgacgtcaagggcacgatcgcgaaccccgagggcctcgacgtcgaggcgctgctcgcggcccgcgacgcgtacgggacggtcgaccgctccgcgctgcgccccggcgaccgggagctgccgggcgaggcctggctgtccgtcgaagccgaggtgctggtgccggcggccgtgtcgtacgtcgtcgacaccacgaaccagcggcggatcggcgcccggtggatcgtcgaggcggccaacatgcccgtactgcccgaagcggaggcactgctcaccgaacgcgggatcaccgtactgcccgacgtcgtcgtcaactccgggacgaacgcatggtggtggtggaccctgttcggcgacatcgacgccgacgcggacgaggcgttcgcccgcacgcgccgttccatgcgcgcgctgaccgacctgatgctggcccgcgcggaggccgacggaacgacaccgcgcgccgccgcgcacgcgatcgtcgccgaccggctgccggtgatcgcggaacggttcgggtggtaccgc

SEQ ID NO: 1626 - DNA, 618 bp, Streptomyces avermitilis
  CDS (1)..(618)
gtggcgagagtgcggttgagcgtggcggagcggcgcgaggaactactgcgggcggcgatcgagcagatcgaggcgcggggcgtggcggcggtacggatcgccgatgtcgcggcggcgctcggggtgagcaacgcgctggtgctgtaccacttctcgaccaaggagaagctggtcgccgaggccttcgcccatgccgccgaggacgatctcgcccatctgcgcaagctgctcggccgccggacgtcggcgctgcgccggctgcggaccgcggtgcgctggtacgcgccgaccgggcaggccaagggctggcggctgtggatcgagggctgggccgtggcgctgcgtgagcccgcgctgcgggaggtcacccaggatctcgaccggcagtggaaggccgcgatcacggaggtcatcgcggagggcgtggccgggggcgagttccgctgtccggaccccaccggcgccgcgctgcggctgaccgcgctgctggacgggctcgccgtacagatgacggcgtactcgggcgcggtgtcccgggcgcgcacgcaggagtgggtggacgacgcgctcgcgcgtgaactgggcctggagcgcgcggcgttgacggcggcgacacgc

SEQ ID NO: 1627 - DNA, 783 bp, Streptomyces avermitilis
  CDS (1)..(783)
gtgatcgggtcgtacgtggcggtgggggacagcttcaccgagggcgtcggcgaccccggtcctgacggggccttcgtcggttgggccgaccggttcgcggtacttctcgcggaccggcggcccgagggcgaattcaactacaccaatctcgccgtacgcggcaaactgctcgaccagatcgtcgaggaccagctccagcgggccaaggagctcgcgccggacatggtctccttctgcgcgggcggcaacgacatcatccggcccggcaccgaccccgacgaggtcgccgagcgcttcgagcgcgccgtcgccgacctcaccgccgccgtgggcaccgtcctggtgaccaccggcttcgacacccgaaccatgcccgtgctgaagcatctgcgcggcaagatcgccacgtacaacgggcacgtacgtgccatcgccgaccggtacggctgcccggtcctcgacctgtggtccctcaagaccatccaggaccggcgggcctgggacaacgaccggctgcatctgtcgcccgaggggcacacccgggtcgcgctgcgggcaggtcaggtgctcggcctcgacatcccggccgatccggaccagccctggccgccgctgccgccccgcggcacgttcgaggtgcggcgcgacgacatccactgggcacgcgagtacctggtgccgtggatcgggcgcaggctgcgcggggagtcctccggcgaccatgtcgcggcgaaggggagcctgtcgccggacgacatcaagatgcggatcgcggcggccgtc

SEQ ID NO: 1628 - DNA, 717 bp, Streptomyces avermitilis
  CDS (1)..(717)
atgaccaccacacgtagagccttcggagccctggccaccggtgccgcgctggccgcgctcgcccccgccacggccgcgagcgcctcgccgcaccaccgcgggggccggctgatcgcccacgacgacttccggcacggactcggccggtgggccaccgaactccaggacggcggcacggtcaccgcggcccgcggcgtcctggagatcgacgtgccgagcggtgccacggtctggttcaggaagcggctggaaggcccgtacgtcatcgagtacacggccacacccgtcgatgcggggggcgccaacgaccgggtctccgacctcaacaacttctggaacgccgtcgacgtacgctccccggacgacctcttcgccaccccgcggggcggcgcgctcgcggagtacgaccacctcaagacgtactacgtcgggtacggcgccaacgcgaacaccaccacgcggctgcgccgttacgtcggcgaggcgggcgtccggccgctgctgtacgactacacgcaaccgctgctcacggcgaacgagccgaaccgcgtccggatcgtctcggacggctccaccgtccagtggtggaacaacgggcggccggtcttcgaccacagcgacccggagccgtacacgagcgggcacttcgcgttccggaccacatggagccacttccggatcacgggcttccgggtgtggcggctgtacaaccacgcc

SEQ ID NO: 1629 - DNA, 903 bp, Streptomyces avermitilis
  CDS (1)..(903)
atgcccgcgaagggtaagcaccgccgccccaggtccccgcgtttcacccgctcgatcgccgtcgccggaaccggtggcgccgcgctcgcgctgccgctgatgggggcgaccggcgcccacgccgccaccccgacggcggccgtctccggaaaggtctccgcagcccccgttgccgcgaagcagggggccgccgagaagagcggcacgaagacgtatgcggtgcgggcgggtgactccctctcgaagatcgccgacgagcagagcgtcaccggcggctggaagaagctctactcggacaaccgctccgccatcggcggcgacccgacgctgatccaccccggtctgaagctgacgatcggcgccaagtccgcgtcgagcgccgccacgcagtcgtccacggcgacgaagccggccacgggggtgaagtccgccacggcgaagacccccgcgtcgaagacgaccacggccacccgggccgcggacaccaccaccggcgccggctacaccctgccggtcgacggcgccaccatcggtaccgcctacaagaccgcgggcagcatgtggtccagcgggtaccacaccggcgtcgacttcgtggtcccgaccggcaccaccatcaaggccgtcgccgcgggcaccgtcgtctcggccggctggggcggcgcgtacggcaacgaggtcgtcgtccggcacgccgatggccagtactcgcagtacgcccacatgtcccagctctccgtctccacggggcagagcgtggccgagggccggcagctgggcctctctggtgcgaccggcaatgtcacgggaccgcacctgcacttcgagatccgtacgaccccctcctacggctcggacgtggacccggtcgcttacctgcgcgcgcacggcgtcgtcgtcggc

SEQ ID NO: 1630 - DNA, 2100 bp, Streptomyces avermitilis
  CDS (1)..(2100)
ttgagtacatctgttgacatctgtgggggcctgatggttgagatcgccgaagaccgacgtacgtggcttctttcggggcccacgagcagctacgccgtgcatctcaccgagggtcacgaactgctgcatctgcactggggcccgcggatcgccctcgccgacgccgaggccctcgccgccctccccgccccgggcggctcgtccttcgaatcgccgctggacgggcgtgaggagtacccggtcgagggcggcccccgcttcgtacgcccggcgctgtccgtgcgcaccgacgagcgccgtggcaccgagtggcgcttcgaggcgtacgagaccgaaggcgacgagctgcggctgcggttcggcgactcggggctggccgtcacgctgcactaccggatgcgggacgacgtcgtcgagcgctgggtgacgctggccaacgacggacccgccctggagctgctgcgcgccgactccgccacctggaccctgcccgagcgcgacggctggcggctgtcccagctgcacgggcgctgggcggccgagtcccgcctcgtacgctcggacctcacctacggcgagaagatcatcggcagccggcgcgggcacaccgggcaccagcatctgccgtgggtcgcgctcgattgcgaggcgaccgaggagagcggcgaggtctacggctgcgcgctcggctggtccggctcctggcgcatctcggtggcccaactctccgacgcgcgcgtgcagatcaccggcggcgcggggtacgacgactcgggcctgctgcgcctggggccgggggagtcgttcacgacgcccgtcttcgcggggctgtggagcgacggcggcttcggcggcgcgagccgcgcctggcacgcgtaccagcgggcgtacgtcatcccggacgcggaccaggaccgtccggtgctcttcaattcctgggaggccaccaccttcgacatctccgaggaacagcagggggctctcgcgcggcgggccgcggcgatgggggtcgagctgttcgtggtcgacgacggctggttcggggcgcggaccggcgaccgggccgggctcggcgactggacgcccaaccccgaccgcttcccggccgggctcaagccgctcgccgactacgtgcacgcgctcggcatgcagttcggcatctgggtcgagcccgagatggtcaacccggacagcgagctgtaccgcgcgcacccggactgggtgcagttccagccggggcggaccaggacggaattccgcaaccagctggtcctcaacctcgcgcgcgaggacgtccagcagtgcctctgggagcagctcgacggactgctgtccagcgcccccgtcgactacgtgaagtgggacttcaaccgctgcttcacggacgccggctggcctggggaggcatatccgcagcggctctgggtcgatcatgtgcgcgccctgtaccgcctgctggaccggctgcgggccgcgcatccgggggtcgccttcgagtcctgctcgggcggtggcggccggatcgacctgggcatcatggcgcgtacggaccaggtgtggacctccgacaacaccgacccgctcgaccggctcgccatccagcacggattcagccagatccaccccgcccgggtcatggccgcctgggtcaccgacagcccgaacacacagctcaacgggcgagtcagcacgctgcgcctccggttcgtcagcgccatggcgggagtgctcggggtcggcggcgatctggccgagtggagcgagcgggaactcgtcgaggcacgggactgggtgagtctctacaaggagatccggcccgtcgtgcagcgcggggacctctaccggctgcggcccccgacgggcgggctgagcgccgtgcagtacgtccacggcgacgaggccgtcgtcctcgcctggctccaggcccagcactacggcgagccggtcgccccgctccggctgcgcggcctcgacccggcagccacctatgaatgccgtgaaacgggcgaagtgcaccgaggtgccgtactgctgcatcacgggctgcggacggggttgcacggggacctcgatgcgacggttgttcggctacgtcgcatt

SEQ ID NO: 1631 - DNA, 795 bp, Streptomyces avermitilis
  CDS (1)..(795)
gtgacgcagcaggtcccgtccaccgagcccgagctggccggagtgcgcaacttccgcgatgtgggcggtctgccgaccgtggacggccggcgagtgcggcacgggctgctgtaccgcagcggccatctcgcgcacgccacggacgaggacgcggcgttcctcgcctccctcgacctgcacacgatcttcgacttccgcaacgccgcggacatcggcctcgaagggccggacgtcgagctgccgggcgtgcgcaatctgaacttcccgctgacggacccggcgcacggcgcggaattctggacgatggtccgtgacggtgatctggaccagctacgcggcctcctggcggacggcaaggccgcgaaccggatgatcacctcctaccgcacgatcatcaaggagcgcacggccgagcacgggcgcgtgctgcgcgagctcgccgaggagagcgtgcccgcgctgatgcactgtgcggcgggcaaggaccgggcgggcctgtcgatagctgtcgcgctcctggccgtgggcgtggagcgcgatgccatcgtcgccgactacctggagtcgaacgccccgcaccgccgctacaaggtgcggcgctccagcagcgcggcccaggcgtacagccccgaggtgatggagctgctcagcccgctcttcgaggcgcgggccgagtacctggcggcggccttcgagacgatcgaggagacctggggcgacaccgacacatatctggagcgggggctgaagatcacgcccgagctgcgggagcggctgcgcgagcggctcctcgac

SEQ ID NO: 1632 - DNA, 192 bp, Streptomyces avermitilis
  CDS (1)..(192)
gtgcctcggcccggcgacgggacacccgacgatgggagacacaccatgacagaacagcccgagtccagccagaaccgcaggtccatggaggagaagttcccgcgcgcgctgtgggtccggctcatcatctacatcgcggtcggtcacctcttcgcgggcttcatctacctgctgttcgagctgggcgcgaag

SEQ ID NO: 1633 - DNA, 624 bp, Streptomyces avermitilis
  CDS (1)..(624)
atgagttcctccgagtccgggccggtcgaggacctgcccgccgtcgcaccacagctccgcgcgctgcgccgccgcgcctccctgacgctggaggtcgcggcccgcgccgccgggctctcgccggcccatctctcccggctggagacaggtcagcgccagccctcgctgccgatgctgctcgcactcgctcgtatctacggtacgaccgtctccgagctgctgggcgagaccgtaggcgaccgggacgccgtcgtgcgcgccgccgacatggagccggccggagcgggtggctggacgtactggcaggcgggcgcgggcggtcgcgccatgcaggcgctgcgcgtgcacgtgccgtacggcacccagggcgatgtcgtgcgcgtccaccccggtgaggagtggctgtacgtcctgaaggggcggctgcggctgcgcctcggcgacaccacacatctgctcgggccgggcgacagcgcgcacttcgactcgctgaccccgcaccgcctcgcggcagccgaccacgacggggccgagctgctcttccttcacaccctgctgcagagccccgccgccacgctgtgcctcggcccggcgacgggacacccgacgatgggagacacacca

SEQ ID NO: 1634 - DNA, 1428 bp, Streptomyces avermitilis
  CDS (1)..(1428)
atgaccatcccctcagggaaggcgccgtcggagggggccccttccggaaaccgggagttcgacctcggcgccctgctggccgagcgcggcgccgagcgctacgaactgcacgccaagtacctcaatcaccagctcccgcgcatgctgcacaccatcggcttcgacaaggtgtacgagcgggccgaaggggcgcacttctgggacgcggacggcaaggactacctggacatgctcgccgggttcggggtgatgggcctgggccgccatcaccccgtcgtccgcaaggcgctgcacgacgtcctggacgcctcgctcgccgacctcacccgcttcgactgccagccactgcccggactgctggcggagaagctgctcacgcacagcccgcacctcgaccgcgtgttcttcggcaacagcggcacggaggcggtcgagaccgcgctgaagttcgcccggtacgccaccgggaagccgcggatcctgtactgctcgcacgccttccacgggctgaccaccggctcgctgtccgtgaacggcgaggacggcttccgcgacggcttcgccccgctgctgcccgacaccgccgtcccactcggcgatctcgacgccctggcgagggagctgaagaagggcgacgtcgccgccctgatcgtcgaaccgatccagggcaagggcgtccacgaggccccgcccggacatctgcgcgccgcccaggacctgctgcagaggcacaaggcgctgctcatcgccgacgaggtgcagaccggcctcgggcgcaccggcgacttctacgcctaccagcacgaggagggcgtggagcccgacctggtctgtgtggccaaggcgctgtcgggcggctatgtgccggtcggcgccaccctgggcaaggaatggatcttcaagaaggtctattcgtcgatggaccgcgtccttgtccactcggcgagcttcggctccaacgcgcaggccatggcggcgggcctcgccgtgctctccgtcatggagaacgagcagatcgtcgcgaacgcccgcgcgaccggagaacagctcaagtcccggctcgcggcgctcgtcgacacgtacgagctgctcagtgacgtacggggccggggtctgatgatcggcatcgagttcgggcggcccacgtcgctgaagctgcgcagccgctggaccgtgctgcaggccgcccggaagggtctgttcgcgcagatggtcgtcgtcccgctgctgcaacgccaccggatcctcacccaggtctccggcgaccacctggaggtgatcaagctgattccgccgctgatcatcgacgagcgggacgtggaccggttcgtggccgccttcaccgccgtgatggacgacgcgcacagcggcggcggcctgctgtgggacttcgggaagacgctggtcaagcaggctgttgcccagagg

SEQ ID NO: 1635 - DNA, 1896 bp, Streptomyces avermitilis
  CDS (1)..(1896)
gtgacgatgctggagaacatccggggaccacgcgacctgaaggcgctgtccgaggcggaactcggtgaactggccgaagagatacgggagttcctggtgcatgcggtcgccaggacaggaggccatctggggcccaatctgggggtggtggaactctccgtcgcactgcaccgggccttcgagtcaccggtcgaccgcatcctgtgggacaccggccaccagagctatgtgcacaagcttctgactgggcggcaggacttttccaagctgcgcagcaagggcggcctgtccggctatccctcgcgcgaggagtccgagcacgacgtcatcgagaacagccacgcgtcgaccgtgctcggctgggcggacgggctcgccaaggcccgccaggtgcagggcgagaaggggcatgtcgtcgcggtcataggcgacggcgcgctgaccggcggcatggcctgggaggcgctgaacaacatcgccgccgccaaggaccgcccgctgatcatcgtcgtcaacgacaacgaacgttcgtactcgcccaccatcggcggcctcgccaaccacctcgccacgctccgcaccaccgacagctacgagaaggtgctggcctggggcaaggacgtactgctgcgcacgccggtcgtcggcaacaccctctacgagtcgctgcacggcgcgaagaaggggttcaaggacgcgttcgcgccgcagggcatgttcgaggacctggggctgaagtacgtagggccgatcgacgggcacgacatgaaggcgatggaatcggcgttcagacgcgcgaaacgtttccacgggccggtgctcatccactgcctgacggagaagggccggggatacgagcccgcgctcgcccacgacgaggaccgtttccacaccgtcggcgtgatggaccccctcacctgcgagcccctcgccccctccaacggcccttcctggacctcggtgttcggtgacgagatcgtccggatcggcgaggagcgcgaggacgtcgtggcgatcacggcggccatgctgcacccggtggggctgaacaagttcgcggagaagttccccggccgggtctgggacgtcgggatcgccgagcagcacgcggcggtgtcggcggcaggtctcgccacgggcgggctgcatccggtcgtagcggtgtacgcgaccttcctcaaccgcgccttcgaccagctgttgatggatgtcgcgctgcaccgctgcggggtgaccttcgtgctggaccgggccggggtcaccggcgtcgacggcgcctcccacaacggcatgtgggacatgtcgatcctccaggtggtgcccggcctcaggatcgccgcaccgcgcgacgccgaccagctgcgggcccagctgcgggaggcggtggcggtcgacgacgcgccgacgctgctgcgtttcccgaaggagtccgtggggcccgcgatcccggcggtcgaccatgtgggcggcatggacgtactgcaccgctttcccgagtctccgcaggtcctgctggtcgccgtcggtgtcatggccccggtctgcctccaggccgccgaactgctcgaggcgcggggcatcggctgcacggtcgtcgacccgcgctgggtcaagcccgtcgacccttcgctgccggggctggccgccgagcaccggctggtcgcggtcgtcgaggacaacagccgggcggccggcgtcggcgccgcggtcgcgctggccctctcggacgccgaagtcgacgtgccggtacggcggttcggtatcccggagcagttcctcgcgcacgccaagcgcgccgaggtgctggccgacataggcctgacgcccgtcgagatcgccgggcggatcagcgcggggctggccaccaaggaagagctgtccaaggagaaacaggaa

SEQ ID NO: 1636 - DNA, 1155 bp, Streptomyces avermitilis
  CDS (1)..(1155)
atgacggccatttccctgggcgtccccgaagtgcccgtccgtccgatcgccgaacgccgtgtctcccggcagatccaggtcggaccgctggcggtcggcggcacggccccggtgtcggtgcagtcgatgacgacgacgcgtacgtcggacatcggcgccacgctccagcagatcgcggaactcaccgcgtccggctgccagatcgtccgcgtcgcctgccccacgcaggacgacgcggacgccctcgcggtcatcgcccgcaagtcgcagatccccgtcgtcgcggacatccacttccagccgaagtacgtgttcgcggcgatcgaggcgggctgcgcggcggtccgggtgaacccgggcaacatcaagcagttcgacgacaaggtcaaggagatcgcgcgcgccgccaaggagcacggcacgccgatccgcatcggcgtcaacgcgggctcgctcgaccggcggctgctggagaagtacggcaaggccacccccgaggcgctcgtcgagtcggcgctgtgggaggcgtcgctcttcgaggagcacgacttccgggacatcaagatctcggtcaagcacaacgacccggtggtcatggtcaacgcgtaccgccagctggcggcgcagtgcgactacccgctgcacctcggcgtgaccgaggccggccccgccttccagggcacgatcaagtcggccgtcgccttcggcgcgctgctcagcgagggcatcggcgacacgatccgcgtctcgctgagcgcgccccccgtcgaggagatcaaggtcggcatccagatcctggagtcgctgggcctcaggcagcggcgcctggagatcgtctcctgcccgtcctgcgggcgcgcccaggtcgacgtctacaagctggccgaggaggtcacggcgggtctggagggcatggaggtgcccctgcgcgtcgcggtcatgggctgcgtcgtcaacgggccgggggaggcccgcgaggccgacctcggcgtcgcctccggcaacggcaagggacagatcttcgtgaagggcgaggtcatcaagacggtgcccgagtcgaagatcgtggagaccctgatcgaggaggcgatgaagatcgccgagcagatggagcagaacggcgtcgcgtccggggaaccggccgtcaccgtgagt

SEQ ID NO: 1637 - DNA, 1020 bp, Streptomyces avermitilis
  CDS (1)..(1020)
atggccatgccactgcgccagaccatcaaggtcgcgacgtatctcgctgaacagaagctccgcaagcgggagaagtttccgctgatcgtggagctggaaccgctcttcgcctgcaatctgaagtgcgagggctgcggcaagatccagcacccggccggagtgctcaagcagcgcatgccggtggcgcaggccgtcggtgcggtgctggaatccggtgcgccgatggtgtccatcgccggcggcgagccgctgatgcacccccagatcgacgagatcgtgcggcagctggtggccaggaagaagtacgtcttcctgtgcaccaacgccatgctgctgcgcaagaagatggtcgacttcaccccgtcgccctacttcgcgttcgccgtgcacatcgacggcctgcgtgagcggcacgacgagtcggtcgcgaaggaaggcgtgttcgacgaggcggtggaggccatcaaggaggccaagaggcgcggcttccgggtgaccaccaactcgaccttcttcaataccgacaccccccagacgatcatcgaggtgctcaacttcctcaatgacgacctcgaggtggacgagatgatgatctcgcccgcctacgcctacgagaaggcgcccgaccaggagcattttctcggcgtggagcagacccgcgagctgttcaggaaggcgttcgcgggcggcaaccggcggcgctggcggctcaaccactcgccgctgttcctcgacttcctcgagggcaaggtcgacttcccgtgcacggcgtgggcgatccccaactactcgctgttcggctggcagaagccctgctatctgatgagcgacgggtacgtcacgacgtaccgggagctcatcgaggacaccgactgggacgcgtacggtcgcggcaaggacccgcgctgcgccaactgcatggcgcactgcggctacgagccgaccgccgtcctggccacgatgggttccctcaaggagtccctgcgcgcggcccgcgagaccgtctccggaaaccgcggg

SEQ ID NO: 1638 - DNA, 642 bp, Streptomyces avermitilis
  CDS (1)..(642)
ttgatgagcacgaagcccgatccggccccgctgctcatcgcgtgcgcgctcggcatcgagcgcctggcgctgcgcagcggcgaccgcggcggtgccgacgggcccgtcacggtgctgcgtacgggcatggggcccaaggccgccgagcgggcggtcacccgggtgctcgccgacccggcgctgcgtgaggccgccgtcgtggccacgggcttctgcgcggggctcgctcccggtatgcacccgggtgatctcgtcgtcgccgaggagacccgggacccgcgtggagtcaccccgtgcgtgggcaccgaggtgctggtcaaggaactcgtccgcgccgtgcccgggcgcaccgtccacacggggccgctcatcggctccgatcacgtcgtccgcggtcacgaacggtcggatctgctcctgaccggcgcaatcgcggccgacatggaatccgcgtccacgctccacggcgccgtgtgcacgggcacgcgcccggttgcggccgtccgagtggtcgtggacgctccagaacatgaactcgtccgtatcggcacggtccgcggtggaatatcagccttccgcgttctccgtgccgtacttcccgctttcttcgaatggcaccgttctttgctgctcccccggagg

SEQ ID NO: 1639 - DNA, 1998 bp, Streptomyces avermitilis
  CDS (1)..(1998)
atgacagcgacgaccgacggaagcaccggggccctgccgccccgcgctgcctcggccagcgaaccacacgacacgatcccgcaggcggccgggagtgtcggaatccaagacgccgccgcgcgcgccacacagcgcgccaccgacttcctgctctcgcggcaggacgccgagggctggtggaagggcgacctcgagacgaacgtcacgatggacgccgaggacctgctgctccgtcagttcctgggaatccaggacgagaagaccacacgagccgccggactgttcatcaggggcgagcagcgtgcggacggcacctgggccactttctacggcggccccggtgacctctccgccaccatcgaggcgtatgtcgccctgcgcctggccggtgacggcccggacgagccgcacatggcgaaggcgtccgcctggatccgcgagcggggcggcatcgcctcggcccgcgtcttcacccggatctggctcgccctgttcggctggtggaagtgggacgacctgcccgaactcccgccggaactcatctacttcccgaagtggatgccgctcaacatctacgacttcggctgctgggcgcggcagaccatcgtgccgctcaccgtcgtctcggcgaagcgtccggtgcggcccgccccgttcccgctcgatgaactgcacgccgacgcgaatgaccccaacccggccaagccccttgccccgatggtgagttgggacggattattccagcggctcgacgtcgctctgcacacgtaccgcaaggtcgcgccgcgcaggctgcgcaaggccgcgatgaacacggccgcgcgctggatcatcgagcggcaggagaacgacggctgctggggtggtatccagccgcccgccgtgtactcggtcatcgccctgtatctgctcggctacgacctcgaacaccccgtgatgcgcgaggggctggcgtcactggaccggttcgccgtgtggcgcgacgacggggcgcggatgatcgaggcctgccagtcgcccgtgtgggacacctgcctcgcgaccatcgcgctcgccgacgcgggcgtgcccgccgaccatccgcagctcgtgcgggcggcggactggatgctcggcgaggagatcgtccggcccggcgactgggcggtgaaacgtccccaactgccgccgggtggctgggcgttcgagttccacaacgacaactaccccgacatcgacgacaccgccgaagtcgtcctcgcgctgcgtcgcgtcaagcaccacgaccccgagcgcctggacaacgcgatccggcgcggggtgcgctggaacctcggcatgcagtccaaggacggcggctggggcgccttcgacgtcgacaacaccagcccgtttcccaaccggctgccgttctgcgacttcggcgaggtcatcgacccgccgtccgccgacgtcaccgcgcacgtcgtggagatgctggcgttcgagggcctgtcgcacgacccgcgcacccgccgcggcatccagtggctgctctccgcgcaggaggccaacggctcctggttcgggcgctggggcgtcaactacgtgtacgggaccgggtcggtggtccccgcgctggtcgccgccggactccccgcctcgcaccccgcgatccgccgtgccgtcacctggctggagaccgtgcagaacgacgacggcggctggggcgaggacctgcgctcctaccccgaggccgccgagtggagcggcaaaggcgcctccaccgcctcccagacggggtgggcgctgctcgcactgctcgcggcgggggagcgcgagtccaaagcggtggagcgcgggatcgaatggctcgcccagacccagcggccggacggctcctgggacgagccgtacttcaccggcaccgggttcccctgggacttctcgatcaactaccacctctaccgccaggtcttcccgctcaccgcgctcggccggtacgtcaacggcgagccgctcgtcgaggtcaaggggggt

SEQ ID NO: 1640 - DNA, 1128 bp, Streptomyces avermitilis
  CDS (1)..(1128)
gtgacgcccgatctgcacgggactggtccccgcaccccccgtaccgcaacaagaggagagactgtgcccactgtgcccccggccgagaaggctgccgacgcggtggacgtgaccgcgctcctggagcgcggccggaccctgtccaccccggtgctgcgcgcggccgtggaccgcctggcaccgcccatggacaccgtcgccgcctaccacttcggctggatcgacgccgcgggcaaccccgcggacggtgacggcggcaaggccgtacgccccgccctcgccgtgctctccgcgcaggccgccggtgccgcccccgaggtgggcgtcccgggcgcggtcgccgtcgaactggtgcacaacttctcgctgctgcacgacgacctgatggacggcgacgaacagcgccgccaccgcgacaccgtctggaaggtgcacggccccgcccaggccatcctcgtcggcgacgccctcttcgcgctggccaacgagatcctcctggagctcggcacggtcgaggcgggccgcgccacccgccgcctcaccaccgccagccgcgccctgatcgacggccaggcgcaggacatctcctacgagcaccgcgagcgggtcaccgtcgaggagtgcctggagatggagggcaacaagaccggcgcgctgctcgcctgcgcctgctccatcggcgcggtcctcggcggcgcggacgaccgcaccgccgacaccctggagaagtacggctaccacctcggcctcgccttccaggccgtcgacgacctcctcggcatctggggcgacccggagtccaccggcaagcagacctggagcgacctgcgccagcgcaagaagtccctcccggtcgtggcggcgctcgccgcgggcggacccgcctcccggcggctcggcgaactgctcgccgaggacgccaagagcagcgacttcgagaacttctccgaagaggagttcgccgcgcgtgccgcgctcatcgaggaggcgggcggtcgcgagtggaccgcccaggaggcgcggcgccagcacacgatcgccatcgaggccctggacacgatcgagatgccccagcaggtgcgggcccagctcgtggcgctcgccgacttcgtcgtcgtacggaagaga

SEQ ID NO: 1641 - DNA, 1425 bp, Streptomyces avermitilis
  CDS (1)..(1425)
atgagcgacgccactcggctcgaggggccggacgcggaggcctccggccgccccgagagggcggccgtggtggtcggcggaggactcgccggcatcaccgcggcgctcgccctcgccgacgccggagtgcgtgtgacgctgctggagggaaggccacgcctcggcgggctcgccttctccttccagcgcggcgccctgaccgtcgacaacggccagcacgtctatctgcgctgctgcacggcgtaccgctggttcctcgaccgcatcgacgccgcctcgctggcccccttgcaggatcgtctcgacgtgcccgttctcgatgccgggggcaagccgggacggcggctcggcagaatcggccgcaccgcgctgccggtgccgctgcatctcgcgaagagcctcgccacctatccgcatctctcgctcgccgagcgcgccagagtcgggcgcgccgcactggcgctcaagggactcgacctcgcggatccggcgctggacacgcagaacttcggcagctggctggccgcgcacggtcagtcggcgcgtgccgtcgaggcactgtgggacctggtcggggtcgccaccctcaacgcggtggccggcgattcctcgctcgggctcgccgcgatggtgttcaagaccggtctgctgtccgacccgggcgccgccgacatcggctgggcgcgcgtcccgctgggcgaactgcacgaccggctggcccgcaaggcgctcgactccgtgggcgtccgtaccgaagtccgtacacgcgtgacctccatctccctcaacggaaacgggcgttggagcgttcaggttcccggcgagacgctgcacgcggacgcggtcgtcctcgccgtaccccagcgcgaggcccacgaactgctgcccgaaggcgcgctcgacgcccccgagcggctgctggagatcggcaccgcgccgatcctcaacgtccatgtcgtctacgaccggaaggtgctcagccgcccgttcttcgcggcgctcggctctccggtgcagtgggtcttcgaccgcaccgaggcctccgggctgcccgaggggcagtacctggcgctctcccagtcggccgcgcaggacgagatcgacgagcccgtctccgtgctgcgtgagcgctatctgccggagctggagcggctgttgcccgcgacgcgcggcgcgcaggtgaaggacttcttcgtgacccgggagcgcacggcgacgttcgcccccacccccggcgtcgggcggctgcggcccggcgcccgcaccaaggcacccggcctctgtctggccggcgcgtggaccgccacagggtggcccgcgaccatggagagtgcggtccgcagcggtgtcagtgcggcgggcgccgccctgaacgccctgggccggccccgagatcacctcctcgaactcttcgaggaggcggcg

SEQ ID NO: 1642 - DNA, 948 bp, Streptomyces avermitilis
  CDS (1)..(948)
gtgatccggaccgtggagtcggaacaacacgtgtccgcaccggtactcgccgcatacagctactgcgagaccgtcaccgggcagcaggcccgcaacttcgcctacggcatcaggctgctgccgacgcccaagcgccgcgcgatgtcggcggtctacgccttctcgcggcgcgtcgacgacatcggcgacggcgcgctcgcgcccgacgtgaaggcggcgaggctcgaggacacccgggcgctgctgtcccgggtgcgtgacgggcgggtggacgaggacgacacggaccccgtcgcggtcgccctggcgcacgccgccgagcagttcccgatcccgctcggcggcctcgacgaactgatcgacggcgtcctcatggacgtgcgcggcgagacctacgagacctgggacgacctcaaggtctactgccgctgtgtggcaggggccatcggccgcgtctcgctcggcgtgttcggcacggaaccgggcgcccgcggcgccgagcgcgcgtcagagtacgccgacaccctcggcctcgctctccagctcaccaacatcctccgcgacgtacgcgaggacgccgagggcggccgcacctatctgcccgccgacgacctcgccaaattcggctgctcggccgggttcgaccggccgatcccaccggagggatccgacttcgcgggcctcgtgcacttcgaagtgcgtcgggcccgcgcccttttcgccgagggctaccggctgctgcccatgctggaccggcgcagcggtgcctgtgtcgccgcgatggcgggcatctaccgccggctcctcgatcgcatcgagcgcgagccggaggccgtactgcgcggccgggtctcgctgcccggacgcgagaaggcgtacgtcgccgtgcgtggcctgtcgggcctcgacgcccggcatgtgtcccggcgcaccgtcaggaggcgcgtc

SEQ ID NO: 1643 - DNA, 900 bp, Streptomyces avermitilis
  CDS (1)..(900)
gtgaccgaagccgggacggcgcgcgccgcggacccggagcgcgacaccctcgacaaggccgcggacgagaacttccccgtggcgccgttcttcctgcccagggcctggcgcaccgacctgatggccgtgtacggcttcgcccgcctcgtcgacgacatcggcgacggcgacctggcccccggcggtgccgacgcccgcctgctcggtgtgtccccgcgggaggccgaggaccggctggccctcctggacgccttcgaggccgacctccaccgggtgttcgactccaccccgcgccaccccctgctccgcaggctccagcccacggtccggcgcaccggtctcagccccgagcccttcctcggcctgatcgccgccaaccgccaggaccagctcgtcacgcggtacgagacctacgacgacctggtcgcctactgcgagctgtccgccaacccggtcggccacctcgtcctcggtgtcaccggcacctccacccccgagcgcgtccgccgctccgacgcgatctgcacggcgctccagatcgtcgagcacctccaggacgtctccgaggacctgggccgtgaccgcgtctatctgcccgccgaggacatgaagcgcttccatgtgcaagaggcggatcttgccacggccacagcaggcgcatcggtgcgcgccctggtcgcatacgaaacggaacgcgccctgaacctcctgaatgaaggcacccctctcgtgggtagcgtccacggcaggctgaggctgctgctcgcggggttcgtggcggggggaagggcggcgatccgcgcgatcgccgccgccgaatacgacgtacttcccggcccgcccaagcccggcaagcttcagctgctgcgcgaggtgggcgtgactctgcgaggagagggg

SEQ ID NO: 1644 - DNA, 777 bp, Streptomyces avermitilis
  CDS (1)..(777)
gtggctgagcagcggaacgactcccacattcccaccgtcatcgcggacgagctgcacatcgtctaccgcgtcaacggtgccaagaccggcaagggcagcgccaccgccgccctcagccgcatcgtcaagcgcggcgaggagcgcggggtgcgcaaggtgcacgccgtcaagggcgtctccttcaccgcctaccggggcgaggccatcggcctgatcggctccaacggctccggcaagtccaccctgctgcgggccatcgccggcctgctgcccgcggagaagggcaaggtctacacggacggccagccctcgctgctcggcgtgaacgccgcgctgatgaacgacctgacgggcgagcggaacgtcatattgggcggcctcgccatgggcatgtcccgagagcagatcagggagcgctaccaggagatcgtcgacttctcgggcatcaacgagaagggcgacttcatcacgctcccgatgcggacgtattcgtccggcatggcggcgcgcctgcgcttctccatcgcggccgccaaggaccacgacgtcctgatgatcgacgaggccctcgccaccggcgaccggaagttccagaagcgctccgaggcccgcatccgcgagctgcgcaaggaggccggaacggtgtttctggtcagtcacaacaacaagtcgatccgcgacacctgtgaccgcgtgctctggctggaacgcggcgagctccgcatggacggcccgaccgaagaggttctcaaggagtacgagaagttcacgggcaag

SEQ ID NO: 1645 - DNA, 927 bp, Streptomyces avermitilis
  CDS (1)..(927)
gtgagtgagacaacgcatgacggcggtgtcgcggtgagcgcccggccgtcgcccgacgaagggctctccggggccgagctggccgccaagtacgggctcgcggtcagcggtgcccggcccgggctcgtcgagtacgtccgccagctcctggggcggcgtcacttcatcctggccttctcgcaggcgaagctcaccgcccagtacagccaggccaagctgggccagctgtggcaggtggcgaccccgctgctgaacgcggccgtgtactacctgatcttcggtctgatcctgcacgccagcaagggcatgccgtccgatgtgtacatcccgttcctggtcaccggcgtcttcgtcttcacgttcacgcagagctcggtgatggcgggcgtacgcgcgatctccgggaacctcggcctggtgcgcgccctgcacttcccgcgcgccgcgctgccgatctcgttctcgctccagcagctccagcagctgctcttctcgatgatcgtgctgttcctcgtcgcgatcgggttcggcagctacccgagcctttcgtgggtgctgatcgtgccggtcctcgcgcttcagttcctcttcaacaccggcctcgcgctgatcatggccaggatgggggccaagaccccggacctcgcccagctgatgccgttcgtgatgcgtacgtggatgtacgcgtccggcgtgatgttctcgatcccggtcatgctggccgacaagccggcctgggtcgccgacgtccttcagtggaaccccgccgccatctacatggacctgatgcgcttcgcgctcatcgacgggtacggctccgagaacctgcccccgcacgtctgggcggtcgccgccggctgggccgtcctcgtggcgctcggcggcttcgtgtacttctggaaggcggaggagcggtacggccgtggc

SEQ ID NO: 1646 - DNA, 882 bp, Streptomyces avermitilis
  CDS (1)..(882)
gtgagcaccgccacaaaggtcggcgcggtcatcatcacgatgggcaaccgccccgacgaactccgtgccctcctcgactcggtcgccaagcaggacggcgaccgcgtcgaggtggtcgtggtcggcaacggctctcccgtcccggacgtccccgcgggcgtccggaccgtcgagctgcccgagaacctcggcatccccggcggccgcaacgtcgggatcgaggccttcggccccggcggcaccgacgtggacatcctcctcttcctggacgacgacggcctgctcgcccaccacgacaccgccgaactgtgccgccaggccttcacggccgacccggaactcggcatcatcagcttccgcatcgccgaccccgacaccggtgagacccagcgtcgccacgtgccgcggctgcgcgcctccgacccgatgcgcagctcacgcgtcaccaccttcctcggcggcgccaacgccgtccgtacgaaggtgctcgccgaggtcggcgggctcccggacgagttcttctacgcccatgaggagaccgacctggcctggcgggccctcgacgcgggctggatgatcgactaccggtccgacatggtgctgtaccaccccacgaccgccccgtcgcggcatgcggtctaccaccgcatggtggcccgcaaccgcgtctggctggcccgccgcaacctgcccgcccccctcgtcccggtctacctgggcgtctggctgctcctgacgctggcccgccgcccctcgggccccgccctcaaggcatggttcggcggcttcaaggagggctggaccagcccgtgcggaccccggcgcccgatgaagtggcgtacggtgtggcgcctgacccgactgggccgacctcccgtcatc

SEQ ID NO: 1647 - DNA, 681 bp, Streptomyces avermitilis
  CDS (1)..(681)
atgcgcgagctctcgctgcgcatcgaccggcacctggtgaacacgcggataacgcccaaccagctgacctacgtgatgaccgtcgccggcgtcctcgccgccccggccctgctggtgccggggatcacgggcgccgtgctcggcgtggtgatggttcagctctacctgctgctcgactgcgtcgacggcgaggtcgcccgctggaagcagcagttctcgctgggcggggtgtacctggaccgggtcggcgcctacctgtgcgacgccgcggtcctggtcggtttcggcctgcgcgccgccgacctgtggggctcgggccggatcgactggctgtgggccttcctcggcaccctcgccgctctcggcgccatcctgatcaaggccgagaccgatcttgtcggtgtcgcccgtcaccagggcggcctgccgccggtcaaggaggcggcctccgagccgcgctcgtccggcatggcgctggcccgcaaggccgccgccgcgttgaagttccaccggctcgtcctcggggtcgaggcgtccctgctgatcctggtcctggcgatcctggactcgatccggggcgacctgtacttctcgcgcctcggcgtagcggtcctggcgggcatcgccctgctccagaccctgctgcacctcgtgtccatcctcgcgtcgagcaggctgaag

SEQ ID NO: 1648 - DNA, 1059 bp, Streptomyces avermitilis
  CDS (1)..(1059)
gtgccagtactgacgaggctcatcccctcgccggtcgtcgtcgacatccgtccgggcgccctggacgacctggcgagtgtcctcgccgaccagcgcatctcgcactccggcaagctcgccgtcgcgatcagcggcggctccggggccaagctgcgcgagcggctcgccccggcgctgccgggcgcgacctggtacgaggtcggcggcggcaccctggacgacgcgatcaagctcgcggacgacatgaagtccgggcactacgacgcggtcgtgggtctgggcggcggcaagatcatcgactgcgcgaagttcgccgcggcacgtatcggcctcccgctggtcgccgtcgccacgaacctctcgcacgacggtctgtgctcgccggtcgcgaccctcgacaacgacgcgggccgcggctcctacggtgtgccgaacccgatcgcggtcgtcatcgacctcgacgtcatccgtgaggcaccggtccgcttcgtgcgctccggcatcggcgacgcgctgtccaacatctcggcggtcagggactgggagctggcccaccgggagaagggcgagcagatcgacggcctggccgccgcgatggcccgccaggccggcgaggccgtgctgcggcacccgggcggcgtcggcgacgacagcttcctccaggtgctcgccgagggcctggtcctcaccggcatctccatgtcggtcgcgggcgactcccgccccgcctccggcgcctgccacgagatcaaccacgccttcgacctcctcttccccaagcgcgcggcgagccacggcgagcagtgcggcatgggcgcggccttcgcgatgcatctgcgcggcgcgcacgaggagtcggggtacatggccgaggtcctgcaccgccacggcctccccgtgctgccggacgagatcggcttcaccgtggacgagttcgtccaggtcgtggagttcgctccgcagaccaggccgggccgctacacgatcctcgaacacctcgacctgaacaccgaacagatcagggacgcatacgccgactatgcaaaagccatcggtagc

SEQ ID NO: 1649 - DNA, 750 bp, Streptomyces avermitilis
  CDS (1)..(750)
atgatcggcctcgtgctggcggccggcgccggacggcgtctgcgcccctacaccgacaccctgcccaaggctctggtgccggttggccccgagggcaacgaggacagcctcacggtcctggacctcaccctcggcaacttcgcggagatcggcctgaccgaggtcgcggtcatcgtcggataccgcaaggaggccgtctacgagcgccgcgaggcgctggaggccaagtacgggctcaagatcaccctcatcgacaacgacaaggccgaggagtggaacaacgcctactccctgtggtgcggccgtgacgccatcaagcactcggtgatcctcgccaacggcgacaccgtgcacccggtctccgtcgagaagaccctcctcgccgcccgcggcgacggcaagaagatcatcctcgccctcgacacggtgaagtccctcgccgacgaggagatgaaggtcgtcgtcggccccgagggcggcatgacgaagatcaccaagctgatggacccggccgaggcgaccggtgagtacatcggcgtcaccctcatcgagggcgaggcggccgacgagctcgccgacgccctgaagacggtcttcgagacggacccgcagcagttctacgagcacggctaccaggagctcgtcaaccgcggcttccgcatcgacgtcgcgcccatcggcgacgtcaagtgggtcgagatcgacaaccacgaggacctcgccaagggacgtgaaatcgcgtgccagtac

SEQ ID NO: 1650 - DNA, 1719 bp, Streptomyces avermitilis
  CDS (1)..(1719)
gtgcgggtcgcctccgacgccggtgacgcagagacgctcctcgccgccgtgccggcgaaccagcgggtcgcgatcgtcgacgcccgcttcgtgggccacctccacgcgctgcgcctcggtctcaccgacccgcgtttcgaggccgccgcgctggccggcgccgtatcggcccagcccggcgcccggcaggcgctgacccgcgccctggcccgggagagctccgcggcgaccggcggtgccaccgtcgtcatggacaacctcgccgagcgcatcaccgcggccctcgacgccgacggcgtccaggtgcaccgccccgacctcggcacactcgtcgccgccgtccccgccgacccgcaggcccgcaacgaggtccgccaggccgtcacggccgtcgacgacgaggcggtacggctgcgtaccgccgtgaagtcccgggacggcttcttcaccacccacttcatcagcccgtactcgcgctacctggcccgctggtgcgcccgccgcggtctgacccccaaccaggtcaccaccgcgtccctgctcaccgccctggtcgcggcgggctgcgcggccaccggcacccgcgccgggttcgtcgcggccggcctgctgctcctgttctccttcgtcctcgactgcgccgacgggcagctcgcccgttactccctgcagtactcgacgctcggcgcctggctcgacgcgaccttcgaccgggccaaggagtacgcctactacgcgggcctcgccctcggcgcggcccgtggcggcgacgacgtatgggcgctcgccctcggcgcgatggtcctgcagagctgccgccacatcgtcgacttctccttcaacgaggcgaaccacgacgccaccgccaacaccagccccaccgccgccctctcggacaagctcgacagcgtcggctggacggtgtggctgcgccgcatgatcgtcctgccgatcggtgagcgctgggcgatgatcgccgtcctcacggcactgacgactccccgcatcaccttctacgcgctgctcatcgggtgcgccttcgcggcgacgtacaccacggcgggccgggtgctgcggtcactgacgcgcaaggcgcggcggacggaccgcgcggcccaggctctcgccgacctgacggactccgggccgctcgccgagttcctgacgcgcttcgcgcgcaggctgcgccttcgcggtcccgcctgcgtggctcttgtcacgggcgctctcgtggtgctggccgccgctctcgccccgtacggcagctggtggcccgtcctggccgccgtgacgtacgtactcctgtcgcccgtggccctgctgaagcccctcaagggcgcgctggactggctggttccgccgttctaccgtgcggctgaatacggcactgttctggtactggccgccaaagcggacgtgaacggagcgctgccggctgctttcggactggtggccgcggtcgcctaccatcactacgacacggtgtaccgcatccgcgggaacgccggcgcgccgccgcactggctggtgcgtgcgatcggggggcacgaaggcaggacgctgctggtcaccgttctggccgcgctgctcgtccccacagatttcaaggtcgcgctcacggcactcgccgtggccgtggcactcgtggtgctcgtcgagagcatccgcttctgggtgtcctcccaagcacccgccgtacacgatgaaggagaacccgca

SEQ ID NO: 1651 - DNA, 978 bp, Streptomyces avermitilis
  CDS (1)..(978)
atgacatggctgatcaccggcggggccggatacatcggtgcacatgtggcgtgggcgatgacggaggccggggagcgtgtgctcgtcctcgacgacctctcggccggggtgccggaccggctccccacgagcattccgctggtgcagggctcctccctggacggggcgctgctgaagcgggtcttcgccgagcactccgtgacaggtgtggtgcatctcgcggcgcgcaagcaggtcggcgagtccgtggcgcagccgacgcgctactaccaggagaacgtgggcggtctcacgaccctcctcgacgcggtggccggagcgggcatccagcgattcctgttctcgtcgtcggcggcggtctacggcaaccccgatgtggacctcatcacggaggacactccctgtgcgccggtgaacccgtacggcgagaccaagctcgccggtgagtggctggtgcgggcggcgggccgggcgcacggtatctcgaccgtatgtctgcgctacttcaacgtggccggcgcggcctcgcccgagctggccgacacgggcgtcttcaacgtcgtccccatggtcttcgaccgtctcacccgcggcgaggccccgaggatcttcggcgacgactatccgacgtccgacggcacctgtgtacgtgactacatccacgtcgccgacctggccgacgcgcatctcgcggcggcacggcggctgaccgccggcgccacgggcgacctgaccgtgaacatcggccgcggcgaaggtgtctcggtgcgcgagctcatcacgctgatcggcgaggtgagcggcgacaccacccccgccctcgtggagccgcgccgtcccggtgacgccccgcgcgcggtcgcgtcggccgcgctggccgccgaggagctgggctggcacgcccggcggggggtgcgcgagatggtggagtcggcgtggcggggctggcgccatcaccaccccgaagcggcgcgcgga

SEQ ID NO: 1652 - DNA, 591 bp, Streptomyces avermitilis
  CDS (1)..(591)
atgccgatcacacctgccacctcgacgcacagttcgtcgaacggcaccgctgaagcgatcttgctggagctggtcgacgagaacggcactacgatcggcacggcggagaagctcgccgcccatcagccgcccgggcagctgcaccgggcgttctccgtgttcctcttcgacgagcagggccggctgctgctgcaacagcgcgccctgggcaagtaccactcccccggcgtctggtcgaacacctgctgcggccacccctacccgggcgaggcgcccttcgcggcggccgcccggcggacccacgaggagctcggggtctccccctcgctgctcgccgaggcgggcacggtccgctacaaccacccggacccggactcggggctggtcgagcaggagttcaaccacctcttcgtcgggctggtgcagtccccgttgcgccccgacgccgaggaaatcggcgacacggccttcgtcaccgccgccgaactggcggagcggcacgcgaaggacccgttctcctcatggttcatgaccgtcctggacgcggcccgtccggcggtccgggagctgacgggcccgtccgcgggctgg

SEQ ID NO: 1653 - DNA, 573 bp, Streptomyces avermitilis
  CDS (1)..(573)
atggaccagcgcattaccaacactcgacgtgtggtgacaatcgagcgcgagggtggcgaccggacgatggacgaccaagggcgagggaccggcccacgccctgaaggcggcgcggacatgcccgacgacgggagacctcccgccccgctgccgtacgagggggtctggcggtacaccgcccccgccgtcgacgcctcggtgccgcaggcgcggcacgccgtccgggacctgctggcccgtcagggcgtgcccgtctcccgcgacctcgcccagggactgctgctgatcgtctccgaactggtcaccaacgccgtcaggcacgcggcgctgctgtcaccgatgctggcggtggaggtcgccgtcggggccgactggctgcggatctccgtggaggacaaccacccctaccgccccaccgccctggaggccgaccacgggcagaccggcggacgcggactgcttctggtgcgggagatcaccagggaggcgggcggggtgtgcgacgtggagcacacggcgagcggcggcaaggtgatctgggcggccgtgccgctcaagcccgtcggcatgttc

SEQ ID NO: 1654 - DNA, 747 bp, Streptomyces avermitilis
  CDS (1)..(747)
atggagccgcagctgctgcacagcgtcgccgacggggtggccaccgttgtcatccaccacccggccaagcgcaatgccatgaccgcgggcatgtggcgggcgttgccgtccctgctggacgagttggcctccgacaccgccgtgaacgcgctggtgctcaccggccagggcgacacgttctgcgccggtgccgacatctcgaccctgctggactcaccggacgaggcgcaggcgctggccgcgcgggccgaggagtcgctcgcggccttccccaagccgaccctggcggcggtccgcggatactgcgtgggcggcggttcccagctcgcggcggcctgcgatctgcggttcgccgaggcggggtccctgttcggggtgacgccggcgaaactcgggatcgtctatccggcctccgccactcgccgactggtgtcgctggtggggccggccaccgccaagtacctgctgttctccggcgagttgatcgacgcggagcgggcgctgcgcacgggcttcgtcgacgaggtgctgcccgagggacagctcgacaagcgggtggccgagttcacccgcgtactgaccgcgcgttcgcagctgacgcaggcggcggccaaggagttcgcgaacggacgcgcggaccgggacacgtactgggcacagcaggcgcgcggcagcggcgacaccgcggagggggtcgccgccttcctggagcaccgccggccgcgcttcacctggactacgtcagga

SEQ ID NO: 1655 - DNA, 633 bp, Streptomyces avermitilis
  CDS (1)..(633)
atgcagatcgcgatcgtcctctacgaccgcttcaccgccctcgacgccgtgggcccgtacgagatcctgggccgcctccccggcgcggagaccgtcttcgtcgccgagcggaccgggcccgtccgcgccgacaccggagccctcgcgctcaccgccgacaagagcctggccgaggtgccgagccccgacctcgtggtggttcccggcgggcccggccagaccgcgcagatggagaacggggtcctcctcgactggttgcgggccgccgacgcgagcagcacctggaccacgtccgtgtgcaccggctcactgctgctcgccgcggccggcctgctgaaggggcgccgcgccacctcgcactggctggccctggacctcctcgaccggttcggcgccgcaccgaccggggagcgggtcgtgttcgacggcaagtacgtcaccgccgccggtgtgtcctccggcatcgacatggggctcgccctgctcggccgcatcgcgggcgacgaacacgcccaggccgtacagctgttgacggagtacgacccgcagccgccctacgacgcggggtccccgcagaaggcgcccgcccacctcgtcgaggagttccgcaccagcagccgcttcatcctgacg

SEQ ID NO: 1656 - DNA, 1002 bp, Streptomyces avermitilis
  CDS (1)..(1002)
gtggggtactcgtccttgcggccatccggcggcccgccaagaatcgaaggcatgcgcaccgttgtggtcgtcctgttcgacgacgtgcagagccttgacgtcaccggcccgctggaggtcttcgcgggcgcggaggcacactccggcggtacctaccgcatccgtacggcgtccctggacggcgcgcccgtgcgcacctccagcggcctcgcgctcgtcccggaccactccctcaccgaggcccccgccgcgcacaccctgctcgtacccggcggcaacggcacccgccgccccgacccccgcctggtggactggctgcgcgcccacggcccccgtgccgagcgcctggtctccgtctgcaccggcgccgtcctgctcgccgaggcgggcctcctggacgggcgccgggccacgacccactgggcgtactgcgaccagctcgcccgcgaccacccggcggtcgaggtcgacgccgaccccatctacgtacgcgacggacacatcgccacctcggcgggcgtcaccgccggcatcgacctcgccctcgccctcgtcgaggaggacctgggccgtgatgtcgcgctcttggtggcccgccacctggtcgtcttcctgcgacggcccgggaaccaggcccagttcagtgcccagctcgccgcacagaccgcgcagcgcgcaccgctgcgggaggtccagcagtggatcaccgaacaccccggcgacgacctcacggtcgagtcgctcgccgcccgcgcccggctctcgccccgccacttcgcccgcgccttccaggccgagacgggcacgacccccggccggtacgtcgacggggtccgcctcgaacacgcccggcgcctgctggaggacaccgcggacggcgtcgaggagatctcccgtgcctgcggctacggcacgccggaggccatgcgccgcgctttcgtcagggcgctcggcacggcgccggccgagtaccggcgccgtttccacaccaccgtcacccgc

SEQ ID NO: 1657 - DNA, 765 bp, Streptomyces avermitilis
  CDS (1)..(765)
atggccgccgtcggtgtcggggacgtccaggccgcctacttcgcggcgcgggccgcggccatggggccggtgggcgccggcgtggtgacggcgacgttccacaacttccgccacgagctggtcgccgcgcatgtgcccggggtgtgggggacggcctctcccgaggtggtgctggcggcacgcgcgcgtgccgtcgacgccacactgcggcggctgctcggcgcggagctgctcgccgccgaggaggtggccgaggcggcggagctggcgctgcgcgcgaccgaggcgtgttccaggaacgcgcgccccctgtacgccgcgcacgccgacctgccggtgcccgacgcgccgcacctggcgctctggcacgcggccaccctgctgcgcgagcaccgcggggacggtcacctcaccgtgctgctcggtgcggaactggacccggtggaggcgctggtcagccacacggcgaccggcaagggcatggcgccgaagtgggccctcgccacccgcggctggagccaggagcactgggaggccgccgttctgcggctgcgcgagcgcggactgctcgacgcggagggcgagttgaccgaggccggaaccgccctgcgcaaggagatcgaggcgcagacggaccggatcgaccgtgcgccgtacgagcacctcggcgccgcgggcgtggcacggctcacggagctggcggcggggctgctgagcagggcgatggcggcgggcgcgttccccacaggcatgatcggcaagagt

SEQ ID NO: 1658 - DNA, 2430 bp, Streptomyces avermitilis
  CDS (1)..(2430)
gtgacgacacccctcgtagggtccatcgaaggcaggatcgcggaggagctcggcgtacgggagcggcaggtgaaggcggccgtcgacttgctcgacggcggttcgacggtgcccttcatcgcccgctaccgcaaggaagcgaccgagatgctcgacgacgcgcagctgcgcacgctcgaggagcggctgcgctacctgcgggagctggaggagcggcgcacggcgatcctggagtcggtgcgcgagcagggcaagctcaccgcggaggtggaggcccagatccgcggtgccgagaccaaggcccgcctggaggacatctacctgccgttcaagcccaagcggcgcacgaaggcgcagatcgcccgggaggcgggcctcgagccgctggccgagggtctgctcggcgacccgtcggtcgacccggcggcggcagcagccgccttcgtcgacgccgacaagggcgtcgccgacccgcaggccgcactcgacggcgcgcgctccatcctcaccgagcggttctcggaggacgccgacctgatcggcgagctgcgcgagcgcatgtgggtgcgcgggcgcctcgccgccaaggtgcgggacggcaaggaggagacgggcgccaagttcgccgactacttcgacttcgccgagcccttcaccgagctgccctcgcaccgcatcctcgcgatgctgcgcggcgagaaggaggacgttctcgacctcgtcctggagcccgaggagccctccgagcagcccgggccgtcctcgtacgagggaatcgtcgcccaccgcttcgggatcgccgaccgcgggcgcccgggtgacaagtggctgggcgacacggtccgctgggcctggcgcacccgcatcctggtgcacctcgggatcgacctgcggctgcggctgcggacggccgccgaggacgaggcggtcaatgtcttcgcggcgaacctgcgcgacctgctgctcgccgcccccgccggtacccgcgcgacgctcgggctcgaccccgggttccgtacgggtgtgaaggtcgccgtcgtggacgcgaccggcaaggtcgtcgccacggacgtcatccacccgcacgtcccggcgaacaagtgggacgaggccctggccaagctggcccgcctcgccaaggagcacgcggtcgaactgatcgcgatcggcaacggcacggcgtcccgcgagaccgacaagctcgccggtgaactcatcacccggcacccggagttgcagctcaccaaggtgatggtctccgaggcgggggcttccgtgtactcggcgtcggcgttcgcctcgcaggagctgcccggcatggatgtgtcgctgcgcggtgccgtctccatcgcacgccggctccaggacccgctcgccgagctggtgaagatcgacccgaagtcgatcggtgtcgggcagtaccagcacgacctgtccgaggtgaagctgtcgcgctcgctcgacgcggtcgtcgaggactgtgtgaacggcgtcggtgtggacgtgaacacggcctccgcgcccctgctcgcgcgggtgtccgggatctcctccggcctcgcggagaacatcgtggcgcatcgggacgcgaacggcccgttcacgtcccggacgaagctgaagggcgtggcccgcctcggtccgaaggcgtacgagcagtgtgcgggcttcctgcgtatccggggcggcgacgaccccctggacgcgtccagcgtgcaccccgaggcgtatccggtggtgcggcgcatggtgaagtcggcgggcagcgaggtcgcctcgctgatcggcaactccggtgtgctgcgctcgctgcggccggacgacttcgtggacgagaccttcggtctgccgaccgtgagcgacatcctgagggagctggagaagcccgggcgcgacccgcggcccgcgttcaagacggccaccttcaaggagggcgtcgagaagatctccgacctggcgtccgggatggtgctggaaggtgtcgtcacgaatgtcgccgcgttcggggcgttcgtggacatcggtgtgcaccaggacggcctggtccatgtctccgccatgtccaagacgttcgtcaaggacccgcgggacgtggtgaagccgggcgacatcgtcaaggtgaaggtgctggacatcgacatcccgcgcaagcggatctcgctgacgctgcgcctcgacgacgaggcggcggcgtccgagggccggcaggaccagcagggccagggcggcggcggtcgtcagcagcgcggggccggccggccgcctcagcagcggcaacagcagcaacggcaacagcagccgcagcgccagggccgggccggcgggggtggcggcgggggcggttcacgtcaggctccgccgccggccaacagtgcgatggcggacgccctgcgccgggccgggctcgtcgaccccaagcggggcaagggc

SEQ ID NO: 1659 - DNA, 1638 bp, Streptomyces avermitilis
  CDS (1)..(1638)
atgactgccactctcgtcgccaagaacctcgccgccggccacggtgaccgctcgctcttctccggactcgacctcgtcgtcgcgcccggcgaggtgatcgggctcgtcggtgccaacggcgcgggcaagtccacgctgctgcgcctgctcgccggactgctccccccggaagagggagagctgcggctctccccgccgaccgccacggtcggacatctgccgcaggagccggagcgccggcccggcgagaccgtacgggagttcctcgcgcgccgcaccggcgtggccgaggcccagcgggtcatggacgaggccacgcaggggctggtcgacggggccccgggcgccgacgacgcctacgcggtgagcctggagcgctggctcgacctgggcggcgcggacctggacgagcgggccgaggaggtcgccgactcgctcggtctgaccgtcggcctcgaccagccgatgacctccctgtccggcggacaggcggcccgcgcgggcctcgcctccctcctcctctcccgctacgacgtgttcctcctcgacgagcccaccaacgatctggacctggacggtctggagcgcctcgaacgcttcgtcggcgggctgcgcgcgggcaccgtcgtcgtcagtcacgaccgcgagttcctcacccgcacggtcaccaaggtcctcgaactcgacctcgcacagcagcagatcacgctgtacggcggcggctacgaggcctatctggaggagcgcgagaccgcgcgccgacacgcccgcgaggactacgacgagtatgcggacaagagggcggccctcgaagggcgggcccagatgcagcgctcctggatggacaagggcgtcaagaacgcccggcgcaaggccggaaacgacaacgacaagatcggccgcaagttccgcagcgaggccagcgagaagcaggcctcgaaggcccggcagacccagcgcatgatcgagcggctcgacacggtcgaggagccccgcaaggagtgggaactgcgtatggagatcgcggccgccccgcgctcgggcgccgtcgtggccaccctgcgggacgccgaggtccggcgcggcgacttcaccttcggccccgcgacgctccagatcgactgggcggaccgcgtcgcggtcaccggcgcgaacggggccggcaagtcgacgctgctgggtgccctgctgggccggatcccgctggacgccgggcacgcgaccctcggttccagcgtggtcgtgggcgaggtcgaccaggcccgcaagctcttccacggctccgaggccctgctcgatgcgttctgcgcggccgtcccggacacggaaccggccgaggtgcgcacgctgctggcgaagttcggcctgaagtcgcaccacgtcctgcgccccgcggcgagcctgtccccgggcgaacgcacccggtcggcactggccctgctccagggccggggcgtcaacctcctcgtcctcgacgagccgaccaaccacctcgacctccccgcgatcgaacagctggagacggcgctcgactcgtacgagggcacgctgctgctggtcacgcacgaccgtcggatgctggacgcggtgcgcacgacacggcagctggaggtcgcggacggcaaggtgaccgagcgc

SEQ ID NO: 1660 - DNA, 1017 bp, Streptomyces avermitilis
  CDS (1)..(1017)
atgtctgccgagtacgcgaccttcggcctggcaccggcgatgcgtgccggtggagtcctcaccaacggcgattaccaagtgcaccgggacttcgtggacttcatcgtcgacgggcgcccgctgctgttccagctctccgacctcgacgccgtctccccactggcctccgacgtgccacccgcgatcttcaccgcgcaggtccggggcctgctgctggaggcggaggctccgcccgcggacggccggtacgtcatctatggctgccccgaatgcgagaacatcgagtgcggggccgtcaccgccgtcatcgagaaggacggcgaggatttcgtctggcgcgacttcgcctggcagacggacgagcgggcggacctggagctgaacggctaccacgggatcggtccgttccgcttccatggcaccgagtaccgtgacgcgctcagctccctcctcgacggcggctcgggcccgcgccgccgcgtcctgctgatcggcgcccgcgtcgccgtcctcgccaagctcgccgccgccctgcgcacgatcggtatcggcgccgacatcacccacgacgccacggcggtcccggccgacgaactacgggagtacggcgcggtggccttcggccgggccgtcggcgaaaaggaacgtgccgccgtgcggcagtccttcgcgcgcgccggggtcgaggtcgcgtacatcgacggcctggcgccgatcatcccgctcctcgtggcgcagacggagcacgccctggaccgcagtcccgaggagcggcgccggctgacccgcctggtcgcggccgacggcgaggcgggcatcgaggtcacctccacctgccgggtccgcctcacggcgtaccggctggaccgtctgtaccgcacccacgtccacgaggtcttcgacgatgtcctggaggccggacgccatcggatcccccttgacccgaaggcgacgaaaggcgagtccttcgtggtggcgaggacgtcggggagcgtgctggtggcggcgatggaacgc

SEQ ID NO: 1661 - DNA, 951 bp, Streptomyces avermitilis
  CDS (1)..(951)
gtggagactggtcgaagcggtgaggtcatcgtggtcggcggcggcgtcatagggctgacgacggcgatcgtcctggcggagagcggccggcgcgtacgcgtgtggacgcgggagccggtcgagcggaccacctcggcggtggcgggcgcgctgtggtggccgtatcggatcgagccggcggcgtcggcccgcgcgtgggccctcacctcgttcgatgtgtacgaggaactggcgacacgccccgggcgaaccggtgtacgcatggtcgaaggcgtgcagggcggggcgacgctggaggagaccgaggcgtgggcattgggccgggccctcgggctgcgggcggcgacggccgaggagtgtcccgggggcgggctgtgggcacggctgccgctgatcgacatgccggcgcatctgcggtggctgcgcgagcggttcaccgcggcgggcgggacggtcgagacccgtacggtgaccgacctcgcggaggccaaggcgccggtcgtggtcaactgcacgggcctgggcgcccgtgacctcgtaccggacacgtcggtgcgtcccgtgcgggggcagctcgtcgtcgtggagaaccccggcatccgcacctggctcgtctccaccggggccgacggggagatggcgtacttcttcccgcagccgggccggcttctgctcggcggcacggcggtcgaggacgagtggtccctcgtgcccgatccggcggtggccgaggcgatcgtgcggcgctgtgcggcgtggcgacccgagatcgccggggcgcgggtcctggagcaccggacggggctgcggccggcgcgcggcacggtccggctggaacgcgaaccgctctcggacggacgggtgttggtgcacaactacggccacggcggcgcgggcgtcaccgtggcctgggggtgcgcccaggaggcggcagggctggccgcctcctgg

SEQ ID NO: 1662 - DNA, 1293 bp, Streptomyces avermitilis
  CDS (1)..(1293)
gtgacgacccgacgcatgagcgccgtcgccctcgcggcggcggccctcgccgcgcccctgctcacagcacccgcgcacgcggccgaacccccgccgcgtacgggattcgagcagaccgacggcgcccgctggaccacgcagcccgaggagcaggacttcctgaccgcgctcgacaggacgagcgagcgggtgtccctcgcccgtatcggcacgaccgagcaggggcggccgctggacctcgtccgggtcggaggcggacaccgcgcccgtgccaccgtgctgctcgtctgcagccagcacggggacgagccctccggtcgcgaggcctgcctgaccaccgtccgcgatctcgcgtacgcgaaggacgcgcatacccggcgcttcctgaaacagaccaccctgctcgtcgtgcccaccgccaaccccgacggccgggccgccgacacccgcggcaacagcgacggcgtcgacatcaaccgcgaccacctggaactgcggaccgccgaggcccgtgccgtggcggcggtcctccgcgaccgccggcccgacgtgatctacgacctgcacgagtacggggccacgcccccgtactacgacaaggacctgttcgacctctggccgcgcaacctcaacaccgaccccacggtgcacgacgaggcacagaccctgtcacaggcgtatgtgcgcccggccgcccagcgggcggggtacacgacagggacctacggcatctggaccgatcccgtcaccggcgatccggtcaaacagaccgccggggacggacaggagcggatcctgcggaacatgtcaggcgtcaaacacgccgccggactgctcatcgagagccgcgtcgaccccctcacggacgccgaacagacggacggatcactcaacaagcggcgtcgggtccaatcccaactggccgcgctgggaggtctgttcggctttaccggcgagcgcggcgcacgggtcgccgccgccaccgacgcggcccggctcgccgggtaccgcgaccgcgggccggtctatgtgggcggcgccgacaacgaccccgccgaacccgccgaggtgattcagaacccgccctgcggctaccggctcaccgccgagcagtacacggccgtcaaggaccggctcgccctgcacggcgtgcgcgtacgccacgagggcgccgacggcgccgacggcacagtcctcgtaccgctgcgccagtcgctgcgcgccctcgtcccgctgctcctcgacgagcgtgcgccgtaccacctcacggccggagaagcggccgccgactgc

SEQ ID NO: 1663 - DNA, 2028 bp, Streptomyces avermitilis
  CDS (1)..(2028)
gtgattccgccccacaggtgtctcacagaccctcttttgcaagggagttggccggggtaccttccgcccatgccgaaacgtgcgcgccgtatgcgcctcacgacctggagatcgccggtcaccgcggtcatcgccgccctgctggccgccttcctgactcccgccgccgcacacggcgcgccacgggagagcgccccggtctactcgtacgagaacgccatccgggagtccgtatgggtggacacccgcctcgacggcgacggcgacgggaagaccgaccgcgtggccgtcgacgtcgtccgtccccgcgaactcgcccggcagggccgcaagattcccgtgatcatggacgcgagcccgtactactcctgctgcggacgcggcaacgagagccagaagaagacgtacgacgcgaacggcgacgtcgtccggatgccgctcttctacgacaactacttcgtgccccgcggctacgccttcgtcggtgtcgacctcgccggcaccaaccgctccgacggctgcgtggacgtgggcggccgctccgacatccagtcggcgaaggcggtgatcgactggctgaacggccgggcgcacggctacaccagccgcaccggcaccgcccgggccaaggcgacctggaccaacggcaggaccggcatgatcggcaagagctgggacggcaccgtcgccaacggcgtcgcggccaccggggtcaagggcctgaagaccatcgtgcccatcagcgccatctcctcctggtacgactactacttcgccaagggcgccccgctctacgactcgggcccggactggctgtccgactacgtggacagccccgacgcccgcaccaagtgcgccgccgtgcagcgcaagctcgtcgacgaggcgccgcgcaccggtgactggacctcgctgtggaccgagcgcgactatgtcaaggacgcgagcaaggtccgggcgagcgtcttcctggtccacggcatgcaggacctcaacgtccgcgccaagaacttcggccagtggtggagcgccctcgcgaagaacggcgtcgagcgcaagatctggctgtcccagaccggccacgtcgacccgttcgacttccgccgcaccgcctgggtggacacgctgcaccgctggttcgaccatgaactcctcggctacgacaacggcgtcgaccgcgagccgacggccgacatcgagcgccaccccgaccagtgggtcacgtccacgctctggccgccgcgcggcacggacgccgtgacgctgcgacccggcacgggcacccaggccggtgtcggcaccctcgggctgcgtaccggatccggcaccgagaccttcaccgacgacccgcggctgagcgagacggactgggccgcccacatcgacgagtccaccgcgagcaaggccggattcgtcaccgcgcccctggccggggacgtgcgtctgtccggctcctccaaggtgaccgtcaccgccacaccgaccacctccacggcccacctgtccgcggtactcgtcgacctcggcccggacacgatccgcgactacgccgacggcggcgagggcatcaccacgctcaccgaccgcacctgctggggtgcgagcacggccggagacagcgcctgcttcaagaacacgcgggccacgaccgccgccgtcgactacaccgtcctcagccgcggctgggccgacctcggcaaccacgcctccgcccgcaagggcgtcccgctcaccccgggcaaggcgtacacgatcaccctcgacctcgccgccaccgaccacgtcgtcccgaagggccaccggctcgcactgatcgtcgccggcaccgacaaggacctcatcgaccctccgtcgagcacgcccaccctgacgctcgacctggcccgcacctcggcccgggtcccgctcgtcggaggcgccgccgccttcacccgggcgaccgcccagtccggcaccgccgcggacgccaccgtcctcgacggcgtacgtgagccgcacaccgcgcaccgcgtccccggaggcggcctg

SEQ ID NO: 1664 - DNA, 1491 bp, Streptomyces avermitilis
  CDS (1)..(1491)
gtgcaccgcagactcatcgccccgggcgcgctcgcggcctccctcctgctggcgatcccggcatcggccgcgagctactcccccggagcgccgggcatcggcgacccctactacccggcctacggcaacggcggatacgacgtctcgcactacgatctgcggctgaagtaccagccgcggacggacgagttggagggcacggccaccctcctggccacgacgaaacaggacctttcacggttcgatctggacttcctgctcgatgtgagcgaggtgcgggtcaacggcgccaaggcctcgttcacgacgtcgggtcagcacgagctggagatcaccccggcgacgccgctgcccaagggcacgccggtcacggtcgtcgtccgctacagcggggtgccgtcgacgaagagcgcgtacgggttcagcacctggcaccgcactccggacggcgcggtcgcggcggacgagcccgaggctgcctggtggtggtatccgagcaacgaccacccgagcgacaaggccacgtacgacgtgtcggtggccgtgccggacggcacccaggcgatctccaacggcctactgcagtccaccagttcgaaactcggctggacgcgctacaactggcggtccaccaagccgcaggccacgtacctcaccacgctcgccgtcggcaggttcgacatcacgaccgggaagacgtccgacgggatcccggtcatcaacgcctacagcaaggacctcggcgacaacgacggtgccgcgcgggcgagcgtggagcggaccggggagctcgtcgactggctgagcgggtacttcggcccctacccgttcaactcggtcggcggatacgtgcccaacacgaccaccgggtacgccctggagacgcagacccgcgtgtactacagcccgaagcagttcgcgaacggctcgaacacctccgtcgtcgtccacgaactggcccaccagtggtacggcgacgacgtctccctcgccgggtggaaggacatctggatcaacgagggcttcgcgcggtacgcgcagtggctgtggtcggagcacgagggtgagggcacgacgcaggaactggcggactacgtgtacgcctcgcacccggccgacgacgcgttctggacggtcaagcccggggatccgggtccggacgaccagttcgacaccgccgtgtacgaccggggggcgctggccgtccaggcactgcgcaacgagatcggtgacgacgcgttcttcgccgtcctgaagggctggccgaaggaccacgcgtacgggaacgcggcggtcggcgacttccagaagtacgcggagaaggtgtcgggcaagtcgctggccgccctcttcgacacctggctgttccagccgtcgaagccggccgcgtccgcggcgaagggcgcgtcgctcgcgtcccgtaccgcggcggccaccgtccagccgaggtcctggaagaagatcgccgcgacgaactcggcgcaccagggc

SEQ ID NO: 1665 - DNA, 477 bp, Streptomyces avermitilis
  CDS (1)..(477)
atgtcggagatcaggtatgtccggggtgacgccaccgttccgtcgggcgagggcgtgaagatgatcgcccatgtgtgcaacgacatcgggggctggggaagcggcttcgtgctggccgtgtcccaccgctggccggagcccgagaaggcgtaccgagcctggtaccgggaccgcgcggcgaacgacttcgggctgggcgccgcccagttcgtccaggtcgagcggtctctgtgggtggccaacatgatcggccagcgggggatacgcaccagcgacaacgaggtgcccgtacggtacgaggcgatcgacgcggcgctcggtctgctcgccgacagggccgtcgcactcgacgcgtccgtccacctgccgcgcatcggctgtggactggccggcggcacctggtcacgcgtggagccgctcatcacggagcggctcgtgcggcggggcataccggtgacggtctacgaccacggcgac

SEQ ID NO: 1666 - DNA, 1461 bp, Streptomyces avermitilis
  CDS (1)..(1461)
gtgagcaaggacgccgtagacacggccagggttgcatcgcgcaccgatgtgacccagtcgcccgcggacgcaggcgacgccggttacagcaaggacctcaaggcccgccacgtcaacatgatcgcgatcggcggagcgatcggcaccggtctcttcctcggtgccggcggccgcctccacaacgcgggaccagccctcgccatcgcctacctcgtctgcggcgtcttcgccttcttcgtggtccgggccctcggcgaactggtcctctaccggccctcgtccggatccttcgtgtcgtacgcgcgcgagttcctcggcgagaagggcgcgtacgttgccgggtggatgtacttcctgaactggtcgacgaccggaatcgcggacatcaccgcgatcgccctctacacccactactggagcctcttcaccgacatcccgcagtgggtgctcgcgctgatcgcgctcgcggtcgtcctggccgtgaacctgatctcggtgaagatcttcggcgagatggagttctggttcgcgatcatcaaggtcgccacgctggtcggattcatgctgatcggcatcttcctgctggccacgcaccacgaggtcggcggccacaccccgggcctgagcgccgtcacggaccacggcgggatcttcccgcacgggatgatgccggtcgtcctggtgatgcagggcgtgatcttcgcgtacgcggccctggagctggtcggtgtcgcggcgggcgagaccgccgagccggagaaggtcgtcccgcgcgcggtgaactcgatcatgtggcgcgtcggcctcttctatgtcggctcggtcgtcctgctcgcactgctgctgcccggatcggtgtactcggcggaccagagccccttcgtcacggtgctgtcgaagatcggcatcccggcggccggtgacgtgatgaacctggtggtcctcacggccgccatgtcgtcgctgaactccggtctctactcgaccggccgcatcctgcgctccatggccatggcgggctcggcgcccaagttcacggcgcggatgaaccgcagccaggtcccgtacggcggcatcctgctcacctgcgcggtctgcgtcctcggcgtcggcctcaactacctgatgccgacccaggccttcgagatcgtcctgaacgtggcatccctcggcatcatcagcacctgggtgatcatcatgatctgccacctggtgttcgtccgccgcgcccgggcgggcctggtgacccggccgtccttccggctgttcggcagccccgtcacggagatcgtcacgatcgccttcctgctggccgtgctcggcctgatgtggaacgaccccgaggtcggccgtaagaccctcctcctcatcccgctcgtcgccgtcctgctggtgggcggctggttcgcggtccgccgccgggtctcgcaggccgaggaccgggagctcgcgcagctgaag

SEQ ID NO: 1667 - DNA, 693 bp, Streptomyces avermitilis
  CDS (1)..(693)
atgacgacggacaccggcgagccgacactcacggtcgacgaactggccgcgcgtgcgggcgtcacggtccgcacggtccgtttctacagctccaagggcctgctgccgccgccctcgatcggcccccggcgggtgggccactacagccaggagcacctggcccggctcgccctcatcgaggagttgcagcaccaggggatgacgctcgccgcgatcgagcgccacctccagcagctcccgccggacctgagcgcccacgacctggccctccaccgtgccgtggtcgcttcctgggcgccggacgcggtggagacggtgacccgggcggagctggagcggcgggcgggccggccgctgggcgaggcggacctggagcggctcgccgcgatgagcgtgctcgcccggaccgaggacgcgttccgcgtggaccccgggctgctgccgctgggcgtccagctcctcgacgtgccggtcgcccacgaggcgatcctcgcggcgcgcaccgcactcatcgagcactcgcgcgcggcggcccacgagctgtcgcggctgttccgggacgcggtggccgagcgcgactcgcaggcggtgaagtccttgtcggcgcacatgcagccgctggtcgtgcaggccctgctcaccaccttccagcgctccctgcgggaggagctgcgggagtggctggcggagtcc

SEQ ID NO: 1668 - DNA, 639 bp, Streptomyces avermitilis
  CDS (1)..(639)
atggagacacgtaccgccctggtgaccggagcggcacagggcctcgggcaggagttcgccgtcgcgctcgcggggcgcggcttccgggtggcggggctcgacctggtcccgcagccggaaacggcgaaacgggtgctggactacgtggagttgaccgcggacgtcagcgacgaggagcaggtccgggaggcgctggacgaggtcatcgaccggttcggcacgctgcacgtcctggtcaacaacgcgggcgccggccccgagtcggacttcgaggacacgacgcccgaggagtggcggcgggccatgcgcgtcaacctggaggcccctttcctggtgacccgcgccgtgctgccgtatctgaaggcggcgggctggggccgcatcgtgaacatcgcgtcggcggcggtcttcgccgcaccgccgacgagggtcgcccacgtgacctcgaaggccggcctgatcggcctgacccgctcactcgcctcggccctcggcccgtacggcatcacggtcaacgcgatcgccccgagcgcggtccgcacggcggatctggtctccacgctgctgtacgtcgtcgacgagggcagcggtctcctgaccggccagaccctgaccgtggcgggcggctcgacgtgctgg

SEQ ID NO: 1669 - DNA, 2205 bp, Streptomyces avermitilis
  CDS (1)..(2205)
atgagcactgagcccaccaccatccgctgggaacaggacgagaccgggatcgtcaccctcgttctcgacgaccccaaccagtccgccaacaccatgaaccaggccttcagggcgtcgatcgcggcgatcgccgaccgcgccgaggccgagaaggactccatccgcgggatcatctacacctccgccaagaagaccttcttcgcgggcggcgacctcaaggacatgatgaaggccggcccgtcggacgcccagcgggcgttcgagaccggtacggcgatcaagaactccctgcgccgcatcgagaccctgggcaagccggtggtcgccgccatcaacggcgcggccctcggcggcggttacgagatcgctctcgcctcccaccaccgcatcgccctcgacgcgcccggctccaagatcggcctgcccgaggtcaccctcggtctgctcccggcgggcggcggcgtcacccgtaccgtacgcctcatgggcatcgccgacgccctcctgaaggtgctcctccagggcacccagtacgcgcccgcccgcgccctcgagaacggcctcgtccacgaagtcgccgcgacccacgaggagatgctcgcgggggcccgcgccttcatcgacgccaaccccgagtcccagcagccctgggacaagccgggctaccgcatcccgggcggtacccccgccaacccgaagttcgcggcgaacctgccggccttcccggccaacctgaagaagcagctgaacggcgccccctacccggccccgcgcaacatcctcgcggccgccgtcgagggctcccaggtcgacttcgagaccgccctggtgatcgaggcccgctacttcaccgagctggtcaccggacagaccgccaagaacatgatccaggcgttcttcttcgacctccaggccgtcaactccggcgccaaccgcccccagggcgtcgcaccgcgccaggtccgcaaggtcgccgtactcggcgccgggatgatgggcgcgggcatcgcctactcatgtgcccgcgcgggcatcgaggtcgtcctcaaggacgtgtccgcggaggccgcggccaagggcaggggctactccgagaagctgtgcgccaaggcggtctcccggggacgtacgactcaggagaaggcggacgcgctcctcgcccgcatcacgcccaccgccgaccctgccgacctggcgggctgcgacgcggtgatcgaggccgtcttcgaggacacggcgctcaagcacaaggtgttcgaggagatcgagcacatcgtcgagccggacgccctgctctgctccaacacctccaccctgcccatcaccgcactcgccgagggcgtggagcgccaggccgacttcatcgggctgcacttcttctcgcccgtcgacaagatgccgctcgtcgagatcatcaagggcgagcggaccggcgacgaggcgctggcgcgcgccttcgacctggtccgccagatcaacaagaccccgatcgtcgtcaacgactcgcgcggcttcttcacctcccgtgtcatcggccacttcatcaacgagggcgtggcgatggtcggtgagggcatcgagcccgcgtccatcgagcaggcggccgcgcaggcgggctatccggccaaggtcctgtccctcatggacgagttgacgctcaccctgccgcgcaagatccgggccgagtcgaagcgggcggtcgaggaggcgggcggcacgtgggtgacccacccggcggaggcggtcatcgaccgcatggtcgacgagttcggccgcacgggacgcggcggcggtgcgggcttctacgactacgtggacggcaagcgcgccaagctgtggcccgggctgcgcgagcacttcaccaagccgggccatgagatccccttcgaggacatgcaggagcgcatgctcttcgccgaggcgctggacaccgtccggctcctcgaggagggcgtgctgacgtccgtcgcggacgccaatatcgggtcgatcttcgggatcggtttcccgggctggaccggcggtgtcctccagtacatcaacgggtacgccggcgggccgggtgccggcgccggggcaggtgccggcctgcccggcttcgtggcacgggcgcgtgaactcgccgagcgctacggggagcggttcacgccgccggccctgctcgtggagaaggcggagaagggcgagcacttcagcgacgcgaag

SEQ ID NO: 1670 - DNA, 1212 bp, Streptomyces avermitilis
  CDS (1)..(1212)
gtgagcaccgaagcgtacgtgtacgacgcgatccgcaccccgcgcgggcgtggcaaggccagcggggccctgcacggcacgaagcccatcgacctcgtggtgggactcatccacgagatccgcgaccgtttccccgggctggacccggccgcgatcgacgacatcgtgctcggtgtggtgggtcctgtcggcgaccagggctccgacatcgcccggatcgccgcgatcgcggccgggctgcccgacacggtggccggcgtccaggagaaccgcttctgcgcgtccggcctggaggcggtcaacctggccgccgtcaaggtccgttcgggctgggaggacctggtgctcgcgggcggcgtcgagtcgatgtcccgggtgccgatggcttcggacggcggcgcctggttcgccgacccgatgaccaacatggccaccaacttcgtaccgcagggcatcggcgccgatctcatcgccacgatcgagggcttcacccgccgggacgtcgacgagtacgcggcgctctcccaggagcgggccgcggccgcctggaaggacgggcgcttcgagaagtccgtcgtgcccgtgaaggaccgcagcggtctcgtcgttctcgaccacgacgagcacctgcggcccggcaccaccgccgactcgctcgccaagctgaagccgtcgttcgccgacatcggcgacctgggcggcttcgacgcggtcgccctccagaagtaccactgggtcgagcagatcgaccacgtccaccacgcgggcaactcgtccggcatcgtggacggcgcctcgctggtcgccatcggctcgaaggaggtcggcgagcgctacggtctgcggccccgcgcccgcatcgtctccgccgccgtctccggctccgagcccaccatcatgctcacgggccccgcgcccgccacccgcaaggcgctcgccaaggcggggctgagcatcgacgacatcgacctggtcgagatcaacgaggccttcgcggccgtagtcctgcgcttcgcgcgggacatgggcctgtccctggacaaggtcaacgtcaacggcggcgccatcgccctcgggcacccgctcggagccaccggcgcgatgatcctcggcaccctcgtcgacgaactggagcgccaggacaagcgctacggcctggccacgctgtgcgtcggcggcggcatgggcatcgcgacgatcgtcgagcgtgtc

SEQ ID NO: 1671 - DNA, 1191 bp, Streptomyces avermitilis
  CDS (1)..(1191)
atgtcacatcagtggtgtcacagtgctgggggcttgatggcagtggcaaggacgccggggcacggcccgctcgcaggcgtgcgcgtggtcgagctggcgggcatcgggcccggcccgttcgccgcgatgctcctcgccgacctcggcgccgatgtcgtccgggtggaccgtccgggcggcgcggggctcgcgatcgcccccgagtacgacgtgaccaaccgcaacaagcggtccgtgatcgtcgacctcaaggccgagcacggaccggccggcgtcctcgacctggccgaacgcgccgacatcctgatcgagggctaccgccccggcgtcgcggaacgtctgggcgtcggcccggaggcctgccacgcccgcaacccgaagctcgtctacggacggatgaccggctggggccaggagggcccgctcgcccagcgggccgggcacgacatcgcgtacatcgccctgaccggcactctcggcatgatcggcaaccccgacgagccgcccgcgatcccggccaacctcgtcggcgactacgcgggcggctcgctctacctcgtcgtcggagtgctcgccgccctccaccacgcgcgcgcgaccggtaccggccaggtcgtggacgccgccatcgtcgacggcgcggcgcatctggcggcgatgatccacggcatgctggcggcgggcggctggcaggaccagcgcggcgccaacctcctcgacggcggctgcccgttctacggcacgtacgagacggccgacgggcagtacatggcggtgggcgccctggagcagcagttctacgccgagttcgtggagctgctcggcatcggggacgaggcgccgagccgcaaggacgtgtcccgctggagcgagctgcgcgagacggtcgcggcccgcttcaagacccgtacgagggacgagtggacggcggtcttcgaaggctccgacgcctgtgtggcacccgtcctgtcgctccgtgaggcaccggcacacccccacctcgccgcccgcggcaccttcaccgaccacggcggcatcacccagcccgcccccgcaccacgcttctcggcgacccgcacggccgtccggagcgggcccgcacaaccgggcgcccacgtcgaggacgtggcccgtgagtggggcgtaccacggctgctcgagggcctccgccccggaccgggggagggcgcc

SEQ ID NO: 1672 - DNA, 1173 bp, Streptomyces avermitilis
  CDS (1)..(1173)
atgagcaggctgaaaacggatcgcgcgtacgacatcgtgcttttcggagccacgggcttcgtcgggacgctcaccgcggagtacctcgccgcgcacgcgcccgaggggcttcgctgggcgatcgcggggcgcagcgcgcggcggctggagcaggtgcgggagcggctcgggggcgcctcggagatcggaatactccaggcggacgtcgccgaccccgggtccctgcgggacatcgcccgcaacgcgcgcgtggtggccacgacggtcggtccctacctgaactacggcgaggagctggtggccgcctgcgccgacgccggcacggactacgcggacctgaccggtgagcccgagttcgtggacctcacgtacgttcggcacgacgcacgcgcgcgggagacgggggcacggctggtgcacgcctgcgggttcgactcgatcccgcacgacctgggggcgtatttcaccgtgcggcagctgcccgaaggggtgccgctgacggtcgacggctatgtgcgctcgcaggccatgttctcgggcggaacgttcgcctccgcgctcaaccagttcgcgcggggcccgcagatgctcgccgcggcccgggaccgcaggcggcacgaaccccgagtggtgggccgccgggtgcaggcgccgttgggtgcgccgcggttcgccaaggaggtcggggcgtgggcgctgccgctgcccacgatcgacagccagatcgtgcagcgctcggcgcgggtgctggagcggtacgggcccgacttccgttaccggcactacgcggcggtcgagcagctgccgttcgccgcgggcggggtcgccgccgtcagcgcgctcttcgcggccgcccagctgccgcccgcgcggcgctggctgtccggccggctgaagccgggggacgggccgagcgccgagaagcgcgcgaagagctggttctcggtccggttcgtcggcgagggcggcggacagcgcgtctacacggaggtcgcgggcggtgaccccggctacgacgagacggccaaaatgctcgcggagtcggccctgtccctcgcgctcgacgacctgccgcacacgtccggccaggtcacgacggcggtggcgatgggagacgccctcatcgaccgcctccgcgcggcgggcatcacgttccgggtggcggccaaacgg

SEQ ID NO: 1673 - DNA, 687 bp, Streptomyces avermitilis
  CDS (1)..(687)
atgacgaccgtacgcatccccgcgggctggcccgccaccgaagaagaagcccgtgccgtgcaggacgagttgcgcggacgagtgatcctcgacgagccgggcccaccgcccggaaccggtcgtgtgacgggcgtcgacgtcgcctacgacgacgaacgcgacgtggtcgtggcggcggcggtcgtgctggacgcggcgacgctggacgtggtcgccgaggccacggccgtgggcgaggtctccttcccgtatgtccccggcctcctggccttccgggagatccccacggtcctggccgccctcgacgccctgccctgtccccccggcctgatcgtctgtgacggctacggggtggcccacccccgtcgcttcggcctcgccagccacctcggcgtcctcaccggcctccccacgatcggcgtcgcgaagaacccgttcaccttctcgtacgaggatcccggcgccccacgaggcagcgccgcgcccctgctggcgggcgccgacgaggtcggccgggctctgcgcacccagtccggcgtcaaacccgtgttcgtgtccgtgggacaccgggtggacctcgaccacgcctgcgcccacaccctcgcgctgaccccgaaataccgcatcccggagacgacccgacgggccgactccctgtgccgacgggccctcaaggaggcgactgcc

SEQ ID NO: 1674 - DNA, 324 bp, Streptomyces avermitilis
  CDS (1)..(324)
atgccacgcggttcgagccccaagagggaacgtcagtacgagcacatcaagcagagcgcgcaggaccggggcgagagccaggggcgcgccgaggagatcgccgcgcgcaccgtgaacaaggagcgggcccggtccggtgagtcgaagacggcgagcaagacgtccacgaacgacatgtcgtccggcaagcgcggcggtcagcgctcgcacacgggctcggcggggcccacgtacgaccagctgtacgaggaggccaagcggcgcaacatccacggccgttcggacatgaacaagtcgcagctgaagcaggcactgggcaacaag

SEQ ID NO: 1675 - DNA, 1050 bp, Streptomyces avermitilis
  CDS (1)..(1050)
gtggcggccctggccgcagcgctgacgactcccgccggggcggctcccgccggggcggcacccttgtcggccgccggcaggcagacgccgcactggcagctcaaggacagcggcacggacgtccgcttccgcggtctttcggccgtcagccggcacgccgcctgggtggccggatccaagggcaccgtgctgcgcacgaccgacggcggggcgcactggcgcaacgtctcgccgccgggcgccgccgatctggagttccgtgacatcgaggcgttcgacgcgcggcgcgccgtggtgctggccatcggcgagggcgaggcgtcccgggtgctgcgcacggacgacggcggcgcgacctggaccgagtccttccgcaacaccgacgcgaaggccttctacgactgcctcgccttcttcgaccggcgccacggcctggcgatgagcgacccggtcgacggcgcgttccgcatcctgtcgaccagcgacgggggccgctcctggaaggtgctgcccggcgccgggatgcccgcggcccaggacggcgaggccggcttcgcggccggcggacagtgtctggtcacctcgggaccgcgcgacgcgtggctggccaccggcggcggcgcccacgcgcgcgtgctgcactccgccgaccgcggactgacgtggacggcggccgacacgccgatcccggcgggcgatccggcgcgcggtgtcttcgcgctcgccttccgcgaccgcacgcacggcatcgcggtcggcggcgactaccgggccgaccaggcgtccccgcgggcggcggcggtcagcggcgacgccggccgcacctggacgacggccgcgcagcctccgcccgcctaccgctccggcgtcacctggctcccgcacaccggctccgccgccctcgccgtcggccccaccggaacggacctgaccacggacggcggccgcacgtggaagaccctcgacacgggctcgtacgacaccgtggactgcaccccggaccgggggtgctgggcctccggcgagaagggacgggtggcccgtctggag

SEQ ID NO: 1676 - DNA, 414 bp, Streptomyces avermitilis
  CDS (1)..(414)
ttgtccaccgtcatcgagcagcccgtagaggcccgtctcgtcgccgccgcgccgcggatgccgagcattcccgccacgctccactacgaccggagcgacccgttcgcgatccgcatgaccttccccgccccggcgacgctggagggcgtggaggtctgctggaccttcgcgcgcgagctgctcgcgtccggcatggaggagcctgtgggccacggtgacgtccgggtgcggccgtacggctacgaccgcaccgtcctggagttccacgccccggaaggcaccgccgtggtccacgtccgctcgggcgagatccggcgcttcctggagcgcacgacggagctggtgccggtcggcctggagcatctgcagatcgatctggaccacgatctggcggaactgatgcgcgacgcgtgc

SEQ ID NO: 1677 - DNA, 753 bp, Streptomyces avermitilis
  CDS (1)..(753)
gtgtacacgctaggagcgggtatgcgggctgtcaacgcaattaacgtgggccctgcccagtaccgaggaggcaccgtgcccgacggctcgctctcactgccggcccggctctatctgctgtcctgggacacgacgaaactcaaggtcagcggcgagactcacctccatcacctggtccgcgccggtgccctcacggagctggcgcagcgcggtctgctcaccgatgtggacggcatcgccacgccggccgacccggatggccgtaccggtgatcccgttctcgacgggctgatggaactcgtcgaggagtcccggccgcgcaagtggaaggcctgggtgaccctgcgggcccgcgtcacgctggacgccgtacgcgcccagctcgccgccgacggatatctgcgcgccgagaagagacgcgtgttcgggctcttcccctccgtggagtacgagctggcgcgggtgcccgcggtgcaggcgctgcgcgccgaggcccggcaggtgctggagggcccgctgcccgtagccgcggtccccgaccgggacgcggccctggtggccctggccgccgcggccgaactgcgcaccctggtgccgtccaaggaccgcaagcggtacaaggaccgcgtcgaggagctgacggaacgcggcggggcggcggcacccgcactgcggaaggtcatccaggaggtgcggacggcaatgatcgtcgcgatcacggcggcgtcgacgtcgggcgccgcgacgagcagc

SEQ ID NO: 1678 - DNA, 1617 bp, Streptomyces avermitilis
  CDS (1)..(1617)
atgaccgcatccatcacctgtacgtccctgtccttcgcctggcccgacggcaccgtcgtcttcgacgacctgcaagccacgttcggccccggcaggaccgggctcgtcggcgtcaacggatcaggcaagtccaccctgttgaaactgatcgccggacagctctccccggccgacggcaccgtccgtgtcgcgggcgaggccggctacctcccccagaacgtcgccctcgacaccgccctccgggtcgacgaggcgctcggcatcgccgcgacgcgcgccgcgctgcacgccatcgaggcgggtgacgtggccgaggaacacttcacagcggtcggtgacgactgggacgtggaggagcgcgccatcgcgacactcggcgaactcgggctcggccacatcgagttggaccgcaccatcggcgaggtgtcgggcggtgagtccgtcctgctgcggctggccgcgctgctgctgcgccgcccggacgtgctcctgctcgacgagccgaccaacaacctcgacctgtacgcgcgccgccggctgtacgcggccgtggaggcctggtccggggtcatggtcgtggtcagccacgaccgcgaactcctggaactggtcgaccagatcgcggatctgcgctccggggaggtcacctggttcggcggcaacttctccgcgtacgaggaggcgctcgccaccgagcaggaggcggcggagcgcatggtgcgcgtcgccgagtccgacctgaagaagcagaagcgtgaactgatcgacgcgcaggtcaagttggcccgccgcaagaggtacggccagaagatgtacgagcagaagcgcgagccgaagatcgtcatgggggcgcgcaagcgggcggcccaggagtccgcgggcaagcaccggatcctgcacgaggagcgactcaccgaggcccgggagcgcctggacgaggcggccgaggcggtgcgggacgacgacgagatccgcgtcgacctgccgtacacggccgtaccgccgggccgctccgtgctcactctccaggacctggagttgacgtacggcgcccgggtggacggcggcctcgaactgcgcggtcccgaacggatcgcgctgatcgggcgcaatggcgcgggcaagacgacgttgctgcgcacgatcgcgggcgagttgcaggcggtgtcgggtgaggcgcgggcccatgtgccgctgcggttcctgccgcaacgcctcgacgttctggaggacgagctgacggtcgccgagaacgtggcccggttcgcgccggacgccacgaacaaccgcgtccgggcgcggctggcccgcttcctgttccggggcgcgcgagccgaccaacgggccgcgaccctgtcgggcggcgaacgattccgggccaccctcgccgcgctgatgctcgccgagcccgccccgcagctcctgctgctggacgagccgacgaacaacctcgacatggcgagcgtccggcagctcaccacggctctggagtcgtacgagggcgcgctgatcgtggccagccatgacgtgccgttcctcgagtcgatcgggatcacacgctggctgctgctggaggggaagctgaaggacacgacgccggaggaggtggggatgggc

SEQ ID NO: 1679 - DNA, 774 bp, Streptomyces avermitilis
  CDS (1)..(774)
gtgcccagcaagaaggccctcatccgccgccccagcccccgcctcgccgaagggctggtcacgcacatcgagcgcgcgcaggtcgatgtcggcctcgcggtcgagcagtgggaggcgtatgcggaggcgctgcgcacgcacggctgggagaccgtcgaggtggatccggccgacgactgcccggactcggtgttcgtcgaggacgcggtggtcatgtaccgcaatgtcgccctgatcacccgccccggcgccgactcccggcgcggcgagaccgccggcgtcgaggaggccgtggcccgcctgggctgctcggtgaactggatctgggaacccggcaccctcgacggcggcgacgtcctgaagatcggcgacacgatctacgtaggccggggcgggcgcaccaacgcggccggggtccagcagctgcgcgcggtcttcgagccgctcggagcccaggtcgtcgccgtgcccgtcagcaaggtgctgcacctgaagtcctcggtcaccgcgctgccggacggcacggtcatcggtcacatcccgctcgtggacaggcccgcgctgttcactcgcttcctctcggtgccggaggagtccggctcccatgtggtcctgctcggcggatcgaagctgctgatggcggacagcgccccgaagacggcggacctgctcgcggacctcggccacgagcccgtcctggttaacatcagcgagtacgagaaactcgaaggctgtgtgacatgtctctcggtccggctgagggagctgtacgcc

SEQ ID NO: 1680 - DNA, 972 bp, Streptomyces avermitilis
  CDS (1)..(972)
gtgacgatcacctctccccaccttggcagcacgtccgactggaccgacgctcggctgctgtacgcgctggaggaagtggtcgagaacgagttgaaccgccacctgaaggtcgccaaggactggatgccgcacgactacgtgccctggagtgacgcccgcaacttccccggcctcttcgaggacggcgaggcgtgggacaaggagcagtccaaggtcaccgagatcggccgcatcgcactggtggtcaaccttctcaccgaggacaacctccccagctaccaccacgagatcgcctccctcttcggccgcgacggcgcctggggcacctgggtgcaccgctggaccgcggaggagggacgccacggcatcgtgatgcgcgactacctgctcgcctcgcgcgccgtggacccggacaagctggaagccttccgcatgtcgcacatgagcgagggcttcgagtcggacaaccggcactcgatgctgcactccgtcgcgtacgtcgccttccaggagctggcgacccgcgtgtcccaccgcaacaccggtcaccagtcgggcgacccggtctgcgaccgcatgctggcgcgcatcgcgaccgacgagaacctgcacatggtcttctaccgcaacctgctgaaggcggcgttcgagctcgcgcccgacctgaccatgcaggccgtgcgggacgtcgtcgtcaacttccgcatgcccggccacggcatccccggcttcgagcgcgcggccgcgcagatggcgatcggcgaggtctacaacatgcgcatccaccacgacgacgtgctccagccggtgctgcgccacctgaaggtcctggagatcgacggcctcagccccgagggcctgcacgcccaggaagagctcggcctcttcatgggcgggctggacacggaggcccggaagttcgacgagaagctggcggcccgcaaggcgcggatggcggcgcgagccggcgcg

SEQ ID NO: 1681 - DNA, 768 bp, Streptomyces avermitilis
  CDS (1)..(768)
atgcgtgaactcgccctccatgtgcgggtcatgagcccaccgcgccccgtgctcgaggcgcgcggtgcgtatgagcggggcatcgcggtggtcgcggcgtccgtcgcccggggcacccagtggatcgcggagcgcatcgcggacgccgagcccttcgtgcgcggccacgccctgcgcgtcgccgacagcctccaagtccccgacaccgtctacgagtcggcgctcggcgacgcctgcgaggccgtatgccgtgatctgctgcgggggatagtcgtgggccgccgcacggcacttgccgaccggctggcggacgggctgcggcgcgactggggcgacgccgaggcggcgcggctgctgccgggctgcgcgccggagaccgttgcccggctcctgcccggcctcttccacgccgtcaccggctggaagaccctcgccaacaggcacccgcgcacggtgctcgacgcggccgaacaagcgctggccacgctccccgaggcgctgcgcgccccctggtggagccggtacgcgcccgccgtggccgccaccgtcacggccgaaccgttgcgcgcacgcgccctgctcgaacgcctcggccccgaaacgatgccaccccgactccgcaagcacctgggcgacttcgcggtggccgcccccgggcggctcctgcgtctcctgctcactcccgcctggcacgccgtccgccgacaccgcgggctgggtcccggtgtcctgcgcacgctggcccgcaagcagctgacggcgtacgaa

SEQ ID NO: 1682 - DNA, 243 bp, Streptomyces avermitilis
  CDS (1)..(243)
atgcacaccgaaacgatcacgtcgcccgacatcgcctggcaggaggaggcgctgtgcgcgcagacgggggctgatttcttctttcccgaacccgggagctccgtacgggaggcgaagcgcatctgcggcctgtgcgagatccgctccgcctgcctcgaatacgcgctcaccaacgacgagcggttcggggtctggggcgggctctccgagaaggaacggctgagcctcaggcgcgacccgcgc

SEQ ID NO: 1683 - DNA, 789 bp, Streptomyces avermitilis
  CDS (1)..(789)
atgctcaccacccgttatgtcaccggtgctccgaactggctcgatgtcggcacccccgacatcgacggcgccacgtccttctacggcggcctcttcggctggcagttccagtcggcagggcccgacgccggtggatacggcttcttccagctctccggcaagaccgccgcgggcggtatgcagacgactccggaacagggcccgccgtcctggaccgtgtacttccagagccccgacgccgaggccaccgcgaaggcggccgagcaggccggcggacatgtgttcctgccgcccatggacgtgatgggccagggccacatggcgatcctcgccgaccaggcgggcgtgcccttcggcgtctggcagccgggccggaacaaggggctggacgtggccggcgcccccggatcgctgtgctggatcgagctctacacaccggacatcgcgcgggccgccgcgttctacgacaaggtgttcggctgggagacctcggcggtgccgttccccggcggcacatacacctgcatcaacccggcgggtacggagccggaggccatgttcggcggtgcggtcccgctccaggacgacccgacggaggccgagtcgggtgcgtactggctgccgtacttcgaggtcgaggacacggacgcgacggtcgccgaggcgcaggagctgggcggcaaggtccggatgcccgcgacggacctggaaggcgtgggccggttggccaagctcgccgatccgtacggcgcgaggttcgcggtgatcaagagcacgccgccgcagggc

SEQ ID NO: 1684 - DNA, 1044 bp, Streptomyces avermitilis
  CDS (1)..(1044)
gtgaccgagaccgcgtcgcgtcccacgctggaggccgtggccgcccgggccggggtctcgcgggccaccgtctcccgtgtcgtcaacggcggcgacggtgtgcgggagcccctcgtcgcgcgggtgcggcgggccgtcgaagaactcggctatgtgccgaaccaggccgcccgcagcctggtgaccaagcggcacgacgcggtcgccgtcgtgatcgccgaaccggagacgagggtcttcgcggaccccttcttcgccctccaactacgcggcatcagcaaggagttgaccgcccatgactgtcagctcgtgctgctgctcacggaagggcgggacgaccacgcacgcgtgggccgctatctcgccggcggccatgtcgacggtgcgctcgtcttctcgctgcacctcgacgacccgctgccgggcctgatccgcggtgccggggtgcccaccgtgttcggcgggcggcccggctggggcgacggcacgcgcgacgccgcgcccgcggtgtacgtcgactgcgacaaccgcggcggcgcccgggcggccgtacgccatctcgtcgggctcggccgtacccgtgtcgcccatctgaccgggccgctcgaccagacctcggcggtggaccggctcgacggattccgggacgtcatggtcgacgccgacccccggctggtcgtgcagggcgacttcacacctgctgggggcgagcgggcgatgcgcgagctgctggagcgctgcccggacgtggacgccgtgttcgcggccaacgatctgtccgcctccggcgccctgcgggtgctgcgcgagcaggggcggcgggtgcccgaggacgtcgcgctcatcggcttcgacgacatgctgccggtcgccgaacagaccgatccgccgctcaccacggtccgtcaggacatagaggagatgggccggctgatggcccgcctgctgctgagcggcctggaccgccgtggcgaggcggcgggcccggccggcaccccggccggcgtggtcctgccgacgacactggtcaggcgcgcctccgcc

SEQ ID NO: 1685 - DNA, 1014 bp, Streptomyces avermitilis
  CDS (1)..(1014)
atgggcgatgcggtggagctggaggcggcgggcaggacggtacggctgtccagcccggacaagatcttctttccggagcgcggcttcacgaagctcgacgtagcccagtactacctcgccgtcggcgacgggatcctgcgcgccctgcgcaaccgccccacgaccctggagcgctacccggacggtatgagcggcgagtccttcttccagaaacgggcgcccaagaacatgcccgactggatccccaccgcccacatcaccttccccagcggccgcagcgccgacgagatgtgccccaccgaggtggccgccgtggtgtgggccgcgcagttcggcacgctcaccttccacccgtggccggtgcgtcgcgacgacgtcgaccaccccgacgaactccgcctcgacctcgacccgcagcccggcacggactacgccgacgccgtacgcgccgcccacgaactgcgcgccgtcctgcacgagtacggcgatctgcgcggctggcccaagacatccgggggccgcgggctgcatgtcttcgtcccgatcgagcgacgctggaccttcacccaggtgcgccgtgccgcgatcgccgccggacgcgaactggaacggcgcatgcccgaccaggtcaccaccgcctggtggaaggaggaacgcggcgagaagatattcgtcgactacaaccagaccgcccgcgaccgcaccatcgcctccgcctactccgtacgcccccgcccgcacgctcccgtctccgcgcccctgcgctgggacgaggtcggggacgcgcggccccgcgacttcgacatcgcgaccatgccccggcggtacgccgaactgggcgacgtccacgcggacatggacgaccacgccttctccctggaggccctgctggaactcgccgaccgcgacgagcacgaccacggcctgggcgacctcccgtacccgcccgaatatccgaagatgccgggcgagccgaaacgcgtccagccgagccgggcgaagcacggggacggc

SEQ ID NO: 1686 - DNA, 1068 bp, Streptomyces avermitilis
  CDS (1)..(1068)
atggatctgccggtgatgccgcccgtgaagccgatgctcgccaagtccgtggcgaagatcccgccggacatgcagtacgaggcgaagtgggacgggttccgggcgatcgtgttccgcgacggcaccgaggtggagctcggcagtcggaccggaaagccactgaccaggtactttcccgagctggtcgaggcgttgcgggaccggttgcccgagcgctgtgtgatcgacggtgagatcgtgatcgcccgggacgggcggctcgacttcgacgcgctcaccgagcgcattcatccggccgagtcgcgggtgcggatgctggccgagaagacgccggcctcgttcgtggcgttcgatctgctggcgctggccgacgactcactgctcgacactccgctgaccgaacggcgcgccctgctggagtcggcgctgtcgggggtgacggcccccgtccatgtcgccccggcgaccacggaccgcgaggtggccgagcagtggttcgagcagtacgagggcgcgggcctggacggcgtgatcgccaagccgctcacattgcgctatcggcaggacgagcgcgccatgttcaaggtcaagcacgagcgtacggcggacgtggtggtcgcgggctaccgcctgcacaagagcggcccggtcgtcggctcgctgctgctcgggctgtacgacgaccggggcgccctgcaacacgtcggggtgtccgccgcgttccccatgaagcgtcgcgccgagctggtggaggagctggagccgctgcgcatggaagacgccgcggggcacccttgggcggcctggtcgaacgaggcggcgcacgagacggcgcggctgcccggcgcacccagtcgctggtcggggaagaaggacctctcctgggtgccgctgcggcccgagcgggtggcggaggtggcgtacgaccacatggagaacggcgcacgcttccggcacacggcccgcttccgccgctggcgccccgaccgcacccccgagagctgcacctacgcgcaactggaggagccggtgagctacgacctgacggagatcctcggctcgcggggc

SEQ ID NO: 1687 - DNA, 975 bp, Streptomyces avermitilis
  CDS (1)..(975)
atggcgcggatgcggcgcggcgtgatgacggcggcactgctggccgccacggtgacgggctccctggtgacgggctgcaccacgcacggccgcgcggtcgacgacggacggaaccggcaacagggccacccggagagccaggtcagcggcagcccgagcgcgacggcgggtccggtactggcggtgaagatcgacaacgctggtgcggcccgcccgcagacgggcctggacacggcggacgtcgtgtacgcggagcaggtcgagggcggtctgagccggctgatggcggtgttcgcgacgaacctgccgaagaccgtcgggccggtgcgcagcgcacgcgagtcggacctggagctgctgggccagttccacgatccgacactcgcgttctcgggggcccagcacaagctgctgccactgatcgacaaggcgcccctgcgggccgtgtcgccggagcaggactcgaacgcctacttccgcggcggcgacaaggcggcgccgcacaatctgttcctgcggccgaagcggctgctgaactccgcaccgggcgccgacgcgctcacgacggggttccacttcggcgcggctcccccgggtggcaccccggagaaggcccgcacggtccgcttccccgcggcccgcttcaccttcacctggtccgagcagcggcagcgctggctggtgtcgatggacgggacacaggcggtgacgacggacggcgcgacggtggcgccggcgaccgtggtcgtgcagcacgtgaaggtgcggcagtccaggttccacgacttcctcggcagcaacaccccctacacggagaccgtcggcacgggcaaggccgaagtcctgcgcgacgggcgggtcttcgacgtggactggcagcggaagtcggcgacggacggcacggagttcacgaccgcggacggctcgccgatgaacttcgccaagggacaggtgtgggtggtgttcgcgaaggcg

SEQ ID NO: 1688 - DNA, 465 bp, Streptomyces avermitilis
  CDS (1)..(465)
atggccgcggtggacctctccacccaccccgggcacctggcccggcggctccagcaggcgcactacctgctgtggaacacgatggtctccgaggagatcacctcaccgcagttcgcggtcctgaacgcgctcgtggccgagcccggcctcgaccagcgcacggtcggagagcgggtcggcctcgaccggtccacgatcgccgaggtcatcagccggctcagtcgccgcgggctgctcgacaaggtccgcgacgcgcacgacggccgccgcttcctgctgcgcctcacggaggagggcacccgcacccaccgcaagctgacggtgcgcacggcccggatgaaccaggtcttcctggcccccctctcggccgaggagcagagccagttcttcgacctcatccaacgggtctcggacgccgccgaggggctccgcaatcccgcggaacccctcacggcctcgaagacc

SEQ ID NO: 1689 - DNA, 780 bp, Streptomyces avermitilis
  CDS (1)..(780)
atggacaaggtggtcgccacagccctggaggcggtggccgatgtgccggacggcgcgacgctcgcggtcggcggattcggcctgagtggtgtgccgaacgtgctgatccaggctctttacgagcgcggagtggcgggacttggcgtggtctccaacaactgcggcgcgatggagtcggggctcgcggtactgctggcggccggacggatcgcccgcgtcaccggttcgtacatcggggcgaacaaggagttcgcccgccagtatctggccggtgagctggaggtggagatgatcccgcagggcacgctggccgagcggctgcgcgcgggcggggccgggatccccgccttctataccccggccggggtcggcacacaggtcgcggacggcgggctgccgtggcgctacgacggctccggcggggtggcgttggcgtcgccgccgaaggaggtacgggagttcgacggcaccgagtacgtcctggagcacggcatccgtaccgacttcgccctggtccgggcggcgaagggcgaccggcacggaaacctggtcttcaacaagtccgcgcggaacttcaacccgctggccgcgatggcgggccgggtgacgatcgccgaggtggaggagctggtggaaccgggcgggctcgacccggacgcggtgcacgtgccgggcatcttcgtacagcgcgtcatcgcgctctctccggaacagacgaacgccaagatgatcgagaagcggaccgtttcggcgtccgcggcaaccgggacggtgagcggc

SEQ ID NO: 1690 - DNA, 645 bp, Streptomyces avermitilis
  CDS (1)..(645)
atggcctggacacgcgaggagatggccgcccgcgccgcacgcgagctcgccgacggccagtacgtgaacctcggcatcggcctgccgacgctgatccccaaccacctccccgccggtgtggaggtgatcctggagtcggagaacgggatcctgggcaccggcccgtatccggccgaggagcaggtcgacccggatctcatcaacgccggcaaggagaccgtcacggtcctgccgggagcctccttcttcgactcggcgctgtccttcgggatgatccgcggcgggcacatcgacgtcgccgtcctcggcgcgatgcaggtctccgcgggcggtgacctggcgaactgggcgatccccggcaagatgatcaccgggatcggcggcgcgatggacctggtgcacggcgcccgcacggtcatcgtcgtgatgacccacaccgccaaggacggccaggcgaagatcctcgaggagtgcgcgctgccgctgaccggcagggcctgcgtcaaccggatcatcaccgacctcggcgttctcgacgtcaccgccgacggactgctcctggtggagaccgcgcccggtgtcaccgccgcggagatcgtcgataagaccgccgcgaaggttcgtgtcccggaggagatccgctcg

SEQ ID NO: 1691 - DNA, 414 bp, Streptomyces avermitilis
  CDS (1)..(414)
gtgaaggacgtctacgtcgtcgacgcggtccgcaccccgatcggcaggtacaacggctcgctcgcctccgtccgcccggacgacctggccgcccatgccgtgcgtgaactcctcacccgtacaccgggcctggacccgtcccggatcgaggacgtgtacttcggcaacgccaacggcgccggcgaggagaaccgcaacgtcggccggatggccgccctcctcgcgggcctgcccgcctccgtgcccggggtgaccgtcaaccggctgtgcgcctccgggctcgaagccgtgatccaggccgcgcgggccatcgcgctcaccgtcgcccaccaactcgcccgcaagggctcgggagtcggtgtcgccaccctctgcatcggcgtgggccagggcctcgccctcgtcctcgagcga

SEQ ID NO: 1692 - DNA, 768 bp, Streptomyces avermitilis
  CDS (1)..(768)
atggctctcactcagtcgcacatcgacatagaggtcgacgacctccagaacgcgtacgacaaggcggtcgccgagggcggcccggtccgccaccacccgccgcgcgactacgccccgtaccgcagttccgtgctgcgtcaccccaagcagccgctggtcgccgtgcacggcggggacccggagacggtggagctggcgggtccggtcttcggcgtcaccgacatcaccgagatcgacaacgacctgacccgccagcaccggggcgagccgatcggcgaacgcatgaccgtctcgggccggctcctcgaccgcgacggccgacccgtgcggggccagctggtcgaggtctggcaggccaacgcggccggccgctacgcccatctgcgcgagcagcacccggcgccgctcgaccccaacttcaccggcgtggggcggaccctgacggatgatcagggccggtacacgttcaccaccatcaagccgggcccgtacccgtggggcaaccacaccaacgcgtggcggcccgcgcacatccacttctcggtcttcggcacggcgttcacccagcggctcgtgacacagatgtacttcccgagcgacccgctgttcgcatacgacccgatcctgcggtccgtgacggacgcggcggcccgaaaccgtctgatcgccacctaccagcacgacctctcggcgcccgggttctccctcggctacgcatgggacatcgtcctcgacggtccctccgccacctggatcgaggaaggccgt

SEQ ID NO: 1693 - DNA, 618 bp, Streptomyces avermitilis
  CDS (1)..(618)
atgggacatcgtcctcgacggtccctccgccacctggatcgaggaaggccgttgagcatgaccgagcggttgctccccaccccgtcccacaccatcggccccttctacgggcacgcgctccccttccccggtggcccggacgtcgcgccccagggccaccccgacacgatcaccctgcacggatacgtgttcgacggtgcgggtgcgccgatccccgacgccctcctggacttctggcaggcggcgcccgacggctccctgacgggtgcccccggctcgatgcgccgcgacccgtcgacgggcggcttcctgggccgcaacggcaccgacttcacgggcttcgggcgggtcgccacggacgccgacggacactacgcgctgcacaccctgccgccgggcaatgccggactgccgtacatcagcgtgtgcgtgttcgcgcgcggtctggtgcaccacctgttcacccgcgcctacctcgccgacggcgccgacccgctgctcgactcgctgcccgccgagcggcgcgccacgctcatcgcggccgagggcgcgaaccgcacgtaccgtttcgacatccgccttcagggcgaaggcgaaacggtcttcctggagttccag

SEQ ID NO: 1694 - DNA, 1335 bp, Streptomyces avermitilis
  CDS (1)..(1335)
gtgacagaacccgtcgattccgtcgattccgacgccggcctgctcgcccccgggtggacgggatcccccgcgtcggccgccaccgggaacggtgcgtttctccaggcgctgctcgacgcggaggcggcgctgacgcgggcccaggcggggctcggcctggccccggccgaggccgcgtcggcggtgtcggtggccgccgacgccgtgggcttcgacgtccggtcgatcgcgctgcgcgcccgcgccggcggcaatccggtgatcccgatggtagcggatctgacggcggcggtcggcgcggagcacgggccgtacgtccaccggggcgcgaccagccaggacatcatggacacggcgatgatgctggtcgcccgcgccgcactggacctgatcctggcggacctggagcgtacggcgcgggcgctgggccgactggccgccgcccaccgggacaccgtgatgccggggcggaccctgacacagcatgctgtaccgacgaccttcgggctgaaggcggcgggatggcgctcgctggtgctggacgcccgggaccggctcacgaccgtgcggctgccggcccaactgggcggggccgcaggaacgttggcggccttcaacgcgttcgggaccgaggacacccaggccctcgtgaccgcgtacgcccgtgaactcgggctcgcggaaccggcgttgccgtggcacaccctgcgtacgccgatcgccgatctggccggagccctggccttcacggccggcgccctcggcaagccggcggcggacgtcctcaccctcgcccgcacggagatcgccgaggtcaccgagggtgccgggggcgggtcgtccgccatgccgcacaaggcgaatcccgtcgcggctaccctgatcgccgcctccgcccggcgcgcgccagggctcgccgccacgctctacgcgtcgatggccgccgaggacgagcggcccgccggggcctggcatgccgagtgggagccgctgcgggagctgctccgactggtcggtggggccgcgggccatgccgccgaactggcggagggcctttgggtgaacgcggacaccatgcgggagcacctcggtctcacccaggggctgatcgtctccgagcggctggccgccgagctcgctcccgtgctcgggcgggcccgcgccaaggagctggtgacccgggccgcgaagctcgccgtcgccgagaaccggcctctcgtggacgtgctcggtgaggagcaggagctgacggacctcgatctcgcggacctcaccgaccccacccgctacacgggctccgcgggagccctcaccgaccgtgcgctggagcgacgt

SEQ ID NO: 1695 - DNA, 1137 bp, Streptomyces avermitilis
  CDS (1)..(1137)
ttgaccaccaaaccgaacggcaggctgtcgcaccaccacgccgagggacccgtcaccgctcccccgctgctcctcggcccctcgctgggcacgtcgtacgcgctgtgggacaaggtcgcgcccgagctgtccgtcacgcaccgggtgatccgctgggacctgcccgggcacggcggctcgccggccggtctgatcggtccgggggcgaccgtcgccgacctcgccgagctggtgctggcgctcgccggctcactgggcatcgaccggttcgcgtacgccggtgtctcgctgggtggagcggtcgggctgcacctcgccgcgcaccacccggagcgggtgtcgtccctcgcggtcctctgctcgtcggcccacttcaacggcgcgcagccgtggcgggagcgggccgagctggtccgccgggagggtgtcgcgccggtcgcggcgacggccgactcccgctggttcacgcccggtttcaccgtgccggagctcgtccaggaccaccgggacgcggacccggacgcgtacgcggcctgctgtgacgcgctggccgcgttcgacctccgtgaccggctgtcgtcgatcaccgccccgacgctgctggtcgcgggccgtcaggaccccgcgacgccgcccgcgcatctgcgggagatcgcggacgcggtgcccggcgcctcgctcaccgagatcgcgggcgcctcgcatctcgcgcccgcggagcgcccggaggccgtgctcgccgcgttgcgcgggcacttcgacgggtatgcgtcgcgcgggatggaggtacgccgccaggtcctcggcgacgagcacgtggaccgcgcgcaggcacggcagacccccttcaccgcccgcttccaggacttcatctcgcgctatgcctggggcgagatctggaccgactccaccctcacgcgccgtgagcgcagcatgatcacgctgacggcgctggtggcgcacggccactacgacgaactggccctgcatgtgcgggcggcccggcggaacgggctcacaccggaggagatcggcgcggtgctgctccagacggcggtgtactgcggggttccggcggcgaactcggcgttcgcggtggcgcagcgggtgctggccgaggaggacgacacggcgggg

SEQ ID NO: 1696 - DNA, 2685 bp, Streptomyces avermitilis
  CDS (1)..(2685)
atgacggaggtacggcccggagcggtcgcctcggcttccctgtgggaacgcgacgcggagatcgccgcgcttgtggaggcggtcgacgccctgcgcgcggactccccgtcctcgggctcgggaagcctgctggtgttcagtggtgaggcgggcatcggcaagaccgcgctgctcggcgagacgcgccggatcgcggagagccgcggctgcacggtgtggtcggcacgcggcggcgagaccgtcacgtccgttcccttcaatgtcgtacggcagttgctgcaacccgcgctcgtcgcgctcatgcccgacgaggcgcgcgaatacctgggcgactggtacgacatcgcggggcccgcgctcgggatcaccgagccgggcgaccgccaggccgacccgcagggcgtgtgcgacggcctggtcgcggcggtgcgccgactggcccggcgcgagtggccgctggtcctgctgatcgacgacgcgcactgggccgaccaggagaccctgcactggctggccgcgttcgccgagcgcctccacgacctgtccgtcctcgtggtggtcgcccgccgccccggcgaggccaccgaggagagcacccgtcacctcgacgtgatcgccgccgcggccggcccggtcgccaccctcagcgcactcacccccgaggcgaccgcagggctcacccgggccacggtcggtgtgcacgccgacgccccgttctgccgcgaggtgtgggccgtcaccggcggcaacccgtacgagaccgtcgaactcctcgccaaggtgcaggacagcgagctggagccgagcgagtcctcggccgccgaactgcgcgccctcaaccgctcggcccgcggccgtggactcgtcgcccgcctcgaaggactcggcatcgacgccacgcggttcgcctgggccgccgcgatcctcggcaccgggatctccctcgacctcgcggcccagctcgccggcatgcagcgcgaggaggccctgcactgcgcggacctgctgggcgcggcccgcatcctcaccgaacccgccccggtcaacggccgacagccggacggcgacctggagttcgtgcacccgctgatcgccagcgccgtctacaactcgatcccggacgccctgcgcaccgccatgcacggcgtggccgcgcaggtcgtcaccgattccggactcggggccgcggccgcctcccgccacctcctcgaagtgcacccggacgacgacgcggagctggtcgaccagatgcgcgaggcggcccgcgaacacctcgcggtcggcgccccggacgccgcccgacgctgtctcgagcgcgccctgctggagcctccgctgtcggacgtccacgcccgcgtgctctacgagctgggctgcgccacgctcctcacctcgcccgccaccaccatcgactacctccaggcggcgctcgccatgccgggcctcgacggggacgtacgcgtggacgccgtcttccgcctgtcccaggcgctgctgcacaacaaccaggtcgaggaggccgtccgcacggtcgacgccgaggccgcccggctcgaaccgggaccggcccggatgcggctccaggcggtgcactacatgtgggagtgcgtccacgcgggtgaggacatctcgccgaccagcgtgcgcgccctcgccgagctcgccaagaagtgcaccggcaaggacaactccgaacgcgcgctgctcatcctgcgcggcttcgacgcgatgacgcgcggcgagaacgccgaggaggtcgccgagctctgcgaccgcgccctcgtcaacggccgcctcgcgcccggactcggctggaccgacaccgagtggggcatcgagctcctcatgatgctggccagcgcgtacgcctacgcggaccggctcgaccgcgcggaagccctctacaacgaggcgctgcgcgcctacgagggcgccggatggagcggcggccatctcgccctggcccattcctacgtcggcctcggccatcgcaggcgggggcgtctcacggaggccgagaagtatctgcgcgagtccctgcgcatcgccgagcgcgtcggccgcggactgcccctgtactggtccgcgacctgcggactcgtcgacacactgctcgcccgcggccatgtcgaggaggccgcggagatcgccgagcggtacggcttcggcccgccgtacccgaccaccatcgtgctgcccgacacccgctccgtgcgcggtcggctgctgctcgccctcggccgcaccgaggaaggcgtcaacgaactggaggccgcggagaaggcggccaccgcacggggtcaccacaacacggtgctggccccctgggcgctggacctcgccagggcactggccgtcgacgacccgcgccgggccgccgaactggcggcgaccgcccgccgccaggccgaacgcttcggcaccgacacggcgatcggcgaagcactccgctgcgccgcggccctggagaccggccagcgcgccgcttcgctgtacaagcaggcggtgacgtatctggaggcgtcaccgtgctcgtacgaacacgcggcggcccgggtggagtacggcatcgcgacgcgctcggcgaccgaactcacccgcggcctgacgctggcccgctcctgcggcgcggacggcctggtggcgcaggcccaggaggcactggacaacgggccggggctccgg

SEQ ID NO: 1697 - DNA, 1350 bp, Streptomyces avermitilis
  CDS (1)..(1350)
ttgaaactaactttccaccatcaccgtggcccgggaggaaccggcatgagcatccccgtgcaggactcggaccggcgcgccgcccggcccgagcagtcccgaagggccctgctcgcgggctcggtgggcaacctgatcgagtggtacgagttcggtgtctacggctatttcgccacgatcgtcgcggcccgcttcttcacccccgagggcggtggcgaggtggagggcctggtgaaggcgtatgcgtcgttcgcactcgcgttcttcttccggccggtcggggccgcgctgttcggacgcctcggcgaccggatcggccgccgcccggtcctcatcctggtgatcgccctgatgacggccgccacgaccctgatcggcgcactgcccacctacgccacggcaggcgccctggccccctggctgctcaccttcctccgcgtggtccaagggctttccgcgggcggggagttcgggggcgcggtgtcggtgatgacggagttcgcgccgccgggccggcgcggtctgtacgggtcgtggcagtcgttcaccgtggcgctgggccttctgtgcggggccggggtcgccgcgctgctcgcggtgttcctctccgaggcgcagctcagctcctggggctggcggctgccgttcctgctgacgctgcccctcggccttggcgcgctgtggctacggctgcggctggacgagacgccggccttcgcgagcgggcgcgcgcacccaaacgcgtacgaccggccgcccgcccgccggctggccggggccatcgccctgggcgcgagccgcgtcatgggatgggcggcggccggctacaccttcctcgtcgtgctcccctcgtatctccagagcaccctgcacgccaccttccagcaggccctggtcgccacggtcctcgccaacctcggcttcgcggccacgatcgtcccggcgggcctgctcagcgaccggatcggacggcgtcccgtgatgctgaccggggcagcgctcgtcaccgttctcgccctgccgctcctcaacctccttcaaaacaccggcacttcgaacgccgcgaagggcgtggcggtgtgcgcggcgggcgccgtcgtcggactgatggcgggtcccgggcccgcgatgctctccgagatgttcccgacgcgcgtgcgctgcaccggcctgggactcgcctacgccctgtccaatgccgtgttctcgggatgcgcgggcctcatcatcacggagacgatcgaacggaccgggaacgtggacatccccgcgtactacgcggcggcgacctgcgccgtgagcgcgctggcgctggccacggtccgcacgaaccagaagagtcaagggagt

SEQ ID NO: 1698 - DNA, 1152 bp, Streptomyces avermitilis
  CDS (1)..(1152)
gtgcgggtgatcggcctgatgtccggaacgtcgtacgacgcgatcgacgcggcggccgccgacctcggcctggccggggaccgtctcgtactgaagccactggggctgatgagcgaggcgtacgactccggcctcagggaggagctcgcggcggcgctgcccccggcggcgacgagcctggccggggtctgccgcctcgacacccggatcgggcaggccttcgcggcggcggccgtgcgggcggaccgtgaactgtgcggcgggcgagccgagttggtggcctcgcacgggcagaccgtctatcactgggccgaggcggggcgggtgtacggcacgctccagctcgggcagcccgcctggatcgccgaggcgaccggactgcccgtggtcgcggacttccgcccgcgcgacatcgccgccgggggtcagggcgcgccactggtcagcctggtcgacctgctgtggctgcgcggccgcgcggggacgtccgtggctctgaacctgggcggcatcgccaacctcacggcccccgacgggaccgcgttcgacaccgggccggcgtgcgcgctgatcgacgcggcggcgcacggtctgagcgggggccgcctcgaccacgacgtcgacggggcgctggcggcccgcggcaccgtgcacgagccgatgctgcgacggctgttggcggagccgtactacgcgctgcccgcgccgaagacgacgggcaaggagctgttccacctcggatatctgcgcgacgcgctcgccggattcgggacactgaccgccgaggacgtgatcgcgacgctcacccggctcaccgcgctgacggtcgcggacgccgtgcgcgcggtgcgggccacggaggtcgtcgcctccggcggcgggacccgcaatcccgtcctgatggagatgctcgcccgggaactgggcgcggtggccctgcgcacctccgacgaactcgggctgccctcggccgcgaaggaggcgtacgcgttcgccgtcctggggttcctgaccgtgcacggcctggcgggcaccgacccggtgagcaccggcgcacggcatcccagtgtgctcgggtcggtgacaccggggcgggacggactgcggctgccgccgcgcgcggactggtcacccgtacggctggtgctggag

SEQ ID NO: 1699 - DNA, 990 bp, Streptomyces avermitilis
  CDS (1)..(990)
atgacgcaggtgactcctcccgggtggtaccccgaccccgggcagacaagtgacggtcccgccctcgagcgctggtgggacggcaaggcatggacggaccagacccgccccgtgggttcggccgccgcgtggggtccgccggcccatcccccgaccgtcggcgcgtatccggacgggccgcccgcccccgcgcggcgtgggctgcggacgggcatagccgtcgccgccgcgatcgccgtcctggccggcatcggaggcggtgtgtacgcgctgaccaaggacgacggcggcagcggcaacgcctcgaactcacagggaccgggcggtcccggcggccagaacggtcagggcggcaccggtggcggcgagggcggctccggcggtccgggcggcctgcccggcgattcgggcggctccgacggccagagcccggcgccggaccagtccgagccgccgaaggtcaagggcggcggtgccgtctccgacgcgatcaacggcatcagccttcccgtgccggacgactggtacggccaggcgctgaccgcgggcgcgcaggtgtcgtcgaacgactcgtacaagtgccccggcgacacgtccaagaagtgcaccaccggcggggcctactcggcgcccgccgtggcgctgggcaccgacggcagcacgcccgaggaggtcgcgaaggcggacatcgcggcgaacgccaaggagtcctacggcggcaccacctacggcaagatcacctcgcacgaggagctggcctccaaggcggtgaccgtggccgggcagaagggctacctggtccgctggaaggcggtcaccagcaagggcgccgacggctatgtcgagtcgctcgtcttcccgtcgccggcgaacgcgaagcagttggtcgtggtccgcttcggcatcgacgtcgggaagaaggagtcggtgatcgacgagatcaccaagggcatcaaggtgtcctccggcggcggcagcggacagaacgtc

SEQ ID NO: 1700 - DNA, 612 bp, Streptomyces avermitilis
  CDS (1)..(612)
atgacgtcgcaggcagcggacggaccggagacggtcgtcgcctcgcgccgctccaagatcacgcctgagcgtgagcaggagttcttcgacgccgtgctcgaacagatccgtgaatgcggctacgacgcgctcaccatggagggcgtcgccgccagcacccggtgcagcaagtcgacgctctaccggcagtggaagacgaagccccagttcgtggccgccgccctgcgcgccaaccggcaggtgcggttctccgggatcgacaccggctcgctggccggagacctgcgcgaggcggcacgggcggcgggcacctggtccggccgtgacacccagctgctccaggcgctcggccatgccgtgatgcaggacgaggaactccagcaggcgctgcgcgacgcgctcgtcgagcccgagatcgaggcgctccaggagatgatccggcgcggagtcgagcgcggcgagatcgccgccgaccatccggcgctggagtacatccccgcacagcttctcggtgtcctgcgcgtccgccccgtcctggaggggcagtacgcggacgaggagtacctcgcacgctttgtggaggccgccgtgctcccggcactcggcctcacc

SEQ ID NO: 1701 - DNA, 1008 bp, Streptomyces avermitilis
  CDS (1)..(1008)
atggattccctgacggagcctgatccagaaggggcagccgcggtccagcggccgcccctcgtccgtgagctcctgctcgtcgcggggctcttcgtcgtctacaaagtgggccggcagctggcgaacggccacaccggcgaggccttccacaacgcacagcgggtgtgggacggggagcgcgccctgcgtctgccggacgagggcgccgtgcagtccgcactgctgcacggcgacgccctcgtccacgtcgccaacacctactacgcggtcgtgcacttcccggccaccgcggccttcctggtctggctgtacctgcggcgccccggccactacctgtgggcccgccgggtcctcgccgtactcaccgccgccgcgctggtgctgcacctgacgttcccgctcgccccgccgcggctgctggcggcggccggcctggtggacaccgcgcaggtgtacggaccgtcggtctacggggggaacccggagaccgactcgatggcgaaccagttcgccgcgatgccgtcgctgcacttcggctgggcgctgatggtggcgatcggactgatcgccgcgacccggtcccgctggcgcccgctgtggctgctgcatccgctgctgaccctgatggtgatcgtcggaacggcgaaccactactggctggacgcgggcgtggcggcggcgctgctcggcatcgcgctcgcggtgatccacgcgccggtccggacggccgcggcggcggaccgcacgcccgcgcccgcggacatcgccgtcccggcgacggggctcacggcaccggcgggcgacgccgcaccgccgctcgccggcctggcgggccacgtcgtgccggcgcccgtgggggccgcgccgtccacgggtggcagcggcctcgtgggagcacgccgagcggaagccgaacgagtcggagcgagcccagcggaagcgaacccagcgaaagcgagccgagcgggagcggaacgcgtgggaacggaacgagtgggagcgggccgg

SEQ ID NO: 1702 - DNA, 942 bp, Streptomyces avermitilis
  CDS (1)..(942)
gtgaacgccaccctcgtcgccatcgtcctgtccctgttctccgccgtcgcgtacgcggccgccgcggtggcccaggagcggctcgccgcccggaacaccgacacgggtgcgctgcgtctgctcggcgacaccgcctggtggtggtcggtcgcgctcaacgcctcggccgcgctgctgcacgtcgccgcgctcaagtacgggccgctgaccctggtgcagccgctcggcgcgctgaccctggtggccgcggtgccgctcggggcccgggtcgccgggcggcgggtcagcgcggtcgagtggcgcggcacggcgctcaccctgatcggcctggccgcgctgctcgtcaccgcgtccgggccggcgcccgacgatgtgctgacggtgccggaggcgctggccgtcgccggtgccaccgcggtgctgatcggcggcctgtcgcggccgggagcgcggccggggctgcggcacgcgaccgcctccgggttcgcgtcgggtgtcgcctcggccctcacccagacggtgacggtggccgcgacggaccgctcggactcgctgctgagcgcccaagtgatcgtggtgaccctgctcgtggcggccttcgcggcgggtggcctgctgctgtcgcagaccgcgtaccagggcggtctcggcgctccgctcgccgtcgtgacgctcgccaatccggtggccgcctcggtgatcggcctgtccctgctcggcgaacgcctcgagggcggcccgacgggtgtgctgctggcgttcgtgggagcggcgatcgcggcatggggcgtggtgacgctgtcccggtcggcgcccgcgcccgcgcccgtggcggacgacgaccacccggtcgcggcggtgctggcgctggagcccggatcagcggcgtacgaaccctcgttgctgccccagcagccgaaccccggccatctgacggctcac

SEQ ID NO: 1703 - DNA, 855 bp, Streptomyces avermitilis
  CDS (1)..(855)
gtgaccacgcattcgaacactcctgcaggttggtacccggatccgcacggggcgccccagacgctgcgttactgggacggtgctcagtggaccgaccacacgaatgcggaccagcaggcccaaggtgcgccgcaggtaccgcagcaggcgcagcagccccagcaggcgtacgcccagcaggccgccccggctcccgaccggcgcgtgcagcgtcaggtgcagcaggaggccggggtcgcggccggcgcggtcggcggcggcacgctgttcaccgagccggtcctggtggtgaaccagaaggccaagctgatcgaggtgaccaacgagtacaaggtcatggaccagaacggcaaccagctcggctcggtcaccgaggtcgggcagaacgccttcaagaaggtcctgcgcttcgtctccagcgtcgaccagttcatgacccacaagctggagatccgtgacgcgtacggtcagccgcagctgctgctgacccgccccgcgaagatcttcaagtcgcgggtgatcgtgtcgcgtccggacggctcgcccgtcggtgagatcgttcagcagaacatgatcggaaagatcaacttcgcgatgaacgtcgacggccagcaggtcggtgcgatcaaggcggagaactggcgggcctggaacttcgcgatcgtcgaccacgcgggcaacgaggtcgccaggatcaccaagacctgggaaggcctcgccaagacgatgttcacgaccgcggacaactacgtcctgcagatccacttccagctccccgaacccctgctgagcctcgtcgtggcgacggcgctgaccgtcgacacggcgctcaagcaggactcccgggggctcggc

SEQ ID NO: 1704 - DNA, 2049 bp, Streptomyces avermitilis
  CDS (1)..(2049)
atgcccgaagtcaaccggcgccgcttccttcaactcgcgggtggcaccgccgccttcaccgcgctgtccaacagcatcgagcgcgccgcggcgctgcccgcgcaccacagctccgggacgatcgaggacgtcgagcacatcgtcgtcctcatgcaggagaaccgctccttcgaccactacttcggctcactgagaggcgtccgcggcttcggcgacccgcgcccggccgcccaggcgaacggcaagccggtctggaaccagtcggacggcgcgaaggacgtgctccccttccatcccgacgcggacgacctgggcctgcagttcatccaggaccttccgcacggctggagcgacggacactccgccttcaaccagggcaagtacgacaagtgggtgcctgccaagtcggcgaccacgatggcgtacctgacgcgcgacgacatcccgttccactacgcgctcgccgacagcttcaccatctgcgacgcgtaccactgttcgttcatcggctccaccgacccgaaccgctactacctgtggacgggctacacgggcaacgacggcaagggcggcggcccggtcctcggcaacgaggaggccggctacagctggacgacctaccccgagcgtctcgaagcggccggcgtctcctggaagatctaccaggacgtcggcgacggtctcgacgcgaacggctcctggggctggatacccgacgcctaccgtggcaactacggcgacaactccctgctgtacttcgaccagtaccgcaacgccaagcccggtgacccgctgtacgacaaggcccgcaccggcaccgacgcccgcaagggcgagggcttcttcgaccagctgacggcggacgtcaagggcggcaagctgcccgagatctcgtggatcgtcgcccccgaggccttcaccgagcaccccaactggcccgcgaactacggtgcctggtacgtcgcccaggtcctggacgcgctcacctccgaccccaaggtgtgggcgaagaccgcgttgttcgtcacctacgacgagaacgacggcttcttcgaccacctggtgccgccgttcccgccgcagtccgccgcgcagggcaagtccacggtcgacgtcggcccggacctcttcaagggtgacgcgagccacgccgccggaccgtacgggctcggccagcgggtgccgatgctcgtcgtctcgccctggagcaagggcggttacgtctgctccgagaccctcgaccacacctcggtcatccggttcatggagcgccgcttcggcgtgcacgagcccaacatctcgccctggcggcgcgcggtctgcggcgatctgacgtcggccttcgacttctcccgcaaggacaccaagccggtcgcgctgcccgccaccgacggataccggccgccggaccacgaccgccaccccgactatgtgccgaccccgcccgcccaccccgccctgccccggcaggagcgcggctcgcgcccggcccgcccgctccggtacgcgcccctggtggacggttcggcggacgcggcggccgggaagttcacgctcaccttcgcctccggggcccgggccggtgccgccttcctggtcacgtccggcaaccgtacggacggcccgtggacgtacaccaccgaggccggcaagaccgtgtcggacacctggaactcggcgtactcgaacggctcgtacgacctgaccgtgcacggcccgaacggcttcctgcgcgtgttcaagggccccggcggggccgccgggcccgaggtcaccgcgcggcacgtcggaagcgatgtgcggctggtcttcaccaacaaggggcccggtacggtccgcctcgagctcaccgacggctatggcggaaagccgcggtccttcaaggtgcgtccgggcgcgaccgtcaagcacacggtggatctgcgggccgccaggcgctggtacgacctgaccgtcgtgtccgacgcggacgcgggctttctgcgccggttcgccggacatgtcgagaacggtctgcccggtgtgagcgacccggcgatcgtcaccgac

SEQ ID NO: 1705 - DNA, 681 bp, Streptomyces avermitilis
  CDS (1)..(681)
gtggacctgacgccgacgcttccacggggcggtacggctgatcgtgggccgctgacgcctcaccgcccttccaccaccccgttctgcgaccgcagtccccgggcccgggtcgccctggagtcgctgtcgtcggccgacatcactgacggactgaccgagttcgagctggacgcggcgatgacgtacctggacgacgacacgctccgccacgtacgccgcttcccgctgtacgaggagcggtacgtgctgctcacgccggtcgacggaccgctcgccgcgcagccgacggcccggtgggctcaggccgccgccctgccgctgtgcctgctcggcccgcggatgcgtaaccggcgcatcatcgacgagtgcttcgccgccgacggggcgacggccacgcccgcgatcgagtcggacagcgtcgccgggctgtacgcgcagctgccgggcggccgctggtccagcgtgatctcgcacgcctggctgcacatgttcggcgtaccggagggcatgggggtcgtacccctggagggccccgcacgcgggccgcgggtcgggctggtcgtcgcccgcagcgaaccccggtcggcgctggccgaggcgctgctgacggtggcccgggaggcagacgtacgggacgcgctcgacagcctcctgcacacctacctgggcggcgggcatggc

SEQ ID NO: 1706 - DNA, 480 bp, Streptomyces avermitilis
  CDS (1)..(480)
gtgagtcagtccctcgcagctgccggtacggccgccggcgcgatggcggaactcgccctcaccggtgatctggcccggccggcccgcctgacggtgtccgatctgctcgcctggccccggcatcgggtgcgggtcagcttcgagtgcgccaccagcggcgtacagcaccacgccttcgaagggccgctgctgcacgacgtcctgtcggacgccggaccggtcttcgacgccgcccgccgcaaggaccgcctgcgcttcctgatcgccgtgacgggagcggacggacaccacgcgctgctgtcctgggcggagatcgacccggacttcggacgcgcccccgtcctgctcgcggtcagcatcgacggcaccccgctcgaccgggccgggccgcagctcgtgctgccccaggaccgctgcggcgcccggcacatcagcggcatcgacgccatccgcgtggacggcggctacaccccgtggacc

SEQ ID NO: 1707 - DNA, 384 bp, Streptomyces avermitilis
  CDS (1)..(384)
atgcacacctaccggatcggggatgcggccgccttgctcggtgtcagcgccgacaccgtgaggcgcctggtcgacggcgggagactcaccgccgaacgcgacgcgacgggccgccggatcatccccggaccggtcctcgcggcctatgcccggcagttgcaccgcacggagcgggagaacgccggctcctccgcccgcaaccgcctctccggcatcgtcacggacgtgaccctcggagacgtgtccgcgcaggtggagatccaggccgggccgttccgggtggtgtccctggtcagccgcgagtcggctgaggaactgaagctggaaccaggtgttccggcggttgccgtgatcaagtcgaccaacgtggtcgtcgaaagaccg

SEQ ID NO: 1708 - DNA, 822 bp, Streptomyces avermitilis
  CDS (1)..(822)
atgacccgttccgcgcgccggacccaccggaccctgaaggtggccggtgcgggagccgccgcgttgctggccctgagcgcctgctcctcctccgacgactcgtcgacgaaggcggactcctccgcatccgcgtcctcctccgcgaagctgtccggcacggtgaccgtgttcgccgcggcctcgctgaaggagagcttcacgaccctgggcaaggagttcgagaaggagcacccgggcacgaaggtgaccttcagcttcggcggcagcgactccctcgccgcgagcatcaccggcggcgccccggccgacgtgttcgcctccgccagccccaagacgatggcgatcgtcacggatgcgggcgatgcgtcggggacgcccgccaccttcgtccgcaaccagctggagatcgccaccctgcccggcaatcccgacaaggtgtcctccctcgaggacctcaccaagtccggcttgaaggtcgtgctgtgcgacaaggaggtgccgtgcggcgccgccgcgcagaaggccctggacgccggcaagctcaagctcaccccggtctcctacgagcaggacgtcaagagcgccctgacgaaggtggagctgaaggaggccgacgccgcggtcgtctacaagacggatgtgaaggccgcgggtgacaaggtggagggcgtggagttccccgagtccgccaacgccgtcaacgactacccgatcgtccggctcaaggacacgaagaacgccgaggcggccaaggcgttcatcgccctggtgcggtccgccgaaggccagaaggtcctgaccgaggccgggttcctcaagccg

SEQ ID NO: 1709 - DNA, 867 bp, Streptomyces avermitilis
  CDS (1)..(867)
gtgacctccccgcacgacacgtccgacgccgtggccgacaccctgacgggcgggccacggcgcgggcccgggcacgtgcggaccggcttcggccggggcgtgccactcccgctgctcgtgcccgcgctggtggggctggccttcctggtgctgccgctgatcgccctgctggtccgcaccccctggcacagcctgccgggccagctgaccagccccgaggtctggcaggcgctgaagctgtccctggtgtgcgccaccgcggccaccgccgtgagcctggtgatcggggtgcccctggcctggctgctggcccgggtcgagtttcccggacgcggcctcgtccgcgctctggtcaccctgccgctcgtcctgccaccggtcgtgggcggtgtggccctgctgatggcgctcggccgcaacggagtcgtcgggaagtggctggactcgtggttcggtatcactctgccgttcaccaccaccggtgtcgtcatcgccgaggcgttcgtcgcgatgccgttcctcgtcatcagcgtcgagggcaccctgcgggccgccgacccgcgctacgaggaggccgccacgaccctgggcgcctcccggttcaccgcgttccgccgggtcaccctgccgctgatcgcgcccggcatcgcggcgggcgcggtcctggcctgggcccgtgcgctcggcgagttcggtgcgacgatcacgttcgcgggcaacttccccggccgtacgcagaccatgccgctggccgtctacctggccctgcagagcgacccggaggcggccatcgccctcagcctggtgctgctcgtcgtgtccgtcgcggtcctggccgggctgcgtgatcgctggatgaccgcctca

SEQ ID NO: 1710 - DNA, 1092 bp, Streptomyces avermitilis
  CDS (1)..(1092)
atgaccgacaccgagaagtccgcgcacgaggtcatgggtgtccccggcccggccgcagcggggctggacgcccgtctgatcgtcgaccgcggcaccttccggctcgacgtggcgctgacggccgcacccggcgacgtcgtcgcgctgctcggcccgaacggcgccggcaagaccaccgccctgcgcgccctcgccggtctcgtccccctcacgggcggtcatctacgcctggacggcgcgccgctggagcgtacgccgcccgagtcacgtccggtcggcgtcgtctttcaggactacctgctcttcccccacctcacggccctggacaacgtggccttcggcccgcgctgccacggcgcgaccaaggcggcggcccgcgcccgggccgccgagtggctggagcggatgggtctgaccgcccacgccggcgccaagccccgccgactctccggcggccaggcccagcgcgtcgccctcgcccgcgccctcgccaccagcccccggctgctgctcctcgacgaacccctcgccgcgctcgacgcccgcacgcggctggaggtacggacgcaactccggcgccatctggccgagttcgaggccgtcgccgtactcgtcacccacgacccgctggacgccatggtgctggccgaccgcctcgtcgtcgtcgaggacggccgcgtcgtccaggagggcactcccgccgacatcgcacgccacccgcgtacggactacatcgcccaccttgtcggcctgaacctctacccgggacgggccgaaggacacgcggtgcgcgtcgacggcgggccggtgatcacgaccaccgaggacctcaccggaccggtcttcgtcgcgttcccgccgagcgcggtcaccctgcaccgcgaccgccccaccggctccagcgcgcgcaacctctggcagtgcgaggtcgccggtcttgagacccacggcgaccagatccgtgccgacctgaccggcgaactccccctcgccgccgacctgacgaccgtcgccgccgccgagctcgacctccatccgggggccacggtgtgggcatcggtcaaggccgcccagacccacgcctactcggcc

SEQ ID NO: 1711 - DNA, 900 bp, Streptomyces avermitilis
  CDS (1)..(900)
gtggccgggcgggcccttgccgtcccctgtgcggatctcgatactttgcccatgacatcggcggaatcggacgggccgggaagagtggaccggctcctgcgctacccggtgaagtcgatgctcggcgaggagctgcccgccgtcgaggtcaccgagcggggcctcgcccacgaccgccgcgtggccctgatcgaccgggacaccggcaaggtcgccagcgccaagcacccccgcctgtggagccgtctgctcacggtgaccgcgcaggccgacaactccgcggtacgcatgaccacgtcggacggcaaggagctgtggtcgaccgatccgggcgtggacgaggcgctgtcggagatcgtcggccgccccgtgttcctcaccgacgccccgccgcacgaggcggcccttgaccgcgccgacccggaggacgtcctgcgcgaccacacgaggccgccggtgagcgctcgtaccggccgaatcggcggcggctcccccgaaggaacgttcttcgatttcgcgcctgtccacgtgatgacgacctcgaccctcgcccgcatcgcggcactcgcaccgaacggcagcgcccaagcggagcgttaccgccccaacatcgtgctccgtacgccgctgacccggggcttcacggagaacgactggatcgaccggaccctgcacctgggcaccggcctcgtcctgcgcgtcatcgcccgcacaccgcgctgcgccatacccacgctggcacacggcactgtgccggcggacaccgcggctctccgcgtcctggccgagcacaaccgcgtcaccccgacggagtcgatgggaccgcagccctgcgccggcgtctacgcccaggtgctgcggcccggccggatccggctcggcgatcctgtccactgggcc

SEQ ID NO: 1712 - DNA, 2172 bp, Streptomyces avermitilis
  CDS (1)..(2172)
atgcacagcaacagcctcagatatgtcaggcgcatgtcagccatcggtgcggccgtcgccctggcggcgggcctgctcgtcgccctggcccccgccgcgcacgcggccgccggcgccgacctccccttcacctccgtcgaggcggagtccgccaccacgaccggcacgaagatcggccccgaccacacccagggcacgatcgcctcggaggcctccgggcgccaggccgtacgactgggcgcgggccagcgcgtcgagttcaccgtcccccgggccgcgaacgcggtgaacgtctcctacaacgtccccgacggccagtcgggcgcgctcaacgtgtacgtcaacggcacgaagctcgccaagacgctggccgtcacctccaagtactcctacgtcgacacctcctggatcgcgggcgccaagacccatcacttcttcgacaacgcccggctgctcctcggccagaacgtccagccgggcgacaagatcgccgtcgaagcggtgtccacccaggtcacggtggacgtcgccgacttcgagcaggtcgccgcggcggccaccaagcccgccggggcggtctccgtcaccgacaagggcgccgacccgagcggccagggcgactccacccaggccttccggaacgccatcgccgcagcccaggggggagtggtgtggatcccgccgggcgactaccggctgacctcctcgctgaacggcgtccagaacgtgacgctgcaaggcgcgggcagctggcactccgtcgtgcacacctcgcgcttcatcgaccagtccagctcctcgggcggcgtccacctcaaggacttcgcggtgatcggcgaggtcaccgagcgcgtcgactccaacccggacaacttcgtcaacgggtccctcggtccggggagctcggtctccggcatgtggctccagcacctcaaggtcggcctctggctcaccggcaacaacgacaatctcgtcgtcgagaacaaccgcatcctcgacaccaccgccgacggtctcaacctcaacggcaacgcccgcggcgtccgcgtccggaacaacttcctgcgcaacaacggcgacgacgccctcgccatgtggtcgctgtactcgccggacaccaacagcagcttcgagagcaacaccatctcgcagccgaacctcgccaacggcatcgccatctacggcggcaccgacctcgcggtcaagaacaacctgatctccgacaccaacgccctcggcagcggcatcgcgatctccaaccagaagttcctcgaccccttctccccgctcgcgggcaccatcacggtctccggcaacaccctcgtccgcgccggcgcgatgaaccccaactggcagcacccgatgggcgcgttgcgcgtcgactcgtacgacagcgccatcgaggcgaacgtcagcatcaccggcacgacgatcaccgacagcccgtacagcgccttcgagttcgtgtcgggcggcggacacggctatgcgaccaagaacgtcaccgtggacggggcgacggtcaggaacaccggcacggtcgtggtccaggccgagtcgcagggcgccgccaagttcagcaacgtccaggccaccggcgtgggcgcggcgggcatctacaactgcccctacccggccggctcgggcaccttcaccctcacggacggcggcggcaacgcgggctggagcagcacctggggggactgctcggcctggccgcagccgggccagggcaaccccgaccccgatcccacccgcaacctcgccaagggccgccccgccaccgccaccggctcgcaggacgtctacacgcccggcaaggcggtcgacggcgacgcgagcacctactgggagtccaccaacaacgccttcccgcaggcctggaccgtcgacctcggctcgtcccaggccgtccggcgcctcgtcctcaagctgccgcccgccaccgcctggcaggcgcgcacgcagaccctgtcggtgcagggcagcaccgacggctcggcgtactcgacggtggtcgcctcgcagggctaccgcttcgacccggcgaccgggaacacggcgaccgtgaccctgcccagcggcacgaacctgcggtacctgaagctcaacgtcaccgccaacaccggctggccggccgcccagttcagtgaggtggaggcgtatctgtcc

SEQ ID NO: 1713 - DNA, 1599 bp, Streptomyces avermitilis
  CDS (1)..(1599)
gtgggacagcccacccctgcccgcatccagaaggactggtggcgcaccgccgtcatctaccaggtgtacgtccgcagcttcgcggacggcgacggcgacggcaccggcgacctcgcgggtgtccgcgccagacttccctacctcgccggactcggcgtggacgccatctggttcaacccctggtacctgtcaccgatgaaggacggcggctacgacgtcgccgactaccgggccgtcgacccggccttcggcaccctcgccgaagcggagaaactcatcgccgaggcacgggaactgggcatccgcacccttgtcgacatcgtcccgaaccatgtctcggaccagcacccctggttccgcgcggcgctcgccgccggcccgggcagccccgagcgcgcactgttccacttccgcgggggccgcggcgcgcacggcgaactcccgcccaacgactggccgtcccagttcgccggctccaccgaacccgtctggacacagctgcccgacggcgactggtacctgcacctgttcacccccgaacagcccgacctcaactgggcccacccggccgtccggcaggaacacgaggacgtactgcgcttctggttcgaacggggcgtggcgggcgtacgcatcgactcggcggccctcctcgccaaggacccggacctgccggacctcgtcgagggccgcgccccgcacccgttcgtcgaccgcgacgaactccacgacatctaccgctcctggcgcgccatcgccgacgagtacggcgccgtcttcgtcggcgaggtctggctccccgacaccgaacgcttcgcccgctatctgcgccccgacgaactgcacaccgccttcaacttctccttcctctcctgcccctgggacgcccggcgcctgcgcacggccatcgacgagaccctcgccgagcacgcgcccgtcggcgcgcccgccacctgggtgctgtgcaaccacgacgtgacccgcacggtcacccggtacgggcgcacggacaccggcttcgacttcgccgccaaggccttcggcaccccgaccgacctggctctcggcacccgccgcgcccgcgccgccgcgctgctctcgctcgccctgcccgggtccgtctacctctaccagggcgaggaactgggcctgcccgaggccgagataccgcgcgagagcatccaggacccgatgcacttccgctcccacggcgtcgaccccgggcgggacggctgccgggtgccgctgccctgggtggccgacgcgccgcacgcgggcttcgggggcgagccctggctgccgcagcccgcacgctggtccgcgtacgcggccgacctccaggccgaggacccgggctcgatgctctccctctaccgggaggccctccggctcaggccggcctacgccgacggccccctcacctggctgcccgcacccgacggtgtcctcgccttcgcgcgcacggagggcctgatgtgcgtcgtgaacctcgcggacaccccggccggcctccccgcacactcccgactcctgctcagcagcggccccctggacgaccagggacgcctcccgcaggacacggcggcctggctgcgcatc

SEQ ID NO: 1714 - DNA, 873 bp, Streptomyces avermitilis
  CDS (1)..(873)
atgagcacccgcacgctcgtctcgccgctcacgctgtcccgcccccgcggcaaggccgcctactggaccgtgttcacgggcgtcgtgctgctcttcgcgctcgccttcctcttccccgtctactggatggtcaccggcgccatgaagtcgccggacgaggccgcacgcaccccgccgtccctcgtcccacagaagtggcacctcagcggctacaccgacgcctgggacctgatgcagctgccggcccacctgtggaacacggtcgtccaggccaccggcgcctggctgctccagctcgtgttctgcacggccgccgcgtacgccctgtcccggctgaagcccgtcttcggcaagctggtcctcggcggcatcctggccaccctgatggtgccggcccaggcactggtcgtaccgaagtacctgaccgtcgccgacctcccgctgatccacaccagcctgctcaacgacccgctcggcatctggctgcccgccgtggccaacgccttcaacctctatctcctcaagcggttcttcgaccagatcccgcgcgacgtcctggaggccgccgagatcgacggtgccggccggctgcgcaccctctggtcgatcgtgctgccgatgtcccggccggtcctgggagttgtctcgatcttcgccctggtcgccgtctggcaggacttcctctggccgctgatggtcttctccgacaccgacaagcagcccatcagcgtggccctcgtccagctgtcgcagaacatccagctgaccgtgctcatcgccgcgatggtgatcgccagcatccccatggtcgcgatgttcctcgtgttccagcggcacatcatcgccgggatcagcgcgggcagcacgaagggc

SEQ ID NO: 1715 - DNA, 954 bp, Streptomyces avermitilis
  CDS (1)..(954)
atgaccaagaccgcagcgcggcggcccgtcgaggcgatcgccgtacgcccggtaccggcgccgcccccgggagggggcctcgggcggcgccgcctcgccgaccaggcccacgcgtacgccttcctgctcggcggcctgctctgcttcgccctgttctcctggtacccggcgatccgcgcggtcgtgatcgccttccagaagtacacgccgggctcaccgcccgagtgggtcggcaccgccaacttcacccgcgtcctgcacgaccccgagttcaccgcggcctggcgcaacacgctcaccttcaccctgctcgccctgctcatcggcttcgccgtgcccttcgtgatggcgctcgtcctcaacgaactccggcacgccaaagccttcttcagggtcgtggtctatctgccggtgatgatcccgccggtggtcagcgccctgctgtggaagtggttctacgaccccggagccggcctcgccaacgaagcactccgcttcctgcacctgcccacctccaactggtccaacggcgccgacaccgccctcgtctccctggtcatcgtggcgacctgggccaacatgggcggcacggtcctgatctacctggccgcgctgcagggcatcccgggggagctctacgaagccgccgagctggacggcgccaacatcctccagcgcatccgccatgtgacgatcccccagacccggttcatcgtcctgatgctgatgctccttcagatcatcgccacgatgcaggtcttcaccgagccgttcgtcatcaccggcggcggccccgagaacgcgacggtcaccgtcctctacctgatctacaagtacgccttcctctacaacgacttcggcggggcctgcgccctgagcgtcatgctgctcgtgctgctcggcgccttctccgcggtctatctgcgcctgacccgttccgcggaggaggactca

SEQ ID NO: 1716 - DNA, 1338 bp, Streptomyces avermitilis
  CDS (1)..(1338)
atgagaagctccgggttccgccgtgcctgtgtcgcgctcgtggcctgttcgttcgtcctgaccgcgtgcggttcgagcggtgatgcggccgacggcaagacccgcatcaccgtgaactgcatgccgcccaagagcgccaaggtcgaccggaagttcttcgaggacgacatcgccgccttcgagaagaagaacccggacatcgacgtcgtcgcccatgacgccttcccctgccaggaccccaagacgttcgacgccaaactcgccggcggtcagatggaggacgtcttctacacgtacttcaccgacgccacccacgtcgtcgacgtcaaccaggccgccgacatcacctcgtacgtcaaggacctcaagagctacgacaccgtccagcagcagctgcgcgacatctacaccgtcgacggcaaggtctacggcgtcccgcgcaccggctactcgatggggctgatctacaaccgggggctcttcgagaaggccggactcgaccccgacaagcccccggcgacctgggacgaggtgcgcgccgccgccaagaggatcgccgcactcggcggcggcaccgtcggctacgcggactacagcgcgcagaaccagggcggctggcacttcaccgccgagctgtactcgcagggcggcgacgtggtgagcgccgacggcaagaaggccaccgtcgacacccccgagggcaaggcggtgctccagaacctgcacgacatgcgctggaccgacaactccatgggcagcaagcagctcctcgtcatcaacgacgtccagcagctgatgggctccggcaagctcggcatgtacctctccgcacccgacaacatcccgatcctggtgaaggagaagggcggcacctacacggacctcgccctggcccccatgcccggcggcaagggcaccctcatcggcggcgacggctacatgttcaacaagaaggccacgcccgcgcagatcaaggccggactgaagtggctcgacttcatgttcctcacccccggcaagggcttcctcggcgactacgcccgcgccaagaagaacgacgcccccgtgggcctgcccgaaccccggctgttcagcggcgccgccgacgccagggaccagcaggtcaagaaggccaacgccaacgtccccgtcgagaactaccagtccttcctcgacggcaaccagagcctgaggatgaagatcgagccgccgcaggcccagcagatctactccgtcctcgacagcgccgtctccgcggtcctcaccaagaaggacgccgacatcgacaagctcctgaaggacgcgtccggcaagatcgacagcatcctcgcccgaggc

SEQ ID NO: 1717 - DNA, 990 bp, Streptomyces avermitilis
  CDS (1)..(990)
atgacgcgacgacttgctgaggtggcgaagaaggtcggggtcagtgaggccacggtcagccgggtgctcaacgacaagccgggagtctccccggccacccggcaggcggtgctctcggcgctcgacgtcctcggctacgagcggcccacgcagctgcgcggcgagcgggcccggctcgtcggactggtgctccccgagctccagaacccgatcttcccggccttcgccgaggtcatcggcggagcgctcgcccagctcggcctcacgcccgtgctgtgcacgcagaccaagggcggtgtctccgaggcggattacgtgaacctgctgctccagcagcaggtctccggtgtggtgttcgcgggcggactgtacgcgcaggccgacgcgccgcacgaccactaccgccggctcgcggaccgcaacatcccggtggtgctggtcaacgcggccatcgagcacctcggtttcccggccgtctcctgcgacgacgccgtggcggtggagcaggcctggcggcatctcgcctcgctcggacacgaacggatcggactcgtgctcgggccgggtgaccatatgccctcggcgcggaagctggcggccgcgcgggctctcggggacctcccggacgagtacgtcgcccgggccatgttctccatcgagggcggccacgcggcggcctcccggctcatcgaccggggcgtcaccggcttcatctgcgccagcgaccccctggcgctcggcgcggtacgggccgcccgccgcaagggacttgacgttccgtcccagatctccgtcgtcggctacgacgactcggccctcatgaactgcacggaacccccgctgaccaccgttcgccagcccatcgagtccatggggcgggcggtggtggagctgctgaacgcgcggatcggcggcagctccgtaccggacgaggagctcttgttcgaaccggagctggtggtgcggggatccaccgcgcaagccccgcgg

SEQ ID NO: 1718 - DNA, 726 bp, Streptomyces avermitilis
  CDS (1)..(726)
atgtccggtgacccggcccccgtgcccggggaccccgccccgaggaggaagaccgcgatggccgcgcagcacagccccgccctgcccacgctgggcggcaggaagcccagctaccgggagcgggtcgccgacgccctgcgggccgcgctgatcgccggtgagctgcgcgccggggaggtctattcggcgcccggcctcgccgcccgcttcggggtctccgcgaccccggtgcgtgaggccatgctcgacctcgcgaaggagggcctggtcgacaccgtcccgaacaagggcttccgggtcaccgcggtctccgagaaacagctcgacgagtacacgcacatcaggtcgctgatcgagatcccgacgacggcgggcctcgcgctcaccgccgacccggccgagctggaggcgctgcgcccggtcgcgcgggagatcgtcgccgccgccacggccggggacctcatcgcgtacgtcgaggcggacctgcgcttccacctggggctgctcgcgctcgccggcaacgaccacctcgtggacgtcgtacgggacctacggcgccgctcccgcctgtacggactcaccgccctcgcccgggcgggccggctgcgggcctccgccgaggagcacctcgaactcctcgacgcgctgctggcccgcgacaccgaggccgcgcgcgaggtgacgacccggcacctcggccatgtgcgcggactctgggtggccccc

SEQ ID NO: 1719 - DNA, 999 bp, Streptomyces avermitilis
  CDS (1)..(999)
atgcgcagcaaactcgtcctgcacgccgtcgactcgcacaccgagggcatgccgacccgggtgatcaccggcggcatcggcacgatccccggcgcgaccatgaacgaacggcgcctgtacttccgtgaacaccgcgacgacatcaggcagttgctgatgaacgagccgcgcggtcactcggccatgagcggcgcggtcctccagcctcccgcgcgccccgactgcgatgtcggcgtcgtctacatcgaggtctccggctatctgccgatgtgcggccacggcacgatcggcgtcgcgaccgtgctcgtggagaccggcatggtcgaggtcgtcgagccggtcaccacgatccgcctcgacaccccggcgggcctcgtcgtcgccgaggtggcggtcgaggacggcgccgcccgggccgtcacgctcaagaacgtgccgtccttctgcgtcggcctcgaccgcaaggccacgctcgccgacggccgcacggtgacgtacgacctcgcgtacggcgggaacttctacgcgatcctgccgctgggggagttcggactgcccttcgaccggtcccgcaaggacgacatcctcaaggcgggcctgtccctgatggacgccgtcaacgcggacggcgggcccgtccaccccgaggacccgtccatccgcggctgccaccacgtccacctcgtcgcgcccggctccgacgcccgccactcccggcacgcgatggccatccatcccggctggttcgaccgctcgccgtgcggcaccggaaccagcgcccgtatggcgcagttgcacgcgcgcggtgaacttccgctcggcaccgagttcgtcaacgagtccctcatcgggacccggttcaccggccggctgctcggcacgaccgaggtggccggcatccccgccgtcctgcccagcttcaccgggcgcgcctgggtcaccgggacggcccagtacctgctggaccccgaggaccccttcccggcggggttcgtgctg

SEQ ID NO: 1720 - DNA, 888 bp, Streptomyces avermitilis
  CDS (1)..(888)
atgaccgtccaccgcccctggcgcggcgtgctcgtcgccaccgcgctcccgctcaccgccgacctcgccgtcgaccacgacaagttcgccgagcactgcgcctggctcgtcgagcagggttgcgacggagtcgtgccgaacggctcgctcggtgagtaccaggtgctcacccccgaggagcgcgccagggtcgtcgagacggccgtgtccgccgtcggcggcgcgcgggtgatgcccggggtcgccgcctacggatcggcggaggcccggcgctgggccgaacaggcccgggacgccggctgccgggcggtcatgctgctgccgccgaacgcctaccgggccgacgagcgttccgtacgcgcccactacgcggaggtcgccaaggcgggcgtgccggtcgtcgcgtacaacaaccccatcgacaccaaggtcgacctcgtgcccgaactgctcgccgcgctgcacggcgaggggtacatccacgcggtcaaggagttctcgggggatgtccgccgcgcctaccggctggccgaactcgccccggaactcgatctgctgatcggcgcggacgacgtcctgctggaactcgcggtcgcgggcgccaagggctgggtggccggctacccgaacgcactgcccgcggcgagcgtcgagctgtaccacgcggccgtcgacggcgacctcgccaccgccacacagctgtaccggcagctgcacccgctgctgcgctgggactccagggtcgagttcgtgcaggccatcaaaatgtccatggacgtcgtcgggcggtacggcggcccggtacgcccgccgcgcgtcccgctgctgcccgagcaggagaccgccgtccgcgccgccacggagaaggccgtggcggcggggctcgcg

SEQ ID NO: 1721 - DNA, 1497 bp, Streptomyces avermitilis
  CDS (1)..(1497)
atgagggctgagccggccagggctgaatcggccagggctgagctggccgtgatcggcgcgggcccggcgggcctcgccgccgccctggccgcgggcgcgcgcggagtgcgcgtcacgctgatcgactcggctgcccaggcgggcggtcagttctaccgccggcccgaccccgcgctcgaggcgcggcgaccgcaggttctgcaccatcggtggcggacctgggaacggctgcgcgacgggctcgccgcacaggtcggaacaggaggagtcaagcacctgaccgaacatcaggtgtggctcgtggaaaggcagtcgacgggtttcacggtccacgcccttcgtgcggagagcccggtcgtcgtccacgccgacgccgtcctcctcgccaccggcggctacgagaaggtgctgccgtttcccggctggaccctccccggcgtactgaccgcgggcggggcgcaggcgatgctcaagggcggcctcgcggtggcgggcggtaccgcggtcgtggccggcaccgggccgctgctgctgcccgtggcgaccgggctggccgcggcgggcgtcgaggtcgcggcgctggtggaggcggcggacccgaagacgctcgtacggcatgcgcgcgctctcgcggtcaagctgcccgaaggcgcccggtacgcggctcggctcctgcggcaccgtgtcgagttcctcggccggcacaccgtcgtcgaggcgcacggcggtgagcggctggcagccgtgaccgtcgccgccctcgatgccggcggacgcgtacggaccggcaccgagcggcgcatcctctgcgacaccctcgccgtcggacacggcatgctcccgcacaccgacctcgccgagacgctcggctgtcgcgtcgacgggctgaacgtctccgtcgacgaggaacagcgcacctccgtccccggtgtatgggccgcgggcgagaccaccggcatcgggggcgccgcgctgtcgctcgccgaggggcacatcgccggacggtcgatcgccgcccggctcgcgggccgcgaacccgacccgcgcgcctgggcggcggccgccaagtcccgtacccgactgcggcagttcgccgccgtgctcgacaccgtgtacgcgccgcccgcccactggagcgaccgggtcaccgacgacaccgtcgtctgccgctgcgaggaggtcaccggcggtgcgatccgggaggccgtcgaggagctcggcgccggtgacctgcgtaccgtcaagctgctcacccgcgccgggatgggctggtgccagggccggatgtgcgggcccgcggtcgccggactcgccggatgccaactcgccccgtccagtgggccgttcgcacgacccgtaccgctcggcgtactcgcccgggccgccgacggccaccggagcgaggctcccaccgccgaccacggggacgaggcccccgcggacggccgtcgagccgaggcccccgccgacgatcacctcacccagagaggaccctca

SEQ ID NO: 1722 - DNA, 297 bp, Streptomyces avermitilis
  CDS (1)..(297)
gtgaatccactgagactcgtccacgcgcggccgggggcggcgttcgccgtcaccttcgacgggcgcgagatcgaggcgcttcccgggcagacggtcgccgccgcgctgtggtcggcgggcgtgaccgcgtggcgcaccactcggggcgggggccgaccgcgtggggtgttctgcgggatcggcgtctgcttcgactgcctgctgagcgtcaacggcgccccgaaccaacgggcttgcctggtacgggtgcggccaggcgatgtgatccgcacacaggagggaaccggccatgagggc

SEQ ID NO: 1723 - DNA, 1245 bp, Streptomyces avermitilis
  CDS (1)..(1245)
gtgacttcgccactgacctgcgatgttgtggtcgtcggggcaggcatggtgggcgcggcctgcgcctactacgcggcccgggcgggtctggacgtgaccctggtggaccggggtccggtggcgggcggcaccacgggtgcgggcgagggcaatctgctcgtctccgacaaggaaccggggccggaactcgaactcgccttgctctcaggccggttgtgggccgaactcgtcgaacggcggccggggttcggccatgccgtcgagtacgaggccaagggcggtctggtcgtcgccgagacgcccgaggcgctgaccgctctcacggatctggcggcccggcagtcggccgccggggtcgaggtgagtcccgccgccgccgaccaactgcgcgaactggaaccgcacttggcgccgggcctcgcgggtgcggtgcggtatccgcaggacgcgcaggtgatgccggcactggccgccgcccacctggtccgggcgtcgggggcccggccggcgaccggcgcgagtgtcaccgccgtgctgcggacgcccgacggttccgtacgcggagtgcgcaccgaccggggcgacatccacgcccccgccgtcgtcaacgccgccggcacctggggcggcgaagtggcgcggctcgcgggcgtccggctgcccgtactgccccggcgcggcttcgtcctcgtcaccgagccgctgccgcggatgatttggcacaaggtgtacgcggcggactatgtcgccgatgtggcgagcgactcggcggccctcgcgacctcgccggtcgtcgagggcacggcggcggggccggtactgatcggtgccagccgtgaacgggtcggcttcgaccgcacgttctcactgccggtcgtgcgggagctggccgcgggcgcgacccggctgttcccgttcctcgtgggggtgcacgccgtacgggcgtacgtgggcttccgcccgtaccttcccgaccatctgccggccatcggcccggacgcacgcgtgccggggctcttccatgcctgcgggcacgagggcgcgggcatcggactggccaccggcaccgggtacttgatcgcccaggtgctggccggccgggaccccgacctggacctgacgccgttccggcccgagcgcttttccggccacttccccgaccgttcccaggacggccttccgggcgctcttccggaccgtcctgcgcaccgcggtgcggatcgccgcgaggaccaggagacgccg

SEQ ID NO: 1724 - DNA, 855 bp, Streptomyces avermitilis
  CDS (1)..(855)
gtgcgctcagcagcctctgatcagcccgttaggagccctgccgtgcaactgtcccgttccgcgcgcatcgcgttgcgcgtcgccgccggatgcggcttcgcggccatctacgtcccgctcgcgctcgtcctcgtcaactccttcaactccgaccgcagcgcgagctggccgccgtcgggcctgaccctccactggtggtcggtcgcctgggggagcgagggcgcccgcgccgcgttgtgggtgtcggtcaaggcgggcctcggcgccacggccatcgccctgctgctgggcacactcatcgccttcgcggtggcccggcaccgcttcttcggccgcgacgccatctccttcgtggtcgtcctgccgatcgcgctgcccggcatcgtcacgggcatcgcgctcaactcggcgttcagtacggtcctggagcccctgggcgtcggactcggcatgttcaccgtggtcgtcggccacgccaccttctgcatcgtcgtcgtcttcaacaacgtcgtcgcccggctgcgccgcacctccggctcgtacgaggaggcggcgatggacctgggtgcgaacaccttccgcgccttcgccgacgtcaccttcccgctggtgcgctcggcgttgctcgcgggcgggctgctcgccttcgcgctctccttcgacgagatcgtggtgacgacgttcacggccggtcccggcatcgagaccctgccgatctggatcttcaacaacatgacgcgaccgcagcaggcaccggtggtgaacgtcgtggcggcggtcctggtcctcctctccgtactcccgatctacgtggcccagcggctgtccgcggacacggcgaccgagagccggatc

SEQ ID NO: 1725 - DNA, 891 bp, Streptomyces avermitilis
  CDS (1)..(891)
gtgaagaccaccactgcgcgagccgccggacggacccccgtccggcggctcgccgggaccctgcaccgccgcccccggctcaggctgtccctgctcctgaccgcaccgctgctctggctcgccgtgctctatctcggctcgctgagcgtgctgttcatctccgcgttctggacgacgaactccttcacctccgaggtcgtgaaggtctggtcgaccgacaacttccacacgctgttcaccacccccgtcttccgccaggtgatcctgcgcagcgtcggcgtcgcgctcgcggtcaccgtcctgtgcgcggtgatcgccttcccggtcgccttctacacggcccgcctggccaagccgaagtggcgtccgctcctcgtggtcgcgatcctcaccccgctgtgggccagctacctggtcaaggtgtacgcctggcggctcatcctctcccaggacgggctcgccgactggatgctgaagccgttcgggctcagcggtccggggttcggcctgccggcgacggtcatcaccctgacgtacctctggctgccgtacatgatcctgccgatccacacggcgctggagcagctgcccgccaacctcctcgacgcatccgccgatctgggcgcgcgggccggccgcaccttccgctcggtcgtgctgccgatggtcctgccgtcggtcgcggccggctcggtcttcaccttctcgctcagtctcggtgactacatcaccgtgcagatcgtcggcggcaagacccagctgatcggcaacctcgtctactccaacatcgaactgaacctgcccatggccgccgcactcggcacggtccccgtcgtcgtcatcgtggtctatctgctcgcgatgcgccgcacgggtgcgctcagcagcctc

SEQ ID NO: 1726 - DNA, 1242 bp, Streptomyces avermitilis
  CDS (1)..(1242)
gtgttgaccccaccgctcagtcccccgtcacgtatggagaacgtcgtgcgtctcacccgaaccctccaggccaccgccgccgtcgcggtgctcctcgcggccaccgcctgtggatcgtccgactcgggcggctcgtcctcgtcgacgggcctcaacccgcccgacctcaaggcgcagtcgaagctcggcaagacggagggccaggtcaacctcgtcgcctgggccggctacgtcgaggacggctccaacgaccccaagaccgactgggtcagcgacttcgagaagcagtccggctgccaggtcaactccaaggtcgcggccagctccgacgagatggtcaagctgatgaagaccggccagtacgacgccgtgtccgcgtccggcgacgcctccctgcgcctcatcgcctccggtgacgcggctcccgtcaacacggacctcgttcccaactaccaggacgtcttcagcggcctgaagaagcaggcgtggaactccgtcgacggcacgccctacggcatcccgcacggccgtggcgccaacctgctgatgtacaacacgcagaaggtgaagcccgccccgacctcctggtccgccgtcttcgacgacgcctcgcggtacaagggtcatgtcacggcgtacgactccccgatctacatcgccgacgcggcgctctatctcaaggccaccaagcccgaactgaagatcaaggacccctacgcgctcgaccagaagcagttcgacgcggccgtcgccctgctgaagaagcagaacgcgaacgtcggcgagtactggggcgactacctcaaggagatctccgccttcaagagcggcgactccgtggtcggcaccacctggcaggtcatcgccaacctcgccgccgacgagggcgccaaggtcaaggcggtcgtgccgaaggagggctccaccggctggtccgacacctggatggtctccgccaaggccaagcaccccaactgcgcctacaagtggctggactggatcatctcaccgaaggtcaacgcccaggtcgccgagtacttcggtgaggctccggccaacgccaaggcctgcgacgagaccagcgacaagaacttctgcgacaccttccacgccaccgaagagagctactggaaggacaccgccttctggaacacgcccatcgagcagtgcctcgacggccgtaccgacgtgaagtgcgtgccctacgccaagtgggtccaggcctggaccgagatcaagggc

SEQ ID NO: 1727 - DNA, 1035 bp, Streptomyces avermitilis
  CDS (1)..(1035)
atggaggcacgcgcgatccggctgcagggactgcggaaggtgttcggtgataccgccgccgtgaccggcgtcgacctggagatagccgacggagagttcttctcgatgctcggcccgtccggctccggcaagacgaccgtcctgcgtatgatcgcgggcttcgagagccccaccgccggccggatagagctggcgggccaggaggtcaccgggctcgcccccttcgaacgggacgtgcacaccgtcttccaggactacgccctgttcccgcacatgaccgtggaacagaacgtcgcctacggcctcaaggtccgcaaggtgcccagggtcgagcggctcgcccgggcccgcaaggcactcgccgacgtacgcctcgaagcgttcggcacccggcgcccatcccagctctccggcggtcagcgccagcgggtcgcgctcgcccgcgccctggtcggccgcccccgtgtgctgctgctcgacgaaccgctcggcgccctcgacctcaaactgcgcgagcagatgcaggtcgaactcaaggcgatccagcgcgaggtcggcatcaccttcgtgttcgtcacccacgaccaggaggaggccctgacgatgagcgaccgcatcgccgtcttcaaccggggccgcatcgaacaggtcggcaccccggccgagatctacgagcgcccctcgaccccgttcgtggcctcgttcgtcggcacctcgaacctcctgtcgggcgagtcggcacagcggatcgtcggcgcccccggcacgtacagcatcaggcccgagaagatccgggtccttggggagtccgcccacgcgggcgacccgcagtactccaccgccactggcaccgtcgtcgaggtggtctatctcggagacgtcacccgtttcctggtggacctggacgcgggcggccggctcaccgccctccagcagaacctggagacctcctccgcggacgtcgccgcgtatcgcggcacccgggtcaccctccagtggcaccgcggccacaccttcagggtccccgaagccggt

SEQ ID NO: 1728 - DNA, 753 bp, Streptomyces avermitilis
  CDS (1)..(753)
gtggtggccgtgaagcagcccgtcaacaggaacgccggcggcgcccggagcgccgtcttcaccccggtggacagccgggcacgagtggagacggtcgtccgccggctcggcgacgccatcgagctcgggctgctcgccgacggggagcagctgcccggcgagagcgagctggccgggcagctcggcgtgtccaccgtgaccctgcgggaagcgctcatggcgctgcggcagcaggggctcgtcaccacccgcaggggacgcggcggcggcagcttcgtctcgctgcccgcgatccccggcgaggagcggctcagggtgcggctggccggctggagcacggaggagctccgggacctgggcgaccactgggcggccgtgtcgggcgcggcggcccggctcgcggcgcagcgcacggagccggacgacctccagcaactgcgccgcacgctcgaggagttcgatcaggccgaggacgcggcggcgcgcagccgcgtctacggccggttccatgtggagttggccgcggccgcgcagtccgcccggctcacccgcgagcaggtcgcgctgcagacggaggtcggggcgctgctgtgtctcgtactcggggacgacgcctaccgtcaggaagtcgccggccgtcaccgcgccgtgatctcggcggtgcaggatggggccgacgacacggccagagcactggccgagcggtgtgtacaggactccacggcgcggctcatcacgctgcgcctcgccctg

SEQ ID NO: 1729 - DNA, 795 bp, Streptomyces avermitilis
  CDS (1)..(795)
atgagcaggagtcccggtccggccggtgcggcggcgacgctggatgtgtcgccgcaggcgcgggtggcggcgcaggcgcgggtggcggcgcaggtgcgttccgcgctggaggcggtgttcgaggccgtcgaggagacgcgggcggacacggcggcgttgctggcgcaagtggccgggctgggtcgtcggccggcgaccgtggatctggccgggctgcggccggggcttcatctgcggctggcgcggcaggagctggtctcgggggtggggttcgtggccgcgccggggctgctgggcgatgtgccgacgtggctggagtggtggcagaccggtgcggacggggcgctgcggccgttgctgctcgacctggacccgcggcagtcggcgtactcggattacacgcactgggactggttcgcgctgccccgtgacaccgggcgccgggcggtggccgggccgtatgtggactatctgtgttccgaggagtacagcctcaccctgtccgcgccggtgcaggtggaggggcggttcgcgggggtggccgcggcggatgtgtatctgcggcacttcgagacggccgtgatgcccctgctgcaacggctgccgggcccggcgcacctggtcaacgcgcgcggccgggtcgccgcgtccgccgaccccgcacacctggccggctccctcaccaagggccccgacttcgccgccgtcctcacccaggcccggccggaacacttcgacggcctgcacctgatgccctgcgacggcgtccccctcgtcctcgtcatggccgagcgg

SEQ ID NO: 1730 - DNA, 666 bp, Streptomyces avermitilis
  CDS (1)..(666)
atggcgtatcaggcaggtgggcagcggccggcgccgcgacccgtccccgcgagtgtggaggctcaggcgtatctgcaggactacgccgcgctcctcgaatccgtctccttcccgtccgtggtcttcgaccaccgctgggacgtcgtcctgtccaacgccgcgttcgagacacttttcggcggcgtggggccgcacccgacggccatgccgggcgacaacttcctccggttcgtgctgttccacccggacgcggccacgatcctcggcgagcacgagtcgagctggtgcctgccgatgctggcgcacttcgccgccgcggtggagcgccacggccaggaccgaggtctgctgtccatccgccgggacatcgcccaggacccgatcatggaagccgcctaccgtcacggcctgccgcactggatccgcgcggtgggggcgaacgccgtcgagcacgacggtgccgtacgcccgctgctgcaccccgatccgcgctggggcaccgactgccgggtggtgggggagaccccgaggacccttcaggacatgggctatacgaggatgacgctggtgctgcgcgaggcgcgccgcccggcggacggccctcgcaggccgcgtcgcgcgggccgcacgtcgaaccatctcagcgtggtgccctcaccggagagg

SEQ ID NO: 1731 - DNA, 654 bp, Streptomyces avermitilis
  CDS (1)..(654)
gtgacggatggcctggaagttccggacgccacggcgacggttctgctgccggccgtcgtggcccgtgtcgcagccctggccgaccggctgggcgtggcgcacgcggaggtcttcgacgtcggccgcctctcggtcgcctcgggcgtcccggagcccgtggtgaaggccctgctgagcgggcgccccgccggtgagccggatcttcaggcccgtttcctccagcggctcgacctgctgcgccgcacccggctcaagcccaacaggcgccggtacacccagcaggagatcgccgacggcgcgggcatgtcgcgccagcaggcgggggccctcatcaacggggaccgccgccccaccatggagcactgcgacgccattcagcgcttctttagggtgcacgccggattcctcacggctgaggaccccgaggcgctcgcgggcaccctccagcgctccgagcaggagctcctccagcagctcgccgaccgggagcgcgcggcggccatggccgtcgacgacccgctggagcggctgttgcaggaccacggcgtccgcggaatcgcctggcgggccgcgcagctgcccaccgaccagcaccgcgacaaggtggcggagtggctcgacatgctcctggagagcgtcaagcggcccgagtcc

SEQ ID NO: 1732 - DNA, 528 bp, Streptomyces avermitilis
  CDS (1)..(528)
atgcgccgcctgtgcggcgagttggtcgcggagctctcgctcccggcgccggcggagcccgccgacctctacgccgcgctgtgcgacggcatgagcagacgccgcggccgccccgtccagtaccgtacggccgcgttcccgcccgggaccgcgagcgggctgtggctcgacatggccgaccaggacctcgtcgtcatcgaggaacgcaccgctcccgaccaccagttggtgatcctcggccatgaactgtggcacatgaaggccgggcactgcagccaccacgtggagggcgccgccgtggcggcccgtctgctcagcgacaccgcggatcttcaggcgaccgtcctgaaggtcgccgcgcgaacccgcttcgaactctcggacgagaaggaggccgagagcttcggtctgctgctcgccagcaagtgccgcagatggctggccggttcgtcgctgcgggggcccgtgcgccgcgacgacgtggcgggccggatcgaggcgtcgctgggctatcgcgggccgcagggc

SEQ ID NO: 1733 - DNA, 1203 bp, Streptomyces avermitilis
  CDS (1)..(1203)
atggacggatccagctactacataccggctgctgccatgggggtcgccctcgcggccaaggcacccgccttgatccgcggctggcgcgacccgctgttgcgttccgtgggcgtgctcctggctctggccggtctggtgttcctgttcgcggccccgccgacgatcgctgaggtcaacgccctcaccgggatcccgaacatctcggcaccgcttgtctactgtgtactgagtgccttcagcgcgtcctgcctggtgctgatcatcaactggcgcggcgggccgcccgaggtgacccgccgcctctctcgccgctggatcgccggatacagcgtggtgagcgtcgccctggtcgtgctgttcctcctcggggaggcccctcaggagcggctgcgggacctcgacacctattacgccaacacacctttcatccgcgagatgatcgtgctctatctcgccgcgctcacggtcgcgggtgtcgccatgaacgtgatgtgctggcgctgggcgatccaggtacgcggctggctgcgggccgggctgctggtcatcgcgttcggcttcatgttcaacatcccttacgcggcggccaagttcaccgccgtggtcgcccagtggaacggcggcaacctggactacctgagtaccgatgtggcccccgtactggcctcggcaggcgcacagataagtgcggtcggcttctgtctcccactggcctgccagcgtatcggggacaactggatcacgtggtcgacctaccgccggctcgggcccctgtggcgcgagttgaagccggtctcgaccttcgccgaccgtgcggtacgcatctcctggtggtcgtcggcagatctccaggtcacccagcgggagtcagacatccacgacggcatgctcggcctgtacccctacttcgattccgaggtccgctgcctcgcctacgacgcggccgtggccgcgggctccgagcccgcccaggcgcaggccgaggccgacgcggcgatggtgacggcggcggtgcgggcgaggtccgccgaccctgagggcagggtcatcagctcagcggaggcaaccgccccgttctcgtccttggacggtccacgcgacctcgtgcggatgtccaatgccctgcgtcagtcacccgtcgtcgcggccgcccgaaggcaggcctcgaccaggtcagagagcgacttccatgagcgaacccgc

SEQ ID NO: 1734 - DNA, 1458 bp, Streptomyces avermitilis
  CDS (1)..(1458)
atgagcgaacccgctagcgtcccccggggcgcggcacctggcagccgcggcacggcctcccccagagccgtcgtcatcggcgcgggactggccggcatgctggccgccgccgccctgcaccgacacgccgaggtcaccgtcgtggaccgcgacgtcctgcctgcggagcccgcgccgcgcaaggggctcccgcaggcccgccacgctcatctgctgtggtccggcggcgcccgcgcgatggaggacctgctgcccggtgtgaccgccgcctggctggccgccggcgcccgccggatacccctcccgaccggcctcgtctcactgtcggcgcagggctggctccggcgctggcccgagatggagttcatgatctcgtgcacccgcgacctgctcgactcggtcatccgtgaacaggttgccaaaaaggagggggtcaccctcttggcgggcaccgaactgctcggtctggagggcggggccttgcgggtgacgggagtacgggtgcggacgcccgagggcgaggagcgcgtcctggaggccgatctggtggtggacgcctcggggcgcggttcgcgctccgtcgcctggctggacgcactgggcgtgccacaggctccgatggacgaggtcgactccggactcgcgtacgccagccggatcttccgggcacccgcaggcaccgaggactttcccgtggtcaacgtgcagccggatccggcacagcccgtacccgcgcagtctgcgacgatcgttcccgtcgagggcgggcgctggctggtgacgctgtcgggcacccacggcggccagccgacggcctccgccgaggagttcgaggcgttcgcccgcggcgtcagagaccccgtcgtgggcgaactgatcgcgcacgcggagccgctgacgaacgtcgtactcactcgcagcaccatcaaccggcggcgcttcttcgagaaggtgaaggactggcccgagggattcgtcgcgatcggcgacgccgtcgccacgtacaacccggtctacgggcacggcatgtcagttgccgcccagggcgcggtggcgctgcgcgagcacgtggccgagcacggactcgcggcccccggactcgcgcgccgggcgcaacgtgccgtggcccttccggtgaagatcgcctgggagctggccacgggcacggacatccgctaccccgaggcgatcggcaagcagcccgggggcacgcagaagctcctgggccgctacgtggagcggctcatgcggaccgcgacgggccggccgctggtcgcccaggcgttcctcggcgtgatcacgctttcgaggccgctctccacgctcgtcaagcccgaggtcctcttcgcagtactgcgcggcccgcggcgctctcccctggccgggccgccgctcacacctgaggagcgcaaggcggtgctgaccgcgaaggagccgtcgggcacgcaggctgccggc

SEQ ID NO: 1735 - DNA, 1041 bp, Streptomyces avermitilis
  CDS (1)..(1041)
atggtcgacgtcccaccaccgcgcccgcggcgcgcactgcggctgcgcccggtgggcgacggcgaactccggctgcaccaccgcgtcgtgcacggctaccgccgcgcctaccgcatggccggcgagggtcccgtactcgtgctcatccacggcatcggggactcctcggcgacctgggccgagctgatccccgacctcgcccgcacccatacggtcatcgcgccggacctcctcggccacggcgcctcggacaagccgcgggccgactactcggtggccgcgtacgcgaacggggtgcgcgatctgctcgcctcgctcgacatcgagtcggccacgctggtcgggcattcgctcggcggcggggtcgcgatgcagttcgcgtaccagttcccggagcggaccgagcggctgatcctggtcagcgccgggggagtgggacgggaggtcaacccggtgctgcgggccgtctcactgcccggcgcgcatctgatgctctccactctgcggttgcccggcatgcggttccaagtggggatgttcgcacggctgatgaggctcctcgacaccgatctgggccaggacgcgccggagttgctgaccctggtggacgcactgcccgacgtgacctcgcgcagtgccttcatccgtacgctgcgggccgtcgtggactggcgcgggcaggcggtgaccatgctcgaccgctgctatctgaccgagggcatgcccacgctgctgctgtggggcgaccgggacagcgtggtgccggtgcggcacgcgtacggcgcgcacgaggcgatgcccggcagccggctggagatcttcgagggcgcgggccacttccccttccacactgaccccgcgcgcttcctcgccctggtcgaggagttcacgggcaccacccgtcccgcccactggagccgcgaacactggcgcgaactgctgcgggccggccgcccgggcagcgcggccggccggcccgacaccgtgcggaaccgggcggtggaacgggacttgaggcaggcgagcgaacgcagcgcgacg

SEQ ID NO: 1736 - DNA, 300 bp, Streptomyces avermitilis
  CDS (1)..(300)
gtgccaccggtgtgcccgggggcgcacgcagttcacgtaccgcacgacgaagccgaccaaggggagagccgaccgatgccgacagccgtactgaccgaccgcgaacgcgccgccgtgcaggcctatctccgcctcctccagaccgtacgagcgacgttcgacggtccgccggacggccgccgaccacccgcggtccccaccgccgcactggcggaggcggagcaggccctgtccgccgcgggcctcgcgggcaacgaggaggagttcttccacctgctgcgcagttggtgcccggagggg

SEQ ID NO: 1737 - DNA, 687 bp, Streptomyces avermitilis
  CDS (1)..(687)
gtgatcgaggagctgctcccggcggcggtcgtggccgtggaggcccacggtgacgaggcggcggtggacggggcgctgtaccccgaggagcaggcggtcatagcgcgggccgtcgagaagcgccgccgcgagttcaccgccgtacgcgtttgtgcccggcgcgccatggagaagctcggcgtgcccccgcagccggtgctgcccggggagcgcggcgccccgcggtggccggccgggctggtcggcagcatgacgcactgcgaggggtactgcgccgccgtgctggtccgcgccggtgagctggccagtctgggcatcgacgcggaaccccacgaccgactgccggagggagtcctctcctccgtcgccctgccgacggaggagcgccgcctgtacgacctcggccggtcccgtccggacgtccactgggaccggctgctgttcagcgcgaaggagtccgtctacaaggcgtggttccccctcaccggcaagtggctggacttcctcgaggcggacatcgagatcttcacggagcccgccgcacagggcaaggccctgtccggcggattccgcgccgaactcctcgtccccggccccctggtgaacggccggcggctcgacgccttcgacggccgctggacggtccggcggggcctggtggcgacggctgtcacggtgccgcaccac

SEQ ID NO: 1738 - DNA, 870 bp, Streptomyces avermitilis
  CDS (1)..(870)
atgaagggggcgagcgtggagtcgacggccggtcgtggacagctgctcgccatcagcgatctgcacatcggatacgcggagaaccgcgccctcgtcgagaagatgcgccccgagtcggacgacgactggctgctggtcgccggtgatgtcgcggagaccgtggccgacatccgctgggccctcgaaacgctggccggacgcttccgcaaggtgatctgggcacccggcaaccacgagctgtggacccaccccaaggacaccgtcaccctgcgcggcctcgcccgctacgagcacctcgtcgacctgtgccgtgagctgggtgtgacgacgcccgaggacccgtaccccgtctgggaggggccgggcggcccggtggccgtcgcaccactgttcctgctctacgactactccttcctgccggcgggctgcgacaccaaggagcaggggctggagtacgcccacgggaccggggtcgtctgcaccgacgagttcatgctgcaccccgacccctacccgacccgcgacgcctggtgccgggcccggatcgccgagaccgagcgcaggctggcgcagctgccccccgagctgtccaccgtgctggtcaaccactacccgctggaccggcaccccacggaggtcctgcactacccggagttcgccatgtggtgcggcacccggctgaccgccgactggcaccgcagattccgggccgaggtgatggtctacggccatctccacattccgcggaccacccaccacgagggcgtccgcttcgaagaggtgtccgtgggctacccccgcgaatggcgcaggcggcagacaccgccgggcacgctgcgccgcattctgccgatggaggtcgaagcccgg

SEQ ID NO: 1739 - DNA, 1143 bp, Streptomyces avermitilis
  CDS (1)..(1143)
atgggctctcgcgtacgcgtctggctcaaccgcacgtacgcggagaacgtgttcttcatggatcagctgcggcgaaatccgcacgaccgggcggtcgagatccatgccacgcacgctgacgccgactcacccgtcctggccgcggcggacacctccgccatggaacccgagggcctgtccccggcgggctacgtcgagtacgccctcgaccagtgcgcgcgccgcggcatcgacgtgttcgtgccgcgtctgcaccaggacgcggtcgtcgcgcatcgcgcggacttcgccgcggccggtacggccctgctggcgccgcccgccgaggccgtggccgtcttccaggacaaggcgacggcgtacgaggcggtgcaggcgatcggcattccggtgccgccgtggcggcgggtgcggaccgaggacgaactcctgtccgctgtcgaggagttggaggcgggcggatacaaggcgtgcttcaagccggcggccggcgcgggcggcgtgggtttccgcatcatcacgcgcacccccttctcgctcgcacacctcaacggcttccccggcccctatgtgcagctggacctggtcatccaggccgtgcgcgacgccgatgagccggtggactggctggtcatgccgcacctcgggcagccggaggtgtccgtggactgcctcaccgggcccgacaaccggatccggatggcggtgggccgcacgaagaacggccgccgccggggcttcacgctccacgagcagtggatcgatcccgccacccggctcgcggagggcttcgggctgcactacctctccaacatccagttccggatgttcggcgacaagccggtcctgatggacgtcaacacgcgcccggccggcggcctgcaccagctctcgctgtgcggtctcaacgccccttgggcggcagtgcagttggcgctgggcgaggacccgggcgaggtggctccgccgttcctgggcacggactacacggtcgtgtcgggaccgcgcccgctgcgggcggtctcgctcccccagcagcgcacggaggagccggagaccgtgctgccggccgtgcccgcaccggccgcgaagcctgtctccgcaccgccggcggaagcgggggcacccgccaccgcgccggcc

SEQ ID NO: 1740 - DNA, 1683 bp, Streptomyces avermitilis
  CDS (1)..(1683)
gtgcgcatcacgatgttcagacgctccagacgttccctcctcgccctgctgggctccgccgccctggctctggccggggcggtcgccctccccggcacggcccaggcggccaacatcctgtccaatcccggcttcgagtcgggcagcctgtccccctggtcctgcacgggaaatctggggtcggtcgtctccagtcccgtgcacggcggctccaagtcccttgcgggagccgtgagttcgagtgacaccgcacagtgcagccagaccgtcccggtgcagccgaacacgacgtacagcctgtcgggctgggtgcgcggcagctatgtgtacctcggcgtggacggcggcgcctcgacctggacgacgtccacgtcggcgtacagccggctgtcggtctccttcaccaccggcgcctcgcagaccagcgccaagatctatgtccacggctggtacgcgcagggcacctactacgccgacgacatcagcctggacggtccgggcggaggcggctcggacacccaggcgccgacggctccgggcagcctccgctccaccggcaagacctcgtcgagcgcgaccctggcgtggaacgcctcgacggacaacgtgggcgtcacgacgtacgacgtctacagcggctccaaccaggtgctgagcgtctccggtacgaccgccacggtcagcgggctgtcgccgagcacggcgtacacgttcactgtgaaggcgcgggacgcggccgggaacacctcggcggcctccaactccgtgtccgtcacgacggacgcgggcagcggcggcggcaccggcttcaagcaggccgcgccctatctctacctcggctggggcgatccgccgagcgcgacctcggtgatgagctcgaccggcatcaagtggtacacgatggcgttcatgctggactccggcggctgcaaccccgcctgggacggcagccggccgctgaccggcggcaacgaccagagtgtcatcaactcggtccgctccgcgggcggtgacgtcgtcccgtcgttcggcggctggtcgggcagcaagctcggcgccaactgctcctcggcgagcgcgctggccggggcgctgcagaaggtgatcgacgcctatggcctcaaggcgatcgacatggacatcgagaacacggacgagttcgagaacgccaccgtccaggaccgcatcctgaccgcgctgaagacggtcaaggccaacaatccgggcctgcgcacgatcgtcaccttcggcaccacgacgaccggccccacctactggggcaaccgcctcatcgagcaggcccaggccctgaacgccggcatcgacgtcttcacgataatgccgttcgacttcggcggcggctccgacatgtacggcaacacggtgaacgcgaccgacggtctgaaggccaagctcaagtcgacgttcggctgggacgacgccaccgcgtactcccacatcggcatctccggcatgaacggcctgtccgaccagcaggagaacacgtcgccggcgacctggacccagatccgcgactgggccaactcgcaccacatcgcccgcctcgccttctggtcggtcaaccgcgaccggccgtgccccggcgggggcgtggtgagcaactgctccggcatcagccagaacacctggcagttcacctcgatcacggccggtttcaccggc

SEQ ID NO: 1741 - DNA, 1248 bp, Streptomyces avermitilis
  CDS (1)..(1248)
gtgtccatgcagccgtggttcaccgacgccaagttggggatcttcgtccactggggcgtctacgccgtcgacggcgtccaggaatcgtggtcgttctacgacgacatcgtgccgcacgaccagtacatgtcccagttcgaccgcttcaccgccgcccgctacgacccgcgcgactgggcggcgctgttcgcccgtgccggcgccaggtacgcggtcctgaccagccgccaccacgacggcgtcgccctgtgggacaccgcccacggcaacctgaacgtcggccgggacctgatatccggctacgccgacgcactgcgcgagcggggcctcaaggtcggcctctactactcgcactcggactggaaccaccccgactacgcctccacgcgcaagccgggacgcccgccggagctggcggacaaccgctactccgaggtcgccgccgagtacgaggacctggccgcctgggagcggttcatcgcctaccgagacggccagatccgcgaactcaccagccgctacaagcccgacctcatgtggttcgacggcgagtgggaccgcagtgaggagcagtggcgcatccccgaactcgccgcgctcatccgctccgaggtgccggacgtcgtcttcaacgcccgcatgctcagcgagggcgactacgcgacccccgagcagggcgctcccgtcgtgccgccccagggcccctgggagctgtgcctgacgatcaacgactcctggggcttccagcaccacgaccacaaccacaaatcggtcacccagctgatccgctacttcaccgagacgatcggcggcggcggcaatctgctcctcgacgtcggtccgaaggaggacggcaccatcccggccgaacaggtcgagcgcctcgagggcctcggcgactggatcgccaagcacgcggaggccgtctacgggaccgtgcgcggactgcccgcgggccaccactacgggccgagcaccctctcggcggaccgccgcacgctgtatctgaccctcttcgacgcaccgcgcgccgagatcggcgtacgcggcatggcgggcacggtgcgccgggtcacggtgctcggcagcgggaccgagctggcccaccgggtcatcggcgggctgcacgaggcaccgggcgtgctctggatcgaaccgccggccgcggccgacctcgacccgcacgccacggtgctggccgtcgaactggacggcgagctggagctgtaccgcgggccgggccgcttc

SEQ ID NO: 1742 - DNA, 3066 bp, Streptomyces avermitilis
  CDS (1)..(3066)
atgcacgacgaacgccgccggatcgaggagcgcgtagagcgcatccacaaccagcgcatcaagcccgcggtctacgcggccgccgtccccttcgccgtcgaggcctggcaggcgccgggcgagcccgttcccttcgaggaggccgcggccgcctcgtacgcgccgttcgccatggacaccccgtgggggccgccctggggcaccacctggttccggatgcgcggccgggtgcccgccgaatgggccgggcggcgcgtcgaggcggtcatcgacctcggcttcaccggcgactggcccggcaaccaggccgaggcgctggtccaccgcaccgacggcaccccgctcaaggcggtcaacccgctcaaccagtacgtgccgatcggcaacccggccacgggcggcgaggagatcgactacctggtcgaggcggcctccaaccccgacatcctcgcaggcgacttcgcgcgcccgaccccgctcggcgacgtcctcaccgcgggcgacaagccgctctacaccttccgccgcgccgacctcgccatcctcgacgaggaggtctggcacctcgatctggacgtccaggtgctgcgcgagctgatgctggagctgggcgagcacgacccgcgccggcacgagatcatgcacaccctggaccgggccctggacgcgctggacctggacgacatctccggcagcgcgacggccgtccgcgaggtcctggccccggccctcgcgaggcccgcgcacgccagcgcccacaccctctccggcgtcggccacgcgcacatcgactccgcctggctgtggccgatccgcgagaccaagcggaagacgtcccgcaccttctccaacgtcacctcgctcgccgacgagtacgacgacttcatcttcgcctgctcgcaggcccagcagtacgagtgggtgcgcgacaactacccgcacgtgtgggcccgcatccaggagtcggtgaagaagggccagtgggcgccggtcggcggcatgtgggtcgaggccgacggcaacctgcccggcggcgaggcgctggcccgccagctgatccacggcaaacggttcttcatcgagcacttcggcgtcgagaccaagggcgtgtggctgccggactccttcggctacaacgcctcctacccgcagctcgccaagctcgccggcaacgagtggttcctgacccagaagctctcctggaaccagaccaacaagctgccccaccacaccttctggtgggagggcatcgacggcacccgcatcttcacgcacttcccgccgatcgacacctacaacgcccgcttcagcggcgaggagatgtcccgcacggtccgcaactacgcggacaagggccgcggtacgcgctccctggcaccgttcggctggggcgacggcggtggcggccccacccgcgagatcatggaacgggcgcgcaggctggcggacctggagggctcgccgaaggtcgtcgtcgaacatcccgacgcgttcttcaaggccgcccgcgaggagtacccggacgccccggtctgggtcggcgagctctacctggagctgcaccgcgccacctacacctcccaggcccgcaccaagcagggcaaccgccgcagcgaacacaagctgcgcgaggccgagttgtgggcgacgacggccgccctgcacgcgccgggctacgcctacccgtacgagaagctggaccgcctgtggaagacggtcctgctccaccagttccacgacatcctgccgggctcgtcgatcgcctgggtgcaccgggaggccgaggccgaatacgcccgggtggccacggaactggaggagctgacggccgaggcggtggccgcgctcggcggcggcggtccgcgcgtcttcaacacgagcccccgcgaccgcgccgaggtggtccgtacgtccaccggggccccggcgtacgtggaggtaccggcgggcggcagcgctcccctcgacggcgccgcacccccgcggccggtgacggtcaccggccgcgtcctcgacaacggcctggtccgcgtcgaggtcgccgaggacggaaccctcgcctccgtaagggatctgacggcggaccgcgaagtcctcgccgaccagggcaacctgctccggctgcacaccgacctcccgaactactgggacgcctgggacatcgacaagcactacaagaaccgctacacggacctgctggacgccgactccgtcacggtcgtcgaacaggacccgctgatcggcgcgatccgggtggagcgctccttcggcaagggttcgaagatcacccagacgatcaccgtacgggccggcagccgccgcatcgacgtcgagacggagatcgactggcacgaggccgagaagatcctcaaggccgcgttcccggtggacctgcgcgccccgcactcgtccgccgagatccagttcggccacgtccagcgccccacccacaccaataccagctgggaggcggcccgcttcgaggtctacggccatcgctgggtgcacatcggcgaacccggctacggcgtcgccgtgatcaacgactccacctacggccacgacgtctcccgcacggtccgcgaggacggcggcacgaccaccacggtccgcctcagcctggtccgcgccccgcgcgtgccggaccccgaggccgaccagggccggcaccgcttcacctacgcgctgctgcccggcgcgagcatcgaggacgcggtcgcggagggctacgccctcaacctgccgctgcgggtcgcggacgcccagggagcgccggagccggtcgtgtccgtcgacggcgccggcctcaccgtcgaagcggtcaagctcgccgacgacgcctcgggcgatgtcgtcgtgcgcctctacgagtcgggcggcggccggtcccggggcaccctgcgcaccggcttcccgctcgcgggcgtccacgtcaccgacctgctggagcgaccgctcgccgagggggccggcgacgcggtcgtcgacggtgacggcgcggtcgccgtggaactgcggcccttccaggtactgacgctccgtctgaagcgcgccgcgaccgcccag

SEQ ID NO: 1743 - DNA, 1335 bp, Streptomyces avermitilis
  CDS (1)..(1335)
gtgaagctgacgattctgggcggtggcgggttccgggtgccgctcgtgtacggggcgctcctcggggaccgcgccgagggccgcgtcacccgggtcgtgctgcacgacctggacgcggggcggctcacggccgtggcccgcgtgctcgccgaacaggccgccggggatccggacgcgcccgaggtgagcttcaccaccgacctggacgaggccctgcgcggcgccgacttcgtcttctccgcgatccgcgtcgggggactggaggggcgcgccgacgacgagcgggtggcgctggcggagggtgtgctgggccaggagacggtcggcgcgggcggcatcgcgtacggactgcgcacggtcccggtcgccgtcgacatcgcgcggcgcgtggcccggctcgcccccgacgcctgggtcatcaacttcaccaacccggcgggcctggtcaccgaggccatgtcacgccacctcggcgaccgtgtcatcggcatctgcgactcgccggtcggcctcggccggcgcatcgcccgcgtgctcggcgccgacccgcgcgaggccttcatcgactacgtcggcctcaaccacctcggctgggtacgcggtctgcgcgtcgcgggccgcgacgaactcccgcgcctgctcgccgaccccggactgctcggctccttcgaggagggcaagctcttcggccccgactggctccggtcgctgggcgcgatccctaacgagtacctgcactactactacttcaaccgggaagccgtacgcgcctacagcgaggccgagaagacccggggcgccttcctgcgcgaccagcaggcgcggttctacgaggagatgaagcgggcggactcctccgccctgtcggcctgggaccgcacccgtgccgagcgcgaggccacgtacatggccgagaaccgcgacgcggcgggcgccggcgagcgcgacgccgacgacctctccggcggctacgagaaggtggccctcgccctgatgcgggccatcgcccgggacgagcgcacgacgctgatcctcaacgtccgcaatcgcggcgcgctcacggtcctcgacgccgaggccgtcatcgaagtcccgtgcctcgtcgacgccaatggcgcgcacccggtcgccgtcgacccgctccccggccacgccacgggcctggtgtgcgcggtgaaggcggtcgagcgcgaggtgctgtccgcggccgagtccggctcccgtgcgacggccgtgaaggccttcgcgctgcaccccctcgtggactccgtgaacgtggcccgcaggctggtcgacggatacacctcggtccacccaggtctgacgtaccttaag

SEQ ID NO: 1744 - DNA, 783 bp, Streptomyces avermitilis
  CDS (1)..(783)
atgacgagtactgttcatcgcgtgctggcagagcgacgacatcaactcatcctgcgggccctgcgctccggcggccccgcggccgtgaccgacctttcggagcagctgggcgtgagccccgccaccgtccggcgtgacctgctcagactcgaggaggagggcctgctcacccgggtgcacggcggcgccgtggtggaggagggcgaccagcccttcgccgaggtcgccgagatgcgggtggccgagaaggacgccatagccgtgcacgccgcggccatggtcgccgacggtcagtcggtgctgctcgacatcggcaccaccgcctaccggctggcccggcagctgcacggccgccggctcaccgtgatcaccagcaacctggtggtctacgaggagctcgcggacgacgagggcatcgagctggtgctgctcggcggcatggtccgccgcgagtaccgctccctggtgggcttcctcaccgaggacaatctgcgtcagctgcacgccgactggctcttcctcggcaccagtggagtgcggcccggcgggcaggtgatggacacgacggtcgtcgaggtgccggtcaagcgggccatgatccgggcgggtgagcgggtcgtcctgctcgccgactcggcgaagttccccggcacggggatggccagggtctgcgggcccgaggacctggacgcggtggtgacggacgggccggtggacgcggcgacgcggtcctccctggaggaagcgggcgtcgaggtgatcgtggcaggaaaggtgcaagcg

SEQ ID NO: 1745 - DNA, 1035 bp, Streptomyces avermitilis
  CDS (1)..(1035)
gtgggcgacgaacggcccgatgtcctgctgaccgggctgctcttctacgacctcgtcctcaccgggctgggcaagccgccgacacccggtgaggagatctggaccgagggcatgggcgtgagccccggcggtatcgccaacctggccgtggccgcctcccgtttcggcctgcgcacctcgctggccacggtcttcggcgacgaccactacggcgcgtactgccggggtgtgctcgccggccaggagggcatcgacctctcgctctcccgtaccgcggacggctggcacaccccggtcaccgtctccctcgcgtacggccacgaccgcgcgctggtcacccacggccaggaccctccgtactcgcaggacgcgctgatgggcgacccgcccgaggcgcgcaccgccctcgtgcacatcgaggccgagccgcacgcctggctcgcaaaggccgccgcgaacggcacccggatctacgcggacgtcggctgggatcccacccagcagtggtcccgcgacctcctcgaccagctctccctgtgccacgccttcctccccaacgaggccgaggcgatggcgtacacccgcaccgacagcgcgatggccgcgctcggcacgctcaccgacctggtgccggtcgccgtggtcacgcgcggcggggacggcgcggtcgcggtggaccagacgacgggcgagtacgccgaggtacccgccctcgacatcgatgtcctggacccgacgggcgccggggacgtcttcggcgcgagcttcgtcgcggcctcgctcggcggctggcccctggcggagcggctgcgcttcgcggtcctcgccgccggactctcggtacagcggcacggcggtgcgctggccgcgcccggctggtacggcgtccaccgctggtggcactcgctcgaagaccccggactgcggcgcgcgtacggcttcctggccgaccggatcccagcggacccggggccgcccgtccggcacgcgcccgtgactccccccgatgccacgcgtcgcccgagcacctcccga

SEQ ID NO: 1746 - DNA, 1293 bp, Streptomyces avermitilis
  CDS (1)..(1293)
gtgggagcagtgcggctctcacgaagaggcctgctgcgcgcgggcctggccggtacggccgccaccgcgctcggcggcctggcgaccggctgtgccgtcccgaccggttccaccggccggaacatggtgctgtggtactggagcggcgggctgagccccaaagtcgtccaggacgccaaggcccgctacgacagcgcggtgaacctacaggccatccagatcggcggctactaccgctcgaagctgatgaccacgatgaccgggcgcgcccacatcccggacatcgtcgggctcaagggcgaggacatggcctcgtacctgccgaactccgaccagttcgtggacctgcgcgcgctcggcgccgacaggctcaaggaccggtatctgccctggaagtgggacgagggcatcgccgaggacggctcgatggtgggcttccccatcgactgcggtccggtcgcgcactactaccagccggccgtcttcgagaaggcgggactgccgtacgagccggcggacgtctccaaggagctggacacctgggagaagttcctcgcggccggtgagcggctcaagaagcgcgtcccgggtgcgttcatcctcacggacgccctcagcatctacggcatgtcggtcaaccagacgaccaagcggttcgtcgacagggaccggcacttcatcggcgaccaggagcatgtgcgcaccgcctgggaccgggctgtcgaggccacccgccgaggcctggtctcgaagatcatcaacgggacgccggacaacatctcggccaccgagcggggcctgctgcccagccaactgaacgcctcctgggcggccggcgacatcaagctcaacacgccgaagaccaagggcaagtggcgggtggcgagctgtccgggcggcccttcgaacatcggcggctcgttcctggcgatcaccaaggcgtgccgggagccggagaaggccttcgagatgatcacctggatgctcgacgcgggcaaccaggcccagggattcgtcgactcggtgctcttcccgtccactccggcgtcgtacggcatgaagaagctgcgcgaacccgacgcgttcttcggcggccagatcaccatggacgtcttcggcccggcggcggagaagatcccggtcgccttcaacagcccgtacgacatcgcgctcaagaccccgatcgacgacgagctgcggaacttctccgtcctcggcaaggacccggagaaggcctggaaggacgccatgagcaagtgccggcgcatcgccgaccatctgggggtgagctac

SEQ ID NO: 1747 - DNA, 960 bp, Streptomyces avermitilis
  CDS (1)..(960)
atggctaccgcacccgtggtcgagacctccccggcggtcgtgtccgccaccccaaccgcccgctccgggaagggcgtcctgagccactggcggctgtacgccgcgatctcccccttctatctgctcttcctcgccttcggtctgataccggtcggcttctcgctctacctgtcgttccaccgctgggacgggctcggctcgatggagttcgcggggctctcgcagtaccgctatctgctgtcggacagccagttctggacctcgatcgggaacacgatcgtcatctgggcgctggccaccatcccgatgatcctcctggcgatggtcacggcggtgctgctcaactccgcggtccgcttcaagaacgtctaccgcttcgccttcttcctgccgaacgtcacctcgatcgtggccgtcgcgatcatcttcggctcggtcttctccaccaacttcggcctgatgaacgccgtgttgcaggcggtcggacttgaccaggtggcatggctgaacactccctggggcatcaaggtcgccatcgcgaccctcatgacctggcagtggaccggctacaacgcgatcatcttcctcgccggtctccagacgatcccgggcgagctgtacgaggcggcgcggatggacggcgccgggcccctgcagacgttcttccgcatcacgctgccgctgctgcgtccggtgctgctcttcgtgctggtcatctcgaccgtcaccggactccagagcttctccgaaccgcaggtgctgttgcagaccacggacaacaactcgtcgttcgcgggcggcccgggccacgcgggccagaccatggtcctctacttcttccagcagaccttcgacaacaacgacttcggctacggcgccgcggtggcctggggcatcttcctcgtcgtcgtcctcttctcgatcatcaactggcgcctggtgcagcgccggggcgaagaa

SEQ ID NO: 1748 - DNA, 834 bp, Streptomyces avermitilis
  CDS (1)..(834)
atggcatccatcaagggttcacggcagcggggcatcgcgctccatctggtcctcgtcatcggcctgctgctctcggtcttcccgttctactgggccgtgatcatgtcgacgcactcgtcgaccgagatcttctcctacccgccgaagctgctgcccggctcgcacttcctcgagaacgtccggcatctcttcgacaacgtcgacttcttcgggtcgatggccaactcgctgctcgtggccggctcggtgaccgtcctggtcctgttcctcgactcactggcggccttcgtcttcgccaagttccacttcccgggccgccgggtgctgttcgcgctgatgatggcgatcttcatggtgccggcgcagctccaggccatcccccagttcgtgatcatggcgaagctgggctggatcggctcgatgaccgcgctggtcgtcccggcggcggccaacgcgttcggcatcttctggatgcgccagtacatgcagagcgccatccacgacgaactgctcgacgcctcgaagctcgacggcgccggcttcctgcgccagtactggcacgtggcgctccccgtggtccgcccgggtctggcgttcctcggcatcttcaccttcatgggccagtggaacgactacgcctggccgctgatcgccctcaccaacccggacaacgtgaccctccaggtcgccctgtcccagctcaacggggtgcacggcacgaccgactacgggatggtcatgaccggcgcgctgctcgccctcgttccgctgctgatcgtgttcgcgatcggcgccaggcagatcatcgccgacctcggcaagggagccattcgc

SEQ ID NO: 1749 - DNA, 2922 bp, Streptomyces avermitilis
  CDS (1)..(2922)
atgtcccgcgatccgctgatcgcgctccgcccctgggagtcacccgaggtgacctcctgggggcggctgccgatgaacgccgtcgaccgccgcaccggggcgctcccgctggacggcgagtggcgcttccagctgctgcccacgcccggctcacccgtgaccgaagcgtggtcgtcacagcatgtccccggcgcctggaccgtgcagggcaccgacgacctgccgcagtacaccaacgtcacgatgccctggggagagttcccgcccgcctcgcccgccgcgaacccgacgggcgtgtacgagcgcgaggtggacgtcccggccgagtgggccggacgccgggtcgtgctccgggtgggcgccgcggagagcgtgctgctcgtccacgtgaacgggcggccgacgggcatctccaaggactcgcacctcgcggccgagttcgatctctcggacgtcgtacgtcccggggagcgggccaccgtacggctcaccgtggtgaagtggtcggacgcctcgcacctcgaggaccaggaccactggtggcacggcgggatcacccggtcggtgctgctgtacgcgaccgatccactgcatctcgcggacgtgaccgtgcgggcgcgcccggacggcgggctgcgggtcgactgccgggtgcggcacgccatgggccggctccccgggggctggtacgtcaccggggagctggcgggccacctcctcgcccaggacgccgagttcgaccggctgaacgcgcaggacgagcgggtctccgacttcctcggcgaggcccgcctcaccgcgctcgtgcgcgaggtgcgcccctggaccgccgagacgcccgagctgtacgagctgacggtgcgcctgcaccgcgccgacggctcggtcgccgacaccgcgcacccgcgcgtcggcttccgccaggtcgagatccgcggccgggacctcctggtgaacggcgagcgggtctacatccggggcgtcaaccggcacgacttccatccgctgacgggccggacggtgtcgtacgacgacatgcgcgccgacctcgtcacgctcaagcggttcggcttcaacgcgatccgcaccgcgcactaccccaacgacccggctctgctcgacctcgccgacgagctgggcttctacgtcgtcgacgaggcggacatcgagtcgcacgaccacgcccacgagatcgccgacgacccgcgctacacggcggccttcgtggaccgcgtctcccgcatggtgctgcgcgacaagaaccacccctcggtcatcgtctggtcgctgggcaacgagtccgactacggcgcgaaccacgacgcggcggcgggctgggtccgccgccacgacccgacccgcccgctccagtacgagggcgcggccaagctcggctgggccgatccgacggtcgcctccgacatcgcctgcccgatgtacgcgccggtcgaggactgtgtcgcccacgcgctgtccggcgagcagaccaagccgctcatccagtgcgagtactcccacgccatgggcaacagcaacggcacgctggccgaccactgggccgccatcgagtccaccccgggtcttcagggcggtttcatctgggagttctgggaccacggcattctgcaacgcgtgaacgacggaagaccggccgggcgcgccggcgccgggctgtatgacaacggtgtcgcggcgcagggccaccgctgggcctacggcggcgacttcggcgagacggtccacgacggcgcgttcatcgccgacggggtcgtctttcccgaccgcacgcccaagccggtgatgtacgagcaccgggagatcgcggcgccggtgcggctcgcgtacgacggcggtgacctgcggatctccaaccaccagcacttccggggcctggagtggctggccgcctcgtgggagctgtcgctcgcggagggcggcacgctgaccgcgcccgccgggctgcccgacgtacgggcgggtgagtcggccgtggtgccgatgccgttcgccctgccggaggacggcggcgaggcctggctgacgctgcgggtgacgacggccgacgacgaggcgtgggcgccgcggggcacggaggtatgtgtgccgcgggtgcggctgcgggcggctgccccggtggcttccgcgccgctgacgacgggcgctcccgtccaggtcgacgaggacgggctgctcgtccatccgctgctcacggccgccccggtgctgtcgctgtggcgggcaccgaccgacaacgacgagatcggcggcatggcggcgcgctggcgggcctggggactcgacgcgctcgaacgcaaggtcgtcgatgtacgccgtgcggccggcagcgtcacggtggtcgccgagtacgggaccatggcgggtgccgtgcggcacgagcaggtgttcacgcgcgtcgagggcggggtgcgggtcgaggagacggccgagctgccggccgggctcgacgacgtggcacgcgtgggctcggtgttcgagaccgtcgcggggctcgatgtcctcgagtggtacgggcagggcccctgggagtcctatccggaccggagcgggggcgcccccgtcggccaccactcccgccccgtggacgagctgttcactccgtatctgcgtccgcaggagagcggcgggcggcacggtgtacgccggttcacgctctcggcgccggacgccacgggcttcgcggtcgagctggacgaaccgcgccaggtgaacgtgacccggtaccgggccgcggacctggccgccgccacccaccacgacgagctggtgccgcggcccggctgtgtggtgcacctcgacgtcgcgcaccgcggcctgggtacggcctcctgcggtcccgacacctcacccggccacctcgtcccgaccggcacacatcgctggtcctggacgctgcgcgtgctc

SEQ ID NO: 1750 - DNA, 1686 bp, Streptomyces avermitilis
  CDS (1)..(1686)
atgaccgagcagcaactgcccgcctgggccgacccgtccgtctcccccgccgcgctggacccccagggcatgtcgcggcgcgggctgctgcgccgcgcgggcctgttcggcgcggccttcgcggtgggctcgctcgcgacacccgcggcggcctcttccggacgctacggcggcaacgatccgcggctcgcctacctcgtcggcgaccaccacatccactccgtctacagccacgacgcgaagtacaccttctcccaactcgcccgggccggcgaccggtacgggctcgactggatggtcttcaacgagcactccaacttcggacacgccgactacggcgcgaagctggagcaccaggagatcctgaaggcccgcgccgagaacccgcgccagctgatcttccagggccttgagtggtacatcccggccgccgagcacgccacggtcttcgcggcgcccggaccgcacgaggtggatctgctcacgcgcttcgagctcgcctacgacgggaagctgctcggctacacggacggcgccacctcgaacccgaacacggcccgcaacgaggcccacgccatcaaggccatccagtggctcgccgaacagcgccgcaccggctacgtcgacgacgtgctcgtcctcgccaaccacccgatgcgcctcggcatcgactccccgcacgagatgcggggctggcgcgacgcggcccccgagatcatgatcggcatggaaggcgcgcccggcgcgcagggcggtggcatacccggctgggtcggctcggggcagcagcgcggcgagtacgtcaacaagccgtccgcgaactcctggcccggctacccggaggacgcctacgtcctgtacggcggcttcgactggacgacggcgaccgtcggcggcctgtgggacgcgatgctcgccgagggcaagctgttcacgatcacgaccaactccgatgtgcaccgggtcgtcttcgacacctggaagaacggcgactgggcacccgggcggaacttcgacaacaccgggcacctccccgacccggtcaacaccgacagccagcagccgggcggcgacttctggcccggccagttcagccgcacccacgtgggcgtgacccgctacggctaccgcgcggtgatggcgggcctgcgcgcgggccgggtctggctcgaccacggccatctgctggacgggctcgacgtccgcctgaagcgggactgcgaccacggtccgggcgtgaccatgggcggccggctgcgcgtccgcaagggcgagaagctcacgctgagcgtcaccgtgacgaccgcgtcgcgccccaacccccacggcatcctgcccgagttggcccacgtcgacgtggtccggggcgcggtgcgcggcccggcggccgaccgcgacgactggcgggcgcccgacaccagggtcgtccacacgcgggacgtgagcggccgcaagggcacgtacaccctgcgcatcccgctggtcgcgggcgacgagtccttctacgtccggctgcgcggcagcgacggcaaccgcaacggtacgggctacctgggcgcctcggtcgacccgcatggcccgattccgcacgtgcccggcaacggtgacccgtgggtcgacacatggttctacgcgaaccccgtcttcgtcgatgtggtgggcggccgacaggagaaccgcccggcg

SEQ ID NO: 1751 - DNA, 2763 bp, Streptomyces avermitilis
  CDS (1)..(2763)
gtgattccagcccgcacacggcacaccgtcgccattgtcggagcgggtgcggccggcacactgaccgcgatccagctgtgcgagacggcgacgcgccgccgtacgcccctcgacctcgtgctcgtcgacccggcgcccgaggccggccgcggtaccgcctacgccacgtccgacccgcggcatcggctcaacgtgcccgcgggcggcatgagttgctatcccgacgaccccgggcacttcacccgctggctgtgccggcacggcgaaccgaccgtcaccggcgccgacttcgccacgcgctaccggttcggcgcctatctggccgacacgctcggtcaggcgatcgtccgtgcgcagggggtggtgggcgtgcggcggctgagggtgcgggcggagagctgtaccgacgcccccgacggccgggtggagcttcacctcgccgacgggggccgcgtcacggccgacagcgccgtcctggccaccgggcccgcgggctcgccgggcgactgggcaccgcccgcgctgcgcgcctcggcgaggttcgtcgcggctccctgggccccgggcgccctggacggcccgcgcgcggacggtgccgacgtgctgctcgtcggcaccgggctcaccgccgtcgatctggcgctcacgctggaccggcccgggcgcacggtgcacgccgtctcgcgcagcggtctgctgccgcagccgcacgcgctcactccggcgggcacgatgcccgcacccgaggacctgggatcctccttggcggagctgcggcgggccgtctaccgacacatcagccgggccgtgcgcacccacggcgactggcgtcccgccctcgacagtctgcgcccgcacaccgcgaggctctggcgcagcctgacgcccgacgagcgcgcccagttcctgaaggaggagggcgcccggtggaacacacaccggcaccggatggcacccgcgaccgcggagtcgctgacccggcgacgtacggcacggcgattgcgcgtgtatgccgggcggatcgtgggtgtgggtgtgggtgtgggtgagggtgcaggtgtggtcggggccggggatgaaggtgcggcggcccgttccgggccgggcggcgtaccggcccacttccgtccgggcggcatcctgaccgtctcgctctccggcggtcgccggatacgcgccggttgggtcgtcgactgcaccggcccggggccccgcctcgacgaccccctgtggcgctcgctcttcggctccggcgccgccgtgcccgggccgctcggcatgggggtcgccaccggtgacggccgtctcctcgacgcgcggggccgtgccgagcgcccgctgttcacgctcggggctccgcggcgcggtgagctgtgggagaccaccgccatccccgagatccgggtccaggcggccgcgctggcccaggagttgctcgcgcccctcacccggccggcccgggccgcccgccgaccgcgccgccggcccgtcgacgcgcacgggctcgccctgtccacccacgccgaggcggccgccgcctaccgcaccgggctcgaccgggtcctcaaggtcagggccgcagccgaggacgccttcgggcgcgcggtgaccctcgacccgggcttcgcgctcgggcacgccgccctcgccctggtcggccacgagtgcggcgccgaggtcgacgtaccccgcgccctcgccgacgcacagcgctccgcgcgcgagcgggccgacgagcgggagcggtccttcgtcgacgtcgtcacccgccgcatccacggtgacgacggcgacggcgccctgctgcggcacctggaggcgtaccccgccgacgcgctcgcgctcgccaccgccgtgcccaccatcgccttctccggcatcaacgacctcgacgacgcctacgccctgcggctggtcgagcgcacctcaccggtgtacgacgggcactggttccccacctcgctgctcgccttcctccgccaggaggagggccggtacggcgaggccggggagctggcgcaccgcgcgctggccgccgagcccgccgccggacacgccgtgcacgcgctcgcccacgtccactacgagtccggcgcgcacgcgactggccgggactggctcgacggctggatctcgggccagggccggggcgcggtccaccgggcccacttctcgtggcacgtcgcgctgcacgaactggccctcgacgacacggcggccgtacgcaaacggtggttcgcgcagctggcgccggggcgcgtgaccggggtgcgggcgctcgtcgactcgggttcgctgctgtggcgggcccggctgagcggcagttggcggggccggatacccgccgcggacgtcctcggcaccgtcgcccaggaggtcgtcgagcggcccgcgaccgccttcaccgccctgcacgcggcggtcgccctggccgccgccggtgacctggcggccctgcgccggctgcgcgaccacgccgccggggcggacgaggtgcagcgcgagatcatcgtcccgctctgcgagtccttcgccgctctcgtcgaggagcgcttccacgacgcggcccgcggcctcgacgcgctcctgcccggcctccgcaaggtgggcggcagcgcggcgcagcgggaggtcgtcgaggagacactgctgtacgccctcgtggcaggaggccggtgcgacgccgcccggcggctgctggacgcccgcctcgaccgccagcacgcgcccagggaccgacgcatgctggcggggctgcccgtc

SEQ ID NO: 1752 - DNA, 1269 bp, Streptomyces avermitilis
  CDS (1)..(1269)
gtgggcgtcccgcacatatcgaacggatccgggcgacagtcctggtcgcgacgcggggccctggccgcactcgccgccgccctgccggccaccgtcctcaccggctgcggcggttttgcggacgcctctgaggacacgaagagcacgggcggaggcacggcagggaacacggccggcacggccgacgcgaagaccaccgaggcgaaggcgcccaccctcaccgtcaccccggccgacggcacgaagaaggcggacttcagcagccccgtcgaggtcaccgtgacccacggcaccctggcctccgtcaaggtcagcggcaacgacggcgccacgctcgccggccgctacaacgacgcccgtacgaagtggacgtccaccgggaacccgtactccggcaccacatacacggtcacggccaaggcgaagggagccgacgccgagaccgtgaccttctccaccaagtcccccggcgagaccttcgtgggctacttcacccccgaggcgaactcgacctccggcgtcggcatgcccgtatcggtcaacttcacccacgccgtcgcggaccgcgccgccgtcgagaaggcgatcacggtgaccgccgagccggcggtcgaggtggtcggccactggttcagcgacacccggctcgatttccggcccgagacgtactgggccgcgggcacgcggatcacgctcggtctgcggctcaaggacgtcgagggcgcggacggcgtctacggcacccagtccaaggacgtcaccttccacatcggccgcgagcagatcagcacggtcgacctcgccaccaggacgatgacggtgcggcgggacggctcgacgtacgcgacctaccccgtcaccggcggcgacgccgaccacaccacctggtccgggatcatggtgatcagcgagcgtttcacggagacgcggatggagtcctccaccgtcgggctcggcgacgagtacgacatcaaggatgtgccgcacgcccagcggctgaccacctccggcacgttcatccacggcaactactgggccgggtcctccgtcttcggtcacaccaacgcgagccacggctgtatcgggctccaggacaccaagggcgcgaacgacagctccgtggcgggctacgcgttctacaagagctcgatgctcggcgacgtggtcgtggtgaagaactcgggcgaggacacggtcgatccgtccaacggcctcaacggctggaacctgtcgtgggaccagtggcgggcgggaagcgccctttcccgt

SEQ ID NO: 1753 - DNA, 1398 bp, Streptomyces avermitilis
  CDS (1)..(1398)
atgagtgaaacttccggcatatccgcgagacggcggtcactgcggcgcgcgctcgtcgccgtgctcggcaccctgagcctggcggcggccgccgccacagccgcgaccctccccgcgaacgcctccgcccccacgcccccggcaggctggacccaggtcttcctcgacgacttcaacggcgcggccggttccggcgtcagcaccgccaactggcagtacgacaccggcaccagctacccgggcggcgccgccaactggggcacgggcgaggtcgagacgatgacctccagcagcaacaacgtgtcgctcgacggcaacggaaacctccggatcaccccgctgcgcgactccgcgggcaactggacctcgggccgcatcgagaccaaccgcaccgacttccagccaccggccggcggcacactgcgggtcgagtcacgcatccagctgcccaacgtgaccggcgccgccgccaagggctactggcccgccttctggatgctgggcgcgccctaccggggcaactaccagaactggccgagcgtcggcgagctggacatcatggagaacgtccagggcctcaacaccgactgggccaccgtgcactgcggcaccaacccgggcggcccgtgcaacgagaccagcggcatcggcggcaacaccccgtgcgccggaaccacgtgtcaggccagcttccacacgtacgccatggagtgggacaggtcgacgagcaccgaggagatccgcttctacctggacggcgtcaacttccatacggtgaaggccagtcaggtcgacgcgacgacgtgggcgaacgccaccggccacggcttcttcgtcatcctgaacgtcgcgatgggcggcggcttccccgccgcgttcggcggcggtccggacagcggcaccgaccccggccacccgatggtcgtcgactatgtgcaggtgctccagtcgagcggcgggagcggtaccacaccccctccgtccggcagccgtgacgcatacagcgccatccaggccgagtcctacgacagccagtccgggacgagcaccgagacgaccaccgacacgggcggcggccagaacatcggctcgctgggcaacggcgactgggcgctctacaagggggtcgacttcggctccaccgcggcgaagcagttctacgcgcgggtcgcgagcggcgcggcggccggcgtcagcgggctggtggaggtacgcctcgacagccgcaccggctcaccggtcggcagcttctcggtggccggcaccggtggctggcagagctggagaacggtcccggcgaacatcagctcggtcaccgggacccacgacgtctatctgaccttcaccagcggccagtcggccgacttcgtgaacgtcaactggttcgacttcggtcac

SEQ ID NO: 1754 - DNA, 894 bp, Streptomyces avermitilis
  CDS (1)..(894)
atggcagacagaaccacccgagccgcccatgaaggtgacgggatcagaaccttccccttccccgtcgacctgagcgtcttcggcgtcggcatgcaggtcggcccgatgggcgccgaccggatctggcatgcggacgcccccctggaccgcgtgcaccggatcgacttccacgtcgtgatggtgttccacgacggcccggtccggcacatgatcgacttcgccgagtacgaggcctccgccggtgacgtgctgtggatccgccccggacaggtgcaccgcttctcccggaccgacgagtaccgcgggaccgtcctgaccatgcagcccggtttcctgccccgggccacggtcgaggcgaccggcctctaccgctacgacctgccgccgctgctgcaccccgacccggaccggctcgccgctctcgaacactccctcgcccaactggagcgcgagtacgtcgacacgacgacgctgccgctgagcctgcacacctcggtgctgcggcacacgctcaccgcgttcctgttccgcctggcccatctcgcggtcagctcggcgcaggccggccgcgagcagacggacaccaccttcacccgcttcagggacgcggtggagaagggcttcgcgaccaaccacagcgtcagcgcgtacgccgacaccctcggctactcccgccgcaccctggtccgcgcggtccgcgccgccaccggccagacccccaaggggttcatcgacaagcgggtgaccctggaggccaagcgcctgctcgcgcacacggacctgccgatcggccgggtcggagccgcggtgggtttccccgactcggccaacttctccaagttcttccaccagcacacggacaccactccggcggcgttccgggcggagctgcgc

SEQ ID NO: 1755 - DNA, 2079 bp, Streptomyces avermitilis
  CDS (1)..(2079)
ttgaagatgagcacgcacacccacgacagcttcgagtggaccgacctcgaccggcgtgccgtcgacacggcccgcctgctggccgccgatgccgtgcagaaggtgggcaacggccaccccggcaccgcgatgagcctggcaccggccgcgtacacgatctttcaaaaggtgatgcgacacgaccccgccgatcccgagtggaccggccgtgaccgtttcgtcctctcccccggccacacctcactgactctctacacccagctcttcctcgccggatacgagctggagctcgacgacctgaaggcgttccgtacgcacggctcgaagacacccggccaccccgagtacgggcacacggccggcgtcgagaccaccacgggcccgctgggccagggcgccgccaacgcggtgggcatggcgatggccgcccgctacgagcgcggtctgttcgacccccacgcgcccgagggcgagtcccccttcgaccacaccatctgggcgatcgtctcggacggcgacctggaggagggcatctccgccgaggcgtcctccctcgccggtcaccagaagctgggcaacctggtcttcctctacgacgacaaccacatctccatcgagggcgacaccgccaccgccttctccgaggacgtaccgaagcggtacgaggcgtacggctggcacgtccagcgcatcgagccctccgccgacggcgacatcgacgtccacgcgctgcacgcggcgctcaaggcggcgcaggccgagaccgagcgcccctcgttcatcgcgatgcgcacgatcatcgcctggcccgccccgaacgcgcagaacaccgaggcctcgcacggctcggcgctcggcgccgaggagatcgcggccaccaagcgcgtcctcggctccgaccccgagcagaccttcgaggtcgcggacgaggtgctcgcccacgcccgccgcgccctggaccgcggcgccgaggagcacgccgcctgggacaagcggatcgccgagtggcgcaccgcccagcccgagcgcgcgaagctcttcgaccggatcgtcgccggtcagctccccgagggctgggagcagtccctccccgtcttcgaagcgggcacgtccgtcgcgacgcgtgccgcgtccggcaaggtcctccaggcactcggcgcggtcatccccgagctgtggggcggctccgccgacctcgcgggctcgaacaacaccacgatcgacaagaccagctcgttcctgccgaagggcaacccgctgcccgaggccgacccgtacggccgcaccgtccacttcggcatccgcgagcactccatggccgcggagatgaacggcatcgcgctgcacggcaacacccgtatctacggcggcaccttcctggtgttctccgactacatgcgcaacgccgtccgcctctccgcgctgatgcagctgccggtgacgtacgtgtggacccacgactccatcggcctcggcgaggacggccccacccaccagcccgtcgagcacctcgcctcgctgcgcgccatccccggcctgaacatcgtccgcccggccgacgccaacgagacggcgatcgcctggcgcgagatcctcgagcggcacgccacccacccggccccgcacggccttgcgctgacccgccagggcgtaccgacgtacgaggccaacgaggacgcggcgaagggcggttacgtcctccaggaggcgtccaccggaaccccggacgtggtcctcatcgccaccggctccgaggtgcagctcgccgtcgcggcgcgcgagcggctggaggccgagggcgtcggcacacgcgtggtctcgatgccgtccgtggagtggttcgaggagcagtcgccggagtaccgcgcgagcgtccttccgccgtccgtgaaggcccgcgtcgcggtcgaggccggtatcggtctgacctggcaccggtacgtcggagacgccggacgcatcgtttcgctggagcacttcggcgcctccgccgacgccgagaccctgttcgccgagttcggcttcaccgccgagaacgtcgccgccgcggcccgggaatccatcaccgccgcgcgtggt

SEQ ID NO: 1756 - DNA, 1134 bp, Streptomyces avermitilis
  CDS (1)..(1134)
atgatcactgtgagcaacaccgtcgaaaacctcgagcgcctctccgacgaaggcgtctccatctggctggacgatctgtcgcgcaagcggatcacgtccggcaacctcgccgaactcatcgcgcacaagcacgtggtgggcgtcaccaccaacccgtccatcttccaggccgccatcggctccggagagggatacgaggagcagctggccgatctggccgtgcgtggcgtcacggtcgacgaggccgtgcgcatgatgacgaccgccgacgtgcgcgccgccgccgacatcctgcggcccgtgtacgacgcgaccggcggccgtgacggccgggtctccatcgaggtcgacccgcgcctcgcccacgacaccgaggcgacgatcgccgaagccaagcagctcgcctggctggtggaccgccccaacgtgatgatcaagattccggcgaccaaggccggtctccccgcgatcaccgaggtcatcggcctcggcatcagcgtcaacgtcacgctgatcttctcgctcgagcgctaccgcgaggtgatggacgcctacctcgccggtctggagcgggcgcaggccgcgggcatcgacctggccggcatccactccgtcgcctccttcttcgtctcccgcgtcgacagcgagatcgacaagcgcctggcgaaggccggcacggacgacgcgcaggccctcaagggcaaggcggcgctcgccaacgcccggctcgcgtacgaggcgtacgaagaggtcttcgccggggagcgctggaccgcgctcgccccggccggcgcgcacaagcagcgtccgctgtgggcctcgacgggcgtgaaggacccggcgtacaaggacaccctgtacgtcgacgagctggtcgctcccggcacggtcaacaccatgccggaggggaccttgaacgccaccgccgaccacggcgacatccacggcgacacggtgaccggcggctatgcccaggcccgcgccgacctggccgccgtggagcggctggggatctcgtacgacgaggtcgtgaagcagctggaggacgaggccgtcgccaagttcgaggtggcgtggggcgacctgctggaggccgtcgcgacctcgctgcgcggcaagggagctgacggcgaa

SEQ ID NO: 1757 - DNA, 1644 bp, Streptomyces avermitilis
  CDS (1)..(1644)
atgagcaagactccttcgaccgggacgccgggcaccgagaagcctgtcaccgggacgccggccaccgagacgcctgtcacggaggctccggtcaccgaggctccggtcaccgaggcgtcggccgtcgactgggccaaccccctgcgcgacccccgggaccgccgtctcccccgtatcgcgggcccctcgggcctcgtcatcttcggggtcaccggcgacctgtcccgcaagaagctgatgccggccatctacgacctggccaaccgcggtctgctcccgccgggcttctcgctcctcgggttcgcccgccgggactgggaggaccaggacttcgcgcaggtggtgcacgactcggtgcgcgagcacgcccgcacggagttccgcgaggaggtctggcagcagctcgccgagggcatgcggttcatcccgggcgacttcgacgacgacatggcgttcaagcaactgcgcgcgtccgtcgacgagctggacgcctcccgcggcaccagcggcaactacgccttctatctctcggtaccgccgaagttcttcccgaaggtcgtccagcagctcaagaagcacgggctcgcggacgcgccggagggctcctggcggcgtgcggtcatcgagaagccgttcggccacgacctggccagcgcgcgtgagctgaacgcgatcgtgcacgaggtgttcgacccggaccaggtgttccgcatcgaccactacctgggtaaggagaccgtccagaacatcctggcgctccgcttcgccaaccagatgtacgagccggtctggaaccggtcgtacgtcgaccacgtacagatcaccatggccgaggacatcggcatcggcggccgtgcggggtactacgacggcatcggttcggcccgtgacgtcatccagaaccacctcctccagctgatggcgctgaccgccatggaggagccggccgccttcgacgccgagtcgctgctcgccgagaagctgaaggtcctcaagtccgtgaagctgccggggaacctgggcgagcacaccgtgcgcggtcagtacacggcgagctggcagggcggcgagcgggtgcgcggctacctccaggaggacggcatcgaccccaggtcgacgacggacacctacgcggccgtgaagctggaggtcgacaaccgccgctgggcgggcgtccccttctatctgcgcaccggcaagcgtctgggccgccgggtgaccgagatcgcggtggtcttccagcgcgcgccccactcccccttcgactcgaccgccaccgaggagttgggcgccaacgcgatcgtcgtccgtgtccagcccgacgagggcatgaccgtgcgcttcggttcgaaggtgccgggtacgtcgatggagatccgggacgtctcgatggacttcgcgtacggcgagtcgttcaccgagtccagcccggaggcgtacgaacggctgatcctggatgtcctgctcggcgacgccaatctcttcccccgccatcaggaggtggaagagtcctggaagatcctcgacccgatcgaggggtactgggacacgcacggcaagcccgcgcagtacccctcgggatcctggggtcccgaggaagccgacgagatgctcgcacgagacggacggagctggcgcaggcca

SEQ ID NO: 1758 - DNA, 933 bp, Streptomyces avermitilis
  CDS (1)..(933)
atgaagatcgacctgaccgacaccacggcaagcaagatcaacaaggcgctcgtgcagggacgccatgccatcggcactcccgccgtgggcatggtcctgacgatggtcatcgtgaccgacgaggagaacgcctacgacgcgctcaaggcggccgaggaggcctcgcgcgagcacccgtcgcgcaccctggtcgtcatcaagcgcgtcgcccgcaccccgcgcgaccgcacgcagtcccgcctggacgcggaggtgcgggtcggctcggacgcgggtaccggggagacggtgatcctgcggacgtacggcgaggtctccgaccacgccgactcggtggtcctgccgctgctgctgccggacgccccggtcgtcgtctggtggccggtggacgcgcccgacatcccgtcgaaggacccgctgggcgccctcgcgcagcgccggatcaccgacatgtacgcggtggaggcaccgctcgccgcgttggaggcccgggtctcctcgtacgcgccgggcgacaccgacctggcctggacccggctcaccccgtggcgttcgatgctggccgcggccctcgaccaggcccgtacgccggtgatctcggccgccgtcgagagcgaggcggagaacccgagcgccgaactgctggcccgctggctgggcgcccgtctgcatgtgccggtggagcgggtcgtcaccgcgggccccgtggtgacggccgtacggctcggcaccgagaagggcgagatcctcatcgaccgccccgagggcccgctggccacgctgtccctgccgggccagcccgcgcgcaccctcgcgctgaaggtccgcagcacctccgaactgatcgccgaggagctgcgacgcctcgacgcggacgagatgtacgccatcgccctgcgcggcgaggcggccgaggagaacaccagtcatgtc

SEQ ID NO: 1759 - DNA, 1647 bp, Streptomyces avermitilis
  CDS (1)..(1647)
atgtctgacagccccaggctcacccgtcgccccgagtggacggaactggaggaccatcgcgcgggtccgctgctccacccggcgctgcgtgagctgttcgcggcggaccccgagcgggccgagcgctatgtcgtgcgggccggcgatctgcgcctcgactactccaagcacctcatcacggacgagaccctcgccctgctccaggaactcgccaccgccaccgacgtgttcgggctgcgggacgccatgttccggggcgagaagatcaacgtcaccgagaaccgcgccgtcctgcacaccgcgctgcgcgccccgcgcgacgccgtgatcgaggtcgacggcgagaacgtcgtcccggccgtgcacgccgtgctcgacaggatggccgacttcgccgaccgggtccgctcgggcgagtggaccgggcacaccggcagccgcatccgcacggtcgtcaacatcggtatcggcggctcggacctgggccccgcgatggcgtacgaggcgctgcgggccttcaccgaccgctcgctgaccgtgcggttcgtgtcgaacgtggacggcgccgatctgcacgaagccgtacgggacctggacccggcggaaaccctgttcgtcatcgcgtccaagaccttcacgaccatcgagacgatcacgaacgccacctcggcgcggtcctggctcctcgccgggctcgacggggacgagaaggcggtcgccaagcacttcgtggcgctgtcgacgaacgccgggaaggtgtcggacttcggcatcgacacggcgaacatgttcgagttctgggactgggtcggcggccgctactcgttcgactccgcgatcggtctgtcgctgatgatcgcgatcgggccggagcggttccgcgagctgctcgacgggttcaggatcgtcgacgaacacttccgcaccgcgcccgcggaggccaacgcgcctttgctgctcggcctgctgggtgtctggtacggctcgttcttcggtgcccagtcgcacgccgtgctgccgtactcgcactatctgtccaagttcaccgcctacttgcagcagctggacatggagtccaacggcaagtccgtggaccgggacggccatcccgtggagtggcagaccggcccggtggtgtggggtacgcccggcaccaacggacagcacgcgtactaccagttgctccaccagggcaccaaggtcatcccggccgacctgatcgggttcatcaacccggtcgacgggctgagcgacgaactggcggcccagcacgacctgttgatggccaacctcttcgcccagggccaggccctcgccttcggcaagaccggcgacgaggtacgcgccgagggagtgccggaggagcaggtgccgcaccgcaccttccgcggcaaccaccccaccaccacgatcctggccgccgagctgaccccgtcggtcctcggccagctcatcgccctctacgagcacaaggtgttcgtccagggcgcgatctggaacatcgactccttcgaccagtggggcgtcgaactcggcaaggtcctcgccaaacgcgtcgagcccgccctcaccgaaggcgcggacgtacccggcctcgacccctccaccgccgccctcgtggccgcgtaccgcactcaccggaagaag

SEQ ID NO: 1760 - DNA, 876 bp, Streptomyces avermitilis
  CDS (1)..(876)
atgcagctcggactgatcggtctcggcaaaatgggcggcaacatgcgcgagcggatccgccgcgcgggccacacggtcgtcggctacgaccgcaaccccgaggtctcggacgtcagtagcctcaccgaactcgtgagcgccctcgaaggcccgcgcgtggtctgggtgatggtccccgcgggcgccccgacccagtccgtcgtcgacgagctcggcgacctgctctcccccggcgacaccgtcgtcgacggcggcaactcccgctggacggacgacgagaagcacgccgaggagctggccgccaagggcatcggcttcgtcgacgcgggcgtctcgggtggtgtgtggggtctccagaacggctatgcgctgatggtgggcggcgacgcggagcacatcgctcgcgtccagccgatcttcgacgcgctcaagccggagggcgacttcgggttcgtccacgcgggcaaggtcggcgcgggccacttctcgaagatggtccacaacggcatcgagtacgccatgatgcaggcgtacgccgagggctgggagctcctcgagaaggtcgactccgtgaccgatgtgcgcgcggtcttccgctcctggcaggagggcaccgtcatccgctcctggctgctcgacctcgcggtcaacgccctggacgaggacgagcacctggagaagctgcgcggctacgccgaggactccggcgagggccggtggaccgtcgaggcggccatccacaacgccgtgccgctgcccgcgatcaccgcctccctcttcgcgcggttcgcctcccgccaggacgactcgccgcagatgaagatggtcgcggcgctgcgcaaccagttcggcggccacgccgtcgagtcagcggag

SEQ ID NO: 1761 - DNA, 609 bp, Streptomyces avermitilis
  CDS (1)..(609)
atgggcgacctcatactggtccgccacggcgagaccgagtggagcctgtcgggccggcacaccagccggaccgacctgcccctcacccaccacggtgaggagcaggccaagtccctggcgcccttcttcgccgggcgctcgttcgcccgcgtcctcaccagccccctcgaccgcgcggtgcgcacggcggagctggccgggctgaccggggccgtgaccgaccccgacctgcacgagtgggactacggcgggtacgagggcatcacgaccgtcgagatccaccgcacccggcccgactgggacctgtggaccgacggcgtgccgtcggcctcggacgggtcccgcggtgagtcgccgcaggaggtgggagagcgcgccgaccgtgtgctgtcccgggtggacgcggcgctccggggtgacggagaagacgtggtcctggtggcccacgcccacttcctgcgggtcgtgaccgcgcgccgcctgggcctgcctcccgagcaagggcggctcttccggctcgccaccggcacggtcagccggctgtccaccgaacacggacgtccggtgatcgcgacgtggaacgagtcgggaacttcccacgggcaccac

SEQ ID NO: 1762 - DNA, 453 bp, Streptomyces avermitilis
  CDS (1)..(453)
atggccctgtgggaccgcatcaaagagtccgcgtcgacgatgcagacccagctcgaggcgaagaagaacgacctgaagagcggcgccttccgcgatgcgagcatggcgatgtgcgcactcgtggcggcggcggacgggtcggtggacccgtccgagcggcagcgtgtggcccagctgatcgccaccaacgaggtgttgcagaacttcgacgccgacgacctgcggcgccgcttcgacgcgaacctggacaagctgaccgccgacttcgccttcggcaaggtcagcgtgctccaggagatcgccaaggccaagaagaagcccgccgaggcgcgtgccgtcatccagatcggcatcgtcatcggcggcgccgacggcgacttcgacaagaccgagcaggccgtcgtacgggaggcgtgcttcgccctcgacctgccgccgcacgagttcgacctg

SEQ ID NO: 1763 - DNA, 2892 bp, Streptomyces avermitilis
  CDS (1)..(2892)
atgaccgagaccgggcggcacgaacagcagtacgagcggtatgagggtggcagtcccgaggcggagcgccaggtgttcgagcggctggcccgggagatcatggaagtccaggtcaaaaaccagcgggcccagggcggcgggatctcgcgcaccttccacgccaaggcgccgctggccgtggagaacgcgcgactgcgcttccacgacgacctgcccgaggccctgcgggtcggcttcgcccagccgggcgccgactatccggcgaccgtgcgcctgtccaacgcgagcggcgtccagcagggtgacggatcgcccgacctgcgcggtgcggccgtccgcgtacgggtgtcggaggacgagagccacgatctgctggcgaccagccatccggtttcgcacgcccgcgacgcccgggagttcgtggccttcgccaaggcgatggcgggtgcccgcagccccctccagaaggccttcgggctgttcgtgaaactcccgctggccgtgggcctcggcaccgcgaaccggatgcggcgcaatgtgcaggcggcggcccggcacaccgtcgactccctcgcgagcgagacgtactggagccgcggggcgatcctgtggggcgaggcgggtccggtgcgctatctgctgcgtccggccccgggcagcccgccgccgctcccctgcgacccgaacgacccggacttcctgcaccgcgagctggcgcagcggctggccaggacggacatcgcgttcgacctgtgcgtgcaaaggttcgtcgatgaacgccgcaccccggtcgaggacgcctcggtggagtggcaggaggcgatcgcgcccgcacagccgatcgcccggctcaccattccggggcaggacctcgacgacgcgaaggcgcgcaccgtcgcccgccggatcgaggacctcgccttcaacccctggcacacgacggacgacttccgtccgctcggcaacatcaaccgggcccgcaaggccgcgtacggggcgagcagcgcgcaccggctcgggctgcggttcagcaccgcggagccgtggcagaaccggctgctcacgccacccgcgggtgcggccttcggcctgctgaaccgagtgctgccctggcaccggctgccgttgcggctgagcctgctgaacctggtgttcctgcggaaggcgctgcgccgcttcaacctgatcgacaccgagccccgcgaggctcccccgaaggcccagccggtaccggagccgattccggagcggctgcgcaccgagcggtcctacgacggctcgtacgacgatctgtccgagccggggatgggcgccgtgggcgccgccttcggccgcaacgtcacgccggactaccggcccgacctcttcgacaccccgaacccggtgacggtcagccgccggctcctgtaccgcgagagcttccagcccgcgacctcgctcaacatcctcgcggccgcgtggatccagttccaggtgcacgactgggtcaaccaccgccgccaccggcccgggggacgcacggtcgaggtgccgctcccgcccggcagcggcgactggcacaacacgccgggcgggccgcccgagaacgtgatgcggttcgcggagaacgagggcctcgaactgcccggcgaccggccgccgatcctcttcggcaacgtcgcctcgcactggtgggacggctccgaggtgtacggcgaggacgagcagaccgctcgtttcctgcgcgaaccggacggcggtgccagactccgcctggaggacggccacttgccgggcggcacgaacgggatcccgctcaccggcttcagcgagagctggtggatgggtctcagcgcgatgcacacgctcttcgcgcgcgagcacaacgcggtctgtgacgcgctgcgcgccgagtacccgtcgatgagcgaggagcggatctaccggacggcacggctggtggtctcggcgctcatcgcgaagatccacacggtggagtggaccccggcgatcctcgccaccgaggcgatcgacatcgggctccacaccaactggcagggcccgccgcggaactggctcaacaagctgggtctgtggctgttcgaggcgcactcgctgaccggcatccccgggacccggccggaccaccacggggtgccgtactcactgaccgaggacttcgtcaccgtctaccgcatgcacccgctgatcccggacgactacgagctgcgcgagcaccacttcgggcagcgcctggagacggtcgggttcctggacatccagggcggcgcggccgaggcgaagatccgcaagacgggcctggcgaacacgctgtactcgttcggcatcgcccatcccggcgcgatcaccctgcacaacttcccgcgttcgctccagcagttcgagcgggacggcgagatcatcgatctgtcggtggtggatctcgtccgcacccggcggcgcggcgtcccgcggtacaacgacttccgggcgggcctgcacaagaagcgcatccgttccttcgaggagctgacgcggaacgccgagacgctggcgcggctcaaggaggtctaccgctcggtcgacgaggtcgacaccatggtcggcctgctcgcggagaacccgccggccggcttcggcttcagcgacaccgcgttccgcatcttcatcctgatggccacgcgccggctccagagcgaccgcttcctgacggtcgactaccggcccgaggtctacaccccgctcggcatcgactgggtcgagaagggcggcatgaactccgtgatcctgcggcactgcccggaactggcgtcgctcatgccgcgccgggcgagcgcgttcgcgccttggcggacggtgcagccggcggccaacggcggcccccctgacaacggcggccccggtgacaacggc

SEQ ID NO: 1764 - DNA, 1455 bp, Streptomyces avermitilis
  CDS (1)..(1455)
atggagatcaacgacctgacgcctgccgagcgacgtgtgtgggaggcctttccgcggggcgcgtccgtggacttccgcacacctgacgcggacaccgaggccgctgagtggggaccggagcggaccgtgcgagcgagcgtcctgcgggcactgctgctcacggcaccgcaggaggagggcgagacggccgcgctcaaggtcgcgggtgcccggatcaccggcgtactgagtctgatgtacgcgacgatcggccatgtcgtccggctgagccactgccggttcgaggaggcgcccaagctgcacggcgcccagcttcgtcagctcaatctgcggcagtcggtgctgcccggcctggcctcggggaacgtacggatcgacggcatcctgcggttgacggactgccgtgtccacgggccggtgcggctcgatggcgcgcagatatcccgcgcgctcttcctcgacggtgcgcggctctccgcccaggacgacgcgcagcccgtgctccagctcaaccaggccgccatcggcgacgacctgtgggcgccgaagctccgggttcggggtgaggtgcggatgaacggcatccatgtggccgggtcggtcaacctggaggacgccgatctgagcgcgcacgcgggcaccgccctcagcgccgagaccctcagcgtgggaaccgatgtgcgggcgcgctgcctgcgcgcggacggccggctcgagctgcgcggcgcccggatccccggccggctcgatctgctgcacgctcgtctctcgaaccccggcggcacggcgctgcgggcgagcagctgcgccatcagggaactctggctgcgcgacggcgaccggatcgagggcgtcctcaatctgcgccgtgcgcagatcgacctgctgaccctggccccggagatgctgcccgacgaggtgtttctgagcggtctcacctacaccatgctcaccccgaacgagcccgccgagcgccgtctgccgatgctcgaccgggacggcggcggctatctcccctccggatacgagcagttgagcgccgcgtaccgcagaatcggcgacgacaacgcggcccgcctcgtccaactcgccaagcagcggcgccatcgcgccaccctggcctggtacgcgcggatctggggccacgtccaggacgccaccgtcggctacggcttccgtccgctgcgtgccgccggctggctgctgtccctgctggccgtgggctcgatcgcgtacggcgtgcatccgccccacccgctcaaggcctccgaggcgccgcccttcaacgccgtcttctacaccctcgacctgctcctgccggtcatcgacttcggtcaggagcgggccttctcccccaccgactggtaccagggcctgtcctacgtcctcatcatcaccggctggatcctggcgacgacgatcgtcaccggtgtgacgcgcacggtcagccgtcag

SEQ ID NO: 1765 - DNA, 1803 bp, Streptomyces avermitilis
  CDS (1)..(1803)
gtgcgtacgtccatcgccaccgtctcgctcagcgggtccctcaccgagaagctcacggccgcggcccgggccggcttcgacggcgtcgagatcttcgagaacgacctgctcgccagcccgctcagccccgaggagatccgggcccgctgcgccgacctcggtctgagcatcgacctctaccagccgatgcgcgacatcgaggccgtaccggcggacgagttcagccgcaatctgcgccgcgcgcgccacaagttcgagctgatgcgacgcctgggcgcggacaccgtcctcgtctgctccagcgtctccccgctcgccgaggacgacgacgcgctcgccgcccggcagctgcgccgactggccgaactggccgcggacttcgggatcagggtcgcctacgaggcgctggcgtgggggcgccatgtgcgtacgtacgaccacgcctggcgcatcgtcgaggccgccggccaccccgcgctcgggacctgcctcgacagcttccacatcctcgcccgcggctcggaccccaagggcatcgaggacatccccggcgagaagatcttcttcctgcaactggccgacgccccgcagatggcgatggacgtcctccagtggagccgtcactaccgctgtttccccggccagggcggcttcgacatcgccgggttcctcggacatgtgatgcgcgccggataccggggaccgctgtccctcgaggtcttcaacgacgtcttccggcaggccgaggccggacccaccgccgtggacgcccagcgctcgctgctcgccctccaggaggcgaccggactcgccacaccccccgcgcccgtggtgcccaccgggatcgccttcgccgaactcgtcacacccgacgtcgagccggtctccgcgctcctgagcgcgctcggtttcggtcgcaccgcccggcaccgctccaagccggtggacctctggcagcagggtgcggcgcgcgtcctggtcaacacgggccccgccgcccgccgcgccggcacctcgctcgccgccgtcggcctggagtcaccggacccggccgccgcggcccgccgcgccgaggccctgctcgccccggtgctgccgcgccgccgcgccctggaggacgcgcccctggaggcggtcgccgcgcccgacggcaccgaactcttcttctgcgccgcccgccccgaactccccgactggcgaggcgacttcgcggacctggaagtggacgcggacgcgccgggccgtgcccccgcgcacggcgtcacccgggtcgaccatctcgccctcacccagccctggcaccagttcgacgaggcggccctgttccaccgcagcgtgctcggtctgaacgcgcaggacagcgtcgacgtcgccgacccctacggtctgcaccgcagccgtgccgtcaccaacgccgacggcagtgtgcggatcgcgctgagcgtcggacccgcaccgaccgacgacggcgcccgggcccagcacatcgcgttcgccaccgaggacgtggtcgccacggcccgccgctttcgcgcggcgggcggccggctgctgcggattccggcgaactactacgacgacctggccgcccggtacgagttcgcggacggcgagctggagacgtaccgcgaactcggcatcctctacgaccgtgacgcgggcggcgcgttccggcactgctacacggagacggtcggccgcgtcttcttcgaactcgtccagcgtgacgccggccaccgcggttacggagcccagaacgcaccggtgcggctggccgcccagcacgcggggcggccggtccgg

SEQ ID NO: 1766 - DNA, 873 bp, Streptomyces avermitilis
  CDS (1)..(873)
gtgacccaggactcgtatctcgtcggcctgatcggttccggcatcggcccctcgctcagccccgccctgcacgaacgcgaggccggccggcagggactgcgctatcactaccggctgatcgacatcgacaggctcggggtcggacccgaagccgtgggcggcctggtacgcgcggcccgggacctcggtttcgacgggctcaacatcacgcacccctgcaagcagctcgtcatcagccacctggacacgctcgccccgcaggccgaggcgctcggcgcggtcaacaccgtcgtcttcgaggacggccgcgccgtcggtcacaacacggacgtcaccgggttcgccgcctccttcgcgcgcggactgcccgacgcccggctcgaacgggtcgtacagctgggcgcgggcggcgcgggcgcggccgtggcgcacgccctgctgacactcggcgccgggcacgtcaccgtcgtcgacgcgctgccggagcgggccgccgccctcgccgtggcactgaaccggcacttcggcgacggccgcgccgccgcggcgagcccggacacgctgcccaagctgctgacggacgccgacggcatcgtgcacgccacccccaccggtatggccgcccaccccggaatcccgctcccggccgagctgctgcaccccggtctgtgggtcgccgaggtggtctaccgccccctggagaccgaactgctgcgcaccgcccgcgcgctcggctgcgccacgctcgacggcggcggcatggccgtcttccaggcggtggacgcgttccggctcttcaccgggcgggaacccgacagcatgcgcatgctcgccgacatcgccgaactggccggcaccgcggccgtccggcac

SEQ ID NO: 1767 - DNA, 663 bp, Streptomyces avermitilis
  CDS (1)..(663)
atgaccagcgtcgacgaaccggcaccaccgaacggccgcatccgcgacgccgcccgcaccagggccgagatcctcgacgtggcgacgcaggagttcgcgcgggccggatacgacggcgcccgggtcgacgagatcgccgcccgcacccgcaccacgaagcggatgatctactactacttcggcggcaaggagcagctcttcacggccgtcctggaacgggcctactccgtcatccgccaggccgagcaggaactcgacgtcgaacacctggacccggtcgcggccatccgcaagctcgccgaggtcaccttcgaccaccacgaagcgcaccccgacttcatccgcctggtcagcatcgagaacatccacggcgccgagcacatcgccgcgtccgaggagctcggccggatcggctcgcccgcgctggacgtgaccggccgcatcctggaagccggccgcagctcgggactgttcacggccgacgtcgacgccgtggacctgcacgcgctgatcagttccttctgcttcttccgggtctcgaaccgccataccttcggcgccctcttcggccgcgacctggtggcacccggccggcgcgagcactaccggaccatgctcggcgacctggtcatcgcctatctgacggcggaccgctccgcggac

SEQ ID NO: 1768 - DNA, 1350 bp, Streptomyces avermitilis
  CDS (1)..(1350)
gtgtccgtccccgccgccccgcacgacgcgccacccggccagccgaggaaggccgcgctcgccgcctggatcggcagcgccctggagtactacgacttcttcatctacggcagcgccgccgcgctgatcttcccgaaggtcttcttcgacgagtcggaccccgccgacgcgacgctgctctccctggccaccttcggtgtcgcctacgccgcccgcccggtcggcgcgctgttcctcggccacttcggcgaccacctgggccgtaagaagatcatggtcttcacgctgatcctgatgggcctgtcgacgttcctcatcggctgtctgcccacccgcgcccaggtcggcggcctggccccggtgctgctcgtgctctgccgtgtcctccagggcgtctccgccgccggcgagcaggccagcgccaactcgatgacgctggaacacgcgccaccgcaccgccgcggctacttcaccagcttcaccctgaacggcacccaggcgggacagcttctcgccaccctcgtcttcctccccgtcgccgcgctccccgaggaccaactgctctcctggggctggcgcgttccgttctggctgagcgtcgcggtggccgtcgccggctacgtcatccgccgcaccctccaggagactccggccttcgcccagcaggccgcggccgacggtgtcgcgaagctgccgctcgccgtgctgctgcgcgagcactgggccgatgtgctgcgtgtggtcgccgccgccctcatcgcctccgtgagcacgatcttcacggtgtgggcgctggcgtacgcgaccagcgactcggtcggcctgagccgctcgtccatgctgtgggtgggcgcgctcgccaacctggtcgccctcggcgcgatcccgctctgggccgtcctgtccgaccgcgtcggccgccgcccggtcttcctgatcggcgccgtcggcagcgcggtgctgatgttcctctacctgtgggccatctccaccggctcctaccctctggtcctgctgctcggcgtcctcaccttcggtgtcgtctacagcgccgccaacggcatctggccctccttctacggggagatgttctccacccgcgtccgcctctcgggcatggccatcggcacgcagatcggtttcgcggtcgccggcttcgccgtcaccttcgccgcgcagatcgccggtccggacggcgacgactggtcctcggtcgccctcttcgcctcggccctgtgcattccgccgatcgtcgcggcgctcaccgcccgcgagacgcacaaggtaccgacggaactgctcggcgagcgcccggcgcagggggccgcgaaccgcgagaccgtgacggcc

SEQ ID NO: 1769 - DNA, 435 bp, Streptomyces avermitilis
  CDS (1)..(435)
atgactcaggacgcgacgcaggacgcactgctgaagctgctctccgaccatctcgccggagtgctggtcaccctcaagcgcgacggacggccccagttgtcgaacgtcgcccacgcgtactaccccgacgagcggacgctgcgggtgtcggtcacggacgaccgcgccaagacccgcaatctgcgccgggacccgagggcgtcgtaccacgtgacggggcccgaccggagggcgtacacggtcgtcgagggcgtggccgaactgtcgccggtcgcgcgggacccgcacgacgagaccgtcgaggaactgatccggctctaccgtgacgtgctgggcgagcaccccgactgggacgacttccgggccgcgatggtccgcgaccgccggctcgtgctgcgcctgcgggtggagcgggcgtacgggattccgcggggt

SEQ ID NO: 1770 - DNA, 582 bp, Streptomyces avermitilis
  CDS (1)..(582)
gtgtctatgagcgatgaggggaccgggctgcgggctcggctgatcgaggcgggcgtcgacctggtggccaaggagggcgcgaacgcgctgtccctgcgggagatcgcccgtcgggcgggggtctcgcacggggccccgcgccgctacttccccacccacctggcgctgctctccgccatcgcgcggcgcggcttcgcggagctggcggagcgggcgacggcggcggtcggcgacggcggggcgagcccgcgcgcacaactggcgtccctgggacgggtctacctggacttcgcgctggacaaccggggcatgtacgagctgatgttccgtcacgacctgctggagagcaaccgtctggggctgcgcgacaccagcctgccgctcttcggtgtgctggtggacctggtcgcaagggcccgtcccggggcggacgcccgcgccgtcgccggctccctgtgggcgaacctgcacgggatcgcccagctgtggggctggggcagccttcaactcgccaccggcgcggtcgacttcgcacccctgctgggtacggccctggacgcgcacctcgggccggaggaccag

SEQ ID NO: 1771 - DNA, 1371 bp, Streptomyces avermitilis
  CDS (1)..(1371)
gtgagcgcgcaccggggtctcactctgacaagcagtgtcgtcggcgcggtgatcgtcgccctggacgggaccgtgctgaccgtcgcgcagcccacgctggggcgggatctgcacgcctcggtcgccgaggtgcagtggacgagcaccgggtatctcatcgcggtggcgagcctgttggtgttcgcgggccgcgtcggcgaccggtacgggcatcaacgcgtcttcgccgtgggcatgctgggtttcggcgcggcctcggccgggatcgggatggcggcgggcatcggctgggtgatcggactgcgcgtggttcagggggtgttcggcgcgctgctccagccggcgaccctcgggatgctgcgggccgcgtatccgcccgaccggctggggatgccgatcgcgctgcggacgagcgccatcggggtggcggccgccgccggtccgctggtgggcggggcgctggtcaccccgttcggctggcggtccgtcttcttcgtcaatgtcgtgcccgcgctggccatgggcggtctcgccctggccgtccgggggccggagcggacgcccccctccgggcggcggctcgacctgcccggcgcctgtctcctcgcggtggccctggcgtgcctcgtgcacaccctggtcgggattccggacggcggctggacgacggtgtccacgctcgggctgatcgcggcggccgtcgccggtaccgtcttcgtccaccacgaacggcgcacgccgagcccgctgctgccgcccgacgtgctcggttcggcggccgtcggtgcggcgctgggcatcctggtggccgcctcggcgtcgatgctcggcaccctgttcgtgagcagctacttccttcaggacgttctcggcctgactccgctggagaccgcccttcgggccctgccgggaccggtgatgatggtgctggcggcacccgcctccgccgtcctcatgcgccgctacggcccccgtcggacgaccgcctgcgcgatgacgctcctcgccctcggcgtcctcgtgctgtcccggctcggcgaagggtcgggggcgctgtcgatcggaaccggattcctgctgctcggcgcgggtttcggcacggtgatggtggccgccacggcggtcgtcgtacggcaggtggcggcgggcgcggccggcgtggcgggcggcctccagcagaccgcgatgaacgtggggccgacgctgggggtagcggcggcgaccacgctgatgacgtacacgcgcgtgggcctggctccgacgctgacggtgctggccgcgctggccgcggcgggcgcactgccggctctcgcgctgccgggccgctccggcagccggagcggagcccccgaggaatcactcacggcctcg

SEQ ID NO: 1772 - DNA, 1224 bp, Streptomyces avermitilis
  CDS (1)..(1224)
atgggacacctgcggcaggaggccgagccgggcgaggtcgggctcgacccgaaggcgctggcccgcctcgaccagcacttcgcacacgaggtcgacgacggccggctgcccggctttctcgtgtccgtctcccggcacgggcgcgtcgcccacctcacgacgtacggccaccgggaccgcgcggccgaactcccggtggagaccgacacgttgtggcggatgtactcgatgacgaagccggtcacctcggtcgccgcgctgatcctcatggaggagggacggttcggactcgacacgcccgtcgccgagttcctcccgtcgttcgccgagccgcgggtgtacgtcgacggcgcgggacccgacatccgcacccgccccgccgggcagccgatcctgatccgccatctgctgacccacacggcgggcctgaccttcggcttctaccactgccatcccgtcgacgcccgctaccgggaggcgggcatcgagtcgtcggtgccaccgggcgcggacctggccgaggcgtgcgaggtgtacgcgggcctgccgctccagttcgagccggggacccggtggaactactccgtggccaccaatgtcctaggccggctcatcgaagtggtgtcgggccggcccctggacgacttcttcgccgaccgcgtcctgactcccctcggcatgacggacgccggcttctgcgtgacgccggagcaggcgtcccgtctcgccgagctgtacggcgagacggaggacggcggtatcgctccggtccccggcctgccgctgcacggccggccgcgcttcctctcgggcagcggcggcctggtggccacggcgtacgactaccaccggttcatggagttcctgcgccgtcgcggcgaactcgacggcgtccggctgctcgcccccaggaccgtcgccatgatgaccgccaaccagctccccggtggcgccgaccgccgtgcgttcggcaccacggtccaccaggagcccggcagcgccggtctcggcttcggcctcggcgtctccgtcgtcgtcgaccccggtgtgacccgctccccgtccgccctcggctcgtacggctggaacggggtggccaccaccacgttctgggtcgacccgcacaacgacatgacggtccagttcctcacccaggtacgcccgacgggctcgcaccgggtctacccggagctgaaacgcctcatccacgagtccctggcgggc

SEQ ID NO: 1773 - DNA, 423 bp, Streptomyces avermitilis
  CDS (1)..(423)
atggccaccgccaccgagaagaacgcagccttgctgcgcaccgcttatcagaggctgcagagcggcgacctcgacgcgtgcgtcgagctgctgacggagaacttcatcgccaacgtccccgggacacccgacccgctgcacgggcgggagatctggcggctgggcgctcaggccatgctcgaaggcttccctgacctccaggtcgacgtcgaggacatgttcagcgtccacgacaaggtggcggtacgcgtccacttccgcggcacccaccagggcaccttccagggcgtggccgcgacgcaccggccggtcggcttccgcagcatcgagctctaccgcatcgagggcgacaggatcgcggaggaatgggtggccccggacctgatgagcctcatgcagcagatctcgccgccgtccggtccc

SEQ ID NO: 1774 - DNA, 849 bp, Streptomyces avermitilis
  CDS (1)..(849)
atgagcgggaccggggaggtacgcgggatgcgggcggcgcggatcgcggccggcgccgtcataccgggggagctcgcgttggcggtgtgcctggcggccggggtacggccgccggtgtgggcgactgcggccgccgaggccgtggcgctcgcggtgctcatgctggaggcatgggtgctgcgctcgctgtacgcgagccggcgcgcccagggcctcgagccaccggccgccctgcgggccgctgtccgtgccgtcgtccccgcacgggtacgccggctactggtgcacgagctgcgtgccgccgcctccctcggccggtgggccgcgcgccggaagcacggtgttcgccccggggaccatgtcgccgggtacaccggaccgcagacggcgatgatgtacggactgatcttcgtctcggtgatcgagacggtcgcgctggcggtcctgatcccgtggcccgtcgtccaccgggtgctgctcgtcctcgacgtgtacggggtcctcatgatgctgggcctgcacgccgcctgcgtcacccggccgcacgtggcgcgccccgacggctccctgcggatccgctatggggccctcttcgacctcgccgtcccggcggacgcggtcgcctcggtccgggtcgaccgctgctacccgcaaggcaggctcgtgacgctgtccgagaagggggtgctcgatctgatcgtggccggtcagaccacggtgaccctggaactgacccgccctctggtcttcacccgcccgctcggcggcagaggggaagcacggaccatccgcttccacgccgacgacccgcgcgcgctggtcggcgccctgcgccggcccgcgctcacc

SEQ ID NO: 1775 - DNA, 732 bp, Streptomyces avermitilis
  CDS (1)..(732)
atgcggatcggagagatcgccgcgctcgtcggggtcacgacccgggcgatccggcactaccaccatgtcgggctgctcccggaaccggagcggcgccccaacggataccgggcctacagcgtccgcgacgccgtcctgctggcccgcgtacgccggctgaccgagctcgggctcagcctcgacgaggtgcgggacgtcctcgcggacgacgcggggcgcgacctggccgacgtactggaggaactggacgccgacctcgcccggcaggaggccgagatcggggagcgccggcggcggctcgcggtgctgctggccgccgagccgcgggacaccgaacccctgtcccccgcgctcgccgcgctcctcgcaaagacgccgcacccggcctcgcccgccgccgcgaaggaccgcgagcacctgacgctgctcgacgccgcgggctccggcggccaggaactgtacgccgcgctcggaccgttggcggccgacccggcgctgctcgcgctctacgaacgcctcgacgcactcgccgaagccccgacggacgatccgcggatcccggcgctggcagccgagctggtggcggccgtccccgacgaggtgttcgccgcgatctccgccgagggacaggtcgtggccgggttccaggaggcgctgctcgcggagtacgcccccgcgcaggcggaagtcgtacgcagggtcatggaggctttcatgcgcaggagccgggga

SEQ ID NO: 1776 - DNA, 1152 bp, Streptomyces avermitilis
  CDS (1)..(1152)
atgtctgacccggttcccgcgagcggtaccgtccactggatcggcgcgggcctgtccacgggcagcggcctcgcggccgtgtgcgtcgccgccgaccgcgtacggctgtggcatcgcaccgaggagcgcgcggcacaggctctcgaccacctggggctcgccgggcgcgccgagccccgcgcgtacacgctccccgcgctggcggccgagctcgcacccggagacgtggtggtctccatgctgcccgccccggaacacgccccgctgctcgccctctgcgtccagggccgggctcacttcgcctgctccagctatgtgtcggacgcggtgctcgaccaggtcccggcggccgccgcggcaggcgtcgtcgtgctcaccgaggccgggctcgaccccggcatcgaccacctgttcgcccacagtctgatcgcacgggcccaggaggcgatcggatccgaaacggcggcggaggtgagtctgacgtcgtactgcggcggcgtcccggcggtccccaacgacttcaagtaccgcttcagctgggcacccgcgggagtgctcaacgccctgcgctcacccgcgcgttacctcgaccacggggccgagacgacgacggaccggccgtgggaggcgacgcggccccatgtcgtcgacggcgagaccttcgaggtctaccccaaccgggacagtgttcccttcatcggccagtacggcctgccggccgcctggaaaccgcagacgttcgtccgcggcaccctccggctcgacggctggctgcgggcctggggcgcggtcttcgaggaactgaaagcgggtgacgacgagcgcatcgcggcgctcgcggcggagctggccacgacgtacccgacgacggaggaggaccgcgaccgcgtggttctcgccgtgtccctggaggtgcggagcggcacgggggcgacctggtcgggccgctacctgctggacctcgaaggcaccccggaggagagcgcgatggcccgctgcgtctcccgcacactggggctgggggtgcgccacgtactcgacggcgacctgccggccggcttgaaccgcgcggcggagacggcgcagcggtcggaggagtggctgggggagctgcggcgggaggggatcgacttcgcgcttcggaccgatggg

SEQ ID NO: 1777 - DNA, 1107 bp, Streptomyces avermitilis
  CDS (1)..(1107)
atgacccagctccacttgtggctgcgccacgagtcccgtacgaccgagcggcgcacgcccgtcgtaccgtccgacgcccgacggctcgtcgagagcggggtgcggctgaccgtggaggactcaccgcagcggatctttccgaccgaggcgtacgaggcggtgggctgcgagatcgccgaggcgggctcatgggtgtcggcgccaccggacgccgtgatcgtcggcctcaaggaactcccggacgagcccgccgaactggttcaccggcatgtcttcttcgggcacgcgtacaagcggcagcccggagccgaggcgctgctgcgcaggttcgcggccggcggcggggccctgttcgacctcgagtacctggtggacgacgacggacgccggctggccgcgttcggctactgggccggatacctgggggcggcgctcgccgtgctccaccaccggggcggcctcggcaccccgctgcggccgacgtcgaaggaggagctggaggcggaactccgctcctccgagggtgagttgacggcgctggtcatcggggccctgggccgcagcggccggggcgcccgcgtggccctcggcgaggccggcgtcgaacccacctgctgggacctggccgagacgcgcgatctcgaccgaccggttctcctggagcacgagttgctggtcaacaccgtgctcaccacccggccgatcccgccgttcctcacggacaaggacctggacgagccgggccgtcggctgcggacgctcgcggacgtcaccgtcgacgtcggatcgcccctgaacgtcctgccggtctacgacacgaccaccgactgggcgcaccccgtccgccgcctccgcgaggcgccgccgctcgacctcatcgcgatcgacaacctgccgtccctgctgccccgggaggcgagcacggacttctcggcggcactgctgccgtcgctgctcgacttcggcaccgctgaatcccggggacggtccggcggacccggggtacggtccggcggaccgtggggacggtgcctggaccgcttccacgaggcctgccgtgaactcggcatcgaactcggcaccgacgacacggaggtccgcgatgtc

SEQ ID NO: 1778 - DNA, 1143 bp, Streptomyces avermitilis
  CDS (1)..(1143)
atgaacacacacgccgacgtggtcgtcatcggcggcggggtgatgggcacgagcatcgcctaccacctggcccgcgcgggcgtacgcgacgtcgtcctggtggagcgcgacgaactcgcctccggttcgacctcgcgggccgcgggcggcgtacgggcgcagttctccgacgagctcaacatccggctcggcgcccggagcctggaggcgttcggccggtttggggaggaaccggggcaggacatcgggctgcaccgggtcggctatctgttcctgctgtccactccggaggaggtcgccgcgttcgagacgggggtccggctccagaactccctgggtgtgccgagccgcatgctcgaaccggccgaggcgcgccgcctctcgccgctcatcaccaccgacgggctgctggccgccgccttctcaccggacgacgggcactgcacgcccgagtcggtggtccacggctacgcggccgccgcccgccgccacggcgcgaaggtgctgcggcattgcgaggtcaccggcatcgagacccgcggcgacgacatcacggccgtactcacccggcgcggacgcatcgggaccggcacggtgatctgcgcggccggcgcctggtcgaaggccgtcggcgccatggtcggggtggacctgccggtgcggccgctgcgccgccagatcgccgtcacggagccggtcaccggtctgccgcccgggctgcccatgaccatcgacttcaccagcagcctctacttccacaccgaaggcccgggtctcctcgtcggcatgtccgaccccgacgagaccaccggcttctcgaccgagacccacgaccgctggatcccccggctgtgcgaggcgatggaacgccgcgcgccccccctgctcgacctgcgccgcaccggcggctgggcgggcctgtacgagatcacaccggaccacaacgcgctgatcggcgaggcgggttcctgctcccgtttcctgtacgcgaccggcttctccgggcatggcttcctccagggacccgcggtcggcgaggtgatccgtgatctgtacctcgaccgcgtaccgttcgtcgacatcagccccctgagcgtcgagcggttcgccgccgacgcgccgcgtccggaggtcaaccgcgta

SEQ ID NO: 1779 - DNA, 978 bp, Streptomyces avermitilis
  CDS (1)..(978)
atgaccgacgacgacgtcctctacctctcctcgcgccgcgtgacggaactgctggacaccgacgcggcgatcgcctcgcagcgcgccgcgttcaccgcgctcggcgacggcaccgccgagctccccggcaagatcatgtaccccagccggttcgacgacagtgtcgtcttcgcgtacgtctcgcggctgtccgcggacaccgggaccgtcgccaagttcggcagcgtcaatcccgggaacccggccgcaggtctggccagcgtccacgcggtgatcaacgcgctcgacccggtgaccggccggctcgtggccgtcatggacggtacggcggtcaccacactgcggaccgccgccgcgagcgccgtcgccttcgacgcgctggccaccgccgacgcctccgagctgggccttctcggctccggcacccaggcactcgcccatgcgcgggccgtcgcccgggtgcgggacctcaggtccgtacgcgtctggagcccgaaccccggccgccgcgagcaggcggcccagcggctcgccgccgaactcggtgtcgccgccaagggtgtcgacaccgccgaggaagccgtggcccaagtgcccatggtcgccgcctgcacactgagcaggacgccggtcgtacgcggcgagtggctcgcgccggggtgcacggtggtgagcgtgggttccttcgagccgacccgcagcgaggtcgacgccgaggtgctgcggcgggccgcggcggtggtcgtcgacgatccggggaccgcggccgaccacgcgggaccggtggtggacgcgctgcgggagcggcggctcgccccggacgacctgatcccgctcggcgccgtggtcaccggccggcacaccgcgcggacgagccccggcgacatcgtcttctacaacagcgtcggactcggcatccaggacgcggcggcggcctgggccgtgatcgccgcggcccgcggaccacgggagcaccca

SEQ ID NO: 1780 - DNA, 690 bp, Streptomyces avermitilis
  CDS (1)..(690)
atgacagaaaactttggcgtactcggcgggactgcgcatctctcaggtgtcgaacgagtcgtgaatgcccccctgcccaccgtgtacggcgatttccatgccgtcggttacctcgaccacgatcgcggagaggagcaagtggccctggtgtacggcgagatcggtgacatcgggggcctcggcggtgtgcgtggcgccggggaggagggggtgctcacccggctccattcggaatgcctgacaggggacgccttcgggtccaggcactgcgagtgcggcccccaactcaccaccgccctgcgggagatcgtcgccgcggggcgcggcatcctcgtctacctccgcggccacgagggccgggggatcggcctgctcgccaagctgcgcgcgatgaagctccaggcggaggggctggacaccgtggaggcgaacctcgccctcggcctcccggtggacgcccgtgactacggggtggcggcgaagatcctgcacgacctcggggtgaggtccgtacgcctgctctccaacaacccgcgcaaactggagtcgctgctccagcacggcatcaacgtcgtcgaacaggttccgctgctgataccgccgtgcgaggagaacatcacctatctgcgcaccaagcgggagcggctcgaccacatcctgccgcacctggacgccgtggcccgctcctcc

SEQ ID NO: 1781 - DNA, 798 bp, Streptomyces avermitilis
  CDS (1)..(798)
atgagtagttcaggatcgcagtcgacggtatccggtctgttgccgcaggacaccacggaggatgtccgggaacgcgggtccggggccgtccggcaggtcgccgtgcttcctgtcggcagcttcgaacagcacggtgcgttccttccgctggccaccgacacgctggtcgcctgtgccatcgcgcgggaagtcgccgccgcgtatccggtccatctccttcctccggtgacgatctcctgctcgcacgagcacgcggcctggccgggaaccgtcagcatctcctccgtcacgctccacgcggtggtccgggacatcgcggactcgctccgccgttcgggggtcgagaccctggttctggtcaacgcgcacggcggaaattacgtactgggcaatgtagttcaggaatccgccggcagcggtacccgtatggcgcttttcccggccccggaggactgggatgcggccagggaacgggcgggtgtacagacctcgctgctcagtgatatgcacgccggggaaattgagacctccattctcttgcacacccatccggaattggtccggcccggatacgagaccaccgatttcctcgtcgacgatcggcggcatctgctcaccctcggtatgtcggcctatacggagtcgggcgtcatcgggcgcccctcgctcgcttccgcggagaaggggaagcaactgctggcggggctcgtcgattccttcgaaccgtatttctccttggtcacctcggaatcggccaccgtgacccccggaacggcggcggcggaccggcaccgttcg

SEQ ID NO: 1782 - DNA, 1497 bp, Streptomyces avermitilis
  CDS (1)..(1497)
atgacggcgccggcggatgcggggccgctgatgaccgacgccgcgcagctcaccacggtgcggccgccggaacccgcacgaccgaaggacggcgcgacctccgtgaccgtgtcgcccgtcgcgtcgccccgcacctcgcgagccacccggctgcgtgcccggttcgcatcgcgggcggtccgtaagcacttcgggaccgtcgccggcaccgtcatcctcggcgtgctcctgtggcgcctcggcaccggtgtcttcctcgacgggctgcgccggatcgacgccccgaccctgctgatcgggctcggcatcggcctgctgaccaccgtgttcagcgcctggcgctggtgcctcgtcgcccggggactgggcatccggctgccgctcggccccgccgtcgccgattactaccgtgccctgttcctcaacgcggcgctgcccggcggtgtcgtcggcgacgtccatcgcgcggtacggcacgggcagagcaccggtgacctcggccgcggcgtccgcgcggtgatcttcgaacggaccgccggccagatcgccctggtggcgatcggcgtaccggtcctgctcacgcagccgtcaccggtgctggcccagagccgccatctggccgagctgctggggctcgccgcactcggttcgctcgccatcgtggcggccatccggatgggccgcgcgccccgcccgtcccgtcggggccgggccctgcgcgccgcgctcaccgaggcgcggagcgcactgctcgaccggcgcaactggcccggcgtcctgctgtcgtcgtgcgtcgtgctcgccggacacctcgcgatgttcctggtcgccgcgcgggtcgccggatccgccgcgtccgtcgcccggttgctgcccatcgcgctgctggccctgatcgccatgggactgccgctgaacatcggcggctggggtcccagggagggcgtcaccgcctgggccttcggcgcggccgggctcggcgcgagcacggggctgaccgtcgccgtcgtgtacggcgtcctcagcttcgtcgcgagcctgcccggcatctgcgtactcgtcgtccgctggtacgccgccctgaagcaccggcggcacgagagcccggccaccgccgaacggccggacgaagcggtggacgtggcggacgaagcggtggacgcggcgcacgccgaaggcgaaacggcggcgcccaccggacggccgcggcaccttgtgcccgacgccggctcgaccccggagcgcaccccccacgcgctccgtgcccccgcaccgcacgcctcctacccccgctcacccccgtcacggccggaggtgctcctgacacggcgtcacgaacggtgccggtccgccgccgccgttccgggggtcacggtggccgattccgaggtgaccaaggagaaatacggttcgaaggaatcgacgagccccgccagcagttgcttccccttctccgcggaagcgagcgaggggcgcccgatgacgcccgactccgta

SEQ ID NO: 1783 - DNA, 954 bp, Streptomyces avermitilis
  CDS (1)..(954)
atgagcatgagcaccaccccgacagggtcccccggaagtacggccacgggagcggctgacaccgacccggcctccgggcccgccccgctgccggcgattccggcgcccgcgggcgccgaccccgaggtgccgcgctacgccccccagtggctccaactgcgcgagcccgccgacgccgccgcgcgggcccacgacctgctcgacccgctgcggatccggctggcgaaccggccggggcggccgagggacctggtcgtgcacgacctcggctgcggcaccggctccatggggcgctggctggcaccccggctcgacggcgcccagcactgggtcctgcacgaccgcgacccgtatctgctgcacttcgccaccgtgggcgcgccccgggcggccgccgacggcagccgcgtcacggtgaccacccagcgcggcgacatcgggcggctcaccccggacgccctcgccggtgcctcgctggtgaccgcctccgcgctcctcgacgtcctcacccccgacgagatcgacacgctcgccgaggcctgcgtcggcgcgggctgcccggcgctgctgacgctctccgtcgtcggacgggtggaactgaccccggccgacccgatggacgcggagatcggcgaggccttcaacacccaccagcggcggggcgacctcctcggacccgacgcgatcaacgcggcctgcgaggccttcgggcggctgggcgcgaccgtacgggtgaacccgagcgcctggcgactcggcgcccaggaaagtgaactggcggcggagtggctgcgcggctgggtcggggcggccgtcgagcagcgaccggagctggcggagcgtgcggatacgtatctgcagcgccgtctggccgcctgcgccgcgggcgaactgcgggtggtcgtgcaccacatggacctgctggcactgccgaggccggcgggcggggcgtca

SEQ ID NO: 1784 - DNA, 1140 bp, Streptomyces avermitilis
  CDS (1)..(1140)
gtgcccgtgcagcacgcggctctcaagaacgccgagatcatccccatgtccctgcgcaccgcccacttcgtgatgcccggcggcgtcgacgacccggccatgccgagcggcggcaacgcctacgaccgccggatctgcctcgacctgcccggcttcggctggcaggtccacaagcacttggtcgacggcagctggccccggcccggcgcggacgcccgcgccgaactcgcccgtacgctgcgggaactgcccgacggcacggtcgtcctgctcgacggactcgtcgcctgcccagtgcccgagatcgtcgtgcccgaggccgaacggctgcgtctggccgtactggtgcaccttcccctgggtgacgagaccgggctcgaccccgccgtcgccgccgaactcgaccggctggagcgcacgaccctgcgtgccgtgtccgcggtcgtcgccaccagcgactgggcggtccgccggctcgtctcccaccacgggctcgcccccgaccgcgtccatgccgccgcccccggcgccgacatcgcccccctcgcctccggcaccgacggcgtctcccggctgctgtgcgtcgccgcggtgacgctgcgcaagggacagcaccggctgatcgaggccctcgcgaccgtcaccgacctgccctggacctgctcgttcgtcggcgggctcggacaggaccccgagtacgtcgcacggctccgcgccctgatcgaccagcacggcctcggtgaccggctgcacctcgcgggaccccaggcgggcgccgaactcgacgcgagctacgccgccgccgacctcatggtcctcgcctcgtacgccgagacatacggcatggccgtcaccgaagccctggcccgcggcatccccgtcctcgccaccgacgtcggcggggttcccgaagcggtcgggcgcgcgcccgacggcggggtgcccggcatcctcgtaccgccggaggatccggcggcgctcgccgcggaactgcgcggctggttcggcgaggccgatgtacggcgccggctgaaggcggccgcgcgcgggcggcgggccgcgctggacggctgggcgacgaccgcccgcagcctggcgggcgtactgtcccggctgcccgacacgtcccggagggcggca

SEQ ID NO: 1785 - DNA, 396 bp, Streptomyces avermitilis
  CDS (1)..(396)
ttgttcagcatcaccgtccgcgatcacatcatgatcgcccacagcttccgcggcgaggtcttcggacccgcgcagcgtctgcacggagcgacgttcctcgtggacgccaccttccgccgcgccgagctggacgacgacaacatcgtcgtcgacatcggactggccacacaggagctgggaggtgtggtgagcgagctgaactaccggaacctcgacaacgagcccgacttcgcccacaccaacacctcgacggagttcctcgccaaggtcatcgccgaccggctcgccgagcgcgtgcacaagggagcgctgggcgagggcgcccgcggcctggcgggcatctcggtcacgctgcacgagtcgcacatcgcctgggcgagttacgagcgtgctctg

SEQ ID NO: 1786 - DNA, 978 bp, Streptomyces avermitilis
  CDS (1)..(978)
atggaactcacaggacgcgccttctggctgcgctcgcccggacacggcgagctgcgggacgtggagctgcacaagcccgccgacggcgaggtgctcgtgcgcgcgctctactcgggcgtcagccgcggcacggagaccctcgtctttcgcggtggcgtacccgagagccaacaggccgccatgcgagcgcccttccaggaaggcgatttcccggcgccggtgaagtacggctacctgagtgtcggaacggtcgagtacgggccgcgggagctcgtcgggcggaccgtcttctgcctctatccgcatcagagccggtacgtcgtccccgcctccgcggtcactgtcatcccggatgccgtacccgccgcccgggccgtcctcgccggcaccgtcgagaccgccgtcaacgcgctgtgggacgccgcgcccctcgtcggcgaccgcatcgccgtggtcggcggcggcatggtcggctgttccgtcgccgcgctcctcgcccgctttcccggcgtccgcgtccagctcgtcgacgccgacccggcgcgcgccgacatcgcccgcgcgctcggcgtcggcttcgccctgcccgaggacgccctcggcgagtgcgacctggtggtgcacgccagcgccaccgaggcggggctcacccggtccctcgaactcctcgccccggaggggaccgtcctcgaaatgagctggtacggcgaccggcgcgtcagcctgccgctcggcgaggccttccactcccggcggctcgtcgtgcgcagcagccaggtcggcaccgtgtcgccgtccgggcgccccggacgcacgtacgccgaccggctcgcgctcgccctcgaactgctcgccgaacccgcgttcgacgcgctcgtcaccggcgagtgcgccttcgaagaactccccgacgtgctgccacggcttgccagtggtgagcttgcggggttgtgccaccgagttctgtacgacgccggc

SEQ ID NO: 1787 - DNA, 720 bp, Streptomyces avermitilis
  CDS (1)..(720)
gtggccctgaaccacacatacgacgcgaggcttttgcagcaggagacgaccgtgggagcgggcgtgcagatcctgttgctggccttgttgggctcggcgatcgggatgggcccggcgggctggctgacgggcctggcgttcgcgctcgccacctgggcggtcctgacccgcgccgtgctccgctcgcgtctgcggtcgttcggcctggccaaccgggtgacgctgggacgcgcgacgctggtcggcggcgtcacggccctggtcgcggactccttcgagagctcgcccccgatcacgctcttcgtcgggctgacggcggtggccctgatcctcgacggcgtggacggcaaggtggcccggcacacgggcacgtcgtcggcgctgggggcacggttcgacatggaggtcgacgcgttcctgatcctggtgctgagcgtgtacgtgtcgatgtcgctgggtccctgggtcctgctgatcggggcgatgcggtacgtgttcgtggcggcggcgcgggcgatgccgtggctgaacggggagttgccgccgagcacggcgcgcaagacggtggcggcgctgcaaggggtcgtgctgctggtggcgggggccgggattctcccgcaggcggtgacactcggggcggtggcgctggctctggggtcgctggtgtggtcgttcgggcgggacatcgggtggctttggcggacgaacgcccgtacggcg

SEQ ID NO: 1788 - DNA, 2088 bp, Streptomyces avermitilis
  CDS (1)..(2088)
gtgcgtaccgactcgcaccgtcaccccaacagccccctgaccgccgtccgtaacctgggcatcctcgcccacgtcgacgcggggaagaccaccgtcaccgagcggatcctctatctcaccggcgccacccacaaacgcggcgaggtccatgacggcacgaccgtcaccgacttcgatccccaggaacgcgaccgcgggatcaccatcttcgcggcggcggtgagctgcgactgggacggccaccggatcaatctgatcgacacccccgggcatgtcgacttctccgacgaggtggagcgctccctgcgcgtactcgacggcgcgatcgcggtgttcgacgccgtcgcgggcgtcgagccgcagagcgagtccgtatggcggcaggccgatcgccacggggtgccccggatcgccttcgtcaacaagctggaccgcgccggtgcggacctcgacacggcggtcgagtcgatccggcagcggctgcatccggccccgctcgtcgtccagttgccgatcggcacccaggacgggttcaggggagtggtggatctggtgcgcatgaggtcgctgctctgggccgacgggcgggacaccgtcgaggaggggccggtgccggacgccctgcgggacgaagcggaccggcgccgacggcagctggaggaagcggtggcggaactccatcccgtcgcgctggaggagttctgcgcgcaggcgacggtctccgcacagaccctcacccgcgcgctgcgcgacctgacccgtaccggggacggcgtggtcgtgctctgcggctccgcctaccgcaatcgcggcatcgaaccgctgctggctgccgccgtggcctacctgccctcgccgctggacgtaccggccgtacgcggcaccgaggacggcgcggtgcgggaacgggccgccgacccggcggcgccgttcgcggccctggtgttcaaggtgaccgcgaccgcgacagggcggctgacgtatctgcgtgtgtactcgggaacgatcgggaaaggagagaccgtgctggacaccggcgcgcggcgcagcgagcggatcggccggattctgcgtgtccaggccgaccgtcacacggagctggaccgggcggtcgccggggacatcgtggccgtcgtcgggccgaagaccgcccgcgccgggtcgaccctgtgcgcacccgcggctcccttggtcctcgaaccgccgaccgtcgccgatcccgtcgtctccgtcgcggtcgaggcgcgcagcagcaccgacaccgaccgcttggcctcggcgctggcgcgcctggccgaggaggatccctcgctggtggtgcggaccgaccccgagaccggccagaccgtgctgtcgggcatgggcgagctgcatctggaggtggcggtggagaagatccggcgcgaccggggaacggccgtcaatgtcggccggccgagggtcgcctaccgggagacggtcgcccgcggcgtgtccgggctcgtgtaccgccatgtcaaacaggacggcggcgccggccagttcgcccatgtcgtcctcgacgtggagccgctggagtccgccgccgacggcggccacgggggcttcgagttccgctcggccgtcgtcggcgggcgggtgccgcaggagtacgtccgggcggtggcggccggctgccgggacgccctggccgagggcccgctcggcggtcacccggtgaccgggctgagagtcgtcctgaccgatggagcgacccatccgaaggactcctccgagatggcgttccggacggcgggccggttcgcgctccgggaggcactgcgcgccagcgcgatgctccttctggaaccggtggcggaagtgacggtcaccgcgcccgacgacgccgtgggcgcggtactcggtgacctggcggcgcggcgcggccgggtctcggactcgacgacgcgagcgggcgcgtcggtgatcacggccaccgtgccgctggccgagctgttcggctacgcgacccggctgcgcggccgcacccggggccggggaaccttcaccacccggcccgccggctacgccccggcactgagcacggcgtcccggcggacaccggtccgc

SEQ ID NO: 1789 - DNA, 1887 bp, Streptomyces avermitilis
  CDS (1)..(1887)
atgccatcccgtaccccccgcacgctgctgaccgccctcgccaccgtcgcgtcggtggcgctgctgtccacgggcccggcgctcgccgcgcccgtaccgcaagccaccgccaccgccgccgcggcctgggacgccgaccgggcggccgccgcctacgccgcgaacccggccgcggtcaccgcctccggcagcgagaacggcggcaccgcgcccggcctcgccttcgacggcaacgcctcgacgcgctggtccagcaatttcgccgacgacgcgtggatccgcctcgacctcggcaccaccctccgcatcgacagagtcgtcctcgactgggagaccgcgtacggcaagagatacgtcctggaggtgtcgaagaacggcaccgactgggcccccttctacaccgagaccgccggcaccggaggttccgtcaccgcgcacacctacccacaggaggtgacgggccgctacgtccggatgcgcggcgtcgaacgcgccacgccctacggctactccctctactccttcaaggtctacggcggtgaacccgcccccgcgtcgacgacccgcaccaacctcgccctcaaccacccggcctactccaacttctaccagcacgccggcaattcacccgccttcgtcaccgacggcggatggcccgccaacttcaaggacgacgcgagcagatggtccagcgactggaacgccgaccgctgggtctcggtggacctgggcgcgacctcgcggatcgacaccgtcgacctgtactgggaggcggcctacgccgtcgactaccagatccaggtctcggacgacaaccgcacctggcgtacggtccaccagccgaccgccgccgagatcgccgcccgccgcgcggacgtcaagtcacccggcgacgcgacgggccggcacgacacggtgacgctgtcgcagcccgccaccggccgctatgtacggatgctcggcaaggagcgccgctccttctacaaccccgcacccgccacggcccaattcggctactccctctacgagttccaggtctggggcaccggcggcagcgcctccgcggcctatcccgcactcccgggcgagcagtcgggcacgtaccagaccgcgttcttcgacgacttcaccacggccgccctcgaccgctccaagtggcgtgtcgtgcgcaccggcaccgagatgggctcggtcaacggcgagtcgcaggcgtacgtggactccaccgacaacgtccgcaccgagaacgggaacctggtcctgcgggccaagtactgcaagggctgcacccgggcgggaggcggcacctacgacttcacctccggacgcgtcgacaccaacaccaggttcgacttcacgtacggaagggtcagcgcccgtatgaaactgccggtcggcgacggcttctggcccgcgttctggctgctgggcagcaacgtggacgatccgtccgtgtcctggcccgcctccggtgagaccgacatcatggagaacatcggctactcggactggacgagctccgccctgcacggccccggctactcggcggacggcaacataggcgcccgccagacatacccggggggcggcacggccgaccactggcacacctacgcggtggagtggacgccgaccacgatgcgcttcacggtcgacgaccgtctcgtgcaggagacgacccgcaacaagctcgaatcgacccgcggacagtgggtctacgaccacaaccagtacgtcatcctcaacctcgccctcggcggcgcgtacccggcgggctggaaccaggtcaccagcccctactggggcctgccgcagaccagcgtcgacaaggtcgcggccgggggagtgcaggcggaggtggactgggtgcgcgtcgagcagaagaag

SEQ ID NO: 1790 - DNA, 1356 bp, Streptomyces avermitilis
  CDS (1)..(1356)
gtgaccatcgacctcgccgcactcccgcacgacttcctgtggggtacggccacagcggcgtaccagatcgagggagccgtcgccgaggacggccgctcgccgtcgatctgggacaccttctcgcacacccccggcaagatcgacaacaacgaccacggcgacgtcgcctgcgaccactaccaccgctggcgcgaggacatcgggctgatgaagcaactcggcaccaacgcctaccggctctccgtcgcctggccgcgggtgatcccgggcggcgacgggccggtgaacgccaagggcctcgccttctacgacgagttggtcgacggtctgctggaagcgggcatcaccccgtccgtcaccctctaccactgggacctgccccaggtcctccaggaccgcggcggctggcccgaacgggcgaccgccgagcacttcgccgcgtacgcagcggtcgtcgccgaacgcctgggcgaccgcgtcacccactgggccaccctcaacgaacctctctgctccgcctggatcggccacctcgaaggcaagatggcccccggcctcaccgacctgaccgccgcgatccgggcctcgtaccacctgctcctcgggcacggcctggccgcccaggcgatccgcgccgcggccccggccgccgaggtcggcatcgtcaacaacctctccaccatccatgccgccagcgaccgccccgaggacgtcgcggcggcgcgccgcatggacggccacgtcaaccgctggtggctggacccggtccacggccgcggcttcccggccgacatgcgcgaggtgtacggcgtcgaactgcccgagcagccgggagacctggcgacgatcgccgcgccgctcgactggctgggcctgaactactacttcccggccaccgtcgccgacgaccccaccggaccggctccgcgtgtccgctcggtccgccggctcggcgtcccgcgcaccggcatggactgggagatcgacgccaccggcatcgagaccctgctgctgcgcctcacccacgagtacgggccccgcaagctgtacgtcaccgagaacggctccgccttccccgacgtggtacgccccgacggcaccgtcgacgaccccgaacgccaggactacctcgtacgccacctggccgcgtgcgcctccgcggcccgcaagggcgcgccgctggccggctacttcgcgtggtcgctgctcgacaacttcgagtgggcgtacggctacgacaagcgcttcggcctggtccacgtcgactaccgcacccaggtccggacgatcaagggaaccggccatcgctacgcggacatcgtccgcacccaccggggccgggcgcgccgggccgcc

SEQ ID NO: 1791 - DNA, 870 bp, Streptomyces avermitilis
  CDS (1)..(870)
atgtctagcacctcttcgacggcccgctcgccgatggctccgccccggtccttcctctggtcccgccggatcttcctcaccctgctcaccggcttcgtcctgctgccggtgtacgtcatggtctccagctccctgaagccgctcgcggacgtctcggggaagttccggtggctgccgagcagcctgacgatccgcccgtacatcgacatctggtccacggtcccgctcgcgcggtacttcgtgaactcgctgatcgtggcgggcgccgcgacggtctgctcggtggtgatcgcggtcttcgccgcgtacgccgtcagccgttacgacttccggggcaagcgcgttttcacggtcaccgtgctgtccacccagatgttccccggcatcctcttcctgctgccgctgttcctgatctacgtcaacatcggcaactccaccggcatcgccctgttcggctcgcgcggcgggctgatcctgacgtatctcaccttctcgctgccgttctcgatctggatgctgatcgggtacttcgactcggtgccgcgcgatctggacgaggcggcgctggtggacggctgcggaccgctcggcgcgctgttgcgggtcgtcgtgccggccgcgatccccggcatcgtcgcggtcgccgtctacgccttcatgaccgcctggggcgaggtgctgttcgcgtcggtgatgaccaacgacaccacccgcacgctcgccgtcggactccagggctactccacgctcaacaacgtgtactggaaccagatcatggccgcctcgctcgtcgtcagcgttcccgtggtcgcgggcttcctgctcctccagcgctatctcgtcgccgggctgacggccggagccgtcaag

SEQ ID NO: 1792 - DNA, 996 bp, Streptomyces avermitilis
  CDS (1)..(996)
atgaccaccacgaccgcctccgccgagtccggcgagcggacggtgcgcaagaactcccccggtgcggcgcgcggcccgcgccgcaccgggcggatcaagcgcatcggactgccctacctgctgcttctgcccgccctgctcctcgaactcctggtccacctggtgccgatggtcatcggcatcgtgatgagcttcaaggagctcacgcagttctacatccgcgactggggcaccgcgccctggtccggcctcgacaactaccaggtgtcggtggacttcgacgcgcccgtcggtgaggcgctgctccactcgttcctcgtcaccatcgccttcaccctgctgtccgtcggcctgtgctggctgatcggcacggcggccgcgatctacatgcaggacaccttccgcggccgcggcctgctgcgcgccctgttcctcgtcccgtacgcgctgcccgtgtacgcggccgtcatcacctgggtcttcatgttccagcacgacaacggcctggtgaaccacgtcctgcacgaccagttgcacctcaccgacaagccgtccttctggctcatcggcgacaacagcttcgtcgcgctgctcaccgtgtccgtgtggaagggctggccgttcgccttcctcatcgtcatggccggcctgcagaacatcccgggcgagctgtacgaggcggccgccctcgacggggccggcctgtggcagcagatccgccgcatcaccctgccgtcactgcgcccggtcaaccaggtcctggtcctggtcctgttcctgtggacgttcaacgacttcaacacgccgtacgtcctgttcggcaggacggcgccggaggccgcggacctcatctcggtccacatctaccaggcgtcgttcgtcacctggaacttcggcaccggctccgccatgtccgtcctgctgctgctcttcctgctcgtcgtgacgggcgtctacctcctgctgacctcccgaggaaggaagacggccgatgtc

SEQ ID NO: 1793 - DNA, 1314 bp, Streptomyces avermitilis
  CDS (1)..(1314)
atgcgcagcatccgagccgcggccgtaggcgccgtcaccatgtctctcgcccttgccgcctcggcctgcggaggcggttcgtcgaccggcgggggatccaacgactcgcccaagacgctcacgtactgggcctccaaccagggcgccagcatcgcggtggacaaaaaggtcctccagcccgaactcgacaagttcgaggagcagacgggcatcaaggtgaagttggaggtcgtgccctggtcggatctgctcaaccggatcctgaccgcgaccacgtcgggccagggccccgacgtgctgaacatcggcaacacctggagcgcctccctccaggccaccggggcgctgctgccgtgggacgccaagaacttcgacaagatcggcggcaaggaccggttcgtcgactcggccctcggctcgaccggcgcccagggcaaggacccggccgcggtgccgctgtactcgatggcgtacgcgctctactacaacaagaagttgttcgccgacgcgggcatcgccaagccgccggccacctgggacgagctgatcgccgacggcaagaagctctccaagggcggcacatggggcctcggagccgagggctcgaacccgtccgagaacatccaccacaccttcgtcttcgccaagcagcacggcgccgacttcttcaccgccgacggcaagcccgacttcacctccgacggcgcggtcacggcggtcaagcagtacgtcgacctgatggcgaaggacaagatcatcgcgcccggcaacgccgagtacgcgcagaaccagtccgtgagcgacttcgccaagggcaagaacgcgatgctgctgtggcagtccgcgtcctccaacctcaagtcgcagggcatgagcgacgacgcgtacggcatcgctccgatgcccgtgcagtccggcaccccgggaagcggcaccaacgtcaactcgatggtcgcgggcatcaacatggccgtcttcaagaacacccacaacctcgacggcgccacgaagttcgtgaagttcatgaccggcgacgcggagcagaagatcctcaacacggcgtacagcacgatcccgccggtcaagaccgcccaagcggacgccgccttcaacaccccggcgaacgcggtcctgaaggacaccctcgccaagagcgccgtcgcgcttccgcaggtcgccgacgagtcccagttcgagacggccatcggtacggccgtcaaggaactgttcgccgacgcggccgccggacgcgcggtgaccacggcgtcggtgaaggccaagctcgagaaggcccagcagcagatgccgaagaag

SEQ ID NO: 1794 - DNA, 1296 bp, Streptomyces avermitilis
  CDS (1)..(1296)
gtggcagcgcgcaacggccggacggtccatgacctgcgacgggagaaccgcaccgccgttctacaacggttgtatttcgacggaccgatgagccgccactcgctcgcgcccgcgaccgggctgagttcgggttccatcagcaacgtcgtcgccgaactgctggccgacggtctggtggaggaggcgggcagcgtcggctccgacggcggccgcccgcgcaccctgctgcgcgtcgtccccggcagcgggcacatgatcggcgtggacgtcggcgagacccgggtgcgcgtggagctgttcgacctctccctggcggaactcgcccgcaccgaacgcccgttggcgcacaagggccggcaggcgtacgacgtgggcgtcatcgtcggtcacatccgcgacggcgtcgccgaggtcctcgcggcagccgggatcaccgccggcgaactcctcggcgtcggcatcggcgtgcccggcatcgtcgagcgttccggcgagggcggcgcggtcgtccacggtcagacgatcggctgggacgccgtcccgctggagcacatgctgcgcctgtcgggtcaactccccgagcatgtgccgtacttcatcgacaacggcgccaagacgctgggccaggcggagatgtggttcggcgccggacgcggcgcgcacaacgccgtggtggtgctcttcggatccggtgtcggcgcctgcgtggtcacggacgaggtggagcacggccgggcggtcgaatggggccacctcaccgtacgggtgcaggggcggcggtgccgctgcggggcgctgggctgcctggaggcgtacgcgggcgccgaggcgctcctcgcgcgctggcaggaggcgggcgggcagccgccgtacgacaccgacgaggagaccgcgctgacggcgatgctggcggcggcctatcccgaggacggccgtgcgccggacccggtggcggcggccgtcctcgccgagaccgcggagtatctgggcgcgggcctgtccgacctgatcaacctcttccagcccgaacgcatcctcgtcggcggctgggccggcctccaactcggctcgcggttcctggagtcggtacgcacccacgccctcgcctacgcactgcggtaccccgccggacgcgtcggcatcgagctgggcaggctcgggccggacgcggtgaccgtgggcgccgcgatcctgccgctcgccgacttcttcgcccacggcggccgccgcgcacccgcacccgacgcacccgtgccgtctcctgcgtggcgtacgtcgctggacgggcgcctggcg

SEQ ID NO: 1795 - DNA, 1797 bp, Streptomyces avermitilis
  CDS (1)..(1797)
atgtcccctgcccccacaggttcttcggcggagcggccttccatagcccgccggacggtgctcggcgccgctgccgccgccgcttccgcgcccgcgctgctcggcctgtccacgccggcctccgccgccccctcctccgccgccccgcgcgccctgccgggcggtggcgacctcggcccgaacgtcatcgtcttcgacccgtccacgtccggcatccaggccaagctggacgaggtgttccggcagcaggaatcggcgcagttcgggaccggccgctacgccctgctgttcaagccgggcacctacaacgggctcaacgcccagctcggcttctacacgtccatcgcgggcctcggactgtcccccgacgacacgacgatcaacggcgatgtcaccgtcgacgcgggctggttcaacggcaacgccacccagaacttctggcgttcggcggagaacctcgcactggtccccgtcaacggcaccaaccggtgggccgtcgcgcaggcggcgccgttccggcgcatgcacgtccgcggcggcctcaacctctcccccaacggctacggctgggcgagcggcggctacatcgcggacagccgcatcgacggccaggtcggaccgtactcgcagcagcagtggtacacccgcgacagcgcgatcggcagctggctcaacggcgtctggaacatggtgttctccggcgtcgagggcgcgccggcacagagcttcccgaacccggtgtacaccacgctgaacaccacccccgtctcccgggagaagccgttcctgtatctgagcggcagtgagtaccgggtcttcctgccggagaagcggaccaacgcccggggcgtgacctggggcaacggcacaccaagaggcacctcgctgcccctgtcccagttctacgtcgccaagccgggtgtctccgcggccaccctcaaccaggcgctcacacagggactccacctgctgctgaccccggggatctaccacgtggaccagccgatccaggtgaaccgcgcgggcaccgtcgtcctcggcctcggttacgccacgctgatccccgacaacggcgtcacggcgctgaaggtcgcggacgtcgacggcgtacggctggccggcttcctcatcgacgccggcccggtcaactccgccaccctgctggaggtcgggccgcggggcgcgagcacggaccactccgccaacccgaccaccgtgcaggacgtgttcgtccgcatcggcggggcgggcgcgggcaaggccaccaccagcatggtgatcaacagccgccacacgatcgtcgaccacacctggatctggcgcgccgaccacgggaccggcgtcggctgggacacgaaccgggccgactacggcatcgtcgtcaacggcgacgacgtgctggccacgggcctgttcgtggagcacttcaacaagtacgacgtccagtggtacgggcagcggggccgcaccatcttcttccagaacgagaaggcgtacgacgccccgaaccaggccgcgatccagaacggctccgtcaagggctacgccgcctacaaggtcggcgacgcggtgaccacgcacgaaggctggggactcggcagctactgctactacaacgtcaacccgtccatcgtgcagcaccacggcttctccgccccgaacacaccgggcgtcaagttccacgacctgctggtcgtctcgctcggcggccagggccagtacgagcgcgtcatcaacgagacgggtgcgccgacgtcgggcacgtcgaccataccgtcgacggtggtgtcgtatccc

SEQ ID NO: 1796 - DNA, 1143 bp, Streptomyces avermitilis
  CDS (1)..(1143)
atgcgccgggtcatcggccgggcggtcgtgaccgccgtggcggtggccctcaccgcgttccttccctccacggcccaggcggccgtctccgtcccacccgccgcggcccgggacgccacctgcggtgtgctggcgccgggtgcctcggccacggcgcaggcggccgtcgatgccgcctgcgcccagatcggcgtctggtacagctggggcggtggccacggcgccacgcccggcgccacgtacggctactacgacggcgtggacccggacagcctccacgacggcgagcgcaagggcttcgactgctcgggcctggtccgttacgcgtactaccgggcgaccggcaaggacctgctcaacggcacgtccaacgaccagttccacagctcgcaggcctccgcccgcttctcggcggggcagggaaccggtccgctgctgcccggtgacctgatgttctgggggagcggtcacatccatcacgtcgccatgtatctgggcggcgggcagatggtcgaggcgtacgagtcgggcacccacatcagggtcgcccccgcccgcaccggcggcgactacgcgggagcgatccggatcaacccctcgggcaccgttccgccgccgcccgcgaacggcggtacgaccttcgagacctggggcaccagtgtgcgcacccactccacgccgagcgtgagcgcctccgtcgtcgacaccttcgccggtccgacccaggtctcggtccagtgccagcagcacgccgagaccgtcaccgcggagggctacaccaacgacatctggtccagactggccgacggctcgtggctgacgaacgtctacatcaagggcccggccgagctgcccggcgtgccggactgcggcggcagcaccacgccgccgcccaccagcggcagcaaggcgttccagacctggggaaccggagtgcgcacgcacagcgaaccccacgtcaacgccggtgtggtcgactacttcgcgcagccgaccacggtcaacgtggtgtgccaggcccatgcccaggaggtgacggccgacggctacaccaacgacgcctggtccaagctcaccgacggctcctggctgacgaacatctacatcaagggcccggcctggctgcccggcgtgcccacctgc

SEQ ID NO: 1797 - DNA, 639 bp, Streptomyces avermitilis
  CDS (1)..(639)
atggagaccagcgacgtcacgtgtgcggcggtcccgtaccagggcgaccgtatgagcccgcgggagttcgacgcgtccttcaccgaagccatgccgcggctgcgccggcggctgctggcgatgaccggcaacgcgcacgatgccgacgatctgttgcaggagacctacctgcggctctcgcgccgggcccgcgcacagaccctggcacgtcagcagcacccgtacgcgtacacctgcgccgtcgccttcaacctgctccgcgactcatgggtgcacccctcccgccgcgagcgcaccacggaccggctgcccgaggcgggctgggacggcggcctcggttcgtacgaggcgtccgccacggctctcgcgctgctgcgcgtgctgtcgccgaaggaggcggccgcggtgatcctcatcgacctggagggcctcagccacgacacggccggtgagcggctcggcgcccaccgcggcaccgtccagcgcaaccggatgcgggcgctggccaagatgcgcgccgcgctcggcgcctgcggaacagagggcgacgacgccgtctcccgtgaagagccgcccgtgccgcgccccttgcaggggagggggcgcggcacgggcatggaccatccgaattccagaaag

SEQ ID NO: 1798 - DNA, 684 bp, Streptomyces avermitilis
  CDS (1)..(684)
gtgacagaaatcatcccgctctcggacgcccgagtcgccggcgtcgccgaggacgaatgcggtgaaccactggtcgatctgcgtgaggtcgccgagctgcgactcgacgcgcgacaggcggaccacgacggcagttacgcccatctgcgggccggcgcactgcggcggctcctccaggcacagcggttgctgcccaccggggtccggttcctggtgctggaggggtaccggccgccgcagctccagcgacgctacttcgaggagtacgcggcgacgatgcgcgcggcccacccggacgaggcgcccgaccggatccgtgagctgacgagcgcgtacatatcgccgccggaggtcgcaccgcatgtcagcggcggagccgtggatctgacgctgtgcggtgcggacggcacggagctgccgctcggcacggaggtcaacgccaccccggaggaaagcgaaggcgcctgccgcaccgcggctccgaacatcagcgtcgaggcacgcgccaaccgggccgtgatggacagggccctcacggcggtcgggttcgtcaactaccccaccgagtggtggcactggtcgtacggcgaccggtactgggccctgctgcgccgggcgcccgccgcccgctacggccccaccgcgccgcccgggctccgggcgggcggctcgacaccgacggca

SEQ ID NO: 1799 - DNA, 1035 bp, Streptomyces avermitilis
  CDS (1)..(1035)
gtggtccactgcgccgaccaagggatggcccgtgcggcccgggatctcgccggtgcgctgatagcgagttcggccgtgctgtacaaccagttcgacgcctggtcgcgctcgcacgccgcggccctcgaggcggtacgccgcggcggggacaccgagggcgaggcgtggctgctcacgggcctcggtcaactgcgctacgaacaggacaagttcgaggagtcgtacgcctacttcgccgacgcgctgcgcctgttcgacgagcgcggcgacgtgccgcgaggggcggccctctccctcgccggaatgggctccgcgcgacgcgaacaggcccgcttcgcggaggcgttgcagctgctgagttccgcactggagcggtacgagcagaccgacgacgtcggcgccagggcgcgcgtgctgtacggaatcggctacgtgcaccgtgagcaggggcgtggggcgcaggcctgggaggccctgtcgggggctctcggtctgtaccgcaccgcgtccgaccggcacggcgaggccctcaccctgcgttcgctggccctgtgccgtcgggcggacggcgcgtgggcggacgccgagcggctgctgcacgaggcgctgcggatcttcgtcggtctccaggacaccttcggcgtgatgtacaccgagcagtcgttggccaaggtggagctgcgccggggccacctggagaaggcacgcgagcggctcggccggtgtctggaggtggcccgcgagcgccaggaccggttcggtgaggcactcgtgctgcgcaccctgggtgagtggtgtctggcggccggcgagaccgagcgcgcgcgggagccactggagcgggcgctggcggcctgggaggcgttggaccttccgctgtggggggcccgtacggcctgggacctggccgaggtgtcggcgtcgcgcgcgacgaacaggcggcgcgggcagcccgcgcgcaggcgctggagaccttccgcgcgctggacagccgggaggcgcgggagcgcgcggacaaaggcgtgtaggacgagg

SEQ ID NO: 1800 - DNA, 2256 bp, Streptomyces avermitilis
  CDS (1)..(2256)
atgttcgaagtgcgtctgctcggtccggtggaggtgtggcaggggaaccggcgggcgccgctcggcggggccagaccccttgccgtgcttgccgcgttgaccgtccatctcggcgaagtgctctccaccgagcgactggtggatttcgtctgggacgagcaggtgcccgccaccgccaccgcgctggtcgccactcatgtctccgccgtgcgccgagcgctcgcacgggtcagcgaggctccggtgatccggacccggccgcctgggtatgtcgccgacttcagtccctcacaggtcgacgcccgccgtttcgaggaactcctcgcgctgggccggagttcggccgcgcgcgaccgtccgggcgaggccgccgacatcctgtccgacgccttgagtctgtggcgcgggcaggaggcactcgaagggctcggccagtccttcgcgcggatcgaggccgcccggctggcggagctgcggctggtggcccaggaggagtccttcggtctgcgtttggcgctcggacgcgaggacgagacgatcgcacccctcctcgcgcatgtcgccgcccatccgctccgggagcgaccgcgcggacagttgatgaccgcgctgttccgtaccggccggatctctgacgcactgcgcacgtaccaggagggacgtgaggtcctccgtcgcgaactgggcatcgacgccgggcccgagctgcgcgccctgcaccaggctgtgctgaccaacgacagcgagcggctgggaaccggcaccggcaccggcaccggcctcgggaccggcgtccgcaccggcctcgggaccggcgtcggcgccggccggaaggccaaggccgtcgcggcaggaccggccgcaacctcctcggcccctccccgaatcccgtacgcccaggacagcacgcaccggatcgccgcccccaccaggttcggccccgagccgaccggccggcccgcccccgccccatcccatctgccccccgacgtggctgacttcgtgggacggacggagcagatcgcctgggccacctcgctgctccacggagtcaacaacaccaccaggaccgctccgccgatcggggtgatctccggacgctcggggatgggcaagaccgccctcgccgtgcacgtcggccaccggaccgccgaactcttccccgacggcaggctgttcgtggacctgcgcgcctcggacaccgcgccgttgcagcccgccgacgcgctcgccagactgctgcgggccatgggcatcgatccggagacgtcgccgaacggaatcgacgacctgaccgggctgtaccgcacacacgtcgcacaccggcgcatcctgctgatcctcgacaacgcggcgggagagacgcatctgcggccgctgttgccgcccggccccggttccgcggtcctggtcaccagccgacgacggctggtggcgctggagggcgcggcacatctggatctgaccgtgccggacgagccggaggcgctgcaactgctgaagcgggtggcaggggaggagcggacgcggtccgagccggaccaggtggcggagatcgtcaccctgtgcggacggctgccgctggcggtacgcatcgccggtgcccggctcgcggcgcgcccgcactgggctcccggccgcctcgcggggcggctgcgtgacgagcggcgacggctcaacgaactgcgcgcgggggatttggagttacgtaccagtctcgaactgggttacgcggacctcgatccgcaggagcgtcgggcactgcgccggctggcgctgatggagctgcccgacttcgccgcgtggatcgccgcacccctgctggacataggaacggaggaggccgaggaagccgtcgagcggttggtggactgccacttcatcgatgtgctcggcgtggacgggaccggccgcaaccgctaccgcatccacgacctcgcccgcgagcacgcccgggaacgatgtctgtccgaggagagcgccgaagagcgtgccgcggcggtgccgcggcggtgctgcggctggtggcctgctggctggggctggccaagggagcggcggcccgggggcccgggggagcggcccggtactttcccgagccggggaccttacgactgctcgaccaggagacggaagagggactgctggaccggcccgcggcctggttcgccgccgagcaggcctgtctgctggcggccgtggtccactgcgccgaccaagggatggcccgtgcggcccgggatctcgccggtgcgc

SEQ ID NO: 1801 - DNA, 1023 bp, Streptomyces avermitilis
  CDS (1)..(1023)
atgaagcgcaccgacgcccggcacgggagggccgcaagcccggctgccgcccgtgacacagccgccccgcggaggcgatcgaggccgggtcggagcggtgtctctgtgctcgccgcgatgtgcgcggtcgcctccctcgccctgaccggctgcacacgggacaccgaccggccccaccccacctccccggtcgcgaaagccgaacgcacccggcagagcccggaactcacctacgccgaggacctgcggatctcggacgccgaacagcacttggtcaagcagtgcatggcgaggcacggttaccgcttctgggaggagcggacgctgaccctggaggagagccggccggtcggctacgtccaggacgacgtccgctgggcccgcacacacgggtacggcagccggatcatggcgaaggaggaccgcgcccggctccgcaaccccaatctcgcctaccgcgcgtcccttcccaccgcccggcagtcgacgtacgacaccgcgctggacggcggccggacagccacgctgctgaagatcgaggcacccggcggcggcacgatcaccaagcggtccggcggctgcacgggcgaggccgagaagaagctgtacggcgacccgaagacgtggttccgggccgactcgaccgtcagcaacctgcgccctctgtacgtgggcaagctgctgcgcgaccaggagttcagcggcgcggtgagggactggtcacgctgcatgcggcgcgccggccacccctaccgcgacccgaacgaggcacgtcaggcgatgcgcgagcacggcacgcgacagacccgggccgcggaggccaggacgttcgcggccgagacccggaccgcgaccgccgacgccggctgcgcccgcgccgcctcactcaagtccatcggcaaggaacgcgaggcccactacgtcggcgagttgtcggccgagtacggggacgccctcgacacctaccgccgtctgaagcgggccgctctcgcccacgccgaacagatcgtcccggcacgagcc

SEQ ID NO: 1802 - DNA, 459 bp, Streptomyces avermitilis
  CDS (1)..(459)
atgcgcaagctgagcatcgccctcgccacgctgggcctcgcggccctcggcctcgccgtcccggccaccgcccacgcgagcgccggctgcgacgcgaagtggccgggccgtgacggcaacgtacgtgcctggaaggacgcggactgccagggcgaactcctcggcgtcacgcccggcagcgaccccaactggggtgacggcgccggccccttccaaggcagtgacgtcaatgtcgcgtcgtcggtcatgaacagcggttacgtcggcggcaaggacgtcgtcgccttctactacctgacgaactacaacgacacgagctacggctgcctcaagccgggcgaactgtacgtcgacaacctgggccgcaaccacttcaccaacggcgccaacatgaacgacaacatcatgtcccacacctgggtggccgcgagcgcctgcgccccgggctcattcatcggc

SEQ ID NO: 1803 - DNA, 2193 bp, Streptomyces avermitilis
  CDS (1)..(2193)
ttgcggcccgacgggcttccccacatggacatgcccccacccgcacgagtcactcgtgccctgggggaacacctcgtgtccatgctcctgctgaagttatcggcgcaggatctgctcgccctgaactcacggcgccgcatggtgccccacctggccgccaggtggaaacacttccgcggatcggatgcctcgctctccgagcgttccgcctgggcggagagcctggtcgatctcgccaaggatctggtggcggccaaccggggaaatgtggaaatgatcgtggagtgtgcggcgacggtcgacgagtccgaccgcccgggtgctccccgtctcatcgacgtcgtcttgatcggccatcatccgtacacgcgcggcctctcggtgcagcttgtcgagctgaagcgctggtcgatggtgaccagggtggaagcggccacagcagagttggtgcatgtaccggggatgggcgagaagaagcatccggcggtgcagttgcgggagtacttcgacgccttcaccggtgccagagggccgctgagcggactcgacttcgagtgtggaggcttcgcgtacctgcacaacgcgacggacgcgtccgtgaagccgttgatggacctcgatgcgcctaccggcgcttacgcccggatgtacacgaacgacggccgcggacggctgatgtcggacctgcgcaagcacttcgccgaggacggcggcgcctccgcggccgagacgctgctccgcagcatgcagttgcggaacacgccactgctcgacgccatgatcaggtcgcgtggagaggacacagtgttcaccctgcgtgggcgccagcaggaggtcgccgaccagatccttggcacgacttcccttgtcctcggagacccgaatcagccggctctcatgccggacgagagacgggtcgtcttcctggtgacgggtggtgccggtacgggcaagagcgccatcggtttgcaggtcaaggcggaactcgaagccaatgggcgaacagtcaagtacgccagcggcagccgggccttcaacggcgcgatccaggagcatgtcggctacggagaccgggagttcagggagagcttcacctacttcagtagtttcgtgactccacccgagccccctttggatgtattgctctgtgatgaggcgcatcgtctgcgggaccgctcgaccagccgcttctggcggcccgagcagcaaggcacaaagccccaggtggatgaactgctcgaagcgtcccgtctgaccgtgttcttcctggacgagagccagtccgtgcggccgaacgaagtcggcaacgtcgagctgatcgagaatgcagccaagcggcacgacgccgaactggtccgctacaggctccgcgagcagttccggtgcggaggcagcgatgcctacatccgatgggtgcgagccgtactcggtgtgacggacgacgtagcggaacagtggacgccggacgggctgatgcatatcgaggtggcagacagccccgaggaactcgagcaggtcatccgctcggaagccctcgccggcgcctcagcgcgtatggttgcgggttactgctggccttggaccaagcccctgggcaaggagaagcggctcgaggctgacgtccgtatcggcgactggcaccgtccgtggaacgctgacagtgagagcttctgcgagaacggtgctccgccttcgaagatctggtcggtgcaccaggacggcctcgaacagatcggctgcgtgtacaccgcgcagggacttgaatgggactggtgcggcgtgatcatgggtgacgacatggtgcgccgtgacggcaagtgggtatttcggcgcggcaaggagcgcaaggacctggaggcgggcgtcaagcgcgtagcggtgccggggtcgtttgatccgaaggtgcgggcgagcagcgtcgacgatgggggcttcgcgcggctcgtccgccatgcctaccacgtgctgatgacccgtgccagccgcgcgaccgtgctctactccacggacgaggagacgcgcgtctacctcaaggatctggtgggcaacgtccagattcacggcctgcgccccacctgggaaaacctaccccctgaggcacgcgtaccgcatcttccccgcccgcggcgcggagggcggaaccgttcacgcaatcggcgagacaaggggcagccgggtcagaaaacactgttc

SEQ ID NO: 1804 - DNA, 1881 bp, Streptomyces avermitilis
  CDS (1)..(1881)
ttgctgttccgcgcgtccgccgcaacggtcgctgtcatggcgctcgacggctcgctcttcctgcatctcaccgaacagttcgtccgcatgcatggctaccgccccggcccttccgaggtccgttcctgggaacgcagcattcccgctctgacggcggcactgaacgaagcgagcctgggcgacgtagaggtcatgatcgagtacgcgctgccgttgaacagcaagcgcgccgacgccgtgcttgccgggctgcacccagccacgggagaaccggcgtacgtcgtggtagagctgaaacagtggagccaggccgcgcctgatgaggacgacccggtcctttgtcatgtggacgcctacgcacacccggtcctcaatcccatcgagcaggtacgccgctactgcgagtacctcgtcaacttcaacggggcggtcgccgagcaccctcaacgcgtcagcggggtggcctacatgcacaatgccacagagttcggggccagcgggctacgagagatcgaacttgacgaccaggggcaattgttcactgccgagcgccgaggggaattcctggaccacctccgttccaagctgagcgacaagcaccctggcgcccgagcagcagacgaactcctcgccggtaagacggtcccctccaagcaactgatgtccgtcgcggctcaggaggtgcaagaccgagaacagttcatcctcctggatgagcagcaggtggcgtaccgcacagtgctcaacgccgtacgcaaggcgaagcagtccgatcgcaaggaagtcttgatcgtcaccggaggtcccggaacgggcaagagtgtcatcgcgctttcgttgctcggtgagctgtaccgacagggcgttccggctctacatgccaccggctctcagtcgttcactaaaaccatgcgtaaggtcgcgggcgcccgcaagcgcgaagtgcaggacctcttcaagtacttcaacagcttcatgacgacagagaagaacaccctcgacgtcctgatctgtgacgaggcgcaccgcatccgcgagacctccgccaatcgctacacccctgcagcccatcgcagcggtcggccgcagattgaggagttgatcgacgtcgcccgggtgcctgtgttcctcctcgacgaacaccaagtggtgcgccccggcgagatgggcacagtggccgagatcaaggcggccgccgcgaagaagggctttgagtgtcatgtcgtaccgctcgaaagccagttccgctgcggtggcagcgatgcctacctgcgctgggtcgttcgcctcctcggcctcgagccgggtggccctgtcgcctgggaccccgatgatcggatgcaactcctggtcgccgaaagcccggaggagatggaatcgtttctccagaaccgccgagggcagggatacggcgcccgaatgtccgcgggatactgctggacctggtcgaaggagcccaagccgggcgacccgctcccggcggacgtcgtcatcggcgactgggcgcgcccctggaacctccggggcgagcgcgccatctccggcgcaccgccgtccgccctgtgggcgaccgacccggccggcttcggccaggtgggctgcgtctacacggcacagggcttcgagtacgactggtccggcgtcatcatcggcccggacctgatctggcgtggcgacacctgggtcaccgaccgtaccgcctccaaggatccggtcttcaagaagtccactctggattcggacgtcgatcgcctgatccgcaacacctacaaggtgctgctgacgcggggcatggtcggcacggtggtgtactccacggatcccgagacgcgggcgaagttgcgcgaactggtgggggtgcaacgcgaggtggtcgcagtc

SEQ ID NO: 1805 - DNA, 1539 bp, Streptomyces avermitilis
  CDS (1)..(1539)
atggcacccaccctcaccctcaaatccggcacgtcctggtccgacgcctggcggcgctgtctggcggtcgcacccgaggcgttccgggacgaccgggtcctcaacctctggggcgccgcctggcagacggacggccgggcgctgcccgcgaccagtcccgtggacggcagcccgatcgcgggaccgccgcgcctggacggtgacatcgccgggcaggccgtacgcgcctcgctcgaccagcaccgcgcctggcgccacgtccccctggacgaacgccgggcgcgcgtcgccgcgaccctcgacgcgctgaccgaacaccgcgagctgctcgccctcctcctcgtctgggagatcggcaagccgtggcggctcgcgcaggcggacgtggaccgggcgatcgacggcgtccgctggtacgtcgacggaatcgaacccatggtcgcggaccgggcgccgctggacggaccggtctccaacatcgcgagctggaactacccgatgagcgtgctcgttcacgcgatgctggtacaggcactggcaggcaacgcggtcatcgccaagaccccgaccgacggcggcgtcgcctgtctgaccctggccggcgcgctcgccgcccgcgaagggattcccgtcaccctcgtcagcggcagcggaggcgagctctcggaggccctggtccgcgcccccgagatcggctgtgtctccttcgtcggcggccgcgacacgggcgccgcggtggccacggacgtcgccgacctgggcaagcgacacatactcgaacaggagggactgaacacctggggcgtctggaactacaccgactgggacgcactgacggccgtcatccccaagctcttcgactacggcaaacagcgctgcaccgcctacccgcgcttcgtcgtccagcgcaccctgttcgacgagttcctggccgcgtacctcccggccgtccgcaccctgcgggtcggccacccgctggcggtggagcggcgcgaggacccgtacccggagctggacttcggcccggtgatcaacgcggccaaggcgaaggagctgaacgaccaggtcaccgaggccatcgaccgcggcgccgtcccgctgcaccgcgccaggctgaccgacgcccgcttcctgcccggccaggacacgtcggcgtacgtccagccggtgacgctcctgaacccgcccccgtcctcgccgctgcaccacgcggaaccgttcggcccggtcgacaccatcgtcctggtcgatacggaggcagagctgctggccgccatgaacgcgtccaacggcgcgctggtcgccacgttgtcgaccgacgacagggcgacgtacgaccgtctgtccccacagatccgcgcgttcaaggtcggccacggcaagcctcgctcacgcggcgaccgcgacgagctgttcggcggcttcggcgcgtcgtggcgcggcgcgttcgtgggcggcgagctgctggtacgtgcggtgacacaggggccggcgggggagcggctgcccggcaacttcccggagtaccacctcatgccg

SEQ ID NO: 1806 - DNA, 897 bp, Streptomyces avermitilis
  CDS (1)..(897)
atggccatctacctcaccaaggagagcaaggtcctcgtccagggcatgaccggcggcgagggcatgaagcacacccgccgcatgctcgcggcgggcacggacgtcgtcggcggggtcaacccgcgcaaggcgggccgtgccgtcgacttcgacgagcggaccgtccccgtgttcggctcggtgcgcgagggaagggaggcgaccggcgccgacgtcaccgtcgtcttcgtaccgcctgccttcgccaaggcggccgtcgtcgaggccgccgacgccggaatcgcgctcaccgtcgtcatcaccgagggcatcccggtccacgacgcggtcgccttccacgcgtacgccgccgccaagggcacccggatcatcggccccaactgccccggcctgatctcccccggccagtccaacgcgggcatcatccccgccgacatcaccaagcccggccgcatcggcctcgtctccaagtccggcaccctcacctaccagctcatgtacgagctgcgcgacatcggcttctcgacgtgcgtcggcatcggcggggacccggtcgtcggcacgagccacatcgactgcctggccgccttcgaggcggaccccgacaccgaactcatcgtcctgatcggcgagatcggcggcgacgcggaggaacgggcggccgcgtacgtccgcgaccacgtcaccaagcccgtcgtcggctacatcgccggattcaccgcccccgagggcaggaccatggggcacgcgggggcgatcgtgtccggttcgtccggcaccgcgcgggcgaagaaggaggccctggagggcgcgggcgtgcaggtgggcggcacgccgaccgcgacggcacggctggtgctggcccgactggaagcggagcgtgacgtcactcatagt

SEQ ID NO: 1807 - DNA, 1128 bp, Streptomyces avermitilis
  CDS (1)..(1128)
atggacctgtacgaacaccaggcaagggaactcttcgcggaccacggcatcttggtgccgagggccgaggtcaccgactcgtcccaggaggcgcgcgtcatcgcccgcaggctcggcggccgcgtcgtagtgaaggcgcaggtcaagaccggtggccgcggcaaggcgggtggtgtgaagctcgccgcggaccccgccgccgccgaactcacggcgcgccagatcctcggcatggacatcaagggacacacggtcggcaaggtgatgctggccgaacccgtcgacatcgaggcagagttctacgtctcctacgtactcgaccgcgcggccggccgcttcctcgccatcgcctccgcggaaggcggcatggagatcgaggaggtggccgccacccgcccggaagccgtggcgcgtgtccccgtcgacccggccgagggtgtcacctccgcgaaggcggccgagatcgcggaagcggccgggcttcccccggcgaccgtcgacgtactcgtccggctctgggaggtactgctccgcgaggacgccgtactggtcgaggtgaacccgctcgtgcgtacggcgcaggggcagatcctcgccctcgacggcaaggtcacgctcgacgacaacgcccgcttccggcagacgcgttggggcgccgaagccgcggagcacggcgatcagctggaggcggcggcagcggccaaggggctcaactacgtgaagctggacggcgaggtcggcatcatcggcaacggagcgggcctcgtcatgtcgacgctcgacgtggtcgcgggctgcggggcccgccccgccaacttcctcgacatcggcggcggcgcctccgcccagatcatggccgacggcctgtccgtcatcctctccgacccggccgtgaagtccgtcttcgtcaacgtcttcggcgggatcaccgcctgcgacgcggtcgccgacgggatcgtgcaggccctggacaccgtccggttgaccaagccgctcgtggtccgcctggacgggaacaacgcggcacgggggcgggcgatcctcgacggccgccggcaccccctggtccagcaggtcaccaccatggacggcgccgcgcgccgcgccgcccaactcgccgacgccggc

SEQ ID NO: 1808 - DNA, 1692 bp, Streptomyces avermitilis
  CDS (1)..(1692)
atgcccgacggcagcagcgacaacaactcggacctcatctccggtgggcacctggtcgccaaggcactcaaagcggagggggtggaggtcatctacaccctgtgcggcggccacatcatcgacatctacgacggctgcgtggacgagggcatcaaggtcgtcgacgtgcgtcacgagcaggtcgccgcgcacgccgccgacggctacgcgcgcatcaccggcaagcccggctgcgcggtcgtcacggcgggtcccggcaccaccgacgccgtgaccggtgtcgccaacgccttccgcgcggagtccccgatgctgctgatcggcggccaaggggcgcacacacagcacaagatggggtcgctccaggacctcccgcacgtcgacatgatgacgccgatcaccaagttcgcggcgaccgtgccggacacggcgcgcgccgccgacatggtgtcgatggcgttccgcgagtgctaccacggcgcaccgggcccctccttcctggagatcccgcgcgatgtcctcgacgccagggtgccggtgagcaaggcccggattcccgccgccggccagtaccgggcctcgacccgctcggccggcgatcccgaggcggtcgagcagctcgccgacctcctcgtgcacgcggagaaaccggcgatcctgctgggcagccaggtgtggacgacacgtgggaccgaggccgccgtcgacctcgtgcgcaccctcaacatcccggcgtacatgaacggcgccgggcgcggcacgctgccgcccggggacccgcaccactaccagctgtcgcgccggtacgcgttctccaacgccgacgtcatcgtcgtcgtcggtacgccgttcgacttccgcatgggctacggcaagcggctgtcgccggacgcgaccgtcgtgcagatcgacctcgactaccggaccgtcggcaagaaccgggacatcgacctcgggatcgtcggcgacgcggggctgatcctgaagtcggtcaccgaggcggcctccgggcgcctcaacggaggcgcgtcgaagcgcaaggagtggctggacgaactgcgcgccgccgagcagacggccctcgacaagcggctgcccagcctgaggtccgacgcctcacccatccacccgtaccggctggtcagcgagatcaacgacttcctcaccgaggactccgtctacatcggcgacggcggtgacatcgtcaccttctccgggcaggtcgtgcagcccaagtcgcccggacactggatggacccgggtccgctgggcacactcggcgtcggcatcccgttcgtgctcgcggccaagcaggcgcggcccgacaaggaagtggtggccctcttcggcgacggcgcgttctccctcaccggctgggacttcgagaccctcgtccgctacgacctccccttcgtcggcatcgtcggcaacaactcctcgatgaaccagatccgctacggccaggcccagaagtacggcctggcccgcgagcgggtcggcaacaccctcggcgacgtccactacgacaagttcgcccagatgctgggcggttacggcgaggaggtccgcgaccccgccgacatcggcccggcgctgcggcgcgcccgcgagtcgggtaagccgtcgctgatcaacgtctgggtcgacccggacgcgtacgcccccggaaccatgaaccagacgatgtacaag

SEQ ID NO: 1809 - DNA, 1227 bp, Streptomyces avermitilis
  CDS (1)..(1227)
atgaccaaggctctcgaaggcatccgcgtcctcgacatgacgcacgtccagtccgggccctccgcgacccagctgctcgcctggctcggcgcggacgtggtcaaactggaggcgccgaccggtgacatcacgcgggggcagctgcgcgacctcccggacgtcgactccctctatttcacgatgctcaactgcaacaagcggagcatcaccctcaacaccaagaccgagcgcggcaaggagatcctcaccgagctgatccggcgctccgacgtcatggtcgagaacttcggaccgggcgcggtcgaccgtatgggcttcacctgggaccgcattcgggacatcaatccgcggatcgtctatgcctccatcaaggggttcggcgacgggccgtacaccgacttcaaggcgtacgaggtcgtcgcgcaggccatgggcgggtcgatgtcgaccaccggcttcgaggacgggccgccgctggcgacgggggcccagatcggggactcgggcacgggcatccacgccgtggcggggattctcgcggcgctgtaccagcgggagaacaccgggcgcggtcagcgggtcaacgtggccatgcagcatgctgtgctcaacctctgccgggtgaagctgcgcgatcagcagcgcctggcccatggcccgctcgctgaatatcccaacgacgacttcggcgacgaggttccccggtccgggaacgcgtccggcggcggccagcccggctgggcggtcaagtgcgcgccgggcggccccaacgactacgtgtacgtcatcgtgcagcccgtcggctggaagccgctcagcgagctcatcggccggcccgagctggcggacgaccccgagtgggcgacgccggaggcgcggctgccccagctcaccaagatgttccagctcatcgaggaatggtcggccacgctccccaagtgggaggtgctggagaagctcaacgcccacaacatcccgtgcggccccatcctgtccaccaaggagatcgtcgaggacgcgtcgctggtcgccaacgagatggtggtgacggtgccgcatccggagcgcggcgagttcgtgaccgtgggcagcccgctgaagctctccgactcccccgtggacgtgaccagctcgcccctgctcggcgagcacaacgcagaggtgtacgtcggcgaactcggcctcggggacgaggagctgcgcctgctcaagtcgaacggagtgatc

SEQ ID NO: 1810 - DNA, 2145 bp, Streptomyces avermitilis
  CDS (1)..(2145)
gtgatggccgaagaccgggcgctgagggtgcggacgctcctcgacaccgtgcgggccgagggacggaccgcgctgacggcgcccgagggcaaggtgatcgccgacgcgtacgggatcgccgtgcccggcgaggaactggcgacggacgtcgacgaagcggtcgcgtacgcggcgcgcttcggcggccccgtcgtgatgaagatcgtctccccggacatcctgcacaagaccgacgcgggcggcgtcatcgtcggtgtggagggcgcggcggacgtacgcgccgccttctgccggatcgtcgagaacgcgcgggcgtacaacgagcgggcccgcatcgagggcgtacaggttcaggaactcctcccgcggggacaggaagtcatcgtcggcgcggtcaccgatccgacgttcgggaaagtggtggccttcgggctcggcggcgtacttgtagaggtcttcaaggacgtcacgttccggctggcgcccgtggacgccgacgaggccctgtcgatgctggactcgatccgctcgacggagatcctgcgcggggtgcgtggggccgccgcggtggaccggtgggcgatcgccgagcagatccgccgggtgtcccgactcgtcacggacttcccggagatcgcggaggtggacctcaacccggtggtcgccaccccggagggcgcggtcgcggcggacatccgggtgatcctcgcggagtcgcagccgaagccccgacgcacgtacacgcgcgaggagatcctcacctccatgcgccggctgatgcagccctcctccgtcgccgtgatcggtgcctccaacgagcacgggaagatcggcaattcggtgatgcgcaacctcatcgacggcggcttctccggagagatccatccggtgaaccccaaggccgacgacatcgtgggccgcaaggcgtacaagagtgtcacggacattcccggtgaggtggatgtggcgctcttcgcgattcccgccacgttcgtggccgcggccctggaggaggtgggacgcaaggggatccccaacgccgtactgatcccctccgggttcgcggagaccggcgagcacgaactccaggacgaggtcgtggcgatcgccgagcggcacggcgtccggctgctcgggccgaacatctacggctactactcgacgtggcacgacctgtgcgccacgttctgcacgccgtacgacgtcaagggcggcgtcgccctcacctcgcagtccggtggcatagggatggccatcctgggcttcgcgcgcactacgaagacgggtgtctcggcgatcgtcgggctcggcaacaagtcggacctcgacgaggacgacctgctcacctggttcggcgaggacccgcacaccgagtgcatcgcgatgcacctggaggacctcaaggacggccgcgccttcgtggcggcggcccgggcgacggtccccaggaagccggtcgtggtcctgaaggcgggtcgcacggcggcaggcgccaaggccgcgggatcgcacacgggcgcgctcgcgggcgacgacgccgtgtacgacgacatcctgaagcaggccggggtcatcagggcgcccgggctgaacgacatgctggagtacgcgcgcgcgttgccggtgcttcccactccccagggcgacaacgtcgtgatcatcaccggggccggcggcagcggcgtgctgctgtccgacgcggtgaccgacaacgggctgtccctgatggagatcccgccggacctggacgcgtccttcaggacgttcatcccgcccttcggagccgcgggcaacccggtcgacatcaccggcggtgagccgccgtcgacgtacgaggcgaccatccggctgggtctcgaggacccgcgcgtccacgccctggtcctcggctactggcacaccatcgtcacccctcccatggtgttcgccgagctcaccgcgcgcgtggtggccgagttccgggagcgcggcatcgagaagccggtggtggcgtcgctcgccggcgacgtcgaggtcgaggaggcctgccagtacctctacgagcgcggggtcgtggcgtacccgtacacgaccgagaagccggtggccgtactcggcgcgaagtatcgctgggcgcgggcggcggggctgttggggggcggttca

SEQ ID NO: 1811 - DNA, 1479 bp, Streptomyces avermitilis
  CDS (1)..(1479)
gtgcgcgtcggccgccccgggacccgtgcgcacacgaaaggcattggacagggggcgctggccagaactttcgacgcaaggggcaatcgcgatatgacaaccaccgacctatcgacgtccgtcccctacagggaggtgacggaccgcaacggccgcgtgtaccggatcggcgagaccgataccgacctcatgggccggccacgcacctggatggtcatcctgccctgggtgggcatgatgggcatcagctccgccgagtacgcgttcacgtcggcggaggacaccctccacgaggctcatctgtggagcagcggacacatcttctggctgatgggcgtctgggtgttcttccaggcggccgtggccttccccgccggacagctgcgggagagcggcaggctgcccgcccgcacggcgatgatgatcggcgcgctcggcaccctgctgggctatctggcgctggctttcgcgccgaacgtggtcgtcgcctacgtcggcttcggcatgtgcagtggcatcggcgccggcctggtctacgcgacctgcatcaacatggtcggcaagtggtatccggagcgcaagggcggcaagacgggcttcgtgaacggcggtttcgcctacgggtccgtgcccttcgtcttcatcttcacgtcggtgctggacctgagcaactacaaggtcgtgctcagctgcgtgggcgtcgggctgtgcctggtggtggcgtcggccggctggttcttcaaggatccgccgaagagctggtggcccccgcacgtcgacccgctgacggtgaccgacgacccgaggatccgccgggcgctggcgaagaacccgccggcggtcaagcagtacacccccaaggaggccgctcgtacgcccgtgctctggatgatgtggttctgtctgctctgcacggccggcatcaacatcttcggcatcgccttccaggtgccgttcggcaaggacatgggcttcgcgggcgggatcgtggccacggcgatgtccctgaaggccatcgtcaacggcaccgggcgcggcgtgatcgggtggatatccgatcgctacgggcgccgcaacacgctggtcgtcgtgtgtctcgtgctgggttccgcccagttcggcgtcctggtgtcgggccagatgggcagcatgccgttcttcctgttctgctccatggtctccggattcggcggtggtgcgatcttcccgctgttcgcggcgatgaccgcggactacttcggcgagaacaacaacgccagcaactacggaatggtctacagctccaagctcatctcgggcctggtgggatccggtctgggcgcggtcgtcgtcggtgcgtgggactacgacggcgcgttcgtcctggcgggctccgtcgggctggcctcggcggtcctggcgctgttcctgcgggcgcccggacggcccagggcccagcacatcctccccaacccgcagccgctcggcgaggagatggcg

SEQ ID NO: 1812 - DNA, 1404 bp, Streptomyces avermitilis
  CDS (1)..(1404)
atgacggcggaccccatcgcggcgaggagcgcgtcggcagaccccggcgccccgaaccgctcgtaccgggaagtgaccgactcgcgcggccgcgtctaccgcgtgggcgagacggaccgcgacatcctcggccactcacgaaaattcatggtgtacctgccatgggcagccatgatggccatcagcgtcttcgaatacgcgtacggctcggccgaggacaccctgtcccacgcccacggctggacgcagagcaacacgttctggatcctgagcgtctgggtcttcttccaggccggtatcgccttccccgcgggctggctgcgcgagaagggcgtcctgaccgcctgcacggccatgcacctcggcgcgggcatgtgcctggtcggattcctcgccctgtcacacctgagcaacgtgctcctggcgattctgggattcggtgtcgtcggcggcatcggttccggcctggtgtacgcgacctgcatcaacatggtcggcaagtggttccccgagcgccgcggtgcgaggaccgggttcgtcaacggcgggttcgcgtacgggtcgcttcctttcatcttcatcttcaactacgcgttcgacacggcgaactaccaccgggtcctggacctcatcggctgctacgtgatgatcgtggtcctgtccagcgcgttcttcttcaaggacccgccgaagaactggtggcccgcggacatcgatccgctgacctgctcgggcaacggcaagagcgccgcgagtctcgcgaagaacccgcccgcggtgaagcagtacacgcccaaggaggccatcaggaccggtgtgctcccgttgatgtggatcactctcgtcatgacggcaggcgtatcgatcttcgggatctccttccaggtcgacttcgccaaggaggtcggcttcgggccactggtggccgcctcttcgatgggcatcatggccgtcatcaacggcatcggccgcgcggtggtgggctggctgtccgacatcttgggccgcaagctcaccctggtgttcgtgatcgtcgtcctgggtctcgcccagttcggcgtgatctgggccggcgacgtcaagagcgagtggctgttcctgttcttcgccttcctctccggattcggcggcggcgcgttctacccgatgttcgcggcgctgaccccggactacttcggcgagaactacaacgccaccaactacggcctggtgtacagcggcaagctgatcagcggtctgttcggcggcggactcggctccatggtggtcgcggcctggggctacaacggcgcgtacgcgctggccggggcgatctccatggtggcggcggcgatcgcgctgctgctgaagcagccggggcggaacacggacaggagcctgactccggagccgcagccggcgggc

SEQ ID NO: 1813 - DNA, 1002 bp, Streptomyces avermitilis
  CDS (1)..(1002)
atgccgcgcgacttcacactcttcaccggccagtgggccgacctcccgctcgaagaggtctgccgcctcgcccgcgacttcggctacgacggactcgaactcgcctgttggggcgaccacttcgaggtcgacagggccctcgccgacccgacgtacctcgagtccaggcacgcgcttctcgacaagtacggcctcacgtgctgggcgatctccaaccacctggtcggtcaggcggtctgcgacgccctcatcgacgagcgccaccgggcgatcctgcccgcgcggatctggggcgacggcgcggccgaaggggtacggcagcgggccgcggccgagatcaaggacaccgcgcgcgccgcggcggccttcggcgtcgacacggtcatcggcttcaccggctccgccatctggcacctggtcgccatgttcccgcccgtccccgagtcgatgatcgaccgcggctacgaggacttcgccgagcgctggaacccgatcctggacgtcttcgacgccgagggcgtgcggttcgcgcacgaggtccaccccggcgagatcgcgtacgactactggacaacccagcgcgcactggcggccgttgaccatcggcccgctttcgggctgaacttcgacccgagccatttcgtgtggcaggacctcgaccccgtcggcttcctgtacgacttccgcgaccgcgtctaccacgtcgactgcaaagaggcccgcaagcggctcgacggacgcaacggccgcctcggctcgcatctgccctggggcgacccgcgccggggctgggacttcgtctcggccggccacggcgacgttccctgggaggacgtcttccgcatgctgggctccatcgactaccgcgggcccgtctccgtcgagtgggaggacgccggcatggaccggctccagggcgcccccgaggcgctgacccgcctgaaggcgtacgacttcgagccaccgtcggcctccttcgacgcggcgttcggcggcaacgac

SEQ ID NO: 1814 - DNA, 1206 bp, Streptomyces avermitilis
  CDS (1)..(1206)
atgggacagccgcacccgcgcgacgaggcggacgccgggaagccgccgctcggtatcggcatggtcggctacgccttcatgggcgccgcccactcccagggctggcgcaccgtcggccgcgtcttcgacctgccgtcccgcccggtgctcgccgccgtgtgcggccgcgacggacaggccgtgcgcgccatggccgagcggcacggctgggcggcggccgagaccgactggcgcgccctgatcgcccgtgacgacgtcgacgtcgtcgacatctgcaccccgggtgacagccatgccgagatcgccgtcgccgcgctggccgcgggcaaacacgtcctgtgcgagaaacccctcgcgaacacggtcgaggaagcggaggccatggcggccgcgggcgaacaggcttatcggcagggccggttgaccatggtcggcttcaactaccgtcggctgcccgccacctcgctggcccggcggatggtccgcgaaggccggctgggcaccctgcggcacgtgcgggtgacgtaccttcaggactggctggtcgaccccgagtttccgctcacctggcgactgcgcagggaagtggccggttcgggggcgctcggcgacctgggcgcccacatcgtcgacctggcccagtacctcgcgggcgagcccctggccggagtctccgcgctcaccgagaccttcgtacgggagcgtccgctgcccggcggcacgaccggcgggctcgccgcggtctccgcgggcggtctcggcaccgtcaccgtcgacgacgccgctctcttcaccgcccgcttcgcctccggcgccctcgccaccttcgaggcgtcccggttcgcgaccggccgcaagaactccctgcgcatcgaactcaacggcgagcgcggctcgttggccttcgacctggagcggctcaacgagctcgcgtaccacgaccacaccgaacccctcgcgcacgccggcttccgccgcatcctggtcaccgagcccgaccacccctacctggaagcctggtggccgccgggccacggcctcggctacgagcacaccttcgtccaccaggcccgcgacctggtccatgccatcgcggcgaaccaccgccccgagccgtccttcgccgacgggctgcaagtgcagcgcgtgctggcggcggtggaggagagcgccgccaagaactccgtctacacacccgtagtggtc

SEQ ID NO: 1815 - DNA, 1047 bp, Streptomyces avermitilis
  CDS (1)..(1047)
atgccagagccgacacctgtcacgagccgcagaggactgctcttcgggaccgccgccgtatccgccggtgccctcctcgtgggttgcacaagcaatgacaccacgtccgagaagccggccgcgaacgaccggtcggccgccgacgacaaacccggcaagcacgtcaccatcggcttcgccggaccgcaggccgaccacggctggctcaacgcgatcaacgacaacgcgaagagccgggcgaagaagtacggcgacgtgacgctggagatcaccgagggctccaacgacaccgccgcgcagatcggccagatcgagacgctgatcaacaagaaggtcgacgtcctggtcgtcctgcccgccgacggcaaggcactcacccaggtcggcctcaaggcgatgcgcgcgggcatacccgtcgtcaacctcgaccgtatcttcaactccccgcaggcgtaccgctgctggatcggcggcgacaactacggcatggggctgagcgccggccgctacatcggcgagaagctcaaggacaagccgaacgcgcgcgtcgtcgagctggccgggctggacaacctggagctcaccaagcagcgcacgcagggcttcgacgcggcgctgaagaactacccgaacatcaggaaggtcgcccggcaggcagccgagttcaccgtcgagtccggacagtcgaagatggcccagctcctccaggcccagtccaggttcgacgcgctgtggaaccacgacgacgaccagggcgtcggcgcgctgcgggccatcaagcaggccggacgggacgacttcctgatggtcggcggcgcgggcgcgctctccgccttccaggccatcaaggcggacgacggtgtcctgaaggcgaccgtgctgtacccgccgaccatggccgcgtccgccatcgacctggcccgcgcgctcggccagggcaagggcgtcggcggcctcgccgagttcgagatcccggcctccctgaccctctactcggcggtcgtcgacaaggacaacgtcggccagtacatgtccaccggcttcagg

SEQ ID NO: 1816 - DNA, 1017 bp, Streptomyces avermitilis
  CDS (1)..(1017)
atgacgcagcccgtatctccgcccaggggcggcaccggccaggcgtcaccggtgagtgaactccccgcatggcgctccctcgccgcccgcgccgacgtccgcacgctctcgctgctcggtgtgctcgccgccctggtcgtcatcggcggcatcaccaaacccgacgagttcctcgacacccgcaatctccaactcgtcctcacccaggcctcggtgatcggcgtcgtcaccgtcggcatgaccttcgtcatcacctccggcggcatcgacctgtccgtcggcgcgatcgtcgccctcgcctccgtatgggccaccaccgtcgccacccaggagtacggcttcgccggcatcctcttcaccgcgatgatcgtcggcgtgggctgcggcctcgtgaacggactgctgatcgcgtacggcgggctggtgccgttcatcgccacgctcgccatgctggcctcggcccgcggcctcgcgctccagatcacggacggcaggacacagatcgtcaccgtcgacacggtcctgaagctgggggagcgcgattcctatctgctcggcatcccgccgctcgtcctggtcttcgcggtcgtgacggtcatcggctggctgatcctgaaccgcaccaccttcgggcggcgcacggtcgccgtcggcggcaacgcggaggcggcccggctcgcgggcatcgacgtacgacgccagcggctgtacctctacctgctctccgggctgtgctgcggcatcgccgccttcctgctgatcatcctgtccggctcgggccagaacaccaacggcaacctgtacgagctcgacgccatcgcggccgcgatcatcggcggcaccctgctcagcggaggccggggcaccatcaccggctcggtcctcggcgtactgatcttcaccacgatcaccgacatcttcgccctgaacaacctgcagagcgacgtccagcagatcgccaagggcgcgatcatcgtcgccgccgtgctggtccagcgccgtaccgcgagcacgacc

SEQ ID NO: 1817 - DNA, 1536 bp, Streptomyces avermitilis
  CDS (1)..(1536)
atggcaccagaaccaccgctgctcaccatgtccggcatcaccaagtcgttccccggcgtccgggccctcgacggcgtcgacctcgacgttcaggccggcgaggtccactgtctgctcggccagaacggcgccggaaagtccaccctcatcaaggtcctggccggcgcccaccagcccgacgacggccgtctgtgctggcgcggcgcacccgtcacgctccgctccccgatcgccgccatgcgcctcggcatcgccaccatctaccaggaactagacctggtggagggcctgtcggtggccgagaacgtccacctcggccatgagcccacgaccgccggcttcgtcgtacgagggaaggccgcgcgagcctcgacagcggctctcctcaagcgcctcggccacccggagatcgcaccgtcgcgcctcgtcggcgacctgtcggcagcccagcagcagatcgtctccatggcgcgcgcgctctcccacgacgtccgcctcatcgtgatggacgagccgtccgcggccctcgatcccgacgaggtcgacaacctcttccgcatcgtcggcgacctcaccgcggacggcgtcgccgtcgtccacatctcgcaccgcctcgaggagatccgccggatcggcgaccgggtgaccgtactgaaggacgggcgcgcggtggcgggcgggctgcccgcgaaatccacgccgacgcgcgagatcgtggcgctgatgaccggccgcgacgtggagtacgtcttcccggaccggccgcccgcccctgccccagccacctccgaccccctactcaaggtccagggcctcgccagggaaggcgagttcgagcccctcgacctcgaactgcgccccggcgagatcgtcggactggccggactggtgggttcgggacggtccgagatcctggagaccgtctacggggcccggaagccgtccgcagggcaggtcacggtggccggacgggcgctgcggcccggcagcgtacgcgccgccgtccgcgccggactcgggctcgcccccgaggagcgcaagacgcaggccctgctcctgctggagtccgtcacgcgcaatgtgtcgctctcctccatgtcccgcttcgcacacggaggttggatcgaccgcggcgccgaacgcgatgccgcgcgagccgcgacccgggaactgtcactgcgccccgaccgtccgtccgcgcccgcgcgcaccctgtccggcggcaaccagcagaaggccgtcctggcgcgctggctgctgcgcggctgccgggtgctgctcctcgacgaacccacccgcggcgtcgacgtcggcgcccgcgccgagctgtacgcggtgatccgccgcctcgccgacgagggcctcgccgtgctgctcgtgtccagcgaggtacccgaggtgctcggcctcgccgaccgggtgctggtgctgcgcgagggccgcgtcgtacaccgggcgcccgcccgtgaactcgacgaacaccgcgtcctcgacctggtcatggaaggaagccccgtggaaggaaccccggcgtca

SEQ ID NO: 1818 - DNA, 1188 bp, Streptomyces avermitilis
  CDS (1)..(1188)
gtgagacgtatgacggctcgacccgcgaacgctcaccaggcccggctgctgcgcctgttgcgtgacgacggccccaactcccgcgctcagctgggcgaccggatcgatctctcgcggtcgaagctggccgtcgaggtggaccggctgctggagacgggcctggtcgtggccgacggactcgccgcctcccggggcggccgccgctcccacaacatccggctcgcgcccgcgctccgcttcctcggcgtcgacatcggcgcgacctcggtcgacgtcgccgtcaccaacgccgaactggaggtcctggggcacatcaaccagcccatggacgtccgcgagggcccggtggccgtcttcgagcaagtcctcgccatggcagccaagttgagggcttcggggctcgcggagggcttcgacggcgccggagtcggggtgccgggtccggtccggttcccggaaggcataccggtcgcgccgccgatcatgccggggtgggacggcttcccggtgcgcgaggcgctcagccaggatctcggctgccccgtcatggtcgacaacgatgtgaacctcatggccatgggggagcagcacgcgggcgtcgcacgctccgtgggcgacttcctctgcgtcaagatcggcaccggcatcggctgcggcatcgtcgtcggcggcgaggtgcaccgcggggtgacgggcagcgcgggcgacatcgggcacatccaggcggtgccggacggccgcccgtgcgcgtgcggcaaccgtggctgcctggaggcccacttcagcggcgcggcgctcgcccgcgacgccaccgaagccgcccagcaggggctttcggaagagctcgccacccggctggcggcggcgggcacgctcaccgccgtcgacgtcgccgccgcggctgccgccggggacgccaccgcgctcgacctgatccgcgagggcggcaaccgcaccggtcaggtcatcgccggactcgtctccttcttcaaccccggactggtggtgatcggcggcggggtgaccggcctcggccacaccctgctcgccgcgatccgcacccaggtctaccgtcagtcgctgccgctcgcgaccggcaatctgcccatcgtgctgggcgagttgggcccgaccgccggagtcatcggcgcggcccggctgatcagcgaccacctgttctcacccgcg

SEQ ID NO: 1819 - DNA, 672 bp, Streptomyces avermitilis
  CDS (1)..(672)
atgttgtccgcaggactgccgcaggggacggtgcccaagctcgaacggcccggtccgctgcgcgaccgcgtctacgaggcgctgctcgaactcatcaccacccgcgccctccagcccggccagcatctcgtcgagagcgaactcgccgggcacctcggagtctcccggcagccggtgcgcgaagcgctccagcggctgaacaccgaggggtgggtcgatctgcggcccgcccagggcgcgttcgtgcacgaaccgacggaggacgaggccgaccagctcctcacggtccgtacgctcctcgaggccgaggcggcccggctcgccgccgccaacgcgggcacggcgggcatcaccgccctcgaagagctgtgcgcgcagggcgagcgggcggtggccgacgacgacgtggacggagcggtcgcgatgaacgcccggttccatacgaaggtcatggagctcgcgggcaacgccgtgctcgccgagctggccgcgcaggtcgaccgccgggtgcgctggtactacacgccggtcgcccggcagcgcggccgccagtcctggatcgagcaccgcgatctgatcgacgcgatctcggcgcgggacgagcggcgcgcgacggaggtcatgcgcgcccacaccgagcacacgcgcaagacgtaccacgagcgcgagaag

SEQ ID NO: 1820 - DNA, 945 bp, Streptomyces avermitilis
  CDS (1)..(945)
atgaacggctcacgcatcgccgccgtcggccactaccagcccgccaaggtactcaccaatgaggacctggcgagcctggtcgacaccagcgacgagtggatcaggagccgggtgggcatccggacgcgccacttcgccgggcccgacgagcccgtcgacgagctggccgggcacgcggcggccaaggcgctcgcctcggccgggctggccccggccgacatcgacctggtgctcgtcgccacctccaccgccgaggaccgttccccgaacatggccgcccgggtcgccgcccgcctcggcatcccgtccccggccgcgatggacatcaacgtggtctgcgccggcttcacgcacgccctggccacggccgaccacgccgtgcgcgcgggggcggccacgcgggcgctcgtcatcggcgccgacaagatgtccgcggtgacggactggagcgaccgtacgacctgcgtcctcgtcggcgacggagcgggcgccgccgtggtcgacgcctgccccgagggcgccgagcccggcatcggccccgtgctgtgggggtcggtccccgagatgggccacgcggtacgcatcgaaggcacgcccccgcgtttcgcccaggaggggcagagcgtctaccgctgggccaccacccagctcccggccatcgcgcgccgggcatgcgaacgcgcggggctcacgcccgcggatctcgccggggtcgtgctgcaccaggcgaacctgcgcatcatcgaacccctcgccgcgaagatcggcgccgtgaacgccgtcgtcgcacgcgatgtcgtcgagtccggcaacacgtcggccgcgagcatcccgctcgccttctccaagctggtggagcgcggggagatctcgaccggcgacccggtcctcctcttcggcttcggcgggaacctgtcgtacgcgggccaggtcatccgctgcccg

SEQ ID NO: 1821 - DNA, 1329 bp, Streptomyces avermitilis
  CDS (1)..(1329)
atgagtccccccgtcgcccccgccggctggagccggtggctcgttccccccgccgctctctccgtccacctctccatcgggcaggcctacgcctggagcgtgttcaagccgcccctcgaatccgcgctcggcctcagcggcacccagagcgcgctgcccttccagctcggcatcgtgatgctcggcctgtcggccgcgttcggcggcacgctggtggagcgcaacgggccgcgctgggcgatgaccgtcgccctggtctgcttctcgtccggcttcctgatctccgccctcggcgcggccaccgagcagtactggctgatcgtcctcggctacggcttcgtcggcgggatcggcctcggcatcggctacatctcacccgtctcgacactgatcaagtggttcccggaccggcccggcatggccaccggcatcgccatcatgggcttcggcggcggcgcgctcatcgcctcgccctggtcgacgcagatgctggagtcgttcggcaccgacagctccgggatcgcgcaggcgttcctggtgcacggcctcgtgtacgccgtgttcatgtcgctcggggtgctgctggtgcgggtcccgcgcaccgagaggcccgtcgagggcgcgccgagcgccttccaggggccgcaggtctcggcccgcgacgccgtgcgcaccccgcagttctggtgcctgtgggtggtgctctgcatgaacgtgaccgcgggcatcggcatcctggagaaggccgccccgatgatcacggacttcttcgcggacacgtccaccccggtgtcggtctccgcggcggccggtttcgtcgcgctgctgtcggccgcgaacatggcgggccggatcggatggtcctcgacgtccgacctgatcgggcgcaagaacatctaccgcgtctacctcggtgtgggtgccctgatgtacgcgctgatcgcctggttcggggactcatccaagccgctgttcatcgtctgcgcgctggtgatcctctccttctacggcggcggcttcgctacgatccccgcctatctgaaggacctcttcggcacctatcaggtcggcgccatccacggccggctgctcaccgcctggtccacggcgggagtcctcggcccgctgatcgtgaactggatcgccgaccaccagaaggaggcgggcgagcacgggtcctccctctacggcctgtccttcctgatcatgatcgggctgctcgtcatcggcttcgtcgcgaacgagctggtccgccccgtccacgcccgccaccacatccccgccccgagggaggccgccgatgtccagcgacagcagcccgagtccgcc

SEQ ID NO: 1822 - DNA, 969 bp, Streptomyces avermitilis
  CDS (1)..(969)
gtgaaagtcgcagttctcggcgccggtgcgatcggcgcctacgtcggcgcctcgctccagcgcgcgggcgccgatgtgcacctcatcgcccgtggaccgcatctggcggccatgaggcggcacggagtgcgggtgctcagtccgcgcggtgacttcaccgcacgcgcccacgccaccgacgacccggccgagatcggcccggtcgacttcgtcttcctcgggctgaaggccaactcgtacgcggcgtgcgggccgctgatcgagcctctgctcagcgacacgaccgcggtcgtggccgctcagaacggcatcccctggtggtacttccaccggcacggcgggccgtacgacggccaccgcgtcgaaagcgtcgacccggacggcgcggtcagtgcggtgctcgcgcccgaacgggccgtcgggtgcgtcgtctacgccgcgaccgagctcgaaggaccgggcgtcgtacgccatctcgaaggcacccggttctccgtcggcgagcccgaccgcagcgtctcggtgcgctgtggcgcgttcagtgaggccctgcgggcgggcggtctcaagtgcccggtcgaacccgacctgcgcaacgacatctggctcaagctgctgggcaacatctccttcaaccccatcagcgcgctggcccgcgcgaccatgcggcagatgtgcctgcacggcggcacccgccgggtcatcgagatcatgatgaccgagacgctcaccgtcgccgaggcactgggctgcgaggtcggcgtctccatcgaacgccggctggccggcgccgagcgcgtcggcgaccaccgcacctccacgctccaggacctggagcgcggcaagccgctcgaactcgacgtgctgctcggcgccgtcgtcgagctggcggagatcaccggcgtcgaggtgccgacgctgcgcaccgtccacgccctctcggatctgctcgcagcgaggaccgccgca

SEQ ID NO: 1823 - DNA, 1923 bp, Streptomyces avermitilis
  CDS (1)..(1923)
atgacgaaacgcgaccgaactccgaagacctacacccgcctcacgcatccgctcgtcagggactcgcgcgacgagcccctccgccgggccacgtgggaggaggcgctggaccgcgcggcccggggcctcgacgcggcacgcggcgccttcggcatgttctcctgcgcccgggcgaccaacgaaatgaactacgtggcgcagaagttcgcccgggtcgtgatgggcaccaacaacgtcgactcctgcaaccggacgtgtcacgccccgagcgtggccggtctgtcggccgccttcggctcgggcggcgggacgtcgtcgtacgaggagaccgagcacaccgacctcatcgtgatgtggggctccaacgcccgcttcgcgcacccgatcttcttccagcacgtcctgaaggggatcaggaacggcgcccggatgtacgccgtcgatccgcgccgcacctccacggccgagtgggcggagagctggctcggcctcaacgtcggcaccgacatcccgatggcgcacgcgatcggccgcgagatcatccacgcgggcctcgccaacgagaccttcgtcgagcgggcgacgagcggcttcgaggagtaccgggcgctcgtcgagccgtggacgctgtcgctcgccgagaaggtgacgggtgtaccggcccgcgccatcagggagctggcgcacgcctacgcccgggcggagcgcgcccagctgtgctggaccctcggcatcaccgagcaccacaacggcaccgacaacgtgcgcgcgctgatcaacctgtccctgctgaccgggcacgtgggccggtacggctcgggcctgcagcccctgcgcggccagaacaacgtgcagggcggcggcgacatgggcgccatcccgaaccggctgcccggcttccaggacatcctcgacccggacgcgcgactgaagttcgagtccgcctgggacaccgtcatccagccgcactacgggctgaacctgacggagatgttcgaggcgatggaggagggcaccctcagggccgtctactgcatcggggagaacccggcgcagtcggaggcggacagcgagcgggccgtacggcgcatgcgggccctcgacttcctcgtcgtccaggacatcttcctcaccaggacggccgagctggccgacgtcgtgctgccggcgaccgccgggtgggccgagacggacggcacgacgaccaacagcgagcggcgggtgcagcgcgtgcgccgggcggtgaccccgccgggtgaggcgcgcgaggacatcgacatcctctgcgcgctcgcggcgcggctcgggcacgactggaagtacgcggacgccgaggcggtctggaacgagctgcggtcggtgtcgccggaccactacgggatgacgtacgagcggttggcggagcaccagggcatccagtggccgtgccccgcaccggaccggctcgaacccccttatctgcacggccggttgtggtcgtccgacccggccgggcgcggccgcctcgcccccttcgggatcgtccagcacgacccgcccgtcgatctgacggacgaggagtacccgatccggctcaccaccgggcgccgcctcgactcctacaacaccggtgtgcagagcggcggtttcgcctctccgctgcggcgcggcgagttcgtcgagctgtgcccggaggacgcggagcgctacggggtcgtggtgggcgagcaggtccaggtggcctcgcggcgcggggccgtggtggcgccggtgtggatcgatccggcgctgcgccccggtctcgccttcatgaccatgcactttcccgacgaggtggacaccaaccggctgacgatcgaggccaactgcccgatcgccgggacggccgagttcaaggcgtccgcgatccggatcgagaagctgccggtcacggccgtgaggagc

SEQ ID NO: 1824 - DNA, 1821 bp, Streptomyces avermitilis
  CDS (1)..(1821)
atggatctgcacttcggtgacagcaaaccgtcggacgaggagcgggcggccgtcgacgcgctgctcggtcccccggagtcctcgtgggagggcgccgaccggtccgacgccgacctcaggtgggcccgcggcgggcgcgcggcccgggaccgccgcgacctgctgctgccggggctgcacgcggtcaacgaccggatcggctggatcagcgagggcgccctcgactacctgtgccggcggctgacggtgccgcccgcggaggcgtacggcgtcgccacgttctactcgatgttcgcggtgaaaccgcgccccgcgaccgtcctgcatgtgtgcacggacctcgcgtgcgcgtccgccggggcggctgagctgtgcgccggtgtcgaggcccggctcgggcccggcagcggcgtcggagtggaacgcggcccctgtctgggcctgtgcgagcgggctccggccgcactggcggtcagggccggggatccggtgcgtacggcggtgtcggcgcccgcgaccgtcgaggccgcggtgctggcggcgagcgcgcccgactcggcgcccgaggagccgtccgccgccctcgcggtcccccaggcgggtcaggacgggctggttctcctgcgccgcgtcggcgtggtcgaccccgcgtcgctcgacgactaccgggcgcacggcggttacgcggcgctgcggcgggccttcgagctcgggccggccgaggtcatccgggaggtcaccgacgcgggcctggtcgggcgcggcggcgccgccttccccaccggccgcaaatggcaggcgacggcgtcccggcccgaccgtccgcaccacctcgtctgcaacgccgacgaatccgagcccggcaccttcaaggaccgggtgatcatggagggcgacccgtacgcgctcgtcgagtcgatgacgatcgccgcgtacgccgtcggggcgcaccagggctatctgtatctgcgcggggagtacccgcgcgccctggagcgcatgagccacgccatcgagcaggcacgcgcgcgtgggctgctcggcgacgacgtcctcggtcagggctacgccttcgacatcgagatccggcgcggcgcgggcgcgtacatctgcggtgaggagaccgccctcttcaactcgatcgaggggtaccggggggagccgcggtcgaagccgcccttccccgtggagaagggcttgttcggccggcccactgccgagaacaatgtcgagacgctggtcaacgtgttgcccgtcctcacgatgggggcgcaggcgtacgcggcgatcggcacggcgaagtccaccgggcccaagctcttctgcgtgtcgggcagcgtggaccggcccggcgtctacgagctgccgttcggcgcgacgctgggcgagctgctggagctggccggagtgcgggaacggctgcgcgcggtcctgctcggcggcgcggccggcggcttcgtacggcccgacgaacgggacatcccgctcaccttcgaaggcacccgtcaggcgggcaccacgctcggctcgggagtcgtcatggccttcgacgacaccgtcccgctcccccggctcctcctgaggatcgccgagttcttccgcgacgagtcgtgcggccagtgcgtgccgtgccgggtcgggaccgtgcgccaggaggaggcgctgcaccggatcgtggcgcggacgggggcggcggccgccgacgacatcgccctgctcagagaggtgggccgggcgatgcgggacgcctcgatctgcggtctgggccagagcgcgtggaacgccgtggaatctgccatcgaccgtctgggggcgtacgaa

SEQ ID NO: 1825 - DNA, 858 bp, Streptomyces avermitilis
  CDS (1)..(858)
atgaccgcgataccgctgggagtgccgcgccggctcgtcgagttcaccgtcgacgggcaggaggccagggtcccggaggggtcgacgatcctcgacgcctgccgggccgccggaaaggacgtgccgaccctctgccagggcgacaccctcaccccgaagaacgcctgccgcgtctgcgtcgtcgaggtcgagggcgcgcgcactctcgtcccggcctgctcgcgcggggcggagcccggcatggaggtgcgcaccgacaccgagcgcgcccggcacagccgcaggctcgtgctcgaactcctcgcgtcctcggtcgacctgtcgaccacgccgaaggccgccgggtggatcaaggagtacgaggcgaagccggaccgcttcggccccgacgccgcccggctcaacgaggagccgaaggtcgacaacgacctctacgtccgcgactacgacaagtgcatcctctgctacaagtgcgtcgacgcgtgcggcgaccagtggcagaacacgttcgcgatctcggtggtggggcgcggcttcgacgcgcggatcgcggtcgagcacgacgcgccgctcacggactccgcgtgcgtgtactgcggcaactgcgtcgaggtgtgcccgaccggcgcgctgtcgttcaagtcggagttcgacatgcgcgcggcgggtacgtgggacgagtcggcacagaccgagacgaccacggtgtgcgcctactgcggagtgggctgcaatctcaccctgcacgtacaggacaatgagatcgtgaaggtcacctcaccgcacgacaacccggtgacccacggcaacctctgcatcaagggccgtttcggctaccagcacgtacagaaccgggac

SEQ ID NO: 1826 - DNA, 846 bp, Streptomyces avermitilis
  CDS (1)..(846)
atgggacgagtcacggaacgacgcaaggtgatccgcatccgggacggggccgtgagcacccgcccggacacgctcgtcgccgaggaaccactggagatccgcctcaacggcaagccgctcgcgatcaccatgcgcacgccgggtgacgacttcgcgctcgccgcgggcttcctggtcagtgagggcgtcctgggcgaggccgacgaactgcagaacatcgtgtactgcgcgggcgcgacggtggacggctcgaacacgtacaacgtcgtcgacgtgcggacggcgcccggtgtcgtcctccccgacatcacactcgaacggaacgtgtacacgacgtcctcctgcggactgtgcggcaaggcgagcctggacgcggtccgtacgacggcacgctggacgatcgacgacactcccccggtccggctcgaacccgagctgctcgcgagcctccccgaccggctgcgggcggcccagcgggtcttcgaccggaccgggggcctgcacgcggcggcgctcttcacggaggagggcgagctcgtcgacatccgagaggacgtgggccggcacaacgcggtcgacaagctggtcggccgcgccctgcagagcggctccctgccgctgtcccgcacggtcctgctggtgtcgggccgggcctccttcgagctggcgcagaaggcggtcatggccgggattccggttctggcggcggtgtcggccccctcgtcgctggccgtggacctggccgcggagtcggggctgaccctggtgggcttcctgcggggcgcctccatgaacgtgtacgcgggcgagcaccgcatcgctctgcgggccgcggccgcccagggc

SEQ ID NO: 1827 - DNA, 555 bp, Streptomyces avermitilis
  CDS (1)..(555)
atgaccgcaccagtacccgcagccgaaccccggctcgccctcgaccccgcacgcaccgccctagtgctcgtcgacctgatggaccgcatcgtcggactgcccgtcgagccccggaagggcgtcgaagtcctctccgtggccgaggggctggcggccggcttccgctccgcgggcgccctcgtcgtcctcatccgcgtcgagcgccccggcctcgccgagcagccacccggaagcgggctggtcgccggtctcgcggcggacggcgacctggagatcgtgaaacggaccatcgggggtttccagggcacggccctggacgagcagctgcgcgagcgcggcatcagcacactggtgttcggcggcatcgccaccaatctgggcgtcgagtccaccgcccgcgcggccggcgacctcggctacgacctggtcttcgtcgaggacgcgatggccgccctcaccgcggccgagcacgacgcgtccgtacggctggacttcccccggctgggcacggtggtcaccgccgccgaggtgcacttcgcctcgggtgaggtgagg

SEQ ID NO: 1828 - DNA, 432 bp, Streptomyces avermitilis
  CDS (1)..(432)
atgtccgcccccctgcccgcaatccgcaccctccccagctggctcctcggccgggccgccgcccgggggcgcggcctggtggccgaggccctggcggccgaggggatgaagatgtggcaccacgtggtgctctccgccgtcgccgacctcggccccgtcgcccaggccgagctcggccgcagtatccagctcgatcccaaggacctggtcggcgtcctcaacgacctccagtccgcgggcctgatcgtccgtgaaccggacccgaaggaccgccgcaagaacgcggtgtccctcaccggggagggcacgcgcctgctgaagcgctgcgagaaggcggcccgcgccgcgaacgacgcgctcctcgccccgctcgaggcggccgaacgcgaccagttcatgagcctgttgatccggatttccggtacggacggc

SEQ ID NO: 1829 - DNA, 714 bp, Streptomyces avermitilis
  CDS (1)..(714)
gtgtcacccgtttcacggcgggcgaccgcgtcaccggtctctgcttcggacacggttacgccgactacgccctcctgcacgaaaccatgggccacccccgtccccgagagcgcgagccccgtcgacgccgtcgccctggtccgcagcggcctggtcgcgctcggcgccctggaggcggcccgcccccgccccggcgagtcggcgctcgtcaccgcggcggccggcggcgtgggccaactcgccgtacagctcgcgcgcctgcgcggggcgtcgcgcgtcgtcggcgccgtgtccgccccgggcaaggcggcgttcgtgcgcgggctcggcgccgacgacgtgatcacctacgacgccgacgcctggggcgagcccgtcgactacgtcctcgacgcggtcggcggtgagctgctcaccccggcgatcgccgcgctcgccccgggtggccggctcgtcgcctacagctcgggcggcgggaccgtccaggcgtacgacctgctggtgagcgcgaagtcggtgatcggcttccagatggcgcggatcgcccgcggggagccgcagctgtacgaacggtggcggcgggagctgtggcggctgttcacggacggggcgctgcggccggccgtgcacggggagttcgacctggcggacgccgcgaaggcgcacgaggtgatcgagtcgcggagcaacctcggcaaggtggtcctgcgcacc

SEQ ID NO: 1830 - DNA, 378 bp, Streptomyces avermitilis
  CDS (1)..(378)
gtgtactcggcctcccgcgcacatccccacccgcgcgggctcgttactcccggtgagttccacagggccacgtccgcgcggcccgtcgtccgggtaggaggcagttacttggatgccggcaccaccctgctcggctcgttagtggcctgcgcgggcgtgctgggcgcggccgtcgtggcgtacctggggaagcggggcgagaacgctctgaacggcttctccagtctcaccgacaagctgcagtccgagcgcgaccgcctggagcgccaggtcgccgaacgtgactcgcggatcgtcgagttgtccacgctgcatgccgcggaccagtcggagatcgcccggctgcgcctcgacgtccaccgcctgggaggtgcgccg

SEQ ID NO: 1831 - DNA, 1875 bp, Streptomyces avermitilis
  CDS (1)..(1875)
atgccgtcaactctccgtgcacgtatcgcatcgaccctgaccgccgtgctcaccaccgccgcactactggccctgccgagccccgcgggggccgaacaggcgacggacacgggtgagttcgagcaacaggtgctcttcaaggcgtcccaggatcccggatacgcctgcttccgcataccggccgtcgtgaagacgaccgacggcaccctcctggcgttcgccgagggccgcgtcctcaactgcggtgacgcggccgacatcgacatcgtcctcaagcgctccaccgacggcggccgcacctggggcccgctccaggtggtcaacgagggcggcggggacacccacggcaacccggcgcccgtagtggaccgcgagaccggccgcatcgtcctggccgagacgtacaacacgggccgtacggacagcgccggctgtaccgtcccgtgcgaccgcacaccgcacctccagtacagcgacgacgacggcctcacctggtcccggccgcgcgacctgagcgacgagatcctcccgccggagtggaactcctggtacgccaccggacccgtgcacggcatccagctgacccggggcagacatgcgggccggctcgtcctcggcgtcaacaccgagacatgggacggcagtcgggtcagcgcgaaccacgccgcgctcatcaccagcgacgacggcggcgaccactggaggatcggcgccacggactcgtggccgatcgccgcggacggcacgttccgtcagaagccgtccgagatgacgctggccgagcgcacggacgggtccgtcctggtcagcgggcgcgagcaggacggcaccgacctcggacaccgcacccaggccgtcagccgcgacggcggctccagcttcaccgcgcccttccgtgatctgccggacctgtacacgccccaggtccagggctcctcgctgcgcctgggcgaccggctgctgctcgcctgccccggcgacccggaccgccggcggaccatgacgatccgctcctcgtacgacggcggacgcacctgggacagcgtcgaccgcggcacggtcgtcaccacggactggtcgggctactcggacctggtgcgcgtcggccgggacaccgtgggcctgatgtacgagggcggtgcggtcgacgcgcgggacgagatccgcttcgcccgcttcaccgaggactggctgaaaccccgccgcggccccgacccgacaacgcccgacctggccccgcacgccaagggcgccgcggtcctcgggggcgccgagcagacggagggcgtgttcggcggcgcgctcgacttcgacggcgccgacgacgccgtacgcctgccgtaccgtgccgaactcccgctcgggacaaaggacttcacggcgtccctctggttccgttacaccgccgcgaccggcgagcagcccctgctgtggatgggcgggatcgggacctcgcagccacaggtgtggctgcgcggcgagcccgcgtcgaaccgcgtccagggtctgatcaccgtccgcgacggcgcctcggccccgcagtccgcgttcgtgcgcacgacgggcgcgtacaacgacggccagtggcaccatctcgcgctgcgccgtggcggcggagcgctcacgctgttcctcgacggtacgccgatcagcaccgcggatgtgcccgggtccgtcagccgcaactcgccgttcggtgtgcacatcggtcagcggatggacagccgggcgtacttcaccggatccatcgacgaagtgcgcgtctatggacgggcgttgagcgacgccgagatcacgggcctgcgcacggacaacgaggcgtcggcccgggacaccgtcctgcggctgcccatggaccgggtgagcggcagccac

SEQ ID NO: 1832 - DNA, 1230 bp, Streptomyces avermitilis
  CDS (1)..(1230)
gtgcccgacgacgcacgagctcgacggcggaccgggaccgggctcggtgtgctcctggccctggtctgcacggccgtgctgctcaccgccctcccggaccaccaccgggagagcggcggctgcgcggcacgcacggtggaatcctggcgcccggacacagaactgaccggcgagttcgcgcgctacggcgacgacgccacccgtgccgacgactggaccggcggcgacggcacccactcggtgcgactgccggacgggcgggtgctgtggctgttctcggacacctatctgggccaggtgcacggcccgcccaaccccgtcggcgagtcctacgcctggcgggacacctcggcacccctcgtacgcaactcggctgtggtgatgacgggtgcgggccggctgagcgccacgctgcccgccccgctgttcccggatccggccgccggacagtggcgctggccggtggccgcccgggtcgagccccgctcccccggctcgtccgaacaggtcgtacgtgtcctgctgtggacccgtacgacaggtgcgtacccgtggatctacggcgtcccgaccgccaccgaggtcgccacgctctccctgccggacctgcgggtcgagggcatcacccaggtcctcgaccagcggcaggtcccagatcccgcgcaccgcgtgctgttcggcaccacggcggtgacgggcgacggggactggacgtacgtgttcggcggcgacgacgggcaggccgcctcccgcccggcgtcgaaggcgtacgtggcgcgggtgccgcgcgggaggctggcggagccgggggcctgggagtactgggacggctccgcctggagggctcacgcccggccggcggcgatgctcggggacgggcggggcacgggcgtgggcagcgccttcacggtcgtccgcgacggaccgacatacgtgctgttcaccatggccgccggcacccgggggctgacgacggtcacgtcgtactgggcgtgctcaccggccggcccctggcacggtccggccaggggattcagcccgccgctgccgcaggggcaggtggccgcgtacaacccgcaggcccacccggtgctcggcggcgacggccggctcgtcctcagctacgacgtcaactggctggacacgacgggcgcttcggcccaggcgaacctcagccggaacgtgtccctgtaccgaccgcggttcgtgtccctgcggctgactccgggg

SEQ ID NO: 1833 - DNA, 1038 bp, Streptomyces avermitilis
  CDS (1)..(1038)
gtgaaacgcctgcggtggccgagttggatacccgtcgacccgtacatccttttgttgctcgggaccgtgggcctcgcggctctcctgcccgcgcgcggcacggccgcggatgtcgcgtcgggggcctccacggccgcgatcgcctttctcttcttcctctacggagcccggctctccacgcgtgaagcactcgagggcctcaagcactggcggctgcacgtcacggtcctcgcctgcacgttcgtggtcttcccgctgctcggtctcgccgcccgcgggctcgtcccggcgctcctgacgcagcccctctacaccggtctcctcttcctcaccctcgtcccgtcgaccatccagtcgtcgatcgccttcacctccatcgcccgcggcaacgtgcccgccgcgatctgcgcgggttccttctcctcgctcgccgggatcgtcgtcaccccgctgctcgcggccgccctgctcggcaacagcggcggcgggttctccgccgactcgctcgtcaggatcgtgctgcaactgctggtcccgttcctcgccgggcaggtgctgcggcgctggatcggcgggttcgtcctgcggcacaagaaggtcctcggactcgtcgaccgcggctcgatcctgctcgtcgtctacaccgcgttcagcgagggcatggtgcagggcatctggcaccaggtgagcgccgtcaggctcgccggactgctcgtcgtcgaggccgtgctgctcgccgtgatgctcgcgctgacctggtacggcggcaaggcgctgggcttcggccgcgaggaccggatcgccatccagttcgccggttcgaagaagtccctcgcttccggacttcccatggccagtgtgctgttcggcgcgcacgcctcgctcgccgtgctgccgctgatgctcttccaccagatgcagctgatggtgtgcgcggtgatcgccaagcgccgggcgcgcgacccggagcggtcggcggtcaccccggagtcagccgcagggacacgaaccgcggtcggtacagggacacgttccggc

SEQ ID NO: 1834 - DNA, 867 bp, Streptomyces avermitilis
  CDS (1)..(867)
atgtacgacccttcacagctgcggacgttcctcgcggtggcgcagacgctgagcttcacgcaggccgcgcgccggctcgggctgcgtcagtcgacggtgagccagcacgtgcgccggctggaggacacggccggacggcagctcttctcgcgcgacacccactcggtggagctgacggaggacggcgaggcgatgctcggtttcgcccgccggatcctggaggtgcacgagcaggccacggcgttcttcacgggcacgcggctgcgcgggcggctgcggttcggcgcgtcggaggacttcgtgctgacccggctgccggagatcctggagggcttccggtacgaccatccggaggtggacctggagctgacggtcgagctgtcgggcacgctgcacgaacagctcgcggcgggcaagctcgacctggtgctcgccaagcgccggccgcaggacccgcgcggggagctcgtccggcacgaccggctggtgtggatcggcgcggagcggctccgcctggaccccgaccgcccggtcccgctgatcgtctacccgccgccgggcatcacccgcgccctcgccctcgaggccctggagaagcagggccggtcctggcgcgtcgtctgcaccagcggcagcctgaacggcctgatcgcggcggcccgcgcgggtctcggtgtgatggcccactcccggggcctggtcccgccgggcctggtccgtgtccctgaacgggcggggctgccggagctgggcgaggtggacttcgtcctggtgcacgggcgccggcggggccccacccagggcgcggcggaagcgttggcggcggcgatcctggcgggcggcgaccggttgcaccgcgggcggacg

SEQ ID NO: 1835 - DNA, 975 bp, Streptomyces avermitilis
  CDS (1)..(975)
ttggagagggaatccgacgcgttcgacgcattggatctgcaactgctggcggcgctggagctggccggccgggcgcccttcagccggatcgcggccgtgctcggcgtctcggaccagaccgtcgcgcgccgctaccggggactgaccgccgaggcgggcctgcgggtcgtggccgtccgggacgcggagcgcctcggccaggaccagtggatgctgcggctgcgctgcacccccgacagctccggggccatcgcggaagccctggccaaacgacccgacaccggctggatcggactggcgtcgggcggcaccgaggtggcctgcatgagccgcccgcgcagccggggcgaccaggacgacctgctgctcggcaagctgccccgcacacccagcatcgtggagatccgcgcccagcagctgctgcaccggttctacggcggcccgacgggctggatcgggaagttctccgcactgacggacgaccagatcgccgcgctgcgccccgaggttccggccgcgtccgggcccgcccggatcgccccggaggacgaacccctggtcgccgcactcgaacgggacggccgggccacctaccccgagctccagcgggccaccggccgctccgagtccgccgtcaagcgcagcctcgccgcactgctggcctccggcgccgtctacatcgacatcgagtaccactccgagatcctcggctactccctcgcggccctcctgtggatcaccacctcgcccggcgcgctgcactcggtcggcgaggccctcgccacccacgacgagatcgcctacgcctcggcgaccgccggcccctccaacatcgtcgcgaccgccgtggtgcgggacacaggggccctctacgcctacctgagcggccgcctcggccacctcgaaggggtccagcacgtcgagacgacaccgttcatgcgccgggtcaaacagctgacgtaccggatgccgggc

SEQ ID NO: 1836 - DNA, 1482 bp, Streptomyces avermitilis
  CDS (1)..(1482)
atgcgtacatgggggccgctcaccgcggtgtgtctggggacgttcatgctgctgctggacgtgacgatcgccgtcgtggcgctgcccgacatggcgcgggcgctgcatgcctcgctcagcgatctgcagtgggtgatggacggttacgcgctggccctggccgcgctgctgctcgggctgggggccgcggccgatgtgctggggcggcggcgggtgcatgtggcgggcgtcgtgctgttcgcggtggcgtcactgctgtgcgggctggcctcggggccggggatgctggtcgccgcgcgcggggtgcagggaatcggggcggccgcgatgttcgcgacgacgctgccgctgctgggctccgtctaccagggtcggcggcggtcggcggcactcggcgtgtggggtgcggtgagcggggcggcggccgccgtcggtcccgtgctcggcgggctgctcaccgacgggcccggctggcgctggatcttcttcgtgaacctgccggtgagcgtcgtggcggtctggctgacgctgcgcgtggtgccggagtcgcgggggccgcgggggcggcgcatcgactgggcgggcacggtggcgttcgcgggcttcgcgggcgcgctgacgtacggggcggtgcgggcagggtccgaggggtgggccgaggcgggcacactcgtgtcgttcgcggcggcggccggggcgctgggctgcttcgtgctgatcgagcggcgcaccgccgatccgctcctcgacctgtcgttgttccgcaagcccgcgttcctgggcgtgatggtgggggcgctcgccttcaacgcggcggcgttcggtgtgatgccgtatctgtcgatctggctccagacgctgctcgggatgagcccggtgcggggcggtctggtgttcctgtggctgtcggccgcctcgttcgtggtggccgcggtcggcggccggctgctgcacggggtgccgtcccggctcaccatcggcggcggactgctgctgatcggctccggtctgttctgccaggcggtgctcgacgcgggtgcgacggcgacggcgctgataccgggtctgatcctggtcggcgtcggtacgggcctggtcgcgcccggcatcgcgggcgccgcgctcgccgccgtcccgctggagcgggcgggcatggcgggcggcgcggtcaacaccttccgccagctcggctacgcgctcggcatcgccgtcttcggcacggtcctcacctcgcgcatgcagaacgcgttgccgcgggacgcggcgcacacgctggcgggcggtggcgcgggagccctgcgcgggacgctctccgaacacgcgctgcgggccgcgttcgcctccggcctcgacgcggcctcggtggccgccggagtgacggcgacggccgccggtgcgctggtgctggtgctggtgcggacaccgcgtcccgcgccggatgcggccggggcgccggcacaggaggtcgcggcgcaccgcggg

SEQ ID NO: 1837 - DNA, 1824 bp, Streptomyces avermitilis
  CDS (1)..(1824)
ttgcgcgagttcaccaaccctccgttggcgtcggcgccgccggtgggcggcctggccgacgttgtcttcgaccatgccctggaggatccgctgcacgtcgctctcggccgcaaggacgagcagggcacctggcgtgacgtgaccgccgcggagttccgcgacgaggtcctcgccctggccaagggcctgctggcgcaggggatccggttcggggaccgggtcgcgatcatgtgccggacgcgctacgagtggacgcttttcgatttcgcgctctggacgatcggcgcccaggtggtgccggtctaccccacctcgtcggccgagcaggtcttctggatgctgcacgacgcccaggtgtcggccgcgatggtggagcacgaggaccacgcgatgaccatcgcgacggtcatcgaccggctgccccagctgcaccggctgtggcagctcgacgtgggcgccgtgcaggagctgtacgagtcgggcgcgcacctcgaggacgaggtggtgcaccggcaccggcgcgcggtcacgcccgagtcggtcgcgaccatcatctacacgtccggcaccacgggacgccccaagggctgtgtcatctcccacgcgaacttcatgttcgaggcggacacggtcatcgagcgctgggagccggtgttccactccaagcgcggcgacgaggcggccacgctgctgttcctgccgctggcgcacgtcttcgggcggatggtgcagatcgccgcggtccgcggccgggtcaagttcggccaccagccgcagctcaacgccgcggcgctgctgccggacctggccgcgttcaagccgacgttcttcctggccgtaccgtacatcttcgagaaggtcttcaacgcggcccgccgcaaagccgagagggagggcaggtcgggcgcgttcgagaaggccgtggaggccgcggtcaagtacgcggacgccgtggaggcgaaagcctggggcatcggacccggtccgtcggcggccctgcggatgcagcaccaggtcttcgacaagctcgtctacgccaagatccgggccgcgatgggcggccgggtgcggcacgcgatgtccggcggctcggcgatggaccgccggctcggcctgttcttcgcgggcgccggcgtgtacatctacgaggggtatggcctcacggagtccaccgcggccgcgaccgcgaacccgccggagcgcacccggttcggcacggtcggccaggcgattccgggcaccaccgtgcacatcgcggacgatggcgagatctggctgaacggtggcaacgtcttccagggctatctcaacgaccccaaggccacggacgcgacgctgcacgacggctggctggccaccggtgatctcggctcgctcgacgaggacggctacctcaccatcaccgggcgcaagaaggagatcctggtgacgtccggcgggaagagcgtctcgccgggggtcctggaggagcgggtgcgcgaccatccgctggtcgcgcagtgcatcgtcgtcggcaacgaccgcccgtacatcgccgcgctcgtcacgctcgactcggaggccgtcgagcactggctccagatgcacgacaaaccacagctgaccccggccgagctggtccgggacgccgagctggagacggaggtgcggcgggcggtggtcgccgcgaacacgctcgtctcgcaggccgagtcgatccgcacgttccggatactggcccaccagttcaccgaggagcacggcctgctcacgccgtccctgaagctgaagcgcaaggcgatcgagaacgcgtacgcgaccgaggtggaggcgctgtaccgggcc

SEQ ID NO: 1838 - DNA, 834 bp, Streptomyces avermitilis
  CDS (1)..(834)
gtgagcaccaaggtccccccgatcaccctgaacaacggcgtcgagatgccccagctgggcttcggcgtctggcaggtgccggacgacgaggcggagcgtgccgtcgccaccgcgctggaggccgggtaccgcagcatcgacacagcggcgatctacggcaacgaagagggcaccggcaaggcgatcgcgaccgccggcatcccccgcgccgacctcttcgtcaccaccaagctctggaacagcgaccagggctacgactccacgctgcgcgccttcgacgtgtcgctggagaagctcggcctggattacatcgacctgtatctgatccactggccgctgccgacccggggccagttcgtcgagacgtacaaggcgttcgagaagatctacgccgacggccgcgcgaaggcgatcggcgtctccaacttcctccccgagcacctcaggacgctcatcgacgcgacgtcggtcatcccggcggtcaaccagatcgagctgcacccgcaccttcagcagcacgccgcgcgcgagttccacgcggagcacggcatcgcgaccgaggcctggtcgccgctcggctcgggcaagggcctcctggaggtcccggcgatcgtcgcgatcgcccggaagcacgaacgcaccccggcccaggtcgtgctgcgctggcacatccagctcggcaacatcgtgatccccaagtccgtgactccgtcccggatcaaggagaacatcgaggtcttcgacttcagcctggacgacgaggacatcgcggcgatcagcgcgctcaacgaggaccgccgcctgggtcccgacccggcgacgttcgacatgggc

SEQ ID NO: 1839 - DNA, 699 bp, Streptomyces avermitilis
  CDS (1)..(699)
gtgcgcactcgaacactgaccctcgccgcggccgccggcgccgcgctcctcgccaccgccgcacttccggccaccgcctccccgtccggcaccaaggcccccgcctcggcacaggagggctcggtcagcgcggcctccctgctcgccaaggtgacgtcctgttcgcagatatcgaacggcaagtacaagaccgacgacgagacatcggccacgatccccgtgtgcggcaagaacggcgcggtgttctggaaggccgacatggacatcgactgcgacggccaggtcaccggcaagtgcaacggcaccaccgacccgtggttccaggacgacacggcgttccaccagtccgacggcaagccgctgcgcgccgactcgctcccgtacgtggtcgtgcccagctccagcagcatctggaactacgcgagcgccggcatcaagggcggcggcgtggtcgccgtcatctacaacaacaaggtcgagtacgcggtcgtcggcgacaccggccccacgaagatcatcggcgaggcctcgtacgccaccgcgcaggccctcggcatcgaccccgacccggagacgggcggcaccgactccggcgtgacgtacatcctgttcaagaactcgcaggtctcgcccatcgagagccacagcgccgccgtgtcgctgggtgactcactggcgaagcagttcctccagaacaac

SEQ ID NO: 1840 - DNA, 699 bp, Streptomyces avermitilis
  CDS (1)..(699)
atgaccgactctcctgtcgcgctcatcaccggcggcggaagcggaatcggggccgcggtggcgcggcggctgctcgacgcgggacaccgggtgaccgtcaccggccgcggcgaggagcggctgcgcggattcgccgaggaactcgggcgtcccgagggcttgttgacggtggcggggaacgcggccgagtacgaacacgtacaggccgcggtcgaggcgacgctcaaggagttcgggcggctcgacaccgtcgtcgccaacgccggcttcgccacccacgacaccgtcgcggagggcgacccggccggctggtccgagatggtgctgaccaatgtgctggggcccgcgctgctgatcagggcctccgtcgacgccctgaaggagacgcgtggccggatcgtgctggtcggcagtgtggcgggccacgtcaacacccccggcaacatctacggggccacgaagtgggccgtgaccggtctcgccgagaacacccgacgccaggtcaccgagttcggggtgggggtgacgctgatctcgcccggacgcgtggagacgccgttctgggacagctatggcagcctgccgccagggcagctgctgacggcggaccagcttgccgagtcgatcgtctgggcgatcgggcagccgagcggtgtcgatgtgaacaccgtggtcgtccggccgatcggccagcccgtc

SEQ ID NO: 1841 - DNA, 876 bp, Streptomyces avermitilis
  CDS (1)..(876)
atggcacaccaccacgaccacccacagcacgaccacacggagatcgacttcgccgagtggcttcccctgctggagcaggaggccgaactgttcaccccgctgtacgcccgggcggcggcctggctgcgggagcggcagcccgagcccgagctgatcgtggacgccggcagtggccccggtgtcatctcctgcctcctcgcggacaccttcccgcgggcgcgggtcgtcgccgtggacggcgcggaacccctcctggaacgggcccgagcccgtgcggaccggctcggagtagccgaccgcttcaccaccgtgcaggccgaactcgccgacggactcggcaacgtggagtatcccgccgacctgctgtgggccagcaggtccctgcaccacgtcggtgaccagcgagccgccctctcgggattcgcgcgggggctggctcccggcggcatgctcgcccttctggaaggtggcctgcccgcgcgcttcctcccgcgcgacatcggaatcggccggcccgccctgcagtcccgtctggacgcggtgcaggaggagtggttcaccgagatgcgggccgcgcttcccggagcggtgaccgagaccgaggactggcccgccctgctgacggccgtcggtctgcgtcacatcgcgacccgcacgttcctcctcgacctccccgccccggtgtcggaggaggcccgcgccttcgtcgtcacctccctcacccaccgccgggacaagctcgccgacggcctcgacgcggatgacctcgccaccctcgaccggctcctcgaccccggcgacaaggcgagcctgcaccaccgcccggacgtcttcctgctcacggcacacaccgtgtacgtcgcggtgaaggccggg

SEQ ID NO: 1842 - DNA, 1707 bp, Streptomyces avermitilis
  CDS (1)..(1707)
atgagccgtaccagaacagcgatactcgctgccttggcgctggtcgccggggcctcggggaccgcggtcgccgcggtcgccccggaacccggcatcgccgccgtcccctgcaccgtcgactacaaggtgcagaaccagtgggacaccggtttcaccaccgccgtcacggtcaccaacaacggggccgccaagtcctcctgggccgtgaaatggtcgtacgccggaaaccagaaggtcaccagcggctggaacgccaggatcagccagagcggcacagccgtcaccgccgccaatgagagctacaacggggcgctggcgagcggcggttcggtcagcttcggcttcaacgcctcgtacagcggcaccaacgcactgccgaccgccttcacgctcgacggcgtgacctgcaacgtcgacgacggcggcggaggcgggggcggcacggacccggacccgtccggcaaggtcgacaacccctacgcaggcgccaaggtgtacgtgaacccggagtggtccgcgaaggccgcggccgagaccggcggcagccgcatctccagccagcccaccggcgtctggctcgaccgcatcgccgcgatcaacggcgtgaacggcggcatgggcctgcgcgcccacctcgacgcggccctcgcccagaagggcagcggcgaagaggtcgtccaactggtcgtctacgacctgcccggccgtgactgcgcggccctcgcctccaacggcgaactcggcccgacggagatcgacaagtacaagacgcagttcatcgacccgatcgcggcgatcctcgcggacagcaagtacgcgggtctgcggatcgtcacgaccatcgagatcgactcactgccgaacctcgtcaccaacaccggcagccgcgccaccgccacgcccgcgtgcgacacgatgctcgccaacggcaactatgtgaagggcgtcggctacgcgctgaacaagctcggcgcgatcccgaacgtctacaactacctcgacgccggacaccacggctggatcggctgggacgacaacttcgccccgtccgccaccctgttcaagcaggcggcgacgagtgagggcgcgacggtcgacgacgtgcacggcttcatcaccaacacggcgaactacagcgccctgaaggagaacaacttcaccatcaacgactcggtgaacggcacctccgtccgccagtccaagtgggtcgactggaaccgctacgtcgacgagctgtccttcgcccaggccttccgcacccagctcgtctcggtcggcttcaactccggcatcggcatgctgatcgacacctccaggaacggctggggcggcaccgcacggcccaccggtcccggcgcgacgaccagcgtcgacacgtacgtcaacggcggccgctacgaccgccgtatccacgtcggcaactggtgcaaccagtccggtgccggtctcggtgagcgcccgcaggccgcaccggccaccgggatcgacgcgtacgtgtggatgaagcccccgggtgagtccgacggctccagctcggccatcgcgaacgacgagggcaagggattcgaccggatgtgcgacccgacgtacacgggcaacgcccgcaacggcaacagcatgtcgggcgccctgccgaacgccccgctgtcggggcactggttctcggcgcagttccaggaactcatgaagaacgcgtacccggcgctg

SEQ ID NO: 1843 - DNA, 1476 bp, Streptomyces avermitilis
  CDS (1)..(1476)
atgcgacatccccctcgttcagcacttcttcttgtcgccggcgcggtcgccctcatcgggagcgcggtcgtgccggtcgtcacggcgtcgggagccacgacgcccgcgtgcacggtggagtacgccgtcaccagccagtgggacgccggcttccagggcggcgtgaagatcaccaacaacatggccgccctgagcagttggcgtctcacgttcgacttcgccggcgggcagaaggtcacccagggctggaacgccaagtggtcccagtccggtaccaccgtgaccgcggccaacgagagctacaacggctcgctgggctccggtgcgagtgtcagcgccgggttcctcgcctcgtggtcggggagcaacgccgtaccgacgtcgttcaagctcaacgggacgacgtgcaatgtggaggcggaaccgtcgccttcaccgtcaccgtcggacccgccggcgacgggtgcggcgccgaaactgcacgtatccgggaacaagctcgtggacgccgacggcaagacgcgccggctgctcggcgtcaaccgttccggcggcgagttcatgtgtgtccagggctacggcatcttcgacgggccggtcgacgacgccgccgtcaaggcgatcgccgactggaaggccaacaccgtccgcattccgctgaacgaggagtgctggctcggcctgtccaacatcaagccggagtacggcggcgccaactacatcgcggccgtcaaggacctggtggccagggtggaggcgcacggcatgacgccggtcgtcgaactgcactggacgtacggccagtacaccggcaactccgccggctgttcggacgtgcacgccacctgccagaagccgatgccggacgcccagtacacgccgtccttctgggcctcggtggcgagcaccttcaaggacgacgcggcggtcgcgttcgacctgttcaacgagccctacccggaccgcgccacctccacgaccacccaggcgtggcagtgctggcgggacggcgggacctgccccggcatcacctacgaggtggccggcatgcaggacctggtcgacgcggtgcgcggcaccggcgccaagaacctgatcctggcgggcgggctcgcgtactcgaacgacctgagccagtggctgacgtacaagcccaccgatgccacgggcaatctcgtcgccgcgtaccacgtctacaacttcaatacctgcgccagtgagacgtgctggaactcgacgctcgccccggtggccgcccaagtcccgctggtggccggggagatcggcgagaacacctgctcccactccttcatcgacaccgtcatgaagtggttcgacgaccggggcctctcctacctcggctggacctggaacacctgggactgctcctccggtccctccctgatctccaactacgacggcactcccacgtcgttcggtatcggactgcgcgaccacctgcgcgccctcaacgga

SEQ ID NO: 1844 - DNA, 2919 bp, Streptomyces avermitilis
  CDS (1)..(2919)
atggcatccagaaggagacgccgcaccgtgcggcggttgtggaccgccgtggtcgcggccctggccctgcccgtgacgaccctggcaaccggaatctccgcgccgtccgcgcaggccgcggcgctccagtgcagcgtcgactacaagacgaacgactggggctccggcttcaccacggacgtgaccgtcaccaaccggggcacggacccgatcaacggctggaccctgacgtacgcctacaccggcaaccagacgctcaccggtggctggagcggtacctggtcgcagtccggcaagtcgatcaccgtgaagaacgcgtcctacaacgggacgatcgccgccggagccgccgtcaacaccggggcgcagttctcgtacagcggcaccaacacctcccccacgggcttcgcggtcaacggcaccacctgcgccggcgcccaccagccgccggtcaccgtgctgaccagccccaccgccggcgccgtctacacgcagggcgacgcggtcccgctcgtcgccaccgcggccgccgccgacaacgcgacgatcagcaaaatcgagttctacgacgacacgacgctgctgggtacggacaccagctcgccctacacgctgtcggccgccggcctgagcgtgggcggtcactcgctgatcgcgaaggcgtacgacagcctgggcgcgtcggcggagtccactccggtcggcatcacggtcgcctcgggtcccgccgtggtggcctcaccgacccaactgggcgtccagcagggcaagtcggggacattcgccgtgaagctgtcgacacagccgagcgcgaacgtcaccgtcggtgtgacgcgtacggacggaaacaccggcctgtccgtcaccggtggatcgtcgctcaccttcacgccggccaactggaacacggcgcagacggtgaccatcaccgccgacgcctccggcaccggttcggccaccttcacggccttggcgaccggccacaccaaggccacggtcacggtcacggaactggccgggtcgaaggcgtacgacgcccgcttcctggatctctacggcaagatcaccaacccggcgaacggctacttctcccccgaaggcatcccctaccactcggtggagacgctgatcgtcgaggcgccggaccagggccacgagacgacctcggaggcatacagctacctcctgtggctccaggcgatgtacggcaaggtgacgggcgactggtcgaagttcaacggtgcctgggatctcatggagaagtacatgatcccgacccacgccgaccagccgaccaactccttctacaacgcctcgaagccggcgacgtacgcgcccgagctggacactccgggcgagtacccggcgaagctggagcccggcgtcccggccggctcggatccgatcgccagtgagctgaagagcgcgtacggcacggacgacgtgtacggcatgcactggctccaggacgtcgacaacgtctacggctacggcaacgagcccggcaagtgcgaggcgggcccgaccgccaccggaccgtcgtacatcaacaccttccagcgcggtgcgcaggagtccgtctgggagacggtcccgcagccgacctgtgacgccttcaagtacggcggcacgaacgggtacctggacctcttcaccggggactcctcgtacgccaagcagtggaagtacaccgacgcacccgacgccgacgcgcgtgccgtgcaggccgcgtactgggccgacgtctgggccaaggcccagggcaagggcggtgatgtgtcggggaccgtcggcaaggccgcgaagatgggcgactatctgcgctacgccatgtacgacaagtacttcaagaagatagggaactgtgtcgggccttcgacctgcgccgcgggcaccggcaaggacgcctcccactacctgatgtcctggtactacgcatggggcggcgccaccgacacctcggcgggctgggcctggcgcatcggctccagtcacacccacggcggctaccagaacccgctcgccgcgtacgcgctcagctcgtacgccgacctgaagcccaagtcggcgacagggcaggcggactgggcgaagtcgctcgaccggcagctggagttctaccgctggctccagtcgagcgagggtgccatcgcgggcggggcgaccaacagctgggcgggccggtacgcgaccccgcccaccgggacgccgaccttctacggcatgtactacgaccagcagccggtgtaccacgacccgccgtccaaccagtggttcggcttccaggcgtggtccatggagcgggtggccgagtactaccagcagacggggaacgcgaacgcgaaggcggtcctcgacaagtgggtcggctgggcgctgtccaagaccacgatcaacccggacggcacctaccgcatcccctcgacgctccagtggtccggctcgcccgacacctggaacgcgtcaagtcccggcgccaacacgggacttcatgtcaccgtcgccgactacaccgatgacgtgggggtggccgcggcctatgccaagaccctgacgtactacgccgcgaggtccggcagcacggcggcgaagacaacggcgaaggcactgctcgacggcatgtggaacaactaccaggacagcctcggcgtcgccgtcccggagacccgcaccgactacaaccgcttcgacgacagcgtgtacgtcccgagcggctggaccggcaagatgccgaacggcgacgcggtcaactcctcctcgaccttcacctcgctccgctccttctacaagaacgacccggcctggtcgaagatcgagagctacctcgcgggcggcgccgcgcccacgttcacgtaccaccgattctgggcccaggcggacatcgcgctcgccatgggttcgtacgcggagctcctcgaa

SEQ ID NO: 1845 - DNA, 2646 bp, Streptomyces avermitilis
  CDS (1)..(2646)
gtgcgaagaacccgcatcttcacggccgtgctcgcgctggcggccggtctgcccgccggcaccccgccggcactggccgcgagcgcccccacggcgacgatcgccgcggacacgtacagctggaagaacgcccgcgtcgacggcggcggcttcgtccccggcatcgtcttcaaccgctccgagaagaacctcgcctacgcccgcaccgacatcggcggcgcctaccgctgggccgagtcctcgaagacctggacgccgctgctcgactcggtcggctggagcgactgggggcacacgggtgtcgtgagcctcgcctccgactccgtcgacccgaacaaggtgtacgcggccgtcggcacgtacacgaacagctgggacccgggcaacggtgccgtgctcaggtccggcgaccggggcgcgagctggcagaagaccgacctgcccttcaagctgggcgggaacatgccgggccggggcatgggcgagcggctcgcggtcgacccgaacaggaacagcgtgctgtatctcggcgcgcccagcggcaaggggctgtggcggtcgacggactcgggggcctcctggtcgcaggtcaccgacttcccgaacgtcggcacctacgtgcaggacgcgaccgacacgagcgggtacgcgtccgacaaccagggcatcgtgtgggtcaccttcgacgagtcgacggggtcgccggggagctccacgcggacggtgtacgtcggggtcgccgacaaggacaactccgtctatcgctccacggacgcgggcgcgacctggtcccggctggccggccagcccaccggccatctcgcccacaagggcgtgctggacgcggcgaacggctgtctgtacctcgcgtacagcgacaagggcggaccgtacgacggcggcaagggacagctgtggcggtacacgacgaagaccgggacctggacgaacatcagcccggtcgcggaggccgacacctactacggcttcagcgggctgaccgtggaccggcagcatccggggacggtgatggcgactgcgtacagctcctggtggccggacacgcagctcttccgctccacggacagcggcggcacctggacgaaggcctgggactacacctcgtatccgagccgctcgaaccgcttcaccatggatgtctcgtcctcgccctggctcacctggggagcgaaccccgcaccgcccgagcagaccccgaaactcggctggatgaccgagtccctggagatcgacccgttcgactccgcgcgcatgatgtacggaacgggcgcgacggtctacggcacggacaacctgacgaactgggacagcggaagccagttcaccatcaagccgatggcgcggggcctggaggagacggccgtcaacgacctcgcctcgcctccctccggcggcgcccagctgttcagcgcgctcggtgacatcggcggcttccggcacacggacctcaccacggtgccgtcgctgatgtacacgtcgccgaacttcaccacgagcaccagcctcgactacgccgagaccgacccgggcacggtggtgcgggtcggcaatctcgactcgggtccgcatgtggcgttctcgacggacaacggcgccaactggttcgcgggggcggacccttcgggggtcagcgggggtgggacggtcgcggccgcgtccgacggcagtcgcttcgtgtggagcccggcgggcaccggggtgcagtacacgaccgggttcggcacctcgtggtcggcgtccgcgggcctcccggccggggcgatcgtcgagtccgaccgggtcgacccgaagaccttctacggcttcaagtccggcaggttctacgtcagttcggacggcggggcgaccttcacggcgtccgcggccacgggcctgccgagcggcgacagcgtgcgcttcaaggcgctgcccggcacgaagggcgacatctggctggcgggcggcgcgagcgacggcgcgtacgggctgtggcactcgacggacggcggcgcggccttcaccaagctcgccaccgtcgaccaggccgacaccatcggcttcggcaaggcggcgaccggcgcctcgtaccagacgctctacaccagcgcgaagatcggcggtgtgcgcggcatcttccggtcgaccgacaagggcgcgagctggacccgcgtcaacgacgatgcccaccagtggggttggacgggcgcggcgatcaccggtgaccccagggtctacgggcgcgtgtatgtgtcgacgaacgggcgcgggatcgtctacggcgacaccgcgggctcttcggacggcggcggtacggagccggcaccgacgggcgcctgcacggtgacatacaggatcacgaaccagtggtcgggcggcttccaggccgatgtacagctcgccaacaccgggtcgaccgcctgggacggctggtcgctgggctggtcgttcggtgacgggcaggaggtcacccagctgtggaacgcctcgtacgcgcaggccggttcgggggtgaccgcagcgaacctggcctggaacgggagggtggcggccgggtcctcggtgagcttcgggttcacgggaagctggtcgggatccaatggcagaccgaccgccttcaaactcggcggtcagaactgcacggtcgcc

SEQ ID NO: 1846 - DNA, 1872 bp, Streptomyces avermitilis
  CDS (1)..(1872)
gtgcagcacccgcactcgcacaggaaccgcagacgtcagatcctgaccatgacggcagccgccgtcctgaccgccgccggactcaccacgctcgccaccggacccgcccaggccgccaccgcacgccaggtcgaggccctggaccggggcgtggtcagcgtccacacggacagcggcaacctggtcagctggcgctggctcggcaccgaccagaacgacgtgtcgttcaacgtctaccgcgccggtgcgttggtcaacgcgaccccgatcaccggctccacgaactacttccactccggggcgcccgcccaggccgactacacggtccgcgcgatcgtgggcggcgtagagcaggccgactcggtgcacgccgtccagttccgtacgggctacaaggacgtacccctcaccccacccgcgggcggcaccacccccgacggcgtcgcctacacctacgaggccaacgacgcctccgtcggcgacctcgacggcgacgggcaactcgacttcgtcctcaagtggcagcccaccaacgccaaggacaactcccagtccggctacaccggcaacaccgtcgtcgacggcatcaaactcgacggcacccggctgtggcgcgtcgacctgggccgcaacatccgctcgggcgcgcactacacccagttccaggtgtacgactacgacggcgacggcaaggccgaggtcgccatgaagacgggggacgggacgacggacggccggggcacggtgatcggcagctcgtccgccgactaccggaacgccagcgggtacgtgctgtcgggccccgagtacctgaccatgttcaacggccggaccggcgcggcgatgggcaccgtcgactacgtcccggcccgcggcacggtctcctcctggggtgactcgtacggcaaccgggtcgaccggttcctcgcggggacggcgtacctggacggctcccggccgtccctgatcatggcgcgcggctactacacccggacggtcctcgcggcctgggactggcggggcggcgccttcacccgccgctggaccttcgacaccacctcctcgaccaacagcggcaaggggtacgacggccagggcaaccaccagttgtcggtcgcggacgtcgacgccgacggcaaggacgagatcgtgtacggctcgatggccgtggacgacaacggctccggcctgtggaccacgaagaacggccatggcgacgccctgcacgtcggcgacctggacccctcccgggccggcctcgaggagttcaaggtggacgaggactcctccaagccgtcgtcctggatggccgatgccgggaccggcgcgatcctgtggtcgacggcggccaacggcgacaacggccggggcgtgtccggggacgtctgggcgggcagcgccggcgccgagtcctggtcgtcccgcgccgacggtgtccgcagcccgcagggcgccgtggtggcgagccgcaagccgggcagcatcaacttcctgtcctggtgggacggcgacaccgtccgcgaactcctcgacgacacccacatcgacaagtacggcaccgcgtccgacacccgcctgctgaccggctcgggcgtccactccgacaacagcaccaaggccaccccgtccctgtcgggcgaccttctcggcgactggcgcgaggaggtcgtctggccgacgaccgacaacacggcgctcaggatctactccacgccgtacgagacgagcacgaagatcacgaccctgctgcacgacacgcagtaccgcacagctctggcctggcagaacacggcctacaaccagccaccgcacccgagcttcttcctcggaaacgacatggcgacggcccccaggcccacggtgtacacgccc

SEQ ID NO: 1847 - DNA, 303 bp, Streptomyces avermitilis
  CDS (1)..(303)
atgcccgtcgaaccgttgtcgcagaaggagatcgaggaccggctggcggagctgcccggctggtcgctggacggggaccggatctcccgctcctaccggctcggctcgcacttcgcggcggccgcgatggtcgtgcacatcgcccaggtccaggaggagctcgaccaccactccgacctcaccctcagctaccacaccgtctccctcacggtgaacacccacagtgtgggcggtgcggtcaccgaactcgacttcgcgctcgcccgccgggtggaggacctcgcgccggggcacggcgcgagc

SEQ ID NO: 1848 - DNA, 1065 bp, Streptomyces avermitilis
  CDS (1)..(1065)
atgtacgaccgctggaatctgtcctggcaggccacggcgggctatcgggcccgggtacgcggctgtctgctgggcggcgcgatcggcgacgccctcggcaaccccgtcgagttcgcctccctggaccgcattcgtgccgagtacgggccgcggggcatcaccgggctcgtcccggacggcgacggggtcgtcggccgtatcaccgacgacacccagatgaccctcttcacggtcgagggactccagcgggcccaccaccgcgaacggcacaagggcatcggcggcgccgcgccccgcctcgtccgccaggcgtacggacgctggctggacacccagaccaggcccggacccggcgcggacgtcgacggcggactcgccgcccggccctggctctacgcccgccgcgcccccggcaacgcctgcctctccgggctcacccaggaccacgtccccgacccgatgctccccctcggcccgcccggcgccgtcaacccgcagtccaagggctgcggcgcggtcatgcgctcggcacccttcgggctcggccgggcacccgtcgacttcgcgttcgggctcgccgcccgctgcgcccagacgacccacggccatccgaccggctactactccgcgggcgccctcgccgcgatcgtcacccatctggtagaaggcgaatccctggagggctccgtcctgcgcgccctgcggctgctcgccgttcatcccggccacgacgagaccacggccgcgctgcaccgcgccctcgacctggccgccgagggcgatccgacccccgagaaggtcgagacgctcggcgcgggctggatcgcggaggaggccctggccatcgcggtgtactgcgcccttgccacgaccgacgtcacccgcgccctgctcctgtcggtgaaccactcgggcgacagcgactccaccggcgccatctgcggcaacctcctcggtgcgctgtacggcgaccacgggctgccgcacgagtggctggagcgagtcgagggccgcgccgagatcgcggccctcgcggacgacttcgcggcggagtgcgtacggcgc

SEQ ID NO: 1849 - DNA, 855 bp, Streptomyces avermitilis
  CDS (1)..(855)
atgaccattgtcgcgtccggcgccgtggcgcctccccccggcccgaccgagaagggcaccggcccgaccgacaggggcgtcggcccgctgctgcgcggctggcgggagcggcggcgggtcagtcagctggagctggcgctgcgggccggttcgtcggcccggcacatcagcttcgtcgagacgggccggtcgcggccgagcgaggagatggtgctgcggctcgccgagcacctggagatcccggtccgcgagcgcaacgcgctgctgctggccgccggatacgcaccgcactatccggagacgccgctggacgatccggcgatggacgcgctgcggcagggggtccggcggctgctcgaggggtacgagccgtatccggcgctggtggtggacgccacgtatgacgtcctggcggcgaaccgcggtatcgcgatgctcctggagggcgtcccggagtccctgctcacgccgccgctcaacgcgatgcggctgacgctgcaccccgagggtctggcgccgcgcatccgcaacctcggcgagtggcgcgggcacctgctggcgcagatggagcgccagatcgcgctgcaccgctcggcaccgctgcgcacgctgtacgaggaggtggcggcgtaccccgtccccgacccggtcccggacgcggccgacgagcccgccgaacccgctccgcacttcgcgctccccctgcgcatcgagcacgacggccgggtgctgtcgttcgtctcgtccatctccaccttcaacaccccgatggacgtgacggtggccgaactggccatcgagacgttcctgccggccgacccggcgacggtcaagtacctccagtcactacagccc

SEQ ID NO: 1850 - DNA, 861 bp, Streptomyces avermitilis
  CDS (1)..(861)
gtgagtgagcggcgggccgcgcccaccgtcggacaggtggtgctggggcggcggttgcaggagttgcgggaggcggccgggctgcggcgggaggaggccgcgcgggtgctgcgggtcgccccggcgaccgtgcgacgcatggagaccgccgaggtcgcgctcaaaatcccctacctccaggtgctgttggccacctacggggtgcccgacgccgaggtcgcggcctacgtctcgctggccgaggaggcgaaccggcccggctggtggcagcgctatcacgacgtcctgcccgactggttcagcatgcacgtcagcctggagggcgccgcgagcatcatccgctcgtacgagccgcacttcgtgcccgggctgctccagaccgaggactacgcgcgtgccgtgctggaggccgggaccgtcgggcagacgcgccccgaggacatcgagcggcatgtgtcgctgcgcatggcccggcagaagctcctcacccgggaacggccgccgcatctctgggtgctcatggaggagaccgtgctgcggcgtccggtgagcatccggggccaggtcatgcgcgaccagatcgaccggctgctcgaagccgccgagagcgacgacatcacgcttcaggtcctcgagtacgcggccggtccgcatccggggacgttcacgtcgttcgtgctgttccgtttcgcggagccggagctgcccgacatggtctacagcgagtatctgtccggcgctctctatctcgactcgcgcgccgaggtgtccctgcacctggaggtgctggaccacatggccgcccgcgccgcctccggccggcgcacccggcagatcctgcgcgagtaccgcgagcgcttc

SEQ ID NO: 1851 - DNA, 423 bp, Streptomyces avermitilis
  CDS (1)..(423)
gtggcaaccacgcgctccgcacacaccgtctgggaaggcaacctgctcgagggcaacggagtcgtcaccttcgactcctccggcatcggccagcagccggtgtcgtggccgtcgcgcgccgagcaggcgaacggcaagaccagccccgaggagctgatcgccgccgcccactccagctgcttctccatggcgctgtcgcacggcctggccggcgccggcaccccgcccaccaagcttgtcacctcggccgatgtcaccttccagcccggcgagggcatcaccggcatccacctcaccgtggagggcacggtgccgggcctcgacaacgacgccttcgtcgcggccgccgaggacgccaagaagaactgcccggtcagccaggcgctgaccggcacgacgatcaccctgtcggcgaagctcgcc

SEQ ID NO: 1852 - DNA, 690 bp, Streptomyces avermitilis
  CDS (1)..(690)
gtgcgcgacatcatccgcaccagaatgttccggaccctcacctcggcacaggcgacggcgctgttcggtgccgtcatcgtgctcgccttcgccgtcgcgatcctcgggatcttcgccacgctggccgagagcaagggcatccagcagttcgtcgtgctcgtcgggatgctgctgttgttcctgctcgccgtggtggtcatcgcggcgcgggtggccaccggcccgcgggcgcgccgcccggcggccggggcgtcccgggccgaacggtcgctcaccacggtgcgccggcatgtgggcctcggcgagccggaccaggcggaacgcgccctggaggcctcgcacgtggaccaggagtcggaggagttctggtactggaaggcccggatcgcgctcgcccgctcgaacatcgaggtcgcttccggatatgtcgacgaggcgctgaggctcgaggcccgcaatccgcacagtctcgcgctgaagatcgcgctgctggtcctgggccgtgatccggaccggcgcgaccgggccgtccggctgtcggaggagagcaccgggctcggccccgaactcgacgcctggctgcggcggatgagggccgagggaatgttcgacggcggcgtgcacacccgcaccgagctggagagccggtgcccgctgcccgcccgtacgacggagagtgcacatgccgag

SEQ ID NO: 1853 - DNA, 1386 bp, Streptomyces avermitilis
  CDS (1)..(1386)
gtgagccatggactcgccgccgtaccgggcgagttcaaggcgaacgaggcgacgacccacttcgtcgagatcgcgctgaaggcgggccgcgcccgccccgaggacgctcccgccaccgagccgctccccgtgaacttcgtcttcgtcgtcgacaccagcggctcgatgacgggcaccaagctcgacacggtgaagtccgctctccagaccatctaccgcgagctgcgccccgccgattgcctgggcatcatcacgttcgaccacaatgtgcgcaccgtcctgccggccgtcgccaagcaggacctgccgcccgagcgcttcgcggaagtggtgtccgcgctgaccacccagggcgggaccgacatcgacctcggtgtgcagtacggcatcgacgagatcagccgccactccgtcagcggacgcaccgtcaactgtctctacctgttctcggacggcgacccgacatccggcgaacgggactggatcaaggtccgggcgaacgtcgccgccaaactgcggggcgacctcacgctgtcgtgcttcggtttcggctccgacgcccggatgcccgaactcgccgcgctcgcggggctggccggcggccactcgaccttcgtgacgcggcccgagcaggtcggcgcggatctgctgggcgatctgagcagacgtgaccacctggccgccatcgacatccagctgcggctcgacatcgaccccgaggtggagatccggcacctgtacgggcatgacctggtcaccgacccaagagcgcgcgccgcggtgctccgcgaggcggggcaggcggccgagcgggcgttgcaggactacggcaccaaggcgctgcccgacatcatcaccgaggacaagggcatcaggatcttcgcgcccgacctcgcgttcgaggagacgtactgggtcgtcctcgagatcagggtgccggcggggcgcgagctgtccgggctgggtacggcgaccgtgcagtacgtggacaccgtggcccgcgcgggacggcggcacgaactcgacctgtgcgaggcgctcacgctccccgaggagacggtgacggtgcacgcggtcggcctgtggaccagcgaggtcaccttctacgcgctggacgacctgtacgaccgcgacagggaggcggcgaagaaccggctgacgcaccacctcaagaacctggaggccgcacacagtcacctcccggccaaggagttccgcgacgaccaggtcaccctgcgcaagctgatcacgctcaccggagcactgggtgccgtggtctccttcagcgacgtctcccacggcgccggtgcgggtcccggcttcgcgcccgccgtgcgggtgatgaacgacttcggcagggtccggtcggggttctggccgcactac

SEQ ID NO: 1854 - DNA, 318 bp, Streptomyces avermitilis
  CDS (1)..(318)
gtgacatcctcggcgccccgctgggcagtccccgcgactacgtggaccttcttctgcgacgcggcaccgcacgacgcgggctatctgccggtcacggtgatcgccggccggctgcgggtgcacggccgcggcggtacggtgctccagcccggcatcgacctgctgcatcgcgcggacgacctcccgcccggcgcgcccgtcccggtgatcacggacggctggtgcgacgtcctgcgggtccggcgcgagcacgcgtacctcatcccgcagggcgcacggctgccgttcaccgcacgggggccggtcttccgggtgagg

SEQ ID NO: 1855 - DNA, 2127 bp, Streptomyces avermitilis
  CDS (1)..(2127)
gtgtgggccgggacgcgaggtgggtgcggcgtgggtggcgggcgttggcggagtgtgctcagcggggtgtggcggagtatcgccgtatgggccgtctcgacggtcaccatgctcgtcctcgccggactgctccccgacttccagctccagtccgacaacggtgacagcgccacccggatagccatcaccgcggccgccggcgcgggcgtcttcggtctgctgtcgtcccttttctggcccctgctcgtgcgcctgctgctcctcgtgcccgccctcgtcatcggcctgctcgtcttcttcctcaacggctccctgctgctgatcgccctgcgcatcaacccctccggccggggcgaggccgcgcccgagaccgccgtcgtggtcgccgccgtgatgtccgccgtggcctccgccaccggcggtgccctcgcggtacgggacgacgacgcgtaccgccgcaggctgtaccggctcgccgaccgccgccgcagacgcggcgaggggcaggcgggtccctccaccccgggcaccgtcttcctccagctcgacggtgtcggccacgacgtcctggcggaggcgacggccaaggggctcatgccgaccgtcgccgcctggctcggcctccccaccgccggcacccgcggcggccgtggccccacccatgtgctcaccccctggcgcaccgactggtccagccagaccggcgccagccagctaggcatcctgcacggctccaaccacgacatcccggccttccgttggtacgagaaggaaacccacgaggtcatggtctgcaaccgcccctccagcgccgccgagctccagcgccgcgccgtcgagcgcaccggtgacggcggtctcctcaccgtcgacggcgccagccgcggcaacctcttcagcggcggcgccgaccagctcgcgctcgtcctgtccatcgccgcgcggcgggggaggaagaaccgctcccgggcgggctacttcgcctacttctgcgaccccgccaacgccgtccgcaccgccatgtccctcgtcgccgaggtcggccgggagatgggccagtccaccctggcgcgcgtgcggaaacagcggccccgggtcaagcgcggcggcctctacccgttcatccgcgccttcgcgaccgtcgtcgagcgggacgtcgtcgtcgccgcggtgatcggcgacatgctcgccggccgcaacgcggtctacgcggacctggtcgggtacgacgaggtcgcgcaccactccgggccgcgcagccgggacgccgcgaaggtcctggagcgcctcgaccgttcgctcgcgctgatcgccaaagtcgccgagcacgccccgcggccgtaccgcgtcgtcgtcctctccgaccacggccagagccccggcgagaccttccagacccgctacggcctctccctcggcaatctggtccgggccggctgcgggctgcccgtgccgcgcagggcccggcgcacccacagcggggccgaggcgcgggcggcggtgcgcgccgcgctgcggcggccggtcgaggagggcggcgaggaacaccgcccgtcgcaccgccgctccgagccggtcgtgctcgcctccggcaacctcgggctcgtctccttccccgacgtgccgcaccggatgagcaaggaggagatcgaccggcgccacccggcgctgctgtccaccctcgccaaccatcccggcataggtttcgtcctcgtacggagcgacgagcacggcgggctggtgctcggggcgcacggcgccgagatacccgtcgacgcgctcgacgacgaacaccccggcccgctcgccgacttcggccccggcgccgccgacgccgtacggcgcacgcactccttcccgcacaccgccgacatcatggtcaactcctggtacgacccggtcgagggcgaagtcctcgccttcgaggagcagatcggttcgcacggcgggctcggcggcgcgcaggggcgtcccttcctgctctcgccggtcgcgttctcggcgccggtggacgacggcaccgaactggtcggcgccgagcacctccaccgggtcttccgccgctggctgcgcgagtgcgacggcccgcaggtgcccctggcgacgcgggccgacgagcgcgcggcg

SEQ ID NO: 1856 - DNA, 423 bp, Streptomyces avermitilis
  CDS (1)..(423)
gtgcgcggcgccttcggcccgtcggccacggtacgggtcacggccatcgccagcctgacgcccctggaggaactggacgcggaccccttcctcgtcgactcccgcagccagtacgcgatgtgcgcccgctgggccgccgagcgcggctacgtcgtgacccgggaactcctcgtccgcggactgcggcccgaccactgcgccctgtgggccgacgtcgaggccggcctcgtcgacctgttcgtcgcccccagccaccgtgtcctggagcgcgcgctcgcctccgtggacgagttcgccgcggagtgcgcccgccgcggcgtccgcgtggagacggtgggccgcgcggaaccgtcgtacgacgcgaagatgaaggcccgtatccaccggcgcctttcgatgccgacagcggggtacgacggccgc

SEQ ID NO: 1857 - DNA, 765 bp, Streptomyces avermitilis
  CDS (1)..(765)
gtggagatcacctggtgggggcatgccacctgcacggtcgaggactcgggaacgcgcgttctcaccgacccgctcttcgcgcgccgcctggcgcacctgcggcgccgccggggcgcaccgcccccgcccgaggcggcggtcgcggacgtggcgctcgtctcgcatctgcacgccgaccacctccacgtaccgtccctggcccggctcgcccccggcacccggctgctgctgccgcggggcgccgtgcgtcaggtgccggggctgcgcaggctcggtcatctgcggctcaccgaggtcgcgcccggcgatcggacgcaggtcggtgacctggtcgtacggaccgttccggcgcggcacgacggacggcggctgccggtcggtccgcaccgctcgcccgcgctcgggttcgtgatcgagggtgccgcgcggacgtacttcgcgggggacaccgggctgttcgaggagatggccgaggaggtcgggcccgtcgacgtggcgctgttgccggtcggcggctgggggccgtatctcggcgaggggcacctggacgcggggcgggccgcgcaggcgctcgcgcggctgacgccccgcagcgcggtaccggtgcactacggcacgtactggccgatcgggatggatgccgtgcgcccccatgaattccacacgccgggcgccgagttcgtgcgcctcgcggcggagcgcgcgccggcggtcgcggtgcacctgctggcgcacggcgagagcgtacgcccggaggtggcccgg

SEQ ID NO: 1858 - DNA, 621 bp, Streptomyces avermitilis
  CDS (1)..(621)
gtgatattcctggccgcggtgaactcgaccgtgtcaccggcgtccacgcagcaggccatcggctatccgacgctgttcctgctggtgctgatcggcgcgctggtgccggtggtgccgacgggcgccctggtcagctccgcggcggtggtggccttccatcagtcggcgcccttcgcgctgctgttcgtcttcgcggtggcggcgctcgccgcgttcctcggcgacatcgcgctgtactggctgggccggcgcggaatgcgctccaagaacgggtcgcgctggctgcgggcgatccgcgaccgcgcgcccgaggaccggctcgcacaggcgcaggagaagctgcgcgaccacgacatcgcggtgctcacgctgtcccggctggtcccggcgggccgtctcccggtgatgctcgcctgtctgatggcggacatgccgctgcggcgcttcgcccgcggcaacggcccggcgtgcctcgcctgggcggtgacgtaccagctgatcggcatcctcggcggttccctgttcgaggagccgtgggagggcgtggtggcggcggtcgcgctgacgctgacgatcagcgtcgcgccgagcgtgtggcgcaggctgcgcagggacgccgcc

SEQ ID NO: 1859 - DNA, 1167 bp, Streptomyces avermitilis
  CDS (1)..(1167)
atgacgcagcagacgcagcagacggagcagacggagcagacgaagcagacgaagcagacgaagcagtccgggttcaccacgagcaccgtttcgccgacggaccaggacgccgacgagccgacgtcgacgaccacgaccacgaccacattcacgtccccgtccccgtccccgcccacccccgccgggcccctcgcaccgccgaacgcaccgcccgagccgcgtccgctcggcgagcgccggcgatggcagcgctccttcgccgaccggctgaccgccccgctgcccggactcaaggccttagcccggttcgcccgcgagggcgcgatacggccgggacccgagggactcgccgacatcccgaagctgcccttcgagccggcgccgctgccccgggtggacgcgcgcatggtcgccgtctcctgggcggggcacgcgagttgggtggtccggatcggtggcctcaccgtcctcaccgacccggtctggtcccgccgcatcctcggcacacccgcccggatcacccccgtcggggtggcctggagcgccctgccgcgcatcgacgcggtcgtcatcagccacaaccactacgaccacctggacgcccccaccctgcgcagactcccgcgcgacaccccggtgttcgtgcccgccggactcgcccgctggttccggcgccgccgcttcacgcaggtgaccgagctggactggtgggaggcggccgaactgggcggtgtccgcttggacttcgtgccttcccatcactggtccaaacgcagcctgaccgacacctgccgcaccctgtggggcggttgggtgctcacggcgcccgacgggcagcgcgtgtacttcgctggggacacgggatacgggcactggttcgcgcagatcggccgccgctaccccggtatcgacctggcgctgctgccgatcggcgcgtacgacccgcgctggtggctgagcgacgtgcactgcgatccggaggaggcggtacaggcggcggtcgacctcggcgcgcaccggatggcgccgatgcactgggcgacgttcgtcctgtccgcggagccggtcctggagccgctcacccgggtgcgggcggcctgggagaaggcggggctggcccgcgaggacctgtgggacctgccggtgggggcctcccgggtcctggag

SEQ ID NO: 1860 - DNA, 1323 bp, Streptomyces avermitilis
  CDS (1)..(1323)
atggggaacggacgtacgagactgcgcggaggcacccatgcggcggacggatcgggaaggacacggccccgtccgctacggcccgccgctgcccgaccagggactgcccgtactgccgggactcgcggccgccctcgccgccgccgcggaccgccccgacgccgaacccgccggcggcggccccgccctcctcgccgcggcctgcggctacttcgggcggcgcggtctgtccgcgggccccgaccgcgtcgccgccgcaccgggcgccccggccctgctcctcgcactgaccgcggcgctcggtggcgatgtgctcgtgccccggccctgcgccgcctggtgggcacccccaagggcccggggccgcctgggaagggtccggtgttcccttgttggcgaaccccccgggggaaattgggggggccttcccgggattccggaccccccctcctggaagaaccggtcgcagggttccgtgcccgaaggccgggggaatcccggggggtccttcggttccgtcgccgggtcggccgaacgaaccccaaccgccaaccgtcgcacccgcccgaggtgctgcacgagaccatcgaggccgccgcgggcgagggactgcacctggtcagcgacgagacctggcgcgacaccgtgcaccgcccgcacgacaccgtgctgttcagccccgccgagatgctccccgacggggtcaccgtcctgaccgacctcgccggccccttcctgccggccggctggcccgcggccgtcgcccgcttcccggacaccgccgacggcgccgggctgcgcgcccgtgtcctcgacgtcctcaccgcgctcggcgcccggatcgcccgaccggtcgccgcggccgccgcgtacgcgctcgacgagcccgccgacgtcaccgaacgcctcaccgccgccgtacgcctgcacgcgcgcgtggccaccgccgcgcaccgtgcggtggtcaccgcgggcgccctcgcccggcccccgcaggccggccggcatctgtacgtggacctcggcccgctgcgctccgcgctcagcgcgcacggagtgggcgacgcacaggaactggaggacttcctcaccgcccggctcggcctgcccgcgcccggcggccagcgcttcggggacgacctcgcggccctgcgcgtacggctgtccaccgggccgctcctcggcaccaccgccgaggagcggacgcggtgcctcgattcacccgcgcctttggaactgccacacgtgcaacgcgcgttgatccttctgggatcggtcttcgacgatcttcgcgacgacgctcagcgatgggagcctcctcga

SEQ ID NO: 1861 - DNA, 1068 bp, Streptomyces avermitilis
  CDS (1)..(1068)
atgcgccgttgcgcccgtgtcctgtccgccaccgccctggccggtgccgccctgggcgtcgccgccccggccgcgtccgcggatccggccacggaggtcagaccgcgctccgtcgcgcccggcggcgccgtcaccctctccgtctcctgcgacgccaccggcgcggagcggtccgacgccatcgaggccggcccgcagagctccgaggagaccgaggcccagctgcggctcggagggaacgacgacgccggggcggccgccgacggcgagacggcgcgtatgccgtccgacggggacttcgacggcggtgctaccggtgcggccggccccccggcgcagtgggaggtcgacggacagtgccccgtgacgacgggcggccaggagagtcagtggaccgccttgcccagcgacacccgcgacggcgaggcccgcaacggcgcggcggatccgtccggcgctgcggacgtgcccggcgctgcggacgcgcccgacgctgcggacgcgcccgacgcggtgaatcgtcctgacgaggtgaatcctcccagcgcggtggctccgcccgacacgctggatgcgcccgccgcggtggatcctccgggtgcggtggttccgcccgacacggtggatcccggtgcggtgaatcgccccgacgcggcggacgcgcccgacgcggtgaaccgtcctgacgaggtgaatccccccagtgcggtggtgccgcccggtgtggtggtcccgcccgacacgctggatgcgcccgccgcggtggatccccccggcacgttggctccgcccggcaccgcgagccgccccggcacggtcgagccgcccgacgcggtgaatcgccccgacgccgtcgatccccccgacacgccgaacggccccgacgccgtgaatccgtccggtgcggcggatgcgcctcccggggtccagcgcggagcgcaggccggcgagggcggcgccttcaccgggtcgatccccgccctggtcaccggcagcgtcctggtcgcggtcgccatcggcgccgcctgctaccgagtgctgcgccggaagggaacgtcctcccgcatc

SEQ ID NO: 1862 - DNA, 792 bp, Streptomyces avermitilis
  CDS (1)..(792)
atgcgaacccaagccagcgcgaagcgccactcgcacgacgatgcacccgacaccgcagaggccttccgcaagctcgccacgctcccgccgggccagcagcgcgacacactccgtgaggagatcgtcgaggcctggctgcccatggccgaacggctcgccggacgctttcggaaccgcggcgagaactacgaagacctgcgccaggtcgcgtcgctcggcctggtcaaggccgtcgaccggtacgaccccgagctcggcaacgccttcgagagctacgccgtgcccacgatcaccggcgagatcaagcgccacttccgcgaccacatgtggaccctgcacgtgccgcgccgcgtccaggatctgcgcaaccgtgtgcggttcgccagtcaggacctctcgcagaccatctcgggccgcaggcccaccgtcgccgagatcgccgagcacgccaacatgagcgaggaggacgtccgggcgggcctggaggccctggagagcttcacggcgctctccctcgacgccgaactgcccggcagcgaggacgggtactcgctcagcgacgccctcggctcggccgacccggccctggacatcgtcgtcgaccgcgaggccgtcaagccgcgcctccaggcgctgcccgagcgcgaacgggacatcctctacatgaggttcttcggtgacatgacgcagagccgcatcgccgagcagctcggcatctcccagatgcatgtgtcacggatcatcagccgctgctgcgaccgactgcgcgagcaggtgatgcgggacgccgcc

SEQ ID NO: 1863 - DNA, 408 bp, Streptomyces avermitilis
  CDS (1)..(408)
atgcagcgaggcagtgaccggctgagcgtccaccgggacgacgagatgaaacacgaactgcagggtctgctgcggtccggtcacccgacgcgggccgaagagtggaacgacccggaaccgacggccgacgacgacccgcagatcgcgggcggccctgtgacgcccggcggcgccacgggctcgctggccgccgtgcgctacgagctgggccggcatctgggacgcacctcgttccccgcggggcccgccgatctgatcggcgccctgcgccgcagccacgcccccgacgcgctcgtcgaaccgctggagcggctgccgcacaaggcccgctacaccaacgcgcacgagcttgccgaggcggtcgtacggaccgccgacggcgccgggccgcaggacgaggaacagggg

SEQ ID NO: 1864 - DNA, 444 bp, Streptomyces avermitilis
  CDS (1)..(444)
atggctgatttcgtcagggaggtcatgactcccggcgtcgtcgcggtccgccccgacgcatcgctcgtcgaggccgcgcagctcatgcgggcccaggatgtgggcgatgtcctcgtgaccctcgaccagcagctcgtcggcgtgctcacggaccgtgacatagcgctgcgtgccgtcgcggacggcgtcgacccgcgcaccgtgagcgcccagggcgtgtgcacgaccaacccggtggtgatcggccccgacgagcccgtgtcggccgcggtcgcgctgatgcgggagcacaccgtgcgccgacttccggtcgtcgaggacggacacccggtgggcatggtgagtctcggcgatctggcggtcgcgcaggaccccgaatcggtgctcgccgacatcagccgcgccgaaccggacagctggccgggcgcggctcccgcggcacgc

SEQ ID NO: 1865 - DNA, 543 bp, Streptomyces avermitilis
  CDS (1)..(543)
atgcgcatcgcattcctgaccgcccccgagggggtcgagcagatcgaactcaccgacccctggcaggcggcggtcgacgccgggcaccaaccggtcctggtctcgaccgagcccggacaggtccaggcgttcaaccatctcgacaaggcggacaccttccccgtcgaggaggtggccggtgaggtgccggccgactccttcggcgcgctggtcctgcccggcggggtggccaaccccgacgcactgcggatggacgagcgggcggtggctttcgtccgcgccttcttcgaccagggccgtccggtcgccgcgatctgccacgccccgtggacgctgatcgaggccggcgtggtcccgggccgtgtgctgacctcgtggccgagtctgcggacggacatccgcaacgcgggcggcacctgggtcgacgagcaggtgcagatctgcgaccaggggcccaacacgctgatcaccagccgcaagccggacgacctgaaggcgttccgcgaggcgtttctgaccgagttcgacaaggctgcggccgcg

SEQ ID NO: 1866 - DNA, 315 bp, Streptomyces avermitilis
  CDS (1)..(315)
atggtccctcctggatgccctcgggtggtaggtcccgagcgcgtacccggaccgcaccagggacacgacgatcggggcacgatcatgaacggagtcgacccgggccgcctgaccgaccagcaactcatgaaggagctggaggcgatccaccgcacgcgtcacgacacgctgctgcacggttccaacgacgcgctgcgggtgcacaacgtccgcatggcgcagctggagggcgagtatctgcgccgccatccacgccgcccggtggccccgggccgcactcgtgagggagcccgggagcggggatgcgcccaggcg

SEQ ID NO: 1867 - DNA, 1617 bp, Streptomyces avermitilis
  CDS (1)..(1617)
atgggacatctggaagccgcgcatctcgagtactaccttcccgacgggagggtgctgctcggcgatgtgtcgttccgggtgggagaaggggccgtcgtcgccctcgtcgggcccaacggggccgggaagaccaccctgctgcggctgatctccggtgagctgaagccgcacggtggcggggtcacggtgggcggcggactcggggtgatgcggcagttcgtggggtccgtgcgggacgagacgaccgtacgggaactgctcgtgtccgtcgcgtcgccccgcatccaggaagcggcgcgcgccgtggacaccgccgagcacgccatgatgaccgtcgacgacgaggccgcccagctccggtacgcgcaggcgctctccgactgggccgaggtccgcgggtacgaggcggagacgctctgggacatgtgcaccatggccgcgctcggagtgccgtacgagaaggcgcagtggcgacaggtgcgcaccctctccggtggcgagcagaagcggctcgtgctcgaagcgctgctgcgcggcaccgacgaggtgctgctgctcgacgagcccgacaactatctcgacgtacccggcaagcgctggctggaggagcggctcaaggagacccgcaagaccgttctcttcgtctcccacgaccgtgagctgctcgcccgcgccgcggagaagatcgtgagcgtcgaaccgagccccaccggggcggacgcctgggtgcacggcggcggtttcgcgacatatcacgaggcgcggcgggaacgtttcgcgcgcttcgaggagttgcgcaggcgctgggacgagaagcacgcccagctgaagaagctcgtgctgaatcttcggcaggcggcctccatcagccatgagctggcgtcccgctaccaggccgcgcagaccaggctgcggaagttcgaggaggcgggaccgccgcccgagccgccgcgcgagcaggacatcaccatgcggctcaagggcggccgtaccggggtacgggcggtcacctgcaaggggctcgagctcaccgggctgatgaaacccttcgacctggaggtcttctacggcgagcgggtcgccgtcctcggctccaacggctccggcaagtcgcacttcctgcgcctgctcgcgggcgacgacgtcacgcacacgggggagtggaagctgggcgcgcgtgtcgtgcccgggcacttcgcgcagacccacgcccacccggagctggagggccgcacgctgctggacatcctgtggggcgagcactcccaggaccgcggcgcggccatgtcccggctgcggcgctacgagctgaccgcccaggccgagcagcggttcgagcggttgtccggcggacagcaggcccgattccagatcctcctgctggagctggagggcgtgaccgcgctgctgctggacgagccgaccgacaacctggacctggagtcggcggaggccctccaggagggcctggaggccttcgacggcacggtcctgtcggtcacgcacgaccgctggttcgcccggtccttcgaccgctatctcgtcttcggctccgacggccgcgtacgggagacggcggagccggtgtgggacgagcgccgggtggagcgggccagg

SEQ ID NO: 1868 - DNA, 1491 bp, Streptomyces avermitilis
  CDS (1)..(1491)
atgaccccagatgtcgacctgacggtccgccccccgcgcccccgcgtcctgcgagaccgactgctcgccgccgactaccgcctcttcgagaaggtcgccgcccggcactggccggggggcgaccgcctgctgcccaggctgagccgcaccgcgaaccacggggtcctgtggttcgccgcggccaccgccctcgcggccaccggcagcccccgtgcccgccgggccgccgcccggggcctcgcctcgctcaccctggcctccgccacgatcaacaccctcggcaagcgctcggtccgccgcccgcgccccgttctcgacccggtcccgcacgtccgccgcctcaagcgccagccgatcaccacgtcgttcccgtcgggccactccgcctcggccgccgccttcgcgacgggcgtcgccctggagtcacgcggcctgggcgcggcgctcgcaccgctcgccgccgccgtcgccctctcgcgcgtctacacgggcgtccacttcccgagcgacgtcctggcgggcgcggccctgggcgtgggcgccgcgttcgccgtccgcgggctcgtgccgacccgcgaccggctcccgccgccgggccgcccgcgcgtggacgcgcccgcgctgcccgacggcgcgggtctggtggtcgtggccgaccagggcgcggcggccccggaccgcgtccgcgccctcggggacgccctcccccgtgccgagacggtgcagtgcgaaccggacgaggtgcgggccgagttggagaaggccgccgcccgcgcccaggtgctcggggtgtgcggggacgacggcacggtgaacgccgccgccgaggtggccctgcgtcacggcctcccgctcgccgtgctgccgggcggctcacccgaccacctcgcgcacgacctcggcatcgagggcgtacgtgacctgacccgcgccctgcggcagggcgacgccgtgcgcgtggacgtcggccgcttcacctccggggacatcgagcgctgcttcctcggctccgtcggtctcggcgtccatccggagctggtacgcgagcgggaacgctgggcggagtggctcggcgcctggccggccgacgtgatcgccgcgctgcgggtgctgcgcgcggaccatcaccccttgcaggtcggactggggggtgcgccccgcccgctgtggctgctgttcgcgggcaacggcacgcaccaccgcacggggctcgcgcccggccgccgccacgagctcgcggacgggctcctcgacgtacgcgtcgtgcacggcggccgccgccccgccgcccgcctgctggccgcggccctcgccggtccgctcacccggtcccccgcccacgcggcggtccgggtacgggaactgcgcctgaccggtgtcgcgcccggcaccctcctcgcccacgacggcgaagtcaccgaagtccagggcgatgtgacgctccggaagcttccggaggcgctgacggtctaccgtccgttcccccgcacc

SEQ ID NO: 1869 - DNA, 819 bp, Streptomyces avermitilis
  CDS (1)..(819)
atgtcgaagtcgcaggagaccgccgtctacacccacggccatcacgagtccgtgctgcgctcgcacacctggcgcacagcggccaactcggcggcgtatctcctcgactcgctgaagccccacatgaagatcctcgacatcggctgcggtccgggcaccatcaccgccgacctggcggcgctggtcccggacggccgggtgaccggggtcgaccacgcaccggacatcctggagcaggccagggccacggccgccgggcgcggtctgcgcaacgtcgagttcgcggtcgcggacgtgcacgcgctggagtacccggacgacaccttctgcgtggtgcacgcacaccaggtgctgcaacacgtgggcgatccggtgcaggcgctgcgcgagatgcgccgggtcaccaggccgggcggtttcatcgccgtccgcgatgcggactacgcggccatgacctggtatcccgagtcaccgggcatgaccgactggctggacctgtaccggcgcgtcgcccgggccaacggcggtgagccggacgcggggcgccggctcagggcgtgggcgctgcgggcgggcctgacggacatcaccgccacgtcgagcacctggaccttcgccaccgcggaggagcgggactggtggagcggcctgtgggcggaccgcaccctcgcctcggcgtacgcggcccgcgccacggagggcggccacgcgaccacgcgccagctgcgggcggtgtcgcaggcgtggcgggagtgggggcggcaggaggacggctggttctccgtcctgcacggagagattctctgccgcaagatcgtc

SEQ ID NO: 1870 - DNA, 282 bp, Streptomyces avermitilis
  CDS (1)..(282)
gtgagcacaagcagcagtggacgtaatcggctggatctcgagcccgacaccgtggagcgcgatctcgtcaagctcgtgctgaccgtcgtggaactgctgcggcagctgatggagcggcaggcggtgcgccgcttcgacacgggagagctgacggaggaccaggaagagcggatcgggctcacgctgatgctgctcgacgaccgcatgaaggaactgtgcgagcgctacggtgtgcggcccgaggacctgaatctggacctcggaccgctcggatcgctgctc

SEQ ID NO: 1871 - DNA, 192 bp, Streptomyces avermitilis
  CDS (1)..(192)
gtgaccgtggtggaacgccgtgagatcgccctggtggacctgctcgaccggctgctcgccggcggcgtcgtcatcaccggcgacctcaccctgcgcatcgcggacgtcgatctcgtgcgcatcgatctgaacgcgctcatcagctcggtgaacgcccaggtcccctcgccgtggccggaccaggaggaacag

SEQ ID NO: 1872 - DNA, 765 bp, Streptomyces avermitilis
  CDS (1)..(765)
atgaccgggctgcgttacgtgtacgccgtctgccgccccttcggcacgcccctccaggccgagctgacgggggtggcgggcgccccgcccaagcagctctcgcaccacggtctggtcgccgtcgtcagcgaggtgccggcggaggacttcgccgaggagccgctgcgggcccatctggaggacctggagtggctgaccgcgaccgcccgcgcccaccaaagtgtgatcgacgcgctcaccgtggtcacgacgcccctgccgctcaggctcggcaccgtgttccaggacgacagctccgtacgggtcatgatggaggcgcgcgaggaggccttccgccgcacgctggaccgcctggacgggcgcgtggagtggggcgtcaaggtgtacgccgaaacggagcagacggaaccggaacgttcgcccgggaaagcggcctcgggacgggactatctgcgtcagcggcgtcagcgcaatcggtcccacgaggagatgtgggagaacagcgagcgcttcgcgggccggctgcaccacaccctcgcggaatacgccgaggattcgcgtctgcacgccccgcagaatccggcgctctcccgggcgtcgggacgcaacgtgctcaacgcggcctatctggtgccgcgttcggactcggaggagttcgtggagaaagtggaccgtacgaaggacgaactgtccggggtacgggtggaactcaccggcccctgggctgcgtactcgttcagcggcatcgacggggaggcggacgcg

SEQ ID NO: 1873 - DNA, 324 bp, Streptomyces avermitilis
  CDS (1)..(324)
atgaccactcccagcagactgcccgacccctacggctcaggcggcggcgccaacctcgccgacatccttgaacgggtgctcgacaagggcgtcgtgatcgcgggcgacatccgcatcaacctgctcgacatcgagctgatcaccatcaagctgcggctcatcgtcgcctccgtcgacaaggccaaggagatgggcatcgactggtgggaggacgacccggcactgtcctcgcgcgcccggcacaacgaactcgcccgggagaacgccgagttgcgcgcccatgtcgccgaactggagggcgcccgcccccaagaggaggcctca

SEQ ID NO: 1874 - DNA, 1134 bp, Streptomyces avermitilis
  CDS (1)..(1134)
atgagtgacaccctcgggtccgtgacgggccgggcgaaggaccaggcgaagggcggggtgaaggagaacccgatcaccggcgtcgtccagagcgaggccgccgaccggctcaaggcggaggtgcaggagtacctgggcgcccaggcccagcggctgctggtcggtttcggccgcaagctcggtgagaccacgggcaagctcaacgacatcgcggaaggcaacagcccgggcttcgccaagctcgcgctcgacggcggccgcaaactcgccgagggcaagggcccgctgcgttccgccctggaactcggcgccggccgggccaaggacagtgtcgtgggcgccttgaagaacctgaccggcggcaagggccggcgcaagggcggtgcgggcaagaagcccaccgtcatcatcgagttcatcgacgtcggcgtgccgctgcgcacggcgtacgaccagtggacccagtaccaggacttcagcaccttcgccaagggcgtcaagagcgcgaaccgcgccgacgacacgacgagcgactggcagctcaaggtcttctggtccaaccgcagctggaaggcgcacaccaccgagcaggtggccgacgaacggatctcctggacgtccgagggcgcgaagggcacgaccaagggcgtcgtcactttccactccctggccgacaacctcacccgggtgctgctcgtcatcgagtactaccccaagggcctgttcgagaagaccggcaacatctggcgcgcccagggccgccgggcccggctcgacctcaagaacttcgcccgcttcatcacgctcaagggcgaggccgaggacggctggcgcggcgagatccgcgacggcgaggtcgtccgcagtcacgaggacgcggtcgccgaggaggaggccgaggagtcgggccctgagggcgagtccgaagagcccgaggaggcctacgaggaccaggaggacggcgaagcggacggcgaagaaggcgagccgtacgaggagcaggccgaatacgccgacgaggacgaagctccggagggcgagtacgccgacgaggacgaggtcccggaggacgaggctcctgaggaggagtacgagtacgaagaggaagaggccccggtaggcgggggtcgccga

SEQ ID NO: 1875 - DNA, 684 bp, Streptomyces avermitilis
  CDS (1)..(684)
atgaatcgaataggactgggcctcgcgataggggccggatacgtcctcggacgtaccaagaagatgaagctggcgttcgccgtcggcaccatggtggccggcaagcggctgaacctcaccccgcgggccctcgccgacctggtctcccagcagctgctgaacaacccgcagttcaaggagatcggcgacgagctgcggcaggatctgcgcggcgtcggcaaggccgcctccggagcgctgctcgagcggcagatcgaaggactcgccgaccggctgcacgggcggaccgcgcaagtgcgcgaccagctcgcgggcgtcgcgccggacgtgccgggcctcgatgacgacgaggaggaggacgagcgggacgaggaggacgcacgggacgagcggggcgaggcggacgagccggaagagcgggaccgggagcccgacggcgaggaggaccgcccgcgccgggcggcgccggccaagaagaccgccgcgaagaagggcccggccaagaaggctccggccaagaaggctccggcgacgaagacggcggcgggaacggccggggcgaagaaggcggccaagaaggctcccgccaagaggacggcggccgccaagaggacggcggccgccaagagttccgcgcgccgggtcacccggactcgtacccgggaaaggggcggcgacgatgag

SEQ ID NO: 1876 - DNA, 261 bp, Streptomyces avermitilis
  CDS (1)..(261)
atgggcctgatcacagaggtgctgctgctgccgttcgcaccggcgcggggcagcatctgggtgctgggtcaggtactggcggaggcagagcgccagtactacgacccggccacgatccgtgccgaactcgcccgcctcgagcagcagctcgaggcgggcgagatcgacgagaccgaattcgaccgccgggaggacgagctcctcgaccggctggagaccagctcgcgcagcggcgcgggaaccggcaacgggacgacagga

SEQ ID NO: 1877 - DNA, 765 bp, Streptomyces avermitilis
  CDS (1)..(765)
gtgagtacgtacgtctacggcatcgccgcgagttcccacccctcgctccccgacggcatgggcggggtcggcgaaccgccgatgccggtgcgcatcatcaaggagggcgagctggcggcgatcgtcagcgacgcgcccgaggggctgcgccccaagcgcagggatctgctcgcccatcagaacgtcctgaacgaggccggaggcggcggcaccgtgctgcccatgcgcttcggcagcgtcggggcggacgacgcggccgtcgccggtgtgctcgccgagcgggccgaccactacaaggagcgcctgacggcactggccggccgggtcgagtacaacgtcaaggcgagccacgacgaagaggccgtcctgcaccgcgtgatgtccgagaacaccgagatacgggcgctcgccgaggccaaccgtcagtcgggcggcggcagttacgaccatcgcctgcaactcggtgagatggtcgcggcggccgtccagcggcgcgaggccgaggacgcggtggacgtgcggcacacgctggagcccgcggccgacgcggtgagcgtcggccccgagtcgacgggctggctggccaacgtgtcgttcctggtggcacgcgacgccgccgacaccttcgtcgccgccgtcgagcagctgcgcaagggccatccgcacctggacgtgcggctcaacgggccgctgccgccgtacagcttcgtcgaacccgacccgtccgagtcggtggacagcttcaccggcgccgagcgggtcgag

SEQ ID NO: 1878 - DNA, 423 bp, Streptomyces avermitilis
  CDS (1)..(423)
atgaccgttgtccccgcacagcagaccggtggcggaggtggctccagtgggctgtatgacgttctggagctcgtactcgaccgagggctcgtcatcgacgccttcgtgagggtctccctcgtcggaatcgaaattctcaagatcgacgtccgtgtggtcgtcgccagtgtcgacacctatctgcgcttcgccgaggcgtgcaaccggctcgacctggaatccggaccgcacaagagcccggggctgcccgacctggtcggtgacatcaccgagtccggcgcccgcggcaagtccaagggggcgctgtccggcgccgccgagacgatctccgacgcgttcaagcagtcccgtgaggaggggcagagcgagagccggccccgcgcccgcaagtccaccgcctcgcgccggaaggaggagcaggag

SEQ ID NO: 1879 - DNA, 345 bp, Streptomyces avermitilis
  CDS (1)..(345)
atgtcgaacacatccaacacgtcaaaatcacaagattcacagaatacgcaggacgcaccgagaaatgagcggggcggcacggcggaaaagcggccgggcacgatggaggtgctacgcaaggcaggcgcccagttcgccgaactcaccggcctggaggccgagtcggtctcgtccttcgaacgctcggaggacggctggcagttgcaggtcgaggttctcgaactcgcccgtgtcccggacacgatgagcctgctggccagctacgaggtgaagctcgacccgtacggcgaactcaccggctatcgccgggtccgccgctacgaacgcggccgggccgacgcccgc

SEQ ID NO: 1880 - DNA, 1848 bp, Streptomyces avermitilis
  CDS (1)..(1848)
atgaacacccgtcaactcaccgaactgggacagcagttgcgggtcgacagtgtccgtgccgcggacgccgcgagctccgggcaccccacctcctcgatgtccgccgcggacctgatggccgtactcctcgcccaccacctccgctacgacttcgaccgtcccgcccaccccggcaacgaccgcttcatcctttccaagggacatgcctcgccgctgctgtacgccgcctacaaggcggccggcgccatcgacgacgccgaactgctcaccttccgcgagctcggcagccgcctcgaagggcaccccacgccccgccggctgccctgggtcgagacggccaccggctcgctcggccagggtctgcccgtcggcgtcggcatcgcgctgtccggaaagcggctcgagcgcaccggttaccgtgtctgggtgctgtgcggcgacagcgaactcgccgagggctccgtgtgggaggccgccgagcacgccgggtacgagcacctcgacaacctcaccgcgatcgtcgacgtcaaccgcctcggccagcgcggccccacccggcacggacacgacctggacgcctacgcccgccggttccaggccttcggctggcacaccatcgagatcgacggtcacgacgtggacgccgtcgaccgtgcgtacggcgaggccgagtccaccagcggccagcccaccgtcatcctcgcccgcaccctcaagggcaagggcgtcgcggccgtcgaggaccgcgagggcctgcacggcaaaccgctgccggacgccgaggaggcgatcgccgaactcggcggcgtccgcgagctgcgcatcgaggtccaagatcccccggcggcacgggtgttgcacgccgtggccgcgccgggacaggtggagctcccgcgctacgacaagggtgacgaggtagccacccgcgacgcctacgggcaggcgctcaccgcgctcggcggcgcccgcgaggacgtcgtcgccatcgacggcgaggtcggcgactccacccgctccgagtacttcgccaaggagtatcccgaccgctacttcgagtgctacatcgccgagcagcagatggtcgccgccgccgtcggactcgccgcccgcggctgggtgccgtacgccgcgaccttcgccgcgttcctcacccgcgcccatgacttcgtgcgcatggcgtcgatcagcggtgcgggcatcaacctcgtcggctcgcacgccggcgtgtccatcggccaggacgggccctcgcagatgggactggaggacctcgcgatgttccggtcggtgtacgactcgaccgtcctctacccctgcgacgccaaccagacggcgaagctcgtcgccgcgatggccggcctcgacggcgtccgctatctgcggacctcgcgcggcgcgtcgcccgtcctgtacgggcccgacgaggagttcccggtcggcggcagcaaggtgctgcggtcctccggcgaggaccggctgacgctcgtcgcggccggcgtcaccgtccacgaggcgctggccgccgccgactcgctggccgaggcgggcatccgggcccgggtgatcgacctctactcggtcaagccggtcgaccgcgacaccctgcgccaggccgccgaggacaccggctgcctcctcaccgtcgaggaccaccgcgaggagggcggcatcggtgacgcggtcctcgacgccttcctcgacggacgccccgtgccccgcctggtgcgcctcgccgtccgtacgatgcccggctcggcgtccccggccgagcagttgcacgccgcgggcatcgacgccgagtcgatcgccaccgcggcccggctgctggtggaacaggccgtcgtgcgc

SEQ ID NO: 1881 - DNA, 1359 bp, Streptomyces avermitilis
  CDS (1)..(1359)
gtgagtcgaccccgcatcctgatcgtcggtgccggcttcgccggataccagacggcccgcaccctttcccggctgacccggcacaaggccgacatcactctcctgaacccgacggactactttctgtatctgcccctgctgccccaggtcgccgccggcatcctggagccgcgccgcgtcaccgtctccctcgccggcacactgccccacgtgcggctggtgctcggcgaggcccagacggacggcatcgacctcgacgctcgcaccgtgcgctacaccggcccggagggcgacgtcggcacactgacgtacgaccggctggtgctcgccgccggcagtgtcaacaagctgctgcccattcccggcgtcgccgagcacgcacacggcttccggggactgcccgaggcgctgtatctgcgcgaccacgtgacccgccaggtggaactcgccgccgcggcggccgactccgagacctgcgcctcccggtgcaccttcgtggtggtcggcgccggttacaccggaaccgaggtcgccgtacaggggcagctgctcaccgacgcgctggtgcgcaaccggccgctgcgcgagggcaggcggccacgctggctgctgctcgacgtcgcaccccgggtcctgcccggactggacgaacggctctcgcgcaccgccgaccgcgtgctgcgcaagcggggcgtcgaggtgcgcatggggacctccgtgaaggaggcgacgtccgacggagtcctgctgtccgacggcgagttcgtcgacacccgcaccctcgtatggtgcgtcggggtgcggcccgacccgctcgccgagtccctcggactgccgatggagagcggccggctgctcgtcgagccgaccctccaggtccccggccaccccgaggtgttcgcctgcggcgacgcggccgccgtacccgacctggagaatccgggccagtacaccccgatgaccgcccagcacgcctggcggcaggggaagaccgccggccacaacgtggccgcctcgttcggcatcggcacccgccgcccctaccgccaccgcgacctgggcttcgtcgtggacctcggcggggtgcaggccgccgccaaccccctcggcatccccctgtccggcccgctcgccggtgccgtcacccgcggctaccacctcgccgccatgcccggcaaccgtgtccgcgtcgccgccgactggctgctggaggccgtactgccgcgccaggccgtgcagttgggtctggtgcggtcctggtcggtgcccctggacaccgcgtcgccggaactggcacggatgcccggcgccccggagaggctcgccaccactgacacccccactacggaaggaccctca

SEQ ID NO: 1882 - DNA, 609 bp, Streptomyces avermitilis
  CDS (1)..(609)
atgttccgccggctccgggtccggcgcttcgccgtgcgtacggcgtcacgcgcggagttacgggagcggaggcccgggtacccgggccgcatgaagcctctcgatcacctggaacatctggacaagagcctggtcgacgagctggcgcaggtcgcccgcgagaccatccgcgacgagctgcgcgagcagagtcgcaagcagcgccgcacggccacgctctacgccgcttcgggcgccgccgccctctacgcgggtgccgcgctggcggtcgccctcggcctggcgctgtcgctcggcctgccgggctgggcggccgccctgatcaccgccgccgtgctcggtgtcgtcgcccagctgctgcgcgccgcggcgcggccgtcgccgtcccggcccacgaccaggtacgacctcgaaccggcaggcgaccatggccgggtcgtcgggggcaccccgcccgccgggccgccgggcggcctcggcatgccgtacccgccggtgccgccggtcgcgcccggcgcgccgatgccgggaaccgcggagccgggtgcgccgcgtcaggacgacatggaccccgaagcaccgcaccaccggggccgccgagcgggctcc

SEQ ID NO: 1883 - DNA, 351 bp, Streptomyces avermitilis
  CDS (1)..(351)
atggagattctgggagccacgctgcgtatctgcgtcgacgacctggaggcttcggtcccgttctacgagagactggcgggcggcagcgcgctgcgtttcgagcgcggtggcgtccaggtcgccgcggtcggctgcttcctgctgatgagcgggccggaggccgaactcgacgtcctgcgcaaggtcgcggccacgatcgcggtgaaggacgtcgacgaggcccaccgagtgctcggcgactcgggcgcccacatcctggcggggccggtggccacgccggtgggccgcaatctgatcgcgatgcacccggacggctcggtgtacgagtacgtggaccggcgggcagcggac

SEQ ID NO: 1884 - DNA, 894 bp, Streptomyces avermitilis
  CDS (1)..(894)
atgcgaagcatcgtcgtcctggacgccccctccaacctgggcctgcgcccgcccgccccgggcaccgtgcccggctgctacaagctcgccggcgcgctgcgggaacagcgcatcgtgcagcgcctgggcgccttggagggcggcgtcgtcgtaccgccgcgctacgaccgcggggagtggcaggagggcgacggcgtcttcaacgcggccgccctcgcctcgtacacccgcaagctggccgaccgcatcgaacaccatgtacgcgccggtgatctgccggtcgtcctcggcggcgactgctccatccagctcggcgcctcgctcgcactgcgccgcatcgggcggtacgggctggccgcggtggacgcctccgcggacttccgccaccccggcaactcggaccgcgtcggcgccgcgggcggcgaggaactggcgctggccaccgggcgggggcaggaggacctgaccgacatcgaggggctgcggccgtatctgcgggacgaggacgtacggctcttcggcatccgcgacgacgatccggagcggacggaactcggcgcgctgaagatcgcgaccgtcaccgtcggcgaccttcgcgcatggggtgcggacgcgctcgcccgggccacggtggaggccttcgagataccgcaactccaggggttctgggtgcacttggacgcggacgtcctcgatccgtccgtcatgcccgccgtcgacagccccgacccggacgggctgctgcccgacgaggtcgtcgcgctgctgcggccgttgctgcgctccccgcactgcgccggtctcaacgtcaccatctacgaccccgacctggacccggacgggacggccggggcgctgctggccgacatcgtcgtgtccgcgttcgacgcgtcc

SEQ ID NO: 1885 - DNA, 540 bp, Streptomyces avermitilis
  CDS (1)..(540)
gtgtctgagaactcccgctatctcgccgagggcccccgcgtgggcctgcggcccttcacctacgacgacgaagccgagttcctcgcccgggtgcgggagagcaaggacctgcaccggccgtggctgtttccgcccgacagcccggacgcgtaccacgcctacgcgggtcggctcatcgaggacccgacgaaggccggcttcctggtgtgcgagaaggacggcggcggtatcgccgggttcatcaacatcaacaacatcgtcgcgggctcctttctgaacgggacactcggatacggcgtcttcgcgcatgccgccgggcgcgggctgatgggcgaggggctcgcactcgtcgtcgcccacgcgttcaccaccctggggctgcaccggctggagatcaacgcgcagccgggcaacgccgcctccatcgccctcgcccgccgctgcggcttccggctcgaggggttctcgccggacttcctgtacatcgacggagcctggcgggaccacgagcgctgggcgatcacggcgaccggccctcgc

SEQ ID NO: 1886 - DNA, 930 bp, Streptomyces avermitilis
  CDS (1)..(930)
gtgatgtcgacgaccccgctgaaccgtcccgcccgcctggcccccggcgcccgtgtcgccgtgatcgcgccgagcggcccggtccccgaggaacggattcaggcgggcctcgacatcctgcggggctgggacctcgaccccgtcccgaccccgcatgtcctcgaccggcatccccggttcgactacctggcgggcaccgacgccgaccgggccgccgacctccagtccgcctggtgcgccccggacgtggacgcggtgctgtgcgcccgcggcgggtacggggtgcagcggatggtcgacctgctcgactgggacgcgatgcgggccgccgggcccaaggtgttcgtcgggttcagcgacatcaccgcgctgcacgaggcgttcgccacccgggcgggcctcgtcacgctgcacgggcccgcggcggcgggcgccgacttcatcaagaacgcgcgggcccaggaacatctgcgggccacgctgttcgagccggagtccgtgcgcaccatcgcgtccggcggcccagcgctggttcccggccgggcccggggcgtcaccctgggcggctgtctgagcctgctggccaccgacctcggtaccccgcacgcccgtgccggggcccgggacgggctgctgatgctcgaggacgtcggcgaggcggcgtaccggatcgaccggtcgctcacgcagctcctgcgcgccggctggttcgacggggtcgccgggatcgcgctcgggtcgtgggagaggtgcggtccctacgagaagctgcgcgcggtcttcgccgaccggctcggcggactcggggtgccggtcgtggaggagttcgggttcgggcactgcgagggagcgctgacgatcccgttcggcgtacgggccgaactggacgcggacgcgggaacgttgacactggacgaacccgcgctccgc

SEQ ID NO: 1887 - DNA, 1998 bp, Streptomyces avermitilis
  CDS (1)..(1998)
atgcagaccctggcgtacggttcatggccctcgcccatcgcggcggggctcgcggccgcgcacgacgggcagcccgagttcgtgggcttcgtcggggacgaggcctggtggaccgagccgcggcccaccgagggcggccggcgcaccctcgtacgccgcagggcggacggcgtggaggagtccgtcctgtccgcgccgtggaacgtgcgcagccgggtcatcgagtacggcggccgcccctgggcgggggcggcccgccccgagggaccgctggtcgtgttcgtcgacttcgccgaccagcggctctacgcccacgagcccgatacccccggtgcgcggccgcgccccctcacgcccgtttccccggtcggcggcggactgcgctgggtcgacccgcggctgcgtgtcgaacgcggcgaagtgtggtgcgtgctggaggagttcaccggcgacgggcccacggacgtacgccgcgtggtggccgcggtgccgctggacggttcggcggccgaggaccggggcgccgtgcgggaactcaccgacgggcggcaccggttcgtcaccgggccccggctctcgcccgacgggcggcgcgcggcctggctcgcctgggaccacccgcggatgccgtgggacggcacggagctgatcgtcgcggaggtcgccggtgacgggacgctgcgggaggcccacacggtcgccggcggccccgacgagtcgatcgcccaggtggactgggcccatgacgggtccctgctgtacgccagcgaccgcaccggctggtggaacctgtaccgcgacgacgagccggtgtgcccccgcgaggaggagttcggcggcccgctgtggaagatcgggcagcgctggttcgccccgctggagagcggactgatcgccgtggtgcacgggcggggcgccaccgcgctcggcatcctcgacccggagaccggcgaggtggtcgacgccgccggcccctggaccgagttcgccgccacgctcgccgtgcacggcacccgggtcgtcggcatcggcgccagcccgcgcagcgcctacgaggtggtcgagctggacaccctcccccaagctctcggctccgatcgagcaggggcaacccccgtcgcccgcgcccgggtgatcggcgccgcgcacgacgacccggtcgaccccgcgtgctaccccgagccgcagatccgcacgttcaccgggccggtggggcgcgagatccacgcgcacatctaccctccgcacaaccccgggtgcgtcgcgcccggcgacgagctgccgccctacgtcatctgggcgcacggcggccccaccagccgggcgcccctcgtcctcgacctggagatcgcctacttcacctcgcgcggcatcggggtcgccgaggtcaactacggcggatcgaccgggcacgggcgggagtaccgcaaccggctgcgtgagcagtggggcgtcgtcgacgtcgaggactgcgcggccgtcgcgctcggcctcgccgaggagggcaccgcggaccgcgcccggctcgccatccgcgggggcagcgcgggcggctggacgacggccgcgtccctggcgagcaccgaggtgtacggctgcggcacgatcctctatccgatcctcgacctcgccggctggggctcgggggagacccatgacttcgagtcgcagtacctggagtcgctggtggggccgctcgcccaggtgccggggcgctatgccgagcggtcgcccgcggagcacgccgaccggatcaccgcgccgttcctgctgctccaggggctggacgacgtgatctgtccgccggcgcagtgcgagcggttcctggcgcggatgcgggggcggggggtgccgcacgcgtatctcgccttcgagggggaggggcacgggttccgccgggccgacacgacggtgcgggtgcttgaatcggagctctccctgtacgcgcaggtcttcgggctgaatccgcccggtgtcccgaccctggagctcaccacg

SEQ ID NO: 1888 - DNA, 1320 bp, Streptomyces avermitilis
  CDS (1)..(1320)
atggctgaagcaccggcactcgaagaggtcgtacggttcacctccgacctcatccgcatcgacacgaccaaccgcggcggcggggactgccgcgagcggcccgccgccgagtacgtggctcagaagctggccgaggcgggtctcgagcccacgctgctggagcgcaccgagggccgtacgaacgtcgtggcgcgcatcgagggcaccgaccccctcgccgacgccctcctcgtgcacggtcacctcgacgtggtgcccgcgcaggccgcggactggagcgtgcatccgttctccggggagatccgcgacggcgtggtctggggccggggcgcggtcgacatgaagaacatggacgcgatgatcctcgcggtcgtacgggactgggcgcgcgaaggcgtgcgaccccggcgcgacctcgtgatcgccttcaccgccgacgaggaggcgagcgccgtggacggctccggcttcctcgccgaccggcaccccgggctcttcgagggctgcaccgaaggcatcagcgagtcgggggcgttcaccttccacgacggcgccggccgacagctctatccgatcgcggcgggcgagcgtggcaccggctggctcaagctcaccgcccacggccgggcgggccacggctccaaggtgaaccggagcaacgcggtcacccgcctcgccgccgccgtcgcgcgtatcggcgcacacgcgtggccgctgcggctcacgccgacggtgcgcgctgcgctcaccgaactcgcggcggtctacggcatcgacgccgatctcgacgacctcgacgacatggacgacatggacggcctgctgaagaagctcggcccggccgccgcgctcgtcgagccgaccgtccggggcagcgccaacccgaccatgctgagcgccggttacaagatcaacgtgattccgggggaggccgtcgggtatgtcgacggccgctatctgcccggcggtgaggacgagttccgcacgaccctcgaccggctcaccgggccggacgtggagtgggagttcgagcaccgcgaggtggccctccaggcgccggtggactcggtgacgtacgcgaggatgcgggccgccgtcgaggagttcgcacccgagggacatgtcgtgccctactgcatgtcgggcggcacggacgccaagcagttctcgcgtctcggcatcaccggatacgggttcgcgccgctgaagctcccggagggcttcgactaccaggccctcttccacggcgtggacgagcgcgtccccgtcgaggccctgcacttcggcgtccgcgtgctcgaccgctttcttcgcaccgcc

SEQ ID NO: 1889 - DNA, 831 bp, Streptomyces avermitilis
  CDS (1)..(831)
atgaagatcctgatcagcgccgacatggagggcgccacgggtgtgacctggccggccgatgtgctgcccgggaccccgcagtgggagcggtgccggtcgatgttcacctccgacgtgaacgcggccgtgctcggcttcttcgacggcggcgccgacgacgtgctcatcaacgaggcacactggtcgatgcgcaatctcctgctcgaacggcttgacgagcgggcggagatgctcaccggccgccacaagtcgttgtccatggtggagggcgtacagcacggagacgtggacggcatcgcgttcatcggctaccacgcgggcgccggcatggagggcgtcctcgcgcacacctacctcgccaactccatcaccggcgtgtgggtgaacgacgagcgggccagcgaaggactgctcaactcccacgtcgtcgccgagtacggggtgccggtcgtcctcgtcacgggcgacgacgtggcctgcgaggacgcgctcggatacgcgcccgaggcgctcaaggtcgccgtcaaggaccatgtctcgcgctacgcggccgtgtgccgtacgccgtccaggaccgccgccgacatccgtgccgcggccaaggaggcggcctcgctggccgtgccgcacgaacccgtcgtgggcgggccgttcaccgtggcgctcgagttcgacgccgagcacctcgcgatggccgccaccgtcgtgccgggtgtggggcgcatcggagagcggaaggtgtcgtacaccagcgggaccatgtacgaggggatccgcaccttcaaggcggtcaccacgatcgtctcggccgccgtcgaggagcagtatggc

SEQ ID NO: 1890 - DNA, 723 bp, Streptomyces avermitilis
  CDS (1)..(723)
atgagcgtgacgagtaggtaccgggaggcctgggagggcttctggcgcgaggcccccgaaggacagggggccgtcttctgggacgcggagcccatactgaccgcgggcgtccatctggcactgttcgagccgcggttgacggccccgggcctgcccctcgtcgacctgggctgcggcaacggcacccagacccgcttcctggccgaccgtttcccgcacgtcgtgggcgccgatctgtcggccgcggccctcgaccacgcccgtcgtgccgaccccgcgggccaggccacgtaccggctgctggacgcggccgagaagaccgaggccgagaccctgcacgccgaactgggcgacgccaacatatatatgcggggcgtgctccaccagtgcgagcccgacgaccggcagccgctcgtcgacggcatcgcgaccctgctgggcgaccgcggccggctcttcctcgtcgaactcgccgaggccgcgggagtggtgctgaagggcctggcgcggagcccccaaggaccgccgcccaagctcgcacccgtcttccggcacggcatcgcccccggcgaggtggcggacgccgcggtccccgcctacctcgacgccgcaggtctcacggttctcgcgagcggcgagctgcccctcgtcaccaccgagtaccggcccgacggcacgcgcatcgaactgccgtccaggtggctgctggcagggcgtggggcc

SEQ ID NO: 1891 - DNA, 2460 bp, Streptomyces avermitilis
  CDS (1)..(2460)
atggaacgtggcaccgagtggggcgcaccttccggccacggagctgggcacggcgcggtggagcgggccaccgcggccgggcgtatccccctcgccgtggtcgtcgtcgaccgtgcgggcctggtctcgcactggagcaggggcgcacgccggctgttcggcacatcgagggaggacgcggtgggccgtcccgccgtcgacctgctccccgtctccggggcgctccccgacgacgagatcgcgccgtacggtgcgtacgcggcgtatgaagggttgggccccgacctggagtcctccctcggcggatggctctcctacccggccgccggccgggcccggctccgggtgccggagcgtgaccgcatcgacgtgctgtggtgggcgtaccccctggtgggcccgggccccgagcggctgctggtgctggccgccgacgcggacgcgctgcgccccgacgcccggggtgccgagggcgtcgccgtcgagcgcatcgcgcccggcttcgccctgcacaccgacttccccggcgccgaggagctggcccgcgaactgcccgagatcctgcccagcatgagcgtcggcgagagcgcgcgcatcgtctcgcaggttctcgaactgggttatcccgtactggagttcagtcagaacgaccgggtgcccgtcactcccgactggggtgtgccccggcgggcggagcgcaaggcgcgtcgcgagcgggccgccagggcggtggcgtcgggcgagagcgtgccgcaggacgtccaggacgagggcgaggacctcgagtacgtcgccgtacgcgaacgcctggagttcctcaacgaggtcagcggacgcatcggcacctcgctcgatctggcgcagaccatcatcgaggtcagcaaggccgtcgtaccgcgcttcacggacgtcgcgggcacctatctgcgcgaacaggtcgtcgccggcgagggcttccccgacggcgtgcccgacaccaccacgatgtggcaccgggtcgccgtcgagcacaccgacgaaccgggccgctgggacgacgtcgtaccggtcggcgaggccatgccgttcccggcgcacacgccgttcttccagtgcatgaccagcgggcagcccgttctcgtgccgcgcatcagcgagcagatggggcacgccatcgccgcgcagttcgagaagcgcgacatccggccgctcatcaacaaccgctccatgctggtcgtgcccctgaaggcccgcaacgtggtgctcggcttcatgatcctgctgcggcatccggagcgcgtcgagttcaacgacatggaccgggtcaccggcgccgaactcgccgcccgcgcgggcctcgtgctcgacaacgcgcgcatgtacacctaccaggagagcgtcgccgagaccctccaggacagcatgctgccgcacatcgcgccccgcatggccggctgcgacatcgcgacccgctatctgccgggcacgttgctgggacgggtcggcggtgactggttcgactcggtgaaactgcccggctcccgcaccgccctggtcgtcggcgacgtcatgggtcacggcctgaactccgccgcgatgatgggccagttgcgtacggccgtacagaccatggcggcgctcgacctgccgcccgcccagctgctgcgcaacctcgacgacctcgcccagcggctcggcgacacctacctcgcgacctgtctgtacgcggtctacgacccgatcacgagcgagctggagatcgccaacgcgggccacatacccccggtgctggtccgcgccgaggacggccgcagcgaactgctcgacctgccgacgggtgcgcccatcggcgtcggcggggtgccgttcgagtcggtacgcgtgcccgtggcgcccggggaccggctggtgatgtgcaccgacggcctggtcgaggtgcgcggcgaggacatcggggtgggtctcgccaccctctgcgagtccgccgcccaccccgccgcctccatggacgacgcctgcgacaccatcatccgcgccctcaacgtccggggcggacgcaaggacgacgtggcgctgctgatggcccggctgggcggcatcgcccccgaggacgtcgccctgtggcgcttcgccctcgaccccgtcgaggtgggccgggcgcgtgcggcggtgcgtgagcaactgcacgaatggggactgaacagcctggcggacaacgccgagttgatggtcggcgagctggtcaccaatgccgtacgccatgcccgcagccgtcgggtcgagctgcgtctggtgcgcggcgagaccctgctgtgcgaggtcgatgacgaggaccacacgctgccgtcgctgcgcggcgcgggacctgccgacgagttcgggcggggtctgcgggtggtcagcacactggcccgggaatggggggccagccgtacgagcgcgggcaagacggtgtggttcgaactgacactgccgagacgc

SEQ ID NO: 1892 - DNA, 2376 bp, Streptomyces avermitilis
  CDS (1)..(2376)
gtgggcgggaccactctggtcaaggacgagccggccgccgagccctcggacacccccgccccaccggcgcccgggcccgcgcaactcggcccgcgccgggtgcggttggtcttctgcgccctcatgctcgccatgctgctcgccgccctcgagcagatgatcgtggccaccgcgctcccgaagatcgtcggcgagctgcacggtctggacaggatgtcctgggcgatcaccgcgtatctgctcaccgccaccgtcgcactgcccgtctacggaaagtgcggcgatctcttcggccgcaagggcgtcttccagttcgcgatcgtcgtcttcgtcgtcggctccgtgctcgccggccgggcgcggaccatggatcagctgatcgccttccgcgcgatccagggcctcggcgccggcggactcatgatcggcgtccaggcgatcatcgcggacatcgtcccgccacgcgaacgcggccgcttcatgggcctgatcggcgccgccttcggtctcgcctccgtcgccgggccccttctcggcggctatttcacggaccacctctcctggcggtggtgcttctacatcaacgcgcccttcggcctggtcaccctggccgtcgtcaccgtcgcgctgaaactgcccaagcccctcaccaaggcgcgcctcgacgttctcggggcgctgctgctggccgtggcgtccacctgcgcggtactgctcaccagttggggcggcaccgagtacgcgtgggactcgcggatcatcctggggctcggcgcgggcgcgtgcgtcgcggccgtcctcttcctggtcgtcgagcacttcgcgcccgaacccctcatccccctgcggctgttcagggactccgtcttcaacgtcaccgggctcgtcggactcgtcatcggtgtcgcgctgttcggcgcggccagctatctgccgaccttcctccagatggtcgacggcgcctcggccaccgagtccggactgctgatgctgcccatgatggcggggatcgtcggcgcctcgatcatcgccgggcagctcatcagccacaccggccggtaccggatgtggccgatcctcggcagcgtcctggccgccgtcggcatgtggctgctctcccggctcgaagcggacacgccccggctccagtacagcatctggatggccgtcctcggcgccggcatcggcatggtgatgccggtcctggtcctcgccgtgcagaactcggtgcgccccgccgacctgggcaccgcgaccagcgccaacaactacttccggcagatcggcggcagcgtcggcgccgccgtgttcggcacactgttcgcccatcggctcgccgacgcgctggaggaacgccttcccacgcgcgcgggcgcccggcttcccgaccccgagtccctcaccccgcaactcgtccacgcgcttcccccggacctgcgcgacggctatgtcgccgcctacgccgacgccatgccgcgcatcttcctcttcctcgtgccggtgctcgtcctgggcctgctcatcgctttctttctcaaggagaaaccactggtgtcccacaacgcccccgccgagcccgtctccctcgcccaggtcccgcaggcgcgttcgccgtacgccgccggtgtgcccgtctgcggcaccgtgcagcaccccgacggcaccgtcgtgccgcgcgccgcgctcaccctcatcgacgtcgcggggcagcagatcggacggggggccagcggcgaggacggacggtacgcgctgtccacgcccggatcagggtcgtacgtcctgatcgccgcggcgggcggccaccagccgcaggccgtgtcggtgaccgtcggcgagcgtccggtggaactggacgtcgtgctcggcggcgcgggcaggctcgccgggagcgtgctcacggcggacggcacccccgtgcgcgaggccatcgtgaccctcaccaacgtccacggcgaggtggtctccaccacccgcagcggacgcgaagggggctacgtcatcaccgagttggtggccggggagtacaccctggccgccagcgcccccgcgttccgtccggccgcgctccccgtcaccgtgcaggccgcgcgtgagacccggcaggacgtggaactggccggcggtgcggtgctgcggggcacggtacgggccgggggtgggcggcccgtcgaggacgcgcgggtgacgctgctggacgcggcgggcaacgtcgtcgacacgctcaccacgggcggtgacggaacgttccggttcgtcgatctctcgtcgggggagtacacggtcatcgcggcgggctatccgccggtggccaccgtgctccaggtcgccgggggcggcaggacggaacgcgacttgcagttggggcacgaggac

SEQ ID NO: 1893 - DNA, 441 bp, Streptomyces avermitilis
  CDS (1)..(441)
atggcgcaggtcgaagccacgacggagcggatcatcgcggcggacgcggagaaggtgttcgacgccctcgccgactacagcgacgcccgcgcgaaggtgctgccggagcacttcagcgagtacgaggtgcgcgagggcggcgacggcgagggcaccctcgtccactggaagctccaggccaccagcaagcgcgtccgcgactgcctcctcgaggtgaccgagccgaccgacggcgagctcgtcgagaaggaccgcaactcctcgatggtcaccacctggcgggtcaccccggccggcgagggcaagtcccgcgtcgtcgtcaccagcgtgtggaacggcgccggcggcatcggcggcttcttcgagaggaccttcgcgcccaagggcctcgcccggatctacgacgcggaactcgccaacctcgccgccgcgatggagaag

SEQ ID NO: 1894 - DNA, 1038 bp, Streptomyces avermitilis
  CDS (1)..(1038)
atgcgctgggagaacctcacagcgggccccgccggggaccccgcccgagacgccgcgctgttcggcgcggacgcggtgaccacccgtaccttcgacaccccggagttccgcggcatcaccttccacgagatccgggcccgctcgatcgtgaaccgggtgccgggggcctcgcgcatgccgttcgagtggacggtgaacccctatcgaggctgcacacacgcgtgcgtgtactgcttcgcccgcaagacgcacagctatctggacctcgacacgggtctcggcttcgactcgcagatcgtggtcaagatcaacgcgccggacctgctgcgccgccagctcgcctcacgccgctggcacggggagcacgtcgcgatgggcaccaatgtcgactgctaccagcgggccgagggccgctaccagctcatgcccggcatcatcgcggccctgcgcgaccacgcgaaccccttctcgatcctcaccaagggcacgctgatcctgcgcgacctcgacctcctcgagcaggccgccgaggtcaccgacgtcggcatctccgtgtccgtcggcttcaccgaccacgagctgtggcgcaccgtcgaaccgggcaccccggccccggagcgccgcctggacgtcgtgcgcaccctgagcgagcacggcatcggctgcggcgtcctgatggccccggtcatccccttcctgagcgatcaaccggcccaactccgcgccaccgtacgggcgatcgccgccgccggggccacctccgtcacgcccctggtgctgcatctgcggcccggcgcccgggagtggttcatggcctggctcgagcaccatcacccgtacctcgtgcgccgctacgagcgcctgtacgcggagggcgcgtacgcccccaagtggtaccagcgccggatcacccgtcaggtccacgaactggcccaggagtacggcatcggccccacgcgcgcggggatgccgcgccggatacccgaacccgaacccgagacgccgccgacgcccgagccgacgcagctcacgctgctc

SEQ ID NO: 1895 - DNA, 1575 bp, Streptomyces avermitilis
  CDS (1)..(1575)
ttgagaaaacgcgcagccgtgctgtgcggtgccgccgtgatggtggccgggatgctcaccaccgcacctgccgacgcgagtgctccacgcaccgcgcggaccgcatccgccgcgaagctcacctggaagaagtgcggcaccgccgactttccgaaactgcagtgcacgtccctgaaggtgccgctcgaccacgcgcacccgggcgggcggaagatcacgctcgccctgtcccgggtcccgcacaccgcgaagacgtaccagggcccgctgctggtcaaccccggcggccccggcggcagcggtctcgcgctcgccggattcgtcgcgtcctcgctgcccaaggcggtcgcggcgcagtacgacgtgatcggcttcgacccgcggggcgtgggcagcagcaagccggccctggactgcaagccggggcacttcaagccggtacgcccggactccgtgcccagcactcccgccctggagaaggccaacgtctcccgtgcgacgtccttcgccaaggcgtgcggcaccaagtacgcgagcctgctgccgtacctcgacaccatcagcgccgcacgcgacctggactcgatccgccagtcgctcgacgccaagaagatcaactacttgggctactcgtacggcacctacctcggcgccgtctacgcgaagctctacccggaccgggtacgccggctggtcctcgactcgatcgtcgatcccacgggcgtctggtacgacgacaacatcgcgcaggactacgccttcaacgaccgccatctggcgttcctggcgtgggtcgccaagcacaacaagacgtacaagctcggcaccgacccggccaaggtcggggccaagtggtacgcgatgcgggcggcgctcgccaagaagccggcccagaagaaggtgggcgcctccgagctggaggacaccttcatccccggcggctactacaacggctactggccccacctcgccgaggcgttcgcggcctatgtgaacgacaagaactccgacccgttggtgaaggcgtacgcgaacttcggcgcggtcgacgccgcgggagacaacggctacagcgtctacacctcggtgcagtgccgtgacgtgtcctggccgcgcgactggaaccagtggcgcaaggacaactgggcggtgtacgagaaggcgccgttcatggcctggaacaacgcctggtacaacgcgccgtgcgcgttctggccgacgagttcggcacgtccggtggacctgtccaacaacgcgctgccgccggcgctgctcttccaggcgacgaacgacgcggccaccccgtacgagggcggcgtgaccgtccatcacctcctgcgcggctccagcctggtggtcgagcagggcggcgggaaccacggcatcacgctgagcgggaacgcctgtctggacaagcacctggcgacatatctcaccaacggaaaggtgccgcacggcggcggcgacatcgacgcggtgtgcaagaaggtgcccgacccggcgccgtcgagcaccaaggcgttgccctccgcggcccgcggctcggcgctgcacgggctgctcggcttccgcggc

SEQ ID NO: 1896 - DNA, 633 bp, Streptomyces avermitilis
  CDS (1)..(633)
gtgaccggcgtcctggtccgggagatgaccctcgacgactgtcaccacgtctccacgatccgcatccgcggctggcagaccgcctacgcggggctgataccccagtcgtacctcgacgcgctcgacctcgacgcggacgccgagcggcgccgcacccatctggtcaagggcgacggcacgatggtgaacctggtcgccgagcgggccggtgaagtcgtcggctgggcctgccacgggccgtaccgggacggtgaagtccgcacgcgggacgccgagttgtacgcgatctatgtacgccccgatgaggtgggcaagggtgtcgggcaggctctgctgcgggagtcgacgcggcggtgcgcgtccgcgggacaccggcacatgttcctgtgggtgctgaaggagaacgccccggcgcggcgcttctacgagcgctccggattcgccccggacggcgccgaggagcccttcgaggtgcacggcgtcacggtgcccgaggtgcggtacgtccgcgccctcggcgctccccaccgaggcgggcgcggtcccgctactcccgaggcgcccgcggccccggcagccgcttcagtgcgcccgccgccgcctgtgcgagcgccggatgcgcgagggcgtccg

SEQ ID NO: 1897 - DNA, 606 bp, Streptomyces avermitilis
  CDS (1)..(606)
ttgcctaggctcggcctcatggacgaagagttgcgatcactcacggagcgtcgtctacggaacgaggcgggggcctcggtggcctacgagcgtctgctggcgaccggcgatgtggaggagctggccgccgcgctcaccgagccgggacagccgctgtgggcgcgggaactggtcgccttccggctcggtgtggccggggaccggcgggcgttcgaggcgctcgtcctgctgctcaaccaccgcgatccgcagcgctgcgcgtccgccgcgtacgccctggcccggctcgacgatccgcgcaccgcccgggcggccgccgccctcgccaccaatgaactgcgcgtcgcctacgcgctccatcccgtgcggctgctggtggagttgcgggcccccgaggcagtgcccgcgctgatcaccacgctccggcggaggctgcggccgcacgacccgtaccgccgggtcgccctcgcgtgtgtggaggggctcggcgcgctgggggacgtccgggcgcgggaggtgctcacggacgccctcgcgcatccggcgctcgcacaggcggcggcgggcgcactgaagcggctgccggggccgcgggcgcctcgggag

SEQ ID NO: 1898 - DNA, 1803 bp, Streptomyces avermitilis
  CDS (1)..(1803)
atggccactcccccgtttgacccctctctgtccccgctgaagaccgttgccgtgatcggcctcggcacgatgggcaccggcatcgccgaggtcctcgcccgggccggccgcgaggtcgtcggcatcgacatcagcgaggccgccgccggccacgccgtcaccgccctggaggcctcgaccgcccgcgccgtgcagcgtgagcggctgaccgagcaggagcgcggcgacatcctcgcccgcttccgcaccttcaccgaccttcaggccgcggccgacgccgacctggtcatcgaggtgaccccggagtcgtacgagatcaagcagcaggtcctccgcgccctcgacggcatcgtgcgtgcggacaccatcctcgccaccggcaccaacgccctctcggtcacgcgtctcgcggccgactcggcgcaccccgagcgcgtcctcgggctgcacttcttcaacccggcgcccgcgatgaagctggtcgaggtcgtctcgtccgtgctgaccgcgcccaccgccgtcgccgcggtcaccaacctcgcgctcgacctcggcaaggagcccgtcgcggtcggcgaccgccccggcttcgtcgccgacgggctgctgttcggctacctcaaccaggccgccgcgatgtacgaggcgaagtacgcctcccgcgaggacatcgacgccgcgatgaagctgggctgcggactgcccatgggcccgctcgccctgctcgacctgatcggcgtcgacaccgcgcgcaccgtcctggaggccatgtacgccgagtcccgcgaccgcctgcacgcccccgcgccgatcctcaagcagctcagcgaggcgggcctgaccggccgcaagtcgggacgcggcttctactcgtacgacgagcccggcagcgccaccgtcgtgcgggacgcgctgacgccgctctccggaggacccggggagcagggccgtacggtccgctcggtcggcgtcgccggctccggcaccatggcgtccggcatcgccgaggtcttcgcgaaggccgggtacgaggtcgtcctcgccgcccgcagcgaggagaaggcgcagacggccaaggcccggatcggcaagtccctgtcgcgttccgtcgacaagggccggctcacggccgaggccgcggccgagaccctggaccggatcaccccggcgggctcgtacgacgccttcgcggacgtcgatctcgccctggaggccgtcgccgaggacctggagatcaagcagcagctgttcgccacgttcgacaaggtctgcaagcccggcgcgatcctcgccaccaccacctcctcgctgcccgtcgtcgcctgcgcccgtgccacctcgcgcccgcaggacgtgatcggcatgcacttcttcaacccggctccggcgatgaagctggtcgaggtggtccgcacggtcctgaccggtgacgatgtgcacgccacggtccgcgaggtctgcgccaagatccgcaagcaccccgtggactgcggcgaccgggccggattcatcgtgaacgcgctgctgttcccgtacctgaacaacgcgatcaagatggtgcaggagcactacgcgacgctcgacgacatcgacgccgcgatgaagctgggcggcgggtacccgatgggacccttcgaactcctggacgtcgtcggcctcgacgtctccctggccatcgagaaggtcctgcaccgcgagttccgcgacccgggcctggccccggcgccgctcctggagcacctggtggccgcgggctgcctcggccgcaagaccggccgtggtttccgcgaatatgccaagcgc

SEQ ID NO: 1899 - DNA, 813 bp, Streptomyces avermitilis
  CDS (1)..(813)
atgtcccagcccgccaggtcctcacgtaccgcagccacgcccgacgcgccggaaagtgccgcgggcagtcgtgctgccgcccagcggctcaagatgcgccgcgaactggcggccgcggcgatggaactgttcgcgaccaaggggtacgaggcgaccaccgtcgacgagatcgcggcggccgcgggggtcgcgcggcgcacgttcttccgccacttccgctccaaggaagaggcgatcttccccgaccacgacgacaccctggtccgggcggaggcggtgctcaacgccgcgcccgcgcacgagcatccgctcgacacggtgtgccgtggcatcaaggaagtcatgaagatgtacgcggcccggcccgagatctccgtgtcgcgctacaagctcacccgcgaggtcccgacgctgcgcgaggcggagatcgcgtcggtcgcccgctacgagcggctcttcacacgctatctgctcggccacttcgacgagcacgcgcacgacgacgacgcgaacgacgatccgctgctggcggaggtcgccgcgtcggcggtcgtcaccgcgcacaaccatgtactgcggcggtggctgcgggcgggcggtcagggcgatgtcgaggcccagctcgaccacgccttcgccatcgtccgcaagacgttcggcaccgggatcggcgccggacgggagaccgcgccgccccggtcggcgccggcgtcctcgttcaccgacggggacgtgctggtgaccgtggcccgcgtcgacgccccgctggatcaggtgatgcgcaccatcgagcaggcgctcaaggaacggtcg

SEQ ID NO: 1900 - DNA, 1335 bp, Streptomyces avermitilis
  CDS (1)..(1335)
gtgaaggaaatcctggacgcgattcagtcccagacggccacgtctgccgacttcgccgcactgccgctccccgactcgtaccgcgcgatcaccgtgcacaaggacgagacggagatgttcgccgggctcagcacccgcgacaaggacccccgcaagtcgatccacctggacgacgtgccggtgccggagctcggccccggcgaggccctggtggccgtcatggcgtcctccgtgaactacaactcggtctggacgtcgatcttcgagccggtgtcgaccttcaacttcctggagcgctacgggcggctcagcgatctcagcaagcgccacgacctgccgtaccacatcatcggttctgacctcgcgggcgtcgtcctgcgcaccggcccgggagtcaactcctggaagcccggcgacgaggtcgtcgcgcactgtctctcggtcgagctggagtcgtccgacggccacaacgacacgatgctcgaccccgagcagcgcatctggggcttcgagaccaacttcggcgggctcgccgagatcgcgctcgtcaagtccaaccagctgatgccgaagccggaccacctcagctgggaggaggccgccgctccgggcctggtgaactcgaccgcgtaccggcagctcgtctcccgcaacggcgccggcatgaagcagggcgacaacgtcctcatctggggcgcgagcggtggactgggctcgtacgccacgcagttcgcgctcgccggcggcgccaacccgatctgcgtcgtctccagcgagcagaaggcggacatctgccgctcgatgggcgccgaggcgatcatcgaccgcaacgccgagggctacaagttctggaaggacgagaccacccaggacccgaaggagtggaagcgcttcggcaagcgcatccgcgagttcaccggcggcgaggacatcgacatcgtcttcgagcaccccggccgcgagaccttcggcgcctcggtctacgtcacccgcaagggcggcaccatcaccacctgcgcctcgacctcgggctacatgcacgagtacgacaaccgctacctgtggatgtcgctgaagcggatcatcggctcgcacttcgcgaactaccgcgaggcctgggaggccaaccgcctcgtcgccaagggcaagatccaccccacgctctccaaggtctactccctggaggacaccgggcaggccgcctacgacgtgcaccgcaacctccaccagggcaaggtcggcgtgctcgccctcgcgccccgcgagggcctgggcgtgcgcgacgaggagaagcgcgcgcagcacatcgacgccatcaaccgcttccggaacatc

SEQ ID NO: 1901 - DNA, 2046 bp, Streptomyces avermitilis
  CDS (1)..(2046)
atgactgagcgtcagaccagcgacgggcggcgggagaaggaccggccgtggctcatgcgcacgtacgccggccactccaccgccgaggcgtccaacgagctgtaccggcgcaacctcgccaagggccagaccggcctgtcggtcgcgttcgacctgccgacacagaccggctacgaccccgaccacatcctcgcccgcggcgaggtcggccgggtcggagtccccgtctcgcacctcggtgacatgcgccggctgttccaggacatccccctggagcagatgaacacctcgatgaccatcaacgccaccgccatgtggctgctggcgctctatcaggtcgtcgccgaagagcagggtgcggacatcaccaagctccaggggacgacccagaacgacatcgtgaaggagtacctgtcgcggggcacgcatgtgttcccgccgggtccttcgctccgtctgacgacggacatgatctgctacacggtcaaccacatccccaagtggaaccccatcaacatctgtagctaccacctacaggaggcgggggccacaccggtccaggagatctcgtacgcgatgtccaccgcgatcgccgtgctcgacgcggtcttcgcgtcggggcagatccccgaggaccgcaagggcgatgtcgtcgcccgtatctccttcttcgtgaacgcgggcgtccgcttcgtcgaggagatgtgcaagatgcgcgcgttcgggcggatctgggatgagatcacgcgtaagcggtacggcatcgaggaccccaagcagcggcgcttccggtacggcgtgcaggtcaactccctcggtctgacggaggcgcagccggagaacaacatccagcggatcgtcctcgagatgctggccgtgacgctctcgaaggacgcacgcgcgcgtgccgtacagctgcccgcctggaacgaggcgctgggcctgccgaggccctgggaccagcagtggtcgctgcgtatgcagcaggtgctcgcctacgagagcgacctgctggagtacgcggacatattcgagggctcgcacgtcatcgaggcgaaggtccaggagctggtcgaggagtcgctggccgagatcgaccggatccaggagatgggcggcgcgatggccgccgtcgagtccggctacctcaagtcccagctcgtcgcctcgcacgcggagcgccgggcccggatcgagtcgggccgggagaagatcgtcggcgtcaacatcttcgagtcgaccgagccgaacccgctgacggccgacctggacgcggcgatccagacggtcgacccggcggtcgaggcccgggtgatcgcggcgctggggacctggcgcgacacccgctaccagccgcccttcaaccacccgcgcccgtgcaaggcgctggagaagctgaaggaagccgccaagggcaccggcaacctcatggaggccaccctggagtgcgcccgcgccggggccacgaccggcgagtgggccggggcgctgcgcgaggtgttcggcgagttccgcgcgccgaccggtgtgtcctccgcgccggtcgccgtcaccgccgaggcgggcaccgcgctcgcgctggtccgtcagaaggtggagctgaccgcgaaggacatgggcgtcggcaagctccgcttcctggtgggcaagccgggcctggacgggcactccaacggcgccgagcagatcgccgtgcgggcccgtgacgccgggttcgaggtggtctaccagggcatccggctgacgcccgagcagatcgtggacgcggccctggccgaggacgtgcacggcgtcggcctgtccatcctgtccggttcgcacgcgcagctcgtgcccgacgttctcgaccggctccgcgaggccggcgcgaccgacattccggtgatcgcgggcgggatcatcccgaacgcggacgccgaacagctgcgggccgcgggagtggccgcggtcttcaccccgaaggacttcgacatcaccggaatcatcggccgtatcgtcgacgagatccggaaagcgaacaagctcgaccccctggaggtccccgca

SEQ ID NO: 1902 - DNA, 963 bp, Streptomyces avermitilis
  CDS (1)..(963)
atgaccacgcccgtcaaccgcctgcgcccgcgacgctcctgcctcgcggtgccgggaagcaacccccgcttcctggagaaggcccagggcctccccgccgaccaggtcttcctcgacctggaggacgcctgcgccccgctcgccaagcccgaggcgcggcacaccatcgtgaagttcctcaacgagggtgactggacgggcaagacgcgggtcgtgcgcgtcaacgactggacgacgcagtggacgtaccgggatgtcgtcacggtcgtcgagggcgcgggccagaacctcgactgcatcatgctgccgaaggtccaggacgcccagcaggtcgtcgcgctcgacctcctgctcacccagatcgagaagacgatgggcttcgaggtcggcaagatcggcatcgaggcgcagatcgagaacgcgcagggcctgaacaacgtcaacgagatcgcgcaggcctcgccgcgcgtcgagacgatcatcttcggcccggccgacttcatggcgtcgatcaacatgaagtcgctggtcgtgggcgagcagccgcccggctacccggcggacgcctaccactacatcctgatgaagatcctgatggccgcccgcgccaacaacctccaggcgatcgacggcccctacctccagatccgcaacatcgacggctaccgcgcggtcgcccagcgcgccgcggccctcggtttcgacggcaagtgggtgctgcacccgggccaggtcgaggcgtccaacgagatcttctccccctcccaggaggactacgaccacgccgagctgatcctggacgcgtacgacttctacacgtccgaggcgggcggcaagaagggctcggcgatgctcggcgacgagatgatcgacgaggccagccgcaagatggcgctggtcatctcgggcaagggccgggccgccggcatgcagcgcacgtccaagttcgaagccccggaggcc

SEQ ID NO: 1903 - DNA, 525 bp, Streptomyces avermitilis
  CDS (1)..(525)
atgcagttcggacgcacgtacgaggagttcgaggtcggcgcggtctacaagcactggcccggaaagacggtcacggagtacgacgaccacctcttctgtctgctgaccatgaaccaccacccgctccacatggacaccaactatgcggagaagacgacggacttcgggaagaacgtcgtcgtcgggaactacatctactcgctgctgctcggcatgtcggtccccgacgtctcgggcaaggcgatcgccaacctggaggtcgagtcgctgaagcacgtggcgccgaccttccacggcgacacgatctacggcgagaccacggtcctcgacaagacaccctccaggtccaagtcggaccgcgggatcgtctacgtcgagaccaagggctacaagcaggacggcacgctggtctgcgtgttccgccgcaaggtgatggtccccaccgagacgtacatcaaggagcgcggcggcgagcagcccggccgcccggagctcaccgcacctgcggagaagaagacggagaag

SEQ ID NO: 1904 - DNA, 1203 bp, Streptomyces avermitilis
  CDS (1)..(1203)
atggcgcgactcgcccagaccgccggtctgaccgacatccagcaggagatcctctccaccgtccgcgacttcgtggacaaggagatcatcccggtcgccaccgagctggagcaccgcgacgagtacccccagcagatcgtcgacggcctcaaggaactgggcctgttcggcctgatgatcccggaggagtacgggggcctgggcgagtccctcctcacctacgcgctctgcgtcgaggagatcgcccgtggctggatgtcggtgtccggcatcatcaacacgcacttcatcgtggcgtacatgctcaagcagcacggcactcaggagcagaaggaccacttcctgccccggatggcgctcggcgaggtgcggggcgcgttctccatgtcggagccggctcttggttcggatgtgtccgcgatctcgtccaaggcggtcaaggacggcgacgagtacgtcctgaacggccagaagatgtggctgacgaacggcggctcgtcgaatctcgtggcggtcctcgtccgaagtgacgaaggacaccccgagggcacggcgccccacaagtcgatgacgaccttcctggtcgagaaggagcccggcttcggagaggtccgccccggcctcaccattcccgggaagatcgacaagatgggttacaagggggtcgacaccaccgagctgattatggacggactacgcgttccggccaatcgggtactcggaggcacgaccggccgagggttttaccaaatgatggacggagtggaagtcggccgcgtgaatgtagcggcccgtggctgcggtgtggcgcagcgtgctttcgaactcggcgtctcatatgcccagcagcgtcacactttcggcaagccgatcgcccagcaccaggccatccagttcaagctcgcggagatggctaccaaggtcgaggccgcccatgcaatgatggtgaacgcggcccgcaaaaaggattccggggaacgaaacgacctcgaagcagggatggcgaagtacctcgcgtccgaatactgcaaggaagtcgtggaggacgctttccggattcacggcggttacggcttctccaaggagtacgagatcgagcgcctctaccgggaggccccgatgctgctgatcggtgaagggaccgccgaaatccagaaaatgatcatcggacgcaggctgctcgaagagtatcgactccagggc

SEQ ID NO: 1905 - DNA, 645 bp, Streptomyces avermitilis
  CDS (1)..(645)
atgccccacagccaaacctctgcacctcgcggccgggtccgcctcgcgcgcggagcatcgccgtggcttctcccgaccgttgccaccgcagcactcagcctggtccgggcgcgccgctccggcgccgccaaggccgtggccgtacccgccaccgcactggcggcgggcatgctgtggttcttccgcgaccccgagcgcgagatcactcagggccgggtcatctcgcccgccgacggcgtcgtccagagcatcatgccctggaaggacgggcgtacacgcgtcgcgatcttcatgagcccgctcaacgtccacgtcaaccgcgcgccgctgtccggcacggtgacgtctgtcgagcacatcccgggtgggttcgttccggcgttcaacaaggagagcgagaacaacgaacgcgtcgtctggcacttcgacaccgagctcggtgacatcgagatgatccagatcgccggcgcggtcgctcgccgcatcgtcccgtacgtgccgcagggcaccaaggtcgagcagggcgaccggattggcctgatccgcttcggctcgcgcgtcgacatctacctccccgagggtgtcgacgtcgacgtggaggtcggtcagaagaccgtggctggggtgactcgaattgaccgtgat

SEQ ID NO: 1906 - DNA, 780 bp, Streptomyces avermitilis
  CDS (1)..(780)
atgcccctctccctccgcctctcaatagcggacacgctgactctcggcaacgccacgtgcggcttcatggcggtgtacttcaccaccaccggcatcctgatcccgcacctcacgggcagccaggagtcgggcatggcccggcacagcgcggccacggcggtcatcctgatgctgtgcgcggcggtcttcgacctcttcgacggcctcgtcgcccgcaagctgcgctcctcacccatgggcgcggagctggacaacctctccgacctgatcagcttcggcctggcaccggcgtacttcgtgctggtctacggcatggtcgcggacgacgcgcaccagagagtggcggcggtgggggccatcgtggtcctcctcgcggtcgtcctacgcctcgcgcgcttctcctgcgtgacggtcaaggacggcacgttccagggcatgccctcgccgttcggcgcgctgacggtcgtctccatcgtgctcctcgagctgccgttcgtcgccacgctcatggcgatcatcggcaccgcctggctgatggtgagccgagtcgagtacccgaagccgcggggtcgtctcgcggtggcgatgctctcctggatcgtgctgtcgatgggcctgctggcggcgtgggccttcgacgcccccagcggccagctgctcctccagacgggctgcgcgctccagctggtcatgggcgcggtgatccccctcttcgcgacggcgcggcgggtgaacaacttccgcgacaaccgccgtgaggcgcgtgccgcgcagttgccg

SEQ ID NO: 1907 - DNA, 1149 bp, Streptomyces avermitilis
  CDS (1)..(1149)
gtggcggacgctggagtcaacgggacccgcagggtgctcatcgccgcggacaagttcaaggggtcgctgaccgccgtacaggtcgcggagcgtgtgacggccggcctgcgccgggtcgcgcccgccgtggaggtcgaggcgctgcctgtggccgacggcggcgacgggaccgtggacgcggcggtcgcggccggattcgagcggcgtgcggtgcgggtcgccgggccgctcggcgaagaggtcacggcggcgttcgcgctgcgcggcggcaccgcggtcgtggagatggcggaggcgagcgggctgcaacggctgcccaaaggtgtcttcgcgccgctcacggcgtcgacgtacgggtccggggaactgctgcgggccgcgctggacgccggggcgcggaccatcgtgttcggggtcggcggcagcgcgacgaccgacggcggggcgggcatgctggccgcgctcggtgcgcgcttcgtggacgcggagggcgagccggtggctcccgggggcggcggactgagcgagctcgccctggccgatctctcgggcctcgacccccgcctcgcggagatcgagctggtcctcgcgagcgacgtcgacaatccgctgaccgggccgaagggcgcacccgcggtgtacgggccgcagaagggcgccgcaccggacgacgtggccacgctggacgcggcgctggcgcacttcgcggcggtgctggagaaggcgatcgggccgaaggccgcggagtacgccgccgcgcccggtgcgggtgccgcgggcggcatcgggtacggggcgctggtgctcggcgccgggttccggcccggcatcgaggtgatgctggacgtgctcggcttcgcgccggcgctggaccgcgccacgctcgtgatcaccggcgaggggtcgctggacgagcagacgctgcacgggaaggcgccggcgggtgtggccgcggcagctcgggcggcgggcaaggaggtcgtcgcggtgtgcgggcggctcgccctgccgccgcaggagctggggcgggccggcatccggcgggcgtacccgctgacggagtccgagccggacatcgcgaagtgcatcgaggacgcggggccgatcctggagcgggtcgcggagaacatcgcccgggacttcctggtc

SEQ ID NO: 1908 - DNA, 1131 bp, Streptomyces avermitilis
  CDS (1)..(1131)
atgacccctgtgggcaccgaaccggatctcgccgaccgcgtcctcggcggctggctgggccggatcgcgggcaacatgctcggcaaaccggtcgagcagggcgaccactggacgcgggagcgcatcgaccgctatctgcggcaggccggggccctgccgctcaccgactatctccccgagcccgtcggcccgggcgccggcgacgagttcgcgctgcgccccgagtggcgccagtgcgtacgcggccgtatccacggcagctgccgggacgacgacgtggactacgcgatcctcggcctccacctcctcgagacgcacggcttcggcttcagcacggagcaggtgggcgacctatggctgctgcggctgccgtacctccagacgttcacggcggaacgggcggcctaccgcaacctcgcgggcggcatcagaccaccgctcaccgcgacgtacgagaacccgtaccaggagtggatcggcgccttgatccgcgccgacatctacggctggacgtgccccggcgctccttggcgcgcggcctcgctggcccgccgggacgccgtgctctcccacaccggcaacggggtgtacggcgcgatgtgggcggcggcactgatctcggcggcgttcacggcacccggggtgcgggacgccctggacacggccctgacggtcatccccgcgagcagccgcctcgcccgcatcgtgcgccgcgtcgcctcgctgcacgagacccggctgagctgggaggacacgctcagcacggtggccgaggagacggcggggctcggctggatccatacggtcccgaacgccgcggtcctcacggcggggctcctgtacggcgacggcgacttcacccgcacgatcacactgacggtgcgcggcggcctggacaccgactcgaacggcgcgacggcgggctcggtggcgggcgtcctcagcggggcggccgcgatcccgccccagtggaaggacccgctggaggacacggtccgcagtgcggtgttcggcttcgacggggtacggatcagcgaactggccgcacgcacgctcgcactggcggagacggaaccggagacgggggccggcccggagacgggggccgccgggaccggtctggacactccg

SEQ ID NO: 1909 - DNA, 492 bp, Streptomyces avermitilis
  CDS (1)..(492)
gtgaccactccacaagacttcgccacgtacatcgcgggcctcccccgcgtcctcgccggtgccgccgtgctcttccgtgacgccacgggccgggtgctgctggtcgagcccagctaccgggagggctgggcgctgccgggcggcacgatcgagtcggacgacggggagacaccgaggcagggcgcacgacgggagacggccgaggagatcggactcgacgtcgagccgggccggctcctggcggtggactgggtgcccggaacggcccgcccacccctggtggcgtacctgtacgacggcggcgttctcggcgaggaggacctcaaggcgatccgcctccaggaggaggaactgctgtcctggcgcctcgtgccgcgggaagagcttccggaatacctttcgggcgccctgggccgtcgcgtcctggccggactcgacgcggtggccgagggtgcggggacggcggagctggagaacggacaccgggtgggc

SEQ ID NO: 1910 - DNA, 438 bp, Streptomyces avermitilis
  CDS (1)..(438)
atgaccacgactggaatgcagcagcggcacgggaccggaagtggcagcggaggagcctgggtgtccggctggaccgcattcgccggggccatgatgatcctcggcgggacgatggcggtattcgaaggaatctccgccatcgtccacgacgatgtcttcatcgtcaccaacagctactcctacaacttcaacctgacgggttggggctggatccacctcatcctcggcattctggtcttcttcgccggcatcgccgtgttccgtggtgagctgtgggcacgcatcaccggaatcgtgctggccggcctgtcgatgatcgccaacttcatatggctgccgcactcccccttctgggccatcgtgctgatcgtcgtggatgccttcgtcatctgggcgctgtgcgtcggaaccgaccgggacgccgcccgcaccaccgcc

SEQ ID NO: 1911 - DNA, 1032 bp, Streptomyces avermitilis
  CDS (1)..(1032)
gtggccgcgaacgcctggatgaacaccccgcgcggcttcacgctcgacgcgtccggcaaccccgtgaacgtcgacgtgcggcgggcggtcttcacgccgatgctcggccccgagtactggcacttcgtggtcggggtgatcctcaccgccgggtatgtcgtcgccggggtgtacgcggtcgggctgctgtggggccgccgggaccgctaccaccggctcggcttcaccgtgccgttctccgtcgccgcgatcctcacccccgtgcagttcatcctcggggactcgatcgcccgctccgtcttccacaagcagccggtgaagttcgcggccaccgagatcgtctggaagaccggcacccatatgccggagtacatgttcgggcgtctgcgttccgacgggtcgatctccggcggcatcaagatcccccagctggactcgatcctcgccggattcagcgtgaacaccaaggtgacgggcctgtcgtcggttcccgcgagcgaccgcccgaccgcgactcaggccacgatcgcccactgggcgttcgacatcatggtgaccatcgggagcctgctcgtcctgctcgccctctggtacggctggtgttggctgcgccaccgtggcctgcccaggtcaccgtggttcttccggtgtgccgctgtcgccggcgccgcctgcctgctgacggtggagtgcggctggatcacgaccgaagtgggccgtcagccctggatcgtctaccagaacatgcgggtctcggaggcggtgacggacacccgtgcctcgtctctgtgggcgatgctcggcatcgtcgtggtggtctacgtactcgtcctcggtgccttcctggccgtcctcctgaagatgagcagccggtggcggctggccgacgaggacgctctcgcgggagccgccgccgaggatctggaggacgacaccccctacgggccccgcccgttgtccacgaccggaagcgggcacagaggcgggaacaacgacggcggcagcggcagggacacggacaggggcggcgaa

SEQ ID NO: 1912 - DNA, 1047 bp, Streptomyces avermitilis
  CDS (1)..(1047)
atgatcgaggacgtcgtcgcctgggtgctgctggccgtggtggccgcgtacgcgtgcgccggcggcgcggactacggcgccggattctgggacctcgtcgcgggcggccccgaacgcggcaaacgccccaggtggctcatcgaccacgccatggaaccggtgtgggagaccaacaacgtctggctcatcttcatcctggtcatcatgtggacgggcttcccggtcctgttccagacggtcttcacggccatgtggctcccgctggcactcgcggccgtgggactcgtcctgcgcggcgccggcttcgccctgcgcaagcccacccggcgcctcgcccggcgcaggatcgtcggcgccgtcttcgccctctcctcgcttcttacgcccttcttcctcggagcggccgtcgggggtctcgccacgggccgggtggctccgggcacgaaggcgtccgccgacgcctgggccaacgggacgtccgtgatcgccggactgctcaccatcgccgcgaccgccttcctcggagcggtgttcctcaccgccgacgcccgccgcttcgatgccgccgacctcgtcggatacttccggctgcgggcctggtgcagcctcggcgtcatcgccgtactggcggtcgtcgggctcgccgtgacccacgacgacgcgcgctacgtccacgacgggctgaccggcggaatcggtctcgccctcgtcctggtcgccgtcgtcagcgcgttggccaccgccgggctgctgtaccgaacggcgacgggatgggcgaggatcaccgcggtcggcagcgtggccctcgtcgtcgtggcgtgggggctggcccagcggccctatctcatccccacctcactgaccgtgtccgaggcggccggcgcgtcgacgacgctgcgctggctgatgctggtcacggtcatcgcggtggtgctcgtcggaccgcccctggtcctgctctaccggctggacacccgcggagccctccagcccctcacggacgcggacctgcggcggacggcgtccggccgggatcccgagaacccg

SEQ ID NO: 1913 - DNA, 564 bp, Streptomyces avermitilis
  CDS (1)..(564)
gtgaccggggccggggccggggccgggatccaggccgccgaggagtcgccgatcgtgttggtcgtgggggtgacaggctccgggaagaccaccgtcggcaaggccgtcgccgagcagctcggactggagttcgtcgagggcgacgacttccatcccgccgcgaacatcgccaagatgaccgccggccacgcactggacgacgccgaccgcgagccctggctacgtgccctcgccgaccgcatccggcactccgccgcggcgggcgaggggctggtcgtcgcctgctcggccctcaagcgcgcctaccgcgacaagctccgggcggccgcgggcccagggctgtggtgcctgtacctcgccctcgaccgggacaccgcccgggaccgcgtgtcccggcgcaccggtcacttcatgcccgcccagctggtcgactcacagttcgagacactggagccgctggaaccggacgagccgggcatgaccatggacgccacggccgccctcgcgacgatcctcacccgggtgcgggccgccgtcccgcgctccggcaggggcacggccccc

SEQ ID NO: 1914 - DNA, 453 bp, Streptomyces avermitilis
  CDS (1)..(453)
gtgagcgatgaatccgtcgaaatgggtccgatcgactatctggtcgtcgagtttcccggtaaccgaatgacgggcgagggatttcctctgctggtcgatctggtggaccgcggcatcattcgaatcctcgatctgatgtttgtcggaaaggaaaaggacggatccgtggtcggcctggagatcgccgacctcaccggcgacggagctctggacctggccgtcttcgagggcgcgtcctccggcctgctgggccaggacgacatcgaggaggcgggcgccgccctggagcccggcaactccgccggaatcctggtctacgagaacctgtgggccgcgcccttcgccaccgccctgcgacgcggcggtgcgcaactggtcgcctccgggcggatcccggtaccggccatcctggccgcgctggacgcgacggacgccgatcagccgccgacgatg

SEQ ID NO: 1915 - DNA, 1365 bp, Streptomyces avermitilis
  CDS (1)..(1365)
atgaccagcagcgcacctccaccggacccggaccagcactccgcggacccgtccggcgaccagcggctctcggcgcgggagcgcagcgagctggacaagctgcggcaccgggtgagcgccctggagggcgccgggccgtcgggggccgggccgtcgggggccgggcggcaccactggctccggtcgacgggttcggtcctgctgattctcctggcctcgctgctgtcgctgctggccgtcgtcgcggtctgggcgaacagcatcgtgcgggacacggaccgctatgtcgccacggtcgggccgctggcgggcaatccggacgtgcagaaagcgatcaccaaccgggtcaccagcgcggtcctcgcgcagatcgacgtggaggcactggtcaaggagctggagcaggcggcggcgcagcagggtgccccgccgaaggcggcccagttgctcggcgacctgagcggcccgatcacgagcggcctgaagagcctggtcagcagcaccgtccagcgggtggtctccagcagtgccttcgacacgctctgggtggacgcgaaccgctcggtccacagcgctctggacaaggccctcacgggccacgacggcggtgcggtgtccctcaagaacgatcaggtcgccatcgacgtggggccgatcgtggccaaggtcaaggaccagctggtcagtgccggcttcaagcccgccgcccggatcccggccgtgcataccgacttcgtggtgttcgcgtcgaaggacatcggcgagatcaagacgtatctgcgggtgctggagatcatcggcaactggctccccgtcatcgccgtgctgatcggcgccgtgggcgtgtacctggccgtcaaccgccgtcgggccctgatcgggatcgcgtcgggggtgttcgccgccatgctgctgctcggcgtcgcactcaccgtcgcccgggcgatctacctcgaccatctgccctccgggacgtcagacgccgccgcgggcgcggtgtacgacgcgctggtcaagttcctgcgcgcgagtgtgcgggcggtcggtgcgctcgccctcctgacggccgtcggcgcgttcctcagcggcccgtcccgggccgccgtcctcacccgtacgggctgccgcaggagcatcggcgccctgcgcgacgtcgccgtgtcggcggggctcccgctgggtgcggtcggccggttcgtacaccgttacaagcggtggatcggcggcgtgatcctggtggtcgccgcggtcgtcctgttcacctggagctatccgaccacggctgtcgtggtgtggacggtggtgatcgtgctggtggccttcgcgatccgcgagttcctggacgcgccgcctacggagcccgcc

SEQ ID NO: 1916 - DNA, 954 bp, Streptomyces avermitilis
  CDS (1)..(954)
atgatccatgtccgagcggtgtgcccgccggacctcacggaacgcaccatggccctgctgagcgcagagccgtgcgtcctgaacctggtcctgcagacgggcggcgtacgcaaccccgacggcgacgccatcgagtgcgacgtcctgaccggagccgcgaacgaggtgctgcgcggcctgcgggccctcggactggaacacgacggttccatcgtcctcgacccggtcgacatggtgttctcggagcgggcggccaggaccggggccgagcggctcggggcccggctgcgcgcaccggtgtgggagcaggtggaggccaggatccgggccgagggcaggtaccccccgagcttctacctcttcctggtcatcgccggaatcatcggcgcggtcggcatcatcaccaactcccagatcctcatcgtcgcggccatggtggtcggacccgagtacggggccatcaccagcatcgccctcgggatcgaccaccactcccggccgagaatccagcggggcctcgtggccctgctcgtgggcttcctgctggccgttgccgcgaccttcctcttcgccctcgtggtccggggctccgggttgcagccgacggccttcgagctggggatcaggcccgtctcgaatctgatcgacacccccaacttcttctcggccgtggtggcggtgctggccgggatcgtcggcatcgtctcgctcgccgaggcccggacgagcgcactgctcggcgtcttcatctcggtgaccaccattccggcgggggccgacatcggggtctcgtgcgcgttcgccagctgggacgaggcccggggttccctgttccaactgctgctcaacatcgtcgtactgatcgtggtcgggaccggcacgctcaagtgccagcgggcgatctggcggcgggtgagcgaacgccggcacgagggcgcggtcaggcgggctccg

SEQ ID NO: 1917 - DNA, 930 bp, Streptomyces avermitilis
  CDS (1)..(930)
atgcggacgcccgacgagctgagcgaggccggcttccggtcgctctaccgacatctgcgcgacacggcccccggcggcggcacacgccggggcgccctggacaccatcagcgccgaacaggtgctggcggccgtccgcgaggtgcggtcgggacgtacggtgtcgctggccgcccccgtcaacacccatgccgcgccggacgacgccgatccggccgagcaccggctcaccgctccggccgacggcgaaccggacccgaccggagtgcagttcgcgcgggaccgcatcgccatgaacattcacggcgatgtgaacagccatatcgacgcgctgtgccacgtcatctacgacggcaccctgcacggtggcataccggcggcggacgcgctgtcgccggacggggcgagcgccctgtccatcgccctggcccgcgacggcatcgtcggacgcggggtgctcctcgacatcccccagctgcacggcgtcccctggctcgaaccgggatcgcaggtgacggccgaggacctggccgccgccgaggcggggcagggggtccgggtcggccggggcgacatcctcctcgtacgggtcgggcatcgccgacggcgtgcggagctgggggcctgggacgtggccgacgctcgggccggactccatccggccgccatggagttcctggccgagcgggaggtggccgtactcggcagcgacggcaacaacgacgcggctccgagcgcggcacagggcgtcgcgttcccggtgcatgtgctcgccatccacgcgatgggactgcatctgctcgactatctgcggttcgaggacctcgtaccgctctgcgcgcgggacggccgctggtcgtttctctgcgtgatcgcccccctgcggctgcccgcggccaccggctcccccgtcaatcccctcgccatcctg

SEQ ID NO: 1918 - DNA, 1635 bp, Streptomyces avermitilis
  CDS (1)..(1635)
atgtccccttcaccgggcaggacggacgatgttccgaggacggtggccggcatgaccgacgcgcggcactacgacgtcatcatcattggcaccggtgcgggcggtggcacgctcgcccaccgactggcccccaccgggaaacggatcctcctgctcgaacgcggtgactacctgccccgcgaacgcgacaactgggaatccaccgcggtcttcgtcaagggcaaataccgcgctccggagttctggtacgacaaacacggaaaccagttcccgcccgaagtcaattactacgtcggcggcaacaccaagttctacggcgccgcgctcttccgtctgcgccccgaggacttcggcgaactccgccaccacgacggcatctcccccgcctggccgctgagctacgaggaactcgagccgtactacacgcaggccgaacacctctacctcgtccacggccggcacggcgaagacccgaccgagggtcccaccagcgcccagtacgcctacccgccggtccagcacgagccgcgcatccagcaactcagccacgacctggagaagcaggggctgcaccccttccaccttccgatcggggtgaacctcacccaggacgaccggggccgggccacccacgccagcgcctgcatccgctgcgaccgcgtcgacggcttcccctgtctggtcggcgcgaagtccgacgcgcaggtcatctgtgtcgaccccgccctggagcacgccaacgtcgagatgctcacccatgcggatgtgcggcgcctcgacacggacgcgaccggacggagtgtcacctcggtcgtcgcgacggtgggggacggggccgcttccaccgtggagttcagcgccgacatcgtggtcgtcgcctgcggcgccgtcaactccgccgtcctgctgctgcgttcggccgatgaccggcatccgcagggcctggccaacagctcgggcgtggtgggccggcactacatgcggcacaacaacctggccctgatggccgtgtccaaggaaccgaacgacaccaaattccagaagaccctggcgctgcacgactggtacctgggatccgacgactgggactaccctctcggcggcatccagatgctcggcaagtccgacgccgagcagatccacggcgaggcgccccgctgggccggggccgtcgcccccgacatgccgttcgaggtactcgcccaccacgcggtcgacttctggctgtgcggagaggacctgcccctcgccgagaaccgcgtcaccctggacggggacggcggcatccatctggcgctcgacgagaagaacaacatcgccgggctgaagcgcctgcggcacaaactacagggcatgctcagccacttgggcatgcacgagcaccatctgctgtcgcacagcatctacctgcacaagggcatgcccatcggcgccaccgcgcatcaggcgggcacggtccgcttcggccgcgaccccgccgactccgccctcgacgtcaactgcaaggcccacgacctcgacaacctctacgtcgtcgacacgagcttcttcccgagcatcggcgcggtgaatccctcgctgaccgccatcgccaacgccctgcgggtcggcgaccatctcgcggagcgactgcgg

SEQ ID NO: 1919 - DNA, 1416 bp, Streptomyces avermitilis
  CDS (1)..(1416)
gtgacggcgggccacccggccgaccacgagacccgacaccgcacgccgcgggagcgagccgcactcggcaaggccgcccggtcctccgtaccccgctccagtcacgccgagttcgcgcccccgcagaagcggcccgacccggtggacgtcgtcgacgcgcagtcggcgacgcgggtgcccgagctcgtaccgatccgctacggcaggatgaccgagtcgccgttccgcttctttcggggggccgccgccatcatggcgggggatctcgccggcactccccggtccgggttcaggacgcagctgtgcggcgacgcacacctgctgaacttccggctgctggcctctcccgagcgccgcatgatgttcgacatcaacgatttcgacgagacgctgcccggcccgtgggagtgggacgtcaagcggctgaccaccagtctcgtcatcgcgggccgggcgaacggcttcagcgccaaggagcgggccggcatcgtgcggtcgacggtgcggtcctaccgcgagtggatgcggcgcttcgccggatggggcaatctcaccgtgtggtacgcccagttcgacgaggagtgggtgcgcgcccacttcatagacgaggcgagcgcggggatccgcgacagttggtcgcaggcggtggcgaaggcacgtacccgggacagtctccacgccttcggccaactcacccacatcgtcgacgggaaggtccgcatcgccgcggatccgcccctgatcacgccgctccaggacctgcttccggatgtcgaacgcggcgcgctggagaaggagatccgccggctgatcgaacgttacggccggacccttcagtcggaccggcggattctgctggagcagtaccgggtggccgacttggcccgcaaggtggtcggggtcggcagcgtgggcacccgctgctggatcgtgctcctgctcggcagggacgacaaggatccgctgctcctccaggccaaggaggccgacgagtcggtgctggcgcccttcgccggcgcgagcggctaccggacgcagggcgagcgcgtggtctccggccagcggctcatgcaggccaccagcgacatcttcctcggctgggagcgggtcgacggcatcgacggccgccgacgagacttctacgtacggcagttgcgggactggaagggcatcgccgagcccgaggtgatggtgccggccggcatgcgggccttcggtgagctgtgcggtgccacgctggcccgcgcgcacgccaggtcgggggaccggatcgccatcgccgcgtatctgggcggcggcgatgtcttcgaccgggcgctggtgacgttcgccgagcgctacgccgaccagaacgagaaggaccaccaggcgctcgtcgacgccgtccgcacgggacgggtagcggctgaagccgcc

SEQ ID NO: 1920 - DNA, 1815 bp, Streptomyces avermitilis
  CDS (1)..(1815)
atggaacgctacccgcccatcgccgaccacgggctcgtcggggacctccagaccgcggcgctggtgtcgtcccagggcgtgatcgactggttcgcggcaccgcgtttcgactcgcccagtatcttcgcctccctgctcgaccacgacggcggcggccatttcctcctcgcgcccgagcaccccgaggggacctggaggcagctctactacccggacaccggcgtcgtggtgacccgcttcatgtcacccgacggagtcggcgagatcatcgactacatgccggtcctgccgggcccgacggcgagcgaccggcacagcctggtgcggatcgtacgctccgtgcgcggcaccgtgcgcttccgcctcgtgtgccggccgcggttcgactacgcgcgggccacccacgaactggacctgacgcccgacacggcgacgttccgggccccgggaacgaccgcgttccttcagtccaccatcccgctcgaacgggacgagcaggacgtccgcggcgccatcaccctcaacggcggagagtcggcggccgcggtgttcaccgtgtgtgcgccgggcggggaggcgccgccaccgcccaccacggagcggatcacagaagagctctgggagaacatcgcgttctggcacgggtgggtgcgcacctcgcgctaccacggccgctggacggacatggtgcaccgctccgcgatcaccctcaagctcctcacgtacgcgcccacgggcgcgccggtcgccgccgccaccatgggactgcccgagcaggtcggcggtgagcgcaactgggactaccggtacacctgggtgcgggacggctccctgtcggtgcgggcgctgctcgacctcggcttcgtcgaggaggcggcccgcttcacgcgctggctgggcgaccgtctgagcgcccgcgaagggccggacgacgaacccctccagatcatgtaccgggtggacggcgaccctcatctgacggaggagatcctggagcacttcgagggctaccgcggctcctacccggtccgggccggcaacgccgcctccgaccagcttcagctcgacatctacggcgaggctctctatgccctggccgagggccgcgagatcggcgaacagacgggctatcacgggtggaaggccctggccggcaccctggactggctcgtggactcctgggaccggcccgacgagggcatctgggagacccggggcggacgccaggacttcacctacagccgggtgatgtgctgggccgccttcgaccgcggcctgaggctggccgccacgttccgcaggccggccgacaccgtgcgctggacccaggcccgggacgccatcctcgaacaggtcatggagcgcggctggaacgacaaggagcaggccctggtccagcattacggcggcgacgtcctggacgcctccctgctgctcgccccccgggtcggcttcatcgccccccggagccccggctggctcaacaccctcgacgccatggaccgcgtcctcgtctccgacagcctcgtctaccgctacgacccgcaggcctcccccgacggactgcgcggctccgaagggacgttcagcctgtgcacgttcctgtacgtcgacgctctcgcccgcgcggggcgcctcccccaggcccgctacaccttcgagaagatgcagacgtacgcgaaccacgtcggcctgttcgccgaggagatcggcccgagcggggagcagctcggcaacttcccccaggccttcacccatctctccctcatcatggccgcgacgaccctggacgaggcgctcgacgggccccaccac

SEQ ID NO: 1921 - DNA, 480 bp, Streptomyces avermitilis
  CDS (1)..(480)
gtgaaacagcacatgctcgtcgacagcccgtacggccccctcaccctcgtcgcggcggacggcgtcctgtgcggcctctacatggtcgcccagcgccaccgcccctcagaggagacattcggggcacgcgacgacacgccgttcggcgagacggtcgaccagctgaccgcctatttcgcgggcgagttgacggagttcgacctgccgctccgcctggacggcacgccgttccagcgcaccgtgtgggagcaactgcgccgcatcccctacggcgagacccgctcgtacggcgaactcgccggcgccctcggcaatccgaaggcatcgcgcgcggtgggtctggccaacggcaagaacccgctcggcatcatcgtcccctgtcaccgtgtggtgggcgccgacggcagcctcacgggctacggaggcggcctggagcgcaagcggcggctgctggacttcgagcggggtgccgccttgttc

SEQ ID NO: 1922 - DNA, 1464 bp, Streptomyces avermitilis
  CDS (1)..(1464)
atgcacatcgacagtgagcgctgcgtgcgcgccgtccggtccaaggacgcgcggttcgacgggtggttcttcacggcggtcctgaccacgaggatctactgccgtccgagctgcccggtggtgccgccgaagccggcgaacatgacgttctacccgagcgcggcggcctgccagcaggccggtttccgggcctgcaaacgctgccgcccggacaccagccccggctcgcccgagtggaaccagcgcgccgacctcgtcgcccgcgccatgcgcctgatcggcgacggcgtggtggaccgcgagggcgtgcccggcctcgccacccggctcggctacagcacccgccagatcgaacgccagctcctcgccgaactcggcgcgggcccgctcgcgctcgcccgggcccagcgcgcccagaccgcccgcctgctcatcgagacgaccagcctccccatggcggagatcgccttcgcggcgggcttctcctcgatccgcaccttcaacgacaccgtgcgcgaggtcttcgccctctccccgagcgagctgcgcggcaggctcccgaagaagacggtcgtgtcccccggcgctctcacgctccgcctccccttccgcgccccgctcaaccccgacaacctcttcggccacctcgcggcgaccgccgtacccggagtggaggaatggcgggacggcgcgtaccggcgcaccctgcgcctgccgtacgggcacgggatcgtcgccctgacccccgccgccgaccacatagggtgccgcctctccctcagcgacctgcgcgacctgcccgtcgccatcagccgctgccgccgcatgctcgacctggacgccgacccggtcgccatcgacgaccagttgcgcgccgacccgctgctcgccccgctcgtcgacaaggcgccggggcggcgggtgccgcgtaccgtcgacgaggccgagttcgcggtacgggccgtgctgggccagcaggtgtccacggccgcggcccgtacccacgcggcccgcctggtcaccgcgcacggcgaagcggtgaccgaccccgaggggggcctcacccacctcttcccggcccccgaggcgctggccgccgtcgcccccgagtcgctcgcgatgccccgtacccgccgcaccaccttcaccacgctggtccgccaactggccgagggcggacttcatctgggcgtggagagcgactgggaggagacccgcgcccggctcctgtccctccccggcttcggcccctggaccgcggacgtcatcgcgatgcgcgccctcggcgaccccgacgcgttcctgcccaccgacctcggaatccggcgcgcggccgaggagttgggcctgccgtccacaccggccgcgctcaccgcacgcgcggcggcctggcggccgtggcgggcgtacgcggtccagtacctgtgggcgacggacagccacccgatcaacttcctgccggtg

SEQ ID NO: 1923 - DNA, 1527 bp, Streptomyces avermitilis
  CDS (1)..(1527)
atgacccttcaggcacgcacacagacgtcgtactggctcgagaccgcgccgcccggtgcccccgcgcccgtaccggccggtgacacgacggtcgatgtcgccgtggtcggtgcgggcatcgccggactgagtgccgcgtgggagctgacccgacggggacgcagcgtcgcggtgctggaggccgggcggatcgccgccggggtcaccggtcacaccacggccaagctcaccgcgctgcacacccttgtctacgaccggctccgccgtacccgcgggacggacgccgcgcggctgtacgcgcgctcccagacggacgcgatccggcgcgccgccgagatcgtggacgaactcggcatcgactgcgagtgggaggaggcggcggcgtacacctacgtcagggacggcgcccgcgcggacgaggtacgcgcggaggccgcggcggcccgcgaggccgggctgcccgccgagtacgtgacggagacggagctgccgttcccggtcgccggcgcggtccgggtcacgggccaggcccagttccatccgcgcaagtacctgctggcgctggccgacgagatccgccggcgcggaggactgatgcacgagcggacccgggtcgtggacctcaccgagggggagccctgcgtcctcacgacggagaacggcgccaggatcaccgccgacgccgtcgtggtcgccacgcactacccggtcttcgaccgtgcgctgctgttcacccggctctcaccccgccgcgaactggtcgtggccgcgcccatcgccgaggagagggccccgcggggtatgtacatcaccccggaggagaacacgcgttccatgcgcacggcgccgtacggtgagggaaaacggctgctcatcgtgaccggcgagcacttcacgccgggtgcgggcgacgacgtcgaggagcggttcgagcgccttgccgagtgggccgcccggcacttcggcgacctcacgttcacgcaccggtgggccacgcaggacaacgactccaccgactccgtgccgctggtcgggccactccaccccggcagccgccacacctacgtggccaccggcttcggcggctgggggctgagcggcggcatcatggcgggcggcctgctgggcgagctgatcaccggtgggacggctccatggcgtgatctgtacgatccggggcgcgtggcctccgtcgtgcgggaaggcacggagttcctcaagcaccaggcccaggtggcagggcacttcgtgggcgaccggctgcccccgctgtccggcccgtcggtgaccggcatcgccccgggggacggcgccgtcgtgcacgcgggcggagagcgctgcgcggtgtaccgcgacgacgacggacaggtgcacgccgtctccgcgcgctgcacgcacctgggctgcctcgtggccttcaaccgagccgaacgggcctgggaatgcccctgccacggctcccgcttcgcccccgacggccagatcctccagggccccgccgtacggcccctggagcagcgcgacatc

SEQ ID NO: 1924 - DNA, 1416 bp, Streptomyces avermitilis
  CDS (1)..(1416)
gtgccgtcgatgctcgatgtggtcgtggtgggtgcgggaccgaacggactgacggctgccgtggagctggcgcgccgcggcttctccgtggccgtcttcgaggcccgcgacaccgtgggcggcggggcgcgcacccaagagctgaccctgcccggtttccgccacgacccgtgctccgccgcacacccgctggggatcaactcgcccgcgttcagggcgatgccgctggagcggtacggacttcagtggctgcacgccgagcggcccatggcgcacccgttcaccgacggcacggcagcggtcctgtcccggtccgtggccgagacggccgcctccttcgggccgcgtgacgcgggcacgtaccgcaggctggtggagcccttcctcagccgctgggacaccctggcgcaggacttcatgtcgctccccctcaccgcgctgccccgcgacccggtcaccctcgcccgcttcggcctcgtcgggctgcccccctcgacctggctgacccgccgctttcgcgacgagcgcgcgaaggcgctgttcgccgggctcgtggcgcatgtcatcgccccgctcgacggcatcgccaccggagccgtcggcctcgtcttcgccctggccgcacacgcccgcggctggcccgtcgcccgcggcggctcccagtccatctccgacgcgctcaccgcgtacctcaaggacctcggcggcaccgtccacacggactacgaggtcaagcgcctcgacgacctgccgcccgcgcgggcctacgtcttcgacacctcgcccaccgcgctggcccggatcgccggcttcggcaggtactacgagggataccggtacggggcaagcgtattcaagatcgactacgcgctggacggccccgtgccgtggacggcgaaggaggcgcgcaccgccggcaccgtgcagatcggcgcgagcagcgcggagatcggcaccgccctgcgcgccgcctcgcgcgagggccgggctcccgacccgcccttcctgatcaccgtgcagcccagcgtcgtcgacccctcgcgggcgccggacggaaagcaggtcttctgggcgtacggccacgttccgaacgggtggacgggcgacctcacggatgccatggagcgccagctggagcggttcgcgcccggcttccgtgaccgtgtcctcgcccgcgccacggccggcccgcccgaactcgccgcccacaacgccaactacgtcggcggtgacatcgcctgcggcgccgcatccggactccagctcctgctgcgccctaggctctccctcttcccgtacagcaccccccacccggccgtcttcatctgctcctcggccaccccgccgggacccggcgtgcacggtatgtcgggccacaacgcggccaaggccgtctggaggagactgcgcagttca

SEQ ID NO: 1925 - DNA, 843 bp, Streptomyces avermitilis
  CDS (1)..(843)
atgatcggagacaccgaaaccatcgaagagtttctcgcccaccgcacgtcagacgtcgaagaggcggtccgccaggcggccgcgaccgagatcatgccgcgcttccggcagctcgccgcgcacgagatcgaccagaagagcggcccgcacgacctggtcacggacgccgaccgcaaggccgaggcgtacctcaccgaggtgctcgccaagctcctgcccggctcggtcgtggtcggcgaggaggcggtgcacgccaaccccgtgacatacgaggcgattcagggcgaggcgccggtctggatcgtcgacccggtcgacggcacccgccagttcgtgcacggtgacccgggcttctgcacactggtcgcgctggcgcagggcggcgtcgtccacgcgtcgtggacctacgccccggccctcgaccagttggccacggcgatacggggccgcggggcccacctcgacggcgaaccgctgcgctcgggcgcgcccgatccgggccgtgacctcgaagtggccacgtcccacccggactacaccacggaagaacagaagcgcgcactcctcgccctgcgcaccgagggcgtcctcccgcgcccgtgcggctcggcggggctcgagtatctcgccgtcgcccggggcgagttggacgcgacggcgttctcctgggaggcggcctgggatcacgcggccggcctgctgctggtcgaggaggcgggcggcgcccatctgacccgcgcgggcgagccgttccggataaccggcggcaacgcgctcccgttcacggcggcgcgggacgaggcgacggcccgccgggtggtggggctgctgtcggccggcggc

SEQ ID NO: 1926 - DNA, 1935 bp, Streptomyces avermitilis
  CDS (1)..(1935)
ttggatctctcgcgtgtgactcgaactccccagattccccccagggccgatcctgagcgccgaccgatctggccgatgagcggaaacagcgaggtgagaggccgtatgttcacgacccgccccaccctccagggcaccttcggcatggtgtcctccacgcactggctcgcctcccagtcggcgatggccgtcctggaggagggcggcaacgcctacgacgccgccgtcgccgccggtttcgtcctgcatgtcgtcgagccgcacctcaacgggcccgggggagaggtgccgatcatcctcgccccggcgggcggtgaggtgcgggtgctgtgcgggcagggagtcgcgccggccggagccacgatcgagcactacaagggactcggtctggatctcgtacccggtacggggccgctcgcggccgccgttccgggtgcgttcgacgcctggatgctcctcctgcgcgactacggaacgaagtccctcgcggacgtcctcaagtacgccatcggatacgcgcaggacgggcacgcgcccgtggagcgcgtcggggagaccgtcgagacggtgcgcgagctgttcgagacggagtgggtctcgtcggccgaggtgtatctgcccggcggaaaggcgccacggccgggtgaactgttccgcaacccggcgctcgccgcgacctggaaacggctgatcgccgaggtgtcgggcaccggagaccgggtggcccagatcgagagggcacgggaggtgtggcgtggcgggttcatcgccgaggcgctcgtacgccagtccgggcggcccaccctggacaccagcggcgagcggcacaccggcacgctgacggccgccgatctcgcctcctgggccgcgacctacgaggctccggcgacgtacgactggcagggctggacgctgtgcaaggccggcccctggagccagggcccggtcctcctccagcagctcgcgctgctcccgcccgagctgccgcgctatgggtccgccgactacgtccacctcctcatcgagggctgcaagctcgccatggccgaccgtgaggcctggtacggcgacgcggccgaggtgccgctggccgagctgctgtcggacgcgtacaacgccgagcggcgggtgctcgtcggccacaaggcctcgtacgagctgcgccccggcagcccgggcgggcggaccccgcggatgagcgggcacgcacgcgtggtggccgccgacgaacccgagcccgcgttcggtcccccgggagcgggcgagcccaccgtcgccaagagcccgctgtccccggtgcccggggaaccggacatcgcggcggacgggggcacccggggcgacacctgccacctcgacgtcgtcgacaggtggggcaacatgatcgcggccacgcccagcggcggctggctccagtccaacccggtcgtgcccgaactcggctttccgctcggtacccggctccagatggcctggctggacgagggcctgccgaactccctcaccccgggccgccgcccccgcaccaccctcacgccctcgctggcgttgcgggaccaagtccccgtgctcgcgttcggcacgcccggcggcgaccagcaggaccagtggcagacccacttcttcctggccgtcgtcctgcgctccggggtccggggcggcctcgacctccagggcgccatcgacgccccgaactggcacaacgacagcttccccggctccttctacccgcgcgggacgcgccccggcagtgtgaccgtcgagtcccgtacggaccccggggtcgtcgaggagctgcggcggcgcggccacgacgtcctggtcggcgaggcctggtccgaggggcggctgtgcgcggtcgcccgggacccggagaccggtgtcctgtcggcggcggcgaacccgcgggggatgcaggggtacgcggtcgggcgc

SEQ ID NO: 1927 - DNA, 861 bp, Streptomyces avermitilis
  CDS (1)..(861)
atggactactgctcctcgtgtcgccggcatctcaatggcgccctggtgtgtcccgggtgcggtgcctacgctccggacatcgcaccggccaccgtcgacggtggcgtcgtcccgagctgggccggcacggcgacgacgggcacgacggtgagcgagtcggtgccgtgggagtacccggcctcggacacgtggcacgacggccgtcttcgtgacgaggcagcggtcgaagccggcctggaggaggccccggagaccgacccgtacggcgacctcgagggcacgatgcccgcacccgcaccgcaagggcgggcggcgcggcgtcgccagctggcccgctggaagaagaaccagcgccgggccgtggtcgcgactgccgtcgcactcgtcggaggcggcctgaccgtcgccgcgatggaccggcactccgccgaccgggcacaggcgtccaccgcgccggaggtcgcgaccatgggcaccgcggacgaacaggtggctgagcagccccacccctcgtcgacacaacccggaactcgcctgtcttcgcacactccccccgcgcagtcgcccacgaccgaccttccgcgccggcggtccgccgccgccccgccccgcgtcacaccgccgagcgctcagccgttcgccgccgcctctccccctccgacggcgagggcggcggccccgcagcctcggaccgcctccccgtccaccgtcggaacggtgcccgacggcaccggtacggcggcgaaggaaacgtccgcgtctgccggcgccgatgacacggccccgggagcaccgcaggcgagccccgcgcccacaacgacttcaccttcgcagatctgcctgctcctggtgtgcctcggc

SEQ ID NO: 1928 - DNA, 429 bp, Streptomyces avermitilis
  CDS (1)..(429)
gtgagcagcatggacgccgtgtgggtacggggcgtgaacggcattcagttgcatcacgtgaccgaccttcaggatgccggccgttttttgggcaacgcggcgatggcactgcgggccgcacacgtaaggaccggcgccgaccggtactccagcattgccaccgagctgaagagcctggtgcagcgagtgcgggaactggaggacgaggcgcggtcgagcatgcacgacctgcactccaccgaccccgagcggttcgcccgctgccgggacggtcacgagccgtggcccggtgagatcccggcgggattcatcccgcgccacacctgcaaggacgagtgcctctaccacgatcgcgacgtcctcgacgccatcacgcagtgcacctgcggccggccgccgtgccgggcctgcgagatcggcgggaagctc

SEQ ID NO: 1929 - DNA, 1161 bp, Streptomyces avermitilis
  CDS (1)..(1161)
atggcaaagatccttgcggtgctctatcccgaccccgtgggcggttatcctcccgactacgcccgcgatgagattccggccatcaccggatatccgggcggtcagacaacgccgaccccacaaaccatagatttcaccccggggcagctcctcggcagcgtctccggagaactgggactacgccggttcctggaggaccgaggcgacacctatgtcgtcaccagcgacaaggaagcgccggactccactctggaccgcgagctgcccgacgcggacgtggtcatctcgcagcccttctggcccgcttatctgaccgccgagcggatcgcctccgcgccccggctcaaactcgcgatcacggcggggatcgggtcggaccacgtcgacctgccgagcgccatcgcccacggcatgacggtggcggaggtgaccttcagcaacagcatcagcgtgtccgagcacgccgtcatgcagatcctcactctggtccacaactacatgccggcccacgactgggtgaccgccaagaagggctggaacatcgccgacagcgtctcgcgcgcctacgacctcgaaggcatggacgtcggcgtcctcggctccggccggatcggccaggcggtactgcgccgcctggcgccgttcgacgtaaggctgcactacagcgacgtgcaccggctgcccaaggaggtcgaagaggaactggagctgacctggcatcccgacgctcgttcgctggcctcctcggtcgacgtgctgtcgatccacaccccgctgcatccgcagacgcagaacctcttcgacgacgacctgatcggggccatgaagcgcggttcgtacatcgtcaacaccgcacgcgcgctcatcgtcgaccgggatgccgtggtgcgggccctcaacagcggccaactggccggatacgccggtgacgtctggtatccgcagccgccaccgcccgaccatccgtggcgcaccatgccgtacgaggcgatgacgccgcacgtgtccggttcgaccctctcggcgcaggcccgctacgccgccggtacccgggagatcctggagtgctggttcgacgggcgccccatccgtccggagtacctgatcgtcgacggtggtgggctagccggaacgggagcgcgctcctacacggtcaccgga

SEQ ID NO: 1930 - DNA, 612 bp, Streptomyces avermitilis
  CDS (1)..(612)
atgcgggcggacgaatccgggcccgagcgggaatcccgagagcccacgcacatccccggcgccgaacccgaactgggtggcgagcccacgccgcgaggcgagcccgggccgggattcgagcccgggccgggaggcgagcccgcaccgtcacgcgcgccgttccgctcacgtctgcgcaagggcgtcctggcggcggtcgcgctcggcggcgttctgggcgggtcggcccgctacgccctgggactgacgtttcccacacctcgggggacgtttccggtgacgacgtttgccgtcaacgtgtccggtgcgttcctactggcgctgctgctcgtgtacgtactcgagatctggccgccgacccggtacgtgcgaccgttcgccgccgtcgggtttctcggctccttcaccactttctcgacgtggatggtcgacaccgatcgccttctgggtcacggccactacgcagtcgcggccttcaacgtgttcggcagtctgttcgccggcctggccgccaccggtctgggcctggccatcggcaggatggccctggcccggcgggtacggctggccgcgcggcacggccgcgcccgccggtacggctggtgggtccgg

SEQ ID NO: 1931 - DNA, 636 bp, Streptomyces avermitilis
  CDS (1)..(636)
gtgggaaacgtgggactgctctttgtcggtgcggtgctcttcatgaacggactgctgctgctcgggaaggttgatgccaaagcagcagcggtgttcaaccttttcataggcgcactacaggtactgacgccgacttacctcatcttcaccgccaacggcgaccccatgaagatcctggcggcatcaggcatctacctcttcgggttcacctacctctatgtaggtatcggcctgctcaccggtctcgacagcaccggcgtcggctactactcgctgttcgtggcagttgccgccctgggatactcgttcgtcaatttccggctcttcaaggactaccccttcggggtcatctggctctactgggcctacctgtggttcctgttcttcctgctgctcggtctcaagaaggacgacctcaagatctataccggttgggtcacggcgatcgaaggctgggtcacgggtgcgattcccgcggggctgctgctctccggctactggaagcaccccaccgagaccgccatcgcactggcggtcttcggcgtggtggtgttcgtggggctgtggccgcgcacccatagaacgccccggccgacctcagccgccccgcggaccggaggtgtgggcgcaccaacg

SEQ ID NO: 1932 - DNA, 1248 bp, Streptomyces avermitilis
  CDS (1)..(1248)
atgcctgaaattctcttcagtgtggaccacagcaagtcgatgcgtgaccaggccgtgcccggccacaacaggtggcacccggacgtccccaccgtcgccatggtgaagccaggagcggagttccgcatggagtgccgcgactggaccgactgccaggtcggcaacaacgacaccgccaacgacgtacgcgacatcgacctgaccatccctcacatgctcagcggcccgataggcgtggagggcgccgaacccggcgacctgctcgtcgtcgacatcctcgacctcggccccgttccgcagcagaccggggacgcggcaggacagggctggggctataccggcatcttcgccaaggccaacggcggaggcttcctgaccgactacttcccggacgcctacaaggccgtatgggacttccacggacagcaggccgtctcccgccaccttcccgggatccgcttcaccggaatcacccaccccgggttgttcggaaccgctccgtccgccgagatgctcgcccgctggaacacccgcgagcaggcgctgatcgacaccgacccgaaccgggtccccccgctcgccgtaccgccggacgccaccaacgcactcgccggcacggccaccggagacctcgcacggcgcatcggcgaagaaggcgcacgcacggtgccggcccgcgagaacggaggcaaccacgacatcaagaacttcacccggggatcgagggtcttctaccccgtacacgtccaggacgcgaagctctcaggcggcgacctgcacttcagccagggcgacggagagatcaccttctgcggcgccatcgagatgggcggcttcatcgacttccacgtcgacctgatcaagggcggcatggagacgtacggcatctccaccaaccccgtgttcattccgggcaacgtcgagccgaggtacacggagttcctcaccttcatcgggatctccgtcgaccacgacacggacacgaactactacctggacgcgacgctggcctaccgccgggcctgcctcaacgccgtcgagtacttcaagaagttcggctacagcggagagcaggcctacctgctgctcggctcctcccccatagagggacgcatcagcggcatcgtcgacatccccaacgcctgctgctcgctgtacgtacccaccgccatgttcgacttcgacgtgcggccgaccgccgccggcccgatgaaggccgaccgcggccagtgcgcgctggccactgcc

SEQ ID NO: 1933 - DNA, 894 bp, Streptomyces avermitilis
  CDS (1)..(894)
atgttcgtgacgaacgcgaggtcaccgcgcttgccgggggcggcctcaccggcgaggagatcgccgcgcaccgggggcatcagccccttcacggccgagacccgcatcagccgcgcgacgacgaacgcgacgacgaagccgggcgcgcctgtggccgggcccaactggtgctgttctcccgcgagtcgggcctggtggcggcgcggggcgagcggagtgacgccttgtgccgagaccgcgtgccatcatcggcgcgtgatcgcgatacgcccgaagccggcccgctgcgccgctctcgcctgtctgttggcgctggccgcgagcgggtgcggactctccgccgaactggaccgcgagcgcaaccccgaacgcaggcccaccccatcgccgacgcgggccgccccgtcgccgacccgggccgccccgccgcccgcgtccgcgacccccgggccctcacccgtcgtaccggtccagcaggaacgcggctgcccgccctccggtctgcgcttcgactccggccccgtcgacgcggccatgggactgcgcgccatgacgctcaccctgaccaactgcggcaagcggtcctacgaggtgaacggctacccgtccgtgcgcgtcctcgacgagaggggcaccccgctcacgggcgtgcgcaccgtcgaggggacggacaaggtgttcatggcgccgcaggaccccggccccgagccgctgacgctcgcgccgggcgagaccgcgcgggcaggtctctactggcggatgggagccgaggacggcacgtacctccgggtcgcgccgaagacggggcgggacgccatgaacgtacgtcctcaagagccgctcgacatcggcccggagaacacgctcgggacgacggcgtgggcacctgcctcc

SEQ ID NO: 1934 - DNA, 666 bp, Streptomyces avermitilis
  CDS (1)..(666)
gtgtcttcgctgcctctgccgctcgccctcaccgcacgtctgctgccggtcgccgtactcgcctcggccggctgggccctgacgtcgggtccgttcgccccggcaccgaccgcccagcacaagccgacacaaaagacacagacccagagccccaccgcaccctcgacaacggcggccaccaagacgtacgcctcggccccggcaccgtgcggcgccgtgccggagaagacggtgacctccctggtccccggcaccaagaccgcgggcaaggagatcgcgtcgaccgacaagtcggtccgccgcacctgctcctggaatgcgctcaaggggtacgactaccgctggctcgacgtctcctacgagatatcggacacggacaaagcggcacagaagaccttcgagcagcgcactacggagaagagcggcggaggggcggtccccggactcggcgacgagggctactccgtcgtgaacctcaccacggaggacaagcagcagacgcgcgagggtgtggtgatggctcgcgtgtccaacgcgctggtgaccgtcacgtacaacggcagcgacttcgagacgcagaaggcgcccggtacggacgagatcaacaagggtgccatcaaggccgcgaaggccgcggtggcagcgctggaggacgggcagaaagcc

SEQ ID NO: 1935 - DNA, 1539 bp, Streptomyces avermitilis
  CDS (1)..(1539)
ttgattggcctgcccatgaccgagaccgtccctccggacagcccgcccaccgcccaagtcaccctgcccgacggacgggtggagatcgccccggacgcgcccgcccccagcggcccctacgccaacgaggacctgcttccggtcccggtcgaaaagcgcacctggaccacgtacaacttctccgccctgtgggtcggcatggcccacaacaccgcttcctggaccctcgcctccggtctgatagccgtcggcatggactggaagcaggccgtgctcaccatcgcgctggccaacctgatcgtgctggtcccgatgctgctcaccgggcatgcgggacccaagtacggcatacccttccccgtcttcgcccgcgcctccttcggcatccgcggcgccaacctgcccgctgtcgtacgggcgttggtggcgtgcggctggttcggcatccagacctggatcggcggcgaggcgatctacttcctcgccgggaagctcttcggcgacagctgggcgaacgcctcgaaggtcggcggctacgcctggaccatgtggctgtcgttcgcgatcttctgggtgctccaggtcgccatcatctaccggggcatggagacgatccgccgcttcgagaactgggcggcgcccttcgtcctcgtcggcgccggtgtgatgctgtggtggatgagcagcaaggccggcggcttcggcccgctcctcgaccagccctccaagctcggctggggcccggacttctggaagctgttcgcgccgtcgctcatgggcatgatcggcttctggtccacgctgtcgctgaacatccccgacttcacccggtacggcaggagtcagaaggcccagacctggggacaggcgctcggtctgcccaccaccatgacgttgttcgcgttcctgtccgtcatggtcacctccggctcccaggtggtgtacggcgaggcggtctgggacccggtacagctcgccgccaagaccgacaacgtcttcggcatcatcttcgcgctggtcaccgtgctggtggcgaccctgtccgtgaacatcgcggccaacctggtctcaccggccttcgacttctccaatatcgcgccccgcaagatcagtttccgcaccggtgcgctcgccacctgtgtgctgggtgtgctgatcttcccgtggaagctgtactcggacccgcagggctacatcttcacctggctgggcctggtcggcggtctgctcggcacggtcgccggcattctcatcgccgactactggatcctgcgccgcggctccctcgacctcgccgacctgtaccgcgcgggcggccgctactggtacgacggcggctggaactggcgggccgtcgtcgccttcgtggtcggcggtgtgctggccgtcggaggtgccgacttccatcccctgatcgacggccggcccataccggcgctccagtcgctggccgactacggctgggcggtgggcctcggcacctcgacggtcctgtacgtggtgctgatggcgctgcgcggacgggacaaggccgcggtc

SEQ ID NO: 1936 - DNA, 1023 bp, Streptomyces avermitilis
  CDS (1)..(1023)
atggacttcggactcgtcctgcagaccgacccgccggcctcgcgtgtcatcagcctgatgaagcgggccgaacgcaacggcttccgctacggctggactttcgactcggccgtgctgtggcaggaaccgttcgtgatctacagtcagattctcgccaacacgcagaagttgacggtcggccccatggtgacgaacccgggcacccgcacctgggaggtcaccgcctccaccttcgcgacgctgaacgacatgttcggcaaccgcacggtgtgcggcatcggccgtggcgactccgcgatgcgcgtcgccgggcgcaagcccaacaccctcgcccgtataagcggtgccatgaaggtgatccgtgccctcggccgcggcgatgaggccgacctcggcggtacggtcgtcaagttcccgtgggtcaagccgggcgccgaactcccggtctggatggccgcttacggcccgaaggccctgaagatgaccggcgaggaggcggacgggttcatcctccagctggccgacctctatctgacggagtacatggtcaaggccgtcaaggacgcggccgtggcggccgggcgcgacccgtccgaggtcaggatctgcgtcgccgcgccggcgtacgtcacggcggacgactcgcccgaggcgctcgcccacgcgcgcgagcagtgccgttggttcggcgggatggtcggcaaccatgtcgccgatctcgtctccaagtacggcgagcactccgccgccgtacccgacgaactcaccgactacatcaaggcccgcgagggctacgactactcccaccacgggcgtaccgacaaccccgacaccgcgttcgtgccggacgagatcgtcgaccggttctgcctgatcggcacggtcgagcagcacatcgagaagctgaacgccctgcgtgagctgggcgtcgaccagttcgccgtctacgacatgcacgacgcgcaggaagccgtcatcgacgcctacgggacgaagatcatcccggccgtcaacggcccgcag

SEQ ID NO: 1937 - DNA, 1398 bp, Streptomyces avermitilis
  CDS (1)..(1398)
atgagccgtaccgtcatccgcggtggcctcgtcgtcaccgcgtccgacgagatccacgccgacgtcctgatcgaggacggccgcatcgtcgccctcgccgcctcgggcaccccggccgccgaggcctggacggccgagcggaccatcgacgccaccggaaagtacgtgattccgggcggagtcgacgcccacacccacatggaactgcccttcggcggcaccttcgcctccgactccttcgagacgggtacgcgggccgcggcctggggcggtacgacgacgatcgtcgacttcgcggtgcagagcgtgggccattcgctgcgcgagggcctggacgcctggaacgccaaggccgatggcaagtgcgccatcgactacgccttccacatgatcgtctcggacgtcaacaacgagacgctgaaggagatggacctcctcgtcgaggagggcgtcacctccttcaagcagttcatggcctatcccggcgtcttctacagcgacgacggccagatcctgcgcgccatgcagcgctccgccgagaacggcggcctgatcatgatgcacgccgagaacggcatcgcgatcgacgtgctggtcgagcaggcgctggcccgcggtgagaccgacccccggtatcacggcgaggtccgcaaggccctgctggaggccgaggccacccaccgcgccatcaagctcgcgcaggtcgcgggcgctccgctgtacgtcgtgcacgtctcggcgcaggaagcggtcgccgagctggcacgggcgcgcgacgagggactgaacgtcttcggcgagacctgtccgcagtacctgttcctgtcgaccgacaacctcgccgagcccgacttcgagggcgccaagtacgtgtgcagcacgcctcttcgccccaaacagcaccaggccgcgttgtggcgcgggttgcgcaccaacgacctccaggtcgtctccaccgaccactgccccttctgcttcgtcggccagaaggagctcggccggggcgacttctccaagatccccaacggtctgccgggggtcgagaaccgtatggacctgctccaccaggccgtcgtcgacgggcacatctcgcgccgccgctggatcgagatcgcctgcgccaccccggcccggatgttcggcctgtacccgaagaaggggaccatcgcgccgggcgccgacgccgatgtcgtcatctacgacccgcacgccgagcagatcatctcggccgagacgcaccacatgaacgtcgactactcggcgtacgagggcaggcgcgtcacgggacgggtcgagaccgtgctctcgcggggcgaaccggtcatcaccgagcgggagttcaccgggcgcgcggggcatggcgtctacaccccccgctccacctgtcagtacctgaac

SEQ ID NO: 1938 - DNA, 840 bp, Streptomyces avermitilis
  CDS (1)..(840)
atgagcagagtgatccgcgccgccgtcttccagaccgcatggaccggcgacaaggaatcgatgatccaggtccacgagcaggcggtccgcgacgcggccgcacagggcgcacaggtcctgtgtttccaggagctgttctacggtccctacttctgccaggtccaggacaaggcgttctacgagtacgccgagcagatcccgcacggcccgatcgtcaagcgcttccaggcgctggccagggaactgggcatcgtcctggtcctgccgatgtacgaggaggagcagcccggcgtcctctacaacaccgcggccgtgatcgacgccgacggctcgtacctgggcaagtaccgcaagacccacattccgcaggtcgagggattctgggagaagttctacttccgccccggcaacagcgggtggccggtcttcgacaccgccgtcggcaggatcggtgtctacatctgctacgaccgtcacttcccggagggctggcgggcgctgggcctggcgggcgccgagatcgtgttcaacccgtcggccacctcgcgcggtctgtccggctacctctggcagctggagcagccggcggcggcggtcgccaacgagtacttcgtcggcgccatcaaccgcgtgggcgtcgaggagctgggcgacaacgacttctacgggacctcgtacttcgtggacccggaggcgcagttcgtcggcgaggtggcgagcgacaaggagaccgaactcgtcgtccgcgacctggacctggccaagctgcgggaagtgcgcgaccgctggcagttctaccgcgaccgcgccccgggcgcgtacgggcccctgaccgctccg

SEQ ID NO: 1939 - DNA, 1557 bp, Streptomyces avermitilis
  CDS (1)..(1557)
atgaccaccgccctggaacccgccctgtcggtacgccaggtcctcaccctggaccgggtactcgccggagagcccgaggtggtggccggcgccggtcacctcgaccggcccgtgcgctgggtgcacgtcgccgaggccgccgacgtcggagtgatgctcaccggcggcgagatggtcctcaccaccggggtgctgctggccggcgacccggaggcgcaggccgagtacatccgctcgctgcaccgcgcggaggccgcggccgtcgtcctcggactcggccgggccttcccggcgccgccggacgtgatgcgccgggccgcggagcgctgcggtctgcccatggtggtgctccaccggcccttcccgttcgccgagttgacggaagaggtccaatcccggctcgtacgacagaagttcgcggccgtcagcctgtccgaggcggtacgcacggcgctcaccggactcatcacggcgggcgctcctctgcagcggatgctcgacgagatcgccgggcacgccgcctgtcccgtcgtcgtcaccaatctcgcgcaccgcgtcctcgccacggcgggggagcggtccgcggtcgacgacgtgttgcgtgactgggagcgcatagcgcgtcaggcgggcggcagcgagggcgccggctgggtccgggccgagctgggcgggcggggtgagcgctggggccggatcgtactgtgcggataccgcggcgacgccgccacggggcgcctgctcgccgaccgggccgccgaggcgctggtcctgcaccggatgctcggcggctccgcccacacctgggaggagcagtccgcgcagggcctgctgacggacctcgtctccggtgtcgtaccggcccgtcagctcctgccgcgtgcgcgggccgccggactgcccgtcaaccgccggactttcgtgccgctcgtcgtacgggacggggagccgcccgtgctcgaccgcgtcctgcgcatgctggggctgcccggactcgtcgccgaactggccgacggagccaccgccgtgctgctcagcctcgcccgggaccaggacgcggaggcactctcggcgcacttcgccacccggctgcgtacggagtccggggcgagcgggaccgtggtcgccgccgccgatccgcgtaccgcctgggacgacgtgcccgccgggctgcgtgaggcccagcacgtggccgacgccgtggccgagaactcggccgtgctggacctgccggccgtggtgcgcctgagggacgtccatctgcgcggtctgatccggctgctgcgggacgacccgtacgtccagtccttcgccgagcgcgagctgaacgggctgctgtgcggacgcgacgccgagtcggacctgctgcccgtactgcgcacctatctggccaccggccgcaacaagtcccgcaccgcgcagctccaccacgtcagccggcccgcgctctaccgcaggctggaggccatccaggcgcggctcggcgtcgacctcgacgacttcgaacaggccgcctccgtccacatcgcgctgctcgcacacgatgcccaacagggg

SEQ ID NO: 1940 - DNA, 1278 bp, Streptomyces avermitilis
  CDS (1)..(1278)
gtgagcgacctgtacgggcgtcaccggtccgtcctgcccgactggctcgcgctctactacgcggacccgatcgagatcacccacggcgagggccgccacgtctgggacgcggcaggcaacaggtatctcgacttcttcggcggcatcctcaccaccatgaccgcgcacgcgctgcccgagatcaccaaggcggtgagcgagcaggccgggcggatcgtccactcctcgaccctctacctcaaccggccgatggtcgaactcgcggagcggatcgcccagttgtcgggcatcccggacgcccgggtcttcttcaccacgtccggcaccgaggccaacgacaccgcgctgctgctggcgacgacgtaccggcagagcaaccagatcctggcgatgcgcaacagctaccacggccgctcgttcagcgcggtcggcatcaccggcaacaagggctggtcgcccacctcgctgtcacccctgcagacgctgtacgtgcacggtggcgtccgcacccgcggcccgtacgccgaactcggcgacgccgacttcatcgcggcctgcgtggaggacctgaaggacctgctcggccacatccgcccgcccgccgccctgatcgccgaacccgtccagggcgtcggcggcttcaccgcaccgcccgacgggctgtacgcggccttccgggaggtactccaggagcagggcatcctgtggatcgccgacgaggtgcagaccggctggggccgcaccggcgagcacttctggggctggcaggcacacgggcagagcggcccgccggacatcctcaccttcgccaagggcatcggcaacggcatgtccatcggtggcgtcgtcgcccgcgccgacatcatgaactgcctggacgccaactccatttcgaccttcggcggcacccagatcaccatggcggccggcctcgccaacctcatctacctcctcgaacacgatctccagggcaatgcccggcgcgtgggcggcctgctcatcgagcggctgcgggccatcggcgcgcagcttcccgtcgtacgggaggtgcgtgggcgcgggctcatgatcggcatcgagctggtcaagcccggcaccgacgaggcgaacccgcaggcggcgtccgccgtgctcgaagccgcccgtgaggcgggcctgctgctcggcaagggcggcgcccacaacaccagcgcgctgcgcatcgccccgccgctctcgctcaccgtcgccgaggcggaagagggcgccgcgatcctcgaccgcgccctgaggagtgtc

SEQ ID NO: 1941 - DNA, 840 bp, Streptomyces avermitilis
  CDS (1)..(840)
atggcccacgtcgtacgcgccgcactggtccaggcgacctggaccggtgacaccgaatccatgatcgccaagcatgtggagcacgcccgcgaggcggcccggcagggcgcgaaggtgatcggtttccaggaggtcttcaacgccccctacttctgtcaggtccaggagcccgagcactaccgctgggccgagccggtaccggacggacccacggtggttcgtatgcaggagctcgcgcgcgagaccggcatggtgatcgtcgtgcccgtgttcgaggtggagcagtccggcttctacttcaacaccgcggccgtgatcgacgccgacggcacctacctgggcaagtaccgcaagcaccacatcccccaggtgaagggcttctgggagaagtactacttcaaaccggggaacatgggctggcccgtcttcgacaccgcggtcggcaaggtcggcgtctacatctgctacgaccgtcacttcccggagggctggcggcagctcggcctcaacggcgcccagctcgtctacaacccctccgccacctcgcgcggtctgtccgcctacctctggcagctggagcagcccgccgcggccgtcgccaacgagtacttcatcgccgcgatcaaccgcgtcggccaggaggagtacggcgacaacgacttctacgggacgagctacttcgtcgacccgcgcgggcagttcgtgggcgaggtcgccagcgacaagtccgaggaactcgtcgtccgtgacctcgacttcgacgtcatcgacgaagtgcggcagcagtgggccttctaccgcgaccgccgccccgacgcctacgaagggctggtgcggccg

SEQ ID NO: 1942 - DNA, 1677 bp, Streptomyces avermitilis
  CDS (1)..(1677)
ttggtgttttctaccggatcggagtactccagtctggcgggagttgtggcgatggctgtggaacaactcccgagacaggtgggggagttcgcgaggtacctgaacggcctgctggccaggctcgatcaggacggcggctggtgcggagtgttctggcagcgggaccccgacggcatgcgggcctgtctcgacggctgggaggtgccgccctgggacgtggtggaggcgctcctccaggacctcgccgcggaatacggtcccggggccgtggccgaggaggccgagcgggcccgctcgctgcacgccgcctcgctcgccgcgtacgacgcccggcccggcggccgcgacgccctcggcgaccggctggacgtgatgctccgcgaacagcgctacgccgccgagcgccaggcggagctgggccggctgcttccgtcggccggctcccacgaggaggccgactccgtccgcctggacctcgcctgggcccgcgacgaccacgaccgtgcgacggcccgctgcgcggagctacggcgccgcatggaggacctggaccgccgcgccctgcgcgcccatggacagggcacgcagcacttcccgccgagcgggagcgggaccgggggtgttttccgggcgcaggaggccggacagcgggagccggacgggaccggcgacagtcgtcctcggcggctgcgtccacagcagcagggctatggaccgaccggccacgccgacctctccggccgcacagacctcaccggtcccaccggtcccaccggttccaccggtcccactgattccactgattccaccggctttgacggcctcaccggccccgctgacccagccgaccccgtcagtcccaccggtcccaccgatcccaccgatccgccccacaccaccgacaaccccccgcccgtcacctccgcagccccggccaccatgcccaagcagcgcggaaagcgccgcccccggggcagcgcccgcttcgccgggatgatcgacgcgcaggagacaccgcccgccgccaccctgcccgccgcacccgctcccgcgcccgcaccgaacaccggccgcaccccccgcggcgcccgcttcgccggagccgccgggcaggccccggcggcgaagccccgacgcgagccgctggacgacgaggcgcgccgcgacaccatcgagaccgtgcgcacactgacccgactgcgcggcgagggccgcagcggtgaggcgcacgcgctgctcgtcgaggccgcgtactggcccgccgcccgcttcccgctgctcgccgccgaactgcaccgcgtcggcctcggcgccgactgggccaccctcctgtgggaggcggcctcgctccccgccgaccgcctggtcgccgccgcggacgcgctcgtcgcggcgggccgcacggtggacgggcaacagatgctgcggcagggggtggtccggcccgccccggagatcggcgaggccctgctcgggctcaccggcgacggccgccaccgcgaggcccgcgccctgctcgacgcgtacgtacgcatccgcactccggaggaagcggcccgcagtgtcgaggcggacccgcacacgctcgtccccctgctcctggaggcggcccggggcgtctccgaggaatgccactgggacctcgtccacgccctccgtgtcgccgggttcacgacc

SEQ ID NO: 1943 - DNA, 255 bp, Streptomyces avermitilis
  CDS (1)..(255)
gtggtcatggtgcgcaccccgctgacccccgaagaacatgaacgcggcgagcggctcgggcagttgctgcgcgaggcccgtggtagtcgcaccatggccgacgtcgccgcgagtgccggcctctcggcggagaccctgcgcaagatcgagaccggccgcgccccgaccccggccttcttcaccgtcgcggcgctggcgcgcgcactcggactgtccatggacgacatcgccgggcggtgcgtactgatcggcgta

SEQ ID NO: 1944 - DNA, 783 bp, Streptomyces avermitilis
  CDS (1)..(783)
atggtggaactcaagacggatacgtcgatcgacgcgatgcacgaggcgggccaggtcgtggggagagctctcacggcggtgcgggaggccgccgacgtgggcgtctccctgctggagctggacgaggtggcacgcggagtactgcgggaggcgggggcctcgtcgcccttcctcggctaccggccgtcgttcgcgcccacgcccttcccggcggtcatctgcgcctccgtcaacgaggcgatcgtgcacggcatcccggacgggtaccggctgcgcgacggcgacctggtctccgtcgacttcggggccgaactgggcggctgggtcggcgactcggcgatcagcttcatcgtgggcacgccccgggccgcggacgtacggctcgtggagaccgccgaacgcgcgctggccgcgggcatcgcggcggccgtcgtcggcaaccgcatcggggacatcgcgcacgcgatcggctcggtgtgccgggcggcggggtacggcatcccggacggcttcggcggtcacggcgtgggccgccggatgcacgaggacccgccggtgccgaacgagggccgccccggccgcggtctgccgctgcgccacggcatggtgctggcgatcgagccgatgctgatcggcggcggcacggacggtttccacgcggcggcggacggctggaccctccgtaccgacgacggttcacgcgcggcccacgcggagcacacggtggcgatcaccgacgcgggaccccggatcctgacagcccgcacaaagacccacgccgcc

SEQ ID NO: 1945 - DNA, 1797 bp, Streptomyces avermitilis
  CDS (1)..(1797)
atgcgtcggcctgtggcacggaatctggcggtgttggcggtttcggccgcggtggtgtcggtgggagcggcggctccacccaccgcggtcacctcggtgcggaaagttccggtcgccgtcggctacggcggtgccgtgtcgagcgtcgacgcggatgcctccgccgccggcatcgaggtgctgaagaagggcggcaacgcggtggacgcggccgtcgccaccgccgcggcgctcggcgtcaccgagccgtactcgtcgggcatcggcgggggcggctacttcgtctactacgacgccaagtcccgtacggtgcgcaccatcgacggccgggagaccgcgccgctgtccgccgactcccacctgttcgaggagaacggcaaggcgctcgccttcgccgacgccgtcaccagcggcctgagcgtgggcacgcccggctcgcccgccacctggcagaccgccctcgacaagtggggcagcaagcggctcggcacggtgctgaagccggcggagcggatcgcgcgcgacggcttcacggtcgacagcaccttccgcacccagaccgcctccaacgaggcccggttccgctacttcccggacacggcgaagctgttcctgccgaacggtgagctgccggtggtcggttccaccttcaagaaccccgatctcgcccgcacctacgccgagctgggcaccaagggcgtcgacgcggtctaccgcggcgatctcggcgaggacatcgtcgccaccgtgaacaagccgcccgtggagccaagttcgggctggaacgcccggcccggccgactctcggccaaagacctcgaggcctaccgcgcgaagctccaggcgcccacgaagacctcgtaccggggcctcgacgtctactccatggccccctcctcctcgggcggcacgacggtcggcgaggcgctcaacatcctggagaagaccgacctgtcgaaggccgacgaggtgcagtacctgcaccactacatcgaggccagccggatcgcgttcgcggaccgggggcgctgggtgggcgaccccgccttcgaggacgtacccacgaaggaactgctgtcgcagaagtacgccgactcgcgcgcgtgcctcatcagcgacgacgcggtgctgaccagcccgctggcgccgggtgatccgcgcagtccggcgaaggcctgcgccaccgggggcacggcggctccgacgacgtacgagggcgagaacaccacgcacctcacggtggccgacaagtggggcaacgtcgtcgcctacacgctcaccatcgagcagaccggcggcagcggcatcacggtccccggccgcggcttcatcctgaacaacgaactgacggacttctccttcaccccggcgaacccggccgtgcacgacccgaacctgcccggccccggcaagcgcccgcgctcgtcgatctcgccgacgatcgtgctcgaccggcacgacaagccggtcgtcgcgctcggttcgccgggcggcgcgaccatcatcacgaccgtgctgcagaccctgaccgggttcctcgaccgcgggctgccgctggtcgacgcgatcgccgcgccgcgcgccagccagcgcaacgcggcccagacggagctcgaaccgggcctgtacgacagcacgctcaggggcaagctggaagccatcgggcactccttcaagctgaacccggagatcggcgcggcgacgggcgtgcagcgcctgtcgaacggcaagtggctggccgcggcggagaaggtgcgccggggcggcgggtcggcgatggtggtgcggccggcgtcg

SEQ ID NO: 1946 - DNA, 753 bp, Streptomyces avermitilis
  CDS (1)..(753)
atgaatgacgacgtgcgcaacatcgtcctcggcgtggtcgcggccggcatcagcgccgccctcggctggatcgcccgtacctatctgtggaagcggaagctgcgccgcaagcaggcgttcttcgggctgcccgacaactcggagtcgctgctggtggtcaaccgcgaggcgggcggccccgagctgacggtgatgcgccacgacgtgttcgcgctgctcgaactctccgcgctgatcaaggactgcggcgcgcacgcccaggtcgtcgcgcacgacgcggcccagcagggcttcggcgagcgcaccgagttctgcgtcggcgggccgtcctcgaaccgccggatggccgcgcacctccacagcctgctgccgggcatacaggtgaacaccgaccccgaaccgggcccggaccgcggcgcgttccagatcggcaccgagcgctaccggctggagtccggcaagggcgagtacgtgctcctcgcccgcctcaccgccgacctgggccacggcacacgaccggtcttcctcttctgcggccagcgcgccatcaccaaccaggcggccacccgctatctcgcccgcaaccacgagcgcctcgcgcgcaagtacggcggcaactccttcgtcctgctcctgaaggtcgtcaactcccaggcgtacgggcccgatgtcgtcgaactcgtcgcggacgtcacccgggccgcgcagaccccggcgccggtcgtggctccccgcaactcgcaccgcgcctcc

SEQ ID NO: 1947 - DNA, 1566 bp, Streptomyces avermitilis
  CDS (1)..(1566)
gtgggacacgcacgcaagaccctgcgcacgaccgcagtgagcgccgtatcggcgaccctgatcgccggcaccgccctcgggctcgcccccaccgcacaggcggcgtcgggcggcgtcagcttcgtcgacatcgccggtgacggcggcacggtcctgaaggccaatgtcgtcacgcccgccggcgccgacggctcccgcacctacccgctcatcgtgctgccgaccagctggggcctgccgcaggccgagtacctcgcccaggcccacaagctcgcggactccggctatgtggtcgtcagctacaacgtccgcggcttctggcagtccggcggatacatagaggtggccggcccgcccgacgtggcggacgcctccaaagtgatcgactgggccctcgcccacaccccggcggacgcgcggaaggtcggcatggcgggcatgtcgtacggcgccggcatcagcctgctcgccgcctcgcacgacaagcggatcaaggcggtcgcggccctcagcggctgggccgacctcaccgactcgatctactcgggccgcacccagcacgtccaggcggccgccctgctggacggtgccggaaccctcaccggccgcccgagccccgaactccagcaggtcttcaaggacttcttcgcctccgacctgtccacggagccggacctcctcgcctgggggaagaaacgttcccccgagacgtacatcgaccagatgaacaagaacggcgcggccgtcttcatggccaacggctggggcgacacgatcttctcgcccaatcaactcgccaagtactacgaggagttgaccggcccgaagcgcctggagttccgccccggcgaccacgccaccgccgagatagccggcctgttcggggtccccaacgacgtgtggacggacacggaacgctggttcgaccactacctcaagggcgaggacaacggcatcgacggcgagcagccggtccagctcaagccccgttccacgggtgactacgagggctatccggactggaagtcggtcggcgcgacgacgaagaagatcgccctcacgggcaccaccacgatccacacgaacgtggactcgggcgccaacggcgggctcatcttcctgtccagcatcctcgaccagctcgcccagctgcccccgatggcctcgatcccgctgctgccgcgctactgggccgccgtctggcagtcggagaagtacacgagcggccaacacgtgcgcggcacggtgaagctgcacaccacggtcaccggcaccaaggagagcggcaccctcgtcgcgtacctctacgacgtgggcccgctcggtgtcggcaagctggtcagcaacgctccgtacaccttccacggccagacccccggtcagccgttcggcgtcgacctggaactgtcctccacggcctacgacgtcccggcggggcaccgcctcgccctggtcgtcgacacggtcgactccctctacatcgagcacaacccgtccggcgcgcagctgaccttctcctcgccggagcacgacacctcatacgtgtcggtacccctgcgcgagcag

SEQ ID NO: 1948 - DNA, 888 bp, Streptomyces avermitilis
  CDS (1)..(888)
atgaccaccaaaacccttgaggccacggccctctacgacatccccgggcccaggacgcgacaacggcaccgactgtacggggtgttgtcgaccgtcgttctgctcgccctggtcggctggatcgtgtatctcctcttcgacaccggccagttcacgtacaccaagtggatgcccttcgagtacaagggaatccaggaactgctgctgcgcggtctcggcaacacgctcaaggccttcgggatcgccgcggtactctcgctggccctcggcggcctgctcgccaccgggcggctctcggaccacgccccggtgcgctgggtggccacgctggtcgtcgagttcttccgggccatgccggtgctggtgatgatcttcttcatcttcgtggcgctcaaggtgcagccgctgcccgcactggtcgcgggactcaccctctacaacggctcggtgctcgccgaggtcttccgctcgggcgtggagtccgtcgaacgcggtcagcgggaggccgcgttcgccctcggcatgcgcaagacgcaggtgatggcgcacgtgctcgtaccgcaggccgtacgcgccatgctgcccgccatcatcagccagctggtggtggccctgaaggatacctcgctcggttatctgatcacctacgaggagttcctccacgccgggaaactgatcgcgtcgaacctcgactacgatttgccgttcatccccgtggtgatggtgatctcgccgatctacatcgggatgtgcatgctgctttcctggttcgcccagtgggtgtcccggcgtgagcagcgcagtcccaagaccgaggccgtggaagtcgccgcggccgagccagggacgctgctgccgcgtgggggtccccccacggccccgagacca

SEQ ID NO: 1949 - DNA, 642 bp, Streptomyces avermitilis
  CDS (1)..(642)
gtgaacgtactgacagacaacttctccaccttcgccaagggattcctcgggacggtcgaactcaccgtctacgcctcggcgctggcactcgtcctcgggttcctcatggcctccttccgggtcgctcccgtcgcctccctgcgggccttcggcacagcctgggtgacggtgctgcgcaacacgccgctcaccctgctgttcttcgcggtgctgctcggcctgccgcggttcggactcgttctgcccttcgaggtgttcgcggtcctcgcgctcggctgctacacctcggcgttcatctgtgaggcgctgcgctccggcatcaacaccgtgcccaggggacagggcgaggcggcccgcagcctgggcatgacgttcgagcagacgctgtccgtggtcgtcctgccccaggcgttccgctccgtgatctcgccggtcggctcgacgctcatcgccctcgccaagaactccgcgatcgccggcgcgttcagcgtcaacgagctgctcggcacgtacaagacgctcagcgagctcggctacaacatcgtctggaccttcgtctggatcgccgtcggctacctgatcatcaccctcaccatcagcgcgatcttcaactttctggaacgccgctggggagtcgcccga

SEQ ID NO: 1950 - DNA, 915 bp, Streptomyces avermitilis
  CDS (1)..(915)
atgatccgcagcacacgtgtgtgtcttgcccttgccctcgtcctgatcacggcacttctcgcgaccgcctgcggcaaggagggcagtccgcccaccaagggaccggccaccgacaaactgcccgactaccaggtggcgcagggctttcagctcaacgactcgcccacctggaagcgggccaagaagcgcggctacctcaccgtcggcgtcaaggaggaccagccctacctcggcgagagggacccggcgagcggcgccttctccggcttcgacatcgagatcgccaagatgatgtcggcctcgctcggcttcgaccccggcacgatccgcttcaagaccatcgcctccgccaaccgtgaaaccgccctccagaacggccagatcgactactacgtcggcacctacaccatcaacgacaagcgcaagaagctcgtcggcttcgccggtccgtactacctggcgggtcagtccctgctggtccgcaaggacgagcaggggatcaacgggccgcaggacctggccggcaaacgcgtctgctcggccgccggttccaccccgtaccagcgcatccagcaggactacccgaaggtgaagctcgtcgcgtacgacacgtactccgtctgcgtcgacaacctgctcacctaccaggtcgacgccgtcaccaccgacgacgcgatcctcatcggctacgcggcgaaggtgcccgaggagctcaaggtcgtcggcaagcccttctccgaggagccctacggcatcggcgtcccgcgcaacgacaacgccctcaggttcgctctcgacgacgcgctggaggcccgtgagaaggacggcgactggaagaaggcgtacgaggcgacgctcggcctgtccggcgtgccggcgcccaccccgcccgcgatcgaccgctacccggcgagc

SEQ ID NO: 1951 - DNA, 759 bp, Streptomyces avermitilis
  CDS (1)..(759)
gtgagtagggcgggctgcatggctgtcgatccgctgatcgaactgcatgacgtgaacaagtacttcggcgagctccatgtcctccaggacatcaacctcactgtcggcaagggggaggtggtcgtggtcatcggcccgtccgggtcgggcaagtcgacgctctgcagaacggtcaaccggctcgagaccatcgagtccggcacgatcagactcgacggacagccggtccccgacgagggcaaggcgctcgcgaaactccgcgccgaggtcggcatggtcttccagtcgttcaacctcttcgcccacaagaccgtgctgcagaacgtctcgctggcgcaggtgaaggtccgcggccgcaagaaggacgaggccgacaggcactcccgggagctcctcgaccgtgtgggcctcgccgatcaggcgctcaagtatccggcgcagctctccggcggccagcagcagcgcgtggccatcgcccgcgccctcgccatgaaccccaaggcgctcctgttcgacgaaccgacctcggccctcgaccccgagatgatcaacgaggtgctggaggtcatgcagcagctcgcccgcgacggcatgaccatggtcgtcgtcacccacgagatgggcttcgcgcgctcggcggccaaccgcgtcgtcttcatggccgacggccgcatcatcgaggaccgcacgccggaggagttcttcaccaacccgcgcaccgagcgggccaaggacttcctctccaagatcctcaagcac

SEQ ID NO: 1952 - DNA, 438 bp, Streptomyces avermitilis
  CDS (1)..(438)
atgaacatccctttcctgggcaactggcgcaagaagcacggtgcggccttcggtgtcgcggtgttcaccgacggtgacagtgatcgcgaaggggtcgccgaacttctctcggagtgcgagctgctgcgctcgcaggccgagcaggcgggcgtcgaactcgacgactccgcgacctcgctggaggcgctcgaccagctcctgccgcgctggcgcgacgacgaggagatcctgccctggctgggaaacgacgcggggctctatctcggcaccgtcatcgtgcgcacggtcgcgggcgccgactgggagatctggaccagtggccggcccacggtgcggctggccggcggccgtgaggtcgacgtggtctccgccggtcacgagtgggcgacgaccggcgcaccggagctctcccaggtgtacgcggaggtcgccgaaccg

SEQ ID NO: 1953 - DNA, 1761 bp, Streptomyces avermitilis
  CDS (1)..(1761)
gtgcgtcgacgtctttggggggcggccgcgctgctcgggctgttcgcgggtgtggcgccggtcgcggcggcggaggcggtcgcggcaccgcacggcgccggaccggtcccactggaacggctcttcgacaacaccgcggtcagcgacgaccagcggccgggcgccgcggacttcgacggctcggggagctccctgtccgcgcaggacctgacggcggccggctggacacccgggcgcacgctgacagtgcagggcgcacggctgacctggccgcgccgggcggcgggcgagcccgacaacgtacgggccgacgcccagtcggtccggctgcgcggccgcggcgacgcgctcgccttcctcgccgccggcacggccggctccgacgtgagcggcacgggcacggtccggtacgcgaacggcacccgctcctcgtaccggctcaccgcctcggactggcgcaccggcccgctcgccaccaaggcggtggcgctgccgcacatcaacacccccgcgggtcaactcgccgagaaggcacggctgtacgtcgtgaccgtgccgctcgcgcacggccgcgaggtcgcctcggtgacactgccgcggggcggcgacctccatgtgttcgccctctcgatacgtccttccacccgtggctggacgggcagttgggcggcctcgacctccggttacacggccgtcggcccgtggacggaccggactctgcggcttgtggtgcacacctcggcgggcgggccacgggtgcgcatccggctcgacaacacgttcgcggcggcgccggtgcggatcggcagcgcgacggtggcggtgcaggaggcgggtgcccggcccgtggcggcaccggtgccgctctccttccggggcgcggccggggccgagatccccgcgggggcgcaggaggtcagcgatcccgtcggcttccaggtgccggccgacgcccaattgctggtcagcttccatctgccggggacggtgaccgcagcgcccgtgcaccggctcgcggtgcagcggtcgtacgtcagcgagccgggcgaccatgcgggcgacggcactccggacgcgtacacctcggccatcacctcgtggccgctgctgaccggcgtggatgtgggcggtgggccgggctccgtggtgatgctcggggactcgatcaccgatggcgagaagtcgacgcaggacgccaatcaccgctggcccaatgtgctcgccacccgtgtgctcaaccaacatgtggtcccgcactatggcgtgctgaaccagggcatctcggcgaatcgtgtggtcaccgaccgctatcccggagacgggatctccaccgacaccggcggggtgagcgcgctgcaccggctcgaccgtgacgtcctggcccagacgtccgcgcgcacggccgtcgtcttccagggcgtcaacgacgtccgctggggcgcctcggcggatcaggtgatcgcggggctccgggagctggccgaccgagcccatgggcgagggctacgcgtcctggccgcgacgatcgcgccctgcgagggcgagtccctgtgcaccccggccgccgacacccggcgcaccgcggtgaacacctggatccgcgcgagcgagagcttcgacggcgtcctcgacttcgacgccgtcgtacgcgaccccgggcatcccgcacgcctcctgcccgcatacgacagcggggaccatctgcatcccaacgacgcgggcctcgcggcgctggcggagtcggtggacctgacgctgctg

SEQ ID NO: 1954 - DNA, 786 bp, Streptomyces avermitilis
  CDS (1)..(786)
atgcgcatcgccacctggaacgtgaactcgatcaccgcccgtctcccgaggctcctggcctggctggagagcagcggcacggacgtgctgtgcatccaggagaccaagacgaccgccgagcagttcccggcggacgcgctgcgcgagctgggctacgagtcggcggtgcacgccacagggcggtggaacggcgtggcggtgatctcccgcgtcggcctcgaggacgtggtcaggggcctgcccggcgaccccggcttcgacggcgtccaggagccccgcgcgctctccgcgacctgcggcccggtccgcgtctggtcggtgtacgtgccgaacggccgcgaggtggagcacccccactacgcgtacaagctccagtggttcgaggccctcaaggcggcggtcgcgggcgacgcggcgggcagccggccgttcgcggtgatgggcgacttcaatgtggcgccgacggacgacgacgtgtacgacgtggccgccttcgagggcctcacccacgtcaccccggccgagcgcgccgccctggcgacgctccgtgaggcgggcctgtccgatgtcgtcccgcgtccgctgaagtacgagcacccctacacgtactgggactaccgccagctctgcttccccaagaaccgcggcatgcgcatcgacctggtgtacggcaacgagccgttcgccaaggcggtgaaggacgcgtacgtggaccgcgaggagcgcaagggcaagggcgcgtcggaccacgcgccggtcgtggtggacctggacgtgcaggacgcg

SEQ ID NO: 1955 - DNA, 633 bp, Streptomyces avermitilis
  CDS (1)..(633)
atgaagctcacgaagaagtcgcacgcctgcatccgcctcgagaaggacgggcgcacgctcgtcatcgacccgggcaccttcagcgaggaggacgcggccgtcggcgcggacgcgatcctggtcacgcacgagcacctcgaccacttcaacgaggaccggctgcgggcgggcctggagtccaacccggcggccgggatctggaccctgaagtcggttgccgagaagctctccgcggctttcccgggccgcgtgcacacggtcgggcacggtgacaccttcaccgccgcgggcttcgacgtccaggtgcacggcgaactgcacgccgtgatccacccggacatcccgcgcatcaccaacgtcggctacctgatcgacgacggccgcgtcttccacccgggcgacgcgctcaccgtccccgaccacccggtcgagacgctgatgctccccgtcatggccccctggagcaagatcgccgaggtcatcgactatgtgcgcgaggtcaagccccagcgcgcgtacgacatccacgacgccctcctcacggacctcgcccgcccgatctacgaccaccagatcggcgccctcggcggctccgaacacctgcgtctgacgccgggcgcgtcggccgaggtc

SEQ ID NO: 1956 - DNA, 1293 bp, Streptomyces avermitilis
  CDS (1)..(1293)
gtgagtgagacaccgatgaacaccctgcaataccgctttgacgggccagaagacgccccggtcctgatcctcggtccctcactgggtaccacatggcacatgtgggaccggcaggtcccggagctgatgaagcagtggcgggtgttccggttcgacctgccgggacacggcggcgcgcccgcgcaccccgcggggtccgtcaccgacctggccgcccggctgctggccacgctcgacgccctcggcgtgcaccggttcggctacgcgggctgcgcgctcagtggtgccgtcggcgccgagctggcactgcgccaccccgaacgcctcgcctcgctcgcgctgatcgccgcctcgccgcgcttcggcacggccgacgagttccggcagcgcggcgtgatcgtacggacgaacgggctcgaccccatcgcccgtacgtccccggagagatggttcaccggcgggttcgccgccgcccagcccgcgatcacagagtgggccgtgcagatggtgcggacgaccgaccccggttgttacatcgcgtcctgcgaggcactcgccgccttcgacgtacgcgccgaactcagccggatcggcgtcccgacgctggtcctcgtcggctcggacgaccaggtcaccggccccgccgaggcgcgcaccctggtcgccgggataccggacgcccggctcgcggtcgtgcccggcgcctcccatctggtgccggtggagcagcccgcggcggtcaccgatctgctcgtgcggcacttctccaccgcctggcagcccgccttcgagtcgaccaccggccagacggcgattcccgcggcccccgtgaagccggtgctcgccgcgccggcaccggtcgcgccggtcgccgagatcgcgccggccgccatgcagccggagcccgcgggcaggcccgaccgctacgagaccgggctcaaggtgcgccgcgaggtgctcggcgacgcgcatgtcgaccgggccctggcctcggcggacgcgttctccggggatttccaggagttcatcacccggtacgcgtggggcgagatctgggaccggcccgggctggaccggcgcgcgcgcagctgcgtcacgctcaccgcgctggtcgcgggcggccacctcgacgagctcgccttccacacccgcgcggccctgcgcaacgggctcacgccggtggagatcaaggaggtgctcctccaggcggcggtctactgcggcgtaccggccgcgaacagcgccttcaaggtggcccagcaggtcatccgggaggagaccacgccccaggag

SEQ ID NO: 1957 - DNA, 570 bp, Streptomyces avermitilis
  CDS (1)..(570)
gtgggtcagggcggagtggcggtactcgtccgtacctgcgcgcagttcaccgatgcgcgtggtcgcgaggaggtcggcgaggagtcggtggtgcaggccacccggatcacgctgggcctgccggttcaccggatcggccagctctccgaggagatccggaacgtcgacgctcgtctgacccggctggtggaacggcgtgccccgcagcttctcgacgtggtcgggatcggtccggacacggcggtcgctctgctgatcacggtgggggacaacccggaacggctggacagtgaggcgtccttcgccgctttgtgcggggtcagccccgtcgagcgctcctcgggacgccggcagttccgtcgcctcaaccgcggcggcgaccggcaggccaacgccgcgctccaccgcatcgtgttcacccgcctgcgggtcgacccgcgcgctcaggaccactacgagcggcggatcgaggagggcaggacccggcgcgaaatcgtgcgttgcctcaaacgctacgcggcccgggaggtcttccacctggtcaaacagctacggccagcaccccgctca

SEQ ID NO: 1958 - DNA, 759 bp, Streptomyces avermitilis
  CDS (1)..(759)
gtggatctctccaaccgcaccgttctcatcgtcggcgggacctcgggtatcggacgagagctggcccgccggttcgccgcagcgggcagcaccgtggccgtcggcggccgcagcccggaggcactctcggaactcgccggagaaggcttcggcacaatcagcatcgatgtcaccgacagtgcctccgtcgcatctgcccgtgacgccgtgctcgcccggtaccccgagctggacaccgtggtgacgatgccgggcatcatgctcctggaggacctgcgcgaccccgcgcacttcgaggcggcagcgacgacgatcgacaccaacctggtgggcaccatccgggtcatcgacgccttcaccccgcacctggtccggcggggcgccggcaccttcatcaccgtcacctccggcatcgccttcctgcccttcccgcccatgcccacctacgccgcctcgaaagccgcggtgcacgcctactccgaggcgctgcgcgcgcaactcgacggcaccggcgtcagcgtcgtcgaactcgtccccccggccgtcgccacagcaggccaggaaaaggtgaacccgcacgcgctgccgctcgacgacttcgccaccgaggtcgtgcaactgctctcagaggaccccaccccccgcgaaatcctcgtgaaggcggcactcatgcaccgctgggccgagcgcgacggcacctacgacgacctcgtcgcacagcgctcccaggccctggccatgctccccagccgtgaaggc

SEQ ID NO: 1959 - DNA, 870 bp, Streptomyces avermitilis
  CDS (1)..(870)
atgaaggatgaggaatccggcaaccggctcggcagctacctgcgcgcccggcgtgagctggtctcaccggcgcgggcggggctcccgcccggcggcaaccgccgcgtgcccggcctgcgccgtgaggaagtcgccctgctcgccggcatcagccccgactactacctgcgactggaacggggacgcgacaagaatccctcacctcaggtcctcgaatcactcgcgcgtgtcctgcggctcgacgacatcgagcggacgtatctgctcggcctcacggcagcacgccccagggctccgcgccgcaagcgacccgagcacgtaccggcacgggtgcaccagctcctcgcccaccttcggattcccgcgttcgtcgaaggtcgcgccttcgacgtcctggcctccaaccccatggccgtcgcgctctccccgcgcctgcggcccggccagaaccggcttcgttccctcttcctcgatcccgaggaacaagcctttcaccaggactgggccaaagccgccgccagcttcatcgccggccttcgcaccaccatcggggacgacaccgacaacccccggtttgtcgaactcgtcggagagctcgcactgtccagccagcggttccgcaccctgtgggcccgacacgacgtccgcaacctcgacggaggcaccaccaccgtccaccaccccgtcgtcggtgaactacggctccaccgcgacaaactccccatcgacgacgtcatcctcgttgtctactaccccgacaaggccagcgacggcgacgagaagctgcaacttctcgccgcactctcacagaccgaacccaccgacacagcacacagcaggcaggcagacgccccgcgcccgaaaacaccc

SEQ ID NO: 1960 - DNA, 240 bp, Streptomyces avermitilis
  CDS (1)..(240)
atggaggaccagatcggcgcgctgggcttggtcctgaatgcgctgttcaacacgaggtacttggaggccgccgtcacgcagccgcgcgaggacgggttcgaggcccgcgacgaggacgtggcccgcctctcctcgttcgtccgccatcacatcaacatgctgggccgctactccttccagctccccgacctgcccggcggcctgcggcccctgcgcgccccggacgccaccgacgaccaa

SEQ ID NO: 1961 - DNA, 819 bp, Streptomyces avermitilis
  CDS (1)..(819)
atggactggacgcttggtgaggaatttgcgacgcctgaaggggtggtgcggtgggggaccttgggtcgcggagacccgatcgtactggtgcacggcacgccgtattcttcctttctttggcgggacatcgctccggccctcgcccgcacccgcaaggtcttctttttcgaccatctcggcttcggccagtcggaccgacgcgagggccaggacctcagcctggcggctcacgcgaggaactttgcccggctcctcgaccactgggagctatccgacccgagcgtggtcgcccacgacataggcggggcagtggcgcttcggacattgctgctggagaagaggagctaccaggatctgaccctcttcgacgcggtgagcggcggcgagtgggagagagggctcttccagctcttcctggagcacgaggaggtcttccagaagcttcccggttacgcgcacgaagcgctggtcgccagccacctgcggcacgccacgcacgtcggcttccggccgggagttctcgatgcgttcctcgcaccgtggcgaggggactcagggcaagcggcgttctaccgtcagtacagccagatcaggcaggcggacacggtcgcgtacgagcacttgctgggcggtatgtcgcttccggtgcggctcgtctggggccgcgaggaccgcattcttccgccgcggtacgccgagtggttgcacgaacgcgttccgcacgcggagctgcactggatcgagggcgccggccaccttctccaggaagacgcgccgggccggctgttggcctgcctgacagccggtttcccctcggcc

SEQ ID NO: 1962 - DNA, 765 bp, Streptomyces avermitilis
  CDS (1)..(765)
atgattgagatcctgaactccgcgcggctcgagcgggcgagggacaccggcgccctggtcggaaacatcctgcacacgctgaagcagcgcagcgcggtcgggacgaacctgctggacatcgaccagtgggccaaggagatgatcaccgaggcgggagcgcagtcctgctacgtcgactacgcgccttccttcgggcgcggcccgttcgggcactacatctgcacggccgtcaacgacggagtgctccatgggcggcctcacaactacacgctggcagacggggatctgctgactctcgacctcgccgtagccaggggcggggtggccgcggacgccgcgatcagctttctggtgggcaaggccaggccggcggagagcgtcgcgatgatcgaggcgaccgaacgtgcactcgccgccggcatcgccgccgccaagcctggggcgcgcatcggcgacctctcccacgccatcggcacggtcctcagcaaggcgggctacccgatcaacaccgagttcggaggccacggcatcggctcgaccatgcaccaggacccacacgtcgcgaacaccggacggcccggccgcggatacaagctgcgccccggactgctgctcgccctggagccctgggtcatggccgacactgccacactcgtcaccgacgccgacggttggacgctgcgcagcgcgacaggctgccggaccgcgcacagcgagcacaccatcgccatcaccgacagcggagccgaaattctcacccgaccg

SEQ ID NO: 1963 - DNA, 303 bp, Streptomyces avermitilis
  CDS (1)..(303)
atggtcaggttgccgctcacccccgccgaggtagaacgcggacagcgccttggcgccctgctccgccgagcccggggctgccgctcgatgctggacgtggcgctcgcttcgcacatctcgccggaaactctgcggaagatcgaatccggccgtgtggccacccccgccttcccgaccatcgcagcgatcgccgacaccctcggcctgtctctcgacgccgtctgggccgagatcagccaggcggaacgaaccgtcgaggaccagtcggtcctgcctgtcacacggcatccatcgctggtttcg

SEQ ID NO: 1964 - DNA, 300 bp, Streptomyces avermitilis
  CDS (1)..(300)
gtggtggcggtgtgcggccgggcgcgagtgggaggagcggatctccaaccgcaccgcgatgccgaagtggagaacggcggtgtcgccgcctgccgcgagtgcgtcggctaccgggtctcccacgccttccccatgtgcgggcacgcggcgagggtgcgggcgctcgcgcccttcgggcaggaagcgacggagccgacaggcggccaggtcggtgtagccgccgaggtccgctgggcggtgctcgggctggtcgacgaggtgatcagcgtgcgcgcaggcgtaccggcacagcgcggtcag

SEQ ID NO: 1965 - DNA, 2370 bp, Streptomyces avermitilis
  CDS (1)..(2370)
atgaccgacatgacggggacccaggggatggacgacggggcggagcggtccccctggcagcgggccgccgacggggccgatcctcggcgctccgccgacggggccgacgtgaccggcccgcacgacccggccggtgaggttgatgtttccggctcgcagcggcccgcggatgtggcgcggcgcgccttgcgcgccgcgcgggggcgggacgcgcggggggctgacgcggccgatgccgatgccgatgccgatgcccgagcccatgccgatgctccccgcgccgatgcccaggccgatgccgatgccgatgccgatgcccaggccgaggcggacccggtgcgggacgcgggccccacgacgtccgacgagacctcgggtcgacgctcccggcccggcgacgtggcacgtgaggcattgcggcgggcgacggcgcgggggagcgctgccgggtccggcgagggagcaccaccggcaccggacagccccgctgagcccagccggcccgctgagcacagtgagtccggtgagtccagtgaaggcgaggagcttgcggagggctggtccgggctgcccgccgcgaaggaagacgctcaggccggccgccccggcgacatcgcacggcaggcgttgcgtgccgcgcgtgatgacgcgaagcaggggcagcgagaggccagggccaggggagtcggggccgcacgccgttcggccggtgcgagccgcaccgattcccgggagcgacagggcacaccgggcgagggcgacgagaggcgcaaccgggcccgggagctccgggagttcctcgccggcgccttcgtacttcctgcggatgacccgacggatcttcctgcggacgcgcttcccacggacgcggccccgcgagacgaaacgcgggacgcggcctcgacgcacgcctcgacctcgtcctcgacgcacgccgaggacgaggtgtggagcggcaggtcgacgccgacggcagaccgtcgtgccgacgggcgcgagaccgagccccgtccccccgtctccccctcccgcccgctgacgggttcggcgccctcggaagacacgccgcatcagccctcggccccgcgcgtcccccgttccatggccgcccccggccgggacggggaactgcggcgcaccttcgccgcccttccggcgcggaccggggacggcgtcggcgtcgaccggttcgccgagacctggtggggcgacgcctgggtgtcggcgctggaggaaggcgccctggacgcggcccgcctggcgcgggggagggtgtacgccggacaggggcacgtggacgccatcaccgtcacgcccgggctcgtgctcgcgtacgtacacggcagccgtccgcgcccgtaccgcgtgcaggtccggctgcgcacgctctccgacgacgactgggaccgtttcctggacgccgccgccgaacggcccgggcacatcgccgcgctgctcgacaaggagatgccgcactccctcgccgactgcgggatcccgctgctccccgagccccgcgacctggacccgcagtgcagctgccccgactccggccacccctgcaagcacgcggcggccctctgctaccagaccgcgcgactgctggacgaggacccgttcgtcctgctcctgctccgcggccgcggcgaacgcgaggtgctggacgccctgtcccgccgcaacgccgcccgcgcggcccgcgccgcccaggaacaggaacccgcaccgctgcccggcgtacgcgcccgggacaccctcgcccgacgttcgctcccgcccctcccggcaccgctgccggcgcccccgcacccggagcagcccccggtctacccggcggccccgggcgggccggacccgttcgcgctggaccagttggccaccgacgcggccgcccgcgcgcacgccctgctcaccgccggacgcgatccggtggccgagctgacgctgtggcaggacgcggtacgactcgccgccgcccggcccggttccggtctgaccgcggcgacacgcgcgctgtacgcgtcgctggccaccgccgccggacggaccaccggggacttggcccgggcggtcgccgcctggcgacagggcggactcgaagggctcgccgtcctcgaggaaccctgggatccgccggccggacgtttcgaccgcgcccgcccgcttctcctcgctgccgacctcccggcgttccggccctggcgcaaccgcctcacccatccgaagggccatgcccagctccgcctcggccacgacggcctctggtacgcctacgaatcggaaccggaccacgacgactggtggccccggggcaccccggacctggacccggtcggcgccctgacgggtctcggcgcaccggacgaagcg

SEQ ID NO: 1966 - DNA, 2886 bp, Streptomyces avermitilis
  CDS (1)..(2886)
gtgaccgggcgtatgggggacggggtggttccggggggtgcggcacgcgccgccggcgcggtcgcggtgcggccgggagtggtcgtcgacgcgtccgtgccggtgcggctggccgccgtcttcctgcccgcgccgctgccgcgacaggggcgggtcgcgttctgggatccggcgggcggaccgctgccaccgctccccggcaccccgctgtccgacgaggagctcacggtcgtacgaccgcacggagccggcgtgcgcagaggcaccgtgcccgcggtgtccctgccgctcgacgcggccctgccgttgctcgcccgctcccgccgtgaccccgccgcccaccccgccaccgcctgctggggcgccgccgccctgcacgccctgcggctcgtggcccgcggccggctgctgccgggcctgacggcggacggcctcgacgcatggcgtgccggaccgctggaccccgaggacatcgcccacctcagggccgtcgccgccgcccttccgtacgagggccatgccgtcccgctcccgggcccgggaccgctccggcttcccgagccggaagcgctgatgaggtccttcctggacgcggtcgcggacacactgccgcgcaccccggccgccgcgtacacctccgggaagcccttcgcggcgcgcgagccgcagcggctgccgggagcccatgactgggccgccgaggtggccgcggggatggacgccggcgtacgcgtctcgctgcgcctggatctgtccgcgtaccagctgttcgacgacggcgaaggggcccgccgcgcgggcgcggccgtcgtccaggtgcacagcctcgccgacccgaccctcgtggtcgacgcggcggcgctgtgggcgggcgaggcggacgcgacgttcggaccacgcgcgcgtgtggacgcggccctggccgtccgccgcgcggcccgcgtctggccaccgctggaccggctcgccgaacaggacgtgcccgacgtactggcgctgtccgagcaggagctgtccgaactgctcggcgtcgccgcgacccggctcggcgcggccggagtcgccgtgcactggccgagggacctcgcccacgacctgaccgcggccgcggtggtgcggcccgcacccggctccgcgaccgacggcaccggcttcttcgagagcgaggaactgctccagttccgctggcagttggcgctcggcggcgatcccctcaccgaggccgagatggacaccctggcagaagcccaccgtcccgtcgtccggctgcgcgaccagtgggtgctcgtcgacccggccctcgtccgcaaggcccgcaagcgcgagctgggcctgctcgacccggtcgacgcgctctccgccgccctcaccggcagcacggaggtcgacggggagacggtcgaggcggtcccggcgggcgcgctcgcggtgctgcgcgaccggctgacggcgggagtgcggcccgccgagccccccgaggggctgcaagcccgcctgcgggactaccagctgcgaggcctggcctggctggacctgatgacctccctcggcctcggcggctgcctcgccgacgacatggggctgggcaagacggtcacggtcatcgcactccatctgcggcgggcgcgcagtgaaccgacgctggtggtctgcccggcgtccctgctgggcaactggcagcgggagatcatcagattcgcccccggtgtcccggtccgccgctaccacggcccggaccgcagcctggaggacctggacggcggcttcgtgctcaccacctacgggacgatgcggtcggcggcaccccggttcgccgaacagaagtggggcatggtcgtcgcggacgaggcccagcacgtgaagaacccctactccgccacggcgaaggcactgcgcacgatccccacgcccgcgcgggtcgccctgaccggcacgcccgtcgagaacaacctctccgaactctgggccctcctcgactggacgacgccgggtctgctcggcccgctgaagtccttccgcgcccgccacgcgcgggccgtggagaacggcgaggacgaggaggcggtggagcgcctggcccgactggtccgcccgttcctgctgcgccgcaagaagtccgacccgggcatcgtccccgaactcccgccgaagacggagacggaccacccggtgccgctcacccgcgagcaggcctccctctacgaggcggtggtacgggagtcgatgctcgcgatcgagacggcggagggaatcggccgccgtggcctggtcctcaagctcctcacgtccctgaagcagatctgcgaccacccggcgctgtacctgaaggaggacgccgggggcacggcgggcctggccgcccggtccggcaagctggccctgctggacgagctgctggacacgctgctgtccgaggacggctcggcgctggtcttcacgcagtacgtgggaatggctcgtctcatcaccgcacacctggcctcgcgcgccgtccccgtcgagctgctgcacgggggtaccccggtccccgagcgggagcggatggtggaccgcttccagagcggtacgaccccggtcctggtcctctccctcaaggcggcgggcacgggcctgaacctcacgcgagccggccatgtcgtccacttcgaccgctggtggaacccggccgtcgaggaacaggccaccgaccgcgcctaccgcatcggccagacccagcccgtgcaggtccaccgcctgatcaccgagggcacggtcgaggaccgcatcgccgagatgctggaggccaagcgggccctggccgacgcgatcctgggctcgggcgagtcgtccctgacggaactgaccgaccgcgacctgtcggacctggtgtcgctgcggaggccgaca

SEQ ID NO: 1967 - DNA, 582 bp, Streptomyces avermitilis
  CDS (1)..(582)
gtgacggccgcctcggtcccccggcagtcctcctcgcccgacgaaccgtcgcgcaccccggaggacccacgccacaggatccgccgccgcgcgctgaccctgctgatcatcgtgctgctcatcggggtaccggccggctatctggtgatctccgccaaccagagccgcgacagcggcaaggacaaggaggagaagtactcggcgaccggcctcaccgcgggctggccctcgcgcgtgcagcgccggctctaccaggtgccgataccggggtggtccagtgacgtcgcctactacgagacgaacaactggaagaccagccgcctgtacgcccagttccgcaccagcaacgaggctctggacacgttcctcgacaacatcggcacgaacaccggcgagctgaagcaggacaagatcgccatcagcgcccgcgaccagcggatcgtcggctgggagttcaccggacccgggccctggtacggcctcgtccaccaccagaaggacccggcgcccacgcaggacatcgtggtgaaccggtccgatccccagcaccccatggtctacgtggtgtcgcgggcggtgccc

SEQ ID NO: 1968 - DNA, 1143 bp, Streptomyces avermitilis
  CDS (1)..(1143)
atgagcacctaccgcgacttcacccaccgcggctccgcgcgggccaccgtcctgcggaccgtggggacccgtgagcgccgttcccatctgacggcgccgcgcgttcccaccgtcggcatcgacatcggcggcacgaaggtgatggcgggcgtcgtcgacgcggacggcaacatcctggagaagctccgcacggagaccccggacaagtccaagagccccaaggtcgtcgaggacacgatcgtcgagctggtcctggatctgtccgaccggcacgacgtgcacgcggtcggcatcggcgcggccggctgggtcgacgcggaccgcaaccgcgtgctgttcgccccccacctgtcctggcgcaacgagcccctgcgcgaccgcctcgccggacgtctcgcggtccccgtcctggtcgacaacgacgccaactccgccgcctgggccgagtggcgcttcggcgcgggccgcggcgaggaccatctcgtcatgatcacgctgggcaccggcatcggcggcgcgatcctggaggacggccaggtcaagcgcggcaagttcggtgtggcgggcgagttcggccatatgcaggtcgtgcccggcggccaccgctgcccgtgcggcaaccgcggctgctgggagcagtacagctccggcaacgcgctcgtccgggaggcgcgcgagctggccgccgccgactccccggtggcgtacgggatcatcgagcacgtcaagggcaacatctccgagatcagcggaccgatgatcaccgagctggcccgcgagggcgacgcgatgtgcatcgagctgctccaggacatcggccagtggctcggcgtcggaatcgccaacctcgccgccgccctcgacccgtcctgcttcgtgatcggcggcggcgtctcggcggccgacgacctgctgatcggcccggcccgcgacgcgttccgccggcatctcacgggccgcggctaccgccccgaggcccgcatcgcccgcgcccagctcggccccgaggccggcatggtcggcgccgcggacctcgcgcgcttggtcgcccgccgcttccggcgcgccaaccgacgccgcgtggagcgctacgagcgctacgagcggtacgtggagtcccgtcgcacgaccaaggagtcgccg

SEQ ID NO: 1969 - DNA, 840 bp, Streptomyces avermitilis
  CDS (1)..(840)
gtgaccgggacggtggagcgtacggcgctcgtggagctggccgacgtcagcaagcactacggcaacatccgcgccctcgaagatgtctccctggaggtccacgcgggcgagatctcctgcgtgctcggtgacaacggcgcgggcaagtcgaccctcatcaagatcatcgcggggctgcaccggcacgacggcggcaccctgcgcatcgagggcgaggacacccacttgtcctccccgcgcgaggccctggaccgcggtatcgccacggtctaccaggacctcgcggtcgttccgctgatgccggtgtggcgcaacttcttcctcggctccgagccgcgcaagggcgtgggcccgttcaagcgcctggacgtcgacttcatgcgccggacgacccatgccgagctgctgcggatgggcatcgacctgcgggacgtggaccagcccatcggcaccctgtccggcggcgagcgccagtgcgtggcgatcgcccgcgccgtctatttcggcgccaaggtcctcgtcctcgacgagcccaccgcggccctcggtgtgaagcagtccggtgtggtcctcaaatatgtggctgccgcacgggacgccggtctgggtgttgtattgatcacccacaacccgcatcacgcctatctggtcggcgaccgtttcgtgctcctgaagcgcggcgccatgttcggcagccacacccgcgaggagatcaccctggacgagctgacccgccagatggcaggcggcagcgagctcgacgacctccggcacgaactcgaacgcgctcccgcgccgacccacctgggcggacaccccagggacgccgcccccggcgac

SEQ ID NO: 1970 - DNA, 1029 bp, Streptomyces avermitilis
  CDS (1)..(1029)
atgaccgccaccaccgcggacgagcggcttctccgcacctcgccgctgcgcaaactcctgggccgccccgaactcggctcggtggtcggcgccgtcgcggtcttcgtgttcttcgcgatcgtcgccgacagcttcctgcgggccgcgagcctcagcacggtcctctacgcgtcctcgaccatcggcatcatggcggtcccggtcgcgctgctgatgatcggcggcgagttcgacctgtccgccggcgtcctggtgacgtcgtcggcgctggtctcgtcgatgttcagctaccagatgaccgccaacgtctgggtgggcgtcggcgtctcgctgctcgtcacgctggcgatcggcgccttcaacggcgtcatgctgacccgcaccaatctgccgagcttcatcatcacgctcggcacgttcctgatgctgaccggcatgaacctcggcttcaccaagctgatcagcggcacggtctccaccaagtcgatctccgacatggagggcttctcctccgcgcacgacctcttcgcgtcgacgttcaccatcggcggcgtcgacttcaaggtcaccatcctgtggtggttcggcctggtcgccgtcgcctcctggatcctgctgcgcacccgggtcggcaactggatcttcgcggtcggcggcaacaaggacgcggcccgcgcggtcggcgtcccggtgaacaagaccaagatcggcctctacatgggcgtcgccctcggcgcctggatctccggccagcacctgctgttctcgttcgacgtcgtgcagtccggcgaaggcgtcggcaacgagctgatctacatcatcgcggccgtcatcggcggctgtctgatcaccggcggctacggcagcgcggtcggctcggcggtcggcgcgttcatcttcggcatgaccagcaagggcatcgtcttcgccgagtggaaccccgactggttcaagttcttcctcggagcgatgctgctcctcgcgaccctgctcaacgcctgggtccgcaagcgcgcggaggccacgaag

SEQ ID NO: 1971 - DNA, 1002 bp, Streptomyces avermitilis
  CDS (1)..(1002)
gtggcacggactcggacctgggcaatcatcgcgctggcaggggcgctcagcgtgtctctcgcagggtgcagcagcaccggcgggaagcgcgccgaggacgcccggaaggccgcgtccgcccagggcaaggccgcggtgaacacgcccagatggaccttcgcgatgatcacccattcgggcgatggcgacacgttctgggacatcgtgcagagcggcgccgagcaggccgccgtcaaggacaacatcaacttcctgtactcgcacaacgccgaggcgcagcagcaggcccagctcgtggacgccgcggtcgacaagaaggtcgacggcatcatcgtcacgctggccaagcccgccgcgatgaaggccgccgtcgcccgcgccgagaaggccggcatccccgtggtgacggtgaactcgggctccgaggagtccaaggcgttcggcgcgctcacgcacatcggccaggacgagaccgtcgccggcgaggccgtcggtgaggagctgaacaagcgcggccggaagaaggccctgtgcatcctgcacgagcagggcaacgtcggccatgagcagcgctgcgcgggcgtcaagaaaaccttcaagggcaccgtgcagaacctctacgtccagggcacgagcatgcccgacgtgcagtcctccatcggcgccaagctccaggccgactcctccatcgactcgctcgtcacgctcggcgccccctacgccgacaccgcggtgaaggccaggaacgacgcgggcagcaaggcggagatcgacaccttcgacctgaacgcgaaggtcgccgccgagctgaaggacggcacgctcggctttgccgtcgaccagcagccctacctccaggggtacgaggcggtggacctgctctggctgtacaagtacaactccgacgtcctcggcggcggcaagccggtgctcaccggcccgcagatcatcaccaaggaccaggcggccaagctggagcagtacacgaagcggggcacgcga

SEQ ID NO: 1972 - DNA, 747 bp, Streptomyces avermitilis
  CDS (1)..(747)
gtggatccgaccgtctcgctccagctcagcgtcgaccgcagcagtccggtcccgctctacttccagctgtcccagcagttggaggccgcgatcgagcacgggacgctgacccccggcagcctgctgggcaacgagatcgagctcgccgcgcggctcggcctgtcccgccccacggtccgccaggccatccagtccctcgtcgacaagggcctgctcgtacgccgacgcggcgtcggcacccaggtggtgcacagccaggtcaagcgcccactggaactgagcagcctgtacgacgacctggaggccgccggtcagcgcccggccacccaggtgctgctcaacaccctcgtgccggcctccgccgaggtcgcggccgcgctcggggtggccgagggcagcgacgtgcaccaggtggagcggctgcgcctggcccacggcgagccgatggcgtacctctgcaactacctgccgaccggactgctcggcctggacagcgagcagctggaggcgaccggcctgtaccggctgatgcgggccgccggcatcacgctgcacagcgcccggcagtccgtcggcgcgcgggccgccacggcggtggagggcgagcggctcggcgagcccgagggcgccccgctgctcacgatgcagcgcaccaccttcgacgacacgggccgggccgtcgagttcggcacccacacctaccgcgcctcgcgctactccttcgagttccagctgctcgtacggccc

SEQ ID NO: 1973 - DNA, 1008 bp, Streptomyces avermitilis
  CDS (1)..(1008)
atgcgcatcggacttatcggagcgggtcgtatcggtacattccacgcgaccacgctcagccgccaccgcgacgtcggctcgctcatcatcacggacgtcgcccctgctcgggcccatgaactcgcggaccgcctgggcgaaaccgcggcgcccggcgtggacgagatcttcacctggggtgtcgacgccgtgatcatcacggccgcgaccgcggcccacgccgaactgatcggccgggcggcgcgctccgggctcccggtgttctgcgagaagcccatcgccgtcgatctgccgggcacgctgtccgcactgtccgaggtggacgccgccggaacgattctccagatgggtttccagcgccgcttcgacgtgggttacacgaacgcgcgggaggcggtgcgctccggccggctggggcggctgcacacggtccgtgcgatgacggccgaccagtcaccgcccccgcccgactacctcccgctctccggcggcatctaccgcgactgcctggtccacgacttcgacatcgtgcgctgggtgaccggccgcgagatcgtcgaggtgtacgcgaccggggccgatgccgggcccgcgatgttccgcgaggcccaggacgtcgacacggccgcggtggtcctcacgctcgacgacggcacgctcgccacggcgacggcgacccgcatcaacggggccggctacgacgtccgcatggaactggcaggtgagctggacacggtcgcggtcggtctggacgaccggacgccgatcgcctccacggaaccggccgggccgccgcccgcggacaagccgtggaccggcttcctcgagcgcttcgggcccgcgtacgaggcggagctggccgcgttcgtcgaggtggtgcgcggcgagcgcgccaacccctgcgacggccgcgaggcactccaggcgctgcgcgtcgcggaggcctgcgagctgtcccggcacgagcggcgcccggtgcagctcggggagatcgcgggcgggcgggac

SEQ ID NO: 1974 - DNA, 423 bp, Streptomyces avermitilis
  CDS (1)..(423)
atgaacgcccccgccaccctggacctctcctcggcccagcaggcgctggacagccagcccttcagccggctgctcggtacgcggatcaccgcgttcggggacggcgcggccacgcttgaggtcggcatccgcgaggaactccaccagcagaacggcttcctgcacggcggagtcctctcctacgccgccgacaacgcgatcacgttcgcgggcggcgcggccctcggcccggcggtcctcaccggcggcttctccatccagtacgtccgcccggctctcggccacaccctcgtggcccgcgccgaggtggtgcacgcgggccgccgccaggccgtcgtccgctgcgacctgctcaccgtgaccgaggacggcaccgaagccctgtgcgcggtcgcccagggcacggtgctgacggccggggcc

SEQ ID NO: 1975 - DNA, 1179 bp, Streptomyces avermitilis
  CDS (1)..(1179)
atggggaatgtgatcgacctgggagagtacggcgcgcggttcacggaggacccgtatccggtgtacgcggagctgcgcgagcggggtcccgtccactgggtgcgcaccccgccgcccgaggcgttcgagggctggctcgtcgtcggacacgaggaggcgcgtgccgccctcgccgacccgagactgtccaaggacggcaccaagaaggggctcacctcgctggacgtggagctgatgggcccctatctgctggtcgtcgatccgccggagcacacccggctgcgcagcctcgtcgcccgcgcgttcaccatgcggcgcgtggaggcgctgcgcccgcgcatccaggagatcaccgacggactgctggacgagatgctgccgcggggccgggccgacctcgtggactccttcgcctacccactgccgatcaccgtcatctgtgagctgctcggcgtgccggacatcgaccgggtgacgttccgagccctgtcgaacgagatcgtggcacccaccggcggcgacgcggagctcgccgcctacgagaggctggccgcgtacctcgacgagctgatcgatgacaagaggtccacggcacccgccgacgacctgctcggcgacctcatccgcaccagggcggaggacgacgaccggctgtccggcgaagagctgcgcgcgatggcgttcatcctgctggtcgcgggccacgagacgacggtcaacctgatcacgaacggggtgcacaccctgctcacgcatccggaccaactggccgcgctgcgagccgacatgacgctcctcgacggcgccgtggaggaggtgctgcgcttcgagggaccggtcgagacggcgacgtaccgctatgcggccgagtcgatggagataggcggtacggccatcgcggagggcgacccggtgatgatcgggctcgacgccgccggccgtgacccggcgcgtcatccggacccgcacgtcttcgacatccaccgcgccccccagggccacctcgccttcgggcacggcattcactactgcctgggcgcaccgctggcccggctcgaagccagggtggccctgaggtcactcctggagcgctgccccgacctggcgctcgacggcccaccgggcgccaggccgccgggcatgctgatacgcggggtgcggcggctcccggtgcgctgg

SEQ ID NO: 1976 - DNA, 669 bp, Streptomyces avermitilis
  CDS (1)..(669)
atgactgcgatccgactgctcctcgtcgacgacgaccccctggtgagggccggcctgtccctcatgatgggcggcgccgccgacatcgagatcgtcggcgaggccgccgacggcagcgaggtggagcaactcgtcgaccgcacccgcccggacgtcgtcctcatggacatccgcatgccgacgctggacggactcgccgccaccgagctgctccggggccgcgcggacgccccgcaggtcgtggtcctcaccaccttccacgccgatgagcaggtgctgcgggccctgcgcgcgggtgccgccggattcgtcctcaaggacaccccgccggcgcagctcctcgacgcggtacggcgggtcgcgggtggtgatcccgtgctctcgcccgccgtcacgcgccagttgatgctccacgcggcgggcggctcccccgacacgcgcagggcgaccgcccgcgaccggatcgccgcgctcaacgaccgcgaacgcgaggtggccgtcgcggtgggccggggcggctccaacgcggcgatcgccgccgagctgtacatgagcgtcgccacggtcaagacccacgtctcccgcatcctcgccaagctcgacctcaacaaccgggtgcagatagccctgctgacgtacgacgccgggctgctggaggcggacgggcac

SEQ ID NO: 1977 - DNA, 1026 bp, Streptomyces avermitilis
  CDS (1)..(1026)
gtgcgttatcgactcttagggcggaccggcctccgcgtctccgagctgttcctcggcgccatgacgttcggcgaacagggcggggtgggtgcgccgaggccggagtgcgcgcgcatcctggacgcgtacgcggaggccggcggcaatgtgatcgacaccgccatcaactaccggggcggggagagcgagacgatcgtcggcgagctgctcaaggggcagcgcgaccggttcgtcctctccaccaagtacaccatctcgcgcgacggcgccgaccccaatgccgcgggcaaccaccgcaagaacctgacgctttcgctggagacgagcctgcgcaggctgggcaccgactacatcgacgtctactgggtgcacatctgggaccggaacaccccgatcgaggagaccgtacgggccctcgacgacgccgtgcggtccgggaaggtgctgtacgtgggcatatcggatgtcccggcctgggtggtgtcgcgggccaacacgctcgcggaatggcgggggtggacgccgttctcggcgctccaggtcccctacagcctgctcaaccgcgacatcgagcgcgaactgctgccgatggccgaggcgttcggcatgtcggtggcggcctggagcccgttgcagaacggcatcctgtccggcaagtacacccgccccggcggcctggagccgggcacggcggcccggttgccggcggaggcgatcggtgaccgcgagcgggccgaggccgaggccgtgcagtccgcggccgacgaactcggcgtctcctgcgcgcaggtggccatcgcctggacgatggcccactcccccgccgtgcacccgatcctcggcgcccgtcgcgtggagcagctcgtggaaaacctgggcgcggccgaactgaccctgccgacggaggtgttggccgcgctcgagagtgcgacggacttccgcgcgggcttcccggcggacttcatcgacgacacgtcggcatgggtgtacggcacggcggggcatcgggtggtggggcgcgccggg

SEQ ID NO: 1978 - DNA, 1437 bp, Streptomyces avermitilis
  CDS (1)..(1437)
gtggacgactttggtcgtcggtcgcgtcggcggggaggtgccggcggccgtccctgcgtaaatttgtcgaccgtgagcagtgacaagccggcgccttccccgggggcgtcgacataccgggccgtgttcgagcggatggtgccggctcggtccggcccgcggccgccggggctgccggagccggccgtgccgctgtcgtacgggctgccccggcagcggtggttcctgccgtccgccgtgatcgcagcgctggacgccggcggcgcggagcgtggccggcatccgcggcgtaccgtgcgggactggatcgtcgacctcggctgcgtcctgctggccgtggtcatcgggatcgccgccgcggaggcggtgacccgggagcacgacatcccgcacggcctggccgtcgccgaccaatggctcggcgcgtcggcctgtgcggcggtgtggctgcggcgccgccggccgctcgggctcgccgtggcgatgatgccggtcgggctgatctcgaacaccgcgggcggcgcgggcctgatcgccctcttcaccctcgccgtgcacctgcccttccggtacgtcgcgtgggtcggcggcatccagctcgcgctgctcccgggcgtctactggctgcgcccggaccccgatctgccctatgtcgccgccgtggccgtcgccgggctgctgaccgtgacggtggtcggctgggggatgttcgtacgatccaagcggcagctcgtgctgagtctgcgggaccgggcgcggcgcgccgagacggaggcggagctgcgggccgagcaggcgcagcggctggccagggaggccatcgcgcgcgagatgcacgacgtgctcgcccaccggctgacgctgctgagcgtgcacgccggcgcgctggagttccgccccgacgcgccccgggaggagatcgcgcgggcggccggggtgatccgggagagcgcgcacgaggcgttgcaggacctgcgggagatcatcggcgtgctgcgggcgggcgacgccgacgacgcgggccgcccgcaaccgacgctcgccgccctcgacgggctggtcgccgagtcccgcgaggccggtatgaagatcgtcctcgaccaccgggtgaccgcccccgccgcggtccccgcctccatcggccgcaccgcgtaccgcatcgtccaggagggcctgacgaacgcgcgcaagcacgcgcccggcgccgaggtcacggtgaccgtggcgggcgccccgggcgacggcctcaccgtctccgtgcgcaatcccgcgccgccgggcgacgtaccccatgtccccggctccggtcagggcctgatcggcctcatggaacgcgcgaccctggcgggcggccgactcgaccacggtgcggagggcgacggcgggttcgggctgcgggcttggctgccgtggccggggccggggccggatccccgg

SEQ ID NO: 1979 - DNA, 393 bp, Streptomyces avermitilis
  CDS (1)..(393)
atgagattccccccacgaatcactcgtatcagcgccgcagccgcgctcctgtccgccctgctcgtgggcggcacggtctccgcgacgaccgcggatgccacggccgcctcggtcggcagcatctgctacagcgacctgccgtcccaggcgtacgacacgctcgatctgatcgagtcgaacggccccttcccgtactcgcaggacggggccgtcttccagaaccgggaaggcgtcctgcccacgcagtccagcggctactaccacgagtacaccgtgaagacgcccggctcctcgacgcgcggtgcccgccgcatcgtcacgggcaagcagacccaggaggactactacacctcggaccactacgtcacgttcgacctgatcgacttcgactgc

SEQ ID NO: 1980 - DNA, 903 bp, Streptomyces avermitilis
  CDS (1)..(903)
atgtcgtcgatcgccgtacccggcgcgctcgcgccccgccgtgcctggctcaccgacctgcccgtgctgctcgtcgcggtggtgtggggagccagctatctcgcggccaaggacatcaccacggcgcggacggtgatcgccgtcctggtgctgcgcttcggcgtcgtcctgcccgtgctggtgatcgccggacggcgttcgctgcgcgcgctgagcgccgcgcagtggcgcggggcggcgctgctggggctgatcctgagcgggatcttcctcctggagacgtacggcgtcgtccacacctcggcgaccaacgcgggcctcatcatcagcctcaccatgatcttcacgccgctcgccgaggcggccgtgacccgggcgcggcccccgcgggccttcctcgccgcggccggggtctccgtgctcggcgtcgtgctgctcacccagggcggcgggttcacccgcccctcgctcggcgatctgctgatgctgctcgcggccctcgcccgcaccgtccacgtgctcgccatgtcccgcgtcaagtccgttcagggcgccgacgcgctgcccctgaccacggtccaactgggtgccgcggtcgccgtgttcgcggtgctctcgaccggcaccgacgcgaccgtgtggggcacggccgcgggcttcggggcgcgggagtggggcgggctgctcttcctcgcggcgttctgcacgctcttcgcgttctgcgtacagatgtgggccgtacgccggacctcgccgtcccgggtcagcctgctgctcggcaccgagccgctgtgggccgccgccgcggggatcaccctcggcggcgaacgtctcggcgcgttggggctgatggggggcgttctcgtcctcgcggggaccgcgtgggggcgccgggcggcaggt

SEQ ID NO: 1981 - DNA, 606 bp, Streptomyces avermitilis
  CDS (1)..(606)
atgggcaagctcaccctcaccgcttttgtcaccctcgacggtgtccaccaagctcccggcggacccgaggaggaccgcagcgacggcttcgagcagggcggctggagcgtcccgtacggggacgaggacttcggacggttcgtgaccgacgccttcgcccgcgtggacgccttcctgctcggcaggcgcacgtacgagatcttcgccggctactggccgaaggtcaccgaccccgccgacccgatcgccgccaagctcaactccctgccgaagtacgtcgcctcgtcgagcctcacggaccccgcctggtccggtacgaccgtgatccgcggcgacctcgccaaggaggtcgccgccctcaaggagcgcaccgcccgcgagctccaggtccacggcagcggtgccctcgcccggtccctcctcgcgctcgatctgatcgacaccgtgcacctgctgaccttcccggtcgtactgggggccggccgccgcctgttcgccgagggcgccgtccccaccgcgttccggcacgtctttggcagcaccacgggcgcgggcgtggcgatccacacgtacgaacgggcgggccgtccgacgtacggcagctac

SEQ ID NO: 1982 - DNA, 1005 bp, Streptomyces avermitilis
  CDS (1)..(1005)
atgatcgtttcggtggtgtcgatgccggagggcgtcgtcgctcgcacggggctgacacaggcccgggagcatctcgcgtcctcccgtttcgtgatcgtggacgtcgaccaggaagaagaacccccgctcgacgacgagccgctctcccgtcggctcgggctggatgacgcggcctggaagtggctcggcagaccggacgagcacgtccgggtcgagtaccacgcgggcacggccgccggcgtcgtgccggtggtctgcggcaaccaggtcatccacatccacgtcctggccggcgatcggcacttcatcacgattcatcaggggcccgtcgaactgatcgacaccttcatcggccagttgccgcaggaccggccccccgacgcggtgacgacgctgttcctgtttctgcaaggggtcctggagacgtatcgccgggccatcacgcaggcccatctggaggtcgaggacctcgaggaagcgatgttcgagcaacggcagccggagcaggtccgtcggctggcccagctgcgacagcgcgcggcccacctgcaccgcgcgttcctgccctacgccgcggtcgcgcaggagatcctcgtacgtcgcaggatggcggatcacgacctctcggcggaacggcaggcgatgaaccgcctgcacgagcacaccgtgcagctggtgctcgtggagatcgaggcgctgcgggacgcggcccggcgagccgcgagcagctacgcgtcactcatcgccgatcagcagaacgtcgtgatcaaccggctcaccatcgtctcgatgatcttcttgccgctgtcgttcctgaccggattcttcggcatgaacttcgccttcctgaccaaccggctcacgagcgaggactccttcctggagttcggcgtgggtcttcaggtgggtgcggtgatcgtcgccctgtactacgtgctgtaccgcacccactggcgtcagctgcgcgacagccgggcccgcgacgccgccggcgacgaccagccc

SEQ ID NO: 1983 - DNA, 1128 bp, Streptomyces avermitilis
  CDS (1)..(1128)
gtgacggcgcagcatccatccccttcggcccgcttcaccggcgacgcgaacccctacggaggcggtgacccgtacgcggactaccgcaccgccgacttccccttcacccagtacgccaacctcgccgaccggcagctcggcgccggtgtcatcgccgccaacgacgagttcttcgcccagcgcgagaacctcctcgtggccggacgcgccgagttcgaccccgaacacttcgggcacaagggcaagatcatggacggctgggagacccgccgccggcgcggcgcctcggccgcacacccgtggccgacggccgaggaccacgactgggcgctcgtacgtctcggcgcgcccggcgtcgtacgcggcgtcgtcgtcgacacggcccacttccggggcaactacccgcaggcggtgtcggtcgagggcgcctcggtacccgggtccccgtccccggaggaactcctcgcgggcgacgtgaagtggatgacgctcgtcccgcgcacggcggtcggcggccacgcggcgaacggcttcgaggtgtcggtggagcagcgcttcacgcatctgcgggtcaaccagcaccccgacggcggcatcgcccgtctgcgggtgtacggcgaggccgtgccggaccccgtgtggctggcggcgctgggcaccttcgacgtcgtggccctcgagaacggcggccgggtcgaggacgcctcgaacctcttctactcacccgccacgaacacgatccagccgggccgctcccgccagatggacgacggctgggagacgcggcgccgccgcgaccacggcaacgactggatccgctaccagctggtcgcccggtccgagatccgcgcgatcgagatcgacacggcgtacctgaagggcaacagcgccgggtgggcggcggtgtcggtgaaggacggtgagagcggcgagtggacggagatcctcccgcgcacccgcctgcagcccgacaccaaccaccgcttcaccctggccgcgccggtggccgggacccacgcgcgcgtggacatcttcccggacggaggcatctcccgcctgcgcctgttcggctccctgacggaggagggcgcggcgcgcctgacggccaggtaccaggagctcggcggc

SEQ ID NO: 1984 - DNA, 1335 bp, Streptomyces avermitilis
  CDS (1)..(1335)
gtgtccgacgtcgaactggtgctgcgctcgacgcgcgtcatcactcccgaggggacgcgccccgccgcggtcgcggtcgccgcggggaagatcacggcggtgctgccgcacgacgccgaggtgccggccggcgcccgcctggaggacctcggcgacgacgtgctgctgcccggcctggtcgacacccacgtgcacgtcaacgaccccgggcgcacccactgggagggcttctggacggcgacgcgcgccgcggccgccgggggcatcaccaccctggtcgacatgccgctcaactccctcccgccgaccacgacggtcggcaatctgcgcaccaagagggacgtggccgccgacaaggcgcacatcgacgtcggtttctggggcggcgcactgcccgacaacgtcaaggacctgcggccgctgcacgacgcgggcgtcttcggcttcaaggcgttcctgtcgccctcgggcgtcgacgagttccccgagctggaccaggagcggctggcccggtcgatggccgagatcgccggcttcggcggactgctcatcgtccacgccgaggacccgcaccacctcgccgccgccccccagcggggcggccccaggtacaccgacttcctcgcctcgcgcccgcgcgacgccgaggacaccgctatcgcgaacctcctcgcgcaggcgaagcgcctcaacgcgcgcgtgcacgtgctgcacctgtcgtcgagcgacgcgctgccgctgatcgccggcgccaaggccgagggcgtacgcgtcacggtggagacctgcccccactacctcacgctcacggccgaggaagttccggacggggccagcgagttcaagtgctgcccgcccatccgtgaggccgccaaccaggacctgctgtggcaggcgctggccgacggcacgatcgactgcgtggtcaccgaccactcgccctccaccgccgacctgaagaccgatgacttcgcgacggcgtggggcgggatctccggactccagctcagcctgcccgcgatctggaccgaggcccggcggcgcggccacagcctcgaggacgtcgtccgctggatgtccgcacggacggcccggctcgtcggcctggcccagaagggcgccatcgaggcgggccgcgacgccgacttcgcggtgctggcgcccgacgagaccttcaccgtggacccggcggcacttcagcaccgcaaccgggtcaccgcctacgccggcaagaccctcagcggcgtcgtcaagtccacctggctgcgcggcgaacgcatcatggctgacggcgagttcacggagccgaagggccggctcctcagcagggaaccg

SEQ ID NO: 1985 - DNA, 801 bp, Streptomyces avermitilis
  CDS (1)..(801)
gtgccgacgtccagcgccagcaccaccgactccgccaagtcgcccgccccgagcggtggtgtccagtccctcgagcgcgccttcgacctgctcgaacggatggcggacgccggtggcgaagtcggcctcagcgagctgtccgcgagcagcgggctgcccctgccgaccattcaccgcctgatgcgcaccctcgtggcctgcggttacgtacgccagcagcccaaccgccggtacgccctcggcccccgcctcatccggctcggcgagtccgcgtcccggctgctcggcacctgggcccgcccctatctcgcacgcctggtcgaggagaccggcgagacggcgaacatggcgcttctcgacggcgacgagatcgtctatgtcgcccaggtgccgtccaagcactcgatgcgcatgttcaccgaggtcggccgccgggtgctcccgcactccaccggcgtgggcaaggcactgctcgcgaacacgccggcgaacgaggtgcgcgcgctgctggcccgtaccgggatgcccgccgccacggagaagacgatcaccactcctgacggcttcctcgccgcgctcgaagaggtgcgccggctcggctacgcgatcgacgacaacgagcaggagataggagtccggtgcctcgcggtgtccgtaccggactcgccgaccgccgcggccatctccatctccggcccggcgggccgggtcaccgaggaggcgacggagaagatcgtgccggtgcttcagcaggtggcggcggagctttcggaggcgctggcgacttcggggccgacggcc

SEQ ID NO: 1986 - DNA, 492 bp, Streptomyces avermitilis
  CDS (1)..(492)
gtgcgctcgaacccgcgcggaccgggtgatgtccatggactgaatttcggtcctcggagtggcgcccaccacaccgggtggcgtttactgacccggttccccggcgcccatcgtcggcgcggggaactgagcgacgtacgaaggacattcgcacaacggcgtgcgagggggagagctgtgttgcggagcttggggcagaggccagtgaccggcagcgacgaggacccgagggtggcagggctgcggaccgccgtgtcccggctgcgccgcgaactcgccgcgcatcccgtcgagttccccgaccggggcatcgccgaggacgaactggccgcactggcggcgatggccgtcggcggagtccccgagatcccgcggttacgccgctcactgctgctgatcgccggcgcgatcggctcggtcagcgcgctggcccggggcctcgcggacgtacgcggcgcggtggagctgttcggggaaccaccgaggcgcggc

SEQ ID NO: 1987 - DNA, 597 bp, Streptomyces avermitilis
  CDS (1)..(597)
atgaccgagaacgaggacctggtggcggggctcctgctggcggccggtggcgggcgtcggctcgggggccggcccaaggcgctcctggaacaccgagggcgcccccttgtcgaacatgtggccggagtgctgcgggcggccggatccacccgcgtgtatgtcgtcctgggcgcccaggccgccgccgtacgggagcgcgcggtgctgcccggctgcatcctcgtggacaacccggactgggagctgggcatgggcacctccctgcgggccgggctggaggcgatgcatggaacgggggtacgcgccgcgctggtgtcgctcgtcgaccagccggggatcggaccggcggcggtggcccgggtacgggcggcgtacacgtccccctcgaccctcgcctcggccgcgtacgacggagtgcgcggccaccccgtcctgttcggcgccgcccactgggcggccgtcgccgcgagcgcgaccggcgaccggggcgcccgcgcctacctcaaggcccatgagtccgcgatcacccttgtcgagtgcggggacgtggccgaggcgtacgacatcgacacggtcgccgacctcgtccacctggag

SEQ ID NO: 1988 - DNA, 1623 bp, Streptomyces avermitilis
  CDS (1)..(1623)
atgtccgcaccagcgccgtccccgctggccctcgtcgacgccgagcccctgccccggcaggaagaggtcctcaccgacgcggccctcgccttcgtggccgagctgcaccggctgttcacgccccggcgtgacgagctcctcgcccgtcgcgcgcagcgccgcgccgagatcgcccgcacctccacgctcgacttcctcccggagaccgccgccgtccgcgcggacgagtcctggaaggtggcccccgcgccggccgcgctgaacgaccgccgcgtcgagatcaccggccccaccgaccgcaagatgaccatcaacgccctcaactccggcgcgagggtgtggctcgcggacttcgaggacgcctccgcgcccacctgggagaacgtggtcgtcgggcagctcaacctgacggacgcgtacacgcggaacatcgacttcacggacccgaagtccggcaagtcgtacgccctcaaggcgaatgaggagctggcgaccgtcgtcatgcggccgcgcggctggcacctgaacgagcgtcatctcgtcgactcgcagggcaggcccgtcccgggcgcgctcgtcgacttcggcctgtacttcttccacaacgcgcggcgcctgctggacctcggcaagggcccgtacttctacctccccaagacggagtcgcacctggaggcccgcctctggaacgacgtcttcgtcttcgcgcaggactacgtcggcatcccgcagggcacggtccgcgccaccgtcctgatcgagacgatcacggccgcgtacgagatggaggagatcctctacgaactccgcgaccacgcctccgggttgaacgcgggccgctgggactacctgttctccatcgtcaagaacttccgtgacggcggcgccaagttcgtcctgccggaccgcaacgcggtcacgatgacggccccgttcatgcgcgcctacaccgaacttttggtccgcacctgccacaagcgcggcgcgcacgcgatcggcggcatggcggcgttcatcccgtcccggcgcgacgaagaggtcaacaaggtcgccttcgagaaggtcaaggccgacaaggaccgcgaggcgggcgacggcttcgacggctcctgggtcgcgcaccccgacctcgtcccgatcgcgatggcgtccttcgacgcggtgctcggcgacaagccgaaccagaaggaccgcctccgcgaggacgtgtccgtggcgcccggcgacctgatcgccatcgactccctggaggccaagccgacgtacaacgggctggtcaacgccgtgcaggtcggtatccgctacatcgaggcctggctgcgcggcctcggcgcggtcgccatcttcaacctcatggaggacgcggccacggcggagatctcacgttcgcagatctggcagtggatcaacgcgggcgtcgagttcgagaacggcgagaaggccactcccgagctggcccgcaaggtcgccgccgaggaactcgcgaacctccgcgccgaactcggcgaggaggccttcgcggccgggaactggcagcaggcccacgacctgctgctgaaggtggcgctggacgaggactacgcggacttcctcaccctgcccgcgtacgaacagctcgccggc

SEQ ID NO: 1989 - DNA, 297 bp, Streptomyces avermitilis
  CDS (1)..(297)
ttggtcggtgcacctcggatgaccaccccgcacactcatcgcgtccagatcgagtactgcacccagtgccgctggctgccccgggcggcctggctggcccaggaactgctcacgacgttcgagaccgagctgacggagctggcgctcaagccgggcaccgggggcgtcttcgtcgtccgcgtggacgacgaggtggtatgggaccggcgggagcagggctttccggagccgacggccgtgaagcggctcgtacgcgaccgagtggccccggagaagtccctgggccactcggagagg

SEQ ID NO: 1990 - DNA, 912 bp, Streptomyces avermitilis
  CDS (1)..(912)
gtgctgcgcgaagtgactgccgttcgatacgtgaccccgttgcgggcgggcggctccgtccccggagtcgtcgaggccgacgacctggggacctacgtcgtgaagttcaccgcctcggcgcagggccgcaaggcgctggtcgccgaggtgatcgtcggcgagctggcgcgccgcctcggactgcgctttcccgagctcgtcctcgtccacttcgacccgacggtcgccgagcacgagccgcaccaggaggtccaggacctcctccacgccagcgccggagtcaatctcggcatggactacctgccgggcgccgaggacttcaccccggagatcgcgaagaccttcgacgtcgacccgctggaggccggcaaggtgatctggctggacgccctcacggtgaacgtcgaccgcacggtgcacagctcgaacctgatgatctggcccacgttcggcatcgcgcccccgaggctgtggctgatcgaccacggcgccgccctcgtcttccaccaccggtgggacgcctcgtccccggagaaggcgtacgacttccgctcgcacgcgctcggtggttacgcccccgacacccgtgccgcggacgccgagctggcaccccgggtgacggaggagctgctgcgtgaggtgctggcggaggtgcccgacgcctggctggccgacgaaccgggcttcgacacccccgacgacgtacgcgccgcctacgtcggctacctcgccgcccgcgtcagggcctccgggacctggctccccacggacttccccacccgagaacaactcaccgccgaggacgcccatcgcgcggcgaagacccgggcgggccgccccaactggctcaaacgggtcccggacctgcacggcaaaccggcggctgaacaggattggtcggtgcacctcgga

SEQ ID NO: 1991 - DNA, 1515 bp, Streptomyces avermitilis
  CDS (1)..(1515)
atggaacgaatggatcgcgtggaccccatgatcccgatgtcccccggggacgacgtcggaccggccgccgacgcctatgcggacgcgccgctgctgaactgtctgctgcgggaaatgggggaacccgccggcgatcagggcgtgtaccggctgcgctccggcggcaggctgctgcgcgtacgcggggaccgccgcccccgcgaccccgaggtgtacgcaggcggcgcctggcaccggctgacccatgccgagctggtgaaactcgtcgccgaggaactgcgccggggcaccggtctgtccaattccgagctgcccggcgagatggtcgacagccgggacgcggtggccgcgctgctcggcgcgcgcgcccgcgcgacgccgccggacgacccgtatctgcgctccgaacagtccctgatcaccggccatccccaccatccggcgcccaaggcccgcggcggcggccccgtcaccggatggctgccctacgcgcccgaggcgtacgcccgtttcccgctggtcctgctgggggtgcgcgcggacacggtcgtggaggagggcgacaccacggcgctcgacgcgctcgccgaggccccgcccggctaccggctgctgcccgcccatccctggcagctggacctggtcggcgcccgcccggagatccgcgacgccttcgcggacggccgcctcgtacggctcggccggaccgggtgtgccgtctggccgacggccgccgtccgcacgctgtacgcgcccgaggcggacctcttcctgaagttcagcctcgatgtgcgcatcaccaacgacgtacgccggctgtggcgccacgacctgctgaaactccgccgcacggacgaggcggcggcgaacgccttcgccgcggcgcgcgggcccgcggcgtggctgagcgaccgcggctaccgcaccgccggcttcgccttcgaggaactggccgtcctcgtccgcgacgggctcgccccccatctcctgcccggtaccaccccgctcctcgcggccgccctggtggagggcttcgacggcaacccgctcgaccggctcgacgatccgagggcctggtgggcggcgtatctgcgccaggtggtgccgccggtgctggacgcgttcgcccgccacggggtcgtcctcgaggcgcacctccagaacacgctggtcgccgtggacgccgacggcatgcccgtccaggcgctcttccgggatgcggaaggggtgaagctgctgcccgacgtgagccgggcggccggctgggagcggctcgtgtactgcctggtcgtcaaccacctcgccgagctcgcggccctgctcgccgaacgccggccgggaacggacccgtggccggcggtacgacgggaactggcgcgccacgacctccccgaagtcggagaactgctggcctcacccacgctccccggcaagacgaacctcctcctgcggtggacgggcgcggacggtgcggacgcccgctatctgccgctgcccaaccccctggcccgcgca

SEQ ID NO: 1992 - DNA, 1506 bp, Streptomyces avermitilis
  CDS (1)..(1506)
gtgcaccgtcccgccaccgcagagtccgagctcgccgccgagctcgacgccgtacggcccggcctgtcggcgccgtacgcggccgcgctcccgggcgcccgtgcggccgtcctgacccggctgtggcgggcgctggcccatgagccgctgccgtggatcgcgcaccgggagccggagcccggcggactcacgctgcggctggccgacggacgccggctgcacggcccgccctcggacccgtacgcgaccgctccgtacgtcaccggcgtgcggctcgacgagacgtcgtacgcgcatccggcccggctggtgtcggcgctcggcgtcccgcacggcccggccctggccgccgaactcgaccacagtgtcgcctcgttggccctgtcgcgggccggtcagccgcgggtcgacccgaagtcgccgacgacgagctgggagtgggaacagcgggtggtcgacgggcatccgttccaccccaactgccgttcccggcccggcttttcggccgccgagcagctcgcttacgggcccgagcaccggccggtggtgcggctgggcctcgtggccgtggaggagtgtctcgtccggggcgagtggcccaagtggctgcgggacggggagcgcgtgctgattccggtccacccctggcagacggcacacgtgctcgacgcaccggtggaggacgggccggccgcccacccgctgatgtccttgcggaccctcgcgctccgcgacggcggcccggacgtcaagaccgcgctcagcgcccggctgacatcgtccgtgcgggacatctccgtgtactcgatcgagacgtccgcgacggtgtcggagttcgccgaggccttcgccgcccgcacggacggcctgctgcacatcacccgcaccctgggcgcggccacggccggccggcccgagctggccgcggtggtacgcgagtccccggacacgtacgccgacgcggaggcggcggaacgtgtcgttccggtggcctcgctcaccggtaccgggctgcccggctctcccgcgtggctcgccgagttcacccggctcacgctcaccgtgggtctgcggctgctcgacctgggcgtggccctggaggcgcacggccagaacctcctggtggtcctgtccgccacgggtgccccgctgcgcctcgtgtaccgcgacctcgccgacatccgcgtcagcccggcccggctggcccggcacggtgtcccgctcccggatctcggcgggcgtctcgtcacggacgacgaaaccaccctgcgccgcaaactgttcggctccctcgtcgcgggcgcgctggcggcgacggcggggtcggggccggcgctgcgggaggcgctcgccgccgcggcgcgggatctgccgcgcacccccgatctgacggcgctgctcgaagagccgctgccggccaaggcgttgacgctgatgcggctgtcgcccgaccggccgggggacagctgggcacagctgcccaacccgctcgtcacgcgcgcgttc

SEQ ID NO: 1993 - DNA, 1260 bp, Streptomyces avermitilis
  CDS (1)..(1260)
atgatcacaagacaacggctggcggtggggctctgcgctctgctcgccgccctgacggccgggttcgccttcccggccggcgccgtcgccgacgagacgacagccgacgcgcccaaggtggacctcgtcctcgacgtcagcggttccatgcgggcccgggacatcgacggcggatcccggatggccgcggcgaagcaggcgttcaacgaagtgctggacgcgacgcccgaggaggtgcggctcggcattcgcacgctgggcgccaactacccgggcgacgaccgcaagacgggctgcaaggacaccgcgcagctgtacccggtctcgacgctggaccggaccgaggccaagacggcggtggcgacgctctcgccgaccggctggacaccgatcggcccggccctgctcaaggcggccgacgacctcgacggcggcaccggctcgcaccgcatcgtcctcatcaccgacggcgaggacacctgcgcccccctcgacccgtgcgaggtggcccgggagatcgcggccaagggcgtcgggctcaccatcgacaccctcggtctggtgccgaacagcaagctgagcaagcagctcagctgcatcgccgaggcgaccggcggcacgtacacctcggtggagcacaaggaggacctcaccgacaaggtcaaccagctggtggaccgcgccgccgacaaggtggtgacgccggtcgccgtggacggcgccgccgactgcgcgaaggcgccgacgctgaagtccgggctcttcacggaccgtgcggagttcgcccagcaccgctggtaccgcgtggacgtgaagccggggcaggagctgcgcgcctcggtgagcctctccgccgaccgtcaggtgaacccggactacggggtgttgctgcgggcggtgaccgtgcacaaccgtgagatcgtccgcggtgaggccgcgggcacgggccgtacggacgtcgtgtcgacgggtctgcgctatccgaaggccgagagcgacgacgaggacgccaccgccgagacggtgtgtctccaggtctcccactccttctcgccggccgccggcgtgaagaccacgcccggactgccgctggagctgaccgtcgacgtggtggacggacccgaccaggcgggcgacgtggcctcgttcggcctcgggcgcggctggtggctgctcggcgccctggtgctgaccggcttcctcgcgggtctgctgtggggctggctgtcgcgctggcggttcgcggtctggaggaccaac

SEQ ID NO: 1994 - DNA, 843 bp, Streptomyces avermitilis
  CDS (1)..(843)
atgcgtatctcacgtgtactgaagtcaggtgtccggaactcgggtgtcctggtcgcggcgggtctgctgctcggcgccgccgtggcaccggccgtcgccgactcctcgccgtccgcgagcccctccggggacagtgccgcgcccacctcggcgggcacctcgttccgtaccgcgaccgagatcgcgcaggggcagcgggccacggccggcggctccgcgggcgactacctgtactggtcgttccccgcggacaccggtctgcggcccaccgtgaaggcgacggtgaagttcccgcagtccgccgagcgcggcgcgagccagacctggcagctcgacgtctacgacgggctgcggcgccgccaggcgtgccagtacggggcgcagacgcggacggccgcccaggacgcgacctccgtcgacctgtcctgcacgctgcgcacggtccgcgcgtggtcggagccgtgggccgatgatccgctgccgggcacgtactacgtccggctgaccctggtcgacgtggcgacgggcgacctggggctgccggtgagcgcggaggtccaggtggactccaaggacatcggcggttcggcggcggtcgacgggtcgctgtcccagccgctggtgccggggatcgcgacggcctccgacacgtcggacgagggatcggactcggccaaggcctcgctgttctcactggagcccgacgacggctgggcctccggctggtggaccgaccgctgggtgtggacggcgatcggcggcatcctcgcggcgctcgccggaatcggcgggtacgcgctgacgaagggctcgggccggcccaggcaggtaccaccgggcgcg

SEQ ID NO: 1995 - DNA, 654 bp, Streptomyces avermitilis
  CDS (1)..(654)
atgtctagactgcgtcgcatgccacctcgccgaagctacgaccagtactgttccgcggcccgagccctcgacgccgtcggtgaccgctggaccctcctgatcgtccgcgagctgctcggcggcccgcgccgctacaccgatctgcacgcggacctgccgggtgtgagtaccgacgtactggcgtcccggctgaaggacatggagcgcgacgggctgacgacccggcgccggttgccgccgccgggtgcggtgtacgtgtacgaactcaccgggcgcgggcgtgagttgctgcccgttctccaggcgctgggcagctggggtgcgcccgcgctggcggagcgccgggccacggacgcggtgcgcgcgcactggttcgcgctgccgttgctgcgctcgctggagggggacggccttgccgtcggcctgctcgaaatccgcctggaggaagggcggttccatctgcacctgggtgcggcggagggcccggcgtacggcgagggaccggcccccgaggagcccgacgcgcgtctggtcatcgacgcggacacctgtatggccctgagccgtgagactttgacgctccatcaggccgtacgggagggccgcgccgagatcacgggcgagagcgcgctcgccaagctgctgcgcggcgac

SEQ ID NO: 1996 - DNA, 1206 bp, Streptomyces avermitilis
  CDS (1)..(1206)
atggagttccggcagtcgagcaagctcagcgaggtctgttacgagatccgcggcccggtgatcgagcacgccaacgcgctggaggaggcgggccacagcgtgctgcgcctgaacaccggcaaccccgcgctcttcggcttcgaggcgcccgaggagatcctccaggacatgatccggatgctcccccgggcgcacggctacaccgactcgcgcggcgtcctctccgcccgccgcgccgtggcccagcgctaccaggaccgtggcctggaggtcgacgtcgacgacgtgttcctgggcaacggcgtctccgaactcgtctcgatggccgtacaggcgctgatcgaggacggcgacgaagtcctcatcccggccccggacttccccctctggacggccgtcaccacgctcgcgggcggcaaggcggtgcactacctctgcgacgagcaggccgactggtacccggacctggcggacatggccgcgaagatcaccgaccgcacgcgcgccgtggtcatcatcaaccccaacaaccccaccggcgcggtctatccgaaggagatcgtcgagggcatcctcgatctcgcccgtcggcacggcctgatggtgttcgcggacgagatctacgaccagatcctgtacgacgacgccgtgcaccactcggccgccgccctcgcgcccgacctggtggtcctcaccttctgcggcctgtcgaagacgtaccgcgtggccggcttccggtccggctggctggtcgtcacgggccccaagcagcacgcccgcagctatctggagggcctgacgatgctcgcctccatgcggctgtgcgcgaacgcccccgcccagtacgcgatccaggccgcgctcggcggccgccagtccatccaggagctgaccgcaccgggcggccggctgtacgagcagcgcgaccgcgcctggcagaagctcaacgagatcccgggcgtctcgtgcgtgaagccgaagggcgcgttgtacgcgttcccgcgcatcgaccccaccgtgcacaagatccacgacgacgagaagttcgtcctggacctgctgctgcgggagaagatccaggtggtccagggcaccggcttcaactggccccgccccgaccacttccgcatcctcacgctcccccacgcggacgacctggacgcggcgatcagccggatcgggcggttcctgagcgggtaccggcag

SEQ ID NO: 1997 - DNA, 597 bp, Streptomyces avermitilis
  CDS (1)..(597)
atgggtgaccttctcctcgtacggcacggtgagaccgagtggtcggtgtccgggcggcacacggggtcgaccgacattccgctcaccgagaacggacgggagcaggcgcgcaggctggctccgctgatcgcctcgcaccacgtcggggccgcgttcgtcagcccgatgcggcgggcgcgggagacggcgcggctggcggggctcgacggggcgcgcgtcgacgcggacctgagcgagtgggactacggcgggtacgagggggtcacgaccgtcgagatccaccggacccggcccgactggttcctgttcacggacggggtcgagcccggcccgccggagcaccccggggagagtccggaggaggtcggggcgcgcgcggagcgcatgctggccaaggtcgacgcggcgctcgccgacacggagggcagtgtcgtcgtggtctcccacggtcacttcctccgcgtgctggccgcgcggcggctggggctgcccgcctcgggcggcgccctgttccagctcgcgaccggaacggtgagccggctgagcacggagcaccgccgccatgtggtggccagctggaatgtcagaccctcctcg

SEQ ID NO: 1998 - DNA, 624 bp, Streptomyces avermitilis
  CDS (1)..(624)
gtgcgcggctccgcgtgctcgccgacctgccagcccgccttctccagcgtggccgcgcaggcgcgcaacgcctccgggtccggctcctgtaccgcgaccgcctccggctggggagtcgcgcgcacccggtacccaccaccgtccgtgcctgccggccggtgccccgcggcctccagcgcgagcgcggcggcctgcaccagatgcgcacgctcccacccgcacggacggtcgacggcaccgtccgggctggtcatccggcgcaactccaggagcccctgccaggcactgtgcacctcgcggaggcgggaagggccggcctcgccctcctcgccgccgatccgcgcggcgaacacgccggacccggcctcggccggcgcgggtgtctcgacgaccggctcgggagcttcacgtatgcgatgcccggcgggcgtcagaaagtggtcgtgcggcggccgcggatgccggaaggcgagtcctcgcttcaccagggcggcgagctgggcctcggtccccttcagtcgcccggtgacgggatcggcggcctcgatgacgcgccgctgcgcggcggtcggcggtcgggtcacggcggcgctccttccttcgtcctctcggcgggcggcctgc

SEQ ID NO: 1999 - DNA, 420 bp, Streptomyces avermitilis
  CDS (1)..(420)
gtggcagagccgttttccgtagcagtgactgtccgcgggtacgagaccgatgtgcagggacacctcaaccagagcgtgtatctccagtacgcggagcacgcccgctggtcgctgctgcacgcggccgggatcagccagacggagctgacaggcaagggcgtgggtccggtgaccctggagaccaccatccgctacaaacgggagctgcgcgcgggggacgaggtcgaggtgacgtgcggcttcgtctggggcgagggcaagagcttccgcgtcgagcagacgatccggaagacggacggcacggtgtccgccgagctgacggcggtcggcggactgctggacctcaaggagcgcaggctggtcgcggacccacgcgagtacttccgcgcactggccgccgacccgggtttgttcgacctc

SEQ ID NO: 2000 - DNA, 399 bp, Streptomyces avermitilis
  CDS (1)..(399)
atgtcccaagggaacaccgctgttacggcgcaggtcgtgaacgcgcacgcgtgccccgtccgcgaagttcttgacagggtcgccggcaagtggagcgtgcagatcatcgtcgcggccgcgcacgggccgatccgcttcaccgagctggagcgcagcatcgagggcatcagccggcggatgctcacgctgaccctgcgcaacctggagcgggacgggctcgtgacgcgcaccgtccattcgacggtgccgccgaaggtcgagtacgaactcaccccggtggcaggggagttgcacgcgaccctgctgtcgctgacggactgggccgagcggcaccgggtcaccgtcgcacagtcgcgcgcggcctacgacgcccggcaccggccggaactgctggatggg

SEQ ID NO: 2001 - DNA, 1458 bp, Streptomyces avermitilis
  CDS (1)..(1458)
atgtcgttcctgatcgagtcccgcacgcgacagcgacagcgaacgccctcccggtgggcgtccctggtcgtcctgtgcgcgggtacgttgatgacggtcctggacggcaacgtcgtgaccgtggccatgcccgcgatccagggcgacctcggcttttcgggccctgggctcgcctgggtggtgaacgcgtatctgatcccgttcggcggactgctcctgctggtcggccgcctgggcgacctcgtgggcggcaagcggatgttcacggcggggctcgccgtcttcaccgtggcgtccgtgctgtgcggggtcgccaccagccaggccacgctggtcgcggcccgcgccctgcaagggatcggcggagcgatgacctcggccgtcgtcctcggcatgctcgtcgccctcttccccgaaccgcgtgaacaggcccgtgccatcgcggtgttcagcgcggtaggcgcggcgggcggggcgctcggcacattcctgggcggtgcgctgacccaggccctgaactggcactggatcttcctgatcaacctgccgatcggcgtactggcctggctcgccgccctgcggttcctcgccccggagcggggtgccgggctcggcaggggcgccgactacccgggcgcggcgctggtcacgggcgcgctgatgctcacggtgtacgcgatcgtcggcgccggcgaccgcgggctcgccggcacgctggtcctcgcggcggtctcactcgccctcttctccgcgttcaccgtccgccaggcccgagcccctcgccccttgctccgtctgcgcctgttccgctcgcgcgtgctgaccggcgcgaacgccgtgcaggtcctgatgatcggggggatgttcggcttccagtacatcggcgcgctctatctccaacgcgtccttggatacggtgagttgctcaccggaacggctttcctgccggcgccgatcgcgatcggggtgctgatgctgggcctgtcggcgcggacgatcgcccgcttcggcccgtaccgtgtgctgctctcgggtctcgtgctcatctccgccggaatggccctgctgagccgtgcgccggtcgacggcacctacctcgccgacgtcctgccaccgctgcttctcctggccgccggtttcgctgctgccatgcccgccgtgacggggctcgcgatgtcgggcgcccgtgcggaggacgccggactcgcctccgggctcttcaacaccacacaggtggtgggcggttcgctgggtctcgcggtgctgacgaccctggcggcgagccgcaccgaccatctgcggcacgggggcgccgacctcgtggcggccaccgcgtccggctaccggctggcgttcatggtggcgacgggcatcgccgtggcggcgctggtgctggcggcgggggtgctgcgaacggagcgtgccacctcggggcagcccccggcgaacacccccagg

SEQ ID NO: 2002 - DNA, 2184 bp, Streptomyces avermitilis
  CDS (1)..(2184)
atgccgctggcgcgccgcgtcctcctgaccgctctcgccgccgggtccgcgggcgccgccgtcgcctgtgacccggcctcggccgacggagcgcccgcggcgggctcggccgcgacggccgcccgccggctcctcccccgtcactggcggcagctgacgttccgcacggcgggcggacgcgacacgttccaggtgtccggccgtacgggccgcgtcaccgtcacgggcggcacaccggcgacccagctcacggggctgaactggtacttgaggaacatcgcggacgccgacatcaactgggcgggcaggcagctccgcctgccccgcgcactgccgggcctcgccggcacagtgacccggcgcgcgaacgtcccgcaccgcttcgccctcaacgacacgaacgacggctacacgggcccgtaccacgactggacgtactgggagcgtgagctcgacgtactggccctgcacggctacaacgaagtgctcgtccaaacgggcgcggacgcgctccaccaccgggtgttccaggagttcgggtacaccgacgaggagctgcggaagtggattccggggccggcccatcagccctggtggctgctgcagaacctctccgccttccccgaccccgtctcacaacagctcctcgacgcccgggccgcgctcggccggcgcatcgcgaaccggctgcgggagctgggcatgacaccggtgttccccggctacttcggcacggttccgccgggcttcgccgaccgcaacgcgggtgcgcacaccgtcccgcagggcacctggatgggcttcgccaggcccgactggctggacccgcgcaccgagcacttcacacgggtggccgcggccttctaccggatccaggacgagatgttcggcggcgcctcgacccgctacaagatggacctgctgcacgagggcggcagccccggtgacgtgcccgtcggcgacgcggcgaagggcgtcgagagggcgttgcgggccgcgcacccgggcgccgtatgggtgatcctgggctggcagcacaacccgcccagggcgatcgtcgacgccgtggacaaggaccggatgctcgtcgtggacggcctctgtgaccgcttcccgaaggtcaccgaccgcgaggcggactggcacggcaccccgtacgccttcggctcgatctggaacttcggcggccatacgaccctgggcgcgaacactcccgactgggcttcgctgtacgagcggtggcgcaccaggccgggcagcaccctgcgcggtgtcgctctgctcccggaggccgcggacaacaatccggccgccttcgccctgttttccgaactcgcctggcgcgagggcgacttggacctgcgcgcatggttcgcgcggtgggcgcgctcgcgctacgggggacgcgatccacatgcggaggccgcctgggacatcctgcgccggaccgcgtacggcaccacgcgcgccgactcgtggagcgagggcgcggacgggctgttcggggcgcgcccctccctcgcggcgacgaaggcggcttcctggtcgccgaagcgcctccgttaccggcccgaggagttcgaaccggcgcttggcgagctcctgaaggtgcggccggggctgcgcggctcgtcggcgtaccgccgcgacctgctcgacgtggcccgccaggcactctccaaccgcagccgggtactcctcccgcagatcaggacggcgtacgaggccaaggacaccgcccgcttcgaccggctgaccggcgtctggctggccctgatggacctgctggaggcactcctggccaccgactcccgtcatctgctgggccgttgggtggccgacgcgcgggcgtggggtgcgagcgcggcggagcgggaccggctcgcgtacgacgccctctcgctgctgaccgtgtggggcacccgcgcgggtgcggacgccgggctgcgcgactacgccaaccgcgagtgggcgggactggtcggcgggctgtaccggctgcgctggtcgacgtacttcgcggagctgcggtcggcgtcgcgggagggacgcacgccgaagaagaccgactggttcgccctggaagatcgctggacccggaatcccgggggcctggcgacgcggcccacgggtgacacgtaccaggccgccgtccgggtgcacgaacggctgaccgccgagcga

SEQ ID NO: 2003 - DNA, 813 bp, Streptomyces avermitilis
  CDS (1)..(813)
gtgcactccccccacatacgcacctcacgccgcaccctgctcgccctgatcggagcctcactggtggcaggcccactcgtcgcgaaccagtccgcgaccgccgcacccgtcggcctggacgacccggcgaagaaagagatcgccatgaagctcgtgtccagcgcggagaactcctcgctggactggaaggcccagtacaagtacatcgaggacatcggcgacggccgcggctacaccgccgggatcatcggcttctgctccggcaccggcgacatgctcgacctcgtcgagctctacacccagcgcaagccggggaacgtcctggccacgtatctgcccgccctgcgcaacgtcaacggcggcgactcgcaccagggcctggacccgggcttccccggcgactggcgccgcgcggcccaggactcggcgttccagcaggcccagaacgacgaacgcgaccgcgtctacttcgacccggccgtccggcaggggaaggcggacggtatcggcgtactcggacagttcacgtactacgacgccatcgtcatgcacggggacggcggtgacagcaccagcttcagcagcatccgcgggcgcgccctggccaaggccgagccgccggcgcagggcggcaacgaggtgacgtacctgaacgccttcctcgacgcccgggtctgggcgatgcggcaggaggaggcccactcggacaccagccgggtcgacaccgcccagcgggtcttcctgacgaagggcaacctgaacctggatccgccactggactggaaggtgtacggggacagctaccacatcggc

SEQ ID NO: 2004 - DNA, 1458 bp, Streptomyces avermitilis
  CDS (1)..(1458)
gtggccgcccagccatcgcccagcaccgatgcagtcccaaccgaccagccccggcatccagttgacgagaagctcccgcttctgaagatgacgaccagcggcctccagcacgtggccgccatgtacgccggcgtcgtcgccccacccctgatcgtcggcgcggccgcgggcctctccggcaccgagctgaccttcctcaccggcgcctgcctgttcaccgcgggcctcgccaccttcctccagaccctcggcttctggaagatcggtgcccggcttccgttcgtcaacggcgtcaccttcgccggcgtcgcccccatgaccgcgatcgtcgcctccaccaaggacaggtccgacgccctcccgatcatcttcggcgcggtgatcgtcgccggcgccctcggcttcgtcgcggcccccttcttcagcaaggccgtccgcttcttcccgccggtcgtcaccggcaccgtgatcaccctcatcggcgtgtccctgctgcccgtcgccttcggctgggcccagggccccgaccccacggcggactcctacggttcgacgacctacctggggctcgccgccgcgactctcgtgatcgtgctgctccttcgccgcttcacccacggcttcgtcaagcagatcgccgtcctgctcggcctggtcatcggcacgctgctcgcgatacccctcggcgtcacggacttcggcccggtggccggagcggacctgatcggcttcccgacgccgttccacttcggcgcaccgcggttccagctcgccgcgatcctctccctcagcgtggtcatggtggtctcgatgaccgagtcgacggcggacatgctggcgctgggggagatcgtcggacgccccgccgacgagcggaccatcgccgccggtctgcgcgccgacaccctcggctcggccctcagccccctcttcaacgggttcatgtgcagcgccttcgcgcagaacatcggcctggtcgcgatgacgaggatccgcagccggtacgtcgtcgccaccggcggcggcttcctggtcctgatgggcctgtgtcccgtggccgcctcgctgatcgcggtcgtgccccggcccgtcctcggcggcgcgggcgtcgtcctgttcggctcggtcgcggccagcggcatccagaccctggtccgggccggcctggagaaggacaacaacgtcctgatcgtggcggtgtcactggcggtcggcatcatcccgatcaccgcgccggagttctaccacgcgttcccgcagacggcgaagatcgtcctggactcggggatctcgaccgggtgcgtggcggccgtggtgctgaacctcctcttcaaccatctgggcaggcgccagggggacgacgaggtgacggcgccgatggagccgggcgaggagatcgccgggcagcggggcggggccggctccccggccgcggggccttccgcggtgacggcacac

SEQ ID NO: 2005 - DNA, 1377 bp, Streptomyces avermitilis
  CDS (1)..(1377)
atggcagcagcccggcgcatcgtcatcgagaactgtgcgatcgcgaccgtcgacgcggacgacaccgagtacgcctccggacacatcgtcgtcgcaggcggccgcatcgagtcgctcggcgcgggcaaggcccccgaggacctggagaacgtcgtacgccgtatcgacgccaccggccacctcgtgacccccggcctggtcaacacgcaccaccacttctaccagtggatcacccggggcctggccacggaccacaacctcttcaactggctcgtcgcgctctacccgacctgggcgcgcatcgacgagcggatggtgcactcggccgcgcagggctccctcgccatgatggcccgcggcggtgtcaccaccgccatggaccaccactacgtgtacccgaagggctccggcgacctgtccggcgcgatcatccgcgccgcccgggagacgggtgtccgcttcaccctcgcccgcggctccatggaccgcagtgagaaggacggcggtctgccgccggacttcgccgtcgagaccctcgaaggggcgctggccgccaccgaggcgaccatcgacgagcaccacgacgcgtccttcgacgcgatgacccagatcgccgtcgcgccctgctccccgttctccgtatccaccgaactcctcacgcaaggtgccgagttggcgcgccgcaagggagtaaggctgcacacccacggttcggagaccgtcgaggaggagcagttctgcaaggaactgttcggcatgggcccgaccgactacttcgagtccaccggctggctcggcgaggacgtgtggatggcgcactgcgtccacatgaacgactccgacatcgccgccttcgcccgtacgaagaccggtgtcgcccactgcccgtcgtccaacgcccgcctcgcggccgggatcgcccgggtccccgacatgctggcggcgggcgtccccgtcggcctcggcgtcgacggcacggcctccaacgaatccggcgagctgcacaccgagttgcgcaacgccctcctcatcaaccgtctcggcgcccaccgcgaagccgccctgaacgcccgtcaggcactgcgcctcggcacctacggaggcgcccaagtcctgggccgggcagccgagatcggctccctggagacgggcaagctggccgacctggtgctgtggaagctcgacacgctcgcccacgcctcgatcgccgacccggtgaccgccctggtcttcggcgccgcggctccggtcacgctctccctcgtgggcggcgagccggtcgtcgagaacagccggctgctgcacgtcgacgaggacgccgtcgcccgctccacgcgggaagaggcgcagcggctggcgcggatcgccgcgcaggcc

SEQ ID NO: 2006 - DNA, 945 bp, Streptomyces avermitilis
  CDS (1)..(945)
atgacagacgattcccgccccggccgccctgtgatgctgggccagaaccagtacggcaaggccgagaaccgagtcgtgaagatcacgcgggacggcgccacccaccacatcaaggacctgaacgtctccgtcgcgctctccggcgacatggacgaggtccactactccggctcgaacgccaacgtcctgccgaccgacaccaccaagaacacggtgtacgcgttcgccaaggagcacggcatcgagtccgccgagcagttcggcatccacctcgcccggcacttcgtgacgagccaggagccgatcaagaccgcgcgtatccgcatcgaggagtacacctgggagcggatcgaggcctccgacgccaactccaggttcatcggcgccgacgaggtcaagcactccttcgtccgcaagggccaggagacccgcgtcacccagatcacctacgacggctcgtcctgggaggtcatctccggcctcaaggacctcgtcgtgatgaactcgaccaactccgagttctggggctacgtcaaggacaagtacacgacgctccccgaggcgtacgaccgtatcctcgccacccaggtcgctgcccgctggcgcttcaactggtctgacgacgagcggaagatgccccactgggagaagtcctacgagcagaccaggaagcacatgctccaggccttcgccgagacgtactccctctccctccagcagaccctgtaccagatgggttcgcggatcatcaaccaccgcagcgagatcgacgaggtccgcttctcgcttccgaacaagcaccacttcctggtggacctggagccgttcgggctcaagaacgacaatgaggtgtacttcgccgccgaccggccctacggcctgatcgaggcgaccgtcctgcgggacggctgcgaggcgaagatcccggtggacctcaccaacctc

SEQ ID NO: 2007 - DNA, 405 bp, Streptomyces avermitilis
  CDS (1)..(405)
atgagcaccagcaccaccgcctcggtgtccacgcacatcctggacaccagcatcggccgccccgccgcgggcgtcgccgtccagctcgccgcccgctcggggcgctccgcctcctacgggcaagggggagactggcaggcgctcggcggctccgcgaccgacgccgacgggcggtgcaaggacctcccggccctgccggccgggaccacccacgtacggctcgacttcgccgtcgaaccgtacttcgagaagaagcaagccgatgcgcagcaggacgcccccgcgaatcgggacagcggtgcgttcttccccgaggtggcgatcaccttcgccgtgaagcccggcgagcactaccacgtaccgctgctgctcaacccgttcggctactccgtttaccgagggagc

SEQ ID NO: 2008 - DNA, 516 bp, Streptomyces avermitilis
  CDS (1)..(516)
gtgacttcgacttccacgccgccgggcctcgcccggttcaacgacctgggggagcacgcggcgctcgccgccctccacgaggcgtgcgcctccacgacgtgggcgaggcggctgatcgccgcccgcccgtacgccaccgccgacgacctctacaccgcgagtgacgccgcgatggccgaactgaccgccgcggacctggcgcaggcgatggccgggcacccgccgatcggccgccccaagcccggcgacccgacctcggcccgggagcagcgcggcatggccggcgcctccgaggaactcaaggcggacatgctcgaactgaacctggcgtaccaggagaagttcggtcatgtcttcctgatctgcgcgaccggccgcaccggcgagcagatgcgcgacgcggtcagggagcggatcggcaacgcgccggagcgggagcgggagatcgtccgcaccgagctgggcaagatcaaccgcatccgcctggcccgactcgtcgaagaggacgcacacgca

SEQ ID NO: 2009 - DNA, 366 bp, Streptomyces avermitilis
  CDS (1)..(366)
gtgaccggcaacggggacgagccgttcatcgcggccgtgaagccgctggtcgacgccatgggtggcgagatgcttccgcccgacgaggccggcgtcgacgacgtcgtgctctcctgggagggcgtcgacgtggtcgccgtacgtctgccgcagctggccgactccctcgaccacatcctggccgccatggagcgcaagaagggcaaaccgctggccgacctggaccgcaagtccaagcaggaggtcgtgcggattctcgaagcgcgcggcgccttctcggtgcggcacggcgtcgagaccgtggcgagcgccctgggcgtcagtcgcttcaccgtctacaactacctcaatcgcgagaaagaggcc

SEQ ID NO: 2010 - DNA, 249 bp, Streptomyces avermitilis
  CDS (1)..(249)
gtgcgattgcgagtggagttcacgaccgagcccttcgatctcgacgaggcgcccgcgcacgcgctggtggcccgtgaggtggtcgaggcggccgagctggacgcggtggacgtcggcccgttcggcaacacggcggagggtggcgccgacgcggtgctcaccgccgtggacgccctgctgcgcaaggccctggaggcgggtgccacccgtgtgtcgctccaggtcaacgtgatcggggagggtgatagg

SEQ ID NO: 2011 - DNA, 1509 bp, Streptomyces avermitilis
  CDS (1)..(1509)
atgaagcgcaggcagatggtgaaggcgctggccggaacagccgccctaccggcggttgtgggcgcggccggcggtgcccgggccgccggctccggggcggcctccacctcgaccggggcggtctccgccgccaccaggacgaagggctcggaccccctggcattcgacccggcgaactacaccaccctcaccacgaccgtcgccacgagcgacggcgacaaggcggtgacgtaccggttcttcaaggcggtcacctatgtcgccgacccggtcgacgtgacgtaccagagcctcaacgtgagcgtcccggtggagatcgacggcaaggcggtcgatgcctcccacgcgccgatcgtcttcagcaacgcggtcggcggctacatgccgtcctccacggccggcaacaccggcatcggacagggggtcaacgcgaagctgtcactcgcgtccggcttcgtcgtggtggacccgggcgcccgcggccggaccctggtcgacaccgccggcgtctactacggcgtcgccccggccgcgatcgtcgacctcaaggcggcgatccgctatctccgccacaacaagggccgcgtcccgggcgacaccgaccgcatcgtcgccaccggcgtcagcgcgggcggcgccctcacctcactgctcggcgcgtccggcgacagcgaccgctacgccccctaccttcaggagctgggcgcggccgacgcgagcgacgccgtcttcgccgccgccccgtactgcccgatcacggacctcgagcacgccgacatggcgtacgagtggaactggggcaccaacccgctccccaccggcgcacaggtcgatcagaccctctccaaggagctccggagcgggttcgccgagtaccaggcgtcgctgaacctccggggcaagaacggcttcggccgcatcaccgcgcgcaactacgacgcgtacatggtcaagacacacctggagccgtcggccaccaggtacctcggcgccctgccggacgcggaccgcgccgcgtacctgaccgccaacccgtggatcacgtggtccggcggcagggcgtccttcggctggggcgacttcctcacccacgtcggcgcccgcaagaagaacgtcccgtccttcgacaccttcaccctggccgcccccgagaacaacctgttcggcgtggccaccaccaaggcacgccacttcacacagtggagcctgcgcaaggccaccggcgacgacggcgcccgcctcgacgcggacctgcccgagaagatcgacctgatgaacccgatgtacttcatcgagcatcagaacccgggccggtcccggcactggttcatccgcgtgggcaccaaggacagcgacacctcgctgaccgtcgtcggcaacctcaccgccggcctggagaacctcggcgacgacgtcgacacgtacatgtactgggacggcgggcacggcgcgaaccaggacgcccccgacttcatcacctggatccgctcggtcagcgggtacgcgaag

SEQ ID NO: 2012 - DNA, 855 bp, Streptomyces avermitilis
  CDS (1)..(855)
atgccgggtcttgaacggggcaccgccgcggagcagcgcttcaacgtcaatctgtcgatcctcttcacggaactcccgctcctggagcgccccgcggccgccgccgcggcgggcttcaccgcggtcgagctgtggtggccctgggtcgactcccccacccccgaccagtccgagctcgacgccctgaagaaggcgatcgaggaggcgggcgtccagctgacgggcctgaacttctacgcgggccggctgccgggcccggaccgcggcgccctgtcgatccccggcgaggagtcggagcggttccgcgccaacatcgacgtggccgccgacttcgcccgctcgctcggctgcacggcgctcaacgccctgtacggcaaccgggtggagggcgtggacccggccgagcaggacgcgctcgccctggagaacctggtcctcgcggcccgggccgccgaccggatcggcgcgatcctgctgatcgagaccctcaaccagccggagtcgccgcgctatccgttggtgagcgccccggccggcatcgggatcgtcgaccaggtcaacgaggcgaccggtctcggcaacgccaggttcctgatggacctgtaccacctgtccatgaacggcgaggacctgccgcgggtgatcgccgcgtacgcggcgaagaccggccatgtgcagatcgccgacaaccccggccgcggcgccccgggcacgggcacgctgccgctgaaggagctgctcgggcaactccgcaaggccgggtacgagggctgggtcggcctggagtacaagccgggcgaccgtccgagcgccgaggccttcgactggctgccggccgaggcccgcgccgcccgc

SEQ ID NO: 2013 - DNA, 915 bp, Streptomyces avermitilis
  CDS (1)..(915)
atgagcagcaaccccgcaccttccccccgcccggcccgcccgctggtcgcgtggatcggtctcggcatcatgggctccccgatgtccgagaacctgatcaaggccgggtacgacgtcaccggcttcaccctggagcaggacaagctggaccggctgaccgccgccggcggcaccgcggccggatcgatcgccgaggccgtgcgcgacgccgacgtcgtcatcacgatggtgcccgcctccccgcaggtcgaggccatctcgtacggccccgacggcatcctcgagaacgcgaggtccggcgccctgctgatcgacatgtcgtcgatcaccccgcggacctccgtggacctggccgaggccgcggccgcgaagggcatccgcgtcctggacgccccggtgtccggcggcgaggccggtgcggtcgaggccgtgctgtccatcatggtcggcggcgagcaggccgacttcgacgaggcgaagccggtcttcgaggcgctcggcaggaccatcgtgctgtgcggtccgcacggtgcgggccagaccgtgaaggccgcgaaccagctgatcgtcgccgtgaacatccaggcgtgcgccgaggccgtggtcttcctggagaagtcgggcgtggacctgaaggcggcgctcgacgtcctgggcggcggcctcgccggctccaccgtgctgacgcggaagaaggacaacttcctccaccgtgacttcaagccgggcttccgcatcgatctgcaccacaaggacatgggcatcgtcacggacgccgcccgcgccgtgggcgcggccctgccggtcggcgcggtggtggcccagctggtggccgcgctgcgcgcacagggggacggcgggctggaccactcggccctgctgaggtccgtggagcgcctctcgggcgcgcggctc

SEQ ID NO: 2014 - DNA, 1455 bp, Streptomyces avermitilis
  CDS (1)..(1455)
atgtcgaagcgcgtgcttacgaccgagtccggcgccccggtcgccgacaaccagaactcagccaccgccggcgtcggtggtccgctcctgctccaggaccagcacctcctggagaagctcgcccggttcaaccgcgagcgcattccggagcgcgtggtgcacgcccgcggctccggcgcgtacggccacttcgaggtgaccgacgacgtcaccggcttcacgtacgccgacttcctgaacacggtcggcaagcgcaccgaggtcttcctgcgattctcgacggtggccgacagcctgggcggcgcggacgcggtccgtgatccgcgcggcttcgcggtcaagttctacacggaggaggggaattacgacctcgtaggcaacaacactcccgtcttcttcatcaaggacccgctcaagttccccgacttcatccactcccagaagcgcgacccgttcacgggcaagcaggagccggacaacgtctgggacttctgggcgcacagccccgaagcgacgcaccaggtgacctggctgatgggcgaccgcggcatcccggcctcgtaccgtcatatgaacggctacggctcgcacacctaccagtggacgaacgccgagggggaggccttcttcgtcaagtaccacttcaagacgaaccagggcatccgcagcctctccgccgaacaggctcaggagatcgcgggcacggatccgaactcccaccagacggacctgctccaggccatcgaacggggtgtgcgcccgtcctggacgctgtacgtgcagatcatgccggcggcggaggcggcggagtaccgcttcaacccgttcgacctcacgaaggtgtggccgcacacggactacccgctccagcgggtgggccgcctggtcctggaccgcaacccggacaacgtgttcgcggaggtggagcaggcggccttctccccgaacaacttcgtgccgggcatcggcccctccccggacaagatgctccagggccgcctgttcgcgtacgcggacgcccaccgttaccgcctcggcgtcaatcacacgcagctcgcggtcaacgccccgagggcgacggtcgtgagcaactacggccgtgacggcctcatggcctcccccgcacagggccgcgccgcgaagaactacgagcccaactcgtacgacggcccggccgagaccggccggccgctgtcggccccgctggcggtgaccggccacacgggcacgcacgaggccccgccgcacaccaaggacgaccacttcttccaggcgggcgagctgtaccgcctgatgtcggccgaggagcggtcccggctggtcgcgaacatcgccggtggcctctcgcaggtctcccgcgacgacgtgatcgagaagaacctcacccatttccacgccgcggacccggagtacgggacgcgtgtggaggaggcggtccgcgccctgcgcgaggac

SEQ ID NO: 2015 - DNA, 234 bp, Streptomyces avermitilis
  CDS (1)..(234)
atggaacacgcgacgaagtatccgcacatagtggtgcatccaccggccctggacggatcccggcgggtcaccgcgggcgacgcgcccctcgggatcgcctcccatctggacgatgtcatcgagatcctgcgcatggccgacctggaccggatcgaggtcgaggagagcgacctcatcgaatggcagggcggcgggccggacgactggccgggactgtcggagcacgaggacgac

SEQ ID NO: 2016 - DNA, 1782 bp, Streptomyces avermitilis
  CDS (1)..(1782)
atggctcgtatgaccgctgcccgtgcggcagtcgagatcctcaagcgcgagggcgtccgcagcgcgttcggtgtcccgggcgcggcgatcaaccccttctacgcggccctcagggcctccggcgggatcgatcacaccctcgcccgccatgtcgagggcgcctcgcacatggccgagggctacacccgtgcgcacccgggcaacatcggcgtctgcatcggtacgtcgggccccgcgggcaccgacatgatcaccggtctctactccgccatcggcgactcgatcccgattctgtgcatcaccggccaggcgccgaccgccgtgatccacaaggaggacttccaggccgtcgacatcgcctcgatcgccaggccggtcacgaaaatggccgtcaccgtcctcgaggccgcgcaggttcccggcgtcttccagcaggccttccatctcatgcgctccggccggcccgggcccgtcctcatcgacctgccgatcgacgtccagctcaccgagatcgagttcgacccggagacgtacgaacccctcgcggtctacaggcccgccgccacccgcgcccagatcgagaaggcgatcacccttctcaacgagtccgagcgcccgctgatcgtcgccggcggcggcgtcatcaacgccgacgcctgcgaactcctcgtcgagttcgccgagttgacgggggtcccggtcgtcccgaccctgatgggctggggcgtcctgcccgacgaccacgagttgaacgccggtctggtcggcctccagacctcgcaccgctacggcaacgccaccttcctggagtccgacttcgtcctgggcatcggcaaccgctgggccaaccgccacaccggcagactggacgtctacacggccggccggacgttcgtgcacgtcgacgtcgagcccacccagatcggcaggatcttcgccccggactacggcatcgcgtccgacgcgaaggccgccctcgaactgttcgtcgaggtggcacgggagctgaagtccgcgggcgggctgcccgaccggtccgggtgggcggcctccacccaggagcggagggccaccctccagcgccgtacgcacttcgacgacatcccgatcaagccgcagcgcgtctacgaggagatgaacaaggccttcggcccacagacccggtacgtctccaccatcggcctctcgcagatcgccggcgcccagctgctgcacgtccaccggccgcggcactggatcaactgcggccaggccgggccgctcggctggaccgtcccggccgcgctcggcgtcgccaaggccgaccccgaggcacgggtcgtggcgctctccggggactacgacttccagttcatgatcgaggagctggcggtcggcgcgcagcaccggatcccgtacgtccacgtcctggtgaacaacgcctacctgggcctgatccggcaggcacagctcggtcttgacatcaacttccaggtcaacctggagtttgagaacatcaactccccggagctgggcgtctacggcgtcgaccacgtcaaggtcgtcgaaggcctcggctgcaaggcgatccgggtcaccgaccccggcgagctgggcgccgccttcgagcaggccaagaagctcgccgcggagtaccgggtgccggtcgtcgtcgaggcgatcctggagcgggtcaccaacatcgcgatgagcaggacgaacgacatcagcgacgtcgtggagttcgaggaggtggcgaccgagcccgggcacgccccgacctcgatcaggacgctgaaggtc

SEQ ID NO: 2017 - DNA, 1116 bp, Streptomyces avermitilis
  CDS (1)..(1116)
gtgccccctcgggccgatgccggacgcggtgccgggaatccggccctgggcgtcaccgcgtttcgctgccgggagtgccgtgactggaggacgatggaggcgctgtcccgacgtcatccggtggagtgggccatggccgagagcgtgcccgtgcggtgtccggtgtgccggcgcgagcacctgtacgcgacaccgtcctatccgtgcgcctgcggtgcccccgtcgctcccccgctcgaccgtgccgccgccccgagcgccgtcacccaccgcacctgggacgaggattgggtcaccgtccgctgcggggcctgcgggcgcgaggaccagtggccgcaccccgagctgggctgccactgcggggtcgtcctgcggattccggtgtcgggcgggccgggtacgccgggccaggcgccgcggccggcagcggaggccgacgacgctcgcggggcgccccccgtcggagaaccggcggatccacaggagccgacgccgggccaccacacaccaacgccggacgaccacccgccgacgccggaagcgcccggaccggcgcccggcgcaccgtcctcggcgcccggcccccgcggctcaacgccgggcccccgcccgtccgccgcgaagccgggcgcagcggcggcaccgggaggtgcggccggatccatcccgcgcatccccggcacgacgcgccgctcgcgcccccgccccgccgcgctcccccgcgccaccccgtcggcccgccccgccttccagcccgtcaccatccgtaccgcgcgggacgccgtgaccgccgccgcgctgtatctgcgctggctggggtaccaggacgtccggcgcgcggaccagcgcccgccgaacgggatcgggctcgcggcgcgcggaatgctcgcgcaggtggacccgacggtgcggccggcttcgctgcgggacgtggagtgcctgtggctgacggccatgacggagtccgccgggtgcgtctacttctccctcgcgggctacgcggacgacgcccgcgccgtcgccgaccgcctcggcgtccccctcttcgtcctcgacctcacgggcaccccgcagcccgtcaacagcctcgccgacgacctggtggccaccggcgcg

SEQ ID NO: 2018 - DNA, 1620 bp, Streptomyces avermitilis
  CDS (1)..(1620)
gtgaccgaactgtcgtacgcgcacgggacgagcacgacaccgctcctcggcgacaccatcggggcgaacctcgaccgggcgatcgccgcgtatcccgaccgtgacgccctcgtggacgtgccctccgggcggcgctggacctacgccgagttcggtgccgccgtcgacgaggtggcgctggggctgctcgccaagggcgtgctgaagggcgaccgggtcggcatctgggcggtcaactgccccgagtgggtgctcgtccagtacgcgaccgcccgcatcggcgcgatcatggtgaacatcaatcccgcctatcgcgcccacgagttggcgtacgtcctccggcaggcggggatctcggtgctcgtcgcctcgctcgcgcacaagagcagcgactaccgcgccctggtcgaccaagtgcgtgagaaatgccccgagttgcgggagacggtctacatcggcgacccgtcctgggaggcgttgacggcgggcgcggcctcggttccgtacgagcggctgatcgccggcgcggccgacttgagctgtgacgacccggtcaacatccagtacacctcgggcaccacgggcttccccaagggggccaccctctcgcaccacaacatcctcaacaacggctactgggtgggccgtacggtcggctacaccgaagaggaccgggtgtgcctgcccgtgccgctctatcactgcttcggcatggtcatgggagctttgggcgccacgtcgcacggcgcgtgcatcgtgctccctgccccttccttcgacccggccgccacccttgcggcggtccagcgggagcgctgcacgtccttgtacggcgtgccgaccatgttcatcgcggagttgaacctcccggacttcgcgtcgtacgacctctcctcgctgcgcaccggcatcatggcgggctcgccctgcccggtggaggtgatgaagcgggtggtcgccgagatgcacatggcggaggtgtccatctgctacggcatgacggagacctcgccggtgtcgttgcagacgcgccgcgacgacgacctggagcaccgcaccggcaccgtcggacgcgtgctcccgcacatcgaggtcaaggtcgtcgacccggcaggcggggtgacggtgccgcgcggcaccgcgggcgagctgtgcacccgcggctacagcgtcatgctcggctactgggacgaacccgagaagaccgcggaggccgtggacgcggggcgctggatgcacacgggcgacctcgccgtgatgcgcgagaacgggtacgtcgagatcgtcggccgcatcaaggacatgatcatccggggtggggagaacatctacccgcgcgagatcgaggagttcctgtacgggcatccgaagatcgccgacgtacaggtggtcggcgtgccgcacgagcggtacggcgaggaggtcctggcctgcgtcatcccgcgcgatccggccgacccgccgacgctggaggagctgtgggccttctgcgacgggcagctggcccactacaagatccccagtcggctgcggatcctggactccttcccgatgacggtgtccgggaaggtgcgcaagatcgaactgcgggagcaggcggcgcgggaggggcgggacgac

SEQ ID NO: 2019 - DNA, 1677 bp, Streptomyces avermitilis
  CDS (1)..(1677)
atgacggcgaacacgagcgcgacggacgcattcagggccgcgcgggacttcctgctgacgcaccgcgaggactacgccacggcctacgagggcttccgctggccccgcccggagcacttcaactgggcgctcgactggttcgacgtcctcgcgcggggcaacgaccgcacggccctgcacctcgtcgaggaggacggcgccaccacccggctgtccttcgccgagctgtccgagcgctccgaccgcgtcgccaactggctgcgcgcgcggggagtccgggcggaggaccgcgtcctggtcatgctcggcaaccaggcggagctgtgggagacggcgctggccgcgatgaagctgcgcgccgtcgtcatccccgccaccccgctgctgggccccgccgacctgcgcgaccgcgtcgagcggggacgcgtccggcacgtcgtggtgcgcgccgaggacaccggcaagttcgacgaggtgcccggccgttacacccggatcaccgtcggcggcgagcggcccggctggcagtcgtacgaggaggcgtacgcggccgacgcggccttcgagccggacggcatcacccatgcggacgatccgctgatgctgtacttcacctcgggcacgaccgcccaccccaagctggtcgagcacacccatgtgtcgtacccgatcggccacttggcgacgatgtactggatcggactcgaaccgggcgacgtccacctgaacatctcctcgccgggctgggccaagcacgcctggtcgaacctcttcgccccctggaacgcggaggcgacggtcttcctgcacaactacacgcgcttcgacgcgggccgtctgctgacggagatggaccgcgccggggtgaccaccttctgcgccccgcccaccgtctggcgcatgctcatccaggccgacctgacccagctgcggaccccgccgcgcgaggcggtggccgcgggcgagccgctgaacccagaggtcatcgaacaggtgcggcgcgcctggggcgtcaccatccgggacggcttcggacagacggagacggcggtccaggtctccaacagccccgggcagaagctgaagacgggctccatggggcggccgagccccgggttccacgtcgaactgctcgaccccgtgtcgggcgcgccgggagtggacgagggcgagatcgcgctggatctctcggcgcggcccgtcggtctgatgaccggctaccacggtgacgccgaccgcaccgccgaggcgatggcaggcggctactaccggaccggtgacatcggttcgcgcgacgcggacggctacatcacgttcgtgggccggcgcgacgagatcttcaaggcctccgactacaagatctccccgttcgagctggagagcgcgctgctggagcacgaggcggtggcggaggcggccgtggtgcccgcgccggacgagctgcggctcgccgtgccgaaggcgtacatcgtcctggcggcgggcttcgagccgggccccgacacggcgaaggtgctcttcgagcacgcgcgctcggtcctggcgccgtaccagcgcatccgcaggctggagttcggtgaactccccaagaccgtgtccggcaagatccgccggatcgagctgcgcgaggccacggcggcgggctcggccgaggagtaccgcgaggaggacttccgg

SEQ ID NO: 2020 - DNA, 837 bp, Streptomyces avermitilis
  CDS (1)..(837)
gtggcagcagacgcagccgaggcggtggaggtgcgcggcgcgttgctacggctgcgccgggcgacggggctcccggtcgccttcggtggactggtcgagcccgggcggccgcagatccgcatcagcgaactgtgcggccacacgacgctcgccctcagctcgctcgcggtggtctccggcagcgggctcggcggcaaggtcgtcgccctctcgcggccgtgcgcggtgacggactactcgacgtcacggcagatcagccacgagtacgacgtggcggtcgccgccgagggactgcggtccgtggtcgcggtgcccgtggtcgtacgccgtcgggtgcgcggtgtgctgtacggcgctctgcgggcggctcagccgctgggcgaccggacgctcacggcggccgtggaggcggcccgggacgtggagcaggcgctggtcgtgcgggacgaggcgcacagcctgatgacggccgcgcgggaacccgagaccgcgtcgggcgcggcctgggagcaggtgcgcgaggcgcacggggcgctgcgggcactggcgccgcgcctcatggacccggcactgcgggccgaactcctcgaggtgtgcgggcagttggccggagcggcgtcggcggagccggccgcggcacacgcgctcgggctggcaccgcgtgaggtggatgtgctggtgtgcgtcgcggcgggggcgacgaacgcggtcgcggccgagcggctggggcttcgcccggagaccgtgaaggggtatctgcggtcggcgatgcgcaagctcggcgcgcacacccggctggaagcggtggtcgcggcgcgccgggcgggggtgctgccg

SEQ ID NO: 2021 - DNA, 2808 bp, Streptomyces avermitilis
  CDS (1)..(2808)
gtgaccgtgcgacgggacttcaaggagcctgcgagaccccgccccgacctggtcatcggccgggaagaactgttcgcgggggcacgcgagcagctcacccgagggggcagtgtgctggtgcacggcccggccggaataggaaagtcgaccatcctgcgggccctggtcaccgaatacggcgaaacggcgcacaccgtcctgcggtgttcgtccaccgagtccgaatcgcatcttccgtttctggccctggccgacctcctcggtctggtcgaggacgaggtcctcgaccggctgcccgccccgcagcgcaccgctctggagtccgcgctgaccgggcgcggcgagtccaccctccagcgcgacggactcgcgctgcgcctcgcggtgctctccacgctccgtgtcctggccgcccgtggcccggtgctgatcgtcgccgacgacctccagtggctggatccggccagcgccgaactcctcggcttcgccgcgcggcgtctgggcggcatgcccgtccagatgctctgcgcggtccgtaccgacaccgaaccacagggccagcagcacgaccgctatctacgcgcgtccccgccggagacgctcgcggtgcgcgtgaaccccctctcccgcgcccagaccgccgagctcctcggccgtcgcggccacaccgacctgccccgttcgacggtgcgcgacatccaccgcaccagcggcggcaacccgctgttcgcgctggagctgggccgcgcgctggccgagagccccaccccgccgagcccgggcgagccgctgcccgtgccgacctcgctgcgcgcgctcgtcctgaaccggctggacatgctgtcgccccaggcccgccgcaccctgctcgtcgcgagcgccggagcacgcccgacgctcgccctgctgcacgccgcgggccgcgagaacgcggaggcggagacggcgcaggccgccgcgctcgggctgctggtgacggaacgggacgcacccggcgtacggttcgcgcatccgctcgtctccgccgcgctgtacgcggaggcgaccgcgcaggagcgacgggccgcccatgccgcgctgtccacggcggcctccgatcccatcgagcgggcccggcatctcgcgctggccaccaccgggaccgatccccgggtcgccacccggctcggggaggcggcggcggtcgcccgggaccgtggtgcgccgtcggtggcggcggggctcggactgctcgccgcccggcacactccggcggacaccgtgccgggcccggacgagcgacgcctccaggcggccgaggacgcgctgaccgccggggagacggatctcgcccgggacatcgcccgcgaggtgctcgggcgggccggggggcccgcggaccgggtacgggcctggatggtcgtgatcgacgcggcggggcaggccatggccgaggtcgacgccgtcttcccgcaggcgctggccgacgcgggcgacgatccccggcttctcgccctggtgcactaccagctcgcgtggcgggcgctgctggtggagggcgagttcgacaaggcccgcgaggaggccgcccggtccgcggagctggccgcgcgcgccgccgaccggcgcgccgagctcctcgcgctggccttccaggcacagatggagaccctgatggggcacccggacgccccgggcaccatcaagcgggcgctcaaggagccgcaggacccgcgggtggcgtgcgaccacaacggcgccggtgcggcccggttccgctggctgatcatgggcgaccagctcgccgaggcgcgtacgacgatcagcgcgctgctgcgcgaggtgcggcggcgcgggatggtcgagagcgaggtgcacttcctgcgggcgctcgccgaggtcgaactgcgggccgggcactgcgggcgggcgctcgacctcgcccgggagagcctccggctggcgcgggacaccgggatcggcgagggcgccaccgcgatgttcacctcgctcgcggaggccgcgggcggcgaggtgaaccgggcgctgacgctggcccgggaggcggtggggcgcgcggaggaggacggtgacctggtctatctctcgcgcgcgctgggcgccctcgggcacgcccagctcgtggccggggacgcggcgggagcggtgcggtcgctgcggcgggtacgggagctggaggagggactcggggtcaccgaccccgcacgggggcgctggcacggcgacctcgccgaggcgctcgtccgcatcggggaaccggcggaggcgcagggcttcatcgacacgacgcgtacccaggcgttgcggctggggcgcgagagcgtgctcgcggtgctggaccgggcggaggcgctggcgcgggcggcacgcggcgaaatcgacgcggccacacggcagttgacgtccgcgcaggaccggctggccaagctgggctacggcctggaggaggcgcgggccgccttcgccctggccggcctgcgcacgcatcggcccggaccgacctcgtacgacgaggcggcccggctgttccgccgctgccgcgccctgccgtggctgcgccaggtggagaccgcgacggtcaccgggcccgcccagccggccctctccacggcggccctcgacgccctggccgcgacggaacgccaggtggccgcgctggtcatggagggcgcgaccaatcgcgagatcgccgcgcgcctgttcatcagcgtgaagacggtggaggcaacgctgacgagggtctaccggaagctgggcatccggtcccgggtggacatcgtgcgcctggcggcgggcggccgccagggc

SEQ ID NO: 2022 - DNA, 789 bp, Streptomyces avermitilis
  CDS (1)..(789)
atgttcgggctcaatcgcgcaaagaagaccgccgccgtagtcgccgccaccgctgccgccgcggcgacggctctgctggccgccccgggcgccgtcgccgccccccagcccatcgtcggcggctcgacgaccacgacgaccgcgtacccgttcatgatgcagatcacggacgcctcgcagaaccagttctgcggcggcaccctggtctcggccaccaaggtcgtcaccgccgcccactgtatggtcggcgagaccaccagcagcgtccgcgtcgtcggcggcagaacgtacctcaacggcacgaacggcaccgtcagcaaggtcagcaagatctggatcaaccccgactacacggacgccaccaacggcgacgacgtggccgtgctgaccctgtcgacgtcgatgtcgtacaccccggcgtcgtacgtctcgtcgtcccagacgagcatctacgcgaccggcgccaccgcccgcatcataggctggggcaccacctccgagaacggcagctcctccaaccagctgcgcaccgcgaccgtcccgatcgtgtccaacaccagctgcgccagctcctacggttccgacttcgtcgccagtgacatggtctgcgccggatacacctccggcggcgtcgacacctgccagggcgacagcggcggcccgctgctcatcggcggcgtcctggcgggcatcacgtcctggggcgagggctgcgcggaggccggctacccgggcgtctacacccgcctgacgaccttctcgagcctggtgaccgcgcaggtcaactcg

SEQ ID NO: 2023 - DNA, 1266 bp, Streptomyces avermitilis
  CDS (1)..(1266)
gtgtccgcaagccccgctagcgtgcgcggcatgacgaagagcacctcgcagaaggccacggcgtcccaggtcacggcatcccatgtcacggcggccacggcggccacggcggccacggcggccacggcgtccaaggccagggcgtccaaggcgcccaaggcctcccgtgccgccgcggccgctcccgtgctcaccccccgcgccctcaaccgcgccaccctcgaccgccagctcctgctgcgccgcgcgcccctgtccgcgaaggacgccgtcgagcacctgctcgggctccaggcgcagaacgtgaagccgccgtactacgccctcgccgcccgcctcgacgggttcacccccgaggcgctgtcacggctcatggccgaccgcgaggtcgtccgcatcgtcaccatgcgctccaccatccacacccacaccgccgacgactgcctcaccctgcgcccgctggtgcaggccgcccgcgaccgggaactgaactacttccgcaagggactcgccggcgtcgacctcgaccggctcaccgccgtcagccgcgagctcgtcgagaccgagccgcgcacgatgaagcagctccgcgaggccctgctcgtggagtggccggacgcggacccgcagtccctcgccgtcgccgcgcgctgccgcctcccgctcgtccaggtcaccccgcgcggtctgtggggcaggagcggtcaggtcgcgctcaccaccgccgagcactggctcggccgtcccgccgggcctgcccccgcgcccgactccaccgtgctgcgctatctggccgccttcggtcccgcgtcggtcaaggacatgcagacctgggcgggtctgacccggctgcgggacgccttcgagcgccttcgcccgcagctcgtcaccttccgcgacgagaccggcgtcgagctcttcgacctcccggacgcgccccgcccggccgccgacacccccgcgccgccccgcttcctgcccgagttcgacaacctgctcctctcccacgccgaccgcacccgcgtggtgcccgccgacctcaagggccgtacctgggcggggaaccaggcgtactgcacgctcctcgtcgacggcttcctggcgggcgtctggcggctggacgaggacgccctcaccatcgagcccttcggcacgctcaccagggcgcagcggcaggaggtggttcaggagggcgagcggacgctcgcggtgatggccggcggcacgaactcgtacgacatccggttcgggaccgtcgtacgggca

SEQ ID NO: 2024 - DNA, 1158 bp, Streptomyces avermitilis
  CDS (1)..(1158)
atgtccgagcgacgcgcccgcccagcttcgaagaacggcaggaagtccgcctggcgccgggccctgaacccgcccgcgacgccgcccgccgaacctccggcgggcggccccgacgcgccggccccggaaacggcggatgcggccagcgtcgtacaggcgaccctgtaccgcgacggcgtacgcgtctcctcgcccgcctccctcgccgacacgttccgggagctgcgcgacgagccgtccggcatggcctggatcggcctcgcgcgccccacggagtccgaactcctttccctggccgaggagttcgatctgcatccgctcgccgtcgaggacgcgatggaggcacaccagcggccgaaactggagcgctacggcgagacgctcttcgtcgtcctgcgggccgcccgctatctggacgcgccggaggaggtcgacttcggcgaactccatgtcttcgtgggcccggacttcgtgatcacggtccggcacggcgcggcccccgacctgtcggccgtccgccgccgtatggaggagacgccggagctgctgaaactggggccggaggcggtgctgtacgcgatcctggacgcggtggtcgacggctatgtgccggtggtggccggtgtccagaacgacatcgacgagatcgagacggaggtcttccgcggcgacccggccgtctcccgccgcatctacgaactctcccgcgagatggtcgagttccagcgcgccacccgccccctggtcggcatgctgcacagcctgatggcgggcttcgccaagtacggcacggacgaggaactccagcgctacctccgggacgtggccgaccacgtcacccacaccagcgaacgcgtcgacggcttccgccaggcactggcggacatcctgacggtgaacgcgaccctggtcacccagcaacagaacgcggagatgcgggcgttggcggaggcagggttcgagcagaacgaggaaatcaagaagatctcgagctgggcagcgatcctcttcgcccccacgctcgtcggaaccatctatggcatgaacttcgagcacatgcccgagttgggctggagcttcggataccccttcgcgatcggcctgatggggctggtctgcgtcagtttgtacgtgattttcaagcggcggggctggctc

SEQ ID NO: 2025 - DNA, 288 bp, Streptomyces avermitilis
  CDS (1)..(288)
atgcggctcgcggccctgcccacagccttcgccccggtggacgacctcgggaaggaggccgtcgcgggacgcgagacggtcatcttcacggagaacaaggccggcacgctcttctacatcaaccacaagcagttcgaccacggccgcgtcgacttccgggccaggctcaacaccgtcgaggaatggacgatcaagaacgacagcgacgagtcccactcgttccacatccacaccaacgacttccaggtgatgcgtatcaacggcaagccgcaggtcaactacggcttg

SEQ ID NO: 2026 - DNA, 273 bp, Streptomyces avermitilis
  CDS (1)..(273)
ttgtccgccgcccggaccgccggtggcatggccggcctgatcgtggtcgacggcctcgacgagtatctgcccgcgccgctccgcgggatcacggaacacgtcgtcgcgctcaaggacttccaactcgtgggcgaccagatcaagaccacgaagctcaagatcggtgcacccacgacacgcaccgtcaacgggcagctcaacccacggatccggatcaggcccggcgagacccagttgtggcgactcgggaacatcggggccaacatcctctac

SEQ ID NO: 2027 - DNA, 1809 bp, Streptomyces avermitilis
  CDS (1)..(1809)
atgacggtcctgcctgacgacgggctttcgctggccgccgagttccctgatgcgacccttgagcagtggcagcgcctcgtggcgggcgtactgcgcaagtcgggcaaggaagtctcggacacggcagccgaggaagctctgtccaccgcgctggaggacggcctcgccagccggcctctgtacacggcgcgcgactccgcgcccgatcccggccttcccggtttcgcccccttcgtccgcggtggccgcgccgaggggaacaccaccggcggctgggacgtacggcagcggcactcggccgccgacggcgacgcggtgctcgcggacctggagaacggcgtcacctcactctggctggtcgccggcgcgggcggaatccctgtgccctcgctcggccgggtcctcgacggcgtctacctcgacctggcgcccgtcgccctcgacgcgggaggtgacaccgagcccgccgcgcgcgagttgctgcggctgtacgcggagcggggtgtcgccaaggaggcggcgcgcggcaatctgggtgcggacccgctgggccacgaggcccgtacgggagacgagccgttcgacttcgcgccggtcgccggcctcgcgcggttgtgtgccgaggagtacccggggctgcgcgcactgaccgtggacgcgttgccctaccacgaggccggtggctccgccgctcaggagctcggctgttcgctggcgaccggcgtcgcctatctgcgggagctgaccgcggccggcctctcggtcgaacacgcctgcgggcagctggagttccggtacgccgccaccgccgaccagttcctgaccatcgccaaactgcgggcggcccgcaggctgtgggcacgggtcgccgaggtgtgcggggcgccgggcgcgggggcgcaggtgcagcatgccgtgacctcgccggtcatgatggcgcgccgcgatccgtgggtgaacatgctgcgtacgacggtcgccaccctggcggccggggtcggtggcgccgacgccgtcacggtgctgcccttcgaccacgccctcggccttcccgacgcgttcgcccggcggatcgcccgcaacacctcgacgatcctggtcgaggagtcgcatctgtcgagggtgatcgatccggcgggcggctcctggtacgtggagcggctcaccgacgaactcgcccactcgggctgggagttcttccaatggatcgagcgggagggcggccaggcgggggccctgcgctcgggccggctcgggcaggacctggcgaacacctgggcggcgcggagcgcgaagctcgccgaacgacgtgagcccgtgaccggggtcagcgagttcccgagtctcgccgagcgccccgtggagcgcgcgcccgcacccgcctctccgtccggcggcctcccccgggtgcggcgcgacgaggcgtacgagacgctgcgcgcccgctccgacgcccacctggcggcgaccgggtcccggccgcggatcttcctggccgccctgggtcccgccgccgcccacaccgcccgtctcgccttcgcctcgaacctgttccaggccggtggcatcgagcccgtcacggagggcacgttcgaggacagcggtgccaccgaggtctgtctctgctccagcgacgcgctgtacgaggagcgggccgcggaggtcgccggggccgtcaaggcggcaggcgccaggcatgtgttcctcgccggccgtcccgggcggtaccccggtgtcgacagccatgtcttcgcgggctgtgacaccgtcgccgtactctccgccaccctcgaccgtatgggagtgtcc

SEQ ID NO: 2028 - DNA, 2172 bp, Streptomyces avermitilis
  CDS (1)..(2172)
atgggaatccccgacttcgccgggatcgagctgggcacgcccaccgcctccggcggccccgacgagtggcgtacggccctgaagaaggcgaccggcggcgacgacctcctctgggagacccccgagggcatcacggtcaagcctctctacaccgggcaggacgtcgagggcctggacttcctgggcacgtacccgggcatcgccccgtatctgcgcggcccgtacccgacgatgtacgtcaaccagccctggaccatccgccagtacgcgggcttctccaccgccgaggagtccaacgccttctaccggcgcaacctggcggccggccagaagggcctgtccgtcgccttcgacctgcccacccaccgcggctacgacagcgaccacccccgcgtgaccggtgacgtcggcatggcgggcgtggccatcgactcgatctacgacatgcggcagctcttcgacggcatcccgctcgacaagatgaccgtgtcgatgacgatgaacggcgccgtgctgcccgtcctcgcgctctacatcgtggccgccgaggaacagggcgtgccgcccgagaaactggccgggaccatccagaacgacatcctcaaggagttcatggtccgcaacacctacatctatccgccgaagccgtcgatgcggatcatctccgacatcttcgccttcacgtcgcagcggatgccgcggtacaactccatctccatctccgggtaccacatccaggaggcgggcgcgacggccgacctggagctcgcgtacacgctcgccgacggcgtggagtacctgcgggccggccaggaggccggcctggacgtcgacgccttcgcgccccggctctccttcttctgggcgatcggcatgaacttcttcatggagatcgccaagatgcgggccgcgcgcctgctgtgggcgaagctggtcaagcagttcgacccgaagaacgccaagtccctctctctgcgcacccattcgcagacctccggctggtcgctgaccgcgcaggacgtgttcaacaacgtgacgcgtacgtgtgtggaggcgatggcggccacccaaggccacacgcagtccctgcacaccaacgcgctcgacgaggcgctcgcgctgcccaccgacttctcggcgcgcatcgcccgcaacacgcagctgctgatccagcaggagtcgggcacgacccgggtgatcgacccgtggggcggcagcgcgtacgtcgagaagctgacgtacgacctggcgcgccgggcctggcagcacatcgaggaggtcgaggcggcgggcggcatggcgcaggccatcgacgccggtatcccgaagctccgggtggaggaggccgcggcccgcacccaggcgcggatcgactccgggcgccagccggtcatcggcgtgaacaagtaccgcgtcgagaccgacgagaagatcgacgtcctcaaggtcgacaactcctccgtccgcgcccagcagatcgagaagctccggcggctgcgcgcggagcgcgacgaacaggcctgccaggacgcgctgcacgccctgacccgcgccgccgagggcaccggcaacctgctggagctggccgtgaacgccgcccgcgcgaaggccaccgtcggggagatctccgacgccctggagaaggtgtacgggcggcacgcggggcagatccgtacgatctccggtgtgtaccgcaccgaagcaggcgagtctccgtccgtcgagcgcacccgtacgctcgtgggctccttcgaggaggccgagggccgccgtccgcgcatcctggtcgccaagatgggccaggacgggcacgaccgcggccagaaggtgatcgccaccgccttcgccgacctcggcttcgacgtcgacgtcggcccgctcttccagacccccgccgaggtggcccgccaggccgtggaggcggacgtgcacatcgtcggcgtctcctcgctggccgcggggcatctgaccctcgtaccggcgctgcgcgagcagctcgccgaagaggggcgcgaggacatcatgatcgtggtcggcggggtgatcccaccgcaggacgtgccgaccctgctggagatgggcgcggcagccgtcttcccgcccggcacggtcatccccgacgcggcgtacgacctggtgacgcggctggccgccgatctcggacacgacctc

SEQ ID NO: 2029 - DNA, 984 bp, Streptomyces avermitilis
  CDS (1)..(984)
atggcgatcgacctcgacagctatgtgaagggcgtactcgaagggaagcgggcgcagatcgcgcgcgccatcaccctcgtcgagtccacccggcccgatcaccgttccctggcacaggagttgctcaccgagctgctgccgcacagcggccaggcgaaacggatcgggatcagcggtgtgcccggggtgggcaagtcgacgttcatcgacgcgctcggcaccatgctcaccggcctcggccaccgggtcgcggtcctggccgtcgacccgtcgtcgagccggaccggcggttcgatcctcggcgacaagacccggatggagcgtcttgccgtcgaccccgcggccttcgtacgcccctcccccaccgccggcaccctgggcggggtcgccaaggcgacccgcgagtcgatcgtggtgatggaggccgcgggctacgacgtcgtcctggtcgagacggtgggcgtgggacagtcggagaccgcggtcgcgaacatggtcgactccttcctgctgctcaccctcgcccgtaccggtgaccagctgcaaggcatcaagaagggggtgctggagctggccgacgtgatcgccgtcaacaaggcggacgggccgcacgagcgcgacgcccgcgccgcggcacgggagttggcgggcgcactgcgcctgatgcacggcgccaacgccgcctggaccccgcccgtgctcagttgcagcgcgcgcgacgcggtgggcctggacacggtgtgggagcgcctcgaacagcaccgcacgctcctcgactcgaccggccggctcgccgccaagcgccgcgaccagcaggtcgactggacctggaccatggtccgcgacgaactcctcggccgcctgcacgccgatccggccgtacggaccctcgcgccttccctcgaacagcaggtgcgggacggcgcgttgacggccacgctcgccgccgagcgcattctgcgggtgttcggcgacggggtgcgg

SEQ ID NO: 2030 - DNA, 1404 bp, Streptomyces avermitilis
  CDS (1)..(1404)
gtgggcaagacctacgcgggagcgcggctacgacgcctgcgcgaggaacgccggatgagccaggccgagctggcccgggtcctgggcatctcacccagctatctgaaccagatggagcacgactcccggccgctcaccgtgccggtcctgctgaggctgaccgaagccttcggtgtcgacgcgggcttcttctccgagcgcgacacgacccggctgatggcggatctgcgggaggcgctggcgcgcgagatcgccgaaacccgggtgtccgcctccgatctgacggagctcgcctcgcggataccggccgtcgcgaaggtcctgctcgacctgggccgccgcaaccaactcctgtccgagcggctcgccgaggccgcggagggccgggacggcgagccggacgtaccccgctcgccgcacgaggagatccgggacttcttctaccgccggcagaactacctgcacgacaccgacctcgcggccgagcggctggccgaggagatcggcatccggcccggcgaggtcgtacgggcgctgacggcgcgactcgccgaccggcacggcgtgcggctgaccgccgagaccggtgaccacctgcatcactacgacgacgcgtcccggactctccacctgtccagccgcctccgccccggacagcgggcgtttcgcatggcgacccaactcgccctgctggagtacggcgacgaactggaccaccaggcggcccaggacttcccgaccgctacgcccacgcatgccctggcccgtatcggcatcgccaactacttcgccgccgcgctgatcctgccctaccgcacgttccacgccgcggcggaggaggcgcggtacgacatcgagcgcctcaccgaccgctacggcctcggctacgagaccgtctgccaccgcctgagcaccctccagcgcccccgcctgcgcggagtgcccttctccttcgtacgcgtcgaccgggccggcaacctgtccaaacggcagtccgcgaccggcttccacttctcccgcgccggcggcacctgcccactgtggaacgtctacgaagcgttcgccgcgcccggccgcatccacgtccagatcgccgaaatgcccgacgggcagcgctacttgtggacggcgcgggcgatcacccgccatcgcggcggctggggcgagcccggcaagaccttcgccatcggcctgggctgcgagatccgccacgcctcccggctcgtctactcggacggcctcgacctcggcaacgcttccgccgccatccccatcggcatgggctgccgcgtctgcgaacgcctcgactgtccccagcgcgccgcaccgcccctcggccgcccgctacggatcgaccagaacagcaccacgttcgttccgtatccggtggcacaccgaccggaa

SEQ ID NO: 2031 - DNA, 1281 bp, Streptomyces avermitilis
  CDS (1)..(1281)
atggcagaggcgaggacgacggcggccgaggagctcacacgacgctgggccttcgacccccggtggcaggggatcgagcgcacctacggcgccgcggacgtcgtacggctgtccgccagcgtccgtgaggaacacaccctggcccggcgcggtgccgagcggctgtggcggcagctgcacgagctggactacgtccacgcgctcggcgcgctcaccggcgggcaggccgtgcaacaggtgaaggcggggctccaggccatttacctgtccggctggcaggtcgccgccgacgccaaccaggccgggcacacctaccccgaccagagtctgtacccggccaactcggtgccgcaggtggtgcgccggatcaacaacgcgctgctgcgggccgaccagatcgccaccgccgagggcggcgaggacaccaccgactggctcgcgccgatcgtcgccgacgcggaggccgggttcggcggccccctgaacgccttcgagctgaccaaggcgatgatcgccgcgggtgcggccggtatccactacgaggaccagctcgcctcggagaagaagtgcggtcacctcggcggcaaggtgctggtgcccacctcccagcacatccgcaccctcaacgcggcgcggctcgccgccgacatcgccgacgtgcccacggtgatcatcgcccgcaccgacgccctggccgcgaatctgctgaccagcgatgtcgatgagcgcgacgccgagttcgtcaccggcgagcgcaccgcggagggcttctaccgggtacggggcggcatggcgccggtcatcgcccgcggcctcgcctacgccccgtacgccgacctgatctgggtcgagaccggcaccccggacctcgcgcaggcccgcgagttcgccgaggcgatccacgccgagtaccccgaccggatgctcgcctacaactgctcgccgtccttcaactggaaggccgccctggacgacgaccagatcgccaagttccagcgggagctgggcgcgatgggctaccgcttccagttcatcaccctggccggcttccactccctcaaccacggcatgttcgacctcgcccgcggctacgccgagcacggcatgaccgcgtatgtcgacctccaggagcgggagttcgccgcgcaggagcacggcttcaccgccgtcaggcaccagcgcgaggtcggcaccggctacttcgacctggtctccaccgccgtcaacccggcctcctcgaccacggccctggcgggctccacggaggaggagcagttccac

SEQ ID NO: 2032 - DNA, 1590 bp, Streptomyces avermitilis
  CDS (1)..(1590)
atgtccaccagcgcactgacacaccgcgtccgggtcctcgcggcaccgggcgaccgccacgacgagatcctgacacccgccgccctggacttcgtcggccgcctcgtcgcggccttcggcgagcggcgcccggagctgctgaaggagcgcaggcggcaggcgatacggctcgcggccggatccgcgctcgacttccccctcgccaccgccggtgtccgggcggacgcctcgtggcgcgtggccgcaccggcccccggcctgaccgaccggcgggtggagatcaccggcccgcccgaccgccgtacggccgtcaacgcgctcaactccaaagcgcgggtgtggatggcggacttcgaggacgccacctcccccacctgggacaacatcatcggcggccagctcacgctgctcgacgccatcgagcggcggatcgacttcaccacaccggagggcaaggagtaccggttgggtgaccggctcgccaccatcatggtccgcccccggggctggcacctgacggaggaacacctggagttcgacggccggcccgtacccgcctccctcgtcgacttcggcctgtacttcttccactgcgcgcagcgccagatcgacgccggacacggaccgtacttctacctgccgaagctggagaacagatacgaagcccgcctgtggaacgacgtcttcgtcctcgcccaggagctgctcggcatccccccggggaccatccgggcgaccgtgctcatcgagacgatcaccgccgccgtggagatggaggagatcctctacgagctgcgcgaacacagcgccggcctcaacgcgggacgctgggactatctcttcagcttgatcaagaccttcgggcaccgcaccgacttcctgctgcccgaccgggccacggtgaccatgaccgcacccttcctgcgcgcctacaccgaactgctggtgcgcacttgccaccggcgcggcgcccacgccatcggcggcatgtccgcgcaggtgcccggcagggatccggccgcgggcgaggcggccctggcgaaggtccggctggacaaggagcgcgaggcggaggacggcttcgacggctcctgggtggcccaccccggcctggtgcccatgtgccgcgaggtcttcgacggtgtcctcggcgagcggccgcaccagatcgagcgcacccgggacgacgtggaggtgaccgccgcggacctgctgtcggtgcggcgcatcagcggaccgccctcgccggaaggggtccgtaccaacatcgcggtctcgctgcgctacttcgacgcctggctgcgcgggcggggggccgtcgccctgtacggcctgatggaggacgcggcgaccgcggagatcgcccgcgtgcagatctggcagtggctgcggcaccgggtcgtcgaccgggataccgtggtgcggctgctcgacgacgaactcgccgccctgggcgcggagtacccctgggcggccctcgacgaggtgcgtgcccttttcgaacgaacggcgctggccgccgagttgccgctgttcttcaccccggacgcctacacccgtcacctcgtccggcacgcggaggcgcggtca

SEQ ID NO: 2033 - DNA, 867 bp, Streptomyces avermitilis
  CDS (1)..(867)
atgagccgaggcatccgacgcgtcggagtggtcggcggcgggcagatgggcgccggcatcgccgaggtgtgcgcccgagccggactggacacgatcgtgtgcgaggtggacgccgaggccgcccgagccgcacgggaacgcgtggaggcctcgctggatcgtgccgtccggcacggaaagctggaccgggccgccgcgcaggacgccctcgcccgtacgaccttcacccgcagcctcgaagacctcgccgaccggcagctcgtggtcgaggccgttgtcgagaacgcggacgccaagaccgaggtcttcgccgcactggacaagatcgtcgaggatcccgaggcggtcctggccacgaacacctcctccctcccggtcacgcgcctgggcatgacgacacgacgcgccgaccgggtcatcggcctgcacttcttcaacccggtaccggtcctgcccctggtggaggtcgtcgcctccctccacacctccgcgcggaccgtcgacgccgtcacggacttcgccacccggtcgctgggcaagaccgtcatccgctcgcaggaccgggccggcttcgtcgtcaacgccctgctcatcccctacctcctgtcggcgatccgcatgacggagtccggcttcgcctccgtcgccgacgtcgacgccggcatggaacgcggctgcgcccatcccatgggaccgctgaagctggccgacctgatcgggctggacaccgtcgcctcgatcgcggagtcgctgtacgacgagttcaaggaaccgctctacgcatcgccgccgctgctccagcggatggtggaggcggggctgctcggccgcaagacgggccgtgggttccacgtgtacgaccagggc

SEQ ID NO: 2034 - DNA, 2316 bp, Streptomyces avermitilis
  CDS (1)..(2316)
gtgacagcgaagtccgcagccgcggcggcacgggccaccgtgtacggctacccccgccagggccggggccgggaactgaagaaggcgatcgaggggtactggaagggccgcctcgacgccgacgccctccggaccaccgccaccggcctgcgccgggacacctggcagcagctggccgaggccggcatccacgaagtaccgaccggcgacttctcgtactacgaccacgtcctggacaccagcgtcatggtcggcgcgatccccgcacgccaccgcgccgcggtcgaggccgacgcgctcgacggctacttcgcgatggcgcgcggtacgcaggacgtggcgccgctggagatgaccaagtggttcgacaccaactaccactatctggtgccggagttgggtccggacaccgtcttcagcaccgactccgccaagcaggtcgccgagctcggcgaagcgctcgccctcggcctcaccgcccgcccggtcctcgtcggcccggtcacctatctcctgctcgccaagcccgcgcccggcgtggccgcggacttcgacccgctgaccctcctcgaccggctgctgcccgtgtacgccgaggtcctcgccgacctgcgggcggccggcgccgagtgggtgcagctcgacgagccggccctcgtccaggaccgcacgcccgccgaactgaacgccgccgagcgcgcctaccgcgtcctgggagggctcaccgaccgcccgaagctgctggtcgcctcctacttcgaccggctcggcgacgccctgcccgtcctcgccgaggcacccgtcgagggactcgcgctcgacttcgccgaaggggccgccgcgaacctggacgcgctcgccgccgtgggcggtctgcccggcaagcgcctggtcgccggtgtcgtcgacgggcgcaacatctgggtcaacgacctggagaagtccctcgccctgctgggcaccttgctggggctcgccgaccgggtcgacgtggccgcctcctgttcgctgctccacgtcccgctcgacgccgccgccgaacgcgacatcgcaccgcaggtcctgcgctggctcgccttcgcccgccagaagaccgccgagatcgtcaccctcgccaaggggctcggccacggcaccgacgccatcgccgcgcagctcgccgccaacagggccgacctcgtctcccgcgccgactcggcgctgacccgcgacccggcggtacggtcccgcaccgccgccaccaccgatgccgacgcccgccgctcggggccctaccccgagcgggccgccgcccagcgcgcccgcctcggtctgcccctgctgccgaccaccaccatcggctccttcccccagaccgccgaactgcgcaccgcgcgggccgacttgcgggccgggcggatcgacagcgccgggtacgaggagcgcatcagggccgagatcggcgaggtgatctccttccaggagaaggcgggtctcgatgtcctcgtgcacggcgaggccgaacgcaacgacatggtccagtacttcgccgaacggctcaccggctacctcaccacgcagcacggctgggtgcagtcgtacggcacccggtatgtgcgcccgccggtcctcgccggcgacatctcccgcccggagccgatgacggtgccctggacgacgtacgcgcagtccctcaccgaccgcccggtcaagggcatgctgaccggcccggtcaccatgctcgcctggtccttcgtccgcgacgaccagccgctcggcgagaccgcccgccaggtcgccctcgccctgcgcgacgaggtgggcgaccttgaggcggcgggcacttcggtcatccaggtggacgagcccgccctgcgcgaaaccctgccactgcgcgccgcggaccgtcccgcctacctggcctgggccaccgaggcgttccggctcaccaccggcggcgttcgcccggacacccagatccacacgcacatgtgctacgccgagttcggcgacatcgtccaggcgatcgacgacctcgacgccgacgtcatcagcctggaggccgcccgctcgcacatgcaggtcgcccgggaactggccgagcacgcctacccgagggaggcggggcccggcgtgtacgacatccactcaccgcgtgtgccgggcgtggacgagaccgcggccctgctgcgcaagggacttgaggccatccccgccgaacgcctgtgggtcaaccccgactgcggtctgaagacccgcggttggcccgagacccgcgcgtcgctggagaacctggtcgccgcggcccggacggtgcgcgcggagcacgccggctcc

SEQ ID NO: 2035 - DNA, 630 bp, Streptomyces avermitilis
  CDS (1)..(630)
gtgaccagtcgcgtcaccttgatctcacccgcgatgaaccggtccctgcgggaggcccggttcgacgacggctgtcggctcgacgcgagcggcgcggcacacgccgagtccgccgccggcacgctgcccgcagccgaccgggtgtgggtctcccccacggcgcgctgtcgggaaacggcgtcggccctcggcctcaccgccatggaggcccccgagctgggaggtctggacgtgggccggtggcggggccggaccctcgacgacgtcagcggcggagaaccgcaggcggtcgccctttggctgacggacccggccgcggcaccgcacggcggggaatcggtgcgtgccctgtgcgcgcgcgtcgccgggtggctgctcacctgcgaagagatcgcgggcaggacccttgccgtagtggagccggagatcgtacgggccgtggtgatcacggtcctcgaatcgccggaggcggccttctggcggctcgacgttccgcccctgacggcgacggacatcagcggacgctccgggcgctggaatctgcgcatgggacggccgcttgacgtgcagggaaacggagttggaactgcaactgcaactgcaactggagctgaaactggcgccggacac

SEQ ID NO: 2036 - DNA, 432 bp, Streptomyces avermitilis
  CDS (1)..(432)
gtggccagacaactacaaccgcggcacatcacgctcggcggtcgcgaggcggtcgcgctgaccctggaggagtacgagcggctgatcgtcagcagacggcagatcggcggtcagagcgcccgggtaagggcgttgtcccagcgggtgaagcagagcgaggaactgctcacggaccttgaggcactgatcggtcggcacacggacggctgtcccggcccgcagggcgtgccgggcgacgccgcgccatgccagcgggagccgcagggggcggacgcgacggaccgggtgggggcgcggggacccggggccgcgggaacggcctcggactgcttgtgctgcgcgctcacggcactgctccggcgccatcggagcgggacaggcgggcgggacccgggtgacaagcggtcgccttcgccttcgccgccgcgccgg

SEQ ID NO: 2037 - DNA, 756 bp, Streptomyces avermitilis
  CDS (1)..(756)
atgaactccacaactgtcagaaaccttctcgtgcggggcatgctcgccggcctgggggccggcgtgctcgccctcctcgtcgcctacttcctgggcgaacccggcgtcgacgacgccatcggattcgaagaggcccatgccccggcgcacgagcacgaggtcgaactggtcagccgcggcctccagtccaccggcggcctcgccaccggggtcctggtctacggcgtcgccttcggcggcatagccgccctcgcctactgcttcgccctcggccgcgtcggccgcttcacgccgcgtgccacggccctgctgctctcggccacggccctgctcgccgtgtacgtcgtgccgttcctgaagtacccggccaacccgccgtcggtcggcgaccccgacacgatcggcaagcgcacgaccctgtacttcctgatgatggtgctcagcgtgctcctcgcggtcgccgcggtgatcctcggcaagcggctcgcacccaggtggggtacgtggtacgccaccgtcgcggcggtcgccttcttcggcctcgcgatcggtctcgcgtacgcgttcctgccggtcatcaacgaggtcccgaaggatttcccggccaccctgctgtggcggttccggacctccgccctcgccatccagctcaccctgtggaccggattcggcctgatcttcggggagttggcgcaacggctgctcgctccgcgcacggaaccggtcgcgcccgcgcaggccactcccgtaccccag

SEQ ID NO: 2038 - DNA, 219 bp, Streptomyces avermitilis
  CDS (1)..(219)
atggcgcagaccgtcgcccagccgacagccaccactcccgctcttcccgccaagctgccgatcggcgcgatcgtcccttgggcggtcttcttcggcattctgatgctcgtcctgctgtacttcgtcggcgccgagcagggagccacctccgtggtcaacggcgcggacgtccacgagtgggtgcacgacgcccgccacctcctcggcttcccctgccac

SEQ ID NO: 2039 - DNA, 618 bp, Streptomyces avermitilis
  CDS (1)..(618)
atgttgatcaaccacagcagcggcctcgccgagtaccttccttatgcctacccctccctcagggcgttccccgccctcgcggacaccgggccccagagcctggacgacaaccggctcacgcggtttcaccccaccgaactgatcgagatgggggtcaccgcacctgccgtcggcgccccgggcggcactccgggggtgtactccaacaccaactacctgctcctcggcgaactccttgaacaggtgaccggcactacagccgagcggtacatcacccggaacgtcatcgagcgcgccgggctccgggacaccgaactccccgccgatccgtacgtcgacgggccgcactcgcagatctacgaggcgtggttcggcatgatcgacccgccgcgcgactacagcgtctacgacatcggcgggcggcggtccgccggggccggcgcgggagccgaggccggcgcactccgcccgccgctgtcaccgccggcgcgcccagcaccgctgacccctgcgtcactccggccggccgtcctgtgccgcacgaagatcacggcaggcggcccggtcttggccagggacccggcacgcggtacggtcggtgcgataacgacgacggca

SEQ ID NO: 2040 - DNA, 882 bp, Streptomyces avermitilis
  CDS (1)..(882)
atgaagtcgctgctctcgtcgaagccggagacggcatacgagacgcggcacatggagcggacggcgggcggcgtgcacgacaccgccgcacgcaggaccccggccgctcccggcccgctcgcttccttcgcccggttcgtcctgtgcggcggcggagtcggggtcgtctccagcaccgccgtggccctgctggccgcactgatgccctgggcggtggcgaacgcgctgatcaccatggcctccaccgtcctctgcacggagctgcacgcacgcttcaccttcggggccgggcagcgtgccggatggcgtcagcactggcagtccgccgggtcggccacggccgcctacgcggtgacctgcgccgccatgctcgtgctgcgcatggtgcagccgtcgcccgggatgctctgcgagcaggccgtctatctcagcgccgccgcgctcgccggaatcgggcgcttcctggtactgcgcctgttcgtcttcgccaccgaccggaaccggaaccggaccacgaccacgaccacagccacagccacagccacggtccgagcgacgagccctgcacggccgtgggacctgtcggaagcggggcgggcgcggggcacggagaccattgctgcgcgggtcaggtcctatgcctcggccgacgtcagcaggtgcggggcgagggcggcgaccgttcccgccctccggggaagctctcggtgccgggccatcaggcgtcccgcgcagggcagttcgacggtgcgcccaccgatctcctcaggccgcaacaggccgcaccggttcgccggtaggaaacgcgccgtgcgctgcgacccggctgggtcagctccggcgggcgggaccgaggccggcgcctcggcctgcggcgtgtgc

SEQ ID NO: 2041 - DNA, 504 bp, Streptomyces avermitilis
  CDS (1)..(504)
atgacggtctacgcgacgatcgacagcccgctgggcgcattgctgctggtgggcgaggagtccgccaccgccaagggcggtaccgcgctggcctccctgtccgtgccgggccagaagggcggcgcgaccgtccaggacgactggctcgagaaggcggaggcgttcgacgagatcgtcacccagctcacctcctacttcgacggcaggctgacccggttcgacatcgagtacgtcaccggcggctcggagttccagcggcgcgtgtggcaggccctggaggccatcccgtacggcaccaccctctcctacggcgacatcgccgcgcggatcggcgccccgagggccgcggtccgggccgtcggcacggcgatcggcgcgaacccgctgctggtcgtccgcccctgccaccgcgtgatcggcgcgagcggcgcgctcaccgggtacgccggcggcctggagcgcaagcggcggctgctggacctggagaacgcccaccgggacgcc

SEQ ID NO: 2042 - DNA, 729 bp, Streptomyces avermitilis
  CDS (1)..(729)
atgaacggcaccgctcatctgccaccccgcatcggcgaccgcgtcgccgagtgcgactggtccgccatcaccgacgaactcgacgagtacggcaacgcccccaccgggcagcttctcactcccgccgagtgccgcgggatcgcgaacctgtacgaggagcccgaccgcttccgctcgaccgtggacatggcccgccatcgcttcggctccggccagtaccgctacttcacccacgaactgccggacacggtcgccgagttgcgggcggcgttctatccccgtctgctacccatcgcccgcgactgggccgaacggctcggcacatccgccccgtggccggacagcctggcggagtgggtagcgctgtgccacgaggccggacaggccaggtccgcccagatcctgctgcgctacggtcccggcgactggaacgctttgcaccgcgacgtgttcggcgagatgctcttcccactccaggtcgtcatcggcctcgacgcccccgaagtcggcttcaccggcggcgagttcatcatgaccgagcagcgcccccgcgcacagtcgaggggttcgtccaggaccctgccccagggtcacgggctggtcttcaccacccgcgaccggccggtggcgagcaggcggggctggtccaccgcgccgatgcggcacggggtgagcacggtccgctccgggcgacggcacacgctcggcctcgtcttccacgacgccgca

SEQ ID NO: 2043 - DNA, 1002 bp, Streptomyces avermitilis
  CDS (1)..(1002)
atgaagaccttcatgatcgagcggtacggcgacaaagccggcgtccgcgccggtgagatgccggacccgcaggtgggcgccgacgacatcctggtccagatccacgcggcgagcgtcaacccgctggacctcaggctccgcgacggggacttcaaggcgttcctgccgtaccgtctcccgctcatcctgggcaacgacctcgccggggtggtggtccaagtgggatcggccgtcacgcggttcgcggtgggcgacgaggtctacgcgcggcccgacaaggatcgcatcggtacgttcgccgaactcatcgccgtccaccaggacgacgtggcggccaaaccggccacgctcaccatggaggaggccgcgtccctacccctggtggccctgacctcgtggcaggcgctggtcgagcgggcacgcgtgatgccaggtcagaaggtcctcatccacgcgggctccggcggcgtcggcaccatcgccgtccagctggcgaagcagctgggcgcgcacgtggccaccaccgcgagcacggccaaggccgacctgatgaaggagctcggcgcggacgtcgtcgtcgactacaagaagcaggctttcgagacggtccttcacggctacgacgtcgtcctggacaccctcggcggcgagacgctcgagaagtcccttcaggtactcaagcccggcgggaaggtcatcagcatcgcaggccctcccgacccggccttcgcccgcgagctgggcgcgaagccaatcctgcgactggcgatgagcgcgctgagcttcaggacccggcgccgcgccaagcgccgcaacgtgacgtactcgttcctgttcatgaaggccagcggcgaccagctgcgcgaactcacgccgctcatcgacaccgggaagatccgtcccgtcgtcgaccgtgtcttccctttcgcggagacccgacaggccatggagtacgtcgagaagggccgcgcgaaggccggaaaggtcgtcgtcgcgatgacg

SEQ ID NO: 2044 - DNA, 387 bp, Streptomyces avermitilis
  CDS (1)..(387)
gtggaaaccgcgtcccgactgttccgggagcaaggcacccgcgtcagcgtcgccgacctcatgaaggcgtccggcccgacccacggcggcttctacaagcagttcacttccaaggaggccctcatcggcgaagccaccgcccacgcgttcgacgaactcgcccggctccgcaatgacggactcgagcagcatgccgggcagcgcgacgccgcccagcaggcactgatcgacaccaccgagggagtgagcgacttcgccgaatggctcaccgtcgaggaccgggacggcatcacccgtctgtgcaccatgctcggcgcactcatcccggcccgagccaccaaagacccccactctccgaggaaatcctcaccaccgcgcgcgcagcat

SEQ ID NO: 2045 - DNA, 327 bp, Streptomyces avermitilis
  CDS (1)..(327)
atgggtgacgtacctgagacacatacaggctggacatttctgaccaatcacgctcgcgtgctgtctgcgatcgccgaggatcccaccgtgcgtattcgcgatatcgccgcgcactgcagactcaccgagcgggcggtccagaagatcatttccgatctggagcagggcggctatctcacccacacccggcagggacgttccaatacgtaccgcattcagccgggcactttcctgcggcacccggcggacaacggctcgaccgtggcggacctgctgtccctcctcgcccagcatgacagccggcgggacggtcagccgcagcaggcg

SEQ ID NO: 2046 - DNA, 783 bp, Streptomyces avermitilis
  CDS (1)..(783)
atgtcagagcaagagctttcccagctgtcggggggcatggatgacgctgccccctgcccttggctgaaggtcgaggtacatccggccggcgaccggcaggttgtcgtggcgtacggcgacatcgacgtcgacaccgaagcgatcctgcaacgggctctgcgcgaagctctcgaccattcggtcagcggcgtgaacctcgatctcggcgccgtcggcttctgcgactgcgccgggctcaacgtcctgctgcgcatgcgtcggcatgctctggcacatggcaagacactcgccgtccaggccaccggcccggcgaccggaaagctgctcacgatcaccggcacactgtcactgttcgacgtcacggccggccccggcacgcgcgccaagggccggaacccgcttccaccggaaccgcacgacccgagccgagtcgaccacatcgacgggaccggccggggcagagacggaaccgacctggaaaccgacgggacaatcgacggaacagtggtcgacctgcgcatcgaagtcggtcagctgcggcgcgccatgcagacccggcccgtgatcgatctggcccgcggtgtactgatggcgtccttcggtctgagcgccgaggacgcctggaccgtgctggtcacggtgtcccagcacaccaacaccaaactgcaccagatagccgaggacctggtgaacacggtccagggagccccgctgcccgagccgttgcagcggcaactcgccgaggcggtcatgccgttcagccgggtacggaatgcgggggcg

SEQ ID NO: 2047 - DNA, 1296 bp, Streptomyces avermitilis
  CDS (1)..(1296)
gtggaccgtgcgactgcctggcgtgacacctggagcacgacgcggcaccgtggcgtcgaacttccgcatgcgcgcggcgtgttctcggtgctgctcggactcctcgcggtcgtggaatcgctggccgaattcgtcgtggggcacggatcgatcccgcggatgttcgccgagtccgccacgacgggcgtccgcgacggcggcgtcgcgggtgtgcaactcgccatggtggtcggcctgttgtgtctgttcaccgcactgccgttggctctgctgcgccccctgccggccggcgtcaccgtcacggccgcgagtttcggatcgctcgtgatcttccagacgctgacactcgcgggcttcgccgcccagtgcgtcgcccagtaccggctcggccgcagcggtcacccggtcgcggccgtgctgctcggcgcccccttcctcgccctggcactgcccgcgtcccaggacaccgacttccgcacacgggtggtcctgctcgcggcgctcgcgccggtggccgcactcgtcggactggtccggcggaccggtgaacaccagcgggaacacacggcagtccagcaggtcatggccggcacccagtgggagaacgccgcacgcggggagcgcgcccggaccgtccgtgagctccacgacgtcgtcggccaccacatctccatgatcgccgtgcgggccgagacggcccgggtggccacccccggcatgcccgccgtgggcgccgacaggctgctcggcatcggggacaccgcccgcgcggccctcaccgagatgcgccggctgctcggcgtactccgggaggacacggagcccgtgaccggcggcgagcgtcgaccgcagccggacctgcgccggctgggcgaactgctcgacgaggcccgcgaggcgtccggatcgacgtcggtccgcctcatcctgtccggctccccgcgcacactggaacccggcctcgaactcgccgcgtaccgcatagtccaggagtccctcaccaacgcccgcaagcacgcgccgggcgccgccgtcgacgtcgagctcatctacaccgaggacgccctgcgcatgcgtatccgcgacaacggacccgggccgccccacaccgagcgggccgacggacacggcctgctcggcatgcgggagcgggccgcggccgtcggcggacagatccgcacaggctcgacggccgtcgggggattcgtcgtcgacgcccgtttccccgccgtgcgcgaaagggtggcgggcggcgggcgggggcggcggtggtgtgcggcggtgtgcggtgtgagg

SEQ ID NO: 2048 - DNA, 762 bp, Streptomyces avermitilis
  CDS (1)..(762)
atgaaaagaccggggaccaggttccgtgcggccgcagtttgtgcggctgtcgtctccctcgccctccccctggcgggctgctcctcgctcgagaccaccgcgcccagtgccgcccgggcacatgccgccggggccgcggcccgactcgggaccgtggactgccggcagaccaagtgcatcgcgctgaccttcgacgccgggcccagcgagaactccgcgcggctgctcgacatcctcaaggagaagaaggtgcccgccaccttcttcctgctcggcaagcggcacatcgagaagtatcccgagctggtcaagcgcatggccgacgaggaccacgaggtggccagccacacctgggaccacaagatcctcacccggctcaagccggcggagatacgcgcggaactggaacggccgaacaaggacatagagcggctcaccgggcggcaaccgaccctgatgcggccgccgcagggtcgtacgaacgcgacggtgcacaagatctgccgggagctggggatctccgaggtgctgtggagcgtgaccgccaaggactacacgaccgacgaccccaagctcatccagaagcgcgtgctggcccagtcgagccgtgacgggatcatcctgctccacgacatctacccgggtacggtcccggccgtgcccggcatcatcgacgcactgaaggaacgcgggtacgtcttcgtcaccgtgccgcagctgctggcgcccggcaaggccgagccggggaccgtctaccggccc

SEQ ID NO: 2049 - DNA, 1224 bp, Streptomyces avermitilis
  CDS (1)..(1224)
gtggacctcgaactgcacggcaggctcgacgagttgcagcgcgacccctacccgcactacgcgcgggcgcggcggttcaccgccctcgagcacgtccccgagctggacgcctggctggtggcgcgggacgcggacgtacgggaggtgctgcgcaggcccgacgacttctcctcggccaacgcactgcggcccgatgtcatgcccgcgcccgccgccctcgccgtgctcggcggagggttcggcgggcgtccggtcgtggtgaccgcggacggcgcccgccatcaggagctgcgggcgccgatcgtgcgcggtctctcgcccgcgcgcgtcgccgccgtgctgccgtacgccgcggagcgcgccaccgccctcgtcgacaggttcctgagcggcgcggagagcggccgcgtcgagctgatggccgcctatgcccgccggctgcccggtgacgtcatcggcagaatcgtcggcctcgaccccgccgacgtgccggccgtcgtgtacggcgggcaccgcgccgaagagctcctcttccgtccgctgacggaggacgagcaggtggttgccgcgcaggacgtggtcgccatgcagcatctcctcgatgccttcgtacgcgaccgccgtgccgatccgcgcgaggacctggcctccgagatcatcgcctccgtggcgccgggagacggtgagctgacgctcgatcagcggcacgacatcgtggcgcatctgcagaacctgctcctcgccgggcacctgaccacgaccgccctgatcggcacgacggtactgaacctgctgcggcacccgcggcagtgggagctgctgtgcgcggagcccgagcgcattcccgcggccatcgaggaggccgcccgctacgacagcgcgctccagggcttccgtcgtgtcaccacccggccggtcacgctcgccggaaccgaactcccggcgggagcatcggtgttcgtggccttcggcggggcgaaccgcgacgggggacggcatccgcggcccgacgagttcgacatcacccgcaccccgcgccgccatctcgccttcggcttcggcgtgcacggctgccccggcgcgcagctcgcccgcgagcaactgcggctcacactggagcagttgacgcgccgcctgccgggcttgcggccggccgacgaccggcccgtgaccatgcgccccaccctgatccaccgctcaccgcggagtctgcacctggtctgg

SEQ ID NO: 2050 - DNA, 1005 bp, Streptomyces avermitilis
  CDS (1)..(1005)
atgccgttgaagacctatggcgtactgatcgcacgcgcggtcgacgtccgtcgcgagggttccaccgacacgccgcactaccaggtccatctgacggacgatcaaggcacgcactaccgcgcctcggtcaacgtcaagtcccaggagcggccctccgagctgctctacctggtcgacgaggacttccgtcaccccatcacggcccgtctggagggcctcgtgagcgggtggagcaagctgccgtcggggccgggcggacccaatctcgacttcgtccgcggcaatctcttcgacccgtcgaagatgcgcacgcttccgccggaggtggagggccccgacaacgacctcgccgacatcctcgaccactacgtacgccgggcggtggaggatccggccgcgcggatgtacgtcttcggggagcgctggggacccgaggccgagctccgggacaaggtcttcgacttcctgcccggcaacggcgtccacgacatccatatgaaccagggcaacagccgtcgcttcgagggcgacgacggagtctggcaggacggcgggctgctgatccacttcccggcccagtcgcgctgggtcggcgtgttcctcgccttccagagccagaagtggcacacggacgacgccaccggccacgccctcgatgtcgccgggccccgccccgagcccgggttgcagccggtgcgtctcgtggcggccctggtcaatccgcccggcccggcccccgagacggagagcgtcacgctcatcaacgcctcgcccgccccggtcgacctcaccggctggcgcctcgtcgatcgcctgggacacggcggcccggtgccgcccggcccgctcgcggcgggcgccaccctgagcgcacccctctccgacggagcccaactgggcaaccatggcggcgagatcaccctgctggacgccgacggcctcaaggtgcacggcgtctcgtacaccgccgagcaggccgcgcacgaggggtggacggtggtgttc

SEQ ID NO: 2051 - DNA, 447 bp, Streptomyces avermitilis
  CDS (1)..(447)
gtggtcctcttcctcctcgaacgcgtcgcgccggtttccgtcgatcaggcctggcaccggctcacggactgggaacgccacgcggccgtggtcccgctgacccgggtcaccgtcgccacgccgccgccgacccgcgtcgggacgctcttcgtggcccgctcaggaatcggcccgctcgccttcgacgacccgatggaggtcgtcgcctggcagccgccgggggcgggcgccccggccctgtgccgactggcgaagaggggcggcttcgtcacgggttgggccgagatcgaggtgcatccctacggtgacggagcctcgcgggtggtgtggcgggaggatctgagcgtgcgagggctgccgcacgccttcgacaggcccctgggcgcggtggcccgacggatgttcggccgggcggtggacgggctactgcggcccggcccggcctcg

SEQ ID NO: 2052 - DNA, 708 bp, Streptomyces avermitilis
  CDS (1)..(708)
atgaccgagacctctcacctgcacaccacccggacgtcgtacgacgccgtcgcagtcgattacgacaggctgctcaggaaccatctggcgcacctgcccttcgaccgggccatgctgggagcgttcgccgagcgggtggtcgccgagggcggagggcccgtcggcgacctgggctgcgggcccgggcgggtgaccgtccatctgaagtcgctcgggctggatgccttcgggatcgatctgtcaccggagatggtcgcggtggcccggcagacctacccggaactgcggttcgacgtcgggtcgatgaccggactcgacctcgacgacggctcactcgccggagccctcgcctggtattcgctcgtccacaccccgcagccggaactgccgcctgtcttcgcggagttccatcgggtgctcgctcccggcggacatctcctcatcgccttcaaggcgggcgacgagtgcgtccacctggagcacgcctacggccacgatctgtccctggacgtctaccgcttcccgcccgagcggatctccgagttgttgcgcgaggccggtttcgtcgaggtcgcccggctggtgcgggaagccgacgcgagctgggagaaaaccccacaggcatacctgctggcacgcaagcccgcccagccgcgagccccccggccggatacgccagaggcctccacccgagacgcagcggcctcc

SEQ ID NO: 2053 - DNA, 1149 bp, Streptomyces avermitilis
  CDS (1)..(1149)
atgctggacatcgccgaagagctgcaccggtgggtcgagcggggacgcgacttcgccgtggccaccgtggtggccgtcggcggcagcgcaccccgccagcccggcgccgccctcgcggtggacgccgacggcacggcgatcggctcggtctccggcggctgcgtggagggcgccgtgtacgagctgtgccggcaggcgctcgaggacggcgaaaccgtcctggagcgcttcgggtacagcgacacggacgctttcgccgtcggactgacctgcggcggcgtcatcgacatcctcgtcacaccggtccgggcggccgatcccgcccggccggtgtacgcggccgcgctggccgccgcggcgcacggggaggcggcggccgtggcacggatcgtcaccggccccgcggagctgctgggacgcgcgctgctggtccgccccgaaggctcgtacgagggcggcttcggcgcccaccccgaactggaccgcacggtggcgggggaggccggcgccttcctggacgcgggccgcaccggcacgctggagacgggagagcagggcgctcgctgcggagcaccgctcacggtcctcgtcgaatcctccgtcccgccaccgcgcatgatcgtcttcggtgcgatcgacttcgcgtcggcgctggtccgcatcggcaggtttctgaactaccacgtgacggtgtgcgacgcccgccccgtcttcgcgacacgtacgcgcttcccggaggccgacgatatcgtcgtcgagtggccgcacacatacctggagcgcacccaggtggacggccggacggtcctgtgcgtcctgacccacgacgccaagttcgacgtaccgctgctgaagctggcgctgcgcctcccggtcgcgtacgtcggcgcgatgggatcccgccgcacccacctggaccgcaacgaccgcctgcgcgccgtcggcgtcacggaactggaactggcacggctgcgctcgcccatcggcctggacctcggtgcccgtacgccggaggagaccgccctgtccatcgccgcggagatcgtcgcgggccgtcgcggcggcagcggggtctccctgaccggcgcccacaccccgatccaccacgacgccgcgtcgagcatggcggggcggatcgggtcggtggcc

SEQ ID NO: 2054 - DNA, 1455 bp, Streptomyces avermitilis
  CDS (1)..(1455)
atgacccagcaatcagtggagcccaggagcgtcgccgacgacgcgggtgcgggaacccgcgtcccggccggccggtcctggctcgatcggtactttcacatatcccggcgtggctcgacggtcgcgcgcgaggtgcgcggtggcgtcaccaccttcatggcgatggcgtacatcctgctcctcaaccccctgatcctgtccggcaaggacgcggcggggaacacgctcggccagcaggccctgatcaccgcgaccgcgtttgcggcggcctgcaccacgcttctgatgggtttcgccggccgggtgccgctcgccctggccgccggcctctccgtctccggtgtgctctcctcgcaggtcgtgccccagatgacctggccgcaggccatgggcatgtgcgtgatctacggcgtcgtgatcatgctcctggtgttcaccggcctgcgcgagatgatcatgaacgcgatcccgctggcgctgaagcacgcgatcaccatgggtatcggcctgttcgtcgcgctgatcggcttctacaaggccggcttcgtgcaccagggcaaggcgaccccggtcaccctcggcccgaccggtgaactcgccggctggccggtcctgctcttcgccgcgaccctgcttctcatcttcatgctccaggcccggggcgtgcccggcgccatcctcatcggcatcgtctccggcacggtcctcgccgtcgtcctgaacgccctcggcgtcatcgaccccaggcagtgggcgagcggcgcacccgaactgcacggcggcgcggtctcgatgcccgacttctcgatcttcggcaaggtcgagttcgggggctgggaccaggtcggcgcgatgacggtcggcatgatcgtcttcaccctggtcctcgccggcttcttcgacgcgatggccaccatcatcggcgtcggcaccgaggccgggctcgccgacgaccagggccggatgccgggcctgtccaaggcgctgttcatcgacggcgcgggcggtgcgatcggcggcgtcgcgggcgcctccggccagacggtcttcgtcgagtccgcgaccggggtcggcgagggcgcccgtaccggcctctcgtccgtggtcaccggcctgttcttcgcggcctgcctgttcttcaccccgctgacggcgatcgtcccgggtgaggtcgccgccgccgcgctggtcgtcatcggagccatgatgatgatgaacgcccggcatgtggactggtccgaccgcggcaccgcgatcccggtcttcctgaccgtcgtgatcatgccgttcacgtactccatcaccgccggcgtggcggccggggtcctcagttacgtcgccatcaaggccgcccagcgcaaggccagggagatcggggcgttcatgtggggcctgacggtgatcttcctcgtctacttcgccctcaacccgatagagagctggctgggcgtccac

SEQ ID NO: 2055 - DNA, 2379 bp, Streptomyces avermitilis
  CDS (1)..(2379)
atgggaaccacgggtacgcccaccaaaatcacgcagggcaccaagtccaagggcggcatcggcgagtccacgctccgtccggacggcaccctcaaggtcaccggcgagttcgcgtactcgtccgacatgtggcacgaggacatgctctggggccagatcctgcgttccacggtcgcgcacgccgagatcgtgtcgatcgacacctccgaggccctcgcgcagcccggcgtctacgccgtcatgacgtacgacgacctgccgaccgacgtgaagaactacggtctggagatccaggacaccccggtcctcgcccacggcaaggtgcgccaccacggagagccggtcgcgatcgtcgccgccgaccacccggagaccgcgcgccgcgccgccgccaagatcaaggtggaataccgcgaactgccggtcatcacggacgaggcgtccgcgacggcgcccgacgcgatcctggtccacgagggccgcaccgaccaccacatcggccatgtctcgcacccgaacatcgtgcaccgccagccgatcgtccgcggcaacgccgaagaggccgccaagaaggccgacttcatcgtccggggcgagtacaccttcggcatgcaggaccaggccttcctcggaccggagtccggcctcgccgtgcccgcagaggacggtggcgtcgacctctacgtcgccacccagtggctgcactccgacctgcgccagatcgcgccggtcctcggcctgcccgaggacaaggtccgtatgacgctctccggtgtcggcggcgccttcggcggccgcgaggacctgtcgatgcagatccacgcctgcctgctggcgctgcgcaccggcaagccggtcaagatcgtctataaccggttcgagtccttcttcggccatgtgcaccgccacccggcgaagctctcctacgagcacggggccacgcgcgacggcaagctcacacatctgaaggcgcgcatcgtccttgacggcggcgcctacgcgtcggcctccccggcggtcgtcggcaacgcgtcctcgctgggggcgggcccgtacgtcatcgacgacgtcgacatcgaggccatcgcgctctacaccaacaacccgccgtgcggcgccatgcgcggcttcggcgcggtgcaggcgtgcttcgcgtacgaggcccagatggacaagctcgccgacaaggtgggcatggaccgggtcgagttccgtcagctgaacgcgatggagcagggcacgctcctgccgaccggacagccggtcgactccccggcgccggtcgccgaactcctgcgccgcgtcaaggcgatgccgctgccgcccgagcgtcagtgggagagcagcgagggcgccgacgtgcggcagctgccgggcggtctgtccaacaccacgcacggcgaaggcgtcgtacgcggtgtcggctacgcggtcggcatcaagaacgtcggcttctccgaagggttcgacgactactcgaccgccaaggtgcggatggaggtggtcggtggcgagccggtcgccaccgtgcacaccgcgatggcggaggtcggccagggcggtgtcaccgtccacgcgcagatcgcccgcaccgagctgggcgtcacacaggtgacgatccagccggccgacacccaggtgggcagcgccggttcgacatccgcgtcgcgtcagacgtacgtcaccggcggcgccgtcaagaactcctgcgagctggtccgcgagaaggtcctggagctgggccgccgcaagttcggtacgtaccaccccgcctgggcgaccgccgagctgctcctggagggcggcaaggtcgtcaccgacgcgggcgaggtcctcgccggcctcgtggacgtactcggcgacgagtccgtcgaggtcgaggccgagtggcggcaccgcccgaccgaggccttcgacctgcggaccggacagggcttcggccacgtccagtactcgttcgccgcgcaccgtgcggtggtcgaggtcgacaccgagctgggtctggtgaaggtcatcgaactggcctgcgcccaggacgtcggcaaggcgctcaacccgctgtccgtcatcggccagatccagggtggtacgacccagggcctgggcatggcggtcatggaggagatcatcgtcgacccgaagacggcgaaggtcaggaacccctccttcacggactacctgatccccaccatcctcgacacgccgaccatcccggtcgacgtgctcgaactcgccgacgaccacgctccctacgggctgcgcggcatcggcgaggccccgaccctgtcgtcgaccccggccgtcctcgcggcgatccggaacgcgacgggtctggaactcaaccggacgcccgtacggccggagcacctgaccggtaag

SEQ ID NO: 2056 - DNA, 588 bp, Streptomyces avermitilis
  CDS (1)..(588)
atgcgcgtcaatttcacggtcaacggccgcccgcaggaagccgacgacgtgtgggagggcgagtccctgctctacgtcctgcgcgagcgcctcggcctgccgggctccaagaacgcctgtgagcagggtgagtgcggctcctgcacggtccgcttggacggcgtgccggtgtgttcgtgtctggtcgcggcgggccaggtcgagggccgcgaggtcatcacggtcgagggcctcgcggactacgccgagcagcgctcctgcggcaccggttcctgcggtacgtcgcttcaggacgcccagcggtgggagtcccggccgggcgactcccggaccggcgagggcaccggcgtctccccgcgtgcggcgctctcgccgatccagcaggcgttcatcgacgccggcgccgtccagtgcggcttctgcaccccgggtctgctggtcgcggcggacgagatgctggagcgcaacccgacgccgaccgacgcggacatccgcgaggcgctctccggcaacctctgccgctgcaccggttacgagaaaatcatggatgcggtccgcctcgcggccgcccggcagtccgaggcggtc

SEQ ID NO: 2057 - DNA, 897 bp, Streptomyces avermitilis
  CDS (1)..(897)
atggacttccttcgccccgccagctgggaggaggcgctcgccgcgaaggccgagcaccccaccgctgtgccgattgcgggtggcaccgatgtgatggtcgagatcaacttcgaccaccgccggcccgagtacctcctcgatctgaaccgcgtcggcgagctgagcgagtgggaggtcggcgaggagagtgtgcgccttggggcctccgtcccgtacacccagatcatggagagcctgcgcggcgagctgcccggcctggccctggcctcccacaccgtggcctccccgcagatccgcaaccgcggcggcgtcggcggcaatctcggcaccgcctccccggccggtgacgcccacccggccctgctcgcggcgggcgccgaggtcgaggtcgcgtccgtacgcggcacgcgtctgatcccgatcgacgacttctacaccggcgtgaagcgcaacgcgctggccgccgacgagctcatcagggccgtccacatcaagaaggccgacggcccgcagcagtactcgaaggtcggcacccgcaacgccatggtgatcgcggtgtgcgccttcggcctggccctgcaccccgagacccgcacggtccgcaccggcatcggatccgccgcgcccaccccggtgcgcgccaagaccgccgaggagttcctgaacgcggcgctcgaggagggcgggttctgggacaacggaaagatcatcaccccctcggtcgccaagcagttcgcggacctgtgctccgccgcctgcaacccgatcgacgacgtccggggcacggcgagctaccgccgccacgcggtcggcatcatggcccgccgcacgctgacctggacctgggagacgtaccgcggcgctgacggtcggacacatcagaaggggagtgtcgcg

SEQ ID NO: 2058 - DNA, 1671 bp, Streptomyces avermitilis
  CDS (1)..(1671)
atgcggctgcgcgcactgctggacaccgacgcgctgggcctgcggctgctcggcggcgagggcgagctggaccgcaccgtacgcggtgtgatgaccacggacctcaaggaccccagccgctacctgtcgggcggcgagctggtgctcacgggcctggcctggcggcacgacgccgccgacaccgagcccttcgtgcgcattctcgcgggcgcgggcgtcgcggcgctggccgccggtgaggcggagctgggcgacatcccggacgacctggtcctggcctgcgcccggcaccggctgccgctgttcgccgtcaacgagtcggtggccttcgcgacgatcaccgagcacgtcgtacggcaggtctccggtgagcgggccggggacctcgcggccgtggtcgaccggcatcggcggatgatgacctcgggcccggcgggcggcggcccggacgtggtcctggacctgctcggctccgacctggacctgcgcgcctgggtgctctcccccaccgggcggcccatcgcgggctcgaacctcagcggcccgctgcccgccacggacgtgtgcgcccggctggccgccgagcacctggcggcggcgcgcaccgggcggcgggggccgcaccgcgtgctggtaggcacgacgacgtactcgctcttcccggtccacagcagcggccggtccaccggcgcctccagggacgtacgcgagacggtgctgtccgactggctgctcgccgtggaggcggacgccggggactggcccgccgagcgcctcgacctgctccagggcgtcacacagctcatcgcggtcgagcgggaccggcgggacgcggcgcgcaccgtgcggcggcggctcgcccaggaggtgctcgagctggtgcagaccggtgccgcgcccgccgagatcgcggcccggctgcgggtcgccgcgccggtgctgctgcccggcctcgggtcggcgccgcactggcaggtcgtggtggcccgggtggagtgggacggcggggagatcgagggcggcccggtcgcccagtcgctcctcgaggagatcctcgtcgacccgctgtcgaccggagccgagcactccgatcgcatcgccgtggcccatacgggtgaggaggcggtcgcgctcgtcccccttccggcggtttcctcggagcacgacggctccgaggccgggctgctcgcggacaccctgctggaggccgtacgcgacccgctgtccgcgggcctgaacgacgacgggcggctcacgctcggggtcagcgcggccgtgcactccgcggaggggctgcgcggcgccctggaggaggcccggcacgcccgccgggtggccgccgcccgccccggccgggtctgcgcggcgggccaccaggagctggcctcgcacgtcctgctgctccccttcgtcccggacgacgtgcgccgcgccttcacggcccgtctgctcgaccccctgcgggagtacgaccgccgccaccgcgccgagctgatcccgaccctggaggcgttcctcgactgcgacggttcgtggacgcgctgtgccgcgcgtctccacctgcacgtcaacacgttgcgctaccgggtgggacgcatcgagcagttgacgagtcgcgacctctcgcgcctcgaggacaagctggacttcttcctggcattgcgcatgagc

SEQ ID NO: 2059 - DNA, 771 bp, Streptomyces avermitilis
  CDS (1)..(771)
gtggcgcataccgccatgtctggtcacggaacgactgcaggggacgatccactccagaccgcggtatggcggctgcgctcgcgcgcctgctgggccgacgcggccgcgctgctcgaaccgcgcaccgcgggcgcctcgctccagcgggccgcgctgctcgtcgagcggtgcctctacaccgagcagggctggcaggaggccgaggacgcgctgcgcacggccgaggcgcaggcccggagcgacgacgagcggggcgcggcggcctgtgagcgcgggcagctcgcgtacgcggccacgctgctcggggtgcgcgaccgggccgacgaggcgcgggccgcgctcggccgggcggccgcgctgatcgcgcccggcgctcccggccgggcgctgctggacttccggcgggggctgctcgccgagaacctggcacgctccccgcaggccgcccgcgccgcctaccgccgggcccacgcgggcgccacggcccacaacgacccgctgctgctgtccttcacctggcgtcatctggccggactcgccctgcgcgacggtgagctggccgaggcgcggcacggcttcggcgaatcgctgcgcatccgcgaggagttgggctacctcgtcggtacggccccggcactggcgtcgctggccgacgcggagacggagccggaggcgtcacgcctgcgcgccgaggcgggacggctgttccggctcctggggggcgtaccgacctggctggcccggcagttgacgccaccggcggccacggcg

SEQ ID NO: 2060 - DNA, 279 bp, Streptomyces avermitilis
  CDS (1)..(279)
gtgacgatggttcccaaccctggccagcagattgcctggcagaaccagttgcgaacgaaccagcaggtcttcagtaacaacgcggcccagtacgaccgccggcgccgccggaaccggggccgccccgcttccggtctcgccggtgtgctgaagctcctgctcctcgtggccgtagtcgtcctcctggccgagaaccccggactccgcgccgaactctggacgttcgcccagaacctgggcgcctacgtccagggcctgtgggctgacacccggaacggc

SEQ ID NO: 2061 - DNA, 888 bp, Streptomyces avermitilis
  CDS (1)..(888)
gtggagcaggccggtccgcgcccgcgtgacatgcacggttcccccgggaccggaattccggacatgggcaaggcggccgttcgggtgccgccgcagccacgggccgccgaggtgggtcgcgagcgcgaccgggaacgcgagcgagaccgggaacgtgaccgcgcccgcgaccgggaacgtgaccggggcgccgccgcggccggtggctcggcgcgcggtgagcacacccacggcgagccgcccctgcccgtcgcccaggccgcgcggcccgtcgtccagcgggcctccgtccgcggccaggtcctcgacgccctgcgcaccgcgctggtcgcgggggaactggcgccgggcgaggtgtactcggcgcccgtcctcggtgagcggttcggggtgtccgcgacgccggtgcgggaggcgatgcagcagctcgcgctcgagggtgccgtcgaggtcgtacccaaccgcgggttccgcgtcgtcgtgcgtggggcccgcgagctggccgaactcgccgagatccggggactgatcgaggtcccggtgatgctgcggctggcccgtacggtgtccgcggggcagtgggccgagctgcggccgctcgccgaggcgagtgtgcgggccgcgtccaccggctgtcgcgcgacgtacgccgagaccgaccgcgccttccaccgggcggtactcgcgctcgccggcaacgagcagctggtgcggatcgcggacgacctgcaccgccgcgcccagtggcccctcgtcggcggcccggtctcgcggggccgcgccgacctgctcgccgacgccgccgagcacacggcactgctggacgcgctgatcgcgcaggacctcgtcgtggtgcagtccctggtgcgggagcacttcgcgggcggg

SEQ ID NO: 2062 - DNA, 825 bp, Streptomyces avermitilis
  CDS (1)..(825)
atgccctcgcccgtcgcggatgcctacgcaaggctgaccgaggcctttcccgggctggcggtcacggagctcgaccccggggaagcggcccccgagggcgacggctgggcctccgccgccctgctcgcggcgggcgggaccggcctcgacgccttcctggcctgggacgaggcgcaggtcctgagggactacggacagcgggggcgcccggacgtcgtggccggcttcggactgcaccggtacgcctggccggcctgtctgctgatcaccgtcccgtggttcctggggcgccgggtaccgcgcctgcctgtggagcacgtcacgttccagcgcaccctcggccgcatggcgatacgggtcacggagttcgcctgcctgccggacgatccggcggccggactgcccggcgcccgcgtcgtaccggacgagcaggccctgcgggccgaggtacgggcggcggtcacggaacatctggagccggtcctcgggggcttcggtccgcgtatgcggcggcgcgggcgtgccctgtggggcatggcgaccgacgaggtcgccgaggggctctggtacgtcgcccacctgctcggcgaggaggagcgcgccgtccgggagctggaactgctgctgccgggcgcgacccggccgtacgtcggctcggccgcgttccgtgagctgaccggaccgaacggcgaggcgctgcccacccgcgaccgcgcgagctgctgcctcttctacacgctgcgccccgaggacacctgcctgacctgcccgcgcacctgcgacacggaccggatcgcgcgactcacggcggtcgcatcgccaagt

SEQ ID NO: 2063 - DNA, 1050 bp, Streptomyces avermitilis
  CDS (1)..(1050)
atgagattgaccgacatatcgctgaactggttgcttccgggcgccgtactgctcctgggcatgctggcggcggtggccgtgctcgcgcgtggcaagcggtccggggagagctcgacgaatgccgacgactcgtgggagcgcagcgaggagcgccgcaggcgcaaggaggccatctacggcacggcctcgtacgtactgctgttctgctgcgccgcggtcgccgcggcgctctccttccacggtctggtcggcttcggcgagcagaacctcggcctcaccgacggctggcagtatctggtcccgttcggcctggacggcgcggccatgttctgctccgtgctcgcggtgcgcgaggccagccacggtgacgcggccctcggctcccggatactcgtgtggacgttcgcggccgcggcggcctggttcaactgggtgcacgccccccgaggtatcgaccacgcgggagccccgcagttcttctccggaatgtcgctgtcggccgcggtgctcttcgaccgcgcgctgaagcagacccgccgcgccgccctgcgtgagcagggcctggtgccgcgtccgctgccgcagatccgcatcgtccgctggctgcgggcgccccgtgagacgtacagcgcctggtcgctgatgctcctggagaacgtgcgcacgctggacgaggccgtcgaggaggtccgtgaggaccgccgccagaaggagcagaaccgactgcgccgccgggagcaggagcgggtcgagcgggcgcacctcaaggcgctcagccgcggccaccgcggcctgccgggccgcggtggtggtggcggcggacggcagctcgaagcgccgtccgtggaacgcgcgcccgcccaggtcacttcggaacctgctatatccacggaacagctgccccccgtaccgtcccgcccctcgcttcagcccgtccgcaactccgctgacccgatcacggtcgacctcaccgcggaggacgacaccatggctctgccccgcctcgactccctggagcgcaagctcaaggacctcgagcggcagttcggc

SEQ ID NO: 2064 - DNA, 420 bp, Streptomyces avermitilis
  CDS (1)..(420)
gtggaggaatcggccgacagcacgacggaccagccaggggggacgcagctcaggcgcaggctggcacgggcggatctacgggcggtgcccgaggcccgacgggccctgcgggagctgctcaggcactggggaaggccggagaagtccgagatagcggagctgctcacgagcgagctcgtcaccaacgcgctcatccacaccgaccatgacgccgtcctgacggccaccgtctccccgcgcggactacgcgtggaggtgcgggacttcgtggggcgcaggccgataccgcgggtaccgaacgccgacgacggtacgcacggcagagggctgctcctggtgcagtccctcgcggacgcgtggggcgtgcgggcgcacggggtgggtaaggcggtgtggttcgaactggacgggggcgccgcc

SEQ ID NO: 2065 - DNA, 489 bp, Streptomyces avermitilis
  CDS (1)..(489)
atgaacagcaccaccgcccgccgacccgcccgccgcgccgccctggccgtcggactcgccgccgctctcgccctgccgctggggctcaccgcctcggcacaggcgtccgccggcacggatcagccgcggtcgatcagcggcaagccgtcggactcggtgacccggatcgccgacttctacggcgcctacatcgacgcgcagagcgaccctgacaacggcggcaagctggtggacgcgctccggaagtactacgtgagcgcctcctacctcaaggagttgaaggcgtgggaggacaagaaccacgcggacggcgtcctgcgcgcccagaacgtcccggtccggtggaaggtgaccgacaacggcaccgcggaccacacggaagccgccgtcacgctgacctggggcgacaagaggacgaccaagctcatcgtcgacatgaccaggagccacaagatcttccacatcggaacgaaggggatcggcggcaag

SEQ ID NO: 2066 - DNA, 870 bp, Streptomyces avermitilis
  CDS (1)..(870)
gtggaggtctgcgccgacggacctgccccgtcccgggacggcatcccaggcactccatatatgtgcacgtcagaagggctgggacggttccaccccggcggatcctccgtcagctgttgcggatgccggacgggacggccgatgctcttggtgtcgtaccgaccgccgccggaccgacctcccgacggcagcccgcgaacgggccgtcgcgacggcatccgacacccatgcacacagatacgggggacacccatgaccaagcgcgtccgagtcgcggcgctcaccgcactcaccgccgcgggcctcgtgctcggcacggcggtcgccggcccggccggcgcggcgatacggggaggcggctcgcccgcgttcctctcggccgccgaactgccgccgcatccgacctcctcctggacggcgggcaaggtcacggacggcgtaccggacgagctgcggctctgcctggacgcggcgctgccgggcgacgactcccggtatcgcgcgtaccggaccgacctcgacaccagcgcacggcagctcaccatggtgctcggcgacgaggccacggccaagggccgcaccgccaggctgaaccaggacatccggtcgtgcgcgacgcggatcgagcggtccgacccggagaccgacgccgtgctgaaggactacggcaggctgccggtcgaggagggcgcccatgtgtacggcctccacaccgccacctcctggggcgccggcgacatccacctgttctcggtcggccgggacgggagggccgtcacggtcgtcgagtgggcgcagctgggcgacttcaccgacgcgccggtgaccgccttcaagaagacgacgaccaccgccgtcaacaagctctac

SEQ ID NO: 2067 - DNA, 1740 bp, Streptomyces avermitilis
  CDS (1)..(1740)
atggccaaacagaacgtcgccgagcagtttgtcgacatcctcgtccgcgcgggcgtcaatcgcctgtacggggtggtgggtgacagtctcaacccggtcgtcgacgccattcggcgcaactccgccatcgactggatccacgtccggcacgaggggaccgccgccttcgccgcgggcgcggaggcgcagatcaccggcaagctcgccgcctgcgccggctcctgcggccccgggaacctccacctcatcaacggcctgtacgacgcccaccgctccatggcgccggtcctcgccctcgcctcgcacatcccctccagcgagatcggcctcggattcttccaggagacccatcccgaccagctcttccgcgagtgcagtcactacagcgagatgatctccaacccgaagcagatgccgaggctgctgcagtccgccatccagcacgcggtgggtcagtccggcgtcagcgtcgtcaccctccccggcgacgtcgcctccgagcccgccccggacaaggccgtcgagaccgccctcgtgacctcccggcccacggtccggcccggcgacaccgagatcgacaagctcgtcgcgttgatcgacgcggccgacaaggtcaccctcttctgcggcagcggcacggcgggtgcgcacgccgaggtcatggagttcgccgagaagatcaagtccccggtcgggcacgcgctgcggggcaaggagtggatccagtacgacaacccgtacgacgtcggcatgagcgggctcctcggctacggtgccgcctacgaggccaccaacgagtgcgatctgctgatcctgctcggcaccgacttcccgtacaacgccttcctccccaccgatgtgaagatcgcacaggtcgacgtccgccccgaacgcctcggccggcgctcgaagttggacctcgccgtctggggcgatgtgcgggagaccctgcgctgtctgatcccgcgggtgaagcccaaggagaaccggcgcttcctcgacaagatgctgaagaagcacgcggacgcgctcgaaggtgtcatcaaggcgtacacgcggaaggtcgagaagcacgttccgatccaccccgagtacgtggcctccgtgctcgacgaactggccgccgaggacgcggtgttcaccgtcgacaccgggatgtgcaatgtctgggcggcccgctacatctcgcccaacggacgccgccgcgtcatcggctcgttctcgcacggctccatggcgaacgcgctgccgatggcgatcggcgcccagttcaccgaccggaaccggcaggtcgtctcgatgtccggcgacggtggattcgccatgctgatgggcgacttcctcaccctcgtccagtacgacctgccggtgaaggtcgtactgttcaacaactcctccttgagcatggtcgagttggagatgctggtggccgggctgccctcgtacggcaccacgaacaagaaccccgacttcgcggccgtcgccagagcgtgtggggcgtacggcgtgcgggtcgagaagcccaagcaactcgcgggcgccctgaaggacgccttcaggcacaagggaccggccctcgtcgacatcgtgaccgaccccaacgccctgtccatcccgccgaagatcagcgcggagatggtgacgggcttcgcgctgtccgcgtcgaagatggtcctggacggcggggtcggccggatggtgcagatggcccgctccaacctgcggaacgtgccgcgtcct

SEQ ID NO: 2068 - DNA, 2022 bp, Streptomyces avermitilis
  CDS (1)..(2022)
gtggccggtttttccggatgccccgttttcatacggcccgagcggtggacaattggcggcatgagccagcagggggagaggtccaccggtcacgaggacgactggtgggggcagttgtacgacgactccacggcggacacgggaccggcggccgccgccgattcccttgacgaccgcttcgcctcggcggccgggacggtgggccagccggcaccccgggacacggccggtgccccgctaccaccgacggcgccgccgtccgtaccggagcagcgggccggtggcggacccgctgccccggcgcggggaagcgaatcccccgctgccccggcgcgggggagcggatcccccgggcggcacgccggcgccgcgacgcgggggaccggagcggccgacgcctcagggggagcagggggagctgacgcctcaggggaagcagggggcgctgggggagccgtcggttccggcggacgccacgccgatccgccgcgacgcgacgtcccggcccgcgaccccgccccttgggaacccccgtccgcccgtccgccgggccccgcgaccttcccgcccggacggcggcccccggggctccgcccggacgcgcccccgccttccccggccggggaaggcggcgtcgagccggtgaatcccggccgttcggccccggccaggccgggcgagccggtcaagccgcgtcctccagtaccgccctcgcccatcggcccgccgcaaccggccccggccgaggccttgtcccccagcgacgccccgcccccaccagtggaggccgaactgggcaggctccgcccgccggcgccgcccgtcggcccgccgtccctggcccccaccgaggcgccggcccccaccgacgcgccacccccgccaccggaactccccgacctccccccgccgtcattggctcgcgccgccgcgccgcccccgccagtggaagcccccggcctcccgccgctccccgacctccccccgcgcgaccccaccctcaccgtcgtccacgagccgccgccggtcgaccacatcggctccgggccacccacctacgacgccgaacccaccgccctcccggccgccgacccggacgacctcgacgacctggtcgcggacaccgtgctggacggcgcccgttacgggtcctgcacgctgcgcgccgtctccgcgcgcggcgactcggcgcgctaccggggcgagccgcgccgcgactccctgctcaccgcccgcttcggcgtgggcgaccaggcgctcctcctcgtcgccatggccaccggagcgcgggccacgcccggcgcgcaccgggcggccgcagaggcctgccactggatcgggcgagccgtgggacgcagtcatgcccggctcgccgaggacatccgggccgcccggcgcggcgacctgaagtcgggcctgcaccggctcaccgaccgcagcctcggcaagctgcgcgccagcgccgcggagcagggcgtcgagcccgaggagtactccgccacgctgcgctgtctcctgctgccggccgaccccgaatgccgtacgcgcgtcttcttcggcgtcggcgccggcggactgttccggctgcgggacggcgcatggcaggacatcgagccgcatgtcgccgacgcgaccggggaagccgtggtcggattcggctcgctcccgtcggagacccccgagggcgaccggctcaccatggacctcggcatcacgacgccgccgagcccgtacgaaccgtccccccggctctcggcttcgctcgagcagggaggcacccccgtcgaaccgccccgcgaccccttccgcttccgcgcctccgtagcccatccgggggacacgctcctgctgtgcagcggcggcctcgccgagcccctgcgcggggagccgcgactcgccgagcacctgaccgcacgctggtcgaacggcgggccgcccggcctcgccgccttcctcgcggacacccaggtccgggtcaaggggtacgccgacgaccggacagcggccgccgtttgggaggcg

SEQ ID NO: 2069 - DNA, 981 bp, Streptomyces avermitilis
  CDS (1)..(981)
atgctgggagcgataggtctggacggggcgcacgagtcggcgtaccgcgcactggtgtccatgggcgccgccgacgtgcccgatctcgcgcgtcggctcaccctcggcgagtacgacaccgagcgcgccctgcgccggctggaacggcacggtctggcggcccagtcgtcggcccgccccggccgctgggtggccgcgccgccgggggtcgccctcggcgcgctgctcacccagcagcggcacgagctggagaaggcggagctggcggccgcgctgctcgccgaggagtaccgggcgcaggccaccgagccggccgtgcacgacctggtcgaggtggtgatcggggcggcggcggtgtcgcagcgctttctgcagctccagctcggcgccggcgacgaggtgtgcgcgctggtcaccggcaccccggtcgccgtctccggaatggagaacgacgcggagaagcaggccgccgaccgtggcgtggcctaccgcgtggtgctcgagcgggaggtcctcgaccagccgaccgggatcgtcgaactgtcggccgcactgggccgggacgaacaggtgcgggtcgtggacaaggtgccgaccaagctggtgatcgccgaccggacgctggcgatggtgccgctcacctcgcacgccgcggaaccggccgcgctggtggtgcacgcgagcggcctgctggagctgctgtccggcttgttcgagtcggtgtggcggggggcgctgccgctgcggttgagcgccggtggcgcggtcgacgaacaggaggccgacggccccgacagcaccgatctggaggtcctgtcgctgctgctcgccgggctgaccgacgcgagcgtcgccaaacagctggatctgggcctgcggacggtgcagcgccgggtgaagcggctgatggagctgaccggcgtgacgacacggctccagctggggtggcacgcgtacgagaagggctgggtggcgcgcgac

SEQ ID NO: 2070 - DNA, 480 bp, Streptomyces avermitilis
  CDS (1)..(480)
atgggagcgtggaaactcctgccggtcggcgtggtgctgctgctcggcctggccggagtgctggtgcccggggtgccggggtcgtggctcgtctgggccgcggtcctttggtggacgctgaaggacccccagcccctcgcctggggcgttctcgtgggtgccacgctggttctgctgctgtcccgggcgatccgctggtccctgccgccacgtcggctgcgggagagcggcgccactccccgcatgggggcgttcgcggggatcggcgcgctgctcggtttcgttctgctgccggtgatcggcgcgatacccggcttcatgggcggcatctacctctccgaacggctacggctcggccggcaccaggaggccgtggcggcgacgcggaccgcgatgcgttcgggcggctccagcgtgctgacggagctgttcgcctgcctgctggtcgcgggcgcgtggctgggcgcggtgctctggggc

SEQ ID NO: 2071 - DNA, 1263 bp, Streptomyces avermitilis
  CDS (1)..(1263)
gtgggacatcatgcccgcatgacccgcgcgatcaaggtccggcacctcctcgccgccctggtgacagcactggtgctcgcccctacggcggtgggagccgacgaggggaccgcctccggcgtcgccccgcccgcctcggcccctcgctggaccggcacctgggaaaccgccccctccggaaccacccccgccctccccggcacctcgatccgcaacgtggtgcacaccagcgtcggcggcacggcgctgcgcgtgcggatctccaaccggctcggcaccgcacccctccaactcgactccgtcaccgtcgcgttgcagcggccgggcgctccccgcagtcccgacgccgtgccgggttccatgcgcaccgccaccttcgcgggcgccacctccgtgtcgattccggcgggccgggagcgggccaccgacgccgtgcgcctgaacgtcccggcgaacgccaacctcgtcgtcagcgtgcacacctcggccgactcgggtcccgcgacctaccaccgctcggccttccagaccaacttcctcgccaggaacggcgaccggaccgccgacaccgacggctccgcgtacaccacgaccgtctcccactggtactacgtcaccggcgtcgacgtcctcggcaccacggccatcggcagcgtggtcgcgctcggggactccctcaccgacggcaccggctcctccgccagcgccaaccgccgctggcccgaccgtctcgccgcccgcctgcgcgcgctgccgccgaaccgccggctcggtgtgctgaacgccggcatctccggcaaccgcgtcctcctcgacggcgtgggccccagcgccctggcccgcctcgacgccgacgcccttctccgctccggggtgcgcgcggtcatcgtcctggagggcatcaacgacatcaagggcacgcccgcgcagacggatccgggtgccttcgagcgggcgtaccggacgatcgtgtcccgcgcgcacgcccggggcatccgcgtcatcggcgcgaccatcaccccgtacggcggccacagttccttcaccggagccggtgagaaggcacgccaggcggtcaacgcgctcctgcgcaccggcagggtcttcgacggggtcgccgacttcgacgccgccgtccgtgaccccgcgaacccgaaccgcatccgccccgcctacgaccccggcgaccacctccacttcaacgaccggggaatgcaggcgctggccgacacgatcgacctcgcgacgctgaccgagtggcga

SEQ ID NO: 2072 - DNA, 399 bp, Streptomyces avermitilis
  CDS (1)..(399)
gtgggggcgcgtgagtgtttggctgctgtcatgaccgaattcagcgaggccgagcgcgcgtacctgaagtcgcagcggctgggacggctggccaccgtcgacgcccacggacagccgcaggcgaatcctgtcggcttcttcccgcaggacgacgggacgatcctgatcgggggctatgcgatgggcggcacgaagaagtggcgcaacctgcagaagaacccgaaggtggccctcgtcgtcgacgatgtgatcagcgtcgaaccgtggcgggttcgcggcgtggacatccgtggcgaggccgaactcctcaccgggccgcacgacttgggtccgcacttcagcgaggaagtgatccggattcatccgcggcggatccacggctgggggctcgaggaggcc

SEQ ID NO: 2073 - DNA, 1416 bp, Streptomyces avermitilis
  CDS (1)..(1416)
gtgatcgatgaagagaccaggtacgaggcggtgcgcagtcgcgatgcgcgcttcgacggggagttcttcttcgccgtcgagacgaccggcatctactgccgccccagctgcccggcggtgacgccgaagcggcagaacgtgcggtactacgccacggcggccgcggcgcagagctcgggtttccgggcctgccgccgctgccgcccggacgccgtgcccggctcggccgcgtggaacgtacgggccgatgtcgtcggccgcgccatgcgcatgatcggggacggtgtcgtcgaccgagagggcgtcggcggcctcgccgtccggctcgggtacagcgcccgccaggtgcagcggcaactcaccgccgaggtcggcgccggacccgtcgccctcgcccgcgcccagcgcgcccacaccgcgcgcgtcctgttgcagaccaccggcctgtccatcaccgagatcgcgttcgcggccgggttcgccagcgtgcggcagttcaacgacaccatcagggcggtgtacgcggccacgcccagtgagctgcgcgccgccgcgccccggggcggaccgcccgcccgccgcggcgccgccccctccgccgggatcccgctccggctcgcccaccggggcccgtaccaggccatcgccgtcttcgacctcctcgcccgcgagaccgtgccgggcatcgaggagatgaacggtccgcgcggccggcgcacctaccgccggaccctccgccttccgtacggcaccggaatcgtggccgtcgacgagcgccccggcgctcccgcgccccgtaccccggcccaccacggcggctggctcgacgcccgcctgcgcctcaccgacccgcgcgacctcaccaccgccgttcagcggctgcggcgactgttcgacctcgacgccgatccgtacgccgtcgacgaacgcctgggccaggacccccggctcggtccgctcgtcgccgcccgtcccggcctgcgctcgccgggcacggccgacccggacgagctggccgtacgcgcgctggtgggcacggcggaggccgagcggctggtacggcggtacgggaagacactcgacgcccccagcggcagcctcacccacgtcttccccgaaccggccgtgctcgcacaggccgaaccggccggcacactcggtgccctgaccgccgccctcgccgacggcaccctccgcctcgacgccggcgccgaccgcgacgacgcccggcaaaccctgctcgccctgccgggcatggacgacgacacggccgccgtcatccgtacccgtgccctcggcgacccggacgtggcaccgccgggcgccgaagtccccgacacctggcgcccctggcgctcgtacgcactccaacacctgagggtggccgccgagtcggcagcgtacgagccggccacg

SEQ ID NO: 2074 - DNA, 1125 bp, Streptomyces avermitilis
  CDS (1)..(1125)
gtgaagggtcaccccttgtcactctcttctctcccgggttcgttctcctcttcctcgcatccgctcgtgccgtacggctgggatgcggactgggaggccgagttcgccccgtacgactccgaaggcctgctggccgggcgtgtcatccgggtcgaccgcggtcagtgcgacgtggtcacccccggcgggatgctgcgcgccgacaccgcgttcgtcaccccgcacgatccgatgcgcgtcgtgtgcaccggtgactgggtcgccgtcgaaccggccggcgacccccgctacgtacggacgtatctgccgcgccgctccgccttcgtccgctccacctcctccaagcgctccgaggggcagatcctcgcggccaacgtcgactacgccgtggtcgccgtgtccctcgccgtggaactcgaccttggccgcgtcgaacgcttcctcgccctggcgtgggagtccggcgcgcagccggtggtggtcctcaccaaggcggacctggtgccggacgcgacgacgctctcgtatctcgtgcaggacgtggagacggcggcgcccggtgtgcccgtgctgtcggtcagctccaacctcggcgaaggactcgacgtcctcgcggcggtcctgtccggcggtacgtccgtgctgctcgggcagtccggcgcgggcaagtcgaccctcgccaacgcgctgctcggcgaggacgtcatgaaggtgcacgccacgcgggacgtggacggcaagggccgccacaccacgaccacgcgcaacctgctcgccctgccgggcgggggtgtcctcatcgacaccccggggctgcgcggggtcggcctctgggacgcggagaccggggtcaaccaggtcttctccgagatcgaggcactggccgcggaatgccgcttccacgactgcgcgcacaccgcggagccgggttgcgcggtcctcgcggccctcgacaccggcgagctgccggagcggcgcctcgacagctatcgcaagctgctgcgcgagaaccagcgcatcgtcgccaagaccgacgcccggctgcgggccgagatccgccgggactggaagcggaagggggcggaggggaaggcggccatggaagcgaagcggggacagtggggg

SEQ ID NO: 2075 - DNA, 1533 bp, Streptomyces avermitilis
  CDS (1)..(1533)
ttgtggatgcactcgatgcaggagctccccatgcccgacctgccgaccccccaggacgccgccgaggcagcactgttctccgagtgctgggacgcggtcctgtcgtacgccgatctgtgcacgtccggttcggctgccgcggcacagcttgccaccgaggcgttcacgcacgggatccaccaggcgcgcgccgccgacgccacggcgaaggacaccgggcgccggacgctcaggctgccgcgcattccgctgctgctgacggccgttcgcactgccgccgccgcctgggaggcccacgggcaggggcaccgtctcgaccccgacctgcggctgtggctcaactccgacaaggccgcacgctacaccgggccgcccctgcaccgcccgctcgcgctgcgcggtctgagggacatgcaggagccggacgcggcgctgctgtggctggccgaggtggagtcgctgcccctgccggacgtggcccgtcggctcggcctcgaccccacggcggcggccgaggaactcgtccaggtacgggcgctgttcagagaccgctgccaccgcaaccacctcgacacccccatgaaggccgagtgccgcagctacgcgcggctcctcgacgcggtgacccggtcaccgaacgccggtgcgcccgatgacctctcgcggcacctcgccacctgtgtggagtgcgccgaggccgcggcgtgcctgcgtctgcacggcgggggactgccctccgcgctggcgggcggagtcatcggctggggcgggctcgcctatctggagcgccggcgccgggcggcggacgcgggactgagtggcgggcgcgtgtacacgggcgcggacaccgggctcgcccagggcgggacggcccggccgcggatcggcaggaccgggatcctggccgcggccgtgatcgtgtcggcgcttgcgctgggggcctcgctgatgcagttcggcgactcgggcggcggcgcgtcggcgagcgacgacgcgacggacggccggccggtggcgggcgaggctgcgtcactgcccgccgcggacctgccctcggggtcggccgccgccccctcgtcctcgtcctcctcctcgacttcgcggccgacgggcgcgaagtccgaggtgaagagcagcgaccccgacacggagccccagggcaagtcgtcctccaccgtggaggagacgcacaaggcgggcggctcgacgaaggccccgtcctactgccaggtgaagtacgagatactcaacgaatggccggacggcttccaggccacggtcacggtcacctccgaaaaggcgctcgacaactggcgcatcggctggacgttccgtgacggccagcagatcagccagatgtgggacgcgagcgtcacccagagcggcgcccgggtcacggccgcggcagccgactacaacaagcaggtcgcggccgacggcaccttcgccttcggcttcctgtccacctggcacgacgagaacacgaccccgtacggcttcacgctgaacggcggcaagtgcacgacgaacggc

SEQ ID NO: 2076 - DNA, 1317 bp, Streptomyces avermitilis
  CDS (1)..(1317)
atgggcagccgtaccgcgctggtcgaggatctgatggagcggttcccgcacgtaccgcgggaagccgttttcaaggaggacctgctccggggaggtgtggccttcgacgactcggcgctctcggacaacgaggacggcgacgtcaagccgaagtcgtacttcatcttctccttcgaccacggcaccctgcccgagctgggcgaggccgcgctgcgccggccgccggaggagatcatcctcaccggtggcccgtacgacctgcggcgcaccgtcgtgtcggtgcgcgtgaacccggcctcgccgtaccgggtggccgccgacgaggacggcatgctcgggctctacctcgacgggaagcggatctcggacgtcggcgtccccccgatgccggagtactaccggcaccagctctccaacgggaagtccgtcatggaggtcgccccgacgatccagtggggctatctgatctacctcaccgtcttccgggtctgccagtacttcggcgccaaggaggagtgccagtactgcgacatcaaccacaactggcgccagcacaaggcggcgggccgcccgtacaccggcgtgaaggacgtcgaggaggtcctcgaagcgctggagatcatcgaccggtacgacaccgcgaaggcgtccaccgcgtacacgctcacgggcggtgcgatcacgtccaaggtcgccgggcgcgacgaggccgacttctacgggcactacgccaaggccatcgaggagcgcttcccggggcgctggatcggcaaggtcgtcgcgcaggcgctcccgagggacgacgtccagcgcttcaaggaccacggcgtgcagatctaccaccccaactacgaggtgtgggaccgccggctgttcgagctgtactgccccggaaaggagcgctacgtcggccgcgacgagtggcacaagcgcattctcgactcggcggagatcttcggcgcgcgcaatgtgatccccaacttcgtggcgggcgtggagatggcggagcccttcggcttcacgacggtcgacgaggccatcgcctccaccaccgagggcctgcgcttcttcatgtcgcacggcatcacgccccgcttcaccacctggtgcccggagccgacgacgccgctcggcaaggccaacccgcagggtgcgccgctggagtaccacatccgcctgctcgaggcgtaccgcgccacgatggaggacttcggtctctcctccccgcccggctacggggagcccggcccgggacgcgcggtcttctccgtcagctccttcatggacagcctcccggcacaggaaccgaccccggcc

SEQ ID NO: 2077 - DNA, 1005 bp, Streptomyces avermitilis
  CDS (1)..(1005)
ttgcccgagcgtcccctggcgatgttcgccatgaccgccgagaacgtgccatggatcttcccgccggaggtgctcgcccgactgcgcgcctgtgtggacatcgaccccggtctggtggccgaggacttcaccgctccccgggtacgggaggcgctcgccggggtggagatcctgatcaccggctggggctgcccccgcctcgacgcggccgtcctcgacgcggcgcccgagctgcgcgccgtgctgcacgcggcgggctcggtgaagggcttcgccacccccgcgctctgggaacgcggcatcgcggtctcctccgcggccggcgccaacgcgctgcccgtcgccgaatacgcgctcgccatgatcctgctcgccggcaaggacctcttcgcgcaccgcgaccgcttccgcaccgaccgggcctttcccatgggggacatcctgccgggcgtcggcaacttcggccgccgggtcgggatcgtgggcgcctcccgcatcggccgccggctcatcgaactgttgcgccccttcgacctgcggccgagcctggccgacccgtacgtagacgcggcggaggccgcccggctcggcgttcccctgctgccgttggacgacctgctgcgctcctccgacatcgtcaccctgcacgccccgctgacccccgagacccgtcggctcatcggccgtcgcgaactcgccctgatgccggacgggtccttcctcgtcaacaccgcgcgcggcgccctggtcgaccacgaggcgctcgtcgacgaactgcgcgccggacggctcagcgccgtcctcgacgtcacggaacccgagccgttgcccgccggctccccgctcttcgacctgccgaacgccttcgtcaccccccacctggcgggctcgcagggcaacgaggtggcccgcctcggcctcaccgtgacggaggaggcggagcggctgcgagggggcgaggcgccggcgtacgcgatcgaccccggcgcgctggagcgcaccgcg

SEQ ID NO: 2078 - DNA, 1266 bp, Streptomyces avermitilis
  CDS (1)..(1266)
atgactgacgcagggaccgcgctcaccaactgggccgggaacatcacgtactcggccaaggagctgcaccggccgcaatcgctggacgcgctgcgggcgctggtcgcggacagtgcgaaggtgcgggtactgggcagcgggcactcgttcaacgagatcgccgagccgggtgccgacggcgtactgctgtcgctgaccgccctgccgccgtcggtcgaggtggacacggccgcccgtaccgtacgggtcgcgggcggggtccggtacgccgaactcgcccgggtggtgcacggacacgggctcgcgctgcccaacatggcctcgctcccgcacatctccgtggcgggctcggtggccaccggcacgcatggctccggcgtcaccaacggctcgctcgcctcggccgtgcgggaggtggagctggtcacggccgacggttcggcggtgcggatcgggcggggcgacgaccggttcgacggcgccgtgaccgcgctcggggcgctcggggtggtcaccgcgctcacgctcgatctggagccggactaccgggtcgcccagcaggttttcaccgaactcccgctggcggggctggacttcgatgcggtggcggcttcggcgtacagcgtcagcctcttcaccggctggcggacgtcgggctttgcgcaggtgtggctcaagcgccgcaccgaccggccgtcggccgacttcccgtgggcggcgccggccaccgaggcgatgcaccccgtgccgggcatgcccgcggtcaactgcacccagcagttcggggtcccgggcccctggcacgagcgactcccgcacttccgggcggagttcacccccagcagcggcgccgagctccagtcggagtacctgctgccgcgcccgtacgccctcgacgcgctgcacgccctggacgccgtgcgggagacggtggcgccggtgctccagatctgcgaggtgcggacggtcgccgccgacgcgcagtggctgagccccgcctacgggcgggacaccgtggcgctgcacttcacctgggtcgaggacctggccgccgtactgcccgtggtgcggcgggtcgaggaggcgctggaccccttcgacccgcggccgcactggggcaaggtcttcgcggtcccggcgcgggtgctgcgcgggcggtatccgcgactgggcgatttccgggccctggtggactcgctcgatcccggcggaaagttcaccaacgccttcgtacgggaggtgctgggctccggcgaccggccgtcg

SEQ ID NO: 2079 - DNA, 1272 bp, Streptomyces avermitilis
  CDS (1)..(1272)
atggcctggagggatcgagggatcgtgtcggtgaagcgcacctcacgcgacatccgcaccgcgaaccgttacgaggtgctccgccagatcatcgccaagtcacccacctcgcggcaggaactggcggccgcgaccgggctcagtctcgccacggtcgccacgctcgtcggggagctgctcgacctcggcatgctgaccgaggtcggattcgaggactcggcgggcgggcggccacgcggtctggtcgccgtcaactccggcggcggcgcgctgatcggcgtcgacatcgcggagacgtacgtacgggtcgagctgttcgacctcggactgggccaactcgcccgcgccgacgaggacatgcgcccgggcgagagccgcccggagcaggtcgtcgggcatgtcgcggccgcggtcggctcggtcgtcgcgcaggccggggtggacggcgcgcgcgtcctcggcgtcggggtgagcgtgccgggccaggtggaccgcgaccgcgggatcgccgagtacgcgccgaactgggactggcacgacgtgccgctgctctccctgctcgccgaacacatcacccatcccctgtacctcgacaatccgctgcgcgcctgcgcggtggccgagctgtggttcggcgcggcccgcgggcgcggggacgccgtggtggtgaacctcggcaccggggtcggcgccgggctggcgctgggcggcgcgctgcaccgcggggtcagcaacagcgccggcgagtggggtcatacgacgctcgtgctggacgggcggctgtgccactgcggcaaccacgggtgcgtggagacgtatgtcggggcgcccgggatcatgcagaacctgcgggagctgagccccgccgaccccctgctgcaccccggggaccagaccgccacgatcgacgcgctggcccgtggggtcgccgcgcgggatcccgtggcgctcaaggtcgttcgcgacacggcccgttacctgggcgccgggatcgccgacctggtgaacctgctcaaccccgaggtggtcgtgctcagcagctgggtggcggccacgctcggcgagccgttgctcgacgaggtgcgcgaggccgtcgcccggcacgcgctgaggcgaccgttcgcctccaccgagatcgtcctctcccccatcccgaccgacccggtgtgcctgggagccgcgaccttcgccctcgaaggcgccctccagtcggtcgggcagcggcccgcgcagcgcgccacctccgcgaggagccgcaccgcaccaccgtca

SEQ ID NO: 2080 - DNA, 1299 bp, Streptomyces avermitilis
  CDS (1)..(1299)
ttgagccgcagccgtactcaagacaaggacgtcaccatgtcggcaacgagcaacagcaactgggaccgccgatccgtactccgagccgccgcgggcctcgcggcgctgggcccgctggccgcctgcggcagcaacaccggccgttcgggcggcgggagttcgggcgagagcctggtgcagtacttccacgcgtacggcgaggcgggcaccgagcaggccatcagacggtacgcgaaggcgtacgacaaggccgccgtgaccacgcagtggatcaccggcaccaacttcgagagcaagctgttctcggcgctgctcaccgacaacgcgccggacgtcttcgagttccacccacagctccagatgatcaagagcggccaggtggcggcgctggacgacatcatcgatccggtcaaggacgacttcaacccggccgacatcacgtcgcacacggtcgacggcaaggtctacggcgtccggatgatcgacgacccgcagttcttcttctaccgcaagtcgctgctggaaaaggccggcacgggcgtcccccagaccctggacgaactcgccgaggccgccgccaaactcaccaccgacaaggtcaagggcctgttcctcggcaacaacatggtggcgccgaactacgccctggtctgggcggccggcgccgatcagctcaacgccaagaacgagatcgcgtaccacaccgacgaggtggccgcggcgctgaaggtgtaccgcaagatgttcaccagcgggcatctgctcctggacgcccccgccgactactgggacccctcggctctggtccagggactcaccgcgatccagtggtgcggcatgtgggccatgcccgtgatgcagcaggccctcggcgacgacctcggcatcttccccttcccctcggcggcctccggcgccaagcccgcggtctacaacggcggctggtccatgttcgtcaacgccaagggcaagaacgtcgacctggccaaggagtacgtgaagtggctctggatcgaccagaagaagtaccaggaggactgggcgctcagctacggcttccacataccgccgcgcacctcgaccgccgagtcggccaccaagctcaagtcgggcctgcccgctgagggcgtcaagctcttcaccgactacgggcgcttcgacaacgtctcctggacccaggccatgatcagcgcgctcgagggcgtgatcgccgacgccgtccgcaagggcaaggaccccgaggccgcgctcgacacggcggacaagaaggtcaaccgcgagctcaagaatctcttcgga

SEQ ID NO: 2081 - DNA, 960 bp, Streptomyces avermitilis
  CDS (1)..(960)
atgtcgaccaccacgacgcgtgacgtcgcgcgccccgccccggccaaggcgtccaaggccgggccgcggcggggtctgcggggcaccacgctcaacttctggctcttcaccggaccgttcctcctcggcctggtgatcttcgtctacgtccccatcggctggagcgtctggctcagcttcttcgaggcgcgctacaccgtcacgcccagcaagttcatcggcctcgacaactaccggcagatgctgacgaacggcgccttcgtcgacgcactggtcacgttcaccgtcttcgccgcgatcatcgtgcccgtcacctgggcgctgtcgctcggcctcgcgctgatggtgcaccggctgcgcttcatgaaggcgttcttccggtcggtgttcttcctgcccaccgcgtgcagcttcgtcgccgcctcgctgatctggaagatgtccatcttcagcggggtgcgcttcggcctggcgaacaccgtcctcggctggttcggcgtcgagaacatcgcctggctggccgaccccgacccgccctggtactggctggtcatcgtcacggtacgcctgtggctccaggccggtttctacatgatcctgttcctggcggccctgcagaacatcccgccggagctgtacgaggccgccgccatcgacggcgccgagccgggctggcagaccttccggcacatcacgctgccccagctgagggccacgtcaactgccgtgatcctgctgctccttgtggccgcctaccaggccttcgacgagttcttcaacctgctgtcgaagaccacatggggccggccaccgctggtcgagctctactacacggccctgggcgaaaaccaggactacggcgcgggcagcgcgggcgcggtcgtcctgaccctgctcatctgcgtcgtgacgctgctccagggcaggctcatgggtttcggacggggggacgagtccaag

SEQ ID NO: 2082 - DNA, 888 bp, Streptomyces avermitilis
  CDS (1)..(888)
gtgacgaccgtcatcgagagcgacaaggccggcgccgtgcccccgaagaagcgcgggcgcgagggacggggcgtcctcggctccaccggcctctacctcgccaccggcctctgcgccctgctcttcctggtccccttctacctgatcatccgcaacgccctgtccacggacgccgaaatcaccggcgaggaatggcagttcttccccacgcacatccggtggggcaacatcaccgagctgttcgacgacccgaccgtgcccttcgcccgttccctgtggaactccgcggtggtcggtgtcctccacacggccggcaccctgctggtctgctccctcgcgggctacggcctcgccaggatcccgtacaagcacgccgacaagatcttctacgcggtcctggtgaccctgatggtcccggccgccgtcaccttcgtaccgagcttcgtgctggtctcgtcgctcggctgggtggacagctaccgcggtctcatcatcccgggtctgttcagtggtttcacctgcttcctgttccggcagtacttcctggggttccccaaggagctggaggaagcggcgcgcatggacgggctcggctactggggcgcgtactggcgcatcgtcgtgcccaactcgctgaacttcttcgcggccatggccaccatcaccttcatcagcggctggaacgcctttctgtggccgctggtcatcggccagggcgaggactcgtggaccgtgcaggtcgccctctcctcgtacatgaccaaccagaccgtcaacttccatctgatcttcatggccaccgccatctcgatcctgcccctggtactcgtgttcctcttcctccagcgctggctggtgcagggggtcgcgcagaccggcatcaagggc

SEQ ID NO: 2083 - DNA, 3045 bp, Streptomyces avermitilis
  CDS (1)..(3045)
atgtccttccgcaccaccgcttcgcccacgtccaccgagtacgtcgaggacgtctcgccgggaagcggggcgctgcccccgagggcctggtacgcatcctcggacgccgtgtccctgtcactgaacggcagctgggccttccggctgtcgccgaccgccgacgcccaggacgactccttcgccgcggaggggtacgccatcgaggaggagggggaggggtacgacgccggggactggaccgagatcgaggtccccggccactgggggctgcaaggccacggcgcgccgatctacaccaaccacctctacccgttcccggtcgacccgccgcgcgtgccgaccgagaacccgaccggtgaccatctgcgggtcttcgatctgccggccgactggcccgcactgtcggacggcggctgcgtgctgcgcttcgacggcgtcgagtcctgcgcccgggtgtggctgaacgggacggacatcggggagttcaagggctcgcggctgccgcacgagttcgcggtcggacacctgctgaagccgcgcggcaacgtgctggccgtgcgggtccaccagtggtcggcgggctcgtacctggaggaccaggaccagtggtggctgcccggcatcttccgggacgtcacgctcctgcaccggccggcgggcagcgccctcgacttcttcgtgcacgcctcgtacgagcatgtcgaggggctcggcaccctgcgcgtcgactccgacgtcgacggccgggtcaccgtgcccgagctggacgtcgatgtcgagaccggcgagtcggtgacggtcgccgtcgagccgtggaccgcggagacgccccggctgtacgacggcgtgctggccaccgagggcgaacaggtccccctgcgcattggcttccgaacggtcgtacgccaagacggtctgatcaaggtcaacggcacgcccgtcctcttcaagggcgtcaaccggcacgaatggcaccccgagcgcggccgcgccctcgacctggagaccatgcgccaagacgtgctgctgatgaaacggcacaacatcaacgccgtccgcacctcgcactacccgccgcaccccgccttcctcgacctgtgcgacgagtacggcctgtgggtcatcgacgagtgcgatctggagacccacggcttcaccgagcaggcctggcgcgacaacccggtcgacgacgatcgctggacccccgccctgctcgaccgcgcggcccgcatggtcgagcgggacaagaaccacccctcggtcgtcatctggtccctcggcaacgaagccggcaccggacgcgggctcaccgccatggcggagtggatccgcggccgggacacctcgcgtctgatccactacgagggtgacatcgactgccgtgacacggacgtgtattcacggatgtacgccgcccacgccgaggtcgagcggatcggccggggcctggacgggggcacgcaccggcggcgcgacctccccttcgtcctctgcgagtacgggcatgccatgggcaacggtcccggcggcctcgccgactaccaacggctcttcgagacgtacggccggctccagggcggcttcatctgggagtggatcgaccacggcatcaaggacgagcggtacggcttcgcgtacggcggcgacttcggggaggagctgcacgacgggaacttcgtctgcgacgggctgctgttcccggaccggacgccgtcgcccggcctggtcgagtacaagaaggtgatcgaaccggttcgcatcgagggatgggggtcccccctggccgggcgaagccgagcgcccgggggaggtgcggacggcacggacggcacggacggcacggacggcacggacggcacggacggcacgatccgtgtgacgaacgcgtacgacttcgcggacctttcggcgctggccttcgagtggtcgtaccaggtcgacggagagaccgtcgaggcgggcgcgctgtcggtgcccgcgctcgctcctggcgagtcggcggacgtgaagctgccgacgccgcccgtggacgggcggggggccgagacacagtggacggtacgcgcggtgctgaccgccgagaccgcgtggggcccgaaggggcatcaggtggcctgggcccaattccctctcggcaaggggagttcggagcgtgtcgcccggcccggcggtcgggtcgccccgtcctgcggtccggtgcccggcgagcgccggatcaccctcggcccggccgccttcgacgcccgcacgggtgcgccgcgaacgatcggcggggtcgacgtcaccgggctccgcctggacgtgtggcgcgccccgaccgacaacgacaacggcgcgcactggcagccggacgagcgctacggcccgctctggcgcaggctgggcctgcaccggatgcaacaccgcctggaggcggtggagttggacgacgacgccctgaccgtacggtcccgggtggcgcccgcgggctgggaggtgggcctgcggacggcgtaccggtggacgtccgacgggacgcggctgaggctgacggtgtccgtggcgccggagggcgactggacgctcccgctgcccaggctcggcgtgcggttcgggctgtcctcggcggcggaccgggtgcggtggttcgggggcggccccggcgaggcgtaccccgacaccaggtcggcgtccatgctgggccgttgggagtcggccgtggacgacctccagaccccgtacgtccggccgcaggagaacggggcgcgcgccgacgtccgctgggcggagatcggcgggctgcggatcgagggcgagccggagttctggttcacggcacgccgctggacgaccgagcagctggacgcggccgagcacctcacggacctgacgcccggtgacaccgtgtgggtcaacctcgaccacggccagcagggcatcggctcgcagtcgtgcgggccgggcgcgctgccgcagtaccaccttcgtccgggcccggcggagttctccttcgtcttctcggaggcgtcttctcggaggtccatgtctgaaccgcgctcgcgacgc

SEQ ID NO: 2084 - DNA, 1074 bp, Streptomyces avermitilis
  CDS (1)..(1074)
gtgccccacacaacagccgcccaccgtcgtcgcgcctcccgtcccctccccctcgtagccgtcggcgcgctggtcgccgccgccgtcgccctcccccagctcaccccggacgcctttgccgccaccaccctccggggctacgccgacggccgcggcgtgcggatcggtgcggccgtcggcgacagcccgttgcggagcgactcggcgtacaccaccgcgctggaccgggagttcaactccgtcaccgccgagaacgcgatgaagtgggacgcggtggagcccagccggggcggcttcgactgggccgccgccgaccggctcgtcgcgcacgcgagcgcacacggccagggagtacgcgggcacaccctggcctggtacgcacagctgccgtcgtggctgaagaacggcaacttctcggcctccgagctgaacacgatcctcaagagccacatcgacaccgaggtcggccgctacaagggcaaggtgtacgcctgggacgtggtcaacgagacgttcaacgaggacggctcgatgcgcggttcgctgtggcaggacaagctcgggaccgggtacatcgcgaacgcgctgcggtgggcgcacgccgccgaccccgccgccaagctgtacatcaacgactacaacatcgaggcggacaacgcgaagagcgacgccctgtacgcgctggcgaagcaactcctggcggacggggtgccgttgcacggcatagggttccagtcccacttcgtggtcgggcaggtgccgtccaccatgaaggccaatctcaagcgcttctcggacctggggctcgaggtctccgtcaccgaactcgacatccgcatccccctgcccgcctcctccgacgaactggctcagcagtccgccgactacaagacggccagcgagaactgcctgggtgtcgcgcgctgcgcgggcatcaccgtgtggggcgtcagcgacaagtactcatggatcccggggacgttcagcgggtacggcgcggccctcccgtacaacgagagctacgcggcgaagcccgcctacaccgggctgtcgaacggactcgatccgaccgcg

SEQ ID NO: 2085 - DNA, 2385 bp, Streptomyces avermitilis
  CDS (1)..(2385)
atgagcatggccacgaggacggacacgcaggcgcccgtgctgcacgtcgccgacagccacgatctgatccgcgtgcacggagcgcgcgtgaacaacctcaaggacgtcagcatcgagatcccgaagcgccggctgacggtgttcaccggtgtctccggctcgggcaagagctcgctggtgttcggcacgatcgccgcggagtcgcagcggctgatcaacgagacctacagtgccttcgtgcagggcttcatgccgacgctggcgcggcccgaggtcgacgtgctcgaggggctgacgaccgcgatcctcgtcgaccagcagcggatgggagccgacccccgctccacggtcggcaccgccaccgacaccaacgcgatgctgcgcatcctcttcagccggctcgggcagccgcacgtcggcccgcccagcgcgtacgccttcaacgtcccctcggtccgcgcgagcggcgcgatcaccgtcgagcgcggtgccaagaaggcggtgaaggccaccttcaaccgcaccggcggcatgtgtccgcgctgcgaaggccggggcacggtctccgacatcgacctcacccagctctacgacgactccaagtcgctcaacgagggcgcgctcacgatccccggctacagcatggacggctggtacggccgcatcttcggcggctgcggcttcttcgacccggacaagccgatccgcaagttcaccaagaaggaactgcacgacctcctccacaaggagccgaccaagatcaaggtcgatggcatcaacctgacgtacgagggtctgatcccgaagatccagaagtcgatgctgtccaaggacatcgacgcgctgcaaccgcacgtccgcgcgttcgtggagcgcgcgatgacgttcaccgtctgccccgagtgcgacggcacccggctcagcgagggggcccggtcgtcgaagatcgaggggctcagcatcgccgacgcctgcgcgacgcagatcagcgacctggccgactgggcccgcggcctcgacgagccgtcggttgcgccgctgctcggcgcgctgctggggaccctcgactcgttcgtggagatcggcctcggctacctctcgctcgaccggccggcgggcacgctgtcgggcggcgaggcgcagcgcgtcaagatgatccgccacctcggctcctcgctcaccgacacgacctacgtcttcgacgagcccaccgcgggcctgcacccccacgacatccagcggatgaacgacctgctgctgcggctgcgggacaagggcaacacggtgctcgtcgtggagcacaagccggagacgatcgcgatcgccgaccacgtcgtcgacctcggcccaggcgccggcacggcgggcggcaccgtctgcttcgagggcaccgtcgaggggctgcgggccggcgggaccgtcaccggccgccacttcgacgaccgggccgccgtcaaggagacggtacgcaagcccaccggcgcgctggagatccgcggcgcgacggcgaacaacctgaagggtgtcgacgtcgacatcccgctcggcgtgctcgccgtcgtcaccggcgtcgccggctccggcaagagctcgctcgtgcatgggtcgatcccggccggcgagggcgtggtgtcggtcgaccagagcgcgatccgcggctccaggcggagcaacccggcgacgtacaccggactgctcgacccgatccgcaaggcgttcgcgaaggccaacggcgtgaagccggcgctgttcagcgccaactccgagggcgcctgccccacctgcaacggcgcgggcgtcatctacaccgacctggcgatgatggccggcgtcgccagcacctgcgaggagtgcgaggggaagcggttccaggcggcggtcctcgaccaccacctcggcggccgcgacatcagcgaggtgctcgcgatgtcggtgaccgaggccgaggagttcttcggcgccggcgaggcgcacacgccggccgcgcaccgcatcctcggccggctcgccgacgtcgggctcggctacctcaccatcggtcagccgctcaccacgctgtcaggcggcgagcggcagcgcctcaagctggccactcacatggccgagaagggcggtgtctacgtactcgacgagccgaccaccggcctgcacctcgccgacgtcgagcagctgctcggcctgctcgaccggctcgtcgactccggcaagtcggtcatcgtcatcgagcaccaccaggcggtcatggcgcacgccgactggatcatcgacctcggccccggcgcgggccacgacggcggccggatcgtcttcgagggcacacccgccgacctcgtcgccgcccgctccaccctcaccggcgagcacctcgcggcctacgtcggcacc

SEQ ID NO: 2086 - DNA, 582 bp, Streptomyces avermitilis
  CDS (1)..(582)
atggctcgtgtcgggctgacggtcgatcgagtcgtggaggccgcggccgacctcgcggacgaggtcggcttcgagaacgtcaccgtgtccgcgctggcacggcagttcggggtgaaggacgcgagcctgtactcgcacgtcaagaacgtgcaggatctgcgcacacgggtcgccctgctggccggcgaggagatgatcgaccggatcgccgccgcggtggccggccgctcgggcaaggacgccctggccgccttcgccgacgcctaccgggagtacgccctggaacggccgggacggtacgcggcgacccagatccggatcgaccagaccctcgtcgcctcctcccgcgccttccaccggaccgccgagatcacctacggcatgctgcgcgcctacggcctcgaagagcccgacctgaccgacgccgtacgactgctgcgcagcaccttccacggctactgcgccctggaggcggccggcggattcggtgcgccccgtgacgtactggcgtcctggcagcggaccatcgacgccctccacgcactcctcgaacactggcccgaacaggagagggaccgtgac

SEQ ID NO: 2087 - DNA, 819 bp, Streptomyces avermitilis
  CDS (1)..(819)
gtgactgacctgtactacgaggtgtgcggcggcgggcccgtgctgctcgtcgtccccggcggggccgggcatccgatggggctcgacgggatgacggagcgcctcgccacgcggttcaccgtcgtcacgtacgacccgctcggcctcgcgcacggacggctcggcgaacccgtcgaggaccagcgggcccaggcgtggagcgagggcgcgcgccgggtgctcgacgcggtcctgccggacggcgagtcggcgtacgtcttcggcagcagctcgggcgccatcgccgcactggacctgctcgcccgccacccgcggcggctgcggcacgtggtcgcgcacgagccgccggtggtggcggtgctcgacgacgcggccgcgcaacgggcgatgttcgcggaggtgtacgaggtctaccgggcggcgggcctggaggcggccgcggcccgactgggcgccgggctgacgggaacgactcccggcgaaccgcccggcggcgccgcccaacccccctcccccgccgacgagttgtcccaccccatgccgctcttcctcacgcgcgtcctgcgtcagttcaccgcctacgagcccgacgtgaccgcactcaccgccctgtccccgcgcctcaccctcggcgccggcgccgactcgcgcggccaattgctgcaccgcacggcctccttggccgccgagctgagcggcagcggtttcgtcgagttccccggcggtcacgtcggggcggtcgaacaccccgtggagttcgcggaccagctcgcggagacactgcttccggccggtgccccaggcgtaccgctgaccact

SEQ ID NO: 2088 - DNA, 1395 bp, Streptomyces avermitilis
  CDS (1)..(1395)
gtgccgccctgggggagggagcgcgccttgtctcaacaacagctgagacgcggaccgtcgaggtccgacccggcgccggtcacgcccggcggttcgcgaccctcgaggttcgtgggctggctcggtggcctcggctgcgcggccgccgggtacggagtgttccagttcctgttcggagtgctgcccgacagcgtcaccggcacccccgccaagtatgtgatcgccggcgtcagcgggctcggcacggccgccgcggcctggctggcggcggcgctggtccgggcccgggccaccgcgtcggcccccggccccgcgccgatcccgtccaccaccgcgcccggcccgctcccccagatcttcacgggcgcctacgacaccctcgccgatcaggtcaccgtggtcgacgacccggtgcgcgggcagctcaccggctggtcccactccctcggcgaggccacgcccgtgcgcccgaccccggtcggcaccgcctacgggctgcacatcatgctcgacctgggcgtgcccgacgggcggctcagcaccggcgacctggtcgacaccctgtggcggctgcggttgccggacggcggctggtcggcgcggtcccaggggaccgcggcccggccggaggtcaccgccctggtgctgggcgcgctggcccgggccggcgccccgcgggaccggctggcggccgaggtggcgttgtgcgaggccgggttcacgcccgaactcgaccgtacgggacgcgagttgacccatgtggtgacgaccgtgctgcgcggactgctgcgcgcggcgccccgctccgccgccctccccctgctgcgcgaggccctcgtcggcggtgcgatcaccgacccgcagcgcgaccaccgccgctgctggagccaccgcctggtgccggtgcacggtcggccgtcgtcgctgcacaccgcgcaggccgtggtcgccctcgaccgcgccgcccgtgtgctgggcgagagcgcgaacgcgcgcgcggcccgcgaggacggcgtgcgctggctgctggcctgcgcggacgagccgcacgacacctgcctggacctggagaacctccgggaggaggtacggcgcccgcgcgcagacgacccctcgcgccacgaggtgctgaacgtacggcacttcaccgcctcctggatcgtgcgcgccctgctcaccccgggcgcgcgcgagctcgcccgcgaggacgggatcgaggaggcgtggcgggagcggctggacggcgcggtcacagccgtgtgggcgggacagaccgacggcatctgggcctgggtgcgcgacgacagcagcgagctgcgccggcccatgtggatgacctatcaaggcctttcggcgctgcgggcgcatgccgtatggatgtatcagcctggaagc

SEQ ID NO: 2089 - DNA, 768 bp, Streptomyces avermitilis
  CDS (1)..(768)
atgggtggtcggcaggtcctggcggcgcggcggcggctcgcgcaggcgctggacggcgaacggcccgagcacgagctggtggcggccgcccgtaccgtcgtcgccgaactgggctcgacggagcgactgttggagctgatctccgaactggcctgcggcgagggggaccccgagggctgcgcccggctgtcgtaccggcacgttctcggcttcgacaagctcctgctgatcgacggcggtccacggcacatgctgcgcgcccatctgtggcaccccggcgcgggtgcgatcggcaaggaggacatccacaaccaccgctccccgctggcgtcctacgtggtccggggccggctgaccatggagttgtacgagcaggacgagcggaacgggcaggacgagcggaacgggaagggcgagcctcgcggcggcggcgggatggcggcggcccgctacagggagtccctggcggaccggtcggccgactggctgctggagcccgcgggcccggcccggctgcggatgacacacgtgggtcagtacacggcgggcagcgcctacgccctgcccgcgcacaccctgcaccgcgcctggtgcgacacggacgtaccgacggtgacgctcttcctggagacggggagtgaacggcggcgccacaccgatgtgttcacggcggccggcccccatccgggaacggtcccgaaggtgccgctcgacgtggcgggctacctggcggaactgggcggcctggcggagctgctcaggagttcg

SEQ ID NO: 2090 - DNA, 417 bp, Streptomyces avermitilis
  CDS (1)..(417)
atggacatccccggcgacaaacgactggcggccgccgtcgtgatggatgacgaggggcgcgtgctcctggtgcgccgcagtgagagggaacggttcctgccccgcgtgtggggcgtcccgtgcgggaagctcgaaccggacgaaagtccccgggacggcgccctgcgtgagctgaaggaagagaccggactccgcggcgaggtggtccgcaaggtcggcgagtcgtccttcgtcagcgactatcgggggcacgagaccaagaactggcaggacaacttcctggtccggccgctgtccacggacatcacgctccccgcgcccgaccaggcgtacgcgtggctgacaccgtcggagctgtcgagcgtcgacatcgacgagtacaacctggacatcgtgcgccaggccctcacgaactcc

SEQ ID NO: 2091 - DNA, 783 bp, Streptomyces avermitilis
  CDS (1)..(783)
gtgacccggcaggcggacgtgacctcgttctccgcactccatcacgccgacgcgcccctgctgctccccaacgcctgggaccacgcctcggcggcggccctcgcggcccagggtttcgaggcggtcggtaccaccagcctcggcgtcgccgcggcggccggtctgccggacggcacggcggcgacccgggaagagacggtacggctcgcccggcagctcggcgggggcaccttcctgctctcggtcgacgccgaggacgggttcggccacgacccggacggcgtggccgagttggcgcgcgagctggcggcggccggggccgtcggcatcaatctggaggacggcctcgcgtccgcgaagctgcacgcggcgaagatcgccgcggtcaaggccgccgtaccggacctcttcgtgaacgcccgcaccgacacgtactggctcggcgacggcggccacgccgagacctgccgccgcctcgacgcctaccgacaggccggcgcggacggcgtgttcgtccccgggctgagcgacccgacccgcatcaccgccctggtgaagaccctcgacgtgccgctcaacatcctctactcacccctgggccccaccgtcgcccaactcggggacctcggcgtacgaagggtgagcctcggctccctgctgtaccggcgggcgctgggcgcggcccttgacgccgccgcggacattcgggcgggacgaccgccgcggggcgtcgcgccgacgtacaccgagattcaggcgctcagcgcggaaggcccggacgcc

SEQ ID NO: 2092 - DNA, 519 bp, Streptomyces avermitilis
  CDS (1)..(519)
atgaacgattccgcgcaggaacgcctgagggaaaccggcaccgaaaacccggccgcggccgtcgtcgccatggtggaccacgtcctcgacctcgccgcgacctggaccgcctgggacgggaagcccgcccacgtcgacgaccgcgtctacaccccgcacaaggcgatccgccgcgtcaccgaccttccccaagctctcaactccgttcgagcaggggataccccgatcctcgaccacctggccgagctggaggcccggctcgtgggcgaggagccgcagcccgaccactggcacgcgtcggcgagcacgacggaggcggatctcgcgccgttcacgcccgaggatctcgacgaggcacgcagccgactcacgcggctcgcccggatctgggcgaaccggctcggcacactgaccgaagggcagctcgacgactctccggcgcagggctggagcttccgccgactggccgagcacctcgaggaatcgacgtactacgccgacgccgtgggcaggtcggcg

SEQ ID NO: 2093 - DNA, 984 bp, Streptomyces avermitilis
  CDS (1)..(984)
atgccgcagaccccgcggaccacagcgctcacccaccgtctggtgtcctcacccgcgggacggatccacctcgtggagcagggcaccgggccgctggtcctgctggtgcacggcttcccggagtcctggtactcctggcggcaccaactgcccgcgttggcggcggccggctaccgcgcggtcgccgtcgacgtgcgcggctacggccgctcctcccggccaaacgcggtgcacgcgtaccggatgctcgacctggtcgaggacaacgtggccgtggtgcacgccctcggtgagcggaccgccgtgatcgtcggccacgactgggggtcgaacatcgccgccacctcggccctggtacggcccgacgtgttccgcgcggtggggctgctgagcgtgccctacaccccgcgcggcggcccccggcccagcgagatcttcgcggggatgggcggggacgaggagttctacgtctcctacttccaggagcccggccgggcggaggccgagatcgaaccggacgtccgcggctggctcgcgggcttctacgccgccctgtcggcggacaccatgcccgcgcccgacgcgccggatccgcacttcgtacgccgtggcggaacgctgcgcgagcggttccccgccggccggctgcccgcctggctgagcgaggccgacctcgacgtctacgccggcgagttcgaacggaccggcctgagcggggcgttgaaccgctaccgcgccatggaccgggactgggaggacctcgctcccttcgacggggctcccgtccgtcagccgtccctcttcatcggcggtggtctggacgcctccacccagtggcttgccgatgcgatcgaggcctacccggtcacgctgcccggcctggtctcctcgcacatcctcgacggctgcggccactggctccagcaggaacgcccgcaggacaccaaccggctgctgacggactggctcgcctcactgcccggc

SEQ ID NO: 2094 - DNA, 1707 bp, Streptomyces avermitilis
  CDS (1)..(1707)
atgcagccgttcaggtcgcccgccacgccgcccgaggaccgcaccctcagcccgtacaccggccacacccgcgcccactgggaggcgaccgccgacgcgctgctcgccgccgtggccccgtacgcgaccgaggaccaggcgctctaccacctgcccggcgaccgcccgagctggtccggcaggctctccgacggcctggagggctacgctcgtacgctgctgctggccgccttccgccgggacgagaaggccctggagcggtacgcggacggactcgcggccggcgtctcgggcgtctggccgcgcatcgagcaccgcggccagcccctcgtcgaggcggcgtccgtcgccctcgccctgcgcctgacccggcccctgctctgggaccgcctctccgacggggtgcgacagcgcgcggcggcctggctcggcgacgcgctgaccgccgaaccctggccctgcaactgggagttgttcccggtgacggtcggcggcttcctccaggagatcgggtacgagccggacgacgcacgggaggccgtcgaccggggtctggagcgcatcgagcagtggtacgtcggggacggctggtacaccgacggcgacggccgggccttcgactactacaacggctgggccatgcacctgtaccccgtcctgcacgcgtggctggccgacgacgcgcggctgctggacctgtacggcggccggctctcggcccatctcaccgactacgcacgcctgttcggcgcggacggagcccccctgcaccagggccggtccctgacgtaccgcttcgccacgacggccccgctgtggctgggcgcgctgaccggccgtacgcccctgccgcccggcgagacgcgcaggctggcatccggcgcgctgcggtacttcctcgaccggggcgcggtggacgaccggggcctgctgaccctgggctggcacggccccgactcggctgtcttgcagggctattcgggcccggcgtccccgtactgggcgagcaaggcgttcctgggcctgctgctccccgccgaccacgaggtgtggacggcaccggaggaaccgggtccggcggaacgcgccgacgccgtcacgccgatcgccgcccccaactggctgctccagtgcacgcgttcggacggggtggtgcgcctccacaaccacggcagcgaggacgtccgctacgacccccactactcccggctcgcgtactcgacggtgacggttccttcgccggcgtacgacaacaccgtgaccgtgggcggcgatccgagccgtacgtcgatcgagccgctcggcgtgggcgagggctgggcggcctcccgccacacggccggcgagggtgtccgggtcacgagtctggtcgtggcccgtggtgcggtggaggtgcgcgcccacctggtggcgggcgccgcgcccgggacgccggtgcgggtcacgggctggacgccggcgcagggcctcggcgccgaactcctgcccggccacaacctctccggggacctcacgggcgtgacggcggacggaccgacactgttcacggccctggcccgtctcacggcggaacaggaccccgtgcccctcgccgaggcggtgtccgtgcgggtggcggacccgggagagatccgggtgagctggacggacggcccggaggtacggatccggctgggcgacggcgaggtggccgtgtcagccgggcag

SEQ ID NO: 2095 - DNA, 1020 bp, Streptomyces avermitilis
  CDS (1)..(1020)
gtgccggcggtgctggccgccgtcaccgccctgtcggcggtgccggcccaggcgcaggcgcacgaggggcggcgcgccccgggcctggagaactgcaccgccagcgcctgtcacttcgacgtcgcgcccgggacgtacgacgtccgcgtgctgctcggcggcgacgcggcggccggtacgagcatcagcggtgaggcgcggcgctccctgctgcccgagacggccacggaggcgggcgagcgcgtggcccgcggcttcacggtgaacgtccgcacgccggagggcgagcccaccggcgccgacggcacgcccggcctcgacctggtgctcggcggcgcggcccccgccctggccggtatcagcgtcacgcccgcgcggcacccgcggcagatcttcctggtcggcgactccacggtctgcgaccagcccggcgacccctactccggctgggggcaacagctgccgcagtacctccgcaaggggctgtccgtcgccaactacgcggactccggcgagagtacggtcacctacctcgccgaccccgcgctcttcccgaccgtccagccgctcatccgcaggcacgacctggtcctcatccagctcgcccacaacgacaagacgacggacgaggcgacgtaccgcgcgaacctcgagacgctcgtcgcgggcgtccgcgcgaagggcggcgatccggtcctggtcacgcccatcgtgcgccgctggttcaacgccgacggcaccctgaacaacaacaccgcgctgctggtcaacggcctcggtgtggaccacccggcggtcatccgctcggtcgcggcggccgaggacgtgcccctgatcgacctgacggcgaagaccaaggcactcgtggaatccctgggtgtggaaagatcaaaatcgatctatctctacaacgagaagcgggacaacacgcatacttcagtgcagggggcgaccctgtacgcgggtctggtgcgcgacgagttggtggcgcagcatctgatcccggagaagcaggcgagg

SEQ ID NO: 2096 - DNA, 1674 bp, Streptomyces avermitilis
  CDS (1)..(1674)
atgtccggttcccccaacaggccggtccgccgccgcaccttcgtactcggcggcgcggccgccgccggcacggcggccctcgccggaccgctcgcgccccccgcgtccgccgcgggcttcggctacacggacgacggctcgaactacgtcgtcgacaccggcgcgaacctcgtcttcaaggtcagcaagaccaacggcgacctgacctcgctcgtctaccgcggcaccgagtaccagggctacggcggcaagaactcgcacgtcgagtccggcctcggcacctccgccgtgacgatcgcgcagtccggttcgacgatcctggtcagcgtcacgtacgggacgctcaagcactactacgcggcccgcagcggcgagaacaacgtctacgtgtggaccaacaaggcggacacgtcggtcagcgcgacccgctacatcgtgcgcgtcaaggcgggtctgttcctcaacgacgagcccgattcctacacgtacgcgccgaccaccgtcgaagccgcggacgtgttcgcgaaggcggacggccagacccgttcgaagcactactcgaagctccgcgtcgtcgactacgactacatcggctggagcaccggcgccgtcggcttatggatggtgcgcagcaaccacgagaaggcctccggcggccccttctaccgctccctgctgcggcaccagagcgcggacggcggcggcctgtacgagatcctctactacggcgagaaccagacggaggcgcagcggttcgggctccagggcccgtacgtcatcgcgttcacggacggcggcgccccctcgtcgtcgctgtaccccggaaacctcacgacctcgtgggcggactcgctcggcatcttcgggtacgtcgccgccgggggccgcggcaaggtcgcgggcgtcggcatctcgggccggaacacggcgtacgcgtacacggtcgggctcgccaactccgccgcccagtattggggttcggcgagatcctccgacggctacttctcgatcgcgggggtcctgccggggacgtacacgctgaccgtcttcaagggtgaactctccgtccacagcgcctcggtgacggtgaccgcgggcgccacgaccaccctcaacacgatcacgatcccctcgtcgaacgacccgggcaacgcgagcgcgatctggcggatcggcacctgggacggcacgccgagcgggttcaagaacgcggcgctgatgacgtacgcgcacccctccgatccccgggccgccgcctggaccggcaacgtggtgatcggcagcggcggcgagacctcgtccttcccggcgtacatctggaaggacgtcaacagcggtctgctggtgtacttcaagctgaccgccgcgcaggccgccgccgcgcacaccctgcggatcggtgtgacgacggcgtacgcgaacggccggccacgggtcacggtgaacgactgggtgtcggccatcccctcgccgcccacccagccgagcacccgttccctgaccgtcgggtcgtaccggggcaacaactacacgttcacctacagcgtcccggccgccgcctggctcacggacaccagtcagtacaacgtgctgaagatcgacgtggtgagcggttcgggaacgacggcctacctcagcgcggggacgtcgatcgacgcgctcgacctcctcgcc

SEQ ID NO: 2097 - DNA, 1392 bp, Streptomyces avermitilis
  CDS (1)..(1392)
gtgatcctcttcgccctgtgtctcgcgttcgccggcgccctcacgaccgcgggcccggcccgggcggcggcccagaccctcaccaacggcacccagttcaccgacacttcgggcaacggcgtgcacgcgcacggcggcggggtcatcaaggtcggcggctactactactggttcggcgaggaccgcaacgccgacaacaccttcaagtacgtcgacgcctaccgctccaccgacctgaagaactgggagttccgcagccacgtcctgacccaggccggcgcgagtgagctggcgagcgccaacatcgagcgtccgaaggtcatgtacaacgcgtccaccggcaagttcgtgatgtggatgcacaaggagaacggcaccgactacagcgaggcacgcgccgcggtcgcggtgtcggacacggtcgacggcacctacacctggcagggcagcttccagccgctcggccagtacatgtcccgcgacatcacggtcttcgtcgacaccgacggcaccggttacatggtgtccgccgcccgtgagaactacgacctccagatctaccggctcaccgccgactacaccggcatcgacagcctcgtcgccgacccctggcacggcggacaccgcgaggcacccgccctcttcaagcggggcggcgtctacttcatgctgacgtcgggcgccacgggctggaaccccaaccagcagcagtacgcgaccgccacctccctggccggcccctggaccgcgatgacgaacgtcggcgactcgacggcgtacggctcgcagaccgcgtacgtccttcccgtgcagggcacttcgggcacctcgtacctctacctgggcgaccgctggggcaactccttcgggggcagcgtcaacgactcccgttacgtctggctgccgttgaccttccccacctcgaccagcctcagcatgagctggtacccggaggtaaccgtcgacacggtcgccggcacgatcagcgggacgagcgccacgtacgagacgctgaccgcccggcactccgccaagtgcgccgacgtccccagtcagtcactgctcacgggcgtcgcgctcacccagtacacctgcaacggcggcaacaaccagaagttctggttcaagtccgtcgccggcggctactacgagctgatgggccggggcagctccctgtgcctcaccgagaacgtcaccgccgtcacccaggagaactgcaccgccgcgacctcccagcagtggtcgctcaccacctcgggcggctacgtcagcctcaagtcccgcgcgagcggcgaatgcctggacgtgtccggcgcgtccaccgccaactccgccgcgctgatcacgtacacctgcaacggaggcaccaaccagcagtggacgcgtggcaca

SEQ ID NO: 2098 - DNA, 327 bp, Streptomyces avermitilis
  CDS (1)..(327)
gtgcgcagccatttccagaagacgggccgggacgtgacgctcaccggcgacgcggtggtgaccgtgccggccgggacccggatcggctatcgcgggggcgacggcaatgacgtggtcctgaagaccatgacgaagaagcggcggggcgcggcaccgtcggcgtccgccgccccctccgtgaagagcaccgccgccgtcggcgagaacgagggcgcccgcgcgtggtggcccctgttgctcgcgccgccggcggccacgctcgccgtgccggtggtccggcggaatcggtcgcggcggcgcggtggacggcggcacgcggcctcccgt

SEQ ID NO: 2099 - DNA, 939 bp, Streptomyces avermitilis
  CDS (1)..(939)
atgaccaggagcaccaccctcgccgaagccctcgccgccgcccctgtcgtgctcgacggcggcctgtccaaccagctggagtcggccgggcacgacctgagcgacgagctgtggtcggcacggctgctcgccgagcggcccgaggcgatcaccgaggcgcacctcgcctacttcgaggcgggcgcggacgtggcgatcacctccagctaccaggccaccttcgagggcttcgccaagcgcggcattccggaagagcgcgcggccgaactcctcggcctcagcgtcgggttggcgcgcgaggcggcggtgcgggcccgcgccgacggcgtcacgcgaccgctgtgggtggcggcgtcggtcggcccgtacggggcgatgctcgcggacggctccgagtaccggggccggtacgggctcacggtcgccgagctggaggccttccaccggccgcgcctggaggtgctcgccgcggcgggacccgacgtcctggcgctggagacggtgccggacgcggacgaggccgaggccctgctgcgggcggtacgcggtctcggcgtgccggcgtggctgtcgtactccgtctccggtgaccgcacccgggccggccagtccctggaggaggcgttcgccccggccgccgaagcggacgaggtgatcgcggtgggcgtgaactgctgcgcccccgaggacgtggacggcgcggtcgagacggccgcgcgcgtgaccggcaagcccgtggtggtctacccgaacagcggcgagacctgggacgccggcgcccgcgcctggagcggccgctccacgttcaccgccgagcaggtcaccggctggcggcgggcgggagcacgcctgatcggcggatgctgccgggtgggcccggcagcgatcacgtcgatcgcggggacgctgggcgagcaagggcgcgcccggccgacggag

SEQ ID NO: 2100 - DNA, 1248 bp, Streptomyces avermitilis
  CDS (1)..(1248)
atgccttcggcgcccagttcttcgtgcccgacaaccttccggcgctgcgcgagcggcggctgcccccggcgccgggccctggccgacgacacggaaatggcctgctccatcgcgcgtgtcccgcgcacggcgggcttcgaccaggacgcgctggcccggtccttcgccgagcaccacgacttcgaccggggctacggcccgtcgatgaatcggctgctgcgcctggtccggcagggcgagccctggcgcgacctggctgccgggctcttcgagggacagggttcctggggcaacggggccgcgatgcgggtggccccgctgggggtccggttcgccgcggacctgcccgtggcggcggagcaggcggcccgttcggccgaggtgacgcacacgcacccggaggccgcggcgggcgcgatcgccgtggcggtggcagccggcttcgccgcccgcgggcgcgccgaggcggtcaccggggccgggctgctggatgtcgtcctggacctcacgcccgcgagcaaggtgcgcgccggggtggagcaggcgcgcctgctcctcgaccagccccatgtcgaactcgccgcgcacacgctcggcaacggccgactggtcagcgccgtggacaccgtcccgttcaccctgtggtgcgcggcccggcatctcgacgactacccggccgccctctgggcctgcgccgctgccggtggggacgtggacaccacgtgcgcgatcgtcggcgggatcgtcgccgcccacgtcggcaccgcgggcattcccgccgcctggcggcagcgggtcgagcccctgccgccctggttcttcggccatgcggcggcctcctggtccgccctggcccgcacgctgcccggcgaacgtcacccctgtgtgtgctgcggacgcctcgtccacgaccggccgcccgggtcccacgacatctgcccgctctgtttctgggaggacgacgccgtccaactgcgcctgccggccgccgcctacgggcccaaccggatctccctggtcgacgcccaggtgaacgcacgcgacatcggcgcatgcacacagcgcgaccttagcttcgtccggccgccgcagcccgacgaacccgtcgaccccgactggcggccgatcgaccccctgcgcgaccggttcgaggacccggacggggagacggacgcgcggctgccgtggcccaccgaccacaccaccctctactggtggcggcccaccttctggaatccctgcggccgc

SEQ ID NO: 2101 - DNA, 1599 bp, Streptomyces avermitilis
  CDS (1)..(1599)
gtgcggtggacccggcggtggacccggcggtggacccggcggcggacccggtggtccgtaccccgtacggagcggtgcgcggccggtacgagaagggggtcgccgtcttccgcggcatccccttcgccgcaccgcccttcggccaccgccggttacgaccgaccgatccgcaggagccgtgggacggggtgcgcaacgccggagcgtttggccccactccgcccaaaccgcaagtactcggaggcgttcgcccgtttcttgtccgacccggtggtggccggggacgactgcctcaacctcaatgtgtggacaccggagccgggtcgtggcgcccggctcccggtcatggtgtggatccatggcggcgcgctgacccgcggctcgtcggcggtccccgtctacgacggcagttccttcgcccgcgacggcgtggtgctggtctccttcaactaccgcctgggtgtggagggttacggcctcttcccggacgcgccgcccaatcccggcctgcgtgaccagctcgcggcgctggagtgggtgcgcgacgccgtcgccgagttcggcggcgaccccgaccgggtgaccgtcttcggcgagtccgcgggcgcgatcagtatcggcgccctgctggcgagcccacgcgcccggggcctcttccggcgggcggtgctccagagcgggccgcccgagtcgacggagcgggacaaggtgcggcgtctggtgcggcggatggcggtgaagctgaggatcccggcgaccgccgcggcgttcgccgaggtggaccgcaccctgctggccgaggcgcaggcggaggtcggccgactggcgggccccgtcctcggcggaccggccttcggcattgtcgtggacggtgacctggtgccgagcgatccgcgggaggcgctcctcggcggcctcgcccgggacatccccctgctgctgggctggaccagcgaggagcaccggctgtggctcgcacccaccgggctcctcgaacgtatcgacaggctcggcccggtcgccctggccggcgcgatggcccgctgccgctgcggcccggaggtcccacgcggctatcgcctcgcccaccccggggcccccacctccgatctggtcggccatctggtcaccgaccatctgctgcgcgttccgctgcaccggctggccgactcccgtacgggccacgcgccctcgtacgtctacgagttcgcctggcgctcgaaccacccccgcctcggcgcctgtcatgccctggagctgggcttcgtcttcgacacggtcgatgtgccggactcggcgaagctcgcgggacccgacgcgccgcaggagctggccgacgcgatgcacgcggcctgggtgcgcttcgcggtggacggcgacccgggctggccggcctgggacgactcacacccggtccgggtcttcggcgcggacgaggagctcgtgcacggcccgcgcgatgccgaagtcggcctgtggaaagccgagttcactcgtccggcagccacgcccgcacccgtgtcgccccctccgcccggtccgcccgcgcgtggcagggcaccgctgtcggccgtacgttacttccgtcgctcggacgta

SEQ ID NO: 2102 - DNA, 1047 bp, Streptomyces avermitilis
  CDS (1)..(1047)
atggtccgtaccggaagcatggccggaccgaccctcgcggtcgtcgcacgggaggccggcgtctcggtgccgacggcctcgaaggtggtcaacggccgggaggacgtggcacccgagacacgccgccgggtcaccgaggcactcgaccggctcggctacgtcaagagaccccgcttcgacacgacgaagtcgcagggcctggtggacctggtggtgcactcgctggagagctcccggtcgggtgcggtgctgcacggtgtggaggaggccgctcatgaggcgggccttgaggtggtggtctcggccgggctgacccggaccaggggtgggcgcccggaacgcggctggctggacaaactgtccgcgcgcggctcgtccggcgtgctgttcaacctcgccgaactgacaccgccccagtacgcctggctggatcagcaccgcatcccgtacgtactgatcgacccggagctcgaaccgccggcgggggtggtgtccgtgggggcggccaactggcagggcgggatgagcgccaccgagcacctgctggcgctcgggcacgagcggatcgcggccatcggcggccaccggcgcaagatgtgcggcggcgcgcggatcgcggggtaccgctcggcgctggccgcggcgggggtccggcaccgtccggagtatgtgcgccacggcaacttcgaccccgccgtcgcccggcggcgcatgcgggagttcctggacctgccggagccgccgaccgccgtcttcgtctgctcggaccggatggcgctcggggtgtacgaggcgctggcggaacgggggttgcgggtgccggacgacatcagcgtcgtcgggttcgacgatctgcccgaggcgcgatgggcctcgccggggctgacgacggttcggcagccgctggcggagatggcggcgaccgcggtgcgcctgctcgtccgcatgatggcgggcgaacggccggagggaacccggacggagttgtcgacacggctggtggaacgggcgagcacggcgccgccgcgtgaccgcgccaccgagggg

SEQ ID NO: 2103 - DNA, 2448 bp, Streptomyces avermitilis
  CDS (1)..(2448)
gtgaacgaaaggcgtcgtccggccgtacgtacagtggcggtcctgtctccccggcctggtccgccgcaccctcaccaggcaacgcacggaaggaccttcgggttgtcccacacaagctcccggcaactcccggacaaggacgacacccccacggcggaggacccgactccgaccgtacttccggagcagcaacctgccgaggacggacaccgggacgacgcacaccgggacgatgaggaagccgcgccggccgacaccgagcccgacgccggtgaggccaccgcggcgcaggacacggcccccggcgcctccgcggcgcaggacacggcccccggcgcctccgcggcgcaggacacgaccaagccgggcgacgcctctgcgacggacggcacccccaagccgggcgacgcctccacgacggacggcacccccaagccgggcgacgcctccacggcggacggcacccccgagccgggcgacgcctctgcgacggacggcacccccaagtcggccgacgcctctgcgacggacggcacccccaaggccgacgacgctccggagaccgctcctggtccggaagcggcagcggaggcggaagccggagccggagccgaagccggatccgaagccgcgccggacaccagcgccgtgccggaatccgacccggacccggcggttcccgacccgtcgactcccgacgcggcggttcccgacccggacactcccgacgcggcggttcccgacccggacactcccgacgcggcagttcccgacccggacactcccgacagcgcccccgcccgccccggctggcgtggcaagcaccccgacgccgctcgtgtcctcgcctggacagccaccgggattgccgtcgccctcgtgctcttcgcgcttctcgtgccgaacgacctcgctcgcttcacgccctcccggttcgtacggatccccgcggaggggatcctcggcgccgcccttctgctcgtcctgccgccgaagccccgccggatcctggcggtggtcggcggggtcgggctcggtctgctgaccatcctgaagttcctcgacatgggcttctactggtcgctggagcgccccttcgacctggtgctcgactgggtgctgctggacgacgccgagtcgttcctcaaggactccatcggcgggggcggcgcgctcgccgtcatgatcggggccatcgccctcgccgtcgcggtgatcgcgctcatgacctggtcggtcgtccggctgacccggctgatggcgagcaggcgccacttcgcgggccgtacgctcctggtgctcggcacggcatggatgacctgctcggtgctgaccctcgaggtcgccggtgtgccggtcgcctcgcgcagcgccgccacactcctcgagaaccgcgcgcacgcggtgcgggccggcatcaaggacgggcaggccttcgcccggcaggcctccgtcgacgccttcgccgacaccccgtccgaccagctgctgaccggactgcgcggcaaggacgtcatcttcgcgttcatcgagagctacggccgcagcgcgatcgacgacccggcgatgaccgagccgatcaacgagacgctcacggcgaagaccaaggaactgagcgacgccggctactcgtcccagagcggctggctgcgctccccggtcgcgggcgccggcagctggctggcccactcgacgttcctgtcgggcctgtggatcaagaaccagcagcgctaccgcaacctcacctccggcaaccgtatgaccctcaccgaggccttccgccgcacggacgcctggcgcaccgtcggcatcatgccgggcgtgacgcgcgcctggccggagggcaagttcttcggcctcgaccacatctacgactcgcgcgaactcggctaccagggaccgaagttcagctggtcaccggtgccggaccagtacagcctggcggccttcgagcgcctggagcacggcaagaagcacagcaagccgctgatgtcggagatcatcctgacctccagccacaacccgtgggcccccatcccgaagacgatccccgaggaccaggtcggcgacggctcggtctacgacgccatccacgacgcgggcaaggatcccaaggaggtgtggaaggacccggcgaaggtgcgcgacgagtaccgcaaggccatccagtactcggtcaccagcctcgtcgactacgtcgcgaagcacggcaacaagaacaccgtgctggtcttcctcggcgaccaccagcccaaccgcaccgtcacgggcgacaaggccggccgtgacgtgccgatcgcgatcgtcgcgcacgaccagggcgtactggaccggatctcggactggggctggacggacggtctcaagcccgcctccgacgccccggagtggcggatggacaccttccgcgaccgcttcctgaccgcgtacggccccgagccgacgtcc

SEQ ID NO: 2104 - DNA, 702 bp, Streptomyces avermitilis
  CDS (1)..(702)
atgcccttccgcgttctcgtgtacacccgcaccaccggataccggcacgattccctcccggacgccgtcgccgccgtacgctccctcggggccgcgcacggcttcgacgtcgacgccaccgaggaccccgccgccttcgaggcacccctcgacgcgtacggcgccgtcgtcttcctctccaccagcggcgaggtcctgacacccgagggacgtacgcgccttgcggcgtacacacgcaagggcggtggcttcgtcggcgtgcacgccgcggcctgtacggaggacgcgtggccgtactacggcgaactgctgggggcgcggttcgcgcgccatcccgcgtaccagccgggcaaggcggtcgtcgaggaccgcgatcacccttcgacccaccacctgcccacggtgtgggagttcacggacgagtggtacgacttccggaccactcctcgcggttcggtgcgcgtcctcgcctccgccgacgaatcctcgtacgacggaggcgggatgggcgacgaccacccgctggcgtggtgccgcgaccagggcgcgggcgcgggccgggtcttctacaccgcgctcggccatgcctccgaggcgtacggggacccggacttccgcgcccatctgctcggcggcatccgctgggccgcccgcgaggtccaggcgtatggccctgtccggcgtgacccgccggaccgaccc

SEQ ID NO: 2105 - DNA, 657 bp, Streptomyces avermitilis
  CDS (1)..(657)
atgacccgtgccgcgcgcgttccgaaagctttggccgtcctgcccgccctgctgcttctgccggtcctgctctccgcgtgcggcaccgagaaggcgggagccggaggcagcggcgcggaccgtgccgaggtgagccgtgcccgactcgacgcccgcgccgcggcgttgggggtcgcaccggaactcgtctacgtcaccgaagcccccggattcaccctcgcccagcagtcggtgggtgtgtacggcggcgacggcttctccagcgtctacgtgtcccggaagacgggcgcccagatccagctctccgtggaccggggcaccatgacggcggcgaactgtccgaagcagccgctcggcgaggcgtcgggggagcggatcacctgcgcgcgggacggcgacacgtggtaccgcacggccgggggccggcaggagtacgcggtgccggagaaagggcacgtggtgcgggtgagcgccgacgcgaacgcagtcggccgcgccgttctgcgccgggccgccggcgcggcgcaccgcccggacgacaccgaactggcggccgtcctgcccaccccggacggcaccgccaccgcgcccgtcgaacgaggcgacctgcccccggtgggcgacggggcgcccaacaacgacgtcggcacgtcgggc

SEQ ID NO: 2106 - DNA, 396 bp, Streptomyces avermitilis
  CDS (1)..(396)
atgactccacgattcgatgtgatcagcctggcggtctccgacatggccgccgctctcgccttctaccgccgcctcggtctcgtcttccccgacggcgccgagagcgagccgcacgtcgaggccgggctgcccggcgggctgcggctggcgctcgacaccgaggagaccatccgctccttccaccccgagtggcagccgccggccgccggcggccgcctctcgctcgccttccgctgtgacagcccggccgaggtggacacggtgtacggggacctggtgggcgccgggtaccacggcgagctcaagccgtgggacgccgtctggggcatgcggtacgcggtggtgcacgacccggacggcaacggcgtcgacctgttcgcgaacctaccggcgcag

SEQ ID NO: 2107 - DNA, 711 bp, Streptomyces avermitilis
  CDS (1)..(711)
gtggttgcagagcgcgcttcggcgccacccgggtacgcggagcggccgtcccggctggcgggcgcggtggtgtggaccaacaggccgtccgctgccgcggggcggcccgtgctgcccgacggctgcatggacctgctgtggaccgaggggcggctcctggtcgccggcccggacacgcacgcgtaccggccgcagggccctgccggggaatgggcgggcgtccgcttcttcccggggacggcgccggtcttcctaggcgttccggcgtacgaactccgggaccggcgcgtcgacttggcggaggtgtggcccgccgccgaggtgcggcgcctgacgggacgcgtcgacgccgccgccgatcccgcgaccgcgctggaagagatcgcgctgcaccgggccgcgcaggcggaccgccccgacccgctgctgcggaaggtggtggcgtccctggccgcgggccggccggtggccagggccgcggacgaactcggcgtcggcgcccgtcagttgcaccgccgctcgctggccgccttcggctacggacccaagacgctcgcccgtgtactgcggctgcaacgggccctcgcgctcgcgtgggcccaagtgcccttcgcggagacggcggcccgcgccgggttcgcggaccaggcccatctcgcccgggacgtgcgggagttggcgggcgtaccgctcggcgagctactgcgccgg

SEQ ID NO: 2108 - DNA, 960 bp, Streptomyces avermitilis
  CDS (1)..(960)
atggacgcactcgcaggcctgctggagggcccccgcgcacggggcgccttcatgatccgggcgtgcttcgacccgccctggtgcatacgcgtcgaggaccgggccccgctgacgatcatgctcgtggtccggggcgaggcctgggtcatgccggacgggcaggagcggacgctgctcagggcgggcgacctggccatcgcgcgcggccccgacccgtacacctgcgccgactccccggcgaccgagccccaggcggtgatcctgcccggcggcgagtgcgcctaccccgacgggcgctccctgaagggccaccgggacctcggggtgcgcagctggggcgaccggcccgacggctccacggtgctgctgatcggcacctatctgatgcagggcgagatcaccggccggctgctggacgccctgccgccgctgctgtcgctcacctcgcgggagtggaagtgcccgctgacgccgatcctcgccgaggagatcgtgcgcgacgagccgggccaggaggtcgttctcgaccggctgctcgacctgctggtgatcgcggcactgcgggcctggttctcccgcccggaggccgaggcacccgcctggtaccgggcgctggccgacccggtcgtgggccgggtgctgcggctggtgcaggacgaccccgcccacccctggacggtggcctcgctcgccgccaaggccggggtctcgcgcgccgcgctcgcccgccgcttcaccgagctcgtcggtgagcccccgatggcctatctgaccggctggcggctcgccctcgccgccgaccggctgcgcgactccgcggacaccatcggcgcgatcgcccaccaggtcggctacggcagcgcgttcgccctgtccaccgccttcaaacgggtgtacggagtcagtccgcaggagcaccggaccgggggtgccccgacggttcctcgcggcaccgtgacg

SEQ ID NO: 2109 - DNA, 831 bp, Streptomyces avermitilis
  CDS (1)..(831)
atgacgcagaacacgcggaacacgacggtgttggtgacgggggcctcgggccggacgggcagccgggtggccgaggccgcgcgggcggcggggctgacggttcgggcggcgtcccgggcgacggggttcgactgggccgaccgggcgagctgggcggccgcgctggcgggcgccgacgcggcgtacctcatgtaccccacggatgtcggctccccggcggcggccggggcggtcggcacgctggcccgggaggcggtggaggccggcgtacggcgtctggtgctgctctcctcgcgcggggaggagcgggcgcggccgaccgaggaggccctgaaggagtcgggtgcggactggacggtcgtacgggccgcgtggttcgcgcagaacttcagcgagggcccgctggtggaggggctgcgccacggggaactggtgttcccggccggtgaggtgcgcgagcccttcatcgacgtgcgggacatcgcggacgtggtggtgaccgcgctgacggccggggaacggtacgtgggacggacgctcgacctcaccgggccccggctgctgacgttccgggaggcggtcgcggagatctcggcggccacgggcggcacgttcgcgtacacgccggtgccggcgcgtcagtacggggagaacctgaaggcgttcggggtgccgcccgaggaggtggacttcctggtggacctcttcgagagcctgctggacggccgcaacgcgcatctgtcgcaggaggtgcggcagatcctgggccgggcaccgcacgacttctccgagttcgcgcgggagaacgcggcggcgggggtgtggaaggcc

SEQ ID NO: 2110 - DNA, 1035 bp, Streptomyces avermitilis
  CDS (1)..(1035)
atggagtaccggatcctcggtctggcggccgaggccgccttcttcacgctgctgtccgtgccgccgctgctgctgagcatgatcgggctgctcggctacgtcgacgactggaccggcgccgacaccatcgccagcctggagaacaacatcctggaggcgtcccgcacggtcctgtccgacaagggcgtcaccgagatcgcccagccgctcctccacgacgtgatgaagggcggccgccccgacgtcatctccctgggcttcctgttcgccctgtggtcgggctcgcgcgcggtgaacgtcttcatcgacaccatcaccgtgatgtacggcctcgacggcacgcgcggcatcgtgaagacccggatgatgtcgttcctgctcttcatcgtggcgctgctgatcggctcggtcgcgctgccgctgatggtggcgggcccggacgcggtggtgaacgtcgtgccgtggtcgacgaccgtcgtacaggtcctgtactggccggtcgtcatcgtcctgtccatcgtcttcctgacgacgctctaccacgtctccgtgccggtgcgctcgccctgggtggaggacgtcccgggcgccctggtcgccctcgcgatgtgggtgctcggcagcttcctgctgcgcatctacctgaccagcacggtcgaggggcccacgatctacggctcgctcgccgcgcccgtcgccgtgctgctgtggatcggtgtgtccgcgttcgcggtgctggtcggcgcggcggtcaacgcagccatcgaccgggtctggccggccgccgccacggccgcggcgcgcgccgcgaacgagcggctgctcgaggagcaggccgcggtgttcgtggcccgcgtggccgcgtaccgggccgccgacatcgatcccgacgacccggacatgccctccgagttcccggagcgctggtcgcgcttcctgcctccggaggacgtgacatcccggttccgcacccatgtgaagagcccgcaccaccacccgcagcacaagaacggcgacccgccggcgggggagcag

SEQ ID NO: 2111 - DNA, 1647 bp, Streptomyces avermitilis
  CDS (1)..(1647)
atggctgccagcacccacaccgtgaccaaccaggctccgcccctggtgggctatgacgtcttcgccgccgaccgggccctcgtggaggccgtcgagcggcatctcgatcccgcgctcctcgacgaggcgcgcaccgagctgtcggggctcgggctcagcgccggctccgcgcaggtacaggagtggggggccctggcgaacgagaacccgcccaagctgcggacgcacgaccgctggggcaaccggatcgacgaggtcgagttccatccgtcctggcaccggctgctcggcaagggcgtgtccgccggactgacggcggcctggtcccggcccggcgggcacgtccggcgcgcggccggtttcgtgatctggacgcaggccgaggcgggcaacggctgtccgctgtcgatgacccacgcggcggtgcccgccctgcgcaccgacccggcgctcgcggccgagtgggagccccggctgacctccatggtctacgaccaggggatgcggcccgccgcccagaaggccggtgccctgttcgggatgggcatgacggagaagcagggcggcagcgacgtacgcgccaacacgacggcggcgcggccgctcgccgaggacgggacgtacgagctgacgggccacaagtggttctgctcggcgccgatgtcggacgggttcctggtgctcgcgcaggccgcctccgccacggacggagggggtctgacctgcttcctcgtgccgcgcgtgctggaggacggcacgcgcaacgtgttccgcgtccagcggctcaaggacaagctcggcaaccggtccaacgcgtcgagcgaggtcgagttcgacgggacctgggcacgccgggtcggcgacgagggccggggcgtgcgcacgatcatcgagatggtggcggcgacccggctggactgtgtcctcgggtcggcgtcgctgatgcggcaggcggtggcgcaggcgatccaccactgcacctaccgggaggcgttcggcggcaagctggtcgacaagccgctgatgcgcaacgtactggcggatctggccctggagtcggaggccgcgacgacgctcgcgctgcgcctggccgccgcctacgacgacggcggcgagcaggagcgggcgttcctgcggctcgcggtgccggtcgccaagtactgggtgaccaagcggtgcacgccggtggcggcggaggcgctggagtgcctgggcggcaacgggtacgtggaggagttcggtctggcccggctgctgcgtgagtcgccgctgaactccatctgggagggcgcgggcaacgtccaggcactggacgtgctgcgggcgctccagcgcgaaccgcaggcgctcaacgcgtacctccaggaggtcggccgggcgcgcggtgccgatcaccggctggacggcgccatcaagggcctgctcacggagctcgccgacctggagggtatcgagggccgggcccgccgggtggtggagcggctcgccctcgtgctccagggggcgctgctggtgcggtacgccccgccggaggtcgccgacgcgttctgcgcctcccggctgggcggcgactggggtacggccttcggcaccctgccgcacagtctggatctggccacggtggtggagcgggcccggccggtggcg

SEQ ID NO: 2112 - DNA, 1323 bp, Streptomyces avermitilis
  CDS (1)..(1323)
gtggcgcactcgccgaaggatgtgacgcggctggtcgcccgggacgccgcgcaggcggcgcgcatgctcagggaggtgcgcagcgcgacgctcgccgggcagcgcacccgggtcgcgccgcgcccggtgatcgaggcgtcgtgggggcgcatgcggcgcagcggggtggatcccgaccacgatgtcagggcggggctgctgagcctcgacgaggtcgagcggcggcgccgggagtcgccgctgcgggtggtgcttccggtgctgcgcgaggggctgttgtcggtcgcggacgtcgcgcagcacatcatggtggtcgcggacgcggacgggcgggtgctgtggcgcgagggcagtccggcggtgctgcgccaggcggacgggctcggctgcgaaccgggcgcggactggggcgagtcggtcgtcggcacgaacggggtgggcacgcccgcggtgaccggccgtcccgtgcaggtgttcgcctccgagcacttcgtacgctccttcgcctcgtggacgtgcacgggcgccccgatcacggacccgcgcgacggccgcctgatcggtgtggtggacatcagcggtccactggagacgatgcatccggccacgctcgcctgggtggactcggtggccaagctcgccgaggcgcggctgcgggaggtgcatctgacgtcactggagcggttgcgcgcggtggcggcgccgctgctggcccggctggacgggcgggcggtggcggtggaccgggacggctggacggcggcggtggccggaatgccgtacgccagacggctggcgctgcccacctcactgacggccgggcggagttgtctgccggtgctgggcccgtgctcggtggagccgctgccgggcggctggctgatccgggcctgtgaccgggcaactcccgcgcacaccacgcggatcgtcctggacctctcccacccgcgccgctggtcggtgacggtctcgggagacacgggttcctggacgcacgaactgacgccccggcacgccgagttgctctacctcctgaccctgcaccgcagtggccgcacggccgcggcgctggccgccgacatgttcggcgacccggcccgcacggtcaccgtccgcgccgagatgtcccgtgtacgacgctatctgggcgctttcctggaccaccggccgtatcgtttctccgaaaccgcggaggtcgaactcctggccccggacgacccgctggacctgctgccccactcgatcgcgccggcggtgctgcgcgtgcgtacggcggggcccggcggcggcgtttccctcctggcgccgggcggcgggccggtc

SEQ ID NO: 2113 - DNA, 1401 bp, Streptomyces avermitilis
  CDS (1)..(1401)
atgaaacagcgtggcagacatcgtcgcaggaggaggggccgtgcgctgcgcgccaccctcgccggaaccgcgctggcgctgaccgccgccgccacgctgatcagcacctcccaggccgccggcggcgacaacccgggagccctgaccccgctcacctccgccgccgagaccggcaagctgcaactccacgagaacctggtcggccggaccaccctggacacgctcaccagcgacatgggcggcaacgtcggcgtgcacggcgtgctccagagcgccaaccactcgatgcgcaacaaggccgactgtgccgccaccgaggcggccgcgctgcccgtcgagccgagcgcctcgcgcgcgtactgctgggacagcggcgacgcgacgacccagaagtggctgccccagtccgtcaccacgtccggcgacgccgacaacgacggcacgtggggcgacgaccgcgtcatcctcgcgggctggacgcacaacgaccacaaggcgggcgagccggccgacgaccagggcctcgcccgggtcgccttcatcgacgcgaacgacccggacaacctcaagtaccgctgggtcctgctggtcgccccgctgagcggcgacgcggacttcggtgccgtccgctcgcatctcggcggcatggtctggtaccaggacaagctgatcgtcaccgcgaaaaacggcgcggaccacaacaacgccctcttcgtcttcgacatgcaccgcatcctgcgggcgaacgtcgacagcagcgcggtcggcaaggtaagcggcggctacgcggcccacggctaccagtacgtactgccggccatcggctcgtacgacctgaccggcggcgcctgcacctcgggcaacgacaacgcggtcccctgcttcgcctccgtctccctcgaccgcacctccaccccggacagcctggtggcgaacgagtggttcagctcgggcggcacccagcccgcccgggtctggcgctactactacagcaccgccgcctcccgcaccggtctgctcggcagcaactccagcgacgtcgtcaacgcggacgaggcgtacgagaccaaggccgtcggtctccagggcgtgctgtcgcacaagccgagcggcgcgagcacgccgaactggtacgtcgaccacgcgcccggcagccgcggcaagcacggcaccctctggcggcagaacaaggacggcgcccgggcggcgcggtgcacgaccgaccagacgaccgcctgctggggccggcacaccgagtccatgtcgctctggcaggagaccggcgagctgtggacgctgaccgagtgggcggcgaacaaggacgcccagtgggagccggacgccatcccggagcgggtgctgtacgccgttccgctgtcctccgtggacgactcgctaggg

SEQ ID NO: 2114 - DNA, 570 bp, Streptomyces avermitilis
  CDS (1)..(570)
atgagcgacatcaccgtgaccacctggtccctggagcagacgtcccccgccgacctgcggcccgcgaccgcccccgacggcgaggtccggatcgtccgctccgaggtgccctcgccggagttcagccggttcctgtacgcgtcggtcggcggcgacatccgctggaccgaccggctgtcctggacgtacgagcagtggcaggcgtacctggcgcggccgggcgtggagacctgggtcgcccacgaccggggcactcccgcgggatacgtcgagctggagccgcaggacgacggggtcgtggagatcgcctacttcgggctgataccggcgttccggggccggcggatcggcggccatctgctctcgtacggcgccgcgcgggcctgggacctggccgcgcgatggccggaacgcgccgagaccaagcgggtctggctgcatacatgcagcaaggacggagagcacgcgatggacaactacctgcggcgcggtttcacgctcttcgacaccaaggtcgaggcggaggcggacgtggccgcaccagggccctggccgggagcgcgcgccgcc

SEQ ID NO: 2115 - DNA, 1692 bp, Streptomyces avermitilis
  CDS (1)..(1692)
atggccgccaccccgcagaatcccgccgccgcgccccgccgcaaggtgagccgtcaccgcggtgagggtcagtgggccgtgggtcacttcaccccgctcaacggcaacgaacagttcaaaaaggacgatgacggtctcaatgtgcggacacgcattgagacgatctactcgaagcgcggcttcgactcgatcgaccccaatgacctccgtgggcgtatgcgctggtgggggctgtacacccagcgcaagcccgggatcgacggcggcaagaccgcgatcctggagccggaggagctggacgacaagtacttcatgctgcgcgtccgcatcgacggcggccggctgaccaccgagcagctccgggtcatcggcgagatctcgcaggagttcgcgcgcggtaccgccgacatcaccgaccggcagaacatccagctccactggatccgcatcgaggacgttccggagatctggcagcgtctggaggccgtgggcctgtccacgaccgaggcctgcggtgacaccccgcgcgtcatcctcggctcgcccgtcgccgggatcgccgaggacgagatcatcgacggcacgcccgcgatcgacgagatccaccgccggatcctcggcaacaaggacttctccaacctgccccgcaagttcaagacagcggtctccggctcgccgctgctcgacgtggcgcacgagatcaacgacgtcgccttcgtcggcgtgaaccacccggagcacggccccggcttcgacctctgggtcggcggcggcctgtccaccaacccgaagctcggccagcgcctcggcgcctgggtcccgctcgacgaggtcgcggacgtccacgtgggcgtcctgtcgatcttccgcgactacggctaccggcgccttcgtacgcgtgcccgtctgaagttcctggtcgccgactggggcgtcgagaagttccgccagatccttgaggacgagtacctgaagcggaagctcgtcgacggccccgcgcccgaccagcccgtcgccagctggcgcgaccacgtcggcgtgcaccggcagaaggacggccgcttctacgtcggcttcgccccgcgcgtcggccgcgtggacggtacgaccctcaccaagatcgccgaggtggccgcggcgcacggctccgggcgactgcgcaccaccgtcgagcagaagatgatcgtgctcgatgtggaagagggccaggtcgagtcactcgtcgaggggctggaggcgctcgacctcaccgtcaagccctcgtccttccggcgcggcacgatggcctgcaccggcatcgagtactgcaagctcgcgatcgtcgagaccaaggcgcgcggcgcttccctcatcgacgaactcgagcgccgcatccccgagttcgacgagccgatcaccatcaacctcaacggctgcccgaacgcctgcgcccgtatccaggtcgcggacatcggtctcaagggccagctggtcctcaacgaccagggtgagcaggtcgagggcttccaggtgcacctgggcggcgcgctcggcctggaggccggtttcggccgcaaggtccgtggcctgaaggtcacttcggacgagctgcccgactacatcgagcgcgtcctcaagcgcttccaggcggagcgcgaggacggcgagcggttcgccacctgggcggccagggcttcagaggaggcgctgtcg

SEQ ID NO: 2116 - DNA, 177 bp, Streptomyces avermitilis
  CDS (1)..(177)
gtgagcgagcgtgccgcgcccttctactgcccctactgcggcgacgaggacctgcgcccgagcgagcagggccacggcgcgtgggaatgcggagcgtgcaatcgagccttccagttgaagttcctcgggctgctcgcccgggggtttcagcccaacgacggtggaggggacgagata

SEQ ID NO: 2117 - DNA, 735 bp, Streptomyces avermitilis
  CDS (1)..(735)
atgaggacggttcaggccgacacggacaccggcacagagcgtgcgaccggccgcgacgcggagctgaagacgctcgccgagcaggccgggcgcgacctggaggacgcctccgccctggagatcctccagtgggcggcggacaccttcggcaagaagttctgcgtgacctcctccatggaggacgccgtggtcgcccacctcgcctcccggaccttccccggtgtggacgtggtcttcctcgacaccggctaccacttcccggagaccatcggcacccgcgacgcggtcgaggccgtgatggacgtcaacgtcatcacgctcaccccgcgccggacggtcgccgagcaggacgcggagtacggcccgaagctgcacgaccgcgaccccgacctgtgctgcaagctccgcaaggtccagccgctggagcagggcctgaccgcgtacgacgcctgggcgacgggcctgcgccgcgacgagtccccgacccgggcgaacaccccggtcgtcagctgggacgagaagcgccgcaaggtgaagatctcgccgatcgcccgctggacccaggacgacgtggacgcgtacgtcgcggagcacggcgtgctgaccaacccgctgctgatggacggctacccctccgtgggctgcgcgccctgcacccgccgtgtgctggagggcgaggacgcgcgcgccggccgctgggcgggcagcaccaagaccgagtgcgggctgcacgga

SEQ ID NO: 2118 - DNA, 534 bp, Streptomyces avermitilis
  CDS (1)..(534)
gtgacgaccggagccaccatctggctcacaggtctgccgagtgccggcaagaccaccatcgcgtacgagctggccggccggctgcgcgaggagggccacctcgtcgaggtgctcgacggtgacgagatccgcgagttcctcaccgcagacctcggcttcacccgcgcggaccggcacacgaacgtgcagcggatcggctacctcgccgacctgctggcccgcaacggcgtcaaggcgctcgtcccggtgatcgcgccgtacgcggacagccgcgaggcggtccgcaagcggcacggggcgagcggcgccgcctacctcgaggtgcatgtcgccactccggtcgaggtgtgcagccagcgggacgtgaaggggctgtacgccaagcaggcggcgggcgagatttccgggctgaccggtgtcgacgacccgtacgaggcacccgcttcgcccgatctgcgcatcgagtcgcacacccagaccgtgcaggagtccgccgccgcgttgcacgcgctgctgaccgagaggggtctcgca

SEQ ID NO: 2119 - DNA, 933 bp, Streptomyces avermitilis
  CDS (1)..(933)
atgacgaccgcagccaccgcttcccaggagaccgacagcccgtacgcgctctcgcatctggacgcgctggagtcggaggccgtccacatcttccgcgaggtggcgggcgagttcgaacggccggtgatcctgttctccggcggcaaggactccatcgtcatgctgcacctggcactgaaggccttcgcccccgcggcgatccccttcaccctgctgcacgtggacaccggacacaacttccccgaagtcctcgcataccgcgaccgtgtggtcgccgcacacggactgcgcctccatgtggcctccgtacaggactacatcgaccgcggtgtactgcgcgaacgccccgacggcacccgcaaccccctgcagaccgtgcccctgaccgaagccatccagcagcaccgcttcgacgccgtcttcggcggcggccgacgcgacgaggaaaaggcccgcgccaaagaacgcgtcttctccctgcgcgacgagttctcccagtgggacccccgccgccagcgccccgaactgtggaacctctacaacggccgccacgcccccggcgaacacgtccgcgtcttcccgctctccaactggaccgagctggacgtatggcagtacatcgcccgcgaacacatcgaactccccgagatctacttcgcccacgaacgcgaggtcttccagcggtcccacatgtggctgaccgccggtgactggggcggccccaaggacggcgagactgtcgagaagcgccgggtccgctaccgcaccgtcggcgacatgtcctgcaccggcgccgtcgactccgacgccaccacgctggacgccgtgatcaccgagatcgccgcctcccggctcaccgaacgcggcgccacccgcgccgacgacaagatgtccgaggccgcgatggaagaccgcaagcgcgaggggtacttc

SEQ ID NO: 2120 - DNA, 1461 bp, Streptomyces avermitilis
  CDS (1)..(1461)
atgaccagcaccaccgagcccaccgagccgctgtcggtcgagcagttgtcggccacgaccctgctgcgcttcgcgaccgcgggctccgtcgacgacggcaagtccacgctggtcggccgtctgctgcacgactccaagtcggtcctgacggaccagctggaggccgtggagcaggtgtcgcgcagccgcggccaggacgctcccgacctggccctcctcaccgacggcctgcgcgccgaacgcgagcagggcatcaccatcgacgtggcgtaccgctacttcgcgaccgcgcgccgccggttcatcctcgccgacacccccggccatgttcagtacacccgcaacatggtcaccggcgcctccaccgccgacctggcggtggtcctcgtcgacgcccgcaacggcgtcatcgagcagacccgccgacacgccgccgtcgccgcgctgctgcgcgtcccgcacgtcgtgctcgcggtgaacaagatggacctcgtcgagtacaaggagtccgtcttcgccgcgatcgccgagaagttcacggcgtacgcctccgagctgggcgttcccgagatcaccgcgatcccgatctccgcgctcgccggtgacaacgtggtggacgcctccgcgaacatggactggtacggcggccccacggtcctggagcacctggagaccgtgccggtcagccacgacctggcgcactgccacgcccgcctgcccgtgcagtacgtgatccgcccgcagaccgccgagcaccccgactaccgcggttacgcgggtcagatcgcggccggtacgttctgcgtcggctccgaggtcacggtcctgccctccggccgtacgtcgaagatcgccgggatcgatctgctgggcaccccggtcgacgtcgcgtggaccccgcagtcggtgaccctcctgctggaggacgacatcgacatctcgcgcggcgatctgctcgtgccgagcaaggacgcgcccgccaccacccaggacgtcgaggcgacggtctgccatgtcgccgacgctccgctgaccgtcggccaccgcgtactgctgaagcacggcacccgcacggtcaaggcgatcgtcaaggacattccgtcccggctgaccctggacgacctctccctggcacccgcacccggggcagctggtcgccaacgacatcggccgcgtcaagatccgtaccgccgagccgctgccgctcgactcgtacgccgactcccgccgcaccggcgcgttcatcctgatcgacccggcggacggcacgacgctgaccgcgggcatggtcggcgagtccttcgccgcgcccgagccggtcaaggacgcgagcgacgacgacgggtgggacttctgatcatgaccaccaccgacttctactccacgttcgcgaaggagggcggccgcgtcggcagcggcgccctcggcagcgggcagggcggagtcgcgcgatgtgcgcga

SEQ ID NO: 2121 - DNA, 204 bp, Streptomyces avermitilis
  CDS (1)..(204)
ctggtcgccaacgacatcggccgcgtcaagatccgtaccgccgagccgctgccgctcgactcgtacgccgactcccgccgcaccggcgcgttcatcctgatcgacccggcggacggcacgacgctgaccgcgggcatggtcggcgagtccttcgccgcgcccgagccggtcaaggacgcgagcgacgacgacgggtgggacttc

SEQ ID NO: 2122 - DNA, 1146 bp, Streptomyces avermitilis
  CDS (1)..(1146)
gtgaccgccgggccaacgaggggaacacctcccgtgcctgccaaccgttccacgctgatccgccgcgctgtggccgcggccgccgccctcccgctgctggcgctcgccgcctgcggttacggttccgagtcgaaggacgacacctccgcgaaggagaaggtcgccgccggggccaagaagatcgacggtctcgacaccgtgaagatcggctacttcggcaacctcacccacgccaccgcgctcgtgggccgccaggagggcctcttccagaaggaactcggcgccacgaaggccgagtacgccaccttcaacgccggcccctccgagatcgaggccctcaactcgggctccatcgacatcggctggatcggcccctcgccgtcgatcaacggctacaccaagtccaacggcaagagcctgcgcatcatcggcggttcggcgtccggcggcgtcaagctcgtggtcaaccccaagaagatcaagtccctgaaggacgtcaagggcaagaagatcgcgaccccgcagctgggcaacacgcaggacgtcgcgttcctcaactggatcgccgagcagggctggaaggtcgacgcgcagagcggcaagggcgatgtcacggtcgtccgcagcgacaacaaggtcaccccggacgcctacaaggccggttcgctcgacggcgcctgggtgccggagccgaccgcgtcgaagctggtcgccgagggcggcaaggtgctgctcgacgagtcgacgctgtggcccgacaagaagttcgtgatcacgaacatcatcgtgtcgcagaagttcctcaaggcgcacccgaaggtcgtcgaggccgtgctgaagggctcggtcgggaccaacaagtggatcaacgccaaccccgacgaggcgaaggccgcggcgaacaagcagctggagaccgactcgggcaaggccctgccggccgatgtcctggacccggcctggaagtccatccagatcaccaatgacccgctggcctccaccctcaacaccgaggcggaccacgcggtgaaggccggtctgctgtcgaagcccgacctgagcggcatctacgacctcacgctgctgaacaaggtcctcaaggccgacggcgcgagcacggtcgacgacgccggtctcggcgtcaag

SEQ ID NO: 2123 - DNA, 810 bp, Streptomyces avermitilis
  CDS (1)..(810)
atgagttcccaggaggtgacgaccatggccacgaccattgccaaggccaccgacagcgtcggcgtggtggagcacgccgctcggatcgagcacgtctccaagtccttcgccgggccagccgggcggcagctcgtcctcgacgacatcaccctcgatgtcgcgccgggcgagttcgtcaccctcctgggggcctcggggtgcgggaagtcgacactgctcaacctggtggcgggcctcgacgccccgaccacgggcagcatcacgaccaaggggcgaccggccctgatgttccaggagcacgccctcttcccgtggctgaccgcgggcaagaacatcgaactcgccctgcggctgcggggagttccgaaggccgagcggcgcgacaaggcggaggaactgctcgaactcgtacggctgaagggcgcgtacggcaagcgggtgcacgaactgtccggcggtatgcgacagcgcgtcgcgctggcccgtgcgctcgcccaggacagcgggctgctgctgatggacgagccgttcgcggcgctcgacgcgatcacgcgggacgtcctgcacgacgagctgacccgcatctggcgggagacgcagttgtccgtcctcttcgtcacgcacaacgtgcgtgaggcggtgcggctcgccgagcgggtcgtgctgctctcctcccgccccgggcgggtggcgcacgagtggacggtggacattccgcagccgcgccgcatcgaggacaccgccgtggcggagctgtccgtggagatcaccgaacaactgcgtggggagatccgccgtcatggccagcac

SEQ ID NO: 2124 - DNA, 909 bp, Streptomyces avermitilis
  CDS (1)..(909)
atggccagcactgagacaacgtcggcggacgctcccgccaaggacaacacccaccacgacctggccggtctggaggcgggcctcgacgcactggagacggtgcaggtcgggcgtacgccgttccggcaggtcttcgtgcagaagatcctgccgccggtcatcgcgatcgcgctcgtgctggtggtgtggcaggcgctgatctcgttcaagatcgtcactgacccctccaagctgccgccgctgtccgcggtgtggaacgagatcgagaacgcctggctggagggcaagctcctcggctacatctggaccagcgtctcccgcggcctgctcggcttccttttcgcgctggtcatcggcaccccgctgggcctgctggtggcgcgcgtgaggtttgtgcgcgcggccatcggcccgatccttcagggtctccagtcgctgccgtcggtggcctgggtgccgccggccgtggtctggttcggcctgaacaactcgatgatgtacacggtgatcctgctcggcgccgtcccgtcgatcgccaacggcctggtgtcgggcgtcgaccaggtgccgccgctgttcctgcgggcgggccgcacgatgggtgcgacgggcctgcggggcacctggcacgtcgtgctgccggccgcgctgccgggctatgtggcgggcctgaagcagggctgggcgttctcgtggcgttcgctgatggccgcggagatcatcgcgtccttccccgacctgggcgtgggcctcggccagctgctggagaacggtcgcaacgccatcgacatggccatggtgttcgaggccatcctgctcatcctggtcgtcggtatcgccatcgacctgctgatcttcagcccgctggagcggtgggtactgcgcagccgcggtctcctggtgaagagc

SEQ ID NO: 2125 - DNA, 735 bp, Streptomyces avermitilis
  CDS (1)..(735)
atgcaccgaccggtactcctcgtcatcgcccacggcagccgcgacccgcggcacgccgcgaccgtgcacgccctggtgcgccgggtacgcgccatgcgtcccgggctgcgcgtggagaccggcttcctggacttcaacgtcccgtccgtgaacggggtgttggagtctctggcggcggagggcgtccgcgaggtggtggccctgccgctgttgctcacccgcgccttccacgcgaaggcggacatcccggcggtcctgcgggaggccccgtcacggctgcgcatccggcaggcggaggtacttggcccgtcccccttcctgacggccgcgctggaacggcggctgtacgaggcggggctgacccccgccgacagaccctcgaccggggtcgtactggcctcggcgggatccaccgacccggaggcgatcgcagtgatcggggacatcgcgcgggagtggcggcgcaccggctggtgcgccgtgcgacctgcgttcgcctccgcgtccctgccccgcaccgaggacgcggtgcgggagctgcgggcactgggctgcgagcggatcgcggtcgccccgtacgtcctggcccccggcttcctgccggaccgcatcgcacggggcgcggcggaggcggacgtcctgtcggatgtactgggtccggcgccggaggtggcccacgtgctgctgaaccggtacgacgaggcgcgggtaccggcgctggccgccctgggcgcc

SEQ ID NO: 2126 - DNA, 594 bp, Streptomyces avermitilis
  CDS (1)..(594)
atgaagaacgacgacatgcacccgtacatgatcgaatgtgccgccgaggcggcccgtgtcgcgcgcggtgtcacggcggcacagctgagcgatcccacccactgccccgactgggacgtccgtgccctggtcaaccactgggtcctctacacctcgcacggcctggagcaccgcgccctgcgcaagcagctccccgaggagctgaccgcgcgcgacttcaccgccgaaccggactgggccgaggcgtacgccgcccagctggaccgggcggtcgccgcctgggcggacccggcggtgtgggagggcgaggtcgacctcggcatggcgaaggtgtccgccaccgacatcgcctcgatggtcatcaaggagctggcggtccacggctgggacgtcgcgacggccaccggccaggagtaccgcgtctcggacggcgcggcccggttcgtcctcgccgtggtcgagacacacggcgacctctaccgccagtacgacggattcgccgacccggtgccggtgccggacgacgcgcccgtcttcgaccgcgccctggcgtcgagcggccgggaccctcgtacgggaaggctgtccctcggc

SEQ ID NO: 2127 - DNA, 273 bp, Streptomyces avermitilis
  CDS (1)..(273)
atgtgcgaggcgagcctgcggctgctgcggctcgacacgatcgacctgtaccagttgcaccggctcgaccccggggtaccgatggccgaccagctgggcacgctcgacgcgttgcgcaccgagggcgagatccggcacctcgggctcgacacggtcaccgccgaacagctcgaagcggcactggagttgacggacatcgcctccgtgcagaaccgctacaacctgctcgaccgtgcgtcggaaccgctgctgtcccggctggacagcctgggg

SEQ ID NO: 2128 - DNA, 543 bp, Streptomyces avermitilis
  CDS (1)..(543)
atgacgacgtatgcggccttgctccgcgggatcaatgtgggcggcaacaagaaggtgccgatggccgagctccggacgctcctccaggggctcgggtacgggggcgtggccacctatctgcaaagcggcaacgccgtcttcaccagcgaccacggcgacgagcagtccctggcggcggaggtcgggcaggccatcgagaagcgcttcggcttcaccgtcgacgtcctcgtccgcgaccacgcctatctcaaggccgtacgcgaggcctgccccttcccggccgccgaactggaggccaagcagctccacgtcacctatttctccgggccggtcgacgcggagcgcttcgcctcgctcgaccagccggccttcctgccggaggagttccgcctgggcgaccgcgcgctctatctgtacgcccctgacggcctcggccgctccaagctgggggagaccctggccaggccccgcctcctcaaggggatcgtcgccaccagccgcaactggaacacggtcgtcaaactggaggagctgaccggcgcc

SEQ ID NO: 2129 - DNA, 2271 bp, Streptomyces avermitilis
  CDS (1)..(2271)
atggcgaacggagaaacaacgcgggtccggggcatagcagcccgggccggcggctggagcgcccggcaccgctgggcagccgtcggcatctgggtgctgttcgtcgtcctggcgatgggactcggttcggcggcgggccaggtcaaggtcaaggagagcgaccagctggggggcgagacccacacggccgccaagatcatcgaggatgccgggatcgaggagccggccagtgagaccgtcctgatccaggtcaggaacgggtcgtccaaggccaccgacgccgggttccgcgacgcggtcgacgcggtgatgcgggcggtcgaagacaccggcaaggcgacggacgtgacgtcgccgtacgacacccggaccatctcgaaggacggccggagcgcgctcgtgcagttcgacatgcgcggcgagtcggacaccgcgggcgagcgggtcgagccggtgctgaaggccgtcgagggtgtccagaaggaccacacggagctgcggatcgaggagatcggcggcgccagcatgatgaagcagtacaacgacgcgttcggcgacgacttccagaaggccgagtactccgcggtgccggtggccctcggtattctgctgatcgccttcggcgcgctggtcgcggcgctactgccggtggccctcgcgatcaccgcgatcatggcgacgatgggtctgatgggcatcgtcagccatctgcagccgatggacgacaccgccagctccgtgatgctcctggtcggtctggcggtcggcgtcgactactgcctgttctacctgcgccgtgagcgcgaggagcgggcggcgggccggagcgcggacgccgccctgcgcatcgccgccgcgaccagtgggcgcgccatcatcgtctccggaatcacggtgtgtgtggcgatggcgggcatgctgttcaccggcctcgccacgttcgaggcgatgggcctcgcctcgctgatggtcgtggcggtcgcgatggtcggatcggtgaccgtgctgccggcgctgctctcgctgctcggtgagcgggtggagaaggggcggattccgttcctgcacccggacaaacggcgtaagaacggcaacgccgccaagggcaacggggaaagccggttctggggagccgtgctccgggtcgtgctcgccaagcccggtgtcgcgctcgtcgtcgcggccggcgcgctgctggcgatcgcggcgcccgcactcggcatgaagacccagaacctcacgctggaccaggagttcggcgattcactgccgatcgtggggacgtacaaccgcgtcaacgacgccttccccggcggctccgagccggccgaggtggtcgtcagggccaaggacatcaacgccgccgacgtgaagtccgcgctggccgacttccgtacccaggccgtgagttcgggtgcctcgcgcgggccggtcgagatcaaggtgcacgacgcgcagaacatcgccttcgtctatgtaccgctggtcggcggctccgaccaggacaaggccggccagagcctggacctgctgcgcgacaaggtgcggcccgacacgctcggcaaggtcgacggcgtccaggcgccgatcaccggacaggtcgcggggaacaaggacttcaacgatcagctgatcggctcggtggccccggtcttcgccttcgtcgtggtcttcgccttcctgctgatgctggtgtcgttccgctcgctgacgatcgcgatcacctcgatcgtgctcaacctcctttcggtgggcgcggcctacggcatcctggtcggcgtcttccagcacggctggggcgcctcgctggtcggcgcggagggcgtgggcgccatcgtcacctggctgccgctgttcctcttcgtgatcctcttcgggctctcgatggactaccacgtcttcgtggtctcgcggatccgtgaggcgcggctgcgcggccggagcaccaaggacgccatccagcacggtgtggtgaccacggccggagtcgtcaccagcgccgccgtcatcatggtcgccgtcttcgcgatcttcgggacgctgtccatgcagtccatgaagcagatgggcgtgggcctggccgccgcggtcctgatcgacgcgacgatcatccgcggcgttctcctccccgccgtgatggccctgctcggcgagcgcaactggtacctcccgaggtggctgaaccggctgccggacctcacccacgacgagtcacccgagccggtgtcgccgcctcagccgcccgccgtggagggcgagcgggtgggagtc

SEQ ID NO: 2130 - DNA, 969 bp, Streptomyces avermitilis
  CDS (1)..(969)
atgccctccctacgccgagacctcccgccccttcccgaggtgcgccgcatcacgcagaagaagcgcgacgcctggtggaccgtgctgctcgtcgacccggtcgccaccccgctcgtgcggcaggtcgcgctgcggacgaggatcacgccgaaccagctcacctggggtgcgttcctgctcggtctcgcctcggcggtgtgcttcgcgctcggcgactggcgctggctggtcgccggtgccgtcgtctaccacctgagcttcatcctcgactgcatggacggcaaggtcgcccggctgaccggccagggctcggtgttcggggcctggctggacttcgtcttcgaccgcatccgggtggcggtgtgcgcggtggcgttgatggccgggcagtacgagcgctccggagacacgacgtacatctggctggccgccgccgtgatcggcctggacaccctgcgctacatcaactcgctggaaatcttcaagatccgccattcgatgcgcaagcagatcaagtcccgcctgagggaggcgcgccggtccgagaaccaggccgagctggccttcatggaagacctgctgcgcaacaatcccgaggcggacatcgagcaggaccagcgcagcgccgcggccgggcaggaggctcccgaaggcggcacggcggcccgcccccaggcccaggtcatcgacctgcacgaggagttccggcaccgcttcccggcctatctgagggcacgttccttcctgctgcgccaccgcattcgcacccacctggtgagcggcatcgaattccagatgggcgtcttcatcatcggcccgttcctcgactcggtgatcggggcgacgatcgtgtccggtgccctgctcctcgtcttcgagctcgccatcatctacaagctgctgctgtccacccgcgacttcacccgcacgatcgactccttcgagcgcgacgacgtggcccgggcggcc

SEQ ID NO: 2131 - DNA, 1278 bp, Streptomyces avermitilis
  CDS (1)..(1278)
atgcgcaggaggtggatcaccgcgctcgtcgcgctggggctgctgctcgcgggatgttcttcggaccacgacggctccggcggccgtatcaccctccgcttccagtccctcgcctggcaggaggagtccgtcgctgccaacaaggagctggtcgaggagtggaacgcgacgcatccggccgtccaggtcgcatacgtgcagggaagctgggacagcgtccacgaccagctgctgacctccttcgagggcggtgaggcgcccgacgtcatccacgacgcgtccgacgacctcgccgacttcgcctacggcggctcgctcgccgatctgcgcgaactgctgcccgcccggctcatgtcggacatcccgcagcggagttggcggacggcgaccttcggggacgggatctacggggtgccgttcctccaggagccaagggtgctgatcgccaacgccacctggctgaaggagtcgggggtgcgcattccgacccccgagcggccgtggacgtgggacgagttccgccggatcgccggtcagctgagcggcaagggcaagtacggcgtcgcctggccgctcaaggaacccgtctcggccacgctcaacctgtccctctcgaccggcggacagatgttccaccggggtgccgacggcaaggtgacggtgcggttcgacgcggccgacgccctcgtgccgcgcaccgtgcacgacgaggtgaacaccgacgggagcgcgtcgggcagcacgctcggtatgggcggttccgacacgctgcccgggttcttcggtgggaagtacgcgatggtcccgctcggcttctcgtaccggcagcagatcgcgcaacaggcgccgaagggtttcgagtggcaggtgctgcccgcgccggccggtgccgacgggctcgcccagggcgtcagcccgcagacgctgtccgtcgccgcggacagcccgcacaagaaggaggccgccgagttcatcgacttcctgctccggccgaagaacatggtccggctcgcgctcggcgactggatgctgcccacgggcaccgaggccctcaaggaccccgccctgcacaccgccatggacgactgggcgaccggcaccgcactcgccgcccacctccgttcggctcccgcccagtccgtacgcggctacccggagtggaaggacaaggtcgcgacccccgcgttccaggagtactacagcggggcgatcggcctggccgagctgagaaagcggctggtcgaggacggaaatctggtgctggctcgctatcagcgc

SEQ ID NO: 2132 - DNA, 831 bp, Streptomyces avermitilis
  CDS (1)..(831)
gtgaagacccccaagagggcccgcgccggccagtacgtcgcactgctcgcctatctcgtcttcctcgccttccccttcctctggctgatctccacggccttcaaaccgccgcgcgagctggccagtctgcaccccacctggatcccgaggaacccgacgctcgccaacttccggcaggccttcgacgagcagcccctgctgcacgccgcgctcaactccctgctcgcggccctcggagcggcgctgatcgccgtgctgatcgcgactccgatggcctacgtcatggcccggcgccgcaccctcctcgcccgggccgccacgggctgggtggtggtcagccaggcgttcccgttcgttctggtgatcatcccgctgttcctggtcctcaagcacctgcggctgatcaactccgtgcccggtctgatcatggtgtacgtggtgtgggcgctgccgttcgcgctgtggatgctggtcgggtacgtacgggccgtgccggtggagctggaggaggcggcggcagtggacggcgccgggcgggcgcgcacgctggtgtcggtgaccgcaccgctgctggcgccgggcatcgtggcgacggcactgttcgcgttcatcaccgcgtggaacgagttcttcttcgcgctggtgctgctcaagaccccgcagaaacagacgctgccggtcgtcctcacacacttcatcggcgcggagggcgtcgcggacctcggcccgctggccgcggcggcgttcctcgccaccctgccctcgctggtcgtcttcgcggtcatccagcggcggatcacgggcggcatgctcaccggggcggtgaagagc

SEQ ID NO: 2133 - DNA, 936 bp, Streptomyces avermitilis
  CDS (1)..(936)
gtgacattggcgaccgtgacgaagcggtcagtgaagagcccgccgcggcccgccgggcggggccggacgcccaccggccagggcgcctggttcctggtgctgcccgcgttgctcccgatcctcgtgctcagcgtcggacccctgctgtacgggatcgcgctggcgttcaccgactcccagtcggggcggaccgcgcccacgcagtggatcgggaccctcaacttccaggacctggtgcaggacacgctgttctgggactcgttccggatcgggctgctgtgggcggtcggggtgaccgtgccgcagttcctgctcgcgctcgggctcgccctgctgctcaaccaggacctgaagctgcgctgggcggcacgggcgctcgcgatcattccctgggcgatgcccgaggtggtcgtcggcatcatgtggcggctcgtctacaacccggacgcgggcatcctcaacgagacgatccgcgatctgggcctcggtgacggccgcgactggctgtccggtctgtccaccgccctgcccgccgtgatcgtcgtcggcgtgtgggcgggcatgccgcagacgaccgtcgccctgctcgccgggctgcagaacaccccgcgtgaactccacgaggcggcctcgatggacggcgcgggcgcctggcgccgcttcctgagcgtcacctggccggccctcagaccggtcgcgctggcgatcaccgcgctcaacctcatctggaacttcaactcgttcgccctggtctatgtgctgaccaacggaggccccggcggccgcacccgcctgcccatgctcttcgcctacgaagaggccttccgctacggccagttcggttacgcggcggcgatgggctgtgtgctggtcgcggtgatctcggtgctcctcgccgtgttcctggtgggccgtctgaagggaggcgaagacgcg

SEQ ID NO: 2134 - DNA, 861 bp, Streptomyces avermitilis
  CDS (1)..(861)
atggacgaggcacaggcgcgggacgtactggccacggcgagcgtgctgcccgggccggcccgggacgcgcggcttctcgccctgggcgagaacgcggtgttcgccgccggtgacctggtggtcaaggtggggcgcgacgccgagctcctcgaccgcgcacggcgggagctggagatcgcgcactggctcgccgacaccggcgtccccgcggtgcgggccgccgagcccgaggcgcggttggtggacggccatccggtgacggtgtggcatcggctgccggatccggtacgccccgcggagccccgggacctggccgaactgctgcgggtggtgcatgccctgccctccccctccttcgacctgccgccccgcgaactgctgggcggcgtggagcgctggctgcgtctggcgggcgacgcgatcgatccggcggacgcggcctatctgcgcgagcgccgcgacgggttcgccgcggccgcggccgcgctcactccgcagctgccgcccggcccgatccacggcgacgcactgccccgcaatgtgcacgtcggcccgggcggtccggtcctggtcgacctggagaccttctccgccgatctgcgcgagcacgacctggtggtcatggccctgtcccgtgaccgctacgggctgcccgccgaggcgtacgacgcgttcaccacgacatacgggtgggatgtgcgggagtggacgggcgctgccgtgctccggggcgcccgggagaccgccagctgcgcctgggtcgcccagcacgcgccgagcaatcccaaggcactgaccgagttcgagcggcgtgtggcgtcactgcgggacggggacgagacggtgcgctggtaccccttc

SEQ ID NO: 2135 - DNA, 720 bp, Streptomyces avermitilis
  CDS (1)..(720)
atggcctggcacgagcagctgctgatcggcttcgacctggagacgaccggaacggatccgcgcgaggcgcgcatcgtcaccggcgcggtcatagaggtcaagggtcaagagccggtcggacgccgcgagtggctggccgacccgggcgtggagatcccggcggacgcggtggccgtgcacgggatcaccaatgagcgggccgcggccgagggcggtccccccgaccgggtcgccgagtccctggcgcagaccctcgtggggtactggcgaaccggagtgccggtcgtggcgtacaacgcgaccttcgacctcaccctcctgtccgccgaactgcgccggtacggactgccgtcgctgcgcgagcggctcgacggccgcgacccggcaccggtgatcgacccgtacacgatcgaccgctgggtggaccgctaccgccgcggcaagcggaacctcgaggcggtctgcacggagtacggcgtccccctggacgccgcgcacgacgcgaccgcggacgccctggccgcggcccggctcgccgccgcgatagcccaccgccacccgaagatcgccgcgctcggcccggcggagctgcaccgccgccagatcgagtggtacgcggcctgggcggcggacttccagagcttcctgcgccgcaagggcgacacggcggcggtcgtggacggcacatggccgctgcgggagccggcggacgaaacggtc

SEQ ID NO: 2136 - DNA, 1290 bp, Streptomyces avermitilis
  CDS (1)..(1290)
ttggctgggatcagccacaggggagagctcgggggagcggaaggcggtgcgtgggtgggctcgggagggctggagttgccccctggtgacgagggtcacgaggggaactccacagatgtcccacccggcgcggtgtccctggcacggccgatggaaatgggatccatcggaccggaactggactggggcacggacgcctggcgcgaggtgcgtacgcgcgcccagcgggccggccgtgcctatatctggctgaacctcgtcgaacagcggctgcgcgcggtcgtggccgctgttctgcgccccatctacgaacccgtccacggcgacgagtgggtggtcgccgcggccggaccggccggccaggagtgggtccagcgggcggtcgcggtacgcgaagtgagccgccgcaagggctacttgctggaccccgccgacgacaacgtgctgagtttcctcaccctgccgcagctgcgcgagctgatggtgcagcactggccgtgcttcgagccgtacatcgacgagcgccgcgacgttgaactcgccctggacgagctggaggtgacgcgtaacgtcgtctcccgcaacagggccctgtccgaagcggtgctcggccaggccgagcgcgcctcggcgaagctcctggagatcctcggcgcgggcagcgacgtgccgtccgcacgccggctgcccgtcgacgcggtcgaggacatggtcggcgaccggtacggggacgtggtcggcgtccacccggaccgggtacggctgctgcggcagttcccgggcgaggacatcttcggcggcgcccgccgcctcgacgccatcggcatcggcctgaacctgctcgtgcagaacttctccgggcgccggctggtacggctcgccgagtcgggctgccgggtgcgtctgctgttcctgaatcccgcgtccagcgcggtgaagcggcgcgagcgcgaactcggcatcaagcggggcgagatgagccgcgccgtcgagatgaacatcctgcacatgcgccgggtgcggtccaagctgcgcgacccgggcgccttcgagatccaggtctacgacgagacgcctcgcttcaccgcgtatctcgtcgacggagacggctccgacggcatcgcggtggtgcagtcgtatctgcggcgcacccgcggcatggaagcgccggtcctggtgctgcgcggcgggggccgggtggtgaaggcggacgacgtcgacgacagcgggctcttcccgacctaccgcgaggagttcgaactggcttgggcggattcgcggcctgtgtcc

SEQ ID NO: 2137 - DNA, 1317 bp, Streptomyces avermitilis
  CDS (1)..(1317)
atgcgcgtgaacagaatcagccgggcccgccgccgggcggcggtgtccctgtccgtggcggcgctcgccgtcggtgcgacgacggtcgcgggaccggccgtcgcccagaccaagtcggcacccgcggcggccgccgactgcagcgcggcgtaccggatcgagcagaagctcgcctccggcaccacctggcagatgtgctggcactacgagagcgaggccgggctcgtcctggagaacatctcgtaccagccgcccggtgagacacggccgatcaaggtcctcaccagcgccaagctcggccagatccacgtcccctacgacgacggcaaagccgagtacagcgacctcacgggtgcgggcttcggccagggcctgatgaacatggcgcccggcgagtgccccggcggcaccatcaagaccgtcaaggtcccgggcgcctgggatccgcagcacccgaacgtcaagggtctgtgcaccaccacccgttcgcgcggccacgcctaccgcatgcagggcgacacggcgaacaaggtcttccaggcccagggcaaggacctgctggtctacaccgtgaaccaggtcggctggtacgagtacatcaccgagtggcgcttccaggacgacggcacgatcaacatgaacgtcggcgccaccggcagcctctcgcccgtcgactacgacgccggcgacggccgcggctggcccctcggcaagggcgccaaggcgtacgcgaccagccacagccacaacatcttctggcggctcaacttcggtctggacggctcctcgaagaacacggtcgagcagtacgactccgtggtcaccgcgcccgcccggggcaacgagggcccgaccaacaagaccacccgcacgaagatcaccaaggaactcgcgggcgacgccaagaacatgcgctggtggcgggtcgtcagcgcgaccggcaagaacaaggacgaccacgcgcgttcctacgagatcgtcccgggcgccaccaccaagtaccccggccgcagcttcaccaagcacgacatctacttcaccgagtacaagaagtgtgaacagttcgccagcgacaacctgcgcaactgcggtaccggagccggtaagtccgtcgacaagtgggtcggcggacagaccctcacccacccgatcgcctgggtcaacgtcggtttccaccacatcgcccgggacgaggaccagcagccgatgccggtacactggcagggcttctcgatagctccgcgcgatgtcaccgctatgaatccgctcactccggccgagctggccgaccagaacgggcatgtggaaaacggtagt

SEQ ID NO: 2138 - DNA, 858 bp, Streptomyces avermitilis
  CDS (1)..(858)
gtggggctcaagacactcctggagaccggaggagtagggggaaatgtgcgcaagatagtgcaccgccatctgggcaaggtggtggcaggcgcggccatcgctgtggccggtaccgcggtgatggtcggcatcacgctcccgggctcggcgggggccgacgaacagggcggccagggcgccggccagtccgcccagcaggccggacaggccgggcagcaggggcaggcggcggcgcagcccggcgtcgtcgagcaggccccggccgagggggagaagggcacgggccgcgaccccctcaccgacgacgagacgaagcgggtcgcgcagatcgcggtgaaccagcagttcttcggctccagcgagaacgtcgagggcaggcgcggcccacagcgcgtcggcgtcgacctcgcggagcaggacgagaacgcgccggccggcgcgaacgcgccgcgccgcgccgacgtgcggttctacgactacaaggacgacacgctcgtcaccaagaccgtcaacctcgacagcgggaaggtcgagcagaccgacacccagcacggcgtccagccgccgatcagctccgacgaggccgtcgaggcggccaggctgctgatcgccgacccgctcggcgcgggcctgaaggccgacttcaaggacgcgaccggcaaggaactcacctcgcccgatcagctgctgctcaacagcatggcctaccgggcgacctcgggtgcccagcccgcggtcctcgcgcagtgcggtgaccaccgctgcgtgcggctgttcccgaaggtcaggaacgggccctggatcgacagccgtgacctggtggtcgacctgagcgcgcgcaaggtgggcaagctcggc

SEQ ID NO: 2139 - DNA, 2106 bp, Streptomyces avermitilis
  CDS (1)..(2106)
atgcaggtctggcctggagaggcatatccactcggcgccacgtacgacggcgccggtaccaatttcgcggtcttctcggaggccgcccatcggatcgagctgtgtctgctgcacgacgacggctcggagacggcggtggaactgagggagaccgacgcgttcgtgcggcacgcgtatctgcccggcgtcatgccggggcagcggtacggcttccgcgtgcacggcccgttcgcgccggggcgcggggtgcgctgcaattccgccaagctgctgctcgatccgtacgcgaaggcgatcagcggcgagatcaagtggggcgaggaggtgtacggctaccacttcggcgcccccgacaagcgcaacgacctggactcggcgccgcacacgatgacctcggtcgtgatcaacccgtacttcgactggggcaacgaccggcggccgcgcaccgagtaccaccacacagtgctctacgaggcccatgtgaagggcctgacgatgcggcatcccgcgctgcccgaggaactgcgcggcacgtatgcggcgctcgcccaccccgccatcatcgaacacctgactgaactgggcgtcaccgcgctcgaactgatgccggtgcaccagttcgtgaacgaccaccgtctggtggacatgggcctgaacaactactggggctacaacacgatcggtttcttcgccccgcacaacgcgtacgcctcctggggcgaccgcggccagcaggtgctggagttcaagtcggcagtgaaggcgctgcacgaggccgggatcgaggtcatcctggacgtggtctacaaccacacggccgagggcaaccacatgggcccgacgctctccttcaagggcatcgacaacgcgtcgtactaccggctcaccgacgatccccgctactacatggacaccacggggaccgggaactccctcctcatgcgctccccgcacgtcctccaactgatcatggactcgctgcgctactgggtcagcgacatgcatgtcgacggcttccgcttcgacctcgcggccaccctggcccggcagttccacgaggtggaccggctgtcgtcgttcttcgacctggtccagcaggacccggtggtctcccaggtgaagctgatcgccgagccgtgggacgtcggcgagggcggctaccaggtgggcaacttcccgccgctgtggaccgagtggaacggcaagtaccgcgacacggtgcgggacatgtggcggggcgagccgcgtacgctcgcggagttcgcctcccgcctgacgggctcgtcggacctctaccaggacgacggccgccgtcccctcgcctccatcaacttcgtcacctgccacgacggtttcaccctgcacgacctcgtcgcgtacaacgacaagcacaaccaggccaacggcgaggacaaccgggacggggagagccacaaccggtcctggaactgcggggccgagggcgacaccgacgatccggcggtgctggcgttgcgggcgcgccagatgcgcaacttcatcgccacgctgatgctctcgcagggcgtgccgatgctcagccacggggatgagttcgcgcgcacccagggcggcaacaacaacgcgtactgccaggacggcgagctgtcgtgggtggcgtggcccgaggacggcagcgagctgctggagttcacgcgcgcgatggtgtggctgcggcgcgaccatccggtcttccggcgccgccgcttcttccacgggcggccggtggagggcacgcacgacgagctgtcggacatcgtctggttcacgccgacgggtgaggagatgatccagcgcgactgggattcggcgcaggcacgggcgctgacggtgttcctcaacggcaccgcgatctccgagcccggcccacgcggagagcggatctcggacgactccttcctgttgatgttcaacgcctccccgaagtcgctggagttcgtggtgccggtcgaccacggccgccagtggcaggtcgtcgtcgacacggcacgcacggacgggatcccgccgggcacggtcgcgaaggtcaaggccggggaccggctgacgctggtggaccggagcctcacggtgttgcagcggccggcc

SEQ ID NO: 2140 - DNA, 2385 bp, Streptomyces avermitilis
  CDS (1)..(2385)
atgacacctgagcgtcccgaacccacggtgcccacggccacgtaccgccttcagctccagccggagttcccgttcggtgcggcggaggcggccgtgccgtacctggcctcgctcggcgtctcgcatctgcatctgtcgccggtcctcgagaccgtaccggggtcgttgcacggctacgacgtcgtcgaccacgcgcgcgtgcgggacgaactgggcggcgagaggggactgcgctccctggcgcgcaccgcgcgggagcacggcctcggcctggtcgtggacatcgtgccgaaccacatggccgcggccccgcgccacaaccgccccctctgggaggtgctgcgcgagggaccggattccgcgtacgcgcactggttcgacgtcgactgggacgcacagggcgggcagctgctgctgccggtgctggggcaaccgctcggcgcggagatcgaccggctgaaggtcgacggcgacgtgctgcgctactacgaccatgtcttcccgctgcgcgagggcaccgggaagctgccgctgccgcagctcctcgatgcccagtggtatcgcccggtgtggtggcggctggcgcgcaccgaactcaactaccggcgcttcttcagcatctccgagctcatcggggtgcgcgtcgaggacccggaggtcttcaccgcgacgcacgccaccgtgctgcggctgctcgacgagggtgtcgtcgacggcctgcgcatcgaccaccccgacggtctcgccgacccggacgcgtatctgcgccgcctccacgcggccaccgggggccgctggaccgtcgtcgagaagatcctcacggacggcgagcacctccccgccgcctggcccgtcgcgggaaccaccggctacgacgccctgcgtcacgtcgacgggcttttcacggacccggcgggagcgggcgaactcctcggccagtaccggcgtttcgcggccccccaggccgatcgcggcggccactgggaagcgaccgtgcggcgcgccgcgtacaaggtggtcacccatgagctggccaccgaggtggaccgcctcacgcgcgcggcgagccgcctgtgcgccacctccccggaccccgccctgcgcgaccacgccccctgggcgctgcgcaccgcgctgcaagagctcctcgtacgtctcgaggtgtaccgcccgtacgcctccggggacgccgccgcggtcgtcaccgaggaggccgccgccgaggcccgtgccgtcttcacggtgcccgaggaggccggtgcggtgagcgtcgtacgggatctggcgctggggcgggccggtgacgggcccgggcacctggagttccgggcccggttcgcgcagacgtcgtcggcgctgcgggccaagtccgtggaggacacggggttctatcgctacgtcccgcttctgtcggcgaacgaggtgggcgggaacccgggcagtccggccgtctccccccaggacttccacgcgtactgcgcgcgcgtgcagcgcgactggcccgcgaccggcaccgctttgtcgacgcacgacacgaagcgcagcgccgacgtgcgcgcggccgtctccgtgctcacccagtgcccggagcgctgggccgacacgctcgcggaggtgacccgcgccggcgacggcgtgcccgacccgcacgtcgcctgggccgcctggcagacggtcctcgggctcggaccggcggccgaggagcgcgtacaggcggccctgctgaagcacgtcagggaggccgggctgcacaccgcctggaccgagcaggaccccgcgtacgaggagacggtggcggcgttcgtcgcgcagggcccgtgcggggcgccggggcggctcgtgacggacttccgggccgagttgggcccgcatgtccgggcgaacgttctcggggccgctctggtccatctgacgatgccgggtgtgccggacgtctaccaggggacggagggcgagtaccgggcgctggtcgacccggacaaccgtggggtgttcgcaccccaggagcagccctcggcgaagtccgcgctcacgacggcggccctgcggctgcgcgggcggcgcccggaggtcttcggtgacgcggcgacgtacgagcccctcgaggccgaggggccgggcgccgcccactgtgtggccttcgtgcgctccggggaggtgctcacggcagtgacccggctgtcgctgcggctggcggaggcgggcggctggcgcgacacggccctcgcgctgccgccgggccggtgggccgacgcactcgccccggagcgggagttcgagggccacacgcgcgtggtggagcttttcgggtcctcgcccgtggtgctgctggagcggctcgggggccgagtgggcggcgtacaggcgacggtggccggaccgcgg

SEQ ID NO: 2141 - DNA, 987 bp, Streptomyces avermitilis
  CDS (1)..(987)
atgagtctgcggcagatggagtacttcctcgccgtcgtcgaagaggcgtccttcacccgcgcggccgagaccctccatgtcacccagcccgcgctctcgcaccagatcaaggccctggagaggtcggtcggcggtgcgctcctggagcgcatgccgcgcggggtgcgcctcaccccgatgggccgcgccttccgcccgcacgccgaactcgccgtgcgcagcgccgcccaggcccgccgcgcggcccgcgcctccgccggagccgaaggcggcgaactgcacatcgcggccgtccactccgtcgccgtgggggtgctccccgacgtcttcgcccgctggcgtaccgcccacccccaggtcgtgctgcacctccacgagtacgccacctccgaggcgctggaggaacaggtcgagcgcggcaccgccgacctcgcggtcgggcccgcgccgcgggactggcccggcagcgtcgtgccggtcggcgaggaggagatcgtcctcgtggtgcccttcgacgaccgtttcgcgggccgtacgacggtgacgctgcccgagttgtcggaccgctcgtggatccggtgcgccatggagcccgtcgtgcacggacagcggtttctcgactgggcctgcgggcaggccggattccggccgcgtaccgccgtgttcaccgagcacacctcgacggcggtgcgtatggcggcggccggtgtgggcgtcagcaccgcgccctcgcacatcgtgcgcggcgcggtcggcgaggactgcgtcgtactctccgtggacccgccctggaggcgtcccctgacggtcttctcccgcgtgccgccctcgggtgccgccgcggccttcgtggagctcctgcgccggtatggagggctcccggcggcgcccgcggaggcctgcgaggacggcatcgcgcggcccgccgactgcggggccccggagacggcccggccgctcccgccgacggcccttctcgacgcccgt

SEQ ID NO: 2142 - DNA, 1434 bp, Streptomyces avermitilis
  CDS (1)..(1434)
gtggagaacatgaacacaccggacgtcatcgtcatcggaggcggcaccggcggctacagcgccgccctgcgcgccgccgccctcggtctgaccgtggtgctcgccgagcgggacaaggtcggcggaacctgtctgcaccgtggctgcattccgagcaaggcgatgctgcacgccgcagaactggtcgacggcatcgccgaggcgcgcgagcgctggggggtgaaggccacgctggacgacatcgactggcctgcgctcgtcgccacgcgcgacgacatagtgacgcgcaaccaccgcggcgtggaggcgcacctcgcccacgcgcgcgtgcgcgtcgtccggggcagtgcccggctgaccggtccgcgcagcgtccgcgtcgagggtgctccggacgacctgccgggcggcgcgggcgacttcaccgcgcgccggggcatcgtcctggcgaccggctcacggccgcgtacgctcccggggctcgtgccggacgggcggcgcgtggtgacgagcgacgacgcgctgttcgcgcccggcctcccccgctccgtgctggtcctgggcggcggtgcgatcggggtcgagtacgcctcgttccaccgctccatgggtgcggaggtcactctcgtcgaggccgccgaccggatcgtgccgctcgaagacgtcgacgtcagccgtcatctgacgcgcggtctgaagaagcgcggcatcgatgtgcgggcgggggcgcggctgctcgacgccgaactcctggaggcgggggtacgcgcgcgcgtacgcaccgtgcggggcgagatccgcacactggaggccgagcggctcctggtggcggtcgggcgggcgccggtcaccgacgggctggacctggccgccgcgggcctggcgacggacgagcggggttttgtgacgccgtccgactgggaccgtctggagaccgcggtgcccggcatccacgtggtgggcgacctgctgccaccgccgtccctgggactggcccacgcgtcgttcgccgagggcctgtcggtggccgagacgctggccgggctgccgtccgcgcccgtggactacgcggccgtgccccgggtcacgtactcgtcgccgcagaccgcctccgtggggctgggcgaggcggaggcacgcgcgcgtggacacgaggtggacgtcaacacgatgccgctgaccgccgtcgccaagggcatggtccacggccggggcgggatggtgaaggtcgtcgccgaggagggcggcgggcaggtgctcggcgtgcatctggtgggcccccacgtgtccgagatgatcgccgagagccagctgatcgtcggctgggacgcacagccctccgacgtggcccggcacatccacgcgcaccccacgctgtccgaggcggtcggcgaaacgtttctcacgctcgcgggacgggggctgcatcagcag

SEQ ID NO: 2143 - DNA, 1248 bp, Streptomyces avermitilis
  CDS (1)..(1248)
gtgagtctcctgccggagcagcgctaccccagtgtgaccgaaatcgtttcgtccgcccgcgcgctggcggctcaccggcccggcctgtgcgcgctcagacaagtcggtgtctcccgcgcgggccgacctctgcacctgctgtccgtcggccacgcgacccgtgccgtcctggtcgtcgcgggcgcccacgccaacgagccgaccggcggttcgaccctgctgtcactcgccgaacgggtgctgtacgagcgggagttgcgggacggcacctcctggcacttcctgctctgcgcggacccggacggcgcggccctgcatgtgactccggcgccgcgcacactgttcgactaccacctcgggttcttccgtccggcgggccccgagcagccggagtggtcgccgtccgtgctgccgccggaccggctgccgcccgagacacgcgcgctgacccgggtcatcgacgaactgcgcccctaccttcaggtgacgctccacggcaccgatctgggcggcagctgggtgcagttgacgaaggacatccccggcctcgccgagccgttcgcgaagtccgcggcggagctgcacattccggtggagacgggcgcctccgacgcggcgggctggcccgcgtccggtcccggcgtccatgtgatgcccgcgccgggttcgaacgcggcgtacccgagcatgcccgacgacgcccggcacagcacctggtaccacacccatcggtacggcggtctcaccgcggtcgtcgaggtcccgatgtgggcgagcgacctggtggacgatccggcgccgcacccggcgcccgcggcggccctgcggcagctggggcggcggctgctgcgggacgcgctggaggtggaactggtcctcacggaggcgctgccgcggctgcccggccccgacgggccgctgctgcgcgccgccaagtgggcgctggagctggtcccggggctcgcgggcgactgggcgcaggcgccgcccgcggacaccacgatggcgtacgtcggcagtgtcgacgcgttcggccgccggctgccgctgcgggccgccgcgatgctgctgcgggtcctccaggaggccgacgaccgcgccgcgccgcgcctcgaacagctcgtcgcggcctggagcgacgccttcgccgtacgcttccgcgcgcgctgggtccccctggaggaccaggtcgaacatcagtcccgtacggtcgtggcggcggcccggcacgcgcgggaccgtgcggcg

SEQ ID NO: 2144 - DNA, 438 bp, Streptomyces avermitilis
  CDS (1)..(438)
atgacgaagacgaccatggcggtccccggcgccctgctggccgcgatcgccctgctcagcgcggccccggcccaggcggcggcccaccgggtgacccccggcaactggctctatgtgacggtcaccacgggcgacgcccgctccagtcacatcagcaggctcctgacgtgcgacccgccccacgggcacgcgcacgcggcccgggcgtgcgaggaactggcggccgccgacggggacatcacccggatcccgcccaagcgcacgttctgcccgatgatctacgccccggtgaccgcggacgcgcacggcgagtggaacgggcggcacgtcgagtaccgccacgccttcgggaacgcctgcgggttggagggggagaccggagcggtgttcgcgctctcggagcaggcgtcggacgggccgacgcccggtctgcggagc

SEQ ID NO: 2145 - DNA, 1407 bp, Streptomyces avermitilis
  CDS (1)..(1407)
gtgcgtacaccatgcacaccaggtgaaccgacggcaccacatgagtggaggtgcgccctgccgccactccttcgctacccgactgtcgacgaactggccgcgcgggctgccgcgctcgtcgcccgccgtccgggcgacgcccggctgcgccgcgtgggcacgtcccggggcggcacgcccttgtggctgctgtccgtcggccacggcacccgccacgccctcgtcgtcgccggaccgcacgccaacgaacccgtgggcggcgccaccgccctgcgcctcgccgagcgggtcctggccggccccgggccggccgagggcgccgacgccacctggaacctgctgctctgcctcgaccccgacggcgcgcgccgcaacgagggctggctgtcgggcccgtacaccctcggccactacttccggcacttcttccgcccgggcttcctggagcagcccgagtggctgcccgacggcgccgagcgggccgccctgcccgaaacccgcgccctcctcgacctccaggacgagctgcggcccttcttccagtgctccctgcacggcgtggacgtcggcggcggcttcgtcgaactgacccaggacctgcccggcctcgcccagcgcgtcgcaggcaccgccgcccggttcggcatcccgcgcgaactcggcccctacgacaccctgtactggccgcccctgggccccgccgtctaccgcatcccaccgccgcgccgcggcgacctggccgccgccatcacggaggccgcggtcgaatccacctggttccacccgcagcgctacggcaccgtgacggcggtcgtcgaggcgcccatgtggggcgtggcggctgtggaggacggctcaccgcccggcgacgccgacgcggtcctgcgcgccgtcagccgcaccctgcgccgcgacacgggccttctggaggacatcctcgcccggatccggccgcggctcgccgccacccccgacaccgccagtctgctcgccccggtcgacgactatttactggtcggccccgggctcgccgactcctgggatcccgacacgttcgacggcacgggccggccgctgccgccgctcaacaccgcccggctgaccgcgctgggcatctcgggccgccgggtcgccctgcggaccgccgggctgctgcgccaactcgccacggccgccggagccgcggcgtccgacgtcctccccgagctggaccggctcatcgacgagtggtgcgccgactaccgcgacggctacggggcgcgctgggtcccggtcggccaccaggtcgagtaccagacgcgcgtggtgctcgccgcgttcgaactcgcggggcggtacgcgcccgtgcgctcgcattcgggtgagccccgctggggttcggacgccgtcgtgccgatgcatacggaa

SEQ ID NO: 2146 - DNA, 636 bp, Streptomyces avermitilis
  CDS (1)..(636)
ttgccacgcggaacgaccctgacggagacgacgtccgtttccggggttttctggacaccctggcccgactgcccgacaatcacctgcgtgacgtcgtctttcgagttccacacgtaccccgcgcggctgtcggacgccgagcgcgacagggcgctgaaggtgctccgcgacggcgtagccctgggacgcctctcgcacgacacgttcatccggcgcatggaactggcgctggtcgcccgccagcccgccgaactggccgcgctcaccgccgacctgcccgccgagaagcgcgtgtcgcggctggtgttcggcacggtcgaggcggtctccggcttcaccgtacggctgcgcagggcctggcaggccgagcggctccccaagctgctcctgccgcaccccggcagcacgcacccgctgcggataggccgcgaccccgccagcggtctgaggctcagtcacgacaccgtctcgcgtgtgcatgccgaactcagccgccagggcggcctgtgggtgctgcgcgacctgggatccaccaacggcacgacggtgaacgggcgtcacgtgatcggcgccgcggtcgtccgtgacggcgaccaggtgagcttcgggaacatggcctttcggctcgcgacggag

SEQ ID NO: 2147 - DNA, 1743 bp, Streptomyces avermitilis
  CDS (1)..(1743)
gtgcagttcgaggtgtgggcaccacaggccgcccgggtgacgctccactgcggcggcgccacgcgcgcgttggcgcgcgacgaggagcgcgacggctggtggaagggcgacgcggaggccggggacggcacgcggtacgggttcgccctggacgacggtgccgtgctgcccgacccgcgctcgcgccgccagccggacggcccggacgggctgagcgcggtggtcgaccacgggcggtacgcgtggcgtgccgaccggcccgggcgcgggctgccgggcgcggtgctgtacgagctgcacgtgggcacgtacacgcgggagggcacgctggacgcggccgccgagcggctcgggcatctcgtggaactgggcgtgacccatgtggagctgatgccgctgtgcccgttccccggccggcacggctgggggtacgagggcgtctccctgtgggcggtgcacgagccgtacggcgggcccgaggcactgaagcggttcgtcgaccgggcgcacgagctcggcctgggcgtcgtcctcgacgtcgtgcacaaccatctgggcccgtccggcaactgtctgcccgcgttcgggccgtacttcacggacacccatcacacgccgtggggcgccgccgtgaacctggacgcgcccggctcggacgaggtgcgcgcctatctggtcggcagcgcgctggcctggctgcgggactaccgggtcgacgggctgcgcctggacgcggtgcacgcgctgtgcgacacgcgcgcgtgccacttcctggaggagctgtcgacggcggtggacgccctcgctgccgaccaggaccggccgctcttcctggtcgccgagtccgacctgaacgacccgcggctcgtcactccccggcacgagggcggcctcggtctgcacgcgcagtggaacgacgacttccaccacgccctgcacaccgcgctgacgggcgagtcgcagggctactacgaggacttcgcccgggcccccttcgcggcactggcgaagacgctgacgggcggcttcttccacgacggcacgtactcgacgttccggggccggtgccacggccgcccgctggaccgtacgcgcgtgtccgcgcaccggctgctcggctatgcgcagacccacgaccaggtcggcaaccgcgcccagggagaccgtctttcggcgtccctgtcccccgggctgctggcatgcgcggcgacgctgacgctcacctccgccttcacgccgatgctgttcatgggcgaggagtgggccgcgggcaccccctggcagttcttcaccgaccacaccgatcccgaactcgcggaggccgtacgccggggcaggcggcgggagttcgcggcgcacgggtgggccgaggaggacgtccccgacccgcaggacccggcgacccgcgaccgctcctgcctcgactgggcggaaccggaaagcggcatccacgcgcgcgtgctggcctggtaccgcggcctgatcaccctgcgccaccacgaggcggacctctcggaccccgacctcaccgacgtcaaggtcgcgtacgacgaggaggcgcggtggatcgccttccgccgcggcgacgtacgcgtggccgtcaatctgtccaaggagcccgcgcggatcccgctcggtctcgcccacgcgcgcgtgctggccgcgtgggagccggtggagaccccgggcgcggacggggtactggagctgccgggcgagtcgtcggtggtgctcacgcaggcg

SEQ ID NO: 2148 - DNA, 933 bp, Streptomyces avermitilis
  CDS (1)..(933)
atgacccaggcaccgacaccgacggcggacagcatccgcagactggtccgttccgtgctcgccgacggccccgcggacggagcgggaccggaggtgcggcccgtcgccgcgggcggtgagcactccacctggtgggtcggtacgcgccatgtgctgcggctcgcccccgaccgtgacgcgtccgtacgcctgcgtcgcgagctgcggctgcgcgacctggtccggccgcacatcggggtcgcggtcccggcgagcgtcgcgcacggcgagtgggccacggggctggcctacaccctcgacaccaggctgcccggcgccggcggagaggagcatgccgtctcggcggtcggtgaggcggacctcgcggcgctgctcaccgggttgcgcgaggtgcccgtacgacaggcggagccgctcggcgtcccgcgcgcggtgccgcgttccctcgaagcgctgcggacggtcgcggaggacgccgcccagtacctctccggggccgacgagttcgacgcggaccgcctcggtcagctcacggcgccggcggcggtgcagctcgccgcgcagcccggtgcggcggtcctcgtgcaccacgccctcaagggcgaacacctcgtggtgagcggcgacggccgggtgcgcggcgtcctcgactggaccgacgcggtgatcggcgaccccgccgaggacatcgccgggctggccatcgccgtgggcgcccccgccgccgtacgtgccgccaccctcgccggctacggcgcccgcccctgtctgcgcggcctgtggctcacccgctgcgacaccctcgtccgcctcgccgaccgtctccagggacgcgacgacagccccctcccgcttctgcgcacccgactgcggcgcgcctgggaggcgatcctcctggaacgggtcacggaactgccgggggacgagacgctc

SEQ ID NO: 2149 - DNA, 1143 bp, Streptomyces avermitilis
  CDS (1)..(1143)
atgaccggcacgcccgcgccccccggcaccggcgaccccgcacccttcaccgccgccgactacgcggcccggatgcggcgcgcggcacagtccgccgcggacgccggtctcgacggcgtactggtcgcacccggcccggacctggtgtggctgacggggtaccggccggtcgagaccgagcggctcaccctgctggtgctgcgggccggacacgaccccgtcctggtcgtgcccaccctggaggcgcccgacgcggcggaggcggccggcgcgcccgcgctgacgctgcgcgactggaccgacggcaaggacccgtacgaggcggccgcgaccctcctcgaccggtccggccgcttcggcatcagcgacaacgcctgggccatgcacctgctcggcctgagcggccggctgcccggcacgcgctacgtcgcgctcaccgaggcgctgccgatgctgcgggccgtcaaggacgccgcggaactggagcggctggcggccgccggcgcggccgcggacgccacgttcgaggagatccggaaggttcccttcgccgggcgccgtgagacggacgtcgccgccgatctcgccgaactgctacggcagttcgggcactcccaggtcgacttcacggtggtcggctccggcccgaacggagccaatccgcaccacgaggcgggcgaccgcgtcatcgagcgcggcgacatggtcgtcctcgacttcggcgggctcaagcacggctacggctccgacacctcgcgcacggtccacgtcggcgagcccgacgaggaggagcgcaaggtgcacgacctggtgcgcgcggcccaggaggcgggcttccgcgcggtgcgaccgggcgtcgcctgccaggacgtggaccgggccgcccgcgcggtcatcgccgacgccggctacggcgaccgcttcatccaccgcacgggccacggcatcggcgtcaccacgcacgagccgccgtacatgatcgagggcgaacagcgggccctcgtacccgggatgtgcttctccgtggagccgggcgtctatctgcccggccgcttcggcgtacgcatcgaggacatcgtgacggtgaccgacgacggcggacgccgcctcaacaacacctcccgcgagctggtgatcgtcgac

SEQ ID NO: 2150 - DNA, 339 bp, Streptomyces avermitilis
  CDS (1)..(339)
gtgtccggcggaccgcagtccatgggcgccaagtccgcgcagggcgacagcagtgcgaacgccgtgctcgcgccgggcaaggcgaccctgggcgtcgaagccgtggacgccgcgtccaatggcgctctcgtggtgggggtccatgcccccggtccgggctacacggcgggcctggtccgcggcgacatcctgctcgccttcggcagaacccgtctcgactcggccgccgatctcgcccgggcggtggcaggcgcacgccccggcacggcagtcccactgacggtgcgtcacgccaacggcaaccagcagcagttgatggcgacaccggggatcgtcacg

SEQ ID NO: 2151 - DNA, 2175 bp, Streptomyces avermitilis
  CDS (1)..(2175)
atgacgcagccgttccaactcccgcacttctacatgccctaccccgcgcggctgaacccgcatctcgacgaggcgcgcgcccactccacgcggtgggcgcgcggcatgggcatgctggagggctccggcatctgggagcagtccgacctcgacgcacacgactacgggctgctgtgcgcgtacacacaccccgactgcgacggcccggcgctctcgctcatcaccgactggtacgtgtgggtgttcttcttcgacgaccacttcctggagacgttcaagcgcacccaggaccgcgagggcggcaaggcctatctggaccggctgccgctcttcatgccgctcgacctgtcggcacccgttccggagccggagaatccggtcgaggcgggcctcgccgacctgtgggcgcgcacggtgcccgcgatgtcggcggactggcgcaagcggttcgccgtctcgaccgagcacctgctcaacgagtcgctgtgggagctgtccaacatcaacgaggggcggatcgccaaccccgtcgagtacatcgagatgcgccgcaaggtcggcggagccccctggtcggcggggctcgtcgagtacgcgaccgccgaagtgccggccgccgtcgccgggtcgaggccgctgcgggtgctgatggagaccttctccgacggggtgcacctgcgcaacgacctgttctcgtaccagcgggaggtcgaggaggagggtgagctgagcaacggcgtcctcgtcctggagaccttcttcggctgtacgacgcaggaggccgccgagaccgtcaacgacatcctcacctcgcggctccaccagttcgagcacacggcgctcaccgaagtgcccgcgctggccctggagaaaggcctcaccccacccgaggtcgcggcggtcgcggcgtacgcgcggggacttcaggactggcagtcgggcggccacgaatggcatctgaggtccagccgctacatgaacgagggcgccctctcccagaagcggcccttcgggctctccgcgatcggcacctccgccgccgacctgcgcggactgctcgccgacgccggggccgagcggctgcgccgatacacccacgtgccgttccagaaggtcggaccgtcccggatccccgacttccatatgccgttccaggtggaactcagcccgcacctggagggcgcccgcgcccggctgaccccgtggatgcacagcacgggcatgctccaggagggcgtctgggacgaggacaagctgacggcgtacgacctgccgctgtgctcggccggcctcgatccggacgccacgcccgacgaactcgacctcagctcacggtggctggcctggggcacgtacggcgacgactactacccgatggtgttcgggccgcgccgcgacctcgcggccgccaagctgtgcacacgacggctgtcggcgtgcatgccggtcgacggcgaggaggtcccggcgccggtcaacggcatggagcgcggcctcatcgacctgtgggccattacgacggcggagatgaccccggacgagcggcgcacgttccgcgcctcggtggacgtgatgaccgagagctgggtgtgggagctgtccaaccagctccagcaccgcatccccgacccgatcgactacctggagatgcgccgcgccaccttcggggccgacctcaccctgagcctgtgccgcgtgggccacggcccgaaggtcccgcccgagatctaccgcagcggccccgtccgctctctggagaacgcggccgtcgactacggcatgctcatcaacgacgtcttctcgtaccagaaggagatcgagtacgagggcgaggtgcacaacgcgatcctcgtcgtgcagaacttcttcggctgcgactacccgaccgcgctcggcgtcatcaacgacctgatgacccagcggatgcaccagttcgagcacgtggccgcccatgaactgccgctcctctacaaggacttcaagctcccgcaggaggtgcgggacatcatggacggctatgtcgtggagttgcagaactggatgtccggcatcctgaagtggcaccaggactgccaccgctacggcgcggcggacctggcccggcgtgcccatggcttcgtaccggaccgggcaccttccgcaccgttcaccgcgtgggcggcgccggtggcgcgc

SEQ ID NO: 2152 - DNA, 777 bp, Streptomyces avermitilis
  CDS (1)..(777)
atgacctccttcgtgctgccccatgaactgcacggcgacggcgcccacaaggtgttcgcggtgcacggctggttcgccgaccgggccgcgtacgcggcggtgctgccggatctcgaccgggccgcgttcacgtacgcgctggtggatctgcgcgggtacggaagggccaaggacgcggtcggcgcgttcaccaccgccgaggccgccgcggacctcgtcgagctggccgaccggctcggctgggatcggttctccgtgatcgggcactccatgggcggcacggtcgcgcagcggctgctggccctcgccccgaagcgcctgcgccggatcgcgggggtgtccccggtgcccgcgtcggggctgtcgttgccggccgaccagtggcagctgttcgcggacgcggcgcacaagccggagaaccggcgcgcgatcatcgacgtcaccaccggcgggcgccgccccggggcctggctcgaccggatggtcgcccgctccctcgcggacagcgacgcgaaggcgttccgggcgtggctggactcgtgggccggggaggacttccaggcggaggtcacgggcgcgggggtgcccgcgctggcggtgacgggggctcttgacccggcgctgtcgagcgcgctgctccgggacacctggatgcgctggtacccgcgcggcgagctgagggagctgccctcggccgggcactacgccatggacgaggcgccgctcgacctgatccacgtggtggaggagttcctccgggccgaggacgccggcgag

SEQ ID NO: 2153 - DNA, 1263 bp, Streptomyces avermitilis
  CDS (1)..(1263)
gtgagcgtccgcgagcaggccccgcccgtccccgatgtcttcgacccgcgccggtacgccgccggagtcccgcacgccgcgtaccgcacgctccgcgaccatcaccccgtcgcccggcaggccgagcccgaggtgctcggctggcccgccgggccggggttctgggcggtcacccggcacgcggacgtcgtacgcgtgctcaaggactccaccacgtactcctcgcggttcggcgccacccagatccgcgaccccgatcccgacgacctgccgttcatccgggacatgatgctcaatcaggatccgccggaccacggcaggttgaggcggctggtcagccgtgcgttcacgccgcgccgcgtcgaccggttcgagtcgctcgcccgtgaccgcgcccgcaccctgctcgccgccgccctcgcgggtgcgcgcgccggcgacggcagctgcgacctggtcgccaccgtcaccgacgactacgccctgctcaacctcgccgatctgctcggtgtaccggagagcgaccgcggcctgctgctgcactggacgcggcgcgtcatcggctaccaggacccggacgaggcgggcgagccgctcctcgacgcggcgggcaaaccggtcgatccgcgctcaccgggggccctgcgggacatgttcgagtacgcgcggcagctggcctcgtacaagagggaacaccccgccgacgacatcatgacgaccctcgccaccgaccccgaactcaccggccccgagctggcgatgttcttcttcctgctgacggtcgcgggcaacgacaccgtgcgcggcgccgctccgggcggcctgctggccctggcggagcacccggaggcgtacgcccgactccgtgcccggccacagcaactaccctccgccgtagaggagttgctgcgctggcatccgcccgtgctcaccttccgccggacggccgtacgcgacaccgacctcgccggacagcgcatccgggccggcgacaaggtcgtcgtcttccacgcctcggccaaccgtgacgggcgcgtcttcaccgccccggaccggctggatctgtcgcggtcaccgaacccgcacgtctccttcggcgacggcccgcatgtctgcctgggcgcgcacttcgcccgcctgcaactgcgggtgctgtacgcgcagacgctacgggcgctgcccgcaccgcgggtcgccgggcctcccggacgcctcgtgtcgaacttcatcaacgggatcaagtcgctgccgttgcaggtggca

SEQ ID NO: 2154 - DNA, 1212 bp, Streptomyces avermitilis
  CDS (1)..(1212)
atgtctgaagcccccgtgatcgtcagcgacgacccgggatccttcccgcacagcgtgctggccgagcggcaccccgcgctcatccgcaaggtgcgggacgccttcccgtacgggcccgagcagcggcgcgcgctcgacgcgctgcaaaagagcgccctcgacggtgtgatcgagccgctcggcacaccggccgaggaccacgagcggtgggtggcctgggggcttccgaagcacctcggccgctcctggttctcggtgcccttcctgtgggccgagagctacttctaccgacaactcctcgcggctgtcggctacttcggctcagggccctggcagggcatcgaccccttccgccccttcaagctcgccgaactcgacaccccggaggcggccgaggaactggccgcgctcgacgcgctcaccggacggccgctggacgaacaggcgcgggcgctgctccacggctcgctctggggcaaccgcgcggacctcggcttccgcatctccgccgggggcgacggctccgtcgactcccaactcctcgtggacgacagcgagtcactgtgggcgctgctgccggcgcacacggccgactccgactccgactccgactccgacgccgacggcacggccggcccggcccgcacggtctgtctggtcgcggacaacgccggccgcgagctcatcccggacctgctcctgatcgaccatctcctgcaccacgggcgggccgaacgggcggtgctgcacgtgaagccgtacccgtacttcgtctcggacgccacgaccgccgacgtcctggacgcggtacggcggctgaccggcaccaagggggcggccggggcggccggggaccgcctgtggtcggccctgaccgacggccgcctcgtggtgcgggcccatgtcttctcctgtgcgccgctgccgtacgcggacatgccggacgacctgcgccgcgagttcgccgaggcggacctgaccatcatgaagggcgacctcaactaccgccgtctggtgggcgaccggctctggcccccgacgacaccgttcaccaccccgacggcgtacttccccggcccggtcgtggccctgcgcaccctcaaatcggacgtgatcgtcggcctggacgcggacacggaggcggcgttggcggcggcccaggggcagggatggcgcacgagcgggacgcacgcggtgatccaggccaggccc

SEQ ID NO: 2155 - DNA, 579 bp, Streptomyces avermitilis
  CDS (1)..(579)
atgcgcatgccaactgagtcggcccacgggccagtcggagtgatatgtccgagctgcggcgaatcgacggtgcgcgcggtcgaggagatctgcgccgacgaggcgtccgtgcgcgacggcctgtccaaccgcctggcgaaggcgccgggcgtgacgtcgggattcgacggctgtctgcacttcgtcgagggcatgctgatggtcggcgtgggcgccgcgctcgcgtacagcggggtggacaacgacaagccgctctacacgatcggcggagcgctgctggccgtgctgctgttcgtcggcacgatcctcgtggtccgcggcgaggcgcgcgagcgcgacgtggtgaacgccggagagcaccgcgccgaccggctgtggcgtccggcgcactactgctccgggtgcgcgtcggtgttctgccccggcggcggcccgtgggagggtctgctgacgccggagcagttccagaagtacgtgtggaccgaggccggatacgggaagcagctggaccccgcggtcagggacctggagctgcctgtcggcatccggaccggtcccgaaggagcacaggaccatgtc

SEQ ID NO: 2156 - DNA, 933 bp, Streptomyces avermitilis
  CDS (1)..(933)
atgaccgcacaccgcaccgccgccgcggccgccgtagccgtggcggccccgctgctgctgaccgcctgggcggcgggtccggcccaggcccatggcgcaccgacggatccggtcagccgggtggtggcgtgctcccccgagggcggcggccgggcgcggaccgccgcctgcacggcggcgatcgcggccaacggctcgcccttcaccgcgtgggacaacctccgggtcgccggcgtgaacggcagggaccggcagctgatcccggacgggaagctgtgcagcggcggcctgcccgcctacaaggggctcgacctcacgcgctccgactggccgtcgacacggctgacccccggcgcgtcgctgaccatgaagtacagctcgacgattccgcacaccggcacgttcaagctgtatctgacgaaacaggggtacgaccccacgaagccgctgacctggtcggacctgccggcgcagccgttcgcgcagctcaaggacccggcactggcgggcggcgcctaccgcctcggggcgaagctgcccgcggaccggaccgggcgccatgtgctcttcaccatctggcagaacaccagcacgacggacacgtactactcgtgctcggacgtggtcttcgcgaaggccaaggccgccgccggtgcgggcggcggatcgacgggcgccgccaggaagccggccggcaaggcgactccgagcagtcccgccgccacgtcctcaccgtcgagctccccgtccccgagcaggtccgagaccgccgcctccacgccgccgccgtccaggaccgccgtgccgggtactccggcggcggccaccgcgcaccgttccgacagcggcccgtccctgcccctgctcgcgggcggcgccgcggcggtggtgctcgccgcgggcgccgtcgtgagcttgcgccgccgtcgccgc

SEQ ID NO: 2157 - DNA, 1170 bp, Streptomyces avermitilis
  CDS (1)..(1170)
ttgctacgtcttgacgttgactgctcatcaggtttacaaattcccctgctttcccaaggatccgtggcgccggatccgtcgcacggcgcgagtcgctctcccggcccctggctgtcccggggcggtggcggcacttctggacgcgcggcgcgacgcacggtctccaccacgatgcgcggtctccaccacgatgcgcggtctccaccacgatgcgcggtctccaccacgatgcgcggtctccaccacgatgcgcggtctccaccacgatgcgcggtctccaccacgatgcgcggtctccaccacctccgagtgatccatcacccccaccgcggcgccggcacggtcgccttcccatcgcctgggccgtgtccggtcgcccggctgccgccgccggtccgtcgcgtacggagaaggcgccatgggccggcggcggcagccgcacctccgcgtcccctcgcatccccgaggggcgcggtcacccgcagcagctccacacttctgagaagaggcacccccatgcgcactcgacccttgcttgccctcgccggcgtcgtcgtggccctctcggtctcggcgatgtcgcccgcctccgcggcaggcacggtcctgaccaccggcagcgccggcggtgacgccgtcgccaccggtgacgtgctcagcgcctcgctggccaccggcaccgcggccacgctctactccagcgcgaccggcacgagcggcgtctcctgcagcgcgtccaccttcaccgccggtgtcgtggacaacccggccgcgtccggcacggccaccgagtcggtcaccgcgcacaccttcgacggttgcaccagcaatgtcatcggtgtcctcggcgtcagcggcgtcaccgtcaacaaccttccgtacaccaccaccgtgggctccgacggaaccgtcaccgtgactccggccagcggctccaccatccagaccaccgtcaagctcagcaccctgctgggcaccatcaactgtgtctaccaggcccccagcctgtcgggcacggcgagcaacaccgacaacagcatcaccttcaccaaccagcagttcaccaagacctcgggctcgtccctgtgcttcagcagtggctacttcaccgcgaagtacgccccggtcaaggacaccagcgtgtccggcagcccgtcggtcttcgtcaac

SEQ ID NO: 2158 - DNA, 672 bp, Streptomyces avermitilis
  CDS (1)..(672)
atggcctcatcctcggacgccacggcgtcccacggttccaccccccagaccccggaaagcggttccgccgccgaagggtccgaaagacgcgggcgggtccgcctgcgccgcgccgcggtgatggcggtgcctgccaccgcgatcgccgccggactggtgatcctcaccgcccagggtgccctcggggtgcagttcgccatatccggcatgccgttcacggtcaccgccaccgacctgaacggcaccggcttcgagcagttcggcaacctcgacaacatggccgagggcagcccgaacgccggtgacaccggcggccaggtcctggtcgtcacctccgcgatcaaggacgcgaccctcaccaagctgtgccagagcgtcgacctcggcggtacgaacctgcggatcgaggcgggcgccggcaaggacaaggtggtggcgagcgatctgaccaccgactccaccgagctgtccggcgacgccgagttcaacaagatcgagatcggcaacgacgcgagcacgctcgacaaggcgggggtgcagggcaacaagggcgtcttcagccagcaggccgacaccgtgcatatcgccaatctccggcagaccaactacgcgaccacggcgggggtgttcaagcttccgggcctgcacctcagcttcagcgacaaggcctgc

SEQ ID NO: 2159 - DNA, 417 bp, Streptomyces avermitilis
  CDS (1)..(417)
atggcatcgcggccgaggtccgccttcaggcggtggcgcgcgagccgtcccttctggggcggactgctgctcaccctgggcggtgcggaggtcctcctcaccgagaaggtgtcactgaaggtggtcatgcacatcggcatgcagggcctcgcgggctatctgctgccggtcgtcatgatgctgtgcggcctgctgatcctcttcaaccccgcccagcggctcttctactccgtcatcggcatcctggtgaccctgggcacctggctcacgtccaacctgggcggcttcttcatcggcctcctgctgggcgccacgggcagctgcctcgccttcggctggctgccggaccaggaaccccgccggcgcctgctgcgccgccatcggacgccgtcccccacggccgattcgcccgcgtcc

SEQ ID NO: 2160 - DNA, 798 bp, Streptomyces avermitilis
  CDS (1)..(798)
atgaaaagaaacggaacgctcgcgcgagagatcgtctccagccattcggtgttcggcgctccgtgctgggtcagcctcaccacccgcgacctggaagccgcggagaacttctacaaggcggtactgggctggcgctggcgcacgggcaagctcggcgaccggttccgcttcgcgctgtcggagggcatgcccgtcgccgggatcgccgcggtggcctcgcagtggcagatggcggccgcctggacgccgtatttcgcggtgcccagcgcggacgaggccgtgtcccgcagtcaggagcgcggcggtacgaccgcggtcgggccgatcgccttcccgcccggccgggcggccctgctggcggaccgcgacggtgccgtcttcggcatctgggagggacagctcgtcgccggctgggaccactggcgccgcgcggcccccgccttcgtacgcctccacacccgcgacgccttcgacgccgccatcttctacggggaggtcctcgaatgggcctccgcacgccccggcgcctgtcaggtccagtacgacgggaaggaggtcgtactgctcagccagggcgacgtggtggcgcggatccactccggggcggtgggagccgcgcccgacccccagctcagaccgcactggcaggtccacttcgcggtcgacgacgtcgaggcctgcgtccatgccgcccaggaccacggcggcacggtgctgcggtgggagcccggcgccacggaggcggtgctgagcgaccccgacggggcccgcttcacggtgaccgcccgcacgaagcgc

SEQ ID NO: 2161 - DNA, 486 bp, Streptomyces avermitilis
  CDS (1)..(486)
atggaccgacagcacacgcctgaccctcgcccgcgcttgtccgacgctcaccggcgcctgtccgatccccgccccggcctgtccgccccgctgctgtgcgagcgcccccagcggctctccctccccgtggaactgccggccggcctcggctacgacgccgtgggcacctcgccggagcacggcgagcggatcatggagtgcctcccgcgcgtcggctgtgtcttcgccgacgacctgcgctggtggtggatcgtcccctccggctcccacgtgggcgtcacctggccgtcctgcacgacctacgcgatcggggcctatctggccgacccgtcctggacccgggcatcgggccgcccccgccccggcggtccccgcctcatccaccgtcccgatggtgactctccgtacacgccaccgatcccgctgtacttcctcatctgccggctcgccggaatcagcccgagctggtcgctgggcgccgtgagc

SEQ ID NO: 2162 - DNA, 708 bp, Streptomyces avermitilis
  CDS (1)..(708)
atgctgagcagtccagttgggggagtcagggctgctcttgggcacgattcgaagcgagttggccgctggtgcgcgactcgcgacggcactgagcggtgtggcaccggcaccttccgtggtgcgacggcagatgaaaggcgaacggcgatggctccgccctccctcccccagcctttacgacgaccgggacgaccggcgcgggaggagcagcccgtcccccaggcgggcatcttcggccttcccgcgatccccgcctcggtggccgtggcccgcggccatgtgcgcgagctgctcgccgcctggaacaccgacgccgagacatgtgacaacgctgtcctggtggcctccgagctcgtcaccaacgcgatcatgcataccgccagcggccggatcgtgtgcagactgcgcaccgacggcgcgcgggtgcgcatcgaggtggaggacgagcaccggggccagaccctccccgcccagtgccggccggagcccgacgaccaggggggtcgcggactcctgctggtcggcgcgctgagcggcgactggggcgtcaagaacagcgcgtacgggcccggacacatcgtctgggccgagctgtcgccggacggaggagaccccgcctcgaccgggcttccggcgaccacgaacaccacccggcccgtcccccacctggccgaaggaccgtcatcccatggaccgacagcacacgcc

SEQ ID NO: 2163 - DNA, 873 bp, Streptomyces avermitilis
  CDS (1)..(873)
gtgaccgcggagaccgactggggcggcgcccccaccgtgctgcgcatgatcctcggcagacagctcgaggagctgcgcacccgggccggccgcacctacgaggaagcggccgcggcgatcggggtcagccactccacgatccgccggatggaatccgccaaggtggcccggctcaggctcgcggacgtcgagaaactgctccagatctacggtgtgacggaccagcaggagatcgacacgttcctgaagtcggtccgtgaggccaacaagcgcggctggtggcacacctaccgcgatgtgctgccggactggttcgccgcgtatctgagcctggagcaggcggcgctccagatccgggcgtacgaggcgcagttcgtccacggtctgctccagacggaggagtacgcgcgggccctgctgagcgccggaaacccgcacgccccggccgaggcgaccgagcgccgggtcgccctgcgcatgcgccgccaggaactgctgtcccgctctgcgccgccccgcctgtgggtggtgatggacgagaccgtgctgcgctggccggtcgggggccccaccgtgatgcgcgcccagatcgaccacctgatcgcgctcaacgcgctgccgcatgtgaccttgcagatcatgccgttccgaagcggtccgcatcccgcgatgcgggccggagcgttccacgtcttccggttcagggcacgtgagttgccggacatcgtctatctgagcggcctggtgggcgctgtctatctggacaagagcgacgatgtcgtggtgtatcgcgaggccctggaccggctgggcgcccagtcggcgcccgccaggaagaccgaggctctcctcggcgcgatacgcaaggagctg

SEQ ID NO: 2164 - DNA, 249 bp, Streptomyces avermitilis
  CDS (1)..(249)
gtgcaccaccacatacgcgacggccacatacgcaacggcatgccggcccgggatctcggcgcgcgcggctggtccaaaccgtggagcgacgacgcgggaggcgcctgcctggaggcgaagaagctcgccgacggccgggtggcgctgcgtcagtccaccgacccggacagcccggccctggtcctcacccccgccgaggtggctggcttcctcgcgggtgtgaagaagggcgaagccgacttcctcctt

SEQ ID NO: 2165 - DNA, 828 bp, Streptomyces avermitilis
  CDS (1)..(828)
atgggaggggcggcgttgcccgacaacggatggccggccgaccgtatcgacaccgagagtgcgcactccgcgcgcatctacgactacatcatcggcggaaaagactactacccggccgacaaggaggcgggtgacgccatgtcccgggagtggcccgcactcccggtccacatgcgggccaaccgcgactggatgaaccgcgcggtggcccatctggcgaaggaggccgggatacgccagttcctggacatcggaaccggcatccccacctcgcccaacctccacgagatcgcccagtcggtggcccccgagtcccgggtcgtgtacgtggacaacgacccgatcgtcctcaccctctcccagggcctgctggccagcacccccgagggcaggaccgcgtacgtcgaggcggacatgctcgacccggcgagcatcctggatgccccggagctgcgcgacaccttggatctgacccggccggtcgccctgacggtgatcgcgatcgtccacttcgtgctggacgaggacgacgcggtgggcatcgtccgccgcctcctggagcctctcccctcgggcagctatctggccatgtccatcggcaccgccgagttcgcgccgcaggaggtgggccgggtcgcccgcgagtacgccgcccgcaacatgcccatgcggctgcgcacgcacgcggaggccgaggagttcttcgaaggcctggagctggtggagccgggcatcgtccaggtgcacaagtggcacccggacgccgccaccgccgacggcatccgggacgaggacatcgcgatgtacggagcggtggcccgcaagccg

SEQ ID NO: 2166 - DNA, 1002 bp, Streptomyces avermitilis
  CDS (1)..(1002)
atgctccccacaccatccgagcccggaacgggaattgtgacttctaccgcgaagagcagcaggtcaaggacgagaaaccccggcgcggcagccgtcgcgctcgccgccacggcggcgctcctggcggcatgtgcggggtgttcgtcgtcctccggcgaagagtccgacccgctctcgggcgacaaggcgggcggcgacagcgtcgtcgtcggctcgaacaacttcgccgagagcatcctgatcgccgacatctacggcgaggccctgaaggccaagggcatcaaggtcacctacaagccgaacatcggcagccgcgagaccacttacggtctgctcaagaacggctctctcaccgtgctgccggagtacaacggcgcgctcctcgcctacctggactccaaggccacgccgaagacggtcgccaccacgaccgccgcgatcaacgccaagctcgactcgaagctgaagctgctcgacccggcgcccgcgcaggacaaggactccgtcaccgtcaacgccgccaccgccaagaagtaccacctcacctccgagtccagcatcgcggacctcaaggacatcgcccccgacctggccatcggtgcctctccggagttccagacccgacagcagggcctggtgggcctgaagtccgtgtacgggctgaacttcaagtcgttcaaggccctggacgccggtggctcgctgacccaggcggcgctgaagaagaacacggtgcaggccgcggacctcttcaccacggacccgaccatcaccaaggagaagttcgtggtcctccaggacccgaagaacctcttcgggttcgagaacgtgcagccgctggtctacaagtcggggctctcccagaagggcgccgacacgctgaacgcggtctccgccaagctcgacacggtggcactgctgaagatggacgccgaggtgcagctccagaacaaggacccgctggacgtcgccaaggcctggctgacgtcggccggcctggac

SEQ ID NO: 2167 - DNA, 2754 bp, Streptomyces avermitilis
  CDS (1)..(2754)
gtggggtggccgaatcgggggtctgaagaggcggtagtctcgcccgagttggcgacaaggcacagcggcgtgcgggggccgccgtcttccgaacgttctgtcgcggccccagtcgatgaatacggtctcgtgaaccttcgcgcgccgtggtccgcccacgaaggaggctcggtgtccacgaacaaggtggacgcgccgacccggccggccccgtcgccgaacccgggcggcaccggcggtttcgccgcccgctggccgttcaggcgcaagctcaacgccctcgtcggcgtaccgctggccgtggtcgccgcgttgctctgctacctcatcaccgaccaggtggaccaggcgcgcagcgcggccgccgccgcccaactggtccgcgacagcgcgcaggtcgccgacctcgtcgaccgggtggagaacgagcaccagcaggccgtcctgctctccgtgcgctacgaggccgccgccggcgccgacgcccggcccgcgctcacctcctaccgcagggcccaggccgccgtggacgcgcaggtcgacaaggtgcgcggcacgttcggcgaccggctgcccgacacggaggcgcaggccctcaaggagatcaacggcctgggcagcctgcgcggcaccatcgaggagggctacctgcccgccgacaacatcgacccggcctacaccaacgccgccaaggggctgctcgacggcctcggactcgaccgcaacgccgccctcgccgccaccttcaccggcaatctgctggactccctgctgcgcgccgacgccgcccacagctccttcgagaccagcgtgttctcggcgacgaccggtgactccaacgcgctcatcgagttcaccaacgccgtgggctcctacgagctgtacacgtaccaggcggaccgcttcgcccggttcgccaccgagcggcaggcggacgaactctccgggatcgagcacagcacggcgcagcgggagatcgccgaggcgtacgccgagctccagatcgaccccagcggactccaggcgaacacgccgtcccggatccgcgcggcgttcgcggacgccctgcgcgactacccggcttatccgaagcaggccgagagccggctgaagatcgccgcctcgctcatcggccagatcgccgaccgcgccgacgacgcgtccagcgaggcctggtggcgggccggtctgctgctggccgcggctctgctcggcttcgtcctgtggctcgccttctcggtggcggtccggcggtcggtcgtacggccggtggaggctctcaccgatgccgcgcaggaggtcttcgacatcaccagccgggaactcgcccgggtggccgacgacgacgccgaggacctgggcccgctccggctgcgcgaggtgcccgtccccgtacgggacgagatcggcgaactcgccgaggccttcaaccacgtgcagtccaccgcggccgccctgctggagcgccaggtgctcagccgtcgcaacgtcgccgagatgttcggcaacgtcggccgccgggtcagcaacctcaccacacggcagctcgccctcatcgacgccgtcgaacgcggcgagaccgaccccgcgctgctcgaccggctgtaccgcatcgaccacatcgcggtccggctgcggcgcaacgccgacagcctcatgctgctggccggcatccgcgagaccgtgctggactccggccccaccgcgctcaccaacgtggtgcgcgccgcgctcggccagatcgagggctatcagcgcgtccggctgcgcgccgagaccgaggtcatggtggagcccgacatcatcggcgacctgacgctgatggtggccgaactcctggagaacgccgtcgcgttctcgcccgtgggcagccccgtcgaggtggcggtgcgcgggaccggtggcgacggcgcgctgatcgagatcgccgaccacggtctgggcatgagcgccgagcgcctcgacgaggagaacgcccggttgatccgccgcgagcgcctggacctggtgccgaccaaggtgctcggcctcttcgtggtcggcagcctcgcccggcgctgggacgtcggggtgacgctgtcccgcacccccggcggcggtgtcacggccgaggccgtcatcccgtccacactgctgctggcgatgagcccgctcaacgtcccggccgcggtggcaacagccccggccgctgccaccgtcgaaccggggcccgccactccttcctcgcccgccacctcgtcctcgtccgccgccgccaccctgccccggcacggcgagaccgagtcccggccgggcgcgctgccccggcgggtgccccggcgcgagacggcgcccgcggagaaggcggaggagacggaggacagggaggaggcggaggagacagcctcgggcacggcgccggcgctccaggaccgcaccgagcggacgctcctcccccacgacgacaccggcgcggcccgcccgctgcgccgccgggtccgcggggccaccctccgcaccacggccgccgaggccgcccagcaggcggcgcacggccccgcccggcccgccgacgcgcacgaggtccgctccgcgctcgaggagttcgaggccgccgtggagcgcgcacaccgggacagcgggaccggcaccccggccccggccccgcagccgacacccgaccagaactaccagaaccaccagagcgaccagagcgaccagcgtcatcagaaccaccagagtcatcagaaccacctcccggaaggagcggagcag

SEQ ID NO: 2168 - DNA, 474 bp, Streptomyces avermitilis
  CDS (1)..(474)
gtgagcacgtcgacaggtgacactccggcgggaggcaccacgcccgccgaactgcgcgccgcagcagccgacttcacgtggctcctcaaccgattcgcgaccgagaccgcgggcgtcgtcgacgccatcgccgtctcctccgacgggctgctcatcgccgtttccgagctgcgtgagcacgccgactccgaacggctggccgccatcgtctccggtatcaccagcctggccgccggagcctccggcaactacggcctgggcggcctcaacaaggtcatcatcgacctggagggcggccacgtcctggtctccgcgatcggcagcggcgcggtgctcggcgtggtcaccgacaaggaggccaagctcggcaacatcgcgtacgagatgacgctgttcgccaaccgggccggcgccgcgctcagcccccaactcgtgctcgaactgaagaactccgtcggcgtcacgtcgacgggg

SEQ ID NO: 2169 - DNA, 438 bp, Streptomyces avermitilis
  CDS (1)..(438)
atggcggacggccgtactccggccggcgaggaccgcttcacggccccgggtcccgacccggtcggccccgcccccgccgtgcggccgttcctggtcaccgcgggccgggtggcgggcaccaggtccggcccgccgatcccggtcgagacccaggtggtggccaccgccgagggtctcgaccagctcgaccggctctcgttcgagcagcacgacatcgttgccgcgtgccggcagccgcagtccatcgcggagctcgcggcccggctgcggctgcacctcaacgtggtccgcgtcctggccgaggacctgcgctccgaaggacggctgtcggtgtaccttccgaaccccggcatcacccaggacgcgtccgtactgcgaagggttatcgatggtctccgcgccatccccgactcccggggggtactccgtgacaccgac

SEQ ID NO: 2170 - DNA, 573 bp, Streptomyces avermitilis
  CDS (1)..(573)
gtgacaccgactgaacaggccgccgtacggccgccgctgccggtcaagatggtgatcgcgggcggcttcggcgtgggcaagaccaccgccgtcggctcgatttccgagatcgtcccgctgaccaccgaggcggccatcaccgaggtcgcggcgggcgtcgacgacctcacccacaccccgcgcaagaccacgaccacggtcgccatggacttcggctgcatcaccatcgacccgacgctgaagctctatctgttcggtacgccggggcaggaccggttcgggttcatgtgggacgacctggtcgagggtgcggtcggcgggctcgtcatcgtcgacacgcggcggctcgacgactgctacgcggccgtcgactacttcgagcacaagcagatcccgttcgccgtcgccctcaacgccttcgacggcaggatcgagcatgatctcgacgaggtccgctgggcgctcgacgtcgccgagcgcgtccccgtcgtcgtcttcgacgcccgggaacgcggctcggtccgcgacgcgctgctcgtcgtactggaactggcgctggcccgcaccggggca

SEQ ID NO: 2171 - DNA, 666 bp, Streptomyces avermitilis
  CDS (1)..(666)
gtgaacgtactgcacttcatcaacgccttcttcagcgacagcgcccactggcacggctacgacggcatcccgcgccggctcctggagcacatccagtactcgctgatggccctcggcatcgccgccgcgatcgggctgccggtggggctgctgaccgggcacaccgggcgtggcggcaacgcgctcgcgttcctcgccaccgccgcccgggcgctgcccagcttcggcctgctggtgctgatgttcgtcctgctcggcctcgggctgctgcccgtgatgatcccgctggtcgtgctcgccgtgccgccgatcctggtgaccacctacgaggcgatgcgctccgtcgacccgtcgccggtcgacgccgcccggggcctgggcatgcacgaggcgaagatcctgttccaggtcgaggtgccggtggcgctgccgctgatcctgagcggcctcaggtcggcggccatccagatcgtctcgacggccaccatcgccgcctacgtcagcctcggcggcctcgggcgctacatcgtggacggcctctaccagcgcaactacgagaaggtggtcggcggagccacgctggtggccgtgatggccctggtcaccctcgggctgttctggacggtcaaccgggtcgccgtgtcgcccggggtgcgcaggagcggc

SEQ ID NO: 2172 - DNA, 720 bp, Streptomyces avermitilis
  CDS (1)..(720)
atgaacggcttcttcgacatccccagcgacctccagcacagctatctcgggctcatcggactgcacctgaaggaggccctgctgccggtcctggccggcctcctcatcgccctgccgctcggccagctgtgcgtgcggttccgctggctgtacccgccggtcctcggggtgacgaccgtggtgtacgccatcccgtcgctggcgttcttcgtcgtcctcatcgactacaccggccagagcgagatcaccgtgatgatcccgctggccctgtacagcctggtgctgctcgtcccggccatcgtggacggcgtcaggtcggtgccccaggagacactcgcggccgccaccgccatgggcttcggccccgtacggcgctacgtccaggtgcagttgccgatcgcggtgcccgccatcatcgccgggctgcgggtggcgaccgtctccagcatcagcctcgtcagcgtcggcaccctgatcggcaaccagggcgccctgggcaacctgctcgccgacgcgatgttctaccaccggcccgcactggcggtgaactccgtggtcaccacggcggtcctggcgatcctcatggacgccgcgctggtactcgtacgcgtcctgctgacgccctggatgccgcgcggcacgcgctcggcacggcgcgccccgcgggacgactccgcccggcccgaaccggccgcgctcgcccttaaggacgcggtccgg

SEQ ID NO: 2173 - DNA, 1125 bp, Streptomyces avermitilis
  CDS (1)..(1125)
ttgatacggatagattcagtcaccaagcggtacccggacggaacggtggcggtcgaccggctgtcgttggagataccggaccgctcgatcaccgtccttgtggggccgtcgggctgcgggaagacgacgaccctgcggatgatcaacaggatggtcgagcccagcgagggcacgatcctcctcgacggtgccgacatcacgaagcaacccgtgaacacgctgcgacggtccatgggttacgtcatccagaacgccggtctcttccagcaccgcaccatcgtcgacaacatcgcgaccgtgccccgcatgctgggctggggcaaggagcgggcccggtcgcgggcgagggagctgatggagcgggtggggctcgacgcctcactcgccaggcgctacccgtaccagctgtcgggcggacagcagcagcgcgtcggcgtggcccgggccctggcctcggacccgcccgtgctgctgatggacgagcccttctccgcggtcgaccccgtggtgcgcaagggacttcaggaggaactcctgcggatccaggacgagttgggcaagaccatcgtcttcgtcacccacgacatcgacgaggcgatccggctggggacgatggtcgccgtcatgcgcaccggcggccatctggcccagttcgcgccgcccgccgaactgctgtccgccccggcggacgccttcgtggaggacttcctcggcaccgaccgcggcatccggcgcctttcgttcttcccctccgccgggctggagctgctgaccactccggtcgtcgcgatcgactccaccgccgagcagatcgccgcccgcggcacgccggacgtgccctacctcctcgtgaccgacgtcgacggcaaggcgctcggctggagcgagccgaaggacctcaccgccgggaaggtggtgcccgaacggctgctgccgtacggtcggcccttcgagtccggcaaagactcgctgcgcgcggccctggactgcgccgtgctctcgcccaccggctgggccgtcgccgtggacggcaccggacgggtggtcggggtcgtctcgcaggagacgatcggcgaggccatccgcggcgcccacgccgagcggcggaaggcggacctcgccgga

SEQ ID NO: 2174 - DNA, 1974 bp, Streptomyces avermitilis
  CDS (1)..(1974)
atgtttcccccaccgcgctcgaccggccggagcttcggccgccgcctgcggatcgccgccgtccgcgcactcgtcctcgcgctcaccgcggccgccaccctcctcttcgtccaaccagcgcccgcgcaggcggcggtgacgacacgtcagataaccgttcccagtgcgccgatgggctgggcctcctggaacagcttcgccgcgaagatcgactacagcgtcatcaagaagcaggtcgacgcgttcgtcgcggcgggcctgccggctgccgggtacacgtacatcaacatcgacgagggctggtggcagggcacccgcgacagcgcgggcaacatcaccgtcgacaccgccgagtggcccggcggcatgagcgccatcaccgcctacatccacagcaagggactcaaggccggcatctacaccgacgccggcaaggacggctgcggctactactacccgacggggcgccccgccgcgcccggctcgggcagcgagggccactacgaccaggacatgctccagttctccacctggggcttcgacttcgtcaaggtcgactggtgcggcggcgacgcggaagggctcgacgcggcgacgacgtacaagtccatcagcgacgcggtcggcagggccgccgccaccacgggccggccgctcaccctgtccatctgcaactggggctaccagaacccctggaactgggccgcgggccaggccccgctgtggcggacgagcaccgacatcatctactacggcaaccagccgtccatgaccagtctgctgtccaacttcgaccagaccctgcaccccacggcgcagcacacgggctactacaacgacccggacatgctcatggtcggcatggacggcttcaccgccgcccagaaccgcacccacatgaacctgtgggcgatctccggcgcgccgctgctggccggaaacgacctgacgaccatgacgtccgagaccgccgggatcctcaagaaccccgaggtcatcgccgtcgaccaggattcccgaggcctccagggcgtcaaggtcgccgaggacaccaccggcctccaggcgtacggcaaggtgctgtccggcaccggaaaccgcgccgtcgtcctcctcaaccgcacctccgccgcgcacgacatcaccgtccgctggtccgacctcggcctgacgaacgcgtccgcgaccgtccgtgacctgtgggcccggcagaacgtggggacgtccgccaccgggtacacggccagtgtcccggcgggcggctcggtgatgctgacggtcacgggcggcacggaggcggcgggcggcgcctacgcggccacctccacggggcgctacacgggcgtgaccgccgccagtaccggcctgaacgtcgtcgacgtcgcctacaccaacaacacgagctcggcccgcaccgccacgctccaggtcaacggccagaccgccaccacggtctccttcccgccgaccggcgcgagtgcgggcacggtctccgtcgaggtctccctctccaagggctccgccaacacgctcgccctctcgggcggcccggccaccgagggaatcaccgtccggccgctgcccggcacgaacggcgccctggtcaccggcaagcagtccggccgctgtgccgacatctacaacaacacgatcaccaacggcacccaggccgagttgtgggactgcaacggcggccccaaccagtcctggacgtacacctcccgcaaggaactggtgctgtacggcaacaagtgcctggacgcctacaacctcggtacgaccaacggcaccaaggtcgtcatctgggactgcaacggccaggccaaccagaagtggaacatcaacagcgacggcacgatcaccaacgtcaacgccggcctctgcctggacgcctacaacgccgccacggccaacggcacctcgctcgtcctgtggagctgcggcaccggtgacaaccagaagtggacggtgacg

SEQ ID NO: 2175 - DNA, 1023 bp, Streptomyces avermitilis
  CDS (1)..(1023)
atgaacgcttccctccgacctcacgctccccgcagctccgccccacccgcccggggcgcggccctggccgccggcgcggtcgccgtctgcctgctcgcggccggctgctccgcttccgacgggtcggacgccggcaccgaagcggcgggccgggcgggcaccgcccggatcaaggtggccctggtgacccacggcgagcgcggcgacgccttctgggacctggtgcgcaagggcgctcagacggcggccgccaaggacggcatcgagctgacctacgtcagcgacgccacgggggcgggacaggcggagctgctgcgggacgcggtccgcgaccgggtcgacggcatcgcggtgaccctggccaagccggaggcgatgaagggcgcggtcgccgacgccatggccgccggcataccgatggtcggcctcaactccggtatcgacgactggcgttcctacggcctgctcgagtacttcggccaggacgagagcctcacgggccgtgcgctcggcgacaagctggacgccctgcacgcccagcacgccctgtgtgtcatccacgagcagggcaatgtggcgctggaggcgcgctgcgccggggtgaagaagacgttcggcggccggacggagatgctgtacgtggacggcgccgacccgaaggcggtgaccgcctccgtcacggcccggctgcggcaggacccgagcatcgacgaagtcgtcacgaacggggcggagatcggcctcgaggcggtgaagtcggtgaagagcgcgggcagcaaggccaggatcgccaccttcgacctcagcaagaacgtggtcaaggccgtgcagcgcggggatgtgcagttcgcggtcgaccaacagccctatctccagggctatctcgccgtggactcgctgtggctctaccggtccaacggcaatctcagcggcggcggagaggctcccgtgctgaccggccccgccttcgtcaccaaggagaacgtcgccgaggtcgcgaagtacgcggccgacggaacccgc

SEQ ID NO: 2176 - DNA, 2487 bp, Streptomyces avermitilis
  CDS (1)..(2487)
atgtctcgacgaacaggtgcccggcgccgcctcggctccatacgtctctcgctgatcctgctggcgctgctccccagcgtcaccctcgccgccatgtggggtgtgacgacgaagcagatgttctcggagggtctggagttgcggacgcagaccgagctgagcatgtcgaccggggccatggggaccgacgcgacgctcgcgctgcaacgggagcggagtctgtcggccgcctggctggcctcgcccggcggttccagagccgccctggacgagcagcggcgacggacggacgcggcggtcacccggctggtcggccggtccgacgagatcgagatggccccggcccgggtcggggaacggatgtacccggtcatggccgcggcgaagagcctggagtactaccggggccaggtggacgacccgaccgacatcaccgccaagcaggccctggaccagtacacctcgatcatcgacaaccaggtccacgccttccaggagctctcccaggtcgacgacggggatctcacctcgcaggccggcccgctcgtcgcgctggaacacgccgcggagatcgtctcccaggaggacgcccagctgacgctggcctggccgtcgggaaagctcgacgagaagtcgtgggtccgcttcgcgcaactggtcgacgcccggcgctggctcgtccaggaccagctcgtcccctcgctgcgcggcagcgcgaagacgcagacggaccggatcctgcagagtccgcaatggcagaccctggaggacgtcgaggaccaggtcatcgcggcccggacggcgaacggcagcgtcgcgcggaccatcgagctgccggacgcgcgaaagcgctggagcgccgcgctggaccaagtctccgcgcagtacgcgaacctgatccaacagcagacctcggccctgctcgaccgcagcagtgacaaggcccgcggactgctgatcaaggcggcctcgctgagcgccggcggactcgccgccctgctgctgtgcgtcgtactgtcctggcgcatcacccgctccctgtcccggcggctgcgggggctgcggatggccacgctcagcctggccgaggagcggctgcccgatgtggtcgcccggctcgaccggggcgagaaggtcgacgtggactccgccacaccgccgctggactacggcagggacgaactcggccaggtggcccaggcgttcaacaccgcgcagcgcacggcggtccacaccgcggtggaactcgccgacacccgacgcggcttccagaaggtcatcctgggcatcgcccggcagagccagaacctggtcaacctccagctcagcaagctcgacgaactggaacgccggcaccaggacccgcacatcctggagggcctgtacgaactcgactccaccgcgagtcagctccgccgctacgaggagaacctcgtcatcatcagcggcgaacagccccggcgcagctggaccgagccggtcgccctgatcgacatcctgcgcagcgccgtcggcgaggtcgccgagtaccagcgggtggaggtgcacaccgacgaagaggtgttcctgaccccgcccgcggtggccgacgtcatccatctgctggccgaactcatcgacaacgccaccgcgtactcccccgcgcccagcccggtgggcgtgcgggccgcgatggtggccaaggggctggccgtcgaggtcgaggaccgcggtctcggcatgtccgaggaggactacgcggccctcaacgcccagctcgcggtggtcccgcagttcgacgtggtggccctggccgacgacctccggctcggcatgttcgtgatcgcccggctcgccacccggcacggcatcgccgtcaccctgcgttcctcgccgtacggagggaccaccgcgatcgtgctgatcccgcacgccatcgtggtgcgcgaggcctccggctccccgtccacgaagtccacggacaccgaaccggccggctccgccgacgcacggaccgtcgaaccggccgcagcggcgaagggcaccgccggcaccccggatccggcccgccaaccccacgaacgcacgcgggaggcgcggccggccgcgcgggcccggacggccgaagtccccgcgaacggagcggagtcggacaccgaaggggtacgcaggacggcgggccgcacgccccgccccgaacccggtggcgtacgccgcgagggactcgctccgctgccgcggcgggtgccgcagaccagcctggccgccgagctgaaggaggaggccgcgcccggccgggaggacgacgacccctgcgaggacttcaccgcggagcgtgccgccgcctcgctcgccggtttccagcgcggaacgctccaggcccgggacaccaccgccgagggggcgtacgaccaccgggaggaagccgccgccgaagacccggacgcccgggttcccgccccgggcgcatcgtcccccacgctctcgactccgcccgcagaccgctca

SEQ ID NO: 2177 - DNA, 429 bp, Streptomyces avermitilis
  CDS (1)..(429)
atgacacgccccacccccgccacgcacagccagctcgaccagttgctcaccggactggtcgaccgggtcgccgaggtggaccacgccgtcgtgctctccgaggacggactggtcgtcagcaagtccaccgggttcctgcgcgacgacgccgagcggctcgcggcgaccgcctccgggctgatgagcctcagcaagggcgtcagcatggacttccgccgtggcccggtgcgtcaggcgctcatcgagatgggcaagggctatctgatcctcaccgccgccggccccggcgcccatctcgtcgtcctcaccagacagggcgcggacgtgggtgtggtggcgtaccagatgaacatgctggtgaagaagatcggcgagcacctcagcgcgccaccgcgtgggggcgcgggcaccgcggccgacagcggcgag

SEQ ID NO: 2178 - DNA, 354 bp, Streptomyces avermitilis
  CDS (1)..(354)
gtgacggatggcgacgcggctggtcgtctggtgcggccgttcacgctgaccggtggccggacccggcccagccgggccgacttcaccctcatcacgtcggtgaccgcggtggaacggccgcccgccgggagcttccgtccgcagcccgagcacacccggatcctgcggctgtgcgcggagccggtcgtggtggcggaactcgccgccgggctcgaccttccggcgagcgtggtcgtcatcctgctctgcgacctgctggaggcgggccggatcaccgcccacccgccgcgcctcctctcccgcaccacggacctggacctgctgcagaaagtgagggacggccttggccggctc

SEQ ID NO: 2179 - DNA, 582 bp, Streptomyces avermitilis
  CDS (1)..(582)
ttggccggctctgaccccgccgcacctgccgcccccgcggccgcggcacccgacacggtcaagatcctgatcgccggcggattcggcgtcggcaagacgaccatggtcggttccgtcagcgagatcgcgccgctgcggaccgaggaaccgctgaccgccgccggcctggacgtcgacgacctcgacggcatcgcggagaaggacgccaccaccgtggccctcgacttcggccggatcacgatcggctcggaactcgtgctgtatctcttcggcacccccggacagcagcggttctggttcatgtggaacgacctggccatcggggccctgggcgcggtggtcctcatcgatgtgcgcaggccggagtccagcttcgccgccgtcgacttcttcgagcggcggggcatcccgttcgtcatcggcgtcaacggtttccacggactgcatccgtacacgcccgaggagatccgggaggccctggccctgccggagcgggcccaggtgctgctgtgcgacgcacgggagcgcgagtcgtgccgggacgtactgatcgccctgatcgaccagttgatcgccgcccgc

SEQ ID NO: 2180 - DNA, 735 bp, Streptomyces avermitilis
  CDS (1)..(735)
gtgcggcgcgtcgaacacgtcatggggttcccggtctcgctgcggatcgacgacgagggcgacttcgacgcggccgcggacgcggtgttcgcctggctgcgggaggccgacgcgcggttcagccccttcaaggccgacagcgaggtgtcccggctggaccggggcgagctgcgcgaggacgcgctcagcgcggatctgctggaggtcctcgacctgtgcgagcactaccgggccgccaccggcggagccttcgacgtgcggctgcccggccgtggcctggacccctgcgcggtggtcaagggctggtcggtgcagcgggcggcggagctgctgtcggcggcgggggcgcggaggttctgcctgaacgccggcggtgacgtggccgccgccggcggtccctggcgggtgggcgtacggcatcccgaacacgccgacaagctgtgcacggtcctggagctcaccgacggggcggtcgcgacctccgcgcgctacgaacgcggcgaccacatccgcgacgggcgcaccgggcgaccggcgaccggcctgctcagcctgacggtcgtggcgccgacactgaccgaggcggactcggtcgcgacggcggccttcgcgatgggcacggagggcgtcgagtgggccgccgggctggacggctgcgaggtgttcgccgtggacgccgagcgtcgggtcctgcgtacggcgggacttccggtggccggggcgcgggcggccgca

SEQ ID NO: 2181 - DNA, 417 bp, Streptomyces avermitilis
  CDS (1)..(417)
gtgaaacgagcacttcctgtcctggtcctgagcgtcgcgggcctgatcccgctgtggcgctacgaaccgtcgaccgacacgacgtccaccacccagaccgccccgcccgccgcgtcgccttccgcgtcctcctcgccgggttcttcgccgggttcttcggcccaggtcgtcgcggggtcgaccgtcaagaccgagaagggccccgtgcaggtcgaggtgaccttcgagggcgacacgatcagcgccgtgcggatgttgcggcagccgaaccatccgcagacgacggcggcggtgccgaagctggtcgcggagacgctgaaggcgcagagcgcggacatcgacacggtgtccggcgcgaccgtcaccagcgacgggtacaaggagtcgctccaggccgccctcgacgcgaagggcgcc

SEQ ID NO: 2182 - DNA, 1416 bp, Streptomyces avermitilis
  CDS (1)..(1416)
ttgaaagtccggcgacaggaaaacgacagctctcgccagcgaagctcggtgtcccaggacccgatcaaggagctgccgtccgtgacgaccgtccaatcgccccctgcgccccccacggcgatacgccccagggtggtggcccgcgcgggcctgtacgccgtgctggccgcgaacgcggccgtggtggccttcctcttcgcccaggccgggttcgcctcgaacgcgctgatcgtgctgggccggctggccggcctgtacggcgccctcctgatggcctttcagctgctgctggtggcccggctgccgtggctcgaccgccggatcggcatggaccggctgaccagctggcaccgctggaccggcttcggcatcctgtggacgctgctcgcgcacgccgtcttcatcaccttcggttacgcacagtcgtcgtcgatggatccggtgaaccagctggtggacctcgccgagaccgtcgagggcgtgctccgcgcggtcgtcgccctgacgatcatcgtcgtcgtgggtgccgtctccggccggtacgcccggcgccgactggcctacgagacatggcacttcatccacctgtacacctacgtcgccgtggtgctcgcgttcacgcaccaggtcgcggccggtacgaccttcacctcgtcgtccgccgccacggcgtactggtacgccgtgtggggcgtcgcgctcggctcggtgctcgtgggccggctggtgctcccgttgtggcggaactggcgtcaccaactgcgggtcacggccgtggtcccggagtccgacaacgtcgtctcgatccacatctccggccgcgacctggaccggatgcccgcgcgggcgggccagttcttcctgtggcggttcctgacccgggaccgctggtggcaggccaaccccttctcgctgtcggccgcccccgacggcacgcggctgcggctcaccgcgaagacggccggcgacggcaccgcggccctgcggcatgtgaaggtgggcacgcgggtcttcgccgaggggccgtacggcgccttcaccgcgatgcaccgcacgcgtccggagtccctgctcgtcgccggcggggtgggcgtcacacccatccgggcgctgctggaggacctggaaggccacgcggtggtcatctaccgggtggccgaggaccgcgacgccgtcctctacgacgagctgcgggaactcgcccacgccaagggcgccgaactccacctggtgaccgggccggccgcccccgacaggctggccccgagcgaactcgcccgcctggtaccggacatcgccgagcgggacgtcttcctgtgcggaccgcccgggatgaccaccaccctgctgcgcaccctgcgcgagctgggcgtgcccaagcagcagatccaccacgagcgcttcagcctggccgga

SEQ ID NO: 2183 - DNA, 786 bp, Streptomyces avermitilis
  CDS (1)..(786)
gtggcccgctctggcgccctgggacacgtgaagcactatgagcaggtggaaaaagtacgactcctcgtcgtggacgacgacccgcccatcgccgacctcgtggcgacggtcgcccgttacgagggctgggacgcggtcaccgcgtactcgggcgaggaggcgctgcgcctggccgcggagttccctccggacatcgtggtgctcgatctgatgctgcccgacatcgacgggttcggcgtcctcgaccggctgcgtcggtccgggacgatggtgcccgtcgtgttcctcaccgcccgggacacggtggccgaccgggtcgcgggcctgaccaggggcggcgacgactatctggtcaagccgttcgcggtggaggagttgatggcccggctgcggaccgtgctgcgccgcagcgccggacccggtttccagcggtccgtgctccgggtggccgacctgacgatggacgaggacacccgtcaggtgcggcggggcgaccggctgctgacgctcacgccgaccgagtacgaggtgctgcgctatctgatgcgcaagtcgccggccgtgctgaccaaggcgcagatcctggaccacgtctgggagtacggcttcgggggccgctcgaacgtcgtggagctggtcgtcagccgcctgcgccgcaaactcgacgaagccgacgctgccgatgccggcgacgtcgccgccgaagacagcgcggccgacgcgggcagggagccgctgatccacacggtccggggcttcggatacgtgatccggccggcggcccgg

SEQ ID NO: 2184 - DNA, 1434 bp, Streptomyces avermitilis
  CDS (1)..(1434)
gtgaccgggcggctgcggcggacgtaccgcaggctgcgcctgggcacccggctggcgctgggccttggcgtgctgtccctcgtcgtgttcgccgtcgtcggcacggcgctgaccacgtacatgcgcgactatctggaagcccagctgggcgaccagatgaagctcgtccaggtcctgcagtcgaaggacgcccaagtgcacggcgtcgtgcagcgccagccgtactacggctggtacaccgcggtgtacgacgtctcgggcgactcggccgtgctgcgcaggccggccgacgtaccggccgacacccgggcgctcaccgctctcgccgagacgatggcgcactcggacacggaccttcggcgcaccgtgcggatcgacggcaagggcacctaccggctacaggcgtgcgaggtggaacccggtgtggtcctcgtcagtgccgcgcccatggcggacgtccaggcgaccgtgcggcagctgatcacggtccaggtggtcgcgttcgtcctcgcgctgctggccctggtggtgttcggccgggcgatgctgcggcgcggtctgaaaccgctgagcgacatggcgcacaccgcccacggcatcgcctcgcacaatctgaccgggtcggcggcgcggctgccgctgcgcgacgacggccgcagcggcggtccggaggtcgaggagctgcgcaccgcgttcaacaccatgctggagcacatcgacggttcgctcgccgtccgcgcggaggccgaacagcggctgcgccgcttcgtcgcggacgcctcgcacgagctgcgtacgcccctgatgtcggtacggggttacgcggacctgttccagtacgcggccgccaacgcgcccggggaacgggacaggcatctggcgcggctgcgtgccgaggccgccaggatggggctgctcctggacgacctgctgctgctcgcccgcctggacgccgcggaggtggagacaccgctgcggatggaggacgccgacctggtggagctggtgcgccaggcggcggacgccttccgcgcgggccacccggaccgtccgctgacggtgacgaccggtcccgacgccgtaccgctgcggctcgaccccctgcgcatccggcaggtgctggacaacctgctcaccaacgccgccgtgcacacccccgccggaacggaggtgtccgtggaggtctcggtctcgtccggcacggcgtgggtgggggtcgccgactcgggcccgggcgttccggcggccgaccgggagcgggtcttcgaccgcttctaccgggtggacaaggcccgcagccgcgaccgcgggggcagcggcctgggcctggcggtcgcccgctccctggtgcgggcgcacggcggcaccgtcgcactgaccggcgaaccgggggcgacggtcttcaccctcgggatcccgctgggccgcagggac

SEQ ID NO: 2185 - DNA, 1941 bp, Streptomyces avermitilis
  CDS (1)..(1941)
gtgtgcgcgagcacccgttcgccctgcacgcctggacgtcttcggcgggcctgtgcatccctgacgccgatccgcgagggcacgcgttcgcgccggtgctctcgatcagttgcgcggggcagtgacgtggaagcgctccgcctcgagtgggccgcgggcgcaccgaggctccgggcgaccgaggccatggcgcggcagggactcgtgacgacggtctcctcccgggccggcaccgcggtggtcgtcggctgggccggctcggtccgtgaccgcgtggcgggcgcgcacggcctcctggacgacttcggccgaccgggagccgcaccgcgtctgccggccggcgactatgcggctgtcctggtgtgccgcgaccgcgtcctgctgatgcgggacgagcaagcacgcatccccctgttcttcagggagtccggcggacaggtgagcgcggtgagcacctcggcgcgccggctgggcgacttcgaagagctggaacgtcgctacttctgccggtacctgaccgggaacatggcgcaaccgcactcggaactcacccctttcgccggcgtgcaccgggtcctcggcggcgaggtcgtggagctctcgatcaccgggcggatgcgcggtcgggcgctgggacgcgtcggtcacgccgaccacccgtgggactcgacagcggacgggctccggctcagcggggccgcgaaggagctgcgcctcgcactggagcacgccgtcgggcgccgcatgggcaccatgacggcgtgtcacgtctccggcggcaccgactccaccagcgtcgcgttgctcgcagcccgtccgacggccgcgggacaggacagccccagggaccttgtcctgctcgccgggcgcttcggcacaggagagctggcgggggagcagccgtacctcgacgaggcgatgaaggagatccaccggcacgcacccggggcccgcccggtgatggtcgatgtcggcgacgtggctgacttcgacgacttccaggaccacgcgggagacgcggacgagcctcatgcgcacgcctttcgcgccccgttctggagcaggctccatgccgctgcggcggagctgggctgtgacatcctcctgaccggctgcggggccgatgcgatggtggacgccaacccctttcacctgcacaggctggcccgcacagggcagctccggcagctgacgaagcaggcacgtgcctgggccgcgggcagcgagcgtggcgtgcgggacgtcgtctgcgactacgtcatgcggccggctcttccgctgaccgccgaacggatcaccgcgctcgtccgccgcggaacggtgctgggcggcctcggcagcttcacccgcccccgatggctgcgacccggattcgcgcgggctcacggctaccgtgaggccggcatcgcggagagccgcttcgtgttcgggcgcaggccggaacagtcgctcttcgaggcggccaattacctcgccgctcccgacccgctctcctggcgccgcgcacggcaggacggattcttcctctcgcacccctttctcgaccacgaggtcatcgccacgatgcgcagcctccctccggaagccacgttccgtccgggccgtccgaaggcggttctgcgcgaggccatggcggatctgcttccgtcccggatccgcggccgagcggtcaaggtccccttcgacgagctctacgcccgcggcctgcgcagacacggcgacgaactcatcgacctctgccgctccgcgaggcatccgctggtcgcggagatgttcgacgtggagacgctgtgccgggctgtgagggaggctcagctcggggtgggcgacgcgtactcctgggaccggatgaacagctctctcgccctggtggtgtggctcgagcggctggaccggcgcggctgtgcgggtggtgcgggcatgccggtcatcgccggctct

SEQ ID NO: 2186 - DNA, 624 bp, Streptomyces avermitilis
  CDS (1)..(624)
gtggcagaggagaccgatgccctggcggccatgacgcggatcctgtcaccgcactgccgggtcaccaggatgtccggcggagctctgatcgcggactggaggcggcggacgcgttttctcggcatgactgcgacggacatgcggaagttcgccgacggaagctctgaggaacgcgccgaactcgtcaccgggctcatccgtgccgggtgtgcgacggcccgccggaaggggcactcggacgtcgaggtcgggctctggttgcgcggagtgcacctgctgatccggaccctgggattcgggcgcgtccttcggctcctgtccttggcggccccggtctacgcccgtgccgaccccccgtccgcggaggacgtcgagcggttgaaacgagcggtgcggtcacacagccgcagcagttggttcgtcaacgacgactgcaagaccgaggccgtgacggctttcgtcctgctgcggcggtgcggcctgaaggccgtgctccacgtcggtgtgcgcgagcacccgttcgccctgcacgcctggacgtcttcggcgggcctgtgcatccctgacgccgatccgcgagggcacgcgttcgcgccggtgctctcgatcagttgcgcggggcag

SEQ ID NO: 2187 - DNA, 3633 bp, Streptomyces avermitilis
  CDS (1)..(3633)
gtgtccgcggatgccgtacacgccgtgcgggcccccgtgccggtggtggccgagtgcgtcctgggcggagccgtcctcgccgtcgtctgtgtgcggctcctgctgacctctctgtggccggtcgcgctcacggtggacatcgacggcatcgagtggcacgggccgctgcgccggctgcggtggtcctggccggaactcgactggctgtgcgtggtcccggccgtggaccggcgcatcctgcgcaccggccaccgtttcccggagcagctgctcctacgtacgaccccacctgccaccgcacctgccaccgcacctacgaccccgcccacgccctcacccctgaccgcgcccgcgaccgctccgggcccgcgtcgccggatcaccgggccggccggactcctgctgcggacagtggagttgacgccccgctgggacgcgggctggcgctgtgtgagcgtcgacctgcgcccgctggccgtcgagccccgcgagctggacctcgcgctcgacacccacgcgggcccccgctggcgccgtaccggactgcccccggcaaccacctccgcggtggccaccggcagtgagtaccgcatcccgggccgcctgcgttcaccgctgacccgcagggcggcgggctacggcggacggctgtcggtcgccgtctggctcgcctgttgctacggctacctccggttcgccgctacccggccgggcccgggcctgcactgggcctacctcggcgccggactcgccgcccctgccgtggtgctgcccgcgctcctcgcgctcgaccacctcctcgcccggcgctgcgcgctgcacctggacgcgggagggctgcggctgcacgccggcggcacggaccgtgccctgccctggagcgcggtggagtcgctggagatcggctccgccccggagggcgcacgcgggcggcagcaccgctgggccctgctcgcgcgcccgctcgtccccgagccgggcgccgcaccgccgcgggactgcttccgggccgcccccgacggcacgctgcggatcgtcccggtactcgccggtgtgccgggcgaggccctcggactggccgtccaccccgggcaactcgcccacgcgctgcacacgttcggggtgcgggtcgccgggccggcccgggacggcgacggcgcccagcgctggtccgcgcccgctctcgacgccgccgtaccgcccgccgacccgccgtccgccccgccgtccgggacccgctccgcggcccccggcgagctgcgtgtgctgcgtgtctcgcccaccggcgacagcggccaccgcaccatcgccgccgcgctgcgcgcacacaccggcccggggccgctgcgggtgatggtcgagccgggccgctaccccgagccgctgtccctcaagggtgaggtcgaactctgtgccgcgcggggcccggggaccgtggtcgtcgaaccggccgtcgccggggcgaacgtgctcgacgtgaccggcagtgcggtggtcacgggcctggcggtcgtgggccgcggcaccgcgacggtcgcggtcttcggccggctgctgctgcgcgactgccggctcgaaggccgcgacggagcggccgccctgaccgcctcggccggcagcgagatcaccgtgatgggcggtgaactggccgtcggcaaggcgacgttgcagggggcccgcgccgtgctgcgcggcacccggttccaggcggcgggcgaggacgcgctggtcgtgtctcagggcgcgcacgccgaggtcaccgactgtgtcttcgccgacggccgcggcagcgccgtccacgtcagcggggcgggcacccgggcccggctccggacgtgcgagttctccggcttcggcggacacggcgtgctggtcgagcagcaggccgaggccgaggtgcgcgactgtctgctgcgcgacctgtccggtacggcgctcggcttccgcgaccaggggcacggcaccgtcgtcgggacccgcgtgcgcggcgcggacgccggggccgtcgtctccggcggcgcggatccgaccctgcgcgactgctccttccacggctgccgggccgtcggggtgcgggtgaccgaggaagccgtgtgcgggatcgaggactgctcgttcgagcacctgtccaacgccgccctgagcgtcgaccagaaggcccggctccgggtgaacggttgccgcatcgtcgacgccagacacggtgtcgtcgtggagaagggccacgcgagcctggagcgggtcgaggcccgcgcgctcaccggttccgtggtgcggctgtgccaggacggcaccttcgaggccgcggaactgcgcgccgacgactgcaagtacggcctgcacgcgtccggctccggatcatccggcgaactcaccggcgccgagctgtgcggaatgcgggactgcgctctcgtactgaccggatccgcccgggtcgtcgcgcggaacctgcggatctccgagcccgtgtccgacggcctcttcgcgcgcgacacctcatatctgacggtgcgtcagtgcacggtcgagcgggccgcgcggtacggggcgcacattctggacagcgccgtcctggtcgcggaccaactgaccgtgacggactccggtgcgcacgggatcctcgcggagaacagcagccagttcgacatccgggacagctcctgcaccggcagcgacggcgacgggctgcgcacccggagcgacgtcagcggccggatcacggacagccggatcaccggcagccgcggcgaggccgtcgcgggcgacggcagcgtacgcctcgacgccgtcaccacccgcgacgcgccgcccccggccgggcagcccgccgccgggctcggaccgcaggccgaactggacgcgctgatcggtctgaccgaggcgaaacgccaggtccgtacccaggtcgacctgctgcggctggcccggctgcgccgcgacgccggcctgtccgaaccgcccggcggccgtcatctggtcttctccgggccgccgggcaccggcaagaccacggtggcccggctctacggccggatcctcgccgagctgggcgtgctgtcggacggccggctcgtggaggtgcaccgcagcgatctcgtcggccagtacctgggctccaccgccctgaagacccgcgcggtcttcgacagcgcccgcggcggggtgctcttcatcgacgaggcgtacagcctggcccggcgcttcggcgtcaaccacgacctcggccaggaggcgatcgacgagctcaccaagctgatggaggaccatcgcgaggacgtcgtggtgatcgccgccggctaccccgtggagatggagggcttcctggaggccaacccgggccttgcgtcccggttctcccggatcgtgacgttctcgccgtacagcccgggcgaactggtccgcatcgtgcgccacttggcggaccggcacggcttcgagctcgacccggacgtggagccccggctcctggcccgcttccggggccgggcgagcaccggcagcccgtccaacgggcgggacgcccgcacgctcttcgagaccatgatcgaacacatggcgggccgcctgtccgacatcgaccgccccacccatcaggaactgctcaccctccgcccggacgacataccggagccc

SEQ ID NO: 2188 - DNA, 282 bp, Streptomyces avermitilis
  CDS (1)..(282)
gtgatcgaccgtgcggtccgggccgcccgcgagggcgggccgatcggcgaacacctcgaagccctgggcctgctgcccgggcgcacggcggacgaggcggacgagggtgcgccgcggggcaccaccctcccgccccgggtgacggacggcgccccgcacgccctgctcggccagcacgtctgcccgcgcggggtctgtacgcggcgggagcagcgggcggtcggcgaggagcgtccggtgtgcgagatcttcgacctggcgctgcgcttcgaccccgagagg

SEQ ID NO: 2189 - DNA, 927 bp, Streptomyces avermitilis
  CDS (1)..(927)
atgctctccggattcgtcaccgatgtcggccggaaactggcggaacgctgggccgccacgctcgtcctgcccggcctgttgttcacgaccgtcgcggccgtcgccctgaccctgcgccagagcgcctggtcggacgtggacctgctgcgcctgcgggtgacggcgctcaccggagccggttcgggggcgggccccggcgcgggctcgggttcgacgcgtacggcggtgctgctgctcggtgtgctggccgcgtccttcgccgccgcgctggtggccgacgcgctcggcgggccgtacgaacaggcgttgctcggcagctggccccgcctcctgagccggcccgccgccgcgctcaccgggcggcggcgcagaatctggcaggaacgggacgacgcctgccgccgggccgtggcgcaggacacggagggggccgccgaacgtgccgcccggctgggcgcgttggaggtgctgagaaaccaagtggccctgacccggccggaatgcccgacctggatcggggaccggctgcgcgcccccgccgtgcgcatccggctggagtaccgcctggagctgtccgacgcgtggccccggctgtggctggtgctccccgactccacgcgtcagccgctggccgaggccaggcagcggctggacgaggcgatgcgcctcggcggctgggcggtcctgtatctcctgctgggcgcggtgtggtggccgagcgccgtggccggggcgggggcggcgctggtggcctggcggcggggccgggaccgggccgaggagtacgccgagctcgtcgagtcggcggtcgatgtccatctccaggagctgttcgaacggttcgacgaggaggcccgcccggtccgggcgagcctgggccccgccgtcaccgaacggttccgcaagggcgcggggccacgacgcccg

SEQ ID NO: 2190 - DNA, 3768 bp, Streptomyces avermitilis
  CDS (1)..(3768)
gtgcacgagatgaccgagccacagcagttgcccggggaggaccggccggcggagcgggaacggctgctacgggcggtacgggggcgcctggacgcgctgggcggaccgacgggcaacggccatctgcacaccgcggaggcacgccaggagaccgaccgtctgctgcgccacctcgtggctccccacccggccacgggcggcggccacgcactcgacgccgaagtggcgtacgtactcggagtgatgtatctgttcgtcgcggacgaccggcccgacgcccccaccgccgcacaggacggccagtgcgccctcctgctgctcgcccccttctactgccacctgccggaccagccggatgtcctgccccctcccctgcgcgccggactcgaccagctcctcggcgccgagggccgacggcccgacgcccccgaggagatcgtccaggagcacgccgcgtccctcgccaacctggcgatgctgctgctggaactgggcatcaccctggcgtacccggaagccatccgcgttgcggccgacctggcccgcgaggcccttccccatctgtcgcccgacggccacgaccgcgccctggccggatgcaacctcggctatgccctgctcctgagcggcccgacccccgtctcctcccccggccaggccgaccccgagcagctggcggaggccgtctccgtgctgcgcaccgcgttcgccgccaccccgcgcgagcacccgaaccacgcccggtgcgccaacggcctcggcctcgcgctgctcgcctcggccggtcaggccgaggaccgcacccaactggccgaggccgccgcgatgttgcgcatcgccacccagaccgccacggaggtcgaccagaacctcccgcagatgtactccgacctcggttacaccctcaccctctgcgcccgcaccgccggggagggcgaggagccgggcccggaggtccgcgaggaggccgtcgacgcgctccggcgtgccgtggacctcaccacgcccgccgaggacggggagatgctgcgcacccgcctcgaccggctcgccgacgccgtggtgatcggctccccctcggacgaccggccgcgcgccgccgcacaggccgagcaggccgtcgacaccctgcggcgcctgctcgacctcacccccgaagggcacccggagcggggggacgtactgctgcggctggcggggaaccggttggtggcacagcatccgcaggagaccatcgacctgctggtacagggcgagtccgcgtacgccacagacccccgccgggagcagatcgcccgggcgttgctcgtggaggcggccatgctcaagggagagctggactcccgcgcggacctcacccccgagcagcaggcggactggcaggccatcgacgacgtcatgctcccgctgctgtccggggacacgaccggccacccgatgcggtccgtgatgaatctgatcggcctcggcggggaggggggcgggagccgcagccaggaactgatggacttcggcagcatggtcctcggctacccggaccgggtcggcctgaacgagatcttcgccaaggcgatggagctccaggcccggcgcatcgccaggctgcccgaggaggaacgcgcgggcgccgtcgccgcgttcctggcgggagacgacgacgagggcgcgcccgggccgccgggcgggcgggtcgaggagtccgaggagccgccggacaccagcagcctcgacgagctgctggagatccacgaacgactgctgccgcggctgccacccgactcccgcgagcaccgcctgctgcacggcgggcggaacatgctgcgcctcgtgcagatcatgtacgagtccatgtacgcgccgggcgacacccggacgcgtctgcagctgatgcgccgggccctgccgctgatgcgggagctgttcgaggaactgcccgcccagttggaggagctggggatcaagccggagctcttcggcgcccatacggcactggcgttcgcgtacgagtcgccgttcgagcagctggaggcggtcgaggagggggtgcgggccgcccgccggaggctcacggaactcgccccggacacgccggagtacgccgagacccggaccaccctggccctgtccctcttcgtccgccatgccctgtggtccgaggaggccgactacgaggaggccgtgggcatcgcccgggagctgacctcggcgccggctcccggctggcgcacggccatgctgctgacgcagtggacctccgcggcccagtcgcggatccagcgcaccgggctgctgggccaggcaccgcccggggtcgggcagtcgcccagcctgatcacccggctggcctccgacggcgccgccaccgcgctcgacgaccgggaccccgtggaagcgctggagaccctggaggacggccgggcgcatctgctgtcgggggcgctcaacgcccgccgcgaactggaggtcctgcacggtgcggacgccaagctgcacggccggctgcgggccgcgctggaacggatccgggcgctccgcacggcgagggaaccgggccgatggcccacaccggacgaggaggacgagctgcggtccgcttccgacgacgcggcctggctcgtcgccgaactccagcagcacccgggcttccagcgctttctgaccccgcttcccctgggtctcgacgacctgctgcccgccgccgcggaggggccggtggtgagcgtcaacatcaacccgcgccgctgtgacgccctggcgctgtgccccgacgggctgcgcgcggtaccgctgccgcggctgtacgcctccgatctggtggcacaggccgagtccttccgggtcgccgtcgaggcactgacggccggaccgcgcgaccctctgttcgaggacgcccgggagatcttcacgggaacgctggcctggctgtgggacgtactggccgaaccggtcctggacgccctcgggttcaccggtccgccggagtcaggagcgccctggccccggctgtggtggtcgccgtccggggtgctcaactcctttccgctgcatgccgccgggcgccacggcagcggggaggcggcggacgccgccgtcctggaccgggtggcctcctcgtacacaccgaccctgcgcgccctgctcttcagccgggcccgcaggcgcgcggcacccggccggcggcgcaccctggccgtggccatgccgcagaccgccggacaggccccgctggcccgtacggtcacggaggccaccgaggcggtggcggcgggcggaggcgttccgctgatcggaccggccgccacccgggactcggtgcgtgcggccatggtggacgcggccgtggtgcacttcgcgtgccacgcggacagtgaccccgaggacctgtcggccggccggctgctgctggccgacggcgacctgctgatccgcgacatcgccgagctccacctggagacggccgagttggcctacctctcggcctgcggcacggcccgcggcggcgccaccgcggcgctcgccgacgaggtgatccacctgggctccgcgttccagctcgccggctacgcccagtcggtggccacgctctgggaggtgggcgactccttcgcggccagggccgcggccgagttccaccgcaccctggccccctccctcccgggccccggccccctgcccgcggccctggccctgcaccacacggtgcgctcgctgagacaagacgaccgggagcggccttggacgtggtcggcgttggtgcacgcgggggcc

SEQ ID NO: 2191 - DNA, 837 bp, Streptomyces avermitilis
  CDS (1)..(837)
gtgtgcgaagcgacgcacccacggaccccgcggtattgtcctgacatggatgccgtacgtgcggtcctgatcgacatcgacggtgtgctcaccgtctcgtggaagccactgcccggcgcgatcgaggcgctgcaccggatccgcgacgccagcctcggcgtggtcctgctcaccaatacgacgtcccgtacgcgcgcgtcgatcgctgcgacactgggcgcctcgggcttcccggtgagcgccgaggacatcctcaccgcacccaccgccaccgcggcccatctcaccgaccactgtcccggcgcccgctgctccctgctgaacagcggtgacatccgggaggacctcgtcggcgtgaccctgctcgacgacaccgacaccgtcccggacgtcgtcatcgtgggcggtgccggcccagagttcgactacgcggcgctcaaccgggtcttcggccacctccagcggggcgcccggctggtggcgatgcaccgcaacctgtactggcgcaccgaccgcggactggatctcgacagcggtgcgttcctgctcgggctggagcacgccgccggcactcgggccgagatcaccggcaagccggcgcccgcgttcttcgaggcggcgctgacacgcctcggggccggccccggccaggcggtcatggtcggcgacgacatcgagtccgacgtgctcgcggcacagcgcacgggtatcaccggtgtcctcgtcaagaccggaaaatacctgcccgaaacgcaccacgcggcgagcgcacggcccgaccacgtcctggactccgtcgcggatctccccgccctgctggactccgtcgtgcgccgc

SEQ ID NO: 2192 - DNA, 405 bp, Streptomyces avermitilis
  CDS (1)..(405)
gtgtcgtacgacatcgaaaagccggacgaggcatggcgcgcggagctgaccccggccgaatacgcggtcctgcgcaaggccggcacggagccggcgttcacgggtgagtacacggacaccaggacgaagggcgtctactcctgccgtgcctgcggcgcggagctcttcacgtcgaacgagaagttcgagtcgcactgcggctggccgtccttctacgacccgaagaacacggacgccgtggagctgatcgacgaccgttcgcacgggatggtgcggacggaggtgcggtgcgctcgctgcgggtcgcatctcggacatgtgttcgagggggaggggtatgcgaccccgaccgatcagcggtactgcatcaactccatctcgttgcggctggcgccggacgagggc

SEQ ID NO: 2193 - DNA, 1392 bp, Streptomyces avermitilis
  CDS (1)..(1392)
atggcacccggtcttcctaccgccatggaccgaccgcacttcatcgggatcggcggcgccgggatgtcgggcatcgcgaagatcctcgcgcagcgcggggccaaggtggccggcagcgacgcgaaggagtccgagaccgccgaggccctgcgggcactgggcgcgacggtgcacatcgggcacgcggccgagcacctcgccgacgacgccacgtgcgtcgtcgtctcctccgcgatccgcgcggacaacccggagctggcccgcgcggcggagctgggcatcccggtcgtccaccgttcggacgccctggcccggctgatggacggcctgcgcccgatcgcggtggcgggcacgcacggcaagacgaccacgacgtcgatgctggcggtgtcgctgtccacgctgggcctcgccccgtcgtacgcgatcggcggcgacctggacgcccccggctcgaacgcgctgcacggcgagggcgacatcttcgtcgccgaggcggacgaatcggaccgcagcttccacaagtacgcgcccgacgtggcgatcgtgctgaacgtggagctggaccaccacgccaactacgcgtccatggacgagatctacgcgtccttcgagaccttcgtggaccgcatcaccgagggcggcacgctggtgatcgcggcggaccacgagggcgcgcgggagctgacgcggcgcgtcacggcgagcggcgtacgggtggtgacgtacggcgagtcggcggacgccgacgtgtgcgtcctgtccgtgaccgcgcagggcctgaagagcgaggtggaggtcctgctcgacggcacggagctgaccttcacggtgtcggtccccggccggcactacgcgcacaacgcggtggcggcgctcgcggcgggggtggcgctgggcatcccggccgcggacctcgcttcggccctggccgcctacacgggggtgaagcggcgcctccagctcaagggtgaggaggcgggcgtccaggtcatcgactcgtacgcgcaccacccgacggagatgaccgcggacctggaggcgatgcgggcggcggcgggtgacgcacggatcctggtcgtcttccagccgcacctgttctcgcgcacgcaggagctgggcaaggagatggggcaggccctggcgctcgcggacgcgtccgtggtcctggacatctacccggcccgcgaggacccgatcccgggcatcacgagcgagctgatcatcgaggcggcgcgggcggcgggcgcggacgtgacgccggtgcacgacaaggcggaggtcccgtcggtgatcgcgggaatggcgaggccgggcgatctggttctcaccatgggcgcgggcgacgtgacggagctcggcccgcggatcctggaccgtctgtcgaagcag

SEQ ID NO: 2194 - DNA, 471 bp, Streptomyces avermitilis
  CDS (1)..(471)
gtgttcacgagcgtattgatgatcgagaaggctctgacgtccgccgacgtggagttcgtcaccaccctgcacggcgacgaggcggtctccttccacgtactgctgcaaccccgcggtgatcaggcggaccggctgctgcgggccatcgacgacgtcgcgctgggtgagctggacgaggcggcgcacgagcgggagaccccggagggcaaggacgcggcggccctcggggggcaggctctggaggtgtccctcgccgccctgcacgcatccggcagcgaggcggtgggccgcctcatcgaggaccatccgctggacgcgctgaaggcgctggtggacgaggtggacgcggacgaggtgatcgtgctgacggacccccactacgtggaggagttcttccaccgcgactgggcgtcgagagcgcgccacaaggtgggggtgccggtgctgaagctcttctcgcacagcaaggcg

SEQ ID NO: 2195 - DNA, 1134 bp, Streptomyces avermitilis
  CDS (1)..(1134)
atgacgtgcagtgtggcacggcaactagagtggggaaccgtgtcgtcctccaccgccgcctccggtatcgatccgatagccgaagcggccccgctgtccctgtgcgcccgtgcgccgcacgtccccgccgaccggctcgtcgcggagatggtgccgccaccgcgcttcgactcggtccgcttcgccacctacatcccggacccgaaccagccgagtcagaccgaggccgtccgcgtcctcgaagacttcgccaccggtctgggcggggcgcacgcctccggttccggcaggcgcaggctgttcggcttcgggaaggccccgaagaccccggccggcccccgcggcgtctacctcgacggcggctacggcgtcggcaagacccacctgctcgcctccctctggcacgccaccccggccgagcccgagctgaaggccttcggcaccttcgtggagctgacgaacctggtcggcgcgctcggcttccagaagaccgtgcagacgctgagcggccaccggctgctgtgcatcgacgagttcgaactcgacgacccgggcgacaccgttctcgtgtcgacgctgctgggcaagctggtcgacgcgggcgtcgcgctggccgccacctcgaacaccctgccgggcaagctcggtgagggccggttcgcggccgccgacttcctgcgcgagatccagggcctgtccgcacacttccgccccttgcgcatcgacggtgaggactaccgtcaccgcgggctgcccgcggctccggcgccgtactccgacgagcaggtgacgaaggcggcgtacgccaccccgggggcgtccctcgacgacttcccgcacctgctcgagcacctcgcccgggtccaccccagccggtacggcgcgctgaccgacgggctcggggccgtgtgcctcaccgacgtccagccggtgccggaccagtcgacggcgctgcggctcgtcgtgctcgcggaccggctctacgaccgcgaggtcccggtgctcgcctcggggctgcccttcgaccagttgttcagcgaggagatgctgaacggcggctaccgcaagaagtacttccgtgcgatctcccgcctcaccgccctcgcccgcgacgccaaggggctcgtagcggcg

SEQ ID NO: 2196 - DNA, 816 bp, Streptomyces avermitilis
  CDS (1)..(816)
atgcgacgcctgttccctgtgacggaagaaacagcagcccaggcctcgggaggggctcccggcgcggatgcggcggaccgggagtgggggctcgacgagctggccgcggcctacgcgtatccccgggccggcgccgcgggcgggcccggcggccgtacgccctggctgcgcgccaacatggtgaccacgctcgacggggcagcccagcacgagggccgctcgcagcccatctccagcgccgccgacatgcggatcttcggcacccttcgggggctcgcggacgtggtggtcgtcggtgcggaaacggtacggcaggaggggtaccggccggcccgcgcgcgtgcggagttcgcggagctgcgggcggcggccgggcagggccccgcgcccgcgatcgccgtggtgacggcgagcctggacctggacttctcgcttccgctcttcacctcggccttggtgcccacgctcgtcctgaccggggccgccgcaccccccgaccgggtcgccgccgccgagaaggcgggcgcgcgggtggtggtggccggggacggcaggggcgtggacccggcccgcgccgtacgtgccctgggcgacctcgggatgacccggctgctcacggagggcggcccgcggctgctcggccagctggtcgcggccggtgtgctggacgagatgtgtctggccctctccccgatgctcgtcgcgggcgacgcgcagcgcatcgcctcagggccgtcggtggcggtgccggcccgcttcgaactcgtctccctgctggaagatgccgggtttctgttcggccggtaccggcgccgc

SEQ ID NO: 2197 - DNA, 390 bp, Streptomyces avermitilis
  CDS (1)..(390)
atggtgcgaggtacgacggtccggttcgtgctgacgatcctctccaccgccctgctggccctgcaactcttcgctcccaccgcgtccttcgcggccacgcacagcgacacccacgcgtccgcccccacagcctcgggcggattcgtcgccaagcgcgcggacgaggtcgcctcctgcggcgagtccgaacaccctgcgggcccgaccggcccactgcgcacccgtgatcgccacggcgccgccgcgacctcggcctccgcgccccccgtgctggtgttcatgggatacggctcccccgccacgcaccccacggaggccggtgccgagtcgcaccgcacctccagatcctcgaccgcccactcccccgcggcacttcaggtgttccgctgc

SEQ ID NO: 2198 - DNA, 579 bp, Streptomyces avermitilis
  CDS (1)..(579)
atgcagcccctcatcgatcatgcccgtgcgcacggacagcgccccgaggagttcgcccagctggccgagggccagtcaccgcaggccctgttcatcacctgctccgactcccgggtcgtccccgccctgatcaccggcgcccggcccggtgagctcttcgaactgcgcaccgccggcaacatcgtccccccgtacgccgcctcccagcaccccaccagcgaggcggccaccatcgagtacgccgtcgaagtgctcaaggtcaccgacgtggtcgtctgcggccactcccactgcggcgcggtcggcgccctggtgcgcggcgacgacctgaccgccgtacccgccgtgcgcgactggctcgcacacgcggctccccgcccggcaggcgcggtcgaggaccccgccgtcaccgaggcggtgcagagccacgtcctgacccagctgctgcgcctgcgctcgtacccgtgcgtctcggcgaaactgacgagtggtcaactacggctgcacgcctggttctacgaggtgcacaccggctccgtgctggcccaccgtccgcagaccgacaccttcacggccctg

SEQ ID NO: 2199 - DNA, 954 bp, Streptomyces avermitilis
  CDS (1)..(954)
atgctccaggagctgctggtggcggccgtggcggccggttccgcgggcctcatatacgtcacggcggcggcgcgggtcgtcaagcagtacgagcgcggggtggtcttccggctcggcaggctcgcgggcgacgtccgtccgcccggcttcacgctggtggtcccgggcgtggaccggctgcgcaaggtcaacatgcagatcgtgacgctgcccatccccgcccaggagggcatcacgcgggacaacgtgacggtgcgcgtcgacgcggtcgtctacttcaaggtggtcgacgcggcgaacgcgatcatccaggtcgaggactaccgcttcgcggtctcgcagatggcgcagacatcgctgcggtcgatcatcggcaagagcgacctcgacgatctgctgtccaaccgggagaagctcaaccagggcctggagctgatgatcgacagtccggcgatcggctggggcgtgcagatcgaccgcgtggagatcaaggacgtgtccctgccggagacgatgaagcggtctatggcccggcaggccgaggccgaccgtgagcgccgcgcccggatcatcaacgccgacgcggagttgcaggcgtccaagaagctcgcggaggcggccggagtgatgtccgagcagcccgccgcgctccaactccggctgctccagacggtggtggcggtggcggcggagaagaactccacgctcgtcctgccgttcccggtggaactgctgcggttcctggagcgggcgcaggcccagcagccgcccacgcccgcggagtccggagccgacggcgcgaccggtaccccggcaggcaccggacacggcaccccggcctacaccggacccggcagcgcgaccgccaccggagccgacggcgcgaccggcatcgaatccggcccccgtaccgacacgggcaccgtccctcgcaccgacaccggcaccggcacg

SEQ ID NO: 2200 - DNA, 1380 bp, Streptomyces avermitilis
  CDS (1)..(1380)
atgcccgaaaacggtcgccccgcatcgcgacgtcaggtactggcccgcagcggcgcgttgggcgtctcgatcgccttcgccggaaacctctccgagctcttcgcgggcaccgccgccgcacaggacctcggccaccggggctatggcccgctggtccccgacccgaacggcctgctcgacctgccgaaaggtttccgctaccgggtcctgtcccgcgagggcgacccgctccgctccggcgagggcccggtccccagcaaccacgacggaatgtcggcgttcgcgggccgccacggccgcgtccacctggtgcgcaaccacgagaaccgcgtcaccgcgaagttcccggtcccgacggtcgagggcctcacctacgatccgacgggcaagggcggctgtacggcgctgacgttggacgggcagggccaggtgctctccgaacgcgtcgcgatcgccggtacggcggtcaactgcgcgggcgggcccaccccttggggcacctggctgacctgcgaggagaccgaggacagggccggcacgaacggctacaccaaggatcacggcttcatcttcgaggtcgacccggcgaacccccaccgcaccggcgccgtaccgctcaccgcgatgggccgcttccagcacgaggcgatcgccgtcgacccgagacacggcatcgtctacgagaccgaggacgcgttcctcaagcccttcggcctcttctaccgcttcctgccccaccggcccgagggcggcgtcggttcattgcgcgccggcggccggcttcaggcgatgcgggtgcccggcgtacccgacctctcctcggtccaggagacgggcgcggccttcgacggcgtcgagtgggtggacgtaccggatccactggccgcccaaaccccggtcagactccaggacttcggcccgaagggcatcacccacgcacagaagctcgagggctgctactggggcggctcgtgcgtgtacttcgtctcctccttcgcccgcggcgcggacggctcggccgctgaccactacgggcagatctggcgctacgacccgtccgcgcgccggctcaccctcgtgatcgtcttcggcccggacaccgacgtacagctcccgggcgagtcaccggacaacatctgcctcgcacccggcggcggtctgatggtctgcgaggacggcaacggcgcgcagcacgtcttcggggtgacgcggcgcggcgaggtgtacgccctggcccgcggcgcccagaacatcggcacccccgaggctccggagtggggcgagttcgcgggcgtcactttctccccggacggccggacgatgtacgtgaactgctacacgcccggtacgaccttcgcggtgacggggccctggcgcagg

SEQ ID NO: 2201 - DNA, 867 bp, Streptomyces avermitilis
  CDS (1)..(867)
gtgatcattcttgtacgccgtgtcgccgtcgccggtgccctgggcgccctgggagccgcgctcgccgcctgcggcactcccggcgcatccggcaccccgcacgccgccgcacgccctgcgcactcggcgcccaccaccgccgcgtcctcgaagccccccaccctcacgcccggcccctccgggctgacccccgtcttcaagaacggcccgcgcacgcagggcaagaccgtcgcgctcaccttcgacgcggacatgaccgcggatcagggcgcgcgggccgccgccggggagcatttcgacaatccgcagttgatcggcgcactgcgcgagctcaaggtgccggccaccgtgttcatgacgggacggtgggccgacgaatacccccaggaggcccgggccatcggccgcgaccccctgttcgaggtcgccaaccactcgtacagccactacgccttcacaagcgactgctacggcctgccgaccgtgtccgaggaccggatgcggtccgatgtggagcgggcgttcgccgccttcgagaaggcgggggtgccccacgtgatgccgtacttccgcttccccggcgggtgctacgaccagcgtgcgctgcgcacgctgatccccgtcggcgtcaccgcggtgcagtgggacgtggtgagcggggacgcgttcgcgacggacgcggacgccgtggcccagcaggtgctggagggcgtccggccggggtccgtcgtcgtcatgcactgcacacggagcgcggccccgacgacggagcgggccgtacggacgatcgttcccgagctgcgcaagaaggggttccggttcgtgaaggtgtccgagctgatccaagcggcctcgggcgggcgtcga

SEQ ID NO: 2202 - DNA, 177 bp, Streptomyces avermitilis
  CDS (1)..(177)
atgagcggcgactactgcggtacggagacggcgggcccggcacccaaggcgggcggtccgccgttcgccgcgtgtgtgctgtgccaggagccgacggagtacccggagtcgtacaaggggatcacgctgtgccccgtctgcgcgtggcaggaggcacagcgcggcgcctgctcagga

SEQ ID NO: 2203 - DNA, 771 bp, Streptomyces avermitilis
  CDS (1)..(771)
gtgaccagtgatcccacccccgccacccccgccacccccgccaccccggccgccccggccgtcgacggcagcgctccgcaggacagccccttccgctccgagcgcacctcccgtgacgaggcgcggcagttcgtgctgccgctcgtcgtgcgcatcgagaagtccgctcccccggcgcgcacggacgcgctggagacggcggcgcgcgcggtgctcgtcatcctgagcgacgagcggtcgctgggcgacggggagtgggcgcaggcgatgacggactggcaggacgcccggatccgcaaggtggtccggcgggcgcgcggcgcggagtggcggcgggccgaggccctgcccgggatcacggtgacgggcaagtcggcggaggtacgggtcttcccgccggtaccgctggacggctggcccaaggacctggcccgtctccaggtctccggcaccgacctcgaggattttgaaccgcccctggaggcggacccttccgccccggtcctccggctgagccccgacctcgacatgtcggcgggcaaggcgatggcgcaggcgggccacggcgcccaactcgcctggtgggaactgtcggacgaggaccgcgcggcctggcgcgacgcgggcttcccgctcgccgtccgcacggcggacccgtcccactggcgcgaactcaccgcctcaggcctcccgttggtccgcgacgcgggtttcacggagatcgcccccggctcgtgcacggtggtggcggaccatccggcactgcgcggc

SEQ ID NO: 2204 - DNA, 786 bp, Streptomyces avermitilis
  CDS (1)..(786)
ttgcggcgtatcaacggcaccgccctcgtcatcgcggcactcttcgccaccgtcggcgcgctggcgtaccccgtgtggtcgtacgccgaccgttccggaaccggacaggcgaacctcgccgccgggacggtgagcacgcgctgggggccgctcaccgcctccgaccgcgacctgatcgtccgggtgcgactggccggcctgtgggagctgccggccggacagcaggcgctcgagcgcccggtcagcaaggcgttcaaggagacggccgaccacctcatcgtcggccacaccgatctcgacaagcgggtccggatcgtcgcggcccagctgggagtggagctgccgaaccagcccaacccccagcagcagggctggctccaggagctgagcgcggccagcggcaaggagtacgagtacaagttcgcgaacctgctgcggtccgcccacggcaagatcttcccggccatcggcgccgtccgtaacagcacccgcaacaccctggtgcgccagctcgcctcggacaccaaccagaccgtgctcgaccacatcacgatgctggagaagaccgggtccgtcgacttcgacgccatcgccaacgacacggcagccgccgcgaccgccagcccgaccggtcccccggccccggtccccggttcgacggcggcctcggcgccgcccgccgaggcgaccggtgacgtgcaggtctcgtcgtctccgtcgccgggggagcctgggacggtcaacacgggccggccggatcccgaggactcggacaacgtgttgcag

SEQ ID NO: 2205 - DNA, 1461 bp, Streptomyces avermitilis
  CDS (1)..(1461)
gtggtggaggaggggacgatggagcgactgaggacactggggacactggggacggggatcggctggcggccggagatcgcggacgccgtggagcggatgccgggcatcgactgggtcgaggccgtggcggagaacgtgtgccccggacatctccccgagtcgctgctgcggctgcgggcgcgcggcgtcaccgtcgtcccgcacggtgtctccctcggcctcggcggggcggaccgtcccgacgagggccggctggccgccctcgcggagcgcgccgaggcgctgggctcgccgctggtcacggagcacatcgccttcgtacgcgcgggcggggcactgaccgcctcgcccctgctggaggcggggcacctgctgcccgttccgcgcacccgcgacgcgctggacgtgctgtgcgagaacgtccgcatcgcgcaggccgcgctgcccgtgccgctcgccgtggagaacatcgccgcgctcatctcctggcccggcgaggagatgacggaggggcagttcctgtacgacctcgtcgagcgcaccggcgtacgcctgctgatcgacgtggcgaacctccacaccaaccacgtcaaccggggcgaggacccggccaaggccctggacgagctgcccgtcgaggccatcgcgtacgtccatgtcgcgggcggcttcgagcgcgacggtgtctggcacgacagccacgcccaccccgtcccgcaaccggtcctcgacatcctggccgacctcgcctcccgtacgaccccgccgggcgtactcctggaacgcgacgagaacttccccgaaccgggcgagctggagcgggagttgggggcgataaggaagacgttggagaaggcggggacgagggcgggggcttcggccggagccgcgggggccgcgacgaggacggcggcggagcttacggtggcggagtcgacggcggtcggcgcgatcgccggcccgaggcgtggcggtgccgacgcgcaggccgcgcctcgggcggccgggaccgaggccctgagcgcggcgtcgacgtcgacgcccgccgaccccgcccgccagcgcctcgcgctcgcccaggccgctctcctctccgccctcgtcgccggcacccccgtacccgaggggttcgaccgggtacggctgggcgtgcaggcccgtgccctcgccgccaagcgggcggacgtggtcgcgaaggtcgcgccggagttgccggagatcctcgcggaggagtaccggccggccttcctcacgtacgcccccgggcacccgatgaccggcggctaccggcgtgacgccctcgacttcgccgagcacctgctgctcgccgggcgccccgaggacgcggaggcccggcgccggctgcgcgactggtggctggagcgctccggccccaccccgccctcccgacaccccgccgcccgcctggcccgcgccacccgcagggtcctgctgcgccgc

SEQ ID NO: 2206 - DNA, 765 bp, Streptomyces avermitilis
  CDS (1)..(765)
atgcgatccatcaaccacaccggactgttcagtggcaccggactcatcatcgccgggctgaccgcgaccctcgtcgcgctgatctttccgatctggtcgtacgcggaccgctccggcacaggcctggacaccctgagcgcccagaccgtgtcgacgaagttcggcccgctgtccgccctggaccgggagttcgtcacgaaggtccggctggccggcctgtgggaactgcccgcggggcagcaggcacaggacaagggcaccacccaggccgtgcacacggcgggcgagcacctcgtcgagggccacacgttcctcgacgcccgggtccgcaacgtcgccgcgcgtctggggctcgagctgcccaaccagccgaacccacagcagcgtcagtggctcgccaccctgaactcggcgcagggcgagacctacgaccgggacttcgccaacatcctgcgccaggcccacggcaaggtcttctccgtcgtcgcccaggtccgcgcgggcacccgcaactccctggtgcgcgacctcgccgacgacgcgaacaccaccgtcctcgaccacatcaaggtcctcgaggccaccggcctggtcgacttcgacgcgctggcccgggacgcggccacctccggcccgcccccgctcaccagttcccccgccccgccgggaccgaaggcctcaccgaactccccgattccggtcaccccctcgccgacctacaccctgccgcccgccgcctccagccccaggccctccgaaaagaac

SEQ ID NO: 2207 - DNA, 765 bp, Streptomyces avermitilis
  CDS (1)..(765)
atgttctgggtccttctcctgctcctggcgtgggtcgccgccggcacgtcctgcacacgcctgtgcctggccgccgtacgcgccgcggccgtcgacgcgaacgccgcgcgcggccacgccctgacgctgtacgaggcggcgttcctggccggcggcccgaagcgggtggccgatctgacgctcgtcgcgatggcccgtcagcggcggctgctgctcgcgcacaccggctgggcgaccgtcgtggaccccaacgggcgggacgagatggagcgttcggtgctgggcgcgataggcccggaggggcagtcgcggatagcgccggtgcgccggacgaccgccgccgccgaccccgtgcgctcgctcgccgaccggctcgtcacggcgggcctcgccgtgcccgacggcgcgcgtacgaccgtcgcgggcgccgtccgccaggtgcaggccgcgtccgcggccgtcgccgcgctgggcgcggtcgccgtactgatgcccgcggaggccgccgaggagcagatcccggtcgtcgtctggttcgcgctgcccctgctcctcacgctgagctgtctcgccatcgcccgcgtcgaggtccacccgtacacgcgctgggcgtcgccggccggccagcggctgctcggcgccctgccccggcacgccgacgaagccggcgacgaccgtacgtatctcacctccgtcgccgtacgcggcatccgcgcgatcggcgaaccggagctgcgcgccgccttcacccaccgggagcgcggc

SEQ ID NO: 2208 - DNA, 729 bp, Streptomyces avermitilis
  CDS (1)..(729)
atgagtgacgacgcccccaccaccgagtccggcaggatcccgaacaagggcaagctggccaaggacctcaacgaggtcatccgctacaccctgtggtcggtcttcaagctgaaggacgtactgcccgaggaccgcgcgggttacgcggacgaggtccaggagctgttcgaccagctcgccgccaaggacgtgaccatccggggtacgtacgacgtgtcggggctgcgcgccgacgccgacctcatgatctggtggcacgccgagaccagcgacgagctccaggaggcgtacaacctcttccgccgcaccaagctgggccgcgccctggagccggtgtggtcgaacatggcgctgcaccgccccgccgagttcaaccgctcgcacatcccggcgttcctcgccgacgagacgccccgcaactacgtgagcgtctaccccttcgtgcgctcctacgactggtacctgctgcccgacgaggaccgccgccgcatgctcgccgaccacggcaagatggcccgcggctacccggacgtgcgcgccaacacggtcgcctcgttctccctcggcgactacgagtggatgctggccttcgaggccgacgagctgtaccgcatcgtcgacctcatgcgccacctgcgcgcctccgaggcccgtatgcacgtccgcgaggaggtcccgttctacacggggcgtcgcaagtcggtggcggagctggtggcggggctcgcc

SEQ ID NO: 2209 - DNA, 648 bp, Streptomyces avermitilis
  CDS (1)..(648)
gtgctgcacgccgactccgtggtcgtcgccctgcccgccgcggccgccgccgagctgctgcgcgccgaggcacccgccgccgcggccgagctggccggcgtcgagtacgcgtccatggcgctggtcaccctcgcctaccgccgcagtgggaccagcctccccgaaggcagcggcttcctcgtgcctcccgtcgacgggcgcaccatcaaggcatcgacgttcgcctcccagaagtggggctggatcgcggacgaggaccccgacctgctggtgctgcgcacgtcggtcgggcggtacggcgagacggagatcctcggccgggacgacgccggcctcgtggacgtctcgcgccacgacctgcgcgaggcgaccggcctggccgccacgccggtcgccagccgcgtcacccgctggaccgacggcctgccgcagtaccccgtcggccaccacgcgcgcgtggcccgcatccgcgaccacgtcgccaagctgcccggcctcgccgtctgcggcgcggcgtacgacggcgtcggcatcccggcctgcatcgccggcgcgtacgccgccgtggagcagctgggcggcgaccgcgcggggctggacgagctgagtgcccacccggtgcagagcctgcacggcggagcgggagaa

SEQ ID NO: 2210 - DNA, 1422 bp, Streptomyces avermitilis
  CDS (1)..(1422)
atgagcacaactcagacgcgcacgggtatggggcaggtcgtcgtcatcgggggcgggatcgcggggctggccgccgcgcaccggctgctggaccgtggcgcgcgcgtgaccgtgctcgaggcgtcggaccgcctcggcggcaagctgctgcccggcgagatcgagggcgtccgggtcgacctcggcgccgagtcgatgctcgcgcgccgccccgaggcggtgggcctcgcgcgtgaggtgggcctcgccgaccgcctccgccccccggccaccgcctcggcgtcgatctggacccgcggcgccctgcgccccatgcccaagggccacgtcatgggcgtcccgggcacggcgtccgcgctggccggcgtgctgagcgacgagggcctgcgccgcatcgagcgcgacgccgacctgccccgcacggaggtcggcgacgacgtggcggtgggggagtacgtggcggcgcgcctcggccgcgaggtcgtcgaccgcctggtcgagcccctcctgggcggggtgtacgcgggcgacgcgtaccgcctctcgatgcgctcggcggtcccccagctcttcaccgcgatccacgcgcacgcgtcgctgacggaggtggtccgcgagctccaggagaaggcggccgcggcccagcagacgggcccggtcttcatgggcatcgagggcggcgtcgggcaactgccgctcgcggtcgcggagtcggtgcgcgcgcggggcggcgagatcgtcaccggggcgccgggtgaccgagctgcgcagagccgagggcgggccggccgcgtgggtggctggtcgccggcggtcgtgtgctgcacgccgactccgtggtcgtcgccctgcccgccgcggccgccgccgagctgctgcgcgccgaggcacccgccgccgcggccgagctggccggcgtcgagtacgcgtccatggcgctggtcaccctcgcctaccgccgcagtgggaccagcctccccgaaggcagcggcttcctcgtgcctcccgtcgacgggcgcaccatcaaggcatcgacgttcgcctcccagaagtggggctggatcgcggacgaggaccccgacctgctggtgctgcgcacgtcggtcgggcggtacggcgagacggagatcctcggccgggacgacgccggcctcgtggacgtctcgcgccacgacctgcgcgaggcgaccggcctggccgccacgccggtcgccagccgcgtcacccgctggaccgacggcctgccgcagtaccccgtcggccaccacgcgcgcgtggcccgcatccgcgaccacgtcgccaagctgcccggcctcgccgtctgcggcgcggcgtacgacggcgtcggcatcccggcctgcatcgccggcgcgtacgccgccgtggagcagctgggcggcgaccgcgcggggctggacgagc

SEQ ID NO: 2211 - DNA, 972 bp, Streptomyces avermitilis
  CDS (1)..(972)
atgcagacagcacgcaccgtacgacctgttcgggtcctggcggccctgcttttgacctccgctctcgcgctcgcggggtgcagcgccgccgacgacggcggcggcagcagctcggacgcgaaggccgccgctccgggcgcccaaaaaggcgcggccgacagcggctcggcgagcggcgccaaggcctccggcgcgcccaagctcaccgcgagcgccatcatccgcaccgcctctctgacggtgcaggtcaaggatgtgcccaaggccctcgacgacgcgcgtacgaccgtcgagacggcgggcggcttcatcggcaacgagagcaccagccgggacgcgcggggccacgagcgcacccgtgtcgtcctgcgtgtgcccagcgagaagtacgaccaggtgctcggtgacctggagggcacgggcaagctcatcgaccgctcccgtaaggcggaggacgtcaccgaccaggtcgtcgacgtggagagccgcatcaagtcgcagcgcgccagtgtcgcccgggtccgcgagctgatggacaaggcgaccaagctcagcgatgtggtcagcctggagggggagttgagcagccgtgaggccgacctggaggccctgctggcccagcaggcgtccctgaaggaccgcaccagcctggccaccatcacgctctccctgtccgagaccccggtgaagaaggcggcggccaaggacgaggacccgggcttcctggacgcgctcgcgggcggctggcacgtcttcgtcacgctgctgcgctggatcgccctggcgttcggcgcggtgctcccgttcgcggcggtcgcggcgctggtggtgttcgtgtgggtgcggctcgtacggccccggctgccgcgccgtccggccccggcgacgaccgccgcaccgggtgcggttcccggcttccccgcgccctcgccggcgcccgcgcagcggcccgcggagggacgggaagagcac

SEQ ID NO: 2212 - DNA, 1398 bp, Streptomyces avermitilis
  CDS (1)..(1398)
atgagcatgagccgtacgagccgtacgaaagagcgcctggtcgtgatcggcggcgacgcggcgggcatgtccgccgcgtcgcaggcacgtcgcctcaagggccccgccgagctggagatcgtggcgttcgagcgcggccacttcacctcctactcggcgtgcgggatcccgtactgggtgggcggcgacgtcgccgaacgggatcagctgatcgcgcgcacccccgaggagcaccgggcccgcggcatcggcctgcggatccgtacggaggtcacggagatcgacgccgagggcgcccgcgtgcgctcccgggacctggcgtccggggccgagtcgtggacgtcgtacgacaaactcgtgatcgcgaccggcgcccggccggtccgcccggagctgcccggcgtcgacgcgcccggggtgcacggggtgcagaccctggacgacggccaggccctgctcgacacgctggccgccacccggggccgtcgggccgtggtcgtcggcgccgggtacatcggcgtggagatggccgaggcgctcatcaaccgcggctacgaggtgaccgtcgtcaaccgcagcaaggagccgatggccaccctcgaccccgacatgggccgcctggtgcacaaggccatggagggcctgggcatcaccatggtgaacgacgccgaggtcaccgggctgccgacgggagacgacggacgggtccgcgcggtcgccacggaggacgccgagtacccggcggacgtggtggtcctgggcatcggcgtacgccccgaaacgacgctcgcgcaggccgccgggctgccgctgggcgagcaccacgggctgctgaccgacctcgcgatgcgggtgcgcggccacgagaacatctgggcgggcggcgactgcgtcgaggtcctcgacctggtctccgggagcgaacggcacatccccctgggcacgcacgccaacaagcacgggcaggtcatcggcgccaacgtgggcggcgggtacgccacgttccccggtgtcgtcggtacggcggtcagcaaggtctgcgacctggagatcgcccgcaccgggctgcgcgagaaggacgcgcggcgggcggggctccagttcgaggcggtcaccgtcgagtcgacgagccgcgcgggctactacccgggcgccgatccgatgacggtgaagatgctcgccgaacgccgcacggggcggctgctcggtgtgcagatcgtcggcggcgaaggcgcgggcaagcgcgtggacatcgccgcggtggcgctcaccgcgggcatgacggtggaacagatgacggccctcgacctcggctacgcgccgccgttctcaccggtgtgggacccgatcctggtggcggcgcgaaaggcggtggcggcggtacgcgccaacggtgtg

SEQ ID NO: 2213 - DNA, 411 bp, Streptomyces avermitilis
  CDS (1)..(411)
gtgaacgcgaccggacggtcgtacgtatgtctcctcaaccgcccgcgatgccggcaactacgtgaggaacaggcgatgaacgagcgagttactcctccgatacacgccctgcccgacggggaggcggaggtcgccctggtgctgcatctgccctgggaggatgtcgccctgctcggccaggaggccggccggctcgccgccaagatgcagcgcccggtgaccatcgacgaggccgtcagccatcggctgcgctccaaccgccctgcctcccatgcgaagccggcgggggcgcagccgcccgccgtgccgtccaccgcgtccgtgtccgcactgtcgccgcggccgccggccgaacaggctcggcaggccatcgagcggatcaacgggacggccggtcagcacgagtcggca

SEQ ID NO: 2214 - DNA, 816 bp, Streptomyces avermitilis
  CDS (1)..(816)
gtggtcattcccgtccatgacgtgaacccggtacagcgcacgccctatgtgacgtatgcgctgatcgcgatcaacttcgccgtcttcctcttcacccccggcatagcgggatcggtgacgggagacagcggggtgtcgcagctgtgtcatctccaggcgttcctggaacgctacgcggccgtgccacaggagttgatccaccaccagatgccgcggctcgtgccgacgggcgaggtgggcatcggcccgcagggccccggctgtgtggccgcgccgccggactacgacaagtcgcccccgctgtcggtcctgacggcgatgttcctgcacggcagctggctgcacctgctgggcaacatgctcttcctgctgatcttcggcaacaacatcgaggaccgcatggggcatgtgcgcttcacgctgttctacgtggcctgcggctacgtggcggggtacggcttcgcactcctcaacgacgactccggggacccgctgatcggcgcctccggggccatcgccggtgtcctgggcgcgtatctggtgctctacccgaaggccagagtgtgggtcctcgtcccgttcctggtgttcctgccgctgcggctgcccgcgtggatcgtgctgggcttctggttcgcgctccaggcggtctactcgtcgggcggcgcggtctccacggcggggacggtggcgtacgcggcgcatgtggtcggcttcctcgccggcatgctgctcgcctggccactgcgcccgggcacaccgccgccaccggcgccgcgcagcctgctgtggggcaggcaggcgcggcacacctgg

SEQ ID NO: 2215 - DNA, 1065 bp, Streptomyces avermitilis
  CDS (1)..(1065)
gtgagtgccaacgaccgccccgcgacgggccagccgacagccacgtacgagtccgccttcctcaaggcgtgcaggcgcgagcccgtgccgcacacgccggtgtggttcatgcggcaggccgggcgctcgctgccggagtacctcaaggtgcgcgagggcatccccatgctcgagtcgtgcatgcgccccgagctggtcgccgagatcacactccagccggtccgccggcacaacgtggacgcggcgatctacttcagcgacatcgtcgtaccgctcaaggccatcggcatcgacctcgacatcaagccgggcgtcggcccggtcgtcgagaagccgatccgcacccgcgccgacctggcccagctgcgcgacctgacccccgaggacgtctcgtacgtcaccgaggcgatcaagctgctgacggccgagctcggcgagaccccgctcatcggtttcgcgggcgcgcccttcaccctcgcgagctatctcgtggagggcggcccgtccaagaaccacgagcacaccaaggcgctcatgtacggcgacccgcagctgtgggccgacctcctcgaccgtctcgccgagatcacctcggccttcctcaaggtccagatcgaggcgggcgcctccgccgtccagctcttcgactcctgggtcggcgcgctcgcccccgccgactaccgccgctcggtgatgcccgcctccaccaaggtcttccaggccgtcgagtcgtacggcgtgccccgtatccacttcggtgtcggcaccggtgagctgctcggcctcatgggcgaggcgggcgcggacgtcgtcggcgtcgactggcgcgtcccgctcgacgaggccgcccgccgcgtcggcaccgggaaggcgctccagggcaacctcgacccggcggtcctgttctccacgacggaggcggtggagaccaagacccgcgaggtgcttgatgcggccgccggtctcgagggccatgtcttcaacctcggccacggcgtcccgccgaccaccgacccggacgcgctgacccgcctcgtggagtacgtccacacgcagaccgcccgc

SEQ ID NO: 2216 - DNA, 669 bp, Streptomyces avermitilis
  CDS (1)..(669)
atggctgcggctcagggacgactgtcggacggcgctggcggaatggacgacgcgaaggagggggaccgggatgggacggagacggctccgctgcccttccgcgcctctgtcgaggcactgagggccgcacgactgcggccggagatcgagatcgacccgacgcggccgccccagcggctcgccccgtacgcgtacgcgctggaggccgccgtcgtcgaggacgacgaggacctggccgacggccggctcgtcctgctgcacgacccggccggacacgacgcctggcagggcacgttccggctggtcacgctggtccgcgcggagctggagccggagatggtcgcggacccgctgctgccggaggtgtgctggtcctggctcaccggcgcgctggaggcccgcgggctgtcgtacggcgaaccgagcgggacggtcacccgcgccagttcgcactacttcggcggcctcggcgagcggccggccgcgtcccagatcgagatccgcgcctcctggaccccgcgcgagggcctgggcggcgtcccggacacggccgcccacctcgcctcctggtgcgatctcctgtgccagatcgcgggcctgccgccgacgggcccgggcgccgacgcctccgtggtgacgctgccgcagcggcgggggccgcagtcccgc

SEQ ID NO: 2217 - DNA, 660 bp, Streptomyces avermitilis
  CDS (1)..(660)
gtgtccgttctcctcgagcagcccgcaagcctggtcgcctaccgcccgaacaagccgaccgccatggtggtcgtggccgacccacgggtccgctccaccgtcacccgccacctctgggcgctcggagtgcgcgacgtcatcgaggcgtcgtccgtcgcggaggcccgtccccgtatcggcaacccgcgtgacatctgcgtcgccgacgtccacctgccggatggttccggcctcaccctgctgtcagagaccagagccgccggctggcccaacggcctcgctctttccgccgccgacgacatcggcgccgtccgcaacgccctcgcgggcggagtgaagggctacgtcgtcaccggcacgcggacgaatctgggactgcccacccggcccggcgccgcccccatcggctccgccgccgcccgtatgcaccgccgccccccgggtgccccgagccacccgggcggctaccgcgaactgtccggacgcgaggtggaggtgctgcgcctcgtcgccgagggccagtcgaacaaggccatcggcgtctcgatgggcctgtccgcactgaccgtcaagagccacctcgcccgcatcgcccgcaagctcggcacgggcgaccgcgccggaatggtggcggtggccctgcggaccgggatcatccac

SEQ ID NO: 2218 - DNA, 1278 bp, Streptomyces avermitilis
  CDS (1)..(1278)
gtgaccgacgcccaagagaccgcagcagacagctcactgcgaaccaccggaggcgcccctccggacgacgtcgaaacggcgccgaccccgttgctcgagccccgcgagggcattccgcccgtgattgccgacgacgcctcgctcgccgaggtgatcgccgccttcgccgccggcagcggccccgtggccgtggacgccgaacgtgcgtccgggtaccgatacggccagcgcgcctatctggtgcagctgcgccgcgagggcgccggcacggcgctgatcgaccccgtggcctgtcccgatctctcgggcctcggcgaggcgatctccggcgtcgagtgggtgctgcacgccgccacccaggacctgccgtgtctgcgcgagataggcatggtgccgacgcggctcttcgacaccgagctggccgggcggctcgccgggttcccgcgggtcggcctgggcgcgatggtcgagagcgtcctcggcttcgtactggagaaggggcattccgccgtcgactggtcgacccggccgctgcccgagccgtggctgcgctacgccgccctcgacgtcgagctgctcgtcgacctgcgcgacgccctggagaaggagctggaccggcagggcaagctggagtgggcccagcaggagttcgacgcgatcgcctcggcgccgccgccggagccgcgcaaggacccctggcgccgtacgtccggcatgcacaaggtgcgccggcgccggcagatggcggtcgtacgggagctgtgggagacccgggaccggatcgcgcagcgccgggacgtctcgccgggcaaggtgctcggggacacggcgatcgtcgaggcggcgctcgccctgcccgcgaacacacacgccctggccgcgctgaacggcttcgggcaccgcatgggccgccggcagctggagcagtggcagaccgccgtcgaccgggccagggcactgccggacgccgagctgccgcagcccggacagccggtgaccggccctccgccgccgcgcgcctgggcggacaaggatccggccgccgccgcccggctctccgcggcccgcgccgcggtgtcggcgctcgccgagcggctgaacatgccgcaggagaacctgatcacgccggacaccgtgcgccgtgtgtgctgggagccgccgaagctcgcggacgccgactcggtggcggccgcactcgccgcccacggggcccggccctggcagatcgagcaggtcacgccggtactggtgacggccctcgccgcaccccccaaggcc

SEQ ID NO: 2219 - DNA, 396 bp, Streptomyces avermitilis
  CDS (1)..(396)
atgctgcccagccccggaggcgggagcggtgaaggtcacatccgcgggggtgccgtggaccctcccggggccaggacgggagtgggcaccggaggcgagcccgacccctcaccccgtgatcacctcgaacgacgtacccgccgcgtccgcacagaacgcgccacccgtggtcgtgacgctttcaccgtctgcgacgacttctgcccgcctttccgctacgcgccgaccgaggatcttggcgtgatctcgacgtcgctgttccgcttcagggggccgttcggcgcgcactgggggacgatctcggccggtgcggtgctcgtcgtcctgccgaccttgatcgtcttcctgttcctccagcggttcatccgcaacgggttcacgcgggccgtgacgaag

SEQ ID NO: 2220 - DNA, 1224 bp, Streptomyces avermitilis
  CDS (1)..(1224)
gtgcctcgtaccgtcagggatgtcgtcttcgtcgacggcgtccgcaccccgttcggcaaggcgggcccgaagggcatttaccacgagacccgcgccgacgacctcgtcgtgaaggcgatccgggagctgctgcgccgcaacccgggtctcgacccgaagaagatcgacgaggtcgccatcgccgcgaccacccagatcggcgaccagggtctgaccctcggccgcacggccggcatcctggccgggctcccccagtcggtccccggctactccatcgaccgcatgtgcgcgggcgcgctgaccgccgtcaccgccacggcgggctccatcgccttcggtgcgtacgacgccgtcatcgccggtggtgtcgagcacatgggccgtcacccgatgggcgagggcgtggacccgaacccgcggttcgtcagcgagaagctggtcgacgagtccgccctcttcatgggcatgaccgccgagaacctgcacgaccgctacccgcacatcaccaagcagcgcgccgacgagtacgccgtgcgctcgcaggagaaggccgccaaggcgtacgccaacggcaagatccagcaggatctggtgccggtctcggtgcgcaacaccaacgcggaggtcggtgagaccggctggggcctggtcaccgccgacgagccgatgcgcccgggtacgacgctggagaacctggccggcctcaagacccccttccgcgtccacggccgggtcaccgccggtaacgcggccggtctgaacgacggtgcgaccgcctcgatcatcgcgtccgaggacttcgcccgcgagcacaacctcccggtcaagatgcgcctggtctcctacgccttcgcgggcgtcgagccggaggtcatgggctacggcccgatcccggcgaccgagaaggccctcgccaaggccggcctgtcgatcgaggacatcaacctcttcgaggtcaacgaggccttcgccgtccaggtgctcgccttcctcgaccactacggcatcgccgacgacgacgcgcgcgtcaaccagtacggcggcgccatcgcgttcggtcacccgctggcctcctccggcgtgcgtctgatgacgcagctggcccgccagttcgaggagcagccggaggtccgttacggcctcaccaccatgtgcgtcggcttcggcatgggcgccacggtgatctgggagaacccgcaccacaaggacgccggaggcgacaag

SEQ ID NO: 2221 - DNA, 2124 bp, Streptomyces avermitilis
  CDS (1)..(2124)
gtgagcaccactgaactcctgaagggtgcggccgcgctgttccccgacgaggtcgtgacgtccgcgcacgtacgtcacctcgacctgccctccggcgccgggcgcttcgcgctcatcacgctggacaacggcttcgaccacaccaagccgaccaccttcggcccggcgtcgctggcgaacctcaacaccgccatcgaccaggtcgagaaggaggccgcggccggcgagatcgtcggtgtcggcatcaccggcaagccgttcatcttcgcggtcggcgcggacctcaagggcgtcgagctcctgaagaaccacgacgacgcgctcgccatcggcaagggcggccacgaggtcttcaagcgcctcgcgggcatagcggttccgaccttcgcgtactacaacggtgccgcgatgggcggcggtgtcgaggtcggtctgcactgccagtaccgcacggtctcggcggcgctgccggcgttctcgctccccgaggtcttcctcggtctggtccccggctggggcggctgcacgatcctgccgaacctgatcggcgcggacaaggccgtctcggtgatcatcgagaactcgctcaaccagaacaagcagctcaagggcgagcaggtctacgacctcggcatcgccgacgcgatcttcgagggcgcggacttcctggagcagtcgctgctctggacgacggccgtcctcaagggcgagatcgccgtggagcgtccggagatcgaccgcggcgaggcctgggaccaggccgtcgccaagggccgcttcatcgccgacagcaaggtgcacggtgcggccccggccgcctaccgcgcgctggacatcatcgccgccgccaagaacggcgacctccagcagggcttcgacgccgagaaccaggccctcgccgacctcatcatgggtggcgaactgcgctccggcatctacgccttcaacctggtccagaagcgcggcaagcgcccggcgggtgcgccggacaagtcgctcgcccgtccggtcaccaaggtcggcgtcgtgggcgcgggcctgatggcctcgcagctggcgctgctgttcctgcgccgcctcgaagtgcccgtcgtcctgacggacatcgaccaggagcgcgtcgacaagggtgtgggctacgtccacgccgagatcgacaagctgctgctcaagggccgcgtcaaccaggacaaggccaaccgcctcaaggcgctggtctccggtgtgctggacaaggccgagggcttctccgacgcggacttcgtcatcgaggccgtcttcgaggagatcggcgtcaagcagcaggtgttcgcggaggtcgaggcggtcgccccggcgcacgcgatcttcgccaccaacacctcgtccctctcggtcaccgagatggcgtcgaagctgaagcaccccgagcgggtcgtgggcttccacttcttcaacccggtcgcgatcctcccgctcctggagatcgtccgcggcgagcagacggacgacgcctccctggccacggccttcggtgtcgccaagaagctgaagaagaccgcggtgctggtgaaggacgccccggcgttcgtcgtcaaccgcatcctcacccgcttcatgggcgagatccagaacgtcatcgacgagggcacgccggtcgaggtcgcggagaaggcggtggagcccctgggcctgccgatgtccccgctcgtcctgctggagctggtcggcccggcgatcggtctgcacgtctcggagaccctcaaccgggccttcccggaccgcttcacggtctccccgaacctcgcggccgtcgtcaaggcgggcaagcgcggcttctacgtgtacgactccgggaagccggagctggaccccgaggtcgccgcgctcctcaagcagggcgatgtcgtcctcaccgaggagcaggtccgcgaccgcgtcctggacgcggtggcccaggagatcggtctgatgctcgacgagggcgtcgtcgccgaggcccaggacatcgacctgtgcctgatcaccggcgcgggctggcccttccacctgggcggcatcacgccgtacctggaccgtgagggcgtcagcgagcgggcgaacggcaagcggttcctcgaggccggggtggcttcggttcccgcg

SEQ ID NO: 2222 - DNA, 4512 bp, Streptomyces avermitilis
  CDS (1)..(4512)
gtgggagaactcgagatgagacaggtgcaggacggcgacaactcctgggtgacggtggtcatccccgcgtacaacgcggcgaccaccatcggcaaggcgctccagtcggccgtgaaccagacctacgagctggtcgaggtgatcgtcgtcgacgacgcgtcgaccgacggcaccatcgaagtggtcaccaacttcgccggaaacaacccgcgtgtgcgggtgctccgtaggaaggagaacagcggaggcgtcggggctccccgcaactggggcatcgcacaggccgcagggcgctgggtgatgttcctggacgccgatgacgaactgccgccccgcgcctgcgagcggctcgtcgcgagcgcgctggagaccggcagcgacatcaccgcgggcaaggcggtgcggatcaaccggaccaccggcgagtccgagccctgggcccccgaggtctacgcgatgagccgcaccgtgtccgacctggaggagttcccgctcctgctctccgaccccatcgccgccgcgaagctctacaacgtcgagttcctgcgcacggccggagtctggttccccgagggcgtcttctacgaggacacgtacttctccaccgtcgcgggctgcctcgccaggggcatcacggtcatcaccgagcccgtctaccggtggatgtgggagtcggacggcgcgtcgatcaccggccgcaccggcgagctgcgcagcatcagggaccgcatcgcggtgcaccgcgccacggacgcgttcctcctcgagcggggtctgtggtcgctcaaggtccgcaaggactccaagttcctctcgcacgacctgcggctgtacatgcgggccctcgcggagggcgatgccgccttcgagcagggcttcgcggcgacggtcagcgcctatctgttctccgtcagcgacgaggcgttcgagctgtgcggccccgtcgaccgggtgcgggcctacttcctgatgtaccaggagacggaagccgccctgaccaccctggactacgcgcagcgcaagagcgtcttctcctcctacctcgtggaggaggacggccgcgtctactggtccggggaccatctccacctgccggacgcccgccgtctgctcgacgtcaccgaactgggcctggccgcggcacccgtgtcccaggtaccgctcttcgcccagctcaacagctggcaggtggagggcacgaaactcaccttcgacggcgaactcgtcaaccgcttcggccggatcaccgccgacgacaccatcagtctgtccctggccgtacggaaccggcacaccaagcgggacgtcgtcgtcccgatccccaaggtctccgtcgacgagcgcttcgtgaccttcgagggcagcgcggacctggtccgcgtgctcggcgacgacctctccgaggccaccgtgtggaacgtctcggtcgtcgtcgagtggaatcgcagccggtcgcgctccgcgctgaacgtgcgcgacatcgacctcgacggtctgcacttcacccgggaggacgaggagttcgagggataccgcaccgtcagcggcaacctcgccttccgttccgcgaccgcgagccggcgcaccttcgaggccgagcagagcgacccgaacgcaccgtggatgtggtggcgcgaccgcatccatccgccgatccgtcagctcacccaccgcttcgagctcgcggtggtcgtcccgtgctacaacgtggccaagtacctggacgactgcctcgcctccatcgcggcccagcgcggcttcgccgccacccaggtcatcctggtcgacgacggcgccaccgacgagacgccgcgcatgctggaccacttcgcccgcttctacgccaacgtcaccgtcgtgcaccagcgcaacggcggcctgggcaacgcgcgtaacacgggcctcgaccaggtcagcgccccctacgtcaccttcctcgactcggacgacatcctcggcgaggacgccctcgccgcgatgctcgaagccgcccgccgcgacggctccgaggtcgtcatgggcgacctcgtcaacttcccggaccggccctacggcccgtggaaggagtacttcggcgacggcgaccgggtcttccacgacttcgccgacgcccccgacatgatcttcagcgggtcggcctgcaacaagctgttcagtaccaggctgctgcgccgcctgggcctgcggttcggcgagggcgtgcacttcgaggacgcctggctcacgctgcccgcgatgctccgcgcgaactcgctcagcctcgtcgaccgtcccgtctactactaccgcggacgccccgacggctcctccatcatggactccctgtggagcaagccggccaactacgtggaccacctgcggctcaaccacttcctcctgaactacagcgccgaggaacgccccgagatccgccgcatgttccaccggtacgccacccgcacgtacaagggcttcctgtgcaacgcgcgcaacgtcatgggccgtacgcagctggccgagatgttcgccgacctccaccggcactacgcgcagattcccgacgacgtgatcgtcgagttcgtcaccagcccggcccagcagctcgaccactacgccgccaagagcgggaacttcgaactgttctgcgaccccgagccggccctggccgcggcgcccctccgtttggagctggacgacgacgggttctaccggaccttcgccggaggagtccgcccgagcaccaccgcccgcgtcaaggaccccaatgtcgtggtggagagcgtccgcgcccgcgacgacgtgctggtcgtcgaaggctgcatggcctttcccggagtcgacctgagcggcccgatggacaaccgtctcgagctggtctaccagacccgccacagcaaggtcaccgtgccgctcacccaggtgtaccggcgcgacctgtggaacgcccgcaacggccgcgacctgtacgcgggctggcacgcggagctgcccgccgaggtgctcgcggacagcggcttcggcgtcggcgacctgcgcctgcgcgtgcacctcgccgacggcagccgccaccgcaacgtcgtgatgaaggcacgcctcgcgctgcaccggctcaaggggccgggccgggtcggcccctaccgctacatgctgacgatcgccgcgcaggacgccctgcacctgcggctcgtcgcctccggcccggcggcccgggtccggcacgcgctgtggcgggccgggcgagagctgcgcatcctcaagacgcgcaaccccggctggcgcatgcggttcgcctactggctgacctacccgttcctgaactccaaggagatctggctcatcggggagcgctccgacacggcccaggacaactcgtaccatttcttcaagtggatccggcagaaccgcaagcgccgcaaggcgtactacgtgatcgacggcgcgtccgccgaccgcgccaaggtcgcgccgtacgggcgggtgctcacgctcggcagcttcaagcaccgcgtgtacctgctgcacgcgaccaagctcatcgggtcgtacgattccgagtcgtatctcgtccccgagggctacaagaaggcgctcttcctgcatcgcttcggcgaactggtcaagtaccagcgggtgttccttcagcacggcgtcacctacaacgatgtgacgaccggtgccgaccagcgcatcgccagctacgacctgctggtgacggcgggccggcaggagcgcgacttcatggcgctggaagccgggtacggcgaccgggccaagcccgtgggcttcccccgcttcgacgccctccagcgtgaaccgagggacaagccgcgcatcctgctcatgccgacctggcggcagtggatcgtcaccgcctcctacaagaagtcggccggcccggcgaagaccaacttcacccagtccgagtactaccgcttctaccggtcactgctctccgacccccggctgggccgggcgctcgaccacttcggtgtggacctggagttcttcccgcactacgagatccggccttacctgcacaacttcaagttctcctcgccgtccatcgaggtcgccgacccgcacacgcgcaacgtccagcaggccatgaaggaatgctcgctgatggtcaccgactactcctcggtgttcttcgacgtggcctacatgggaatcccgctcgtctacgtccccttcgacgaggaggacttctacgggcggcactacaagcgcggctacttcaacctctccgaggacggcttcggcccggtctgccggaccgtcgaccaggccgtcgacgagatcatcgaggtcgtccgccgcggtttcaccgtcgaaccggcctaccgcgcgcgcgtcgaggacttcttcgtgcaccgcgggggaggcaactgccagcgggtctacgaggccatcgacgccatgggcgacgcgagcgcggcgcagctggcacccccggcacccgtgggcgcgctcatgcccggccggtcccggtcgcccgagggggcggggcggcacggctgggtcgacgcggcc

SEQ ID NO: 2223 - DNA, 1218 bp, Streptomyces avermitilis
  CDS (1)..(1218)
atgaccaagctgtccctgcgggctgtccagaagctgaccgtcaagaagcgggatgcctggtggacggtcctccttgtcgatcccgtcgccacgcggatgctgatcgtcctcgcgcgtttccggttcatcacgccgaaccgcgtcacctgggccgcgctgttcgtcggcctggccgcggcgggcttcttcctcaagggcgacccccagtccctgctcatcggcgcgctgctctaccacctgagcttcatcctcgactgcatcgacggaaagctggcgcggctcaagggcaacggcaccgtcttcggaggctggctcgactacgtcttcgaccgcatccgcgtcctgttctgcgccctcgcgctgatgggcggtcagttcctgcccaccgacgacgagcgctatctggtcgccgcgctggtcgtggtcttcctcgacatgctgcgctacgtcgacgcgctccagatctacaagatgcgcatgtcgatgcgcacgaagatcgagaagatcaccaaagcgcgtgaggaggaggagcgcgccgcgcgcggagtcccggccgacgccgagggcgagcaggtcgtcttcatggaggacctgctgcgggacaacccgggcgcggcggccgagaccctccgcgaggaggccggcgcggcgaacgtggtggacctgcacgagcagttccgcgaccagttcccctggtacacgcgcgtccgccgggcgatgctgcgcacccggatccggccccacctcatcagcggcatcgagttccagatgttcatcttcatcgtggggccgctgatcggtcagatcctgtggaccaccgtggtctccgcggccctcgtgatgctcttcgagctcgtcatcatgtacaagttctggctctccacccgcgacttcacccgcgtcatggaggagctgagtcccgccccggccaccgtcgggaccatcgccccgcatctgcaccggggccgccaccgccgtgccgcgcaggaggccctgctggccgacgagcggtaccgcgcaccggaggccgaggacgatcccggcttctggccctacccgcagccgaacgtcaccccccacgggcacgaccttccgcagcagcacgacggactcccccatgttccccgccagcacgccggcgccgggccgctcccgcagtacgggacagcccagtccggcgagcggcgcggggcaccgggggcgtgggagaactcgaga

SEQ ID NO: 2224 - DNA, 1575 bp, Streptomyces avermitilis
  CDS (1)..(1575)
atgacacgcaggtccgagcgcagagcgggcggcgccgtcgcccaggcgccgggaattcgtccgcacgtggtggccgtggtcgtcacggaacccgcggccgcggtgccactcgtcacgctcgaagcgcccggcgccgagatcgccgtcgtctgcctgcgggcgggggcgaaggagggccgggcggcgctcgaccgggctctcgcgcaggccgccgagcgcggctgccgcgtcctgggcgctccccggatcctggggggcgagggcggcgactctgtcgcggcgctgctcgacgagctgcgggagatcaaccccgagcggctgcacaccctggacccggaccccgttcatgtctcgttcgacgagacgggcggaacgccggtgtacgacgagccggccgggcacgccgacatcgcggcggacgcgctcgccgcggcacgcgctctccagtcggagaccggagagcccctctacgtcgactgccaccgggcgaaggcggacgtacgcctgggcgccgcgtcctgcctgcggcatcccgccccggtgaactggctggtggcgggcttcgacggccggctgaccgccttcctgcccaccgccgccggggtggtgcgctggttccaggacctgccggacggcacggcctggcgcggccccgaaccggtggagggccccggtctgctgccggggctcaccgtggtgcgcgatccgcacggcttcccgcacctgttcgcgctgcgcaggacgcggcgcggcgacggcggcgtggacgtcgaggtcgtgcacgccgtgcagtaccgcaccgggcagccgctgacgccgtggaactcgctcggcggccccaactccggcgactggcgcaaggggcgcgaagtcggtttcccgaccgccgcgttcgactccgccggcaatctcttcgtcttcgtacggaacttcggacacagcatcagctaccgctgtcagtcggtggacggcgtctggaccgcgtggcagcacctcgggggcacccgggtcgccgacgacctcgtcgcggtgaccaccccgcacggcggggtcgaggtctacgcccgggcccgcgacacggaggccgtggtccgctggtatccggcgcaggggggtgcctggacggaggaccgcacaccgccgttcgcggcccggcccggcaccatgtccccggcgccggagccgggcagcatccacttccgcgacctgcggaccaacgcaccttccgcctggcgcccgggcgcccaggcgccctgtcccctcggtgacgcggagggctccgggcccgtggccgcggcgtcgggcgtcgagatggacggctgggcgtactccctgctgattcggtcgggttccggcggcgcctgcgcggtcggcgcctatcccgagggcaggcccggcaccggggtgtggtggcaggacctcgcggagcggtcgtacggcattccggccgccgccgtgagccgtaccgggcggctggccgtcgcgaccagggcacccggacaggggctgctcgtcgcgcaccggcgtgagcaggcgggttccctcgccttcggcgactggcagccggcccgaggc

SEQ ID NO: 2225 - DNA, 1239 bp, Streptomyces avermitilis
  CDS (1)..(1239)
gtgggcgggctggtgcgcgcggcatccgcaggcgcggcgctgacggccgggccgtctctctacgatccggcgtgcgggcccccgaaaggaccgggggccgacgccttgggaaggacgacgaagaccatgcgggccacctccgcgcgtgcgaacgggcaacggcagcagccggtgggcgaggaagcactagacctcgccgaccggccggcggccgtgcggtcggggccgtggctcctccccggacacgacggccggctcctcgcgtacgcgctggtggaccaggcggtactccgctggaccgagcgccggcccggcggccccgactggctcggaccggacgtcctgccggcgaagggcctgtcgcatctcacggtcgcccagggccgtaaccggtacgcgcatctcctgggccgccgggtgcgtcccgcgaaggacggttcgctcaccgtggacctggtctacgcgatccagtaccaggcgggccgccccttgagcgagtggcggtcgatcggcaacccgcacgccaagcgtgaacgcaccgcgctcatgggaggcccgaccgccgccgtcaacaccgcgggcaccctgtacgtcttcgtgcccacggcggagggccgggtcgccgtccggcgggaggacacccaggggcgctgggagccctggctcgatctccaggtgaccgccgcggtggacactccggcggccgtctcgacgtcgaccggacacgtggaacttctcgccccggcccgcaccggcgctctgacctggcatcagccggagccgggggcggtactgcggcgcgggcacgacttcggcgtgatcccgctgcccggatccgtgaccggagcggagacctctcccggccgggtcacgtacttcctgaccgatgtgcgcggcggcatggtcgccgtccgcgcgggggagtggcccgttccgctcggcggggacccgggcgacggacggcacgcggtggtgagcaccaccctcgacggctacccctgcaccgtgctcgcccaccggggcgccgaggggcgcatcatgctcggcgtctgcgtcgcggaggacgagggcaacggagtgtggtggacggacaccggcacggcctgcctgggggatcctgtcctcgcgctcgacgggcgggggcgggtggtggtgctggccgtcgccgccgacggctcgctgaccctggcccgccaggaggacggaccggggctgacactcagcacctggagccggata

SEQ ID NO: 2226 - DNA, 984 bp, Streptomyces avermitilis
  CDS (1)..(984)
atgacttggttgatcacaggcggggcagggttcatcggggcgcatgtcgtccgcacgatgctggaggcgggcgagcgggtcgccgtgtacgacgatctgtcgaccggagacccgggccggacccctgagggagtgcccttcgtgaagggctccacgctggacggcgggctgctccggcgcaccctcgccgacctgcacatcacgggtgtcgttcacctcgcggcgaagaagcaggtcgcggagtcggtcgaacgcccgctgtactactaccgcgagaacgtccacgggctggagaccctgctggacgcggccgccgaaaccggtgtgcggaacttcctcttctcctcctcggcggccgtgtacggcatgcccgatgtgaaggtggtgacggaggacacaccctgtgcccccatcaacccctacggcgagacgaagctggcgggcgagtggctggtgcgtgccgcgggccgcgcgcacggcatgaccaccgcctccctgcgctacttcaatgtcgcgggggccgccgacgaacgcctcgcggacaccggggtgttcaacctgatcccgatggtgttcgagaagctcacccagggcacggcgccggtgatcttcggtgacgactacgacaccgaggacggcacctgcgtacgggacttcatccacgtcgaggacatcgcctccgcccatctggccgcggcgcgtgcgctgaccggccgggagcccggcagtgatctgacggtcaacatcggccgcggtgagggtgtctccgtgcgcgagatgatcgagctgatcggcgaggtgaccggttacggtgccgacgcggcaccggtgtcggccgcccgccggcccggtgacccggcccgggtggtcgccgcggccgatcgcatccaggcggaactcggctggtcggcccggtacgacgcgcgcgcgatggtcgcgtcggcgtgggcgggctggtgcgcgcggcatccgcaggcgcggcgc

SEQ ID NO: 2227 - DNA, 1107 bp, Streptomyces avermitilis
  CDS (1)..(1107)
atgagccatgtctcgacgccccagcgccgaagcaccggtgagacaccccgcggacgcggcggtcgcggacgcaagcggcccggaggccgccgaacaggccggaagatcctgctcgccctgctgatcctcgtcctcgcggcggccggcaccggctactggctctacagcgacctcaacaacaacatcgagggcgtcgacatcgacaaggcgctcggggacgaccggcccgagaagctggccacctccggccagaacatcctggtcctcggctccgactcgcgtgccggcaagaacgcctcgctgaacacgggcaaggtctccggggcgcgttccgacaccgctctggtgatgcacatacccgagggccgcaagaaggccgtcgccgtcagcatcccccgcgacaccctcgtgacccgtcccgagtgcgccaagtcggacggctccacgctcgcctcggcgaagcgcgtgatgttcaactcggtctactcgcaggccggtccggcgtgtgtggtcaagaccgtggagcagatgtccggggtgcggatggaccacttcgtggagatcgacttcgccgggttcaaggggctcgtggacgccataggcggtgtgaccgtcaccgtcgaccaggacatccacgacacgtcgagcggcctggaccttaccgccggcacccacaagctcaacggcacccagtcccttcagttcgtccgcacccggcacggcatcggggacggcagcgacctcggacgcataggcctccagcaggagttcatgctcgccctgctctccgagatcaagcagcaggatctgctgggcagccccacgaaggcgtacaagatcgccaacaacctcacggagtcgctcaccacggactccggtctcgcctccctcaccaagctggccgagttcggccgcagcatgaacggcgtcgacccgtccaccatggagacgatcatgcttccggtggcgtacgacaaggccgacccgaaccgggtggtggccgccgagccgcaggcaacgacgctctggaaggcgctccgaacggacgcgaccatcccggagtcggcgaagaagtcacccgcgaccggcgggacgtcgtccgcttcg

SEQ ID NO: 2228 - DNA, 363 bp, Streptomyces avermitilis
  CDS (1)..(363)
gtgacgactcttgtgatcatcgacgccgccaacgtcatcggctccgtccccgacggctggtggcgcgaccgccggggcgcggcggaacggctgcgggaccggctcgcgcgggacggggtgccgggagccgaggggccggtggagatcgtgctcgtggtcgagggggcggcacgcggtgtggagtccgtgcccggtgtacgggtcgagtcggctcccggcagcggggacgaccggatcaccgagctggccgccgaggcggccgggcgcgaccgcctcgtggtcaccgccgaccgtgaactgcggcgcagggtacgcgagtcgggggccgaggtggccgggccccgggcggtgctcggtccgtcc

SEQ ID NO: 2229 - DNA, 1491 bp, Streptomyces avermitilis
  CDS (1)..(1491)
gtggagaccgcggggccggatagcgtgctccgtatgctcgtcgagccccttgacgcaccacgttccgtagtcgcaccgaggagggagcgcgggtactggagccggctgctgcccccgctgacggtgctggcctgtctgacgcgcgtcccctcgttcgtacggccgctctggagccccgacgagggctatctcgccgtacaggcccggatgctggcgggcggcggagagctgtacgagacggtcgtggaccgcaagccgccgctgctgccgtggctgtaccagggcgcgttcgcggtgtgcggctccgggtcgctcacctccgtgcgggtgctcgcggtgctggcacagctgctgaccgcggtgctgctcgcgtcgctggcgaggcgccgctggggcgacggggcgggccgtacggcgggcgtcctgtatctgctggcctccgtggggctcaacccccaggacgcgcaggccgcgaccttcgaggtgttcatgctgccgtgcacggccgccgcgatgtggtgcgcggaccggcgccgatggggcgcggcgggggcggccgtcgcctgcgccttcctggtgaagcagacgggcggcgcggtgctggtgccggtggtgtggctgctgtgccgcggcggtgtgtcacggacgggcctggtacggctgggagccggggcgatcgtgccggtgctgggcgcggctgtgctcaccgatccggcgggcttcgtgttctggacggtcacgggatcgggcgcctacgccgccttcaccggctccgaactccacgtactgacccggggactgaccaacaccgcgatcctcgcggtggcctgtgccgggctgattcccccggtggtccgcgtcctgcgccgggcccgtacgggcccggcggagctgtggctgtggccggcctcgtcggcggtggcggtgctgctgggcttccacttcttcggccactacttcctgcaactcatcccgcccgtcgcgctgttggcgacggccgcgttgcaggccctgccgcgcgaccgcatggtgaccgcggtgttcacctccgcgtgctgctgcacgctgttcctgacgtggggtctgctggcgccccgctccgacctcgcccacgccgagcgcctcgcggacgcggtggtccgccgcacggcacccggcgacccggtcctggtctggggcatacacccggagacgtactggctcgccgaccgtgcccccgccagccgctacctcacggcgggcctcctcaccaactacagcggaggccgcgacgggccccaggtcggggagaggtacgcggtcgagggcgcctggccggccttccgcgcggagctggccgcgcacccgccggccctgatcgtcgacgactcccgggacaagccgtaccggccggagcgggtgccgtcgctgcggcggatcctggcggccgggtacgaggaggtggggcgggtggagggggcggtgctgtacgcgcccgcgtccggacgggac

SEQ ID NO: 2230 - DNA, 1521 bp, Streptomyces avermitilis
  CDS (1)..(1521)
gtgagcagcaccctcttcaggacgaagaaggtcgaacagtcgatccaggacaccgaggaacctgagcacgcgctcaagaaatccctgtccgcgttggacctgaccgtcttcggcgtcggtgtcatcatcggtaccggcatcttcgtcctcaccggcaaggtcgccaaggagaacgccgggcctgccgtctcgctggcgttcgtcgccgcgggcatcgcctgcggactcgcggcgctctgctacgcggagttcgcgtccacggtcccggtggcggggtccgcgtacaccttctcgtacgcctcgctcggcgaactgcccgcctggatcatcggctgggacctggtgctggagttcgcgctcggcacggcggtggtggccgtcggctggtcggggtacgtgcgctcgctcctggacaacgcgggctggcatctgcccgactacctcagcgggcgcgagggggccaccgggttcggcttcgacatcctcgccgccgcgctggtgctcgtcctcaccgtcatcctggtcatcggcgtgaagctgtccgcccgggtcaccacggtggtcgtcgcgatcaaggtcaccgtcgtcatgatcgtgatcatcgcgggtgccttcttcatcagcggcgacaactacaagccgttcgtccccaaggccgagcacgtggcggcgggcagcggagtcaagtccccgctggtccagctgatgttcggctgggcacccaccaacttcggagtgctgggcatcttcaccgccgcctccgtcgtcttcttcgccttcatcggtttcgacgtggtggcgacggcggccgaggagaccaagaacccgcagcgggacatgccgcgcggcatcctgggctcgctcctcatctgcaccacgctgtacgtggccgtgtcgatcgtcgtcacgggcatgcagaagtacacccggctctccatcgacgccccgctcgccgacgccttcaaggccaccggacacccctggtacgcgggcgtcatcagcttcggcgcggccgtcggtctgacgacggtctgcatgatcctgctgctcggccagacccgtgtcttcttcgcgatgagccgcgacggactgctgccgcggttcttctcccgcgtccacccgaggttccgcaccccgcaccggccgaccatcctgctcggcgtgatcatcgcgatcgtcgcgggcttcaccagcctcagcgaactggccgaactggtcaacatcggcacgctcttcgccttcgtggtggtcgccatcggcgtcatcatcctccgtcacacccgccccgacctgcaccgcgccttccgcaccccgctcgtgccgttggtgccgatcctgtcggtcctcgcctcgctgtggctgatgctgaacctgcccgccgagacctggatccgcttcgcggtctggatggtgatcggcttcgtcgtgtacttcctgtacgggcgctcgcacagccgcctcggacgggagcaggcggccgcggccggtcggacgccgacgccgtcgggcggcgacatcgag

SEQ ID NO: 2231 - DNA, 1926 bp, Streptomyces avermitilis
  CDS (1)..(1926)
gtgccgctgctgacccgcatcaggggaccgcgcgatctggaccggctcagcctggagcagctggaccagctggcagaggagatccggaccttcctcgtcgacgccgtctccaagaccggcggccacctcggccccaacctcggcgtggtcgagctcaccatcgccctgcaccgcgtcttcgactcgcccaaggaccgggtgctcttcgacaccgggcaccagtcctacgtccacaagctgctcaccggccgtcaggacttctccaagttgaagatgaagggcggcctgtccggctacccctcgcaggccgagtccgagcacgacgtcatcgagaactcgcacgcctccacggtcctcggctgggccgacggcctcgccaaggccaaccaggtgctcgaacgcgacgaccacgtggtcgcggtcatcggcgacggcgccctcaccggcggcatggcctgggaggcgctgaacaacatcgcggccgccaaggaccgccccctcgtcatcgtcgtgaacgacaacgagcgctcgtacgcccccacgatcggcggcctcgccaaccacctggccaccctgcgcaccacggacggctacgagcgcttcctggcccgcggcaaggacctcctggagcgcacgccggtcgtcggcaggccgctctacgagaccctgcacggcgccaagaagggcctcaaggacttcatcgccccgcagggcatgttcgaggacctcggcctcaagtacgtcgggccgatcgacggccacgacatcgaggccctggagtccgcgctcgcccgcgccaagcgcttcggcggcccggtcatcgtgcactgcctcaccgagaagggccgcggctaccagcccgccctccaggacgaggccgaccgcttccacgccgtcggcaagatccaccccgacacgggcctgccgatcgcctcctccggcgccgactggacctccgtgttcggcgaggagatggtcaagctcggccaggagcgcaaggacatcgtcgccatcacggccgcgatgctccagccggtcggcctcgacaagttcgccaaggtcttcccgaagcgggtgtacgacgtcggcatcgccgagcagcacgccgccgtctccgcggccggcctggccaccggcggactgcaccccgtcttcgccgtctacgccaccttcctcaaccgcgccttcgaccaggtcctgatggacgtggccctgcacaagtgcggtgtcaccttcgtcctggaccgcgcgggcgtcaccggcaccgacggcgcctcgcacaacggcatgtgggacatgtccatcctccaggtcgtgccgggcctgcgcctggccgcgccgcgtgacgccgaccaggtccgcgcccagctgcgcgaggccgtcgacgtcgacgacgcgccgaccgtggtccgcttctccaagggcgcggtcggcccggccgtccccgccgtgggccggatcggcggcatggacgtcctgcgcgagcccggcaccgacgccccggacgtgctcctcgtctccgtcggcgccctcgcgcccatgtgcctggagatcgccggcctcctcgacaagcagggcatctccgcgaccgtcgtcgacccgcgctgggtcaagcccgtcgacgaggccatggccccgctcgccgagcggcaccgcgtggtcgtcaccgtcgaggacaactcccgcgtcggcggcgtcggctcggcgatcgcgcaggccctgcgcgacgcgggcgtggacgtaccgctgcgcgacttcggcatcccgccgcgcttcctcgaccacgcctcccggggcgaggtcatggcggagatcggcctgaccgcgccggacatcgcccgccaggtcaccgggctcgtctccaagctcgacggccgcttcgagcgcccgacggcggagatcgactcggtggagcccgcgcgcgac

SEQ ID NO: 2232 - DNA, 1290 bp, Streptomyces avermitilis
  CDS (1)..(1290)
gtgagcatcgaaaagacctccgcgaccgcggaccaggccgccgtcgagaacccggaggcggccgcgggatcggacgtcgccgtcgacccccggctgctcgtgcgcgaacgaggcttcgccggctacatctccgagttcaagcggaagatccgcgccggtgacctgggctccctcccggtcgtcgtcggcttgatcatcatctgggcgatcttcgcgagcctgaactcgaacttcctcaccgcgggcaacctctccgacatctccgtggcgatggtcggtaccggcatgatcgccgtcggcatcgtcttcgtgctgctgctcggcgagatcgacctctccgtcggttccgtcagcggtgtcgcgggcgccgccttcgcggtcctcaacgtcacccacggcatgcccgagtggctggcgctgattctcgccatcctcacgggtacggtcgcgggcgccatccacggcttcgtcttcgcgcgcatcggtgtgccggccttcgccgtcaccctggcgggtctgctgttctggaacggcttcatgctccagatcctcggcagcaacggcacgatcaacctggacagctccggcctggtggccaagctgagcggttactacttcagcgacgtggcggcggcctacggtctcgccgtgttcgccgtggcggtcttcttcctcaccacgttcttcgacaaccgccgccgtgaggccgcgggggtgccgtcccgtccgctgagcgagatcatcgtccgtacggtgctcctcgccgtggtggccttcgccgccgccgccgtcttcaaccagtacaagggcctgccgctggccgtcgtcctgttcctggcggtcctggtgatcacggacttcgtgctgcgccgcaccgcgtacggccgcaagatcttcgcgctcggcggcagcatcgaggcgtcccgccgtgccggtatcaacgtcgccgcggtccgtatctcggtctacgcgatctccggcaccttcgccgccatcggcggtctgttcatcgcctccaagatcgcctcggcgaaccagggtgccggtgccggtgacctcctgatgaacgccatcgcggcggccgtcatcggcggtaccagcctgttcggcggccgcggccgcacctggaacgcgctgctcggtgtgctggtcatcgtctcgatccagtacggcctggcccttcagggcatcgcctcgccggtccagtacatgatcaccggtggtgtactcctcgcgaccgtcgtcatcgacgcggtcacccgcaagacccagaagtcggcgggccgcgcg

SEQ ID NO: 2233 - DNA, 786 bp, Streptomyces avermitilis
  CDS (1)..(786)
atggttcacgtgtccgctacgcccgtgctggcgttgcgcggggtctccaagcggttcggtgccgtccaggcgctcaccgacgtagagcttgagatccacgccggtgaagtggtcgccctggtgggcgacaacggcgccggaaagtccacgctggtcaagacgatcgccggcgtgcatcccatcgatgagggcgtcatcgagtgggacggcaaggccgtacagatcaacaagccgcacgacgcccagaacctgggcatcgcgacggtctaccaggacctcgcgctgtgcgacaacatcgacgtggtcggcaacctctacctgggccgggagctgcgcaagcgcggcatcctggacgaggtcgagatggagcgccgctcccgtgagctgctcaccacgctgtcgatccgcatccccagcgtgcgcatcccgatcgcctcgctctccggcggtcagcgccagaccgtggccatcgcccgctccatgctcggcgagcccaagctggtcatcctcgacgagcccaccgcggccctcggtgtcgagcagaccgcacaggtcctcgacctggtggagcggctgcgcgagcgcggtcacgcggtcatcctcatcagccacaacatggctgacgtgaaggccgtggccgacaaggtcgccgttctgcgcctggggcgcaacaacggcgtcttcgaggtcaagtcgacctcgcaggaagagatcatctccgccatcacgggtgccacggacaacgccgtgacccgtcgtgcggcccgcaacggggaggctcagaag

SEQ ID NO: 2234 - DNA, 1107 bp, Streptomyces avermitilis
  CDS (1)..(1107)
gtgaacacgcgtatgcgtcgtgccgccgttgctgttgccgctggtgcgatggccgtttcgctggccgcctgtggcagtgccaaggaatccaagggtgacagcgacacctcgagctcgaagaagggcgacgcgatcacggtcggcctgctccttccggagaaccagaccgcgcgttacgagaagttcgactacccgatcatcaagaagcaggtcgcggacctgaccaatggcaagggcaaggtcgtctacgccaacgccaagcaggacgccaccacgcagagccagcaggtcgacacgatggtcaccaacaaggtggacgtgctgatcgtggacgcggtggacgccaaggcgatcgccaactcggtcaagaaggccaaggacgccggcatcccggtcgtcgcgtacgaccgcctggccgagggcccgatcgacgcctacacctccttcgacaacgaagaggtcggccacgcccagggcaaggccctcctgaaggcgctgggctccaaggccaagccctccgccaagatcgtcatgatgaacggcgcgatcaccgacccgaacgccgccttcttcaagaagggcgcgcttgccgagctcaagggcaaggtcgacatcgcgaagtcgtacgacaccaaggagtggaagccggagaacgccaacgccaacatggagggcgccatctccgccctcggcaagaagaacatcgtcggcgtctactccgccaacgacggcatggcaggcggcatcatccaggcgctcaagtccgcgggcatctccgtcccggtcaccggccaggacgccgagctcgccggtgtgcagcgcatcgtcacgggtgaccagtacatgagcgtgtacaagtcctacccgcaggaggccgccgtggtcgccaagatggccgtcgcgctcggcaagggcgagaagctcgactccatcgccacgagcaaggtcgacagcccgaccaccaagcaggtcccgtcggtcatcgtcccggtcatctcgctgaccaaggacaacatcaaggacacggtcatcaaggaaggcttctacacggtcgccgacatctgcacggcgaagtacaagaaggcctgcgacagcatcggtctcgag

SEQ ID NO: 2235 - DNA, 1197 bp, Streptomyces avermitilis
  CDS (1)..(1197)
gtggagactccggggtcgcagtcgtccctgcatcgagccaatctggagcgcgtcgtacgtgcggtgcgccttgccgggtcgctcacgcaggcggagatcgcgaggacgacgggcctgtccgcggcgacggtctccaatatcgtgcgggagctcaaggacggcgggaccgtcgaggtcacgcccacgtcggcgggtggccgcagggcccgcagcgtctccctcagcggcgacgccggcattgtcatcggcgtcgacttcgggcatacgcatctacgcgtcgcggtcggaaacctggcccaccaggtgctcgccgaggagtccgagccgctcgatgtggacgcctccgccgcacagggcttcgaccgggcggaagagctggtcagccgcctgatcgcggcaaccggggtcgaccggtccaagatcgcgggcgtgggcctcggtgtgccgggcccgatcgatgtcgagtcgggcaccctcggctccacctccatcctgccgggctggaccggcgcgaagcccgccgaggagctgcgggggcggctcggcgtgcccgtgtacgtggacaacgacgccaacctgggcgccctgggcgagctggtctggggcagtggccggggggtcaaggacctggcgtacatcaaggtggcgagcggtgtcggggccgggctggtgatcagcggcaagatctaccgcggccccggcggcacagcgggcgaaatcggccatatcactctcgatgaatcaggccccgtctgccgctgcggcaaccgcggctgcctcgagaccttcacggcggcgcgctatgtgctgccgctcctccagtccagtcacggcaccgatctgaccatggaaggcgtggtcaggctggcgcgggacggcgatccgggatgccggcgggtgatcgccgacgtcggccgtcacatcggcagcggagtcgccaatctctgcaatctgctcaaccccagcagggtggtcctcggcggcgatctcgccgaggccggggagctggtcctggggcccatcagggagtctgtcagccggtatgcgatccccagcgccgcacgtcaactctcggtgcttccaggggcacttgggggccgcgccgaggtgctcggagcgctcgctctcgcgttgagcgagatgggcgattcgacccttttggatggcacgctttccgcggccacccctgccttcact

SEQ ID NO: 2236 - DNA, 918 bp, Streptomyces avermitilis
  CDS (1)..(918)
atgaagaccactgacaccccgcctccggtggaccggatcgaggaccgtccgcgagtgacgaagacagcggccgcgcggaagaaggagaagagcagcgagggcggcgtcctgaacgtcttctcgcacggtgtcctcatcctctgggcgatcatggtcgttctgccgctcctgtgggcggtgatgacgtccttcaaggatgacgactccattttcagctcgccctggtcgctgccggacaagctgcatttcgagaactggtcgcgcgcctggtcacaggctcacatgagcgactacttcggcaacacgctcatagtggtgggcttctcgctggtcggcacgctcgtgctcggctcgatggcggcctacgttctcgcccggttcgactttccgggcaaccgcttcatctacttcctcttcgtcggaggaatgagcttcccggtcatgctcgccctggtgccgttgttctacgtactgaacaacatgcggctgctgaacacgctgccgggcctgatcctcgtctacatcgcgtactcgctgccgttcacggtcttcttcctgacctctttcttcaggacgttgccgacgtcgatcgccgaggcggcgttcgtggacggcgcgtcgcacacccggacgttcttccagatcatgctgccgatggccaagccgggcctgatcagcgtgggcatcttcaatttcctggggcagtggaaccagtacatgctcccgacggtgctgaacaccgacccggacaagaaggtgctttcccagggcctcgtagagctggcgaccagccaggggtacaagggcgactggtcgggcctgttcgcgggtctggtgatggccatgctccccgtgctggcggcgtacatcatcttccagaggcaggtcgtgcagggactgacggcgggcgcattgaag

SEQ ID NO: 2237 - DNA, 921 bp, Streptomyces avermitilis
  CDS (1)..(921)
atgcaacacggcaagtaccgtttcattgtggggttcttggtggcccccttggcgctgtacgcgatcttcgtgatctggccgttcatccaggcgatctactactcgttcacggactggaccggtctgagccccgacttcaagatggtcggcttcgcgaactacaccagaatgttcgacgacgacatcttctggaagtcgttgcggcacagtctggttttcgccttgctgctgccgctggtgacgctgagcctcgcgctgttcttcgccttcatgctcaatgtcggtgggcggcgccgtaagggcgccgccatcaccggagtgcgcggctcgggtttctacaagatcgcctacttcttcccgcaggtgctgtcgatcgcgatcgtcgccctgctcttccagttcgcgtacaaccccaacgacggtgtgatcaacgggactttgcaggccatcggtctcggaagtgtccagccggactggctgggcgacccgaatctcgccctctggtgtgtgatggcggtgctcctgtggagcacggtcgggttcttcgtggtgctgttctccgcgggaatggcgtcgattccgaaggacttctacgaggccgctctcctcgacggcgcgagccggttcaccacgttcttcaaaatcactcttccactgctctgggacaccgtgcagtccggatgggtctacatgggcattctgtctctcggcgccgaggcattcgccgccgtgcagatcatgacggtaggtcccggtggtcccgactactcgaccacggtccttccgctgtacgtgtaccaatcggcgttccgcgacgcgaacgccgcctacgcgacaacgatcggtgtcgccctcctcgtcgtcacgctgctgttcgcggcgatcgtgatgaggctgggccggcgcgagcggctggagtac

SEQ ID NO: 2238 - DNA, 1455 bp, Streptomyces avermitilis
  CDS (1)..(1455)
ttgagcatgggatccacttccgccgagaaccgcaacaccggaggcatcggccgccgcgacctgatcaagcggtccgccgcgctcggtctgatctccgtacctacgatgagcttcttgtccgcttgtgcgagcagcgacagcggttccgaggacaaggccaagaccggcaagaagacgaagaagaacccgctgggcgtcaacgagaccgccgcgctgtcggtcgtcatcttcgacggcggtttcggtacgaagtacgcgaccgacgcgaacgccgagtacaagaaggcgtatcccaaggtcacgatcgatttccacaagacccagaagatccagtccgagcttcagcccaagttcaacggcggcactccgccggacctgatcgacaactcgggcgcccagcagatggacatgggtgtgctcgtcggcaagaagcagctgaccgacctcacgccgctcctcgacgcgccgtcgatcgacgacccggcgaagaaggtccgcgacacgctgcgccccgggatcgtggagatgggccagttcgacggcgaccccgtctggatcatgtactacgcctacacggtctacggcgtctggtactcgcagaccgccctcgagaagctcgactcgacgtaccccgaggactgggacgccatgctcgcgctctgcgcgaaggcgaagaagaagggcatcgccggctggacgtacgcgggcaagtacccgtactacctgccgttctcgctctaccccttcatcgccaagatcggcggccgcgaggttctcgacaagatcgacaacctggagccgaacgcctggaaggacccggccgtcaagtccgccttcgaggcgtactacgagctctacaagaagggctacatcctcaagggcaccccgggcatcgaccacatccagtcgcagaccgcctgggccaagggcaaggcgctgttcatcccgaacggctcctgggtggagaacgagtccgcgaaggtcatcccggcggacttcaacctggcggtcagcggtccgtccggcctcgacagctccgacaagatgccgttcgggaccatctgggcctccggtggcgaaccgttcatcgttccggccaaggcgaacaaccccgccggcggcatggagcagctccgcatcatgctcagcgaggcgtcgtcgaagaacttcaccagtcaggtgaagtcgctcaccgcgttcaacggcggtacggacggcatcgagctgaccccgggcctcaagtccggtgtcgcggccctggacaaggccggcgacaacgtggtcaacccgcgcctccaggactggtacgtgaagctccagaaggagcagatcggtgtctccggtctcggcgagatgatggcagggcggctcaccccggccgaggccatcaagaagatccagggctacgcggacgcggctgccaaggaccagtccatcaagcactacaagcaccag

SEQ ID NO: 2239 - DNA, 3843 bp, Streptomyces avermitilis
  CDS (1)..(3843)
atgcagcacggagctcggcacaggtggggtttgacatccgggtacagacccggttccgggcgcaggcccggtccttcggcggtcgttgcggtggccgccttcgctctggtggtggcctcgcagggcgcggccgtggcccggcccgcccaagcggcggcggccgaccgggaattcgcttcctcgttcgagtccggtgagccggccccggactggctcagcaccgtcgacacggcggcggacggttcgaagcgggcgtcgggggtggacggcggctacagcaccggcattccgggcaatgtgaccgaccacgtcacggatgtccgggccggcgccgagaacaccggagcgggcgaggtgaaggagaacctcgtcgacggcgaatcgagcaccaagtggctgacgttcacgcccacgggctgggcggagttcgacctcgacgccccggtcaagctggtgacgtacgcgctgacgtcggccaatgacgccgacgagcgcgaccccgccgactggaccctccagggctcgacggacggcaaggactggaagaccctggacacccgcaccggcgagtcgttcgccgagcggttccagacgaagtcgtacgaccttgcgagcccggccgagtaccagcacttccggctcgacatcaccaagaaccacggcgcggacctcctgcagctcgccgacgtccagttctcgacgggcggcacctccgacccggcgcccaaggacatgctctcgctggtcgaccgcggcccgagcggctcccccaccgccaaggcgggcgccggcttcaccggcaagcgggcgctgcggtacgcgggaacccacaaggccgacgcgcgggcctactcgtacaacaaggtcttcgacgtcaatgtgggcgtcgggcgggacaccgagctctcgtaccgcatcttcccttcgatggcggacaaggaccgggactacgacgccacgaacgtctccgtcgacctggtcttcacggacggcacctatctgagcgacctgaaggcgacggaccagcacggcttcgcgctgaccccgcaggggcagggcgctgccaagatcctgtacgtcaaccagtggaacaacgtcgtctcgcggatcgggtcggtcgcggcgggcaggacggtggaccggatcctggtggcgtacgactcgccgaagggacccgcgaagttccgcggctggctggacgacatagcgctgaaggccgcgccgcccgagaagccgaaggcgcatctgtccgactacgcgctgacgacccgcggcacgaactccagcagcggcttctcgcgtggcaacaacttcccggcgacggccgtgccgcacggcttcaacttctggacgccggtgaccaacgcgggctcgctcagctggctgtacgactacgcgcggtccaacaacgcggacaacctgccgaccatccaggcgttcagcgcgagccatgagcccagtccctggatgggcgaccggcagacgttccaggtgatgccgtcggccgcgtccggcaccccggacaccgggcgcaccgcgcgggcgctcgccttccggcacgagaacgagacggcccgtccgtactactacggggtgacgttcgagaacggcctcaaggcggagatggcgccgacggatcacgcggcggcgctgcgcttcacctatcccggtgacgacgcgagcgtgctcttcgacaacgtgacggaccaggcggggctgacgctcgacaaggagcacgggatcgtcaccggctactccgacgtgaagtcggggctgtcgaccggggcgacgcggctgttcgtgtacggggtgttcgacgctccggtcaaggagggggcgtcctccggggtcaagggctatctgcgcttcgcgccgggcgccgaccacaccgtcacgctgcggctcgccacctcgctgatcagcgtcgaccaggccaaggacaacctcggccaggagatcccggacggcacctcgttcaccacggtcaagaaccgggcccagcagcagtgggacaagctgctcggcaaggtggaggtcgagggtgccacgcccgatcagctgacgaccctctactccagcatgtaccggctgtacctgtaccccaactccggcttcgagaagatcggttcgaagtaccggtacgcgtctccgttccagccgatgccgagcccggacaccccgacgcacaccggggcgaagatcgtcgacggcaaggtgtacgtcaacaacggcttctgggacacctatcggacgacctggccggcctactcgttcctgacgcccggtcaggcgggcgagatggtggacgggttcgtgcagcagtacaaggacggcggctggacctcgcggtggtcgtcgccggggtacgcggacctgatgacgggcacgtcgtcggacgtggcgttcgcggacgcgtatgtgaagggcgtcgacttcgacgcgaaggcggcatacgacgcggcggtgaagaacgcgacggtcgtaccgccgtcctccggggtgggccgtaagggcatggccacctcgcccttcctcggctacacgagcacggacacgtccgagggcctgtcgtgggcgatggagggctacaacaacgactacggcatcgcacggatgggccaggcgctctacaagaagaccggcaagaagcggtacaaggaggaggccgcgtacttcctcaaccgggcgcaggactacgtgaagctcttcgacgggaaggccgggttcttccagggccgcgacgggaagggcgactggcgggtcgactcggccacctacgacccgcgcgtgtggggttacgactacaccgagacgaacggctgggggtacgccttcaccgcaccgcaggactcgcggggtctggcgaacctgtacggcggccgtggagcgctggccaagaagctcgacacgtacttcgcgacgccggagacggcctcgccggacttcgtcggctcgtacggcggcgtcatccacgagatgacggaggcacgggacgtccggatgggcatgtacgggcactccaaccaggtcgcgcaccacgtgaactacatgtacgacgcggcgggccggccctggaagacgcaggccaacgtccgtgaggtgctgtcccgcctctacaccggcagcgagatcgggcagggataccacggcgacgaggacaacggcgagcagtcggcctggtacctgttctccgcgctcggcttctatccgctggtgatgggcagcggcgagtacgccatcggctcgccgctgttcaccaaggcgacggtgcacctggagaacggccgggacctggtcgtcaaggcgccgaagaacagcgcgaagaacgtgtacgtgcaggggctgaaggtcaacggcaagaagtggacgtcgacctcgctcccccactcgctgatcgcgaagggcggggtactggcgttcgacatgggcgcgaagccgtcgtcgtggggcagcggcggcggcgcgggcccggtgtcgatcacgaagggcgaccaggtgccgtcgccgcgggcggacgccatcaagggtggcggtgcgctcttcgacgacacgtcggcgacgagcgcgaccgtgacatcggtggaactgccggtcgccgcccgcacgaaggcggtccagtacacgctgacgtcgtcctccgaccacacggcggcgccggccggctgggtcctcgaggcctcggcggacggcacgcactggacgacggtcgacaggcgcacggacgagtccttcacctgggacagacagacccgggtgttctcgatcgcgcatccgggcaagtacgcccactaccgcctggtcccgacggccgaggcgaccctggcggaggtggaactgctgtcc

SEQ ID NO: 2240 - DNA, 3312 bp, Streptomyces avermitilis
  CDS (1)..(3312)
atgcgtttccgtccgtcatctgtcctgctggccgtcaccctggtggtggccggcggcgccaccccggcgctcgcggcgaccaccgccccaccggacctcgtccgggaccccaccacgtacgtcgatccgctcatcggcaccacgaacggcggcgatgtcttccccggcgccgtcacccccttcggcatgctctcctggagccccgagaacacccgcggcgacgccacccgcaccgccgcccccggcggctaccagtacgacgccacccgcatccgcggcttcagcctcacccacatgtccggcaccggctgcgcgggcggcagcggtgacatccccttcttcccgtacgcgggcgacgtcacctcctccccggcgagcgacaccaaggacgccgtgtacgcggccgacttcagtcaccaggacgagacggccgagcccggccactacaaagtggggctctcctccggtgtcaccgccgacctcacggccaccgcgcgcacgggctcgggccgcttcacctaccccgcggacaagccggcctcgctgctgatccgcaccgccaactccgaggtgggctcgaccgattcgtccgtgcggatcgacccggcgacccgcacggtctccggctcggtcacctcaggcaacttctgcggctacctcgatcccgagggccggcgcggctactacaccctccacttcaccgcccgcttcgaccgcgccttcaagtccaccggcacctggcaggacgacaggctgaaccccggctccacggaggcgagcggcggcacgggcggcttctcccagggcgggcggcccgtcgccggcaagggagcgggcggctatgtggagttcgctcccggctcgggaccggtcaacgtcaaggtcggtatctcgtacgtcagccaggcgggcgccgaggccaacctcgcggtggagaacccccgcggccgctccttcgaggccgtccgggacgcggcgcgccgtgcctggcgcgagcgtctgggggcggtcggggtcggcggcggcacggcggaggaccgcaccaccttctacacggctctctaccacgccctcctgcaccccaacgtgatcagcgacgcggaccgcagataccggggcagtgacgacaaggtgcacgtcgtgggccgcgggcaccgggcccagtacggcacgttctccggctgggacgtctaccgctcccaggtgcagctgctgacgctgctcgatccgcgcaccgggtccgacatcgcgcagtcgctgctcgaactggcccggcagaacgggggaatctgggaccgctggctgcacggcgcgagcgggacacacgtcatgaacggcgacccgtccccggccgccctcgccggtatccgtgccttcggcggcacggacttcgatctgcgcggcgcactggactcgttggtgaaggcggcgaccgtgccgacgtcgcaggacctgtcggcggccgggaagccggtcctctcggtcggccagcgtccctccctcgacaagtacctgaaccgccactacatgccgtccgtctccaacgcgtggggcggggccgccgagaccctggagatgtcgggcgccgacttcgcgctgtcccaactggcgcgggcggcgggggagaaggagaccgcggcgaccttcgcccggcgctcccagtggtggcagaacaacttcaacatcgcggccgccccgtccccgagcgcccgggtcggctcgggcaaggggtacctcaacagcggctacatcgccaaccggaaggccgacggcagctgggtcaccggcttcaccccggccaccggcaacggcttcgtggagggcacggcggcccagtacacctggatggtgcagcacaacccggcgggactgttcgcggccatgggcggccgggacgcggcgctcgaccggctggacgccttcttccacgactccgacggcagctgggccttcaccggcagcggcggcgacaagtccgagctggacaacgagccgtccatcaacgtgccctacctgtacgcctacgcgggagcgccctacaagacgcaggagacggtccgcgcggcgatggacaagctgtggtcgacgcggccgggcggcattccgggcaacgacgacctcggcgcgatgtcgtcctggtacgtcttctccgcgctcggcatgtacccgcaggtcccgtcccgtgccgaactcgtgctggcctcaccgctgttcccccgcgtggagatcaggcgcccgcacggcaacgacatcgagatccgcgcggcgggcgcggcgaaggacgccccgtacgtgcggtcgttgaaggtcgacggccgcaccagtgaccgctcctggctgcccgcctccttcgtacgggacggcggccgcctcgactacaccctctccgcgaccccgaaccgcgcctggggtgccgacgccgccgacgcgccgccgtccttccgcgcgggcgagcagccgtaccagatcggcgtgggccccaccacggccacggtcgcgcccggcggcagcacgaagatcgacatcagggcgctggcgctcagcggcggaacgggacccgaggtgcgcttccgcgtcgagacgccggccggcgtcacggccacgcccgccgagggcacggtgtccgacggcgcccagcagatcacggtgaccgcggccgacgcggccaggcagggcttttacgacgtcaaggtgacggtgacgtcgcccgacacgtcgtacgagcaaccggtggccctgacggtggccgcgcccggctcactgctggccgcgtacgacaacacgggcgtctcggacgacgtgggcgaccacgacgaggccgactacgacggcgggggctggagctactcgcgccaggcgctggcgggcgcgggtctgaccccgggcacgcagggcacggtgaacggcctcacgttcacctggcccgactccccggcgggccgccccgacaacgcctcggcgaccggccggaccgtcgaactccccactccggcagccgaactgagcttcatcggcagcgcggtgaacggcaaccagcagacgaaggcgacggtgacgtacaccgacggcagcacggacccggtcgacctgtccttcaccgactggaccgtcggcggaggcggcggcacggtccagtacggcaacgaggtcgtcgcgaggacgccgtaccgcaatgtcgccggcgccgacaaggacccggtggccacgtacgtcttcgcgaccaagccgtacacggccccggccggcaagaagatcaagagcatcaagctccccgacaacacggacctgcatgtcttcaccctcgccgtgaac

SEQ ID NO: 2241 - DNA, 1173 bp, Streptomyces avermitilis
  CDS (1)..(1173)
gtgaggtgggagcgctcccatattccggcggaccggaacccgccggagggtaccgctcccacctcgcgcggaatccccacgactccgaccagagggatgtttgtcatgctccctacagtcgcacgattacccctctccacccgccacagagccctcctcctcgtcctgctcgccctcctcaccacggtcccggccctcggcctggtcgtcacggcgggcggaagggcggcagcccacggcacccccatgaagcccggcagccgcaccttcctgtgctggcaggacggactcaccgacaccggcgagatcaagcccgtcaatccggcgtgcaaggccgcgcagcaggtcagcggtaccacgccgttctacaactggttctcggtgctccgctcggacggtgcgggccgcacccggggcttcgtgcccgacggcgagctgtgcagcggcggcaaccccaacttcacgggcttcgacctcccgcgcagcgactggccgctcacgcacctgacgtcgggcgcgacggtcgacttctcctacaacgcctgggcggcgcacccgggctggttctacgtctacctgaccaaggacggcttcgaccccaccaagacgctcacctggaacgacatggaggaccagccgttcctgagcgtcgaccacccgccgctcaacggcagtccgggcacggtggacgccaactactcctggagcggcaggcttccgtcgggcaagtctggccgccacctcgtctacatggtctggcagcgctcggacagcgcggagacgttctactcctgctccgacgtcgtcttcgacggcggcaacggcgaagtgacgggcgtccacgacccgggcaaccccaccgagcccccgcccggcgtgtgctccgcgacccgtcgtacgacgggcagctggcccggcggttatcagtccgaggtcaccgtcaccaacaccggtgacgtcccgatgctcggctggatggtcgactggacgctgccgagcggccagacggtcgacagcctctggaacggcaacgcgacgtaccaggggcaggacgtgatggtgcacaacgccgactggaacgggtcgctggacccggggaggagcgcgacgttcggatacgtcgtcaggggctccggcggcgatccgtcgacggcgctcgcctgtcaggtcggt

SEQ ID NO: 2242 - DNA, 495 bp, Streptomyces avermitilis
  CDS (1)..(495)
ttggaccgccctgccgaggaaccgtcggggaaacgcctgggaactgcccgggaactggcgaggaacctcttctgctccagggacatctacctgtgcgaacagcacgggcagggaggaagcgaagcggtgcggggaccggatgcgggcgacgaccgcgaggccgacgccgacgacggcctgtgggggccggcgctggcgaacctcctcatcgggctgctcgcgatcctcccggccctgtgcctgtgccggctgctgaccccctacccgcaggccggctgcgacggcgggttcgcctgcgccggggaggcccccggccacacgaccggcgtgacgatcggcgccgtgctcggcggagcggcggtcctcgggctggtgctggtggtggacgtcctcatgccacggcaggaggggcggcggatgcgtacgtggctgggaatgaccgtactggtgccgataccgttcgtggtggggcaggcgttcggctggatccagggg

SEQ ID NO: 2243 - DNA, 1536 bp, Streptomyces avermitilis
  CDS (1)..(1536)
atgacggcccggccgcgagcgcgctcgctgcggacgcggctgctgctgttcatcggtgtcaccctcgtcgtcgtctgtgccgcgatgacgctcaccacggtcttcgcccagcgtgcctatctgctcggcaacctggacgagcgcgtcaccgacgccgccgagcgcagccagggcggagccgggctccatccggagaacgacacggacctggggttcctccacgagaacgggcagcccgccggcacgctcgccgcccggctcgacgtcgacgggtacatcaccgccgccgaggtcgtcagccaggacgccccgccgcgcgcgctcaccgccgcccagcgcgccgctctcgacggcatcgcgaccgacggctcgaagcacacccgtaccgtccccggcctcggcacctaccgggtcaccgcgctcgacagcaaggggatccgggtcctcaccggactcccgatgggggacgtccaggacatgatcggcggcctggtcctggtcgaggccgtcgtggcggcggccggtctcaccgccgcgggctgtgcctgtgccgtcgtcatccggcgccagctgcggccgctggggcgggtcgccgccaccgccgtggaggtctcccgctccccgctgggccacggcagggtcaccggcctcaccagggtccccgaccgcgacgccgacctcggcagcgaggccggacaggtcggcgccgccctcaaccggatgatcgaccacgtcgagtcctcgctcgccgaacgccagcgcggcgaggaggagatgcgccgcagcgaggaacgcatgcgccgcttcctggccgacgccagccatgaactccgtacgccgctggcctccatcgccgggtacgccgaactcatgaaccgcggcaccgagcggatcgagccgaacctggcctggcgccgggtctccgccgagtcggcacgcatgacgggtctggtggaggatctgctcctgctcgcccggctcgacgaggggcggccgttgcactcggccgaggtcgacctcgcggggctggtcgccgaggcggtgtgggacgcgcgggccgccggggacacccacgactggcagctggcgctgccgctcgacgtcccggcgctcgtcatcggcgacgaggcccggctccatcaggtcgtggcgaaccttctggccaacgcgcgcgtgcacacgccaccgggtacgacggtcgtcgcctcggtggaggccacgggcggctcctgcaccatccgcgtgcgcgacgacggtcccggcatcccgcccgctctgctgcccacggtcttcgaacgcttcacccgcgccgacgcgtcccgctcccgggcctccggcaaggtgggcggctcgggcctgggcctggccatcgccgcggccatcacggcggcgcacggcggccgcatccatgtcgacagcgccccgggccacacggagttcacgatcgaactgcccctggccccagagccggagcccacggaactggcggcaagcccggcactgtccggtgccctggaggccgcgcgggcacatccc

SEQ ID NO: 2244 - DNA, 723 bp, Streptomyces avermitilis
  CDS (1)..(723)
atgtctggcacccctgggccccgaaacggccgcgtccgtgtgctcatcgtcgacgatgaacccgcgctcaccgagctgttgtccgtggccgtcaccgaagcgggctggcggccctacccggcggccgacggccacagcgcgctgcgcctcgcgcgcggctgcgccccgcacgcggtggtgctcgacggaatgctgcccgacctggacggactccaggtgctgagacggctgcggtacgagagtccgaaactgcccgtgctcatgctgaccgcccgcgacgcgctggagcgccgcatcgaagggctcgccatgggcgcggacgactatgtgacgaaacccttctccctggaggaggtcgtcctgcggctgcgcgggctgctgcggcgggccggcaccgcgggggcccgggccgacgactcggtgcgggtgctcggcgacctcgtcctgaccgaggagacccgcgaggtgcaccgcgacggcacgccgatcgggctcacggccaaggagttcgacctgctcgccctgctgctgaaccacccgcgccaggtgctgagcaaggcccagatcctcgagcacgtgtggagcagcaccttcgacggcggcggcaatctcgtggaggtgtacatctccaacctgcgccgcaagatcgacaaggggcgggcaccgatgatccgcacggtgcgcgggctcggctacgccatcaggtccgcggaggacggcaga

SEQ ID NO: 2245 - DNA, 2715 bp, Streptomyces avermitilis
  CDS (1)..(2715)
gtgtcggcgaacagcttcgacgcccgcagcacgctgcaggtgggcgacgagtcgtacgagatcttccggctggacaaggtggaaggctcggctcgccttccgtacagcctgaaggtgctgctggagaacctgctccgcaccgaggacggcgcgaacatcaccgccgaccacatccggtccatcggcaactgggactcccaggcgcagcccagccaggagatccagttcacgcccgcccgcgtgatcatgcaggacttcaccggcgtgccctgcgtcgtggacctcgccaccatgcgtgaggccgtgaaggagctcggcggcgaccccgcgaagatcaacccgctggcgccggccgagctggtcatcgaccactccgtcatcgccgacaagttcggcacgaacgacgccttcgcgcagaacgtcgagctggagtacggccgcaacaaggagcgctaccagttcctgcgctggggccagaccgccttcgacgagttcaaggtcgtcccgccgggcaccggcatcgtccaccaggtcaacatcgagcacctcgctcgcacggtcatggtccgaggcggccaggcctacccggacaccctggtcggcaccgactcccacaccaccatggtcaacggcctcggtgtgctgggctggggcgtcggtggcatcgaggccgaggccgcgatgctcggccagccggtctcgatgctcatcccgcgcgtcgtcggcttcaagctcaccggtgagctcaagcccggcacgaccgccacggacctcgtgctcacgatcaccgagatgctgcgcaagcacggcgtcgtcggcaagttcgtcgagttctacggcgagggtgtggcggccacgagcctcgccaaccgcgccaccatcggcaacatgtcgccggagttcggctccaccgccgcgatcttcccgatcgacgacgagaccctgaagtacctgcgcctgaccggccgtgacgagcagcaggtcgcgctcgtcgaggcgtacgccaaggagcagggcctctggctcgacccggccgccgagcccgacttctccgagaagctcgagctcgacctctccacggtcgtcccgtcgatcgccggcccgaagcgcccgcaggaccgcatcgtcctcgccaacgcggcccagcagttcgcccaggacgtccgcaactacgtggacgaggtggacgaggcgggcaaggagtccttcccggcctccgacgcccccgcgctccgccccaacggtgcgccgagccgcccgaccctcgtcacggcccccgacggctcgacgtacgagatcgaccacggcgcggtgacggtcgcggccatcacctcctgcaccaacacctcgaacccgtacgtcatggtcgccgccgcgctcgtcgcgaagaaggccgtggagaagggcctgacccgcaagccgtgggtcaagaccaccctcgccccgggctccaaggtcgtcaccgactacttcgacaaggcggggctcaccccctacctcgacaaggtcggcttcaacctcgtcggctacggctgcaccacctgcatcggtaactccggcccgctgccggaggaggtctccaaggccgtcaacgagcacgacctcgcggtcacctcggtcctctccggcaaccggaacttcgagggccgcatcaaccccgacgtcaagatgaactacctggcctccccgccgctggtcgtcgcctacgcgctcgcgggctccatgaaggtggacatcaccaaggacgcgctgggcatcgaccaggacggcaagccggtctacctggccgacatctggccctccgaggccgaggtcaacgacgtcgtggcgaacgccatcggcgaggacatgttcaacaagtcctaccaggacgtcttcgcgggcgacgcccagtggcaggcgctgccgatcccgaccggcaacaccttcgagtgggacccgcagtccacctacgtccgcaagcccccgtacttcgagggcatggcgcacgagccgtccccggtcaccgacatcaccggtgcccgcgtgctggccaagctgggcgactcggtcaccaccgaccacatctccccggccggcgccatcaaggccgacaccccggccggcaagtacctcaccgagcacggtgtggagcgtcgtgacttcaactcctacggctcgcgccgaggcaaccacgaggtcatgatccgcggcacgttcgccaacatccgcctgcgcaaccagatcgcgccgggcaccgagggcggctacacccgcgacttcacccagccgggcgcgccggtgtcgttcatctacgacgcctcgcgcaactacatcgagcagggcaccccgctggccatcctggccggcaaggagtacggctccggctcgtcccgcgactgggccgccaagggcaccgcgctcctcggcgtcaaggccgtcatcgccgagtcgtacgagcgcatccaccgctcgaacctcatcggcatgggcgtcctgccgctccagttcccggagggcgcgaacgccgagtccctcggcctcaccggcgaggagaccttctccttcaccggcgtcgaggagctcaacaacggcaccaccccgcgcacggtgaaggtcaccaccgacacgggcgtcgagttcgacgcggtcgtccgcatcgacacccccggtgaggccgactactaccgcaacggcggcatcatgcagtacgtgctgcgcagcctgatccgcaag

SEQ ID NO: 2246 - DNA, 195 bp, Streptomyces avermitilis
  CDS (1)..(195)
atgccactcacattccgcaagagcttccgcatcctccccggggtgcgcctgaacataaacaagcactcctggtccctcaccaccggcggcaagcacgggcctcgccacacccacagcagcaccggacgacgtacgacatcgatggatttgcccggacctttcgggtggcgtcgtacccgtacggacaagcgccac

SEQ ID NO: 2247 - DNA, 1311 bp, Streptomyces avermitilis
  CDS (1)..(1311)
atgcatctgcgggtggtcggcggacgccgtctgtccggctcgatcgatgtcaagaccagcaagaacgcatgcgtggcactgctgtgcgccacgctcctcaaccgggggcgcacggtgctgcgccgggtcgcccgcatcgaggaggtgtaccgccttctggaggtgctcggctccatcggcgtacgcacccggtggatcaacgacggcgtcgatctggagatcgtgccgccggccgagctggagatggaggcgatcgacgaggaggcggcccgccgcacccgctcgatcatcatgttcctggggccgttgctgcaccgcgtggacagcttcaagctgccgtacgcgggcggctgcgacctcgggacgcgcaccatcgagccgcacatgatcgcactgcgccggttcggtctggagatcgccgcgaccgagggtctctaccacgcccaggtggatcgggcggtcacccccggccgcccgatcgtgctgaccgagcgcggcgacacggtgaccgagaacgcgctgctcgccgccgcccgccacgacggcgtcacggtcatccgaaacgcctcgtccaactacatggtccaggacctctgcttcttcctggaggccctgggcgtacgggtcgagggcgtcggcaccacgacgctcaccgtgcacggcgtgccgaacatcgatgtcgacgtggactactcgccgtccgaggacccggtcgaggcgatgagcctgctggccgccgccgtggtcacggagtccgagctgacggtgtgccgggtgccgatcgagttcctggagatcgagctcgccgtcctggaggagatgggcctcgaccaggaccgctcggcggagtacttcgccgacaacgggcgtacgcgtctggtggacctgacggtccggccctccaagctggaggcgccgatcgacaagatccacccgatgccgttcccgggcctgaacatcgacaacgtgccgttcttcgcggcgatcgcggcctccgcccagggcaagaccctgatccacgactgggtctacgacaaccgcgcgatctatctgacggacctcaaccgcctcggcggccggttgcagttgctggacccgcaccgggtcctggtcgaggggccgacccgctggcgcgccgccgagatgatgtgcccgcccgcgctgcggcccgccgtggtcgtcctgctggcgatgatggcggccgagggcacgtccgtcctgcggaacgtgtacgtcatcaaccggggttacgaggatctggccgagcgtctcaacacgatcggcgcgcagatcgagatcttccgggacatc

SEQ ID NO: 2248 - DNA, 672 bp, Streptomyces avermitilis
  CDS (1)..(672)
atgacggaccgcggtgagcgtccggtggtgccgtgggagttaccggatccgggcctggagccgaccttgcaggacccggatgtgcaaccgactatcagagacgtcgacgacgccacctacgtcccgaccgtcctcgacgcccactggaccagcgccgagcccgcgcccgagtccgacgtcctgcatttcggaccgggcgtcccgcccctggggctgacggacaccgccgtcgacgtctggcgcggcacggcgaagcgcaagagccagcaggagccctggggccgactgcaccggctacgcagataccgcctggcggcggtcgtcctggccatcgtgctggcctggttgttatggcaacggcagacggcggacctgcggatcactcaggtgacggcgcagacgagcagcgtcctcggctgtgacggaacagccgaggtggtcgcggtggtgaacaccaacggggcggccggcacgttcacctacgagtggaaccgcagtgacggaacctcctcgggcccgcgcgaagagcggttgggcagggggcaggacgagacgcacctccgcctgctgtggaccttccacggcaagggcaccagcaaggcgacagcgcggctggtcatcgagtcccccagccggcacacgacgtccgcgtccttcacctacacctgccgc

SEQ ID NO: 2249 - DNA, 1989 bp, Streptomyces avermitilis
  CDS (1)..(1989)
atggcaggagcgaccgatcgtgacgggtggaaagtcgaacggggcgacgattcatggaccgtccccggctatatcgatctgaagaaactgggcaaaggcggtgccggtcgggtgatgatcgcccgccatgccgggaccggccggaacgtcgcgatcaagtacctcaacgaggaactgtgttcgaaggtggaatttcgcactgccttgcgagccgaggcccggcttctcggtggcctgacatcccctcatgtgacgcggctctacgagtacgtcgaagccgagcagggcgcggcaatcgtcatggaactggtttacggcgccgcactccgcacgctgctgaaaaaggagggatccaccgacatcgaggccgcactcgtcgtgctgaaagggtccctgctcgggctcgccgccgcgcacggcgtcggagtggtgcaccgcgactacaagcccgaaaacgtgctggtgaactgggacggccagaccaagctggtggacttcggaatttccgcgcgcaccggcgaccgccacaacctgcgcggcacctgtgcgtacatgccccccgagcagtggaaattggaagccgccaccccggccggcgatgtgtacgcggcgaccgccaccctctacgagtgcgtgaccggcgtgcgcccgttcgaggggccggaaccatgggacttccagcgccagcacgttgacgagccggtgccgatggacagggtgccggaagaggtacgcgcgctggtccggcacggcatggccaaggacccggcgctccggccccccagtgccctcgacttcctgcgggaactggagtgggcggcggagaacgcgtacggacccgactgggaggaacgcggccagagccggctggccgcggtggcggcggccctggtgccgctggcgatctcacgcctggacgcccgtctggtgggctcctcggccgaactggcccgcaccgtgttgaccgcacggcgtcgcagtcggctgcgcaggcggggcgatgtgctcaccggcgcggccgccgtggcggtggtggggctgctgagcctgatgcccagcggctgggcggcgggtggggccgaagggcacgccggcgctcacgcccaggccgtcaccaggctcgacgcacggaaggacaccggctcggcgacggaggcgcggggcaccgagcacggcgacacggccgagtcggacccggactccgacagggctggcacatccggcgcccagggcggtggcggccacggagacggaggcgccggcctcgcgcccgccgatggcggcacccgttccgactcgggttccggcggtggggccggggacagcggcacggactcccccgacgacgggaacaacaccgtcgagaggaacggcgggacggagaacggcgggacggagaacggcgggacggagaacggcggtacggagaacggcggtacggagaacggcggtacggagaacggcggtacggagaacggcggtacggagaacggcggtacggagaacggcggtacggagaacggcggtacggagaacggcggtacggagaacggcggtacggagaacggcggtacggagaacggcggtacggagaacggcggtacggagaacggcggtacggagaacggcgggacggagaacggcggtacggagaacggcggtacggagaacggcggtacggagaacggcggtacggagaacggcggtacggagaacggcggtacggagaacggcggtacggagaacggcgggacggagaacggcgggacggacaacggcgggacggacaacggcggtacggacaacggcggtacggatgcgaggcacggccactcgaacgcggggaccagcgacggtgatcccgcgtcaacgggcggcaccgactccggcaactccgccggcggcaccggcaccggcaccggctcgggttcgacgtcagctgtgaccccgcggcaaggggatccggcggccgtggagggcgagcccggc

SEQ ID NO: 2250 - DNA, 588 bp, Streptomyces avermitilis
  CDS (1)..(588)
atgaacgagatgacgatgggccgccgtgagcggaagaaggccgccacccgcaaggctctggcggacgcggctctggatctattccttgagcgtggctatgaccaggtcagcgtcaaggacatcgccgacgccgccgatgtgtcgacgacgacccttttcaagcacttcccgagcaaggaggcgctggtcttcgacgaggacgcggagcaggaggcggcgctggtgtcggccgtacgtgaccgggctcccggccggtcgatccccgcggcgctgtgcgagggcatcctgcacatccgttccggcgccaacctggaggacccgcgtatcgccgcgttccgcgcgctcgtcgagggcacgccggtactccgctcgtacgcccatcgcatgtggatgcgtcaccaggccgccgtggcccacgccatcgccgaggagatcggcgcgccggacgacgacgcggcctgcgcggccctggcccgattcgccctcgaggcccccagggtcggcgagggctacccggacccccgtgagcggatccgccgcgctttcgacctcctcgagcggggctggtcggccgagcacgggcggggc

SEQ ID NO: 2251 - DNA, 1566 bp, Streptomyces avermitilis
  CDS (1)..(1566)
atgtccgcgactcgtccctcccggcccggcggcccggccgccgagccggccgccaccccgcccaacgtgcgttggacgctgctcggcgtgatgctcggaatgctgctggcgatgctcgacaacacgatcgtcagcacatcgatgccgacgatcgtcggcgacctgggcggcatggagcacatctcctgggtggtgaccgcctatgcgctggccaccgccgtctccacccccgtatggggcaaactcggcgacctctacagccgcaagcacgccttcctcgccgcgatcaccgtcttcctgatcggctcggtcgcctccggcgcggcacagtccatgacccagctgatcagcttccgcgtcgtccagggactgggtgccggcggcctggccgcgctcgcgttcgcgctgatcggctccctggtgtcgccgcgcgagcgcggccgctatcagggcatgaccgccaccgtgatggcgatcggcaccgtcggcggcccgctcctgggcggcctcatcaccggccacctgggatggcgctggtcgttctacatcaacctgccgctcggtctggtcaccctggtgtggtgccaggtgatgctgcgcctgccggtccagcgcaccaaggcgaggatcgactggctcggcatcctcctgatgaccgtcacgatcagcgcggtggtgctcgccgcgacctgggcgggtacgacgtacgcgtggggctcctggcagatcgtctcgctggccgtcgtcaccgtgctcggcctgaccgcgttcatcgcctcgcagaagcgcgccgtggagccggtactgccgctccgggtgttcgacaccggtaacttccggctggccggagtcatggtcttcgccgccggcgcggccatgttcggcgcgacgctctaccttccgctgttccagcagagcgttcagggcgccgacgcgacgagctccggtctgctgctgttgccgatggtggttccgatcgccctggtctccaacatcgcgggcaaggtcatgtcccggaccggcaagtacaagatcttccccatcctgggagccggcttcctggccgtgggcctcttcctgctgtcgaccatggacaccggtacgtcccgcaccgtcacttccttctacatggtgctggtcggtgtcgggctcgggttcctgatgcagatgaccacgaccatcgcgcagaacagcgtcgagatgcgcgacatgggtgtcgcgtctgcgggcgtcacgctcttccgcacgatcggcggctcgctgggcgtggccgtgttcggctcgctgttcacccgggccaccgaacaccacctcccctcggcggcgtccgggaacgccgacgcctcgctcagcggctccgccgtggaccggctgccgcagggcgccaaggacgcctatctgaccgcggtcgccgacggaacccagcagatcttcctggtcgccgcggccgtctgcctcgccgctcttctcgccgcgctcgcggtcaaggaggtcccgctccgcggcaagcccgtggccgccgaacccgcggagcagccctcggcagagaaggcgcggatttggcgc

SEQ ID NO: 2252 - DNA, 201 bp, Streptomyces avermitilis
  CDS (1)..(201)
gtgacggagcggacggaagcggcgggacgccgtgcgccggtgatccacgcctacgccgccgacccgaacgcgaccggcgacgcggtggcgaagaccgtggcggggtcggccggctcgacatcctggtcaacaacgcgggcgtgctcctctgtggcccgctgccggacatcactctggattagatcgaccggatcatcgcgg

SEQ ID NO: 2253 - DNA, 687 bp, Streptomyces avermitilis
  CDS (1)..(687)
gtgagtcctgacctgataccccatcaaaagagcctctcgccctcctacttggtgttctgcgacgtggacgagaccctcatccgctgcaagagcggccctgaattcctccgccactacttcgagttccggcacggggccgagggcgcgcgccgcaccgaggagctcctcgcggacctgtacgcgcggctggctcgtggcctgccgcgcgatgaggccaaccgggagtaccaccgggcctggcgccgctgcccggtcgacgaggtcgaggaccgggcccgccactggtaccgggaacgcagccgggccgcggacttctacatcaccgccacggtcgacgccctgcgccggcaccgggccgagggcggggccgtcgccctggtctccgggtcgttcccgccgctgctgcccctcgtcgcggaggaggtcggggcgcagtacgtgctcggtgcccggctggagcgctgcgggcgcgtcctgaccggcgaactcctgggcctgcccgcgatcggcgacggcaagcgcgtcctggcacgcgaactcctcgcccgccacccgcacatcgaccccgccgactgctacgcgtacggcgaccacccctccgacctgcccatgctgcacatggtcggccacgcgaccctggtgacccccgacggcacacacgcgcccgtgaagccggcggccctgacc

SEQ ID NO: 2254 - DNA, 1221 bp, Streptomyces avermitilis
  CDS (1)..(1221)
atgatgctgcgtcacaatcctgtggacgaaagcgtgaacgatacgtcgccggcgctgccggtcgccgtcctggccgcggccgagagcgccgccgcacatgccacggccgccgacgacgcccgcaggctcggcgacgagaccgtcgcgctcctgacccacgcgggcttcgcgcgccacttcgtgccccgcgcctggggcggcacggagggcacgttcgacagcctgctcacggcggtcaccgcggtgggggaggggtgcgcctccgcggcctggtgcgcggtcctgtgggcggcccacagccggttcgcggcctacttaccgtacgaagggcagcgcgacctgtggtcggccggccccgacgtacggatctccgcgtcggtcaggccgtcgggtgaggcgcgccggctgccgtccggctggctgctgagcggcgagtgggagtgcgtcagcggggtggacttcgcggactggcttctgctgtgcgcaccggagcccggcgtggagggcgcggcggggtcgcgcatgttcgcggtgccgaagggcgacatccgcgtacgtgactcctggcacagcaccgggctgcgcggcaccggcagccacaccgcggtgctggaacccgccctcgtacccgagcaccgcaccttccccatggcggacctgctggccgggacacccggcccgggacggtcccggtgccacaccgtgccgggtcacctcgccggcggccttctcttctgcgccccggcgctcggcgcggcccgccgcgcgctggcggagtggtcgtcctgggcggcccgggcccagacccggggacggccgcaggacgacggcagccgtctgcaccacgccctggcgcgctcggccgacgacatggaggccgcccagctcctcctccaggacgcggcccggtgcgccgacacgggcacccgcgccgaggcggacgtcctcaggaaccgccggatcaccgccgccgccgccgacctgctcgtggacggggtcgaacgtctcttccgcaccgccggcgtccacgcctgcggcggccccggcgtcctcgaacgcagctggcgcgacgtgcacacggtcgccgcccaccagatgctgcgcagggaagcggcggcgatggtctacgcgacgtccgtcttctcctcgctgaccgagccccgccccccggccacggcaccccagccggccgcactgctggaggtctccgcacgtgagtcc

SEQ ID NO: 2255 - DNA, 618 bp, Streptomyces avermitilis
  CDS (1)..(618)
gtggagccggcaaaggaggggagcgtcatgcccaagcaggcacgcgccctgcgtacctacgaccgtgtactcgacgcggccgcctacgagttcgcccgatacggctacacgaacgcgaacctgcagaacatcgcggaccgcatcaggctgacgaagggagcgctctacgggcatttcgccaacaaggaggaactggccgccgcgctggaccaccacctgtccgccacgctgggggtactgctcaccgaggcccggacatcgccccatccggcactgggccggctgcagtccctcgtcctcggtctgggccggctcttccggacggatctgcgggccctcgcggcgctgcggctcgcggcggagacggcccgttcgaccgccaagccgatacctctgctgacggagacgcacgacctcgtcctccagttggtgcgcgagacacagcaggaggggcactgggacgcgtcgatctccaccaggcctctggcggacctcatcgtggcggccctcttcggcacgttctggacggagaccgacaccggccacccagggtccgacgggaccgtcgacacgatgtgggaggccctggctcaggcgctcggcggcgccccggcccgc

SEQ ID NO: 2256 - DNA, 1035 bp, Streptomyces avermitilis
  CDS (1)..(1035)
atgtctgtcgtactcgatgattccaggaccatgaaggcgccatcaatgggtgccacggtcgaagtgctcagtttcctccagccggtgacacgagagctggtgcaccgcagctccatcgccgaggtgtttgtcaccgacggtgtgcgcaccggcgagaacgcgttctcggtcggggcccagtggccgcgcgatcacgcgctctaccacccggacgagaacgggctgaacgatccgctgctgttcgcggagaccctgcgccaggcccacttctacggggcccacacgtacttcggtgtgccggtcgggtcccgcttcatcggccaggacgtcagcttcgagatcacggatccgaccgcgctgcgcgtcggcgccgcgccgctggcggtggtgctgaacggtacgtggaccgaggagagggaccggcggggacggccggccggggcgcggctggacgtgacgctcacggtcgacggccgcccctgcggacgcggtcacacccgaggactgatgctggacgaccggcgctaccggctcttacgggggcgtccggccgcgagcggcgaggtgagcccgcctcgtcccgcgccggacgccaggatcgcccggccgaacagggtgggccggctgcgctggaaggactgcgtactggagcgggaccggcccgaccaggactggcggctgcgggtcgaccgcgatcacgcggtgctcttcgaccaccccaccgatcacgtaccgctgatggtcatgctggagggcttccggcagctcggccatctcaccgtgcacgaggcgtcccgcaggacgctcggcgaccgggccttcgccctggccggcctctccctggactgcgccgccttcggcgagttgggggaaacgattttgctctccctcgagaagggtccgtccgagggcgtgccgaccgaagagtgcgctctgcgcgtcgcggcccaccagggcgagaggctgctggcccgcgccgacatgacctggaagtgcgtgggcagccgcgctccctggtcacgtttcgcctcgtgg

SEQ ID NO: 2257 - DNA, 654 bp, Streptomyces avermitilis
  CDS (1)..(654)
atggacgtcatgagtagcgagcgcaacggacagagcacccgtctcccggcgggcacccccttcgacgacaccgcccacctcaagcagcagcgtgcgatccgcacccgcggcacgatcctcaacgccgccgccgcggcgttcgccacggacggcttcccccaggtcaccatcaaggacatcgccgacggcgccgagatgaccaagggagccgtctacttccacttccccaacaaggaggcgctcgccgtagcggtgctggaggagttctaccggcgcatgcaggaggccgtcaacggcgctctggagcacggggaccccacatccccgacgaccgtcgtcgacgtgatgaggcgcctcgcccgcgccttccacgaagacgtcttcatccacgccggggcccgcctgcagatcgaacggccgtacatcaaggccgagctgccggtgccgtacgtggggacgctgaaggtgctcaccgagctcctggatcagtgccgcaccgccggcaacctccccaagagcacgaagcccgaggccctggcccgcgcgctcggctccgccgtgttcggcgcccagcacatctcctgggtgctgaacgaccgcgaggacatcgtggagcgggtggaggagatcatcgacgccttcgtgccactgcac

SEQ ID NO: 2258 - DNA, 867 bp, Streptomyces avermitilis
  CDS (1)..(867)
gtgacgcggccgccgccgggctgcgcggcgcgcccgacatcatcgagcaccaggacggcttcctggcccggttcgcgacggtgccgctgccccaggcggtggcgaaggggctcggcagccgctggcacaccaacaccctctcctttaagatgcaccccggcgggccccggcatcaacgcggccgtggactgcgccgccgacatccaccgcgaactcggcccgctgcgcccggacgacgtgcgggagatcgtcgtcgaggcgtccttgtacacgctgttcgcgggggagcgcgcggcccgctacgtcgacggccccgcctctccgctgggcgcgctcgtcctcgacgtcccctacccggtcgccaccaccctgctgaccggcgacttctcggtggacgacttctcctcaccgcatctggacgaccccgcacgctgggcgctggcccgccgggtgcggctggagcacgacacggcgatgacccgcgaactcttcctgtccgacgcgccgttcggcgaggcggtgcgcgaggcgggcccgctggccacgccgtggctgcgcggcttcggcggcgacgcgctcgtcgacctcgtcggcacgctggaggccgacggccgggacttctcccgctccaccaaggccaccggcgcccgggtcacggtacggctgaccgacggccgtacggtcacccgctcccgcctgatcccggtgggcgcggcgggcccggacacccgcgtccgccactccgagatggtccaggagaagtttctgtcggtgggcggcccccgtcgggtggccgacacggtggggcggctgcaccgtatgcgcccgcgaggtgtacgccgctggatagaggcggccttcctcgac

SEQ ID NO: 2259 - DNA, 1668 bp, Streptomyces avermitilis
  CDS (1)..(1668)
atgacggcagctgtactcagcgagcgagtggccagggccctgtgcgagcagtgggagcagcagacgcggcccgcccgctcgcgcccgtcctcggacaccccgctgcgcgaactgtcccactgggccgcgaacctgcgccccgaacacatcccgtgccgcgtcctgaagctcgcggccagccaggtgctctcccagatcgcctcgatccgggccggcctcgaacacccgctgggccgccggctggtggcggccttcggtcaccccatgcagcgcgacccgcgagccgccgcgggcgtcttcgccgccctcggctcctggctcaacctcgacgacaccgcgtacgccggacacctgtccaactccaccgtcgcggtgccgctcgccttcgcgtacgcccgtcagctcgacgggctctccctgctgaccgcggtcgtcgcggccaacgagtgcgcggcccgcatcaccgcctccgccaccctcggcccgctgcgcggtcagagcgccgtgcacacccacctggccggcgcggtggccggccggctgcactgcgaccgggccccggccgaccagtgggagaacgccctggggctggccttcgccatgcccaactggccgctgatgcgggccttcctggccagcgacgcccggctgttcaacaccttcacgccggtacgcaccgcgatggacgcctgtgacgcggccgccgccgggctgcgcggcgcgcccgacatcatcgagcaccaggacggcttcctggcccggttcgcgacggtgccgctgccccaggcggtggcgaaggggctcggcagccgctggcacaccaacaccctctcctttaagatgcaccccggcgggccccggcatcaacgcggccgtggactgcgccgccgacatccaccgcgaactcggcccgctgcgcccggacgacgtgcgggagatcgtcgtcgaggcgtccttgtacacgctgttcgcgggggagcgcgcggcccgctacgtcgacggccccgcctctccgctgggcgcgctcgtcctcgacgtcccctacccggtcgccaccaccctgctgaccggcgacttctcggtggacgacttctcctcaccgcatctggacgaccccgcacgctgggcgctggcccgccgggtgcggctggagcacgacacggcgatgacccgcgaactcttcctgtccgacgcgccgttcggcgaggcggtgcgcgaggcgggcccgctggccacgccgtggctgcgcggcttcggcggcgacgcgctcgtcgacctcgtcggcacgctggaggccgacggccgggacttctcccgctccaccaaggccaccggcgcccgggtcacggtacggctgaccgacggccgtacggtcacccgctcccgcctgatcccggtgggcgcggcgggcccggacacccgcgtccgccactccgagatggtccaggagaagtttctgtcggtgggcggcccccgtcgggtggccgacacggtggggcggctgcaccgtatgcgcccgcgaggtgtacgccgctggatagaggcggccttcctcgactgaccacgcgcggagcctcaggcgcaccgcagggggagttccaggcgcccttcctcccggggtacgggccgcgccgcgtcacgcacgaccggtgcgcgggaccgccgcgg

SEQ ID NO: 2260 - DNA, 366 bp, Streptomyces avermitilis
  CDS (1)..(366)
atgagcgacatcaccaccaccgtcacccagtacctcgccctgtggaacgagaccgacgcggacaagcgcgccgcgggcatcgccgagctcttcgccccggacgccccgtacatcgatccgctggcggccgtcgagggccacgagggcttcggtgccgtcgtcgccggcgcgcaggagcagttcaagggcctctccttcgagctgcacggcacggtggacacccaccacaacctcgcccgcttccagtggggcctggtgaccgcgccgggcaccgagcccgtcgcgatcggcttcgacgtcctggtcaccggcgacgacggccgcatcaagggcgtctacgggttcctggacaaggtccccggcgcc

SEQ ID NO: 2261 - DNA, 957 bp, Streptomyces avermitilis
  CDS (1)..(957)
atggcagacagcgccgcagccctgggccccacccgggccctggtcctggccaaccccgcctccggcagccacagcccccaactggtccgtgaagtgaccgagttgtgcggctcctgcctggagcacgtcgagcttcacccgaccacggcaccgggggacgcgaccgtcgccgtgcgccgcgccctgcaacggcccgcccacgcacccgacctcgtggtcgtcatcggcggggacggcaccgtccgcgaggcggtacagggcctggcctccgcgcccggccgcgccgcgctcaccgtggtgcccggcggcaccgggaactcgggctacaagatgctgtggggggagcgcccctggaccgagtccctcaaggcggtcctcaccgactcgggcgtgggcggcagcgcccggctgcgccggcacgacctggcgcgcctggccgagacccggcagtacgtctatctgggcgcctgctccggagtgatcgccgacgcgctgatcacggcccgggacatcccgctgacgggccgggatctgtacaccaaggcgttcgccgacacggccgccgcgtacgtcccgtacccgggccgcgtcaccgtcgacggacgcgtggtgcacgagggcccgaccgtcctggccaacgtcggcggcggccgctaccgcggcggccggtacctcgtcctgcccgactcgctcctcgacgacggactgctcgacgtctgtgtcatcggcgacggcgtgaccgccgcggacgtaccccgactcaccctgaacgccgaccacatgggacacccggccacggtgtacgcgcgtggccgcaccatcaccgtcgagcgcaccgacggccgccggctgcccctggagcacgacggcgagtaccagcacggcatcggaccgtcggcgaccttcgaggtccagcccggagccctgcccgtgtgggccccggccatcgaacggaac

SEQ ID NO: 2262 - DNA, 1467 bp, Streptomyces avermitilis
  CDS (1)..(1467)
atggccttggagtctccacgggaagccgccccgaagaaagccgcgaccgaggagcggcaaccaccctcggcgccacactgggcgaccctgccgatcatcctcatcggcacgttcgtcatcacgctcgacgtcttcatcgtcaacgtggccattcccgccacccagcaggatctccacgcgagccagtccgccgtcgagttcatcgtcgcgggctacgcgctcgcgtacgccgccggtctcgtcaccggcgggcggctcggcgacctgtacggccggcggcggctcttcctcatcggcgtcgcgctgttcaccctgtcctccgcctgggccgggttcgcccccagcgcgtcgcagctggtggcggcccggatcgcccaggggctggcctcggcgttgatggggccccaggtcctggcgatcatcggagtggcctacgacgggccggcccgggtccgcgcgttcaacgccttcgggctgaccatggggctcgccggggtcttcgggcagctcatcggaggcgtgctgatccacgccgacatcgccggactcggctggcgcacctgcttcctggtcaacgtgcccgtggggatcgcggctctcgtcctcgctccccgggtggtgcccgagtcccgggcccagggccgcgcgcggctcgaccccctgggcatggtgctgatctccgcgggcctggtcgccgtcgtcctgccgctggccgagggacagcaggagggctggccgttgtggacctggctgagcctggccgccgcccccgtcctgctggtggtcttcgccgtccagcagcgccgcctcgccgccgcgggccgcagcccgctggtcgaccccgcgctgttccggcagcggtcgttcacgttcggggtcagcaccgcggtcgtgtactactccgggatggcgtcgttcttcctcgtcctggcgctctacctccagcagggcctggggctgaccgccctggagtccggtctggtgttcctgcccctcggcgtgggcttcctgaccgtctcgctcagcgcacgccgcatcgccgcggcgctcggccggcagaccctcgcggtcggcgcgctggtgctcacggcggggctggccgcgctgttcgccgccgcgcagcacatcggcacggacggcgccgtcggctggctggtgccggggctgacggtcggcggggcgggcatggccatggtgatggcaccgctggcgtccatcgcgctggccggcaccgacccgcgctacgcgggagcggcgtcgggcgtgctgtccaccgccagccaggtgggcggcgccgtgggcgtggccctggtcggcgtcgtcttctaccacgtcctgggacagggcaccggcacgtccgcctacgccgacgccttcaccgcctccctctacctgctggcaccactggcgctggccgtggcggcgttcgtgcagttcatcccggggccgaaggcggcgtcgtccgcc

SEQ ID NO: 2263 - DNA, 1017 bp, Streptomyces avermitilis
  CDS (1)..(1017)
atgagattcgagaatgatctgtacatcgcctcgaccgcgtcctggctgccggacctggtccccatggaggaggccatcgcggcgggactggtcgacgacgagcaccggaacctgggctacgagtcgatcgccgtggccgacggcgtcgccggccccgagatggccgtccgcgccggccggctggccctggagcgggccgtcgggatcgagcgggacgaggtcggtctcgtcctgcactcgtcctgcggtttccaggggcacgagatgtggcccgcggcggcctacgtcgcgaacgagacggtgggccgggccgctcccggcttcgacctccagcagcgctgcaacgccgggctgggctcgctgtgcctggccgccggctacatcgacgccggtttcacctccgcggtcctgctgaccaccggagacaacttcgccccgccctgggtcgaccgctggaacgtacagctcaacctggtcttcgcggacggcggcaccgctctggtgctgtccggacggaagggcttcgcccgtgtcgtctccgccaccctgggcgccgacaactccctggagcggtggaaccgggggacgaccccgttcgccaccgcgcccggcctcgaaatgccgctgcggctgcgcgaacgcggccttcagcacgcggccacccccgaggccgagggctcctgggagcgcatcgaggccgccctcatggacaccacccggcgggccctggccgaagcccaggtgagcgtcgaggacatatcccgcgtggtgacaccgctcatccaccgcggggtctggcccgagaactacgacgtgctcggcttcaccgagaagcagagcacctgggacctcggccgcctggtgggccacatcggcgcgggcgaccagttcctcggcctcgaacacctggtcaaggaacgcgcggtgggaccgggcgacctcgtgctgctcgtcgcggcgggagcgggattcagcctctccgccgcggtggtggagatcctcgacgtcccgccctgg

SEQ ID NO: 2264 - DNA, 765 bp, Streptomyces avermitilis
  CDS (1)..(765)
atgtcccgcgagggccagtggttccaccccgccgagccttccctggacgcctccgtacggctgttcctgctgccgcacgcgggcagcggcgccatcatctaccgcgactgggagaacctgcttccgtccgacatcgccccgcaggcggtgaccctgcccggccgccacaaccgccgtggcgaggcgacgttcgaggactgggacccgctgctcgacgccctgcacgaggccgtgctcgacgacctcgacgaccggccgttcgccttcttcgggcactgcctcggcgcccagctggccttccggctggccatccgcatggaggaggacggcgggcccgcgccggtcatgctcggcatgtccggctggtcgccgcagggcttcttcctgcccaccgaggagcagagccggatgcccgcggccgagatggtcgagtggatcaagaagctgggctcgttcccggccgagatctacgacaacccggagatgctcgccctggtggtcccggcgctgcgggcggatctcagggtcgccgcgcagtacgtggacgacaaggccggcgtcagctgcccgctcgcgtcctacggcggccgctcggacccgctccaggagcacccggacgccatgacgcactgggccgggcgcagccccgactacctgggccacagcgagtacccgggcggccacttctacatcgacgcccacgcgcagtccgtcaccgcgcacttcgcccagcggctccagcgcgtcgtctcggcactggtgagc

SEQ ID NO: 2265 - DNA, 1101 bp, Streptomyces avermitilis
  CDS (1)..(1101)
atggacgccgagcgccctggacgtgccccgcaaggggcgcggggaaccgcgcgatcagcccccgacgacacgcggtcgacgaaccaaccgcagtcccccgaccgagccctgcggatcggcatcctgctccccacccgggagcaggccatcaacggcgcctacgcggcggcccccctcctggacttcgcccgtcaggcggagcgcctcggcttcgactccctgtgggccggcgactccctgaccgcccgcccccgcctcgaccccctcgtcgtgctcgccgccgccgcggccgccaccgagcggatcaccgtgggcaccgccgccctcacccccgccctgcgccacccgctgatcggcgccaacatggtcgcgagcctcgggcacgtcgcccgagaccgcctggtactcggcctcggctcgggtttcccgatgcccgagaccgaggaggagttcgcctccgtcggcgcgtccttcgccggacgggtcggccgcctcgacgagatcaccgcgctctggcgcaccgcgtggaactccggggaaccgggcaaccccaccgacttcgacggcaggttctggcaggcggaccgcctcgaccggctgcccgctcccgccacccccggcggcccgccgctgtggctggcgggcagcgacaccccgaaggtgctcgcccgcgtggccacccgctacgacggctggctgccgttcctgccggacgccgacgcctacggcagggcccggcgcaggatcgccgaactcgccgaggaggccggccgcggcgccgacgcggtgacgcccgccctgtacgcgacggtcaccgtcaacagcgacagcgccgccgccaagtccgagctggagcactacatcacccactactacggacgctccctggaacagatgtcggccatccaggcctacggctggggcagcgccgagagctgtgccgagtggctcggcggctatgtccgcgccggcgcccggcacctcgtcctccggatcggatcgctcgacccggagccgcagttgaaggaaatcgccgaggtactgctccccgcggtacgcgcgctcggcgggcagaccgtcaccgtaggaggagcgaagtcg

SEQ ID NO: 2266 - DNA, 1602 bp, Streptomyces avermitilis
  CDS (1)..(1602)
atgaccacgacagccaacgggagttggacactcacccacacctcccgcgcccacgccggcagccgtccgcaccacgcggcgatcgtctgcgagggccggatcaccacctacggaaagctgcaccgcgagagcaaccgcgccgcgcacgccctgcgcgtcagtggcgtacagcgcggtgaccgggtcgcctacctggggcgcgagtcggagaactactacctggtgatcctcgcctgcgccaaggccggcgcggtgctggtcccggtcaactggcggctcaccccggacgaggtcgaccacatcctgcgcgactcgggcgccaccctcgtcttcgtcgacgacgagttctgggccaccgccaccaaggtccgcccgcacctgccggaattccacacgatgatccggatcgacggcaccgacgccgaaggcgaaccggcccgcggcgccggactgcccgcctggtacgcggaccagcccgacgccgacctggagccgggcaccgggcccgacgacgccgtcgtgcagatctacaccagcggcaccaccggactgcccaagggcgccgtcctcgcccaccgcagcttcttcaccctgccgcaggccatgcgcgaccacgacgtcgcctggatcgactggctgcccgacgacgtcgccctcatctcgctgccgggcttcggcatcgccggcatcggctggttcatgcacaccttcaacgccggcggcaccagcgtgatcatgccccagttcgacccgcaggaggcggtgcggctgatccgtacccaccgggtcaccaccaccttcgccgcgcccgccatgctccagatgatggcgggcgaacggaccgccgggcccgacgcgttcgtctccctgcgcaagatctgctacggggccgccccgatgtccgagacgctgctgaagcagtgcctggagacgttcgactgcgagttcgcgcagatctacgccagcacggagaccggcagcgtggcggtctgcctgccgcccgaggcgcaccacccgggcagcacggtcctggagtccgtcggcaagccctgccccggcaacgaggtgaaggtggtcggcccggacggcgccgaactgccgcccggggccatcggccagatctgcgtccgcgccccctcccggatgctcggctactggaacctgcccgaggccaccgggcgcaccctggtgggggagtggctgcacatgggggacgccggctacctcgacgaggacggctacatctacctgtgcgaccgcatgaacgacacgatcatcgtcgccgggcagaacatctacccggccgaggtcgagaaggccctcgccgcccacccggccgtcgcggactccgcggtcgtcgggctgcccgacccgcgctggggcgaggccgtgcacgccgccgtcgtgctgcgccccggtgcccaggcgagtccgcgcgaactcctgctgtccctgcgcggccatctcgccgactacaagatcccgggcgcctaccacttcgtcgacaccttgccccgtaacccgtcgggcaagatcctgcggcgcgcggtgcgcgagcggttgagcgccccggcacgcgatccgctcacgtcagcggtccag

SEQ ID NO: 2267 - DNA, 1899 bp, Streptomyces avermitilis
  CDS (1)..(1899)
gtgaccgcgctggacgccgcccgacagcccgtaccgccccggctgtggctggtgaccgagggcgcccagtggctgcccggcgacccggcgggcgacggcgggcacctggccgccgccaccctgtggggcttcggccgggtcctgctcaccgagtacccgcgccaccgcgccacgctcgtcgacctcgccccgggcagcgacctcgcgccgctgctcgacgagtgggaggccgaggccgccggtgagtaccagatcgcccaccggcccggccgccgctatgtccgccggctcctcgccggtgacgccacgctcacctggagcgggggctacgaactgcgcgcccccgactccggggacctctcggacctcgcgctcgtggccgccgcggaccgggcgccggacgccgacgaggtccaggtccgcgtcggctccgtcgtgctcaccgacgacgacgcccgtaccgccctggacaccggacgcgccgaacgggaggaggaggaacccccgcccgtgctcggcgccctcgccaccggcaccgtgctcgcggccggcgacgggtccggattcgccaccggcgacgaggtcctcgtacgccacgccgggaccctgcgctccacgctcaccgtcccgtccgcgtccgtcgtgctcgcgccgcaccccgaaccccactacggcgcccggcacttcggcctcgacgagacgggcgaggccctgcgcaccgccctcctcgacccggacacgcaggtgtgggtggacctgcccggcgaggcggcggacgagccgtccgccggcgcgcaggccgggaccgacgcccccgcggacatccgccccgaccgcacctacctcgtcaccggcggtctcggcggcctcggcctggtcaccgcccgcaagctcgtcgccctcggcgcccgccacctgaccctggtcagccgcagcggaaaggccaccgaggcggccacgccgctcctcgcgaagctcgccgaggacgccgaactcgccgtcgtacgcgccgatgtgagccggcccgcggatgtgcgcaggctggtggccgaggtggcggcgggcccgtatccggtcggcggcgtcgtgcacgccgccgggtcctacgacaagaagctgatctccgaactcacctgggagtccatcgacgcccagctcgccgcgaaggcgtacggcggctggctgctgcacgaggccgcccaggcctcgttcccggagctggagttcttcgtcacctactcgtcgatcgcctccgtcctcggcggcgccgcccaggggcactacgccgccgccagcgccggcctcgacagcctcgccgagtggcgcacccgccagggcctgcccggactctccgtcaactggggcgcctgggccagggtcggcatgtccgcccgcctggaggaacacctcagccgggagatcgaacgcggcggtgtccacttcttctcgccgacccgggcactcgacaccctggcccggctgtggggcggcacaccacgcacccagcgggtggtgggcgagttcgactgggaccgccatgcggcggacagcgagaccggcgaccagttctacgaccgcctggtccgaccggaccgcgccgacgacgggctcgaccgggcccttctcgccgcgctgccgaagccggagcgcaccgctctgatcacccaggtggtccgcgagaaggtcgccgccgtcctgcgtctgacggccggcgacgagctggagacgacggccgagttcggctcactgggcctggacccgctgagcgcgcggcacgtcacctccggtctggagcaggcgttccggctgcccctgcccgcctcactcgccctcgaccacccgaccgtacggcagctcgccgccttcctcgacgggcagctgtgcccggtgccggcggcc

SEQ ID NO: 2268 - DNA, 3759 bp, Streptomyces avermitilis
  CDS (1)..(3759)
atgccgcgtacggagtcacagacggaagagacgaaccgggcgccggggcaggcacccgagccgatcgcgatcgtcggaatcggtctgcgcctccccggcggcggcaactcgcccgacgagttcgacgcctacctgcgggaaggccgcggcgcgaccggccccctcgaccgcctcgacacgttcgacgcctccttcttcaacatctcgccgaaggaggccccctacctggatccccagcagcggatgctgctggagaccgcgtggcaggccctcgagcacgccaacatcgaccccaccccgctgcggcgcggcaacggcggcgtctacctgggcgccggctcccgcggctacgcccccgaaccggccccgctgccgtacgaggagccggacggccccctcgccgccggcgtcaccacgtgcgcgctgtcgggccggctgtcgtacttcctgggctggcgcggtccgagcctgagcgtcgacaccgcgagctcgtcctcgctggtcgccctgcacctggccgtgcgggggctgcgggcgggcgagaccgacatcgcgctgtgcggcggggtcgacgccccacaccgcccgcgcgttgcggggaagctcgccgagggctgcggtgtcgtcgtcctcaagcggctcggcgacgccacccggcacggcgacaccgtgctcgccctggtacgcggcagcgccctcgcgcaggacggcgacggcgcgggcccggccgcccccgacggcgccgtgcaggagaaggtcgtccgcggcgcgctcgccgcggcccgcctcgcccccgaggacatccagtacgtcgaggcgcacggcaccggcacctcgccggccggctccgtcgagtccggcgccgtcggccgcgtcttcgccgagtcgcacaccgaggacgctccgctgctggtcggctcggtgcagaccgacctgggccacctggaaccagcgtccggcatcgtcggcgtcatcaaggcggtgctccagatcaggtccggcacggtctacccgcaccccggccgcaccacgtcctccgggcgcgacgcgggggagccccgcttcgtgcgcgtaccgaccgcgtgcgagccgtggcaggccgacgtccggcgcgcggtcgtcagcagcctcggcttcgcgggcaccgtcggcgcggtcgtcctggagcagccgcccgccgtgaagcactccgaggagaccgccccggacgccgccgcccccctgttcaccctctccgccaagagcgccgccgccctgcgcgaacaggcccggaactaccggcggttgctcgcccagcggcccgacgtcccgctggccgggctgtgctacaccgccaacgtcggccgctcccaccacccctaccgcgtcgcgggaccggtcgccgaccacgcggcgctcgtccggctgctcgaccaggcggccggccgggaccacgagggcccctccggcatccgcaggaccgccttcatgttcagcggccagggctcccagtacgcgggcatgggcgccgcgccgtacgagcggttcccggtcttccgcgagcacgtcgacgcctgcgaccggctgttcgcaccgcacctgggccgctccgtggccgcactggtgcgcggcaccgccgccgacccggaggcgatcgaccgcaccgagtacgcccagcccgccctgttcaccctggagtacgcgctcgcccggctgtggatgtcctggggcgtgcgcccccacgtgctcatcgggcacggcatcggcgaggtcgtcgcggccgccgtggccgggctgttcagtctgccggacgccgtgacgctggtcgccgcccgcgcgcggctgacgcgggcggtgcgcgcgaagggcggcacggccgaggtcgccgcccccgccgaggacgtcgaaccgctcctcgccgcccacccggacctggctctcgccgcggtcgacgcccccgaccggtgtgtgatcgccggcggcgcgaacgccctcgccgaggtcaccggcctcctgcgggcgcggggcgtacgcgtcgaccggacggctgtcccgcacgccctccactcgccgctgatgaccgaggtgtacgacgacttccgcgccgcccttgacggcatcaccttccacgagcccgccatcagcctgatctccaacgtcaccggccggccggcccgccccgccgagatcggcacccccgactactgggtgcggcacctcggcgaacccgtacgcttcctggccggcctccggtcggtggcccagcgcggccggcacgccctgatcgagatcggaccggggtccgacctgaccgcgctcgcccagcgtggtctgaccgccgccgaccacgtgtggccggtgagcctacgccgcggcgaccgctccgccgacaccaccctggccgcgctcgccgggtactacacggcgggcctgccggtctcctgggccggctaccacgcgggccgcccggcccccgcgaagacgtccctgcccacctacgccttccagcgcgaggaccaccggccgccctccatcgcaccccggcgcacgggcgcggcctacggcgccgcccgccatctgctgctcggcacggaggagcggttcgccagcggggtacgggagttcacggccgagttcaccgccggggacctgggcgcgctggccgacctcggcgacggtgaacgtacgacgctgccgaccggcgcgtacgtcgacctgctgctcgccctccaggacgcggtcggcgggcacacccgctgcgccgtccgcgagctgaaactgctcacgcccctgcacatacccgccgggacgacggtggccctgacgacccggtggcgaccgcgttccgagggcggcgccgacgtggaggtcttcaccctcgtcgggggcgaggaggacacccacgccaccgcccggatcgccgccgggcgcgaaccggtcgtacccgtctgcgaactcgccgagctggacgccgaactgacgcccgccgggcagcggatcgacgacgaggacatctacaccgacctcgcctccgtcggccgcccgcacggcccgcgcatgcggctgctgctgcacgcctcccggcaccgggacggcctggtcaccggcgagctgaccggccgcgacgccaccgcggccgagcatgtgccggcggagctcctggaggccgcggtgcaggccgccgtcgtcctcgaccccgagggcccggtcttcgtgccgcgcgagatctcccgcgtacgccacttccgcaagccccgcggggaacagctccgcgtcctcgcccgggtgcacggcgaacaggaccgccggatcgccgacatcctcctcctggagaacggcgaacccgtcaccgaactcctcggcgtccacctcgcccgccccgagggccgcgtgggccgccgccagttcctgcaccggccggagtgggtacggcgggccctgccgggcgcggccgcggggacgtccgccgccgcaccctcctcggccgacgccgcggccccggcgcggaccgctcccggcggccgccacctcctcctgctcgacccggcggcgggccgggccgccgcgctcgccgggcagcccggcctgcgcgtgacccggctgagcgatcccaccggcctcaaggcggccctcgaggacccgaccgtcaccgacgtctgccgcgtctggcgccgaccgtcaccgacgtctgccgcgtctggcggcagcggcagggcgccatgtccgccgaccggatgcgcgccgagtgcgaggacaactaccgcgcgctgctggccctgg

SEQ ID NO: 2269 - DNA, 336 bp, Streptomyces avermitilis
  CDS (1)..(336)
gtgtcagccggcgctgcttgcatgaccgccatgccacctgccgacaccaccgtgatccagcggctgcgcgaactgccgcggaccgaaatcgccgatgaaatagagacactcgtcctgcggaagttcaagactgttcttctcatggacgagtcggaggatcttcccctcgacatcagttatttcgacctcggtctcacctcacttcggctgaccgagatacggcagagcctggagcagctcctcgatctgtccatcaacgtgaatgtgctgttcaacgagccgacggtcgcccagctcgtggactacctggccgacgccctgtccaccccgtccgcc

SEQ ID NO: 2270 - DNA, 1629 bp, Streptomyces avermitilis
  CDS (1)..(1629)
atgcttcgcgaagctgcgcaggaggagagtgctccggcaccttccggattgaagagctacgacctctacatcgcgggcaaggatgtcgccggtgacgggtgggtctacaccgtcagcgggcggtccctgctggaagacgtgttcaccagcgtgagcctcaagcgctcgctggagcaggacccggagtccgaggccgcccagcacccctacgtcgtgggccgctgcgcggtcgccgacgacagcgccatcgacatggccacccaggcggcggccgccgccgcctcggactgggcggccgtcccgctggagcggcggatgcgcctgggcacccgcttccgcgaggaactcctcaagcaccaggacgagttcctcgacatgctggtcgccgagtcgcacccggtgaagctggcccgctgggagctgagctgcctgctccagatctacgccccgggcagtctgcgctggtacatgaagcagatgcgggtcgagaaggagtacgcgggccgcaaactgatcctgcaccgtcagcccgacggtgtggtcgccttcaacccgccgcagaacgccccgctgcccagcgccgcgctctgcgtactggccctgatggccggcaacgccgtggtggtcagggcaccccgcagtatcgcgctgagcaccatgtggctgctgcgcgacatcgtggcgccgatcctcgaggagttcgacgcgcctcccggcgtcctcaacgcggtgtgcagcaacccgaagcagaccatggaccgctggatcgccgacccgctgatcaacgacatcttctacatcggcggcagccaggagggcctgcgcttcgaacagcagtgcgtcgcgcacggcaagaagccgatcctcgaactggccggcaacgacggcatcgtggtgtggaaggacgccgacgtgaagtgggcggccgaggccatcaccgagtccttcttcggctccgggcagatctgcatggtccccaactacgtgctggtccacccggacgtcgcggaggcgctgatcgccgaggtgcgtgagcaggtcaagggcatccggccgggcctgcccgaggaggaggacgtcctgctgtcgccggtgcgccgcagcgagcggttcttccggctgctgcgccaggccctggacaacgggggctcgctggtcaccggcggtcaccgcaccgagctcgacgggacgccctcggagacgggtgtcttcctccagcccaccgtcatccgggtggacggcctggaccgggcccgcaccttcgacgtcgtgcgcgaggagaccttcttcccgctcatcccgatcgtggtgcccgaacgcgacaacgacgacgcgctgctggaggccttcctccgcttcgtcaacaccaactcctacgggctgcgcaactccctgtggtcgcgctccgaccacgtcatcgagaccttcgtgcggcgcgtcgtcaacggcggtctgctgaaggtcaacgactctcacatcggcttcctgccgtatctgcccagccacggcggcaccggccgcaccggcggcgcgttcggcgaggccaactacccgatgctcaagacctcgcacgtgcaaggggtcagcatcgcccgcgacatcagcccctacgacgcggtcttcggcgcc

SEQ ID NO: 2271 - DNA, 1137 bp, Streptomyces avermitilis
  CDS (1)..(1137)
gtgcgttccctcgatgctgctcgggccgtctgcgagcaattccaccccggtctgctcaaagagctggagcagatcccgttcacggaccgggaaaagcccggcagtcccgtcatcgacctcttccgcatccacggcggggtcggcctgctgatacccgaggagtacggcggccacggcgccgccccgctggacgcgctgcgcatccagctggcgctgggcgccgtgtccccctcgctcgtcgcggccgtctccatgcaccacttcaccgcggccatgctctactcgctcgccgtcaaggcgggccggctcaccggcgcgcagaccgaactgctgcgccggatcgtccccgaccagcaggtgatggcctccggctgggccgagggccgcaccgagcagaacatcctcacccccgcggtgacggcgcgaccggtcgacggtggatacctgctctccggctcgaagaaaccgtgcagtctgtcccgttcgatgagtctgctcaccgcgagcatcgccatccaccacgacgacggcaccgccgaactggccctcgccctggtgccggccgacgctccgggcctgtccgtccacccgttctggggcaacgacctgctcgcgggcgcggagagcgacgaggtgcgtctgacggacgtgttcgtgccggcgggcatggtcgtacgggcgggggcggacgacccgcaccggctggacgatctccagacggccgggttcgtctggttcgagatgctgatctccgccgggtacgcgggcggggccgccgcgctcgtcgagcaggtgctggagcgggagcgcggcagcgtccaggaacgggccgagctcgcggtcgagatggaggccgccctggcgctcctcgagggtgtcgcacgggcgatcggcacggagccgggcgacgaggagtcggtcgcccgcgtcctggtcgcccgctacaccgtgcagaaggcgctgccgcggatcgccgcccggtccctggagctgctcggcggcctggacttcatccgtggctccgcccacgcccaggcggccgccgccgtgcacgccctcgccttccatccgccgggccgcggcgccgccgccgagccgctgctgcgctacttcgacggcggcgcgctggtcctggcc

SEQ ID NO: 2272 - DNA, 1281 bp, Streptomyces avermitilis
  CDS (1)..(1281)
gtgaccgtcatccaggaatcacccgtcgacaccgaggcggagatcctcggcctgtaccgggcccatctcagcaagggccgggccaccctcgccgagctcttcggcagccacatggagacggcgtccgagggcgcctggctcaccaccagcgacggtgagcgcttcctcaacgcgggcggctacggcgtgttcatcatgggcgcccgccacccgatcgtgatggaggaggtggagcgccagctgcggacgcatcccaccgcgacgcgcatcctgctggagcccaccgtggcccgcgccgccgaggcgctcgtctccgtgctgcccgacggcctggaccgggtgcacttcgcgctgtcgggcgccgaggcggtggagaccggcctcaagctggcacgggccggcggccgcaagcggaccatctcgatgcgcggcggctaccacggcaagacgctcggcgcgctgtccgccaccgccaaggacgtctaccaggcgccgttccggcccctggtgccggacttccagcacctgccgttcggcgaaacggacgcgctggaggcggaactcgcggcccaccccggcgaggtctgcgtcatcctcgaacccgtacagggcgagggcggcgtgatcattccgcccgcgggctacctcaagcgcgtcgaggaactggtccgcgcccacgacggattcctgatcctcgacgaggtgcagtccggtttcggccggctcggcgagtggtggggcgcggacaccgagggcgtggtgcccgacgtgctcctcaccggcaaggccctcggcggtggcgtcatgccggtctccgcggccgtggcgacccgcaaggccttccgccccttcgacaaggacccgtacgtccacaccgccaccttctccgggcagccggtgctgatggccgcggtgcagggcgcgatccgggccatgaaggaggagcgcctggtcacccgggccatggacctcggcgcgcagctgctgccgaggatcgcggagatcgcgtaccgcaacatccccgaactcgtcgtggacgtgcgcggccaggggctgctcatcggcgtggagctcgtcgaggccggactggccggcgagctgctgatcgagctgttcaaccacggtgtggtcgccaaccactcgatgaacggcagctcggtggtgcggttcaccccgcccgccgtgctgagcgacaccgatgtggagttcctcctgaactccttcgacctggccacacgcgacctcgtccggggcgcggccaagatgccggaaggcggtaac

SEQ ID NO: 2273 - DNA, 480 bp, Streptomyces avermitilis
  CDS (1)..(480)
gtgcggcacgtagagctcgaagccctgatacccgcggagcaggccacgacggtcttcgactccgtacgacgctgggagcggtacccggacctggcgccccatgtgaagcagaccaccgtgcacgccacctacccggcggaggacgccagttcgagctgggagctgcacttccgcagcgggctgctgcgctggaccgaggacgacgtgttcgtgccggagcggggcgagatccgcttcgagcagagcgacggggacttcgactccttcaccggcacctggaccctgacgcagcagggcgacgacgtcgcggtccgcttcgacgccgacttcgacttcggcatcccgagcctggaggggatcctcgacccgatcgccgagcgggtcatcaaggagaccgtcgcctgggccctgaccggcctgttccccgccgtccgcctctcgggcggcgtcgagctcaccgagcccgccgccgtcggcgtc

SEQ ID NO: 2274 - DNA, 534 bp, Streptomyces avermitilis
  CDS (1)..(534)
atggaccaggcaaatcccttcgagacaccgaggacgtactcgctgcaccgcgccgagtacctggtgggcctcgccgtcaccaccggtctgatcgtcgcccacttcggcgagatccggtggtggcccgcgatcgccctgttcctgtacatcgacctgatcggctacattccgggcgcgatcgccttcaagcgcagcggtgggcagccgatctccaagacgtactacgtgctctacaacgtcatgcacagcctcatcacgcagggcgcggtcgccgcgctgtggtgctggctggtgaagccggagtgggcgcttctggtgctgccgttccatctcttcggcgaccgcggcctgttcggcaacttcatgaagtcgttcgcactgccgttcgagccggtacggcagtccggctatctgcggctcctggacgacctggggctggcccatcccaagccggtcggccacgccgtggagccgaccccggtcggtcacgtcccggcaccccgggtccgccaggagcagcgggaggccgtgcga

SEQ ID NO: 2275 - DNA, 552 bp, Streptomyces avermitilis
  CDS (1)..(552)
atgagcaccgccaccgaagtacgtgccccgcggcgtcccgtacgccaggacccggtcgagcgccggcgggcgctgtaccacctggcgtccccggtgtcggtgctgacggtcggccccgaggagcggctgcacggcaccacggcgagcaccgtcacgctggtgtcgcgcgagcccctgctggtgggggtcgtgctgcgggcgggttcgtccttcgcgcggctcgccgccgccgaggggcggttcgcgatcaacgtcctcagcgacgaacaggccgtggtggcacgccacttcgcggacagcggccgccccgacggcagcgagcagttcgcgggcctcgcgtggacggcggactcgtacgcgcacgctccgctgatcgcgggggcgctcgcccactacacctgccggttccactccgcgcacgcggcgggcgacagcgagctgctgctcggccatgtcgtccgggccaggaccggcgacggccttcctctgttcagctacgccggcgggctgttcgccggttccctgcgccccgcgaaggaggcggccgcgtca

SEQ ID NO: 2276 - DNA, 981 bp, Streptomyces avermitilis
  CDS (1)..(981)
atgaccggttctgtggcacccgaggccgactgggacaaggctcccggtctgctcgacggcgcgaaggatctcaccctcgggcccgaggagtgcaacctcgcctactggttcacctcggtggcgcagggcacgctgcgcgaccggggcgagaccgggcaccatgtgaacgccaccgtgcccgcgttcctgaaggagccggggccgctgcgcgacgccctggtgctggagttcggcttccgcggcctgtcggaggagatcgcgacgcggctgctcggccactatgtcgcgatcgcccccggcgtccccgaactggagttctacgccactcagttgatcgacgaggcgcggcacgcccgggtcttccgcaatcacctggtggagctgggcatgcctgccgggacgctcctcaaggacatcgacgagatggccgcggactaccgcaagcgggtcctggacccggtcgtggacttcaccctcgacatcgtccgcgaccaggccgacttccccggcggcgtcgccgtgttcgccatcgtcatcgagggtgcgctcgccccggcggccgagctgagcgagcgcaagtggaccccgctgtcgccggccaccggcgagatctcgcgcggcaccgccatcgacgagatccggcatctgacggtggccagcacgatcctgcgcgaccacgcggtcgagcaccccgaataccgcccgcgcctcctggagatcctgcgggccggcgtgcggctgtgggacgagatccccgaccgtgagttcgtcatccaccgcgaggaactcttccaggagggcatggcccagcacgccgacaagatcggcgactacgagatctggccgggcgtccggatgctcgacaccacgccggagcagcgctacgacatggccgagcgctggaccgacgagatggccgagtcgcggatggcgtacatgggcctgcccctggacgtcctcagcagtccggaggccggcaca

SEQ ID NO: 2277 - DNA, 1005 bp, Streptomyces avermitilis
  CDS (1)..(1005)
atgagcggcggacgcgcggcggtgatcaccgggatcgggggctatgtgcctcccgatctggtgaccaacgacgatctggcccagcggctcgacacctccgacgcgtggatccgctcgcgcaccgggatcgccgagcggcatgtgatcgcgcccggcaccgcgacctccgacctggcggtggaggccggactgcgggccctgaagtcggcgggcgacgagcacgtggacgcggtcgtcctggccaccacgacgcccgaccagccctgcccggcgaccgccccgcaggtggccgcacggctgggactcgggcaggtgccggcgttcgacgtggccgccgtctgctccggcttcctgttcggcctcgccaccgcgtccgggctgatcgcggccggggtggcggacaaggtcctgctggtcgccgccgacgcgttcaccacgatcatcaaccccgaggaccgcaccacggccgtcatcttcgcggacggcgcgggcgcggtggtgctgcgcgcgggcgccgccgacgagccgggggccgtcggcccgctggtgctcggcagcgacggcgagctgagccatctcatcgaggtgccggcgggcggctcgcgccagcgctcgtccggccccacgaccgacccggacgaccagtacttccggatgctcggccgggacacctaccggcacgcggtggagcggatgaccgatgcgtcccagcgggcggccgaactggccgactggcggatcgacgacgtcgaccggttcgcggcgcaccaggccaacgcccgcatcctcgactcggtcgcggaacgtctcggggtccccgccgaacggcagttgaccaacatcgcccgggtcggcaacaccggcgccgcctcgatcccgctgcttctgtcgcaggcggccgcggccggccggctcggcgccgggcaccgggtgctcctgaccgcgttcggcgggggcctgtcctggggcgcggggactctggtctggccggaggtccagccggtc

SEQ ID NO: 2278 - DNA, 228 bp, Streptomyces avermitilis
  CDS (1)..(228)
atgctggagcagctcaaggaaatcctgtccaacaagctcaaggtgtcgcccgaggccatcaccccggaggccacccgggaggacatcgagctggactcgctggccgtggtggagctgtcgctgctgctcaagtccgaactggacctggacgtcagcgacgacgacctcctggaagccgagaccgtggccgacatggtccggctcatggaggagcggagcgcgaaggtc

SEQ ID NO: 2279 - DNA, 1218 bp, Streptomyces avermitilis
  CDS (1)..(1218)
atggccggcatggacatcgccgtcaccgggctcggcctggtcaccccgggcggtatcggggtcgggcccagctgggcggcggtctgcgacggcaggccggccgccgccctcgatccggtgctggcggacaatcccgtacgtatctcctgccgggtgcccgacttcgacccggagcaactgctcagcgcacgacgggcgcaccgcctggacaggttcgtgcagttcgctctggtcgccgcccatgaggcggtggccgacgccggtctcgacccgaccacctgggacggggctcgggtcggtgtggtgctgggctgcgcggacggcggtcccggcacggtcgaggagcagcaccgggtgctgctggagcagggcgccgaccgggtgtccccgctgctgctgcccatgcagctgccgaacatgctggccggtcagacggccatcgagttcggggcgaccgggcccaacctggtggtggccacggcctgcgcttcgggcgcgaccgccatcggcacggcccgggacctgctcgcgctcggccgctgcgacgtggtcctggcgggcggcagcgaggcgatgatcactccgctggtcatggccggcttcgcccagatgggcgcgctgtcgcggcgcgaggacgacccggcgtcggcgtcgcgtcccttcgacgccgaccgggacggcttcgtcgccggtgagggcgccgggatcctcgtcatggaacgtgtcgaggacgcccgggcccgcggtgcgcacatccacggccggatcatcggctacggggccaccgcggacgcccaccacatgacgtcgccgcacccggacggcgccggcatcgaggcggcggtccgcgcggctctcgccgacgccggcgcggacccggacgacgtgcagcacgtgaacgcccacggcacgtcgacgccgctcaacgatctggccgaggcacgcatgatccagcggaccctgcagggcgacccgctggtcacctcgacgaagggagtcaccggacatctgctcggcgcggccggcgcggtcgaggccgcgttcgccctgctgagcatcgagcacgagatggttccgccgatcgcgggcctgtgcatccccgatccccggatcgacatcaagctcgcccagtcggccacgtcgatgccgatcgacctcgcgctcagcaattcgtgcgggttcggcggccagaacacggcgcttgcgatcgctccggcc

SEQ ID NO: 2280 - DNA, 1518 bp, Streptomyces avermitilis
  CDS (1)..(1518)
atgtccaagatcggttcaccgccgacggatcgccggacggtcgccgtgaccgccccgcccggacggctcgacacccggcacatcctcttcctcatcgtcgcggcggccgccccgctgtccgcgatggtcggcaccgtgccgctcgcgttcgccttcggcaacggcgcgggcgtcccggccgccttcctcttcgccggggtcaccctgctgtgcttctcggtggggtacgccgtcagcgtccgccgcaccggcggcagtggcggcttctacgcctccgtcgccgacggcctcggccggccgcccgccgtcgccgcgggcttcgtcgccctgctcgcgtacaactgcgccaccatcgggctggccggtgcgctcggctacttcacccaactcgtcctggccgcgcacgggttcaccgtctcctggcagtggtgcgccgccgtcggcctgctcgcggtcgccgtgctcggctaccgcgagatcgccctcagcgcccgtgtgctcgccctgctgatgctgggcgagatcggcgtgctggccgccctggacgtggcgatcctggtgcggcacggcctgtccgcgctgcccacggcctcgttctccccgcacacggcgaccggcccgggcctgggcgtggcgctgatgttcgcgttcgtctccttcatcggcttcgagtcggcggccctgtacggcaaggaggccagggacccgcagcgcagcgtcccgcgcgccacgtacgccgcggtcgtcctgatcgccggcttctacgccctcaccagctggctcgcggtgggcgccgtcggcaccggcaaggtgcgcgaggtcgccacccggcagatgggcgacctgttcttcgtcctcggcgacgacttcctcggcaaggccggcagcacgggcctgcagatcctgctgtgcaccagcctgttcgccgccacgctggccctgcacagcgccgccaaccggtatgcgcaggtgctcgcggaggacggtctgctgcccgcctcgctgggcgccgagcacccgaggcaccgctccccgcaccgggcgagcgtcgcacagagcgtcctgacggccctggtcgtcggcggtttcgcggtcgccggcctggacccgtacgccgatctgaccaccagcatgctgggtcttggcaccctgggcatcgtcgtcctccaggcgttggccgccctgtccgtcctcggcctgcggctgcggcggccgggcggcagggcgcactggtggcgggagctggtcgcaccgctgctcggcttcgcgggactcgccgtctccgtgtggctggtggtcggcaacttcgacatgctcaccggctcccccgacccgctgatcgcccgcctcccgtggctgctcgtcgcggtggccgccctcggcctcgggtacgcggcctggctgcgcgccgcccgcccgggccgctaccgcctgctgggcacccgccacctcaccacgtccgacgagcccccggccaccgccgtccccacctcaggagtccgtcatgcacgatcccag

SEQ ID NO: 2281 - DNA, 1281 bp, Streptomyces avermitilis
  CDS (1)..(1281)
atgcacgatcccagtgagctgctcgaagacgggccggccgccgtacggcggctggcccgtcgccgctacgacctcgacctggccgcgctggagaaggcggtgcgccgccggtccgaggcgcaggccgaggtgacccggctgcgcaccgagctgaaccgcacctcgcgggcgcgcggacgctcggggccgccctcggaggaggagaaggaggccgcccgcgcgctgcgcgcggatgtgcagcaggcggaggccacggcccgcaccgcgggacacgacctcaccgagctgctgctcggcatccccaacgtccccctggactcggtgccggacggcgacaccgaccaggaggcggtggaggtccgccgctggggccggccgccgcacgacgccggcaccgacgcccggcaccactccgacatcggcgagtcactcggcatcctggacggcccggcggccgccaagctctccgggtcccgcttcagcgtcggccgcggcgccggcgcccggctggagcgggcgctggccgatttcttcctcgacctgcacaccggcgagcacggctacacggagtactccgtcccgttcctcgtcaaccgcgacaccatgaccggcaccggtcagctccccaagttcgaggacgatctgttccgcacccaggtcggcgaccgggaactgttcctgatccccaccgccgaggtgccgctcaccaacctggtggcccagcagctcctggacgcccgcgccctgccgtacgccttcaccgcgcgtaccccctgcttccgcgccgaggcgggggcgtacgggcgcgacacccgggggatcctgcgcctgcaccagttcgagaaggtggagctggtccgcgtctgcgcccccgaggacgcaccggcgcagctggagctcatggtggggcacgccgaggagtgcctgcgccgcctcgaactctcctaccgcgtggtccagttgcccgcgggcgacctcggcttctcggcccggatgacgtacgacatcgaggtgtggctgccgggcagcgacgcctaccgcgagatctcctcggtctccgactgcggcaccttccaggcccgccgcgccgacatccgtcacaagcgggccgacggccgcaaggccccggccgccaccctcaacggctcggcgctgcccatcggccgcaccgtcgccgccctgctggaacagggggtgcgggaggacggctcggtgctgctgcccgaggccctcgtcccgtacaccggtttccgccggatcctgccgggcggggcaaccgcg

SEQ ID NO: 2282 - DNA, 780 bp, Streptomyces avermitilis
  CDS (1)..(780)
atgagcggagttctcgccggtaagcgcatcctggtgacgggcgtcgtcacggaggcgtccatcgccttccacgtcgcccggctcgcgcaggaggagggcgccgaggtcgtactgaccggcttcggccggctctccctgatcgagcggatcgccgcccggctgcccaagccggtcccggtgatcgagctggacgtcaccgaccaggcgcacctggacacgctcgcggaccggatccgcgagtccgtcgacggcgccgacgaacactacggtctcgacggggtggtgcactccatcgcgtacgggccgcagggcgccttctccttcctcgacggcgactgggcggacgtctcgacggccgtgcaggtgtcggcgtactccctgaagtccctgaccaccgcgtgcctgcccctgctggagcggcgcggcggttcggtggtcgggctcaccttcgacgcgacggtcgcctggccgcactacgactggatgggcgtcgccaaggccgccctcgagtcgaccagccgctatctcgcccgcgacctgggcggccgcggcatccgctgcaacctggtcgcggccggtccgctgcgctccatggccgccaagtcgattcccggcttcggggaactcgcggaggtctggcagcaccgggccccgatcggctgggacctcgtcgacccggaccccgccgcacgcggagtggtcgcactgctgtccgacttcttcccgcgcaccaccggcgagatcgtccacgtggacggcggagtgcacatgatgggggcg

SEQ ID NO: 2283 - DNA, 324 bp, Streptomyces avermitilis
  CDS (1)..(324)
atgacctatgtcatcgctctgccttgtgtcgatgtgaaggaccggtcctgcgtcggcgaatgcccggtggactgcatctacgagggccggcgtgccctctacatccagcccgacgaatgcgtcgactgcggggcctgtgaaccggtgtgcccggtggaggccatctacttcgaggacgacgtccccgccgagtggggcgaccaccgcggctccaacgccgacttcttcgacgccctcggctcgcccggcggcggcacccccctcggtgccctcgacaccgattccccgctggtccggtccctgccgcagaaagtggtgcagtca

SEQ ID NO: 2284 - DNA, 1407 bp, Streptomyces avermitilis
  CDS (1)..(1407)
atgtcccagaccaccacggcggtgagcggagtctccgctcccgtctcgatcggggtccgtctggaccgcatgccgatcacgcccatgcaccgcagactgaccgcggtcatcggcataggcctgctcttcgacaccttcgagaacagtctgtcgggcaccatcgccaaggtgctccagggcgacttcgccttcggtgccacctcgctcaaactggtcctggcctccgtgttcgtcggccagttcatcggctcgctggtgctcggccgggtcgccgaccgattcggccggcgccgggccttcctgatcaacctcgcgatctactcgggcttctccctgctcggcgccttctcgcccaacgccggctggctgatcgcgacccgcttcctggccggcatcggaatcggcgccgaacaggccctgtccgactgctatctggccgacgtcctgcccgccgccaagcggggccggttcatcgcctgggcctacacgctcgccttctgcggggtgcccgcggtcggcttcgcggccctgtggctggttccgctgaccccgctgggcgtggacggctggcgctggctgttcgtcatcggcgccctcggctcggccgtcgtgtgggtgctgcgccggcagctgatcgagtccccgcgctggctggcggcgaccggccgcaccgcggaggccgaccggctggtgtcccggatggaggcgcaggcgccggccggccggacggccgaggacctcccggccccgtacgaggcacccggcgccgcgcgggtccggctgcgggacgtcttcgcgcccgggctgcggcgccgcaccgtgatgctgtggatcttctgcgcgctctccgtggtcggctactacggcttcggcaccctggcgccgcagatcctcgccgccaaggggttcgacatcgtggccggcctgggcttcacggccctgtgcttcctcggctaccccgtcggctcggcgctgtcgctgcccgtcatcgaccgcgtcgaacgcaagacgctggtcgcggcgtccgccgccgcgatggtcgcggccggcatgggtttcgccttcaccgactcgcccgccctcatcgtcgcgttcggcttcggctacacgctgtgcagcaacgtcttctccagcgtgtcgcacgtgtacctctcggagcagtacccgacggcgatccgcgccaccgcgtccggcgcggcctactcgctgtccaaactcagtgccgccgcactgccgttcgtgctgctgcccgtcctcgactcgtacgggcccggcgcgctgttcgcggtcatcgccgccgcgatggccgcactggccgtcaccgtcctcacgctgggcgagcgcaccaccggagcgtcggtggaccgggcgccggttccggtgaacattcctaccctgaagaggagt

SEQ ID NO: 2285 - DNA, 1095 bp, Streptomyces avermitilis
  CDS (1)..(1095)
atgcagcgtccgcacgtccaagaagccgaggccaccgccgctccccagcagcgcaccggcgcttcggccacgttcgccgaactgctcaaacgggtcaaggcggaaggccttctcgacctcgatccccgctactacataggccggctggcgctgaacaccacgctgctgctggtcgggttcgccgcgttcttcgcgctgggcgactcgtggtggcagctcgtggtggccctgtggatgggcctgtgcggcggtcagtccgccttcatgtggcacgacgccggccacaaggccatgttccgcagcaagaaggccgcctccgccgtcggatacttccacgccaacctcgtcaacggggtcagcttcggctggtgggtcaaccaccacaaccggcaccacagcaaccccaaccacctggacatggacccggacatcggccggcgcaccgccatcttcgacatcaagcagtacccgacccggcgcggcacacagaagttcatcgtgcgctaccagagcgtgctgttcttcgcgctgctggtcacggagtccttcaagatgctgaagacggccgtcctgtccatcgcccagggcaagaccaagcgccccgtcctggagtcgttcctgctcctcgcgcgggcggcggtctatctgacgctcgtgttcaccgtcctctcgcccgtcctcgcggtcgccttcgtcctggtccaacaggccgccctgggcgtctacttcggcatgatcttcgccccgaaccacaagggcatggaggtccgcgacggcgacgaggagaccctggactggctggagcgccaggtcctcacctcccgcaacatccgcccctccctgttcatcgacttcctctacggcggcctcaactaccaggtcgagcaccacctgttcccggccatgccccagaagaacctggcgcgcgcccgtgaactcacccgcgcctactgcgccgagcgcggtgtgccgtatcacgaggtcgggttctgggcctcgtaccgcgaggtcgcctccttcctgcacgaggtcagcgcgcccgtgcggcgcggcgacgtcgaggagcagatccggcggcaggcgggccaggccgcc

SEQ ID NO: 2286 - DNA, 198 bp, Streptomyces avermitilis
  CDS (1)..(198)
gtgagtgacagcgaagagaccccggccaccgggaccccgaccgacgggaccacgaccaccgaatccctccagcacgccctggtcgggcagctcatggccatcatcggagcccccgacgacgaggacgtggcccgtgccgcggacgacatcgtccaggcgctcgacatccggctgcgcgaggctcagaccgccgcggcc

SEQ ID NO: 2287 - DNA, 993 bp, Streptomyces avermitilis
  CDS (1)..(993)
atgcccgcaaccaccacggacaacccgattctcggggcgatccgaacacacacccagagcgagaatcccagctcattcctggcgctcaacagcggcaacagcacgttcaccgtcccgggcgcggacggcgtcgtcgtctaccgccgcaccggccgctacgcggtccagttcggcggccccttcgccgcccccgacgcctacgacaccctcctcgacgccttccgccagtacgtgaaggacgaagggctgcacctcgtcgccgtccagctccagcgccccgacgccgagcgctacgccgggcgcggcttcaccgtcaaccaggtcggtgcctcctgggccgtacaactgcccgagttctcgctgcgcggcacccgcttcatgcaactgcgcaacaagatctcccgcgcacaccgcaacggcctgcagatcaaggaggtcaccgccgaggactggcaggacgcgatagcgacgatcgacgaggcctggctcggctccaagggcggcgcacagcagctggagttcctggtgggccagatcggcggcgaaccgcaggcgcagcgacggctgttcgccgggaccatcgagggcgccccggtcgcgtacatctcgtactcgcccgtctacggcgagcgggccggctggatgcacgacctgagccggcgcatacccgagggctccccgggcctgatggaggcgatcaacgcgcacgccatcgaggtgttccgcgccgagggcgtcgagtggctgcacttcgggttcacgcccttcaccggcctcgacgcgagccatgaactcgacggtcacagcccggcgttccagtggctgatgcacgccctgtgggccgagggcgccgctctctacccggcacagacccagctttcgtacaagcagaagtgggccccggacgcgctcatcccggagtacgtcgccttcgacggaccgagcgcctcgctcgccggcttcgcgcacgtcttccgtgcctgcaaggccttc

SEQ ID NO: 2288 - DNA, 795 bp, Streptomyces avermitilis
  CDS (1)..(795)
atgctgagcttctcgattctcggcgcactccagatccgtaccgcattaggacccgcggagatctccggcgatctccagcggaccctgatccagacccttctcgtgaacgagggccagtccatctccggcgagagcctcgtcgaggagatgtggggcgaggccgtgccggacaaccaggccaacgccctacaggcccacatcagccgcctgcgccgcaaactgaggagcctggagcccgaccggacgacgtcccgggtgaccatccacccctccggctaccggctcacgatcaacgaaagcgagctggacgcggccgagttcaccaagaccgtacgtctggcggaggtcgccacggccgacgacccggcggcgaccgcccggctgctcggcggcgccctcgccatgtggcgcggcccggtcttcggcgacttccccggcggcaccctgtgccaactggcctgcgcccgctacgaggagtaccgcatgcgggccatggagctccgcttcgacgccgagctgcgcctgggccaccacgcggccatgctcgccgagctccacgacgcccacaccaaccacccactgcgggaacgcttctgcgagcagctgatgatcgccctctaccgctcgggccgccaggccgacgcgctcaacgtctaccgccggatgtggcagcacctctcggacgaactcggcatcgagccctcgcccgcgctgcgccgggtggagaacgcgatcctctcccacgacccggccctcgcgggcgacaccccggcaccgatcatcctccagccggcc

SEQ ID NO: 2289 - DNA, 429 bp, Streptomyces avermitilis
  CDS (1)..(429)
atgaccacgagtcagacctcggcccggcccgcgacgacggccggacgtgcggcggcggcccgccccctgcgcacgttcctcgcgctcgacgccgccgtgaccgcggtgaacggcctgatctatctgctcgccgccggtcccgtcggagacctgctcgacctcgacaccggtctgctgcgcggcatcggcgccttcctcaccgtatacggcgtcctcgtggccgtcctggcgtcccgccaggtgccgtcggcggtcgccaccaaggcagtgatcgaggccaacctgctgtgggcggtcgcgagcgtcgccaccgccgtcttcggctggttcgacccgaacaccgtcggcacggtgtggatcccgctccaggccgctgtcgtcgcgggcttcgccgtcctccagatcaacggcctgcgccggctcgccggc

SEQ ID NO: 2290 - DNA, 1542 bp, Streptomyces avermitilis
  CDS (1)..(1542)
atgaggttccaagtcgcggagctggccgagatacgggagcaggtgcacgcaggccccggcgagaaggccaccgccgcacagcacgccaagggcaagctcaccgcccgcgaacggatcggcctgctcctcgacgagggctcgttccacgaggtggaacccctgcgccggcaccgggcgaccggcttcggcctggaggccaagcggccgtacaccgacggagtcgtcacagggtggggcaccgtccagggccgtaccgtcttcgtctacgcgcacgacttccgcatcttcggcggcgctctcggcgaggcccacgccgccaagatccacaagatcatggacatggccatctcggcgggcgccccgctcgtgtcgctcaacgacggcgcgggcgcccgcatccaggagggtgtcagcgctctcgcgggctatggcggcatcttccagcgcaacaccaaggcgtcgggcgtcatcccgcagatcagcgtgatgctgggcccgtgcgcgggcggcgcggcgtactcgcccgccctgacggacttcgtgttcatggtccgcgagacctcgcagatgttcatcaccggaccggacgtggtcaaggcggtgacgggcgaggagatcacccagaacggcctcggcggcgccgatgtgcacgccgagacgagcggcgtctgccacttcgcctacgacgacgaggagacctgcctcgacgaggtgcgctacctgctctccctgctgccgggcaacaaccgcgagaccccgccgtcggtgccgagcgaggacccgcccgaccgccgctgcgaggcgctcgtcgacctggtcccggtggacggcaaccgcccgtacgacatgcggcaggtgatcgaggagatcgtcgacgacggcgagttcctggaggtccacgaacgctgggccaccaacatcatctgcgcgctgacccggctcggcggccaggtcgtcggcatcgtcgccaaccagccccggtccctcgccggcgtcctggacatcgaggcgagcgaaaaggccgcgcgcttcgtgcagttgtgcgacgcgttcagcatcccgctcgtcaccctgctcgatgtgcccggcttcctgccgggcgtcggccaggagcacggcggcatcatccggcacggcgccaagctgctgtacgcgtactgcgacgcgaccgtgccgcggatctcgctgatcctgcgcaaggcgtacgggggcgcctacatcgtcatggacagccagtccatcggcgccgatctcacctacgcgtggccgacgaacgagatcgccgtgatgggcgcggagggcgcggccaacgtgatcttccgccgccagatcgccgaggccgacgatcccgaggccaagcgtgccgagctggtcaaggcgtacaaggcggagctgatgcatccgtactacgcggccgagcgcggcctggtcgacgacgtcatcgacccggcggagacccgcgaggtgctgatcagctctctgacgatgctgcgcaccaagcacgccgaccggccggcccgcaaacacggcaatccccctcag

SEQ ID NO: 2291 - DNA, 183 bp, Streptomyces avermitilis
  CDS (1)..(183)
atgaccaccccctgcatacgcatcgagaagggtgcggcgacggacgaggaactcgccgccctcaccgtcctgttcctcacccgggccccccggcccgagcccgacaccgcacccccctcccccggctccaccaccgcctggcgccccgatcccttccacgccccgcacagctggcaggcaccg

SEQ ID NO: 2292 - DNA, 396 bp, Streptomyces avermitilis
  CDS (1)..(396)
gtgaggaccgagcgcatcaacccgcccgagctctccccgcccaccggcttctcgcacgccgtcgccgtcaccggcacccgcgtcgtcttcctggcgggccagacggcgctcgacacggacggaaaggtggtcggcgagacgctgccggaccagttcgggagggcgctgacgaacctgctgaccgctctgcgggccgcgggcggcgttccggcggacctcgcccgggtcaccgtctacgccaccgacatcgccgactaccgcgcccacgcccgcgaactcggcggtatctggcgcgagttggcgggccgcgactaccccgcgatggccgtcatcggagtcgcccgcctctgggacgaacaggccctcgtcgaactcgacggcttcgcggtgctggcc

SEQ ID NO: 2293 - DNA, 1125 bp, Streptomyces avermitilis
  CDS (1)..(1125)
atgaccgcattctcgctcgatccggcacagaccgcccggcgggcggagctgcgcacgctggcggcggaccgtctgcggccgctcgcggagaagggcgagccgggccacgtcaaccgccccctggtcgccgaactgggccgactcggcctgctggaacggctgttcaccgccggggcgctcgacctctgcctgctgcgggagtccctggcgtacacgtgcaccgaggccgagacggcgctcgcactacaggggctgggcgcgtatccggtgcacgggtacggcacccgggcccagcgggagtgctggctgccccgggtgagcgacggcagcgcggtcgccgccttcgcgctcagcgagccgggcgccggctcggacgcggcggcgctgtcgctgaaggccgagcccgacggcccggacggctggcgcctcaccggtgagaagtgctggatctccaacgcgcccgaggccgacttctacaccgtcttcgcgcgcaccacccccggcgccggcgcccgtggcgtgaccgccttcctggtccccgccgaccggcccggtctcaccggcaccccgctcgacatgctctcgccgcatcccatcggcgcgctcgccttcgacgccgtaccggtgacggcggacgacgtgctcggggagcccgaccacggattccgggtcgcgatgcacaccctcaacctcttccggccgagtgtgggcgccttcgcggtcgggatggcgcaggcggccctcgacgcgacgctcgcgcacacctccgggcgcgacgcgttcgggggcaagctgcgggacctccagaccgtggcgcaccaggtcgccgagatggccctgcgcacggaggcggcccgcctcatggtctacgcggccgcggcggcgtacgacgaggcggcgccggacgtgccgcggcgcgcggcgatggcgaagctgctcgccaccgagaccgcgcagtacgtcgtcgacgcggccgtccagctgcacggcgcccgtgccctgcgccgcggccacctgctcgaacacctctaccgagaggtccgcgcgccccgcatctacgaaggggcgagcgaggtccaacgggccgtcatcgccaaggagttgtacgccaccgtggaggccccg

SEQ ID NO: 2294 - DNA, 1782 bp, Streptomyces avermitilis
  CDS (1)..(1782)
atggacccgaggaacggcacggatcccaggaacggcacggatcccaggaacggcacggactccgggaacggcacggccccccgggacgccgtcgacgaccggcggcccacggcctccgcccacgtcgacaccttcgcccgcgaccacctcccgccccccgaacagtggcccgaactccacttcgacctgccggagctgcgctaccccgaacggctgaactgcgccgccgaactgctcggccgcaccgacgccgggcgcccggcgttccgtaccgcggacggcgacgtctggacgtacggacagctgcgcgcccgcgtggaccggatcgcccatgtgctcacctcccggctcggtgtcgtccccggcaatcgcgtcctgctgcgcgggcccaccaccccctggctggccgcctgctggctggccgtgctgaaggcgggcgcggtcgccgtcacggtgctcgcccagcagcgtccgcacgagctggcgaccatgtgcgggatcgcgcgggtgacccacgccctgtgcgacgtacgggccgtcgacgacctggcgaaggcggaggtccccgggctgcgcctcaccacgtacggcggcgacgcccccgacgacctgctgcgcctgcccgcaccggacgaggcgtacccggccgtggacaccgcggccgacgatgtcgcgctgatcgcgttcacctccggcaccaccggccgccccaaaggctgtatgcacttccaccgggatgtgctggcgaccgccgacaccttctcgaagcatgtgctgcggccacaggaggacgatgtcttcgcgggcagtcctccgctcggcttcaccttcgggctcggcggcctcgtcgtcttcccgctgcgggccggggcctcggccctgctgctcgaacaggccggtccccggcagctgttgcccgcgatcgccgagcaccgggtctccgtgctgttcaccgcgccgaccgcgtaccacgcgatgctcgacgagctgccggcccacgacaccggatcgctgcggcgctgtgtctcggccggtgagaatctgcccgccgccacctggcgggcctggcacgagcgcaccggcctgcggatcatcaacggcatcggcgccaccgagctgctgcacatcttcatctccgcggccgacgagcggatccggcccggcatgacgggcgttcccgtaccggggtggcacgcgcgcgtgcaggacgagaacggcacgcccgtacccgacggcgagccgggactgctcgcggtgcgcggtcccgtgggctgccgctatctcgccgacccgcggcagcgggagtatgtgcggggcggctggaacgtcaccggtgacacctatgtccgcgaccccgacggctacttccgctatgtcacccgcgccgacgacatgatcatctcggccggctacaacatcgccgggccggaggtcgaggacgccctgctgcggcacccggacgtgaccgagacggcggtcgtgggacggccggacgaggcgcgcgggcaggtcgtggtggcgtacgcggtgctgcgggcgggcgcgcgccgggacgcggaggcgctcggcgcgttcctcagatccgaactggcgccgtacaagtgtccgcgcgagttcgtcttcctggacgcgctgccgcgcacggcgacgggcaagctccagcggttccgcctgcgcgacaaccgccgtacggacgtcgactccgtacccccggaagcctccgtccccgcggaaacctccgtacccgcggaagcccccgtgcccgcggaaggtgatcatgag

SEQ ID NO: 2295 - DNA, 840 bp, Streptomyces avermitilis
  CDS (1)..(840)
gtgatcaacgtgtccgatcagcacgctccccggtccctcatcgtcacgttctacggcgcgtacggccgcttcttccccggcccggtgccggtggcggagctgatccggctgctcgccgccgtcggcgtcgacgcgccctccgtcagatcgtcggtgtcccggctgaagcggcgcggcctgctggtgccggcccgcacggcggccggcgcggccgggtacgcgctgtcgccggacgcccgccaactgctcgacgacggcgacctgcgcgtgtacgcgaccactcccccacgggacgagggctgggtgctcgcggtgttctccgtgccggagtcggaacggcagaagcggcatgtactgcgctcgcgcctggccgggctcggcttcgggacggcggcccccggggtgtggatcgccccggcgcggctgtacgaggagacccggcacaccctggggcggctgcgcctcgacccgtacgtcgacttcttccgcggcgagcacctgggcttcgccgcgaccttcgaggccgtcgcgcgctggtgggacctggccgcgatcgccaagcagcacgaggagttcctcgaccgccacgcgcgcgtgctgcacgactgggaggcacgcgaggacaccgagcccgaggaggcgtaccgcgactatctgctcgccctggactcctggcgccacctcccgtacgccgatcccggcctgcccgccgcactgcttcccgaggactggccgggcgcccgctcggccgccgtcttccgggcactgcacgagcggctgcgcgatgcgggagcggccttcgcggctgggacggagacactcgaccccgccggtgaaacg

SEQ ID NO: 2296 - DNA, 897 bp, Streptomyces avermitilis
  CDS (1)..(897)
atgagtctgatgcgcaatctgaaccgggcgctcaccgccactaccggcctccaggtgcgtagggccgccgccgacgccccgccgcagccgaagaagacggccacggcggcgaaaccggccgggcggcccacgccggtgtaccgatgtcccgccgacaaggacctctcgacggaccgactgctgcggcggccggtcttcatcatgtcgcccgtgcgctccggctcgacattgctgcggatgctcctgaacgcccactcccggctgcactccccgcacgagctgcacatccgccgcctggaggtcgactacggcagcaagctgtcgcagcgcgccatgagcgccctggacctggagcgcggcgacctggagcatctgctgtgggaccgggtcctgcaccgggaactggtcaggtccggcaaggacttcatcgtcgagaagacgcccagcaacgcgttcgtgtaccggcgcatcagggactgctggcccgacgcgcgcttcgtgttcctgctgcgccaccccgtctccatcgcccagtcctggcacgagggcgaccccgacaagcgcacctacgacgaggccgcggccgacgcgctgcgctacatgaaggccgtggacaacgcgcgcaagggcatcaccggcggtcacacggtgcgctacgaggacatcaccgccggccccgagcgggagctgcgccggctgtgcgtcttcctcggcatcgacttcgagcccaccatgctggagtacggccggaaggacgactcgcaggtcgtcaagggactcggcgactggcgcgacaagatccgcagcggcagcgtacaggccgggcgctcgctgcccgccgaggacgagatacccgagctcctgcggcccatgtgcaaggcgtggggctacagctcg

SEQ ID NO: 2297 - DNA, 408 bp, Streptomyces avermitilis
  CDS (1)..(408)
gtgaagccgcacgccgaaatagcggaggtctggccgcgcgacggatacatccggctggtcggccgcatccacggccgcccggccgacggctcctggcggcttctggtcacccgccgggcccgcgccgaacagcggctggactaccgggcccgcgtcgagggcgaccggttcgagagcgagctgcccatcgccgacctcgccgtccccgacggtgccggagtcgaggagtgggacatccatctcaccgacggcgcggccgagttgcgggccggccggcggctggacgacatctgcggcaagaagaagatcatggtgttcccccggcagctcacccaggacctgagcgtgcggccgtactacacggtcaaggacaacctgtcactggagtgccgtacgggagccgcctcg

SEQ ID NO: 2298 - DNA, 1164 bp, Streptomyces avermitilis
  CDS (1)..(1164)
atgaaccaggccaactccctggtcgccgcgggctgggacgtcgagctggtgagcgcggtgcgccgccgggacgacatccagttcccgctcgacgcgcgcgtgaaggtctccaccgtcgtcgacctgcgcgaggacgcccacgtcccgccggccggtccggtggcccgctggcgcgaccggcgccgcggccggctgctggaccggcccgcacggcacatccccgcgggcgagttcggctaccgctacttcaaccggtacgtcgaggaacgcctcatcgcctacctgcggacgctgaccgacggcgtcctcgtcaccacccggcccgcgctcaacttcctggccgccgagcacgccagccgcggcgtgatccgcgtcgcgcaggagcacatgaaccacggcacccacaagcgggacgtgcagcagcgcatccgggagacctacccgcgcttcgacacggtcgccgtgctgaccgaacgcgaccgcgaggagtacgaggcactgctgcccggcacccgcgtcgtccgcatccccaacgccgtgcactcgctcgaccaggtgcccgcccgcccccggtcgaagatcgcggtggcggccgggcggctcttcccgcagaagggcttcgacctgctgatccccgcgtgggcgaagctcgtcgaggcgtaccccgactggcagctgaggatctacggcagcggcgagaagaaggccgagctgcgtgccctcatcgaggagcaccacctctacaaccacgtgttcctgatgggccacaccgaccggctggacgacgaactcgccaaggcctccttctacgtgctcagttcacgcttcgagggcctgccgatggtgatgatcgaggcgatgagccactccctgccggtggtcggcttcgactgcccgaccggcccgtcggacgtgctcacccacggagtcgacggtctgctcgtgccgccggaggaccccgacgcgctcgccgacgccatggcgaagctgatgaaggacgaggggctgcgcgccgagatgggcgtggcggcggtcctgacggccgcctcctacggcccggacgccgtccacccgcgctgggaagcgctcttcaccgaactcgccacacgccccggccgccacggacaacggcgcccgggcggcgccgcgaaaggaccgcacgca

SEQ ID NO: 2299 - DNA, 549 bp, Streptomyces avermitilis
  CDS (1)..(549)
atgaccaccacgtccagggcgcagggagccacggtctggctcgccgggctgccgagcgcgggcaagaccaccatcggccgcatactcgccgggcggctgaggtcgcaggggcaccgcgtggaggtgctcgacggcgacgagatccgccgtttcctctccgcggggctcggcttctcgcgcgcggaccgccacaccaatgcgcagcgcatcggcctggtcgccgaggtgctggcgcgcaacggcgtcctcgccgtcgtcccggtcatcgcgccgtacgccgacagccgcgaggcggtccgcaaacggcacgaggcgagtgggacgccgtacctcgaggtgcatgtcgccaccccggtcgaggtgtgcagcgaacgggacgtgaaagggctgtacgccaggcaggccgcgggccggctgaagggtctgaccggtgtcgacgacccgtacgagccgcccgtggacccggcgctcaccctggagacgcaggggcagacgcccgaggagtcggcgggggccgtgtacgcggtcctggcggcgaggggtctcgta

SEQ ID NO: 2300 - DNA, 933 bp, Streptomyces avermitilis
  CDS (1)..(933)
atgacgaccgcggccaccgcttcccaggagaccgacagcccgtacgcgctctcgcatctggacgcgctggagtcggaggccgtccacatcttccgcgaggtggcgggcgagttcgaacggccggtgatcctgttctccggcggcaaggactccatcgtcatgctgcacctggcactgaaggccttcgcacccgcggcgatccccttcaccctgctgcacgtggacaccggacacaacttccccgaggtcctcgcataccgcgaccgtgtggtcgccgcacacggactgcgcctgcatgtggcctccgtacaggactacatcgaccgcggtgtactgcgcgaacgccccgacggcacccgcaaccccctgcagaccgtgcccctgaccgaagccatccagcagcaccgcttcgacgccgtcttcggcggcggccgacgcgacgaggaaaaggcccgcgccaaagaacgcgtcttctccctgcgcgacgagttctcccagtgggacccccgccgccagcgccccgaactgtggaacctctacaacggccgccacgcccccggcgaacacgtccgcgtcttcccgctctccaactggaccgagctggacgtatggcagtacatcgcccgcgaacacatcgaactccccgagatctacttcgcccacgaacgcgaggtcttccagcggtcccacatgtggctgaccgccggtgactggggcggccccaaggacggcgagactgtcgagaagcgccgggtccgctaccgcaccgtcggcgacatgtcctgcaccggcgccgtcgactccgacgccaccacgctggacgccgtgatcaccgagatcgccgcctcccggctcaccgaacgcggcgccacccgcgccgacgacaagatgtccgaggccgcgatggaagaccgcaagcgcgaggggtacttc

SEQ ID NO: 2301 - DNA, 1218 bp, Streptomyces avermitilis
  CDS (1)..(1218)
atgaccagcaccaccaccgccaccaccgacaccctgcgcttcgcgaccgccggttccgtcgacgacggcaagtccacgctggtcgggcgtctgctgcacgactccaagtcggtcctcgcggaccagctggaggccgtggagcaggtgtcgcgcagccgcggccaggacgctcccgacctggccctcctcaccgacggcctgcgcgccgaacgcgagcagggcatcaccatcgacgtggcgtaccgctacttcgcgaccgcgcgccgccggttcatcctcgccgacacccccggccatgttcagtacacccgcaacatggtcaccggcgcctccaccgccgacctggccgtcatcctggtggacgcccgcaacggcgtcatcgagcagacccgccggcacgccgccgtcgccgcgctgctgcgcgtcccgcacatcgtgctcgcggtgaacaagatggatctcgtcgggtacgaggagaaggagttcgaccggatcgtcgaggacttcgcgggccacgcggcggagctggacctgcccggcttcactcccgtcccggtgtccgcgctgtgcggcgacaacgtggtcgagcgctcggcgcacatggactggtacgcgggcccggcgctcctcgacctcctggagacggtcccggtcggcgccgagtcggccggcgccccggcccgcttcccggtgcagtacgtgatccggcacgacggggtccgccactacgcgggccagttggtgtcgggctcactgcgggtcggcgaccgggtgaccgtccacccgtccggcgagacctccgagatcaccggcatcgacgtgctcggcacaacggcgcgggcggcgtacgcgccgcagtcgctgaccctgcgcctggccggacagcgggacatagcgcggggcgacatgatcaccgccggccccgacgctcccgagctcacgcgggacgtccgggcggccgtctgccatctggccgaccgcccgctgcgcatcggcgaccgggtgctggtcaagcacacgacgcggacggtgaaggcactggtcaaggacctggccggcgcgaccgagctgaccgcgaacgacctcggcaggatcgccctccgcacggccgagcccctggccctggacgactacgcccgggtgcgccgcacgggcgccttcctgctggtcgacccggcggacggcgcgaccctgaccgccgggatggcagacctgtcg

SEQ ID NO: 2302 - DNA, 2265 bp, Streptomyces avermitilis
  CDS (1)..(2265)
atgcgggtcgcggtcgtcggaggcggccccgggggcctgtacgcggcagcgctgctgaagcgtctcgacccgtcccgcgaggtcaccgtctgggagcgcaacgcgcccgacgacaccttcggcttcggtgtcgtcctctccgacgagaccctcggcggcatcgaacacgcggacccggtggtgtacgcggccctcagggacgagttcgtgcgctgggacgacatcgacatcgtgcaccgcggcgtacgccacacctccggcggccacggcttcgccgcgctcggcaggcagcggctcctcgggatcctgcacgagcggtgccgctcgctcggtgtggagctgcgcttcggtaccgaggcgccgtaccccgcgtggctcacggagacgtacgacctcgtcatcgccgcggacggggtgcacagcagcacccgcgaggcgtatgcggaggccttccggccctccgtcgagacgcaccgctgccgctacatctggctcgccgccgacttcgccttcgacgcgttccgcttcgagatcgccgagaccgagcacggcgtgctccagctgcacggctatccctatgcggccgacgcctccaccgtcatcgtcgagatgcgcgaagaggtgtggcaggcggccgggttcgccgagctggacgagcgggagtccgtcgagcggtgcgccaagatcttcgcggacgcgctgggcggacgatccctccggtccaacaagtcggcctggacccacttccgcacggtcgtcaacgaacgctggtcgcacggcaatctggtcctcctcggcgatgccgcgcacaccgcccacttctccatcggctccggcacgaagctcgccgtcgaggacgcgctggcgctggcggcctgcctggaggaacagccggggctgcccgaggccctggccgcgtacgagcaggagcggcggcccgtcgtcgcctccacccagcgcgcggcccgggccagcctggagtggttcgagaacatcgggctgtacctcggccggccctcccggcagttcgccttcaacctgctcacccgcagccgccgtgtcacccacgacaacctgcggctgcgcgacgcccacttcaccgaggccgtggagcgcgagttcggctgcccgtccggcaccccgccgatgttcaccccgttccggctgcgcggactgaccctgcgcaaccgggtcgtggtgtcaccgatggacatgtacgcggcggtggacggtgtccccggcgacttccacctggtccacctgggcgcgcgggccctcggcggggccggcctggtgatgaccgagatggtgtgtgtcagccgcgagggccggatcacaccgggctgcgccgggatctacaccggacggcaggccgaggcatggcggcggatcaccgacttcgtgcacacccgggcgccgggcgtcgggatcggcgtgcagctcggccactccggacgcaagggaagcaccaagctgatgtgggagggcatcgacgagccgctggaggagggcaactggccgctggtggccgcctctccgctgccgtacaagccggggagccagacgccccgcgcgttgtcccgtgctcagctcaccgacatccgggagcagttcacggacgccgcctggcgggccgcccgcagcggcttcgacctcctcgaactccattgcgcccacggttacctgctctccggcttcctctccccgctgaccaaccaccgcaccgacgcgtacggcggaagcctcgcgcgcagactccgcttcccgctcgaggtcttcgacgccgtacgctccgtctggccggaggagcggcccatgacggtccgcatatcggcgaccgactgggccgagggcggcaccacggccgaggacgccgtcgagatcgcccgcgccttcgccgcgcacggcgccgacgcgatcgacgtgtcgaccgggcaggtggtcgccgacgaacagcccgcgtacgggcgctcgtaccagacgccgtacgcggaccggatccgcggcgaggccggcgtcccggtcatcgccgtcggcgcgatctcctcctgggacgacgtcaactcgctgatcctcgccgggcgtacggatctgtgcgcgctcgcccggccgcacctctacgacccgcactggaccctgcacgcggcggccgagcagggctacacggggccgggtgtcgtctggcccgcgccctaccgggcaggcagccggcgcccgcagtccggccgcacggacgcccccaagccccggctgacactggggacc

SEQ ID NO: 2303 - DNA, 825 bp, Streptomyces avermitilis
  CDS (1)..(825)
atgagtcccttcaccggttccgccgcccgcacccccgactggaaacacctcggggtcgagatcgcggacggggtcgccaccgtcaccctggcccgccccgagaagctcaacgcgctcaccttcggcgcctacgccgatctgcgcgacctgctcgccgagctgtcccgcgagaagtccgtacgtgccctggtgctggccggtgaggggcgcggcttctgctccggcggcgacgtcgacgagatcatcggcgcgaccctggccatggataccgcccagctcctcgacttcaaccggatgaccggccaggtggtgcgggcggtgcgcgagtgcccgttcccggtgatcgcggccgtgcacggggtggccgcgggagccggggccgtgctcgccctggccgccgacttccgggtggccgacccctccgcgcgcttcgccttcctcttcacccgcgtcggactgtccggcggcgacatgggcgccgcctatctgctgccccgggtcgtcggactcggccacgccacccggctcctcatgctcggcgaaccggtccgcgcgcccgaggccgaacgcatcgggctgatcagcgagctgaccgacgagggccacgccgacgacgccgcccggaccctggcccgccggctcgccgagggccccgcgctcgcgtacgcccagacgaaggccctgctcaccgccgagctggacatgccgctcgccgcctccgtcgaactcgacgccgcgacccaggcgctgctgatgaacggcgcggactacgccgagttccacgcggccttcaccgagaagcggccgccgaagtggcaggggcga

SEQ ID NO: 2304 - DNA, 498 bp, Streptomyces avermitilis
  CDS (1)..(498)
gtgcgccgtaccattcctgatgttgaaagcaggacagcctgctccatgaacggaccgaccttgcacgagccccccaccccgccggcctcctggcgcgtcgcgctgccgcacaccgccgcggccgtgcccgtcgcccgcgccctggtccgctcggcgctggccgagctgaagcactcggccgacagcgacaccgcggagctgctcaccgccgagctggtggccaatgccgtggaacacaccgcgggcgagggcccgatcgagctggtggtcgagctgctgccgaccggctgccaggtcgaggtgcacgaccccgacccggccccgccgggcaacctcacggtccccggcccccgcgaggagcccgacccctggcaggaacacgggcgcggcctcctgctgatccgcgccctcagctccgcctgcggccatcgccccacgggctcgggcaaggcggtgtggttcagactgcctgtgataccgcctcagcgtcggttcgcg

SEQ ID NO: 2305 - DNA, 1440 bp, Streptomyces avermitilis
  CDS (1)..(1440)
atgcccgcacttcgcatcaagtcccccgagctgctcgtcgccgaatccggcgccgacctcgaaggccatggcctcaagcgcaccatgggcctcttccagctcatctgcttcggcgtcggcgccatcgtcggcaccggcatcttcgtcggcctgtccgactcggtcgcccaggccggccccgccgtcgtggtctccttcgttctcgccgcgatcacctgcgtcttcaccgccttcgccttcgcggagctgggcggcgcgatcccggtctccgggtcctcgtactccttcgcctacgcgggcctcggcgagcgcacggcctttctcgtcggctggtgtctgctgctcgagtacggcgtgtccgtctcggccgtggcggtcggctggagtcagtacgtcaacgaactcctggacagtctcaccggcctggagctgcccgccgcgctgtccgcgggccccggcgacggcggagtgatcaatctccccgccgtcgtcgtgatcgccctcgcctcggtcctcctggtgcgtggtgtgcgcgagagcgcccgggccaccgccgccatggccgtgctgaagctcgccatcctggtcgtcttctgcgccatcgggttcagcgccttcaaggacggcaacctcaccccgttctcgcccgccggtctcggcggcatcggcgcgggcaccaccgccgcgttcttctcgtacatcggcttcgacgcgatcaccacggccggcgaggaggccaggaacccgcgccgcgacatcccgatcgcgatcctcgtctgcctcggcctggccaccctcctgtactgcgcggtggcactcgccgcgatcggtgccatcggcggcgaccaggtcggcggtcggcccgccgcgctgtcgtacgtcgtcaacgaggtcaccggctccacggccggcggcgcggtcatcgccttcggcgcggtcgtcgccatcgcctcggtggtgctcgcggtgatgtacggccagacccgcatcctgatgtccatggcccgcgacggactcgtgccccgcgtcttcgagcgggtctcgccgaagacctcgacgccggtcaccggcacgctgctcgtcgcgctcgtcttcgcggtcccggcggccttcgcgtcgctcgacgcggtggtcaacctgtgcaccatcggcacgctcgcgatcatggccgtggtcaatgtcacggtgatcgcgctcaggcgccgcgagccgggcctcacccgcagcttccgggtgccgctctaccccgtgataccggtgctcggcgtcggcttctgcctctatctgatgtacgagacgggctggacgacctggatccagttcgccgccttcctggcggcgggctgcctggtgtacgcgctctacgggcgtcgcaactcccggctggcgaagtcggcggccgctacgcgaaccgacgctgaggcggtatcacaggcagtc

SEQ ID NO: 2306 - DNA, 1005 bp, Streptomyces avermitilis
  CDS (1)..(1005)
atggcgacagtcccgaccgccctcgccggccgccatttcctcaaggagctggatttcaccgcggaggagttccgcgggctgctcgagctggccgccgagctgaaggccgccaagaaggcccggacggagacgctgtatctgcggggccgcaacatcgcgctcgtgttcgagaagacgtcgacgcgtacgcgctgcgcgttcgaggtggccgcggccgaccagggtgcctccacgacgtacctcgacccggcgggctcgcagatcgggcacaaggagtcggtcaaggacacggcacgcgtactcggtcgcatgttcgacggcatcgagtatcgcggccacggccagggcgtcgtcgaggagctcgccgcgcacgccggagtccctgtctacaacggcctcaccgacgagtggcaccccacccagatgctcgccgacgcgctcaccatgaccgagcacagcgacaagccgctgaccgagatcgcctacgcctacctcggcgacgcccgctacaacatgggcaactcctacctcgtcacgggcgccctgctcggcatggacgtccggatcgtcgcgccccggctgctgtggcccgacgagacgatcgtcgaggtggctcagcagctcgccgtcgcgtccggcgcccgcatcacgctcaccgaggacgtgaaggagggcgtgcgcggcgcggacttcgtcgccaccgacgtctgggtgtcgatgggggagcccaaggaggtctgggacgagcgcatagggctgctcggcccctacgccgtgacgatggacgtgctgcgcgccaccggcaacgacgacgtgaagttcctgcactgcctgccggccttccacgacctcggcaccgacatcggccgtgagatccacgcgcggcacgggctgacctccctcgaagtcaccgacgaggtcttcgagtccgcgcactcggtcgtcttcgacgaggcggagaaccggatgcacaccatcaaggcggtcctggtcgccaccctcgcc

SEQ ID NO: 2307 - DNA, 1227 bp, Streptomyces avermitilis
  CDS (1)..(1227)
atgggactgcatgtcgactccgaagccgggcggctgcgccgcgtcatcctgcaccggcctgatctcgagctcaaaaggctcacccccagcaacaaggacgccctcctcttcgacgacgtgctgtgggtgcgccgggcccgcgcggagcacgacgggttcgcggacgtgctgcgcgaccgcggtgtcgccgtccacctcttcggcgacctgctcaccgaggcgctggacatcccggccgccaggacgctcgtgctggaccgggtcttcgacgagaaggagtacgggccgctcgccaccgaccatctgcgggccgccttcgagaccctgcccgccccggacctggccgccgcgctggtcggcggcatgaccaagcgggagttcctggaggcgcaccccgagcccgtctccgtgcgcttccatgtgatggacctcgacgacttcctgctcggtccgctgcccaaccacctcttcacccgggacacctccgcctggatctacgacggggtctccatcaacgccatgcgctggcccgcgcggcagcgtgaaaccgtgcacttcgaggcgatctaccggcaccacccgctcttccgggacgaggccttccatgtctggtccgaagggcaggcggactacccctgcaccatcgagggcggggacgtcctcgtcatcggcaacggcgccgtgctcatcggcatgagcgagcggacgacgccgcaggccgtcgagatgctcgcgcacaagctgttcgcggccgggtccgcgcgcaccatcgtggcgctcgacatgcccaagcggcgggcgttcatgcacctggacaccgtgatgacgatggtcgacggcgacaccttcacccagtacgcggggctcggcatgctccgctcgtacaccatcgagccgggcgtcggggagaaggagctgaaggtcaccgaccacccgccggagcacatgcaccgcgcgatcgccgccgcgctcgggctcggtgagatccgcgtcctgaccgccacgcaggacgtgcacgcggccgagcgcgaacagtgggacgacggctgcaacgtcctcgcggtcgagccgggcgtcgtggtcgcgtacgagcgcaactcgaccaccaacacgcatctgcgcaagcagggcatcgaggtgatagagatcccgggcagcgaactggggcgggggcgcggcgggccgcgctgtatgagctgtccggtggagcgggacgccgtgcccggg

SEQ ID NO: 2308 - DNA, 1020 bp, Streptomyces avermitilis
  CDS (1)..(1020)
atggccgacatcacccggcgcttcggctggcgccatctgcgcggcgcaccgaccgcccatgtccggcaccagcgggcgggacggctggtgcacgacgggcccgggctcagcttctggtaccgctccctgaccgccgcgctctccgagatcccggtggacgaccgcgagctggccatgacgttccacgcccgtacgtccgacttccaggacgtggcggtgcaggcgaccgtgacctaccggatcagcgatcctggcgtcgccgccgcgcggctcgacttctccgtcgaccccgacacgggcgtgtggcgcggcgcaccgctggagcagctggcgacgctgctgaccgagacggcacagcagcacgcgctggacgtcctggcccgtacgccgctgtcggcggcgctggtcgacggggtcgcggcggtacgggaccgggtcgccgccgggctcgcggccgagcctcggctgcccgcgaccggcatcgaggtggtcgccgtccgcgtcgtggcgctgcgtcccgagcccgaggtggagcgggcgctgcgcaccccggcccgtgagcagatccagcaggaggcggaccgggcgacgtacgagcgccgtgccgtggcggtggagcgcgagcgtgcgatcgcggagaacgagctggccagccagatcgaactcgcccgccgcgaggagcagttggtcgaccagcggggcacgaacgcccgccgcgaggcggaggagcacgcggcggcggacgccgtgcgcgcggaggcggaggccgcccgcaccgtgcggctggccaaggccgaggcgcaggccgcgcgcgaggtcggggaggcgcgggcgcgcgcacaggcggcgtggctgcacgtgcacgcggaggtggacgtggcgacgctgcacgccctgacggggacgcggctcgcggagaatctgccgcggatcgatagcgtgaccgtgtcgccggacgtggtgacaggactgctgtcccggctcggcgcggccgcgggcgggccctcgggagaaccggcg

SEQ ID NO: 2309 - DNA, 891 bp, Streptomyces avermitilis
  CDS (1)..(891)
gtgagtctcgcgccgagggtcgtgctggtccatcgcaccacggagtacgaggagttggtggcccggcacggcacacccggtcaggccgccttcttcctggcctcgcgcgggcggagcgtcgacgaggtggccgagcggcaccggcgggcccgccgggcgtgggccgaggtggtggcggcggtgccgctgacgtggcgtcaggcccgggtggagcgacgggacctggaccggttcctgttcgccccggaggacgtggtggtcgtggtcgggcaggacgggctggtggcgaacgtggccaagtacctcgccggacagccggtggtggggatcgacgcggacccgggacgcaaccccggggtgctggtgcggcaccggcccggtgacgcggcggcgctgctcgcgtcggcgcgcagcggtcacgccgacgagctgacgatggtcgaggcggtcgcggacgacacccagcggctgctcgcgctgaacgagatctatctgggagcggcgggtcatcagacggcccgctaccgcctggggctcgacgagtacgggggtgccgtcgagccccaggcgtcatcgggggtgctcatcggtaccgggaccggggcgacgggatggatccgctcggtgtggcaggagcggggcgaaggactgccgttgccggcgcccgtcgaggaccgcctggtgtggttcgtccgcgaggcgtggccgtcgccggccaccggcacgtcgctggttgccggtgaactcaccgcgtccgcccggctgtcggtgaccgtcgagtcggaccggctcatcgccttcggggacggcatggagggtgacgcgctggaactgacgtgggggcagacggtgcgactcggggtggcggcggtcaggctgcggttggtgggg

SEQ ID NO: 2310 - DNA, 2544 bp, Streptomyces avermitilis
  CDS (1)..(2544)
atgacgaacgggactcagatgaaggcgcgcactctcgcggtgaccgacctctctctcgtggtgctgatcggcgcctccggctcgggcaagtccaccttcgcccgcaagcacttcacgcccaccgagatcatctccagcgacttctgccggggtctggtcgccgacgacgagaacgaccagagcgccagccgcgacgccttcgacgtcctgcactacatcgcgggcaagcgtctcgcggcgggccgccgtacggtcgtcgacgcgacgagcgtgcagcaggagagccgcagccagctgatcgaactggccaggaagcacgacgtgctgcccatcgcgatcgtgctcgacgtgcccgaggaggtgtgcgcggaacgcaacgcggcgcgcaccgaccgggcggacatgccgcgccgggtcattcagcggcacacgcgtgaactccgccgttccctgcggcacctggagcgcgagggcttcaggaaggtgcacgtcctgcggggtgtggaggagatcgagaacgcctcggtggtcaccgagaagcgcttcaacgacctcacccacctcactggccccttcgacatcatcggcgacatccacggctgtgccgccgaactggagtcgctgctcggcaagctgggttacgccgacggcgtgcaccccgagggccgtacggccgtgttcgtcggcgacctcgtcgaccgcggcccggacagccccggcgtcctgcgccgcgtgatgtccatggtcggctcgggcaacgcgctgtgcgtgcccggcaaccacgagaacaagtacggccgtcacctcaagggccgcaaggtccagcacacgcacggcctggccgagacggtcgagcagatggaaggcgagagcgaggagttccgtacccaggtgcgggagttcatcgacggcctggtcagccactacgtcctcgacggcggccggctcgtcgtctgccacgccgggctgcccgagaagtaccacggccgtacctccggccgggtgcggtcgcacgcgctgtacggcgacacgaccggggagaccgacgagttcggtctgccggtgcgctatccgtgggccgaggactaccggggccgggcggcggtcgtctacgggcacacgcccgttccccaggccacctggctgaacaacacgatctgcctggacaccggcgccgtcttcggcggcaagctcaccgcgctgcgctggccggaacgcgagctggtcgacgtaccggcggagcgggtctggtacgagccggccaagccgctggccaccgaggcgcccggcgggcacgagggccgtccgctcgacctggcggacgtgcgcggccgcagggtcgtcgagacccggcacgcgggccgggtgtcggtgcgcgaggagaacgcggcggccgccctggaggtcatgagccgcttcgcggtggacccgcgtctgctgccgtacctgccgccgaccatggcaccgaccgcgacctcgcaccgggacggttacctggagcacccggccgaggccttcgcgcagtaccggcaggacggggtcgcgcgggtcgtgtgcgaggagaagcacatggggtcgcgggcggtggcgctggtgtgccggaacgcggaggcggcacgcgagcgcttcgggaccgacgggcccaccgggtcgctgtacacgcgcaccgggcgccccttcttcgacgacgcggacaggaccgaggagatcctcggccgggtgcgggaggccgtcggcgcggcgggtctgtgggaggagctggagaccgactgggttctgctggacgccgagctgatgccgtggtcgctgaaggcgtccgggctgctccgtacgcagtacgcggcggtcggcgccgcgtccggggcggtgttcccgggggcgctggccgcgctcgagggggcggcggcgcgcggtgtcgacgtcggggagctgctggccaggcagcgcgaacgggccgcggacgcggccgcgttcacggacgcgtaccggcggtactgctgggcgacggacgggctggagggtgtgcgcctcgcgccgttccagatccttgccgtccagggccgcagtctcgccgccgtgccgcacgaggagcagctcgcgctgctcgaccggctcgtcgagcacgacgcgagcgggctgctggggaccacccgacggctcttcgtcgacacgggcgacccggagtcggtgcaggccggcgtcgactggtggctggagatgaccgggcgcggtggtgagggcatggtcgtcaagccggcgggcgcggtggtacgcggtgagcaggggcggctggtgcagcccggcatcaagtgccgggggcgggagtacctgcggatcatctacggtccggagtacacgcggcccgagaacctcgcacggctgcgcgggcggttcctgaaccacaagcggtcgctggcgatccgggagtacgcgctgggcctggaggccctggaccggctggcggagggcgagccgctgtggcgcgtgcacgaggcggtgttcggggtgctggcactggagtcggagccggtggacccacgcctg

SEQ ID NO: 2311 - DNA, 1485 bp, Streptomyces avermitilis
  CDS (1)..(1485)
gtgttcctgacgatcagtgccaccggtaccccagagcgccccgccaccgacctcggtttcctgctgcacaagcatcccgacaaatcgcaggcgttctccacctcgtacggcacggcgcacgttctctaccccgaggcgagcgtcgagcggtgcacggccgcgctgctgctggaggtggatgcggtggcgctggtccggcgcggcaagggcaagggccggggcggcgcccccgacgccgcgctcgcgcagtacgtcaacgaccgcccgtacgcggcctcctcgctgctcgccgtggcgctgagcagcgtgttctccagcgcgatgaagggcacctgcgcggcgaggcccgacctgccggcccggccgctgccgctgcgcatcgaggtgcccgcgctgcccgcccgcggcggcccggacatcgtgcgcgcgctgttcgagccgctcggctggacggtgacggctcggcccgtggcgctggacgccgcgttcccggagtggggcgactcgcggtacgtgggcctggtcctggagtcggcggagctgaccctggccgaggccctgcgccacctctatgtcctgctcccggtgctcgacgacgccaagcactactgggtcgcctcggacgaggtcgacaagctgctgcgggccggtgagggctggctgccggaccacccggagcacaaactcatcaccagccggtacctcgcgcgccgctggtcgctcacccggcaggcgatggaccgcctcgaactcgtccgtctggccgaggccgacgacagcgaggtcgaggagatcgacaacgcggtcgacgagtcgacggacaccgaggagaagccggtgccgctcgccgtgcggcggcgggacgcgatcatcgcggcgctccaggcgtccggtgccgcacgggtgctcgacctcggctgtggacagggccagttggtgcaggcgctgctcaaggacgtgcggttcaccgagatcgtcggcgtcgacgtgtccgtgcgcgcgctgaccattgccgcgcgccgcctcaagctggaccggctgggggagcggcaggcatcccgggtcaccctcttccagggctcgctcgcgtacaccgacagccgcctcaaggggtacgacgccgccgtgctcagcgaggtgatcgagcacctcgacctgccgcggctgcccgccctggagtacgcggtgttcggctcggcccgccccaggaccgtgctcgtgaccacgccgaacgtcgagtacaacgtccgctgggagaccctcccggcgggccactcccggcacggcgaccaccgcttcgagtggacccgtgaggagtttcgcgcctgggcccgccgggtcgccgaacggcacggctacgacgtggagttcacgcccgtcgggcccgacgaccccgaggtgggtccgccgacccagatggccgtgttctccatgacctcggcgcactcgaacacgccgaccaccgcgaaggaggagaaggccgca

SEQ ID NO: 2312 - DNA, 924 bp, Streptomyces avermitilis
  CDS (1)..(924)
atggatcttcgagtcttcacagaaccgcagcaaggcgctacctacgagacgctcctccgcgtcgcacaggccgccgaagacctcaattacgacgctttcttccgctctgatcattacttgcacatgggatccgtcgacgggcttcccggccccaccgacgcgtggatcacgcttgccggtctcgcccgcgagacgcgccgcatccggctcggcacgctgatgaccgccggtaccttccggctccccggcgtcctcgcgatccaggtcgcccaggtcgacctgatgtccggtgggcgggtggagctcggcctcggttccggctggtacgaggccgagcacgaggcgtacgggatcccgttcccgaaggagaagttcggccggctggaggagcagctcgccatcgtcaccgggctgtggtcgacgcccgtcggcgagcggttctccttcgacgggacgtactaccagctcaaggactcccccgcgctgccgaagccggcccaggggaaggttccggtgctcatcggcggccacggcgcgaagcggacccccgcgctggcggcccggtacgcggacgagttcaacattcccttcgcgtccctcgctgataccgagcagcagttcaaccgggtgcgtgccgccgccgaggaggccggccgcaggggcgacgacctggtgtactccaacgcgctcgtggcctgtgtcgggaggaacgacgtcgaggtgaagcgccgggcggacgtcatcgggcgtgatgtcgacgagctgaaggcgaacggtctcgccggctctcccgcggaagtcgtcgagaagatctcccagtaccaggctgtcgggtcgcagcgcatgtacctgcagatgctggacctcgacgacctggatcagctggagctgatcgccgccgaggtcatgccccagctcgaccgg

SEQ ID NO: 2313 - DNA, 459 bp, Streptomyces avermitilis
  CDS (1)..(459)
atggacgtggtgcggctcatcgtggcgagcaggcgcgccctggcggggagcgacgcggcgccgcagatcatgacagaggcgtggcaggcgtacgccctggcgcaggcgataggcagccgcctcgcggtgtcgggcccgcccgaactgcggggcgaggccctgggattgacggagctggcgggccggggctgcggcgtcctcgacacgccgtcgctggacgtcgccgacttgcgcgccgcgcagctcaccgagctgggggacgcccgtgaggccctcctcgacctcggcgacctcctcgccgaggtcggcatggccctcgtcgccctcgccagcgcggcggacggcgaggggacgtactggcagtgcatggaggccatcgacgcggcggacgagtccagggaccgcgtacgggagatgctgcgcagactggcggcgagagacggggctctccctcagccg

SEQ ID NO: 2314 - DNA, 330 bp, Streptomyces avermitilis
  CDS (1)..(330)
gtgaaggaactggacgtagcccatctgcagcgccggctggcggacttcgcggccgcccgcgactggcagccgtaccacacccccaagaacctggcgaccgcgctcagcgtggaggcgtccgaactcgtggagatcttccagtggttgaccccgcaggagtcggaacgggtgatggacgacccggacacggcccaccgcgtcaccgacgaggtcgcggacgtgctggcgtatctgctccagctgtgcgaggtgctggacatcgacgcgctcgcggccctggacgcgaagatcgaccgcaacgagaagcggtttccggtgccggggaccgac

SEQ ID NO: 2315 - DNA, 1215 bp, Streptomyces avermitilis
  CDS (1)..(1215)
atgaccgtgtcatccctgtcgaccgggtcgctcccggcacccctctcgttcgagccctccctgtcgtccccggcgtccggcgccgtcgtcgacgccgggccgcgtcccgaccggccgcacgtctcggagctgcgcctgtccgccttcgccgggcaccggcgggccggcttcccactgggaccgctgacgctcttcaccggccccagcgggtgcgggaagtcgcgcgccctccaggcgtacgaggcgctcgcgcggctcgccggcggggccgaactgggtgcggcgttcccggatccggccgcctgtgtgccgcagcgggcccgccccgacgcccagcggcggcgcggcttccggatcggctgcacgaccgacggccccgaaggacccgtacggctcgacgtcgccgtacaggcggagcccgtaccacgcatcgtgggcgagcggctgacctccggtgggctcgttctgctggagacggcgctgcgcgatccgggccgacgcgtggtgcaggcggcctggcacacggcgggctccgcgcccgtgacccgcggcccgctcccggacgaccgcctcggcaccgccctgctgcccctgcgggtggccggcaagacggacggccagcgccgggtgctggcggccgccgagcagatggtcgtcgcgctgcgctcggtcttcgcctgcgacccgcgaccgcaccggatgcgcgccccggcgccgctgggcacgggacggctgctgccgggctgcgccaacctcgccgatgtgctgtggcgcacgcggtcggagtgcggacggcggcacgcgctgctggtcgaggcggtgcgcgcgggatgcgcgggcccggtcgaggacatgctggcggaaccggcaggcgacggcacggtacgcgcactgctcgaccggggcgacgggtcccgtacgccactggcgctgctgggcgacggcgagttgcggtacgcggctctggcgctcgtcctgctcaccggtcccggcgtcctggaggtcgacccggccggcgaggtgccgcaggcgctccagacgctgacggtgctggccgacggcctcgaccgctgcatggatccccggcaggcgcgggagctggtgcggctggcggcgcggatgtgcgagcgggggcacatccggctggtgggcgcggtgagtgatacgtcctgggcggcgggggcggaaggggtcacggtggtagacctgagcgcg

SEQ ID NO: 2316 - DNA, 402 bp, Streptomyces avermitilis
  CDS (1)..(402)
gtgcggggagggccggtgaacagccacgatgtcaccgacgagcagtgggaagggctcgcccaggtcgttcccttgcgtggccgggacgcctggccgtccgcggtcggtcaccggtcgatacccgaggcgcagacagaggcgcgacgccgcttcgtggtcctgcgggtcaacatcttcgcggacgcccgtgacgtcgccgagacgctgatgcgcgggatcccggtcctcctcgacctgacgagcgcggagaccgaggtcgccaagcgggtgctggacttcagcacgggcgtggtcttcggcctcgcgagcggaatgcaccgggtcgaccggaatgtgttcctgctcacgccgccgggaaccgaggttcaggggctgatggagggggtgggggtgcccgggatc

SEQ ID NO: 2317 - DNA, 4056 bp, Streptomyces avermitilis
  CDS (1)..(4056)
atgaccacgaccccagaggcggagcggacccggaccgcggagcaggtgcggaccgtctgctcgtactgcggtgtgggctgcggaatcgtgctcgacgtggggaccggccccgacggccgtcgtacggtcctcaaggcgtccggcgacaaggagcaccccgccaaccgcggccggctgtgcaccaagggcgcgacgaccgccgacatgctcgccgcgcccggccggctgaccagcgcgctcgtccgcgacgaccgtggcgcggagccggtgcccgcgccggtggacgaggcggtccgcgagaccgcccgccggctgcgcgcgatcgtcgacgagcacggtccggacgccgtcgccttctatgtctcggggcagatgagcctggaggcgcagtacctggcgaacaagctcgccaagggcttcgtacggacgaaccagatcgagtcgaactcacggctgtgcatggcgagcgcgggcaccggctacaagctgtcgctgggcgccgacgggccgccggggtcgtacgacgacctcgacaaggcggacgtcttcctggtcatcggctccaacatggccgactgccaccccatcctcttcctgcggctgctggagcgggtgaaggccggcgccaagctgatcgtggtcgatccgcggcggaccgccacggcggccaaggcggatctgtttcttcaggtcaggcccggcaccgatctcgccctgctcaacgggctgctgcacctgctgtacgagaacgggcacacggacgccgagttcatcgcccggcacaccgagggctgggaggcgatgccggacttcctcgccgactatccccccgccaccgtctccgagatcaccgggatccccgaggacgacatccgggcggcggcgcggctgatcggcgaggccggggagtggacgagctgctggaccatggggctcaaccagtccacgcacggcacctggaacaccaacgccctggtcaatctgcatctcgcgacgggcgcgatctgccgtccgggcagcggtcccctctcactgaccgggcagcccaacgccatgggcggccgcgagatggggtacatgggtcccgggctgccgggccagcggtccgtgctcgtcgacgaggagcgggcgttcgtcgaggagttgtgggagctcgcgcccggcacgatccgcgcggacggggtcgggcggggcaccgtcgagatgttccggaagatggcggacggggacatcaaggcgtgctggatcatctgcaccaatcccgtcgcctcggtggcgaaccggaagacggtcatcgagggcctcgaggccgccgaattcgtggtcacccaggacgtgttcgccgacaccgagaccaacgcgtacgccgatgtcgtgctgccgggcgcgctgtggacggagagcccgggcgtcctcgtcaacagcgagcgcgtcctcacgctggcccggcccgtggtcgaaccgccgggggaggcgacggccgactggcggctgatcgcggccgtggcgcgcgagatggggtacacggaggggttcgcgtacgagagtgccgagcaggtcttcgaggagatcaagcgggcgtggaacccgaagaccgggtgggatctgcggggggtcacgtacgagcggctgcggtcgacgcccgtgcagtggccggcggcgcgggcggacgggccggcgcggaacccggtccggtacgtggcggacgggctggtgttccccacggcgagcgggcgggccgtcttccacgcccggccgcatcttccggccgccgaactgccggacgacgacttccccttcgtactcaacacggggcgggtgcagcaccagtggcacacgctgacgaagaccgggaaggtcgccaagctcaacaagctgaaccccggaccgttcgtggaggtgcatccgcgggacgcggccgccctcggggtcgtggacggtgactcggtggaggtcgcctcccggcgggggcgggccgtcctgcccgccgtcgtgacggaccgggtccagcccgggtgctgcttcgcccccttccactggaacgatctcttcggggagtacctgagcatcaacgcggtcaccagtgacgcggtcgatccgctgtcgttccagccggagttcaaggtgtgcgcggtggcactggcccgggtcgcctcgcccccttcggcccttcccgtccggtccctcgatgctgcgccccctgcccccgacggcggcctgacggcctcgtccgctcccgccggacaggcggagatcttcggtctcacccccggcccgccaccggtgctgaccgcgcgggaacgccagtacctgaccggcttcctcgccgggctcggctccggcgcgccgggcgtgcccgtgctgcccgcggaagcacccttcagcgccgagcacgcgctctgggtcaacggcgtcctcgccgggatgtactccagggccgccaccgctgaggccccggcgaaaccgcccggccgcgaggtcgtcgtcctgtgggcgtcgcagaccgggaacgcggaggagttcgccgccgcgaccgccgagcggctcaccgcgaccggtcaccgggccaccctcgtcggcatggacgacacggatgtcgcccaactcccgcgcactgctgacctgttgctgatcacgagcaccttcggcgacggcgacgcacccgacaacggctccggcttctgggacgcgctgtccgcggaggccgccccgcggctggacggcgtgcgctacgccgtcctcgccttcggcgactcctcgtacgacgacttctgcgggcacggacgccgactggacacccggctggacgagctgggcgcggtgcggctcgcgccgcgcacggactgcgagccggactacgagccgtacgcgggagcctggctcgaccaggttctcggcgcgctgggcaccaagacggacgccccgaagcctgcccggccccgcaagccggaacccgccatcgcccgtctcaccggcaaccggctgctgagcctgcccggcgcgggcaaggaggtccgcaggttcaccttcgacacgagcgggacgggactgacgtacgaggccggggacgcgctcggcgtacggccggtcaactcccctgatctggtggacgagtggctgtcggtgaccgggctcgaccactccactcccgtggccgtcgagggagtcggcgaggtgcccttcgcccaggccctgcaccgccatctcgacatcacccacatcacccccgacctgctccggttcgtgtccgaacacgcccacgacaaccgggagttgaagaagctgctgcgtccggacaacaaggacggcctggcgcagtggtcctggggccggcaggccgtggacgtggtggccgagcatccggtgcgggcgacggccgaggagtgggcggaggtcttcaagcgcctccagccccggctgtactccatatcgtcgagtccgctcgtggacccgcatctggtgtccctgaccgtctccgtcgtgcggtacgaggaccggctcgggcggccgcgcggcggggtctgttcgccgttcctcgccgacgcggagcaccacacaccggtgccggtcttcgtgcagcgctcgccgcacttccggccccctgcggacagctcgacgccgatggtgatggtgggccccggcaccggcgtcgcgccgttcatgggcttcctccaggagcggcgggcgctcgggcaccgggccccgaactggctgttcttcggcgagcagcaccgcgccaccgacttctactacgaggaggagctgacggcgctgctggcggacggcaccctcacccgcctcgacaccgcgttctcccgtgaccagcgcgccaaggtctacgtccaggaccggatccgcgaacacggccccgagctgtggcactggctccagaacggcgcccggttctacgtctgcggggacgcctcccgcatggcgaaggacgtcgaccgggccctgcgggacatcgccgtcacccacggcggtctgaccgaggcggaggccacggcgtacgtgaagcagctggccgcggagaagaggtacgtccgagacgtgtac

SEQ ID NO: 2318 - DNA, 1710 bp, Streptomyces avermitilis
  CDS (1)..(1710)
gtgcacttggcagaagcagggccgtcgacaagcggccgacgggcgggtacgccggcggcgccggacgaggcaccggcacagtggcaccgggtgctgacgctcctcgcgtgcatcagcctgttcatcggcacgcggcaggtgtgggtgcaggccgccagtctccgtccggtggtggccgcggtcatctccctgtgctacgcggggatcctgacgaccggcctgctgaccctggtggtgcgccgcggccgcgcgctggcgcgcctcgatctgggcgtcctggtgatcgcggtgacgctcaccctgtgcgcctgggtcatgaaccacggcggcaccgacgaggccgtcctgaccatgcaggccgcccgcgagttcatcgccggccgcccggtgtacgaacagccgtggccctggctgttcggccacggcatcgcgctcacgccgaccatgagcggcggctacgacttcacgtacggctatccgccgctctgtctgctgctgaccgcggcgctcctgtggatcgggggcaccggcgcggccgcggccaccctggtgagcacggtggccctgctggccggcacggtcgttctgtggtggctgctgcccgtgcggtggcgctcggcggccaccctggtgtgcctcggcttcgggcttgtgccgtcgtacgcccggtacgggtaccccgccgtcgtcgcgctcgccctcctcatcccggtggtggtgcgctggccacggatgggcgggggcggctggacggactgggggcgggccgcctgtctgggcgcggcctgcgcggcgcagcagctgccgtggttcctgacgccgttcctgctggccggggtctacgcgctgcgccgcggggagcggggcccgcgcgccgccgtggtcgccgtgggccggatcggggccgtggccgccgggacctggctgctgatcaacgcgttcttcgtcgtcagtgagccgcgctcctggctctccggcatcatgctgccgctcacccagggtgcggtgatccacggtcaggggctggtcggggcctcgctctactacaccgacggcagcgggcgactggcctggtactcccatgcgagcacgctgctggcggcggtcctgctcgcgctgctcgtcctgttcatgcgccggctggggccggcggcgacggtgctgccctggtgcacgttcttcctggcgacccgctcgcaggacggctactacctgctgatgacgccgttgtggctggcggccgccgtcaccgcgccgccctcggccttcgcgagcgcctggcagccccggctgccgttcggggcgcaccggcggcgggcggcccgcgtgggcgtcgtcgcgctgctgctggcactgcccctgtcggcggcggcgtacgcggtgaccggcgcgccgcccctgcgcatggaggtcctggccgtccgccggggcacggggaccgtcaccgggctcaccctccgggtcaccaacaccggcggcaccaccatgcgcccccacttcacggtgaccaccaatcagggcatgaaccgctactggtcggtcaaggccggcccggcgtctgtccccgcccacggctcggcccgctatgaactcctgccgcccgacggcaggttcaagctccccgagccaggtgtacgcatccggctgcgcgccttctccgcgtcgccggagacgctgtcgagcacggatgtgcggttgcagccgaagcgt

SEQ ID NO: 2319 - DNA, 345 bp, Streptomyces avermitilis
  CDS (1)..(345)
atgcatctcgtccccgccgaccgcgttgaccggagcaccatcgacggccaccgggtctgtgacgccatcgccgcgatcggcgagccccacggcgtacgcgcctgggccgaccggttctccctgctcgccgaccccggccggctcgccctcctcctcgccctgcaccgggccggaccgctcgccgtctccgacctcgcggtcgccaccggcatgaacgaccccgccgtctcgcaggcgctgcggctgctgcgcaccgccgaggtggtcgtgggcgagaaggcggggcgggtcgtgcggtaccgggtgatcgacccggtggtgctgaagctgctggagcaggtgacc

SEQ ID NO: 2320 - DNA, 1131 bp, Streptomyces avermitilis
  CDS (1)..(1131)
gtgatccacgaggtgctggagcgtgaccgtatgaccctgcccgcgcagtcttccgaggccgccgcctccttccggtggcggcgtgaggacaccgtccgtaccgccgggctgctggcggtgatcgcggccctgcacgtggtcgcgttcggcgttctgttcctgctggtcgtgcccgggcactacgaggtcggctccaaggccttcggtatcggcctcggcgtcaccgcctacacgctcggtatgcggcacgccttcgacgccgaccacatcgccgccatcgacaacaccacccgcaagctgatggccgacggcaagcggccggtgtcggtggggttctggttcgcgctcgggcactccagcgtggtcgtcgtcctcgccgcgctgatcgccgggggcacccagctggcgggacgggtcatgaacgaggactccaccacgcaccaggtgctgggcgttctgggtacgaccatctccgggtcgttcctctatctgatcgccgccctcaatctcgtcgccctcgtcggcatcctgcgggtcttccgggccatgcgggcgggaacgtacgacgagcgggagctcgaacagcacctggactcgcgggggttcatgaaccgcatcctggggcgcttcaccaagtcgatcacccgtcccgggcagatgttcccgttgggcttcctcttcgggctgggcttcgacacggccaccgaggtcacgctgatggtgatggcgggcagcggtgcggcggccgggctgccctggtacgcgatcctgtgtctgccgctgctgttcgcggcgggcatgagcctgttcgacacgctcgacggcacgttcatgaacttcgcctaccagtgggccttctcgaaccccgtgcgcaaggtgttctacaacctggcgatcaccggtctgtcgatcgccgtggcgtttctgatcggcaccatcgagctggtcggcgtactgcacgacaagctcgacctgcgggactcggtgaccggctggatcgccggcctcgacctcgacaacgtgggctacatcatcgtcgggctgttcggggtcgtgtgggcggcggcgatcacgtactggcgggtggccagggtggagcagcgctgggcggtccgccccgccgacgggaac

SEQ ID NO: 2321 - DNA, 762 bp, Streptomyces avermitilis
  CDS (1)..(762)
atgtccccgatccgcaccaccccgatccgcaccaccctgcgccgcgccggcaccgtcaccgctctcgccgccgccggtgtcctcaccgcggcgggcgcctccttcgcgcacgtcaccgtccactccgagagctccgcgaagggcgccacggacggcgttgtgaccttccgggttcccaacgaggaggacaccgcaagcaccaccaaggtgcaggtcttcctgcccaccgaccacccggtcctgggcgtgctcgtcaccccgcaggacggctggagtgccaaggtgacgaccacgaagctcaagacgccggtcaagacggacgacggcaccatcaccgacgccgtctccgagatcacctggaccggcggccgcatccggcacggccagtaccaggacttcgatgtcgccttcggccagctccccgacgacgccgaccagctgaccttcaagacgctgcagacctactccgacggaaacgtcgcccgctggatcgaggagacgccgaagggcggcgaggagccggagaacccggcgccggtgctccggctcaccgccaagggcgccgcggaggacaccgggtccgccgccgacagcgacaagagcgccgccgggagcgggagttccgagaccaaggcggccgacagcgactcgaccgcccgcgggctcggcatcgccggactgatcgtcggcgtcctcggcctggccgccgcgggcttcgccatcgcccgcggccgtaccgccaccgcccgctccgtggacgag

SEQ ID NO: 2322 - DNA, 609 bp, Streptomyces avermitilis
  CDS (1)..(609)
gtgtgcatggcaggatccaccgcgatgaacgcatcccccacggtccggaccgtacgcgcggcggtgttcgccgtcgggtgcgtgctgctggccgtcgggggacacgcgctggcgaccggtgccgtgccgccggtgtggctggacgtggccgggttcctgcccgtcttcgccgccgcctttgcgctgggcggccgggagcggtcgctggccgggatcggcggcgcgatgctcaccgtgcagggcggcatgcacctggccttcgacgccgtgcggccacgggccgagcggatgcccatgccggggacggcccacggcatgcacatggcccaccagccgcacgcgatgacctcccacgccgtcgccgcacacctcgccgccgccctgctcgcgtcctggtgcctgcgccgcggcgaggccgccctgtggtcgctgctgcgcaaggccgtcgcgttcgtcccgggcctcgcggcctggtggcgtacggcaccgctgcccgcgtacgcggccgcggcacgcccgtacgcgcccggcccccgccgcccccaccggaccctgctccgccacgccctgtcccggcgcggcccgcccgccggaagcccgtaccccgcc

SEQ ID NO: 2323 - DNA, 5001 bp, Streptomyces avermitilis
  CDS (1)..(5001)
gtgacgcccgggtccgccgcgacgggtacctccgacatgtccggtgacttcgagaactccggcgaggactccggtggttccggtgacgcgctgccccgactgctgtccgcgctgcacggtgccgtccccggcctcgacggcacggcgctggcggaggcgctgtggctggcggcgcggatggcacgggaccaggacccggcggtcgacgcgcccgcacggacggcgaccggcacacccgagaccgagggccgcgcacagcggccgtcggcgcccgggccccggcagccgttccccgtcccggacgacgacggcacacgggccccggacgccacggaccccgccccggccgcctcgcccgccctccccctgcacgaacggctgccgggcagcggaacgaccctgcgcggacatccggtggccgcaccccgcgcggcggtactgccgcacgccctggagctgacccgggcgctacgaccgtggaaacggccgtggtccgaagggcgccgcgcccaactggacatggacgccaccgtcgacggctacgcccgcagcggcgaactgctcccggtgttcacggcggcgccggagcggtggttcgacctcgcgctggtcgtcgaccgctcacccggcatgcaggtgtggcgggagacgatcgccgagttcgcggcggtcctggaccggctcggcgccttccgcaccctccaggtcgcggacctcaccttcgacaccgcccagcgtccgcacactcccggtcagctccgctcgacggacggccgccgcctggtcgtggtggtctcggactgcacggcgaaggcctggcgccgcccggaggtgtggcatctgctgagggactgggcgggcgcgacccccacggcggtgctcaaccccctcccggccaagctgtggcggcgcggcggcctcaacctgcccaccgtgcggttcacccccgcggcgccgggcgcgacgcgcagccgggtcccgcacgagccaccacccctgctggacgtgtcgccggatccggacgaagacccctggctgcccatcccggtcctctcgctcaccccgcactccctgggccgctggtcccgggcgctgatgcggggcgacccggacggctgcacggcggtactcgtcccgccgaccggacgcctgccgggtcccgcccggccgcgcggggttccgctgccgccggacacactcgccaagggcttcctgcgcacggcggcgccgcgcgcggcccggctggccgtgctctgctcgccgttcgaccgcctgagcctgcgcctgctgcacgtcatccggcaggaactcgtacccgaggccacgaccgcggacgtggcggaggtggtgacgagcggggtgttcgcgctggagggggacggcacgggtccggtggaactcgtgctgccggccgaggcccagaccgtgctccaggaacagttgggcgcacacgaggtgtgggggatccaccgggcgatctcccggcacgtggcgtcccgcggggacggccgggcgctgctgtccgcggcggcctacgacccggagggagcgcgcgaactgcgcggggagcgggaggcgttcgcggaggcttcccggcggacgctggagctgctggggctggcggagacgggggagaagtgggtgtcgggggcggacggacttccccctgccccaccggtgttcgtcgagtacaacgcggtcgccgaggaaatgcgggcacagatcgcctccggccggagccgggtggtcctcgtgaccgcgcggaacgaggccccgggggccgggcggacggcgctcgccctccaggtcgcccggctggtgcgcgagcacttcccggacgggcagttccacgtggatctgcgcgggtcccgccgggtccccctgccgcccgacgccgcactgcacctgctgctccggctcctcggcacacccgcggaggggatcccgcgcgagcccgacgacatcgcggccgcgctccactcggcgctgcgcgggaaacgggtgctcctcgtggtggacgacgcgagcacccccgaactgctgcgctgtttcgcgggcgaaccgcccgaaggctgcgccgtcatcgtcaccgcgcgcggcctgccgcccggtctgccggcgcactgttccgaggtctggctggactcgctctcggcggacggcgcgctgaccctgctcgaagccaccctccgccgcacgatccgcgacgacgacctgctgcgcccgcttctctccgggaccacctggtggcccctcaccgtgcggctgctgggcagctggctcaactccgcgaacccgccggaactcgcctacctcctctacggggccggggaacagcccctgagcctggaggggtttctccggctccgtctcgaccacctgccgtgggcgtccgcgacggccctgcatcagctggccgtggcggagaccggcgagttctccttcccggaggccctggcactgatgggcccggtcccggacgcccgccggctcctcgacaccctggtcgacgagggactgctggagcgccgggggcccgacgcgtacggattccacggggccgtccacgaccacctgcacgggcgcacggcgtacgccgtggagcgcggcgaggccgccgcacggctcctggacttctaccgctccgcggccgccacgatgtacgagaacaggcgccccggcacggcgctcgcgaggcgtctggacgcgcccccgctgccggtccgcctcccggaaggctggatccccaacgcgctggcgctcctcgaccggaccggtcgctccgcgctcggggcctgggtgctgttcctcctccaggacgcgggagccacgacgccgtaccggacgctgtacgagcaggcggcgcacacgttcctggaaaggacctcggacttcgtcccgggcgcctggggcgtggccgcgctggcgcacgcccagtacgaggggggccggccggacgacgcgtggcacaccgtcgaagccctgtcctggcccgaagtcgcccgctggcagggcccgttgagtggcaccaacgccctgctcctcgggcggctgacgctggcgcgcggactgctggaccgggccgtcggggaactgcggctggcctgcctcctcttccacgaggacgcggaccggcacggcgaggcgaccgcgtccctcgtcctcgcccgggccttcctgcggcgcgacgagccggtgcaggcggtcgcgcccgccgtgcgggccgcccggttcttcgaggacctcggtctgaccgccgagaccgggaacgccctcctctgtctcgaatccgcgttctccgccaccggagcggacgaggaactcctcaccgcccagcgccgggtccgcgcccacttccgcacccgccacctgcgcgacgaggaggcccaggccctcgcccgtaccgcgcacaccctgctccgcctgggccgcccggccgaggcggaggaggcggcccgcgcggccctcgcgctgctcgaaggatcggaccacgaggcggcccgcgaggccgcccggaacgcgctgaacagctcactgcacccgggcccggccgcccggacggtcatcgcggtcgacacctccccgtacacctcggccgtgggcatcctcgacacggtgacccgcaccctccgctccgggacggccgtcaccgcggacgaacagctcgcggcctgcacatggcacgacagctgcctgatcttcgtggatcaagcggtcccgctcggccccctcctcaccgagctggcggaccggctccccgcggaactggaggccgtcggtgaactggctccgccccgactggccgtgcacgtaggccccctggagacggaccccgtcgacctgacgtccgacgtgggcgtcgagtacacccgggcgatgctccgctccgccgagttccgcaggctgtcggaccactacccggatcaccccaccctctgcatctcgcccgaggcgtacaaggcactcaccgctgacggccgcccgctgctgcggttcgccccgcacctggtcaccagcgcggcgggcacggaggtgtgcgtcgtcctcaccccgctcgggcacgcttacgcggacgactccgaactgctccgactggcacggacgttcaacgaactcgacccggacggacggcgcctggcaggcgccctgcgcgactgcttcgacgcggcgctcgacatggagaacaccggccgcttcgaccttcgtcagctcaggggacgggagcgggcgctgaccgcactcgaactggaacgctccctgtgccgcgcgttccccttcgacgccggcgagagcacggacctggtgtggcgtccgtccgggcgccgcgcccccgtcccgttcgaactgcgactctcgctcacggggccgaactggcgtttctccccgcacacccaggacgtcctctgcctggtcgtgcaggccgacgaccgggcctcccgctggtcggccgggctcatccgggtacggcccgacgcgctcacccgcacgtcggaaccggagaacgacggcacggccgtgctgaccacttccgcccgtcggtccgccgtgctgtggctgcgtcgcgacgccccgctgcccgagaacgtcctgctgcacctcgacgacgcgacccgcgcggcgatcctcgccccgaaggacgcggtcggccgtacggcggagttcttccgccgggtccagggcaggccggtccccgtcaccgcgctgcgccccctgctccgcgggcaggaccacaagaggcgcgtacgggaggccgtggtggtgctgcgtcccgaaggagtcctggtggtgcggggcaactcatggggccgcgccgtggccgaggcgctgcgcctgcgccggcccgcggaggacgaactcctgagcgtacggctcgcggcgcaccggcccggccacggcgaccggcccaccgtctccatcggcgccggcacgtgggtcgtcgcggcctccgacgatcccgtggtgccgttcgtggagggtttccccgccccgtcgtggctctcg

SEQ ID NO: 2324 - DNA, 942 bp, Streptomyces avermitilis
  CDS (1)..(942)
atgacctggcagcccttctacgtcgggaccggacaggccccggccggtgccgaggagcaggtcgtcctgccccccgccccgccctggcgggagttcccgcgccgctcccagcaccggcagttcgtgccgccgccccgcctggccgaggccgtgaacgcggcactcgccctgcgccgccccctcctggtcaccggcccggccggctccgggaagtccacggtcatcgaacaggtggccgccgagctcgcactcggtgacgtcctgcgctggcacatcacctcccgcagcagcctcgccgaggcgctctaccggtacgacgcactcggccgcatccacgcccagcgcctggagggccccggcggcagcgacgacatcgcccccttcctgcgcatgggcccgctcggcaccgccctgctgccttccgcccgcccccgggccctgctcatcgacgagatcgacaagagcgacctggacctgcccagcgacctcctcgacgtactggagcgcggcgagttcgagatccccgaactggccaggtacggcacggacgtggtccccgtccgcgaacacggcggcgagcggacgcacctcatcgcccgcggccgggtgcagtgcgccgagttcccgttcatcgtgatgaccagcaacggcgaccgcgacttccccgccgccttcctgcgccgctgcatccgcttcacgatgccgctgcccacccccgaaaccctgctgcgggtcgtcgaggcgcacatggggcccgagaaggcggcggcggacgagaccggacggctgatcaccgtgttcctggaacggctgaccgccggcgagagcctcgccgtggaccagctcctcaacgccgtacacctgctgaccggcgacggcgcgcccggtgacgaccgccgccaggccatcgcggaactgattctgcgggaactgtcccatgcg

SEQ ID NO: 2325 - DNA, 2103 bp, Streptomyces avermitilis
  CDS (1)..(2103)
gtgatcggggcccagtgccccgccctcggcctgctcccggagctcgaacaggcggccaggtccctgcacgacaccctgacggccccctgggcaggcgcctgcgagaaggaccaccccgagcggacgaccctgcgctgcggcgccgacgtcacccaggccgaggtggagcgggccgtacgtgaggcgggacggcacgcggcggcggagggcgcggtcctggtcgtggcgctgctcggccacggcacgcccggcggaaccagcctgtacttcgcggccggcgactcggagcccgagaaccccacgaagatggtcgacgtcggatcgctgctgtcgcaactgctggacacccccggcctcgacggcgtgatcgccctcgtggacacctgctacgcgggcaacgccgcccccgacctcaagtccctggccggcggcatcagggagggcgacacccggctcgccctgctcatgggagccggcgccaaggaggaggcgtacgaactccgcttcagccggaccctggtgaaggtgtgcggcgaaggcatcgagggggccggcgagaccctctccccggcggccgtcgcggacgccgtccggaccgacggcggcgcggagggccaggccatcctccgtacggaattcgacggcgcccaactcgcccaggagcggttgtggctggcccgcaacgcccgtcacagcactcccacgggtcccctgctcggacccgtgggcgccgaggaactggccagggccctggaacggctgggcggcgacccggactcgtccggggtgtcccatccggccaaagtcaccggcctgcgggacctggactcgctgaagcccgcgctgtccgccctcccgtcctccgccgaacgcgcctgggcgctcggtgtgctggacgcgctgcgcgacgccgtgcgcaccaccgccctgctgaccgcctggcccggtgccgacctcaccaccccgctgctgcgccgcaccctcgccgaggtgagccccgcgtccaccgcgaccctgcccgagtccaggggcaccggcctcctgcgcgacgccgtggaacacctgctgctgcgcagcccacgggccggtcagcgacggaccgtccccctggcggacttcgtggccgcgctcgcccgggacacgggcgtcgacccggggacccccgaactgcgccgctgggccgccgacctggacgccgagatcgacctcaacgacgccttcgtacgacaggcggaccgcacccgcgacacgcgcctgcgactcgtcgtcagcctgcactccgcggtcggcgacgactggcccgagtcgctggcggcctggctgctcgacggggacgccgtacgccaccacgaggagttcccctgcgacccggaccggaccggcgtcgagggccggctcggcaccgtcctgcgctgggcgtcgcggcacgcgcgcgtcctgggcgcgcccctgtaccgggtggagatcgccgcgcccgccccgctgctggtccagtggcgccccgaggagaccgacttcgggatgcggctcggcgccgatcacgacgtggtcctgcgctggagcgaccgtatccagccgcccgaccacctctggtggatcaacgaccgcgcccgcaaggccctggaggcgatgcgggcctgcccggacggcacccgcgccgactggctcggcgagtcggacacccggcagttccaggagacctacggccggctgatgagcgggccgcgcacccgggccgtggccctgacgcaccggccgtcccggctcaaggacatgatggaacggctgctggccgcctcgcccatcgtgctgtggcccgacgacgaagcctcggtgccggacgacgtacgcgcctacctggacacccactggcatctgctgcccgcggagttctgccgcgcctaccgcgacaagtggagcacgtgcggcgacccggcaggcgccacctccgcggccgcctccgaccgacggcggctggccgggctgcgcacggtgtgggacggccccgagtggctcgagttctgcacctggttcgagcaggagcagttcacccacgaagcagcacaggaagaaagcgccaccaccgacggggagtatccgaca

SEQ ID NO: 2326 - DNA, 1068 bp, Streptomyces avermitilis
  CDS (1)..(1068)
gtgcaggaaagagttccacagcggttgccggtgctccaccgatcgcgaaaggatctctgtcctgcatatgtgccgaatccatgtgcgccgaatcgggggagcgggaaagcgatgggtcgtcctcgactggtgttcgtccacggcatcggcggtccgcgggacgcccgggccgacctggacgagtggctgcgcgccacggcccacggcgcgcgtgccgccgggcactccgcgcggatctccggcctcctcggcggctgggcggccgacgcccgcttcgcctactacggcgacctgttccgaaggagcggcgcccagggcggcccggccgcgggggcacaggacgaggacgcgctcgtcgccctgctccaggaggccgtcgacgagcggctcaccgacccggaactgaccccggcggaggccgcggcactgcgccgggccagagcccagctcgcgcccaccggccgggcccagggggccggcgccccggcccgccacgcggtcaacgcgctgaccagcctgctggccctaccgggcctgcgcgccacgggcggctggctgaccgcccgcaccacggcgggcatgctgggccaggtcgcccgctacctcaaccgcgccgagccggacgagcggggcgccgcactcgacgaccggatccgctcccgggtcgccgagtgcctggaccgggaggggcccacggtcgtcgtcgcccactccctgggcacggtcgtcgccctcgagacgctccacgcacaccgtgcttccgtacccctgctgatcaccctgggctcacccctcggcatccgtacggccgtacagccgcgggtacggccgcagccgctcggtaccccggagtgcgtcggccggtggctcaatttctgggaccgcgacgatctcgtcgccgcccggcccgcactggagaagttcgtccggcccaacgccgcgggcgctctcccggtcagcggccgggtcgactcggacggtgcgtgggtgcacccggccgccaagtacctggcacaaccggccgtcgcgggaccgctcgtcgaggccctcaccaccgccggcggccga

SEQ ID NO: 2327 - DNA, 390 bp, Streptomyces avermitilis
  CDS (1)..(390)
atgcagtcctacacaatcggccaggccgcccggctgctgggcgtgagcccggacaccgcacgacgctgggcggacgccggccggatggcgacccatcgcgacgagggcgggcgacggctcatcgacgggcgggacctggccgccttctcggtcgagatcgccaagtccggcggtgaggaggacgcctcctacacgtccgtacgcaacgcctttccgggcatcgtcaccgccgtgaagctcggtgacgtggccgcccaggtggagatccaggcggggccgcaccggctggtctcgctgctgacccgggaggccgtggaggaactgggtctggaggtcggcgtggaggccaccgcccgggtgaagtcgacgaacgtgcacatcgaccgggcc

SEQ ID NO: 2328 - DNA, 417 bp, Streptomyces avermitilis
  CDS (1)..(417)
atgagcctgagtatccgcaaccagctccccggcaccgtcaccgccgtcacccggggcgaggcgatggcgaccgtcaaggtccgtctggacggcggccaggacatcaccgcggcgatcacggcggacgccgtcaccgacctcggcctgaccacgggtgccgccgtacgcgccctggtcaagtccaccgaggtctcgctcgccaccgacgcggtcgagggcgtgtccatccgcaaccagctgcccggcacggtcgagggggtcgccgcgggcggcgccatggcctccgtccgggtgacggtcgagggcggcgaactgaccgccgccatcaccaaggaggccgtcaccgatctgggcctggcgcccggttccgccgtcgtcgctctgatcaagtcgacggagatcgccctggaagcggtc

SEQ ID NO: 2329 - DNA, 666 bp, Streptomyces avermitilis
  CDS (1)..(666)
atgaccccacctgttcacctggctgcgcagctcgcggtcaacgtgctggacgcccagtccctcctggccgccttcggcgtgctgggtgtcggcgtggtgctgttcgccgagaccgggctgctcgtcggcttcttcctgcccggtgactctctgctgttcaccgcgggcctgctgtgcaccgggacggcggaccacggggtgaagctgtcgctcgggccgctgctggtcgccgccgccgtgggcgcgctcgccggctcgcaggtcggctacctgctgggccgcaaggcgggcggcgccctgctcgcccgcagccgctcggcccggctgcacgagggggcgaagcgggccgaagagctgctggagcggtacggacacgcgaaggcgatcgtgctggcccggttcgtgccggtcgtgcggacggtgctcaatccgatggcgggagcactggacgtgccggtccggacgttcaccctgtggcaggtcgtcggcggcctcgtctggagcgtgggcctgaccctggccggatacgcgctgggctcgtccatcccgaacgtggaccgttatctgctgcccatggtcgcggtgatcgtggccgtgtcgctgatcccgctcgccgccgaggttctccgctcccgcagggcggccagggcgaagggagcgcgtgga

SEQ ID NO: 2330 - DNA, 1341 bp, Streptomyces avermitilis
  CDS (1)..(1341)
atgacgcgtatgccgaggcggtcgggcaggccgggcgggccgggcgggccgggcgggccgggcgggtcgagcacacccggcacaccggacccgtcgagcgcgtccagtgcatgcagcgcatccaccgcgtcgaccccgtccggcacatcgagcccgtccggcacatcgagcccgtccggcgcatcgagcccgtccggcacatcgagtacatcgaccacatcgagtacgtccgcccccgacgcccccgacgcccccgacgcccccgacgcccccgacgcccccgacgcccccgacgcccccgacgcccccgacgcgcccgacgcccccgacgcgcccggcgcccccggcgcccccggcgcccccgacgcgcccgacgcgcccgacgcccccgacgcccccgacgcgctggagccgcccgagcgcgcacggacccgctcccgctggcacgcggctgccgcgctgctcgtcctcgtcggcgccgtctttctcgcccatgaccactggcccgtcatcgaggccggcgccgaccggctcgccgccgccgaccggggctggctgctggtgggcgcgacggcggcggtgtcgacgtgggtgtcgtcggcgctcgcccagcagggtgcggtggcgcagccgctgcccggcgggcggctggtggcggtgcagttcgccgcgtccgccgccaaccacgtcctgcccgcgggcatcggcgcgggcgcggtcaacctgcggttcctgacccgctgcggactgccggtggcccgctcggcgacggcgctcgcggtcaagaccgtcgccggggccgtggtgcgcggcgtcctgatcgccgtactcgccctcgcctgtcccggcgtgctgcgcgtcccgcacgtccccgcggtcgtgcacgtgcccgcggtcgcggtggcgatcgtcctcgcggtgggcgcggcgatcgcggcgctgctgtccgggccgctgcggcgggccatacgggcggtgctggcggacgtccgcgccgtgcaccggcagccggcccgggcggcggccctgtggggcggatcgctggccttcgccctgctgcacgcctcggtcgtggtggccgtcacccagtccctcgaactaccgctgtcgccggccctggtggcgctggcgtacctcgcggcgagcggcgccgccgccctgctcccgacccccggcggaatcggctccctggacgccgcgctcgccctggccctcaccctcgccggatcccccgccgccacggcggcctccgcggttctcggctaccgcctcctgacggtctggctgcccttgctccccggcctgttcgtcctcggactgctggtccgccgcaagacgctg

SEQ ID NO: 2331 - DNA, 1557 bp, Streptomyces avermitilis
  CDS (1)..(1557)
atggccaacagctcgaacgtcacgctcgtcggcggtcgccgccccgggccaccggcggtcgtcggcacctcgtggcgggggcggggggaactggcgctcgcggcgctggcggccctcttcaccctggcccaactcgccctcgtacgacccgggatggggctcggctgggacgagaccgtgtacgtcagccagatcagcgcgcaggccccgcccgcgttcttcagcgcgccgcgcgcccgtggcgtctccctgctggtcgcaccgatcacctcgtggtcgtcgtcgacgccgctgctgcgggtctatctcgcgctgctgtccggactgggcctgtacctggcgctgcgcgtctggcgcggcctgttcccggcgcgggtgctcgccctggcgggcgcgctcttcgcgagcctgtgggtgacggtgttctacggcccgcaggcgatgcccaactactgggtggcgatcggcgcgctgatctgcgtcggctgcttcctgcgcgtgcgggcggaccgctatggccgggcggaccgctacggccgggcggaccgctacgcgccggcggaccgctatgaccgggcggccctcggtggagtcggagccggcgcggcgctcatggcgtggatgcggcccaccgacgcgatctggacggccctgccgctgctcgccctcctggcgtgtgtacggggccggcggcgccccgcgctgctgacggctctggcggtcgggctggtggccggggccggcgagtgggtcgtcgaggcgtatgccagttacggcggactggggcagcggctgtccgacgcctcccacatccagggcggcctcggctggaacatcgccgtcggcgaccagctgcgcagcctcggcgggcgggccctgtgccgtccgtgcaccggggcgatgccgggcgtcgccgtgatggcgtggtggttcgtgttgccgctgctcgccgccctcggactggccgtcgcggtccgggcccggcgcacggcggccaccctggtcccgctggcctgcgcgacgacggccgccgtcccgtacctgttcctgatcgggtacgccgcgccccgctttctgctgcccgcctacgcgctgctcgcgatcccggtcgccgacgcgctcgtccacctggtcagcgtgccgcgccgcgcgtggcggccggtggccgtggcgctggtgacgctcgtcctcgccgggcatctggcggtgcagtacgcggtgctcgagaaggcggtcgaccgcaccaccgccgcccaccgcggctgggcccgcaccgccggcgaactgcaccgtctcggcgtacggccaccgtgcctgctgaccggcagcgaggccatcccgatcgccttctacacgggctgctcctccgcccagaccagcggccacaacgccaacgccacccgggcgggcatcctgcggaccgccacgcggatcccggtcgccgcgctcgccccggcgaacggctcgccaccggcctacgcccgcgactggccctcccaccggtacggcgccgtacgcatccacgtggcaccggcggcgggggagggcggacgcgga

SEQ ID NO: 2332 - DNA, 666 bp, Streptomyces avermitilis
  CDS (1)..(666)
atgaccaccattgccatcgtcggagcgggtcccggtctcggtgctgcggtcgcgcggcggttcggccgtgagggcttcgacgtcgcgctcgtctcgcgcgaccggggccgggtcgacgccctggccgcggagctggccgaggagggggtgacggcgcggggcttcgccgccgacgtgcgcgacccgaaggccttgaccgccgccctggacgcggcgaccgcgaccctcggcccgatcgaggtcctgcagtacagtccggtcccgcagcgggagttcatgcggccggtgctggagaccacgcccgccgatctcgtcggcccgatcgagttctccctctacgggcccgtcgccgccgtgcagcaggcggtgcccgggatgcgcgccctcggccgcggcaccgtcctcttcgtcaacggcggcacggcggtcgtcccccatcccgaccgggccggcacctcggtcgccttcgccgcggagagcgcgtacggccacttgctgcacgacacgctcgcgggcgacggcatccacgtcgcgcagctgatcatccccggcgcgatcattccggggcaccggcggaaggacccggccgtgctggcggacatcctgtggggcctgcaccaggaccgccacgggtaccgccacttcgccgacgacctcgacgccgcc

SEQ ID NO: 2333 - DNA, 651 bp, Streptomyces avermitilis
  CDS (1)..(651)
atgagcgttggtctgccccgaaggaagagaccggtccgatgccgttcggccacggtcacccttgccggactcgtcgtggcagcggcgatgggcaccgcatcgctcgtgtcgtgcggtacggacggcggcggcagcggcagcaacaacgcgtcgttcagcccgacccccaccgcccccgacaccgcgtcgttctccggcaccccgccgtccgccctctcctcgctcggcgcgtccgtcaaggaatccgcccgggcggcggcctcggcagcggcctcgtccgcctcggccgccgcttcggccttcgaagcctcggtctcggccgacgtggcgcgggccaacgcggccgccgagcagcggctcaagaacgccaagggccagggcaacgcgatgtccgacgtcgcgctcaccggcaagccgcgctccgagacgggtggcgtgctcgccctcgtcgtgaacatcaccaacaggacggacaagaccgcctcgtacgccgtccaggtcgacttccgcgatcccgacggaaaggtcgtcgagacccgcttcgtcggcgcggagaaactcaagccgggtgagcgggcacagcccctcgccatcagccggaagcctcccgagcctcggctgaccgccgagatcgcgagggcacaacgctac

SEQ ID NO: 2334 - DNA, 276 bp, Streptomyces avermitilis
  CDS (1)..(276)
gtgaccggttcccggctcgacctggactccgaccagatgggacgcgacctcgtcgccctcgtcctgacggtggtcgaactcctcagacagttgatggagcgccaggcgattcgccgtatcgaccagggcgatctcagcgatgagcaggtcgacgagatcgggaccacactcatgctgctcgaccagcggatgacggaactctgcgagcagcacggggtgcgtccggaggacctcaacctcgacctcggaccgctcggaaccctcctgccgaaacgc

SEQ ID NO: 2335 - DNA, 225 bp, Streptomyces avermitilis
  CDS (1)..(225)
gtgacacgcgacgtggtgccctgggacagccccgagcccctgagcggccccatcggggtgccgctcgtcgacctcttggaccgcgtcctggcgaccggcgtggtgatcagcggtgacctggtcatcgccattgccgacgtgccactcgtgcggttgtcgctgcacgccctgctgtcgtccgtcagcgaacgcgttccggcgccctgggcggacggaggcccgctg

SEQ ID NO: 2336 - DNA, 813 bp, Streptomyces avermitilis
  CDS (1)..(813)
atgacggagcgcggccctgagccttcggacgccaaggccacctacgtgttcgctgtctgccggaacccggatccggccgtcgtcgccggcctgccgggtgtcaccgacgaggcggctgtgggcacactgccgctcgggaccctgacggcgatcgtccagcccgtccgagcgggtgacttcaccgacgaagcctggcaggcacgcctgtccgaccagcgggaactggagcgatacgcgcgcgcccaccacgaagtcgtcgccgcggccgccgcctgctgccccacggttcccctgccgatggccacgctctaccacggtgaggaaagggcgcgggaggccctggcccgtgaggcggaccggttccacgcggcgctcgggcgcatcgcgcaccacgccgagtggggcgtgaaggtgtacgcgccggcctgcccgccaaacgacacggaccggactccgaaccgccgtacgactccggctgaccgctcgcgccccgcgcccggcgccggcctcgcctacctggaccgcaagcggggcctgcaagagcgccgtgagcggcgtcaggacgaggcgctacggaccgcggaagcggtggacgccgaggtccgtggcctcgccaccgcgtcccgcaggctgcgaccgcacgggccccaggccgccggggaccggcgggtccagatcctcaacgccacctacctggtggcagaacaccgcgccgacgagttcgctctcctggcgcggacgctccggaaacggaccggggcggacatcgagctgtcggggccgtgggtgccctattcattcgtcggggaggtg

SEQ ID NO: 2337 - DNA, 357 bp, Streptomyces avermitilis
  CDS (1)..(357)
gtggctgacgtcgatttccggcagggggcctacccggtctccggcccggggaccaccaaccttgccgacatcctcgaacgcgttctcgacaaggggatcgtgatcgcgggtgatatcaagatcgacctcctcgacatcgagctgctcaccatccggctccgtctgttcgtggcgtccgtggacaccgcgaagaaggccggcatcgactggtgggaaaccgatccggcgctcagttcccgcgcggcccgtagcgcgttacaggacgagaaccgtgaactgcgggagcgtctgaaggcgctcgaatcccggacggacgacgaatcggccccagcggcggccaaggaggaccgaggcaca

SEQ ID NO: 2338 - DNA, 1128 bp, Streptomyces avermitilis
  CDS (1)..(1128)
atgaccaagacggagagagaccagcccgcagaggaagcgtcaggcgcggaccggctgcgcgaagagctgtccaacttcctcggcgcacaggtggagaaactcgccgaaaaggcgggcgacaaactgagtgacgtcacggggcagctcaccgatgtggccgagggtggtggtgggttgcccgccatcggctcccgcatcctccagggcgactccccgctgaaggcattcgtcagcgagaaggccaagggcctcaaggacaacgttctgggcaaggccaaggaagccctgggcggaggaaaagggaaacgcaaggccagcggcggcaaggtcatgaacatcatcgaggttctcgatgtgggagtgcctctgcgcgccgcctacgaccactggacgcagtacgacaagttcagcagcttcgccaagggcgttcgtgacgtctcgaagaccgatgaggtcgggagtaactggaaggtcaaggtcggcccttcctcacgcagttacaaagcgacggtccaggaacagatccccgacgaccgcatcgtctggacctcagagggagccaagggcaccacccgtggtgcggtcagcttccatgagctggcccccaccctgacccggatcgtcctggtcgtggagtactacccgtccgggttcttcgagaagacgggcaacctgtggcgggcccaagggcgccgcctgcgactggacttcaagcatttccagcggtacgtctccctcactcaggaagagcccgaaggctggcgcggtgagatccgtgacggtgaagtcgtcgtgtcccacgaggacgccgtggaagaagaagaggccgctgagcaggaggaatccgagggcgaggagcccgaggaggagggcgagggcgaggccgagggcgaggccgaggacgatgccgactacgaatacgaggacgaggacgaggacgagggcgaaggcgccgcggaggaggcggacgagtacgaggacgaagacgaggagggggcggaggacgaggaaggcgcatacgaggacgaggacgaagacgcggtggaggacgaggagggtgaggaggacgaggaggacgaggacgtagccccgtcgaggaagcagagacggcagaggcgaggccgtggc

SEQ ID NO: 2339 - DNA, 1128 bp, Streptomyces avermitilis
  CDS (1)..(1128)
atggatgacacggccaaggtgacgctcgctgccgctgtcgtgggcggctatgtgctgggacggacgaagaagggccggatggctctgtccatcgcgacctatctggcgggccgacgattcggcctcgaacctcgtcagctcgccacggaagggatgcgcaggctgggcgagatgccgcagttcgcgcagttgcaggagcagttgaggggggaggttctcgacgcgggtcgtaaggcggtgaccgccgccgccgaccggggcatgagctcgctggccgatgccctcagcgaccgtacggcccggctcggcaagaagggggaggaggaagagggcgaggaggaagagggcgaggaggagtacgcgccggacgaggaaggcgcggagggcgaggaggaagaagaggaggaagaggaggagccggaagaggaagagccggaagaggaagaggaagagccggaggccgcgtacgaggaggaagaggaagaggaagaggaggaggaacagccggaaggcgaatacgaggaggaggaagaggaggaggaagaggaggaagagcccgagggcgaggaagaagaggaagaggaagaggaagaggaagaggaagaagaggagccggagccggaggagacgcggcccaggcgaccccgcagcgctcggcaatcggctcggtcccgcaaggcacggggaccagaggcacgcgagaaggccgctcccgcgggtgaagagaagcctcggacggccaagaaggccgcggcgcgaaaggctgcaccggcaaagaagacgccggcgaagaaggcggcggccaagaagacggctcccgccaagaagtccgcgcctggtaagacggccgcgaagaaggcggcggcgaagaagtccgctcccgccaagaagtccgcgcctggtaagacggccgcgaagaaggcggcggcgaagaagtccgctcccgccaagaagtccgcgcctggtaagacggccgcgaagaaggcggcggcgaagaagacggctcccgccaagaagtccgcggcgaagaagtccgcggcgaagaaaaccgctccggccaagaagtccgcggccaggaagacgacgtcgtcgaagcgagcagcgtccaagcgcgccgatcgtcggagg

SEQ ID NO: 2340 - DNA, 252 bp, Streptomyces avermitilis
  CDS (1)..(252)
atgggactgctcaccggcctgctcacgttccccgtcgcaccggtccgcggggtgatctgggtggcggagaagctcaacgaggcagccgagcgcgagctgcacgacccgggggtgctccgcgcccagctggcggtgctgaaccaggagctcgaagacggagacatcagcctggaggagttcgaacgggaagaggaacggctgctcgaccggctgcacgccgcacaggtcggctccgcgcggaacgatcgaagg

SEQ ID NO: 2341 - DNA, 747 bp, Streptomyces avermitilis
  CDS (1)..(747)
gtgacagccgaaggtgtgtacgtctacgcgatcgtccgggcgggaagaccgctgcctacgggcgccggaggcgtgggcagcccggctgccccgctgcggacgatccggcaggggcgcctcgccgccgtcgtcagtgaggctcccccgaaactgcgcgccagacggcgcgatctgctggctcaccaggaactgttgctgcgcctttcggccgagggcccggtactgcccatgcggttcgggatggtcgcaccggacgaggagacggtgcgcggccggctggcagccgacgaggcggaccacgtcgcggcactggagcggctctccgacggggtcgagatcaacgtcaaggcgctcccggcacagaacgcactggccgacctcgtcgccgaggacaagaaggtccggcggctgcgggacgaagcgcgtcgacgtcccggttacgaagccagcctccgactgggcgaagccgtgacgacagcactgcagagcagggccgccgaagccgggcggcgaattctccgcgagctcacccccctggcccgtgcggtggccccggggccggacgtccagggatgcgtgctcaacgtgtcgttcctcgtcagccgcggcgacagcgacgacttccacagggtggcggaacgattcgccgaccggcaccgcacacacgtcgagctgcgcctcgcgggcccgctgccctgttacagcttcgtctccgctgaagcccctcacgctcgtacggccggagtc

SEQ ID NO: 2342 - DNA, 468 bp, Streptomyces avermitilis
  CDS (1)..(468)
atgcccccgaccacctactccgacgaggtagtggcgtgtccgccgcgcgccggcacgttgtacgacgtgctggaactcatcctcgatcggggcatggtgatcgatgtgttcgtccgggtctccctggtcggcatcgagatcctcaagatagacgcgcgcatcgtcgtggcgagtgtggacacctacctgcgcttcgcggaagcgtgcaaccggctcgacctggagcgtgactccgggagcaccaccgttccggagctgatcgggggaggtgccgtcaagtccatgggcaagcgcaaggtccgcaaggccgcggagtccgtgggtgacaccgtgcgcaaggcggtcgggggcggccgtgacgaggacgaagagcccgacgaggacgaggaagagcagcaggaggaacggccgaggaagcggcgcgctcctgcccgcagcggcgcgagccgacgacgacccgtggaggca

SEQ ID NO: 2343 - DNA, 318 bp, Streptomyces avermitilis
  CDS (1)..(318)
atggcagaagagcgtcggccgcgcgccgggaaatcctcgacgaatgccgctcgccgcacgccgtccgtgcgtggagcggaaggcgccgcccgtgctgccagccggagcctggaggggctgatcggccatcccacggagggcgtctcggcggtgaggcgtgccgacgacggctggtgcgtcgtcgtggacgtccttgagctggcccggattccggacacaacgagccttctcgcctcgtacgaggtgcagctcgatcaggacggcgaactcatggagtaccgcagggtccgccgctatcggcgggggtccgccgacgag

SEQ ID NO: 2344 - DNA, 222 bp, Streptomyces avermitilis
  CDS (1)..(222)
atgctctgcgtcgccttgcggatgcgtcgggcgcatactgaaaaaaagcctacgagatcggagggcgccatgatcgtcctgggcgtcattcttctggtcatcggcctgctgacgggcatatcgatcctgtggaccatcggtgtcgtgctcgtcgtgatcggcctcattctctggattctgggcgccgtcgggcatgcggtgggcggcaggcgtcactactgg

SEQ ID NO: 2345 - DNA, 819 bp, Streptomyces avermitilis
  CDS (1)..(819)
gtggcagagaagcgagttgtgatcgtgaccggtggaggtacgggcattggggaagccaccgcccggctgctgcgtgagggtgggcaccacgtggtcatctccgggcggcgggccgaaccgctgcggcggctcgaacgggagaccggggcactggcctgtccgtccgacgtgggtgatcccgatgctgccgacggtctcgtccgcacggccctggccgcctatgggcgactcgacgggctcgtgctcaacgcgggcatcgggcgcggcggagctgtcggggacgtgtcgttggaggactggcacgacgtgatgcgcaccaacgtcaccggtccgctgctgctcctgcgcgcggcgatcccacacttgctggacacgaaaggggcggtggtcgcggttgcctcggtgtccgcgctgcgcaacggcgcgagcaacgtcccgtacgccacgtccaaggcagccctgctgcaactctgccgttccgtcgccgtcgactacgggcggcagggagtgcgtgccaacatcgtgtgtcccagctgggtgcgcagcgagatggccgaccggcgcatggcgcgcttcgccgaggaagcggacctgaaggacggcagtgtggagtccgcctacgaggaggcgaccaggttcctgcccctgggccggccgggcgaaccgcgtgaaatcgcggaggcgatcagctggctgctctccccggcggcctcgtacgtcaatggctcagtgctcacccttgacggtggggcgacggcccttgatccggggaccctcgcgttcgacttccatgtcgcaccacgcggcgacgcggaactc

SEQ ID NO: 2346 - DNA, 534 bp, Streptomyces avermitilis
  CDS (1)..(534)
atgtcgtcggcagacggggggcaaaggatgagcacggacgaccgcgtcgcggtgacacccgggatcgcacgaccgcacgcgtcgcccggacttgccgggcccgaccggctcggactggtgaccgaccgcaccggcgccctccccgacctgcgcccggccgcgcccaggctggtcggcgacagcgacagcgacgtgtacgacgtctgcgtcggggtgtcccactcgggaaccacgcccgagaccgtcagggccctcggcccggcccaccgcccccgccgcgcgataaccgctgccctcaccgacgccgcgccctgccccgtcgccgacgccgacgccgcggacgccgccctcggcacggtggtacgcgaaacgggactgcgccagggcgcgatttccgtccgcatcgcccaactcgccatcgtggaccgcgtcctgatcgccgtgacgcggcgcaccccgcaccaggccgaggcagcgccgcgggccacgttcgacaccgtccatgacctgcgtttggaaggacaaccccgtcga

SEQ ID NO: 2347 - DNA, 978 bp, Streptomyces avermitilis
  CDS (1)..(978)
atgaccgatcgcacgacgacatcccgggccgggattcgcggctttcgcgcgggcgacggcccgcagttggtggaggtatggcgccggagtgcgcctgccgactccatcaccccggaccgcttccgctccctggtgctgctcgacgccaatttcgatccggaggggcttcgggtcgccgtcgacggcgaccgtgtcgtcggcgcggcctacgcggtgcgccgtctgacgccgatgaccggcaccgacctggagccggagcagggctggatcccgttcttcttcgtcgacccggccgcccgcgggcacggcctcggccgccggctgctgaccgacgccctcgactggctgcaccgccacggccgcacccgggtggacttctcctcatacaccccgaactacgtcctccccggcctggacgccgaggcgtacccggaagccgccgggctccttgagtccctgggctttcgcactctgtacgaggcggcggccatgcaccgcggcctggtcggctatcgcgtcccggaggacgtcgcgcgccgctcggacgaactgacagcgcggggctaccggttcgccaccccgtgcgacgacgacctggtggacctgatcgcgctcgccgggaaccacttcggcccggactgggcgtgcacgatccggcagtgtctggccgcgggcacaccgctcgaccggatcgtcgtcgcccgggacccaacgggtcgcctggtcggctgggcgatgcacggcacgttcgatgccgtggacgagcggttcgggccgttcggcgtgctggaggagatgcgcggcaccggactcggcaaggtcctgctccacctggtcctggagcggatgcgggcgcgccgcgcgcactccgcgtggttcctgtggaccggcgaacagtccccggcgggccacctgtaccgcaggagcggtttcaccacgacccgggtgttccgcgtgctgcgccgggaggccgccgga

SEQ ID NO: 2348 - DNA, 1347 bp, Streptomyces avermitilis
  CDS (1)..(1347)
atgacgccgtcacaccgcaccggcggcctgagccgccgtcacttcgcgctggcgctcccctcggcgctgctcgcctccggagcttttggatgcgccgcgccgcaccagggcaccgggcggcccggggacccgatcgtcctcaccctgctctcccactacgcgagcggggagctcaagaaggccctgcggggcccggtcgacgagtggaacgccacgcacgaccgggtcaaggtgcggacgaaggccgtcgagttcacggacctgctgaccacgttcatggtccggcaggccgcgggccagggcgccgacatcatccacccgtactgcctgtggaacggccagctcgtccgggccggcgtcctgcggcccgctccgtccgagcacgccgaggagatcacgcgcggctacggcacggccgcggtcggcgcctcgtcggtgggaggcgaggtgtacggctaccccaccgaggtgcagacgtacgccctctactacaacaagcggctgctgcgcgaggccggcatctccggccctccgcgcacctggcgggagctggaggagacggcctaccgcaccgccgcgcgggaccggtacggcaacacactggtccaggggttcgggctttcgacctacgacgactccaccaccgtcggccagaccctcgcactgctcaacgccgccggcggaaggttcgtctccgcggacggcaggagcaccgccatcgactcaccggccggccgggccgtgctcgatctggagcaccgcctcgtcgtcaaaggcgcgagcgcccccggcgtcaacgtctacaaggcgttccagtccgggcaggtggccatggtggtcagcgccggctggtggaccgcgagcctgaaggcccagatgggcaaggactaccgcgatgtcggcgtcgcgcccgtgcccgtccccgaggcggacgacaagcgcgccacgctctccaccggcttcatgctgggagtcaacacggccagtgaccacccgcgcgaggcctgggagttcctgcgctggctgaacaccgagaaggtgagcgcgaagagcgccgagaagggcgcgacagcgacccggatgagctccctacaggtgtcggtcggctccctgaccggccgcgccgacgacatgcggacgctcctgagcgaaggcggcgatccgaacctgcgcccgttcctggacgcgctggcgtacgcggtgccggagccgaacgtgccgggcgcgcagcaggccaagtcgctgctgcgcaagaacatcgaggcgttgtggaccggtcagcagtcggtcgacgaggcgctgcgcaccatccgccgtcaggtcgatcaggaggtgtcgcgctcatgg

SEQ ID NO: 2349 - DNA, 960 bp, Streptomyces avermitilis
  CDS (1)..(960)
gtgaacacgttgaccccggagacgactgagcgggcgcacggcccgcggtccgccgggcccgccgtcaacggccgcgcccagacccggcgccggcgccaccaggccgtcgtcgcctatctcttcctggccccggcgttgctgttcttcgcggtcttcctgatcctgccgctcggcttcgcgctgctgctgtcgacgtcccgctgggccgggttcgacctcggcgacatcgatccggtcggcctggacaacttcaccggcctcttcgcggacggatcgacgttcctgacgccgatcctcaccaatacgctgctgttcgccctgggcaccgtggccctcgcgctcgccggctccgtgctcgtggccacctgcatcgacaacctgcggttccagggactgtggcgcaccctgtacttcctgccgatcgtcacgaccgtcgtcgccgtcggcaacgtatggaagtacatgtacgagccgggcggcctcgtcaacggcgtcctcaacgccctcggtctcggctcggtggcgttcctccaggacccggacaccgcgctgccctcggtcgtggtcgtacaggcctgggcgtcggtcggctcggcgatcctcatcctgaccgccgggctgaagtccatccccgagtcgtactacgaggccgccgcgctcgacggcgccgggcccggcaccgtcttctggaagatcacactgccgctgctgcggccgtccctgctgttcgtgtgcatcacccagttcctcaccggcctgcagtcgttcgcgctgatcatcgtgatgaccaagggcgggccgggtgacgcgaccaatgtggccgcgctggagatgtaccggcaggccttctcgtacggcgactggggcacggcgagcgccgccgccttcgtgctgttcgtggtggtcctcgtggtcaccctggtgcagttgtggatcttccggcgcaagggggaggacgca

SEQ ID NO: 2350 - DNA, 825 bp, Streptomyces avermitilis
  CDS (1)..(825)
gtgaccggcgccgtgctcacggtggtgccgttcctcgacatggtgatgacgtccttcaaggggcccggcgagtccggcacgctgccgtaccggttcctgcccgaggcgttcgacctgtccaactaccgggcggcggtcgcccagctcgatctgccggtgctcttccgcaacagcgtcatcgccaccgccctgatcaccggatcggtgctgctcacgtcgtcactcgccggctacgcgctcgccaaactccgcttccccggccggaacttcatcttccgcctggtgctgtcgacgatgatgttccccccgttcctcttcttcatcccgcacttcctgatcctggtgcactggccgctggcgggcggcaacgacctgttcgggcgcggcggcgcgggcctgaccgtcagcatcgcggcgctcgtcgtgccgttcctcgtcaacggcttcgggatcttcctgacacgccagttcatggtgtcgatcccggacgaggtcctcgaggccgcgcgcatcgacggggccggcgagttcgccgtgtggtggcggatcgtggtgccgcagaccaagccggtcctggtgacgctcgggctgctgaccttcgtcgacgcctggaacgagtacatctgggcgctgctcgtgtcgaccgccaacccggacgtgatgaccctgcccgtcggcatccagctcctccaggactacgtcgacccgacccgcacgatgcccatcgtcatggcgggcctcgccctgagcatcctgccggtcctgatcctcttcctgctgctgcagaagcactacatccgcggcgtcatgctcagcggcctcaaa

SEQ ID NO: 2351 - DNA, 1914 bp, Streptomyces avermitilis
  CDS (1)..(1914)
atgacgtctcccacgggaggtggcgccgcgttcaacggaggcggcagggccaccgcgccaggtctgcccttcgccggagtgccgccggagatgcaggcgagcgtcgacacgttgctgaagaccgagccggaacatcccgagcccgaggtcgtgttcgagcacggccggcccgatcccgacggcgccgagctgagtctgcggcggctgatccgcccgtactggccgatcgcgctgctgggcggcgtgttcgtggccctggaggcgctgacgctccaggccggtccgaagctgacccagatcggcatcgacgacggcatcacggcgaaggactccggcacgctggtgctggtcgcgatcgcgtacctggtcagtctggtggtcaccggtgccgcgcaggccgcgcgggtcaaggtgaccgggcggatcgccgcgtgggtgatgaacgacctgcgggtacgggtcttcacccagttgcagcggctctcgctgaacttctacaccggcgagaagtccggcgtgatcatgacccggatgaccagcgacatcgagaacctccaggcgttgctgcaggacggtctggcacagctcgccgtccagggcctgaccatggtcgttgtcacggtggtgctgttcaccttcgacgtgcggctggcgctgatcaccgtcgtactggtcgtgcccgtcctgaccgcgctgtccgtgtggttccaccgggcgtccggcaagggctacgtgcgggtgcgggacaccatcgccgccgtcatcgccgatctctccgagagcctgcagggagtgcgcatcgtaacggcgcacaaccggcagcagcacaacatcgagcaacaccgacaggtcacgggcacgtactacgacgccaatgtccgcaccggacggatcaactcgatctacacgccgagcacccaggtcatcggtgtcgttgggcagctcgctctgctggccatcggcgccggcatggtcgccgacggggagctgaccatcggcgagctggtgacgttcctgctctccctgggcgccttcttccagcccatccagcaactggtgcagctctacaacacgtaccagcaggggcagtcgtcgatcgtgaagctcagggagctcctgagcacgcgggcggaggtcgaggaggctcccggagccgtcgacctgccgaaggtcgagggcgagatcgtcttcgaagacgtcacgttcggctatgttcccgaccggccggtgatctccgaggtgtcgctggacatccgggccggtgagaccgtggcgttcgtcggccccaccggtgccggcaagtccaccctcgcgaaactggtcacccggttctacgacccgacgtccggccggatcctcatcgacgggcgcgacctccgggacgtgcggatagagtccctccggcggcagatcggcgtcgttccgcaggaacccttcctgttcgccgggccgctccgggacaacatccgtttcgccgtcccggacgcctccgacggccgggtgcgggaggcgctgcgggtggtcggcctggtcgacgtggtcgagcggctgcccgacggcctcgacaccgtcgtccaggagcggggccagtcgctgtcctccggcgaacggcaactcgtcgccctggcacgggccttcctggcccagccccgggtgctggtcctggacgaggccacgtccaacctggacctccagtccgagaccaagatcgagcaggccctggacgtgctgctggagggccgaaccgcgatcctgatcgcacaccggctctccaccgcgatgaaggccgaccgcatcgtcgtcgtcgacgagggccgcatcgtcgaggtcggtgcgcacgaccagctcctcgccgccgacggcaagtacacccagatgtacgccgtctggaccaatcaggccgccgaggcccac

SEQ ID NO: 2352 - DNA, 1791 bp, Streptomyces avermitilis
  CDS (1)..(1791)
gtgaacaagacgtatccgccgcccagcgcggcgatcgaccccgacccgagcaggtcctggttatggcgagcgtggccgctggtccgggcacaccggtggatgttcagcgcggccctggtgatgtccggggccagcatgctggtggtcgtacaggtgccgaggctgatccaggacgcggtggacaactcgatcgtgtcggacagggtgccgctgtcgcactacatgtggtggctggtcgggatgtcggtgatcatgctggtcgtcggctacctgtccaagcaactgctcttccgcgccgcggccaggatcgagtacgacctgcgcaacatcgtgtacgagcacctgaccgccatgtcgttcccgttctacgaccggatgcagagcgggcagctcatctcccgtgccaactccgacatccgcgcggtgcagatgtatctggcgttcgcgccgtacctgctggtgcagtccggtatctcgctggtgtcgttcgcgtacatgctggcgatcgacgtgccgctggccatcctggccatgctgccgatgccgctgatgttcgtggcgagccggcgcatgcaacggtccctgttcccggtgtcctggctgatccaggcccggctggccgatgtcgcgaccgtggtggacgagaacgtcaacggcgtgcgcgtggtcaagtcgttcgcggccgagcggagccagctcgcctcgctgcagaaggccgcgacgagcgtcgcctgggcgaacgtgaaggacgccgatctgcgcgcgcggtggacgcccctggtgcagaacctgccccgcgtcggcatggcgatcgtgctgctgtacggcggatacctggtcattcacggcgagctgggcgtcggcgcgatcctggccttcaacgcctatctcctgatgctccaggttccgttccaggtgatcggcaacctgatcatgctggggcagcggtcgtcggccgcggccaagcggctgtacgaggtgctggacgagaagccggagatcgcggacgcccccgacgcgcgggagatcaccgggccgcgcggtgacgtccggttcgacgatgtcaccttcggctacggcgacggcctcgacgtgctgaaggggttctcgctgcagctccgccccggcgagaccgtggcgctggtcggccggaccggcaccggaaagtccaccgcggccagactgctgccgcgtttctacgacgtgcgcgccggctccgtcagcgtggacgggcacgatgtgcgggacctgaccctgcgcagcctgcgggacaccgtcggcgtcgtactggacgagccgttcctgttctcggcgtcggtccgcgacaacatcgcctacgggcggccggacgcggacttcaccgacatcgagcgggtggcccggctggccggggcccacgagttcatcaccgaactgtccgagggctacgacaccgtcatcggcgaacgcggctacacgctgtccggcgggcagcggcagcgcatcgcgatcgcccggacgctgctgctgaatccgccggtgctggtgctcgacgacgccaccagcgccatcgacgtccaggtggagcaggagatccacgccgggctgcggtccctgttcgccggccggacgacgctgatcgtcgcgcaccggctgtccacgatcagcctggccgaccgcgtggtgctgctggacggcggccggatcgtcgcggacggcacgcacaaggagctgctcgcgagcacgccgctgtacgcggaagtgctggcgcaggcggacgagaccatcgaggaactggggagtgtgggccga

SEQ ID NO: 2353 - DNA, 663 bp, Streptomyces avermitilis
  CDS (1)..(663)
gtgctggccggtgccgacaaggtgttcctgtacgccaaaccggagcagatcgaggcattcgtggcggcggcgcagtccgccggcgtccggcaggtggtcctgctgtcgtcggtgtcggtcgtgatggccacctccgaacagaacccgatagcccggatgcaccggacggtcgagctggccatcgagcggtcggggctggactggacgttcatcaggccgggcatgttcgccaccaacgcccgttggtggtggggggaatcgatccgcggggagggcgtcgtgcgccttccgtacccggaagcgcagaacgcacccgtccatgagaaggacatggccgcgctcgccgtgaccgctctgaccgagcccggccactcccaccaggcctacaccgtccacggatccgagtcgctgacgctgcggcgccaggtggagcacatcggtgaggccctcgggcgcccgatccgggtggagacggtctctgtcgagcaggcgcgggaggaattcgccgagaaggcgccgtcgaacgtggccgaggcgctactgcgcatgtgggccgccgccgacggcgttccggccccggtctcggtcatcgtcgacaggatcaccggcaggcccgcgcacacgttcgcgcagtgggccgccgaccacgccgacgacttccgc

SEQ ID NO: 2354 - DNA, 1317 bp, Streptomyces avermitilis
  CDS (1)..(1317)
gtgtgcgtctggacaccgcgtcgatgttccaccggtcgacaccggacgacctggtccagcacctcaagcaggcactgctcgacaaccgatccggcagaggagccgatgatgcccccatcgatgacacagtctgagcgcgtcgtgaaaccgacaggacgtggctatcttctgctcgacgcgcatccggtcggatgcttccgcagcgtggagctgatgcgggccgaggtgccggtcccggagaagccaccggcgcggcggcccacggcgctggtcatcgggtcgagctcgggctacggtctggcgagcacgatcgccgggctggtgcggtacggcatcgacggcgtggggatcggcctcgaacggccggccgggcatcgcagcgcgaccgccgggtggtatcgcacggtcgccaccgacgcgatcgcccgcgagctcggggcggacttctcgttccgcaacgccgacgcctttgccgacaccacgaagaccgagacgctggatctgctggccgagcggttcggcggcgtggactacctgatctacagcgtcgccgcgccccggcgcaccgacccgcggagcggcacgacctaccagtcggtgctcaagccgctcggcgcgccgcacaccacccggaacctggagttcgccgacgacggagccgcgcaggtgcgggaggtcacggtcgccccggcgaccgaggccgaggccgccgcgaccgtgggggtcatgggcggcgaggactggtcccgctggatcacggcgctggccgagcgcgggctgctgcggagcggcttccgcacggtcgccctcacgtacatcggctcgccgctgacctcggcgatctaccgcgggggcacgatcggcgccgccaaggcccacctggagtccaccgcgcgcgccctgaccgagcggctggccgcggtggacggccgcgccttcacctcggtgaacggcgccctggtcacccaggcgctgaccgccatcccgggcatcccgctctacgtgagtctgctccgtggcgttctcggcgaccgtttcccgtcccccgtggcgcagtcgctcgacctgtggcaccagctcaccgcgcgccggcccgacgtggacgactccggccgcatccgcctcgatcgctgggagctgtccgagccggtccaggcggcggtggccgaacgctggcggtcgatcactcccgagaccgtcaccgcgctggccgacaccgcgtggttccgggcccagtgccgtgccctgtacggcttcgacgtccccggcgtcgactacaccgtcccggtcgcgaccgacctgccctggccggagtcg

SEQ ID NO: 2355 - DNA, 13494 bp, Streptomyces avermitilis
  CDS (1)..(13494)
gtgaaaacgagtggtcaggacgtcgtcgcggtggtcggtctgtcgtgccgccttccgggcgcgagctcgcccgaggcgtactgggagctgctcgcggccggccgggaggccgtcggtggggttcccgcggaccgcgccgtccacgtcggcacccgggtggccagggccggtctgctcgacggcgtcgcggatttcgacgcgggcttcttcggggtgtcgccccgcgaggccgcggcgatggacccacggcagcggctgatgctggaactcgcgtgggaagcgctcgaacacgcgggagtcgacccgtcggcggcgcggggcagccgggccggagtcttcctcggggcgatgggggacgactacgccggtctggtgcgcgaccagggcgcgggagcgatcgacagcttcaccctgtcctcgctccagcgtggtgtcctcgcgaatcggatctccttcttcctgggactgtccggcccgagcgtggtcgtggactcggcacagtcctccgccctggttgccgtgcaccaggcgtacgagagcgtgcgacgcggggagtcggcgtgggcgctcgcgggcggggtcaacctgatcctctcgccggagtcgacggcgaccgcgagcgagttcggcgcgttgtcgccggacggccgctgctacacgttcgacgggcgcgccaacggctacgtgcgcggcgagggcgccggcctggtcgtgctcatgcccctggcggacgcccacgcgtacggccacgacgtcgtgtgcgtgatccgcggcggagcggtgaacaacgacggcggcggcgagcagctcaccacgccgagccgggcggggcaggaggacgtcctgcgggcggccctcaccgacgccgggacgcggtccgccgaggtcggatacgtggagctgcacggcaccggaacccccgtgggggaccgcgtggagtcggcggcgctggccgcggtcttcgccgaccgggaccggccgctggtggtggggtcggcgaagaccaacgtggggcacgcggagggagcggcgggggtcgtcggcctcatcaaggcggccctggccgtccagcacggccaggtcccggcgagtctgaacttcgccgccccggcggacgacatcccgctcgccgagctgggcatcgaggtcgccgccgagctgcgcgcatggcccggcgacgagccgcgggtggccggcgtgtcctcgttcgggatgggcggcacgaactgccatcttgtgctcgcgcaggccctggatccgtcccctgccgaggagaaccacggcgtgcgggcgggcaccgttccctggctcgtgtccggcggcaccgagcgggccctgcgggtccaggccgaacggctggccggacacctcgccgcacaggacggcccggacgcgctcgacatcgggttctcgctggcgaccacccgtgccgcgctgccgcaccgcgccgtcgtcatcggcgaggacccggccgagctgagcgagggactggccgcgctggcggccaaccagccggcgccgaacgtcgtgtccggtgcggtcgccgagggcgggacggccttcatgttcaccgggcagggcgcgcaacgaaccggcatgggacgggatctgtacgcgcgtttccccgtgttcgccaagtccttcgacgcggtgtgcgcggaactggatccgtcgctgggcggagagctgcgggagatcgtgtggtccgacgcggacctgctcggccggacccggtacacgcaggcggcgctgttcgcgctggagacggcgctgttcaggctgatggagtcgttcggagcgcgtccgacgcatctgataggtcattcgatcggtgaggtcacggccgcgcacgtcgcgggggtgctgtcgctgtccgacgcctgcacgctcgtcgaggcgcgcggacggctgatgcaggccgcccggtccggtggggcgatggtggccgtcaacgccgacgagggcgacgtgcgggcgctgctgcccgtgtcaggggtgagcatcgccgccgtcaacgggccccgctcggtggtgatctccggagacgccgacccggtgctcgcgaccgcggagtccttccgcgccgcaggagtgaagaccaagcggctgaacgtcagccacgcgttccactcccaccatctcgacggagttctcgacgagttcgccgacgccatccgcgggctgacctttcacgctccccggatccccgtcgtctcgaacctcaccggacgccccgccaccacggacgagctgaccgaccccgactattgggcacgtcagatccggggcaccgtccgcttcgccgacggcatccgcgccctgcacgacgcgggcgtctcccgctacctcgagctcggccccgaccccgtactcgccggcatggcccgggagaccctcgccgagcaggcgccggcggcggtggccacgctgcgcaccgggcaggcggaggtccgcaccctgctcagggcgctcggcaccctgcatgccacgggggcgccggtggactggacgccgctgttggacggcggccgcagggtcgtgctgcccacgtacgccttccagcgccgccgacactggatcggcgaggcgcgcgaggccgcgcccgccgcggagccggcgcgggtccacgaccgcgggagcctgctcgatctggtgcgcacccacctcgcggccgtcctggggtacgacgcggccgacatgacgccgctgacgtcgttcaaggacctcggcctgacgtcgctcaccgcggtcgagctgtgcgctgggctgtcctcggagctgggtctggctctgccgggatcgctggtgttcgaccaccccacccccgatcggttcgcggcgttcctgcacgcgaagctcaccggacacggcgacgcggagggcgcgccgagcgtcccggcatttcgtgacggcgacgccgacgatccgatcgccatcgtcgggatgggctgccggtttcccggtggcgtgtcgtcgccggacgctctgtgggagctggtgcggtcgggtcgggacgccgtgtccgggctgccgcgcgatcgtggctgggatctggacaacctgttcgacccggacccggagacctccgggcggacgtacgtccggcagggcggattcctcgacgacatcgccggtttcgacgccgggttcttcggggtgtcgccgcgcgaggcgctggcgatggatccgcagcagcggctgctcctggagaccgcctgggagacgctggaggacgccgggatcgagcccggatcgctgcgcggcagcgacacgggcgtgttcatcggcgccatggcgggcgactacggcccgcggctcgacaccccgcacggcggggtcgacggatatgtgctcaccggtaccagtgggagcgtcacgtcgggccggttggcgtatttcctggatctggaggggccggctgtgacggtggacacggcgtgttcgtcgtcgttggtcgcgttgcatcaggctgcccgggcggtgcggagcggggagtgctccctggcggtggctggtggtgtgagcgtgatgtcctcgcccggggtgttggtggagttctcccggcagcgtgggctgtccgctgatgggcggtgcaaggcgttcgcggagtcggcggatgggaccggttggggtgagggtgcgggtcttgtggtgctggagcggttgtcggtggcgcgtgcccgtgggcatcgggtgttggcggtgctgcggggttcggcggtgaaccaggacggtgcgtcgaacgggttgacggctccgaacggtccgtcgcagcagcgtgtgattcgtctggcgctggcggatgcggggctgggcgcgggtgatgtggatgtggtggaggcgcatggtacggggacgaggctcggtgatccgatcgaggcgcaggcgttgctggccacgtatgggaaggggcgttcggaggaccggccgttgtggctgggttcgctgaagtcgaacgtcggtcacacgatggcggcggccggggtgggtggtgtgatcaagatggtggaggcgctgcgtcgtggggtgctgcccgccacgttgcatgtggatgagccgacgtctcatgtggactggagtgccgggggagttcggctgctgaccgagtcgcgtgagtggcgttcggagggccggccgcgtcgtgcgggggtgtcgtcgttcgggatcagcggcaccaacgcgcatgtgattttggagcaggcgccgccggccgaacagtcactgccgccggagtccgtcccgccgtcggagtccgtcctgccgcaggagtccgtcccgccggcggggtccgtcctgccggcggggccggtgtctttcacggagcaggcggggccggtcgggtgggtgttgtcggcgcggagtgaggaggcgctgcgggcccacgcggggcggatcgccgaggccgccgctgataccggggtgccgttggaggacgtggcggcgacgctggcggcccgtaccgcgttcgagtggcgtggcgtggtgctgggtgccacgcgtgaggagttgctggtggggctgggttccctcgcggagggtgctccttgcgatggcgtggtgacgggggtcgccggggccggcgggacggtgttggtgtttccggggcagggttcgcagtggggtgcgatggcgcgggagttgtatgcgggtgctccggtgttcagggcccgtctcgaggagtgcgcgaaggcgttgtccgccttcgtggagtgggatctgctggatgtgctgctgagcgatgacggtggtgtgctgctgtcgcgggtggatgtggtgcagccggcgttgttcgcggtgatggtgtcgctggcggcgttgtgggaggcgcacggggtgcgcccggatgcggtcgtggggcattcgcagggggagatcgctgccgcgtatgtggcgggggttctgtcgctggaggacgcggcgcgtgtggtgacgttgcgcagtcaggcgatccgggccttggccgggcggggcgggatggtgtcggtcgggctgtcggtggacgaggtgcggccgcgtctggggcggtggggcggcgatgtcgagatcgccgcgatcaacggtccgacgtccacggtcgtctccggcagcgcgggggctctcgacgagctgcaggccgtgttcgaggccgagaacgtgcgtacctggcgtatccccgtcgactacgcctcgcactcctgccacgtcgaccgactgcgcgagaacgtcatggatctgctggcgccgatcaccccgcgagccggtgacctccgcttctactcgaccgtcaccgggcggcggatcgacaccaccgagctcgacgcggactactggttccgcaatctccgcgaaaccgtcgagttcgaggccgtcacccggttgttgctggcggacggcttcgacaccttcatcgaatgcagtccgcacccggttctggtcgccggtgtgcaggagaccatcgacagcacgcacactccggcccgcgccatcgggactctgcgtcgccatcacggtggcctggacagcttcctgcgctccaccggcgaggcgttcaccgccggcgccaccacccagcacacgcccgcacgtccgcacgacggccgtcatgccgacctgccgacctaccccttccagcggacgcggtactggctcgagcccgacacgagccgacgtgacatcgccgccagcgggctgaccgcggccggccatcccctgctcggcgcggtcaccgagggggcgaccagcctggtcctcaccggtcggatctccctggccacgcatccctggctggccgaccaccaggtggccggcaccctcgtggtgcccggcgccgccttcgccgagctggcggtgtacgccgccgaccgggtcggcgccggcagcatccgtgagctgaccgtgcggtccccgctcgtcctgcccgagcacggcgccgtacggctacgggtggaggtgagcgagccggccgccggtgagagcgggcgtacggtgcggatcgacgcccggccggacatgggcacggccacgtcctggacgtgtcacgcgacgggtgtcctggacgccgagacgccgtccccggactgggacctcacggcctggccccccgccggggcacggcccgtggacgtctcctacgagaccctggccgcccaggggtaccactacggtgcggtgttccaggggctgcaccggatgtggcgccacaacgaccacgtctacgccgagatctccctccccaccgagcccgacgccttcaccatccaccccgccctcctcgacgccaccctccacgccgcactcatgagtcaggtcctgccgagcgacggccggatacgactgccgtacgcatgggaaggcgccacgctgtacgcctccggcgcctccgcgctgcgcgtgtcagtgacgactgcgggggacaacgcgatacggctgcgcgcggcggacggcgccggcatgcccgtggcagaggtggcgtcgctggccatgcttccggccgacctcgccgacctcggctccgcggccgtcagccgggactccctgctgcacctggagtggacacccgcgccgtcggcggacgcggcaccgcccacccggctctcgctgctcggccacgacccgttcggcctgcgcgcggcgacggcggacggcgtcgactggcgacggttcaccgaactgtccgcgatacccggcgactcgtccgacgtggtcgtatgcatcgaaggggatgagacggcagacgtccccggagccgcccgcacggcgctgtaccgtgcgctcgacctggtccaggcctgggtgtccgacgaacgcttcggggaggcgcggctggtcgtggtgacccggcgcgcggtgatgaccggatccggcgagcccgtaccggacctgtccaccgcgcccctctgggggctgctccgctccgcgcagagcgagcatcccggccggctgatcctggccgacgtggacgaggacgctcgctcgtcggccgcgctgccgtccgcgctagccggcggcgccacccagttcgcgctgcgtgacggacgggtcgtggtgccgagactggccagggcgagctcccaggacggcccacggggacccgcgggcatgccggggcggccggagcccgagggccggcgcgggccggaggcgccgtcacggtgggacaccgacggcaccgtgctgctcaccggaggtaccggaacactcggcaggctgttcgcccagcacctggtcacgcagcacggggtgcggcacctgctgctggtctcccggcgcggaccggacgcctcgggagccgcggacctggtcgccgagctgtccgggctgggcgccgaggtgacgatcgccgcgtgcgacgtggccgaccggggcgcgctctcggcactgctcgcggcagtcccggcgaaccacccgctcaccggcgtggtgcacgccgccgggaccctggacgacgggctgatcgccgggatgacaccggagaagatcgacgccgtcctcacgccgaagctggacgcggcgtggaacctgcacgacctgaccaaggacctcgggctgtccgcgttcgtgctgttctcctcgatcatgggcacgatcggcaacgcgggccaggcgaactacgccgccgcgaacgtgttcctcgacgcgctcgcccagtaccgccacgccaccggacttccggcgacctcgctcgcgtgggggttctggagcgagcgcagcgaactgacccgcggcctgaacgacgcggacatcgcccgcatggcgcgcactgggctgaagccgcttccgtcggacgagggcgtcgcgctgttcgacgcggcgttcgcccgaggtgaggccaccgctgcaccggtcgcgctcgacctggaccggctgcgtgcgcaggccgcgggggcgaccctgccggaggttctgcgcgggctggtccgggcgcggcgcgcggcgaccgccgtcacggcgaccgcgtcgacgctcgccgaccggctggccggccacacggccgaggacgtcgaccgcgagctgctcgatctggtgcgctcccacaccgccaccgtgctcggccacgccggcgccgactccgtacagccggccgtcgcgttcagggagctcggcctcgactcgctgtccgcggtggaactccgcaagcggctcaacgaggtcaccggactgcggctgtcggccaccgtggcgttcgaccggccgaccccgtccgcgctggccgcgttcctgcgcgaggagctgctcggcgggagcacccaggccgtcgctccggccgctgcggccgccacggcggaggacgatgatccggtcgccgtcgtcgggatgggctgccggtttcccggtggcgtgtcgtcgccggacgctctgtgggagctggtgcggtcgggtcgggacgccgtgtccgggctgccgcgcgatcgtggctgggatctggagaacctgttcgacccggaccccggacggaccggcaagagctacgtggacaagggctacttcctcgacgacgcgggggagttcgacgccgggttcttcggggtgtcgccgcgcgaggcgctggcgatgcacccgcagcagcgactgcttctggagaccatgtggcagacgctggaggacgccgggatcgagcccggatcgctgcgcggcagcgacacgggcgtgttcatcggcgcgatgtcgcaggactacgggccgccgatgcacgaggggtccgcggaggccgatgggctgctgctcaccggtaccagtgggagcgtcacgtcgggccggttggcgtatttcctggatttggaggggccggcggtgacggtggacacggcgtgttcgtcgtcgttggtcgcgttgcatcaggctgcccgggcggtgcggagcggggagtgctccctggcggtggctggtggtgtgagcgtgatgtcctcgcccggggtgttggtggagttctcccggcagcgtgggctgtccgctgatgggcggtgcaaggcgttcgcggagtcggcggatgggaccggttggggtgagggtgcgggtcttgtggtgctggagcggttgtcggtggcgcgtgcccgtgggcatcgggtgttggcggtgctgcggggttcggcggtgaaccaggacggtgcgtcgaacgggttgacggctccgaacggtccgtcgcagcagcgtgtgattcgtctggcgctggcggatgcggggctgggcgcgggtgatgtggatgtggtggaggcgcatggtacggggacgaggctcggtgatccgatcgaggcgcaggcgttgctggccacgtatgggaaggggcgttcggaggaccggccgttgtggctgggttcgctgaagtcgaacgtcggtcacacgatggcggcggccggggtgggtggtgtgatcaagatggtggaggcgctgcgtcgtggggtgctgcccgccacgttgcatgtggatgagccgacgtctcatgtggactggagtgccgggggagttcggctgctgaccgagtcgcgtgagtggcgttcggagggccggccgcgtcgtgcgggggtgtcgtcgttcgggatcagcggcaccaacgcgcatgtgattttggagcaggcgccgccggccgaacagtcactgccgccggagtccgtcccgccgtcggagtccgtcctgccgcaggagtccgtcccgccggcggggtccgtcctgccggcggggccggtgtctttcacggagcaggcggggccggtcgggtgggtgttgtcggcgcggagtgaggaggcgctgcgggcccacgcggggcggatcgccgaggccgccgctgataccggggtgccgttggaggacgtggcggcgacgctggcggcccgtaccgcgttcgagtggcgtggcgtggtgctgggtgccacgcgtgaggagttgctggtggggctgggttccctcgcggagggtgctccttgcgatggcgtggtgacgggggtcgccggggccggcgggacggtgttggtgtttccggggcagggttcgcagtggggtgcgatggcgcgggagttgtatgcgggtgctccggtgttcagggcccgtctcgaggagtgcgcgaaggcgttgtccgccttcgtggagtgggatctgctggatgtgctgctgagcgatgacggtggtgtgctgctgtcgcgggtggatgtggtgcagccggcgttgttcgcggtgatggtgtcgctggcggcgttgtgggaggcgcacggggtgcgcccggatgcggtcgtggggcattcgcagggggagatcgctgccgcgtatgtggcgggggttctgtcgctggaggacgcggcgcgtgtggtgacgttgcgcagtcaggcgatccgggccttggccgggcggggcgggatggtgtcggtcgggctgtcggtggacgaggtgcggccgcgtctggggcggtggggcggcgatgtcgagatcgccgcgatcaacggtccgacgtccacggtcgtctccggcagcgcgggggctctcgacgagctgcaggccgtgttcgaggccgagaacgtgcgtacctggcgtatccccgtcgactacgcctcgcactcctgccacgtcgaccgactgcgcgagaacgtcatggatctgctggcgccgatcaccccgcgagccggtgacctccgcttctactcgaccgtcaccgggcggcggatcgacaccaccgagctcgacgcggactactggttccgcaatctccgcgaaaccgtcgagttcgaggccgtcacccggttgttgctggcggacggcttcgacaccttcatcgaatgcagtccgcacccggttctggtcgccggtgtgcaggagaccatcgacagcacgcacactccggcccgcgccatcgggactctgcgtcgccatcacggtggcctggacagcttcctgtggtcggccggggatgccttcaccgcgggggccgtcgaccgctggaacccggcggaccagagccgtggcggacatgtcaccctgccctcctatccgttcgagcggacgcggtactggctgaccccggacaccggccgtcgtgatgtcggtgcggtcgggctgaccgcggccggccatcccctgctcggtgctgtcgtcgagggtgcggccggcacggtcttcaccggccgggtgtccctggccactcatccctggctggccgaccaccaggtggccggcaccctcgtggtgcccggcgccgcgttcgtggagctggcggtgtacgccgccgaccgggtcggcgccggcagcatccgtgagctgaccgtgcggtccccgctcgtcctgcccgagcacggcgccgtacggctacgggtggaggtgagcgagccggccgccggtgagagcgggcgtacggtgcggatcgacgcccggccggacatgggcacggccacgtcctggacgtgtcacgcgacgggtgtcctggacgccgagacgccgtccccggactgggacctcacggcctggccccccgccggggcacggcccgtggacgtctcctacgagaccctggccgcccaggggtaccactacggtgcggtgttccaggggctgcaccggatgtggcgccacaacgaccacgtctacgccgagatctccctccccaccgagcccgacgccttcaccatccaccccgccctcctcgacgccaccctccacgccgcgtgcaccgagggcccccggctggcgacatcgtggcgcggagtcgccgtgcacgcggtcggcgcgtccgccctgcgggtgcggatcggcccggaccgcgccggctcggtgtcggtgacgctggccgacaccgtgggtgatccggtcgccgagttcaccgtcggtaccacgcccgtcgaacccggggagctgcgggccgccggggtcgtacaactcggcgtgctccaccgggaggcatgggtcgaccacctcgcgaagtcgtcgccccggaaggcgaactgggccgtcgtgggcgaggatccgctccgcgccgcggcggggctgacggccgcaggcgtgtacgcccgggcatacccgggactcgacgccctggccgaagccgacggggacgcgccggactatctgctgctcaccgtgccgacgggcgcggaggtcgccgccaccgtgcgggagacactgagccggctgaacgcggtgcagtcggccgagaggctcgccacggcgaccgtggtgttcctgaccaccgccgccgtgccggccttcgaccctgccggcgccgacctcgcgggcgccgcggtgtgggggcttgtccggtccgcgcaggcggagaaccccggacggttcgtcctcgccgacgtggacgccgacgaggcgtcctggcgtgcgctgccgaggcccgtcatgtccggcgagccgcagatggccctgcgcgagggtcgggtcagggtgccacggctcgccccgggcgcaccggtgggtacgagggagcggttcgccggccacgagggcaccgtgctgatcacaggcgggaccacacccatgggcgagcgactggcgcggcacctcgtctccgtgcacggggtacggcatctgctgttcaccggcgccgaagcccccgagccgaccgcggaactcaccgcgctgggcgccgccgtcaccaccgcggcgtgcgatccggccgaccgcacggcgctgcgggagctgatcggccgtctgcccgcggagcgtccgctgaccatggtcgtgcacataccgcaggctccgccgcacgacagaaccctgtctgcgccaccgtctcaagccccggacgcgctcgccgaggtggtgggcgcgatggtcggtgccgcgggagtcctcgaccaggagatcggggaggccaccctcgtcctgtgctcgtcgttcgccggaaccgtcggtggtgccggaaccgccgccacggccgcgtcagcggtcgcgctggacgcgctggcccgacggcgccgggcgcgcggcgcccccgcggtgtcgctggcctgggggccctggacggcggacgacgcaccgtcccgtggcgggaacgcgggagtgggcgtgctgggggcgcgggaggccgtcgcgctgttcgacaccgcctgccgcgcggacgaacccgtgtggatcccggccaggctggatctggccgagctgaccaggcaggccgaggccggggaggcgctgccgccgctgttcaggtcgctggtcaagaccaccggcaaacgcacggcgagcggaggcgcggtctcggtcacatcgctgcggcaacggctcgcgtcgatggcggaggccgaacaggaccggacgctgtccggcctgatctccacacagatctcggcggtgctcgggctggagtcggccgacgtggtgcggccgaaccagatcctgctcgacttcggcttcgactcgctgtccatcctgaccctgcggaaccgcctcgactcggcgaccggtgtgcgtctggacaccgcgtcgatgttccaccggtcgacaccggacgacctggtccagcacctcaagcaggcactgctcgacaaccgatccggcagaggagccgatgatgcccccatcgatgacacagtc

SEQ ID NO: 2356 - DNA, 810 bp, Streptomyces avermitilis
  CDS (1)..(810)
gtgttgcgattccaggcactcggccgcctaaccgtcaccaacgacctgggcgactgcacgccgaccgcgccgatggcgcggcgggtgctggcgcagctgctcttgtgctcgaacaacatcgtcatgctcgacgcgatcatcgatgaactatggggtgacaaaccgccgaagagtgccgtccccaccgcgcagacgtacatctaccagctgcggcgtcagttcgaaccgtgggtgccggagggtacggtcgagcaggtgctcgccacctgcggcaccggctacatgctccgggtggacccggaccagctcgacctggcagcgtttctccggctgtccaagcaggggcggaccgcgctcgccgccggcgatccggccgcggccgcgcggttactgagacaggccctcgatctctggtcggggccggcgctcgccgatgtgaccgccggcccgtcgatccaggcgcacgtcgtccatctcacggagcagcgggcgcacaccgtcgaactgcgcatccaggcggacgcaatgctgggacggcaccgggaactggtcggggagctgaaggcgatgctgctgacccacccgctcaacgagtggtaccacgcgcagctgatcaaggcgctggcctccagcggcaggcggaacgaatcgctcgtcgcctaccagcatctgcgccggacgctgtcggccgaactcggcctcgaaccctcgggggtgctgcgggaactccatcaggaggtgctggccggacgcgactcctggtcggactggggggtctcggggaggcccctcgcggagcagctcacccgg

SEQ ID NO: 2357 - DNA, 825 bp, Streptomyces avermitilis
  CDS (1)..(825)
gtgaaacgccgggagaaatgccgccgactgacaaggcgcaataaccgcaggcgcagatcaagggaaggtacgcagactgtggcaagcttagagggcaagaccgcgctggtgacgggcggtcggaccggtctcggcttcggcatcgccaccgcgttggtggagcggggcgcgaacgtcgtgatcacttcacgcactgaggacgagctgcgcaaggcggccgccgcactcggcgaggaacgggccctcggggtcgccggtgacgcccgcgaccccgagcaccagcggatcgcggtggagaccgccgtcgaccggttcggatccctcgatctgctggtcaacaatgtcggcggtacggagcggaccgcccgccggttggtcgatgtcgatctggcgtcgtaccggcgcaccgtcgagatcaatctgatgtccgccctgacctgggtccagacggcctggcacggctggctcggcgagcacggcggcgccatcgtcaacatctcctccatcgccggggaactcgccgttcccgacggcacggcctacgggacggccaaggcggcgctgaaccacttcacccggcagatggcgaacgagctcgcccccgcggtccgggtgaacggcgtcgcgtccggcacggtcctcaccgacttcacccgggcgaacgtcgagggcagggaggacaaggtcatcggctccatcccgctgaggcgcctcggcgaacccgccgacgtgggcgccgccgtggccttcctgctgtcggacgaggcatcctggatcaccgggcacaccctggtcgtcgacggcggccggctcctgcacaacagg

SEQ ID NO: 2358 - DNA, 654 bp, Streptomyces avermitilis
  CDS (1)..(654)
atgcagcctgaccgcgccggccagttgcggatcgtactgatcgacgaccacgcgctgctgcgcgaggtggtgtgcgagacgctcaacgtggaaccggacatggtcgtcgtcggcgtcgccgccagcggtgccgccggcatcgcgcactgtgagatcgaacagcccggcgtcgtgctgctcgacgggaacattcctgacgagtcggtgaccgaaacagcgcacgctatccgctccacctcgccgaacgcgagaatcctgatcgtcagcatgcccgacgatccggcgctggtgcgccaattgctcgactgcggcgtccggggctatctgaacaagtcggcgagccggaacgacctggtgtccagcatccgcgcggtgtgcgcggacaacatccgcatcgtgctccacatatccgtcgaggcgctgacgcacatcgccacgacggcgaactgccaggacaagctcacccggcgcgagatagaaatcctgaccctggtgagcaaggccatgagcaaccggcagatctcgcggcgactgactatcgccgagggaaccgtgaagcgccacctgggcaccatcttcacgaagttgggcgctcgctcccggctcgaagcggtcaacaaggcggtttccatcgggctcatcgcccgcgccggg

SEQ ID NO: 2359 - DNA, 807 bp, Streptomyces avermitilis
  CDS (1)..(807)
atgtacagaacagagcacgagcaacgcttcgacaacggcgcgccggaagcacccgagcagctcggcctgctctccgagatcctcaacagggagaccttccgcaccctgggtgaggaggtacgcgtcgggcatgggtggcgttgctgggaggtgggcgccggggacggctccgtcgcccgctggctggccgccagggtggggacgtccggacatgtggtggccagcgacctcaagccccagcacgtacccagccatccgcggatcgaggcgatccgccacgacctcgtcgaggacccgtggccggagcacgcgttcgatctcattcacgcccggctggtgctgatgcacgtggccgacaaggaagcggtcgcggcgaggctggccgcacatctccggccgggcggtgcgctggtgctcaccgactggtactgcggttgtgctgacgagggcatcatcaagtccccggtcgacgcatacacggcgcgcatcttccaggaataccacgacggcgtgcacaaactcgccggagaaaccggtatggatttcgaatgggcggcgcgtacgccggacgttctgtccgccgccggctatcgggacatcacggtgcgcgacttccgggcaccgggggagggcggggcgccgaccgcgcggctcgcccgactgcacagcaccatgctggagcctttcctgctgagtcagacatctctgaccgaagccgacctctccgtaatccgggagaaactcctggacccggaattcgagatggtgaccaaccacacgtacacgaccgtcgtgcgggtgccgaag

SEQ ID NO: 2360 - DNA, 258 bp, Streptomyces avermitilis
  CDS (1)..(258)
atggcgactttcactcaggcggacctggtggggtacatacgccaggcggccggcgaggacgagggattcgacctggacggcgatatcgccgacatcacgttcgccgatatgggctatgactcggtcgcgatggtggaggtgacgctcctggtcgagcgtgaactcggcatcggcctgcccgatgacgacaaggcgagcaagaactcgaccccgaagcagttcgtcgaactggtcaacgagctgctgcccgcgtcgatc

SEQ ID NO: 2361 - DNA, 1002 bp, Streptomyces avermitilis
  CDS (1)..(1002)
atgagcgacggactctacatcgccgccgcgagttcgtggctgcccgagcggctgacactcgacgaggcggagcaggccggcctcgccgatcgggcgcgggtctggaacaccggcatcgagtcggtgtgcgtctcgccggacaagtcggcgccggaaatggcggtgctggcggcacgggacgccctcgggcgcgccgcggtcggggcggaggacctgcagctgctgctgcacgcctgcgcgtaccaccaaggtcatgacatgtggccggcggcgtcgtacgtccagcgcttctgcggcggtggctcctacccggccgtcgaggtccgccagatgtccaacggcggcatgatcgccctggaactcgcggccggccacctgcgcgcgtacggcgggtcgaccgccctggtcaccacggccgaccggttcagcctgcccggcttcgaccggtggcgcagcgacccgagcaccatctgcggcgacggcggcaccgcggtggtggtgtccacccgcaccggcttcgccctgctccgcggactcgctacggtgtcggatcccgggctggagcacggcagccggggcgagcggttcagtgacgcgccgttggccgcgcgagcgccgatcgacctgaacagcgactccctggtgcgcgaactcggagtggaggccctgctcaaccgcatcgaagcggggcaacgggaggcgttcgaccgggcctgtgcccaggcggacgtcaaactcggcgacatcgactggtacgtgctgccgaacctgggccggacccggatgcgggcgcagtacttcgacccgttcggcatcgatccgcagcgctcgacctggtcctggggccggcgggtcgggcacctcggcgcgggcgaccagttcgccggtctcgcccatctcgtctccgagggcgcactggagccggggcagacgtgcctgctggcaggcgtcggcgccggcttcacctggacggccggcatcctggagatcatcgccaggccg

SEQ ID NO: 2362 - DNA, 1248 bp, Streptomyces avermitilis
  CDS (1)..(1248)
atgagtagggcagtcccggagaacgacaacggcacgacgccggagcgtcctcgtgcggtgatcaccggtctcggggtggtcgcgccgaacgggttcgacaccgacgagtactgggacgccgtcctccatgggcggggcggcatcgaccgggtcacccgcttcgatccggagcagtacccggccacactggcgggcgaggtggccgactacgacgtgcgcgcgtacatccccggacgtctggtgccgcagaccgaccagaccacccggctggtgctgatggcggcggacgccgctgtccgggactcctcgctcgatccggccgcgctcccggaggaccaggtcggcatcgtcaccggtctctccgcgggcggcctcgagtacagccagcgcgagctggagaagctctggagcctcggcagcgaccatgtgagcgcctatctctcgttctcgtggttctacgcggtgaacacgggtcagatttccatccggcacgggtggcacggccccggcggcgtcctgaccgggaacaccagcggcctggacgccatagcgcaggcccgccggcacgtggtcgacggcctgccggtggtgatgtgcggcgccgtggagagcgcgatgtgcccgctcgggtggacgatcgagctgaccaccggccggatgagcacggtcgccgaccggacccaggcctacctgccgttcgacaccgccgcgtccggctacgtacccggagagggcggcgccatggtcgtcgtcgaggaggccggacacgcgcgcggccgaggcgcccggccgtacagcgagatcgccgggtacgccaccaccttcgacccgcggcccggttcggcacgggagcccgggctgcgccgggcgatcgagtccgcgctggcggacgccggtgtgacgcccgacgaggtcgacgtcgtgttcgcggacgcggccggggtcggcgaactcgaccgcgcggaagccgccgccgtcaccgccgtgttcggtccacggggtgttccggtgaccgcgccgaagacgatgaccggccggctgtactccggtggcccggcgctcgacgtggccacggcgtcgttgagcatgcggcacggcgtcatcccgccgatgatcaatgtgaccgaccccgtccggtccgaccagctcgacctggtgctcgaccgaccgagggagacgaccgtgtccaccgctctggtactggcccgcagcgacggcatcaactccgcggtggtgctgacggcggca

SEQ ID NO: 2363 - DNA, 1230 bp, Streptomyces avermitilis
  CDS (1)..(1230)
gtgcgcgccccgggcggaggaaacgccaaggagttctgggagctgatctcctccggcacctcggccatacgcaccatctcgctcttcgacgcgtccgggttccgctcccggatcgcgggcgagtgcgatttcgacccggtcgcggagggcttctccgcgcaggagatccggcgcatggaccggagcgcgcagctcgccgtcgccgcgaccagggaagccgtcgcggacgccggactcgacctggccgagacggacccgcatcgctgcggggtcagcgtcggcagcgccatcggcggcacgatgagcctggaccgggagtacaacgtgctctccgacggcggccgcaagtggctccttgaccacgagtacgcggtgccgcacatgtacaactatctcgtcccgacgtcgatcgccgcggacgtggcctggacggtcggggcggaaggccccgtgtccctggtgtccacgggatgcaccgcgggcatcgagtcggtgtcccacgcggcgcggctgatccgcgagggctccgccgacgtgatgctggccggcggctcggacgcgtccctctcaccgatctgcgtcgcctgcttcgacgcgatcaaggcgacgacgccgcgcaacgacgaaccggccaccgcgtcccgcccgttcgaccgcacccggaacggcttcgtgctcgccgaaggcagcgcgatgctggtgctggaagagctgaaccacgccagggaacgcggcgcgcgcgtctacgcggagatcggcggatgggacgtgcgcgccaacgcgtaccacatgaccggactcaggaccgagggcccggaactggccaaggccatcgaggtggcgctgcggatggccgggcgggtgcccgagcaggtcgactacgtgaacgcgcacggctccggtacgaagcagaacgacgcgcacgagaccgacgcgttcaagcgcactctcggcgaccacgcctaccggacgccggtcagttcgatcaagtccatgatcgggcactcgctgggcgcgatcggctcgatcgagatcgcggcatgcgcgctggccatcgacgccgggctcattccgccgaccgccaacctgcacgaacccgacccggaactggggctcgactacgtgccgctgtcggcgcgacaggcggacctgcggacggtgctcaaggtcggcagcgggttcggcggtttccagagcgccatggtgctgacccaggggggatccgatgag

SEQ ID NO: 2364 - DNA, 1197 bp, Streptomyces avermitilis
  CDS (1)..(1197)
atggatttcggcgctgatccctatcccgagtacgcgtggttacgtgcggaggaaccggtccggcaggtcctggagggccgcggcctttacggactgctggtgacccggtacgaggacgtgcggaagctgctgtccgatccccggatgagcaaggacccgcgcaacgcaccgctcgactggcaggaggcgggcaaggggagaccgctggaggaccggaccgggctcgggacgcatctgctgaccacggacgcgcccgaacacacgcggctgcgtcggctggtctcgaccgccttcaccgcccgccgcgtcgagggcctgcgcgcacaggtgcagcacatcacggacgggctcctcgacacgatcgtgccccgcgggcaggccgagctgatcggcgacttcgcgttcccgctggcgatcacggtgatctgtgaactgctgggagtgcccaaggcggaccaggacgtgttccgccagtggacgaaggacttccggcggtggacgaacaccgactccgcccaggccgaccgcggtgacgcgcggccggtcggactgcgcgacctcctcgaatatctgacccgactggtcgacaagcgccgtcaggacccggccgacggactggtcgacgcgctgatcgcggcccgggacgacgacgaccggctgaacgaggccgagttgctgtccatgatgtccctgctgctggtcggcggcttcgagacgacggtcaatctgatcggcaacggcaccctggccctgctgcgccaccccgaccaactcgccctgctgcgcgagcgaccggaactggtggactcggcgctggaggagatgctgcggtacgacgggtcgttcgagacggcgacgtggcggttcccgctcgaacccatcgaggtggcgggcacgcgcatcgagaagggccacccggtgctcctgtccctggcatcggccaaccgggacggggcgaagttcccggcaccggacgacttcgacgtcacccgcgcggaccccgcccacgtggccttcgggcggggtgcgcacttctgcctcggtgctcccctggcccggctggagggccggatcgcgttccacggactgctgcgccggctgcccggccttgcgctgtccgtaccgccggagcagttgcgatggcagcggagcctcacggtccgaggactggaagccctgccggtcaccttcgatgcc

SEQ ID NO: 2365 - DNA, 1503 bp, Streptomyces avermitilis
  CDS (1)..(1503)
gtgcgacgtacccgtgaggaaaacaccgttctcattctcggagggacaagcatgcgcgtagtgatcgtcggaggcggcacggtcgggttgtgcaccgccgtcttcctcgcccgtcagggtgtctcggtccatgtgctggagcgccgggcacaggtcaacgaccatccgcgggccttcggcatcacggaccggtcggcggagatcctccgggaggccggcatcgacatagagacggaccatctcgtccggggcctcatgacgggcacgagcctggccgatctgaccaccgtcacggccaagttcgagccgccggagatcggcccggcgaagctgggaagctgcccgcaggaccgggtcgaccgggccgcgctggcacggctgcgggagctcggcggccaggtggacttcgacagcgaggtggtcgcggtgacggacggcggcgtcaccaccgcggacggcaggaccgtcacggcggactacgtgatcgccgccgacggagtccgcagccggatgcgtgacctgctcggcatcggcgtgaccggcccgggaccgctgagcagttcgcacatgctcaacgtgctgttccgcgcggaactgcccaccccgccgacgtccatgacgttcctgcgcaacgagcgggcgtccgggatcctgctgaaggtcgacgagaccggccgctgggtcttccacatcccgaacggtgacccggagacccccgtcgagcggatccagcagcagatcagggacgccaccggcgtcagcgacatcgagccggagatcatcagcctgctgccctggtcgtcgacggcgcgggtcgccgaccgcttccggcagggcaacgtcttcctcgtgggtgacgcggcccacgtggtgccgccggtcgggggtctcggactcaacgtgggtatcgccgacggccacaacctggcgtggaaactggccgccggcggtgacgcgctgctcgacacctacgaggccgagcgccggcccgtcgcgctgttcaccatgcgacagaccgtgctccgcgccgagcaccgtgacctgcactgggacaacgacgcgagccgggccgccgaccgcgcggccgtgggcatggcgggcatcatgatccccgtgatcggctaccggtacgactccggcgcggtggtcgacccggagccgctctccgacatggagaacctcgtcctggacggcgccccgggcagccgcctgccgcaccggtggcttccggacggacggtccacggtcgacctcgtcgacggattcacgctgatcaccgggaccgcggccgaccactggctggacgcgacacgggacctgggcatcacggggcacgcggtcgaagggtgggccgaggccgtcggcatcaaggaggacggcgccgtgctcgtccgcccggacgggttcgtcggctggcgtacggccacgacacggaatgccgtggagaccagcacgcagcacctgcgggacgtcctcgaccggatcctgtgccggcagaaggcc

SEQ ID NO: 2366 - DNA, 783 bp, Streptomyces avermitilis
  CDS (1)..(783)
gtgaacctcctggccgacggctggacgctgacccagcgaaggctgttccggctgcgccacgagcccggcaccctgctcaccatgctgatgatgccgagcgggttcgtggtgctgttcggcttcgtgttcggcggcgcgatcggggtgccgggcacctcgaactaccgcgagttcatgatgcccggcctgttcgtgatgacgaccgggaccgctctgtccaccgccatggtggaggtggcgacggaccaggcgcgcggggtgatggagcgcctgcgttcgctcccgacccaccgggtgtccgtgccgctcggccagagcggcgccgaggggatcctcggggcctacggcctcgcggtcctgatggtgtgcggtctcgtcgtcggctggcggccgcacgacggcgttccgcgggcgctggccggcatcggcctgctcctgctgttccgctacacgctggcgtgggtcggcacctacctgggccttgtggtgcgttcggcacggaccgcggcccggctggcaccgctcacgctgtcgctcaccatggtgtccaacgccctcgtgccgaccgaccggatgccggtcggcctccgggcgctgtgcgagtggaacccgctcagctccgccgcggcggccgcgcgcgagctcttcggcaaccccggtgctcccgggccggacgccgcgtggccgctgacccacccggtgaccgcgagcctgctgtgggccggcctgctgttgctgatcttcgtgccgctctcggtgcgccgcttcgcccgcgccggactc

SEQ ID NO: 2367 - DNA, 939 bp, Streptomyces avermitilis
  CDS (1)..(939)
gtgaggaagcagtacggggatgtcgtcgcgctggacggcctggacctggtggtgccgtcgcgcaccgtctacggcctgctcggcccgaagggtgcggggaagagcaccgccgtgcggatcttggccaccctgacccggcccagcagcgggcgggccgtcgtcgccggcttcgacgtggcccggaatccggcggatgtgcggaaggtgatcggcctggccggtcaggacgcctcgttcgacgacggactgaccggccgggagaacctgcggatcctcggccgcctctcgcggctcggctcgcgcggcgcccgtcggcgcgccgacgagctgctggaacggttcggtctcgcccacgccggtgatcggctggtcggcacgtactccggtggcatgcgccgccggatccacctgatcgccagtctgttacgggcccccgcggtgcttttcctcgacgagccgaccaccgggctcgacgcccccagtcgcgccgagatctgggagagcgtgcggagactggtggccgacggcaccacggtcctgctcaccaccccgtgtctggaggaggtggagcggctcgccacggcggtcggcgtgatcgaccgcggccagctgatcgccgaaggcagcccggcccagctcaaagcccagatcggccgtcacatcgacgtcgtggttgagtcggcggaccatgtgccgagtgccatggcgaggctggagcggctgaccggccggtgccccgaggccgacggatcgcgcatcgtcgtggccgcggtggatcaggcgcccgccctgccgctgatcgtgagtgaactggacgcgtccggcgcggtgatcaggaacatcgggatccgcgagcccggcttggacgacgtcttcctgacgatgaccgggcagaccgtcggaccggcgcaaccggtcgagacgcccgaggcggtgtcg

SEQ ID NO: 2368 - DNA, 783 bp, Streptomyces avermitilis
  CDS (1)..(783)
atgcgaccggagaagccggcgcgaggccccgcgccgtcgcacagtcgtaggcagatcgccgcggtggcgatcgatatcgcggactccgaaggcatcgaagccgcgtcggtgcgcgccatcgccaagcgactcggcaccggtgcgatgaccctctaccgctacctgccgaccaaggaagacctgtacacggtcatgatcgacgaggcgaccggcttcgagccgcaggagccgaccggcgatctccgtgcggatctgacgaccttggcacgccgccgccggcagatcctcctgcggcacctctggctcgccccgctcctcgccacccgcccgatcatgggccccaacttcatgcgcggcatggaacgcgatctcgccgttctcgccggctgcggcctgggcatggacgacacgatccacgtgctcaacctgatccactcgtgggtcagcggcgccgtgcaggccgagttgaccgagcgggcgaccgcgaatcagtccggcctcgaccgccatgcctggcggctgcggatggagccgtacctcaagtccctgctggagaccggtgagttcccgcacctgagccggatggtccagacctccgagatcggggaggcagacgagcggttcgcgaacggcctggcgatcatcctggacggaatcgaagcccgcttcccgacggccaccgggaaggacggatcgcgccggccggtcggcgacaccggcggtggtgcgccgtcggcgcggcgcgcgaaaggtcagccaaccgcgcgcagttcgacgacggag

SEQ ID NO: 2369 - DNA, 1077 bp, Streptomyces avermitilis
  CDS (1)..(1077)
gtgagctgccgcaccggcaccgacaccgtcccggccgggtcccacgaacagagaaccgtcgagtcaggagaagtcatggccaaggagacgaccccccgaggcgggggagtgtgggcagccgccgatctgctgaccccgatggccgtccgggtggcggcgacgttgcggctggccgaccacatcgccgcgggcgcccggacgaccgaggcgctggccgaggccgtcggcgccgaccgggacgcgctggggcggctgctggaccacctggtgaccgcgggcgtgctgtcgggcaccgggcccggcgcctacgacctgacggccatgggccgccacctgtgcgagggcgcgcccgaggacatgcgggccatactcgacatcgaaggcgccctgggacacgcagagttgagcctcgtccacctgttgcacacggtacgcacgggtgaggccgcgttcccgcagcagtacggtgtgacgttctgggacgacctgtcgtccgacgacgggcgcgccgagtccttcgacaccttgatgggcgccaggttgacggcgcactcgccggccgtggccggggcgtatccgtggggaacgctccgtcatgtggtcgatgtcggcggtggcgacggcaccatgctgatcgccatcctgcagtcccaccccgacctgagggggacggtcgtcgacctgcccggcccggtgcgccgcgccgagaaggccatcgccgcggccggtctcgaccaccgggccgacatcgcggccggcagtttcttcgacgctcttcccgccggagcggacggatatctgctgtcgagcatcctgcacaactgggacgacgcgtcggccgcccgtatcctgcgccgctgcgccgacgcggcgcagacgacgggacgtgtgctcgtcgtggactacttcggcgaccggaccgtgcagacggagggcgacctgcgcatgctcggctacttcggcggccggcagcacaccctggagcaactggccgaactggcgggaaccgtcggcctgcacaccacctcggtcacgccggccggccgttactccgtcgtcgaactgcgcgcggttggc

SEQ ID NO: 2370 - DNA, 966 bp, Streptomyces avermitilis
  CDS (1)..(966)
gtgacgacgcttgtgaggtgtcttgttgtgtcgagtacacagcggcgagttgaccacgccatcaccatcgagggcgacgtggagacggtgttcgacctgatcgcggacatcgcgcgatggccgcagttccaccggtccgcggtgcacgcggagacggtccacgccaacgagaagggagagttggtcaggcactgggctctggccggtgacgccgccgtccgcgcctggcagaccgtgcgccgcacggaccggccggggcgccgcatcaccttcgcgcacatggaacccgaacagcccgccaccgacctccgcggcgagtgggtcttcaccgaactgacgccgaaccggacccgggtcgagctgagccaccaggtcgtcgcgccgaccggcgccgatctcggcccgttgctggacaggatcgcgcaggagagcgaggactgcctcgccacgctccgcgacacggccgagcgccgggccgacctggacgaactcgtcgtgtccttcactgacccgctgttcatcgccggctccgtcgaggacgcctatgactacctctaccgggcggacctgtggcccgagcgcatcccgcacgtggtggggctcgccatgaccgaggacgtgccgaacgtccagttcttcgacatggacaccaagggtccggacggcagcacgcacaccgtccgctcggtgcggatctgcctcccgaaccacctgatcgtgtacaagcagatctcgctgcccacgatgctggacgcgcacaccggccactggcggttcaccgagacgccggaaggcgtcatcgccgaggcccggcacaccagcacgatcaagcgctcggcgctgtcccagctgggcggcgcgacgacggtcgccgaggcgcgccggtacctgcgacggctgctgagcggcaacagcatgagcaacctccgcctcgccaaggcgtacgcggaggagcgcgccggcttc

SEQ ID NO: 2371 - DNA, 675 bp, Streptomyces avermitilis
  CDS (1)..(675)
atgccgagcatcatcactgtcggcgcattcgacagtggtaacgtcgccgacgtcaccaagatccttcaggagttcgatggcgaggtcgcgtccgaactgccccagctgcgccgccgccaggtattcagctacagcgacctttatgtgcacatgcaggactgggacgtcgccgaccccgacgaggcataccggatcatcagcaccgacccccggtgcacgcggctgaacgaacgcctgtcgacctatttcggcgatcacgccgcgacggaggactgggacggcccggtcgaccggccgacggccgagcgtttctacctgtggccggccgagcgactggacgacctggagcagacgtacagcgcggtgatcgtcaacacccagcggcaggaacacatccccgaggcggcacggctgttcgcggagtcggacgcgaccgacatcccgcagaagatgggcacgctgcgccgccagatctatctgtggcgcggcatctacctgcacatccaggacttcgccgtagccaacagcatggaggcgatcagcgaggtgtggacggaaggcgatccccgcttcctccagctcgtcgacgacctcacggagatcattccgccgtacgacccgcagggcaattcactggccacccgtttctaccactgggctgcagaggtgccggca

SEQ ID NO: 2372 - DNA, 1158 bp, Streptomyces avermitilis
  CDS (1)..(1158)
gtgctgccggccgagtacgagacactgcgggaacgaggcatcggccaggtcgaattgcccacgggcaaactcgtctggatggtggtgaggccggaatacgcccgcatcgtgctctccgacccgcggttcagctcggacaagacggacgaccgatttccgaagctgacacccaattcgctgatgaagctgcggtactgcgcaccgttcatgatcaacctggacggtccggaacacctgaagaagaagaagtccatcatggacgagttctccccggaaggactcgcccggctgctgccgcgcctgcgggtcgccgtcgaggagaagatcgacgacatgctgcggcagccgacgaagccggtcgacctggtgaaggagctggcgttccccatcgcgtggcagctgcaggagatgttcctcggcatccccgcggccgagctggagacgatgcgggacaacgtctggaagctgctgctcggcaccaccaccgaggccgaggagagggaagcggccgaccgcctgaacgggcacgcggaagaggtcctgaaggagaaggccaagcacctcggcgacgacatgatgagtcgtctgatcgtgcaggaacgcgagaagcacggcgaggtcaactggtacgaactcgcgcctctgatgctgtcgaacgcccagggcattcacaactcggtgtccacgatgatctcgctgggcgtgctcaccctgctgaaccacccggagcagcggccgacgctgctcgcccatccggaccggatgacgactgcggtggacgagatgctgcggtacttctcggtcaacgacggaacccccatgcggctcgccaccgaggacatgctcatcggcgacacgctggtcaaggccggtgacggcgtggcggtgccgacgctgcccgtcaaccgcgacccgtcggtgtgcccgtatccccatcagctcgacatcatgcgggaggagcccgcccggcacctggcgttcggtcacggaccgcacaagtgtccggcggaccgcctggtgccgagcctgctcgagatcgtctacacgacgctcttcgagcgggtcccgacgctcgcgctcgccgtgcccgaggcggaactgacgtacaagtaccactcgatccaggcgttcggcccggccgagatgccggtcacctgg

SEQ ID NO: 2373 - DNA, 702 bp, Streptomyces avermitilis
  CDS (1)..(702)
atgacgcagatcactccgccggtcaagctcgacgagctcatcacggcgatcaccgagaaccacaccaccgccctcgaccagctcagcggcgccatcctgctggccgaccacatcggcgaggtcgccgaccatctcatcggccacttcgtcgaccaggcccgtcactccggcgcgtcctggaccgacatcggccgctgcatgggcgtcacccggcaggcagcccagaagcggttcgtcggcaagcccgacgccaagccgtcgaatgccttcgagaagttctcccagcccgcccgcagcgcgatcatcgccggcatgaacgaggccaagacggccggcaacgccgagatcgtcccggcgcatgtcctcctcggcctgctcggcaccgagggcagtgcggtcggcgccctgcgggcgcagggcatcgacctcgaccaggcgcgagacacggcggtggccaccctgccgccgcgcagtgacgccgatccggtgctgatcccgtacgacgcccacgcgaagaaggcgctggaactggcgtctcgggtggccttccgcctcggccaggacagcgtcagcaccggccacatgctgctggggcttctggaagagggggacggcgccggggtgctggcctcgctgggcctcgacacggcagcggccgagcgtttcgtggcggaagccgccgacgaatcgtccgtcgcctcg

SEQ ID NO: 2374 - DNA, 738 bp, Streptomyces avermitilis
  CDS (1)..(738)
atggcgacgccgggtaccgacggccgtgtcgctctcgtcaccggcgcttcgggagcgctcggcgccgccgtggcacgggtcctcgaccaccgtggctaccggctggcgttgcactacaccaacggtgaggaccaggcccgcaaggtagcggccaagctcagcgggccgagcaccctcgtgcgggcggacgtcgccgactgggctgccacccgggacatggtcgaccgggtacgcgctgagctgggaggcatcagcgtcctcgtcaacacgggtgcgatccgccgggacggtctcatggccacccagtccgtcgacgactggacccggaccgtcgccgtcaatctgatcggcaccttccatacctgccgggcggcactcccggacatgctgcggggccgctggggacgcatcatcaacgtcgtctcgcccgccggcctcctcggcagccggggccagacggcgtactcggcgtccaaggccggtgtgctggggatgacccggagcctggccctggagtgcgggcggttcaatgtgacggtcaacgcgctgtcacccggcctgatggccaccgcgctcaccgaggaggtgccggccgaggtccgcgccacgctcgtggcgcggaccgcgttcggccgcatgggcacgcccgacgaggtggcccgtggcatcgaactgctgctggacgccgactacatgaccggtcaggtgctgtccatcgacgggggcatgtcgatctcg

SEQ ID NO: 2375 - DNA, 237 bp, Streptomyces avermitilis
  CDS (1)..(237)
atgggaccccgcctcctgttcagcgccaaggtgtccgtacacaaggcgtggtacccggtgacccgccgccgactggacttccaggaggcgttcctcgacctcgccccagacggcacgttcaccgcccgcgccctcgtacccgccccgcccgaactcgcctgtgtacacggacgttgggtcgccgacagcagccatgtgctcagctggacagcagccaccgtgaacgcctcgacccac

SEQ ID NO: 2376 - DNA, 1299 bp, Streptomyces avermitilis
  CDS (1)..(1299)
gtgggggaggagtacgaggtcgagatcggccccgtcgcccacggcgggcactgcatcgcccgtacatccgagggccaggtcctcttcgtacggcacgcgctgcccggcgagcgggtcctcgcgcgcgtcaccgagggcgaggagggcgcgcggtacctgcgtgcggacgccgtcgagatcctggacgcctcgaaggaccgtgtcgaggccccctgtccgtacgcgggccccggccgctgcggcggctgcgactggcagcacgccaagccgggcgcccagcgccgactgaagggcgaggtcatcgccgagcagttgcagcggctcgcgggcctcacgcccgaggaagcgggctgggacggcacggtgatgcccgccgagggcgacaagctcccggccggcgaggtccccgcgtggcggacccgcgtgcagtacgcggtggacgccgacggcaacgccgggctgcggcgccaccgctcgcacgaggtcgagccgatcgagcactgcatgatcgcggcaccgggcgtcagcgagctgggcatcgaggagcgtgactggtccggcatggagtcggtcgacgcgatcgcggcgacgggatcgcaggaccgcatggtgatcctggagccccggcccggcgcccgtctgcccctcgtcgagctcgacaagcccgtctccgtcatgcgcgtcgaggagaaggacggcggcatccaccgcgtccacggccgggcgttcgtgcgtgagcgcgccgacggccgcacctaccgtgtcggcagtggcggcttctggcaggtccacccgatggccgccgacaccctggtcaaggccgtcatgcagggtctgctgccgcgcaagggcgatatggcgctcgacctgtactgcggtgtcggcctcttcgcgggcgcgctcgcggaccggctcggtgacaagggcgcggtgctcggcatcgagtccggcaagcgcgcggtcgaggacgcgcggcacaacctcgccgccttcgagcgcgtgcgcatcgaacagggcaaggtcgaggcggtcctcccgcgcaccggcatcaccgaggtcgatttgatcgtcctcgacccgccgcgtgcgggcgcgggcaagaagacggtcgaacagctcgtgtccctgggcgcgcgaaagatcgcgtacgtggcctgcgacccggcggcgctggcacgggacctcgggtacttccgcgacggcggctacaaggtgcggacgctgcgggcgttcgatctgtttccgatgacgcatcatgtggagtgtgtggcgattctggagcctgctgcaaaggggctc

SEQ ID NO: 2377 - DNA, 2049 bp, Streptomyces avermitilis
  CDS (1)..(2049)
gtgtccaaactgaccgacgtgcccaaacggatcctgatcgggcgcgcactgcgcagtgaccggctcggagaaacgctcctgccgaagcgcatcgcactgcccgtcttcgcttccgacccgctctcctccgtggcgtacgcaccaggagaagtgctgctggtcctctccatcgcgggcgtgtcggcgtaccacttcagcccctggatcgcggtcgcggtcgtggtgctgatgttcaccgtggtcgcctcctaccggcagaacgtccacgcctacccgagcggcggcggcgactacgaggtggccaacaccaacctcggccccagggcgggtctcaccgtcgccagcgcgctgctcgtcgactacgtcctcaccgtcgccgtctccatcgcctccggcatcgagaacctcggctcggccatccccttcgtggtcgagcacaaggtctcctgcgcggtggccgtcatcgtgctgctcacgttgatgaacctgcgcggcgtaaaggagtccggaaaacttttcgcgattccgacgtacgtcttcgtcgcgggcgtcttcatcatgatcgcctggggcgccttccgcgggttcgtcctcgacgacaccatgcacgcgccgaccgccgactaccacatcaaggccgagcaccagggcctcgccggcttcgccctcgtgttcctgctgctgcgcgccttctcctccggctgtgccgcgctcaccggtgtcgaggcgatctccaacggtgtcccggccttccgcaagcccaagtccaagaacgcggcgtccacgctcgcggcgatgggcctgctcgccgtcaccatgttctgcggcatcatcgccctggccatggcgaccaacgtccgcatggcggagaacccggcgaacgacctgatccacaacggcgtcgcggtcggccccgactacgttcagaacccggtgatctcgcaggtcgccgaggccgtcttcggcaagggcagcttcctgttcatcgtgctggccgcggccaccgcgctggtgctgttcctcgccgcgaacaccgcgtacaacggcttcccgctgctcggctcgatcctcgcccaggaccgctatctgccgcgtcagctgcacacccgtggcgaccgcctggccttctccaacggcatcgtgctgctcgcgggcgcggcgaccctcctggtcgtcatctacggcgccgactcgacgcggctgatccagctgtacatcgtcggcgtcttcgtctccttcacgctgagccagaccggcatggtccggcactggaaccgccacctggccaccgagaaggaccaggccaagcgccggcacatggtccgctcccgggcgatcaacgcgttcggcgcgttcttcaccgggctcgtgctggtcgtcgtcctcgtcaccaagttcacgcacggcgcctgggtcgcgctgctcggcatgtgcatcttctacgcgacgatgagcgcgatccgtaagcactacgaccgggtcgccgaggagatcgccgcccccgagggcccgtccgacgacagtgtccgcccctcccgcgtccactccgtggtcctgatctccaagatccaccggccgacgctgcgcgccctcgcctacgccaagctgatgcgctccgacacgctggaggcgctcagcgtgaacgtcgacccggccgagaccaaggcactgaaggaggagtgggaccggcgcggcatcgacgtaccgctgaaggtcctcgactccccgtaccgcgagatcacccggcccgtcatcgagtacgtgaaggggctgcgcaaggagtcgccgcgcgacgcggtgtccgtgatcatccccgagtacgtggtgggccactggtacgagcacctgctgcacaaccagagcgcgctgcgcctgaagggccggctgctcttcaccccgggcgtcatggtcacctccgtgccctaccagctggagtcctccgaggccgcgaagaagcgggcgcgcaggcggcaggagtggagtgcgccgggtgcggtgcggcgcgggcccgcggaggagcgcgcgaaggagtcgtcgaacacgaagggc

SEQ ID NO: 2378 - DNA, 669 bp, Streptomyces avermitilis
  CDS (1)..(669)
gtgcacatcgtcatcatgggctgcggaagagtgggctccgctcttgcccagaccctggagcaacaggggcatacggtcgctgtgatcgaccaggaccccaccgccttccgacgactgggctccgggttcggcggccgtcgtgtcaccggagtcggcttcgaccaggacaccctgcgcgaggcgggcatcgaggaggccggcgcgttcgccgccgtctccagcggtgacaactcgaacatcatcgcggcccgggtggcccgcgagatgttcggcatcgagaacgtcgcagcccgtatctacgacccgcgccgcgccgaggtctaccagcgcctcggcattccgacggtcgccaccgtccgctggacggccgaccagatgctgcgccggctgctgccctcgggcgccgagccgctgtggcgcgaccccaccggcggggtgcagctcgccgaggtgcacgcctcttcggcctgggtgggccacaagatcagcaagctccaggaggagaccagcgtacgcgtggccttcctcacccggctgggcgaggcaatactgccgtcctcccagacggtgctccaggagggcgacctggtgcacgtgatgatgcgtacggacgacgtcgagaaggtcgaggcggcgttcgccgagggccctgaagaggagagcggtcac

SEQ ID NO: 2379 - DNA, 675 bp, Streptomyces avermitilis
  CDS (1)..(675)
atgagggtcgccattgccggtgccggtgccgtcggccgctcgatcgcgggcgaactgctcgagaacggccacgagatcctgctgatcgacaaggcgccgaccgccatctcggtcgagcgcgtcccgcaggcggagtggctgctcgccgacgcctgcgagatcacgtccctggacgaggcggcgctccagcgctgcaacgtggtgatcgccgcgacgggcgacgacaaggtgaacctggtcgtctcgctcctggcgaagacggagtacggcgttccgcgcgtcgtcgcccgcgtcaacaacccgaagaacgagtggttgttcaacgaggcctggggcgtggacgtcgccgtctccaccccgcgtctgatgtcggccctggtcgaggaggcggtgagcgtcggtgacctggtccggctgctgcgcttcagccacggcgacgcgaacctggtcgagctgaccctgccgccggagtcggccctggcgggcacgcaggtcggagacgtggagtggccacaggacacgtccctggtgacgatcatccgcggcacccgcgtcctcacaccgtcccaggaggactccctggaggcgggcgacgaactcctgttcgtggccgcgcaggcccgcgaggaacaactggaggacctgctgtcggtgcgccgcgaggacgcatcgagc

SEQ ID NO: 2380 - DNA, 765 bp, Streptomyces avermitilis
  CDS (1)..(765)
gtgacgtcgctcgacaagcctacggaagacgcccagcaggattccagggcggtgaccgaggccgcgctcttcgaggcgttcggcggtgtccggggcatggtcgagacggtggtgcccggcctcctcttcgtcaccatcttcacgatcaacaaggacctgcactggtcggcgatcgccgccatcacggtgtccctgctgctggtcgtggtccgcctcgtcatgagggacaccgtcaagcacgccttcagcggtgtcttcggtgtcgccttcggcgtggtcttcgcgatgatgaccggcaacgccaaggacttctacctgccgggcatgctctacacgctcggtctggcgctggcgtacatcatcaccacgctcgcgggcgtgcccctgatcggcctgatcctcggcccggtcttcaaggagaacctctcctggcgtacccgcaacccgggccgcaagaaggcgtacgcgaaggcaagttgggcctggggcctgatcctgctcgccaagtgcgcgatcctcttcccgctgtactggtgggccaacaccgcccaactcggctgggtcctggtcgcgctgaagatcccgccgttcctgctggcggtctggctcacctgggtgttcctggccaaggcccccgctccgatcgacgtgttcgcggagatggaggcggcggagaaggccgaggaggaacgcaaggcggcactggccgaggagcggggcgaggagcggggcgaggccacggcagggcgtcaccgccgcgacgtc

SEQ ID NO: 2381 - DNA, 516 bp, Streptomyces avermitilis
  CDS (1)..(516)
atgcgagcggtggcggcggagtgtgcgggggcggcggagtgtccagggccggtcagtgcccgttcagagcgttggcgccgcgagtgcgttgctgtcggcgtcccccggtacgctttcggtatgagcgctgttcctcattccgaaaagccggtgggccggttccggcgcatgctcgaccggctctcctcgtcccaggaggacctggagtccgaggagctgcgcgaggacgccgagaccgcaggatgtacgcgcatcggcgactgtcatgaccggcagatcgtcaccgttactggtaccttgcgcacggtcacgctgcggccgcgggccggagtcccggccctggaggcggagctgttcgacggctcggccgcactggacgtggtgtggctcggcaggcgttccatcgtcggcatagagccggggcgcaagctgatcgcttcgggccggatctcgatgagccggggccgcagagtgctgttcaacccgaagtacgaactcagaccgctcggacgggag

SEQ ID NO: 2382 - DNA, 714 bp, Streptomyces avermitilis
  CDS (1)..(714)
atgctgagcccgaccgggggaggcccccagaccccgacgagggtgctcgtggtcgacgacgagccgcagatcgtacgcgccctcgtgatcaacctgaaggcgcgcaagtacgaggtcgactcggcccacgacggcgcgaccgcgctgcacgtcgccgccgcccgccaccccgacgtcgtggtgctcgacctcgggctgcccgacatggacggcgtcgaggtgatcaggggactgcgcggctggacccgggtgccgatcctggtgctctcggcccgccactcctccgacgagaaggtcgaggcgctggacgcgggcgccgacgactacgtcaccaagcccttcggcatggacgagctgctggcccgcctgagggccgccgtccgccgggccgagcccacgggcggcggtgaggacgacgtgatcgtggagaccgaggacttcacggtcgacctggccgcgaagaaggtcaaccgcgacggcagggacgtacggctcaccccgacggagtggcacctgctggaggtgctcgtccgcaacaccggccgcctggtcggccagaaacagctgctccaggaggtgtggggcccgtcgtacgggacggagacgaactacctgcgcgtgtacatggcacaactgcgccgcaagctggaatcggatccgtcgcatccgaagcacttcatcacggagccggggatgggatatcggttcgagagg

SEQ ID NO: 2383 - DNA, 2553 bp, Streptomyces avermitilis
  CDS (1)..(2553)
atggcacgcggcaagcttcggatctacctcggtgcggcaccgggcgtcggcaagacgtacgccatgctctccgaggcgcaccgccgcgtcgagcgcggcacggactgcgtggtcgccttcgtggaacaccacgggcggccgcgcaccgaggtgatgctgcacggtctggagcaggtcgcgcgcagggagctcgcgtaccgggacaccgtcttcgccgagatggacgtggacgccgtcctgcggcgggcccccgccgtcgctctggtggacgaactcgctcacaccaatgttccgggctcccgcaacgccaaacgctggcaggacgtcgaggagctgctcgcggcgggcatcgacgtcgtgtcgaccgtcaacatccagcacctggagtcgctgggcgacgtcgtggagtcgataaccggcgtacgccagcgcgagaccgttccggacgagatggtgcgccgggccgaccagatcgagctggtcgacatgtcgccgcaggccctgcgccgccgcatggcgcacggcaacatctacaagccggacaaggtcgacgcggccctgtccaactacttccgcccgggcaacctgaccgcgctgcgcgagctggcgctgctgtgggtggccgaccgggtcgacgcgtacctgacggagtaccgcagcgagcaccgggtctcggcgatatggggctcgcgcgagcgcatcgtggtcggactgacgggcggccccgagggccgtacgctgatccggcgcgccgcacgcctcgcggagaagggcgcgggcggcgaggtcatggccgtctacatcgcccgcagcgacgggctgacctccgcctcgcccaaggagctggccgtccagcgcacgctcgtcgaggacctgggcggcaccttccaccacgtcgtcggggacgacataccctccgcgctgctggacttctcgcgcggcgtcaacgccacgcagatcgtgctcggctcctcgcgccgcaaggcctggcagtacatgttcgggccgggcgtcggcgccacggtcgcccgcgagtcgggacccgacctggacgtccacatcgtcacccatgaggaggtcgccaaggggcgcggtctcccggtcgcccggggtgcgcggctcggccggtcgcggatcatctggggctggctggtcggcgtggccgggccggtcgtcctcgcgctgctgctgaacaccgtcgacctcggcctcgccaacgacatgctgctgttcctggcgctgaccgtggcggccgccctgctcggcgggctgctgcccgccctcgcctcggcggccttcgggtcgctgctgctgaactactactacacgccgccgctgcaccggctgacgatcgccgaccccaagaacatcatcgccatcgcgatcttcgtcggtgtcgccgtctccgtggcctccgtggtggacctcgccgcccgccgtacgcatcaggcggcccggctgcgtgccgagtcggagatcctctccttcctcgcgggcagcgtgctgcgcggcgagaccagtctggacgccctgctcgaacgcgtccgcgagaccttcggcatggagtcggtcgccctgctggagcgggagagcgacgtcgcgccgtggacctgcgcgggcagtgtgggcgtgcgtccgctggtcgaccggccggaggacgcggacgtggacatgcccgtgggcgaccacatggccctcgcgctgtccgggcgcgtgctgcccgcctccgaccgccgggtgctcgccgcgttcgccgcccaggccgccgtcgtcctggaccgccagcgccttcagcgcgaggcggaccaggcccgcacgctcgccgagggcaacagcatccgtaccgcgctgctggccgcggtcagccatgacctgcggaccccgctggcggggatcaaggcggccgtgtcctccctgcgctccgacgacgtggcctggtccgaggaggaccgggcggagctcctcgaaggcatcgaggacggcgcggaccgcctcgaccacctggtgggcaacctgctggacatgtcccggctgcagaccgggaccgtgaccccgctgatccgcgagatcgacctcgacgaggtggtgccgatggcgctcggcggagtgcccgaggacagcgtggtgctggacatcccggagagtctgccgatggtggccgtcgaccccggtctgctggagcgctcggtggccaacctcgtcgagaacgcggtcaagtacagcccttcggacgagtcggtcctggtggccgcgagcgccctcgccaaccgggtggaactccgtgtggtggaccgcgggcccggtgtccccgacgaggcgaaggaccgcatcttcgcgcccttccagcgctacggcgacgccccgcgcggtgtcggtgtcggcctgggtctcgcggtggcacgcggcttcgccgaggcgatgggtggcacgctgaacgccgaggacactcccggcggcggcctcaccatggtgctgacggtcggggcggcggtggacagccccgccggccgtcccggcctcgcgcacgcaacagcagaaaggcagaccagatgc

SEQ ID NO: 2384 - DNA, 1212 bp, Streptomyces avermitilis
  CDS (1)..(1212)
atgcccaagctgccctctcgcgtgcaccgtcgcagaccacgcaccgccgtcatcgccgccctggccaccgctctggtgggcggcctcctcgcctggcccgccgcccatcgcgccgacgcggcaccggccaccttcgcgcaccccggagtcaccgtctccaggagtcagctggacttctcccgcaccaaggtcaacgccggtgcgcagccctggaagggcgcgtacgaccagatgatggcgagcacgtacgcttcgctgacgcgcaccgcgaagccccgcgcgaccgtcgagtgcggctcgtactccaaccccaactacgggtgcacggacgagcgtgaggacgcgatagccgcgtacaccgacgccctcgcctggtacatcacccgcgacgagcggtacgcgaagaaggccatcgagttgatggacgcgtggtcggcggtgatcaaggaccacaccaacagcaacgcgccgttgcagaccggctgggccggctcctcgtggcccaaggcggccgagatcatcaagtacacgtacaccggcacctgggcgaactccggccgcttcgcgaccatgctgcgcgacgtgtacctccccgagatcatcaacggctccaactccaacggcaactgggagctgtcgatgatggaggccgccgtcggcatctccgtcttcctggaggacaagacgtcgtacgacaaggccatggcgaagttccgtacgcgtacggccgcgtacatctatctctcgtccgacggagctgtgccgaagaccgtgccgagccagaatctcgacacgaccgcgaagatcgtcagctactggcaggggcagtccaccttcgtcaccgggctcacccaggagacctgccgcgacttcacgcacaccgggtacggcatctccgccgtctcgcacatcgccgagaccagccgtatccagggcgcggacctgtacggcacggacgtcggcgagcggctgcggcaggcgctcggcttccaggccaagtaccagctgggcgaggcggcaccgagctggctgtgcgggggctccctgaaccgggggctcgggccgatcaccgaggtcggctacaacgccctgcacaaccgcctgggcatcgccatgaccaacacccagaacctgaccgagcagaaccgcccggccggcagcaacaacctcttcgttgcctgggagacgctcacacacggcgacaacccgagc

SEQ ID NO: 2385 - DNA, 762 bp, Streptomyces avermitilis
  CDS (1)..(762)
gtgttcggacgtcgcaagaagggcagtgccgccgaggacgcggcgggcgaggccgagcaggtcgtcgacggcgtcgacgctgaggcggacgacgagggcgagcgcgagcggccgcggctcgagcccgagccgcggcccgacgggccctgggacagctccgaggtccgtgacccggccgagggccgggtggacctgggcggtctgttcgtgcccggggtcgagggcatggagctgcgggtcgaggtcgcgggcgacgcgatcgtcgcggcgaccgtcgtgctgcgggacagcgcggtccagctccaggctttcgccgcccccaagcgcgagggcatctggggcgaggtccgcgaggagatcgccagcggcatcacccagcagggcggtgtcatcgacgaggtcgagggcccgctgggctgggagctgcgcgcgcaggtgccggtacagctgccggacggtacgggcggcttccaggtcgtccggttcgtgggtgtggacggcccccgctggttcctgcgcggggtcatttccggtcagggtgccgtgcagccgcaggccgccggtctcctggagcagatcttccgggacacggtcgtggtccgcggtgagggtccgatggcgccccgcgacccgatcgtcctgaagctgccgaacgacgcgcagatggtccccgagggtgtccagcaggaggagcagagcggttcgcgcttctccggcggcatggggcagttgcagcgtggaccggagatcaccgaggtccgc

SEQ ID NO: 2386 - DNA, 525 bp, Streptomyces avermitilis
  CDS (1)..(525)
atgacccgtgcccccctgaacgtgctgctccgacgagtcgaccccgacgtaccgcttccggcgtacgagcacccgggcgacgcgggagcggatctgcggaccaccgagagctgcgaactgaagcccggcgaacgggccgtgctgcccaccggggtgtctgtcgcgctgcccgaggggtacgcggccttcgtgcacccgcgatccggcctcgccgcccgctgcggtgtcgccctcgtgaatgccccggggacggttgatgccgggtaccgtggggagatcaaggtgatcgtggtgaatctcgacccgcgcgagtccgtgcggttcgagcgcttcgaccggattgcccaactggtcgtccagcaggtcgagagggtccgcttccaggaggtggcggagcttcccgattcggcgcgggccgaggggggcttcgggtccaccggcggtcatgccgccgtgggcgccgatacgaacgggcaacagggtgggaatcgatacgcttcggtcgtatccgaccggaaaggacag

SEQ ID NO: 2387 - DNA, 582 bp, Streptomyces avermitilis
  CDS (1)..(582)
gtgagtggtacttccgcagctctgaagccccccgccgacgccacgacgccggtgcggcaccccgatgcgcccgcccccggcgaactcctcggcgcgcactacggacactgcttcgggtgcggggaggagcagtcccacgggctgcacctggcggcacgggcgggtcagggcgtttcgatcaccgccgagttcaccgtgcagcccgcccatcagggtgcgcccggtctggcccacggcggggtgctcgcgaccgctctcgacgagaccctcggctcgctgaactggctgctgcgcaccatcgccgtgaccggccggctcgagaccgacttcgtacggcccgtgcccgtcggcaccgtgctgtacctggaggcggaggtgacggcggtggccgggcgcaagatctactcgaccgccaccggacggatcggcggccccgaggggcccgtggccgtccgcgccgacgcccttttcgtcgaggtcaaggtcgaccacttcaccgacaacggccgccaggaggagatccgggcggccatgaacgacccggaccagctccggcgtgcccgtgccttcgaggtgaaccca

SEQ ID NO: 2388 - DNA, 459 bp, Streptomyces avermitilis
  CDS (1)..(459)
atgcagctttccgcgccgccgtacgaagaacgcctcaccgccccccgcacctggtggctcatgtgcttcctggtcggcgtctcgatggccctgatcctgctccccttcggcacactcccgctgctgggcggcctggtgggcggcacggcggtcgcggcggtcgtggccagctcgtacgggtcgatccgcatccgcgtggtcggcgactccctcatcgcgggcgaggcgaagatccccgtggcggccctgggtgaggcggagatcatggaccaggaggaggcgcgcgcctggcgcacgtacaaggcgaacccgcgcgccttcatgctgctgcgctcctacatccccacggccctgcgggtagaggtcacggatccccaggacccgaccccgtacctgtatctgtcgacgcgcgaaccggaacgcctggcggcggcgctgaaggcagcccgcacggaggcg

SEQ ID NO: 2389 - DNA, 933 bp, Streptomyces avermitilis
  CDS (1)..(933)
gtgactggctcgacccctccctggaagcgccgcttcccccgccggggagcggacgaagagccgcacgacggctctcacggcgcgcgtgacgacgagcggggctcttccgagcctggatcagcctcgctcgaaccgtcggccgccactgtggacgccgcggccccttcggggcttccggcgcccgtggatccggatcctcctccgcccgtcgccagacgccgggcggccgtcgtacgtgacggggtccgggaaggtgtccgcaagggcggcagccgggccagggcgggcctggcgtacgtcgtggaccggatcatcgagaacgccccgcgtatccccgtacgcgacctcgcgaccctgcgcaggcagttcccgggcctgggacccgaggagctcgcggacaaacttgtgacgggcgcggccaacgccacgtccacggtgggcgcggggatcggagccgccgccatgctgccggtgccgccggcgatgccgaccgagctggccgccgagatcaccggcgtcgccgcgatcgagctgaagctgatcgccgagctgcacgaggtgtacgggctgcggccgccgggcacgctgacgcagcgcagcaccgcgtatctgcactcctggtcgggggagcgcgggatcgacgtgacgaagccgtcgacgatcaatgtggccctcgggggccagatgaggcgcgaactgcgccagcaggtcatgaagcggacggtgcgggatctgccgaacctgatgccgttcatggtgggcgccgcggtcggggcggtcatgaaccgccgggacaccaagcggcttgcggggcgtatccgcaaggacctgcggaagatgcaggtgccatgggacgcgctgccggagctgccaccgctggagaagccggccgatccgctgcggctgggggagatccccaaggagctggggccc

SEQ ID NO: 2390 - DNA, 294 bp, Streptomyces avermitilis
  CDS (1)..(294)
atggcaacggattacgacaccccacgcaagaccgacgacgacgtcgattccgacagtcttgaggagctcaaggccaggcggaacgacaagtcgacttcggcggtcgacgtagacgagttcgaggccgccgaaggcctggagcttcccggagcggacctctcgaacgaggagttggccgtccgggtgctgcccaagcagcaggacgagttcacctgcatgagctgcttcctggtgcaccaccgcagccagctggcccgcgagaagaacggtcagccgatctgccgcgactgcgac

SEQ ID NO: 2391 - DNA, 1245 bp, Streptomyces avermitilis
  CDS (1)..(1245)
gtggcgacgacacccgcaccgcccgccgcacccccgaagccgacctgggaccccaggcggcaggaggcgccgttcccctggctgcggcccaccatccgcatacggctcaccctgctgtacggcggcatgttcctgatcgccggcatcctgctgctgtcgatcatctatctgctggccgcgcaggcgctgcggacgggcagcgaaccgctgttcaagatcctcgacggcaacggcatcaaggtcgccagcgacgactgcccgggcgtcagcacgaacaacattccgctgacggcgttcaacgacgcgatcagcgcgtgcaccgaccaccagcgccaggtcgccctggacaacctgctgagccgctcactgctcgcgctgctcggcctcgccgtgatcgccttcgccttcggatacgcgatggcgggccgcgtcctgtcgccgctcgggcggatcacccgcaccgcccgcgcggtggccggctcggacctgtcccggcggatcgagctggacggtcccgacgacgagctgaaggagctggcggacaccttcgacgacatgctggagcggctccagcgggccttcacggcccagcagcggttcgtcggcaacgcctcgcacgagctgcgtaccccgctcgcgatcaaccgcacgctcctcgaagtgcacctgtccgacccgggcgccccgatggagctccagcagctcggcaagaccctgctcgccaccaacgagcgcagcgagcagctcgtcgaggggctgctgctgctcgcccgcagtgacaaccagatcgtggagcgcaagccggtcgacctcgccgaggtcgcctcgcaggccatcgaccaggcgcggtccgaggcggacgccaagggcgtggagttccgcggcgagcgggcctccgcggtcgtccagggcaatggcgtcctgctggagcggatcgccctgaacctggtgcagaacgccgtgcggtacaacgtgcccgaggacggctgggtcgaggtgaccaccgaggtccagcacgggcacgcggtgctggtggtctcgaacacgggtcccgtggttcccgcgtacgagatcgacaacctcttcgagcccttcaggcggctgcgtacggagcgcacgggcagcgacaagggggtggggctcggtctgtccatcgcccggtccgtggcccgcgcccacgggggccacatcgccgcccagccccgtgaaggaggcgggctcgtgatgcgcgtcaccctgccgatc

SEQ ID NO: 2392 - DNA, 651 bp, Streptomyces avermitilis
  CDS (1)..(651)
gtgcgcgtactcgtcgtcgaggacgagcagctgctcgccgatgcggtggccaccggactgcgccgggaggccatggccgtcgacgtcgtgtacgacggtgcggccgccctggagcgcatcggcgtcaacgactacgacgtggtcgtcctcgaccgcgacctcccgctcgtgcacggcgacgacgtctgccgcaagatcgtcgagctcggcatgcccacgcgcgtgctgatgctcaccgcgtccggcgacgtcagcgaccgcgtcgagggtctggagatcggcgccgacgactatctgcccaagccgttcgcgttcagcgagctgacggcacgcgtgcgtgctctcggccggcggacgagtgtgccgctgccgcccgtcctggagcgcgccggcatcaagctcgaccccaaccgccgcgaggtcttccgcgacggcaaggaggtgcagctcgcgccgaaggagttcgccgttctggaggtgctgctgcgcagcgagggcgccgtggtctccgccgagcagctcctggagaaggcctgggacgagaacacggaccccttcaccaacgtcgtacgggtgacggtcatgacgctgcgccgcaagctcggcgagccgcctgtcatcgtcaccgtgcccggctccggctaccggatc

SEQ ID NO: 2393 - DNA, 816 bp, Streptomyces avermitilis
  CDS (1)..(816)
gtgaccgaccagtccgagcacctggaccacctcaaggccgaactcctggagatcgcgctcgacgccgcggcccgcgcgggagccttcctgcgcgacggccgccccgacgacctcggggtggccgcgaccaagtccagcgccgtcgacgtcgtcaccgagatggacatcgcctccgagaagctgatcaccggcctgctggccgaccgcaggcccgacgacggcgtgctcggcgaggagggcgccgacgtcgaggggacgagcggtgtccagtgggtcatcgaccccatcgacggaaccgtcaactatctgtacggcctgcccagctgggccgtctccatcgccgcgcgcaaggacggcgagacgctcgtcggcgtggtgcacgcgccgatgcgcggcgagacctacagcgccgtcctggggcagggcgctttcgtcaacgacctccccgcgcgcgtgcggcccgcgcccgccttcggactggccctcgtcggtacgggcttcggctatctcgccgagcgccgggcccggcaggccgaggtcgtccggcagctcgtccccgaggtccgggacatccgccgcggcggctcggccgcgatcgacctgtgcgacgtggcggccggccgcctggacgcgtactacgagcgcggactgaacccctgggactacgcggcgggcgacctcatcgcgcgggaagcgggcgcgctgaccggtggacgccccggagagcccctctcgaccgacctgacgatcgccgccccgcccggcctcttcgaggcgctccagacccgcctggaggacctcggggcctggcacgac

SEQ ID NO: 2394 - DNA, 1125 bp, Streptomyces avermitilis
  CDS (1)..(1125)
atgcccgaagcactcgatgccagcccttacgacgccctgctgctcctctcgttcggaggtccggagggcccggacgacgtggtcccgttcctggagaacgtgacgcggggacgcggcatccccagggaacggctcaaggaggtggggcagcactacttcctgttcggcggaatcagccccatcaacgaccagaaccgcgctctcctcgacgccctccgcaaggatttcgccgagcacggtctgaacctgcccgtgtactggggcaaccgcaactgggcgccctacctgaccgacaccctgcgcgagatggcagccgacggccgccgtcgcatcctggtcctggccaccagcgcgtacgcctcgtactcgggctgccggcagtaccgcgagaacctcgcgggcgccctggccaccctggaggccgagggtctggaggtgccgagggtcgacaagctgcggcactacttcaaccaccccggcttcgtggaaccgatgaccgagggcgtgctgaggtccctcgccgagctgcccgaggacgtgcgcccgggcgcgcacatcgccttcaccacgcactccatccccaccgccgccgcggacacctccggacccgtcgaggagcacggggacggcggggcgtatgtgaagcagcacctggacgtcgcgcggctgatcgcggacgccgtgcgggaggagaccgggatcgaccatccctggcagctggtctaccagtcccgctccggggccccgcacatcccctggctggagccggacatctgcgaccacctccaggagctgcacggcgccggggtgccggccgtggtgatggcgccgatcggattcgtctccgaccacatggaggtcctgtacgacctcgacacggaggcgaaggcgaaggccgaggagctggggctgccggtgcgccgttcggccaccgtgggcgccgacgcgcggttcgccgccgcggtccgcgagctggtcgtggagcgtgccgccgtcgagagcggacagaaggtgaccccgtgcgccctaggcgcgctgggcccgagccaccagctgtgtccggtgggctgctgccccgcccgcgcccccaagcccgccgccgcgggcgccgacagcccgtacgcg

SEQ ID NO: 2395 - DNA, 1236 bp, Streptomyces avermitilis
  CDS (1)..(1236)
gtgccaagcccctaccgcgccctgttcgccgccccaggctccaagggcttctccgccgcgggcttcctcggccggatgccgctgtccatgatgggcatcggcgtggtgacgatgatctcccagctcacggggcggtacgggctcgccggcgcgctgtcggccaccatcgcgctgtccgccgcggcgctcggtccgcagatctcccggctggtggaccggcacgggcagcggcgtgtgctgcgcccggcgacgctcttcgcgctgaccgcggccgccgcgctgctgctggccgcgcactacgactggccggactgggtgctgttcgtctgctccgccggcatcggctgcgtaccgagcctcggcgcgatgacccgggcccgctgggcgaacctgtaccgggacaccccgcagctgcacacggcgtacgcgttcgagtccgtcgtggacgaggtgtgcttcatcttcggcccgatcatctcgatcggcgtctccacggtctggttccccgaggcgggtcccctgctcgcggccgtcttcctggccctcggtgtcttctggctgaccgctcagcgggccaccgaacccgagccgcatccgcacgagcagcacagcggcggctcggcactgcgcgcggccggactacaggtcctggtggccacgttcgtggcgaccggagcgatcttcggggccgtcgacgtggtcaccgtggccttcgccgaggagcagggccacaaggcggccgcgagcgtcgtactggcgctgtacgcggcgggttcctgcgtcgcgggagtcgtcttcgggctgctgcgcttcacgggggcggccgaacgccggtggctgctgggcatatgcgcgatggccgtgagtatgatccccctcctactggtcggaaacttgccgttcctggccgtggcgctgttcgttgcgggcctgtccatcgcacccacgatgatcacgacgatgtccctcatcgaacagcacgtaccacgcgcgaaactgaccgagggaatgacctgggtgagcaccgggctcgcggtcggcatcgcgctcggctcctccgtttccggctgggtgatcgacgccgccggtgcgcgtgccgggtacggggttccggcggtgtccggggccgtcgcggtcgcggtcggtttcctcgggtatcgccggctgagcaggccggctccgcagcggggagggtcccatgagcaccacagtgagcgggaagagcggcacgtggcg

SEQ ID NO: 2396 - DNA, 1317 bp, Streptomyces avermitilis
  CDS (1)..(1317)
atgagcaccacagtgagcgggaagagcggcacgtggcgtaactgggcggggaacgtcaccgcccggccggtacgggaggtcactcccgcttccgtcgaggaactctccgccgccgtacggaaggcggccgacgagggcctgcgggtgaaggccgtcggaaccggacactccttcacggccgccgccgcgaccgacggtgtattgatccgccctcaactgctgacggggatccgcggcatcgaccgcgaggccggcacggtcaccgtggaggccggcaccccgctcaagagactcaacgtggctctcgcgcgcgagggtctctcgctcacgaacatgggcgacatcatggagcagacggtctccggcgcgaccagcaccggaactcatggcacgggccgtgactcggcctcgatcgccgcccagatcaagggccttgagctggtcactgccgacggctcggtgctgacctgctccgagaaggagaatccggaggtcttcgcggcggcccgcatcgggatcggcgccctgggagtggtcaccgcgatcacgttctccgtagagcccgtttttctgctcacggcccgcgaggagccgatgagtttcgacaaggtcaccgccgacttcgacgaactcttcgccgagaacgagcacttcgagttctactggttcccgcacaccggcaactgcaacaccaagcgcaacaaccgcagcgcgggaccggagaggccggtcggacagctcagcggctggatcgaggacgagttcctctccaacggcgtcttccaggtggccaatctgctcggccgagccgtgcccgcgaccatacccaccctcgccagggtctccagccgggccctgtccgcccgcacgtacaccgacatcccctacaaggtgttcacctctccgcgccgggtgcgcttcgtggagatggagtacgcggttccccgcgaggccctcgtggagacgctgcgcgaactgaagtcgatggtcgaccgctcccccttgcgggtgagtttccccgtcgaggtgcgcacggccccggccgacgacatcacgctctccaccgcgtccggccgggacagcgcgtacatcgccgtccacatgttccggggcacgccgtaccaggcgtacttcaccgccgcagagcggatcttcaccgcgcacgaggggcggccgcactggggcaaggtgcacacgcgcgacgcggagtacttcagcggggtctacccgcgcttcggcgagttcacggcgctgcgggaccggcttgacccggaacggcgcttcgggaacgactacttgcgtcgggtgctggggtcg

SEQ ID NO: 2397 - DNA, 789 bp, Streptomyces avermitilis
  CDS (1)..(789)
atgcgtgagaagccggaagtcggtgcgaggccggatagcgaggaggagcccgggaggaagaggctggacctgagcgtccctcaggtcgcgggcagtgccgtggccgcggtggtggccgccaaactcgcctcctgcttcggcgtctacgggaccatcctgggcgccggcctgatcagcgtcgtcgccacctgcggcggcacggtcttccagcacttcttcagtcgcaccggtgagcagctgcgcgaggtcaccgtgcagcccaagccgcgcgtgtcggccggccgccggcccggtgagccggtccggccggtggcggccgcggcttcgggtgagttcacggacggcacggtctaccgggcgcgggtcaagagctggaagcgaccggtggtcgccgccaccctcgtgttcggcgtcacgatggccgggatcaccacctacgagttggtctccggcgacagcttcagcggcggggtcagcaccacggtcgggggcgcgctggccggccgcaccaagacgccgccgacgacggacaattcgccgtccccctcacggacgccgtccagcgtccgccctgcgccgtcggacgacgcctcctcggagagcggcgagggcggtacgacacaggacccgacgccgacgcccagtgccacgaagagcccggacgccggctccgacggcagcctgcccagtgcgaccccgacgcccagcgtctcggctacgaccccagcacccgacgcaagtagtcgttcccgaagcgccgttccgggtcaagccggtcccgcagcgccg

SEQ ID NO: 2398 - DNA, 1044 bp, Streptomyces avermitilis
  CDS (1)..(1044)
atgcccgaactgcgtgtcgtggccgtctccaatgacggcacacggctggtgctgaaggctgcggacagcacggagtacacgcttccgattgacgaacggctccgcgccgccgtgcgcggcgaccgtccccgcctcggccagatcgagatcgaggtggagagccatctccgcccccgagacatccaggcgcggatacgtgccggcgcgtccgccgaagaggtggcccagctcgccggcatcccggtcgatcgcgtacgccgcttcgaggggcccgtgctggccgagcgcgccttcatggccgagcgggcccgcaagacccccgtccgccggcccggcgagaacgccggtccccagctcggtgaggccgtccaggagcgactgctgctgcgcggcgccgacaaggacaccgtccagtgggactcctggcgccgcgacgacggcacctgggaagtgctgctggtctacctggtcgcgggtgagccgcactcggcgagctggacgtacgacccgccgcggcggctcgtccaggccgtcgacgacgaggcgcgctcgctgatcggcgagtccgacgacctcgcggcgcccgagcccagcttcccgttcgtgccgcggatcgcacgcctgccgcgcgaccgcccgctggaccgcgccctggaccgccagacggaacgtcccgccctgccgtcgcaggcacccgagcccgcggaggagagcacggctgagcgcgactcgctcaccagcctcctggaggcggttcccagcttccgcggggacatggtggtgcccgagcggcccgcggaaattcccgcaggacaggacgagcccgcccccgagccggaggcggaggagcccccggcggcatcggcttcggccggttccgcgtacgcggacgtgctcatgccccgctcggtcggcagccaccgcgaccgactggtcggcgcgaccgaccgccaggccgaggcggacggcgtccgtccgggccgcagagcggccgtgccgagctgggacgagatcgtgttcgggacacgacgcaagaagcaggaa

SEQ ID NO: 2399 - DNA, 849 bp, Streptomyces avermitilis
  CDS (1)..(849)
atgaacgtcatcatctccgcatccgaactggcgagcgagctggcggggccgaacccgccgaccctcctggacgtccgctggcagctgagcacagccaaggcgggtggtgccgccccgttcgacggccgggccgcgtatgcgtccgggcacgttcccggcgccgtcttcgtggatctggacgccgatctggccggccccgcgggccctgccggacggcatccgctgccggatctcgcgcacttcggcgaggccatgcgggccgccggtgtctcggcgcggcggccggtggtcgtgtacgacggtgggcagggctgggccgccgcgcgcgcgtggtggatgttgcgctggacgggtcacccggcggtgcgagtgcttgacggcggcctcgcggcgtggagcggaccggtgaccacggagaccgaggagttggtcgccggggacttcgagcccgcgcccggcgccctgccgcttctcgacgccgacggcgccgcggcgctcgcccgtaccggtctgctgctcgacgcgcgggccgccgagcgctaccgcggtgacgtggagccgatcgacccggtcggcggccacatcccgggcgcggtgtcggccccgaccacggagaacgtggccgagaacggccggttccggcccgctgccgaactggccgaccgcttcaagtcgctcggcgtgaacgacgcggccgaggtcggcgtgtactgcggctcgggggtctccgccgcgcacgaggtgctcgcgctggcggtcgccggaatcccggccgcgctctacgtggggtcctggtcggagtggtcggcggccggcagccgtcccgtcgccgcgggtcccgacccccag

SEQ ID NO: 2400 - DNA, 801 bp, Streptomyces avermitilis
  CDS (1)..(801)
atgaccgaggcacgggggccggccggccgcaacggcaccacagacgccgggtacacgccgggcacaccctgctgggtgagtctgatggtgcacgggatggccgcgacccaggagttctacggcgcgctgttcggctgggagttccagccgggcccgcagcagctggggccgtatgtgcgggcgctgctggacggccacgaggtggccgggatcggccagctgccgcccgaccggcacctgcccgtcgcctggacgccgtacctcgcctcggaggacgtggacgcgacggccgagaccgtgcggcaccgcggcggcacggtgggcgtcggccccctggacgccgccgaggccggccggatggccatcgcgtcggacccgatgggcgcggtgttcggcatctggcaggagtccgcacacctgggcccgaggctgaccggggtgcccggcacccccacctggaacgagctgctgacctacgactccacgagtgtcgccaagttctacgaggcggtcttcggatacgaggaggagccggtggtctccgccgacttcgactacatcaccctcaaggtcgagggccgcccggtcgcgggcatccacggcgtcggcaacgccgtcccccgcgaccgggggccgcactggatcacgtacttccaggtcgcggacgtggacgagacggccgctcaggtgacggacctgggcggtcacgtcctgcgtcccccggcggaatcggcccacggccgcgccgcgacggtggtggacccggagggggcgatgttctcggtggtcaccacgagcggc

SEQ ID NO: 2401 - DNA, 648 bp, Streptomyces avermitilis
  CDS (1)..(648)
atgcccgagctcgtgttcttctccggaacgatggactgcgggaagtcgacgttggcgctccagatcggacacaaccggtcggcgaggggcctgcagggcgtcattttcacgcgcgacgaccgtgccggggagggaaagctgtcgtcgcggctcggcctggtgacggaggcggtcgaggcggctccgggcatggatctgcacgcgtatctggtggatcagatgtcgaagggcggcaaggtcgactacctgatcgtggacgaggcgcagttcctcgcgccggagcagatagaccagctggcgcgcgtcgtggacgacctggacctggacgtcttcgccttcggtatcaccaccgacttccgtacgaagctcttccccggctcgcagcggctgatcgagctggcggaccggatcgagacccttcaggtcgaggcgatgtgctggtgcggggcgcgggccacgcacaatgcccgcacggtgggcggcgagatggtcgtggaaggcgagcaggtcgtcgtcggtgacgtgaaccgcccggcggcggaggtcggctacgaggtgctgtgccggcgccaccaccgccgccggatgaccagcgcctccgcatacgccgccgcgatctcgccggacgttctgccggtcacttccgcc

SEQ ID NO: 2402 - DNA, 1185 bp, Streptomyces avermitilis
  CDS (1)..(1185)
atggctctgcccacctgggacgacccggaaccgctggccgtcgactccgccccccttcccgagtacggtgccggttcgctggccgacctgctgcccacgctcgcggcgggcatggaggtgcccggccagcgggccgccatacaggagctgaccgccgccgaccggaactgcgtcttcctgatcgacgggctcggctgggagcagctgagggcgcacccggaggaggcgcccttcatggcgtccctcctggagtcctcgcgcggcggcacgggccgcccgatcaccgccggctatccggcgacgaccgcgacctccctcgcctccgtcggcaccggcctgccgcccggcgcgcacggcctgcccggctacagcgcgcgcaacccggagaccggcgagctgatgaaccagctccgctggcagccgtggaccgatccgcgcgcctggcagccgtaccccacggtcttccagctcgcggacgcggcgggggtgcacacggcccaggtctcgtcccccaccttccagaacaccccgctgaccaaggtcgcgctgagcggtggaacgttccacgggcggttgtccggcgaggaccgcatggacctggccgccgaacaactggccgccggggaccgctcgttggtctacacgtactacgccgaggtggacggcaagggccaccgcttcggcgtcgactcggacccgtggcgtggccagctcatgtacgtcgaccgactggtccagcgactggcggagcagctgccgccgcgctccgcgctctacgtcacggccgaccacggcatgatcgacatcccgttcgacgagcagcaccgcatcgacttcgacgaggactgggagctgcgtgccggggtcgccctgctgggcggcgagggccgggctcgtcatgtgtacgcggtgccgggcgcccaggtggacgtgctgacctgctggcgcgaggtgctcggcgagcagttctggatcgcttcgcgggacgaggcgatcgccgcgggctggttcgggcccgacgtcgacgagcgggtgtacgcgcgcatcggcgacgtggtcgcggcggcccgcgacgacgtgctgatcatcgcctccgagcgggagccgaaggagtcggcgatggtcggcaaccacggttcgatgacgccggtggaacagctggtgcctctgctggaagtacgcacc

SEQ ID NO: 2403 - DNA, 585 bp, Streptomyces avermitilis
  CDS (1)..(585)
atggccaagaccagtacgacgacccaggggctgcgtgcggcgatcgagcgcagcggctactacccggccctcgtggccgaggcggtggaggccgcgatcggcggcgaggccatccggtcgtacctggtccaccaggagacgacgttcgacgccaacgaggtgcgacggcatgtgaccgtgctcgtcctcaccggcaaccgcttcatcgtgagccacaccgacgagcaggccgccgacaccacctcgccgacgccgtacgccacgacatcgacggagtccgtgaagctcggccggatctcgtcggtcgtcgtcagccgggtggtcgccaaccccgagtcgtacaagccgggcaccctgccccgcgaggtcgtcctgaccatcggctggggcgcggtctcccgtatcgacctggagcccgccgcctgcggcgaccccaactgcgaggcggaccacggatacacgggcaactcgacggcggacgatctgagcctgcgcgtcagcgaggccggggacggccccgagacggtgcgccaggccctggtcttcgcacagtccctctccgaggccaccgcggacgtcgcgcgc

SEQ ID NO: 2404 - DNA, 2847 bp, Streptomyces avermitilis
  CDS (1)..(2847)
atgcagaccgcgtcggaccggcacgagtaccccgcccactgggaggccgacgtggtgctgcgcgacggcggtaccgcgcgcatcaggcccatcaccgtcgacgacgccgagcgacttgtcagcttctatgagcaggtctcggacgagtcgaagtactaccggttcttcgccccgtacccgcgcctgtccgccaaggacgtccaccgcttcacgcaccacgactttgtggacagggtgggactcgcggccacgatcggcggcgagttcatcgccaccgtacgctatgaccgtattaatgccgccggcctgtccgcctccgcgcccgccgacgaggccgaggtcgccttcctcgtgcaggacgcgcaccaggggcggggtgttgcctctgccctcctcgagcacatcgcggccgtcgccagggagcgggacatccgccggttcgccgccgaggtgctccccgccaacagcaagatgatcaaggtgttcacggacgccgggtacacccagaagcgcagcttcgaggacggcgtcgtacgcctggagttcgacctggagcccacggaccgttcgctcgccgtgcagcgggcccgggagcagcgggccgaggcgcggtccgtgcagcggctgctcgcgcccggcgcggtcgccgtgatcggcgcgggccgcacccccggcggagtgggccgcagcatcctcggcaacctccgcgacgctggcttcaccggtcgtctgtacgccgtgaacagggcgttccccgaggacctgaagaacttcgacgaggtgcccgcgcaccgctccgtcctggacatcgccgagcccgtcgacctggccgtcgtcgccgtgccggcggcgcacgtccccgaggccgtggccgagtgcggcgagcacggggtgcaggggctcgtggtcgtctcgtccggttacgcggagagcggccccgaggggcgcgagcgccagcgcgagctggtgcgccagatccgtacctacgggatgcgcctcatcggtcccaacgccttcggggtcatcaacacgtcccccgaggtgcgcctcaacgcctcgctcgcgcccgagacgccgcgacccggccggatcggtctgtacgcgcagtccggcgccatcgggatcgcgctgctgtcccggctgcaccggcgcgggggcggcgtcaccggggacacgggcgtgtcgaccttcgtgtcgtccggcaaccgcgcggacgtgtccggcaacgacgtactccagtactggtacgacgaccccgacaccgatgtcgccctgatgtacctcgagtccatcggcaacccccgcaagttcacccgcctcgcccggcgtacggcggcggcgaagccgctggtcgtggtgcagggcgcgcgccacggcggggccgcgccgcaagggcatgccgtacgggccacacggctcccgcacgccaccgtgtccgcgctgctgcggcaggccggggtcatccgggtggacacgatcaccgagctggtggacgcgggcctgctgctcgcgcggcagccgctgccgtcggggccccgggtggccatcctcgggaactccgagtcgctcgggctgctgacgtacgacgcctgtttggccgaggggttgcgaccgcttcccccgctggacctgacgacggcggcttcggcggaggacttccacgcggcgctggcgcgggccttggcggacgacgggtgcgacgccgtggtcgtgacggccatccccgcggtgggggagacgtcggcggccgaccaggcccttgcggaggcactgcgttccgccgctgcggcggctccggcgaagccggtgctggtggtgcacgtggagctgggtgggctcgccgaggcgctgtccgcggcggccagcaccgcaccgcagccgaccgacgtggcgggccacccgccgtcgctgccggcttcggccgagcgcggggacccgcatcgccccgcggaacgcctgtccgccgcggcgcaagcccccgacggggcccgcctcatccccgccttccccgccgcggaacgcgccgtcagggccctcgcggaagccgtcaaatacgcccagtggcggcgtgacgccgccgaccccggcaaggtgcccgagtacgacgacatcgaccagaagggtgccgccgagctgatcgaccggctgctcgcgagcggacaggggctgaccctcgggaccgacgagacctgcgcgctgctctcgcggtacggcatcggcgtacgcagggcactgcccgcgccgacgcccgacgacgccgccgaggccgcccgcgccatcggctacccggtcgccctcaaggccaccgccccgcacctgcggcaccgcgccgatctgggcggcgtacggctcgatctcgcggacgaggagcaactgcggcgcgcgtacgccgaattgaccgaaatgttcggaaagccggaggagctgcggccggtcgtgcaggggatggcgccgcgcggtgtcgacacggtcgtacgcgcggtgatcgacccggcggccggggccgtactgtcgttcgggctggccggggccgcctcgcagctgctcggggatatagcgcaccggctgattccggtcaccgaccgcgaggccacctcgctggtgaggtcgatccggacggcgccgctcctcttcggctggcggggctcggcgccggtcgacacgcctgcgctggaggaactgatgctgcgggtgtcgcggctggtggacgaccatcccgaggtcgtcgccgtgaccctggagcccgtggtcgtggcccagcacggcctgagcgtgctcggggcgaccgtacggctcgcaccgccgcccgtccgcgacgacctgggcccgagaacgcttccggtgtac

SEQ ID NO: 2405 - DNA, 279 bp, Streptomyces avermitilis
  CDS (1)..(279)
atggctgagcgccgcgtcaacatcggctgggccgagggcctccacgcccgccccgcgtccatcttcgtccgggcggccacggcctccggcgttcccgtgacgatcgccaaggcggacggcaaccccgtcaacgccggctccatgctggctgtcctcggcctgggtgcccagggtggcgaggaggtcgtgctcgcctccgacgccgagggtgcggacgcggccctcgaccggctggcgaagctggtctccgaagggctcgacgagcttcccgagaccgtc

SEQ ID NO: 2406 - DNA, 693 bp, Streptomyces avermitilis
  CDS (1)..(693)
atgcgtattccggcgcactcggtatgcacggcgatccgtgatgacatcgtcgcgggtgtctacgagcgcggcagccggctcaccgaggaactcctcgcgcggcgctacggcgtctcgcgcgtccccgtgcgcgaggccctgcgcacgctggaggcggaggggttcgtcgtcacccgtcggcacgcgggcgcgtgcgtcgcggagcccaccgagcaggaggcctccgacctgctggagatgcgcatgctgctggagccgctgggcgccgcgcgcgccgcccagcgtcgcaccgaggcccacctcaaggtgctgcgcggcctcgtcaggctggggcaggagcggtccaggagggggagcagcgaggatctgcggtccctggggggctggttccacgagacgctcgcgcaggcctccgggagccccgccctgacctcgacgctggcccagctgcggcacaagatcgcctggatgtacgcggtggaggcgccggccaacccggcggagtcctgggcggagcacggcggcatcgtggacgccgtcgcgcgcggcgacagtgagcgggcccgggcgatcacggccctgcacaccgaacgcgcgagtgcggtgcaccggctccgttttcccggcggcggagaccgcccggaacgtgtgaggacttcgcaacatcccgtaaacatgacgagcctgcggcat

SEQ ID NO: 2407 - DNA, 774 bp, Streptomyces avermitilis
  CDS (1)..(774)
atggcgttcacccgcgccaccgggaagcaccgtcgtccgggccgcacgaagcgcacgaccacgcacgccgtgggcgtcgcggcgctcaccaccaccggcgtcatcggcaccctggccgctccggcgctcgccgccgagccctccgccgaaccctccgtcgagcagaccgggctgactcaggccgtctccatcggtgactcggtcgccgcccaggtcgacgcccaggccgtcgcccaggagcaggccgccgcagaggccgccgccaagaagaaggccgaggaggccgcgcgcaagaaggccgccgagctggccgagaaggagcacgccgccaaggcgcgcgccgcccgtgaggccgagcgcaagcgtctgaacacgtttgtggccccgatcgccggctcgtacgtctccacgggctacaagtccggcggctccctctggtcctcgggcagccacaccggcgtcgacttccacgccgcgtccggcacctccgtccacgcggtcggctccggcaccgtcgtggaggccggctggggcggcgcgtacgggaacaacatcgtcatcaagatgaacgacggcacctacacgcagtacggccacctgtcgtccatcggcgtctccgtcggtcagacggtcaccccgggccagcagataggcatctcgggcgccacgggcaacaccacggggccccacctccacttcgaggcccgtacgaccgcggagtacggctcggacatcgacccggtcgcgtacctgcgctcgcacggcgtgaacgtc

SEQ ID NO: 2408 - DNA, 1386 bp, Streptomyces avermitilis
  CDS (1)..(1386)
gtgaacgagctcgcgaccatggacttccacccgcagccccaggccggcgaggccaggccctgggcgttcccggcgcccgagcgcggcacgctcgacaacggcctgaccgtgctgcgctgccagcgccccggccagcaggtcgtcgccgtcgaggtgctcctcgacgcacccctggacgccgagccggcgagcctcgacggcgtcgccacgatcatggcgcgtgccttctccgaaggcaccgacaagcacaccgccgaggagttcgccgccgagctggagcgctgcggcgccaccctcgacgcgcatgccgaccaccccggcgtacgcctgtccctcgaagtccccgtctcccgcctcccgaaggcgctcggactgctcgccgacgccctccgggcaccggcgttcgaggacagcgagatcgagcgcctggtgcgcaaccggctggacgagatcccgcacgagacggccaacccggcccgccgcgccgccaaggagctctccaaggagttgttcccggccacgtcgcgcatgtcgcgcccccgccagggcaccgaggagaccgtccagaaaatcgactcggccgccgtgcgcgccttctacgagaggtacgtacgccccgccacggccacggtggtggtcgtcggcgacctcgccggcgtcgacctcgacgggctgctcgccgagacgctcggagcctggacgggttcgtccgccgagccgcggccggtgcccccggtgaccgccgacgacagcggccgcgtgatcatcgtggaccgccccggagccgttcagacgcagctgctcatcggccgcgtcggcgccgaccggcacgaccgcgtgtggcccgcccaggtgctcggcacgtactgcctgggcggcaccctcacctcccgtttggaccgggtcctgcgcgaggagaagggctacacctacggtgtgcgggcgttcggtcaggtgctgcgctcagcccccgacggtacgggcgtcgcgatgctcgcgatcagtggctccgtcgacacgccgaacaccggccccgcgctcgacgacctctggaaggtgctgcgcacgctcgcggccgaagggctgacggacgccgagcgcgacatcgccgtgcagaacctggtgggcgtcgcgccgctcaagttcgagaccgccggggccgtcgcgggcaccctggccgaccaggtcgagcagcacctgccggacgactaccaggcgacgctgtatcaacagctcgccgccacaggcacggtggaggccaccgcggccgccgtgaacgccttcccgatggaccgtctggtgaccgtcctcgtgggtgacgccgcccagatcgcggagccggtcaaggccctcggtatcggcgaagtgagcgtcgtggcagccgag

SEQ ID NO: 2409 - DNA, 1362 bp, Streptomyces avermitilis
  CDS (1)..(1362)
atgcccatgggtcacacggccacagctgaggcaggctccggcggcctgacagcgaccgagcaccgcctggccaatggcctgcgcgtggtgctctccgaggaccaccagaccccggtggcggcggtgtgcctctggtacgacgtcggctcgcgccacgaggtcaaggggcgtacgggtctcgcccacctcttcgagcacctgatgttccaggggtccggacaggtcaagggcaacggtcacttcgagctggtgcagggcgccggcggctcgctcaacggcacgaccagcttcgagcgcacgaactacttcgagaccatgcccgcgcaccagctggagctcgccctctggctggaggccgaccgcatgggctccctgctcaccgccctcgacgacgagtccatggagaaccagcgggacgtcgtcaagaacgagcgccggcagcggtacgacaacgttccgtacggcaccgccttcgagaagctgaccgccctcgcgtaccccgagggccacccgtaccatcacaccccgatcggctcgatggccgacctggacgcggcgacgctgcaggacgcgcgcgagttcttccgcacctactacgcgcccaacaacgccgtcctgtcggtcgtcggcgacatcgacccgaagcagacgctcgcctgggtcgagaagtacttcgggtccatccccgcacacgacggcaagccccagccgcgcgacggctcgctgcccgacaccatcggtgagcagctgcgcgaggtcgtcgaggaggaggtccccgcgcgcgcgttgatggccgcctaccgcctcccggaggacggcacgcgcgtgtgcgacgcggccgacctggcgctgaccgtcctcggcggcggcgagtcctcccgcctctacaaccggctcgtacgccgtgaccgtacggccgtcgcggccggcttcggtctgctgcggctcgccggggcgccctccctgggctggctggacgtgaagacgtccggcgacgtcgaggtcccagtgatcgaggcggccgtcgacgaggagctggcccggttcgccgaggagggccccacggccgaggagatggagcgcgcccaggcccagttggagcgcgagtggctggaccggctcagcacggtcgcgggccgcgccgacgaactgtgccgctacgcggtcctgttcggcgacccgcagctcgccctgaccgctgtccagcgcgtgctcgacgtcagcgccgaggaggtccaggaggtcgccaaggcccgcctgcgccccgacaaccgcgcggtgctcgtgtacgagcccgtcgcagccgaggcggaggacgtggaagccgccgaaaccaccgacgagaacgaggagtcggcgaag

SEQ ID NO: 2410 - DNA, 2454 bp, Streptomyces avermitilis
  CDS (1)..(2454)
atggcccgccgcagcacgaagaccccgccgcccgacgacttcgaggagaggatcctcgacatcgacgtcgtcgacgagatgcagggctccttcctcgagtacgcgtactcggtcatctactcccgtgccctgccggacgcccgcgacggcctcaagccggtgcaccgccggatcgtctatcagatgaacgagatgggcctgcgccccgaccgcggctatgtgaagtgcgcccgcgtcgtcggcgaggtcatgggtaagctccacccgcacggcgacgcgtcgatctacgacgccctggtgcgcctcgcgcagccgttctccatgcgcctgcccctggtcgacggccacggcaacttcggttccctgggcaacgacgacccgccggccgcgatgcgttacaccgagtgccggatggccgacgcgacgtcactgatgacggagtcgatcgacgaggacacagtcgacttctcgccgaactacgacggccaggagcaggagccggtggccctcccggccgccttcccgaacctgctggtgaacggctcgtcgggcatcgccgtcggcatggccaccaacatgccgccgcacaatctcggcgaggtcatctcggccgcccgccacctcatccgctacccgggcgccgacctcgagacgctgatgaagcacgtcccgggcccggacctgcccaccggaggccggatcgtcggtctcaccggcatccgcgacgcctacgagtcgggtcgcggcaccttcaagatccgcgccacggtgtcggtggaggacgtgacggcgcgccgcaagggcctggtcgtcaccgaactgcccttcaccgtcggcccggagaaggtgatcgccaagatcaaggacctggtcggttcgaagaagctccagggcatcgccgacgtgaaggacctcacggaccgcgcgcacggcctgcgcctggtcatcgagatcaagaacggcttcgtgccggaggcggtcctggagcagctctacaagctgacgccgatggaggagtccttcggcatcaacaacgtcgccctggtggacggccagccgctcacgctcggcctcaaggaactccttgaggtctacctcgaccaccgcttcgaggtcgtacggcgtcggtcggagttccgtcgcggcaagaagcgcgaccgtctgcacctggtcgagggcctcctcgtcgcgctcctggacatcgacgaggtcatccgcctcatccgctcaagcgacaactcggcgcaggcgaaggagcgcctgatcgagcgcttctcgctgagcgaggtgcagacgcagtacatcctggacacgccgctgcgccggctcaccaggttcgaccgcatcgagctggagtcggagcgcgaccggctgaacggcgagatcgacgagctgaccggcatcctggagtcggacgcggagctgcgcaagctggtctccggcgagctggccgcggtggccaagaagttcggcaccgaccgccgtacggtgctcctggagtccgccgggtcgacggccgccaccgtgccgctccaggtggcggacgacccgtgccgtgtcctgctgtcctcgacgggcctcctcgcccgtacggcgaacggcgcccccttcggggaggacgccgacggcaggcgcaccaagcacgacgtgatcgtgtcggcggtcccggcgacggctcggggcgaggtgggcgcggtgacgtcctccggccgtctgctccggctgaacgtgatcgacctgccacggctgccggagaccacatcggcgcccaacctctccgggggcgcgccgatttcggagttcctctcctcgctggagggggacgagacggtggtctgtctgacgacgctcgacgagtcctcgcccggcctggccctgggcacggaacagggtgtcgtgaagcgcgtggtccccgactacccctcgaacaagggggagttggaggtcatcacgctcaaggacggcgaccggatcgtcggcgcgatcgagctgagcacgggcgaggaggacctcgtcttcatcacggacgacgcccagctgctgcgctaccaggcctcccaggtgcgcccgcagggccgtgcggcgggcggcatggcgggcatcaagctcacggacggcgcgaaggtgatctccttcacggcggtcgacccggcggccgatgccgtggtcttcacggtggcgggctcgcgcggcacgctggacgactcggtgcagaccacggccaagctgacaccgttcgaccagtacccgcgcaagggccgtgccacgggcggcgtgcgctgccagcggttcctgaagggcgaggactgcctgtccatcgcctgggcgggaccggtgcctgcgcgggccgcgcagaagaacggcaccccggcggagctgccggagatggacccgcgccgcgacggctcgggtgtgtcgctggcgaagacggtggcggtggtggcgggaccggtg

SEQ ID NO: 2411 - DNA, 1083 bp, Streptomyces avermitilis
  CDS (1)..(1083)
ttgagccagtcgtcgagtccgcagcagatcccggtcgtcgtcctcgccggattcctgggctccggcaagaccaccctgctcaatcacctcctccatcgcagcggagggagccggatcggtgccatcgtcaacgacttcggtgccatcgagatcgatgccatggccgtcgccggggctctcggtgactcgaccgtctccctcgggaacgggtgcctgtgctgtgccgtcgacgccggcgaactcgacctctacctggagcggctcgcgcacccctccgcgcgtgtcgacgtcatcgtcatcgaggccagcgggctcgcggagccccaggagctggtgcgcatggtgctcgccagtgagaatgcgcgggtcgtgtacgggggcctcgtcgaggtcgtcgacgccgccgagttcgacgccacgcgcgcgaagcatcccgaggtcgaccggcacctcgccatggccgatcttgtcgtcgtcaacaagatcgatcgggcggatgacggggagcgggtgctccgggccgtccgctcactcaccgaccgagccgccgtcgtgcccgccacctacggccgggtcgaccccgagctcctcttcgactgccggcccacgggggagcgcatcgggcagctttccttcgacgacctgcacgaacaccgcggtgaggaggaccatcacggtcacctgcacgccgcctacgactccgtctccttcacctccgaagcgcccatgaatccgcgtcggatgatggacttcctcgacagcaggcccgaggggctgtaccgcatcaaggggtacgtcgacttcggcaccgccgatcctcgcaaccggtacgccgtgcatgccgtcggccggttcctgcggttctacccggagccctgggcgcccgccggcccccgcctcacccagctcgtcctcatcgggtccggcatcgacacggccgccctgcacaaggagctggacgcgtgcacgaacgacgccccacacgccgacgagcacagcatgtggggcgtcctccgctacgtacaggagcaggagcaggagcaggagcaacggcaggagacggccgaggccgagcaggccggc

SEQ ID NO: 2412 - DNA, 519 bp, Streptomyces avermitilis
  CDS (1)..(519)
atggccacacagaactctgggatgcggaggctcggctccgccaccagggccaggctcgcggtcgcggtcagcgcggtcgtggaacgcagcacgcgccagcgtcggcgcgccgtactcaccgaacagcaccgcctccacttcgacctgctgtgcaaggccatggacgaccctgcgctggcggcggtcctggatacgtacgagcgcgagatcccgccggagacacagcgccagtacctcttcgcgaacgctctgtacgtcaacgccctgtacttccaccggatcggcgctctgaacctcgtcgaactccacggacaccttcgcgtgatctgccgcaaccggatcttccgtgagtactggaccgccacgcagcaccatcgcgagagcctgcccgattcgtccgaagaggccgcactgggtcggatgaccgagggtctggtgcaggaattgaacaacttggccgacgacacggacgacggcgatctcgaggagtggtgggtggtggggcaaccgccaggcgag

SEQ ID NO: 2413 - DNA, 327 bp, Streptomyces avermitilis
  CDS (1)..(327)
atgagcttcactggacgcgagagaaaggtcatcagcccgcgcagcgtccggcgcgccctctcggcccgtccctcgaccgacctaggaacggacttgaagatcgtgcgtcgagtcggcgcctcgccccgggagcgcgggagcgcttcggggcagacctgccccgacatcttcgaactcagcgacggaaacttcgctgtcatcggcaccgaagccacagctgaccttgacggcgaactgccgcccgacgcagcgcgcgcagagtacgaacgcatcgttgtcatcagccgcgagacgctggtgcgagccaaggcggacattccggatgcg

SEQ ID NO: 2414 - DNA, 1164 bp, Streptomyces avermitilis
  CDS (1)..(1164)
atgccgatcaaccgggccgcatccacttctgtcgacgtcccacggggccttgccggcgttgtcgtcaccgacacctcattgggtgatgtcagagggctggaaggcttctaccactaccgccagtactcggccgtcgaactcgcgcagacccgcggtttcgaggacgtctggcatctgatggttcatggcgaactgccggacgcggagcagcgggccgtcttcaccgcgcggaccgcggcgctgcggtggctgccggatggggtgagggccacgctgccggccgtggccgccgccgcgggccgctccggaccgctcgccgggctgcgcacggcgctgtccctgctcggtgccgccaaggggttccggccggtgtacgacatcgaccgggaacagcgccgcgccgacaccgtcatggcatcggccgccgtgcccacactcctgacggcgctgtaccgactcgggcaggggctggatcccgtggagcctcgcgaggacctctcctatgcggcgaactacctctacatgttgacgggctcggagccggacgcggccaggaccagggcgatcgagcagtacttgatctcaaccattgaccacggattcaatgcatcaaccttcacagcccgagtgatcacatcgacgggtgcggatgtggcggcggccctggtgggcgcggtgggagcgctgtccgggccgctccatggaggggcgcccagccgggccctcgacaccctggacgcgatcggtacgcccgagcgcatcgactcctggatacgcgagcgcgtcctggccggcgaccgcatcatgggcttcgggcaccccgtctaccgcacggaggacccccgctcccgcatgctccgcggcgtcgcggagcagttcggtggcccgctggtggacttcgcggtcgaggtcgaacgccatgtggaggcgatcctcgcggaactgaagccgggccgtgaactccacacgaacgtggagttctacgcgggcgtggtcatggaactctgcggcctgccacgggagatgttcactcccacgttcgcggcggcccgggtggtcggctggagcgccaacatcctggaacaggcggaggacccgaagatcatccgaccggcggcccggtatgtggggccggtaccgccggtggcggtgccactgatggtt

SEQ ID NO: 2415 - DNA, 1254 bp, Streptomyces avermitilis
  CDS (1)..(1254)
atgacggaccacgaagccgcgcccacgcaccccgatcggcgactgagcaccaaagaggccgccgaactgctcggcgtgaagcccgagaccgtgtacgcctatgtgagccgcggccagctcagcagccgccgcgagcccggcgggcgcggcagcaccttcgacgccaaagaggtggcggcgctcgcccggcgcaacaggcgtgagccgagcgggagttcggccatcggcggcgagctgtccgtccgcacacggatcaccctcatcgacaaggaccggtacttctttcgcggcgtcgacgcgaccgaactcgccgcgcggcactcctacgaggagatcgccgagtggctgtggaccggtcggctgcggcccggagtcacctttgccgctccggacgcgtccgtcgccgtcgcccgccgcgccgtcgatgccctgcccgagcacagcggtccgaccgaccggctgcgcgtcgcgacgatcgccgccgcgaccgcggacccgctccgcttcgacctgtccgaggacgcggtcctcggcaccgcacgcaccctcatccccaccctcgtggccgccctcccgcccctgcgccgcgaccaccgcgacgagggcccgctcgcccggcacctgtggggacggctcaccggccgcgcacccgacgcggcatcagttcgcgtactggacacggcactcgggctgctcatcgaccacgacctggccgcctcgacgctcgcggtccgtgtcgccgcctcggccagggcccacccgtacgctgccgtctcggcgggtctcggcgtgctcgagggccccctgcacggcgcggccagcggcctcgcgcaccggttgctcctggacgtcctggaccagggcagcgcagcccccgtggtcgccgacgaactgcgtgccggtcgccgtatccccggtctcggccaccggctctaccccggcgaggacccgcgcgcgcgtgctctgttcgccctcctggaagaggtacccgacgcggcccccgcccttgccgctgcccatgacgtcgtggccaccacggcccgccacgcgcccctgcacgccaacgtggacctggctctcgcggtcctcacggtctcctccggcatgcccgcctccgccggcgagaccgtcttcgccgtcgcccgtacggcgggctggatcgcacatgccctggaggagtacgaggagcgtccgctgcggatgcgcccgagtggccgatacgtaggggcgcggcctccgcaaccgctcccccgg

SEQ ID NO: 2416 - DNA, 945 bp, Streptomyces avermitilis
  CDS (1)..(945)
gtgagtacgtgcgcgaccgtgtcccgggacctcgacgagcccctcgcggggaccgcggcgaccgcgaggacatggctgctcctcgaacagcccggcccctggggcaccaaggcgctcacttcgagccacctggaccaggcgctcggccgcgctctcgaagcggccgccgaggggaccggcgtacggatcgcgctcatccgccgccccggccgccacgccgactgcggcacgccggccgtacgacaggtgtacgcggcccacacggttcccggaaacgtatggctgcacggcgccatgacgtccgatcccgagcagttgctcgacctcgacttcaccgcgctcggcatgggcgacccgcacaccttcgacagactcctagggggccgtccccacacgggcgaccccctcgccctcgtctgcaccaacggcaagcgcgaccgctgttgcgccctcctcggccgccccctggcagccgaactggccgcctccggagtgaccggcgcatgggaggtcacccacctcggcggccaccgtttcgcccccacgctgctgatcctgccgttcggctacgcgtacggccgggccgaggccccgcacatcaaggaggtcctccagggcgtacgcgaagggcgtgtggtcgtcgagggatgtcgcggtcgctccgcctgggagcggccgggacaggccgcggagctggcggtgcgtacggcggcccacgagtacgccgcggacgcgctgaccgtcgtcgccacggacggcaccgcaccacgctgggaggtcaccgtcgcccacgccgacggccgcctctggcgcgtcatcgtggcccagggcgcctcgctgccaccccgcccggaaagctgcggctcggcgctcggctccccggcgcgcatggacgtggtggcggtacgggagctgattcccacggagatcgacgccacgtcccgc

SEQ ID NO: 2417 - DNA, 1725 bp, Streptomyces avermitilis
  CDS (1)..(1725)
atgagccccactccccctgtacgacgactgcgcctgggtctgccccggcgggtgttctcgcaggtcctgctgatgcaggtgtcgatcgccgcaggtgtcgccgtactcgcgaccgggctgttcctcgccccgctcagcgcccagctggacgaccaggcgatgcgcagggccctcgcgatcgcgcagaccacggcggcccagccgcagatcgccgaggacttccaggcgacacggccgtcggtcggcgggcccgtgcagaccgaggccgagcggatccgtaaggccagcggggccgagtacgtcgtggtgatgaacatggacggtgtgcgctggtcgcacacggacccgacgcagatcggcaaggtcgtctcgaccgaccccagggaggccctggcgggcaaggacgtcatgcagatcgacaacggcaccctgggccgctcggcccgcggcaaggtgccgctgcgcaacgccgacgacaagatcgtcggcgcggtctcggtcggcatcgagtacgacagcgtgcgagcccggctgatcctcgccataccggggctgttcgcatacgccggcgccgccctggccataggcgcggtggccgcctacctgatctcccgaagggtgcagcggcagacgcgcgacctggcgttctccgacatctcggcactgctcgccgagcgtgaggcgatgctgcacagcatcagggagggcgttgtcgccctggaccgcggcggccgcgtacgcctcctgaacgacgaggcgcagcgcctgctcgggctcgacgcggaggccatcggtcagtcgctggacgacacgctcggaccggggcgtacgaccgatgtgctggccggacgcgtcacgggcaccgatctgctcaccgtgcgcggccagcgcgtactggtcgccaaccgcatgcccaccgacgacggtggcgcggtcgccacgctgcgcgaccgcaccgagctggagcaactgggccgcgaactcgactccacccggggcctgatcgacgccctgcgcgcgcaggatcacgaacacgccaaccgcatgcacacgctcctcgggctgctcgaactggacatgtacgacgacgccgtggagttcgtcggcgaggtggtcggcgaccaccggaccaccgcggagcaggtcaccgagaagatccacgacccgctgctcgccgccctgctggtagggaaggcgaccgtcgccgccgagcggggcgtggccctgtggatctcggaccgcaccctgctgcccgaccggctgatcgaccccagggggctggtcaccgtcgtcggcaatctggtcgacaacgcgctggacgcggtcgcgggcacaccgcacgcgcgcgtggaggtcgaattgcgcgccgagggtcgtacgacggttctcagggtgcgcgacaccggacccggaatccccgtggaacggcgagagttgatcttcacggacggatggaccaccaagaagccgccggcccacggcaaacgcggcatcggtctctccctggtgcgccgtctcgccgaacggcagggcgggagcgcccgggtggacgaggcggacggcggaggcgcggagttcaccgtcgtactgccggaggcgctcaccgaacccgctccggcaccggagacggctcctacggaggactctcttccggggaacacccctacggaagaactgattccggcgccggacacctcggcgccgaccaccaaggaggagtcgcga

SEQ ID NO: 2418 - DNA, 687 bp, Streptomyces avermitilis
  CDS (1)..(687)
atgacccggccgatcgaagtcctggtcgtggacgacgacacccgagtggcgcgggtcaacgcggcctatgtacagaaggtggccggcttccatgtcgcgggcgaggcgcacaacgcggccgaagccctgcgccagatggagacactgccccacctggatctggttctcatggaccactatctgccggacgagacgggtctcgcggtcgtccaggagatgcgcaggcgcggccaccagaccgacgtgatcatggtgaccgcggcccgtgacatctcgaccgtccaggcggcgatgcggcacggcgcactccagtacctcgtcaagcccttcgccttcgcgggcctgcgcgccaagctggaggcatacgcggagctgcgtcgcacgctggacggcggcggcgaggccgaacaggccgaggtggaccggatcttcggcgccctgtcagcgggctcggagccggggttgcccaaagggcactccccgaccaccgcggagctcgtgcgtcgcgccctggtggccgccgagggccccctgtcggcccaggagatcgccgaacggaccgggctgagccgccagaccgcccagcgttatctgaagctcctggaacgcacgggacgggccacactgaccctgaaatacggcgacgcgggccgcccggagcatcgctacgtgtgggcgacccgcgtc

SEQ ID NO: 2419 - DNA, 1059 bp, Streptomyces avermitilis
  CDS (1)..(1059)
atgcgcatgaccgccagatacaccgccctggcagcggccggcctgctcgctctctcctccctcaccgcctgtgccaacgacgcggcgagcaccgcgtcgtccggttccggcagcaagggcgacggcaagggcgtgaaggtcaagatcatggtcggcggcctggacaaggtcatctaccttcccgcgatgctcacccagcggctcggctacttcgacgccgagggcctcgacgtggagctgctgagcgagcccgccggcgtgcaggcggagacggcactcgtctccggacaggtgcagggtgccgtcggcttctacgaccacaccctcgacctgcagaccaagggcaaggacgtggagtccgtggtgcagttctcgcatgcgcccggtgaggtggagatcgtctccaacaggcatgccgacgacatcacgtcgcccaaggacttcaagggcaagaagctcggcatcactgggctcggctcctcgaccgacttcctcaccaaatacctggcggtcaagaacggcgtcagcgtcagcgagttcagcccggtcgccgtcggcgcggggccgaccttcatctccgccctccagaagggttccatcgacggcggcatgaccacggacccgacggtcgccaacatcctggcgaagaacctcggcaaggtactcatcgacatgcgtacgccgcgtgggtcgaaggaggcgctcggcggtccgtacccgtcgtcgagcctctacatgcagacggagtgggtgaacagccacaaggacaccgtccagaagctcgccaacgccttcgtgaagaccctcaagtggatgtccacgcacaccgcgtcccagatcgccgagaagatgcccgccgactactcccagggcaacaagacgctctacgcgggggcgatcaagaccacgctgccgatgttcacggacgacggcgtgatgcccaaggacggtcccgagacggtagagagggtcctcaaggccttcaatcccaacatcaagaacgccaagatcgacctgagcaagacgtacaccacggagttcgtcgagaaggtcaccggc

SEQ ID NO: 2420 - DNA, 891 bp, Streptomyces avermitilis
  CDS (1)..(891)
gtgagaggggtgccgcccatgtcgcctgacctcatgcccggggccgtcgtcgcggtgaccgccaccgagaccaccaagacgggccgcgcgcattcacgcgcgcgtgccgcccgcagacgcaaggtcgtcatcaccctcgcccgggccctgctcctggtggccgtgctcggtctgtgggaggcgtgcgcccgggccaaggtcatcgaccccttcaacttctcgatgccctcgaagatctgggaccagatctacacctgggtcacccacggcaccgcgctcggctccctgggcgagcagatctggttcacgctccatgaggcgctgctcggctgggtcatcggcgtagtggccggtgtcgtcttcggcattgcgctcgggcgcatcaacttgctcgccgatgtccttggtccatacatcaaggtgctcaactccataccgaggatcgtgctggcaccgatcttcgtgatctggttcgggctcgggccggcctccaaggtcgcgtcggccgtggtcctcgtgttcttcccggtcttcttcaacgccttccagggcgcccgcgaggtcgaccgcaacctggtcgccaacgcccgcatcctgggcgccagcgaccgcagggtgacacttcaggtcgtcattccgtcggcgacctcgtggatcttcaccagcctccacgtcagcttcggcttcgcgctcatcggcgccatcgtcggcgagtacatcggtgccaccaagggcatcggtctgctcgtcgcgcagtcccagggcaccttcaacgcggcaggtgtgtacgccgcgatggtcatcctcgccgtggtcgcgctggtcgccgaggggttgctcaccttcgccgagcgccgcatcttccggtggaagccgtcggattccgagcgc

SEQ ID NO: 2421 - DNA, 849 bp, Streptomyces avermitilis
  CDS (1)..(849)
atgctgtggcccgcgccacatctacggtcccggcccatgagcgcagacaccagccccgccatcgagctgcggggcgcgagcaagatcttcaagaccccgtccggggggctgcacacggccgtcagggaactggacctgaccgtcggccgtggcgagttcgtggccgtcgtcggccccaccggttgcgggaagtcgaccacgctgaccctcgtcagcggcctggaagagcccaccgagggtgaagtcctggtgaccggcgagccggttgccggtgtcggcgacaaggtcggcttcgtcttccagcaggacgccaccttcccctggcgtacggtcctgtccaacgtcatggcgggcccgcggttccgcggcgtaccgaaggcggaggcgaagcagaaggcgcgcgagtggctggcccgggtcggcctcacggccttcgaggaccgctatccgcaccagctctccggcggccagcgcaagcgcgtcgccctcgccgccaccttcgtcaacgacccccagatcctgctcatggacgagcctttctcggcgctcgacgtgcagaccagggcactgatgtcggacgagctgctggagctgtgggagggcacgggtgcctccgtcgtcttcgtcacccacgacctggaggagtccatcgcgctggccgacaaggtcgtcgtgatgaccgcgggtcccgcgaccgtgaagcaggtcttcgacatcgatctgccacggccgcgcaaggtcgaatcggtgcgcctggagccgcggttcatcgagatctaccgcgagatctggtcgtccctcggcgaagaggtccgcatcacccgtgagaggggtgccgcccatgtcgcc

SEQ ID NO: 2422 - DNA, 690 bp, Streptomyces avermitilis
  CDS (1)..(690)
atgattgacgtcctggtcgtggacgacgacttccgtgtcgccgagataaacgccaagtacgtgggaaaggttcccggcttccgggtggccgcccgcgcgcacagcgctgcccaggccctggccgcggtggagcgcgcgcccatcgacctggtgctgctcgaccactatctgcccgaccagacgggtctcgagctggtccaccgcatgcgcgaacgcggtcacggcaccgacgtcatcatgatcactgcggccagcgacgtgacgaccgtgcaggcggcgatgcgtctgggcgccctgcactatctggtcaagccgttcaccttcgcggcgctgcgcacccgcctcgactcgtacgccgccctgcgccgcaccgtcgaccgtgtgggcggccggggcgtggcgggacaggagcaggtcgaccgcatcttcggcgccctgcgcacgacaccggccccgtcgtcgcccgggctgcccagcggccactcggagccgacgacggacctgatctgcgacgtcctccaccaggccgatcaccccctgtcggcccacgaggtggccgccgagacgggcctgagcagatccacggcccagcgctatctgcgtcacctggaacaggtgggacggctacggctctcactcaagtacggcgacaccgggcgaccggagcaccggtacgcgtgggtggcgccg

SEQ ID NO: 2423 - DNA, 1590 bp, Streptomyces avermitilis
  CDS (1)..(1590)
gtgaccggccatcatcagacgctggcgctgctgctgttcagcggtttcgttgcggtgacactggcgatcacgacgtgggtgagccgtcaccggcatggttcggcggaggagttctacgcgggcgggcgcctgttctcacccatggagaatggttttgccatcgcgggcgactacatgtcggccgcgtccttcctgggggtcacagggctcatcgcgctctacgggtacgacgggctgctgtatgtggtgggcttcctggtcgcctggttggtggtgcttttcttggtcgccgaactggtgcgcaactgcgggcgcttcaccctcgcggacgtggtcgcggcgcggatgagcgagcgtccggtgcgcatcgcggcgggaacttcgtcggtgaccgtgtccgttctgtatctggtggcgcagatggtgggggcgggcagcctggtcgcgctgctgctcgggggttcaagcggggcagcgcgcgcctggacggtgatcggcgtcggcgcgctcatggtgatctatgtgtcgatgggagggatgcgggccaccacctggatccagatcgtcaaggcggtgctgctgctcagcggcacgatcgcgctgaccgtgctcgtgctggtgcggttccaaggggacttcgaccaattgctgcgtacggcgatggagcgcagcgggcacggtgaggccttcctcgcgccagggctgaagtacggcggggactggaccgcgcggctggacttcatcagtttgggcctggccctggtgctcggtacggcggggctgccgcacatcctgtcccgcttctacaccgtgccgaccgcacgcgccgcgcgccgctcggtcgtctggtcggtcgggctcatcggcggcttctatctgatgacgatcgtgctgggcttcggtgcggccgcgatcgtcggacccgaggccgtgcgcaggtcgaacgcggcggggaacacggcggttccgttgctggcgctcgatctgggcggtgggacgaattccaccggaggaacggttctgtttgcgatcgtcgccgccgtcgcgtttgccacgattctcgcggtcgtcgccgggatcacgctcgcctcctcggcgtccgtggctcacgatctctacgcgtcgctgcggcgtcggcatgcgaagccgcggagcgaggtggccgtcgcacggaccgcggcggtcggtgtcggcgtggtcgcgatcgccctcggactgctcgcccgggatctcaatgtggccttcctggtgggcctggccttcgcggtcgccgcgtccgcgaatcttccggtgctcatgtattcgctgttctggcgcagcttcaccacacgtggcgcggtgtggtcggtctacgggggcctggtgcccgcgctggggctcgtgctgctctctccggtggtgacggggagccccgaatcgcttttcccgggcgtcgacttccagtacttccccttgcagaaccccggcatcgtgtccatcccgctgggcttcctcgcgggctggctcggcacggtcacttcggtggagccggcggacgaggcgaagcacgcggaggccgaggtgcggtcgctcacgggggccggtgcggtc

SEQ ID NO: 2424 - DNA, 528 bp, Streptomyces avermitilis
  CDS (1)..(528)
ttgggcacgtggccgaaacgggctgcggacaaggagagttcggtggagaagcaggacggccgcgacgccggagaggtcggcttcgacgacccctggtacgacgcgctcgcctccggctggggcgagttggacagtacgggggcgcccgctcccgtggtgccgcccgcgcgccgggagcacgagggccgggtgggtggtgcggccgacgtctatctggaggtgcagcgaagcgctgccttccaggaggtgcgcagccggtatcgcagatttgtggttccaggcgtgatcgtgttcttcacctggtacgtgggctatgtggtgaccgctacgacggcgcccgggctgatggcgcgccccgtggccggctcggtgaacgtgggcctgctggccgggctcggtcagttcctcaccacgttcctgttcacctgggcgtacgcgcggcacgcccggctgcgcagggaccgggccgcgctcgacctgcgctgggacacccaggagctgacgcggagtgcgggaggtggtcagctg

SEQ ID NO: 2425 - DNA, 681 bp, Streptomyces avermitilis
  CDS (1)..(681)
atgacggaggaggagagccggaagccggcgcgggtcgtggtggcggacgatcagaccgtggtgcgcgagggcatcgtcatgctgctggggttgctgcccgggatcgaggtcgtcggcgcggccggtgacgggcacgaggcagtgaagctggtcgccgaactcaacccggacgttgtgctgatggacctgcggatgccacgctgcgacggtgtcgaggcgacccggcggatccgggccgagcaccctgggacccaggtcgtcgtgctcaccacgtacgccgacgacgagtcactgtttccggcgctcagagcgggcgctcgtggctatctcaccaaggacgcgggcggcgacgagatcgtgcgggccgtggagagcgtgctgtcgggggacgcggggctctcgccgagtattcaacggcggttgctggagcggctgtcggagccggaacggggacaggccgcatcctcggaggtaccggacgggctcaccgcacgggaggcagaggtgctcgtgctgatcgccgagggcctcagcaaccacgagatcgcacgcaggctccatgtctccaccgccacggtgaagacccacatcaacaatctcttcgccaagacgggactcaaggaccgtgctcaggcggtccgttacgcctatgggaagggacttgtgcggccccccgccgag

SEQ ID NO: 2426 - DNA, 1152 bp, Streptomyces avermitilis
  CDS (1)..(1152)
gtgacgaccgagagcgcctggacacgctggccctcccgtgaggcactcgggcgggaagggctctcgcggcctcggcgcatgctcgcctggaccgtgcgggcgctggtcctcgccatgctgctgtggggtgccttcagcagcagccacgtgcacggctggggtgcggtcgcagccgcggcgggtgtgctcctggccgcaggcgcctcctgggccttcttccgcaccacacttcagcaccggctctggccgtcgctggcgttgatcgcggtgcttctcggaatcgcgatcgtggcgcagaccgccggcttccaggtccctgccctcgtcatctggtgcgggtgtgccgtcagtgcgctggagcggcttcctctcgcggccgccctgcccgtgaccacagctgccctggcggcgtatgcggcggtcgacaacgatgtgtggctgaccaccgccgccaccatcgcggggctatttctcgccgggtatgtgctgcgtctcgacgccgaggctcgtgggagcgcccagcgtctgctcgctcaggagcgcgcggcgcgggcggccgagacgcagtcggcggcgctggcggagcgagccaggatcgcgcgggagattcatgacgtgctggcgcacagcctctcggcgcagctggtgcatctggaggcggccaggttgctgatcgagcgaggagccgaccgggagcagatactcgggcgggttgtggcggcacgcgggatggcgcgcgagggcctcgccgagacccggcaggcgctctccgcgctgcggggcgagatatccccgctcgaggacttcctgagcgagctcgtcgccttcgaggacggcgcggacgtcaccgtctcgggtgagcggcggcttttgacggccgaggcctcgcaggcggtgcgcagggtcgcacaggaagccctgacaaatgttcgtaagcacgctccgggcgcgaaggtgcaggtgaagctggagtacggcgagcgtcaagtgacgctgcatgtgcgggactcgggcgggaagccgggcgatctcaccggctcgggggccgggtacggtctgctgggcatgcgggagcgtgcggagctgctgggaggctcgttggaggccggccgggaggagaaggggttcgtggtgacgctgaaggtgcctgca

SEQ ID NO: 2427 - DNA, 546 bp, Streptomyces avermitilis
  CDS (1)..(546)
gtgatgtccgggctcacccatgccctcctgatcctcgccgtcgtcgtgctggtcgtcgcccggcagttccgcatgcaaaagatcaacgcggaccggcgctggtggatcgttcccgccgtgctcgctttcctggccgtgcgcgagcccggcctgctcgacgcccaccaccgcacggggtcggggatactgctcggcgccgaactgctcataggcgtcgccaccggcgtcggctgggcttggacgacccggatatggacggacgcggacggcaccgtgtggagcaagagcaccaaggcgagcgtgggggtgtggatcgtcggcatagtcctgcgcgtcggactgttcggcctcggtgtgctcctcggcgtgcgccaggagagccccgcgctgcttctcgccctcgcggcgacgctgctgctccgctccggggtcctgatctggcgggtgcattccctgggtccggcggacggtgggagcagggcatacggtgacggcgtcgcccagccctcgtggagcgtgcctcagccctcgcggaaggagcgagtg

SEQ ID NO: 2428 - DNA, 189 bp, Streptomyces avermitilis
  CDS (1)..(189)
atggtgtcccgtcggtcccggtgggtggccccaccctcgctcacagccccagcgcaggtgagcagggccatctgcgctggccgccgacggtgtccgtcggggttctccacccgcgggtggagaaccgtctcactgagggatccacccacgatccaccccggctccgatctgctgacctgccgatttccg

SEQ ID NO: 2429 - DNA, 2121 bp, Streptomyces avermitilis
  CDS (1)..(2121)
gtgaccgccgatacgtccgtgccgtccacagcgctgctgaccggagcagaccgggacggttccaactacaccgcgcggcacctgctcgtccttgaggggctcgaggccgtgcgcaagcgccccggtatgtacatcgggtcgaccgacagtcgcgggctgatgcactgcctctgggagatcatcgacaactccgtcgacgaggctctcgggggttactgcgaccacatcgacgtgatcctgcacgacgacggctcggtggaggtgcgggacaacggccgcggcatcccggtcgacgtggaacccaagaccggcctctccggcgtcgaggtcgtgatgaccaagctgcacgcgggcggcaagttcggcggcggctcgtacgcggcctccggaggtctgcacggcgtgggcgcctccgtggtgaacgcgctctccgcgcgcctggacgtcgaggtcgaccgcagtgggcacacgcacgccatcagcttccggcggggtgtcccgggcgccttcgcgacggtcggcccggatgcgaagttcgacgcgaccgccggcctgcgcaaggccaagaagatcccccggacgcggaccggtacgcgcgtgcgctactgggccgaccgccagatcttcctcaaggacgccaagctttccctggagaacctccaccagcgtgcccgccagacggcgttcctggtgccgggtctgaccatcgtcgtcagggacgagtacgggctcggggagggcggcagcaagggcgaggagtcgttccgcttcgacggcggcatcagcgagttctgcgagtacctggccactgacaagccagtgtgcgacgtcctccgtttctccgggcagggcaccttcaaggagacggtcccggtcctcgacgaccacggtcagatgacgcccaccgaggtcacccgtgagctcggcgtggacgtcgcgatgcgctggggcaccggctacgacacgaccctgaagtcgttcgtgaacatcatcgccaccccgaagggcggcacccatgtcgccggcttcgagcaggctgtcaccaagacggtcaatgaagtcctgcgtgccaagaagctgctgcgcgtcgccgaggacgacgtcgtcaaggacgacgccctggaggggctgacggtcgtggtcacggtgcgtctcgccgaaccgcagttcgaggggcagaccaaggaggtcctcggcacctcggcggcccgtcgcatcgtgacgaatgtggtctccaaggaactcaaggcgttcctgacctccacgaagcgggatgccgccgcacaggcccgggtcgtcctggagaaggctgtcgccgccgcgcgtacgcgcatcgcggcccgccagcacaaggacgcgcagcgccggaagacggccctggagtcctcctcgctgcccgccaagctcgcggactgccgcagcgacgacgtcgagcgcagcgagctgttcatcgtcgagggagactccgcgctcggtactgccaagctcgcccggaactccgagttccaggcgctgctgccgatccgcggcaagatcctcaacgtccaaaaggcctcggtcacggacatgctcaagaacgccgagtgcggggcgatcattcaggtcataggagcggggtccggccggaccttcgacatcgacgcggcgcgctacgggaagatcattcttctcgtcgacgccgatgtcgacggtgctcacatccggatcctgctgctgacgctgttccagcgctacatgcggccgatggtcgaggccgggcgggtgttcgccgcggttccgccgctgcaccggatcgaactcagccagccgaagaaggggcaggacaagtacgtctacacgtactcggaccgggagctgcgggagacgctgctggagttgcagcgcaagaatgtgcgctacaaggactcgatccagcggtacaagggtctgggcgagatggacgcggaccagctggcagagacgacgatggatccgcggcaccgtactctgcggcggatcaacatttccgatctggaagcgtccgagcaggtgttcgatctgctgatgggcaatgatgtggctccgcgcaaggagttcatctccagttcggcggccacgttggatcggtcgcgaatcgacgcg

SEQ ID NO: 2430 - DNA, 816 bp, Streptomyces avermitilis
  CDS (1)..(816)
atgcgtcgtcccttcgcccgagcgctggcccttggggccgcagcggccgtgataccgctggcgtcccccgcgcccgcgacggccgacagcattgtcatcggcggctatccggtcgagaccgcccagagtccgtggacggtcgcactgtccagccgtgaccggttcggaggtacgcgggcggggcagttctgcgggggcgtggtgatcgcccggtccactgtgctcaccgcggcccactgtctgagcgcggccgtcctgggggcgccgccgagccggattcgcgatctgaggatcatcgccgaccggaccgacctgctgtcgacccagggcaaggagatcccggtgcgcgccacctgggtcaacccggattacgacagttccacgaacgccggcgacttcgccgtactcaccctggcctcgccgcttccggagagctccgtcatccccatggcctcctcggccgacccggcctacgcgcctgggacggccgccgtggtctacggctggggcgacgccaccgggagcggcgactatgcccacagcctgcgcgccgcgcgcgtgcaggtgctgccggacgaggcctgtgaggaggcgtatcccggcgatggggacggaaagtatctggccggctccatgctgtgcgccggagagctcgcaggtggccgtgacgcctgtcagggggacagtggcgggccactggtcgcccaggggcgtctgatcggactggtgtcgtgggggagtggctgtgggaggcccggaagcccgggcgtctacacgcgggtctcagacgtcgccagggcgttcggcaggagtcgc

SEQ ID NO: 2431 - DNA, 1536 bp, Streptomyces avermitilis
  CDS (1)..(1536)
gtgtcggccagcacatcccgtacgctcccgccggagatcgccgagtccgtctctgtcatggcgctcatcgagcggggaaaggctgaggggcagatcgccggcgatgacgtgcgtcgggccttcgaagctgaccagattccggccactcagtggaagaacgtactgcgcagcctcaaccagatcctcgaggaagagggtgtgacgctgatggtcagtgccgcggagcccaagcgcacccgaaagagcgtcgcagcgaagagtccggccaagcgcaccgccaccaagaccgtcgcggcgaagacggtgactgccaagaaggcgaccgccaccgccgccccggctgtgcccgtcggcgacgatccggctgaggacgcgtccgccaagaaggcagctgccaagaagacgaccgccaagaaggcggtcgcgaagaagaccgtcgccaagaagacggcggccaagaagaccaccggcaagaaggacgacgtcgagctgctcgacgacgaggcggtcgaggagaccgctgcacccggcaaggccggcgaggagcccgagggcaccgagaacgccggcttcgtactctccgacgaggacgaggacgacgcgcccgcgcagcaggtcgccgcggccggtgccaccgccgacccggtcaaggactacctcaagcagatcggcaaggtccccctgctcaacgccgagcaggaggtcgagctcgccaagcgcatcgaggcgggcctcttcgccgaggacaagctggccaacgccgacaagcttgcccccaagctcaagcgcgagctggagatcatcgccgaggacggccgccgcgccaagaaccacctcctggaggccaacctccgtctggtggtctccctggccaagcgctacaccggccgcggcatgctcttcctggacctcatccaggagggcaacctcggtctgatccgcgcggtggagaagttcgactacaccaagggctacaagttctccacgtacgccacctggtggatccgtcaggcgatcacccgcgccatggccgaccaggcccgcaccatccgtatcccggtgcacatggtcgaggtcatcaacaagctcgcgcgcgtgcagcgtcagatgctccaggacctgggccgtgagcccaccccggaggagctggccaaggagctcgacatgacccctgagaaggtcatcgaggtccagaagtacggccgtgagcccatctcgctgcacaccccgctgggtgaggacggtgacagcgagttcggtgacctcatcgaggactccgaggccgtcgtcccggccgacgcggtcagcttcacgctcctccaggagcagctgcactctgtcctcgacaccctgtcggagcgcgaggcgggcgtcgtctcgatgcgcttcggtctcaccgacggtcagccgaagactctcgacgagatcggcaaggtgtacggcgtgacgcgtgagcgcatccgccagatcgagtccaagacgatgtcgaagctgcgtcacccgtcgcgttcgcaggtgctgcgcgactacctcgac

SEQ ID NO: 2432 - DNA, 861 bp, Streptomyces avermitilis
  CDS (1)..(861)
atgaccgccgcccgctccgccgactccggcctgaccggaccgggcgaactcgaccgctacccctacgccgaggcctctgccgccgaccgcgtcggcattcccgcgtgggagagcgccgatccggaactgggccgcgtcggccggcgtgccgcgggcagccgcggacgcggactgcacggccaactcgtacagcagctggggcagatgatcgtctccggcgacctgggcgcggaccgcccgctcgtgcccgaggagatcggtcagcgcttcgaggtgtcccgcaccgtcgtccgcgagtcgctccgtgtgctggaggcgaagggcctggtgagtgcccgcccgaacgtcggcacgcgcgtacgccccgtcagcgactggaacctgctggatccggacatcatcgagtggcgggcgttcgggccgcagcgcgacgaccagcgccgcgagctgagcgagctgcgatggacgatggagccgctcgccgcgcgcctcgccgccggccacgggcgcgaggaggtccagcagcggctcgccgacatggtcgagatcatgggccacgccatggcacagggtgacgccctgaccttctcgcgcgccgacgcggaattccactccctgctcatccaggtcgccggcaaccgcatgctggagcacctctccgggatcgtgtcggccgccctgcaggtctccggcggcccggtcaccggctgcgaccgccccaacgaggccgcgctggcgcaccacgcccggatcgtcgacgccctgggcgcgggcgacggcgcggctgccgaggcggccatgcgccaattgctcaccgtccaccctgaggtggagcgtgtggtgcccgcgccgcgcgagcac

SEQ ID NO: 2433 - DNA, 1743 bp, Streptomyces avermitilis
  CDS (1)..(1743)
gtgatccaggcgatcggactgaccagcaacccccgcaaggaccttccgcccgtcgtcgacgatgtgtccttcgaggcgcacgcgggccgtgtcaccgcgctcctcggaaccccgggcgcgggcaagacgacggcgctcaggctcatgctcgaactccaacagggccgtggcatcacctacttcaggggccgcccgctgcaccgcatcgcccatccctcgcgcgaagtgggcgtcctgctcggcgatgtccccggtcaccccgcccgcacggtgcgcggtcaactccgtatgttgtgcgccgccgccggcgtccctgtccgccgtgccgatgaagtcctcgaggtggtcggtcttgtcagcctgcgcgacgaacgcctgagcaccctttcgcgcggcatggaccgccgcctcggtctggcctgcgcgctgctggccgatccgcacacccttgtcctcgacgcccccgccgacggcctgtccgcccgcgaaggccggtggctgcacggtctcctgcgtgcgcacgccacgcagggtggcacggtcctgttcaccacggacgaccccagagaggccgcgcagaccgcagatcaggtcgtcacgttggaggcgggcaggcttgtcgccgaccaggaggccgcagacttcgcccgcacccggctgcggccccgcgtggcagtccgcagcccgcacgccgcccgactcggcgctctgctggccaaggaggctcgaaccgggcaacgctccgtggagatcgtgcgcgaggacggcaatcggctgtcggtgtacggcagtacgtgcgccgatgtcggcgagaccgccttccggcacggcatcctcgtacaccaactggccgacgaaaccggtgacatgggggccgcccccgacacgcagccgaccgctcccccgccccgcccggccggttcgctggagtcggaagacctgtccccgctgccgccccccatcagtgtccgccaggcgcccagtccgctgcgtccgttgcgctacgagctgcgccgcgctgccggagtcggcaccggctacgtcaccgcggctgccgtgctgatcgcctccgccctgatcgccgtgatcctcgccagaatcggtcacacgccgcagcaccgcctcctggccgcgtggccgcaggacttccccctgccccccgcggcgctcggcgcggggttgctcggggcggtcgccttcggcgacgagttccgccaccccgccctggccacggatcgcggcaccgtcccccgccgcctggggctgctcaccgcgaaactcctcgtctccggggcgaccgcgctgctgctggccttccttgccgtggggtgcgatctcgaagtgctctacctcgtctacggacgggagctcacccaagttcccaccgactggctttccctgggcgccggttggctcggactcctggtgggctgcgcctgggccggtgtactggccgcgggcatcttccgctccacgaccgccgggctcgccgcggtgctggcggtacccgtcgtcgtcgtacccctcgtacaaagggcgctcgaaggcccgtctgttcggacggcggccgggttcgccacgcggctgcgagagctgatgctggtgcagtggccgttcggcggcgagcggtatctggccgccgcggcccgggtggtcgcccaacccgtgggcagtgcactgatgttgtcgctgaccgctctgctctgcgcatatctgctcacgaccctgcgtagcagggtccga

SEQ ID NO: 2434 - DNA, 750 bp, Streptomyces avermitilis
  CDS (1)..(750)
atgccctacgacccgtcagcctttccgccctttgctgtcaccgtggacctggtcgtgctgaccgtgcgccgccacgccctctgtgcgctggcggtgcggcgaggtgagcagccctttcagggcaggtgggcgctccctggcggcttcgtgcggcctgacgaggacctggggcaggcagcagcgcgcgagctggccgaggagaccgggctgcgcgcccatgacccctccgcacaggacaacggagcgcatctcgaacagctggcgacgtacggcgaccccaagcgtgacccgcggatgagggtggtcagcgtcgcccatctcgctctcgcacccgacctgcccgcgcccagggcgggcggcgacgccaacagcgcccgctgggcgcccgtcgaggagctgctgcagcagggcggttacggcagggacggggagaaggcggcaccgctcgccttcgatcatgcgcagatcctggcggacggtgtggagcgtgcccggtccaagatcgagtactcgtcgctggccaccgcgttctgcccgaccgagttcaccgtcggcgagctgcgccgggtctacgaggccgtgtggggcgtggcgctggacccgcgcaacttccatcgcaaggtgacgggcacaccgggcttcctcgtgcccacgggcggcaccacgacgcgccagggcggtcgtccggcccagctcttccgcgcgggcggcgccacgctgctcaatccgccgatgctgcgcccggaggtc

SEQ ID NO: 2435 - DNA, 2397 bp, Streptomyces avermitilis
  CDS (1)..(2397)
gtgacccgaggcaggcccactccgttcacctgggtggcggtacccgtggccgggtcgcgccgacgcatcgcccacgacctttcggagccccccaccaggcgccggtcgcgcccaaggcgcgccaggcgcagaagaagccgcctcatgtccttgcccactccgtccgccgcccacgacggcgaccggcctccccgccgcgcatccacaaagcccttgatgccgggtggcgatccatcggcgccaccgaccgggggcggcgggaagacagcgccccgcatggctcaggagaggacacctacctccttcgcaggcgcaggccgacggtcggtcattcccgaagcgacgtccaggccatcgggtacccccgcgcggggcaaccggccctcgggccccggcccgttggcgggcagacccttcgctccccgacccccgcttccaccactccgccacgccgcggacctgccgccagcccacaccgcgctgatctgtgcggccctgccggggctggcgatctccacggagcaggggcagctgaccggccaggggttggacgggttctaccgctcggggcggcgcctgctctcccgctgtcaggtgcgggtggcggggcgggagccgctcgccgtgcaagcgcggatggtagcggccgaccgcgtccgcttcgtgggcgccctccgagcctcccccgacgcaggaccggacccggacgtcctggtggaacgcacgcggcacgcggacggcacggaacggatcacgctgcacagcgctgcctcacgccccttgcgcctgtccgtcgaggtggcactcgggacggacctcgcggatctggggacggtggcttcgggcagccccggtcccgagctccccgcgagcgttcacgactcaggcctgcgctggaccggcccgaccggcacctcggccgtcaccgcggatccgccgccggccgacgccctcgcctccgccggactgctgcgctgggggctggagctgccacccggcggcacatggagtgtggaactgcgggtacggccggacggggccggagccggcagagcggtggtacgcggcgcgacgagcccactcgcccaggccacggctacgggcgacgaccccagggcccaatcgctgctccatgcctgcgtcgaggatctgcaggctctgctgctgcgcgatcccagccacccttccgacccgcatctcgcagccggggcgccgtggcgctgcggcctggctccggcggaggcactggtcgccgcgcggatggcactgcccctcggcacccggcttgccgcgggcacgctgcggaccctcgcccgcagccagctctcgggaccaggcccacattcgggcatgatcccgggaccacggcgggacgcgggcgcacatctgccacctggctgcacgggcacggaggcaaccctgctcttccctgtgcttctcgcggaggcccggcgctgggggttgccggagcaggagacgcaggagttgttgcccgccgcggaacgctgtctccagtggcttcggaccgctgtcggcgacggtacctacctccccgacccccagcccggcgggccgctgcgctgcgagacacaggcgtacgcccatcgggcagcgctgctgggcgcggacctgctcgatgcccacggccgcccaggcggccccgggctgcgccagtgggccggggaactgcgcaccgcgttccgggacgacttctggatcgaggacctgaagggaggcagaccggcggccgcccgggccccggacggacgcctggtgccccacctcggcgcgggcgccgcccaccttctcgacaccggcctgctcggctccggtgtcatggctcagggcctgctcgacagggtgcggacggagcaactcgcgcggctcctcggcggtccggccatggactgcggatgggggctgcgcagcctgggagcgagggaggcggcgtacaacccgttcggtcatcgaggaggagccgtgcgggtccaggagacggcggtcgccgtcacgggcctggccgccgccggttacgagaaggaggcgagttcgctgctgcggggcgtactggccgcggcggaggcgttcgggcatcggctgcccgagatgtacgcgggggaacaacgcacggaagccggctctccgctgccgcaccccgcagcctgccgaccggccgccaccgccgcggcctcaggggtgctgctcctcaccgctctggcggggatccgccccgacgccccggccggcacggtgacgctgcgcccgctgcgcagtgccccactgggcgagatcggattgacgggactgagagtcgccggcgcgcccttctccgtgcgcgtcagccggctcggcctcgccatggtcgaggaggcggccgacggattgcagttgagagcg

SEQ ID NO: 2436 - DNA, 1725 bp, Streptomyces avermitilis
  CDS (1)..(1725)
atggctcggaccgcggcccacccgagcggtgacgtcgagcggtcctcggctggcgcgggtgatgatctcgctggacccgcaggccctgtggacgccgagatgggcggcaccccctacgacgacgagtccaccgcgtacatcagccacaccgaacacacggacccgagcggtgagcgccaggtcacattgcggactccggccgaactggcggacgcgctgccttacttgctcgggtatcgacccgaggacagcatcgtgctggtcgctctgcacgaccaggacgggcgaggcaggttcggtgggagggcgaggctcggcatccccgcccattcggacgactgggcgtccgtggccgggcagctggcgcacggcctggtgacgggaagtgagcgcagaggcgtacgcccggagagcatggtggcctacctctgtcaggagcctgcgagcggcgagacggggtgcgacgtcgtggcacggctccagccgctcgctcagctgctgcgcacggcctgcggcagcctcgacgtacccgtggtcgaggcgctgtgcatctccgacggccgcttctggtcgtactgctgcccgagccccgactgctgtccgcccgagggccggccgatggggctgcccggcacctccgtgctcgccgctgccgcaacgtacgcaggtctgcaagtacggggaagcctgcgggagttcagggccaggctcgctccctgggagaccgcggcagccctggcgcaggagatcgccctcgacgccgccagcacggccctcgttcccaggatcctcgacggcgagacccgggaggacgtcgccgaggagacccttggactggcccggcaggtgatgggacggttcaccgctacgtcgcccgtgtccggcaccctcccggcagacctccgcgacgacgaactcctcgggcacgaggaggccgccactctgatcctcggtctgcaggaccggacgacccgcgaccgtgcggcggagtggatggaagacgacgaagcggcaccggccctgcgcctctggcgtgccctggcccgccgctgcgtcggttcgtacggtgagcacgctgccgcgcccctcacgctcgctgggtgggtcgcctggtcttccggcgacgaactggaggcccgcgaagccctggccatggccctgggcgccgaccctggctatctcttcgcccgcctcctccatcaagcctgcaacgagggcctggacccggagtccgttcgccgctgcctgcgtgcggagcgagagggccgggccgtgacggacgggagtgtccctcccgcgccactggccgccaccgcgccttcgctccgctccgcgcagccaccccggagtctggagccacaagatcctggagcttcgcaaggcgctcgatggtccggcccctccacgccgggcgacagcgccgatccggcggctccggccgggcagggcgacggaactggggagtcgcctggtgttctcggccgtcgccgtcgcagggtgcgttccgtgagcggtggcagccgtccgagccgccgttctcccaggacggtcgcccgcagaggcaggcgtccagccgagggcaccgggcctgccgccgacggaacacggtccgcgatggacggactccggcgttccgccgaaggaccgcggagtgcggcagagggtgccaccactcgttcacacgcacccggtggcaccgcacgtagcgatgcgcagggagacgta

SEQ ID NO: 2437 - DNA, 2202 bp, Streptomyces avermitilis
  CDS (1)..(2202)
atgagcgacgaagaccaacgacccgccccgtccgcagacccgcgccccgccccggacggagacctgcgtaccgcggccgatgccgtgctcgcccgcctcgtgggcgcgccgacgggcgaggcccggctgcgcgaggatcagtggcgggccatcgaggcactggtggcccacaagcgcagggccctggtcgtgcagcgcacgggctggggcaagtccgcggtgtacttcgtcgcgaccgcgttgctgcgcgagcagggcgcgggtcccacggtcatcgtctcgccactcctcgcgctcatgcgcaaccaggtggattcggcggcccgcgcgggcatccgcgcgaggaccatcaactcgtccaacacggaggagtgggacacgatccaggccgaggtggccgcgagcgaggtcgatgtgctcctggtgagcccggagcggctcaacaaccccgacttccgcgaccaggtgctgcccaagctggccgccgcgaccggcctcctcgtggtcgacgaggcgcactgcatctccgactggggccacgacttccggcccgactaccgccggctgcgcaccatgctcgccgacctcccgtccggtgtgccggtcctcgccaccaccgcgacggccaacgcgcgcgtcacggccgacgtggccgaacaactcggcaccggaggcggcacggacgcgctcgtgctgcgcggaccgctcgaccgggagagcctcagtctcggcgtgctgcgcctgccggacgccgcccaccgcatgggctggctcgccgaacacctcaacgacctgccgggctccggcatcatctacacgctcaccgtggctgcggccgaggaagtcacggccttcctgcgtcagtgcgggcacaccgtggcctcgtacaccggcaagacggagaacgcggaccggctacaagcggaggaggacctgctcggcaaccgggtcaaggccctggtagccacgtccgccctgggtatgggcttcgacaagcccgacctcgggttcgtcgtccacctcggctcgccctcgtcccccatcgcgtactaccagcaggtggggcgcgcgggccgcggtgtggagcacgccgaggtgctgctcctgccgggcaaggaggatcaggcgatctgggagtacttcgcctcggtcgcgtttcccccggaggagcaggtgcgacgcacactggacgtcctggcgcgggccgaccgaccactgtccctgcccgccctcgaaccgctggtcgaactgcgccgctcacgtctggagacgatgctcaaggtcctcgatgtcgacggggccgtacggcgtgtgcagggcggctgggtctcgacgggcgttccttggacgtacgacaccgagcgctacgcctgggtggccaagcagcggtcggctgagcagcaggcgatgcgcgactacgtgacgacgacggcctgccggatggagttcctgcggcggcagctcgacgacgagggggcggctccctgtgggcgctgcgacaactgcgccggaggccgattccacgactccgtgtcgtccgggtcgctcgacgcggcacgtggcgaactcgggcgtgcgggcgtcgaggtcgagccccggaagatgtggccgacgggcctgccggcggtcggcgtcgacctgaaggggcgtatcccggccggagagctggccgcgcccgggcgtgcgctggggcggctgtcggacatcggctggggcaaccggctgcggccgatgctcacgccccaagccccggacgggccggtgccggacgatgtcgccaaggccgtggtcggtgtgctggccgactgggcgaaggggccgggaggctgggcctccgcagggcccgacgcacagccgcgtccggtgggcgtcgtcacgatggcctcccgtacgcgtccgcagctgatccagtccctgggggcgcggatcgcggagatcggacggctgccgctgctggggtccatcgagtacaccggtgagttcgcgcaggtccaccggagcaacagcgcgcagcggctgaaggcgctcgacggggcactgaccgtgccgcccgccctggccaccgcgctcaaggaagccggcggtccggtacttctcgtggacgatgcgacagagacgggctggaccctcgcggtggccgcgcgcatgcttcgacgagccggtgcgtcgggggtgttgccgctggtcctggccgtacaagcg

SEQ ID NO: 2438 - DNA, 633 bp, Streptomyces avermitilis
  CDS (1)..(633)
gtgaccttcggattcgcaccgtcctcggcggcatccatgtcgacctccgccgacctgtccgccgcttccgccaaccctctgacccggatgctcgaacccgcggagtgggccgccgcggggattccgctgctgcgcaatccccgggaggtcgtcagcgggctgcactcccggcaccggcccggcccggcaaccgccatcgtggccgtcctcgatccggaagaacggcttcaggcgagcgcctccttcacccggcgggcggccccggccgacggctggatgttccgcaacgcgctgctcgcgcagctgcgccgggtcatcccgcacgacctgcgacgccgtacgccggtccgcacggccgtgctgctctactgccgtgagggcgacgcgcgttggacggaggaggacggggcgtggatgtgggggctacgcgacgcgtgcacactccacgggctgcgctgcggggcgtacatcacactgacgcgtgacggctggcaggtcctgggcgagggccggggcggacgccgccccaacacggactcgccgccggaggctttcgaactgaccagcgcgccaccaccactgccgcgcaccggaggctccgcgtcggaggtgctgcgccgggcggccgcccgc

SEQ ID NO: 2439 - DNA, 624 bp, Streptomyces avermitilis
  CDS (1)..(624)
atgcctctcattcccgaggagcctcagattcacgagagtgcccagggtccccgcgccactccggccagtggccgtaccgcgccgaccccccgccccgtacccggcccccgtcccgcggctccgtcgcggcccggccgtccgggtcccgtccggccgatgccggcccaacgcaccccacgcgatccggccgtggccacgcccggaccggccgctccggcggctgccgttacccctgccaccccgcagatccagttgatcccggcctcggtcgagggcgcgctggacgctgccgaggaggccgtcgacctgctgctggagtcgggccgtgccccgggggaggtgctggtggtcaccaccggcgaaccgcacccgtgggccgcgcacgagctgtccttcggcgaggctgcctactgggctcagcacgacgcgggcgacgacgtcttctacgccgacgcctccgcggtcggccgggccgcgtcccggccggtggtcgtggtcgcggtcaacggcggccctgccggcgtcgctgccaccgcgcttccgctggcgctcggccgggccggagccctgctgatcgtctgcggcgacccgcagcagatcaactcggtgctgggcgccggggtc

SEQ ID NO: 2440 - DNA, 699 bp, Streptomyces avermitilis
  CDS (1)..(699)
atgccgtacgaaccacccactcacaccgtcgagcgctccctccgcgcaacgaccggagcgaaggtcattgccggtgtcgacgaggtggggcgcggcgcgtgggccgggcccgtcaccgtctgcgcggcgatcaccggactgcgccggcctcccgaaggcctcaccgactccaagctgctgaccgtcaagcgacgcactgtgctcgccgaggagctgcggaagtgggtgacctcgtacgctctggggcacgcctctcccgaggagatcgacgccctggggatgacggccgcgctgcgactcgccgccgtacgcgccctggaggccttgccggtccgtcccgacgcggtcattctcgacgggaagcacgactatctcgggtcgccctggaaggttcgtacggtgatcaagggtgaccagtcctgcgtggccgttgcggcggcctcggtgatcgccaaggtgcagcgcgacaaaatgatggccgaactgggcatcgaacatgcagacttcggttttgcggccaacgccgggtatccgtcaccggtgcacaaggccgcgctggcggagcggggccccaccccgtaccaccggctgtcgtgggcgtatcttgatgcgctgccccagtggcggcacctcaagaaggtccgcagctgggcggacggaagcgttccggaaatcgagggccagctcggcttcgatttc

SEQ ID NO: 2441 - DNA, 621 bp, Streptomyces avermitilis
  CDS (1)..(621)
atggttacttcgcgctggacggccgcccccgctcagacggcctcccttcgccggcgcggtgctgtgctcgaacgcgcgatcctcgacgccgcgctcgaacagctcagcacggtcggctggaacggcctcaccatggagggtgtcgccgccggcgcccagacgggcaaggcggcggtctatcgccgctggccctccaaggaggacctcgtcgtcgacgcgctccaggcaggactgccacgcttcgacgaggtgcccgatctggggtgcgtgcgcgaggacctgctccagctgtgccgacaggcgcgcgaggcgatgttctcgcgccctgggctcgcgctgcgctcggtgattcacgaatgcgactcgagtcaggccgatcgcttcggaggggtgatcctcgaaggggtggtggagccgaccgtcaaactgttgcgtgccatcatcaaccggggaatcgaacggggagaggtgcgctccgatgcggcgaacgggtacgtcttcgacgccattccggcgatgatgatgtaccgcacaaagatgtgcgcgagcgaatggagtgaacgcgacatcgaggagctggtcgatcagctgatggttccgctgctgcggccgcaaggtgcc

SEQ ID NO: 2442 - DNA, 1557 bp, Streptomyces avermitilis
  CDS (1)..(1557)
gtgacaacctctcagttaatccatgatcagaagaagccgggagcagcccgccgggaggggcaccccggcatcgcactcgccgtcatcgcggcctgccaactcatggtggtactcgattcgacgattgtgaacatcgcccttccgcacattcaagacgcgctcaagttcagcacgaccgacctgacctgggtggtcagcgcgtacaccctcaccttcggcggcctgctgctgctcggcggccgggccggtgacatcctcgggcggcgccgggtcttcatgaccggcatcctgttgttcacgctcgcctcgttcctcggcggtctcgcgcaggaaccctggcaactgctggccgcacgcgcccttcagggcgtcggtggcgcgatcgcgtcgccgacctcgctggccctcatcaccaccacgttccccgagggcccggagcggaaccgcgcgttcggtgtcttcgccgccgtctcggccggaggcggcgcgatcggcctgctcgccggcggaatgctcacggagtggctcgactggcgctgggtgctcttcgtcaacgtgcccatcggggttctgatcgccgtgctcgcgccgatgtacatcagcgagtccgaacggcaccccgggcgcttcgacatcgcgggcgcgctcacttcgacggccggcatggcgtccctggtgtacggcttcatccgtgcgtcggaggagggctggcgggacagcctgacgatcgggtccttcggtgccgccgtggtgctgctgctggccttcggcttcgtcgagatgcgggccaaggagccgatcaccccgctgaagatgttcgccgaccgcaaccgttcgggcacgtatgtgatcatgctgagcctggccgcggcgatgttcggcatgttcttcttcatcgtgctgttcgtgcagaacgtgctggactactcgccgatccaggcgggcctggccttcctgcccgtgacggcggcgatcgtgaccggcgcgggtctgtcacagcggttcctgccggtgctcggccccaagccgttcatggtcaccggttcgtcgatcgtcgtgctcgggctcggctggcagaccttcatcaaccccgacagctcgtacctcggcggggtgctcggcccgatgctgctgttcggcttcggcatgggcctgaacttcgtgacgctcacgctcaccgcggtctcgggtgtcgccgtgcacgaggcgggggcggcctccggtctgctcaacgccacccaacaggtgggcggttcgctcggcctctccatcctgaccacggtcttcggctcggccagtcgtgacgaggcggagaaacagttgccgaagttcctggcggacggctcggccgagcagaaggcggagttcgccaagacgcatcagctgcccgctccctgggggaacgaagtgctggcgcacggcatctccacggcgttcatcccggccgtcgcgatggccgtactggccctggtcacggccggattggtcatccgggtccgcaagagcgacctggaggccctcgccggtacggcgggcgcggcgggacccgccggaggc

SEQ ID NO: 2443 - DNA, 1818 bp, Streptomyces avermitilis
  CDS (1)..(1818)
gtgtccgacagaccgtccacgcccgagccaagggatgcgcagccggaaggttccgaagcatcccgcggtgccgggcgtgccagccgctccgagcagtctgagcactccgatcgctcagagcgctccgagggccgtgagaagcgcgaccgcgcggaagcgacttccggggcgggtgcgagccgagatgccgccgctggcgccgacaagagctcgggctccgtttccggaggtgtcgcgacggtcgagcgcaccggcgacgagggcggctcctcggccgacgacgattccgccgaaccggaccaggacgacgattgggcgccgccgtcgccgtcgccatcgcccgcgccctggctcgccgacgttcaggcggggccgcccgctccggtgcgtacggccaccctctgggccgcgttcgccaccggcgtcctgagcatgttgttcctcggcgacggactggcggtcaacctcctgttcgtcgcgatcccggccgccctcgccgcgcacttcgccgctcaggcggcgggccgacgcacgcgcgcgtggacgctcgtctggggagtgggcggcctcgcgctgctggcggttcccgccctgcgcgacgcggactggccgtccttcctggccgtcgtcaccgcggtcgcgctcggctcgctcgcgctgcacgggggtcgcacgtggcccgctgtgctgctcgggccgatcggggtgttcaactccgtgttcaccggcgccgtctggggctggcgcggactgcgcgagcgtgcgggcggcgggcacgggcgcgtgggaccggtactgcgtgcgctcgtagtggccgcggtgctgctggtggtcttcggggctctgttcgccggcgcggacgccgccttcgccgacctgctcggcgacctcgtgccggacgcctccgtctccggcggcccctggcatgtcctgctgttcgtcctgggcgtcgtctgggcgctcgcggcagcgcacacagccgccgctcccgcacgctgggaccgggccgagatacccgagggccgtgagcgcggccgcgtcgagtgggcactgccgctgatcgtgctcgccgtgctcttcgcggtcttcaacgcggtacaactcgccgtgctcttcggcgggtacgacgccgtactgaagaagacgggccagacgtacgccgagtacgcgcgccagggcttctggcagctgctcctggtcacgctgctgacgctgctcgtcatcgtcgtggccctgcgctgggcgccgcgcgacggatcgcgcgaccggacgctcgtacgtggtgtgctgggaactctgtgcgcgctcgcgctcgttgtcgtggcatccgctgtgcggcgtatggacatgtatgtggaggcgtatgggctcacgcgactgaggatctcggtgctttcggccgagctgtggctcggcctggtcatcgtgctcatcatggcggccggggtgtggggagcccgctggctgccgcgtgccgtcgcggcgagtgcggccgcgggggtgctcgtgttcgggttcgtctcaccggacggtctgatcgccgagcgcaacgtccaaaggtacgaggagaccggcaagttcgacctcgactacgcgcgcgacctgtccgccgacgccgtaccggccctcgatgagctgaaggagccgctgcgttcctgcgcgctgcgcgccatcgcacggggtctgggtgaggacggcccctggtacgcgacgagctgggggcaggcgcgcgcccggcagatcctcgacgaccgtccggtctcgccggacgcggactggagcgtgtgcgaccgcttcgatacggacctgatgtaccgc

SEQ ID NO: 2444 - DNA, 903 bp, Streptomyces avermitilis
  CDS (1)..(903)
atgaccgctgactcctcatacgacgggcgcctggagcgcgccctgtcaggcctgcgcggacttgcggtgggggacgcgctcggctcgcagttcttcgtgcccgcgcactaccccctgctcaagcgccgcgagctgccgccgggtccctggcggtggacggacgacaccgagatgacctgctccgtggtggcagttctggccgcgcaccaccgcatcgaccaggacgcgctggcccgctccttcgccgagcacctcgatcccgaccggggctacgggcccgcggtcgcccggctgctgcgtcaggtcggcgagggtggcgactggcgggagctcgcctccgccctcttcaaggggctcggatcgtggggcagtggcgcggcggcccgtatcgcgccgctgggagcctggtacgcggacgacccggagcaggccacccaccaggcggagatctcggcctaccccacgcatcagcaccgtgaagccgtggtgggcaccatggccgtcgccgcggccgccgccctggccgccgatccgacgggtccgcccagcgccgaggcgctgctcgacggagtgatcgcgctcgtgccgaagagcgccgtcggcgcgggactgcggcgggctcgggacatgctcgactacggcgacgcggcgaccgtcgcggccgtactgggctgtgggcggcgcacgacggcgcacgacaccgtgccgttcgcgctctggtcggccgcgcgggcgctgagcgactacgaacaggccttctggacgaccgcccgggtgggcggtgacgtggacacgacctgcgccatcgtcggaggggtggtcgccgcggggaaggcgggggcgccgccgggggagtgggtggaacgtacggagaagctgccggactgggtgccgggggtggcg

SEQ ID NO: 2445 - DNA, 657 bp, Streptomyces avermitilis
  CDS (1)..(657)
atggcacgaccacggcgcatcgtccttgtccggcacggcgagtcagcgggcaatgccgatgacaccgtctacgaacgcgagcccgatcacgcactgccgctcaccgaggtgggatggcggcaggcggaggagagaggcaaacagctgcgcgagctcttcgggcaggagggcgtaagcgtttacgtatccccgtaccggcgtacgctcgaaacgctccgcgcgttccacctggaccccgacctcgtccgcgtccgcgaggagccccgcctgcgcgagcaggactggggcaactggcaggaccgcgacgacgtacgcctgcagaaggcgtaccgggacgcgtacggacatttcttctaccgcttcgcgcagggcgagtccggcgccgacgtgtacgaccgggtcggcggtttcctggagagtctgttccggagcttcgaggcgcccgaccatccaccgaacgtgctcatcgtgacccacggcctggccatgcggctgttctgcatgcgctggttccattggtcggtcgcggagttcgaatcgctgtcgaacccggggaacgcggagatgcggatgctcgttctcgggaacgacggcaagtactcacttgaccggccgttcgaacgctggcgtgatccggaacggtacggagccaccgga

SEQ ID NO: 2446 - DNA, 603 bp, Streptomyces avermitilis
  CDS (1)..(603)
gtgctggtcaagtggattcgctgcaccgtggtggaccgccgcggtttcgagcgggggcagcgaaggtgggcggggctgctcggagagccgggtttccgggggcagggcggaggctggagccgaggacggcccggtgtcgcgcacatcttcgccttctgggaaagccgtgccttctacgactccttcatggcgcgctcccatgatcgtctcgccgccacgcagtcgggcaccttcaaggattcacaagtcaaactcttcgatcaccgtttcgatgtgaagaccggtttcgagccccgcttcaccgacgccgacctggtgcgtgtcgcgcattgccgggtccacgaggagcgggccgagcacttcgcactcatgcaggagaaggtctggaaccccgcgatggcgggctcgcccgggatgacccgcgggctgttcggggaggcgccggggcacgagttcctgatcctgtcgatgtggcagtcggccgccgagcacgggaagtaccgcgccgagcgggtggagcgactcgcgctcagggcccagacggaggccgacgtcgcggccctggcgggcgacatcgtcgatctggaaccggcctggatagtt

SEQ ID NO: 2447 - DNA, 531 bp, Streptomyces avermitilis
  CDS (1)..(531)
gtgaacggtctcaacaaaggcatccgcaaggtcgagctcgcggtgaaatgggaccccagtccgcccggcgatccggccaccgatctcgacatcgtcgccgcgaccttcctggccggcgacgcgtatgggaaaccggcctacgtagtgcacttcgacagccgctcccccgacggcacgatctacctcaaccgggacagcaaggacggcaagggcttcggctgggacgaggtcatgacgctggagctgaaccggctcgacagccgctacgcgcgcgtggtggtcggcgtcgtgatccagcagcgcgacgcgcaccggacgttcgtcggcgtcctgaaccccggcctgcgtatgcgcgagggctacaccgtgctggccgaggacgacttcggcggcgtcctggggtcgacggcggcgaccgtcggtgagttcgtacgcgacgactccggtgaatggaccttccacccgggcatccacggctacgactcggacccggcgaccttcgcgcgcgtcatgggcggccgtcaggactcc

SEQ ID NO: 2448 - DNA, 2892 bp, Streptomyces avermitilis
  CDS (1)..(2892)
atgacagagacggcgagcggtccggcacgaggttcccgcgccaagggcaccaaggccaaggggctgcgcatcgagcgcatccacacgactccgggcgtgcacccgtacgacgaggtcgagtgggcgcgccgtgacgtcgtcatgaccaactggcgcgacggctcggtcaacttcgagcagcgtggcgtcgagttccccgacttctggtcggtgaacgcggtcaacatcgtcaccagcaagtacttccgcggtgccgtcggcaccccgcagcgcgaagtgagcctcaggcagctcatcgaccgcatcgtgaagacgtaccggaaggccggcgaggactacaagtacttcgcctcgcccgccgacgccgagatcttcgagcacgagctggcgtacgccctcctgcaccagatcttcagcttcaacagccccgtctggttcaacgtcgggactccgcagccccagcaggtctccgcctgcttcatcctggcggtcgacgactccatggagtcgatcctcgactggtacaaggaagagggcatgatcttcaagggcggctccggcgccggcctgaacctctcccgtatccgctcctccaaggagctcctctcctcgggtggcaacgcctcgggtcccgtctccttcatgcgcggtgccgacgcctccgcaggaacgatcaagtcgggcggcgccacgcgccgcgcggccaagatggtcatcctcgacgtcgaccaccccgacatcgaggacttcatcgagaccaaggtcaaggaggaggagaagatccgcgccctgcgtgacgcgggcttcgacatggacctgggcggcgacgacatcacgtccgtccagtaccagaacgccaacaactcggtccgcgtgaacgacacgttcatgaaggcggtcgaggagggcggcaagttcggtctgacgtcccgcatgaccggcgaggtcatcgaggaggtcgacgccaagtcgctcttccgcaagatggccgaggccgcctgggcctgcgccgacccgggcatccagtacgacgacacgatcaaccactggcacacgtgcccggagtccggccgtatcaacggctcgaacccgtgcagcgagtacatgcacctggacaacacgtcctgcaacctcgcctcgctgaacctgatgaagttcctgaaggacgacggcaagggccgccagtccttcgaggtcgagcgcttcgccaaggtcgtcgagctggtcatcaccgcgatggacatctccatctgcttcgcggacttcccgacccagaagatcggcgagaacacccgcgccttccgtcagctgggcatcggttacgccaacctgggcgccctgctgatggcgaccggccacgcgtacgactccgacggcggccgcgccctcgccggtgccatcacctcgctgatgaccggcacctcgtacaagcgctccgccgagctcgccgcggtcgtcggcccgtacgacggatacgcccgtaacgcgcagccgcaccagcgcgtcatgaagcagcactccgacgccaacggcgtggccgtccgcgtggacgacctggacacgccgatctgggccgccgccacggaggcctggcaggacgtgctgcacctcggcgagaagaacggcttccgcaacgcgcaggcctcggtcatcgcgcccaccggaaccatcggtctcgcgatgtcctgcgacaccaccggtcttgagcccgacctcgcgctggtcaagttcaagaagctggtcggcggcggttcgatgcagatcgtcaacggcaccgtcccgcaggccctgcgccgcctgggctaccaggaggagcagatcgaggcgatcgtcgcccacatcgccgagaacggcaatgtgatcgacgccccgggtctcaagcacgagcactacgaggtcttcgactgcgccatgggcgagcgctccatctccgcgatgggccacgtccgcatgatggccgcgattcagccctggatctccggcgcgctctccaagacggtcaacctgccggagacggcgaccgtcgaggacgtcgaagaggtctacttcgaggcctggaagatgggcgtcaaggcgctcgcgatctaccgcgacaactgcaaggtcggccaaccgctctccgcgaagaagaaggagaccgagaaggccgaggtgaccgcgaagaccgaggcgacgatccgtgaggccgtcgagaaggtcgtcgagtaccgcccggtccgcaagcgcctgcccaagggccgtcccgggatcacgacgtccttcacggtcggtggcgccgagggctacatgaccgccaactcctacccggacgacggtctcggcgaggtcttcctgaagatgtcgaagcagggctccaccctcgcgggcatgatggacgccttctcgatcgccgtctcggtgggtctgcagtacggcgtgccgctggagacgtacgtctcgaagttcacgaacatgcgcttcgagccggccggtatgacggacgacccggacgtccggatggcgcagtcgatcgtcgactacatcttccgtcgtctggcgctcgacttcctgcccttcgagacgcggtccgcgctcggcatccactccgccgaggagcgccagcgtcacctggagacgggttcctacgagccgtccgacgatgtcgacatggacgtcgagggcctggcccagtccgcgccccgtgcgcaggagctgaaggccgtcgccacccccaaggccgaggtcgcggcggcggtgcccgccccgaagcaggcccacaccagcgccgagctggtggagatgcagctgggcatccaggcggacgccccgctgtgcttctcctgcggtaccaagatgcagcgggccggctcctgctacatctgcgagggttgcggctcgaccagcggttgcagc

SEQ ID NO: 2449 - DNA, 561 bp, Streptomyces avermitilis
  CDS (1)..(561)
atgcactgccccttctgcaggcacccggacagccgcgtcgtcgacagtcgtacgaccgatgacggcacgtcgatccgcaggcgccgccagtgccccgactgctcccgtcgtttcacgaccgtggagacgtgctcgctgatggtggtgaagcggtccggagtcaccgagcccttcagccgcaccaaggtcatcaacggcgtgcgcaaggcatgtcaggggcggcctgtcaccgaggacgcactcgcccagctcggccagcgggtcgaggaggcggtgcgcgccaccggaagcgccgagctgaccacccatgacgtggggctggccatactcggccccttgcgggagctcgacctcgtcgcctatctgcggttcgcgtccgtctaccgggcgttcgactcgctggaggacttcgaggccgcgatcgcggaactcagggaagagcagcgggagcgccccgccgtggacgacgaggaccacgaagacgctggcgccgagcgccagggaaccgaccgcgggtccggagggactgtcgaagtccccgttcccgccaccgtcgccgac

SEQ ID NO: 2450 - DNA, 777 bp, Streptomyces avermitilis
  CDS (1)..(777)
gtgaccaccaccgcagacagtgccaccatcactgcccaggaccgctcccagggccgactcgagccggtgcatgcgatgaacgaagccacaagccacgagggacccaagcgctccctgccaggccgacctccaggcattcgcgccgacagctcgggactgaccgaccggcagcgccgggtgatcgaggtcatcagggactcggtgcagcggcgcggctacccgccgtcgatgcgggagatcggccaggcggtcgggctctccagcacctcttcggtcgcacaccagctcatggcactggaacgcaagggcttcctgcgccgcgacccgcaccgcccgcgcgcatacgaggtgcgtggatcggaccagtcgtcctccgtgcagcccacggacacggcgggcaagccggccgcgtcgtacgtgcccctcgtcggccgcatcgccgccggtgggcccatcctcgccgaggagtcggtcgaggatgtcttcccgctcccgaggcagctggtcggcgacggtgagctgttcgtcctgaaggtcgtcggcgactccatgatcgaggccgccatctgcgacggggactgggtgacggtccgccgccagcccgtcgccgagaacggcgacatcgtggccgcgatgctggacggcgaggccacggtgaagcgcttcaagcgcgaggacggccatgtgtggctgctcccgcacaactccgcgtaccagccgatccccggtgacgaggcgacgatcctcggcaaggtggtggcggtgctgcggcgggtg

SEQ ID NO: 2451 - DNA, 2031 bp, Streptomyces avermitilis
  CDS (1)..(2031)
atgacaaagccctcactccccgaactcctgcatgctgccgtcactgccgtaggcggcacggagcgccctggccaggtgaccatggccgaagctgtcgcggaggcgatcgacgacagctcccatctgctggtccaggccggcaccggcaccggaaagtcgctcggctacctggtgccggcgctcgcgcacggggagcgcgtcatcgtggcgaccgccaccctggcgctccagcggcagctcgtggagcgggacctgccccgcaccgtcgacgcgctgcatccgctgctgcgccgccgcccggagttcgccatgctcaagggccggtcgaactacctgtgtctgcaccgactccacgagggcgtgccgcaggacgaggaggagggtctcttcgaccagttcgaggcggccgcgcccaccagcaagctggggcaggacctgctgcggctgcgcgactggtcggacgagaccgagaccggcgaccgcgacgacctgacgccaggggtgtccgaccgcgcctgggcccaggtgtccgtgtcctcccgggagtgtctgggcgcgacgaagtgcgcgtacggcgccgagtgcttcgccgagatgtcccgcgagcgcgccaagctcgccgaggtcgtggtcaccaaccacgcgctgctcgcgatcgacgccatcgagggcgcgccggtcctcccgcagcacgaggtgctgatcgtcgacgaggcccacgagctggtctcccgcgtgaccggtgtcgcgaccggcgagctcacacccggccaggtcaaccgcgcggtgcggcgcgccgccaagctcgtcaacgagaaggccgccgaccagctccagaccgccgccgagggcttcgagcggctgatggagctggccctgcccggacgcctggaggagatccccgaggacctcgggtacgccctgatggcactgcgcgacgccgcccgtacggtgatctcggcgatcggcgccacccgcgacaagtccgtgcaggacgaggacgcggtgcgcaagcaggcgctggcttcggtggagagcgtgcacgacgtcgcggagcggatcaccaacggctccgagtgggacgtcgtctggtacgagcgccacgaccgcttcggcgcgtccctgcgggtcgcccccatgtcggtgtccgggctcctgagggagaagcttttcgcggaccgttcggtcgtcctgacgtccgcgacgctgaagctgggcggcgacttcaacggggtgggggcatctctgggactcgcccccgagggcacgcagggcgacgaccttccgcagtggaagggcgtcgacgtcggctcccccttcgactacccgaagcaggggatcctgtacgtcgccaagcatctgtcgcgccccgcgcgcgacggcgaccgggcggacatgctggacgagctcacggagctgatccaggcagccggtggccgcacgctgggtctgttctcctcgatgcgggcggcccagctcgccgcggaggagctgcgctcccggatccccgagttcccgatccttctccagggtgaggagacgctcggcgagctgatcaagaacttcgcggccgaccccgagacgtgcctcttcggcacgctctcgctctggcagggagtcgacgtcccggggcccagctgccagctggtcgtcatggacaagatccccttcccgcgccccgacgacccgctgatgagcgcccgccagaaggccgtggaggacgccgggggcaacggcttcatggccgtcgccgccacacacgcggccctgctcatggcccagggcgcgggccgcctggtgcgggcctcgggggaccgcggcgtcgtcgccgtactggaccagcggctcgcgacggctcgctacgggagctatctgaaggcgtcactgcccgacttctggtacaccaccgaccgtaaccaggtccgcagatcactgaccgcgatcgacgaggcggcgaagaagacggaagtgacggaagtgacagaagtggcggaagtaacggaagaggcggccaaggagtcggaaggcgcc

SEQ ID NO: 2452 - DNA, 1131 bp, Streptomyces avermitilis
  CDS (1)..(1131)
gtgcctcccaccgatgcgagcaccgacgccgagcccgctacctctgcggaccccgcccgtatcgccgtctcagcccgctcagccgccgacagcgaggacacgctggaactgcggctgcccgacgaactcgtcgcgctcttcgccgcggaagaggcggcgggcggcgaagaggctgcgggcggcggggatggtgcagtacgaggcgaggaagggacagcgggcggcgaggaagatgcggtaggaggcgcggaagagccagcggggcgtaaggacgcggggcccgaggcgcagggcacggcgacggccgctccctccgtcccggcccgcgccggcgccacggctgcttcggcggattcggacggttgctccgacgccgttgatccggcggccccgttcgctgccgcctctacggtcccctccgcctctagggtcccctccgccccgtcggtcacgtctgccccgtcggtcacgttcgccaccgcacccgcacccgccccgccttccctcggcgacaccaaggccctcgccggcaggcaagccgtctccgtcacccgggccgctgacgacctgctcggccgcgtcgaggactggggccccaccgtcacccccgcgggcaccttccagctcgcccccgtccgcccggaacgcgaccttccgctcctcgggcgctggatgaacgaccccgctgtcgccgccttctggaagctggcgggcgacgagtcggtgaccgagcagcatctgcgcgcccagttgggcggtgacgggcgcagcgtcccctgcctcggcgtactggagggcacaccgatgagctactgggagatctaccgcgcggacctcgactccttggcccgtcactatccggcccgcccccacgacaccggaattcacctcctcatcggcggtgtcgccgaccgcgggcgcggcctcgggtccacactgctgcgagccgtcgccgacctcgtactcgaccggcgtccttcctgcgcacgtgtggtcgctgaacccgatctgcgcaacacctcctccgtgtccgccttcctgggcgcgggcttccggttctccgccgaggtcgacctgcccgacaaacgagcggccctcatggtccgggaccggcccctgcgcgatctcctg

SEQ ID NO: 2453 - DNA, 2058 bp, Streptomyces avermitilis
  CDS (1)..(2058)
ttgaacgccacccccacatccgacggcggctcccgcactcacgagcgagcaggccacgacacccagctcccgaccgttcagggcccccaggccgtgttcgcatcggaggctcaggccgcgccggcacctgagacccaggccccgctcgcaccagcgacccaggtcgtattcgtaccggaggtccgcaccccagttgtgcaggcgtccgaatcggtccccccgccggttggacgggctcgggagagtgagcggctgcgcggcaccaccgccgacccgctggatcatcccgaagcccagaccgccgcccaggccgccgccgtcgagaacctgctgcgctgctgggtacgggagaacggcctcgtcgcccccgacgacggcaccctgcgcatccccctgctcgccacgggcaccgccctcctcgtccccgttcaccactggtccccgacgggctggcaccgcttcggcctcccgtacctcgcggacgcgccgcagacggccccgccggccgacgcggtgacggtggtggcgctgctggccagggaagcggccggaagccgccgcgccccccgccccgcgcacagcgccgtcgaccactgcgccgtcgaccacagcgccgacctggtgggccgtgtcgccgactccgtccgtcgcaccgccgtcttcatcgacgaccgccgcgcccgccccgccgacgagcccgacctcttcctcgccgccgaacaggcgctgctgctcggacacccgctgcaccccacgccgaagagccgcgagggcctctccgaggccgaagcccgcctctactcacccgagctgcgcggatccttcgccctgcactggctggccgtcgcgcccccggtactcgccacgaactcggcgtggaccgagcgcggtcgtcccgtgcccgccgagcagctgaccgcacggctcgccggcgacggactgccgatgcccgacgggttcgccgcgctgccgctgcacccctggcagatccgcgagatccggcaccgtcccgaggccgccgcgctgctcgacgccggactgatccgggatctcggcccccatggccccgcgtggcaccccacctcatccgtccgcaccgtccaccgcaccggcgccccggccatgctgaagctgtcgctgggcctgcgcatcaccaactcccgccgggagaacctccgcaaggaactgcaccggggcgtcgaggtccaccgtctgctgcgcagcggcctcggcgagcagtggcaggcagcgcaccccggcttcgacatcgtccgcgacccggcctggctcgccgtcgacgaccagcacgggaacgcggtccccgggctcgacgtgatgatccgccacaacccgttcgccccgaccgacgacgtctcctgcgtcgccgggctcgtctcgccacgcccctggccccagcccaccgaacagccccgtcccgtcatgcgctcgcggctcgccgagatcatcatccggctcgccggccgcacgggccgtccccgcggtgccgtggccaccgagtggttcctgcggtatctggagcaggtcgtacggcccgtgctgtggctcgacagcgaggcgggcatcgcactggaggcccaccagcagaacaccctgctcctgctggaccccgaaggctggcccacgggcggccgctaccgggacaaccaggggtactacttccgtacgtcccggcgcgcggaactcgaggcccggctgcccggcatcggcgagcacagtgacaccttcgtctccgacgaggtcaccgacgaacgcttcgcgtactacctcggcatcaacaacgtgctcgggctcatcggggcgttcggctcccagcaccttgccgaagagcaactgctgctggcggccttccgacgcttcctcgccgatgtcgccaccggccccgcccggctgcgcacaccgctgccgacccgcctgctcgactcacccgtgctgcgctgcaaggccaacctgctgacccggttgcacggcctcgacgagctcgtcggcccggtcgacacccagtccgtctacgtcaccatcgccaatccccttcattcc

SEQ ID NO: 2454 - DNA, 1452 bp, Streptomyces avermitilis
  CDS (1)..(1452)
gtggctgtgaccaagtctgcggtggcgtccctgaaacgtgaagccgagggagcgcacgcggcgcacgaggggattctgcggcgtcagtcggcgcgcgaatccgcggcacgcacctatgcgcgcgccctgccgatcgtgccggtccgggcgcgcgggctgaccatcgagggggccgacgggcgccgctacctcgactgtctctcgggcgcggggacactggctctgggacacaaccacccggtggtcctggaggcgatccggaaggtcctcgactccggggctccgctgcacgtcctggacctggccaccccggtcaaggacgcgttcaccaccgagctgttccgcacgctgccggccgggctcgccgaccgggcgcgcgtccagttctgcgggccggccgggacggacgccgtcgaagccgcgttcaagctggtgcgtacggccaccgggcgcagcggactgctcgccttcaccggcgcgtaccacgggatgaccgcgggggcgctcgaggcatccgggggcgcgaccgacggacgggtggcgcgcctgccctatccacaggactaccgctgtcccttcggcatcggcggcgaacgtggcgccgaactcggcgcccgttggaccgagtcgctgctcgacgacgtcaagtcgggcgtgccgctgcccgccgggatgatcctcgaacccgtgcagggcgagggcggggtgattcccgcgccggatgcctggctgcgccggatgcgcgcgatcaccgcggaccggtccattccgctgatcgcggacgaggtgcagacgggagtgggccgtaccggaaggttctgggcggtcgaacacagcggtgtcgtaccggacgtgatggtcctgtcgaaggcaatcggcggcagtctgcccctcgctgtcgtcgtgtaccgggacgacctcgacgtctggcaaccgggcgcccacgcgggcacgttccgcggcaaccagctcgccatggccgcgggcacggccacgctcgcgtacgtccgcgagcaccgcctcgccgaacgcgcgcagaccctgggggcgcgcatgctcgaccaactccgctcactcgcgacggagttcccgtgtgtcggggaagtgcgcggtcggggattgatgatcggcgtcgagctggtgcgggccgaggaggatcgcgaggcggtgagtccgggttccggggacttcgcgtccctggacacggccggcgcgggcccgcgtcccgccgcgcccgaactggcggccgcggtccagcgggagtgtctgcggcgtggcctgatcgtcgaactgggcggccggcacgcgagcgtggtccggctgcttcccccgctgaccatcagcgacgaacaggcgaccgcggtgctggaccgactcgcggacgcggtggaagcggtggcgcgcgggcgggcagaacggagccgaggcttccagcgctcggagcgggccggg

SEQ ID NO: 2455 - DNA, 1230 bp, Streptomyces avermitilis
  CDS (1)..(1230)
atgcgaccgattcgcccgctcttcgccgctcgccgagggaggagcgcacgccgcaggacctctcccgtgctgggcgccgtcggcctcgccacggcactcgcgctgaccgccaccgcctgcgactcgggcgacgacaccaaggcgagcagcgagtcgtccccgtccgcgtcctccgccggcgacgacaagatcaagatcccggacgacatcagggacaagctcaaagagcgcgggatcgacatagacaagtggaagaacggcgcctggaagaactggaacagggacgactggctgcgcgaggccaacgagtacatcaacccgatcatcaagggcctgtgggacccggaccggatgcgtgacgccgacgacccggacaagaacaagggcgtcgacgacaacgacctcaccggcgaccagggcgtcacggacccgactccggcgccggtgaacgcgaaggcggtgcaggcggcgtaccacgacaacgcccccaccgcgggcaaggtcttcttcgacgcgcccgagggcacgatggtctgttcggcgaccgtggtcgaggacccggcgcacccgggcaagtccaacctcgtgtggaccgcgggccactgcgtgcacgccggcaagaagggcggctggtaccgcaacatcgcgttcgcgcccgcgtacaacaacgccggccagacgaccgccgagctgcagaacgccacgaagcaggagatagctccgtacggcgtctggtggggcgactgggcgcagacctcgcagcagtggatcgagaagggcggcgagacgggcggcgacggcgcgtcgtacgactacgccgtcatccatgtgacgccggagaagggcggcgacggcaagtccctggaggagacggtcggttcggcccttccggtggacttcaacgcccccgccgtgccgaaggtgagcagcatcacggcgaccggctacccggccgcggcgccgtacgacgggcagacgctgtaccagtgccaggacaagccgggccggctgtccatcgccaagtcggacccgacgatgtaccgcatcggctgcacgatgaccggcggttcgtccggcggcggctgggtggcgacgggttcggacggcaagcccgcgctcgtgtccaacacctcgatcggcccggtgacttcgggctggctggccggcccacggctcggcccggtggccaagggcgtgtacgactcggtcagcaagaagttcgcgggtcag

SEQ ID NO: 2456 - DNA, 1191 bp, Streptomyces avermitilis
  CDS (1)..(1191)
atgcgttccgtacgtccgcccttcgcgcgccggcgcgggaggaacaccgtcctcgccgcgaccgtcgcggccctggcgctcaccgccaccgcctgcaacggcagcgacgacaaggcgagcgacaagcccgagaccaccacctcgcaggcggccggccaggacaaggcccggatgcccggcgacatcgccgcccggctcaaggagcacggcgtcgatgtcgacaagtggaagaacggcggctggaagaactgggacaaggacaagtggctcagtgaggccaaggacttcgtcaatccggtgatcaaggggctgtggaagcccgagcggatgaagtccgccaaggacccggacaagacgatctcggcgaaggacgcgtccgccgaccagggcgtcagcgacccggatccggcgcccgtcgacgccacggccgagaagaccccgtaccacgagcacgcggccccggtgggcaaggtcttcttcgactcccccgagggctcgatggtctgttcgggcaccgtcatcaaggacgtcaaccacccgggcaagtccaacctcatatggaccgcgggccactgcgtgcacgcgggcggcagcggcggctggtaccgcaacatcgcgttcgtgccggcctacaacgacctcggcaagtccgcggcggcactgagcgacgccacgtcgtccgaggtcgctccgtacggccagtggtgggcggactgggcctcgacctcgcaccagtggatctccggcggcgacgagacgggcggcgcgggcgcgccctacgactacgcggtactgcacgtgaagcccgagtccggctccaagtccctggaggagacggtcggtgccgccctcgacgtggacttctccgcgccctccgcgcaggacgtcagcgcgatgggcgcgtggggctacccggccgcgccgccgtacgacggccagcagatgttcaagtgcctcgacgagcccggccggctctcgctctccccgagtctgccgacgatgtaccgcatcggctgcacgatgaccggcggttcgtccggcggcggctggttccgggtcgtcgacggcgagaccaagctcgtctcgaacacctcgatcggcccgtccgacaacacctggctggcgggtccgcagctgggcaagggcgccaaggcgctgtacgacaccatgagcgagcagtacggcggtcgg

SEQ ID NO: 2457 - DNA, 1491 bp, Streptomyces avermitilis
  CDS (1)..(1491)
atgacctcctcttcttccccttcccaggacgcgcagagcttcgcgcacacttaccccgagggtcttcgggccgatgccctgatggaagaggacgtcgcctggagccaggagatcgacggagaccgggacggcgatcagttcgaccgctccgagcgcgcggccctgcgccgtgtggccggcctctccaccgagctcgaggacgtcaccgaggtcgagtaccgacagctccgcctggagcgcgtcgtgctcgtcggtgtctggacctcggggaccattcaggactcggagaactcgctcgccgagctggccgccctcgcggaaaccgcgggtgcgctcgtgctcgacggcgtcgtccagcgccgcgacaagccggacgcggccacgtacatcggctccggcaaggccaacgaactgcgggacatcgtcctggagaccggcgccgacaccgtcatctgtgacggtgagctcagccccggccagctcatccacctcgaagacgtcgtcaaggtcaaggtcatcgaccgtacggccctgatcctcgacatcttcgcccagcacgccaagtcccgagagggcaaggcgcaggtcgcgctcgcgcagatgcagtacatgctgccgaggctccgcggctggggtcagtcgctgtcccgtcagatgggcggcggcaagggcggcggcctcgccacccgtggccccggtgagaccaagatcgagacggaccgtcggcggatccgcgagaagatggcgaagatgcgccgggagatcgcggacatgaagacgggccgcgagatcaagcgccaggagcgccgtcggaacaaggttccttcagtcgcgatcgccggttacaccaacgccggcaagtcctcgctgctcaaccgcctcacgggcgcgggcgtgctcgtcgagaacgcgctgttcgcgaccctcgacccgaccgtgcgccgggccgagaccccgagcggccggctgtacacgctggccgacacggtcggttttgtacggcacctgccgcaccacctggtcgaggccttccgctccaccatggaggaggtcggtgactccgacctgatcctgcacgtggtggacggttcgcacccggtcccggaggagcagctggccgccgtgcgcgaggtgatcagggacgtcggcgccaccggcgtacccgagatcgtcgtgatcaacaaggcggacgcggccgatccgctggtgctccagcggctgatgaggaacgagaagcgctccatcgccgtctcggcccgcaccggccagggcatcgccgagctgctcgcgctcatcgacaacgagctgccgcggccgtcggtcgagatcgaggcgctcgtgccgtacacgcacggcaagctggtggcgcgcgcccacaccgagggcgaggtgatctccgaggagcacaccccggagggcacgctgctcaaggcgcgggtgcacgaggagctggcggcggatctcgcgccgtacgttccggcaccgctcgcc

SEQ ID NO: 2458 - DNA, 1467 bp, Streptomyces avermitilis
  CDS (1)..(1467)
atgccgcacaccccccgccccagaacccgtcgcgtcacgtcggcgatgctcgcctccgccgtctccgtctgcctcatcgccgcgagcgcccccgcgccggcggtccccctggggatcggcgaccggctcttcccgcacctcggaaaccccggatacgacgtcgcctcgtacgacctcgccttcacctatcccggcgccaacaacaagccgctcaccgccgtcaccaccatcaacgcacaggcgaagggccggctggaccgcatcaacctggacttcgcgcacggcatcgtgcggtcggtcgacgtcaacggcgagcccgcgtcgttcaccggtgcgggcgaggacctggtggtcacccccgaggcgccggtctcccgggggaccccgatgcggatcaccgtgcggcacaccagtgatcccgtgtccgccaagggccaggacagcggctgggtccggacggaggacggcctcgtgatggccaaccaggccgacgcggcccacctcgtcttcccctgcaacgaccacccctccgacaaggcgatcttcaccatccacgtgacggcacccgacgggtacacggccgtggcgaacggccggccggccggggccgaccgggagggcagggcgaccacctggacgtaccgcaccgagcaccccatggccaccgaactcgcccaggtgtccatcggccgctcctcggtgctccaccggaccggtccgcgcggtctgcccgtccgtgacgtcgtacccacgaaggaccgcaagcggctggaaccgtggctggcgaagacgcccggccagatcgcctggatggagcgcagggtcggcccgtacccgttcgagacgtacgggctgctcgtggcccaggcgcagaccggcttcgaactcgagacacagacactctcgctcttcgagagagagctgttcacccggtccacgaacccgaagtggtacgtggagtcgatcatggtgcacgagctgtcgcaccagtggttcggcgacagcgtcagcccccgcacctggtccgacctgtggctcaacgagggacacgccacctggtacgaggccctgtacgcggaggagacggcgcaccggcccatggagccgcgcatgaaggaggcctacgaggcatccgactcctggcgggccaccggcgggccgcccgcagcgcccaagggccccgagcccggccagaagatcagcatcttccgccccaacgtctacgacggcgccgcactcgcgctgtacgcgctgcgccaggagatcggccgaccggtcttcgaacgactggagcgggcctgggtggccctccaccaggacggcacggcgtcgaccgccgacttcgaacagctggcgtccgccctctcggggcgcgacctgagcaggttcttcaaggcgtggctgtacggggagaagacgccgccgatgcccgggcacccggactggaagtccgggcaggccacgaaa

SEQ ID NO: 2459 - DNA, 2160 bp, Streptomyces avermitilis
  CDS (1)..(2160)
atgagcgcggaggccacgaaccctgccacgcccggccccgtcacgcccggggcgtaccgcaggaagggccgccccaggatcgacctgcgccgtctgggccgggccgcgctgctcggccccgcggcccgcgaccggctgccggacgcgatcggtcatgtggccgaggcccaccgcgcccaccaccccgacgccgacctcgaacccctgcgccgcgcgtacgtactcgccgagtcctcgcaccgcggccagatgcgcaagagcggcgagccgtacatcacgcaccccctcgccgtgaccctgatcctcgccgaactcggcgcggagaccacgaccttgacggcgtctctgctccacgacaccgtcgaggacacggaggtgacgctcgatcaggtgcgagccgagttcggcgaggaggtctgttacctggtcgacggcgtcaccaagctggaaaaggtcgactacggcgccgcggccgagccggagacgttccgcaagatgctcgtggccaccggcaacgacgtacgcgtgatgtcgatcaaactcgccgaccggctgcacaacatgcgcaccctgggcgtgatgcgcaaggagaagcaggaacgcatcgccaaggtcacccgggacgtgctcatcccgctcgccgaacggctcggcgtccaggcgctgaagaccgaactcgaggacctcgtcttcgcgatcctgcatcccgaggagtacgagcgcaccagagaactcatcgtcggcaacgcggcgaacggcggcgacccgctcacggagatcgtcgaaaacgtgcgcaccgtcctgcgcgaggccggactgcaggccgaagtcctcatccggccccggcacttcgtctccgtgcaccgcgtctcccgcaagcgcggccggatgcgcggctccgacttcggccgcctcctggtgctggtgaacgaggacgccgactgctatggcgtcctcggtgaactccacacatgtctgacgccggtggtctccgagttcaaggacttcatcgccgtccccaagttcaacctgtaccagtcgctgcacaccgccgtggcgcgcgaggacggcgaggtcgccgaagtcctcatccgcacccaccagatgcacaaggtcgccgaggccggtgtcatcgcgctcggcaatccgtacacccccggggccgacgaccccgccgagggcgagcgcgccgacccgacccgccccggctggctctcccggctcctggactggcaggaggccgccccggacaccgacacgttctggtcgacgctgcgcgaagacctcgcccaggacaaggagatcaccgtgttccgccccgacgggggcgcgttgggtctccccgagggcgcgagttgtgtggacgccgcgtacgcgcagtacggcgaggacgcccacgcctgcatcggcgcgcgtgtcaacggccgtctggcgacgctgagtacggtcctgaaggacggcgacaccgtgcagctcctgatgggccaggaccccgcgtccgagccctccagggagtggctggagcatgcgcacacgcctgccgcgcggatcgccatccagcggtggctggccgcgcacccgtcgccgtcgccgagcgaggagcccgccgacggccccgccacggacggcttcgccgaacgcttcgccgccgaccccgccgcggagggcgccgcccgcttcgcccccgaaggacccgccgcccgccccgccgcgaacgccgtcgtcgaccagccgggagcctcggtccgcctggccggctgctgtacgcccgtaccgcccgacgagatcaccggattcgccgtgcgcgggggagtggtgaccgtccaccgagtcgagtgcgccggagtggcacgcatgaagagcgtggggcgcgcggaggtcggtgtgcgctggggggacacctccgaatgccgggtcacgctcgtcgccgagtcgttcgggcgcccccaccttctcgccgacctcaccgaggccatcgccgtggagggcgtcgcgatcgtctccgcgaccgtggagcccccgagccgccagcgcgtacggcacacgtacacgctccaactccctgacgcggcacacctcccggccctcatgcgcgcgatgcggaacgtgcccggggtgttcgacgtgagccgggcgcagcaccaggcggcggccgcgcag

SEQ ID NO: 2460 - DNA, 867 bp, Streptomyces avermitilis
  CDS (1)..(867)
atgagcacgcggatcgccttcctcaagggtcacggcactgagaacgacttcgtgatcgtcccggaccccgagaacgccatcgacctgcccccggccgccgtcgccgccctgtgcgaccgccgcgcgggcatcggcggcgacggcgtgctgcacgtcgtgcgctccgccgcccatccggaggccagggagatggccgccgaggcggagtggttcatggactaccgcaacggcgacggctcggtcgccgagatgtgcggcaacggagtgcgggtgttcgcgcgctacctccagcgggccggacatgtgaccgaaggcgacctcgcggtggccacgcgcggcggcgtgaagaccgtgcacatcgccaaggacggcgacgtcaccgtcggcatgggcaaggcgttcctccccgaaggggacgtcacggtgagcgtcggtgagcgcagctggcccgcgcgcaatgtgaacatgggcaacccgcacgcggtcgccttcgtcgacgacctcgcgcacgcgggcgacctgctcgccccgccgcccttcagtccgccgaccgcctacccggacggggtgaacgtcgagttcgtgatcgaccgcgcccccggccacgtcgcgatgcgcgtccacgagcggggctcgggcgagacccgttcgtgcggcacgggcgcgtgcgccgtggccgtcgccgccgcccgccgcgacggcgcggaccccgcggtgacgggtaccccggcgacgtacaccgtcgatctcccgggcggaacgctggtgatcaccgagcgcccggacggcgagatcgagatgaccggccccgcggtgattgtcgccgagggcgagatcgacgcggagtggctggaaaacgcggccctc

SEQ ID NO: 2461 - DNA, 531 bp, Streptomyces avermitilis
  CDS (1)..(531)
gtggcgatggaggccggccctcgcgataccgcacaaggcgcggagcaggacaccccggaacgcggggacgagctgggcgccgacgggtaccgactggagcccgacggagttttgctgagcccggacgggcccgatgagcagccgccgggaggcgtgaccgccgacggaccggaaccggaagagatgtccccgggacccgaggtcgaggtcgagctgcgtccccagcgccggctgcggatctggcagctcgcgcccatcgtggcgctggccgcggtcggctcgctgatgttcgccttcccgctggccttcgagttcggcgacggcggtgccgtggtcgccatgctcggactactgatctgctcctgcgccgccggctggggcatgatggccgcccgccgggtgggctacacctggccgggcctgccgcagcgcggctccggccgccgcgtggactggcgggtcgtgatcgcgtacgccgtcgtcgtcgccgcggtcgtcgtgctcgccgtgtggcgcgtggcgcggctgcgc

SEQ ID NO: 2462 - DNA, 936 bp, Streptomyces avermitilis
  CDS (1)..(936)
gtgagtagcgcaccccccgccccccgcgtcatcgccgtcgtcggaccgaccgcggcaggaaagtccgatctgggcgttttcctcgcccagcgtctcgacggcgaggtcgtcaacgccgactccatgcagctctaccgagggatggacatcggcaccgccaagctgacgcccgaggagcgcggcggcatcccgcaccatctcctggacatctgggacgtcaccgtcgccgccagcgtcgccgagtaccagcgcctggcccgcgcccgcatcgacgccctgctcgccgagggtcgctggccgatcctggtgggcggctccgggctgtacgtgcgcggggccgtcgacaacctggagttccccggcaccgaccccgaggtgcgggcccggctcgaggaggagctcgcgctgcgcggccccggggcgctgcacgcccgcctggccgccgccgaccccgaggccggccacgcgatcctctccagcaacggccgccgcatcgtccgggccctcgaggtgatcgagatcaccggccggcccttcacagccaacctgccgggccatgactccgtctacgacaccgtccagatcggggtcgacgtggcgcgccccgaactcgacgagcgcatcgcacgccgggtcgaccggatgtgggaggcgggcctcgtcgacgaggtgcgcgcgctggaggcgcaggggttgcgtgaggggcgtacggcatcgcgtgcgctcggctaccagcaggtactcgcggcgctcgccggggagtgcaccgaggacgaagcgcgcgccgagaccgtacgtgccaccaagcgcttcgcgcgccgtcaggattcatggttcaggcgcgacccccgggtgcattggctcagtggggctgcggcggatctcacagaacttccgcagctcgcactgatgttggtcgaacgaccggttacagcc

SEQ ID NO: 2463 - DNA, 363 bp, Streptomyces avermitilis
  CDS (1)..(363)
atgggcgtttttgcacgacttctccggaggtcgaaggctacgaaggaggcgtcgaccgccgaggcggaggccgtgaaggtgacggccgtgaaggtgacagctgagcctgtggcgaaggtgacggaggaggcgaagggttccgaggccgatgccaaggcagacaacaaggccggtgccaaggttgcggaaaaggttgaggtcgtagccgagtccgaggtcgagggcgaggcgacgaaggccgaacccgagcccgaggcctcgacggaggacaccgctcagtccgtcggcgagagcgtcgagatccccaagcagcagtccgccgaggaagccgccgacagcgacaccggcgaggacgcccgcaca

SEQ ID NO: 2464 - DNA, 273 bp, Streptomyces avermitilis
  CDS (1)..(273)
atgagtctcctggagaatttgaaggccaagctcgccccggccaaggacaaggtgtcggacctcgcgcagcagcacggggacaaggtggaacgtggtctcgacaaggccgcgaagatggtcgacgagaagaccaagggcaaatacagcgacaagatccatacggggacgggcaaggcgaagggtgccatggaccgactcgcgcacaaggacggcggatcgccgggcggtggcgcgactccaccgcatgatgcgcctgggccccccacggctttc

SEQ ID NO: 2465 - DNA, 717 bp, Streptomyces avermitilis
  CDS (1)..(717)
atgcttgtagccgccgccgtctgcccctgtccgcccctcctcgtgcccgaggtcgccacgggcgccgcgcccgagctggacgccgcgcgtgccgcctgcacggacgcgctgggcgtactcgccgcggcgcgtcccgaccggctggtggtcctcgggcccgccgagcagagcgggcgaggaccgcacccggagggcacgcggggttcgttccgtgggttcggcgtggacctcgacgtacgactgggcggggaccgggcggcaccggcggcctcgcacggtgagcttccgccctcgctggccgtcgcggcgtggctgctggagcggaccggctggtccgacgccgccgtggaaggcctcggtgtgggggagaccctcgcggccgagcggtgcatcgaggccggggagggcctggtcgcgcgggtcgagcggacggcgttgctggtgatgggcgatgccagcgcgtgccggacgctcaaggcgccgggttatctcgacgagcgcgcggcgggcttcgacgcggaggtcgcgcgggcactgggggctgcggacgtgaccgccctcaaggggctggacgcggagctggcgtacgagctgaaggcctccggccgggccccctggcaggtcctcgcgggcgcggccgagggcgcgggtctcggcggatcgctgctctatgacgacgcgccgtacggggtggggtacctggtggcggcctggtcg

SEQ ID NO: 2466 - DNA, 1524 bp, Streptomyces avermitilis
  CDS (1)..(1524)
atgagcagcatcgaccggagccagccagtgggcgtcaagacatacgaagtacgcacctacgggtgccagatgaacgtccacgattccgagcggctctccgggctcctcgaagacgccggttacgtgcgcgctcccgacggctcggacggggacgcggacgtcgtcgtcttcaacacgtgcgccgtccgcgagaacgccgacaaccgcctgtacggcaacctgggccggctcgccccgatgaagacgaagcgccccggcatgcagatcgccgtcggcggctgtctcgcgcagaaggaccgcgacaccatcgtgacgaaggcgccctgggtggacgtcgtcttcggtacgcacaacatcggcaagctgcccgtcctcctggagcgcgcccgcgtacaggaagaggcccaggtcgagatcgccgagtcgctggaggcgttcccctcgacgctgccgacccgccgcgagagcgcgtacgcggcctgggtgtcgatctccgtcggctgcaacaacacctgcaccttctgcatcgtcccggcgctccgcggcaaggagaaggaccgcaggaccggtgacatcctggccgagatcgaggcgctggtcggcgagggcgtctccgagatcacgctgctcgggcagaacgtgaacgcgtacggctccgacatcggcgaccgcgaggcgttcagcaagctgctgcgggcatgcggtcagatcgacgggctggagcgggtccgcttcacgtccccgcacccccgcgacttcaccgacgacgtcatcgccgccatggccgagacgccgaacgtgatgccgcagctccacatgccgatgcagtccggctcggacaccgtcctgaaggcgatgcgccgctcgtaccgtcaggaccgctacctcgggatcatcgagaaggtgcgcgccgccatcccgcacgcggccatcaccaccgacatcatcgtgggcttccccggcgagaccgaggaggacttcgagcagacgatgcacgccgtgcgcgaggcgcgcttcacacaggccttcaccttccagtactccaagcgccccggcaccccggccgccaccatggagaaccagatccccaaggaggtcgtccaggcgcgctacgagcgtctcgtcgccctccaggaggagatctcctgggacgagaacaagaagcaggtcggccgcaccctggagctgatggtcgccgagggcgagggccgcaaggacggcgccacgcaccgcctgtccggccgcgcccccgacaaccgcctcgtgcacttcaccaagcccgacgaggaagtgcgccccggcgacgtcgtcaccgtcgaggtcacctacgccgctccgcaccacctgctcgccgagggtcccgtgctgaacgtgcgccgcacgcgcgcgggggacgcctgggagaagcgacacatcgagaagacagccgaggcggcgaagccggcgggcgtgatgctggggctgccgaagatcggcgcaccggagccgctgccggtcgccacgggcagcggctgcggctgcgac

SEQ ID NO: 2467 - DNA, 474 bp, Streptomyces avermitilis
  CDS (1)..(474)
atggactccgcgcccctctcgcacgcttctcctgccgctcctgccgctcctgccgctcctgccgctcctgccgctcccgcttctcccgcctccctggtccgcgcgttccacctcgctttcggcctggatgcccgcaccgtgccgaccgaggtctccccggagctggccgcgcaccgtggtgagctgctcgccgaggaggcggcggaggtcgccgaggtgtccgtcaccggcccgctcgaccggctcgcgcacgaactggccgacgtcgtctacgtggcgtacggcacggccctcgtccacgggatcgacctcgacgaggtgatcgccgaggtgcaccgcgccaacatgaccaagctgggccccgacggccgcgccgtccgccgggccgacggcaaggtcctcaagggcgaccactaccgcgcgccggacgtcggggcgatcctccgccgtcaagggtggggacccgcggcggtg

SEQ ID NO: 2468 - DNA, 996 bp, Streptomyces avermitilis
  CDS (1)..(996)
atgttccaggcactcccccgtcttcgcaggcgccatgcgctgctcggctcgacggccgctttcgtggtgttcgggctgctgctgtggtggctgctgccgctgggcgaggagtcaccgggcggcacggtcacgttcagtacgggcacgcccaccggcgtctatcagaagtacggcaagcttctgaaacaggcgatcgccaaggacatgccgaagctggatgtcacgctgctggacagcgacgggtcgcaggagaacgtgcggaaggtggcgaccgggaatgccgacttcaccatcgcggcggccgacgcggtggcgacgtacgagctggcgcgcaagccgggagccgaccggctgcgtggctgtgcgcggctgtacgacgactatgtgcacctggtggtgccgcgttcgtcgtccgtgcagtccgtggcggacctgaagggcaggaaggtggccgtagggccgagcggctccggggtgcggctgatcgcggagcatgtactgaaggcggccggtctcgacgcggagaaggacatcacaccgtcgtccgagggcatcgcggccatgccggggctgctcgaacaacacaagatcgacgcgttcttctggtcgggcgggctgaccaccagtgcgatcaccgagctctcgaagggcttcgacatccggctcgtgccgatcggcagcaccctggtcaagaggctccatgagcagggcgactcgtccagctactaccgggcggccgtgatgcccgccgatgcctatcccctggcccagcagggctcgtccgtgcagacgatcgcggtcgccaacctcctgatgacccgggaggacatggacgcgaccctgaccgagcagctgacccgtacggtgatagacagccgtgaccgcatcggctcccaggtgcacgcggcccagctggtggacctgcggacggcgatctacacggatcccctggcgctgcacgagggcgcgagccgctactaccgctcggtgaagccg

SEQ ID NO: 2469 - DNA, 1404 bp, Streptomyces avermitilis
  CDS (1)..(1404)
gtgcgcacacgtctcctcccgctgctcatcgtcctgatggcggccgtgctgctcgcgctcggcttcccgctggccgtgagcatcgcggcggcgcagcagcagcgggtcgtcgtcgaccgcatagacgacacggcgcggttcgcggccctcgcgcagttcgtcaccgaccggcccaccggctcccgggtggccgtcacggacgaacgcggcgagacgctgagcaaggaactcgccatgtaccacgacgtgtacggcatccaggccggcgtcttctacctggacgacgcgcccatggcccacgcgccccagaactggtacctgcccgaacggggcgaggggcgcgacgcgttcgacgaggcccggctgggccgccgcagccacgaccccgagcaggtctggccctgggagcacaagcggctcgtcgtcgcctccccggtcatcagggacggcgacgtcatcgccgtcgtcgtcaccgactcgcccaccgggcagatgcgttccaagacccagcacggctggctgctcatcggggcgggcgagatcgccgcgatgctgctggccgtcggcgccgcactgcgcctgacgggctgggtgctgcgccccgtacgcgtcctcgacgccaccacccacgacatcgccaccggacgcctcaagtcccgggtggcggccgccggcggaccgccggaactgcggcgcctggcccggtcgttcaacgagatggcggacaacgtcgaggacgtcctggagcagcagcgcgccttcgtcgccgacgcctcccaccaactgcgcaacccgctgtcggcgctgctgctgcgcatcgaactgctcgccctcgaactgcccgagggcaacgaggagatcgcctcggtgcagaccgagggcaagcgcctcgcccaggtcctcgacgacctgctcgacctggcgctcgccgagcacgccgaggcggacctgcggctcaccgacatcggcgagctgacggccgagcgcgtcgccgcctgggggccggtcgccgccgccaacggcgtacgactggccgggacctgcccggccaccacggcctgggccgaccccatcactctctccagcgccctcgacgcggtcatcgacaacgcgctgaagttcacgcccgagggagagagcgtggaggtcgaggtgacgtccaacggcgcggtgtcgtcggtcgtcgtcacggacggcggcccgggcctcggcgacgaggaactcgcgcgcgtcggcgaccgcttctggcgcagcgcgggccaccagaacatcaagggctcgggcctcggcctgtccatctcgcgggcactgctcgcggcgggcggcgggacgatctcgtacgcgcaccacgagccgcacggactgaaggtgacggtgacggtgccgaggacggtgccgacggcc

SEQ ID NO: 2470 - DNA, 684 bp, Streptomyces avermitilis
  CDS (1)..(684)
atgcgactgctcctcgtagaggacgacaaccatgtcgccgccgccctgtccgcggtgctggcgcggcacggcttcgccgtcacgcacgcccgcaacggcgaggaggcccttcaggcgctcgtccccgagagctccggcttcggcgtcgtcctgctcgacctcggcctgcccgaccaggacggctacgaggtctgcggcaagatacgcaagcgcaccagcaccccggtgatcatggtcaccgcgcgctccgacgtacgctcccgcatccacggcctcaacctcggcgccgacgactacgtggtcaagccgtacgacaccggagaactgctcgcccgtatccacgccgtcagccggcgcaacgcccacgaggagggcggggcggccgccgagaccgcgctgcgcctcggctccgtgcacatcgagctgcccacccgccaggtcagcgtggacggttcggtggtccaactgacccgcaaggagttcgacctgctcgcgctgctggcccagcgccccggcgtggtgttccgccgcgagcagatcatcagcgaggtgtggcgcaccagctgggaggggaccgggcgcaccctcgaggtgcacgtcgcctccctgcgctccaagctgcgcatgcccgcgctgatcgagaccgtgcgcggcgtcgggtaccggctcgtcgccccggccgcg

SEQ ID NO: 2471 - DNA, 774 bp, Streptomyces avermitilis
  CDS (1)..(774)
atgaccgaagtatcggtggccaaggacgccgtggccgcgaccgacgaactggtcgtcctgaagagcgtcaacaagcacttcggcgcgttgcacgtgctccaggacatcgatctgaccatcacccgtggtgaggtcgtcgtggtcatcgggccctccgggtccgggaagtccaccctgtgccgcaccatcaaccgcctggagacgatcgattcgggcgacatcaggatcgacggcaaggcgctgccccaggaaggcaaggagctcgcccggctgcgcgccgatgtcgggatggtgttccagtccttcaacctcttcgcgcacaagacggtgctcgagaacgtgatgctgggccaggtcaaggtccgcaaggccgaccggaagaaggccgaggagaaggcgcgcggtctgctcgaccgcgtcggcgtgggcacgcagtccgacaagtaccccgcgcagctctccggcggtcagcagcagcgtgtcgccattgcccgcgcactggcgatggaccccaaggtcatgctcttcgacgagccgacctcggcgctggaccccgagatgatcaacgaggtcctcgaggtcatgcagcagctcgcgcgcgacggcatgaccatggtcgtcgtcacccacgagatgggcttcgctcgttcggctgccaaccgagtcgtcttcatggccgacggccggatcgtcgaagaggctgtgccggatcagttcttcagcaatccccgcagcgatcgggccaaggacttcctgtcgaagatccttcaccac

SEQ ID NO: 2472 - DNA, 831 bp, Streptomyces avermitilis
  CDS (1)..(831)
atgaagctccgcaaggtcaccgcagcctcggccgccgtgctcgccctcgccgtcacggccacggcctgcggctccgacgacaaggacagcagctcctccggcggcgacaagaagatcaccatcggcatcaagttcgaccagcccggcatcggccagaagacgccgcagggctactccggcttcgacgtggacgtcgccacgtacatcgccaagcagctcggttacaaggcggaccagatcgagtggaaggagtcgaagagcgccgaccgcgagaccatgctccagcgcggtgacgtcaaattcatcgccgcctcgtactcgatcaccccggagcgccaggagaaggtcgacttcgcgggcccgtacctgctggcccaccaggacgtcctggtccgtgccgacgacaactccatcaagtcgccgtcggacctcaactccaagaagctgtgttcggtgacgggctcgacctcggcgcagaacgtcaaggacaagctcgccccgaaggccaacctcctgaagtacccgacctactcggcgtgcctgaccggtctgcagaacaaggccatcgacgggctgaccaccgacgactcgatcctcgccggttacgccgcgcaggccagcttcaagggcaagttcaagctcgccggcttcaagatgacgaacgagaactacggcatcggcgtcaagaagggcagcgatctcaaggcgaagatcaacaccgccctggagaagatggtctcggacggtgcctgggagaaggccgtgacggccaacttcggcccggcgaactacaagaacgagcccgccccgaagatcggcgacatcaagaag

SEQ ID NO: 2473 - DNA, 663 bp, Streptomyces avermitilis
  CDS (1)..(663)
gtgttcgactttcttgaaggttacgacctgctgggagcgttctgggtgacggtgaagctcaccgtcttcgcaggcgtcggctccctgatctggggcactctgctggccgcgatgcgggtcggtccggtgccgctgatgcgcggtttcgggaccgcctacgtgaacatcgtgcggaacatcccgctgaccgtgatcattctgttcacctcgctgggcctgagccagacgctgggtgtcaatctcggcgcggacacgttcgagaccatcaacttccggctctccgtgctcggtctgatcgcctacacctccgcgttcgtgtgcgaggcgctgcggtccggcatcaacacggtgcccgtcggccaggccgaggcggcgcgggccatcggtctgaacttcacccaggtcctcactctgatcgtgctgccccaggcgttccgttcggtcgtcggcccgctgacgaacgtactgatcgcactgacgaagaacaccacggtggcggccgcgatcggtgtcgcggaagcggcggcgctgatgaaggagatgatcgagaacgaggctcaactcattctgatctccgcggtcttcgcgttcggcttcgtgtgcctgacgctgccgaccggtctgatcctcggctgggtgagcaagaaggtggcggtgaagcga

SEQ ID NO: 2474 - DNA, 903 bp, Streptomyces avermitilis
  CDS (1)..(903)
atgagctcggtcctgtacgacgcccagggcccgcgggccaagcggcgaaacgttctcttcaccgtggtgttcctggtcgcggccgccgccgtcctgtggtgggtgatcaccagtctcaacgacaaggaccagctggcctgggagaagtggaagcccttcttctcgagcaccgaggcctggaccacgtacctctggccggggctgcagaacacgctcaaggccgcggccctctccatggtcatcgcgatgccgctcggcgcggtcctcggtatagcccggctctcggaccacaggtgggtacgtgttccggtctcgatcgtggtggagttcttccgggccatcccggtgctgatcctcatgatcttcggcgtcgccctgtattccgagtacacgaacgtcagctcggacgaccgtccgctgtacgcggtcgtcaccggactcgtgctctacaacgcctcggtgctcgcggagatcgtccgggccggcatcctgtcgctgcccaagggccagtccgaggccgcgatggcgatcggcctgcgcaagaaccaggtcatgcggttcattctgctgccgcaggccgtcacggtgatgcttccggcgatcgtcagccagctcgtcgtgatcgtgaaggacacggcgctcggcggcgcggtcctcaccttctccgagctgctcgcctcggtcggcccgatgagcggctactacggcgcgaacaccatcgccagcttcacgatcgtggccctgatctacatcgcgatcaacttctccctcacgaccttcgcgagctggctggaggggcggctgcggcgcggcaagaagtcgacgggcgccgtgctcccgccggccgcggtcggcggggccgaatcgaccggcgcgggcggggccggcgggggcatcggcctc

SEQ ID NO: 2475 - DNA, 1863 bp, Streptomyces avermitilis
  CDS (1)..(1863)
gtggacccggtgatcatcgtcggagcggggcccgtggggctggcgctcgcccttgcgctggcgcgccaggaggttccgtccgtggtcctcgacgagggtccgggcaacgacgaacagcggcccgcgcgaaccgtcgttctgcgcgaggacaccgccgcgctcatggaacggctgacgggtctcccgctcgacgaggccgggttccgttgggccggatggcggtcgatgcggcgcaagcaggtgatgagtgagatcacgttcgacgcggacgggtccggggggtcggtgtacggctctgcgggcgtcgcctacggctccggcggtgcggggtacggctcggcgggcgccgcgggtgtctcggatcgctccatgggcggctccaggaggcctgtggacgactcacggggggccgtcggcggctccaaggggtccgcgggcgacaacagggggcccgtgggcggccccagggggcccgtggtcggctctgggcgtaccgctgaaggcgctgaagggcccgccccgctgcacatcgcccagcacgtgctgacgggcgcgctgcgggcggccatcgcgaccgagcgactggtcaaggtcgcggtgcggagccggctggacgcgatcgagcaggaggcgtccggcctcacggcgcacacacgcgacccgaaggggacctggtggcggggcagttacctggtcggctgcgacggaccgcgctcgacggtgcgcaagctcctggacatccgcttcccgggccgtaccgccgttgagcgacacgccgtggcggcgctgcatgcggaacttccctggcccggtgaggcgttgttgcaccggatgccgccgtggcggacgtcgggcccctcggccggggaggtgaccgcacgcccgctgcccgacggcgtgtggcgcctggactggctgttgccgccgggcaaggatctggtcacgcccgagctgctggtgacccgcgtccgggagacgctcgcgggctggagcggaggtcccacacctccgtacgagctgctcgacacgggcgtgcacaccgtccaccaccggctcgcccgccgctggcgggccggccgggtcttcctcgccggtgacgccgcgcacctgctcggtgcgctcggcacacagggtctcgacgagggcctcagggacgccgacaacctcgcctggaagctggcgctggcctggcatcacggcccgcacgagccgctgctcgacagctatcaggcggagcgccgtgcggtcgtcgcggcccgactgcgcgccgccgaccaggcgctgccggtggtgcgcggcggcggagggctgcgcgcgtacgtgcccggctcggcccgcggacacgacgcgctgctcacggacggtcacctggggcgcggggcactgggtacgccggggtcgtacaccgattcgccgctcgcgcctgagcgcgcggactcgacggcccctgtggacacggcaccgggtgcgccggtcgtcgatgtacgggtgacggccgaggacggctccttcgtacggctgcgggaccggctcgggcggggcgcgctgctcgtggtattgatcgcgccgggtacgggtgtgtgggagcgcaagcactgggtgtcggccgggatcatgccccggctcgcggcggcggtgaccgcgttgccgcatcccgccgagctgctggtcgcggagggttacccgggcgcggccgcgcacaccgtgctcctggtacggcccgacgggcacctggtcacggcgctgagcggggtgcggccggccgacctgtacgcggcggcggaggcgacgctgggcgggcctgcggggtcggggagcaaggcggggaccgagacgagggcggagcgggcggcgaccgggggg

SEQ ID NO: 2476 - DNA, 543 bp, Streptomyces avermitilis
  CDS (1)..(543)
gtgtctgtctctccctccacccctgcccctgcctccgtctccgtctccgctcaggtccccacccaggccgagcttctcgacttcgtacgccgttccgcggccgacgccgagctgatcgcctcgcttccgctggatcccgagggtcgcacctgggtgcgtctggagggccccggcggcagcgaggcctggctgatcggctggccgcccggcaccggcaccggctggcacgaccacgccgactcggtcggtgccttcaccacggcagcgggcgagctcaaggagaactccctcgccgtccggctgccctccgacggctggaggacgctggaactcaccgaaggggtggaccgtgaacggcggctgccggccggcaagggccgctccttcggcaaccaccacgtgcacgaggtgctcaacgactccaccgaggagcacgcggtctcggtccacgcctactatccgcccctgccgcagatccgccgctacagccgtaccggtcaggtgctgcgcctggagcacgtcgagcgtccggaggactggcag

SEQ ID NO: 2477 - DNA, 399 bp, Streptomyces avermitilis
  CDS (1)..(399)
gtgagctcttcccatgaacgtcccataggtatcgacgagttgctggaacaggtccggaagggtctcgaccgggtggaggcggcggacgcgtacgaggccgcgctggccggcgatgccctgctggtcgacatccggtacgcggccctgcgcgaccgcgacggtctgatccccggcgcgctggtcgtcgaacgcaacgaactggagtggcgcctcgacccccagggcagccaccgcgccgccgaggccaccggccacgacctgcgcgtcgtggtcgtctgcaatgagggctacgcgtcgagcctggccgccgcgtccctgcgccagttgggcctgcaccgggcaacggacctggtgggcggcttccaggcatggaagtcggccgggttcccggtgacggcc

SEQ ID NO: 2478 - DNA, 945 bp, Streptomyces avermitilis
  CDS (1)..(945)
atgacacgacgaaccgactgggccgagtacgcgtaccccgtcgcgccgcagggacgggggagcggagccgacgggaggtccgtcgggggcggcgacggggcgtacgacgagggcgagccgtacgacgacgaggcatccggcgctcacggggtgtacggcgctcacggggtatccgggacgacccgggaggcatacggcgccggtggtacgtacggcggggatgcggacggcgacggttcgcagagtcgcggttcgcggtcccgccgtggcggtcggcatggtgacggcggcttccgtggtgaccgcggcgaaggcgcatcacgcgatggcggcggtgcgcaaggaggacgagggcgcggccggcggcgcgggttcggcgagccggccggtgacccacaggacggaggcgcccctgcctcgtcgagggccgagaagggggagcccccaggggacccggctgagcgggcgcgggcgatctgtctgcgcctgctcaccgggaccccgcgcacgcgcaagcagctcgcggacgccttgcgcaagcgcgagatccccgaggacgtggcggacgaggttctgtcgcggttcgaggaggtcggcctgatcaatgacagcgccttcgcggacgcctgggtggagtcccggcaccacggccggggcctggcccgacgggcgctcgcgcgagagctgcgcacaaagggcgtggactccacactgatcgacgaggccgtggggcagctcgactccgagcaggaagaggcgaccgcgcgcgaactcgtcgcccgcaagctccgctccacgcgcggcctcgaccgcgacaagcggctgcgtcgcctcgccggcatgctcgcccgcaagggctactccgagggcatggctctgcgggtggttcggcaggcgctggaggaagagggggaggacacggaaggcttgggggacgaggggttc

SEQ ID NO: 2479 - DNA, 1131 bp, Streptomyces avermitilis
  CDS (1)..(1131)
atggcaggaaccgaccgcgagaaggcgctcgacgccgcgctcgcacagattgaacggcaattcggcaagggcgcggtgatgcgcctgggcgagcggccgaatgagcccatcgaggtcatccccaccgggtcgaccgcgctcgacgtcgccctcggcgtcggcggcctgccgcgcggccgagtggtggaggtgtacggcccggagtcctccggtaagacgaccctgacgctgcacgcggtggcgaacgcgcagaaggccggcggccaggtggccttcgtggacgccgagcacgccctcgaccccgagtacgcgaagaagctcggcgtcgacatcgacaacctgatcctgtcgcagccggacaacggtgagcaggctctggagatcgtggacatgctggtccgctccggcgcgctcgacctgatcgtcatcgactccgtcgccgccctggtgccgcgcgcggagatcgagggcgagatgggcgactcgcacgtgggtctgcaggcccgcctgatgagccaggccttgcggaagatcaccagcgcgctcaaccagtcgaagaccaccgcgatcttcatcaaccagctccgcgagaagatcggcgtgatgttcggctctccggagaccacgacgggtggccgggcgctgaagttctacgcctcggtgcggctcgacatccgtcgcatcgagacgctgaaggacggcaccgacgcggtcggcaaccgcacccgcgtcaaggtcgtcaagaacaaggtcgcgccgcccttcaagcaggccgagttcgacatcctctacgggcagggcatcagccgcgaaggcggcctgatcgacatgggcgtggagaacggcttcgtccgcaaggctggcgcctggtacacgtacgagggcgaccagctcggccagggcaaggagaacgcgcgcaacttcctgaaggacaaccccgacctcgccaacgagatcgagaagaagatcaaggagaagctgggcgtcggcgtacggccggaggagcccacggcggagccgggcgcggacgcggcggtcacgtcggccgcggctgccacggacgacaccgcgaagacggtgtccgctcccgcggccaagaccaccaagtccaaggccgcggcggccaagagc

SEQ ID NO: 2480 - DNA, 1029 bp, Streptomyces avermitilis
  CDS (1)..(1029)
ttgacgaggacggcggtgcatagagatcggccagatgcgggccggtggccgcgaggagtgcggcgagcacgacgacggcgccgaacaccaccgcggtctgggtacggaggtggtgccaggtcgctactcctccgtgagtcgccggggctactcctccgggcgtacgtccattgccttcggccgtacgacgacgacgtgggtcctgcgcacgaggcttgggccatggaaaacctggtttccccggcggttccgggcgccgcgtcggccgcgcgcaaggggccccgccgaaggttcacgacgcgcccggccgaacggttctgctacgcgaccggtgcccttctggttctctcgggcctggcgcatctggtggtcttcgccgtcgacggcggcccctgggacgggcccgtctcctggcgcaagcccgtcacgttcgggctctccttcgggctgacactggtcgccgtcacctgggtcacgtcgtatctgcgcgtcggggcgcgtctgcgcaccgcgctactcgtcgtgttcgccgccgactgcgtcgtggaggtcggcgggatcacacttcaggcgtggcgccgtgcgccctcgcacctcaacatggagaccggcttcgacacactggtctccatgaccctcgcggtgggcggcggcgtcctggtggtcgtgctctcggtgttcgcggccgcggccttccggcaccggcccgagggcccggtggggatgccgctcgcgctgcgctccgggttcgcgatcctggtcgtcgctctgctgtcgggcgccgcgatgatcgcgcgcggggtggtgctgacccgcaccggccaccaggaggcggcgtaccactcgacggccccgctcaagccgctgcacggggtgagcctgcacgccgtgctcgtgctgcccgcgctggcctcgctgctgtcccgcacgccctggagcgacccgcggaaacagcggctcatgtacgtggcggtcggcgcctacgcggtggccgtcctcgcggccggggtctgggccgtcctcacgtac

SEQ ID NO: 2481 - DNA, 1149 bp, Streptomyces avermitilis
  CDS (1)..(1149)
atgccgcgctggctgccgcgtgccatggtgctcgccctcgcccttatcgccggcttccagttcggcagttgggcgtttcaccagctcaccggcctgctgatcaacattctcatcgcgttcttcctggcgctcgccatcgagccggcggtgagctggatggccgggtacggaatgcgcagagggctggccaccttcctcgtcttcctcggcgccatgatcgtgacggcgggcttcgtcaccctgctcggctcgatgctcgcgggccagatcatcaagatggtcgagggcttccccgactacctcgactccgtcatcagctgggtcaacacgaccttccacacggatctccgacgggtcgacatccaggacagcctcgtccactccgactggctgcgaaggtacgtccagaacagcgccacgggtgtgctggacgtgtccgcgcaggtcctgggaggcctcttccagctgctgacgatcgcgctgttctccttctacttcgccgccgacgggccgcggctgcggcgcgccctgtgctccgtgctgccgcccgcccggcaggccgaggtgctgcgcgcgtgggagatagccgtcgacaagaccggcggctatctgtactcgcgcggcctgatggcgctgatctcgggcatagcgcactacatcctgctgcagtcgctgggcatcccgtacgcgcccgtgctggccgtctgggtgggcctggtctcgcagttcattccgacgatcggtacctatctcgcgggcgccctgccgatgctgatcgccttcaccgtgaatccctggtacgcgctgtgggtgctgatcttcgtcgtggtctaccagcagttcgagaactacatgctgcagcccaagctgacctcgaagaccgtcgacatccaccccgcggtcgccttcgggtcggtcatcgcgggcaccgcgctcctgggtgctgtcggggcgctgatcgccatccccgcagtcgccacccttcaggccttcctcggggcgtacgtgaagcggtacgacgtcacggacgacccccgcgtgcacgggcaccggcgccgtggccccggaaccggctccggcggtgccctcgggcgcgtgcgtcggctgtgggggcgcagccgggcggccgagtccgaggacgggtcccgg

SEQ ID NO: 2482 - DNA, 192 bp, Streptomyces avermitilis
  CDS (1)..(192)
atgcggttgacggtcttctggcagcggatggcggatcacttcggcgcggggtacgcggagaccttcgcgcgcgatcacgtgatgtcggagttgggtgggcgcacggtggacaaggccctggaggccggctgggaggccaaggacgtgtggcgcgcggtgtgcacggcgatgaacgttccgcaggagaaccgc

SEQ ID NO: 2483 - DNA, 942 bp, Streptomyces avermitilis
  CDS (1)..(942)
atggccgaaacaggagcatccccactccccccgacgccctcggcgcgctccccgctgtcccgcgccgagcacttcgtctggctcaccgcgcgcgtgctggagcagcgccgcttcgcgtaccacttcctgggtggcaccgccgacgcggtggagaccgcgctggccgcctaccgcaacgaggacgacgggtacggccacgcgctcgagcccgatctgcgcggcccggtcagtcagccgttgcacgccgggcacgcgctgcgtgtactggactcgatcgggcgctgcggcgggcagcgggtggagcgtgtgtgccggtatctgacgtccgtctcgacgctggacggcgcgcttcccgcgatccggcccagccagcgcggctatccgacggcgccgttcgtgccggtcgtcgacgatccgcccagcgaccttctcgccaccggcccggtggtgggcctgctgcaccgcaacgaggtgtggcacgcctggctgttccgggccaccgacttctgctggcaggccgtcgagtccctgcggaagtcgcacccctacgaggtcgaggcggccgtggccttcctggattcggcgccggaccgcccccgcgcggaggcggccgccgaccgtctgggccgtatggtgcgcgagcagcggctcgccgtcctggacccggagcgcctggacgcgtcccccgtatcgcccgggtacgggccgggcgaacatcacttcccgtacgacttcgcgcggactccgggctctctcgcgcgcgcgtggttcacggacgaggagatggcccgctcgctcgacttcctggcggccgaacagcggaaggacggcggctggcccattcgctggcgccagtgggcccccggcaccgctctggagtgccgccccatggtgacgatcgaggcgctgcgcaccctgaaggcgtacggacgggccatcgcc

SEQ ID NO: 2484 - DNA, 306 bp, Streptomyces avermitilis
  CDS (1)..(306)
ttgaacatctggatcgcgatcgccgcgaccgccgtcggctgctacgccgtcaagctcatcggcctgctggtccccgcgggcgtcctggagcggccgctcgtcagacggctcgcggccctgctgcccgttgccctgctcgccgccctcaccgcccagcagaccttcgccgacggccgcacgctggtgctggacgccaaggcggccggtctcgccgcggccgctgtggcgctcgtgctgcgtgcgccgttcctcctggtcgtcgccgcggcggtggtggtgacggcgggcgtgcgggcgatggcgggc

SEQ ID NO: 2485 - DNA, 906 bp, Streptomyces avermitilis
  CDS (1)..(906)
gtggcgaggacggccgcacgggcgcgcgcaagaacatggacacgggtgtgtgagggaaccgccgcgggagcgtacgggcacggccgcgggagcgtgcaagaacgtacaagacccacgggcgcgcccgcggctaccgtccgaggcgtggcagaacagacagctctcgcagacatacgcagtgaggacggcggaaaacccgacgccgccgtcgtccgggacgccctgggagtcggggtcgccgtcggactgtccggcttcgccttcggggtgacctcggccggcagcgggctgtccttgctacagacctgcgccctcagcctcctggtgttcaccggcgcctcacagttcgccctcgtgggtgcgctcgccgccgggggcaacccgctcgcggcggccgcgggagccttcttcctcggtgtgcgcaacgccttctacgggctgcgtctgtcgcagttgctggccctcccgcgcgcggtgcgcccgttcgccgcccagtgggtcatcgacgagaccaccgccgtcgcgctggcccagcccacccggcgcagcgtccgtatcggcttcacggtcaccggactctcgctgtacgtgctgtggaacctcaccacgctgatcggcgcggtcggtgcgcaggccatcggcgacaccgacgcgtggggcctggacgcggccgggcccgcggtcttcctggcgctgctcgcgccgatgctgaagaccgcggcggagcgggcggtggcgggcatcgccgtcctcctggggctcggcctgctccccgtactgcccgccggtgtgccggtcctggtggccgcgctggccgccccgaccgtcctctacgtagaagggcgccgcatgaggacctccgcctgtgacgcgacctccgcccacgacacccggagggaagcgcgt

SEQ ID NO: 2486 - DNA, 894 bp, Streptomyces avermitilis
  CDS (1)..(894)
atggcaggcacggggaaggagcgggcacggcactggcggtacgcggaactgcccggtgtcgacctgctgcgggccagctacatcgagaagatcttcgtacggcacacccacgagaacttcgtcatcgcggccatcgccgaaggcgtcgaggtcttccatcacggtggcgccgaccagtacgcgggcccgggcgccctcgcgctggtcaaccccgacaccccgcacaccggccgcgcgggcgtccccgagggctggcggtacggggcggtctacccgtcgccggaactggtggccgagatcgcggccgagaccacctcgatccgcggcacgcccggcttcaccagcccggtgctcgacgacgcgtacgcggccggcctggtccaccaggtgctccgcgccgccgacgagggcaacgcgctcgccgccgacaccctgctgcgggttgccgtgaccaggttgctccggctgaacgggggaccgatgccacagcgcgaggtccgtagcgcaggtgccggcatcgccgtacgtgcgcgtaccgtgctcgaagagcgcatggccgagcctccgaccctggagcgcctcgccggcgacctcggcgccagtcccttcgccttgctgcgcgccttccgggaggcgtacggcatgccgccccacacctggctgaccgacgcccgtgtacgccgtgcccgccgcctcctggacgccggtaccgcgcctgccgaagtggctgtcgccgtcggcttcaccgaccagccgcacctcaaccgccacttcacccggatcgtcggcgtgcccccgggcgcgtatcagcgggagcgcggcagcgacgcccgtccggtgctcggtggcgaggacggccgcacgggcgcgcgcaagaacatggacacgggtgtg

SEQ ID NO: 2487 - DNA, 4974 bp, Streptomyces avermitilis
  CDS (1)..(4974)
atggtcagttccacacaccgagccctcgacggcttctcgcccgcgacccgcggctggttcacgggggcgtttcccgcgcccaccgcggctcaggccggcgcgtggcgtgccatcggcgagggctcggacgtgctcgtggtcgccccgaccggctccggaaagacactggccgccttcctcgccgcgctcgaccagctggcgtccgccccgccgcccgccgaccccaggaagcgctgccgggtgctgtacgtatcgcccctgaaggccctcgcggtcgacgtggagcgaaatcttcgcagcccgctgaccggcatcaggcaggaagctgtgcgcctgggcatgcccgagcccgaggtgaaggtcggcatccgctcaggggacaccccgcccgccgagcgccgcgcgctgtccacccgcccgccggacatcctgatcacgaccccggagtcgctgttcctgatgctcacgtcggccacgcgggacgcgctgacgggcgtggagacggtgatcctggacgaggtgcacgcggtcgccggcacgaagcgcggcgcgcatctcgcgctctccttggagcggctcgacgagctgctgcccaaaccggcccgccgcatcggcctctccgcgaccgtgcgcccggtcgacgaggtcgcccgctatctctcaccgcggcgcaaggtggagatcgtccagccgaagtccggcaaggagttcgacctctccgtcgtggtcccggtcgaggatctgggcgagctgggcggctccccggtcgccgacggcagcgagggcgccgagcggccgtcgatctggccgcacgtggaggagcggatcgccgacctcgtccaggcccaccgctcgacgatcgtgttcgccaactcccgccgcctcgcggagcgcctgtgtaacaggctcaacgagatcgcctacgagcgggccaccggcgagcctttggacgagcaccacgccccggccgaactgatgggcggctcgggcgcggcccagggggcgcccgcggtgatcgcccgtgcccaccacggctcggtctccaaagaacagcgcgcgctcgtcgaggaggatctcaaggcgggccgcctgcccgcggtggtcgccacctccagcctggagctgggcatcgacatgggcgcggtggacctcgtcgtccaggtcgagtcgccgccgtcggtggcttccggcctccagcgcgtcggccgcgccggccaccaggtgggcgcggtctccaccggcgtcgtcttccccaagtaccgcggcgacctcgtccaggccgccgtggtcacggagcggatgcgcaccggctccatcgagtccctgaaggtgcccgccaaccccctcgacgtgctcgcgcagcagctcgtggccatggtggccctcgacacctggcaggtcgacgacctgctgaccacggtccgccgcgccgctcccttcgcctcgctcccggagtcggccttcaccgccgtgctcgacatgctcgcgggccgctatccgtccgacgccttcgcggagctgcgcccgcgcgtggtgtgggaccgcgtcgccggcacggtcaccggccgcccgggagcgcagcgcctcgccgtcacgtccgggggcacgatcccggaccgtgggctcttcggggtcttcctcgccggcgcggaccccaagaagggcggtggccgggtcggcgagctcgacgaggagatggtgtacgaatcccgggtcggggacgtgttcaccctcggcaccagctcctggcgcatcgaggacatcacgcgcgaccgggtcctggtctcccccgcccccggagtcccgggccgtctgcccttctggaagggcgaccagctgggccgcccgctggaactgggccgcgcgctgggggcgttccttcgtgaggtcggcgcgctcccgaaggacgacgcccggctgcggctgctggcagccggactcgacgcctgggccgccgacaacgtcctgtcgtacctggccgaacagcgcgaggcctgcggacacgtccccgacgaccgcacgatcgtcgtggagcgcttccgggacgagctcggcgactggcgggtcgtcgtgcactctcccttcggtgcccaggtccacgccccgtgggccctcgcgctgggcgcccggctcgccgagcggtacggcatggacgcccaggtcatgcacgccgacgacggcattgtgctgcggctgccggacgccgacctgatgggcctggacctgctcgaccaggagcccctgaaggccggcgcccctctggacacagcgggcgccgagcaggcgcccatcggtgccgcggacgtcgccttcgacaagggcgaggtcaaccagatcgtcaccgaccaggtcggcggctcggcgctgttcgcgtcccggttccgtgagtgcgccgcccgcgcgctgttgctgccgcgccgcagccccggcaagcgcaccccgctgtggcagcagcgccagcgtgcggcccaactgctccaggtggccagcgagttcggctcgttcccgatcgtcctggaggcggtccgcgaatgcctccaggacgtcttcgacgttccgggcctcacggagctgatgggcgacatcgagtcccgcaaggtccgcctggtcgaggtcaccacgccggagccgtcgcctttcgcccgctccctcctcttcggatacgtcgcgcagttcctctacgagggcgactcacccctcgccgagcggcgcgccgccgcgttgtcgctggactcgcggctgctggccgagctgctcggccaggcggagttgcgcgagctgctcgacgccgatgtcctgacggagctggagcgcgagctccagtggctcaccgaggaccgtcgcgtcaaggacaccgagggcgtcgcggaccggttgcggctgctgggccccttgaccgacgccgagctggccgagcgcggggccgagccgcagtgggcccaggagctggccggggcccgccgcgccatcaaggtccgcatcgcgggcaccgaccactgggcggcgatcgaggacgcgggccgactgcgcgacgccctcggcacagcgctgcccgtcggcgtccccgaggcattcacggagccggtcaaggacccgctcggcgacctcctcgcgcggtacgcgcgcacgcacggcccgttcacctcaacggccgctgccgcgcgcttcggtctcggcgtggccgtcaccgagggcgcgttgcagcggctcgcggcggccggccgggtcgtccagggggagttccaccctgcgggcatcggccaggagtggtgcgacgcgaccgtgctgcgccggctgcggcgccgctccttggccgccctgcggcacgagctggagccggttccgcccgccgcgctcgcgcagttcctgccgcagtggcagcacgtcggcggcggacatgggctgcggggcgtcgacggcctggtgcgcgcgatcgagcagctccagggcgcctccgtgccagcgtccgccctggagaagctcgtcctgccgtcacgcgtctcgaactacacgcccgcgatgctggacgaactcaccgccgccggtgaggtggtgtgggccggggccggttcactgcccggcaaggacggctgggtctcgctgtacatggcggacgcggcccccctgctcctgcccgccccgcaccccttggagccgaccgcgctccaccagtcggtcctggacgccctgtccgggggttacggcctgttcttccggcagatcaccgatcaggtccgggccaccacgcaccccgacgccaccgatccccaactggcggacgtgatctgggacctggcctggacgggccggctcacgaacgacacgctcgcgccgatgcgttccctgctcggctcgggccgcaccgcgggctccaccgcgcaccgcgccaagcgtgccgtcccgcgcgggcggtacggctccctgacggccaccgcgcgcccccagtcccgtacgggcccgccgaccgtcgccggccgctggtcgctgctgcccgctctcgagcccgacaccaccgtgcgcgcccacgctctggcccgcaccctgctggaccggcacggggtggtgacccgcggagccgtcgcggcggaaggcgtcgagggcggcttctcggcgacgtaccgcgtcttgtccgtgttcgaggagagcgggcaggcgcgccgcggctatgtggtcgaggggctgggcgcggcgcagttcgcgatggacggcgcggtggaccgcctgcgcgcggcggcgaacgcgcgggagagggacgagacactgcccggcccggaccgttcggacggcttcgccgggggcgccccccatcggctcgacgcggcccgtccgttcgcccctgcggcggctcccggttccggagatggtttcctcgacaggttcgacccgcagttcgactccaacctgggcgccttcgccgacctctccgacactgccgacgcgcagcccgtctccagccacccggggacgcaggcagcccccggcctccccgaggtgcagccgggtccaggccttccccgcgcgcaagccggcccccgctccccgtacggccagggtcttcccccgaaccgcactcgctccgccggcgcctcccgagccgtcgtcctggccgcggcggaccccgcgaacgcctacggcgcggccctctcctggcccgaacccccgaccggggcgggacacaagccggggcgcaaggcgggttccctggtcgtactcgtcgacggcgagctggcgctctacatggagcgcggcggcaagacgctgctggcctggccctccgaccccgacgccaagacgacggacgatccccgtctactggccgccgccgaggctctcgccgcgtccgcccgcgcgggttccctgggcacggtcaccgtggagcgggtcaacggcgcctcggcgctcacctccccgttcggcaccctcctggaaggagcaggcttcatcgcgacgccccgcggtctgcgccttcgcgcg

SEQ ID NO: 2488 - DNA, 840 bp, Streptomyces avermitilis
  CDS (1)..(840)
atgcccgaaggcgacaccgtctaccaagccgcgaggcgtctgcacagcgccctcgcgggcaaggtactgacccgttccgacctccgggtgccgaaattcgccacggccgacctcaccggccgcaccgtactggacgtcaccccccgcggaaagcacctcctcacccgcatcgagggcggcctcaccctgcactcccatctgcggatggacggttcctggaaggtgtacgcgccgggccagcgctggagcggcggccccgcacaccagatccgggcgatcttcggcaccgcggaccgcacgtccgtgggctaccgcctccccgtcctcgaactgctccgcaccgccgacgaacaccgcgccgtcggccatctgggccccgacctcctgggccccgactgggaccccgaccgggctcgggagaacctcctccgcgacccggcccgccccctcggcgaggccctcctcgatcagcgcaacctcgccggcatcggcaatgtctacaagagcgagctgtgcttcctgctccgggccactccatggctccccgtcggtgacctcccggccgagcacctcgcccaactccccgccctcgccaagaaactcctggagaccaaccgcgaccgcccggcgcgcagcaccacgggccgccgcgagcagaggctcttcgtgtacggccgcgcaccccgcccctgtctgcgctgcggcacccccgtccgggtggccgaccagggcgacggttcccgcgagcgccccacctactggtgcccggcctgccagccggggcccactccggccccgggcgcccacgcacgaaggccaagccggccacgtatcactaat

SEQ ID NO: 2489 - DNA, 762 bp, Streptomyces avermitilis
  CDS (1)..(762)
atgcccgtcaaggcgtacgacctcaccggacgcaccgcattcgtcaccggcgccgccagcggcatcggccgggcctcggccgtactgctcgcgcaggccggcgccaccgtgcactgcgcggaccgcgacgagcagggcctgcacgagacggagaccctgatcaagggcgggggcggcaccgcccgcacccaccacctcgatgtcaccgaccgggcgcggctgcaccaggccgttgccggatgcgaccgactcgacatcatggccgcggtcgccgggatcatgcacagcagtcccgtgctggagacgcgggacgaggacctcgaccgggtgctgaacgtgaacttcaagggcgtgctgtacgcctgccaggaggcggcccggcggatgatcgcggacggtactcgcggcagcattgtcaccatggcctcgggagccgtcgacaccggcggccccggactgctctgctacggcgcggcgaaggcggccgtggtccagctgaccaagaccctggcgaccgaggtcggccggcatggcatccgggtcaacgcggtggcgccgggctgggtgcgtacggccatgacggaccgccatgacggggcggcgcaggcgcatacggaggcgttcatggccaggttgtcaccgctgggcagggtcggtgaaccggacgacatcgcccacgcggtactgcacctggcctccgacgcctccccgttcaccacgggccagatcctccggccgaacggcggagtggcgatgccctgg

SEQ ID NO: 2490 - DNA, 276 bp, Streptomyces avermitilis
  CDS (1)..(276)
atggctgggcgaatagcgcgctggggggtggcgctggcgctcggcgcgctgtggtggtggggggtactacggctcgtactggtgcccgattccggggtgctggagggagccgtcgtggccggggggtgggggctgagcctgctgccggtgcactgtgtgccgaaggcccgggtggcaggagcggccggctcggaccagtgggcggtgtcctggcagcagtggaggtcgcgggaagggcgcgcggaggtgcggcgtgggggagacgcgccgcgcgcc

SEQ ID NO: 2491 - DNA, 468 bp, Streptomyces avermitilis
  CDS (1)..(468)
atgtatgtcgtgaagagcccgctgcccgacgcggacctgaagaccgtggccgaggcattgcagggtgcgctggtcgacctggtggatctgtcactcgtggcgaaacaggtccactggaacgtcatcggaccgcgcttccgctccattcacctgcaactcgacgacgtcgtcgacaccgcgaggctgcactccgacacggttgccgagcgcgccgcgaccctgggtgtctccccggacggccgcgccgtgaccgtggcgaacaccagtggcatcggtgagacggccgcgggctggatccaggacaaggacgcggtgggcatgctggtcaccgcgctgggcgcggtgatctcgcgtatgcgggagcgcgtggggtcgacggcggacgcggaccccgtgagccaggacatcttcatcgggatcaccgccgatctggagaagcaccactggatgttccaggcggagaacggg

SEQ ID NO: 2492 - DNA, 375 bp, Streptomyces avermitilis
  CDS (1)..(375)
atgattctgctccgtcgcctgctgggtgacgtgctgcgtcggcagcgccagcgccagggccgtactctgcgcgaagtctcctcgtccgcccgagtctcactcggctatctctccgaggtggagcgggggcagaaggaggcatcctccgagctgctctccgcgatctgcgacgcgctggacgtacggatgtccgagctcatgcgggaagtgagcgacgagctcgccctcgccgagctggcacagtcggctgcggccaccgaaccggtaccaacaccggtacgtcgcccgatgctcaactccgtgtccgtcgccggtgtgccaccggaacgggtcacgatcaaggcgcccacagaggcagtggacgtggtcgccgcc

SEQ ID NO: 2493 - DNA, 543 bp, Streptomyces avermitilis
  CDS (1)..(543)
gtgaattccctggccactgaagtgctgcgactactcggagtgaggggcgagacgctcgccgtcgccgagtcgctgaccggtggcctggtggcggcggagatcaccgcggcgcccggagcctccaagagcttccgtggctcggtgaccgcgtacgccaccgatgtgaagcgggacatcctcggcgtcgacagcactctgctggccgagcgcggagcggtggatccgcaggtcgctgcccagatggcggtcggcgtccgcaaggtcatgggcgcggactgggggatttccaccacgggtgtcgcggggccggaggcacaggacggacagccggtcggcacggttttcgtggccgtcgacgggcccttcgcgggctccgggagttccagcggtggcgggaaagtggcgtccctgcggttgaacggcgaccgtgcggaaatccgtatggagagtgtacggagcgtactcgcactgctcctgaaggagctcgcgggcgaacagaccgggaatgagcgggcacaggatacggaagagaacggggggact

SEQ ID NO: 2494 - DNA, 846 bp, Streptomyces avermitilis
  CDS (1)..(846)
atgaccggagtcccggcatccgcggcgggcggttccgccggcgcacggggtgcggcctccgcggcgggcgcctccggggccaagggagccgccggcgttccgggcgcgatgaccgcgaggaacgcggcgggcggctcctccggtgcgcagagcgtggatgacggcgccgccggcacacagggcgcccagggcggagcttccgccggtcatgagagcacgcggcaggtgcggggcggaaagctgggcgccgcggccgtcaaccaggccagcgtctggaacgtcgcgaacctgctgaccatgctccgcctggtcctcgtaccgggtttcgtggcactcatgctggccgacggcggctatgaccccgcctggcgcgcgtgggcctgggcggccttcgccgtcgccatgatcaccgacatcttcgacggccatctggcgcgtacgtacaacctggtcaccgacttcgggaagatcgccgaccccatcgccgacaaggcgatcatgggtgcggcactgatctgtctgtcctggctcggcgatctgccgtggtgggtcaccggggtgatcctcgggcgtgagctcgggatcaccctgctgcgtttcgtcgtgatccggtacggggtcatcccggcgagccgcggcggcaagctgaagaccttgacccagggcgtggccgtcgggatgtacgtgctggcgctgacgggacccctggcgaccctgaggttctgggtgatgggcgtggcgatcgtcctgaccgtggtcaccgggctcgactatgtgagacaggccattgtgctgcgcaggcagggaatcgccgagcgcaaagccgcggccgaggaggcggaacgg

SEQ ID NO: 2495 - DNA, 1485 bp, Streptomyces avermitilis
  CDS (1)..(1485)
atgcctgaacgccgtaccgtcgcactcgtcacccttggctgcgcccgtaacgaggtggactcggaggagctcgcaggccgcttggaggcggacggctggcaactcgtggaggacgccgaggacgcggacgtcgccgtcgtcaacacctgtggcttcgtcgaggccgccaagaaggactccgtcgacgccctcctggaagccaatgatctcaagggacacggcagaacccaggccgtcgtggcggtgggctgcatggccgagcggtacggcaaggagctggccgaggccctccccgaggccgacggcgtgctcggcttcgacgactacacgaacatctccgaccgcctccagaccatcctgaacggcggcatccacgccgcccacaccccgcgcgaccgccgcaagctgctgccgatcagccccgcggagcggcagagcgcgggcgcggacgtggcacttccggggcacggtgcccccgagggcctgccggaggacctgcccgagggcctggcgcccgagtccggcccccgtgcacccctgcgccgccgcctcgacggttccccggtcgcctcggtgaagctcgcctccggctgcgaccggcgctgctccttctgcgctatcccctccttccgcggctccttcatctcccggcgccccagtgacgtgctcggtgagacgcgctggctggcggagcagggcgtcaaggaggtcatgctggtctccgagaacaacacctcgtacggcaaggacctgggcgacatccgcctgctggagaccctgctgcccgaactcgccgaggtggacgggatcgagcgcgtccgcgtcagctacctccagcccgcggagatgcggccagggctcatcgacgtgctgacctccacgccgaagatcgcgccctacttcgacctgtccttccagcactccgcgcccgacgtgctgcgcgcgatgcgccgcttcggtgacacggaccgcttcctggagctgctcgacacgatccgctccaaggccccgcaggccggcgtgcgctccaacttcatcgtgggcttccccggcgagaccgaggccgacctcgcggagctggagcggttcctcacgggcgcacggctggacgcgatcggcgtcttcgggtactccgacgaggagggcacggaggcggcgacgtacggccacaagctggacgaggacgtcgtcgccgcgcggcttgcgcgggtctcccggctggccgaggaactggtcgcgcagcgcgcggaggagcgggtcggcgagaccgtgcacgtcctggtcgagtccatcgacgacgaagagggcgccgtcggccgcgccgagcaccaggcgcccgagacggatggccaggtgctgttcacgagcggcgaaggtctgaccgtcggtcgtatggtcgaggcgaaggtggtcggtacggaaggtgtcgacctcgtggccgagccgctcccggggtcgctcgtgtgtactgaggaggcgggcaga

SEQ ID NO: 2496 - DNA, 894 bp, Streptomyces avermitilis
  CDS (1)..(894)
gtggctacacgctcgaaaggcgcccccgtgtccatcggcaactcccctgacggcaactcccctgaggacgagcgtccgttcgaaagcgatcgtgaagacgcccgtgcggcggatcgcccctcgatcggccgtgctctgcagcaggcgcgcatcgcggccgggctgaccgtcgacgacgtcagcaacgccacgcgggtccgcatcgccatcgtgcacgcgatcgagcaggacaacttcgccccctgtggcggtgacgtctacgcgcgcggtcacctgcgcaccctcgcgcgcgcggtgcgcatcgatccggcgccgctgctcgcccagtacgacgccgatcacggcgggcgccccgccccgaccccggccgccccgctcttcgaggccgagcgcatccgtccggagcggcgcgggcccaactggaccgcggccatggtcgcggcgatcgtcgcggtgatcggcttcgtcgggttcaccgccgtcaaggggagcggcggcggcgacggcacgaagacgcaggtcgccgagggctccacgccgagcaccagcaagcccgcctcgcccacgcccaagaaggccaagcccgtcgaccccaagcccgacgtctcggacagcgccatcgcggccgcgccccgcgacaaggtgaccgtccaggtgagcgccgccgacggccgcagctggatctccgccaaggaccacaacggccggctgctgttcgacggcaccctggagaagggcgactccaagaccttccaggacaaggagaagatcgagctcgtcctcggtgacgcgggcgcggtccagctgttcgtgaacggcaagcagatccaggacgagttccaggccggccaggtggagcgcctcacatacaccaagggcgacccccaggccgga

SEQ ID NO: 2497 - DNA, 2751 bp, Streptomyces avermitilis
  CDS (1)..(2751)
gtgtcccctgccgtctccaccggtaacctcacactcatggcctcacgtcagcccgcagccaagaagccgcccgcgaagaaggcggccgttccgacgaaggctccggcgaagaaggcccccgcgaaaaaggcagccgtcaggaaggcgcccgccaggaaggtcgcggcgaagaagcccgctccgaagccggcgcccaatcccaccgggggcgtgtacaagctcgcacgcgccctgtggctgggagtcgcgcacgccgtcggagcgatgttccgcggcatagggcagggcgccaaggggctcgacccggcgcaccgcaaggacgggctcgcgctcctgctgctcgggctcgcgctgatcgtcgccgcgggtacctggtcgaatctgcgcggacccgtcggcgacctggtcgagatgctggtcaccggtgccttcggccggctcgacctgctcgtgccgatactgctcgcggtgatcgccgtgcgcttcatccggcacccggagaagcccgaggccaacgggcgcatcgtgatcggcctgtccgcgctcgtcatcggcgtgctgggccaggtccacatcgcgtgcggggcgcccgcgcgcagcgacggcatgcaggcgataagggacgccggcggcctcatcggctggagcgcggccactccgctgacgtacacgatgggtgacgtactcgccgtcccgctgctcgtcctgctcaccgtcttcgggctgctcgtcgtcacggcgaccccggtcaacgcgatcccgcagcggctgcggctgctcggcgtgaggctcggcgtcgtccacgacgcgcaagagggactcgccgaggacgacgagcgctacgacgagcagtggcgcgaggcgctgcccccgaacgcccggcggcgcgggcccgcccccgcgggctacgacccggacggggacgagcaggaggcactctccaagcgccgcagccgccccaggcgctccgccgggcagcagcccgacctgaaccggcccatggatgccgtggacgtcgccgcagccgccgctgccgccctcgacggcgccgtcctgcacggcatgccgccctccccgctggtcgccgatctgacgcagggcgtcaccgtggagcgtgacgggtacgaggagacgacacccgtaccggccgcacgcgccaaggcggtgaagccgcccaggaaggaggcgtcgaaggcgggggtcccggacctcaccaaggcgccgccggccgagacgcgggacctgcccgcgcgtgccgagcagctccagctctcgggcgacatcacctactccctgccgtcgctcgaccttctggagcgcggtggccccggcaagacgcgcagcgccgccaacgacgccgtcgtcgcctccctctcgaacgtcttcatggagttcaaggtcgacgccgccgtcacgggtttcacccgcggcccgacggtcacgcgctacgaggtcgaactgggcccggccgtgaaggtcgagcggatcaccgcgctcaccaagaacatcgcgtacgccgtcgccagccccgacgtgcggatcatcagcccgatccccggcaagtccgcagtcggtatcgagatcccgaacaccgaccgcgagatggtcaacctcggtgacgtgctgcgcctcgcggacgccgccgaggacgaccaccccatgctggtcgcgctcggcaaggacgtcgaggggggctatgtgatggccaacctcgcgaagatgccgcacctgctcgtcgcgggtgcgaccggctccggtaaatcgtcctgcatcaactgtctgatcacgtccgtcatggtccgcgcgacccccgaggacgtgcggatggtcctcgtcgaccccaagcgcgtcgagctgaccgcgtacgagggcatcccgcacctgatcacgccgatcatcaccaaccccaagcgggccgccgaagcgctgcagtgggtcgtgcgtgagatggacctgcgctacgacgacctggcggcgttcgggtaccggcacatcgacgacttcaacgaggccatcaggaacggcaaggtgaagctgcccgagggcagtgagcgcgagctgtcgccgtacccgtatctgctggtcatcgtggacgagctggccgacctgatgatggtcgcgccgcgcgacgtcgaggacgccatcgtgcgcatcacgcagctcgcgcgcgcggccggcatccacctggtgctcgccacgcagcggccgtccgtcgacgtcgtcaccggtctgatcaaggcgaacgtgccctcccggctagccttcgccacctcctcgctcgccgactcgcgtgtcatcctcgaccagcccggcgccgagaagctgatcggcaagggcgacgggctcttcctgccgatgggcgccaacaagcccacccgtatgcagggcgccttcgtcaccgaggacgaggtcgaggccgtcgtccagcactgcaaggaccagatggcgcccgtcttccgggacgacgtcaccgtgggcaccaagcagaagaaggagatcgacgaggacatcggcgacgacctcgacctgctgtgccaggcggccgagctggtggtctccacgcagttcgggtccacctcgatgctccagcgcaagttgcgcgtcgggttcgccaaggcggggcgcctcatggatctcatggagtcccggaacatcgtcggcccgagcgagggttccaaggcacgtgacgttctggtgaaggccgacgagctggatggcgtgctcgcggtgattcgcggggaggctgcgccg

SEQ ID NO: 2498 - DNA, 684 bp, Streptomyces avermitilis
  CDS (1)..(684)
atggtgcagaaggccaagatcctcctggtcgatgaccggccggagaatctgctggcgctggaggccatcctctctgcgctcgatcagacactggtgcgggcatcgtccggggaagaagcactcaaagcactgctcacggacgacttcgcggtcattctgctggacgtccagatgccgggcatggacggtttcgagactgccgcgcacatcaagcggcgagagcggacccgggacatcccgatcatcttcctcaccgcgatcaaccacgggccgcaccacaccttccgggggtacgcggcgggtgcggtggactacatctccaagccgttcgacccgtgggtgctgcgcgcgaaggtctcggtgttcgtcgagctgtacatgaagaactgccaactgcgtgagcaggcggcgctgctgcggctccagctggagggtggtggcggcaaggtcgccgtcggcgagaccaaggagccggcgggactgctcgccgaactctccgcacggctcgcggctgttgaggaacaggccgaggcgctgtcgaagcagctcgacgacgactcggcggatgcggccgcggtggcgaccgccgcccatctcgaacgcaaactcacgggtctgcgcagggcgctggacgccctggagccgggcaccgggagcggagcgccctcgctgccgtcgccgaac

SEQ ID NO: 2499 - DNA, 5487 bp, Streptomyces avermitilis
  CDS (1)..(5487)
gtggagtctggcgcagcgacgcggggcactaagacgcgcgcgaaaggcggacagtccctgagtaaccagcgcaaaccgcgcaccggcaccacggcggtggatacggcagccctgaaccggctgctggctgccctggtgtcgatgcgggacggcaacttccgcaaacggttgacagtctcgggcgacggcgtgatgtccgagattgcggcggttttcaatgaagtggccgagcgcaacctgcatctgaccggtgagctggcgcgggtgcggcgcatggtcggccgtgagggaaagctcacggaacggctggagtcgggtgcctgcgagggttcgtgggcggccgcgatcgacaactccaacgcgctcgtcgacgacctcgcgcggcccgtctccgaggtcagccgggtgctgtccgcggtggccgagggcgacctgtcgccgcggatggagctgcgggcgcaggcggcggacgggaacgggcatccgctgcgcggtgagttcctgaaggtcgggcgcacggtcaacaacctggtcgatcagctgtcgtcgttcaccgacgaggtcacccgcgtggccagcgaggtgggcaccgagggcaagctgggcgggcaggcccgggtgcgcggtatgtccggttcgtggaaggatctcacggactccgtcaacaccatggcgtaccggctgaccgctcaggtgcgtgacatcgctctcgtgacgacggcggtcgcgaagggtgatctgtcccggaaggtcacggttcacgtggccggcgagatgctggagctcaagaacaccgtcaacacgatggtggaccagctgtcctcgttctcctccgaggtgacgcgagtcgcacgtgaggtgggtaccgagggtgagttgggcggtcaggcgcaggtgcccggtgtggccggcgtgtggaaggacctcaccgattcggtgaacctcatggccggcaacctgacggcccaggtgcgcgggatcgcgcaggtgacgaccgcggtcgccaacggtgacctgtcgcagaaggtgaccgtgtcggcgcgcggggaggtcgcgcagctcgccgagacgatcaaccagatgactgagacgctgcgcacattcgcggacgaggtcacccgcgtggccaacgaggtcggcggggaggggcggctcggcgggcaggcgaacgtgccgggtgcggcgggtacgtggaaggacctcaccgattcggtgaacacggtcttccggaacctgaccactcaggtgcgggacatcgccgccgtgacgacggccgtggccaacggtgacctgtcgcagaaggtcacggtcgacgtggccggcgagatgctggagctgaagaacaccgtcaacacgatggtcgaccagctgtcgtcgttcggcgccgaggtcacgcgcgtggcgcgcgaggtcggcgtcgagggggagctgggcggtcaggcgcaggtgccgggggcggccggtacgtggaaggacctgacggactccgtcaacacggcgttccggaacctgacgggccaggtgcggaacatcgcccaggtgacgacggctgtcgccaacggtgacctctcgcagaaggtcacggtcgacgtctccggcgagatgctccagctgaagaacaccgtcaacacgatggtcgaccagctgtcgtccttcgccgaccaggtgacgcggatggcccgggacgtgggtacggagggccgcctcggcggtcaggcccgggtggacggcgtgtccggtacgtggaaggaactcaccgactccgtcaatttcatggcggggaacctgacctcgcaggtgcggcagatcgcccaggtcacgacggcggtggcgcggggtgacctgtcgcagaagatcgacgtggacgcgcgcggcgagatcctggagctgaagaacaccatcaacacgatggtcgaccagctctccgccttcgccgaccaggtgacccgggtcgcccgcgaggtgggcacggaaggccggctcggcggtcaggcgcaggtgccgggcgtcgccggggtgtggcgcgacctgacggattccgtgaacggcatggcgggcaacctcaccgcccaggtgcgcaacatcgcgcaggtcgcgaccgcggtggcgcggggtgacctgtcgcagaagatcgacgtggacgcgcgcggcgagatcctggagctgaagaacaccctcaacacgatggtggaccagctctcgaacttcgccgagcaggtgacccgggtggcccgcgaggtcggcacggagggcatgctcggcggacaggccgaggtgcagggtgtctccggcacctggaaggacctcacccagtccgtgaacttcatggcgaacaacctgaccattcaggtgcgcaacatcgccgaggtcacgaccgcggtcgccaagggtgacctgtcgaagaagatcactgtcgacgcgaagggcgagatcctcgaactcgtcaccaccgtcaacacgatggtggaccagctgtcgtccttcgccgagcaggtgacccgggtggcccgcgaggtgggcaccgagggcatcctcggcggtcaggcgcacgtgcccggtgtcacgggcatctggaaggacctcagtaacaacgtcaacctgatggccaacaacctgaccatgcaggtgcgcaacatctcgcaggtcgccgcggccgtcgccaacggcgacctgacccggacggtgacgatcgaggcgcgcggcgaggtcgcgcagctcgccgacaccttcaacaccatggtgaagacgctgagttcgttcgccgaccaggtcaccaaggtggcccgcgaggtgggcacggacggcatcctcggcgggcaggcgcacgtcccgggggtcgccggtacgtggaaggacctcaccgagtccgtgaacggcatggcgtccaacctgaccggccaggtgcggaacatcgcgatggtcaccaccgccatcgccaagggcgacctgaccaagaagatcgacatcgatgcccgcggcgagatcctggagctgaagaccaccatcaacacgatggtggaccagctgtcgtccttcgctgaagaggtcacccgagtcgcccgcgaggtgggcaccgaggggcagctgggcggccaggcacgcgtgcgggacgtcgacggcacctggcgcgacctcaccgagtcggtgaacgagatggccgggaacctgacccggcaggtgcgcgccatcgcgcgcgtggcgaccgcggtgacccgcggcgacctgaacctgaagatcgacgtggacgcctcgggcgagatccaggaacttcaggactacatcaacaagatgatcgccaacctgcgcgacaccaccatcgccaacaaggaacaggactggctcaagggcaatctcgcccggatctccgccctgatgcaggggcgccgcgacctcgacgacgtggcctcgctgatcatgagcgagctgacgccggtcgtgtccgcgcagcacggagcgttcttcctggccatgccgctggtcgacgccagggagggcggcgccgagcaggaggacgcgtacgagctgcggatgtgcgggtcctacggctactcgatgggctccatgccgacgtcgttccggcccggtgaggcgctcatcgggacggccgcccaggagaagcgcacgatcctcgtggagaacgcgccgagcgggtacctgaagatctcctcggggctcggcgaggcgccgcccgcacaggtcatcgtgcttccggtgctcttcgaggggaatgtgctcggcgtcatcgagctggcgtcgttcacaccgttcacgcagatccagaaggacttcctgaaccagatcgccgagatgatcgcgacgagcgtcaacaccatctccgtcaacaccaagacggaggtgctgctgaagcagtcgcaggagctgaccgagcaactccgggagcggtcggccgagttggagaaccggcagaaggccctccaggcgtcgaacgccgaactggaggagaaggccgagctgctggcgcagcagaaccgcgacatcgaggtcaagaacaccgagatcgaggaggcgcggcaggttctggaggagcgtgccgagcagctcgcggtctccatgcgctacaagagcgagttcctggcgaacatgtcgcacgagctgcgtacgccgctcaactccctgctgatcctcgccaagttgctggccgacaacgcggactcgaacctcaccccgaagcaggtcgagttcgccgagaccatccatggcgcgggctccgacctgcttcagctcatcaacgacatcctcgacctgtcgaaggtcgaggccggcaagatggacgtgtcgccgacgcgtatcgcgctcgtccaactcgttgactacgtagaggccactttccgtccgctgacggcggagaagggcctcgacttctccgtacgggtctcgccggaactgcccgccacgctgcacaccgacgaacagcggctccttcaggtgctgcgcaacctgctgtcgaacgcggtgaagttcaccgactccggagcggtcgaactggtcatccggcccgcgggcgcggacgtaccggtggccatccgggagcagctcctggaggcaggttcgctgcgggacgcggacgccggtctgatcgcgttctccgtcaccgacaccggcatcggcatcgcggccagcaagatgcgggtgatcttcgaagcgttcaagcaggcggacgggacgacgagccgcaagtacggcggtacgggtctggggctgtccatcagccgggagatcgcgcgtctgctcggcggcgagatccacgcggcgagcgagccgggacgcggctcgacgttcacgctgtatttgccgctgcaccccagtgaactgccgccgcagggttacgcccagatggcgcccacgatggaggtcggtgagctgctggcgtccgagccggagctgtccgcgccggacatcgagacgccggccgaggtgaagtcgtaccgcgacacgcagaacgggcccgccgcgctcttcaggcgccgtcgcagggcggtgaccgcggccgaggaacggaccgcgctgccgggcaggcccgcccaggggcaggagcagtgggtgggcgcggggcagcaggagccggcgccgcagccgcgtcgggggatccggttcgacggcgagaaggtgctgatcgtcgacgacgacatccggaacgtcttcgcgctcacgagcgttctcgagcagcacggtctttcggtgctgtacgccgagaacggccgcgagggcatcgaggtcctggagcagcacgacgatgtgacggtcgtcctgatggacatcatgatgcccgagatggacggatacgccacgaccaccgcgatccggcggatgccgcagttcgccggactgccgatcatcgcgttgaccgccaaggccatgaagggcgaccgggagaaggccatcgagtcgggagcgtccgactatgtgaccaagccggtcgaccccgatcatctgctcaccgtgatggaacagtggatgcgtgcggag

SEQ ID NO: 2500 - DNA, 2745 bp, Streptomyces avermitilis
  CDS (1)..(2745)
atgaccaccggactgcatcccgggggaccaccccaggatccccggccgacggggaaccagccgctgccgaggcaggagcgggtcggcgaggcagccctgcacgccgacaaccggacgaggagttctgtgatcaccgcgcgcgcggccgccagtttcgatcctgtcgggcgatcggtcgcgaccgcccgctccttcgtccgcgacaccctccagggctggggtttcgccgacatcgtcgacgacgccgtggtcctcaccagcgagctggtcaccaacgccgtggtgcacgcgggtacgtccgcggacgtgctctgtctgcgcagcgacgacggcgtacgcatcgaggtcggggacagatatcccgaacgcgagatccccctccaggccgccgccgtcaacatgggcaaccccgaccgcgaggggggccgcggcctccagctctgcgctgccctggccggccgctggggcgtcgactacacacccacgcacaaacaggtctggttccaactggacctccccgaacgcccggtgggcacccgcaccgccggcccgtccctccccgccgagctcctcccgctcgccgacggccgggtccgtgtcgccgtcgtccagatcgaccgagcgggcgccatcaacgcgtggaacgaggacgcggaggagctcttcgggtacgcggccgagctggtcatcggcaagcccctcaccgaccttgcggcctggccccacaccccgggcaccagcaccggcatcgtcgaggccctccagctgtcgcgctgggagggcagttacggcgtccgcggcgcgagcggccgcgtgatccccgtgtacgcctcccacctccgggtgcgggacaccggcggcgaaccgtccacggtctgcctcctggtacgcgaacacgaacgcgccgtcctccagaccccgttgcgcggacagtcccccgacgcgacgaacagcgccgagggccaggccctggacccgttcgaggtcttcatcggctccccggcccccgacgacctcgacggcctgctccagcgcacggtggagcgcgcccgcgacatgctcgacgccgactcggcgttcctgctcctggccaccgacgacgagacggagctggaggtacgagcctcgacgggcctcccctcggcccgccagcgcttcgcccgtgtcccggtcgacgcgggccccggccgctacgggtcggcccgcatgccggccgtccatgacgacctcaccgccgtccccggcgcggtccccctgctcagcggcacgggcatgcgttcggtcgtcacggtcccgctgaaggtcgagggccgcctcaccggttcgctcggcgtcgcggccgagtccccgtcccggtactccaacgaggaggccctgcgcctccagttcgccgccgaccgcatcgcgctcgctgtggagtccgcccggctcggcgagctggagcgcctgcgccgcggttccctgagcttcctggtggaggcctcggacctcctggcgggcaccctggaccgcgaccagaccctggctctgatggcccagatgaccatcccgaccctcgccacctggtgcgccgtctacacgatcgccgaccaggcctcggagccgtacctctcctacgttctccacgaggacgaggaccgcatcgacggcgtcaaggcactcctgtcgaagatccccccgccggagccgattccgacgccgggcgcccgcgtctggtcggccccggcacaggcggctcacgaggcggccctgcggacgtccatgcgcagcctgggcctgggcgagcccgcgacggtgagctccggcatcggtacgaccctggcgacggcgtccgcggtgggcggcgagacggtcgtcctccccctggtggcgcgcaaccgcgtcatcggcatgctgacgctgggcaagccgtcggacgaacacttccgccaggagatcctggagctggccgaggacttgagccgccgggccgccctggccctggacaacgctcgcctgtactcggagcgcacggccatcagccagtccctccagcgcagcctcctgccgccggatctcccgcacatcgagggcgtcgaggtcgaggtcatctaccgcgcggccggcgagggcaacgaggtcggcggcgacttctacgacctcttcccgatccgcgacggtgcgtacggcttcgccatcggcgacgtctgcggtacgggcccgaacgcggcggcggtcaccggcctggcccggcacgccctgcgtctcctggcccgcgagggcctcagcggcccggcggtgctggagcgcctcaactccgcgatcctcgacgagggcgcccgcagccgcttcctgacgctcctgtacggggagttgtggcctcaggaggacggcagcgccctcctcaaggtggtctgcgccggccacccgctcccgctccgcctgcgccaggacggcacggtcgaaccggccgccgaaccgcagccgctcctcggcgtcatggaggacctggagctgtacgagcagacggtgacgctcgatccgggtgacgtcctgctgtgcgtcacggacggagtcaccgaacgccgcgagggcacccgcatgttgggcgacgacggactgacggacgtcctcaccacgtgcacgggcctgacagcgggcgcggtggcggcccgcatcatgcgtgcggtcgaacgcttcgcctcggacgccccgtcggacgacatggccattctcgcgatgcgtgtggcgggcctgcagaaggac

SEQ ID NO: 2501 - DNA, 675 bp, Streptomyces avermitilis
  CDS (1)..(675)
atgggtaccgttggaatgctcaaggccgccggcgcaggagccggtgacgaggtcatcgtcccggccttcgggaacgtcgaagtcgccgaggccgtgaccctggccggtgcgacgcccgtcttcgcggacatagacccggccacgtactgcctggaccccgcggcggtcgaggccgccgtgacctcggggaccgtggccgtcatcgccgtacaccgcttcggccggccggccgacatcgctcggctgcacggtgtcggacagcggcacggccttctcgtgctcgagcagggcgagtccgaggcgccgtacgacgagatcgcgcagcgcagggagcgggccgcctatctcgatgcccggttgaacggggtgtggacgccggacggcggtgacgggcacacctatcagcattacgtcgtgcgcgtgcccgggaacgggcgcccggaccgcgacgcattcgcgcgggccgtgcggtccaagggagttgactgccgggtgccggtgaagacgcccgtacaccgcatgcccgccttccgtcgggacgtgtgcctgccggagaccgagcgggccgcggacgagacattggcgctgcccgtggacgtgtcgctgacaaagcgcgagatgcagcggatcgtctccgcgtgcaatgcgctcggcggactccttcagcctgccttc

SEQ ID NO: 2502 - DNA, 1683 bp, Streptomyces avermitilis
  CDS (1)..(1683)
ttgagtcatccgcatcctgaactcggcccgccgccgaagctccccaagggcggccttcgggtcaccccgctgggcggtctcggcgaaatcggccgcaacatgaccgtcttcgagtacggcggtcgcctgctgatcgtcgactgcggagtgctcttccccgaggaggagcagcccggaatcgacctgatcctgccggacttcacgtccatcagggaccgcctcgacgacatcgagggcatcgtcctcacccatggccacgaggaccacatcggcggcgtcccgttcctcctccgggagaagccggacatcccgctgatcggctccaagctgaccctcgcactcatcgaggcgaagctccaggagcaccgcatccgtccgtacacccttgaggtggcggaggggaaccgcgagcgcatcggcccgttcgactgcgagttcgtcgccgtcaaccactccattccggacgccttggcggtcgccatccgcactccggccggcatggtcgtccacacgggcgacttcaagatggaccagctcccgctggacaaccgtctgacggacctccacgcgttcgcgcggctgagtgaggagggcatcgacctcctcctctcggactcgacgaacgcggaggtcccgggtttcgtcccgcccgagcgcgacatctcgaacgtgctgcgcaacgtcttcgcgggcgcccgcaagcggatcatcgtggcgagcttcgccagccacgtccaccgcatccagcagatcctggacgcggcgcacgagtacggccgccgggtcgccttcgtcggacgctcgatggtccgcaacatgggcatcgcccgggacctgggctatctgaaggttccgccgggcctggtcgtggacgtcaagacgctggacgacctcccggagcacgagatcgtgctggtctgcacgggctcgcagggcgagccgatggcggctctgtcacgcatggccaaccgggaccatcagatccgcatcgtccagggcgacacggtcatcctcgcgtcgtcgctcatccccggtaacgagaacgcggtctaccgcgtgatcaacggcctgacccgctggggcgcgcacgtcgtccacaagggcaacgccaaggtgcacgtctcgggccacgcctcggccggcgagctgttgtacttctacaacatctgcaagccacgcaacctcatgccggtccacggcgaatggcgccatctgcgggccaacgccgagctgggcgctctcaccggcgtcccgcacgaccgcatcgtgatcgccgaggacggcgtcgtcgtcgacctggtcgagggcaaggccaagatcaccggcaaggtccaggcgggatacgtgtacgtcgacggcctctcggtcggcgacgtcggcgagcccgcgctcaaggaccgcaagatcctcggcgacgaggggatcatctcggtcttcctggtcgtggacgcgtccaccggaaagatcactggtggtccccacatccaggcccgtggctccggcatcgacgactccgcgttcggcgacgtcatcccgaagatcgccgaagtgctggagaggtccgctcaggacggggtcatggagccccaccagctgcagcaactcatccgccgcacactgggcaagtgggtctcggacacctaccggcgccggccgatgatcctgccggtcgtggtcgaggtc

SEQ ID NO: 2503 - DNA, 897 bp, Streptomyces avermitilis
  CDS (1)..(897)
atggctccgacctccactccgcagacccccttcgggcgggtcctcaccgccatggtcacgcccttcgcggcggacggcgcactcgacctcgacggcgcgcagcggctcgctgcccacctggtggacgcaggcaacgacggcctgatcatcaacggcaccaccggcgagtccccgaccaccagcaacgcggagaaatcggatctcgtacgagccgtcctggaggcggtcggcgaccgagcccacatcgtcgccggcgtcggcacgaacgacacgcaccacagcatcgagctggcgcgcgcggcagagaaggccggcgcgcacggcctgctgaccgtcacgccgtactacaacaagcccccgcaggagggcctgtaccggcacttcacggcgatcgccgacgcgaccgagctgccggtgatgctctacgacatccccggccgcagcggcgtaccgatcagcaccgagacgatggtccggctcgccgagcacccgcggatcgtcgccaacaaggacgccaagggcgacctgggccgcgcgagctgggcgatcgcccgctcgggtctggcctggtactccggcgacgacatgctgaacctcccgctgctgtccgtgggtgccgtcggcttcgtctcggtggtcggccacgtggtcacgcccgagctgcgcgcgatggcggaggcgtacatcggcggggacgtccagaaggcgctggagatccaccagaagctgctgccggtgttcaccggtatgttccgcacccagggcgtcatgaccaccaaggccgccctcgccctccagggcctgcccgccggaccgctgcgcgcccccatggtcgagctctcgcccgaggagaccgctcagctcaagatcgatcttgccgccggcggggtacagctc

SEQ ID NO: 2504 - DNA, 738 bp, Streptomyces avermitilis
  CDS (1)..(738)
gtgaccgacacccccgccgacgacctcaagcccagcttccgcagcgacgtcaccgtcgagttggtgaagcacagcgcggccgactcggacgtgctgtgggccgcccgcgtctccaccgccggcgagcagtccctggacgagctgaagaaggacccggagcgctcgaagggcctgatcaactacctgatgcgggaccggcacggcagccccttcgagcacaactcgatgacgttcttcatcagcgcccccatcttcgtgttccgcgagttcatgcgacaccgggtgggctggtcgtacaacgaggagtcgggccggtacagggagctcgagccggtcttctacgtcccgggggagtcccgcaagctggtccaggagggccgccccggcaagtacgtcttcgtcgagggcacccaggcacagcaggagctcacgggccgcgtcatggaggactcgtaccgtcaggcgtacgaggcctaccaggagatgctcgccgccggcgtcgcccgcgaggtcgcccgcgcggtcctccccgtcggcctcttctcctcgatgtacgccacgtgcaacgcccgctcgctgatgcacttcctcggcctgcgcacccagcacgagctggccaaggtgccgtccttcccgcagcgggagatcgagatggtcggcgagaagatggaggcggagtgggccaagctcatgccgctgacgtacgcggccttcaacacgaacgggcgcgtggcgccg

SEQ ID NO: 2505 - DNA, 237 bp, Streptomyces avermitilis
  CDS (1)..(237)
atgttccgtcggcgcgagcccgttccgttcgccttcatcgccgaagccgacaagttccgcagcaatgtcaccccgccgccccgccagcgggcgtccgccggtcagacggccgggcgctggctcctgggactcaccgtgatcgccgggctcgtgggcgcgctggtcgtcgggatgccttcgctgtcactcgaccagtcacctgcgacgacgcagcattccgaggcgtcccgggggcac

SEQ ID NO: 2506 - DNA, 555 bp, Streptomyces avermitilis
  CDS (1)..(555)
gtgcccctgcccttcctgacggccgaccgcacgtttgacgaggcggcggacgacctcccgctgccctacgacgaccgcgaccgctggcggcgcccgtaccggccaggtccctggcgggtgggcatggccgcacttctgctcctgctcgcgtcgtacgtgctcgccgcggcggtcgtcatcgcgctcaccggcaccgcctcaggcgccggagcggtcctggggatcgcggccgtcgtgatcgcctgcgcgctgcggatgctgcgcatgggcgtctgggtgagcgcgcgcggagtgcgccgggtcggcttcctgcgtacgggcaccacgccgtgggagcaggtcgtcgcggtgcgcacggttcagcagccggtgcgctggctcgggctgccgcgcacggttcaggggcaggcgctgatcctcgtacgtggggatcgtgcccccgaggaccagccgtcgctgctgaccacgcacggcgccgacttcctggcgcgtgcggcggccttcgaccgggcggccgacgcggtcgaggcctgggcgtcggagtacgggcggagc

SEQ ID NO: 2507 - DNA, 450 bp, Streptomyces avermitilis
  CDS (1)..(450)
atgcgcgccaaaatcacgtacgccgtcacggccgccgtcctggtcgtctacttcgtcctggtcggcagccgcggtgtgctcctgatccagaacggcaccctggtcaccgtcaccttcggtgtcgcggtgctgatcctgccggtcatcggtgtctggttcctctggaagaacacgcagttcgtccggaaggccaacgcgctcgccgccgagctcgacgccgagggcggcctgcccgtcgacgagctgaggcgcacgccgggcggccgcatcgaccgggactcggccgacgaggtcttcgcccgccgcaaggccgagaccgaggacgccccgggcgactggcgcagctggttccgtctcgccgtcgcctaccacgacgcccgcgacaccccgcgggcccgcaaggcgatgcagcgcgccatcgcgctccacgagggaaggccggtcgaggcc

SEQ ID NO: 2508 - DNA, 750 bp, Streptomyces avermitilis
  CDS (1)..(750)
atgagcaagttgcgcgtggcggtcctcggtgtcaagggccgcatcggatccgaggcggtacgagccgtcgaggcagccgaggacatggaactggtggccgccctcggccgaggcgacaaactggagacgctggccgacaccggcgcccaggtcgccgtcgaactgaccacgccggcctcggtgatgggcaacctcgacttctgcgtacgccacggcatccacgccgtggtcggtacgacgggctggaccgacgaccgcctcgcgcagctgaagggctggctggcccagtcgccggagacgggtgtgctcatcgcgcccaacttctccatcggggccgtgctgaccatgaagtttgcgcagctcgcggcgccgtacttcgagtccgtcgaggtcgtcgagctgcaccacccgaacaaggtggacgcccccagcggcacggccacgcgcaccgcccagctcatcgccgaggcccgccgcaaggcgggcagcgctccgcagcccgacgccacggtgacggccctggacggtgcccgcggtgcgaacgtcgacggtgtcccggtgcacgcggtccgcctgcgcggcctgctcgcgcaccaggaagtgctgctcggcgccgagggcgagaccctcaccgtccgccacgactcgctgcaccacagcagcttcatgccgggcatcctgctcggcgcccgccgtgtcgtcaccactcccggcctcacgttcggcctggagcacttcctggacctgaac

SEQ ID NO: 2509 - DNA, 1377 bp, Streptomyces avermitilis
  CDS (1)..(1377)
gtgacgtctcgtagctccacggcgacggcccgcacctcctcggaggcgcgggccgtcgcccgtacccaaaccctcgtcaagggcgtcaacggcatcggtacggtccgcaagaccaccctcccgggcggcctgcgcatcgtcaccgagacgctgccctcggtacgctcggcgaccttcgggatctgggcccacgtcggttcccgcgacgagacgcccacgctgaacggcgcgacgcactacctggagcacctgctcttcaaaggcacgcacaagcgcagcgccctggacatctcgtcggccctcgacgcggtcggcggcgagatgaacgcgttcacggcgaaggagtacacgtgctactacgcgcgcgtgctcgacaccgatctgccgctcgccatcgacgtggtctgcgacatgctgaccggctcgctcatcctcgaagaggacgtcaacgtcgagcgcggcgcgatcctcgaagagatcgcgatgaccgaggacgacccgggcgactgtgtgcacgacctgttcgcgcacacgatgctcggcgacaccccgctcggccgcccggtcctcggcacggtcgacacggtcaacgccctcaccgcggaccgcatccgccgcttctacaagaagcactacgacccgacccacctcgtggtcgcgtgcgcgggcaacgtcgaccacaacaaggtcgtacgacaggtccgcgccgccttcgagaaggcgggcgccctgaagcagccggacgccaccccgatcgccccgcgcgacggccgccgcgccatccgcaccgcgggccgcgtcgagctgctcggccgcaagaccgagcaggcccatgtcgtcctcggcatgccgggtctcgcccgcaccgacgagcgccgctgggcccttggcgtactgaacacggcgctcggcggcggcatgtcctcgcgcctgttccaggaggtccgcgagaagcgcggcctggcctacagcgtgtactcgtacacctcgggtttcgccgactgcggcctgttcggcgtgtacgcgggctgccgcccgagccaggtccacgacgtgctgaagatctgccgggacgaactcgaccacgtcgccgagcacggcctgtccgacgacgagatcgcccgcgccatcggccagctcaagggctccacggtcctcggcctggaggacaccggtgcgttgatgaaccgtatcggcaagagtgagctgtgctggggcgagcagatgtccgtcgacgacatgctggcccggatcaccgaggtcaccccggacgatgtccgttcggtcgcccgcgacatcctgggacagcggccctcgctgtcggtcatcggcccgctcaaggacaagcaggcgtcccgtctgcacgaagcggtcgcg

SEQ ID NO: 2510 - DNA, 2214 bp, Streptomyces avermitilis
  CDS (1)..(2214)
gtggagaacgagacccactacgccgaggccgtcattgacaacggttccttcggcacccgcaccatccgcttcgagacgggccgcctggccaagcaggccgccggctccgccgtcgcgtacctggacgacgacaccatggtgctgtcggccaccaccgcctccaagaagcccaaggaaaatctcgacttcttccccctcacggtggacgtcgaggagcggatgtacgccgccggcaagatccccggcagcttcttccgccgcgagggccgtccctccgaggacgcgatcctcacctgtcgcctgatcgaccgcccgctgcgcccgtccttcaagaagggcctgcgcaacgagatccaggtcgtcgcgacgatcatggcgctcaaccccgaccacctgtacgacgtcgtcgcgatcaacgccgcgtccgcgtccacgcagctggccggcctgcccttctccggcccgatcggcggcgtccgcgtcgcgctgatcaacggccagtgggtcgcgttcccgacgcacaccgagctcgaggacgccgtcttcgacatggtcgtcgcgggccgcgccctggaggacggcgacgtcgcgatcatgatggtcgaggccgaggccaccgagaagaccatccagttggtcgcgggcggcgccgaggcgccgaccgaggaggtcgtcgccgccggtctggacgccgcgaagcccttcatcaaggtgctctgcaaggctcaggccgacctcgccgcgaaggccgccaagccgaccggcgagttcccggtcttcctcgactaccaggacgacgtcctggaggccctgaccgccgcggtcaagagcgagctctcccaggcgctcaccatcgccggaaagcaggaccgcgaggccgagctggaccgcgtcaaggagatcgccgccgagaagctgctcccgcagttcgagggtcgcgagaaggagatctccgccgcgtaccgctcgctgaccaagtccctggtgcgcgagcgcgtcatcaaggacaaggtccgcatcgacggccgaggcgtcacggacatccgtacgctcgccgccgaggtcgaggccatcccgcgtgtgcacggctcggcgctgttcgagcgtggtgagacccagatcctgggcgtcaccaccctgaacatgctccgtatggagcagcagctggacaccctctccccggtgacccgcaagcgctacatgcacaactacaacttcccgccgtactccgtcggcgagaccggccgcgtcggctccccgaagcgccgcgagatcggccacggcgcgctcgccgagcgcgcgatcgtgccggtcctgccgacgcgcgaggagttcccgtacgcgatccgtcaggtgtccgaggccctcggctccaacggatcgacgtccatgggctcggtctgcgcctccaccatgtcgctgctgaacgccggtgtgccgctgaaggcccccgtcgccggtatcgccatgggcctgatctcccaggagatcaacggcgagacgcactacgtcgccctcaccgacatcctcggtgcggaggacgccttcggcgacatggacttcaaggtcgccggcaccaaggagttcgtgaccgccctccagctcgacaccaagctggacggcatcccggcctccgtcctggccgcggccctcaagcaggcccgcgacgcccgcctccacatcctcgacgtgatgatggaagcgatcgacacgccggacgagatgtccccgaacgccccgcggatcatcaccgtcaagatccccgtggacaagatcggtgaggtcatcggccccaagggcaagatgatcaaccagatccaggaggacaccggcgccgagatcacgatcgaggacgacggcaccatctacatcggtgcccaggtcggctcgcaggccgaggccgcccgcgccacgatcaacggcatcgccaacccgaccatgccggaggtcggcgagcgctacctgggcacggtcgtcaagacgaccaccttcggtgcgttcgtgtcgctgctcccgggcaaggacggtctgctgcacatctcgcagatccgcaagctcgccggcggcaagcgcgtggagaacgtcgaggacgtgctcggtgtgggcgccaaggtccaggtcgagatcgccgagatcgactcccgcggcaagctctccctcatccccgtggtcgagggcgaaggcgacgacgagaagaaggacgacaccgacaag

SEQ ID NO: 2511 - DNA, 285 bp, Streptomyces avermitilis
  CDS (1)..(285)
gtgtcgctcgacgccgctacgaagaagcagatcatcaccgagttcggtaccaaggagggcgacaccggctcccccgaggtccaggtcgccatgctctcgcgccggatctcggacctgaccgagcacctcaagacccacaagcacgaccaccactcccgtcgtggtctgctgatcctggtcggtcagcgtcgccgcctgctgcagtacctggccaagaaggacatccagcgcttccgtgcgctggtcgaccgcctgggcatccgccgcggtgcggcgggcgccaag

SEQ ID NO: 2512 - DNA, 1458 bp, Streptomyces avermitilis
  CDS (1)..(1458)
gtgagtttcggtcctccgccgtctccctacaccgcatccaccctggaatccgagaaccggaggaagcgccgtcggttgcggatcctcggtgccgcggcggccgctgtcgcggtgctctgcgcgggaatctggggactttcccacaccccctccgaccagcgcccgacggcctcccggcaagatcccgacgccatccgggagacggtcgagcggcgcccggcgacgccggaaggggcgacagcggtcacgcgccgcgccaagggcgtcaaggcgggccagaccatcgaggccacgggtacctgggcgaccggcaaggtcttcgcgaagaccctgggcaaccgcatcaccgggttcaagatcgcgaccaacaaggaagcgtggaaaatcggcttccccggcgctgtctgcgccgccaccccacacgtcaccgtggacggccgtaccgccgtggccttctcgggcgaggcgaccagaaccgacccgagcggtggggtcatgagcggcccctgcgacgagatcgccatgttcgacatcgacacgggcaagcggctgtggcacgtcaagctgcccgagaaggaacttgtgcccgccaccgtcaccatgacgcgcggaaaggtcatcgcctcctggaaggacggctcggcggcgtacgccatggccgacgggaagctgctctggtcgcatgtgcccggggcggtctgcggggacagcgggtacgccgggggcaaggccctcgtgcgcctcgtcaagtgcgggaacgcggacaacaggcggttccgggtggaggggacgaaccccaggaccgggaagtcactgtggacctaccaggtggaccccggggtccaggacgtccgtctggtctcctcgtcccccgtcgtcatcgccgtcgcggcgggcgcccccgagatcaccgacctcatctccctcagcgaccggggcacggtccgcgcctcgctctcggtgcccggccagaggtacgtcaccaagtgcgccacggacatcacgggcccggtcgagacctgcgaggccgtggtggtcggggaccggcagctgtacgtcgccacccaggggcgcgactacgtcgcggggagcgcccacggccaggtggccaacgagatcgtcgccttcgacctggccaccgggaagagcgtccggaagttcgacgccaaggtcggccgccccatgtaccccgtccggatgagcggggacagactcatcgcctaccggtcttccgtctccagatacgcgcccagcgccgccgtgagcatcgacaccgcgtcggggaaggagacgctgctcctgctcttcggcaccgacggcatgtcgttcttcgactacctggacgtccgctacgagcacggccgcatcttcttcgccgccaccaccatcgacgggccggtgaacaaggacggcgaaggggagagcgaatggctcgccgacgggttcgagaccagcggc

SEQ ID NO: 2513 - DNA, 1500 bp, Streptomyces avermitilis
  CDS (1)..(1500)
gtgagcttcggcccaccaccgtccgtctacacccaatccgcactggcggcggaccaggcccgcagccgcggccgcatgaaggtggtgggcgccgtggccgcactcgtcgtcgccgtgctgtgcgtgggcggctggctcctgttgtccgcgggcgacgacgcaccggccgatggcaaggcggccgccgcctcgcagcgccctgatgagatcagggagacggtcgagaagatccccagcacacccgagggccggctggtgatcgaacacagcgaggacggcctggccaagaacaccaccgacccgcgctacgcgcccggcacttgggccacgggcaagatcttcgccaagggtattgcccgcaaggtcgtgggctacaagatccagtcccagagcgagaaggcggcctggaccctcgagctcggcggccacatctgcgccaccagcagacatgtcacagccgacggtcgtacggcggtcgtcgttcagcccagcaagcccgagggctccaagaccgcgggcgtctgcaacgaggtggtgttcttcgatctggacaccggcaaaaagctctggcaggcgaagatgccctcggcgaaccaggcctacgtgacgaacacgaacctgactctcacgcgaggcgtcgtcgccgtggcctggaggcatggctcggtggcttacgacatgaagaacggcaagcagctctgggacagcaccgctgtttccaactgcgaggacgagggcttcgccggcggtcgcgccctgctcgccctggtcagctgcggggaggcgcccgacaccaagtacgaggtgcagaagctcgacccccgcacgggcagggccgactggacgtacaaggtcgccggcggcatccaggccgtgtacatgccctcgtccgatccgccggtcctcgccgtcgcggccggggacatcacggtgaccgacttgatcacgctggacgacaagggcaaacacctcgccacggtctctctggcgggcaatcgctacgaccccgggtgcgggcagcgctacttcgcggcgccgtacttcggtgtgatggagaactgcgacaagatggtcgtggggcgcaagcagatgtacgtcgccaccaaggagggcttcgacgccgctcagccggcgaactggatcgtggcgttcgatgtcagaacgggcaagacggcggggaagttcgacggacgctccttccagtcggttcttccgttgcgcatgagcggcgacgagcttctgatctaccggcggaccttcggcagcgtcggaccggcggccgtggtgcgctggaacccccgtaccgacaaggagtcaccgttcctcctcttccacctcccggaggacgaggagtccgagctgagcgacccggaacagtcggacatcatcgtcgagaaggacagggtcttcttcgcgaagcgggaactgaccgccgacgacaagcaccccaaggacccggtgctggcagcgatcggagtggggagcgccggggtcagccac

SEQ ID NO: 2514 - DNA, 1506 bp, Streptomyces avermitilis
  CDS (1)..(1506)
atgacggcctccgtgccgaccggcgcgaccggcggagcgggcaccacggcccctgccggggcgggcgcaggactcggcttctgccgggtcaccatcgtggcgcccgacagccggatcgatgtggcgttgcccgatgacgtaccggtcgccgacctgtacccggaaatcctgcgactgtcccagcagagtccggccgagggcgcccccgtcggctactccctcgtacgccgcgacgggtccgtcctcgacagcgcccgctcgttcgcggcccagcgcatcctggacggtgaactgctcacgctgcgcccgttctccgagtcgcttccgccggccgtcttcgacgacgtctccgaagccgtcgcctccgccgtcacccgcgaccgcagcctgtggagcggcgaactgacgcgcacggccggtctcgtcgcgggcggcatcctgcccgcactgctcgccttcgtggtctggagttcccagatccgccacgacatgcacagccttcagggtgtcctggccgccgtcgccggcatcctcctggtcaccctcgcgtgcgtccgcgcccgcgtgtacgacgaccggggctcggccgtcgctctggggctcggcgccctgccgaacgtcgcggtggcgggctccgggctgctgccgctctccgacgggcaggggatcggacggctccagttcctgctcgcctgcacggcggtcctggtcgcgtccgtggtgctcaccttggtgtcgccgaggggcgacgggcccttcgtggcgttcgtcttcgcggccacgatcggcctgctcaccaccttcatcgcgattctcacggatctgaaacccatggagacggctgccgtctgcgccccgctctcggtctgcgcactcgccttcctgccgggcctgtccatgcgcttcgcccggctgcccatcggcttcgaaccgcccaacccgtcccgcggcggctacgacccgggcgagcccgccccccaggagcccgtcgacgccgagcgcgtcgcggcccaggcccgccgcggtcacgaacttctcgtcggtctggtcggcggctgtgcgctggtctccgtaggcgcgtcggtcgtcctcggcttctccagcaacgcgtgggcacaactcctcgccctcgcgacaggcgtggcgatgctgatgcgtgcccatctgttccgctacaccgcgcaggtcggcgccactttggccgccggcctcgcggctctcgtcctccttggcctcgggctcgccctgaacccgccgcaggggtactggcgcggtgctctccagggagacaccaccgccctcgacatccgcagcgtctggctcgccgcggcggtcgccgcggccaccgtcctggtcaccgcgatcggcctggtcactccgaagcgcggcgtgacccccttctggggacgcttcttggagatcgccgagagtttcgtcctgctgacgctgatcccgctggctctggctgtcttcgacgtgtacgcgcaggcgcgggccatgaccagc

SEQ ID NO: 2515 - DNA, 3969 bp, Streptomyces avermitilis
  CDS (1)..(3969)
gtgagccacatcgtggtcaagcgtccgcctcgggcgctgccgtccgaagtgcccacggaagaggtcgtactacagcctccgccggagcttccgcgcgggcagcaggagggcgctctgatgcagctcctgccgatgctcggcatgggcggctccgtggtgttcttcttcaatccgcaggcgcagcccttcatgaagatcatgggcatggtgatggtggcctccaccatcgccatgggcatctcgatgctcatccgctaccgccgcggcagccagggacagatggcggacatgcgccgcgactatctccgttacctgtcacggacccggcgtgccgccgcggacgccgcgaaggcacagcgcgacgcgcagtactacttgcacccttcgcccgagcaactgtgggcactggtcgccgagggcagtcgagtatgggaacgacgcaccagcgacgaggacttcgcgcaggtgcgcgtgggtctcggaccgcaggcgctggcgacccccctagtgccgccggagaccgccccggtcgacgagctggagccgctgacagcgagcgcgatgcagcgtttcctggccacgtacagcgtcctcgaggaactgccgatggcggtgtcgctgcgcgccttctaccacgtcacggtcagcggcgagccgacgaccgtacggggcacggcccgcgcccttgccgcctcgcttgcgtccctgcactcccccgaggacctggtcatcgcggtcgcggccgcccgtgagtcgctgcccgagtgggagtgggccaagtggctgccgcacacccaggcaccgggcctcgcggacggagcgggcagccggcgtctgatcgccggcgacccgatgcagttggaggaactgctcgccgcccgcctggagggccgcccgcggttccacccggcgggcgccccggtccccgagcagccgcacctggtcgtcgtactcgacggtctctccctgcctcccacatcgatactggccagccccgagggcctgcaaggggtgacggtcctggaggtcgtgcccggcaacctcaccgccggtcgcggcgacctctccgtcgtcgtacacccgcagctgctgcgcctggagtcggcgcagggttcggtctacgacggcacgccggacgtgctctcgtacgaggccgcggaggcgctcgcccggcagctggcgccgctgcgcgtggcgacgggtggggacgacgacgaaccgctcctcgccaacctggagttcacggatctgctgaacctgggcgacgccgcgtccgtcgacaccaagcgaacgtggcggccgcgctcgcagtccgagcggctgcgcgtaccgatcggtctcggcgaggacggccggcccgtcatgctcgacctcaaggaggcggcgcaggagggcatgggcccgcacggcctgtgcgtcggtgcgacgggttccggcaagtcggagctgctgcgcacgctggtgctcggcctcgcggtcacccactcctcggagacgctgaacttcgtcctcgcggacttcaagggtggtgccacgttcgcggggatggcccagatgccccatgtggcggccgtgatcacgaacctggcggacgacctcaccctcgtcgaccgcatgggcgactcgatccgaggtgagctcaaccgccgccaggagatgctgcgcgacgcgggcaactacgcgaacatccacgactacgagaaggcgcgcgcggccggtgccccgttgcagccgattccgtcactcgtcctggtgatcgacgagttctccgaactgctcacggccaagccggacttcatcgagatgttcgtgcagatcggccgtatcgggcgttcgctgggggtgcatctgctgctcgcttcgcagcgcctggaggagggccgccttcggggcctggagacctacctctcgtaccgcatcggtctgcggacgttctcggcggccgagtcgcgtgcggcgctcggtgtccccgacgcgtacgagctgccgaacgttccgggttccggtttcctgaagttcggcaccgacgaaatggtgcgcttcaaggcggcgtacgtgtccggggtgtaccgctccggttcctcgcaggccgcggcgctcggcgggccgcttccggtggaccggcgcccggtgctgttcacggcggccgaggtgccggtgcagtacctgccggtgccgcagcagcgccggcaggccccggacgagaaggacgacgcgctcgcggacacggtgctcgatgtcatcgtgcgccgtctggaggcgcaggggcctgcggcgcatcaggtgtggctgcccccgctggacagcccgccggcgctcgactcgctgcttccgggcctcgccgcggtgcagggtcgcggcctcacccagcccggatacgagggcgcgggacggctcgtcgtcccggtcggtatcgtcgacaagccgtacgagcaacggcgtgacccgctgtggaccgacttcagcggcgccgcgggccacatgcagatcctgggcggcccgcagtcgggcaagtccaccctcgtgcgctcgctcatcacctcgttcgcgctgacgcacactccgcacgaagtgcagttctacgggctcgacttcggcggcggcggcatggccgccctggccgacctgccgcacgtcggaggggtggcctcgcgcctcgaccccgagaaggtgcggcgtacggcggccgaggtgtacggcgtgatgacgcgccgcgaggagtacttccgcaccacgggcatcgcctcgatcgccgacttccgcgcccgccgcgcccggggcgacatctcgacggccgatcagccttggggcgacgtgttcctggtcatcgacggctggggcaacttccgtacggactacgaggcgctggagccggtcgtcctggacatcgccgcgcgtggcctcggttacggcatccacctcgtcctcacggcgtcgcgctccatggaggtgcgttcgaacctcaaggaccacctgatgaaccgcctggagctgcggctcggcgaccccatggactcggagttcgaccgcaaggtcgccgccaacgtgcccaccggtgtgccggggcgcggccagaccccgcagaagcagcacttcatggcggcggtgccgcgcatcgacggcctgtcctcggacacggatctggccgaggccacgaccgctctcgcgaccgaggtgacgcggcactggacacagcccggcgcgcccaaggtccggctgctgccgacggagttcccggcgagtcagctgccgcccggtgacaggttcccgaagctcggtgtctccttcgcgctggacgagaacaacctcgagccggtgttcgtggacttcgagcaggacccgttcttcctcatcttcggagagagcgagtccggcaagtcgaatctcctgcggctgctcatcaagcgcatcaccgagcgcaacgacggcaacagcaccaagctgttcgtggtcgacaaccgccggtccctgctggacgccaccccggctacgcacctggccgagtacatccccatgtcgaaccagatgcagcaccacatggacgccctggccgacctcatgcagcgccgcaccccgaccgcggaggtgacggcccagcagctgcgcgaccgcagctggtggcgcggcccgacggtgtacgtcgtcatcgacgactacgacctggtgtccacgtcgagcggcaatccgctggcaggcctcaccgaaatgctgccgttcgcgcgggacgtgggcgtgcggttcatcatcgcccgctccacggccggcgcggggcgggccggctacgagaccttcatgcagcgcatcaaggaactcggcgcgcagggcgtcgtcctctccggcgacccgggggagggtgacctgctcggcggggtgcggccgcggcccatgacggcggggcggggcgtgttcgtgtcacgtcggcgcggaaagcctttgattcaggtgggacttgcggaaaccgcggagtac

SEQ ID NO: 2516 - DNA, 318 bp, Streptomyces avermitilis
  CDS (1)..(318)
atggccgacacgcaggagaacaccgccgcagagacggtggacgaggacgtcaaggcccgcaaggagcgcgagaagaacgagctgtacgcgctcgacatctccggcgtcgagtggcacagcgcaccgggtaccgaggagcacgaggagcgcgtcgagatcgcgtatctgccggacggggcggtggcgatgcggtcgtcgctcgatccggagaccgtgttgcggtacacggaggcggagtggacggcgttcgtcctgggcgcgcgggacggggagttcgacctggagccgacagagcacaacggggggcttgcggcggag

SEQ ID NO: 2517 - DNA, 1287 bp, Streptomyces avermitilis
  CDS (1)..(1287)
atgcgcaacggggacgacgatcacatcggacatgacgacgccggatccgctgccggcggtgccggcaacggggccgaccagggggacgccgcgctgtccgcgcctccctcccccgtcggccgccgcgcctggctgcgaagtcaccggctgctcgtctccgccatggcgacggcggtcgtggctctggcggtggccatccccctgaccgtctccgactcggccgacgcggcgccctgttggagcgttcccgccaaggcccgcgccctggcgggtgatccggccgccgcccgcaaggcactcgacccgctggacgacgcgagcaacctgcagcgggcccgtcggctgctcacccacgaccgcgtctgcggcgacggggccaaggtcctcggccgtatcgtcaccgccgccacttcggccaccacctccggcagcccgcacaccatggcccaggcccgctccgccttcgcggtcgcctcggcgctctcacaccgggaaatcccgcccggcctggctccggcggtggcccgcatgctggcggagtacgtggtggacgtgacgcgcgacgtctccgacggccatgaccgcgacgcgaccggccccgcggaatccgccgaaggggccgccctggacgacaccggcttcacgccctacggccgcttcctggccccgcacgaggcccacaccaacttcggtctctacgagggtctggacagcgcacaccatgtctccctcggcgttgtcatcaccgagctggccaaggacccggaagccttcgcgatcctctacgacgccgaacgcacctacttcgcacactacttggaacgtctgaccgaccgcgcgggcgatccggccgcccgcctcaccgccaaaagcaaggccgaggacaagaagttcggcgaggactggcacgcgtacgacaccgactggccggacaacgacctggaggacatcaccgacgtcatcgcagccctcatgcaggcccgcacgcggtacgcgaagaacggcacgatcacggacctggccgcgttcgacaagtcggtgcgcgcccacaccgacggcgcctaccgccccgcggccgaccgcgtgaccacccgcccgccgatgggcgacatcgcggagcggccgccgtcggcgcgggtacgcggtgacttgttcgacgggcggcagcagttgttcacggtgtacgacgcctgggtgcgcgatcgcgacattccggccgaacgagcgggcacactacggcagttgctggacgatcactatgtacgggggttgtggctggggcgcttt

SEQ ID NO: 2518 - DNA, 1086 bp, Streptomyces avermitilis
  CDS (1)..(1086)
atgaacccccgcacccgccgcctgctcacctggtccgtcgcggccgccgtggtcctctccggcggcgcctggacagccgagccctacgtccaggactgggccgtcgcccgggacgtgtgcgacggagccgtctcccgggacacggtcgaccaactcatcccggaagacacgcacttgaaggagtcccggggccggcagatcgagcagctgggaacgtacacctgcgtgctcaccgccaagcagggcgaccacgcgcgcgactgggacctgctggccatgtcggcctacacccggcgtgacgaccaggacctggcgttcttcgactccttcccggagtacggctccgcgacgcacaccgtgcttccgggcggccttcccggtttcgtcgaccgcttccgggacgttgtactgcaagtgccctgcccggacctcggcaaggacgcggagggacgggcccggaggttggtgtcccgtgtctccttcgccgaagacgcgctcgtcggtgcgggcggtacggcgtaccgggccgccgtctccttcaccaacacggcgtcgaagcggctggggtgcggcgccgatccgctgacgttgaccaggacggcggccgcggccgctctggccgatccggggcgaagcgacgatccccggggggtggttctcgccgacgcggagaagacgccctgtgcctgggttgccggagccggcctgcccgacggggtggactggcgggtgtccggggaaggcagcgcggcggcaccgctcgcgtcctgccacctggacgtgccggaggaggcgggggtgacggaggccggcggcgagtcgatcggcctgtacgcctggtacggagactggagcaatcggttcgtcacccgcgattccacgcacggcgggaggtcgtccatgacggccacggtgcgctgtgacggcgaggcggccaacttctccctggactcctccgacggcgtgcgcgacctcggtctgagcgagggcgtgagcgaggccgacgagcggcggttgctgcggctgttcgtcgcggaccagatggagcggcacgacgggtgtgtgggcgagccgaagttctccttc

SEQ ID NO: 2519 - DNA, 297 bp, Streptomyces avermitilis
  CDS (1)..(297)
atggcgaccaacgcagacggaacgcaagtcacttatgacgcacttgacttcgcggcgacgagtatcggtaacgaggcgaagaccctcgagcaggacctccaggagctcaagaagctcgtggcccagtgcaagcagtactgggacggcgcggcccaggacgcgttcgacagcaagctcgccaggtgggacaaggaagccaacgacatccacaccgcgctgaccggcatcggtcacgccgtcggtacggccggtggtacgtacatgggtggcgacaagaaggccgccagctacttcctg

SEQ ID NO: 2520 - DNA, 348 bp, Streptomyces avermitilis
  CDS (1)..(348)
atggccaccaatggcatgaaggtcaacaatgatccagtaatcaagctggagcaggacatgtacaccaagttcgaggccatcagggcacgggtgcacaagcttcagggtgtcatcgacggacttgagggccagtggcagggaatcgggcgtgccgctttcgacaagaagcagtacgagatcaaccagtccctgggagccctgggtggcatcctcaccgaggtcatcgaaggcgtgaacaagacgcgaaagatcacggacggcagcgaggacgaggtgcgcgcggccgtgcagaagatcgaccttcaggacggcgctccgacggtcaccgcatccgcgttcaacaactac

SEQ ID NO: 2521 - DNA, 1215 bp, Streptomyces avermitilis
  CDS (1)..(1215)
gtgggcgcggtcgtcggcgccctgacagttgtgagtatggggttcgccccgagtgccgccgcgtacgacgctcagtcgaaacagtggtacttggaatcgatgcaggccgagcagatgtggaaggccagcacggggaaaggcgtcaagattgcccttatcgacacaggggtgaacgcggatacgtccgcgttgacagggcaagtcctggccggtgaggtccccaagtcggttgcctaccacgccacggacgactacgtcggccatggaacgagcatggctgagttgatcgcaggcacggggtccggcggtgggctgcaaggtttggcgccgggtgcgaagatcgtcccctatcgcgttcagcttgagggtctcaagagcggggcggagaaagacaagacacccaaggcctgggaggctctcagggcggccgccgacaccgacgcaaagatcatcagtatgtcgttcggcggcatgaccaccgatgaggatgaagcggcggtcaaatacgccgcgtcaaagggcaagctattgatcgccgcagtcgggaacaatgcgagtgacggggggagcggcttgatcgactatcccgccgcctatccctacgtggttggcattgcatcggccaataagtccttgacggtgtcgaagttttcttcaagcggaaactatgtcgacctggtggcaccgggcgagggtttccccggctggtgtaacgccaacttccgctcgtactgcgacgatcgcaacggtacgagcccggctgccgcaatcgcttcagcctccgccgccttgatctggtctgctcaccccgactggacggtcaatcaggtcacccgttcgttgatcgatacggccggccgtacttgggcgaagggcaatccgagtaagtacgcgggctatgggcttgtccgcccccgcaaggtcctggcaaacccccactacaacgccggccccgcctactccgacccgctcgccaaggagaacaagacggatggagaggagctggtgacggaagtctcgccggctccctccccttccgcatcagcctcgtcacaagccccgaaggacacttcaggtggcgcgacatcggcggcaggatcaagtgcggagtcgtcgaacgacagtaattcgctgtggattgcgctgggcgcagccgccgcggtcatcgtgatcggcggcgccggagcagctgtgatgcgggcgcgacgtgccagg

SEQ ID NO: 2522 - DNA, 1785 bp, Streptomyces avermitilis
  CDS (1)..(1785)
atgacaatgaccgacaagcagcacaaggccgacctggaccgagtcgccagtcagaactccatcacggacttcgctcggggggttgaggagcggccacgaggtgggctcttcaacaacttggtgcgctcggcggtcgacgccaccccgttcgggcaggccatgcacggccgtacgaacttcgagctgcacgacctcaaccagatgctcgacctggtcgagcagacgaacccggaggacctggagtcctcagggttcgccctgtgggacgcgcgggacgccattaaggcggcagccaaggaactcgacggccacatcgagaacgtccactgggtcggagagtcgggcgatgccttccgtacgtggagccgttcgctcgtcgccagcacgcagaaactgagtgacttcgccggcggggcgggcgatcagatcaccgccgtcgctgtgggcctggcgaacgtacgcagtgccatgccacctcgcgatcagcgaccgcatgcgacgcgacccgagcagctcccgaaggccaagcaggtcgaaagtaacgaggagtacgccactgccgtccgggtggagaaggaccggcaagaagcgatcaaccagatgaatcggttgtcgtcgtactactcggtgtcgcacgaggcgctggttgccttgaactcggaggcgccgacattcaaggccatgcctgacgtgggtgtacctgcgcccacctcatatgcgcaagtgcatggttcgggaggggcggcctcggacggatcgaccgccggcgtgaaccatcacgcgacggccggggcagcgggccatgctggctcacgcgccgcaatcgatacgcctacgccttcaatcgatacacctacgccttcctatgacgctaccgggaggactccgcctcccgatgatcctgcccgtacgaacatcgacagcgtcggcacgttgccgccacccgtaaccgcacccgggaccggtcacaccccaccagtcacagctgccccgggcacaggtggcggcccgaccagcgcgttcgacggcggctacgggaccccggttcccaacggcacgtcaggcaggggcggtggagccggtggtgtccggccccccgcgtccgctcagggccgggccggtgcgtccggtttgagcaaccagggcacggggcggtctggggggagagggcccatgaaccagatgggccgccccacggcgactggacagtcggctgccaagagcactgcttccggggcgaagtcgtcctcgatgggcagaggtgtcaccggtggcaccccgcgggtcggtggcgaggcaatgccacggggcgccggtggcccgaccactggtgccggccgttcgaacggcgtggtcggggggcgacccacgactgctggcggcgcttcggggaagggcgggccgagaattcctcgtggcacggtcatcggagccgaggaaacggccaactcccggaccgctgcgaatggccgacccggccagcgtggagtcttcggagcgcccgagcccactgccaggccgggttcgagtgcgaccgcctctcgtggaggtgcgggaacgtcggaggctgtcaccggcaggccctccgcacgcaactctgttgccggagccgagcgcagcggcatgacgcgcggaggtgtcggtcttgtgcgtgggcctggcggccaggcgaagtccagtgatgggcagagcaccgggggaccgaagcgccccgagtacttggttgaagacgaagagacgcatctgcccactcggccgcgacgcgatgtgccgccgaccatcagc

SEQ ID NO: 2523 - DNA, 525 bp, Streptomyces avermitilis
  CDS (1)..(525)
gtggcgcggctcgctttgcgatcgtatcgagggccgaacggcagtgcgcacgacggtcatacggggaaaacggggaggagtgtcgtgcttccggcagacatggtggggggcgtgtcggctaccagggcggcgaacctggaggtcagtggtgaggcgttgtccacgttcatgaagcgggtggacacggtcctcagcgagctcgaggcgtcggcgggcaacccgaagcgggtcggtgcccagacgatccggcccgcgtcgctgaacagcggcaagcagggtgcctttcctgaggcggacgacctgtacgcgcagtacaacgcggtccacgagaagctcacttccctctccaggaccctgcacctgcagatcgaggcgatcggtatcgccgttcagggcgcgcatcggggcttcgacaacctcgaagaggagcagcgtcggcggttctgggcgatccagactgagatcaaggagattcggggcgcgaagggcagcgagcactccggcgacggcaccagcttgaaggga

SEQ ID NO: 2524 - DNA, 450 bp, Streptomyces avermitilis
  CDS (1)..(450)
gtggcatgggacgagtgggaacagctcaagagcgaggcgcaacagcgtcagcagggcaccacgcacatgcagctcaaccagcttccggtcgatcctggcggcggtagcactcagggtgacctcaaagtcagccagaaggacctcgccgcgatcggcgacgcggcatacgagttgaatcaggcgttcgagcacttcagcgacctcgcccgaatgagctcgatcgcggcgggggatggcttgaaaggcgagggttatgcgatcggttcggcgctggatcacgtagcggagcgctgggtggaccaggtccggtcgcttctggacgccacggcccacatctccaaccacctggactacaccaagggcgcgcacgccggcgacgaggtctatatcgccggcactctcagcagcatcgccacgctcgaccagggtttcgacgagcggaagggcagc

SEQ ID NO: 2525 - DNA, 2298 bp, Streptomyces avermitilis
  CDS (1)..(2298)
gtggatctcgactcgctccggcagggcaacttccatcagctcggtgaagcgatcaccgactggcagaacatgacgaagcacctcaagactctcgccgaggacgctgacaagaacctcaagggcaaggcacacaaagccaactgggccggcatgaacgccaccgtcactcgcgagttcatcgacaagacggccggcgagttctccgacgcccatacgcaggccgacacggtcaccaagatcctcagcgatacccggggcgagctcatcgactaccgcacccaggtcaatgacgccatcgatcgagggctgaagaagaacctgaccgtgatggacatgggcgacggctccttcgtggtcaccaggtccacccgccccgactgggcttccgatccaagtggtcagaacgacacaacgagccagaaggacgcggacgatctccgcgacgagatccagcgcattctcgacaaggccacggagagcgactccactgccgccaaggcgctgcgtctcatcgccgaccaggccaagtacggcttctccgacgccagctacgcagaccgggactccgcagcgaaggccctcgcggacgccgacaagatggccaagatcctcgcgaagaacccgcatgacgtgacgaacacggagctcgcgtccctcaactccaccctggccaagtacaagggcgatccgctcttcgccgaggagttcgccacaagcgtcggccccaagaaacttctcaccttctatgccgggatcgcggacccctatcaggcccagtacgaccccgaacgcggcaagcaggcaaaacagctccagaagaacctcggaatcaccatcggtcaggcgacgctctccgacagcgatgcaatgcagggctgggagaaaaagatgatcaagttgggtcccggccaactcgacatcgacgacgcgagcaacccgaccggctatgccgccatgagcaacctgatgcgcttcggtgactacgacgaccagttcctcaacaactacggcaacaagctcttcgcatacgacaaacaggtcaacggtgaggccatcagcctctgggtgaacaacgccaaccagggcgacctcaactactggggctacaagaacgatcgcggccgcgacccggtgacgggcttcctggaggctttggggcacaacccggacgcgtcgacccagttcttcgcgcagcccgacggcgcaggtgccaccgtcaacaagggctccgaggtcaacgaccatctgaagtacctgacccaggagcgcgtctgggcgtccgacgtgaccctcgagggcaagcacggctacgtcgctggacgcgactctctcggccatgccctggaatccgcgacgacaggctacgcctacgacgccaaaccgatgacagagaaggatccgatgatccctggcagcggtgaccgccgcaccgcagccacggccggggtaatggaggaggtcgcgtacctctacggcagcgaagacggtcccaagatgctgcgcggccagccggaattggcagacagtttgggcaagatggccggcgcgtacatcgacgacattgactacagcctgtctggtgtcggagaaagcgcgaaggacgccgacaccttccctgccaaataccaagggcgggcggacttcaccaacgcaggcgcaatcaacttcctgagcgtactcgggcaggatgagaactcccaccgcgccgtcaccgcagcgcagcacctgtatacgctcagccaactcgacgcccacccatccaccagcgatgccaacatcgagcatgcccacgacgccctggttaccggatcccaagttcggggcattctggataattcccgcgtcgagcaggcccagaccgactacggcgaaggctcggaggagagcaataaatcgctgggccgttccgccgactggatcaaactgggggccggtgcggtcgtcgcggggggtgtcgccgccatccccctccccgggacgagtgccgcggcactcgtggtcgcaccgctggcagcggacaccgtgggcgaggcggtgaacaccttcatcggccagcagatcgacaagggtgtggacgacgcagaagcggatcccgccgagaaatcgcagttgaccagcagccagttctatggcaagggcgccaatcagctcggtgccgcttaccagtcctacattgaagacagttcaaaagctgccgacgtcgctggcaaggaggattggaaggatgacatcaacaacgcttactacgggacgggatcacacgagaacgagtatcgcgggcgtgcttcgtacaaggat

SEQ ID NO: 2526 - DNA, 585 bp, Streptomyces avermitilis
  CDS (1)..(585)
atgacggccatgacgaccatttgtttcgccctcgccgtcgtgatggccgcggccgggtgcgtcaaggcggaccgcgtgcgcgcgtggcgccacggcttcaacccgtcagcggacgaactcccgtcctccgctttcgtcgcggggcgtgccgtcttcttcgtcctggccggcatcatggcctttcagggctttcagctcctggccgtctcggacgacgtgtcgtggagcgacagcgagttgacgaaggcggtccagggggccaccaccgccttggacgcgcgttcctatttcgagatcgactccgtcggcaacgacatcaagtccatgatcgaggacgaggtcgtccagcatggcggcggcgacgccccgcagtccggggtcgacgctttccccgccgacacgaacacggccaaggacgcggactacacgatcaaggccgacggcgcgaaggccgccttctgcatgcacgtcaagcgcacggagtcgaaggacggcggctacacgccaccgggcgtcgcgggcggcgagggcacggtgaccattcccgagtacgaacttgcggcgacggtggatgagggggagtgc

SEQ ID NO: 2527 - DNA, 1296 bp, Streptomyces avermitilis
  CDS (1)..(1296)
atgatgtcgacgccgatgccgtacgtcactgaagccaccctccgcgggacgttcgcgcgccgcgcggcgctggccgcaaccacaacggccgtcctggcggcgaccacggtgctgctcccggccgccgctcccgcggcggtcgccgactcgacgaccggccagtgcaccttcccctcgaagaagtacgagggccggccctgggcactgcagcgcgtgaatctcgaccagttgtgggacctgtcgaccggcaaaggcgtccaagtggccgtgatcgacacgggggtcgacgtcaagaacccccaactcagtaacgccgtggacgcgtccaaaggggagaacagcctccccgccaagaactccaagggcgagaagatagaccgcggaaacgcgtccggcaccaccgacaccgtcggccacggcacgcgcgtggccggcatcatcgcggcccgctccgtcaagggcacgggattcgtgggcctggccccggacgccacgatcatcccgatcaagcagaacaacgcggagggcgacggcacggccctcaccctcgccaccgcgatccgttacgccgtgggcgccggcgccgatgtcatcaacatctcccaggacacggcgaacgcagtcgaacccgacccgaagctgcatgaggccgtcgactacgccctgacccagaaggtcgtggtcgtcgcctcggccggcaacgacggcctgggcggcaacgacaaggccacctacccggcgtcgtacaagggcgtcctggcggtggccgcctccgaccgcaacaacgaacgcgcctcgttctcccagtccggcgacttcgtcggtgtcgcggcccccggcgtcgacatgatctccacggtccccggcggcggccactgctccgacaacggcacaagcttctccgccccctacgtggcgggcgtcgcggcgctgctgaagtccaagtacccgaactggacggcccaagaggtggtcgcccagatcgaacagaccgcggaacgctccatccccggacacgaccgcctggtcggctggggcgtggtggaccccgtcaaggcgctctcggacatcgacgcggcccacccggtcgagtcccccaagccggtcaatggcgtgacccgggccaaagccccctcggtccccaccctccacttcggcgaaacagcggaggaacgcaacacccgcctggccacgtacgcggtggtcggcgcggcggtactggtcctcggactcacgggctccgcggtggcggtacgggatgcgcggagacggcgggggcgtgtggggggcggcgta

SEQ ID NO: 2528 - DNA, 1521 bp, Streptomyces avermitilis
  CDS (1)..(1521)
atggcatcacggcgggacgaactcaacgcctacaccttcgcgaagcgccgcgtcctggcgtccttcgtgcagccctcgccctcgggctcggaggaaggggcgccgaagccgctgcgcgcggtgctgcccggtgtcatcatcggcgtcgtcatcctggccgtgttcggggccatcggcatgttcagcccgacggctcccaagggctggaagaccccgaacgcgaacgtcatcgtcgccagcgactcgaccacccggtacgtggtcctggagaccgacggcaaggcgcaactgcatccggtcctcaacatggcctcggccaagctgctcctcgcgcccgacaaggacaccgtcatcaccgtcgacgagaaggtcctcgacagcgacacgctgccgcacggtcccaccatcggcatcccctacgcacccgaccgcctgccgtcggcgaaggaggccggcgccgccaagcgctgggctgtgtgcgaacgtcccggccagggcggcaccgccatccagaaggccactttcgtcttcgcccagcgcgactacggcaagaccgacggagccgaccggctggccggcggtgaactcctgtacgtcgtcggccccgacaacaagacgccgtacatcgtcgacgcgcagggcaacgcgtaccgcgtggactccacggacgacaacctgctgaacgcgctcgacacccaggggcgcaagccgcagcgcgtctcgcagcagtggctgaacacgctccaccagcgcgacccgatctcgatccccacggtcaagggcatcccgggcgcggcggcgaacgcccccggtgacctccgctccgccgacaaggtcggcatgatcatcaaggcccgcaagggcaccacgatgcagtcctacgtggtcctgcccggccgcgtcgcccccatctccgacttcaccgccaccctgctcctcaacagcccccagctggtcaccgtgggccagaccggcgaggcgcagcaggtcagtcccggcgccatcgtcgaaggtgcgcccttcgccgcgagcgagaagtggccgcaggccgcaccggagacggtgaacaacgccacgagcgccaccagcggccgcaacaccgtgtgcaacgtcctgcgctcggtccacggcaagggcggcgccaccactctgtcgacctgggccggcaccgagttccccacctcgctgccctccggctcctccagcgcatacgtgacgcccggatcggggcagctctaccgccagttccagggcaccgagacctcggcgggcccggtcttcctggtcaccgacaccggcctgcgctacgccctgcagtccaacagcgacagcgccaccgacgacaagggcatcggcaccacggccaagcagcgcgaagaggaactcaaggaggccaagatcgcccagaccaggctcggttacgcggatacggatgcggctccgatccccaccgcctggtcgaccttcctgccgacgggcccccgactgtcggagtccgcggcgcgccagccacagggatcg

SEQ ID NO: 2529 - DNA, 1335 bp, Streptomyces avermitilis
  CDS (1)..(1335)
gtgatggcttccggaacgcggacccggtcgcgtgaccgggcgcaggcgcggggctcttcagcgccccgtccaggggcggcacagcaaccgtccgcgccggggccgcggccgcaggcgtcgggcgcgctccatctcagaacgcgtcagggacagtccggggcgttccggctgcaacggatcgttctgttggaaatcgcggccgctgttcttctcgccggctgggtgatcgatccgctggcgctggtgccggcagccgtcgtcgccgtcgtactcgtactgctcgccttcgtgcgccgccggggccgctccctgcccgaatggctgggtacggcacgggcgttgaaggcgcggcagcggcgggcagcgagtacgccgataccaccgggtacggagccgggcctcgcacccgcggtggagtgcgacccgagtctgcggacgtatgcgtacggcggacgggaccgacggccggtcgggatcatcggggacgggacgttcgtcaccgctgtgttgcaggtggaggccgacgcgacggcgctgcgtgccgagcgcagtcggcagcccctgccactcggactggtgcgggacgcccttgaagtggacgggatccgcctggagtccgcgcagatcgttctgcacacgcagcccgcgcccgcactgcacctgccgcagcagtccgtggccgtcaccaactacgcgccgctgcaggcgcagacgggcgcacctgccgtgcgcatcacctggatcgcgctgaagctcgacccggagctgtgcccggaggccgtgtccgcgcgcggtggcggactcgtgggggcgcagaagtgcgtcgtgcgcgccgccgaccacctcacgagccgtctgacgggagcgggattccgtacaaccgtgctcaacgaggaggagttgaccgccgccatcgccacctcggcctgcgccaacccgctggtgacggcgggggcggggcggaccgaggcgagggagcggcggaccgaggagtcggggcgcagctggcgttgcgacaaccgcaggcacacgacgtactgggtccgccgctggcccctggtgggcggcgacggacggtcgctgccccaactcgtcgccctgctcacggccgtacccgcgctcgccaccacgttcagtctcacgctggcgcacggcgagcggggcgaggtgtcgctgtgcgggcatctgcgggtgaccgggcgcagtgacgacgaactggtcgcggcgcggcgggcgctggaggaggccgcacgacggggcggcgccgggctcgcccgcctcgaccggcagcaactgcccggcgtgctcgccactctgcctctcgggggtgctcgc

SEQ ID NO: 2530 - DNA, 801 bp, Streptomyces avermitilis
  CDS (1)..(801)
atggccatgaccacggcatcgacaccgggagcgcgggcgtacggcgccccggggaacgccgatggcccgggcgagccctcggtcgccgagcggctgcgcggacgggcgcgcagcgggttcgggctgatcgggccccggcacgggcggcactcgctgtccgtggagcaggtggactcgctcgcgctgcccatcggggacgacggggtcgtcgtcggggtggacgcggaggggcagcccgccgtgctcgggctcaatcggcccactccgtacgacgtcgtcctgatcggtggcctgtggaccgcgcaggtgcttgctctgcgggctgcggcgaccggggcgcgggtcgccgtggagaccgggcgggcaccggcctggatgcagttggtgcatgccatgggcggcggacagaacgggatgtccgtgtacgacgtggggcgggtgccgccgcagggtgcctcggcgggcaacccggtgctggtggtgcgtgactgcggtatgcggccgccgcgggggcgggtcgtctccgggccctggcaggcggtgctgacgctgctgccgtatctcagtccggtggcgccgcggctcatgcggcaggcgcggctcgtcggggtccagcgggtctcgcccgacgaggccgcggagataggccgcacggtggcactgccccggggcgacatggactcgctgccgaccctgcccgacggtgtcacgctctggtgtgccgatcgcgaccggcagtatgtgatgacccagccgaccgacgccgagaccggattgttgggtatgccccgcaggatggac

SEQ ID NO: 2531 - DNA, 2430 bp, Streptomyces avermitilis
  CDS (1)..(2430)
gtggcgaggcagaccccgccgcccctgccccgaccgcctccaacgacgtaccggccccgcagtcctggaccccgccgccggctccgccgagcgcgcttccgccgttgccgcccgcctatcagccggccgcgcccgcaccggcggcccagtggcccgcgtctccgcagccgggcgagccgacgagccccgaggccgcagcccccgctcccgtccaaggccagccgcagccgcagccgcagccccagccggcggccgcgcagggcgagccggccacggcgccccgggagccgcagccgcagcccccgttccagccgcaggcaccgcagccggcacccgcggcctggaaccagcctgcgccgcccgcacccacggatcccgtgcccccgccggcgccccacgccccgggcccgggtcaccggcgccccggcggcaccgcaggcgggctacggcttcccgcagcccggagttccgactcccccggcgcccgactcccgtgtcaagcaggatggttacgggttcccgcaggccggtgcccagggcgttccgcaagccggccccccggccggccccatctcacccgcagcccaagcggcccccgcacctcccgcggctcccagcgcccccacccctcagcccggctacggcttcccgcagcccggcggacccgttccgccccagagcggctacggcttcccgcagcagggcgctcccgctccgggcccggccgccccacaggaccaaccgcccgccccccaggccggctacggcttcccgcagccgccggccccggccgcaggtcctgatgcgcacaacccgcccaccccgcagcccggctacggcttcccgcagcagggccagccgcccgccccacaagccggctacggcttcccgcagccccccgcgcagcacgcccaggcccagcccgggcagccgcagggtcccgcggtcccgcccgccgcccccgcccctcatcccggcccgcagcccagcggctacggcttcccccaggccaccccaacgccgcccgctccgcccgcccaacaggcgccgcaggcacagccgtctcagccgcagccgcagccccagccccaaccccccgtcgaccctcgcaccggtgccgcctggccgcagcccgtgcagcacgaccagcggcagcccaccaaccccggtgtcgcgcccctcggttacaccgccgcggtggagctgtcctccgaccggctgctcaacaacaagaagcagaaggcgaagagcggccggccgggcgcgggcggtggtctgttcaagctcggagcgaagaaggaagaggccgagcggcagcggaagctggagctgatccgcacgccggtgctgtcgtgctaccggatcgccgtcatcagcctcaagggcggtgtcggcaagacgaccacgaccaccgcgctcggcgccacgctcgccaccgagcggcaggacaagatcctcgcgatcgacgcgaacccggacgccggtacgctcggccgccgcgtgcgccgcgagaccggggccaccatccgcgacctcgtccaggcgatcccgtacctcaactcgtacatggacatccggcggttcacctcgcaggcgccctccggcctggagatcatcgccaacgacgtcgacccggccgtctccacgacgttcaacgacgaggactaccggcgcgcgatcgacgtgctgggcaagcagtacccgatcatcctgaccgactcgggtacgggtctgctctacagcgcgatgcgcggggtgctcgacctcgccgaccagctcatcatcatctcgacgccgtccgtcgacggtgcgagcagtgccagtacgacgctggactggctgtccgcgcacggatacgcggatctggtctcgcggtccatcaccgtcatctccggggtgcgcgagaccggcaagacgatcaaggtggaggacatcgtcggccacttcgagacacggtgccgtggtgtcgtcgtcgtgccgttcgacgagcacctggccgccggtgccgaggtcgacctcgacatgatgcggccgaaggtgcgggaggcgtacttcaacctctccgtgatggtcgccgaggacatggcgcgccaccagcagtcacatgggctgtggacctcggacggcaacccgcccccggtcgcggcaccgccgatgccgggccagccgctgcccggtcagccgatgccggggcagccggctccgggacagcccgtccccgggccgccgtacccgcagcaggggcagcagccgtacccgcagtaccccggctacccgcagcagccgggtcaggcacagccccagccgcaaccgcagggccagccacaaccgcagccgcacccgggacagccctacccgccggcccagcagcagccctacccgccgaacccgaaccagggccaggctcccgggcaggccccgcctcagcag

SEQ ID NO: 2532 - DNA, 792 bp, Streptomyces avermitilis
  CDS (1)..(792)
atggacacctctgcttcccgcacctacgtcggtgacatcggcacgctgtcgggggcggcccgtaccgaggccctcgacacgctcgtcgaggaccttcgctcacccgatcccgtggtgcgcgacgaacaggcctacgtcagggccgcacgctggataccggtcctcgacgcggcggaccggctccggctgggcgaccgcatggccgcgagcttcaccgaccccgccgtccaggcccgcgccttcgcgccgctggtcctggcccggatcgtggaagcgggcgcctggcggccgcggtggtggagcgccttcgccgactggtatccggccgagacggacctgcgcggccatgaccccgccctcggctggctgcacgccgtcgcccacggcgccgacctgctggcagccgtttcccaccacccgggacaagaccccgtgccgctcctggagttggcggtcgcacggctgctcacccccaccggtcacctcttcgacgcgcaggaggacgaccgactggcccacgccctggcgcagatcctgagccaccccggactcaccgccgcgcagtcggcgcggtggctcgaccccgtctccgaggccttccgcacgggagagccggggccggtcccggcctgggcgtccaacaccatgcgcacgttgcgcatgctctatgtcctgacggaccggggttttcgcaccaaggacacgggcgccgggatccgtacggtcacccatcggacgagtgccctcgacgctctcgcggggacacttgcgatcgtcgcgccgtacagcgca

SEQ ID NO: 2533 - DNA, 951 bp, Streptomyces avermitilis
  CDS (1)..(951)
gtgcagcgctggcgtggcttggaggacatcccccaggactgggggcgcagcgtcgtcaccatcgggtcctacgacggagtccaccgcggacaccagctgatcatccggcatgccgtggaacgcgcccgtgagctgggcgttccctccgtcgtggtgaccttcgacccgcaccccagcgaggtcgtgcggcccggcagccacccgccgctgctcgccccgcaccaccgccgtgccgaactgatggcggagctgggcgtcgacgcgctgctgatccttcccttcaccaccgagttctcgcggctctcgcccgccgagttcgtggtcaaggtgctggtcgacaaactgcacgccagggccgtggtcgagggcccgaacttccgcttcggccacaaggccgccgggaacgtggagttcctggccgagcaggggaagacgtacgacttcgaggtcgagctggtggatctgtacgtgaccggtgaggcaggcggcggcacgcccttctcctcgacgctgacccggcggctgatcgccgagggcgacgtggagggcgcgcgcgagatcctcgggcgcccgcaccgcgtcgagggcgtcgtcgtacgcggcgcccagcgcggccgtgagctgggcttcccgacggccaacgtcgagacgctgccgcacaccgcgatccccgccgacggcgtctacgccgggtggctgcacgtcggggacgaggcgatgccggccgcgatctccgtcggcacgaacccgcagttcgacgggacggagcggacggtggaggcgtacgccatcgaccgcgtcggcctcgacctgtacggcctgcacgtcgccgtcgacttcctcgcgttcgtccgcggccaggccaagttcgactccatcgacgcgctcctggaaaccatggcggtggacgtcaagcggtgccgggagctgatcgcggcgtacgacggggag

SEQ ID NO: 2534 - DNA, 3597 bp, Streptomyces avermitilis
  CDS (1)..(3597)
atggcggaacggggccgtcggacacgggacgacggccggggagggcgagacgcggcggagggcgcgccggccggccgggaagggcaggacgcgacggctgccgcgctggtgcggttctgtgatccggccgggcggccgcggggcacgggcttcgccgccgaccaccacggcacggtactcaccagccacgaggcggtcgacggcctgtcccggctggtcctgcacgcgccgggcgaccgcagctgcgtggtgacggccggcgcggtcaccccgttgcccgacctgggcctggcgatcgtacgcacggagggcctcgccctggcgccgctccccgtcatcgtgcgggaccgcgtcggggtcggctcgtatgtgcggctcgtcgcgggcggctggcgcgaggcgcgggtgctcggcacgaccgccgtgacgtacacggcgacggaccgctgccatctcctcgacggcgcaatggagttggcgatcggcacggcgggcgtcgacgcgctgcgtctcggcggcggagcggccggcgggccggtgctcgacgcggagaccggcgcggtggtggccgtcctcggcacggccctgcacaccgagcaccgggcggcgggcttcgccgtgccgctgcggggcaccgggtgcgccgccggaccgctggacgagctgctcgcccgtaacgcggcgaccgtcccggcctaccgggccgatctgaatccggcgggagtgctggagctggccgccactacggtcggctcggacgggccctcccgagcacacgaggccctcgctccggtggaacgcgcccgaatcgtaggggagttcgcggcattcgccgacggtccggccgccgtcctcgggctcgtcggagccccgggcagcggccgtacgaccgaattggcgtccctggccgcccggcgcacccgggcgcctgaaccggcgcccaccctgtggctgcgcggtgcggatctgctggccaccgacacgtccgtggccgatgccgcggcacgggcgctggagcgagcggcgcggatcgtggcggcggcggacggcgtgggcggcgtggacggcggagcccgccacgcggacggggtgctcggcgacgtccgtccggagcggctggcccgtgtcgcgcgggaagcggggcgcccgttgctgctcctgctggacgggcccgaggagatgccgtcggctctcgcgcaccggctgcccgagtggaccgccgggacggcccctggtggctcgggtgattcagagggttgtggtggctcgcgtggcgcgcgcgatgcacgtggctcgggtgattcacgtgcgtcgggtggctcaggtgattcacgtgggtcaggtggctcgggtgatttgggcggaaccgatggctccggtgcgtggttcgggcggctcggtcgcgacgaggtgttctcctcctacctggatctgatgtgcttgcgcatcgcggtccggctcgcggcggccgacgggctgcgcggcacggcggtgcggcgcctcgccgcccgggtgtcagggcaggtccacgcggccgcgcgccgctgtctgggggccgggcagggagagctggaccgcgagtcgttcgaggccgtgttcccgtgggggcccgtgccgggacggcccttcgacggcatcaccggctgggccaccgcggttctcaccgagggcctcctcgtgcccgcgggcaacggctaccgcttcgcccacgaggaactcgccgactggatccagggcatgcatctggacctggaggccgcgctgcacgcactcgtccaccgcgaccgtgacacgccgcccagcactccccccgtcccccgccaccgcaccggccccatcgtccaggccctgctcctcctcgctcgccagcagggccccgccgaactcgccctccgtctggaggacctggccgacgccgcgggcgcactgctgccgcagcgccccgatcccggggccggcaacgcccagagcctcgccgcgccgactgccgccacgaggccccccgccacgaggccccccgctacgaggaccctcgccgcgagaacccccgtcccgacgaaccccggtccgctgggccccactctgttgcaccccacttcgtcgcaccccactccgtcacaccccactccgtcggaccaccccgcctggtggcccgtgcggctcctcgcggacgttctgctgcacgtgcccgacgcgacgccgtacctccccgtcctgcggcacctcgccgcgcggatcatcgagtggcgggcccaagggcggtgtgtgccggaggagttcgggccctcgttctgggagagcgtgccggtgggggacaccgagcggttcgacctgctgcgacagctcgtcgtcgcggacgaggcgccgggcggcccggccgaaggcccccgctatctggacgccgtctccgggctcctcgccgccgaccccgccgccgtacacccccacctcacccgctggttcgacgacgaccgcccgctgcccgcgaccccggacgcgaccgtggccaccgccgcccaggcgctgctgcacacgcaccggcgccgcgccctggacgacctgaccgaggcgctggccgacagcgcgcaccggcgcggggacgagctgctcgccgtactcgccgaggaggagccgtcggcggtgtgccgggccgtcgaccggtgggcccacgacgagcgccccgcgcgccgggtggcggccgtggcctacgggctgcgtgccgctccgcacgtgcgcaccgaggacggccgggaactgctgcgctacgccgcgctcgccctgctcgcccgccccgccgactgcaccctgcacggcggcgccctcgcgcttctcgtgcgcgatccgcgcacccgctcccggcacctcccgcaggccctggcacgcttcggcgagggtgacccgcaggtgccggcgagcgcgctggccaccgccctcgcctcccacccggagccggtgctcgaggccttccaggcccggctccgacgaccgggacccgacgtcggcgaagtgctgcgtacgctcgccgacgtcaccacgcccgccctcgcccgccgggtcgccaccctggtccgcgaggtcgtggagctgcgcccggagacggccgaccacgtcgccgcgtacgtcgagcggcgcctggagcagggcctcgcctcccgggccgtactccttccgctggtcggcggcctgctggacggcggtccccccgaggtgcgggtcgcgctcacgaccgttctcgccgcgcccggcggtgcggagtccggtccgctgcggcacgagctgctcgggctgcttctcgggcgtgaacgcgatcccgccgtgctcgtcgccctgctgtgcgccgccgccgacggagcgcggcacagcggcgagcagcacacccgtgagctggtgcgccgggccggtctgctgctcgtacgcactcccgacggcgcgacccgtttcgaccaggccctggtagaactgggccgccgggtaccgggcttcgcacccctcgtggcccgctggctgaccagggagcccgaggcatgggccgcggtggtcggaccgagcacccgccgcatgatcgagaacctggcgggcgtcgtccgcgtcccggcc

SEQ ID NO: 2535 - DNA, 903 bp, Streptomyces avermitilis
  CDS (1)..(903)
atgaccgagaagcacaggacgcccgacgggcttgtcatcgtggacaagccgtcgggcttcacttcgcacgacgtggtcgccaagatgcgcgggatcgccaggacccgccgcgtcggacacgccggcaccctcgaccccatggcgacgggcgtgctcgtcctcggcgtcgagaaggcgaccaaactcctcggccatctcgcgctcaccgagaaggaatacctgggcacgatccgtctcgggcagaacaccctgacggacgacgccgagggcgagatcatctcctcgacggacgcctcccgggtgacccgggacgcgatcgacgcgggggtcgccaagctcagcggcgccatcatgcaggtgccgtccaaggtcagcgcgatcaagatcgacggcgtgcggtcctacaagcgggcgcgcgagggcgaggacttcgagatcccggcccgcccggtgaccgtctcgtcgttcgcggtgtacgacgtgcgtgacgcggtcgccgaggacggcacaccggtgctcgacctggtggtgtcggtggtgtgctcgtccggcacgtacatccgggcgctggcccgggacctgggcgcggacctgggcgtcggcggacatctgacggcgctgcgccggacgcgcgtcggaccgtacaagctcgatgccgcgcgcaccctcgaccagctccaggaggagctgaccgtgatgcccatcgccgaagcggccgccgccgcgttcccccgctgggacgtggacacgaagcgggccaggctgctgctcaacggcgtacgcctggagatgcccgaggagtacgcgggccgcggcgcggtggcggtcgtcgaccccgcgggccgcttcctggccctggtggaggagcagaagggcaaggcgaagagcctggccgtgttcggc

SEQ ID NO: 2536 - DNA, 471 bp, Streptomyces avermitilis
  CDS (1)..(471)
gtggccgacaacgcgcgggcgaagaggctggcggacctcatccgagaggtggtggcccagaagctgcagcgcgggatcaaggacccgcggctcggctcgcaggtcaccatcacggacacccgggtgacgggtgatctgcgggaggcgaccgtcttctacacggtgtacggggacgacgaggagcgggcggccgcggccgccggcctggagagcgccaagggcgtgctccgctccgcggtgggtgcggcggcgggcgtgaagttcaccccgaccctcaccttcgtggcggacgccctgccggacaccgccaagaccatcgaggacctgctcgacaaggcgcgggcctcggacgcgaaggtgcgtgaggtctcggcgggtgcccagttcgcgggcgacgcggacccgtaccgcaagccggagtccgacgacgagtcggacaccgctgccaagacggacggcgacgccgcggaa

SEQ ID NO: 2537 - DNA, 291 bp, Streptomyces avermitilis
  CDS (1)..(291)
atgtatgtggggacactgtccttcgatctgctcctcggcgacgttcgctcgctcaaggagaaacgctccctcgtccggccgatcgtcgcggaacttcagcggaagtacgccgtgagcgtggcggaaacgggtcatcaggaccttcaccgcagggccgagataggcctggcggtggtctccggagacacagggcacctcaccgacgtgctcgaccggtgcgaacggctcgtggcggggcgaccggaggtggaactgctctcggtgcgccgcaggctccacaacgacgaagat

SEQ ID NO: 2538 - DNA, 3138 bp, Streptomyces avermitilis
  CDS (1)..(3138)
gtggctaaggtccgggtatacgaactcgccaaggagttcggggtggagagcaaggtcgtcatggccaagctccaagaactcggtgaatttgtccgttcggcgtcctcgacgatcgaggcgcccgtagtacgcaagctgaccgatgccctgcagcagggcaacggcggcaaggcagccccccgtaaggccgcaccggccaagccgggtgcgccttctcccgcgcaggcggcccgtccggccgccccccgtccgccggcgcccaagcccgccgcggccgagcggcccgcagcggctgagcggcccgccgcggctccggccgccccgggcccgcgtccgggcccgaagcccgcgccgcgacccgctccggcggctccggctccggccgcgcccgagttcacggcgcctccgtcggcccccgcggctcccgccgctgccgcctccggtccgcgtccgggtgcccgtcccggtgccccgaagcccggtggcgctcgtccggccacgcccggccagggccagggtggccaggtccgtggcgaacgcactgaccgcggtgaccgtggtgaccgcggtgaccgtcagggcgctgcgcgtccgggcggccaggccccgcgtccgggcgctcgtccggccggtccacgtcccggcaacaacccgttcacctctggtggctccaccggcatggcgcgcccgcaggcgccccgtccgggtggtgccccgcgtcccggtggcgccggtgcccccggcggtccgcgtccgcagggcgcgggcggccaggaccgtgctccccgtccccagggcggtcccggcggcgctccgcgtccgcagggcggtccgggcggtgcccgtccgactccgggcggcatgccccgtccgcaggccccccgtcccggtggtgcgcctggtggtaaccgtccgaaccccggcatgatgccgcagcgtcccgctgcgggcccgcgtcccggtggcggtggccccggtggccgcggtcctggtggcggcggtcgtcccggtggtcccggtggcggcggcggtcgtccgggtggcggcggcttcgccggccgtcccggtggcggcggtggcggcttcgccggtcgtcccggtggtcccggtggcggtggcggcggcttcgccggccgtccgggtggtcccggcggtggcggcggcggtcgtcccggcttcggtggtcgtcccggtggcccgggtggccgtggtggcacgcagggcgccttcggtcgtcccggcggtcccgcgcgtcgtggtcgcaagtcgaagcggcagaggcgccaggagtacgaggccatgcaggccccgtcggtcggcggcgtgatgctgcctcgcggcaacggacagtccgtccgcctgtcgcgcggtgcgtccctcaccgacttcgcggagaagatcggcgccaacccggcgtcgctcgtcggcgtgatgatgaacctcggcgagatggtcactgccacgcagtccgtctccgacgagacgctgaagctcctcgcggacgagatgaacttcgtcctcgagatcgtcagccccgaggaggaggaccgcgagctgctcgagtccttcgacatcgagttcggcgaggacgagggtggcgaggagttcctcgtcgcgcgtccgccggtcgtgaccgtcatgggtcacgtcgaccacggtaagacccgactgctcgacaccatccgcaagacgaacgtcgtggcgggcgaggccggcggtattacgcagcacatcggtgcgtaccaggtcacgaccgaggtcaacgacgaagagcgcaagatcaccttcatcgacacccccggtcacgaggcgttcaccgccatgcgtgcccgtggtgccaagtcgaccgacatcgcgatcctcgtggtggcggccaacgacggtgtgatgccccagacgatcgaggcgctgaaccacgccaaggcggccgacgtgccgatcgtggtcgcggtcaacaagatcgacgtcgagggcgcggacccgaccaaggtgcgcggtcagctcaccgagttcggtctggtggccgaggagtacggcggcgacacgatgttcgtcgacatctccgccaagcagggcctcaacatcgagagcctgctggaggccgtggtcctcaccgcggacgcctcgctcgacctgcgggccaacccggagcaggacgcgcagggtattgcgatcgagtcccacctcgaccgcggccgcggcgccgtcgcgaccgtcctggtccagcgaggcaccctgcgggtcggcgacaccatggtggtcggcgacgcgtacggccgtgtccgcgcgatgctcgacgacaagggcgagaacgtggaagaggcgggtccctcgaccccggtcctcgtcctcggtctcaccaacgtcccgggcgccggcgacaacttcctggttgtcgacgaggaccgcacggcgcgtcagatcgccgagaagcgcgcggcgcgcgagcgcaacgccaacttcgcccgccggggtgtccggttctccctggagaacctggacgaggccctcaaggccggtctggtgcaggaactcaacctcatcatcaagggcgacgcgtccggttcggtggaggctctcgagtcctcgctgctccagctcgacgtcggcgaagaggtcgacatccgcatcctgcaccgcggtgtgggtgcggtcaccgagtccgacatcaacctggcgaccggctccgacgccatcgtcatcggcttcaacgtccgcgctgcgggccgcgcggctcagatggcggagcgcgagggcgtcgacgtccggtactactcggtgatctaccaggccatcgaggagatcgaggcggccctcaagggcatgctcaagccggagtacgaggaggtcgagctcggcacggcggagatccgcgaggtcttcaagtcgtccaagctgggcaacatcgccggtgtcctggtccgctcgggcgaggtcaagcgcaacaccaaggcgcgcctcatccgcgacggcaaggtcatcgcggagagcctcaacatctccgggctgcgtcgcttcaaggacgacgtcaccgagatccgcgaaggcttcgagggcggtatcaacctcggaaacttcaacgacatcaaggtcgacgacgtcatcgcgacctacgagatgcgcgagaagccgcgctcg

SEQ ID NO: 2539 - DNA, 291 bp, Streptomyces avermitilis
  CDS (1)..(291)
gtgtctggccggacgcatgcccgcgcatgccctgagcgcacctgtgtggggtgccgggagcgagcggccaagaaggatctgctgcgcatcgtggcggtcgagggtgattgcgtccccgatcatcgcggtacgctgcccggccggggtgcgtatgtgcaccccgccctggtctgtctggacctggcggtccgccgccgggcgttcacgagggcgttgcgcgccccgggagcgctcgacacagcggcgttgcgccactacgtcgagcagaccgttgccgagcaggcaacaccg

SEQ ID NO: 2540 - DNA, 984 bp, Streptomyces avermitilis
  CDS (1)..(984)
gtggacatcgacatgagcgccctgcggggcttggtgcgggagaaggagatctccttcgacctgctggtcgaggcgatcgagtcggccctcctcatcgcctaccaccgtaccgagggaagccgccgccacgcgcgcgtggagctcaaccgggaaaccggccacgtgacggtgtgggcgaaggaggaccccgaggacctggaggaggggcaggaggcgcgcgagttcgacgacacgccgtccggcttcggccgtatcgccgccaccaccgccaagcaggtcatcctgcagcgcctgcgggacgcggaggacgacgccacgctcggcgagtacgccgggcgcgagggcgacatcgtgacgggcgtggtccagcagggccgcgacccgaagaacgtgctcgtcgacatcggcaagctggaagccatcctgcccgtgcaggaacaggtacccggcgagacgtaccagcacggcttgcgccttcgctcgtacgtcgtccgggtggcgaagggcgtgcgcggtccgtccgtcaccctgtcccgcacccaccccaatctggtgaagaagctcttcgcgctggaggtgccggagatcgccgacggttccgtcgagatctccgccatcgcccgcgaggccggccaccgcaccaagatcgccgtccgctccacccgatcgggcctgaacgccaagggcgcctgcatcggccccatgggcggtcgcgtgcgcaacgtgatggccgagctgaacggtgagaagatcgacatcgtcgactggtcggacgacccggccgagatggtggcgaacgcgttgtccccggcccgggtctccaaggtcgaggtcgtcgacctcgcggcccgctccgcgcgcgtgacggtccccgactaccagctgtcgctggccatcggcaaggaagggcagaacgcccggctcgcggcccggctcaccgggtggcggatcgacatccgcccggacaccgagcagagcggcgac

SEQ ID NO: 2541 - DNA, 507 bp, Streptomyces avermitilis
  CDS (1)..(507)
atgagcaccacccagagcgagaggctgcgagaacttctggaaccgctcgtgggctcccagggcctcgatctcgaagggatcgaggtggaatccgtcggacgcaagcgtgtgctgcgtgtcgtcgtcgattccgacgagggcgccgacctcgacgcgatcgccgatgtgagccgcgcgctctcggcgaagctcgacgagacggacgcgatgggcgagggggagtacaccctcgaggtcggtaccccgggcgcggagcgcgccctcaccgagcaccgccactacgtgcgtgccgtggaccgtctggtgagattccagctcaccgagggtgatgagctggtcgccagaatcctgaccgtggacgacgccggcctcgacctcgaggtgcccggagtgaagggccgcaaggccaccacccgcaggctcgccttcgaggacatcgccaaggcccgcgtccaggtcgagttcaaccgcaaggacaagaaggacatgacggaagaagaggaggcg

SEQ ID NO: 2542 - DNA, 696 bp, Streptomyces avermitilis
  CDS (1)..(696)
gtggcggggccacggcgaccgacgacaacgccgcagaggtgcgtgccggcccccgcggccccggcaggatccgccggacaggccctgggccgcccatccgttcgtacgagcccttcgaggacgtctgccgtgccgttcaccctgccgccgcgcatcccgccggggccgcgccgaaggagcctgctcgcttcggccgcgggcgccgcgctgctcgtcggctgctccgaaagccccgactcggccaacacggccggcagcccctccgccgccgaccgggcacgcgcgcgtgccgcccgggacagcgcggcgctggccacgcggtacgcggctgtgatcgccgcgcatccggcgctggcggaccttctgcgcccgctccggaccgcggtcgtacggcatacggaggcgttcgggggcagcgctcaggcatccgcgtccgcttcggcttcggcatccgtttcggcttcggccgacggtgacggtcgggcgcccgcgtccgcccacccctccgcgagcgcctcccccgccgtggccgccgaccggaagacggccctgtccgacctggccgccgccgagcgcgccctggccgaccggcgcacgaaggcgctgctggagttgccgggagagctggcgcggctcatggcgtccgttgcggcggcgggcgccgcgcacgcgttcttgctgacggagggcgcgaag

SEQ ID NO: 2543 - DNA, 501 bp, Streptomyces avermitilis
  CDS (1)..(501)
gtgagcgcgagcaccggcacgaccggcacaccgaaggccgagagcaccgagagcgccgagctgagggcgctccaggcggccctcggggccgaacacgccgccgtctacgggtacggcgtcgtcggcgggaagatcgggcaggcgcggcgggccgacgcgcgggccgcgtacgacgcgcaccgggcgcgccgggacgagctcgcgcggtccgtgcgtgacctgggcgggacgccgcaggccgccgcggccgggtacgcgctgccgttcgccgtgccggatgcgacggccgccgtacggctcgccgccgagctggaggaacgggtggccggggtgtactccgatctcgtacgggccggcacgggcgcgcgacgccgctcggccgccgaggcgctgcgggaggcggcggtgcgggcggtgcgctggagcggcgagagcgtagccttccctggtctcgccgagcgggcggcggccacccccaccgcgtcggcgacaccacagacg

SEQ ID NO: 2544 - DNA, 900 bp, Streptomyces avermitilis
  CDS (1)..(900)
atggctttcgaaccgccgcaacgcctcgtgcgggcgctcggcgagaccgagcggaacggggccgccgactggctggtcaagctgcccgagctggttcaacaggtcgttgatctacgcgagttgaccgtcgagcgggtgcaggcgccgggcgggcgcagcagcctggtcgtgctggtgcggcaggccgacggcacgcccgccgtgctgaaactcgcgccgccgtgggcccggcccgagagcgagcgggccgcgctggcgcactggggcggcttcggcgccgtacagctgctcgacggcgacggcggcgagggtgtgctgctcctggagcggctgcacccggagatgtccgtacggtccctgccggaggcgaaggccttgctggaggcggccggaaccctgcggcggctgtgggtcgagccgccggccggtcaggtcttcgagagcgtggccgagcggaccgggcggcaggccgaggcgatgcggacgagcgcggccgccgacgccgaggtcgcaccgctggtcgacgcggccctcgcggcccgcgaggaactgctggcctccgccccgcaggcgcgtctgctgcacggcaccttccggcagagcaaggtgctggccggtgagcggatgccgtggctggccgtggggcccgacccggtggtcggcgagtgcgccttcgacctggcccggctggtccgggaccgggtggaggacctgatcgcgtcgccctcgggggcctcgatcacccggcgccgggtgaagcggctcgcggagtcgctggagctcgaccaggaacgactgcgcggctggacgctgttccgtgccgtcgagtcgggggtgcgggcacgcagggtgggccgtccccaggacgcggaactgctgctggagttcgcgggctggctc

SEQ ID NO: 2545 - DNA, 1692 bp, Streptomyces avermitilis
  CDS (1)..(1692)
atggcccaggtccagcgcatgtcccgtttgatggtcaagacactgcgtgacgacccggcggacgccgagacgctcaaccacaagctgctggtgcgcgccgactacgtgcgccgcaccgcggccggcatctggtcctggctgccgctgggcaagaaggtcctggagaacgtcgcccgcgtggtccgcgaggagatggacgccatgggcggccaggaggtcctgctcccggccctgctgcccaaggagccctacgaggcgaccggccgctgggaggagtacggccccgagctgttccgcctcaaggaccgcaagggcgccgagtacctcctcggccccacccacgaggagatcttcacccagctggtcaaggaccagtgctcgtcctacaaggacctgccggtgatcctctaccagatccaggcgaagtaccgcgacgaggcccgcccgcgcgccggcatcctgcgcggccgcgagttcctgatgaaggactcctactccttcgacacggccgacgagggcctggcgcagtcgtacgcgctgcaccgcgaggcgtacatcaagatcttcaaccgcctcggcctcgaccaccggatcgtctccgccgtctccggcgcgatgggcggctcggcgtccgaggagttcctcgctccggcccccgccggcgaggacaccttcgtggactgcccggcctgcgactacgccgccaacaccgaggccgtcacgttcgtcgccccggccgtcgagagcgtcgagcacccggcggtcgaggagctggacacccccgacaccccgaccatcgagtccctcgccgagtacctcggcgtcccggcctcggcgaccctgaagaacctcctggtgaaggccgacggcgagatcgtcgccgtcggcgtccccggcgaccgcgaggtcgacctcggcaagctgggcgagcacctcgcgcccgccgtcgtggaactggtgacggccgaggacttcgagggccgcgacgacctcgtacgcggctacgtgggcccgcagggcctggagaaggtccgctacatcgccgacccccgcgtggcccccggcacggcctggatcaccggcgcaaacaagatcaacacgcatgcgaagaacgtcgtcgccggccgtgacttcgaggtcgacgactacctcgacgtcgtcgtggtcgaggagggcgacccctgcccctcctgcggcacgggcctcaggctcgaccgcgccatcgagatcggccacatcttccagctcggccgcaagtacgccgacgccttccagctcgacgtcctcggcaaggagggcaagccggtccgcgtcaccatgggctcctacggcatcggcgtctcccgcgccgtcgccgccctcgccgagcagacggccgacgagcagggcctgtgctggcccaaggagatcgccccggccgacgtccacgtggtcgccgcgggcaaggccctgcagaccgagctggcgctcgacgtcgccgagaagctgggcgcggccggtgtacgggtgctggtggacgaccgtgcgggcgtctcgcccggcgtgaagttcaccgacgccgagctgatcggcgtaccgcagatcctggtcgccgggcgccgctcggccgagggcgtcctggagctcaaggaccgcaagaccggcgagcgcgaggagctgacggtcgaggaggcgatcgcccgcctgtcggcg

SEQ ID NO: 2546 - DNA, 567 bp, Streptomyces avermitilis
  CDS (1)..(567)
atgctgcgctttcccggtcagggccaccacaaccccgacgacgtggtcatcggcctcctggatctcgccgcgcgcgtcgacgaggcgctcgccgtacaggcggtggccttcgggctcggcgccgacgaggtcgccgtacgacaccagatcgtcctgcggcacctgacctccccgggagcccgcgcgttcggcgccaccaccggcgacggacggctcgtcggcttcgtctacgggatgccgaacgaccgtacgcactggtggtccaccgtcgtcgagccctatctgcgcggccagggccacgaggactggctcgacaactccttcgtgatcaccgagctgcacgtccacccgcacttccagaaccacggcatcggccgctccctgatcaccaccatcacggacggcgccgccgagccccgctcgatcctctccgcgatcgacaccgagagccccgcccgcgggctgtaccactcgctcggctacgaggacctggcgcggcaggtcctgttccccagcgcgccgcggccgtacgccgtcatgggcgcccccctgcccctgcggcgccgc

SEQ ID NO: 2547 - DNA, 885 bp, Streptomyces avermitilis
  CDS (1)..(885)
gtgcggagatcagcagaccccagggtgaggcccccgcacgtgttgacgcagaccaccacccgggtcctcgaaccgagtgacctggacgccgcgctcgccgtactcgaccgcgagccggtcgcgaacgccttcgtgacctcccgggtacaggtcgcgggcctcgacccctggcgcctcggcggtgagatgtggggctggtacgaggacggcatgctcacgtccctgtgctacgcgggcgccaacctggtccccatctgcgccaccccgcgggccgtccgcgccttcgccgaccgtgcccgcagggccggccgccgctgctcctccatcgtcggccccgtcgaacccaccacccagctctggcagctgctcgaacccggctggggcccggcccgcgaggtccgcgcccatcagccgctcatggtcaccgaccggctgcccgacgacgtcgcccccgatccgtacgtccgccgcatccgcaaggacgagatggagacgatcatgccggcgtgcgtggcgatgttcaccgaggaggtcggtgtctccccgctcgccggcgacggcggcctcctctatcaggccagggtcgccgaactcgtcggctccggacgctcgttcgcccgcctcgaccgcaacggcaaggtcgccttcaaggccgagatcggcgccgcgacccaccacgcctgccagatccagggcgtctgggtcgcccccgaataccggggccagggactcgcggcccccggcatggcggccgtcctgcgctacgccctcgccgatgtcgccccggtcgtcagcctctacgtcaacgacttcaacacccccgcccgggccgcgtaccgaagagtgggcttccaagaggtcggcgcgttcatgagcgttctgttc

SEQ ID NO: 2548 - DNA, 1155 bp, Streptomyces avermitilis
  CDS (1)..(1155)
atgactgcgatttctctcggcatgccgtccgttccgaccaagctcgccgagcgccggaagagccggcagatccaggtcggaaccgtggccgtgggcggagacgcacccgtctcggtgcagtcgatgacgacgacgcgtacgtccgacatcggcgccacgctccagcagatcgccgagctcacggcgtccggctgccagatcgtccgtgtggcctgccccacgcaggacgacgcggacgccctcgcggtcatcgcccgcaagtcgcagatccccgtgatcgcggacatccacttccagccgaagtacgtgttcgcggcgatcgaggcgggctgcgcggcggtccgggtgaacccgggcaacatcaagcagttcgacgacaaggtcaaggagatcgccaaggcggcgaaggagcacggcacgccgatccgcatcggcgtcaacgcgggctcgctcgaccggcggctgctggagaagtacggcaaggccacccccgaggcgctcgtcgagtcggcgctgtgggaggcgtcgctcttcgaggagcacgacttccgggacatcaagatctcggtcaagcacaacgacccggtggtcatggtcaacgcgtaccgccagctggcggcgcagtgcgactacccgctgcacctcggcgtgaccgaggccggccccgccttccagggcacgatcaagtcggccgtcgccttcggcgcgctgctcagcgagggcatcggcgacacgatccgcgtctcgctgagcgcgccccccgtcgaggagatcaaggtcggcatccagatcctggagtcgctgaacctgcgccagcgcggcctggagatcgtctcctgcccgtcctgcggacgcgcccaggtcgacgtctacaagctggccgaggaggtcacggcgggtctggagggcatggaggtgcccctgcgcgtcgcggtcatgggctgcgtcgtcaacgggccgggggaggcccgcgaggccgacctcggcgtcgcctccggcaacggcaagggacagatcttcgtgaagggcgaaatcatcaagacggtgcccgagtcgaagatcgtggagaccctgatcgaggaggcgatgaagatcgccgagcagatggaggcggacggcatcgcctccggcgagccctcggtgtcggtggccggc

SEQ ID NO: 2549 - DNA, 1302 bp, Streptomyces avermitilis
  CDS (1)..(1302)
atgacgaccctgatgttcatcctcggcatagtcgtcttcgcgatcggcctgctcatctcgatcgcctggcacgagctgggccatctgtcgacggccaagctcttcggcatccgcgtcccgcagtacatggtcgggttcggcccgaccgtctggtcgcggaagaagggcgagaccgagtacggggtcaaggcggtgccgctcggcggctacatccgcatgatcggcatgttcccgccgggatccgacggaaagatcgaggcccgctcgacctccccgttccgcggcatgatcgaggacgcccgctcggccgcgttcgaggagctgaggcccggcgacgaggaccgtctcttctacacgcgcaagccgtggaagcgcgtgatcgtgatgttcgcgggccccttcatgaacctgatcctcgccgtggtgatcttcttcggcgtgatgatgaccttcggcgtcaacacccagaccaccacggtcggcaaggtctcggactgcgtcatccagcagagcgagaaccggacgaagtgcgcgcggagcgaccaggccgcgcccgcgaaggccgccgggctcaagggcggcgacaagatcgtcgcgttcgacggcaaggccgtcgcggactggtcggccctccagtccgacatccgcgccaaccccggcaaggacgtcacgatcacggtggagcgcaaggggcagcagctcgacctcaaggcccacctgatcaagaaccaggtcagcaagaccgacggcaacggcggctacgtcgagggcaagtacgtgtacgccggcttcctcggcttcacgcccgcctccggcatcgtcgagcagtcgttcgggcagtccgtgacccgtatgggcgacatgatgcagaacggcgtcgagtcgctgatctccctgccgggcaagatccccgccctgtgggacgcggccttcggcgacggcccgcgcgaggcggactcgccgatgggcgtggtcggcgcggcccgcgtcggcggcgacgtcttcaccctggacatcccgccgtcccagcagatcgcgatgatgctgatgctcgtcgcgggcttcaacctctcgctgttcctgttcaacatgctcccgctgctcccgctcgacggcggccacatcgcgggcgccctgtgggagtcgctgcgccggaacgcggcgaaggtgctgcgacgcccggacccgggcccgttcgacgtggcgaagctgatgcccgtcgcgtacgtggtggccgggatcttcgtctgcttcacgatcctggtcctgatcgcggacgtggttaacccggtgaaaatctcc

SEQ ID NO: 2550 - DNA, 1182 bp, Streptomyces avermitilis
  CDS (1)..(1182)
gtgatcctcggttccaccggctcgatcggcacccaggccatcgacctcgtgctgcgcaaccccgaccggttccgtgtcaccgggctctccgccgccggcggacgggtcggactgctcgccgaacaggcccaccgcctgcgcgtgagcaccgtcgcggtcgcccgcgaggacgtcgtaccggtgctgcgcgaagcgctcaccgcgcagtacggccccggcgagccgctccccgagatcctcgcgggggcggacgccgccacccagctggccgcctccgactgccacaccgtcctgaacgggatcaccggctccatcggcctggcccccaccctggccgccctggaggcgggccggacgctcgcgctcgccaacaaggagtcgctcatcgtcggcggcccgctggtgaaggcgctggccaagcccggccagatcattcccgtcgactccgagcacgccgccctcttccaggccctcgccgccgggacgcgggccgatgtgcgcaagctcgtcgtcaccgcctccggcggccccttccgggggcgtacgaaggccgagctggcgaacgtctcgcccgagcacgccctggcccaccccacctgggccatgggaccggtcatcacgatcaactccgcgaccctggtcaacaagggactcgaagtcatcgaggcgcacctcctctacgacattcccttcgagcggattgaggtggtcgtgcatccccagtcgtatgtccactcgatggttgagttcacggatggatcgacactggcccaggcgacgcccccggacatgcgcgggccgatcgccatcgggctcggctggcccgagcgcgtgcccgacgcggcgcccgccttcgactggacgaaggcgtcgagctgggagttcttcccgctcgacaacgacgccttcccctcggtcggactcgcccggcacgtgggacagctcgcgggcacggccccggcggtgttcaatgccgccaacgaggagtgcgtcgacgcgttcctgaacggcacgctgccgttcaacgggatcatggagaccgtcacgagagtggtcgaggaacacggcacgccgcgcacgggaacttccctgaccgtcgcggacgtcctcgaagcggagacctgggcgcgtgcccgggccagggaactgacagttcagacggcgaccgcggaggctcgtgca

SEQ ID NO: 2551 - DNA, 447 bp, Streptomyces avermitilis
  CDS (1)..(447)
atgcggatacgcgctgccctgcccgcgctcgcgggcgccgtggcactcaccggcaccattctcagcactccggccgaagcggccggcggtgtgaccatccatcacgtctggttcgacagcccgggctccgacacccgctccaacgcgagcctcaacgccgagtgggtgcagatcaagaacaccggctccgccacggtctcgctgaagggctgggtcctcaaggacgtctcgaaccacaagtacgtcttcccggacgtcgcgatcggcgcgggcaagaccgtgaaggtgcgcaccggcaagggcaccgacaccacctcgaccaagtaccagagccgcggcgcgtacgtctggaacaacaccagcgacaccgccacgctcaccaaggcgagcgggaccaaggtcgactcgtgtgcgtggacgacacgggacccgagcgacacgtactgc

SEQ ID NO: 2552 - DNA, 2760 bp, Streptomyces avermitilis
  CDS (1)..(2760)
atgccggttctcggtctcgacaacatcaccggcaggatcatgcgggccggtgaagggcgaatcctgcgccgtttgcagcgcatcgcggcacaggtgaactccctggaggaagaattcaaggcgctgaccgacgaggaactccaggcactcactcccgagttcacccggcgccacgccgacggcgagagcctcgacgacctgctgcccgaggccttcgccacgatgcgcgaggcggcccggcgcaccctcggcatgcgtcacttcgacgtccagctcatgggcggcgcggcgctccacttcggcaacatcgcggagatgcagaccggcgagggcaaaaccctggtcggcaccctgcccgtctatctgaacgccctgaccggcaagggggtccacctcgtcacggtcaacgactacctcgccgagcgcgacgccgagtggatgggacgggcgtaccgcttcctgggcctgaccgtcggcgtcatcaagtcacagtcgacgcccgccgagcggcgcgcgcagtacgcctgcgacatcacctacggcaccaacaccgagttcggcttcgactatctgcgcgacaacatggcctggtcgcaggacgaactcgtccagcgcggccaccacttcgccatcgtcgacgaggccgactcgatcctcatcgacgaggcccgcacgcccctgatcatctcgggcccggccgaccagcccacccagtggtacggggccttcgccaagctggtcacgcggatgcggggcgtacgggtccaggaggagcagttcgtcaccccggccgacaaggaccgcctcgcccatctgcggaccacccacgactacgagtacgacccgaagaagcgcaccgtggcgatcctggaccgcggtgtcgagtacctccaggaccagctcggcatcgagagcctgtacgagtccgagcacacctcgctgatcgggcatctcaacaacgccctcaaggccaaggagcacttcaggaaggacaaggactacgtcgtcgtggacggcgaggtactgatcgtcgacgagcacacgggccgcatcctggccggccgccgctacaacgaggggctgcaccaggcgatcgaggcgaaggaggcggaggagggcacggaggcgggagtgacggtcaggaacgagaaccagaccctggccacgatcaccctgcagaacttcttccgcctctacgagaaactcgcgggcatgaccggcacggcgatgaccgaggccgccgagttccaccagatctaccagttgaacgtcgtgccgatcccgagcaaccggcccatgatccgccgcgacgaccccgaccagatctaccgcaccgaggaggcgaagtacgccgcgatcctcgccgacatcgccgaacggcacgagaccggccagccgatcctcgtcggcaccacctccgtggagaagtccgagctgctgtccggcctgctgcggaagcagggcatccggcacgaggtcctcaacgccaagaaccaccagcgcgaggcccagatcgtcgcccaggccggccgcaggggcgccgtcaccgtcgccaccaacatggccggccgcggcaccgacatcatgctcggcggcaaccccgaggcgatggcgctcgccgcgctccccgaagacgccacgccggaggaccgcgaggccgtactcgaccgcgtcggcagggcggccgccgccgagcacgaggaggtcaaggaactcggcggcctctacgtcctgggcaccgagcgccatgagtcgcgccgcatcgacaaccagctgcgcggccgctccggccggcagggcgaccccggcgcctcccgcttctacctctccctcggggacgacctgatgcggctgttccgcgcccaggtcgtcgagcgggtgatgtcgatggcgaacgtgcccgacgacgtcccgatcgagaacaagatggtcacccgcgccatcgcctccgcccagtcccagctggaacagcagcacttcgagtcccgcaaggacgtcctgaagttcgacgaggtcctcaaccgccagcgcaccctgatctacgccgagcgccgccgcgtcctggccggtgaggacctgcgcgagcaggtccggcacttcatggacgacaccatcgaggcgtacatccggcaggagaccggcgagggcttccccgaggagtgggacctggagcggctgtggggagccttcaggcagctctacccggtcggcatcaccatcgaggacctggaggactccgtcggcggccggcccgacctcacagtcgacgacctcgtggcggcggtcaccgaggacgtccacgaccgctacgcgcggcgcgaggcggaactcggcgccgacgccctgcgcgacctggaacgcctcgtcgtgctctccgtcctcgaccgcaaatggcgcgagcacctctacgagatggactacctgcgcgacggcatcggcctgcgctggacgctgggccgcgagccgatcgtcgagtacgagcgcgagggcttcgacatgttcggcgcgatgaccgaggcgatcaaggaggagtccgtcggatacgtgttcaacctggacgccacgggccgggagggggagggctccgccctggaccgccgccccaccgacggactgcacttcagcgcgccgacgctggacaccgcggagggcgtggtcgagggccgcttcacgacggcgcccgccggggaaccggccgagcacgacaaagcgccgccgcaccggcccgggaagtcccggaaccggcggcggcgcaagagg

SEQ ID NO: 2553 - DNA, 483 bp, Streptomyces avermitilis
  CDS (1)..(483)
atgcgccaaggtgtcggggaagaacacagtcatggaatttccgtacagctgacgcgtgcccggggggacgcgcgccaccagctcgacgcgacagatctggtaaaggccctgcggaccgtgcgcaacgaggtcgtgcccctggcggagaaactgcgccagacggcaccggagaccttcgaggcgcaccgggacgcgctcgccgtcctcctgaacgactgcgcgctcgccctggtcgacgaggaaccgaggccgcccgtcgccaccttcgacccgatgccggtgcggcggatcgacctgcgggacgtcgacgccctgctggacgcgggccggccgggcgaacggcccgtcatccagcagctgttccgcggctccgtggcgtacgcgaaggacccggtactgcgcgaggtgatcaaggcgaatcagcagggcgtccacattctccagcgggccaaccactggatccggatgctggcggactcgatc

SEQ ID NO: 2554 - DNA, 1938 bp, Streptomyces avermitilis
  CDS (1)..(1938)
gtgagcctcatgtccgccacaccccaccagccaacggtcactgaacgtgaggcgcgtcaggtcgccgaggccgcgcgtgaacaggactggcgcaagcccagcttcgccaaggagctgttcctcggccgcttccggctcgacctgatccatccgcacccgatgcccgccgacgaggacgcgcagcgcggcgaggagttcctcgccaagctgcgcgacttctgcgagacggagatcgactcggcccggatcgagcgcgaggcgcggatccccgacgagaccgtcaacgggctcaaggagctcggcgccctcggcatgaagatcgacaccaagtacggcggcctcggcctcacgcaggtgtactacaacaaggcgctcgccctggtcggctcggcgaacccggcgctcggcgcgctgctgtccgcgcatcagtcgatcggagtaccgcagccgctgaaactcttcggcacccaggagcagaaggacacgtacctgccgcgctgcgcccgcaccgacatctccgccttcctgctgaccgagccggacgtgggctccgacccggcgcggctcgcgaccaccgcggtcccggacggtgacgactacgtgctcgacggagtgaagctgtggaccacgaacggcgtggtcgccgacctgctcgtcgtcatggcccgcgtaccgaagtccgagggccacaagggcggcatcaccgccttcgtcgtcgaggccgggtccgagggcatcacggtcgagaaccgcaacgcgttcatgggcctgcgcggcctcgagaacggcgtcacccgcttccaccaggtccgcgtcccggccgcgaaccgcatcggcccggaaggcgcgggcctgaagatcgccctgaccacgctgaacaccggccgtctctccctgcccgcgatgtgcgtcggcgccggcaagtggtgtctgaagatcgcccgcgagtggtcggcggcgcgcgagcagtggggcaagccggtggccttccacgaggcggtcggcgcgaagatctccttcatcgcggcgacgacgttcgcgctggaggccgtcgtcgacctgtcctcgcagatggcggacgagaaccgcaacgacatccgcatcgaggcggccctcgccaagctgtacggctccgagatgggctgcctgatggccgacgaactggtccagatccgcggcggccgcggcttcgagaccgccgagtcgctcgcggcccggggcgagcgcgcggtccccgccgagcagatcctgcgcgacctgcgcatcaaccgcatcttcgagggctcgacggagatcatgcatctgctgatcgcccgcgaggccgtggacgcccatctctcggtggccggcgatctgatcgacccggacaagtccctgtccgacaaggcgaaggccggcgcgaacgccggggtgttctacgccaagtggctgccgaagctggtcgcgggacaggggcagatcccgggtgcgtacggcgagttccgccgcgaggtcgacctgtcgccgcatctgcgctacgtcgaacgcggcgcgcgcaagctggcccgctccaccttctacgccatgtcgcgctggcagggccgtatggagaccaaacagggcttcctcggtcggatcgtcgacatcggcgcggaactcttcgcgatgagcgcggcgtgcgtacgcgccgaactcctgcgcaaggagggggaccacggccgcgaggcgtaccagctcgccgacgccttctgccgccagtcccggatccgcgtcgaggagctcttcggccgtctgtggtccaacaccgacgacctcgaccgcaaggtggtcgagggcgtcctgtcgggcacctacgcatggctggaggaaggggtcatcgacccgtccggcgaaggcccgtggatcgcggacgcgaccccgggagcggcgaaacgggaaaacgtccaccgccccattcgc

SEQ ID NO: 2555 - DNA, 807 bp, Streptomyces avermitilis
  CDS (1)..(807)
atgcagcatcgcagaccgcgcctgtccaagaaggcgagggccctggtcgccaccacggtcgtcctcgcggccgccgccggcgtcaccgtcgcccaggcgggcgagaccggcaagaagtgcgcggccttcgacacgatcacgctcggcaagtactacgtgaacaacaacctctggggccaggacaaggccaccggcacccagtgcgtctgggacgactcccggtccggctccacgatctcctggggcacggactactcctgggccaacaactccgccgggcacgactacgacgtgaagtcctacgcgagcagtgtcctcggctggcactggggctggaaggcggacaaggcggcgacgggtctgcccgtccgggtgggcgaccgcaagagcgtgaggaccacctgggacttctcggtcggcgccggtcccggcacgatgaacgtcgcgtacgacctgtggctgcacgccaagaacaacgcggactggcaggaccagcccaccgacgagatcatggtctggctcaaccgccagggcggcgcgggcccgctgggcaccaagtacggcagcgtcagcctcggcggcgcgatgtgggacatctaccagggcgacatcggctggaaggtgtactccttcgtacggcgtacgaacaccaccaaggccacgctcgacctggacgacttcacccaggccctggtccgccgcaagctgctgagcgacgacaagtacgtctccggcatcgaggcgggcaccgaggtcttcaagggcgcgggccgactggacaccaaggcgtactcggtggacatcggc

SEQ ID NO: 2556 - DNA, 1011 bp, Streptomyces avermitilis
  CDS (1)..(1011)
atggtcaccctcgccgaggtcgcccagcacgccggagtctcggcgagcacggtgagctatgtcctcagcggcaagcggtccatctccgtgggcacccgccggcgggtcgagcagagcatccaggagctcggctaccacccgaacgcgggggcccgcgccctggcgagcagcaggtcgaacatcatcgcgctgatgatcccgctccgcacggacatgtacgtccccgtgatgatggagatcgccatcgcggtggcgaccagcgcccgcacccacgggtacgacgtgctgctgctcaccggcgaggagggtcccgacgcggtgcgccgggtcacgggcagcgggctcgccgacgcgatgatcctgatggacgtcgagctcgacgacgagcggctgccgctgctgcgcagcaccgaccagccgtccgtgctcatcggactgcccgccgacacctccggactgacctgcgtcgacctggacttcggcgcgacgggcgccctgtgcgccgggcatctggcgacgctcggccaccgtgacatcgctgtcatcggcgaggcgcccgcggtctacgaacggcacacgggcttcgccgagcgcaccctcgacgggctccgctcccgctcgcgggagctgggcctgcgcgtgctgcaccggccgtgcgagggcggctacgacgcgatggccctgacgctcgcccggatcttcgacgagcgcccgagcaccacggggttcgtcgtgcagaacgagtccgccgtggaaccgctgctcgcgctgctgcgccggcagggacgggccgtacccgaggacgtctccgtgatcgccatctgcccggaccaggtcgccacgcaggcctcggtgcggctgacgtccgtggccatcccggcccaggagatgggacggcacgcggtggagcacctggtcgcgaagctgaacgggcacggcgaggacgaagtcgtgctgatcgcacccgagctgacggtacgggcgagcacgggaccggcaccgaccgccgcc

SEQ ID NO: 2557 - DNA, 1926 bp, Streptomyces avermitilis
  CDS (1)..(1926)
gtgcgcgtcgagccctggggcccggacgcggtccgggtccgcacccggctcggcggcccggtcctggaggggctgccgggcgccctcctcgacgagcggccgtcgacgccgtacaccctcaagatcgaggacgggcgggggacgctgaccgtcggcgcgctgaccgtcgaggtcgacgccgagggcctgctccgcttcgtgcgcacggacgacggtggagaactcctcgccgaggagcgggcccacttctggtggccgggctcgcggctgtacaccccggccggcggcggccggcaccgcctggaacagcgcttcgccgcctacgagggtgagcggctgtacggcctgggccagcaccagcacgggctgttcgaccagaagggcgcggtgctcgacctggtgcagcgcaacgccgaggtgaccatcccggtgctgacctccagccgcggctacaccttcctgtggaacagcccggccatcggccgcgtggagctggcgggcaacggcacgcgctgggtggcggactcggcccggcagatcgactactggatcaccgcgggcgacccggccgacgcccagcgccgctacagcgcggtgaccggccgtacgccgatgctgccggagtgggcggccggcttctggcagtgcaagctgcgctaccgcacccaggacgaactcctcgcggtggcgcgggagtacaagcggcgcggcctgcccctcgacgtcattgtctgcgatttcttccactggacccacctgggcgagtggaagttcgacctcgatcagtggccggacccggcggcgatggtggcggagctggcggaactcggcgtcgaactggtggtgagcgtctggccgtcggtctcgccactgagcgagaaccaccagctcatggagcagcgcggctacttcatcggcaccgagtacggccccatggcccatgccgactggcccgacaagggagtcgcgtcgacggtccaggtggccttctacgacgccacgaaccccgaagcgcgcgagttcgtgtggtcgaaggtgcgggacaactacctgaagccgtacggcatcaggtcgttctggctggacgcctgcgagccggagctgaagccgggcttccaggagaacctgcgctactacgcggggcccggtccggagacgggcaacctgtatccgcgcgagaactcccgcaccttctacgagggcatgctcgccgccggcgagaccgaggtcgtcaccctcaaccgctcggcgtgggcgggcagtcagcgctacggcgccgccctgtggtccggcgacatcggcaccgacttcgcgactctgcgccgccagatcgcggccggtctcaacacggccctgtccggcatcccctggtggaacacggacatcggcggcttccacggcggtgacccggacgatccggcgtaccgcgaggtcatggtgcgctggttccagttcggcgcgctgtccccgctgatgcgcctgcacggcttccgcgacccgggcacgccgctcggacccgggatgaccggcggccccaacgaggtgtggtcgtacggcgaggaggccggcgcgatcctggagaagtacctgcggctgcgcgagcggctgaagccgtacgtcctcgacgtcatgcgcgccgcgcacgaggagggcctgcccgtgatgcggccgctgttcctggagttccccgaggaccgggccgcctggtcggtggacgacgcctatctcttcggacccgatctcctggtcgcgccggtcctcacggcgggcgcgacgtcccggaccgcgtacctcccggcgggcgcgtggtggacggacgcgtggacgggtcaggagtacgagggcggcacggccgtgaccgtcgacgctccgctggaccgcatcccgctgttcctgcgggacggggcgcggctgccggtggcggag

SEQ ID NO: 2558 - DNA, 711 bp, Streptomyces avermitilis
  CDS (1)..(711)
atggcaccacgcacgctcagcaaggtcaccaaagccctgatcgcccccgcgctcgcgctcggcgcgaccatcggcctcgcctccgcccccgcccaggcagcggtctggagctcctgcgaccagtggggcaacacgaccctgaacggctacacgctctacaacaacatctggggctccggcgcgggcagccagtgcatctgggccaactccggcaccaactggggcgtcaacgccaaccacccgaacactggcggcatcaagtcctacccgaacgccaagaaggtgatcaacaagtcgatcacctcactcggatcgctcagcagcagctacaacgtcacggtcccgtcctccggcgcgtacaacacgtcgtacgacatctgggacacggcctacaagtacgaggtcatgctctgggtgaactacaacggagccgtcggcgcgctcggcacctcccagggcaacctgacgctgggcggtcacacctggaccgtctacaagggcaacaacggctcgaacgacgtcttctcgttcctgcgcacctcggactcgtcctccggcaccgtgaacgtcctcccgatcctgaagtggatcaaggacaccaagggctggttcggcaatgtgaccatcggtgacgtgcagttcggcttcgagatcacgtcctcgtcgggcggcctggacttcaccaccaacagtctgagcgtcagcagcagc

SEQ ID NO: 2559 - DNA, 2196 bp, Streptomyces avermitilis
  CDS (1)..(2196)
atgagcgagcccgtgcacggcacctgggaggccgcccccgccacccgctgggaggacgccttcctgagtggcaacggccgccatggcgtcatggtgttcggtgatccgaacgatgaccgtgtcatcgtcaatcatcacaccctgatccgccccaacggcagcgcggacgccggcccgcccgcgctggcggaccggctccccggcctccaggaccgcttgctggcgggcgacaccacggccggcgaggacttcaccgacggtcggccgctgctgtgggtgcggcccttccacccggcgttccggatacggctgcgccgcccggcccccgagcggcgctcgtaccggcgccatgtcgacttcaccaccggagtcgtcggcgccgacggcggcggccgcagcgaggtcttcgtctcccgcgccgacgacgtcgtggtccagcgcgtgaccggacccggcctcaccctcgacgtgacgctggaccaccggctgccgggcgcgccgagggacctggcggtggggcacggcgccgtcctcacctccgagggcgccctcctcaccctgcgggcccgctaccccggcggcgacctggcgtacacgggcgtgacgctcgccgtggtgagcggcggccggacccggacggcgctgcccggtctgcgggtcgagggggcggcctcgctgctcctgctcacccgcgtacggcggcacaccggggagctggacgtcctggccgaggccagggaactgcgcgccctgctgcccggtgacgaggaggacgcgtacccccacctcctggcccgccacaccgccctccaccgcaccgcctacctccgcgcgggtctggacctcggcgccgaccccaccgaacgcgccctccctggttcggagttggtccgccgcccgaagagccccgccctcctcgaacgcctcttcgcggccggccgctaccacctcctgtcctccgccgggatgcttcccccacggctgaccggcctgtggaccggggactgggacaccgcgtgggcgggggccttcaccaccgacgccaatgtcaatctgcagacggcgtcggccgccgcagccgccctcccggaggtctccgaggctcatgccgccctggtgcacggccagttgccgcactggcgcgacaacgcccgggcgatcttcggtacccgtggcgtcgtcgcccccgcgcacaccgacggtgagtccgggcacatctaccacctcagccgcgagtaccccctgcatgtgtggaccgcgggcgccgactggctcctgaagcccctcgtggaccatgacgagacgagcggggcgcgcgacccgcggctggcggtcgcgctcgccgaagtggcgtacttctacgaggacttcctcacccggaccgacaagaacggtcatctcgtcgtcgtgccgtcgtactccccggagaaccgtcccgcgaacgcgagctggatcaccctcaacgccgccatggacctctcggcggcgcggcacgccctcctcacggcggcccactaccacccgggacccgacgccgagcgcctgcgcgcgctcgccgaccggctgcccccgcaccgcgtcaacgccgacggcgccctcgccgagtgggcctggcccggtctcgacgacacctacgaccaccggcacctgagccacctctacggggtctggcccctcgacgagatcaacccgtacgacacccccgaactcgccgccgccgcccatcgcgccctcgaactgcgcggcgccgagaacgactccgcgcacggccacctccaccacgccctgatcgcggcccggctgcgcgacgccgaccgggtggcgggcgccctcggcaacgtactggccggggacttcttccatgtctccctgatgagcgggcactacccgaaccgccacgtctacaacgcggacgccgcccacacgctgcccgccgtgatcatcgaggcgctgatccagtccacgcccgggcggctcgtcctctttcccgccctgccgaccgcgtatccgacgggccgattgcgcggcgtccgcacccgcttcggcgccgaggtcgacctgacctggggccccggggagcgcacggccgtcatccgcccgacgcgcaccctgcgcgtcgacctcaggacttcctccggcgcacgacccctcgatctcgtcgccggagaggactgcgtcctcaccctggggccgcag

SEQ ID NO: 2560 - DNA, 1977 bp, Streptomyces avermitilis
  CDS (1)..(1977)
atgcccgggctcacggatgccacccggggccgcatcctgttcggtggcgactacaaccccgagcagtggcccgaggaggtctggcaggaggacgtacgcctcatgaaggaggccggcgtcaactccgtcaccgtcggcgtcttctcctgggccgagctcgaacccaccccgggggcgagggagttcggctggctcgaccggctcatggacctgatgcacgagaacggcatcggcgtcgtcctggccacccccaccgcctcgcccccgccctggatggggcgcctgcaccccgagaccctgccccgcgacgaggacggccgcatcgagtggtggggcggccgccagcacttcgcccactccagtgccgtctaccggcgctacgccgccgccatcaccgaggacctcgccgcccgctacggcggccatcccgccctcacgatgtggcacatcaacaacgagtactgcacctacgactggggcgacgaggcggccaccgccttccgccgctggctccagggcaggtacggcacgctcgacgcactcaacacggcctggggcacggccttctggagccagggctacgacgactgggaaggcatcctcccgccgcgccacgcccactacatgaacaaccccacccaggtgctcgacttcaagcgcttcacctccgacgcactcatggagtgcttcgtcgccgaacgtgacatcgtcgcccggcacaccccgaacatccccgtgaccagcaacttcatgccgttctggcagggccaggacgcctgggcgtgggccggccgggaggacgtcgtctcggtcgacagctatccggacccgcgcgatccgctgggcggtcagtacggtgcgctcatccacgacatgacccgctcgcaggcccgcggcggcccctggatggtcatggagcaggcggcgggcccggtcaactggcgcggggtcaaccaccccaagccgcccggcctcaaccgtctctggtcgctccaggccgtggcccgcggcgccgacgccgtctgctacttccagtggcgacagtcccggcagggcgccgagaagttccactccggaatggtcagccacgcgggggagcggggccgcaccttccaggaggtcaagcgcatcggggcggaactcgccctgctgagcgagaaggtggcggacactcgggtcacgggtgccgatgtcgccgtactgctcgactggaacgcctggtgggcgagcgggcaggacggtcggctgtccggcgaggtcgactaccccgcggtcgtacgcgcctggcaccgcgccctgtgggaagcgaacgtcaccgcctccttcgcccaccccgagcacgacctgtccgcgtacaagctggtcgtcctcccgcagctgtatctcctgacggacacggcgatcgacaacctcgtcgcatacgtacggggtggcggcaccgtggtctccggcttcctgaccggcgtcgccgaccaggacgaccgggtgcgccagggcggcatggacgagcggttgcggaagctcttcggcatccgcaccctgcacgaatggtggccgctcgacgccgacgagaaggtcggcgtagagggcttccgcggcactctgtggtccgaggagatcgaggccgcggacgaggcctacgccgtcatcccctacaaggggggcgagctggacggtcttccggccgtactgcgcaagggccgcgcctggtacctgtccacccttcccgagccggcggcgctgtggccgctgctcgccgggatcgccgaggacgcgggcgtacggccggcgctcgaccacctcccggcgggcgtggaggcggtacgccggggcgagctactgttcctgctccaccacgggcgggacacggtgaccgtgccggtacccggacgccaccgcgacctgctgaccggcgaggacgtcgtcgatgccgtggagctggggcggtacggcgcggcggtactggaggcggcgcca

SEQ ID NO: 2561 - DNA, 2217 bp, Streptomyces avermitilis
  CDS (1)..(2217)
atgcgcacgccccgcccgagcagacgaaccgtcctcgccgggaccgccgcggccgccgcgctcacggccgtccccgccgtggggtcccaggcgcacgccgccgaaaccaccgccggcccgtcgtaccgctggcgcaacgccgtcatcgggggcaccggcttcgtcaccggcgtgctcttccacccctccgtacgcggtctcgcctacgcccggaccgacatcggcggcgcctaccgctgggacgaccgcggcgcccgctggaccccgctcatcgaccacctcggctgggacgactggaacctcctcggcgtcgaggcgatggccgtcgaccccacgcacccggaccggctctacctcgccgtgggcacctacgcccagtcgtgggcgggcaacggcgcggtcctgcgctccgaggaccgcggcgccacctggacccgcaccgacctgaccgtgaagctcggcggcaacgaggacggccgcggcgccggtgagcgactcctcgtcgacccgcgcgacagcgacaccctctggctgggcacgcggcacgacgggctgctcaagtcgaccgaccggggcgccacttgggcagccgcgaccgccttcccggcgaaggcgaactcctccgggcagggagtcgtgttcctcgtcgccgccgggcgcaccgtctacgccggctggggtgacggcgacggcacctcgggcacggcgaacctgtaccgcacggccgacggcacgacctggggggccgtccccggccggccctccggcacctccgccaaggtcccgctccgcgccgcgtacgacacgcacacccgcgagctgtacgtgacgtacggcgacgcacccggcccgggcggccagtccgacggcagcgtgcacaagctgcgtaccgccacggggacgtggaccgaggtcaccccggtgaagccgggcgggacgacgagcgacggctcggcggacaccttcgcctacggcggggtcgccgtcgacgcccgccgccccggcaccctcgtcgtctccaccaacaaccgctgggccgacggcgacacggtcttccggtccacggacggcggccgtacctggacgtccctcaaggacgccgccgtgttcgacgtgtccgagactcccttcctcgactggggcgacgacaagccgaagttcggctggtggatccaggcgctcgcggtcgacccgtacgactcccagcacgtcgtgtacgggaccggcgcgaccctctacggcacccgcgacctcaagcgctgggcaccgcggatccgcggcctggaggagagcgccgtgcgccaactgatctcgcccccggtcggggaggcacacctgatcagcggactcggggacatcggtgtgatgtaccacgagcggctcacggcgtctccgtcgcgcggcatggcgacgaaccccgtgttcgggtcggcgacgggactcgcgcaggccgcggccaggccggcgtatgtcgtccgcacgggctggggcgaccacggcaacggcgcgtactcccacgacggcgggcggacctgggcgcccttcgaggcccagcccgacatcgccaaggacgcaccgggaccgatcgccaccagtgccgacggcggcacactgctgtggtccttcgtgcactgggacggcacgacgtacgcggcccaccgctcgacggacaacggcgcgagctggtccgaggtctcctccttcccgaagggcgccacaccggtcgccgacccggccgatccgacgcgcttctacgcctacgacttcgacaatggaacgctatacgccagcactgacagtggccgttcgttcacggcccgtgcgggcggactgccctccggcgacagccagttcaagctggtcgcggcgccgggacgaagcggcgacctgtggctctccgccaaatggaacgggctctaccggtccaccgacggcggggacaccttcgccaggatcgacagctgctgggcctcgtacaccctcggcttcggcaaggcggccgacggcgccgactacccggcgatctaccaggtcggctcgacggagaccatcaccgccgtctaccgctccgacgacgccgccaggacatgggtccggatcaacgacgacgcccaccagtgggggtggatcggcgaggccgtcgtcggtgacccgcgcatccacggccgggtctacctcgccaccaacgggcgcggcatccagtacggggagccggtc

SEQ ID NO: 2562 - DNA, 933 bp, Streptomyces avermitilis
  CDS (1)..(933)
gtgagcaccgtgaccgaacaacggccgaaggcccccggccgctgggccgccccgccgaggcccgtctgggaggaggagcccggcaaggccgggctcgcgggcaagggcattgccctggccggtgcctgcctcggcgtcctgttcccgctgtggatcgtcatcgtcaccagcctgtcctcgaagaaggtcatctccgacgccggcggcctggtggtcatccccaagggcatcagcttcattgcctaccaggagctgctgagcggcggtcaggtcacctgcgccaccctcgtcagcctgggcgtcaccctcgtcggcacgctgttctcgatgacggtgtccgtcctagcggcgtacgggctgtcccgcatcgggtcggtcgggcaccgctggttcctgatgaccctgctcgccacgatgttcttcggcgcaggcctcatccccacgtatctgctggtgcagtcgttgggcctgacggacacgtatctcgcgctcatcctgccgagcgccatcagtgtcttcaacatcctggtgctgcgcgggttcttcatgggtatctcgcaggagctcgtcgacagcgcgcggatcgacggcgcgggggactggcggatcctctggcagatcgtgatgccgctgtcccgcgcggtcatcgccgtgatcacgctcttctacgccgtcggctactggagcgcctggttcaacgcgtcgatctacctgagcgaccaggacatgatgccgctgcagaacgtcatgatccagctcgtccagaagcaggagccaccggtcggcatgggccaggccatcaagacgggccaggtgtccgcactcgccgtccagatggccgtcatggtgctggccctgctgccggtcgccgttctctcgcccttcgtccagcggcacttcaagaagggcatgctgaccggcgcggtgaagggc

SEQ ID NO: 2563 - DNA, 1083 bp, Streptomyces avermitilis
  CDS (1)..(1083)
gtggcacacagcaccacgccgggcgccgccgcgcgcaccgatccgtcctcggcgacggacaccgccgagccgtccgacggcgggagcgggtccgccaaggccgccaggcccgccgctgtctccaaggcgtcgaagaaagccttgaagaaggcctcggagggcggcactctcaggacccgtctcaagcgggaccgcacgctgatcctgatgaccctgccggccgtcctgctggtcctggtcttcaactacataccgatcctgggcaacgtcgtcgccttccaggagtacgacccgtacatcagcgacaacggcttcgtcgccatcttcgagagcccctgggtgggcttcgagcagttcacccggatcctcgatgactcggcgttctggaacgccgtccagaacaccttcgtcctgttctccctccagctgttgctcttcttccccatcccgatcctgctcgcgctgctcatcaacagcgtgatcaggccccgggtgcgggcggtgtcgcaggcgatcctctacctgccgcacttcttctcctgggtgctggtcatcaccgtcttccagcagatcttcggtggcgccggcatcatcgcgcagaccctgcggcagcacgggtatgagggcttcgacctcatgaccgacccggggatcttcaaattcctggtgacgtccgagggagtctggaaagacgcgggctggggcatcatcgtcttcctcgccgcgctggcttccgtcagtcccgacctgtacgaggccgcggcgatggacggggccgggcgatggcgccggatgtggcacgtcacgctgcccgcgctgcgcccggtgatcgccctgctgctggtgctgcgcgtcggtgacgcgctcacggtcggcttcgagcagatcctgctgcaacgcgacgcggtcgggccgggcgcgtcggacgtcctcgacaccttcgtgtggtggaacggcgtccgtaaccaggacttcagttacgcggcggcggcgggcctgatcaagggcgtggtcagcctcggccttgtcctcgccgcgaacaaggtcgcccatctcatgggcgagcagggggtgtacaagaag

SEQ ID NO: 2564 - DNA, 1680 bp, Streptomyces avermitilis
  CDS (1)..(1680)
atgacgccgaactccgccacctccgcccccagccggagaagcttcctcgcttccacggcggtcgccgccgcggcggtcgccggagggatgccgctgctcgccgcctgcggcgggtcggacagcggctccaaggagggcacgacctcgggcaagggtgcgcagaagatccttcccgccttcgtggcgcagaacgtggtgacgccggacatcgcgtcgaagaacggctccgccctcggcttcaccagcgagctttcgctcgcagacctgaagacctcagtgcctcggaagctcggcaagggcagcaccatcaagatcatgtcaccgttctggggctcgccgccgaagagcagcaacccctactactcggcgatgaacgcgaagatcggcgccaacatcgtctggcagaaccaggacggcaacacgtacgacgagaagctgggcgcggtcctcgcctccagcgacatgccggacgtcgtggtgatccccagttggaacatgggcggcaagatacccagcgccatcatcagcaagatggccgacctcggcccgtacctctccggcgacaagatcaaggactacccgaacctcgccgccatcccgagcgacgcctggcagtactccatcttcggcggcaagctgcgcggcctgccccagcccgcgcccaccgtcccgggcatcgtgcccttctaccgcaaggacgtcttcgacgacaaggggtacgaactccccaccaccgccgacgcgttcctggccctcgccaaggagatcaccgacgccaaggcgaaggtgtgggcctgcgacgacatgaagtggacggccttcggcatcttcggtgtgctctccggaagcgagaagccgctcggctggaacctcgtcgacggcaaactgatctaccgcgtcgagaccgacgagtacctcgaagcgctggagtggacgcgcaagctgtacgccgcgggtgtcgtccaccccgatgccaaggcgaagaaccagggcaacgcgggccagcgtttcaccgacggccaggtcctgatgtacaaccagaacatctcggactggtggggcaagatggccgaacaggccacccagaacaaggacttccgcatcgcgggcatggacatcttcggccacgacgggggcgatccccagttgtggtgcgggtcgcccgcgggcatcttcgccttcatcaacaagaaggcgtcgaaggccgtgatccacgatgtgctggccgccgcgaacgtcaccgccgccccgtacggcaccaaggagtacatgctcaccaactacggggtggagggcacgcactacaccgtcaaggacggcatgccggtcaagaccgaccagggcaacttggaggtcctgaacgcctacgtcatgctcgccagccccgccccgaccatcgcgcaccccgacttcccggacatcgccaaggaacaggtggagtggcagcagcggatgggcgccttcaccaagaagtcctccttcttcggactccaggtcaccgaaccggctcgctacaccaacctctccaacgacttcgaggatctggaggacgacgtcgtccgcggccgcaagaagatcagcgacatgcagcaggcggtgtcggactggaagagccagggcggcgacaagctgcgggactggtacaagaagctgctggacgacagcggatccgcgcagggg

SEQ ID NO: 2565 - DNA, 2862 bp, Streptomyces avermitilis
  CDS (1)..(2862)
gtgaccgcacaaacgccgcctacgccgtctttccgtgatccgcggctgccgttcgcgaagcgcgtcgacgacctgctggcgcggctcacgctcgatgaacgcatcgcgttcctgcaccagttcacgcccgccgtcgagcgcctcggcatcgccgcgttccgcaccggccaggaagcgctgcacggggtggcctggatgggcccggcgacggtgttcccgcaggccgtgggcctcggcgcgacctggaacgacgacctggtacggcggatcggcgaggcggtctcggccgagacccgtgcgatgcgcgcccgcgacgaccgggtcggcctcaacgtctggtcccccacggtcaatctgctgcgccacccgctgtggggccggggcgaggagggctactcggaggacccgaggctgacctcggcgatcgcgacggcgtacacccgggggctgcgcggcgaccaccccacctactggcgcacggcgcccgtcctcaagcactggctggcccacaacaacgagacgaaccgcgacaccacgtcgtcctcggtccgcccgcgcgtcctgcacgagtacgacctgcgcgccttccgcgagacggtcgaggcgggcgcggtggccggtgtgatgcccgcgtacaacctggtcaacggccgccccaaccacgtctcgccctatctgcgcgagcacctgcgcacctggacggaccaggaactgctggtctgctcggacgcgggtgcgccctccaacctggtcgactccgagcactacttcgacacccacgaggaggcgacggcggcggcggtcctggccggcgtcgacagcttcaccgaccacggcacggacagctccaagatcgtcgagcgggtccgcggcgccctggtccagggcctgttgagcgaggccgacatcgacgaggcggtccgccgccagctcgcgatccgtttccggctcggcgagttcgacccgcgcctcgacccgtacgccggcaccttggacttcgacaccgcggcccatcgcgcgctcgcccgggagtccgcggagcaggcggtcgtcctgctcaagaacgagggactgctgccgctgggccccgaggtgcgcatcgcggccgtgggcctcctcgccgacgagtgcaagctcgactggtacagcggcaccctgctgcaccgctccaccccgctggagggcctgtacgaacgcttcggcgccgaccgcgtcaacttcgcggagggcgtggaccgcgtacgtctgaggacgtcgtcgggcgcctttctgcgggtgcccgtggccgagaacgcggccgaggtcacggccgacgaggcgcgcggcgccgagggcgcgctggacccggcactgctcgcgggccgcaccgacctgcctccgctcacgaccgacgccgtcggcagcgaactcgcgctgatcgactggggcgagggcgtgctgacgctgcgcgcgcccgacggccgttacctctcggtcgccgacgacgggtacgtacgcgcctccgcggaccagccgggcggctgggtcgtccaggagacgttccgcctcgaaccttccgaatcccatgacaacggccacctcctgaagcacacagggacgggcaggtacgtctgtgtcgccgccgacggcgtgaaggttgccgctcaggagccgcgggacgcggagatcttcgaactggagtcgaccgagcgcggcgaggacgcggtgacgcgcgtcgccgccgcggcggacgtggtcctggtgttcgcgggcaacgatccgcacatcaacggccgggagaccgaggaccgtacgacgctgcggctgcccgcccaccaggagcggctgctgcgcgccgcccgcgccgcgaacccggccaccgccctggtcctggtctcggcgtacccgtacgcggtggaccacgccgacctcccggccgccctgtggaccgcgcacggcggccaggccgcgggcaccgcgctggcccgcgtcctgtccggcgacgtctcccccgcgggccggctcccgcagacctggtacgcggacgacgcggacctgcccggcctcctcgactacgacgtgatcggcagccgccagacgtatctgtacttcgagggcacgcccctgttcccgttcggccacggcctgtcgtacgcgtcgttcgcgtacgaggggctcgaacaccgcacggacgaagacacggtgcgggtctccttcaccgtcaccaacacgggctcccgggcggcggacgaggtggcccagctctacatccgggcggtggacccgtccgtcccgcgcccgcgccgcgaactggccgcccaccgccgcctgcgcctcgcccccggcgcctcggcggagctggccttcgcactcccgtcggccgccttcgcgttctgggacgtggcgcacggccgccgacgggtggagccggggtcgtacgaactcctggtcggcgcgtcgagcgaggacatccggctgcgtacgacgatcgagctgaccggcgaggcggcggccccccgcgccgtacgtgcgctcggcctgaaggcggccgacttcgacgaccagcggaacaccgagatcgtcgaccgtacgaaggtgtcgggcgacgcggtgacaccgctggacggcgggacgggcgaactcgtcttccgcgcctgcgacttcggggccggtgtctcgggcgtcagcgcggatctcgcgggcgagggcgtcgtcgagatctccctggccggcggcccgccaccggcggtgctgaccctgcccccgacgaaggggccgtacgactacaccaccgtgacggccgccttcgccgcggacggcgtgcacgacgtccacctcaggctgcgcggcccgctgcggctggcgcaggtcggcttctccggt

SEQ ID NO: 2566 - DNA, 1443 bp, Streptomyces avermitilis
  CDS (1)..(1443)
gtggcagccacccacgccttctggctcgccggccgccaggccaccggtgagaccaccttcgacgtcacctctccgtgggacgggcggctcgtcggcaaggtctccgtgcccaccgaggcgcagaccgaggaggccgtggccgccgcgtacgccgtgcgcgacgagttcgccgccaccccggcgcatgtgcgtgccgccgccctcgaccacgtcagcaagcggctcgtcgagcgcaccgaggagatcgcccagctgatctccgccgagaacggcaagccgatcaagtgggcgcgcggggaggtcgggcgtgccgtctccgtgttccggttcgcggccgaggaggcccggcggttcaacggtggcgaggctcagcggctcgacaccgacgcgggcggccagggccggctggcgctgacccggcggttcccgaagggtgtcgtgctcggcatcgcgccgttcaacttcccgctcaacctgtgtgcccacaaggtcgcccccgcgatcgcggccggcgcgccgatcatcctgaagcccgcccccgcgacgccgctgtcgggtctcgtcatcggtgacctgctcgccgagaccgacctgcccgccggttcgtggagcatcctgcccgtgtcgaacgaccggatgcccgctctcgtccaggacgagcggctgcccgtcatctccttcaccgggtccgagaaggtcggttacgcgatcatggactcggtgccgcgcaagcactgcacgctggagctcggcggcaacggcgcggcggtcgtgctcgccgactacgcgagcgacgcggacctggactgggccgccggccgtatcgccaccttctccaactaccagggcgggcagtcctgcatctccgtgcagcgggtgatcgcggacgcgtcggtgtacgagcggctgctgccccgggtcgtcgccgccgtcgaggcccaggtcaccggtgacccgtcggacgacgcgaccgaagtcggcccgctggtcagcgaggacgccgccaagcgcgtcgagtcgtgggtggacgaggccgcgcaggccggtgcccgggtgctgacgggcggcaagcgcgagggtgcctcgtacgcgccgaccgtgctcgtcgatgtgccggccgacgtgacgctctcgtgcgaggaggtcttcgggcccgtcctcaccgtgcagaaggtggagggggaggcggccgccttcgccgccgtcaacgagtcgaagtacgggctccaggccggtgtgttcacgcacgacctccaggccgccttccgggcccaccgtgccctggaggtcggcggtgtcgtcatcggcgacgtgccgtcctaccgcgccgaccagatgccctacggcggcgtcaagcagtcaggcgtcggccgcgagggcgtgaagttcgcgatggacgactacacctacgagcgggtgctggtcctgacgggcctcgccctc

SEQ ID NO: 2567 - DNA, 1080 bp, Streptomyces avermitilis
  CDS (1)..(1080)
gtggagcggctgcgggagcggccggcgcccgcgagcgcggtggtcggcgcgcccgacaacgaggaccgcgtcgagctgcactcgctcggcaccggccgccggccgcgcgccgcgctcgccgtcggcacggccgccgccctcggcaccgccgagcggtacgccgtgcactccgcgatcgccctgctcacgctgaccaccgagcggtcgcgctcgctgcacgccgccgaacagcggatcggggcggccgtcctgcgcatgctgctggccggggagtccgatcacgcccgggccgtcgccggggatctgtacggtgccctgctcgacgctccgttccggctgatcctggccgagtcggcgtccgcgtcggccgcgcgggcgcatgccgacaggcacgcgcgcgtggcgcccacgaagcgctcgcccgccgccgtcgccgtgcccgagaccaacggggacccgctcggcggcctcgcggagatcgtcgagtccgccgccgcccggtccggcgagtccgtgctgctcgtgcccgacggggagcggctcgtggtgctcgccgtggacgggggcgccgcggtcgccgcctgcggggagtacgcggcggcgctggaggcggcgcgggccgcgacgcgggagcagcccgtgaccgacgaggacgagctggtcgtggggctgtcggcgccggcgggaccgatcgcggcgggggccgcgtacaagcaggccgagcaggcgctgtcggtggcgcggcgccgtggacgtttcctcgtcgagcacgaggagctggcggccgggtccgtactgccgctgctcgcggacgacgcggtgcgggcgttcgcggacgggctgctgcgggcgctgcgcgagcacgacgcgacggggcggggcgatctcgtggcgtcgctgcgcgcctggctgtcgcggcacgggcagtgggacgcggccgcggccgatctgggggtgcaccggcatacgctgcggtaccggatgcggcgggtcgaggagattctggggcggtcgctggacgatccggatgtgcggatggagctgtggctggcgttgaagacgacggccgcggcgggagag

SEQ ID NO: 2568 - DNA, 777 bp, Streptomyces avermitilis
  CDS (1)..(777)
atgccccccacgctcgcctcgctcgtccaccactccgcgctcaagctgaccgtgcgagcgggcgaggaccgcctggatgtgcccgtccgctgggcgcacgtcagcgagctcgccgaccccgtcccctacatggagggcggggaactgctgctgatcaccgcgctcaaactggacgcggaggatcccgaggtcatgcggcgctatgtgaagcgcctggcgggcgcgggcgtggtcgggctcggtttcgccgtcggggtcaactacgaggagatccccgaggcgctcgtcgacgcggcggacaaagaggggctgccgctgctcgaagtgccccggcgcacgcccttcctcgccatcagcaaggccgtctccgcggccatcgccgccgaccagtaccgggcggtcacggcagggttcgccgcccagcgcgagctgaccaagcaggcgctgggcggtggggccgaggggctgctcaccgcgctggccggacaggtcgacggctgggacggctgctgtacgacgcctcgggcgccgtcgtcgccaccgcacccgagtgggcgggccgacgggccgcccggatcaccccggacgtggagcggctgcgggagcggccggcgcccgcgagcgcggtggtcggcgcgcccgacaacgaggaccgcgtcgagctgcactcgctcggcaccggccgccggccgcgcgccgcgctcgccgtcggcacggccgccgccctcggcaccgccgagcggtacgccgtgcactccgcgatcgccctgctcacgc

SEQ ID NO: 2569 - DNA, 2439 bp, Streptomyces avermitilis
  CDS (1)..(2439)
gtgcacggagcggctggtcagggggcaagggcgatggacagcgacgggacgcaggacgcacggggtacgcatgcgactcctgtgccacgacccgccgcacccccaccacccgtgccgcccatgccgcgcggcgcgccccccgtgcccgagcaggccccggcccgcccggccaccgtcgccgactggctcgacgaaccccgcccggccgccgcacccgggatctggcggtacggctaccgggtgccacggccggcgaagggagcgcagcggctctccccggtcacgatcgtcggtctcgcggtgccgctggtggtggcgctgatcgtctggtccctgtggcgccacggcagcgtgccctaccagtggatcgtgctgaagctcttcaccccggacgactggtggtggggcggcaccaccgcgccgaagacctggcaggggcaggaggccatcgaggtctacaccggggtgttcttcgccgtcctcgtctacgccatgggacggctgggaagctggtccgacgtggtccgtcactacgtcacccgccggccgcagcccgcgcgcgccctgctggccgccctgggcgccctgctcacgctgaccttcgtcttcccccgcgccttccccggcgtcggctgggacgcactgccggtcgtcgcacccctcttctccgtcacggccctgctcaccggcggctacgaggtgttccagtcgcagctggtcaccgacggtctgtacgcgctgatcaccctgctggtcctgtggcccttcgccaggatcggcgactggtggccgttcgccagggaacggttggccgcgcgcggccgcggccgggcgcccgagaccccggccgccccccggccacccgcccagtggcccgaactccatgacgcggggcagcaccaggcggcggacctgctctccggagaggtgctctccggccggatgaacgacgtggactgcgcccgtgtccggcacgcgtggaacgcggcgaagcgggacggcgcgcgcctcgccgccttcagcgacaccgtgctgcgccggggcgccgccgcctgggtccacccgtccggcgcccgggacctgccggcccgcaccgcacgccacgacgtgctcgaaggccaggtgcgcatcgggcgctggtcggccggggaccgtacgccgctcgtctaccgcggggccggcgcggccctcgacgccgagaccctcggcacctcactcctcgcggtgggtccgtccggctccggcaagacccgccagctggtccggcccctcgtcgagtcgctcaccctgcgagcgctcaccggacggtgcgccgtcgtcgtggtcgccgccgccggcacgcccctcggcccggactcggcgttcgacgtggtcgtcaagatcggcgatccctcctccgtccacgacctggacccgtacgcggattccgacgaccccgacgaggtggcgtccttcctggccgaaggcctggtcggagacctcgacacggtcgacggccggcgtgccgccaccgcgctcgcccaactgctcggcccctaccgggcggtgcacggacggttcccggcgctgcccgtgctgcgggagcttctggagggcgagccggcggcgctgtcgtccctgcgggaggcgctggcgggggacgaacacgccgtgatgcgccgggaactcgacgcccgcatccggcaggccgggagcgcggccgacgccggaccggctctcgccgaccggctcgcgctgctcgaccggccggtcttcgccgcgttcttcggcggcggcggtacggacagcgggatccggccgttctcactgcggtccgtggtccatcatccgctgcgggtgcgcgtcgatctgcccgagcgcgggcacgaggaggcgtcccggctgatcgcacggctcgtgctggcccagttcaccgccgtggtgcggggcggggagcgggccggggagcgggcccacttcgtctgtctggtcctcgacgacgccaccgggacgccgaccaccgaatccgtacgcggcatgcagcgcctgcgctcccagaacgccggagtggtcctcgcgctgcgcacgatcggcgacgtgcccgaggcgctgcacgggccgctgtacggggcggtcggctgccgtatggcgttctccggcgtcacgacgtgggacggcagccggttcgcccacgcctggggcaccgagtgggtggagacccgtgacgtggcccagcacacggtcttcgcggaccagccgatgacgcgggccatccacgccctgcgcaagctggtcaccggcaaggccgtgaccacggacgcggtgaccgtacggcaggtcgagcgggagcggtggtcggcgtccgagctggcgcacgaggtgccgccgggccacgcggtgctgtcgctcaccagcgtcgcgggcgagcacgcgccgccgctgctcgtggatctacggggc

SEQ ID NO: 2570 - DNA, 1332 bp, Streptomyces avermitilis
  CDS (1)..(1332)
atgagcgcacttccgcaggagcgccgcgtcgtcaccgccatccccggcccgaagtcgcaggagctgcaggcccgccgtaccgccgtggtcgcggccggtgtgggttcggtgctgccggtcttcaccacgcgcgccggcggcggcatcatcgaggacgtcgacggcaaccgcctgatcgacttcggctccggcatcgcggtgacgtccgtgggcgcctccgccgaggccgtcgtacgccgcgcctccgcccagctccaggacttcacgcacacctgtttcatggtcacgccgtacgagggctacgtcgccgtcgccgaggcgctggccgagctcacgccgggtgaccacgccaagaagtcggccctgttcaactcgggcgccgaggccgtcgagaacgccgtcaagatcgcccgcgcgtacaccaagcgccaggcggtcgtcgtgttcgaccacggctaccacggccgtacgaacctcacgatggcgctgaccgcgaagaacatgccgtacaagaacggcttcggaccgttcgcgcccgaggtctaccgggtgccggtggcgtacggctaccgctggctgaccggcccggagaacgccggtgccgaggcctccgcccaggcgatcgacatgatcaacaagcagatcggcgccgacaacgtcgccgcgatcatcatcgagccggtgctcggcgagggcggcttcatcgagcccgcgaagggcttcctccccgccatcagcaagttcgccaaggacaacggcatcgtcttcgtcgccgacgagatccagtccggcttctgccgcaccggccagtggttcgcgtgcgaggacgagggcatcgtcccggacctgatcacgaccgccaagggcatcgcgggcggtctgccgctcgccgccgtcaccggccgcgccgagatcatggacgccgcgcacgcgggcggcctgggcggcacctacggcggcaacccggtcgcctgcgcgggtgcgctcggcgcgatcgagacgatgaaggagctcgacctcaacgccaaggcgaagaacatcgaggccgtcatgaaggcccgcctgggtgccatggccgagaagttcgacatcatcggcgacgtccgcggccgtggcgggatgatcgcgatcgagctggtcaaggaccgcgacaccaaggagccgaacccggaggcggccggcgcgctcgccaaggcgtgccaccaggagggcctgctggtcctgacctgtggcacctacggcaacgtgctgcgcttcctgcctccgctggtcatcggcgaggacctgctgaacgagggcctcgacatcattgagcaggcgttctcccgtatc

SEQ ID NO: 2571 - DNA, 822 bp, Streptomyces avermitilis
  CDS (1)..(822)
gtggacggcttcgggccgaggcctccccagcttcgacctggtcgtgccctcgcgcacacacccggagcttccggctccggttctcctcaccgatcggatggccgcacgccccaaaccccccggggcgggcggcacaccgatctggacggccgccccggaaccaccccccctgttccggggcggccgaccttcctcctcggcctttcggcccttctcctcgcgctgatcacctggcaggtcgcggcccacggccccctggcccgcgcggacgaacgcctcagcggcacgctggtccgtccgggccgcttctccgaactcctcgccgatctgggcaacgccacggtcgcggtaccggtgctggccgtcgtcctggtgtacgtggccgtacgcgaccgccgggccggtgcggatcgctggtggctcccgtccacggccgcggcgctcctggtggcggccctcccggccctgatcgtcccgctcaaggaactgatcgcccgcccgggacccccggtcatgggcccgggcacgggcttctatccctcgggccacaccgccacggccacgatcgcctacggcacggcggccctgctcctgctgccccggctgcacgccacctgggcccgccgcaccgtgctcgccgcctccgtcaccctgaacctcgcggtcgccgtcggcctgatccgccgtggctatcactggccgctggacgtcgtggcgagctggtgcctgggcgcgctgctgctgacggcgctcgcgatgttcctcagccgaagtactggtcgaagttccgctggaactcccagctcccgaaccggtcccagt

SEQ ID NO: 2572 - DNA, 1827 bp, Streptomyces avermitilis
  CDS (1)..(1827)
gtggaccgcacccgacgcaccgtgccgcgcccacggcggcacagacttctcgccgtgggcgcggccgccgtcctggccgtacccgcaatgaccgcgctctcgtcggccgcccgcgcggccgacgcggacctcgcacgcaacggcgggttcgagtccggcctgaacgcctggacatgtgcggccgacagcggaaagaccgtcaactcgcccgtacggagcggaggttccgcgctccaggcgaccccggccggcagcgatcacgcccagtgcgcgcagacggtgaccgtgaaaccggacgcgcagtacaccctgtccggatacgtccggggcagctacgtctacctcggcgcgagcggcaccggcaccaccgacgtctccacctggacccagtccgcccccgactggcagcagctcaccaccacgttccgcaccggcccgtccaccaccgaggtcacggtctacacccacggctggtacggcaccggcgcctactacgccgacgacatctccctggtcggtccgggcgtggacgcgggtcagccaccggcggcgccgacgggcctgaaggcgggcacggtgacgtccacgagtgtcgccctgtcctggtcggcggtccccggagccacggggtacgcgatctaccgcgacggggtgaaggcccggtccgtgaccggcacttcggccacggtgaccggtctgtcaccggccacggcgtacggcttccaggtcgcggccgtgaacgacgcgggcgagtcggcgaagtcggcgacggtgccggccacgacgtcggcgggctcgggcggcggctcgacggacctgcccgcccacgccctggtcggctacctccacgcgagcttcgccaacggctccggctacacgcgcatggcggacgtgcccgacagctgggacgtcatcgacctggccttcggcgaaccgacctccaccacctcgggcgacatccgcttcacgcgctgcccggtcaccgagtgcccgaacgtcgagaacgacgccgacttcaaggcggcgatcaaggcgaagcgggcggccggcaagaaggtcctgatatcgatcggcggccagaacggccaggtccagctggccacgacggcggcgcgcgacaccttcgtctcctccgtctcgaagatcatcgacgagtacggcctggacggcctggacatcgacttcgaggggcactcgctggcgctggacgcgagcgacacgaacttcaagagcccgaccacacccgtgatcgtcaacctgatctcggcgctgaggaccctgaaggcgaggtacggctcgacgttcgtcctgaccatggcgccggagaccttcttcgtccagctcggccaccagtactacggcacgggcaagtggggcggccaggacccgagggcgggcgcgtacctcccggtgatccacgccctgcgcgacgacctcaccctgctgcacgtccaggactacaactcgggtccggtcatggggctcgacgaccagtaccactcgatgggcggcgccgacttccacatcgccatgaccgacatgctgctgacgggcttcccggtggcgggcgacgccaacaacgtcttcccgccgctgcgccccgaccagatcacgatcggcatgccggcctcgacgaacgcgggcaacggccatgtgtcccccacggaggtgaacaagaccctgaactgcctcacgaggaagaccgactgcggctcgtacgcgacccacggcacgtggcccgcgctccgcggcctgatgacgtggtcgatcaactgggaccggttcgggagctgggagttccagcggaacttcgaccagtacttcggc

SEQ ID NO: 2573 - DNA, 207 bp, Streptomyces avermitilis
  CDS (1)..(207)
gtgatgctggacctgctggcgggggagcgcacggagcgcaccgagctggagatggtccgcaggaagccgctgcccttcccgccggagccgttcgcctggacgggcatcgcgctcaccaagtggtcgctggcacgcgcggacgcgcacggcggccggcggaacctctggctgaaggccatggacaggctgggtctgggcttcgacagc

SEQ ID NO: 2574 - DNA, 1533 bp, Streptomyces avermitilis
  CDS (1)..(1533)
atggccccaagcgccatgagtcgttggaccacatctctttccgaagcgcagccggttccgtactggctggacgaccccggcaggccccgccccgagcccgccctcaccggcgccgagacctgcgacctgctcgtcgtcggcggcggctacagcggactgtggaccgcgctgctcgccaaggagcgtgacccgggccgcgacgtggtcctgctggaaggccgcgaggtgggctgggccgcctccggccgcaacggcggcttctgcgccgcctccctcacccacggtctggccaacggcctcgcccgctggccggacgagatcgggaagctggaggagctgggcgcccgcaacctcgacgagatcgaggcggccgtcgcccgctactccctcgactgcgacttcgagcgcaccggcgagatcgacgtcgccaccgagccgcaccaggccgaggaactccgcgcgtggtacgagaagctgcggcggaagggcctcgcggacggcatcgatctcctggacgccggggcggtgcgggaacaggtcgactcgccgaccttcctggccgggctgcacgaccgcgggggcgtcgcgatgctccacccggccaagctcgcctggggcctcaagcgcgcctgtctcggactcggtgtgcgcgtgtacgagcacacacccgccctgaacctcgaggcgtacggcgccggcatggccgtacgcaccccctacggctcgatccgcgcccgccgggtcgcgctcggcaccaacatcttcccgaatctgatcaagcgggtgcgcgcgtacaccgtgccggtctacgactacgcgctgatgaccgaaccgctgacggacgaccagctggccgccgtcggctggaagaaccgccaggggactcggggacagcgccaaccagttccactacttccggctctccgccgacaaccggatcctgtggggcggttacgacgcgatctacccctacggcggccgggtacgggccgagtacgacgaccgccccgagacgtacgccaagctcgccgggcacttcttcacctgcttcccgcagctggagggcgtccgcttcacgcacgcgtggggcggcgcgatcgacacctgctcgcgcttctcggcgttcttcggcaccgcgcaccagggaaaggtcgcgtacgcggcgggctacacgggcctcggcgtcggggcgacccggttcggcgcggacgtgatgctggacctgctggcgggggagcgcacggagcgcaccgagctggagatggtccgcaggaagccgctgcccttcccgccggagccgttcgcctggacgggcatcgcgctcaccaagtggtcgctggcacgcgcggacgcgcacggcggccggcggaacctctggctgaaggccatggacaggctgggtctgggcttcgacagctgacgctcgcggtggcgcgcgggcgggtcgcgttccgctcgaacggcgtacgccccgcgccaccgctgtgccccggttcgcaccggtccctgacggcaggtaaccgccggaggtct

SEQ ID NO: 2575 - DNA, 798 bp, Streptomyces avermitilis
  CDS (1)..(798)
atgcccttcgtgcgctggctcaagcatcatctcgtcgtcatcgcgggactgttcacgctcggctatctgctgctgccgaacgtcgtcgtcacggtgttctccttcaacaaaccgaaggggcgcttcaactacgaatggcagcagttctccacggaagcctggcgcgatccctgtggtgtcgccgacatgtgcggctcactctcgctcagcctccagatcgcgttctgggcgaccgtcggggccaccgccctcggcacgatgatcgccttcgccctggtccgctaccgcttccgcgcgcgcggcgccgtgaactcgctgatcttcctgccgatggcgatgcccgaggtcgtcatggccgcctcgctgctgacgctcttcctcaacatgggcgctcagctggggttctggacgatcctgatcgcccacatcatgttctgcctcagcttcgtcgtgacagccgtcaaggcgcgcgtcatgtcgatggacccgcgcctggagcaggcggcacaggacctgtacgccggcccggtgcagaccttcctcagggtcaccctgcccatcgcggcccccggaatcgccgcgggcgcgctgctcgccttcgcgctctccttcgacgatttcatcatcaccaatttcaacgcgggctcgaccgtcaccttccccatgttcgtctggggatcggcacagcgcggcacacccgttcagatcaatgtcatcggtacggccatgttccttgtcgccgtgctgttcgttctggccggaatggtcgtcggcaatcgccgtaaccggcagaaggcg

SEQ ID NO: 2576 - DNA, 942 bp, Streptomyces avermitilis
  CDS (1)..(942)
gtgatgacgagcctcgccgacgccccgccgccgctcgccccgcccgccgccgagaagccgcccaggtcgcccaaggcgcgcaaacgcggccgcctcgtcccgtactggctgctgctgcccggcctcctgtggctggtggtcttcttcgcgctgccgatgatctaccaggcctccacctccgtgcagacgggttccctggaggagggcttcaaggtcacctggcacttccagacctactggaacgccctgtccgactactggccgcagttcctgcggtccgtgctctacgcgggcgccgccacgctcctgtgtctgctgctcggctacccgctcgcgtatctgatcgccttccgcgccggccgctggcgcaacgtcgtgctgatcctggtcatcgcgccgttcttcaccagcttcctgatccgtacgctcgcctggaagacgatcctcgcggacggcggcccggtcgtcggcaccctcaactcgctgcacgtcctggacgtcaccaactggctcggcatgaccgcgggcgaccgcgtcctggccaccccgctcgcggtggtctgcggtctgacgtacaacttcctgccgttcatgatcctcccgctctacacctcgctggagcgcatcgacggacgcctccacgaggcggcgggcgatctgtacgcgaagccgttcaccaccttccggaaggtcaccttcccgctgtcgatgccgggcgtcgtctccggaacgctgctgaccttcatcccggccagcggcgactacgtgaacgccgatctcctcggctccacggacacccgcatggtcggcaacgtcatccagacgcagttcctgcggattctcgactatccgacggccgcggcactctcgttcatcctcatggccgcgatcctcatcatggtcacgctctacatccgcaagtccgggacggaggatctggtc

SEQ ID NO: 2577 - DNA, 1161 bp, Streptomyces avermitilis
  CDS (1)..(1161)
gtgacgacgatgaacaacacggacaacagcggcgacgtccgcctctccggaatcagcaagacctacggctccttcaccgccgtgcaaccgctcgacctgaccgtgccgcagggctcgttcttcgccctgctcggcgcttccggctgcggcaagaccaccacgctgcgcatgatcgcgggactggaggaaccttcctccggcaccgtgttcctcggcgaccaggaggtcacccacctgccgccctacaagcgaccggtgaacacggtcttccagtcgtacgccctcttcccgcacctcgacatcttcgagaacgtggccttcggcctgcgccggcgcggcatcaagtcggtgaagaagcaggtcgaggacatgctggacctcgtccagctcggcgagcaggcgcgcaagaaaccgcaccagctctccggcggccagcagcagcgcgtcgccgtcgcccgcgcgctgatcaaccaccccaaggtgctgctcctcgacgagcccctcggcgccctcgacctcaaactgcgccgtcagatgcagctggagctcaagcgcatccagaccgaggtcggcatcaccttcgtgcacgtcacccacgaccaggaggaggccatgaccatggccgacacggtcgccgtgatgaacgcgggccgcgtcgaacagctcggctcgcccgccgacctctacgagaacccgaacaccacgttcgtcgccaacttcctcggcacctccaacctcatcgaggcggaggtcgactccaagggcggcgacgagatcgtcctcagggcgggcggtggcaagctcacgctgcccacggcgcgatgttcggcggccacgacgaccggcggcaaggtccttgtgggcgtccgccccgagaagatctccctcacgcacgccgacgacgcgggcgagatcccggcgggccgcaaccggatcaccgggaagatcgccgactccagcttcatcggagtctccacccagtacgtcatcgacagcgcggtctgccccgagttcgaggtctacgcccagaacatcgaccgcgactcccggctcacccccggcgccgacgtcgtcctgcactggaacccggctcacaccttcggtctggacgccgcgcaggacatcgacgcgggcgtggagacggtcgaggaagaggccgcg

SEQ ID NO: 2578 - DNA, 1245 bp, Streptomyces avermitilis
  CDS (1)..(1245)
atggagcagtacgagcccgaccgcctgtccccggcccaactggccgcggtgcggcgcagtttcaggaacggcagggcctccctcacccgccgttcgctgctgcgcgcctccgccggcggcgcgctcgcggtcggcggtctcggggcgctgagcgcctgcgggatccccgcggcgggcaggaccgagggcggcgtctccgccgaggatcattcggccgaggagaagacgatcaacttctccaactggcccgaatacatcgacgtggacgacagcggcaagcggcaccccacgctcgacgccttcgccaagcggaccgggatccaggtcaagtacaccgaggacatcaacgacaacgacgagttcttcggcaagatccagccgcagctcgccgcgggtcagtccaccggccgggacctcatcgtgctcaccgactggctggccgcccgcatgatccggctcggctacgtccagaaactggacccgtcccacctgccgcacgccttcgccaacctgtcggaccagttccgcgcccccgactgggatcccggacgcgcctactcgtacccgtggcagggcatctcgaccgtcatcgcgtacaacaagaaggcgctcgacggtgtcgaggtgaagtcggtctccgacctgctcgacaaccccaagctcaagggccgcgtcggcttcctgaccgagatgcgcgacagcgtcggcatgaccatgctcgacatgggcaaggacccggcgaagttcacggacgacgactacgacgcggtgatcgcccgtctccagaaggccgtcgacaaggggcagatccgccgcttcaccggcaacgactacacgtccgacctcagcaagggcgacttcgccgcctgcatcgcctgggcgggcgacatcgtccagctccaggcggacaaccccgacgtcggctacgtgatccccgacagcggatacatgacgtcgaccgacaacatgctgatccccaacaaggcgcgtcacaagacgaacgcggagcggctcatcgactactactacgagctggagccggccgccgaactcgccgcctacatcaactacgtgagcccggtcgcgggagtgcagccctatcttgccaagatcgacaagtcggcggcggacaacccgctgatcgttcccgacaaggccatgcaggccaagtcccatgccttccgctcactgagctcgaaggaagagacggcctatcagcagaagttcgcgaagctcacaggggcg

SEQ ID NO: 2579 - DNA, 1521 bp, Streptomyces avermitilis
  CDS (1)..(1521)
atgcacaatccgggccatcgcttccaggcgcaggaccgcttcgcggacggcgcgcagtacatcgcgggcaggttcgccaagggaacctcggggcgccgtcacgcggtcgtggaccccgccaccggcgaggaggtctaccggtacgagctggcgggcaccgccgacgtggacgcggccgtcgccgccgcccgcgccgcgttccccggctgggccgccaccacgcccggcgatcgctccgacgccctgcaccgcttcgccgcggtcctcgccgaccgcgccgaggagttcgcccgcgccgagtccctccagtgcggaaagcccctcaagctgacgcgcgagttcgacgtcccgggcaccatcgacaacacctccttcttcgcgggggccgcccggcatctgcagggccagtccgcaggcgagtactccggcgaccacacctcgtacatacgccgtgagccgatcggcgtggtcggttccatcgcgccctggaactacccgctccagatggccgcctggaaggtcctcccggcgatcgcggcgggcaacacgatcgtcctcaagcctgccgagatcaccccgctcacctccctgctcttcgccgaggcggccacccgggcgggcatccccgacggcgtcgtcaacatcgtcacgggcgcgggcagggacgccggggaacacctcgtcgcgcaccccgacgtcgccatgacctccttcaccggctccaccgccgtcggcaggcgcgtcgccgagatcgccacctccaccgtcaagcggctccacctggagctgggcggcaaggcgcccttcgtggtgttcgacgacgccgacctggacgccgccgtgcacggcgcggtcgcgggctcgctgatcaacaccggccaggactgcacggccgccacgcgcgcgtatgtgcaaaggcccctctacgaggagttcgtcgcgcgcaccgccgccctgatggagaccgtccgtctcggcgacccgttcgcgcacggcaccgacctcggcccgctcgtctcgcacgcccagcgtgaccgcgtcgccggattcgtcgaccgggcccgtgcctacgcgcgcgtggtgacgggcggtgagatccccgaggagctcaaggacggcgcctactaccgccccacgctcatcgccgacgccgcccaggacagcgagatcgtgcagtccgagatcttcgggcccgtcctggtggtcctccccttcgacagcgacgacgagggcatccggctcgccaacgacactccgtacgggcttgcggcctccgcctggagccgggacgtgtaccgcgcgaaccgcgccacccgcgagatcaaggcgggctgcgtgtgggtcaacgaccacattccgatcatcagcgagatgccgcacggcggatacaaggcgtccggcttcggcaaggacatgtccgcgtactcgttcgaggagtacacccagatcaagcacgttatgttcgataacacagcaattgtccgaaaggactggcaccgcacgatcttcggggaccggccg

SEQ ID NO: 2580 - DNA, 585 bp, Streptomyces avermitilis
  CDS (1)..(585)
gtggtgcgtgccagactcgcgtgcatggggaagatcgattcttgggaagccctggtcagggaggtccacgcgggggcgaggatcaagtacctgcacttctggggacaccggccgcgaccggacggacgggtgggggcgagctgcctgagccagtggtggccgtctccgttcaccgtggacggcgtggagtacacgacggcggagcactggatgatggcggcgaaggctcggctcttcggggacgaggaggctcagcggcgcgcgatcgaggcgcccactcccgcgcacgccaagaaggcggggcggctggtgcgcggcttcgacgaggccatatgggcgcgcgagcggtacgggatcgtggtcgagggcagcatccacaagttcgccgcgcacatggatctgcaggcgttcctgctgggcacgtccgggcgggtgctggtcgaggcgagccccctggaccgcgtgtggggcatcggcctcgcggcggacgacgagcgggcaggcgacccggatcggtggcggggcccgaatctgctggggttcgcgctgatggaggcacgggaacgactggcggccggcgaccgc

SEQ ID NO: 2581 - DNA, 324 bp, Streptomyces avermitilis
  CDS (1)..(324)
atgcccctcccgccgagcaacggcatgggcaccgccgcgctggtgctcggcatcatctcgaccgtcgtgttctgtctctggccgctcgccatcgtcatgggcgtgctcagcgtcgtcttcggtgtgatcggccgccgcagagcgcgccggggagaggcgacgaatgccggccaagccctcgccgggatcatctgcggagcggtcggcatcgtgctcggtgtcgccttcatggtgatcatcttcgccgccgcggagagcagcagcgacccgtggagcaccaccgacgacagctactccacgtccctggtcgtgcacgcggaccgc

SEQ ID NO: 2582 - DNA, 1074 bp, Streptomyces avermitilis
  CDS (1)..(1074)
ttgaccgagcacttcgacgcccgtggcacccgcgacgcccagaccgggcgcgacctgcactccttcatcgccggactgccgaaggccgaactgcacgtgcatcacgtcggctccgcctccccccgcatcgtctcggagctggccgcccgccaccccgactccagcgtgccgaccgaccccgaggccctggccgactacttcacgttcacggacttcgcccacttcatcaaggtgtacctgtccgtcgtcgacctcatccgaacccccgaggacgtccggctgctgacgtacgaggtcgcccgtgaactcgcccggcagcaggtgcggtacgccgagctgaccatcaccccgttctcctccacccggcgcggcatcgacgagcgcgcgttcatggacgccatcgaggacgcccgcaagtcggccgaggccgagttcgggaccgtactgcgctggtgcttcgacatccccggcgaggcgggcctggagtccgccgaggagacggtgcggctcgccaccgacgaccggctgcgccccgaggggctcgtctccttcgggctcggcggccccgagatcggcgtaccgcgcccgcagttcaagccgtacttcgaccgggcgatcgccgccgggctgcggtccgtgccgcacgccggtgagacgaccggacccgagacggtctgggacgccctcaccgacctgcgcgccgaacgcatcggacatggcaccagctccgcccaggacccgaagctgctcgcccacctcgccgagcaccgcatcccgctggaggtctgcccgacctccaacatcgcgacccgcgcggtccgcacgctcgacgagcaccccgtcaaggagttcgtccgggccggcgtcgtcgtcaccatcaactccgacgacccgccgatgttcggcaccgacctcaacaacgagtacgcgatcgccgcccgcctcctcgacctcgacgagcggggcctcgccggcctcgccaagaacagcgtcgaggcgtccttcctcgacgccgcgggcaaggcccggatcgccgccgagatcgacacgtacaccgcggcatggctcgcgccc

SEQ ID NO: 2583 - DNA, 678 bp, Streptomyces avermitilis
  CDS (1)..(678)
atgcgcaccgtgacagccgtcgcccaccgtggcgacccctatcgcgtccgcgagaacacgatcgactcgctgcgttccgcgctccggcagggcgcggacgcggtcgagatcgacgtacggctcacccgtgacggcgttcccgtgctgctgcacgacgagacgctgaagcggctgtgggagcaggaccggccgctgcggtcgctctcctgggacgaggtccgggggctgacggacggcggggtgccgacgctggtcgacgcgctggcggccaccggggagagccgggtcatgctggacctgccgggtgccggcccccgggcggtgcgcaggatcgtcgacgtcatccgggagtacggagccgaggagcgcgtgtactactgcgccggggccccggccatgctcgcggtgcgcgcggccgaccccgccgccgagatcgccctgacctggacgacgctcgcaccgccgcgccccgcgctgctcgacgcggtgcgcccgcgctggctcaactaccgcttctcgctggtcgaccgcgagctcacggcacgcgtgcaccgcgagggctatctgctgtcggcgtggacccccgacacccgccgttcgatgcggcgtctgctcgacatgggcgtcgacgcgatcacgacgaaccgtatcgacgcgttgtgcgcgttgcgcaaggac

SEQ ID NO: 2584 - DNA, 1902 bp, Streptomyces avermitilis
  CDS (1)..(1902)
gtgccgacgtgttgccggagtccccggggcggatggagcgaaagttcttcggcgggaggaaaaactgttattgcggagggcggcactccgtctcctgtggtgtccgaggactccacgcgtggtgtccgagggctccacgagccgactgtgacctgcggcatagcgcacgggcaggtccaacctggttcggggcatcctgctctgatcagcgcgccatcgaaagggacgtacgtggacgggcggcagtggcactccaccatcgcggccgcgcaggccggtgaccgggaggcactcgacgagctggtcgcgggctggctgccgctggtctacaacgtcgtcggccgcgccctgggcggccacgcggacgtcgacgacgtcgtgcaggagaccatgctgcgcgccgtcgaccacctcggctcgctgcgcgatccggacagcttccggtcgtggctggtcgcgatcgcgatgcggcagatacgtgaccgggcccggcggcgcacggcggagcccctgaccgacggcgcgggcgaccaggccgtggacttcgccgaactcaccgttctgcggctccagttggagggccagcggcgtgaggtcgcggaggcggtgcgctggctcgacgccgaggaccggcagctgctgtccctgtggtggctggaggtcgcgggcgaactgacccggcgtgagctggcggcggcggtcggcatcagccgtcagcatgccgccgtacgggtgcagcggacgaaggcccgcctggagaccgcgcgcggcatcgtgcgtgccctcgactcgtcctgccccgagctgcgtgacatgaccgcccgctggagcggacggcccgactcggtgtggcgcaagaggctggcccggcacatccggggctgcgggtactgcgccgggccgggcgaggcggtcgtaccggcagagcggctcctcgccgggatcgcgctcgttccggtcccggccggtttcaccctgtcgctggcgctcggcggcaaaccggcggcggccgccacggcggcgtcggccggctggtccgccaaggtgctcggtgtgctcggcaagcccgccgtcgcggtcacggcgggcgcgaccttcgcggcgggcggcgtgtacgtcgtgacgcagacgcccgaccacccgccgcgccgggctgtcgccgcgccgacggcggcgagcacggcgcgcccgccgtcggtcacccggtccgcctcgccgagccccagccgcaccacgagccccagcccgagcccgtcgaagacccgggtcccgctgtacggcactgtcgtcgacgccgtcgacagcgcgccctcggcggatacgccgcccaaggtgctgccccgccgtgccgagaagggcgtcaccgcgacgggcgcacccgcgaccggtctgacccatcgcggcgagacggtcaccctcagcggagagggctatttccgggtccggtggcagatccagcccaaggaacgtccggggagcgtcgcgatgccggcctggaccggactcgacggcaggctcttccacgtcgcctcgggcggcggccaccgtatggacgatccgcagcccggcaccacggacggcacgacctggatgggcggtccggccaccggcctggccgtactgccgtccggcacccagcagatgtggcagaacgagtacttctggatcgacggcaccgtcaccctccaccagaacgagcgcggcgccgactacaacctcttcgtcgagacctcgtcctggggcaaggcggcccaggacgtccgcacggggcccgaacagggcgccgtccgctacggcctcgtacgcgacaacggcaaggacacggccccggtgccgcagtacctgacgcggtccgcccccgcggacccggcgacggtacggcagcgctcccgcgtcactccc

SEQ ID NO: 2585 - DNA, 582 bp, Streptomyces avermitilis
  CDS (1)..(582)
gtgaagtggcccggaatgctttttgaacgcgttcaagtcggggggtacgctccagtcatgagcgacagagtcgcccttctcaagggcatccgcgggtggctggtcgtcttcgtcgtctgcctggtgctcagcggcgccacggccttccccctggtgcacgaactgcgctggaccgaggacctgctgcggtccctttccgtgccggaccgcctgcccggcctgatggactggatcgagcgtgtccgccgcgggctcgacgccaccgacgcgaagtaccccttcgtgctgtacggcacggactggctggcgttcgcgcacctcgtgatcgcggtcgccttctacggcccctatcgcgaccccgtccgcaacatctgggtcgtcgagttcggcatgatcggctgcgccggcatcgtcccgctcgccctcatctgcggtccgatccgcggcattcccttctggtggtcggtcgtcgacatgtcgttcggggtcttcggggtgatcccgctgtacgtcctgcgcaagaagatcaagcggctggaggcgctcacggccgccccgcccgcggccgcggtcgtcaccgcc

SEQ ID NO: 2586 - DNA, 498 bp, Streptomyces avermitilis
  CDS (1)..(498)
ttgacgtcaaggtggcttgatggcaccgtggaagacgtggccactcctgacgagctagagcgccagtacacgctgctgtccgccgcggcgcgtttcgacgcactgcgcacacgcgacgccctcgccccgcccccggacgacgtggacgacgtggacgacctgggtgacgggggcggcggggacggcgccgagccggacgaggccaccggatcggcggcacccctgacccgcgaggaagcccttgagcttctcgcgctcggcgaggtgctcgcccgcaaggcggcctacggccgtcagctctccgtacggtccgcccgccgggccggtgcctcctggtcacagatcggcgccgccctcggcaccagcaagcaggccgcgtgggaggcgcacaatcgctggatcgacgaacaggccaaacaggaccgggaagccggacactggggactgaacgacaaggagatcgacgcggcccggacgctcgcgggcgagctggacaac

SEQ ID NO: 2587 - DNA, 2526 bp, Streptomyces avermitilis
  CDS (1)..(2526)
atgttcgagaggttcaccgaccgcgcgcggcgcgttgtcgtcctggctcaggaagaagcccggatgctcaaccacaactacatcggcaccgagcacatcctcctgggcctgatccacgagggtgagggtgtcgccgccaaggccctggagagcctcgggatttcgctcgaggcggtccgccagcaggtggaggagatcatcggccagggccagcaggccccgtccgggcacatccccttcactccccgtgccaagaaggtcctggagctgtcgctccgcgaggcccttcagctgggccacaactacatcggcacggagcacatcctgctcggcctgatccgtgagggcgagggtgtcgccgcccaggtcctggtcaagctgggcgcagacctcaaccgggtgcggcagcaggtcatccagctgctctccggttaccaccagggcaaggagagcaccgtcgagggcggtcctgccgagggcaccccctccacgtccctggtcctcgaccagttcggccggaatctcacccaggccgctcgtgagtccaagctcgacccggtcatcgggcgcgagaaggagatcgagcgggtcatgcaggtgctgtcccgccgtacgaagaacaacccggtcctgatcggtgagcccggtgtcggcaagaccgccgtcgtcgagggcctcgctcaggcgatcgtcaagggcgaggtgcccgagaccctcaaggacaagcacctctacaccctggacctgggtgcgctggtcgccggttcccgctaccgcggtgacttcgaggagcgcctgaagaaggtgctgaaggagatccgcacccgcggcgacatcatcctgttcatcgacgagctgcacacgctcgtcggtgcgggtgccgccgagggcgccatcgacgcggcttcgatcctgaagccgatgctggcccgcggtgagctgcagaccatcggcgccaccacactcgacgagtacaagaagtatctggagaaggacgcggctctcgagcggcgtttccagccgatccaggtggcggagccttccctcccccacacgatcgagatcctcaagggcctgcgggaccgttacgaggcacaccaccgtgtctccatcacggacgaggccctggtgcaggcggcgacgctcgccgaccgctacgtctcggaccgcttcctcccggacaaggcgatcgacctgatcgacgaggcgggttcccggatgcggatccgccggatgaccgcgccgccggacctgcgcgagttcgacgagaagatcgcgggcgtgcgccacgacaaggagtccgcgatcgactcgcaggacttcgagaaagccgcctcccttcgcgacaaggagaagcagctcctggccgcgaaggccaagcgggagaaggagtggaagaccggcgacatggacgtcgtcgccgaggtcgacggcgagctgatcgccgaagttctggccgcgtcgacgggcattcccgtcttcaagctcacagaagaggagtcgagtcgtctcctgcgcatggaggacgagctccacaagcgggtcatcggccagaaggacgccgtcaaggcgctgtcgaaggcgatccgtcgtacgcgtgcgggtctgaaggacccgaagcgtccgggtggttcgttcatcttcgcgggcccgtccggtgtcggtaagaccgagctgtcgagggccctggcggagttcctgttcggtgacgaggacgcgctgatctccctcgacatgtcggagttcagcgagaagcacacggtctcgcgtctgttcggttcgcctcccggttacgtgggctacgaagagggcgggcagctgaccgagaaggtccgccgcaagccgttctccgtggtcctgttcgacgaggtcgagaaggcccacgcggacatcttcaactcgctgctgcagatcctggaggacggtcggctgaccgactcccagggccgggtcgtggacttcaagaacacggtcatcatcatgacgaccaacctcggcacccgggacatctccaagggcttcaacctgggcttcgccgcccagggcgactccaagtccacctacgagcgcatgaagaacaaggtcgcggacgagctcaaacggcacttccgccccgagttcctcaaccgcgtcgacgacgtggtcgtcttcccgcaactgacgcgggacgacatcctcgcgatcgtcgacctgatgatcaccaaggtcgacgagcgcctcaaggaccgggacatgggcatcgaactcgcccagtccgcgaaggaactgctcgcgcagaagggctacgaccccatgctcggggcgcggccgctgcgccgcacgatccagcgcgagatcgaggacaccctctccgagaagatcctcttcggggagctgcgtccgggccacatcgtggtcgtcgacacggagggcgagggcgagaccaagaccttcaccttccgcggcgaggagaagtcggccctgcccgacgtccccccgatcgaacaggcaacaggaggtgaccggccgggctcgggtacggagtcc

SEQ ID NO: 2588 - DNA, 591 bp, Streptomyces avermitilis
  CDS (1)..(591)
atggcggccatgctcgaactcgcgatcctcggcttcctcgcaggcggcccgctgcacggctacgaactgcgccgccgtatcgcgcagctgtccggccacaccacccctgtcagcgacggcagcctctacccggcgatcaaccgtctggtgaagcgggggctgctggaccgacgtgtcgagccgggcgcggcggccgcccagcggtacgtgctgagcctgaccgaggccggccacgccgaactgcttcagcgcctgcggcacccggccgaccaggcgatcaccgacggcagccagttcttcacggtcctggccttcctctcccggctgccggacatcgccgaccagcacgcggtgctgcgccggcgtctggcgttcctggaggagccggcgagcttcttctacgacggcgaccgcccggtgcgcgcggaggaggtcgccgacccctaccggcgcggcatgatgcgggtcgcccgcgccaccagccgtgccgaacgcgcctggctgcacgaggttctcgacacccctgaccaggcaggacctggtgacgcgcgcacggcgaacggcgcggctacgcccgacgagcacgtcgac

SEQ ID NO: 2589 - DNA, 435 bp, Streptomyces avermitilis
  CDS (1)..(435)
atgaccgaacacaccctgcgctctgtcagcgtcgagcggaccagcaccggccacttcaccgcgacgaacgtgcgcggcggcacgatcggcttcggcaccggctccgatcccggcgacaccgacttcaccccggtcgagctgttgctcgccgcgatcgggggctgcaccgcggtagacgtcgacgtcgccaccagccgccacgcggagcccaccggattcgccgtcaccgtcaccggcaacaagatcagtgacgagctcggcaaccggatgaccgacctcgtggtcaccttctccgtcgccttcccggacggtgaacccggcgaccgcgcccgcgcgatcctcccccgggcggtcaagtcctcccacgaccggctctgcacggtcagccgcacggtcgagatcggcacgcccgtcaccgcgcgggccgcggacacc

SEQ ID NO: 2590 - DNA, 1233 bp, Streptomyces avermitilis
  CDS (1)..(1233)
atggccggccggcccggggtggtgcgcgggactaccgtcggcggcatggacggtgatcgccgagggtggcgccagtgtttgctcagcggggcggtgttcgccgtgtgcatggtcggcaccacgctgccgacccctctctacggcctctatcaggagaagttcgggttctccgagctgacggtgaccgtcgtgtacgccgtgtacgccttcggggtcatcggcatgctgctgctggcgggcaacgcctcggacgccgtgggcaggcggccggtgctgctggcgggtctgggattcgcggccgtgagcgccgtctgtttcctgtgcgcgaccgggctgggctggctgtatgcggggcggctgctgtcggggctgtccgccggcctgttcaccggggccgccacggtgtacgtgatcgacctggcaccgtacggcggcgcctcccgggccacgttcgtggcgacggccgccaacatgggcgggctgggctgcggtccactgctcgccggtgtgctcgcgcagtacgcggcctggccgctgtacctgccgttcgtcgtgcacctcgcgctggtggccggctcggccgccgtcctgctgtggcttccggagaccgttcgggagccgcggccgctgagcacggtacggccgcagcgtcccgctctgccctcgcaggtgcgggcggtgttcgtgcccgcggcgaccgcatcgttcgtggggttcgccctgttcggggtgttcacgtcggtcagcccggcgttcctggagcagtccctcggcgtggacaaccgcgcggtggtcgggctgatcgtcgcgctggccttcttcgcctcgaccgccgggcagttgatggtcggccgggtcggggtggggcggtcgttgccgctgggctgtgccggtctcttcgccgggctggcgctgctcgcgggcgccctgcggtgggacctgttgtcgctggtggtgctgagcgcgctcgtcggcgggggagggcaggggctggcgtttcgcggggcgctgtcggcggtggccgaggcgtctcccgcggaccggcgtgccgcagtgatctccacgctgttcgtggtggcgtacgtgggcatctcggtgccggtgatcggggtgggggtactgacgggtccgatcggcctggagggtgcggggctggtgttcatcgcgtgcatggccgtcctggtctcgaccgcggccgtctacctgctccggcggccggtacgggcgaggacg

SEQ ID NO: 2591 - DNA, 2793 bp, Streptomyces avermitilis
  CDS (1)..(2793)
atgaggaggggacccttgaaccgcacccggcgaataggtgtcaccgccctggccgtgctcgcggccctggcgggctcaccggggctggcccaggcccaacagccgccccaggcaaagccgttgacagcggaggccgacagtccgctgccgccgggctggcgcgtcaccggggagggcgtcgcgcgggaactggtctggcggtcggacagggccgtgcccgtgggcgacgcccgcgtcgagttccacgcggacggccggctgctcggggtgccgaaggcggccaaggacggccacacgttccggctcgctctcggtagagccaccccgctgaaggaccttcaagtcctggcggccggacgccggttggacgcgcccgccggcaccaccggcaccaagaagccgaggaactccgcggcggccgcgcagcccccggcccggctcccggcgaactccgtggacccgggcaggccgggctcgtaccgcacggtcaccggcgagtacgacctcgacccggtgaagctgcccggcttcgcccagccggtcgagatgcaggccgtcgtcgtcgcacccgagggcgccaccggcaagcggccgctcgcgctgttcctccacggccgccacaccacctgcttcaagcccggtgggtccgaggacgacgtgaccatcgactggccctgcgcggccggcacgcagccgatcccgagccacaagggctatctgaaggaccagaagctgctggcctcccagggctatgtgacggtgtcgatctcggcgaacggcatcaacggccaggacggggacgccgaggacggcggtgcgcaggcgcgctcctcgctggtgcggcagcacctcgccaagtgggccggctgggccgcccacccgggctccgccccggcgggcgtgcccgacgcggccgaggccgacctgtcccgcgtcctgctcgtcggccactcgcgcggcggcgagggcgtcaaccgggccgccatggacagcctctacccgccgcccgccgcgcaggacggctaccggggcccggtgcgctggaagatccgcgggaccgtcctcatcggaccgacgatcttcggccagaatccggtcgccgacgtgccgtccacgacgatcctccccggctgcgacggtgacgtctccgacctccagggcgaggtgtacgtcgacgggacgcgcggggtcagccggggcaccgccctgcacagcgccgtctacgtggtgggcgccaaccacaacttcttcaacaccgagtggacgccgggcaagtccgaggcaccctcctccgacgacttctgggacgacccggaagggcagcccgacccggtgtgctccacgggcacccgcacccggctgaccgccgaccggcagcaccaggcgggcgcgacctatatcgccgccgcggcccggctgttcgtcgccggcgacgaccgggtgcgcccgctgctcgacggctcgggccggcgcgccccctcggccgacccggcccgcgtgctgacccacgcggtcggcgcccgccgcacgggcggcttcctgcccgacgcaccggtgaaggtgaccggcggcaggctgtgctcggcggtcgaccccgacccggccagggcatgcctgaaccccgacaccaacgggtcgtcgccgcacttcgcggggtggcagacggagaaggagaccggccgcggcgcggtcgcgctgaagtggtcgacgccgggcacggcggcgaaggtccgccccgccgctccggtgtccctctccggtgcgaaaagcctggcgttgcgcgtgttcgtgccgccgaacgcgaccggcaccaagctggacgtggccgtcaccgactcctccggccgccgggccaagctcggccgggtccaggccgacgggctgccgggctccgagcgcaccgcctcctactgggcgcgcgagctgcgcgtcccgctgacggcggccacccgcgccggtctcgacctgaggcacgtcaagtccctcgaactgaccccgcgttcacggtccgggcgggcctggctgatggatgcctggggctgggcccccggtaccccggcggccagggcggcgacactgccgcgcgtcgacatcggccggctctccgtcaaggagggcgactcgggcacccgtacgtaccacatcccggtccaggtctccgggcacggcagcggcaaggtccgcttctccgtcctcgacccgggcaccggacgggccaaggacaagctgatcacggtacggccgggcagcaaccccatcgacgtgcccgtgaaggtgaagggcgacacgcgcttcggctacgacgagcagaacgacctcatcgcgaaggccgtgcgcggcgccgtcatcggctcgtaccggggcggcgtcaccgcggtgaacgacgaccccgcgcccgcggtcaccatgacgccggtcacggaccgggtgaccgagggagggacgctgacgtggcggatctccctctccgagcccgccgacgtggacgtctggcagccggtccgggcgcttccggtcaccgagggcgccgagttgtccaccaaggacgtggacccgcagtggctgacggaccacaccggtgacctccccgacccggagcgcgcgctctccaaggcgaacgtgtgggtgtggacgagcattccggccggggccaccaccgccgacttcgtcgtgccgacggtgaaggaccaactggccgagccggccgagtcggtacgcctcgcgctgaccgacgacaacgccgagccgcttcccgaccaccccgtgcggacgggcacggtggtggacgcgccg

SEQ ID NO: 2592 - DNA, 924 bp, Streptomyces avermitilis
  CDS (1)..(924)
gtgcaacacccgatcgcgctggcgccgatgggcggatcggccggcggtgccctggcggcggcggtctctcgcggcggcgggctcggcatgctgggcgccgggggcggggaccgggagtggctggcccgcgaactgccactcgttgcgcaggccggcggcaggccatggggtatcggtttccagacctgggcgatcgaccgcagcacggtcgagcgggcgttggagcacaccccccgggcggtgatgttgtccttcggggacccgagcccgttcgcggagtgcgttcgcgcggcgggcgctgtgctgatcgttcaggtgaccgatctggacgaggccaggcaggcggtcgacctgggcgccgatgtcatcgtggcccagggcaccgagagcggtgggcacggggcccggcaggggcgttccacgttgccgttcgtgccggtcgtggtggatctggcggcaccggtgccggtgctggcagccggtgggatcgccgatggccgcggtgtggcggcggccctggctctgggcgccgccggggcgctcgtcggcacccgtttccaagccacgaccgaggccctggtggacccctcgaccgccaaggcgatcgtcgagggacatggcggggacaccgagcgcaaccgggtgctcgacatcgcccggggctctcggtggccgtcgaagtacaccgcgcgcaccctcggccacccctacctcgaccggtggcggggccgggaagccgaactcgccggggacccccgggcccgacaggactaccagcgcgacgtcgcgcagggaaacatcccctcgctgccggtgtgggccggcgaggccatcgacctcatcaaggatctgccgtccgcggccgatctcgtcgccaccctggccgcgcaggcggaggacgcactcacccgcgcgggaagacgc

SEQ ID NO: 2593 - DNA, 1041 bp, Streptomyces avermitilis
  CDS (1)..(1041)
atggagcgcgccggtcccgcggagccgcggaacgtcccgtcacccggcccgcgggacgaatgcgtgtccatccggaacttggtggcgcggctgagggccgactacccctcggccgacgcggtcaccgtcgaggtgacggtcaggaccgcgtacgacgtgttcggtgtggccaacctggcggccggtctcttccagggcttcccggtcagcacgagcggctcccgtacggcggtggcggagcgcgcgggggccagaagtcagctcaccggggtcgtcggagcggcgctcatcgtcctcatgctcgtgctggctccgggcctgttccgcaacctcccccagccggcccttgccgccgtggtgatcaccgcgtcactgtcgctggccgacatcccgggagcggtacgactgtggcggcagcgccggacggagttcctgctgtgcatcgcggccttcgccggcgtggccctgctcggcgtcctggaaggcatcgccatcgccgtggccctgtccgtcctcaacgtcttccgacgcgcctggtggccgtacaacaccgtgctggggcgggtgcagggcctggagggctaccacgacgtccgctcctacccacaggccgggcaactgccgggcctggtgatctaccggttcgacgccccgctcatcttcgccaacgccaaggccttccgcgacgagatcaggcgactggccgacgcggacccgcggccgagctggatcgtgatcgcggcggagccgatgacggacgtggacaccaccgccgccgacgtcctggaggaactcgacgagacgctcaacgcgaaccacgtacacctcgtgttcgccgagctcaaggaccccgtacggcgcaagatcgaacggtatgggctcacccgcaccatcgacccccggcacttcttccccaccgtggaggccgccgtcgccgccttccggctgcgcaccggagcggagtggacgcccctcaccaccgccgaacagcccgcccggcccaagcccgacaccgccgctccaccgcccgccgacgagcgg

SEQ ID NO: 2594 - DNA, 315 bp, Streptomyces avermitilis
  CDS (1)..(315)
atgcccgacctgaccacttggccgaaggggatgcggctgatcgtcagaaaggaacgcccgcaccccggcgcccagttgcgcttcaccgacctcgacggactgcggctgacctgcttcgccaccaacacccaggcggccagctcgccgacctcgaactgcgccaccgcagaccgtcccgctgcgaggaccgcatccgaaacgcccgcgacaccggcctgcgcaacctgcccctgcacgacaccgcacagaaccggatctggctggagatcatccccctcgcactcgacctcctcgcctggatgccgatgctcgcac

SEQ ID NO: 2595 - DNA, 474 bp, Streptomyces avermitilis
  CDS (1)..(474)
ttggccgaaggggatgcggctgatcgtcagaaaggaacgcccgcaccccggcgcccagttgcgcttcaccgacctcgacggactgcggctgacctgcttcgccaccaacacccaggcggccagctcgccgacctcgaactgcgccaccgcagaccgtcccgctgcgaggaccgcatccgaaacgcccgcgacaccggcctgcgcaacctgcccctgcacgacaccgcacagaaccggatctggctggagatcatccccctcgcactcgacctcctcgcctggatgccgatgctcgcactgaccggccaaacccgccgctgggaacccaagaagctccgcctgcgcctgttctccgccgccgctcagctcgtgaacaccggacgccgccaccggctccgcttcgccgtccgatggccctggaccgacgtcatcacccacgcgatcggcaggctccacagcctcccgatccccggt

SEQ ID NO: 2596 - DNA, 1188 bp, Streptomyces avermitilis
  CDS (1)..(1188)
gtgccccagactcctaggacgccctcgctctcccgccgctccctcctgcgtgcgctgggcggcaccaccgcgctcggcgccctcgccggctgtggcgtgcccgccgcctatgtgcagcccggcgaccgtgccgccgcggacctgtccgtcagcgacaagcggctgacctgggcgaactggccgctgtacatcgacaccgacgacaaggacacgacccggcgtcccacgctggaggccttcgagaagcgcaccgggatctccgtcgactacgtcgaggagatcaacgacaacgacgagttcttcgggaagatcagcccgtccctgatgaaccaccagcagacgggccgcgatctcatcgtcatcagcgactggatgtgcgcccgcttcgtacggctcggctgggtccaggaaatggaccgcgcacgccagccgaacgtcgccaggtacctcgatccgctgctgcgctcgccggccttcgacccgggccgcacgttctcggtgccgtggcagtcgggcatcaccggtatcgcgtacaaccgccgcaagctgggccgcgagatcaagcatgtgtcggacctgtgggcgagcgacctcaagggccgggtcacactcctgtccggcctggacgaggcgttcgcgctgctgatgcagggcaacggcgtggacatcacccggtggacggcggacgacttccacagggtctgcgaccaggtcgagaagcatgtgcgcagcggccagatccgccgcttcacgggcaacgactacatcaaggacctctccagtggcgacgtgctcgcctgtcaggcgtactcgggcgacgtgatccagctccaggcggacgatccggacatccacttcgtcgtcccgcaggagggggccgagctctgggcggagtcgctgatgatccccaatctggcgcgccacaaggcgaatgcggagcggctgatcgaccactactacgagcccgcggtcgccgccgaactggcagcgtgggtcaattacgtctgccccgtcccggcggcccaggacatcctggcctcgtccaaggacgaggacaccgccgccctcgccgaggacccgctgatcttcccggacgcgtcgatgcgggggcgcctggcgatcgcgcgggacatcacgtccacggagcgcgtggagttcgcgaagcggtggaacgcgatcgtgggactg

SEQ ID NO: 2597 - DNA, 1437 bp, Streptomyces avermitilis
  CDS (1)..(1437)
gtgagcaccgagctgcgtcgtctgcgtaaccacatcgacggcgaattccgtgacgccgccgacggacggaccaccgaggtggtcaaccccgcgaccggtgaggcgtacgcgacggcgccactgtccgggcaggcggacgtcgacgccgccatggcggccgccgccgcggccttcccggcctggcgcgaccagaccccggccgagcgccagaaggccctcctcaagatcgcggacgcgttcgaggagcgggccgaggaactcatcgcggccgaggtggagaacacgggcaagccgatcgggctgacccgctccgaggaaatcccgccgatggtggaccagatccgcttcttcgcgggcgccgcccgcatgctggaggggcggagcgccggcgagtacatggaggggatgacctcgatcatccgccgcgagccgatcggcgtctgcgcccaggtcgcgccgtggaactacccgatgatgatggccgtgtggaagttcgccccggccctcgcggcgggcaacacggtcgtcctcaagccgtcggacacgacgcccgcctccaccgtcctgatcgccgacatcatcggttcgatcctgcccaagggtgtcttcaacgtcatctgcggcgaccgtgacaccggccgcgcgatggtcgagcacccgacaccggcgatggcctccatcaccggttcggtccgcgccggcatgtcggtcgccgagtccgccgccaaggacgtcaagcgcgtccacctggagctgggcggcaaggcgccggtcgtcgtcttcgaggacaccgacatccccaaggccgtcgaggacatctcggtcgcgggcttcttcaacgccgggcaggactgtacggccgccacccgcgtcctcgtccaggagtccatccacgacgagttcgtggccgcgctcgccaaggcggccgccgacacgaagaccggccagccggacgacgaggacgtgctgtacgggccgctgaacaacccgaaccagctgaagcaggtcgccggcttcgtcgagcgcctgcccgcccacgccaaggtcgaggcgggcggtcaccaggtcggcgagaagggctacttctacgccccgaccgtcgtctcgggcctcaagcaggacgacgagatcatccagaacgaggtcttcggaccggtcatcaccgtccagtccttcacggacgaggcgcaggcgatcgagtgggcgaacggcgtcgactacgccctcgcctcctccgtctggacgaaggaccacggccgcgcgatgcgcctgtcgaagtccctcgacttcggctgcgtgtggatcaacacgcacatcccgctggtcgccgagatgccgcacggcggcttcaagaagtccggctacggcaaggacctctcggcgtacggcttcgacgactacacgcggatcaagcacgtgatgacgtcgctggacagc

SEQ ID NO: 2598 - DNA, 498 bp, Streptomyces avermitilis
  CDS (1)..(498)
gtggccagtcgaagcgcagaccagagggactcccgcgagtccaggaacggcactccccagctggatgccgtctccctcgccatcatcgggcagctccaggaggacgggcgtcgcccgtacgccgcgatcggcaaggccgtcggcctgtccgaggcggccgtacgccagcgcgtccagaagctgctcgaccagggcgtgatgcagatcgtcgccgtcacggacccgctcaccgtgggcttccgcaggcaggcgatggtgggcgtccatgtcgagggggacctcgacccggtcgcggacgcgctgaccgccatgtcggaagtcgagtacgtggtgatgaccgcgggctcgttcgacatcctcgccgagatcgtctgcgaggacgacgaccacctgctggacgtcatcaacaaacgcatccgggccctgcccggcgtgcgctccaccgagagcttcgtctacctgaagctcaagaagcagacctatatgtggggaacccga

SEQ ID NO: 2599 - DNA, 1377 bp, Streptomyces avermitilis
  CDS (1)..(1377)
gtggggaacccgatagccgtgagcaaggacctcagccgaaccgcgtacgaccacctgtggatgcacttcacccgcatgtcctcgtacgagaacgcgcccgttcccaccatcgtccgtggtgagggcacctacatctacgacgacaagggcaagcgctacctcgacggtctctcgggtctgttcgtggtccaggcgggccacggccgcacggagctggcggagaccgcgttcaagcaggctcaggaactggccttcttcccggtgtggtcctacgcccacccgaaggccgtggaactggccgagcgccttgcgaactacgccccgggcgacctcaacaaggtcttcttcaccaccggcggcggcgaggcggtcgagaccgcctggaagctcgccaagcagtacttcaagctccagggcaagccgaccaagtacaaggtcatctcgcgcgcggtcgcctaccacggcaccccgcagggcgccctgtccatcaccggcctgccggccctgaaggcccccttcgagccgctggtcccgggcgcccacaaggtcccgaacaccaacatctaccgcgccccgctcttcggcgacgaccccgaggccttcggccgctgggccgccgaccagatcgagcagcagatcctcttcgagggcccggagacggtcgcggccgtcttcctggagccggtgcagaacgccggcggctgcttcccgccgccgcccggctacttccagcgcgtgcgcgagatctgcgaccagtacgacgtgctgctggtgtcggacgaggtcatctgtgccttcggccgcctcggcacgatgttcgcctgcgacaagttcggctacgtaccggacatgatcacctgcgccaagggcatgacctcgggctactccccgatcggcgcgtgcatcgtctccgaccgcatcgccgagccgttctacaagggcgacaacaccttcctgcacggctacacgttcggcggccacccggtctccgccgccgtgggtgtcgccaacctcgacctgttcgagcgcgagggcctcaaccagcacgtgctggacaacgagtccgcgttcctcacgacgctccagaagctgcacgacctgccgatcgtcggcgacgtccgcggcaacggcttcttctacggcatcgagctggtgaaggacaaggccaccaaggagacgttcacggacgaggagtcggagcgcgtgctctacggcttcgtctccaagaagctcttcgagtacggcctctactgccgcgccgacgaccgcggtgacccggtcatccagctgtcgccgccgctgatctccaaccagtcgaccttcgacgagatcgaatcgatcatccggcaggtgctgacggaggcgtggacgaagctc

SEQ ID NO: 2600 - DNA, 735 bp, Streptomyces avermitilis
  CDS (1)..(735)
atggtggccccgccggacaacgacgtgctctgggcacgcaccctgcacttcacacacaacggctcccccgcgctcaacggtgtctcgctcggtgtgcgcgtgggcgagatcctcgccgtcaccggcccgcgcggcagcggcaagacgacgctcctgcagtgcctggccggactgctcccgacccagcggggcgaggtctggttcaacagcacgccggtccacaccatgggcccgctcacccgcgaacggctgcgccgcgaccgcttcggctggatcgacccggcccccctgctggtccccgagctgaacgtatgggagaacgccgccctgccgctcatgctgcgcggcaccggccgccgccgggcgaaagccaccgccctggagtggctggagcgcctcgacatcggcgactgcgcccgcaagcgcccctacgcgctggtccaggccgagcggcagcgggtcgccatcgcccgcgcactggcccccgcccccaccgtgctcttcgcggacgagcccaccgccccgctgcacagcgccgaccgcgcccatgtgctgcggacgctcaccacggcggcccgctcgcacggcatcacggtcgtcctggccacggacgacgcggacaccgcggcgctcgccgaccggacggtggcactgcgcgacggacggcgcgtgcacaccgtccatctgcccccggtcgccgagacggaaggccgggccgcgtgctcgctctccgtc

SEQ ID NO: 2601 - DNA, 1392 bp, Streptomyces avermitilis
  CDS (1)..(1392)
gtgctcgctctccgtctagcccgcggggcccaccccctggtccagctccgcagactgctggtcacggcggcggccgcgggcaccggcttcctgctgctgggcacgctgggctacgcgatggcgcacccggacgcctcggctcgctcggtgctgcggctggcgtggtgcgtggcgccgatggcggccacggtgtacttcgcggtcgccgtggcccgtacggacccgggcacccgcccgcgcccgggcctctcggcgatcggcctcggccccgtacgtctgatggccgtctcggccgtgaccaccgccctgtccaccaccctcggctcgatgctcgccctgctgttcttcctgcatctgcgcggcgatctgaccgggatgccgttcgacggggcggcggccgagttcctcgccgcggaccagcccctgcccctgccgggggcgctcaccctgctggccctggtgccactggcggcgtcggtcacgagcgcgctggtgctgcggccgcggggcgagaagcaggcccgtatgtccggcacgtccaccacggccggcacgtccccgacgatcggcacgccccttaccgccggcgcgtccgcgacggccggcacgcccaccaccgcaggcacgaccccgacggccgacactccccctgccgccgacacggacagcacgtccaccgcacccgggacagccgccgacagccccaccccctccgccgcaccctcctccgccacaccgcacgacgtcccggccgagccactggacccgcagcgccccgccgtgccccagccggcccccggcggtctcccctggagcgtggccgtgctcgccgccggtctcgccgtcgagatgtacgcgagccagtcggggcccgcgcccggcctcgccctgccgggcaggttcgcggacggacccgccggggtgctggcgggctggacgctcaccgcaatgggcctcgtgctggccgggcccgcgatcacgtatctgtgcgggtggctgctccaggccctacgtcccggcgcgctgcgcctgctcgccgggcgcgtgctccaggaggaggcacggcggatcgggcaaccgctcggcgtggtgtgcgcggtggcgtcgggggcgtacgcgacggcgacgctgtacgccggggctcggccgtccttcgggccgctcagcacgctgggcgcgctgctggtgaccggctgcaccgtcgcgacgctggtgacggccgcggtggaggccaagcacgcgcgcgcggagaccaccgcggcgctgctgcggctcggtgcgccggccaccatgctgcgcagcgcggcgctgctgcgcgccggcgccctggtcgccgtgttcgtcccgctgacctgggcggtcgccgagctggcggccatgccgctgacgggc

SEQ ID NO: 2602 - DNA, 405 bp, Streptomyces avermitilis
  CDS (1)..(405)
atgtaccagcagatgatcttcgtgaacctcgccgtcgacgacgtcgacgcctcgaagaagttcttcacggagctcggctacacgatcaacccgcagttcacgacggacgactgcgcatgcgtcgtgatcagcgacacgatcatcgcgatgctgctgagcaagcagcgctacgccgacttcaccaagaagcggatcgccgacccgaccacgaccagcgaggtgctgctctgtctgagcgccgagagccgcgagaaggtcgacgaactggtcgacaaggccctcgccgcgggcggcacgagcagcggggagacccaggatcacggcttcatgtacggccgctccttcgacgacccggacggccacacctgggagatcgtgtggatggatccggcggcggtccagggc

SEQ ID NO: 2603 - DNA, 1116 bp, Streptomyces avermitilis
  CDS (1)..(1116)
gtgcagccgataccttcacccaccgcttcccacgaccgtgagatcgagtccctcgaggagttcgacgaggtggtctcggagcgcggctccctcgcccggtaccgcgtacaggccgtcgatctgacggcccgtacgcgggcgctgctcaccatggactgcgcgggcgccgtcttcctgggctgcccgatggaccccgaggcggcggcgcgcgtacgggccacgggcgcgctggtcttcccgccggtcccgggcctgcccttcgacccgtaccgcggtcggctctacaccccggacgagctcttcgactcgctcgacaccgactacgaggcgacgcccgacgcccgcgcgtacgcctggttccagcggacgaaggccgacggcgacatcttcgcgtcgatggtgcgcgcgatccacgacgacgccgtctcggacgccctcgacgaactcctcgtcggcgcgcgggtggtgggcgtgatgggcgggcacgccatggcacgcggcacgcgggagtacgagggcgcggcccggctcggccgtgaactggcgcgcgccggtttcacggtcgccaccggcggcggcccgggcgcgatggaggcggcgaacctcggcgcctacgcggcccccttcgggcccgagatgctcaccgaggcgctccaactcctcgccaaagcaacgtcgttcacaccgtccgtgaccgagtgggcgcgcgccgccttcgacgtgcgcgagcgctggccggccggcggcccctcggtcggcatccccacctggttctacggccacgagccgccgaacgcgttcgccgcgcacgtcgccaagtacttcgccaacgcgacccgggaggacgggctgctggcccgctcgaacgcgggcgttgtgttcctgccgggcgccgcgggcacggtgcaggagatcttcgacaacgcgacccccaactactacgagtcccggggcgaacccacgcccatggtcctcgtcgaccgcacccactggaccgagcggctgccggcctggccgctgctccaatccctggcgcgggaacgctcgatggagtcccgcatcgccttggtggaccgcatcgaggacgccccgggggctctcaaacgcctcggtggt

SEQ ID NO: 2604 - DNA, 672 bp, Streptomyces avermitilis
  CDS (1)..(672)
gtgtccatatctcgccgtaccgcacgttctgtgcgaatcctcggagttgcctccgccacggccgcgctcgcgctcggcgtcgcgggcaacgcaatggcctgcaacatcagtgagttctccgccgaagccaagtgcgacggcaccaagagtgtcatcaccgtcaaagacgtggacccctccggcgtacccgcggtcgtctccgtgttcctcgagaacaacggcgccgacgtgaagaagatcggcgagcaggaggtcaagggctcgcgcgaaggtgtcaccatcaccttcgacgaggcctggaagccgaacgccgaataccgcatccacgtcaaggccgggaaccaggtcgacgaggacatcaagccgaacctgaccaccccggccacggcgtgcaagacggagacgaccccgccggccaccaagaccccgaagccgtcgaagaagccgtcgtcctcggcgacgccgtccgcgaccccgtcgacgtcggacagcagcacgccgccggccgcctcggacaacgccccctcgcccgcggtcggtgagtcgaacctcgccgagaccggtgcgaactccaacaccggcatgatcgccggtatcgccggcggcctggtcgtcatcggcggcggagcggtgttcttcggcatgcgccgccgcggcgcgtcgaaggccggc

SEQ ID NO: 2605 - DNA, 1035 bp, Streptomyces avermitilis
  CDS (1)..(1035)
atgctgctgagcctgaaggccgcgaccgtacgcttcggcgggcgggccgtgctcgacgccgtcgacctcgatgtcgccgagcacgagaccgtgtgtgtgctcgggccgagcggcagcggcaagtcgacgctgttgcgggcggtcgccgggctccagccgctcgacgagggacaggtggtcctggggggccgggcgatggactcggtgcctccgcacaagcggggggtgggtctgatgttccaggaccatcaactgttcccgcagcgggacgtgggcgggaacgtcgctttcgggctccgtatgcacggggcttcgcggtccgaacaggagggccgggtgcgggagttgctcgacctcgtcgggctgccgggcgccgcgcggcgggccgtcgcctccctctccggcggcgagcagcagcgggtcgcgctggcccgcgcgctggcgccccgtccccggctgttgatgctcgacgagccgctcggccagctcgaccggtcgctgcgtgaacgcctggtcgtcgaactccgggaactgttcaccgaactgggtacgaccgtgctcgccgtcacccatgaccagggcgaggcgttcgcgctcgcggaccgggtcgtcgtgatgcgcgccgggcggatcgcccagtccggtacgccccttgaggtgtggcggcagccggccgacgagttcgtggcccgcttcctcggcttcgacaacgtggtcggtgcgaccgtcgccggggaggccgccgacacgccgtggggcaaggtcccggtgccggaggggtccccgcaggggccgggcacgctgctcgtcaggcccgccggcgtgcggctggcggatgccaccgaggggcttcgctgcaccgtggccgcccgcacgttccggggcacccatgtcgccgtgcacctccagccggaggacgacgcaccgcgactggaagcggcgtgcgcgctgcgggacgcgccggagcccggggagacggtcggggtggcgttcgacgtggccgacatcgtcgtactcggaggcgcttccggcgca

SEQ ID NO: 2606 - DNA, 1698 bp, Streptomyces avermitilis
  CDS (1)..(1698)
gtgggtcaagtcgtggacctcgctcgtactgaagtagagcccccggcgcgcaaggggctctcccgtgggagcgcggcgcggctcgggctcatggccctgcccgtcgcgttcttcggggtgttcttcgcctaccccgtcgcggcgatcgtggcgcgtggtctgaaggccgacggggcctggcagtgggggcggatcggtgacgtactggcgcagtccggcatacagcacgtcctgtggttcaccacctggcaggcgttcgcctcgacagcgctcacgctgctgatcgcgctccccggcgcatatgtcttcgcacgcttcgatttccggggcaagcaggtgctgcgggccgtcgtcaccgtcccgttcgtgctgccgacggtcgtcgtcggtacggccttcctggccctcgtgggccgcgggggactcctcgacgagctgtggggcgtacggctcgacaccaccgtctgggcgatcctgctcgcgcacgtcttcttcaactacgcggtcgtcgtccgcaccgtcggcggtctctgggcgcagctcgacccgcgtcaggaggaagccgcgcggatgctcggcgcctcccggttcgcggcctggcgcaaggtgacgctgccggcgctggccccggcggtggcggcggccgcgctgatggtcttcctcttcaccttcacctcgttcggtgtggtgcagatcctcggcggtcccaccttctccaccctcgaagtcgagatctaccggcagacctccgagatcttcgacctcgccacggccgccgtgctgacgatcatccagttcatggcggtcggcgcgatcctcgccgtacacgccgggaccgtgcgccggcgggaggccgcgctgcggctggtggacgcatccatgacggcgcgcaggccgcgcggggcgggacagtgggcgctgctcggcgccgtcctcgccaccgtcgccgtactcctggtgctgccgctcgccgttctcgtccagcgctcgttcgacgcgcccggcggccacggattcgcgtactaccgggcgctgacgcacgacgacggcgggaccttcctcgtcgcaccgatcaccgccatcggcacctctctgcagtacgcgctcgccgccaccgccgtcgccgtgctgatcggcgggctggccgccgcggccctgacccggcgcgacgccggccgtctcgtgcgtggtttcgacgcgctgttgatgctgccgctcggcgtgtccgccgtgaccgtcggcttcgggttcctgatcgccctcgacaagccgccgctgaacctccgcggctcgtggattctcgtgccgctcgcgcaggcgctggtcggtgtccccttcgtcgtccgcaccatgctgcccgtcctgcgcgccgtggacgaacggctgcgcgaggcggcgtccgtgctcggggcctcgccgtggcgggtgtggcgcgaggtcgatctgccgatggtgcggcgggcgctgctggtcgcggccgggttcgccttcgccgtgtcgctgggcgagttcggtgcgacggtcttcatcgcgcggcccgacaacccgacgctgccggttgccgtggcccggctcctcggacgcgcgggtgacctcaactacgggcaggcgatggccctttcgacgatcttgatggtggtgtgcgcggtggcactgctgttgctggagcgcgtccgtaccgatcggaccggggagttc

SEQ ID NO: 2607 - DNA, 1083 bp, Streptomyces avermitilis
  CDS (1)..(1083)
gtgagcaccaccaagaagttcacggccgcggccctggccgccgggctcgggctcgtcacgctgtccgcgtgcggctcgtccggctcgggcggcggcgacgccgactccaagacggtgaccctggtcagccatgactcgtgggccgcctcgaagagcgtgctcgaggacttcgagaagcagtccggctacacggtgaaggtcctcaaggatggcgacgccgggcaggcggtcaacaaggcgatcctcaccaaggacaacccgcagggcgacgtcttcttcggcgtcgacaacaccctgctgtcgcgggcgctcgacaacgggctgttccagccgtacgaggccaagggctccggcctgatccgccccgagtaccaggtggaccgggccaagcaccgggtgacaccgatcgactccggtgacatctgcgtcaactacgacaagaagtacttcgccgaccacaagctggacccgccggcctccttcggcgacctggtcgagccgcggtacaagaacctgctcgtcacggagaacgccgccacgtcctcgcccggcctcggcttcctgctggggacggcggccgagtacggcgacaaaggctggcccgactactggaagaagctcaaggccaacggcgtgaaggtggtcgacggctgggagcaggcctacaaccaggagttctcgggctcagcaggcggcaagaaggccaagggcgaccggccgctggtcgtctcctacgcctcgtccccgccggccgaggtgatctacgccagccccaagccgaagaccgcgcccaccggggtcgcgagcgggacctgcttccggcaggtcgagtacgcggggctgctgagcaacgcgaagaacaccaagggcggcaaggcgctcctcgacttcctcgtcaccaaggaattccaggaggacatgccgctgaacatgttcgtgtacccggtggtcaagggtgctcaggtccccgccgaattcagcgagttcggtccggcggccaagagccccgagaccctggccccggccgagatcgccgacaaccgtgaccagtgggtcaagtcgtggacctcgctcgtactgaag

SEQ ID NO: 2608 - DNA, 1104 bp, Streptomyces avermitilis
  CDS (1)..(1104)
atgcctaagcccggagaactcactttcgtcgccccgcgcggagccaagaagccgccgcggcaccttgccgatctctcgcccgccgagcgtaaagaggctgttgccgcgatcggtgagaagccgtttcgcgccaagcagctctcgcagcactacttcgcgcggtacgcgcacgacccggagcagtggaccgacatccccgccggttcccgcgccaagctccaggaggcgctgcttcccgacctgatgacggtcgtgcggcatctgtcgaccgaccaggacaccacccgcaagacgctgtggcggctgttcgacgggacgctcgtcgagtcggtgctcatgcgctacccggaccgggtgacgatgtgcatcagctcccaggccgggtgcggtatgaactgcccgttctgcgccaccggacaggcgggcctggaccggaacctgtcgaccggcgagatcgtgcaccagatcgtggacggcatgcgggcgctcagggacggcgagattcccggcggccccgcccgtctctccaacatcgtcttcatgggcatgggcgagccgctcgccaactacaagcgggtcgtcggtgcgatccgggcgctcaccgacccggagccggacgggctcgggctgtcgcagcgcggcatcaccgtgtcgaccgtcgggctcgtcccggccatccaccggttcgccgacgagggcttcaagtgccggctggccatctccctgcacgccccggacgacgagctgcgcgacactctcgtgcccgtcaacacgcggtggaaggtgcgggaggtgctggacgccggctgggagtacgcggccaggtccggacgccggctctccatcgagtacgcgctgatccgggacatcaacgaccaggcctggcgcggtgaccgcctcggccggatgctcaagggcaggccggtgcacgtcaacctgatcccgctgaacccgacgcccggctcgaagtggaccgcctcgcggcccgaggacgagaaggcgttcgtcgaggcgatcgccgcccacggggtgccggtcaccgtccgggacacccgtggccaggagatcgacggagcctgcggccagctcgcggccaccgagcgg

SEQ ID NO: 2609 - DNA, 408 bp, Streptomyces avermitilis
  CDS (1)..(408)
ttgcgcttgaaagcgattccggcagtcactgcaattgccgccgcgacgttcctcggagctgccgccagcccggcgcaggccggcaccggcctgctcatcgcggtgcagatcaactcgttccaggactggggcaatttcaaccaggacccggtggaaagcaccaacactcccggtgacgccatccgggcctgtgactggacggcggacgggtgggccgtcacgtcctacctggatgtcggcaggaacggaacgtgggaccgcacggtttcgacgagcggcgttccctcggatttctgtacccactgggaaaccggcaacctcgccgagggcaccaaggtgaccatcaaggcgtgtaacacgaaggccggttacgccccgaagaactgcaaggaagaggacaccgtcgct

SEQ ID NO: 2610 - DNA, 1176 bp, Streptomyces avermitilis
  CDS (1)..(1176)
atgaacgaatcttcctggggggcgccgccacaagccgggtactgggggccgtccgaccaggggcctgcccagggggcagccccggcgggtcccacgtacgatgcgcatgacgcgcagcagactcgccccatgcccatcgtgcccgacgtacccgcgcatggcggagaccaggatgacgaccggggggccgctcggctgagtggccccttgttccgcgacgacacgccgcagacgacgtcctacgggtcacagacgccgtacgtgactcagtcgccctatgggtcccagacgccccatggggcccagccccagaagccggagcccatgcccgacgccccacagccagcgcccgccccgcagaagaagagcgcgggccgtgacctgggtgcggccataggggtcggcgtcgggctcggggtggtgatcgtcgcgtcgttgttcgtcgtcaaggccgtcttcgtcggggtcatagcggtcgccgtggtggtgggcctttgggagctcacctcacggctcgaggagcgcaagggcatcaaggcgcccctcgtaccgctcgcggtcggcggcgcggcgatggtcgtcgccggatacgtccggggtgccgagggcgcgtgggtggcgatggcgctcaccgcgctcgccgtcctggtctggcgcatgacggaaccaccggagggctacctcagggacgtcacggccggggtcttcgcggcgttctacgtcccgttcctggcgacgttcgtcgcgatgatgctcacggccgacgacggtccgcgccgggtgctcacgttcctgctgctcaccgtggtcagcgacacgggcgcgtacgcgatcggctggcgtttcggcaagcacaggctcgccccgcgcatcagccccggcaagacccgcgagggcctggtcggagcggtctcgttcgcgatggtggcgggcgcgctgtgcatggagttcctgatcgacgacggcagctggtggcagggcctcgtgctcggcttcgcggtcgccgccagtgccacgctcggcgacctcggcgagtccatgatcaagcgggatctgggcatcaaggacatgggcacgctgctgccggggcacggcggcatcatggaccggctggactcgctgctgccgacggctccggtggtgtggttgttgctggtgatcttcgtagggtctggc

SEQ ID NO: 2611 - DNA, 555 bp, Streptomyces avermitilis
  CDS (1)..(555)
gtgatcgaagagaccctcctcgaggccgaggagaagatggagaaggccgtcgtggtcgccaaggaggacttcgccgcgatccgcaccggccgtgcgcacccggcgatgttcaacaagatcgtggccgactactacggcgcgttgacgccgatcaaccagctggcctcgttctcggtgccggagccgcgcatggccgtggtgaccccgttcgacaagagcgcgctgcgcaacatcgagcaggccatccgggactccgacctgggcgtcaacccgagcaacgacggcaacatcatccgtgtggtgttccccgagctgaccgaggagcgccgcaaggactacatcaaggtcgccaagaccaagggtgaggacgccaaggtctcgatccgctccgtccgccgcaaggccaaggacgccatcgacaagctgatcaaggatggcgaggtcggcgaggacgagggccgtcgtgcggagaaggagctcgacgacaccaccgcgaagtacgtcgcccaggtggacgagctgctcaagcacaaggaagcggagctgctcgaggtc

SEQ ID NO: 2612 - DNA, 756 bp, Streptomyces avermitilis
  CDS (1)..(756)
atgaccaccaaggccgacaagagcgacgacggcaaagtacgcggccggtacctgctgaagctgtccggagaggcgttctccggaggcggcggcctcggcgtcgacccggacgtggtgcacgccatcgcccgtgagatcgcggccgtggtgcgcgacggctccgagatcgccgtcgtcatcggcggcggcaacttcttccgcggcgccgaactccagcagcgcggcatggaccgggcccgctccgactacatgggcatgctcggcacggtcatgaactgcctcgctctccaggacttcctggagaaggagggcatcgactcgcgcgtgcagaccgccatcaccatgggccaggtcgccgagccctacatcccgctgcgcgccgtgcgtcacctggagaagggccgtgtggtcatcttcggcgccggtatgggcatgccctacttctccaccgacaccaccgccgcccagcgtgctctggagatcgacgccgaggcgctgctcatgggcaagaacggcgtggacggggtctacgactccgacccgaagaccaaccccgaggctgtcaagttcgattcgctcagctacggcgaggtcatcacccgcgacctgaaggtcgccgacatgaccgcgatcacgctgtgccgggacaacaagctgcccatcctggtcttcgaacttctggcggagggcaatatcgcgcgcgccgtcaagggtgagaagatcggcacactcgtgggtgaccagggcagccgggac

SEQ ID NO: 2613 - DNA, 834 bp, Streptomyces avermitilis
  CDS (1)..(834)
atggcgaactacaccgccgccgacgtcaagaagctccgtgagctcaccggcgccggcatgatggactgcaagaaggcgctggacgaggccgagggcaacgtcgagaaggccgtcgaggcgctgcgcatcaagggccagaagggcgtcgccaagcgcgagggccgctccgccgagaacggcgctgtggtctccgtcatcgccgacgacaacgcctccggtgtcctggtcgagctgaagtgcgagacggacttcgtcgccaagggtgagaagttccaggccgccgccaacgcgatcgccgagcacgtcgccaagaccgccccggccgacctcgaggcgctgctcgcctccgagatcgagcccggcaagacggtccaggcgttcgtcgacgaggccaacgccaacctgggcgagaagatcgtcctggaccgcttcgcggcctacgccgacggttacgtgtccgcgtacatgcaccgcacgatgcccgacctgccgccgcagatcggtgtcctcgtcgagctggacaagccgaacgcggagatcgccaagggcgtcgcccagcacatcgccgccttcgcgccgaagtacctctccaaggaggacgtcccggccgaggtcgtcgagtccgagcgccgcgtcgccgaggagaccacccgcgccgagggcaagcccgaggccgccctgccgaagatcgtcgagggtcgcctcaacggcttcttcaaggacgccacgctgcttggccagccgtacgcgctcgacaacaagaagtccgtccagaaggttctggacgaggcgggtgtcaccctgaagcgcttcacgcgcatcaaggtcggcatc

SEQ ID NO: 2614 - DNA, 924 bp, Streptomyces avermitilis
  CDS (1)..(924)
atggccgtcgtcacgatgcgggagctgctggaaagcggcgtccacttcggtcaccagacccgtcgctggaacccgaagatgaagcgcttcatcttcaccgagcgcaacggcatctacatcatcgacctgctccagtcgctgtcgtacatcgaccgcgcctacgagttcgtcaaggagaccgtcgcccacggcggcacggtcatgttcgtcggcacgaagaagcaggcgcaggaggccatcgcggagcaggccacccgcgtcggcatgccctacgtcaaccagcgctggctgggcggcatgctcaccaacttctcgaccgtctacaagcgtctgcagcgcctcaaggagctcgagcagatcgacttcgaggacgtcgccgcttccggtctgaccaagaaggagcttctcgtgctctcgcgcgagaaggccaagctggagaagaccctcggtggtatccgcgagatgcagaaggtgcccagcgccgtctggatcgtggacaccaagaaggagcacatcgcggtcggcgaggcccggaagctcaacatcccggtcgtcgccatcctcgacaccaactgcgaccccgacgaggtcgactacaagatcccgggcaacgacgacgcgatccgctccgtcaccctgctcacccgcgtgatcgccgacgccgtcgccgagggcctcatcgcccgctccggcgccggcaaggccgagggtgacaaggccgcgggcgagccgctcgccgcgtgggagcgcgacctgctcgagggcgagaagaaggccgacgaggctgaggctccggccgccgccgaggccgagaagccggccgaggccgctgctgaggcgccggccgccgaggcccccgctgccgaggctcccgccgctgaggcccccgctgccgaggccccggccgcggacgccgagcaggcc

SEQ ID NO: 2615 - DNA, 696 bp, Streptomyces avermitilis
  CDS (1)..(696)
atgcgggaccgttctcgcatgcgagcgaaacgatctgtgcgtacgtggccggggttgctgctggtcctgacggtgaccgtcctgggcagcacggcgtgggcaagcggggacatgaccgcgcggcgaacgggtgcctccccggggccggaggtgtcgcgggcggcgggcgcgccgccggggacgggcgctcctccagggggtggcgcgcccgcgccaccggaggccgatggcgcggttccggcgatcggccgcgcgtggcccgtgggtgtacgcccgttggtggtacgcggctgggagcctccggctacggcgtacggccggggtcaccgtggcgtggacctggcggcggcccccggcactccggtgcggtccgtcgcggccggccgggtctcgttcgcgggccgggtcgccgggcggggagtcgtctccgtcgagctgacgggaacgggcgagccgcccctgcgcacgacgtacgaacccgtacgcccgtccgtggagaagggcgacgaggtggcggcgggcgggagcctgggcacgctggagccgacgaccgcccactgctcgacggcctgtctgcactggggcctgctcagaggccggacctacctgaacccgctgtcacttctgcccgcgtggctgctgcaccgaggcccgtcccgcctgctgccggtgctcggggtgcccttgcctcgtgcg

SEQ ID NO: 2616 - DNA, 537 bp, Streptomyces avermitilis
  CDS (1)..(537)
atgcagcgagccgccctgctggacgcggctcggtccctgctgtccgagggcgggacggaggcgctgaccttcccggccctcgcggagcgcacggggctcgcgcgctcctccgtgtatgagtacttccggtcgcgggcggccgtcgtcgaggaactgtgcgcggtcgacttccccgtctgggcggcggaggtctcggcggcgatggaccgggcggacaccccggaggccaaggtcgaggcgtatgtccggcagcagctggccctggtcggagaccggcggcaccgggccgtggtcgccatttccgccggcgagctcgacgccggggcgcgcgagaagatccgtgcggcccacggcgggctcgtcgcgatgatcgtgcaggcgctgggggagatgggtcatgcggagccgaggctggccgcgatgctcctccagggcgtggtcgacgccgcggtacggcggatcgagctgggggccgccgaggatcccgcggcgatcaccgacgccgccgtggccatggccctgcgaggagttcggggc

SEQ ID NO: 2617 - DNA, 840 bp, Streptomyces avermitilis
  CDS (1)..(840)
atgccccagcacacctccgggtccgaccgggcggcgattcccccagccgcccgcgacggcggcagcgtgcgcccgcccgctccctcgacgctcgacgagctgtggcggtcgtacaaggcgacgggggacgaacggctgcgggagcagctgatcctgcactactcaccgctggtgaagtacgtggccggccgggtgagcgtcggtctgccgcccaatgtggagcaggcggatttcgtctcctccggggtgttcggactgatcgacgcgatcgagaagttcgacatcgggcgggagatcaagttcgagacgtacgcgatcacccggatccggggcgcgatgatcgatgaactgcgggcgctcgactggatccctcgctcggtgcggcagaaggcgcggaacgtggagcgggcgtacgcgacgctggaggcgcggctgcggcggaccccgacggagggggaggtggccaccgagatgggcatcgcggtggacgaactccactccgtgttcagccagttgtcgctggcgaacgtggtggccctggaggagctgctgcatgtcgggggcgagggcggcgaccggctgagcctgatggacacgctggaggacaccgccgccgacaacccggtggaggtggccgaggaccgggagctgcggcggttcctggcaagggcgatcaacacgctgcccgaccgggagaagaccgtggtcacgctctactactacgaagggctcacgctcgccgagatcggcaatgtgctgggggtgacggagagccgggtgagccagatccacacgaagtccgtgctccagctcagggccaaactggcgagcttcggtcgc

SEQ ID NO: 2618 - DNA, 1143 bp, Streptomyces avermitilis
  CDS (1)..(1143)
atgacggacgacgaacggctcgcccgtgtcgccctcacgcggatcatcgagcccggtgacgagatcggcggccgatggctgcgggagtacggcgccgtggcggttgcccggcggctggtggagggaggcgagccgtttccccgggtgtcggccaagcgctgggcggggctgagaggacgggccgcccaggccaggccggagcgggacctggccgaggcccggcaggccggggcccgctttgtctgcccgggcgatgcggagtggccggcacagctcgacgacctcgcggacgcccgccccaccgggctctgggtgcgtggccggccgagcctgcggatgtgggccctgcggtccgtcgcggtcgtcggcgcgcgagcctgtaccgagtacggcgcccacatggcggccgccctcggcgcgggactcgccgagcgcggatgggtggtggtgtcgggcggcgcatacggcgtggacggtgccgcgcaccggggtgcgctcggggccggcggggccaccgtcgccgtactcgcctgcggagtcgaccagccctatccacgcggacacaccgagttgatcaccaggatcgcggaacagggtctggtcgtgggggagttgccgcccggcgaccatccgacgccgagcaggttcatcctccgcaacagggtcatcgccgcgctcacccggggcaccgtggtcgtcgaggcggcctaccgcagcggcgcgctggtcacggcacgcgcggcccagcggctcgggcggttcaccatgggggtgccggggccggtgaccagcgggctctccgccggggtgcacgagttgctgcgcggcgacgccgtcctggtctccgatgccgcggaggtggccgaactggtgggtgacatgggcgagctggcccccgaccggcgaggccccgtcctgccgcgcgacctgctggagccgggcgccgcccgcgtcctggccgcgctgccgggccacgggaccgcgacgccggacgagatcgctcgcggagcgggcacgacgggtgacgacgcggtcgggagactgtacgaactccgatcacttggtttcgtcgaacgacacggcgatcgctggaagttgacacgccaggcgctgatctcggtctcccaagatcgcggccgatgc

SEQ ID NO: 2619 - DNA, 1623 bp, Streptomyces avermitilis
  CDS (1)..(1623)
atgggattcgcccgtacgtgttcggtggcactggtcggcgtcgagggcgtggtggtcgaggtccaggcgggcctggagcccggggtcgcggcgttcacgctggtggggctgccggacaagagcctgacggagagcaaggaccgggtcaggtcggcggtggtcaactccggcggcgagtggccccagaagaagctgacggtgggtctgagcccggcatccgtgccgaagggcggctcggggttcgatcttgccgtcgcgtgcgccgtgctgggtgccgccgagcgcatcgacccgcgtgtgctggccgacatcgtcatgatcggcgagctcgggctcgacgggagggtgcggccggtcaggggcgtcctgccggcggtcctggccgcagcggacgcggggtacgaacaggtggtggtgccggagtgcgccgcggccgaggcctcgctggtccccggcgtgtccgtgctcggtgtacgcagcctccggcagctggtcgccgtgctcacggatgagccgttccccgaagaggaccccgacgagcaggggcggccggatccgctgctggcgggcctgcgcatgcccggtaccggcgcggccaccggcatccacagcgtgggcgccgcgcctctcgacctcggccatgacctcgccgacgtggtcgggcagctctcggcgcgtacggcggtggaggtggccgccgccggcggtcaccatctgttcctcgaagggccgccgggagccggcaagacgatgctcgccgagcggctgcccacggtcctgccacggctcggccgggacgagtcgctggaggtcaccgcggtgcattcggtcgcggggctgctgcctgggggcaaacctctggtggacgccgctccctactgcgccccgcaccactcggccacgatgcaggcactggtcggcggtggccagggcgtcgcccggccgggcgcggtgtcgctggctcatcgaggggtgctcttcctcgacgaggcgccggagttcagcggccaggctctcgacgcgctgcggcagcccctggagtcagggcatgtggtgatcgcacgcagtgcgggcgtggtgcggttcccggccaggttcctgatggtgctcgcggccaacccgtgcccctgtgggcgattgtcgcaacgggacaccctgtgcgaatgcccgcccgcgacgatccgccgctaccaggccaggctctcgggaccgttgctcgaccgggtcgacctgagggtcgaggtggagccggtcacgcgggccgagctgacggtgcgcggggcccggggcgagtcgacgcgggcggtggccgaccgggtgcgagccgcccgtgagcgctccgcgacgcggttgaccgggacaccctggcgcaccaacagcgaagtgcccggacgggagctgcgcagccactggcaggccgtgccgggagccatggaggaggcggagcggggactggagcggggcgtgctgagcgcccgcggcctggaccgggtgctccgcgtggcgtggacggtcgcggatctgtccgggcacgacaggcccgacgccggggatgtggccctggccctgcagttgcgcaccggggtgccccggggcgtgcccatgatgatcggcgcgtcggca

SEQ ID NO: 2620 - DNA, 540 bp, Streptomyces avermitilis
  CDS (1)..(540)
gtgggtggcggggttgtccacaaccaccgcgttgtccaccaagatccacaaagggctcggtacgggctcagtgttggcgccggaggtggtgccgacatgagcacacgcaaggcacagcacggcgcgcggcaggacacggagtacggcgcgcggcagggcaccgagcaaggcgcacggcggagcgcgcaacgcggcgcactcggcaggtacggcgagtcgctggccgcacggcggctgaccgagtccgggatgacggtcctggagcgcaactggcgcggcggcaggaccggcgagatcgacatcgtggcccgcgacggcgacgcgctggtcgtgtgcgaggtcaagacccgccgggcaggcctcttcgaacacccgatggcggcgatcacaccggcgaaggcggagcgtctgcgcggtctcgccgagcgctgggtccaggaacacggaggcgctccgcccgggggcgtccgtatcgacctggtcggcatcctcctgccggaccgcggcgcacccgtcgtggagcatgtgcggggggtggcg

SEQ ID NO: 2621 - DNA, 306 bp, Streptomyces avermitilis
  CDS (1)..(306)
atgagcgccgaggacctcgaaaagtacgagaccgagatggagctgaagctctaccgggagtaccgcgatgtcgtcggtctgttcaaatacgtgatcgagaccgagcggcgcttctacctcaccaacgactacgagatgcaggtgcactcggtccagggcgaggtgttcttcgaggtgtccatggcggacgcctgggtgtgggacatgtaccggcctgctcgcttcgtgaagcaggtgcgcgtactcacgttcaaggacgtgaacattgaggagctgaacaagagcgacctggagctgccgggcggc

SEQ ID NO: 2622 - DNA, 525 bp, Streptomyces avermitilis
  CDS (1)..(525)
gtgcccgctgaggcttcgtcgcacgacgcgtacgagtcctacgcgccctacgcgtcgtacgagtccggcgcgggcgccgcgggtgagggggtcgaggactcgtacaagggcggcctgcgcaaggtggcccgcgtggtccttctcgacccgcaggagcgcatcctgctgctgcacgggcacgagccggacgatccggcggacaactggtggttcacgcccggtggcggcctggagggcgacgaatcgcgcgaggaggccgccctgcgggaactcgccgaggagaccggcatcaccgatgtcgagctgggtccggtgctgtggcggcgcaggtgctcgttcccgttcgccgggcgccgctgggaccaggacgagtggtactacctggcccgtacgacccagacggccacggcggccgcgggcctgacggaactggaacggcgcagtgtcgccggagcgcgttggtggacgtgccaggaactgaccgaggcacatgagacggtgtatccgaccaggtcgccgagctgc

SEQ ID NO: 2623 - DNA, 741 bp, Streptomyces avermitilis
  CDS (1)..(741)
atgagcaggaccggtcgtacggacgagggccacggacggctcggcagcacgctgtcgggactggccgtggccctcggctgtgtgctcttcctcggcgggttcgcctggggagcggtcgtctaccggccgtacacggtgccgaccccatcgatgtcgcccaccatcgtggccggcgaccgggtccttgcccagcgggtcgacggaggcgacatcaagcgtggtgacgtcgtcgtcttcaagcagaagagctggggcgacatgctcatggtcaagcgggtcgtggctgtcggcggcgacacggtcggctgctgcaccggcggcaagctgaccgtcaacggcaagcagatccaggagccgtatctgcccaagggccaggccgcggaggtccggacgatccccacggtcacggtccccaaggaccggctgttcctgctcggcgacgagcgcagcggctccctggactccacggcccacctcaccgaggccttcgacggcacggtggcgcgcagcggggtgaaggcccgggtggacgccgtggtgtggcccatgaacggcatgctggagcgccctacgggcttcgaggccctgggaagcctgtcctctcccggcccgctgcggctggtcgtcgccgcgatcgtcgggggggcggtgctggtcctgggcggtgcggcgtacggcccgatcgcgaatcgggcgcgccgcaggcgcagcggggcgcggatggagcccgccggtgcccgc

SEQ ID NO: 2624 - DNA, 873 bp, Streptomyces avermitilis
  CDS (1)..(873)
gtggaagacgccgcgacctccgcgagtgactccggagacggagacggcggcggtacccgggagagcggcgagcagggcggtcagcccaagaagcagcgctccttctggaaggaactcccgctcctcatcggtatcgcgctgatcctggcgctgctgatcaagaccttcctggtacaggcgttctcgattccctcggactcgatgcagaacaccctccagcagggcgaccgtgtcctcgtcgacaagctgaccccctggttcggctcggagcccgagcgcggcgaggtcgtcgtcttccacgaccccgccaactggctggcgggcgagccgacggccaccccgaaccccctgcagcgggtcctcggctggatcggcctgatgccgtcgtcgaacgagaaggacctcatcaagcgggtcatcggcgtcgcgggcgacaccgtcgagtgcaagggcaccggccccctgaaggtcaacggtcacgcgctgaacgacaccttcgtctatgccgggaacaccccgtgcagcgtggacgaccagggcggtcagttcaaggtgaaggtacccaagggcaaaatctgggtcatgggtgaccaccggcagaactccctggactcccgctaccaccagcaggacaagaaccacggcttcgtgcccgtggacaacgtcatcggccgcgccatcgtgatcgcctggccgcccacccgctggaacacgctgccgattccggacgccttcgaccagaacctcagcgcggcagcccccggcgccctcgggctcgcgggagcggtgccgctggtcctgtggcgcaggcaccgtctcgccggcggtcctaccggcggaaacccgagggtttctagcgacggtaccgccggg

SEQ ID NO: 2625 - DNA, 1080 bp, Streptomyces avermitilis
  CDS (1)..(1080)
atgggtaaccgaggcaaaccccgcggtgtgtcgagcagcgccgccgagaacctgctgcccaccggagcgcgccgcgcctccggcggtgccgtgcggccgggacgcgccgagcggcgcaagctgcaacgcaaggtcaagcggcgcagaaggcgctcggcggtcaaggagatacctctcctcgtgggtgtcgccgtcctcatagccctggtcctgaagacgttcctcctccaggccttcgtgatcccctcgggctccatggagaacacgatccagatcggcgaccgggtcctcgtcgacaagttcacgccgtggttcggctccaagccgcagcgcggtgacgtggtcgtcttcaaggaccccgggaactggctcgcgggcgagaagaccaccaagaagaacgaccccgtcgtcgtcaagcaggtcaaggagggtctcgtcgccatcggcctgctgccctccgacaacgacaaggacctcatcaagcgggtcgtcgccgtcggcggtgacaccgtcaagtgctgtgacgcccaagggcgcgtgaccgtcaacggcatgccgctcagcgagccgtacattcacccgggaaacaaaccttcggcgttcgacttctcggtgaccgtgccgcaggggcgtctgtgggtcatgggcgaccaccgggccaactcggccgactcccgctaccaccgcaccgagcagtacggcggtactgtctccgaggactccgtcgtgggccgcgccatggtcatcgcctggcccctgggccactggacgcgcctgaaggaaccggatacgtacgcgtccgtgccgggcggcgtgaccaccgctctcggcccgtcgcatagggtggcctccgcggatcgatatggattgatccccctcccgagccctgcggaactcccgctcgttatgggagtggtgggcctgcgccgactacggcgcgggcggcggcacggagtgaggagtggatgtgggggatttggcggtcggcgcacgatccggacacgatggccccgaagatcggccggagcggcacgacgggacggtacccccggcagtggaagacgccgcgacctccgcgag

SEQ ID NO: 2626 - DNA, 714 bp, Streptomyces avermitilis
  CDS (1)..(714)
atggacaccgaagcacagcacacggagcgcgaccgctcctccagccctttcgaatccgaggagatctcggacacacaggggccggagggccggtcgcgtttcgcgttggtgtcccgggtcgccgactggctcccgggcgggcggatcaccctcaccctgctgagctgcctgctgtttctcctggcgctcagcaacttcgtgatgcagccgttccagatccccagcagttccatggagggcgcattgaggattggggaccgcgttctcgtaaataagttggcgtaccgtttcggttcgaagccgcagcgcggtgacgtcgtcgtcttcgacggcaccggctatttcggggacgccgactacgtcaagcgcgttgtcggtgtagggggagaccatgtggtctgctgcgacagggaggggaggctcaaggtgaacggccggccggtcgacgagtcgtcgtttctgtatccaggagacagcccgtccgatgtcgacttcgacgtcgtcgttcccgacggcacgctcttcgtcctcggcgaccaccgcagcgactcccgcgactcccgcgaccacctgggctctccgggcggcggcatgatccccgtcggtgaagtcgtcggccgggccgactggatcgtctggcccgccggccacgggacgcaccttcgacgccccggcgcctacgcgcgcgtgcccgccgtggacggtgcccatggg

SEQ ID NO: 2627 - DNA, 348 bp, Streptomyces avermitilis
  CDS (1)..(348)
atgtctcacctgctcgactccgtcgactccgcgtcgctgcgcagcgacctcccggccttccgcccgggtgacaccgtcaacgtccacgtgcgcgtcatcgagggcaaccgctcccgtgtgcagcagttcaagggcgtagtcatccgtcgccagggtgccggtgtccgcgagaccttcacggtccgcaaggtctcgttctccgtcggcgtcgagcgcaccttcccggtgcacaccccgatcgtcgagaagatcgagctcgtcacccgcggtgacgtgcgtcgcgccaagctctactacctgcgtgagctgcgcggcaaggccgcgaagatcaaggagaagcgcgagagc

SEQ ID NO: 2628 - DNA, 846 bp, Streptomyces avermitilis
  CDS (1)..(846)
atgcggcacggcacccttcgggtcgatgtggtcacgatctttcccgagtacctcgaacccctgaacgtctcccttgtcggcaaggcacgcgcgcgtggacagctgaacgtgcacgtgcatgatcttcgggagtggacgtacgaccgccacaacacggtcgacgacactccgtacggcggcggcccgggcatggtcatgaagacggagccctggggcgacgccctggactccgtgctcgccgacggctacgagacggacgcccacggccccgctctgatcgtcccgacgcccagcggccgccccttcacccaggaactcgccgtcgagctctccgagcgcccctggctggtcttcacccccgcgcgctacgagggcatcgaccgccgcgtcatcgacgagtacgcgacccggatgcccgtctacgaggtctccatcggcgactacgtgctcgccggcggcgaggcggccgtactcgtgatcacggaggctgtcgcccggctgctgcccggcgtcctcggcaacgccgagtcgcaccgggacgactccttcgcacccggcgccatggccaacctcctggaggggcccgtctacaccaagcccccggcgtggcgcgaccgggagatccccgaggtgctgctcagcggccaccacggcaggatcgcccgctggcgccgcgacgaggccctgaagcgcacgaccgccaaccggcccgacctcatcgagcgctgcgacccctcggcgttcgacaagaaggaccgcgaaatgctctcgatcctgggctggttcccggatcccgacggagtgccgcacggccgattttggcgcaggccagaggccatggaagaa

SEQ ID NO: 2629 - DNA, 558 bp, Streptomyces avermitilis
  CDS (1)..(558)
gtgcagctggtagtcgcacggatcggccgtgcccacggcatcaagggcgaggtcaccgtcgaagtacgtaccgacgagcccgagctcaggctggggcccggagccgttctggccacggacccggcctccgtcggaccgctgaccatcgagaccggccgcgtgcacagcggccgcctcctgctgcgtttcgagggcgtacgtgaccgcaacggcgccgaggcgctgcgcaacaccctgctgatcgccgaggtcgacccggacgaggtgccggaggaccccgacgagtactacgaccaccagctgatggacctggacgtcgtcacgaaggacgggacggaggtcgggcgcatcaccgagatctcgcacctgccctcgcaggacctcttcgtggtggagcggtccgacggcagcgaggtgtacatcccgttcgtcgaggagatcgtggtcgagatcgacctggaggagcagcgggcggtcatcgacccgccgccgggcctgatcgacgaccgggccgaagtggattcctccgataccgaggccgccacggaggcagacgcc

SEQ ID NO: 2630 - DNA, 237 bp, Streptomyces avermitilis
  CDS (1)..(237)
atgctcgaggaggctctcgagcacctcgtgaagggcatcgtcgacaaccctgacgatgtgcaggtcgcctcgcgcgacctgcgtcgtgggcgcgtcctcgaggtccgggtccaccccgacgacctcggcaaggtgatcggccgcaacggccgcaccgcgcgtgccctgcgcaccgtcgtgggcgccatcggcggtcgcggcgtccgggtcgacctcgtcgacgtggatcacgtccgc

SEQ ID NO: 2631 - DNA, 426 bp, Streptomyces avermitilis
  CDS (1)..(426)
gtggcagtcaagatcaagctgaagcgtctgggcaagatccgttcgcctcactaccgcatcgtcgtcgccgactcccgtacccgccgtgatggccgggccatcgaggagatcggtctgtaccacccggtgcagaacccctcccgcatggaggtcgacgccgagcgcgtcgcctactggctgggtgtcggcgcacagccgaccgagcccgtcctcgcgatcctgaagaagaccggcgactggcagaagttcaagggcgagcccgccccggctccgctgctcgtggccgcgccgaaggccacgcgcccgtcgttcgacgcccttggtggcgacgacgcgggcaagggtgaggccatcacccagaagaagaaggctgagaagaaggacgaagctgccgctgagtcctcttcgtctgagtcgaccgaggcc

SEQ ID NO: 2632 - DNA, 594 bp, Streptomyces avermitilis
  CDS (1)..(594)
gtgagcacgacaccacctgttctcgccgcagagctggcacaggcgtgggccgacattcagcggtaccaccccgagctgcccgatcttgccgcgccggagtccctgatcggagagtcgtcgtccgcctgcggacacgaactctctttcgagcgactgcttcatgaagcagtccacggcatcgccgccgcgcgtggagtccgagacacctcgcgcgccggccgataccacaaccgcagatttctcgcgatcgccgaggagctgggcctggaccacccggaggagccgcatcccagcagtggcttctccctggtcacgctcaaccccgaggcgaagcggcgctaccgcccgaccatcgagcggctgcagcgcgccctcaaggcccacacggccgcgaccgccgccgacacggcccgcagcttccgcggcccggccgcccggcacggctcctccggaggaggcgtccgcgtcaaggcggtctgcgactgcggccgcaatgtgcgcgtcgtcccgtcggtcctcgcgcaggcgccgatcgtgtgcggggggtgcggcaagccgttccggatccccgaggtggtgggcgcggcggcaagc

SEQ ID NO: 2633 - DNA, 1413 bp, Streptomyces avermitilis
  CDS (1)..(1413)
atggcaaaggcacccgttctcacgccccgggcggacgacttcccgcgctggtaccaggatctgatcaacaaggccgaactggcggacaacgggccggtgcgcggcaccatggtcatccgaccgtacgggtacgggctgtgggagcggatgcagcaggagatggacgcccgcatcaaggagacgggcacccagaacgcgtacttcccgctgctgattccgcagtcgtacctcaccaaggaggccgaccatgtggagggcttcgcgcccgagctcgccgtggtcacgcacggcggcggcaaggagctggaggagcccgcggtcgtccgtcccacctccgagatgatcatcaacgactacttctcgaagtgggtacagagctaccgcgacctgccgctgctgatcaaccagtgggcgaacgtggtgcgttgggagctgcgcccccgtctgttcctgcggacgaccgagttcctgtggcaggaggggcacacggcgcacgccacgtacgaggaggcgcgcgacttcgcggcccacatccaccggcacgtctacgcggacttcatggagaacgtccttgcgatggacgtcgtcctcggccgcaagaccgccaaggagcgcttcgccggtgccgtcaacaccctcacgctcgaaggcatgatgggcgacggcaaggccctccagatgggcaccagccacgagctgggccagaacttcgccagggcgttccacacccagtacctgtcgaaggagggcaagcaggaactcgtctggcagacctcctgggggtccaccacgcgcatgatcggcgcactggtgatgatgcacggcgatgacaacggcctgcgggtgccgcctcgcctggcccagacccaggtcgtcgtcctcgcgatcaagggcgacgaagcggttctggccaaggtccgcgagaccggcgaccggctgaaggcggcgggcctgcgcgtccaggtggacgaccgcaccgacgtccccttcgggcgccgcgccgtcgactgggagctgaagggcgtgcccgtacgcgtcgaggtcggcccccgtgacctggagaacggcaccgcgatggtggcgcgccgtatccccggcggcaaggagccggtggcgctggacgcgctggccgcgctgctgcccacggccctcgaggaggaccaggcgctccttctgaggcaggcgcgcgagcgccgcgcatcccgtacgtcggacgtgtcgacgatcgaggaggccgtcgaggcggccgccggcggcggctgggcgcgcattccgtgggcgaccctcggcgagaggggcgaggccgagctggccgagcacgctgcgtccgtacggtgtctggtcgccgaggacgggtcggtgccgggcgccgacgacgcacccggtaacgtcgccgtcgtcgcgcgcgcttac

SEQ ID NO: 2634 - DNA, 861 bp, Streptomyces avermitilis
  CDS (1)..(861)
atgacacctacgctcgtgcggcagcacctacctcacgcggggcccgcgccccgtgtggacccgtgtgcacgcgcgcgtgactgggccgagatccaggagcggatgctggtgccgctctacgaggccgtccacgagcggctcgaggtgggccccggcacccggctgctcgggctcggctgcggttccggtctggccctgctgacggcggcgtcccggggtgccgcggtcaccggtgtcgacacgcgggtgcccgagcggctggccctcgcgcgcgaacggctgctgcccgagtcgcggggcacacgcgcgcgtacggacccgcgcatcgtcgacggcacccccgaggacgcggccgccgctcccggggaacccgggtacaacctggtgaccgccttcgagccgatcggctgcgcgaccggggacgccgaaaggctcggcgaactcctcgccgccgcgacaccgctcgccgggcgcgggacgcccgtggtgctcgccggatgggggccgccggaacggtgcgccacctcctcggtgctgcgcgtcgccacccggctggccgatccgctgcgcggtgcgcgcagttggcgccccgcgctccgcgacgacctcgaggagatcgcccagcgggccggcctcaggccggacgggtcgggacgggtggcgtgccccttcgggtacgccgatgtgaacaacgcggtacgggggctgctgtccacggggctgttcgacccggcgatcacggcgaccggccaggagcaggtggacaaggaagtgacggaggcactgcatccgcatgtgcggcaggacgggaccgtgtggatgccgaacgtcttccgctatctgatcgcccgcacgccccag

SEQ ID NO: 2635 - DNA, 1548 bp, Streptomyces avermitilis
  CDS (1)..(1548)
gtgttcgatactctctccgatcgcctctcagccactttcaagaacctgcggggcaagggacggttgtccgaggcggacatcgacgccacggcccgcgagatccgtatcgcgctcctcgaggcggacgtggccctgccggtcgtccggaccttcatcaagaacgtcaaggagcgcgccctcggctccgaggtctccaaggcgctgaacccggcccagcaggtcctgaagatcgtgaacgaggaactcgtcacgatcctcggcggcgagacgcgacgcctcaggttcgccaagaacccgcccaccgtgatcatgctcgcgggtctgcagggtgccggtaagaccacgctcgccggaaagctcggcaagcacctcaaggaccagggccactccccgatcctcgtcgccgccgacctccagcgcccgaacgcggtcaaccagctcagcgtcgtcgccgagcgcgccggcgtcgcggtctacgcgcccgagccgggcaacggcgtgggtgacccggtcaaggtcgccaaggactccatcgagttcgcgaagaccaaggtccacgacatcgtgatcgtggacaccgcgggccgcctcggcatcgaccaggaactgatgcagcaggccgcggacatccgtgacgcggtctcgccggacgagatcctcttcgtcgtcgacgcgatgatcggtcaggacgcggtcaacaccgcggaggccttccgtgacggtgtcggtttcgacggcgtggtcctgtcgaagctcgacggcgacgcccgcggtggcgccgccctgtcgatcgcctcggtcaccggcaagccgatcatgttcgcgtcgaacggcgagaagctcgacgacttcgacgccttccacccggaccggatggcctcccgcatcctcgacatgggtgacctgctcaccctgatcgagcaggcggagaagacgttcagccaagaagaggccgagaagatggcctcgaagctggcgtccaagaagggccaggacttcacgctcgacgacttcctgtcccagatggagcaggtccggaagatgggcagcatcagcaagctgctcggcatgctgcccggcatgggccagatcaaggaccagatcaacaacctcgacgagcgcgacgtcgaccgcacggccgcgatcatcaagtcgatgaccccggccgagcgccaggagccgacgatcatcaacggctcgcgccgcgcccgtatcgccaagggttccggcgtcgacgtcagcgcggtcaagggcctggtcgagcggttcttcgaggcccgcaagatgatgtcccgcatggcccagggcggcggtatgccgggtatgcccgggatgccgggcatgggtggcggccccggccggcagaagaagaagcagaagcaggccaagggcaagcagcgctcgggcaacccgatgaagcgcaggcagcaggagctggaggaggccgcccgcaaggaggccgcggaccagggcggcaacgcgttcggcctgccccagcagggcggccaggacttcgagctgccggacgagttcaagaagttcatgggc

SEQ ID NO: 2636 - DNA, 2559 bp, Streptomyces avermitilis
  CDS (1)..(2559)
gtgacggcaaggtctggtccatcccggtggacacggccgtccgggtccggaccggcgagcgcggacccgacgcgctgtaaggcaccgacagaacaggagtcgctgggtgacgagtacggacgtacgtacggatgcagaggactcgggacccagcggctacgcggcggcccggctgcgcctcctccagagggggcgcggtccgggccgccgcgccgtgctgccctcgccgaactgaccgacgactggctgaccggcctgttcgacgcgggcggcgcgggaccgcggggcgtgtcactggtcgcggtcggcggctacggccgcggcgaactgtccccacgcagcgacctcgacctgctcctgctccacgacggcggtgaccagggcgcggtcgccgccctcgccgaccgcatctggtacccggtctgggacctcggtctcgccctcgaccactccgtccgtacgcccgccgaagcacgcaagaccgcgggtgaggacctcaaggtgcaactcggcctcctcgacgcccggcacctcgcgggcgacctcgccctgaccgccgggctgcgcaccgccgtcctcgcggactggcgcaaccaggcaccgaaacgtctcccggaactccaggagctgtgcgccgaacgggccgagcggcagggcgagttgcagtacctgctggagcccgacctcaaggaggccaggggcggcctcagggacgccaccgcgctgcgtgcggtcgccgcgtcctggctggcggacgccccgcgcgagggcctcacggacgcccgccgccggctcctcgacgtacgtgacgccctccacctcaccaccggccgcgccaccgacaggctcgcgttgcaggagcaggaccaggtcgccgccgaactcggcctgctcgacgccgacaccctccttcgccaggtgtacgaggccgcccgcgtcgtctcgtacgcgagcgatgtgacctggcgcgaagtggggcgcgtactgcggtcgcgcgccgtacggccgcgtctgcgcgccatgctcggcggcggaaagccggtcgccgagcgctcaccgctcgcggagggcgtcgtcgagcaggacggcgaggtcgtcctcgcccgcaccgcacgccccgaccgcgacccggtactgccgctgcgcgccgccgcggcggccgcccagtccgggctgccgctctccctgcacgcggtccggcgcatggccgccgccgcgcgccccctgcccaccccgtggcccgcggaggcccgcgagcagctggtgacgctgctcggctccggcccctcgaccatcgaggtctgggaggcgctggaggcggagggcctgatcacccgcctgctgcccgactgggaacgggtccgctgtcgcccccagcgcaacgccgtgcacatctggaccgtcgaccggcacctcatcgagacggccgtccgcgcctccgaactggcccgccgcgtcggccgccccgacctcctcctggtgtccgccctgctgcacgacatcggcaagggctggcccggcgaccactccgtcgccggcgagatcatcgcgcgggacgtggcggcccggatcggcttcgaccgcgaggacatcgccgtcctcgccaccctcgtacgccaccatctgctgctcgtcgagacggcgacccggcgtgacctggaggacccggcgaccgtgcgcgcggtcgccgaggtggtcggttcccagagcaccctcgagctgctgcacgcgctgaccgagtccgacgcgctggccaccgggcccgccgcctggtcgtcgtggcggggttccctggtggccgacctggtgaagcgggtctcggccgtgctcgcgggcgacgcccccgaggagccggaggccgccgcgcccaccgccgagcaggaacgtctcgccgtcgaggccttccgcaccggcggcccggtgctggcgctgcgtgcccagaccgaaccgggggccaccgaggccgacaacgcggtcccggacgacccggagcccctgggcgtggagctgctcatcgcggtgccggaccagtcgggcgtactgccggcggtcgccggggtgctcgcgatgcaccggctcacggtccgtacggcggaactgcgggcgctgccgctgccggacggggtcgagggctccgtactgctgctgaactggcgggtggcggcggagtacggctccctgccgcaggccgcccggctgcgtgccgacctcgtccgcgccctcgacggctccctggacatcgcggcccgtctcgccgagcgggacgccgcctatccgcgacgccgcggtgtcgtggcgcccccgccgcatgtgaccgtcgcctcggcggcctcccacctggccacggtcatcgaggtccgcgcccacgacgcccccggcctgctgcaccgcatcgggcgggcgctggagaagtcgggcgtacgggtgcgcagcatgcacgtgtcgacgctgggcgcgaacgccgtggacgccttctatgtcaccggtacgaggggcgggcccctgccgggcgaggaggcggcgacggtggcgcgggcgctggaggagacattgcgcact

SEQ ID NO: 2637 - DNA, 336 bp, Streptomyces avermitilis
  CDS (1)..(336)
atgaagctcatcaccgccgtcgtgaagccccatcggctcgacgagatcaaggaagccctccaggccttcggagtacacggtctgacggtcaccgaggccagcggttacggtcgtcagcggggacacaccgaggtctaccgcggcgccgagtacacggtcgacctggtccccaagatccgtatcgaggtgctggccgaggacgacgacgccgaacagctgatcgacgtcgtcgtgaaggcggcccgcaccggcaagatcggtgacggcaaggtctggtccatcccggtggacacggccgtccgggtccggaccggcgagcgcggacccgacgcgctg

SEQ ID NO: 2638 - DNA, 1338 bp, Streptomyces avermitilis
  CDS (1)..(1338)
atggcaccagccatcacgcttgccgcagaggctcccaagctgtctgccgccaacacaggcttcatgctcatctgttccgccttggtactgatcatgaccccgggcctggccttcttctacggaggcatggtccgcgtcaagagcactctgaacatgctcatgatgagcttcatcagcatgggcatcgtcaccatcctgtgggtgctgtacggcttctcgctcgccttcggtaccgacaagggttcgctcatcggctggacgtccgacttcgtcggcttcaccgggatcggcaaggtggagctctggcccggttacaccattccggtctatgtcttcgccaccttccagctgatgttcgcgatcatcacgcccgccctgataagcggagccctggccgaccgcgtcaagttcaccgcctggtccctgttcgtcgccctgtgggccacggtcgtgtacttcccggtcgcgcactgggtgtggggcaccggtggctgggccttcgacctcggcgtgatcgacttcgccggtggtacggcggtccacatcaacgcgggtgccgcggcgctcggcgtcatcctggtcatcggcaaacgcgtcggcttcaagaaggacccgatgcgcccgcacagcctgccgctggtcatgctcggctgcggcctgctgtggttcggctggttcggattcaacgcaggctcgtggctcggcaacgacgacggtgtcggcgcgctgatgttcatcaacacgcagatcgccaccgccgctgcgatgctcgcctggctcgcgtacgagaagatccgccacggcgcgttcaccaccctcggtgccgcctccggcgcggtcgcgggcctggtcgccatcaccccgtccggtggcgcggtctccccgctcggcgcgatcgccgtcggcgccatcgccggtgtcctgtgcgccatggccgtgggcctgaagtacaagttcggctacgacgactccctcgacgtcgtcggcgtccacctcgtcggcggtgtcgcgggctccctgctcatcggcttcttcgccagcggcggcggccagtccgacgcgacgggcgtcttctacggcgaccactccttcgaccagctgtggaagcagtgcgccggagtcttcgcggtcctcgcctactccctggtcgtctccgcgatcctcgccttcctgatcgacaagacgatcgggatgcgggtttccgaggacgaggagatcgccggcatcgaccaggcggagcacgccgagaccgcatacgacttcagcggagcgggcggcggcgcggcccggatcctccccgcccctctcgcggacacggcgaccaagaaggtggacgca

SEQ ID NO: 2639 - DNA, 1473 bp, Streptomyces avermitilis
  CDS (1)..(1473)
gtgggcggcaacggcggaagcggtacgaacgctgacaggcgccccaatgagcttctgggctcgtggttcgtgcgcagcggctggtcgaagggcgagctcgcacgacaggtgaaccgccgggcccgccagctgggggccagccacatctccacggacacctcgcgggtccggcgctggctcgacggcgagaacccgcgtgagccgattccgcgcatcctgtccgagctgttctccgagcgcttcggctgtgtggtcgccgtcgaggacctcggactgcgcaccgcccaccaggcaccgtctgtgtccggcgtcgacctgccctggacgggcccgcagaccgtggcgctgatcagcgagttctcgcgcagcgacctgatgctggcgcggcgcggcttcctcggtacgtcgctggccctcgccgccggcccgtccctcatcgaacccatgcagcgctggctcgtgcccggccccgccgccccgcgggaggagcccgagcccctggccgcgtcgcgccgcgccggccggctgtccaggcccgagctggacctcctcgaatccaccaccgtgatgttccggcagtgggacgcccagtgcggcggcggcctgcgccgcaaagcggtcgtcggccagctgcacgaggtgaccgacctcctccaggagccccagcccgcggccaccaccaaacgcctgttcaaggtcgccgccgagctggccgagctggcgggctggatgagctacgacgtgggactccagcccaccgcgcagaagtatttggtcctcgccctgcacgcggccaaggaggccggcgacaagcccctcggctcgtacgtgctctccagcatgagccgccagatgatccacctcggccgccccgaggacgccctggaactcatccatctcgcccagtacggcagccgtgactgcgcgagcccgcgcacccagtccatgctgtatgcgatggaggcccgcgcgtacgccaacatgggtcagcccggcaagtgcaagcgagccgtccgcatggccgaggacacgttcgccgacgcgctcgagtccgacgagcccgagcccgactggatccgcttcttctccgaggccgagctgcacggcgagaactcccactcctaccgcgacctcgcctatgtcgcgggccgcagccccacctacgcctccctggccgagcccgtgatgcagaaggccgtcgacctgttcgccaaggacagcgagcaccagcgttcgtacgcactgaacctcatcggcatggccaccgtgcacctgctccagcgagagcccgagcggagtgccgttctggccaaggaggcgatggaagtcgccaaaaaagtgcgctccgagcgcgtgaacactcgtatccgaaagaccgtcgacacggccgtacgcgatttcggcgatctcgccgaggtcggcgacctgaccgcccagctcgccgtccacctgcccgagaccgccgaagcggta

SEQ ID NO: 2640 - DNA, 660 bp, Streptomyces avermitilis
  CDS (1)..(660)
atgggcttcacgatcggcggtacgcgcggaatccgcgaaattcgacccggcgcccggcgccgtggccgctcgtcggagtgcaccgccgtggccgagtacaccggactgtggggctgggacgtcgtcgccggcgcccgggccgcggcgggcgcgtgctcctgcggcagggcggagtgcgtccggcccggcgcacatccgctggacttcgccactcccctgcccgccggcgcgacgctcgacgaggtgaccgaggcctgggccgaggtccccggcgccgccgtgctgctgccggtcggccgcgcgttcgacgtgatcgaggtcgccgaggccgccggacggcacgccctggtccggctggagcgcatggggctcccgctcggcccggtgaccgcgactccggacggccgcgcccacttcttcgtcgccccgggcgcggcggccgaactccccgagttgctctaccggatggcctgggacgacacctccctcgacctgcgcgccctgggccccggtacgtacatcacggccccgccctccgacctcggcggtctcgggccggtgcgctggctgcgctcccccgcgctcgactcggcgacgaacccgcccgccgcgcggctgctcctggggacgctggcctacgtggcgcatcgatcgcgcgcg

SEQ ID NO: 2641 - DNA, 1227 bp, Streptomyces avermitilis
  CDS (1)..(1227)
atggccgatactggacgcgttatggaaaccgtcatccttgctgtagtcatcgccgtggtcgtgctcggcgcgctcggtgggctcgtcatcggcagtcgccgcaagaagccgctgcccccggcgccccccacgacgcccgacatcaccgcccctccggccgagccgcatgtcggcgacgaggccgagcagccgcgcgacgaaccgcgcagaacgatcgaggaggttgatctcccggacaagtcggcggcggcgccggtcgccgtcgaagaggcacccgtcgtcgaagtcccggcgatcgaggtcccggagccgaccgcgggacgcctggtgcggctgcgcacccggctctcccgctcgcagaacgcgctcggcaaggggctgctcacgctcctgtcgcgcgagcacctcgacgaggacacctgggaggagatcgaggacacgctgctcaccgccgacgtcggcgtgcagcccacccaggagctggtcgagcggctgcgcgagcgggtgaaggtgctcggcacccgtacgccccaggagctgcgcggcctgctgcgcgaagagctgctccagctcctcgtccccgagttcgaccgcgaggtcaggaccgactccaacctcgacacccccgggatcgtgatggtcgtcggtgtcaacggcaccggcaagaccaccaccaccggcaagctcgcccgggtgctcgtcgccgacggcaagcatgtggtgctcggcgccgccgacaccttccgtgccgccgccgccgaccagctgcagacctggggtgagcgcgtcggcgcccgcaccgtgcgcggacccgagggcggcgacccggcgtcgatcgccttcgacgccgtcaaggagggcatcgaggagggcgccgacgtcgtcctcatcgacaccgcggggcggctgcacaccaagaccgggctcatggacgagctgggcaaggtcaagcgcgtcgtcgagaagcacgccccgctcgacgaggtactgctcgtcctcgacgccaccaccgggcagaacggcctggtccaggcacgtgtcttcgccgaggtcgtcaatatcaccggcatcgtgctcaccaagctggacggcaccgccaagggcggcatcgtcatcgccgtgcagcgcgagctgggggtgccggtcaaactgatcgggctcggcgagggcgcggacgacctggcgccgttcgagccggaggcgtttgttgacgctcttgtcggagag

SEQ ID NO: 2642 - DNA, 1470 bp, Streptomyces avermitilis
  CDS (1)..(1470)
atgagcaccaccgcatcgaacgatggcgccctcgaaacgcacggcgagtcccacggcctcgaaacccgaggcctagaccccgtcccccactccgagcgcaccgcccgcacccgggaactcctccccacctgggtcgccgccaatatcagcgttctgctcctcagcatgggggcggggctggccgtctcgtacggactgaacttctggcaggccctcgtggtcggcgtcgcggcgccggtcgtgtcgtacgggctggtcggcctcatgggtatcgccggcaagcgcggtggcgcgcccggcatggccctgtcccgcgcggtcttcggccagcgcggcaacctgctccccggcgcgctgatctggatcgcccgctggggctgggagacgatcaacgcggtgaccggcgcctatgcgctgctcaccgtcctgaacatcctcttcggcatcaggagcaacacgttcctgatcatcgtgacactgctgctcttcgtcgtcaccaccttcgtgatctccggcctcgggatcaacgcggtgcgcaggtgcaaccggtgggcgtcctacctcttcgccggcttctccgtgctcgtactcggccatctggtcgtcgacaccgactggggcaaggtcttcgggcaggcggcgggccccacgcccctgatgatcaccggtgtcggcgtgatcgccgcgggcggcatcagctgggctccctcctcccccgacttcacgcgctatctgccgcgtacggcgtcgtctgtggcgatcgtgcgcaacacggtcggcggcgccggcgtcgtcgtcctgcccatggtcctgatgggtgcggtcatggcggtctccacgcccgatctggcctcggcggccgacccggtgtccttcctcggcgagatcctgccgttgtggatcgcggtgccgtacctgctcatcgccctggtcggcatgctgctgatcaacgccatgtcgatgtactcggcgggcttcaccgcgcagaccctcggcttccgggtgccgcggcactgggcggtctccgtcaacgcggtgatctcgctggtcttcggcggtgtcctgatgctggtggcgacctccttcatggggtccttcatcgccttcctgtcgctgctcgcggtcgcgttctcggcctgggtcggcgtgttcggcgcggacatgctgcggcgccgtgagtacgacgccggggccctgctcgacaccacgcgcaccagcgcctactggtaccggggcggcttcagcccggccgcggtcgccgcgtgggcggtcggcctgggcaccgggctgctgttcacgacgtccgactggttcaccggcccgctggcgagcggcaacccggtcggcgagtacgggctcggctgggtggccacggtcgtggtgtccttcctgctgtacgtcgccctgcccaagcccgcgctcccgcggacgccggctcccgccacggaagagcccgcacccctggctgtc

SEQ ID NO: 2643 - DNA, 978 bp, Streptomyces avermitilis
  CDS (1)..(978)
atgcccgtgacggtcgtacgtttcaacctcgtcgagcccggcgcgacgcccgcctcgctcagcgcccgctaccgggcggcgctcgagatggccgcgtacgccgacgaccgcgggatcaccaccgtgcagaccgaggagcaccacggcgtcgccaacaactggctgccctcgccgttcgccttcgcgggcgcggtcttcggtgcgacccggcacatcgcggtcaccgtctcggcggtcatcggccccctgcacgacccgctgcgactggccgaggacatctccgtgctcgacctgctcagcggcggccggctcatcacggtggcggggatcggctaccggcccgaggagtacgccctcttcgacgtcgactggaagaggcgcggcaggctccaggacgagcttctggagaccgtgctgaaggcgtggaccggtgaggagttcgagtaccggggccgtacggtacgggtcaccccgcgcccgttctcggatccgcacccgctcctgctggtcggcggctcctcgaaggccgcggcccgccgtgccgcccgcctcggcctccccttcttccccagcgcgcatctgccggagctggaggcgtactacaaggaccggctcatcgagtacggcaccgagggctggaccatgatgccgtcggccgtgaccccgctgctgcacatcgccgaggacccggaccggacgtgggccgagtacggcgagtacttcctgcacgaggcacggacgtacgcctcctggcagtccgcggagattcgctcggcggtgaagtcggccgccaccacggtcgacgagctgcgcgccgagggtgtctaccggatcctcacgcccgacgagtgcgtggcccagggcctggacaaccatgtcctgcatccgctgtccggcgggatgcccgtcgacgagggctggcgcagcctgcacctgttctgcgaaaacgtactgccccggctcaaggacctcgagggc

SEQ ID NO: 2644 - DNA, 1410 bp, Streptomyces avermitilis
  CDS (1)..(1410)
gtgaccagcacagcgcaggcgcccggagcccgggaagctcatcccgagcatctcggccatgtcatcttcatcgcggcggcggccgcgatgggcggcttcctcttcggttacgacagtgccgtgatcaacggcgccgtcgaggccatccggagcaagtacgacatcggttccgcgaccctggcccaggtcatcgccatcgcgctgatcggctgcgccgtcggcgccgcgaccgcgggccgcatagccgaccgcatcggccgcatccggtgcatgcagatcgccgccgtgctgttcaccgccagcgccatcggctcggcgctgcccttcgcgctgtgggacctcgcgttctggcgcgtcatcggcggcttcgccatcggtatggcctccgtgatcggccccgcctacatcgccgaggtcgccccggccgcgtaccgcggccgtctcggctccttccagcaggccgcgatcgtcatcggcatcgccatctcgcagctggtcaactgggccatcctgaacgccgccggcggcgaccagcgcggcaagctgctgggcctcgaagcctggcaggtcatgctcggcgtcatggtcgtcccggccgtcctctacggtctgctctccttcgcgatccccgagtcgccgcgctatctgatcgaagcgggcaaggacgcgcgcgcccgtgaggtgctcgaagaggtcgagggcaaggagatcgacctcgacgcccgcgtggaggagatcaggctcgccatgtaccgcgaggagaagccgagcttcaaggacctgctcggcggcaccttcttcttcaagccgatcgtctgggtcggtatcggactctcggtcttccagcagttcgtcggcatcaacgtggcgttctactactcggcgacgctgtggcagtcggtcggcgtcgacccgacggactcgttcctctactcgttcaccacgtcgatcatcaacatcatcggcaccgtgatcgccatgatcttcgtcgacagggtcggccgcaagccgctcgcgatcatcggctccgtgggtatggtcatcggtctcgcgctggaggcctgggccttctcgtacgacctcgtcgacggcaagctgccggccacccagggctgggtggccctgatcgccgcccacgtgttcgtcctcttcttcgccctctcctggggcgtcgtggtctgggtcttcctcggcgagatgttcccgaacaggatccgtgccgccgcgctcggtgtggccgcgtcggcccagtggatcgccaactgggcgatcaccgcgagcttcccgtccctggccgactggagcctctccggcacgtacatcatctacacggtgttcgccgcgctctccatccccttcgtgctcaagttcgtgaaggagaccaagggcaaggcgctggaggagatgggc

SEQ ID NO: 2645 - DNA, 3606 bp, Streptomyces avermitilis
  CDS (1)..(3606)
gtgcacctcaaggctctgaccctgcgcgggttcaaatcgttcgcctcggcgaccacgctgcggttcgagccgggcatcacctgtgtcgtgggccccaacggctcgggcaagtccaatgtcgtggacgccctgagctgggtcatgggcgagcagggggcgaagtcgctgcgcggcggcaagatggaggacgtcatcttcgccggcaccaccgggcgtccgccgctgggccgcgccgaggtgtccctcacgatcgacaactcggacggcgcgctgcccatcgagtacgccgaggtcaccatcacgcggatcatgttccgcaacggcggcagcgagtaccagatcaacggcgacacctgccgtctcctcgacatccaggagctgttgtccgactccggcatcggccgcgagatgcatgtcatcgtcggccagggccagctcgactccgtactccacgccgaccccatgggccgccgcgccttcatcgaggaggccgcgggcgttctcaagcaccgcaagcgcaaggagaaggcgctgcggaagctggacgcgatgcgggccaatctcgcgcgggtgcaggacctgacggacgagctgcgccgccagctcaagccgctcgggcggcaggccgccgtcgcccgcagggccgccgtcatccaggccgacctgcgcgacgcccggctgcgactgctcgccgacgacctcgtacgcctgcgggtggcgctccagacggaggtcgccgacgaggccgcgctgaaggagcgcaaggaggccgccgaggccgagctgaagagggccttgcagcgcgaggccctcctggaggacgaggtgcggcagctgacgccgcgtctccagcgggcccagcagacctggtacgagctgtcgcagctcgccgagcgagtgcgcggcaccgtctccctggcggacgcgcgcgtgaagagcgccacctccgtgcccgcggaggagcgccgtggccgcgaccccgaggacatggagcgcgaggccgcacgggtccgggaacaggaggcggagctcgaagcggccctggaggcggccgagcgggcccttgaggacacggtcgagcaccgggccgagctggagcgggaactggcggtcgaggagcggcgcctgaaggacgtggcgcgtgccatcgccgaccggcgcgaggggctggcccgcctcaacgggcaggtcaacgcggcccgttcccgggcggcctccgcccaggccgagatcgaccggctcgcgtccgcgcgggacgaggcgcaggagcgcgcggtcgcggcgcaggaggagtacgagcagctcaaggacgaggtcgacgggctggacgcgggcgacgcggacctggcggagcggcacgaggcggcgaagctcgccctgtccgaagcggagtccgccctgacggcggcccgtgaagcggtcacggcggcggaacgcaggcgcgcggcgacggcggcccggcgcgaggcgctggcgctcggcctgcgccgcaaggacggtacgggcgcgctgttgggggcgaaggatcgcctcggcggcctgctgggaccggccgccgaactgctgtcggtgactccgggctacgaggttccgctcgccgcggcgttcggcgtcgccgcggacgccatcgcggtgtcgacaccggcttcggcggccgaggcgatccgcctgttgcgcaaacaggacgcgggccgggcggcgctgctgctgggcggcgcccccgacgacgtacccgcgccggaaccggaacacgcccggcggccgggtgccgcgcacaccgacgtaccccctgcggagcaccgcggcggtccgccgtacgcggccgatctcgtccgtggccccgccgaactgatgcccgccgtacggcgtctgttgcgcggcatcgtcgtcgtcggcaccctcgaggacgccgaggacctcgtgtacgcgcggcccgggctgaccgccgtcaccgccgaaggcgacctgctcggtgcgcacttcgcgcacggcgggtccgccggggcgccgagtctgctcgaggtgcaggcgtccgtcgacgaggccgcggccgagctggaagagctcgccgtgcggtgcgaggagctgaccggggcgcagcgcctggccgccgagcggcgcacggaacgggcggcgctggtagaggagttgggggagcggcggcgctccgccgagcgggagaagtccgccgtcgcccagcagctcgggcggctggccgggcaggcgcggggcgcggcaggcgaggccgaacgcaccgccgccgccgtcgcgcgggcgcaggaggcgctcgaccgcgccgtacaggaggccgaggaactggccgaacggctcgccgtggccgaggagatgcccgtcgaggaggagccggacacctccgtacgcgaccggctcgccgccgacggggccaacgcgcggcagaccgagatggaggcccgcctccaggtgcgtacgcacgaggaacgggtcaaggggctcgccgggcgggccgactcgctcgaccgggccgcccgcgccgaacgcgaggcacgcgcgcgtgccgagcagcggcgggcgcggctcagacacgaggcggccgtcgccgaggccgtcgcctccggtgcgcgccagctgctcacgcacgtcgaggtctccctcggccgggccgacaaggagcgcaccgccgccgaggccgccaaggcgcgccgggagcaggaactcgccgccgcccgcggcaccggccgcgacctgaaggcggagctggacaagctcacggattccgttcaccgtggcgaggttctcggcgccgagaagcggctgcgcatcgagcagctggagtcgaaggcgctggaggaactcggtgtggaaccggcggggctcgtggcggactacggccccgatcagctcgtgccgccctcgcccgcggccgagggcgaggaactccccgacgacccggagcacccgcgcaaccggccccggccgttcgcgcgggcggagcaggagaagcggctcaagtcagccgaacgggcgtaccagcagctgggaaaggtcaacccgctcgcgctggaggagttcgccgcgctggaggagcgccaccagttcctcagcgagcagctggaggacctcaagaagacccgtgccgacctgcttcaggtggtgaaagaggtcgacgagcgcgtcgaacaggtcttcaccgaggcgtaccgggacaccgcacgggagttcgaaggagtcttcggccggttgttcccgggcggtgaggggcggctgatcctgaccgatcccgacaacatgctcaccacgggcgtggacgtcgaggcgcggcccccgggcaagaaggtcaagcggctgagtctgctctccggcggggagaggtctctcaccgccgtcgccctccttgtgtcgatcttcaaggcgcggcccagcccgttctatgtgatggacgaggtcgaggcggcgctcgacgacaccaacctgcagcggctgatccggatcatgcaggagctccaggaggcctcgcagctgatcgtgatcacgcaccagaagcgcacgatggaggtcgccgacgcgctctacggcgtctccatgcagggtgacggggtgtcgaaggtcatcagccagcggctgcgc

SEQ ID NO: 2646 - DNA, 279 bp, Streptomyces avermitilis
  CDS (1)..(279)
atgaacgaggacgtgaggctcgtcgcgtgggtgcgcggacgtgtgcaaggtgtgggtttccgctggttcacgcgggccaaggccttggagatcggcgggctgagtggttttgctctcaatttggacgacggacgggtgcaggtcgtcgcggagggtgcgcgcgagggttgccaggggctgctcgactggctccagggggacgacacgcccgggcgggtggacggtgtcacagagatgtgggacacaccccgcggcagctacgacggcttcttgatccgc

SEQ ID NO: 2647 - DNA, 933 bp, Streptomyces avermitilis
  CDS (1)..(933)
atgggacgccaccgacgctccgccgccggccgcgccgccaccggccgcaccagcgaggtcaccaagcctcgcggcgacagcaccgagagctacggcccggagaacctgtacggcttcgccgcggttctcgaggccgagcgcgaacagcgttcccaccgtaagaagaaggtcgcgacgcccgtgcgcaccgggctgctcggcgtctccgcggccgtcgccctgggcacggtggcggtggccgccggagtactgccgggcggcggcaaatacacggtcggcgactccgactcggtgcaggccggcggttccccctcgggcttcgagacccagcagggcggcacgaacggcaccgcggacgaccgcgagtccacgtccacgagccgcggctccgaccgctcggcctcgccgtccgccgccccttcgactccgtcgaagaagccgtcgacgacgactccctcgaagaagcccgccccgacggcgacccagtccaggacggccactccgccgagcaaggcaccgaaggctccggaggccagcgcctcggtgacggtgtccaccgagaccgcggtcgcggccgaggtgctcaagctagtcaacgaggagcgggccaccgcgggctgcagcccggtggcggcgaacagcgcactgtcgcagctggcgacggccttcagcgaggacatggccgcgcgtgacttcttcgaccacaccgaccccggcggcaacgacccctgggaccgcgcggcgacggcaggtgtcaccggcctcggcggcgagaacatagcccgcggccaggccaccgccgaggccgtgatggagtcgtggatgaacagccccggccaccgcgcgaacatactgaactgcgacttcaagacgctgggcgtgggagtgcacttcggcgcgggcggcccttggtggacgcaggacttcgggtac

SEQ ID NO: 2648 - DNA, 621 bp, Streptomyces avermitilis
  CDS (1)..(621)
gtgaagtgctgctcgatccgctgtcaaggagtccccatcgtgaccacgcccgtcgtttccatcgccttccactccggccacggccacaccgccgtcctcgccgaggccgtacgcagcggtgccgtcgaggccggcgcccaggcgcacctgatcaacgtcgacgagatcaccgaggagcagtgggcggtcctcgacgcctcggacgcgatcgtcttcggctcgcccacctacatgggcaccgcgtccggcgccttccacgtcttcgccgaggcgtcctcgaagcggtggttcgggcaggactggaaggacaagctggccgccggcttcaccaactccggctccaagagcggcgacaagctgcacacgctccagttcttccagatcctggcggcgcagcacggcatgaactggatcaacctcggcctgcacccgggctggaacagcagcacggccgccgagaccgacctgaaccgtctcggtgtgttcgccggcgccgccgcccagacgaacatcgacgagggccccgaggccgtccacaaggccgacatcgccaccgccgagcacctcggccgccgggtggcggaggcggcgcgggtgttcgcgctggggcgtgcggcggcg

SEQ ID NO: 2649 - DNA, 411 bp, Streptomyces avermitilis
  CDS (1)..(411)
atggaacccatcgcgcagcccgcccagggcatcgagaacggcgactgtccgggtctcgcgtacgacgtgttcgcccgcagctgcccgtcccggggcacgctggagcacgtcaccggccgctggggcgcgctcacgctgggcgcgctgcacgacggctcgttccgcttcaacgagttgcgccgccgtgtcgacggcgtcagcgagaagatgctgtcccagacgctgcacgcgctggagcgcgacggtctggtgcaccgcgacgcccaggccacgaacccgccacgcgtcgactactcgctcaccccgctcggtcgcgacgtcgccgagcgcctgctgacgctcatccggttcgtggagggccgcatggacgaggtactggtggcacgggagcgctacgacggggcccgcgcg

SEQ ID NO: 2650 - DNA, 1311 bp, Streptomyces avermitilis
  CDS (1)..(1311)
ttgtgggttttgtccttatttggctggagtcagcccatgacgcactcgaccgtacgactgcgcaggggcgccgtgaccgccatagcggtagggacgctcatggtgccgttcgcgggcggggccgcctcaggtgcgccggcctccgccaccgccgccgccacagcctccgccaccgccgtcgagccgcccacgccgtccgattccgcgtcggcttccacgggtgatttccgcaccctcactcctgccgtgacgaagcaggtcgacgaggccgtgcggcgggtcatgcgcgaggcgaacgtgcccggggtgaccgtgggcctgtggacgtccgaccaggggcagcacgtacggtcgttcggggtcgcggacaagagcggcggcgagcggatgtcgccggacctgtacatgcggatcggcagcgagaccaagacgttcaccgtgacggcgctgctggagctggtggacgagcacaaggtgggcctggacgatccgatcggcaagtacgtcgacggtgtgcccaacggcgacaagatcaccctgcgcgagctggccgggatgcgcagcgggctcttcaactacaccgaggacgacggcttcttcaaggcgctgacgtccgacccgcggcgcccgttcacgccgcagcagctgctcgactacgccttcaagcaccctgtgctgttcccgccgggcgagaagttctcctactgcaacaccaacctcatcctgctcggcctggtcgtcgagaaggcaggcggccggccgctcggagacttcatacggcagaacgtcctggagccggccggcatgaaccacacgtccctcccggccgacgcggctttcccgaacccgcacgcgcagggatacacggaccagaccgcgaccggcgaggtcgagaacgcgaccgactggaacccctcctggggttgggcggccggcgcgatgatctccgacctggacgatctgcgcacatgggcgcgcacggtggccacgggcatcctgcccgacggtgacagcctgatcagtcccgtcacgcagaagcaacggctcaacacgccccccaccacgatcccgggggccggatacggcctcggcatcttcaacgtccagggctggatcgggcacaacggctcactgccgggctacgagtccctgaccatctatctcccgtcggcgcaggcaaccctcgtcgtgctgctgaacaccgacatcaaccacgccggcaccgagcccagcacactcttcggcgaggcgatcacgaagatcgtcaccccggggcacgtcttcaacctgcccgcacagcccgcagccagg

SEQ ID NO: 2651 - DNA, 858 bp, Streptomyces avermitilis
  CDS (1)..(858)
atgcccgaattgcccgaggtcgaggttgtacggcgaggcctggagcggtgggtcgcccaccgcaccgtcgccgatgtcgaggtgctgcacccacgtgccgtacgacgccacaccgcgggcggcgaggacttcgcgcaccgcctgaagggccggcgggtcggggtgccgagccgccgcggaaagtacctctggctcccgttggagacgaccgacacggccgtcctggcgcatctcggaatgagcggtcagctgctggtgcagccgcacgactgtgccgacgagaggcatctgcgcatccgggtgcgcttcgccgacgccctcggcaccgaactccgcttcgtcgaccaacgcaccttcggcgggctctcgttgcacgacaccacgcccgacggtctgcccgacgtcatcgcgcacatcgcccgtgacccgctcgacccgctcttcgacgacgccgccttccacgaggcgctgcgccggaagcgtacgaccgtcaagcgggccctgctcgaccagtcgttgatcagcggcgtcggcaacatctatgcggacgaggcgctgtggcgggcgcgcatccactacgagcgccccacggccggcttcacgcgcccgcgtacggccgaactcctgggccacgtacgggatgtgatgaacgcggccctcgccgtcggcggcaccagcttcgacagcctgtacgtcaacgtcaatggcgagtccggctacttcgaccgctcactcgacgcctatggacgtgaggggttgccctgccggcgctgtgccaccccgatgcggcgacggccgtggatgaacaggtccagctacttctgccccaagtgccagcgggcgccgcgcgtcaccgtg

SEQ ID NO: 2652 - DNA, 828 bp, Streptomyces avermitilis
  CDS (1)..(828)
atgtctgacgccaaggcggactcaaccgccaagaaaaaggcggacaacacagcctcgtcccacacgcttctggaagggcggctcggctacaagctcgagtccgcccttctggtgcgtgcgctgacccaccgttcgtacgcgtacgagaacggcggcctgcccaccaacgagcgtctggagttcctcggggactccgtactcggcctcgtggtcacggacacgctgtaccgcacccaccccgacctcccagaaggccagttggccaagctgcgggccgcggtggtcaactcacgtgcgctggcggaggtcggtcgcggactcgaactgggctccttcatccggcttggccggggcgaagagggcacgggcggccgggacaaggcatccatcctcgccgacacccttgaagcggtgatcggcgcggtctatctcgaccagggtctcgaagcggcgggcgaactcgttcaccggctcttcgatccgctgatcgagaagtcctcgaatctgggcgcgggcctggactggaaaaccagcctccaggagctcaccgcgaccgaggggctcggcgtgcccgagtacctggtcacggagaccggcccggaccacgagaagacctttactgctgccgcccgcgtcggaggcgtctcgtacggcaccggcaccggccgcagcaagaaggaagcggaacagcaggccgcggagtccgcgtggcgtgcgatccgctccgcggcggacgaacgcgcgaaggcagccgcccaggccgctcagacggcggccgaggccgccgagcgcgcccagggaaacgccgacgcgtcctcggcgtccgcc

SEQ ID NO: 2653 - DNA, 171 bp, Streptomyces avermitilis
  CDS (1)..(171)
gtggctgttccgaagcggaagatgtcgcgcagcaacacgcgccaccgccggtcgcagtggaaggctgcggtccccaccctggttgcgtgcgagcgctgccacgagcccaagctgcagcacattgcgtgcccgtcttgcggcacttacaacaagcgccaggtcctcgaggtc

SEQ ID NO: 2654 - DNA, 651 bp, Streptomyces avermitilis
  CDS (1)..(651)
atggccctgaacgcccgcctcgaccaccgcaaccctctcgtgttcgacacacacgagctggggcggcgtcctggcgcgctgcagcgcctgacccgcacgatcgacgctccccgggatctcgggatccagggagtcatcggagtgccggaaggcgcgccggtggagctcaggctccgcatcgagtcggtcatggaaggggtgcttgtcacaggcaccgcccgtgcacaggccgagggggagtgcgtaaggtgtctggagccgcttgagcagcagctcgaagcggacttccaggagatgttctcgtaccctgacgccgacgaccggggccgcgaaaaggcggagccggtcgacgacgccgaggaagacgaggacaggctctttctcgaggacggcctgttcgacctcgaaaccgtgctgcgtgacgcggtggtgcttgcactgccgatgcagccggtgtgccaggacgactgcccgggcctgtgctccgaatgcggagcccggctcgcggacgacccggaccaccaccatgacgccgtcgacatccgttgggcggcactgcagggactcgccggttcactcgaagacggcgagaaggacgagatgagcggcggcgcgcttccatcagcgcacgtcgacgagaagcaggagaag

SEQ ID NO: 2655 - DNA, 1089 bp, Streptomyces avermitilis
  CDS (1)..(1089)
gtggacgtgcagaagaagcttgatgagatcgtcgcggcggtctccggcgcccggtccatgcccatgtcggcctcctgcgtggtcaaccgcgccgagctgctctcgatgctcgaagaggtgcgtgaggcgctgcccggctccctcgcccatgcccaggagctgatcggcgaccgcgaacagatggtcgagcgggcccgccaggaggccgagcggatcatcgagaccgcacacgccgagcgcggctccctgatctccgacaccgaggtcgcccgccgctcccggaacgaggcggaccgcatcctctccgaggcccgccaggaggccgaggagatccgcaccgaggccgacgactacgtcgactccaagctcgccaacttcgaggtcgtcctcaccaagaccctcggctccgtcggccgcggccgcgagaagctcctcggcaccgggcccggcgtcgacgaacagggattcgaggacgaggacgcccccgagcgcagccacgaccccgagaccctgcgccacaacgccgacgcctacgtcgacgtcaagctcggcgccttcgaggccgtcctcgccaagaccctggaggccgtcggccgcggcaggcagaagctgcacggccgcatcgccagcgacgacctgggcgccctcacggacgacggaacgcccgtccagcacaccagcgacgccgactacctggccggtctggcggacctcggcaacacccccgaccagccctcggcaccgccccagaccccccaggcccctgagatcccggctcagccgcagtacggcgggcaggacgcctacgcgtaccagcagcagacccccgatccctacggctaccagcagcagtacggccagcaggacgcgtacggctaccagccgacggccgacccgtacgccgcgtacccgcagcagggctacgaccagcagacggcgtacgaccagaaccagcagcagggctactcccagccgcagacgcacgactcccagccgcaggcacacgacctggacgaggccagcctcttcgacaccagcatgatcagtgcggagcagctgcgggcctacgaacaggggcgcggcggtcac

SEQ ID NO: 2656 - DNA, 477 bp, Streptomyces avermitilis
  CDS (1)..(477)
ttgcgccgcgccgtctgtcccgggtcattcgacccgatcaccaacggacatctcgacatcatcgcccgcgcctccaagctgtacgacgtggtgcacgtcgcggtgatgatcaaccagtccaagaagggcctgttcgaggtcgacgagcggatcgagctgatccgccaggtcaccgcggaattcgggaacgtcgaggtggagtccttccacggcctcctcgtcgacttctgcaagcagcgcgacatccccgcgatcgtcaagggcctgcgcgccgtcagcgacttcgactacgagctgcagatggcccagatgaacatcggcctctcgggcgtggagaccctcttcgtccccaccaaccccacctacagcttcctgtcctcctcgctcgtcaaggaggtggcggcctggggcggcgacgtctcgcatctggtgccgccggcggtcctggaagccctcaacgggcgcctcaagcaggac

SEQ ID NO: 2657 - DNA, 585 bp, Streptomyces avermitilis
  CDS (1)..(585)
atgacccgcgtgatcgccggtcgggccggcggacgccgtctggccgtcccgccgggcaacggcacccgtcccacctccgaccgcgcgcgcgagggcctcttctccacctggcaggccctcctcggcggcccgctggacggcgagcgggtcctcgacctgtacgccggctccggcgccgtcggcctggaggcgctcagccggggcgccgggcacaccctcctggtggaggccgacacccgcgcggtccgcaccgtccgcgagaacgtgaagtcgctgggcctccccggcgccgaggtcagagcgggcaaagcggaacagatcgtccagactccggcgtcggcggacccgtacgacatcgtcttcctcgaccccccgtacgcggtctcggacgacgatcttcgcgagattctgctcacactccgcacggggggctggctcgcgggcgaagccctcgtcaccgtggagcgcagcaccagaggcggcgaattccggtggccggacggcttcgagccgatccggtcccgtcgttacggcgagggaacgttttggtacggtcgcgccgcctctacgtgcgaagacgcacga

SEQ ID NO: 2658 - DNA, 3225 bp, Streptomyces avermitilis
  CDS (1)..(3225)
atggatctcgtgcccgcgctcgaagaaccactgaagaaggtgctcggacccgccaccgcgaaggtgatggccgagcacctcggcctgcacaccgtcggagacctgctgcaccactatccgcgcaggtacgaggagcgcgggcagctcacccacctcgccgacctgcccatggacgagcatgtgacggtggtcgcccaggtcgccgacgcccgcctgcacaccttcgcctcggccaaggcaccccgcggcaagggccagcgcctcgaagtgaccatcaccgacggcagcggccgcctccagctggtcttcttcggcaacggcgtgcacaagccgcacaaggacctcctgccgggcacacgcgcgatgttctcgggcaaggtctccgtcttcaaccgccgcctccagctggcccatccggcgtacgagctgctgcgcggcgccgacgacgaagccgcggagagcgtggacagctgggccggcgccctcatcccgatctacccggccaccgccaagctggagtcctggaagatcgccaagtccgtgcagacggtgctgccgagcgtccaggaggcgctcgacccgctccccgactccctccgggacggccgtggcctgatctccctgcccgaggccctcctgaagatccaccgcccccacaccaaggcggacatcgaggacgcccgcgcccgcctgaagtgggacgaggccttcgtcctccaggtggccctggcccgccgccgccacgccgacgcccaactcccggccgcggcaaggaaacccaagcccgacggcctcctcaccgccttcgacgccaagctccccttcaccctcaccgaaggccagcagaaggtctccaaggagatcttcgacgacctggcgaccgagcacccgatgcaccggctgctccagggagaggtgggttccggtaaggctcagcccctcgactcgctggtgctggcccccacgggtttccgacggatgggagacctgcgggagggcgacgaggttgtcgtgcccaacggagagatcgcactgatcgacggggtattcccccagggagtgcgtgacgtctggcgcatcgttctctccgacggaagttccgtggagtgcgacgacgagcacctctggatcgtcggtacgagttgcgggtggcatcgtggccagacgcccaaggtgatgaccacgcgggagatccgcctcgacacgttcaaggcgaacgggtcgtcaaagtggtacgtccctgccgcgaccccggtcgacctgggaccggatgtcggcctgccactggatccctatcttttcgggctgctgttgggcgacggctcattccgacacaatctgcgtttgtccacggtcgatgacgagatccgcgacgctgcggcggatgccgtggcacctgactgccggctggttcccgtgacgggttcccgctgcgactacaccatccagctgaagcagcgctccggcggtgtgcggaatcctgtcatccaggctctgcgcaggctggatctgtggggtaagacgtcccacggcaagttcattcccgaggacttcaagaacacgtcgatcaagaaccgtctctcgctcctgcaagggcttctggacactgacggcacggtgcacgcggatgggatgagcgtctctctccgctccgcatcgctcagactcgcagaggatgtcgcctggctcgtgcgttcgctggggggccgggcgcgagtgctgcccgagaaggccgcgttccatgtgtcggtggcgctccctgatgagtacgcgcccttcaggctgtcccgtaaggccgatcgcgtgcgcccgcgcccgaaatacaacacattccgacgaggcattcgagccgtcgagtacgtaggtcgcaaaccggcccagtgcatcagtgtcggtcacccgagccacgcttatgtcactgacaacttcacagtgacccacaacaccatggtggcgctccgcgccatgctcgccgtcgtcgactccggcgggcaggccgccatgctcgcccccaccgaagtgctcgcccagcagcaccaccgctccatcacggagatgatgggcgagctggccgagggcgggatgctcggcggggccgagcactccacgaaggtcgtgctgctcaccggctccatgggcgccgccgcgcggcggcaggccctgctcgacctcgtcaccggtgaggccgggatcgtcatcggcacgcacgcgctgatcgaggacaaggtgcagttccacgacctcggtctggtcgtggtggacgagcagcaccgcttcggggtcgagcagcgcgacgccctgcgcggcaagggcaagcagccgccgcacctgctcgtcatgaccgccacgcccattccgcggaccgtcgccatgaccgtcttcggcgatctggagacctccgtcctcgaccagctccccgccggccgctcgccgatcgccagccatgtcgtcccggccgccgacaagccccacttcctcgcgcgcgcctgggagcgcgtgcgggaggaggtcggcaagggccatcaggcgtacgtcgtgtgcgcccgcatcggtgacgaggaggacgaccccaagaaggccaagaagaagtccccggaggacgaggccgagaagcggcccccgctcgccgtcctggaggtcgcggaccagctcgccaagggcccgctccagggcctgggggtggaggtcctgcacgggcggatgccgcccgacgacaaggacgccgtgatgcgccgcttcgccgccggcgagagggacgtcctggtcgcgacgacggtcatcgaggtcggggtgaacgtgcccaacgccaccgcgatggtgatcatggacgcggaccgtttcggcgtctcccagctgcaccagttgcgcggccgcgtcggccgtggctcggccgccgggctctgtctcctggtgaccgagatgcccgaggcgagcccggcccgccagcggctgaacgcggtggcgtccaccctcgacggcttcgagctctcccgcatcgacctcgaacagcgccgcgagggcgacgtcctcggccaggcccagtccggcgtccgctcctcgctgcgcatgctcgccgtcatcgaggacgaggagatcatcgccgaggcccgcgaggaggcggccgcagtggtcgccgccgacccggagctggggcacctcccgggcctgcgcaccgccctggaggccttgctggacgaggagcgcgagcagtacctggacaagggc

SEQ ID NO: 2659 - DNA, 1836 bp, Streptomyces avermitilis
  CDS (1)..(1836)
atggactcccagacctcacagtcatcccaggcatcccagtcaccgcatacgttccaggtcgacctgcgcggcctcgtggacctcctctcccatcacctctactccagtccgaaggtctatctgcgcgagctgttgcagaacgccgtggacgcgatcaccgcccgccggaccgagcagcccgaagcgcccgcgcgggtgcgcttgtacgcggagggcggcaccctgcgtgtggaggactccggcgtggggctcaccgagtccgacgtgcacagcctcctcgcgacgatcggccgcagttccaagcgggacgacggcctccaggaggcccgctccgactttctcgggcagttcggcatcggactgctggcgtgcttcgtggtcgccgagcgcatccgggtcgtgagccgcagcgcgcgtacgcccgacgcggcgcccgtggagtggacggcggccgacgacggctcgtacaccgtgcggacgctgccgcacgaggcgcgccccgagcccggtaccaccgtgcacctggtggcacgggccggggccgccgactggctgtccgcggagcgggtcctgtcgctggcgcgggacttcgggtcgctgctgccgtacgacgtccgggtgggcgacgaggcgatcaccgatctgccggcgccctgggaccgctcgtacccgagccccaccacccgcagggtggcgctggcgcggcactgccacgacctgttcggcttcacgcccctggactcgatcgagctgaacgtgccgctcgccgggatccggggcgtggcgtacgtgctgccgtccgcggtcagccccgcccagcgcgcgagccaccgtgtgcacctgaagggcatgctgctcaccgagcgcgccgaacagctgctgcccgactgggcgttcttcgtgcgctgcgtcctggacacggacagtctgcgccccacggcctcgcgcgagtcgctgtacgaggacgagacgctggcggcggtgcgggaggcgctgggcgagcggatacgggcctggcttacgggtctcgcggccggtgacccggatcgtctggcggccttcctctccgtgcactacctgggcgtgaagtccctggcgcggcacgacaaggagatgctgcgcacgatgctgccgtggctccccttcgagacgaccgacgggcggctgtccctggaggagttcgcgcagcggcacccggtggtgcacttcacgcggaccgtggaggagtaccgccaggtcgcgccgatcgcgtccgcgcagggcgtcggggtcgtcaacggcggctacacgtacgacagcgagctggtggaggcgctgccctcggtccgcccgggaacggtggtggccgagctggacgccgacacggtcaccgcccacctggacgcggtcgacccggccgaggagctggcgctgtccggcttcctgtccgcggcccgcgccaagctcgatcccctgggctgcgacgtggtcctgcgttccttccacccgctgtccgtgccggcgctgcacctggacgaccgggcggcccgtcacgagcaggcccgcgcggaggccgaggagcaggcggacgacctgtgggccggcatcctcggctccctgcggggcagtgccccacgcgcgcgtctggtgctcaaccacctcaacccgctgatccggcggatcagttccctggacgaccgggagctgatcggcacggccacggagtccctgtacggacaggccctgctgatggcccagcgcccgctgcgcccggccgactccgcgctcctcaaccgcgctttcataggcctcctcgaatgggccacccaccccagcttcccggaggacggtgcccga

SEQ ID NO: 2660 - DNA, 2973 bp, Streptomyces avermitilis
  CDS (1)..(2973)
atgggccacccaccccagcttcccggaggacggtgcccgatgagccagaccatggacttcgacacgctgcgccgggcgatggcggacaactacgagcagccggagggccccgcccgcaacgcgcgcgcggagcagctgctcaccgaggcggagaagctgaacatcccgctcgccgtgatcgaggcgctcgggcaccagctgaaggtctacaactacagctccgagaaggacaagatgttcgtccccttcgcgcgtctgctgcgcatgtgggacgagcggcccgaggacttcgacgagtacgagatccactcgctgcactgggtcttcaagtggatgtcggcgggcatgctgggccagccgcacatcccgctcgcctccatagagaagtggctcggcgagatggagcaccgctaccgtctggccggccactccgaacgagcggtgcgcagcgccgagttcagcgtcgcgaaccacatcggggacctggcgcgcgccgaacgggcgtacgccgcctggctggccgccgaccgggacagcatggccgactgccacgcgtgcgagctgcacgaccagggctggtggcaggcgcgcaagggcgcggacgccgacgccctggaggtgtggcgcccggtcgtggagggcgagtacgtgtgcgcccacgagccgcacgcgatcctcgcctcctccctggtgccgctgttgcgcctgggccgcctggacgaggcgcgggcgcaccacctgcgtggcttcaggctgatccgcccgatggagagcatgcgcggtgcgtacgcggaccacgtggagttctgcgcgctctccggcaacgaggcacgcgccctcgaactcctggccgagcggcccgcctacttcacggactccggagagccgcgcagcaagctggacttcatggccgtggtggccctgctgatggaccggctcgtcgaactgggcctcggcgagcagacggtccccggtccggccggccgtgtgtggagcgcgcgcgaactcgccgcccacgcgcgcgcggaggcgctcgcgctggccgcccgtttcgacgagcgcaacggcacggcccacgtcagcgagcgcgcccgcgagcggatggaccggcgcccgctggtggaccggctgccgctgggcgtgcgctcgacgcgcccggcaccgacggcgccccggccgccggccgccccggactccgccccggccccggccgtggaacgggatctgcgggacgtactggccgaggcacgcggccgctcggacgcgctgcgcccggacgccatggacgcgtgggcggcggtggcacgcgccgccggggaccacgagctggacgcccgcgaccgcgcggagatcgccgaccacgaggcgatgagccgcggcccggagggcgccccgctcttcgaacgggcggccgagctgtacgcggaggcgggcgaccccggggaggcgctcgcggcacgcgcgcgtggagcgtacgtacgcgccctgacggggcactccgacgacgcgctgcggacgatcaacgacctgcaccggcaggtccgcgccctgttcgcaaaggacgggaccggggtgcggcagacggcggccgtgctggtgggacgggcgcgcattctggtgcaccgggtgcatgagacggagggcgcgggcacgaccgtggccgccgccgaggaggccgtacgggagctgctggagttcgccgagccgcacatcgcacaggtgcggctggcctcgcgggccgccgaggcgcgggcgatgctcggggagctggcggcactcaccggggacgcgatgacggcggcggagctgctggctcaggcggcggaaggtttcctcgccgccgggctgccgtggttcgcggtggaatacgaggcgcggctcgccgggatcgcccgggagctcggcgacgcggtggaggcggagcgggcggcgcgctcggcgctggagcacggtgtggagtacctggagccggcgggacaggcgcaactgcatctccagctggccgaagtgctgggcacgacggggcagttcggtcccgccgcggagcacgccctggaggcggcgcactgggccgacgaggcgggcgagggcccgacgttcggcgcctgggcacggcaccagctgggtggtttcctcctccagcaggggcggtgggccgaggcggcggaggtgctggagtccgcgctgcccgatctgaccgccgagacgcacggcgacggggcgctcgtgcagacccagtggtggctcggcgactgccacaccgagctgggggagcaccgggaggccgcggagcgctggctgcgggccgcggagatcgcccggcactggccggagcagcgtgaccacgcgatgctggcgcatctggccgcggaggccctcggccacgcgggcctgccggccgaggcggaccgggcgtacacgcgggccggtgacctctggcgcgacctgggcaacgtccacggcctggcacgtgccctgcgcgcccgcgcctggctcgcggcgcgggaggaggacgaactcgacccggcgcgggagctgatggcgcaggcggtgcgggagtgcgaggcggcgctggagggcgccaccgagggcgaggacggcgcgcgggagcgactcgtcgccgaactcggccacacccaccggcagttcggcgacctcgtcgcacggtcggtgcaggacggggaccggggcgccgacttccagggggcgttcgaggaggcgctgggccacgtcacgcgggcggtcgcggtgttcgcaccgctcggcgcgagcgcgctcgacctgcgtacgggcgcggaactggcggcgggctggctggaggccgacctccaccgccccgccgaggcgaccgcacgcgcgcgtgcggtcctcgcggcctacgcgaaccggcaggaggcggacgacgagacagcacgggcgcggtgcgcggaggcggaccggatgctggagctgctggggacgcggacgggacag

SEQ ID NO: 2661 - DNA, 1713 bp, Streptomyces avermitilis
  CDS (1)..(1713)
gtgccgcaggtgccgcagacattcgatgctctcgcggtgcgcacctggtgcggtctcgcgcttcaggcgctggggcgggcgcgggcggagatcgacgccatcaacgtctatcccgtggccgacggggacaccgggacgaacctctatctgaccgtggagtcggcggccacggcggtcgaggcggtcttcgccgggcacgacgccatgggcgccgtgggcgggacatccgacgccgcttccgccgggccggggcggccgacgctcgccgacgcggtccaggccatggcgcacggtgcgctgattggcgcccgcgggaactccgggacgatcctcgcgcagctgctgcgcggtatggcccaggtgctcgccgccgacagtgagaccgcgcacaccgacgggcagggcctgcggctcgcgctgcggcacgcggccgactccgcgcgcgaggccgtcgcgcaccccgtggaaggcaccgtcctcaccgtcgcctcggccgccgccgacgcggccaccggggccgaggacggctgcgggtcggtcgcgcgcgcggcgtacgagggtgcctgtgcggcgctggcggcgacacccggtcagctggccgtgctgcggcgtgccggggtcgtggacgcgggcgggcgggggctggtggcggtgctggcggctctggtgcagaccttcacgggggaggcgccgggagcctcgggggccgtcgtccacgcgcgcgtggacgacgaggccgcggcggggcgtcccgacgcgggggagtgcggggacggacccccggcggagggcgggcccgcgttcgaggtgatctatctgctcgaagccgatgacgcggccgtgggccggctgcggtcccggctcgacgggctgggggagtcgctcgtggtggtcggcggggacggcctgtggaacgtccacgtgcacgtcgacgacgccggtgccgccgtcgaggccggggtcgaggcgggacggccgtaccggatccggatcacccacttcgcggccggggacgtgcacaccggcggcgccgggcgaccgccgcgggaaccggctcagcgggccgtggtggccgtggtgccgggggaggggctggccgggctgtacgcggaggccggggcgaccaccgtgctggcgcgggccggggagccaccggtgagcggagagctggtggacgcggtgcggcgggcgcacgcgcgcgaggtggtcctgctgccgaacgacgcggagctgcgccacacggccgcggcggccgcggagcaggcgcggacggaaggggtgcgggtcgcgctgatcccgacccgctcggcggtgcagggcatcgcggcgctcgccgtgcacgagccggagcggcgcttcgacgaggacgtggtggcgatgacgtcggcggcgggagcgacccgctacgccgaagtcgccgtcgcggaacggcagtcctggacgatggcgggcatctgccaggccggggacgtcctcggcctgatcgaggacgacgtggcggtgatcggctccgacgtcacggagacggcggagatcattctcgaccgcatgctcgcggcgggcggcgagatggtcacgctggtgctcggcgacgaggctccggagtcgatcgcggcgcatctggaatcccgggtacgggagtcctacctggcggtcgacacggtggtgtaccggggcggccgtcaggggccgttgctgctgatcggcgtggag

SEQ ID NO: 2662 - DNA, 183 bp, Streptomyces avermitilis
  CDS (1)..(183)
gtggctgccaactgcgacgtctgcggcaaggggccgggcttcggcaacaacatctcgcactcccaccgccgtacgccccgtcgctggaacccgaacatccagcgtgtgcgtaccgtggtgggcgggacgccgaagcgcgtgaacgcttgcacctcgtgcatcaaggccggcaaggtctcgcgc

SEQ ID NO: 2663 - DNA, 960 bp, Streptomyces avermitilis
  CDS (1)..(960)
atgaagggcaccgttggcgagttgggggagttcgggctcatccgagagctcacctcgcgcctgaccaccactccggcggtccgggtcggccccggcgacgacgccgcggtggtagccgcgcccgaccgcagggtggtggcgagcaccgacatcctcctggagggccggcatttccgccgcgactggtccacggcgtacgacgtcggacgcaaggcggcggcgcagaacctcgcggacatcgccgccatgggcgccgtaccgaccgcgctgctgctcggtctggtcgtacccgcggaacttcccgccacctggccgtccgagctgatggacggcctgcgtgacgagtgccaggtcgcgggcgcggccgtggtcggcggggatgtggtgcgcggggacacgatcaccgtggcgatcaccgcgctcggcgatctgcgtaatcacgagccggtgacgcggggcggggcgcagcccggcgacgtggtcgccgtgaccggctggctgggctggtccgcggccgggcacgcggtgctctcgcgcggcttccgttcgccgcgcgcgttcgtcgaggcgcaccggcgccccgagccgccgtatcacgccggtcccgcggccgccgggctcggcgcgacggcgatgtgtgacgtgagcgacgggctgatcgccgacctggggcacatcgccgaggcgagcaaggtccggatcgacatccgctccggcgccatcgacatcccgacccagatgaacgacatcggccaggccgtcggggtcgaccccatccagtgggtgctgaccggcggcgaggaccacgcgatcgtggcgaccttcccgccggacgtgaagctgcccgcccgctggaaggtgatcggcgaggtcctcaacccgtcggcgctgccgcaggtcaccgtggacggggcgccgtggtccagcaaggggggctgggaccacttcggggacatcgag

SEQ ID NO: 2664 - DNA, 231 bp, Streptomyces avermitilis
  CDS (1)..(231)
gtggtacaggcgtacatcctgatccagacggaggtcggcaaagcgtcgaccgtcgccgagacgatcagcaagatcccgggggtgatccaggccgaggacgtgacaggaccgtacgacgtcatcgtgcgggcccaggccgagacggtcgatgaactcggccgcatggtcgtcgcgaagatccagcaagtggacggcatcacccgtaccctgacctgcccggtggtgcacctg

SEQ ID NO: 2665 - DNA, 489 bp, Streptomyces avermitilis
  CDS (1)..(489)
gtggacttctcccgtcaccggcccaacactttcttcgggctgcccgtgctcgcactgctgatcgccgccacgggctgctcctcggcagacgacaacgcctcggccacggttcccagcccggacgcgaaggtcaccgagctgtgccagaacctggacaaggtgctgccgaagaaggtggacggcctcgagcggaaagatcccgagccccggtccgcgctgaccgcgggctggggaagcccggcgatcatactgcgctgcggtgtggaacggcccgccgagatgctcgacccgaaggcgtccaccaccgaggtgaacggcgtgggctggctggtgcgggagcacgacgacggctcctacgtcttcaccaccagcctgcgcagggcatatgtcgaggtccggctctccgcggagcaggcgaagaacggcgccggttcgctcgtcgacctcgcgaagcccatcaagaaggcgatccccgaagggatcgccgac

SEQ ID NO: 2666 - DNA, 1155 bp, Streptomyces avermitilis
  CDS (1)..(1155)
atgagcaccgagaacctcccccagagccccgagcagccgcctcgcaagccgcgtgtggccgtcgtattcggcggtcgcagctccgaacacgggatctccgtggtcaccgccggcgccgtcctgcgcgccatcgaccggacgaagtacgacgtcctgccgatcggcatcacccgggacggccgctgggcgctcaccgccgacgagccggagcggatggcgatcaccgaccgccgtacgcccagcgtcgaggaactcgccgagtcgaacgagggcggggtcatcctgcccgtcgacccggccaaccgcgaagtcgtctacagcgagccgggatcggtccccaaggcgctgggcgaggtcgacgtggtctttcccgtgctgcacggcccgtacggcgaggacggcaccctccagggcctcctggagctgtccggcgtcccgtacgtcggcgcgggcgtcctcgcctcggcggtcggccaggacaaggagtacatgaagcgggtgttcacctccttcgggctgaaggtcggcccgtacgtggtgatccggccgcgcgaatgggagcgcgacgagtccgccgcccgcaggaagatcgtcgacttcgcgggtgagcacggctggccgttgttcgtgaagcccgcacgcgcgggttcctcgatcggcatcaccaaggtcgacgacctcgccggcctcgacgaggcggtcgcggaggcacagcggcacgacccgaagatcatcgtggaggcgctgctgcgcggccgcgagatcgagtgcggggtcctggagttcgaggacgggccgcgtgcctcggtccccgccgagatccccccggcccagtcgcacgcgtactacgacttcgaggcgaagtacatcgactccacgcccggcatcgtgccggcgccgctgacgccggaggagaccgccgaggtgcggcggctcgccgtggaggccttcgaggccacctcctgcgagggcctggtgcgcgcggacttcttcctcacggaggacggcgatttcgtgatcaacgagatcaacacgatgcccggcttcacgccgatctcgatgtacccgcagatgtggcaggcgagcggtatcgcctacccggagctggtcgaccgtctggtggaggcggcgctgcggcgttcgacgggcttgcgt

SEQ ID NO: 2667 - DNA, 1008 bp, Streptomyces avermitilis
  CDS (1)..(1008)
gtgagcacgccggtcaaggcagccgtcttcgggaccggatcgtggggtacggccttcggcatggtgctcgccgacgcgggctgcgacgtcaccctgtgggcgcgccgcgccgaactcgccgacgcggtcaactccacgcgtacgaacccggactacctgccgggcgtcgaactcccggagaacctgcgggccaccaccgaccccgccgaggccgcgcgcgccgccgacttcaccgtgctcgccgtcccctcgcagaccctgcgcgggaacctcgccgaatgggtgccgctgctcgcacccgacacggtcctcgtctccctcatgaagggcgtcgaactcggctccgcgatgcggatgagcgaggtcgtcgaggacgtcgccaaggtcggcgcggaccgtatcgccgtggtcaccgggcccaacctcgcccgggagatcgccgcccgcatgccggccgccgccgtggtcgcctgtgccaacgaagccgtcgcccagcgcctccaggccgcctgccacacgccgtacttccgcccgtacaccaacaccgacgtggtcggctgcgaactcggcggcgcggtcaagaacgtgatcgggctcgccgtcggcatcgcggacggcatgggcctgggcgacaacgccaagggctcgctcatcacgcggggactcgcggagaccacccggctcggcctggtcatgggcgcggacccgctgacgttctccggtctcgcgggcctgggcgacctggtggcgacctgttcctcgccgctctcgcgcaaccacaccttcggcaccaacctcggcaggggcatgaccctccaggagaccatcgcggtcaccaagcagaccgccgagggcgtcaagtcctgtgagtccgtgctggatctggcccgcagacacggcgtcgacatgccgatcacggagacggtcgtcggcatcgtccacgagggcaagccgccggtcgtcgccctcaaggagctgatgtcgcgcagcgcgaagccggagcggcgc

SEQ ID NO: 2668 - DNA, 798 bp, Streptomyces avermitilis
  CDS (1)..(798)
gtgccccgccgcagaatcagcttctggtaccgcttcgcagcggtcctctgcaaaccgccactggtggttctgatcaagcgggactggcgcggaatggagaacattccggtcgagggcggatttatcaccgcggtcaaccacaattcccacgtcgaccccttcgcgtatgcccactatcagtacaacaccgggcgggttccgcgattcctggcgaaggccgggcttttcaagaagggattcgtgggggccgcgatgcggggcaccgggcagatccccgtgtaccgcgagagcaccgatgcgctgagcgccttccgggccgcgatcgacgccgtggagcgcggcgaatgcgtcgccttctaccccgagggcaccctcacccgcgaccccgacggctggccgatgaccggcaagaccggtgccgcccgcgtcgctctgcagaccaagtgcccggtgattccggtcgcccagtggggcgccaacgagttgctgccgccgtatgccaagaagcccaacctccttccgcgcaagacccaccgcgtgctcgcgggcccgccggtggacctcacgcgcttctacgaccgggagatgagcccggacctcctgaaggaggcgaccgaggtcatcatggcggccgtcaccgcgcagctcgaggagatccgcggcgagaaggcgcccgagaggccctacgacccgcgccaggtgcgcatcgaacagcgccggcggaccgcggcctacgaaagagcgcaggcgcagcagaaagcgcaacagagggcacagcaggaagaggagcagagcacg

SEQ ID NO: 2669 - DNA, 648 bp, Streptomyces avermitilis
  CDS (1)..(648)
gtgcagtggaccttggtcgtacccctcaaagccctggcgcgggccaagagcaggcttgcggacaccgccggggacggactgcgccccggactcgccctcgccttcgcgcaggacaccgtggcggccgcgctcgccagcgccgcggtccgcgatgtggcggtcgtcacgggcgatccggtcgccggacgcgagctggccgcgctcggggccaggatcgtcgccgacgaaccggcgggcgggctgaacgccgcgctggcgcacgcggccgcggtcgtacgctccgggcgccccgacagcggcgtcgcggccctgaacgccgatctgcccgcgctgcgccccgcggaattggcccgggtactggaagcggccgtcgaattcccgcgcgctttcctcccggatgccgccgcaatcggtacgactttgctggccgccgctccgggtcgcgaattgctccccgctttcggtaccgattcccgggcccgtcatcgcgcctcgggggccgtggaactcggtctgggcggggtgaactccgtacgccaggacgtggacaccggcgccgacctgcgcgcggcgctggcactgggggtgggcccgcgcacggcagcggcggcggcccggctgctgatcccgggcccccagggggatcga

SEQ ID NO: 2670 - DNA, 201 bp, Streptomyces avermitilis
  CDS (1)..(201)
atgcaggcgaccgcgtacacgtacgactccgagacccgcagcggccaggtgctgctcgacgacggcacccccctgcccttcgacggccccgcgttcgacgcgggcgggctgcggctgctgcgcccggggcagcgcgtgcggatcgaggtggacggcgagggcgacgcccggcgcatcaccctggtgaccctgcagacgttc

SEQ ID NO: 2671 - DNA, 651 bp, Streptomyces avermitilis
  CDS (1)..(651)
gtgaacaaggcgcagctcgtagaagcgatcgcggacaaggtcggcggccgtcagcaggccgccgacgcggtcgacgccgtactggacgccatcgtccgcgcggtggtcggcggggaccgggtttcggtcaccggcttcggttccttcgagaaggtggaccgtccggcccgctacgcccgcaacccgcagaccggggagcgcgttcgggtcaagaagacctccgtgccgcgcttccgcgccggccagggcttcaaggacctggtgagcgggtcgaagaagctcccgcgcggtggtgaggtctcggtcaagaaggcgcccaagggcagcctgaccggcgccgcttcggccacggtcaagaaggccgcggccaagaagaccaccgccaagaaggcgacggcggccgcgaagaagaccaccgccaagaagaccacggccaagaaggccgcgcccgccgccaagaagaccacggcgacggcgaagaagacgaccgccaagaagaccacggcgggcgccaagaaggccgcggccaagaagaccaccgccaagaaggcgacggccaagaaggccccggcgaagaaggcgacggccaagaaggcccccgccaagaagtcgacagcgcgcaagaccaccgccaagaaggccaccgcccgc

SEQ ID NO: 2672 - DNA, 591 bp, Streptomyces avermitilis
  CDS (1)..(591)
atggaagcattcaccacgcacaccggccgggccgtcccgctgcgccgcagcaacgtcgacaccgaccagatcatccccgcccactggctcaagaaggtcaccagggacggtttcgaggacgggctgttcgaggcctggcgcaaggacgagtccttcatcctcaaccggcccgagcgcacgggtgccacggtcctggtcgccggccccgacttcggtacgggttcctcgcgcgagcacgccgtgtgggcgctccagaactacggcttcaaggccgtcatctcctcgcgcttcgccgacatcttccgcggcaactcgctcaagaacggcctgctcacagtggttctggagcagaagatcgtggacgcgctgtgggaactcaccgaaaaggacccgcaggccgaggtcacggtcgacctggaggcccgtgaggtgcgcgccgagggcatcacggcggccttcgagctcgacgagaacgcccgttggcggctgctgaacggcctggacgacatctccatcaccctccagaacgagggcgacatcgcgacgtacgaggccaagcggccgtcgcacaagccgcggacgctccaggtc

SEQ ID NO: 2673 - DNA, 1431 bp, Streptomyces avermitilis
  CDS (1)..(1431)
atgggtaggacactcgcggagaaggtctgggacgaccatgtcgtccggcgcgccgagggcgagcccgacctcctcttcatcgatctgcacctgctgcacgaggtgaccagtccgcaggccttcgacggtctgcgccaggcggggcgtccggtgcgccgtctcgacctcaccatcgccaccgaggatcacaacaccccgaccctcgacatcgacaagcccatcgcggacccggtctcccgggcccagctggagacgctgcgcaagaactgcgccgagttcggcgtgcgcctgcactcgctcggcgacgtcgagcagggcgtcgtgcacgtcgtcggcccgcagctgggcctgacccagcccggcaccacggtcgtctgcggcgactcccacacctccacgcacggcgccttcggcgcgctggcgttcggcatcggcacctcgcaggtcgagcacgtgctggccacccagacgctgccgctggcccgccccaagaccatggccatcaccgtcgacggcgagctgcccgacggcgtcaccgccaaggacctgatcctggcgatcatcgccaggatcggtaccggcggcggccagggctacatcctggaataccgcggctccgccatcgagaagctctcgatggaggcccggatgaccatctgcaacatgtcgatcgaggccggcgcccgcgcgggcatgatcgcccccgacgagaccaccttcgcgtacctcaagggccgtgcccacgcgcccgagggcgaggagtgggacgccgccgtcgcgtactggaagaccctgaagtcggacgaggacgcggaattcgacgccgaggtcgtcatcgccgccgccgcgctgtcgccgttcgtcacctggggcaccaaccccggccagggcgcgccgctttcggcgtccgtccccgaccccgcttcgtacgaggacgcttcggagcgcttcgccgccgaaaaggccctggaatacatggggttgaccgccgggcagccgctgcgcgacatcaaggtcgacaccgtcttcgtaggttcgtgcaccaacggccgcatcgaggacctgcgtgcggccgccgcgatcgtcgagggccgcaaagtcgccgacggcgtacggatgctgatcgtccccggctcggcgcgggtcggtctccaggccgtctccgagggcctggacgtggtcttcaaggaggccggcgccgaatggcggcacgcgggctgctcgatgtgtctgggcatgaaccccgaccagctggcccccggtgagcgctccgcgtccacctccaaccgcaacttcgaaggcaggcagggcaagggcggccgtacgcacctggtgtcgccgcaggtcgccgccgccaccgccgtgctcggccacctggcctccccggccgacctggccgacgagaacgccgcccgtacgcccgctggagtc

SEQ ID NO: 2674 - DNA, 714 bp, Streptomyces avermitilis
  CDS (1)..(714)
atggacaacagtagcggcgtcggcgtgctggacaaggcggcccttgtcctgagcgccctggagtccggcccggccaccctcgcgggactggtggcagcgaccggactggcacggcccacggcacatcgcctggccgtggcacttgaacaccaccgcatggtggcgcgtgacatgcagggccgtttcattctcgggccccggctggcagagctggccgcggcggcgggcgaggaccgtctgctggcgacggcgggcccggtgctcacccacctccgggacgtcacgggcgagagcgcgcagctctatcgccgccagggcgacatgcggatctgcgtcgccgcggccgagcgcctgtcgggcctcagggacacggtcccggtcggctccacgctcaccatgaaggccggttcctcggcgcagatcctgatggcctgggaggagccggagcgcctgcaccgcggcctccagggcgcccgcttcacggcgacggccctgtcgggcgtacggcgccggggctgggcccagtcgatcggcgagcgcgagccgggtgtcgcgtccgtctccgcccccgtacgcggcccttccaaccgggtggtggccgccgtgtccgtctccggccccatcgagcgtctgacccgccacccgggccgtatgcacgcccaggcggtcatcgacgccgccgggcgcctgtccgaggccctgcgccgcacgggc

SEQ ID NO: 2675 - DNA, 495 bp, Streptomyces avermitilis
  CDS (1)..(495)
atgttcgccaagcccgtcgcgggccgcaccaccgcagccgccgagggggacgtggtcgtgctgctgatcggcatgcgcatcaaccacctctgggccgtgcaccagtggctgccggtcttcctcgcgatgccgcgcatgctgcgcgagctgacgcgggaccggagccgcggactgctcggccatgtgctgctgacggcctcaccgcggacctactacgtggtccagtactgggagtccaaagagaagctctacgcgtacgcgacgtcacccgacatgttccaccaccgggcctgggcgatcatcaaccgcaaggagcgcgcgggaaaggcgcgcgggcacgtggggctgtggcacgagacgtatgtcgcgcccgaggggtcgtacgagtcgatctacgcggacatgccgcccttcgggcttgcggccgcgcacggggtgctgcccgtcgagaagcgggggcggcgggcgaaggaccggttcgcgcaccggtccgcc

SEQ ID NO: 2676 - DNA, 642 bp, Streptomyces avermitilis
  CDS (1)..(642)
atgcggctggccgagttgagcgagcggagcggtgtacccctcgcgacgatcaagtactacctgcgcgaaggcctgttggcgccgggccggcgcatcagcgcgaccaccgccgagtacgacgagggccatctgcgccggctgcgcctggtccgggcgctgattcaggtcggccgggtcccggtggcgacggcccgggaggtcctggggcacgtcgacgacgactccctcggccgcacgatccggctgggagcggccctgtgggcgctgccgcaggttccggagccggacgaggaggacgagaacgtccgggccgcgcagcacgaggtggatcagctcctgcggacgctggactggacgaccgcccagaacctgagcagcatctctcccgcgcatcgttcgctggtcgtggccgtggccacactcaggcggctcggctacgcctgggacgccgaactgatggcgccgtacgcccagttgatgcatcaggcggccgtccgggacctggacttcgtggagacccatccgtcggaggccgagaaggtcgagaccgcggtcgcggcggcgatcctcttcgaaccggtgctgcgcgcgttgcaccggctggcgcaggaggaggagtcggcgcggcggtacggcatcgag

SEQ ID NO: 2677 - DNA, 1134 bp, Streptomyces avermitilis
  CDS (1)..(1134)
ttgcctcagcggggccgcggcgctgtcgtgcgccgtgccggccgggcccgcgtcgccaccggcgcgccccgcacgcccagcgccacccaggccgtcaacacctggctgtaccggtcctgcggcgcctttggacccgccggcgtccacgaccgcgccacgaaccgtcccctcacggtcccggccggccgggaccgcctcgccgacggctgtctgatccgcgagaaccgcggcacgcacgaaccactgctcaccgacttccccacgggtacggcgaccacgcggacggcgaccgtgctgcgcaccgccgaccaggacgacgcccagggccccggcctgaccctgaccggcacgactgccgtcaaccggccgacgcggcgcccacccccgggttaccgtcggctcatggacatcagcgccgtggtctgggacatcgacgacacgatcttcgactacggcgccgcggaccgagccgggatgcgcgaacatctggcggccgagggcctgctcgacggatacgagtccgtcgagcaggccctggcacgctggcgggaggtcaccgaccagcagtggctgaggttctcggcgggagagaccgactgggagggccagcgccgcgaacgcgtccgggtgttcctcgggcagccgctgaccgacaccgaggccgacgactggttccagcgctacgtcgcgtactacgaggccgcctgggccctcttcccggacgtactgcccgtcctggacgccctcgccgccagtcaccggcacgcggtcctgtccaactcgagcctccacgtccaggaccgcaagctccgggtcctcggcgtgcaccaccgcttcgaagccgtcctgtgcgcggccgagctcggcgtctccaagcccgccgcggaggccttccacgcggcctgcgacgcgctcgggctgccgccgcaccaggtcgcgtacgtcggggaccacccggagatcgacggccgcggcgccgccgaggccggactgctctccgtctggatcgaccgcgacggcgctcacaccgccaccgccgtcgcgtccaccggcccgcaccggatcgcgtcgctggccgaactccccgccgtcctcggcgcggatacccgttttggagtgccgtccaccttcggg

SEQ ID NO: 2678 - DNA, 1512 bp, Streptomyces avermitilis
  CDS (1)..(1512)
gtggctaacgcgaactcccccaagtcctcgactccgctcggagagggggtgcccccacgcgtacgtttctgtccctccccgaccggcaacccccacgtgggcctggtccgtacggccctgttcaactgggcgttcgcccgccacaccggcggcaccttcgtcttccgcatcgaggacaccgacgcggcccgtgactccgaggagtcgtacgagcagcttctggactcgctgcgctggctgggcttcgactgggacgagggccccggcgtcggcggcccgcacgcgccgtaccgccagtcgcagcggatggacctctacaaggacgtcgcccagaagctcctcgacggcggctacgcgtaccactgctactgctcgacggaggagctggacacccgccgcgacgccgcccgcgccgccggcaagccgtccggctacgacggacactgccgggagctgtcggccgagcagaaggccgcctacgaggccgagggccgcacgcccatcgtccggttccggatgcccgacgagccgatcaccttcacggacctggtccgcggcgacatcacgtacctcccggagaacgtcccggactacgggatcgtacgagccaacggcgcgcccctgtacacgctggtcaacccggtcgacgacgcgctgatggagatcacccacgtcctgcgcggcgaggacctgctctcctccactccccgccaggtcgccctctaccgggcgctgatcgagctgggcatcgcgaagtccgtgccggagttcggccacctgccgtacgtcatgggcgagggcaacaagaagctctccaagcgtgacccgcaggcctcgctgaacctctaccgggagcgcggcttcctcccggagggcctgctcaactacctctctctccttggctggtcgctctcggcggaccgcgacatcttcacgatcgacgagatggtcgccgccttcgacgtcaaggacgtgaaccccaacccggcccgcttcgacctgaagaagtgcgaggcgatcaacgccgaccacatccggctgctcgatgtgaaggacttcaccgagcgctgccggccgtggctgaaggccccgttcgccaactgggcgcccgaggacttcgacgaggcgaagtggcaggtcatcgcgccgtacgcgcagtcccgcctcaaggtcctctccgagatcaccgacaacgtcgacttcctgttcctgccggagccggtcttcgacgaggcgtcctggacgaaggccatgaaggagggctcggacgcactgctgcgcacggcccgggagaagctggaggcggccgactggacgtctccggagtccctgaaggaagccgtcctggcggcgggcgaggagcacggcctcaagctcggcaaggcgcaggccccggtccgcgtcgccgtcaccggccgcacggtcggcctgccgctcttcgagtccctggagatcctgggcaaggagaagacgctggcccgcgtcgacgcggcactggcgaagctgacggcg

SEQ ID NO: 2679 - DNA, 774 bp, Streptomyces avermitilis
  CDS (1)..(774)
gtgcgcatcgccagattctccatcgacggcaacgtcgctttcggcgcggtcgagggcgacaagccggacgagctcgtcctcgacatcatcaagggcatcccgttcgcggacttcgagctctccggtacgaaggttcccctcaacaaggtgcgcctgctgccgcccgtgctccccaacaaggtcgtggccttcggccgcaactacgcggagcacgccaaggagctgggcaacgaggtgcccgacgccccgttcgccttcttcaagccgtcgacctcggtgatcggccccggcgacccgatccagtacccgtccttctcgaacgagctgcaccacgaggccgagctggcggtggtcatcggccgcatgtgccgcgaggtaccgcgtgagcgcgtcaaggacgtcatcctcggctacacctgcgccaacgacatcaccgcgcgtgacgtccagaagcgcgagaagcagtgggcccgggccaagggcttcgacagctcctgcccgctcggcccctgggtggagacggacctcgacccgagcgacgtcaccatccagctcacggtcaacgggcaacagcggcagctcggccgcaccagcgagatgatccactcgatcgaggatctgatcgtcaacatcaccgaggccatgacgctgctccccggcgacgtgatcctcacgggcaccccggctggggtcggccccctcaacgtcggcgacgaggtcgccgtcaccatcgaaggcatcggcactctcaccaacaaggtgatcaagcgtggc

SEQ ID NO: 2680 - DNA, 171 bp, Streptomyces avermitilis
  CDS (1)..(171)
atgttccgcaacatagccaacccgcgacgcaccacgctggcgcacctcaccgacgccgacgagctgcacacgccggaccagccggaacactccgtcgatcttcccacccagaccgccaatccccgacgcaccatcctgatggaggcccccgtcacggcttccgtcgcggag

SEQ ID NO: 2681 - DNA, 3834 bp, Streptomyces avermitilis
  CDS (1)..(3834)
gtgcagggacgtttcaagagggatggcagcgcttcggcggagccggagccgcacggcgggaccgaccgcggttcctcgccccagcacgcccagaacccgggaccgggtgaggccggcaagagcggtgggcgcaccggtgcgcccaaggcccccactccacccgcgaagccgacgagcagcggccccagcagcggctcgcgcgtagctctgcgcaactggcgcatctccacgcgtctggtctcgctgctcgcgctccccgtggtcgccgcgacctcgctcggcgcgctgcgcatcagcgactccatggacgagatccagcagctcgacaacatgaagctgctgaccgacatgaccaagcaggcgaccgagctcgccgccgcgctccaggacgagcgcgaccagtcggcaggtccgctggcgcacggcgccacggccaccgacttcacggtcaagggcgtccgccagaagacggaccgcgcgcgctccgccttcctctcgggcacccaggagatcgacgacgccagcggcaacggccagctctccggcgtccgcgacagcgtcgtgggtctggccggtgagctgagcaacctgagcagcatccgcaacgtcgcctacaaggactccgagaacgccacgcagacggtcgagggctaccaccgcctcatcacccagctgctcggcctctcgcaggacatggccgaggcgaccagcaacccggagatgatccagcgcacgcgcgccctggcggccttctcgaccgccaaggagtacgcgtccgtgcagcgcgcggtcatcgcggcgtcgctgcccgcgagcaacaacaccttcggcaagctctccgagaacgaccgccagtacgcgctctcggccctggacagccaggaatccgagatatcgagcttcaacagcatctacggcgacggctacgaagatctgacgaagcccatcgacagcggcaacccgaccatcgaggccgccgacgagtacgcgaagcgcgcgctgagcgacaagaacggcatccgccagcagaacaagcgctcgtacaaggactgggtcgacgacgactcggccaagctcgagcagatgtcgaagatcgagctcaccctgctcaaccagatggagcagaaggcccgcgagctgcgcaaccagtccgagcaggaagcgatcatctcgggtgcgctgatcctcatcgtcctcggcgtctcgctcgtcggcgccttcgtcgtggcccgctccatgatccgctcgctgcgccggctccaggacaccgcgaccaaggtcgcccaggaccgcctgcccgagctggtcaggcagctgtccgagtccgacccgcaggacgtcgacacgtccgtggagtcggtcggtgtgcactccaaggacgagatcggccaggtggccgcggccttcgacgacgtgcaccgcgaggccgtacgactcgccgccgagcaggccctgctgcgaggcaacgtcaacgcgatgttcaccaacctctcgcgccgctcccagggcctcatccagcgtcagctctcgctcatctccgaactggagtcccgcgaggccgacccggaccagctgtcctccctgttcaagctcgaccacctcgcgacccgcatgcgccgtaacggtgagaacctcctcgtgctcgccggtgaagagcccggccgccgctggacccgcccggtcccgctggtcgacgtgctccgcgccgccgcctccgaggtggagcagtacgagcgcatcgagctgtcctcggtcccgaccaccgaggtcgcgggccgggtcgtcaacgacctcgtgcacctgctcgccgagctgctcgagaacgcgacgtcgttctcctccccgcagaccaaggtcaaggtcaccggtcacgcgctgcccgacggccgcgttctgatcgagatccacgacaccggcatcggcctctcccccgaggacctcgcggcgatcaacgagcggctcgcggcgccgcccaccgtggacgtgtcggtctcccgccgcatgggtctgttcgtggtcggccgtctgtcgcagcgccacggcatccgcatccagctgcgtccgtccgactcgggcggtacgaccgcgctcgtcatgcttcccgtcgatgtcgcccagggcggcaagaaggttccgggcaagccgggccagggcgctcccggcatcggcggcccggctgccgcacaggcctcggccggtgtggccgcggcccgtcgcggcggtcagtcgggcagtccgagcctcggcgccggtgcccccgcgggcaacgccggccgtatcggtgcggctccgcagcgcggacaggtgggtgccggtcagggcccgcgtgccgcactgcccggcagcaaccagggcggacgtcccggcgcgccgggcggagcccggggtccgcagcagggtccggcggcaccgcagcagggccggccggcccccgcgggtgccggtgcgggtgccggtgccttcgggcagaacgcgccgggcgccccgcagggcctccaggcggcgcaggccttcaacgagggcccggcggccacccgtcagggcggcttcggcgacggcggttccggcacgcgccggggcggcggcttcggcgacagcacccccgcggccgcacccccgcagcagccccagcagcctcagcagcagcccaaggagtcccgtcgccgcaggccgcagctgccgggtcgcggtggcccgcgggccgaactgcccggcggcagcgcccagccgcgcacgcccagctggagcgacgagaacgcgcagccgccggtgccgcgcgcctcgctcgacgccccccgcggccacgaggagccggacgcgctgtccgccacctcccggctgccgcgcgtcgacgaccgccagggacccggcgcgacctcggagatcccccggatcgacgaccgccagggacccggcgccacttctgagttcgcccgtcccgacttcgacaccacgcgccccggcgcggaggcgccgcagggcggcaacgggcagttcggccgcccggacatgttcggcaccggcaaccaggcggcacccacgaaccggttcccggctcagggccgcccccaggacgcgtcgcccaccggacagccgccggcctacggcggctcccaggacccgtcggccaccggccagttcgcgacgccgggctacgacggttccggcacgggtcagtacgcgacgccgggctacgacgcgtccggcacgggtcagtacccggcgccgggccagggcaaccgccaggactcctcgtccacgggccagttcgagcggccgcaggccggtggccccgccgacttcggtgtcccccggccgccggccccgcagcgtcccgcgcgtccgcagcagcccgaggcgctgccgccggcggcgggtcccggcgacgggcgtacgccgctgtacgacacgctggagaccaactggttccacggtcagcagggccagcagggccagcagcagagcaacggctcggcgcaggccccccagcagcagccgcagtcacctgcggccccccagcgtccggcccccacgccggccgcctcctcctggcgcagcacgccgaacgacgatctcgtcaagcaggccgaacgcgtccgtcagccgtcggcgggcggggtcaccacctccggcctgccgcgtcgggtcccccgcgcgaacctcgtcgcgggtacggctcagcagcaacagcaccaagcaggtccgcaggtctcgcgtgcgcccgatgacgtacgcggccggctgaccaatctccgtcggggcatccagcagggtcgccaggccggtaccggccagaccggcagcttccccagccccactcaccagcaggagcgt

SEQ ID NO: 2682 - DNA, 411 bp, Streptomyces avermitilis
  CDS (1)..(411)
atgagccaggccgcacagaatctgaactggttgatcaccaacttcgtggacaacacccccggggtgtcccacaccgtcgtcgtgtccgccgacggactccttctggccatgtccgaaggcttcccgcgcgaccgcgcagaccagctcgcggccgtcgcgtcggggctcacctcgctcacggccggggcgtcccggatcttcgagggcggcacggtggcccagacggtcgtcgagatggagcgcggtttcctcttcctgatgtccgtctcggacggctcgtcgctcgcggtcctctcccacccggagtgcgacatcggcctcgtcggctacgagatggcactcctggtcgaccgtgcgggtgcggtgctcacgccggacctgcgcgccgaactccagggcagtctgctccac

SEQ ID NO: 2683 - DNA, 396 bp, Streptomyces avermitilis
  CDS (1)..(396)
atgaccccgcccaccgcctctcatgatccgtacgcacagtcgtacggggacgagggcgaccagccgttggttcgtccgtatgcgatgaccggcggccggacccggccgcgttaccagctcgccatagaggcgctgatcagcacgacggccgacccggcccagctgatggggctgctccccgagcaccagcggatctgccacctgtgccgtgaggtgaagtcggtggcggaggtgtcggcgctcctgtccatgcctctcggtgtggcacggattcttgtcgcggacctcgccgaggccggacttgtcgccatccaccagccgggcggcgacgagaacaacggcggtgcaccggacgtgacactgctcgaaagggtgctcagtggacttcgcaagctc

SEQ ID NO: 2684 - DNA, 576 bp, Streptomyces avermitilis
  CDS (1)..(576)
gtggacttcgcaagctctgacggcggggggcggacgaccacctccgccaagatcgtggtggccggcggcttcggcgtgggcaagaccacgttcgtgggcgccgtctccgagatcaacccgctgcgcaccgaggccgtcatgacgtccgcgtccgcgggcatcgacgacctcacccacaccggggacaagaccaccaccacggtggccatggacttcggccgcatcacgctcgaccaggacctgatcctgtacctgttcggcacgcccggccaggaccgcttctggttcatgtgggacgacctggtccgcggcgccatcggcgcggtggtcctggtcgacacccgccgtctcgccgactgcttccccgcggtcgactacttcgagaacagcggtctgccgttcgtcatcgccctcaacggcttcgacgggcaccagccgtacaaccccgaagaggtacgcgaggctctgcagatcggtccggacgcgccgatcatcacgacggacgcccggcaccgcgcggacgcgaagtcggcgctgatcacgctggtcgagcacgcgctcatggcccgtctgcga

SEQ ID NO: 2685 - DNA, 3243 bp, Streptomyces avermitilis
  CDS (1)..(3243)
gtgaggcgaagcaagaacggtcccgagccgtcggcacggggcaacttcaccccgccgccgcggggaggggtacccgcacaatccggccccgagccggcggcggtggtcgcgcccagcggcagccgtctctctccgcgcaactggcgcgtgccgaccaggctgaacgcgatcctgctcatacccgtgctggtcggcctggtcatgggcggcttccaggtgaagggctcgatcgacacctggcaggaagcccgcgacgccgagaaggtcgcgaagatcgtggcgtccgccggtgaatacgccgaggcgctgctcaacgagcgcgatgtgtccgccgccccgctcctcaagggcgaccggaacaacgcgacggtcaagaaggcccgcgccctcaccgaccagaaggccgacgccttccaccaggaagtcgtcggaatgccggccaaggcaggtctccagcgccggctgggcctggtggagaaggccgaaccgcagctggagcagatccgcaaggcggcctacacgaccgccatggacccggtgaagaccgaagagggttacgtcaccgtcgagcacctgctcatggagttctccaacgagctgggcctgggtaccggcaacatcaccagctacggccgtaccgtgtacgccatcgcgctggccaagggcgccgagtcgctggaacgctccatcggcctgcacctgctgatcaagcccagcagcgacgagaagatccgcgcccagcagatcacctccttcacctcgtacgcgtacctcgagcagatcgctcttcaggagtacgtctccggcggcaccgagcaggactacgcccggctcacccaggtgatgaagcagaagaccgctgcgggcaaggccaagctcgccgaggccaagagcaggaccgaggccgcgggcggcaccttcgtggccccgccggccctggacaagatgatccaggcgatcggcagtggcgccacgcccgccgccctcgcccagcagggcatcacccccacgacgtggatgtccgccgcgaccctcaagttcgacggctacagccaggtggagaaggaactcgtcgaccgggccgtcaacgacgccaacgacatcgcctccagcgcccagcgcgacgcctacatcaacggcgccatcgtcgtcgtggccctgctcgccgcgttcatcctcgccggcctcatggcccgccagatgagccgctcgatgcgccagctgcgcaacgcggccttcaatgtcgccgagcagcgcctgccgatgctggtcgaccagctgtcccgtacggacccgggacgcgtcgacacccgcgtacaggccatcccgatcaccaccacggacgagatcggcgaagtcgcccgcgccttcgaccaggtccaccgcgaggccgtacgactggccgccgagcaggccctcctgcgaggcaacatcaacgcgatcttcaccaacctctcgcgccgcaaccagtcgctgatcgagggccagctgaccctgatcaccgacctggagaacaacgaggccgacccggaccagctggagaacctcttccggctggaccacctcgcgacccgtatgcgccgcaacggcgagaacctcctggtcctcgccggcgaggagcccggacgccgctgggaccagccggtcccgctggtcgacgtgctgcgcgccgcctcctccgaggtggagcagtacgagcgcgtcgagctgtccggcgtcccggaggccgagatccacggccgcgccgtgaccgacctcgtgcacctgctcgccgagctcctggagaacgccaccacgttctcctcgccgcagaccaaggtccgcgtcaccgcgacccgtctcccggacggccgcatcatggtcgagatccacgacaagggcatcggcctcaccgccgaggacttcgcggacatcaaccacaagctggccaacccgccgaccgtggacgccgcgatctcccagcgcatgggtctgttcgtggtcggccgcctgtccgaccggcacggcatccgcgtccagctgcgcccctcgggcgagcaggccggcacgacctcgctggtcatgctccccgacgtcatcacccacggtggcggtggcgagcagcaggtgcagcgcgacgagttcacggtctcgcagatcatcccggagcagcagaacttcgcgggaggcggcgaagccttccaggtggagccgatgcgtacggccgcggagctgggcttcgacgacagccgctacaccgaggtccccgacgacatacgggagctggaccccgtcggccgctcgctgatgcgcgaggagcgccgggcggccctggaggcccaggcacacggcccgcaggacggttccgaggggcagcgctaccaggacgagttcgacgcgtcgcagcagccggcctacggcaacgggcagaacgggtacccggagcagcaggcggggtacgaccagcagacggcgtacgaggagcagcagcagcctgcgtacgaggagccgtacttcgcgccgaacggcgacttctcccagaccggggagttcccggccaccggagagttcgcgccgaacggtgacttcgcctccaacggcggctatccggaaccctcgtacgcggagccgaaccaggagagcaactcgggtggcgggcgcaccgcctcggagacgttctcggccttcgacgagccgtcctaccaggatgactggccgaagcaggacgactaccagagcgggtaccggtccgagtacgctccggaagcggaatcctcgcaggccgctgacgtgagtgagcgggaccacgtaggcttcacccgtccgggaccggccccctccgccgcccacgcactgaccgacgccggtctgccccgccgcggatccaccgggaacggcaacggcaacggcccgcagcgcgtgagcccggacccgtcggcggcccctgccgggaccgagacgggcggcatgggcagcaactggcgctcctcgaacgacgagcgctggcagcaggcctcgcagctgaagaagcccaaggccggcggagttacctcctccggactgccgcgacgggtacccaaggccaacctggtcgagggaaccgcggattcgaccccccagggcggcccccaggtctcccgcgctcccgaggacgtccggggcaggctgagcaacctgcgccggggcgtggagcggggacgcaatgcaggtagtgacacgaacggccagggcctcggtcctgatagcacctacaaccaggagcgt

SEQ ID NO: 2686 - DNA, 411 bp, Streptomyces avermitilis
  CDS (1)..(411)
atgagccaggcggcgcagaacctgaactggttgatcaccaacttcgtggacaacacccctggggtgtcccacaccgtggtggtctccgccgacggactccttctggcgatgtccgaaggctttccccgtgaccgcgccgaccagctcgcggccgtcgcgtccggtctgacctcgttgaccgcgggtgcctcccgcatcttcgagggtggcgctgtgaatcagacggttgtggagatggagcggggattcctcttcctcatgtccatttccgatggttcgtcgctcgcggtcctcgcacacccggaggcggacattggcctcgttgggtacgagatggcccttctggtggaccgtgccggtacggttctgaccccggaccttcgggcggagctccagggcagccttctcaac

SEQ ID NO: 2687 - DNA, 582 bp, Streptomyces avermitilis
  CDS (1)..(582)
gtggcaacacccccaggcggttcgtcttcgggcaactggtcctacggccccggccagggccagggtcagggtgagcagaaccggtacaacttcccctccgcacccagcccgcggcgtcagccgtacgcaccccagggcccccagggtcccggtccctcgccgtacgaccagccgtcggcgccgcgcatccagcccgtgcagccacagcgacgctcccccgagccggcgcccgcagggtcgtcgagcaaccccctggtgcgcccgtacgccatgacgggcggccgcaccaggccgcggtaccagctcgccatcgaggcgctggtgcacaccactgcgcagccgcaccagatgcaggggcaactgcccgagcatcagcggatctgcaacctctgccgagagatcaagtcggtcgccgaagtctcggcgctgctcacgatccccctcggcgtggccaggatcctcgtcgccgacttggcggaggcgggcctggtcgccatccatcagcccggcggcgacgaaaacgccggtggccagccagacgtgactttgctcgaaagggtgctcagtggacttcgcaagctc

SEQ ID NO: 2688 - DNA, 522 bp, Streptomyces avermitilis
  CDS (1)..(522)
gtggtggcaggcggcttcggcgtgggcaagaccacgttcgtcggtgccgtctcggagatcaatccgctgcgcaccgaggccgtcatgacgtccgcgtccgcgggcatcgacgacctcacccacaccggggacaaaaccaccaccacggtggccatggacttcggccgcatcaccctggaccaggacctgatcctgtacctgttcggcacgcccggccaggaccgcttctggttcatgtgggacgacctggtccgcggcgccatcggcgcgatcgtcctggtcgacacccgccgtctcgccgactgcttccccgcggtcgactacttcgagaacagcggtcttcccttcgtgatcgccctcaacggcttcgacggcaaccagccgtacaacccggacgaggtgcgcgaggcgctccagatcggccccgacaccccgatcatcacgacggacgcccgccaccgcgcggacgcgaagtcggcgctgatcacgctggtcgagcacgcactcatggcgcgactccgc

SEQ ID NO: 2689 - DNA, 192 bp, Streptomyces avermitilis
  CDS (1)..(192)
atgaacccgcctgacattcgcgtcgagaagggccacgccgagcccgaggaagtggccgccatcacggccatcctcctggctcgcgcggcaaccgcccccgccgcctcgccggcccgccgtggccgcccgaaggcgggctggcgccgcctggagcgcgagccgggtttccgggcaccgcacagctggcacggc

SEQ ID NO: 2690 - DNA, 1593 bp, Streptomyces avermitilis
  CDS (1)..(1593)
atgaccgttttggacgagacgccgggtgagacgtcgggtgagccgacggacgcgcgcgggcgcgtggccgaactgcacgagatccgcgcgcaggcgctggccggccccagcgagaaggcgaccgacgcgcagcacgccaagggcaagctgaccgcccgggagcgcatcgagctgctgctcgacccggggtccttccaggaggtcgagcagctgcgccggcaccgggcgaccgggttcggcctggaggccaagaagccgtacacggacggtgtgatcaccggttggggcacggtcgagggccgcacggtcttcgtctacgcgcacgacttccgcatcttcggcggcgctctcggcgaggcccacgccacgaagatccacaagatcatggacatggccatcgcggccggggccccgctggtctccctgaacgacggtgcgggcgcccgcatccaggagggtgtcagcgctctcgcgggctatggcggcatcttccagcgcaacaccaaggcgtcgggcgtgatcccgcagatcagcgtgatgctgggcccgtgcgcgggcggcgcggcgtactcgcccgccctgacggacttcgtgttcatggtccgcgagacctcgcagatgttcatcaccgggccggacgtggtcaaggcggtgacgggcgaggagatcacccagaacggcctcggcggcgccgatgtgcacgccgagacgagcggcgtctgtcacttcgcctacgacgacgaggagacgtgcctcgctgaggtgcgctacctgctgtcgatgcttccgcagaacaaccgggagaacccgccgcacgccgagtcgagcgacgcggccgaccggcgctcggacgtcctgctggacctggtcccggcggacggcaaccggccgtacgacatggccaaggtcatcgaggagctggtggacgacggggacttcctcgagatccacgagcgctgggcccgcaatattatctgcgcactggcccgtctcgacggccgtgtggtgggcatcgtcgccaaccagccgcagaccctggccggggtcctggacatcgaggcgagcgaaaaagctgcgcgctttgtccagatgtgtgacgcttttaacatcccgatcgtgaccctcctggacgtcccggggttcctccccggagtcgaccaggaacacggcggaatcatccggcacggagcgaagctgctctacgcgtactgcaacgcgaccgtgccgcggatttcgctgatcctgcgcaaggcgtacggaggcgcgtacatcgtcatggacagccagtccatcggtgccgatctcacctacgcgtggccgaccaacgagattgccgtgatgggcgcggaaggcgccgcgaacgtgatcttccgccgtcagatcgccgaggccgaggatccggaggccatgcggacccgcatggtcaaggagtacaaggccgagctgatgcacccgtactacgccgcggagcgcggcctggtcgacgacgtcatcgatccggcggagacccgcgaggtgctcatcaagtccctcgcgatgctgcacaccaagcacgcggatctgccctcccgcaagcacggcaacccgccgcag

SEQ ID NO: 2691 - DNA, 2325 bp, Streptomyces avermitilis
  CDS (1)..(2325)
atgcacatgactcccaaccgccgtacgttcctccgcgcagcggtcctggcggccggcatcacggccacggtcaccgccaccggcgccccgtccgcgtacgccgacgacgagtacgacaccctccggcgccgttggctcgtcctcgccctcggcgccggatacgaccccaccgccgagccctacgcctcccgcctgcgccgcaccggggaactggcccgcggctaccgcgccaccatggccccggccgccgcctccctctggcccggccaccccttcgacccgccctccggcatcacccagagctacagccggctctggacgatgacccaggcctacgtccaggaaggcaccggctcgaccggcgacgcgggcctgctcgcggacatcgtccggggcctcgaccacgtgagcgcgaccgtctacaacccgaccaccacccgctacggcaactggtgggagtggcagatcggcagcccccgcctcctcatggacatcgtcgccgccctgcacgatcggctctcggccgcgcggcgagccgccgcctgcgccgccgtcggccacttcatccccgacgacatgctccgcgactactccggcacctccaccggcgccaaccgcgtcgacctctgccgcggcgtcgccctcagcggcatcctgggccgggcccccgacaggatcgccctcgcccgcgacgccctctcgcccgtcttcccgtacgtcacccagggcgacgggctctacgcggacggctcgttcgtccagcacacctgggtcgcctactcgggaacgtacggacaggtgttgctcgacgggctgggccggctgttcagccttttcgccggttccacctgggacgtcaccgatccgaaccggcagatcatcctcgacagcgtcgagcaggcctacgcgcccctcatccatgacggcctggtcatggacagcgtcaacgggcgggccatcagccgcggttacctcaagagcgacgacctgcacgtcatgcgcggcgaccacttccacgggcaggcgctgatcgccgcgatcgcgctgctcgcgggcggcgcgggccctcaggagcgcgcacggtggcacgctcggatcaaagggtggatcgaacgggacgacgtcacgccgatcctgaccgcaccccagttcggggtcgcggacctggcccggctgcacgccgtcgcggactccggcgtccgtgccgctcccgagcccgccgggcaccacctcttcgcccacatggaccgcgccgtccaccggggccggggcttcgccgcgaacatctccatgtcctccgaacggatcgcctcgtacgaatgcggcaacggcgagaacccccgcggctggcacaccggcgccggaatgctcctctggtggagcggccggaccgaccagtacacggactggtactggcccaccgtcgactggtaccggctgcccggaacgaccgtgtccaccaagcggctcgccgaccgggcgggcggcgagtggggtgagccgaaaccggccgtgcggtgggtcggcggcgtgacggacggcgtgtacgcggcggtcggccagcaggtgaaggggctcggatcgacgctggaggcccgcaagtcgtggttctgtgtggcggactccgtgatctgtctgggcgcggggatcacctgtagggacggcgtaccggtcgagacggtggtggacaaccgcaatctgggagagggcggcacgcaggccttcgtccgggggcacggctgggcgcacctggagggccacggcggctgggtgctgcccgccggcggcgagctgcgcgccctccgcgaggaccgcaccggcgcctggtccgacatcaacaccacgagtacgaccgagcgtcgcacccggcgctggcagacgctgtggctggaccacggcacggaccccgtggacgcgacgtacgcctacgtcctgctgcccggcgcgagccgcgcgcaggtcgccgcccacgcggccgaccgccaccggctgtcggtcctcgccaacgacgcccgccggcaggccgtccacgtcggctccctggccctcacggcggccaacttctggtcggccggcacggcgggcccgctggccgcctcggcggccgcgagcgtgctcgtccgccgccggggccggaccgctacgctctgcgtgagcgagccgtcgcgcacgggacagcccctggagatcgtctgggatcatcccgtagggcgggtcgtccgcgcggatccggccgtcgacatcgtcgccgccggccgccgactgagggtccgtgtcactccagggatggcatgtgccacgcacaaatgtgaggtgactctcagc

SEQ ID NO: 2692 - DNA, 507 bp, Streptomyces avermitilis
  CDS (1)..(507)
atgcagttccgcaggaaattccgctccgccctgaccgccctcgccctcgtcgtcgccccgggcgtcgccgtcgtcggtaccgccaccgacgccttcgccgtcaccaagatcagccacgccaccgccacctcgatgttccgcggggcaggcatcacctggtcctcctccggcggctgctccgaccgcaacaaccccagctgtacgtccttcgagcagctcaacctcgccaccgcgcagggcgcccagaccctcaagcaggccaccgggtgcgcgctcaacatcaccggcggcacggagaccggccacgcgagcggcacgtactcgcactggaacggctacaagctcgactacggcaagagcacctgcgtcaccacctacatcaagaacaccttcacctacatcggcctgcgcggggacggagccccgcagtaccggtccggctccggcaacatctacgccgacgagggcaaccactgggacgtcctctactacaactgcggcggctgc

SEQ ID NO: 2693 - DNA, 618 bp, Streptomyces avermitilis
  CDS (1)..(618)
atgggtatcttcggccgcaagaacacgaccgacacgaccagcacgaccgcgaccgcccccacggccgccgtgagcccggagctggccgcgctgaccggcacctacacgatcgacccggcgcacacgacgatcggcttcgtcgcccggcacgcgatggtcacgaacgtcaagggcggcttccaggagttcgagggcaccctgcacctggacggcggggacccggccaagtccagcgccgtgatcgaggtcaggatggacagcatcgacaccggctcgtcggaccgcgacacccacctcaagagctcggacttcttcaagacggacgagttcccgacgatgaccttccgctccaccaaggcggaggcgctgggcggtgacgactaccggatcaccggtgacctgtcgctcctcggcgtcaccaagccgctcagcatcgacctggagttcaacggcgcggccagggacccgttcggcaacgagcgcgtcggcttcgagggcaagacggagatcctgcgttcggagtggggcctcacgtggaacgcggcgctggagacgggcggggtgctggtgtcggacaagatcaagctggtgttcgacatctcggcgatcaagcaggcg

SEQ ID NO: 2694 - DNA, 1368 bp, Streptomyces avermitilis
  CDS (1)..(1368)
atgaaggccgtgctactcccaggagtccggctccgcgggctcttcctgtcgctgatcgcgctggtggcggccgctctggcggtgctgtccaccggggcgcccccggggcatgcggccacgagcgtgtcggccgtggccgaggcccttcgcgagagcccggtgtacgtggacccggcggcgtccgcgcagctgtccgcggcggacgcggacgccctcgccaagaagatcgaggacgccgacaagccggtcttcgtggccgtcctgccggccggcttcccgacgcggaatctcttcaccgatctccgtacggacaccggcgtcacgggcctgtacgcgatccgcctgggcgaccggttcgacgcgcgggccgactccgcggtgctgtcccgctccgctgtgcagaacctggtcaagagcgtgcagggcgaggacaccaagacccagctgaacgacttcacggaccgcgcgctcaggaacatgggcggctcggcaccgtcgagctgggactcctcgggcggcggcggggtgtcgtcgacctccctgatcggggtcggcgcggtcctggtggccggtggggccggcgcgtacacgctggtccggcgcaaccgccgccgcaaggaggaggaacagcgggcggcgctggacaagctgcgcgtggtggtcgacgaggacatcacggccttcggtgaggagctggaccgcctggacttccacccggccgaggcgggcgcggacgacgcgatgcgcgcggactacgagcgtgcgctggacgcgtacgagcgggcgaagtcgtccatggcggcggctgagcgcccggaggacgtacgcgccgtcaccgaggcgctggaggacggccgtttctcgctcgcgcagctcgccgcccgccgggagggccgcccgctgccggagcgccgcgcgccctgcttcttcgacccgcggcacggcccgtcggtcaccgacgcgacgtggacgcccgcgggcggcgcgccccgcgaggtcccggtctgcgcggcggaccgggcgcgcctgtccgacggactcgccccggccgtccgcgaggtcgacacggagtacggccgccgcccgtactgggacgcgggcccggcctacggcccctgggcgggcggctacttcggcggcggactcctgccggggctgctggtcggcacgctgctcggcggcatgatgtccagtccgtcgtacgcgtccgactacggctccgggtacggcgacttcggctccggcggctacgcgggcggcgacgtctcgggtgcggacttcgacgcgagcgacttcggcggaggcttcggtgacggcgggggcggtggcggggacttcgggggcggcggggacttcggcgggggcttc

SEQ ID NO: 2695 - DNA, 3033 bp, Streptomyces avermitilis
  CDS (1)..(3033)
atgcgaagaaccgccctgctcgtctcggccgccatgctcaccgggctgctgccccttgccggagccgcggccgccgtcggcgcggacgacccggcgcccgtccccgtcgaccagttcgagggcgaagtccccttcgccagtccgcccgccgagggcatcttcacctggggcggcgacaccgacgacccgccccagctcgccctgaccgcccgcgccgacgcgcccgagggcgacaaagtcctcaccggcacgtacgacatcagcggctacggcggcttcacccacgacttcgccttcgaccggcccgcccacgactggtccgcgcaccagggcatccgcttctggtgggacggccggggcaacggcaagaaggtcgccttcgagatcaaggacggcggcgccaacggcgaggcctccgagctgtggacgacgtccttcaccgacgacttcaccggctggaagcagatcgagatcccgttcaccgacttcacttaccgtacggactaccagcccgtcggcggcatcgaccaggtcctcggcctcaccgggatgtgggggtacgccgtcacgcttccggccggcgtcaagggccagttcgccatggacggcgtcgagttgtacggcaggggcgatcagtcgctgcgggcctccgtggtcaccgactccgccgttcacccggtgaaggagggccgcacggccgacgtgcgggtctccgtcgccaccaccggttccgccccgatcgacgagccggtgaccgtcgcgtacgaggcgacgggcggtaccgcggaatccggcaaggactacaccccggtcaagggctcggtcaccttcccggcgggcacggcgtccggcacctcgcgcacgatccaggtgcccacgctcaaggacaggtccgcagaacccgccgagacgatccccctgaagctcacggtcaccggcgcgaaggcccccgccgagaccccgcaggtcgtcatcgacgcgcacgggctgccgtatctggacccgaagctgccggtgaagaagcgggtcgccgacctcgtctcgcgcatgtccctggaggagaaggccgggcagatgacccaggccgaacgcggcgcgctcaccgcgcagggcgacatcgcggcgtacgacctcggctcactcctgtccggcggcggctcgaccccgacgcccaacacccccgaggcgtgggcgaagatgatcgacgccttccagctccgggcgcaggcgacacggttccagatcccgctgatctacggcgtggacgccgtgcacggccacaacaacctcaccggcgcgacgatcatgccgcacaacatcggcatcggggcgtccagggatcctgggatcgcccggcggaccggcgcggtgaccgccgccgaggtccgcgccaccggcatcccatgggacttcgccccttgcctgtgcgtgacgcgcgacgagcgctggggccgctcgtacgagtccttcggcgaggacccggccctcgtcaagtccatggagacggtcatccagggcctccagggtgcccgtgacggcaaggacctgaaggacgacgacaaggtgctggccaccgccaagcacttcgtcggcgacggcggcaccgcgtacggctcgtccacgacgggcacgtacaccatcgaccagggcgtcaccaaggtcacccggcaggagctggaggcggtgcagctcgcgccgtaccagaccgccgtggaccgcggtatcggctcggtcatgccctcgtactcgtcgctcgacatcctcggcgacggccagggcgcggtgaagatgcacgcccgcgcggacatgatcaacggggtgctgaaggaccgcatgggcttcgacggcttcgtcatcagcgactggaaggccatcgaccagatccccggcgactacgcgtccgacgtccgtacgtccatcaacgcgggcctcgacatgatcatggtcccgtacgagtacaaggacttccgtacgacgctgatcgacgaggtgaaggccggccgcgtcagtcagaagcgggtggacgacgccgtatcccgcatcctcacccagaagttcaagctcggcctcttcgagaagccgtacgcggacacgagcggcgcgtcgcggatcggctcgtccgcgcaccgcgccgtggcccgtgaggcggccgccgagtcgcaggtgctgctgaagaacgcgggcggggtgctgccgctgaagaagtcgcagaaggtctacgtcgccggttcgaacgccgacgacctcggcaaccagaccggcggctggacgatcacctggcagggctcctcagggaagcacaccgacggcacgacgatcctggacggaatgcgcaaggccgcgggttccgggggcgccgtcacctactcgaaggacgcgtcggcgcccaccagcggctacgacgtcggcgtggtcgtcgtcggcgagaccccgtacgccgagggcgtcggcgacgtcggcaacggcaacgacctggagctgaccgccgcggacaaggccgccgtggacaaggtgtgcggcgccatgaagtgcgcggtgctgatcgtctccggacggccccagctgatcggcgaccggctcggcgacatcgacgcgctcgtcgcgtcctggctgccgggcacggagggcgacggcgtcgccgacgtgctgtacggcaagcgggcgttcaccggtcaactcccggtcacctggccgaagtcggaggcccagctgccgatcaacgtcggtgacacgacgtacgatccgcagttcccgtacggctggggtctgaccacgctgacgaaggtgccggccggcggtgcggcgacgctgaaggcactggcggtcgcggcggcggtggccgagaggaccggttccggcaaggccggacgcgctctggtcggcaaggcgcggctgctcgtccagcagaaggccggatcgggaccggggatcaccgcggcggtcgcggggccgttcgccgacgcggaccatctgctgctgaccgggaagtacggggcggcggtcgcgaagctgacggaggcctaccgggccgcc

SEQ ID NO: 2696 - DNA, 1941 bp, Streptomyces avermitilis
  CDS (1)..(1941)
ttgacgcgcgtccgcggccgtcatttactcacgcctcgcacgccccactcccccaccccagaagggcgacgcgccatgaggagatccactcgggcggcccggcttctgctcgccgggctgctcagcaccgccgggctgaccgccgtctcgaccgcgcccgcgcacgccgcgggcgaacaggtcaccgcctggctgaccacgacggacgacaccggcggacgccatgtcgtgcgcgggctccaggcccagacgccgttcgccttccagtccggcagcggcggcagcggcgagaacatcaccgtggacgagaacacccggtaccagacattcaccggtggcggcgcgtccttcacggacaccgcggcctggctgatgaacagcagcggggcgctgtccgcgacgacccggaacgcggccatgaccaagttgttctcgccgacggacgggatcgggctgtcgttcctgcgcaatccgatgggcgcctccgacctggcgcggtacgggtactcgtacgacgacgtgccggccgggcagaccgaccccaacctgacgagcttctccatcgcgcacgacctcgccgacgtggtgccgctcaccaagcaggcgctccagctcaacccctctctgacggtcatggcctcgccatggacggcgccggcctggatgaaggacagcggctcgctcaacgggggctggctgaagtcggaggactacggggcgtacgccaactacttcgtgaagtaccttcaggcgtacaaggcgcagggcgtcaacgtctcgtacgtgaccgcgcagaacgagccgacgtgctgctcgggttacccgtcgatgagctggaacgccagcgggctcgcgtacttcaccaagagcgagctgctgccgaagctccaggcggcgggcctgacgaccaaggtcctcgcgcacgactggaactgggacgtctacgactcctacgcggcctcgacggtcgacgacgcggcggtgcgttcgcaccccaacttcggcgggatcgcctggcacggctacggcggtgacatcgccaagcagacgtccgtgcacaaccagtacccgaccctcgacgccttcggcaccgagcactccggcggcacctggatcgccaaccagcagcgcgaggacatgtccaacatcatcgactacacccggaactgggcgaagtcggtgaccaagtggtcgctcgccgtggaccagaacatgggcccgcacaacggaggttgcggcacctgcacgggtctggtcaccgtgcacaacggggacggcgcgagcgggaccgtcgactacacggtcgagtactacacgatgggtcacctgacgaagttcgtccgcccgggtgcgcagcgcgtcgcgtcgacggcgagtgcgtcggtgccgaacgtggcgtggcgcaatccggacggttcgaaggcgctgatcgcgtacaacgacgcgtcgacggcgaagacggtcaccctcaactggggctcgcagcacgcgacgtactcgctgcccggcaagacgtcggcgacgttcacctggtcggggacccagtcgggcggcggcgaccagacgggctcgttcgtggggctcgcgggcaagtgcctggatgtggcgagcagttcgtccgcgaacgggacggcggtgcagctgtacgactgcaacggctcgaccgcccagcgctggacggtgaaggccgacggttccgtgcaggccctcggcaagtgcctggacgtcacctcggcctcgacggccgacggcgcgaagatccagctgtacgactgcaacggcacggcggcccagcgatggtcgtacaacgcttcgacgggtgatgtggtcaacacggccgccgacaagtgcctcgacgtgaccggcaactcctcggccaacggcgcccgcgcgcagatctggtcctgcacgggcgccgccaaccagaagtggaagctccag

SEQ ID NO: 2697 - DNA, 1602 bp, Streptomyces avermitilis
  CDS (1)..(1602)
atgacggaaaccagcgaactcgacgattcgttccacgtcttcgacacgaccctgcgcgacggcgcacagcgcgagggcattaacctcacggtcgccgacaagctggccatcgcacggcacctggacgacttcggcgtgggcttcatcgagggcggctggcccggcgccaacccgcgggacaccgagttcttcgcccgcgcccagcaggagatcgacttcaagcacgcccagctggtggccttcggagccacgcgccgcgcgggcgccaaggcgagcgaggacccgcaggtcaaggcgctgctggaggcgggcgcccaggtgatcaccctggtcgccaagtcgcacgaccgccatgtcgaactggctctgcgcacgacgctcgacgagaacctggagatggtccgcgacacggtctcgtacctgtgctcccaggggcgccgggtcttcgtcgactgtgagcacttcttcgacggttaccgggcgaacccggagtacgcgaaggcggtcgtacgggccgcggccgaggccggcgccgatgtggtcgtgctctgcgacaccaacggcggcatgctccccgcccaggtccaggcggtcgtcgccacggtcctcgcggacaccggtgcccggctcggcatccacgcccaggacgacacgggctgcgcggtggcgaacacgctggccgcggtggacgcgggcgcgacccatgtgcagtgcacggcgaacgggtacggcgagcgggtcggcaactccaacctgttcccggtggtggcggccctggagctgaagtacggcaagaaggtgctccccgaaggcgcgctgcgcgagatgacgaggatctcgcacgcgatcgccgaggtcgtgaacctcaccccctccacgcaccagccgtacgtcggtgtctcggccttcgcgcacaaggcgggcctgcacgcctccgcgatcaaggtcgacccggacctgtaccagcacatcgaccccgagcgggtcggcaacaccatgcggatgctggtgtccgacatggcgggccgcgcctccatcgagctcaagggcaaggagctcggcgtcgacatcagcggcgaccgcgagctggtcggccgggtcgtggagcgggtgaaggagcgcgagctcaagggctacacgtacgaggcggcggacgcgagcttcgaactcctgctgcgcgcggaggcggagggcaaggcccgcacgtacttcgaggtcgagtcctggcgggcgatcgtcgaggaccgcccggacggcacccacgccaacgaggccacggtcaagctcttcgccaagggcgagcggatcgtcgccaccgccgagggcaacggcccggtcaacgccctcgaccgggccctgcgcgtcgccctcgaaatgatctacccccagctcgccaagctggagctggtggactacaaggtccgcatcctggagggcaagcacggcacgtcctccacgacccgcgtgctcatctccacctccgacggcaccggtgaatggtcgacggtcggtgtcgcggagaacgtgatcgccgcgtcctggcaggccctggaggacgcctacacgtacggcctgctgcgggccggcgtggagccggccgag

SEQ ID NO: 2698 - DNA, 1329 bp, Streptomyces avermitilis
  CDS (1)..(1329)
atggcactcatgggacgagagcactggaagacgatctgggtcggctcggccggcaacatggtggagtggttcgactggttcgtgtacgccagcttcgccacgtatttcgcgggggccttcttccctgacgggaaccccacggcccagctcatgaacaccgccggcatcttcgcggtcggcttcttcatgcgcccggtcggcggctggctgctgggcagagtcgccgaccgcaggggccgcaagaccgcgctgaccctgacggtcacgctgatgtcggcgtccgcggtcctcatcgcgatcgcgccgacgtacgccgtcgcgggctacggcggcgcgttcgtgctgctcctcgctcgcctgctgcaagggctctcggtgggcggtgagtacgcggccagcgccacctacatgaccgaggcgaccgacccgaagaagcgcggattcgcctccagcttccagtacgtgtcgatgacggtcggtcagctgatcggcctcgccctgctgatcatcctccagcgcaccctgtccgaggacgcgctggccggctggggctggcggatcccgttcgtcgtcggcgcggcgggcgcggcagtcgtcttctacctgcggcgcaccatgctggagagcgaggtgtacgaggagtcggccgacggcgacgccgcggtcggcgagaagggctcgctgcgcgccctgtgggagcatcgccgtgaggcgttcctcgtcgtcgcactcaccatgggcggcacgctcgcctactacacgtacacgacgtatctcacgaagtacctctcgaacacggcgggcctgcccaagcagacggccaccctggtctccttctgcgcgctgctggtcttcgcctgcgtccagccgctggccggagccctctccgaccggatcggccgccgcccgatgctgatcaccttcggtgtctgcgcgaccttcctgacggtcccggtgatgaccctcctgtcgaaggtggacagcttctggccggccttcgggctcgcgctcttcgcactggtcatgatcacgccgtacacggcgctgagcgcggtggtcaaggcggagctgttccccaccggcgtccgtgccctgggcgtcgccctgccctacgccctcgcgaactccctcttcggcgggacggcggagtacgtcgccctgtggttcaaggacggcgggatcgagtccggcttctactggtacgtggcggcctgtgccgccgtctccctcgtggtgtacgtcaccatgcgggagacccgggacgtggatctccaccgtgtcggcgacggccggaagtcttcgcacgagcggacggcccggctcgcatcc

SEQ ID NO: 2699 - DNA, 1341 bp, Streptomyces avermitilis
  CDS (1)..(1341)
gtgatcggttcgacgtccgacggcctggtgcccggcaacaccgacatgccggcaacaccgaccaccgcgctgacagcgcttcgtacgccgcacccgccgaccggaggagaaagcatgcacccgcgcacgagaaccgcccccgcgctcctgttcgccgtctgtctcacggctctcgccgcgtacccggcggccgccgacgacccggtgcccacgacggaacgcgtcagcgtcaccctcgacggcgcccagatcgacgacccctcgtaccgcccgcagctgacctccaagggcggcgtcgtgtacaccagcgacggacccgtctggagcaccgaccacaacggcgtgtccgacgcctaccgcaacagcgaacgcgtcagctacaacatgggggccgcccgctcgtacgacccctcggcctgccacaccgcccggatgatcgccttcgtctccgaccgcacgccggccggcggcaccacgccctcggtctacgtgcgcaacacccctgtcggcaagctctcgtacgccagtcacggctaccagggcgtccccttcacctgggcggggcagcccgcgatgagcgccgactgccagtggatggccttcagcgccaccctgccggccacgccggaccacgtggagcagccgcgcgtctaccgctaccgcatctacgacggcacgatcgagcaggtcagcccggactcggcggacggatcccgggcggcggtgcgtccgtcgatcagcgcggacggccggtatgtcgcctaccagtcgtcgatcccgcatccgggcggcccggccaacgacagcgacatctatgtgcgcgacctggagaccggcaccctggagaaggcgtccgtgggacggcacggccgcccggccgaccgcgcctccaccggcccgtcgctgagcgccgacggacggcacgtcgcgttcgactcctacgcctcgaacctcgcccccggcgacaccaacggcaccgtgaacgtcttcgtccgcgacctcgacgcgggcaccacccgcctggtcaagggcgcgggccggcacgcctacaccgccgaggccgcgctgagcggcgacgggctgcacctcgcgtacgtctcggccggaatccgcggctcccgcggcgtgccggccgtgtacctgcgcgacctggccaccggcagaacgcggttgatcagcgtcgacacccgaggacaccgcaacgaccgggcggccggcaacccgtccgtcaacccggacggcacagcggtcgccttcgactccgcctcgcccgacctcgtcccgggcgacaccaacggcacggtggacgtgttcctgcgccgactgggttcccccgaggcg

SEQ ID NO: 2700 - DNA, 618 bp, Streptomyces avermitilis
  CDS (1)..(618)
atggccggtgcgggccgggcgcggaagaacgcgccgccgcgcgaggaggtcctcgccgccgccatggacatgatcgccgagcgcggtctggagaagctcaccatggcggcgctcggccgcgaggtcggcatgagcagcggccatctcctctactacttccactccaaggacgagctgctgctccagaccctggagtggagcgagggccgcctcggcatcgagcgcgggcggctcctcacgcggacggccccggcccgcgaacggctggacgcgtatgtcgacctgtatgtgcccgacggccatcgcgacccgcactggacgctctggctggaggtctggaaccactcgcagaacgccgacgagcagggccgcgagcgacaggcggccatcgagggcgcctggcaccgcgacctggtggcactgctcgcggagggggtctcccggggagagttccgccccgtggacccggaccgcctcgcggcccgggtgcgcgcgctgctcgacggcttctccatccacgtggcgatcggcctccgcggcacggaccgggggcagattctcggccacgtacgggagttcctcgatgagtcgctggggcgaccgggtctcgcggacacc

SEQ ID NO: 2701 - DNA, 1038 bp, Streptomyces avermitilis
  CDS (1)..(1038)
atgagcacccccgccgccgacggcttccgcatgcccgccgagtggaccccgcacgagcgcacctggatggcgtggccgggccccaaccccaccttcgaccaccccgacgacctcgccgagtcgtgccgggcctgggcggatgtggcccgcgcgatacgccgcttcgagccggtcaccgtcgtgtgcgggccggggcggtcggccgaggcgcgagacctgctgggcccgggcatcgacaccgtcgaacgcgacctcgacgacgcctggatgcgcgacatcggtcccaccttcctgaccgacgggaagggcggactcgccgccgtcgactggacgttcaacggctggggcgcccagagctgggcccgctgggagcacgacgcgaagatcgccgcgtacgtcggtgacctcgccggcgcgaagacgtacgcctcgaagctggtcaacgagggcggcgcgatccacgtcgacggcgaggggacggtcctgctcacggagaccgtgcagctcggtgccgagcgcaaccccggctggacccgcgagcaggtcgagacggagatccacgcccacctcgggaccagcaaggcgatctggctgccgcgcggactgaccggcgactacccgccgcacggcttcggcaccctcggccatgtcgacatcgtcgccgccttcgcccgccccggcgtcgtcgtcgcgcaccaccagccggacccggcccaccccgaccacgaggtcagcaaggaggtcatcggcctgctgaaggcggcgaccgacgcgcacggccggcgcatcgaggtcgtcgaggtgcccgccccgacggtcctggaggcggacggccactgggccgactactcctacatcaaccactacctgtgcaacggcggcgtcgtgctctgcggcttcgacgatccgcgcgacgagaccgcggccgggatcttccgccgcctgttccccgagcggacggtgaccctggtggacgcccgtacgatcttctccggaggcgggggcatccactgcatcacccagcagcagccgaagaac

SEQ ID NO: 2702 - DNA, 1668 bp, Streptomyces avermitilis
  CDS (1)..(1668)
atgaatccctacgcatacgccgccacccacggcccccgggccggcgaccgggtccgcctcggcgactcggggctgacgatccgcgtcgagtccgacgcccagcagtacggggacgagttcctcgccgggttcggcaagaccgcccgcgacggactgcacctcaaggccgcggccgtccgcgacacctgtgacgtcgtcatcagcaatgtcgtcgtgatcgacgcggcgcagggcatccggaaggtgtccatcgggatccgggaaggccggatctgctcgatcggacgggccgggaaccccgacaccctcgccggggtcgacgtcgtggtcggcaccggcacgtccatcgtctccggagaggggctgatcgccaccgccggagccgtcgacacccacgtccacctgctgtcgccgcgcatcatggaggcctccctcgcctccggcgtgaccacggtcatcggccaggagttcgggcccgtgtggggcgtcggcgtcaactcgccctgggcgctgcggcacgcgttcagcgccttcgacgcctggccggtcaacatcggcttcctgggccggggttcgtcgtccgacccggcgcccctggtcgaggcactcgccgagggcggcgcgtccggcttcaaggtccacgaggacatgggcgcccacacccgtgccctcgacaccgcgctgcgcgtcgccgaggagcacgatgtgcaggtcgccctgcacagcgacggactgaacgagtgcctctcggtcgaggacaccctgcgggtcctcgacgggcgcaccatccacgccttccacatcgagggctgcggcggcgggcacgtaccgaacgtgctgaagatggcgggcgtcccgaacgtcatcggctcgtccaccaacccgaccctgcccttcggccgggacgcggtcgccgagcactacgggatgatcgtctccgtccacgacctcaagcccgacctgcccggcgacgccgccatggcccgcgaccggatccgggccgggaccatgggcgccgaggacgtgctgcacgacctgggcgcgatcggcatcacctcgtcggacgcgcagggcatggggcgggcgggcgagaccgtgcgacggaccttcgcgatggccgggaagatgaaggccgagttcggcgcccccgaggaccacgacaacgcgcgcgtcctgcgttacctggccaagctgaccatcaaccccgccctcgcgcacgggctcgcccacgaggtcggctcgatcgaggtcggcaagctcgccgacatcgtgctgtggcgcccggagttcttcggcgccaagccgcagctcgtactcaagtcgggcttccccgcgtacggggtcgtgggcgacccgaacgccgcgaccgacacctgcgaacccctcgtcctcgggccgcagttcggggcgcacggggcgacgcccgccgagatctcggtggccttcgtggcgcaggcggcgctcgaccagggcaacgaccggatgccgacccgccgacggagggtcgccgtgcgcggcacccgcggcatcggccccgccgacctgcgcctcaactcccgcaccggagcggtcgacgtcgaccagcgcaccggcctggtcaccctcgacggcgacccgatccgttccgagcccgccgactcggtctccctcaaccgcctgtacttcctc

SEQ ID NO: 2703 - DNA, 681 bp, Streptomyces avermitilis
  CDS (1)..(681)
gtgcggctgacccccacggaacgtgaccggctgctgctcttcggggccgcggagctggcccgggcgcgcagggcgcgcggtcttcggctcaatgtgccggaggcgaccgctctcatcgccgacaccgtctgtgaggccgcccgggacgggcgccggctcgccgaggcgatcgccgccgcgcgagccgtgctcggcccggacgacgtactgccgggcgtcgccgacatcgtcaccgaggtgcatgtcgaggctgtcttcgacgacggttcgcggctcgcggtggtgaccgacccgatcgggggagggctgggcgaccaggctccgggcgcgctgctgccggggccggaacacaccgagcccgaggccgtcgtacgggtgctcgtcaccaacacggccaccgtgcccgtctccgtcacctcccacttccacttcttcgaggccaacccgcggctcgacttcgaccgcgcggccgcctacggcatgcgggcggccgtgcccgcgggctcatcggtgcggttcgggccgggggagagcgtcgagatcgggctcgtgcccgtcggcggcgaccggatcgcgatcgggttcgccggtctggtcgacgggccgctggacgcgcctggggcgaaggaagaggccctgcgcagggccgccgcctgcggatatctcggagtcgagcagcga

SEQ ID NO: 2704 - DNA, 1086 bp, Streptomyces avermitilis
  CDS (1)..(1086)
atgacgacgcccacgatcgagctcaagccctccgccagtccgctctccgacgcggagcgcgaggcgatcctggccagccccggattcggccgccacttcaccgaccacatggtgacgatcaagtggacggagggacgcggctggcacgacggccagctcgttccgtacgccccgctctccctcgacccggccaccatggtcctgcactacgcgcaggagatcttcgagggcctgaaggcgtaccgccagcccgacggctcggtggcctccttccgccccgacatgaacgccaagcgcttccaggcctcggcccgccgcctcggaatgccggagctgccggtcgagacgttcatcgaggcgtgcgacgtgctggtccagcaggacgcgtcgtgggtgccggcgcacggcggcgaggaatccctctatctgcgcccgttcatgatcgcgaccgaggtcggcctgggcgtgaagcccgccaacgagtacctcttcctcgtcatcgcgtccccggcgggcgcgtacttcccgggcggcgtgaagccggtctcgatctggctctccgaggaccgcgtgcgcgccgtccccggcggcatgggtgacgccaagaccggcggcaactacgccgcgtcgctgctcgcgcaggccgaggccgccgagaagggctgcgcccaggtcgcgtacctcgacgcggtcgagcacaagtgggtggaggagctcggcggcatgaacctgtacttcgtgtacgggaacaagatcatcacgcccgccctgaccggctccctcctcgcgggcgtcacccgcgactccctgctctcggtcgcccgtgacctgggctacgagtccgaggagggccgcgtctccatcgaccagtggcaggccgacaccgagaacggcacgctgaccgaggtcttcgcctgcggtacggccgcggtcatcacgccggtcggcacggtcaagcgcagcagcgccgagtggcagcactcgggcggtgagccgggcgaggtcaccctgaagctgcgcgaggccctcctcgacatccagcgcggcatcggcgaggacaagcacggctggatgcacccgctgggc

SEQ ID NO: 2705 - DNA, 1041 bp, Streptomyces avermitilis
  CDS (1)..(1041)
atggctcgcagcatcaatctcgcagtgattcccggtgacggcatcggccaggaggtcgtggcccaggggctcaaggtcctctccgccgcccttccctcggacgtgaagctggagaccaaggagttcgacttcggcgcccggcgctaccacgccaccggtgagaccctcaccgacgccgacctcgacgccctgaagcagcacgacgcgatcctgctcggcgcgatcggcgacccgtcggtcccgtccggcgtcctggagcgcggcttcctgctcaagctgcgcttcgccttcgaccaccacgtcaacctgcggccctcgaagctgctccccggcgtcgagaccccgctcgccggccagcccgagatcgacttcgtggtggtgcgcgagggcaccgaaggcccgtacaccggcaacggcggcaccatccgcaccggcaccccgcacgcggtcgccaccgaggtctcgctgaacaccgccttcggcatcgagcgcgtggtgcgcgacgcctatgcccgcgcccaggcccgcccccgcaagaagctggcgctcgtccacaagaacaacgtgctcgtgcacgccggtcacctgtggacggacatcttcaacaaggtgggcgaggagttcccggacgtcaccaccgagtacatgcacgtggacgcggcgaccatctacctcgtcacgcagcccgagcgcttcgacgtgatcgtcaccgacaacctcttcggtgacatcatcaccgacctcgccgcggcgatctccggcggcatcggagtcgccgcctccggcaacatcaacccgtccggcgcgtacccgtcgatgttcgagcccgtgcacggctcggcacccgacatcgccggccagggcaaggcggacccgtccgccacgatcctgtccgtcgccctcctgctgcgccacctcggctacgaggccgaggccgcgcgtatcgaggaggccgtctccgccgacctcgcggagcgtgtgggcaagcccgcccgcagcaccgacgagatcggtgacgcgctcaccgtacgagtagcaggc

SEQ ID NO: 2706 - DNA, 1647 bp, Streptomyces avermitilis
  CDS (1)..(1647)
gtggccgtacacgcctcacgggtcaatccgtcggctgccgttcacccgtacgtttggcggtcgttgggcttcgctgggaagttcaccggcatggacaccccgaacgtcggcatccccgagcggctcgcgcgccgtatgagcatggcggagcagtacgagtacctgcgtacgaagctgtcccggcgtggcgtgctgctgaccgcgggcggggtggccggcgggctgctgaccggctgtgccgggtcgggcacggcaaccggtaccccgtcgtccgcgcccgccaccgggacggtgcacggctccgccgtggcccccttcggccgccatctcgccttcggcgcggatccgaagacacagatgcggatctcgtggcaggtgccgctcgcggtccaaaagccgtatgtacgggtggggctgaagcccaccgacctgagccggaggatggcggccgaggtccgggatctgcacacgccggggctgaccgggcagcggttcgcggtggaccagtactacctgcacgcggccctcgacggcctcaggcccggtacgcggtactactacggggtcgggcacgacggcttcgacccggcgtcccgggagcggctgtccacggtcggctccttccgtacggcgcccgcggctccggagacgttcgtgttcaccgccttcggcgaccagggggtgagctacgacgcgctcgccaacgacaaggtgatcctcggccgccacccgtccttccacctccacgcgggcgacatctgctacgcggacacgaccgggcacggcgaggagtcggacatctacgacccccgggtctgggaccagttcctcgcgcagaccgagtcggtggcgaagtcggtgccgtggatggtgacgaccggcaaccacgacatggaggcgtggtactcgccgaacgggtacggcggccagtcggcgcgctggacgctcccggacaacggcttcgacccgcagaaggcgccgggcgtctactcgttcacctacggcaatgtcgggatcgtggcgctggacgcgaacgacgtgtcgtacgagattcccgccaacaagggctttacgggcggtcggcagacggcctggctcgaccggcggctcggcgaactgcgcgcgtcggcctcggtggacttcgtcgtggtcttcttccaccactgcgcgtactcgacctcgacgcacgcctccgacggcggcgtgcgggacgcgtggctgccgctgttcgccaagcaccaggtggacctggtgatcaacgggcacaaccatgtgtacgagcggaccgacgccatcaagggcggccgcgtcggcagggcggtcccggtcggcgcgtcgaccgacccgacgcgggacgggatcgtgtacgtcacggcgggcggcgcgggcaagagcctgtacagcttccccgacggggtcaaggacagctacgaggggaacgtggccgaccgcgagtccgtggacaccttccactggaccgaggcgcgccatcgcaaacacgacaccgtggagtggtctcgggtgcgctacaccggcttctcgttcctctcggtggaggcggagaccggcgcggcggcgaagctcaaggtgtcggcgctggcgcagagcggcgagcggatcgactacttcgaggtgcggcgcggggcg

SEQ ID NO: 2707 - DNA, 129 bp, Streptomyces avermitilis
  CDS (1)..(129)
atggccgagacgaccgtccgccgccgagtccgtcacatctcccctgcgagcgaatccgaccgcaagaacgccgccgcagccctccagcgcgccctcgaccgccgggacaacggcgggaagaccgggcac

SEQ ID NO: 2708 - DNA, 567 bp, Streptomyces avermitilis
  CDS (1)..(567)
gtggtggtgggtgtccgcgatactgggccgatggccatccgactccgtaccgcccataccgtggatctcaccgccgccgaactccgttccgtccgctccttgttggacggcgccttcgaggggggctttgacgacgaggactgggaccacgggctcggtggtctccacgtcctcgtgtacgacgcgcgggggctcgcggcccacggctccgtcattcagcgccgcgtgctgcaccgcggccgctcgctgcgcgtcggctacgtggaggcggtcggggtccgtgccgaggcacgccggagcggtctgggcgggcgggtgatggccgagctggagcggatcgtggagggggcgtacgacctcggggcgctctcggcgagcgagaagggggccgccctgtacgcggcccggggctggcaggtctggccgggccggatcggcgcgctcggccccgacggcatcgtgcgcctgccgggggaggaaggcagcaccttcgtgcgcgccgcgggggccggccccctcgacccggcgtacgacctggtcttcgactggcgcgacggtgacgtgctc

SEQ ID NO: 2709 - DNA, 867 bp, Streptomyces avermitilis
  CDS (1)..(867)
atgaccacgcaccggatccaccaccgcaccgccaccgtccgcggccacgagatccactaccgggaggcggggccggccggcgccccggtactgctcctgctgcacggcttcccgaccagttcgcacatgttccgcgacctgatgccgctcctcgccgaccgctaccacctggtggctcccgaccacctgggcttcggccgctcgtcggcgccggccgccacggagttcccgtacacgttcgccggactggccgagatcacggacgagttcaccgaacagctcggcctgaaggagtacgcgctctacatccaggactacggcgccccgatcggcctgcggctcgcgctcgcgcaccccgagcgggtgacggcgatcatcacccagaacggcaacgcgtacgaggacgggctgggcgccgaggcctgggcacccgtcctcgccctgatcgcggagcgcacacccgcgaccgaggagcccgtccgcgcgctcagtggccccgagggcatcaagtggcagtacctgcacggcgtcccggaccccacgctggtcagcccggacgcgtacgaacacgacgcggcgctgatggcccgccccggtcagtccgagatccagctcgacctgatctccgactacggctccaacttcgccctctatccggcgttccaggagtacttccgcaccagccaggtcccgctcctcgcggtgtggggcggccacgacgagatcttcgtcccggcgggcgccctcgccttccagcgcgacctcccgacggccgagatccacctcctgcccaccggccacttcgccctggagacacacgcgggccaggtcgccgccctgatggacgacttcctggcccggcgggtg

SEQ ID NO: 2710 - DNA, 1629 bp, Streptomyces avermitilis
  CDS (1)..(1629)
atggatgctgtgacccaggtccccacccccgtcaatgagccggtgcacggctatgcccccggctcgcccgagcgcgcccgtctggaggccaagctcaaggagctggccgagaacccgatcgagctgccgatgaccatcggcggcgagaagcggctcggcggcggtgagcgcttcgaggtggtgcagccgcacaaccacaaggccgtcatcggcaccggcgcgcacgccacgcagcaggacgcgcaggacgcgatcgacgccgcgctggccgccgccccggcctggcgcgcgatgtccttcgacgaccgcgccgcgatcatcctgcgcgccgccgagctgctgtccggcccgtggcgcgagaccctcgccgcctccaccatgctcggccagtcgaagaccgcccagcaggccgagatcgactgtccgtgcgaactggtcgacttctggcgcttcaacgtcaagtacgcccgcgacctgctcgccgagcagcccccggccaactcgccgggcgtctggaaccgcctcgaccaccgcccgctcgagggcttcgtctacgcgatcaccccgttcaacttctcggcgatcgcgggcaacctgccgacggctccggcgctcatgggcaacgtggtcgtgtggaagccgtccccgacgcagacccacgccgccgtgctgctgatgcggctcctggaggaggcgggcctgcccaagggcgtcatcaacctcgtcaccggtgacggcatcgaggtctccaaggtcgccctggagcaccgcgatctcgcgggcatccacttcacgggttcgaccaagaccttccagtacctgtggaagacggtcggcaacaacatcgagaagtaccgctcgtacccgcgcctggtcggcgagaccggcggcaaggacttcctggtcgcgcacccgagcgccgaccgcgcggtcctgaagaccgccctgacccgcggtgccttcgagtaccagggccagaagtgctccgcgacctcccgcgcctaccttccggcctccatctggaactccggcttcaaggaggagttcgcggccgaggtcgactacctgaccatgggtgacgtcaccgacctgtcgaacttcgtcggcgcggtcatcgacgagcgctcgttcgccaagaacaaggcggccatcgaccgcgccaagtcggacccgacctgcacgatcgtggcgggcggcgagtacgacgactcggtcggctacttcgtgcgcccgacggtcgtcgagtgctcggacccggagaacgaggtcttcaagaccgagtacttcggcccgttcctcgccgtgcacgtctacgaggacgacgcgtacgacgagatgctgacccagatggagtcggcctcggactacgcgctgacgggtgcggtcgtctccaacgaccgtgcggcggccgcgtacacgatggacaagctccgctacgccgcgggcaacttctacatcaacgacaagtcgaccggcgccgtcgtcggccagcagcccttcggcggcggccgtgcctcgggcacgaacgacaaggcgggcgccccgcagaacctgatgcgctggacgctgacccgcgccatcaaggagacgctggtcccgccgaccgactacacgtacccgcacatgggc

SEQ ID NO: 2711 - DNA, 924 bp, Streptomyces avermitilis
  CDS (1)..(924)
gtgctgggtcccgtgattctcgccgcgtcgcgcagcgaccgcatgcgccgcttcgtgtcggcggcccccggcaccaagcaggtggtcgcccgcttcatcgccggcgagagcgtcgaccaagtggtgccggtcgtccaggactccgccgccaaggggctcgaggtcaccctcgacgtcgtcggcgaggacatcaccacccgcgagcaggcgtacgccgcccgggacgcgtacctcgaactgatcggccgcctcaaggagctggacctcggcacccaggccgagatgtccgtcaagctgtcgatgttcgggcaggcgctggacggcggtcacgagctggccctcgccaatgtccgcccggtcgtcgaggccgccgccgccatcggcacgaccgtcacgctggacgcggaggaccacaccaccctcgactcgatgttcgccatccacgaggagctccgcaaggacttcccggggaccggctgcgtcatccaggcgtacctcttccgtaccgaggccgacgcccgccgcctcgccgcgaacggcagccgggtgcgtatcgtgaagggggcgtacaaggagcccgccgaggtcgcgtaccagcagaagtccgagatcgacaaggcgtacgtccgtgtcctgaggatcctcatggagggtgaggggtacccgatgatcgggtcccacgacccgcgcctcatctccatcgcccaggagctggcccgccgcgccggacgcaagctcgacgagtacgagttccagatgctgtacggcatccgcggcgaggagcacctgcgcctggcagccgagggccaccggatgcgggtgtacacggcgtacggcaccgactggtacggctacttcatgcgccgcctcgcggagaagccggccaacctgcgctttttcgcccgcagcatgctgacccgaggt

SEQ ID NO: 2712 - DNA, 1197 bp, Streptomyces avermitilis
  CDS (1)..(1197)
atgcgggagaatgcccgagtgaaggccgattacaagggtgactaccaggagctggtcgacgagatctcggcgctcctgggcgcccccgcgacgctggagaaccgggacttcgaactgatcgccttcgccgcctacgacagtgacggcgacggcggcttcgacgaggcgaccctggacccggtccgcacccgttcgatcctcacgcgccgctcgaccccggcggtgcggaagtggttcgagggcttcggtatcgcgcaggcggccggcccggtccggatcccgccgaccccggaggcgggggtccaccggggccgcgtctgtctgccggtacgccatcggggggtggtgctgggctatgtgtggctgctggacaccgatccggggccgtccacggagcagctggccgccgccatggaggtcgccgcccgtatcggcgcgctcctcggcgacgaggcgcaggcgggcgcggacctgacccgtgaactgcgggcggtgctcaccgcggagcgcggctggcagcgggacatggcggtcgcggagctgcgtacggccctcggtccgcgcggcgacagcctgcacacggtggtctgcgtggccccctggccctccgccgacccggacgacgcgccttcggtgcgtacggtgccgggggcgaccgcgctgtgcacggtgccgtgggggacgaccgcgcagagtctggcgctgctggtgcggctgcgctcggcggacgtcctgacgccggcgctgaccgcggccgcccggctgctggagcgcgcccggggcggcacagcggcggcggccggggtcgcggtcgcccgcagcgggctcgtcgaactgggcaccgcctggcaggaggcgtcggccgccgcgcgtgcggtgctggcggagccgcggctcgggccggtcgccgagtgggcgtccatcggcccgttccggctgctgaccgcgctccctcccaaggcggcgcacgaccccgccgtacgcaccctgctctcccccgcccaccgcgaactggcccgcacggccgaggtgtacctggactgtgcgggccaggcgggccgcacggcggcggagttgggcatccaccggcagacgctctactaccgcctgtcacgcgtcgaacagctcacgggcctggacctggacgacggcgaggaccggctgctgctgcacatggcgttgaagggggcgcggctt

SEQ ID NO: 2713 - DNA, 1494 bp, Streptomyces avermitilis
  CDS (1)..(1494)
gtgaagatcgtgatggacatgaacggcacgtcgctcgatgagctctcccggtcctgggacgaagtccgcgagaaccaccgcgactactacaacgaccagtacgaccggacggtcctcgactgcgcggcccgcctcgccgccgaccccggcggtggggcggcgtacgtgtggacgctggggctgctggtgatggccccctacgtcaactggcttccgggcgagggcgtcaccacggccgccgtcgccgcgctggaggccgccgacgaggcgctgcgcgaccggccgtgcgaccacgcgtcccacccgtaccaggtccatgacgccgaggacgacccgtatctgaccgagcaactggccccgctcgccgacgagcgcgccgaccgggaggggcaacggccccgggacgaatggctctgcccgccgaacgtcgccggattcgcgcggatcgccctggacgtcgtcgacccgggatcggtcacagatgtgccgccccgtctgccggccgaggcccaggacaccatcgacacgctgtcggcgctgctgcacggctacccccacccggggaccgacatcgacgacgagatctcctcgcaggcgtcgaacctctcgtgcgcggaaccggcggaccgcgccggacatctgctggtcgtcagggcggtgacctggtacgccgtctccggaatggtgcgtacgaaatccgtcctcgacgacctggccgaagcggtcgagaaggcgttgccgcacttcgccgccgcgtcctgcgcccacgagtggcatgcgaccctgcccgacagcggcccggacgccgcggaactcggcgtccgcctgagcagcgccggtgggcgcggcaggtacgaacgcgaccgtaccgagtcggggcggggcgctccgctggagcacgtactgtgcccggtcttcatggcggaggtcgcggacaggacactgacgatgctgcgcgagcggcgcgaggtgctcttcgggaaccgcgacacctcccacctggacgccgagtacctgcgggccgacggacggctggagatcgcgaggatcgtggagcggctcgcccaccacagctggaacgaggagtacgccgacgatctggccctgtgggccgcccgccgccacgagcgggccgacgggcgggaacgtgcggtgctgctgctcgccgcccaccaggcgacggagatctcgtatccgagcccgcccctgtcggtggtccgcggcgtcctcgcgaccctgcgtaccgtcgccgccgcaccccgcctcgagcgctgcgcgcacgacgacgagcacccgccgctgcggtacgaggagttccgcgacgccatgctccacttctacgcgcccgaggagttcccgccacccgaggagtgccccagcccggaggcctggacctgcccgcggttcgccgtcacggtcgccgaggagtgcgtcagcgggctggagggtctgtacgaggacgaggacgaggcagagggcgagcccgagaacggg

SEQ ID NO: 2714 - DNA, 588 bp, Streptomyces avermitilis
  CDS (1)..(588)
atgggacaccgtgaggatctgctcgagggcgccaagcgctgcctggtggagaaggggttcgtgcgcacgaccgcgcgcgacatcgtgaaggagtcggggaccaacctggcctcgatcggctaccactacgggtccaaggacgcgttgctcgcggaggcgtacgtcgatctgatctcgaacgtcggcgacacgttcggggcgttcgacgaaggcgccgcgacgggggagcccggttccctcgaacgcttcgaggaagcctggaggggcgtcatcaggtccttcaccgaggcccgcccgatctggctgctcaccttcgaggtggtcaccaacgccgaccggcttcccacggtccgcgagcacctggtcaaggcccaggacgaggggcgccggggcctcatccccatgttcatgggcggtcgcgaggaggacgtcgacgacgaggcgttgcggacgctcggcggcttctaccagacgctgctcaacggactgtgcctccagtggctcttcgatcccgacagcgcgtccacggccgagggactcaccgcgggcctgcgacgcgtgatcgaggcggccgccaagccgacgggc

SEQ ID NO: 2715 - DNA, 1470 bp, Streptomyces avermitilis
  CDS (1)..(1470)
atgctccctctgctcctggtctcgatggacgtctcggtcctctacttcgcgatcccctcgatcacggcggacctggagccgagcagcacccaacagctgtggatcttcgacatctacgcgttcgtgctcgccggcctgctgatgacgatgggctcgctgggcgaccgcatcggccgccgcaagctcctcctgatcggcgccgcggccttcggcacggcctcgctggtggccgcgtacgcgaacagcgccgagaccctgatcgcggcccgcgcggtcctcggcatcggcggcgcgaccctgatgccgtcgacgatggcgatcgtgcgcacgatgttcaccgaccccgggcagcgggcgaaggccgtcggcctgtggtcgggtgtcatgacggccggcatcgcgctcggctcggtgatgagcggtgtcctcgtcgagtacttctggtggggctcggtcttcctggtcaacctgccggcgatggcgctgctcctggtcctcggcccgatcctgctgccggagtcgaagaacccggacccgggccgcttcgacctcctgagcgtgccgctgtcgatggcggccgtactcccggtgatctacgggctcaaggagatcccttccgagggctggcacgcctcgtacgtggtgtgcgtgacggtgggtctgctcttcgccgccctcttcgtccaccgccagcgcacggccgcgtcgcccctgatctcaccggccctcttccgggcccacggcttcacccccgccatggtcctcaacctcatctcctgcttcgccatgctgggttcggccttcttcaccacgcagtacctccagtccgtcctcggcaacagcccgctcgaggcggccctgtggtcactgctcccgtcggtgctgatcggcttcgcggcacccgtgaccacccagctcgtacagaagggcgtgaaccgcgcgtacgtcgtcagcgccgggttcgtcgtcgccgcgggcggctacgggatgctggcgctcgccggtacggactcgatgtggctggtgctggccggggcgggtgtcctcgcctccgggatcgtcaccgtgatgtcccagatgatggacctggcgatgggcgcggcaccgttggagcaggcgggcgcggcctcttcgctgatggagacgagcgcggagttcggcggcgcgctgggcatggcggtcctgggttccatcggcacggcggtctaccaccacgagatcccggcctcggccccggctcccgcccacgagacgctgggcgcggcgctggcggtggcacaggagctgccgggcggcgcgggcaccgcactgatcgcggtcgcgcgggacgcgttcaccagcggtatgcaggcggcggcgctcgccggggcggtactcctgctgggcgcggcgttcctggcgacggcgacgctgcggaaggtggccgtgcgcgagagcgagtccgcgacgccggaacaggtgcccgccgcc

SEQ ID NO: 2716 - DNA, 3012 bp, Streptomyces avermitilis
  CDS (1)..(3012)
gtgccgcagctcccgccttccgtcgagaccccgttcatcggccgtgcagccgaactcgcccgcctcaccggcgtactcgaccgcgcccgcggcggcgacccccgcgccgtactcgtcgcaggcgacgccggcgtgggcaagacgcgcaccctcgccgaagccgccgcacacgccacccgcaccggcatgacggtcctcaccggccactgcgtcgacctcggcgacgtgggtctgccctacctcccgttcacggaaatcctcggcaccctcgccaccgacgaccgcctcgcccccgccctggcagcccaccccgccgtcgaccgcctcctcggcggcggagccgacggcagccggctccagctcttcgagagcgtcgccgccctcctcgccgacctctccgaacacggccccctcctcctcgtcctggaggacctccactgggccgaccagtcctcccgcgacctcctccgtttcctgctcagccggggcgtgctccaactccccacggccggcgcccccgcccaccgcctcgcggtcttcgcctcgtaccgggcggacgacctccaccgccgccacccgctgcgccccctgctcgccgagctcgtacggctgcccgccgtcgaccgcctggagctgcgcccgatggccgacgccgaggtcacccgcctcgtccgtgccctgcgcgccggcccgctccccgacaccacggtccgccggatcgtcgaacgcgccgagggcaacgccttctacgcggaggaactgctggccgccaccaccgacacggccaccgggacgggcgagcccccgcacgagtccatggacggccccaccccggcgctgcccagcggcctcgccgacgttctcctcatccggctggaacaactgtcggacacggcccagcaggtgctgcgcacggccgcggtcgccggccgccgcgtcgagcacgacctgctgcgcgaggccgtccaactcccggacgacgaactggagtcggcactgcgcgaggcggtcggccgccaactcctcgtcccggacgaccgcgacacctactcgttccgccacgccctcacccgcgaggcggtctacgcggacctgctgccgggcgaacgcgtgcgactgcaccgcacgttcgcggggctcctcaccgccgcgggccgacacgacggcccacccggctctcaccccgccaagaccgccgccgaacgcgcccaccactcccgcgagagccacaacctccccgacgcgctcagcgcctccctcgaagccgccgaccacgcccagcggctcggcgcgcccgccgaggagctgagccacctcgaggcggcgctggagctgtggccggccgtggcccccgcggaccgccccaccacgcccggcctggacacggtgacgctcacgctgcgcgcgtccgcggcggccgcgcacgccggcgagagccaccgcgccgtctccctgacccgcgccgccctcgcccgcgccggcacggacacggactcggaactcgccgcccgcgtccgctacaccctcgccggcaacctgatgcgcgtcgacagcctcaaggccgcgttcacctacagcagcgaggcgctcgccatgatccccgccgagcccccgtcccgtacctgggtgtgggcggcggccacccacgccatggccgcgcgctacgtgggcgaggacgaggacgccgggcgggtggcccggcaggccctggccgtcgccgagcggctcgaactggccgacgcccaggccgacttgatcgtctccctggtcggcctggacggacacgaccggcgtacccccgagggccgggaccggctgcggcaggcccgcgaactggcccgccgcgcgggcaacgtgtcggtcgagatgcgcgccctgttcaacctggccatcggcgcctacgagaccggcgcgctggacgactgcctgacctggctgtccgacggactggaccgggcgagccgcaccgggctgctgtcctcgccgtacgccctggagctgcgctacctccagtccctgatcctctacaccctgggccgctgggacgagtgcgcccgggcggccgccgccgacgccgaacggctgcccgcggcagccggattcgccatcggccccgcgctgtatgtggcgctggcccgcggcgagcggtccgccgccgaccgcgcccaggcgctcctcgacgggccgtccgagtggatggccacgctcgtggccggcatcgtgctgaccgacgccgcggccctgcggggcgatccggaggcggccgtcgagcgcgtccacggcacgctggccgcgctggccgacggcgcggtcaacgagcgcccggacgtcggcgtacggcttgccgcgctcgccctggccgcggtcgccgacgcggccgaggaggcgcgcctgaccggcgacgcggcgaccgtccgccgctggacggacaccgcggccgagctgctggagctggcccgcaccacggccgaccggggcgaggacggaaccgagcagggccccgagggcgtggcctggctggcccgcgccgaggcggagtggacgcgcacggtgtccggtccggacgtggtggtgtgggagaaggcggtgaccgcgttcgcgtacggcgatccgtacgagcgggcgcgttgccggcgccggctggctcaggcgctgctcgcggcgggccgtcgcgaggaggccgccgagcaggcccgggcggtccgcgagaccgccaccctcctcggcgccgcgcccctgctcgacgccgtggagacgctcgtccgccgcggccgcctcgccgagacctcacccgcggcggacggcaccgcggtactgacggcccgggagaacgacgtactccgactgctggcccgcggccgcaccaaccggcagatcggtgaggagctgttcatcacgggcaagacggcgagcgtccacgtctccaacatcctggcgaagctgagcgcggcgagccgcacggaagccgtcgtgatcgcgtaccgggaggggctgctcgaaccggagccgacc

SEQ ID NO: 2717 - DNA, 1587 bp, Streptomyces avermitilis
  CDS (1)..(1587)
gtgagctcgaaacctgtcgtactcatcgctgaagagctgtcgcccgcgaccgtcgacgcccttggcccggacttcgagatccggcactgcaacggcgcggaccgcgccgagctgctgccggcgatcgccgacgtggacgccatcctgatccgctcggccaccaaggtcgacgccgaggcggtcgccgccgccaagaagctgaaggtcgtcgcacgagccggcgtcggcctggacaacgtggacgtctccgccgccaccaaggccggcgtgatggtcgtcaacgcccccacctcgaacatcgtgaccgccgccgagctggcctgcggtctgctcctggccaccgcgcgcaacattccgcaggccaactccgcgctgaagaacggcgagtggaagcgctccaagtacacgggcgtcgagctggccgagaagaccctcggcgtggtcggcctcggccgcatcggcgcgctcgtcgcccagcgcatgtcggccttcggcatgaaggtcgtcgcctacgacccctacgtgcagcctgcccgggccgcgcagatgggcgtgaaggtcctctccctcgacgagctgctcgaggtctccgacttcatcaccgtgcacctgccgaagacccccgagaccctcggtctcatcggcgacgaggcgctgcgcaaggtcaagccgacggtgcgcgtcgtcaacgccgcgcgcggcgggatcgtcgacgaggaggcgctgttctcggcgctcaaggagggccgcgtcgccggtgccggcctcgacgtgtacgcgaaggagccctgcacggactccccgctcttcgagctcgacgaggtcgtctgcaccccgcacctcggtgcttccacggacgaggcgcaggagaaggccggtatctccgtcgcccggtccgtccgtctcgccctcgccggtgagctggtcccggacgcggtgaacgtccagggcggcgtcatcgccgaggacgtcaagccgggcctgccgctcgccgagaagctcggccgcatcttcaccgccctctcgggcgaggtcgcggtccgcctcgacgtcgaggtgtacggcgagatcacccagcacgacgtgaaggtgctcgaactctccgcgctcaagggcgtgttcgaggatgtcgtcgacgagaccgtgtcgtacgtcaacgccccgctgttcgcgcaggagcgcggcgtcgaggtccgcctgacgaccagctcggagtcctcggaccaccgcaacgtcatcaccgtgcgcggcacgctcggcaacggcgaggaggtgtcggtctccggcacgctggccggtccgaagcaccaccagaagatcgtggccgtcggcgagtacgacgtggatctggcgctcgccgaccacatggtcgtcctcaagtacacggaccgcccgggtgtggtcggcacgctcggccgcatcctcggcggggccggcatcaacatcgcgggcatgcaggtgtcccgcgcggtcgccggcggcgaggccctcgcggtgctcacggtcgacgacaccgtgtcgcagaacgtgctgacggagctggcggaggagatcggcgcgacctcggcgcggtcggtcaacctcgtc

SEQ ID NO: 2718 - DNA, 999 bp, Streptomyces avermitilis
  CDS (1)..(999)
gtggccgagctgttctacgacgccgacgccgacctgtccatcatccagggccgcaaggtcgcggtcatcggctacggcagccagggccacgcccacgcgctgtcgctgcgtgactcgggtgtcgacgtccgcgtcggtctgcacgagggctccaagtccaaggcgaaggccgaggagcagggcctgcgcgtggtgacgccgtcggaggccgccgccgaggccgacgtcatcatgatcctcgtcccggacccgatccaggcccaggtctacgaggagtccatcaaggacaacctcaaggacggcgacgcgctgttcttcggccacggcctgaacatccgcttcggcttcatcaagcccccggccggcgtcgacgtgtgcatggtcgcccccaagggcccgggccacctggtccgccgccagtacgaggagggccgcggcgttccgtgcatcgcggccgtcgagcaggacgcgacgggcaacggcttcgcgctcgccctctcgtacgcgaagggcatcggcggcacccgcgccggcgtcatcaagacgaccttcaccgaggagaccgagaccgacctgttcggtgagcaggcggttctctgcggtggtacggccgcgctggtcaaggccggcttcgagacgctgaccgaggcgggctaccagccggagatcgcgtacttcgagtgcctccacgagctgaagctgatcgtcgacctcatgtacgagggcggcctggagaagatgcgctggtcgatctccgagaccgccgagtggggcgactacgtcaccggcccccgcatcatcacggacgccaccaaggccgagatgaagaaggtcctcgccgagatccaggacggcacgttcgcccaggcctggatggacgagtaccacggcggtctgaagaagtacaacgagtacaagacccaggacgagaaccacctcctggagaccaccggcaaggagctgcgcaagctcatgagctgggtgaacgacgaagaggcg

SEQ ID NO: 2719 - DNA, 525 bp, Streptomyces avermitilis
  CDS (1)..(525)
atgagcaagcacaccctctccgtcctcgtcgagaacaagcccggtgtcctcgcccggatcaccgccctgttctcccggcgcggcttcaacatcgactcgctcgccgtcggtgtcaccgagcaccccgacatctcccgcatcaccatcgtggtgaacgtgatcgaggcactgccgctcgaacaggtcaccaaacagctcaacaagctcgtcaacgtcctgaagatcgtcgagctggagccgtccgcggccgtgcagcgcgaactcgttctggtgaaggtgcgcgccgacaacgagacgcgctcccagatcgtcgagatcgtccagctgttccgcgccaagaccgtggacgtctccccggaggccgtcaccatcgaggccaccggcggcagcgacaagctggaggccatgctcaagatgctggagccgttcggcatcaaggagctcgtccagtccggaacgatcgcgatcggacgtggggcacgttcgatcacggaccgctcgctgcgcgcgctggaccgatccgcg

SEQ ID NO: 2720 - DNA, 1848 bp, Streptomyces avermitilis
  CDS (1)..(1848)
atgaccgagcaggccaccggggcccaccatccgcagccgcggccccgttccggaggacagcagtccgcccccgagcacgtcacgggcgcgcagtccctcatccgctcgctcgaggaggtcggggcggagacggtattcggtatccccggcggcgcgatcctcccggcctacgacccgctgatggactcgaagcgcgtgcggcacgtgctcgtccggcacgagcagggcgcgggtcacgcggccaccggctacgcgcaggccaccggcaaggtcggcgtgtgcatggccaccagcggcccgggtgccaccaacctggtgaccccgatcgccgacgcccacatggactcggtgccgctcgtggcgatcaccgggcaggtcgcgtccaaggcgatcggtacggacgccttccaggaggcggacatcgtcggtatcaccatgccgatcaccaagcacaacttcctggtgaccaaggccgaggacatcccgcggacgatcgcggaggccttccacatcgcctccaccggccgtccgggcccggtcctcgtcgacatcgccaaggacgccctccaggcgcagaccaccttccagtggccgcccaccccggacctgcccggctaccgcccggtgaccaagccgcacgccaagcagatccgcgaggccgccaagctgatcacccaggccaagcggcccgtcctctacgtcggcggcggcgtcctcaaggccaaggccaccgccgagctgaaggtcctcgcagaactcaccggagcgcccgtcaccaccaccctgatggcgctcggcgcattccccgacagccacaagctgcacgtgggaatgccgggcatgcacggtgcggtcaccgccgtcaccgcgctgcagaaggccgacctgatcgtcgccctcggagcccgcttcgacgaccgcgtcaccggcaagctggacagcttcgccccgtacgccaagatcgtgcacgccgacatcgacccggccgagatcggcaagaaccgcgccgcggacgtgccgatcgtcggagatgcccgcgaggtcatcgccgacctggtccaggccgtgcagaaggagcacagcgagggccacgccggcgactacaccgcctggtggaaggacctgaaccgctggcgcgacacgtacccgctgggctacgagcagccggacaacggctcgctgtcgccgcagcaggtcatcgagcgcatcgggcagctcgccccggagggcacgatcttcgcggcgggcgtcggccagcaccagatgtgggccgcgcactacgtcaagtacgagcagcccgcgacctggctgaactccggcggcgccggaacgatgggctacgcggtcccggccgcgatgggcgccaaggccggtcagccggaccgtacggtctgggcgatcgacggcgacggctgcttccagatgaccaatcaggagctcaccacctgcgccctgaacaacatcccgatcaaggtcgccatcatcaacaacggcgccctcgggatggtccgccagtggcagaccctcttctacaaccagcgctactccaacaccgtgctgcacagcggcccgggcgcggacggaaagcagccgagcgccggcacccgcgtccccgacttcgtgaagctgtcggaggccatgggctgctacgcgatccgctgcgagtccccggacgacctcgacaaggtcatcgcggaggcgaactccgtcaacgaccgccccgtcgtgatcgacttcatcgtccacgaggacgcgatggtctggccgatggtcgccgcaggcacctccaacgacgaggtcatgttcgcccgggacgtccgccccgacttcggcgacaacgaagacgac

SEQ ID NO: 2721 - DNA, 3135 bp, Streptomyces avermitilis
  CDS (1)..(3135)
atggaccaacgatccgacgcggcggggcggccgacggcgaccctggtgtgcggcggcgcgcagacgcggcctcggtggccatcaccagcgcaggcccggcggtcgcaagcggcacgcacagccggcgccggacctgcgggaccccgcagcggcccgggcccggtgggcccggtgagctcccccggggcgctgcttgtccgccagccggcactcggcggcgggacgagcctggtcccgcaactcgtactggccctggtgtgcgcgggatacgccctcggttccgcgctcggctggggctcccagagggtcgcactcgtcatgggcgacttcgggctgagcgccgcggcgggtaccgcggcggtctcctgcctcctctatgcgcgcacgcgtcgcagccgcttccgactcgcatggctgctgttcgcgctctcctccgccatggcgtcactgggcaacggggtttgggggtggtacgaggtgattctccaccaccccgtgcccagccccagctacgccgacctgttcttcctctgcttcgcgccgcccgccatcgtggggctgctggtgctcgccaaacggcccgtgaccaaagcaggttgggtgtgtctcgtcctggacgcctggctgatcggcggctcgctgctcacgctctcctggagcctcgcactcgcccaggcggcgaagttcgacgggccgagcgtcgcgcacacggcgctctcgctcgcgtatccactgctcgacatcgccctggtcagcatggttctcgccctgcacttcaggcgctcggcggtcaaccgctccgcggtgaacaccgcgatcggcgcgctggccctgaccgtgatgtgcgacgccctgttcacctcgcccctgctgcacgacaactaccgctcgggccagctcctcgacgccggctggttcgccggctcgctgctcctcgcgtacgccccctgggtcggcgtccggttcgggcagcgggagagcgggcacgcacgcgtggtgcacgagcacgtgccggggccacggccggcgggctcacggcctgcggggcctcgcccaccgggccacccgggcgaccggccgcgcgcacccctccaggacggaggtcacagccggtatccggccacccgcccgatcgccggatcgctgggcgccctcacgccgtatctcgccgccgccgtctgcacgctcgggatcctctacaacatgctcaacggccgcaacgtcgaccgagtggtgctcatcaccgcgggcgccgtcgtgctcgccctcgtcgtgcgccagggcatcatgctgctcgacaacatcaccctcacccaggagctggcccagaaggagaaccacttccgctccctggtgcagggctccagcgacgtgatcatgatcgccgcgcccaacggcatcctccggtacgtctccccggccgccgcgggcgtgtacgggcggcccgccgaggacctcgtcgggaccgagctcgcctcgctcatccacccggaggacctgcgctgcgtggtgcacgaggtgcgccgcttcctcgccgccagccacaccgaggaacccaccacccgcatcgagtgccgcttcaagtccggctacggcggctggctgaacgtcgagtcgaccgtcaaccggcaccacggcggtctcatcttcaacagccgggacgtgaccgaaagggtgcgcctgcaagcgcagctgcagcacaacgcggagcacgacccgctcaccgacctgcccaaccgcgccctgttcaccaagcgcgtccagcaggcgctttccggccgccgcacctccgaccgcggcacggccgtcctcttcatcgacctcgacggcttcaaggcggtcaacgacacgatcgggcaccaggccggcgacgagctcctcgtccaggccgcccgcagactccaggacgcggtccggtacggggacaccgcctcgcggctcggcggcgacgagttcgcggccctcatcgtcggcgacggcacccgcgaccgcaccgcccgcgaaggccacatcatggagctcgccgaccggctgagggtcaccctctcgcagccgtacgccatcggcggcaacgatgtccgggtcgccgcgtccatcggcgtggccttcgccgagccgggcctcggcgccggtgacctgctgcgcaacgccgacctcgccatgtaccgggccaaggccgccggcaagggccgcgtcgagctgtacgcgccacagatgcagcaggacgtcgtacggaaggcggagctggccacccggctgcgcgccgctctgcacgacggcgagttcgcgctgctgcaccagcccgtggtgtcgctggaggacggccggatcacctcggtcaccgcccaggcgcgctggcgttcctcccagggcgtgctcttcacgcccgccgagttcctgcgcgtgtccgaggacagcgacaaggccgccgagctgggccgctggatcctcgaggaggccgtcgagcaggccgccgagcgcaccgccaccggcctcgccgtacccgtcggcgtccggatgagcgcccgccgtctgctggaccgctccctgcccctcggctccgtggaggccctgctgacccggcacgggctcgcctcgggcgccctggtgatcgagctgtccgacaccgacccacgggtctccctggacgagctggagcgcaggctgagcgcgctgcggcggatcggcgtccggatcgccctggacggcttcggcagcggctacgcggccatcacggccctgcgcaggctccccgtggacgtactgaaactggaccgtggcctcgtcgagggcgtggtggagtccgcgcggctgcacaagatcaccagcgggctgctgcgcatcgccagcgacctcgggctgcagtccgtggccgacggggtggacctgcccgagcaggtgctcgctctccgtgcgatgggctgcacgcacgggcagggcacggccttctccggcccgctcgacgagtaccggctgcgccgggccctggccaccgggcagtacccggtgccccacggaccggccgagcccgccttcgcgggcgggggtgccggggtgtacacgcctggtgtgccggtcgtgttcggtggcggtacggccctccgctcacataatgagactcccgtcccacccact

SEQ ID NO: 2722 - DNA, 939 bp, Streptomyces avermitilis
  CDS (1)..(939)
atgacttccgacgtatggctcccgcttcgcgcggaggagatcgacggcctccccgaggacctcacctaccgcttctgggacggcggcaaggagttccccgcggaccccgccgactgcgcgttctatgtcgtgccctacatgaagggcgccgagatcgcgctgcgccccctgccggagatgacgtccgtacgcgtcgtacagacgctctccgccggcatcgaccacatccagcccggcctcggactgctgcccgagggcgtgcagctgtgcaacgcgcgtggggtgcacgacgccagcaccgcggagctcacactgacgctgatcctcgcctccctccggggcatccccgacttcgtacggggacaggaccgggaggagtggcgctccgggttccgtccggcgctcgccgacaagtccgttctgatcgtcgggtacggctcggtcggcagcgcgatcgaggaccggctcgcgccgttcgagctcgcgcgggtggcgcgcgtcgcgcgctcgggacgcgagacggcgcgcggccccgtgcatcccatctcccgattgcctgaacttcttttggacgccgatgtggtggtggtcgtcacgcccctcacagaacagacgaaaggcctggtcaacgcggacttcctggcccggatgaaggacggtgcgctgctggtcaacgtcgcccgcgggggcgtcgtcgacaccgaggcgctgctgaccgagctggagagcggccgcatccaggcggcacttgacgtcaccgaccccgaaccgctgccggcggggcacccgttgtggcatgcgccgggggtgctcatcagcccccacaccggcggccccacctccgcgttcctgccgcgcgccaagcggctcctggtggcgcagctgaaccgtttcgcgcgcggagaaccgctggacaacctggttctcaccacgggtgcg

SEQ ID NO: 2723 - DNA, 930 bp, Streptomyces avermitilis
  CDS (1)..(930)
atgaactgggcgtacaccggttcgcggcagcggggcgacgagtcgctgcggaccgtgcaccgggcgctcgacgtgggcgtgacgctgctcgacaccgccgacatgtacggcccgttcaccaatgagctgctggtggggcgggtgctgaaggagcgccgctccgaggccttcgtgtcgaccaaggtgggcctgctggtgggcgaccagcacatcgtggccaatgggcgccccggctatgtgaagcgggcgtgcgacgcctcgctgcgccgcctccagacggacgtgatcgacctctaccagctgcaccgcgcggacccggagattccggtcgaggagacatggggtgcgatggcggacctcgtccgggccgggaaggtacgggcgttggggctgtgcgcggtgggcgcgcgttccgcccgccgctccggggcacggctgcacgacgccacgatccggcagctggagcgggtgcagcaggtgttcccggtgagcgcggtggaggccgagctgtcggtgtggtcgaaggaggcactggacgcgctgctgccgtggtgcgcggcgcgcggggtcggcctgctggccgcgatgccgctcggcaacggcttcctgaccggcacgctcacgcccggcgagggcttcgagccggacgacctgcgggcccggcacccccgcttcacggcggagatgatggccgcgaaccagccgatcgtggtgggccttcggcgcatcgcccggcggcacggggacgaggtcacacccgcgcaggtggcgctggcgtggctgctggcgcagggcccgcacgtggtgccggtgccgggggcgaagcgggcacggtgggtggccgagaacgcgaccgcggccgggctgcgcctgacggcaagggacctggcggacgtggcggccctgcccgcggcacgggggtcctgggac

SEQ ID NO: 2724 - DNA, 1161 bp, Streptomyces avermitilis
  CDS (1)..(1161)
gtgcaacgtcgagctgcggcggccgtactggccgcggcctccctcctgctggcgtccggctgttcctccggcgacggaggaaccccgggcgcggacaggagcacctcaccgggccgtacggcgccggggtcgtcgtcctccgggaagacggcggaggcaaccccgcccgcgaagggctcggtgaaggtggtgcgcacggtcgcccagggtctgaagaccccctggggcctcgccccgctgcccgacggcgatctgctcgtcacctcccgggacgacgggacgatcacgcggatcgacgagaagaccggcaagaagacggagttgggctcggtgccgggcgtctccgccgccggcgagggcggcctcctgggcatcgccctctccccgtcgtacgcctcggaccacatgatctacgcgtacttcacgacggcgtcggacaaccgcatcgcccgcctgctgcacgaggagcacaagccgtcgggcgagcagctgggggcaccggacacggtcttcaagggcatccccaaggggttcatccacaacggtggccggatcgcgttcggcccggacaacatgctctacgcgggcacgggtgagtcgggcaaccgcggcctggcccaggacaagaagtccctgggcggaaagatcctccgcatgacgccggagggcgaaccggcgcccggcaaccccttcggtgactcggtcgtgtactcgtacggccaccgcaatgtccagggcctggcctgggacgacaaacaacgcctgttcgccgcggagttcggccaggacacatgggacgagctgaacgcgatcaagccgggcggcaactacggctggccggacgccgagggcaggtcaggcgacgcgaagtaccgcgacccgatagcccagtggcacaccgccgaggcctcccccagcggcatcgcctacgccgagggctccctctggatggcgggcctgcgcggtcagcgcctgtggcgggtcccgctgaagggcaccgaggcctcggcggccccccaggccttcctgaagggcacctacggccgactgcgcacggtggtcccggcgggcgacggcaagctgtgggtgacgacgagcgagacggacggccggggcacaccggggaagggggacgaccggatcctggagctgcaggtgacg

SEQ ID NO: 2725 - DNA, 270 bp, Streptomyces avermitilis
  CDS (1)..(270)
gtgagacatacgctggaacggatcccggccgagggaggccctgtgttcaacatgttcgaggaactcttcgcaccaggccgtaagcacaccaatgacgagagaaagcgcctggaactcagccgaacggatgtgaacgacggcgaccccggaagagggcccatagacctgtcctcgggcaaggtcgtcgtacgcccgccgaagcagccccccgcggctccggagccgcccgcggccccggagcccgccgccgccccggagcccggtgaggac

SEQ ID NO: 2726 - DNA, 3471 bp, Streptomyces avermitilis
  CDS (1)..(3471)
gtgaacacgagcgcgggggagccgccgggcggcgcgggcccggggctccgagaggacggccgtacggggatcggccgacctcgggaggacggccgtaccgggaccggcgggtcccgggaggacagccgcagggggaccggccgtacgggggtcggccggtcccgggcgggggcgccgtcgggggacaccgccccgtcgatgtcggtgccggccgtccgggccgccgccggcatcgacgcgtctgccgtcgtcggcaccggtggcgcgtctgccgtcgtcggcatcggcgacgcgtccgccgtcctcgccggcctcggtgtcggtggcgcaccggccgttgccgcccgcccgccgatattcgctgccccgttgtccgacccccgtgcgatgctcgggaccgtggagaccaggtccgtcagtcccgtgttcgtcggccgcgccgcagagttgggcgcactcgccgacgcgctcacccgtgccgccgcgggcgagccgcaggcgttgctgctcggcggtgaggccggggtcggcaagacacggctgatcgaggagttcgccaccgcggccggccgtaccggcgccgtcgtggcggtcggcggctgcgtcgagatcggcgccgacgggctgccgttcgccccgttctccaccgccctgcgcgccctgcgcagacagctcccggacgaactcgccgccgcggccgcgggccaggaggcggagctggcccgcctgctgcccgagctgggcgaggccaggcgcggcccccgggacgacgaggagggaacggcccgcctcttcgaactcaccgcccgcctcctggagcgcctcgccgccgaccgcacggtggtcgtcctcctggaggacctgcactgggccgacgcctccacccgccatctcctcgcctacctcttccgcaccctgcgcagcggccgcctggccgtcgtcgccacctaccgcgcagacgacatccaccgccgccaccccctgcgccccctcctggccgaactcgaccgcctgcgcaccgtccgccgcatcgaactcgcccgtttcaaccgcaccgaggtcggccgccagatcgccggcatcctcgccgcggaacccgaccccgcccaggtcgacgacatcttcgaacgctccgacggcaacgccttcttcgtggaggaactcgccgtcgccgcccacgagggctgctgcaccggcctcaccgactccctccgcgacctcctcctcgtacgcgtcgaggggctgcccgagagctcgcagcgggtcgcccggatcgtcgccgagggcggttccaccgtcgagtaccggctgctggccgccgtggcccggctcgccgaggacgacctcatcgaggcgctgcgtgccgccgtcggcgccaacatcctcatcgccgcacccggcggcgacggctaccgcttccgccactccctggtccgcgaggccgtcagcgacgacctgctgcccggcgagcgctcccgcctcaacaggcgttacgccgaggccctggaggccgatcccgcactcgtaccggccgacgagcgcgccgctcgcctggccagctactggtaccacgcccacgacgcggccaaggcgctgcccgccgtcctcgacgcctccgtcgaggcccgctgccggcacgcacacgccgagcaactgcggctcctggagcgggcgatggagctgtgggagttggcccccgactcgatacgggccggcctgcgccccgtcgactacgccgaggtctatccgccctgcggctgcgacccggccaccacccccctgcgctacctcgacctgatggccgaggccgccgtcgcgggccgcctgtgcggggaacgcgaacgcgcgctgaagatcaccaggcgggccctgcgcctcctggaggacgaggacgatcaccacccgaactcgccgtccggctcgggccgtggggacccccttcgcgccgcctggttctgggcccagcgttcccggctggtgcagaccacggcccgcggcgacggctggaaggagctggccaccgcccaggaactggtccggggcctaccgccctcggaggtgcacgccgaggtgctcgccaccgtcgccaactggtcgatggtgcacgagccgggacccgacgcgctcatggccgccgagcgcgccgtggagtacgcgcgcatggtgggcgcccgggacatcgagctgaacgcgcggctcaccctgggcgggctcctcgtcgaagcgggcgacatcgaggcggggctcaccgagctgcacgaggtcaaggaacaggcaaaggcgctcggcgacgccgccgtgctgggccgcctccatgtgaacctgccgtcccacctggaaggcatcggccgctcccaggaagccgtccgcgtcctcaaggaaggcgtcggcctcgccaggcggctcggtctgctggacatcgaggccctggtgtggggcaacctcgccgaatccctgcactccctcggtcgctgggacgaggccggtgaagccgcgatcagctcggagcgcgtcggccagagcgcaaaacgccgcggcttccacgccacgctgcacgcccatttcgccctctcccgcggcgacctgaccgtggcccgccgccaactgaccgccgcccgcgaacacttcggcacccacgacaccatgccccagcacgccctgccgctcggccgcatcgcgatcggcgtcgccgcggcggagggccgcctcctggatgcccgggccgaactcgccgccgcgctggacaccggcttcccgcccggaacccagcgctacggctggccgctgctgctggccgccgccaccgcggaggcggacgccctcggcctgcccggcgccgagccggggcgtggcgaggttctcgaagacatccacaaggccgccaagacactcgccacgaacgtgcccgtctggcaggcctacgggcactggctgcgcgccgagctgctgcgcgccgagggcgccgggaccccacgggactggtccgagacggtcaccgccttcgaaccgctggagcgcccctacgacctcgcccgcgtccgccaccgcctcgccgagtccctgctggcctccggcgcggacgacgacgcccgcgcccgcgccacggaactgctgcgcctggccggggcggtggccgaccacctcggcgcccgcccgctcgccgaatcggtcgccctgctcgcccagcgcgcccggctcaccctgtccgggacgacgcggcagagcccgcccgccgacccggccgaggcgctcgggctgaccagccgggagcgcgacgtgctgcgcctggtcgccgccggccgcagcaaccgccagatcgccgagaaactgttcatctcccccaagacggcgagtgtccacgtctccaacatcctggccaagctgggcgtcgcggggcggggggaggcggcggcgctggcgcatcggatgcggttgttcccgcccgaggcacccgctgccccggcggcgggg

SEQ ID NO: 2727 - DNA, 300 bp, Streptomyces avermitilis
  CDS (1)..(300)
atgcggaactctcccgatgtggcacacccgccttggagacgaaagttgaggcatcgcaacaagcgaagccggaaaccgactcttcacgagggacacgagatgttcgagtacgagctccaccagatccgttccgccgacctgatccgcgaggcgcagaaccaccgtctcgtccgcgaggccctccgcctgcgccgcgacgcccgcgacgcccgcaaggccgccgccggggaacccgacacggagggacagtccacgtcccatagcaaccgtccccgccggccgcggttcgcccgcgccgcg

SEQ ID NO: 2728 - DNA, 609 bp, Streptomyces avermitilis
  CDS (1)..(609)
atgggaaccaagacagttgacgaggccggggcagagaccggcaccgaggcgaagagcgacgaggcaaaggtggacaccaccaaggtcgaaaagtccaccgagaccaccgaggccaccgaggcgaagaccgacgccgaggccgcggccgacgagtccgacgagtccgaggtggccgacgacgaggtcgacggccttcggggggacacccaggagggcccctccggcgtggggcagggcgccggcgccgtcgtctccgccgggctcggcctcgtgtcgctcaccggcagctgggtcgccaccgtggccgccgcgcgcgagaccctggtcggccagctggggacctcgtcgtcggcgaccgtcgccacgcaggtcaaggaggtctacggcgatgcctgggccacgaccgcgctgatcggcgggctgttcgcgctcgccgcgctgatcgtcggcgtcgtggtgctcgcccggcccgcgttcggtgcccccggcaagccgcagcccgcgtggatcaagtcggtcgcctggggcggcgtcgccctcggtgtgatcggtctgctgctcgcggtcgcgaagtacaccgacatcatcctgggcctgccgtcggcgagt

SEQ ID NO: 2729 - DNA, 573 bp, Streptomyces avermitilis
  CDS (1)..(573)
atgtacgcgatatcgctgggtgacgacggcgccgaactgcgtccgctggaaccctggcacgccgaggagtttctggcgcacctcgaccgcgggcgcgagttcatcacgcggcacatcccgttcggggtgggcgcgacggacgtcgactccgcgcgggccgtcctgcggacctgggccgacaaacgcgccaccgacaacggcggcctgcacggactgtggctggacgggaagctcgtcggcggcgtgctcttccgcgtcttcgacgccgtgaacggcacctgtgaggtcggctgctggctggaacccgccgggagcgggcgggggctcgtcacccgcgcgatgcgggtgctcatcgactgggcggttgacgggcgcggcatccaccgtgtggagtggcgggcgtcgtccgccaacgaaccgagcatcaaggtggcgcggcgactgggcatgagccgcgacggcgtgcttcgggggaactccgtccaccggggcgtgcgccaggacaccgaggtgtggtcggtgctcgcgcccgagtggcgggcggcacgcgcgcgtaccactcacaacgatcat

SEQ ID NO: 2730 - DNA, 1515 bp, Streptomyces avermitilis
  CDS (1)..(1515)
gtgaccaccacgaccgacgagctggtgtcgtacgaggacgccctggcgtcgtacgaccccgtcatgggcctcgaggtccatgtcgaactcggcaccaagaccaagatgttctgcgggtgttccaccgagctgggcgccgagcccaactcgcagacctgcccgacctgcctcggcatgcccggcgcactgccggtcgtcaacgcgatcggcgtcgagtccgccatcaagatcggtctcgcgctgcactgcgagatcgccgagtggtgccgcttcgcccggaagaactacttctatccggacatgccgaagaacttccagacctcccagtacgacgagccgatcgccttcaacggctatctcgacgtgcagctggaggacggcgaggtcttccgggtggagatcgagcgtgcccacatggaggaggacaccggcaagtcgacgcacgtcggtggcgcgaccggccgtatccacggcgcctcgcactccctgctcgactacaaccgcgcgggcatccccctcatcgagatcgtcaccaagccgatcgagggtgcgggagagcgtgctcccgaggtcgccaaggcgtacgtcgccgagctgcgcgagctcatccgggcgctcggtgtgtcggaggcccgcatggagatggggcagatgcgctgcgacgtgaacctctccctgcgcccgcacggccgggagaagttcggcacgcgctccgagacgaagaacgtcaactccctgcgctccgtggagcgtgcggcccggttcgagatccagcggcacgccgcggtgctgaactccggcggcacgatcatccaggagacccgccacttccacgaggacacggggtccacgacctcgggccgggtgaaggaggaggccgaggactaccggtacttcccggagcccgacctcgtccccgtcgccccgtcccgcgcgtgggtcgaggagctgcgcgcgggcctgcccgagcagccgctggcgcgtcgtaaccggctgcgcgaggagtggggcgtcaacgcccacgacatgcagtcgatcctcaacgccggtgccatcgacccgatcgtcgccacgatcgaggccggtgccgacgcggcgtccgcccgcaagtggtggatgggcgaactggcccgcagcgccaacgagtcgggcaaggccctggaggacctgcccatcaccccggcgcaggtcgcccgggtggcacagctcgtcgtcgccggagagctcaacgacaagctggcccgccaggtcatcgagggcgtcctcgcgggcgagggcactccggacgaggtcgtcgagaagcgcggtctgaaggtcgtctccgacgagggcgccctgaccgccgccgtcgacgaggccatcgcgggcaacccgggcgtcgcggacaagatccgcggcggcaaggtggccgcggccggcgccctggtcggcgccgtcatgaaggccacccgtggccaggccgacgcggcccgcgtcaaggagctgatcctggagaagctcggcgtcagcgagggc

SEQ ID NO: 2731 - DNA, 240 bp, Streptomyces avermitilis
  CDS (1)..(240)
gtgagcaccgcactgaccaaggccaagggcttcaagaagtccaagtccggtacgtacctgtccatcgcgaccaccgcgttcggtgtgatcggggtcgccaagcaggccaagaaggcccgcctcgagagcgacacgctgcgcctcatcgacgcggccgtgtccgccgccgccatcgtcaccggcctcgccatcctctaccgggagctcaagcgcctgggcgacgacgacgtcctgctgggc

SEQ ID NO: 2732 - DNA, 1503 bp, Streptomyces avermitilis
  CDS (1)..(1503)
atgacggacaccaacgtcaacatcatcaggctcaccgccgccgagatcgccgcgaaggtcgcctccggcgagctcacggccgtccaggtcaccgaggcccacctcgcccgcatcgacgccgtcgacgagaaggtgcacgccttcctgcacgtcgaccgcgagggcgcgctggcccaggcccgcgccgtcgacgagaagcgcgagcgcggcgagaagctcggcccgctggccggcgtcccgctcgcgctcaaggacatcttcaccaccgagggcatcccgaccaccgtcggttcgaagatcctcgagggctggatcccgccctacgacgcgaccctcaccaagaagctgaaggccgccgacgtcgtcatcctcggcaagaccaacatggacgagttcgccatggggtcctccaccgagaacagcgcgtacggccccaccggcaacccctgggacctcagccgtatccccggtggctccggcggtggctcctccgccgccctcgcctccttcgaggcccccctcgccatcggcaccgacaccggcggctccatccgccagccggccgccgtcaccggcacggtcggcgtgaagccgacgtacggcgcggtctcccgctacggcatggtggcgttctcgtcctccctcgaccagggcggcccctgtgcccgtacggtcctggacgcggccctgctgcacgaggtcatcgccgggcacgacccgctcgactcgacgtccatcgacgccccggtcccgccggtcgtcgaggccgcccgcaacggcagcgtcgagggcatgcgcgtcggcgtcgtcaagcagttccgcggcgagggctaccaggccggtgtgctccagcgcttcgacgagtccgtcgccctcctcaaggagctgggcgccgagatcgtcgagctggactgcccgtccttcgacctcgccctgtcggcgtactacctgatcgcgccgtccgagtgctcctccaacctcgcgcgcttcgacggcctgcgctatggcgtgcgcgtgggtgacgacgggacgcgctccgccgaggaggtcaccgccctcacccgcgaggcgggcttcggcgacgaggtcaagcgccgcatcatgctcggcacgtacgcgctcagctccggctactacgacgcgtactacggcagcgcccagaaggtccgtacgctcatcacccgcgacttcgagaagtcgttcgagcaggtggatgtgatcgtctccccgaccacgcccaccaccgccttcccgatcggcgagcgcgccgacgacccgatggcgatgtacctcgcggacctgtgcaccatcccgaccaacctcgcgggcaacgccgccatgtcgctgccctgcggtctcgcgcccgaggacaacctcccggtcggcctgcagatcatcgccccggcgctcaaggacgacaggctgtacaaggtcggcgccgccgtcgaggccgccttcgtggaaaagtgggggcacccgctgatcgaggaggcaccgtcgctg

SEQ ID NO: 2733 - DNA, 294 bp, Streptomyces avermitilis
  CDS (1)..(294)
atgcctggcatcacgcgcgaggaggtcgcccacctcgcacggctggcgcgtctggagctgaaggcggaagagctcgaccacttcgccggccagctcgacgacatcatcggcgcggtcgcccgcgtcagcgaggtcgccgaccaagacgtaccgccgacctctcacccgctgccgctgacgaacgtcatgcgcgcggacgaggtccgtccgtcgctcacccccgagcaggcgctctccggcgccccggcccaggagcagcagcgtttcaaggtgccgcagatcctgggggaggac

SEQ ID NO: 2734 - DNA, 2334 bp, Streptomyces avermitilis
  CDS (1)..(2334)
atggaaccgaccgagagcgccgccccggactcacggctgcgccggaggtccggcgcatggcgatgggggtctcggcggcccacaggggtcgccccggtcgaacggagccgcgtgtggggaggcagccgggagcccggcggaatccgccgcgtggcgcgcacttcggggctcgcgggcgtggacggacgcggaccggcgcgggggaacgcccccggcgtcatgccgctcaccgccgcccccggcagcggagcgctgggcgccgggcagggccccgggacgtccggccccgactccgagcgacacctgtcctggcccgcgctgcccgcggccgtcgtcgcgacggcgggcttcgtgctcggcgccggcttctaccgggcgttcacctggaaccacgcgctcttcccgtccggcaccgtcggctggtccctggccgtgctcaccggcgtcatcgtcggccacctggtcgcgctcggccgcgcccgctggtggggcggcacgggctccggtgccgccctcaccctcgccgtcctgctgctgtacggctgggtgccggccgggatggtcagcctcaccgtcgtcgtcctcgtcggcatagcccgacgcgaccgctggcgagggggcgtgctgcacggctcggtcgacctcctcggcatcggcgcgggtgcgctggtgctggccgcgttcgggcgcgtgccgtccgtcgagacgccctgggacccccagagctggaccgtctacaccgtgcccgagctggcgctggtcgcggtcgcctatctcgcggtgacccgcacactggtctggtacgtgcacacgccgcgcaccggcggtgtgcccacggtcgcccgcaccgccctggtcagacagggactcctcgcggtcgcgctgctcggcatcgcgccgctgatctgcgtcgtcgccgacgcgctcccgctcctgctgccgctcttcgccatccccctcatcgccctcgactccaccctgtggatagcccgggcccgggcggaggaacaactgcgcgacccgctgaccgggctgcccaaccggcagtggctgctggagcggacctggacggcgctggacgacgccgaacgcatcggggcgcgctccgccctgctgctgatagacctcgaccgcttccgggcggtgaacgacacgctcggtcacctcgccggcgaccggctgctgctgcagatagccgaccggctgcggctcgccctgccgcgcggagcggaggccgcgcggctcgggggtgacgagttcgccgtgttacttcccgtcgcggactccacgacgtccgccacccgggtcgcccgcaacctggtcgcagccctcggctcgccgctcgacctcgacgggctcacgctcgtcctggaggccagcgccgggctcgccgtcttccccgaccacgcactggacgcggaggggctgctgcaacgcgcggacgtcgcgatgtaccaggcgaagcgggaccgtacgggggtggaggtgtacgagtccaagcgggactcgaacacaccggaccggctcggcctgctgggagacctgcgccgggcgctggacgccggcgacgtggagctgcactaccagccgaaggtgcgcttcgacgggcaggtcgccggtctggaggcgctcgtgcggtgggtgcaccccgagcgcggcaaggtgccgccggacgagttcatcgccatcgccgagtcgtcggggctgatgccgcatctgacggagtacgtgctggagacggcgctcgggcaggtggcgcgctggcgggcgcagggtctgcgggtgccggtggccgtgaacgtctcgccgcgtgacgtccacacccccggcttcgcgggttcggtggcggcccggctggcccggcacggggttccggcgggggcgctgcagctggagataacggaacacgtgctcctggaggacccgcagcgggcggcggacacgctcgccgggctcaccgggcacggggtgaagatgtcgctggacgacttcggcacggggtactcctcgctcgtgcacctgcggcggctgccggtcagcgagctgaagatcgaccggtcgttcgtggcccggctggccgtcgacacgcaggacgcggcgatcgtgcgctgcacggtggatctcgcccattcgctggggctgctggtcgtcgcggagggcgtcgaggacgacgagacatgggagcggttgcgggacctgggctgcgacgccgtccagggctggctggtggccgcggcgatgccggcggacgaggcgacggcgtggctgcgggcgcggggatcgcgggggtggcagcggccgacggcggcgttgcccgcggcggcgacggacgaa

SEQ ID NO: 2735 - DNA, 2190 bp, Streptomyces avermitilis
  CDS (1)..(2190)
gtggccggcgaacagcacgcacagcccacatcggtacccgccgaggcacgggagaagcacgcgcagctcgctgagcagatcgaggagcaccgcttccggtactacgtgaaggacgcccccgtcgtcagcgacgcggagttcgacaccctcctgcgctccctcgaggcactggaggaggagtaccccgagctgcgcacgcccgactcaccgacccagaaggtcgcgggcgggtacgagacggagttcacggccgtccagcaccgtgagcgcatgctctccctggacaacgccttcgacgacctggggctggccgcctgggccgagcgcgtcgccaaggacgtcggcacctccgactaccacttcctgtgcgagctgaaggtcgacggcctcgccgtcaacctcacgtatgagcacggccgcctcacgcgcgcggcgacccgcggcgacggccgcacgggcgaggacatcacgcccaacgtccgtacgatcgcggagattccggaccgtctcaagggcgaccgcatcccggacctcgtggagatccgcggcgaggtctacttcccgatggagaagttcgaggagctcaacgcacgtctggtggaggccggcgacaagcccttcgccaacccgcgcaacgcggcggcgggttcactgcgccagaaggacccgcgggtcaccgcgacccgcccgctgcacatggtcgtccacggcatcggcgcccggcagggcttcgacatcgaccggctctcccaggcgtacgagctgctgcgcgagtggggcctgccgaccacccggtacgccagagtggtcgacgacctcgacggcgtacgggagttcatcgcgtactacggggagaaccgccactccgtggagcacgagatcgacggcgtggtcgtgaagctcgacgagatcccgctccagggccgcctcggctccacctcccgcgcgccgcgctgggcgatcgcctggaagtacgcgcccgaggaggtcaacaccaagctcatcaacatccgcgtgggcgtggggcgtacgggccgggtcacgccgtacgcgcaggtggagccggtcacggtcgcgggctcggaggtcgagttcgccaccctgcacaaccaggacgtcgtcaaggccaagggcgtcctcatcggggacacggtggtgctgcgcaaggccggtgacgtcatcccggagatcctcggcccggtcgtcgacctgcgcgacggcaccgagcgcgcgttcgtgatgcccgccgagtgccccgagtgcggtacgccgctggcgccggccaaggagggcgacgtcgacctgcgctgcccgaacgcgcgcacgtgtccggcccagctgcgggagcggctcttctatctcgcgggccgcaagtcgctcgacatcgagcagttcggatatgtcgcggcggcggccctcaccaagccgctggagcccgccgagccgccgctgctcgacgagggcgacctcttcgacctcaccatcgaacggctgctgcccatcaaggcgtacgtcctcgaccaggacagcggcctgcccaagcgggacccgaagacgggcgaggagaaggtcgccacggtcttcgccaaccagcagggcgagccgcggaagaacgcgatctcgatgctggacaacatcgcggccgccaaggagcgcccgctcgcccggatcctgaccggtctgtcgatccgccacgtcgggccggtcgcggccgaggcgctggcgcgcgcgttccgctcgatcgaccgcatcgaccaggccaccgaggaggagctgaaggacaccgacggtgtcggcccgatcgtcgccgccgcggtcaagcagtggttcgccgaggactggcaccgggagatcatccgaaagtggaaggccgccggcgtccgcatggaggacgagcgctccggagaggacgaggggccgcgcccgctcgaaggactcacggtcgtcgtcaccggaacgctcgaacaccacacgcgggacggcgcgaaggaggccctgcagagccgcggggcgaaagtcaccggttcggtttcgaagaagacgtctttcgttgtcgtaggtgacaatcctggatcgaaatacgacaaggcgatgcagctgaaggttcccgttctgaacgaggccggattcgccgttctgctcgagcaaggaccggaagccgctgcggaagtcgcacttccgaccgaggag

SEQ ID NO: 2736 - DNA, 1005 bp, Streptomyces avermitilis
  CDS (1)..(1005)
gtgagtgaaaacagcgagttcaggttcggttccgccaccggggtcggctccatgccgggcggtgacgcgcgggagaccgccaagaccgtcaccggatccgtcgaggacttccccttcctcgccgagctgcccgcccgggggcccggcgccgacatgatcggccgcaccgccggaatgctcgtcgagctgtacgcgcgcgtggagcccagcggttggcggatcggggaccggccggggcgggacaccaagcgggcccgctcctggctgggggaggacctcgacgcgctggaggagttcacccaggggtacgaggggccggtcaaggtgcaggcggtggggccctggaccctggccgccgcgctggagttgaagaacggcgaggtggcgctgtcggaccccggcgcctgccgggatctcgccggttcgctcgccgaggggctgcgcagccatctcgaagaggtgcgacggcgcatcccgggcgcacagctcgtgctccagctcgacgagccctcgctcaccgccgtactgcgcgggcaggtgaagagcgccagcggctaccgcacccaccgggccgtcgaccggcaggccgtcgaggccacgctccgggacgtcgtcggggtgcacggggagggaccggtcgtggtgcactcctgcgcaccggacgtcccgttcgccctcctgcgcagggcgggcgcggcggcggtctccttcgacttctcgctgctcaccgagcgtgacgacgacgtgatcggggaagccgtggaaggggggacgaagctgctcgccggtgtcgtgccggggacggacggcccattgtcagaccctgccggtagcgtcatgggtgtcaggacgctgtggcgcaggctggggctgcatccggggcttctcgcggaggcggtcacggtcactccgtcgtgcgggctcgcgggcgcttctccggcgtacgcgcgccaggcgctcgcccactgcgtccgggcggcgagatcactcgcggacaaccctgag

SEQ ID NO: 2737 - DNA, 696 bp, Streptomyces avermitilis
  CDS (1)..(696)
atggccggcatggctacacatgtgatcaccggggcgggctccggcatcggcgcggcagtgacccgccgtctgcacgcgcgcggggacgaactcgtgctccacgcgcgcgacgcgggccgcgcgaaggaactggcggcggcgttccccggggcgaagaccctggtcggggacctggcggaccccgacaagctgtcctgggcgttctcgcaccagacgttgccggaccacgtggattccctgctccacatcgcgggcgtggtcgatctcggcccggtgggcgagctgaccccgaagtcctggcgccaccagctcaacgtcaacctgatcgcccccgccgagctgacccgccacttcctgccccaactccgcctggcccacggccaggtggtgttcgtgaactcgggctcgggtctcaacgcccacgccgactggtcggcgtacgcggcctccaagcacggtctgaaggccctggcggacgccctgcgcgaggaggagcacgcgaacgggatccgggtcacctcggtctaccccggccgcaccgcgagccccatgcaggccaaggtccaccagcaggagggcaaggagtacgaggcggcgaagtggatcgaccccgagtcggtcgcgacgacgatcctgatgtccctggacctgccccgggacgcggaggtcaacgacctgacggtgcggccgggccac

SEQ ID NO: 2738 - DNA, 537 bp, Streptomyces avermitilis
  CDS (1)..(537)
atgaaaatctgcgtcttcctctccgccgccgacctcgacgaccgctacacgcgccccgcgcgggagttcgcggaactgctcggcaagggcgggcacacactggtgtggggcggctccgacgtcggtctcatgaaggtggtcgccgacggtgtgcaggaggcgggcggccggctcctcggggtctccgtggacttcctcgccgccaaggcccgcgcaggcgccgacgagatggtcatcgcccgtgacctcgcggagcgcaaggcgctgctcctggaacgggccgacgccgttgtgatcatggtcggcgggaccgggacgctggacgaggcgacggagatcctggagctgaagaagcacggtcacaccgacaagcccgtggtgctgctgaacaccgcgggcttctacgacggcctgaaggagcagttccggcgcatggaggacgaggggttcctgccctgccccctcacggacctggtgttcttcgccgaggagccggtgggcgcgctggcctacctcgaggagtcgttcggcaccgtc

SEQ ID NO: 2739 - DNA, 321 bp, Streptomyces avermitilis
  CDS (1)..(321)
atggctgaaggacacacgatcacgatcgagcagggcaccgagcgcgtccgcgtggtgcacggcgaccaggtcctggcggagagcgaccggcccctgctgctgcgggagacgggctgccccgtgcgctactacctcccgccggaggacgtacgcctggacctgctgaagccctcggagacccacacgcactgccccttcaagggcacggcctcgtactggtccctgccggacgcggcggacctggtgtgggcctacccggaacccaagccggacgtcgcgcagatcaaggaccatctctgcttctacgaagtcgaagtggcc

SEQ ID NO: 2740 - DNA, 1128 bp, Streptomyces avermitilis
  CDS (1)..(1128)
atgactgagaccccgcagcgcccccgccgcctccgcgtccttgccgccatgtcgggcggagtggactccgccgtagccgccgcccgcgcggcggaagcaggtcacgacgtgacgggcgtgcacctcgcgctgtccgcgaacccgcagtcgttccgcaccggagcgcgtggctgctgcaccatcgaggactcgcgcgacgcccgccgcgccgcggacgtcatcggcatcccgttctacgtctgggacctcgccgagcgcttccgcgaggacgtggtcgaggacttcatcgccgagtacgaggccggccgcaccccgaacccgtgtctgcgctgcaacgagaagatcaagttcgcggcgctgctcgacaaggcgctggcgctcggcttcgacgcggtctgcacgggccactacgcacaggtgatcgtccgcgaggacggcacccgcgagctgcaccgcgcctccgacatggccaaggaccagtcgtacgtcctcggggtcctcgacgaccgccagctcgcgcacgcgctgttcccgctcggcgacacggtcacgacgaaggacgagatccgcgcggaggccgagcgccggggcctggcggtcgccaagaagccggactcgcacgacatctgcttcatcgcggacggcgacacccagggcttcctggcgaaccgtctgggcaaggcggagggcgacatcgtcgacgagtccgggtcggtcgtcggctcccacgagggcgcgtacggcttcacgatcggccagcgcaaggggctgcgcatcggcaccccggcgcccgacggaaagccgcgctacgtgctggacatctccccggtggacaacacggtgacggtgggcccggcggccgccctggacgtcaccgccctgacggcgatcaagccccgctggtgcggcgccgccccgacgggcccgggcacctacacggcccagctccgcgctcacggcggcgagacacaggtgacggccgagctggtcgacggcgagcttcaggtcaccttcgcggagccggtccgcggcgtcgcccccggccaggcggtcgtgctgtacgacggcacgcgcgtggtgggctcggcgacgatcgcgacgacgacgcggacggcgaccgcggtggcg

SEQ ID NO: 2741 - DNA, 654 bp, Streptomyces avermitilis
  CDS (1)..(654)
atgggggagacgaagggcggggacgcggaccgtcgcatcgggcgccgggccctgctgatcggcggggccgcggccgccgtgggcacggcggtgctcgcccgcgaggagctggcgcacctgtggtggcggctgcccggcgtggagaagccgcgggtggcgggcgcggtggacttccggggcgcgcagtgggtggcggcgtcctcggcgaactggcggcgggcggaccggcccgacgactacgccgtggaccgcgtggtcgtccatgtcacccagggcagcttcaagagtgcggtgaaggtcttccaggacccggggcacggcgctgccgcgcactacatcgtgcgcaaggacggccacatcacgcagatgatccgcgaactggacgtggcgttccacgcgggaaaccgggagtacaacgagcggagcgtcggcatcgagcacgagggcttcgtggagagcgcctcgtcgttcacggacgcgatgtacgaggcgtcggcgcggctgacggccgggatatgcgggcggtacggcatacccgtcgaccgcgcgcacatcatcgggcacgtggaggtgccgggcacggatcacacggaccccgggccgcactgggactgggaccggtacctgaagctcgtacggcgggctcggaccgcc

SEQ ID NO: 2742 - DNA, 1446 bp, Streptomyces avermitilis
  CDS (1)..(1446)
atgcaccggcggaagttcctcggcggaatggccggggccggcttcgcggcggtggcggcgggcggcgcggccctcgcgtacctgaccgacgcggggcagaaccgggcgggggcggcgagcaccacgctgaccattccggagctgctggagggcaccacgtcggacggcaccacgacgttcaccctggaggccaagaccggcaccagcgaggtgctcagcggagtgaccagcaccaccgcgggctacaaccagtcgttcctcggccccaccatgaaatggacgtccggcgacaccgtcctgctgaacatcaccaacagcctggacgcggacaccacggtccacttccacggcgcccacatcccgcccaagatggatggcggcccgcagaacgccttcgccgcgggggagacctggtcgcccaccttcaccgtcaaggacgaggccaagacgctctggtaccacccgcacgccctgggcaccaccgccgagcaggtcacgcgcggcctggccggcatgatcatcgtcgaggacgactcggacgcctcggccgccctccccagcacctacggcaccgacgacatcccgatcatcctccagtgcctggccgccgacagcagcggggacgtcaagtacgacctgaccggctatctgtccggcggcctgagctaccccctgctgtgcaacggcaccaacgtcgacgccaccacgctcgccttcaccgccaccaagtcccgcacccggttccggctgctcaacgcctcaccgtccgacatcatcaccgtgcagcgcggcgacggcgggacgctgacccagatcgccaccgaccaggggtatctgacggaggccgccgaggtggagtccatccgtctggtggcgggcgcgcgcgccgagttcgtcatggacctcagcgacgcggtgacgctccaggccgtcgtcaccacgggctgggtccgcggcggcagcggcacgtacgacttcctcaccgtcaccccggacgcctcggacacccccgacgccctgccgagcagcctcaacacgatcacccgctacgacaccaccgacttcgccgcccggaccatcacgctcggccagagcggcgcgagcatgctgatcaacggctcggccggcacgaccatggcggccatggcgatgatcagcaccaccctcgacgccgaggagatatggaccgtcaccaacagcacccagctggaacactcgttccatctgcatgatgtgccgttccagctgatctccatcaacggagaggagccgacgggcgtcgatctgggctggttcgacacctacgaggtcgtcggcggcggcaccatcaagatcgccatgcagttcaccgacttcgcggacgacacctacatgtacatgctccattgccatctgctccagcacgaggacgagggcatgatggcctcgctcatggtgacggagagc

SEQ ID NO: 2743 - DNA, 1167 bp, Streptomyces avermitilis
  CDS (1)..(1167)
atggcttacctcgaccacgccgcgaccacgccgatgctccccgaagcggtcgaggcactgaccgcccagctgagcgtcacgggcaacgcctcctccctgcacgcctccggccgccgcgcgcggcgcacggtcgaggaggcccgcgaaaccctcgccgaggccctcgccgcccgccccagcgaggtcgtcttcacctccggcggtaccgaggccgacaacctcgcggtcaagggcctgtactggtcccgccgcgacgccgacccggtccgtacccgcgtcctcgccagccccgtcgagcaccacgccgtcctggacgccgtccactggctcggcgagcacgagggcgccacggtcgagtacctccccgtcgacacctacggccgcgtccaccccgaagcgctgcgcgaggccatcgcccgcaaccccgacgatgtcgccctcgccacggtcatgtgggccaacaacgagatcggcacggtcatgccggtccgggaactcgccgatgttgccggggagttcggggtcccgctgcacgccgacgccgtccaggccttcggccaggtcccggtcgacttcggcgcttcgggcctggcggcgatgaccgtctccggccacaaggtcggtggcccgtacggcatcggcgcgctgctgctcggccgcgagtacagccccgtacccgtgctgcacggcggtggtcaggagcggcatgtgcgctccggcaccctcgacgtgcccgcgatcgcgtccttcgcggtcgcgggacggctcgccgccgagcagcgcgagtggttcgcccgcgagatcggcgccctgcgcgacgatctggtcgacgccgtgcggggggccgtgcccgaggcgatcctcggcggtgacccgtccggtgcgggccgcctcccggccaacgcgcacttcaccttccccggctgcgagggcgactcgctgctcctgctgctggacgcccagggcatcgagtgctccacgggctccgcctgcaccgcaggcgtcgcccagcccagccacgtcctgctggccaccggcaccgacccggacctggcccgcggcaccctgcgcttctccctcggccacacctccacggaggcggatgtggaggcggtggcgaaggcgatcggccccgcggtggagcgggcacggacggcgggcctgagc

SEQ ID NO: 2744 - DNA, 264 bp, Streptomyces avermitilis
  CDS (1)..(264)
atggaactcaccgccacatcgaccagccgcactcccgcgcgggacgccgacggcatggccgtggcgtccttcgtcctgggcctgatcggcatcctcgccctcaacatcgtcctcggcccgaccgccatcgccctggcggccgtcgccctgtggcgcggcacgcagcgccggggccgcgcactcctgggccttggcctgggcgtggccgacctggccgtcctggtggtcgcgatgcaactggaccacacggtttcgtggagcttc

SEQ ID NO: 2745 - DNA, 165 bp, Streptomyces avermitilis
  CDS (1)..(165)
atgctgttcctcgtcgccgcactcctgctcctgggcgtcgtgctgggcgccgtggcccacgccccgctctccgtctcccttgtcgccgcggccgtcatcggcctgtggctcgtggtcttcgcgatccgcgagcggcacggtcaccggcgacgcacctcgaccaac

SEQ ID NO: 2746 - DNA, 624 bp, Streptomyces avermitilis
  CDS (1)..(624)
atgagtcacaccctcggcatccggcaggcccagaagcagaagacccggcagtcgctcctggacgccgcgttggccctgctggaggagcagagcctgagcagcctgggtctgcgcgaggtcacccgcgccgtcggggtcgcaccgaccgccttctaccggcacttccgctcgacggcggacctcggcgtcgccctcgtggaggaggcgctgggcagcctgcacctgatgatcgggaacaccgtctccgacgccggcgacagcgaggaacgcatagcgcgcgccgtcgaactgatcgcccgccatgtcgccgcgcacccggcgcacgtccgtttcatcgcccgggagcggcacggcggcgtccagccggtgcgggaggcgatcgcggagcaactggcccggttcgccgaggaggtcaaggtcgagctggccaaacaccccgagtccgcggggtggagcgacgacgatctgctgatgctcgcgggcctgtacgtcgaccagatgctgatgacggcctcgctcttcctggaggcactggaggggccggaggaggaacgggagcgcgtcgccagggtggcgacccgccggatgcggctgatcagcatcgggcgccgccactggctgggc

SEQ ID NO: 2747 - DNA, 954 bp, Streptomyces avermitilis
  CDS (1)..(954)
gtgaagtccgaccgcctgctctcgatccttctcctgctgcagacccgaggccgggtccccgcgcacgaactcgccacccggctggaggtgtcggtgcgcaccatctaccgcgacatcgaggcactgtcggcctccggggtcccggtgtacgccgaacgcgggcggcacggcgggatcgaactcctcgccgggttccgtacggacgtcacgggactgaccgccgacgagtcccgcgccctgttcatcctggcggcgcagggcgcacacgccgcgctcggcctggacgcggcgctcggttcggccctgcgcaaggtgatgaccgcgctgcccgcgccgcaccggccggccgccgaggccaccagccggcgcgtcctcgtcgacgcgacccgctggaagggcggcccgcagcccgtcgtcgacctggagacgctccaggacgcggtcttcgccgaccgcaggctgcggctgcgctaccggcacggcggagacgcacagccgcacacgtacaccgtcgacccgtacgggctcgtctccaaggcgggcgtctggtacctggtcgccgaccggcgcgcgaagccgcagctgttccgcgcggaccgggtgcgctcggcgaccctgctggcggatccggtacgacggcggccgggcgtcgaactcgccgacgcctgggaggtgttgcgccggcaggtcgaggagcggccgggcgggatcgaggtcacggtccgggtgcggcgcgaccggctcgacatgttccggcgcctgaacgcctcctcgctcgccgccctgccggaggacgacggcgagagcgagtgggtgacggcacggctgtcgtacggcttcgtccgcgaggcacgtcaactgctcatgttctccgacctggtggaggtcgtcgcgccgcccgaggtgcgggaggaactggcgcgggcggcggcctccgtcacggagctgtaccag

SEQ ID NO: 2748 - DNA, 582 bp, Streptomyces avermitilis
  CDS (1)..(582)
atgaacaccgacccccgccccctgtacgcccgcgccgccgagcagatcgccgcgctgatcaggaccgtgcgcccggagcagctcgccggtcccacgccgtgcggcgagttcgacgtacggacgctgctgtcccacatggccggcggcacccgccggatcgccgtggtcggcgcgggcggcgacggtctcgccgtgcggccgttcgtggacggcgtgccggacgacggctgggtggcggcgtacgacgaggtcagggcggaggtcgagcagagctgggcggacgacgcccggctggacgcgctggtgcacgtgccctggggcgaggcgccgggccgtatcgccctgtcgggatatgtgatggaggccgtcacccacacctgggacctctccgaggccctcggccggccgctcggactcgacccggaactggccgagttcgcgctcgccatcgcccatcgggtactgcccgacgagcagcgcggggacgacgtgcccttcgactcggcggcgccggcccccgagggagccgacgcgtacgagcgactggcggcctggctgggccgccgttccctcagccgagcc

SEQ ID NO: 2749 - DNA, 858 bp, Streptomyces avermitilis
  CDS (1)..(858)
atgcctgaagcatctcccctgcaggccgtacgggcctcgatcggtgacagtgagttcgaccgcgacaccgcggtcaccctgcgcgaacccggcgtctacgacatcgacctctccgccgggtggacgatcatcagcgccgtcaacggcggctatctcctggccgtcctgggccgcgccctgtccgacgccctgccgcacgccgacccgttcacgatctccgcgcactacctgacggcctcccagccgggcccggccgtgatccgcacggacatcgtccgcaccggtcgcaccctctccaccggccaggcctcgctcttccagtacgacgaagagggccgcgaagtggagcggatccgtgtcctcgcctcgtacggcgacctcgacacgctgcccgacgacgtccgtacgaccgcgcggccgcccgcactcccgccgatggaccagtgcttcgggcccgaagacggccccgccccggtccccggcagctccgccatcaccgaccggctgatgctcaagctggacccggagaccctgggctgggcgctcggcgcgccgtccggcaagggcgagatgcggtcctggttcggcctcgccgacggccgcgacccggaccccctctccctgctgctcgcggtggacgcgctgcccccgaccgccttcgagctgggcctgtccggctgggtgccgaccgtcgaactgacggtgcacgtgcggtcccgccccgcgccgggcccgctccgggtgtcgatcaccacacgtaacctcgccggcggcttcctggaggaggacgccgaggtatgggacagcgcggaccggctggtcgcgcagtcccggcagctggcgcgggtcaggctcggc

SEQ ID NO: 2750 - DNA, 654 bp, Streptomyces avermitilis
  CDS (1)..(654)
gtgctccaacaactgttcagcccctccgtccagcacacgctcgacctgatcggcatcttcgtcttcgcgatctccggcgccctgctggccgtccgcaagaacttcgacgtcttcggcatcgccgtactcgccgaggtcaccgcgctgggcggagggctgctgcgcgacctgatcatcggggcggtgcccccggcggccttcacggacctggggtacttcctcaccccgctgctcgccgccctgctcgtcttcttcctccacccgcaggtggagcgcatccagctcggcgtgaacgtcttcgacgcggccgggctcggcctgttctgcgtcgccggcacggtgaaggcgtacgactacgggctcaacctcaccgcctcggcggccctcggtctcgccaccgcggtcggcggcggtgtgctgcgcgacgtcctcgccaacgaggtcccctccctgctgcgctgggaccgggatctgtacgcggtgcccgcgatcgtcggcgccacgatgatcgtcctgtgtatccactacgacgcgctgaacgcgttcaccagcgggttcgcggtgatcaccgccttcgtcctgcggctgctcgcgatgcgcttccactggcgggcgccgcgcgcctggcaccggcgctcgaccgtgacggaggag

SEQ ID NO: 2751 - DNA, 1389 bp, Streptomyces avermitilis
  CDS (1)..(1389)
atggcactctcccgttcggcacgactgggggccctcgcgaccgcggcggcctcctttcttgtcatcgccgcctcctccgccccgaccccgggcgccgacggcatcggcgactcctacttcccccagctcggcaacggcggttacgacgcacgccactacgacctcgacgtggcgtacaacccggacaccgaccgtctcgacggccgtacgaccctcacggcccgcgccacccagcgcctgtcctccttcgacctggacctccagaagctcgacgtcacgaaggtcgaagtgaacggcagacgcgccgagttcacgcgcgagggcgacgagatccgcgtcaccccgcgtggcgcgctgccgaagggcagaaccttcacggtgaccgtcacctacggcggtgtcccccaacccctcggcggccccatcgtcttcggctccgactacgggtggatgaagaccgcggacggcgtcttcgtcgcctgcgagcccaacgccgcctccacctggttcccgtccagcgaccaccccgccgacaaggccacgtacgacatccgcatcaaggcccccaagggcctgacgggcatctccaacgggcgcctcatatcgacgcgcgacaagggcgacaccaccgtcacgcactggcgtgagagcaagcccatggcgacgtatctcgcgaccgcgaccatcggcaagttcgacgtgaagacggggcggacccccgcgggtacgcccgtctacgtcgccatcgacccggtgctcgcgaacagcaacaccgtcgacgtctacgccgtgaccgccgaggccaccgactactggtcgcagatcttcgggccgtaccccttcgaggagaccggcgcgatcgtcgacgacatgccgcaggccggcttctcgctggaggtccagtcgaagcccgcgtactcggccgtgcgctccgagtcgaccatcgtgcacgagctggcccaccagtggttcggcgactccgtgtcggtggagcgctggaaggacatctggctcaacgagggcttcgcgacctacgcccagtggctgtggtccgagcacaagggcatccgctcggcgcacgactcgttccgggccggatacgacgcccggcccgccgacgcggccttctggcagatcaaggtcgccgatccgcagcgcgacaccatgttcgcctccgccgtctaccagcgcggcgcgatgacgctccagatgctgcgcgagcgcatcggcgacaccgccttcttcaagctgctgcccgcctggaccaagctgcacaaacacggcaacgcgaacaccggcgacttcatccgcctcgccgagaggatctccggccgacagctggacgacctcttccagacctggctgttcaccacgggcaagcccaccctg

SEQ ID NO: 2752 - DNA, 1524 bp, Streptomyces avermitilis
  CDS (1)..(1524)
gtgagtgagacgaagaaagcggacgcgaccgagcccgccgcgaaggtcccgcaccaggggtcggctcccgaggagcgcgacgtcctgctcaaggtccaggggctgaccaagcacttccccatcaagaaggggatcctgcagcgtcaggtggccgcggtgaaggccgtcgacggcatcgacttcgaggtgcgcaggggcgagaccctgggcgtggtcggcgagtcgggctgcggcaagtcgaccatgggacgggtcatcacccggctccaggacccgaccggcggcaccatcgagttcgagggcaaggacatcacgcggctgagcacggccgggatgcgtccgctgcggcgggacatccagatgatcttccaggacccgtacggttcgctgaacccgcggcacaccatcggctcgatcgtctcggcgccgttccggctccagggcgtggagcccgagggcggcgtgaagaaggaggtccagcggctcctggagctggtgggtctgagccccgagcacttcaaccgctacccgcacgagttctccggcggccagcgccagcgcataggcatcgcccgcgcgctcgcgctgaagccgaagctggtcgtggcggacgagccggtctcggcgctggacgtgtcgatccaggcgcaggtcgtgaacctgatggacgacctccagtccgagctgggcctgacgtacgtgatcatcgcgcacgacctctccgtcgtccgccatgtctcggaccgtatcgccgtgatgtacctcggcaagatcgtcgagctcgccgaccggacctcgctgtacgaggcgccgatgcacccgtacaccaaggccctgatgtcggcggtgccggtcccggaccccaagcgccggggtgccaagagcgagcgcatcctgctcaagggtgacgtgccctcgccgatctcgccgccgagcggctgccgcttccacacgcggtgctggaaggcgacggagatctgccggacgaccgagccgccgctgctggagctgaagcccggtcagcaggtcgcctgccaccacccggagaacgcggaggaccaggcgccgcaggacacggtgctgctctcggcggcgagggaggcgatcgaggtggtgtcggtgggggagactccgcagacgccggcgaagacggccgacgttgcggtcgccgagaagacggctgagaagacggctgagaaggctgtcgaggagacggtcgccgagaaggcggctgagaaggctgtcgaggagacggtcgccgagaaggcggctgagaaggctgtcgagaaggctgtcgccgagaagacggtcgagaaggctgtcgccgagaaggcggtcgctgcggagacggtcgagaaggcagccgtcgcggagacggtcgcggagtccgccgagcccgccgacgccgacaccgccgacgagcccgccgctgtcgcagaccccgctgtcgcagaccccgtcgacgaagaccccgccgccgagtcggcggaagcggagtcgggccgtcaggagtcaaccgacaag

SEQ ID NO: 2753 - DNA, 1095 bp, Streptomyces avermitilis
  CDS (1)..(1095)
gtgaccgaactgtccaagaccggcgccgccgtgggggagcccacccgctcgccctcggacgcgccccgtgccttcctcgaggtccgcgacctcaaggtgcacttccccaccgacgacggtctggtcaagtccgtcgacgggctcagcttccaggtggagaagggcaagaccctcagcatcgtgggcgagtcgggctcgggtaagtccgtcacctcgctggcgatcatgggtctgcaccggctcggcgcgcgcggcaagaacgtgcagatgtccggtgagatctggctcgacggccaggaactggtgtccgccgccccggacgaggtgcgcaagctccgcggccgcgagatggcgatgatcttccaggacccgctgtccgcgatgcacccgtactacacgatcggcaaccagatcgtggaggcgtaccgggtccaccacgacgtcagcaagaaggtcgcgcgcaagcgtgcggtcgagatgctcgaccgggtcggcatccccgagccggccaagcgtgtcgacagctatccgcacgagttctccggcggtatgcgccagcgcgcgatgatcgcgatggcgctggtgaacaaccccgaactgctgatcgccgacgagccgacgaccgcgctcgacgtgaccgtccaggcgcagatcctggacctcatccgggatctgcagaaggagttcggctccgcggtcgtcctgatcacccacgacctcggcgtggtcgccgagatcgccgacgacgtcctggtgatgtacggcggccggtgcgtggagcgcggcccggtcgacgagatcttcgagcagccgcagcacccgtacacctggggtctgctcggctcgatgccccgcatcgaccgcgacacgtccgaccggctcatcccggtcaagggtcagccgccgagcctcatcaacgtcccctcgggttgcgccttccacccccgctgcccgtacgcggacgtgcccaagggcgacgtcacccgcaccgtgcgccccgaactgcagcaggtcggcggcggacactggtccgcctgccacctctcgcaggaggaccgtacgcggatctggaccgaagagattgcgccgaagctg

SEQ ID NO: 2754 - DNA, 1005 bp, Streptomyces avermitilis
  CDS (1)..(1005)
gtgatctcgtacatcctccgtcggacgttcgcggcagtgatcctgctgctggtcgtcaccgcggtcacctttgcgatcttcttcctgctgccgaggatggccggccagaccgccgaccaactggctcagcagtacatcgggaagagccccaccgccgcggacatcgcgaccgtcaagcacaacctcggtctggaccagcccctgtacgtccagtactggcacttcatcaaggggatcgtgtccggcgccacctatgacctggggcccaccacggcgcactgtgacgcgccgtgcttcggttactccttcaagacccatgtcgcggtctggccgcagctcacctcgcgccttccggtgacgatctcactggccgccggcgcggccgtgctgtggctgctgtccggtgtggcggtcggcgtgatctccgcgctcaagccgcgctcgttcttcgaccgcaccttcatgggggtcgcgctcgccggtgtctcgctgcccatgttcttcacgggcaacctcgcgctgctgctcttcacctaccagtggccgatcttcgggcgtacgtacgtcccgttcaccgagaatcccgcgcagtgggccaacacgctcttcccggcgtggtgttccctcgctctgctgtactccgccatctacgcgcggctgacccgctcgggcatgatggagacgatgaacgaggacttcatccgcacggctcgcgccaagggtctgcgcgagcgcaacgtcgtggtccggcacggtctcagggccgcgctgaccccgatcatcacggtcttcggcatggacctggggctgctgctcggcggtgcgctgatcaccgagtcggtgttctcgctgcacggtgtcggtgagtacgccgtgaaggcgatccaggacaacgacctgcccccgatccttggcgtcaccctgctcgccgccttcttcgtagtgatcgcaaatctcctggtggacctgctgtacgcagccgccgacccgcgggtgaggctctcg

SEQ ID NO: 2755 - DNA, 1770 bp, Streptomyces avermitilis
  CDS (1)..(1770)
atggaggggaacccgaccatcatgcgaaggtcagcgctggccgcgattgcggccatcggcagtgcgagtctgctggttgcaggctgcagcaaggccgatgacaacaaggatgacaacaactcgaagtcggctggggccaacgcagcgaccaaggacgtcgtcaacgcctccaccaagaaggggggcacggtcacctacgagtactccgatgtcccggactccttcgaccccggcaacacgtactacgcgtacatgtacaacctcagccggctgtacgcccgtccgctgatgaccttcaagcccgccccgggcgagaagggcaacgagctggtcccggacctcgccgcgagcgcgggtgtgccgagcgacggcggtaagacctggacgtacaagctccgttcggggctgaagtaccaggacggcaccgcgatcacctcgaaggacgtcaagtacgccgtcgagcgctccaacttcgcgcgtgacgtgctctccctcggcccgaactacttccagcagttcctcgtgggcggcgacaagtacaagggtccctacaaggacaagagcgccaagggcctgaagtcgatcgagacgccggacgacaccacgatcgtcttcaagctcaaccgcgccttccaggagttcgactacctggtcgcggcgccgcagacggctccggtgccccagtccaaggacaagggcatcgactacgtcaagagcatcgtgtcctcgggctcgtacaagttccagagctacgacgacggcaagcaggccgtcctcgtccgcaacgagaactgggacccgaagacggacccgctgcgcaagcagtacccggaaaagatcgtggtcaacctgaaggtcaacgccgagaccatcgacaaggacgtccaggccggcgacgcgatcgacctgggtggtacgggtgtccaggccgcgacgcaggcgcaggtcgtcaactccgcggagaagaaggccaacaccgacaacacctacggtggccgtctcgtctacatggcgatcaacaccaaggtgaagccgttcgacaagctcgagtgccgcaaggccgtgcagtacgcgatcgacaaggtctcggtgcagaccgccgagggcggcccgatccgcggtgacatcgcctccaccgtcctcccgccggacatcccgggctacgagaagtcggacgtctacgccacctccggcaacaagggtgacgcggccaaggccaaggagcagctgaaggcctgcggcaagtcgtcgatcaagaccaacatctcggcgcgcagcgaccgtccgcaggagatcgacgcggcgaccgcgatcatcaactcgctgaagaaggtcggcatcgacgccagcctgaagcagtacccgtcgggcaagtacttcaccgactacgcgggtgtcccgaagttcaccgagaagcagaacctcggtctgatcatgatgcagtggggcgccgactggccgtccggctacggcttcctgcagcaggtcctgaacggcagcgccatcggttcctcgggcaacgtgaacctctcccagttcgacaacaaggacgtcaactcgctgctgggcaaggcgatcggtaccgaggacaagaccgcgcgcgacgccctctacaccgagatcgacaagaagaccatggacgaggcggtcctcgttccgctgacctacttcaaggtcctgctgtaccgcccgacgacgtacaccaacctggtgtcgacggcggccttcagcggtcagtacgactacctcaacatcggctcgaccaagaag

SEQ ID NO: 2756 - DNA, 996 bp, Streptomyces avermitilis
  CDS (1)..(996)
gtgaccgcaccgatcgagaccaccggggcggcagccgaggcacagccggaggctgtgctcgtcggcgccgagaaggggcagatcgagggccgttccctggggcagatcgcctggtcccgcttcaagagggacaaggtggccgtcgtcggcggcgtcatcgtcatcctgctgatcctggtcgcggtgctctcccgccccatccaggccctgctgggtcttgacccgaacgccttcaaccaggacctgatcgacccgaacacctcccttcccaagggaagcttcggcggcatgagcggagaccacccgctgggtgtggagccgaagttcggacgcgacatcgccacccgcgtcctggagggctcctgggtctcgctggtcgtcgcgttcggtgccacgatcctgtccaacgtgatcggcgcgatcctcggcgtggtggccggctactacggcggacgggtcgacacgatcatcagccggctgatggacaccttcctcgccttccccctcctgctgttcgccatcgccatctccgcaacgctccagggcggcgccttcggtatggaagggctgccgctccacctcagcgtcctgatcttcgtcatcggcttcttcaactggccctacctgggacgtatcgtccgggggcagacgctggccctgcgcgagcgggagttcgtcgacgcctcccgcggcatgggcgcgaagggtccgtacatcctcttccgggagctgctgccgaacctggtcggcccgatcatcgtctactcgacgctgctcatcccgaccaacattctcttcgaggcgtccctgagcttcctcggggtcggtatccagcccccgcaggcgtcctggggcgggatgctcagggaagcggtcacctactaccaggtggacccgcagtacatgatcgtgcctggcctcgccatctttgtgaccgtgctggcgttcaacttgctgggcgacggtctccgcgacgctctcgacccgcgcagccgc

SEQ ID NO: 2757 - DNA, 804 bp, Streptomyces avermitilis
  CDS (1)..(804)
gtgagcgcgtcgggcacggccgcggccgggcaggtcgagcacatgctgcgccaggtgacgcccgggcgttacgacgcctacgaggcgctccttcgtgcgctcgcgaccccgtcggccggccagatctggatgctgctgtggcacggtcaggccggttcgcccgacgcccagtacgggaacatggaggtcgacggctacggctacgcgccctgcgtcacctccgcccaggagctctcggccagcggctggaacagatcgtacgaggtggtcgacggcctcgacgtggcccgcaccctctaccccgaccacttcggcctctggctgaacccgcacgcccccggcggcggcgtcggcatcccctggctggacctgcgccggatcgccacgggcctggagcgccagccggccggcccgctccggctctccgaaccgggcatcgaggtcccccagttctacgccctgctcacgcagaacgcgcaccgcacgcccgccgtgcgctcactgcgccgcgcctgggtgcagcccgccctcggcgcgccctatctggccatcggcctcgatgtgtacgacacgtcgccgccggccgtcgactccgtgcgcgggatgatgcagcagtccatcggcgcggtcccggacggactgcccgtctcgaccgtcgcgatgtccgacgcgtacgacccggtcgcgatgtggctgcgcgccaacgcccgtcccttctacgaccgtgaggcccacgcggccccggcaccggcaccggccccggcggcgggcgggtacggatacccgccggcccgcggcgggtac

SEQ ID NO: 2758 - DNA, 780 bp, Streptomyces avermitilis
  CDS (1)..(780)
atggacatcccggcacaggcgcacccgcactcccattcgcacggcggatggcccggcaacgaactggaggaggtgctctccgcgtccctcggcgtacccgcgtcgccgtcgacgggcgcccggatcgtggaggtcctcggccacagtttcgtctgggtgccgctgcccggcgggggcggaccgcacagcggcccgctcgacctgcccacgctggagctcgacggccaggcgttcgtcccggtcttcagctccgaggagcagttccgccaggtcgtcggcaaccacatgtcgtacacgatcgcgcccgccgtggagttcgcgcgcgggctgccgccgcaggtcggcatcgcggtcaacccggacggcgtggtgggcgtgccgctgccgccggacgcggtcgccgaactgtgccgggtcggccggacccctctcgacgggcccgcgagcggcggccgggtgcggctgttcgagccggactggcaggacgacccggtggacttcctcgcggcggcctcagccgagttcgccgagaccggcatcgtggtgagcgcccgccgctgcatggccgccatcgagacctccgacccggtgatgttcatcggcgtcgaactgtcctcgtgggaggccgacgcccgtacgctcccgctggacgccctcggccgcgcgctgggccgggtgccggtggaccgcccggtgaacatggtcttcctggacgtggcccaggatccggtgggcgagtggatgcgggcccaggtgcggccgttctaccagcacgggtac

SEQ ID NO: 2759 - DNA, 684 bp, Streptomyces avermitilis
  CDS (1)..(684)
gtgaagaggattacggcgtacgcgacgacctcgggcatcgcgctgcccgagcagcccggagtaccggcccgggacgcgtgcggcccgcagccggcggccgtcgtccgcgacctgcgtgaccgcgcgggccgcagcccgcacggactcaccttcggcgcggccgatctcgtcgtggtcaccggcctgcccggcagcggcaagtcgacgctgatgcgccgggcggtgcggggcgcccgtgtcgactcccaggacacccgcgaccgctgggacacccggctggccggcttcctgccgtacgcggtctaccggccgctggtccggctggcccactacgcgggactgcgccgcgcgctgcgctccggcgcgggcgtcgtcgtgcacgactgcggtacgcaggcctgggtgcgccgctggctcgcccgcgaggcccgccgccgcggcggcacgctgcacctgctgctcctcgacgtcacggtgggcaccgcgctggacgggcagcgcgagcgcggccggggcgtctcgcgctacgcgttcctcaggcaccgcaaggcggcgggtcacctgctgcgctcggtggagaaggggaatctgcccgagggctgtggttcggcgatcctgatggaccgcacggcggcggacgtactgaaccgcatcgacttcgcggccggagtggcgacggcggcc

SEQ ID NO: 2760 - DNA, 1116 bp, Streptomyces avermitilis
  CDS (1)..(1116)
atgagcagcaacgcaccccgtcacaccgcgctcgatgccctgcatcgctcgctgggcgcgacgatgaccgacttcgcagggtgggacatgcccctgcgctacggctccgagcgcgacgagcacctcgccgtccgcagcaaggccggtctcttcgacctctcccacatgggcgagatcaccgtcaccggccccggggccgccgcgctcctgaactacgcgctggtcggcaacatcgcctccgtcggcgtcggccgcgcccgctacaccatgatctgccgggccgacggcggcatcctcgacgacctgatcgtgtaccggctccaggagcagacgtacctggtcgtggccaacgcctccaacgcccaggtcgtcctggacgcgctcaccgagcgggccggcggcttcgacgcggtcgtgcgcgacgaccgtgacgcgtacgcgctgatcgccgtgcagggcccggagtcccccggcatcctcaagtcgctgaccgacgcggacctggacggcctcaagtactacgcgggtctgccgggcacggtcgcgggcgtcccggcgctcatcgcccgcaccggctacacgggtgaggacggcttcgagctgttcgtcgaccccgcggacgccgagaagctgtggcaggcgctgaccgaggcgggcgccccggccgggctcgtcccctgcggtctgtcctgccgggacacgctgcgcctggaggcgggcatgccgctgtacgggcatgagctgagcacctcgctcacccccttcgacgcggggctcgggcgggtcgtgaagttcgagaaggagggtgacttcgtggggcgcgaggcgctcaccgaggccgccgccctggccgagaagaacccgccgcgcgtcctcgtcggactgatcgccgagggccgccgggtgccgcgtgccgggtaccccgtcgtcgtcggcggcgaggtgatcggcgaggtcacctccggcgccccctcccccacgctgggcaggccgatcgcgatggcgtacgtcgacgccgcgcacgcggcgccgggcacggccggggtcggcgtggacatccggggcagccacgagccgtacgaggtcgtggcgctgccgttctaccggcgccagaag

SEQ ID NO: 2761 - DNA, 375 bp, Streptomyces avermitilis
  CDS (1)..(375)
atgagcaacccccagcagctgcgctacagcaaggagcacgagtggctgtcgggcgccgaggacggcgtctcgacggtcggcatcacggagcacgcggccaacgcgctcggcgatgtcgtgtacgtccagctcccggaggtcggtgacacggtgaccgcgggcgagacctgcggcgagctggagtcgaccaagtcggtcagcgacctgtactcccccgtgacgggcgaggtcgtcgaggccaaccaggacgtggtggacgacccgtcgctggtgaactccgctccgttcgagggtggctggctgttcaaggtacgcgtcgcggaggagccgaaggacctgctctccgcggacgagtacaccgagttctccggctct

SEQ ID NO: 2762 - DNA, 1260 bp, Streptomyces avermitilis
  CDS (1)..(1260)
atgtcgcttctgaacacgcctctgcacgagctcgacccggacgtcgccgccgccgtcgacgccgagctgaaccgtcagcagtccaccctcgagatgatcgcctcggagaacttcgctccggtcgcggtcatggaggcccagggctcggtcctcaccaacaagtacgccgagggctacccgggccgccgctactacggcggctgcgagcacgtcgatgtggtcgagcagatcgccatcgaccgggtcaaggagctgttcggcgccgagcacgccaacgtccagccgcactcgggcgcccaggccaacgcggccgccatgttcgcgctgctcaagcccggcgacacgatcatgggtctgaacctcgcgcacggcgggcacctgacccacggcatgaagatcaacttctccggcaagctgtacaacgtggtcgcgtaccacgtggacgagaccaccggccaggtggacatggccgaggtcgagaagctggccaaggagtccaggccgaagctgatcgtggccggctggtcggcgtacccgcgccagttggacttcgccgcgttccgccggatcgcggacgaggtcggcgcgtacctgatggtcgacatggcgcacttcgccggcctggtggcggcgggtctgcacccgaaccccgtgccgcacgcccatgtcgtgaccacgaccacgcacaagacgctgggcggcccgcgcggtggcgtgatcctgtcgacggccgaactggccaagaagatcaactccgcggtcttcccgggtcagcagggtggtccgctggagcacgtgatcgccgccaaggccgtctccttcaaggtcgccgcctccgacgacttcaaggagcgccagcagcgcacgctggacggcgcccgcatcctggccgagcgtctggtccgggacgacgtcaaggccgtgggcgtggacgtcctctcgggcggcacggacgtgcacctggtcctcgtcgacctgcgcgactccgagctggacggccagcaggccgaggaccgcctccacgaggtcggcatcacggtcaaccgcaacgccatcccgaacgacccgcgcccgccgatggtgacgtccggcctgcgcatcggtacgccggccctcgccacccgcggcttccaggccgcggacttcaccgaggtcgcggacatcatcgccgaggcgctgaagccgtcctacgacgcggacgccctcaaggcccgggtgacggcactggcggacaagcacccgctgtatcccggtctgaag

SEQ ID NO: 2763 - DNA, 1365 bp, Streptomyces avermitilis
  CDS (1)..(1365)
gtggccatctccgtcttcgacctgttctcgataggcatcggcccgtccagctcccacacggtgggcccgatgcgggcggcgcgcatgttcgcccgccggctgcgcaacgaggagctgctggacccggtggcctcggtccgcgccgagctgtacggctcgctgggcgcgaccgggcacggtcacggcacgcccaaggcggtgctgctcggcctcgagggcgcgtccccgcggacggtcgacgtggagggcgcggacgaccgggtggcgacgatcaaggagtcggggcggatcaggctcctcggcgagcacgagatcgcgttcgacttctccgaggacctggtcctgcaccgccgcaagacgctcccgtaccacgcgaacggcatgaccctgtgggcgtacgacgcctcgggcgccgaactgctgtcgaagacgtactactcggtgggcggcggcttcgtcgtcgacgaggacgcggtgggcgaggaccgcatcaagctggacgacacggtcctcaagtaccccttccggaccggtgacgagctgctgcggctcacccgggagacgggtctgtcgatctccgcgctgatgctggagaacgagcgggcgtggcgcaccgaggaggagatccgcgaggggctcctcggcatctggcgggtcatgcaggcgtgtgtgtcgcgcggcatgtcgcgcgagggcatcctgccgggcggtctgaaggtgcgccgccgggcggcggtctcggcccgccagctgcgcgccgagggtgacccgctggcccgtgccatggagtggatcacgctctacgcgatggcggtgaacgaggagaacgcggccggcggccgggtcgtgacggccccgacgaacggcgccgcgggcatcatcccggccgtgctgcactactacatcaacttcgtgccgggcgcggacgaggacggggtcgtacgcttcctgctcgcggccggcgccatcgggatgctcttcaaggagaacgcgtccatctccggcgcggaggtcggctgccagggggaggtcggctcggcctgctcgatggcggccggcgcactggccgaggtcctcggcggcactcccgaacaggtcgagaacgcggccgagatcggcatggagcacaacctcggcctcacctgcgaccccgtcggcggcctggtccagatcccgtgcatcgagcgcaacggcatggccgcggcgaaggcggtcaccgccgcccgcatggccatgcgcggcgacggctcccacaaggtgtccctcgacaaggtcatcaagacgatgaaggagaccggcgcggacatgtcggtcaagtacaaggagacggcgcggggcggcctcgcggtgaacatcatcgagtgc

SEQ ID NO: 2764 - DNA, 552 bp, Streptomyces avermitilis
  CDS (1)..(552)
atgctgcgaggcatcgacgtgagcgcgtaccagtcgtccgcgtacgacaccgacggcctctccttcgtcttcatcaaggcgacggagggccgttcgtacgtcaacccgaagctgacggctcaggtgaagacggctcgcgacgccgactgcgtggtcggtttctaccacttcctgtggcccggcaacatcacggcccaggccgagtacttcgtgagcaaggctccggagaaggcgggcgacctgctcgccgtcgactgggagacgacgggcgacggcacccacgcgacgaacgccgagaaggaccggttcatccgcgagctcaaggaactgcggccgaatcaccgtgtggtcctgtacacgaaccggaatttctggctgaacatcgacaccacctcgtacgcgggtgacgggctctggatcgccgactacgtcaccgcgggcaagccgcgcatcaaggcgaagtggcgtttccaccagtacaccgatcaccccgtggacaaggacgtcgcggacttcgacaccctcgccgacctgcgggactgggccacccca

SEQ ID NO: 2765 - DNA, 351 bp, Streptomyces avermitilis
  CDS (1)..(351)
atgcacgaggaactcttcgaggagctgcgcggcgccggattcaccgtcgcggccggggaactcggcgagaacgtcaccacccggggcatcgatctgctggggctgccgaccggtgccctgctgcacatcggggacgaggccgtcgtcgaggtcacggggctgcggaatccctgcgcccagatcgacacctttcagaaaggcctgctcaagcaggtggtgggcagcgacgacggtgccgtcgccttcaagtccgggatcatgagcgtcgtgcgggcgggcggggtggtgcggcccggggactcgatcgaggtcgagttgccggacgggccgcacctgccgctccggaccgtc

SEQ ID NO: 2766 - DNA, 660 bp, Streptomyces avermitilis
  CDS (1)..(660)
atgaagatcggcatcatcggcgcgggcaacatcggcggcaacctcacccggcggctcaccgccctcggccacgacgtctccgtggccaattcgcgcggaccggggaccctcaccgcactggccgaggagaccggggcgacgcccgtgccggtcgaggaggcggcgcgcggcgcggcggtcgtcgtggtcacgatccccctgaaggcggtaccggacctgccctccgggatcctcgacggcgccgcggacgacgtggccgtgatcgacaccggcaactactacccgcggcagcgggacgggaagatcgacgcgatcgaggacgagggcctgacggagagccgctggaccgcccggcagctcggtcacaccgtcgtcaaggcgttcaacggcacctacgcccaggacatcctcgaccgcgcgcggcctgcgggcgccccggaccgcctggccctcccggtcgcgggcgacgacgcggccgcgaagcaggtcgtacgggacctgatcgacgaactcggcttcgacacggtcgacgcgggcaccctggacgagtcctggcgccagcagccgggaaccccggtctacggcctccaggagggccgcgacgcggtgacgaaggcactggcggaggcgtccccggagcgtccggcggacttccgcgcg

SEQ ID NO: 2767 - DNA, 210 bp, Streptomyces avermitilis
  CDS (1)..(210)
gtggcggacgtcgaggaagcacgcaagcagttcgagcggatcgatacggatggtgacggctttatcacggccgccgagttcaagaccgccctggcccagggtggcgactggaacgtcacggagtcggtggcatcggccatcatcgccagccgcgacctcaacggggacaaggtcctctcgttcgacgagttctggacccacctgaacaag

SEQ ID NO: 2768 - DNA, 924 bp, Streptomyces avermitilis
  CDS (1)..(924)
atgatcgatgacggcaccggactgttcaccatcggacagctcgcgcggcgcaccggcctgtcggtgcgcaccatccgctactggtcggacgagggcgccctgccaccggtcacgcgctcctcgggcggctaccggctgtacgacgccgggtccgtggcccggctcgaactcatccgcaccctgcgggagttgggcctcggcctcgacgacgtgcgcgaggtgctggccggcgagacgacggtcgcggaggtggcggccacgcatgtgacggcgctggacgcgcagatccgtgcgctgaaggtgacccgggcggtgctgtcgaccgtggcgcgacgcggttcgaccgcagaggagatgacactgatgaacaagctggcgcgactgtcggccgccgagcggaggcggattctggaggagttcgcggacgagatgttccgcgggctcgacacggcggatccggtgatccgcgagcggatgcggaacaccgccgtggacctgccggacgagcccacgcccgagcaggtggacgcctgggtggagctggtcgaactgttgcaggacccggagttccgggcgcagatgcgggcggcggccgagttcaacgcggccgaccgcggtcacgacagcccggccggcgcttccctgtggttcgtcaggcgcctcgtccagttggcggccgacgcgcggcagcgggggatcgcccccgaggcgccggaggcggaggaggtgctgcgggagctgctcggcgaggccgacggggccgccgaccgggccgccgtgctggaacggctggaggccacgtccaacgaccgggtggcccgataccgcgagttgctcgccgtggtgaagggcggcggacccctgcccgcgcaccgggaggagttcggctgggtggtcgccgcactgagggctcggccgggccgt

SEQ ID NO: 2769 - DNA, 714 bp, Streptomyces avermitilis
  CDS (1)..(714)
atgacggacgctctgcgggacattctggacgcggcggcccgaggggtcttcccgcccgccgacggcggcatcaccgtcgtaccccagcactcccaccgtgacgccggtgtcctcgccttcaccgcgcactccgtcgtcttcaccgacgaggaccccgcctgggtgtacgacaccctgcgcgcactcgactgcgacgcgctcgcggcgacgatgaacccgcggttcctggccgcgttcatggagcgcacgggccgtacgaccgacaccatcgacctgatgacggttgccccgccgctgccggacggccctccgctcgcgctgagggagatcgacgatcccggccatccccgggccgtccgggcgcgcacgcggcgggacggcatacgggtgtgggccgccgacgggggcgtgctcgtcctggggcgtgggatcggggggcggttggaggccgcggtcgaggtggacgaggacgtacggcatcgggggctggggcggacgctcgccacggcggcgcggcacctgggcggcggcgaaccggtgtgggcgcaggtggccgcggggaacgcccgcagtgcgcgggcgttccaggcggcgggctatcgaccggtgggcgcggaggccctgctcagcgcgtcgccccagtcgccccagtcgcctcagtcgccccagtcgcctcggtcgcctcagcggaagatgcccgtgtggcccagtgag

SEQ ID NO: 2770 - DNA, 1194 bp, Streptomyces avermitilis
  CDS (1)..(1194)
atgcaccaccccatcgagaagcacctcaggcgcaccctggccgccggcgccgccctcgtgtccctcgccctgctggcgggctgcgacggcgactccagggaccgggcggacgaggccctcgccaccaaggccgccgtaccccccgccgagaagaagccggtggtcgacggcctgcccggcatgccgcccgtactcgacccgaaggacgtctacgccgccgaccgccccggcaggctctcccccgtggtcaaggacttcccgtcgcgggtctacgtccccaacaccaactccaacaccgtcaccgtcatcgacccgagcacctacgaggtcatcgagacgatcccggtcggcgcccagccccagcacgtcgtcccgtcctgggacatgaagacgctgtgggtcaacaacgacaggggcaactccctcacccccatcgacccgaagaccggcgaggtgggcaaggccgtcgacgtgcacgacccgtacaacctgtacttcacgcccaacggcacgtacgcgatcgtgatggcctccctcgaccgtgagctggtcttccgggacgcgcacaccatgaagcggatgaagaccgtgccggtcagctgctacggcgtcaaccacgccgacttctcgctcgacggccgctacttcatcgtgtcgtgcgagttcagcggcgagctgctgaaggtcgacacggagcggatgaaggtgatcgggcagcagaagctcccgttcgacggcgccatgccgcaggacgtcaagatctcgcccgacggcaagaagttctatgtcgccgacatgatggccgacggcgtgtgggtcctggacggcgacacgttcggcgagccgaggttcctgcacaccggcaagggctgccacggcctgtacgtcagccgcgactcgcgcgagatgtacatctccaaccgcggcgagggcaccatctccgtcttcgacttcgccgaggacaggctgaccaagaagtggaacctgccgggcggcggcagccccgacatgggcggcgtctcggcggacggcaaggtgctgtggctgtccggccgctacaactccgaggtgtacgccatcgacacccgcaccggtgtccagctcgcccgcatcaaggtcggcagcggcccgcacgggctcgcggtctacccacagcccggccgctactcactgggccacacgggcatcttccgc

SEQ ID NO: 2771 - DNA, 888 bp, Streptomyces avermitilis
  CDS (1)..(888)
atggtgcgggtgaccacgcccgcccccctccctcagccggacagtgagccggacagtgcgacagtcgtcgtgcgcgcggcgccgaaccggcgctcggcgctgcgcgcgggcgcggggctcgccgcggccggcgcgctcgccaccgggggctccgccaccggcgccggcgcacacccggcgtccgcctcccgggcgaccggaacgtcccacgcgggaagctcccgcgcacccggcatcccgcacgcacccagcagccccgtctccgcccccgccccccgggccttcccggggcagcccgcccagatcacccacggcccgcgcacccgcccccgggtcgcgctcagcttccacggccagggcgaccccgccgtcgccgagaagctcctcggcgaggcggagagcgcgggcgcccgggtcaccgtgctcgccgtcggcacctggctcgacgagcacccgggcatggcccgccgcatcctcgacggcggccacgacctcggcaaccacaccctgcgccacatcgacatcaacgcgatgtccgagccggacgcgtacgcggagatcctcggctgcgcggaccggctgcggcggctgaccggctccatcggcacctggttccgcccctcccgcacctcccgtgcctcgccgctcgtcgaacgggtggcccgccgcgtcggctacccgcacgtcctgtcgtacgacgtcgactccctcgacttcacctcgccgggcgcccccgccgtcacccgccaggtcctcggcggggtccggcccggatccgtggtgagcctgcacttcgggtacgccgacacggtcgccgcgctccccgccctcctgcacgaactcgaccgccgcggactgcgcgcggtgaccaccacggagctgctgagc

SEQ ID NO: 2772 - DNA, 606 bp, Streptomyces avermitilis
  CDS (1)..(606)
ttgcttctggcatatgccttccgaatggtgcggaatgggggattccggggggtgtattccttcggaacgccccccaaggcccctccgggcggccatcatggaggcatggcggggctggagggtatcgaaccgccgcggcagcacgcgagtgcgaccgcggcacgctggtcgcccgcggtcgaggatgaacgggcgctcaaggcactggagctgttcggcaacccggcggaggcggaggtgccgctgccgtcccgcccggagtccgcggccacggcacgacggctcgcgcaagtcgtcgtgctgcgccactgggggctctcgccgaagatgaccgaggacgcggtgctgctcgtctcggaactcgtcggcaacgcagtacggcacaccggcgcacgcgtcttcggactccggatgcgccgccgccgcgggtggatccgtatcgaggtccgcgacccctcccgcggcctgccctgtctgatgcccgttcaggagatggatctgagcggccgtggtctcttcctcgtcgacacgctcgccgaccgctggggcgtcgatctgctgccgcgcggcaagacgacctggttcgagatgcgcgtcgccgaccgc

SEQ ID NO: 2773 - DNA, 765 bp, Streptomyces avermitilis
  CDS (1)..(765)
atgactgtgcatctcgaagtcgccgagggcgtcggcaccatccgcctcgaccgtccgccgatgaacgcgctggacgtcgccacccaggaccggctcaaggaactcgccgaagaggccacgcgccgcgaggacgtgcgcgcggtggtgctgtacggcggggagaaggtgttcgcggcgggcgcggacatcaaggagatgcaggccatggaccatacggcgatggtcgtacgctcccgggccttgcaggactccttcaccgccgtcacccgcatccccaagccggtcgtcgccgccgtcaccgggtacgcgctgggcgggggctgcgaactggcgctctgcgcggactaccgcatcgccgccgagaacgcgaagctcggccagccggagatcctgctcggcctgattccgggcgcgggcggcacccagcgcctgtcccggctgatcggtccctcgcgcgccaaggacctgatcttcacgggccggatggtcaaggcggacgaggcgctggcgctcggcctggtcgaccgggtggttccggtcggggaggtgtacgagcaggcgcacgcctgggccgcgaagctggcgcagggcccggccctcgcgctgcgggcggcgaaggagtcgatcgacgtcggcctggagacggacatcgacaccggactcgcggtcgaacggaactggttcgcgggcctgttcgccacggaggaccgtgagcgcgggatgcgcagcttcgtggaggaagggccgggcaaggcgaagttcctc

SEQ ID NO: 2774 - DNA, 1239 bp, Streptomyces avermitilis
  CDS (1)..(1239)
gtgaacgggcgaccgatatcgggggcgtcggttgacgcgcacagccaccggagcaagggaatcctggcactgctgctgggcgttctgctgctcgcggtgactgcgtgcggcgggggcggaggctcggactccgggtcaggcgacggcaagggcaaggactccgggcaggcggacaccaagtcctcgcaggccgtcgtgacgatcgccccgaaggacggcgccgacgacgtggcgaccagcggcgccctcaaggtgaccgcggccaagggcaagctgaccgaggtcaaggtcgaggacaccaagggcaatccggtcgacggcaagataaccggcgggggcgccggctggacgccctcgacccacctcgcctcggccaccaagtacaaggtccacgcggtggcgaaggacgccgacggacacgagtccgccgaggagtccgcgttcaccacgctgaccccgaagaacaccttcgtcggcatctacacgcccgacaacggcgccaaggtcggtgtgggcatgccgttctccgtccacttcacccggggtatcacgcacccggaggacgtcgagaaggcgatcaccatcaagaccgagccggccgtcgacgtcaagggccactggttcggcaacgaccgcctcgacttccgtccccaggagtactggaagtccggcaccaaggtcaccgtgaacctcaacctcgacggcgtcgagggccggcccggcgtctacggcaagcaggccaagaccgtcaccttcacgatcggccgcgaccaggtctccacggtcgacgccaagacccacaagatggtcgtcaagcgcgacggcaaggtctacaagacgatccccatcaccaccggcaagccgggctacgacacctggaacggccagatggtcatcagcgagcgcctgcgggtgacccggatgaacggtgagacggtcggctacggcggcgagtacgacatcaaggacgtgcccgacgcccagcgcctgaccaactccggcaccttcatccacggcaactactggggtggcggcgccttcggcaactacaacgccagccacggctgcatagggctgcgcgacgtgcgcggcggcggcgaccgcagtgtgccggccggctggttcttcgaccactcgatgatcggcgacgtggtgatcgtgaagaactcccacgaccggacggtcgcgcccgacaacgggctcaacggctggaacatgtcctgggagaagtggatcgcg

SEQ ID NO: 2775 - DNA, 1227 bp, Streptomyces avermitilis
  CDS (1)..(1227)
atgcatgtacagacacggcgcgcgcggcgcgcaggggccgccctggccgccgtactgacctgggcgggcctgttggccggcgcctccgcctgcacttcccccggaatctcccacggagtcgacgaggtgttcggcaaaccccctgcggccgaggatgtgatccacgtctggccggacgacgacagcaaggccgtacacgccgaccagccgctgaaggtgcgggtgcccggcggccggctcgaatcggtgaaggtcgtcaagtcccaggacgcacaggactccccggtgcccggccacatctccggcgacggccagagctggcagcccgacgacaagcggctggcgctcgccgccaagtaccgggtcgacgcggtcgccctcgacgagcgcggacaccgctccgcgcgccacacgaccttcaccaccttcgtccccgacgagcggttcatcgggtacgtcactcccgagaaccggtcgaccgtcggcaccggaatgatcgtctccctggagttcaaccgggagatcgtgaaccgggccgccgtcgaacgcgcgatccgtgtgagtgccaagccggccgtggagatccgcccgcactggttcggcaaggaccgcctcgacttccggccccaggagtactggaagcccggcaccaaggtcaccgtcgggctgaacctgcgggacgtggagggcgcgcccggcgtctacggactccagtacaagaccgtctccttctccgtgggccgcgaccaggtctcgctcgtcgacgcggtcgagcacaccatggaggtccgccgcgagggcgagctgctcgccaccgttccgatcaccgcgggcgccccgaagacgacgacgtacaacgggaagatggtggtcatggagatgctggaagtgacccgtatgaacagccgcacggtcggcttcggcggggagtacgacatcccggacgtcccgcacgccatccgcctcaccgcctccggaaccttcctgcacggcaactactgggcgccggacgccttcggcaacaccaatgtcagccacggctgtgtgggcctgcgcgatgtgaagggcggcagctcggacaccccggcgggctggttcttcgaccgcaccctgatcggtgacgtcgtggaggtcgtccgcagcaatgacaaaaaggtcgctcccgacaacggcctcggagggtggaacatgggctggaaggagtggaaagcgggcgccgcggtgaag

SEQ ID NO: 2776 - DNA, 2247 bp, Streptomyces avermitilis
  CDS (1)..(2247)
gtgtcgagcgcagccgagcaggaggcagtacaggaggagcgcgcgggtgaagaacatgccgcgcgcccggccgccgtgctgaacggcaggcggcccgcggcgcccgccccacccgtgtggccgggcgcccccaccccgctcggagcgcgcttcaggaccgggcccgacggggtgacgggcaccaacttcgccctgtgggcgggcggcgcggaggcggtcgagctgtgcctgttcgacgagacgggcgcggagatccgcgtcccgctcaccgaactcacgcacgagatctggcacggcttcgtccccggtgtactgcccgggcgccgctacggctatcgggtgcacggccgctgggacccgtggacgggcgcccgctggaacccggcgaagctgctcctcgacccgtacgcgcgcgcggtcgacggcgacttcagcctgccgccggaggtgtacgggcacgtccgggactggccgcagcagcaggtcgcggacaccgtgcgcgacgaccgggactcggcgccgtacgtccccaagggcgtcgtcgtccacgatgacgacgactgggcggacgaccaccgtccgaagacgccgtgggcggactcggtgatctacgagctgcacgtacggggattcacgaagacgcatcccgggatcccggaggaactgcgcggcacctacgcgggactggcgcacccggcggcgatcgaacacctcgtcggactcggcgtgacggccgtcgagctgcttccggtgcaccagttcgcccacgaggaccacctgctgcgcaagggcctgcgcaactactggggctacaactcgatcggctacttcgccccgcacgccggctacgcggccgccgggacgaacggacagcaggtcggtgagttcaagcggatggtgcgcgccctgcacgcggccgggatcgaggtcatcctcgacgtggtctacaaccacaccgcggaggcgggcgaactgggcccgacgctctcgctgaaggggatcgacaaccggggctactaccgcctccagcccgacgcccgccggtacgcggactacacgggctgcggaaacacgctgcacgtggtgcagccgcacgtcctgcgcctgatcacggactcgctgcggtactgggtgacggagatgggcgtggacggcttccggttcgacctggccgcggccctggcccgatcgatgcacgacgtcgacatgctctccccgttcctcgcggtcatcgcacaggacccggtgctgcgccgggtgaagctgatcgcggaaccgtgggacgtcggctccggcggctaccaggtgggcgcgttccctcccctgtggacggagtggaacgaccgctaccggggcgccgtacgggacttctggcgaggcgcgctgccggacgtgcgggacctgggctaccggctgtcggggtcgagcgacctgtacgcgtggggcggccgtcggccctacgcgtccgtcaacttcgtgacggcccacgacggtttcacgctccgggacctcgtgtcgtacgagcgcaagcacaacgaggcgaacggcgagggcaaccgggacggcagcgacgacaaccgggcgtggaactgcggggcggagggcgagacggacgacgagcgcgtacggtccctgcgccgccgtcagctgcggaacctcctgaccaccctgctcctgtcgacgggcgtgccgatgctggtcgcgggcgacgagctggggcgcacgcagcgcgggaacaacaacgcctactgccaggacaacgagatcagctgggtggactgggaactgctggaggagcccggctggcgggcgctgcgcgacctcaccgcccggctgatcgcactgcggcacgcccatcccgtgctgcggcggcgcgcgttcttctccgggcgggcgcattcggcggacggcctgcgggacctggcgtggttcacgccgcgcggggcggagatgacggaacgggactggtacgcaccggcggcgacgctcggcatgtatctgtccgggcgggacataccggggcgcgacgctcggggcgtgccggtggtggacgacagcttcctcgcggtgctgcacgccggacaccggccggtgagcttcgtactgcccgggccgccgtgggccgagcggtacgaggtcgtcgtcgacacctcccgcgaggaccaggccgcggcaccggggacggcgcaccgggcgggggcgacggtcacggtcgcggcccgggcggtgctgttgctgcgggtgggg

SEQ ID NO: 2777 - DNA, 1959 bp, Streptomyces avermitilis
  CDS (1)..(1959)
gtgggcagccggggttcgatccctcgaacgtgcaggtcccaggaccggcggccgcctctggtccggccaaaactcggtgggcgctgtcagtgccgaaccgtaggctcgctcctgatgtccaccacactcgcagccgccgaagaccgctccgaccacgccggccgttcgtccgtgcgcactctcctgcgcctgtggccgtatgtgcggccggtgcgcgtacggctgttcaccgccgccctcgtggcggtcgtggcctcctgtacgggcctggtcatcccgctcgtcctgaagtggctggtggacgggccggtggcggaccgggacacccgtggcatctggctcggggcgctgtatctgctgctgctcgggttcgccgaggcgctgctgttcgggctgcggcgctggctggtggcgcggccgctgtcgcgggtcgaggcggacatgcgggcggatctgtaccgccatctccaacggcttccggtcgccttccacgaccgctgggcctccggccagctgctgtcgcggggcacgacggatctgatgctgctgcggatgttcctcgcgttcccactgacgttcctgctggtcaacggcgtgacgatcctcgtcggcgtgatcatcatgctggttcaggactggacgctcgggctggtgatcctgggcccggccatccccgtggtgatcatgtgcgcgctgttcgagcggcggtacgcggaggtggcgcggcgggcgcaggaccaggtgggcgatctgacgacggtggtcgaggagagcgtgctcggcatccgcatcgtcaagggcttcggccgccaccgcagccaggcccgcgcgttccgtgagctgacccggaccctgcgcggcacggagctggcgaaggcccggctgctcgccgcgatctgggcggtcatcgtcaccctcccggaactggccatcggcgcggcactcgtcctcggcacgatccaggtggccgatggggacctgtcggcgggcaccctggtcgcgttcctgtccacggccctggccctgcgctggcccgtcgactcgatcggcttcctcctcgcgatgagccaggaggcggcgacggcgacggagcggtatttcgaggtgatggacgcggaaccggagtcggccgacgccgtcgccgccccggccgccccggccggcgccgacggcctgcggttccacgacgtccgcttccgctaccccgacgcgccctcggacgcgccgcccgtcctcgaccgcgtcgacctccacatccgccccggcgagacgatggccctggtcggcgccaccggcaccgggaagaccaccctgaccgcgctcatcccccgcctgcacgaggtcacgtcgggccggatcaccctggacggcgcggacatcacggccatgccccggcaggcgctgcgcgaactcgtcgccgtcgccttcgaggagcccaccctcttctcggcgaccgtcggcgagaacgtcctgatgggtgccgacgacagcgcgggcgagcaggagctggaccgcgccctcgccgtcgcccaggccgacttcgcgcacgccctcccgcagggcaccgccacccaggtcggcgagcagggcctcagtctctccggcggccagcgtcagcgcctcgccctggccagggcggtcgtgggccgcccccgcttcctcgttctcgacgaccccctgtccgccctggacgtccacacggaggccgccgtcgaggccgccctgcgccgggtgctcgccgagaccaccgccctggtcgtggcgcaccgcccgtccacggtgctgctcgccgaccgtgtcgcgctgctctccggcggccgcatcgccgccgtcggcacccaccaggaactgctgcgcacgaacgccgagtacgcccatctgatgtccggggcggaccgtgcggaggaagcggaggaagcagagaaagcggaggaagcagaggaattggaggccgaccga

SEQ ID NO: 2778 - DNA, 1860 bp, Streptomyces avermitilis
  CDS (1)..(1860)
atgacggcgccgacgacgaccgcgcccgacctgaccgacgacggcgaggaccccgtcggcacaccgggcggcggcgaccccttcgaccgggacaccctccccacgcccccgggcgcgacgggcgccctgctgcgctcgctgctggcaccgctcagggcccgcgtcgtcgtgacgagcgggctgctcctgctccagcaggcggcggtgcagctgggcccgctgctggtcgcctacgccatcgacagcgccgtaccggcgttccggcgcgacgaccacggcccgctgatcgcggtgggagtggcgtatctgctgtgcgcggcgctctccggcggcctccagtacgcgttcatcctggcgtccgcgcgcgtcaaccaggacgtgctgctcgacctgcgcggccggatcttccgccatgcgcaggccctgagcatcgacttccacgagcgctacacctcggggcggctgatctcccgctcgacgacggatgtcgagtcgctgcgcgagctgctcagcgagggccttcaggaactgatcgcggtcatcctgtcgttcgtctacatctcggcgatgctgctgtggctggacctgggcctgggcgcggtggcggtcgcctcgttcgggccgctgtatctgctcgtacggctctaccggcgccgtgcgggacgggtgtaccgcctgcgttcgacggcgatcgcggcggtcatcgtgaagttcgcggagacgatgaacggcatccggccggtgcgcgcgttccgccgcgaagcggtgaacgacgcggacttccgcgtgctgaacggacgccaccagcgcaccaacggcgacgctttgctggagatggcccgctatgtcaccggctcccgtctggtggccaacacggcggtggcggggatcgtgctgtggggcgcgtaccgggtgtcgtcgggctcgctggagctgggcgtgctcgcggccgccgtgctctatctccgccggctgtacgaccccatcgaccggctcggcatgttcctcaactcgtaccagtcggcggcggcctcgctggagaagatcgcggggctgctggcgcagacgccgtcggtgccggagccctccgagccgcgcgccctgcccgccctggagtccgcgcaccccggccgcgaggtcgtgttcgacgccgtccgcttcacgtaccgcacgggcggggaggtgctgcccaccttctcgctgacgctgcccgccgggcagacggtcgccgtggtcggctcgaccggcgccggcaagtcgaccctcgccaagctgctcgcccgcttctacgacccctccgccgggcgggtgctgctggacggggtcgacctgcgcgagctgacggttcccgagctgcggcgcggtgtggtgatggtgacgcaggaggcgttcctgttctccggcacggtcgccgagaacatcgccatcggtcgccccgacgcgacccgggaggagatcgagcgggccgcgaaggcgatcggcgcccacgacttcatcagtgcgctgccggacggctacgacacggacgtccgcaagcggggcgggcgcatctccgcgggccagcgccagctggtcgcgttcgcacgggcgttgctggccgacccggcggtgctgatcctcgacgaggcgaccagctcgctggacgttcccggtgaacgggcggtgcagcgggcgatgctgacggtactgaagggccggacggcggtcgtgatcgcgcaccggctgtcgacggtggagatcgcggaccgggtactggtcatggagcacggccggatcgtcgaggacggcagcccggccgaacttgtcgcgggcacgggccggttcgcggatctgcaccgggcctggcgggacagcctggtg

SEQ ID NO: 2779 - DNA, 1719 bp, Streptomyces avermitilis
  CDS (1)..(1719)
atgatcgacgcgtacgaggacccgggggacccggactgtcgcggtggcggccggtatctgtggtggctggtcatgcggcagcggggccggtgcgccgccggggcgctgttcggcagtacgtggatggtgctgctggcggcgacgccgtatctgatgtcccgcgcgatcgacgacgggctggcaccgggcgaccggaccgcgctgatcggctggacggcggccctgttcgcggtcggggcgttcaacgcctggctgagcatcatgcggcaccgcacgatgacccgggtccggatggacgccaacttccgcaccgtcaaggtcgtcgtcgggcaggcggtccggctgggcgccgcgctgtcgcgtcaggtcggggccggggaggtcgtcacgatcggcgtgggcgacgtccagacgatcagccagtccctgaccgtcgtcggccccggcgtcggtgcggtcgtcgcctacacggtcgtcgccgggctgctgctgtccgtctcgccgccactggccgcggtggtgctgctcggggtgccgctgatcgccgtgctcgtcggtccgctgatggggcggcttcagggcgcggagacggagtaccgcgagcggcagggcgtgctgaccgagcggatcggggacctcgcgggcggtctgcgggtcctcaacggcctgggcggcaaggggctgttcgcggacgcgttccgccgggactcgcggcggctgcgggagcagggctaccgggtcggggcggtgaccagctggatcgaggcgctcggggtgggcctgccgacgctgttcctcgccgtggtgacctggctggcggcccggctggccgcgcgcggggacatcacggtgggcgagttggtgtcggtgtacggctatgtcgcggtcctggtggggccggtggcgttcttcatcgagtgcggctaccagctcagccggggcgtggtggccgcgcggcgcgtcgtgcgcttcctgagccttgcgcccctcgcggacgacggcacggccgacgcgcccgcggagccgtccgtgctgtccgacccggagtccggggtccgggtggtgccgggccggctgaccgcgctcgccggggcccgccccgccgatgccgcggaggtggtcgaccgcctcggccggtacgcgccgtcggccgccacctggggcggggtgcggctcgacgccgtcgcgctggggcaggtccgcgagcggatcctggtcgccgacaacgaggccgatctgttcgcgggtccgctgcgcgatctggtgggcggcagacggggaccggacggctgggacgaggcggccctcgcgcgggccgtgcacgcggccgcggccgacgacatcgtcctcggtctgccggacgggctcgagacggccgtgaccgcgcagggccgcaccctctccggcggccagcggcagcgcgtacggctggcgcgggcgctgctggccgaccccgaggtgctgctggccgtcgagcccacctccgcgctcgacgcccacaccgaggccaccgtggcggaccggctgcacaccgcgcgcagcggccgtacgaccgtcgtgaccaccacctctcccctcgtgctcgcccgggcggacaccgtgtactacctggtcgacgggaaggtggccgcgaggggcagccatcgcgaactcctgggcggggagcccgggtaccgggcgctggtggcccgggacgcggacgccgaggaggccctgcgg

SEQ ID NO: 2780 - DNA, 1764 bp, Streptomyces avermitilis
  CDS (1)..(1764)
gtgacgaccggaacttctggacacctgcccgtcgcggaaccggccggtgtgcggcgggccgccgtccgtctggtccgggccgacgggcgcgccttcgccgccgtgctggtcctgaacgcgctggccgcgggcgccgggctggccgggccgtggctgctcgggcgcatcgtcgacggggtcggggccggaggcggggtgcgggccgtggaccggctggcgctgggcatcctgctgtgctccctcgcgcagctgctgctggcccgctgggcccggtacgtggggcaccgcttcggggagcggacgctcgcccgggtgcgcgaggagttcgtcgaccggacgctggcgctgcccgcgtcggtcgtggagcgggcgggcaccggcgatctgacggcccgtggcaccgccgacgtggccgccgtcggcaccaccttgcgcgatgtcggacccgatctgctcatccacaccctcgaggcgctgttcctcctcggtgcggtgttcgtcctcgccccgctgctgggcgccttcggcgtgctcggtctgaccggcatctggtgcgcgctgcgctggtatctgcggcgggcccgggacggctatctcgccgagggcgcggccacctcggaggtcgccgagatcctcgcggcgacggcgtcgggggcccgtaccgtcgaggcgttcgggcttcaggagcggcggatcggcgcgagccgggaggcgctggagacgtcccggcgcacccggctgtacacgctgtatctgcgcaccgtgttcttcccggtggtggaggtgtcgtacatcgtgcccgtggccggggtgctgctgatcggcggtgcgctgcacgcgcggggtgtgatgagcctgggtgcggtggtggcggcggcgctgtatctgcgccagctcggcgaaccgctcgaccagatcctgatgcgggtcgagcagttgcagagcagcggcgcctccttcgcccgggtggagggcctggcccgggcgccgcggagcggtccggccgactcggccgcgccggcggacgaccggatcgacgtgaccggggtgcgctacgcgtacgagcgtgggggcgaggtgctgcgcggcgtcgacctgaccgtgcgtcccggggagcggctggccgtcgtcggcccgtccggcgccggcaagaccacactgagcaggctgctcgcgggcgtcgacgcgccgagcgcgggcacggtgacggtgggcggggtgccggtcgtcggcctcgagccggagcggctgcgccggcaggtcgtcctcgtcacccaggagcaccatgtcttcctcggcacggtccgcgacaacctgctgatcgccgagccctcggccacggacgacgcgttgtgggcggctctcgccgcggtcggcgccgacggctgggtgcgcgagctgccggacggcctcggcaccgtcctggggtccggtggttgtgccacggacggctcacaggctcagcaactggcgctggcccgggtggtgctggcggatccgcacacgctgatcctcgacgaggccaccgcgctgctggatccgacgaccgcccgccacaccgagcgcgcgctggcggccgtactcgaagggcggaccgtcatcgccatcgcccaccggctgcacacggcgcacgacgcggaccgggtggccgtgatggaggacggccggctgaccgaactcggcacccacgaggccctggtggcggcggggggcgcgtacgcggcgctgtggcattcgtggcacggcgacgagccgtccccgtcc

SEQ ID NO: 2781 - DNA, 2043 bp, Streptomyces avermitilis
  CDS (1)..(2043)
gtgttgagtagcagttcctcccacagacgcacctcccacatcctgcgtcgtcgcgccggggcagtcgccctggtgggcgtcaccgccctgctcgccgcggccgtccagtcgggcgccgccaacgccgcccccgaccaggcccccacgggcaaggtcaagccgggcgccgtcaccctgaagctcaccccgtcccagcgcgccgagctgatacgcgacgccaacgcggccaaggcggacaccgccaaggatctgggcctcggagccaaggagaagctcgtcgcccgcgatgtcctcaaggaccacgacggcacggtccacacccgctacgagcgcacctacgacggactgccggtcctcggcggcgacctggtcgtggacacctcgaagtcgggcaagaccgagcgggtcgtcaaggcgacgaaggcggccatcaagccggcctccctcaagccgcagatcgcctccgccaaggccgagcagcaggccctgaccgccgccaagtccgccggttcgaagagcaccaaggcggaccgcgcgccccgcaaggtgatctgggcggccgacggcaagccgaccctcgcctacgagaccgtcgtcggcggcctccaggacgacggcaccccgaaccagctgcacgtcatcaccgacgcggccaccggcaagaagctctaccagtaccagggcatcaagaacggcatcggcaacacccagtacagcggccaggtgaccctgacgaccacacagtcgggctccacctacacgctgaacgacggagcgcgcggcgcccacaagacgtacaacctgaaccacgggtcgtccggcaccggcacgctgttctcgcagacgaacgacacctggggcaacggcaccacgtcgaacgccgcgaccgccggcgccgacgcgcactacggcgccgccacgacctgggacttctacaagaccacgttcggccgcagcggcatcaagaacaacggcgtcggcgcgtactcgcgggtccactacggcaacgcgtacgtcaacgccttctgggacgacagctgcttctgcatgacgtacggcgacggctccggcaacgccgacccgctgacctcgctggacgtggcgggccacgagatgagccacggcgtcacctcgaacacggccaacctgaactacagcggtgagtccggaggcctgaacgaggcgacctccgacatcttcggcacgggcgtggagttcttcgcggcgaactcctccgacgtcggtgactacctcatcggcgagaagatcgacatcaacggcgacggcaccccgctgcgctaccaggacaagcccagcaaggacggcgcgtccaaggacagctggtactcgggcatcggctcgatcgacgtccactactcgtcgggtcccgcgaaccacttcttctatctgctgagcgagggcagcggcgccaaggtcatcaacggcgtcagctacaactcgccgacgtcggacggccttccggtcaccggcatcggccgcgacaaggccctgcagatctggtaccgggcactcaccaccaagttcacctcgaccaccaactacgcggcggcccgcaccggcaccctcgcggcggcgggtgagctgtacggcacgacgagcaccgagtacaaggcggtgcaggacgcgtgggcggccgtcgcggtcggtgcgcgctccggtggcggcggcggtggcggtacctcgtacgagagcacgaccaaggtatcgattccggacaacgcgggggcggtgacgtcctcgatcaccgtcacgggccgcaccggaaacgcgccgagcaatcttcaggtcaccccgaacatcacgcacacctggcgtggtgacctggtcatcgacctggtggccccggacggctcgacgtaccgcctgaagaacttcagctcgtccgactccgcggacaacgtgaccgacacctacacggtcaacgcgtcctccgaaaccgccaacggcacttggcagttgaaggtccaggaccaggcggcgcaggacgtcggcaccatcaacagctggaagctgacgttcccg

SEQ ID NO: 2782 - DNA, 1662 bp, Streptomyces avermitilis
  CDS (1)..(1662)
gtgacctccctctacgcgcgtcacaagcgcaccactctggccatcgccaccgctgtcgccgccggagccctgctcgccaccggtgtgaccaccggtgcctctgcccagaccccggtgtccgacgccggcaagaaggccaccctcgccggcgccccgctccagctgtccgcggcggcgcgcacgtccctcatcaagaaggccgaagccgccacgccggagacggcccagcagataggcctcggcaccaaggagaagctggtcgtcagagacgtcgtcaaggacgccgacggcacgctgcacacgcgctacgagcgcacgtacaacggactgccggtcctcggcggcgacctggtcgtccaccagtcgaagtcgggcacgaccgagggcgtgaccaaggcgacgaaggcgaccatcaaggtggcctccctcaagccgcagatcacctccgccaaggccgagaagcaggccctgaccgtcgccaagtccgccggctcggagaagacctcggccgaccgggcgccgcgcaaggtgatctgggcgggcaacggcaagccgaccctcgccttcgagaccgtcgtgggcggcctccaggacgacggcaccccgaaccagctgcacgtcatcaccgacgcggccaccggcaagaagctctacgagtaccaggccatcgagaccggcaccggcaagaccctctactcgggcacggtcaccctcaacaccacgctgtcggggtcgacgtaccagctgaccgacgggacgcgcggcagccacaagacgtacaacaagtcgcacaccaccacctcctccgcgggcaccttgttcaccgacgcggacgacacgtggggcaccggcgcggcctccagctccaccaccgaccagaccgcggccgccgacgccgcgtacggcgcgcaggtgacgtgggacttctacaagaacaccttcggccgcagcggcatcaagaacaacggcgtcgccgcctactcccgcgtccactacggcaacgcgtacgtcaacgcgttctgggacgacagctgcttctgcatgacctacggcgacggctcgggcaacacccacccgctgacctcgctggacgtcgcgggccacgagatgagccacggcgtcaccgccaacaccgcgggcctcaactacagcggtgagtccggcggcctgaacgaggcgacctccgacatcttcggcacgggcgtcgagttctacgcggccaactcgtccgacgtcggcgactacctcatcggcgagaagatcaacatcaacggcgacggcaccccgctgcgctacatggacaagcccagcaaggacggcggctcggcggactcctggtcctccagcgtgggcaacctcgacgtgcactactcgtcgggtgtcgcgaaccacttcttctacctcctctcggagggcagcggttcgaagacgatcaacggggtcacctacaactcccccacgtccaacggctccacggtcacgggcatcggccgggccaaggccctgcagatctggtacaaggctctgacgacgtacttcacgtcgacgaccaagtacgcggccgcccgcacgggcaccctctcggcggcctcggcgctgtacggctccaccagcaccgagtacaaggcggtggcggcggcctggtcggcggtcaacgtcagc

SEQ ID NO: 2783 - DNA, 504 bp, Streptomyces avermitilis
  CDS (1)..(504)
atgtccttcacgtacgaggatgtcggcgcgacccgtgagaacgggtactgcccgccgggattccactccctgcacgtgcgcacgcgcataggcgagggcgaagaggtgttccgccgggcgtcccacgcggtcgtcacctgggagatgcaccgcgccatgggcgtcggtattgacgcgtccgcggacgcggccgccccgggggtcgacgtcacggtctccctggccggcatgatcaaggccccgtgccgggtggtctggacggtcgacgaaccccgccgcgccggctgggcgtacggcacgctttccggccaccccgagtgcggcgaagaagccttcgtcgtgaacagaacgggcgacggcacggtctggctcacgatcacggccttcagccgcgcggccaagtggtacgcccgagcgggcggcgcggcgacgcgaggcttgcagcacgcgtacgcgcggcggtgcggggtggtgctgcggaggctgtgcgagtcggttgcggac

SEQ ID NO: 2784 - DNA, 588 bp, Streptomyces avermitilis
  CDS (1)..(588)
gtgtcccacgtcgctcaacctcccgcgccgataagccggaagcgcaccacagccctggcactgccaccgcgcggcgctgccgtcgagcgagcccaagccccttccactccggagccgttcatggtcaccgtaaccccgcccgacacctgggtatacgcccttcgcctgccccatgacccccgcgccgcacgcgtcgcacgtatgaccgtgcgggccacgctgtccgggcacggtatgggtgaagtcgtcgatgtcgtcgagctgttgacctccgagctcgtcaccaacgcctaccggtacgccaaagggcctgcatccctgcggctgacggcgctgggaggaggacggttgcgggtcggtgtgtgggacagcagtccgcacattcctgcccccttcgaccggccgcccggagaccgtgtcccgtgcgcgccggtggacgccgttggtgggcgcggtctcttcctcgtacaggagtacgcggactggtggggcggctggcgcctcggcgatgaccagatggggcacggtgccgggaagctgctgtggttcgaagtgggaaggaggagggcggtggcggagcgccgcgtg

SEQ ID NO: 2785 - DNA, 852 bp, Streptomyces avermitilis
  CDS (1)..(852)
gtgccgcccagcaccactcccacactgcgccaacaacgactgggctccgagctgcgcaggctcagggagcactcaggactgacatccaccgctgccgcggacctgcttggcctcaagcaggctcaggtcagcagcatcgaggccggccgctacgccgtcagcgccgaccgcgtacgcaccttcgcccgcacatacagctgcgccgacccggctctgatcgaggcgctggccgagatgaccgggggccgtacccggggttggtgggacgagtaccgggagtatctgcccgccggattggccgatctcgccgaactggagcaccacgcaaccgagttgcgcgtggccctgtccctgcacatccctgccctgctccagaccacggaccacgcccgagccatgctccgcgaagcggtcccgcccttcctgccgtacgagctcgagcaccgcctgtcgtaccgcatcaagcggcaggagatcctgaaccgctcggccccactcccctacacggcacttctgcatgaggcggccctgcgcatgcagtacgggggcgcggacgtcgcccgggatcagctcgcccacctgctggagcggagcgagcaggacaacatcaccatccgcgtcatccccttcacctcgccgcatttccccggcaacggccagtccttcgactacgcggtcggcccgaccccccagctcgacacggtccaactggacacccaccacggcggctgcgaattcctggacacggaagcacagttggcgaaataccggaccgtgctggaccgcatggaaaactgcgctctcgaacccgccgagtcacgcaagttcatcgagcacatcatgcaaagccac

SEQ ID NO: 2786 - DNA, 186 bp, Streptomyces avermitilis
  CDS (1)..(186)
gtgcacatatccgcctggcagaagtccacctacagccccgacggctcgaactgcgtctacgtcgccgccacccccaccggaaccgttcacctccgcgaaagcgacgaccctgacgtcatcctgaccaccacccgcaacccgctgctctccctcatacgctccctcaaagaagacagccaacgacgc

SEQ ID NO: 2787 - DNA, 2634 bp, Streptomyces avermitilis
  CDS (1)..(2634)
gtgaaggccatccgtaggttcaccgtacgtcccgtactccccgacgcccttcacccgctcagcgatctggcgcgaaatctgcgctggtcgtggcatgcggagacccgtgagctcttccagtccgtggaccccgagcgctgggcggcgtcggacggcgatcccgtacggctgctcggcagcgtcccgcacgcgcgcctcgcggagctggcggaggaccgccgcttcctgcgcaggctgggcgcggccgccgacgatctcaccgactacgtgaccggcgaccgctggtaccagtcgcaggccgaggccccgtcccgcgcggccgaactgcccgccgccatcgcctacttctcaccggagttcggcgtcacggccgcgctgccgcagtactccggcggcctcggcatcctcgccggggaccatctgaaggcggccagcgacctgggcgtgcccctgatcggggtgggcctgctgtaccggcacggctacttccgccagtcgctgtcccgcgacggctggcagcaggagcactatcccgtcctcgacccgcacgaactgccggtggtgccgctgcgcgaggacgacggcgccctggcccaggtctccctcgccctgcccggcgggcggcggctccaggcccggatctggctggcccaggtgggccgcgtaccgctgctgatgctcgactcggacgtcgaggagaacgaccacggtgagcgcggtgtcaccgaccggctgtacggcggcggcagcgagcaccggctgctccaggagatgctgctgggcatcggcggggtgcgcgcggtccgcacgtactgccggctgaccggtcatgccgagccggaggtcttccacaccaacgaggggcacgcgggtttcctcggcctggagcggatcgccgaactctgcgacacggggctggacttcgacgcgggcctggagtcggtgcgggcggggacggtcttcacgacccacacgccggtcccggccggcatcgaccggttcgaccgggagctggtggcccgccacttcggcccggacgcggaacttccgaggatcgacgtggagcggatcctggggctcggcatggagacgtacccgggcggcgaacccaacctcttcaacatggcggtgatgggcctgcggctgggccagcgcgccaatggcgtctcgctgctgcacggtcaggtgagccgggagatgttctcgggcctgtggccgggcttcgacccggacgaggtgccgatcacctcggtgaccaacggggtgcacgcgccgacctgggtggccccggaggtgttccggctgggggcgcggcagatcggcgcccagcgcaccgaggacgcgatgacggtgggcggctcggagcgctgggacgcggtggcggagattccggaccaggacatctgggacctgcggcgggtgctgcgggagcaactggtgaccgaggtgcgggagcggctgcgcgcgtcctggcggcagcgcggggcgggcacggccgaactcggctggatcgacggggtgctcgacccggacgtcctgacgatcggcttcgcgcgccgggtcccctcgtacaagcggctgacgctgatgctgcgggaccgggaccggctgatggacctgctgctgcaccccgagcgcccggtgcagatcgtggtggcgggcaaggcgcacccggcggacgacggcgggaaacgcctggtccaggagctggtgcggttcgctgacgacccgcgcgtccggcaccgcatcgtgttcctgccggactacgggatggcgatggcgcagaagctgtacccgggctgcgacatctggctgaacaacccgctgcgcccgctggaggcgtgcgggacgagcgggatgaaggccgcgctcaacggctgcctgaacctttcggtgctcgacggctggtgggacgagtggttccagccggacttcggctgggcgatcccgacggcggacggcaccgcgacggacgaggaccgccgggacgacctggaggcgacggcactgtacgacctgctggaagggcgcgtcgccccccgcttctacgagcggggccaggccggtctgcccgaccgctggatcgagatggtccgccagacactgacgcatctgggtcccaaggtgctggcggggcgcatggtgcgcgagtacgtggagcgtctctacacccccgcggccctcgcgcaccgggcgctgaccccggaaccggcacgggagctcgcgacctggaagtcccgggtacgggcggcctggccgcgggtcaccgtcgaccatgtggagacctcggtggcgacgacgacggcggagctgggcacgacgctgtcactacgggtccgcgtgggcctcggcgacctcgacccggacgacgtcgaggtccaggcggtcgcgggccgggtggacgggcaggaccgcatcacggacgcgacggcggtccccctgaaaccggtgggcggcccggacctggagggacgacgggtgtacgagggccccctgtccctggaccgcacgggccccttcggctacacggtccgcatcctgccgacccaccgcctcctggcgacgagcgcggaactggggctggtggcggtgccatcggaggatgtgggggagggggctggggttttgctgcgg

SEQ ID NO: 2788 - DNA, 1206 bp, Streptomyces avermitilis
  CDS (1)..(1206)
atggcacggacgagcagcgctcgtctgcgctgggcaggaggcctgaccgcggtcaccaccgccgcggtgctttcggccgtcaccctgcccgcgcaggcagccccgcaggggcggatactcggcgccggcgatcccggttccgtcagcggaagttacctcgtgacactcaaggggggaacgagcgcgccctcggcggccggcaagagcgtcgccgggaagtacggggcgaggatcagccacatctacggtgccgccttgaacggctatgcggtgcaggccaatgagaagcaggcccggcggctcgcggcggacccccgcgtggcctcggtggcgcaggacaccgaggtcgctctcgaccactaccagaagaacccgccctcctggggcctggaccggatcgaccagaacgacctgccgctcgaccacggctacacctggccggagtcctcgggcgccggcgccggcgtgaccacgtacgtcatcgacaccggtatccgcgtcacccaccgggacttcggcggccgggcgagctacggctgggacttcgtcgacggcgaccggacggcgggcgacggcaacgggcacggcacgcatgtcgccggaacgatcgcgggcaccacgtacggggtcgccaaacaagccaaagtcgtcgcggtacgcgttctcgacaacgagggctccggcaccaccgcccgagtcatcgccggcatcgactgggtgaccaggcacgcgaagaagcccgccgtggccaatctgagcctgggcggcttcgccaacgcgcagctcgacgccgccgtacgcaactccatcgcctccggcgtcacctacgcggtcgcggccgggaacgacggactcgcggccggcctgtactccccggcccacgtgaaacaggccataactgtcggcgccggcgaccggaaggacgcccgtgcgagcttctccaactggggcccgcgcctggacctgttcgccccgggcgtggcgatcacctccgcctcgaacgcgagcgacaccgcgaaggccaccttctccggtacgtcgatggcgacgccgcacgtcaccggcgcggcagcgctcgaactggccgcgcatcccgaagccacacccgcccaggtcagcaaggcgctcgccgcccgggcggccacggggagaatctcgggcggcggccccggctcaccggacaaactgctccaggtgaacagccct

SEQ ID NO: 2789 - DNA, 2103 bp, Streptomyces avermitilis
  CDS (1)..(2103)
atgcccgcaacgcaccactcgccggcacccccggcgtccagtaccgactcaccccccatacgcaggggcgacgccggtccacccgccccggagacaccctccgcgggcaccacccccggcatcggacgcatccccgtcctcgacatccgtccgctcgtcgaccacgggcgccgcccggccaaagcggtcgtcggtgaggagttcgaggtctccgccacggtcttccgcgaaggccatgacgcggtcgccgccaatgtcgtcctcacggatccgcagggccgcagcggcccctggacccccatgcgcgaactcgcccccggcaccgaccgctggggcgccaccgtgtccgcgaccgccgccggccgctggacgtacaccatcgaggcctggggcgatccggtcaccacctggcgccgtcacgccgggatcaagatcccggccgggatcgacaccgaactcgtcctcgcggagggcgcgggcctgtacgagcgggcggccgccggagtaccgaagagcaagggcaggcgggaggtgatcctcgccgccgccgacgccctgcgcgacaccgggcgccccgccgcgtcccggctcgccgcggcgctcactgccgaggtggacaaggttctcgcgcggcatccgctgcgtgaactgctcacgtcgtcggagccgttgccgctgctggtggagcgggagcgggcgctgttcggttcctggtacgagttcttcccgcgttcggagagcggccgcgtggaccggccggtgcacggcacgttccgtacggcggccgagcggctgcccgccatcgcggagatgggcttcgacgtcgtctacctcccgccgatccaccccatcggcagcaccttccgcaagggccccaacaacaccctgtcggcggccgcccacgacgtgggggtgccctgggcgatcggctcgcccgagggcggtcacgacgcggtccacccggacctcgggacgatcgaggacttcgacgtgttcgtgcggcgggcccggggcctgggcctggagatcgccctcgacttcgcgcttcagtgctctcccgatcatccgtgggtggagaagcatccggagtggttccatcaccgtccggacgggacgatcgcgtacgcggagaatccgccgaagaagtaccaggacatctatccgatcgcgttcgaccgggacatgccggggctgatcgcggagacggtgcggatcctgcggttctggatgggccatggggtgcggatcttccgggtggacaatccgcatacgaagccggtggtgttctgggagcgggtgatcggggaggtcggccggacggatccggatgtgatcttcctggcggaggcgttcacgcggccggcgatgatgcgggcgctggcggcggtcggtttccagcagtcgtacacgtacttcacctggcgcaacagcaagcgggagctgacggagtacctgaccgagctgtcgggggaggcggcggccgttatgcggccgaacttcttcgtcaacaccccggacatcctgcatgagttcctccagcgtggcgggcggccggccttcgaggtgcgggcggtgctggcggcgacgctgtcgccgtcgtggggggtgtactccggctacgagctgtgcgagaacaccccggtgcgcggcgggagcgaggagtacctcgactcggagaagtaccagctccgcccgcgggactgggcggcggccgagcgcgagggacgcagcatcgcaccgctgatcacctcgctgaacgagatccggcggcgcagccccgcccttcgtcaactgcgcgacctgcacttccaccacaccgacaaggaagaggtgatcgcctactcgaagcgcagtggatcgaacacggttgtggtggtggcgaacctggatccgcaccacacccaggaggcgacggtctcgttggacatgccgcaactcggtctggactgggccgcgttcgtgccggtgcgcgacgagctcaccggggagagctaccactggggcagggccaactatgtgcgtctggagccggggcaccggcccgcgcacgttctcaccgtcctgcgaccgtcctcaccgcagatcggagggtcacccacacga

SEQ ID NO: 2790 - DNA, 1716 bp, Streptomyces avermitilis
  CDS (1)..(1716)
atgatcgtcaacgagcccgtcccggacaccttcgaggacacgcccgccaaggaccgcgatccggagtggttcaaacgcgccgtcttctacgaggtcctggtccgctccttccaggacagcaacggcgacggtgtcggcgacctgaagggcctgaccgccaagctggactatctgcagtggctgggcgtggactgcctgtggctgccgccgttcttcaagtcccccctgcgcgacggcggctacgacgtctccgactacaccgcggtgctgcccgagttcggtgacctggccgacttcgtcgagttcgtggacgcggcccaccagcgcggcatgcgcgtgatcatcgacttcgtgatgaaccacaccagcgacctgcacccgtggttccaggagtcccgcagcaaccccgacggcccctacggcgactactacgtgtgggccgacgacgacaagcagtaccaggacgcccggatcatcttcgtcgacaccgaggcctccaactggaccttcgacccggtccgcaagcagtactactggcaccgcttcttctcccaccagcccgacctcaactacgagaacccggcggtgcaggaggagatcgtctccgccctgcggttctggctcgacctcggcatcgacggcttccgcctcgacgcggtgccgtacctgtaccagcaggaaggcaccaactgcgagaacctgccggcgacgcacgagttcctgaagcgggtgcgcaaggagatcgacacgcactatccggacacggtgctgctcgcggaggcgaaccagtggccggaggacgtggtcgactacttcggcgacttcccctcgggcggcgacgagtgccacatggcgttccatttcccggtcatgccgcggatcttcatggcggtgcggcgtgagtcgcggtatccggtgtcggagatcctggcgaagacgccggcgatcccgtcgagctgccagtggggcatcttcctgcgcaaccacgacgagctgaccctggagatggtcaccgacgaggaacgcgactacatgtgggcggagtacgccaaggatccgcggatgcgggccaacatcggcatccgccggcgtctggcgccgctgctggacaacgaccgcaaccagatcgagctgttcaccgcgctgctgctgtcgctgcccggctcgccgatcctctactacggcgacgagatcggcatgggggacaacatctggctcggtgaccgggacgcggtgcgcactccgatgcagtggacgccggaccgcaacgcgggtttctcgtcctgcgacccggggcgtctgtatctgcccacgatcatggatccggtctacgggtaccaggtcacgaacgtggaggcgtcgatgtcgtcgccgtcctcgctgctgcactggacccggcggatgatcgagatccgtaagcagaacccggcgttcggcctcggctcgtacaccgaactccagtcctcgaacccggccgtcctcgcgttcctgcgggaggccccctcgaccggggggaacggggacgacctggtgctgtgcgtgcacaacttctcccggttcgcgcagcccacggagctggatctgcgggcgttcagcggccgtcatccggtcgagctgatcggcggtgtccgcttcccggccatcggggaactcccgtatctgctgaccctggcaggccacggcttctactggttccggctccgcaaggacgccgtc

SEQ ID NO: 2791 - DNA, 1398 bp, Streptomyces avermitilis
  CDS (1)..(1398)
atgtcggaagccgtcactcgtgccaccaggacaagtcccgggctccttgcgtccctcgatccactgctgcgggagtggctgccgcggcaacgctggttcgcgggcaaggggcggccggtcaccgggttctcactggtcgcggccaccgaactgctgccgcccaccgccaagttgggcctgctccacctcctcgtacgggcccatcagccggatgtccccacccacggcgcgatgacgcaccccggggactgctaccagctcctgataggcgtgcgcgaggcgctgccaccccggctggcgcccgcgctcatcggacatccggacgacggtccgctcgccgggcggaccgtgtacgaggctctccacgacccccgccccgccgaagtgctcctcgaagcgctgcgggcacgggcccgcatcggcgaactgcgcttcgaacgcgatacgcggcaggagatacccgacggactgatgccgcgcctgatgaccgcggaacagtcgaactcctcgatcgtctatggagatacgttcatcctgaagctgctgcgccggatcgtgccgggcgtcaaccccgatctggaactgccgttactgctcgcccgcgagggctgcccccgggtgcccgcgccgacggcctggctgctcgccgacctcgaaggccccgacgactcgtacgtcctcggcgtactccagccctttgtgaagggcgcggccgacggctgggaactggcgctgcgtgaactggccaagggcgaggacttcagcacccaggcgcgggcgctcgggcgcgcgacggccgaggtgcacaccgcgctggcccgcgcgacgcccccggtcaccctgggacacgcacaggtgcggctgctggtcgacggcatgacggagcgcctggaggcggccgcgcaggcggtgcccacgctgcggacgtacgcgcccggcctgcggtccgcgttcgagacgctgggcgagctggccgccgagggacgcacctggaacgcccagcgcatccacggcgacctgcatctgggccagtgtctgcggtcgccgtccggcacctggtcgctgatcgacttcgagggcgagccgtcgaagtcgctggccgagcgccggctgccacagcccgtcgcgcgggacgtggccggcatgctccgctccttcgactacgcggcccactcgcacgaaccccgggtgcccggctgggcggacacctgccgggccgcgtactgcaccggctacgccgagatctccgggctcgatccccgtaccgaccccgtgctgctgcgcgcctacgagacggacaaggcggtctacgaagtcgtctacgaggcccggcaccgccccgagtggctgccggtgccgatggcggcggtacaccggctgtccgccgacgccgcaccg

SEQ ID NO: 2792 - DNA, 2514 bp, Streptomyces avermitilis
  CDS (1)..(2514)
gtgatcccccgtcctccgtccgacgaccgcgcgaaccagaacggtgacggttcgaagaagaccggtgcgaagaagaccggtgcgaagaaggcggctgccgcgaagaagacggctgggaagaaggccacgccggcggcgaaggcgacggccgcgaagggggcggtgacgaagaagaccgggaaggggaaggcgaccgccaagaaggccgtggccgacaaggccgccgccaaagcgaccgttccccagcaggccgttcccaagcaggccgtgtccaagagggccgtgtccaagaaggccgtgcccaggaaagccgtggtcaaggcggccctcgacatccccgaagcgcccgtctcccccgccgtcgcccccgacgaccgcgaccggctcctgtccggcacgcaccacgccccgcactccgtgctcggcgcgcatcccgtgcccggcggggtcgccttccgcgtgctgcgcccgtacgcgctgtccgtcaccgtcgtcaccgacgacttgcgcaccgagctgcacgacgacggcgccggcttcttcaccggcctgctgccgctgcgcgccgtaccggactaccggctgcacgtggcctacgagggcacggtccacgagaccgaggacgcctaccgcttcctgcccgcgctcggcgagctggacctgcacctcatcaacgagggccggcacgaggagctgtggacggcgctcggcgccgaaccgatgacgcaccagggcgtgcccggcacccgcttcaccgtctgggcgccgaacgcgcgcggcgtccgactggccggcaccttcaacttctgggacgccaccgccttccccctgcgctcgctgggctcctccggcgtgtgggagctgttcgtgcccggcgtcggcgagggcgagctgtacaagttcgagatcacccgccccgacggctcgaagaccctgcgcgccgaccccgtggcccgccgcaccgaggccccgcccaggacctcgtcgatcgtgcacgcgtcgcactacgcgtgggcggacgaggcgtggatggccgcgcgcggcgagcgtcccgtgcacgagtcgccgttctccgtgtacgaggtccacctgccgtcctggcggccaggactgacgtaccgtcaactcgccgaacagctccccgcctacgtcgccgacctgggcttcacccacgtcgagttgctgcccgtcgcggagcaccccttcggcggctcctggggttaccaggtcaccggcttctacgcccccaccgcccgcctgggcacccccgacgacttcaaatacctcgtcgacgccctgcaccgggccggcgtcggcgtcctgatggactgggtgcccgcccatttcccccgcgacgactgggccctggccgaattcgacgggcggccgctctacgagcacgaggatccgctgcgggccgcgcaccccgactgggggacgttggagttcgactacggacgccgggaagtgcgcaatttcctcgtcgccaacgccgtgtactggtgcgaggaattccatatcgacgggctgcgcgtggacgccgtcgcctcgatgctctacctggactactcccgcgaggaagggcagtggagcccgaacgagttcggcggccgggagaacctggacgcggtcgccttcctccaggagatgaacgccaccgtctaccggcgggtgcccggcgtggtcacgatcgccgaggagtccaccgcctgggagggcgtcacccgcgccacacatgacaacggcctcggcttcggcctgaagtggaacatgggctggatgcacgactccctcggctatgtgcagcacgagcccgtgcaccgcaggttccaccaccacgagatgaccttctccatggtgtacgcctacagcgagaactacgtcctgcccatctcccacgacgaagtcgtgcacggcaaaggctcactggtgtcgaagatgccgggcgactggtggcagcagcgggcgaccgagcgggcctatctcggcttcatgtgggcccatccgggcaagcaactcctcttcatgggtcaggagttcgcccagggcgcggagtggtccgagacccacgggcccgactggtggctgctcgatccggcgtacggtgccgagcccgaccaccggggcatgcgggatctggtgcgggacctgaacaccgtctaccgtcacgaacccgctctgtgggagcgcgacacggacccgtccggcttcgcctgggtcaccggcgacgccgtcgaggacaacgtcttcgccttcctgcgccacgccgccgacggcaccccgctcctcgccgtcagcaacttctccccggtcgtccgccacgactaccgcctcggtgtccccgacgacatccccgcctggcacgagacgctcaacaccgacggcgcccgctacggcggcagcgacgtcaccaacccgcacccggtgaagcccgaaccgcagggccgccacggccgcccggcgagcatccggctgaccctgcccccgctctccacgctctggctgcgaccggcc

SEQ ID NO: 2793 - DNA, 1446 bp, Streptomyces avermitilis
  CDS (1)..(1446)
gtgcacggccggtgcggtatgcgtagcggtatggaagcccagccctacgcgaccgccccggccggcagccccaggctcgagtcactgcgcgtggaacctctgctgacatcggagttcgacgccgacccggccggcgtgtacgagcggctgcggcggacgtacggcccggtcgcgccggtcggcctgatgggcgtgcccgtctggctggtcctcgactaccacgaggtcctggaggtgctgcgcgacgacagccagtggcggcgcgacatccggtactggcgggcgcgcgcacaggggcaactgccgcgcgactggcccctgctcgcgggctacgaggtgcggcagaccatgttcctggacggcgacgagcaccacgcggcccggctgacccaccactcggccctgcgccccttccaggacgggcacagcccgcaggggtgggaactgcgggcggccgtcgcccggtacgcggacgaactcatcgccctgctggccgccgaatcgggctccgccgggtacgccgatctgggcgcgcagtacaccagaccgctgctgctgatggtcaccggcaagctgttcggctgtccggtgggactcggcgacgagctggtcatggacctgtggcggatgctcgacggcggcccggacgcgggccccgccaccgaccgcgcggccgctgtcatgacccggctcgccgcccaccgcagacagcgccccggcgacgacctcacctcgtacctgctcctcgccgacccgggcatgaccgacgagcagctcggccgcgagctgttgatgaacgccgtctacctcaacgacatcaccggcaacatggtcatgaacaccctgctggaggtgctgcgcggcaacgccaccgtccgccgcagcgtgtcggacgggcacctcggcgagaccttccaccgcgtggcgctggtcaacccgccggtggccaacatgtgcttccgcttcgccgccggggacgtgcgcctcggcgccttctggatcagggcgggcgacgtcgtctccccgtcagccgcggccgcccaccaggacctgctgacgatcggcacctcccccctcggtgacgccaccgcgagcacccgcgcccatctgggctggggagcgggacagcaccagtgccccggcgcggcccgcgagctggcgggcatgatcgtgaccacggcggtgggccggatcttcgaccacttcaccaaggccgaactcacccttccggccgaccagttgccctggcgctccggcccggtcgtacgaggtctgcggctgctcccggtccgctacgagctgagggggacgccgtcggagtcccaccccgtgccgccgccccggcacgacggcgaggcaccggacaccgcgcccaccgccgaccaccgctccagaggcctgctgtcggcgctgcgccggctgatgaccggtacgggaagggcgggt

SEQ ID NO: 2794 - DNA, 2325 bp, Streptomyces avermitilis
  CDS (1)..(2325)
ttgtcaaacagcggctctaacacagaaggcagcacggccggcgcggtatttaccgacgatgaattgcggcttgagcaggaattcatcgacggactgtacgcgcgcgtggacgccctgcgcggtgtcaccgaggtctccgtcacggacgcgctcgcgcagggcaacacgcccatgcaggccaggctggaacgggacgtcctcgtcgccgagcgctcggggctgctcgccgcgctgaacgcggtcgacgaatcgctctgcttcggccggatcgacctcacctcgggggtcagccaccacatcggccgcatcggcatccgcgccgacgacaccgagcacaccccgatcctgatcgactggcgggcccaggtcgcccgccccttctacctcgccaccgggcacaccccgatgggcctgcgccgccgccggcacctcaccaccgacgggcgccgggtcaccgacctgcacgacgagctcctcgacctcggcgacgccacgaggaccggccacgaggacccgacgggcgacgccgtgctgctcgccgcgctcaactcggcccgcaccggccggatgagcgacatcgtgcagaccatccaggccgagcaggaccggatcatccgtgcgccgcaccgcggggtgctggtcgtggagggcggcccgggcaccggcaagacggccgtcgccctgcaccgggccgcctttctcctctacgagtaccgggagctgctcgccaagcgagccgtcctcatcgtcggccccaaccccgccttcctcggctacatcggcgaggtgctgccctcgctaggcgagacgggcgtgctcctggcgacggtcggcgagctgttccccggtgtgaaggcgacggcggccgacaatccgcgggcgtccgcggtcaagggccgcgccgagatggcggaggtgctcgccgaggtcgtacgcgaccggcaggcgctgcccgacccggtgatcaccatcgagcacgaccgggacgtgctgatgctcgacgacggtctggtgcgcgtcgcccgcgaccgcacgcgcgaggcgaagctgccgcacaacgtggcccgcgagtacttcgagggccacatcctcaacacgctcaccgacatggtggccgagcggatcggcacggaccccttcgacggctccaacctgctggacgccgccgacatcacccagatccgggacgagctggccgagaaccgcgaagtctggtcggccatcgaccggttgtggccgaggctgactccgcagcggctggtcgcggacttcctcgccgagcccgaggggtatgtgtccgccgaggacgcggccgcgatccgccgtccggtcacccgggcgtggaccacggcggacgtaccgctcctcgacgaggcggccgaactgctcggcgaggacgaccggctggcccgcgccctcgccgaccgcgaacggaacacccaggtcgcgtacgcgcagggcgtgctggacgtgtcgtacgcctcgcgtacatatgagttcgaggacaaggacgaggaggactccgaggttctgtccgcgcaccacatcatcgacgccgagcggttcgccgagcggcacgaggaggaggaccaccgcagcgccgccgagcgcgcggcggccgaccgcacctgggcgttcggccacatcatcgtcgacgaggcgcaggaactgtcgccgatggcgtggcggctgctgatgcggcgcagcccgacccgctcgatgaccctggtcggcgacccggcgcagaccgccgaggcggcgggcgtcggctcgtgggaggagatcctcgccccctacgtccaggaccgcttcgaccacacgcgcctcgccgtcaactaccgcacgccgtccgagatcatggacatggcggcggccgtggtccgggccgagcggcccggcttcgagccgccgagttccgtgcggtcgacgggcgtacggccctgggtgcgcgccaccgacgacctgcccagtgccgtcgccgaggcggtcgccgagctgaccccggcggaggggcggctcgcggtgatcgcaccgcgcgagctgcaccggaagctggcggcacgcctcgacggcgtcacggcgggcgccgagcccgatctgacccacacggtcgtcctcctcgatccgcgccagtccaagggcctggagttcgactcggtgctcgtggtcgagccggcccgctacggcaccagcgacctgtacgtcgcgctgacccgcgccacccagcggctgggtgtgctgcacacgggcgagctgccgaaggcgttggcggacggggagccgcacccggccgacggcacacccgccccgggtattaccaagcgg

SEQ ID NO: 2795 - DNA, 312 bp, Streptomyces avermitilis
  CDS (1)..(312)
gtgaccgaagtgacggatgcggacttcgaggcggaggtgatcggcgcggacctgcccgtgctggtggagttcacggcggactggtgcccgccgtgccggcagatggggccggttctcagctccctcgccttcgaggagggcgaccggctcaaggtggtccagctggacgtggacacgaacccggagacgacgaacgcgtacaaggtgctgtcgatgcccaccttcatggtgttccggggcggtgagcccgtgaagtcgatggtgggggcccggcccaagcggcggctgctggaggagctggccgacgtgctg

SEQ ID NO: 2796 - DNA, 426 bp, Streptomyces avermitilis
  CDS (1)..(426)
atgcgaatcggcgagctggcgacgcgggccgggaccaccacgcgcaccctgcgctactacgagtcgcggggactgctgcccgcgcggcggggcagcaacggctaccgcacgtacgacgaggacgacctgaagctgctgcggcagatcaggacgctccaggacttcgggttcgacctggaggagacgcggcccttcgtggagtgtctgcgggccggccacccggagggcgactcgtgcccggcgtcgctcgcggtgtaccggcgcaagctcggcgaactcgacgcgctgatcggcgagttgcaggccgtgcgggcgcaggtcggcgaccagctggcgcgggccgagctggcccgcgacgagctggcggccgaggcgggggttccgggcggtccggagcccgtgtgcgaactgggagggcagacgcgg

SEQ ID NO: 2797 - DNA, 447 bp, Streptomyces avermitilis
  CDS (1)..(447)
gtggccttcgacgccctcgaccggcagatcctggagctccttcagagcgacggccggatcaggctcagcgagctggggcggagggtgcggctgagcccggcggccgtcgcggagcgggtgcggcggctcgaggcggcgggcgcgatcaccgggtacggcgcccatgtctcgccggcccggctcggctacggcgtccgggccttcatccgcgtgaacccgcacgccgggtacagcctcaggcacccccggactctggaactgctggcccgccccgagatcaccgaggtgcaccacgtcgtcggcgaggactgctggatcctcaaggtcgccgtagcggacaccctccacctggaggagatcctcgaacagacctcggcgctgggccgcacgaccacgtcgatcgtgctctcctccccggtggagcggaagccgctgctgccgccgcac

SEQ ID NO: 2798 - DNA, 894 bp, Streptomyces avermitilis
  CDS (1)..(894)
gtgcgtgaagtgtgcgtcattggcgggaaccggtatttcgggaagcggctcatcgcccggctgatggccgccggagaccgcgtcaccgtcatcaaccgcggttcgtcggcaccgccgcccggcaccattcatctcgtcgccgaccgcaatgaggagagatccctggaaagcgcgctgggctcgcgcaccttcgacgtcgtcgtcgaccaggtctgctacaccccgcgccaggcggcgatcgcccgccgcgtcttcgccggccgcacccggaggtatctgatgacgtcgacggtcgaggtgtacgagtacgaggactcccccgcgccggtgcgcgaggacgccctcgacccgcgtacggtcgccgtcgacctcgacctcccctgggacgacccgcagttcctcgacagcaactacggcgagggcaagcgtcaggccgaggcggtcctcgcggcggaccccgccttcccgtacgccgccgtacgcgtcgcccatgtgctgggcggcgacgacgacttcacgggccgtctcgcccactacgccgagcggatgcgcaccggcgagcccatcgccgtccccgccgtgaaccacccggcgacctacatccatgtggcggagatcgccgacttcctcgcctgggcggcgggcgccgacttcggcgggccggtcaacgcggcgtcccacggaccgctcaccaccgaggaactgtgcgcggcggtggccgcgcacataccgggcgggacggccgtgttccgggaggtggaggtcggcgaggtctcccccttctccttcgcccgctcctacgcgatggacaactcccgggccgagcgtctcggcttcaccttcggcgacgcgagtgaatggctgcaccgggccgtcgccgagacgctcggcaga

SEQ ID NO: 2799 - DNA, 852 bp, Streptomyces avermitilis
  CDS (1)..(852)
atggcacagcgcgacaccggtggccggttgggggcggagttcttcacccccggggactcgtccttcaccgcgttcctggcagcccaccgtccggcattactgagcacccgcggcctcctcccggacggcgtccgggccgcgcccgaccgtgtcccgcacggcaccacggtcctggccctcgcctaccgcgacggcgtgctgatcgccggcgaccgcagggccaccatggggaacctgatcgcacagcgggacctggagaaggtgcaccccgcggacgactacacggcggtcgcgttcgccggcaccgtgggactcgcgctggacatggtgaagctctaccaggtcgagctggcgcacttcgagaaggtcgagggcgtcccgatgaccctcagggcgaaggcgacccggctggccggcatgatccggcagaacctcggccaggccatgcagggcctcgccgtggtcccgctgctcgtcggatacgacctcgcggcccgcgccggcgaacacggccgcatcttcagcttcgacgtcaccggaggcccgtacgagaagacggacttccacgccgagggctccggctccccgtacgcccggggcgcgttgaagaagctgttccatccgggcatgtcccggcgtgaggcggccctggccgcgctccaggcgctctacgacgcggcggacgacgactcggccaccggcggtccggacatcagccgccggatcttccccgtggtgtccgtcatcacggaggacggcttcgagcggctcccggagtccgagacggaggacctgagccgggagatggtcgaacagcgccacacccgcccggacgggcccaccgccgccatg

SEQ ID NO: 2800 - DNA, 1725 bp, Streptomyces avermitilis
  CDS (1)..(1725)
atgcgtctcgtcatgaacgaaccggtcgagaggatggaccggccctacgcccggcgctggtgggcactgctcgtgctctgcctgagtctgctgatcatcgtgatggcgaacaccgccctcacggtcgcggcccccgacatgacccaggacctcggcttgtccagcgccgacctccagtgggtcatcgacggctacaccgtcccgtacgccgcgctgatgctgctgctcggcgcgatcggcgacaagtacagccgccggggcgcgctcgtgctcgggctcgtcgtcttcggcggcggagcggtcgcgggctcgctcgtcgacagcgccaccggggtcatcgcggcccgggccgtcatgggcgtcggcgccgcgctgatcatgcccgccacgctctccctgctcgccgcgaccttcccgcgcgccgaacgggcgaaggcgatcaccctgtggaccgccacggcgggcctcgcgatcgcggcgggcccgctggtcgcgggcgcgctgctccagaaccacggctggtcgtccacgttcctcatcaacgtgcccatcgccttcgtggccgtcatcggtacgttcgtcctcgtgccgccgtccagggccgcccaccaccaccgcatcgactacgtcggcggactgctgtccgtcgtctggatcggctcgctggtctacatgatcatcgaggggccgcacttcggctggggcgtcaaggcggtcacggccgcggtcgccgcgggcgtcggcttcgtcctcttcatcggctgggagctgcgtcacccgcgccccgtcctggacgtacgccgtttcgcgcaccgccgcttcgcgggctccaacctcgccgtcgccctcttcttcctggcggtgttcggcgccttctactacctcacccagcacctccagttcgtcctcggatacgacgccctggacaccggggtgcgcatgctgccgctcgccggggccgtgttcgtcggctcggcgctgaccggctacctcaccccgcgcgtcggcatgaagatcacggtgacggcgggcatggtgggcggcacggccgcgctcgcgctgctcacccgggtcgacgcggcatcgtcgtacggcgacttcgtcctccccctcgtcatcttgggcctcgcgatcgggctcgcgctgtcgccctgcacggacgcgatcatgggggcgttcccggaggccgagctgggggtgggcggcgccgtcaacgacacctcgctggagctgggcggctcgctcggcatcgccatcctcgggtccgtcctggccggttcgtactcctcgcacctctcggacgcgaccaccggcagcaagctgcccgcgagcgcgctgagccaggcgcaggactcggtcggcgccggttacgcggtggcgcggggcatcggcgacaaggcgcgacacctcggcgagcaggcggcgcaggcggggagcacggaacaggccgcgcggttgaaggtgcagtcgggccaactcgccgacggcgcccggcagatggcggacgcggtcggctccgcgttcgcggactcggtcgcccacaccagcctggtcggcgcggtggtcctgggcgtggggacggtactggtgggagtgctgctgccgcgcaaggaagccgccgtgcgggaggttgagcaggagcaggagcaggagcaggagcaggagcaggagcaagggcaggggcggaagcaggaggaggaagagctggtggacagcgaggctcgc

SEQ ID NO: 2801 - DNA, 615 bp, Streptomyces avermitilis
  CDS (1)..(615)
atggctgacatgaccacgggtaacaccagccgcgccgacgccaaccgccgccggatcctcgatgtcgcgctcgccgagctgctgcgcgaccccgatgcgtccatggaccagatcgcccgggtcgcgggggtcgtacggcgcaccgtgtacgggcacttcccgagccgtgaggcgttgatcagcaccctggtcgacggcgccgtcgaagcggtcgcggccgcgcacgcggcgggccgggagagcgtggcggacccggccgagtcgctggcccgctcgacgctcgcggtgtgggagatcgccgaccggtaccggatcctggtcgcgctcgcccagcgcagcgtcaccgtgcagggcatccgggaccgcctcacgccggtccgtcaggcgtgcgtggagttgctccggcgcggcctggagcagggggtgttcgagtcgccgctgccggctgcggccctggcgtacgtgcacgagcagatgctgttcgcgctcatggaggcggtgaacgacggcctgctggcagccgaagaggcgggccgctccgccgcggtcacgatgctgaccgcggcgggcgtacccgcctcccgcgccaccggactggtggcgaagctgagcgac

SEQ ID NO: 2802 - DNA, 1410 bp, Streptomyces avermitilis
  CDS (1)..(1410)
atgatgccgacgacgtcgtcaaggagggcagccgtgagcacagcccaaacggcacctgccgcacccgccgccaagcgggaccgcacccactatctctacatcgcggtgatcgtcgcggtggctctcggcatcgccgtcgggttcgccgcgccggacttcgccaaggagctcaagccgatcggcaccggcttcgtcgcgctgatcaagatgatgatctcgccgatcatcttctgcacgatcgtgctcggcgtcggctcggtgcggaaggccgccaaggtcggcaaggtcggcgggctcgcgctcggctacttcatcgcgatgtcgttcgtggcgctggccatcggcctggtcgtcggcaacatcgtccacccgggcagcgggatgcacctgaccgaggccgtgaagggtgtggggcacacccaggcggaggccgccgcggaaggacccgtggacttcctgctcgggatcatcccgaccaccttcgtctcggccttcaccgagggccaggtgctccagacgctgctcgtggcgctgctcgtgggcttcgcgctccaggccatggggcgtaccggtgagccggtgctgcgcggggtcgagcacatccagaagctggtcttccgtatcctcggcatgatcatgtgggccgcgcccgtgggtgccttcggcgccatggcggccgtcatcggtgagaccggcatggacgcgctcaaggcgctggccacgatcatgttcggcttctacatcacctgtttcctgttcatcgtggtggtgctcggcacgctgacgaagctggtggcgaaggtcagcctcttccagctgctgaagtacctcggccgggagttcctgctgatcgtctccacctcgtcgtccgagtccgcgctgccgcggctcatcgcgaagatggagcacctgggcgtcagccgcccggtcgtcggcatcacggtgccgaccggctactccttcaacctcgacggcacgatgatctacctgaccatggcctcgctgttcatcgccgacgcgatggaccagccgatgagcatcggccagcagatcggtctgctgctcttcatgatgatcgcctcgaagggtgccgccggtgtctccggttccggcatcgccgtcctggccagcggtctccagtcgcacaagcccgcgctggtcgacggtgtcggcctgatcatcggcatcgaccgcttcatgagcgaggcccgcgccgtcaccaacttcgcgggcaacgccgtggcgacgctgctcatcggtacctggaccggcgaggtcgacaaggagcgggtgaaccgtgtgctcgccggtgagctgcccttcgacgagaagacgctgctggacgacgccgaggacgacgtccgcgcggaggtgcccgagcagggcggcgagaaggaactcgccaaggcg

SEQ ID NO: 2803 - DNA, 1695 bp, Streptomyces avermitilis
  CDS (1)..(1695)
atgcgcttcccccacgtgccccgaccccgcagcctggcgggtcagctcttcgccatgcaggccgtgctgatagcggtgctcgtggccggatacgcgctcttcacctacgtcagcgaccgcagccaggccgaggaggcggcgaggcggcagaccatggccgtcgcccggtcggtcgcggacgccccgtccgtgcgcgcggcgatccgcacctccgacccgtcggccgcccttcagccgtacgcgctccaggtacagcggcacaccggcgtcgacttcgtcacgatcatgaatccgcggggcatccgctggacccaccccaaccccgacctgatcggcgaacgcttcctcggtcacacgacccgagccctgaagggcgagtccttcacggagacgtacacgggcacgctcggcccgtccgtccgcgccgtcaccccgatccgtgacgggacgcggatcatcggcctggtcagcgcgggcatcaaggtggaggcgatcacgaagcgggtccaggaccaggtgacggccctgatcggcgtcgccgcgggcgccctcaccctcggcggcatcggcacctacgtgatcaacgcccggctgcgccgctccacgcacggcatgaacgcggccgagctgagccgtatgcacgactaccaccaggccgcgctgcacgccgtacgcgagggtctgctgatgctggacggccagttccgggtggcactgatcaacgacgggggccgggagctgctgggggtgacgggggacgtgatcggccgctcggtggcggagctgggcctgcccgcggcgctgacgggcgcgctgctgtcggcggaaccgcgggtggacgaggtccatctgacggccgcgcgcgtcctggtcgtgaacacctcgccggtctcgggcggcgagcgccgcggcaccgtcgtcaccctgcgcgatgtgaccgaacttcagtcgctgatgggcgagttggactccgagcgcggcttcaccacggcgctgcgctcacaggcgcacgaggccgccaaccgtctgcacaccgtcgtctcgctgatcgagctggggcgcgcggaggaggccgtcgacttcgccacggcggaactggagctggcccaggccctgacggaccatgtggtctccgcggtcagcgagccggtcctcgccgccctgctgctgggcaaggcggcacaggcgaacgagcggggcgtggagctggtggtgtcggaggagagcgccctcgacgacggtctgctgccgccctcgctcccggcccgggacctggtgacgatcctcggcaacctgatcgacaacgcggtggacgcggcccagggctcgatgcgggcgcgggtgacggtgacggtgttcaccgacgcgtcggggctggtgctgcgggtggccgacacgggcgcgggagtggatccggcgtacgcggaggcggtgttccagcggggctggtcgacgaagccggcgaccgcgtccggcggccgggggctggggctcgccctcgtccggcaggccgtcgcccgccacgaggggaagctgacggtcgcggaggcggacggcggcggggcggagttcgaggtgcggctgccgttgcctacggtgggtccggccggagccgccggcggatccgagcccacccgccgacacggtggtgcgtccgagcccgccctacccgccttgcctggaggcgacgacgta

SEQ ID NO: 2804 - DNA, 675 bp, Streptomyces avermitilis
  CDS (1)..(675)
atgaccgagcccattcgcgtactggtcgtggaggacgacccggtggccgccgacgcgcacgtcatgtacgtcggccgcgtccccggtttcacggcggtcggcaaggcgcacaccggtgcggaggcgcggcgcgcgctggaccgtacgccggtggacctgctgctcctggatctgcacctgccggacgtgcacggcctgcaactggcccgctccctgcgggccgccggctatcacgcggacgtgatcgcggtgacctcggcgcgggacctggcggtggtgcgggagggtgtgtcgctgggggtggtgcagtacgtgctgaagccgttcaccttcgcgacgctgcgggaccggctgatcagatacgccgagttccatgcggcggcgggcgaggcgagcggccaggaggaggtggaccgggccctggcgaccctgcgggcaccgggcccggcggccctgccgaagggcctgagcgcaccgaccctggaacgggtgacgcgggctctgcgggactcggccgaggggctgacggccgcgggggtggccgaggcggtgggcatctcccggatcacggcacggcggtatctggagcacctggtcgaatccgggcgggccgggcggagtccgcagtacgggcaggtggggcggccggagttgcagtaccggtgggtgaagggc

SEQ ID NO: 2805 - DNA, 1395 bp, Streptomyces avermitilis
  CDS (1)..(1395)
gtgcccgtgcgccccaccgccgcccgcccccgcaccactgccccgcttcttctcgccgccctgctcaccgtctccgccggcggtgccctcaccgcctgcggcagcggttccggaagtgatccggacacggtgaaggtctccttcaaacagtccatggacaactcgatcaaggtcacggacacctacctggccggcatcaagaagcagttcgagaaggagaaccccggcaagaaggtcgaactcgtccccatcaaggccccggactccgagtactacacgaaggtccagcagatgatgcggtccccgaagaccgcccccgacctggtctacgaggacaccttcctcatcaactcggacatcaccagcggctacttgaagcccctcgacccctacctcgccaagtggcgggactgggaccagttcctcgacacggccaaggcggccgccaagggcgaggacgggaagacgtacggcgtccccgacggcaccgacacccggggcctctggttcgacaagggcgtcttcgagaaggccggtctgcccgccgactggcagccgaagacctgggacgaggtcctctccgcggctcgtacgatcaagaagaaggtccccggcgtcaccccgctgaacgtgtacacgggcaagccggcgggcgaggccgccacgatgcagggcttcgagatgctgttgtacgggacgggcgacggcacggcggaccccctgtacgacacggccaccaagaaatggatcaccgcgggccggggcttcaaggacgccctccgtttcgtcgagacggtctaccaggagaagctcggccccgatgtctccgacgccctcgacccgaacttctcgaccgcggtccgcggtgaactgctgcccaagggcaagctcggcatcgacctggacggctcctggctcccgcaggactggctgaagggcagcggccacgagtggcccgagtggtcgagcaggctcggcctcgcggccatgccgacgcaggacggccgggcacccggcaaggtgagcatgtccggcggctggacgtggtcgatcccggcgaaggccggcaaccccgacctggcgttcaagttcatcgagacgatgcagacggcggcgaacgcacggaagtggtacatcgccaactccggcatcgcggtgcgcaaggacgtcgccgaggaccccgcttacacgaaggcccagcccggcatcaagttcttcacggacctggtcgccagcacgcactaccgccccgcgtacccggcgtaccccaaggtctcgaccgccatccaggaagccatggagggcgtgaccacgggtgacatgtcggtcgacaaggcggcgagcggatacgacgaagcgctgaagacggccacgaacaaccaagtgatcgagaag

SEQ ID NO: 2806 - DNA, 927 bp, Streptomyces avermitilis
  CDS (1)..(927)
gtgagcgcggacacccgagccgccccgggccgccccctgaccgggaaggccgccgcccctcgccggaaaggcgcccgccgctccctggtccgcgccctcccggccgcccccgccgtcgtcctcctggtcctcttcctcgcgggcccgatcggctactgcgcgtacatcgccttcaccgatctccagctcacgggccaggcccacgcgtcgttcgtcggtttcgacaacttccgggcggcgttcaaggacgaggcgttcctgaacgcggtctggctgacactcgtcttcacggtgctgtcgtcgctggtcggccagaacacgctgggcctggcgctcgcgtcgctgatgcaacgggcgtcgaagccgatgcgtacgctcgtcggcgggatcgtcatcacggcgtgggtgctgccggaggtggtggcggggttcctgctgtacgcgttcttccggcgggagggcaccctgaacgccatcctcgacgggcttcacctcccctcccagaactggctgttcacgctgccgatcctggcggtctccttcgcgaacgtatggcggggaacggccttctcgatgctggtctactcggcggcgctgaacgagatccccaaggagatcacggaggcggcggaagtagacggggcgggcggctggcgccgcatgtggcacatcacgctgccgatgatccgccggtcgatcggcaccaacctgatgctgaacaccctccagaccctgtccgtcttcggcctgatctgggtgatgacgagaggcggccctggaaacagaagccagacgctccccctgttcatgtacgaacaggccttccagaagagcatgatcggctacgggaccgcggtggcgctcctgctgctggtggtcggctcgctgttctcgctcgtctatatgcggctgctgcggacggaggtc

SEQ ID NO: 2807 - DNA, 837 bp, Streptomyces avermitilis
  CDS (1)..(837)
atgccgcgcactcccgcctcccgccgcacggcccaccggctcgcggcggacgccggcctgctcgtcgtggcggcggccttcgcgctccccctggcctgggtggtgctgtcctcgctggacgcgcacgccggactcgaggtgaaggtgccggacggcctgacactggacaacttcgacgcggtcctcaagccggacatcaccttcacgccactgctcaacagcctgatcctgtgcggcggggcgacgctcctgacggtggcgtgcgcggcgctcgcggcctacccgctgtcgcggttccggtcgcggctcaacaggccgttcctgctgacgatcctgttcgcgacgagtctgccgatcacggcggtgatggttccggtgtacgcgctgttcgtacaggtgaatctgatcgacaccctccaggggacgatcttcttcttcgcggcctctcaactccccttcgccatctggctgatgaagaacttcatggacggagtgccgaaggaactggaggaggcggcgtggacggacggagcgtcgtcgttccagtcgctgatccgggtcgtgctgcccctgatggggccgggcgtggcggtggtgacggtcttcgcgttcgtgatgatgtggggcaacttcttcgtgccgttcatgctgctgctcacgccggaccagatgccggcgtcggtgagcatcaacgacttcttcgggaatcgggggacggtggtgtacgggcagctggcggcgttctccgtcatctactcgacgccggtgatcctgctgtacgtgctggtcgcacggcggttgggcgggggattcgcgctgggcggggcggtcaagggg

SEQ ID NO: 2808 - DNA, 714 bp, Streptomyces avermitilis
  CDS (1)..(714)
gtgcgcgtgcacccaccgcaggcccaccagcccaccccgcccttcaacgccctcgccgcccgcagactgcgctcggctctcggcatggggcccgagcatgtcgcgtacggcatgcgtgcgtcgtacgggcttccctacgtcactcccgatctcgtcgtcgcctgggagcgcgggatcaccgcgccgagttcccccgaactcaccgcgctcgcgggggtgctgtggtgctcgccgggcgaactcatcggcgcgccgcggacgttgcgcgagcaccgggtcgcgcacggtctcgccgccgaggacgtcgcgcgggccgtcgggctcgaactcctcgtgtatcagcggatggaggagaccgacgagtggcgcggcaacgagcggcagtcgtccgcactcgccgatctgctcgaactctcgctgcccgacttcatcacggtgaccggacgcgacgcgaagctggcggagctgctgcgcagcgcggtcacgacgcgctggcaggcgtatgtgcggccggtcggcaagatggtgcccctggaccggcgcctgctggaggacgcgctccaggagctgcaccacgcctatcaggggcagatggtcgccaccctcagctggggcggcggcggcccggccgccgacgaggccggcgacgcgggccgcgacttcctcgaccggatcgtggagaacttctggtcgacggtccagcggagcacgtat

SEQ ID NO: 2809 - DNA, 1023 bp, Streptomyces avermitilis
  CDS (1)..(1023)
atgcgtatcggagtactcaccgcaggcggcgactgcccaggcctgaacgcagtgatccggtcggtcgtgcaccgagcggtcacgatgtacggcgacgaggtcatcggcttcgaggacggctacgcgggcctgctcgacggccgctaccgcgccctcgacctcaacgcggtcagcggcatcctcgcccgcggcggcaccatcctcggctcctcccggctccagcgcgaccgcctgcgtgaggcctgcgagaacgcgcaggacatggcccgcgagttcggcatcgacgcgctgatccccatcggcggcgaaggcaccctgaccgccgcccgcatgctctcggacgcgggcctgccggtcgtcggcgtcccgaagacgatcgacaacgacatctccgccacggaccgcaccttcggcttcgacacggccgtgggcgtcgccacggaggcgatggaccgcctcaagacgaccgccgagtcccaccagcgcgtgatggtcgtcgaggtcatgggccgccacgcgggctggatcgccctggagtccggcatggccgccggcgcccacggcatctgcctgccggagcgccccttcgaccccgcccacctggtgaagatggtcgaggagcgcttcgcccgagggaagaagttcgccgtcctctgcgtcgccgagggcgcgcaccccgtcgtgggcagcatggactacagccacggcgcgatcgaccagttcggccacgagcgcttccagggcatcggcacggccctcgcggccgagctggagcaccgcctcggcaaggaggccaagccggtcattctcggccacatccagcgcggcggcacgccgaccgcgtacgaccgggtgctcgcgacccgcttcggctggcacgcggtcgaggccgcgcaccgcggggacttcggcaggatgacggcgctgcgcggcacggacgtccagatggtgccgctggcggaggcggtcacggagctgaagacggtgccgaaggaccggatggacgaggcggagtcggtcttc

SEQ ID NO: 2810 - DNA, 2088 bp, Streptomyces avermitilis
  CDS (1)..(2088)
gtgacgcgcagcgtgtacgtgaccggaatcgaccgcggcgacggccgccaggtcgtcgagctgggggtcatggagcttctgacccgccaggtcgaccgggtgggggtgttccgcccgcttgtgcacgacggtcccgaccgcctcttcgagctgctgcgcgcccgctaccggctcgcccaggacccggcgaccgtgtacggcatggactatcacgaggcgtccgcgctccaggccgagcaggggaccgacgagctgatgtccacgctggtcgaccggtttcatctggtcgcgcgcgactacgacgtcgtcctcgtcctcggcacggacttcgccgacacccagttccccgacgagctggccctcaacgcccgcctcgcgaacgagttcggcgcggccgtgatccccgtggtcggcgggcgcgggcagaccgccgagtcggtgcgcgccgagacccgtaacgcctaccgcgcgtacgaggggctcggctgcgacgtcctcgccatggtggtgaaccgggtggcccgagaggaccgcgaggaactggccgcacggctcgattcccttctcgccgtgccctgttacgtactcccggacgagccggcgctctccgcgccgacggtcgcgcagatcacgcacgccctgggcggcaaggtgctcctcggcgacgactcggggctcgcccgggacgccctcgacttcgtgttcggcggtgcgatgctgccgaacttcctcaacgcgctgaccccggggtgtctggtggtcaccccgggcgaccgcgccgacctggtggtgggcgcgctcgccgcgcacagcgcgggcaccccgccgatagccggtgtgctgctcaccctcgacgagcggcccagcgacgaggtcctcaccctggccgcccggctcgcgcccggcaccccggtggtctcggtggccggcaccagcttccccaccgcggccgaactgttctccctggaggggaagctgaacgcggcgacgccccgcaaggcggagaccgcactcggcctgttcgagcggtacgtcgacaccggcgacctgctgaagcgggtgtccgccccgagcagtgaccggctcacgccgatgatgttcgagcacaagctcctggagcaggcccgctccgacaagcggcgcgtcgtgctgcccgagggcaccgagacgcgcgtcctgcacgccgccgaggtgctgctgcgccggggcgtgtgcgatctgacgctgctcggcccggtcgaccagatccgcaagaaggccgccgacctgggcatcgatctgggcggctcccagctgatcgacccggtgacctcacagctgcgggactccttcgccgagaagtacgcccagctccgggcccacaagggggtctcggtggagctggcctacgacgtcgtcgccgacgtcaactacttcgggacgctgatggtgcaggaggggctcgccgacggcatggtgtcgggctccgtgcactccacggccgccaccatccggcccgcgttcgagatcatcaagaccaagccggacacgaagatcgtgtcgtccgtcttcttcatgtgcctcgccgacaaggtgctggtgtacggcgactgcgcggtcaaccccgacccgaacgccgagcagctgtgcgacatcgccgtccagtcggccgccaccgcccggcagttcggggtggagccgcggatcgcgatgctgtcgtactcgacgggtacgtccggttcgggcgccgacgtcgacaaggtgcgcgaggcgacggaactggtccggctgcgccgcgacgacctgaagatcgagggaccgatccagtacgacgccgccgtcgagccgtccgtcgcggcgaccaagctgccgggctcggacgtcgccgggcaggcgtccgtgctgatcttcccggacctcaacaccggcaacaacacctacaaggccgtgcagcgctcggccggcgcgatcgccgtcggcccggtcatgcagggtctgcgcaagcccgtcaacgacctgtcccgcggcgccctcgtgcaggacatcgtgaacaccgtcgccatcaccgcgatccaggcccagtccccccacgagaaggcgaccgcccag

SEQ ID NO: 2811 - DNA, 1215 bp, Streptomyces avermitilis
  CDS (1)..(1215)
gtgagcccgacccgcgtcctcgtcctcaactccggctcctcgtcggtgaagtaccagctgctcgacatgcgggacagcagccggctggccgtgggtctggtcgagcgcatcggtgaggggacctcccggctgaagcacacgccgctcaccacgggtgtctcccgggagctgaccagcccggtcgccgaccacgcggccgccctcaagaccgtcgccgaggagctggcgaaggacgggctcggcctggactcccccgagctggcggcgatcggccaccgcgtggtgcacggcggcaggtccttcaccgagccgaccgtcatcgacgacgacgtcctcgccgagatcgagcggctgatccccgtggcgccgctgcacaacccggccaacctcaccggcatccgcaccgccatggcgctgcgcccggacctcccccaggtcgccgtcttcgacaccgccttccacacgacgatgccggagtcggcggcgcgctacgcgatcgacgtgaagacggccgacgagcaccgcgtccggcgctacggcttccacggcacctcgcacgcgtatgtgtcccgggcgaccgcgaagctcctgggcagggcgccgaaggacgtgaacctgatcgtgctgcacctgggcaacggcgcctccgcgtcggccgtgcgcggtgggcgctgcgtggacacctccatggggctgacccccttggaggggctggtgatgggtacgcgctccggtgacatggatccggccgtcatcttccatttgatgcgggtcggcggaatgtccacggacgaggtcgacactctgctcaacacgaagagcggtctgatcggcctgtgcggcgacaacgacatgcgggagatccgccgccgtgtcgacgagggcgacgagcaggcggcgctcgccttcgacatctacattcaccgactgaagaagtacataggcgcctactacgcggtcctcggccgggtggacgcggtcgcgttcacggccggggtcggcgagaacgcggccccggtgcgcgcggccgcgatcgcgggcctggaggaactggggctggtggtcgacagcgagcgcaacgccgtacggagcgacgagccgcggatcgtctcgcccgaggacgcgcgggtcgcggtcgcggtggtgccgaccgacgaggaactggagatcgcccagcagacgtacgccctcgtgggcacggcgcaccacctcacc

SEQ ID NO: 2812 - DNA, 1428 bp, Streptomyces avermitilis
  CDS (1)..(1428)
atgcgccgttcgaaaatcgtctgtactctcggccccgcggtcgactcccacgagcagctcgtcacgctgatcgaggccggcatgaacgtggcccgcttcaacttcagccacggcacgcacgccgagcaccagggccggtacgaccgggtccgggccgcggccgccgagaccggcaaggccatcggtgtcctcgcggacctccagggcccgaagatccggctggagaccttcgccgagggtcccgtcgagctggtgcgcggtgacgagttcatcatcaccaccgaggacgtgccgggcgacaagcacatctgcggcacgacgtacaagggcctgcccggggacgtctccaagggcgaccagatcctcatcaacgacggcaacgtcgagctgcgggtcgtcgaggtcgacgggccgcgggtcaagacggtcgtcatcgagggcggcgtgatctccgaccacaagggcatcaacctgcccggcgcggccgtgaacgtgcccgcgctgtccgacaaggacatcgaggacctgcgcttcgccctgaagatgggctgcgacctggtcgcgctgtccttcgtgcgcgacgcgagcgacgtgaaggacgtccacaaggtgatggacgaggagggccgccgggtccccgtcatcgccaaggtggagaagccgcaggcggtggagaacatggaggccgtcgtcgcggccttcgacggcgtgatggtggcgcgcggcgacctggccgtcgagtacccgctcgagaaggtcccgatggtgcagaagcgcctcgtggagctgtgccgccgcaacgccaagccggtgatcgtcgcgacccagatgatggagtcgatgatcaccaactcccgcccgacgcgcgccgaggcgtccgacgtggccaacgcgatcctcgacggcgcggacgcggtgatgctgtccgccgagtcgtcggtcggcgcctacccgatcgagacggtcaagacgatgtcgaagatcgtcacggcggcggaggaagagctgctgtcgaagggcctgcagccgctggtccccggcaagaagccccgtacgcagggtggttcggtcgcccgcgcggcctgcgagatcgccgacttcctgggcggcaagggcctggtggccttcaccaagtcgggcgacaccgcccgtcggctctcccgctatcgcgcggcccagccgatcctggccttcaccacggacgagggcacgcgcaaccagctcgcactgagctggggcgtcgagtcccacgtcgtgccgttcgtgaacagcaccgacgagatggtcgacctggtcgactccgagctgcagaacctgaagcggttcaacgacggcgacgtcgtcgtgatgaccgccggctcgccccccggcgtcccgggcacgacgaacatggtgcgagtgcaccacctgggcgagggcaagcgcgcc

SEQ ID NO: 2813 - DNA, 1296 bp, Streptomyces avermitilis
  CDS (1)..(1296)
gtgtcggctgatgaggtccatggcgagagctcttcggccctggcgcaggtgagatcgggaccgcgccacgcggcccccaggaagccgctgttcaccaggttccacatgcctgccggcaaggcgatagccatcgcggcgatgccgacggcggtcctcatgggcatggggttcacgccgacgctcgcccaggcggacgaccagccgttgtccaagagcgagttggccgacgagtacaagaactgcgtcgccgccctggaggacggcgcgtccgcgtcggccacgccgtcaccgtccgcctccgcgtccgacgacgcgtcggacaagggcgactcggcggagccgagcccctcggcctccgcgtcctcggacaagacctcttcgtcggattcaggttccgacgacaaggccgagcccacgccgtccgcgtccgcgtccgcgtcctcgtcttccgccggtacgtcggacaagtcgtcgggcggcgacacgtccacggcgaccccgtcggcgtccgagagcagcggcaacgtgctcgaggaaatcggcgacgcgatcaaggacgtcctcacccccgacagcccgtcggcgagcgccacccccaccccgacggcctccgcctcggcgagcgcgagcaaggacacctccgacaccgtcaaggacacgaccgacaaggtcaccgacacggtcaaggacaccgcgcaggacgcgacgaacacggcgtcgaaggcggccgaggacgccacggagaaggcgaaggaagcggccgacgaggccacttcctcggccacccccagcccgtcggcgtccgcgagctccaccacggacccgaaggactgcaaggccgccaccgacgaccagggcggtatcgacaacagcatcaacctgcccgacgacccctggacgctcaaggccagttcgctgaagctcgagggtgccgactaccagggcgtcgtcaaggtgcgcacggccggcggcaaggtcaaaaaggtcctgaagtacgtgatctcccagggcaccgagatcggtgacctgcaccagctcgtcgtcggcgacggcggcaagacctaccacgtccaggcgggcgagggcacgaagtccaccatcagtgacggcaagacgatcatgtacacggagagcatctccggcaatctgttcggcctgatcccggtcacgttcgacccggagaaccccccgccgctgaacatcccgctgatctacttcaccaaagtgacggtcatccaggccggccagttcggcggaacgctgcacgtgccggggctccaccagtacatcaccggc

SEQ ID NO: 2814 - DNA, 564 bp, Streptomyces avermitilis
  CDS (1)..(564)
atgagtgccgagacttcggtccagagcgccgggagcttcacccggctgcgtctgcgattccgtgactggcggggcagtcggccgttctgggcgggccttttcaccatgctcggcggggtgccgatcgcctatttcccgtacgccaccctcaagctgggcacgatgtcgatcgcgatggcgaccacggcgggtgcgggctccctcatcatcggcgtcctgctgttcacgctgggcctgaccatgtggttccagcaggccacgcgcatcttcgccggcgtcgccgcgatcgtcctcgctctggtgtccctcgtggtctccaacatcggtggcttcatcctgggcttcctgttcgcgctgatcggcggcgctctgtccgcttcctgggcgccgggcaagccggcagcggacgccgggcggcgtgccgcgagccaggaccccgcgggcgacggcggggcgggaacggctccggagaacgccgccggtgggcccggtgagccacaccctttgccggaccccgtgcacggcgccggggccgaggactccaacggggggtaccgtgtcggc

SEQ ID NO: 2815 - DNA, 348 bp, Streptomyces avermitilis
  CDS (1)..(348)
atgaccacagcgaagcgcttccatctggtcccgccacgcacctgggactccatatttcctccttctcggacgtacatctcctggccctggctgcctcctgacggcggctcaaccgggcagggatgggagaagtgctacgtcctcgggaaggagagcgcaggtactcggaggcacgtactgcgcccgaatcaccggcgatcacccccgagcgacaaccactggtcgcgcctgacacacatcacgcacaacctgccggacaggctccaccggacggcggagacccccctgtccaggagccggcgccactggccgccgtctcctgctcggtggggacccaggaaaacccgt

SEQ ID NO: 2816 - DNA, 642 bp, Streptomyces avermitilis
  CDS (1)..(642)
atggagtcccaggtgcgtggcgggaccagatggaagcgcttcgctgtggtcatggtgcccagcgtcgcagcggctgcttgcgttggtgtcgggcttgcgcagggtgcgctggccgcgtcgttcagcgtttccggccaggagttcaaggtcagtgccgatcatctgcacggtgatggcttcgcccagtacggcggtatcgacagtggctacacgtcgaccgacggaaagaccaagacggtccgtccggtcgcgatttcgtcgttcgacacggccgagatcacgaagatgtgccagtcggtcaagacggagatccccctcatagggaagacgatctacctccgtctggacgcggggccggacgacaagcacaaggtcgaggccgagaagctctacatcgatgtcgcccagcttgacgccgacgcgacgttcaagaacatcgacatcggtgtggcggtcaaggacaagaccaggggtcctgccgtgaagagcggcgaaaacgcgctgccgggcggcttcgcccagcaggcggagtccgccgacctctacggcgtcgagcagacggcgtgggcgaccaccgccggcaccttcaagctcagcggcctgaagatgcgtctcggtaccgactccaagatggagtgcttc

SEQ ID NO: 2817 - DNA, 984 bp, Streptomyces avermitilis
  CDS (1)..(984)
atgcagccacggaacatgtccatgagcggagtcgtcgacctcgccgcggtgaaggcggcccaggaggccaaggcgaaggcggagcaggcgcgcgccgaagcggccaggcagggcggcgggggtacagccgtctctgctgtgcctccatcgagcctcgtcatcgacgtagacgaggcgggttttgagcgcgatgtcctgcagcggtccaccgaggtcccggtcgtcatcgacttctgggccgagtggtgcgagccctgtaagcagttgagcccggtcctggagcggctggccgtcgagtacaacggacggttcgtcctcgccaagatcgacgtcgacgcgaaccagatgctgatgcagcagttcggcgtccaggggattccggccgtgttcgcggtcgtcgccgggcaggcgctgcccctcttccagggtgcggcgggcgagcagcagatccgcggcacactcgaccagctcgtcgaggtcgcggagcagcgcttcgggctcaccgggctgaccgtcgccaccgacgccgagccgggtgccgcccaggaggccccgccgattccggccggcccctacgacgcgctgctcgaagccgccgtacaggccctggacgcgggcgacttcggcggcgcggtgcaggcgtacaagaacgtcctgagcgacgatccgggcaacacggaggccaggctgggcctcgcccaggccgagttgttgcagcgggtgcaggacgcggacccgcagcgggtccgcgtggaggccgccgagaagcccggcgatgcgcaggcgcagatcgcggccgccgacctggacctggtgggcgggcatgtcgacgacgcgttcgggcggctgatccagacggtgcagcgcaccgcgggcgacgaccgggacgccgtacggctgcggcttcttgagctcttcgaggtcgtcggcgccgatgatccccgggtgacggcggcccgccgggcgctggcccgggcgttgttc

SEQ ID NO: 2818 - DNA, 633 bp, Streptomyces avermitilis
  CDS (1)..(633)
atgcagtgccgcacctccgccccccgtacggggcgtccacgcagcgccgccgcggacgccgcgatcctggcggcgacgcgggaggcgctggtcgaactcggctggtcgaagctcaccctcggagacgtggcgacccgcgccggggttgcaaagacgacgctctatcgccgctgggcgggcaagaacgagctcgtggtggacgccgtggccgaactcttcgacgagctggaactgcccgatctgggcagcctggccgcggacatcgagggagtcgtccttcagttcgcggcgatcctggcccgcccggaggcgcggagcgggctgatggcggccgtcgccgagtcgacgcgcgacgacgccctgcgcgagcggatccgcgcctcgatcgtcgaccgccagaaacggctcgtcctggccggccggtcccgcgcccaggcccgcggggagctgccgcccgaggaggacgcacaggaggcggcccgcaccgtggacctgatcttcgacatggtggcgggtgcggtggtccaccgcaccctggtgagcgcggagccggtggacgcggcctgggcccagtccttcacccggatcctgctgctggggctcgccggggcgtcagccggcccgcacggcgcc

SEQ ID NO: 2819 - DNA, 1698 bp, Streptomyces avermitilis
  CDS (1)..(1698)
atggacgctgacgccatcgaggaaggccgccgacgctggcaggcccgctacgacgcctcacgcaagcgcgaggccgatttcaccacgctctccggcgatcccgtggagccggcgtacgggccccggcccggggacgcgtacgagggtttcgagcggatcggctggccgggtgagtaccccttcacgcgcggtctgtatccgaccggctaccggggccggacctggaccatccggcagttcgccgggttcggcaacgccgagcagaccaacgagcgctacaagaagatcctcgccaacggcggcggtgggctgtccgtggccttcgacatgccgacgctcatggggcgcgactccgacgaccgccgcgcgctcggcgaggtcgggcactgcggggtcgcgatcgactcggcggccgacatggaggtcctgttcaaggacatcccgctgggtgacgtgacgacgtcgatgacgatcagcgggcccgccgtgcccgtcttctgcatgtacctggtcgcggccgagcggcagggcgtcgacccctccgtcctcaacggcaccctccagaccgacatcttcaaggagtacatcgcgcagaaggagtggctcttccagcccgagccccatctgcggctcatcggcgacctgatggagcactgcgcctcgaagatccccgcgtacaagccgctgtccgtctccgggtaccacatccgggaggccggtgccacggccgcccaggagctggcgtacaccctcgccgacggtttcggatacgtggagctggggctgagccgcggcctggacgtggacgtgttcgcgcccgggctctccttcttcttcgacgcgcacgtcgacttcttcgaggagatcgccaagttccgtgcggcgcggcgcatctgggcgcgctggctgcgggacgtgtacggggcgaagtcggagaaggcgcagtggctgcgcttccacacccagaccgcgggcgtctcgctcaccgcgcagcagccgtacaacaacgtcgtacggacggccgtggaggccctcgccgcggtgctcggcgggacgaactcgctgcacaccaacgccctcgacgagaccctcgccctgccgtccgagcaggcggccgagatcgccctgcgcacccagcaggtgctgatggaggagacgggcgtcgccaacgtggccgatccgctgggcggttcctggtacgtggagcagctgaccgaccggatcgaggccgacgccgagaagatcttcgaacagatcagggagcgcgggctgcgggcccacccggacgggcggcacccgatcgggcccatcacctccggcatcctgcgcggcatcgaggacggctggttcaccggggagatcgccgagtcggccttccagtaccagcaggcgctggagaagggcgacaagcgggtcgtcggcgtcaacgtccaccacgggtccgtgacgggcgacctggagatcctgcgcgtcagccacgaggtggagcgcgagcaggtgcgggtgctgggcgagcggaagtcggggcgcgacgacacggccgtaaccgcggccctggacgcgatgctcgccgccgcgcgcgacgggtcgaacatgatcgccccgatgctggacgcggtccgcgcggaggccacgctgggcgagatctgcgatgtcctccgggaggagtggggggtctacacggagcccgccggtttc

SEQ ID NO: 2820 - DNA, 336 bp, Streptomyces avermitilis
  CDS (1)..(336)
atgaaaaagagcgtgctgacccgctaccgcgtcctggcctacgtcaccggcgtgctgctggtcctgctgtgtctcagcatgatcgccaagtacggcttcgacgtcgacggcgccgccgacttcacccgggtcgtggccatcgcccacggatggctctacgtcgtctacctcgttttcgccttcgacctgggcgccaaggcgaagtggccggtcgccaagcagctgtgggtgctgctggcgggcacgatcccgacggccgcgttcttcgtggagcgcaggatctcccgcgagctggagccgagggtcgcggacgacgctcccgcggtcgcgaaggcc

SEQ ID NO: 2821 - DNA, 432 bp, Streptomyces avermitilis
  CDS (1)..(432)
gtgccgtccatggccgcgatcacctcgatcatgcgcgcgcaccagattctgctggcggaggtcgacgcggtcgtcaagccgtacgggctgaccttcgcgcggtacgaggcgctggtgctgctcaccttctccaaggcgggcgagctgccgatgtccaagatcggcgagcggttgatggtgcacccgacgtccgtcaccaacaccgtggaccggctggtgacgtccgggctcgtcgacaagcgccccaacccgaacgacgggcgcggaaccctcgcctcgatcaccgacaagggccgcgaggtctgcgacgcggcgacccgcgacctgatggcgatggacttcgggctcggtgcctacgacggggaggagtgcgcggagatcttcgcgatgctgcgcccgctgcgcatcgccgcgcacgacttcgacgaggag

SEQ ID NO: 2822 - DNA, 1587 bp, Streptomyces avermitilis
  CDS (1)..(1587)
gtgggtctgtccgcctcgctgttcctcggccggctcggcatcccgcacatgctggtcgagaaacacgcgggcacctcgaagcacccgcgtgggcgcgggaacaacgtgcgcacgatggagctgttccgggtggccggggccgaacaagcgatccgcaaggccgcgtcgaccctggcggacaaccacggcatcctgcagacctcgtccctgaccgacgacgagggcgagtggctgttcaaggagatcgacccgggtggcggcctggcccgcttcagcccgagcggatggtgtctgtgcagtcagaacgacctggagccggtgctgctgaagtccgcccgcggcctcgggggcgacatccggttctccaccgagatgctctccttcgaccaggacgcggagggcgtcaccgcgctcatgaagaaccgggacaccggcgcgcacaccacggtgcgggcggagtacctcatcgcggccgacgggccgcgcagcccggtccgcgagcgcctgggcatccgccagacgggccccggagacctgttccacaacgtgagcatcaccttcaactcccgcgcactcgcggacgcggtgggcgaccggcgcttcatctgctgctacctgacgaacccggaggcggacggcgcgctcctgcccgtggacaacgtggagaagtgggtgttccacgctccctggcaccccgagcagggcgagacgctggaggacttcaccgacgagcggtgcgtctcccacatccgccgggccgtcggtgatctcgacatggacgtcgagatcaccggcagggcgccctggcacgcggcggagcgggtcgccgagcggtacgcgtcggaacgggtcttcctcgccggggactccgcccacgagatgtcgccgaccggggcgttcggctccaacaccggtatccaggacgcacacaacctcgcctggaagctcgccgccgtactgaacgggtgggccgggcccgggctgctccagtcctacgaggccgagcgtctcccagtggcgcaggcgacgagcgcgcgggcctcggcccgttccgcggaacacagccatccgggctacgcccccgctcccggcgcgggcggcggtggcggcggacgtcagggcggtgtcctcaaggtggccctgggctaccgctatccgcgtggcgccgtcatcggcgccgacccggcgggcccggtcgtgcccgagcagatggccatggccggcgaacccggcagccgcgccccgcacatgtggctcctgcgctccggcgcccgcacctccacgctcgatctgtacgagcgctcgttcgtcctgctcagcggggctgccgaggacgcctggcaccgggcggcgaccagcgttgccgagcgcctcgccgtaagcctcgactcgtaccgcatcggcaaggacccgcacgccgagctcgtccccgagaacggcacggactgggccgaactccacggcacgacgccgcggggcgcggtgctggtgcggcccgacgggtatgtggcgtggcggtccgagggcccgctggccgaaccggaggcgacgctgtacgagatcatggcctccctgctggacctggcc

SEQ ID NO: 2823 - DNA, 1122 bp, Streptomyces avermitilis
  CDS (1)..(1122)
atgacaacttcggaacgtgtatcgcagtccgcgttcgacggctcccggctgcgggtcgtcctgctgctggacctccatgacggcgcccagaagcagttcctggaggcctacgaacaactgcgcaaccaagtggcctccgtgccgggccacatcagcgaccagctgtgccagtcgatcgagaatccctcgcagtggctcatcaccagcgagtgggagagcgccccgcccttcctggcgtgggtgaacagcgaggaacacgtcgagacggtccagccgctgcacagctgcgtccgggacacgcggtccctgcgcttcagcgttctgcgcgagacggggaacatctccgcgccgctcccccagtcggagaagggccgcctccaggcgacggcacgggtgggcgacggcgtcgtgcgccacgccctcaccttcaccgtgaagccgggcagcgagccgatggtcgccaagatcctcgccggatactcctcgccgcaggcgcaggtcgacgagaacacccgactgcgccgcacctcgctcttcatgcacggcaaccgggtggtacgcgccatcgaggtggaaggcgacctgatggccgccctgcgccatgtgtcccggcagcccgaggtcatggcggtcgaggaggccatcaacccctatctggagcaggaccgggacctcagcgatccgggatcggcccgggtcttcttcacccgggcggcgctgcccgcggtgcaccatgtgtcggtcggcaccggcgagccgtcggacgtggagcggcacgcgctgttctacccggccaagagcgggtccggcatggccctggcccggctgctcgcccgcgaggacgaggcggcggccgacgaccccgccaaccccatccactgcagcaccatcttccagcgcgacgacatcgtggtccgtctggtcgatgtgcggggcagcatcgaggacgaccccgtcctggccctcggtctcaagggcgaccgcaacggcgcggtcctgtcccgcctgctcgacgccgacgcgctcggcgtcgacggtgcgccgacgaccgagaaggagatctcgcgcttcctcgagcggtccgacatgcaactgatcaccgaccgcagctcatcagcctcc

SEQ ID NO: 2824 - DNA, 441 bp, Streptomyces avermitilis
  CDS (1)..(441)
atgaccacgccccgcccacgcatcgtggacctcagcgagaccgagcccaacaccaggcgcggaggtgatctgcgcgccatgctcacgcccaccgcggtgggcgccaagagcggcttcatgggcctcgccatcgtgcagcccggcgaacgcatcggcgagcactaccacccgtactccgaggagttcgtctacgtcgtgagcggtcggctcgaagtcgacctggacggcgagacgcacccgatccagcccgaccagggcctgctgattcccatcaacatgcggcaccgcttccgcaacgtgggcgacgtggaggcccgcatggtcttccacctgggcccgctggcgccgcgccccaagctcggccacgtcgacaccgaggagaccgacggcctggagggagccggacaggcgatgacaccacagcgaaccgaggccgtgtca

SEQ ID NO: 2825 - DNA, 1263 bp, Streptomyces avermitilis
  CDS (1)..(1263)
atgacccggcgcgtggcggtcaccggcgtcggcatcgtcgccccgggcggtgtgggcgtcccggcgttctgggacctcctggcgaacggccgcaccgcgacgaggggcatcacgctcttcaacccggaaggtctgcgttcgcgtatcgcggccgagtgcgacttcgacccggccgcccacggaatcgacgcggcggccgctgagcgcgccgaccgctatgtccagttcgccatggtcgccgccagggaggcggtgggcgacgcgggactcggcccggagaaggaagacccctggcgcatcggggtgtccctgggcaccgccgtcggtggcaccacgcgcctcgaacacgactatgtcgcggtgagcgagaccggccggcggtgggatgtcgaccaccgcctggccgacccccatctgcaccgcgcgttctcacccagcaccctcgcctccgaggtggccgaacagttcggtgcccacggcccggtgcagaccgtctccacgggctgcacctccggcctcgacgcgatcggctacgccttccacgccgtacaggagggacgggtcgacgtgtgcatagcgggcgcttcggactcgccgatctcacccatcacgatggcgtgcttcgacgccatcaaggcgacctccccgaacaacgacgaccccgagcacgcgtccaagccgttcgacaagcaccgcaacgggttcgtcatgggcgagggcggagccgtcctgatcctggaggagctcgaacacgcgcgggcccgtggcgcacgtgtgtactgcgagatcggcggctatgccaccttcggcaacgcctaccacatgaccggcctcacccgtgagggtctggagatggcgcgtgcgatcgacggcgccctcgcgcacgcccggttggacggctccgacatcgactacgtcaacgcccacggctccggcacccagcagaacgaccggcacgagacagccgccgtgaaacggtccctgggcgaccacgcgtaccggacgccgatgagttcgatcaagtcgatggtgggccactccctgggcgccatcggtgcgatcgaggtcctggcctgcgtcctggctctcgtccatcaggtcgtgccgcccacggcgaactacacgaccccggaccccgagtgcgacctcgactacgtgccgcgcaccgcacggcaggtcaaactccgcaacgtgttgtccgtcggcagtggcttcggcggcttccagtccgcggtggtgctgacccgcccagatgggaggacc

SEQ ID NO: 2826 - DNA, 1248 bp, Streptomyces avermitilis
  CDS (1)..(1248)
atgaagccgcagcaaaaacggcgtgccgccatcaccggcataggcgtcgtcgcccccaacggactgagcaccgagaccttctggaagtccaccgagaagggcctctgtgtactggaccgggtgacccgcgaggggtgcgaccatctgcccctgcggatcgccggcgaggtccgcggattcgacccggtggcgctgatcgaggagcggttcctcgtccagaccgaccggttcacccacttcgcgatggccgccgccgacctcgccctggaggacgcccggctcggccgcacctacaccggcgacgagccgttcgggatcggcgtggtcaccgccgcggggtccggcggcggcgagttcgggcagcgcgaactgcagcggctgtggggacaggggcccagattcgtgggcccgtaccagtccatcgcctggttctacgcggccagcaccggccagatctccatcaggggcggcttcaagggaccgtgcggcgtcgtggccagcgacgaggccggcggtctggacgccctggcgcacgccgcccgagccgtccggcgcggcaccgacgtggtcgtggccggtgccgccgaggctccgctggctccgtattcgatggtctgccagctcggctacgaggacctcagcaccagcgacgacccggcctgcgcctaccggcccttcaccggcgctgcctgcggattcgtgcccgccgaggggggcgccatgctcgtcgtcgaggaggagacggtcgcacggggccgggaggccgcgatccgggccttcgtcgccgggcacggtgcgacgttcaccggcgcgtcctgctgggcgcagtcccgggagggtctggcgcacgcgatacgcgacgcgctgaacgaggcccggtgcgcgcccgaggagatcgacgtcgtgttcgcggacgcgttcggcgtaccggaggccgaccgtgccgaggcgctggcgatcgccgacgtcctgggcgcacagggccggcgcgtgccggtgacggcacccaagaccggcatcggccgggcgtactgcggagcgccggtgctggacgtggcggcggcggtgctcgccatggaacacggtctcgtaccgcccaccccgaacgtcttcgacccctgctacgacctcgacctggtgaccgggagcgctcgccccgccgagctgcgcacggcgctggtcctcagccggggactcatgggctcgaacgcagcgctggtgctgcggcacggcgctcatgccctctca

SEQ ID NO: 2827 - DNA, 282 bp, Streptomyces avermitilis
  CDS (1)..(282)
atgccctctcatgagaaggagaaagagatggacaaccaactgaccgtccaggagctggccgctctgatgaagaaggcggccggcgtcacggtggacgtgaaggagctggaggaccggctcgactccggcttcgccgagttcgggctcgactcgctcggcctgctgggcatcgtcggggagctggagaacggccacggcgcggtgcttccccccgacgcggagcgctgccggaacccgcgcgagttcctcgacctcgtcaacaacaacatcgtcgctggagcc

SEQ ID NO: 2828 - DNA, 477 bp, Streptomyces avermitilis
  CDS (1)..(477)
gtgtctggacacaccgagaacgacatcatcatcgccgcccccctggacctcgtctgggacatgaccaacgacatcgagagctggccgcagctgttcagcgagtacgcgtccgtcgatgtcctgagccgggagaacggcacgaccaccttccgcctcaccatgcacccggacgagaacggcaaggtctggagctgggtctcggaacggacgcccgaccgggagaagctgacggtcacggcccgccgcgtcgagaccggccccttcgagtacatgaacatcaggtgggtgtactcgcagacccccgacggcaccaggatgcactggacgcaggacttcgcgatgaagcccgaagctcccgtcgacgacgcctggatgaccgacaacatcaaccgcaactcggtcgtccagatggaactcatccgggacaaggtcgaacagcacgcccgcgagcgcaggaccgcttccgtcaccaccgac

SEQ ID NO: 2829 - DNA, 324 bp, Streptomyces avermitilis
  CDS (1)..(324)
atgcaccaagccctgatcgtggcccggatggcgccgggttcggccccggacatcgcgaaggtgttcgcggagtccgacagcggcgaactgccgcacctcgtgggcgtcacccgccgcaccctgttccagttcaacgacgtgtacatgcacctggtggaggcggaccggccgcccggccccgcgatcgccgaggtggccggccacccggccttccgggacatcagcgacaggctctccacctacgtgagcgcgtacgacccgacgacgtggcgcagcccgaaggacgcgatggcccaggagttctaccgctgggaacgcgagagc

SEQ ID NO: 2830 - DNA, 993 bp, Streptomyces avermitilis
  CDS (1)..(993)
atgcagctgagggagctcgtcttcggggcggcgtgcgccgcggccgtccgggcggcggccaagctcggcgtcgccgacgcgctcggcgagaagcccgccaccgcggaagaactcgcggccgtgctgggcaccgagccgcggcccctgctgaggctgctccgggccctgtcctgctacggcatcttcgcgcagaacgacgacggacggttcgtccacaccagcatgtcccggctgctgcgcgaagacgatccgcacagccttcggtacatctccctctggtgcaccgaaccctggacctgggacgcctggccgcggctcgacgaggcggtgcggtcgggcggcagcgtcttccacgagctgtacggcaaggggttcttcgactacctgcacgaggacgcgcacgactccgcccaggtcttcaaccaggccatgaccacgtccagcgagcagtcggcgcgggacgtcgcggagctcctcgacctgaccggcgtgtcgacggtcgccgacatcggcggcggccagggacatgtgctcgccagcctgctggagaagcacccggacatccggggaaccctgctcgacctgccccgcgtggtggagaaggcggacccccggctgcgtgacggcggcccgctcgccgcgcgggcccggatcgtcggcgcggactgccgcgaggagatcccggtcgaggccgacctgtacatcatcaagaacatcctggaatgggacgacgacagcacccgcagaaccctgcggaacgtgatgacgaaggcccgccccggagccagggtcgtcatcatcgagaacctcgtcgacgacaccccgtcgatgaagttcaccacgtccatggacctgatgctgctcctcaacgtcggaggagccaagcacaccaaggaaagcctggtcacccgcatgacggaggccggtctgaccgtcggtgagatccggccggtcaacgcgtacctgcacgcgttcgaatgcaccgtacctgcc

SEQ ID NO: 2831 - DNA, 1056 bp, Streptomyces avermitilis
  CDS (1)..(1056)
atgaacaaaaaagatttcgcatacctcggttgcgccgcaatcgtggtggcgtcgggactgagctgtatcccggcggccaatgccgcgactgctcatgtcgtgcatccgggggaatcgatccagaaagcggtcgatgccgcgcagtcgggcgacaccattgtcatctcgcccggcacctaccatcagagcgtcctcgtcacgaagtccggtctgaccatccgcggggcgggggagcggaccgtgctgatgccggcggcgaccagggccgccgacaagtgcgcggccgccggcaacgggatctgcgtcgagggcacgtccgcccaccccgtcacgcgtaccagcgtccgctcgctcacgctgaccggctacaagaagaacggcctgtgggcgtccaacaccgacaagctgaccgtgcgggacgtggccgcagacaagaacaagaactggggcatcgccatcgagcggtccgtccggagcgtgctcgaggaaaacgtcgcccggggaaacgccgagtcgggcgtgttcctctccaacacggtggacaccgaggccggcgccacggacacgcggggcaccgtcgtccgccacaacaggctggagggcaaccggatcggactcaccgtcaggcgtctgcggaatgtcaccgtcgaggagaacgaactcagcgcgaactgcagcgggctgttcgccgtaggcgacgagggcaagccgcacgccggagccctggccattcggggcaatggcgtccacgagaacaacaaatactgcgcgaagacggctcggctgccctacatccaggggtccggaattgttctcaccggtaccgaggacacggtcgtggagtacaacgacatccgagacaacgtgggcaagtccgtgttctccggcggagtggtgctgtacaagagcttcgtcggcacgccgaacaagcgcaatgtcatccgggacaacgtgctgtcgggtaattcgacggccgacctggccaaccgggacaccggcaccggcaacaagttcgagcacaactcgtgtcagcgctccgaacccgcgggcatgtgc

SEQ ID NO: 2832 - DNA, 630 bp, Streptomyces avermitilis
  CDS (1)..(630)
gtgagcgagacgacgaagacgaagctcctcgaaggagcgctgcgggcgctctccgagcaggggatcgccaagacgtccgcccgtgcgatcgccgcggccgccggagtcaaccaggcgctcgtcttctaccacttcggatcggtggacgaactgctggccgcggcctgccggcacggcgcagagcaggtggtggcgcgctaccgggcacggctggacgaggtcgccaccctggccgagctcctcgcgctgggccgcgagctgcacgagcaggagaaggccgagggccatgtggcgatgctcggccagctgctcgccggcgcccagacgcagccacgcctcgcacccgcgacggcggccggcctcgacctctggatcgcggagatcgagaaggtgctgacccgcgtcctgaccccgaccccgctgggcgagttcgccgacccggcggggctggcgcgggcggtggcggcgtcgttcgtggggatcgagctgtacgagggggtggacgcggaaggggccggggccgccctcgcggcactggaccaattggcactcctgctgacggcgttggaggacctgggcccggtcgcccagcgcgcggtccgccacaccctgcgccgggccacccgcggc

SEQ ID NO: 2833 - DNA, 678 bp, Streptomyces avermitilis
  CDS (1)..(678)
atgacgtcgatcttccgtacggtgatgggcgcggacttcgaccgcctccaccccgaactgcggcgccgcttctcggtgggcctcacgagcggcgaggcctgcaccgggcggggcgtcatggagcgcatctggcacggcgggcgcttcgtgaagccgttcctggccctcggcggcactcgcaacatcctggtcccgcgcgcgggccggcggatcccgttcaccatcgagaacgtgccgtacaaggacaccttcggccgtgagacggtgacgttcgtgcgcaccttcgacctccccggcggcccccgccgcttcgacgcccagatggtgctgagccccaagggcgaccgcgtcctcgactacctcggcacgcaccagcacctcgccagcgacctgcacttccgcgccgagcccgacggttcgctgctgatccgctcgggcgaacaccgcttccgcgaggggccggtcgacgtccgggtccccgaactcatcggcggcgaggctcaggtacgcgagtccttcgacgaccggacgggccgcttccgtatccaggtccgggtcgtgaaccggtacgtcggcccgctcttcggctacgaggggtcgttcgaggccgactacacggacatccgcacctgtggcgtgcgccccggcctgcgtcccgtccgcgaggagcggcgggcg

SEQ ID NO: 2834 - DNA, 750 bp, Streptomyces avermitilis
  CDS (1)..(750)
atggggctctacatagagacacgcatacgacgcgacctggacgacctctggacccacacccaggaccccgcgcgccaccagcgctgggacctgcggttcaccgagatcgactacctcgcgcgcggggagggcgagccgcagcgcttccggtacgcgacccgcgtactgccgttcctgacgatcgccggaaccggcgtgtccgccggtgagaaggagcgcccggacggcacccgcacctccgccctgcgcttcgcctccccgcaccccctctccctgctcgccgagggaagcggctactggcgctacgttcccgacggggacgggatccgcttcctcacgggctacgactaccgcccgcgatggggcctggtcggagtcgccaccgaccgcctgctgttccgccccctgatgggctgggccacggcctggtccttcgaccgcctgcgcctctggctggagcgcggcatcacaccggagcgggcgctgcgccgctgggccgccgaactggccctgcgtgtcctggtgatcgccgcgggctgcacgggcttcggcttcggccggctcctcctgctcaccggccccttcgcgccgatgctctgctacgcgatgccgctgctggcgagcgtggccgtagcgctggccctgttcctgccgcccgcgcccggcaccccggccgcccgccgctgtctgcgcaccccgcccacccgcacgcgcgcaccccgccttctcgccaccctggagcggcagtca

SEQ ID NO: 2835 - DNA, 291 bp, Streptomyces avermitilis
  CDS (1)..(291)
atgatcgtcgctttctccgtcacccccctcggcgtcggcgtcgacgtgggggagtacgtcgcggacgccgtccgggtcgtgcgcgagtcgggcctgccccaccgcaccgacgcgatgttcacgtcggtcgagggcgagtgggacgaggtcatggccgtcgtcaagcgcgccgtcgccgtggtggaggagcgagcgccgcgtgtctccctcgtcctgaaggcggacatccgcccgggcgtgtcggacggcctcacctccaaggtggaaacggtggagcgccacctgtccgca

SEQ ID NO: 2836 - DNA, 342 bp, Streptomyces avermitilis
  CDS (1)..(342)
gtggacgtcaagaccgcagccgcactccaccgactcaggctcatctcgctgcccgaggccatctcgttcccgatcctgctggtctgctcggtgctgaagcggacgaccgagttcgacgctgtcttcccgatgggcctgatccacggcctgctgttcaccttctacgtgatcttctgggcggacgcctggaaccgcgccaagtggtccaagaagaaggccgccggctacttcctgctggcgatcccgcccttcggcggccttttcgccgagcgcaagctcaagcgcgaggccgaggacgcggtcatcgcctcccgcgcccgccgggaagggacggtgaacgca

SEQ ID NO: 2837 - DNA, 630 bp, Streptomyces avermitilis
  CDS (1)..(630)
atgttccgacttcaaggcagcaaggtgctggccgtcgacatgaccggggacgccgtgaaggcgaagaacgggtcgatggtcgcctacgacggccagatggcgttcaagaaactgagcgggggcggtgaggggatccgggggatggtgacccggcggctcaccggcgagcagatgacattgatggaggtgaaggggcaggggacctgctggttcgcggaccgggcttccgagatcaacctggtgagccttcagggggacaagctgtacgtcgagtcgagcaatctgctcgcgaccgacgccgggctgcggacgggtacgtccttcaccggcctgcgcggcgcgtcgcagggcaacggcctgttcacgacgaccgtcgaggggcacggccaggcggcgatcatgtcggacggccccgcggtggtgctgcgcgtgagctcgcagtaccccctgacggtcgaccccggggcgtacatcgcgcaccaggggaacgtgcggcagtccttccagtccggtgtgacgttccgcacgttcatgggtgagggcggcggcgaggccttccagatccgcttcgagggtgacgggctggtctacgtacagcccagcgagcgcaacacgatcgcgggggatgtg

SEQ ID NO: 2838 - DNA, 657 bp, Streptomyces avermitilis
  CDS (1)..(657)
atgtgtgacatgcccttccgcgagatcaactccaagatgatcgaggccaccgtcgccccgggccagcggctgttcagtcagcgcggcgcgatgctcgcctacaagggcgaggtgtccttcacgcccaacgtccagggcggccagggcggtgtgatgtcgatgctcggccgccgcatggcgggcgaggccactccgctgatgacggtggagggcagcggcacggtgttcttcgggcacggcggccatcacatcgaggtgatcaacctcacgggcgacaccttgtacgtcgaggcggaccggctgctcgccttcgacggcacccttcagcagggcacgatgttcatgggctcgcagggcggggtcatgggcatggtccggggccaggtgacgggccaggggctgttcacgaccacgctcaagggtcatggcgcggtcgccgtgatggcccacggcggggtcatcgaggtgccgatcaccccgcagcgcccggtccatgtcgacccccaggcgtacgtggcgcaccacggcgacgtacgcaacaagctgtccacggcgctcggctggcgcgacatggtgggccgcggctcgggcgaggcgttccagctggagctgagcggcagtggtgcggtgtacgtccaggcgtcggaggagaagctg

SEQ ID NO: 2839 - DNA, 795 bp, Streptomyces avermitilis
  CDS (1)..(795)
gtgagcgcgtacggggccgcgggcccggtgatccacgacccgatgacgctgccggtcgacgacaacgtcaacaagtacaccttctgcgtggagctcaaggggagccagtggttcctgcagaagggcaagatgatcgcccactacggctcgatcgatttcaacggcatcggacacggccggctcgaccggctcgtccgtacgtcgttccattcgccactgcacgcgagcgactgggtcgtggcggagggctccggcaagatgctgctcgccgaccgggccttcgatgtgaattcgtacgacctggacgacggcaatctgaccattcgctccggcaacctgctcgcttttcagccaagtctcgcgctcaagcagtcgatcgtgccgggctttctgacgctgatcggaaccggcaagttcgtggccgcgtccaacggtccggtggtgttcatggaaccgccgatccgggtggacccgcaggcgctggtcggctgggccgactgcccctcgccgtgccatcactacgaccacgggtacatgacgggcgtcatgggcggtctacgtgcgatgacaggcctgggcggggcctccggggaggagcaccagttcgagttcgtgggggccggcaccgtgctgctccagtccacggagacactcatggccgagcaggccatgggggcggtcccgcaggagcccggagtaccgggcggtggcggggtgcctggtcaccagggacagcaagccggcgcaccgcgtcttcccggacagctgggggacctccagcgtcgcttcgggctg

SEQ ID NO: 2840 - DNA, 474 bp, Streptomyces avermitilis
  CDS (1)..(474)
atggagaccgagacggccacgcgctggctgaccgatgcggagcagtgcgcctggcgcacccacctggaggtcaacaggctgttgacgtaccagctcgagagggacctgcagccgttcagcctgacaatgaacgactacgagatcctggtcaatctctccgagtcggagggcgtgcggatgcgaatgagcgacctcgccgccgccaccctccagtccaagagccgcctctcgcaccagatcacccgtatggagaacgcggacctggtacgccgcgaaaactgcgagtccgaccggcggggactgttcgcggtcctcaccgagcacggcatggagaccatgcggaaggtggcgccgcatcatgtggcgtccgtgcggaggcacttcatcgacctcgtctcgccggaggcgctggaagagctccacaaaaccctgcggcccgtcgccgaacacctccgcgcacagcggggcaagccg

SEQ ID NO: 2841 - DNA, 996 bp, Streptomyces avermitilis
  CDS (1)..(996)
atgtctgcgtcatctgcgcggccctcgtacgccgcgctcctccgcatcccccacgcccgccgcaccttcacggccgccctcgtcggccggctgtcgtacggcgtcgtctccctggccatgacgctcacggtggcccgggggaccgggtcgtacgccgtggccggcacggtcatggcgctgttcggcgcgatgagcgtggtcctgtcgcccgccagggcggccctgatcgaccggtacggcccccgccgtgccctgatccccatggcctcgctctacgccggcctgctcgcggccttcgcggcggcggcctggctgccgggagcgccgtcggtggcactcggcgcgccggccgccgccgcgggcgcctgcacgccacctctaggccccacgatgcgtgccgtctggggcgaagtcgtcgaggacaaactgctgttgcagcgggcgtacagtctggacggcgtcgcggaggagatcctcttcgtctccgggccgctgctggtcggcgtggtcgtccggtgcgcgccgccggccgccggggtcgcgctgagcgccctgctggtgtgggccggaaccctcgcgttcgcgctgtcgcccgtcgtggcgggcgtacggccggccgcggcgaagccggcggcgcgctccgggggccggccccggggtgggcgcgcgctcgtgcagcccgtcgtcgtcgcgacgggcgtcggcctgtccctgggcgccgtcgacctcctcgtcatggccttcgcccagcagcaccgtcacggggacgacgtggtggcctgggtgctcgccgcgctgtccctgggcagcgcgctgggcggcctgctcaacggcgccgtcgactggcgtacgtccgcacgggtgcgcctgccgttgcaggcctgtggcctgggcctcgccctgctcgccgcggggctggctccggcctcggcaccctggccctggccgtggcctgcgccggcttcttcgtcgccccggccctcaccacgtcctacc

SEQ ID NO: 2842 - DNA, 954 bp, Streptomyces avermitilis
  CDS (1)..(954)
atgcaggacgtctcctcgctggtggcccaggccagggaaggtcggccgcgggccgtggcccggctgatctccctggtggagggggcgtccccgcagctccgggaggtcatggaggccctggcgccgctgacgggcaacgcctacgtggtgggcctgacggggtcgccgggcgtcggcaagtcgacgtccacgtccgcgctggtgacggcgtaccggaaggccgggaagcgggtcggggtgctggccgtcgacccgtcctccccgttctccgggggcgcgctgctcggggaccgggtccggatgtcggagcacgcgtcggacccgggtgtctacatccgctcgatggcgacgcgcggacacctgggcggtctcgcctgggcggctccgcaggcgatccgggtgctggacgcggcgggctgtgacgtgatcctggtggagacggtgggcgtcgggcagtcggaggtggagatcgcctcacaggcggacacgtcggtggtgctgctcgcccccgggatgggcgacggcatccaggcggcgaaggccggaatcctggagatcggtgacgtgtacgtcgtcaacaaggcggaccgggacggcgccgacgcgacggcacgtgagctgaaccacatgctgggactgggggagtcgcggggcccgggggactggcgcccgccgatcgtgaagacggtcgcggcgcgtggtgagggcatcgacgaggtggtcgaggcgctggagaagcaccgggcgtggatggaggagcacggggtcctcaccgagcgccgcctcgcccgtgcctcccaggagatcgagacgatcgcggtcacggctctgcgccggcgcatcggcgacctgcacggcgaccgccgcctcagcgcgctcgcggagcggatcgtggcgggggagctggacccctatcgggccgcggattcactggtggagggcgtgacggagggc

SEQ ID NO: 2843 - DNA, 1200 bp, Streptomyces avermitilis
  CDS (1)..(1200)
atgtctggaacgaacagcacgacctcggtgatcgtcgcgggtgcacgcaccccgatgggccgtttgctcggctcgctgaagtccttctccggagccgacctcggcggcttcgcgatcaagtccgccctcgaccgtgcggggatcggcggcgaccaggtgcagtacgtgatcatgggccaggtgctgcaggccggggcggggcagatcccggcacgccaggccgcggtcaaggcgggcattccgatgagcgtcccggcgctcacgatcaacaaggtgtgtctgtccgggctcgacgcgatcgcgctcgcggaccagctgatccgcgccggtgagttcgatgtcgtcgtcgccggtggtcaggagtccatgaccaacgccccgcatctgctgccgaagtcccgtgagggctacaagtacggcgcggtccagatgatcgacgccatggcgtacgacggtctgacggacgccttcgagaacatcgccatgggcgagtccacggagaagcacaacacgcggctcgggatcggccgcgcggaccaggacgccgtggccgccctgtcgcaccagcgggccgccgccgcgcagaagaacgggatcttcgaggccgagatcacgcccgtggagattccgcagcggcgcggtgagccggtggtcttcagccaggacgagggcatccgcggcgagacgacggccgagtcgctcggcaagctgcggcccgccttcaccaaggacggcacgatcacggccggttcctcctcgcagatctcggacggtgcggcggccgtggtcgtgatgagcaaggccaaggcgcaggagctcggcctggagtggatcgcggagatcggcgcccacgggaatgtggcgggaccggacaactctttgcagtcgcagccgtccaacgcgatccagcacgcgctgaagaaggagggtctcgcggtcgacgatcttgatctgatcgagatcaacgaagccttcgccgcggtcgcggtgcagtcgatgaaggacctcggggtgtccaccgaaaaggtgaacgtcaacgggggcgcgatcgccctgggacacccgatcggcatgtccggtgcccggctcgtgctgcacctggcgctggagctgaagcggcggggcggcggcgtgggcgcggcggcgctgtgcggtggcggcgggcagggtgacgcgctgatcgtgcgggtacccaaggtc

SEQ ID NO: 2844 - DNA, 489 bp, Streptomyces avermitilis
  CDS (1)..(489)
gtgatcgcgcgcacgttgcgtaaccacctcccggagcgctgcactgactccatgctgacgcgaatcgaccacatcgggatcgcctgtttcgacctcgacaggaccgtcgagttctaccgggccacatacggcttcgaggtgttccactccgaggtcaacgaagagcagggcgtgcgcgaggccatgctcaagatcaacaacacggacgacgggggcgcttcctacctccagctcctggaacccacccgcgaggactccgccgtcgggaagtggctggcgaagaacggagagggcgttcaccacattgctttcggtacggcggatgtggacgcggacgccgccgacatcagggaaaagggcgtacgcgtcctgtatgacgagccccggcggggctccatggggtcccggatcacgttcctgcatccaaaggattgccacggagtactgacagaactggtcacttcggcggctgttgagtcacctgagcac

SEQ ID NO: 2845 - DNA, 3774 bp, Streptomyces avermitilis
  CDS (1)..(3774)
atggatcggctcaagaccgagcgggaaaaggcgatccagcacgccgaggatctcggctaccaggtcgaggtactgcgcgccaagctgcacgaggcgcggcgcacgctcgcgtcccggcctgcttatgagagcgccgacctcggctatcaggccgagcagttgctccgtaacgcccagatccaggccgatcagctgcgcgccgacgccgagcgcgagctgagccaggcccgcgcgcagacgcagcggatccttcaggaacacgccgagcaggcggcccggctccaggcggagctgcacacggaggcggtcacccgccgccagcagctcgaccaggagctggccgagcgccggcagaccgtcgagtcgcacgtcaacgagaacgtggcgtgggccgagcagctgcgggcccgctccgagcagcaggcccgccggctcgtggaggagtcgcgggccgaggccgagcaggcgctggccgccgcccgcgccgaggccgagcggatcgccgccgaggcccggcagcggctcaacaccgacgccgagtcggcccgcgcggaggcggaggcgctgctgcgccgggcccgcacggacgccgagcggctgctgaacgccgcgtccacgcaggcccaggaggccacggaccacgccgagcagctgcgcagttccacggcgaccgagtcggacgccgcccgccggcaggcctccgagctgagccggaccgccgagcagcgcatgacggaggccgacgcggcgctgcgcgaggcgcgggccgaggccgacaaggtgctcaccgaggccaaggaagccgcggccaaggcgctggcgagcgcggagtcggccaacgagcagcgcacccgtaccgcgaaggagcaggtcgcccggctggtcagcgaggccaccaaggaggccgagaccaccaaggcctcggccgaggaagtggtcgcggacgccaaggccgaggcggagaagatcctcacggaggcggcggacaaggcccgcagcctgaccgccgaagagaccgcgtcccagctcaccaaggcggcccggacggccgaggacgtcctgaacaaggcgtccgaggaagccaagtcgaccaccaaggccgcgaccgaggaggccgagcgcatccgccgtgaggcggagaccgaggcggaccggctgcgcgccgaggcgcacgacatcgccgagcagctcaagggcacggcgaaggacgacaccaaggagtaccgcgccaagacggtcgagctccaggaggaggcgcgccggctgcgcggcgacgccgagcagctgcgcgccgacgcggtcgccgagggcgagcgcatccgctccgaggcccggcgtgaggccgtccagcagatcgaggaggcggccaagaccgccgaggagctgctggcgaaggcgaaggccgacgcggacgagctgcgtacggcggccacgaccgacagcgagaaggtccgcaccgaggccatcgagcgcgccacgacgctgcgccgccaggccgaagagaccctggagcgcacccggaacgaggcggagcggcaccgcgccgaggccgtcgagcagtccgaggcgatcaaggaggacgccgagcgggccgcccgtgagctgcgcgacgacagcgagcgcgccatagaggcccgccgggccgaggccgccgacgagctgacccggctgcacaccgaggccgagcagcggctcgcctcggccgagcaggcgctcagcgacgcccgcgcggaagccgagcgcatccgccgcgaggccgcggaggaggcggaccggctgcggaccgagtccgccgagcggattcgtacgctccaggcgcaggccgagaccgaggccgaccggctgcggacggaggccgcggcggacgcgtccacctcgcgggccgagggcgaggccatcgccgtacggctgcggtcggaggcggtggcggaggccgagcggctgaagtcggaggcgcaggacaccgccgaccgggtacgggcggaggcgcaggccgcggccgagcggctggcggccgagggcgcggagacgctggcggccgcccaggaggaggccacccggcgccgtcgcgaggccgaggaactcctcggctccgcgcgccaggaggccgaccaggagcgtcagcgggcccgcgagcagagcgaggaactcctcgccgtggcgcgcgcccgggtcgaggaggcacaggccgaggcggtccggctggtcgaggaggccgaccggcgcgcgacggagatggtcgcgaacgccgagcagaccgcgcagcaggtgcgggactcggtggccgggctgcacgaccaggcgcaggaggagatcgccgggctgcgcagtgccgccgagcacgcggcggaccgtacgcgcaccgaggcgcaggaggaggcgggccgggtccgcgccgacgcgtacgcggagcgggagcgggccaccgacgacgccaaccgcatccggcgggaggcggccgaggagacggacgccgccaaatccctcgcggagcgcacggtttcggaggcgatcgccgagtccgagcggctgcgttcggacgccgccgcgcacgcccagcgggtgcgcaccgaggcgtcggacgccatcgccaacgccgagcaggacgcttcccgtacccgcgcggaagcccgcgaggacgcgaaccgcatccgttcggacgcggccgaacaggcggacaccctcatcaccgaggtgacggcggaggcggagcggctcacggcggagaccaacgtcgaggccgagcgcgtacgggccgagtccgtggccaaggccgagaagctcatctcggacgcgaccggggacgcggagcggctgcgtgccgaggccgccgagacggtcggttccgcgcagcagcacgccgagcggatccgcagcgagtcccagcggctgaaggccgacgccgaggcggaggccgagcgggtgaccacggccgcgcgcgcggaggccgagcggacgctggacgaggcccgcaaggacgccaacaagcggcgctccgaagcggccgagcaggtcgacacgctcatcacggagacggccgccgaggcggacaagctgatctccgaggctcggcagaccgcgcagaagaccacggcggacgccgagggccaggccgacacgatggtgggtgtcgctcggaacgaggcggagcggctggtctcggaggcgacggtcgagggcaactcccgggtggagcgggcccgtacggacgcggacgagctgctcgtcggcgcccgccgggacgcgaccgcgatcagggagcgcgcggaggagctgcgcgaccgcatcacgagcgagatcgaggagctgcacgagcgggcgcggcgcgagtcggccgagacgatgaagtcggcgggcgagcggtgcgacgcgctggtgaaggccgccgagggccagctcgccgaggcggaggcgaaggcgaaggacctggtcgcggaggccaattccgaggcgagcaaggtacgcatcgccgccgtgaagaaggccgaggggctcctcaaggaggccgagcagaagaaggccagcctcatctcggaggccgagcagatcaaggtcgaggcgatccgtgaggcgcgggccgccgtcgaggagggcaagcgggagctggaggtcctggtgcgccggcgcgaggacatcaatgcggagatctcccgtgtccaggacgtcctggaagcgttggagtcttttgaggccccgtccggcggcaaggacggaggcgtcaaggcgggtgccgcagcgggcgcgactcgttcgggtggcaaggtgtcagaaggc

SEQ ID NO: 2846 - DNA, 936 bp, Streptomyces avermitilis
  CDS (1)..(936)
atgagcgacacttccccctacggcttcgagcttgtccggcgtgggtacgaccgcgctcaggtggacgaacgcatctcgaagctcgtctccgaccgtgacagcgctctggcccgtatcactgctctggaaaagcgcattgaggaactccacctcgaaacgcagaacgcccaggcccaggtcaccgacgccgagccgtcgtacgcgggtctcggcgcgcgcgtcgagaagatcctccgcctcgccgaggaggaggcgaaggacctgcgcgaggaggcccgtcgcgcttcggagcagcaccgtgagctcgccgagtcggcggcccagcaggtgcgcaacgacgcagaatcgttcgctgcggaccgcaagtccaaggcggaggacgagggcgtccggatcgtcgagaaggccaagagcgacgcctcccagctgcgccaggaggcgcagaaggacgcgcagtcgaagcgggaggaggcggacgccctcttcgaggagacccgcgccaaggccgcgcaggccgccgccgacttcgagacgaacctggccaagcgccgcgagcagtccgagcgcgacctggcctcgcgtcaggccaaggccgagaagcgtctcgcggagatcgagcaccgcgcggagcagctgcgcctggaggccgagaagctgcgtacggacgccgagcgccgcgcccgccagacggtggagacggctcagcgccaggccgaggacatcgtggccgacgcgaacgccaaggccgaccgcatccgctcggaatccgagcgcgagctggccgccctcaccaaccgccgcgactcgatcaacgcgcagctcacgaacgtccgcgagatgctcgcgacactcacgggcgcggcggtggccgcggccggcacgccgtcgaccgacgacgagccgatctcgcgcggggttccggcccagcagtcccgg

SEQ ID NO: 2847 - DNA, 948 bp, Streptomyces avermitilis
  CDS (1)..(948)
atgatcgagctggacgggctgaccaagcggtacggcgagaagttggcggtcgacgacctcaccttctccgtcgagccgggcatcgtgacgggcttcctcggccccaacggtgccgggaagtccaccaccatgcgcatgatgctcgggctcgaccgtcccaccgcgggtgacgtcctgatcgacgggcggcattacgaccgtctcaagaacccgctcaagtacatcggcgccctgctggacgccaaggcgatgcacggcgggcgcagcgccttcaaccacctgctgtgcctcgcgcagagcaacggcatccccaaggcgcgggtgcacgaggtcctcgacatggtcgggctgaccgcggtcgcgaagaagaaggcgaagggcttctccttcggcatggggcagcggctcggcatcgcgggtgcgctgctcggcgatccgcggatcctgatgttcgacgagcccgtcaacggtctcgaccccgagggcatccactggatccgcaacctgatgaaatcgctggcctcgcagggccgtacggtcttcgtctcgtcccatctgatgagcgagatggcgctgaccgccgaccatctcgtcgtgatcggccagggccggctgctcgccgacacgtccatggccgacttcatccagcagaactcgcggtcgtacgtccggatccgttctcctcagcgcgagcggctcctcgacgtgctgcacggggcggggatcacggtcgtcgagaccggcggcggcacgctggaggtggacggcggcaagtccgagctcatcggcgagctggccgccgggcaccagatcgtgctgcacgagctgagcccccagcaggcttccctggaagaggcgttcatgcggctgaccgcggagtcggtggagtaccacgcgcatccgcagggcccgccccaggactggggcgacgcctggaagaaaggggcc

SEQ ID NO: 2848 - DNA, 768 bp, Streptomyces avermitilis
  CDS (1)..(768)
atgtccgcggcgcaggtcgtccgctccgagtggaccaagatccggtcggtggcgtccacggtgtggacgctctccctcgccgtggtcgtcaccatcgccctcggcatgctgatctcggccctggccgggaacgagttcgacaagatggacccgcgggacaggctctccttcgaccccacgttcatcagtttcgccgggatgagcctcggccagctcgcgatgatcgtgttcggggtgctcgtcgtgtcgaacgagtacagcacgggcatgatccgcagctcgctcgccgcggtcccccagcgcggcacgttcctgttcagcaagatcgcggtggcggcgggactcgccctcgtcgtcggcatcgtcaccagcttcgccgcgttcttcctcgggcaggcgatgctcggctcccaccgggcgtcgatcagcgacacgggagtgctgcgcgcggtcatcggcggcggcctctacatgacgctcatcgccatgttctcgatgggtgtggccgcgatgctgcgctcgccgatgctgtcgctgggcatcctgatgccgttcttcttcctgatctccaacgtcctgggcaatgtctccgccacgaagaagatcggccgattcctgcccgaccaggccggcagcaagatcatgcaggtcgtgacgcccctcggcgacgacactccgtacggtccctggggcgggctcgggatcatggtgctgtgggtggtgctggcgctcgccgggggctatgcgctgctcaagagacgggacgcg

SEQ ID NO: 2849 - DNA, 1329 bp, Streptomyces avermitilis
  CDS (1)..(1329)
atgatcgaggcagtcggcctgacgaagcgctacggcgacaagacagccgtgtacaacctttccttccaggtgcgaccgggctccgtcaccggcttcctcgggcccaacggctcgggcaagtccacgaccatgcggatgatcctcggcctggacaaccccacctccggtcaggtgacgatcggcggctacccgtaccgcaggctgcccaacgccccccggcaggtcggtgcgctcctcgacgccaaggccgtgcacggcggccggcacgcccgcaaccacctgctctccctggcccagctgtccggcatcccggcccgccgggtggacgaggtgctcggcgtggtcggcctccaggacgtggcccgcaggcgctccaagggcttctccctcggcatgggccagcggctcggcatcgccgccgcgctcctcggcgacccccaggtgctgctcttcgacgagccggtcaacggtctcgaccccgagggcatcctctgggtgcgcaatctgatgaagtccctcgcggcggagggccgtacggtcttcgtctcctcgcacctgatgagcgagatggcgctgaccgccgaccacctgatcgtgatcggccgcgggcagctgctggccgacatgagcatccgcgacttcatctcggccaactccgccgacttcgcgcgcgtccgcactcccgagaccgacccgcagcagcgcgagaagctgacggccgcgctgacggaggcgggcggacatgtgctgcccgagctggacggcgcgctgcgcgtgaccgggctgccgctgccgcgcatcagcgacctcgcgcactcctccgacgtacgcctgtgggagctgtcgccgcatcaggcgtcgctggaggaggcgtacatgcggatgacgcagggcgccgtcgactaccgctccacgatcgacgagaaggccggtctccagcagccgctgccgccgggcgtgcagccgccgatgcccgtgccggggcagggccagccgggctggtacgccccgccgtcgccccagcagggcgggcagccgttcgcgatgccgcaggggcagccgctgccgcagggccaggccgcggcgggcccgtacggcgctccgtacggcgccccggccgcgcccgccgcacaggcgccgggcggccccaacccgtacgcgcagcccgcagcctcaggccccggtccagcccgcccaggcgcccgtggctcccgcggtccctgcggcctcggccgtgccccccagcgcccgctcaggcccccgcgcagccgagcgccgcacccgcacagcccgtcgcggcccccgccgcgccctccgccgctcccgacc

SEQ ID NO: 2850 - DNA, 867 bp, Streptomyces avermitilis
  CDS (1)..(867)
atgagcacgccccagcccccgatgccgcagccggccgcgcccgcccccacctggcaggcggcgtccggtggttcgtacacctcgccgatcccgatcatccgcacccacctcgggcatgcgctcgcctccgagtggacgaagatcaagtcggtccgctccacgatctggacgctgggcgtcttcctgttcctcgtgatcggcatcggtctgggcgccggcgccctcgtctccggttccgacacggacatgcacggtgattcgccgctggcgctgggcttcttcggtctgctgctcggcagcatctgcatcatcacgctcggcgtgctcaccaccgcctccgagtacggcaccggaatgatccggaccacgatggtcgcctgccccacccgctcccgggtgctgctggcgaagtccgtcgtgttcttcgccgtcgcgttcgtggtcaccacggtgagcgcctcgttcgtcgccttcgcgcagtcggcgatgctggagggcagcggtgcgggcacgcccagcggcggggagtggctgaagggcacggtcggcgtcggcctctacgtcgcgctgctcgggctgctctcgctgatcgtcggctccatcatccggcactcggcgggtgccatcaccatcatgatcggcgtcctgctcgccccgctggtcatcgcgatgttcatgttcgcggactcgctgcgggacctccagcaggccctgttcgagtactcgatcccgaaccagctcgcggtcttctacgacaactcgctcagcgggtcggggccgtccggctgggacccgctgtggatcatgctgggcgtgacggccgtcgcgttcggcggcgcgtacctcctgctggagaagcgggacgtg

SEQ ID NO: 2851 - DNA, 330 bp, Streptomyces avermitilis
  CDS (1)..(330)
gtgtccccgcgtcgcaaccgtccgaagggtgccggctcgtccggcgggagcgcggcggaggagcgctccggccgctacggcggctggcagtccacggagagctggcagggcgaggagtggagcgtgcgccacgtcgcgggcgccagcgcggagggcaagacctaccgctgccccggctgcgaccagatgatcccctccggcgtcccgcatgtggtggcctggcccgagcacgcgggcgtggacgaccggcgccactggcacaaggcgtgctggaacgcgaaggaccgccgcaccctgcgggtgcagcggtcccgtaacgcgcccaggttc

SEQ ID NO: 2852 - DNA, 1026 bp, Streptomyces avermitilis
  CDS (1)..(1026)
atgcacgtaggaagttttgtactggcggcccagttcccggggcagggccagggggaggcgctgcaccgcgcggtgcggtcggccgaggtggccgaggaggcgggtctcgacacggtgtggttgggcgagcaccacttcgtgccgtacgggacgtgcccgtcggcgatcaccctcgcggctctgctgctcggccgcacccggcggatccgggtcggcacggcggtcagcgtgctgcccaccgtccacccggtggcgctgggcgagcaggccgcgctgctgcacctcacctccggcgggcggttctcgctgggcgtgggacgcggcggaccctgggtggatctggaggtcttcggttcgggtctcgaggcgtacgagaaggggttcccggaatcactcgatctgctggtgcgctggttgcgcgagccgtccgtcgcgggcacgggggaacgattcaccttccgtgaagtcccggtcgtcccccggccgtcggagtcgctgacggacgcctcggggcccgaggtcgtcgtcgcctgcacctcgccggccagcgtccggctcgcggccgagcgggggctgccgatgctgctcgggatgcacgtcggggacgaggagaaggccggaatggtcgcactgtggcggcagcacgcgcgcgccagcgggctcggcgcgggcgagatcgcgggtgccgcccatgtctcggcgggcatctgccagatcgccgaccggcgcaccgacgccgtcgagacgctgaccaaggcgatgccgggctggctgcggcaggggctcgacgcccatgtgacggtggacggtcggccccgcgcgatgcgggacccgctggcgtacaccgaactgctctgcggactgcacccggtgggcagcccccggctgtgcgccgaccggctggcggcgacctcggagcggaccggcatctcccgcttcgcgctgctcgtcgagggctcgggcgacctcgcggccaccgaggagaacgtacgccggctcggcaccgaggtacttccccacctcggc

SEQ ID NO: 2853 - DNA, 390 bp, Streptomyces avermitilis
  CDS (1)..(390)
atgtcgctcgacgtctcaccggccctactcgaacaggccgagcgaggcgaggtcgacgaagctgacttcgtcgactgcgtccggacctccctgccctacgcatgggagatgatcagctccctggtggcccagctgaaggtggacggcggcgcgttcgccgacaaccagacgcccccgccggacgagcaggcgcgtggccagctgctgcgtgcgctcgcgagtgacgcgatacgcggcgcgcttcagcggcacttcggagtgcgactggccttccagaactgccaccgggttgcggtgttcccgctggacacctcggtggaccagaagctggcacgcttcacctcggtccgcagccagttgctgaaccagtccccggagttcagggactgc

SEQ ID NO: 2854 - DNA, 669 bp, Streptomyces avermitilis
  CDS (1)..(669)
atgcgtctcgtcattgcccgctgttccgtggactacgcgggccggctcaccgcccatctcccgtccgccccccgtctcatcctggtgaaggcggacggcagcgtctcgatccatgcggacgaccgggcctacaagcccctcaactggatgtcgccgccctgcacgctgaaggaggggtcgggggacgaagagggcgtctggaccgtcatcaacaaggcgggcgagaagctcatcatcacgatggaggaaatcctccacgactcctcgcacgaactcggcgtggaccccggcctgatcaaggacggcgtggaagcgcacctccaggaactgctcgccgaccgcatcgagacgctcggcgacggctacacgctgatccgccgcgagtacatgaccgccatcggcccggtcgacatcctgtgccgggacgccaccgggcagaccgtcgcggtggagatcaagcggcgtggcgagatcgacggcgtggagcagctcacccgctatctggagctgctgaaccgcgacccgcacctcgcgccggtgcgcggcgtcttcgccgcacaggagatcaagccgcaggcccgcgtgctggccacggaccgcggcatcggctgcacggtcctcgactacaacgccatgcgcggcatcgaggacgacaagctccggctgttc

SEQ ID NO: 2855 - DNA, 2541 bp, Streptomyces avermitilis
  CDS (1)..(2541)
atggacccgaacaaccaggaacccgaggagtacggccatgacggtgacggcgaaacgccgcgccagcgcccgccgcgggactccctcacctcagacttcggacagcacacgccggtggtcgcccgcaccgtccagctcgtctcgggcgactacctgctcaccgtcaaccccgtcgacggcagcgagatagaggcctgcccgccgggcgagcggccaccccggccggtgaagttcgctccggccgagcgcgccgagaccgcccgcgccgcccagccgcccgtcccgcccggaccggcgcggccccggctgccgctcctggagcgccaggaggagcgcgagcggctcgtacggctcctcgcgcgcggccgctccgtccgcctcaccggccccgccggctccggccgcaccgtcctgctggacgccgtggccgaggactgcgcggacctcgcccccgacggcgtcgtccgcctcaccggctaccggcgcaccgcgagcgacctcctccacgacctcttcgccgccgtttacaagagcgatctccaccggccggagcgggaggaactgctccggctcgtccacgagatcggcgcggtcgtcgtcctggacgacgtggagttcggcggcagcgcgctcgacgagctgctcgacgccacgcccgagtgcgccttcctgatctcggccacgcccgatgtaccggcgccctccgccgactccctgctcgaagaggtcttcctcggcggcctcgaccgcgcgggcggcctcgaactcctcgagcgcgcggtcggccgggtcctcaccgaggacgagtcgaactgggcgggcgacctctggttcgagtccgagggtcttcccctgcgcttcatgcaggccggagcgctgctgcggcagcgcgacgagctgcgcgccgacccgaacgccttcgactcgctcggcttctacgacgacgcgccgtccccgaggctctcggcctcgctcgaaccgggagacacccccgacgcgccgtcggacgccgaagacggtcacgacctgcccctgccgtccctcgccgagggtgccgcgcccgcctcactgctcgcctcgcggctgagcgcgtcggcccgcgagaccctcaagttcgccgtcgcgctcggcggcgaggtgccgcaccagacgcatctgcccgccctcgtggacgacacccacgccgacgccgcgctcgccgagctcctgagctgtgcgctcgtctcgccggtcggctcccgctaccggctcgcggccggtgtgcaggcccagctggaggccgccggatacgcgaccggggccgacgcccgcgccctcgccgccgcccagcactacgcctggtgggccgggcacccctcggtgaccccggagcgcgtctcggccgaggccgacgccgtgctcgccgcgctcaccgtcctggtgccgctcaccacgcccccgggcgagaacgaggagagcgccgccgtactgctggcccgccacgccacccccgcgttcgccgcggggctgcactggagcgcctgggagcgcgcgctgcgcgccggcgccgaggcgtcccggctcgccggcgaggtcggcgaccagacctacttccaccacgaactgggcatcctcgcgctctgctgcggccagctcgaccgggcccgcgccgagctggaggcctccatcgggctgcgcggcgccctcgccgacaagcgcggcacggtcgccggccgccgcgccctcgccctggtcgccgaccgctccggggcggcactgcccggcgggcgcacggcggcgggcgaggaggtgccggacgcgcgctacgaggagtcggcgtcgccgcccggcggggtaccggccggcttcggactgcccgagccgtccggcgacggtacgaccctggtcacccaccggaccgagcccacgcccgcccggcagggcccggtctccgtcaagggcatcgtcggcggcgcccggcgcaacctggtggccgcgggcgccggtgtgctgctggcgggggtgctcggcaccgtcgtcacgctcggcatgacgtccaacaacaacgacgacccgccggccgagaaggtcggcgtcaacccgtcggccagccagggcatcgacgacgacagcctcggtgcggacaagccgaggaaggacaccggcgactcgggcgtcgcaggcgtgcccacggacccgggtcccgacggcacctacgggacggcggacgacccggccccgtcggccagcgcccggccctcggacgacccgaccggaacgaaggggaccaccccgtcgacgtcgccgtccaagtcgccctcgaagtcgccgacgaccaagccgccgacgtcgtccaagccgacgaccagcaacccgacgacgaccccgccgaccagcacgcctccggcgaccaccacaccgccgccgactacgacggccccgtcgacgacggattcggccagcggcccggcgtcctccagtgctcccgccaccggcagcggtacggcgagcgcaccgcagagcagcggcgccgggtcgcccagcgactcggacccggtgatc

SEQ ID NO: 2856 - DNA, 321 bp, Streptomyces avermitilis
  CDS (1)..(321)
atgcatatcaggggcgaccacgccgagctggtcgtcgggggccgcctcgacgtccgcagcgcggcggacgcccgaacggtcctgcactcggccgtcgacgacggagtcggtgacctgattctcgacctgtccgaactggactcatgggacgccaccggactcggggtgatcatgggagcccaccggcgggccggacgctgcggcagacggctcgtgctgcgcgacgtaccaccgcagatgcagcgcctgctggtggccacccggctgcaccggatcctggcgatcgagggcggcatcggggtcgagtcactgccccgggtg

SEQ ID NO: 2857 - DNA, 846 bp, Streptomyces avermitilis
  CDS (1)..(846)
gtgacagggaagctcgccgtcatcggagccggactcatgggttccggtatcgcccaggtctccgcccaggccggctgggacgtcgtcctgcgcgacgtcaccgacgaggcgctgacccgcggcaccgacggcatcaaggcctcgtacgacaagttcgtcagcaagggcaggctgtcggccgacgacgccggggccgccctcgcgcgcatcaccacgaccaccgatctggacgcggtcgccgacgccgacatcgtcgtcgaggccgtcttcgagaagctggaggtcaagcacgagatcttccgcgcgctcgacaagatcgtgcgggacgagaccgtgctcgcctccaacacctccgccatcccgatcaccaagatcgccgcggtgacggagcgcccggagcgcgtcgtcggcgcgcacttcttctcgccggtcccgatgatgcagctgtgcgagctggtccgcggctacaagacgagcgacgaggccctcgccaccacgcgggagttcgccgagtccgtcggcaagacctgcatcgtcgtcaaccgcgatgtcgccggttttgtgacgacccgtctcatctcggcgctcgtcgtcgaggcggcgaagctgtacgaatcgggcgtggccaccgccgaggacatcgacctcgcctgcaagctgggcttcggtcacgccatgggccccctcgccaccgccgacctcaccggcgtcgacatcctgctgcacgccaccagcaacatctacaccgagtcccaggacgagaagttcgccccgccggagctgatgcgccggatggttgacgccggtgacatcggacgcaagagcgggcagggcttctacaagcac

SEQ ID NO: 2858 - DNA, 639 bp, Streptomyces avermitilis
  CDS (1)..(639)
atggcagaggggctcagggagcggaagaagcggcaggccaggcagcacatctcggatgtggccacggggctgttcctggagcgcgggttcgacgaggtgacgatcgccgagatcgccgaggcggccgacgtctccgtcaacaccgtctacaactacttccaggccaaggaggacctcttcctcgaccgggccaagggcagcgtcgcgcgcctctcgcgttttgtgcgcgcccgcgacacgggcgagtccgcggccgccgcggtactgcgcgagctgcgcggcgaggtggaggcggtctcgccccaggtgggcctcttcgagggatatgaccgctttatgaaagtcgtcgaggcggcggccggactccgcgcccgtctggggcacatgaaccagcagagcctcgaactcctcgaggagaccctgcgtacggagaccggcgccgatccggacgacccgatgccgtcgctgatggccggtcagatcggctgggcgcacaccacgctgctggcgctcatcgggcgcgagatgatggccggccgctcccccggcgaggtctcccgtgaggccctcggtctactcgacgacatggaggagctgttcagcgagagggtgctcaactatgccgtgcgggaggcgggc

SEQ ID NO: 2859 - DNA, 780 bp, Streptomyces avermitilis
  CDS (1)..(780)
atggcaatcatcagtacggccggtctggcccgtaccttccggacgaaacgcggcccggtcgaggcggtgcgcggcatcgacctcaccgtgcggccgggcgagatcctcggcttcctcggcccgaacggagccgggaagaccacgaccctgcgcatgctcacgaccctgctgccgcccaccggcggtgcggccaccgtggccggctgcgacctggtctcggaccccgtcggagtgcgccgggccgtggggtacgtggcgcagtccggcggtgtcgacccgaatgtcaccgcgcgggaggagctggtcacgcagggacggctgtaccgcctgaccaggctccaggcgtcggagcgcgccgcggaactggcgcgtgacctggatctggcggacctgctggaccgccggacggcggcgctctccggcggccagcggcggcgcctcgacatcgcgatggggctcacgcaccgcccccgggtcctgttcctcgacgaaccgacgacggggctcgaccccggcagccgggccgacctctgggacctggtccgccgtctgcgcgacgagcacggcaccacggtcttcctgaccacgcactacctcgacgaggcggacgcgctctccgaccggctcgtgatcgtcgacaagggcgtcgtggtggccgagggcacgccgagcgcgctgaagctggcgcacggcggctcgatcgacgcgacgctccaggacacgttcctcgccatcaccggccggggcccctcgcccgccgactccgcccccgtagccgta

SEQ ID NO: 2860 - DNA, 747 bp, Streptomyces avermitilis
  CDS (1)..(747)
atgctcttccaggacaccgcgctgatctacgggcgctacgcccgccagaccctgcactccaagttccagatcttcttcggcatgctgatgccgctgctctacctgctgctgttcggaccgctcctgacccatctgccgctgggatcgcacggcagttcctggcaggtgctggtgcccggcctgctgcttcaactcggcctgttcggctccctgttctcgggcttctcgatcatcttcgagaagaactacggcgtcgtggagcggatgcgcgtcacccccgtcagccgtctcgccctgctcctcggccgggtactgcgcgacgccaccctgctggtcttccaggcagtgctgctggtgctcaccgcgctgctcatggggctgcgggcgccgctcgccgggatgctcatcgggttcgcgttcgtcgcgctgctggccgtctccctcagctccctgtcgtacgcggtggcgctgaaggtcgaccggccgcaggagttcggcccgatcatcaacgcggtctccctgccgtcgatgctgctgtcgggcctgatgctgcccatgaccctcgggcccgactggctcgacgtcctgtcccacgtcatgccgctgcgctatctggtggacgcgatccgggacgcgtacctcggccagtacgcgacctcggccatgctgtacggcgtcctggtcgccctcggcttcgcgacgctcgccgtgacggtgggcacacgggtgttccggacggccggagcg

SEQ ID NO: 2861 - DNA, 570 bp, Streptomyces avermitilis
  CDS (1)..(570)
atggtcaatctgacgcgcatctacacgaggaccggcgaccagggcacgaccgccctcggcgacatgagccgggtcgccaagaccgatccccggatctccgcctacgccgacgccaacgaggccaacgccgccatcggtacggcgatcgcgctcggcgggctcgacgaggagatcgtcaaggtcctcgtccgggtgcagaacgacctgttcgacgtgggcgcggacctgtcgacgccggtcgtcgagaacccgcagttcccgccgctgcgcgtcgagcagttctacatcgacaagctggaggcggactgcgacctcttcaacggcgagctggagaaactgcgctccttcatcctgcccggcggcacgcccggcgcggcactgctgcaccaggcgtgcacggtcgtacgacgggcggagcgctcgacgtgggccgcgctggaggtccacggagaagacatgaacccgctcaccgcgacctacctcaaccggctgtcggacctgctcttcatccttgcccgcaccgccaacaagggcgtcggggacgtgttgtgggtgccgggcggagagcgc

SEQ ID NO: 2862 - DNA, 621 bp, Streptomyces avermitilis
  CDS (1)..(621)
gtgccgtttcctcactggcgacgacgatccgggtccgcgccgccgggagtctggaagggtgaccgagaggagcgagccgtgatcgtcacactcgtcattgcctgtgaagtggccttctgggtgctgctggccgcgggactgaccttccgctacgcgttcaggatgccgcgcaccggcctggccctgttgctgtgcgagccgctgctcgaagtcgtcctgttcgctgtcaccgcgatcgacctgaggaacggcgcggagcccgactggaagcacggtctcgccgccgtctacatcggcttcaccgtgggcctgggccactccacgatcaagtgggccgacgcccgggtggcccaccggttcgcgggcgggccaccgccggtcaggccgccgaagtacggggtggcccgcgccgtccacgagtggcgggtggcggggcgctggatcctcgcggccgtcgtcgcgacggcgctgcttcaggccgcgatctggtacgtcggttccggcggcgagaccgactcactgcgcatgtggcagatgaggatggtgtggctgatcggcatcaacgtgatcatcgccctcagctacacgctgttcccgaagcaaaaacgggccaagctccgc

SEQ ID NO: 2863 - DNA, 1182 bp, Streptomyces avermitilis
  CDS (1)..(1182)
atggccgtacgactcccccgcccccaccaccacgacgtgcgcatcgcggtgggcgggctcctcggggggctgctgctgtgggggctcggcctcagtccacggaacccgcacgacagtgtcgtgctgtggccggcgcactgggcggtgctggtcccgctcgtcgtgacggccggctgcgagctgctgcgcaggacccggccgcgggcggccctgctgatcggcacggccgccgtggtcgccgacacggtgaccctgggcagcgtggtcaccgtcgtgatgttcacggacctcatgtacgcggccgtcctgtacggcacccccgcctccgcccgccggctgccctggctcaccgggctgctcaccgtgatcggcggggtggggccggccgccgtctggggcgaccccgacggcctgctgatcggtgtcggcgtcggcgtggtggcattcgcgcccgccgccaccggctcggtcgtccgcaaccaccgcgaggccgccgaggccgcccggctgcgcgccgaacagaccgccctgctcgccgagatggaccgctcccaggcggtcaccgccgaacgcgccaggatggctcgggagttgcacgacatggtcgccaaccacctgtcggcgatcgccatccactccaccgccgcgctgtccatcgacgagccggggacctcccgggaggcgctcggcgtcatccgggagaacagcgtggcgggactcgccgagatgcggcggctgatcgggatcctgcgcgacggcgacggcgagggggagccggtcgcgaccccgaccctcgacgggctcgccgcgctcgtcgacggcgcccggaccaacggcctcgacgtcaccctcgacgccgaccccggccgggttcccgccccggtcgagctcgccgcctaccgcatcgtccaggagtccctgaccaacgccctcaagcacgcctcccccggccgggtcgccgtcacgctcgccgcgcgggacggctccctcgccgtgcgggtgaccagcccctacggcgaccgggacgggccgcgcgcgcccggctcgggggccggcctggtcgggatgcgggaacgcgtcgccctgctgcacggaacgttcgaggcgggccccgagaactccggccggggcacggtctggaccgtacgcgccacccttccgatcacccatggaggaaccgaa

SEQ ID NO: 2864 - DNA, 639 bp, Streptomyces avermitilis
  CDS (1)..(639)
atgatccgcgtgctcgtcgccgaggaccagtccgccgtacgggccgggctcgtcctcatcctgcgcagcgcgcccgacatcgacgtggtcggcgaggccgcggacggcgagcaggcggtcgcgctcgcccgtgaactccggccggatctcgtcctcatggacgtgcagatgccgcgtctcgacggggtgtccgccacccgccgggtcgtcgccgagaacctggccgacgtactggtcctcaccaccttcgacctcgacgagtacgtcttcggggcgctgcgcgcgggcgcctgcgggttcctgctgaagaacaccgaggcgcgccagctgctggaggcggtccgcaccgtcgcgcggggcgaggggctgatctcgcccgcggtcacccgccggctgatcgccgagttcgccgcgaagcccgtacgggagccggggcccgacccggtgatcctcgacgtcctcacccggcgggagcgcgaggtcctgtcctgcctcggccgggggatgtccaacgcggagatcgcggcccggctcgacatggcggaggcgaccgtgaagacgcacgtcagccgcctgctggggaagctggagctgcgcagccgggtccaagccgccgtgctcgcgcaggagttgggggtc

SEQ ID NO: 2865 - DNA, 1821 bp, Streptomyces avermitilis
  CDS (1)..(1821)
atgcgcttcggacacagagccgtggcagggttcgccaccctgctgctcccgctcgccggcctggtggggctcgcaagccccgcccaggccgcaggctcggccaccgccacctacgccaagacccaggactggggcaccggcttcgaaggcaagtggaccgtcaagaacaccggcaccagcagcatcagttcctggacggtcgagtgggacttcccctccggtacgtccgtgacctcggcctgggacgcggacgtcaccagctccggcacccactggaccgccaagaacaagtcctggaacggcaccctcgcccccggcgcctccgtctccttcggcttcaacggcgcgggctccggatccccttccaactgcaagctgaacggcgacagttgcgacggcgccaccacccccggcgacgccgctccctccgcaccgggcaccccgaccgcctccggcatcaccgacacctcggcgaagctgtcctggacggcggccacggacgacaagggcgtcaagaactacgacgtcctgcgcgacggcgccaaggtcgccaccgtgacgacgacctcgtacacggacaccggtctgaccgccggcaccgactactcgtacaccgtccaggcccgtgacaccgccgaccagaccggcccggtcagcggcgcggtcgccgtgcacaccaccggcggcggcacgactcccccgcccaccggctccgccgtcaagctcggctacttcaccgagtggggcatctacggccgcaactacaacgtcaagaacctggtgacgtccggctccgcgtcgaagatcacgcacatcaactacgccttcggcaacgtcaccggcggcaagtgcgcgatcggcgactcctacgccgactacgacaaggccttcaccgccgaccagtcggtcagcggcgtcgccgacacctgggaccagccgctgcgcggcaacttcaaccagctgcgccagctgaaggccaagtacccgaacatcaaggtgctgtggtcgttcggcggctggacctggtccggcggtttcggcgcggcggcggcgaacccggccgcgttcgcccagtcctgctacgacctcgtcgaggacccgcgctgggccgacgtcttcgacggcatcgacatcgactgggagtacccgaacgcctgcggtctctcctgcgacaccagcggctcggcggcctacaagaacctgatgtcggcgctgcgcgcgaagttcggttcgaacaacctggtcaccgcggccaccaccgccgacggctcctccggcggcaagatcgacgcggccgactacgcgggcgccgcccagtacgtcgactggtacaacgtgatgacgtacgacttcttcggcgcctgggacgcccagggccccaccgccccgcactcgccgctcacctcgtacagcggcatcccgaaggccggcttcaccacggccgacgcgatggccaagttcaaggcgaagggcgtgcccgcgagcaagctgctgatcggcatcggcttctacggccgcggctggacgggcgtcacccaggacgctccgggcggcacggccacgggcccggcggcgggaacgtacgagcagggcatcgaggactacaaggtcctcaagacgtcctgcccggccaccggcacgatcgccggtacggcctacgcgcactgcggcagcaactggtggtcctacgacaccccggcgaccatcggtacgaagatggcgtgggccaagagccagggcctgggcggcgcgttcttctgggagttcagcggtgacaccggcaatggcgagctggtgagcgccatcaacagcggactcgga

SEQ ID NO: 2866 - DNA, 450 bp, Streptomyces avermitilis
  CDS (1)..(450)
gtgtcgatggtcctcgctctgactgtgtgcgggttggtagtggcgctcgtagtggtggggctcttcgtcttcggtctccgccgccggctgatccagcgctccggcggaacgttcgactgcagtctgcgctgggacgtccccgagaagggcgactcgaacggcaagggctggagctacggcgtcgcccgctacaacggcgaccgcatcgagtggtaccgcgtcttctcctacgccccccgcccgcgccgcgtcctggaacgctcggcgatcgaggtggccggccgccgcgcccccgagggcgaggaggagctggcgctgctctccgacgccgtgatccttgtctgtctccaccggggcacgcgtctcgagctcgcgatgagcgaagacgcgctgaccggatttctcgcgtggctggaggcagccccgcccggacagcgagtgaatgtggcc

SEQ ID NO: 2867 - DNA, 372 bp, Streptomyces avermitilis
  CDS (1)..(372)
ttggctgctgagctgcacgtcgagctggtcgccgccgaccgccaggtctggtccggcgaggccaccctggtcgtggcgcgcaccacgtccggcgacatcggcgtcatgcccggtcaccagccgctgctcggtgtgctggaatcgggcccggtgaccattcgtacgagtgatggtgaaacggtcgtcgccgcggtgcacggcggtttcatctcgttcgccgacaacaagctgtcgctgctggccgagatcgccgagcttgcggacgagatcgatgcccagcgcgcggagcgggagctcgagcgggcgaaggcggagggtgatgccaccgccgagcgtcgcgcggacgtccgactgcgtgcggtgtcggcgcgc

SEQ ID NO: 2868 - DNA, 1434 bp, Streptomyces avermitilis
  CDS (1)..(1434)
atgacgacgacagttgagacggccgttgccacgggccgcgtcgcccgggtcatcggcccggtcgtcgacgtggaattccccgtcgacgcgatgccggacatgtacaacgcccttcacgtcgaggtggccgacccggccaacgccggcgagaagaagacgctgaccctggaggtcgcccagcacctgggtgacggcctggtccgcaccatctccatgcagcccaccgacggtctggtccgccaggccgcggtcaccgacaccggtacgggcatcaccgtcccggtcggcgacttcaccaagggcaaggtgttcaacaccctcggtgaggtgctgaacgtcgacgagaagtacgacggcgagcgctggtccatccaccgcaaggccccgcgcttcgacgagctcgagtcgaagaccgagatgttcgagaccggcgtcaaggtcatcgaccttctcaccccgtacgtcaagggtggaaagatcggtctgttcggtggagccggcgtcggcaagacggtgctcatccaggagatgatctaccgcgtcgccaacaaccacgacggtgtctccgtgttcgccggtgtcggtgagcgcacccgtgagggcaacgacctcatcgaggagatgtcggactcgggcgtcatcgacaagaccgccctggtcttcggccagatggacgagcccccgggcacccgtctgcgcgtggccctggccggtctgaccatggcggagtacttccgcgatgtgcagaagcaggacgtgctgttcttcatcgacaacatcttccgcttcacccaggccggttccgaggtgtcgaccctgctcggccgtatgccctccgcggtgggctaccagccgaacctggccgacgagatgggtctcctccaggagcgcatcacctcgacccgtggtcactcgatcacctcgatgcaggcgatctacgtccccgcggacgacctgaccgacccggccccggccaccacgttcgcccacctcgacgcgacgacggttctctcccgtccgatctccgagaagggcatctacccggccgtggacccgctggactccacgtcccgcatcctggacccgcgctacatcgcgcaggaccactacgacgccgccatgcgcgtcaagacggttctgcagaagtacaaggacctccaggacatcatcgcgatcctcggtatcgacgagctcggcgaggaggacaagctcgttgtccaccgcgcccgtcgcgtggagcgcttcctgtcccagaacacccacgtcgccaagcagttcaccggcgtcgacgggtcggacgtcccgctggacgagtcgatcaccgcgttcaacgcgatcatcgacggcgagtacgaccacttcccggagcaggcgttcttcatgtgcggtggcattgaggacctcaaggccaacgccaaggagctcggcgtctcc

SEQ ID NO: 2869 - DNA, 915 bp, Streptomyces avermitilis
  CDS (1)..(915)
atgggagcccagctccgggtctacaagcgtcgcatccgatccgtcaccgcgaccaagaagatcaccaaggcgatggagatgatcgccgcctcgcgtgtcgtcaaggcgcagcgcaaggtggcggcctccacgccgtacgcgaccgagctcacccgcgcggtcacggcggtcggcaccggctcgaacaccaagcacccgctgaccacccaggccgagacggtcacccggtccgcggtgctgctcctgacgagcgaccgcggcctggccggcgcgttcaactccaacgccatcaaggcggcggagcagctgaccgcgcggctcgaggccgagggcagggaggtcgacacgtacatcgtcggccgccgtggtgccgcccactacaacttccgtgagcgcaaggtcacggagctgtggacgggcttcaccgacgagcccacgtacgcggacgccaagaaggtcgcgggtccgctcatcgaggccatcgagaaggagacggcggacggcggcgtggacgaactccacatcgtctacaccgagttcgtctcgatgatgacgcagacggcgatcgacgcccgcctgctgccgctcagcctcgaagaggtggcggaggagtcgtccacacagggcgagatccgtccgctgtacgacttcgagccgtcggcggaggacgtcctcgacgccctgctgccgcgctacgtcgagagccgtatctacaacgcgctgctccagtcggctgcctccaagcacgccgccacgcgtcgtgcgatgaagtcggccaccgacaacgcgggcgagctgatcaacacgctctcccgccttgccaacgcggcccgccaggccgaaatcacccaggaaatcagcgagatcgtcggtggcgccagcgccctggccgacgcgaccgcggggagtgacagg

SEQ ID NO: 2870 - DNA, 1587 bp, Streptomyces avermitilis
  CDS (1)..(1587)
atggcggagctcacgatccggccggaggagatccgggatgcgctggagaactttgtccagtcgtacaagccggacgcggcctcgcgcgaggaggtcggcacggtcaccgtcgccggcgacggtatcgccaaggttgagggtctcccctcggccatggccaacgagctgctgaagttcgaggacggcactctcggcctcgcgctgaacctggaagagcgcgagatcggtgcggtcgtcctcggcgagttcagcggtatcgaggagggccagccggtgcaccgcaccggtgaggtgctgtccgtcgccgtgggcgagggctacctcggccgcgtcgtcgaccccctcggcaacccgatcgacggcctcggcgagatcgagaccagcggtcgtcgcgccctcgagctgcaggcccccacggtcatggaccgcaagtcggtgcacgagccgatggagaccggctacaaggccgtcgacgcgatgaccccgatcggccgtggccagcgtcagctgatcatcggtgaccgccagaccggcaagaccgccctggccgtcgacacgatcatcaaccagcgtgacaactggcgcaccggcgacccgaagaagcaggttcgctgcatctacgtcgccatcggtcagaagggttccaccatcgcctccgtgcgcggtgccctggaagaggccggcgcgctggagtacacgaccatcgtcgccgccccggcgtccgacccggccggcttcaagtacctggcgccgtacaccggttcggccatcggccagcagtggatgtacgagggcaagcacgtcctcatcatcttcgacgacctctcgaagcaggccgacgcctaccgcgccgtgtccctgctgctgcgccgcccgccgggccgcgaggcctacccgggtgacgtcttctacctgcactcccgtctgctggagcgctgcgcgaagctctccgacgacatgggcgccggttcgatgacgggtctgccgatcgtcgagaccaaggcgaacgacgtgtcggcgttcatcccgaccaacgtcatctccatcaccgacggccagtgcttcctggagtcggacctgttcaacgccggtcagcgccccgcgctgaacgtcggtatctccgtctcccgagtcggtggttccgcgcagcacaaggcgatgcgtcaggtctcgggtcgtcttcgcgtggacctcgcccagttccgtgagctggaggcgttcgccgccttcggttcggacctggacgccgcgtcgaagtcccagctggagcgcggtcagcgcatggtcgagctgctcaagcaggctcagtaccagccgatgccgaccgaggaccaggtcgtctccgtgtgggccggcaccaccggcaagatggacgacgtaccggtcgccgacatccgccgcttcgagaaggagctgctggagttcctgcaccgcaagtaccagggactcatgacctccatcaaggagggcgccaagatgtcggacgacaccctcacggccatcgccgacgccatcgcggacttcaagaagcagttcgagacctcggacggcaagcttctcggcgaagacgttccggccgccggcaag

SEQ ID NO: 2871 - DNA, 819 bp, Streptomyces avermitilis
  CDS (1)..(819)
atgactgcacacggagcgagccgcgaggcaaccgctgccgcacgtgagcgtctcgatgcgctgacggactcgacgtccgtggacgtggtccagctcgccgacgagctggccgccgtcaccgcgctgctcgaccgcgaggtgtcgctgcgtcgggtcctcaccgacccggcgcaggccgccgaggccaaggccgagctggccggtcgcctcttcggcagccagatcggcggccccgccaccgacctggtcaccggcatggtgcgctcccgctggtcgcagtcccgcgacctggtggacgccgtcgaggagctggcggacatcgccgacctcacggcggcccagcgggcgggcgtgctcgacgacgtcgaggacgagctgttccggttcggccggatcgtctcgtcgaaccccgcgctgcgggccgcgctgaccgaccgcaccgccgacaaggcggccaggagcgagctggtgcacagcctgctcggcggccgggccaccgcgaccaccgagcgtctcgtgacgcgccttgtgaccacgccgcgtggacgtagcctggaggcgggactcgagtccctgtccaagctcgccgccgagcgccgcgaccgcttggtcgcggtcgtcaccacggcggtcccgctgagtgacacgcagaagcagcgcctcggcgccgccctcgcgacgctctacggccgtcagatgcacctcaacatcgacgtggaccccgaggtcctcggcgggatgcgggtgcaggtcggcgacgaggtcatcaacggcagcatcgcggaccggctcgaggacgcccgccgccgcatggcgagc

SEQ ID NO: 2872 - DNA, 558 bp, Streptomyces avermitilis
  CDS (1)..(558)
ttgacggaaggcacagatgtgatcctggtacagctggctgctgaggaagcccagaatcccctcattccggaggtcccggagctcgtcatcggccttctggccttcgcgatcgtcttcttcgtcctcggcaagaagctcctcccgaacatcaacaaggttctggaagagcgtcgtgccgcgatcgaaggcggtatcgaagaagccgaggccatgaaggtcgaagcccagagcgtgctcgagcagtacaaggctcagctcgccgaggctcggcacgaggccgcgcgtctgcgccaggaggcgcaggagcagggcgccacgctcatcaccgagatgcgtgcggaaggccagcggcagcgcgaggagatcatcgctgccggccacgcccagctcgaggccgaccgcaaggccgccgcgcaggcgctgcgccaggacgtgggcacgctcgccaccgacctggccggcaagctcgtcggtgagtccctcgaggaccacgcccggcagagccgtgtcatcgaccgcttcctcgacgggctcgaggagaaggccgaggcgactcga

SEQ ID NO: 2873 - DNA, 240 bp, Streptomyces avermitilis
  CDS (1)..(240)
atgtccgctctccagaccctcgccgcggtcaacatccagggcaacctcggtgcgatcggttacggcctcgccgccatcggcccgggcgtcggcgtcggcatcatcttcggtaacggcacccaggccctcgcccgccagcccgaggcggccggcctgatccgccagaaccagatcctcggcttcgtgctctgtgaggcgctggccctgatcggcctggtcatgggctttgtctacccttcc

SEQ ID NO: 2874 - DNA, 807 bp, Streptomyces avermitilis
  CDS (1)..(807)
gtgagtgatgccaagacgctcgccttcgagaccgattgtcatattttcgaagggtgcggtttcccgacccccggtctgcactccttcgtcttcgagccgatcttcacggtcggcggcttcgagttcaacaagccgatcctgttggtactgctgagcacgatcatcgtcatcgggttcttctgggcggccttcaacaagccgaagctgatcccgggcaagctccagatgatcggtgagctgggctacgacttcgttcgtcgtggggtcgtctacgagacgctcggcaagcgggagggcgacaagtacgtcccgctcatggtctcgttgttcttcttcgtctggatgatgaacatctggtcgatcatcccggtcgcgcagttcccggcgacctcgatcatcgccttcccggcgggcctcgcagcggtcgtctatgtgctctgggtgagcctgacgttcaagaagcacggcttcgtcggcgccttcaagaacatcacgggctacgacaagtcgctcggcccggtgttcccggtggtcatgttcttcgagttcctctcgaacctgctcatccggcccttcacgcacgcggtccggctcttcgccaacatgttcgccgggcacgtactgctgctgatcttcaccatcgccagctggtacctgctcaacggcatcggcatcgcctacgccggcgtctcgttcctgatggtcctcgtgatgacggtcttcgagctgttcatccaggcgcttcaggcctacgtcttcatcctgctgtcctgcagctacatccagggcgctctcgccgagcaccac

SEQ ID NO: 2875 - DNA, 411 bp, Streptomyces avermitilis
  CDS (1)..(411)
atgcagtccaacgacgcccgaacgctcctgcactgtgctctgcccaccgctgccgcgggcgtggtgggagtcgcggtcagtgccgccgtggccggtggcaagggtgcgctaggcgccggcttcggcaccgttcttgttctgctgttcatgtgcagcggccttgtggtgctgctgcggaccgcgcgctcgctgccccacctgttccagatgatggggctgttgctctacaccacgcagatcctgctcctgatgatcctgttgaccatcttcaggggcacctcggtgttcaatcccaagtgcttcgccctgaccctgcttgcggccaccctggtgtggatcgctgcacaggtgcgatcccacatgaaggccaaggtcctctacgtggagccggactccgctcggacgccgtcg

SEQ ID NO: 2876 - DNA, 816 bp, Streptomyces avermitilis
  CDS (1)..(816)
gtgatgggcgcgggcctcgccgaagtgtgcgcccgggccgggctcgacgtactggtcacgtcctcgggcgaggacgggctggcccggggccgcggccggctcgaacgctccctcgcccacgccgtccgcaaggacaggatcagcgacacggcccgcgaagagacgctcgcccgcgtctccttcaccaccgacctcgccgccttccgcgaccggcaactggtcctggaggcggcccccgaggacgagcccacgaagctgcggatcttccaggcgctggacagggccgtcgaggacccggaggcgatcctcgccaccaacacctccgcccttcccgtcatgcggctggcccgcgcgaccgaccgccccggccaggtcctcggcctgcacttcttcaacccggcccccgtgctgcccctggtcgaggtgatcggttcgctgctcacccgcgaccgcacccggcgcatcgccgcggagttcgccaccacggtgctcggcaagcaggtcgtccacgccggcgaccgctccgggttcgtggtcaacgccctgctgatcccctatctcctgtccgcgatcaggatgtgcgaggcgggattcgccggcgcgcaggacatcgacaaagcgatgacactgggctgctcgcaccccatgggaccgctggcactggccgacctcatcggcctggacaccgtcgcggccatcggcacggccctgtacgaggagttcaaggagcccacgcacgccgttcccccgctgctgtcccgcatggtcgacggcggcctgctcggcaggaagtccgggcagggtttctacacgtac

SEQ ID NO: 2877 - DNA, 1350 bp, Streptomyces avermitilis
  CDS (1)..(1350)
atgaccctgctgaccgaagcggtacgtgcgggcgcgccgccgcaggagctggagcgcgcgccgctgcccggggagtacaccgccgcgtacatccaggccgaggacgcccggatgttcgacggagtcgccgacaaggacatccgcaagtcgttgcgcgtcggccaggtcccgatgcccgaactggcgccggacgaggtgctggtcgcggtcatggccagcgcggtcaactacaacaccgtgtggtcggcgatgttcgagccggtctccacgttccgcttcctgcggcagttcgcgacgcagggcggttgggcccgacgccacgatctgccgtaccacgtgatcggttccgacggggcgggcgtgatcgtgcgcgtgggctccggcgtacggcgctggggcatcggcgaccacgtggtgatgagctgcgtccagcccgacgaccaggaaccggccacgcaggccgacgggatgctcggcgccgagcagcggatctggggcttcgagaccaacttcggcggcctggcccactacgcggtcgtcagggcaagccagttgatccccaagccggcccacctcagctgggaggaggcggcctgcaaccccctgtgcgcgggaaccgcgtaccggatgctcgtcggcgaccggggcgcccgcttcaagcagggcgacgtcgtactgatctggggcgccgccggcggactcggcgcgtacgcggtgcagctcgtcaagaacggcggcggcatcccggtcggcgtggtcagctcgcccgccaaggcggaggcggcccgcagactcggctgcgacgtggtcatcgaccgccaggacatcggcctcgacgaccgcacggccgacgacccccgtgcggtgatcgaggtgggcaagcggctcgggaccgccatccgcaaacgggtgggggaggacccgcacatcgtcttcgagcacgtgggccgtgccaccttcgcggtctcggtcttcgtggtccggcgcggcggcacggtggtgacctgcggctccagcaccggctaccagcacggctacgacaaccgctacctgtggatgaaactcaagcgaatcatcggcagccacgcggcgaacctccaggaacaatgggagtgcaaccgcctcgtctccctcggccgcatcgtgccgacgctgtccgcggtctatcccctggaggagatcggcgaggccgcccggtcggtccagacgaaccagcacatcggcaaggtcggagtcctgtgcctggcatcgggccccggccagggcgtgacggaccccgaacgccgtgccgacctgggcgaggaacgcctcaacccgctgcgcggactcacaccgacgcgacaggccggc

SEQ ID NO: 2878 - DNA, 501 bp, Streptomyces avermitilis
  CDS (1)..(501)
atgagcgtttctgagaaggaagccgaaacttcggccgagcaggaattcaccaggccgccggccccggagaagatgcgggatctggatttcctgctcggtgatttccgtgcggagtggaccaacttcaccgccgacccggccacgaccggcacggccgcctggaacaccgcgtccaccttccacgggcacgcctacgagatgacgcagcgggtcgaggcgcacgacctcaccggccgcttcgtcgtccagtgggtcgagtcggaatcgtcgttctccggctactactacgacgactggggaaaccgcaccctgctgacctccgagggctggcaggacggttatctcgcgttcaccggagaatgcttcggattcggcaagtccttcctgctcaaggagcagtacgaaatcgtcgacgagaagcactacgtcaaacgcggtttcatcaagttcgacgaaggcgactggatccccgcggacgaggtgcactgccaccgcgaggcg

SEQ ID NO: 2879 - DNA, 11910 bp, Streptomyces avermitilis
  CDS (1)..(11910)
atggcagccgatctgcggcaggcccatcggcgcatcaagaaacttgaggccgacgacaccgagcccatagcgatcgtcgggatggcctgccggctgcccggcggtgtcggctcacccgaccagctgtgggacctcgtccggcgcggtgaggacgccgtcaccggcatgccgacggaccgcggctgggagctcggggagctttacgaccccgaccccgaccacccgggcacctcgtacgccaccgagggtggattcctgcgcggggccaccgagttcgacgcggagttcttcggcgtctccccgcgcgaggcgctggcgatggacccgcagcagcggctgctcctggagaccgcctgggaagccctggagaacaccggtctcgatccgcggtcgctggccggctcgcgcaccggtgtcttcaccgggctgatgtaccacgactacgcctcgggtcccggtgccctgcccgacgaggtcgagggctatctgagcaccggtatggccgcgagtgtggcctcgggccggatctcgtacttcctcggcctcgaggggccggccgtcaccctcgacaccgcgtgctcgtcctcgctggtggcgctgcacctcgccgtgcaggcgctgcgggacgaggagtgcgacctggcgttggcgggtggcgcgacgatcatgtccacccccgccaccttcgtggagaactcgcggcagcgcggcctcgcccgcgacggcaggtgcaagtcgttcgcggccgccgccgacggtgtcggctggggcgagggctccgcgctgctcgtggtggaacggttgtcggacgcccgtcgcaggggccaccaggtgctcgcgatcgtccgcggcagcgcggtcaaccaggacggcgcgtccaacggtctcacctcccccaacgggccctcgcagcagcgggtcattcagcaggcgctggcctcggcgcggctcggcgtcgcggatgtcgacgtggtggaggcgcacggtacggggacgacgctgggtgatccgatcgaggcacaggcgctgctggccacctacggccgggagcggagcgccgagcagccgctgtggctgggctcggtcaagtcgaacatcgggcacacgcaggccgccgcgggtgccgccgggatcatcaagatggtccaggcgatgcggcacgagcagctgccgaggacgctgcacgtggaccgtccgacgcccgaagtggactggtccgagggcgcggtggagctgctgaccgagaaccgcccgtggccgcgcggcgaccgcccccgccgggcgggggtgtcctcgttcgggatcagcggcaccaatgtgcacgtcatcctggaggaaccggcgccggcggatctcgacgcggacggcccggccggggcgagcggctcggccggcgcggacggcccggccggcgcggacggctccgtcacttccatcgcctccggcacctccgacacttccggcgcttccatcgcctccggcgcttccgtcgccggagcgcaggtcgtgccggtggttctgtcggcggccacgcccgcggcgctgcccgcccaggccgcccggctgcacgcgcacctgctcgaccaccccgatctgccgctcgacgacgtggcctgcgcgctcgccacgacccgtaccgccttcgagcaccgggcggtgctgctcgccggggaccgcgcggaactgctggactcgctggccgagctggggcggggaggcagtcccgccgggctggtgagcggactcgccggcgaggtgcgcggcgcgttcctgttcaccgggcagggagctcaacgtcccggcatggggcgggagttgtacgaggcgttcccggcgtacgcccgcgcgctggacgccgtctgtgccgagctggacgcccggctcgaccggccgctgctgccgctgctgctggccgccccggacagcgaggaggcgcggctgctggaccgtaccctctacacccagtcggcgaccttcgccctcggggtggccctgttccggctcctcgaggagtggggtgtgcgtccgcggctgctgtccgggcactcggtcggcgagctgaccgcggcccatgtctcgggcatgctgtcgctggccgacgccagtgaactggtcaccgcccgggggcggttgatgcaggaactgcccgagggcggggcgatggtctccgtggcggcgacctgggacgaggtgctgcccctgctggccgggcacgagtcggtggccggtgtcgcggcggtcaacgggccgggttccgtggtggtgtcgggcgacgaggacgtcgtcaccgccgtcgcggcgcacttcaccggcctggggcgcaggacccggcggctcccggtgagccatgcgttccactcgccgctgatggaccccgtggtcgacccgctgcggcaggtcgccgcccggctgacgttcggtccccctgccattccggtcgtctccagcgtgacgggcaccctcctggagccggccgcgtgggcggacccggcgtactgggcgcggcaggcgcgcgagccggtccgcttccacgacgtggtgcgcgccctcgacgccgagggcgtcaccgtgttcctcgaactcggggccgatgccgcgctcacctccatggccgaggagacgctcgcgtccatggccgaggagacgctcgcggaaaccggcaccgccggcgcggtcgtcgcaccggcgctgcgccgcaaccggccggaggtccgcaccctgacggccctgctggcccaggcgcacacggccggtgtgccggtggactgggcggcgttcttcgccgggcgggcgggacggcgggtgccgctgccgacgtacgccttccagggcacccggtactggctgcgcggcgtgcccggggccggcgacatggccgcggcggggctggcccccgcggaacacccgctgctcggtgccgtgctggtgccggcggccgggggcggccggctgttcaccggcaggctgtccacggacagcctgccgtggctggcggaccacgcgatcggcgacaccgttctgctgccgggcaccgccgtcgccgaactggcgctgtgggccgggacgtacctcggcctcgactcggtcggggatctcacgctggagcttccgctcgtcctgccgtcgagcggcggcctgcgcgtccagctcgccgtgggtgctccggacgagtccggcgagcgtgagttcgccctgtacgcacaggccgaggagtccgccgaggaggtgtggacgcggcacgccggcggcaccctcaccacggctcgtacgcgtcccggagacgagctgacggcctggccgcccgccggggccgaggagctggacgtcgacggcttctacgcggacctcgcggacgccggtttccagtacggcccggccttccaggggctgcgcgcggtgtggcggcggggcgaggaggtgtacgttgaggtccggctgcccgacgaggtggccaccggcgccggggagttcgggctgcatccggcgctcgccgacgccgcactgcacgcgtccgcgttcgtgccgggcgagttcggccgggagcagcggggcaggctgccgttcgcgtggcgcggggtggcgctgcacgcggccggtgcgtcgttcctgcgcgttcggctgacgccgaccggcgccgactcgctctccctgttcttcgccgacgccgccggtgaggccgtggcgacggtggactccctggtggtgcggcccgccgggcggatcgcggcgccggacggtgcctcggacgccttgttcgtgccgtcgtgggctccggtcggcgcggccgagccggagggccgctgggcggtgctcggttcggggccgctcacggggctcgcgggcgccgagcgtcaccccggcctggcggggctcggtgccgcgctggacgcgggtgccgggatgccggagttcgtcgtcgccacggccggcccgtccgagggctcgggtggcgcggacgcggcggacgacctcgccgggcaggagcgcgaccttgccgggcaggcgcacgacctcgccgggcgggcgctggacctggtgcggtcgtggctggccgacgagcggttcgccgactcgcggctggtggcggtgacctggaacgcggtggccgtgggtgagggcgacccgctcgacccggtgcaggcggccgcgtggggcctgctgagctcggcggtgaccgaacacccgggccggatcgtcctcgtggacgtcgacggcacgccgcggtccctggcggcggtgcgctcggcggccggctcggacgaaccccgggtcgccctacgggacggcagggccttcgctccgcgcctgacccgggccgtggcggacgacgccgtggcaggcgacgccgtgccgcgggagatcgatccgcacggcaccgccctcatcaccggcggcaccggcaccctcggcgccctcctcgcccgccacctcgtcacccggcacggggtgaccagcctgctgctcaccagccgacgcggaccccacgcccccggcgccaccgaactcgtagccgaactcaccgcagccggcgcccacgtcaccgtcaccgcctgcgacaccaccgaccccgaacaactcgccaccctcctcaccaccatccccaccgaacaccccctcaccaccgtcatccacaccgcaggcaccctcgacgacgccaccaccacgaagctgaccgacacccaactccacaccgtcctccaacccaagatcgacgcagccacccacctccaccacctcaccctccaccaccccgtcaccaccttcgtcctctactcctccgccgccggacaactcggcaccgcaggacaagccaactacgccgccgccaacacctacctcgacgccctcgcccaccaccgccgcacccacggacaccccgccacctccctcgcctggggcttctggaaccaacgcagcgacatgacagccgaggtcgacgagcagacgcggcgccggatggccggtgccggggtgctgccgatctccgaggagcagggggcggccctgttcgacgcggcgctcgcgctggacgctccggtcgccgtgccgctgccgctggatctcggcgcgctgcgggcgcaggcggccgtgggcaccctgccgccgctgttccggggcctggtgcgggcgccggtgcgccgggcggccggtgcggtcgacggagccggtgcgcaaggggcgttcgcggcccggctgcgggcgctgccgcgggcggaccaaatccggctgctggtggacctcgtacggacccacgcggccaccgcgctcggccatccgacgcccgacgggctggatgcgcggcggaccttccgggagctcggtttcgactccctggccgccatcgagctgcgcaacggcgtgggtgccgcgaccggtctccggctgcccgcgaccctggtcttcgaccacccgacgccgtcggccgtggcggaggtcctgctcggcgagctgaccggcgggcaggaggcgtcgccggcaccccgggcgtccgccgccgtcgagcccggggagccgatcgcgatcgtgggcatggcgtgccgttatcccggcggggtggcctcgccggaggagctgtgggagctggtcgccgcagggcgggacgcgatcggtgacatgcccgaggaccgcggctggaacgtggaggagttgtacgacccggagctggcccggccgggcacctcgtacgtgcgggagggcggcttcctgtacgacgcggccgagttcgacccggagttcttcgggatctcgccgcgtgaggcgctggcgatggacccgcagcagcggctgctcctggagacgtcgtgggaggcgctggagcgggccggcatcgatccgcgggcggtgcgcggcagccggaccggggtgttcgccggggtgatgtaccacgactacggcgccgaccaggccgtactgcccgaggaggtcgaggggttcatcgggaccggctcggccggcagtgtcgcctcggggcggatcgcgttcacgctgggtctggagggtcccgcggtcacgctcgacaccgcgtgctcgtcctcgctggtggcgctgcacctggcggcgcaggcgctgcgcaccggtgagtgcgacctggcgctggccgggggcgtgaccgtgatgtcgacgccgggtgtgttcgtcgagttgtcccggcagggcgggctgtcccccgacggccgctgccggtccttcgccgagagcgcggacggtacgggctggggcgagggtgccgggctcctgctggtcgagcggctgtcggacgcccgccgcaacgggcaccccgtgctggcggtcgtccggggcaccgcggtcaaccaggacggcgcctccaacgggctgaccgcgcccaacgggcccgcgcagcagcgggtgatcgaacaggcgctggcgaacgcgcggctcggtggcgccgacgtcgacgtggtggaggcgcacgggacggggacgacgctgggcgatccgatcgaggcgcaggccctgctggccacctacggccgggagcggagcgccgagcagccactgtggctggggtcggtgaagtccaacctgggccacacgcaggcggcggccggggccgcgggcatcatcaagatgatcatggctatgcggtacggggtgctgccgaggacgctgcatgtggaccggccgtcgcccgaggtggactggtccccgggcaccgtggaactgctcaccgaggagcgggagtggccggacgcgggccgtccgcgccgggccgccgtgtcctcgttcgggatcagcggcaccaacgcccatgtcatcctcgaacagccgcctgccgacgacgagcccgggacatccgggacggttccgggcggcgtggtgccgtgggtgctctccgggcacgaccgggccgcgctgtacgcccaggccgagcggctcgtcgcgcatgtggcggcgcgtcccgagctgtccgtggccgatgtcggcaggacgctgacgggccgggcccggctgtcccaccgcgcggtggtgctgggcggcgaccgggacgagctgctggccgccgcggccgggctggcgcgccgggccggggagccggacgaggcgctgccgccgggtgtggtcgaggggtccgtgctcggcgacgaccgcgtggtgttcgtcttccccggccagggcgcccagtgggcggggatggcggcggaactgctggtctccgcaccggtgttccgggcccggatcgaggagtgcgaggaggcgctgcgcccgtacgtcgactggtcgctgctcgccgtcctgcggcaggagccgggcaccccgccctgggaccgggtggacgtggtgcagcccgcgctgtgggcggtgatggtgtcgctggcggcgctgtggcgttcgtacggcgtcgaaccggacgcggtgctcgggcactcgcagggcgagatcgcggccgcctgtgtctgcggggcgctggacctcgccgacggcgcccgggtcgtcgccctgcgcgccagggcgatcggctcgacgctcgcggggcggggcgggatggtgtcggtggcgctgccgtcggcggcggcccgggagctgatcgccgggtggccggggcgcgtctcggtggcctcggtcaacggtcccgtcagcaccgtggtggccggtgatcccgacgcgctcgacgaactgctcgcccgctgcgccgacgacggcgtgcgggcccgtcgcatcccggtcgactacgcctcccacacatcccaagtggcggagatcgagggcgacctggccgccgaactggcggggctgacgccgcgttcgtcggcgatcccgttcttctccaccctcaccggggccccgctcgacaccgcgaagctggacgccggctactggtatcagaacctgcgtcacaccgtggagttcgaggcggcgacccgcgcggcactcgaccagggcttcaccgtcttcgccgagatcagcccgcaccccgtgctggtgccctcggtccaggacacgatcgacgatacgggccggaccgcggtggcggtgggctcgctgcgccgggacgacggcggcgcgcggcgctttttcacctcggccgccgagctcggtgtgctgggcgtcggcgtcgactggccggcggtgttcgacggcaccggggcccggcaggtggacctgccgacctatgcgttccggcgccgccggttctggctggagtcccgccgcggcgcgggcgatctgtccgcgaccggtctcgaggcggcgggccatccgctcctcggcgcggccgtgtcgctggcgggcggcgagggcgtgctgctcaccggccggctgtccgggcgtagccatccgtggctgctcgaccacgccgtctccggcacggtcctgctgcccgggaccgccttcgtggacctggcgatccgggcgggcgaccacctgggccgtccccatctggaggaactgaccctccaggcaccgctgttgctgggctccggccccaaggacgaggtcacggtgcaggtccgggccaccccggacggcgagacgggcacctgcacggtcaccgtccactcccgtaccggcgaggacgactggacgctgcacgcgaccggcaccctcggcctggacgcgcccgaggaacccgcgccggatccggcgtggccgccggccggcgcggagccggtcgacacggagggcgtctacgacggactcgccgagggcggctaccactacggccccgccttccagggcctgcgcgcggtgtggcggcgggacggcgagctgttcgccgagatccggctgcccgacggcgagcgggaggaggccgcgcactacggcgtccacccggccctgctggacgccgcgctgcacgccatggtgctcgccggcgaccaggaggcgggcgtgaagctgccgttctcctggaccggggtgcacctgtacgcgaccggcgccaccgcggcccgggtgcggctcaccccgtccggggaccagctcgcgctgctgctcaccgacgagacgggccgcccggtcgtctcggtacggtcgctggtgaccaggcccgccgccctggccgcccccggccggtccacgggcggcgcgctggaggaggcgctgctccacctccactggacccccctgaccgtcacggttgacgagccggccccgtcgtacgcgctggtcggcgccgacctgttcgggctggcgggcgaccgtgccggcgtacgggtgggggcggatctcgacgagctgggcgcggccgacgggccggtcccggacatcgtggtgcactgcctcgcccccggtgcgccgggcgatcccgcggcggcggcgcacacggccgcccaggagacgctcgaccgggtccgtgcctggctggccgacgagcggttcggctccgcgcggctggtgttcgtgtcctcgggcgcggtcgcggcgggcgacgacgaggatgtcaccgacctggggaacgcggcgagttggggcctggtgacctcggcggtgtccgagcacccggaccggttcgcgctggtcgacctggacggcacggccgagtcccgggaggtgttcgcggcggcgctggggtgcgcggagccccggctcgcgatccgcggcggcacggtcacggcgccccggctggcccgcgcccaggcgcatccggcgctgctgccgccgcccggcccgacgccgtggcggctggagagcaccggccgcggcacgatcgagaacgtggcgctggtcccctgccccgaggtcctggacccgctcggtcccggccaggtccgtatcgccgtccacgcggtcgggctgaacttccgggacgtcgtcgtcgcgctcggcatggtcgaggggcagaacggcatcggcggcgatgtcgccggaacggtcctggagaccggtgccggggtgggcaacgtcgcggtgggtgaccgggtgctggggctgtgctccgactcgttcgggccggtcgcggtgtgcgaccaccgttttctggccccgatgccggacggctggtcgtacgagcaggcggcggccgttcccatcacgcatctcacggcctactacggtctggtggacctggcggacgtgcagccgggcgactcggtgctggtgcacgcggcggccggcggggtcggcatcgcggccgtgcagctggcccgtcatctgggcgccgaggtctacggcaccgccagccccggcaagtggcggacgctgcgcgaccacgggctcgacgccgggcacatcgccaactcacggaccctggagttcgagcagtggttcatggagggcagcagcggctgcggcatggacgtcgtactggactgtctggccggtgagttcgtcgacgccgggctgcggctgctgccgcgcggcggacggttcctggagatgggcaagaccgacaagcgcgacccggcgcgggtcgccgccgcgtacccgggcgtggcctaccaggcgtacgacctgatggaggcgggccccgaccggatccaggagatgctggtcgcggtgctggagctgtaccgcgccggggtgctggtgccgccgccggtcaccacgtacgacctgcgccgggcccgtgaggcgatgcgggacctgagccaggcgaagctggtcggcaaggccgtgctcaccgtgccgcgggggatcgatccgcacggcaccgccctcatcaccggcggcaccggcaccctcggcgccctcctcgcccgccacctcgtcacccggcacggggtgaccagcctgctgctcaccagccgacgcggaccccacgcccccggcgccaccgaactcgtagccgaactcaccgcagccggcgcccacgtcaccgtcaccgcctgcgacaccaccgaccccgaacaactcgccaccctcctcaccaccatccccaccgaacaccccctcaccaccgtcatccacaccgcaggcaccctcgacgacgccaccaccaccacactcacggacacccaactccacaccgtcctccaacccaagatcgacgcagccacccacctccaccacctcaccctccaccaccccgtcaccaccttcgtcctctactcctccgccgccggacaactcggcaccgcaggacaagccaactacgccgccgccaacacctacctcgacgccctcgcccaccaccgccgcacccacggacaccccgccacctccctcgcctggggcttctggaaccaacgcagcgacatgacgggccacttgggcgacgccgaggtggaacggatggagcgggcgggcatgcggccgctggacaacgaggaggggctcgcgctgttcgacctggcgtgcggggccgacgtaccgctccaggtgatcacccggctgacggcgtcggcgctgcgggccgacccggacagcgttccgccgctgttccgcggtctggtgcagggcacctcgcggcgggtggtgcggtccggcggcgacggggccgagctgcggacgcggctgaccgggctgcctccagccgagcagcttcgcaggctgctggacctggtccgttcgaacgcggccaccgtgctcggccacgcctcggccggggcgatcgcggcggagcagtccttcagcgagctcggcttcgactcgctgaccgccgtggagttccgcaaccgactcggcgcggccacgggtctgcggctgccggccacgctcgtcttcgagcatccgacgccggccgcgctcgccggggaactgctcacgcagctcgccccggccgggctctccggcgccgaggccgccctctcccaggtcgacgccctggaggccgccctcgcggcggtcaccgctgacgacggggaccgcgaccgggtcacccggcggctgcgcgggctgctggcgcagtggagcacgggcgatgccgaaccggccgcggcggacgccctcgacgacctcgacgcggccagcaccgacgacctcttcgacgcgatcgaccaggggttcggtctc

SEQ ID NO: 2880 - DNA, 5721 bp, Streptomyces avermitilis
  CDS (1)..(5721)
atgtccgacgaggagaagttccgcgactacctcaagcgggccgtcaccgaggcacgcggactccagcgccggctgcgcgaggtcgaggacaaggcgcgcgagccgatcgcgatcgtcggcatggcgtgccggttccccggcggggcccagaccccggaagacctgtggcacatggtgtccgagggcgtggacgcgatctcgggcttccccgacgaccgcggctgggacctggaccggctgtaccgcaccgacgccgaggagtccggcgcctccaccacactggagggcggattcctgcacggcgcgggcgagttcgacgcggacttcttcgggatctccccgcgcgaggcgatcgcgacggacccccagcagcggctgctcctggagacctcgtgggaggcgctggagcgggccggggtggacccgcgatccctgcgcggcagcgtcaccggggtgtacttcggcggtacgggcggggacttcgccggtctgctggccgcgtcgccgcaggcactggacggctacatgctgaccggcacctccagcagcgtgctctccggccgggtctcgtacgtgctcggtctggaggggcccgcggtcacggtggacacggcctgctcgtcctcgctggtctccatgcatctggccgtgcaggcgctgcgcaaggacgagatctcgctggccctggccggcggtgtctcggtcctcgcgacgcccggcgcgttccccgagttctcccgccagggcgggctggcctccgacggccgctgcaaggcgttctcgtccgacgccgacggcaccggctggggcgagggggtcggtgtcctcgtcctcgaacggctctccgacgcccggcgcgccggacacccggtgctggccgtcgtacgggagaccggcatcaaccaggacggggccagcaacggcctcaccgcgcccagcggccccgcgcagcgccgcctcatcctgcgcaccctcgacgacgccgggctggccaccgcggacatcgacgtggtggaggcgcacggcaccggtacgaaactcggtgaccccatcgaggcacgagcgctgctggccacctacggccaggaccggccggccgaccggcccctgtggctgggctccatcaagtccaacatcggccacacccagtacgcggccggcgtcagcggcgtgatcaagacggtcatggcgctgcggcacggcgtcatgccgaagaccctgcacgtggacgagccgacgccgcacgtggactggtcctcgggtgcggtgcgactgctgaccgagaaccgcccgtggcccggccacggccgcccccgccgggccgccgtgtcctccttcggcgtcagcggcaccaacgcgcatctgatcctggagcaggcgcccgaagcggccggggcgacggactcggcaacggactcggagacggagtcggagtcgcagtcgaagtcggaggagcacggtgcggtcgtgacgccgccgttgatcccctgggcgatctccgggcggggtgaggccgcgctgcgtgcgcaggcccagcggttgctggaccgtctctcggagcgtcctgacctggagccgctggacgtgggcctcgcgctggcgcggacgcggtcggcgttcgagcagcgggcggtggtgctgggagccgaccggacggaactggtcgcggggttgcggtcggtggccgagggggccgccgtcggcgccggcgtggtggcggggcgtgccgccgagtcaggtgtggtgttcgtgttcccgggtcaggggtcgcagtgggtggggatggggcgggagttgtgggacgcctcgccggtgttccgtgcgcggatggaggagtgcggccaggcgctgagtccgtacgtcgactggtcgttgagggatgtggtgttccgggacgcgggggatccgttgtggtctcgggtggatgtggtgcagccggtgttgtgggcggtgatggtttcgctggcggcggtgtggcgttcgttcggggtggagccggccgctgtcgtggggcattcgcagggtgaggtcgctgcggcgtgcgtggccggtggtctgtcgctggaggatggcgcccgggtggtggcggtgcggtcgcggctggtgctggagaagctgtccggtaagggcggcatggtgtccgttgcgctgccggtcggggacgtcgaggagcggctggcgcggttcgagggccggatcggtgtcgcggccgtcaacgggcccacctccgtcgtcgtctccggtgagcccgacgcactcgacgaactcctcgcggaatgtgaggagtcgggggtacgggcccgtcgtatcgcggtggactacgcctcccactccgcgcaggtcgacgccctcaacgacgacctgctcgccgaactcgccgacatccggcccaagtcgtccaccgtcgccttccactccacggtgaccggcgagcaggtggacacctccgggctcgacgcccgctactggctgcgcaacatgcgggagaccgtcgccttcgaggccgcggtgcgcgccaccctcgacgaggggcaccggaacctgctggagatcagcccccatcccgtggtgaccatggccgttcaagaggtcatcgacgcggcgggcgtcatggcccaggtgtccggctccgtgcgccgcgacgagggaggcctcggccggctgctgacctcgctggccgaggcgtacgtcgcgggcgcgcccgtcgactgggcgcgggtgttcgacggcaccggcgcgcggccggtggacctgcccacgtacgccttccagcggcagcggtactggctgcgcctgccgtccgccgggtccggcgacgtgacgtccgtcggtctgcgctcccccggacatccgctgctcggggccgccgtggagcccgccgagtccgacggcctcgtactgaccggccgggtctccctgcgcgagcacccctggctggccgaccaccgggtcatgggcacggtcccgctgccgggaaccgcgttcgtggagctggccgcgacggcgggcgacctcgtcgagtgcccgcacatcgaggaactgaccatgcaggcccccctcacgctgcccgagaccggtggcctggacctccagctcacggtgagcgcaccggacgagaccgggcggcgcgagatcgggttcttcgcccgcgcggacgacgagatcgcggcggccgcctggacgcggcacggcacgggcgtcctgtgcccggccggtcccgtaccggaggcggcaccggccgtctggccgccgcgcggtgccgagccggtcgaactcggcgacctgtacgggcagttggcggacgggccgttcgcctacgggcccgccttccatgggctgcgggctgcctggacccgggaccggaaggtcttcgcggaggtacggctcccccaggaactgcacgagcaggcgggtgagtacctgctgcatccggcgctgctcgacgcggcgctgcacgcggtgggcctgggcgaactgctggacaccggcgggcagccgctgcgcccgttcgcctggaacggtgtgtccgtgcacgccaccggtgccaccgctttgcgggtgaccctgacgccggcgggggcgaacgccgtgtcgctgtacgccgccgacggcaccggtgccccggtcgtcacggtcggttcgctgctgctgcggccggtcgacgtgacggagccgggggcccggccgccggccgccgcgcactcctcgctgctgtccctgacgtggacgccggttccgttgcccgccgtcggtgccgtgccctgggcggtgctgggggaccggccgtcgtgggcgggcccggactccggtgccgtgtgccacgccgacctggacgcgctcgcggcgtcggtcgccgcgggtgaccccgtgcccggcttcgtcgtcctggatccggcggccgggggccgcgacgacgacgggcatcccgccgtcgcccgggaacgtgccgcgcgggtgctggagtcggcgcgggcgtgggtctccgaggacctcgacgaacggctcgccccggtgccgctggtggtggtcaccagggacgcggtgggcacctcggcggacgatccggtgaccggcctcggctccgccccgctgtggggcctcgtgcggtcggtccagtcggagaatccggggcgtttcgtgctgctggacaccgacggcgaccccgagtccggacggtccgtgccgggcgcggtcgcgtcgggagaacccgagatcgcgttgcgcggcgggtccgcgctggtcccgcggttgagccggatggcggtcaccgagctccccgacccgacgcccggtacgcggcccggtacggggggtacgggactcgacgacgtgcccggtacgggactcgacgtgcccggtacgggactcgacgcgctcgacccgtcccgcacggtgctcgtgaccggggcgacgggcggtctgggcacgctggtcgccggccatctcgccgaacggcacggcgtacgccacctgttgctgctgagccggcgcggcccggaggcggagggcgccgaggagctggtcggccggctggagaagctgggcgccacggtgacgctggtcgcctgcgacgccgcggaccgcgaggcgctggccgccgtactcgccgggattcccgccgcacatccgctgaccgcggtggtgcactgcgccggaaccgccgagaacgcgctgctggcagcgctgaccccggagctgatcgaccgggtcttccgcgccaaggtggacgcggcggtgcatctgcacgagctgaccgagggcctggacctgtccgccttcgtcctgttctcctcgatcgcgggcaccctcggcggcaccgggcagggcaactacgcggccgccaacacgttcctggacgcgctcgcccggcaccggcgcgggcgcggtctgccggccacctcgctgggctgggggctgtgggcggccgagcgcggcatgggcggcggtctgaccgacgcggcctcggcgggcactcccatgcgcggggtgtccgcgctgccctccgacgagggcctcgccctgttcgacctcggctggcgctgcgccgagcccgtggtgttccccgctcgcctcaacggggccgcgctgcgcgcccaggccgccgccggctccctgccgccggtgctccgggggctcttccgcggcccggcccggcggacggcggaggccggcggtcaggactcgggcgcccaactgcggcgtcggctcgcggagctgatgccggtcgagcggcaggagaccctgctggccctcgtacgcgaccggatcgccgccgtgctcgggcacgcctcctcggaccggatcgagacggaccggccgttccgcgacctcggcttcacctcactgaccgcggtggagctgcgcaaccggctgaacgcggcgaccggactccgactgcccgtgagcctggtcttcgactatccgacgctgggcgaactggtggagttgctggcggggaagctggtcccggacggcaccgaaccggccgcgcggcccgaggacgaccgggaggcggccgtgcgccgcaccctgctgtccatcccgctcgcccggctgcgcgagcacggactgctcgacacgctgctggccctcgccgacgacggcggggcgcagccggaggcggccgaccgcagcgacgagatcaagtccatggacgtggccgcgctgctcgccatggccaggagcaccaccgcgagctccaccgcgagcaccaccgctcaa

SEQ ID NO: 2881 - DNA, 1212 bp, Streptomyces avermitilis
  CDS (1)..(1212)
atggccgaagcgccttccgagcccatcgcgttcccgttccccgacccgccgtcggtctgcgagctgcctcccgagctggcggagatccgcgacggccagtccgtggtggaggtgaagttccccgacggcatcagcggatggatggtgaccaagcacgccgatgtccgcaaggtgctggtcgactcccggttcagcagcaaggtgatggccaccgcggccgccgcgatgtcggagaccgagaccggcaagctgatgaacgagtcgctcgtcggcatggacgcgccggagcacacgcggctgcgcaagctggtgaccaaggcgttcaccgcgaggcgggtggagacgctgcggccccgcatcacggagttggtcggccagctgctcgacgagctggagacgctgccccgcccggtggacctggtcaagaacttctccgtgccgctgccggtccgggtgatctgcgaactcctcggcgtaccggccggggaccaggacaccttccacgcctggtcgaacgcgctgctcggggactggcagcaggtggtggagaaggaggccgcgacggtctcgttggtgaactacttcggcgaactcatcgcggtgaagcgggagaatcccgccgacgacctgatcagtgagctgatcgcgatcagcgacggggacagcacgctcaccgagcgcgagatcatcgcgctgagcatcggcattctcagcgcgggccacgagacgaccgccaaccagatcagcatgttcctggtgacgctgctgcacaatcccgaggagctcgacaagctgcgggacaaccgcgaggcgatcccgaaggccgtcgacgagctgctccgcttcgttccgctcaccacgaccggcggcatcattccccggctcaccacggcggaggtggagctgagcggcggccaggtgctgcccgccggcgcggtggtcctgcccgcggtcgccaccgcgaaccgggaccccgaggtgttcgaggacggcgagcggctgaacgtgacgcgggagaacaatccgcatctggccttcggcgccggtatccaccactgcctcggggcgcagctcgcccgcatcgagctccaggaggcgctcggcgcgatcctggaccggatgccccaggtgcggctcgcggtgccggagtcggagctgcggctcaagtccgcgtcgatcatccgcggcctcgagagcctgcccatcacctgg

SEQ ID NO: 2882 - DNA, 10839 bp, Streptomyces avermitilis
  CDS (1)..(10839)
atgaccgaggacaaactccgtacctatctgcgccgagtcacggccgaactgcaacagactcgacagcagctccaggacagccaggaccgggcgcgggaaccgctcgccgtcgtgggaatggcctgccggctgcccggcggcgtcgactcacctgagcagctgtggcagatggtgatggacggtgccgacggggtgagcggattccccgacgaccggggctgggacctctcctcgctcttcgacagcgaccccgaccggccggggacgacgtacacccgggaaggggcgttcctgcgcggcgcgggcgacttcgacgccggcttcttcgggatctcgccgcgtgaggcgctgaccatggacccgcagcagcggctgctcctggaaacgtcgtgggaggcgctggaacgggcgggcatcgacccgcacacgctgcggggcagccgaacgggggtgttcgtcggcggtacggccatcgagcacacggtcaagctgatgaactcgccgaccgaccagggatacgcgatcacgggcggctcggcgagcgtgatgtccggccgggtgtcctacgtactcggtctggagggccccgcactcacggtcgacacggcgtgctcgtcctcgctggtcgccctgcactccgccgctcagtcactccgccagggggactgctcactggcactggccggcggcgtcgcggtcatggccacctcctcggcgttcgtgaccttcgcccggcagcgcggcctggccgcggacggccggtgcaaggccttctccgacgacgcggacgggatcggctggggcgagggcgccgccgtcgtcctgctggaacgccttgcggacgcgcggcgcaacggtcaccccgtcctggcggtgatccgcgggtcggcggtgaaccaggacggcgcgtcgaacggtctgagcgcgccgaacggtccctcgcagcagcgggtgatccggcaggcggtcgccaacgccggactggcgctggcggacgtggacatggtggaggcgcacggcacggggacgtcgctcggcgacccgatcgaggcacaggcgctgctggccacgtacggccaggaccggcacgacggccggccgctctggctcggctcgctcaagtcgaacatcgcgcacacccaggccgtctccggtgtcgccggtgtgatcaagaccgtgctcgcgctgcggaacggcgtactgcccaagaccctgcacgtcgggaagcccagcacccaggtggactggtcggcgggtgcggtggagctgctgacggaggggcgggagtggcccgagacgggcggtccgcgccgggcgggcgtgtcctcgttcggtatcagcggcacgaacgcccacgtgatcctcgagcaggcccccgaggaggactccgccgagccgcagccggtcgacgcgccggagccgcccctcaccacgagccccgccaccgtgccgtggctgatctccgggcagacggaggcggccctgcgggcgcaggccggacgacttcaggcacacctcgacgcccaccccggcctcggaaccgcggacgtggcccactcactcctggcgagccggtcgaaactcgcgcatcgcgcggtgctgttcgccggacagggcgcacgtagcggagaccggcccaccggactcaccgccctcgcggacggactcgacgtgcccggcctggtccggggaaccggcgacgccggaaccggtgtggtgttcgtgttcccgggtcaggggtcgcagtgggtggggatggggcgggatttgtgggacgcctcgccggtgttccgtgcgcggatggaggagtgcggccaggcgctgagtccgtacgtcgactggtcgctgaggaatgtggtgttccgggacgcgggggatccgttgtggtcccgggtggatgtggtgcagccggtgctgtgggcggtgatggtgtcgctggcggcggtgtggcgttcgttcggggtggagccggccgcggtcgtggggcattcgcagggtgaggtcgctgcggcgtgtgtggcgggtggtctgtcgctggaggatggggcgcgggtggtggccgtgcggtcgcggctggtgctggagaagctgtccggcaagggcgggatggtgtccgttgcgctgccggtggagggcgtcgaggagcgtctcgcccggttcgagggccggatcggtgtcgcggccgtcaacgggcccggctccgccgtcgtctccggtgagcccgacgcactcgacgaactcctcgcggaatgtgaggagtcgggggtgcgggcccgtcgtatcgcggtggactacgcctcccactccgcgcaggtggatgccctcaacgacgacctgctcgccgaactcgccgacatccggcccaagtcgtccgccgtcgccttctactcgacggtgaccggggagcggctggacacctccgggctcgacgcgcggtactgggtgacgaatctgcgggagcgggtccggttcgagccggtggtgcggctgctcgccgaacaggaataccaggtcttcgtcgagtccagcccccaccccgtactgaccgtggcgatccaggaaacccaggaaggcgtgttcggcaccggtaccgctgtggggtcgctgcgccgtgacgagggcggtgcggaccgcttcctgacgtcgctcgcggaggcttacgtggcgggcgctcccgtcgactggtcggtgctgttcgccgggatgccggtgcgccgggtcgatctgccgacgtacgccttccagcacgagcgctactggatcgaggacgtggtggcgcccggtgcggacggcgtcgtcgatccggtggacgcggccttctggggcgcggtggagaacgcggacctccaaggcatggccgcgctcgtcgacggcgcggagcctgaggtgtgggagccggtggtcccggcgttgtcggcttggcgccgggggcgtcaggagcggtcggtgctggattcgtggcggtatcggacggtgtggcgttcggtgacggtgccgtcggtgggccggttgtcggggacgtggctggtggtgacgccgggtggcgcggggccggtcgaggaggtccggcgggcgctggaggcggccggcgccgaggtcgtcgtactggcgtgggaggcggaggagggccgtgaggctctggccgggcgccttaccggagccggtgaggtgtcgggtgtggtgtcgctgttgggttgggatgaggaggccgcgcctgtcgcgacggtgacgctcgtccaggctttggcggatgccggggtcgaggcgccgttgtgggtgttgacgcagggtgccgcgtcggtgggtgcggaggatgtggtgcacccggtgcagacgcaggtgtgggcgctgggtcaggtggccggtctggagcagccgggcagttggggtggtctggtcgatgtgccgggggtgtgggacgagcgggttgcttccgggctgactgccgtgttggcggcgggggagggtgaggatcaggtagcggtgcggtcgtcgggtgcgtatgcccggcgtctggtgcgggctccgctgggtgcgaacccggcacccgtacgcgactggaaccctcacggcacggtgctgatcaccggcggcaccggtggcatcggtgcgcatctggcccgttggctggcgaaggagggcgccgagcgtctgctgctggtcagccgtagtggcgagcaggcagaaggtgctgccgaactggccacggagttgggcggtttgggtgcggaggtgacgttcgccgcgtgcgacgtgagcgaccgcgacgccctcggccacgtgatcgccggcatcccggcggagcaccccctcaccgccgtcttccacaccgccggcgtatccggttacgcggaactcgccaccgccacccccgagcactacgagacggtcctttccgccaagacgcggggcgcccgcaacctcgacgccctgaccgcggagctgaccctggaggcgttcgtcctgttctcctccggcgccgccgtgtggggcagcgcgggaaccggtgcgtacgccgcggcgaacgcctatctggacgggctggcgtggaaccggcgggcgcgcggtctggtcgcgacgtccgtgtcgtggggcggctggaaagccaccggcatggcggccgacggcaccgaggagcagttggcgcgccgcggtgtgcgggcgatggaaccggcactggccatcaaggccctgcgacaggcgctggagcaggacgagacggcgctgaccgtcaccgacatggactgggcgcgcttcacccccggctacaccatcgcccggcgccgcccgctgatcgaggacatccccgaagtcgcccgcgcgctgagcgaggactccgagcccgcgcccgacgacggcaccgactccgccctgcgccagaccctggccgggctcaccgcccccgaacagcacgaccggctgctcgaactcgtccgctccgaagcggcgaccgtgctcacccaccggacgacggacgacatcacggccgggcggccgttccgggacctcggattcgactccctgaccgcgatggaactgcgcaaccggctgaacacggccaccggcctgcgcctgcccgccaccctcgtcttcgaccaccccacaccgcagcgtctcgccgggcacctgcacgagaagctcttcgacagcgccacggagacggcactgccggtcctgcggacgaccgacgacgacccgatcgtgatcgtgggcatggcctgccgcttccccggcggggtgcgcggtcccgaggacctctggcgtctgctcgtcgacagccgcgacgagatgacggacttccccgccgaccgaggctggcacggcctggccatgaacgccttcatcgaggagtccggcggagcccggcagggtgccttcctggccgaggccggcgacttcgacgcggcgttcttcgggatctcgccgcgtgaggcactggcgatggatccgcagcagcggttgttgctggagacctcgtgggaggcgctggaacgcgccgggttcgatccggtcggcctgcgcggcagccgcaccggcgtcttcgtcggcggcaccccgcaggagtacacgaccgtcctgatgaactcgtccgaggcaggcggcggttacgccctcaccggggcgtcgggcagcgtgatgtcgggccgggtcgcctatgccctgggcctggagggcccggccgtcacggtcgacaccgcgtgctcctcctcgctggtcagcctgcacctggcagggcaggcgctgcggggcggcgagtgcgacctggcgctggtcggcggtgtgaccgtcatggccacgccgggagccttcgtcgagttctcgcggcagggcggtctcgcgggagacggccggtgcaaggcgttcgccgccggtgccgacggcacgggctggggcgagggtgtcgggatgctggccgtgcagcggctttcggacgcggtgcgggacgggcgtccggtgctggcggtggtgcggggttcggcggtgaactcggacggtgcgtcgaacggtctgacggcgccgaacggtccgtcgcagcagcgggtgatccggcaggcgctcgcttcggccgggttgtcggcggcggacgtggacatggtggaggcgcacggcacggggacgtcgctcggcgacccgatcgaggcacaggcgttgctggcgacgtacggtcaggaccgtccggcggaccgtccgctgtggctgggttcggtgaagtcgaacatcggccacacccagtacgccgccggtgtcgccggtgtcatcaagtccgtactggccctgcgcaacggcctgttgcccaagaccctgcacgtggacgagccgacccccgaggtggactggtccgcgggcgcggtggagctgctgacggaggggcgggagtggccggagaccgacgggccgcgccgggcgggcgtgtcctcgttcgggatcagcggcacgaacgcgcacgtgattctggagcaggcgccgtcggtcgaggaacggacgccggtgtctgcggttgacgggttgctggtgccgtgggtggtgtcggcgcggtcggaggaggcgttgcgggcgcaggcccgacggcttgccgaccacgtacgggggagcgatctgcggccggccgacgtgggtctgtcgttggcggtgacgcgtgcgggtctggagcaccgggctgttctgacggggcgggatcgggaggacttcctggtccagttggccgcgttggcggagggtgcgggcgcggcggggatggtgcggggtgtggccggggagggcgggacggcgttcctgttcaccggtcagggtgcgcagcggcttggtatggggcgtgagctgtacgagcgtttcccggtgttcgcggctgcgttcgacggggtgtgtgcgcagttggatctgttgctggagcggccggtgaaggaggtcgtgttcaccgatgcgccggcgttggaccggacggtgttcacgcaggccggtttgttcgcgttggaggtggcgctgttcgagctggtgggttcgtggggtgtgcgggcggatgtgctgctggggcattcgatcggtgagctggcggcggcgtatgtggcgggggtgtggtcgctggcggatgcgtgccggatcgtggcggcgcggggccggttgatgcaggcgctgccggagggcggtgcgatggtcgctgtcgaggcggccgaggacgagctgccggtgcttcccgggggtgtgtcggtggctgcggtgaacgggccccgttcgctggtgctgtccggtgatgaggagccggtgaccgcgctcgcccaagcgtttgctgaacagggcaggcggaccaagcagttggcggtcagtcacgccttccactccgcgcggatggagccgatgctggcggagttcgcggagacgctcgccgcggtggagttccgtccgccgcgtatcccggtggtgtcgaatgtgacgggtgggatggcggacgccgagttcaccactcccgcctactgggtgcggcatgtgcgggaggccgttcgtttcgccgatggtgtggcgacggtgctggcgcggggtgtggacaggttcctcgagctgggtccgcggggtgcgctgaccgcgatggccgaggagaccctcgaccacaccggcgccgacgccgtgtgcgtgcccgtactgcaccccgaacgccccgaagcggactgcctgaccctcgcgctcggccggatccacgcgagcggtgccccggtcgactggtccgggctgttcgccggcaccggcgcccgcaccgtcggactgcccacctacgccttccagcacaagcgctactggctggactcgcgcacgaccggcagcggcgaccccgcgagcatcggactgacggcgaccggacacccgctgctcggcgccggagtggcgctgcccgactcggacggattcctgttcaccggcaggctctccctggccacgcagccctggatcaccgatcacgcgatgctgggcaccgcgctgctgccgggtaccgcgttcgtggaactcgcgctgcgcgccggcggacaggtgggctgcgagctgatcgaggaactcaccctggaggcaccactggtgctgggcgagcagggcggtcgcgccgtccaggtgctggtcggcggcctcgacgagaccggccggcgcgccatcaccctgcactcgaggcccgacggcgaaggcgacgaccagccctggctgaggcacgccagcggcgtactcgccgagaacacgggagcggaacccgacgcggagccgatgacggtatggccgcccgacggctccaccgccgtcgccgtcgaggacttctacccggacatggccgaggccggattcacctacggcccggtcttccagggcctgcgggcactgtggaccaaggacggagacctgtacgccgaggttcggctccccgaggaggcgggcgacgccgacagcggtttcggagtgcacccggccctgctggacgccgcactccagccactcgccctgggcgtcctcggcggcacccccgaccgggaggcggtcaagggaggcatgccgttcgcctggaccggagtacgactgcacgccacccacgccaccgtcgcccgcgtccacctcgctccggtgggccggggcgaagtgtccgtcctggtcaacgacgagtcaggactgccgatcgccacggtcgggtcgctcacgatgcgggaccccgcgctggaacagttcaccgcctccgcaccccgccaggacgcgctgttcgacctgaagtggaccccggtgcccctcggctcccgagaggtctccggcgaatgggcgatgctcggcttcgacccgctggagatccgcccgcggctcgtcgaagccggcctgaccgggacgccgtacctcgacccgcaatccctgatcgacaccgtggagtcgggcaagcccgccccctccgtggtggcgatgtcctgcttcggcggggaccagggcggcatcgtcgccgccacccatgacgccgtacaccgggtactggaggtcattcagcactggctcgccgacgaacgcctcacaggctccaagctgttgctgctgacccggggcgccgtcccggccgccggcacggaccgtaccgaggacgtggcggcctcggccgtgtggggcctggtgcggacggcacagtcggagcacccggaccggatcgtcctgatcgacctcgacgacgaccccgcctcctaccgggccctgcccaaggcgctcggcaccggtgaaccgcaactcgccctgcgcgccggctcgccctgcgtgccccggctggccaggcacaccggaccggcggacggcgcccctggcttcggccccgacggcaccgtgctggtcaccggcggcaccggagcgctcggcgcggtggtcgcgcgtcacctcgtgaccgcacacggcgtccggcatctggtgctggccggccgccgcggcgagcgcgcgcccggcgcggccgccctgctggccgaactcaccgaactcggcgccgacacccgcatcctggcctgcgacgtctcggaccgggacgcactcgccgtgctgctgcgggacatcccggccgaccggccgctgaccgcggtcgtgcacaccgcgggtgtgctggcggacggcacggtcgagtcgctcaccccggaccggttcgacaccgtcctgcgggccaaggccgacgcggcctggcatctgcacgagctgacccaggacgccccgctgcgggagttcgtgctcttctcctcggccgccggactgctcggcagccaggggcagggcaactacgcggcggcgaactcgttcctggacgccctcgccgcgcaccgccgcgaggccggactgcccggcaccgccctcgcctggggctggtgggagcagcccggcggcatgggcggcgacctcggccgggccgaacgcgcccggatggcccgcggcggggtcacccccttcaccgccgagtccggcatggaggccttcgaccgggccctcggcgccggccaggaagccctcctcgtaccgatgcggctgaacaccacggcggcgcgggcggcgagcgagcagcaggtacccccgctgctgcgcggcctggtgcgcgctccgcagcggcgggccgcccggtccgacgtacgggccacctcgcacctgcacgagcaactggccgcggcggaccaggcggaacggcaggccctgctggccgagctgatccgcggcgaggtcgcgcaggtgctcgggcactccggtgccgaggcgatcgaggacggccacggcttcgtggagctgggcttcgactcgctgacctcggtcgaactgcgcaaccggctcaacgagcgcaccgggctgcgcctcgcgtccacggtcgtcttcgaccatccgacgcccctcgcgctcgccgccgaactcagcgagcagctgggcaccccggcggcaccgatggccgccgctccggcggcggggcaggcggccgccgggccggccgaggacaccgggagcggccgtggcgcggacgcgctcggcgacctggcggtgatcaacggagtggaggcgctgtaccggcgctcgaacgagctgggccggctcgacctcggccacagcgtgctgcggaactcggtcgacctgcgggtgagcttctccgacccgcaggaggtcaagggcggcccgagcctcgtccggctcggtgagggggcgcagtacccgaagatcatcgggttcccctcacagtccgtgtgggcgagcaaccaggaactggtcagcatggccacgccgttgcgcggaacccgtgacgtgtggtcgctgatgctccccggcttcgtcaccgggcagccggtcgcggccgacgtggacgcggcggccgagtacgccctgcggctcatcgaggaactggtcgacggcgaaccgttcgtgctggccggccgctcctccggaggccggatcgcccacgaggtcacgtccaggctggaggaccggggactggcgccccggggcctggtcctgatcgacagctacatggccggctacgacgccacctcgtacatcgtgccggtgatggagtcgaaggccgtcgagctggagaaggacttcgggcagatgaccgggacgaggctcacggcgatggccgcgtacttcggcatgttcgagcactggcagcccaaggagatcgcgacgccgaccctgctcgtacgggcctcggagtgctacggcatcgagccgggcgaggtgcagccgccggccgagcagtggcaggccgcctggccgcttccccacgaagcgatcgacgtgccgggcaaccactacacgatgctggagggcaacggagacgtcacggcggccgccgtgcacgagtggctgacgcgccacgaggcg

SEQ ID NO: 2883 - DNA, 14055 bp, Streptomyces avermitilis
  CDS (1)..(14055)
atgaacagttccatgtcggaggtcgtcgacgcgctgcgggcctcgctgctggagaacgagcggcttcggcagcagaaccagcggctcaccacggcctccgcggaacctctcgccatcgtgggcatcggctgccgctacccgggcggtgtccgcgacaccgaggacctgtggcggctgatcacggaaggccgcgacgccatgtcgggcttccccaccgaccgcggctgggaccgctgggacatccccaccgcccgtacgggtgccttcctccacgacgccggcgacttcgaccccgccttcttccgcatctcgccgcgtgaggcgatggcgatggacccgcagcagcggctgctcctggaaacgtcgtgggaggcactggagcgggccggcatcgaccccgccacgctcaagggaagccgcaccggcgtgttcatcggcggagccccgcaggagtacggcgcgctggtgatgaactcggccgagggagcgggcggttacgcgctgacgggcgcccccggcagtgtgctgtccggccggatctcctacgtgctgggcctggagggtcccgcggtcacggtggacacggcgtgctcgtcctcgctggtcgccctgcacctcgccgtcaagtcgctgcgcaccggcgaatgcgatctcgcgctggccggcggcgtgctggtgctcgtcaccccgtcgatcttcgcggagttctcggcgaccggcggatcggcgggcgacggccgctgcaaggccttcgccgcgtccgccgacggcaccggctggggcgaaggggcgggcgtactcgccgtccagcgcctgaccgacgcgcgccgggacggtcaccccgtcctggcggtgatccgcgggtcggcggtgaaccaggacggcgcgtcgaacggtctgagcgcgccgaacggtccttcgcagcagcgggtgatccggcaggcgctggcgaacgccggtctgtcggccgccgacgtggacatggtggaggcgcacggcacggggacgacgctgggcgacccgatcgaggccgaagcgctgctcgcgacctacggccaggaccgcccggccgaccggccgctgtggctcggcaccctgaagtccaacatcggacacacccaggccgcggccggcgtctccggagtgatcaaggccgttctctcgctccagcacggcctgttgccgaagacgctgcatgtggacgagccgacgccgcaggtggactggtcggcgggtgcggtggagctgttgacgcaggcgcgggagtggccggagacggacggcccgcgacgggcgggtgtgtcctcgttcggcatcagtggcacgaacgcgcacgtgatcctggaacaggcgccggagccggagggcgcggaggtaccggagtccgcggaggcgccgggggcggaggggcgtccggcgttgagcgggccggtgccgtggctggtgtcggggcgtaccgaggcggcgttgcgggctcaggcggcacggctggccgagcacctggccgggcgtcccgaggcgaccccgctggatgtgggcttctcgctggcgcggacccgttcggccttcgaacagcgggcggtggtggtgagcgccgaccgcgacgaactgatcgccggactgcggtcggtcgccgacagcggggacggtgcgggcgtcgcgggtgtcgtggccggccgagccaccgccgacagcggcgtcgtgttcgtgttcccgggtcaggggtcgcagtgggtggggatggcggcggagctgctggactccgcaccggtgttccgcgcacggatggaggagtgcggggaggcactggccccgcacgtcgactggtcgctgctcgccgtggtgcggcaggaggagggcactccgtcctggtcccgggtggatgtggtgcagccggtgttgtgggcggtgatggtgtcgctggcggcggtgtggcgttcgttcggggtggagcctgccgctgtcgtggggcattcgcagggtgaggtcgctgcggcgtgtgtggcgggtgggctgtcgctggaggacggggcgcgggtggtggccgtgaggtcgcggctggtgctggagaagctgtccggcaagggcggcatggtgtccgttgcgctgccggtcggggaggtcgaggagcgtctcgcccggttcgagggccggatcggtgtcgcggccgtcaacgggcccggctccgtcgtcgtctccggtgagcccgacgcactggatgaactccttgcggaatgtgaggagtcaggggtacgggcccgtcgtatcgcggtggattacgcctcgcactccgcgcaggtggatgccctcaacgaggatctgttgagggagctcgcggacattcagccccggtcgtcgtcggtggcgttctactcgacggtgacgggtgagcggctggacacgtccggtctggacgcgcggtactgggtgacgaatctgcgggagcgggtgcggttcgagccggtggtgcggctgttggcggagaaggggagttcggtcttcgtcgagtcgagtccgcatccggtgttgacgatggcggtggccgagaccggtgaggtcgcggaccgggctgtggtgacagtggggtcgttgcggcgtgacgacggtggcgcggaccgcttcctgacgtcgctcgcggaggcctacgtggcgggcgctcccgtcgactggtcggtgctgttcgccgggatgccggtgcgccgggtcgatctgccgacctacgcgttccagcaccagcgctactggctcgacgacgttgcgctgcccggccagagcggtttctccgacgacccggcggatgccgcgttctggggtgcggtggagcgcgccgatgtgcagggcgtggccgcgctggtggacggtgcggagcctgaggtgtgggagccggtgctctcggcgttgtcggcttggcgccgggggcgtcaggagcggtcggtgctggattcgtggcggtatcggacggtgtggcgttcggtgacggtgccgtcggtgggccggttgtcggggacgtggctggtggtgacgccggggggcgcggggccggtcgaggaggtccggcgggcgctggaggcggtcggcgccgaggccgtcgtactggcgtgggaggcggaggagggccgtgaggctctggccgggcgccttaccggagccggtgaggtgtcgggtgtggtgtcgctgttgggctgggatgaggaggccgcgcctgtcgcgacggtgacgctcgtccaggctttggcggatgccggggtcgaggcgccgttgtgggtgttgacgcagggtgccgcgtcggtgggtgcggaggatgtggtgcacccggtgcagacgcaggtgtgggcgctgggtcaggtggccggtctggagcagccgggtagttggggtggtctggtcgatgtgccgggggtgtgggacgagcgggttgcttccgggctgactgccgtgttggcggcgggggagggtgaggatcaggtagcggtgcggtcgtcgggtgcgtatgcccgtcgtctggtgcgggctccgctgggtgcgaacccggcacccgtacgcgactggaacccccatggcacggtgctgatcacgggtggtaccggcggtattggtgcgcatctggcccgttggctggcgaaggagggcgccgagcgtctgctgctggtcagccgtagtggcgagcaggcagaaggtgctgccgaactggccacggagttgggcggcttgggcgcggaggtgacgttcgccgcgtgcgacgtgagcgaccgcgacgccctcgcccacgtgatcgccggcatcccggcggagcaccccctcaccgccgtcttccacaccgccggtatatccggttacgcggaactcgccaccgccacccccgagcacttcaccgacgtgctctccgcccgcgttctcggcgctcgtcatctggacgagttgaccgccgagctcggtgtggagttggaggcgttcgtggtgttctcctccggggctgcggtgtggggcagtggcagtaatggtgcgaatgcggccgcgggcggttatctggacggtctggtgcggcggcggcgggcgcgtggtgtggcggggacgtcggtgtcgtggggcggttggcaggcgacggcgatggcggtgggggacacggcggagcagttgtcgcgtcggggtgtgcggctgctggatccggtgctggcggtgcaggcgttgcggcaggtgctggagcaggacgaggtgtcggtgacggtgaccgacatggactgggcgctgttcactccgggatacgcgatggcccggcgccgcccgctcatcgaggacatccccgaagccggtgaggcactgagtggggcggccggggccggggagaccctggactcggcaggcgtgggtctgcgggagcggctcgccgcgatgacggagaccgagcggcaggccacgctgctggggctggtgcgcggcgaggcggcccaggtgctggcgcacgggtcgacggcggagatcacgccgaccaggccgttcaaggaactcggcttcgactcgctgaccgcgatggacctgcgcaaccggctgtccaaggccaccggactgcgactgccggccacgctcgtcttcgactatcccaacccggaacagctggcggccctgctgcgtaccgagctggtggacggtctgccggggacagccggacccgcggcaccggccgtccggccggtggacgacgaaccgctcgcgatcgtcggcatggcctgccgctaccccggtggcgtgcgcgacgccgacgacctgtggcggctgatcgtcgaaggccgcgacgaactgtccgacttccccaccgatcgcggctgggaccgctggggcgcacccgcggtcggccaggccggtttcctgcacgaggcaggggagttcgacgccgccttcttcgggatctcgccgcgtgaggcggcgtcgatggacccgcagcagcggctgctcctcgagacgtcgtgggaggcggtggagcaggccggtatcgatccgtggtcgctgcgaggcagctccaccggagtgttcgtcggcggcggcccgcaggactaccccgcggtgctgatgggctcggccgaggccggcggcggctacggcatgaccggtgcgctcggcagcgtgatgtcgggccgggtgtcgtacgtgctgggcctggagggtcccgcggtgacggtggacacggcgtgctcgtcctcgctggtcgccctgcacctagccgctcagtccctgaacaacggcgagtgcgagctggccctggccggcggtgtgaccatcatggccacgccgggcgcgttcgcggagttcgacaccttgggcggtatggcgggcgacggccgctgcaaggccttcgcggcatccgcggacggcaccggctggggcgagggcgtcggcatggtggtcgtcgagcggctctcggacgcgcgccgcaacggtcacgaagtgctcgccgtcatccgtggcagcgcgatcaaccaggacggcgcgtcgaacggtctgagcgcgccgaacgggccttcgcagcagcgggtgatccggcaggcgctggcgaacgccggtctgtcggccgccgacgtggacatggtggaggcgcacggtacggggacgacgctgggcgacccgatcgaggcccaggcgctgctggccacctatgggcaggaccgtccggccgaccggccgctgtggctcggctccgtgaagtccaacttcgggcacacgggtgccgcggccggcgtggcgggcgtcatcaaggccgtactggccctgcgcaacggcctgttgccgaagacgctgcatgtggacgagccgacgccgcaggtggactggtcggcgggtgcggtggagctgttgacgcaggcgcgggagtggccggatgcggagcgtccgcgccgggcgggtgtgtcgtcgttcgggatcagtggcacgaacgcgcacgtgattctggagcaggcgccggagccggagggtgcggaggtgccggggtccgcggaggcgccgggggcggaggggcgtccggcgttgagcgggccggtgccgtggctggtgtcggggcgtaccgaggcggcgttgcgggctcaggcggcacggctggccgagcacctggccgggcgtcccgaggcggccccgctggatgtgggcttctcgctggcgacgacgcgagcgaacctggaacaccgtgcggtggtactcggcagcacctcggaggaactcacgcgcgggctgaacgccgtcgccgaagccgccatctccccggccgtgatccgtggcaacggcacggacaccggtgtggtgttcgtgttcccgggtcaggggtcgcagtgggtggggatggggcgggatttgtgggatgtctcgccggtgttcgccgagtcgatggtggcgtgtgagcgggcgttgtcgccgttggtggactggtcgttgagggatgtggtgttccgggacgcgggggatccgttgtggtctcgggtggatgtggtgcagccggtgttgtgggcggtgatggtgtcgctggcggcggtgtggcgttcgttcggggtggagccggctgcggtggtcgggcattcgcagggtgaggttgctgcggcgtgtgtggcgggtggtctgtcgctggaggacggggcgcgggtggtggccgtgcggtcgcggctggtgctggagaagctgtccggtaagggcgggatggtgtccgttgcgctgccggtggagggcgtcgaggagcgtctcgcccggttcgagggccggatcggtgtcgcggcggtgaacgggcccacctcggtggtggtctcgggggagcccgaggcactggatgagctccttgcggagtgtgaggggtcgggggtgcgggcccgtcgtatcgcggtggactacgcctcgcactccgcgcaggtggatgccctcaacgacgacctgctcgccgaactcgccggcatccggccgaagtcgtccacggtcgccttctattccacggtgaccggggggcggctggacacgtccggtctggacgcccggtactgggtgacgaatctgcgggagcgggtccggttcgagccggtggtgcggctgctcgccgaccaggcgcacggactcttcgtggaagccagtccgcaccccgtactcaacatggcggtggccgagaccggtgaggtcgcggaccgggctgtggtgacggtggggtcgctgcgccgtgacgacggtggcgcggaccgtctcctgacgtcactcgccgaggcacacgtcgccggtgctcccgtcgactggtcggtgctgttcgccggcaccggaacccgccggatcgggctgccgacgtacgccttccagcaccagcgctactggctcgaggacgcggccgcgcccggtacggacggcgtcgtcgacccggtggacgcggccttctggggtgcggtggagcgcgccgatgtgcagggcgtggccgcgctggtcgacggtgcggacccggaggcgtgggagccggtgctctcggcgttgtcggcttggcgcaaggggcgtcaggagcggtcggtgctggattcgtggcggtaccggacggtgtggcgttcggtgacggtgccgtcggcgggccggctgtcgggcacgtggctggtggtcgcccccggcgaaggtgctccggccgagcggatcgaggaggccctggtcggcgccggcgccgaggtcgtcgtactggcgtgggagacggaggagggccgcgaggcgctggccgggcgcctggccgaagccggtgaactgtccggtgtggtgtcgctgctgggctgggacgagaaggccgcacccgccgcgacagtgacgttggttcagggcttggcggatgccggggttgaggcgccgttgtgggtcctgacgcatggcgccgcctcggtggggtcgggcgatgtgatccgtccggtgcagacgcaggtgtgggcgctggggcagatcgtcggtctggagcagccgggtagttggggcggtctggtcgatgtgccggaggtgtgggacgagcgggttgcttccgggttcgctggtgtgttggcggcgggggagggtgaggatcaggtagcggtgcggtcgtcgggtgcgtatgcccgtcgtctggtgcgggctccgctgggcgcgaacccggcacccgtacgcgactggaaccctcatggcacggtgctgatcaccggcggcaccggtggcatcggtgcgcatctggcgcgctggctggcgaaggagggcgccgagcgtctgctgctcgtcagccgtagtggtgagcgggccgagggtgctgccgaactggccgcggaactgggcggcttgggcgcggaggtgacgttcgccgcgtgcgacgtgaccgaccgcgacgccctcgcccacgtgatcgccgagcacccgcccaccgccgtcttccacaccgccggagtcgccagctacggcaccgtacgggaactcgacctcgccgacctggacgcacagatggccgccaagaccctcggcgcccgtcacctggacgagctcaccaccgaacgcggcctcgaactggacgccttcgtggtgttctcctccggagccgcgatctggggcagcgccggcaacggcggctacgccgcggccaacgcgtacctggacggactcgcatgggaccgccgggcccgcggcctcgccgcgacctccgtgtcgtggggcggctggaaggccaccggcatggccaccgacgacaccgccgagcagctcgcgcgccgcggcgtccgtccgatggacccggcacgggccgtcgaggccctgcgacaggcgctggagcaggacgagaccgcgctgacggtcaccgacatggactgggaacgcttcacccccggctacacgatggcccggcgccgtcccctgatcgaggacatccccgaagtcgcccgcgtcctgagcgaggactccgccgacgtgctcggtgacgactcggcgggctcggccctccggacggagctcgcggcgctcggccaggccgagcagctcgatctgctgctggacctggtgcgcggcgaggcggcccgcatcctggcccactcctccacggccgagatcactccggagcggccgttcaaggaactcgggttcgactcgctgaccgcgatggaactgcgcaacctgctgaacaccgccaccggtctgcggctgcccgcgaccctcgtcttcgactaccccaacccgcggcagctcgccgcccacctgcgcaccgaactgatcggcgccgggccggacctcgtcccggccgccgacgtcgtacgggccgatgccgacgaacccctcgccatcgttggcatggcctgccgctactcgggcggagtctcctcgccggaggacctgtggcaggtcgtggtggagaacaaggacgggatgtccgacttcccctcctaccgcggctgggaccggtggaacctcgccagcctccgccgtgccggatttctgcacgaggcgggcgacttcgacgccggcttcttcgggatctcgccgcgtgaggcgatggcgatggacccgcagcagcggctgctcctcgaagcgtcgtgggaggccgtggagcgcaccggcatcgatccgcactcactgcggggcagcgacaccggcgtcttcgtcggcggtacggccgtcgagtacggcgcgctcctgatgaactcgccggccagccagggctacgccgtcaccggttcctccggcagcgtcatgtccgggcgcatctcctacaccctcggcctggaggggcccgcggtgacggtggacacggcgtgctcgtcctcgctggtcgccctgcacctcgccgcccaggcgctgcgcggcggtgagtgctcgctcgccctgaccggcggcgtcggtctgatggccaccccgggcgcgttcgcggagttcgacacgctgggcggactctcggtggacggccgcaccaaggccttcgcggccgccgccgacggcatcggctggggcgagggcgtcggcatggtggtcgtcgagcggctctcggacgcgcgccgcaacggtcatgaagtgctcgccgtcatccgtggcagcgcgatcaaccaggacggtgcgtcgaacggtctgagcgcgccgaacggtccctcgcagcagcgggtgatccggcaggcggtcgccaacgccggactggcgctggcggacgtggacatggtggaggcgcacggtacggggacgacgctgggcgacccgatcgaggcccaggcgctgctggccacgtacggtcaggagcgaccggccgaccggccgctgtggctcggctccgtgaagtccaacatcgggcacacgggtgccgcggccggtgtcgcgggcgtcatcaagtccgtactggccctgcgcaacggcctgttgcccaagaccctgaacgtggacgaaccgacccccaaggtggactggtccgccggtgcggtggagctgctgacccaggcgcgggagtggccgcagggggagcgtccgcgccgggcgggcgtgtcctcgttcggcatcagcggcacgaacgcccacgtgatcatcgaggaggcgcccgccgccgaggagacaccggccgcgcccgacgaggcggccccggcagcacccgcactggtgacgccggtcgtcccgtgggtgttctcgggccggtcgagcggcgccctgtgcggccaggccgggcgcctgggcggcctggtggagcgcgagccgggcctcgacgtcaccgacgtggcgttctcgctggcgacgacgcgagcgaacctggaacaccgtgcggtggtgctcggcggcgacgcggccggcctgctcgaccgtttgcgctcggtcgccgcgcgggagccggacgccggcgtcgtgtcgggcaccaccgccgccggtggccgggtggtgttcgtgttcccggggcaggggtcgcagtgggtggggatggggcgggatttgtgggatgtctcgccggtgttcgccgagtcgatggtggcgtgtgagcgggcgttgtcgccgttggtggactggtcgctgagggatgtggtgttccgggacgcgggggatccgttgtggtcccgggtggatgtggtgcagccggtgttgtgggcggtgatggtgtcgctggcggcggtgtggcgttcgttcggggtggacccggctgcggtggtcgggcattcgcagggtgaggtcgctgcggcgtgcgtggccggtggtctgtcgctggaggacggggcgcgggtggtggcggtgcggtcgcggctggtgctggagaagctgtccggcaagggcgggatggtgtccgttgcgctgccggtggagggcgtcgaggagcgtctcgcccggttcgagggccggatcggtgtcgcggcggtgaacgggcccacctcggtggtggtctcgggggagcccgacgccctcgacgaactcctcgcggagtgtgaggagtcgggggtgcgggcccgtcgtatcgcggtggactacgcctcccactccgcgcaggtcgacgccctcaacgacgacctgctcgccgaactcgccgacatccggcccaagtcgtccacggtcgccttctactccacggtgaccggcgaccggctggacacgtccggtctggacgcgcggtactgggtgacgaatctgcgggagcgggtgcggttcgagccggtggtgcggctgttggcggagaaggggagttcggtcttcgtcgagtcgagtccgcatccggtgttgacgatggcggtggccgagaccggtgaggtcgcggaccgggctgtggtgacggtggggtcgttgcggcgtgacgacggtggcgcggaccgtctcctgacctcgctcgccgaggcctacgtggcgggcgcgcccgtcgactggtcggtgctgttcgccggcaccggggcccgccgggtcgacctgccgacctacgccttccagcaccagcgctactggctcgaaggcgtctccgtcggaggcgagatccaggaggcctcggcggacgcgatggacgccgcgttctgggatgccgtggaacgtgaggatctcgccgatctcaccgaggtgctcgacacatccggcggcaccgggcccgacccggccgccgccgcggaggcctggctgcccgcgctgtcggcctggcgcaagggccgccggaagcagacgacactcgactcgtggcgctaccgcaccgaatggcgcacgaacgatcggcccctctcggcacggctgtcgggcacgtggctggtggtcgccccgagcgacggtgcgccgaccgagcggatggagcggaccctcgccggcgccggtgccgaggtcgtggtcctggcgatcgaggcggggacggaccgggcggagctggccgaacggctcgccgggactcccgaggcggcgggcgtggtctcgctgctcgcctgggacgaacacaccgcggtcgcctcgacactgacgctcatccaggcccatggcgacatcgagtcggcggcccctctgtgggtggtgacccgcggagccgcgtccgtggactcgggcgatgagatccgtccggtgcagacgcaggtgtgggcgctggggcagatcgtcggtctggagcagccgggcagttggggtggtctggtcgatgtgccggaggtgtgggacgagcgggtggcctctcaggttgctggtgtgttggcggcgggggagggtgaggatcaggtagcggtgcggtcgtcgggtgcgtatgcgcggcgtctggtgcgggctccgctgggtgcgaatccggcacccgtacgcgactggaacccccatggcacggtgctgatcaccggcggcaccggtggcatcggtgcgcatctggcgcgctggctggcgaaggagggcgccgagcgtctgctgctcgtcagccgtagtggtgagcgggccgagggtgctgccgaactggccgcggaactgggcgggttgggtgcggaggtgacgttcgccgcgtgcgacgtgaccgaccgcgacgccctcgcccacgtgatcgccggcatcccggcggagcaccccctcaccgccgtcttccacaccgccggagtcgccggtcacggaccgctggccgacctcgacgtgaccgacctcgacacgcagaccgccgccaggatcgcgggcgctcgtcatctggacgagttgaccgccgagctcggtgtggagttggaggcgttcgtggtgttctcctccggggctgcggtgtggggcagtggcagtaatggtgcgaatgcggccgcgggcggttatctggacggtctggtgcggttgcggcgggcgcgtggtgtggcggggacgtcggtgtcgtggggcggttggcaggcgacggcgatggcggtgggggacacggcggagcagttgtcgcgtcggggtgtgcggctgctggatccggtgctggcggtgcaggcgttgcggcaggcgctggagcaggacgaggtgtcggtgacggtgaccgacatggactgggcgctgttcactccgggatacgcgatggcccggcgccgcccgctcatcgaggacatccccgaggcggcacaggtactgcgtgacgccgaggagatcgaggacggcccggaggacggggcggccggcgcggatctgcgcaagcgtctggccgggctgaccgaccccgagcggcaggccacgctgctggggctggtgcgcggcgaggcggcccaggtgctggcgcacgggtcgacggcggagatcacgccgaccaggccgttcaaggaactcggcttcgactcgctgaccgcgatggacctgcgcaaccggctgtccaaggccaccggactgcggctgccggccacgctcgtcttcgaccaccccaacccgcagcgcatcgccgaacacctccgcgccgggctggcccaggacgggcagcagggcatcgccgacgtcctcgacatccggcgtgagctgacccggatcggcgaggcgctgaacagcgtcgcacccgatgcccgggcccgcgaggacatcgtcgaccatctccgcgacctcatcacccagctcggcaccggcaccggagccgccgagcaggacaccaccgatctcgaagccgcgacggacgacgagatcttcgacttcatcgaccgcgacctaggcgtgtcc

SEQ ID NO: 2884 - DNA, 11817 bp, Streptomyces avermitilis
  CDS (1)..(11817)
atggccaacgagcagcagcttcgtgactatctcaagcgggtcagcgcggatctgcaccggacgcgccagcgactgaccgagatcgagtcgcagggcaccgagccgatcgcgatcgtcgggatggcctgccgctaccccggcggggtgagttcgcccgaggacctgtggcggctggtcaccgacgagacggacgcgatcggccccttccccaccgaccgcggctgggacctggacggcctccaccaccccgaccccgaccacccgggcacctgctacgcggaggcgggcgggttcgtcgaggacatcgcctccttcgacgcggccttcttcggcatctccccgcgcgaggcgcagtccatggacccccagcagcgactgctcctggagacctcctgggaggcgctggaacacgccggcctcgacatccacgcgctgcgcggcagccgtacgggcgtcttcgccggactcaaccagcaggactacggcaccctgctggccgccgccccggacggtctggacagctacggctccaccggcacctccaacagcgtgctctccggccggatctcgtatgtgctgggtctggagggcccggccgtcaccgtggacaccgcctgctcctcctcgctggtgaccctgcacctcgccgcccaggcgctgcggagcggggagtgcgacctcgccctggccggcggcgcgacgacactgtccacctccgcggtccacgtggccctgtccgggcagcgcgcgctggcccccgacggccgctccaaggcgttctcggcggcggccgacggcgcgggctggagcgagggcgtcggcgtcctcgccgtcgagcggctctccgacgcccgccggctcggtcaccgggtgctcgcggtgctgcgcggcagcgccgtcaaccaggacggcgcgtccaacggtctcaccgcgcccaacgggccctcgcagcagcgggtgatccggcaggcgctggccaacgcgggtgtgtcgcccgccgaggtcgacgtggtcgaggcgcacggcaccggcaccagcctcggcgacccgatcgaggcggacgcgctgctggccacgtacgggcaggccaaaacggcggggcggccgctgtggctgggctccctgaagtcgaacatcgggcacagcggtgccgccgccggcgtcggcggtgtgatcaagatggtgcaggcgctgcggcacggcctgctgcccaggaccctgcacgccgaggagcccaccccgaacgtcgactggtcctcgggcgccgtcgaactcctcaccgaggcccgcccctggcccgcctccgacaccccccgcctggccgcggtgtcgtccttcggcatcagcggcaccaacgcgcacgtgatcctggagcaggctcccgaagaaacgcccgaagaagcaccggaggaaacccccggagaggcgcccggggcgaccgccccgccactcctcccgtgggtgctctccgcccgcggtgagcccgcgctgcgcgcgcaggcccgtgccctgcgcgagcacctgctggcccgtcccggcgcgagcgacgccgacgtggccctctccctcgccgtcacccgcaccggcctggagcaccgggccgccgtgctcgccgccgaccgggacggattcctcgacgcgctggacgcgctcgccacggaccgccccgccgaaggggtactgcgcggctcaccgcccgtcgacggcaaggtcgtcttcgtgttcccggggcagggctcgcagtgggccggcatggcccgcgaactcctcgacacctcaccggtgttcgcggcgaaggcggccgcgtgtgcggcggcgatcgaggagttcgtggactggaaggtcctcgacgtgctgcgcgagaagcccggcgccgcctcgatggaacgcatcgaggtcatccagcccgtgctcttcaccgtgatggtgtcgctggcggagctgtggcgttcctacggggtggagcccgacgccgtcgtcggcagctcgcagggcgagatcgcggccgcccatgtcgcgggcggactgacccttcaggacgcggcccgggtgatctgcctgcgcagcgcactcctggccgagaccctcgtcggcaagggcgccgtcgcctccgtcgccctgcccgccgacgaggtgcgcgagcgactgacccgctgggcggaccggctgtccgtggccggcgtcaacgggccccggatcgtcgcggtcgccggagacgacgacgccctcgccgagttcatcgccgagtgcgcccgcgacaacgtgcgcgccaggatcgtcgccgccaccgtgccgacgcactgcgccctggtcgaccccctgcgcgagcggctcctcgacctgctggcgccggtcgcgccgcgcaccgggaccgtacccctgtactcgacggtgaccggcggccggctggacaccgccgccatggacgccggctactggtacgacaacacgcgcgcgccggtgctcttcgaaccggtcgtgcgcgcgctgctcgccgaggggcacagcgcgttcgtcgagtccagcgcgcacccggtgctggcgatgggcgtcgaacagaccgtcgacgccgccggggcgtccggcgtcgtggtggagtccctgcgccgcgacgagggcggcctcggccggatgacggcctcgctggccaaggcgcacctcggcggggtccgcgtcgactggcccgcggtgttcgccggcaccggcgcccgcaccgtggaactgcccacctacgccttccagcgcacccgttactggaccgaggccggcgaccgcaccggtgacgtcggttcggtcggcctgtcctcggtcgaccacccgctgctcggagccctggtccggatggccgacggcgacggcgccgtgctcaccggccggctctccctgcgcgcccagacctggctggccgggcacggcgtctccgaccgggtgatcttcccgggcaccggcttcgtggagctggccgtgctcgcgggcgaccaggtcggctgcggccggatcgaggaactgaccctgcacaccccgctggtggtgcccgagagcggcgcggtcgtggtgcaggcacaggtcgaggcggccgacgagacgggggcccgcgcggtgagcgtgtactcccgtgccgacgacgcctcggcggacacggtctggacccggcacgcgtccggcgtcctcgtcgccgaacccggcgaggaacccgaggggatcaccgggacctggccgcccgagggcgccgaggccgtggacatctccgggatgtacgaccgcatggccgcggccggttaccagtacgggcccgagttccgcggcctgagccgggtctggcaccgcgacggcgaggtgtacgccgaagtggccctgcccgccgaccagcgctccgcggccgagcgcttcggcctgcacccggcgctcttcgacgcggccctgcacgccatgttcacctggggcgacgacgacggcggcgtgggcatgccgttctcctggaccggcgtacggctgcacgcgaccggctgctcgcggctgcgcgtacggctgtcccggcgcggcgagaacgggatcacgctgctgctcgccgacgaggccggcgcaccggtcgtctcggtcgacaccctcgtcgtacgccggatgaccgaggccgcgctgagcaccgtacgcgccgacgcgctgtaccggctcgactggaagaccgtccgggccgaggagcccgccccgcgctgcgtcgtgctgggggccgacccgctggggctgtgcgacgccctgcccggcaccccgctcgccgccgggaccgaggagctggccgcgctcgtcgccgcggacggcgccgccgtcaccgcgctgctcccggtcgccggcgacggctccaccgaccgggtcggcgaaccggtcgtcgacaccgtcgccctcctccaggagtggatcgccgacgggcggctcgacgacacccggctcgtcgtggtcacccgcggcgcggtggcggccacggccggcgaggacgtgaccgacctcgccgccgccggagtctggggactgctgcgctcggcgcagaacgaacaccccggacgcttcggcctcctcgacctcgacacggccgccgggtcccgagcggcgctcggcgcggcgctcgcgtccggcgaggaacaactcgccctgcgcgaaggccaggtacgcaccccgagcctggcccgctgggatcccgccggcaccatcctgcccccggccggggagcccgcctggcgcctggagaacaccaggcccggcaccatcgagggcctcacggcggtcccgtacccgcaggcactcgaaccgctcggaccccggcaggtgcggatcgccgtccgcgccgccggcatcaacttcaaggacgtcgtcgtcgccctcgacctggtgcccggcctgaccggactcggcggcgaagtcgccggtgtcgtcaccggcaccggcgccgaggtcacccaccaccgcgtcggcgaccgggtgttcggcctgtccaccgaggtcttcggcccggtgaccgtcgccgacgaacgcaccgtccaccgcatccccgacggctggaccttcgaggaggccgcctcggtctccgtcgcctacctgaccgcgtactacggactcgtcgacctcggcggactccggcccggccagtccgtgctgatccacgccgcggccggcggcgtcggcagcgcggccgtccagctcgcccgccacctcggcgccgaggtctacggcacggcgagccccggcaagtgggacacgctgcgcgcctgcgggctcgacgccgcgcacctcgcgaactcgcggaccctcgacttcgagcagtggttcctggagtccaccggcggccgcggcatggacgtcgtactcgactgcctggccggcgagttcgtcgacgcgggcctcaggctgctgccccggggcggccgcttcctggagatgggcaagaccgacaagcgcgacccggcacaggtcgccgaggcatacccgggcgtcgcctaccaggcgtacgaccttccggaagccgggctcgaccgcatccacgccatgctgggcatcctcgccgagctgttcgagagcggcgtccttgcgcctccgcacctcaacacctgggacatccgcgacacccgcgccgccttccgggcgctgagccaggccgcgctcatcggcaaggcggtgctcaccctccccggcgagcccttccccgcccacggcaccgtcctgatcaccggcggcaccggcatgctcggcgcgctgctcgcccgccacctggtcaccgagcacggggtgggcagcctgctgctgaccagccggcgcggcccggacgcccccggcgcgagcgaactcgccgcggaactgaccgcggccggtgcccaggtgaccgtcgcggcctgcgacatcgccgaccgcggccaactcgccgcgctgctcgcggacatccccgccgaacgccccctcaccgccgtactgcacaccgcggcggcgctggacgacggcctcgtcgagtccctcaccgccgaccgcacgagggccgtactgcggcccaaggtgaccggcgcactcaacctgcacgaactcaccaaggacctcgacctcggcgccttcgtgctgttctcgtccatggcgggcaccatgggcgcccccggccagggcaactacgccgccgccaacgtgatgctcgacgccctcgccgcccaccggcgggcccacgggcggcccggactctccctcgcctggggcttctgggcacagcgcagcgagatgtcgggccacctcgacgaccgcgacatgcggcgcctgagccgcggcggcatcgtgccgatgaccagcgacgaaggcctcgcggtgttcgacctggcctgccgcaccggcagcgcccagctggtgcccgcgaaactcaaccccgccgcgctcgccgggacgtcgggccgggtgccgcccatcatgcgggcgctggtgcccacgcccgcccgccgcgccggacgccggccggcggacaccggcggcggatccctgcgcgagcgcctgaccccgctcaccggcaccgaacgcatgcggatcctgctccagctggtccgctcccatgtcgccaccgtgctcgggcactccgaccccgacgcggtcggctcgacggcgccgttccgcgagctcggcttcgactcgttgaccgccgtggagttccgcaaccggctgaccggcgccgtcggcttccggctgccggtcaccgtcgtcttcgaccacccgacgccgagcgagctggccgacttcctggccgccgaactcctcggtgatctcgccgaacccgccgcccccgcggcccccgtgcccgcggtagcccgcaccgacgacgaacccctcgtcatcgtcggcatggcctgccgctacccgggcggcatcacctcgcccgagcagctgtgggacctcgtcatcggcgagcgggacgccgtctccggcttcccggaggaccgcggctggagcaccggggcacccgccgacggctccgtgccgcagcagggcggattcctcgaccgtgtcgcggagttcgacgccgcgttcttcgggatctccccgcgggaggcgctgaccatggacccgcagcagcggctgctcctcgagacgtcctgggaggccctcgaacgtgccgggatcgcgcccggcaccctgcgcggcagccgtaccggcgtcttcgtcggcgcggccacctccggatacacgagcctgttcccccgcggctcacaggcgctcgccgggtacggcgtgaccggcgcgtccaccagcgtggtgtccggacgcgtctcctacgtgctgggcctggaggggcccgcggtgacggtggacacggcgtgctcgtcctcgctggtcgccctgcacacggccgcccaggcgctgcggagcggcgactgcgacctcgccctcgccggcggcgtcgcggtgatgaccagcccgttcctcttcgacgacttcgccaagcagggcggcctgtcacccgacggccgctgcaaggccttcgccgccggtgccgacggcaccggctgggcggagggcgtcggcgtcctcgccgtcgagcggctctccgacgcccgccggctcggccaccgggtgctcgccgtgctgcgcggcagcgccgtcaaccaggacggcgcgtccaacggcctgaccgcgcccaacgggccgtcgcagcagcgggtgatccggcaggcgctggaacggtccgggctgaccgcccccgacgtcgacgccgtcgaggcacacggcaccggcaccaccctcggcgaccccatcgaggcccaggccatcctcgccacctacggccgggaccggaccgaggaccggccgctgctgctgggctccctgaagtccaatctcgggcacagccaggccgccgccggcgtcggcggagtgatcaagatggtgcaggccctgcaccacggcgtactgccgcgcaccctccacatcgacgaaccgaccccgcacgtcgactggaccgcgggcgccgtggacctgctcaccgagacccgcccgtggccggagaccggccgcccccgccgggccggcgtgtcctccttcggggtcagcggcaccaacgcccacgtcatcctcgaacaggccgcggagccggaccccgcccccgcggcggccaccgcgctgccgctcaccccgtggctgctgtccggccacgacgaacaggccctgcgcgcccaggcgaagaccctgctgacccatctgcgtcagcggacggaggactcggtcaccgacgtcgcccactccctggccacccggcgcaccgccctggaacaccgggccgcgctgcccgtcaccgaccgggacgacgcactcacccggctcgcggagttcgcggcggggcgcaccccggacggactgctgctcggcacggccggcgagggcggcctcgcgctgctcttccccggacagggcgcccaacgccccggcatgggccgggagttgtacgagacgttccccgcgttcgcccgggccttcgacgaggtctgcgcgcacatcgacccgctgctcggcaggccgctgcgcgagacggtgttcaccgccgaggccgccgaactcgaccggaccgcgctcacccagcccgcgctcttcgccctcgaagtggccctgttccggctgctcgcgtcgtggggcgtggtccccgactacctcctcgggcactccgtcggcgagatcgcggccgcccacgcggccggtgccctggacctcgccgacgccgcggggctcgtggtcgcccggggccgcctgatgcaggccctgccgccgggcggagccatgctcgcggtccaggccgacgagcgggaggccaccgaggccctcaccgccgtcctgggcgagcacgcggacaccgtggacatcgccgccgtcaacggcccccgctcggtggtgctctccggcgccgccgcgtccgtggacgcgctcaccgcgcacttcaccgagcggggccgccggatccgccgcctcggcgtcagccacgccttccactcgccgctgatggagccgatgctcgacgagttcgccgagctggtcgcaggcctgtccttcgctccaccccgcatccccgtcgtctccaacctcaccggagccgtcctcggcgccgacgagttcgccgacccgcgctactgggtgcggcacgcccggcacaccgtccgcttcgccgacggggtcgacgccctcgtcggcgcgggcgtcaccggcttcctggagctgggtcccgacgcgacgctcaccacgatggccgaggattgcctcgacaccgcccccaccggggtgtgcgccgcactgctgcggcgcgacgccacggaaccgacgaccctcctgaccgcactggcccgcgcccatgtgcacggcgtcaccgtggactgggacgcggtcttcgaaggcaccggcgcccggcgggcggacctgccgacctacgccttccagcgcacggcctactggcccgccgagtccaccgccgaccgcggtgacctctcctcggccggcctggacggcaccggacaccccctgctcggcgccatggtcggctcggcctccggcggcgacaccctgttcaccggcgaactctccctggccgcccagccctggctggccgaccaccggatcctggactccgtgctgttccccggcaccggcttcctcgtactcgccctgtgggcgggcagccgcctcgacgccggtgaggtcgaggaactcgtcgtccacagcccgctgatcctgcccgaacacggcggcgtcaccgtccaggtcgtcgtcggcgagaccacccgggaggaaagcaggccggtcgcggtctactcccgtgcagcctccggcaccgagtggaccaaacacgcggagggactgctcgccgccggcccgccccccgagcagccggccaccccgcccgccgtgtggccgcccgacggcgccgaacccgtacgcctcgaggacttctacgcggacctgaccaccaccggcaccgcctacggaccggtgttccagggcctgaccgcggcctggcgccacagcgacgggatctacgccgaggtcgccctgcccccgcagaccaccgacgacgccaaggccttcggcgtccaccccgcactgctggacgcggccctgcacaccctcgcgttcctgccctccgccgcccgcgacagcggcccgttcctgcccttctcctggcggaacgtgtccgcgcccgcccccggcgccaccgcctgccgcatcctcctcgcggcaggccccggcaccgacgaagtggccgccaccctctgggacggcgacggacagccgctcgtctccgtcggcggactgagcctgcgcaccgtctcccgcgcccagctgggcacgtcggtcgcggcctcgtcgctgttccgcatggactggacccccgccccggagcccgaggcggccggccaccccgcggtccgctgggccgtggtgggccccgccgtcaccgacgccccggacatcgacccctacccggacctcgacgccctgcgccggcacctcgccgaaggcggaccggcccccgaccacgtcctgttcccctgcgcccccggcacccccaccggcttcgacgcggacgcggcccgtacggccgtgcacgcggcgctcgacaccctccgcacctgggtggaggacgaacacttcgtcaagtcacggctggtgctgtgcacccggggcgccgtcgaggcccgacccggcgaaggcgtacgggacctggcgcagagcgcggtgtggggactggcccgcagcgcccagctggaacacccggaccggctgctcctggtcgacctcgacaccgacaccggcctcgcggacctcacccgggcccaggcgctcgtacaggcctccggttacggcaccgacgactccgacgacttcgacggcaccggcgactccggcgacaccgcggacgccgcgcagttcgcgatccgggccggcacgaccctcgtaccgaggctcgcccgccaccccgtcgacaccccgccgcagggccggccctggccggccgacggcaccaccctgatcaccggggccggcggcatgatcggtggcctgctcgcccggcacctggtccaggagcacggcgtacgccacctggtgctcgccggccgccgtggcgaggccgcgcccggcaccgccgaactccgccgggacctcgccgacgcgggagccgacgtacgcgtcgtcgcctgtgacgcggccgaccgggacgccctggccgccgtactcgacgcgatcccccaggaggcacccctggccgcagtggtgcacgcggcgggcgtcgtcgacgacggactgctcggcacactcaccggggaacaggtcgaccgcgtcctcaggccgaagatcgacgcggcggtgaacctgcacgacctcaccgcacacctcggcctgcgcgccttcgtcgtctgctcctccctcgccggcgccctcggcggcggcggacagtccgcctacgccgccgccaacgcctacctcgacgccctgtgccgacggcgacgggccgacggcctgcccgccctctccctcgcctggggcccctgggagagcagcgccggcatgaccgcccagctggccgccgccgacctgcggcgcatcgcccgcgcgggcatgctgccgctggcccccgacgacggcctggccctcttcgacgccgcccacgccaccggcgaaccggagctgctgcccttccgcttcgaacccggcggcctgtccaccgccgaccgggccgccctgcccggcgccctgcgcgccctggtcccggcgccacgacgccgcaccagcggactcgcccacggcccctccggcctgcgcgaccgactgcgccccctgccgcaggacgaccggaccaccaccctggagaacctcatccgcgccgaggtcgcctcggtgctcgccctgccgtcggcggacgccgtaccggtcaccaaggcgttcaagagcctcggcttcgactccctgatggccgtcgacctccgcaaccgcctcagcaccctcaccggcgtacggctctccgcgaccctcgtcttcgaccaccccaacacccgggtcctcgccgcccatctgctgaccggcatgcggctggacacggccggcgccaccgacccggccctgctcgccctgcgcggcctggagagcgccgtccggtcgatgaacccggacgccgacgaccgcggagcgatggcgacccggctacgggtgctcctggcgacgctggaagaggccggggacgaggaagcggcggacggttccgacctcgactcggtgagcgcggaggagctcgtgtccctgctcgacgacgagttcgggctgtcc

SEQ ID NO: 2885 - DNA, 14520 bp, Streptomyces avermitilis
  CDS (1)..(14520)
gtggatgacgacaagctcgtcgactatctcaagcgggtcaccgcggacctgaagcggacccggcagcgggtgcaggaactggaggcgggcgccgccgaacccatcgccgtcgtctcgatgggctgccgcttcccgggcggcatcgcctccccggaggacctgtgggagtgcgtgcgcaccggcaccgacaccatctccgggttccccaccgaccgcggctggcgcaccggccacctgcgcggcgacttccgcctcgcgggcggcttcctcgccgacgcggccggtttcgacgccgggctgttcggcatctcgccgcgtgaggcgctggcgatggacccgcagcagcggctgctcctggagacctcctgggaggtcctggagcgggcgggcctcgaccccaccacggtgcgcggcgccgacggcggggtgttcgtcggcatggccgaccagaagtacggcccgcgcgacggtgaactcctcgaccaggtcaagggcctggtcctgaccggcaccaccagcagcgtcgcctccggccggatcgcctactcgctcggcctccaggggcccgcgatcaccatcgacaccgcctgctcctcctccctggtcgccctgcacctcgcggtacgggccctgcgctcgggggagtgctcgttcgcgctcgtcggcggtgccgcggtgatggcggaaccccagctgttcgccgagatggcggagcagggcgggatggcgggcgacggccgctgcaaggcgttcgccgcggcggccgacggcaccggctggggcgagggcgtcggcgtgctcctgctccagccgctgtccacggcccgggaacagggcctgcccgtcctggccaccgtccgcggcacggccgtcaaccaggacggcgcctccaacggactgaccgcgcccaacggtcccgcccagcgccgcgtcatccgcaaggccctcgccgacgcccagctcagcgtcggccaggtcgacgcggtcgaggcgcacggcaccggaacccggctcggcgaccccatcgaggcgggggccctgctggccacctacggccaggaccgggccggggacgagccgctgtggctcggctcggtcaagtcgaacatcggtcacacgcaggccgcggccggcatggccggagtcatcaagatggtgctggcgatgcggcacggactgctgccgcgcaccctgcacgtggacgaacccacaccccaggtcgactggtcggcgggcgccgtacggctgctgacggaggaacagacctggccgagcaccggccggccgcgccgctcggccgtctcctccttcggcatcagcggtaccaacgcccacgtcgtcctcgaacacgaccccgccgcgagcggcgcggacggcgcacccgagcccggccccgacacctcgcccgccgcccccgtcccgtggacgctgtccgccgcgagcgaggaggcgctgcgcgcccaggcacggcggctgcaccggtacgccgacggcgaccccggacggcgcccgctggacatcgcccgatccctggcccgtggccgcgcccggctcgcgcaccgcgccgtcgtgctcggcgccgaccgcaccgaactcctcacgtccctggccgccctcggcgcgggcgagcccgacccccgcgtcgtacgcggccggaccgtgccgagcggccccgtcgccttcctgttcaccggccagggctcgcagcgggcgggcatcgggcgggaactgtacgagaccttcccggtgttcgcccgcgccttcgacgaggtgcgcgaccggctcgacccgcaactcgcccacccgctcgacgacatcctcgacgggcgcgtcgtggacggactgccgctgatcgagcagaccgggtacgcgctcgccgcggtgttcgcgctggaggtcgcgctgttccggctggtcgaacacgccggtgtcgtccccgacttcgtcctcgggcactccaccggcgagctggccgccgcgcactgcgccggggtgctctcgctggacgacgcctgcaccctcgtcgcggcgcgcggccggttcgtgcagaccctgcgcaccgacggcgcgatggtcgccgtcgagacctccgagacggaactcgccgaactcatcgcgcgggccgacgtcggcgaccgggcgaccatcgccgtggtgaacggaccccggtccgtggtggtctccggtgacgcggacgccgtcgagcgggtgcgcgcccggtgcgaggagcgcgggcgcaagacgcgcaagctgcccatcagccacgccgcgcactccgtccacatggaaccgatgctggcgcggctgcgcgaggtcgccgagggcctcgaacaccgcccgccccgcatccccatggtctccaacctgaccggcgcacccgtcccgcccgaggcgaactggccggagtactgggtccgccaggtccgcgagacggtgcgcttccacgacggcatccgctggctcggcgcccagggcgtcaccgcctgcctcgaactggggcccggcggagcgctcatcgcgatggcgcgcgagagcctcggcgacccgggccgcgaggtggccctcgtccccaccctccagcacgaccggcccgagccggccacgttcctgtccgcgctggccgaactgcacgtgcacggcgtggccgtcgactgggacaccccgctcgccgcccgcggcgcgaccagcaccgacctgcccacctacgccttccagcgcgagcgctactggctgcccgccacccccgcggcaccacgcaccgccgaaccggccgaccggaccggacgcgtgcgctaccgggtcggctggacgccgtacccggacgtcgacaccgacgcgcggccgaccggcacctggctggtcgtcgcccccgacggcgacagcgacggtgacggtcacggcgacggagcgcgggtcgccgaggccctgggggagcgggcggtgctgctgaccgccgggcccggcctcgctcccgccctcgcgcggctgcccgaggaccggcccgtcgcgggcgtgctcgcgcttcccgcggagtccgcgacccgctggacccgcctggcccctcgttcagccctccgaggccggggtgcgcgccccgccagtgtacgccaccaggcgcccgtctccgtcgacaccgaggccgtgcccggtgccgccccagccctcctgtgggggctcggccgggtcccgcactccggcggcggcgtggtggacctgcccgccggcctcgacgcgcgctccctgcggctgctcgcggccgtcctcgccgcacccggcgaccaggacgaactcgccgtacggccgggcggcgtcttcgccaggaagctgctgcccgcccagcgcccccggcggcagcgtgcctggcgcaccggcggaaccgtcctgatcaccggggacatcgcgggcgtcacaccggaactcctccagtacctctccggcggcggcgctcgcacgctcctgctggcgcaccgccccggcacgcccctgcccgacgccgccgtcctcgccgcggcgggcggaccgtgcaccgtcaccgagtgggacctgggcccgctggagacggcgtcggtgaccgccgtcgtccacctcagcggcatcgacccggacggcccgtccacgccggacgccctcaccgccgccgggccggcccgcgccgtccaggaccggctgcgtaccgtcgtacggctcgaagagctgttccacgacgcggacctggacgccttcgtgctgctgtccaccgtcgccggcacctggggcggcgccgaggacctcgtgcacaccgtcgcgcacgccgccctggagtccctcgccgagcgccgcaccctcgacggccgccccggcacctgcgtcggctggggcccctgggagacaccggcggacacgggggcgtcaccggtccccggcctgctgccgctccccgccgacctcgccgtgtccgcgctggccgaggccctggacgccgacgaccccgtctgcgccgtcgtcgacgtcgactggagcctgttccaccccgtcctcaccgggcgcggcccccgcccgctcgtcgccgacctgcccgaggtccgcgccctgcccgcacccccgaccgccgaagtggtcctcgcgcccgccgccgaccgggaacaccaactcctcgaactggtccgggcgcaggccgccgccgtgctcggccacgcctccggcgccgccatcgatcccgtacgcccgttccgcgacctcggcttcgagtccctggcggccgtacggttccgcgaccgcgtcgccgccgagaccgggctgcggctgcccgccaccctcgtcttcgaccaccccaccgcgcaggcggtcgccgcacatctgctggccgaactgtccggcgtacgacagcacgaggacgaggtcgccccgacggccgaccacgacgacccgatcgccatcgtcggcatggcctgccgctaccccggcggcgtacgcggacccgaggacctgtgggacctcgtccactgcggacgcgacggcgtcggcgacttccccaccgaccgcggctgggacctgcccgccctgcgccgcctggcaccggacctcgccatgaagggcggattcctgcccgacgccgccgacttcgacgccgccttcttcggcatctccccgcgtgaggcgaccgcgatggacccccagcagcgactgctcctggaggtgtcctggcaggccctggagggcgcgggcctcgacccggcggccctgcgcggcagccgcaccggagtcttcgccggcgccgcgggctcggactacggcgtggtgctggaaggggccccggaggcggacggatacctgaccaccggcaccgccgcgagcgtcatctccggccggatcgcctacaccctcggcctgcacgggcccgcggtcaccgtggacacggcgtgctcctcctcactggtggccctgcacatggccgtgggcgccctgcaccagggtgagtgcgacctcgcgctcgccaccggcgtctccgtcatctccacgccgggcgcgttcgtcgacttcgcccggcagagcgggctcgccgccgacggccgctgcaaggcgttcgccgcgagtgccgacggcaccaactgggccgagggcgtgggcgtcctggtcgtggagcggctctccgacgcgcggcgcaacggacaccgcgtcctcgccacggtccggggcagcgccgtcaactccgacggcgcctccaacgggctctccgcgcccaacggcggagcacagcagcgggtgatccggcaggcgctggccgccgccggactgtccgccgacgacgtcgacgccgtcgaggcgcacggtacgggcacgacgctcggcgacccgatcgaggcgcaggcggtcctggccacctacgggcgggaccggccggccggacagccgctgtggctggggtcgctcaagtccaacatcgggcacagcggggccgcggccggggtcggcggcgtgatcaagatggtgcaggccctgcggcacggcgtactgccgcgaaccctgcacgtcgacgagccgacgcccgaggtggactggtcggcggggacggtgggactgctcaccgagaaccgagagtggccgcacaccgggaagccacgccgggtgggggtgtcggcgttcggagtcagcggcaccaacgcacatgtcgtactggaacaggggcccgaagaaacgcccgaggaagcgcccgaagaagcgccggaagaaacccccggagaggcgcccggggcgaccgccccaccgctcctcccgtgggtgctctccgcccgcacccccgaggcgctgcgcgcccaggccgcccgcctggccgcccgtcttgccgagcgggagctgcccgccgccgccgtcgggcacgccctgctgacctcccggtcggacttcgagcaccgggccgtcgcgctgggcgcgggacacggcgagctcaccgaggcgctgcgcgcgatcgccgccggggagcccgccggctccacggtcaccggcgtggcccgccgggccgccggacgcggcccggtcttcgtcttccccgggcagggcggacagtggcccggcatggccgccgaactcctcgacaccgcaccggagttcgccgcccgctgggccgagtgcgagcgcgccctcgcgccgtacacgggcttctccgtgaccgagctcgtgcgctcgggcacgcccctggagcgcgtggacgtcgtccagccggtgctgttcgcggtcatggtgtcgctggcggcgctgtggcgctcgtacggcgtggtgcccgccgcggtggccggacactcgcagggcgagatcgcggcggcctgcgtggccggggcgctgtccctggacgacgcggcgcgcgtggtcgcgctgcgcgcccaggcgctccgcgcgctcgtcggcgagggtggcatggtctccgtcggcatccccctcgccgaggccgagcggtggctgccgcgctgggacggacaggtctccgtcgcggccgtcaacggcccctccgcggtggtgttctccggcgcacccgccgccctggacgacctggtggcccacgcccgcgaccaggacgtccgggtccggcgcatcgacgtcgactacgcctcgcactccgcgcaggtggagcggatcgaggacgagatcatgaccgccctcggcccggtccggccggggccgggacagatcccgttcttctccaccgtgaccgccgactggcaggaccccaccggcctcgacgccgcctactggtaccgcaacctgcgcgaaccggtgctcctcgaaccgtccgtcaccgccctggccgagcagggctacgacgtcttcgtcgaggtcagcccgcacccggtgctcggcgccgcactcaccgagaccgccgaactggccggagcggaaccggtggtgacgggcaccctgcgccgcgacgagggcggtctgaagcgcgtacgcacggcactggccgaactgtggacgcacggcgtccccgtggactggacgcccgccttccccggccggcacggcacaccggtggaactgcccgcctaccccttccagcgcacccgctactggccggcggcccgcccggcggtggcccaggacccgcaggacgagcggttctggcaggccgtggaccaacaggacctgcccaccctggccggcacgctcggcctcgccgacgaacagccgctgcgcgagctcgtaccggccctgtccgcctggcggcgcgaccgcaaggagcgggccgccgtcgagtcctggcgctaccgcatcgagtggcgccggctgcccgagccggagcgccgtacgctgcccggcacctggctcctcgtggtgccgaccgggaccgggaccacggacgaaccgttgaccgggaccgggaccacggacgagccggtgaccggcgccaccaccggcggcaccgcggacgacccggtgaccgccgccgtcaccgccctcctgcgggaacgcgccgaacagctcgtggtgctcgccgtcgaccccggctccgaccccaccaccctggccaccgccctccgcggcgccctcggcggcacggagccggccggtgtggtctcgctgaccggcatcgacggttcgccgcacccggagcggcccgtcgtcccggcgggcgcggcgctcagcctcgccctgctgcgggcgctcgccgacgcccgggtcaccgcgcccctgtggtgcctgacccacggcgccgtcaccaccgacgacgacgccggaccggtccaccccgaacaggccgccgtatgggccctcggccgggtcgccgcgctcgagttcccgggcacctggggcggcctcgtcgatctgcccgaccccctcgacgaccgcacggcggaccgtctcgcggcggtgctcgcgggcctcgacggcgaggaccaggtggcgctgcgcccgtcgggcgtcttcggccgccgcctcgtacgcgccaccccgcgcgccacggccggcacgggctggcggccgcgcggcaccgtgctcgtgaccggtggcaccggagcgctcggccggcgggtcgcccgctggctggcccgcgagggcgcggaacacctcgtcctcaccagtcggcgcggcccgctcgcacccggcgccgacgcgctcgtcaccgaactcaccgggctcggcgtcaaggtcaccctgctctcttgcgacctcgccgatccggcccaggtgaccgcgatggtcgccgaggcgcagcgcgacggcgacccgatcggcgccgtggtgcacaccgcgggcggcggcgggctcggcccgctggccgaggccgggcccgacgacctggccgaggcgatggccgccaaggtgaccggcatcgcccacctggaagcggccctggaccccgaacagctcgacgccgtcgtctacttctcctccatcagcgcctcctggggcgccggcgaccacggcgtctacgccgccgccaacggcgtgctcgacgcccgtgccgaggcccgcagcgcggccggcgtgcacaccgtgtccctcgcctgggcgccctgggcgggcggcggcatggccgacgacccggtcttcgacaccctctcccgcaagggcctgcccctcatcgacccggacctcgccgtctccgcgctcgccgcggtgctcgcggagggcgagtcctcgctgctgctcgtcgacgtcgactgggagcggttcaccccgcagttcaccttcgagcggcccacccgcctcctgaccgaactgcccgaggcccgccccgaaccggccaccgacgacaccgcgcccgacaccgccgcctccccgctcgcccaacggctggccgcactgaccggaccccagcgcacggcggccctgcgcgacctggtgcgcgaacaggccgcggccgtactcggccacgccgacgcacggtccgtcgaccccgcccgcgcgctcaaggagctcggcttcgactcgctcaccgcggtcgaactgcgcaaccggctgagcaccgcgaccggcctcaggctgcccgccaccatggtcttcgaccacccgaccatcgccgaactggcggatttcctggcccgcggcctcacccccgaggccgccgtaccggccgaacccgccaccgtcgtacgcgtcgaccaggacgacccgatcgccatcgtcgcgatggcctgccgctaccccggcgacgtcgcctccgccgaggacctgtggcgcgccgtgcgcgacgaggccgacctgatcaccccgttccccaccgaccgcggctggccgctcggccgactcgtcgacgccgccgaccccgaccggccgggcaccagctacgtcggccacggcggattcctgcacggcgcgggcgacttcgacccgggcttcttcggcatctcgccgcgcgaggcccaggccatggacccgcagcaccggctgctgctcgaatcgtcctgggaggcgctggaacgcgcgggcatcgccccgaggtcgctgcgcggcagcaggaccggggtgtacgtcggtctgaccgaccaggcctacgggacccggctgcgcggctccaccgacggcatggagggctacctcgtcagcgcgtccgccaacgtcgcctccgggcggatctcgtactcgctcggcttccagggacccgcgctcaccgtggacacggcctgctcctcctcgctggtcgcgctgcacctggccgcgcaggcgctgcgggacggcgagtgcgacctggcgatcgcgggcggtgccaccgtcatgccggaccccacctccttcgtggcgttcagccggcagcgcggactggccgccgacggccgctgcaagccgttcgccgccgccgcggacgggttctcgctcggtgagggcgccggtgtgctgctcgtggagcggctgtccgacgcccgccggctcggacacccggtcctcgcggtggtccgcggctccgcggtgaaccaggacggcgcgtccaacggcctcaccgcgcccaacggccccgcccaggagcgggtcatccggcaggcgctggtcaacgcggcgctgcccgcctcggccgtggacgtggtcgaggcgcacggtacgggcacgacgctcggcgacccgatcgaggcacaggcgctgctcgccacctacggccaggaccgcccggccggccggccgctgcggctgggctcggtcaagtccaacatcgggcacagccaggccgccgcgggcgtcgccggagtcatcaagatggtgcaggcgatgcggcacggactgatgccccgcaccctgcacgtggacgccccgagtccgcacgtcgactggagttccggggcggtggaactgctcgaccgggcccaggagtggccacgggacggcgcaccgcgccgcgcgggcgtctcggcgttcgggatcagcggcacgaacgcgcacgtgatcctggaggaggcacccgacaccctggaggaggcacccgacgagcccgccggcgagtccaccgacgagcgggccgacgagcccaccgacgagcgggccgacacggacaccgggcgccccgcccccggcgtctccgtccccaccgccggccgccccgtccccgtcgtcgtctccgcccgcacccaggacgccctccgtgaccaggccgcccggctgaccgccctcctcgacgagggcgggcacggcgtcaccgatctcgcccactccctggccaccacccgcagcgtcctcgaccgggcggcggtgctcgtcgccgccgacccggacgaactgcgccgcggcctcacggacctgtccgcgggcgccgtcgccgaggagcgcgccgagggccggctcgccttcctcttcaccggccagggcgcccagcgcaccggcatgggccgcgccctgtacgcggccttcccggcgttcgcgtcggccttcgacgagctgtgcgccgccctcgaccgccatctgccgcgcccgctggcctcggtcgtgttcgccgagcccggctcgcccgaggccgcgctgatcgaccagaccctctacacacagccggccctgttcgccgtggaggtggcgctgttccggctgctggagcactggggcgtacggcccgacgccgtgctcggccactcgatcggcgagctcgccgccgcgcacgtggccggcgtctggtccaccgccgacgcggcccgggtggtcaccgcccgcgcccggctgatgcaggaactgcccgagggcggcgccatgctgtccgtcgccgcggccgaggacgtggtgtccgcgctgctcggcgacgcgttcgacgaggtgtccgtcgccgccgtcaacggcccggcctcgatggtgctgtccggcacggaggaggccgtcacggcggcgggtgcccggctcgccgaggcggggctgcgcaccaagcggctcaccgtgagccacgccttccactcgccgctgatggaaccgatgctcgccgcgtacgagcgcgaactggcccaggtgaccttcgccgagcccgaactgccggtcgtctccaacgtgaccggcaagccggccaccgccgagcagctgtgcgaccccgcctactgggcgcggcaggtgcgggggaccgtgcggttcgcggacggagtggacagcctgctcggcgaggaggtgaccaccttcctggagctgggcccggacggcgtgctgaccgccatggcgaaggagtcggccggggcgggcgccaccggcatcgccgtccagcgccgcgaccgcgacgaggtacggaccctgctcaccgcgctcggcaggctgcacgtgcgcaccggccgcgtcgactggcccgcgttcttccacggcaccggcgcccgccgggtggaactgcccacgtacgcgttccagcaccggcggtactggctggacgcgcccacgggcggcgtcgaggcgctggccggcgcgggcctggcgggcaccgggcacccgctgctcacggcggccgtgccgctgcccggtaccggcgggtcgctcttcagcggcagcctgcccggcatcgacgaagaacggccgccgtcccgcggcgacatcctcgatctggtgctgtgggcggccggcagcctcggctgcgaccggatcgccgaactcgacgtccccgccgcgctgcccggcggaccgcacgccccgctgcaactcgtggtggcggcgccggacgaggacggcgaccgggacttcaccctccacgtggggcccacggactccggtgacgccggggacgagtcctggacgcggatcgcgcacggcaccgtcggcggtgcggccgcccggcccgagcccgaccccgccgcctggccgcccgccgacgccgaacccgtcggcgcggacgcggtgtggcgccgggcggacgagctgttcgccgagctggtgctgaccgagcaggaggcgggcgacgccgaccgcttcggtctgcaccccgagctgctggcgggcctgacggacctgatcaccgaactcgccggcgagccggtccacttcgccggggtgacccggtacgccaccggcgccaccgagctgcgggtccggctgacccgctcgggcccgggcgccgtagccgtgctgctgtcggacgcggagggcgagccggtgctctcggtggaccgcgtcggcgtacggacgggcaccgcgcccgccacgacgcccgccggcgcccccaccggacctgactcgctctatcgcctgacctggacacccgtggcggccgtggctcccgaaccggccggcccttgggccgtcgtcggcgcggacggcctggccaaggcgctcgtcgccacccagggcgccgaagtcgaggcccacccggacctcgcgtccctcggccgctccacggagcacggcgccgcgcccgggctcgtcgtcctgtccgtggacacggaacccggcgcgaccgtcgagtccatgcggcacaccacccaccgcaccctggagctggtcaaggaactgctcgcggacggccgcctggccggggcccggttcgtcctcgtcacccgcgcggccgtgtccaccggggacggcaccccggtcgacccggcgcaggcggcggcccgcggactgctgctgtcggcgcaggcggagcacccggagcggttcgtcctggccgacctcggcggccgcgacgcggacgccgaactgctcgccgccgccgtgggaaccgcactgaccgaggccgaaccgcaactcgccgtccgggacggccaggtgctcgtgccccggctggcccaggtcaccgaacggcccaccgacggtccggcggaacgcggcccgggaggcgaacacggcacggtggtggtcaccggcgcgaccggcggcatcggcaccgagatcgtgcggcacctggcgaccgcgcacggcgtgcggcacctgctgctgctcagcaggcggggccccgacgacccgcgcgcggccgaactgggccgagtccttgccgaggcgggcgccgacgcgaccttcacggcctgcgacaccgccgaccgcgccgccctggccgacgcgctggcggacgtaccggccgagcaccccgtgaccgccgtcgtacacatcgccggagtcgtcgacgacggagtcctcaccaccctgacccccgaccggatcgacaccgtgctgcggcccaaggccgaggcggcgcagcatctgcacgagctgaccgcggacctcgggctgtcccacttcgtgctgttctcctcgggcgtcggcaccttcggcggcgcgggccaggccaactacgcggcggccaacgccttcctggacgcactcgcccaccgcaggcgcgcggccgacctgccggcgacctcgctcgcctggggcctgtgggagaccacggccggcatgtcggcgcacctctccgacgtggaccggcggcggatggcccaggccggcgtcctcgccttcaccccgcggcagggtctcgccctgttcgacgcggcgtggaactcggacgcgaccaccttggtacccatgcgcctcgacaaggccgtactgcgcgggaaggcggccgaggcgaccctgcccgcacccttccgcggcctggtccgcgcacccctgcgcagggcctcggcggccggtgcgcgggcggccgggcagtccttcgcgcagcagctggccgagcagtccgagagcgggcggcgacagctgctgctggatctgatccaccggcaggtggccgccgtactggactacgcggccgacgccccgctcgacgccaaactccccttccgggagctgggattcgactcgctcaccgcggtcgagctgcgcaacggcctgatcgccgcgaccggcgtccagctctccgccgcgctcgtcttcgactaccccacggcgaccgcgctcgccgagcacctggagagcaaggtcctgcggtcggtcgccggggctccgctgccggcgctcacccagctcgaccatctcgaagccgcgctcgccacctcgccaccggaccgggccacccgcgaacagctcgcggcccggctgcgccggctggcctccgcctggagcgcggacgaactcgaagccgacgacggcgacatcaccagcaagctcgattccgcctcggatgaagagctcttcgacttcatcaacgcggaattcggaaaggac

SEQ ID NO: 2886 - DNA, 18438 bp, Streptomyces avermitilis
  CDS (1)..(18438)
atggcgtgccggctgccgggtgcggcgggaccggccgagttcctggctctcctccgaaatggcgaggacgccgtcggtgccgctcccggggaccggcggtacgcgccacggcggggcggattcctcgactccgtcgacgagttcgacgccggcttcttcgggatctccccgcgcgaggccgcggcgatggacccgcagcagcggctggtccttgagctgagctgggaggcgctcgaggacgccgggatcccgcccgcccgcctcggcggcagcggcgccggggtcttcgtgggcgccatcgccgacgactacgccacgctgtcccgcgccgccggcgccgacgccgccaccccgcagacgacgaccggtctgaaccggggcatcatcgccaaccgcgtctcctacacgctgggcctgcgcggaccgagcttcaccgtggactcgggacagtcgtcgtcgctggtcgcggtgcatctggcggccgagagcctgcgccggggcgagtgctccgtggccctggcgggcggggtgaacctgatccttgccgaggactccaccgtcgccgtggaacggttcggggcgctctccccggacgggtactgctacaccttcgacgcgcgggccaacggctatgtgcgcggcgagggcggtggcgtcgtcgtactcaagccgctcgccgacgcgatcgccgacggcgacgacatccactgcatcctcgcgggcagcgcggtgaacaacgacggcggcggcgaggggctgaccgtcccggaccgcgccggccaggaagcggtgctgaccgccgcgtacgaacaggccggaatctccccggccgccgtcggctatgtggagctgcacggcaccggaacccccaccggcgatcccgtcgaggccgccgccgtcggggccgttctcggcgccgggcgtccggccgggcagccgctgctggtcggctccgtcaagacgaacatcggccacctcgaaggcgccgccggtatcgccggcctcctcaaggccgtactggccgtgcgccaccgggagatcccggcgaccctgcaccacgcgtccccgaacccggccatccccatggcggagctcggcatcggcgtcaacacggcactcacaccctggccggagcaggcagggccgctggtcgtgggcgtgagctccttcggcatgggcggcaccaactgccacgtggtgctcaccgaacccgcggggtacgacgccgccgctcggccggccacggccgggatcaggcccgccgggacaccggccccgctgctcgtctcgggccgcgacgaacaggcgctgcgcgcccaggcacgcaagctgcgggaccacctcgacacgcaccccggcctccccctgcgcgacgtcgcccacacgctggccgccgcccgtgccccgctcgcccggcgcgcggtactgctcgccgcggaccgggaggacgtgtccgccggtctcgcccggctcgccgacggcacacccggcgcggacctcgtgcgcggcacggtctccccgggcgcgctcgcgttcgtcttcaccgggcagggcagccagcgccccggcatgaccgccgagctgtaccggacgtccgcggagtacgccgccgccctggacgaggtgtgcgcgagcctggacccgtggctgcgacggccgctgcgggacgtgctgttcgcggcggaaggttccgacgaggcggcgctcctggaccgtaccgagttcacccagcccgccctgttcgccgtcgaggtcgccctcttccggtacgccgagcactgcggcctgacaccgcggttcctgctcggtcactcggtcggtgaactggcggccgcgcacgtcgccggagtcctctccctggcggacgcctgcacgctcgtcgccgcccgcggccggctgatgcaggaccggccggcgaccggcgcgatggtgtcggtccaggccaccgaggacgagctggcaccgttcgtctccgagtcggtgaccctggcggcgctgaacggccccgcctccacggtgatcgcgggtgacgaggacgccgtactggccgtcgccgcgcactgggcggcccggggacgcaagacgaaacgactgcgggtcagccacgcgttccactccccgcacatggacgggatgctcacggagttccgccggatcgccgccggactgaccttcggcgcgccccggatcccgatcgtctccaacgagacgggcaccctgctcaccgaggccgacgcccgctcaccggagtactgggtacggcacgcccgtgccgccgtgcgcttcctggacggggtgcgcctcctcgaggaccagggcgtgaccacgctgctcgaactgggccccgacggggtgctgtcggccatggcacgggactgcctgcgcgatgccgggaccgtgtgcgtgcccctgctgcgcggccgcgaccggaccgaaccggaggcgctgctcgccgcgctcgccggactgtacgtccgcggcgtaccgatggactgggagcggacggccaccgaggcgggcgcacggcgggtaccgctgcccacgtacgcgttccagcggaggcggcactggctgccggagccctcggcgagcgcgtcccggcccgtggtgaacggtggtgggcacgcggggcaggcggggcacgcggggcaggcggggcgcgcggggcaggcggggcacgccgggcacgatggcgagcccgcccccgcggtccgcgaccgtacgacaccggaactcgtccgcgaccgtacgacgctggaactcgtccgtgacgccacggcccaggtgctcggccacgcgtccccggacgacgtcgcgacgcacgaggcgttcagggaactgggcttcagctccctgatgctggccgaactcggtgaacgcctcaccgaggcgaccggccgcagggtgcccaccacgctgctgttcgaccacccgacgccggacgccctcgcgcgccggctcgaggccgacggggcggagcgcacggacgcaggcccggtgagcccgccggccgccgccgcgcacgacgacgaccccatcgtgatcgtcggtatgggctgccggctgcccggcggcgtccggtcgcccgaggacctctggcggttcgtggccgccgggggcgacgcgatctccgcgctgcccgtcgaccgcggctgggagttcgccgcggacttccccggcgagggcgggttcctcgcggacgtggccgagttcgacgccggattcttcgggatctctccgcgtgaggcgctggcgatggatccgcagcagcggttgttgctggagacgtcgtgggaggcgctggagcgggcgggcgtggacgcgctgaagctgcgcggcagccgcaccggcgtcttcgtcggcgccagcccctcggagtacgggccccggctgcacgagacctccgacgccgacgggcatgtgctgaccggtacggcgcccagcgtgctgtccgggcggatcgcctacgtgctggggctggagggcccggcgctgacggtggacacggcgtgctcgtcgtccctggtggcgctccatctggcggcccaggcactgcggggcggcgagtgcgatctcgccctggccggcggtgtcacggtgatggcgacctcgggcatgttcgccgagttcgcgcggcaggggggcctggccccggacggccggtgcaaggcgttcgccgacggagcggacggcacgggctggggcgagggtgtcgggatgctggccgtgcagcggctgtcggacgcggtgcgggacgggcgtccggtgctggcggtggtgcggggttcggcggtgaactcggacggtgcgtcgaacggtctgacggcgccgaacggtccgtcgcagcagcgggtgatccggcaggcgctcgcttcggccgggttgtcggcggcggacgtggacatggtggaggcgcacggcacggggacgtcgctcggcgacccgatcgaagcgcaggccctgcttgctacgtacggccaggaccgtccggacgaccgtccgctgtggctgggttcggtgaagtcgaacatcggtcatacgcaggcggccgcgggtgtggcgggtgtgatcaagtccgtactggccctgcggaacggactgctgcccaagaccctgcacgtggacgagccgacccccgaggtggactggtccgcgggcgcggtggagctgctgacggaggggcgggagtggccggagacggacgggccgcgtcgggcgggcgtgtcggcgttcgggatcagcggcacgaacgcgcacgtgattctggagcaggcgccgtcggtcgaggaaccggtgaccgcgcctgcggatgacgggttgttggtgccgtgggtggtgtcggcgcggtcggaggaggcgttgcgggcgcaggcccggcgcctggccgaccacgtacgggagagtggacttcggccggccgacgtgggtctgtcgctggcggtgacgcgtgccgggctggagcaccgggcggtgctggtcgcggaggacgaggccggattcctggcccacttggacgcgctggccgagggcaggaccccggccggtgtggtggtggagggcgggacggcgttcctgttctcggggcagggctcccagcgcgcgggcatgggccgtgagctgtactccgcccaccccgtgttcgcggccgccttcgacgaggtgtgcgccgccttcgacggtctgctgcccggggcgctgcgggaggtcgtgttcggcggtgcgggcctggaccggaccgagtgggcccaacccgcgttgttcgcgttggaggtggcgctgttcgagctggtgagttcgtggggtgtgcgcgcggatgtgctgttgggccattcgatcggcgagctggctgccgcgtatgtggcgggggtgtggtcgctggcggacgcgtgccggatcgtggcggcgcggggccggttgatgcaggcgctgccggagggcggtgcgatggtcgccgtcgaggcggccgaggacgagctgcccgaccttcccgggggtgtgtcggtggctgcggtgaacgggccccgttcgctggtgctgtccggcgatgaggagccggtgaccgcgctcgcgcaagcgtttgctgaacagggcaggcggaccaagcagttgacggtcagtcacgcgttccattcggcgcggatggagccgatgctggcggagttcgccgagacgctcgccgccgtggagttccgtccgccgcgcatccccgtcgtgtcgaatgtgacgggtgagatggcgggcgacgagttcaccacccccgcctactgggtgcggcacgtccgggaagccgtccgtttcgccgacggggtcggcgcggcccacgccgcaggcgtccggcggtacctcgaactcggtccggacggcaccctgaccacactcgcccacgacaccgcccacgacgccggccgcgacgtggccgccgtacccgcgctgcggggcgaccagcccgagacccggaccgtggtgaccgccgtcggccgcctgtacgccaccgggctgaccgtggactggcccgccttcttcgctccgtacggtgcccgcccaaccgagctgcccacctacgccttccagcaccgccgttactggctggagccggtcgcaccgtcgtccgcgcccccggcgaacccactgcgctaccgcaccgcgtgggcgtccgtgcccgacggcccccggccctcgctgagcggcacctgggccgtcgtcgtaccggcatccgggtcgtacgaggacatcgtggccggtgtgacggccgcactgcgtgaccatggcgcgcggcccgtcgtggtggaggtcgacccggccggacccgagcgcgccgacgtcgcggacaccctgcgcgcggcgctcggcgaggacgccgggggagtggtgtcgttgctcgggacggccggctcgctctcctcgggcgtggccgcgaccgccgtgctggtgcaggcgtggaccgatctcggcggcggcgcccggctgtggtgtctgacccggggcgcggtgtcggtgagcccctccgacccgctggccgcgccggcgcaggcgcagctgtgggggatgggccgggtcgcggcgctggaacacccggagcgctggggcgggctcgtcgacctgcccgccgtaccggacgaccgggcgtggacccggctgtgcgccgtactggcgggcggaagcggcgaggaccaggtcgccgtccgtgccgccggcctgttcgcgcggcggctgggccgggccggtacgcgggccgacgccgcccccgccgggccgagcccctggcgtacggacggcacggtgctcgtgaccggcggcacgggggcgctcggcgcgcacctcgcgcagtggctggcggcggccggagccgcgcatgtgctgctcaccagcaggcgtggccccgacgccgacggagccgcggaactgacggcgcggctgcgcgagacgggaaccgaggtgacggtcgccgcgtgcgacgtgaccgaccgggacgccctggcggagctgctctccgggctgcccgccgaccggccgctgaccggtgtcgtacacgccgcgggcgtcctggacgacggcgtgctcgactccctcacccccgaccggttcgccgccgtcgccggacccaaggtgaccggggcgtggcacctgcacgagctcacccgggacctggacctctcggcgttcgtgctgttctcgtccttcgcgggcaccgtgggcctggccgggcaggccaactacgccgccgcgaacgcgtacctggacgcgctggccgtccaccgggcccagctcggcctgcccgcgaccgcggtggcctggggctcctggtccggcgccggaatggccgccgacaccgaggccgcccggcgccaactggcccgcaccgggctcgtccccctcgccccggacgccgccctggccgcgctcgggcaggtcatggacgacggcgagaccgcggtgaccgtcgccgacgtcgactgggaccggttcgcggcgggcttcggacccggccggccgagcccgctgctcaccggcgtccccgaagtacggcgcatcgaggagcgggagaccggccgcgccggcgccccggcggagacggaccggctcggcgggctgaccggcgacgcgctgcgccaggcactcgccgacctggtgagcaccgaggtcgccgccgtcctcgggctgccgcccaccgaccgggtgcgggaggacacgaccttccgggcgctcgggttcgactcgctgatcggtgtcgagttccgcaaccggctcgccgcggccaccggcaggcggctgccgccgagccttatcttcgaccacccgacccccggcaggctcgtcgaacacctggcggcaggcctggacggaaccggcccgaacaccgccggggaggaacgggtcgcaccggcccgtacccacgacgacccggtcgtgatcgtgtcggccgcctgccggttccccggcggcgtcacgaccccggaggagctgtggcagctcgtcctcgacggcggcgacgccatcggccccttcccggccgaccggggctgggacctcgaccgcctgtacgacccggaccccggcaaccccggcaccagttatgtgcgtgagggcggcttcctgaccgacgtggcggacttcgacgccgcgttcttcgggatctcgccgcgcgaggcgctggccatggacccgcagcagcggctgctcctggagacctcgtgggaggcgctggagcgcgccggcatcgtgccggcctcgctcgccggcagccgtaccggcgtcttcgtcggctccaacggccaggactacgccaccctgctcggcgagtccgaggtcgaggggcatgtgctgaccggtacggcgtccagcgtgctctccggccgtatcgcctacaccctggggctcgaaggacccgcgctgaccgtcgacaccgcctgctcctcctcgctggtcgcactgcacctcgccgtccaggcgctgaacgcgggcgagtgcgacctcgcgctcgccgccggggtgaccgtgatgtccagcccggagatcttcgtggagttctcccggcagcgcggcctctccgcggacgggcgctgcaaggcgttcgggcccgacgcggacggcaccggctggggcgagggcgtgggcaccgtactcctggagcggctctccgacgcccgccggctgggacacgacgtgctgggcgtggtgcgcggcaccgcggtcaaccaggacggcgcgtccaacgggctcagcgcgcccaacgggcccgcgcagcagcgggtcatccgccaggcgctcgccgacgccggctgcgtgccctcggacgtggacgccgtggaggcgcacggtacggggacccggctgggcgacccgatcgaggcgcaggcgctgctggcgacgtacgggcgggaccggccggccgaccggccgctgtggctcggctccgtgaagtcgaacatcgggcacacccaggccgcggccgggatggccggagtgctgaagaccctgtccgcgatgcggcacggacagctgccgcgcaccctgcacgccgcccggccgaccccgaaggtcgactggaccgagggcgcggtcgaactgctcaccgagacccggccctggcccgccaccggcgcccggccgcgacgcgcgggcgtgtccgccttcggtgtcagcggcaccaacgcccatgtcatcctcgaacaggcacccgcaccgcagccggcccggcccgccgtactgccaccgctcctcaactccccctccgtgccctgggtgctgaccgccaagtccgaagaagcgctggccgcccaggcggaccggctgagcgcacggctgcccgaggcggcgcccgccgaggtcggccggtccctcgtgacgaccagggcgacctggccggagcgggccgtactcatcggtgacggctccccgcacttcgcggcggggctcggcgcgctggccggcggcgcgggggacccgcgggtggtgcgcggcaccgccgacacccgcggccgggtcgtcttcgtgttccccggccagggcgcccagtgggccggcatggccgcgcggctgtgggagtcgtcgccggtgttcgcccagtggatggaccgctgcgccgaggtgctggcgcggctgaccgactggtcgctgaccgaggtgatccatgagacgcaggacgcacccggactggaccgggtcgacgtggtgcagcccgcgtcctgggccgtgagcgtgtcactggccggcctgtggcgtgcctgcggtgtcgagccggccgccgtggtcggacactctcagggcgagatcgccgccgcctgcgtggcgggcggactgtccctggaggacggcgccgccctcgtgacgctgcgcagcaggctgatcgccgaggaactgtccgggcacggcggcatggtgtccgtggccctgtcccccgccgacacggccgaacgcatcgcccgctggaacggcgggatctgtgtcgcggcgaacaacagccgccgctccaccgtcgtgtccggcgaaccggaagcgctggccgaactgctcgccgagtgcgaggccgagggcgtacgggcccgccgcatccccgtggactacgcctcccactccgcccaggtggagcggatcgagcggcagctgaccgagctggcggccggtgtcgcaccgcgcccgggggacatccccttccactccacgacgaccggcggcccgctcgacaccacgggcctggacgccgactactggtaccgcaatctgcgccggcccgtgctgttcgggccggtcaccgaggaactcctcgcccagggccacgacgtgttcctggagatgagcccgcacccggtactcgtccccgcggtgcaggacgccgtcgacgcgaccggcacgaccgccgccgccgtgggcagcctgcgccgggacgacggcggccccgagcggttcacgctctccctggccgaggcgttcgtgcgcggcgcccccgtggactggacggccgtgctcggcaccagcggcgcccgccgggtcgagctgcccacctacccgttccagcgcggccggttctggccggagccccgcacggcggccgccacgaccggcggtgccgaggaggacgcgccgctgtggcgggccgtggaccgcggcgacctggccgccgtcgccgccgaactcgccctccccgacggggagtcgctgcacgacctgcacgacctggtgcccgccctgtccggctggcgccgcaggcgcaaggactcggcgctggtcgacagctggcgctaccgcgtctcctggaccccggtgaccgccccggtcctggccgccctgaccggcgactggctgctggtgaccgcggacccggacggcgaggccgcccggtgggcgcgtacggcgctcggcgcgagcgtcaccgcccagctcacctcgccggacggcccgataccggcgggcccgtggacaggcgtggtgtccctgctgggactggccgaccggccgcacccggaccatcccgtcgtaccggtgggcgtcgcggacaccgtggccctgctgtccgcgttgcgcgaggccgggatcgacgcgccgctgtggggtctgaccaggggcgccgtcggcaccggacgctccgaccaggtccgcgcgcccggccaggcccagctgtggggcctcggacgggtcgccggcctggagaaccccgccgcctggggcggactcgtcgacctgcccgccgaactggacgaccgcgccgccggactgctgcgggccgcgctcgccgcgggcgaggacgagcaggagtacgcgctgcgccccgccgggctgtatgtgcgcaggctggtccgtgctcccctggacgggacggcggcgcgacgctcctggcggccccggcccgacggcacggtcgtcgtcaccggcggcaccggcgcgctgggcgcccgggtcgcccgctggctcgcccacgcgggcgccggacacctcctgctgaccagcaggagcggtatggccgccgacggcgccgacgacctggtagcggaactgcgcgcgctgggcgcccgggtcacggtcgccgcctgcgacgtggccgaccgcgcccagctcgccgcggccctggacacggtgccggacgagttcccggtcgccgccgtggtccacaccgcgggcgtgaaccgcaccgccaccctcgaccggaccaccctcgccgagctggcggacgtcatgtcggcgaaggccgccggcgcccgcaacctggacgaactcctcgccggtcacgacctcgacgcgttcgtcctcttctcctccggcgccgcgatctggggcagcgcgggccagggcgcgtacgcggccgccaacgcgtacgccgacgcgctcgcggcggaccggcgcaggcgcggcctcaccgccacctccgtggcctggggcagctgggccggcggcgggatggtcgacgacgacctggcgcgggacctcgcccgcggcggggtgcgctcgatggacccggaccgggcgatcggcgcgctccagcaggccctcgaccacgacgagaccacgctgacggtcaccgacatggactgggagcgcttcgccgggacgttcaccgcggcccgcccgcgccccctcatcgacgccatcccggaggccgcccgcgccgccacgacggatccggccgccggagagtccgaactggccgccaggctggccgggtcgaccgacggcgaacgcgaacgcgaactcctcgacctggtcaggaccgccgccgccctcgcgctggggcaccggggcgccgaggccatcaccccgtcgaagcccttcaaggacctgggcttcgactccctgaccgccgtcgacctgcgcaaccggctcaccgccgcgaccggcgtacgtctgcccgccacgctcgtcttcgaccaccccacgccgctcgcggccgccgtcgagttgcggacgcggctgttcggcggcgacgcgctcccgacgtccgcggggtccgtggcgcccacggcggccgaggccgacgatccggtggtcatcgtcgccatggcctgccggttccccggtgaggcgacctcgccggagaagctctgggacctgatcgcggcgggcaaggacggaatcggggacttccccgccgaccgcggctggagcgtcgccgccgacgccgcgttctcccagaccggcgggttcctcccggacgtggccgagttcgacgccgggttcttcgggatctcgccgcgtgaggcgctggcgatggatccgcagcagcggttgttgctggagacgtcgtgggaggcgctggagcgggcgggcgtggacgcgctgaagctgcgcggcagccgcaccggcgtcttcgtcggcgcgggctcccacgactacggcaccctgctcacctcactcgaaggaggccaggactacgcgctcaccggagccgtcggcagcgtgctgtccgggcggatcgcctacgtcctggggctggagggcccggcgctgaccgtggacacggcgtgctcgtcgtccctggtggcgctccacctggcggcgcaggcactgcggggcggcgaatgcgacgtggccctcgcgggcggcgtggcggtcatggccacccccgacgccttcgacgcgttcgcgcggcaggggggcctggccccggacggccggtgcaaggcgttcgccgacggggcggacggcacgggctggggcgagggcgtcggcgtactcgtgctgacgcgcctgtccgaggcgcggcgtcgcggccatgacgtgctggcggtggtgcggggttcggcggtgaactcggacggtgcgtcgaacggtctgacggcgccgaacggtccgtcgcagcagcgggtgatccggcaggcgctcgcttcggccgggttgtcggcggcggacgtggacatggtggaggcgcacggcacggggacgtcgctcggcgacccgatcgaggcacaggcgttgctggcgacgtacggtcaggaccgtccggcggaccgtccgctgtggctgggttcggtgaagtcgaacatcggtcatacgcaggcggccgcgggtgtggcgggtgtgatcaagtccgtactggccctgcggaacggactgctgccggcgacgttgcatgtggatgagccgtcgcgggaggtggactggtccgcgggtgcggtggagctgttgacggaggggcgggagtggccggagacggacgggccgcgtcgggcgggcgtgtcggcgttcgggatcagcggcacgaacgcgcacgtgattttggagcaggcgccttcggtcgaggaaccggtgaccgcgcctgcggatgacgggttgttggtgccgtgggtggtgtcggcgcggtcggaggaggcgttgcgggcgcaggcccggcgacttgccgaccatgtggcagccacggatctcaccgtcgcggatgtcggctactccctggcggggacgcgtgcggggctggagcaccgggctgttctgacggggcgggagcgggaggacttcctggtccagttggccgcgttggcggagggtgcgagtgccgcggggatggtgcggggtgtggccggggagggcgggacggcgttcctgttcaccggtcagggtgcgcagcgtctgggtatggggcgtgagctgtacgagcgtttcccggtgttcgcggctgcgttcgacggggtgtgtgcgcagttggatctgttgctggagcggccggtgaaggaggtcgtcttcaccgacgcgccggcgttggaccgcacggtgttcacgcaggccgggttgttcgcgttggaggtggcgctgttcgagctggtgagctcgtggggtgtgcgcgcggatgtgctgctggggcattcgatcggcgagctggcggccgcgtatgtggcgggggtgtggtcgctggcggacgcgtgccggatcgtggcggcgcggggccggttgatgcaggcgctgccggagggcggtgcgatggtcgccgtcgaggcggccgaggacgagctgcccgaccttcccgagggtgtgtcggtggctgcggtgaacgggccccgttcgctggtgctgtccggtgatgaggagccggtgaccgcgctggcccggacgttcgccgaacagggcaggcggaccaagcagttggcggtcagtcacgccttccactccgcgcggatggagccgatgctggcggagttcgcggagacgctcgccgcggtggagttccgttcgccgcgtatcccggtggtgtcgaatgtgacgggtgggatggcgggcgcggagttcaccactcccgcctactgggtgcggcatgtgcgggaggccgttcgtttcgccgatggtgtggcgacggtgctggcgcggggtgtggacaggttcctcgagctgggtccgcggggtgcgctgaccgcgatggccgaggagaccctcgaccacaccggtgccgacgccgtgtgcgtgcccgtactgcaccccgaacgccccgaggacgccacgctgttgcacgcgctggccaccgcgtcggtgacgggtgcggccgtcgactggacgaccccgttcgcctgcgcccgcaccacggagctgccgacctacgccttccagcgcaggcgcttctggccgcggcccgccgcgagcgcgggcgccggcgacctggccgcggccggactggccgaggccggacacccactgctcacggcatggctcccgtcgcccgagggggacggggtgctgtgcaccggccggctgtccctcgcgacacatccgtggctcggcgaccacacggtcctcggcacggtgctcgtaccgggcaccgcgttcgtcgacctcgtcggctgggtgggcgaccgcgtcggctgcggcgggatacgggagctgaccctggccacgccactggcactcgccgaggacgcggcggtacggctgcgcgtggtgctcggtgcgcccgacgacaccggatgccgtccggtcgccgtgtacgcgcagccggacaccgaggacgagggaacggactggacccggcacgccgagggcctgctggccccggccgacgcgtcggacaccccggcggcaccccccggccccgccctcgacgcatggccggtgccgggcgccgaaccccttcccatggacgggttctacgaagggctcgccgacgccggtttcgcctacgggcccctcttccggggactgcgggcggcctggcggcgcggtgacgaggtcttcgccgaggtgagcctgcccgccgacgagagcggcgccgggttcggcgtgcaccccgccctgctggacgcggcgctgcacgcgctgggccccgccgcccaggcctcggacgagccaggatcggcccggctgccgttctcctggggcgaggtgcgggtgcacgccgtcggcgcggatctgctgcgggtccggctggtccgggccgcggacggcaccgtcaccctggacgccgccgacgccgcgggccggccggtggtctccatcggctcgctcgtcctgcgtccgctgtccccggaccgcctgcgcgccggtacccaggcacccgacgacgcgctgttcgccacccgctggataccgctggacgtcacgggcgacacgggcgacacggcgcgggacaccgtcgagtgcgtgctgctcggcgagccgtcggcgggcgcctggcgttcccaccccgacctcgcggcgtacgcggcggccctcgcggacggcaaggagacgccgggcccggtcctcgcccgctgcccgctgaccaccggggaccccgccgaggcggcccggcgttccgccgagtggaccctcgacctgctccagcagtggctggccgacgaccggttgaccgacagccacctcgtgatcggcacccggcacgcggcccccgtcgccaccccatacgcggcccccgtcgacgccacggacgcggacgcggcccccgtcgacgccgggcacgaagcccccgtcgacaccgccgctgccgcgctcgcccagtccaccctcgccggcctcgtccgttccgcccagaccgagaaccccgcccgcatcaccctcgtggacttcgacaccaccgccccggacccggcccacctcaccgcggccgtacgcctcggcgagccggaagtcgccgtccggcagggcacgttgtacgcccgcaggctcacccgtccggagaccggccgggccctgaccgtgccgcccggccccggcccgtggcggctggacagcaccggccgcggctcactggaccacctggcgctcgtgccgtgcccggacgccgcggcgcccctggccgagggcacggtgcggatcgccgtacacgccgccggggtgaacttccgggacgtcctgatcgccctcgacatgtatcccggccgggcggacctcggcaccgagtgcgccggcgtcgtcctggagacgggacccggtgtcaccgggctggcccccggggaccgggtgatgggcatggtcgccggggcgttcgggcccaccgcggtcgccgaccggcgcgtgctggcgcggataccggacggctggtccttcgagaccgccgccgccaccccggtcgccttcctgaccgcctactacggcctggtggacctggccgggctcggcgcgggcgaatcggtgctcgtgcacgccgccgccggcggggtcgggatggccgccgtgcagctggcccggcacctgggcgccgaggtgttcggcaccgcgagcgaaccgaagtggagcaccctgctcgacaccggtctcgaccgcgcgcacatcggctcctcacggacgctcgacttcgcggacctggtgcgcgagacgaccggcggcgcgggcgtcgacgtcgtactgaactcgctcgcgggcgagttcaccgacgcctcgctgcgcgcgatgccgcgcggcggccggttcgtcgagatgggcaagaccgacccccgcgaccccgaacgcgtcgccgccgaccaccccggcgtgcggtaccgctccttcgacctgggggaggcgggcccggaccgcatcgccgagatcctcgcccatctcgtcgagctgttcgagtccggcgcgctcaccccgctgcccgtcaccacctgggacatccgggacgcgacggacgccttccgtgtgctgagccaggccaccctcaccggcaaggcggtcctgaccgtccccgccgggtccgtcccgttcgaggccggtgagacggtcctgatcaccggcggcaccggcaccctgggcaccctgctggcccggcacctcgtcaccgagcacggactgcgtcatgtcaccctggccggacgccggggcacggacacgcccgaagtgcggcaactgcgcgccgacctcgccgagatgggcgcggaggtacgggtcgaggcctgcgacgccggcgacgaggacgccgtacgacggctcctggaaccgctcaccgcgcaccaccgcctggccggagtcgtccacgccgcgggcgtcaccgacgacggggtggtgtccgcgctcgaccggcggcggctgtccgccgtactgcaccccaaggtgcgcggcgcctggaacctgcaccggctcaccgcgcacctggcgccccggatgttcgtcctgttctcctccgcctcggccacactcggcgcggccggccagggcaactacgccgccgccaacgccttcctcgacgcgctcgccgagcaccggcacgcccggggcctgcccgcgagcagcctcgcctggggactgtgggaccaggccagcgggatgaccgggcgcctcgcggaacgcgaccggcagcggatgagccgggccggcgtcgcccccctcgactccgcacacggcctcgcgctgttcgacaccgcgctgctcaccggtatcccggcgctgacgcccgcccggctcgacctggccggactgcgggccagggccgcgcaccagccggtcccggccgtactgcgggaactcgtccgcgtgcggcgcgtggcggccaccggcacgacggccccgaccacggggacgcccggtgacgcgcggacgctgacggagcggctggccgcgctgtcccccgccgagcggcaccggctcgtactggatctggtgcgcgagcacaccgcgggcgtcctcggtcacggctcggccgacgacatcgaccccgaccaggcgttcaagacgctcggcttcgactcgctcaccgcggtcgaactccgcaaccggctgcggacggccacctccctgaccgtccccgcgaccctggtcttcgaccaccccaccccggcggcgctcaccgcgcatctgctggaactcgccgcgccgccggagcacgacccggtgctccaggtcctgggcgaactcgaacggctcgaagcgggcgtcgaggcgctcggccccgtcgacggcgcccacgacgaagtcgtcgcacgactgcgccggatcctgcgcaaggccgaggccggctccgcgccggacggcggcggcgaggactcctcgctccagacggcctccgcggcggaagtgctcgcgttcatcgacagcgaattcggcgatctcgcc

SEQ ID NO: 2887 - DNA, 336 bp, Streptomyces avermitilis
  CDS (1)..(336)
gtggaggtcggcgggcagacgatcagggcgggggagggcgtgctgtgcacgctgtccaccgccaaccgcgacgagggggcgttcaccgaccccgatgagctggacctgcggcgcgacgcccgcagccacctgagcttcgggttcgggatccatcagtgcatcggccagtcgctggcccgcgccgaaccgcagatcgccctggagacactgctgcgcaggctcccggggctgcgactggcggcctccttcgaggagttgcggttccgggacggggtcgggttctacggggtcaaggagctgccggacccctgtcccgcactgccgccggaccggccc

SEQ ID NO: 2888 - DNA, 2826 bp, Streptomyces avermitilis
  CDS (1)..(2826)
gtgctggcgagtgccggacagggcgaaggcggtgtggtcctcgtcaacgcggggccgggagtcggcagaacggcactgctcgacgcgttcctgcggaaggccaccgaatccggcgcccgggtgtgcgccgccgcgggctcgtccgccgagaccgaggccgagttcggcgtcgtcggccagcttttcccgccgaccggtccgctgggcgccggattccgattggcccgggcgatcgggagccgcgacgccggtcccgggctcgacgcggaccggctcttcgacgcgctgtgccaggagctccggcgccggccgacggtgatcgccgtcgacgacgcgcagctcgccgacgcggcctcgctgcggttcctgcggtacctcgtacgacggctgcggacggccccggtcatgatggtgctcaccgaacccaccgggcccgacgcgctgccgccgtccttccaggccgaactcctgcgccatccgcagtgccgccgcctcggactgctgcccctgtcccgggacggtgtcacccaggtggtctcggcccaggtgggcagcgaccgggtaccgcgcctcgcggcggacttccacgccatcagcgggggcaacccgctcctcgtccacgcgctgctggcggaccaccgggcagcgcaccggctctcacctgtcccctctgtccctactgtcccctctgtttcctctgcctcgtcagctgcgtctgcctcgtccgctgcgtccgctgcgtccgccgtgtccgccgcgcccgccgccagtgccgccttcgccaaggcggccctcgcctgggcctaccgcgacgagcccgtgctcttcgacgtcgcctgcggcttcgccgtactcggcgagtcggcgacccccgcccgggtggcctgtctggtcgaccggggggccgacgccgtcgaccaggtcatgacggcgctggacacggcgggcctgctggcgggcggcaccttccgcagcgccctcgtcggcaaggccctgctggagcacgtggacgtggagaccagggcggaactgcgccgccgcgccgcccggctgctccatggcgacggagcgccggcgaccgtcgtcgcgcggcatctcctcgccgccccggtcgccgagccctgggcgggccgcaccctgctcgccgccgcggagaaggccatgcaggaagggcgggaggaactcagcctcgactgcctgcgactggccggacagagcgcgacgaccgaacaggaacgcgccgccgtcgtcatggcccgggtgaagatcggctgggagatcgacccccggctggtgagcccgtggctcgacgaactcgtcgccgcgctcaggcggggcgacctcaggagcggggacgccgcctggatcgtcaagcacctcgcctggcaggaccgtttccctgaggccgtggagagcctctcgacgctggccgcggccggcgatgccggcgaacccggcgtggaggccgaactccacttcgtacggcactggttgcgccactcctgtccgccgttggaggcgagcgtcccgggcccctcgaaccccacgaggccgcgcacgccccgcctgcgccgggtgagcccggcctcctacgccggcgaggtgctcggcaaggtcctcaccgagggccccgacgaccacaccgtcgccatggcggaggagatcctgcggggctgccggtacagcgagacggtcgtcgaggccctggaggcggcgctcctggccctggtctacgcggggcgtccggaccgcgcggcgttctggtgcgacgggctgctccagcaggccggaacccgctcgacgggcacgtcggtggcgatcctctccggcatccgggcggagatcgcgctcaggcagggcgcgctgcccgccgtggaacagtacgcgcgcagcgccctctcggccatctcgctgcccggctggggggtggccgtcggctccccgctggccgcactggtgcactccaccacggcgtcggggatgagcggggtggccggggcctggctcaaccaggccgtccccgacggtatgttccgcacccgccacggactcctctacacccacgcccggggccactaccacctcgccgtcgaccgcccggccgccgccctcgacgacttcctgacctgtggcgggctcgcgaaggagtggggcatggacgtgcccacgttccttccgtggcggacctccgcggcgcaggcgcagctcgccctcggcaaccccggtcaggcgcgggcgctggtgcgggagcagctcgggcggccgggcggcagtacggcgagggcccgcggagtggccctgcgcctgctcgccgccacgggcgaacccggccggcgtcccgcgttgctgcgcgagtcggtcaacctgctggagagctgcggcgaccaggtggaactcctccgtgccctggccgatcgctgccaggcgttggaccacgtcggtgcgcccgcgaaggcacggatgacggcccggcacgccaggaacgtcgccgacgcctgcggcggggatgcgctgttccgcaagctcttccgggacgaggtgcccgaccgcgagggcgaccccgacgggctgacgggcgaggagcagggctccgcgagcctgacggcggcggagcggcgggtcaccgccctggccgcgctcggccactccaaccgcgagatcgggcgcaagctgttcatcaccaagagcaccgtcgagcagcacctcacccgcgtctaccggaagctcggggtgcgcaaccgggccgacctgggcgatctgctcgccgggacgaacctcggcgccgggacaccggccatggccatggcgtcctcggccgtcgcgggc

SEQ ID NO: 2889 - DNA, 2793 bp, Streptomyces avermitilis
  CDS (1)..(2793)
gtgctgattgggcgaggtcaagaaatagatcgactgcgcgcggcctattcttcagttcgttccaccggtagatcacgggccgtactcgtcgagtcggcggccgggtgcggcaagagcgagatcctggaggatctcgtacggcatgtggaatcgctcggcctgatcgctctgcgcgccacggcgatcgccgaggaacgaaacaccccgctgagtgtgctccggagtctggtcaacggggctcctttcccggacgacctcgtgcggcgctttcacacgatgagcgacgcggcggcccggatgatttccacggagggccgggacaaggcacgccgcgacgccgcctggtacgaactgatgcggaccttctgtaccgaggtccgcgccctcgcccagcgggcgcccctggtggtggccgtcgacgacatccaccacggggacgccgactcccttcgccagctgctccatctggcccggcactgccgcaacgtgccggtgctgctgacgttcacgcagtcgctcgccggcggtccggcggaccggaccttcggcgcggaactgctgaggcagccgaacctcgaacacatacggctgccgaggttctgtcgtcaggacatcgccgacatgctggccgagcagggacgcgcggacgccggtcagggcacggtggagcgctacttcgcggtcagcggcggcaatccgctgctgctgcgagccctcctggaggacgcccgcctcgagcccgacgacaccgtcgacgcccaggacgtggggccccgggccgggcaggcgtacggccgcgcggtcctcgcctgtctggaccgcggcggagagaaggcacacgaggtcgccgccggactcgccgtgctgggcggggcgttcacccatgaactgctctcccgcttactcgacatctccgccgcggcgctcaccgagaacctgcgcgcgctgcgggccgccggcatcgtggtcggcacgtccttccagcacccggcggccaaggccgcggtcctggactccctggagccgtcgcaccgcctccggctgcaccagcggtccgcggcgttgctgcacgcctccggcgcaccggcggccctggcggccgaacacctccacgaggccggacaggccgacggcgcctgggcggtgggcgtgctccagcaggccgccgaacaggccctgctggcggacgaggcacggcgggccgtgtcgtacctcgaactcgcccacgccgcgagcgcggacccgcggggccgtaccgagatcaagatcaggctcggctccgtcacgcgccgggtcagcgcggccgacgccgaacgccatgtggacgacgcgctgcgggggttcggggccggcctgctcaccccgtcggacacgggcggcctcgccgcgctgctgctggcccacggacggctggaacaggcgcgctcggtgctggagcagggacggcggccgggcgacggcgacgccgaccgcacagccgcgcggcgacagctcgccgagatccgcgacagcgtgctgaaccggggcgcgtggtgcgcgggcacccgggccgcctggcacgagaaccccgccgggcggccgtcgacgggccgggcgggcaccggcctgcgcgcctggctcagtgggtcgcacgccgcgctgctggcccagcgcatcgcgggcaccgagggcctgctggagatcacacacctgaccgacgccacgttcgacctggtactcaacgcggtctggacgctgctcgcgctcggcgccgtcgagcgggccctgcactggtgcgacacgttcctgcgagaggcgaagcggcgcgacgcgccgggctgggaggcggtcttcgcggccgtacgcgccgagggggccctgcgcggcggcaatctggccgaggcggagcgggacgcccgccgctgtttcgcggtcctgccggaacggcaccggtcggccctggagggcagcgcggtctcgtacctggtgacggtccagatcgcgcggggcaagtacgaggacgcggcacggcagttgagccggcccatggcggactcgctgcccgacaccatccactggctcgactatctgcgggcccgcgggctctactacatggccacccggcagtaccactcggcgctgcgtgacttccacgaggtgggccgcctcgccgagcggtggggcacggactggcccgccctgctgccctggcgcacggacacggccgaggcgctgctgcgcctcggggagcgggagcaggggctgcggctggccaccgagcagctggccatggtgcaggacggcgccccgcgcatcaagggcatctcactgcgcctccaggggctcgcgtcggagcccgccgcccggctcgggctgctcaaccgggccgtcgtggagctgagccgcgcggacgaccggctggagctctcgcgcaccctgttcgacctggccgacgcccaccgggagacccggcagacccggcaggcggcgatggtcctgcgccgggcgcggcaactggcgaagagctgcggggcgcagccgccccgggaccggatcggttcgcccgacgccgcgggggcgtcgggggaactcttcggcgagggacccgaacggaacgccgactggggacatctcagcgagtccgaacgccgggtcgccggcctggccgccagcggatatacgaaccgtgagatctcggtaagactctacataaccatgagtacggtggagcaacaccttacccgagtttaccgaaagctaaagataaacggacgtgaggaattgctggccgaagcccgcgcgggtgtgcaggtc

SEQ ID NO: 2890 - DNA, 756 bp, Streptomyces avermitilis
  CDS (1)..(756)
gtgagtgccaaccgcgttgacgggaacctgtgggtccgccagttccacccggcgccgaccgcggccacaaagctcgtctgcctcccacacgctggtggatccgcctcgtacttcctgcccgtttcgaaggcgctggctcccggcgtcgacgtactcgccatccagtacccggggcggcaggaccggcgccacgagaagtgcatcgacaacatcgccgagctggccgacgccgtgacggccgtactggagcccctggccgaccggccgctggtgctgttcggccacagcatgggggccaccctcgcgttcgaggtggccctgcggctggagcggaagggcatcgtgcccctcgcgctgttcgcctcgggccggcgggctccttcgcgccaccgtgacgagagcgtgcatctgcgcggcgacgacgagatcatcgccgagctgaagacgctgagcgggacgcggtccgaggtgctcggggacgaggagatcctgcgcatggtgctgcccgccatccgcagcgactacaaggcggccgagacctatcggtacgccggcggggcgcggctcacggcgccgatccacgcgcatttcggggtggaggatccgcgggtcagcctcgatgaggcgcaggcctgggcggaccacacgaccggtcacttcgagctccggagccatccgggcggccacttctacctcaatgaccaggctccacgcgtcatcgaggagatcgcccgggtcagttcgtccgtcgcttcg

SEQ ID NO: 2891 - DNA, 963 bp, Streptomyces avermitilis
  CDS (1)..(963)
gtgagccaggacaggcacgacggctccaccgccgctctcggcggcccctcccacggcggccggctcctggccgtcagcgacatccacgtacgccaccgacagaaccgggacatcgtccaggacctgcacccgggctgtgccgaggactggctcatcgtcgccggagacgtggccgagagcgtggccgacatcacctgggcgctctccctgctccgggaccggttcgccaaggtgatctgggcgcccggcaaccacgagctgtggaccgcgcccggcgaccccgacgaactgcgcggcgagcgcaagtaccggcacctggtggacctctgccgcgccctgggagtcgtcaccccagaggacccctaccccgtctggcacggcgcgggcggtcccgtggccgtcgcaccgctcttcctcctctacgactacagcttcctgcccccgggagcctggtcgaagagccacgcgctgcgcctggccgacgacgccggcgtgatctgcaccgacgagttcctgctccacccggacccctacccgagccgtgaggcctggtgccgggccagggtgagggccacccgggccaggctcgacgccctgccggacgacctgcccaccgtcctggtcaaccacttcccgctggtccgggagcccacccgcgtcctccggcaccccgagttcgccctgtggtgcggcaccacggcgacggcggactggcacctccggtaccgggcggccgcggtcgtccacgggcatctgcacattccccggacgatccgctgcgacgacgtaccgcaccacgaggtgtccctcggctacccgcgggagtggcagcggtacggccggcgcccggactggccggtccagatcctgacaccggcaccggcaccggcaccggcacccgtgcccgtacccgtaccggcaccgccgggccaccggaccgcgtcacccgcggaccgacggcca

SEQ ID NO: 2892 - DNA, 780 bp, Streptomyces avermitilis
  CDS (1)..(780)
atgatcgagcagctgctgccgccgcgcgtgcgggcgcacgaggtcttcgccgacgtcccggtctcctcgctgcacccccgggaggccgccctcgtccaggacgccgtggagagccgccgccgggagttcgcgaccggccggcactgcgcacgccgggcactggcctcgctcggcgtcccgcccggcccgctgctcgccaccccgaggggcgcaccccgctggcccgccggtgtgtgcggagcgatcacccactgcgccgggtaccgcgccgccgccgtcgcccgcgcccccggcatcagggccgtcggcatcgacgcggagcccgaccggccgcttccggagggagtcctggaggccgtcgcgctgcccgcggagcagttccaggtcaaggagcacacggcccggcaccccggtgtcgtctggggaaagctgctgttcagcgcgaaggagagcgtctacaaggcgtggttcccggcgaccgggcggcccctgggcttcgaggaggccctgatcgacctcgaccccgtcagcagcaccttccgcgtacgggtgctccccaccgccctgcgcgcggccgagccggagctgcgggaccttcacggccgctggctcgtccggcacgggatcatcgtcacggcggtcgtggtggacggccccggccgggacacaccgcacgccccgtcgccgtacgaccgtacgaagcactccgcgcccaccggccgttccgccgaccggcccggcggccggcccaccgaccgcgccaccgaccgccccaccgca

SEQ ID NO: 2893 - DNA, 1131 bp, Streptomyces avermitilis
  CDS (1)..(1131)
atgaccggctacagcaccgccgcggacgccaacgcacggttccggcagctggtcggcagcggcacccgggccgtaccggtcgtcttcgacctgccgacgcgcgccggactcgactccgacgcgccggcggcgcgcggactggtcggccggcgcggggtggccgtcgactcgatcgacgacatgcgggtgctcttcggcgggctccgcctggaccgggtcgtcccgtcgctggccgtcgacgccccggcggcccccctcctcgtcctctaccagctggtcgccgaggagcacggggcaccggcccagcggctggcgggggcggtccggggcgacgtcttcaaggagttcctcgcccgcgggcccggcgtcttcccgctgcggccgtccctccgtcttgccatgaacgtgttcgcctactgccaggccgagctgccgcgctggcagtgcctgtccgtgtgcggccaccatctggccgggaccggcgcggacccggcgctggaggtcgccttcaccgtcgccggcggcatcgagtacctgcgcgcggccgtgacggcgggcctggacgtgcggaccgtcgcaccgcgcctgacgctctgcctcgtcggcggcaccaccggccgcgagaaccgggccaagctacgggcgacgcgccgggtgtggaccaggacggcgaacgagcgcttcggttcgggccggaccgcaccgcgcctgtacgtccggaccccccgggacggcttggccaccctggcgtgcacggaggacatcgaggccggggcgaccgctctggtggaccggatcgaacggctcggcgggacgctcacggtcctcgaacacggcctggccggccaactgctcggccggccccacggcgaccggcccgccacgccccggccgcacccgccgcaccaggactccctcgacctccaggcccggcagacggagcggctggccaagctgcgcgcgtggcgcgtccagcccgccgtcgacgaggccctgctacggctgcggaaggccgcacagggcgacgacaacgttctctaccccatgcgggaggcgctggcggccagggccacggtgggcgaggtctgcgacgccctgcgctcgacgtgggggacgggccccagcgccacc

SEQ ID NO: 2894 - DNA, 1422 bp, Streptomyces avermitilis
  CDS (1)..(1422)
gtgcgtgaatacctgctgacgctctgcatcacggccgcggtgacgtatctgctgacagggccggtacggaagttcgcgatcgtggccggagccatgccggaaatccgggcgcgcgacgtgcaccgggaacccacgccccggctcggcgggatcgcgatgttcttcggtctgtgcgccggtctgctggtcgccgaccacctggagaacctcaacgaggtcttcgccgactcgaacgagccccgggcgctgctctccggagcggcgctgatctggctgatcggcgtcctggacgacaagttcgagatcgacgccctgatcaagctgggcggccagatgatcgccgccggcgtcatggtcatgcagggtctgacgatcctgtggctgcccatcccgggcttcgggctgttcgccctgacccagtggcagggcaccctgctgacggtggcgctcgtcgtgatcaccatcaacgccgtgaacttcgtcgacgggctcgacggcctcgccgccggcatggtgtgcatcgcgtccgccgcgttcttcatgtacgcctaccggatctggtacggctacggactggaggccgccgccccggcgaccctcttcgcggcgatcctgatgggcatgtgcctcggtttcctgccgcacaacatgcatcccgcgcggatcttcatgggtgactcgggctcgatgctgatcgggctcgtgctcgccgcgggcgccatctcgatcaccgggcagatcgaccccgacgcgatgaacctgttctccggttccgagcgcaacacggtccaccagaccgtccccgtctacatcccgctgctgctgccgctgacgatcatcgcggtgccggccgccgacctggtgtcggcgatcgtgcggcgcacctggcgcggtcagtcgccgttcgcggcggaccgcgggcatctgcaccaccggctgctggaaatcggccactcgcacagccgcgcggtgctgatcatgtacttctggtcggcgctgatcgccttcggggcgctcgcctactccgtcaactcggcgtccatgtggatcgtgctgggcatcgccgcgctcagcgccctcgggctcggtctgctcctgctgccgcggttcacgccgcgcgccccgcgctgggccgagcacgtcgtgccgccgcgctaccggcgccggagggcggcgaggacgggctccgcgccggccctcgacggccttcaggcttccgtcgacggcgatcacggcgaccgtgcggcgacggcgcctgccgctgccgccgaggcgcgcgagccgagcgccctcgggctgcacggcagcaccgcgctgtccgagctgtcgtcgagcccacggacccacgagcgcgagcgggcgcacgagcggacccacgagcgcgagcgggcgcacggcctgtcgggcggtacgggacgtaag

SEQ ID NO: 2895 - DNA, 1269 bp, Streptomyces avermitilis
  CDS (1)..(1269)
atgtcggtcacgcatgtaccggaagccgtacggcccgccgtcgccggggccgacttcgaggcccttcgtcggcaggatcccgagctggccgagatcctcatcggggagctcgaccggcagtcgaccacgttgcagctgatcgccgccgagaacttcacctcgccggccgtgctcgccgccctcggctcaccgctcgccaacaagtacgccgaggggtaccccggtgcccggtaccacggcggctgcgagttcgtcgatgtcgccgagcgcctggccgtcgaccgggcgacggccctgttcggcgccgcgcacgccaatgtgcagtcgcactccggctcgtccgcggtgctcgccgcgtacgccgcgctgctgcggcccggggacaccgtcctcgcgatgggcctgccgttcggcggccatctcacgcacggctcgcccgccaacttctccggccgctggttcgacttcgtcggctacggggtggacgccgagaccgggctcatcgactacgagcaggtgcgcaccctcgcacggtcgcaccgcccgaaggccatcgtctgcggatccatctcctatccccggcacatcgactacgcggcgttccgcgagatcgccgatgaggtgggcgcccatctcatcgccgacgccgcccaccccatcgggctcgtcgccgggggagcggcgcccaatccggtgccgtacgccgatgtcgtctgcgccaccacccacaaggtgctgcgcggcccccgcggcggcatgatcctctgcggcggtgaactggccgagcgcatcgaccgggccgtcttcccgttcacgcagggcggcgcgcagatgcacaccatcgccgccaaggccgtcgcgttcggcgaggcggcgaccccggctttcgccgcgtacgcccgtcaggtggtcgccaacgcgcgcgtgctcgccgagaggctggccgccgaggggctcgcgatcaccaccggcggcacggacacccacctgctgaccgtcgatcccgcgccgctcggcgtggagggccgcaccgcccgcggccggttggccgccgcgggcatggtcctcgacacctgtgcccttcctcacggcgacgcccgcggtctgcgcctcggcacggccgcgctgaccacccaggggatgggcgagaccgagatggcccgcgtcgccaagctgttcgcgggcgtgctgcgggacgagaccgacagcaagacggcacgtgaagaagtgcgggagctggctggtggatttccgccgtatcccggccgg

SEQ ID NO: 2896 - DNA, 663 bp, Streptomyces avermitilis
  CDS (1)..(663)
ttgacagcccctgacgcggggcgtggcataggcacgggaatcacaggggccgatgggttctctgggggttccttccgcatcctccacgtcagcaccggcaacgtgtgccgctcgccgatcaccgagcggctgacccgtcatgccctggcggaccggctcggggaccccctgtggggcgggctgatcgtggagagcgcggggacctggggccacgagggcgcgcccatggaggccaacgcggaggcggtcctcgcggacttcggcgcggacgcctccggcttcgtgggccgcgaactcctcgacgaccacgtcatcagggccgacctggtcctgacggcgacccgcgaccaccgcgcccaggtcatctccatgggccactcggcgggcctgcgcaccttcaccctgaaggagttcacccgcctggtccgggcgatcgatccggcgacgctgcctccgctggaggacggtgtggtggagcgcgcgcgggcgttggtgcgggccgcggcggcgttgcgggggtggttgctggcgccgacggcggaggcggacgaggtgtatgacccgtacggtgcgccgttgccgtttttccggtcggtgggggacgagatacatcaggcgctggatccggtggtgacggcgctgacgggggtgcccgcgcggatg

SEQ ID NO: 2897 - DNA, 645 bp, Streptomyces avermitilis
  CDS (1)..(645)
atggctcggcgatacgacaccaacgacgcgaccgaccgcgcgaccggtctgcgcgaggccgcgtccgccgtccgccgtggcgagctcgtggtgctcccgacggacacggtgtacggcgtgggcgccgacgcgttctcgtcggaggccgtcgccgacctcctccagtccaagggccggggccgcaacatgcccacccccgtcctcatcggctccccgaacacgctgcacgggctcgtcacggacttctccgagatggcctgggagctggtcgacgccttctggccgggcgcgctcacgctcgtcgccaagcaccagccgtccctccagtgggatctgggggacacccgtggcacggttgccgtgcgcatgccgctgcaccccgtcgcgctcgaactgctgtcggaggtcggcccgatggcggtctcctccgcgaacctcacgggccaccccgcgccggaggactgtgacgccgcgcaggagatgctcggcgactccatctccgtctacctcgacggcggcccgacccccggcatcgttccctcctcgatcgtcgacgtgagcggcaagattccgctgctgctgcgcgagggggccctgtcggcggaggagctgcgcaaggtcgtacccgacctcgaggtggcgaat

SEQ ID NO: 2898 - DNA, 879 bp, Streptomyces avermitilis
  CDS (1)..(879)
gtgcagcaacattttgggggtcgacccccaaacccccgcagcgtgctgctcgcggaagtggcccaggccacccagcggctggccgacgccggcgtgccctctccgcgcaatgacgcggaggagctcgccgccttcgtgcacggcgtcaagcggggccagctgcacctcgtcaaggacgcggacttcgacgcccgctactgggagatgatcgcgcgccgcgaggcccgcgagccgctccagcacatcaccgggctggcctacttccgctacctcgaactccaggtggggccgggggtgttcgtcccacgcccggagaccgaatccgtcgtcggctgggccatagacgccgtacgcgccatggatgtcgtcgagccgctgatcgtcgacctgtgtacgggctccggcgccatcgcgctcgccctcgcgcaggaggtgccgcgctcccgcgtgcacgccgtggagctgtccgaggacgccctccggtggacccgcaagaacgtcgaggggtccagggtcgacctgcgccagggagacgccctggaggccttccccgacctcgacggccaggtcgacctcgtcatctccaacccgccgtacatcccgctcaccgaatgggagtacgtcgcccccgaggcgcgggaccacgatcccgaactcgccctgttctccggagaggacgggctcgacctcatccgcggcatcgagcgcaccgcgcaccgactgctgcggcccggcggcgtcgtcgtcatcgagcacgccgacacgcagggcggccaggtgccgtggatcttcaccgaggagcggggctgggccgacgcggccgaccacccggacctcaacaaccggccgcgcttcgcgacggcccgcagggcgatgccg

SEQ ID NO: 2899 - DNA, 1074 bp, Streptomyces avermitilis
  CDS (1)..(1074)
atgttcgaggcggtcgaggaactcatcggcgagcacgccgacctggagaagaagctcgctgacccgtcggtgcacgccgaccaggccaacgcgcgcaagctcaacaagcgctacgccgagctgaccccgatcgtcgcgacgtaccgctcctggaagcagaccggggacgacatcgagacggcgaaggagttcgtcgccgacgaccccgacttcgccgccgaggtcaaggacctggagaagcagcgcgaggagctcaccgagaagctccggctgctgctggtcccgcgtgaccccagcgacgacaaggacgtcatcctcgagatcaaggcgggcgcgggcggcgacgagtcggccctcttcgccggcgatctgctgcgcatgtacctgcgctacgccgagcgcgtcggctggaagaccgagatcatcgactccaccgagtccgagctcggcggctacaaggacgtccaggtcgccgtgaagaccaagggcggccagggtgccaccgagcccggccagggcgtgtgggcgcggatgaagtacgagggcggtgtgcaccgcgtgcagcgggtgccgtcgaccgagtcgcagggccgtatccacacctccgccgccggtgtgctggtcacgcccgaggccgaggaggtcgacgtcgagatccacgcgaacgacctgcggatcgacgtctaccgctcgtcgggccccggcggccagtccgtcaacaccaccgactccgcggtgcgcatcacgcacctgcccaccggtgtggtcgcctcctgccagaacgagaagagccagttgcagaacaaggagcaggcgatgcgtatcctgcgctccaggctcctcgcggcggcccaggaggaagcggagcgggaggccgcggacgcccgccgcagccaggtccgcaccgtcgaccgctccgagaagatccgtacgtacaacttcccggagaatcgcatctcggaccaccgcgtcggcttcaaggcgtacaacttggaccaggtgctcgacggggacctcgacgcgatgatccaggcctgcgtcgacgcggactcggccgcgaagctcgccgccgcg

SEQ ID NO: 2900 - DNA, 219 bp, Streptomyces avermitilis
  CDS (1)..(219)
ttgaagcgcgacatccaccccgagtacgtcgagacgcaggtcagctgcacctgtggcgcgtcgttcaccacccgtagcacgatctccagcggcaccgtccgcgccgaggtctgctccgagtgccacccgttctacacgggcaagcagaagatcctcgacaccggtggccgtgtggcccgcttcgaggcccgcttcggcaaggctgccgctgccaagaag

SEQ ID NO: 2901 - DNA, 1137 bp, Streptomyces avermitilis
  CDS (1)..(1137)
atgtctgccgagagcacgccggaacccggcataccggggagcaccggcaccgagggcccgcgccgccgcgccaaggggcgccgcagaaagccccccggcacgcgccgcaaggccctgctcatcacggcctgggcggccgcgggcgtcgtcgtcctcggggggaccggcgccggctacctctacttcaagctcaacggcaacatcaagagcgtcgacatcaaccaggccctcggcaccgaccggccgctgaaggtcgacgacggctccgagaacatcctggtcctcggctcggacacgcgctccggcagcaacaagaagctgggcggcggcaccgacgacggcagcgcccgctcggacaccgcgatgatcgtgcacatctaccggggtcacaagaaggccagcgtggtctccatcccgcgcgacaccctcgtcgagcgcccccggtgcaccggccgcaagggcaccgtgtacccgggctcgtcgagcgcgatgttcaactccgcgtactccaccggcggcgccgcctgcgcggtgaagaccgtcgagtcgatgaccggcatccgcatggaccactacctcgaggtcgacttctccggcttccaggacctcatcgacgacctcggtggcgtccgggtgaccaccaccaaggacatcgccgacaaggacagccacctcgacctgaaggccggcactcacacgctcgacggccggcaggcgctcggcctggtccgcacccggcacggcgtcggcgacggctccgacctcggccgcatccagctccagcaggcgttcatcaaggccctggtcaaccaggtcaagcacatcggcgtcctgaccagcccgacgaagctgtacgacctcgccgacaccgcgaccaagaccgtcaccaccgattccgaactggcctccgtcaaggacctcgcgtctttcgccggcggactcaagggcatcagctcgtcccacatgaacatggtgacgatgccggtccactacgacgcggcgaacgccaaccgcgtcctcgtcgataaggccaaggcccagctgatctggaaggcactcaaggacgaccgggccatcccgaaggcggccacccacggcacggccaccggctccgccaagggtgtcgtgacgtccggc

SEQ ID NO: 2902 - DNA, 2064 bp, Streptomyces avermitilis
  CDS (1)..(2064)
gtgagcgacaccaccgatctgatgggcgcacgtgtcgaggagaccgctgccgcgcccgccacggacgcctccgcgcctgccaccggtgccggctcccggcggcgccgcggtaccggcctcgagggcatggtgctggccgagctgcagcaggtcgcatccggcctcggcatcaggggcaccgcgcggatgcgcaagagccagctgatcgaggtcatcaaggaggcgcaggcgggcggcggcgccccggccaaggcggcagcgtccgccgcggacgccaccgagaccaagcccaagcgccgtgccacctccaaggctcgtacgggcgacgacgccgcccccgccgagaaggcggagcgggccgcgaagcccgccgccgagaaggccgtggcgcagcagcagatcgagatccccggccagcccgccagcgaggacgccccggccgagcgccgccggcgccgtgccaccgccgaggccggcagccccgagacggtcgccgccgaggcgaagagcgagccgaaggccgagacgcccgccggcgaggccaagggcgacgccgccgacggcggcgagggccgtcagggccgccgcgaccgccgtgaccgtggcgaccgcggagaccgtggagagcggggcgaccgtggagaccgtggagagcggggcgaccgcggggaccgcggccgggaccgcgaccgccgtggcaacaagggcgacgagcagcagggccagggcggccagcagcgcggcggcggccagcagcaggccaccggccgccaggaccgccaggaccgtcagcgtgacaacggcccgcaggacgacgacgacttcgagggtggccgccgcggtcgccgcggtcgttaccgggaccgccgtggccgccgtggccgcgacgagttcggcgccaacgagccgcaggtcgccgacgacgacgtcctgatccccgtcgcgggcatcctggacatcctcgacaactacgcgttcatccggacgtccggctacctgccgggtccgaacgacgtgtacgtctccctcgcccaggtccgcaagaacggcctgcgcaagggcgaccacgtcaccggcgcggtccgtcagcccaaggacggcgagcggcgcgagaagttcaacgcgctcgtccgcctcgactcggtcaacggcatggcgcccgaatccgggcgcgggcgaccggagttcaacaagctgacgcccctttacccgcaggaccggctccgcctggagaccgacccgggcgtgctgacgacccgcatcatcgacctcgtcgcgccgatcggtaagggccagcgcggtctgatcgtggccccgccgaagaccggcaagaccatgatcatgcaggcgatcgccaacgcgatcacgaccaacaaccccgagtgccacctgatggtcgtcctggtcgacgagcgtccggaagaggtcaccgacatgcagcggtcggtgaagggcgaggtcatctcctcgaccttcgaccgcccggccgaggaccacaccacggtcgccgagctcgccatcgagcgcgccaagcggctggtggagctgggccacgacgtggtcgtcctgctcgactcgatcacgcgtctgggccgtgcgtacaacctcgccgcgcccgcctccggccgcatcctgtccggtggtgtcgactcgaccgcgctgtacccgccgaagcgcttcttcggtgccgcgcgcaacatcgaggacggcggctcgctgaccatcctggccaccgcgctcgtcgacaccggctcgcgcatggacgaggtgatcttcgaggagttcaagggcaccggcaacgcggagctcaagctcgaccggaagctcgccgacaagcgcatcttcccggcggtggacgtcgatgcgtccggcacccgtaaggaagagatcctgctcggcagcgacgagctcgccatcacctggaagctgcgtcgcgtgctgcacgcgctcgaccagcagcaggcgatcgagctgctgctcgacaagatgaagcagacgaagtcgaacgccgagttcctgctccagattcagaagacgacgccgatgccgggcaacggcaacgac

SEQ ID NO: 2903 - DNA, 915 bp, Streptomyces avermitilis
  CDS (1)..(915)
atggccggtccagcgttccgtgccgccgccgtccgggtgcgcgtccccgccaccagcgccaacctcggtccgggcttcgacgccctgggcctgtcgctgggtctgtacgacgacgtggtcgtccgggtggccgactccgggctgcacatcgacatcgcgggtgagggcagcgagacgctcccgcgcgacgagaggcatctcctcgcccgctccctgcgcaccgccttcgatctgctgggcggccagccgcgcggccttgagatcgtttgcgccaaccgcattccacacggccgtggcctcggctcctcgtcggccgccatctgcgccggcatcgtcgccgcgcgagccgtgaccataggcggggacgggaagttggacgacaccgccctgctcgagctcgccaccgagatcgagggacaccccgacaatgtcgcggcctgtctcctcggtggtttcacgctctcctggatggagggcggcgccgcgcgcgccatcaggatggagcctgccgattccatcgttccggtggttttcgtgcccggaaaggcggtcctgaccgagaccgcgcgcggactgctcccgcgcagcgtcccgcatgtcgacgccgccgccaacgcgggccgtgccgcactgctcgtcgaggccctgaccaggcgccccgagctgctgctgcccgccacggaggaccggctgcaccaggagtaccgcgccccggccatgccggagagcatggcgctggtggagcggctgcgggccgacggcatccccgcggtgatctccggggccggacccacggtcctggcgctggccgacgaggcgtcggccgacaaggtcgcccgtctggcgggcgagggctgggccgccaaccggctgagcctcgacgcccggggagcgagcgtgctgccgcttgccgcc

SEQ ID NO: 2904 - DNA, 1056 bp, Streptomyces avermitilis
  CDS (1)..(1056)
atgacccaccagtggcgcggaatcatcgaggagtaccgggaccggctgcccgtctccgacagtacgccggtcgtgacgctccgtgagggcgggacgccgctcgtgcccgcgcaggtgctctccgagcgcacgggctgcgaggtccacctcaaggtggagggcgccaaccccaccgggtccttcaaggaccgcggcatgaccatggccatcacgcgggccaaggaggagggcgcgaaggcggtcatctgcgcctccaccggcaacacgtcggcctccgccgccgcgtacgccgtacgcgcgggcatggtctgcgccgtgctcgtcccgcagggcaagatcgccctcggcaagatgggccaggccctcgtgcacggcgcgaagatcctccaggtcgatggcaacttcgacgactgcctcaccctcgcgcgcaacctgtccgacaactacccggtggcgctggtcaattcggtcaacccggtgcgtatcgaggggcagaagaccgcggcgttcgagatcgtcgacatgctcggtgacgcgcccgacatccacgtcctcccggtcggcaacgcgggcaacatcaccgcgtactggaagggctatcaggagtacgccgccgacggcatcgcccgccacaagccccgtatgtggggcttccaggcatccggctccgccccgatcgtgcgtggcgaggtcgtcaaggacccgtcgaccatcgccaccgcgatccgtatcggcaacccggcgtcctggaagttcgcgctggcggcgaaggacgaatccggcggtttcatcgacgaggtgacggaccgtgagattctgcgcgcctaccggctgttggccgcgcaggagggcgtcttcgtcgagcccgcgtccgccgcgtccgtcgccggtctgctgaaggccgccgagcagggcaaggtcgacccgggccagaccatcgtctgcacggtcaccggcaacggcctcaaggaccccgactgggccgtcgcgggcgctccgcagccggtcacggtcccggtcgacgcggccacggcggccgagcggctcgggctcgcg

SEQ ID NO: 2905 - DNA, 1287 bp, Streptomyces avermitilis
  CDS (1)..(1287)
atgcgtacgcgtccgctgaaggtggcgctgctgggctgtggggttgtcggctcagaggtggcgcgcatcatgacgacgcacgccgacgatctcgccgccaggatcggggccccggtggaactcgcgggcgtggccgtccgccggccctccaaggtgcgtgagggcatcgaccccgcactggtcaccaccgacgccaccgccctcgtcaaacggggcgacatcgacgtcgtcgtcgaggtcatcggcggtatcgagcccgcccgtgccctgatcaccacggccttcgagcacggcgcgtccgtcgtctccgccaacaaggcgctcctcgcccaggacggcgccgccctgcacgccgtcgccgaggagcacggccgcgacctctactacgaggccgccgtcgccggtgccatcccgctgatccggccgctgcgcgagtccctcgccggcgacaaggtcaaccgtgtgctcggcatcgtcaacggcaccaccaacttcatcctcgacaagatggactcgacgggcgccggctaccaggaagccctcgacgaggccaccgcgctcgggtacgccgaggccgacccgaccgccgacgtcgaggggttcgacgccgccgccaaggccgccatcctcgccggaatcgccttccacacgcgcgtgcgtctcgacgacgtctaccgcgagggcatggccgaggtcaccgccgccgacttcgcctcggcgaagaacatgggctgcaccatcaagctgctcgccatctgtgagcgggccgcggacgggggttccgtcaccgcgcgcgtgcaccccgcgatgattccgctcacccacccgctcgcctccgtgcgcggcgcgtacaacgccgtcttcgtcgagtcggacgcgtccgggcagctcatgttctacgggccgggtgcgggcggctcgccgaccgcctccgccgtgctcggcgacctggtcgccgtgtgtcgcaacaagctcagcggcacgaccgggcccggcgagtccgcgtacgccgccctgcccgtgtcgcccatgggcgaggtcgtcacgcgctaccacatcagccttgacgtggccgacaaaccgggtgttctcgcccaggttgccaccgtcttcgccgagcacggggtgtcgatcgataccgtgcgtcagcagggcaaggacggcgaggcctccctcgtcgtcgtcacccaccgtgcgtccgacgcgtccctgagcgggaccgtcgaggcactgcgcagcctcgacaccgtgcggggtgtcgccagcatcatgcgggttgaaggagag

SEQ ID NO: 2906 - DNA, 1389 bp, Streptomyces avermitilis
  CDS (1)..(1389)
atgagccgttccgcacaccccgccgggccccgtcacgccgacgtcctccccgagggccactacagcgccccggccgcagatctcaacgcccttgacccgaaggtctggtcccacaccgtcagccgcggcgacgacggggtggtgcgcgtcggcggcatcgacgtcaagcagctcgccgaggagttcggcacccccggctacttcctcgacgaggccgacttccgcgagcgtgcccgcgcctggcgcaccgccttcgggcacgacgccgacgtcttctacgccgggaaggccttcctgtcgcgggccgttgtccgctggctgcacgaagaggggctcaacctggacgtgtgctccgggggagagctcgccaccgccctctccgccgggatgcccgccgaccgcatcgccttccacggcaacaacaagtccgaggaagagatccgcacggccgtcgaggccggcgtcggacgcatcgttctcgactccttccaggagatcgtgcgtgtcgcgcacatcgcccagtccctcggcaagcggcagcgcgcgcagatccgggtgacggtcggcgtcgaggcccacacccacgagttcatcgccaccgcccacgaggaccagaagttcgggatcggcctcgccgacgggcaggcggcggaggccgtacggcgtgcgctcgcgctcgacgggctcgaactcgtcggaatccacagccacatcgggtcgcagatcttcgacatggccgggttcgaggtcgccgcgcgccgggtcgtgaagctgctcgccgaggtccgtgacgagcacggcgtcgagctgcccgagatcgacctcggcggcggtctcggcatcgcgtacacgagtgaggacgacccgcgcgagccgcacgagatcgccaaggcgctcagtgagatcgtcacgcgtgagtgcgaggccgcgaagctgcggactccgcgtatctccgtcgagcccgggcgcgccatcgtcgggccgaccgccttcaccctctacgaagtcggcaccatcaagcccctcgacggactgcgtacctacgtctccgtcgacggcggcatgtccgacaacatccggaccgccctctacgacgccgagtacagcgtcgctctcgtctcccgcgcgtccgacgccgagccgatgctcgtccgcgtcgtcggcaagcactgcgagagcggcgacatcgtcgtgaaggacgccttcctgcccgccgacctggcacccggcgacctcatcgcggtccccgccaccggcgcgtactgccgctccatggccagcaactacaaccacgccctgcgcccgccggtcgtcgccgtgcacgacggtgaggcccgggtgatcgtccgccgcgagacggaagaggacatcctgcgtctcgacgtcgga

SEQ ID NO: 2907 - DNA, 1056 bp, Streptomyces avermitilis
  CDS (1)..(1056)
gtgacccccgtcgagctctcccgcaccgtgctgcgcgcggtgcgttgtgccgtggacgagggtgagctgagcgtggccgttcccgtacgggccgtggtcacgccgcccgggcccggcggctgtggggactacgccaccaacatcgcgctccagctggcccgccccgccggacgcccgccccgccaggtcgccgagatcctgcgcccccacctcagccgtaccgccggtgtcgccggtgtcgagatcaccggccccggcttcctcaacatccatctcgaagcggccaccgccaccatcgccctcgtacgcgagatcctcgacgggcacgcgaacgggcacgccaacgggcacgcaatcgggcatgcaatcgacagtggccatgacagtcacggcaccccctacggccacacccccaccctcaccggccaagtcatccccctccgcatcccgtacgacatccgcgccgaagtcgtcgccgacagcctcgtccgtatcgtcgccagccagggcggtcgcgccgaggtcgatcatgtgcgggcgggggaggctgtcaccctgcggcccgtgcccgcgcccgaggaccccgcccccctcggtgccgacgccgcccgctgggcgctgttgcaccccgccgcccacgaccggccccgcatcaccgccgaccacctcgcgcagcgcgagagcaaccccctcttccggatccggtacgcccacgcgcgtgcccgtgcgctcacccgttgcgccgcccggctggggttccacggcgaacccggtgacgtacccgttgacgtacccggcgcagaggttctcgtccgggagctcgccgggtacccgcacgccctgagcgccgccgcggcccagcacgcccccgaccggctcgcccggcacctcgtcgccaccgccgacgcgttcctcgccttccagcacaccgtgctgccgctcggcgacgagaaaccctcggccgcccaccgtgcccggctcgccctcgccgaagccgccgggacggtgctggccggtggcctgtccctcctcggcatcagcgcacccgactacctc

SEQ ID NO: 2908 - DNA, 591 bp, Streptomyces avermitilis
  CDS (1)..(591)
atgaacaggttttgggggtggcgggggagcggtgtcgcggccccggacgagggggaagtggggaaaagccggacgcggtcgtgggtgccgacctactctcgagttgtgccaggcgcgtccggccgggtgcttgttgtggacgacaacaaggtcatccggcagctgatcagggtcaacctcgagctggagggtctcgaggtcgtgaccgcggctgacggtgccgagtgtctggatgtcgttcatcaggtacgccccgatgtcgtcacccttgatgtcgtcatgccccggctcgacgggctgcggaccgccgcccgcctccgtgccgatccgcggacccgtgatctgcccctcgcgatcgtgagtgcctgtacgcagtacgaggtcgaggccgggctcggtgtcggcgtcgacgccttcctcgccaagccgttcgagcccgccgaactcgtgcggctcgtacggcagttgatggagcgagacagtgagggagggggaagcgggggaggcgacggtgacccggcctccctcggcagtccctgcggcgccggtggggccggtggggccgagcgggcgggtgaccgcgccggcacc

SEQ ID NO: 2909 - DNA, 1410 bp, Streptomyces avermitilis
  CDS (1)..(1410)
gtgcgacgctccctcacggccgccctcgcggtcaccacgctcgccactcccctcgtgctcgtcgccgccgccggcccggcctcggccgcgccagtgccgccgcgcacgccgctcgtcgacttcaaccacgacgggtacgccgacctcgtgttctccgcggtcggcggctacgagggcacgacgcccggccaggtgacggtcgtctacggctccgcgtcgggccccgacaccgcgcacgccaagaccttcggccgcgccacccctggcgtgcccggcgacccggagagcggcggacgcttcggccaggagacggccgccgccgacctcgacggcgaccggtacaccgacctcgtcgtcaacggctacgacggcaaggccgtggtcctgtggggctccgccgccggcctgtccggccagggcagcgccgagctgccctggaacggcgggcacgtcaccgccggcgacttcaacggcgacggcaagcgcgacctggtcacggtggacttcccgcgcagcgacgaccccgacaacgacgaccagggcatgctcatctcctacggccccttcacgcgcgaaggcaaggccgcgagcacccaggcggtcgccaccagccggaccttcggccccggcggcttcgtcacgggcgacatcacgggcgacggcgccgacgacatcgtctccaaccacggcttcgaggagatggcgtacggcagcaagttctgggccggcggcaaggacggtgtgaacaccaccccgaagccactcgcggcctccgtcggcggggcgatcgcggacgtcgacaaggacggctacggcgacctgatcgtccgcgacatcggcaacaacttcgaggacatgccgtaccagaagggcacgatcctcatcaagtacggcaccgcggacgggccttcgacgacccgcaccgcgaagatcacgcaggacacggcgggcgtgcccggggtcggcgaggagggcgacgagttcggctcctcgatcagcgcgggcgacgtgaacggcgacggctacgcggacgtcgcggtcggcatccccggcgaggacatcgagtcggtcgcggacgcggggagcacggtgctgctcaagggctcccgcaccggtctgaccggcacgggcgcgcaggccttccagcagtccacgaccggcgtgcccggcgcctccgagaaggaggacaagttcggcagccaggtcctgctgtcggacaccaacaaggacggcaaggccgacctgacggcgaccgcgcccctggaggacggcacctacgccgactccggcgccgcctggcacctgcggggcgcggccggcggcctgacggtcaccggcatcacgtcgttcggccccaaggcgctcggcgcgctggagaagggcgtcatgttcggctcgtggctggcgcgc

SEQ ID NO: 2910 - DNA, 1527 bp, Streptomyces avermitilis
  CDS (1)..(1527)
atggaacgtccgcatctcgcaacggagttcctgcggtgtacaaccttcactcgaagtggtccgtctcccggtacgtcacacacgttccgcacaggaggcacagtgccccgccgcactctcaccgccgcgatcgccgtcaccgcgctcgcgacccccctcgcgctcttcgccacctccggcacggcgtcggccgcgcccgtgccgccccgcacgccgatgaccgacttcaaccacgacggacacgccgacctcgcggtcgcggcgcccttcggcaccgtcggcggtgtggagaaggccggttacatctcggtcgtgtacggcaccgcctccgggcccggaacggcgcgccaccagatgatcagccgggccacgcccggcgtccccggcgacctccagggcacgttcgccttcggtgtccagacgctccccggtgacctcgacggcgactcgtacaccgacctgctcgtggcgagcggcggcgacgacggcgagccgaccgtgctctggggctccaaggacggccttaccggccagaacaccgttctgccgtaccggtactccgagttcgccctcggtgacttcaacggcgacggcaagcgcgacctcgtcgtgaactccgacccgagcgacgacccggacgtctccgggatgacgatccagtacggcccgttcacccgcgacggcaagacgcgcacccaggacagcatcaccacggacgacggcccctcgggtctgcgctccttcatcaccggtgacctcacgggcgacggtgtcgacgacatcgtcaccacgcacggcttcgaggagatgcagcacgaggcccgcttctggaaggggtcgaggaccggcgtcggccacacctccaaggccctcggcacggcgtacagcggcaccgtcggcgatgtcgacggcgacggctacggcgacctgatcacccgcgacatcggctccgtcaccgaggtcatcgactccgccccgggcagcatcaccatccagtacggcggctccaccgggccgagcaacacgcgcaagaaggtcatcacccaggccaccgcgggggttcccggggcgagcgaggcgaacgacgccttcggcgcgtccctcagcgccggtgacgtgaacggcgacggcaaggcggaggtcgcggtcggcgttcccggcgagagcctcgacgccgccaccggtaccggcgcggtgatcctgctcaagggcgcgtccaaggccgtcggcggcatgaccggcaagggtgcgatcgcctacaaccagtccactgcgggcgtgcccggcgtctccgagtcgggcgacgacttcggccgccaggtgagcctctccgacctgaacaaggacggcaaggcggacctgaccgcgacggcccccggcgaggacggtgccttcgccgactcgggcgccctgtggaacctctacggctccgcgagcggcctgaccacgacgggcgccggcacgctcagccccgtgaagctcggcgcccccgagaaggacgccaagttcggccacacgctcggcggc

SEQ ID NO: 2911 - DNA, 264 bp, Streptomyces avermitilis
  CDS (1)..(264)
atggcgcgggcgaggatgtcgatgcaggagctgatccggcgcaggcggcgggcgggcttcgtgggcagacgcgaggagctgcgggcgttccgggagaacttcgacctgcccgtggacgacgaccgccaccggttcctgttccacgtgcacggcccggcgggcgtcggcaaggcccaggtcgtggaagatcgtccagccctcgccgatcaacacctcgaccagctcctgattgcagcgctgtcgacacttcgtgtgagtggcgta

SEQ ID NO: 2912 - DNA, 1806 bp, Streptomyces avermitilis
  CDS (1)..(1806)
ttgcatcatccaggatggctatccagtaggccgaaacgaacttcgcttacccgacgatgtatcaggagtcctgcagctgttgatccgcaagggggaggaaacgccgtggtgacgattcgtcgcgcgtacgacgcttttcgcacgtttcagacttcagacagcaagccgttgattctcttctctgctcctgccgtggagatcgagaagtggtcgggtgttcccgaacggcgacgcctcgccggagaggaaaccgcagggttccagcgtgaacaagaccccgccagggtccgagaactagcaaaattcttcaaggatgaccgtaacgtagcccaaaatccgctcttgggagccttgcaagacgcaacgaaggtgcattttaaagagaagacccctggctcccccttcggacgcctagagatcgagtatgaagactactcgaaagtgccactccgtgacttgctgcagagactgactgaaagacttgaagagcgcgtcggcgcacttaatgacagcatcgttgacgagaggaaagttgctctgttgctcgagcgagaatctgagcgggcagagccgtccggtctcgcagaggacgaacagatagaagaggtttccaacgacgatagggacgaggtcattgcggacaatgaaggcggagatgtaaacacggcactgctcgctgaagaaacgcacctagtggacttctatgtcgaactgaaagcgcggatgcgtgttttgcagcatctaggggttgacgacgccgacgagatccaaggtttcaccaaagctgcgctattgggataccttaagcccgtcgtcctcgtcgacggacaacacaggctcagaggggccgtcctctctgctgagcaactggcggacaccccggcagctgaggaagcagtcatggaatcagttcaagcaggactggatcctggcgaggcggagaagcaggtactgctgaaaaagagccgccaccttcccgtctcactgctgatggacagcagtccgagcgagcatgtgtttcaattcgtgatcgtaaaccagaaagcagtactcatggggtcagccctgctgggaacgatcatctcgaccagtctcggtcgagaagaattgcaatcagttcgggagcggcttaagggagccggcattcagctcgaggactcccaggccattgcttatctaactcgcgctgaggacagcccgtttcgcgggcttgtgcagaccggtgtcgacggggaccggccggacctgctcaaatggagcgtgctgcagagcctggtcactattttccgcaaactgcagggtggccgcccctaccacgagaggacggattacgctcgagcttggcggttggagtacttccctaactgcggactggcttcgggtgacacgctcgacgagaaactcgcagactggtcacgcccagacggaccgtggagagagatctttgttcgtttctatgtccacgtgcgcgactattttggcgacacgcaggatctagatacctacaacgcatggggtagcactgggaatagtaacctcttcaataaaatttcacttaccatcctggcgtgcgactattttgacttcatctacactcaaggcgaagccctcgagaccacggatgactttgatcgcaccttgcagaggtggctgaaggacggccgtgtaagcccctcctacttcaatcgtgactggcgtctcgaaaaaacgaaaaaagaccaattgatcgtgaagcgtctgtggtctcaaaactggcatgagtatcggaaagtgccggccaacggtcttccgcggaagttcaagccg

SEQ ID NO: 2913 - DNA, 2052 bp, Streptomyces avermitilis
  CDS (1)..(2052)
gtgaagctcctgaggctgacgctggacaacttccgtgcgttctacggccgtcagacgctggatctcgccgtcaacgattccaagccggcggtgctgatcttcggcaataacggtgcgggaaagaccaccctcctcaacgccttcgcctgggcgttgtacggaaagttctccgccgacgtcgagcaacagcagcgcgtcatccatgaccacaaatgggcggaaaccccgcatggcaccccagtcagcgcctcggtggagctgaaattcgaacacgcaggggtgatcttcaccgtgttgcgtgaggtggccaccgtcaagaacaccgacgagcagatagctgtcgcagccaagctcaccctgaacgagataaaaaacggcgagagcaagcccgtagccaacggtcaggaccgcatcgagaagatcctccctgaaggcttgcgccgcttcttcttcttcaacggtgagcggatggagaagatgttcaccggcgaggagaacaacgacgaggtcaaacgcgccatcaagaccctgatggatcttgaaccgatggagcgtgcgatcaccgagcaccttcccgcagccgcacgacgcctcgccaaggagatcgacaagggtggcgacagccgcctccagcagctgcgtgatcaacaagaaggactcgaacggcagcgcgatgacgctgaccggcgtgcgaagaaagtctcccgcgacatcagcagctacgagagcgaagtccgggagatggaaagagcgctgcgcagccactcggagtccaagcctctacagaacgcccgaaagaaactcgaatggaaaatcaacgagatgggcgggcaactgcaggaccggtacgcacgcaagcgtgaggtcctctccaaaggaggcttcctcgccttcacatcgcacatcgacgaaaccgtgatcgggctggcagagggcatgcgcgagcgccgccaattgcccgctggaatccaacgcgacttcatcgagggcctcctcgacgaaggcacgtgcatgtgcggcactcccgttccccaagggagctcggcatatcaagagttggataaacgtcgctacaacgccggtcttgccgatgtggaagcccgctggatgtatgtcagtggacagatgaagcacctcagcgaggcacgtcaaaatctcctcgacgacctgcggcaggccacattcgagattcaaaactgccaggacgagatcaagagcctggaggaagaaaagagcgaggtcgaccgccagctgcaaggcgtcaacatcgaagacgtacagcgcctcgagcagcggcgcaaggaatacgacgaaaaacgcatcgacggactcgcagagcatcgtcgactggaagagcgccgagtagagttcgaagccgagatcgacaagatgaagagactcttcaagtccgcgcaggcagcggacgatgcatcccgaaaggtgcagcgacaggtcaatctcgtcaacgaggtgctggacaccttccgcgaggcactggaactgaagaccgaagaggtccgcgaacagctcgatgcgaagctcaaggaggtcttctcaaggatcttcatcaagtcctacgagcccaaactgacggactccttcgagctgttgctgaagtcacccgccggcattgctatccgcagcacgggcgaaaaccaggtcctgggcttgtctttcgtcggcgcagtctcggagattgccaagcagatccaccagcgcaaggccaaagacagcgaagacatcatcggcgagggaggcatctaccccgtcgtcatggatgcccccttcggcagcctggacttcacgtatcaagaagaaatctcgcaagcactgccgaagctcacctcacagatcgtcaccctgctctcaaactcccaggcgagtggcaaagtgatggaaaacctgcaaggggcagccacccgcatgtacgtgctgcgcacggtcacccccaacaccaacgccgcgcaagagaccatcgagatcaacaaccgggccgtcgcctacgtcacgcacggcgatttcgagcacaccatcttggaagaggtggccttc

SEQ ID NO: 2914 - DNA, 162 bp, Streptomyces avermitilis
  CDS (1)..(162)
gtgagcgagaagaaaactgcgcaggacgtgctgagtcagctgtcgcctgagggcgtcaaactcgccaggcgcgtcatcgagttggagcgtgaaaacttgcacatcagaagttccaccaccgtggtcaacgagatcgtggcggccgtgaagggactgatcaag

SEQ ID NO: 2915 - DNA, 2142 bp, Streptomyces avermitilis
  CDS (1)..(2142)
gtgcacgctcttgaagctctccggcacgccgatctcgggggagaataccgtagcgatcgcggcaacgttgtcgatgagttctacgtcccggctctgcgggcatcaaccgcgtacgaccgtgctgtcgggtatttcacggcttctgtcctggccgtcattggcgagggcatagaagaattcacccggcgcgccgggacgatgcgcatcgtggcctcgccctatcttctcgccgaagacatcaccgagatcgaagccggctacgaacttcgcgccgtcctggagaaggctgctctacgcgacctggagcgtgcgacggaagacgccagggcggtgcgcggactaggcaagctcggcgtgctcatcgccgaggggcgactggacgtgaagctcgcctacgtcacggcaggcagccgggtcggcatgtatcacgagaagatcggcgtcttccgcgacgaccacgacctcgtcgcgttcaaaggcagcgcgaatgagactctgtctggcctggttggcaacttcgaatccatcgaggtcttccgtagctgggacgaccgagaccgtgaacgggctttgcgtatcagcaaagacttcgatgacctgtggcatgacaggacgccactgctgcgtgtcatgcccttcaccgatgccgccaagcagatcatcgagcgcagcacccgcgctgcagtcgaccctagcgacgacacagcgatccccccgtccggtgcgccgatcactatcgcgcgcgaagacctcgccggcatgttgaccatccctccgctgttggaagtgcgcgactaccaaaagcgagccgtcacccagtggttcgcgcagcgaggccgcggcatcctgcgcatggcgaccggcacaggcaagactctcaccgccctgtccgcggccgcgcaggtgaccaagatgctccacaaggtcggcgaaccactgctcaccgtcgtgatcgccccctaccagcacctggtcgaccagtgggcgaaagacatcgagtggttcggcgtgcaccccctgcgcgcctacgagtcgaccgccgcatggttcccccacgcctcccaactgctggatgcgctagcgctgcataccacccgcggcggcgtcatcatcaccacgaacaaaaccttcggcgagaccgctttccaaagcatccttcagcgctatcgcggccagctcctcctcatcgccgacgaggcacacaacctcggcgcccggcacatccgctccaagctgcctgacagcgcgcagtttcgcctcgggctgtcagccaccccggaacgctggtttgacgacgaaggcaccgccgcactcaccgactacttcggcccggtggtgttcgagctcggactcggcgacgccatcaaagccggcgcactgtgccgctacacctataagcccgtgatcgtggaactgaatgccgacgagaccgacctctacatagagatcaccgaaaagatcggcaagctgttcgcgatgcagcagttctccgaacaagccgacgacaacagccctctgggccacctgctgcgcaaacgggccaacctgctcggtcatgcccgcgccaaacttcccgcgctgcgacgggagatcagccaacgcagggaggagtggtatcagctgctgtactgcgcagagggacagcaccccttgtcctacgaagacggtgccgcggcagagccagcgcagatcgatcaagtactggatctcgtcggcaatcacttgcacatgcccgccgctcgctacaccgccgagaccaaacggcccgagcgtcgccaggtcttgcagcggttcaccgaccgcaagctgcaagtcatcgcctccatgcgctgcctggacgaaggtgtcgacgtgcccgccgcccgcaccgcatacctgctggccagttcctccaacccccggcagttcattcaacgccgcggccgagtgctgcgacaggcaccgggcaagaccatggccgacatcgtcgacttcatcgtggtgcccccgaccaacatgcccgacctgcaggaccgcaccgaacgcagcatggtggcccgcgagctggcccgcgtgacggagttcgcacaactggcggacaacgaagccgagaccctcgacctccttcgtccgctgcgcctgcgatatggcctgctcgacact

SEQ ID NO: 2916 - DNA, 393 bp, Streptomyces avermitilis
  CDS (1)..(393)
gtgcaggagcctcgcatgccggttgaccacgtccgtctgtctcagccggccaaggatcggctgtcctacctcaagcgcaccaccggcgtcactcagtggaacgtgctgtgccgctgggcgctgctgctgtcgctgagggacccttccaccccgctggtgaaggacatcgtcactgactccaacgttgagatgagctggaggaccttcgccggccagtacggcgacctctacctggccctgctcaagcagcgctgtgtcgccatcggtgaggagcccaatgacgagaacatccagcgcgtcctgaccgtccacgtgcaccgcggcatcggctacctcggtgccgacaagcagatggccacggtcgaaggaatggtcggcgccgtcgtgcccacc

SEQ ID NO: 2917 - DNA, 2025 bp, Streptomyces avermitilis
  CDS (1)..(2025)
atgctcctgcgtaagatcaccctcgaagaattcggggcgtaccgcggaaagcagtctctcgaccttacccccaagaagaacaagccgatcatcctgatcggcgggttgaacgggtgcggcaagacgactctgctcgacgccatccagctggtgctttacggcaaccgggcgcgctgcagcggtcgtggcaccaaggcctacgagacgtacctgcgggagagcatcaaccgcaaggccgaccccagccgcggttctgccatcaccctcgaattcaccgtcatgaccggtgggcacgagcactactaccgtctcgtccgcagctggcacatcagcggtaagaccctcaaagagttcctcaacgtctacgtcgacgagacctatggcgagcgggtgaaagcgcagcgcagcgcggagccggaaggcaagttcaaccgcctcctcagtgagggctgggcagaccacgtcgagtcgctgctgccgttggagatcgcctccctcgccttcttcgacggcgagaagattgagtcgctggccaaccccgaacgggcggcgtccgtcatcgagtcggccgtgcactccctgctgggcgtcagcaccgtccagcagctgcgcaacgatcttctggccctccagcggcgccagaagctgtccgaggaggaacagcatctcctggacaacatccgtgcccaggaagccgaacgcgaagcggtggtgtcccagtacgacatcgcgcaccaggaactggcccactcccgcagcgaactcggcaaggcgcagcgcaagctggacagcctggagaaggcgttcgctgacgagggtggcgatctgttcacccggcgcgtcgagctggaaaacgacaggaagcaggccctcgtccgcctggcccaggtgcgcacggagctcacgcaacttgcagcaggacccctgccgttgttgatggtcgcaccgcttctcgacgacgtccggcagcaagccagaatcgagcaggaagcccagcagtccgcccaggtcctcgaggtcctcgaagagcgcgatcggtggctgctggagttgatgcccgacgccacccgagccgaggtcctcaagcggctggacgacgaccgcgccgagcgcgccgccaagacgcagctggcggtggatctgcgcctgccgcacgacgcgctggcccagctcaccgtcctcgacgaactgctccagcgggatacccagcgctccgcgcagctgcttcatagcgccgctgaactggccgagcatctggaccagctggatcggcagcttgccggcgttcccgcacaggacaaggtcgaagccctccaggcggcccggggcgagcagatcgtagaggtaacccgctgtgagacgactcgcgaccgtgccacagccaagcttgaggacctcaagcggcgccgtgaacacgtcaccacgctgctggagcgtgcgcacaaagagttcgtccgcaccaaggtgaaggcggaagaagtcgagcgggtgatcaagtactcggagaaggcccgcgacactctcgagcgtttcggctccgcgctccttgagcggcacatcagtcggctcgaagtggccgttctgcagagcttcaaggtcctcatgcgcaagcagggtctcgtgcgcgacctgcgcatcgataccgacaagttcatcctcaccctggctgacgccgatggcgaggccatcgatccggcgcgtctgagtgcgggtgagcgccagcttctggctgtctcgctgctctggggtttgatgcgcgtcgccggcaaccggctgcccagcgtcatcgacacccctctgggccgtctcgacagccgtcaccgcgagcacctcgtcgaccgctacttccccaacgccagcgaccaggttctcctgctgtccaccgacgaggagatcgacgagtatctgctgggccgcttggagaagtccgtcgcccacacctacacgctcgtccacgacgacaccgaattcaccaccgccgtcgtcgaaggctactggtggagtgcaggagcctcgcatgccggt

SEQ ID NO: 2918 - DNA, 1575 bp, Streptomyces avermitilis
  CDS (1)..(1575)
atgaccaccatccccctcaacctcgggcttacccccgtacgtcgcaagccgttcggtggacgctccctggaggaggtcgtcaacgaactgacggaggagatccgggagctctacaccgccgaccaggtgccctgggtcatcggctacagcgggggtaaggattccactgctgtcctgcagctggtgtggatggctctcaagggcctgcctgccgagcaacgcaccaaggctgtgcatgtcattagcaccgacacgcttgtggagaacccggtcgttgccgcctgggtgtccgcctcgctgggcaccatgcaggatgcggcgcaggcgcagggtctgccggtcgagccgcaccgcctgactccggagatcaaggacaccttttgggtgaacttgcttggccggggctatcccgccccgcgcccgaagttccgctggtgcaccgaacgtctgaagattaagccgtcgaacgccttcatccgcagtgtggtcgccgctcacggcgaggcgattatggtcctgggtatccgtaaaacggagagccaagcccgcgcccgcgccatggaaaagcacgagaagcgccgcgtccgcgaccgcctctcacccaacgcaaacctgcccaactccctcgtctacagccccgttgaggactggaccaacgacgacgtgtgggagttcctgatgcaaaagcccaatccctggggctacaccaatcaggacctgctcactatgtatcagggcgcttccagtgatggcgaatgcccgctcgtggtcgactccactactccttcctgtggctcaagccgtttcggctgctggacctgcaccctcgtcgatgaggacaagtccatgtccgccatgatccagaacgacgaggaaaaggagtggatgacccctctgttggagctacgtaataagctcgacgccccatttgatgaatggaaagagggcgaggaaattccggctggccgcaaggttggcgatcctaagcctgacaagccggctcgcgacttccgtcggatgaacggcaaggtcatgctgttcaaggacgacgccatccacgggccttatctgcagtccttccgcgaagagtggttgaaggacctgctggacgcccagacttggatccgtgcccatgctccggagcacgtgcagaacatcgagctgatcacgcttgaggaactgcacgagatccgccggatctgggtgttcgacaagcacgaggtcgaagacagcctgccgcggatctaccaggaggccaccggcgagtccttcccgggtggcccgctcgacgagcaactcgtcatggggtccgacgagatggacgtcctcaagcaggtctgcgatggcgacgacctgcattacaacatggtccgcgagctcctcgccgttgagcggaagtaccgcaccatggcgcgccgttcaggcctcttccaggcactcgagcaggctgtgcagaagggctactacgaagaccacgaagacgccgtggaattcgccacccgcaaacagaagtggcgagacgacatcgccgagaacctgaccttcgacgacgaaaacgaactcgatgctcctgcg

SEQ ID NO: 2919 - DNA, 1137 bp, Streptomyces avermitilis
  CDS (1)..(1137)
gtgcagactgaagcggcgagcaagactgcggggcgggctgccacgcgagcgtcaacgggctttgaatacacctttcctgcgatccgtggagtgcaggcggggcgggagttctatgcgtcgatgtgcccgctgcggctcatcccgaagatcttcctcttcgacgaagatgatctttccgctgagctgagagcccagcgggtgcttaataagggacgcctgccggcgctcgctcgctacattctggacaatcccgacgattacgtcttcagtgccctgaccgcgtccgtggacggggatatggccttcgaatgtcagggcgcagagggttctgcgcaccgcacggggcagttgcgcatccccatggatgcccgcttcctgatcaacgacggacagcatcgccgcgccgccatcgagctcgcgctgaaggagaagcctgacctcggggacgagaccatcgctgtcgtcttcttccatgacactggcctctctcgctcccagcagatgttcgccgacctcaaccggcatgccgtccgcccggcgcgctccatcggggtcctgtacgaccaccgggacctcaacgctcagatcacgcgcgccctcacggaacgctcagccatcttcaagggctttgttgagatggagaagagcacgctctccgctcgctcgcgcaagctgttcactcttagcgccctgtattacggcaaccagtccctccttcaaggcctcgacctcaagcaggacgaggcgatcaagctgacgcagtcgttctgggaagccgtggacacggcgctgccggagtgggcgatggtccgcggtaagcagctttccgcccaggagatgcgtcgggacttcatccacagccacggcatcgccctgcatgcgctgggccgcgttggaaacgcgctgttgcgggagtcggtcaaggaggctgcatggaagaggcggttggttccgctgacggatgtggactggacccggggcaacatcgactgggaggggcgtgccatcgtcggcggccgcgtttccaaaagccatcaaaacgtgacattgaccgttaattacctgcgtaagcatctgggcctggagttgagcccggaagagcggcgcgtggaagacgcatatctgcgaggcgaggca

SEQ ID NO: 2920 - DNA, 1152 bp, Streptomyces avermitilis
  CDS (1)..(1152)
gtgagcgccgtggtggcgtatctggatgttgcggcgacgacacgggtggatccccgggtagccgaggtcgtcctgcactggatgacagaggacttcggcaacgccggcagccgcacccatgaatacggcgcccgcgccaagaaggctgtccagcaagcccgttcctatctcgcggacaccgtaggcgcgaagaccgaggaagtgatcttcaccagcggggcgacggagtccaacaacatcgccctgctcggcctcgctccacatggcgagcggaccggcaagaagcacatcatcacctccgccatcgaacacaaggccgtcctcgagcccctgttgcacctcgcggaaacccgcggcttcaccgtggacgttcttgagccgggtgcgtcaggccgaatcactgtcgagcaggtcatggagcacgtgcgccccgacacactcgcggtgtctctgatgcacgtcaacaacgagaccggagtcatccagccggtcgccgagctagccgagcgcctgcggtccacgccgacctacctccacgtggacgccgcccagggatacggcaagatcgccggcgatctgaccgcgccaatcgacctgatcagcatcagcggccacaagatcggcgcaccgaagggggtcggagcgctcatcacacgacgtcgcggctgggataaggctccactggagccgatcatgttcggcggtggccaggagaggaagctgcgtcccggaactctgccggtcccgctgatcatgggcctccacgaggccgcgcggatcttccacgagagccgggataactgggagcgcgaggcacgagcgatgcgtgagcagatcttggaagcgctcggcaagacacgcttccgggtcaacggagatcaggctcacaccgtgccgcacatcctcaatgtctccttcgaccagctcaacgctgaagccttgattgtccgactcaaggatcaggtcgccattgcaacaggttcggcgtgcaccagcgcctcctacacccctagccacgtgctccaggctatgggccttcccgatgacgtggctgccaatgggctgcggttttcctggttccctccgcaagcgagggacttcgaccctcttcccattgccgaaaccattgcccgcatgcagcctcaggaaggc

SEQ ID NO: 2921 - DNA, 1434 bp, Streptomyces avermitilis
  CDS (1)..(1434)
atgcagcaaatctggggtagtgagcgtcgccggacagcgatcgggcggatggccttgtcggtgcccgcgcgtcaggctttggcggatcgccagttggtggctgagcggacgatcctcgactacggctgtggccgtggcgacgacgtcagagctttgcagcaactggactgccaggtggtgggttgggatccgtactaccgcaccgatacgcaactagtcgccaccgatgtggtgctgctgacctacgtgttgaacgtgatcgaggatccggcggagcgtcggcagaccttgaagcaggcgtgggagctgacctcgacgctgctggttgtctcagcgcgcctgacatgggagaagtcgaaagttcacggtgaggggttcggtgacgggctgctgacgagccggcagacgttccagcatctgtatgccacgagtgagctgcgggagtacgtggagcaagtgaccggcgcgcgagtggtggcggctgcgcccggggtaatctacgcgttccgggacgagggtgcccggctgagctatctggcacagcgtgtgatcccggatgccgcgtggcttgcttccgaggacactgcctcggcggtgagtgcggtggtggacttcttcgaacgtcggggacgtgcgccccgtattgaggagatgccgcggaccgttgcagagctgttggctcatctgcggccaggcgaggtcaagcgcctgctgagggacggtgctgatgctgagcgggctgatgcgggggctaagcgatcgacgctgaacaccttgctctatttggcggtggaactgttcaacggtcgggggccgttcgcgagtctgccggtgggcttgcagcaggacgtgcgtacgttcttcagttcctacaaagaggcgtgtcaacgcgctgatcggctgttgttcaagctccgcgacgacggctatgtacgcaatgccatgaatgcgtctgctgcgggtaagataacaccgacggctctgtatgtgcatcgacgcgcgctggggcgaatcccgacggtgttgcgtttgtacgagcactgcgcatcgatcgctgctggtcgcccggaacagtggacggtggcaaagctcaagcatcaggggagggcagtgtcttggctggactacccagactttgacaaagacccgcatccacggatctggtcctcctacatggtggacctgcagacgcttcagacgtcccatctctcctatgagaactcggccaaccgccccctgctccaccgcaagcatgagtttctggcaccggatgatccggacgtgccgcgataccgccggttgaccgagtctgaaatgcgggccgggctgtataaacggccgcacctgattgggaccgagaacggctgggaagccgagctcgtcagatgcggccggcaactgcgcgggcaccgcctggtgcgtcgcacggagacg

SEQ ID NO: 2922 - DNA, 495 bp, Streptomyces avermitilis
  CDS (1)..(495)
gtgtgcgatgtgtctgcaccaggtcggcacagctcgacggggaggggagaccgggttggtccagggaggcgtcaccgcgacacggaaccgtctactcccccaagcccggggaatgcggtgctcatgacactggcgcgctcactgcccgacaatgccaccgagtggtggatcttcctgggaacgttcgtcctctacgtgctcggacgctggttcttcgcctggcagcgagccaggcgcgagggcgacagccaccccatgcgtaccgcgttcgccgaagaagacgatcctgccgcaagccacgcggccatggtcggcggcttccgctcctaccggcagttcttcggcttcgtcggaagcgccgtcgcagtggttctcgtcgctgccctgaccgaaggctggctgcgccacgccctgctatggatcattgttccgcttctggtcatagcgctctcgtacctcgacttccgccaggccctgaaagcgcgctcagaagcc

SEQ ID NO: 2923 - DNA, 969 bp, Streptomyces avermitilis
  CDS (1)..(969)
gtgctgcctggaccgggtgagcgggaggtgcctacggagatcgaggacaccttgcattggatcgccaaggcgtcgcgcccgttgaatgatctggctgaccctgtgacggcacgggaggtactcgactcgttcaagatccatctcgacgggaaggctgctgcggccgagaccgtgcgccgaaagcggtacagcttcgtcaacgccctgcattacgccgttgacctaggcgaattcaaggaaaatcccctgatcgccgtgcgctggcagaagcccaaggtttccagtgaagtagacccgcgcttggtggtgaatccgcagcaggccgtttcgctactccacgccgtgtcctacgtgggcggttaccgaagggcccgcggtcgtcgactggtcgggctctttgcctgcatgtacttcgccggcctgcggcctgccgaggatatcggcctctccgaagctgacctgacactgccggaacacggctggggcactgtgctcctgcaccgcacgcgtccgagcgtcggcaagcagtggacggattcgggggagagccacgacgaccgagggctgaagaaccggccggccgaagacatgcgccccgtgccgatcccgccccaacttgtgtcgatgctccttgaacccctcgacaccttcgggaccgcttcagacgggcgcctgttctatagcgagggcggaggagtagttgcctcctcgacctactcgcgagcctggcaggaagcccgcacgctggcgctcccgtcggccgcggtggcttcgccgttggcgcgtcggccgtacgaccttcgccactcagccctgtcgacctggctcaacgccggggtcgacccgaccgaggtcgccgaacgggcgggcaacagtgtcgaggtcctgttgggccgctacgccaagtgcattgacgggcggcaggagatcgccaaccggaagatcgaggagttgttgcgcgagtatgag

SEQ ID NO: 2924 - DNA, 336 bp, Streptomyces avermitilis
  CDS (1)..(336)
gtgaagtccctggacgtcaagatctggggggttcgcaagcgcccttcgaagcggccctcatacgacgtgcgttggtcggttgcggagagggtcttctccgagacgttccgaaccaaggctctggcagatcattaccgcaccaagctcatgcgcgccgcgcgtgatggtgatgaattcgacgatgtcaccgggcttccggactcgatggccgagacaagagccgaactgagctggtacgccttcacgctgaagtacctggcaatgaaatggacggccgagcgctccgctgatccggcaaaccctgcgcaactgggctttcgtgctgcctggaccggg

SEQ ID NO: 2925 - DNA, 696 bp, Streptomyces avermitilis
  CDS (1)..(696)
gtgatccgcctcgacggccccgacgatccgcccccgtcctgggccaacgtcggcctcctcaccgacgcgatccgcgccgccgccctgcaccgctacaccacggtgtcagtgcccgccgcgggcgacgagccggcccgcaccttccagtggggcacacagctcgacatccggcccgtgaaggcattcaacgacggcacggacatcaccgaacaggccgttgcctcctacgtcaccaagtacgccaccaaagccgccgaaacgaccggcaccctcgaccgccccatcggcaaccgcgaagccgccgttctgctcggcgtccccgaccacgcccgccggctcatcgacgcatgcttcgacctcgaacccctctaccccgaccgacggttacgcgcctgggcccacatgctgggcttccgcggacacttctcctccaaatctcgccactactccaccaccctcggcaccctccgccggacccgcgccgactatcgcgccgcccaagggcgccaggaccgcggcctcgaggacaccgagccggacaccgtgctcgtcctcgcctcctggcagtacgccggccacggccacacccccggagaatccgccctcgccgcgacgatcgcccgagacctccaactcaaccgcgagaccgcacgtgaagccctgtccgaccaactagccctggaaggagcgcacctg

SEQ ID NO: 2926 - DNA, 834 bp, Streptomyces avermitilis
  CDS (1)..(834)
atgaagtcgtcccgaacgtccccgagattcctcgccctcgctctcggcctgggtctggcctccagcgcattggccgtggcggtgccggcgagcgcccagacggttgccaccccctccgactccgccgatacctccgtggcggggtacgacgggtcggctgaggaggccgcgaacaacaaggcgttcttcgaggctgtgctcaagtcggtcgctgagaagcgcgccgcccagcccagcgggcaggcggtgaccctccactacgacgcctccaaggcgccgagcttccgttcgcagatagcgagcgcggccgcgacctggaacagctccgagtccaacgtcaagctcgaggaggcttcgagcggggccgacttctcctactacgagggcaacgaccctcgcgggtcccacgcctccaccgacggccacggaagcggccagatcttcctcgactacacccaggcccagcagaacgactcgatccgcgtcgtcacccacgagaccgggcacgtgttgggcctgccggacaactacagcgggccgtgcagtgagctgatgtcgggcggcggccccggcccgtcctgcaccaaccgctacccgaacgccaccgagcgcgcgcgtgtcgacgagctgtgggccggcggaggcgcgcaggccccgggcacggggagccagcccgctggcggcccgagtgctgcaccgtcggcaccgtcggcaccgtcggtggctccgggtacggggaaccagcctgctggcggcccgagtgctgcactgccggtacggcccgtggggccgggtcagggtccgtggcgtccgcacctccgtacgctctggaat

SEQ ID NO: 2927 - DNA, 564 bp, Streptomyces avermitilis
  CDS (1)..(564)
gtggcctctggcagactccgcggcatgggaatgttcaagcgggccaatgaggcggagagtgctgatcaggccggggagcgagccgacttgagcctcctgctgctgcagggcgaagacatgatcgaacagttgggtcgtgcccacatgtcctgggggctgggttcagcggaccgctgggatctggatcagacgaccggcatcatcacctggaccttccctgacaagacggcggcagcacccgcgcagatcctcggcagtttcagccccggctcgggctcgtggctgtgggcctgggccaacaagagcatcctccccgacatgagccgtgacgcccgcagcttccgggactgggcagacgacaacgggcatcccgctctcgcccagccgaagatcgaggccgatgagaaggccgctgcgacgcttgtggccttggctgttcgggtcaccaaggcgaccggctattaccggggcccgggaggcaactccgccgtgatcatcacgttcggtccggtcactctgaccgccgctgacggcagcgtctccaacttcaacatcaatatcgac

SEQ ID NO: 2928 - DNA, 495 bp, Streptomyces avermitilis
  CDS (1)..(495)
atggacaacacccgcgcatcagccacgccccggaactgggcgggctaccagcaggcagtcgtggacatccgactcgccgaccgcacggtgagggtcgtgccgggcccgcagggtacagccgaaggccacttcccagaaccggccgggcgcaccatccatgtgatcaccgcatgcaatccctatggccgtacggcctctgccgaggacaacggccgtgcccaggcgctgctgttcgaggagatcggccggcgtcggctcgcctggtggcccgcggcaggaggcaccgtgtgcggtgcgcacgtcgaggagagcgccgccctcgtcggcctgagcgacgccgaggcgcgtgaactgggccggcacttcggccaggacgcggtcttcgcctggacccctgacgcctggcgtctgctgtcgtgctccagcgatgagacagccgtgtccgggtggaccatgtccacgcagcagcccagggacccggggtcctgcctcacc

SEQ ID NO: 2929 - DNA, 213 bp, Streptomyces avermitilis
  CDS (1)..(213)
atgggcatgcatcccatgccgaccccggcccgttgcccgcgctgcggcagaaccctcgtcggcccaccggccgagcgggtcaaggccgacggcttcccggcggaggtgacgtacgagacggacccgctgtgcggagcgcgctggcacgtgtgggacaagacgtccccgctgcgccgccgggcccgcccctatgtggatggcacgggaccacgc

SEQ ID NO: 2930 - DNA, 1641 bp, Streptomyces avermitilis
  CDS (1)..(1641)
atgacctccgagccccgggcggccggtacgctcccgccggacgaaacccgagccgcccgcaagccgacgtggcgaaccgagccgcacaggaggagcaagccccgcatgccgcacgcgcgttacgaccaacgggtccgggctctcgtcgaggtccgtggaggccccgacgactgggaggaggcgcagcggtgtttcgaggagcacggctggccggtgcgcggcttctccacagagacaggcggggaaccgccccgagggccggcgctggatcctgaccccgaagcccgcgtgtacgagatagaggtccgcttgttcggtgccgccaaggcatgcgaccgaggggcggcgcacagggtgcgcaaggccatgcgcggcgcccgactcgaagcgtacgtgcgcttcgcggagcccgtccggcgcgatcgcgagatgttctcgcactggcgggtcgtcgacagcgcgcggcatcgcgcccgtccaccgcactcctggcgtcgtactgtctcgcgcctggccctgcgctgcggatggtacgacgcgggcggcgtcgtatcgggacacccgcggcaggcccttcgactggcccggacacacacccctcagatcgccggagcgggagtgcggcccctcgacggtcgctggcgcggcacggtgaggtactggccggaggaggagaccgaacaccgtttgttccacgcggtgtcgtggtccttgctgacggccgcggcgctggtcttcgcggccggtcggtccgggttcgcctggtggttctgggtgacggtggccggcctcggcgcggcgggtggtgtgcgtgcgggagcgcggctcgcacgggagggccgacggttcggcgtggtgacggtcctgctgctgatggcgttcctcaccgcttccgggctcggtctcgtcgacggcgaagggcacggctggacacgacgccagatactcatgacggcactcgtgctcggtgtgatgtcgggtctgtggctcctcgtacgccagtggagctggggcgagtgggtcgcctgggcggtcccgctcgtggcgaccctcgccctgtcctcgtttctggccgccggatccgtgctccacgccctgtacgcggacggcctgtcgctctcgccggacgacctcgaggtgcctgcggtctggcaggtactggccgccgcgaagctgctcacactgctcagcccgctgctcgtcgttcccgcgtggtggggaatcgcacggcaccggcaccactcctacgcggcgcccggcgaacgcctgaacgtagccctgaacgcctgcttcttcctcctgatgctcggcgtggtcaccttgcaggcactcgattcggcgagcacggcggtgcacaggacgaccgaggccgccgaacgcggcgacgatcccccgtcctacttcggcgtcgaaccggaatggacctgcgtcgaacccgccgtacccctcacccgcctctccggcgagggcccacacctgtcaccgaaacacccgtacctgtccttcggcgtaacggccggcaccgcgatcctctgggaccgaacaacccacgaaccgctcaaactccagtcctcccagatccgcctgacaccggccgagtccgggacgacccggtgcacgaaaccgaccacgggcgcctca

SEQ ID NO: 2931 - DNA, 1248 bp, Streptomyces avermitilis
  CDS (1)..(1248)
atggcgccgcgtcgggtcgtcgtcaccgggctcggtgccgtcaccccgctcggggtcggtgtgggtgagctctggcgggggctcctcgaaggggagtgcggcatacgggagttggacggggaggagttcgaggggctgcccgtgcgggtggccgggaccgtgcccgtggaccccgccacgctgctgccccggccgcaggcgcggcggatgaaccgggccgcccagttcgccgtgctcgccgcgcgggaggcctggcgggacgccgggttcgacggggccgggacggcggagagcgggctcgaccccgcgcgggtcggcgtgtccgtcggggccatcctcggggacgcgtccgtcctcgtcggaggcgaccgcaagctgcgcgccaaggggccgcgctcggtgtcgcccctcaccacccccatgacggtgccctcgcaggccgcctcgcaggtctctctcgcgttgcgcatcaccggcgaggcccgcaccgtgaccagcgcgtgcgcctccggcaccgaggcgatcgggctggccatcgaccggatccggtacggacatgtggacatcgcgctggccgggggcgccgaggccgtcgtcacgcccgcgatcatggcgtcgttcgccgcgatgcgggcgctgtcgcaccacggtctgacggagggctcgccctcccggcccttcgccaaggaccgcgacgggttcgtcaacggggagggtgccgggtttttgctgctggagacggaggagcacgcgcgggcgcgcggggcgcggatctactgcgaggccgccggctgggggctgtccgccgacgcccaccacatggccgcgcccgacccgtccggcagcggcgtcgcgctcgcgctgcggcgcgcgctgaaggacgccgggggtcatgtcgtggacgtcgtgcacgtcaacgcgcatgccacggccaccgtcgagggcgatctcgccgaggcgaacgcgttgcgggcggtgctcggcgggccggtgccggtcacggccctgaaggggcacctcggtcatctccagggcgccgcgggcggggtggaggccgtcgcgacggccctcacgctgcaccacggtctcatcccgcccacgatcggctgcgcgatccaggacgacgagatcggcctggacgtcgtgacccacagcgcgcgcccgctgccggccggcggagacctggccctcagcaactcgttcggcttcggcggccacaacgcggtgctggcgctgcggcgagtgggg

SEQ ID NO: 2932 - DNA, 1098 bp, Streptomyces avermitilis
  CDS (1)..(1098)
gtgctgcacgtgcgatccatatggaacggcgccatctcgttcggcctggtcagtatcccgatcaagctggtgaacgccacggagagccactccatctcgttccgccagatccatctggaggacggcggccggatccgctaccgcaagttctgcgagctggaggaccgtgaggtcacgcaggacgagatcggcaaggggtacgaggacgcggacggcacgatcattccgatcaccgacgaggatctggcccagctgcccatcccgaccgcccgcaccatcgagatcgtggccttcgtcccggcggaccggatcgacccgctccagatggacacgccgtactacctgtcggcgaacggcgtccccgccgccaagccgtacacgctgctgcgcgaggccctcaagcgcagccagaaggtcgccgtcgcgaagttcgcgctgcgggggagggagcggctcggcatgctgcgggtcgtcgaggacgtcatcgcgatgcacgggctgctgtggccggacgagatccggccccccgagagcgtcgcccccgacgcgagcgtcaccgtccgggacaaggaactggacctcgcggacgcgctgatggacacgctcggcgaggtcgacctgaacgagctccacgacggctaccgcgaggcggtcgaggcactcatcgaggcgaaggcctccggcgagaaggtcccgtccgcgcctgccgatgagccgggcggcaaggtgctggacctgatggccgccctggagaagagcgtccgcgcggcgaaggagtcgcgaggcgaggggacgggctcggagacgggctcggagacgcgcgaccgcacgggcgcgaagaaggggaaggcgacggggaaggacacggggaaggaggcgcaggcggaggtgacgcggctgcgccgcaagacggcccgcgccgcgcccaaggaggtcgggggcaagaagtcgacgtccacggcgaagaaggcgacggcgaagaaggcggctccgaagaagacgacggcgaagaagaccaccgccaaggcgacgagcgcgaagaagaccacggcgaagaagaccccggccaagaaggcgacgccacggaaacgctctgcg

SEQ ID NO: 2933 - DNA, 879 bp, Streptomyces avermitilis
  CDS (1)..(879)
atgacgccgatcacggaggtggcggggcgacggctggccctctccaacctggagaaggtcatctatccggcgaccggcttcaccaagggcgaggtgctgcactactacgccaccaccgccgacgccctcctggcgcacctgcacgaccgtccgatctccttcctgcgctaccccgacggcccggacggtcaggtcttcttcgccaagaacgtgccgccgggtacgcccgactgggtcgtcaccgccgaggtgccccgttcggaggggcccgcccgcatggtcctggtccaggacctggcgagcctgatgtgggcggcgaacctggtgaccgagttccacacccaccagtggcggatcggcacgcccggccaggcggaccggctcgtcttcgacctcgacccgggcccgcccgcgacgatcgtcgagtgctgtgaggtcgcgctgtggctgcgggagcggctggcggcggacgggatcgagtcgtacgcgaagacgtccgggtcgaaggggctgcatctgctggcggcgctggagccgacgccgtccgggcgggcgacggagtacgccaaggagctggccgtggcggcggagaaggacatgccccgtctcgtcctgcaccgcatgacgcggagcctgcgccccggcaaggtgttcgtcgactggagtcagaacgcggcgcggaagaccacggcggccccgtacaccctcagggcccgtgccgagcccaccgtctccactcccgtgacctgggaggaggtcgccgactgcactgccgcacgcccgctcgccttccaggcccccgacatcgccccccgcctccaggagcacggcgacctgctggcccccctgctcgaccccggccacgccgcgcccctgccg

SEQ ID NO: 2934 - DNA, 801 bp, Streptomyces avermitilis
  CDS (1)..(801)
atgagcggactccgcgtcgtaccgacctggcgacatggtcaggagcggctgtacgtctgcctggcggacgggaggaacgtcgcctggtacgaccgtgaggcggcccgggtcaacgtgctcggcgaggactggcgggaggacgtgctcgacgcgctcgggcccttcctgaccgggccggtcaccgtgggtccgccaccggtgccgacgcccgcggagctggcccgcctcaccctccatccggacgacgacctggcgcccaaccggcccggtgaggcgctggtgatcgacctggaccgcgacccgggtcctgcgcaccggctgcggccggatccgcggcggcgggcgctggccgccgagcaggcggtcggcgaggcgctggaccggctcgagggggcggggtggcacaccctgcactcggtgccgctgcccggaggcgatcgcatccaccatctggtgatcgggccgggcggcctgttctcggtccacgcgctgtacgcccgcaagcagcgggtgctcgtcgccgacccgatggtcggggtggggcgacgggagccgcggccggtgctgcggtgggtgcgggccgacgccgaccgcgcctcgtacgcgctgacggccgaggtccgtccggtgctggcggtggtggggccgaccgcccttgatgtcacggctccgctgcgggcggtgcgggtcctgcgggaggcggacctgtccgggctggcgcggctgggcggggtgctcaagccggcggatgccgaggcgctgcacgcgatggcccgggaccggcatacgtggttgcaggtg

SEQ ID NO: 2935 - DNA, 477 bp, Streptomyces avermitilis
  CDS (1)..(477)
atgccggccccggacagcccgtggagcgagatcgtgcccggtctgtggatgggcgggcacgagttccagggccccgccgggcaactggagttcgccgtcgtacgcgatgagttcgacctggtcctgacgctgctgcggctgccgggccacggccccgacgagggcgtcgagcaccatgtgtggccgatcccggacggcccgctggacgggacgcagctcgcgggcgtcatccggctcgcgcagaccgcggccgaggcgctggagcagggccgccgggtgctggtccgctgctaccacggctacaaccgctcggggctggtcgtggcgcacgccctgatccggtccggccgctccgccgaggaggcgatacggctcgtccgcacccgccgctcgcactgggcactgcacaacgacctgttcgtcgcgtacctgcgggcggggctgcccacggcccgcctgctggaggaactgacggag

SEQ ID NO: 2936 - DNA, 888 bp, Streptomyces avermitilis
  CDS (1)..(888)
gtgccgcccctccgccacacaggcgccacccgcagcccctcacgcgccggcctcagcccgtcacgcgccggcctcagcccctcactcaccggcctcagcccctcccccaccggccgcgcccgccgcgccctccgccgcgccgggcgcgcggccctcggcaccctcaccgcggccctgctgctgacggccgcgaccggctgcggcgactccggcgggctgcgcggcgcgggcgcgacccccacggccgtcggcccgacgaagctctggccccagctgccggccgccaccaccgcggccctcgactacggcgaggcggacacggagacggtcaagggggtcacggcccccggcgacgacatccacgaggtggacccggtcgacgtgatgcgcgccgacatcgccgcgcacccggcccagtacaccggcccgaaggcgccgtaccacgagatcgtgcggcagatcgggaactgcggaaagaagggcgcgcggggccgcgcctgcccgatcctccaggcgtactaccgagatctcaccggcgacgggaaggacgacatggtgctcggcatccgctttcccggcaaccagctcgccgtgcgcgcctacaccttcgagcaccacaagctggtgcaggtcatgagcaccacggacgccgtggtcagcgtggaggtggcgggccgggaggtgatcatccgctcgccgtcgatactgccggggtacgagttccgtacggtctggcagtgggacgcgcaccagcacgcgatgctggcggcccgcgacgagatcctgcgcgtgggcaccgcgccgcccgcctcccggggcacgccgtcgccgtcgccccctgcgacaccggagccggcccggtcgccgaccccgtcggagagcacccga

SEQ ID NO: 2937 - DNA, 1293 bp, Streptomyces avermitilis
  CDS (1)..(1293)
atgagcccggccggacggcgcgtgggcctcttgggacgtctcccccgctggaccgccgccctcgcctggaaggccgccgtcttcatcacggtgatgtgctgcggcctcgccgccctgctcggcgtactcgtccatgtctcggtcaccgaccagaccgtcggcgaggcccgcggccgcgcgctcgaccggctgacgcaggcggcgtcggcgtaccaggcaggggaccggctgccgccgggcgcggacatcgatccgccgggtctgcccgcgcggctgaaggaactggccaccgacggacggcgcggcacgatggtcggccggaacgacccggagcccacgatgtgggcggcgggccccgccgacggcgggcgcacgctcgccgtgcgggtcgactacgcgcagggcgcccacaccatcgacgcgctcgaccgggcgatcgtgtggtcgtcggcgctggcgatcggcgcgacgctgctggtgggcgcgttcgcggtgacccgggtgacccggcggctgcacggcaccgcccaggtggcgcggcggatcagcgccggcgacctggacgcgcgcgtgaacgacccgcggacgaaggatccgacgcgcccccaggacgaggtggccgcggtggccggcgccctcgacacgatggcgtcgaccttgcagagcaagctgctgagcgagcagcggttcaccgcggacgtggcgcacgagctgcgcaccccgctgaccggactgcacgcggccgccgaactgctgccgccgggccgcccgaccgagctggtgcgcgaccgggtcgccgcactgcgcacgctcaccgaggacctgctggagatctcccggctcgacgcccgcagggagcggctcgagctggactcggagccgctcgcgccgctggccgagcgcgtggtgcgggcgtcggggacgcggacggaggtccgggtcgtgcgcgacgcgcgcgtggagaccgaccggcgccggctcgagcgggtgctcggcaatctggtggcgaacgcgcaccggcacgggcggggtccggtggtgctgacggtcgacggacccgtggtcacggtgcgggaccacggggacggctatccggcgtacctggtggcgcacgggccgcagcggttccgtacggagggcggcgcgaaggggcacgggctcgggctgacgatcgcgctcggccaggcggaagtgctgggcgcgccgctggagttcgccaacgcgcccgacggcggggcgctggcgacactgacactcccccacatgcaccgcaatggaccgattgtcgcgaca

SEQ ID NO: 2938 - DNA, 1365 bp, Streptomyces avermitilis
  CDS (1)..(1365)
atgatccagcccggatggcccggaacgaaggcggtggcggacccgctcgctcccgacctacgcctgccccggcgccgtggcatcgagttcagcctcctcgtcgtcgccgtcctgctgtccgtgtacggctactgcgccgtcggtctcgcgaagcggggcaccgtcccgcccggcgccgccggttacggcgccgggctcggtgtgctcgccctcctcgcccacctcgccgtacgcttccgggccccgtacgccgatcccctgctgctgcccatcgccgtgctcctcaacggcctgggcctggtgctgatctaccgtctcgacctggagaccccggccgaccacgcggcgccggcccagctcaactggtcgacgctcggggtcgcgctcttcatcgcggtcgtggtcctgctcagggaccatcgcgtcctccagcgctacgcgtatgtcagcgtcgtcggcgcgctcgcgctcctcaccctgccgatcttcttcccggccgtgaacggggcccgcatctggctccggatcgccggattctccatccagccgggcgagttcgcgaaggtgctgctcgcggtcttcttcgccgggtatctggcggccaaccgccatgcgctgacgtacgcgggccggcgcgtctggaagctccagttccccaccgggcgggtgctcggccccatcgtcgccatctggctgctgagcctcggcgtgctggtcctggagcgggacctcggcacctcgctgctgttcttcggcctgttcgtgatgctgctgtacgtcgccacgggccgcaccggctggatcgcggtggggctgctgctcgcggtcggcggcgccctcgccgtcggccggctcgaaccgcatgtgcacagcagggtccaggactggctgcaccccttcgcgtcgatcgacgcgggccagggccccaaccagctcgcccagtccctcttcgcgttcgcctccggcgggatgctcggcaccggactcggactcggccactcgatcctcatcggcttcgccgccaagtcggacttcatcctggcgacggcgggcgaggagctgggcctggccggcctgtccgcgatcttcctgctgtacgcgctgctggtggagcgcggctaccgggccggcctcgccctgcgcgacccgttcggacggctcctcgccatcggcctcgcctcgatcgtggcgctccaggccttcgtgatcgcgggcggggtgaccgggctgatcccgctcaccggcatggcgatgccgttcctggcccagggcggctcgtccgtcgtcaccaactggatcatcgtggcgctgctgatccggatcagcgactcggcgcgcagccagtacgacggcacggcggcgccg

SEQ ID NO: 2939 - DNA, 1455 bp, Streptomyces avermitilis
  CDS (1)..(1455)
atgacccgctacatccgccgggcggcggccctgtgcgcactgctcctggtcgccctgctggtcaacgcggcccgggtgcagatcgtccagtcgtccacgtacgacgacaaccccgccaaccgccgtccgacgatcgcccgttacggccagccgcgcggcgacatcgtcgtcggcggacagccggtcaccggctccaaggacaccggcgagcagctccgctacgaacggacgtaccacgacggccccctgtacgcgccggtcaccggcttcgcctcgcaggtgtacgggacgacgggcctggagaacgccgcggacggcatcctcgcgggcaccgacccgatgctgtcgctgctgcccttgtggaacggcgtctcgcgcgaccggaacccgggcggcaaggtcgtcacgaccctcgcggcgggcgcacagcgcgcggcgtacgaggggctggccggccggcggggcgcggtggcggcgatcgagccgtccagcgggcggatcctggcgctggtctcggccccgtcgtacgacccgggcgaactgtccgggacgaactcggccgtcacgagcgcgtgggaccggctgaacggcgacccggccaggccgatgctcaaccgggcgatccggcagacgtatccgcccggttcgacgttcaaggtggtgacggccgcagcggcgctggacgcgggcgtgatcagggatctggacgcgccgacgaggtccccggacccgtatccgctgcccgaaacgaggatctcgctgacgaacgaggcggaggactgcgaggacgcgtccctgcgttatgccttcgagtggtcgtgcaacacggtgttcgcgaagctgggcgtggacgtgggcctgaaggacatgacggccacggccgcgcacttcggcttcaacgacaaggggttgcggatcccgttcccggtcgctcccagcaacttcgacacgaagctggacgcgccgcagctggcgctgtcgtcgatcggccagttcgacacgcgggcgaccccgctccagatggcgatgatcgcggcggcggtggcgggcggggggtcggtgaagtcgccgtacctggtggaacggaccacgacaagcgccggcggcacggtctcggcgacgtcgccccgcaccctgcaccaggcgatgaacccgtcgaccgccgcgcggctgcgggagatgatgacggacgtggtgcgaaaggggaccggcaagaacgcggcgatccgcggtgccaccgtgggcggcaagacgggcaccgcccagcacggcatcggcaactccggtacgccgtacgcctggttcatctcctgggcgcaggcggacaacgcgttggaacccgcggtggcggtcgcggtcgtggtggaggacgcgtcggcgcgccgcggggacatcagcgggggcggggacgcggcgccgatcgcgaaggcggtgatggaggcggtgctcaggtcg

SEQ ID NO: 2940 - DNA, 1104 bp, Streptomyces avermitilis
  CDS (1)..(1104)
atgccgacgcatgagctgtacgccaaggacccgggagactcccactggcaggtgccggcctcgggcgcggcacgcttcagctgggagtacgacgacggacgcgaccggctcctcgccctctaccagaagggcaaggacaagcagtgggacggtcagcggcgcatcgactggggcctggaggtggacccgcacgatccgctcggcacgcccgacgaggcgatgaccctctacgggacgccgtactgggcgaagctgaccgaccgcgacaagggcgagctgcgcaagcactacgcgtcctggcagttcagccagttcctgcacggcgaacagggtgcgatggtgtgcgcggcgcgcatcgtggagtccgtccccgacctggacgcgaagttctactcggcgacccagacgatggacgaggcacggcacgcggagatctacggccgcttcctgcacgagaagatcggcatgctgtacccggtcaacgacaaccttcaggcgctcctcggggacaccctgcgtgacgcgcgctgggacatgccctacctcgggatgcaggtgttgatcgagggcctggcgctcgcggcgttcgggatgatccgcgacaccacggacaagccgctgccgaagcagatcctcgcgtacatcatgcaggacgaggcccggcacgtggccttcggccgcatggccctgcgcgactactacagccagctcagcgacgccgaactgcgcgaacgcgaggagttcgtcatcgagggctgctatttgatgcgcgaccggctgcgcggcatcgaggtgctggagaacttcggcattccgcgggcggaggcggagcggtacagcgagcagtccgaattcctgcacctcttccgccagttgctgttcagccgcatcgtcccgtgcgtcaaggacatcggcctgtggggcaaacgcctccagcaggcgtacgtcgacatgggcgtcttcgagatgggcaactccaacctggacctcctgatggcccaggacgaggagatcgcggaacgactggacgccgaacgcttcgccgcggaggagaaggagcgggtcgcggaggtgacggaggcgatcgaggcgggcacggagtcc

SEQ ID NO: 2941 - DNA, 933 bp, Streptomyces avermitilis
  CDS (1)..(933)
atgacgactgtgacggagggcgtggccgatgggttgcgcgacgcgctcggcctgctcaaggaccgcgagcaggtggccgagcggctgctcgactcttccgccaagcactccttcgacccggacaaggagctggactgggaggcgccgttcgaggagggcaagtggttctggccgccggagctggtgtcgctgtacgacaccccgctgtggaagcggatgggcgaggagcagcggatggccctcgcgcagcacgaggccgcggcgctcgcctcgctcggcatctggttcgagatcatcctgatgcagctgctggtgcggcacatctacgacaaggcggcgacgagcgcgcatgtgcgctacgcgctgaccgagatcgaggacgagtgccgccactcgaagatgttcgcgcgcctgatcagccggggcggtacgccgtactacccggtgagccggctgcaccagaacctcggccggctcttcaagacgatctcgacgacccccgggtccttcacggcgacgctgctcggcgaggaggtgctcgactggatgcagcggctgacgttccccgacgagcgggtccagccgctgatccgcggggtcacgcgcatccacgtcgtggaggaggcccggcacgtgcgctacgcccgcgaggagctgcgccgccagatggtcaccgccccgcgctggtcgcaggagttcacccgggtcacgtcgggcgagttcgcgcgcgtcttctcgctggccttcatcaaccccgacgtctacaccaacgtgggcctggacaagcaggaggcgctggcccaggtacgggcgagcggacaccgccgggaggtcatgcagacgggctcgaaacggctgacggacttcctggacgacatcggggtgctgcggggcgtggggcggcggctgtggcagtcgtcggggttgctggcc

SEQ ID NO: 2942 - DNA, 723 bp, Streptomyces avermitilis
  CDS (1)..(723)
atgacgtcgcaggccccaccccccgcataccgccggctcagcgtcgaggaacggcgcagtcagcttctggaggccgcgctggcgctcttcgcgcaccgtgcgcccgaggaggtctcgctggacgacgtcgcggaggccgccggggtgtcacggccgctcgtctaccggtacttccccggcggcaagcagcagctgtacgaggccgccctgcggtccgccgccgaggagctggagcagtgcttcgcggagccgccgcaggggcccctgtcccgacggctcggccgggcactcgaccgctatctcgccttcgtcgaccagcacgacaccggtttcagcgccctgctccagggcggaagcgtcgtcgagacctcccggaccaccgcgatcgtggacggggtgcggcgggccgccgccgagcacatcctcgaccacctggaggtgcgggagcccggcccgcggctgcggatgaccgtccggatgtggatcaccgccgtcgaggcggcctcgctcatctggctcgacgaggagaagaacccgccgctggacgagttgcgggactggctcgtcgagcagttcgtggcctgtctggcggccaccgcgggacgggacgcccagaccgccgacgtcctgcgcgcggcgctggcgacggagccggccgacggggccgcgggcgaactggtccggcgggtgctgcccgtgctcggcgacgccacccacctgctg

SEQ ID NO: 2943 - DNA, 363 bp, Streptomyces avermitilis
  CDS (1)..(363)
gtgaagagcgaagacacccccttcgtcggcggccccctggacgggcgcgtcctgccgatcctgctcggtccgaccggccaccccccgaagacctaccgggtccccgtcccggacgcggcgggcggcccgcccaccgtgctcgtctaccggcgcgagcaagcggcgcagagcaagcggctcggcctccacaagggctggaagtacgtgtacgaccccgaaggggacagcgggggcggccgcatcagatggccctggtccaagccggcccccacgcccgccacgcagccggacggcacaccggactccgcgcccgacaggaagccagacgccacgccggacggcaagccggacgccgccgacggg

SEQ ID NO: 2944 - DNA, 1413 bp, Streptomyces avermitilis
  CDS (1)..(1413)
gtgtcaggaaggttgctgcgactggtatgtacggcggcgatgacggccggcgcactgctgtcccccgggcaagcgacggcggccccgcccccggaccccgactctacggcgaccgctccggacaccacggagaccgctccggacaccacggcgacggcaccggacaccacggagacggctcccgaccccaccgcgaccgctcccggttccgcgggccccgacgtctccgacgccacctccatgggacgcctcctgacggatcttcagcggctgtaccggcaggccgagcaggccaccgagagccacaacgccaccacggagaagctgaggcggcagcaggccgaggtcgcgcgcctggacaggcagctcacccaggcccgcctctccctccaggacagccacggcgccgtgggccggctcgcccggcagcagtaccagggcagcaccggcatctccccctacgtacgcctgctgctggcccgcgatccgcagcacgccctcgaagagggccatgtgatcgggcagttggcgcaggcgcgggccaagacggtggagcggctgaccgggaacgagcagcgcagcgaccggctggcccgcgaggcccgggcggcgctcgaccggcagctcaccctcgccgagcgtcagaagaaggaacgggacgacgtccagggacggctcgaccaggtcgaggcacggctcgccacgctcagcacggaccagcgcgccgagctggtcgagttcgagaagaacggggaggcccaggcgcagcggaagttcgtggcgtcgggctcgctgagcagcgctcgcatcccctcgcggcagggcgacaaggccctgcgctatgccgtgcagcagctcggaaagccgtacgaatggggcgccgaggggccgaagtcgtacgactgctcgggcctgacctcgcaggcctgggcgcacgcgggccgcgccatcccccgcaccagccagggacagtgggccgcgctgccgcacgtcccgctgaagaaactgcgccccggagacctggtgatctacttccccgaggccacgcatgtggccctgtacctcgggaacgggatggtggtccaggcgcccagaccgggaagccaggtcaaggtgtcccccatcgcggcgaacccggtactgggcgcggtccgcccggacccgcgggccaagcccctgaggcactacgccccgctggcgctccccggaaccaccgcgaaggagcccgcccttcccgaggtccccgcgaagggcaggggcggcccgaagggacacggggccgtaccccatgtggttccgccgcccgggcacaccgtggctccgccgcgcgggcacgccgtggctccgccgcgcgggcacgccgtggttccgccgcgcgggcacgcccggccgcagccggcccgcgcccgcgtc

SEQ ID NO: 2945 - DNA, 1251 bp, Streptomyces avermitilis
  CDS (1)..(1251)
atgcggaagatactcgtcgtcggagccggccagtccggactccagctcgccctcggcctccagtcgcacgggtacgaggtcaccctgatgtccaaccggacggcggacgagatccggtcgggccgggtcatgtcgacccagtgcatgttcgacacggcgctcgggcacgagcgtgatctccagctgaacttctgggagtcccaggccccgaagatcgaaggactcggcgtctcggtcgcggcccccggctccttcgaccccggcccctcgcagcgcgccatcgactgggtcggcaagctcgacgggtacgcgcagtcggtggaccagcgggtcaagatggccggctggatggagacgttcgcgcagcgcggcggccaactggtcatccacggcgcggccgtctccgacctcgactacttctcccgtgcctacgacctcgtgctggtgtcggcgggcaagggcgagctggtgtcgatgttcggccgcgacgcctcgcgctcgccgtacagcgagccgcagcgcgccctcgcggtcgcctacgtccacggcctgggcccgcgccccgagcaccccgactacgacgcggtccgctgcaacctcgtccccggcgtcggcgaactcttcgtgatgccgaccctcaccacctccggccgcgcggacatcctgttctgggagggcatccccggtggcccgctcgacgtcttcaagggcgtcaacgacccgggcgagcacctctccctgaccctggaactcatggaacgcttcacgccgtgggagtacgcgcgggccaccaaggtcgaactgaccgacgggaacggcacgctggccgggcggtacgcccccaccgtccgcaacccggtcggccggctgcccggcggtggcctggtcctgggcgtggcggacgtggtcgtggcgaacgacccgatcacgggccagggctccaactcggcgtccaagtgcgcggccgcgtacctcgcgtccatcgtggagcacggtgagaaggagttcgacgagacctggatgcgggcgacgttcgaccgctactgggacacggctcagcacgtgacgaagtggacgaacgcgatgctcggcgtcccgccggagcacgtcctgaacctgatcggtgccgcgggcgccctccagccggtggccaatcgtttcgccaacggcttcgacaatccggcggacttcgagaacttcttctacgagccggagaagacggaggcgtacctggcctcggtggccgggagc

SEQ ID NO: 2946 - DNA, 624 bp, Streptomyces avermitilis
  CDS (1)..(624)
gtggactccgtcgtctctgacgtctctgatctcgtcgaaccggacgaggagttgaaggcctggcagacggaccgcacgcgcgccccgatcgccacgaagatcgtggtggcgggcggcttcggcgccggcaagaccacgctggtcaccgccgtctcggagatcacgcctctccagacggaggcgctgatgacccaggccagtgaggacaccgacgacctgacggggacgccggacaagctcaccaccacggtggccatggacttcggccgcatcacgctcgacgacgacctggtgctctacctcttcggcacgccgggccagcagcggttctggttcatgtgggacgacctggtgcgcggcgcgatcggcgcggtcgtcctcgccgacacccgccgcctgtccgactgcttccccgcgctcgactacttcgagagctgcggactgccgtacgtcgtggcggtcaaccacttcgacggcagcgagaagttcgagccggaggatgtgcgcgaagccctcaccgtgcctgcacacatacctgtcatgatcatggacgcgcgtcgccggatctcggtcatcgagaccctgctggccctggtcggccacgcgctggaagtaagcccggaa

SEQ ID NO: 2947 - DNA, 414 bp, Streptomyces avermitilis
  CDS (1)..(414)
atgagtacgagcgacaagtcctccgcgaacaagctcccggtccgcggtggcggccgcaagcccgcccgcgtacgcccctactcgctcaccggcggccgcacccgtttcggccacgtcctgctcgtcgagaccttcgtggccgcactggaggccccggctgagcggcgcgaactcaccaatggttcactcaacacccgagtgatgcccgagatgcgggccatcgtcgagctctgccgccgtatgcgcacggtggcggagatcgccgcgctgctgaggatgccgctcggcgtggtccgtgtgctcctcagcgacctcgcggaccagggaaagatccgtgtgtacggaaccggtcatggccccggacagcctgaccgcgctctgctggaaagggtgctgagtggactccgtcgtctc

SEQ ID NO: 2948 - DNA, 423 bp, Streptomyces avermitilis
  CDS (1)..(423)
gtgccggggctgctgtcggtcgcggtcgtctcctccgacggcctgctgctgctctcctccgaccccgggcggaacgcggaggcacgggcgggcctggagggcaggcccaagggcccgcgaggctcctccgccgacctcgccaccatcgtctccggcatcggcagcctcaccatcggcgccgcgaagctgatggactccggagccgtcaagcacacgatggtcgcgatggacgagggcagcgtcttcgtcatgtcgatcagcgacggttcactgctcggcgtgcacggctccgcggactgcgacatgagcgtggtggcgtaccacatggcgctcttcgtcggccgggccggacatgtgctgacgcccgaactccgcagcgagcttcggaaatcactggaggacgagtcgaccgggagtgcccga

SEQ ID NO: 2949 - DNA, 2922 bp, Streptomyces avermitilis
  CDS (1)..(2922)
atgcgagcaccggtgcagaagacgcggcctcggcgcacaggcaagcagacggcccccgaagagggcgcctcgtccgagtccgcgggcaagggtcgtgctgctcatgtgcgcaatcggctcatcatcgccgtcgccgtggtcgcggccgccgtcgcgggggccggcgccccctcggtcgtcgcggcctccggccaactgaacgactcccagaacctggtgacgctcaccggacagacccagcaggcgctcaccctcgcccactccctggccgacgagcgcgacgaggtcacctcctacgtggccgccgggcgccccaagtccaaggcccccgccgagcagcagagcgcccgcgtcgaccggcaggtcgaggaagtgcgcgcggaccctgacgcgcccaccgcgctgcgcaaggacctcgacgccatcgacgccgtacgcagagcggcgctcaccggcaagagcaccgctctcgaagcgcatcaggcgtactcggccaccatcaccgaactccacgccctcgccgaggagctggccgagcgactgccgccccgcgcgggctccggcgcccacgccctcgccgaactcgacggcgccgtccagcagtccgccgccgcccgcggtctgctgctggccgccctgaacatcccgcgctccacccagaccacgatcaacccggcgaccggtctgccgaccaccagcgacagctcctcggccgccgacaccaagcagcgcgacgccctgaccgccgccgcccagcaggccgccgtccgctccgacgccgcgatcgccgacttccgtgacaccgcgccccaggccgcccgcgcctcgtacgactccacggtcaacggccccgaggtcgcctccgccgagaagtacctcgccggcctcaccgaccagcccaccctctccgactccgaactcggcatcagcgtcaagaagctcgacgcggccctgtccgcccgtgtcgagctgatgcgcggcgtcgagtcgtccctctacgagcaccgcggcaaggacctcgcccagctgcgcgacgacgacgtcaccgcgctggagatccgcgtcgccctgctcggcgccctgatactggtcaccctcggcatcgcgaccgccatggcccgcacgctcacccgaccgctctccgtcctgcgccgcggttccgcccgcctcgccgccgacccggccgccgaggaaccggtcaagttcaccggtcggaacgacgagttcgcccaggtggtgcgttccgtcaacgcgctgcacgcgcacgccgtcgccctgcacgagcggcagaccaccctcgaggcggaccgcaagcacctcatcgggcagcggcagacgatggccgacgaccgggagcagctgcgcgccgagatcgcgacggccaccgcccacctggagcaggtccggcagagcattcacggcaccttcgtcaacctcgccctgcgcaccctcggcctcgtcgagcgccagctcgccgtcatcgagggcctggaggagcgtgaacaggacgcggaccggctggccacgctcttcaagctcgaccacttcgccacggtcatgcgccgccacagcgagaacctcctcgtcctggccggtgccgagcacgtacagcagcacgcgggcccggtcccgctcgtcgacatcgtccgcgccgcggtcagcgagatcgagcggtacgagcgcgtccgcatcgcggcgctgccgccgcacgcgcacctggtcggcttcgccgccgacgacctctcgcacctggtcgcggaactcctggagaacgccacgtcgttctcaccgccggacgtctccgtcgaggtctcgggctggctcctggagaacggcgaggtgatgctctccgtgcaggacgagggcatcggcatgaccaccgagcggatgcgccagctcaactcccggctcgcggacttcgatccggaggacgcctacgaccaggagagcggcgagggcctcggcctcggtctgtacgtggtggcccgcctcgctcaccggctcggcgtccgcgtgcagctgcgcgagcagaagcagggtggtgtcgccgcggtcgtcgtgctgcccgggacactgctggcctcggcccccgaggccgtcgtgtccaccaccggaccgctggccggcggcgccgcctcactgtcactgccgggcgccgacgcggaggccaactccaacgtcctgtacgcccgctcgacggtcgccgtaccggactccacggccgccgaacaggactccccggattccctggattccccggattctccggactccacggccgtcgtgccggagcccgcggccggcgaggacccgttgatcgcggcggccgagcgggcggtgcgggagcgtgacgaggacgccgtaacgggagaaagcgccggacgcgagccggagcccgagcccgagcaggtgcccgagcccacgtcccccgagaccacgatggagctgctggccccggtacccgcggccgaggaacccgccccggccgccgggctgcccgcgcggaccgccaccgaccccttcgccatcgggcccgacgcccacgagcgcactgtcgacgagggggaggcgccgtccgcggccgaggaacccggcaccccccgcctcaccgccaagggtctccccaagcgcacccccaagatctccgctcccgctccggtaccgcgccagcggcccggcggggtcgacgccgaggccctgcgccgcaggctcggcggcttccaccagggcgccaggagcggtcagcgcgtcatcgaggccgagatcgccgagaagacggccgagacgaaggcgcccacggaccggcccgcggaccggtccacgggccggcccactgatcggccggcacccgagcacaccgcaccacacggcaccgcacaggacgtagaagcatcggggggcactgtcgaggaggcaagcagt

SEQ ID NO: 2950 - DNA, 786 bp, Streptomyces avermitilis
  CDS (1)..(786)
atgcgtactgaactcgtctcggaatccggtgatccggcccgccccaacgaggacttcgccgcactcgcgcttccggcctcaggacagggcggcacgctgatcgtcctggacggcgtgacgccgccgcggggggaatacggctgtctgcattccgttccgtggttctgcgcacgcctcggcggagcactgaccgaactgtccgtttcccgccaagatctggcgttgccggaagtcctcgcgcacgccattcgcgccaccgcgcgggcccacgcggacacctgtgacctttctcacccgcgcacaccgcaggcgaccgtcgtcctggcccgctggtccgagaccgtcatggagtatctggtcctgtcggactcggtactgctgaccgaggcgccggacggcacggtcaccgccgtcctggacgaccgcctgtcccgcctgccccgcacgtccctcgtcacggacgccgtcgccgacgcgacggtccgcaacaaggagggcggcttcttcacggcggcggcggacccgtcggtcgcggcgcgcgcggtgaccggcacgctggaccgcggcgcggtccgcgcgctggccgccctgacggacggtgcgacccgctggacggagaagttcgccgagggcgactggaaggctctgttcacggtcgtgcgcaaggagggcggacaggccctggtggaccgggtgcgggcgctggagcgcgcggacagcgagcggcgggtgcacctgcgccgcagcaagacgcacgacgacgcgacggtggtgttcgtggagtgg

SEQ ID NO: 2951 - DNA, 513 bp, Streptomyces avermitilis
  CDS (1)..(513)
gtgcacgaggacgggaacggcgccgggcgtccggtcggaaccggcttgccggggagtggtgtggaccaggggacgggccggaaaggggaccgcgaattcctgtccctggaacgtgagttgaccgtttttctgcgccgcgcccgcgccaaccagggcgagatggcccgcgaagtccacccggacctggaatccgccgcgtacggactcctcgtgcgtctggacgagtgcggccgccagcgggccacggcactcgccgcctacatcggcgtcggcaaggccacgatgtcccgccagttgcgcgccctggaggacctcggcctggtcgcccgcgaaccggacccggccgacggccgcgcctggctcgtccacctcaccgaggagggccggcggcgcgtcggccgggtccgggaggcccggcgggcgcgctacgtcagccagctcgcccactgggaccagcgcgaggtcgcggaactggcccggctgctgcaccagttgaatctcggtatggagaag

SEQ ID NO: 2952 - DNA, 816 bp, Streptomyces avermitilis
  CDS (1)..(816)
atgtccgtgcacagatccggaacggcccaccgcccacgcctgctcgcggcaggcatcctgctcgccgcgttctccctcctgttcacccacccggctccggcggccaccacccccgcccgcggctccgcctacatgggcatgggagtcctggcccacgacggccggaacggcacccccagcaccggtgacgccacccagacggaaggggtggacgtctccagccaccagggcaacgtcgcctggtcgaccctgtggagcagcggggtcaagtgggcctacgccaaggcgtcggagggcacgtactacacgaacccgtacttcgcccagcagtacaacggctcgtacgccgtgggcatgatccgcggcgcgtaccacttcgccacccccgacaccacgaccggcgccacccaggccgactacttcgtcgacaacggcggcggctggtcccgcgacggcaggacgctgccgggtgcgctggacatcgagtggaatccgtacggcgccgcctgctacggcaagtcgcagagcgccatggtcagctggatcagcagcttcctcacccggtacaaggcgcgtaccggacgggacgccgtgatctacacggccaccagctggtggacccagtgcaccggcgactacggcggcttcggcaccgccgacccgctgtggatcgcccgctacgcctccgacccgggcacgcttccggcgggctggtcgtactacacgatgtggcagtacacgtcgtccggaccgacggtcggcgaccacgacaagttcaacggagcactggaccgggtgcaagcgctggcgaacggc

SEQ ID NO: 2953 - DNA, 2433 bp, Streptomyces avermitilis
  CDS (1)..(2433)
ttgactgccgaaggggagatcatggcttcgacgtccacaccgctcaccttgcctgtgctgccgctcgacgatgaggtcgtgctgcccggaatggtggtcccgctggacctgaacgacgccgacgtgcgcgccgccgtggaggccgcccaggccgccgcgcggtccgagcccggcaagccgaaggtgctgctggtgccccgcgtcgacggggcgtacccgggcaccggtgtgctcggcaccgtcgagcaggtcggccggctggccgacggcgacccgggcgcgctcatccgcgggcgtggacgggtgaagatcggcgcggggacgaccggccccggcgccgccctgtgggtcgagggcacacaggtcgacgagaccgtgcccgaccctctgcccggacacgtcaccgaactggtgaaggagtacaaggccctcgccaccagctggctgcgcaagcgcggcgcctggcaggtcgtggaccgggtgcaggccattgacgacgtttccgcccttgccgacaattccggatactcgcccttcctctccaccgaccagaaggtggagctcctggagaccgccgacccggtcgcccgtctgaagctggccaccgagcagctgcgcgagcacctcgccgagcaggatgtcgccgagtccatcgccaaggacgtacaggaaggcgtcgacaagcagcagcgcgagttcctgctgcgccggcagctcgaagccgtgcgcaaggaactgcgcgagctgaacggcgagcaggacggcgaggagtccgacgactaccgcgcccgggtcgaggccgccgatctccccgagaaggtccgcgaggccgcgctcaaggaggtcgagaagctggagcgggcgagcgaccagtcgcccgagggttcgtggatccggacctggctcgacaccgtgctcgaactgccgtggaacgagcggaccgaggacgcgtacgacatccagggcgccaaggcgatcctggacgccgaacacgccggtctcgaagacgtgaaggagcgcatcaccgagtacctggcggtgcgcaagcggcgccaggaccggggactcggcgtggtcggcgggcggcgcggcggtgccgtgctcgcgctcgtcggaccgcccggcgtcggcaagacctcgctcggcgagtccgtcgcccacgcgatggggcgcaagttcgtgcgcgtcgccctcggcggcgttcgcgacgaggccgagatccgtggacaccggcgtacgtacgtcggcgcgctgccgggttgggtcgtgcgcgccatcaaggaggccgggtcgatgaacccggtggtcctgctggacgagatcgacaaggtcggctccgacttccgcggcgacccggccgcggcgctcctcgaagtcctcgaccccgcccagaaccacaccttccgcgaccactacctggaagtcgaactcgacctgtccgacgtcgtcttcctggccacggccaatgtgctcgaagccatcccggaggccctgctcgaccgtatggagctggtccgcctcgacggctacaccgaggacgagaaggtcgtcatcgcccgggaccacctgctgccgcgccagctggagcgggcgggactggagaaggacgaggtcacgctcgacgagagcgcgctgcgcaagctcgccggtgagtacacccgagaagcaggtgtacgcaacctggagcgtgccgtcgcccgcctgctgcgcaaggtcgcggcccagcacgaactgggcgagcggaagctgccgttcacggtcgcggacgcggatctgcgcgggctgatcgggcggccgcaccacgtgcccgagtccgcccaggaccccgccgagcgccgtacggccgttcccggtgtcgccaccgggctcgcggtcaccggcgcgggcggcgacgtcctctatgtggaggcgtcgctggccgacccggagacgggcgcggccggtctgaccctgaccggtcagctgggtgacgtgatgaaggagtccgcgcagatcgcgctctccttcctgcgcagccgcggcgcggagctcgaactgcccgtcggcgacctcaaggaccggggtgtgcacatccacttcccggcgggcgcggtcccgaaggacgggccgagcgcgggcgtcacgatgacgacggcgctggcgtcgctgctgagcggacggcccgtgcggacggacgtggcgatgaccggtgaggtctcgctgaccgggcgggtgctgcccatcggcggcgtcaagcagaagctgctggccgcccaccgggccggcatcacgaccgtggtcatccccaagcgcaacgagcccgacctggacgacgtcccggccgaggtgctggagaagctggacgtccacgcggtgacggacgtccgccaggtcctggagctggcgctgtccccggcgacgaacggcgcggcaccggaggttccggtcgcggcg

SEQ ID NO: 2954 - DNA, 867 bp, Streptomyces avermitilis
  CDS (1)..(867)
gtgttcgctctcagcgatcatcggaaatcaccggatgcgcgccgaccgcaggggtgcggaggcgcggaagttctgccaggcgaaccaggtgcttcgccacggaattccgaggaccggcgcgcacgacctcgctatagtcactccgtaatacctaaacagcttaagtggccattaccaggggtgacggtgaacgagcttgtacggacctgggtggacggctgggtcgtctcgcgcggggcggcgccgcccgtcgtcgagccctgggggtacaccgtcgacgtggggcagccggagcacatcacgcggcacgtcctcgcggcgacgaacgacggggtcgagcgggcggcggtccggaaggtggcgggggcggtgaccggggccggggtgtggctcaaggttttcgcggacccggcggtcgtcgggccgtggctgggcgagggatggtgggtggaccccgagcccgcacacctcatgtcggtttctctgaagccggtctccctgaggggtgccgaagcctgcgccggggcggccgcggcggaccgggccgtgcccgagggctaccggctgcgcgcctggtctcgcggaggcgtcacccgcgtgatcgtcgccgcgccggacggctcctgggccgcgcgcggccagaccgccccgaccggcgcgacggcggtcgtcgaccagatcgagacctcccccgcccaccgccgccgaggactgggcacccttgtgctgcgcgcgctggcgcgggccgccgtcgatcagggcgcggagaccggcgtcctcgcgggaacaccggagggacgggcgctgtacgagacgctggggtggacggtggcggcaccgctgacgagtgcgaagttcaccggggca

SEQ ID NO: 2955 - DNA, 948 bp, Streptomyces avermitilis
  CDS (1)..(948)
ttgcgggtggtgtcggtcatagacagcgatgccatgcgacacgaagtgtggggcgcgacggaaggagcgccgcacgtggaccgcactgtggaccgcgctgtcgcgacggctgacgccgcgctcatggccccggagtcgggcgcgcccccgctggacggcctgccgcggcagcgcacgacgcccctcgcggtgccgccgtccgccggagcggtcccgtccccggcctccgcgccgtcgtcgtccgccggaccggccccggtgccgccgtccgtcgcgcggtcggtgccgcgccggcttccacgcctgtggctgctgctgccgagcccgctcggtacgcccttcactctcgcgtacgcgctcgtcctcgtcgccacgtccctggtcgcggagtacgccgatccgtcgttcgtgcatgtcctgcaccaggcatccagtacggatgtcgcgcatctgatgcgggatccgctgctggtgctggtggcgagcgcgctgtgggtcgcgggcggggtgacgtcgccgtacgcgctcggcttcctgctcgtcctcacggctctggagcggcggacagggggccggcgcacggcgggcgtgttcctgctcggccatgtgctcgcgaccctggccaccgaggtcccggtcggcttcgcggtcctcgccggccatctgcccggcagctccctgcaccgcctcgactacggcatcagcttcggcgtcgcggcgtgcgtcggcgcgctggcgggcctgctgacaccttggccgcgctgcacgatcctcgtcgtcttcggcgggtcactggtcgccgacctggtcgagttcgcggatccgatgacggactgggggcacctgatggcgctgtcgatcggggtcgggatgtggccggtggtgcggcggtggcagcgtgcgcgtacgtccagccgtcccgccgctgcggcgaacgcgtccgactgc

SEQ ID NO: 2956 - DNA, 675 bp, Streptomyces avermitilis
  CDS (1)..(675)
atgaccacctcgtacgactctcccgtagtcatcgaccgtcgcgagggccctcacggcgaggtcgtgctgcgccgccacggaacgctgcttcagatcatcgccaacgggtgcttcctgatggacacctcggacggacgctcggagcggctgctggtggacgcggcccgcgacgcactggacgagcggcccgagccgagcgtcctgatcggcggcctcggcgtcggtttctcgctcgcccacgccgccgcggacgcccgctggggccggatcaccgtcgtggaacgcgagcgggccgtcatcgactggcaccgcgacggaccgttgtccacgctctccgcgccggcgctcgccgacccgcgcaccgagatcgtggaagctgatctcgtcgcctacgtcaatgagacatccgccacgtacgacgccctgtgcctggacatcgacaacggacccggctggacggtcaccgagggcaacgacagcctgtattcgaaggccggactggcagcctgcgcacgggtgttgaagcccggtggggtgctagcggtgtggtcggcacaaccctctccggattttgaaggaaccctacggaatgccgggttcctaggggtgcgtaccgaagaggtccccgttgcccggggcgttccggacgtcgtacatctcgctgtcagacctgga

SEQ ID NO: 2957 - DNA, 735 bp, Streptomyces avermitilis
  CDS (1)..(735)
atggagcagacacacacctcccacaacggcgcggcggcgacgcccggcgctcaacgccgggttctggtggtcgaggacgacccgacgatcgtcgacgccatcgcggcccgtctgcgcgccgagggattcctcgtgcaaacggcaggcgacggtccctccgccgtcgacaccgcggaggcctggcagcccgacctgctgatcctcgacatcatgctgcccggcttcgacggcctggaggtctgccgccgcgtgcaggcccagcgcccggtgccggtgctgatgctcaccgcgcgcgacgacgagaccgacatgctcgtcgggctcggggtcggcgccgacgactacatgaccaagccgttctcgatgcgggagctggccgcgcgcgtgcatgtgctgctgcgccgggtcgagcgggccgtggtggccgccacgacgccccgcaccggcatcctgcgcctcggtgagctggagatcgaccacgcgcagcgccgggtgcgggtgcgctcggaggacgtgcacctgacgcccaccgagttcgacctcctcgtctgtctggcgaacaccccgcgcgcggtgctctcgcgcgagcagctgctcgccgaggtgtgggactgggccgacgcgtccggcacccggacggtggacagccacatcaaggcgctgcgccgaaagatcggggccgagcgcatccgtaccgtgcacggcgtgggctacgcgctggagaccccgacgcca

SEQ ID NO: 2958 - DNA, 1104 bp, Streptomyces avermitilis
  CDS (1)..(1104)
atgagcgacgggccggccgcacggaggggccccggggatccctggggcggagtacgcccgttctcgatcaagaccaagctgggcgcgctggtcgtcatctcggtgctgatcaccacaggcctgtcgatgatcgcggtgcacaccaagacggagctccgcttcatcacggtcttctcgatgatcgccacactgttgataacgcagttcgtggcgcattcgctcaccgcgccgctggacgacatgaacacggtggcccggtccatctcgcgcggtgactacacgcggcgggtgcgcgagaaccgctgggacgagctgggtgacctggcccacacgatcaacctcatggccgacgagctggaggcccaggaccgccagcgcaaggaactcgtggcaaatgtctcccacgagctgcgcacccccatcgcgggcctgcgcgcggtcctggagaacatcgtggacggcatctccgccgccgaccccgagacgatgcgcacggccctgaagcagacggagcgactgggacggctggtggagaccctgctggacctctcccggctggacaacggcgtcgtccccctccgcaagcgccgcttcgaggtgtggccctacctgtccggcgtcctgaaggaggccaacatggtcgcctcggcacgcgcgagcctggcgacgggctccggcagccacacccgcacggacgtccatctgcacctcgatgtgtccccgcccgagctgaccgcgcacgcggacccggagcggatccaccaggtcgtcgccaacctgatcgacaacgcggtcaagcacagcccgccgcacgggcgcgtgacggtcaaggcccggcggggccccgcacccgagtcgctggacctggaggtcctggacgagggcccgggcatccccgagtcggagtggcaccgggtcttcgagcggttcaaccgcggcgccgtcagcgcgccgcacggcccgggcagcgacggcggtacgggcctggggctcgccatcgcgcgctgggcggtcgatctgcacggcggccggatcggtgtggccgaatcccagcggggctgccggatccaggtcacccttccgggacttccctctctgccaagt

SEQ ID NO: 2959 - DNA, 3828 bp, Streptomyces avermitilis
  CDS (1)..(3828)
gtgtcgccacagtcccccagtaactcgagcatctcgaccgacgaccaagccgggaagaaccccgctgcggccttcggacccaacgagtggctcgtcgacgagatctatcagcagtacctccaggacccgaattcggtagaccgagcctggtgggacttcttcgccgattacaagccgggcgcagctgccgcctcggctccggcgggtactgcggccgcgggggccgcagagaccaccacgccggctccggccgcgccgaccgctgcggcccccgccgctcccgcggcaccggctccggccgccccggcaccggctccggccgctccggctcccgcggccgctccggcggtcccgaagcccgctgccgcggctccggccccggccgccgcgaagccggccgccgccgcgcccgcccagccgaaggccgccgcggcgaccgaggccgccgagggccccacgttcgtcccgctgcgcggtcccgccgccgcggtcgcgaagaacatgaacgcctcgatcgaggtgcccacggccacgtccgtgcgcgcggtcccggtgaagctgctcttcgacaaccgcatcgtcatcaacaaccacctgaagcgtgcccggggcgggaagatctccttcacccacctcatcgggtacgcgatggtgcaggccatcaaggccatgccgtcgatgaactggcactacgcggagaaggacgggaagcccaccctcgtcaagcccgcgcacgtcaacttcggcctcgccatcgacctggtgaagcccaacggcgaccgccagctcgtcgtcgccggcatcaagaaggccgagacgctgaacttcttcgagttctggcaggcctacgaggacatcgtccgccgcgcccgtgacggcaagctgacgatggacgacttcaccggtgtcacggtctccctgaccaaccccggcggcctcggcaccgtccactcggtcccgcgtctgatgcccggccagtcggtcatcatgggcgtcggctccatggactacccggcggagttccagggcacctcccaggacaccctgaacaagctcggcatctcgaaggtcatgacgctcacgtcgacctacgaccaccgggtgatccagggcgccgcgtccggcgagttcctgcggatcgtcgcgaacttcctcctcggcgagggcggcttctacgacgagatcttcgaggctctgcggatcccctacgagccggtccgctggctcaaggacatcgacgcctcgcacgacgacgacgtcacgaaggccgcccgcgtcttcgagctgatccactcctaccgggtccgcggccacgtcatggccgacaccgacccgctggagtaccgccagcgcaagcaccccgacctggacatcaccgagcacggcctcacgctctgggacctggagcgcgagttcgcggtcggcggcttcgcgggcaagtccctgatgaagctgcgcgacatcctcggcgtgctgcgcgactcgtactgccgcaccaccggcatcgagttcatgcacatccaggaccccaagcagcgcaagtggatccaggaccgcatcgagcgctcgcactccaagccggagcgcgaggagcagctgcgcatcctgcgccgcctgaacgcggcggaggccttcgagaccttcctccagacgaagtacgtcggccagaagcgcttctccctggagggcggcgagtccgtcatcccgctgctggacgcggtcatcgactccgccgccgagtcccgcctggacgaggtcgtcatcggcatggcccaccgcggccgcctgaacgtgctcgccaacatcgtcggcaagtcgtacgcgcagatcttccgcgagttcgagggcaacctcgacccgaagtcgatgcacggctccggcgacgtgaagtaccacctgggcgccagcggcaccttcaccggcctggacggcgagcagatcaaggtctcgctggccgccaacccgtcccacctggagacggtcgacccgatcatcgagggcatcgcccgcgccaagcaggacatcatcaacaagggcggcacggacttcacggtcctgccggtcgccctgcacggtgacgcggccttcgcgggccagggcgtggtggccgagaccctgaacatgtcgcagctgcgcggttaccgcacgggcggcacggtccacatcgtcatcaacaaccaggtcggcttcacggccgccccggagtcgtcgcgttcgtcgatgtacgcgaccgatgtggcccgcatgatcgaggcgccgatcttccacgtgaacggcgacgaccccgaggccgtcgtccgcgtcgcccgcctggccttcgagttccgccaggcgttcaacaaggacgtcgtcatcgacctgatctgctaccgccgtcggggccacaacgagtccgacaacccggcgttcacgcagcccctgatgtacgacctgatcgacaagaagcgctcggtgcgcaagctctacaccgagtccctgatcggccggggcgacatcacgctggaagaggcggagcaggcgctccaggacttccagggccagctggagaaggtcttcaccgaggtccgcgaggccatctccaccccgggcgaggcgccggctcccgagccgcagcccgagttcccggtggccgtgccgaccgcggtctcccaggaggtcgtgaagcggatcgccgagtcccaggtcaacatccccgaccacgtcaccgtgcacccgcggctgctgccgcagcttcagcgccgtgcggcgatgatcgaggacgacacgatcgactggggcatgggcgagaccctggccatcggctcgctgctcctcgagggcaccccggtccgtctttcgggccaggactcccgccggggcacgttcggccagcgccacgccgtcctgatcgaccgggtcacgggcgaggacttcaccccgctccagtacctcgcggacgaccaggcgcgcctgaacgtctacgactccctgctctccgagtacgcggtcatgggcttcgagtacggctactcgctggcccgccccgacgccctcgtgatgtgggaggcgcagttcggtgacttcgtcaacggcgcgcagacggtcgtcgacgagtacatctcggccgccgagcagaagtggggccagacgtccggcgtcaccctgctcctcccgcacggctacgagggccagggtccggaccactcctcggcccgtatcgagcgcttcctccagctgtgcgcgcagaacaacatgacggtcgcccagccgacgctcccgtcgaactacttccacctcctgcggtggcaggtgcacaacccgcaccacaagccgctggtggtcttcaccccgaagtcgatgctgcgcctcaaggccgccgcctcgaagacggaggagttcaccacgggcgccttccgccccgtcatcggcgacgacaccgtcgacgccgccgcggtccgcaaggtcgtcttctgcgccggcaagctgtactacgacctcgaggccgagcggaagaagcgcggcgccacggacgcagcggctgccgagaccgcgatcatccgcctcgagcgcctgtacccgctgccgggtgccgagctccaggcggagatcgccaagtacccgaacgccgagaagtacctgtgggcccaggaggagccggcgaaccagggcgcatggcccttcatcgccctcaacctgatcgaccacctggacctggcggtcggcgcggacgttccgcacggggagcgactgcggcgcatctcccgcccgcacagctcttcgccggccgtgggttccgccaagcggcaccaggctgagcaggagcagttggtgcgagaggtgttcgaggcg

SEQ ID NO: 2960 - DNA, 3990 bp, Streptomyces avermitilis
  CDS (1)..(3990)
gtggacgaacgacccgaaggcggcgacgcgcagggagcacgcgaggggcgcgatgcccgcggggacggtgagccggacgaggtggtgtcgggggaactgctcccctacgacgacatcgcgggcgtcgcggccgcgagcgtcggcctgcacgcgctcgcggacgacctcgcgggtgagcgccgtgagctggccgtcgagctgcgcaagttcttcgtggtgctcaggctctccgtgcgccggtacgccgccctgcggccctacagcccgagcagtgtgagccgctatctcagcggcgacctcgtggcaccggaccacttcgtcgccacgctgatggacgacgtcggcagggaactggggcgcccgctgtcggcgcaggcgcgtggccgggtgacggggctccagcgggcggccctccggtcgagcaacagccgtgcctggaaggtgcaggagctggaggaccggttggccgcggcccatcaggacgcccaggtggccaggacccaggccgacgcggtggccacgctgctgcacgcggagcggcagcgtgtggccggggtggaggaggagcgtcaggaactcgcacggacactggaggcccatcaggccaccagcggagccgagctggacgtgttgcgcgcacagcaacaccgggtgcgcgccgaacgcgacacgctgcgccgccgggtggcagacctggaagcggcgctcgcggccgccgaacaccgtgttgcggaggccgagcaacgctgcgcggacctggagcacgaactgctcaccgcggacgcggcggcagccgccgaggagtccgcggccgccgagcaggaacgggcccggcaacaggccgaactcggcagtctgcgcgacgaggtggcgcggctgagggtggctgccgagcgggtcccggagacctccccggccaggggaacgcaagcccctcgcacctcggtccacggggccgaagccgacgcgacgggcccggtttcaggcgatcggtccgcggccgcccctgcggatgtccctggtgcggcatcgagtgtcacgatcgtctacgccgggttcaaccgggcctgggcggcctggatcggagaccgtctggagcggtggggtgtgcgcgccgtactcatgctctgggatgtgccggccgacatcccgctgattgatctgctgcgcgatctgaaactcgccgagggccggatcctcatcgtcgtcagcgagtggtacttccagttgggcctgcgctcccacgacgagtggaacgaggccctccgggaggtcgtggcgcccgacccgtcccggttcgtggccgtctcggtcaccaacgcgcccgtgccctcggccgcggcggtgctcgccgcggtcgatctgaccgacacgggcgccgacgaggccgaacgacgactgctggcccggctcgtcggtctgcccggtgactcgctgcccgcggcctcgggcggcgagcggcgcgggccgcgctttccggccgccacacccgaggtgtggggcggagtgccgcgccgcaacacccgcttcacgggacgtgagtcgctgctgagcgacgcctacagcctgctgaagggcgccgagccgggtgcgggcgtcctcacgctgcacggcatgtcaggcgtgggcaagacccagctcgcggtcgagtacgtgtaccggttcagctccgagtacgacgtggtgtggtgggtcggcgccgacaaccggggggtgttccggcagacactcgccgaactcgcctcgcgactcggcctgtccacgggtgccgagtacggcgagcggctgcgtgcggtgcgggattcactgcgccggggcgacccgtacgcgcgctggctgctgatcctggacggcgccgacgacccggaccagatcgaggacctggtgcccacgggaccggggcacgtactgatcacctcccgcaacctcaagtggggcgaacacaacagcgaactgctcgaagtcccggtctacgaccggcccgaatcggtggccttcatcaggcgccgcgcaccacggctggcggaggcggacgccgaccggctcgcggaggccttggaggatctgccgctgctgctggaccagaccgcgggctggctcaacgactcggacctgtccgtcggggagtacatcgcgttgctggacggaggcatcgaccaggacgtggtcaaggtctccgcggacttcccgatcgcgttccggacggcctggtcgatcctgctgaacaaggtccgcgagaccgtcccggaggccgtcgacctgctgcgtctgtgcaccttcttcgctcccggcctcatccccgtacggttcctcagggagatgccgcacaacgagttgccggagacgatcaccgggctgctcaacgaccggctgctgtggaacaaggcgatccaccaactgcgtcagtactccgtcgtccgtctggagtcccatgaggcggccaccgacgggagcacctcttcgggggagtcgctgtacctgcaccggatggtgcaccagatcgtccgcaacgacatgccggaggacgagcggcatgagttcgccgccgtcgtgcggcgcgcactggcgagcgcggaccccggccgtcccaccgacacccgccactggggcgagtacgcggagatcgtcccgcacctgaagtacgcggacgtactcgacagtcctgaccccggcgtacagcggctggtcctcaactgcctcggctaccttcacctttcgggccggtacgcggccggtgtcgagctcgccgagcgcgccctggaagcctggcgggaactgctcggtgacacccatcccgtgatctgggagctgaccgcccaccacaccaacctgctgcgctcgaccggggactaccggcggacggaggccgtcgaccgggcggccgtcgagcacctgcgggaagagcgcggggagctggacccggaccacttgcgcgcggctgccggcctggccgccgacctgcggggtctcggccgctacggggaggcgctggagctgacccggcggctgctcacgagctgcctcgacctcctcggggaacaggactcgcggaccctcgacgctcagcacgacctggggttctcgttgcggctgctcggccgctacgaggaggcgctggacgtcgaccggcggacgctggaggcacgtcgggcgctgctgagcgggcggcatcccggaatcctcctctcggagacctcctgcgcgacagacctgcgtctgctgggccactacgccgaggcggagtcggcccaggcgacgaacgcgcgggcgcagcgcgccgtgatgggctccgacaatccgcagaccctgcgcgccgagcacaacctcgcgctgtgccagtaccgcgccggcgaccgggaaaaggcggggaagctcttctcccgcgtactggagcgctacgagcggaccctgggcgagaccgaccccctgacgctggccgcggccgtcagccagagctgcttcgcacgcgagtacggcgacatcgaccaggcgggcgcggcgagcgaatccctcatcgcccgctacgaagcgatgctcaccgacggacatccgttcaccatcggcgcccgcgccaaccacgtgttgctcctgcgccaggtcggcgcacgcgacgaggcgcgcttcggggccgagaaggcgctgacggccatggcggcggcgatgggcgagagccacccctggaccctgggctgcgccatcaacgccgccgccgtgcgtcaattcatcggcgacgtcgagtcggcggccgagctgagcgggagcacggtcgcacgggccaccgacgcactgggccgcacccaccccctcaccctgtccgcccgggtggcccaggccgcggacctgcgtggcctgagggagcaccggcgggccgaggagatcgagcaggaggtgcttgcggatctcgccgcgacgctgggctcgcgacacgtccacaccgtctcggcccgctcccgcaaccgcccgtactgggacttcgaaccgcagccgacc

SEQ ID NO: 2961 - DNA, 162 bp, Streptomyces avermitilis
  CDS (1)..(162)
ttgacgcatcaagtcgctcatctccgggcgcacacgcgaaaggaaacgctcatgaaccgcaagcacgctctcaaggcctcgctcgctctgctcggcgcggccgtctcgggtggcgtacgcgccgtcgtgtcgtggctgctgcagatcggtacggacgggtcg

SEQ ID NO: 2962 - DNA, 321 bp, Streptomyces avermitilis
  CDS (1)..(321)
gtgcgcgtgagcgccggcctacctgtgcgggggcccggccacccgtgcgagcgggggccgccgggccgcgcctatcctggtgagaccgcggggtactgcgttccggcaggccccgcctgtccccacctgacggagagcacgttgtacttcaccgaccgtggcatcgaggagctggagaagcggcgcggcgaggaagaggtcaccttcgagtggctcgccgagcagctgcgtacgttcgtcgatctcaatccggacttcgaggtgccggtggagcggctggcgacgtggctggcgcgactggacgacgaggacgacgaggag

SEQ ID NO: 2963 - DNA, 1167 bp, Streptomyces avermitilis
  CDS (1)..(1167)
ttgggcacattcacccctttcaccccccaggtgttcaccagaacgggtgtcttgactttcgacatccgcgatatatcgtgtttagggagagaccggaagacgcgatatgacgtgtcgcaccctgctccggccgaggaggtctgcaccatgtccgagtggtccgtcgcagagccgaggaagctcacctttgacgaccccgtgacggcactccatgtgcgcatcgtcaacggaacggtgaacgtcgtgggcaccgaggagggttccgcccggctcgaggtgtccgcgatagagggcccgccgctgacggtcacgcagaagggcggcaccctcacggtggcgtacgacgaccttccctggaagggcttcctcaagtggctggacggaaagggctggcgccgtagcgcggtcgtctcgctcgccgtcccgatgagcacgcgcgtggaggtgggtgtggtcggcgccggcgccgtggtctccgggatcgacggacccgcggaggtgaagggcgtcaccggcgacacgacgctggtgcggctctcgggcccggtacacgcctccacggtctcggggagcgtggaggcccagggcgtcaccggcgatctgcgcttcagttccgtctccggcgacctgaccgtggtcgagggctcgggcccctccgtgcgggccgagtcggtcagcggctccatgatcgtcgacctcgacccggcggaccgtccgaccgacatccacctgtcgaacgtctccggggagatcgccatcaggctgccccaccccgcggacatggaggtggaggcgaacaccacgagcggcaccgtgtcgaacgccttcgaggacctccgggtcagtgggccgtggggcgcgcacaagatcaccggccggctcggctcgggcagcggcaagctcaaggcgatgaccgtctccggctccatcgccctgctgcgccgccctcaggcggaggacgagccatgggacgcggagccgccgacacccggcgacgcaccccggcccaaggacatgccccgacccaaggacacgccccggcccaaggacacgccccggcccgaggacgcgcatcagcccgaggacacgcgtcgcacggcgtcagtgccaaaggacgcggtgcccgacgaggactccaccgacggcccgaccgagaagaaggggctc

SEQ ID NO: 2964 - DNA, 1074 bp, Streptomyces avermitilis
  CDS (1)..(1074)
atgcctcccgtctttgcccatggccgcctgcgcctgtacctgctgaagctgttggacgaggcgccgcgccacggctacgaggtgatccggctgctggaggagcgcttccaggggctgtacgcgccgtccgcgggcaccgtctatccccggctcgccaagctggaggccgagggactggtcacgcacaccaccgagggcggccgcaaggtctacgcgatcacggacgcgggccgcgccgaactggcggaccggcaaggtgagttggccgacctcgagctggagatccgcgagtcggtggctgagctggccgccgagatccgggcggacgtgcgcggcgccgcgggtgatctgcgccgcgagatgcgggcggcggcgaccgaggcccggcgcggccccgaggcaggtgccaaggacgacgggcgccacggggagtacggcgacaaggagtcctggcgcgtcgcgaaggaggagatgcgccgcgtcaagcaggagtggaaggagcaggcccggcgcgcgaaggacgagagccggcgggcccgcgaggaggcccagcgggcgcgccaccaggccaaggaggcgcaggagcacgcacgcgcccaggctcaggaagagttgcagcgcatcgccaggcgggtccaggagcaggtccaggaccacttcgcgcgaggcgactggccgacgggcgtacgggacggtctgagcgaactcgccaaggagttcggcgaattcgggaaggacttcggaagggagttcggcaaggacttcggcttcggccgcaccgagacgaaggagggcccgaggacaccggccgacgccggcaccggcccgaccgccggcgcggagtactcggtcacgccggaggacttccccgccgattacgaaccggcctgggcgcacgaggactccacgggcgaccccgcccgcgacctggaccgtctcctggaccgtttccgtgacgacatccgcgacgccgcccgcgaccacggggtgacggaggagcaactgcgctacgcccggcgccacttgtcgacggcagcggcacacctgggcgcaactctgcgcaccccgaaggcc

SEQ ID NO: 2965 - DNA, 564 bp, Streptomyces avermitilis
  CDS (1)..(564)
atgttcgaacggttcacgaaggacgcccgcgccgtggtcacgggcgcggtcgggcactgcgaacgggcgagggaggagaaggtcgacgaggcgcatctgctgctcgcactccttgaccgcgaggccagccgtggctccttcgccctggcgtcgctcgggctggcgggccgccgcagcgaggtggagcgggacctggccgaggcccgccgccggggtggcctctcccgcgccgacgcggaagccctgaccggcctcggcatcgacctcacggagatcgtctccagggtcgaagaggctcatggggcgggcgcgttggcggtcggcgggacgggcggcgggcgccggggggcggggcgacgccccttcactcgcggcgccaaggacctcctcacggagtccctccgtatcgccgtcgcccaccgcgaccggcatatcggcgacgaacatctgctgctcgccctgaccgcccgcccgggcgtcccggccgaggttctcgcggatcacggggtgacgtacgaggcggtgacgcgcgtgttgtacggcgggggagcggcgaaggccggg

SEQ ID NO: 2966 - DNA, 207 bp, Streptomyces avermitilis
  CDS (1)..(207)
atgaccgaagcaacggatctcgccgagcgcgcgggcgaccgcgatccgcggatcgggctgcgggcggtctccgcgctgcggaggctgctggagcagctggaggcggtgcaggtgcgcagtgcgcgcaaccagggctggtcgtggcaggagatcgccgcggaactcggagtgagcaggcaggccgtgcacaagaagtacgggaggcag

SEQ ID NO: 2967 - DNA, 963 bp, Streptomyces avermitilis
  CDS (1)..(963)
atgttcgctgcctacgccgcccgaatcgaccgtgaccagccgctcagcggcctggagttgggggagcgcccggcccccgagcagaggcccggctggaccaccgtgaaggtcagggccgcctccctgaaccaccacgacctgtggtccctccgcggcgtcggtctctccgaggacaagctcccgatgatcctcggctgtgacgcggccggcgtggacgaggacggcaacgaggtcgtcctgcactccgtcatcggccagaccggccacggagtcggcccgaacgaaccccgctccatcctcaccgagcgctaccagggcaccttcgccgagcaggtctccgtgcccacctggaacctcctccccaagcccaaggacctgtccttcgaagaggccgcctgtctgccgaccgcctggctgacggcgtaccgcatgctcttcaccaacgcgggcgtacgccccggcgactccgtgctcgtccagggcgccggcggtggcgtcgcgacggccgcgatcgtgctcggcaaggcggccgggctgcgtgtcttcgccaccagccgtgacgaggccaagcgcaagcgggccgtggagctgggcgcggtggaggcgctggagccgggggcgcggctgccgcagcgggtggacgccgtcatcgagaccgtcggcgccgccacctggtcacattccgtgaagtcgctgcggcccggcggcacgatcgtcatctccggcgcgaccagtggagaccgtccctcccacgccgagctcacccgcatcttcttcctggagctgaagatcgtcggctccacgatgggcaccaaggacgagctggaggacctgctctccttctgcgccgccaccggcgtacgtcccgttatcgacgaggtgctcccgctcgaccgcgcacgtgagggcttcgaacgtctggagtcgggcgacctgttcggcaagatcgtactgaccacgacc

SEQ ID NO: 2968 - DNA, 1221 bp, Streptomyces avermitilis
  CDS (1)..(1221)
gtggcagcggagatcgtcaatcctcgcagcgacagcagtacggatcaggaaggcggggcggagcccctcgattccttcgatcccgcgttcgcgctgcatcgtggtggcaagatggccgtgcaggccaccgtgcccatccgcgacagggacgacctgtccctggcgtacacgcccggcgtcgcgaaggtgtgcaccgccatcgccgagcagcccgagctggtccacgattacacgtggaagtcgtccgtggtcgcggtggtgaccgacgggacggccgtgctcgggctcggggacatcggtcccgaagcctcccttccggtgatggaggggaaggcgattctgttcaagcagttcggcggggtggatgccgtgccgatcgcgctgggcacgacggacgccgacgagatcgtcgagaccgtcgtccggctcgcgccgtccttcggcggggtcaatctggaggacatctcggcgccgcggtgcttcgagatcgagcgcaagctccaggagcggctggacatcccggtcttccacgacgaccagcacggtacggccgtggtgacactggcggccctgcggaacgccgcgaagctgaccgggcggacgctgggcgagctgcgtgcggtgatctccggcgcgggtgcggccggcgtcgccatcgccaagttcctgctggcggcggggctcggggatgtcgcggtcgcggaccgcaagggcgtcgtgtcgaaggaccgggacgacctcacgccggtcaagcgcgagctcgcggagatcacgaacaaggcgggcctgtcgggctcgctggagtcggctctcgcgggcgcggacgtcttcatcggggtctccggcggtacggtgccggagccggcggtggcttcgatggcggagggcgcgttcgtcttcgccatggccaacccgaaccccgaggtgcatcccgagatcgcgcacaagtacgcgtccgtggtggctacgggccggtccgacttcccgaaccagatcaacaacgtgctggcgtttccggggatcttcgcgggggcgcttcaggtgcgcgcgtcgcggatcacggaggggatgaagatcgcggcggcggacgcgctggccgatgtggtcggtgacgatctcgccgcggactatgtgattccgtcgccgttcgacgagcgggtggcgcctgcggtgaccgcggcggtggccgcggctgcccgggcggaaggtgtggctcgccgc

SEQ ID NO: 2969 - DNA, 957 bp, Streptomyces avermitilis
  CDS (1)..(957)
atgaccgcaagcaccatccgccgttcgaccgccatacgctcccggatagctgcggtcggcgcgatcgcggtcgcgggcacgctgctgctcaccggctgcggtgaccagaccaagagcaagagcaacgaatcgggcagcagctcgtcgggctcggcaccgctggccgacaagctccccgagtcggtccggaacgcgggtgtcgtcaaggtcggttcggacatcgcttacgcgccggtcgagttcaaggacaactccggcaagacggtcggcatcgacccggacctggccgaggcgatgggcaagcagctcggggtgaaattcgagttccagaacggcaccttcgacaccctgatcacgggtctgcgctccaagcggtacgacatcgccatgtccgcgatgaccgacaccaaggaccgccaggagggcgtcgactccaccaccggcaagaaggtgggcgagggcgtcgacttcatcgactacttcaccgcgggcgtgtcgatctacacccccaagggcaagacccagaacatcaagacctggtccgacctgtgcggcaagaagctcgtgctgcagcgcggcacggtctccgaggacctcgccaagtccgaggccaagaagtgtcccagtggcaagaccatctccatccaggccttcgacaacgaccagcaggcccagacccgcctgcgcgcgggcggtgcggacgccggctcctccgacttcccggtcgccgcgtacgcggtgaagacctccggcggcggcaaggacttccagatcgtcggcgagcaggtcgaggccgcgccgtacggcatcgcggtcgccaagtccaacacccagctgcgggacgcccttcaggccgccctcgacgcgatcatcaagaacggcgagtacgacaagatcatcgcgaagtggggcgtcgaggacggctccgtcaaggcagcccagatcaacggcggcaag

SEQ ID NO: 2970 - DNA, 936 bp, Streptomyces avermitilis
  CDS (1)..(936)
gtgactgttgacatcgacaagacgacgggcccggagggcactcccccgggcgggccggaagccatcaaggccattccggtcaggcactacgggcgctatgtctccgccgtcatcgccatcgcgatcctgatcgcgatcatctacgcgttcggccagggcaagatcaactggcacgccgtaccggactacttcttcgacgaccgcatcctcacgggcgtcggcaagacgctcctgctgacggtgctgtcgatgctgatcggcatcgtcggcggcatcctgctggccgtcatgcgcctgtcgaagaacccggtgacgtcgtccatcgcctggttctacatctggttcttccgcggcaccccggtcctggtccagctcatcatctggttcaacctgggcctggtcttcgagtacatcaacctcggtccgatctacaaggactactggtcgagcttcatgacgccgttgctgacggcgctcctgggactcggtctgaacgaggccgcgtacatggcggagatctgccgcgcgggcctgctctcggtcgacgagggccagaccgaggcctcgcacgcgctcggcatgagtcacaacaaaaccctgcgccggatcgtgatcccgcaggcgatgcgtgtgatcgtgccgcccacgggcaacgaggtcatcaacatgctgaagacgacctcgctggtgtcggtcgtccagtatccggaactcttccgctacgcccaggacatcggccagacgtccggcgcgcccgtggagatgctcttcctcgccgccgcctggtacctgatcatgacctcggtcctcagcatcgggcagtactacgtcgagcggtactacgcacgcggttccagccgtagtctgccggccacaccgttccagaagatcaaggccaacatgctctcgctgggccgcccgaggggaggcacggca

SEQ ID NO: 2971 - DNA, 789 bp, Streptomyces avermitilis
  CDS (1)..(789)
atgaccgccaacgtgaccaagacggacgccaccacgccgatggtgaagtccgagggcgtccacaagtccttcggcgccgtggaagtcctcaagggcatcgacctggaggtgaagaccggcgaggtgttctgcctcatcggcccctccggctccggcaagtcgacgttcctccggtgcatcaaccacctggagaagatcaacgccggtcgtctgtccgtcgacggcgagctggtcggctaccgccagaagggcgacaagctgtacgagctgaaggacagcgaggtcgcggtcaagcgccgcgacatcggcatggtcttccagcgcttcaacctgttcccgcacatgacggcgctggagaacgtcatggaggcgccggtccaggtcaagggcgtcagcagggccaaggcgcgggaacgcgcgggccagctcctggagcgcgtgggcctggccgacaaggcgaagaactacccctcgcagctctccggcggccagcagcagcgcgtggccatcgcccgggccctggcgatggacccgaagctgatgctcttcgacgagccgacctcggcgctcgacccggaactggtcggtgacgtcctcgacgtcatgcgcgacctcgccgagtccggcatgacgatgatcgtcgtcacgcacgagatgggcttcgcgcgcgaggtgggtgactcgctggtcttcatggacggcggtgtcgtggtcgaatccggccacccccgcgacgtactgaccaatccgcagcacgagcggacgcagtcgttcctgtcgaaggtgctc

SEQ ID NO: 2972 - DNA, 783 bp, Streptomyces avermitilis
  CDS (1)..(783)
gtgcggccgagcgaagaaggggcttccatgaccacgacgaccggaaccgactggcacgcctggcaggaaagctgggaccggcagcaggagtggtacatgccggaccgcgaggagcgcttccggatcatgctcgacatggtcgaggcgctcgtcggccccgagccgcgcgttctcgacctcgcctgcggcacgggcaccatcacggcccgcctgctcgcccgtctcccgaacgcgaccagcaccggcgtcgacctcgaccccgcgctgctcaccatcgccgagggcacgttcgcgggcgacgagcgggtctccttcgtcaccgcggacctgaaggaccccgagtggcccgcccggctgccgtacgacgcgtacgacgccgtactcaccgccaccgccctccactggctgcacagcgaacccctcgcggccctctacggtcaggtcgcggagctggtccgcgacggcggtgtcttcatgaacgcggaccacatgatcgacgagtcgacgccccggatcaacgcggcggagcgggcgcagcggcacgtccgtatggatcaggccaaagcggacggtgccctcgactgggccgaatggtgggcgctggccgcccaggacccggtgctcgcggccccgacggcccgccgcttcgagatctacggggagcacgccgacggtgacatgccgtccgccgcgtggcacgcgcgcgtactgcgcgagaagggcttcggcgaggcccggccggtgtggcgctcgccctcggacacgctgatcctcgcggtcaag

SEQ ID NO: 2973 - DNA, 627 bp, Streptomyces avermitilis
  CDS (1)..(627)
gtggaactggcctattactcggattacgccgtacgtctcgtcaacagcgaggagccggcccggggcaaggacgcgctcacctcggtggaggccgtccgcgacctcttcgggggcaacgcgtcggcggcccggcgcgctacggacgcggacgtgacgcggttccgttcggtccgcgcgcgcctgcgcgcggtcttcgaggcggccgacggcggcgacgagacgctcgccgtcgacctgctgaactcgctgctgctggaattcccggtgagcccgcagatctcgggccatgaccaccgggacgacgacgggcgcccgttgtggcacatgcacctggccgaccacccgtccaacgcgaccgcgggctacgcggcgatcgccacgatgggcctcgcgttccacctcaccgagtacggcgtggaccgcctcggcctgtgcgaggcggcgccgtgccgcaacgcctatctggacacctcgacgaaccgctcccggcgctactgctcggaccgctgcgccacccgcgcgaacgtggccgcctaccgggcccgcaagcgcctggaggcggaccggacggagagcacgggccgggcggccgagagcgcccagagcgcgagcgcgaacggcgagcgc

SEQ ID NO: 2974 - DNA, 432 bp, Streptomyces avermitilis
  CDS (1)..(432)
atgccggagctgtcgcaggagaccgagcgtgggagggccgtgctgccgttcggggcggccgaggtgacgggaccgtcgatggtccccacgcttcagcacggggatcggctgctacttcagtacggggcgcgcgtcaggcccggcgacatcgtcgtgctgcggcatcccttccagcaggatctgctcgtcgtgaagcgggccgtggagcggcgcgagggcggctggtgggtgctcggggacaacccctacgcgggcggggacagcaccgactacggcaccgttcccgaggaattcgtcctcgggaaggtgcggttccggtaccggccgcgcaaggagggtcagcgctcgccgttcgcgctcgcgctctgggcgctctcggccgcccggcccgtgctctccgtccggtccgcctccaggcgcttgcgggcccgg

SEQ ID NO: 2975 - DNA, 393 bp, Streptomyces avermitilis
  CDS (1)..(393)
atgctctcccgcctgtttgcccccaaggtcaaggtcagcgcgcactgcgacctgccctgcggtgtgtacgacccggcccaggcccgcatcgaggcggagtcggtgaaggccgtccaggaaaagatggccggcaacgacgacccgcacttccaggctcgcgccacggtcatcaaggagcagcgcgccgagctcgccaagcaccacgtgtcggtgctctggagcgactacttcaagcccccgcacttcgagaagtacccggagctgcaccagctggtcaacgacaccctgaaggccctctcggccgccaaggcgtccacggacccggccacgggccagaaggcgctggactacatcgcccagatcgacaagatcttctgggagaccaagaaggcc

SEQ ID NO: 2976 - DNA, 507 bp, Streptomyces avermitilis
  CDS (1)..(507)
gtgcacgacaccaagaaccaagatgtgaacgaagagctcaacgacgagctcgccgaaaagccgggcgaagaggcgcacgccgagctggacgtggacgcgttcaccacggcgatcgagaacttcaaccgcttctacatccggctcccgatgctggagaagctgtccttcacgacgctgtcggtgctggacaccctcgcgttcggcggcagcccgatgcggctgaccgatctggccaggaccgagcaggtcagccagcccggcatcacgcagctggtcacccggctggagcgcgacgggctggtggagcgccggtccgacccgagcgacggccgcgccgtcctcgtccacatcaccgaggcgggccgcaagatcggccgctcgcgccacgaggaccggacgcggcacctcaccccgctggtggcccaactggcccccgaacagcgccaggcgatcgccgacgccctgccggccctggcccgcctggcggaaatcggacggggccgaccc

SEQ ID NO: 2977 - DNA, 1002 bp, Streptomyces avermitilis
  CDS (1)..(1002)
atgactgttcgtgtcggcatcaatggcttcgggcggatcggacgcaacgtcttccgcgcggcagccacccggggcgcggatctggagatcgtcgccgtcaacgatctcggcgacgtggcgaccatggcccatctgctggcctacgactcgatcctgggccgcttcccggaggaggtcaccgcggaacccggtgcgatccgcgccggcgacaccaccgtcaaggttctcgccgagcgcgaccccgccgccctgccctggggcgacctgggcgtggacgtggtcatcgagtccaccggcatcttcacggacgcggccaaggcccgcgcgcacgtggacggcggcgccaagaaggtcatcatcgcggccccggccagcaacgaggacgtcacggtcgtgctcggcgtgaaccaggacgcctacgacccggagcgccacacgatcatctccaacgcctcgtgcaccaccaactgcctcggcgtactggccaaggtgctgcacgacgccgtgggcatcgagtccggcatgatgaccacggtccacgcctacacccaggaccagaacctccaggacgccccgcacaaggacctgcgccgtgcccgggccgcgggcctcaacatcgtgcccacctccagcggagccgccaaggccatcggcctggtgctgcccgaactccagggccgcctcgacgccttcgccctgcgggtccccgtccccaccggctcggtcaccgacctgacggtcaccgccagccgcagcaccacggtggaagaggtcaaggaggcgtacgccaaggccgccgccggcgcgtacaagggtctgttgtcctacaccgaggcccccatcgtcagcaccgacatcgcgggggaccccgcctcctgcgtcttcgacgccgagctgacccgcgtactgggctcccaggtcaaggtcgtcggctggtacgacaacgagtggggctactccaaccgcctcatcgacctggccctgctggtcggcgacaccctc

SEQ ID NO: 2978 - DNA, 933 bp, Streptomyces avermitilis
  CDS (1)..(933)
atggcattgcgcccccaatgcgcggtagtgtttgattgcagtaccacggccactgaggtctcacaaggagatgaatctgtgacgaacgtgactggggactacacggactgcactcctctgctcggcgaccgagcggcactcgacagcttctacgaggaacacggctacttattcctgcggaacgtactcgaccgtgacctcgtcaaaacggtggcggagcagatgcgggaaggactcgtcgcgctcggtgccgcggatccgcacgccacgctcgaggaactcacgatcgactccttcgagtcggtcgacgaagtggccatgcacgactacgtcaaatacgacgcattctggaacaacccgtcgaccatcaaggttttcgagcaggtgttcggcgagccggtattcgtgttcctctccacgaccatccggtactacccgtcgcaggcgggctccgaggagccgtccttccactacctgacgccgtttcaccaggacggcttctacatagggcccaaccaggactttcgcaccttctggatccccctgatacggacgaccagggagtccggaggtgtcgcgctggcggacggcagccaccggcgcggaaagcgcgaccacgtgctcaacgagtccttccgcaggttcggccacccggtgcgcggaattccgccgacggaggtgagtgaggacgaacacctgctgcactcccccatggagccgggagacatcctcctctttcatgcgcacatgtgccacaaatcaattccgaacctgtcgaaggacccgcgcctcatgcggatgtcgatggacacccgggtacagcccgcgaaatcccaccgcggcttcaacgcaatgacgccctggacggaatcggcaaaggacgcgtcaaagggaatcatggcgaagatcaccggtacccccaccgacgtggaa

SEQ ID NO: 2979 - DNA, 1452 bp, Streptomyces avermitilis
  CDS (1)..(1452)
atggatttgacttcagagacgtcgcccgcaggtggcccggtggaaaaggaagatctggtccgccagggcagtgacaaaccagcgggattatcgggcgccggcctggcagtgatcctgacgggcttcgcgctgtccatcgccgacttcttcatcgtcaacgtggcgctggccacggtgaaacacgacctccacgcatccgatgccgagctggagctggtcgtgtccggctacggaatcacctatgcgctcggcctggtcatgggcgggcgtctgggagacgcgttcggcagacgacgtctcttccgtgacggcctgatcgcgttcacgatcacgtcggcactgtgcggcttcgcgccgaacgtcaccttcctcatcgccgcccgtctgttgcagggcgcggccgccgcgatgctcgtaccgcaggtgctgggcaccatccaggcggcgaccgacggcgcgtcccgcgcccgggcgatcagcctctacggcgccaccgccgggatcgcggcggtggccggacagatcatcggcggattcctgctgatgctcgacatcggcgactccggctggcgatccgtgttcatgatcaatgtgccgatcggtctggtggcgctgctgctggtccggcgcatgcccgccaccaaggcggaccggaaaccgggcctcgacctgctcggcacggccctgttcggggtgaccatggtctgcgtgctgatggtgatcgtcgagggcaggtcgctcggctggccggtctggctgtggtcactgctggtggtcgccgccgtcgcggccgtgactctggtcagggtcgagcgcgggctggaggcccggggcggttcaccgttgcttcccccctcgatcctggcccgccacagcatgcgcacggggctgatggcggtcgtgcccttctccatcgggttcggcagcttcctgttcgtctacaccctggtcgcgcaggacaagctgggcctcggggcgctggcctcggccggcgtgctgtccccgttcgcctcgtccttcttcgtggtctcgctgttcaccccgaagatcacggcccgtatcggccggcgcatcgtgtcggtgggcgcggtcgtccagggcacgggcctgctgctgctcgccctcctgatcggagtggagtggccgcatctgccgctcctgctggtcctggcggtgctcgccttcaccggcatcggccaggctctgatcggaccgacactgctgaggatggtgctcgccgacgtaccccccgcgtcggcgggcaccggcagtggagtgctggtcaccagccagcagacggcaacggccctgggcgtcacggtcggcgggaccctctacctcaccctcgcgagctcgctcggcgacgcgtccggggcggtgctcgtcctcgttctgctggccctgttctccgcggtcatcttcgccctgagcctgcggctgcccgagccgcgc

SEQ ID NO: 2980 - DNA, 810 bp, Streptomyces avermitilis
  CDS (1)..(810)
atgcaccttcaaccgagtacggccgtcgtgaccggcgcggcgagtggcatcggtttcgcgctcagcgcccgactggcacaagcgggcgccagggtcgtgatgacggacatcgcgggtgacggcctggccggggccgtcgaggagctggccgcgcacggcgcggacgtcaccgccgtggtcgccgacctcaccgacccggccgcggttcaggagctggccgacacggccttcgggcggctcggcgacatcgacgtggtctgcaacaacgcaggcgtcgtcggaccggtcggaatgccgctgtggagcgttcccctggacgagatgcacgctgtcttcgacgtcaactactgggcgcacgtccatgtcgcgcgggccttcgtgccgcgcctcctcgacagcgggcgcccctcgcacctcgtgcagaccgcctcgatgtccgcgttcgtcgtcggcgcgggtaccgcgtcgtacgccgcgtccaagcatgcggacctggccgcggcccgaagccttcgggcggacctcgacggcactcccgtgcgggtctcggttctctgcccggggcgggtcgacacaccgatgacccggggtcttgtcgctccccggaacgcgaccgggaacacgacgatcagcgcggacgaagcggccgacgcggtgtggaacgcgctgggctcggaccgcttctacatattcaccaacgccgatgcccaaaccaggctcggcgatcaattcaacgacgtatggcgccatctggcacgggaaaagtactggaccgaatcctcttcaccgagcgttaacagttctcgccca

SEQ ID NO: 2981 - DNA, 1782 bp, Streptomyces avermitilis
  CDS (1)..(1782)
gtggtggatatcgaggcagtgagagcgaagtaccgggaggaacgcgacaagcgcgtgcaggccgatggtggccgacagtacctgagtgcgcagggggaattcgcccattacgccgacgatcctcacgcgaagccgatcgagcgggctcccgtttccgacgaagtggatgtcaccatcatcggcgcgggaatcggcggactgcttctgggagcccggctgcgcgaggcgtgcgcattcgacaccatccgactcgtcgacaaggccggggacgtcggcgggacctggtactggaaccgttttcccgggctgcgctgcgatgtcgagagctatgtctacatgccgcttctcgaagagctgggacgcctcccctcggagaagtacgcgaccggcgccgagatattcgagcactgccaggccatcgcgcggacatacgatctctatgacgaggcgttgcttcagacctccgtcaccgagctgagctgggacgaggattcctcgcgatggctggtgcgcacggaccgcggggacctcgtccgatcacgcttcgtggccatggcgatcgggtccctgcacaggcccaagcttccctcgatacccggaacagaggccttccaaggacactcgttccacaccagccgctgggatttcgcatacaccggcggtgacatctcgggcgggctggagaaactcggggacaagcgggtcggaatcgtcggaaccggtgcgacggcagtccagtgcatcccgcatctggccgagtcggcagcgcatctctacgtcttccagcggacgccgtcgaccgtcagcgtacgaaacaacaggccgaccgacccgggctgggcggcggggctcgaacccggctggcagcaacggcggatggacaacttccatgcgctgacctcgggcgtcgaccaggacgtggacctcgtccaggacggctggacggagatcacctccaagctcgccgcgatcctcccgaagtcggcggccgacgcggacccgaaggacatcggcaccgccgtcgaactcgcggacttccacaagatggaggagctgaggaaacgggtcgacgcgatcgtccacgacaaggacaccgccgacgccctgaagccgtactaccggctcttctgcaaacgaccgtgcttccacgacggatatctggacacttacaaccggcccaacgtcaccctggtggacacccagggacgcggagtggagcgcctcaccccgacctccgtggtggccggcggccgggaatacccggtcgactgcctcatcttcgcctcgggctacgaatccgaattcggcgtcccctacacgaaccgcaccggattcagcatagtcggccgggacggaattcgactgtccgagaagtgggccgagggcgcccgcaccttccacggtctccaggtgaacggcttccccaactgcttcatcctgtccaaggcgcagtcgggtctccacgtcaatgtgccgtacatgctcaatgagcagagcaaacacgtcgcctacatcctcaaggccgtgcagcagcgcggtcggcaggtggtggaagcatccgccaccggcgagaaggaatgggtggagacgatcctcaggctggcgaaccggaacctcgacttcaccgagtcctgcaccccgggccttttcaacaacgagggaaaccctcgaaatgtggccatcctcaactccagctacggaggcggatcggtcggattcgtcaatattttgaaacggtggcgagaggcggacgacctcgccgacctcgaattacgtgaaggg

SEQ ID NO: 2982 - DNA, 918 bp, Streptomyces avermitilis
  CDS (1)..(918)
gtgtcaagagcaatggacattacgcggatacctggttcggcgatcggcgcggtcgtggccggcgccgacttttcaggcaccatcgacgacacgcaggtcgaagagatctggcaggccctcgaccagcacctcgtgctggttttccgcgggcacaaggatccctcgaacgacgacctcctcatgttcgcccggcgcttcgggcacgtaccgaagaccggcctgacgaccggtgccagcccggatcacaacgagatcctcctcatctccaacatcctcgacgagaacgggcagaagataggcgtcggcaacgcggagtggatggactggcacacggactactccttccgcccgagggtgtcccgcatcggcttcctggcggcggtcgagctaccgccgtcgggcggcggccagacgctgttcaccgacatgtacacggcctacgaatccctcccggacgacctccggcagcgcctgcactcctaccgggccaggcattcgctccggtccggctacgaggacgtcatcgaggaggagtaccagggcgaggtctccatcgaagggccgaccgcgaaaccgttcgtggcccccgaggacggtacggcgacggtccatcagctgatcgccaggaacccgcggaccggccgccgcgcggtgtacgccaacccgctcaacaccaaacgcatcctcgaactggacgtcacctccagcaaggaggtgctccagcagctgttcgccaagcccggtgagccggaactgacctacgcccacgagtggctccccggtgacatcgtcatgtgggaccagttggggaccgtccacgccaaacgggctttcgatccgaccgagcgccggctcctgcgcaaggtcgtcacgatcttcgacgacccggcggagccgtggcacccggaggacgcggcg

SEQ ID NO: 2983 - DNA, 174 bp, Streptomyces avermitilis
  CDS (1)..(174)
atggaacagaccgtccgcagcggcaacggggccgcaggcggcatcctcggccactcctcggccggactccggaatgacaggcacgacggcgccctcacaccaggagcggcgccgcagcgttcgtccaccgtggaccccgtgcacctggtggaccccgtgaagggtgtggcgtca

SEQ ID NO: 2984 - DNA, 1011 bp, Streptomyces avermitilis
  CDS (1)..(1011)
atgaccgtgaccccggaaagtctgcaccgcagccgcgacgcgatcacaccggcgttgcgcaccgcgctccacctgctcgacgaggagacccgccatcaggcggcgtaccacctcggctggatcgaggccgacggcaccccggcggacggcggcggaggcaaggccgtacggcccgcgctcgcgctgctgtcggcgcaggcggccggcgcaccggcggaaaccggcctgcccggtgcggtggccgtcgaactggtgcacaacttctcgttgctgcacgacgacctgatggacggcgacgaggagcgtcggcatcgacgtacggtctggacgctgtggggcgcctcgggcgcgatcctcaccggtgacgcgctgctggcgctcgcgcaggaggtgctgctcgactgcgggctgcccacgggggcggccgcggcgcggctgctcgcccgcaccacccgcgacctcatccgcgggcaggtgcaggacgtggcgttcgagcggcgggcccatgtgccgatcgaggagtgcgtcgacatggcggccggcaagaccggcgcgctgctgtcggccagcgccgcgatcggtgccgtactggccggcgcgccggtgaccaccgtcgacgccctggcgctctacgggcagcaggtgggcctcgccttccagctgaccgacgacgtcctcggcatctggggcgacccggctgtcaccggcaagtcggtccactccgacctgcgggcccgcaagaagtcgctgccggtcacgtacgcgctcaaccagggcgggaccgtgagtgtcgagctggccacctggctctccgcaccaggcgagcccgacgaggcagagctgcgccgggcggccgacctggtggcggcggccggcggccgcgactgggccaccgccgaggcggcccggcgcatggcgctcggggaggccgcgctgcgcggcgtcgacctggacgccgcggcgcgcgacgagctcatcgccctcggacacttcgtcgtcgaccgggaggtg

SEQ ID NO: 2985 - DNA, 1008 bp, Streptomyces avermitilis
  CDS (1)..(1008)
atgccccaggacgtcgacttccacataccgttccccagccgtcgcagccccgacttcgagcgggccagggccgaccacctcagctggccccgcgcgctcggcctcatcggcaccgacgccgccgccgagcgccacagccggggcggctacgccgatctggccgcccgcttctacccctcggccaccggagccgacctcgacctgggcgtcgacctgatgtcgtggttcttcctcttcgacgacctcttcgacgggccgcgcggcgaggacccccaggagaccaggaagctcaccgacgccgtcgccgccgcgctcgacggccccctgcccacgtcggcgccgcccatcgcccatggtttcgccgacgtgtggcggcgcacctgccagggcatgtcccccgcctggcgcgcgcgctccgcccggcactggcgcaactacttctccggatacgtcgacgaggcggtgagccgccacctcaacaccccctacgactcggccggtcactacctcgccatgcgcaggcagaccatcggcgtgcagcccaccgtggacctggccgagcgcagctgccactgcgaggtgccccagcgggtgttcgacagcgccgtgctgttcgcgatgctccagatcgccaccgacaccaatctgatcctcaacgacatcgcctccctggagaaggaagaggcccgcggcgagctgaacaacatggtcttcatcctgatgcgcgagcacggctggacgcgcggccgcagcatcgcgcacatgcaggacggagtccgcacccgcctcgaacagttcctgctcctcgaggcctgcctgccgaaggtctacgacaccttcgagctcactgcgcaggagcgcgagagcgcggagaagtaccggatggacggggtgcgttcggtgatccgggggtcgtacgactggcaccgcagctcgggccggtacgccgccgactacgcgatcgccgccagctaccagggctacctcgaggagctgggcagcacgctg

SEQ ID NO: 2986 - DNA, 1347 bp, Streptomyces avermitilis
  CDS (1)..(1347)
atgtcccagcacaccttcgtcgccggaacggcccccggggccgtgcccgtagtggggcacgcctggcagatgatgcgccgccccctgcacttcatgtcctcgctgtccgcgcacggcgacctggtgaagatacgcattggcccgacgtccgcctatgtgccctgccaccccgagctgctgcggcaggtactgaccaacgaccgcgtcttcgacaagggaggagtgttctacgaccgcgcccgggacatcgccggcaacggtcttgtcacctgcccctaccgcgaccaccgcaggcagcggcgcctgatgcagtcggccttccagcgcacgcagctggagcggtactccacggcgatgcgcgcggagatcgacgccacggcggcgcggtggcacgacggcacggtcatcgacgccttccccgagctgtacgggatggcgctgcgcaccgtggcccgcacgctgtactccaccccggtcaccgaggaactggcacagcgcgtcgaacaggcctttgacaccgtactcaacgggctcttccgccagatgttcctgccccactccctgcggcggctgccgaccccggccaacctccgctaccgcaacaacctgcgcttcctgcacgacaccgtgcaggacctgatcaccgagtaccggcgggacgacacccagcgcgacgacctgctgtccgcgctgctggcgtcccgtgacgaggacggcggacggctgggcgacacggagatccacgaccaggtcatcaccgtgatggcggccggaaccgagacggtcgccggcaccctcacctggatcttccatctgctctcccggcatcccgagatcgaggcgaggctgtacgaggagatcgacaccgtcctagacggaaagcccccgcactgggacgacctgccgagcctgtccctgacggaccggatcatcaccgaagcgctccggatgtatccgccggcctggatcttcacccggctcaccgcgtcggacgtcgacctcgcgggggtgcgcctgcccgagggcaccaccatcgtcttcagcccctcctccgtgcagcgtcactcggaggcctacgacgacgcgtcccggttcgaccccgaccgctggctgcccgaccgcacctcggccgtcgcccggcaggcgttcacggcgttcggcaccggcgcgcgcaagtgcatcggcgacctgttcgcgcggaccgaggccaccctcgcgctcgccacgatgctgagccagtggcgggtcaccgtggagcccgacgcggacgtccggcccgtcgccctggccaccgtgtaccacccgcgccgcctgcgcctgcggctgacggcccgtacgccgggtcag

SEQ ID NO: 2987 - DNA, 459 bp, Streptomyces avermitilis
  CDS (1)..(459)
atggcgaatctggaggacctggtcaggttgcggaaggcgcgcgaccggatggaccgcgagtacgccgagcagctggacatagcggcgctcgcgcggacggcgctgatgtcgccgggccacttccagcgcagcttccgggcggccttcggcgagacgccgtacagctatctgatgacgcggcggatcgagcgggcgaaggcgctgctgcggcggggcgacctgacggtgacggaggtctgtctggccgtggggtgcacctcgctgggctcgttcagttcgcgcttcacggagctggtgggcgagacgccgagcgcgtaccgggcgcggtcgcacgaacacggggcacccatcccgccgtgcgtggcgaagggcctcacccgcccgagacggggccgccccgtgtacgggcgggcagatacggcaggcgggacatggacgacagggcctagcgtgacctca

SEQ ID NO: 2988 - DNA, 432 bp, Streptomyces avermitilis
  CDS (1)..(432)
atgaacatggacaccgatccgggcgtgatgctctcgcagtgcttcatcgccgtcgacgaccacgacaaggcactcgcgttctaccgtgacgtcctcggcctggaggtccgcaacgacgtgggcttcgagggcatgcgctgggtgacggtcggctcgccgctccagccggacgtggagatcgtcctggagccgccgggggcgaacccggacgcgtccgaagcggaccggcaggcgatggccgagctgctggccaagggcatgctgcggggggtcatcttctcgacgccggactgcgacgccctgttcgcccgcgtcgaggcgtccggcgccgaggtcctgcaagagcccatggaccagccgtacggcgtgcgcgactgcgccttccgcgatccggcgggcaacctcctgcgcttcaagcagcgctccgccgcc

SEQ ID NO: 2989 - DNA, 768 bp, Streptomyces avermitilis
  CDS (1)..(768)
atggcccccgtccggcccggcagggagcgatccatgagtgaaccgatccgttgggcgtacgccttcgtcgaccggcccgcggcggagttcgtccgggccgttgacttctggaccgccgtcacggcgaccgagcggtccgaatcccgcggcgaccagggcgagttcgtgtcgctgctgccgggggcgggcgacgcgtgcgtgaaggcgcagggggtgcgggacggtaccgggggcgcccacctcgacctcgccgtcgcaaacgtgccggcgctcgtcggggcggcgcggcggctcggcgccgaggtcgtcgccgagcatccggggtgggccgtactgcgctcccccggcggccagttgttctgcgcggtcccctggcacggcgagtcggcgcggccgcccgtcgtcgagggcagccgcctcgaccagctgtgcatcgacctcgccccggcggtgtacgacctcgacgtcgcgttctggagcgacctcaccggctggacctcccaccccggcgccctcccggagttccacctggtcaggccgcccgaggggctgccgatccgtattctcctccagcgcctgggcaccgatcgccccacctccgcccacctcgacctcgcctgcgcggacatcgaggcgacacgggtccggcacgaggagctgggcgccacgctcgtcgcccgcggcgcccggtggacggtgctgcgcgaccccgcgggcggaacgtactgcctgacggcccgcgacccggaaacgggcagcctgccggcc

SEQ ID NO: 2990 - DNA, 345 bp, Streptomyces avermitilis
  CDS (1)..(345)
atgtccgaaccccttctgcaccttaccgagcgctccctgtgggacgccgcccgcgaccgtggcacgtacgagatggcgacgcgcggccgcaccctccaggaggagggcttcattcactgctcgctgcggcatcagctccccggcgtggcagcgctcctgtacggatcccgcgccgggtccgacgagctggtggtgctggtcgtggacgcggagcggctcgcggcgcccgtgcggtacgaggccgtggggcccggcggcgaggagttcccgcacgtctacgggccgattccggtgtcggccgtcgtggacgtggaggtctggacgggcggcgaagcggcttcggcg

SEQ ID NO: 2991 - DNA, 213 bp, Streptomyces avermitilis
  CDS (1)..(213)
atgggcagcgatgagtatgcgtgtccctcgtgcggacagcctgtcggcacggtcgtgcggcgccacaagacgctcggcgccttcgtccccgtgtggggacccgccccgtgccggaatccccggtgcacggcgtacgtacccggaggcggggcggcggcggaacgccctgggccgcccgaagcgccaccagaagcgccggccgcgaaggcgcca

SEQ ID NO: 2992 - DNA, 588 bp, Streptomyces avermitilis
  CDS (1)..(588)
atgggcgtggcgatccggacggcgggcgagggcgatcgcgaggcggtcgtccggcttctggacgaggccttccagcacgacccggtgagcagctgggtcttccccggcgaggcgtaccgccgggccacgcaccaccggctgatggcggccttcaccgacatcgtgctcggcgaggggcgcgtcgacctcaccgaggacggcaccgcgtgcgcgctgtggctgtccctgcccgccgacgcgcacgacgaggaggacggcccggcccggctgcgggaggccgtcgacccggacaacgaccgtgtcgagctgatcggccggctgacgagcgggatccatccgtcgggccgggcccacgcgtacctgtggatgatcgccgtggcccccggccgccagggcgagggcctcggcacggcgctcatgcagcccgtcctcgaccgctgcgaccgcgcgggcctgcccgcctatctggaggccagcagcgcccgcagccgcaagctctacgaacgcctcggcttcgtctccacgacccccgcgctcgacctgccggacggcccgcggatgtggccgatgtggcgggagccccggagc

SEQ ID NO: 2993 - DNA, 1182 bp, Streptomyces avermitilis
  CDS (1)..(1182)
atgggtgagttcctgacggaggcgaagcagagcccggccgaggtgctcgaaaggcggagccccgcgggccccgccggccggcgaggcccgctcccggctccgtccaccgggcggcaggcgccggccgcgagtccgcccaccgatccgcagggcccggcggcccagctcgacgggcaggaagccgcggggatcctggagcgtgcccgggcctcggtcgaccccgagctgcgccgggccgtcgactcgctgccggggtccatgcgccggatcgcgctccaccacttcggctgggagcacgcggacggcaccccggcggcaggcaacgcgggcaaggcgatccgccccgcgctcgtgctggccgcggtccgggcgctcggcggaccgcagtcctccgccgttcgggccgccgcggcggtggagctgatccacaacttcaccctgctgcacgacgacgtcatggaccgggacaccacccgcaggcaccgccccaccgcgtggaccgtgttcggcgacgccgacgcgatcctcgccggggacgcacttcaggccctggcccaccggctgctcgccgaggacccgcacccggcgtccgcggcggccgccgcccggctcgcggcctgtgtcatcgaactgtgcgcggggcagcacgcggacacggcgatggagcggcgcggcccgggtgaggtcaccctcgacgagtgcctcgccatggccgaggccaagacgggcgcgctgctcggctgcgcctgtgcgctgggggcgttgtacgcgggggcggaggaggaggacgtcgaggcgctggacgcgttcggccgggaggccgggctcgccttccagctcatcgacgacgtgatcgggatctggggggacccgagccgaaccggcaagccggccggggcggacctgatggcccgcaagaagtccctgcccgtggtggccgcgctcgccgcgggcactccggcggcggcggaactcgccgagctgtacgcggttccgcaccaggaaggggagctggagcgcacggtcctggccgtcgagcgggccggcggccgcgactgggcccagcagcaggccgccgaccggatggcccgggcgatgcacgagctgtcccgggcgattccggacccggaggcggcgggcggcctgctcgccctcgccgagttcgtgacccggcgcagcaac

SEQ ID NO: 2994 - DNA, 1404 bp, Streptomyces avermitilis
  CDS (1)..(1404)
atgtcggtaggcgaagaggtccgcgcggagcagggcaggccccagcagagtctcggcacatcggccgcgcggaacctggccacgaccaccaagtccgcaccccagatgcaggagatcagctcacgttggctgctgcgcatgctgccgtgggtgaacgtgcagggtggcacgtaccgagtaaaccgccggctcagttactccgtgggcgacggccgtgtcaccttcgtgaagaccggtgaccgtgtgcaggtcattcccgcggagctcggcgaactgacgctgctgcggacgtacgaggaccaggaggtgctcggcgagctcgcccagcgctgcgagcagcgggagttcgcaccgggggaggtgctcgcctcgttcggcagccgggccgacgaggtctttttgctcgcgcacggcaaggtcgagaaggtgggcacgggcccgtacggcgacgacgcggtactcggagtcctcgccgacggcgcgtacttcggcgagcaggcgctgatcgacccggaggccatctgggagtacacggcacgcgcggtcaccgcctgcaccgtgctcaccctgccccgccgggacgtcgaccaggtcgccgagcgcgccgagtccctgcgcgaccacctccagcaggcccgcgcgatccccgagcagcgcaccaacaagtacggcgagaaggagatcgaccttgcggcaggccacaccggagagccggacatccccggaaccttcgtggactacgaggccacgccgcgcgagtacgaactgagcatcgcccagaccgtgctgcgcctgcacacgcgcgtggccgacctctacaaccagcccatgaaccagaccgagcagcaactcaggctcaccgtcgaggcgttgaaggagcgccaggagcacgaactcatcaacaacagggagttcgggctgctcaacaactgcgagtacgaccagcggctccagccgcacgacggtgtgccaggccccgacgacctggacgaactcctcagccgcaggcgcggatccaagctgttcctcgcccacccgcgcgcgatctccgcgttcggccgcgagtgcaaccggcgcgggctcgtccccgagagcgtcgagatcgcgggcaaccgcatccccacctggcgcggggtgccgatcttcccgtgcaacaagatcccggtcagcgacacccgtaccacctcgatcatctgcatgcgtacgggcgaggacgagcagggcgtcgtcggactccagcaggcgggcatcccggacgagatcgagccgagcctgtcggtgcgcttcatgggcatcaacgagcaggcgatcatctcctacctggtcacggcctactactcggccgcggtgctcgtgcccgacgccctcggcatcctggagaacgtcgagatcggccgctggcgg

SEQ ID NO: 2995 - DNA, 675 bp, Streptomyces avermitilis
  CDS (1)..(675)
gtgggccgcccagtcgcgttccgggtacaagcctcggtacgaggcggtcgcgacgggcggccgtcgcgcagcgctaaggaggcggtcatggccccacccatgtccgcgggcagtttcctggaccggctcagagaggaaggcgtcaccgtcgtcgaggtcggcgactgggagcatcacaaccgcaatcacaagggcccctgggggccggtccacggtgtgatgatccatcacaccgtcacctcgggcagcgaacacaccgtcgagctctgccgcgacggctacgaggggctgccggggccgctgtgccacggggtcatcaccaaggacggcgtcgtccacctggtcggctacggccgcgccaaccacgcgggtctgggcgacgacgacgtgctgcgcgccgtgatcgccgagaaggccctcccgccggacaacgaggcgaacaccgacggcaaccgccacttctacggcttcgagtgcgagaacctgggcgacggcacggacccctggccggacgcccagctggaggcgatcgagaaggtctcggccgccatctgccgccatcacggctggtcggagcgctcggtcatcggccatctggagtggcagccgggcaaggtggacccgagaggcttcacgatgacctggctgcgggagcggatccgcgaccgtctgaag

SEQ ID NO: 2996 - DNA, 933 bp, Streptomyces avermitilis
  CDS (1)..(933)
gtgtccgacaatggtggggtgaccggccccgacgtccccgaagcgctcgacctcgccgccctgcgaccgcgcctgccgtcgccggtgcaggcggtcgacgacgagcgcttcgcacggcacggggtccggctcctgctcaagcgggacgacctgatccacccggacctcatcggcaacaagtggcgcaagctcgcgccgaacctccgggccgcggcgggccgcccgctcgtcaccttcggcggtgcgtactcgaaccacctgcgagcgacggccgccgcgggccgcctcctggggctggccacgatcggcgtggtccgcggccaggagctggccgaccgtccgctgaacccctccctcacccggtgcgcggccgacggcatgcggctgcacttcgtggaccggtcgacgtaccgccgcaagaccgaaccggggacgctggccgcgatcctgcgcgcggtggccgccgaggacgcgtacgtcgtgcccgaaggcggcagcaactcccctgccgtacgcggctgccgcgccctcggcgaggagctgcgcgggcacgccgacgtcgtcgccctcgcctgcggcaccggcggcacgctcgcgggcctggccgccggcctcggccccggccagcgggcgctgggcgtcccggtcctcaagggcgacttcctgaccgccgaggtcaccgcgctccaggagcgggcgttcggcggccgccagggcgcctggtccctggacgaccgcttccacttcggcggctacgcccgtacctctcccggcctccacgcgttcgcggcggacttcgagcggcgacacggactgccggtggaacgtctctatgtcgccaagatgctgtacggacttgtcgccctggccgaagagggcgggttcgcccgcggcacgaccgtcgcggccgtcatcaccggacggccgctcggc

SEQ ID NO: 2997 - DNA, 1599 bp, Streptomyces avermitilis
  CDS (1)..(1599)
atggacgtattgccactgctgttgctggtcgcgggcagcgccgcggtcgccggagccgcacgccgtacgcccgtacccgcaccgctgctgctcgtcgctgcgggcctgatcgcctcgtacatccccggggtgcccgagtacaccctcgacccggaggtggtgcttccgctggtgctgcctccgctgctgtacacggccgccagcgacagctcgtacctcgatctgcgcgcgcaactgcgaccggtggcgctgctgtccatcggctacgtcctcttcgcgaccctggtcgtgggctgggccgcgtatctgctcgtgccgggcctgccgctgcccgcggcgctggtgctcggcgcggtggtcgcgccgccggacgcggtcgcggcgacggcggtggcgcggcgggtggggctgccctcgcggatcaccacgatcctccagggcgagtccctggtgaacgacgcgaccgcgatcaccgcctacaaggtggccctcgccgccgcggtcggcgagggtgcgacctgggcgcacggggtgggcgagttcctgctggcggcggtcggcggcgtggcggtcgggctgctgctgatggtgccgctgcactggctgcgcacgcacctgaaggaggcgctgctgcagaacacgctctccctgctgatcccgttcgtcgcgtacgggctcgccgagtgggcgcacgcctccggagtgctcgccgttgtcgtcgtcgccctctacctcgggcatcgcaactacgaggtcgacttcgccacccggctccaggaggaggcggtgtggaagatggtcgcgttcgtcctggagtcggcggtgttcgcgctgatcggcctgcaactgcaggtcgtgctgaaggggctcggggagtaccggggcgtcgacgccgcctggtacgcggtggccgtcttcctggtggtggtcctcgcgcggttcgtgtgggtgtatccggcgaccttcctgccacgcctgctctccgcgcgcatccgggaacgcgaggagaaccccacctggaaggcgccgttcatcatcggctgggcgggcatgcggggcgtggtctcgctcgccatcgccttctcgatcccgctgaccgtccacgggcaagggaaaggtccctttcccggccgcaacctcatcctcttcctgaccttcacgaccgtgatcggcacgctggtcgtgcagggcctgaccctgcccccgctgatccgtctgctgagactcccggggcgcgacgcgcaggccgagacgctcgcggaggccaatgcccaggcccaggcctcccgggtcgccgagctgcggctgaacgacctcctcgacgacgagcgcaacgctctgccgccgcccctggccgaccggctccgtgacgtcctggaacggcggcgcaacgcggtctgggagcggctcggcgcggtgaacccggtgaccggggagtccgtcgacgacacctaccggcgcctgtcgcgcgagatgatcgccgccgaacgctcggtcttcgtgaggctgcgcaacggccgttacatcgacgacgagatgctgcgcacgctgctcagacgcctggacctggaggaggcggcggcctttcgggaggcgacc

SEQ ID NO: 2998 - DNA, 258 bp, Streptomyces avermitilis
  CDS (1)..(258)
atgaaacagtgcacgcacgccgacgcgctgccgcacccggagcccgaacctctgagcgaaacctgcccggagtgcctggccaccggcacgcacccggtgcaactacggctgtgtctggtgtgcggacacgtgggctgctgcgattcgtcgccgcggcgccacgcgacggagcaccacaaggaaaccgggcaccccgtgatgcgaaccttcgagcccggcgaaagctggcgctggtgcttcgtcgatcatgtcctcgtg

SEQ ID NO: 2999 - DNA, 411 bp, Streptomyces avermitilis
  CDS (1)..(411)
gtgtcccagatcgacggcgagcccgcgacccaggacttcgtggaagtccggctgccggccgcgggtgcctacctgtcggtgctgcgtacggccacagccggtctcgcggcccgtttggacttcaccctcgacgagatcgaggacctgcgcatcgcggtcgacgaggcctgcgcgatcctgctccagcaggccgtgccgggctcggtgctcagctgcgtcttccggcttgtcgacgactcgctcgaggtcacggtctccgctccgaccacggacggtcacgccccgtcgcgcgacaccttcgcctggaccgttctgtcggccctcgcgggcaaggtctcctccgcggtcgccgacgacaagactgtgtccatcagcctctacaaacagcgcggcgcgggacccgggccggcg

SEQ ID NO: 3000 - DNA, 1173 bp, Streptomyces avermitilis
  CDS (1)..(1173)
gtgaggaacggggacgggccggtgcaggacgaagagcgcggcacacgggaacttcccaccgaggacgggggtgccccctgctcgatcggagccgacagcctggggggcggcggccccagcgggccgcggcgcacggcggacggcatcgacggcatccccgagcaggcccggccgcaccccgaggaccactcctcggcggcggccgagggttctcagcagcaagagccgttcggcgagggcgggcgcgcggcgcgctccgtcccggtcgacgggcgacgggatccagcgggtgcccgcggggaggctctgcggacggagtccggtggagcgtcctcgaaagggcggcgcgtgacgggcgggacgatgagcgagcacgagcgaaacgctgagccgagtgtgccgagcggcacacagcacgacccccaggaccgcagcggggcgcgcgccctgttcatcgagctgcgcatgctgcccgacggcagcccggagtacgcggagctgcgcaaccggctggtccgtatgcatctgccgctcgtggagcacctcgcgcgccgcttccgcaaccgcggcgagccgctggacgacctcacccaggtcgccaccatcggtctcatcaagtcggtcgaccgcttcgacccggagcgcggcgtcgagttctcgacgtacgcgaccccgaccgtagtcggcgagatcaagcggcacttccgcgacaagggctgggcggtccgtgtgccgcgccgactccaggagctgcgcctcgccctgacgacggccacggcggagctgtcccagcagcacggccgctcgccgacggtgcacgagctggccgagaagctggccatctcggaggaggaggtcctggagggcctggagtccgcgaacgcgtactccacgctgtccctggacgtccccgacacggacgacgagtccccggcggtcgcggacacgctgggcgcggaggacgaggcgctggagggcgtcgagtaccgggagtcgctcaagccgctgctcgaggacctcccgccgcgggagaagcggatcctgctgctgcgtttcttcggcaacatgacgcagtcgcagatcgcgcaggaggtcggcatctcacagatgcacgtctcgcgtctgctggcccgcaccctggcccagctgcgggagaagctgctcgtcgaggag

SEQ ID NO: 3001 - DNA, 471 bp, Streptomyces avermitilis
  CDS (1)..(471)
gtggccgacggctaccctgcaggggtgagtgctgagcagaaccgcgtcccggacacctccgacgccgagccccgtcccgggcggctgaccgccgcggcggcgctggccgcgctggaggggctcgcgctggccgcgggcggtgtctggatgctcgtacgaggcgtcacgggtgacccggacgaccggcagcaggccgtcaccggcggcatcacgctgctcgtgctcgcgctgctgcccctgctggcggcgcgcgggctgctgctgcggcgcggctggagccggggcccggcgatcatcacccagatcatggcgctgcccgtggcctacagcctgctccaggccgacagcatcgccatccccgcgggaatcgcgctcgcggccgtcgcggtcacggctctggtgctgctcgtgaacccggccacgacccgggcgctcggtatccggaggcccgggaacgtgcaggacgagaag

SEQ ID NO: 3002 - DNA, 966 bp, Streptomyces avermitilis
  CDS (1)..(966)
atgcgtgcacttctcgtggtcaatccggcggcaaccaccacaagcgcacgtacccgtgacgtcttgatccacgctctggcgagcgagatgaaactcgaggcggtcaccaccgagtaccgcggacacgcccgggacctcggccggcaggcggcggacagcgaggacatcgagctggtcgtggcgctcggcggcgacggcacggtcaacgaggtcgtgaacggcctgctgcaccgcggccccgatccggagcacctcccccgcctcgccgtggtccccggcggctccaccaacgtcttcgcacgcgccctcggcctgcccaacgacgccgtggaggccaccggcgccctgctcgacgcgctgcgcgagaagcgtgagcgcaccgtcggcctcggcctggccgccggcaccccgggcacggaggacgaggcggtcccgtcccgctggttcaccttcaacgcgggtctcggcttcgacgcgggtgtggtcggccgggtcgaacaacaccgcgagcgcggcaggcgctccacgcacagcctgtatttgcgccaggccatacgccagtttttggacgaacctcaccgcaggcacggaacgatcacgctggagcgacccggcgcggccccggtcacggatctggtcctgtccctcatctgcaacacctcaccctggacgtttctcggcaatcgtccggtgtacgcgtcacctaaggcctcgttcgataccgggctcgacatactcggcctcagccgcatgtcgacggcctcggttgcccggtatgcgacccagttgctcacttcgtcccccgagcgcggaccccatggcaaacacgccgtatcgctgcacgacctgaccgacttcaccttgcattcgaaggcgcccctacccctccagatggacggcgaccacctcgggctccgtacgagcgtgacgttcacaggcgtacgccgtgcactgcgtgtgattgtg

SEQ ID NO: 3003 - DNA, 255 bp, Streptomyces avermitilis
  CDS (1)..(255)
atggactggcgtcacaacgccgtttgccgcgaggaagaccccgagctcttcttccccatcggcaacaccggtcctgcgctgctgcagatcgaggaagccaaggccgtctgccgccgctgccccgtcatggagcagtgcctgcagtgggcgctcgagtccggccaggactcgggtgtctggggtggcctcagcgaggacgagcgtcgcgccatgaagcgccgcgccgcccgcaaccgggcccgtcaggccaccgcc

SEQ ID NO: 3004 - DNA, 1503 bp, Streptomyces avermitilis
  CDS (1)..(1503)
atgtccgaacccccgggtacgctcgcagatgtgccctccatgaacgaactcgtacgccagcacacggccctcgacgactccgacctcgagtggttgcacatgctggtctcggagtggcagctgctctccgacctctccttcgccgacctcgtcctctgggtccccacacgcgacggcacccgctatgtgtccgtcgcccagatgcgccccaacaccggccccacctcgtaccaggacgacatggtcggccacctcgtcccgcgcggccgccgacccctgctggacgcggctctggacgagggccggatcgtgcgcgagggcgaccccgagtggcgcgaagaggtccccgtacgggtcgagtccattcccgtccgcagggaagggcgcgtcctcggtgtgatcgcccgcaacaccaacctcctgacggtgcgcaccccgagccggctggagctgacgtacctccagagcgcctccgacctcgcccagatgatcgcggcgggctccttcccgttccccgaccagcaggtcgacatggacgcctcgccgcgggtcggcgacggactgatccggctcgacggggacggcatcgtccagtacgcctcaccgaacgcgctgtcggcgtaccaccgcctcggcctcgccgccgacctcgtcggccaccacctgggcaagaccagcgccgagctcgccccgtcccggggaccggtggacgaggcgctggccaaggtcgcgagcggctgggcgccccgcgagttcgagatcgagggcgaggacggggtcatccagctgcgcgcgatcccgctcaagcccaagggcacccgcatcggttcgctcgtgctgctccgggacgtcacggaactgcggcgccgcgagcgggagttgataacgaaggacgcgaccatccgggagatccaccaccgggtgaagaacaacctccagacggtcgcggcccttctgcggctccaggcccggcgcatcgactccgacagcggccgcgaagccctggaggaggccgtgcgccgggtcggttcgatcgcgatcgtgcacgagacgctctcgcagaacctggacgagcgggtggagttcgacgagatcgccgaccgcgtgctcgccatggtcgccgagatctcgccgggcaaggtgacggggcggcgcagcggccgcttcggaatcctggacgccgaggtcgccaccccgctgtcgatggtcctcaccgaagtcctccagaacgcgctggagcacggcttccgcgagggcgaccgcggcacggtcgaggtctcggcggtccgcggcggcaccacgaaggaggcgcgcctcctggtcaccgtccaggacgacggcgtcggcctgcccgagggcttcgacccgcaccgctcgggcaacctgggcctgcagatcgtacggaccctggtggagggcgagttgggcggcaccttcgacatggtcccggccccggagcgcggtacgcaggtgatcctcgacatccccgtacgggcgcacaag

SEQ ID NO: 3005 - DNA, 783 bp, Streptomyces avermitilis
  CDS (1)..(783)
gtggaagttgtcatcgtcccggacgccagggcgggcggcgagctcatcgccgaggccatggctcagctgctcggacgcaagcccgaggccctgctcggcgtggccaccggctcgaccccgctgcccatctacgaggcgctggccgcccaggtgaagtccggtgcggtggacgcctcgcgggcgcggatcgcccagctcgacgaatacgtggggctgccggccgagcatcccgagtcgtaccggtcggtgctgcggcgggaggtgctcgaaccactcgggctcggtatggacgcgttcatggggccggacggcacggccgaggacgtacagggtgcgtgcgaggcgtacgacaaggcgctcgccgcggccggcggggtcgatctccagctgctcgggatcgggaccgacgggcacatcgggttcaacgagccgtgctcctcgctcgcctcgcgcacgcggatcaagacgctgaccgagcagacccgggtcgacaacgcgaggttcttcgacggcgacatcgagcaggtgccgcaccacgtgatcacgcagggcatcggcacgatcctggaggcgcgccacctggtgctgctggcgacgggcgagggcaaggcggacgcggtggcggcgaccgtggagggacccgtggccgccgtgtgccccgcgtcggcgcttcagctccacccgcacgcgaccgtcgtcgtggacgacgcggccgcctccaagctgaagctggcggactacttccggcacacctacgccggtaagcccgactggcaggggatc

SEQ ID NO: 3006 - DNA, 1602 bp, Streptomyces avermitilis
  CDS (1)..(1602)
atgacgacactcgccagtggtaccgacaccctgacgcgcgacgccctcaccgtcctccagcccggcttcaccgggaccagcgctccggactggctgctgcgccgcctgggcgaaggcctcgcctcggtcggactgttcggccggaacatcgcctcgcccgcgcaactgggccggctgaccgcccagttgcgcgcggaacgcgacgacgtcctggtggcgatcgacgaggagggcggcgacgtcacgcgcctggaggtgcggacgggatcctccttcccgggcaatcacgcgctgggcgccgtggacgacgtcgcgctgacccgggaggtggccttcgaactcggccgccggctcgcggaatgcggcgtcaatctcaactgggcgccctccgcggacgtgaactccaaccccggcaaccccgtcatcggcgtccgctccttcggcgccgacacggacctggtggcccggcacacggccgcctacgtcaccggcctccaggcggcgggcgtcgccgcctgcaccaaacacttccccggccacggagacacggcggtcgactcccaccacgcgctgccgcgcatcgacgtggacgcatcggtcctgcacgcgcgggagctggcgcccttccgggccgccatcgccgccggttcacgcgcggtgatgagcgcgcacatcctggtccccgccctcgacccggaccgccccgccaccctgtcccgccgcgtcctcaccggcctgctccgcgaggagctgggctaccagggcctcatcgtcacggacggcatggagatgcaggccatcgcgggaacgtacggcatcgaacggggcagcgtcctcgccatcgcggccggtgcggacgcgatctgcgtgggtggcggcctcgcggacgacgagacggtacgccgactgcgcgacgccctggtctcggcggtgcgctcgggcgaactggccgaggaacgcctggcggacgcggcggaacgggtacgggcactggcccggtggacggcttcggcgtcggtttcagctcaggcgtcggcggcagcttcgggttcggctccggaagcggcttcggatgcggcttcggctccggggggagtgtccaccggcatgggggccggcgccggtcccggttccggcgccggacatgacatcgggctggtcgccgcccggcgcgcgctcacggtgacgtgctccgaggcgtacgagccggtgggtgaacctcccttcgtcgccgtcctcaccccggtggcgaacatcgcggtcggtgacgagaccccgtggggcgtggccgcggagctggcgcgtctgctgcccggtacggagacgggcagcttcgccggcggggagggcgggaacggcgaggacacagcacccgccgcgctgaccgccgcgggcgaccggcgcatcgtggccgtcgtccgcgacgaacaccgccatgcctggatggcctcggccctcgacgccctgctcgccgcccggcccgacacgatcgtggtcgagatgggcgtcccccaggccacgccccgcggcgccctccacatcgcgacgcacggcgcggcacgggtctgcggccgggcggcggcggagatcatcgcgggccac

SEQ ID NO: 3007 - DNA, 840 bp, Streptomyces avermitilis
  CDS (1)..(840)
atgagcgccatcgccgtttcggggcgtcgcaggtcaaggctcggctggaacctgctcggcctgctcgtcttcgtcaccgcgggcttccccgtctactggatgctcaacacggcgttcaagcccgcgaaggacgccatcgacccggaccccagcctgctgcccacgagcccgaccctggacaacttccaccgggccctcgacatcgccgacttctggggcccggtcggccgcagtctgatcgtgtccctgtccgtcgtcgtgatcggcgtcgtggtcggcatgctcgcggcactggcgatctcccgcttcgccttccgcggccggaagatcgtgatcgtgggcatcctggcggtccagatggtccccctggtcgccatgatcatcccggtcttcctcctcctgaacgacctgggccagtacgacaagctcacgggcctgatcctcacgtacctgaccttcatcctccccttcacggtgtggacgctgcgcggcttcatcgtcaacatcccgaaggagctggaggaggcggccatggtcgacgggtgctcccgcacgggcgccttcatccgcgtggtcttccccctcctcgcccccggcatggtcgccacctcggtctacggcttcatccaggcctggaacgagtacctctacgccctgatgctgatgagccaggagaaccagaccgccaccgtctggctcggcaacttcaccaccaagcacggcaccgagtacgccccgatgatggccggttccacgctgatggccgtgccgatcgtcgtgctcttcctcctcgttcagcgcaagatggccgcgggcctcaccgcgggcgccgtgaaggga

SEQ ID NO: 3008 - DNA, 987 bp, Streptomyces avermitilis
  CDS (1)..(987)
atgagtgccgcagacacgaccacccccgccaaggtgccgccacctcggcaggcacccccgccacccgccgtcccacggaagccgggcagaacgcggacctcgaaggacaccgccgtcccctgggccctgctggcgccctgcctgctgatcctcgcgctggtcctcggctatccgctcgtgcgcctggtcaccctctccttccagaagttcggccaatcccagctctggggcttccagccgcccgagtccgtcggcttcgacaacttctccctggtgctcggtgacggcgagttctgggcggtcgtcgtccgcacgatcgtcttcgcgggcggctcggtcgtcttcaccatggtcgtcggcatgctgatcgcactgctgctccagcgggtctccggctgggtgaagacgctcgtcaacatcgtgctcgtggccagctggggcatgccgatcatcgtggccaccacggtcttcaagtggctcttcgactccgactacggcgtcttcaacgcgctgctcagcaagctcccgggcgtcgacctcatcggccacaactggttcgccagcggtccgcagggcctcgccgtgatcatgctgctggtggtctggggcgccgtgccgttcgtcgtcatcaccctcagcgcgggcctcacccaggtgcctgctgagctggaggaagcggcccgcctcgacggagcgggcgcgtggggcgtcttccgctatgtcacgctccccatcctcaagccgatcatcgtgatgctcacgaccctctcggtcatctgggacatgggcgtcttcccgcaggtcttcgtgatgcgcggcggccaccccgaggccgagttccagctgctcaccacctactcgtacgacaaggcgttcgtggtcaacgactacgggcagggctcggcgatcgcgctgctcaccgtgctgttgctgctcggcgtcgtcgccgtctacatgcgccagatgctgaagatcggagaggtcgaa

SEQ ID NO: 3009 - DNA, 1317 bp, Streptomyces avermitilis
  CDS (1)..(1317)
gtgggcaggggggtttgtggcatccctgaggagggtggcgtgaagcgcaagctgatagccgcgatcggtatcgcgggcatgatggtctccatcgcggcgtgcggggacaacaagtccggggggtcggacaagggcgcggacgccaaggagctcaccgtctggctgacggtggacgcgcagaacaactggccggcgctggtcaaggccgccgacgccgcggtgcagaagaagcaccccggcatcaagatcaagcacgagtactacggctggccggacaagaacaccaagctcgacgcggtcctcgccaccgacaaggcccccgacgtggtcgagatgggcaacaccgagatgctcggttacatggtcaagggtgccttcgcccccgtcgacgcgtcgaagttcgacaactccgccgcctggctggacggcctcaaggcctcggtcacctacgacggcaagacctacggcgtcccgtactacgccggcggccgggtcgccaactggcgcaaggacgtcgccgcttcggtcggtgtgaagacacccccgaagacctacaaggagctcaccgccgccctgggcaagatccagaagaagcagggcagcaagttcagcgcctggtaccagcccacccgcgactggtacgccgcgatgtccttcgtgtacgacgccggcggctccatcgcggtcgagtcgggcggccagtggaagggcaacctctcctcgcccgagtcggtcaagggcctcacggagttcaagaaggtcgtcgacacgtacatgcacggcgacaagaccaaggacgagtccgaccgttacatcgtgtacggccagggcaagtccgccatgatcttcggcgccgcctgggagggcgcgacctccgaggacccgaagaacgacaagaccggcaagctcaagggcaacctcgagaacttcgtgatgcccggcccgtccggcaagaacatccccgtcttcctcggcggctccgacctcgcgatcccggtgaagtcgaaggcgcagggcgtcgccgccgagtggatcaacgcgctcaccggcgccaagggccagaagggcctgatggccaagggcaacctgcccaacaacaagaccgacctcgcgacgctgaagaacgacccggcgaccgaggtcccggccaccgcggccgagtccaactggttcgtcccgatggcgccgggctggggccaggtcgagaaggcccaggtcctgcagaagatgctgcagaacatcggcaccggcaagaagtcggtcgaggccgccgcgaaggaagcggacgccgcgatcgacaaggtcatcaacaccaag

SEQ ID NO: 3010 - DNA, 762 bp, Streptomyces avermitilis
  CDS (1)..(762)
atgagcaccgacgtcagcagtgcggagaacgagggcggggcacccatccgtaccgcgcgtgtgcccaagtactaccgcctgaagaagcacctgctcgacatgacggagacgctgccgcccggcacacccgtgccgcccgagcgcacgctggccgccgagttcgacacctcccgcacgaccgtccgccaggccctccaggagctggtcgtcgagggccgcctggagcgcatccagggcaagggcacgttcgtcgccaagccgaaggtctcccaggcgctgcaactcacctcgtacaccgaggacatgcgcgcccagggtctcgaaccgacctcgcagctcctggacatcggctacatcaccgcggacgacaccctcgccgggctgctcgacatcaccgcgggcggccgcgtgctgcgcatcgagcggctgcgcctggccagcggcgagccgatggccatcgagacgacccatctgtccgccaagcgcttccccgcgctgcgcaggtcgctggtcaagtacacgtcgctctacaccgcgctcgccgaggtctacgacgtccgtctcgccgaggccgaggagaccatcgagacctcgctggccaccccgcgcgaggccggactgctgggcaccgacgtcggcctgcccatgctgatgctctcgcggcactcgctggacaaggacggccggccggtggagtgggtgcggtcggtgtaccgcggggaccgctacaagttcgtggcgagactcaagcgcccccaggac

SEQ ID NO: 3011 - DNA, 252 bp, Streptomyces avermitilis
  CDS (1)..(252)
atgtccgaaacgcctgaagtgaaaccaccggtggtgacaccggtccgggtggtcatcgccctctgtctgatcgccccgttcgtggcgatgctgtgggtcggttcctacgcgaaggtcgacccgaccttcataggcatccccttcttctactggtaccagatgctgtgggtgctcatctccacggcgctcaccatgaccgcgtaccagctgtggcagcgcgaccagcgcgcccgcaagggaggtgaggggcag

SEQ ID NO: 3012 - DNA, 1614 bp, Streptomyces avermitilis
  CDS (1)..(1614)
gtgaacggagtcgccctcggcgtcttcgtcttcttcttcctggccgtcaccgtgctgggcttcctggcggcacggtggcgcaaggccgagaacgagcacagcctggacgaatggggtctgggcggccggtcgttcggcacctgggtcacctggttcctgctcggcggcgacctctacacggcgtacaccttcgtcgccgtaccggcggcgatctacgcggcgggcgcggcgggcttcttcgcggtgccgtacacgatcctcgtctacccgctgatcttcaccttcctgccccgcctctggtcggtgtcgcacaagcacggatatgtgacgacgtccgacttcgtgcgcggccggttcggctcgaagggcctgtccctggcggtggcggtcaccggcatcctggcgaccatgccgtacatcgcgctccagctggtcggcatccaggccgtcctcgacgtcatgggcgtgggcggcggcgagggcaccaactggttcgtcaaggacctgccgctgctgatcgccttcggcgtcctggccgcgtacacgtactcctcggggctgcgcgcccccgccctcatcgcgttcgtgaaggacgggctgatctatctcgtcatcgcggtcgcgatcatctacatcccgatcaagctgggcggcttcgacgacatcttcgccaaggcgggcgaggcgttctcccagaccaacccggcgaccggcaaaccgcgcggggcgctcgcaccggccgaggcgggccagtggacgtacgcgacgctggcgctgggctccgccctggcgctgttcatgtacccgcactcgatcacggcgacgctgtcctcgcgcagccgtgacgtgatccgccgcaacaccacgatcctgccgctctactccctgatgctgggcctgctcgcgctgctcggcttcatggccatcgcggccggcatcaaggtccagaacgggcagctggccatcccgcagctgttcgagacgatgttcccggactggttcgcgggcgtcgccttcgcggcgatcggcatcggcgcgctggtcccggcggcgatcatgtcgatcgcggccgcgaacctcttcacccgcaacatctacaaggacttcatcaagccggacgcgaccccggcgcaggagaccaaggtctccaagctcgtgtcgctgctggtgaaggtgggcgcgctggtcttcgtcctgacgatggacaagacggtggcgatcaacttccagctgctcggcggcatctggatcctgcagaccttcccggccctggtcggcgggctgttcacccgctggttccaccgctgggcgctgctcgcgggctgggcggtcggcatggtgtacggcacgctggccgcgtacggcgtcgcgtccccgacccagaagcacttcggcggcagctcgaaggagatcccggggatcggggagatcggctacatcggcctgacggcgttcgtgctgaacgtggtggtcaccgtggtcctcaccttcgccctgaaggccctcaaggcccccgacggcatcgacgagacctcgccggaggactacacggcggacgccggcgacccgggcgtcgaggtggaactgccgccggccacggcgggcgccacgcac

SEQ ID NO: 3013 - DNA, 2379 bp, Streptomyces avermitilis
  CDS (1)..(2379)
gtgaccatcgcgccagccgatccggcttcagtgacaacgtcggtgacatcggcggagacggacggtcccggtaccgcgctgctgcggaccctgaccgacctcaccgccgacctccccgacgccgaccccggccgggtcgccgccgccgctctgcgcggccggtccgcccgggcggacgaagcggagctgcgcgagctggccaccgaggcggccgcgggtctcatctccgaggaccccgcgtactcgcggctggccgcccggctgctgaccatcagcatcgccgaggaggccgcctcacagggcgtcacgtcgttctccgcgtcgatcacggtcgggcaccgcgagggccttgtcgccgaccgcaccgccgacttcgtacggctgcacaccgctcgcctggacgcgctgatcgacaccggcgccgacgaccgcttcggctacttcgggctgcgcaccctgcacagccgctatctgctgcggcacccgatcacccggcgcgtgatcgagaccccgcagcacttcatgctcagggtcgcctccggcctcgccgaggacgacacctcgcacgccgtcgacgaagtggccgccctgtacgggctgatgagccgcctggactacctcccctcctcccccacgctcttcaactccggtacgcggcacccgcagatgtcgtcctgctacctcctcgactccccgctggacgagctggactccatctacgaccgctaccaccaggtggcccggctctccaagcacgcgggcggcatcggcctctcgtacagccggatccgctcgcggggctccctgatccgcggcacgaacgggcactccaacggcatcgtcccgttcctgaagaccctcgacgcctcggtcgccgcggtgaaccagggcggccggcgcaagggcgcggccgcggtctacctggagacctggcactccgacatcgaggagttcctggagctgcgcgacaacaccggtgaggacgcccggcgtacgcacaacctgaacctggcgcactggatcccggacgagttcatgcgccgggtcaacgagaacggcgtctggtcgctgttctccccggccgacgtgcccgagctggtcgacctgtggggcgacgagttcgacgccgcgtaccgcaaggccgaggaggcgggcctcgccaagaagaccatcccggcccgcgacctgtacggccgcatgatgcgcaccctcgcgcagaccggcaacggctggatgaccttcaaggacgccgccaaccgcaccgccaaccagacggcggagccgggccacgtcgtccactcctcgaacctgtgcaccgagatcctggaggtcacggacgacggggagacggcggtctgcaacctcggttcggtgaacctgggcgcgttcgtggtcggccgggacatcgactgggagcgcctcgacgccaccgtccgcaccgccgtgaccttcctcgaccgggtcgtcgacatcaacttctacccgaccgagcaggccggccgctccaacgccaggtggcgtccggtgggcctgggcgcgatgggcctccaggacgtcttcttcaagctgcggctgcccttcgactcgcccgaggcccaggcgctctccacgcgcatcgccgagcgcatcatgctcgccgcgtacgaggcgtccgccgacctcgccgagcgcaacggaccgctgcccgcctgggagaagacccgtaccgcccgtggcgtgctgcaccccgaccacttcgacgtcgagctgacctggcccgagcgctgggcggccctgcgggaacgcatcgccgccgtgggcatgcgcaactccctcctgctcgccatcgcccccaccgccaccatcgcgtccatcgcgggtgtctacgagtgcatcgagccgcaggtctccaacctgttcaagcgcgagacgctgtccggcgagttcctccaggtcaactcctacctggtggacgaactgaagcagctcggcgtgtgggacgcgcagacccgggaggcgctgcgcgagtcgggtggctcggtgcagggcttcacctgggtcccgcaggacgtccgcgatctgtaccgcacggcgtgggagatcccgcagcgcgggctcatcgacatggccgcggcccggaccccgttcctggaccaggcccagtcgctgaacctgttcctggagacgccgaccatcggcaagctctcctcgatgtacgcgtacgcctggaagtcgggcctgaagacgacgtactacctgcgctcccgcccggcgacccgcatcgcccgcgccgcccaggcccaggcacagcccgagaagaccatccccgtccagcaggtgtccgagcccgacgccgtcgcctgctcccttgagaaccccgagtcctgcgaggcctgccag

SEQ ID NO: 3014 - DNA, 1014 bp, Streptomyces avermitilis
  CDS (1)..(1014)
gtgatgtccagcgaaaccaagaacctgctcgacccgggcttcgaactcaccctgcgccccatgcgctacccggacttctacgagcgctaccgggacgcgatcaagaacacctggaccgtcgaggaggtcgacctccactcggacgtcgccgacctcgcgaagctgacgcctgccgagcagcacctgatcggccgcctggtcgcgttcttcgcgacgggcgactcgatcgtcgcgaacaacctggtgctgacgctgtacaagcacatcaactcccccgaggcgcggctctacctgagccgtcagctcttcgaggaagccgtgcacgttcagttctatctgacgctgctcgacacctatctgcccgaccccgaggacaggacggcggccttcgcggccgtcgagaacatcccgtccatccgtgagaaggccgagttctgcttcaagtggatcaacgaggtcgagaagctcgaccggctggagacgaaggccgaccgccgccgtttcctgctcaacctgatctgcttcgccgcgtgcatcgagggcctcttcttctacggcgccttcgcgtacgtctactggttccgcagccggggtctgctgcacggtctcgccaccggcaccaactgggtgttccgtgacgagacgatgcacatgtccttcgcgttcgaggtggtcgacaccgtccgcaaggaggagccggagctcttcgacgacgagcttcagcagcaggtcaccgacatgctgcgggaggccgtcgaggcggagctccagttcgggcgcgacctgtgcggcgacggcctgccgggcatgaacaccgagtcgatgcggcagtacctggagtgcgtcgccgaccagcgcctccagcgcctcggcttcgcgccggtgtacggctccgagaacccgttctccttcatggagctccagggcgtccaggagctgaccaacttcttcgagcggcgcgcgtccgcgtaccaggtcgcggtggagggcacggtcgacctcgacgaggacttc

SEQ ID NO: 3015 - DNA, 507 bp, Streptomyces avermitilis
  CDS (1)..(507)
gtgagtggatcctggtgcacgggtgacacgtccaagcggcaaggaggccacgccatgcgccgaacgacccaccaccggacgatcgccctcgcgacactgacgctcgtcctcgcgggctgcggcacgcagaacggaagcggcccgggcggcagcggcaccgtgtccccgtccccctcgacgaccggcgaaggctgtacggcacagacggagctgagcgccgccgacagcggccgtacggtctgtgtgccgacgggcggtgtgatccgcctcagcctggacggcacccgcgacaggccctggcagcccgtcgccgtcagtggcggcggtctcgaagccaccaacagcggcatcgtcctccagccgggcgacgccgtctccgccttcagggcggtctcggccgggaaggcacggctcacctcgtcccgcccgctgtgcgtcaccgacccggccagggcgtcgtgcaagggccttcaggagtggacggtgacggtggtggtgacgaaggcc

SEQ ID NO: 3016 - DNA, 228 bp, Streptomyces avermitilis
  CDS (1)..(228)
gtgatcggcgcgacagtggtgtccatgaacgcactcatggacaacctcgccggaatactgaccgtcctcgtcatcttcgtggtgctggccctccccgcactgatcggcctcgcccacgaaaggcggatcgaccgtcagctcagggaggcggccggccgctcccaccgggaggccggtccgccgcagcggcctcaggccttcgtcaccaccaccgtcaccgtccactcc

SEQ ID NO: 3017 - DNA, 978 bp, Streptomyces avermitilis
  CDS (1)..(978)
atgctcaccaacgtggtcgccgtcctgctcgacggcgtgcatcccttcgaactcggcgtcgtctgcgaggtgttcggcatcgaccgcagcgacgagggcctgcccgtgtacgagttcgcggtcgcgtccgccgagggcccgaccctgcgcacgcacgcggggttctcgctgcgcacggagcacggcctggaacggctggagacggccgacctcatcaccctgcccgccgggaactcctatgtctcccgcggctatccacccgaactgctcgacgccctgcgccgcgcggtcgaccgcggtgcccggctgctcagcgtctgttccggcgtcttcgtgctgggcgcggccgggctcctcgacgggcggcgctgcgccgtgcactggcaccacgcggacgaactcgcccggcagtacccgaaggcgatcgtcgagccggacgtgctgtacgtcgacgaggaccccgtcatcacctcggccggtacggccgccgggatcgacgcctgcctccacatcgtccgcaaggagcagggccccgaggtcgccaacgccatcgcccgccgcatggtggtgccgccgcaccgcgacggcggccaggcccagtacatcgagcggccgctgccccgctccccctgcgacacggtcggcgaggtgctggtgtggatggagcagcacctcgacgaggaggtcaccgtcgaacagctggcggcccgcgcgcacatgtccccgcgcaccttcgcccgccgcttccagcaggagacgggcacgactccgtaccgctggatcctgcgccaacgtgtgctgctggcccagcggttgctggaggtgacggacgagacgatggacgcgatcgcgggccggaccggattcgggaccgcggccgccctgcgccatcagttcgtccggtcgctggggacgaccccgaacgcgtaccggcgtacgttccggggaccggccacggggccgctcggtctcgccggg

SEQ ID NO: 3018 - DNA, 1368 bp, Streptomyces avermitilis
  CDS (1)..(1368)
atgaccctcgaatcggtgaaacccgaagcaccggaggcaccacagctgcgcaacccgcccctcgccgggggcggcatcccgggcctcggccacggctggaaactggcgcgcgaccccctgggcttcctggcccagctgcgcgaccacggcgacatagtccggctcaaactgggccccaagacgatgtacgcggtcaccacgccggcgctcaccggggagctcgcgctgagccccgactacgagatcggcggacccctgtgggagtccctcgaagggctgctcggcaagcacggggtcgccaccgccaacgggccgacgcaccggcgtcagcggcggacgatccagcccgcgttccggctcgacatcatccccgagtacgggccgatcatggaggaggaggcgcgggcgttcgcggcgcgctggcagccgggggagatcatcgactgcacatcggagtcgttccgggtcgccgtgcgcatcgcggcccgttgtctgctgcgcggccattacatggacgagcgggcggagcggctgagcatcgcgctcacgacggtgttccggggcatgtaccggcgcatggtgatcccggccgggccgctctatcggctgccgcttccggccaaccgcaaattcgaccgcgcactggccgatttgcatcttctggtggacgagatcgtcgccgagcgccgggcatccggtcaaaagccggacgatttgctgacggcattgctggaggcgaaggacgacaatggcgaccccatcacggaacaggagatccacgaccaagtcgtcgccatactcacccccggcagtgaaaccatcgcatccacgatcatgtggctcctgcaagtcctcacggaacacccggaacatgcggccaaggtgtgtgcggaggtcgaatccgtcacgggtgaccggaccgttgcattcgacgacgtccggaagctttcgcacacgaacaatgtggtcgtggaggcgatgcggctgcgccccgccgtatggatattgacgcggcgggcggtgaccgaaaccgaactcggcgggtatcgcattccggccggtgccgacatcgtgtacagcccgtacgcgatccagcgcgacccccgctcgtacgcggagcacctggagttcgaccccgaccgctggcttccggagcgctccaaggacctcccgaagtacgcgatgcgcccgttcagcctgggcaaccgcaagtgcccgagtgaccacttctcgatggcccagctcaccctcatcacggcgacggtggccgccaagtggcgcttcgagcaggtgtccgagtcgagcgacgcgacgcgcgtcggcatcacgctgcgcccccaccggctgctgctgaaggccataccgcgc

SEQ ID NO: 3019 - DNA, 1089 bp, Streptomyces avermitilis
  CDS (1)..(1089)
ttgttcgtgcctgctttcccacacagcacttcaccgacaacgaccgtgatcgcggttccaccggcgctctctctaccggtgatcgagacggattttccccgtcaactgcatccgtattggccccggcttcaggagaagacccgatcctggctgctggaaaagcgcctcatgccggcggacaaggtcgaggaatatgccgacggactgtgctacacggacctcatggcgggctactacatcggcgcccccgacgaggtcctccaggcgatagcggactacagcgcgtggttcttcgtctgggacgaccgccacgaccgggacgtcatccaccgtcgggccaccgcctggcggcagctccggttccagctgcacacggcactcgactccccccgggatcatctgcaccaccgggatcccctggtggccgggttcgcggacagtatggtgcggctgtactcgttcctcggcaagaagtggaacgcgcggttcgcgtgccacttccacgcggtgatcgaggcgtacgaccgggagttccacaaccgcacccggggcatcgtccccaccgtcgaggagtacctcgaactgcggcggctcaccttcgcgcaccggatctggaccgacctgctggagccgagtgcgcgccacgaaattccggccggcgtgcgggaacaccccggatatcggcgggccgcgctgctgagccaggaattcgccgcctggtacaacgacctgtgttcacttcccaaggaaatcgcgggtgacgaggtccataatctcggcatcagtctcattcatcacgagggactgacactcgaagaagccgtcacagaagtccggcgacgagtggaggaatgcattgcggaattcctcgtcgccgaaaaggaggcggtgcacctcgccgacggcctcgccgacggaacccgggcgggccatgaattgagcgacgccgtgaaggcgtgcgtcgccaatatgcggaactggttcagcaccgtgtactggttccaccacgagtccggccggtaccgggtcgacagctgggacgaccgctcgacacccccgtacgtcaacaacgaagcggcaggtgagaaa

SEQ ID NO: 3020 - DNA, 648 bp, Streptomyces avermitilis
  CDS (1)..(648)
atggcgcagcaggacaccgatcagcagcacaccggggtgctccccgtggacgacgacggcttcgtcatcgacgccgaggactgcgaggagcgcgaggcggcctaccgcgagcgcggcacctcgcgaccgatcacggtcgtcggcaaccccgtgctgcacaaggagtgcaaggacgtcaccgacttcggcgccgagctggagcagctggtggccgacatgttcgccagccagcgcaccgccgagggcgtgggcttggccgccaaccagatcggcgtcgacctgaaggtcttcgtctacgactgccaggacgacgagggcacccggcacgtcggtgtggtctgcaaccccaagctcgtcgacctgcccgccgaccggcgccgcctggacgacagcaacgagggctgcctctccgtgcccaccgcgtacgcgccgctcgcccgccccgactacgccgaggtcaccggtcaggacgagaagggcaacccgatcaaggtgcggggcaccggctacttcgcgcgctgcctccagcacgagacggaccacctgtacggctacctgtacatcgaccggctctccaagcgcgaacgcaaggacgccctgcggcagatggccgagaacgagccccgctaccccgtggtcgcgaacgac

SEQ ID NO: 3021 - DNA, 978 bp, Streptomyces avermitilis
  CDS (1)..(978)
gtgaggatcttcggcaagggacggcaccggccctccgcctcatggcggcaggccaccgaccgggcgttcacactgatcggcgacggccggtacgaggacgcgggcgcgctgctgacgcgtgcggccgacctggagccgtggctgtcggagtcctggttcaacctggccctgctgcacaagttccggcacgactgggagcaggcgcgggcggccgggctcagggccgtggcgctcctcgaccgcgagaccggcgcacctgactggtggaacgtcgggatcgccgcgaccgccctccaggactggccgctggcccgccgtgcctggcaggcgtacgggctgcgggtgccgggcggcgccaccgcctccggcgaacccgtcgggatggacctgggcagtgcggccgtacgcctgtcgcccgagggcgaggccgaggtcgtctgggggcggaggctggatccggcgcgcatcgaggtgctgtcgattccgctgccctcctccgggcggcgctggggcgaggtcgtcctgcacgacggggtgccgcacggggagcggacgaccgccgccgggcacgcgtaccccgtgttcgacgagatcgagctgtgggcgccgtcgcccgtgccgacctgggtggtgctgctggaagcggccaccgaggacgaccgggacgcactggagcagctcgcggccgacgcgggcttcgccgccgaggactggtcctcgtccgtgcggctgctgtgccgtatgtgctccgagtcccggatgccgtccgacgagggcgacggcgagcacctcgacccgcacgaccacagcgaaccggggcacccgggccccctcggccaccgcaccgacgggcagctgtgggtgcccgagcgggagtgcggcatcgcggcgcccgccgccctcgtgcgcggcctgctcgacggctgggtcgccgacagcccggactcgcgcggctggcgggatctcgaagaggtctgc

SEQ ID NO: 3022 - DNA, 1326 bp, Streptomyces avermitilis
  CDS (1)..(1326)
gtgagcgggccggagaggtccgaggggtccgaggggccggagaggcaggggctgccagggcagcggcagacgtacgttccgggggccgtccggggacggcctgcccgggttctcgtcctcgcccacgggggcgccctgctgctgggcgccgcggcccttgccgacaccctctggcacggggtcgaccggcccggtgacgccctcgccttcgggctgctcgtcgccgtgggggagctggcccgctggagcggggccggagaacgggcgtcggcgccgctcggcgcggccggggcgctcgcctacgcactgctcggggagaacgccgggcacccgacccatcacggcgccctccaggtcgtcgccgtcgtcgtcgccgcggccctcctcggctgtgtcccccacgtggcccggggcggccccaccgccgaccacctcacccgccgcgtcctcaccgtcggattcgccgccctctgcttccaacccctctacgagcggggccggttgcacgagtggggcggccccgcccacgccctgctcctcgtcgccctgctgctgctcaccgctctgtgcgacgcgctgctcgccgcggtcatggcacactcccgcacccgctggccgttcggccccctgctccgcgacgagctgcgcgccatgctcggcatcggctccgccgtgtgcgcgaccggggccgtgatgtcgctcgccgtcgccgtcgtgggtctctgggccctgcccgtcttctccctgccgctcctcctcacccagttctccttccggcgctacgcggccgtccgggtcacatacacgcagacgatcgcctccctcgcacgcgcgaccgagatcgcgggctgcacccccgccggccacgcccggcgcgtggccgtgctcagccgggcggtcgggcgggagctcgggttgtccgggccggaactgaccgtgctggagtacgcggccctgatgcacgacatcggccagctgagcctggtcgatccggtgcccgccggggccaccgccgtgctctccgccgacgagcagcggcgcatcgcgctcctcggcggtgccgtcgtgcggcagaccggggtgaacgccgaggtggcggtggtggtggagcggcaggccgacccgtaccgggagcagccggtgagtgccaggatcgtacgggccgtgaacgcgtacgaggagatggttcgggcagcaggtcccggagggccgctcacggccttggagaaactgcggctgggcaccgcccgcgactatcagccggaggtcgtggaatccctggccagagtgctgtcgagagacggtctgaccttgccttcggctggg

SEQ ID NO: 3023 - DNA, 1437 bp, Streptomyces avermitilis
  CDS (1)..(1437)
atgggggctgtgcgggccatggggtcggttccggcacggggacgcgtgtacgtcctctgcaccgccgtcgccgccctggcctgcctcgctccggcggcgaccgtccgcgttccgtggtgggtggtcgcgctgctcgccgggctctacgccggctgcgagcagatcacgtttccccgcgtccggcccggtcgcggggaggtgagcggcggcaccggaggggacggctcccggccggccggccgccgggtgcccgccggtatgggcaccctcttccccgtcctgctcgccggggcctttctgctgccgccgtcggccgccgcactggtgccgctgcccggggccctgctcgcccgggtcgagcggcgaccgcggtggctgcgccggatctggcacgcggcccagctggccctctgcacctgggcggcgtcccgggcacacggggcgctgggcgggcgggccgcggtcgcctcccccgacttcccgtacgcgctcgtgcccgccggggccgccgtgctggcgttctgcgccgtgctgaccgcgctcgacggggggatcctggccctggccgagcgggtgcccgtgcgcggtgcctggcggggcctgttcccgcgctccctcgcacccgtcgccgtgcacggccttgccgggctgatgatggcggtgctgtggcgcagtccgtacggtccggtggccgcgctgctcgtgctgctgccgatgtacgtgtcctgctgggtgttcgcgcagtaccaccgggagcgggccgcccatcaggccacgatccgcgcgctggtgcaggccgtcgacatcaaggacgggtacacccgcggacacagcgagcgggtcggccaggcgtcgatgatgatcgcgcgcgagctgggcatggacgacgagcgcgccgaggtgctgcgcttcgccgggatcctgcacgacgtgggcaaactcggggtgcccacgcggctgctgcgcaaggacgggccgttgacgcccgaggagcggcggatcatcgagctgcatcccgagtacgggcacgagatggtgcgcgggatcgggttcctgggggaggcgcggtccgcgatcctgcatcaccatgagcggctggacggaagcgggtatccgtacgggttgaccggggcccagatcccggagttcgcccgggtggtggccgtggcggacgccttcgacgcgatgacgtcgacgcggtcgtaccggcgggcgcggccggtggccgcggcgctggaggagctggagcggtgtgcgggggcgcagttcgatccggtgatggtgggggcgttggtgcgggcgttggggcggcaggggtggcatccggcggtgaccgcggacgagaacgtaccgccaggcgtctgcccacccgccccacctgtttccagccgactggaaagccggagccaccgaaacggcgtcggcgggggcggggcg

SEQ ID NO: 3024 - DNA, 309 bp, Streptomyces avermitilis
  CDS (1)..(309)
atgagctgcggagagccgcacgagacggattgcagtgaggtcctcgaccatctctacgagttcctcgaccatgagatgccggactcggactgcaccaagttcgaggtgcatttcgaggagtgctctccgtgcctggagaagtacgggctcgagcaggccgtgaagaagctggtcaagcgctgctgcggccaggacgacgtgccgaccgacctgcgtgccaaggtcatgggccggatcgatctgatccgctccggacagacggtgcccgagcacgacgtgaccgccgccccggcgacaccccaggagtcg

SEQ ID NO: 3025 - DNA, 681 bp, Streptomyces avermitilis
  CDS (1)..(681)
gtgggtccggtcactgggaccgacgcagggaccgacaacggccaggcggagcagcccgagggccagggcacgagcacggagtcgaccgccgagcgcagcgcgcgcttcgagcgggatgcgctcgaattcctcgaccagatgtactcggccgccctgcgcatgacgcgcaacccggccgatgccgaggacctggtgcaggagacgtacgcgaaggcgtacgcgtccttccaccagttccgtgagggcaccaacctcaaggcgtggctgtaccgcatcctgacgaacaccttcatcaactcgtaccgcaagaagcagcgcgaaccccagcgcagcgcggccgaggagatcgaggactggcagctggcacgcgccgagtcgcacatgtcgaccggtctgcgctccgcggagtcgcaggcgctcgaccacctgcccgactcggacgtcaagtcagcgctgcaggcgatccccgaggaattccgcatcgccgtctatctcgcggatgtagagggctttgcgtacaaggagatcgcggacatcatggggacacccatcggtacggtgatgtcccggctgcaccggggccgccgtcaactgcgcggcatgctcgaggactacgcccgtgaccgcggactggtcccggccggcgccggagagtcgaacgaagcgaaaggctcgggctca

SEQ ID NO: 3026 - DNA, 633 bp, Streptomyces avermitilis
  CDS (1)..(633)
atggcggagatcaccgagctcatcgagaccgacgcgggtacggcgcgcatcacctggcacaaggcgaggaaggccagcctcgtgctcgccgtcagccatggggccggcggtggcatcgaggcgcgtgatcttcaggcgctcgcgcgggtgctgcccgggcacggggtgaccgtcgcgctcgtcgagcagccctggcgggtggccgggaagaaggtggcgcccgcgccgaagacgctggatgtggggtggcgggggctgtggccggcggtcgcgaaggccgggctgcccgtgatcgccggcgggcggagcgccggtgcccggggcgcctgccggaccgcgacggaactcggcgccgccgccgtcctcgccctcagcttcccgctgcacccgcccggcaagcccgagaagtcccgcgccgacgaactgctcggcgccggggtgcccacactcgtcgtgcagggcggcaacgacccgttcgggaagccggaggagttcccgaacggatcatacgaactggtcgaggtgccgtacggcgatcatggtttcgccgtccccaaacgggcgcccctcggccaggagcaggccctggcgatcatcacggaccgtgttgtggagtggaccgcgtcactcggg

SEQ ID NO: 3027 - DNA, 837 bp, Streptomyces avermitilis
  CDS (1)..(837)
atgtgcggacggtatgcagcgagtcgtgggcccgaggatctcgcaggagtctttgaggtcgagaagtgggagccggaggaaagcctggcgcccgatttcaatgtggccccgaccaaggacgtctacgccgtcctcgaccgccccctcaaggacgccgacaccgcgtccacgagttcctccgtcccgggccggccggttcgccagctgcgcaagctcaagtggggcctggtcccctcctggtccaagacgcccgagggcggcgcccggatgatcaacgcgcgcgcggagaccgtgcacgagaagccgtcgtaccggcgcgccttcgccgcccggcgctgcatcctgcccgccgacggttattacgagtgggtgaccggttcgcaggagcgcgagctggaggtcgagggcaggaagaagcgcccgcgcaagcagccgtacttcgtgctccccgccgacgggtcggtcttcgcgatggccggtatctacgagttctggcgggacaggaccctgcccgacgaccatccgggggcctggtgggtgacgtgctcggtgatcacgacggaggcggagaccagccccctggcggtggccccggccgaggggccgtacgcgctcgccgacatccacccgcgcatgcccctgatgctcaccccggaccgctgggacgcctggctggacccggcccgcacggacaccgacgacctccgcgagctgctcgccccaccgcctgccgggctgatgcgcgcgtaccccgtctccacggccgtcagcaatgtccgcaacaacgggccggagctgctcaaggagctggaggggcccgaagagggcacactcttc

SEQ ID NO: 3028 - DNA, 729 bp, Streptomyces avermitilis
  CDS (1)..(729)
atggacagcaccgcatcgacctcgctgagctcgttgaccgacctctgggaccaggtcttcggcagccagccggaccccgacctgtgggtcgtgatcgcgaccatggtcgccgcgctcgccgtgatcgtcccgcacaacgtctggcgcctctcccgcaacgcgatcaccatcgcgcacgagggcggccacggtctgatcgcgctgctgaccggccgcaccctcaccggcatacggctgcactccgacaccagcggcctcacggtcagccgcggcaagccgcacggcctgggcatgatcctgaccgcggccgcgggctacaccgctcccccgcttctcggcctcggcggcgccgcgctgctcgccgcgggccacatcaccgcgctgctgtggctggccaccgtcctgctgatagcgatgctggtgatgatccgcaacgcgtacggcgcgctgacggtgctgctgacgggcggcacgttcgtggtggtgtcctggctcgccggtccccaggtgcaggcggcgttcgcgtacgcggtggtgtggttcctgctgatcggcggcgtacgcccggccttcgaactccaggccaagcggtcgcgcggcaacgcgggcgactcggacgcggaccagctgtcccggctgacgcgggtgccggccggactgtggctgttcctgttccacgcggtgtccctgtgctcgctgatcggcggggggcgctggctgctggaggtc

SEQ ID NO: 3029 - DNA, 1338 bp, Streptomyces avermitilis
  CDS (1)..(1338)
atgaccgttaaccccgcacacaccgccctctggcccgccccgcacgcgagcggagccgtcgacgcgacggtccacgtgcccgggtcgaagtcggtcaccaaccgtgccctcgtcctcgccgccctcgcctccgagccgggttggctgcgccgcccgctgcgctcgcgcgacaccctgctgatggcggccgcgctgcgcgagatgggcgtcggtatcgaggaaacggtgtcctccagctcctccgtcgggggcggctcggacggctccggtgaggcctggcgtgtcatccccgccgcgctgcacggcccggccacggtcgacgtcggcaatgccggcaccgtgatgcgtttcctgcccccggtggccgcgctcgccgacggccccatccgcttcgacggcgacccgcgttcgtacgagcgcccgctgaacggtgtgatcgacgccctgcgcgccctcggcgcccgcatcgacgacgacggccgcggcgcgctgccgctgaccgtgcacggcggcggcgccctggacggcgggccggtcgccatcgacgcgtcctcctcgtcgcagttcgtgtcggcgctcctcctgtccggcccgcgcttcaaccagggcgtcgaggtccggcacaccggttcgaccctgccctcgatgccgcacatccgcatgaccgtcgacatgctgcgcgcggtcggcgcccaggtggacaccccggagtcgggcggcgaggcgaacgtgtggcgggtgacgccgggcgccctgctcggccgtgacctgaccgtcgagccggacctctccaacgcccagccgttcctggcggcggcgctggtgaccggcggcaaggtcgtcatccccgactggcccgagcgcaccacgcagcccggcgacaagctgcgtgagatcttcaccgaaatgggcggttcctgtgaactgaccgagcaagggctggagttcaccggttcgggtgccgtccacggcatcgacgtggacctgagcgaggtcggcgagctgaccccgggcatcgcggcggtcgcggccctcgcggactccccgtccaccctgcgcggtgtggctcacctccgcctgcacgagacggaccgtctggccgcgctcaccaaggagatcaacgagctgggcggcgacgtcaccgagaccgccgacggcctgtcgatccgcccgcgtcggctgcacggcgggatcttccacacgtacgacgaccaccgtatggccaccgcgggcgcgatcatcggtctcgcggtcgacggcgtacagatcgagaacgtggcgacaacggccaagacgctgccggacttccccgacctgtggaccgggatgctcgggaac

SEQ ID NO: 3030 - DNA, 1008 bp, Streptomyces avermitilis
  CDS (1)..(1008)
atgcgccgctacggcaagcacaccgacgaggacgacatccgcgcccgccccaaccgcaagggcaaccggccgcgttcgaacatccgcccaaagcacgaggacgcggcggagggcctcgtcatcaccgtcgaccggggccggctgacctgcctggtcgaggaccgggtcgtcctggccatgaaggcccgcgaactgggccgcaaggcggcagtggtcggcgaccgggtggcccttgtcggcgacctgtccggcaagaaggacaccctggcccgcatcgtccgcatcgagccgcgcacctccgtgctgcggcgcacggccgacgacgacgatccctacgagcgcgtggtcgtcgccaacgccgaccagctcgccatcgtcaccgccctcgcggacccggagccgcgcccgcggctgatcgaccgctgtctggtggccgcttacgacggcggcctcaccccgctcctcgtcctcaccaagtcggacctcgcctcccccgacgaactcctggagatgtacggggcgttgggtgtcccgtatgtcgtgaccagccgcgaggagctggagagcggcgaggcggtggaacgcgtgcgcaagcagctggacggcaagatcacggccttcgtcgggcactccggcgtgggcaagacgaccctggtcaacgcgctcgtgtcggtggagcggcggcgcagcaccggccatgtcaacgcggtcaccggacgtggccggcacaccacgacgtcggcgcgcgcggtccccctgccggacagtgcgggctgggtcgtcgacaccccgggcgtgcgctccttcggcctgcaccatgtggacccgtcccgtgtcatcaaggccttccccgacctcgaacccggcaccgagggctgtccgcgcgcgtgcagccacgacgagccggactgcgcgctggaccagtgggtgacggacggtcacgcggatccgcagcggctctactccctgcgcaggctgttggcaacgcgtgagcggacggaaggcgac

SEQ ID NO: 3031 - DNA, 321 bp, Streptomyces avermitilis
  CDS (1)..(321)
atggcgtggctgctggtcgttgtggccggactactggagaccggcttcgccgtctgtctgaagctctcgcacggcttcacccgactgtggcccacggtcgccttctgcgtcttcgcgctcggcagcttcggcctgctgaccctgtccctgcggaagctcgacgtgggacccgcctacgccgtctggaccggtatcggcgcggcgggcaccgcgatctacggcatggtgttcctcggtgacgtggtctccgtcctgaagctcgtgtcgatcagctttgtgatcatcggcgtgatcgggctccagctctcgggctcggcccac

SEQ ID NO: 3032 - DNA, 1785 bp, Streptomyces avermitilis
  CDS (1)..(1785)
gtgctcgaagtggcccgtctgaacgtggacttcgacgggcggcccgccgtccgcgacgtgagcctctcgctctcgcggggcgaagtcctcggcctggtcggtgagtcggggtccgggaagtcggccaccgcgctcgccgtcctcgggctgctgcccgacaacgcgaccgtccaagggtccgtacggctcgacgggcaggaactggtcggcgcgggcgaaagggagctgacccggatccgggggagccgcgtcgccatggtcttccaggacccgctctccgcgttcacaccggtccaccgcgtcggcgaccagatcgcggaggccgtacgggcccatcagggcgtgtcccgggagcgggcccgcgaacgcgccgccgaactgctcgacctcgtcggcatccccgcttcccgggtgcgggccttcccgcacgagttctccggcggcatgcgccagcgcgccatgatcgccatggcgatggcgaacgagccggacgtgatcctcgcggacgagccgaccaccgccctggacgtcaccatccaggcccaggtgctcgacgtgctgcgcacggcccagcgggagaccggcgccgctgtcctgctggtcagccacgacctgggggtgatcgccgggatggcggaccgggtggcggtcatgtacgagggggaggtggtcgagtcgggaacggccgtcgaggtgttcggacggccgcgggagccgtacacgcggaagctgctcggggccgtaccgcgtctcgacgacgcgcgcccgcgcgccgaactcccggacagcgaaccagtgttgagggtgcgcggactcaccaagacctttccccttctcaaagggagcgcgttcaagcggcgggtggggagtgtgtacgccgtcgacggcgtggacctcgacatccggcgcggggagaccctggcgctggtgggggagtccgggtccgggaagtcgacgacccttttcgagctgctcgaactcgccgctcccgagggcgggtcggtcgaactgttcgggcagcggctcgggagcctgcgcaaagccgagtcgaaggcgctgcgccgccgggtgcagatcgtcttccaggacccgatggcctccctcgacccgcgcatgccggtcggcgacatcatcgccgagccgttgcgcacccagggctttgaccgggccaccgccgcccggcgcgtccccgaactgctcacccgggtcgggctcgacccggcgcacgcggaacgcttcccgcacgagttctccggcggccagcggcagcgcatcggcatcgcgcgggcgctgtcggtcgagccggagctcctcgtgctcgacgaacccgtgtcggcgctcgacgtctccgtccaggccggggttctcgacctgctggaccggctgaaggcggagctggggctcgcctatctgttcgtctcgcacgatctgtccgtcgtccggcacatcgcggaccgggtgagcgtggtctacctcggccggaccgtcgagtcgggcccggtcgaggaggtcttcgaacggccccgccacccgtacacccaggccctgctgtccgccgtcccgctgcccgacccggagcgcgaacgggaacggcggcgcacgcggatcctgctcgccggggacccgcccagcccgacacagcggtacgacggctgccggttccgggcacgctgcccgctgtacgcctcactcgccgaggaggagcgcaagcggtgcgcccatgacgtgccggtcctcgacggggacggggcggcctgtcactttccgcgggtgcgcgaggtgatc

SEQ ID NO: 3033 - DNA, 906 bp, Streptomyces avermitilis
  CDS (1)..(906)
atgacgatcacccctgtggtcgagacggtcgaggcggccgtacgtccggtcgggcgcgggaccgtcgtcctgcgccgcttcgtacgcaatcggggcgcgctcgccggatccgtcgtcctcgtactgctgttcctgctggccttcgtcgggccgtacgtcaccccgtggtcgtacagccatatcgactacaccgcgttgcggtcggggccgagcgccgaccactggtgggggaccaaccggatcgggcaggacgtgttcgcgcagaccgtgcggggactgcagaagtcgttgctgatcgggctgttggtggcggtcttctcgaccgggctcgccgcattcgtcggcgcctgtgccgggtacttcgggggctggaccgaccgggcgctgatgttcttcgtcgacttgctgctggtcttcccgtcgttcctcatcatcgcggccgtctcaccgcggatgcccagcggcggctgggtcgtcctcgcgggactgctcgccgtcttcgggtggatgatcaccgcgcgggtggtccggtcgatgacactgtccctgaaggagcgcgaattcgtccgcgcggcacggttcatgggcgtcgggccgttccggatcatctggcggcacgtgctgccgaacgtcgcctccttcctgatcatcgacgcgaccatcgcggtcggcggggccgtgatgagcgagaccgccctgtcgtacttcgggttcggggtgcagacgccggacgtgtcgctcggcacgctgatcgcctcggggaccggggcggcggtgacgtacccctggatgttcttctacgcggccgggctgctggtggtcttcgtgctggcggtgaacctggtgggggacgggctgcgggacgcgctggacccgacctcccgcagcaggaaaggggcatcgcgg

SEQ ID NO: 3034 - DNA, 993 bp, Streptomyces avermitilis
  CDS (1)..(993)
atgcgtgacgtgcctgcctatctggccaagcggctcggctattacgccgtcctgctcctggccgccgtctgcctctcctatctgctggcctcgttcgcgctcgacccgcgcgcgtactacgagggccggcagccgcccgtctccgcgagcgcggtgaatcaccacctcaccgagatcggcgtcaacgaccacgcgtcgctgctcgcccgcttcctgcgctgggcggggcatgcggtccgcggagacctcggcaggacgatcgacggtacgagcgtcaacgcggagttcgggcggcgcatcggggtcagcctgcggctgctgctcgccggaaccgtgctcggcacggtcgcgggcgtgctgatcggagcctggacggcggtgcggcagtaccgcttcagcgaccggacggtcacgttcgcgtccttcgcactgctctccacccccgtgttcctgctggcgatccttctcaagaccggagcgatctggttcaaccggacgacagggacggatctgatccagttcacgggcgagaagagccccgggctgacgggcgggttcggggccgtactccaggaccgcgccgtacacctgctgctgcccaccctgtccgtcgccctcttcgcgatcgccggctacagccgctaccagcgcagcaccatgctcgacgtgctgggctccgactatctgcgcaccgcgcgggccaagggtctcggccgccgggcggtgctgctcaagcacgggctgcggacggcgctgatccccatgtcgacgtacttctcgtacggcttcctcgcgctcttcaccggtgccatcttcacggagacgatcttcggctggcacggcatgggagagtggttcatctcctcgatcggcaagaacgacgtcaactcggtcgtcgccgtcaatctcttcgcggcggtcaccgtgctgctgtccggcttcctcgcggacgtgctgcacgccgcgctcgacccgcgcatccggcaggcgtca

SEQ ID NO: 3035 - DNA, 1686 bp, Streptomyces avermitilis
  CDS (1)..(1686)
atgcgcagaacccccgccgcagccctggtcgccgccaccgcggccaccgcgttgctggtgaccggctgcggttcgtccgacgacgacaagccgcaggcgcagaagagcgccgccccggccggcagccagcagatcaacgcccacccgctcagcgacatccagcagggcggcaccctcaagttcgcgatctcccagtacatcgcggacttcaaccgctacaccgccaacggcaaccagggtgacgccgcgacgatcaacgagctggtcgagcccagcctcttcaccgccgacgcgcgcggcgcggtccggccgaacgagaacttcctgctctccgcctcggtgacctccaccagcccccaggtcgtcacctacaagctcaatcccaaggccaagtggtccgacggcgcgcccctgagctggcgcgacttccgtgccctgtggaaggccacgaacggcacgaacaaggagtacgaggccgccaacacctccggctacgaccagatcagcgcggtcgggcagggcaccgacgcccaccaggtcaaggtcaccttctcctcgccgtacgccgactggaagcggctcttcgacccactgctgcccgccgcggggatcgacaccccggccaagttcaacaagggctggaccgagaagatcccggtcaccggcgccgccttcaagatctccgcgtacgacaggaccgcccagaccatcacggcggtccccgacccccagtggtggggtacgaagcccaagctggactcgatcgtcttccgcgccctggacttcagcgcctggacggacgcgtacctcaacaaggagatcgactacgcctccgcgatcctccccgaggactacaagcgccttgccaaggccgccggcacggacatccgcaccggcgcccgctgggacgaggtgcacatcaccctgaacggcgcgcgcggcccgctgaaggacgtccgggtccgccaagccgtccagcacgccatcgaccgcaaggccatcgccaccgccttcggcaaggacctcccggtcgagctgaagacgtacggcagccacttcttcatgcccaaccaggccggctaccaggacaactccggtacgtacggcacgtacgacgtcgaggcggcgggcgaactcctcgacgcggccggctggaagaccaagggcgacacgcgcgtgaaggacggcaagcagctcgccctcacctacgcactcagcgcgggcagcacctccgcgcaggaggaccaggccgagctggtgcaggcgcagctcgcggccgtcgggatcaaagtgtcgatcaagaaggtgccgacgaacgactacttctccaagtacgtcaccatcggcaacttcgacctggtcagcttccgctgggtcgaccagatcttccgctccgaggcgtacccgatctaccgccagaccgccggcaagaacctgtacgagaactacggctcggtcggctccccggagatcgacaccctgctgaagaaggcgggtgagaccaccgacgccaccgagcaggccaagatctacaacgaggccgacacgaagatctgggccctcggccactccatcccgctctaccagcgcccccaggtcctcgccgtccgctcgaacctcgccaactacggcgcgggcggcctcgccgacgacgacttcaccaaggtcggctggctcaagaagaag

SEQ ID NO: 3036 - DNA, 630 bp, Streptomyces avermitilis
  CDS (1)..(630)
atgcctgcagcgcgggaatccctgctggacgccgcgtacacggcgctcgcgcgccgtccgtggtccgccgtgcgcatggtggacgtggccgccgtggccggggtgtcacggcagacgctgtacaacgagttcggcagcaaggagggcctggcgcgggcgctggtgcgcagggaggccgacgcctatctcgccggtgtcgagcgggcgctggccacgcacgccgacccgcgcgagcgcctcgccgcgaccgccgagtggaccacgtccgccgcccgtggcaacgccctcgtacgggccatgctcaccggctgctggagcgagcggctgccctcgccgacgctcacggcggtgccctcggcgtccgcggtgcccgcgcagcgccgggccgacggtgcgctgccctcgcccgccgacttcgtggcgctggtccgtgaccgtgccgtcgccgcgctcgccggacccggcaccaccaggtcggacgccttcgagctggcgcgctcctgcgaactcgtcgtccggctcgcgctgtcgtgcgtggcggcgccgcccggcgagggcggggtcccggacctggtgaaggccgcgctgaccccgtcccaccggctgggtgtccggacggtcacttcttct

SEQ ID NO: 3037 - DNA, 798 bp, Streptomyces avermitilis
  CDS (1)..(798)
atgcccgactatcgcgatgacctgcgcctcgcccatgtcctggcggatgccgccgacgccgcgacgatggaacggttcaaggcgctcgatctcaaggtagagaccaagccggacatgactccggtgagcgaggccgacaaggccgccgaggagctgatccgcggccacctccagcgggcgcggccgcgcgacgcgatcctcggcgaggagtacggcatcgagggcacgggcccgcgccgctgggtcgtcgacccgatcgacggcaccaagaactacgtacgcggcgtccccgtctgggcgaccctgatctccctgacggaggcgggcgagggcggctaccagccggtcgtcggcgtggtctccgcgcccgcgctcggccggcgctggtgggccgcgaagggccacggcgccttctccggccgcagtctgtcctcggcgtcccggctgcacgtctcgcgcgtctcgaagctgtccgacgcctcgttcgcgtactcgtcgctgagcggctgggaggaccagggccgcctggacggcttcctggatctcacgcgcgcggtgtggcgcacccggggatacggcgatttctggccgtacatgatggtcgccgagggctcgatcgacatctgcgcggagcccgagctgtcgctgtgggacatggcggcgaacgcgatcgtcgtgacggaggcgggcggctccttcacgggcctcgacggccgtccgggcccgcacagcggcaacgcggccgcgtcgaacggggtgctccacgacgagctgctggggtatctcaaccagcgctac

SEQ ID NO: 3038 - DNA, 390 bp, Streptomyces avermitilis
  CDS (1)..(390)
atgctcgtccgcgacgccatgagcacggtggtcctgaccatcggcccggcacacaccctccgccaggcggcccgcctgatgtccgcacgccgcgtcggtgcggccgtcgtcctcgacgaggactcctgcggagtcggcatcctgaccgagcgcgacatcctcaactcactggccctcggccagaacccggatgccgagaccgcaggcagccacaccaccaccgacgtcgtcttcgccgccccggcctggaccctggaggacgccgcgacggccatgtcgcacggcggtttccggcatctgatcgtgctcgacggaagcggtcccgtcgggatcgtctcggtccgcgacatcatccgctgctgggccccggcccggcagcacataccggcc

SEQ ID NO: 3039 - DNA, 1449 bp, Streptomyces avermitilis
  CDS (1)..(1449)
gtgacgcagggaccgctcacgacggaggccggtgcaccggtagccgacaatcagaacagcgagaccgcgggcgtcggcggcccggtgctcgtgcaggaccagctcctgctggagaagcttgcccacttcaaccgtgagcgcatcccggagcgcgtcgtgcacgcccgcggcgcggccgcgtacggcacgttcacgctgacccgtgacgtctcgcagtggacgcgcgccgcattcctctccgaggtcggcaagcagaccgagaccttcctgcgcttctccaccgtggccgggaacctgggttccgcggacgccgtccgtgacccgcgcggctgggcgctgaagttctacaccgaagagggcaactacgacctcgtcggcaacaacaccccggtgttcttcatcaaggacgccatcaagttccccgacttcatccacacccagaagcgcgacccgtacacgggctcgcaggaggcggacaacgtctgggacttctggggtctgtcgcccgagtccacccaccaggtgacctggctgttcggcgaccgcggcatccccgcgtcctaccgccacatgaacggctacggctcgcacacctaccagtggaacaacgaggccggcgaggtcttctgggtcaagtaccacttcaagaccgaccagggcatcaagaacctcacgaccgaggaggccgtgaacgtctccggtctcgacccggactcgcaccagcgcgacctgcgtgagtccatcgagcgcggtgacttcccgacctggaccgtgcaggtgcagatcatgccggcggccgaggcggccgggtaccgcttcaacccgttcgacctcaccaaggtgtggccgcacgaggactacccgccgatcgagatcggcaagctggagctcaaccgcaacccggagaacatcttcgccgaggtcgagcagtccatcttcagcccggcccacttcgttcccggcatcggtccctccccggacaagatgctccagggccgcctcttcgcgtacggcgacgcccaccgctaccgcgtcggcatcaacgccgaccacctgccggtgaaccgtccgcacgccaccgaggcgcgcaccaactcccgcgacggcttcctgtacgacggccgccacaagggcacgaagaactacgagccgaacagcttcggcggcccgttccagacggaccgcccgctgtggcagccgatctcggtcaccggcgtcacgggcgacacagaggccccggtccacaccgaggacaacgacttcgtgcaggcgggcaacctctaccgcctgatgtcggaggacgagaagacccgcctggtcgacaacctcgcgggcttcatctccaaggtctcgcgcgacgacatcgccgagcgcgcgatcaacaacttccgccaggcggacggcgacttcggcaagcggctggaggccgcggtccaggccctgcgcggc

SEQ ID NO: 3040 - DNA, 414 bp, Streptomyces avermitilis
  CDS (1)..(414)
atgagtgacctactggaacgactgcgcggccgcggatggcggatgaccgcgcagcgccgcgtcgtggccgaggtcctcgacggcgaccacgtccacctgacggccgacgaggtgcacgcccgcgccgtcgtgaagctgcccgagatctcccgggcgaccgtctacaacaccctgggtgagctggtctccctcggcgaggtgctggaggtcgccacggacaagcgcgccaagcgctacgacccgaacgcccaccgtccgcaccaccacctggtctgcgcccggtgcggcgcgatccgcgacgtccacccgagcggcaacccgctcgccgacctccccgactcggagcgcttcggcttcacggtctcggacgtcgaggtgacgtaccggggcgtgtgccccaactgcgcggccgcc

SEQ ID NO: 3041 - DNA, 1848 bp, Streptomyces avermitilis
  CDS (1)..(1848)
atggacgttatgggggacaaggcaactctgttggaaacagggcgttttgcgcagcctgccgactttgtgcagcctgccgacattgcgcagccttccgaccgggacgaaaccggcgaggctgcagaggaggcgcgccgtcggctcgccgccgaagcgggcgacgtggaggcgaagagcgtcctcggagccatgctgctgcgacgcggcgatctcgacggcgcggagccccagctgcgcgccgcgaccgccgccggtgaccgtgccgccgccaacaacctgggtgtcctcctgcatcagcgtggatacgccgaggaggcggccggctggtggcggatcgccgccgtcgccggttccgccgcggccgcgcacgcgctcgggcgccaccaccgcgagcgcggcgacgagcccgcagccgagtactggctgcgccagtccgccgagcagggccacgccctcggcgcgtacgcgctcgccgacctgctggagcaccgcaacgacgcccgcgcggagcagtggatgcgggccgcggccgagcgcgggcaccgcgaggccgcctaccggctggcgcgcgcgcttgatcgcaaggtcgcggacgcgggtgagccgggcgctgacaacggtgtcataggagcaggcggtgaagaggccgcgcagtggtaccggcaggccgccgcgcgcgggcaccggcgcgcggcgctgcatctcggggcgatcctggagaagcggggcgagctcaaggaggccgggcggtggtatctgacgtccgccaaggacggcgaggcgcgcgccgcatgcgccctcggcttcctgctgcgggacgcgggcgacagcgagagcgccgccgtgtggtggctgcgggccgcccaggacggcgacgggaacgcggcgaacgcgctcggcgccctgcacgccgagcgcggcgagacccagaccgccgagcggtggtaccgggccgcgatggacgcgggcgatgtgaacggcgcgtacaacctgggcctgctctgcgccgagcagggacggaccgcgcaggccgaccagtggtaccggcgtgcggcgtacgccggacaccgggaggcggccaacgcgctcgccatcctgctgctccaggtcggcgacgcggccggggccgagccctggttctccaaggccgcggaggcggggagcgtggacgccgcgttcaacctcggcatcctgcacgccgggcgcggcaccgaggaagacgatgcggcggcactgcgctggtacgagcgggcggctgccgccgggcacaccgaggcggcgctccaggtcggcatcgcgttgctgcgcgacggggacgagcaggcggcggagcggcaccttcggtgcgcggcgggcgggggcagtgccgaggccgcgtaccggctggcgtccgtgctggacgcgcgccggccgcccgcgcccgcgcacgagctgggcgagcccgcgcacgagaagaccgagtgcgaggagtggtacgagcgcgcggcgtcccaggggcaccggcgggcgcaggtgcgggtcgggatgctggcggcggcccgaggggacgtggtggaggcggcccggtggtaccgggaggcggcggaagcgggctcccggaacggggcgttcaatctggggctgctgctggcccgcgagggaagtgagccggaggccgcgctgtggtggacccgggcggccgatgccgggcatggacgggcggcgttgcggctggccctggtctacgcgcgtcgcggggagcttgtcgaggggcagcggtgggcggaccgagcggtgtctctgggacccgccgaggtctccgagcgtgccgcccggctacgggatgccttgcggcaggagctgtcggcc

SEQ ID NO: 3042 - DNA, 2994 bp, Streptomyces avermitilis
  CDS (1)..(2994)
atgccggaccgcggcggaggcccgacggggccacggatcagagtgggccgaccgtcccggcgggtccggaccctgctcatgacactgggcgttcttgccgttctcggcatggcgttcgtcatgtttgcggggttctggacggactggctctggtaccggtcggtcaagtactcgtccgtgttcacgaccaccctgtcgaccaagatcgggctcttcttcgtcttcggcctgctgatggcggtcgcggtcggcgtgaacatctggctggcgcaccggctgcgcccgccgctcagcgccatgtcgatggagcagcagagcctcgaccgctaccggatgggcatcgcgccgtacaagaagtggttgctgctcgggatcacttctctggtgggcctcatcgcgggtgcgtccgcctccagccagtggcggacctggctgatgtgggtcaacggggtgcccttccaccagaaggacccccagttccacctggacgtctccttctacgccttcgacctgccctggtaccgcttcctgctcggcttcggcttcgccgccgcggtgctgtccctgatcgccgccgctctcacgcactacctgtacggcgggctcagaatcacctctccgggcgcgcgcgccacggccgcggccaccgggcacctgtccgtgctgctcggcatcttcgtcgccctgaaggcggtcgcctactggctcgaccggtacgggctcgcggtgaagtccagcgacttcaaggcgaccggcaactggacgggcctcaggtacgtcgacgccaacgcctatctgccggccaagacgatcctgttctgcatcgccgtgatctgcgccctgttgttcttcgccaccctgtggcggcgcacctggcagctgcccgtcatcggattcggcctgatggtgctctcggcgatcctcatcggcgggctctacccggcgatcgtccagaagttccaggtccagccgaacgagcaggccaaggaagccccgtacgtcgagaagaacctcaaggcgacgcgtgaggcgtacggcatcgacggcgccaaggtcaccgagtacccgggcaagagcgacaccacggacaagacgaagctgcgcgacgacgccgacgccacggcgagcgtccgtctgctcgacccgaacgtcgtctcgcccacgttccagcagctccagcagatgcggaactactacgcgttcccgaccaacctggacgtcgaccgctacagcaaggacggcaaggaccaggacacggtcatcggtctgcgtgagctgaatctcaacggcattccgaagaacaactggatcaacgaccacttccgctacacgcacggattcggtgtggtcgccgcgaagggcaccaccgccgactccgagggccggccggtgttcaccgagtccgacctgccgtccaggggtgacctcaaggcgtaccagcagcggatctactacggcgagaagaccagccagtactcgatcgtcggcggtccccagaaggagatcgactactccgacgacagcggtgagaagaccaccagctaccagggcaagagcggggtcaacctctccagcccgatcaaccgggccgcgtacgcggtggcgttcagcgagccgcagatcctctactccggggcgatcggcgagggttcgcggatcctgtacaaccgcacgcccaaggagcgcgtcgaggcggtggcgccctggctgaccatcgacggggacgcctaccccgcggtcgtcgacaacaagatccagtggatcgtcgacgcgtacacgacgacgaacggatacccgtacgcctcccgtacgacgctgggtgacacgacggccgactcgctgaccgccaacaacaaccagcgcgcggtggtggcccagcagaaccaggtcaactacatccgcaactcggtgaaggcgaccgtcgacgcgtacacgggcaaggtcacgctcttcgagtgggacaccaaggacccggtcctgaagacatgggagaaggccttccccggcacggtgaagccgaagggcgacatcccgaagtccctgatagatcatctgcggtacccgcaggacctgttcaaggtccagcgcgagctgctcacccgctaccacgtgaaggacgcgcagacgttcctcagcggcagcgaggtgtggcaggtgccggacgacccgtccaacaagtcgggcaacgcggtgccgccgtactacctgagcatgaagatgcccgaccagcaggcgcagacgttctcgctgacgacgacgctcaccccgaacggccgggacaacctgagtgccttcatgtcggtcaacgccgaagcgggcacgagtgattacggcaagatcagaatcctgaaactgccgacgagcagaacagtcgacgggcccaaacaggtccagagccagttcaactccgaacaggacatcgccgagtccatcaggctgctgaagggcggcgactcggaggtcgagtacggcaatctgctgacggtgcccctcgacggcggactgctgtacgtggagcccgtgtacgtacgcggtggcggactcaagtacccgctgttgcgcaaggtgttggtgacctacggaggcaacaccgccttcgaggacacgctcgacgaggcgctcaacaaggtcttcggagcggattcgaccacgcagccaccggacgagggcaccacgaagccgccgacgtcgagcaaccccacggtccaagaggccctgaacgacgcccagaaggccttcgacgcgggccaggaggccctcaagaagcccgactggcaggcgtacgccaaggcgcagaaggatcttgaggatgccctgaagcgggcggaggacgcccaggccgaggcggacaaggccagcggcggcagcaagagcggtgacagcggcaagggcagtgggccgaccagcagcccgagcggcagtgccagtagcagtcccagtagcagtccgagcagcgacaagagcccgagcagcgacaagagccccggcagcgac

SEQ ID NO: 3043 - DNA, 546 bp, Streptomyces avermitilis
  CDS (1)..(546)
gtgaccatgtccaacactcccatggcagcgagcccgctcacccgggccgtactcgagatcgacgagtacgcctccaccctcggctgggaccagcccgctcgcctcttcgccctcgtagacaccgcgcggctgcgcactcaggaaccctcgctcgcggcccagctcggcctcgcggacgcgccggagaccaccggtctcacccccatcgagcaggacgagatcccggccggcaagccgctggacgagttcctcggcaccatcgcctggcccgacgcggtggtcggctgcgcgctcacggtggagcggctgatgctgccgccgtccgcggaggcctcggttccggaggggctgagcgagaagaagctcgcgaagtgggtcgccgagcacccggaccgccaggaggtccggatgacggtggcggtgctgcgggacggcgcgcgcgaatcggccctgcggctgcgcgagaaggactcgccgacggaggtgctgaccgggtcggacctggtgccgggtctggcggaggccctgtcggcgacgttcgcggac

SEQ ID NO: 3044 - DNA, 1095 bp, Streptomyces avermitilis
  CDS (1)..(1095)
atgccacgccgcaccgcgacgatgctcgcctccaccctgatgttgatcgcgctcctgtgcgcgggagtgttcatcaaagtgccctacgcggagatgtcaccgggcccgacggtgaacacgctcggggagcacgacggcgagccggtgctgcagatcaccgggcacaagacctatgcgacgaccgggcacctgaacatgacgaccgtccgggtgaccagcgccgactaccgcatgaacctcgtagaggccgtgtacggatggcttgcgcacgacaacaaggtggtcccgcacgacacgctctacccggacggcaagaccgaggagcagtcgacgcaggagaacgccgaggagttcagccagtcccaggagagcgccaaggtggccgccctcaaggagctggacatcccggtgaagtcctgggtgatcgtctccaccgtcctcaaggactcgccggccgagggccggctgcacgcgggtgacgtgatcaaggcggtcgacggtacggcggtgaaggcgcccgacgacgtggccgagctggtcaccaagcacaagcccggggacgacgtcgccttcacgatcctgcccgccaaggagcaggccgcggccgagaagtcgaagacgtacgtgcccaggaccaagaaggtgacgatcaccaccgcgaagtccgacgacacgggcgcgccccgggccatagtcggcatctccgccggcaccgatcacacgttcccgttcacggtcgacatcaagctcgccgacgtgggcggcccgagcgccggtctgatgttcgccctcggcatcgtggacaagctcaccccggacgatctcaccggcggcaagttcgtggccggcaccggcaccatcgacgacgacggcaaggtcggcccgatcggcggcatcgagatgaagacggtcggcgcgcgcgaaaagggcgcccagtacttcctgacgcccaaggacaactgcgcggccgccgccaaggacacccctgaggggctcacgctcgtcaaggtgaacacgatcgacgacgcgctggacgccctcaaggacatccgcaccggcaagacggccgacctgccgaagtgcaccaccaagggc

SEQ ID NO: 3045 - DNA, 162 bp, Streptomyces avermitilis
  CDS (1)..(162)
atggcggtgctcgcctggttgctgattccgcttttgactgcgatcggtgccggactgtggggcagctgggccggacggaaccgcaaggccgcgggagacggttcggaactcgccgggtacgcgcgtttccgcgaggccatggagaagtcccactcgggtacc

SEQ ID NO: 3046 - DNA, 459 bp, Streptomyces avermitilis
  CDS (1)..(459)
atggcatccatgaacgaccaccccggcgagcaggccgcccaggagcccgtcaagctgctggccatccgtgagacgccgctctccctcgacgaggtcttccgggccgtcggggacgacgcggccggtgggaccgcactgttcgtggggaccgtgcggaatcacgacgggggcgccgacgtcgacgagctggggtattcgtgtcaccccagcgccgaggccgagatgcggcgcgtcgccgagaaggtcgtcgccgagtacccggtgcgggccctggccgccgtccaccgcatcggtgatctgcgcgtgggtgatctcgccgtcgtcgtcgccgtgtcgtgcccccaccggggcgaggccttcgaggcctgccggaagttgatcgacgacctcaagcacgaggtgcccatctggaagcaccagaagttctccgacggcacggaggaatgggtcggcgcctgc

SEQ ID NO: 3047 - DNA, 1110 bp, Streptomyces avermitilis
  CDS (1)..(1110)
gtgagttccccagatccgcaggttcgcgcagcgcgaaaccattcaaccagtcccgccgtccgcgggcccgtcgtcgcggtcaccggcgccgcgtccggtgtcggcgccctcctgaccgagcggctcgccgcgtccgacgcgatcaagcaggtcgtcgccatcgacgagcggcgcggggagtgcgcgacggcacagtggcacatcctggacgtacgggatccggccatcgcggacaaactgcggggtgcggacgtcgtcgtgcacctcgcgctcgacctcgatctggagtccgacgcggcggcccggacggcgtacaacgtccgggggacgcagaccgtgctcacggctgccgcggcggccggcgtccaccgggtcgtgctgtgcacctccgcgatggtctacggggcgctgccggacaacgaactgccgctctccgaagacgccgaactgcgcgccacggccgaggccacgggcgtcggggacctgctggagatcgagcggctcgcgcggcgcgcgccccgggcgcacccggggctcaacgtcaccgtcgtacgcccctccgtgctggtcggtggcacggatacggcgctgaccaggtacttcgagtcgccccgtctgctggtggtggccggttcgcggcccgcctggcagttctgccacgtcgaggatctgtgcagtgctctggagtacgccgttctggagaaggtcgacggagagctcgccgtcggctgtgacgggtggctggagcaggaggaggtcgaggagctgagcgggatccggcggatggagctgccgtccgcggtcgctctgggcgccgcggcccggctgcaccggatcgggctcactccgtcgccggccggggacctggcgtacacgatgtacccctgggtggtgagcggaagccggctccatgacgccgggtggcggccgcagtggaccaacgaggaggtcctggcggagctgctggaggaagtggccgggcggcacacggtggccgggcggcggctcgggcgcaaggacgcgacggcggccggggccgcgggagcgacggtcgcgctgctgggcacggccgcgttggtgcgccgggcgcggaaggctcgacggcggttc

SEQ ID NO: 3048 - DNA, 1449 bp, Streptomyces avermitilis
  CDS (1)..(1449)
gtgagtgacaccccattcggattcggccttccgccggaggagccggagaacggcgacgagggcaagaagaaggaccagcagagcggcgggggtcagggaccggccaacccgttcggtttcgggtcgcccggagccggaggacccggcgccgacaatccgctcgccgcgatgttcggttccatcaaccccaacgacctgggggccgccttccagcagctcggccagatgctctcgtacgagggcggcccggtgaactgggacatggccaagcagatcgcccgccagacggtcgcccagggcacccaggacggcaccaaggacgcgagcgtgggccccggtgagcgctccgcggtcgaggaggccgtgcgcctggcagacctgtggctggacgacgcgacgtcgctgccgtccggcgccggctccgccgtggcctggagccgcgcggagtgggtcgaagccaccctgccggtgtggaaggagctcgtcgacccggtcgccgagcgcgtcggcgcggccatgggcgacgtcctgccggaggagatgcaggccatggcgggcccgctcatcggcatgatgcgctccatgggcggcgccatgttcggtacgcagatcgggcaggccgtgggcgtgctcgcgggcgaagtcgtcggctccaccgacatcggcctgccgctcggcccggccggcaaggccgcgctgcttccgttgaacatggcggcgttcggcaaggacctgggcatccccgaggaggaggtgcggctctacctggccctgcgcgaggccgcccaccagcgcctcttcgcccacgtgccgtggctgcgctcgcacctgttcggtgcggtcgagggctacgcgcgcgggatcaaggtcgacaccgcgaagctggaggacgtggtcggccagttcgacccgcagaacccggaggagctgcagcaggcactccagcagggcatgttccagccggaggacacgcccgagcagaaggcggctctggcccgtctggagactgcgctggcgctcgtggagggctgggtggacgcggtggtgcacgcggccgccaagccccgcctgtcgtccgcggacgcgctgcgtgagaccctgcgccgccgccgcgccacgggcggcccggccgagcagacgttcgccaccctgatcggcctggagctgcggccgcgccggctgcgggacgcctcgcgtctgtgggcctcgctcaccgacgcgcgcggtgtcgacggccgcgacggcctgtgggcccacccggacatgctgccgaccgcgtccgacctggacgacccggacggcttcgtgcaccgcgagcagctggacttctccgagctggacaagatgctcggcgaagcggcgagtggcggtccggccgccgggaagcccgacctgaagaaggacgacgacaacaagggcgaggacgacagcaagggcgacaccgccgag

SEQ ID NO: 3049 - DNA, 519 bp, Streptomyces avermitilis
  CDS (1)..(519)
gtgagcctcttcgacgacacggtcctcgtactcaagggctacgaggaccaggaggagctgcgcgaggcgtacctgggccacctggaggcgcatccggacggcacctggaagtcgtgccacgccgggcacatcacggcgagcgccctggtggtcgaccccgagcgcggccaggtactgctcacgctgcacaagaagctgcggatgtggctccagatgggcggccactgcgagccgggcgacgcgacgctcgcggccgcggccctgcgcgaggccacggaggagtcgggcatcccgggcctgacgctgctgccgggcggaccggtgcgcctcgaccggcatcccatcccagcaccgtgccactggcacttcgacgtccagtacgccgtcgtggcgcccccgggggcggtgcacgcgatcagcgacgagtcgctcgacgtgcgctggttcggctacgacgaggtggcggacgtggccgacgagtcggtcgtccggctgctggaggcgacacgctcacgcctg

SEQ ID NO: 3050 - DNA, 753 bp, Streptomyces avermitilis
  CDS (1)..(753)
atgcagagtccgcttttcggctacaacgaacagcagacccaggaccgctacagcctgcagaactcgcagatgctgcgcgtcgtcctggagggccacgacgacatcctcgcccgcaagggcaccatggtcgcctaccagggcctcatcgagttcgacgccgagtaccagaacaacagccagcagcgcgcgcgtgcgtacaccggcgagggcctcgacctgatgcgctgccacgggcaggggacggtctatctctcgaacctcgcccagcacgtccacgtgatggacgtggaccaggacggcctcaccgtcgacagcagctacgtcctggcgatggactcctcgctgcaccacgaggtcatcgccgtggacagccagtacggcatttccggctccggcaagtaccagctcaacatcaccggccgcggaaaggtcgcgctgatgacctcgggcatgcccctgctgatgcaggtgacgccggacaagtacgtcaactgtgacgccgacgcgatcgtcgcctggtccacgagcctgcgcgtccagatgcaggcccagacgcattcctccggagtgtggcggcgccgcggcaacaccggtgaggggtgggaactcagcttcctcggcaacggctacgcgctcgtccagcccagcgagctgctgccgccgcagaacgcgcagatcggtcagggactgcgcgcccagtacggcatggggcagcagggcgcccgggcgcagaaccagggcaacgtctggagc

SEQ ID NO: 3051 - DNA, 678 bp, Streptomyces avermitilis
  CDS (1)..(678)
atgaaccagccgctcgcgggcttcgccccggcaccggtcaccgcccgcatggagaaccacggcaaccacatgctgaaggtcgccatgcagaccggaaacgacctcttcgcgcgcgtgggctcgatggtcgcctacgaagggttcgtccagtacgagcccaacccgcccgccgtacgccagatcgcacgcgactggatgaccggcgagggcgcgcccctcatgaagtgcaccggcgacggactgctgtacctcgccgactacggggcgaacgtcgtcgtcatcaacctcaacggcgacgcgatctccgtcaacgccaccaacctgctcgccttcgacgcacatctgacgtggggtgtcgagcgcgtcaaggggctcgcgaagttcgccggccagggcctgtggaacaccaagatctccgggcagggctgggtcgcgctgacctcccggggcaagccgatcgtcgtcgactgcggcggcggcgaggacgagacgtacgtcgacccggacgcgctcgtcgcctggtccccgaacctgaaggtgaagggcaagcgcagcttcaaggcacagtcgctcatcgggcgcggcagcggcgaggcgtaccagatggcgttctccgggcagggcatcgtcgtcgtccagcccagcgaggacagcaccgaccgcctccgagtccggggc

SEQ ID NO: 3052 - DNA, 1674 bp, Streptomyces avermitilis
  CDS (1)..(1674)
atggccagggaattccaacgcggccacaaggccaagatcagtgacctcaccgcgggcaccgatctgtacgtaggcgtgcagatcaccggccccggactgacgttcgacatcagctgcttcggtctggacgccgaggagcggctctcggacgaccggtacttcatcttcttcaaccagccgaagacccccgaggagtccatccaactgctcggcgcccaggcgggcgacacggagtccttccgtgtgacgctcgaccggatcccgccgcagatccagaagctgtccttcacggcgacgctcgacggcgccgggcagatgtcgcaggtcgcccccggttacctccgtatcgtcgcgggcggtgaggaagtggcccgctactccttcaccggttcggagttctccaccgagcgtgccgtgatgctgggcgacttctatctgaaggacgtctggcggttcgccgccgtcggccagggcttcgacggcggcctcgacgcgctgctgaagaacttcggcggagaggtcgccgaggaggagccggctgttccggcacagacgcagtccggtgccgcgccttcgttcgcgccgcccgcgttcggcgccccggccgctcccgctcccgctcccgccccggcgccgcagcccgcccaggggttcacgccgcccccggggcccacgccgcctcccgccccggcgcccgcaccctccgtgcacgccgcgccgaccatcgtcgggcccctgcacaccccgccgggcggcactgtcccgccgccgggtcccgcaccgtacgcacagcctcccgggcagccgggtccgccgccgggatacggacagcagcctcccggccagaccgccccgatgccgcccggctacggccagcaacccccgggcgcgccccccggctacggccagcagccgcagtacggccaggttccggggcaggtgccgcccggtcagtacccgggtcagtccggtgccccgtccccgtacggcgttccccagggcgccccgcagggcggtgccggtgtggccgccgcgctgtcggtcttcaaggagacgcccaccggtcagcgctggacgcagcagaacaagaagctgatccgcgtcgacctcggcatcggcggccagccggtgctggcgcggcagggcagcatggtgctctaccagggcaaggtcgagttcagctacaagggcgcgggcttcgccggccggatcacgggcaatgccaccggccaggagatgcagctcatgcgctgtaccggccagggccaggtgttcctcgccgacaacgccacccatgtgcaccccatcgagctccagggcgacgcgatctgcgtctccgcggagaacgtcctcgccttcgacgagtccctccagtacgaggtccgtcgcatcgagggacacggcatccccgggggcgcgctgttcacgatgcagttccaggggaccggcacgatcgtcgtgaagacgcacggcgcgccggtcgtgctgcctgtgacgccgacgacgttcgccgactgcaacgccgtcgtcgcctggtccgcggcctcccaggtgatcgtctccagccaggtgcggatgcgccgcaacgcctaccccggcgacaccggcgagagcgtgaacctccagttccgcggcgcgcccggcaatttcatcgtcgtccagccgtacgaggtc

SEQ ID NO: 3053 - DNA, 441 bp, Streptomyces avermitilis
  CDS (1)..(441)
gtgctcatccccgcccgtatgtccgaggcggaggaacagcgctgggtgaccgtcatgctcgacaagctggccgcccaggagagcaagcggcggctcggcgacgccgagctggccgagcgggccgagcgtctgtcgctccagtacttcgacggccgcgcccggcccaccgcggtccgctgggtcaccaatcagaacacgcgctggggttcgtgcaccccgtccgagggcagcattcgcctctcgcaccgcttgcagggcatgcccgagtacgtcgtcgactacgtcctgctgcacgagctcgcacatctgctcgtgcccgggcacgggccgcgtttctggcggctgctggaggcgtatccgcgtacggagcgtgctcgcggctaccttgaaggggtggtcgccgccgaccggctgccgcaccagcccgccccgggcgccgag

SEQ ID NO: 3054 - DNA, 1221 bp, Streptomyces avermitilis
  CDS (1)..(1221)
atgcatccgatggtgaaacccgcgctgcggcgcggctggcgggatctcaacaccgtgcagttcgggatggcacccgcgcacgccatggtgctggggccgatggacacggcgacgggcagtttcctggccctgctcgacggcacacgcgggctgccgctcctgcgagaggagggacgcaggatggggctgcccgacggccatgtcgacggactggtggagcggctggcggcctcggggctgctggacgacgcgacgggcgggggcccgggcgccgacgccttgcgcggaaagggggccgtcctggaccggctccgccccgatctggcgtccctgtccctggtcgcccgcgcaccgggggcggggattcagcggctggccgcccgtcgctccctgcgggtgcaggtaaggggcgcgggccgggtgggtgtcgtcctcgcctcgctgctggcgggcgccggcgtgggcgaggtcgacgtacaggacacgggccgtgtcgagccgtgggacgtggcccctggcggactgcccgccgagtcgatcggcgagcgcagaaacgaggcggcccggcgggccgtgcggagtgcggcaccggagcggcccccgcgacaggagcgtgcctcgcgcaggaccaccgcgggcgcagcggaccccggtctctcgctggtgatcctcactccacgcgacggcctgggcatccacgccccggacccggccgccgccgagccactcatcacttcgggcacaccgcatctctacgccggagtcgtggagggcacgggagtggtcggccccttcgtcctgcccggcgagtcgggctgcgcgggctgcctggaccaggggcgcgccgaccgggaccggacgtggccgcgcctggtcgcccagtggcgctccggacggccccgtcaggtgcaggcgtgcgacgtggcgctggcgaccgctgtcgcgggtgtcgccgccgggcacgcgctcgccttcctcgacggggaactgccgtcgagcgcgggcgcgcgctgggagacctccgtgccccggctcgactggcacgcccggcccgtgtgggcgcatcccgcatgctcctgcggcgccgcggagaaaggtaacggagaacacaccgcaaaggagggggagccgcacgagacaatggcggagcaacagccgtcggcagacttgccccgcaaggcacgcgccgcacggctgtctgggacttggagggcgcatgtc

SEQ ID NO: 3055 - DNA, 1353 bp, Streptomyces avermitilis
  CDS (1)..(1353)
atgtctgatcttccccggaaggcggtcacccgtaccgccaagctcgccgcgctcccgctcggcttcgccgggcgggcgacctgggggcttggcaaacggatcggcgggaagtcggcggagatcgtcggccgggagctccaacagcgcacggcggagcagctgttcaaggtgctcggcgagctgaagggcggcgcgatgaagttcgggcaggcgctgtccgtcttcgagtcggcactgcccgaggaggtcgccgggccctaccgcgcggcactgacgaagcttcaggaagcggccccgccgatgccgacccgcacggtgcacgccgtgcttcaggagcggctcggcgaggactggcaggagctgttcctggagttcgaggacaagccgtcggctgcggcctcgatcggccaggtacaccgcggggtgtggcacgacggccgtgaggtcgcggtcaaggtccagtatccgggtgcgggcgaggccctgctctccgacctcaaccaactcagccgtttcgcgcgcctgttgggcccgttgatcccgggcatggacatcaagccgctgatcacggagctgcgcgatcgggtgtcggaggagctggactacgccctggaggcgcaggcccagctggcgcacgcggaggagttcgccgacgaccccgatgtcgtggtcccggcggtggtgcaccagagcgagcagatcctggtgaccgagtggatcgacggcataccgctgtcggaggtgatcgccgacggcacccaggagcaacgcgaccgcgccggccagctcctggcccgcttcctcttctccgggcccgcccgcacgggactcctgcacgccgatccgcatccgggcaacttccggctgttgcccgacggcttcgacgagaaggccggctggcgcctgggcgtcctggacttcggcacggtcgaccgcctgccgggcggcctgccgaccccgatcggcgactccctgcgcatgaccctggacggcgatgccgagtccgtctacgagctgctccgcgaggagggcttcgtcaaggagtccatagagctggaccccgacgccgtcctggactacctgctgccgatcatcgaaccggcccaggccgacgagttcaccttcacgcggggctggatgcgcagccaggcggcccggatcgccgacccgcgctcccccgcgcaccagttgggaaagcagctgaacctgcccccggcgtacctcctgatacaccgcgtcaccctcagcaccatcggcgtcctgtgccagctgggcgccaccgtgcggctgcgggacgaactggaggagtggctgccgggcttcctgctggaggaggagtcggccgcggaggcg

SEQ ID NO: 3056 - DNA, 321 bp, Streptomyces avermitilis
  CDS (1)..(321)
atgaacatcacaggaacgatcgaccgccccctcacgcacgaccccaagaagcaggccccgatgaagccgtccgccggcgagcccgcaggctccgcgatcccagacttcaccaccaccggcgcgaacgactcgcgtcagaacaggacccgagagatgcaactcatcccagaagccctggctcgtgcgcatatgcacgagcgactgcatgaggccgagcaggaacgccgggccacgcgcctggcgacggcccgccggatgcagcgccgggccgagcgcgcctcgatgcgcgcccgccgcgcgctcgccatggcggtcatgcag

SEQ ID NO: 3057 - DNA, 366 bp, Streptomyces avermitilis
  CDS (1)..(366)
gtgcaactcgaagcgcacgccccgtccgtaccgccttccgaaacgatccccccgcccggcctcacggaggactccaccttgatcccgctcaccgcgctcaccgcgctcgacgacgccatcgagaacctcggcgtacccgtcccctgccgctcgtacgacccggaggtcttcttcgccgagtcgccggccgatgtcgagtacgccaagtccctctgccgcacctgcccgctcatcgaggcctgcctcgccggcgccaaggagcggcgtgagccctggggcgtctggggtggcgagctcttcgtccagggtgtcgtcgtcgcccggaagcggccgcgtggccgcccgcgcaagaacccggtcaccgca

SEQ ID NO: 3058 - DNA, 345 bp, Streptomyces avermitilis
  CDS (1)..(345)
ttgagacgccgagaggaggcgattccagtgatcagcatcaacaccagctccatcagcaccgtcaaaatgaccgatcgctcggtcgtctccctgtgcatgtccggcgtctcgaacctggggaccggtctgtccggcattcgtgccgcccggccggcgtcctccctgtctctcgcggaacttcccatccgtgagcgcaatgagcgaccgaccaaggcactggaagcagcagtagtggcacaggcgcatgcctatgcctttgcggccggtgccggatccctgaagcagacgacgcagcaccacacgatgtgggccttccgtgggcctgaaccctggagtgatccagcc

SEQ ID NO: 3059 - DNA, 2310 bp, Streptomyces avermitilis
  CDS (1)..(2310)
gtgcgtctgccgcccggacgcggcggcgagcctgccgcattagtacgactgcaggcgcctccctgtggacaaccgccgcacccgcctccgccgacctggcagcatggcggggtgacagcagcaacgcactccaccctcttcccacaggttccggactctgccgacgcggtgctcgacgggctcgaccccgagcagcgcgcggtggcgaccgccctgcacgggccggtgtgcgtgctggcaggtgccggcaccggcaagacacgcgccatcacccaccgcatcgcctacggggtgcgcgcaggcatcctccagccctccagcgtgctcgccgtcaccttcaccaaccgcgccgccggcgagatgcgcggccgactccgccagctcggcgcctccggtgtccaggcccgcacgttccactccgccgcgctgcgccagctccagtacttctggccgaaagcagtcggtggcggactccccagaatcgtcgaccgcaagatccagatcgtcgcggacgcggcggccgcctgccgcatccgtctcgaccggggcgagctgcgggacgtcaccgccgagatcgaatggtccaaggtcacccagaccgtccccgccgactacgcggccgcggctgccaaggcagcccgcgaggccccccgggacccggccgagatcgcccagatctacgcaacgtacgaagacctcaagcgcgaccgcgccgtcatcgacttcgaggacgtcctgctgctgaccgtgggcatcctccaggaccggcaggacatcgcggaggcggtccgcgcccagtaccagcacttcgtggtcgacgagtaccaggacgtcagccccctccagcagcgcctcctggacctgtggctcggcgagcgcgacagcctgtgcgtcgtcggcgacgccagccagacgatctactccttcaccggagcgacccccgaccacctgctcgacttccgcacccgccaccccggagccacggtcgtcaagctggtgcgcgactaccgctcctcgccccaggtggtccacctcgccaacggcctgctcgcccaggcccgcggccgtgccgcggagcaccgcctggagctgatctcccaaagagagcccggccccgaacccgtctacaccgaatacaccgacgagccggccgaggccgaaggcgctgcccgccgcatccgcgacctcctggcctccggcgtaccggcggccgagatcgccatcctgttccgcacgaactcccagtcggaaatctacgaacaggccctcgccgacgccggagtgccctaccaactgcgcggcgccgagcggttcttcgaccgccccgaggtgcgcaaggccggcgtcgccctgcgcggcgcggcccgcttcggcggcaacgacacgctcctggacgacgtcgtcgacctgccctcccaggtgcgcgccgtgctctccggagagggctggaccagtcggcccccggccggctccggcgcggtccgggaacgctgggaatcgctggccgccctggcgaacctcgcccaggacttcgccgccgccaagcccgacgccaccctcggcgacctcgtggcggagctggacgagcgggcgagcgcccagcacgcaccgaccgtgcagggcgtcaccctcgcctcactgcactcctccaagggcctggagtgggacgtcgtcttcctggtcggtgtcgccgagggcatgatgccgatcacctacgccaagaccgacgaacagatcgaggaagagcggcgcctcctgtacgtcggcgtcacccgcgccagacagcacctgtccgtctcctgggcactgtcccgctcacccggggggcgcccgaaccgccggcccagccgcttcctcgacgggctgcgtcccggctcggtcaccaccacgggccgcggcgccagggccggcgccgcgggaggcatcgagcgcggcttcgcgggctccgccaccagccccgccccgcgccgcaccagcaggatcccggcccgctgccgggtctgcggccgcacgttgagcgacgcgggcgagatgaagctgatgcgctgtgaggactgcccctcagacatggacgagggactctacgagcggttgcgtgagtggcgggcggtgcaggcgcagcgcagcgggcagcccgcgttctgcgtcttcaccgacaagaccctgatggcgatcgccgaggccgtgcccgacgacgagggcgatctggcgcggatccccggggtcggggtgcgcaagctcaatcgctacggagccgacgttctcagcatctgcgcaggtcaggaagttgaggtgggcgccgagggtgac

SEQ ID NO: 3060 - DNA, 240 bp, Streptomyces avermitilis
  CDS (1)..(240)
atgccgggcactgtgacgatgtacagcaccacgtggtgcggctactgcagtcggttgaagagccagatggaccgtgagggcatcacgtacaacgagatcaacatcgagcacgacccggactccgcggcgttcgtggagaaggcgaatggcggaaaccagacggttccgaccgtgctcttcgcggacggttcgacgctcaccaacccttcgctggcccaggtcaagcagaagatcggcgcg

SEQ ID NO: 3061 - DNA, 945 bp, Streptomyces avermitilis
  CDS (1)..(945)
gtgaccacctggaccgaccgtaccgccgaccgtcccctctcactcaccgcgccgagcggcatcgatcgggccgcccaccaccggctcgacgaggcctggctcgcggccgcgtggagccaccccaccactcgggccttcgtggtctccggcggccaggtcctcatcgacgagacggcggacggcgccaccgaactcgtcatgactccgtcattcgaggcccccctcaccgaggcgcaccgctacttcctgggcacggacgacgacggcgtcagctacttcgccctccagaaggacgcgctgcccggccgcatcgaccagtccgcgcggccggcgggcctgcgcgaggcgggcctgctgttgtcgccgagggacgcgggcctgatggtccacgcggtcgccctggagaactggcagcgtctgcaccgcttctgctcgcgctgcggcgagcgcacggtgatcgcggcggccggccacatccgccgctgcccggcctgcggcgccgagcactacccgcgcaccgacccggcagtgatcatggcggtcacggacgacgaggaccgcatcctgctcggccgccaggtgcactggccggagggccgcttctcgacgctcgccggcttcgtcgagcccggcgagtccatcgagcagtcggtgcgccgcgaggtcttcgaggaggcggggatcaccgtcggcgaagtcgagtacgtcgccagccagccctggcccttcccctccagcctcatgctgggcttcatggcccgggcgacctcgacggagatcaacgtcgacggcgacgagatccaggaggcgcgctggttctcccgtgaggacctgaaggccgccttcgagtccgaagaagtgctgccgccgtacggcatctccatcgccgcccgcctgatcgagctctggtacggcaagcccctgccgaggccgggtacggccgtc

SEQ ID NO: 3062 - DNA, 1401 bp, Streptomyces avermitilis
  CDS (1)..(1401)
atgagcgagaccccggacagcgccgtccgcacgtacatcgacagtcaccgagccgtcttcctcgacgacctcgcggagtggctgcgcatcccgtctgtgtcggcccagcccgaccacgcggcggatgtacggcgcagcgccgactggctcgccgccaagctcaaggagaccggcttcccgaccgccgaggtgtgggcgactccgggcgccccggcggtcttcgccgaatggccctccgacgacccgcaggcgcccactgtcctcgtctacggccaccacgacgtgcagcccgccgcccgcgaggacggctgggacaccgagcccttcgagccggtcattcgagacaaccgcctctacgcgcgcggggccgcggacgacaagggccaggtgttcttccacacactcggtgtccgcgcccacctcgccaccacgggccgtaccaccccggcggtgcacctgaagatgttgatcgagggcgaggaggagtccggctcgccgcacttccgcgccctcgtcgaggagcacgcggaccggctcaccgccgacaccgtgatcgtctccgacaccggcatgtggtccgaggacacccccacggtgtgcaccggcatgcgcggcctcgccgaatgcgagatcgagctgcacggccccgaccaggacatccactccggctccttcggcggcgcggtgcccaacccggccaccgcggcggcccgcctggtcgccgccctgcacgacgaacacgcgcgcgtggcgatccccggcttctacgaaggcgtcgccgaactcaccgcccgcgagcgcgaactcttcgccgagctgccgttcgacgagccgcagtggctgcgcacggccaagtcggccgcgacgtacggagaggccggtcacaccaccctggagcgcatctgggcccgcccgaccgccgaggtcaacggcatcggcgggggctaccagggccccggcagcaagacgatcatcccctcctccgccatggtgaagctctccttccggctggtcgcaggccaggaccccgacgacatcgagacggccgtacgcgcgtgggcggccgatcggctgcccgccgggatccggcacgagatcacgttcggggccgccacccgcccgtgcctgacaccgctcgaccaccccgcgctgcagtccgtcgcacgcgccatgggccgcgccttcgaacagccggtccgcttcacccgcgagggcggctccggacccgcggccgacctccaggaagtcctcggggcacccgtgctcttcctcgggatctccgtcccgtccgacggctggcacgcccccaacgagaaggtcgaactcgatctgctcctcaagggcgtcgagaccaccgcgtacctgtggggcgacctgggagggagtccgcgccatggggac

SEQ ID NO: 3063 - DNA, 3606 bp, Streptomyces avermitilis
  CDS (1)..(3606)
gtgcttcttccagccatgcggctgattggtcctccactgtcagtggccgccgctagcctctctgacgtgccagcccgtatcaccgaccccgagcagctcaaggagctcctcggcatcccgttcaccccggagcagacggcctgcatcaccgcaccgcccgccccgcaggtgatcgtggccggagccggatcgggcaagaccaccgtgatggcggcacgcgtggtctggctggtcggtaccgggcaggtggcccccgagcaggtgctgggcctgacgttcaccaacaaggccgccggtgaactcgccgagcgcgtccgcaaggcactcgtcaaggcgggcatcacagacccggacgtgatcgacccggacaacccgccgggcgagccggtgatctccacgtaccacgccttcgcgggccgactgctgaccgaccacggcctgcgcatcgggctcgaacccaccgcccgcctgctcgccgacgccacccgctaccagctcgccgcgcgcgtgctgcgtgaggccccgggcccgtacccggcgctgacccgctccttcccggacctcgtcggcgatctcctcaccctcgactccgaactcgccgagcacctggtgcgccccgaggagctgcgcgcatacgacgccgagctgctgagctcactggagggcgccaagctctccaacgccgagctgcgcaagatccccgaaacggcagccgcccgtcgtgagctggccgacctggtggtgcgctaccgggccgccaagcgcgagcgcgacctcctcgacttcggtgaccagatcgccctctcggcgaccctggcacgcacgcgtgcggaggtcggagccatcctgcgggacgagttccgcgtagtgctcctcgacgagtaccaggacacatcggtcgcccagcgcgtcctgctcgccgggctgttcggcggtggcaccgggcaccccgtgaccgccgtcggcgacccctgccaggcgatctacggctggcgcggcgcctccgtcgccaacctcgacgacttccccgagcacttcgcgcacgccgacggccgcctcgcgacccgccaggccctcagcgagaaccgccgcagcggcggccgcctcctcgacctcgccaacggcctcgccgagcccctgcgcgccctgcacgcgggcgtggaggccctgcgcccggccccgggtgccgagcacgacggccaggtccggtgcgcgctgctgcgcacccacgccgaggagatcgactggatcgccgactccctcgcccacctcgtgcgcaccgggaaggagcccggcgagatcgccgtcctgtgccgcaccgcgacggacttcgccgagatccagggcgcgctcgtcgcccgcgacgtccccgtcgaggtcgtcggcctctccggactgctccatctgcccgaggtcgccgatctcgtcgccgtctgcgaagtcctccaggaccccggtgccaacgcctctctcgtacggctcctcaccggcccgcgctggcgcatcggcccgcgcgacctcgctcttctgggacggcgcgcccgcctgctcgtgtcccacgcacgcgtgggggccgacgacgaccccgaccgccggctcgccgcggccgtcgagggggtcgacccgtccgaggtgatctcgctcgcggacgcgctcgacacgttcctggaagcgcccctcgaagatcccgcggaggcggacgacgggctgccgttctcggccgacgcgcgcgtacggttcgcacggctcgccgccgaactgcgtgacctgcgccgctcgctcgccgaccccctgatggacgtcctgcaccgggtcctcgccgtcaccggtctggaggtggagctgtccgcgtccccgcacgcgctggccgcgcgccgacgcgagacgctgtcgaacttcctggacgtcgccgcatccttcgccgcgagcgacggcgaggcgacgctccttgccttcctcggcttcctgcgcaccgccgcccagtacgagaagggtctcgacaacgcgctgccgggcggtgagaacaccgtcaaggtgctcaccgcgcacaagtccaagggcctggaatgggacgtcgtcgcggtccccgggctggtcaccgggacgttcccgagcacccagggccgcgagaagtggaccgcgcagggcaaggtcctcccgcacgagctgcgcggcgacgccgacacgctgcccgacatcgaggcctgggactccagaggcatgaaggccttccacgaggccatgaaggagcaccagcacaccgaggagctccgcctcggctatgtcaccttcacccgcccccgctccctgctcctcggctccggccactggtggggcccgtcccagaagcgcccgcggggtccgtcggacttcctgcacgccctgtacgagcactgcgcggccgggtacggcgagatcgaggcgtgggcggaggagcccgaggagaacgaggagaacccggccctgcacgaggcggccgccgaccacgcctggccacttcccctcgacgacacggcgctggcccgccgccgggcggccgccgagaccgtactcgcctacctggagcgagtcgcctcgcacgagaacgcccacccctcggcgccctcggccgtccacgacccgacgtcgtacgacgacccggactggccgccaccggaggacgccgaaagcccccacgaagatcccttcgacgaggcctacggcgatctcgcccacgacgaggccccctacggggaggacgacgtcccggaggaaggcctcctcgaagacgacggcgacgacgacgccgactgggagtcctggtcgacggaccggccgacggtgccccaccaagcagcggctccggaggctcgtccccacccggcgggcccgccgcccctcacgcccgaggaagcacgcaccatcgcctcctgggaccgcgacctggacgccctcaccggagagctgctgcgcgcccgcgcgagcgtcaccgacgtgcccctgccggcgtcgctgaccgcgtcgcagctcctggagctggccgccgacccggacggcttcgcccaggagctcgcgcgccccatgccgcgccccccgcagcccgccgcacgccgcggcacccgcttccacgcctgggtcgaggcccgcttcgaggagcttcggctgcccatgctggagccggacgagctgcccggcagcgaagccgagatcgccgacgaacgcgacctggaggccctcaaggacgccttcgaacgcactccctacgcccaccgcacgccgtaccgcgtggaggtccccttccagctcgcgatcgcgggacgcgtcgtacgcggccgcatcgacgccgtctaccggaaagaggggaacgacgggacgacgtacgagatcgtcgactggaagaccagccgcacccgcaccgcggaccccctccagctcgccgtgtaccggctcgcgtgggccgagcagcagggtgtgcccctggagtccgtcacgaccacattcctgtacgtacgcagcggcgaggtcgtacggcccgacggtctcccggaccgggccgcgctggagcggctgctcctggacgagccgtcctccggtgaaccgccgggcgagcgtgtcactgagggccga

SEQ ID NO: 3064 - DNA, 3387 bp, Streptomyces avermitilis
  CDS (1)..(3387)
gtgagctcctcttcctccaccaggcgccttgtgcatccccggatgcgacaggggagccgtggcgcttaccgactggtgcgtaccccgttggcccgggtggatcccccccgtcttgacgcaaaccagcgcgcggtggttgaccacacgtccggtccgctgctggttctcgcaggtccgggaaccggcaagacgaccacgctcgtggagtcggtggccgcgcggatcgcccgtggcggggacccggagcgggtcctggtgctgacgttcagccgcaaggccgccgtcgagctgcgcgaccgtatggcgctgcgcatgggtgcggcgcgcgctccgcaggccaccaccttccactcgttctgctatgccctggtccgcgcccaccaggacgtcgggctgttcgtggagcctctgcggctcctgtcgggccccgagcaggacgtggcggtgcgcgggctcctcgccggacagcccgacctggagcggctcggcctcgcgcacgtgcgctggccggacgaactgcgcgcctgcctcaccacccggggcttcgccgacgaggtccgtgcggtactggcccgcagccgcgaactcggactgagcccgggcgccctgcgcagtttcgccgcgcgcatcggccgtcccgactggatggccgcgtccgccttcctggccgagtacctcgacgtactcgacctccagggagtcctcgactacgcggaactcgtccaccgcgccgtcctcctcgcccggcggccgggcgtcgccgagcggctggccgcgcactacgacgccgtctacgtggacgagtaccaggacaccgatccggcccaggcaaggctgctgcacgccctcgccggcagcggccggaccctggtggccttcggcgaccccgaccagtcgatctacacattccggggcgccgacgtgaacggcatcctggacttccccgacgccttcccgcgcgcggacggaaggccggcgccggtcgaggtcctcaggacgtcccgccgctcgggcgccggcctgctggccgcgacccggctgctgacccagcgcatgcccctgaaccgtctcccggcggagaaagtacgcgcccaccgtgagctcgcgccggtacgggacggaggccacgccgaggtctacacgtaccccacgcccggtacggagctggacaacatcgcggacgtcctgcgccgggcacacctggaggacggcgtgccgtggggcgagatggcggtcctggtgcgcgccggctcccgtacgatcccgacggtccgccgcgccctgacggcggccggggtccccctggacatcgacggcaacgacctgccgctgcgtcacgaaccggcggtgacgcccttgctgacggcgctcaaggcggtggcggaggcggaggcggatgcctccggcacggacgcctccggcacgcacgccgaatcgtccggacccgccggacccgccgcgtcccctgaacccgctggatcggctgagcccgttgagcccgcgcgggaaagctcctggctcgacaccgagaccgctctcaccctgctcgcctctcccctcgccggcatggacgccgccgacctgcggaggctcggccgcgccctgcgcgaggaggagcgggcggccggcaaccacgtaccgccgccctccgacgaactgctggcacgcgcgctggccgagccggaacggctggtcgcgcacgacccggcgtacgcgcgcggagcccagcgcctcggcgtgctgctgcgcaaggcccgcgagcgcctcgcgggcgggcgggcacggcggaggagagccctctgggagctgtgggacggcacgccctggccccagcgcctggcgcgggccgcccggcgcggcggcgcggcagggcgcaacgccgaccgcgacctcgacgccgtgtgcgccctgttcgcgaccgcggcccgcgccgaggagcgcaccggcggccgtggcgcgctcaacttcctggaggagatcgacgcccaggacatcgcagccgacaccctcacccgcagggccgtgcgccccgatgccgtacgcctgatgaccgcgcaccgttccaagggcctggagtggcgcctggtcgtcgtcgcgggcgtccaggagggcctgtggccggacctgcgccgccgtggctccctcctggaggctgaccgcatcgggcgcgacggcctggccgagccgctcaccccgggcgccctcctggcggaggagcgacgcctgttctacgtggccgccacacgcgcgcgtgaacgcctgatcgtcaccgccgtgaaggctccggccgacgacggcgatcagccctcccgcttcctcaccgaactcggcgtcgaaccgaaggacgtcaccgggcgcccccgccgccccctgtccgtcgccgcgctcgtcgccgaactgcgtgccaccaccgtcgacccccgggtctcggacaccctcagagaggccgccgcccgccggctggcccggctcgccgcgctcggcgacgaggacggccgccccctcgtgccgtccgcccacccctaccgctggtggggcatgtacgagccgaccgagagcaaggtgccgctgcgcaaccgcgaccagcccgtcgtgctctccggaagcgccctcgaccagctcgccaacacctgttccctccagtggttcctcggccgcgaggtgaaggccgacgccccggcgaccgccgcccagggcttcggcaacgtggtgcacgtcctcgccgacgaggtcgcctccggacacacccccgccgacctcgacgtcctcatggagcgcctcgactccgtgtggaacgcgctcgccttcgacgcgccctggaagtcggcgcaggagaaggagaacgcgcgcgtggcgctcgaacgcttcctgcagtggcatgtgatggaccgcgcgggacgtacgccggtggcgagtgagcacgacttcgacgtgaccctcgaagcgggctcctacgaggtacgcatccggggctccatggaccgtgtcgaggcggacggcgaaggccgcgcctacgtggtcgacttcaagaccggcaaacaggcgccgaccgccgccgaggtgggccgccatccgcagctcgccgtctaccagctcgcggtgagcgagggcgccgtcgacgaggcgttcgacggcgtacgtcccgagccgggcggcgccgaactcgtccagctgcgccagggcgccgccaagcgggacggcggcgaggccctccccaaggtgcaggcccaggagcccctggagggggagtgggtcggcgacctcctggccaccgccgcgggcaaggtcctcgacgaacggttctctccgaccaccggccagcactgcacccactgcgccttccgggcgtcgtgcagcgcgcgggcggaggggcgccacgtggtggag

SEQ ID NO: 3065 - DNA, 471 bp, Streptomyces avermitilis
  CDS (1)..(471)
gtgcaaatgcgggggcgcacagtctgcccgaagcctcgcccgggggcgagggatacgcacggtcgccgtcgcgtcacattgtcggtggggtggggcaggatgaggcggatgagcgaggagagccttccggcggacgccctgccggagtacgcggagcgggtccttgacgtcgccgagcggatcccgcccgggcgcgtgatgacgtacggggacgtcgccgagtggctggaagagggaggcccgcgccaggtcggccgggtgatggccctctacggaggagcggttccgtggtggcgcgtcatacgcgcggacggcgtgctgctcccgggccacgaactcagggccctcggccactaccgcgccgagggcacacctctgaaggaggcgagcagagcctccgaaggccatctgccacgcgtcgacatgaagcgggcgcgatgggacggcgacgagcgcgcggagggccacgtc

SEQ ID NO: 3066 - DNA, 2892 bp, Streptomyces avermitilis
  CDS (1)..(2892)
atgaaacagcagggtgtgcaccccgatgacgcggagggcacctctggggtctcgtcgcgccccgacaccgccgacgcggcccccacgccgcacgaggagggcccgaaaccgcaggaagcagcagccccgcagcagcaccaggaagcatcccccgagcagcacgaagaagcggctcccgagtcgcacggagaagcggctcccgagtcgcacggagacgagaagcggcaagctgtgagcgaggagcagcgggccgagccggacgccgaccgcgccgacgacgcccacaacgaagaagtcgagggcgacgaaccgctgcttcccgcgcgcgtgcaccggccctccgacctgatgcgcctgctggtgggcgtcctcgcgatcgccgtgctgctcgcggtcgccgcgttcgcgcacggcaccacctcgggcctggaacaggacatcaacaagggcaccggacaggcacccgacctgctgatcaagatcgcggggctggtgtcgagcatcgcgatcctcctggtgccggtcgccttcgcgatcgaacggctgatcaaacgggacggactgcgcatcgcggacggcgttctggccgccgtgctcgcccacggagtgacactcgccacggacctctgggtcgccagggcggctccggactccatccaggaagcgctcacccagccctcgcccggcgacatccacgccctcaccgacccggtgcacggctatctcgcgccggtcatcgcctacatgacggccgtcggcatgtcgcgcagaccgcgctggcgggcagtgctgtgggtggtgctgctcctcgacgccttctcgatgctcgtcaccggctacaccacgccgttctcgatcatcctgaccgtgctgatcggctggagcgtcgcgtacggaacgctgtacgcggtcggctcgccgaacgtgcgccccacggggcggacgctgatggccggcttgcggaccgtgggcttccaccccgtgagcgcggcccgcgaggaggcgccggacacgacggagaacggcgaccgcggccgacgctacttcgtcaccctggaggacgggccgccactggacgtcacggtggtcgaccgcgagcagcaggcacagggcttcttctaccgcgtgtggcggcggctgacgctgcgcgggatcaccacccgccgcagcctccagtcgctgcgccaggcgctggaacaggaggcgctcctcgcgtacgcggccatcgccgccggagccaacgcgcccaagctgatcgcgacctccgaactcggccccgacgccgtcatgctcgtctatgagcacaccggtggtcgcaccctggactcgctggacgacgcggagatcaccgacgaactgctgcgcgagacctggcagcaggtgcgagcgttgcagtcacggcggatcgcgcaccgcaggctcgcgggcgacgcgatcgtggtggatcgttccggcatggtcatcctgaccgatctgcggggcggcgagatcgcggccggcgatctggtgctgcgcatggacatcgcccagctcctggccacgctcggcctgcgcgtgggcgcggagcgctcggtggcgtcggcggtcggcgtgctcggccccgacgcggtcgccgactgtctgccgctgctccagccgatcgcgctgacgcgctccacgcgcgcgacgctgcgcagactggcccgggagcggtcgcagcgcgaacgcgaggccgtactggaggcgtcccggcagtccaagctggcccgcctggaggaggcgcagcaggacgccggtcccgtcgtactcaccaagcccgacaagaaggccgacaagaaggccgtacgcgccgaacagcgggcggagaagcgggcgatagacgaggccctggacgaggcccgcgaggaggatctgctcacccagatccgccatcaggtgctgcggatccggccgcaggccccggtcgagccggcccgtctggagcgggtgcggccgcgcacgctgatcagtttcatcgccggtgccatcggcgcgtacttcctgctcacgcagctcacccatatcgagttcggcacgctcttcagcaacgccgagtggggctgggtcgccgcggccgtcctcttctcggcgctgagctacttcgccgccgcgatgagcctgctcggcttcgtaccggaacgggtgccgttcctgcggaccgtggcggcgcaggtcgccgggtcgttcgtgaagatcgtggcgccggccgcggtcggcggcgtcgccctgaacacgcgcttcctgcagcgtgcgggggtgcggccggggctcgcggtggccagtgtcggcgcctcccagctgttcgggctcggctgccacatcctgatgctgctgtccttcggctatctgaccggcaccgagaagacaccgtccctgtcgccgtcgcggacggtcatcgcgggtctgctgacggtcgcggtgctcgtactcgtggtgacctcggtgccgttcctgcggaaattcgtcgtcacgcgcgtgaggtcgctgttcgccggtgtcgtgccgcgcatgctcgacgtgctgcagcggccgcagaagctggtcaccggcatcggcggcatgctgctgctcaccgcctgcttcgtgatgtgcctggacgcctcgatccgggcgttcgggcacgaggagaccaccacgctgagcctcgccagcgtcgcggtcgtcttcctcgccggcaacgcgctcggttcggcggcgccgacccccggcggtgtgggcgcggtcgaggcgaccctcacggtcggcctgatcgcggtggggcttcccaaggaggtcgcggcgcccgccgtgctgctgtaccggctcctgacgctgtggctgccggtgctgccgggctggctcttcttcaaccatctgacacgcaagggcgccctg

SEQ ID NO: 3067 - DNA, 1548 bp, Streptomyces avermitilis
  CDS (1)..(1548)
atgccgaaccctccccggctgcgcgccgccgtcctgaccgccaccgccgtcctgctgtcctcttcggtgacgggttgcagccacgacaacgacaccaaggacgaggacctgtcgggccagaagctgagctggaaggactgcccggcgccgtccgagtccgagggcggcggcaacgctccctcgccgctgccggacggcgacgagtggcagtgcgcgacgatgaaggcgccgctcgactgggccaagcccaggggcgacaccatcgacatcgcgctcatccgggcgaagacaagcggggaacagagcaagcggatcggctcgctcatcttcaacttcggcggcccgggcggctccggcgtcgcctcgctgcccgccttcggcaaggactacgaaaagctgcgcacccgctacgacctggtgagcttcgacccgcgcggggtcggccgcagcgccggcgtgaagtgcgaggacgacgcacaactcgacgagtacttccagcaggacgcgacgcccgacgacacggccgagcagaagaatctcctggccaacaccaagaccttcaactcggcctgtgaaaagcactccagcaggatcctgccgcatgtccgcaccaccgacgcggcccgtgacatgaatctgatgcgccaggtgctcggcgacaccaaactgcactacttcgggatctcctacggcaccgagctcggcggcgtctacgcccacttgttccccaagagcgtcgggcgggccgtcttcgacgcggtcgtcgacccgacccagaacccggaacagggctcgctgggacaggctgagggcttccagctcgcgctcgacaatttcgccgaggactgcacctccaagaccacggactgcccgatcggcgacaccgcgcaggacgtcaaggaccggatcgccacactgctcaaggacctggacagcaagccgatcccgggggtcttcccgcgcgagctgacccagaccgccgcgaccagcggcatcgcgcaggccctgtactcgaaggacttctgggagtacctcaccgaagggctcgagcaggcgtacgacggcgacggcaaggtgctgatgctgctgtccgactcgatgaacgggcgcaatgcgaacgggcagtacagcaatctcgtcgcggcgaacgtctcgatcaactgcgcggacgacaagccgcgttacaccaccgccgacgttcaggcgaagcttccgcagttcaaggccgcctccccgctgttcggcgactatctggcctggggcctgctcagctgtaccgactggtcggtggcgggcgccgcggaccatcccgacgtgagcgcgcccggtgccgcgccgatcctcgtcgtcgggaacaccggcgacccggccacgccgtacgagggtgcgaagaagatggtggacgcgctgggcaagggcgtcggcgtcgagatgacgtacaagggccaagggcacggcgcgtacgacagcaagaacaagtgcgtgcagagcgcggtggacggctatctgctggacgggaaggtaccggcggccaacactgtctgctca

SEQ ID NO: 3068 - DNA, 1551 bp, Streptomyces avermitilis
  CDS (1)..(1551)
atggcgcgtatcgcacggtggacggctctggccgccgctgcgttgctggtggccggctgtggcggcggctcgtccgacgacggcaaggagacaggcgaagccgatcggtcggccgactcgtcgacgtcctcgtcgccgtccggtacgccgtcgcagctgcccgcctcgctcacctcacagaagctcggctggggccgctgcaaggccacctcggactcgcccgcgccgggcggcgactggcagtgcgcgacgctcaaagtgccgctggattacgcgaagccggacggcgagacgatcggacttgcgctgatccgctccaaggcgacgggcggccggcgcatcggctcgctgctgttcaacttcggcggccccggcgccagcggcgtctcctacctgccgtcgtacgcgaccacggtctcgaaactgcacgagcgctatgacctcgtgagctgggacccgcgtggggtcgccgccagcgagggcgtgcgctgccgcagtgaccgggcgatccaggctgccgagtcggtcgactcgaccccggacgactcgaccgaacagcaggcgtatctgaaggactccgccgatttcggcaaggggtgcgagaaggccgccggaaagctgatgtcgcacgtctcgacgaccgacaccgcgcgcgacatggacctgatgcgccaggtgctcggtgaccggaagatgcactacttcggcatctcgtacggcaccgaactgggcggggtctacgcccacctgttcccgaagaacgtggggcgtctggcgctggacgcggtcgtcgatccgagcgcggacacggtcggccacgccaagaaccagacccgcggcttccagcgcgcgttggacgactacctcaaagcgacaggccaggatccgaagcagggctcccagaagatcgtggacctgctgaagcgaatcgacgccaagcccctgccgacgtcgtccggccgcaagctcacacagacgctggcggtcaccgggatcgtgctgccgctctacagcgagcagagctggcccgtgctcaccagcgctctcaaggcggccgagggcggggacggttcggagctgctgttgcaggccgacagctacaacgaccgggacgcgtcggggcactacggcacgacgacccactcgcaacgggtcatatcgtgcctggacgacaggcagcgcccgacgcccgaggagacgaagaagcggctgccggagttcgagaagatctcgcccgtcttcggcgactacatgggctgggacacggcgggctggtgccacaactggccggtgtccggtcagtacgacaatccggaggtcagcgcgcccggggcggagcccgtcctggtgatcggcaacaccggggacccggcgacgccgtacgagggtgcccgcaagatggcggacgaactgggcaaggacgtcggtgtggagctcacctggaagggcgagggccatggggcgtacgggagtgggagcgactgcgtcgactcgacggtggacagctacctgctgaacgggacggtgccgaaggacggcaaggtctgttcg

SEQ ID NO: 3069 - DNA, 1176 bp, Streptomyces avermitilis
  CDS (1)..(1176)
gtgtcgctgccacccctggtcgagccggctgccgagctcaccgtagacgaggtccgcaggtactcccgccacctgatcatccccgatgtgggcatggacgggcagaagcggctgaagaacgccaaggtgctctgtgtgggcgccggcggcctcggatcgccggcgctgatgtacctggccgccgccggcgtgggcacgctcggcatcgtggagttcgatgaggtcgacgagtcgaacctgcagcgccagatcatccacagccagtcggacatcggccgctccaaggcccagtcggcgaaggactccgtcctcggcatcaacccctatgtgaacgtgatccttcacgaagagcggctcgaggccgagaacgtgatggacatcttcagccagtacgacctgatcgtcgacggcacggacaacttcgcgacccgttacctggtcaacgacgcgtgtgtgctgctcaacaagccgtacgtatggggctcgatctaccgcttcgacggccaggcctcggtcttctggtccgagcacggtccctgctaccgctgcctctacccggagcccccgccgccgggcatggtcccctcgtgcgccgagggcggcgtcctgggcgtgctgtgcgcgtccatcggttccatccaggtcaacgaggccatcaagctcctcgcgggcatcggtgagccgctggtcggccgcctgatgatctacgacgccctggagatgcagtaccgccaggtcaaggtccgcaaggacccggactgcgcggtctgcggcgagaaccccaccgtcaccgagctcatcgactacgaggccttctgcggcgtcgtgtccgaggaggcccaggaggcggccgccggctcgacgatcactcccaagcagctcaaggagtggatcgacgacggcgagaacatcgagatcatcgacgtccgtgagatcaacgagtacgagatcgtctcgatcccgggcgccaagctgatcccgaagaacgagttcctcatgggcaccgccctcgaggccctgccgcaggacaagaagatcgtcctgcactgcaagacgggtgtccgcagtgcggaagtcctcgccgtcctgaagtcggcgggcttctcggacgccgtccacgtgggcggcggcgtgatcggctgggtcaaccagatcgagccgaacaagccggtgtac

SEQ ID NO: 3070 - DNA, 747 bp, Streptomyces avermitilis
  CDS (1)..(747)
atgtcgtatctgaccagcagcgcaacgggcaccgcgagcaccgacttaggcctcggcttcggcatccccggctatgcgcaccccctcgtcgcccccatggaatggggcgagctggcccgccccggcacccccctgcactgggtcgtcctgaatgtgagcggcggccccggcgcccggcccgacccgcactgcctggaggccgtcggccgactgcgcaacgcgggcgtccgcgtcctcggccacctggacaccacctacggcgtacgcaccttcggtgagctgatctccgacgcgcaccggtatctcgactggtaccagaccgggggcttcttcctgagccgctgccccaccgaacgcgccgcgctccccgagatccgccgcacggtcgccaccttgcgcggactcctcggtggcagccacatcgtcctcggccacggcacccacccgttccccggctatgccgagagcgcggaccagctggtcaccttctccggcccctggagcgactaccgctggtcgcaggtggccgagtggaccgccgactacccacccgagcgcttctgccacttcgtgcacggtgtcccgcgcggacatctcgacgaggcactgcgcatcgcccgctggcagggcgcctcgacgatctacttcaccgaccgcaccgatcgtggcggccgcgacgatccctgggagaccatgcccggctactgggacgaaatcgtctcgcggatcggaacgggtgtctcggaa

SEQ ID NO: 3071 - DNA, 957 bp, Streptomyces avermitilis
  CDS (1)..(957)
atgagggtcctgctgatcggagccaacggatacctcggccgcttcgtcgccgaccggctgctcgccgacccggccgtgcagctcaccgcgctcggccgcggcgacgacgccgacgtacgcttcgacctcgcctccggcagccccggcgcgctcacccgcttcctggacgccgtgcaccccggagtcgtcgtcaactgtgccggagccacccgcgggggtgcccgcgaactcacccggcacaacaccgtcgccgtcgccaccgtctgcgaggccctgcgccgcagcggctgcggcgcccgcctcgtgcagatcggctgcggtgccgaatacggccccagccagcccggctcctccacggctgaggacgccgtgccgcgccccggcggcccgtacggcgtcagcaagctcgccgccaccgaactcgtcctcggctccggcctggacgccgtcgtcctacgcgtgttctcgcccgccgggcccggcaccccggccggctccccgctcggccgcctggccgaggccatgcgccgcgcgatgcagtccggcgacggtgagctgaagctcggcggactcggcgtccagcgcgacttcatcgatgtccgcgacgtcgcccgcgccgtccacgccgcctccctctccgccgcgcagggggtgatcaacatcggttccggccgtgccgtacggctgcgcgacgcggccgccgtcctcgcccgcgtggccggctacggcggtgccctgcacgaactcgacggcccgcacatccccgtacggccctccatcggccacccccgccccgaacccgaccacgcggccccggccgcctacccctacccggacggctgcggcagctggcagcaggccgatgtgcgcaccgcacgcgaccggctcggctggcggccccggatcaacctcgaggagtccctggccgacatctggatggaggcggcatgtcgtatc

SEQ ID NO: 3072 - DNA, 1029 bp, Streptomyces avermitilis
  CDS (1)..(1029)
atgcaccggcaccgagagctctgcgagcgggccgtcgatcccctggagatcgcggccggcctcgaggcgcacggagtcaccgaccggaccgccgcccgcttccggcaccgggatgtgttctccctcgccgaggagatgtacgcgcgcgtgccgcgcgacgccgagcctgcgccgcagcccgtcgccgccggcccgcgcgccgagggcggcgcatgggccgtgctcgccctgctgccgggcaccctctgcgcggcgaccgtcgtcggactgcggctcaccgagggacggccacgcctcgccgtggccgccgccggcgccctcgccgtggcgatcgggctgcgcgcggccctcggccggggcccgctgcacgccccctcccaccacacgacgggcgccacgcgcgcgtggacgtgctggctgctcgcgtacgccctcctcggcgacgggctcctgagcgccgggctggaaggcggccccgacggcccctggcccctggccaccgctcccgtgctcgccctcgccctggcctgcgcccccgccgcctggtgcgcccgcctcttcgccgtacgcgcccgccgccggctgaccgccagccgtggtctggaggagttcgcggcctccgccaagccgctgctgctcgggacattcgtcctgttcctctgctcgctcggcgcgctgctcgcgctgtgcgccgccctgctggacgagagcgccgactacccgggagcaggcaccctcggcgcgctgctcctgctcgcccgactgctcaccgcacgcggcttcacccacgccccggcggtcgtgctcggcgtcgccgcggcggccgaggcgaccgccctggccgcggtcttcgcgggccgcctccccggctgctcgtatctggccacgcccgtcgacacggtcgtcggcgcctggggaccgggcgccgtcccgaccctcgtctgcggtgccgccgccctgagcctgctgatccacacgacccgcaccctgacccgggcctcggcgcacgccctgccgcccggaccaccc

SEQ ID NO: 3073 - DNA, 1926 bp, Streptomyces avermitilis
  CDS (1)..(1926)
gtgcgcatcggactgcttacggagggtgggtatccgtatgtgagcggtgacgccaggctgtggtgcgaccggctcgtgcgcgggcttgagcagcacgagttcgacatctacgcgctcagccgcagcgagcagcaggaggacgagggctggatccagctgccgccgcaggtcagccgggtgcggaccgcacccttgtggacggccgaggacgacggggtcggccacgggcgccgggcgcgccggaggttcgccgaggcgtacggggagctggcggcggcggtctgcgcggtggaggagccgggtgggtccggggggccgggggcgttccgcggggccgtcggagccgctgccgggcccgcggctggatgggacgtcggagggggcgccggcgttgccgtcggagatgtcctcggagatgtcggtggaggtgccgtcgggcctgaggcggaccgtttcggcaacgccctgtacgcgcttgccgaactcgcccgcgacgagggcggactggtcggcgcgctgcgttccgagaccgccgtacgcgcgctggagcgggcctgccgcgcccgcggggcactgcgcgaggcgcgggcggcgcgcgtacccgatcttctcgacgtggccgcgcgtctggaacgcgccctgcgccccctctccctcgactggtacgaggacgacgggctcggctcggtggacctgtgtcacgcggcggccggcggtgcggccgccctgcccggactcctcgcccggcacttagccggcgtaccgctgctggtcacggagtacggcgtgcaactgcgggcgcactacctggcctcgggcggcgagtccgctcccgtacgcgcgctgctcgccgcgttccacggccggctggcggcggaggtctaccgccaggccgcctgcatcacccccggcaacacgcacgcccggcgctggcaggagcggtgcggtgccgaccgggccaagctgcgcacggtctacccgggcatggaggcgtcccggttcgccgaggtcggcgagtccaccgggtgcggcgacccggacacgctggtctgggtcggccgcatcgaaccggccaaggacctgatctccctcctccacgccttcgcggagatccgcagacaggcgcccaagacccggctgcgcatcgtcggcacggcggcgggcgccgagggcgtcgcctatctcgggcactgccggaccctggccgcgcagctcttccccgacgaggcggagtgcgcgcacgccgtcggcgacaacccggtgtccttcgaggagatcggcggcccggaggtgcccgacctcgcggaggcctacgcggccggggcggtcgtcgtcctgtcgagcgtcgtcgagggcttcccgatcagcctggtcgaggccatgttctgcggacgcgccacggtctccaccgatgtgggcgcggtcgtcgaggtcatcggcggtacgggcctcgtggtgccgccgcgcaatccgcgggcgctcgccgaggcgtgcgtgacgctgctgcgtgaccccgagcgccgtgagcgcctgggagcggcggcccgcgcccgcgcgctcgaactgttcaccgtcgagcagaacgtcgcggcatttcacggcatttacctggagatcgtctcgcactcgccggtgcggagggtgttcgtggacgacacgggggagccgctgccgttcggcgtgccggccgaggcgcacgtcccggggcggtggaccgaggtgagcctcctggccggtggtcggccgcggtggacggcgggagcggacgcgccgggggcgccggtgagggggacgactccggtgcgggccactccgttacctgctgtggcttccgcttgtcctgtgcctgctgcgcctggtgtgtctgccgtgcctgccgcgtcttccgggcctcaggagccggttgtggcgggggagggggcgcga

SEQ ID NO: 3074 - DNA, 1599 bp, Streptomyces avermitilis
  CDS (1)..(1599)
gtgagtcttgtggaagtcaccgatctcacggtggagttcgggacggtgcgcgccgtggacggactgtcgctgcgcctggagaagggcgccgcgctcggcctggtcggcgagtccggctccggcaagtcgaccgtggcgtccgccctgctggggctgcaccgcggtacgggagcgcgcgtcggcggcaccgtcaaggtcgccggcaccgacgtacaggaggcctccgacgacgaactgcgacggctgcggggcgggaaggccgccatggtcttccaggacccgctgtcgtccctcgacccgtactacgccgtcggcgaccagatcgccgaggtgtaccgggtgcacacgcgcgcgttccggcgggccgcacgcgcgcgtgccgtcgacgtactgaaccgcgtcggcatcgcggacgcggcccgccgcgctcgctcccgcccgcacgagttcagcggcggcatgcgccagcgggccctgatcgccatggcgctggcctgcgaacccgacctgctgatcgccgacgaaccgacgaccgccctggacgtgaccgtccaggcccagatcctcgacctgctgcacacgctgcgcgaggagaccgggatggggctgctgctcgtcacgcacgacgtcggtgtcgccgccgagagcgtcgacgacgtcctcgtcatgcggcacgggcgcgcggtcgagcacggggcggccgccacgctgctgggggcgccggaacacgcgtacacgcgggaactgctgggcgcggtgccgcgcgtggacgtgccgcgtgccaccgccggcgccggggcacagccggcggaggtcgttctcgaagcggtgggcatgcggcgcgagttcgggcgcggaaagggggcgttcgccgcggtcgacgacgtgtccgtcgagatccggcggggcgagaccctaggcatcgtgggcgagagcggcagcggcaagacgacgctcggacggatgctggtcgggctcctcgagccgacggccggagaggtccgtcacgacggccgcgtgctgtccggggtgaacccggccgtgcagatggtcttccaggaccccgtctcctccctcaacccccggcgcagcgtgggcgagtcgatcgccgacccgctgcgggcccgtggggaacgcgacgaggggcgcatccgggagcgcgtgggggagctgctggagcgcgtgggactcgatccggcgcactacgaccgctatccgcacgagttcagcggcggacagcgccagcgcgtcggcatcgcacgggcgctcgccgcagacccgcgcgccatcgtgtgcgacgagccggtctcggcgctcgacgtcaccacgcaggcccaggtggtcgccctgctcggcgagttgcagcgggaactggggctcgcgctggtcttcgtggcacacgatctggcggtcgtacgccaggtcagcgaccgggtcgcggtgatgcggcgcgggcggatcgtcgagtacggcccggccgacgaggtgtacgagtcgccccgggacccctacacccagcagctgttggccgccgtccccgccctggacccggcggtcgcggccgagcggcgcagcgcccgccgagagctggcctccgca

SEQ ID NO: 3075 - DNA, 996 bp, Streptomyces avermitilis
  CDS (1)..(996)
atgagcggcttcaccggcttcgtactgcgccgcggcctcggcgccgtcgtcaccctgctcgccatctcggtgatcgtctacgtcgtcttctacgccacccccggcaacgtcgcccagatcacctgcggtccgcgctgctccccggaacaggtccatcaggtcgccgagcagctgaagctcgacgatccgctgtacgtgcgttactggcacttcctggaaggcatcgtcgtcggccaggactactcgaccggcacgtcggtgcagcactgctcggcgccctgcctcggcctgtcgtaccggaccgaccagcaggtcacccagctgatcttgacgaagcttccggtcagcctgtcgctcgtgttcggcgccatggtgctgtggctgatcctcggggtcggcaccggcgtgctctccgcgtggcggcgcggccggctcaccgaacgggtactgaccggcatcaccctcgtgggcgtcgccacccccgtcttcgtcatcgggctgatcctgatgatcgtcgtctgcggacagctggaactgctgcccttcccgcagtacgtcgccttcaccgacgaccccgagcagtgggcgtggaacctgctgctgccatggctctcgctcgccctcatcgaggccgccgcgttcgcccgcctgacccgggccgcgatgctggagacgctcgccgaggaccacgtacggaccttccgggcgtacggcgtgggggagcggtcgatcatcggacggcacgcgctgcgcggggcgttgtcgccggtcatcgcgctgaacgccaacaacttcggcgcgcaggtcggcggcgccgtactcaccgagacgctcttcgggctgcccggcatcggccaggatctggtgcacgccgtggcggtcgtcgacctgccggtggtcgtcgggatggtcctggtgatcggcttcttcgtggtcctggccaacgccctcgcggacgtgctgtacgcggtggccgaccgacgggtggtgctgtcg

SEQ ID NO: 3076 - DNA, 1080 bp, Streptomyces avermitilis
  CDS (1)..(1080)
gtgagcgaggcacttgtcgcctcccaggccgccgggacgggtacgcccgtcccggcggtttcgggggcccgtcagttctggcggcggctgcgagcgcagcgcgccgccctcgtcgcggcggccgtcgtcgcgctcctggtcctggtcgcgctcgccgcgccgctgctgacggccctggagggccaggacccgaccacctaccatccgtccctcatcgactccgcgcgcggtggcgtacccgtcggctccctcgggggcatcagcggcgaccactggctcggcctcgagccccagaccggacgcgacctcttcgcccggctcgtgtacggggcccgggtgtcgctcggcgtggcgctcgccgcgacgctggtgcaggtcctcatcgcggtcgtggtgggtatcgcggccgcgctcggcaacggatgggtcgatcaactgttgagccgggccaccgacgtcatcgtcgccatgccgctgatgatcatgtcgctggcgctgctggcgatcgtgcccagcagcttcccgcggcccgtcctcgtcgcgctcgtcatcgggctgatcgcctggggctcacccgcgaagatcgtgcgcgcccagacgctcacgctcaagcagctggactacgtctccgccgcccggctcagcggctggggcacctggcggatcgcccgccgcgaactgctgcccgggctcgccgcgcccgtcatcacctactccgcgctcctggtgccgcagaacatcaccatcgaggcggccctgtccttcctcggcgtcggtgtgaagccgccgaccccgtcctgggggcagatgctcaccgccgccgacgtctggtaccaggccgcgccgcagtacctgctgctccccgcgggcgcgctgttcgtgaccgtcctcgcgctgaccgtcctcggcgacggggtgcgtacggccctcgacccgcgcgcggcctcgcggctgcgggtcggcaccggccggaagcgggaggccagggcggctgccgacgcgggcgctccggcgaaggccgatgtggccgccccggcgcaggccgatgcgggcgcctcggcgaacaaggaggccaaggca

SEQ ID NO: 3077 - DNA, 1716 bp, Streptomyces avermitilis
  CDS (1)..(1716)
atgcgtcatccgtccgtcatagcgcgccgcgtggccgcggcatccgtcagcctggtcgtggcagcgggcgccgccgcctgcgggccggaggacaacgatgccaagggcgccggtggcgactccacgccgcggaagggcgggacgctcaccgtcctgaactccaacccgcaggaggacttcgacccggggcggctctacacctcgggcggcggcaacgtcccctctctcgtcttccgtacgctcaccacgcgcaaccgtgaggacggtgccgccggcgccgaggtcgtccccgacctcgccaccgacaccgggcgtccgagcaagaacgcgaccgtgtggacgtacaccctgaaggagggcctcaagtacgaggacggcgccgcgatcacctccgccgacatcaagtacggcatcgagcgctccttcgcccccgaactctccggcggcgccccctacttgcgggactggctggtcggcgcggccgactaccaggggccctacaaggacaagaagggcctctcggcgatcgagaccccggacgagcgcaccatcgtcttccacctcaacaagcccgagggcgagttcccctacctggccacgcagacgcagttcacgcccgtcccgaaggccaaggacaacggcacgaagtacgaggagcacccgatctcgtcgggcccgtacaaggtcgtcaagaacgagaacgacggcgagcggctgacgctggagcgcaacacgtactggtccgcggcgaccgacgcggagcgcaaggcctacccggccaagatcgatgtgcggtcgggtctcgactcgtccgtgatcaaccagcggctgtcggcgtcccagggcgcggacgccaccgccgtcaccacggacaccaacctcggcccggccgaactcgccaaggtcaccggcgacaaggcgctcgccgcgcgtgtcggcaccgggcacttcggctacaccgactacatcgccttcaacccgaaggtgaagccgttcaacaacgccaaggtgcggcaggcgatctcgtacgccatcgaccgctcgtcggtcatcaacgcggcgggcggatcgtcgctggccgaggcggcgaccacctacctgccgaaccagaagtccttcggctacacgccgtacgaccacttcccggcgggcacgtccggcaatccggccaaggccaaggaactgctgaaggaggccggttacaagaacgggctcacgatctccctcacccactccaactcgaaggacttcgagaccagcccggagatcgcgaccgccgtccaggacgccctgaagaaggccgggatcaccgtcaagctccagggcctggaggagaacgactacaaggacaagatccacagcgtcaagaccgagcccggcttcttcctcgcccactggggcgccgactggccgtccggcggtccgttcctcgccccgatcttcgacggccggcagatcgtcaaggacggcgcgaacttcaacaccggcttcctcgacgacaagtccgtcaatgccgagatcgacgcgatcaacaagctgacggaccttgacgccgccgccaagcggtggggcgcactggaccagaagatcggcgagcaggcgctgaccgtgccgctgttccacccggtctacaagcggctgtacggcagcgccgtcaagaacatcgtgatcagcgactggaccggtgtgctggacatctcgcaggtctcggtgaag

SEQ ID NO: 3078 - DNA, 1548 bp, Streptomyces avermitilis
  CDS (1)..(1548)
gtgggacggcacagccgcaaggggcggggcgacaagggcggcaccggttccgtaccggtgatcccggagccggctcgcggccgcgcgcagaccccggtgcaggcgccgggtgcggacggcgcacaggcgtcggttgccgcgggtgcgcaggcgtcggtccagcgacagccggcgggcggggccgcacagcggccggtgccgcggttcgcggacggtactcccgccaacggtgttccgcggttcgcggaagggactcccgcgcgtggtgtgcccgccgggcctcgcctgccggacgggacccccgctcgcggtgtcccgcgtttcctcgacgggaccccggcgcacggcacgccccgtccgttcgacggcacccctgcccacggcaccccccaagtccgcggcggtcacccccagcagcgtgaacccggcggtggctggggcgagtccggaggcgtacccgccggtgctccgaaggccgcgccgcccggaccgcggcttcccggacagcggcggcaccgcggccttggcccccggcaggactacgtcgacgctttcggcgcggacgaggacgatgtcttcgcgcctcggggcggcgcaggcaaccgcatggacccctacggtcccccttccccgcacgctcctcatgcccacgcccatgcccccgccaccgaccgcgacggccggaccggggccgacaccgaggccgcggccgacgaggagccgggcaaggagaagggtggcaagggccgcacgttcaccggaatcgcggccgccgccgtcaccaccgtgctcgctgtcgtcgtggccggtcaggtcgccgacggacacgacgacaaggccgccgtacagtcgcagtccgccaccgacagtgcccgcgacgcccgcgactccgcctcccgcggtgacgaccggcccaccccctccggatcgcccagcgtggccgcgctgacgtacggccagaagatggccaaggtgtatccgctcggcgccacgctgaaggcggcggggaagttcgacgcgatcggcgggttcgacaaggcgccgggcggggggcggaagtacacgtaccgcgtggatgtggagaagaggctcgggctcgacggcgaactcttcgcgcaggccgtccagaagaccctcaacgacgaccgcagctgggcccacaacggcgcccgcaccttcgagcggatctcctccggcaagcccgacttcgtgatcacgctggccagccccggtaccaccgccgactggtgcgccaaatccggtctcgacacgaccgaggacaacgtgtcgtgcgactcggccgccaccgagcgcgtgatgatcaacgcctatcgctgggcgcaggggtcgaagacctacggattcggtgatcaaattcacgcgtaccggcagatgctgatcaatcacgagatcggccaccgcctcggctacggccacgtcacgtgtggcaaggacggcgaactcgccccggtcatgcagcagcagaccaagttcctcgaccacgacggaatccactgccgggccaacgcctggccgtaccccgggagt

SEQ ID NO: 3079 - DNA, 1035 bp, Streptomyces avermitilis
  CDS (1)..(1035)
atgtcttcgaccgagctgccgcccgtgccggccagcactgtgcttccgagggtggcgcccgtccgggtggcggagggcgagcggctgcggtcggtcgggctgccgggggccacgctgaccgtgcggtcgagaccgccggtgcgcgagggactgccgcccgccctgtgcgtgcacggtctcggaggctcctcgcagaactggtcggcgttgatgcagcgactcgaggggctcgtggacagcgaggcgctcgacctgcccggcttcggggactccccgccgccggacgacggcgactactccgtgaccgggcacgcgcgcgcggtcatccgctatctcgacgccgccggacgcggccccgtgcacctgatcggcaactcgatgggcggggcggtcacgacccgggtcgcggccgtacgccccgatctcgtccgtacgctcacgctggtctcgcccgcgctgccggagatccgggtgcagcgcaccgcggtgccgacggcgctgctcgcgctgcccggggtcgcgcccctgttcacccgtctcaccaaggactggacggccgagcagcgcgtacgtggggtgatggcgctctgttacggggatccggggcgggtcacgccggagggtttccgggccgcggtcgaggagatggagcgacggttcgcgctcccctatttctgggacgcgatggcgcgctcggcgcgcggaatcgtgaacgcgtacacactgggcgggcagcacgggctgtggcgccaggccgagcgagtgctcgcgccgacgcttctcgtctacggtggacgcgaccagctcgtgggatatcgcatggcccggcgggcggcgcgcaccttccgcgactcccggctcctttcgctgccggaggcggggcatgtggcgatgatggagtatccagatctggtggcggaggcggtgcgcgaactgctcgcggacacaggtgagttgggcgagccggcgaaggtctccgacgaggcggccgggtcggccatggcggacgaggccggtactgccggcgcggggagc

SEQ ID NO: 3080 - DNA, 219 bp, Streptomyces avermitilis
  CDS (1)..(219)
atggccatagaccccaccgatcccgagacgttcgagaacgaggtcgacggcgaggccgagctcgatgtcgaggcgccggagggagacgccgcagagcagctcgcggacatcgccccggaggaggacgacccgctgaccgacgtgaacccggaccgcgccaacgaggccgacctggtggaacaggcccgcgtggtctccctcgacgaggacgactaccgg

SEQ ID NO: 3081 - DNA, 639 bp, Streptomyces avermitilis
  CDS (1)..(639)
gtgacagccatcgagcagacagaggcagcgcgcccgcggggcacacgcctgccgcgccgtgcccgacgcaaccagctcctcggcgcagcccaggaggtcttcgtcgcccagggctaccactccgcggcgatggacgacatcgccgagcgcgcgggcgtcagcaagccggtgctctaccagcacttcccgggcaagctcgacctctacctcgccctgctggaccagcactgcgaggccctgctccaggcggtccgcgccgcgctcgcgtcgaccaacgacaacaagcagcgcgtacgggccacgatggacgcgtacttcgcgtacgtggaggacgacggcggcgccttccggctggtcttcgagtccgacctgacgaacgagcccgcggtgcgtgagcgcgtggacagggtcaccgtccagtgcgcggaggcgatctgcgaggtcatcgcggaggacaccggcctgtcgcgggccgagtcgatgctgctggcctccggtctcggcggcctggcccaggtggtggcgcgctcgtggctgcacagcgaccgcagcgtgccgcgcgaccaggcggtgcagctgctgacctcactggcctggcgcggcatcgcgggcttcccgctgcacggcacggacgcccac

SEQ ID NO: 3082 - DNA, 282 bp, Streptomyces avermitilis
  CDS (1)..(282)
gtgctgagtacggcgcggagggccgcgcacatcactgaccgtcggagggacaaagtcgtggaggtcaagatcggcgtgcagcacgcgccccgcgagatcgttctggagagcggtcagaccgccgaggaggtcgagcgcgcggtgtcagaggcgctggccggcaagtcggcactgctgagcctcgtggacgaccacggccgcaaggtcctggttccggccgaccgtctcgcgtacgtggagctcggcgagcccaccacgcgcaaggtgggcttcagcgcgctg

SEQ ID NO: 3083 - DNA, 351 bp, Streptomyces avermitilis
  CDS (1)..(351)
atgatgattgctttccgcacgtcaggggtagaccggctacgaccgatttgcacctgtgtctgtcgtgcgggagggacccccaccatgttcttggaagcgctcggctccgcgattatcggtctcgccctggcctgggcggccgtgtaccggatgccgcatcgcctgcccgcccgcagcatggtcctgtcgacgggagtcgccggagcgctcttcggcgcgtttctcacgcacagcgcgctcggccccggccatgtcctcgtgagcctgatcggcgcggcggtcgtgtccgccgcctcgctgtcgctgctgctccgcccggcggagcgttttcgccgccgctcagcgacggcc

SEQ ID NO: 3084 - DNA, 744 bp, Streptomyces avermitilis
  CDS (1)..(744)
gtgcgcttcatgacgacgcccgacaacgccgctgacacccccgccgaaccgaccggagtcgccgcccaggactgggccaaggcctccgtcgacccccagtaccgcgccgcggtcgtggacctgctcggagcgctcgcctacggggagctggcggcgttcgaacggctcgcggaggacgcgaagctggcgccgacgctcgccgacaaggcggagctggcgaagatggcgtcggccgagttccatcacttcgagcagatcagggaccggctcaccgagatcggcgcggagccgaccgccgccatggacccgttcgtcgccgcactcgacggcttccaccggcagaccgccccgtcggactggctggagggcctcgtcaaggcctacgtcggtgactccatcgccagcgacttctaccgtgaggtggcggcccgcctcgactcggacacgcgctcgctcgtgctcgccgtcctcgacgacaccgggcacgccggcttcgccatcgagaaggtgcgcgccgcgatcgacgcggacccgcgtgtgggtggccggctcgcgctgtgggcgcgccggctgatgggcgaggcgctgtcgcagtcgcagcgtgtggtcgccgaccgtgacgccctgtcgacgatgctcgtgggcggtgtcgcggacggcttcgacctcgccgaggtcggccggatgttctcgcggatcaccgaggcccacaccaagcggatggcggcgctggggctggcggcc

SEQ ID NO: 3085 - DNA, 2277 bp, Streptomyces avermitilis
  CDS (1)..(2277)
atgacgctccccgtggccctttcgggctcggacgtcatcggccaggccaagaccggcaccggcaagacgctgggcttcggccttccgctcctcgagcgcgtcaccgtccccgccgacgtcgaggccggccgcgcccggcccgagcagctcaccgacgcaccgcaggcgctcgtcgtcgtgcccacgcgcgagctgtgcacccaggtcaccaacgacctgctgaccgcgggcaaggtccgcaatgtgcgcgtgctcgccatctacggcggccgggcgtacgagccgcaggtcgaggccctgaagaagggcgtcgacgtgatcgtcggcaccccgggccgcctgctggacctcgcgggccagaagaagctcgacctcaagcacatcaaggcgctcgtcctcgacgaggccgacgagatgctcgacctgggcttcctgcccgacgtcgagaagatcatcaacatgctgccggcccgccgccagaccatgctgttctcggcgaccatgccgggcgcggtcatcggcctcgcgcgccgctacatgtcgcagcccacgcacatccgcgccacggcgccggacgacgagggcgcgacggtccgcaacaccgcgcagttcatctaccgcgcgcacaacatggacaagccggagatggtctcgcgcatactgcaggccgacggccgcggtctcgcgatggtcttctgccgcaccaagcggacggcggcggacctcgccgaccagctccagcagcgcggtttcgcctccggcgcggtccacggcgacctcggccagggcgcccgcgagcaggcgctgcgcgccttccgcaacggcaaggtcgacgtcctcgtctgcaccgacgtcgccgcccgcggcatcgacgtcgaaggcgtcacccacgtcatcaactaccagtcccccgaggacgagaagacgtacctgcaccgcatcggccgtacgggccgcgcgggcgccaagggcatcgcgatcaccctcgtcgactgggacgacatcccgcgctggcagctcatcaacaaggcgctggacctgggcttcaacgacccgccggagacgtactccacgtccccgcacctcttcgaggaactgaacattcccgcgggcaccaagggtgtcctgccgcgttccgagcgcacgcgcgctggtctggcggcggagaaggtcgaggacctgggcgagaccggcggccgcggtgcacgcggtcgcggcggccggccctcgtccgccgaccgggatcgcgaccgcgaccgcgaccgcgaccgtgagcgcaccccgcgccgccgccgtcgtacgcgcaacggcgagaccgtcgacgcggcagcggtgaccccggtcaccccggccgaggcgcccgcggactccgccgattcccccgcgtccacggagccgcgcacgccgcgccgccgtcgccgcacgcgtggcggagcgacgggcgagccggtcgcctcggtgaacgggaccgccgtgaccgaggccgtcgtgaccgaggccgcgcggacggccgtggacacggcggagggcacggaggccgcggagtccgcgaagccgcgccgccgtcgcacccgtaagacggcggagacccccgtcgcagcgcccgaggtcacgcttgaggcgccggccacggacgccgccgaggctccggccgcgccgcgtcgccgtacccgcaaggccgccgagaccgtcgtcgacaccgccgaggccgtcgcgacgacggaggagcccgaggccaagccgcgacgccgtacccgcaaggccgccgaggccgccgtcgacaccgccgaggccgtggcgacgacggaggagcccgaggccaagccgcgccgacgcacccgcaaggccgcggaagccgccgtcgacaccgccgagggtgctgccgcggccgcccccgaggccgtggaagcaccggccgcgccgcgacgccgtacccgcaagacggccgaggccgccgtcgacaccgccgaggccgtggcgacgacggaggagcccgaggccaagccgcgccgacgcacccgcaaggccgcggagaccgccgtcgacaccgccgagggcgttgccgcggagcccaccgaggccaagccgcgccgcacccgcaagaccgcggtggcggccgacgcggagcccaccgaggccaagccccgccgcacccgcaagacggccgtggcagccgaggccgcgatccccgcacagacggccgaggaagcggcggagcccgcgaagccgcgccgccgtacccgcaaggccacagcggccgcggagcctgcggagagc

SEQ ID NO: 3086 - DNA, 870 bp, Streptomyces avermitilis
  CDS (1)..(870)
atgagccgtcctcccaccttcgccccgcccccgggcgtccgcgcgtaccatctcgccaccgctcgcggtgacttcgccgtgctcgacgcgccggcggtcggccctctccggggaaccgctctgctgctgcccggattcaccggcagcaaggaggacttcatcgccctgcacggccccctcgccgacgccgggtaccggaccgtcgccgtggacggccgcggccagttcgagtcccccggcccccgcgacgacgaagccccgtacgcgcaggccgagttggcgcaggacgtactcgcgcagacgcacgcgatcggcgcccccgtacacctcctcggtcactcgctcggcggccagatcgcgcgtgcggcggtgctgctcgacccggcgccgttcgtctcgctcacgctcatggcctcgggccccgcgcagatctccagctcccagcagcagcgcgtgaaactgctgcgcgacgccctcgccgtgatggacctggcccaggtgtgggacgccatgcaggcgatggacgcgccggaggagaccgacaccggcgagctggacgaggggctcgacgaccgcgaggacctgcgccgccgctggctcggcaacagccccgcccagctcatcgcgaccggccgtcagctctgcgtcgagccggaccgcgtcgccgaactggccgccgtcggcctgcccgtccacgtactgtccggcgagctcgacgacacctggccgatcactctcctggacgacatggccacccggctgggggcccagcgcaccgtcgtacgggacgccgagcactcccccaacacggaccagccgctcaccacggcccgcgccctcgccgccttctgggaccgcagccgaacgacg

SEQ ID NO: 3087 - DNA, 894 bp, Streptomyces avermitilis
  CDS (1)..(894)
atgaacgacgaccacgcggcgctcggcgcccgcatcgaccgtacgaacgagctgctccagcgcatgctcgccgaggtggcgaagacgccctcgactcatgcgatcttcgttgacgccggctatctgtacgcggccgcggggcggctcgtcgccgggaccgaggaccgccgggcgttcgagctcgacgccgaggggctgatcgaggccctcatcgacaaggcgcgcacgatcttcgcggacagccggctgctgcgggtctactggtacgacggcgcgcggcgccgcatccacacggcggagcagcagtcgatcgcggaactgccggacgtgaaggtgcgcctcggcaacctcaacgccaacaaccagcagaagggcgtcgattcactgatccgtacggatctggagtcgctcgcccggcaccgtgccatcagcgacgcggcgctcctcggcggcgacgaggacctggtgtcggcggtcgaggcggcgcaggggtacggggcccgtgtgcacctgtggggcatcgaggccccggagggccgcaaccaggcggagcccctcctctgggaggtcgacagccagcgcaccttcgacctcgacttcttcaagccgtatgtgtcccggcggaccgccgccacgtacgacgcgtccgcggcgatcaggcccacccgggaggacgtgcgtttcgtgggcgcgcagattgccgcgaagtggctggcggcacgcgggcgggaggcgctggtggagctgctgcccgggcacccgtatctgcccggttcggtggaccaggacctgctggtggaggcggagggcctgttgcagtactcgctccgtgggcaggcggatctgcggcgggcgctgcgggacgggttctgggagcaccttcaggcgcagtac

SEQ ID NO: 3088 - DNA, 174 bp, Streptomyces avermitilis
  CDS (1)..(174)
atgaccagacgaagggagaagcccttgcgcttcgaaatcatgcgactcgacgatgtcgacggtacgcccgtggacagcactgtcgtagacgccgcctccgtcaatcggatcgttcagcaggccgccgccatcgggcagcgactgtggatccgcccgaccgaatcgtccgcttcg

SEQ ID NO: 3089 - DNA, 603 bp, Streptomyces avermitilis
  CDS (1)..(603)
gtgttcgacgtcgccgtcttcggctcactcttcctcaccctcttcgtgatcatggatccccccgggatcaccccgatcttcctcgcgctcaccgccggccggcccgccaaggtgcagaagcggatggcgttccaggccgtctgcgtggccggtggagtcatcaccgtcttcgggttgctcgggcaccagatcctcgactacctgcatgtctccgtgcccgcgctgatgatcgccggcggactgctgctcctgctcatcgccctcgacctgctgaccggcaagacggacgagcccaagcagaccaaggacgtcaacgtcgccctcgtaccgctgggcatgccgctgctcgccggccccggcgcgatcgtctccgtgatcctggccgtccagaaggccggcagtgtggcgacccaggtgtccgtgtgggccgcgatcctcgcgatccatgtcgtgctgtgggtggtgatgcggtactcgctgctgatcatccgtgtcatcaaggacggcggcgtcgtgctggtgacgcggctcgcgggcatgatgctctccgcgatcgccgtgcagcagatcatcaacggggtcacccaggtgattcgggggagc

SEQ ID NO: 3090 - DNA, 864 bp, Streptomyces avermitilis
  CDS (1)..(864)
gtgcgcatcgatctgcacacccactccaccgcctccgacggtacggacaccccggccgagctggtgcggaacgcgggcgccgcaggtctggacgtcgtcgcgctgaccgaccacgacagcacccgcggacacgcgcaggcgatcgcggcgcttcccgaggggctgaccctcgtcacgggcgccgaactctcctgccgcctcgacggcatcggcatgcacatgctggcctacctcttcgaccccgaggagcccggactgctcgccgagcgtgagctggtgcgggacgaccgggtgccccgggcccagggcatgatcaccaagcttcaggagctgggcgtgccggtcacctgggagcaggtggcgcgcatcgcgggcgacggctccgtcgggcgcccgcacatcgcctccgcgctggtggaactgggtgtcgtggagagcgtctcggacgcgttcacgcccgagtggctcgccgacgggggccgggcgtacgtcgagaagcacgagctggacccgttcgacgcgattcggctggtcaaggccgcgggcggggtcaccgtcttcgcgcacccggccgcgtcgaagcgcgggcggaccgttcccgagagcgcgatcggggaactggccgcggcggggctcgacggcatcgaggtcgaccacatggaccacgagccggcgacgcgcgcacgactgcgcgggctggcggccgacctggggatcctcgccaccggctcctccgactaccacggcagccgcaagacctgtgtgctcggcgagttcaccacggatcccgaggtgtacggggagatcacccggcgggcgacgggcgcgttcccggtgccgggtaccggcggaagccacttcgcc

SEQ ID NO: 3091 - DNA, 639 bp, Streptomyces avermitilis
  CDS (1)..(639)
atgaggggcgaacccagttgcccgaagtgtggtggccgggtcagggctcccggcctctttgccgactcctggcagtgtgatgtgcatggcgccgtgtatccgttgcagcccgtgatcccgcccagcgtcgaggccctcggtgtcgtggtgcaccgtgcccaggtacccgtgtggatgccctggccgctgcccgtcggctggctgttcacgggtgcgggctgcgcgggtgacgaccgcagcggcgggcgtgcgacggccgtggcctgctcggggcccggtccgctcggcggcataggggagctggtcctcgtcgccgaggaactcggcgtcggcctcggcgcgcggtacgcgggcatcgacggacccgatccgggcccgtacatcgatgtcgagaagccgccccaggcgaaggtgctggccgccggtcggccgaccccgctgtggcatgtctccggcacccccgacgaccgtgccgtcttcgcgggcgaggcgctcgggctgtggctgtgggcggtcgtgtggcccgagcagtcggggctgctgatgtacgacgaactggtgctgacggatctgcgggacgcgggtgcggagatggatctgctgccgtgcggggcactgtcgccgcggctccttgagccg

SEQ ID NO: 3092 - DNA, 186 bp, Streptomyces avermitilis
  CDS (1)..(186)
ttgacgacgaccgtgacgtcgtcccgcgtggcgtgccgccgctccggctccttgatcttcggcgcgaagtacggcgccgccgcgaccgcgaaccaccggacgaagttgcagcccgcgctcgccaccgggcgcggtgcttccgagatgcccgggccggcgcggtgcagaccgcgttgttcacgccga

SEQ ID NO: 3093 - DNA, 582 bp, Streptomyces avermitilis
  CDS (1)..(582)
atggctgatgttcttcctctggtcgaggcccggttgcgtgcggcactgggcgaacccgacgcgcgggccgcggtcaccttcctcggcacggaccgcatcgaagtgctgcgcttcacagcgggggacgtcgtccggtacgcgaccctcggtatgtcggcccagccgatgacggaccccacggcggtcgtcgccgaccaggtgaagggcccgcgcgcggagctcgtcctgtcggtacgcgcaggcggcgccgacaccgacaaggtgctccgcccgctcgccgtcctcgccgcgtccccgcaggtcgagggccttgtcgtggcccccggcgcctcgctcgacgtgggcgaacccctgtggcccggcgctccgttcagctccgtactggtcgccgagtccggcggtctggtcgaggatctggagctggacgagcccgccgatcccgtacgtttcctgccgctgctcccgatgacgccgaacgaggccgcgtggaagcgtgtgcacggggcgcaggcccttcaggagcggtggctcgccggcggaacggacctgcgcgatccgtcacgcagatccgttccgctggac

SEQ ID NO: 3094 - DNA, 1113 bp, Streptomyces avermitilis
  CDS (1)..(1113)
atgtcgatgatccgtgacctccgtgccgcggtccgcccgtcccgtccctcgatgcgcaaggacggcagtgcgtacgacaccacgcgtgacccctcgacgccctccgccgtcgtcgactgcgccatctaccgcgacggcgcccgcgtcgcgaccgaccggccgctcaccccgcacgaggcgatgcgccaggtgcggcgcgacgggggcttcgtgtggatcggcctgcatgagccgacggaagccgaattcgccggtatcgcgggcgagttcgggctgcacccgctggccgtcgaggacgccgtccaggcgcaccagcggccgaagctggagcgctacgacgactccctcttcaccgtcttcaagaccatccactacgtggagcacgaccagctgaccgccaacagcgaggtcgtcgagaccggcgaggtcatgtgcttcaccggccgggacttcttcatcaccgtgcggcacggcgggcagggctcgctgcgggcgctgcggcaccggctccaggacgaccccgagctgctcgcgaaggggccctcggcggtgctccacgcgatcgccgaccacgtcgtcgacggctacatcgcggtcgcggacgcggtgcaggacgacatcgacgaggtggagacggaggtgttctcgccgggccggaagggaacgccgcgcggtacggacgcgggccgtatctaccaactcaagcgtgaggtgctggagttcaagcgggcggtctcgccgctgctgaggcccatgcagctgctgagtgagcgaccgatgcgactgatcgacccggacatccagaagtacttccgggacgtggcggaccacctcgcccgggtccaggagcaggtgctgggcttcgacgagctgctcaactcgatcctccaggccaacctcgcgcaggcgtccgtcgcgcagaacgaggacatgcgcaagatcacgtcctgggcggcgatcatcgccgtaccgacgatggtgtgcggggtgtacggcatgaacttcgagcacatgccggagctgcactggcggttcgggtacccggtgatcatgagcgtcaccgtggtgctgtgtctgggcatccaccgcgccctgaagcgcaacggctggctg

SEQ ID NO: 3095 - DNA, 540 bp, Streptomyces avermitilis
  CDS (1)..(540)
atgacggaacagctgctcgaccgggccctcgtcgaggaggccaccaagaagtccggactcatctgggtccggggcgacggcgcaccggctcccgacgaccgggcgcacggtgtgccgacgcgccctctgtggcacgcgtggcacgcgggtgcggtgtgcctggtcggcgacgggccgggtgagcagccactgcccgggctggtcgacggcgggggcgcgacggtgaccgtccgcagcaaggacaagggtggccggctcgtcacgtggtcggcgaaggtggtggagctggcgccgggttcccccgagtgggcggccgcggtggccgagctgaagggcaagcgcctgaacgcgccggacggcgaggcgatgccggagcgctgggcgcgcgaatgccgggtgctgcggctggaaccgctcggcgacacggccgagctgccgacggactcactggcggcggcaccgctgccgacgcctgcgacgacccgccacccgatcccggcggcactcccccggctgctcctgaagcggcgcaagcgcggc

SEQ ID NO: 3096 - DNA, 762 bp, Streptomyces avermitilis
  CDS (1)..(762)
gtgactgcaattccccagggtcgtacccgcagggccgcactggtgagcgcgacgtgcgcactggtcgtgaccgggacggggctgacggggtgcagtagtagcgatccggacgcgggcacgaacggggtcggcaagctgccggccgagaagatccagagccggacgcgtgcggccgcggaggccgcggacacggtacggctgtcgggcaccgtggtgaccaacggacgtacgtaccggctcgacatgcgcctcaaggaggacggcgccagcgggtcggtcacctcgaagggagcgaccttccggctgctgcgggtgggccggcacctgttcctgaaggcgggcgcggacttctggagccaccagggcggccagggcggcggcggatccagtgacgcgggggacgcggccgcggacaagctcgacgacaagtacgtgaaggtgccgaccggggatccggcgtacaagcgcttcagcggcttcacggacaagagcgtgctgctggacggtctgctcacgctgcacggcaccctggcgacggacggccaccacgatcagagcggcgtccgcacgatccgcatcaccggcgagaagggctccggcggcacgctggacgtctccctggagggcaagccgtatccgctgcgcctggtgcgagcggggggcgcgggcaccctcagcctgacggactgggggaagggcttcgccctgaaggagccgtcgaagaaggagacggtggactacgggcaacagctgccgacgtcg

SEQ ID NO: 3097 - DNA, 1296 bp, Streptomyces avermitilis
  CDS (1)..(1296)
atggtggcaggcgcccccaggatcttcgtctcgcacctctccggtgtccccgtcttcgacccgaacggcgaccaggtgggccgcgtccgcgatcttgtcgccatgctccgcgtcggccgccgtccgccccggctgctcgggctggtggtcgaactgtccacccggcgccgcatcttcctgcccatgacccgtgtgaccggcatcgagtccggccaggtcatcaccaccggcgtgctcaacgtgcgccgcttcgaacagcggcccaccgagcggctggtcttcggtgagctgctcgaccggcgcgtccggctcgtggagacgggcgaggaggtgaccgtcctcgacgtggccgtccagcagcttccggcccggcgggaatgggagatcgaccgggtcttcgtgcggaagggccggagcggggccttccggcgcaccaagggcgagaccctgaccgtcgaatggtccgccgtcaccgggttctcgctggaggaggacgggcagggcgcggagagcctgctggccaccttcgagcagctgcgcgcggccgacctcgcgaacgtcatgcaccacctgtccccgaagcggcgcggagaggtggcgctcgcactggacgacgaccgcctcgccgacgtcctcgaggaactccccgaggacgaccagatcgagatcctcagcaagctcaaggaggagcgcgcggccgacgtcctggaggcgatggacccggacgacgcggccgacctgctcggcgaactgcccgaggaggacgtggagcggctgctgacgctgatgcggcccgacgaagcggcggacgtacggcggctgatggcgtacgaggagcggaccgccggtggcctgatgacgaccgagcccatcgtgctgcggcccgacgccacggtcgccgacgcgctcgcccgggtccgcaacgccgacctgtcccccgcgctcgccgcccaggtgtacgtgtgccgcccgccggacgagacgccgaccggcaagtacctgggcacggcgcacttccagcggctgctgcgcgacccgccgtacacactggtcagctcgatcctcgacgacgatctgcaaccgctcgccccggacgccgcgctgcccgtcgtcgcgggcttcttcgccacctacgacatggtcgccgcgcccgtcgtcgacgagagcggctcgctgctcggcgcggtgaccgtggacgacgtactggaccacatgctgcccgaggactggcgcgagacggagttccacctggacgacgggcccggcgccgacggctcggaggcaccccatggcccc

SEQ ID NO: 3098 - DNA, 594 bp, Streptomyces avermitilis
  CDS (1)..(594)
atggcccctgagcgcgagatccgcgaacgaacggcgtccggggcgatcgccgccacccggccccgtacccggctcgaccagccgaagccgcaacgccgcaggctgctgcccgagtgggacccggaggccttcgggcggctctcggagcggatcgcgcggttcctgggcaccgggcggttcatcgtctggatgacggtcgtcatcatcctgtgggtggtgtggaacgtcgccgcccccggcgagtggcgcttcgacacctacccgttcatcttcctgacgctgatgctgtcgctgcaggcctcctatgccgccccgctgatcctgctcgcgcagaaccgccaggccgaccgcgaccgggtcaacctcgaacaggaccgcaaacagaacgagcgctcgatcgccgacaccgaatacctcacccgcgagatcgccgcgctgcgcatcggcctcggtgaggtggccacccgcgactggatccgctcggagctccaggacctggtcaaggagctggaggagcggtacaccgacggccacggggacggccgcgtcgtattcccggcggagcgtgcgcacggacgtgacgtagacgaccgc

SEQ ID NO: 3099 - DNA, 1131 bp, Streptomyces avermitilis
  CDS (1)..(1131)
atggctacggaagacgcggtgcgtgaagcactggcgacggtgaacgaccccgagatccagcgacccatcaccgagctggggatggtcaaatcggtggagatcggtgcggacggagcggtcgcggtcaccgtgtatctgaccgtctccggctgcccgatgcgcgagaccatcacgacgaacgtgacgaaggcggtctcggcggtcgagggcgtcacgcgcgtcgacgtgaccctggacgtgatgagcgacgagcagcgccgcgagctggcgaccgcgctgcgcggcggccaggccgagcgcgaggtgcccttcgccaagcccggctccctgacccgggtgtacgcggtcgcctccggcaagggcggcgtcggcaagtcgtcggtgacggtgaacctggcggcggcgatggcggccgacggcctcaaggtcggcgtcgtcgacgcggacatctacggccactccgtgccgcgcatgctcggcgccgacggcaggcccacccaggtcgagaacatgatcatgccgccgtccgcgaacggcgtgaaggtcatctcgatcggcatgttcaccccgggcaacgcaccggtcgtatggcgcggcccgatgctccaccgcgccctccagcagttcctcgcggacgtctactggggcgacctggacgtcctcctcctcgacctcccgccgggcacgggcgacatcgcgatctccgtcgcgcagctcgtcccgaacgcggagatcctcgtcgtcacgaccccgcagcaggccgcggccgaggtcgccgagcgggcgggctccatcgccgtccagacccaccagaagatcgtcggcgtggtcgagaacatggcggggctgccctgcccgcactgcgacgagatggtcgacgtgttcggcacgggcggcggccagtcggtggccgacggcctgacccgcacgaccggcgcgaccgtcccggtcctcggctccatcccgatcgacgtccgtctgcgcgagggcggcgacgagggcaagccggtcgtcctgaccgatcccgactccccggccggctcggccctgcgcgcgatcgcgggcaagctgggcggccgccagcgcggtctgtcgggcatgtcgctggggatcacgccccggaacaagttc

SEQ ID NO: 3100 - DNA, 732 bp, Streptomyces avermitilis
  CDS (1)..(732)
gtgcggaccgttggagagcgaggacgcccgtggggggcgggccgctcgggtccgacgagagctaggaggcgtccgggtatggagacgacgagtcgggtgggcgcgcaggcgccggccgcggagggcggacagcagttcccctccgcccggcgcacggtcgacggctacctgctggcgccctttccttggtacggcctcgacgaggcgttcacgggcccgcgctggctgatgcaggtgggcaccgcggccgacggtgcggtggagcacggttcgatcgggcacggcgaggagcccaccgtgcgcggtgagtcgacggaggacaaggagcggttcgcggtcgtggtgaccgtcgcggccaaccccgtcaggcgcagtgccgacggcacgggcctgctcgaggccacctcggtctcctccgcggcctggctcgcgggtgtggggctgttgtccgtcacctggcccggccagatggaccacaccctgcgggacgactggctggaccagcagaccgagacggcgtgggtcctggccgacgacctggccggccccgactggtccacgctgtccctccccgtggacggggtcccctcgtccttccactaccgggagtccgagttcggctgggtcctcgccggctccacccaggaaggcgtccacgtgggcgcgtacgggcgcgggatgagcgcgtacgggctgggcttctcggtgatcaaggacatcgcggcgtacgcg

SEQ ID NO: 3101 - DNA, 444 bp, Streptomyces avermitilis
  CDS (1)..(444)
gtgttcaatgacataggaccgcttgagctggtgacgctcgttgtccttgctgtgctcgtcttcggcccggacaagcttccgaagatgatccaggacgtcacgcgcaccatccgtaagatccgcgagttctcggagagcgccaagcaggacatacgggaggaactcggtccggagttcaaggacttcgagttcgaggatctcaaccccaagacgttcatccgcaagcagctggacaacgacgagctggggctcaaggagatccgcaacggcttcgacctgaagaaggagatggccgaggtcacggacgcggtgcacggccgtgagtccgagacctccgcctcctcctcgtcggccaacggctccgccggcggcacggtcgacatgacgaagaagcgcgagcagctcgaagcggacgagcgcccgcccttcgacgcggacgccacc

SEQ ID NO: 3102 - DNA, 1857 bp, Streptomyces avermitilis
  CDS (1)..(1857)
gtgaagtccccgtcggcgacggggacttcgagttggagcgcccggcttcgacgcgccgggggagcggtccgtccgacgaggtacccaccggcgcgacggcgccggacgcgacggccgaagcggcccaggagacgtctgctgcggctgacctggccgttgccgcgggccccgcgtctgccgatgccgaagtcgcccccgtgccggcggtgtcccgcgtttcgcccgacgccgcgtccgccggtgtggccgacgcgtccgtcgacgcggccgacgcttctgccgccgcggcccacgctcccgccggtgctgcccacacgaccgtcgaagccgagggcgaagccgcccccgcggcggccgtgcccggcaccccggccgatgccccgggcggtgttcccgtcgaccggcccaagccgctgcacgatcccgatccctacagcacccacgcggtacgggcatgcgggggccctgggcagcgggctccgcccgtccagttgcccaggcgaccacgcccgcccaacaggcacgccgcccgagagcgcctcccatgactgcccaggcacatgccgcgccctcgggacaccggacgcacggcgccctgggcaccgacgcatggcgagcccaactgggcggccccgcgtcgccggccgcagccccatgtccgccccctggcaaaactacgacccatgggccgccacctccgcccccgtgcaccagacgaggcaccgcagtcgcgctcccgggaggagcggcgcaagcgcgcgagtcagggtgctcgtgctgggagccgtggtcctcgccctcgtctccggcgggatcggcggagccgtcggcgtgtatctggagcgcaccggcggggtcacggacgtggagctgccgcaggccggccaggagtccgaggagcgggccgcggacagcgtcgcggggatcgccgcccgcgcgctgcccagcgtggtgaccctgcacgtcaagggctccgccgcggagggcaccggcaccggcttcgtactcgacggccgcgggcacatcctgaccaacaaccacgtcgtcgaaccggccggatcgagcggcgagatatccgtgaccttcagcggcggcgagaccgcaaaggccaccgtcgtcggacgggacagcggctatgacctcgccgtcgtcaaggtgagcggggtcggcgggctcaagcccatgcccctcggcaactccgacaacgtccaggtcggcgacccggtcgtcgccatcggcgcgcccttcgacctcgcgaacaccgtcacctcagggatcatcagcgccaaggagcggcccatcaccgccggcggtgagaagggcgacggcagcgacgtctcgtacgtggacgcgctccagaccgacgcccccatcaaccccggcaactcgggcggccctctcctcgactccaaggcccgggtcgtcggcatcaactccgccatccgctccgccgacagcagctccgaccagagcggccaggccggttccatcgggctcggcttcgccatcccggtcaaccaggccaagcgggtcgcggaggagctgatcaacaccggcagggccacccaccccgtgatcggcgtgaccctcgacatggactacacgggcgacggcgcgcgggtcggcacgaagagcaacgacggcgggtccccggtgacgcggggcggccccggcgaccgggccggcatccaggccggggacgtcatcaccgaggtcgacgggcagcgcatccactccggggaggaactcatcgtcaagatccgcgcccaccgccccggcgaccgcctggcgctgaccgtcgaacgcgacggcaaggagaagccggtcaccctcgtcctgggctccgcgtccggggcc

SEQ ID NO: 3103 - DNA, 1002 bp, Streptomyces avermitilis
  CDS (1)..(1002)
gtgagtggaacacggccgaactccgctgagcggcgtattgcggatcagcatctgggagaccgactctctgccctggtggacggggagctcggtcatgagtcgcgcgagcgtgtgctggcccacctggccacctgcgccaagtgcaaggccgaggccgacgcacagcgccgactgaagaacgtctttgcggaagtggccccgccacccccctccgagagcttcctggcacgcctccaggggctgcccgggggaggcgactccgacggcagtggttcgccgctcgacgggggaggcttcggcagaagactgtccggcaggcccggagtccctgggggcgccggggtcttcggagtgaggggtgagacgtctttcggctacgtcccttccgggccgcacgccaccgcgctgtcaccgtccgaggaccgggccctgtccggggaccgtggcttccgcatccatgacgtcagccggcacgaggccgagcggtcggccacgcgcggcatgcggttcgccttcgtcgccgccggagcggtgtcgctggccgcgatcgcgctcggcggagtgtcggcgaccggggtgccgaccgacaccgcggccgacgcgcggggcggatcgggctccggaagcaatgtgacaccgatgcgcactccgggcgccggagccgccacggcgccggagtcccagcgccgtcgctccgtcggcccgctcctcggccagggacagcgctcgctcggcgagaccgctgtcgcgcccaccgaggtgtcggcgccgctgctgcccggagcccccaccccggcggcccggaagctgccggacctgcacacgctgaccgctcccgtggtggccggtgccgccgtgatgtcccccctcatacgtccgctcaccgaggcggcaccggtcgcgctgtcctcatggtcgacggcggcgggtgtcaccgcacccggcctgctcgtcgcgccggacgccacctcgttcccctctcccacctcccccaccgcaccc

SEQ ID NO: 3104 - DNA, 657 bp, Streptomyces avermitilis
  CDS (1)..(657)
gtgaccgacatcgctgacaagcaccacgctgccaccaccgcgcagaccgcgaccttcgccaccgacgcggactcgcaggcgtggactccgcccacctgggaggagatcgtcagcacgcacagcggcagggtctaccgcctggcgtaccgcctcaccggcaaccagcacgacgccgaggacctgacccaggaagtcttcgtccgggtcttccgctccctgtcgacgtacacgcccggcacgttcgagggctggctgcaccgcatcaccacgaacctcttcctggacatggtccgccgcaagcagcgcatccgcttcgacgccctcggtgacgacgcggccgagcgcctgcccagccgcgagccgtccccccagcaggtcttcaacgacgcgcacttcgacgcggacgtccagcaggccctcgacacgctggcgcccgagttccgcgccgcggtcgtcctgtgcgacatcgaagggctgtcgtacgaggagatcgccgcgaccctgggcgtcaagctcggcacggtccgcagccggatccaccgcggacgttcgcagctgcgcaaggcccttgcgcaccgctcgcccgcggcccgcgcggaacgccgttccttcgcggtcacgggtgtgcccgtgctgggaggagggggcgcgtccgcg

SEQ ID NO: 3105 - DNA, 522 bp, Streptomyces avermitilis
  CDS (1)..(522)
gtgtcgccgggcaccggcgcggcactgcggttgctcgccgccaccgtggacgccaaggccgtcgcggagatcgggaccggcaccggagtctccgggattcatctgctgcacggcatgcggccggacggcgtgctgaccaccgtggacccggagccggagcgccagcagttcgcccggcaggccttccgcgcggccggcttcgccagcaaccgtgcccgcttcatcccgggccgcgccctggacgtgctgccccggctcgcggactcgggctacgacctcgtcttctgtgacggtgaccgcctggagtgcctggactatctcgctgaatcgttgcgcctgctgcgtcctggcgggctcgtcgtcttcgagggtgtcttcgcggacggtcgcacggtggactcgggaccgcagcccgctgaggtcgggcggctgcgggagctgctgcgcgcggtgcgcgagagcccggatctggtgccctcgctgctgccggtgggcgacgggctgctgtgcgcggtcaagcgc

SEQ ID NO: 3106 - DNA, 243 bp, Streptomyces avermitilis
  CDS (1)..(243)
gtgtcctaccaacaggcgcgcgtgccctcccatggggccgtcggcgacgatgagctggtttcaggaaggggaacgagcatggcggccatgaagccgcggacgggcgatggcccgctcgaggtgaccaaggaggggcggggcatcgtcatgcgagttccgctcgaaggcggcggtcggctcgtcgtcgagctgaccccggacgaggcggacgctctcggcgacgccctcaagaaggtcgtcggc

SEQ ID NO: 3107 - DNA, 801 bp, Streptomyces avermitilis
  CDS (1)..(801)
atggccgacaccgtgctctacgaggtgagcgacgggctcgcgacgatcacgctgaaccgccccgaggcgatgaacgcgatgaacatcgcgaccaaggtcgccttccgggacgcggcgcggacagccgccgacgacgaagccgtacgggcgatcctgctcaccgcggccggcgaccgggcgttctgcgtgggccaggacctgaaggagcacatcgggctgctggcctcggacaagcagtccgggtcggggcagacgatgagcaccgtgcgcgagcactacaacccgatcgtgcgggcgctgaccggcgcggcgaagccggtggtggcggcggtgaacggggtcgcggccggggcgggtttcggtttcgcgctcgccgcggactaccggatcgtggcggacacggcggccttcaacacctcgttcgccggggtcgcgctgaccgccgactccgggatctcctggaccctgccgcgcgtcatcggcccgagccgcgccgccgacctgttgctcttcccgcgcagcatcaccgcgcaggaggcgtacgagtggggcatcgcgaaccgggtggtccccgccgccgaactgcgcgccgaggcacagaaggtggcgcggtccctggccgaaggcccgaccgtggcgtacgcggcgctgaaggagtcgctcgcctacgggctctcccacaccctggacgagaccctggagaaggaggacgaactccaggcccgcgcgggcgcgtccgaggaccacggcatcgcggtgcaggcgttcgtgaacaaggagaagccgaagtatctggggcgg

SEQ ID NO: 3108 - DNA, 579 bp, Streptomyces avermitilis
  CDS (1)..(579)
gtgagcagcggtgccctggccggctcggacggcgtgctgcgctgcccgtgggccctgtcgaccgaggactacgtggcgtatcacgacgaggagtggggccgcccggtccacggcgacgacgcgctgtacgagcggctgtgcctggaggccttccagtcgggcctgtcctggatcacgatcctgcgtcggcgggaggggttcagagccgccttcgccggcttcgagatcggcaaggtggcggacttcacggacgccgacaaggagcgcctgctcgccgatccgggcatcatccgcaaccggttgaagatcgaggcgacggtcgccaacgcgcgcgtgctggccgactggccggccggtgaactggacgagctgatctggtccttcgcccccgatccggccgcccgccccgtcccgaggaccctcgccgacgtgccggcggtcaccgacgagtcgacggccctctccaagaccctcaagaagcgcggcatccgcttcatcggcccgacgacggcgtatgccctgatgcaggcgtgcgggctggtcgacgaccacctggcggactgcgtggcccggagccac

SEQ ID NO: 3109 - DNA, 354 bp, Streptomyces avermitilis
  CDS (1)..(354)
atgttcatgttcattttcctggtcgtcgcgctcgtcgtcgtggtcgccgcggtgacactggccgtggtgggcggcggcgagagcgccccgctgcccgaggcggccgccgagcggctcgacgaccccctgcctccggaccggcccgtgaaccgcgcggatgtggaggccctgcgcttcccgctcgccccccgcggctaccgcatggcggacgtggacgacgccctgggccgcctcggcgccgagatcgccgagcgggacgcccgcatcgccgatctggagtccgccctcgccggggctcggacggccagggtctccatggacaagcccgtcgagggggaccagggggaccaccag

SEQ ID NO: 3110 - DNA, 858 bp, Streptomyces avermitilis
  CDS (1)..(858)
atgctcaggctgggcaagcgtgaattcggcactcacgagccggtgatcatggcgatcgtgaaccggaccccggactccttctacgaccagggggcgaccttccacgacgaggccgccctcgcgcgcgtggagcgggcggtgtcggagggtgccgcgatcatcgacatcggcggcgtcaaggcgggtcccggcgaggaggtgaccgccgaggaggaggcacggcggacggtgggattcgtcgccgaggtgcggcggcggcacccggacgtgatcatcagcgtcgacacctggcggcacgaggtcggtgcggcggtctgcgaggcgggcgcggatctgctcaacgacgcgtggggcggggtggatccgcggctggcggaggtggcggcgcggtacggggtggggctggtgtgcacgcacgcggggggctctcagccgcggacgcggccgcaccggatcgcgtacgacgacgtcatggccgacatcctgggggtcactctcgggctggccgagcgggcggtggaactgggcgtgccgcgtgagtcggtgctcatcgaccccgggcacgacttcgggaagaacacgcggcacagcctggaggcgacgcggcggctgggcgagatggtcgagacgggctggccggtgctggtctccctctccaacaaggacttcgtgggcgagacgctcgacaagccggtgaaggagcgggtgttggggacgctggcgacgaccgcggtctcggcgtggctcggggcgcaggtgtaccgggtgcacgaggtggcggagacgcggcaggtactggacatggtcgcgtcgatcgcggggcaccggcccccggcggtggcccgtcgggggctcgcg

SEQ ID NO: 3111 - DNA, 756 bp, Streptomyces avermitilis
  CDS (1)..(756)
atgcctactggcaacccggagggcaagaagcagccaccggaggagcagcggctgggccccgtgctgcgcaggcgggaccaggtgcagtcgagcacgacggaccagcggctgctcgacgcgggcggcccctcggactgggtgcacaccgacccctggcgagtgctgcgcatccagtcggagttcatcgagggcttcggcacactggccgaactcccgcccgcgatcagcgtgttcggctcggcgcgcacgaaggaggactctcccgagtacgaggcgggagtgcgtctcggccgcggcctggtcgaggcgggctgggcggtgatcacgggcggcgggcccggcgccatggaggcggccaacaagggcgcctgtgaggcgaagggcatctcggtcggcctcggcatcgagctgccgttcgagcaggggctgaacccgtacgtcgacatcggcctgaacttccggtacttcttcgtccgcaagatgatgttcgtgaagtacgcgcagggcttcgtcgtcctgccgggcggcctcggcaccctggacgagttcttcgaggcgctgaccctggtccagacccagaaggtcacgcgcttcccgatcgtcctcttcggtacggagtactggggcggtctcgtggactggctgaagcacacgctggtgggccaggggaaggcggccgagaaggacctgctgctgttccacctgacggacgacgtggacgaggcggtggggttggtgtcgaaggaggcggggagg

SEQ ID NO: 3112 - DNA, 1077 bp, Streptomyces avermitilis
  CDS (1)..(1077)
atggccgataccccgcttgacctcacgctggacgccgccgagctcaccgcccggctcgtcgacttcccctcggagagcggcagcgagaagccgctcgcggacgccatcgaggcggcgctgcgtgccctgccgcacctcacggtcgaccggtacggcaacaacgtcgtggcccgtacgaacctcggccgcgccgagcgcgtgatcctggccggccacatcgacacggtcccgatcgcggacaacgtcccctcccgcctcgacgagaacggcgtgctgtggggctgcggcacctgtgacatgaagtcgggtgtggcggtgcagctccgtatcgcggcgaccgtccccgaccccaaccgcgatctcaccttcgtcttctacgacaacgaagaggtggcggcacatctgaacggcctcaagcatgtggccgaggctcaccccgagtggctggccggtgacttcgcggtcctcctggagcccacggacggtcaggtggagggcggctgccagggcacgctcaggatgttcctcaggaccgagggggagcgggcgcactccgcgcgcgcgtggatgggctcgaacgcgatccacgccgcggccccgatcctggccaggctcgccgcgtacgagccgcgccggccggtggtggacggcctccagttccacgagggcctcaacgccgtccgcatcgagggaggcgtggccaacaacgtcatccccgacgcctgcacggtcgtcgtcaacttccgctacgcgccggaccgcaccgaagaggaggcggaggccttcgtacgcgcgtacttcgcggactgcggcgtgacggagttcatcgtcgacgaccacacgggcggggcccgccccggcctgacccacccggcggccgcggccttcatggcggccgtcggcggcgaggcccgccccaagttcggctggacggacgtcgcccgcttcagcgcgctcggcgtgcccgcggtgaactacggtcccggcgcccaactgctggcccacaaggtggacgagcgggtcgaggcggccgtgatccctcaggccgaggagcggctgcgggcctggctgacgtcc

SEQ ID NO: 3113 - DNA, 861 bp, Streptomyces avermitilis
  CDS (1)..(861)
gtgcagtacgtcaccggcggcccgggcgcgacgagctgcaaggtcgtctcggacgagcgcgacggcgcgtcgtacgagttcaccccggagcaggcggtgaacgcggcgacgatctcggcggtcggcgccacgcgcggcatgccggagcgcgccgtcacgatcgccctcgcgaccgcgctccaggagtcggggctgcgcaacatccggcatggcgaccgggactcgctgggactgttccagcagcggccctcgcagggctggggcaccaagaaacagatcatggatccgacgtacgcggcgggtgtgttctacgagcacctggccaaggtgagcgactacacacagctgcggctcacggtggccgcgcagcgcgtgcagcgcagcggttacccggaggcgtacgcgaagcacgagccggacgccacgctgctcgccgccgccctgaccgggcactcggcggccacgctgacctgcgagggccgcccggcgccggcccggacgggcggcacggacgcggtgcgggccgcgctcgtacgggacttcggacgcgatgtgctgcagtcggccggcgcggaggtgagcaccgggacgccgtcgccctcgccgtccccgaaggccacggcggcccccggcgccgtcaccgtcccggtgccgaggaggacggccgccgagggcagtacccggcagcgcggctgggcgctggcgcactgggccgtggccaacgcgtccgcgctgcacatcgcccacgtctcctatgcgggccgcgagtggtcgcgtggcggttacgcgaacgaatggcgtacggccggggattccggagcgaagacgtccaccgccgaagtccggatagtcgccgggcag

SEQ ID NO: 3114 - DNA, 447 bp, Streptomyces avermitilis
  CDS (1)..(447)
atgtccctccccctgacccgccggatcgcccgtgccgcgctgctcgtcgcagcgggagcggcagccggggtcggtgcggccggctccgccagcgcggctcccgaactgccgacggcccccaacctcggcggcctgaccgcattggacggcgcgcacgccgccgacaccgtcgacggtgcggctcagaatgtcaccgggctcgcgggcagcaccggcagcaaggcggtcaagaaggcggtcccggccgtgggcaagaccggtgggaaggtcgccaggacggcgacgccggccgcccagaaggtggccggggacgcggcgggccaggccggcggcctgctcggcgacaccgcgaagacggcgtccggtggcggtctgccgacggacgcggtcaccaagggcggtctgccgacccagcagctgccgctgaagggcggcctgccgctcggc

SEQ ID NO: 3115 - DNA, 1092 bp, Streptomyces avermitilis
  CDS (1)..(1092)
gtgtccgcagtctccgaccgccttccgacctttccctgggacaagctggagccgtacaaggcgagggccgcggcccacccggacggcatcgtcgacctgtccgtcggcacgccggtcgacccggtgcccgagctgatccagaaggcgctggtggccgcggccgactccccgggctatccgaccgtctggggcacgcccgagctgcgggacgccctcacgggctgggtggagcgccggctgggcgcgcgcggcgtcacccaccaccacgtgcttccgatcgtcggttccaaggaactcgtcgcctggctcccgacccagctgggcctgggccccggggacaaggtcgcccacccgcgccttgcgtacccgacctacgaggtcggcgcccgcctcgcccgcgcggaccacgtggtctacgacgacccgacggagctggacccgaccggcctgaagctcctctggctcaactcgccctcgaacccgaccggcaaggtcctctcgaaggcggaactcacccggatcgtcgcctgggcccgtgagcacggcatcctcgttttctccgacgagtgctacctcgagctgggctgggaggccgacccggtctccgtgctgcacccggacgtgtgcggcggctcgtacgaggggatcgtctccgtccactcgctgtcgaagcggtcgaacctggcgggctaccgcgccgcgttcctcgccggtgatcccgcggtcctcggcccgctgctccagatccgcaagcacggcggcatgatgacgtcggcgccgacgcaggcggccgtggtcgccgcgctgggcgacgacgcccacgtccgcgaacagcgcgagcgctacgcggcccggcgcacggccctgcgcgacgcgctcctgtcccacggcttccgcatcgaacacagcgaggcgagcctgtacctgtgggccacgcggggcgagtcctgctgggacacggtggcgcacctggccgacctgggcattctggtggcccccggcgacttctacggctcggcgggcgagcagttcgtacgggtggccctgacggcgaccgacgagcgggtggcggcggcggtacggcgcctggcg

SEQ ID NO: 3116 - DNA, 318 bp, Streptomyces avermitilis
  CDS (1)..(318)
gtgacctacgtcatcgcagagccttgtgtcgacgtcaaggacaaggcgtgcatcgaggagtgcccggtcgactgcatctacgagggctcccggtccttgtacatccacccggacgaatgcgtcgactgtggagcctgtgagccggtgtgcccggtcgaggcgatcttctacgaggacgacactcccgaagagtggaaggactactacaaggcgaacgtcgagttcttcgacgagctcggctcgcccggtggtgccagcaagctggggctgatcgagcgcgaccaccccttcatcgcggcgctgcccccgatgaaccag

SEQ ID NO: 3117 - DNA, 1371 bp, Streptomyces avermitilis
  CDS (1)..(1371)
gtggaaatctctgcgggcggacagctcgaagtccgtatcaccactgctgacgtgggaaaacgcgtctccgtgcggcggtggaacgaagatgtcgcggggggtgagaagttcaccgacacggtcggagttctcacatcatgggacaacggagtgttgctgatcacacggcggggcggcgaaagcgtccggatagcggagtcctcgctggtcgcgggcaaggtcgtaccggccgcaccggcgcgtcggcggggtcccgcggcctcgtacgaggagctggcgcggatcgccgcgcgggcctggcagccggtggagcgcgaacggctcggcgactggcagctgcgggcgtccgccggcttcacccgccgggccaactccgtcctgcccgtcggcgagccgggactgccgctggacgaggcgctgaccgtcgtacgggactggtacgcgggccgtgagctgccggcgtacatccagaccgcgaccggggccgagggcacgcaggagctgctgtgcgcggagctggaggcgcgcggatggacgcgtgaggtgacggccgagctgtggatcggcgcgctggcgccgctggccgaccgggaggtgtccgccgaggtggtgctgtcccgcgaggcggacgaggcgtggctgagccgctaccagcgcaaggggctgaacgaggtcgcgctgaaggtgctgggcagcgggccctccgtctggttcgcgacggtgccgggggccgcgggccgcgctccggccgcgatcgggcggtgcgtggtggacgggcgctgggcgggtttcgcggcggtcgaggtggaccccgcgcagcggcgccgtgggctggccaccgcggtgatgacggccctggcccgccgggctctggaggagggcgcctcggcggcctggctccaggtggagacggacaacgcggcggcgcgggcgttgtacgcggggatgggattcgcgacgcatcacgcgtatcaccactatcggtgggcgtctgagagcgatgtgcggggcgagctcgggggccgggagcgtggtgcgccgggtgaggccggtgtgtcgggtgaggctggtgtgccagatgaggctggtgcgcccagtgaggccggtgcgccgagtgagagtggtgcgccgagtgaggccggtgcgccgagtgagagcagtacggctggtgagagcggtgcgctgggcgggagcagtgcgcctcgcgggatcagtacgccggatgtgagcagtgcggctggtgagagcggtgacgaggtgtgtggcggttcgggggccgggtcggtcggcgggccgggcagtggtccgcctggcgcatcgggcggcggctcgggcgatgctgtggacggcgtcggaacgtatcgatcggta

SEQ ID NO: 3118 - DNA, 870 bp, Streptomyces avermitilis
  CDS (1)..(870)
atgaacgggcacgaggctgctatgcgtcccccacaccccccggaaccggagcgggccgccgagctgcggcggcggttcgccgatgaggcacggtccgagcggcccgatctgtcggcgttgtgtctgctcgtgggcgcggcggcggacggggcgctggacgaggccgggatcgacgcggcacagatcgacctcgaccggctcgccggacaggtgccgttccggcccggcgggccgcggccttgggccctcgcgctcgccgagctgctcggcgggcgctgcgggttccgcggtacgcccgcggactaccagcggctggagtcctccctgctgcacgaggtgctgcggcgccggcgcggcctgcccatcctgctgtcggtggtctggatggaggtcgccaggagagcgggcgcacccgtgtacggggtcgcgctgccggggcacttcgtcgtcggattcgggccccccgagcagcaggtgctggccgaccccttcgacggcggccgggtgctgaccggcggcgacgccgaactgctcgtcgcgggtgccacgggcgccccgctcgacccgtcgatgctcacgccggccgacccgctcgacgtcgtgctgcgcatcctcaacaacatccgcgcgtgggcggccgcacgccccgaacgctcggacgtcgcgctctgggccgtcgacctctccctgctgctcccctcccaccccgcccgcctgcgctacgaccgcgcccaactgctcgtcgagcggggggacttcctgaccggagccatggagctggacgcctacgcggaggtggtcgaggccgtcgacgggagcgccgccgaccggatccgtcaccaggcccgcgcggcgcgctcgatgctcaac

SEQ ID NO: 3119 - DNA, 612 bp, Streptomyces avermitilis
  CDS (1)..(612)
atgagccgcacgatcaaggtcctgctcgccgaggaccagtcgatggtccgcgaggcgctggccgccctgctcggcctcgaacccgacatcgaggtcgtcgcccaagtcgcgcgcggcgacgaggtgctggcggcggcgcgcgagcacgccgtggacgtggcactcctggacatcgagatgccgggtgccacggggatcgaggcggcggcgcaggtgaaccgggagctgcccgcggtgaaactggtcgtcctcaccacgttcggccgccccggctatctgcgcagcgcgatggaggccggcgccgacgcgttcctggtgaaggacgcgccggcggcccaactcgccgaggcggtacgcaaggtgctggccggggagcgggtcatcgaccccacgctggcggccgccgcgctcgccgggggcgccaatccgctgaccgaccgcgagcgcgaggtgctgcgcgcggcggccgacggcgcgacgaacgcggagctggccacggccctgcacctgtcccagggcacggtccgcaactacctgtccaccgccatacagaaactggcggtccgcaaccggacagaggcggtacggacggcgcgggacaagggctggttg

SEQ ID NO: 3120 - DNA, 1155 bp, Streptomyces avermitilis
  CDS (1)..(1155)
gtgcgcacggggcagtcaccgcgcaacgtgcgcgaggcgctgcgcaaggcgatgtggatcgtcatctggctggtgttcctcagctcaccggtccacgacctggcctccggccaccacacgcccgccgccaccgcggccggctggctcggcctcgcggccttcgtcgggatctatctgacgctggtcttccggaacatgggcagggcgttgaacggcccggccgtcgccgccctcgtcgtcgccctcggcgtgctcgccgtcgtgctgtgcctgtccctcggcccgtcctggctgggcctcttcgtgtacgtctccgtggcctgcgggacgacgttcccgctgcgggtggcgtactggacgatccccctgaccgccgtcgcgatgctgctcgtcggcctccacggcggtgagcaggacgcgcgcaacctcgtcctcctcgtcgtcctcatcggcttcgcgatgaccggcgtacggcaactggtccgtacgacggtggagttgcgcaaggcgcgggcgaccgtcgcccagctcgccgcgaacgaggaacggctgcggctggccagggacctgcacgacctgctgggtcactcgctctccctgatcacgctcaagagcgagctggccgggcggatgctccccgaccaccccgagaaggcggcccagcaggtcgccgacatcgaacaggtcagccgccaggccctcgtcgacgtccgcgaggccgtcaccggctaccggcggccccggctggccggggagctcgcgggcatgcaggtcgcgttgaccgcggcgggcgtcaccgccgacctgccggctgaaccggacctcgacggcgtccccgaggagagcgagtccgcgctggcctgggcgctgcgcgaggcggtcaccaacgtcgtacggcacagcggggcccggcgctgcgtggtggagctcgtccaccgtcagacgctggacggtccggtgctcgaactgtccgtggaggacgacggttcgggcggctccggcagcacccccggcaacggccttacgggactgaccgaacgcctggagaaggccggcggatcgctggacgccggccgcgtgcgacgcgggttccggctggtcgcgcgggtaccgatggcatccgcccgggggcccgtgggcacggcggggaccccg

SEQ ID NO: 3121 - DNA, 756 bp, Streptomyces avermitilis
  CDS (1)..(756)
gtgacgaacatcttcgcttcgtggggtctcatcaaactggagatcgtccgcgccctgcgcaaccgcaagttcctgttcttctcggtgatctacccctcggccctgttcctactgatcgcgggcagcgccgacagcacgacgaaggtggagggcacgggcctcagcctcccgaccttcttcatggtctcgatggcgtccttcggcgccctgaccgctgtcctgatgggcaacagcgagcgcatcgccaaggagcgcgagagcggctgggtgcggcagctgaggctgaccacgctccccggccggggctatgtcctcgcgaagaccgccagtgccgcagtgatcagcctgccgtcgatcctgatcgtcttcgtggtcgcggcggccgtgaagaacgtccgtctggacgcctggcagtggctcgcgctcaccggcacgatctgggtcggcagcctcgtcttcgccgccctcggggtcgccatcggctatctggcgaccggggacgcggtccgcccgatcacgatgatcgtctacttcgggctgtcgatgctcggcggcctgtggatgccgacgacgaccttccccgactggctccagtccatcgcgaagtggctccccacgcacgcgtacgctgccctcggacaggccatagagctgggcaacgccccgcaagccaaggacatcgccatcctcgccgtctccttcgtcctgttcgcgggcggagcggcgtggctgtaccggaaggacacgctgaaggcg

SEQ ID NO: 3122 - DNA, 906 bp, Streptomyces avermitilis
  CDS (1)..(906)
gtgaccaccggctcggtggtcgcgttcgaccaggtgacgaagacgtacggcgacgtccgggccgtggacgggctgacactcgccctgcacccgggcgagacggtggccctcctggggcccaacggcgcgggcaagtcgaccacgctggacctcctcctcgggctcaagcacgcggacagcggcacggtccggctcttcggcggcagcccgcgcgaggccatcgtcgccgggcgcgtcggcgccatgctgcaaagcggcgggctgatggacgaggtcaccgtcggcgagctggtgaagctcgcctgcgacctgcaccccaagccgttccgcgtcaccgacgtgcttgcccgcgccggtgtctcgcagatcgcggatcgcaaggtcaacaagctctccggcggccaggaacagcgcgtccgcttcgcgctcgccacggccggggacaccgacctgatcgtcctcgacgaaccgaccaccggcatggacgtcaccacccgccacgccttctgggccaccatgcgcgaacaggccgaccagggccgtacggtcctgttcgcgacgcactacctggaagaggccgacgccatcgcggaccgcgtcctggtcctgcaccggggccggctgctggccgacggcaccgccgccgagatcaaggcgaaggccggcgcccgccgggtctccttcgacctggagggcccgatcgacgaggccccgctgcgtgccctgcccttcctgacctccgtcgacatatcgggtcacacgatccgcatccagtcgaccgacgccgacgcgaccgtgcacgcgctgtacgggctcggggtcttcccccgcaacctcgaagtcgccgggctcgggctcgagcaggccttcgtcgccatcaccgccgccgaggagtcgaagtccaag

SEQ ID NO: 3123 - DNA, 2277 bp, Streptomyces avermitilis
  CDS (1)..(2277)
ttgagtcgtgaaactgacagttcgtccgccggacccaacggccgcggcggagccgcgtacccgtccgggacgccgccgtacgggacccccatggcttccgaagacggtgtcgatgcgggccgtccggccgcaaagtccgacgaacgcaagaccgagaccacgctgacgacccggatccggatcaacatccccggatcgcggcccatcccgccggtcgtcatgcgcacgcccgtcgtggacgccgaggccgccgaggacgccccggccgccgaggccccggcgccgggccccgtgagcgcgatcagcacctacgacgttcccgccgaggcctccgcgccgcccgggccggccgcgcccgccgggcctgccgcgccggccgaggagaagaccagcgactggttcgcgccgcgcaagtccggtgcccccaaggggcagccgggcggcgggtcgaccaacggcgccggtctccccacgggttcgggtgcgcagggcgcgcccggccagggagcgccgggcggcggcggtccgcggccgggtgctgcgggcggtccgggagccggcggtccgcgtccgggtgcgtcaggaccgcgccccggcggtgcgggtggttccggacctctgggtgcccgcccgaacgggcctgtcccgggcggccagggcggccagggcggtacgaacggtgccgggctgcccggtgccaccggtgccggacccgtcgcgcccggccacggcggcggcaccggctccttcgacgtgtccgaggcggtcgcggccaccacgggctccttccccctccccgttgtcggctccgacaacggcgcggaaccgcgccgcgacaacctgccgtacttctccgagaacgaccggcgcggcccctccggcccgaccggcggtcccgtcaccggcgacggcccggccgtgccgcccaggggacccggcggccccggtctcggcgccccggggatgtcgagcccgggcggccccggcctcaccgctcccggcaccgggccccgcggccccgtcggacccggcgccccgagcacccccggagcccctggcggccccggccgtagcggcggtctcagcgacgacaccgcgatcctcaccccgcagcgctttgcgcccgacccggatatgcccggctacggcggccccggcgacaacgtctccgggcacaccgtgaccagcggcatccccgtggtgccgtccggcggccagaactcgccgttcggaccgggcgcgcacaccgacggaccggtgccgcacaccccgccgaagctgcccgctccgtccgagccgaagacggccacctcctcgaagccggccaagaagaagggccgcagcaagctggtcctgctgggcgtcggcgtggtcttcatcggcggtgtcgtctacggcgccgggctgctgatgaaccactcggacgtgccgaagggcaccaccgtgctcggcgtcgacatcggcggcggcacccgcgacgaggccgtcaagaagctcgacgacgccctggggggccgtacgggcaaggcgctcaagctgtcggtcgacggcgacaccgtctccctcaagccggaccaggcgggcctccagctggacagcaaggccaccgtcagcgccgccgcgaacagcgactacaacccggtgtcggtgatcggctcgctcttcggacagcagcgtgtcatcgagcccgtgatgcccgtcgacgaggagaagctgcaggccgccctggagcgcgccgcgggcggcgccggctcggcgagcgacggcaccatcaagttcacgtccggcaaggccgtcgccgtgtacggcaaggcgggcaagggcatcgacgtcgcccaggccacgaaggccgtcgaacaggcgtaccgcacacaggtggagagcgacaccagcacgcccgtgaaggtgcccacgaccaccaaacagccgacggtctcgaacgccgaggtcgaccggatgatgaagaagttcgcgaagccggcgatgtccgccaacgtgacggtgcagacggacgccgcccacgcgatcgcgttcagcccgcagaactccctgtggaagttcctcggcgtgaaggccgtgaacggcaagctcgtcgaggcgtacgacagggcggcgctgaagagcctctacggcaacacgttcgacggcgtcctcgtcacccgcggcaccggcaagaagacggcggtgacggtggaggacgtgatcagcgcgctgcgtccggccctgctcaccacgaacggcgccgcgcggaccgcggtcatcgacacggacccgagc

SEQ ID NO: 3124 - DNA, 417 bp, Streptomyces avermitilis
  CDS (1)..(417)
atgagtacgacgggcagacagcagagcgcgctcgcgcaaccggtgacgttgccctcggccggccgggcagccgcctacctgggcctcttcctgctcggcgtactggtcggcctggccggggcactggtgcaagccgcctggttccccggcgggttgctgctcgcgctggccggcgcggccgggctccatctgggcgggtcctacgtgatcgggtcccgcgcgggggccgtcgcgcccgccgccggatggatggtcgccgtcgtgctgctcaccgccagccgtccggaaggggacttcctgttcggcgcgggagtcgtctcctatctcttcctgctcggcggcatggccgtggctgtgatgtgcgccacccttgctcaagggcggcaaccgggcggcgaccgcgtccgacttggcaaa

SEQ ID NO: 3125 - DNA, 882 bp, Streptomyces avermitilis
  CDS (1)..(882)
atgaaggatctgcccgaccggcgtctgctcctggtgcacgcgcacccggacgacgagtcgatcaacaacggcgcgaccatggccaggtatgcggccgagggcgcccaggtgacgctggtgacctgcaccctcggcgaggagggcgaggtcatcccgccagctctcgcccacctcacgcccgaccgggacgacgcgctgggcccgtaccgcgtcggcgagctggccgccgccatgaaggaactcggggtcaccgaccaccggttcctcggcggccccggccgctaccgcgactccgggatgatgggcggcgagcagaaccaccgcgcgggcgccttctgggccgccgacctcgacgaggccgccgggcacctggtggccgtcgtacgcgaggtacgcccccaggtcctcgtcacctacgacccggacggcggctacggccacccggaccacatccaggcccaccgcgtcgccgtgcgtgccgccgagctggcagcggaccccgccttccgtccggagcttggcacgccctgggagatcgccaaggtctactggaaccgggtgccccggccggtggccgaggaggggttcgcgcggctgcgcctcgctcttcccgggacccgtttcgccaagtccgcggcggtcgacgacgtacccggcgtggtcgacgaatcggtgatcaccacggagatcgacggcacgcccttcgccgccgccaaggccgccgcgatgcgggcgcacgccacacaggtcgaggtcgacgggccgtggttcgcgctctccaacgaactcgcgcagccgctcttcaccacggagtactacgagttggtgcgcggcgagcgcggctcaccgcgcgagacggacctgttcgaaggggtggccccg

SEQ ID NO: 3126 - DNA, 894 bp, Streptomyces avermitilis
  CDS (1)..(894)
atggatacgcgagaccttagcgtgcccccgcacgcccagtcccggcctcccgccgacaaacacccgaaccggcggcactcccgcaccggagactccggccacggcggcctcactcacgacaacgcccgccacaccacccgcttcacggtgatcggcaaccacctggcccagcacccggagctgtcgggcctcgccatcgggctggccgtctacatccagtccctccccgcaggcgcccgtgtcgacatcaagaccctcgccgcccgcttccccgaaggcgtgacccgtatcgccgcagctctgcgcgagctggaggcccacggctacctgcgccgcgaacgtcaacgcatccccggcggccgcatcgtcacccgcacgatctcctgcaaccagccgggacgtcgtagcgagggcgagcccgtctgctccgcccccgcccggccggtggcggccccagagaggcgcgagaagcgcgcacccaagcccctccccgccgtaccgcaccccgcccagccggcccccgccctcctccaggccgccacggccctcctcgcaggcctccgccgccacgacccccgcctgctcctgtccgcctgcgacacggcccacctcgtccccggcgtcgccgcgtggctggagcgcgacgtgagccccggcgccgtacggcacgcactcaccagcgacctgccccccgaaggaccgcggcgcccggccgccctcctcgcccaccgcctcgccgcccatctgccacccccgcccccgttcggcgtgcctgcacctccgcccccggccgtccggagcccgctccagacctgtgacggctgcgaccgcgccttccgcgcccctgaccccggtctctgccgggactgccgatccgatctccggacggccgcc

SEQ ID NO: 3127 - DNA, 492 bp, Streptomyces avermitilis
  CDS (1)..(492)
gtgatccagaaaacagccgctcccgaggcccgactcgaccaccccatccgcaacttcagcgtgcaactgtcacccacgccacgcggagcccgcctcgcccgcctgctcgccaccgagcagctccgctcttgggaactcccgttggacccggcacgccaactcgtcgccgaactggctgccaacgcggccacgcacagccgtgtccctggccgggacttcaggctcaccctctacgtcgtcggtgacaccctgcgtatcgaggtgaccgacacctgcggcgacctcctgccccgcccccaagaccccacctccgacgccgagtcgggccgaggcctcgtcctcgtcgaggcgttcgccgatcgatggggcgtcgctcagggaccgtgcccgcgcaagacggtctgggcggaactgaacctcgtacccctggcaccggaccccgcccgcacgtgctccggtgccaggggcgctcttcccaaagaactacaaggg

SEQ ID NO: 3128 - DNA, 867 bp, Streptomyces avermitilis
  CDS (1)..(867)
gtgaacggcaaggcggtccagctcaaggaggaggcggacgagccgggttgggaggtggacccggacgacgagtggggcgtcgccgtcgtggagacggtgggacggcagctgaagctgcggcgggaggccctggggatgcgcgccgccgacttcgggacggcggtcggttacggcgaggacatggtctacaagatcgagagcgggaagcggattccccggccggagttcctggacagggcggacgagctgttgggggcgggtgggttgctctcggcaatgaaggaggacgtgaagaaggtccggtacccgaagaacgtccgcgagatcgccaagttggaggcgcaggcggtcgagctcggggtgtatgtcgggctcagcctgcacgggttgttgcagacgcccgagcatgcgcgggcactgttcgaggtctggcagcctgcctactcaccggaggaggcggagcggcgcatggccgcccgaatggcccggaaagcgatcttcgagcggtcgcctgcccccgcccttagcttcgttcaggaagaggcaacgttgcgtcggccggtcggaggcacaatggtgtggcgtcagcagctcgaacatctgctggaggtagggcagttgcgcaacgtcacacttcaggtgatgccgacgaactccgaggcccaccccggactgagcggaaggatcgaggtgctgaagttctcggacggcacagcagtgggccgttccgatggcgcgtacaacggccgaccgatctcagatccgaaacagcttcggatccttgagctgcggtatggcaccatccgggcccaggcactcccgcctcgggagtcgctggccttcatcgagcaactgctgggagaaaca

SEQ ID NO: 3129 - DNA, 210 bp, Streptomyces avermitilis
  CDS (1)..(210)
atgatccacaacggttccgccggagatacatccgagctggcgtggttcaagagcagctacagcgacggccccgacggcgactcctgcgtcgagatcgccaccacccccggcaccatccacgtccgcgactccaagcacgccgacagcagcccccgtctcgcgctctcacccaaggcctgggccgccttcgtgccgtacgcatccgaaggc

SEQ ID NO: 3130 - DNA, 192 bp, Streptomyces avermitilis
  CDS (1)..(192)
gtggcactctcgatttcggcggtggtgctgctggcgatcatcgtcttcatcctgatcaagaagtcagggttgaaggcaccacacgcgatcgtgtgcgttctgttcgggttctatctcgcgtcctcgaccgtcgccccgaccatcaacgagctgacgacgaacatcgcgggcatgatcgggagcatcaagttc

SEQ ID NO: 3131 - DNA, 2130 bp, Streptomyces avermitilis
  CDS (1)..(2130)
atgacgaccgagcctctctccttcccacgccggcaggcgcgcacccagcggttcacgctcggcgcgccacgcgcgttcaccgtggcccccgacggttcccgagtggtgttcctgcgttccgggtccggcacggaccgggcgcaaaagctgtgggtcctcgatctgccggacggtcgggagcgcctggcggccgacccgggcgcactgctcgggggcgcctccgagcgcctgtcgccgcaggagcgggcgcgccgcgaacgcagtcgcgagggcggcgccgggatcgtcgcctacgccaccgacacggcgctggagttggcctctttcgcgttgtcagggcggcttttcacggccgaactgcgggccggcacggcacgtgaactccgggtcccgggaccggtgatcgacccgcgccccgcccccgacggacggcacatcgcgtacgtcgccgggggcgccctgcgggtcgtcggcgccgagggcgagggcgaccgggcgctcgcggagccggagcccgcggcggacgcggcgacggtttcctatggactcgccgagttcatcgcggccgaggagatgggccgttcgcggggtttctggtggtccccggactccgaccggctgctcgtcgcacgggtcgacgacgcgcccgtacgccgctggtggatctcggatccggcgcaccccgagcgggagccgcagcgggtcgcctacccggcggcgggcaccgacaacgcggacgtacgactgttcgtcatcggtctcgacggggtgcgcaccgaggtcgtctgggaccgggcgcggtacccctatctggcgcatgtgcactggtcagaggcgggtgcgccgctcattctggtgcaggcccgggaccagctgagccagctgttcctggccgtggacccggacagcgggacgacgcggatggtgcacgccgacgaagatcgacaatggcttgatcttttccccggtgtgccgtgctggagccccgccggacagctcgtacggatcgccgacgagggcggtgcgcgggtcctcgcggtgggtgaacggccgctgacaggaccgcagttgcatgtacgggcggtgctcgacgtgacggccgacgacgtgctggtcgcggcgtcggccggcgaggccgccccctcccccgagatcggcgaggtccatgtgtaccgcgtcaacgagctcggcgtggagcgggtctcgcaggagcccggcgtgcactccgcggtgcgcgccgggggcgtgaccgtgctcgtctcggcggtgccggcccagccgggcactcaggtgcaggtgctgcgcgagggcaagcgggcggcgaccgtgccctcgtatgccgaacatcctggtttgcccccgcgcgtgacgctcacacgagggggcgcacggaaaatcccatgcgccgtgcttatgccatcggactaccccggtgacacgcccctaccggtcctcatggacccctacggcggcccgcacgggcagcgggtgctggccgcgcacaatccgcacctcacctcgcagtggttcgccgaccagggcttcgcggtggtcgtcgcggacggccggggcactccgggccgctccccggcctgggagaaggcggtcaaggacgacctggcggccatcaccctccaggaccaggtcgacgcgctgcacgcgctggccggcgacttcccgctcgacctctcccgcgtcggcatccgcggctggtcctacggcggctatctggcggcgctcgcggtgctgcgccgtccggacgtcttccacgcgggcgtggtgggcgccccggtcaccgatctgcggctgtacgacacccactaccaggagcgctatctggggcacccggtgcggcagccggaggtctaccggcggaactcggtgatcgacgacgcgggcctggtggacgcggccgagccgcaccgaccgatgatgatcatccacggtctggcggacgacaatgtggtggtcgcacactccctgcggctgtcctcggcgctgctcgccgccggccgcccgcacgaggtgctgccgctgtccggggtgacgcacatgaccccgcaggagacggtcgccgagaacctgctgctgctccagctggacttcctgaagcgctcgctgggcgtggcc

SEQ ID NO: 3132 - DNA, 1083 bp, Streptomyces avermitilis
  CDS (1)..(1083)
atggctgagccgattctggaggtcagcgggctcgtcaagcactacccgctcacccggggcatcctcttcaggaaacaggtcggtgccgtcaaggcggtcgacggggtcgacttcgccctcgggcacggcgagaccctcggcatcgtcggcgagtccggctgcggcaagtcgacggtcgccaagatgctggtcagcctggagaagccgaccgaggggtcgatcaagtacaagggcgaggacgtcaccagactctccggcaaggccctgaaggccgtacggcgcaacatccagatggtcttccaggacccgtacacctccctcaacccccggatgaccgtgggcgacatcatcggagagccgtacgagatccatcccgaggtggctcccaagggggaccggcgccggcgggtgcaggacctgctggacgtggtcgggctcaaccccgagtacatcaaccggtatccgcaccagttctccggcggccagcggcaacgcatcggcatcgcccgcgggctggcgctgcgccccgagatcatcgtcgcggacgagccggtctccgcgctcgacgtctccgtgcaggcccaggtgatcaacctgctcgccaagctccaggacgagttccggctgagctacgtcttcatcgcgcacgacctgtcgatcgtgcggcacatctccgaccgggtcggggtcatgtatctggggcggatcgtggagaccggcaaggacgccgagatctacgaccatccgacgcatccctacacccaggccctgctgtccgccgtgcccgtgccggaccccgaggcgcgcgagcaccgggagcggatcatcctcgtcggcgatgtcccgtccccgacgaacatcccctccggctgccgctttcgcacccgctgctggaaggcgcaggagcgctgcgccctcgaggtgccgctcctcgcggtgcccgcggtgttccggttcacctcaggaccggccgcccacgactcggcctgtcacttcgcggagaccgtccccatgaggcactccgcgccggggcgggtggtgccgccggaacaagatccggaacaagatccggaacagggggca

SEQ ID NO: 3133 - DNA, 981 bp, Streptomyces avermitilis
  CDS (1)..(981)
atgctgctcgacgtacgcgacctgcgggtggagttccggaccagggacggggtcgcccaggccgtcaacggggtcgactacggcgtggacgccggcgagaccctcgccgtgctcggcgaatccggctccggcaagtcggtgaccgcgcaggccgtgatgggcatcctcgacacgccgcccggcaggatcaccggcggggagatcctcttccagggccgggacctgctcaagctgaaggaggaggagcggcggaggatccgcggcgccgagatggcgatgatcttccaggacgcgctctcctcgctcaaccccgtgctgagcgtgggcgaccagctcggcgagatgttcgtcgtgcaccggggcatgtcgaagaaggacgcgcgggccaaggcggtcgaactcatggaccgcgtccgcattccggccgccgccgagcgcgtacgcgactatccgcaccagttctccggcggcatgcgccagcgcatcatgatcgccatggcgctcgcgctggaaccggcgctgatcatcgccgacgagccgaccaccgccctcgacgtcaccgtgcaggcccaggtgatggatctgctggccgagctgcggcgcgagctgaacatggggctgatcctcatcacccacgacctcggcgtcgtcgcggacgtcgccgaccgcatcgccgtgatgtacgcgggccggatcgtggagtcggcgccggtgcacgagatctacaaggcgcccgcgcacccgtacaccaagggcctgctcgaatccatcccgcgcctggaccgcaagggcaaggagctctacgccatcaagggcctgccgccgaacctcatgaacatcccgccgggctgcgccttcaacccccgctgcccgatggcccaggacgtgtgccgaaccgacgtgccgccgctgtacgaggtggacgacgggggcgcggctcggggaagcgcctgtcacttctggcgggagtgcctgcatggc

SEQ ID NO: 3134 - DNA, 918 bp, Streptomyces avermitilis
  CDS (1)..(918)
atggacctcgccacgagcgaggcggccacgctggagaggattccgggcggccccgagggcacgggcccgcagggcaaaccgcgctccctgtggtccgacgcctggcgcgacctgcgccgcaaccccgtcttcatcatctccgcgctcgtcatcctctttctggtcttcatctcggtctggccctcgctgatcgccccaggcagccccctcaagtgcgacctggccaaggcccaggagggtcccgcgcccggccatcccttcggatacgacggccagggctgcaacgtctacacacgcaccgtgtacggggcccgggtgtcggtcaccgtcggcgtctgcgccacgctcggcgtcgcgatcctgggcagtgtcctgggcggactcgccgggttcttcggcggcgtcccggactcgttcctctcccgggtcaccgacgtcttcttcgcgatccccgtcgtcctcggcgggctcgtcctcctctccgtggtgaccagcaatacggtctggccggtcgtcgggttcatggtgctgctcggctggccgcagatctcccgcatcgcacgcggctccgtcatcaccgccaagcagaacgactacgtccaggcggcgcgcgccctcggcgcctccaactcccggatgctgctgcggcacatcgcgcccaacgcggtcgcgccggtcatcgtcgtggcgacgatcgcgctcggtacctacatcgcgctggaggcgaccctgtcgtacctcggtgtcgggctgaagccgccgacggtgagctggggcatcgacatctccgcggcgtccccgtacatccgtacggcgccgcacgccctgctgtggcccgccggcgccctcgcggtcaccgtgctcgcgttcatcatgctcggcgacgcggtgcgcgacgccctcgacccgaagctgagg

SEQ ID NO: 3135 - DNA, 921 bp, Streptomyces avermitilis
  CDS (1)..(921)
atgggacggtacgtgatccggcgtctgctgcagatgatcccggtcttcatcggcgccacgctgttgatcttcctgatggtgaacgtgatgggcgaccccatcgcgggcctgtgcggcgacaagcagtgcgaccccgccaccgccgcccagctgaagaaggagttcggcctcgacaagcccgtgtggcagcagtacctgacgtacatgggccatgtcttcaccggcgacttcggcaccgccttcaacgggcaggaggtcaccgagctgatggccgacgccttcccggtcaccatccggctgacgctcgtggccatcgtcttcgagatcgtcatcggcatcgcgctgggcgtcgtcaccggcctgcgccgcggccggcccgtcgacacgggcgtcctcctgctcaccctcgtcgtcatctcggtgcccaccttcgtcaccggcctgctgctccagctgctgttcggcgtcgagtggggctggatcaaaccgtccgtctccccggacgccgccttcggcgaactgatcgtccccggcctggtcctggcctccgtctcgctcgcctacgtcacccggctcacccggacctccatcgccgagaacaaacggtccgactacgtccgcacggccgtcgccaagggactgccccggcgccgggtgatcacgcggcacctgctgcgcaactcgctgatccccgtggtcaccttcatcggcacggacatcggcgccctcatgggcggcgcgatcgtcaccgagcggatcttcaacatccacggcgtcggcttccagctctaccaggggatcctgcgccagaacacccagaccgtcgtcggcttcgtgaccgtactcgtcctcgtcttcctggtcgccaacctgctggtcgacctgctgtacgccgtactcgacccgaggatccgctatgcc

SEQ ID NO: 3136 - DNA, 1620 bp, Streptomyces avermitilis
  CDS (1)..(1620)
atgcgtggagccacgcacgccaagtgggccgcatgcgcggcggcggcagccctcgcggcgaccgcatgcgggggcggcggcggtggcagcgcccccggggtcctgagttcctcctggggagacccgcagaacccgctggaaccggccaacaccaatgaggtgcagggcggcaaggtcctcgacatgatcttccgcgggctgaagcggtacgacgccaggaccggcgcggcccagaacatgctcgccgaccggatcgagacctcggactcgcagaacttcaccatcaccatcaagggcggatggaagttcagcaacggggagcccgtcacggcgaagtcgttcgtcgacgcctggaactacggcgccggcctcgagcacaaccagaagaacgcgtacttcttcgggtacatcgacggctacgacaaggtccaccccgaggacggcggcacacagaccgcggacacgctctccggcctcgccgtcaagaacgacaggaccttcaccgtcaggctcaggcagaagttctcgacgttccccgacaccctcggctacgcggccttcgccccgctgccccaggcgttcttcgacgaccacgcggcctgggtgaagaagccggtcggcaacggcccgtacctcatcgactcgtacaccaagggttcgaagatgtccctgcggaagtgggccggctatccgggtgacgacaaggcccggaacgagggggtggacctccaggtctacaccgacaacaacaccgcctacaccgacctcatggccggcaacctcgacctcgccgacgacatcccggccgcacagctgaagaacgtgaagagcgacctcggcggccggtacatcaacaccccggccgggatcatccagaccctcgccttcccgttctacgacagcaagtggaaccagagcggctcggacaaggtccgcaagggcctgtccatggcgatcgaccgcgaccggatcaccggcacgatcttccagaagacccgcaccccggccggcgactggacctcgccggtgctcggcaaggacggcggcttccaggacgggctgtgcggcgacttctgcacgtacgacccgcagcgggccaagaagatgatcgacgagggcggcggcctgcccggcggacaggtcaagatctcgtacaacgcggacagcggttcgcaccgggtgtgggtcgacgccgtgtgcaactccatcaacaacgccctcggcaacgacaaggcctgcgtcggcaacccggtcggcaccttcgccgacttccgcaaccagatcggccggcacaagatgccggggccgttccgggccggctggcagatggactacccgctgatccagaacttcctccagccgctctactacacgaacgcctcctccaacgacggcaagtggtccgacaaggacttcgacaagctcgtcgaccgggcgaacgcggagaccgaccgggccaaggccgtgcagctcttccagcaggccgagggtgtcgtgcgcgacaacatggccgccatcccgctctggtaccagaacggcagcgccggctactcggaccgcgtctccgacgtggcgctcaaccagttcagcgtccccgtctacaacgagatcaaggtcagc

SEQ ID NO: 3137 - DNA, 987 bp, Streptomyces avermitilis
  CDS (1)..(987)
gtgaccgacgagagtgtcgagaagtcgatcacttctcccactcccaaggccaacgagagccggtcccccggacagctcgcctggctccgtttcaagcgggaccgcacgggcgtcatctcggcgctggtcgtgatcttcttcttcgtggtcgcgatcgccgctccgctgatagccacgctgtacggcaaggacccgaccacgacgtacggcatcaacaccccgggactgctgggtgacaacagcttcccgatcaagccgaacggcggcatcagctccgacttctggttcggcctcgaacccggcctcgggcgtgacgtcttcaccttcctcatctacgggatccgcaactcgctgctcatcgccgcggcagtgaccgtcctcgtcatgatcatcggcgtcgtggtgggcgtcaccgccggctacgtgggcggcaagtccgactggttcatcggccgggtcatcgacatcctgctcgccttcccctcccagctgttcttcgtcgccttcacccccgtcgtgctcgccctgttcgtggcacccgacgagaacacgccgacctggctcaccgtggtctccctcatcggcgtcctcaccgccttcggctgggcctccatcgcccgtcttctgcgcggccaggtgctggccctgcgcgagcgggagttcgtcgaggccgccaaggtcacgggggcgtctccggcgcgaatcatcttcaaggaactgctgcccaacctctggaccccgatcctgatccaggcaacgctgctcctgccgaccatggtcaccacggaagcgggactcgccttcctgggagtcggcgtcaaggaaacgactccggactggggcgtcatgctcggacgcgccgccgacgtctaccaggacgacatcacctacctgctcttcccgggcatcacgatggtgatcttcgtcctggcgttcaacctcctcggcgactcgatgcgcgacgcgctcgacccgaagaccaagcgc

SEQ ID NO: 3138 - DNA, 1761 bp, Streptomyces avermitilis
  CDS (1)..(1761)
atgtctttttcgcgcagaaacttcctgatagccaccggcgttgtcgccgcgtcgagctcggtgctgtccgcgtgcagcagcggtgactccagcggcggctccggcggcggcaagcaggacgccgccaaggccaagacgaccacggtcaagatcggcaccgcggccgactccaagggcccggcccccgaggtccccggcgcgaagaagggcggcaccgcctacctgctgaacgacgacgacttctcgcacctcgacccccagcgcatctactacgcctggaactcgctcgccgcgatcgtcctctcccgcaccctgaccggctacaaggtcggcgatgacggcaccatgaccctggtcggcgacctcgccaccgacacgggcaagatgtccgacggcggcaagacctggtccttcaccctgaaggacggcgtcaagtgggagaacggcgccgacgtcaccgtcgacgacgtgcgccacggcatcgagcgcgccttcgccagctacatcaccgagggcgccttctacgtccaggcgtggctgacgggctcgcagaactaccgcaagtcgtactcgggcccgtacaagggcaagcacctgaagtcgatcgagaccagcggcaagacgatcaccttccacctctccgaggcgcgccccgacttcaactacgtggtcgcgatgcactcctacgcgccgaccccggtgaagaaggacaccaaggaggactacgacaagaagccggtctccaacggtccctaccgggtgaagtcccacgtcacggacaagtcgatggtcctggtccgcaacgagcactgggacgcggacaccgacccgatccgcaacgcctacccggaccagttcgacttcaccttcggcatcgagcagctgacggccgtcgaccgcctgatcgcggacgccggcaaggacaagtacgccgtcagctggcgcacgatcccgcaggagcgcatccagaaggccacgaccgaggccaaggaccgcgtcttcgaggagctcggcagcggtgtcagcgtctactggatcaacacgacccgggtcaaggacaaggccgtccgtgaggccctgatcaaggcgtggccgaccgcgcagatccgtcagctcatgggcggcgtccaccgtggcgactacgccaccggcatcatgagcccgctcgtggccggctacgagtcgcaggacgtctggggcaagctgaagacccccgcgggcgacccgaaggccgcgaagaagatcctcgacaaggccggcaagaccaagcagaagatcgtctacgcctaccagcaggacgacgtccagccgaagatcgcggtcgtcatcgagaacgccctcaaggcggcgggcttcgacgtggtcaccaaggccatcgactccaccacctggtacgaccagatcggcaagctggacaacccgttcgacgtctactggggtggctggtcctccgactggccgaccggttactcggtgttccagccgctgttcgacagcgccaacgtcgtcgaccagggtcagaactactcgcacctcaaggacccggccgtcgacgccgccatcaaggcggcgacgctcgagaccgaccagaccaaggccaacaagatgtgggcggccctggacaagcaggtcacggagatcggcgcgttcatccccgatgtgtacatgaagcgcatctacctccacggctccaagctcggcaacgtgaagatggacccgaacttcgacggctgcatgctctacaagatgtacgtcaagtcc

SEQ ID NO: 3139 - DNA, 978 bp, Streptomyces avermitilis
  CDS (1)..(978)
atgcttcgcttcctcgcccgccggctcctcggcgccgtgatcacgctggtcgtcatcagcgcgatcacgttcatgctcttctacgctgtgccgcgcgacccggcccggctggcctgcggcaagctctgcaccccggagacgctcgaggtgatccgccacaacatggggatcacggactcgctgccggtccagtactggcactggctgaccgggatcttcctcggccgggactacggctcctacggccactgcgacgcgccgtgcctgggctactcgttcgtcaaccgcgagtccgtcctcggcacgatcatggaccggttcccgaccacggcctccctcgccctcggctcgtccgtcgtcttcctcatcggcggtatcggcgcgggcatgatcgccgccgtcaagcagggcaaggcgctcgacaaggtcgcgagcggcgcgtcgctggtcgcctcgtcgatgcagatctacttcgtcggcaccctggccctctactgcttcgtgtaccagtggcagatcctggaccagccgtcgtacacggacttcaccaagaacccggcctcctgggccaacgggctgctccttccctggctggtcctgtcgctgatctggaccgcgaactacacccgtatgacgcgctcccaactggtcgagcagctcaacgaggactacgtccgcacggcccgggccaagggtctgtcccgccgaaacgtcttcttccgcttcgcctggcgcggcgcgatggggccgatcgtcaccatcttcggcatcgacctcggcgtccttctcggcggcgcgatgatcaccgagaagaccttcagcctccagggcatcggcatgctcgccatcaaggccgtgaccaacaacgacctgcccatgctgctcggcatcatggtgatcaccgcctccttcgtggtgatcgcgaacatcgtcgtggacgccgtctacgccctgatcgacccgcggatccggctcgcc

SEQ ID NO: 3140 - DNA, 1068 bp, Streptomyces avermitilis
  CDS (1)..(1068)
gtgaagagcaccgctaccaagcccgccggcgagcggaaccctcaggccaccggacccttcctgtccgtgcaggacctgaaggtgcacttctcgaccgaggacggcaccgtcaaggccgtcgacggcctctccttcgacctcgagcgcggcaagacgctgggcatcgtgggtgagtcggggtccggcaagtcggtcaccaacctgaccatcctgggcctgcacaacccggacagcaccgccgtcgagggctccatcaccctcgacggcgaggagctgaacggcgcttcggagaagactctggagaagctgcgcggcaacaagatggcgatgatcttccaggacgcgctgacctccctgtcgccgtaccacaccatcggcaagcagatcggcgagacgtaccgcaagcacaccggctgctccaaggcggcggcccgggcgcgggccatcgagatgctgacccgggtcggcatcccgcagcccgacgtgcgcgtggacgactacccgcaccagttctcgggcggtatgcggcagcgcgcgatgatcgcgatggccctggtctgcgaccccgagctgctgatcgcggacgagccgacgacggctctggacgtcaccgtgcaggcccagatcatggacctgctcaaggacctccagaaggagttcggcacggcgatcatcttcatcacgcacgacctgggtgtcatcgccgacatcgcggacgacgtgctggtgatgtacggcggccggtgcgtggagcgcgggacgaagaaggaggtgctgcgtacgccgcagcacccgtacacgtggggtctgctcggttcgatgccgagcctggagggaccggtcgacgtaccgctgacgccgatcccgggttcgccgccctcgctgctgaacccgccgtccggctgccggttccacccccggtgcagcttcgccgagaaggtcgaggacgggcgctgctcctccgagcgcccgccgctggagatcacggacggtcgcggggccgcctgccatctgaccgccgaccagcgccgcgcgttcttcgccgacctggccgccagcccggccaac

SEQ ID NO: 3141 - DNA, 1044 bp, Streptomyces avermitilis
  CDS (1)..(1044)
atgagcaccaccacccccctcctggacgtctccgggctgaccaagcacttcccgatcaagggcggcttcccgatccggcggaccgtcggcgccgtgcaggccgtcgacggactggacttccaggtcgccgagggcgagagcctcggcctggtcggcgagtccggctgcggcaagtcgacgacgggccggctgatcacgcgcctgctggagccgacgagcggcaagatctcgtaccgcgggcaggacatcacgcacgcggaccgcaagaagctggcgccggtccgttccgagatccagatgatcttccaggacccgtacgcgtccctgaacccgcgacacacggtcggcaagatcatcgcgggtccgatggagatcaacgggatccagccgagcggcggccgggagaagcgggtccgtgagctgctggagatcgtcggcctcaaccccgagcactacaaccgcttcccgcacgagttctccggcggccagcgccagcgcatcggtgtggccagggcgctggccctcgaaccgaagctgatcgtggccgacgagccggtctccgcgctcgacgtgtcgatccaggcccaggtggtcaacctcctccaggaccttcagaaggacctgggcatcgcgttcgtcttcatcgcccacgacctcgcgatcgtgcgtcacttctcgcagcgcgtcgcggtgatgtacctcggcaagatcgtggagatcgccgaccgtgcggacctgtacgagaacccgcgccacccctacacccgcgccctgctctccgcggtccccgaggccacggtggaggacggcgaggcccgcgagcgcatccggctcaccggtgacgtgccgtcccccatcaacccgccgtccggctgccgcttccgtacgcggtgctggaaggccacggacaagtgcgcctcggaggcgccgccgctggtccaggtcgagggcaacaacgccggccacctgacggcgtgccactacccggagaccaaggagaccgtcccggctccccgtctctccaaggaccccaaggcagcggtc

SEQ ID NO: 3142 - DNA, 165 bp, Streptomyces avermitilis
  CDS (1)..(165)
atggacacgaaccccttcgaggacgacaccgcctcgtacgtggtcctggtcaacaacgaggcccagcgctccctgtggccgtcgtccctgcccgtaccggccggctggaccgtgtccttcgggccgaacacccgccggacggttgtggcccacatcgaaggcgac

SEQ ID NO: 3143 - DNA, 1875 bp, Streptomyces avermitilis
  CDS (1)..(1875)
atgagccctgacgtggacgagatcgccgcatggaacggcgtgagcccgcacgtggacgagatcgccgcatggaacgacaccgcgcgggagctgcccggcggtggcgacaccctgcccgagctgttccgtacgcaggtgtcccggacccctgacgccaccgccctggtcttccgggacacccgcctcagctacaccgagctggacgagcgctcggaccgcctggcccggctgctggccgggcacggggccgccccggaccgggtcgtggccctgaccgtgccgcgctcggtggaactcgtcgtcgcgctgctcgccgtactcaagacgggcgccgcctacctcccggtggacccggactacccggcggaccgcatcggctacctcctcgccgacgccgccccggtcctgctgctcacccactccgacgtggaggcgacgctgccgccgggcgcacggcccgaggggctgccccgtctggtcgtcgacgcacaggaagagccgctggagcgcgcccccttcgcgcccgcccgtccgcccgccgcgcaggacgccgcgtacgtcatctacacctccggctccaccgggcggcccaagggcgtggtcgtcccgcacgccggcatagtcaaccggctgcactggatgcagcacgagtaccggctgaccggcgacgaccgcgtcctgcagaagacgccctcgggcttcgacgtctcggtgtgggagttcttctggccgctgatcaccggcgccaccctggtcgtcgccgaacccggcgggcacaaggaccccgcctacctggccgagctgatccggggcgagcggatcaccaccgtgcacttcgtcccgtcgatgctccaggtgttcctggacgagccggccgcggcgctctgcaccggcctgcgccgggtggtgtgcagcggtgaggcgctgccggtcgaactcgccgaccgcttcacggcgtcgctgcccggcgtgcccctgcacaacctgtacggcccgaccgaggcatcggtcgacgtcacgtactgggagtacacccccgagcccggcgccacctcggtgccgatcggccggcccgtgtggaacacccgcctgtacgtcctggacgcggcgctgcgcccggccgcggtgggggagaccggcgagctgtatctggccggggtgcagctggcgctcggctatctgaaccgccccggcctgacggcggaacgcttcgtcgccgacccgtacgggccgccgggcagccgtatgtaccgcaccggggacctggcccgccgccgcccggacggcgcgctggactacgtgggacgcgcggaccaccaggtcaagatccggggcctgcgcgtcgaactgggcgagatcgaggcggccctggcccggcatccggcggtctccggggcggcggtgctggtccgggaggaccggccgggcgacaagcggctggtgggctatgtggtcccggcgccgggcggcacggtcgacccggccgagctgcgcacgctcgccgccaccacgctccccgactacatggtgccgtcgacggtggtcgtgctggaaagcctgccgctcaccccgaacggcaagctggaccgcaaggcgctgcccgctccgcccgacgccgccgccgctcccgcccgggtcgccccgcgcaccccgcaggaggccctgctgtgcgacctgttcgccgaggtgctgggcctgtccgaaacgcaggtcggggtcgaggacagcttcctcgaactgggcggccattcgctctccgcgatccggctggtcagccgcatcagggcggccttcgacacggatctgaaggtccgccaggtcttcaagacccccaccgtggcggccctggccgcgtgcctcgcgtcggcggggcgc

SEQ ID NO: 3144 - DNA, 1290 bp, Streptomyces avermitilis
  CDS (1)..(1290)
gtggaggacacggcggcggcgggctcggcggccccccgccgccgcggtggcgggctgtggcgcaaccgggacttcctggtcttctggaccggggagaccctctccctgtacggcacccaggtgaccaccctcgcgctgccgctcgccgccgtgctggtcttcgacgccagcgccgaggaactcggtgtgctgcgcttcctccagctcgtgccgttcctcgggctcgccatgctcttcggcgtctgggtggaccgggtccgcaagcgcccggtgatgatcggtgccaacgcggcccgcatggtgctgatcggcctggtcccggcgctctccgcggccgacgtgctcaacctgccgctcctgtacgccgtcgcgttcggcatcggcgtcgcccaggtgctgttcgacgtgagctggatgtcgtacgtgccggtgctggtgaaggaccgacgccacctcgtggaggccaacaccaagctcagcaccacctcgtcctcggccgacgtggccgggccgggtgtcgcgggcgtgctggtgaacgcgctgaccgcgccgacggccatggcggtcaacgccgtcacctacctgctgtcgatcgtctcgctgctggccatcaggaccccggagccccggcccgcgaagccggagcggcggcgcagcatccgggccgatctcgtcgagggcctgcgcttcgtgttcggcagccggctgctgcgggccatcgccctcgtcggctgcgcctgcaacttcttcagcgtgatgatcctgtcgctgttcctgctctacgccgtgcgcgggcagcatctgtcggcggcgacgatcggcctggtcctcggcgtcggagcggtcggcggactggccggctcggcactgtcgggcacggtgatccgccgggtgagcgtcggcaaggcctacctggtctcggtctccgggatcttcgtcgccccgctgctgatcccggccgcgggcggctccaagctgatggtgacgggcgtcttcatcgcctcgttcctggtcttctacgcctcgctcagcgtcgccaacgtggtgatcgtcagcctgcggcagaccatcacgccggacccgctgatggcccggatgaccgcggcgatgcgcacgctgatgcacggcggcggcgcgctcggcggtccggtcggtggtctgctggccggtgcgctcggactgcacgaggccctgtggctggccgccgtgctctccgccgtgatgctggtcccgatcgcactctccccggtcagccgcctccacgagatgccggccccggcacccgttccg

SEQ ID NO: 3145 - DNA, 810 bp, Streptomyces avermitilis
  CDS (1)..(810)
gtgccgctccgcgaggacggcacccacccgccgctgtactgcgtgcacccggtctccggttcgggctacgtgtacgcggggctcgccgaactcctcggccctcagcagccgtcgtacggcttcgaggcgccggggttcgacgacggcggggcgcccctcaactcgatcgaggcgctcgcggaacggcacctggcgtccctgcggtcggcccggccgcggggaccgtacctgctgctcggctggtcgctcggcggtgtggtcgcctaccacatggcccagcggctcgtggaggccggcgaggaggtgccgctgctcgtcctcatcgacgcgacggtgccccagccgttcccgctgccgccggagaaggcgctgctgcacgccttcctgcgggacctcgtgacggcgatgggggagccgccggaggcgctggacgcgctgctgacgccctaccccgacgacgtcacccccgaggcggtgtggacggctgtcaccgcggccggggacgaggtgcttcccgaggagttcgacgaggagttcctccaggagcgctacgacgtgttccgcgcccacgccgaggcgctgtacgcgtacgagcaccggggcccgtacgcgggccgggtgctcttcctcaaggcggccgactccctggacgcgcgcacgcgctgggagacgctcgccccccgcgtcgagcggcacacgatcacgggcgaccacgactcgatctgggccggcgaggcgttcgctacgctcgccggcctggtgcggcagggcctcgcgcaggcccggtccgctctcgccccggcggaggga

SEQ ID NO: 3146 - DNA, 3048 bp, Streptomyces avermitilis
  CDS (1)..(3048)
gtggcgtaccggctgcgcggcaccctcgacgtcggggccctgcaccgggcgctgacctccctggtcacccgtaacacggcgctgcgcacgaccttccgctccgccgagggcaccccgtacggcgtcgtcgcgcccgcgggcgaggtcgacctggagatcgtcgacctggcggacgccgacctggacgcaactctgcgcgcccgcagcgaggcccccttcgacctggcggccgggccgctgtaccgcttctcgctgctgcggctgtccgccgaggaccacgtcctggtgctggtcttccaccacatcaacaccgacggctggtcgtcggccctgatcaaccgcgagatctccggcgcctacaacgccttcgtccagggcacgcagcccgcgctccccgagctggaggcgacgtacgaggaccacgtccgggcccagcgcgagcagcacgggggcgactcctgggagcagcagctgaagttctggaaggggaagctcgccgggctgccggtggtggagatgcccgccgaccgcgcgcgtccggccaccccgacccagaacggcgagaccctcaccttcgacttccccgccgaactgctccacggggcgcgggcgctcgcgcagcaggagggcgcctccctgttcatggtgctgacgaccgccctgaacgtcgtggtcggccgctacaccggccaggaggacatcccgctcggcatccccatgctcggccgcacggagcccgaactcgaggacgtcgtcggcctgttcatcaacatgctggtgctgcgcaccgatctgtccggcgaccccaccttcgccgagctgatcgagcgggtcgcggacgccaacatggacgtgtacgacaaccaggacgtgccgttcgaccagatcgtcagccatgtccagccggcccgtgaggcgggccgcaacccgctgttccagatcggcacccagctgctcggcagcggcaccgggggttccgacctgggcctgaccgggctcaccgacgaacagctggacgtcgccgtcccgcgctcccgctacgacctgtcgctgacgttcctggagagcgcggaccggctgcggttcgtcgccgagtacaccaccgacctgttcgacggcatccgcatcgaggcgatggcccggcacatccagaacgtgctggccgccgcggtcgaggacgccgagcagccgatctccaagctggcgatgctcggcgaggacgagcgccggctgctgctggaggcgggccgcggcccggacttcgacttcagccacgacccggtgcacaccaccgtcctccaggtcgccgagcgcaccccccacgccgtcgccgcggtctgccgcggggtggagatgacgtacggcgaactggcgcgccgctccggcaagctcgcccgccatctgcgggcccgcgggatacgccccggacaggtcgtcggcatcgtcatggaccgcgacctggacgccctggtggccatgctgggcgtcatgcgggccggcggcgcctacgcggtcatggacccctcgcacccggccgcccgtatcgactacatgctccaggacaccgcggccccggtcgtcatcacccgcgccgatgtggcgggcgggctcccgacgagcgaggaccggaaggtcgtgctcatcgacgcggactgggcggccatcgaggccgagtccgacaccgagccgctcgaagagctcgcggaccgcgagaccctcgcctacgtcctctacacctcgggctccaccggccgccccaagggcgtgatgatcgagcaccgcagcctgcgcgtgttcatcgaggcgtaccggcacacgttcggcgaattcacccccgaggaccggctgctccagcagccgtcgctgatcttcgacatgtcgcagggcgagatctacaccgcgctgatcaccggcgccacgctggtcctcgtctcgcccgaggacgcctcgtcgcccgaggcgctcggcaccctcatccgcgagcagcgcgtcacctatgtcggtctctcgccgaccctgctctcgctgctcgacggcggaccgtacccgcacctgaaatacatcatgggcggcgccgaggtcctgccggccgagctggtcaacaagtggaacatccccggccgcaagttcgtgaacctgtacggcccgaccgaggcggccatcgcctgcaccgagtacctctgcgagcacatcgagtggcgctccgccccgccgatcggccgccccgagtacgggcgtctgcactacgtggtcgaccggcacggcaacctcgccccggtcggtgtccccggtgagctgctcatcggcggcgaggacggcctggcccgcggctatctcaacctgcccgagctgaccgacgagaagttcgtgcccaaccctttcgagcccaccggccgggtctaccgcaccggcgacctcgtccgctggaccccggactaccaggtcgacttcatcggccgcatcgacaaccaggtcaagctgcgcggcctgcgcatcgagctcggcgagatcgagtccgcgctggtcgcccacccgcagatccgcatggccctggtgctgctcaaggcggacccgcagggcgagaagcagctcgtcggctactacacggtgctcggcgaccaggccccgaccctcgccgaactccgccgccacctcggcgagtcgatgcccgagtacatggtgccgaccgcctgggtgaagctggacgagttcccgctcacgctcgccaagaagatcgaccggcacgcgctgcccgagccgtcgtacggcgccgacggtacggaaggccgggcctacgtcgcccccgccacgcccaccgaggagcgggtcgccgaggccttcgccacggtcctgaaggccgatcagatcagcgcggacgccagcttcttcgaactcggcggcaactcgctccaggcgatgcgggcggtcagccggatcaacaaggccttcggcgtgaagatcaacgtccggatgctctacggcggcgccaccgtgggcggcgtggccgaggccatcgacgaactgctcgccgccaaggccggccgtgac

SEQ ID NO: 3147 - DNA, 1101 bp, Streptomyces avermitilis
  CDS (1)..(1101)
atgaccactgcgacgaccgtctccacgtaccccatgcgccgctgggtgttcgacgacgccgccgggcgctacgacatcgacctcggcgacagcaacctgccctgcggcactctcgacgaactgacccccctcggcggcctcgaactcgactacgggcacaaccgcggcatacccaggctgcgcgccctggtcgcggacctctacggcaccgacgacgaccacgtcctgatcacccacggcgcccagcaggcgctctacctcgtttacaacgcgctgctgcgccccggcgaccaggtcatcaccttccggcccggctggcagcagtcctgggacatgccggccgaactgggctgccgggtcgacatcctcgaccaccgcccggacctcaccgtcgacgtcgaggccgcggccgccgtcgcgggccccgacctgcggctgatcgtcgtcaacaccccctgcaacccgaccggtcagcgcgtctccgacgccgacctggccgcgctgcacaccctggccgcccgcacgggcgcgtacctcctgctcgacgaggactacgcgctggagctgaaggactcggccgccacccgcctcgagcggacgatctccgtgtcgagcctctccaaggtctacggctttcccggcctgcgcatcggctggctgtacgggccgcccgagctcgtcgtggcctgcacggagcgcaagttcctctccaacataggcaattccgtgctgtgcgagacactcgcgtgcgacgtgctggagcgccgcgaccactacaccgagcggtaccgcacgctgaccggggaaggcctcgccgtggtccgcgcctgggccgcgcgcaacaccgacgcggtccggctcaccgaaccgcggggcacccccttcgcctggttccggctgctcaccggcgaggcgccgctcgacctgtgccgccgggtgctggacaccggagttctgctcatgccgggcgagacgctcggcggccccgacggattccgcctgtgcttcgcacgggacccccatctcatctccgaaggcctgcgacggctcgaccccgtcctgcggccccaggccgtgcgcaacatgacaagtggagcagtg

SEQ ID NO: 3148 - DNA, 921 bp, Streptomyces avermitilis
  CDS (1)..(921)
atgggcgaacattcgacgtcctcgacggtcgtgacacccgcgtcgacgccttcggcgtcctcgccgcccgcggagttcgaggagtccgcggagttcttcacctaccacgcgctcggcaacgactacgtggtcgtcgacccgcgcggcagcgacttcacgcccggccccgcggccgtgcggctgctgtgcgaccggcacttcggggtcggcgcggacggagtgctgttcggaccgctcggggcaccggaagccggtgaaccggtgcgcctgaggatgttcaactccgacggcaccgagtgcgagaagagcggcaacggactgcggatgttcgctctgcatctggccgaaacctacggcgagccgtggagcggggacgaggagttcccgctccgcacggccgccggtgacgtaccggtacgcatcctcgacctcgcctcggggaccgtccaggtcggcatgggccggcccgagttcggggcgacgggcgagagcctcgacgtcggcgggcgccgcctcgcggtcacctccgtgcacaacgggaacccgcacgcggtcgtcccgctggcggagatctccgccggcctcgcccgcgaactggggcccctgatcgccggacacacccgcttcccgggacgcacgaacgtgcagttcctggcgatcgtggaccgccggacgatcgccatcgaggtctacgaacgcggcgccggctacaccctcgcctccggcagcagcgcctgcgccgccgccgcggccgcgcacgccctcggcctgaccggcccggacgtggaagtacgcatgcccggcggccggatcgacgtctcgatcgcggcggacggctccgtctccatgaccggcaccgccgagcggatcagcagcggccgcttctcacccgtcttccggaacaagctggagaccgcacga

SEQ ID NO: 3149 - DNA, 693 bp, Streptomyces avermitilis
  CDS (1)..(693)
atgccgctcaacgagcagaaattcgctttgatcgagctgccggaggtctctcaggagctcctcgacagctacgaggacctgccggtcgacgagtacatgggcaacggcacccgcttcaagcggttctcccagtaccggctgcgccccgagggcaccgagggctggaccttcgagctgctggcccaccgcgactacaccaccttcaccaagttcaacaaggtcggtggcggcatccgccgcgtctaccagcccatcaaggccgacttcgtgccgttgatctcgcacggcatcgaggagctgggtctcgaccggtccgaggactggcagatcaacgtccaccagaaccggacccgggccgacggcgactacgcgggcccgctcaccccggagggcgtgcaccacgacggacacgagttcgtcatgatcgccgtcctgaacaagaacaacgtggccggcgcgcagacccggctgtgggagccgggcgccgacgccccgttctggaccggcacgctggagcccggccacgcggtgctcctcgacgaccgcggcctcgcccacgacgtcaccgacgtggagtcggccgacggcggccccgccaaccgcgacatcgtcatcatcgcgttctcccgctgggccgagaagtggtacggcgaggagcacgacgaggccgcgctggccgacggcgccgagagc

SEQ ID NO: 3150 - DNA, 975 bp, Streptomyces avermitilis
  CDS (1)..(975)
gtgtcttcctggctgcccaggaatccggccgaacttgacaaggctgtaacaggagcggagcgcgacgcgatcctcgacgcgatccgttccctcaacgacgacgcgcggctcggcgactccgaggcgttctatgcgcagcagcgtctcctcgcccgcatctacgggctgcacaccctgatacccgagggcccctccgccgaggggtccgtcctgctgcacacgatcacccgcctgctcgaagaggccaccatcgaggccgaggacggctacatcgagcccggcctgatcgaccaggcgcccgccgagcccgccgcctacctctcctggctgaagaagctggcccgcgaacaccgcgtctacaagcacccctactaccgggagttcatccgcgacgaggcgacctccgccgacctgcgcacctatgtgatgcaggagtcggtcgtcgacgggcggttcgacgacctgctggcgatgatgcaggtcggcaccagcggcgccgcgaagatggagatcgcccagaacttctgggacgagatgggcaacggcaagccggaagaggtgcacacccacctcttcaacaagatcttcgaggtcttcgagatcccggccgacgagctggagcgctcgctgaccgccaacgcgctgctctccggcaacctggccgtcctgctgtgccgttaccggcagtactacccggaggccgtcggcttcctcggcatgacggaatggctggttcccgaccgcttcgtgcaggtcgtgcacgcctgggagcgtctcggcctgccggacatcggcatcgtctaccaccggctgcacatcacggtcgactcccagcacgccgccggctggttccacaacgtggtcatccccgcggccgagtcggagcacatgcggcgcgccatcgcccgcggcaccctgtggcggctcaactcctccgcccgctacctcgacgagcgcatgcccgccgtcgccgtc

SEQ ID NO: 3151 - DNA, 240 bp, Streptomyces avermitilis
  CDS (1)..(240)
ttgcgcaccggaaaaggcatgcttttcccgagcggcgggaagatccccgaccgttatggggagggaactagcgtgcacgacaagatttccattcgttctttgcgagcgctggtgtgcggagtcgccgccggtgtgctgaccgtcacggtcctggggtcctgtcacatcaccgacggcgcgcactcgcagacgaacgtccaggcggacctcgcctggggtgtggtcgcacgccacgcgaac

SEQ ID NO: 3152 - DNA, 1038 bp, Streptomyces avermitilis
  CDS (1)..(1038)
atgactgaatacgacgaacaagacgaacatcacgacctcggccgggccgcgcgccccggcgacttcgagctccccgacgtcagcggtttcgatctgctccagtaccgggagtccctcacgcagggcaggcgcccgcgggaggagacgtctcaggcgctgctccgtctgcatctgctgcaccccgtgtccgaggcgtcggacgtgtgcgtcccggtgtccccgagcgccgcggtggacgcgctggtcgcaccgctggaagaagagcggctgaagctgcgcaagaagatcaacgacatccggtccgccatggcggccttcgacgcggtgcactcggaggtccgcagcaaggaggcggtcccgctgactctgctggtcggcggcgccgcgatcagcgcctcggtgacgagttccgcccgcgccagcgagcgggagatcatcacggtacagccaggtggcagtcgtccgcccgaacttctggccgagacgatggagttgaacatgtccctgctggcccgcggcgtccggcagcgcacgctctaccagcactcgatccgcaagcaccagctcacgatggactacagccgtcaggtggtggcggccggtgccgagatccggacagtgaccgagatcttcgagcggctcatcatctgcgacgacaccgtggcgtacatccccaccaacgacgagcgcgccaacgaggccctggagatccggcaccccgcactgatccgctatctgcgggccggtttcgagcgggcctgggagggggcggaacccatcagcccggccgatccgctgccgaagcgggcccgcgaggacgccattctggtgcggatcgcccaactgctcgtcgacggtcacaccgacgagtccatcagtcagcggctcggcatcggggtgcggacggtggccaagcggatcagcacgctctccggccggctcggcagccgcagccggggacagctcggctatctgatagcccgctccggaatgctcgacgagccctctccccctgccccgccggctcctccctcgggc

SEQ ID NO: 3153 - DNA, 1017 bp, Streptomyces avermitilis
  CDS (1)..(1017)
atgaaccggcaccgggtgacggccctgctgaacccaccgcagtcacccttcgaactggcctgcgccgccgaggtcttcggcacggtccgcccgcagctcccggcccactacgacttccgggtctgcgccgaccacccggggccgctgccgaccaccgtcggctacgcgatgctcgtcgaggacggcctcgacgcgctggacgaggcggacaccgtcgtcgtaccgggctggcagccgcccggcactcccgcgcccgcccgcgtcctcgcggcgctgcgggccgcgcaccggcgcggcgccagaatcatctccatctgcacgggcgcgttcgtcctcgcccaggcggggctgctcgacggccgcgccgccaccacccactggcgccgcacgggccaactcgcggccgccttccccgaggtgcgggtcgaggcggacgtgctctacgtcgaccacggcgacgtggcgaccagcgccggcatcggcgccgggatcgacctgtgcctgcacctcgtacgctccgaccacggcgccgcgtacgccaccgaggtggcccgcagcatggtcctgccaccgcaccgcgagggcagtcagctccagtacgccgtgcggcccgccccggcccgcacggacgagtcgctggcaccgctgctggagtgggccaccgcccacctcgacggccggctgaccctggaccggctcgccgagcgcgccgggctgtcgagccggacgctcgcccggcgcttcgccgagcagctcggcaccagccccggacagtggctgctgggccgacgcatcgacgcggcacgcgtgttgctggagcagaccgacctgccggtggagaccgtcgccacccgggtcggcctcgcctccgccgtcaacctgcgccgccgctttcgtacggccgtcggcaccacacccggcgcgtaccggcagatattcggcggggctcagcccgagggaggagccggcggggcagggggagagggctcgtcgagcattccggagcgggctatcaga

SEQ ID NO: 3154 - DNA, 327 bp, Streptomyces avermitilis
  CDS (1)..(327)
atgagcaacatcaccgacaccgggaagtacgccgtccaggtcgccgaggtgccgccggaggaagtgacgcccgggatcgtgcgccgtccgctgccgaagaccgacaacgcccgcggctggctgatcgacttcgcccccgggaccgagtggccggaagtcgacgtccacgcctccgaggagcgctactacgtcctgaacggggaggtcatcgagggcgaggaacgccacggccccggcagctacgtcgtgttcgccccgggcagcagccatcgcccccgcagcgacatcggcgccacgatcctgggctggacggacctgccgggggca

SEQ ID NO: 3155 - DNA, 519 bp, Streptomyces avermitilis
  CDS (1)..(519)
atggccacaccgcccggctcgcccgacccgcacgggccgggcggctcttcgcaccggctgcgcctggagaaggtgaccccggacaacatcgacgcggcgatcgccctgaaggtcgggcccggccaggagcggttcgtgtccccggtggtgaagtcgctcgccgaggcgtacgtgcaccccgcgacggcctggccccggctcgtttacgacggtgacgaactcgtcgggttcgtgatggccttcttcgacatccgcttcaaccccgacgacccggacgaccgcccccggtccggcctctggcgcctcaacatcgggcacggccggcaggggcgcgggtacggccgcttcgccgtggacgccgtccgcgcggagatccgccgccgcggcgggtcccgggtcaccgtcacctgggcggagggcgagggcggccccgagccgttctatctccgcctcggcttccggcgaaccggggagatcagcggggaccaggtcgtgggcgagctggacctggccggggcc

SEQ ID NO: 3156 - DNA, 405 bp, Streptomyces avermitilis
  CDS (1)..(405)
atgggcgagacgagccggttgacgccggtcatccacaacatcaccttcgactgcaccggcgacccgtacgacgtcgggctcttctggagcgccctgctcggccggccgctggacgacgacgacaagcccggtgacccggcggcgctgatccgcgaccccgacggcggcccgagcctgctcttcctgcgcgtcccggagggcaagtcggtgaagaaccggatccacttcgatctccggccccgcggatgcacccgggacgaagaggtcgagcgggccctcgggctcggggcacggaaggtcgccgaccacacccgtcccgacggcaccggctgggtcctcctggccgaccccgagggcaacgagttctgcgtggaacgcggggacgccgaacgcgcggagaaggac

SEQ ID NO: 3157 - DNA, 501 bp, Streptomyces avermitilis
  CDS (1)..(501)
atgacacgaaccgatacgcctcccgcctgggacgagcgcacgcagctggccaccttcctcgactacgtacgtgccaccgcccgggccaagtgcgagggcgtctcgcccgaggacgccgtcaaggcaccgttgcccggctccccgctgatgacgctgagcggagtggtcaaccacctccgctgggtggagtactggtggttccaggtggtgttcctgggcgaggaggacgagggtccctggacggacgaggaccccgaccgcgagatgcgcatcgccgtggacatgccgccggcggacgtcctggccgagtacgaggaacagtgcgcccgctaccgggagctggtcgcggagcatgacctggacgccaccgccaagcgccccatccgcgacggccgccatgtcgacctgcgctgggtgatcctgcacctcatcgaggaaacggcccgccacaacggccacctggacatcatccgcgagctggtcgacggcgagacgggagcc

SEQ ID NO: 3158 - DNA, 738 bp, Streptomyces avermitilis
  CDS (1)..(738)
atggccgaccgctcgttctccgacaccaccctcgccggactgtacgacgccctcaacccctggggcccgagtgaggacttctacctgggacttgtgatgtccgcgcagagcgtgctggacgtcggctgcggcaccggcgccctgctcgggcgggcccgcggcgcggggcatccaggacgcctgtgcgggctcgaccccgccgcggccatgctcgtccaggcccgccggcgccgccccgacgtcgagtgggtgctcggcgacctccgctcgcagcggtggcagggcgccttcgacctggtcgtgatgaccgggcatgcgtttcaagtgctggtcggggacacggaattgaggacctgtctggccggcgtgcgcgaagccctcgcggacggcggccggttcgtcttcgagacccggaacccggctgcccgtgcctgggagtcgtggaccccggaccgggtgcgtgaggtcccgcgggtcgacggcggtgccgtacgcgtccggcacgaggtcgaaccgcccgtcaccggcgatcgcgtgaccttcaccgagaccttcaccagccccgcctgggagcacccccgggtcagccggagcaccctgcgcttcctcgcacccgacgcgctcacccgcttcctggcggaagccggcctgacggtcgccgagcagtacggcgactgggggcgggcaccgctcacccccaccagcgcggagatcatcaccgtggccgaaatcgccccc

SEQ ID NO: 3159 - DNA, 1212 bp, Streptomyces avermitilis
  CDS (1)..(1212)
gtgaagggcggggccacgaagggtgacgccgcgaagggcgcagccgcgaaaggtgacgccgtgaaggccgacgccgtgaaggccgacgccgtgcagggcgacctcaccctgcccgccccgcgcgagggcgccgccgacgacccgggggagccgttgctcgtggtggaaggcctcgtcaagcacttcccggtcaagggcggcttcccgatccggcggaccgtcggcgccgtgcaggccgtggacggcatcgacctgaccgtgaacgtcggcgagagcttcggcctggtcggcgagtccggctgcggcaagtcgacgaccggccggctgatcacgcgcctgctggagccgacgagcggcaggatcacgtaccgcggccaggacatcagccacgccagccgcaagcagctcgcgccgatccggtccgagatccagatgatcttccaggacccgtactcctcgctgaacccccggcagaccgtcggcaagatcatcgcgggtccgatggagatcaacgggatccggccgagcggcggccgggagaagcgggtccgtgagctgctggagatcgtcggtctcaaccccgagcactacaaccgcttcccgcacgagttctccggcggccagcgccagcgcatcggtgtggcccgggcgctggccctggagccgaagctgatcgtcgccgacgagccggtctccgcgctcgacgtgtcgatccaggcccaggtggtcaacctcctccagcaggtgcagaaggacctggggatcgcgttcctgttcatcgcccacgacctggccgtcgtacggcacttctcgcagcgcgtcgccgtgatgtacctcggcaaggtgatcgaggtcggcgaccgcgactcgatctacgcgcgcccccgccacccctatacgcacgcgctgctctccgcggtccccgaggtcgacctggacggcggcggcgagacgcggcgcgaacggatccggctggccggcgatgtgccgtcccccatctccccgccgtccggctgccgtttccgcacgcgctgctggaaggcgcaggacaagtgcgcggccgaggagccgccgctggtccggatctccggcaaccgcgacggccacctgacggcctgccacttcccggaggacccgacgaccggcgcccgcgaggaggacatcgtgctcgacccggccctggtggcactggaggagggcggcgcggagggc

SEQ ID NO: 3160 - DNA, 1059 bp, Streptomyces avermitilis
  CDS (1)..(1059)
gtgaccactgtgaccaaggaatcgggcgttccctccccgtcggacgcgggcgccttcctctcggtgcgtgacctgcacgtccgcttcaagacggaggacggggtcgtcaaggccgtcgacggcctctccttcgacctcgaacgcgggcagaccctcggcatcgtgggggagtcgggctccggcaagtcggtgaccaacctgaccatcctcggactgcacaacccgatgttcaccgagatcgacggcgagatcgtgctggagggacaggagctgatcaccgcccgcgagtccgagctggagaagctgcgcggcaacaaggtcgcgatgatcttccaggacccgctgaccgccctgtccccgtactacaccgtgggccggcagatcgccgaaccgttcatgaaacacactggggcctccaggaagacggcctgggaccgtgcggtggagatgctcggcaaggtcggcattccccggcccaaggaccgggcgaaggactatccgcaccagttctccggcggtatgcggcagcgcgcgatgatcgcgatggccctggtctgcgaccccgatctgctgatcgcggacgagccgacgaccgccctcgacgtgaccgtgcaggcccagatcctcgacctgctcaaggacctccagcaggagttcggctcggcgatcatcttcatcacccacgacctcggcgtcatcgccgacatggccgacgacatcatggtgatgtacgcgggcggcgccgtcgaacggggaacggtcgaggaggtgctgcgctcgccccagcacccctacacctggggcctgctgaactcgatgccgcggatcgactcggacctcgccgcacccctcgcgccgattccgggggcaccgccctcgctgctgaacccgccgtcgggctgccgtttccacccccggtgcaccttccggggcgaggtcggcgggacgcgttgcgtggacgaactcccgctgctgccacccgggcggggcggggcctgccacctcacggcggagcagaagcggaccatcttcatcgagcagatcaaaccccggctgcgg

SEQ ID NO: 3161 - DNA, 978 bp, Streptomyces avermitilis
  CDS (1)..(978)
atgctgcgcttcctcattcgccggacactcggcgccggcgtcatcctctttctgctgagcatcgtcgcgttcctgctgttcttcggaatgccgcgtgatcccggactgctgatgtgcgggaagacgtgcacgccggcgaacctcgcgaacatccaccatgtgctcggcctcgacaagtcgatccccgagcagtactggatcttcctgcacaacctcgtgctgggcagcgaggaattcacccagggcccttgccccgccccgtgcttcggctactcgtaccacaccaacgaggaggtctggggcaccctgatggaccgcctgccgaccaccgtctccctgacgctgggcgcgtgcgtcttcttcctgctcatcggcctcggcaccggactgctcgccgcctggaagcgcggcacgctgatcgacaagaccgtcacggccgggtcgatggtgctcagttcgatgcagatctacttcctgggcccgctggcgctggccgctctcgtgtaccagacccacctcttcgacaagcccgcctaccacgagttcaccgcgaacccggtcacctggttcaccggactgatcatcccgtgggtcgtgctgtcgaccatcttcgccgcgcagtacacacgtatggcgcgctcgtcgatgatcgagcagctccaggaggagcacgtacgcaccgcccgcgccaagggcatgtcgcgcaagtacgtcttcttccgctacgcctggcgcggttcgctgatccccatcgtcaccatcttcggcatcgacctcggctccctgctgggcggcgcgatcatcaccgagtacaccttcggtctgccgggtctcggccaactggcggtgcagtcggtgttcttcagcgatctgccgctgctgctcggggtgatgctgttctccgccgccatgatcctgctgttcaacatcatcgtggatgcctgctacgccttcatcgacccgcgcgtgcggctgtcc

SEQ ID NO: 3162 - DNA, 1809 bp, Streptomyces avermitilis
  CDS (1)..(1809)
gtgatgagtaggggcggacgccacgcatatgccgcaatctcagtgctcgcggccggagctctcgtgctcaccggttgcagcaagggcggcagcgacagcggcaacaacgacaagaaggacaaggagaacgcccagcggcagcaggcgtcgatcaagttcggcgacgcgaaggactccacgggtcccgcggccgccgtaccgggcgccaagaccggcggcacgatggaggtcctgcaacgtgacagctacgcccacctcgacccggcccagatctacgtctccgacgagggctccgtcgccacgctgctccaccgcggcctgaccggctacaaggccaccagcaacgacggcagcaagcacgaggtggtcggcgacctcgccaccgactccggtacgaccacggacggcggcaagacctggaagtacacgctcaaggacggcatcaagttccaggacggcacggcgatcacctccaaggacgtccgccattccgtcgaacgcctcttcgcgcccttcatcaaccaggggccgccctacctccagcagtggctcgccgacaccccgggtgccgactaccgcaagctgctcaaggacggcccgtacaagggcaagcacctgccggacagtgtcctggagacaccggacgcgaagaccgtcgtcttccacttcaagacggcgcaccccgacctgccgtacgccctcgccatggcgggctacgcggtcgtgtcccagaagggcgacaccaaggagaagtacgacagggcgcccgtggcggccggcccgtacaagatccagtcgttcaagtccggcaagtcgatggtgctggtgaagaacaccagctgggacccgaagacggacccgatccgccaccagtacgtggaccggttcaacttcacgttcaaccagcagtacgagacgtccaccaagacgctcctcgccgacagcggcgccgaccaggccggcgtcagcttcaacaaccaggtcgacgcgggcaacctctccaaggtcctcagcgacccgaagatgaagtcccgtacggtcggcggcttccagccctacgtcggccagatgaacatcaacatgagccacccggccctcaaggacaagaagatccgcgaggccatcgcctacgccctgccgatcacaccgttcgtccgggcctacggcggcaccgacgcgatgcaggtcgccggcggtctgatcagcccgaccgtgagcggctacgacgcctccttcgacccgttcggcaagatcaagaaaccggcgggtgacccggtcaaggccaaggcgctgctgaaggaggccggcaaggtcggcatgaagctgaccttcggctacatcaacacgcccgagggccagcagtactccaccgccatggcggccggcctgaagaaggccggcttcaacgtccagcgccaggagatcccggccgagacgtactacgaccaggtcagcaagctcgacaacaactacgacatcttccacaccgcgtggggtgccgactggccgtccgcctcgaccgtgatcccgccggtgttcgacggccgcgcgatcgccgacggtgcgcagaactactcgcaggtcaacgacccccacgtcaacagcgagatcgaccgcgtcaacaagatcaccgacccggtgaagtccgcggccgggtgggagaagatcgaccagtacctggtcaaggaagtagtgaacgtcgtcccgaccgcctactacaagcagatccagatcgccggctcgaaggtcggcggcctggcctacgacgacgtgatcggcggcatcgacccgcgacgcctgttcgtcaag

SEQ ID NO: 3163 - DNA, 1032 bp, Streptomyces avermitilis
  CDS (1)..(1032)
atgacgagtcctcttgaggtcgagggcggcggtccgtcggtcgtcgcggacgacgagaaagaccccaagaaggggtcgggggccgcgcagttggtgggccgatcgcctggccggctgatgtggatccgctacaaacgcgaccgtgccggagtgatctccgcctacgtcgtcggcttcttcttcctcctcggcctgctctccccgctgatctccaagctgtacggcaagaacccgtacaccgtgtacgcggacgagcgcccggagctgttcgacagtgccggcgtgccggtgcagcccaacggcggtatcagcggcgagttctggttcgggctcgaacccggcaacggctacgacgtcttcaccaagctgatctacggcatccgcacctcgctgatgatctccatcgcggtgacgatcacggtcgtgctcaccggcatcctgctcggggtcgcggcgggttacctcggcggcaaagcagacttcttcatcagccgggtgatcgacttcctgctggccttcccgtcgcagctgttcttcatcgcgagcatgccggtggtggtctccctcttcgtgagcccgcgcgacgagacaccgacgtatgtgcgggtcgtcgccctcatcgcggtccagtggttcctgggctggatgagcctcgcccgtatcctgcgcggcacgagtctgtccctgcgggagcgcgagttcatcgaggcggcccgggtcagcggggcgtccccctggcgcatcatccgcaaggagatcctgcccaacgtggtgacaccgctcctggtgcagtccacgtatctgctcccgaacttcgtcacgatcgaggccggcctgtccttcctcggcgtcggcatcgtcgaaccgacgcccgactggggtcagatgttcgccaaggcgtcgaccgagctcgtgctccagaacgacatcacctacatgttcttccccggcgtctcgatgatcatcttcgtcgtcgcgttcaacctgctcggggactcggtcagggatgccttcgatcccaagacggcgcgc

SEQ ID NO: 3164 - DNA, 1905 bp, Streptomyces avermitilis
  CDS (1)..(1905)
atggccacgcgccacgacatccgcaacgtcgccatcgtcgcccacgtcgaccacgggaagacgaccctcgtcgacgccatgctgaagcaggccggtgccttcgcggcgcacgccgccgaatcgctcgacgaccgcatgatggactcgaacgatctggagcgtgagaagggcatcacgatcctggccaagaacacggccgtgaagtaccacccgaaggatggcggcgacgtcatcacgatcaacatcatcgacacccccggccacgccgacttcggtggtgaggtcgagcgcggcctgtcgatggtggacgcggtggtgctgctcgtcgacgcctccgagggcccgctgccgcagacccgcttcgtgctgcgcaaggcgctgcaggcccgcctgcccgtcatcctgtgcatcaacaagacggaccgccccgactcgcgcatcgacgaggtcgtcaacgaggcctacgacctcttcctcgacctcgacgccgacgaggaccagatcgagttcccgatcgtctacgcgtgtgcgcgtgacggtgtggcctcgctgaccaagccgcaggacggcaccgtcccggccgacagcgacagcctggagccgttcttctccacgatcctccagcacgtcccggccccgacgtacgacgaggcggcccccctccaggcgcacgtcaccaacctggacgcggacaacttcctcggccgtatcgcgctgctgcgcgtcgagcagggcgagctccgcaagggccagacggtcgcgtggatcaagcgcgacggcaccgtctccaacgtccgcatcaccgagctgatgatgaccgaggcgctcacccgcaagcccgccgagatggcggggccgggtgacatctgtgccgtcgccggtatcccggacatcatgatcggtgagaccctcgccgaccccgagaacccgatcgcgctcccgctgatcacggtcgacgagcccgcgatctccatggtcatcggtacgaacacctcgccgctggtcggccgtggcggcaccggcaagggtgcctccgccaaggcggccgtcaaggaccgcaaggtcaccgcccgccaggtcaaggaccgtctggaccgcgagctggtcggtaacgtctcgctccgtgtgctcgacaccgagcgcccggacgcgtgggaggtccagggccgtggtgagctcgcgctcgccatcctggtcgagcagatgcgccgcgagggcttcgagctcaccatcggcaagccgcaggtcgtcaccaaggaggtcgacggcaaggtccacgagcccgtcgagcgcctcacggtcgacgtgcccgaggagcacatgggcgcggtcacgcagctcatgggcgtccgcaagggccggatggacaacatgtccaaccacggctccggctgggtccgcatggagttcgtcgtcccgtcccgtggcctgatcggcttccgtacggagttcctcaccggcacgcgtggcacgggcatcgcccactccatccacgagggccacgagccgtggttcggcaccctgacgacccgtaacaacggttcgctggtcgccgaccgcgcgggcgccgtcaccgccttcgcgatgacgaacctccaggagcgcggcgtgctgttcaccgaccccggcaccgaggtgtacgagggcatgatcgtcggcgagaactcgcgcgccgacgacatggacgtgaacatcaccaaggagaagaagctcaccaacatgcgctcctcctcggccgactcgttcgaggcgatcgtcccgccgcgcaagctctcgctcgagcagtcgctggagttctgccgcgacgacgagtgcgtcgaggtgactccggaggccgtgcgcatccgcaaggtcgtcctggaccagaaggagcgcggtcgcaccgccagccgagccaagcacggc

SEQ ID NO: 3165 - DNA, 2235 bp, Streptomyces avermitilis
  CDS (1)..(2235)
atgtcccacgacggcgtcggaccgcgcgcggtgatgcgctcggtcgtgttcctcaccgcgggtgtgctcgtggtgcccgcgctcaccggctgcggcgcggacgacgaggtgagcaagccggtcgccgggcaggacatcgcgccggccgagcgggctctggtcgccgacgggggcaccctgcgctgggccatggacgccgtaccggagaccttgaacacgttccaggccgacgccgacgccacgaccacgcggatcgccggggccgtgctgccgtcgatgttccggctggacgcctccgggcgcccgcagcgcaaccccgacttcctggagtccgccaaggtcgtcgagaccgagcccaagcaggtcgtgctctaccggctccaccagcaggccgtgtggagcgacggccgcgagatcggcgccgccgacttcgccgcccagtggcgggccctgtccggcaaggacagcgcgtactggaccgcccgcaacgccggctacgaccgcatcgagaagatcgagcgcggcaagggcaacctggaggtcaaggtcaccttcagcaggccgtacgccgactggaagtcgctgttctcgccgctgtacccgaaggacgtcatgggcacccccgactccttcaacgacggcgcgcgcaccaagctgaaggtcaccgccgggcccttcgggctcacgaaggtcgaccgcaaggcgggcgaggtcgctctcgcccgcaatccgcgctggtggggccgccccgccaagctctccgagatcgtgctgcgtgccgttccccgcgaccagcgggccgccgcgctcgccgccgacaaggtcgacctcgcggaggtcgacccggcggaggccgagcggatcacgctggccgcccgcgacaagggcggtaagccgctggcggggccccgcgccgcgacgacgcccgccggggcgctgcgctcctgggccgtggcgcacggctccgacgagaaggccgccgaccgggagatctcggcccgcaagaagcggaccaaggcgatcgccaagtacgccgaccagcagtcggcgctgggcggtttcgtggtccgcaaatccctggagcccacctacacgcagctcgccctgaacggctccgggggtcccctcgccgacgagcgcgtgcggcgggccgtggcgcgtgccctcgaccgcaccgagctggccaagctcgtgctccagccgctcgggctgcccgtcgtgccggtcggcagccatctcgcgctgtccgggcaggaggcgtacgccgacaacagcggcgccctcggcgggcaggacaccacggaggcgcaggcgctgctgaccgacgccggctgggtgctcggcggacccgtcaaggagcagaagaagacggccgggtccgaggggaagaaggcgcgccccaccaacggctccggggacggttccggggacgacgggacgtacgtcgtcggcgaggacaacaagccgtccgagaccgacaaggagaagaaggaccccaaggaccacacgaagcagcacggcaacgagcagcccgggaagcacgccgacgaccaggtcggcaagcacatcgacggccggcagtacgtccacgagcaggtcgggcggggcggggcgccgggcgcgtacgccccgaagggcaccgcggcgccgggcggcacgtcggccggggtgctggccaaggacggcaagccgctgacgctgcgcttcgtcctgccgtccggcccggggtcggagtccctgcgggccgtcggggcccggatctcgcggatgctggacagagtcggcatccgtacggagatctcgaaggtgtccgacgacagctacttcaaggaccacatcgcgtccggcgagtacgacctcgcgctctactcgtggcccgcctccgcgttcccggccaccgacgcccggccgatctacgccaagccggtcccggcggcggacggctcgctgagcgtcgagcagaactacacgcgggtcggcacggaccaggtggaccagctcttcgaccaggcgatcgccacgctggacgaggacgaggcgcgcgacctggtccgtaaggccgacgcccgcatctgggccgcagcaggatcgattcctctctatcagcgcccccagctgacggccgcccgccccaccctggcgaacgcgggttccttcggcttccagacaccgctcttcgaggacatgggcttcctgaagaagggcgccaagccgtcggccggcccgtcccagggg

SEQ ID NO: 3166 - DNA, 285 bp, Streptomyces avermitilis
  CDS (1)..(285)
atgtccgtgcacgaagacttgacgtccgtacagcgctgcctcgacgaccttgcgaggtccgtgggacggctggaacagcagctgggcgcgggcctggagatgcgccgggtgcgggccgatgccgaccacctgcgcgagagcctcgcgctgctgcgcgaggccgccgccgagccggccgcgccacgccgacccgacctgctcgccatccccgacaccccgtacgacaaatccctgtggacggactcggacgacgagggtctgggcgcccgcgaccgccacgccccg

SEQ ID NO: 3167 - DNA, 819 bp, Streptomyces avermitilis
  CDS (1)..(819)
ttggccactggcacggaaccccatccgaacagcggcggcgtacgaaccggtacgcgcgccgcgatcgccgccccccatctgcggaccgaccgctggtggctggcgcccgccgtcaccgcggccgggctgctggccttcatcgtgtattcgacctggcgggccttcgcggacacggactactacgccgccccgtacgtctcgccgttctactcgccctgtctggcggagcggtgccagaccatgcacgcgggcccgaacgcggacctcttcgggagctggtggggcatctcccccgccgtcatcatcctgatcttcccgctcggcttccggctgacctgctactactaccgcaaggcctactaccggggtttctgggcctcacccccggcctgcgcggtccccgagccgcacaagaagtacaccggcgagacccgcttcccgctcattctccagaacgtccaccggtacttcttctacgcggccatcgtcgtcgcgggcatcctcacctacgacaccgtgctctccttccgcgacgagcactaccgctggggccatatgggcctgggcaccctggtcttcctgctcaacatcacgctgatctgggcgtacaccgtctcctgccactcctgccggcacatcgtcggcggcaagctcaagcacttctccaagcatcccgtgcgctaccggatgtggcagtgggtcgggcggctcaacgcccgtcacatgctgctggcctgggcgtccttggtgagcgtggcgctcgccgacttctacgtcttcctggtggcgtccggcgccttcgacgatccgcgcttcttc

SEQ ID NO: 3168 - DNA, 2001 bp, Streptomyces avermitilis
  CDS (1)..(2001)
atgcccgtggtcgaccgccaggaatgggacgtcgtcgtggtcggcgcaggaggcgccggactgcgcgccgccatcgaggcgcgggaacgcggcgcccgtaccgccgtgatctgcaagtccctcttcggcaaggcacacaccgtgatggccgagggcggcatcgcggccgcgatgggcaacgtgaactccggcgacaactggcaggtccacttccgcgacaccttgcgcggcggcaagttcctcaaccagtggcggatggccgagctgcacgcccaggaggcccccgaccgcgtctgggagctggagacctggggcgccctcttcgaccgtacgaaggacggccggatctcccagcgcaacttcggcggtcacgagtacccgcggctcgcgcacgtcggcgaccgcaccggcctcgaactgatccgcacgctccagcagaagatcgtgtcgttgcagcaggaggacgagcgggagaccggcgactacgagtcccgcctgaaggtctatcaggagtgcacggtcacccgggtcctgaaggacggcgccgccgtgagcggctccgccgggggacgggtcgccggcgtcttctgctacgagcgcgagtccggccgcttcttcgtcctcgaggcgccctcggtcgtgatcgcgaccggcggcatcggcaagtccttcaaggtgacgtcgaactcgtgggagtacacgggcgacgggcacgcgctggcgctgctcgccggagcgcccctgctgaacatggagttcgtgcagttccacccgacgggcatggtctggccgccgtcggtgaagggcatcctcgtcaccgagtcggtgcgcggcgacggcggcgtgctcaggaactccgacggcaagcggttcatgttcgactacatccccgacgtcttcaaggagaagtacgcgcagtcggaggaggagggcgaccgctggtacgaggacccggaccacaaccgccgcccccctgagctgctgccccgggacgaggtcgcgcgcgccatcaactccgaggtcaaggcgggccgcggctccccccacggcggcgtcttcctggacgtctcgacgcgtatgccggccgaggtgatccggcgccggctcccctccatgtaccaccagttcaaggagctggcggacgtcgacatcaccgccgaggcgatggaggtcggcccgacctgccactacgtgatgggcggcatcgcggtcgactcggacaccgcggcggcccgcggcgtaccgggtctgtacgcggccggggaggtggccggcggcatgcacggctccaaccggctcggcggcaactcgctgtccgacctgctggtcttcggccggcgggcggggctgcacgcggcccagtacgcggcgggcctgccggccggggaccgcaccggcgtggacgacatccaggtcgacacggcggccgccgaggcactgcggcccttctcggccgagggtccggagccgggcgcggacagtgccggcctgggggacgtaccccggccccccggtggccgcccgccggagaacccgtacaccctgcaccaggaactccagcagacgatgaacgacctcgtcggcatcatccgccgcgagggcgagatggaacaggcgctggagaagctggcggacctgcgggtacgggcggggcgggccggggtggaggggcaccggcagttcaaccccggctggcatctggccctcgacctgcggaacatgctcctggtcagcgaatgtgtggcacgcgcggctctggagcgcacggagtcccggggcggtcacacacgcgaggaccacccggcgatggaccgcgcgtggcgtcgtatcaaccttctgtgccgactggccgaccctacgggcgggttggcggcgatggaccccgcccgcggccagatcgacctcacccgggacaccaccgaacccgtccgccccgacctgctcgccctcttcgagaaggaggagctggtcaagtacctggccgaagaggagctgtacgag

SEQ ID NO: 3169 - DNA, 774 bp, Streptomyces avermitilis
  CDS (1)..(774)
gtgaccagctatgaggcccgcttcaaggtgtggcgcggggatgtgaagggcggtggcctggaggacttcgaggtcgaggtgaacgacggcgaggtggtgctggacatcatccaccgcctccaggcgacccaggcccccgatctggccgtgcgctggaactgcaaggcgggcaagtgcggttcgtgctcggctgaggtcaacgggcggccgcggctgatgtgcatgacgcgcatgtcggtgttcacccgggaggagacgatcaccgtcacgccgctgcgcgccttcccggtcgtacgggacctggtgaccgacgtgggcttcaactacgcgaaggcgcgcgaggtcccggccttcgtgccgccggccggcctgggccccggcgagtaccggatgcagcaggaggacgtggaacgcccgcaggagttccgcaagtgcatcgagtgcttcctgtgccaggacacgtgccatgtcgtccgcgaccacgaggagaacaaaccggcgttcgcgggcccgcgcttcctgatgcgggtcgccgagctggacatgcaccccctggacgccgccgccgacaccggcctggaccgtaagcgcacggcccaggacgaccacggcctcggctactgcaacatcaccaagtgctgcacggaggtctgccccgagggcatcaagatcacggacaacgccctgattcccttgaaagaaagggcggtcgaccgcaagtacgacccgctggtgtggctgggatcgaagatcggaaggcggcctcgtccgtcg

SEQ ID NO: 3170 - DNA, 1236 bp, Streptomyces avermitilis
  CDS (1)..(1236)
gtgcggggaaggcccagggaggcccaggggtgcgggcgcggaagtagtacgggcgtacgggagggagcgcggaggatgggtacgagacatacggactccgagggggagagccgagtgggcccgccgggagcggagccggggccggggtcggggccggagcctcgggagacctcggaggagtcctcatcccgcacccccgcctgggcccgccgcacggcccgcgcctggcggcacccgcgcctgcgcctgcccaaacgcatcgcgctcgccctcgctctcgtcctgctcctgccgctcctcgcggccggcgtcgccctgcgcgtcaactacgccggggacccggccgccggcacccagaccagaaaccgcgacgccctctggatgggccacgcctgggtcgacgggcggaagcgggacgcggacgtgaaggcgctcgcgaagcggctgcgcggcaccggcatccgggacctgtatgtgcacgcgggcccgctggaacacgacggaaccctgcccgggtcggctcatcccagggcccgttggctggtcggcgccgtgcaccgcgagctgccgggcgtccgggtccaggcctggctcggcgacaaactggcgagcgagggaccggtcgggctgcggctggagcgcgcggcgacccggacggccgtcgtcggctcgacccggcagatcctggcggccggcttcgacggcgtccacttcgacctggagccgctgcactcgggggaccgcgactacctttccctcctcgacgatctgcgcggcgtcacccgctccgcgcacgtccagctctccgtcgcagcccaccagatcgaccccctcccggcggccaacgcgatccggggcgctctctccggtcaccccaagtggtggtcccagtcgtacttcggccaggtcgcccgccgggtcgaccagatcgcggtgatgtcgtacgacacggccatgccgctggagagcctgtacggcggctacgtcgcccagcagacctccctcgccctcgaggtcaccccggagtcgacggacctgctgatgggcctgccgttctactacgaggacaacctgagccaccacggctccgccgagacggtcgcggcggcggtacgcggcacccgcctcggcctgtcccgcacggaccgcgaccgggagaacttcggggtcgccctgtacgtggacttcgcggccagggagtcggactggacggcctaccggaagggctggctgccg

SEQ ID NO: 3171 - DNA, 2241 bp, Streptomyces avermitilis
  CDS (1)..(2241)
atggccctggggtggctggtgctgcccatggagatggccggagtggatcattcggttcccctgatcccggccgagcagttcgtggccgcgtcgacgtccgcccccggcggggccgcgccggacggcgggggaacgtccaccggggacctcgtcctgccggtcgtggcggtgggggcggcgggactgctggcggtgtacgcgcaggtacgtcggcgacggcgcatgcggacgcgtacgacccccggcggcacgagcgtcggggcggcttcggtggaggagatcgaggcgcgggcgcggcggtcactggtcgagaccgacgactccgtacggaccagcgccgaggaactgcgggcggcagcggcacagttgggggacacggccgtacggcccttccgggctgccctggagtacgcggagtccgagctggccgccgcctttcggctgcggcaccgcctggacgactccgtggcgggcggcggcgcggacacccgggggatgctggaggagatcgtcgcgcgctgcgcggaggcggggcggcggctggacgcggaggccgcggcgttcgaccagacgcggtcgctcgagcggcaggcgccggccgtgctggagcggacggaggcacggttcagggagctgaccgtgcgggcctcggccgcggacaccacgcttgccgagttgcacgaacggtatgccccctcggccgtcgtgccggtggcgggccatgtcgaacaggccaaggaccggctggtgttcgccacgagcagcctcaaccgggcccggcaggccctggaccggggtgagaccgagcgggcggtcgtgctgctgcgtgcggcggagggggccgtcgaccaggccgcggccttcgtggacggcgtcgcgcggctcgccgcggagctggccgccgcggcggagagactgcccgccgcggtggccgggacggagaccggcctcgtggcggcacgcggccgcacggacggcggggccggcgcccgggcggatctgccggggcggatcgcccgcggcgaggcggtggtggcggaggtgcgccgggagatgtccacgggggtgtacgacccggtcggcgccctccgccggatcgagcaggcgcacgcgggcgtggacgtcgcccggcaccacgaacccgacgacgacgaggccctcgtccgcctggaccactcccgcctgacggcacgcagcgcgaccgccgcgacgtcggactacgtcacgacacatcggggcgcggtgggctacgaggcacgcaccctgctggcggaggcgatacggaggttgcaccggcccgaaacggggtggcgagcaagcgacgggaacgacgtacggccggagccggaagggggagggcacgggggcgacgcggaggagacacccaggcaggctgaggcaggccgggcaccggacggctcggagacggaagcggacgaggcgggcgccggaccggggctgggcgaggcgggcgctgaacggcagccgggcgaggtggaggcttcgcgggagccgggcacggcagaagctgaacgggtgccgggcacggcagaagctgcaccggagccgggcacggcagaaaccgcgcgcaagccgggcgcggcagaggctgcgcgggaggcctctgacgctggagcggcgcgggggcccggcgatggaaaggcggcgcggcatccgggcgaaggcggagccgggcccgaagccgacacgatcaaggcttcgccgggacccggcaagacggcagccgcacagcaatccgccggcgcggcagccgcacggcaaccccgcgaaggcggggccgggccggaagtcggcgaggtggaggccgggtgggggctcgttccggtcgtgggcctcggggaggtgcgggaggccgacgcgctggcccggcgggcccggcaggtcgccgagcgcgatgtgcgggcgtacgggaatccgtacggcgcgggagcgccggcgggcgacgggacgggcggcgcggtgctcggcgggatcctgctcggcggcagcgcccgccatgacgacgcgcaccacgcgcgccacggccccgcgcactccggcgggccgacgagcgccgacggcccggcggcgtactcgggcggccctgcggcgtactccgacaggccgacggtgtactccgacagcccggcggcgtattccggcggccccgcgagtttcggcggtccgaggacgcgtggccggaggggcggcggtgagctgttccgtccgcccgcagcggac

SEQ ID NO: 3172 - DNA, 2940 bp, Streptomyces avermitilis
  CDS (1)..(2940)
atgtgccggccggtccaaaaagcatcgggaccgtgctgtgatcgtgaacaccgtgttgtgcggtgccgtagtgctggatactgcgggcagccgcccccggtgaccggtgccggacgcggtgagctggaggggacggttcgcgtgagcgagataccagcgaaggccacggagtccgaggacccgtcggacggcgcgagggcaaaggccgtggctgactcggccatgcccaccgcggccgacgacgcggcccacccccgcagagccgtcgcggcggacggtacggcggacggctccgtggacgacgctgagagcggctccgcgggtgaggccgagagcggctccccggctgccacggccgatgccctggccggcggccgggccgatgaccggtccggcggccgggctgattacggggctgatgaaccgatcggtacccggaccggtgagccggtcggcgacatgatgtggcagagcagtccgcccgggtccatgtacgactacatcaaggtcgcctccttctccatcggcccggacgggctcgtcgagcagtggagtctgcgcgccgagcagatcttcggtatttccgcggagcgcgcggtcggcatggaccccatcgcggcgttcgtcgcgcccgaccggcgtgagttcggacagcgcaagatggcggagatactcgacggacgcgagtggaccggcgtggtccccttccggatgcccactccggaagcgaccgaagggctcgccgaggtctatgtgatgcccaccacgaccgaggacggcgaacgagccgccgtctgcatcgtcgtggacgtccgcaccctgcgccggatcgagaccgaccttgccgcctcgcaggcgatattcggtcaatctccgttcggattcctgctgatcgacaccgatctgcgggtacgccgcgccaaccagcgcttcgcctccacgttcggcggcaaggtggacgaccaccgtgggcgctccgtccacgactacctgccgtccccggaggccgagcgcgtcagcgcgaccctgcgccgcgtcctggagaccggcaactcgatcacggacatgcacgtcacgggcttcgtccccggctccgacgagcgccgcgactggtccatcaacctctaccgcgtgcacagcggcagcggccgccccatcggtgtcgcctggctcggaaccgacaacaccgcccgccgtgcggccgcccgcgaggccgcggccgcccgacgcaatctcgcccttctgaacgaggccggcgcccgcataggcaactccctcgacctggagaccacggcacgcgaacttctcgacgtcgtcgtccccggcttctgcgacctcgccaccgtcgacctgtaccaagggctgctggccggcgacgagaccccgccgggccgggccgacggcagtgccgagctgcgccgggtcgccttctccagcgcggtctccgacgcccctttcgccggtggacccgacccggtgacggtcggcgcggtgcaccactaccccttcaactcgcccggcgccgacgccctgcgcaccggccgcccgcagcacgtcccgcccgaggacggcggcctcatccagtccacgctcgccgtcccgatggtcgcgcacgacacggtggtcggcctcgcccagttctcccgtacgaagggcagcgagccgttcggcgaacgcgaccgcgcactcgccgtggagctggccgcgcgtgccgcggtctgtatagacaacgcgcgcctgtaccgccgggagcacgagcgcgcgttgatactccagcgctcgctccttcccccgggcgacccggaggcgtcgggtctggacatcgcgtgccggtatctgccgggcaacgcggcgacggaggtcggcggcgactggttcgacgtcatcgaactccccggccaccgcaccgcgctggtcgtcggcgacgtgatgggccgcggtctgcgtgccgccgtcgccatgggcgaactccgcacggccgtacgcacgctggcgctgctcgacctcgaacccgccgaagtcctctcggcgctggacgagatcgcccggggcctcggcacccccggcggtgtccagcaggccacccgcacggcccgccagccgcgcgacgcggacctgtccgaggtgtacctcgcgacctgtgtgtacgcggtctacgactcggtgacgcgacggtgcaccttcgccaacgccggccacctgccgcccgtcctcgtcgagccgggcgagaccgcgctgatgctcgacgtaccgccgggcatgccgctgggcgtgggcggcgagccgttcgaggaggtggaggtggagctgccggaaggggctctgctggcgctctacacggacggcctggtcgaatcccgcgaccaccccctcgatgaggggctgcaagcgttcgtgggcgcgctcaccgaccccaccagcccgctggaggacgtgtgcgaccacgttctcaacaccctcgacacacaccacggcgaggacgacatcgcgttgctgatggcgcgtgtgcaggggctgccggccgagtccgtcggcgactggacgctgccgcgggagccgcgcagtgtggggcgggcgcgggagtacgcgcgcggacaactggtcagctggggtctggagccgctggtggacacggcggagctcctggtcagcgagttggtgaccaatgcgctgcgctacggcgagggcgagatcagactccgtctgctcctcgaccgcacgctggtgtgcgaggtctgggacgcgggtctggtgcagccgcgccggcgccgggcgcgggacaccgacgagggcgggcgcggcctgcaactcgtcgggctgctctcggccgggtggggctcacggcggacgccgcgcggcaagacggtgtggttcgaactcccgctcccggacggcgaaacgggcctgacggatccggcggaggcgctgctcagcctgttc

SEQ ID NO: 3173 - DNA, 456 bp, Streptomyces avermitilis
  CDS (1)..(456)
gtgccccttaaccccacgaaaccggacattggtgggcttctggcctgggaagtgatcggcgtgctcgacaccgaaggcgaatgcgccgagtggacgttccccgcggaacccggtgcggtacggactgcgcgtgcggtcgtccgggaccagctgcgcacctgggggctcgacgagctcagtgacatcaccgcgctgctggtcagcgagctggtgaccaattccctgcggcatgccaccggccccatcggcgtacggctggtgagccccgcccaaacgatgcccacgctgctcgtggaggtctccgacccgcttccggacccgccccgtgaacgcgccgccgactccgacgaggagagcggccggggattgcagctcgtcgcatgctcctcccggcgctggggtacgcggccgggagacacgggcaagaccgtgtggttcgagctggcggtgcccggc

SEQ ID NO: 3174 - DNA, 390 bp, Streptomyces avermitilis
  CDS (1)..(390)
atgacggaacggatcgtggtgggggctgccctgctgagcggcggacgcctcctcgccgcgcgccgcagcgcgccccccgagctggccggacgctgggagctacccggcggcaaggtcgaaccgggtgagacccccgagcacgccctcgtgcgcgagctgcgcgaggaactgggcgtgacggcggaaccgggcgggcgcgtaccgggagagtggtccctgaagccgggatacgtcctacaggtatggacggcccgcctcctcgccggcacccccgagccccttgaggaccacgacgaactgcgctggctgactcccggccagatctgggacgtggactggctggaccaggacgtggcggcggtcaaggccgtgctgggcgtctggaacacc

SEQ ID NO: 3175 - DNA, 180 bp, Streptomyces avermitilis
  CDS (1)..(180)
atgaacgacggcacgatcactctcccctggctcgtcatacgccaggacgacaacggcaatcgctatcgcgtgggcaggtacgcgacgcgggccgaggcccagaagatcgcggacagcctcgacggccgtgggcacaagcagctctactgggtggaacggatcgggcagaacggcatcaag

SEQ ID NO: 3176 - DNA, 750 bp, Streptomyces avermitilis
  CDS (1)..(750)
gtgactttcggtgagcagccggcgtatctgcgcgtcgcgggtgatctccgcaagaagatcgtcgacggttcgctgccaccgcacacccgcctcccgtcccaggccaggatccgcgaggagtacggcgtctcggacacggtcgccctggaggcccgcaaggtgctgatggccgagggcctggtcgagggccggtccgggtcgggcacgtatgtgcgggagcggccggtgccgcgccgcgtcgcccgctccgggtaccggccggacagcggcgcgaccccgttccggcaggagcaggccgacggggcggtgcgcggcacctgggagtcgcacagcgagcaggccgaggcgagcggtgcgatcgcggagcggctcgacatccggcccggcgagcgcgtgatgtgcacgaagtacgtgttccgggacgcgggcgaggtgatgatgctgtccacgtcctgggagccgctcgccgtgaccggccgtacgccggtgatgctccccgaggaggggccggtggggggcatgggcgtggtcgagcggatggcggccatcgacgtgatcgtggacaacgtgaccgaggaggtcggcgcccgccccggtctcgcggaggagttgctgaccctgggcggtgtgcccggccatgtcgtcctggtcattcagcggacgtacttcgcgtcgggccgcccggtggagacggcggacgtggtggtgcccgcggaccggtaccgggtggcgtatcacttgccggtgaag

SEQ ID NO: 3177 - DNA, 1167 bp, Streptomyces avermitilis
  CDS (1)..(1167)
gtgcctccgggaagcccgtacccgcaaggcccctaccagcagcagccgtacgcgaacccgtacccgcagccttatcagcagtgggggcagggctattccccgttcaaccggccggcgtccgtcaacggtctcgccatcacctctctcgtcctcggcgtcgtctgctgcgtgcccgccctcgggctgatcctcggcgtgatcgcgctcgggcagatcaagaggcgcggtgagcgcggcaaggggctcgcgatcggcggcatcgtcatgtcctcgctcggcaccgtcctgctggtgctctccctcgccacgggcggcgcccacgagttctgggaggggttcgaggacgaggcgcgggacagcggcggcagcggcgtcaccttctccgtcggcaagggggagtgcttcgactcgcccagcggctccctcgagggcgaggcgtacgacgtcgacaaggtgccctgcgccggcgaccaccaggccgaggtgttcgccaacttcaagatccaggaaggcggttacccgggcgacggcaagatctccgagaccgccgacgacaagtgctacgcgctgcagaacgtgtacgccatggactcatgggccgtcccggacaacgtcgacgtctactacttcacgccgaccgaggacagctggagcctcggcgaccgcgaggtcacctgcatgttcggcaacaccgacgagaagggcagcctcaagggcaccctgcgctgcgacgacaccacgctcggcgccgaccagctcgcctatctccaggccgacgggatcctctacgacgcgctggacaccgcccccgacgaggagtacgtcgaggacgacctgccggggcacaaggagtgggcgacccgggtcgccaaggcgctcggcgaccagaccgagctgctgcgcgcgcaccagtgggcggccgcggacgagcagccggtgacggaccaggcaaaggccctggaccaggcacggaaggagtgggggcaggcggcgaaggcggccgacgccgacgccttctacacccactacgacaacggcagcaggctcctggagggcagcagggcggtcacggcccgcaaggctctgggtctcgccacgaccccgccttcggacggcggggacggcggcggaggcggacaggggagcggggacagcagcagcgaggtg

SEQ ID NO: 3178 - DNA, 1131 bp, Streptomyces avermitilis
  CDS (1)..(1131)
atgactcctttgccggattacttctgcccggcggacggcacgcgcgtccccggcggctccctcgactggtgctgccccgcctgccgcgggccgctggacctggacttcgcccccacgcccgggcccctcaagtccctcggcgggcgcgtgaactcgctgtggcggtacgcggagtgcctgccgctcgcggcgccgacgacgagtctcggtgagggccgtaccccgctcgtgtccctgacggacggcgtcgcggccaagctcgacttcctgatgccgaccctgtcgttcaaggaccggggcgcggtgctgctggccgaactggcgctgcagctgcggccccggcaggtcgtcgcggacagcagcggcaacgcgggtaccgcgatcgccgcgtactgcgcacgggccgccctgccgtgcacggtctacgtccccgagggcacgtcagcgaagaagctggagcagatcgaggcgcacggggcccggctgcgggtggtcgagggcgaccgcgaggcgacggcgcatgcggcgcgggaggccgcggacgaggcgggcgtcttctacgcgtcgcacgtcttcaacccgtacttcctgcacggcaccaagacctatgtccacgagctctgggaggacctcggcggacggctcccggacgcgctcgtcgtgcccgtcggcaacggcacgctgctcctcggcgccgcccttgccgtcgccgagctgcacgcggcgggtctcatcgaccggcggcccgcgctgtacgccgtccaggccgcggcggtcgcaccgctggcccacgcctgggagcagggcgcggacgacctggtcggggtcaccccggcggcccccacgttcgcggagggcatcgcgatcccccgcccgccgcgggcccgtcagatcctgcgggcggtacgcgagtccggtggcgccttcctgacggtgacggaggatcagatcaggcacgcgcagagcgacttggcgtcgcggggactgtacgtcgagtcgacgggcgtggcgtgctgggcggccgtgcgcgcgggcgcgctgccccagccccggccgcgtccgggcgagggaatgcccgcggcggtcgtaccgctgtgcggggcggggctgaagacgggaccggcgcgggcg

SEQ ID NO: 3179 - DNA, 2103 bp, Streptomyces avermitilis
  CDS (1)..(2103)
gtgctcgccgaccacgcccgtgccctcgacgccctgcgctcggccctgacgcccctcaaggccgaactcgtcgccgcggagctggagtccatccccgtctcccggctgaaggacgtcaccgaggggcggctcagactgggggccgtcgaggcggccgggttcacgtccgtgcgcggggtgtacgaggccggccgctacgagctgcggcagcttcccggcgtgggggagcagaccgccgaccgtgccctcgccgcggcccggcagatcgcgcgggccgtggcggagaccgtctccgtacgcctggacgtcgaccaccccgaaccacggaccaccgcgctggtcgtcgccctgcaccggctcgtcgaggccggtcccgagctgcgccgcgccctggacgccgccacccgcctcgacgagcggctcggcgcgctgctgcccgcggcccggcccgcgggcggccggctgcgtctggcgctggccggccggcaccggcgggaggacgcgctcgccgcggccgccgagacgcgcgacctggtcgcggaggccaccgcccgggacgtaccgctgctgctcgcccaggccagtacggacctgctgcgcgaccccgcctccgacatcgaggcctgggtcgacttcgagctgcgttccgcggagtactacagccagctcgccgaggtctcggaacaccgtccggacgccgaggccggcgagggcttcctgccgtccggggtcgccgagcgggtgcacgcccagccgctcgacgacacgcaccgccgggtctcccttcgcggctaccagtcgttcggcgcgcggttcgcgctcgcccagcgccgggtcgtgctcggcgacgagatggggctcggcaagacggtccaggccatcgccgcgctcgcgcacctcgcggccgagggacacagccacttcctcgtcgtctgcccggcgagcgtactgatcaactggacccgcgagatccgcgcccgcagcacgctgcgcgccctcccggtgcacggcgccgaccggcgcgacgcgtacgaggagtggcgcgagcgcggcggcgtcgccgtgaccaccttcgacgtcctgcacagcctgcccgtgcccgacaccgagaagcccggcatgctcgtcgtcgacgaggcccactacgtgaagaaccccgacacccgccgcgccaaggccgtcaccggctggaccgcacactgcgaccgcgtcctgttcctcaccggtacgcccatggagaaccgggtcgaggagttccgggccctcgtccgccaccttcagcccgccctgctgcccgccgtccagggcggcggcgtggcggccggaccgcatgccttccgcaagtccgtcgcccccgcctacctgcgccgcaaccagcaggacgtcctcaccgaactgcccgcgctggtgcaggtcgacgagtgggaggagctcagcgccgccgaccgggacgcctaccgcaaggcggtcgccgaggggaacttcatggcgatgcgccgggccgcgtacgccgacgccgagaagtccgcgaagctggggcggctgcgcgagctggtcgccgaggccgcggacaacgggctgaaggtcgtggtgttctcgtacttccgcgaggtgctcgccaccgtgcaacagtgcctgggggagccggtgctcgggccgatctcgggcggcgtccccgccgcccgcagacagcggctggtcgacgcgttcgcggcgatcgacgggcacgcggtgctgctcgcccagatcgaggcgggcggcaccggcctcaacctccaggccgcctccgtggtcatcctctgcgagccgcaggtcaagccgacgatggaacaccaggccgtggcccgcgcccaccgcatgggccagatacgtacggtccaggtccaccgtctcctcgcgaccgacagcgtggacgaccggctcctgcgcatcctgaagaacaaggaccgcctcttcgacgcgtacgcccgccgcagcgacatcgcggaggccaccccggacgcggtcgacgtgtcggacgcgtcgctcgcccgacgcatcgtggaggaggagcagcagcggctggccgcccggccggccgaccagccggcgcgtacgacgagt

SEQ ID NO: 3180 - DNA, 672 bp, Streptomyces avermitilis
  CDS (1)..(672)
ttgagtagtgcgcccgcggtacgacgacccgccgcggggcgcccggttgtccggctcatcgacgcggacgagagctcccgggccgccgcccggcacgcgccacggctcctgggccccgaggagtggacccgcgccgtcgcgctccgccgtggcccggatcgcgaggtgtacgtcacggctcacgtcgccctgcgcattctgctgggtcccctgctgaaacgtcatcccggtgatctgccgatgggaagggaagcctgtcacgggtgcggcgcacctcacggccggccggtggtgcggggaagccggctgcatttctctctctcgcacagcggacgcctgatcctcgtcgccttcgccgccgaacccgtgggagtcgacatcgagcagatcgcctcgagtcaggcggtggagcaggccagggacgcactgcaccccgctgagcgacaggagttggacacgctccccgaggcccgaagacctcgcgtgttcaccgacatatggacgcgcaaagaggcgtatctgaagatgctgggctccggactcctgcgggacacccgcctggatcgggtgggaacagggcggccgggaagtacgggcgtcaccggagcggaactgacatccgtgcctgtgccctcgggatacgcggcggctttgtgcgttgcggtgcccgtc

SEQ ID NO: 3181 - DNA, 804 bp, Streptomyces avermitilis
  CDS (1)..(804)
gtggcggtcgcgcagaccgtcgcccgcccgggtgacaccgtgcacaacgcgaccgaggcggcggcgaccatagcccgcgcggcggacgccggcgtccgggtcgtccagttccccgagctctccctcaccggatacgagcccggctggctcacgtcccacctgcccgccggagccctgaccccggacggccccgaactgaccgcggtccgcgaggcgtgccgcgcgaccggcgtgaccgccgtcgtgggcgcgccgacctccgcgggtacgaagtcggcgatctcggcgatcgccgtcggcggagacggcgggatcctggccgactaccgcaagagccggctggaggagcacgagcgacagctgttcgtgccgggcacccagtgctgcaccctgaccgtggacggctggcggctggccctgggcacctgctacgacgcgagtttccccgagcacgcccgggccgcggcgcgctccggcgccgatgcctatctgtgcggcggggcgttcgtccggggcgactccgaccaccgccgttcggtgtacttccccgcccgcgccctggagaacaccttctacgtggtgttctcgaacttcgtcgggccgcagggaccgtgggacttctgcggccgcagcgccgtctacggaccggacggccgcaccctggcggaagcgggcgcccgggaggcggagctcgtcgtcgccgacctcgacgacgcggcgctggtggctacgcgccgtggtctgaccatgctccgggacctggacgacgccgcggcaccctcggcgatgagttcgtgtgtcgtg

SEQ ID NO: 3182 - DNA, 291 bp, Streptomyces avermitilis
  CDS (1)..(291)
atgggcctgtgcagcttcctgccgcgctatctgcccctggtcctcctcgccgaccgggagatgcccgcggtggccaagtccctgctgagctacaccccgccggcggtgctggccgccctggtcgtcccggagatgctgatgcccggcggacacggcatgcaactgagtgcgtcgaatccgtatctcatcggtggtggcgtgacctttgtcgccggtctctactcgaagaagttcctgctggtgaccgcgatcggcatcgccgccttctacctgagccgctggctgctcggc

SEQ ID NO: 3183 - DNA, 891 bp, Streptomyces avermitilis
  CDS (1)..(891)
gtgcgatgtcacatgagtaatccgcaggccccgggagaagcggtgcgtcccggtcccggatccacgctgcgcgccggggcgatgagcatgctgccgttcctcgcgtcggccatccccatgggcttggccggaggcatcctggggcccgccaacgggctgtccggctgggccacgctggggctggcgatggccgtcaactcgggcaccgcccagttcatcgggttcgccctgatcgcgggccactcgggcgcgctgaccatcctgctgacgaccctgatcctcgggctcaggatgctgatctactcggccatcctggtcccgcatgtgcgggaggtcccgcagcgctggcgggtgctgctcggcttcgggctgatcgacgccgtcttcttcgtcgccatcgagcgcctcaagaagggcgagctcaccgagcgcaagcacctgttcttcctcggcgcgtccggggtcatgtacgtcacctggatgctgtgcaccctggtgggcatggcgctgggcagtgccgtgccggacctggcggacctcggtctcgacttcccgatgaccgccatgttcgtcgccatgctggccgggtcgctggccaactggcgggtgggcgcggccatcgtgaccgccggtctgacggtcgtgctcggccacggcctgccgtacaacctcggcgtggtgctcgccaccgtcgtcggagccacggtgggcaccgtatgcgagtacctggagaagcgccggaccccggagaactccgccaccgagacgtccgaggagagttcgccggacgagggcgacccgacgagcgaggacaacacggcgaacgacggcaagccgccgaccgaggacaagacggcgaaggcggacaaggtgaacgaggagaacgtggca

SEQ ID NO: 3184 - DNA, 5304 bp, Streptomyces avermitilis
  CDS (1)..(5304)
gtgcaatccctggaaactctcggccggctcaaggttgccgcggcgcaacgtccccgcgagggagcgttctggcgcgcggcactcgccgccctgcccgagcgcaccggcttcccgtccgatgccccgggccgtctcgccgggacgggcccgcacacgacgaccgtgctgcccctcggcgccgaactgaccgccggactggacacgctgacccgtggccggccgatggcgctgcacaccgtgctcgtcgccgccgtcggcaccctgctccagcgctacaccggcggtgaggaggccgtcgtcgccatccccgccacgtccgcggacgcggcggcccccgctctcgccgacgggctggtgctgcgcctgccgttcacgcccgagtcgacgttccgcgcggtcctcgccgacgccaagccccggctggtcgccgcactggagcaccaggacttcccggtcgagatcctcgccggggagttcggcgccgccgccgaccacgacacacaccccttcgcggacgtcctggtcgacgtcgtacgcgaggagcacgaggcaccggccgcccggccgcggttcgcggtggtgttcgccctcgtccgcgacggcgaaggcctgcgcctggagctgcgccaccgtgccgggcagcacagcgccgacaccgccgggcggctgctcgcgcactgcgcggtgctgctggccggagccatcgccgccccggacgacccgctggccgcgctcgacctgcgagcggacgccgaccgggccgtgctcgcgcgggccaacggcaccgacgccgcgttcgaggacaccgtgcgcctcgacgagctgttcacccggcaggcgcggctgaccccggacgccaccgccgtggtcggcgacggcttccggctcacctacgccgaactcgacgcccgtgccaaccggctggcgcggacgctgcgcgagcggggcgtgggccgcgacgacctcgtcgcggtgctggccgaccgctcgccgcagctgctcgtcgccgtctacgccgtcctcaaggccggcgccgcctatctgccggtggaccccggctaccccgtcgagcgcatccgctacgtcctggacgacagcgccgctcgtctcgtcctcagcacgccccgccaccgcgacctggtccacgagggccgcgaggtactcgacctgaccgacgagtccgcgtacgcaaaggacagcacggcgccggaggtcatcggcgacgcccgcgacctggcgtacgtcatctacacctcgggctcgaccggcaatcccaagggcgtccagatcgagcaccgctcggtggtcaaccgcatcaactggatgcagcgcgcctaccccgtcacgtccgccgacgtgatcatgcagaagacgcccacctccttcgacgtgtccgtctgggagctgttctggtggatgttcgagggcgccgcggtgtgcctgcccgaccccggcgcggaacgcgacccggaggcgctggtcaccgccatcgagcggtacggcgtgaccaccatgcacttcgtgccgtccatgctgggcgccttcctcgacttcgtcgtgggagcgggcgtacaggccgggctggtgtcgctgcgccaggtcttcgccagcggtgaggcgctcacgccgcaccacgtccggcgcttcgccgaggtcgccgccgccaccacgggcccggccgcccggctgatcaacctgtacggccccaccgaggccaccgtcgacgtgacccaccacgcgtgcgggcccgacgacgtggaccgggtcccgatcggccgcccgatcgacaacacccgcatcctcgtcctcgactccggactgcggccccagccggtcggtgtgcccggcgaactgtgcatcgccggtgtcggtctggcccgcggctacctcggccggccggaactgaccgccgagcggttcgtcgccgccccggccgccggtgaggagcgcgtctaccgcacgggcgacctggcccggtggctgcccgacggcagcatcgactacctgggccgtatcgaccaccaggtcaaggtgcgcggctaccgcatcgagctcggcgagatcgaggagtcgctgcgccgccacccccaggtcaaggacgccgtggtgctcgcccgcaaggccgaggacggtcagacccacctgtgcggctacgtccagtcggcggacgccctcaccgaagaggacctcaagcggcacctcggtgtgacactgcccgactacatggtcccggcgcgtctcgtcgccctcgacaccttcccgctctccccgaacggcaagctggaccggcgtgcccttcccgagcccggtccggccgagtccgaaagcgccgcctacgtggcccccggcacgccgcaggaggccgagctggcccgcatctggggcgaggtgctcggccatgagcgcgtgggagtgaacgacaacttcttcgccctcggcggcaactcgatccacttcgtcaccgtcctggcgaaagcccgcgcgggcgggctggacttcacgttccagcagttcttccagaaccccacggtggcgcagctggcgcgcagcctcgcccggtccgggccgggtgaacagcccgccgcgctcagcccgttcgagctgctggagcccgaggaccgcgcgctgatccccgccggcgtcgaggacgcgtacccgatgacgcagctccaggccggcctggtcttccagagcgagctgtcgcacggcaccgccgagtatcacgacatcctcagctacatgatccagagctccttcgacgccacgtgcttcgaggaagcggtacgcatcctggtccgccgcaacccgatcttccggaccagctaccacctgaccggctacagcgagtacctccagctggtgcacgaggacgctccgctgccgctgtacatcgccgacctgcgcgggatgagcgagaccgaacaggaggagtggtaccgcgactgggccgtgcgggagaaggcgcaccagttcgtctggacggagccggggctggtacggctgcacgtgcacgtcctgtcggacgacctgttccgctacagcctgagccagcacaactccgcgctggacggctggagcatcaccctggtgcacaccacgctgttcgacctgttccaccggctgcgcgacggccgggaactgccggatgccaccgtggacaaccacgcccgcacctacgtcgcgctggagcgccgctcgctggccgacgacgagcaccgcgccttctgggcggacctgctggaggacagcaccttcacggcgctgccgcggacccgccaggaggccgaggcggacgtcctccccgtggtgttccacgaggtggagttcgcccgggggctctccgaccgcatcgtggcgctcgccaaccagctgtccgtgccggtcaagaacgtgctgatggccgcgcacgcgaaggtgctctcgctcgtctcgggcgaacccgacgtgatggtcggctacgagcacagcggccgtcccgaggcggaggacgccacccgtgccatcgggctcttcctcaacaccgttcccttccgggtggacgccgccgaggggacctgggaggagctggtccggcaggtctaccgctccgagaccgacctgctgcccgcccgccgctaccccatggcgcagatgaagcgggacctcggcacccagaaggagctcttcgaaaccgccttcaacttcacgcacttctacctgctcaagcagctggaggcgcaggacggcttctccctgctggacgtgcgggccaactccgagaccgagttcgtgctgcgagcggagttctcccggcacttcgtcaccgacgaggtccgcctgagcctgcactaccacgcccatctcttcgagccgtggcagatcgcccggatgggtgcctgctacgccgccgccttcgagcagatgacggctgatccgggcgccccgcaccacctggcgaacctgctggccgaagacgagctggccgagctggagcgggccgagcgggccgacgccctccccacggagctggcggccttcctcccgcagcccggtgccgctgtccgggcccgcgtggtcgacgagcacggtctcgcggtgcccttcgccaccgtcggccgggtcgttctgctcgccgacgggcgggacccggtcgagaccggcctgtacgggcgccgcgaccgcgacggtctgcgtctgctgggagaggagcgggcgcggcacaccttccgcgccggcccggccgacgcggccgagaccgcctcggtgccggagcagccggccgaccggcggcccctcgacgaggtggaccggcgtatcgcgcgggtgtgggccacggtcctggacacaccgctggaggagatctccctcgacgacaacttcttcctgctcggcggtgcctcgctcgccgcgatgcgcgtggtcatggaactcgacgggctggtctcgctcaccgacctgatgcgcaactccaccctggcggcgctgggcgaggccgcccgcgccaacctcgcggcggcgaccgaggccgaacagggcccgcaggagctgctgctgtcgctgtccgccgaacgcggcgccgccgaatgcgcgctgatctgcttcccgtacgcgggtggcaacgcgatcaacttcgagccgctggcacaggcgctggacgccgcgggcggcgcggtggccgtgtacggcgtggagctgcccgggcacgacgcgggccgtccggacgaggcgttctcgtcgctggaggacaccgcccggcgcgtggtggaggagatccgcgacaaggcgggcgaccggccgctgatgctctggggccactgcgtcggttccgctctcgcggtggagacggcgcggctgctggaagccgagggcacgactccggcggaggtcttcgtcggcggcaagctgctgcacgacgccgcgaccacgcggcagggcatcgagcaggcggcggcgatggccgacgaggacatcgtgcgctggctcgtcgacgagaccggtttcaccgggttcgacagtctgcgacccgagcacgccgcgttcgtggccggggtgttccgccacgacgccggctccgccaacggctacctgctcgcggccgacgagcacggcccgaaggcgcggctgtccgcaccgctgaccacggtcttcacggcggacgacccgctcacccccgggcacgccgagcgctacaccgcgtggtcgctcttcgccgatcagccccggctggtcgaactcaccgacggcggccactacttctgccgcaccgcggctcccgcggtcgccgacctggtcctgagccgctggcaggcggcctccggacgcggg

SEQ ID NO: 3185 - DNA, 3789 bp, Streptomyces avermitilis
  CDS (1)..(3789)
gtgagcgcacccgtggacacccccgtaccgggcggcgagccgatggcgtggctgcccacaccggccgatccggccgcgagcggcgcgtacgccccggaggagccggcggagaagatggccggggcggagccgggtgccgtctccgtgctcgccacccggacgacgcccgcccgggtgctcgcggcctgggcggcgctcctccaccaccacaccggccgggtcgacctcgacttcggcttcgccgacgcggcggcgcgacccgcgacggtacggctccgggtcgagccgaccgcatcgctcggggcgctggaggaagccgccgcgcgggcgctgcgctcgccgtcgcccggcgagcccgccgccgccacaccttggatggtccggcacacggacgccggtccgtccgggcccgggcgcgccggcgcgctcgtggcggaactggacgagtccgccggcggtggctgcctgaggctgcggcacgaccctgccgcgcaccgcgcggacgcggtggcccggcacgccgtccacctgcgcggcgcgctgaccgccctcgcggacgatccgacgctgccggtgcgggaactggacccgctgacccccgccgaacgcacccgactgctggtggacttcaaccggacgacggtcccctacccgcgggacagccgcgtcgaggagctgttcgccgagcgggcccgcaccgcacccggacacccggccgtggtccacggcgacaccgtcctgagctacgccgaactcgaccacaggtcggagctgctcgcggcccgcctgcgcgcggaggggctgccgccgggcgaaccggtcgccctgctcctgcggcgcgagcccaccctggtggtcgccgcgctcgcggtcctcaaggccggcggcgtctacctgccggtcgaccccgactaccccgccgaccgggtggcgtatctcctggcggacagcggtgcccgccgggtgctgaccgtcagcgacctggccgggcaactcaaggccgtccacgaccggtcggcagatgacctcacggtcctcgccctcgacacctgggactggcgacggacccccggcacgcccccgtgcgcgccggacgccccgccgcgggacgccggtgacgcggcctacctgatgtacacctccggtacgaccggcaagcccaagggcgtgctggtcccgcatcggggcatcacgcgtctggtcagcgggatcggctatgtacgcctggacccgacgaccaggatggcgcaggtcggcacgaccggtttcgacgcctccgtgtgggagatgtggggcgcgctgctcggcggcggcaccctgtgcatcctggaccgcgagaccctgctcgacaccgaggaactcggccgggccctgcgcgaacagcgcatcaccaccgccctgttcacctccgcgctgttcagccggctcgccgacgaggacgtgaccctgttccgtccgctgcgcgacctgctggtgggcggcgacgtgctctccgcccggcacgcccgcgaggtgctggccgccaaccccggcctgcggctggtcaatgcctacgggccgaccgagaacgccgtgatctccacctgccagatcgtcggcgaacccgtcggcgcccgggtgccgatcggccgcccggtgcccaacgcgaccgcgtacgtcctcaaccaggacggactgccgctgcccaccggcgtccccggcgaactccatgtgggcggcgacggcctggccgtcggctaccacggccgccccgacctcacggaacgtgccttcgtaccgcatccgttcgcacccggccagaagctgtaccgcacgggggaccgggtgcggctgctgccggacggcgcggtcgacttcgtcggccggaccgaccaccaggtcaaggtgcgcggcttccgggtggagccgggcgagatcgagaccaccctgtccgcgctgcccggcgtgcgggccgccgtcgtactggcccggcgcctgcccggctcctccgacagctatctgtgcggttacgtcgtgggagacccggacctggacaccgaccggctgcgctcggccgccgccgagtccctgccgccgcacatggttcccgctcacctgatcgtgctgcccgcgctgccgctcaccgtcaacggcaaggtggaccgcgccgcgctgcccgagcccgccgtcgcgaccggtacggcgcccggcggccgcccgccgcgcgacgaactggagcgggcgctgatcgacctgtgggaggacaccctcggcatcgccggcctcggcgtcgacgacctgctgagcgcctacggcgccggctcgctgaccgccacgcggctgtccgcccggatccgccgcaccctgcacctggcctgccccgtctcgctggtgctgaccgccccgacggtggccgcgctcgccgagcggctgcgcggggccgagccctccggccacggcccgctgtcaccggacgcccacccggacggcccccaggggccggccccgttgtcaccgcagcagcacgggatctacgtcgagcaggtcaaggaccccaccgggaccgagtacaacctgccgctcgtcgtggacctgcccgaggtcccgtcggccgagcgcctgcgcaccaccctggccgctctcgtggcccggcacgacgtgctgcgcaccgacatcaccctggacgcggacggccgtccccaccagcgggtgcacgcggaactcccggtggcactcgaggaggtggacctgccggacgacgccgaccccgacgcgtggacggcccggtgggtcagggccttcgacccgcaccgggcaccgctgtggcgcgtggcgctgctgcgccggccgggccgggcccggctcgtcatggacatccaccacctgatcaccgacggctgctccctcaccctgctggccaccgagtgggcgcgacagctgggcggcgccgagcccgcgcggcccgaggtcggctacgccgactacgcccgctgggccgcggggcccgcgggacgggaacacgccctggcccagggggagttctggcgccgtacctatgccacgccggtacggccgctggacctgcccaccgacctgccccggcccccggtgcgccggaccgaaggggcccacctgtcgttcccgctcgccgcggaactcagccacgcgatccgtgagctggcgcgcgcggagggggtgacccccttccacgtcctgctcgccggatacacggcgttcctggggcggatgagcggcagcgacgacgtcaccgtgggcacgcccgtgtccgggcgccacctgcccggcgtggagcgcacccagggcatgttcgtcaacaccctgtgccttcggctcaacccgcgaccggagctttcgttccgcgcccacctgcgtgcggtggccgaccacgcgatggcggccgccgatcaccaggacttcccgttcggggaactggtggccgccgcgggggagcgggactacagccggcaccccatgttcgacacgctcttcgcggtccaggacaccggactgcaccaggtcgacttcctcggcggccgcccgcgctggacaccggaagccaccggacgcactctcttcgacctcaacctgcagatcgacgacgccccggagggcttcacggcccactgggcctacagcacccacctgttcctgccggggaccgtcgaactgttccgcgacgaactgctcgccctgttcgacgcggccgtcaccgcacccgacacggccctgcacagcatgaacgtggtggcagccaccacgcaggccgtgccggacttcgacttcgacttc

SEQ ID NO: 3186 - DNA, 2934 bp, Streptomyces avermitilis
  CDS (1)..(2934)
atgccgccttcccccctccacgcccacctgatcccggccgactgcccaccgtcgggccacacccatgcctggcgggtccggctgcccgaaggcgccgacaccgtccgcctttcccacctgctcgacaccgcggtcgccccgtggtggcccgaggccaccgcacgtccgacgctgtggagcgaacccgtccccgcggccgccggctccaccatcgcggaccgtcgcctgcgggccgagctgcaccgcccgctgggcaccggccaggcgccgctgcgcgtggtgctcctcgcctacgcggacggccgggccgacctgatcctggtcgcccaccgcggcttcctggacgcggcctcgctgcggcacgtggccgacgtactgctcgatcgcgcgccggccgagcggcacgccccgccggcgagcgcgcggctcgcgcctgccgacgcggagctgcgcaaggcgtggagcgtggcggagttcgccggccgggtcgaatgggcggcgggcgacagttccgccggggaccgcaccggcgtggtgcggcaggccctgcgggacacggccgccgacacgtcggggggcgcgctcgcggtcgccacgggactggttctcgggcggtacgagaaccaggacacccctgtcgtcggcgccctgaccggccacccgggccgcccggccgacgccctcgggcccgacgcgggcaccctcctggccctggacctctccggcgcgcgctccaccgccgagctgctgcgcgaggccgcgcacacgctgacagccacgtggtgcgaccggcagacctacgcggacctggtggccgagtcgggcggccgcgtgctggcgggcgtgctcgatccggtcgcgcacccggcggacggccccaccgagacctatctgccgtgccagacggcccccttccccctcaccgtgatggtgcgccgccgtacggacggggagccggagctggagatccaccaccgtctcgccgacgtcgacgaggcggcggcccggcagttcgcccggcacctggcgcggagcctggagcaactgtccgccgacgcgcaggagacggcccccgaggacatcgacctgctgggcgacgaggaccgggacgccctggtggccctcggccgcccggcgcgaccgctcgagtggcagccgcagcgcatcgacgaggtcttcgcgcaccgcgccgccgagcgccccgaggcgatcgccctcagctgcgaggaccactcgctgacgtacgcggagctgaacaaccgggccgaccgcttcgcgggagcgctgcacaacctcggtgtccggcccggtgaacgggtcggcgtctgcctggaccgctccctggacctggtcgtcacgatgctggccgtgctcaaggccgacgccgtctacgtgccgatggacccggcctacccggccgaccggctcgcctacaccgccgaggacgcggggctgcgcctcgtcgtcaccgcgctggaggacttccccgccggacaggcccgcacgatccatccggaggagctggcagcgggcaccgccatggccgcgcccgcacccggacggggcaacgagcaggccgcgtacgtcatctacacgtccggctcgaccggccgccccaagggcgtcgtcgtcccgcaccgcaacgtggtcgccctgctcggtgccacccgggaggacttcggcctctgcccggacgacacctggacgctgttccactccgccgccttcgacttctcggtctgggagatctggggcccgctgctcaccggtgcccggctcgtcgtcgtgccgtactgggtctcccgctccccgcaggatttccgcgcgttgctgcgggacgagcgggtcacggtgctcaaccagacaccctcggcgttcgcccagctggtggaggcggaccggcagcacgaaccggaccttgcggtgcgcctggtggtgttcggcggcgagccgctggacgcacgtggtctgcgcgactggttcgaccgttacccggagcgccgctgccgcctggtgaacatgttcggcatcaccgagaccaccgtccacgtcaccgcccagacggtcggccgcaaggaggccctgtccggctcccgttccgtgggcccggcgctgccgggctggtacctctacgtgctcgacgaacggcagcgacccgtccccctcaacgtccccggtgagatctacgtcggtggcgagggcgtggcgctggagtacctcggccgtcccgagctgaccgccgagcgcttcgtcacggatccgttcaccggcggccggatgtaccgcagcggagacaagggccggctgcggccggacggccggctggagcacctgggccgactggacacccaggtcaagctgcgcggcttccggatcgagctggacgagatccgcaacgtcctgctggacgaccccacggtgaccgcggccgccgtggtcctcggcagcgccgatgccggggacgcggccgcggcgcgcctggacgcctacgtggtcctcgccggcggcgacaccgccgcggtgcgccggcgggcggccaaggtgctgcccgagtacatgctgccggccaccgtcacagctctgcccgcgctgccgctgaccgcgaacgggaagctggacgcccgtcggctgcccgctcccgcggccggtgcgcccgcggcggtggccgccccgtccgcacagccgtcgcccgactccaccgaggcctcgggcacgggactggccgccgcgctcgtcgaggtctggcaggacgtcctcggcgtgccggtcggcccggacgacaacttcttcgagctgggcggcaactccctgtacgcggtgcgcctcgcggccgcgatgaacgagcggaacctgcccccgatgccgatgcgggagctgtacctgaacccgaccgtcaaccgcctcgccgcggtcctcgcaccgggagaccaggcg

SEQ ID NO: 3187 - DNA, 828 bp, Streptomyces avermitilis
  CDS (1)..(828)
atgaccccgcgactgtccggcaagaccgctgtcatcacgggcgccgcccgcggtctgggacgcgccaccgcggtggcgttcgcccgcgagggtgccgacctgatgctgctcgacctggcggcggacctgccgggcgtcccctacccgctgggctccgagagccagctggcccacaccgccgagttgtgccgcgagcaaggcgtcgccgcctcgacggcccggctcgacgtgcgtgacctcgacgcggtggaggccgcgatggccaccacccgcgagcggttcggacggatcgacgtactcgtcaacaacgccgggatcgccgccccttcgggcaaggccgcccatgagatcgacgagcgtgagtggcagctgatgatcgacgtcgacctctccggagcctggcggaccatccgcgcggtaggcggtcacatggccgagcagcgctcgggcagcatcatcaacatcgcctccaccgcgggcctggtgggctaccgccacttcgccggctacgtggccgccaagcacggcctggtcggtctgaccaaggccgtcgcgctcgactacgcaccgctcaaggtgcgggtgaacgccctctgccccggctcggtccgggacgactcgcaggtcgagggccggatgctgtccgaaatcgcgcgttgcctggacgtgccggtggccgagcacgaggagaccttcgtgcaggcccagccgatgaactccctgatcgagcccgaggacatcgcgtcggcagccgtgtggctggcctccgacgagtcccgccaggtcaccggcagcgtcctcgcggtggacggcggcttcaccgcccgt

SEQ ID NO: 3188 - DNA, 711 bp, Streptomyces avermitilis
  CDS (1)..(711)
atgcccaggactcatctcatatgtctgcctttcgcaggttccggtgcgtcgctcttcaaggaatggcaatcacttgctccggaagggctccggatcgtccccgtgcagctccccggtcgtgaggaacgcttcatcgaggctccgcataccgaggtcgccagggccgtggaggagatccacaccactgtgctcgaccagctggccgacgccgaagacatagccgtcttcgggcacagcctgggcgccgtgctggcctacgagctgacgcacaagctccgcgtatcccagtcggtgccgccgagccggctgttcgtcagtggttcgcccggcccgtggagcggtcgcgagcaccgggccaccggtctggacgacgaggcgttcctggcacaggtccgcgcgttcgccggctacgaccaccccgcgctcgcccaccccgagatgcgcgcgctcctgctgcccatgctgcgggccgacgtccagatgcacgagaactaccgcccgacctccgacaagcccctggacgtggcggtcacggccctgcgcggcagcgaggacgaactggtcgacgccgagcagatcgcccagtggcgcgaggcgaccacggccgacttccgcacggcggagctggacggcggacacatgtacctggccgacggcgccgaggcactgctgcggctcatcgccggcgagctcgggccggtggacgcccga

SEQ ID NO: 3189 - DNA, 831 bp, Streptomyces avermitilis
  CDS (1)..(831)
gtgccaatcggctcggacaggctgtgctcggacaggctgtgcgatcgcacatggcgtgtcaccgggttcggcggtagccgtcgagtgtcgtacgaagcctggctcagccccttgcggcggccgactccgcgccccgaggcgcggatcgtggtcatcccgcattccggtgccggccccaatgccctgctgccgctggtgaagcacattcccgcaccgttcgaggtcgttggagtgacgcttcccgggcgggagcggcggttcgtcgaagcgcccgagatctcgccggacgacctcctcggaggcatcgcccgtgaactggccgcgctgccttcccttcccaccgtgctgttcgggcacagtctcggcggatccatcgccttcgccctgtccgtgacggatccgggcagctgctcggcgctggtcatcagcgcccaactgccttgcggatcgcagatcgagcggccgagggagtgggacgaggacgcgctgacccgcgtgctccagcggggcggcgggactccggccgacatgctgaacgatccggcgtggcgtgaccatacgctgcgactcctgcgagccgacctcaccctcgggggacagctggcgctgcgcaacgcgcagatgagggtggcgcatccgctcaccgtgctcggaggcgagcaggacctcctcgtccccgcggagcggctgggcgcctgggccgagcgggcggacaccgcggtggattcccgcgttctccccggcggtcacttctatctcctcgacgatgcgaaccgcgaggttgtggccgaggccgtcgcggcctccgcgagggtggccacggctgccccc

SEQ ID NO: 3190 - DNA, 1065 bp, Streptomyces avermitilis
  CDS (1)..(1065)
gtgacagcaatacacagcgacccggccatcgccttgcgggatccggacccgaccatcgtcttgcgggatctggagaagcggatttacgcccgcgcctgcgaagcggggctcgtcaccaccggtgacgtcgaagcgggtacgggggcgccgcagagcgagatccgcgcggccatccagaacctgcgcacccttcacctggtgcgcgaaacggaggacggggacggccggttcgtcgccgtgtcaccggagagcgcgaagctccaacgtcttgcgccgctgctcggcgaactacggcgccttcaggcacggaccgagacgatgcgcaccgcgtacgacggcttcgtccacgtctacgagacggccgcggccgaacgatcgcggcgagcgggcatcgaggtccttccgaaccgcggcgacgtccggcgcaccatcaacggcctggcggcctcgtcgaccaccgaggtgctcacgtcccacccgggcggtccacggccgcaggaagtgctccacgaatcggtcgccaggtcgcgtgacctgctggagcggggcgtcgccatccggactctctaccagcacagcgcccacttcgacgtcggcacgaccgcctacgtcgagcacttcaccgccctgggcacccagttccgcaccctggccgacgggttcccgcagctgatgatcttcgatcggcgctatgtgctcgtaccgctgcgcgacccgtccgagggcgcgacgctggtcagcgaccccagcatcgtcgacttcgccacagccgcgttcgaacgcgcctgggttgccgccacccccttccgcatcgcctacgaccagcggaaggtccgagaaacctctgaggacgtccggcacagcatcatgcgtctcctggtcaccggcgaggaggaccggcgcatcgccgcgcgcctcgggctgtccctgcgcagttgccagcgccacgtcgcacagatcatgaagcgaatcggcgcccgaaaccggctccacgccggttacctcatctcccagcacgaccttctcaaccggccgctccccgactcccctcaggaactcgcctcc

SEQ ID NO: 3191 - DNA, 393 bp, Streptomyces avermitilis
  CDS (1)..(393)
atgtacgagttccacggttggttcggcatcgcggagtcgccggaggaggccgacaccggcaccctggagcagggcatcgccgagctgcgcgaacgggtcgaggcgctcgactggtcgacgggcgaggcggtgctgcgcgctcacaacggggagtggttcgtacgcgccgacaggctggtcaaccggcggcgcgacgaggcggaggagctcgacgccctggtcgccttcatcgcacggcgcttccccggcgggtggggtctcctgtacgagcgctcggacgaccttccctcaccgccggggccgggcgccttcagggtgcgggtgctggcacgtggtgaggtgacggagcggctcgatccgtttctgtcgccggtacggccgctcatcgaggac

SEQ ID NO: 3192 - DNA, 252 bp, Streptomyces avermitilis
  CDS (1)..(252)
gtgaggcttgtcttcgaggatcagggctgggaggactacacgtcctggctcaagaacgaccgcaagatgctcgctcggatcaacaggctcatcgaggacgtcaaacgcgatcccttcacggggatcggcaagcccgagccgctcaagtaccacttgcctggggtgtggtcgaggcggatcgatgacgagcaccgtctcgtctacctagtcaccgacaaagaggtcgtcatccttgccgctcgctaccactac

SEQ ID NO: 3193 - DNA, 279 bp, Streptomyces avermitilis
  CDS (1)..(279)
atgtcgataactgcgagcgaagcccgcaaggctctctttccgctgatcaagaaggtcaacgacgatcacgaggccatcgagatcgtctccaagcatggcaacgccgtgctcgtctcggccgaggactacgcggcactgcgcgagggctcgtacctgctgcgctcccctgtgaacgcacggcgactgctcaaggcgtacgagaacgccctgggcaacatcaacgtctcggagcgcgagctgatcgatccggatgcgacggatcctgctgagggcgctgcg

SEQ ID NO: 3194 - DNA, 1086 bp, Streptomyces avermitilis
  CDS (1)..(1086)
gtgtcgctcacgatcggaatcgtcggtctgcccaatgtcggcaagtcgaccatgttcaacgccctgaccaagaacgacgtgctcgcggccaactacccgttcgccacgatcgagcccaacgtgggcgtggtcggtgtccccgacgcccggctggccaagctggccgagatcttcggttcgcagaagatccttccggcgaccgtcgacttcgtggacatcgcgggcatcgtgcgcggcgccagcgagggcgagggcctgggcaacaagttcctcgcgaacatccgcgagtccgacgcgatctgccaggtgatccgcgccttccacgacgagaacgtcgtgcacgtcgacggcaaggtctcgcccaaggacgacatcgagacgatcaacaccgagctgatcctcgcggacctccagacgatcgagaaggtcctgccgcgcctgcagcgggagtcgcgcatcaagaaggacatcggcccgaaggtcgcggcggtcgaggcggcccaggcgatcctggagaagggcgagaccctcttctccgcgggcatcgtccagggctccggcaacgaggagctgctgcacgacctgcacctgctcaccaccaagccgttcctgtacgtcttcaacgtcgacgaggacgagctggtcgacgacgacttcaaggccgagcagcgcgccctggtcgcccccgccgaggcgatcttcctcaacgccaagctggaggcggacctcgccgagctcgacgaggaggaagcgatggagctcctggagtcggtcggcgtcgaggagcccggcatggcgaccctggcccgcgtcggcttcaacaccctcggcctccagacgtacctgacggccggccccaaggagtcccgcgcctggaccatcaagaagggcgccaccgcccccgaggccgccggtgtcatccacaccgacttccagaagggcttcatcaaggcggaggtcatctccttcgaggacctggtcgagacgggctcggtcgccgaggcccgcgccaagggcaaggcacgcatggagggcaaggactacgtgatgcaggacggcgacgtggtcgaattccgcttcaacgtc

SEQ ID NO: 3195 - DNA, 711 bp, Streptomyces avermitilis
  CDS (1)..(711)
gtggagcaacacaggacgcgtccccctcagcacggaccgcgacgcggtacgcccctgcccccgcaggccgggcggggcggagccggcgccggacggcccggcaggcccgacgaacggcctggcgggcggcccgacgggaacggtgaggccgccgacggccggccgacgcgcgggcgcggtccgggcggcggcgccgtcgccggcgcgggtcgccgtccgcctgctccgggtcggtccgttccgccgggtcggtccgttccgccacgccggtccgttccgccgcgccggtctgcttcgccgctggtccaggcggtacggcggatgccgaacccgcggctcacagggctcggcggggggttgttctgcggggcggtgatgttcgccctggcgtgtgtcgaccaactgctgttcggggcgtcgctcgcggtgtacggggtgctgttcctgccggtgtgcgcgctgaccgcgtggtgggtgcggcggggcgacctgctgaccgcgccggtggtggtgcccctcgcgttcgccttcggactgctgcccctcgccgacagcagcggggggttcggggggcgcctgatgggcctggtcaccgcgctcgccacgcaggcgggctggctgtacggcggcacgctggtcgcgggtgtcatcacggcggtgcgcaagatccgccagatgagccgccgagccgcgcagcgccgccgaccggcc

SEQ ID NO: 3196 - DNA, 744 bp, Streptomyces avermitilis
  CDS (1)..(744)
atgcagatcttcggtgtggacatcggtggatccgggaccaagggcgctcccgtggacctggacaggggcgagctgacggaggagcgcttcaaggtgctgactccgcacccggcgacgccggacgcggtggccgacggcgtgaaggaggtcgtcggccacttcggctggacgggcccggtcgggatcacgttcccgggagtggtcaccggcggtgccacgatccgtacggcggccaatgtggacaagagctggatcgacacggacgcgcgcgccctgctgagcgaccggctgggcgggcgcccggtgacggtgctgaacgacgcggacgcggcgggtgtggccgagatgcagttcggcgcggggcgcgaccgccagggcacggtcctcgtcctcacgttcggcacggggatcggcagcgccctgttcgtcgacggcgccctcgtcccgaacacggagctgggccacctcgagctgcacggccacgacgcggagaagcgtgcctcgacgaaggtcaaagaggacaacgacatgtcgtgggagcactgggcgcaccgcgtccagaagtacctcgcgcacgtggagatgctcttctctccggagctgttcatcatcggcggcggagtcagccgcaagtcgcacaagttcctgcccctgatcgagggaatcaaggcggagatcgtcccggcggcgcttcagaacaacgcggggatcgtgggcgcggcgatgacggcggcgaagagcgcg

SEQ ID NO: 3197 - DNA, 1014 bp, Streptomyces avermitilis
  CDS (1)..(1014)
atggtttccatgactgcttcgtctggccgccgtgtcctgctcgccgccccccgtggctactgcgcgggcgtcgaccgtgccgtgatcgccgtcgagaaggccctcgagcagtacggggccccgatctacgtccgccacgagatcgtccacaacaagtacgtggtgcagaccctggagcggaagggcgcgatcttcgtcgaacggacggcggaggttcccgagggggccatcgtcatgttctcggcgcacggcgtggcgccggtcgtccacgaagaggcggcccgcggcaagctcgccacgatcgacgcgacctgcccgctggtcaccaaggtccacaaggaagccgtccgcttcgccaacgaggacttcgacatcctcctcatcgggcacgagggccacgaggaggtcatcggcacctccggcgaggcgcccgagcacatcaccctcgtggacggccccggggacgtcgccaaggtagaggtccgcgacccgtccaaggtcgtctggctctcccagaccaccctgtcggtcgacgagacgatggagacggtcgacgccctcaaggagaagttcccccagctcatctccccgcccagcgacgacatctgctacgccacgcagaaccgccagctcgccgtgaagcagatgggcgaggaggccgacctggtcatcgtggtcggctcgcgcaactcctccaactccgttcgcctcgtcgaggtcgccaagctcgcgggcgcgcgtgacgcgtacctcgtggacttcgccgacgagatcgacgaggcgtggctggagggcgtgtcgacggtcggtgtcacgtcgggtgcctccgtgccggagatcctcgtcgagcaggtcctggagtggctgtcgcagcgcggcttcgaggacgtcgagatcgtcaaggcggccgaggagtccatcaccttctcgctccccaaggagctgcgccgcgacctgcgcgcggaggcggcggccctggtggagcagcggacgggcaacggcccctcggcggag

SEQ ID NO: 3198 - DNA, 1206 bp, Streptomyces avermitilis
  CDS (1)..(1206)
atggctgcgaacacgtccgcggaaacgcctctgcccgtaggtgaggtgtcgcggctcatcggggggtggatcgaccggctcggcgcggtgtgggtcgaggggcagatcacccagctgtcgcggcgcccgggcgcgggcgtcgtcttcatgaccctgcgcgacccgtcgtacgacatctcggtcggcgtcacctgctaccgacaggtgttcgacgcggtggcggacgtggtgagcgagggcgcccgggtggtcgtacacgcgaagcccgagtggtacgcgccacgggggcagctgtcactgcgggccgccgagatcaggcccatcggggtcggtgaactcctcgcccgtcttgagcagttgaagaagagcctcgccggcgagggcctgttcgtcaccgagcgcaagaaggccctgcctttcctgccgcagctcatcgggctcgtgtgcgggcgcgcctcggcggccgagcgcgacgtcctggagaacgcgcggcaccgctggcccgccgtccgcttcgaggtgcgcaacgtggcggtgcagggcgtgcacgccgtgccgcaggtcgtccaggcggtgaaggagctggacgcgcgcgacgacgtggacgtgatcatcgtcgcgcgcggcggcggcagcgtggaggacctgctgccgttctccgacgagcagctcgtccgagcggtggcggcctgccgtacgccggtcgtgtcggccatcggtcacgaacccgacaccccgctcctcgactacgtggccgacctgcgcgcctccaccccgaccgacgcggccaagaaggtcgtgccggacgtcggcgaggaggtcgagcgggtgcgggcgctgcgggaccgggcgcggcggtgcgtgcggtcggtcatcgagcgggaggagcgggggctcgcgcacacgctggcccgcccgtcgatagaggatccgcaccggatggtcgacgagcgggcggaccaggtcgcctccctgctcgaccgtggccggcgcacgctcggacatctgctggaccgcgccgattcggagctgtcgcacacccacgcgcgcgtggtggcactgtcaccggccgcgaccctgaagcgggggtacgcggtgctccagcgagccgacggccatgcggtccgggcgccggacgaggtgacggcggacgaggtgctgcgggcgcgggtcgccgagggtgagttcacggtacgagtcgatgtt

SEQ ID NO: 3199 - DNA, 240 bp, Streptomyces avermitilis
  CDS (1)..(240)
atgaccagcaggacggacgagacggcgaacgcgacggcgctcgggtacgagcaggcgcgggacgagttgatcgaggtcgtacgccgcctggaggcggggggcacgaccctggaggagtcgctcgccctgtgggagcggggcgaggagctggccaaggtgtgccggacctggctggagggcgcgcgcaagcggctggacgcggcgctggcggaggaagagaacgcgggcgacgactcggaa

SEQ ID NO: 3200 - DNA, 588 bp, Streptomyces avermitilis
  CDS (1)..(588)
atgtctctcgtccttgaccccgccgcccaggacctgctcttccgcgaggcccgcaccgccaacacgttctccgacgagcccgtgaccgacgagcaggtgcaggcgatctacgacctggtcaagtacggcccgaccgccttcaaccagtcgccgctgcgcatcaccctggtccgctccgccgaggcccgcgagcgcctcgtgcagcacatggccgagggcaaccagcccaagaccgccaccgccccgctggtcgcgatcctctccgcggacaacgagttccacgaggagctgccggccctcttcccgcacttcccgcaggccaaggacgtcttcttcgcggagcgcccggcccgtgagggggccgccgcgctgaacgccgctctgcaggccgcgtacttcatcatcggcgtccgtgccgcgggcctcgccgccggcccgatgaccggtctcgacttcgcgggcgtccagaaggagttcctcgacgacgaccacaccccgctgatggtggtcaacatcggcaagccgggcgaggacgcctggttcccgcgctccccgcgcctggagttcgaccaggtcgtcaccacggtc

SEQ ID NO: 3201 - DNA, 519 bp, Streptomyces avermitilis
  CDS (1)..(519)
gtggcaggtacgaacggtaagcagaagacggtccgggacatgatcctctccctgggcctgatcgggctgatggccgcagtcatctacatcttcatcccgcacgacgactccccgcatgagcctccgcgggtcgactaccgtgtcgaactgctgacggcgcgccgcgcggcgtcctacccggtcgcggcgcccgaaggtctgtccggctcgtggaaggcgacgtcggtgcggtacgcgggcgacgccttcgaggcctggcatctcgggttccacggtcccgacggtgcatacgtggcgatcgagcagtcgactcagaaggcgtccgcgttcatcgactcggccagtcagggcgcgaggaagacggacgccacccagcgcatcggcgaccggacgtggcagcggtacaagggtgagcggtacgacgccctcgtgctcgaggaaaagggcgccacgaccgtggtgaccggctcggcgtcgttcgcggagctgacgacgatggctcaggcgctgaagacggcg

SEQ ID NO: 3202 - DNA, 1032 bp, Streptomyces avermitilis
  CDS (1)..(1032)
atgaccgagaatcatcagctgccgtccgaactagaggtcccctccgaggcacccgaccggaacctcgccctggagcttgtccgggtcaccgaggccgccgcgatggccgcgggccgctgggtcggccgcggggacaagaacggcgccgacggcgcggccgtccgcgccatgcggaccctcgtctccaccgtgtcgatgaacggcgtcgtcgtcatcggcgaaggggagaaggacgaggccccgatgctcttcaacggggagcgcgtcggcgacgggaccggccccgagtgcgacatcgccgtcgacccgatcgacggaaccacgctcaccgcgaagggcatgaccaacgcgatcgccgtactggcggccgccgaccgcggcaccatgttcgacccgtccgcggtgttctacatggacaagctggtcaccgggcccgaggccgccgacttcgtcgacatcaacgccccggtctcggtgaacatccgccgggtggccaaggccaagcgctccatgcccgaggacgtcaccgtcgtcatcctcgaccggccgcgccacgacggcatcatcaaggagatccgggagaccggcgcgcgcatcaagctgatctccgacggtgatgtcgcgggctccatcctggccctgcgcgagggcaccggcatcgacctgctgctcggcatcggcggtacgcccgagggcatcatctcggcctgcgccgtgaagtgcctgggcggcaccatccagggcaagctgtggcccaaggacgacgaggagcggcagcgggcggtcgacgcgggccacgacctcgaccgcgtgctgttcaccgacgacctggtctccggcgagaacgtcttcttcgtcgcgaccggcatcaccgacggcgaactgctgcgcggcgtgcgctaccgcgccgagacagccacgaccgagtcgatcgtgatgcgctccaagtccggcacggtccgtcagatcaggtccgagcaccggttgagcaagctgcgcgcgtacagccagatcgacttcgaccgcgcgaag

SEQ ID NO: 3203 - DNA, 369 bp, Streptomyces avermitilis
  CDS (1)..(369)
gtgctgcaaccgccgcatcagtccctgcaggtcgctgccgttccggcccagcgggcgccagtgcgggaccgggatcaggacgccccatggcacacggaggccgtgtgccggcgtgacgaggccggactgttcttcgcaccctccaaggaacccaccgcggccaggctgtcccgggaggaggcggccaagcgggtctgcgcgcgctgccccgtgatggtcgagtgccgggagcacgcgctgcttcagcccgagccgtacggcgtgtggggcggcctcaccgccgccgagcgccgtgtggtgctggcccggcgcaggcgccgtgacgtcgagctgaagaaggccgcgcgggggacgatagcggcggcggga

SEQ ID NO: 3204 - DNA, 702 bp, Streptomyces avermitilis
  CDS (1)..(702)
gtggaccttcagaagcagactgaactccggcagcagcagagcgaactgcgggcctcggacgccgatcgcgaccggatcgcggacatcctgcgcgaagccctcgccgagggccgcctcaccgccgaggagcacgccgagcgcgtcgaggaggtctaccgcgccaggaccgtcggcgagctggagcctctggtgcgggacctgcccgccgcccacccgcttcgcgcgaccccggcatacgccccggcgccgaaccgccccacggccggcgcgatacccgtcgagcccgacgagaacgtggtggcggtgttcagcgcggccatgcgcaagggccgctggcgtgccggacgtcggatgcacgcgtacgcgatcttcggcagcgtcgagatcgacctcagcgaggcgatcttcgagtaccagcaggtcgtgatcaaggtgatctcggtcttcggcaacgtggagatccgcgtcccggagaacgtctcgctgcgcggcaccggcggcggtgtgctcggcaacttcgaggtgagcacgctggattcgggcgacgccgacgcccccgtggtctacgtggacggactggccatactcggaaacgtcgaggcaaggcccaagcggggcaagttggtcgcggacatcctcgaccgtgtgtcggaccgcgtgacgcgcaagctcgaccacggtttgcgcaaacacctggaccgt

SEQ ID NO: 3205 - DNA, 1674 bp, Streptomyces avermitilis
  CDS (1)..(1674)
atgggcgagatgcctgagttcgcgtacaccgatctgctcccccagggagaggacaccaccccgtaccggctggtgacctccgagggtgtctccaccttcgaggccgacgggcggacgttcctcaaggtcgagccggaggcgctgcgcaagctcgccgaggaggccatccacgacatccagcactacctgcgccccgcccacctcgcgcagctgcgccgcatcatcgacgaccccgaggcgtcgggcaacgacaagttcgtcgccctcgacctgctgaagaacgcgaacatcgcggccgcgggcgtgctccccatgtgccaggacaccggcacggcgatcgtcatgggcaagcgcggacagaacgtcctcacggagggcggcgacgagtcggccctcagccgcggcatctacgacgcgtacaagaacctgaacctgcgctactcgcagatggctccgctcaccatgtgggaggagaagaacaccggctcgaacctgccggcgcagatcgagctgtacgcgacggacggcggcgcgtacaagttcctcttcatggccaagggcggcggctcggccaacaagtccttcctctaccaggagacgaaggcggtcctcaacgagggctcgatgatgaagttcctggaggagaagatccgctcgctcggcacggcggcctgcccgccgtaccacctggcgatcgtggtcggcggcacgagcgccgagtacgccctgaagaccgcgaagtacgcctccgcgcactacctggacgagattccggcggagggctcggagctgggccacggcttccgcgacaaggacctcgaggagaaggtcttcgagctgacgcagaagatcggcatcggcgcgcagttcggcggcaagtacttctgccacgacgtccgcgtcgtccggctcccccggcacggcgcgtcctgccccgtcgcgatcgccgtgtcctgctcggccgaccgccaggccgtcgcgaagatcaccgccgagggcgtcttcctggagcagctggagacggacccggcgcgcttcctgccggagaccacggacgaccacctggacgagtcgggtgacgtcgtcaggatcgacctcaaccagccgatggacgacatcctcgcggaactcacgaagtacccggtgaagacccggctgtccctgtccggcccgctggtcgtggcgcgcgacatcgcgcacgccaagatcaaggagcggctggacgcgggcgaggagatgccgcagtacctgaaggaccacccggtgtactacgcgggtcccgccaagacccccgagggctacgcgtccggctccttcggcccgaccacggccggccgtatggactcctacgtcgagcagttccaggcggcgggcggctccaaggtgatgctggcgaagggcaaccgctcggcgcaggtcacgaacgcgtgcgaggcgcacggcggcttctacctcggctcgatcggcggcccggccgcgcgcctggcccaggactgcatcaagaaggtcgaggtcgtcgagtacgaggagctcggcatggaggccgtctggaagatcgaggtcgaggacttcccggcgttcgtcgtggtcgacgacaagggcaacgacttcttcaaggaccccgcacccgcaccgacgttcacgagcattccggtacgggggccggggctggcg

SEQ ID NO: 3206 - DNA, 435 bp, Streptomyces avermitilis
  CDS (1)..(435)
atgggggagcgggacatggtcttcaatcagtccgggtggaatgtcggcaaggtctacaacatcgcgggcgatctccgcctcaccgaccggagctccccccaggagttcgccgaggcgctgaacgaactgcggtcacgtatacgggccctggaggacgttcccggcgccgatctcgcggccatggacgcggagctggcccaggcggcactggccgcggacacccacgccggcgaacacgccaccgacgccgccaccgacgacgccgcgagcggcgaagacgccaccggagacggcccgtcgcccggtgacgacatcgtcgccggccggctgacgagggtcgcgaaccggctgcgcgcgctcggcacggcgaccgcggcggcctccgaactcggcacctccctcgacaccatggcccagtgggtcgggcaccacctc

SEQ ID NO: 3207 - DNA, 3189 bp, Streptomyces avermitilis
  CDS (1)..(3189)
atgtcaggcttcgacatcacaggtcccgaggacccggccggcgcccccgacggcgcccccggtgagcgggaggccagggtcaacctgccgggcgccgtggacgccgccgtcacccatcagcccgactgggccgtcgactcggtctacatggcgaaggagatctcgttcgtcgaccgccgggtcatggtcaacgagacacccgcgccggccccggacccgtccgggtctcccgcccccgccgacgggcccgcgttccgcaaggccctcgcgagagtgctgctgggcaagctgacgtccacactcgacgagacccactggctggaccacaaactggtcgagctgaccgccatcgtcgaggacgtggacggatacccggccgcgggccaccgcagcctgtggcgcaggcggggacggtacgccacccggcccctcacccaggtgctggcccgccccgaaacggatctcatcctgctccagggcgcccccggcgccggcaagagcgtcgccatgtggcagcacgccgtggaaggactccggcagatcgtgtccggacggaatccggacctgcccctgcccatctacgtcaacctgcgggaactgagggcgaagccggacgagatcaacaccgatgtgctgcggaagtacatcgcccagcagacgggccccaggggaagcatcgagatcgcctcctacttcgcccactgcttcaccgaggatctgcgcagacgccgggtgaccctgttgctcgactccttcgacgagatccccgcggtcctcggcagtgcgaccgtggacaaggcggtgtcgccctacgtccagacggtcatcgaactcgtcgggggcggcggaaggtgcgtcgtggcctcccgggagtacaaggggccgcgcgccgcgggctggacccggctgcacatcctgggactgtcgtcggagcagcaggagtccttcctgcgcggtctcgggctcggccgcgaggacatcggtctcgtccagcccctcctcaccgacccgcggcacgggttcgtgacggagctccagaatccgctcagcctgaagcttctcgcgagctatgtggaggcgcggcacactcttccggagcgcccgagcgccgtgttcgaggagtatgtgtcgcagcgcctgcacgcggccgtggagacggcccgcgacaccggtgaactgcggcgggtcgaggacttcctcgcgcggttcgccttccggctgacgtcgacggacggcgggctctcggtgagcgaacgggagtacggggaggagatcgtgcgggaggcgggtgacgacgccgccgtacgcgagctgctgctgcgcgtcgtgccggcgtccaggctcctcgtctccgcgccggagggccggcatgccggccgccgggtgttcttcggccaccgccgcgtacagcagtacttcgcgagccgccacgtcgcgtcgcgtccctccgcggtcgcgcccttcgagctggtgaccaacggccgctggcgcgagacggccgtgaccgtgctccaggacggttccccggagatcaccggccccctgatggcggagctggccggggtgctgaccgccgagtggggccgctaccgggccatggaggaggcgagccgaagagagtacgtacccatcgccgaggagttcacgtggtcgtcgtacggggagttggtcggcgaggagggcgccaaccctcccccgctgctcacccccttcgcctggtccccgatggccgtgcactgcctggagctgctgaccgccgcctaccacggccagtcgcagtggccccgggcggagatcgaggggctggtccaggcactggtggatgccgcctggaggcgcggcagcgtcagtgaccgcaagttcgccgtcgactgtctgcccctgctgccggagccggtccgcgagcggtacatcgaccgcgcgttcgccggtggcagcggctggatccgcaccacggcgctgcgcgactgcgccacgttgcccgccctgacccccggcatccgccggtccatccgccggctgctgatcaccatgctcagcgagcggtcgctcgccacggagtcccacgccgtcgacgtcgacctgcggcgcctgcacggggacgacgacctggtccgggtgcgccggatcatcagctggtcgccgaaggcggtcgccgtcatctgcgtcctgcacgccctggtggccatggcggcaccgggtgcgtactggtggcgtctgcgggaccagctgctgtggtggtacgccgtgccgctcttcttcttctggtggttccagtccacccagcccctgtcctacggcgtcggaaagagccggacgcggctgttcttcgaacgggtcgtcaaccgcacggtcggcgtggagatggacgtcctggagaccgacgtcctgctgggcagcctggtgatgatcgccggcttgcaggcggcccttcaggtggccctgggcttctacgagatcaccgagggccatacgacgtggggcctgctggagatcacgctctacgcgccgctgagcgtctgtgcgctcctgtggggccccagcctgctgtacgcggtccgccaagggcgctcgtcccgcgagttgagcgcgatcaggctggttctggtcgttcccgacacgatgcgcctcccggaccatccggcgcgtgcgctgtcccggcagacctgggcgaggttcgcctgggactcgctgtggggcctgctcaagatggcggtgttcacctcccccgtctggggcaccttcgccctgctctactacgcgggaggacacaccggacacatcctggcgctcgtcctgctgggcctgctcaccggctatttccccctggtcgtggtgatcggcctggtccgtgagttccgggcgcaccgccgggtgcagcgtgccgtcctgcggggctccaggggcggtgccgccttcgtcgaggccatgttctcgctgcgggacaccggtgaggcggccgagtacgtgcggcgcatccgcggcattcccggcatggacgccgagaagctggaccggcaggccgtccgggcctccatcgcctacctccagaaccgtcccggggcgaagccgtcggacccggcgccggccggcttcgccgtcaccgccccgcgcaggcccgccgcctggcgggcggacgacgccctgctggacgaactgggccgcctggacgaacacctgcgcgcgcgc

SEQ ID NO: 3208 - DNA, 1401 bp, Streptomyces avermitilis
  CDS (1)..(1401)
atgaccgacgaggacgacaagcagaactaccgtgtcgagcacgactccatgggtgaggtccgtgtccccgcggacgccaagtggcgggcccagacccagcgtgccgtggagaacttccccatctccgggcagcggctcgagcgggcgcacatcgaggccctcgcccggatcaagggagccgccgccaaggtgaacgccgagttgggcgtgctcgacaaggacgtcgccgaggccattcaggaggcggccgccgaggtcgcggaggggcgttgggacgagcacttccccgtggacgtgttccagaccggctccgggacctcgtccaacatgaacgccaacgaggtcatcgccacgctcgcgaccgaacggctcggcagggacgtacaccccaatgaccacgtgaacgcgtcgcagtcgtcgaacgacgtgttcccgtccagcattcacatcgcggccaccgccgccgtcacccgcgatctggtacccgccctggagcacctggccgccgcgctgggccgcaagtccgaggagttcgcggacgtcgtgaaggccgggcgtacgcatctcatggacgcgacgcccgtgaccctggggcaggagttcggcggatacgcggcccaggtgcggtacggcgtcgagcggctggccgcctccctgccgcggctcgccgaactgcccctcgggggcaccgcggtcgggaccgggatcaacaccccgccgggcttctccgccgccgtcatcgccgaggtcgcccgcgtcaccgggctgccgctcaccgaggcgcgcgaccacttcgaggcgcagggtgcgcgggacgggatcgtcgagaccagcgggcagttgcggaccatcgccgtaggactgacgaagatcgcgaacgatctgcggtggatggcttcggggccgcgtaccgggctctccgagatcagcctgcccgaccttcagccggggtcctcgatcatgcccggcaaggtgaatcccgtgattcccgaggccgtgctgatggtcgccgcacaggtgacgggcaacgacgcgaccgtcgccgccgccggagccgccggcaacttcgaactcaatgtgatgctgcccgtcatcgcgaagaacgtgctggagtccgtccggctgctcgcccatgtctcccggctgctggccgaccgcaccgtcgacgggatcgtcgcccatcgcgaccgggcccgtgagtacgccgagtcgtcaccgtccgtcgtcaccccgctgaacaagtacatcgggtacgaggaggccgcgaaggtcgccaagaaggccctcgccgagcggcagacgatccgtcaggtcgtcctggagagcggatacgtggaccgtggcgacctcaccctggagcagctcgacgaggcgctcgacgtcctgcggatgacgcacccc

SEQ ID NO: 3209 - DNA, 690 bp, Streptomyces avermitilis
  CDS (1)..(690)
atggcagacggtggagcggtgagacgagtgaaagcggacggttcgacggcgcactgggccccgggcagccatatcctgtggcgctaccgggagaacgccggcgagcacttccacatcgcgcggcccgtgaccgtcgtacgggacgacgacgaactgctcgcggtgtggctggcacccggcaccgaatgcatgcggccggtgctcgcggacggcacgcccgtgcacgtcgagccgctggagtcccgttacaccaagccgcgcacggtgcagctggaccgctggttcggcaccggggtgctcaagctggcgcggcccggcgagccgtggtcggtgtggctgttctgggaaccgggctggctgttcaagaactggtacgtgaacctggaggaaccgctgacgcgttgggccggcggggtcgactccgaggaccacttcctggacatctccgtgcatccggaccgcacttggggctggcgtgacgaggacgagttcgcgcaggcccagcgggacggtctgatggacgccgaactcgccgctcgggtgcgaaaagcgggacactcggcggtggaggtgatccgcgcctggggcccgccgttctcggacggctggcagcactggcgcccggatccctcctgggccgtaccgcccctgccggaggactgggaccgtacgcccgcgcagatggcgacg

SEQ ID NO: 3210 - DNA, 2148 bp, Streptomyces avermitilis
  CDS (1)..(2148)
atggattcgacacgcgtgacggagcaccccacctcgcatgagcgccgccagccgagcgccggccggccctccgcccccgcggacccccgcggggcgctcctgcgtaccccggaaccgctgcagacgccgtcgtcgtcggcggccttacccgcacaggcccgcaccggcgacgcacccaccggacagggcacgacgacaccgtgcggcaagggtccgtccggcggccagggcactcccacgcccccgggtgcgggcggcgccaagccgtccacccctggcgccgagcactcgcagccctcggacgcgggtcccgacgcgcaccgcccgcgccccgctcccgagggcatcccggcccagccgggcggggagcaggacagggtcgccccggcagcgggcggcggggaccggcgcaccgggcaggggctgccgcccggcggcccgatgccgatgcggcgcgacggggaccggctgcgcttcgtgggcgccgcgacccggcggatcgcccgcggcatcgacctcgacgagatcgtgatgggcctgtgccgggccaccgtgccgaccttctcggacgcgatcctcgtctatctgcgcgatccgctgccggtcggcgacgagcggcccatagggcccatggtgctgcggctgcggcgcaccgaccgcatccccgaggagcgggacaccgacggcggcttcctgaccgcgttccagccggagcccgcctccgagctgtcggcggtcacggccgaactgagcgaggtgcggccgggcggcgcgctcgccgaggtgctgcgcggagtacggcccgtcttcgcggacgcgcccgccgcccgggccgcgctgcccgaactcctcggcgacgatctgcccatgcccagcgggcagcgcgcgatcctggccccgctgcgcggccgccgccgcgtcatcggtgccgccctgttcctgcgccgccccgagcgcatggcgttcgaggcggacgacctgctggtcgccgcccagctcgccacgcacagcgcgctcggcatcgacaaggcggtgctgtacggccgcgaggcgtacatcgccgacgagctccagcgcacgatgctgcccgagacgctgccccggcccaccggcgtgcgcctggccagcaggtatcttccggccgccgagaccgcgcgggtgggcggtgactggtacgacgccattccgctgcccggcagccgggtcgcgctcgtcgtcggtgacgtcatgggccactccatgacctcggcggcgatcatgggccagctgcggaccaccgcgcagaccctggccgggctggacctgccgccgcaggaggtgctgcaccacctcgacgagcaggcccagcgcctgggcaccgaccgcatggcgacctgcctgtacgccgtctacgacccggtcgcacaccgcatcaccatcgccaacgcgggccatccgccgccggtgctgctgcacctgggcggccgggccgaggtgctgcgggtgccgccgggcgccccgatcggcgtaggcggggtggacttcgaggcggtcgagctggacgcgcccgccggggccacgctgctgctgtacacggacgggctggtcgagtcccggctgcgcgacgtgtggaccgggatagagcagctgcgggagaagctcgccgccaccgcccagctgaccggcccggaccatccgccgccgctcgaggccctgtgcgacgaggtgctcgacatgctgggccccggcgaccgggacgacgacatcgcgctgctcgccgcccgcttcgacgggatcgcgcccagcgatgtggcgtactggttcctggagcccgaggagaccgcaccgggccgggcgcgcaagctcgcccgccgtgcgctgtcccgctggggcctggaggagctcagcgactccatggagctcctggtcagcgaggtcgtcaccaatgccgtgcgctattcgacccgtccgatcaccttgcggctgctgcgtacggacgtgctgcgctgcgaggtcggcgacgatgtgccgcagctgccgcgactgcgacaggcgcgggccacggacgagggcggacgcggcctctacctggtgaacaagctggccaggcggtggggcgcgacccggctgagcacgggaaaggtggtctggttcgagttgaaccggagc

SEQ ID NO: 3211 - DNA, 1461 bp, Streptomyces avermitilis
  CDS (1)..(1461)
gtgacccaggcaccccagaaggctccgtacaccacgaacaacgtcggaattccggtggagagcgacgaacactcgctcaccgtcggtcccgatggcccgatcctgctccaggaccactacctcatcgagaagatggcccagttcaaccgggagcgggtccccgagcgtgtggtgcacgccaagggcagtggcgcgtacggattcttcgaagtcaccaatgacgtcagccagttcaccaaggccgacctgttccagccgggcaagcgcaccgagatgctggcccgcttctccaccgtcgccggcgagcagggctcgcccgacacctggcgcgacccccgcggcttcgcgctgaagttctacaccgagcacggcaactacgacatggtgggcaacaacaccccggtcttcttcgtccgtgacacgatcaagttccaggacttcatccgctcgcagaagcgccacccggtcaccgggctgcgcagcaacgacatgcagtgggacttctggacgctctcccccgagtccgcacaccaggtgacctggctgatgggcgaccggggcatcccgaagacgtaccgccacatgaacggctacagctcccacacctatatgtggatcaatggcgccggtgagcggttctgggtgaagtaccacttcaagaccgaccagggcatcgacttcctcacccaggcggaggccgacgagctggccggttcggatgccgacaagcaccgccgggacctgttcgagtcgatcgagtccgggaacgcgccgacctggaccctgaaggtccagatcatgccgttcgaggacgcggcggactaccgcttcaacccgttcgacctgaccaaggtctggccgcacggcgactacccgctgatcgacgtcggccggatggtcctcaacaagaaccccgaggactacttcatccacatcgagcaggccgccttcgagccgtccaacctggtgccgggcatcggcccctcgccggacaagatgctgctcggccggctgttctcgtaccccgacacacaccggtaccggatcggcccgaactatgcgcagctgccgcccaaccggccgcacgccccggtgaactcgtacgccaaggacggcccgatgcggtacgtgccgtcgaacgcggcgaggccgtacgcgcccaactcctacggcggccccgcggccgactacgggcaattcggcgacccggcgagctgggagacggccggagagctggtccgcgaggcgaccaagccgcaccgcgaggacgacgactggggccagccgggcacgatggtgcgccaggtcctggacgacgcggcccgcgaccggctcgtgtcgaacgtcagcggccatctgaaggccgatgtctcgcgcccggtcctggaccgcgcggtgcagtactggcgcaacatcgacaaggagatcggcgaccggatcgccagcaacgtcaacggaggc

SEQ ID NO: 3212 - DNA, 2331 bp, Streptomyces avermitilis
  CDS (1)..(2331)
atgggacgagcggaagagagacgagcgcggcagcgcggtggccgccgcgcggcgccccagggctcgtcgaggacggctgccaagagcgccggcgccggcaagggccggatacgcaggctgttcacctggaagaagatcctcggcacgctgttcggcctgtgcctgctgggcatgggcgccttcatcgtgctctacatgatgatcagcgtccccaagggcaacgcggacgccaagctccagagcaacgtctacgagtacagcgacggctcgcccctcgcccgcaccggcacccgcaaccgtgagatcgtcgacctctccgaggtgcccaagggcgtccagcggaccttcgtcgccgccgagaacaagtccttctacaaggactccggcgtcgacttcaggggcacggcccgcggtctgatcaacaccctctccggcaagggcaagcagggtggttcgacgatcacccagcagtacgtcaagaacttctacctgagccaggaccagaccgtcacgcgcaagctgaaggaactggtcatctcgctgaaggtcgaccgccagaagaccaagagccagatcctcgcgggctacatcaacaccagctactacggccgcggcgcctacggcatccaggccgccgcccaggcgtactaccgcgtggacgccaaggacctctcggtaaggcagggcgcgtatctcgccgcgctgctccaggccccgaaccagtacgactgggccatcgcgacggacaccggcaagaagctggtgaaagaccgctggaactacgtgctggacaacatggtcgaggagcactggctggactccggcaagcgcgagggcatgacgttcccgacgcccaagcccccgagggcggcgcccggcatggaggggcagaccggctatctggtggacgcggccaacgcggcgctgatgaagcagctcgtcgcccagggcgccgcctccgacctgggcaccgccgaggcgatggtcaaggccggcggctggaccctcacgctcaacatcgacaagaagaagcaggaccagctggaggcggccgtcaaggcgaagctgaccagcaagctgaacgcgaagaagcgcccggtggacggcgacgtccaggccggcgccgcgtccgtcgacccgaagacgggcaaggtcctcgcgctctacggcggccagaactacgtcaagcactacctgaacaacgcgacccgccgcgactaccagcccgcctccaccttcaagccgctgatcttcgcggccgccctggacgagggagccagcacgcaggacggcaaggcgatcaacgccaacacgatctacgacggcacgagcaggcgccccgtcctggacaacggcgacaaggtcgggttcgcgccgcccaacgaggacaaccgcagctacggaaaggtcaccgtccagcgggccatgaacgcgtccatcaactccgtcttcgcgcagatgggcgtcgacgtcggcatggacgacgtgctgaaggtggcgggcaagctcggcatggacaccaagggtctcgaggcggtgcccgcgcagaccctcggctcgatgggcgcgagcccgctggagatggcggggatctacgcgaccctcgacaaccacggcaagaaggtcaccccggccgtcgtgaggtcggccgagcacaaggaccgtcaggtcaagttcccggacccgatcggcgaccgggtcatcacccgcgaggccgccgacacggtcacgtccgtgctgaccggcgtggtcgacgacggtacggcccagacctcggtggcccaggcggcggaccggcgcggccagcaggtcgcgggcaagaccggtacgtccgacagcaacaagtcggcctggttcaccggctacacgccgaacctggtcacctcggtcggtatgttcggcgagagcgcgaagaaccagagccaggtcaccctgaagggcgccacgggtctcatcccgggcagcggccgcatcaacggcggcggctatccggcgcagatctgggccgcgtacaccttcggcgcgatgggcaaggtcaccaagttcgacctggagaccacccagggcgcggcgatcgagcccaccgtgacgccgaccctcacccagtcgccgagcgactcgccctcgtcgtcgccgacgacgaagaagccgacgaccacgccgcccagcacgtcgacgaccccggcgagcccgtcgacctcgccgacgaccaaggggccgagcaacacgccgacgggtacgacgacgaccccgacggacggactgccggacgatccggtcaatccgaacgaccggaacggtctgaggaaccagaacgatccgacgagtcag

SEQ ID NO: 3213 - DNA, 945 bp, Streptomyces avermitilis
  CDS (1)..(945)
atgtccacgcacgactccacgcacgactccacacccgccgccgacgtacccgagatgcccgcaccgcgcgtgcgggagttcgccgcgcacagcatcggtggcggcctcgcgctgctgctcgggctcgtcggactgctcctcggcgccgggatgatcgcgggcgcgacgacactcgccgcgaccggcgccaaggccgcactgatcgtcggcggcatcctgatcgccatcgcggccttcctcgcgatgtgcggtctgaacacggtggcgccgggtgaggcccgcgtcgtccagctcttcgggcggtaccgggggacgatccggcaggacggcctgcgctgggtgaaccccttcacctcgcgcacgaagatctcgacccgcgtacgcaaccacgagacccccgtcctcaaggtcaacgacgcctacggcaacccgatcgagctcgccgcggtcatggtctggaaggtcgaggacaccgcgcaggccaccttcgaggtggacgacttccgggagttcgtcgccactcagaccgaggcggcggtgcggcacatcgccatcgagtacccgtacgactcccatgacgaggacggcctctcgctgcgcggcaacgcggaggaaatcaccgagaagctcgccatagaactgcacgcgcgcgtggcagcggccggcgtgcggatcatcgagtcccgcttcacgcatctcgcgtacgctcccgagatcgcctccgcgatgctccagcgacagcaggccggggcggtcgtcgcggcgcggcggcagatcgtggaaggcgcggtcgggatggtcgaggcggcgctcgcccggatcaccgagcgggacatcgtggagctggactccgagcggaaggcggcgatggtgtcgaatctgatggtggtgctgtgcggggaccgcgcaccgcagcccgtcctgaacacgggcaccctctaccag

SEQ ID NO: 3214 - DNA, 261 bp, Streptomyces avermitilis
  CDS (1)..(261)
gtgacggctccttcggagggcaccccttcgccggggcggcggccgcagcagcagcgcaagcaggtgctgctgcggctggatccgctcgtgtacgaggcgctggcgcggtgggccggggacgagttgcgctccacgaacgcgcagatcgagttcctgctgcggcgcgctctcgcggaggccggccgcctgccgggggaagccggcccgatcccccgccggggtcggcccccgggaggctccacccccggaccctcctcgacc

SEQ ID NO: 3215 - DNA, 525 bp, Streptomyces avermitilis
  CDS (1)..(525)
atgtccatcggtcacacgctcctagggctcctcgagtccgggccctgtcacggttacgacctcaaacgggccttcgacgaaaagttcggtcacgaccggccgctgcattacggccaggtctactcgaccatgtcccgcctcctgaagaacggcctcgtcgaggtcgacgggatcgaggccggcggcggccccgagcgcaagcggtacgcgatcaccgacgccgggatcaccgacgtgcagcagtggctcgcgaccccggagaagcccgagccgtatctccagtcgaccctctacaccaaggtcgtcctcgcgctgctcacccaccgcgacgcgtccgagatcctcgacacgcagcgctccgagcatctgcgcatgatgcgcatcctcaccgaccgcaagcgcaagggtgatctggccgaccagctcatctgcgaccatgccctcttccatctggaggcggatctgcggtggctggagctcaccgcggcgcgcctcgacaaactcgccgaggcggtgacgacccga

SEQ ID NO: 3216 - DNA, 684 bp, Streptomyces avermitilis
  CDS (1)..(684)
atgactcctgctggttctctgctggccgcgacggatctgcggaagacgtacggtgcgacgaccgctctggacggcgccgagttctcgatccaccccggcgaggtcgtcgcggtgatgggcccctccggctccggcaagtcgaccctgctgcactgcctcgccggcatcgtgccgcccgactccggctcgatcacctacaacgggcgcgagatggccggtatgagcgacaccgagcgcagcgccctgcggcgctccgagttcgggttcgtgttccagttcgggcagctcgtgccggagctgacgtgcgtggagaacgtcgccctgccgctgcggctgaacggcaccggccgcaaggaggccgagcggatctcgctgtcgtggatggagcgcctggaggtcgacgacctccagggcaagcgccccggtgaggtctccggcggccaggggcagcgcgtcgccgtcgcccgttccctcgtcaccagcccgcgcgtgctgttcgccgacgagcccaccggcgccctcgactccttcaacggcgaacgcgtgatggagctgttcaccgaggccgcccgctccaccaacgccgccgtcgtactcgtgacgcacgaggcgcgggtcgccgcgtactcggaccgcgagatcgtcgtacgcgacggcaggtcccgggacatggagcgcatcgta

SEQ ID NO: 3217 - DNA, 2334 bp, Streptomyces avermitilis
  CDS (1)..(2334)
atgagggtgcgtcagtggtccagagacctggccatgggggccagattcgccttcaccggcggacgcgagggctggatgcgggccgtgctcacggccgtcggggtcgggctcggggtggccctgctcctgatgacgaccgcgataccgagcgcgttgcaggcccggagcgaccgcgagacggcccgtacggacatcacctacggcaacacacacataccgaaggcctccgaccggaccctgctggtcgcgcgcgtcgacgacgagtaccgcgacaaggccatccgcggacgggagctggaggccgaagggccccgggcgccgctgccgccgggtgtgcggaagctgccgaagccgggtgagatggtggtctcgcccgcgctggccgacctcctgaagtccggcaacgggaaactcctgcgcgagcggctgccgtaccgcgtcatcggcaccatcggcgagcccggcctcatcggctcggccgaactctccttctactcgggcgccgatgacctcgccccgcggatcaacggctccgaggtcacccgcatcgaccacttcggacagccgctcgggccgcccgacaagctggacccggtgctgctcctgctgatcctcgtcgtcttcgtggtgctgctgatgccggtcggcgtcttcatcgccgcggccgtgcgcttcggcggcgagcggcgcgaccgcaggctcgcggcgctgcgtctggtcggctccgacagtcggatgacccggcggatcgccgccggcgaggcgctcgggggcgccgtgctcgggctcgtcttcggcacggtcttcttcctgctggcccgtgaggtcgccggctccgtcgaggtcttcggccagagcgtcttcccgagttatctgaacccgactccagcgctggccgcgctgatcgccgtcacggtgcccggcgccgcggtgctcgtcaccctgttcgcactgcgcggggtcgtcatcgagccgctcggtgtggtgcgtacggccaagcccgcgcggcgtcggctgtggtggcggctgctgctgccggtgggcgggctcgcgatgctctacccgatgatcgggcagggcaacaccagcgggaacttcaaccagtacctggtgatcggcggcgtcctgctgctcctggtcggcgtcacggcgctgctgccctggatcgtggagacggtggtcggccggctgggcagcggtggcgtggcatggcaactcgccgtgcgacgactgcagttgagcagcggctcggcggcccgcatggtcaatggcgtcgccgtggcggtggccggcgcgatcgccctgcagatgctgttcgccggcgtcgagggcgactacaccaaggcgtcgacgaacgatgtcatgcgggcgcagatggaggtgcgcctgccgtacgacgtcccgctcgaccaggcgcgcgagcagctcgcccggaccaagggcgtacagcgggtcaccgcgatcggctcggcctcgacgggcgacaagaagaaggacgcggacctgtccacgtcgatgaccgtcggcgactgcgcgtcgctgcgcgaggtggccaagctgccgacgtgccacgacggtgacgtcttcgccgtcacggacgccgagtacgacacggacctacggaagctggccaggcccggccgcaccatctacatcgacccctcctacagcggggccgtggcgaacaggcaggtcccctggacggtgccgcgggacatcaagaaggccggggtccgcaaggacccgacgaacagcgagcgcggcggcttcctgctcaccccgggcgcggtgcccgcgaaggccgtgcccgccatcgagggcagcgcctttctgcagatcgaccagtcggtgccggacgtctacgaacacgtccgcaacaccacggcgaagctccacccgctcgcccacgcctggacctgggcgtcggccacgagggacacgagctacgcgtccatccgcaccggcctgtccgtcggcgcgacctgcgtgctgttcctgatcggcgcgagcctgctggtctcgcagctggagcagctgcgcgaacgcaagaagctgctgtccgccctggtcgccttcggcacccggcgccgcacgctgagcctttcggtgctgtggcagacggcgatcccgatcgcgctgggtctcgtactggcgtcggtggtcggtctgactctgggcatcgtcctccagcggatgacggacgtctcggtgcgcgtggactggtcgagcctgctgacgatgaccggcagcggcgcgggagtcgtgctgctggtgaccgccctgagcctgccgccgctgctgcggctgatgcggccggacgggctgcgcgcggag

SEQ ID NO: 3218 - DNA, 1008 bp, Streptomyces avermitilis
  CDS (1)..(1008)
atggccgggaccaggacgaacgggcggcgccagcccagcctcgcccagctgcgggccttcgccgccgtcgccgagcatctgcacttccgcgacgcggccgccgcgatcggcatgagccagcccgcgctgtccggcgcggtctccgccctggaggagacactcggggtgaccctcctcgagcgtacgacccgcaaggtcctgctctcgcccgccggtgcccgtctcgccgtacgcgccaaggcggtgctcgacgaggtcggcgcgctgatggaggaggccgaggcggtacgcgccccgttcaccggggccctgcggctcggggtgatccccaccgtcgcgccgtatctgctgccgaccgtcctcaggctcgtccacgaccgctaccccgacctcgacctccaggtccacgaggaacagaccgccaacctgctggagggcctcgcggtcgggcggctcgacctgctgctgctcgccgtgcccctcggtgtgcccggcatcgtcgagcttccgctgttcgacgaggacttcgtgctcgtgaccccgctcgaccactggctcggcggccgggagggcatcccgcgcgaggcgctgcgtgagctcaacctcctgctgctcgacgagggccactgcctgcgcgaccaggccctcgacatctgccgggaggcgggccgcgcggacgccccggtcaccaccaccgcggccggcctgtccaccctcgtccaactcgtcgccggcggcctcggcgtgaccctgctgccgcgtaccgcggtcaaggtcgagacgacccgcagcgaggaactcctcaccgggtacttcgcggacccggcacccacccggcgcgtggccctcgccatgcgggcgggcgccgcgcggggcgcggagtacgaggagctcgcggacgccctccgcgaggccctgcggccgctgcccgtacgggtcctgggccgcgacgaccgagccgcgacggccggcccgagtccgttgcccggtacgggactacggcgtttc

SEQ ID NO: 3219 - DNA, 552 bp, Streptomyces avermitilis
  CDS (1)..(552)
gtgctcactgtcggtgacaagttccccgagttcgatctgaccgcctgtgtctcgctggagaagggcaatgagttccagcagatcaaccacaagacctacgagggtcagtggaaggtcatcttcgcgtggcccaaggacttcaccttcgtgtgcccgaccgagatcgcggccttcggcaagctgaacgacgagttcgccgaccgtgacgcccaggtgctcggcttctccggcgactccgagttcgtgcaccacgcctggcgcaaggaccacgacgacctgcgtgacctgccgttcccgatgatggccgactcgaagcacgagctgatgcgcgacctcggcatcgagggcgaggacggcttcgccaagcgcgccgtcttcatcgtcgaccagaacaacgagatccagttctccatggtgaccgccggctccgtcggccgtaaccccaaggaggtcctgcgggtcctcgacgccctgcagaccgacgagctgtgcccgtgcaactggaccaagggcgagaccacccttgacccggtcgcgctgctggctggtgag

SEQ ID NO: 3220 - DNA, 531 bp, Streptomyces avermitilis
  CDS (1)..(531)
atggctctcgatgaactgaaggccgccgtaccggactacgccaaggacctgcgcctgaacctgggctcggtcatcggcaactccgacctgccgcagcagcagctgtggggcacggtgctggcgtgcgcgatcgcgtcgcgttcgccgcgcgtgctgcgcgagctggagcctcaggcgaaggcgaacctgtcgccggaggcgtacacggccgccaagtcggccgcggccatcatggcgatgaacaacgtcttctaccgcacgcggcacctgctgtccgacccggagtacgggacgctgcgcgccgggctgcggatgaacgtcatcggcaaccctggtgtggagaaggtcgacttcgagctgtggtcgctcgcggtgtccgcggtgaacggctgcggtcagtgcctcgactcccacgagcaggtgctccgcaaggcgggcgtcgaccgggacacgatccaggaggcgttcaagatcgcggcggtgatccaggcggtcggtacgacgctggacgccgaggcggttctcgcggag

SEQ ID NO: 3221 - DNA, 1320 bp, Streptomyces avermitilis
  CDS (1)..(1320)
atgtcgaaggtgccacggtggatcggccggctcggcgccggactgaccgagatgggtgagcggttggacgagcgccgcgccgaggtggagaaggagacgtccgacgcgccgtcggacggctcgcccccggttcccgctcagaccccggaccacgtcccgccccctcccgagtacgctcccgccgtctccgcccgtcccgatcccgccgtggccgtgccgtgggggatgagggtcgcggcggaggccggttggcggctgctcgtactcgcgggcaccgtctgggtgttgatgcgggtcatcagcgccgtacagctggtcgtgctggccttcgtggccgcgctgctcatcacggcactgcttcagcccaccgtggcacgcctgacccgtcacggcgtgccgcgcggcctcgcgaccgcgctgaccgcgatcctcggcttcgtcgtgatgggtctgatcgggtggttcgtgacctggcaggtcatggagaacatcgacaacctctccaaccaggtccaggacggtatcgacgaactgcggaagtggctgctgaacagccccttccacgtcacgcccaagcagatcaacgagatcgcgaagaacctgcgcgaggccgtcggcgcgaacacggaccagataacgtccgcgggtctggagggcgtcacggtcatcgtcgaggcgctgaccggcatcctgctcaccatgttctcgacgctgttcctgctctacgacggccggcgcatctgggagtggacgctgaagctggtgccgtcggcggcccggccgggcgtcgcgggagcggggccgcgggcctggcggacgctgaccgcgtatgtgcgcggcacggtgatagtggcgatgatcgacgcgatcttcatcggcctgggaatctacttcctggacgtcccgatggccgtaccgctcgccgtcttcatcttcctcttcgcgttcatcccactggtgggcgcggtggtgtcgggcgcgctggcggtcgtggtggcgctggtgacccagggcgtcttcacggcggtgctgacgctggcggtggtgctcgcggtccagcagatcgagggccacatcctccagccgttcatcctgggccgcgcggtccgtgtccacccgctggcggtggtgctgtcggtggcggccggcggaatggtcgcggggatcggcggtgcggtggtggcggtgccgttggtggcggtgacgaacacggtggtcgggtccctgcgttcgtactcccaggaccgggccgtacgccaggccacgacggcgaccccaccggcgcagaccccgaccgagccgtccgaggcgccggcgtcg

SEQ ID NO: 3222 - DNA, 711 bp, Streptomyces avermitilis
  CDS (1)..(711)
atgctggaaggaaaccgtgtgagccggatttcggtccggggattcgcagtggcttcggccaccgcggtcaccgctgtcggcgccgtgactggtgttgcctcgggcagcaccgggcagccctcgagcgacgccgaagcactggcgagcgactcgacgcttctcgcggacatccccgcgggtcagcaggcccaggtacagaccgcatccctgacgcagcaggccgacgcacaggccatcgccgcggatgcgagcgccaagaaggacgccgaggcgtcggcccgcaagcaggcagccgaggacgcggtcgccaagcagaaggccgcgaagaaggcggaagccgacgcgaaggcgcgcaaggaggccgagaccaaggccagccgcgcctcggtccgctccaccagcttccccgtccagggctcgtacaccatcgcgcagatccaggcgatggcgacccagatggtgccgagcggccagttccagtgcttcagcaacatcgtggaccacgagtccagctggaactacaaggcggtcaacgcctcttccggcgcctacggtctcttccaggcgctgcccggctccaagatgtcgtccgtcggttccgactggcagaccaacccggccacccagatcaagtggggcctcaactacatggacagccgctacggcagtccgtgcgaggcctggtccttctggcaggccaaccactggtac

SEQ ID NO: 3223 - DNA, 1323 bp, Streptomyces avermitilis
  CDS (1)..(1323)
gtggtgaccagcacaaagcgccacaagccagaccggcgcacctatgttctcgacaccagcgtcctgctggccgacccgcacgctctgaaccgcttcgacgagcacgaggtagtgctgccgatcgtcgtggtcacggagctggaggccaagcggcaccatcccgaactcggctacttcgcccggcaggccctgcgcctcctcgacgagttccgggtccggcacggtcgcctcgacgcccccattcccatcggggagctcggcgggacggtacgcgtcgagctcaaccactcggaccccagcgtgctgcccagcggctaccgcctgggggacaacgactcccgcatcctcgcggtggcccgcaatctgcaggccgaggggtacgacgtcaccgtcgtgtcgaaggacctcccgctcaggatcaaggcctcgtccgtcggtctcctcgccgaggagtaccgcgcggaactcgccatcacgggctcctccggctggaccgggatggccgagctgaccctggcgggcgagcaggtggacatcctcttcgacgagggacacgtgtatgtccccgaggcggccgaccttcccgtgcacacgggcctgacgatccagtccgagcggggcaaggccctgggccgcgtcacctcggaggggaacgtccggctggtgcgcggcgaacgggaggcgttcgggatcaaggggcgcagcgccgagcagcgcatcgcgctcgatcttctcctcgacccggacatcgggatcgtgtcgatgggcggccgggccggcaccggcaagtccgcgctcgcgctgtgcgcgggcctggaagcggtgctggagcggcgtcagcatcagaaggtgatggtcttccggccgttgtacgcggtgggcgggcaggagctcggctatctgcccggttccgagtccgagaagatgagcccgtgggcgcaggcggtcttcgacaccctgtccgcggtcaccagccgcgaggtcatcgaagaggtcaccgcgcgcgggatgctggaggtccttccgctcacccacatccgcggccgttcgctgcacgacgcgttcgtgatcgtggacgaggcccagtcgctcgaacggaatgtactcctgaccgttctgtcccggatcggggccaattcgcgggtcgttctgacccatgacgtggcgcaaagggacaatctgcgagtggggcggtacgacggtgtcgtcgccgtggtggagaagctgaagggacatccgctcttcgcgcacgtcacgctgacccggtccgaacggtcccagattgcggcccttgtgaccgaaatgctggaggacgggcaggtc

SEQ ID NO: 3224 - DNA, 771 bp, Streptomyces avermitilis
  CDS (1)..(771)
gtgaacctgcgggacaacctgcgccgcctgctggtcaggttctatgcacgcagggtggaaggccatctcgaccacgaccaggtgcccaagcacatcggggtcatcatggacggcaaccgccgctgggcgaaggcggcgggctccaccaccgcccagggacaccgggccggggccgacaagatcgaggaattcctcggctggtgctcggagaccgatgtcggggtcgtcaccctgtggctcctgtcgacggacaacttcgaccgtccgcaggaagaactcggcccgctgctcgggatcatcgagggggtcgtacgcaccctcgccgccgacggccgctggcgcgtgcaccacgtgggcacgccggacatcctgccctcccagatgcagaacgcgctcaaggaggccgaggagaccaccgcgcacgtcgacgggatactcgtcaacgtcgccatcggctacggcggccgccaggagatcgccgacgccgtgcgctcgatgctcctcgacgcccacgagaagggcacgtcgatcccggacctcgccgacgccgtcgacgtcgacctcatcggcaagcacctctacaccggcgcccagcccgacccggacctggtgatccggacgagcggcgagcagcggctgtccggtttcatgctgtggcagaccgctcactccgagtactacttctgtgaggtcttctggccggccttccgcaaggtcgacttcttgcgcgccctgcgcgactacgcggcgcgacaccggcggtacgggaac

SEQ ID NO: 3225 - DNA, 588 bp, Streptomyces avermitilis
  CDS (1)..(588)
gtgatgctgcgtgcatcggcgtgccacaactactctccgaagttgcccggcgacgcgacggtggccgcggaggcgttcattccgggcgggatcatggccgaatcgcagcggattccaagggaatcgttcggaatcagaaataatccggaggatttgcgcacagttgtagatctttcggcgacacgccccggcgtactccgggcgggtgacacgcgccgggaacgcccgcttgacgccggcgctaacttcgcagccatggccacgttcaccacccccgggacacccgaaccggtcccgctggagctcgcgaagtcggcccgcgcccggcggcgcgggctgctgaggcgcgaggggatcgagggggcactgctgctgagcccggcgaactcggtgcacaccctggggatgcggttcgcggtcgatgtcgcctatctggaccgcgagctgcgggtcctggcggtgcggaccatgcgtccgggccggatcggacggccgcgaccgcgggcccggcatgtcctggaggcggaggccggggcgatggagcggtggggggtccggcgtggggtgcgggtcgccgtacgcggcggg

SEQ ID NO: 3226 - DNA, 1158 bp, Streptomyces avermitilis
  CDS (1)..(1158)
atgaccttgaagatcacgtgggacgaggcgagcgcacggcggatgcaacggcagttcctggctgatcccgcgccggccggcagcgccgtcgcggaggtggtcggcgcgatgctgggcgcgcacgcccaggtgctgtcggcggccgagctgtcggtggggatacgggccgagggcgtcacccgggcggacgtacgggcggcgctgtgggaggaccggacgctcgtgaagacgtacgggccgcgcgggaccgtccatctgctcccgagcgccgaactccccttctggactgcggcgctccgcgcgatcccgtcccgtccgagcccgttcgcgccggacgtccggctcaccgacgagcaggcggagcaggtggtgaccgcgatcggcgacgcgctcgacggtgcgttcctgaccatcgacgagctgaacgacgaggtcgtcgcccgcaccgggccctgggccggagacctggtgatgcccgcgttccagggcatgtggccgcgctggcgccaggtgatgcaccgggcgggccagtcgggcgcgctgtgcttcggcccccagcgcggccgcaaggtgacgtacacccgccccgcgcgcatcgggcccgacgcggaagtcaccgcacagcaggcggtcgccgctctcgtacggcgtcatctgcgcgcctacggtccggcgacgcccgcgcacttcgccaagtgggccgccacgtcgaaggggtgggcggacggcgtgttcggtgcgctggcccgggccggggagatcgaggaggtccggttcgagggggcgagtgcctgggtggacgccggggacacccggttcccggcggaggccgtgcgcggggtgcggctgctgccgtacttcgacccgtacggcatcgccgcccagccgcgcgaactgctgttcccgggcgcgtcgtaccagcgggcgctcgcgcgcggccaggccggcaactatccggtgctcctcgtcgacggggtggtggccggggtgtggcatcaacggcgtcaggggcggcgtacgaccgtgacggtggaggcgttgggccggctgacggcacgacaggaacaggaactgggcgagcaggtggagcggatgggcgaggtgctggaggcgaagcccgagctggtggtgggggaggtgacgacggggccgcatgcg

SEQ ID NO: 3227 - DNA, 858 bp, Streptomyces avermitilis
  CDS (1)..(858)
atgaccacgagccgagcgggccgcaccagccataccagccgcaccggcggtgccggtggtgccggtggtaccggtggtgccggcggtaccggtcacaccggccgcaccttcgaagacctcgtcgccgaggccgcggccgcgtccgtcgacgggtgggacttctcctggttcgagggccgtgccaccgaggagcggccgccgtgggggtacgcgcgggccatgggggagcggctggcgggtgcgtccgccgcgctcgacatccagaccggcggcggcgaagtcctcgcctgcgcaccggagttgcccccgctcacggtcgcgaccgagggctggccgccgaacgtcgccaaggccaccgccctgctccacccgcgcggcgccgtggtcgtcgcctccccggaggacgcgccgctgccgttcgcggacgccgccttcgacctcgtcaccagcaggcatccggtgcgcacgtactgggacgagatcgcccgcgtcctgcgccccggcggcacctacttctcccagcaggtcggccccgcgagcgcctacgagctcgtcgagtacttcctcggcccgcagcccgaggagaaccgcacggcccgcgacccggagcgcgcgcggaccgccgcccggaaggccggcctgacggtcaccgacctccgcccggtacgcctgcgcatggagttccacgacatcggggccgtcgtccacttcctgcgcaaggtgatctggatggtcccggacttcacggtcgaggcgtacgagccccaactccgctccctgcacgagaagatcgggagcgagggcccgttcctcgcgcacagcacccgcttcctgatcgaggcccgcaaaccgcaggca

SEQ ID NO: 3228 - DNA, 483 bp, Streptomyces avermitilis
  CDS (1)..(483)
gtgccgtacaccggtggcgagaaagagagtctgcacgccagtctcgaccggcaccgggacgccgtgttgtggaagctggcggggctggacgacgagcaggggcggcgggtgatgacgccgtccggtaccagtctgctgggcctggtgaagcatctcgcgtccgtggagtacggctggttctgccgcacgttcgggcgggaggtggagccgctgtggttcgacccgttcagcgaggaggacatgcgcgcgggcccggacgagacgaccgacgggatcatcgagttctacggccgcgcccgcaccgccgccgaccgcgcgatcgcggagctgtccctggacgacctcggcacgtcgtggaacggcacgcgggtctccctgcgctgggtcctgatccgcatggtcgaggagacggcccggcacgccgggcacatggacatcctgcgggagctgatcgacggggcgaccggggatcaccggcccggg

SEQ ID NO: 3229 - DNA, 504 bp, Streptomyces avermitilis
  CDS (1)..(504)
gtgccacactcacccgacatgagcgacgacaacgtggacaacgcgggcgacgtggaagacgtacagctgcggtacgtgaccgaggccgacctcgaggtcttcctcgcgtacgagcacgatccggaggccgtccggcggtcgaggttcacgccccggccgcgcgaggccttcatgacccactggaaggaaagggtcctcggggacgacaccggtctcgtgctgacggtcaccgtggacggcgacccggccggcaacatcgtggcctggtgggagggcgagcgccgcttcatcgggtactggctcggccgcccgtactgggcccgtggcatcggcagccgggcgctgggcctgttcctgcgccgcgaaaggacccgcccgttgtacgccgaccccttccacggcaacaccgcgtccgtacgcctcctggaaaagcacggcttccgccgcacgggcacggtccgccacggggaggacgagcacatcatgctcgtgctggacgacgcc

SEQ ID NO: 3230 - DNA, 870 bp, Streptomyces avermitilis
  CDS (1)..(870)
atgactgcactcggcgccgtgttccgtccccaactgccccccgagcggctgcgcgcgatcgcgcggctcgcggacgactgcgggctcgaggagttgtggctctgggaggactgcttcctggaaggggggatctcggccgcctccgccgcgctcgcctggacggaacgtctgcgcgtgggcgtcggtctgctccccgtgccgctgcggaacgtcgccgtgaccgcgatggagaccgccacgctcgaccggctgttccccggccgggcggtcgtcggcgtcggccacggtgtgcaggagtggatggggcaggtcggtgcgcgcgccgagtcacccctgacgctgctgcgggagtatctcgacgcgttgcgcgcactgctgcgcggcgagcgcgtcaccacggacggccggtacgtcacgctcgaccgcgtcgccctggactggccgccggcggacgccgtgcgcgtcctcgccggtgccaccggtccccgctcgctgcggctgtccggcgaggcggcggacgggacgatcctcaccgccgccacctccccggagggcgtacggcaggcccgtcggctcatcgacgagggacgggagtcggccggtcgtaccggcccgcacgaggtcgtcgtctatctgcacacggcgaccggcccggacgccgccgcccggctgcgcgccgagatcgaggcgaacggtgaggacccggccgtggaacacggagtcgccggggacgccgccgaggtcgccaaggccgtccggcgcctcgccgacgcgggcgctgacacggtgatcctccagcccacggccgacgagtccgaccccgagggcttcatccgcttcgcggccggggaagtacgcccgctcgtgccg

SEQ ID NO: 3231 - DNA, 645 bp, Streptomyces avermitilis
  CDS (1)..(645)
atgagaaagatcgtgctgatgatgtccgtgtccctggacggctatatcgaaggaccgaaccgcgagatcgactggcatttggtcgacgacgaggtgcaccagcacttcaacgacacgctcagggggatgggcgccttcctgagcgggcgggtcacctaccagctcatggccgacttctggcccaccgccgacgccgatcccgccagcaccggacccgtggccgacttcgcccggatctggcgggacatgcccaagatcgtgttctcgcgcacgttgcagcacgccgggtggcacaccaccatcgtgcgggacctggtcgtcgaggacatccacgccctcaaggcccaggagggcggtgacctcgcgctcgggggcgcggacctcgccgccgaattcatgcggcacgacctcgtcgacgagtaccgcgtgtacgtccatcccgtcctcctcggccggggcaagcgcctcttccccgagaccgacaccctcacgccgctccggctcaccgagtcccgcaccttcggcaacggcgtcgcactcctccgctacgaacgcgccgagagcacagccgacacagccggcacgaaccccgcagcgggcacagccgacgcagctggcacagaccgcccgaacggcaccggctca

SEQ ID NO: 3232 - DNA, 678 bp, Streptomyces avermitilis
  CDS (1)..(678)
atgaccctcaccccccgccgcgccaccgcgaccgcgaccgccaccgcgaccacactcaccgcactggccgtactcgccacgctcaccctcaccgtcccctcagccgtcgccgacgacggtgaccccagcgcgcccccgggcagcgtgaccacctcgccacccccggacgtggatgcgaacagcccgggtctgaagctcgcggacggagcgaccctcgcccccgccaaggtcctggacatcaagtcggtcgtcgaggacctcggcggcgaggagcgccgggaggacacgaacgcggacgtgacgttcgcgctccaggcggaggtgctcttccccaaggacagcccgaagctgaacccggaggcacggtcgcgcatcaacgccatcgcggacgagatcaagaagcagaacgccacgaacgtccgcgtcttcggtttcaccgacaacctgggctcgtacgcccacggcctgaccctctccaagaagcgcgcggaagccgtccacgaccaactggcctccgctctcggctcgcaggacgtcaccttcgaggtccgcggctacagcgaggactaccccatcgccgacaacacctccgagcagggccgccgcaagaaccgccgcgtggaggtgacgttcccgagggacacggcatcgtccgagtcccagaagtccggcgcgagc

SEQ ID NO: 3233 - DNA, 591 bp, Streptomyces avermitilis
  CDS (1)..(591)
atggactatcggcacaccatgaagggccgccgggcactgagcgccgtggcgatcacggccgggctgcttctcacggtggccggctgtggcgggggagacgacgggaagtccgacaagggaaccccgtcctccacggctcccgcgaagagcggcgacgacggcagcaaggcgcagtcgaaggcccccgagtcggacacggtgcttgccgaggtcaaaggcgagggcggtgtgacgctcacggtgaaatccgccaagcgcgacgggggcgggttcgtgaccgtcgagggcacggtggcgaacggaacgggccgcgcctggtccgtggggtcctggcgaggtgacgaaagggagttggccaagaacggcggttccatggccggcgccagcctggtcgacgagaccggcaagaagaagtacctggtgctgcgggacacggagggccggtgcttgtgcacgaggttcacgggcggccttctccaaggacagtcgacagactggttcgcccagttccccgccccacccgaaggcaccacaaaggtcagtttccaggtcggcggaatgccccccgcctcaatcgaaatctccgagggc

SEQ ID NO: 3234 - DNA, 552 bp, Streptomyces avermitilis
  CDS (1)..(552)
gtgatcctgctcttcgcagccttcgcctgtttcgcgttcgcccaggcagcgtccgcccgcaacggggctcaatccgcggcggacgctgcggcgttggcggcagcgcaggacgcccgggacgagctgttggtgcgcctcggggacgccgtcggcacggacgacaactggctcgactggttggacctgccggaggacacggtgctcccggccgacggagccgacgccgcggctcaggtgttggctgccgcgaacgactcgaccgtgcagggcggagcccaaccggtcgtgaggaacggctatcccggctttcaggtcgacatccagaccaactacacggtcggtgactcgatcattcccggcacggagggcatgcgggcgagggcccatgccgttgcagtcgtccagccgcgctgcgacttcgatctgaacgcggatcccaagaagcctgtagagctgggctgtgatggccagaccgtgaacatcgatcccgaagatttcgatccggccgaccttcctgacgcatccgtgctgttctctgtgcatctggccgag

SEQ ID NO: 3235 - DNA, 213 bp, Streptomyces avermitilis
  CDS (1)..(213)
atggtgacgaacacgaggcgcaggctcagcgggtggcggacgaccgtggtctcccggatgcggggggcggggcgggacgcgggggccgggtttgtggagtatgcggggttgatgatcatcattgcggggatcttcacgctgatcgatgggctcggcctggacgggttgatctcggatgcgatcctgcgcgcggtcaccgacgtcatcggcggc

SEQ ID NO: 3236 - DNA, 729 bp, Streptomyces avermitilis
  CDS (1)..(729)
atgcctgaccaggcactctccggcccgcccctgcgcgtactcgtggccgacgacaatccggtggtacgggcgggcctgtccgccctgctgtccgcgcaccccgacatagaggtggtggcggaggcctcgaacggcgaggaggcgaaggccctcgccggggaacaccgccccgatgtggtcctcctcgacgtgcggatgccgggcacggacggccttaccgcactccccgaactggtccggcttaccaccgtgatgatgctgacctacagccgggagcccaaggtggtggcggaggcgctgcgcagaggagcgtccggttacctggtgcacggggagttcacggtgcccgaactgatcaccgcggtacgggatgtacggagggggcggctcactgtctcgtcttcgctcagcgtttcgtacgaaccgaacggaaacccttcgcacctgcaatcagttgtggcacagtcgtcgaaggcttggcccacccgtgtgacgggcctgccccgccggaccgtcaatcggctggacttcggtctgagttcaagggaggtggaggtcatggatctcatcgcggccggcatgaacaaccggcagatcgccgccacctgcttcatcagcgagaagacggtcaagaaccacatcaatcgcatcttcgcaaagctgcacagtgcgacgcgcagcgaagcgatcgcccactggctgggtacggcgcgggaggggtggagccga

SEQ ID NO: 3237 - DNA, 1416 bp, Streptomyces avermitilis
  CDS (1)..(1416)
atgggagacggccggctcgcggggctgtgggcacagcgggcacagtgggcacagtgggcacagcgacacccggcacgtgccgccaggcggaccccggcgccggccggccccgacgccggatacctggcggacgacgccccgccccccaccagcgtccgcctccagctgagcgccctccaggccctctgccggcagaccatcgccgtccgcctgacgatgatcgccttcggcgcccccttcgccatggccaacgccgcggccggcgccccccgctacgccgtcctggccgccgcggtcctcggcgtcatggcctcgtacgccatgctccgcgactgggaccgcttcggcccccgtctcctggcccaccccaccctgatggcgctcgacctgctcttcgtggcgaccctgctcgtgacggcgtcccccgcgtcccccctggcgtacgcgacggtgtgcaccccgctcctctccggtctcctctacggctggcgcggctcgggagtgttcaccggcctccaactcgtcgtcctcctgacggtgttcagggcctgggaacaccgccccggcgccggcgccaacaccctcctcgtcgccggcttctgcgtcgccgccgggatcatcggcgtcaccctgcgcaatctgatgttccgcttcggcgcggccagtcaggcgttgtcggaggcgacctcccggctggcggtcgcggaggcggtggagtcggagcgcgcgcggctggcccgcgagatgcacgactcggtggcgaagaccctgcacgggctggccctggcggcggacgccctggcggcgtccacggaccacagcgaccccgccgccctcaagcgccaggcgacggtggtggcgggagcggcacgcagggcggcggccgagtcccgggacctgctgtcggacctccggcgccatacggacttcaccgccgcgcacgtcgatctgaccgcggaactgggctgccgggtaagggacttcggcactcgtacgggcctggcggcagagctgagacttccgcgtacggacgaagacgccctgcgcgccctgcggcagcttccctgcgcgaccgcgcaccacgtcctggcggtcgtgtcggaggcgctggagaacacccaccgccacgcgcgggcgacgagcgtactggtcgaactcgacgtcgccgaggaccggctggcggtgagggcgggggacgacggtgccggcctgccgccgtccgcgacccccgacagcccggcgaaaaccggccacttcgggctgctgggcatggcggagcgggccgcgagcctcggcggccgggtccggctgggccgttccccgctgggcggcgccgaggtccacctgacggttcccctctccacgcccgccaccccctccactccccacaccccccaagaggaggccgcacatgcc

SEQ ID NO: 3238 - DNA, 903 bp, Streptomyces avermitilis
  CDS (1)..(903)
gtgtcctcgtctacgtcgctggggttgctgctcgccgcgctgatggccgtggccgtggcgggtgtcctcctcggcatccgcatgatcagggcggacgccaagctgcccagcgacctcgtgctcgccctggaggtcggcgccacccgcgtctccacggccgactccgccgtcgaccgcctcggcatgcgcttcgcccctctcgtcctgcgcctgatgggcccccgccgcgtcgccgccaagcggcgccgcatcgacatggcgggcaacccgggcggcctcaccctgaaccgctacgcggcccgccgcgccgtctacggcatcttcggcgtcgtactcggcctgatcttcctcaccaacggtcacccgctgttcgcgctgggcaccctcgccttcggcctgctcgccgccgacgcgctgatctggcaggccgtccgcgaacgcaaggacgtcatcgaccgcaccctgcccgacttcctcgacgtcctggcggtcgtggtctcggcgggcctcggcttccgccaggcactggaccgggtggccgagaagtacgagggcccctgggcggacgaactgcgcatcaccctgcgccagatggacatgggcgtgagccgccgccaggccttcgacgaactgcgcaaacgcaactcgtccgagcaggtggcccagttcgtctccgccctgcaacagggcgaggagctgggctccccgatcgccgagaccctcatccagctggccaccgacatgcgccgcaccgacgcccagaacgcccgccgccgcgcggcgaagaccatccccaaggccacgatggtgaccctggtcttcatgcttccggccacgatgatcctcatcgcgaccggcatgttcctggggtcggggacgaacttcggctcgatcctggggcga

SEQ ID NO: 3239 - DNA, 939 bp, Streptomyces avermitilis
  CDS (1)..(939)
gtgaaccatcccgctctcctcgccctcggcgccaccgtgctgtgcggcacgctcgccgtcgcgggcgtgcacgtgtacgcggcgggccgcgcccagcgccaggccctggtcgaccggctggccggcggcggcccgatccgtacggtggcaggccgcgtacggcgcttcgcgggcatcgaccgccgactgcgccgcacccgcctcggccgcgccatccacctccgcctgacgacgaccggactcgacctgaccgcaggggagttcaccacctacgtcgccgcggtggtcgtcgcgctgtggctgatcgcggcgaccaccctggcgccgttcttcggcccgatcgccgccctggtcggcatctggggtgcggccgtgttcctcaactggcagcgccagaaacgcatcgaggcgttcatcggccaactgcccgacgtggcccgtctcctcgccaacgcgaccgccgcgggcctcgccctgcgcacggccctcgccatggcggcggaggaactggaggcacccgcgggcgaggagctggcgcgtgtcgccgaccagttgacgctcggcaggtccgtcgacgacgccctggacgaactcgccgaacgcctcccgtcccgcgaactgatcgtcctcgtgaccaccttggtgctggccaacaaggcgggcggctcggtcgtcagctcgctgcgcaacctcacccagaccctggaggaccgcaaggagacccggcgcgaggtgcgcaccatgctctccgaggtcaacgcgaccgccttcacggtcccgctcctcgggctcggctcgctgctgctgatcaactcctcgaacgagggagccctcgcccgcgtgaccggctcctcgctcggccagggcctgatcctcctgtcgctcggcctctacacggtcggcttcttcgtcatccgccgcctcggcaagatcgaagtg

SEQ ID NO: 3240 - DNA, 1338 bp, Streptomyces avermitilis
  CDS (1)..(1338)
atgagcctccgctcccgaatcgccgcccccgacgaaggcggccccgcccgcgaggacggacacctggtcgccgtctaccgcgccaagctcctcgaagagatcgacctcgccgagatgtcgagcctggcggcggccgaacgccggatccgcctggagcgcgtactcggccacatcatcagccgggaggggccggtcctctcctccgccgagcggtcccagctgatccgccgggtcgtcgacgaggcgctcggcctcggcgtcctggaacccctgctcgccgacgcctcgatcacggagatcatggtcaacggcccggactcgatcttcgtcgagcgagccggccgcgtcgaacagctcccgctccgcttcgcctccaccgagcagctgatgcagaccatcgaacgcatcgtctcgacggtcaaccggcgcgtggacgagtcgaacccgatggtcgacgcccgcctccccaccggcgaacgcgtcaacgtcatcatcccgccgctcgccctcaccggccccaccctcacgatccgccgcttcccccgcgcgtacacgctgccggaactcattggcctcggctccctggacgagcagatgctgctgctgctcgcggccttcgtccgggcccgcttcaacatcatcgtcagcggcggtacgggcaccggcaagacgaccctcctcaacgcgctctccgggctcatcccgtcctacgagcgcatcatcaccgtcgaggactccgccgaactccagctccagcaggagcatgtgatccgcctcgaatcccgccccccgaacgtcgagggcaagggccagatcaccatccgcgacctggtccgcaactcgctccggatgcgccccgaccgcatcatcgtcggtgaggtccgcggcggcgagacgctcgacatgctccaggcgatgtcgacgggccacgacggctccctggccaccgtgcacgcgaactcggccgaggacgcgctgatgcggttgcagaccctcggctcgatgtccgaggtactgatcccgttcgaggccctcaaggaccagatcaactcggcggtggacgtggtcgtccagctcacccggcacgccgacggctcccgcaagatcaccgagatcgccctcgtcgtctcgcacggccgcgagcagttccgcatcgtccccgtcgcccgcttcgtgccgcgccccgtcggcgccgaccgcgtcgtccacggccgcttcgagcacctcccgctgccacgccaggtcgccgagaagctgtacgtcgccaatgagccgctgccggccgccttcagagtcgcggacgccatcgacgtactcgacacgaggcaggccatcgga

SEQ ID NO: 3241 - DNA, 150 bp, Streptomyces avermitilis
  CDS (1)..(150)
gtgagctcctggctcgacccggacgtccccgcgccggcgaagggcgccgacaccaccaccgccaccgtcaccgtccacgtcccctccgtcatccccttcttcggcgccggctgggacgtgacccgccgcgccaccatgcccaccgacgac

SEQ ID NO: 3242 - DNA, 1605 bp, Streptomyces avermitilis
  CDS (1)..(1605)
atgaccgtacgcatcctccccgccgtcggcgacatcgactcggcccgcgccctcgccaccctgctgagccagctcaccgacgccgaaccggccccgccggtcgccgacaccaccgcgctcctggacaccctggcccggctcgccgccgagtccctcgacgagctgcccgaggtcgtcctggtccacgagcgcatcggcccggtaccggcgctcgacgtgatccgcgacctggtgctgcgcttcccggcggtcggcgtcgtcctcatcaccgccgacaccggaagcggcgtcctcaccgccgccatggacgcgggcgcccgcggcatcatcggcctgccgctcggttacgacgccctcgccgaacgtgtccaggcggccgccgcgtggtcgacgggcatgcggcgccacctcggcagcgggacacccgagctgtacacgggccccggcggcacggtcgtcacggtgaccggcgccaagggcggcgtcggcgcgaccgtcacggccgtccagctcgcgctcgcggccagggcgtcgggccgtacggtcgcgctgctcgacctcgacctccagtcgggcgacgtggcctcgtacctggacgtgcagttcaggcggtcggtcgcggacctggccggcatcaccgacatcaacccgcgcgtcctccaggacgccgtctacatccacgacagcggcatcgggctcctgctggcgcccgccgagggcgagcgcggcgaggaggtgacggaccgggtcgcccggcaggtcgtgggaaccctgcgctcgcgccacgacgtggtgatcgtcgactgcggctcccagatgaactccgccaccgccgcggccgtcgagatggccgaccaggcgctgctcctggtcacccccgacgtggtcgcgatccgcgccgccaaacgcatggtccgtatgtgggaccgcctccagatccgcaaggcggaggagacgctcacggtcgtcaaccgccactcacgcggtacggagatccagccgtccctggtcgagcgggtcaccggcaccaaagtggcccgctccgccgtccccgccgccttcaaggaactccagtccgtggtcgacgcggggcgcctccaggacctcgacgcccgctccacggtcaagcaggcactgtgggcgctggcgggggagctggggctggtcgccgtccaggagagcggtggacggcgccggaagtcctcggaccgcggcgcgctctccctgcggcggcgcggcggcgaccggggcgcggtcaccctggagttcgccgggatgttccccctgctgctggtcgtgatggcgatcctgtgggagtgcgtgctgtacggctacacgtactccctcgccgggaacgcggcggacgaggcggcccgcgcggccacggcggcgtacgcgatcaagggcgatgtgggaggggcgtgccagtcggccggcgccgagcatctgccggattcctggagcggggcggacatcagctgcgggcaggacgggtcggtgatgaaggcgaccgtccaggtggacgtcccgctgttcttccccggggtcaacccgggctggtcggtcgacggctcggcgggggcggcgctggagggggacggcggg

SEQ ID NO: 3243 - DNA, 627 bp, Streptomyces avermitilis
  CDS (1)..(627)
gtgatccgtgacgttaactcgaaggtcggccccgaggtggcggcgtaccggctgaggaacgacatcgcgccctacaaggagctgtcggccgaccagttcgagaaggtctccatgcccaggcgctggctgtcgaagacggcggtcaccgacctcgcccagatccgcgggaagatcgcggtgacccagctggagaagggctcgttgctccagaccgacatgatcgtggaccggcccgcgctggcggcggggcaacaggagatcgcgatcatgatcgacgcgtcgaccggtgtcgccggcaagatcaaccccggctcccgcgtcaacatctacgccaccttcaaggcgccgagcgacaagggcaaggaccagtccaaggtgatcgtcgagaacgcccgcgtcctcgacgtcggcaagctcaccgccctcgaccccggccagagcagcgaccagcgccgccgcaccgcgagcgaggccgtccccatcaccttcgcgctcgacacggcggacgcccaacgggtcgcgtacgccgagtcgttcgccgaacacgtccggctcgcgctggtcgcgggcggctcggggaccacggtcccgccgggcgaccgctcatacaccctcgacgaggacaag

SEQ ID NO: 3244 - DNA, 885 bp, Streptomyces avermitilis
  CDS (1)..(885)
gtgccgaccgcgatagccgtcaccagcgccgacctggtgctccccccgctcgaccgggggaccccgcccgccgccgtccagcccctcgacaccctcgagcagtccctgaacgggatgcacgcgctcatcgagcagcacgggtacgtcgtcgtcctgtacccggctcccgccaccggccccgccgcggccgagcagccggacgtcaggcggctgcgtaccgtgcgctccgtcctggagagcgaccgcatcgcgctgctcggcatcgacctgcccccgctcggactcgccttactggcccagcagttgcggcagctgtcgatgtgcgacttcagccccggcgtactcgcctccgccgcgcgcctgctcgcccactacatctacgccggcgccctgctcggctcggtcgcggggctcgaccgcgtgcccgtctcgatgaagtcccacgccaagtcgtgggtgccgggcgcccagttcgccgtactggccaatccccggccgcagctcgtacgggtcggcgaggaggagttaccgggccccgagttcggcacccggctgctcgtcgccgccgggcagccgccctcggactgggtcacggcctcactcgctcccgcgtggcgcgtgcagggcgtggcgaccgtgccgctgcccgctcagtccacgcgctggtggggcacgggacggctcgccgagttcgccgcgggcctgttcgacgtctccgtgctctatcagctcgtctcgtccgtacgccgggaggagtgccactggtgtgggctcgaactcatcggcgaccgctgcgggttctgcgcggcgccgcttcccccgccgccggagctcgggcaggcgagagcgcccgcggccgtacgagccctgccccggggccggacg

SEQ ID NO: 3245 - DNA, 1737 bp, Streptomyces avermitilis
  CDS (1)..(1737)
gtggaccgcgcaccaggcacacccccacgcagacgcacccccctacgcaccccgaggcgcacccgcacatgggcggggctcctcgccgccgtactgggtgcgtccgtcctctccctcaccggtgccggtccggcctcggccgcggacgtcaacaacgcgaagaacggcggctacgagtcgggcctcggcaactggacgtgttccgcgagcagcggtacgaccgtctcctcgccggtgcacggcggttcggccgcgctgaaggcgacgccggccggccaggacaacgcgaagtgcacccagacggtcgcggtcaagcccaactcgacgtacacgctgagcgcctgggtgcagggcgggtacgcctacctgggcgcgagcggcacgggtacgacggacgtgtcgacgtggacaccggactcgacgtcctggaagcagctgaccaccaccttcacgaccggcgccgcgacgacgtcagtgacggtctacacgcacggctggtacgggcaggcggcgtactacgccgacgacctgtccgtcttcggccccgacggcggcggcggttcggaccccgcgcccacggtccccgcggccccggcgggcctcgccgtgtcgtccaccacgtcctcctccgtctccctgtcctggaacagcgtctccggagcgacgggctacaacgtgtaccgggccggtacgaaggtccagtcggtgacgggcacgtcggcgacggtgtcctccctcgccgcctcgacgtcgtactccttccaggtcacggcgacgaacgcggcgggtgagtcggcgaagtcggcggcggtgacgggcacgacgagcgcctcctcgggcgggggcgggggttccgtgccgaagcacgcggtgacgggctactggcagaacttcaacaacggggcgcaggtccagaagatctcggacgtccagtcgcagtacgacatcatcgcggtggccttcgcggacgcgacgtcgacgccgggcgccgtgagcttcagcctcgactcggcgggcctcggcggctacacggtcgaccagttcaaggcggacatcaaggcgaagcagacggccggcaagaaggtcatcatctccatcggcggccagaacggcacggtgtcggtgaacgactcggcctcggcggcgaacttcgcgaactcggtgtactccctgatgcagacgtacggcttcgacggcgtcgacatcgacctggagaacggcctcaacgcgacgtacatgtcgcaggcgctgcggtccctctccgccaaggcgggctcgtccctggtcatcacgatggcgccgcagacgatcgacatgcagtccacgtcgaacgggtacttccagacggctctgaacatcaaggacatcctcaccgtcgtcaacatgcagtactacaacagcggttcgatgctcggctgcgacggcaaggtgtactcgcagggctcggtcgacttcctcacggccctcgcctgcatccagctcgaaggcggcctcgccccgtcccaggtgggcctcggcctgccggcctcgacgagcggcgccggcagcggctatgtctccccgacggtggtgaacaacgccctggactgcctgaccaaggccacgaactgcggctccttcaagccctcgaagacgtacccggacctgcgcggcgcgatgacctggtcgacgaactgggacgcgtcggcggggaacgcgtggtcgaacggggtgggggcgcacgtgcacgcgctgccg

SEQ ID NO: 3246 - DNA, 351 bp, Streptomyces avermitilis
  CDS (1)..(351)
atgcaccgcgaattcaccgtgccagacgaccatgaaatcctcgacacactgggggagtggccggagaccgacgaggacggcagcgctcgtctccttaagctgtcaggcggcgaggacggggacgtgctcctctcctacgactccttgagccaatccgtgcgggtgcgttggatcaatcctgctggagaaaagatcctcgacctgttccgtgaaggtgccataaaaatgtccgtaacagccaccgccaacaatacctccattaccctcgacttcagtctgggcgaatgcagcggggagatcaatattcagatttccccccgccttgtcataaccgaccgtattcttctcgtc

SEQ ID NO: 3247 - DNA, 459 bp, Streptomyces avermitilis
  CDS (1)..(459)
atgtcattcgggccgccacccaacactttcgaccctcccgctacgttgactgattcaagaaattcgagaagcagtcggggccgacgcgagagactcaggcgcgccttggaaggatttggaaacgtggtgtggatgcgctcacccatggagcgccacccgatttacggttatcgacaggtatcctttgcgtcatggcgcttcgaggagccgtcagatttcctgaagacgaaattcgagtccctcgttcaggacacccctacgaatctagagtggagattcaaggccgcacgcaactggatgattgctcccgcccggctcgtcgatcaggcaggccaaggtggggagttcttcaatgaggccgtggtgtccatcacggaacatgatcaggaattttgcgcttccgccgaagaggatctcatgcagattttgatcaccctggaagagggaggaggaaagagc

SEQ ID NO: 3248 - DNA, 1251 bp, Streptomyces avermitilis
  CDS (1)..(1251)
atgtcattcgggccgccacccgacgtctctcaggctccgtttccgcctggctggacgccaccgacggctgtcgagaaggctttgttcgaggcccgggcgcggggggactgggcggcgttccacgacgcgctcgctcggaccgtgctctatttcgaggtggggcgcgacgagaccgatgccgatcccgacggcatctttccccgcttccatcgcaacctccggaccggcgcccgatggtggaaggtgttcaccatgggcatgttgcccgctccgcagcccgacctggtgttcgcccgcaggtccctgcgctggttcgcacgcgcctggcagcccaccgatccgccgacgctgctggtcaatcccgacagcccttgcgaggtcgccctgcccttggggcccgcacattccacggagtggtcccgggtcgccgagcacgtgggcgaaccgtccatcgccatgcagttgcgctccctccacgccggcggtccgctccacggccccgtcgcccacggtctcgcctgcggcgccctcctctgcgtcaacaacggctcgctctggaacgccatggcctggcacggcaccggctacggcagcgagcgccggcggctgcgtgagtggtggggcatcaccagccgggaggagtggcagtactacctgcgcagccttctggcctgcgatgcctccagctccgtctgggagttcgccctcggactgcgccgcaccatcgcccgagatttcggcgggcatgtcgacatcgggtactggcggcaggccgtcgccaacgtactgcgcgccgaagccggcggctcgaccgtactcagcgccgacggcgtcacgaagagcgagccacgtcccgagtcggagaccgaagcgaagatcgaaggtgtgcagcggctcatcgggcgcatcacgcggtacgaggcacgcatgcgcgccgatggggtgctggacgagggccggtatgtgacgtcggtcgaggcctgggacctcgggcgagcctcgaagatggcccggtgggggctcggcgcccggttcgggacgttgcaggaggccgaggccgcggtcgtccaggccggacgcagcgccgctctctcctaccgctcctggcaggacttctccgccgcctacatcctcgggcgctgtctccacttcgacgaggaggagttcggggactggtaccaggacatggtctccgcccatcggatcctgatgtccgagcccggtagcccctggctcaacattccgttcaag

SEQ ID NO: 3249 - DNA, 522 bp, Streptomyces avermitilis
  CDS (1)..(522)
atgcccgagacccgttcagcggcccgctgcccgctggcgaccgcatacccggcggaccccaccccaccccgtcccgaaaccctggcctacagcctcacgctcccggccgcgctctccagcccggccgtggcacgagcggcgacccgcgcgttcctggaggcgcacgccctgccggacatcatggacgcggcgctccaggcggtcggcgaactcaccgcaaccgcagcccagttcacacaggcgccggattactacctgtccctccgctaccgagccgccaccctccgagtgatcgtctacgacagccacccccgccacacacaaccccgcctggccgcggcctgcgacacccgccgcagggcagccctccgcgtactggcctgcgtatgccgggcctgcgaaggcgactggggcttcggcgagtcccgggagccgggcggcggcacgcggatgtgggcgaccctgccgagggcgagcgcggcggcgtacggctccgccgccgtgcccagcgccaccgctact

SEQ ID NO: 3250 - DNA, 849 bp, Streptomyces avermitilis
  CDS (1)..(849)
atgccaaccagatccactccgacggaacggcagaagcggctcggcgccgagctacgaaagatgaggctggccgcgggtgcgcccacggagtacgccgcggggctcctgggcatcgacaggacacggctgtccaacatggagtcgggtatccgcccgttctcgccggaccgcgtccgcacactggcctgcaactacagctgcacggacgacggttacatcgaagccctggtcgccatgacgtcgacgaaggagcgcggctggtgggagcgccatcgaggaatcctgccctcagggctcttggacatcgccgagctcgaatggcatgccacccgcgtccggaccgctcaagtcatgcatgcacccggcctgctccagaccgaggactacgcccgaggcgtgttcaccgctgtcctgccgccgttgacccgactagaggtcgagctgcgcgtcgcacatcgcatggagcgccagcaagtcctggagcgaccgagcccgctcccgtacatcgcctacgtccacgaagccgttctgcgcatgccgtacggcggcacggaagccacccagcagcagctgaagcatctgtgctcccagtccgagcgggagaacatcgaggtccgcgtgatccccacgtccacgggcgggttccccggcgcagggcatgcgttgctctacgcggacggagcagttccccaactcgacaccgtgcaactggactcggctcatggaccggagttcacccacgccgatgcccagctcacgaagtaccgttcccatctgaactggatggacggcgcggcgatgacgtccgcggcatcacgcgacctcatccgcaagatcgcccgcgacctg

SEQ ID NO: 3251 - DNA, 192 bp, Streptomyces avermitilis
  CDS (1)..(192)
gtgaacgaccgcatcgcttgggaagaacccttctgcggcgaaggcaacaactgcttccgcctcggcaccgacaacgagggcaacgcctacatagccgtagccggcgccgaggactcctacctcagcgacagtcgcgaagcactccgtaccctcatccgcgacatcaaggccggcaaagccgaccacctgctc

SEQ ID NO: 3252 - DNA, 528 bp, Streptomyces avermitilis
  CDS (1)..(528)
atgcgggcgcacggcatactgacagcggcacatggtcggtgtcgaccgaggcgaacaggggagaagagaatgaaccagcccccgtacggcaccccgcccccaccacccgtaccgcccacggcacctccgggctacggcccgcccgtaccgcacccgggctacagccagcccgtaccgcccccggcgcccacgggcttcggcccgcccccaccttcgtacgcgccgtaccccgcgcccgccgccgccccggagttcctcgccgtcgaccgccacaactccgtggtcgtggacgagacgggggtcaccttcgaatgcaacggcgtgaccgcggagttcccctggccggaaatccgcagcgtccaccaccagccgagcggcaacggcaagtcactgatgatggccgtgatccacgccgacggcatgctgtacgagtgcgtggtcgacgcgaagcgccgcgaacgcctgcacgagtggctcaaccaagtggcgttggtgatcgggcactaccgctactaccgccccggcggc

SEQ ID NO: 3253 - DNA, 1350 bp, Streptomyces avermitilis
  CDS (1)..(1350)
atgcgacttcgtatccgcggcaggggcccacgaagcggcagacgcaccgccgccctcgccaccctgctggccctcgccctcgcggcgccggtcggcggcgccgtcaccgacgccaccgcgaccggtgcgagggcgagcgacccctcggccgatgacgtccggcagtacgagatccaccagagcaccacccccgtgacccgcaccgccatccagcagaccggcgtgaccgtggacgaggccgacgaggagaccgtcgtcgtctccggccgcgcggcccagatcaagaagctgcgcgggctcggttacgacctctcgccgctgggctcggcaccggatcgttcgagcggctccgacgtacggctgttcgacttcccgtcggccgactcgaagtaccacaactacgccgagacgaacaccgagatcgaccagcggctcgcggcctacccgggcatcatgagcaagcgtgtgatcggcacgtcgtaccagggccggaacatcgtcgccatcaaggtcagcgacaacgtggcgaccgacgagaacgagcccgaggtcatcctcaccttccaccagcacgcccgcgagcacctgacggtggagatggcgctgtatctgctgcgtgagctcggggccggatacggcagcgactcccgcgtcaccaacatggtgaacaaccgtgagatctggatcgtcccggacctcaacccggacggcggcgagtacgacatcgcgaccgggtcctatcggtcatggcgcaagaaccgtcagcccaactccggttcctcgtacgtcggtacggacctgaaccgcaactggaactacaagtggggctgctgcggcggctcgtcggggtcgacgtcctcggagacctaccgcggcacgtcggccgagtcggcgcccgaggtgaaggtggtctccgacttcgtacgcagccgggtcgtcggcgggaagcagcagatcaaggccgggatcgacttccacacctacagcgagctggtgctgtggcccttcggctacacctactcggacaccgcgaccggcatgacggcggacgacgccgccgcgttcaaggccgtcggccagaagatggccgccagcaacgggtacacgccggagcagtccagcgacctgtacatcaccgacggttcgatcgacgactacctctggggcagccagaagatcttcgactacaccttcgagatgtacccgtcgtccagctccggcggcggcttctacccgcccgacgaggtcatcgagcgggagacgtcacgcaaccgggacgcggtgctgcagttgctggagaacgcggactgcatgtaccggtcgatcggcaaggaagcgcagtactgcacc

SEQ ID NO: 3254 - DNA, 603 bp, Streptomyces avermitilis
  CDS (1)..(603)
gtggagcagcgcataggttcgaacagccagcccctggacgtcgccgcggtcgatccggcgttcattcccgggctcacgccgaccgtgtccgcggagccgaagagcacggccgagcccgagggcgcggccgagccggagaaggcggccgaggccgcggacgaggcttccccggaggacaagacctccgaggaagcccccgccgggaaggcggcgcagaagccgtccctcggcaaggcctccggcaaggtctccgacgaggccgacgacgagcccgccgacgaggccgaggaggaacccgcagaggaagccgacgacgaggccgacaccgagggccccgccttcgaggcctccgaccggcgagcgagcatcgtcgccgacggcagaggcgtacgactgcgcctggacgaccaggaggcggagttccgctgggacgagatcggcgcggtggagaccgagtcgccgcgcttcggcaagcggttcacgatcacggtccacaccccggaccgccgctggtacccgatcgagatcgaggcgtcgtcccgctctcgcttcaaggagtgggagacgaagctcgacgaggtgctggacgcctacttccaggag

SEQ ID NO: 3255 - DNA, 1563 bp, Streptomyces avermitilis
  CDS (1)..(1563)
atgtcgaactacaccgagagcctccagtacctcgacagctacatctccgcccgggtcccggtcatcgggatgcgcaccatcgagcagcagcgcgccctgcggctgctgcgcgaggccgccacccagccgcgccgcagcagcatgccgttctggatctacacccgggccaccggcctgcgtgacctgcgcaccaacgcgcccgtgcaggacgaccgttcgctgaccggcgcgatggacttcgcggcggcccagttcaccagcagggcgaacgccacggtcgtcttcgtcgaccccgacgacctgggcggagacaccccgatcacccggcacatcgccgagctggcccggctcgccgacagcaacatgggcagcatcgtcctcatcacggacacccccatctggagcgggttgcagcggctcggcatgagcctgcacctcgacctgccggacgccgacgagatgtacggcatcctcagcggcttcctcggcgaccaccacgggcacatccccatcgagtgggacgaggccgacggccggcgggccgccgagttcctgctcggtgtcaccgaggccgagtgcatcaacctgatggcgaccatcgcggccaagggctccatccagaaggcggacgtcctcgggctcgcccaggccaaggaccgcatcttcagcgacctcaccggtctggaacgggtgcagctcaaggaggccgactacacggtcggcggtctgagcagcctgcgcgaatggctccagcgcaagcactggcagctgcacgaggacctgcgcgacagcgcgctgcgcccaccgcgcggggtgcttctggtgggcgtgccgggctgtggcaagtccctgtcggcgaaggcgatcgcccacgagtggcaacttccgctgtaccggctcgacatgggtgccatccacggcaagtacctcggcgagtccgagggccgtttccgggaggcgctcgcgatggcggaccgggtggcgccgtgcgtcctgtggatcgacgagatcgagaaggggctcgcgggccgggacgacggctccggggtaccgcagcggatcatcgggcagttcctgttctggctccaggagtcccagtcgcgcgccttcgtcgtggccaccgccaacgacatccgcagcctgccgcccgagctgctgcgcaagggccgcttcgacgagctgttcttcgtggacctgccggacgcgcaggaccgcaaggagatcatcgagctgtactaccagcgctatcttcagggcgagcccgaccgggaccaggtggaccagctcgtcgacctgtccgaggggttcgccggctcggacatcgagtcggcactgcacgacgtgggcctggaggcgcgccgcatcggcggggccgacggtctgaaggcgtcgttcctgcgggacaccttcgccaacacggtcccgatgagccgggtcaaccccgagcagatcgaggagatcagggcctggggccgcgaacgcgcgctgcccgccgggcgttccacggtcagcgcggcaccgggcggggcgaagccctcgcgccggatcgtgttcatggacgac

SEQ ID NO: 3256 - DNA, 618 bp, Streptomyces avermitilis
  CDS (1)..(618)
atgagcggcctgtggggcgacggcggcccctacgcggcctgggtcggcttcctgcgccgctgggcggccctggaacccgtcgaccccggcacgctgccggccatcgtcccggaggacttccagggcgacacgctggcccgcctgacccagcacctcacggacgcgctggacgcccggctgaacgactgggccgagcggcttctgcgggccatggcgcacagcacggacgagttctcggtcggccgcgagctggcccaggccagggccggactgaacaccgtccgcgcgctggccggccaccccgggctgccgccgaaggtgcgcgaggagctgaccgggctcgtcgaccggcagatcccggagctccaggcgcagttggagcgcaacctggacgccgaggcccgccggggcgccgacccccggctgctggagcggcgccgccgcaccctgcgtgagaacgccctcacgagcgtgctcaccgcgcccccgccaccgctcgcgcccccgtccgcgcccccgtccgcgggaaggcggtcgccggtttccggaccggcggcgggcggcgacgcctgggcgtacgacccggcggcgcggccacggcgccggatcgtgcccgac

SEQ ID NO: 3257 - DNA, 1770 bp, Streptomyces avermitilis
  CDS (1)..(1770)
atgtccgaggtggaccacgtactgcgccgccaggtgcaggaggtcagcaacctcgtgttccggctcagcgaacaggtcggctcggtgtccggccaggtctcggcggtcgaggccgagcagcagcaggcccggaccgaactccagcagttgcgcgccgacttcctcgccttcgtcaaacaggccgagttcaccgccaacgtgcagcgcgccgagacccgcatcggcgtcatccaggaccaggtcgaccacgagttcggccaccacaagacggtccggcgcaccgcggtgggcatgctccaggccttcgacgtgggtctggtgtccgaggacaacgtgcggatggtcagcgaccagctgatgatccagaccccccgctactggctggcccccgcgctggtggcgctcgcgtcctggtccgccgacgacccgcagctgtgcgagcgcgccgtcgaggaggccttccggcgctcaccggaccgcaccgccctcttcttcgcgctggtgctgcgccgccaggaccgcaaggagtcggccgtgcgctggctgcggcactatctgctggcccaggacccgaccgcgctcggccgggagttcgcggtcatcctggagtccatcgcgcagggcgccttcgggctcgtcggccgtgatctgctcgaccgcacgctggccggctggcgcgcgcagctgatggacagcgcggagacgcaggcgaagcaggtccagcggtggcgcgacgagatcgacacgctgcgcgcgccgtccgcccaggccgagttcccgcgtctctcccaggtctccccgcagtggccgcagctggacgcggcgctcggcgcggcccgcggccaccaggcgctgctgaacaagtaccgggccctcctgaaccgggagttcgagccgtcggagcggatcgaggacgccgtcgacgacatcctcgaccggctcgtcaaggagtacgacaacgaggagctgcccctccgtcgcgacctcgccttcaaccaggcggtcgtggaacacgacggtgacgtcctcgcggcccgcggcgccgccgacgcggacgccgcctcgtacgaacagaccctcgactacctgaccgtgcagaccaccgccgcgctcaacccgcaggcgatcggcacctcgcccgccacccagcggctggccgtcgtcgcctgccaggagtggttccagcacgcgcaggccggcgccacgcgcgactaccggctcgccgtcccgcaggacgtccaggcccacttcgacaccacgcactcggtgggcgcgcagaccttccggctgccgccctggacgggctcgttcacccagccgctggccgccctcgaacagtcgctgggcgcgcactgggaccggcacatgcagccgttcatcgacgcgctcgcgtatccgacgctgaagaaggcggcgccgctgatcgcggtggtggccggcatcctgctgatcttcggccaggtcagcatcggtttcgcgttcacggcggcggcgatcaccgcggccgtctggggcctgatcctcctcaaccgcaagcagtccgccgaccgtctccaggatcaggcccggcaggcgctggaccgggccaagaccgactcgctgcaccaactgcgcggctcggccgccgagctgaccgactggaacgagcggttccgggcggcggacctggtcgacgcggagtgccgcgcgctgatcacgtcgctgtccaccgcggacggcggagcctccccgttcgagggccgcacggtgcgcagggaggagccgaccgca

SEQ ID NO: 3258 - DNA, 546 bp, Streptomyces avermitilis
  CDS (1)..(546)
atgccgaccggctcgccgcccatgactctcgggggacacatgggacccattgagcacccacgacgcattgtgcccggcggcacacccgccgcgcccggaacgcaggcggggaccggccgtcgcctgatcgccgcggcgaacgagacccggcagcggaccgcgagcacgcccggcgcgcggacgatccgccgcgagctgtaccagccccgctcccgccggctgctcgacgccgtggcgcagctcgacgccggactggacgaggccgcctgccggcagctggccgaccggatccgcgacgagtacacgaccacgtacgacgacgtgccgctcggcttcgtcgcccggtgctatctgggaccgccgtacgtggaccaccagttgaacctcttccaggtgatcgtcaagcacttcgctccgtcccagcggatgcccgacccgttcgacggggcccggatgctggcccgctccggcgcctacgcctacatcgaggtctacgccggcggactgatcctccccgtcctcgaggacggcacggtcgtacgtccc

SEQ ID NO: 3259 - DNA, 2028 bp, Streptomyces avermitilis
  CDS (1)..(2028)
atggggaccattcatgcgctcctggtggggatcgacgactatccgtcgcagacggcgaccccgctcaggggcgccgtcaccgacgtcgaggaggccgcccggctcgtgacggagctcgtcggcgagagggcggacctgctcttcctgcgcgacggcgaggcgacggtcgcggccgtcgaggacgcggtcgtacggcagttgggcgcggcggggccgggggacacggcgctgctgtggttctccgggcacggcacccagcagcgggccacgggcgcggatctgctgatcgaggcgacggggcagaaccaggcgctggtgtgcgtggacgggccgctcctcgacaaacggctcggcgcgctgctggagcgggtcgccgagggcggtgcgcatgtcgtggcggttctggactgctgctacgcgggcggcggcacccgcgcgggtgtactgaccccacgtttcgcgccgccgtccccggactgggactggggcgagggcgagggcgggggcggagacgggggcgagggctgggatttcggggcggacgagcgggcccgaggggtcgtcgcggcggccggctccggtacgcccgcgccgacccgtcatgtgctgctcgccgccagccgtctcgaccagcagtccttcgagggccacttcggcggccggcggatgggggcgttcacgtacgcactgctcggcgcggtgcgcgaggcggggcccggcctcggctaccgcgagctgctggccgcggccgacgcccggctgcgccgctccgggggccgtcagcagccggtgctgtacccggtgacgccgggcggccccgcggaccagccgttcctgggcggcgcggcgcgcagaccgagcccgcatctgctgcggttcggcgcggacggctgggaggtggactgcggcagcggccacggtctgcgggacggcgcgggagcggagggcaccgagttcacggtggtggacggggagctggtcgggcccgtggtgcgggcgcgggacgtgcgcacggaacgtacgctcgtcgaccccgtggagtggatgccggcccgggagcaggtgtatcccgtgacgctctcggcgctcgcgctgcccgcggccggcgtggctctgctcggccctgcgcggtcggaggaggtacgggcgttggagcgggcgatcgcgtcggccgggccgggcggcgggccctcgccgctgctgcggctcgtcggcagcccgcaggaggccgcggacctgcacttccgggtcgaggtgcgggcgggtctcgcgcacgtactgggccgggacggtacgccgttcgtcgacccgctgccgctgacggacccggcggcgcacgcccgccggatcgcggactgtctggtccatctgacgcgctggcaccagctgcgtgatctgacgccccgcccctccctcctggacgggctcgtccggatggagatcgtgccgtggcacgcggcccccggccaggcgctgaccccggacggctccgggcagatcaccgtctcctacccgccgggagccgccgggccaaaggcgccgtggctctcgatccggctgcacaaccgctcccccgaccggaagctgtggtgcctgctgctcgacctgaccgacagctacgccgccgactcggcgctctaccgcgggcacttcatcggccccggccacaccgggtacgcgctcgacggcgatcccgtacagctgtcgctgccgccgaaccgtgcggtcgtccccggtgccgccgcccgggactggctgaagctgatcgtggccgagcgcgagctgaacacggtgccgttccagctgcccgcctgggatccgtacgccgtcgtggcccgggaccgcgtgccgggcgacggtgtcctgcggttcaccggccccggccacgcggcggacggcagccgtgacctcgggcccgcctacggtgcggcggccggccgctggacgacggtgacggtgccgctgcggacggtcgtacccggcggggcggcgctgcccgggccgggggcgttcactggcccaggtggg

SEQ ID NO: 3260 - DNA, 4443 bp, Streptomyces avermitilis
  CDS (1)..(4443)
atgccggcccagcccgtcgatcccgtcgacccgctcgatcccgtcgactctcccgattccgccgacgctcccgattccacagaccccgccgaccccgccgactcctccgaccacctcgacctgctcgatcccctcgacctccttgccgagcgcgaggaagtgctcgaagagctgtcggggctgccggccgacgaccccgaggtgccccggctgtgcgcgtacgccggggaactcagcatccgcctgcacatgctgcggcaggagccggaggacctggagctggcggccgaggccttcgggcacgccttcgcccggcccggcaccgatgccgagtggcactcctggcgcatcatgtacgggcatgtgcgcgcctgccagttcgacgccgagccgtcccccgaactcctggacgagtgcctggcgctggtcgccgagggcctggcgggcctgcctacgggcgacgagctcggcggggcccacgagctcggcgggaccggcgggaccggcgtgaccggcgagcctggtgtgaccgacgaggccggcgagcccgacgagagtcacgacacctacgaggccgtccgtggcttaggactgcgtctcctcgccgccggtacgaaggtccgctgcctcgactgccccgaggatgccccggccgaggagcgcacccggctgttcgaagaggccctgcgccgccacgaggaggcgtacgagcacctggcgcccggtgacccggacgacgccgccgacctgaacgaggcgctcggttacctccgcttcgagcgcggtgtcctgctcggcagcgcggaggacggcgccgcgtccgccgcgcactaccgcgccgcactggacgcgccccgccccgcgagcgacctcccgttcgtgcggcacagcctcggcctcgccctgctgctgcacgggctggtcacctccgaccgggacgtgctcgaagaggcgcgggacgccttcggcaccgcgctcctcgacgcgggacgggccggcggcgaccgtcccgagtgggcctgggaggcggagatccgcagcgcctacatccgtgccgtgctgtgggccaagtggcaggaccagggccacggtgccgccgccgaggtcgaactggccgcactgctcgccgaaccggacgccctggaccggctcagccccgtgtacctggacatcttcggacggctgctctacgagcgggccgcacaccgcgacgacccgcagggccgggaccgcggcatcatgctgttgcggcgcgcggtggccgagtggcggccggagcacgacgggaacgtcaccgcggccgccctgctcctcgccaccttccagcagatccgccaccaggacgacccggacccgagccgcctccaggacatcgtccggggcgcgtccctcgcgatggcggacgaggaactcgacccggagagcgtgcagctggccaggatgatgctggcctgggcgcggcacggcctcgaagagatgggactccacgccgagaccgaggggctgcccgagcagcccggcttcgaggaactccgcgacatgttcaccgcgatgttcgtcaccgaggaggatcgcaacctggtcgacctcggggagcgttccgacttccccggcatctaccgggacatgggcggcgacagacggcgtatggccatcctggacgagggcttcgcgaggctggacgcgctgtcgccggacaacgagttccggccccggctcgccgccatgctgctgtcgcagctggtggtgctggacccgaacaacaccgacgtcggcgccgaccgcaaacagcggctcctcgacatcgtgctcgagcacggccgggtcgacccggactgggaccggcacgcccaggcggtggtcggcgcggcccggctgcgggacgagatggcggggtccggcgcgcggatggacgaggtgctggcccacttcgaccgggcggcggcgacgggggccggtgacaccgcgatccccgaggtcgccttcgccagactcctcgcgcgtacccaccggggacagaccgtcggcgccgccgacgacctcgaagccgccgccgaggcctggcggcagctgcgcgacatgccccacatctccgactacatgcggcgcatgatggacgcgcaactggccggcatggacgcgcagaacgccgcacagcgcggcgatctggccgccgtggaccgccacatcgcgaccgtcctcgaagcgcacgcctccctggaccccgaggacacctcacgcatccagctgtggacgtccctggagaacgccctcatgaaccgcgacgagctggcccggtctctcggcgccccgctcgcgcccccgccccccggccgccccacggtggacacactgcgccgcgaggcggcccggttgccccgcagccaccgcgcctgggtcctcggcgacaacggcatctcccgcttcggccgcgccatgcggaaccgggacgcggacgcgctcgccgacgccgtcaccctgctccgggaggcccacgacctcgccgaggaggacagcgacagccggctgcgctacggccactgcctggcctccgcgcactgcgtcctgtccgagatgctgccgacgccgcatctgcgccgcagccacctcgccaagggaatcgccctcttcgagaaggccttcgagcaggtcaaggggcccgagcaccggctgtacgcgccggtcgggctgtcgctcggccgcgcctaccgcacccgtgacgacctcggccgcggcgaccgcgccgaaggccggcgcatcggtctggaggcgctgcgcggccacgcctgggcggcgctgctccagtccggcaccgcgcacgccgcgcaggccgcggcccaggccacctcgacggcgctggaagtcgccgggtggtgtctgcgcgacaacgttcccgaggaggccgtccaggcgctcgacgcctgccgcgggctcgtcctgcacgcggccaccacctcgacgaccgtgcccgaacgccttgtcgcggccggccacatcgacctcgccgagcagtggcgggccgcgggcgccggggacccgctctccgccgccgggggcgggcctacgctccccagcgagctgcgccgccgggtgctcgccgcgctcaccgccggggacgtctcacaggaacggctcctcgacccgcccaccccacgggagatcgccgacgccctgcgcgccctgcgcaaggacgcgctggtctacctcgtgcccgcctcggaggacggcggcggcacggcggtcgtcgtcaccaacggcggcgacgtgcacgccgtccccctgcccaacctcacggaggtcgccgcaccgctcaaggagtacgcgccggcggggacgtacgcgcgcgacgcggggccacgacccggcggcgagacggccgcgcccggcggacgtgacggcggacgtgagggtggacgcgacggcggaccggagcgtgacctcgggcccgtgcccgggttcgcgaccggggagtacgggtcccagggcgcccgagtcgacaccccgacgctgcgcaagcagctggaacggctgtgcggctgggcctggtacgccgcgatgcggccgctgttcgccgagtttcccgagccgcgggccggccgcgtcccccggctcgtcctcgtgcccatgggcgccctcggactcgtaccgtggcacgcggcatgggagcagggcgacgacgggcgccgccgctacgcgctccaggcggccgagatctcgtacgccgcctccgcccggctgctgtgcgaggtggccgcccgccccgcggtcgcccacagcggggcggccctcgtggtgggcaaccccacgggcgacctgcactacgcgggcgaggaggccgacgccgtgcagcgggcgttctacccccgcggccagttcctggggcggcgcggcagcggtcccgccgacggcgcgggcagcccgcaagaggtgctgtcctggctgcgcaagggcggcgaggacgagggcggagtactgcatctcgcctgccacgccgtggtcgccgagaacgccccgcgcagcgcgtatctcgccctgcaccaaggggagttgtcggccgaggaactcaccgaggcggtcagtgacggcagccgcggacacctcgggctggtgctgctcgccgcctgccgcagccatgtctcgggccgcggccacaacgaggcctacaccctggcgaccgccttcctggtgtccggcgcccgctccgtgatcggctccctgtggccggtgccggacgacgcgacctcggtgctgatgtacctgacgcaccactatctgcgcacgggcggtgaaccgcccgccaaggcgctgcgccgggcccagctgtggatgctggacccggaccgcgaccggtcggccgaactgcccgccgaactcgccgaccgcgtccggcacatcgaccccgacgacctcagcgcctgggccgggttcacccacctgggccag

SEQ ID NO: 3261 - DNA, 651 bp, Streptomyces avermitilis
  CDS (1)..(651)
gtgccgaaccaccggccgcccgccgccctgaccggcacccccggcaaggccaccctcgcccggggcaccctgctgcaccgggtgcactcggtccaccgggacgccgccgcgttcaacccgcgccccacgcactgcctgtacggcggcggccgcttcgacggcacctcctgccatccgtacggctatctctacgcgggctcgaccccggccgccgcggtctgcgagacgctgctgcgctccgtgccgttcgacccgtcgggcgggccccggctgctgccgcgggtgagcgtcgagcggcgcgggctgagcgcgctgcggctcaccaccgacctcgatgtcgtctcgctgatgaccgggcaggacctggccgccgtccaccaggacagttggctcgtgcagaccgaggcggccgactacgcgtacacccgcgactgggcccactggatacgggagcacaccgatccctgggcgcaggggttcgtctgggccagcaaacgggagcccggcgaccgcgcggtcgttctcttcggtgaccgctgcccgcccggcgccctggccgccgtcgacggccacacggtggacttcggcaccgacgggggacgacgctggctcaactccgttctccagccgtaccacgcacagctcgcgccc

SEQ ID NO: 3262 - DNA, 666 bp, Streptomyces avermitilis
  CDS (1)..(666)
ttgaatccgtacgccgtgctggccgcggccgccgccgcctgggaccggatcgccgcacgcctggaccgggcggcgcgcgaggggctgaccgagctgctgcgcgtcgtacgcgaccgggacaccgccgagcgggagcggctggccgccgccgcacgggccgccgcgctgctgggcgaggcgctgcccgacgagttcggggccgcacagcaggcccggctcgcccccgacgtactcgacgagggcgcgcccaccggccccgtcgtccagggttttcacgccgaggacctcgcggtgctgctcatggacggccaccgcatggtcggcccggtgctcggcccggtgcgcgagcggctgctcgccgcgcccgccctcgacgccgacacggtgctgcgcgaaggcggcgacccgtacgcgcccgatctgatccggctggccggcgcgggcggccggccccggctgccccgcttccagttctccgagggcaccctgccctggctggtggtcctggaggtcaacgcgctgctcgccgcggaccgcgacccgtggggcgccgccgactggtggctgtcgggcaacgcctggctcggcgcgcgccccgtcgtgctgctcggcaccggccgcgacggccacctggccgacgtggcacggttcttgatggaagaggag

SEQ ID NO: 3263 - DNA, 1191 bp, Streptomyces avermitilis
  CDS (1)..(1191)
atggacgtggagaacagccaggggagcacggaacgggcttgtgacgggggtggcggcggtgcgatccttgccgccatggcgctgccccctcacctgcccgatcacggatcggttctcgcggaggtgcgcaaggtgaggcgggccggggtcgttcggttgaggggactggacacaccggagctgatccgcatcgcgcgagaactgcccggacaacagggggagttggcgagccgctcggtcgaggtactgctgcggaccgccgtcgcgggactgggcggcggcacacttcagaccgccgccgagtacagcctgggcctcgcccagggcacccgggactggccggccgcggaccggcgcagacgggccgcggaggtgtacggcgtcagcgtcgaacgcttccgcaagcaccacgaactgatggtgctggggcagttgacggagcaggtgctgggcatcgccggcgccccggccgccccggcgcgtgaagtcccggcaacgggacggccggtggcgctccccgccgcacaccgcgtcctgaagccgtacgtccacggccggcccgtgtccgtcacggtgcatgtgcactcggtcgatctgctccgggacgtcgatgtcgtcgtctcaccgtcgaacacgtacttcgcgctgccggccgcgtacaagtcgtcggtcgccgcgaccctgcgccgggcaggcgcgcacaaggaccccacggggggactcgtcgaggacagcgtccatgacgagctgcggggatgggccgtccggcacggtgcgccgggccgggcggccctgcccggcacggtcgccgccacctccgccggagccctcgccgcacagggcgtccggcggatctaccacatggccgtcgccgtgccgcgcttcggcaccaacgactacgacgtgcagcccgccgacatcacccgcggtgtcacccgggtcttcgccctcctcgccgaggagtcccgccgcttcgacccgcccctgaactccgtctgcctgcccctgtcgggcgcgggccgcggcggactgtcgccgctggagagcttcggcgcgctctgggcggccgtggaggccgaactcgcccgcggcgcaccctgggacgtccacttcgtggtacgccgccacgcccgcgccgacctcatcgagcggctgctgtccgaccgcgcggaccacgacaccgggtcccgg

SEQ ID NO: 3264 - DNA, 1485 bp, Streptomyces avermitilis
  CDS (1)..(1485)
ttgatctcgtatccgctcgcagcgacggccccggccacccccgagacgccaccccacaccggcggcctgctcctgctcatggacggcaccgcgggcctgctcacggtcgccgccctcggaatcgccctcctcctgatcctgatcatcaaggtcagactccagccgttcgtcgccctgctcgccgtctccatagccgtcggcctcgcggccggactgtcggtcaccgaactcttcggcacggtccagcggtccaccgcggtgtcggtcgtcgaaagcggcatgggcggcatcctcggccatgtggcgatcatcatcggcctgggcacgatgctcggcgcgatcctcgaagtcagcggtggcgccgaggtgttggcgacccggctgctgaacctcttcggtgagcggcgtgccccgctcgccatgggcctgaccggcctgatcttcggtatcccggtcttcttcgacgtcggcatcttcgtcctcgcgccgatcgtgtacgcggccgccaagcgctccggcaagtcgatcctcctctactgcctgccgctgctggccggcctgtcgatgacccacgcgttcctgccgccgcaccccggcccggtggccgcggccggcctcctgcacgtgcagctcggctgggtcatcctgatgggcgtcgtctgcggcatcccggccgtgctcgccgcctgggtctactccgcctggatcggcaggcggatcttcgtcgccgtaccgcaggacatggtcgaggcggcggccgaggccaagctggccgtcatcgaggaacagcgcgcgcagggtgtcgagccgcgtgaggagcccgtccccctcggcacggtcctcggcatcatcggtacgccgctggtgctgatcctggccgccaccttctcctcgatcgccctcgacccctccacgctccgctcggtcatcgagttcttcggcagcccgttcgtcgccctcaccatcgccctgctgctcgcgtactacctgctcggcatccggcgcggctggtcccgcaagtccctggagacggtgtcgacttcgtccctcaagccggtcggcaacatcctgctcgtggtcggcgcgggcggcatcttcggggccgtcctgaaggccagcggcgtcgcccaggcgctctccgacaccttcaacgacgtcggcctgccggtgatcgtcctctcgtacctgatctccgtggtcctgcgggtcgcccagggctcggcgacggtcgccatcgtcacgacggccgggatcgtggcgcccctgctcgccgcgggcgaccactcccaggccttcgtcgccctggtcatcatggccatctcggcgggctccatcttcgcctcgcacgtcaacgacggcggcttctggatggtgtcgaagtacttcggcatcagcgagcgggacacactcaggacgtggaccgtgctggagtcggtgctgtccgtcgccgggttcgcggtggcggcggtggtgagcacgttcgtc

SEQ ID NO: 3265 - DNA, 417 bp, Streptomyces avermitilis
  CDS (1)..(417)
atgaccgagaagaccgagaagaccgccctcacccccaagacccacaccaccccgcccgccaagttctcgcacggcgtcaggaaggggaacatcctccaggtcgccgggcaggtcggcttcctgccggccgaggagggcaagcccccgacgcccgcgggcccgaccctgcgcgagcagaccctccagaccctcgccaacgtgcgggcgatcctcgaagagggcggcgccacctgggacgacgcgatgatgatccgcgtctacctcacggacgtcgaccacttcgccgagatgaaccagatctacaacacctacttcgaggagcagggcctcaccgcgccccccgccgcccgcacgacggtgtacgtcggcctgccggccggcctcctcatcgagatcgacgcgctcgccgtactgagc

SEQ ID NO: 3266 - DNA, 792 bp, Streptomyces avermitilis
  CDS (1)..(792)
atgagccagaccgtcgaccgcgccctcagcatcctgccgctgctcgccgaaggccccgccgacctcggccaggtcgccgaccggctcggtgtgcacaagtccacggcgctgcgcctcctgcgcaccctgcacgagcacggcctcgtccaccgccagtccgaccagcgctaccgcctcggcgcccggctcttcgccctcgcccaggaagccgtcgagaacctggacgtccgcgagatcgcccacccccacctcgtacgcctcaacgagcagtgcggacacaccgtccacctcgcggtgtacgaggagcacgaggtcctctacatcgacaaggtggagagccgctaccccgtgcgcatgtactcgcggatcgggaagccggtggccatcaccgtcgccgccgtcgccaagctgctcctggccgacctgcccgaacccgagcgccgcgccctcgcggagaagctcgactaccccatgtacacggcccgttcgatccccaacgcccctgccttcctgcgtgagttggagaaggtgcgcgaacagggctgggccaccgacctcggcggccacgaggagtccatcaactgcgtcgccgcccccgtccgcggcgccgacggacgggccgtcgccgcgatgtcggtgtccgcgcccaacgtcgtcgtcacggccgacgagctcctcacgctgctgccgctggtccgccgcaccgccgacgccatcagccgcgactactccggaaagcccccgaaagaccagctgaaagaccacccgagagaccacccgaaagaccccggc

SEQ ID NO: 3267 - DNA, 1083 bp, Streptomyces avermitilis
  CDS (1)..(1083)
gtgaccaccgacggacgtaccggtgccgtgccccgcgacgcccacgacgtcgtcgcgctcggcgagtccatggtcacgttcctgccgacgcggcccggacgcctcgccgacgtgccgtccttcgagcgtggcatcggcggcgccgagtcgaacgtggcgtgcgtgctcgccgccgcggggcactccgtgcggtgggccgggcgggtcggcgccgacgggttcggcgaccacctggtggaggcgatcgcggcgtacggcgtcgacacctccgccgtgcgacgcgatcccgcacgcccgaccggtgtctacttccgcacggcgggcgaccgggccaccgacgcccacgaggtggcgtactaccgggccgggtccgccgcctccgcgatgacggcggagaacatggacctcgacgccgtccgcgcgggccgggtgctgcatctgtccggcatcaccgccgccctgtccgacggctgcctgggcctgctgcgcgaactcaccgcccgccggcccgcacgcccgctcgtctccttcgacgtcaaccaccggcccgggttgtggcgtgacacggacgggccgcgggtgctgctggagctcgcccgcggcgccgacctcgtgttcgtcggcgacgacgaggcacgggcggcctgggggctgcacggcccccgggcgatccgggacgcgctcccggagcccgaggtcctggtcgtcaagcagggcgggggaggagcgaccgccttcgagcggcggcccggcgggccgggcacgggcgacacctcaacggacacggtcaccttcgtccgggctctccaggtcgatgtcgtcgccgccgtcggggccggcgacgccttcgccgccgggttcctctccgccaccctccgcggcctgcccgtccgcgaccgcctccggcacggacacctcatggccgccgccgcgctcaccgtgcccggcgacctcgccgtgccgcccgcccgcgaccacgccgaccgcctggccgccctcgacgacaccgcgtgggagacacttcgactcggccccggctggacacaagccgttgatcgggcccaggaggaggtacgtacccca

SEQ ID NO: 3268 - DNA, 1269 bp, Streptomyces avermitilis
  CDS (1)..(1269)
atgagtgccgaagcgctcgcccggctcgccacggaccgcgtggaccaccgcttcaagggcctcccgccggacgccgaggggctgaccgtgggcgagctggccgcccagcgccgcgacctcttcaccggcggcttcaccaccccggtcctcgccctctccgccgaacgcctgacgcacaacctcgaactcatggagacctacgcggcccgccacggcctcgccttcgccccgcacggcaagacctcgatggcgccgcagctcttccagcgccagctcgaacacggcgcctggggcatcaccctggccgtcccccaccaggtgcgggtggcccgggagttcggcatccagcgggtgttcctcgcgaacgagctggtcgacgcggcggccctgcgccacatcgccgccgacctcgcggccgaccccggctaccgcttcatctgctacgtcgactccgtgcgcggagtggaactcatggacgcggcgctgcgcggcacgccccgcccggtggacgtcgtcgtcgagctcgccgccggagagggcgcccgtaccggggtgcgcacggaggaggagtgcgcggcggtcgcggacgcggtggccgcgacgccgacgctgcgtctggtcggggtcgcgggctacgagggcgaggtgccgcgggcggactccgagcgggtccacgcctggctgcgccggctcgtcgcgctggcggtggacctcgaccgggcggggcgcttcaaggacgcgggcgagatcgtggtcagcgcgggcggcagcgcctggttcgacgcggtcgccgacgtgttcgccgggatccccggcctctccctgcccgtgctgaagttgctgcgctcgggcgcgtacgtctcgcacgacgacggccactaccgcaggctcacgcccttcacccgggtcccggaggagggtgccctccaccccgccttccgtctctggacgcagatcgtctcgcgcccctcccccgggcaggcgttcgccaacgcgggcaagcgggacgcggcgtacgacctggatctgccgctggcgcaggtcgtgcgggacgcggggtcgggagagatccgcgacgccgccggcatcgaggtgacggccctctcggaccagcacgcgtggctccgtacggccccggaggcggagctggaggtcggcgactgggtcggcctgggcctgtcccacccctgcacgtccttcgacaagtggcagctgatccccctggtggaagcggacgggacggtcgtcgactacatccgtacgttcttc

SEQ ID NO: 3269 - DNA, 1590 bp, Streptomyces avermitilis
  CDS (1)..(1590)
gtggatctcgtcatccgtgatgtgcgcgtcgtcgacggcaccggcggcgcgtcctgccgtgccgacgtcggtatcaccggcggccggatcgccgagatccgccgcgacggcccggccctgggcggacgccgggtcctggacgccggcggcctcgccctggcccccggcttcatcgacatgcacgcccacagcgacctcgccctgctgagggacccggaccacagtgccaaggcggcccagggggtgaccctcgaagtcgtcggccaggacgggctctcgtacgcaccggtcgacgaccgtacgctcgccgaggtccgcagggcgatcaccggctggaacggccacggcgacgacatcgacttcacctggcggtcggtcggcgggtacctggaccggctggaccagggcatcgcggtcaacgcggcgtatctgatcccgcagggcaccgtccgtatgctcgccgtcggctgggaggaccgcgcggcgacgcccggcgagctggaccggatgcggcggctggtggcggacggcatgcgcgagggcgccgtcggcatgtcctccggcctcacctacacccccggcatgtacgccgaggacgccgaactcaccgaactgtgccgggtggtcgccgagtacggcggctactactgcccgcaccaccgctcgtacggggcgggcgcgctccaggcgtacgaggagatggtggccctcacccgcgaggcccgctgcccgctccatctcgcccacgccaccatgaacttcggggtgaacaaggggagggcaccggacctgctggccctcctcgacggcgcgctggccgagggcgccgacatcaccctcgacacctatccgtacacccccggctgcaccacgctcgtggccatgctgccgagctgggcgggcgagggcggcccggaggcggtcctcgctcggctgcgggacgacacggtcgcggagcggatccgccacgccatggaggtcgtcggcgcggacggctgtcacggcgtgcccatcgagtgggacacgatcgagatctcgggcgtgagcgacccggcactcgccccctacgtcggcagcaccgtccaggcctcggccgacctgcgcggcgaggccccctggaccaccgcccgccggctgctcctcgacgaccggctcggctgcacgatcctccagcacgtcggccacgaggagaacgtccgcgcgatcatgcgccaccgtgtgcacaccggcggctccgacggcatcctccaagggacgaaaccgcacccgcgcgcgtacgggaccttcccgcactacctcggccattacgtacgcgagctgggggtcctctcgctggaggagtgcgtcgcccacctcaccgggcgcccggccgcgcggctgcggctgccggaccgggggctcgtccgcgagggataccgcgccgacctggtcctgttcgacccgtccaccgtcgcggccggctcgaccttcgaggacccgcgcaggctcccggccggccttccgcatgtgctgatcgacggccgcttcgtcgtcgaggacggccgccggacggacgtactggcggggcgggcggtccgccggactcctcgc

SEQ ID NO: 3270 - DNA, 639 bp, Streptomyces avermitilis
  CDS (1)..(639)
gtgctcagcaacggccactgcctggagaccggcttcccggagcccggcgaggtgatcgtcaaccaggcgtcgagccgtaccttcggcctgctcaactccgccgccacccgggtggcgacgctgcgcgcgaacaaggtcgtctactcgacgatgaccgacacggacgtctcgatctaccagctgaccaccacctatgcggcgatcaagagcgcgtacggcatcagcgcgctcaccgtgcaggacacgcacccgaccgccggtaccgccatcaccgtcgcctccgggtactggaagcggctctacagctgcaacgtcgacgggttcgcgtaccgcctgaaggagggcgactggacctggaaggactccctccgctacacctccgcctgccagaccatcggcggcacctccggctcgccggtgatcgacaacgccaccggcaaggtcgtcgccgtcaacaacaccggcaacgaggacggcgagacctgcacggagaacaacccctgtgaggtcgacgcgagcggcaacgtgaccgtccgcgagggcatcaactacgcccaggagacgtaccagatcccggcctgcttcacgaccgccaacgtgctgaacctgagcgcgagcggctgcaccctgcccaagccg

SEQ ID NO: 3271 - DNA, 801 bp, Streptomyces avermitilis
  CDS (1)..(801)
gtgagacacggggtgtcgagcggtggccacccgcgggtacacgtgacccccttcttgtctctacactttccggccatgtcatggcaccttcagcccgccgaccgggcgcccgggacaaatggcgcgaacgggccgggcggcccgtctggtgccgatgccgcgcacggcgcgccgagcgtctaccacccgcgggccgacgccgcgcccgcgtacgaggagtacgcggaccccgcggccgcccacgggtgggagaacgcctacgacagcacgcgcgagctgcccgtgaccgttccggacgcggacgaaccggcggggcccggcggcccggtcctggacggcggaccgcgacggcgggcgcgcccgaagggtcgcggacggccgacgtcccgggtgctcgtcgccgtcggcgcggtctgcgccctgggtgccgccgtcgcgatcgcggggttctccggctcggggtccccggccggtccgcgggtcgagggcgacggggtgcggccgaaggccgagcggtccgagcagccgtccgtggacgcgagcgcctcggccggcgcggccaccaccgggccgtcggacggcggcgccccgcccgtcaccgcccgcccgtccgacgacgcgtcctcctccgccggcgcttcggtgtctccttccccctccggggaggaaaccggtgcgcccacgacttcggcgccctcgacggaggcggcggtgacggcgacggcgtccgccggcgtgagcgcgtccgcgtcccggccgggcaactccggtcacggcaagggtgcgagcaagcggcccaag

SEQ ID NO: 3272 - DNA, 1209 bp, Streptomyces avermitilis
  CDS (1)..(1209)
atgcaggtgatccagtccacgaagctcgccaacgtctgctacgagatccggggcccggtgctcgaggaggcgatgcggctggaagcggctggtcatcggatcctcaagctcaacacgggcaatccggcggcgttcggcttcgagtgcccgcccgagatcctcgaggacatcctccgcaacgtctcctccgcacacggctacggcgacgcgaagggcctgctggccgcccgccgcgccgtcgtcatgcacaaccagaccctcggcatcgagacggacgtcgagcacgtcttcgtgggcaacggcgtctccgagctgatcgtgatggccatgcagggcctgctggacgacggcgacgaggtgctcgtaccggcgcccgactacccgctgtggaccgcctccgtctccctgtccggcggcacggccgtgcactaccactgcgacgagcagtcggactggatgcccgacctcgccgacgtggagcgcaaggtcaccgaccgcaccaaggcgatcgtcatcatcaacccgaacaacccgacgggcgcggtgtacgacgaggcgatgctgcggggcctgacggacatcgcccgccgccacaacctgctcgtctgctcggacgagatctacgacaagatcctctacgacggcgccacgcacaccccgaccgccgcggtcgcccccgatctgctcacgctgacgttcaacggcatgtcgaaggcgtaccgcgtggccggctaccgggtcggctggatggcgatctccgggccgcgcgcgcacgccgactcgtacatcgagggcctgacgatcctggcgaacatgcggctgtgcgcgaacatgccgggtcagcacggggtggtcgccgcgctgagcggccgtcagacgatcaacgaactggtgctgccgggcggacggctcaaggaacagcgggacgtggcgcacgagctgctgacccagatccccggcgtgagctgtgtgaagccgaagggcgcgctctatctgttcccgcggctcgaccccaaggtcttcaagatcaaggacgaccggcagatggtgctcgacctgctgcgccgcgagaagatcatggtggtccagggcacgggcttcaactggccggaccccgaccacttccgggtggtgaccctgccgacggtgggcgatctgacctcggcgatcacccggatcgggaacttcctggacggttacagccagccg

SEQ ID NO: 3273 - DNA, 417 bp, Streptomyces avermitilis
  CDS (1)..(417)
atgtatgaaccgatccggaccaagtcggtccacacgatggccggcaccgcccccgactttcctcaccggtcgcgcgaggaggagctggacatccagctcgcgggtcatctggcggcactgctcgcggtgaccgacgaactgcgtgcgctgacgccctccgcggagctggacacggccgccgagcggctcgcggagcaggtggcccggctgcgcgggggactgccgcccgcccggacgtcggtggccgccgccctccacgagccgcatctcgcggcactgcaccgacgggcgcacgccctcgcgggccgcgccctcgtcgtcgccgcctcccgggccgacacggcggccgccatcctcgccgccgagcgcatggacgcccacgcggcggccgccgacccgcgcgaactcgcgccccgc

SEQ ID NO: 3274 - DNA, 1821 bp, Streptomyces avermitilis
  CDS (1)..(1821)
gtggcgcgcgacatcgcggctccctccagcgtccccacccagcacaaagaactgatctcgtgggtcaacgagatcgccgaactgacgcagccggacagtgtggtctggtgtgacggatccgaggcggaatacgagcgactgagcgaggagctcgtccgcaagggcaccttcaggaagctcgacccgatcaagcgccccaactcgtactacgccgcctccgacccgaccgatgtcgcgcgggtcgaggaccggacgttcatctgctccgagaaggaagaggacgcgggcccgaccaaccactggaaggaccccgccgagatgcgggagatcttcgccggtgagcagggcgtcttccgcggctcgatgaggggccggacgatgtacgtcgtcccgttctgcatgggcccgctcggctcggacctctccgcgatcggcgtggagatcaccgactccgcgtacgtcgccgtgtccatgcgcaccatgacccgcatggggcagccggtcctggacgagctcggcaccgacggcttcttcgtgcgtgccgtgcacacgctcggagcgccgctggaggcgggcgaggcggacgtgccgtggccgtgcaactccacgaagtacatctcgcacttccccgagtcccgcgagatctggtcgtacggctcgggctacggcggcaacgcgctgctcggcaagaagtgctacgccctgcgcatcgcctccgtcatggcgcgcgacgagggctggctggccgagcacatgctgatcctcaagctcacgccgccgcagggcgagtccaagtacgtcgccgcggctttcccgagcgcctgcggcaagacgaacctcgccatgctggagcccacggtcggcggctggaccgtcgagacgatcggtgacgacatcgcgtggatgcggttcggcgaggacggccggctgtacgcgatcaaccccgaggccggtttcttcggcgtcgcgcccggcaccggcgagcacaccaacgccaacgcgatgaagaccctgtggggcaactccgtcttcaccaacgtcgcgctcaccgacgacaacgacatctggtgggagggcatgacggaggagactccggcccacctcaccgactggaagggcaacgactggacgccggagtccggtacgcccgccgcgcaccccaacgcccgcttcaccgtccccgcctcgcagtgcccgatcatcgcgcccgagtgggaggaccccaagggcgtgccgatatcggcgatcctcttcggtggccgccgcgccaccgcggtcccgctggtgacggagtccttcgactggaaccacggcgtcttcctcggcgcgaacgtcgcctccgagaagaccgccgccgccgagggcaaggtcggtgagctgcgccgcgacccgttcgccatgctgccgttctgcggctacaacatgggcgactacatgggccactgggtcgacgtcgccaaggacaaggaccaggcgaagctccccaagatctactacgtcaactggttccgcaagaacgacgagggcaagttcgtgtggcccggcttcggcgagaacagccgcgtgctgaagtggatcgtcgagcgtctcgagggcagggccgagggcgtcgagacccccatcggcatcctgccgaccagggaggccctggacacggccggcctcgacctgtccgcgtccgacctggacttcctgctcaccgtcgacaaggaggtgtggcgcgaggaggccgcgctcgtgcccgagcacctcaacaccttcggcgagcacacaccgaaggagctgtgggacgagtaccgcgcactggtgcagcgcctgggc

SEQ ID NO: 3275 - DNA, 711 bp, Streptomyces avermitilis
  CDS (1)..(711)
atgactgcgcccgtccccgacgcgcccacggacacgccggccgcaggccacggtcccgccgcgctctccttgtccgacgagatcaagccgaagctccgcggctggctgcacctgggcatgttcccggccgcactcgtctcgggcctggcactcaccgccttcgcgagctcgccccgcgcccgcctggcctgcgggatcttcgctctgacggcctgcctgctgttcggcgtgagcgcgctctaccaccgcggcacctggagtccgcgcatggacggcatcctgcgcagactggatcacgccaatatcttcttgatcatcgcggggacgtacacaccactgacgatgctgctgctgccgggggccaagggccagtggctgctgtggagcatctggggcgcggccgccgcgggcatcgccttccgggtcttctgggtcggcgcgccgcgctggctctacacgccctgctacatcgcgatgggctgggcggccgtcttcttcctccctgacttcatgcgcacgggcgggatcgccgtcctcgtcctggtggtcgtcggcggtctgctctacagcgcgggcggcgtgatctacggcatcaagcgcccgaacccgtcaccgcagtggttcggcttccacgaggtcttccactccctgaccctcgcggcgttcgtcgtgcactacgtcgggatctcgctggtggcctatcagcacgga

SEQ ID NO: 3276 - DNA, 1572 bp, Streptomyces avermitilis
  CDS (1)..(1572)
atggttactgtcactcagcagcacgacccgcggcacgacgcccgccgctggtgggccctcggagccctggtcgcgagcatgctcgtactcggcttcgacatgacgatcctcaacgtcgcactgccgaccatggcccgggacctgggcgcgtccaccggcgagcagcagtggatggccgacgcgtacgtcgtcgtcttcgcggccctgatgctcccggccggcctgctcggcgaccgcttcggacggcgccggatgctcatcaccggactcggcgtcttcctggccggctccctggccggcgccctcgtcgacgacgtcaccccggtgatcgtcgcccgcgccctgatgggggtcggcggcgcgctcgtgatgccgctcgcgatggccgtactgccctcgctgttcggacccgaggagcgcaccagggccgtcggcgcggtctccgccgcctccgcgctgggcctgccgctcggcccgatcctcggcggctggctgctcgaccacttctggtggggctcggtcttcctggtcaacgtgccgatggccgcgatcggcatcgccgcctgcgtcttcctgctccccgagacccgcgaccccgcctcccccaaggtcgacgccgtctccaccgcgctcaccgcggccggcctcagcatcctgatctacgcgatcatcgaggcgccggggcgcggctggggcgacccgctggtcctcggcctcttcgccgcctccgtcgtcctgatcgccctgctcgtcgtccgcgaacgccgcagcgcccgcccgatgctggacctctccctgctcgcccagcgcggcttcctgctcaacacgctcgccgcgaccctcgtcatgttcgtcctgtccgggctgatgttcgtgctgccgccgtacctccaggcggtgctcgggaacgacacgttcgccaccggggtgcggatgctgccgatgatgggcgggctgctgatcgcgtcgaggggcgcacagccgctgctggcgaagttcggggcgcgggcggtgatcagcgccggcctggtcaccctcgccttcgccgcgatcctcggcagccgcacgtccgtcgacgacggctacggcttcaccgccctgtggctgtccatcgccggcctcggcttcggcttcgccgtggtgcccgcgatgtccgccgccctcggcgccctgccccgcgaccgggccggcagcggctccggcctcctcatgacggtgcgccaggtgggcggcgcgatcggcatcgccctgctcggctcgctcctcgcgggcgcatacggcgaccggctcgacacctccggcctgccgcacggggccgccgacgccgcctccgactcggtggtcggcgcccatgtgatcgccgcgcagctcggcgaccgcgcgctcaccgcctccgcgaacgccgcgtacctccacggcatggacctggtcctcatgatcagcggaatcgcggcactcgtcaccgcgctgctggccgcggcgctgctcccgaagcccgagacgtcgcccgccccggccccgacccccgaggaggacaccgccgtggccccgacgcccgccgatgccggacaa

SEQ ID NO: 3277 - DNA, 660 bp, Streptomyces avermitilis
  CDS (1)..(660)
atggccgccaccgcacacagctccacccccgccgacggcccccagctggggctccgggaacggaagaagctcaagacccggatcgcgatccgcgacgcgacctacggactgatccaggagcaggggtacgacgcgacgaccatcgagcagatcgccgagcgcgccgaggtctccccctcgacggtcttccgctacttcccgaccaaggaggacatcgtcctcacggacgagtacgacccggtcatggagaaggagctgaccgcccgcccggccgacgaaccgtggacggagtccctgcggtacgcggtgcaccaggccatcggcttcgggttcaccgaggagccgcacgtgtcccggctgcggacccagctgatggtcgacgtgcccgcggtgcgctcccggatgatggagagcatgtcggtcaccggccgcatgctgtgccgggtcatcgcggcgcgcaccggccgcgaccccgacagcctggaagtgcgggtgttcgcgatgtccctcatcggcggcctgatggagacctcgctgtactgggccgagaccggccaccaggaggacctcggcgacctcgtcgaccgcgccctggacgtcctggagaacggtctgccaccgaaaaacccggaggccacggacgcgtccggcgtgacatcc

SEQ ID NO: 3278 - DNA, 723 bp, Streptomyces avermitilis
  CDS (1)..(723)
gtgaacggaccggagatccacgtcgcattcgcccccgaactgcgcctgttcgtcccgcacgagcggcggtccggcaccacggcggtcggcaccgacggcgcctccaccctcgggcacgtcgtggagtcgctcggcgtccccctgccggaggtcggcgcactcgtcgtgaacggccgcgagacacccgtctcgtacatcccggcggccggcgactcggtggaggtgcgcccggtcgagcgcccccagcgggtccccggcgccccgctccgcttcctcctcgatgtgcacctcggcacgctggcccgccggctgcgcctcctcggcgtcgacacggcctacgagtcgacggacctcggcgacccggccctcgccgccctctcggccgccgagaagcgcgtactgctcagccgcgaccgcggcctgctgcgccgccgcgagctgtgggcgggcgcctacatctacagcaccaggcccgacgaccaactccgtgacgtcctggaccggttcgcccccgggctggccccctggacccggtgcacggcgtgcaacggcgtactcgagaaggccaccaaggagcaggtcgccgaccagctggaaggcggcacgcagcggtcgtacgacgtcttcgcgcagtgcgaggagtgcgggcgggcctactggaagggcgcgcaccacgaccgcctggaggccatcgtggagcgcgccctcgcggagttcggcgcc

SEQ ID NO: 3279 - DNA, 2271 bp, Streptomyces avermitilis
  CDS (1)..(2271)
atgccgtactgctgggagaagtcgggctggggcgacaacgacttcacgttcaccaccacgagtgacgcgcacaccggcaccaaggccatgaaggtcgcgctgacccggcgtgtcgacggcgaccgcaaggcgctgatcaccgagtccgccgcctgcgcgccggtggtcaccgcgggcaagcagtacgacctcggcctctggtacaggacgacgacccccgacgccgcgatcacgctcttccggcatgacgcgacggcgggctggcagtactggaccgacctcaagacgctggacatgcagagcggttggacccgggcgacggtccgcacacccgaggtgccggccggcaccgaccgcatcacctggggtgtgtcggtgtacggcaccgggtccgcgaccaccgacgactacacgatggagcaggtcgccgacccgctcccgccggccacctgcacgggcacggccgaggagtgcgcgaacggccggtggacggtcctgcccacgcagaacccggtccgctccatgcactccgtcgtcctcaacaacggcaaggtgctgctgatcgcgggctccggcaacagcgaggagcagttcaacgcgggcacgttcaccagcgcggtctacgacccggtgaagggcacgtaccggcagatccccacgcccaaggacatgttctgcgcggggcacgtccagctctccgacggccgggtgctcgtgatgagcggcaacaaggcgttcccggtcgtgggcggccacgggtacgaggggtacaaggactcgtatctcttcgacccggtcaccgagacctacagcaagaccaacgacctgaacgacgggcactggtatccgtcggcgacggagctgggcaacggcgacatcgtctcgttcggcgggctgcgcgaggactcgaccggctcggtgaccgccgagcgctggtcggccgcgcagcagcggtggctgccgctgtggcaggtcaaccagacctggtcgtactggggtctgtacccgtcgatgatcctgatgcaggacggccgcctcttctactcgggcagccatgtcttcggcaacggcaccccgggcaccggctcggcggtctacgactacgacgcgaacacgaccaccgcgatcccgggtctgcagagcaaggacgagcgcgaccagtcggcgagcgtgctgctgcctccggcgcaggaccagaaggtcctcaccatcggcggcggcaacatcgactcgaatccggccgccaaccggctgacggacatcatcgacctcaagtcggcgaacccggcgtacaccgccgggccgccgctgccgcagggcaccgtcgacctcggcaacggcaaggtggccgagaccggcacccagggcaagatgtacgtctcggccgtgctgctgcccgacggcaaggtcctggagaccggcggcgccctgcacaatcgcgccgacccggtctacgagtcgtcgatcttcgacccggcgagctccaccttcgacccggtggccgccgacccggaggcccgcggctaccactcgtccgctttcctgctgcccgacggccgcgtgatggcgaccggcgacaacccgggcaacggcacctggaaccacaacgtgtccctctacaccccgccctatctgctcaagggcacccgcccgacgatcacttcggtgatcgacaacgagtgggtgtacggcgacacccagcgcatcaccgtcgaccgtcccatcgccaaggcggagctgatccgcccggcggcggtgacgcactcctcggacccgaaccagcggttcgtcgatctgccgctgtccgtgggcggcaacaacgtcgatctgaacgtgacgagcaacccgaacctggcgccgcccggctggtacatgctcttcgcggtggacgccaacggcgtgccgtcggtggccaagtgggtgcatctccagggcccgtccgcgctcgccgccgcctccgaggacacggcttcggcgcatgtccacccgttcgccgactccctggacggcaaggtcacggggcccggcaggaagcgcgcctcgcagaaggtcggcgccgccgtctccggatgcgaccggcactacgggaccgtcaacgtctgcgtgcccaccgcgttcccgcgcgaggtgaggaagacgacggccgcccggtgcgcctggctcgagaagaacgactacggccggctgaaggtcaacggcgaggacgatccgctggggctcgatcccagcaaggacaaactggcctgcggcaccaaggatctgaagcgccgt

SEQ ID NO: 3280 - DNA, 1200 bp, Streptomyces avermitilis
  CDS (1)..(1200)
atgagtcacgagtccaccgttcccgaggagctcggcgacccggtcgtacgggccgccgaggtccctgaacccggggccgtcaccatcgtcgtaccgaccttcaacgagtccgcgaacatcagggagctgctgcaccggatcaccgagtcggtgccggcgcggctgccctgcgaggtcgtcttcgtcgacgactccaccgacgacacccccgacgtgatcttccaggcggcgcaggactgcccgttcccggtcaccgtgctgcaccgcgaggagcccgagggcgggctcggcggcgccgtggtcgagggcatcaaggcggccggctccgactggatcgtcgtcatggacggcgacctccagcacccgccgtccctggtgccggagctggtgggcaccggtgagcgggcgaacgccgggctcgtcgtcgcgtcccgctacatcaagggcggcagccgcgccggtctcgcgggcgggtaccgcatcgccgtctcgcgcggcgcgacctggctgacgaagtcgctgttcccgcgccggctgcgcggcatcagcgacccgatgagcggcttcttcgcgatccgccgcagtgcggtcaccgcggagatcctccagccgctcggctacaagatcctcctcgaactggccgtacgcagccgtccccgcgaggtcaccgaggtgcccttcgtcttccaggaccggttcgcgggcgagtccaagtcgaccgcgcaggagggcttccgctttctgcgccatctcgtcggactgcgcaccgcctcgccgatcgcgcggatggtcgtcttcgggctgatcggcgccaccggtttcgtaccgaacctgctgggcctgtacgccctcaccgcgctcggcatgcactacgtaccggccgagatcctcgccaaccagctcggggtggcctggaacttcctgctcatcgagcacctgctgttccgcgagcgccggcggcaccgcacctggtgggaccgggtgggccggttcgcgctgctcgccaacgccgacctggtgctgcgcatcccgctgatcgcgctgctggtcggcaggttcggtatggagtcgctgcccgccaccgcggtggccctggtgatgacgttcgtcctgcgtttcgtggggaccgaggcgctggtctatctgccgcgccggggccggggggcgccggacgggagccgcacggcaaggagagccatg

SEQ ID NO: 3281 - DNA, 1638 bp, Streptomyces avermitilis
  CDS (1)..(1638)
gtgacctccactcttcccgcggcgaccacacccaaggtccccgcgcagcggtcccgtgcacccaaattcgtccccagccccccgcggatcctgcgttttcgcagctcgcgctcggatctgctgctgtgcggtgcgctcctcgtggcgatcctggtcgtgcagggctggaacatcgccgactacccgacgctcagcgacgacgagggcacctatctctcccaggcctgggccgtccaggagggcaagggcctcgcccactacacgtactggtacgaccacccgcccctcggctggatccagatagccctgctgacctggatccccgcgcacttcagcccctcgtcgatgacggtcggctcgatgcgtgcggcgatgctggtggtcagcgcggtgagcacggtcctcgtgtacgtgctcgcccgccgcctctcgctgccgcgctgggccgcgggcctcgccatggtcctcttcgggctctcaccgctgtcggtcgtgctccagcgcgagatcttcctggacaacatcgcggtgatgtggacgctgctcgcgttctgcctggccgcctccccgagccgccacctctggcaccacttcggggcggggatcgccgcggccgcggccgtcctcaccaaggagacgatgctcgtcatcctgcccgccctgctggtcaccatgtggcggcacggccaccgcgacacccgtaagttcgccctcaccggggccatcaccgcatgcaccctgctcggcctctcgtacccgctgttcgccctgctcaagggcgagttgttccccggtgcgggccatgtctcgctgtgggacggcatcacctaccagatgagccgccccggctccggcttcgtcctcgacccgggctccggctcgtacggagtcctccagtcctggctctactacgaccgtgtcctgccgctcggcggtctcgccggggcgctgctgctcctggtgacctggcgctggtcggtgaccgcgcgggcgctggccggacccgcgctcaccgtggcgatcctcgccctcgtcgccctgcgcccgagcggctatctgcccgcgatgtacgtcatccaggccctgcccttcctggcgctggtcctggccggtggtaccgcgagcgtcgcccacgcggtgctgcgcaggtggcgcggcggcgcggagaagccgtatgtgaccggggcgcggtacgtcgtggcggcgctgctcgcggccgtcgccggggcgtacgtcgtgccgcactggtacgacggcgaccgcaccgccctgaccgccgacgcgaacgccccctaccgggccgcgtcggcctggctgaagaccgaggtgaaggacccggaggacacccgggtcctggtcgacgacgcgctgtggctcgacctcgtccacgacggctaccggccgggcctcggcgtcatctggttctacaaggccgacctcgaccccgcggtgaccaagacgatgccgcgcggctggcgcgacctggactatgtggtcgcctccccgacggtacggcgtgacgcggtcgacctgccgcacgtcaaggccgccatggagcactccgagccggtcgccaccttcggcaccggcgcggaccggatcgagatccgtcggatccagaccgtgggaggttcccga

SEQ ID NO: 3282 - DNA, 1308 bp, Streptomyces avermitilis
  CDS (1)..(1308)
gtggctcatcgtcgcgacagggggcttttggggatctggggggatctggtgctcacgtctgtcttcattgctgccgtttcgctggctttgttctggatggcggccttcaccctgtggtggcagatgcacgcgtggcgtacgcccgaggtgctggcctccacccgtttcagcagaccggacggcggtgagggcctgtccttctcgctgctgctgccggcgcgacacgaacaggccgtgctggaccacacgatccagcgcctgctggagtccagtcacaccgacttcgagatcatcgtcatcgtcgggcacgacgacccggagaccaccgaggtcgcccggaaggccgcggcccgcgacgagcgggtgcgcgtcgtcgtcgacacccacgagaagaagaacaagccgaaggccatgaacaccgcgctgccgcactgccgcggcgacgtggtgggggtcttcgacgccgaggaccaggtccatcccgagctgctcgcccacgtcgaccacgccttccgctccaccggcgcggacgtcgtccagggcggcgtacagctcatcaacttcaactccagctggtacagcctgcgcaactgcctggagtacttcttctggttccgctcccggctccatctgcacgcgcagaaagggttcatcccgctcggcggcaacaccgtcttcgtccgcacggacgtcctcaaagaggccgacggctgggatcccgactgcctggcggaggactgtgacctgggcgtacgtctctccagtgtcggcaagaaggtcgtcgtcgcgtacgactccgacatggtgacccgggaggagacccccggcagcctgatgtcgctgctcaagcagcgcacccggtggaaccagggcttcctccaggtctaccggaagaaggactggaagcagctgccgggcttcggccagcggctgctcgcccgctacacgctcatgacgccgttcctccaggcgatctccggcgtcatcattccgctcaacgcggccgtcgcgctcttcctcgacgtgcccgtcggcatcgccttcatcaccttcctgccggccgtcaccgcgttcgtcaccttcgtgttcgaagtggtgggactgcacgacttcggcaagcagtacgggctccgtgtccgctccgtgcactacctcaagctgatcgtcggcggccccttctaccaggtgcttctcgccggcgcggccatccgcgcggtgtggcgtgagcaacgaggccgcaacgactgggagttgaccagtcatgtcggcgcgcatctcaccgaagtgatccgagaggacgttcccgcg

SEQ ID NO: 3283 - DNA, 2025 bp, Streptomyces avermitilis
  CDS (1)..(2025)
gtgaaccgactggcccatgagacgtccccgtatctgctccagcacgccgacaatcccgtcgactggtggccctggtcgcccgaggccttcgaagaggcccgcaagcggggcgtacccctcctgctgagcgtcggctacagcagctgtcactggtgtcacgtcatggcccacgagtccttcgaggacgagacgacggccgcgtatctcaacgagcacttcgtgaacgtcaaggtcgaccgcgaggagcgccccgacgttgacgctgtctacatggaggccgtacaggccgccaccgggcagggcggctggcccatgaccgtcttcctcacgccggacgccgagcccttctacttcggcacgtacttcccgcccgagccccggcacggcatgccctccttccggcaggtcctggagggcgtgcgcagtgcctggaccgaccggcgggacgaggtcgccgaggtcgccgggaagatcgtgcgggatctcgccggacgcgagatctcctacggagacagcagcaccccgggcgaggaggagctcgcgcaggccctcctcggtctcacccgcgactacgacgcccggcgcggcggcttcggcggggcgcccaagttcccgccgtccatggtcgtcgagttcctgctgcgccaccacgcccgcaccggctccgagggcgccctccagatggcgcaggacacctgcgagcgcatggcgcgcggcggcatctacgaccagctcggcggcggtttcgcccgttactccgtcgaccgtgactgggtcgtaccccacttcgagaagatgctctacgacaacgccctcctctgccgcgtctacgcccacctctggcgtgccaccggttccgaactcgctcgtcgtgtcgccctggagaccgccgacttcatggtgcgcgagctgcgtaccggcgagggcgggttcgcctccgcgctcgacgccgacagcgatgacggcagtggtcggcacgtcgagggggcgtactacgtgtggacgcccgagcagctggagcaggccctcggccgcgaggacgcggaactcgccgcccgctgcttcggggtgacgcgggacggcaccttcgaagagggtgcctccgtcctccagctcccgcagcaggacgtcgtgttcgacgcggagcggatcgcctccgtccgggcgcggctcctcgggaggcgggccgagcgtcccgcccccggccgcgacgacaaggtggtcgccgcctggaacggcctggcgatcgccgccctcgccgagaccggcgcgtacttcgaccgcccggacctggtggaggccgccatcggcgccgccgacctcctcgtacgcctgcacctggacgagcacgcccggctcgcccgcaccagcaaggacggccgggccggcgcccacgcgggcgtcctcgaggactacggggacgtcgccgagggcttcctcgccctcgcctccgtcaccggggagggggtctggctggaattcgccgggttcctgctcgatcacgtcctcgcccagttcaccgaccccgagtcgggcgccctctacgacaccgcggccgacgccgagaagctcatccgccgcccccaggaccccaccgacaacgcgaccccgtccggctggagcgcggccgccggcgccctgctgagctacgcggcccataccggcgccgagccccatcgcaccgccgccgagcgggcgttgggcgtggtgaaggcgctcggcccgcgtgctccccgcttcgtcggctgggggctcgccgtcgcggaggcgctgctcgacgggccgcgcgaggtctcggtcgtgggcccggccgacgacccggcgacagggaccctgcaccgcacggcgcttctgggcaccgcgccgggcgccgtcgtggccgtggggactcccgggagcgacgagtttccgcttctggccgaccggcccctcgtcgggggagggcccgccgcctatgtttgccgtaacttcacctgcgacgcgccgatcacggacgcggaccggctccgcacggctctgagcggc

SEQ ID NO: 3284 - DNA, 3234 bp, Streptomyces avermitilis
  CDS (1)..(3234)
gtgggcggaggagttgccgccggagggggacgtgacatgcgggacggtcatcgggcggacgccgagcggctgttggcccgggctgtggaggaggaggtgcgccggtcgggcgggcgcaccgacggggcgctgctgctgtcgcgggcgcgtggagcgctggacggcatggcgcgggcggccgcggaggagtacgaggcgtacacgcgggccctcgacgagacggaggcgggccggctgacgttcggtcagcgctacgcgcgcgagggcgccggaacgccgctgctggtggcggccgtcgcggcggtcgcggcctgcgtggcggacctgtccctcggcacgggtgcggggacggcgttcggcgccggtgcggccgtgggcgtggtgggtgccgcggcgaccgtggcgaaggtgaccgcctcgcatctgccggccgcgagccgccgggccggggcgctgggccagccgggcggcccggagcagttgcggttgcagtggctgacggcgctcgaagtacggggcatccgcccgttcctggaccagcagcgggtgatcacggccgcgacgggcgcgaagaagggtgcgccccagctgcggcgcaccgacaagagcgcggcggcacggcggcgcagcgtcctggagcagtccttcggtcaactcccggagccggacggcccgttcgcggggcggcgcgccgagctgtcgcggatcgcgcagtgggtgcaggcggcccgggcgagcacggagaccaagccgacggtggtggtgctgcacggcgcgccgggcgcggggcgtacgtcgctggcggtgcgggcggcgcacgcgctgaaggaccagttccggggcgcgtgcgtggtggatctgcgcggcgacagccccgaggagccgccgctgtccacgcgggacgcgctgctgcatctgctcaaccggctgggcgcgccgcgtgagcagctgctcttccgggatcggtcctcaccggaccagcaggtcagacggctcagcgagctgtaccaccagcatctgacggggctggcggtcacgatcgtgctggacgacgcgtcggacgcggagcaggtgcgcacgctggtgcccgagcggtcggagagtctggtcgtggtgaccgcccgcaagccgctggacctgccggccgacctgcccgcctgggtgcaccagctcccggtggaggcgctggacgcggcgggcgcggaggagctgctgaacgcggcggcgcaggacagctcgggaccgtacgacgccgagtcggcggaccggatcagggagttgtgcggcggtctgccgctggcgctgcgtatcgcgggctcctccctgggcccgcgcaccccgcggcaactggccgccgatctgggggcgtacggcccggtggagccggtggagcgctgtctgtggctgcgttacaccgaccagtcggatgtctcccggcgtctgctgcgccggctggccctggcgggccgggcgtccctgggcacggcggcggcggcctcgctgctggccacggacgagcacgaggccgcccgccatctggacgcgctcgcccgggcgggcctgatcgaccacgtccgcggcagccgctaccggctgcacgacgtcgtgcgggccttcgcgcaggcccgtctgctggacgaggaggagccggccgaccgcacggccgcgcaggaacgcctgatcgtgaactacgcggagctggcggactcggtgatccgtctggtcgacggcaagacgtcgacccgcgcggaccagttcggcccgcacggtttcacgtccctggacacggcgttgcgctggctggacgacgagtcgagcttcatcacggcggctctgcggcacgcggagggggtgaaccaggccgcggtcctgaatcttctcggcgctctgtgcgactactgcctgctgcgcggcgacctgtaccggctgggcgagatcagcgagctgacccaagccgtggaccagggcctcctggtccgttcggtgcagtggcgtacgggtatcgcggcccgtcatctgggcgagctggacaaggcccgcagcaccctgtcgtccgtcgtggacctctacttcgaggcgcaccacgacgcgggcgcggcccgtgcgctcggctccctcggcatcaccctgcaccaccagggcaatctgacggaggcggcggcgaagctgcgggaggccatggacctccaggccgcgcccgagctggcggcggaccgggcgtggacgatgcacgcgctggcggcggtggagcgggaccgggcccggctggcggaggcgctcgacctgctcacccaggccctggtgctgcaccgcgagggcgagtcggtgcacggtgaggcgtgggcccacttccagctcggtcagctggccctgcgcatgggcgacgtaccgcgcgccgacacggaactgcgggaggccctcgatcggtacgggcgtacgcgcgacgcccgcggtgaggcctgggccctgacccagctggcccgtgggcgactggtcgccggggacgcgtccgcggcggtcgacgggctgcgccaggcggtctcccgtcaccgggacaacgaggacgcgcggggtgaggcctggacggtgtactacctgggccaggccctggaggagacgggcaacctggaccaggcggtccgtgaactggagcgttcccgcacgatgttctcccggatgcgggacgtctacggtctggcgtgcgcgcggcaccattcggcccgggtgacgagagaccagcgagcggcgcagacgggctcgctccggaactcgggattcgcccgccagctcctggtcgacgcccgctcggacttccagcgcatcggcgtggcccacggcgagggctggacgtgcctggagctggcggtggtcgacgcgggcaacggccgtacccagcaggcgctgacgctgtgcgacgaggcgctggacctgttcacctcgtacggggaccggcgtggggaggactgggcccgtttcctgcgctgcacgctgctgccgtacgcggctcccggcggggtggaggtcggcacggcggtggcccaggaggacctgcgccgtctgtcccgtacctcgcacccgctccgggacaccaagctggtcgactacgtggaggcgtaccagctgctgctggagcgaggcgtgaacctggactcgggctggcaggcctggcgtctgcggatggtgccggaccggcatgcccgggaggtcatgggggtgccggtgaccgcttcccgc

SEQ ID NO: 3285 - DNA, 312 bp, Streptomyces avermitilis
  CDS (1)..(312)
atgcctgacatgagcgcaagcgcgagcctggcaatgacgcacctcgtccccctcgccaaggaggtcgaccagaacaaggtcacccccggcgtcctcggcttcatcgtcttcgcggtgatggcactggcggtgtggggcctgatgaagtcgatgaacaagcacatgaggaaggtcgacttcgaggagaagtcgcaggacggtacgccgtcctcggacgcgtcctcctccggtacgccttcctccggcccggtcgccgccggcacggccgcctccgccaaggcgcccggcgggaaggcctcgcccgccaagggc

SEQ ID NO: 3286 - DNA, 870 bp, Streptomyces avermitilis
  CDS (1)..(870)
ttgactgatcagttgcgactgatggccgtgcacgcccaccccgacgacgagtcgagcaagggcgcggccaccatggcgaagtacgtgtccgagggggtggacgtgctggtcgtgacctgcacgggcggggagcgcggctccatcctcaatccgaagctccagggcgacaagtacatcgaggagcacatccacgaggtacgcaagaaggagatggacgaggcgcgcgagatcctcggcgtcaagcaggagtggctcggcttcgtggactcgggcctcccggagggcgacccgctgcctcccctgcccgagggctgcttcgccctggaggacatcgacaaggcggccggcgagctggtgaagcagatccgctccttccgcccgcaggtgatcaccacgtacgacgagaacggtggttacccgcaccccgaccacatcatgacccaccagatctcgatggtggcgttcgacggcgcggcggacaccgagaagtacccggagtcggagtacggtccggccttccagccgcagaagctctactacaaccagggcttcaaccgcccgcgcaccgaggcgctgcaccacgcgatgctggaccgcggcctggagtcgccgtacggggagtggctgaagcgctgggacgagttccagcgtgcggagcgcacgctcaccacccacgttccctgcgcggagttctacgagatccgcgacaaggcgctgatcgcgcacgccacgcagatcgaccccgacggcggctggttcaaggtcccgatggagatccagaagaaggtctggccgaccgaggagtacgagctggccaagtccctggtcgacacctccctcccggaggacgacctctttgcgggcatccgc

SEQ ID NO: 3287 - DNA, 396 bp, Streptomyces avermitilis
  CDS (1)..(396)
atgagtacggcgagcacgcagctgcccgagggccggtacggccgctccgcggacgagcgtgccgaccacaagctcaagatcgtcggcggcatcctggccgtggccctgctcgccctgttcggctacttcgcgtaccactacgtcgtgcagaacaagatcagcggcgaagtgatcaccttcaaggcctcggacgacgtggtcaaggtgcatctggaagtgcgcaaggacgcggatgccaccggctactgcaccgtgcgctcccaggcggcggacggttccgaggtgggccgcgcggacttccgtttcaccgggcacgacacccgcatcgacaaggtcgtcacgctccgtacgaccgccctggggaccacggcggagctgctcggctgtcacgccgac

SEQ ID NO: 3288 - DNA, 495 bp, Streptomyces avermitilis
  CDS (1)..(495)
gtgacccagaccagtgagaacgtcacctggctgacccaggaggcgtacaaccagctgaaggccgagctggagtacctgtctggtcctgcgcgcacggagatcgctgccaagatcgccgccgcgcgcgaggagggggacctgcgcgagaacggcgggtaccacgcggccaaggaggagcagggcaagcaggagctccgtgtgcgccagctgacccagctcctggagaacgccaaggtcggcgaggcgccggcggcggacggtgcggtggcgcccggcatggtcgtgaccatcgccttcgacggcgacgaggacgacacgctggacttcctgctcgcctcccgcgagtacgcgagcgccgacatcgagacgtactcgccgcagtccccgctgggctccggcgtgaacggcaagaaggtcggcgaggacgcgcagtacgagctgccgaacggcaagctcgcctccgtcaagatcctcaaggccgagccctaccagggc

SEQ ID NO: 3289 - DNA, 1227 bp, Streptomyces avermitilis
  CDS (1)..(1227)
atgagctacagcacagctgactccttgcccgcggtgacgctcgacgacgtacggggcgcccagaagatgctggcgggcgtggcgcgcatgaccggcatggagggcagcaggcatctgtcccagctggtgggcgcgccggtgcacttcaagtgcgagaacctccagcggacgggttcgttcaagctgcgcggtgcgtacgtgcgaatcgcgggactgctgcccgaggagcgcgccgccggggtcgtcgccgcgagcgccgggaaccacgcacagggtgtcgccctggcgtcgtcgctgctcggcgtgcgctcgacggtgttcatgccgaaggcggccccgctgcccaagatcagcgcgacccgggagtacggcgccgaggtgcggctgcacggaacggtggtcgacgagacgctggccgccgcgcaggagtacgcggccgagacgggcgcggtgttcatccaccccttcgaccatcccgacatcatcgcaggtcagggcacggtcggcctggagatcctggagcagtgccccgaggtgcgcacgatcgtcgtcgggatcggcggcggcgggctggccgcgggcatcgcgacagccgtgaaggcgctgcgccccgatgtgcggatcgtgggcgtgcaggcggcgggcgcggccgcgtacccgccctcgctggcggccgggcgcccggtgtccgtcgagaacccggcgacgatggccgacggcatcaaggtcggccggcccggcgacgtaccgttccggatcatcggcgatctggtcgacgaggtgcggacggtgtccgagggcaacctgtccagcgcgctgctgctctgcctggagcgggccaagctggtcgtcgagccggccggcgcgagcccggtggcggcgctgctgcgggagccgggcgccttcgaggggccggtcgtcgcggtgctgtcgggcggcaatgtggaccccctgctgatgcagcggatcctgcggcacggcatggccgccgcgggccgctacctggccgtccggctgcggcttacggaccgcccgggcgccctcgcgacgctgctcggggtgctgccgacggtcgacgccaacgtcctcgacgtgagtcatgtacggaccgacccgcggctcgggctcacggaggtggaggtggagctgcacctggagaccaaggggccggaacactgcgccgaggtggagcaggcgctgcgcgaggcgggctacacggtcatcgac

SEQ ID NO: 3290 - DNA, 498 bp, Streptomyces avermitilis
  CDS (1)..(498)
atggacatgacgaccgtcggtgaacccggtcttctcgacactctgcagcacgaggtcgcggtgttcgcgcgtcgtgccgaacagacccggctcggcggggtggggcaggtgcgcaactccatggaccgtgccgcgtatctgctgctcaaccgcctcgacaaggaaggtccgatgggggtgaaggccctcgccgcgagcatggggatcgactcgtcgacggtcacccggcaggtggcgccgctcgtcgacaccggcctcgtcaagcggacctcgcacccggaggacgggcgcgccgtggtgctccagctgtccccgcgcggcatgtcccggctggaggaagtgcgctcctcgaggcgtcagttgatgtccgagctgacacacgactgggcgccgcaggagcgcgaggcgttcaccgcgctcctcacgcgcttcaacaccgcgctctcggaccgcatgtccaccccggggatgccgaccggggactcccagcccgcttcc

SEQ ID NO: 3291 - DNA, 498 bp, Streptomyces avermitilis
  CDS (1)..(498)
gtgcgagaacggcatgcgtcccaaggcgcccgccgagcccgggagttcgaggcgttcgtcgcgggcgcggcagggcggctgctgcacgccgccacgctgctcacggcggagccgccgggcgccaacccacgcgcgcggcgcctgctgacgctggccctctcccacacgtacgcctcctgggaccggctgcgcggcgaggacccgtacgaccggacccgccagtacctggccgtccgcttcgcgcgcggggcatggcaccagtacggcgggctcggccggtcgcggccgtccccggacagtgtgctggcccggctgacgccccaggaacggctgatcctcgtcctgcggatgtacgagggggtcgccgaggagcagacggcggcgctgctcgggctgcccgccgaacgcgtgggggcgatctgcgcccgtgcgacggcgacgctgctgcatccgccgcggggaccggcacccgccgacgtcatggaggtggccccgtcg

SEQ ID NO: 3292 - DNA, 1152 bp, Streptomyces avermitilis
  CDS (1)..(1152)
atgagcgacaggcacatcagtcagcacttcgagaccctcgcgatccacgcgggcaacaccgccgatcccctgaccggcgcggtcgtcccgccgatctaccaggtctcgacctacaaacaggacggcgtcggggggctgcgcggcggctacgagtacagccgcagcgccaaccccaccaggaccgccctggaagagaacctcgccgccctcgagggcggccgccgcggcctcgcgttcgcgtccggactggcggccgaggactgcctgttgcgtacgctgctcagccccggcgatcacgtggtcatccccaacgacgcgtacggcggaacgttccgtctcttcgcgaaggtcgtctcccggtggggcgtggagtggtcggtcgccgacaccagcgaccccgaggccgtccgggccgcgatcaccccgaagaccaaggccatctgggtggagaccccgtccaacccgctcctcggcatcaccgacatccccgcgatcgcccagatcgcgcgcgaggccggcgccaagctggtcgtcgacaacaccttcgccaccccctacctccagcagccgctcgcgctcggcgcggacgtcgtcgtgcactcgctgaccaagtacatgggcggccactcggacgtcgtcggcggtgcgctcgtggtgagtgaccaggagctgggcgaggagctcgcctaccaccagaacgcgatgggcgcggtcgccgggcccttcgactcctggctggtactgcgcggcaccaagacgctctccgtgcgcatggaccggcacagcgagaacgccaccaaggtcacggagatgctcacccggcacgcgcgcgtgacgcgcgttctgtacccgggcctgccggagcaccccggtcacgagatcgccgccaagcaaatgcgggcgttcggcggcatggtctccttccaggtcgagggcggcgaggaggcggccgtcgaggtctgcaaccgcgccaaggtcttcaccctcggcgagtccctgggcggcgtcgagtccctgatcgagcaccccgggcggatgacgcacgcgtccgcggccggctccgcgctcgaggtccccgccgacctcgtacgcctctccgtgggcatcgagaacgtcgacgacctgcttcaggacctccagcaggccctgggc

SEQ ID NO: 3293 - DNA, 1116 bp, Streptomyces avermitilis
  CDS (1)..(1116)
atggagattctctgggtcctgatggcgctggccatgatgagcatggttctgctgccggtcctcatgcgcaggcgggccggtattcagcaggtcgcgccgggcgacccggacgccgcggacccggcgaactacggcttcctgcggcaggaggagctggacatccgcatgcccggcccggacgaggacctgctggacgtcctggatgtggtgcagcggacccaggaccaccgggcggcgtcccagctgctggccggcacggagacggcggacgagacacgctggcagcgggtgcaggccttcgcgggcgcggcctcgctggagttgcagcagcaccccggcggggtgagcgagacgcccggcgggcagtggctgcgggtgtggcgggccgaggcgccgaaggacgcgggcggcgcggcggtgcacgcggagttcctggtgcagcaggcctggcggacctcgacgccggggacggacgagttccggatcatcatggaggaggcgaaggtcgcgtgcggggaggcggcgctgctggcccccggtgacccgatcccgtacatcgtcgagctgtcgatcgcgcgcgggctggcctacccgcaggcggagttcgagaagctgtggctcaagatcctggaccgcgcgcccgagcacatgggagcgcatctggccgcgctgcactactggtgcgagaagtggcacggctcgcgggaggtggcgtactccttcgcggaggcggccgccgctcgcgccccccggggttccctgctcgccgcgatgcccctcttcgcggtcttcgagcacctccccgaggtgaacctggtcagcagcttctaccagagcgaggtcgtgacgaaggcggtgcacggcgcgctctacgcggtgcactcagcccgtcccgacgacccgatgctggcgcatgtgcgccacctcctggtgttcttcctggtccgcggcgagcgctggtcggaggcgatgaaccagctggtgcacgtcgacggacacgtcggcgcactcccctggaccctcacgtccgacccggcgtcggactacgcgatataccgggcactggcggtggcggggtacgaggcgaacgggggaagcccggcgacgctgccgcac

SEQ ID NO: 3294 - DNA, 510 bp, Streptomyces avermitilis
  CDS (1)..(510)
atggctgcgcagacgcaaagggccgtcctggcgggtggatgcttctgggggatggaggacctgatccgccggctcccgggcgtgacggcgacccgggtcggatacaccggcggggacgtgccgaacgcgacgtaccgaaaccatggcacgcacgcggaggccattgagatccttttcgaccccgcgaggaccgatttccgcgcgatcctggagttcttcttccagatccacgacccgagcaccaagaaccgccagggcaacgacatcggcctcagctaccgctcggcgatctactacgtggacgacgagcagaagcggatcgccgaggacacgatcgcggatgtggacgcctccggactgtggccgggcaaggtcgtcaccgaggtagagccggtcggccccttctgggaggccgagcccgagcatcaggactacctggagcgttacccggacggctacacctgccactttccgcgcccgggatggcggctgcccgcccgcgcggagggc

SEQ ID NO: 3295 - DNA, 591 bp, Streptomyces avermitilis
  CDS (1)..(591)
atggaagaaacccagcgcaggatccgggcggtccacacaacatccacgatcaccgtctaccaggcttactccccggaaatcggcctgcctgcggtccgagagggccggttccccacggcgtggaagcgggaccggatgacgtggatcaagccgtcgttcctgtggatgatgtaccgctgcggctggggcgcgaaagcaggtcaggagaccgtcctggccgttgagatcacccgagacggtttcgagtgggccttgcgccacgcgtgcctgtcgagctatgtccgcggtgtgcaccccgaccgcgccacctggcagcgtcagctgaagcacgcacccactcgcatccagtgggaccccgagcgcgacctgcaccttcaagccctgccgtaccgctccctgcaactcggcctggccggtgaagccgcacgacgctacgcggacgaatggacggtcagcatcagcgacgtgaccccactcgcccgcgagatccgcacgctcgtcggcaacggcgacctcgactcggccgcacggctactgccgcaggagcttccctaccttcccgcagacgaactgccggcccacctgcgtccg

SEQ ID NO: 3296 - DNA, 2058 bp, Streptomyces avermitilis
  CDS (1)..(2058)
atgagtcgtcgctctactggtttggtcggcgtgtgggccgaggtgcaacggcagcagcagcgccagatggaagccgaggccagacagcggagacaagaagctcagcaagcacgggcctaccagcggcgagctgcccagagccaccgcgagtacaggcaggcggaggcgctacggcgcacggaggaactggacgcacaggtcgcgtcgctgcaaggccttctcgctgcgggttgtcaggctccggctttcagggcttcctcgctcatgcgacccgaggaggtccagcccttcgccccaggaccgttggcgcagcccgtgcccatgccggatttccatcagtaccaaacgcaaagtggttggaccgcgagtcgccgtgctcaggcgcagaccgaagcgcgggcgcgcttcgagcgggactggcacgccgcccaggccgcagaggcccacagacagcagcagctggcgtcgtaccagcgggagtaccagcagtgggccgatgctcagctggccgaggtacgtgcgcacaacgccggcgtcgtcgcggtgaccgaaggcgtgcggcgtagagatcccgactccgtggtcgagtacttctccgccgctctctacgcctcaacggcgtggcccgaaggtttcccacgtcaggttgcggcggcctacgactcagcagcccggcagctggttctcgattgggagttgcctgcctacggcatcgttccagaggtcaagtccgttcggtacatgtccggggtcgatcaggacaaggagaccccccgtccggcaggccaacgtcgagctctgtaccgggaggttctcgcgcagtgcctgctgctcgtgctgcacgaactcttcgccgcagatgagctgggcgcgcttgagtccgtggccctgaacgggttcgtggacggacacgaccctacgacgggccggcccggccatatcttcctcgcgacggtcatgtccccgcgctcttcgttccgtgacctgcacctggcacaggtggacgcgggcagttgcctgtctgacgcactgcgagggcagctctcggcccggccggaccaactcacaccggtacggccgagccggcggccgcaagacgtcgggaaccgcgtcgtcgctcacggcagcgatgaggaaccggacctgtacgacatggatccgatcgccttcgagaaccttgtcgccgagctcttccgggccatgggaatgcaggcggtgacgacccaacgctcaaacgatggcggcgtggacgtcgacgcgctggatccggcaccgatccgaggcggcaagatcgtcgtgcaggtcaagcgctaccgcaacacggtgcccccgaccgccgtacgcgatttgtacgggaccgtgcaggacgccggtgccaacaagggtgtcctcgtcacgacgtcagggttcggccctggctcacacacgttcgccaacggcaagccgctggaactggtctcgggctccgagctcgtcgacctgctgcacagacatgggctgcgcgggcgactgggagagggtggtcgtcaagccgcggcgcagccgacaccgtcggatccgaacactcggctgcccgacgactacaacgtgctgggcatgtcgtggaccggaagcgtggccctggacgtgtgtgcacttgtctgccgtggcaaccgcgtcctcagcgacgatcacttcgtcttcttcaacaacccgcagactccggacggctcagtgcgcgctcttccggccgctgcgccggacaaggccgcgatctgcgtctcgttcgacgggttgccgtcggaggctgatcggctcgtactcgtggccgccatcgacccggaggtcaacgcggacgccgatctctccggcttcacggatgcctgcatccggctgctcgatcccggtatggccgaggtgggacggcttgaggtctctgacggccgaatccgtgagagggccttggtgctcgggtccttccgccgaaggtccaacggggactgggacttcgtactcggcggcaagggctacccgggcggtctggaggaactcgtccaggatttcggcatcgtggtggcg

SEQ ID NO: 3297 - DNA, 756 bp, Streptomyces avermitilis
  CDS (1)..(756)
ttgggggctttcatgcccgaaccggcgggcgccggctcatcgatccggcccgcgggcggtacgggagcggagcggagtgtggatcatggtggggtgatgaagtggagcgagaaggcagcgtcatctgggcggggcgacggcgagacggggctcaccggctatcaacaggatctgcgggaccggtttctggcggctcccgtgcttcccgcgcctgagccctggcggccggtcttcaagcccttcgccgctgtcggcggacttctcgggatcggtttcgcgtcgcaccccgacaacggcaacgacctggtgatggtcgtctcgcaggccgggcatggcctcttcgacgccgtcacaggggagaagatcgcccgcgaccgggaccccgaccccgaggacagcacccccgatgccgtggccgatctgtcgtgcccagggctggggccgatcgccggcagcagggtgcgtatcgccgggctcttcggtggcgggctccacaccggcaccgaagacggctgggtggtggaggtcgtcagcccggcctggccgcatgaccgcgtcctgctctcccgcggcagcgggatgcctcaccgcggtccgcacggggagaagtggtggcacatcttccactccaactactccgaactccgagccgccggcttctccccgtccgggcaaaccctcgccgtcgccacgagcagcgatgtgactctgtggacacgccgcaccgctcacaccccgggcggccccgcccggcgt

SEQ ID NO: 3298 - DNA, 1185 bp, Streptomyces avermitilis
  CDS (1)..(1185)
gtgcaagccgtcttactggggtccgtacttttggtgtgtctggccgcgccgctggtcggagcgtcgcagcggccgcggttgccgtcgaggcggtgcacgcccgagcgttcggcgcacgcgccgttcgcggtggcgttcggctgctggctcgtgccggtgccgatggccctgttgctggaggacggccgcgccgatctgatgcacagctggtgggccgtggccatgctcatggccagtccggtcgtcgccttcgccctggtccgcatggtggcgccccagcggctgaaacgaaggcggctgcttctggcggcgcgcgcggcagccctcatggccgccgtggtggccgtcgagatggcggcgctcgacgcaggggttccgtcgctgtccgtcgtcggaccgctgttgacggtctcgttcgcggcgacggcgacggtgctgggcgtcctacgggtcgtggaccacggctatttcccgctggtgctgttgcggacggcagcgaagcaggcactcgtggccggcggaacctggtactggatgcaccgcaccggcgccaccctcacccccgatccggcggactccaccaccacggcccaggtgctggccctgctgtggtggtcggtggtggcgctgtccagtggatgtgcgctggtcgcggtcgcccggctggtgcgctggctgcgatccggtccaccggctcggcccgcgccacccggtgtggctccctggccgcccgcggtgggcgacgtatggatggccgagctcacccacgacgacaacacctacaaggagcgccccgtcgtggtgctcgaacacacgcccggcttcgtccgcgtgctcggcatcaccagcgtcgacaagtccgacaggcggcgcggctatctgaagctccacatgtccgagtggaagggagtgctgaccaaggacggctggctgaatctggagatcgcgcaggttccgtactgcgacttcctgtggcggcgcggggagtgcccggacccggtgtgggacgcgctgtgcacgaaggcggcggtccgggagcgtcccgcgggccgggggccgacccccggattcaccttccgacaccggctgtggtcggcgatgaacgcgcacgcgggccgtgactcacgcaacgtccacgccggttccgacaaccggcggcgccgggtctggacgcgggcaaaggtg

SEQ ID NO: 3299 - DNA, 876 bp, Streptomyces avermitilis
  CDS (1)..(876)
ttgccgtcatgcgtgcctccatgggatgagccgggggatgagcaaggaaatgatcttgacctggaggggacgtacgacatgcacacgtatctgatcggtggcgggtgggacgagcggggcgccgaggccgtctacggccccttcctggaggccgctgggcagcgggcgggcaggcagcgggcggcgggtgacgccgcggtcgtcggctgccttctcgtcgacgagggcgacggggccgggcagttcgcccggtacgaggccgtgctgcggaaggtcgccgactgtgcgccggtgccgctgctggtgcccctgggtgagcggttcgacgtgggtgcgctcgggcgcgtcgacgccctgttggtgtgcggcgggctgacgcccgcctatcaggacgcgttggcggaggtcctcggccggctgccccgggtgctcgccgaacgcgggatcccgtacgccgggttctccgcgggggccgccgtcgccgcgcggcgggcggtcgtcggcgggtggctcgccggtggtgttccggtctgccccgaggacaccggggaggacctggacgagatcgaggtgcgggaagggctcgggctcgtcccgttcggggtcgacgtgcatgccgcgcagtgggggacgctgccccggctgatcgccgccgtggcggacggacgggtccctcacggtgtggcgatcgacgagaacaccctgctgaccgtcgacggccggacggcacgcgtctccggcctcgggcgcgtgcacacggtacgacccgggaccgacagcgggaccggcaccagggccgacggcggaaacggcgacgggaccggcggtgacgtgctcgtacggtcgtacgcggccggggagtccttcgccgccgac

SEQ ID NO: 3300 - DNA, 834 bp, Streptomyces avermitilis
  CDS (1)..(834)
gtggcgcacaccatcgtgctgggcgctctggtcggcgccgctctcgggctgtccggggcgctcgtgcagagcgtcacccgcaatccgctcgccagtccggacgtcatcggcgtcggacacggcgccgccgccgcgaccgtactggccctggcgaccggaaccgtcgcctcgcccggcgcccttccggcggtgtccgtcgcgggcgggctcggggccgcggcgctcgtgtacgtcctcgcctggcgccacggcatgcagccgacccggttcgtgctgacgggcgtcggcatcggcgtcgccctctccgcggtcgtccagctctatctgaccgagagcgaactcaccgccgccgaacaggtcaagctgtggctgacgggcagtctcaacggacgcggctggacgcaggccaccccgctcgcctgggtgctgctgctgagtctgcccgccctggtgcgggcgagtagggccctgcgcccgctcgggctcgacgccgacaccgcgtccgcgctcggtgtgcgcgtgcagcggacccggctcgggctgacggtcctcggcgtggttctcgccgcgacggcgaccggcgcggccggcccgatcggcttcgtcgcgctcaccgcaccgcagctggcccggcgcctctcgcgtacccctcaactcccgctggcgggctccgcgtcgaccggcgcgatcatcgtggtcgccgccgatctggtggcccgtacggcgctgccgccgctggagatcccggtcggcgccctcacctccctggtcggggggccgtatctgctctggctgctggggcgggaacccggcaggggtgcccgcgcctctcgg

SEQ ID NO: 3301 - DNA, 1041 bp, Streptomyces avermitilis
  CDS (1)..(1041)
atgaccaccactgttgccgcgtacgccgccccggccgccaaggctcccctggagcgcaccaccatcgagcggcgtgaggtcggcgagttcgacgtcctgatcgacatcaagttcgccggtatctgccactcggacatccaccaggcccgcgacggctggggcgagggcatattcccgatggttccgggccacgagatcgccggcatcgtcgccgaggtcggctccggcgtcaccaagttccaggtcggcgaccgggtgggcgtcggctgcatggtcgactcctgccgcgagtgcgagaactgcaaggcgggcctggagcagtactgcgtcgggggcaacgtcggcacgtacaacgccctcgacaagaacggtgagcccacctacggcggctactccgagaaggtcgtcgtcgacgagaactacaccgtccgcatcccggacggcctcgccctcgacgtggccgccccgctgctctgcgccggcatcaccacgtactccccgctcaagcactggaacgcgggccccggcaagaaggtcgccgtgctcggcatgggcggcctcggccacatgggcgtcaagatcgcgcacgcgctcggcgccgaggtgaccgtgctgtcccagtcgctgcgcaagaaggacgacgggctgaagctgggcgccgaccactactacgccaccagcgacccgaagaccttcgaggagctggcgggcacgttcgacatcatcctgtcgacggtctcggcgccgctggacttcggcgcgttcctgtcgctgctgaggacggacggcgccctggtgaacgtcggcgcccccgaggagccgatctccatcaacctcttctcggtgatcgccggccgcaagaccctcgcgggctccggcatcggcggcatccaggagacccaggagatgctggacttctgcgccgagcacggcctcggtgcggagatcgagctgatcagcgcgtccgagatcaacgacgcgtacgagcgggtgctgaacagcgacgtgcggtaccgcttcgtgatcgacaccgcgacgatc

SEQ ID NO: 3302 - DNA, 909 bp, Streptomyces avermitilis
  CDS (1)..(909)
atggacgaacagcccgaacccgtacagggggccggacagccgctggaccggcgtgccgagctcagcgagtttctgcgcacccgccgggcccggctgaagcccgaggacgtgggcctgccggacttcgggcggcaccgccgggtgccggggctgcgccgcgaggagctggcgcagctggccggggtgtccgtcgcgtactacacccgcctcgagcaaggcaacggacggaacgtgtccgcggaggtactcgacgcgatcgcccgcgcgctgcggctgacgaacgccgagcacgcgcacctcacgcatctggcgaagccgaaggcgcacaagaagaagcagacggcgcggccgcagcaggtgcggggcgcgctgcggcagctgctcgacacgctggacggcgtgcccgcgtacatctccgggcagcgctcggacgtcctcgcctggaaccggatggccgcggccctcttcggtgactgggcggagctgccgccgcaggagcggaactgggcgcggatggtgttcctgaagcccgagtaccgtgatctgttcgtggactgggagcagaaggcgatcgacatcgtctgccttctgcgcatggacgcgggctgtcaccccgacgacccgcggctctcggccctggtcggcgagctctccgtgaagagcgaggacttccgccggctgtgggccacgcacgacgtgaaggagaagacccacggcgtgaagctgctgcggcatccgctggtgggtgacctggcgctgcagttcgagtcgttccggctgcccgatgacggtgagcaggcgctgatcacgtaccacgcggagccggggtccgcctcggcggaggcgctgcgcctgctggcgagctgggggacggacgcgacgcgggcgggtacgacggcgcctcagccg

SEQ ID NO: 3303 - DNA, 780 bp, Streptomyces avermitilis
  CDS (1)..(780)
ttgtgtggggacatgaccgttcacactgtcgaatacatccggtaccggatccccgagcagcagtcggcggagttcctcgccgcctacacccgcgccgccgcccagctcgcggcggccccgcagtgcgtcgactacgagctggcccgctgcgaggaggacttcgagcacttcgtcctgcgcatcacctggacctcgaccgaggaccacatcgagggcttccggaagtcggagctgttccccgacttcctcgccgagatccggccgtacatcagcagcatcgaggagatgcgccactacaagccgacgacggtacgcggcacgggcgcggccgtgccgacgctctacgcctgggcgggcggggccgaagccttcgcgcgcctgaccgaggtgttctacgagaaggtgctcaaggacgacgtcctcgcgccggtgttcgaggggatggcgcccgagcacgccgcgcatgtcgccctctggctcggcgaggtcttcggcggcccggcggcctactccgagacacagggcggccacggacacatggtcgccaagcacctcggcaagaacatcaccgaggtgcagcgccgccgctgggtcaacctgctccaggacgccgcggacgacgcgggcctgcccacggacgccgagttccgctcggccttcctggcctacgcggagtggggcacgcggctcgccgtgtacttctccggccccgacgcggtgcctccggccgagcagccggtgccccagtggtcgtggggggcgatgccgccgtatcagccg

SEQ ID NO: 3304 - DNA, 267 bp, Streptomyces avermitilis
  CDS (1)..(267)
atgctgtacaccactgcctacaagggcggccgcgacgcggcggcctggcagcgttacgcggagttcgacaacgccgccggcgtcgacgaagtggtcgaaaacctggacaccaccctttccacctgcggtttcaagcccgtgggcaaggccgcggacacgcacttcgcgggcgccagcgaggacggccgacgggtacgcgtcaccgtcgagcacggcaagcggtggatctacgtgtccgaggtggaggacggccggcccggcggcgac

SEQ ID NO: 3305 - DNA, 576 bp, Streptomyces avermitilis
  CDS (1)..(576)
gtgaccacgaagacgaacgaagacgaacgaagacgaacacggaacgggaaacggggacagatgtcggcgcagtcggaggacttcgacgcgttctacaccgccacgcacaaacggatggtcgccacggtctacgcgatgaccggagatctggtggaggccgaagacgcggtgcaggaggcgtacgtacgggcgtggcagagatgggacaggctgacgcgggacgacggggatccgctgccgtgggtgcggaccgtcgcgatgcggctggcgatcagcacgtggcgcaggacgcggggccgcctgctcgcccacttccggcacggcccggacgcggacgtgcccgaactgtccgccgaccgcgtggcgttgctgaacgccctgcgcgaactgaacccggaccagcgccaagtggtgatcctgcaccacctcctcgacctgcccgtggagcaggtcgcgcgcgagaccggcgcctcaagcggcgcggtccgcacccggctgagccgggcccgcaaggccctcggcgagcgcctcgccgagcccaccgtcttcaccaccgagggagtggtccggcatggc

SEQ ID NO: 3306 - DNA, 3417 bp, Streptomyces avermitilis
  CDS (1)..(3417)
ttgcttacgccggggggtgacgtacatgtgtgcgctatttccctcggacgggtgaacggggattcgcccgatacttcatctccagggggagacttgcgcagacaagtgaagagagcatgcgcggccaccgtcgccacggcggccgctgtggttctggcggcgggcatgaccaccccggcgtcggccaagcccgaagtcgcgtcgagcggcaccaccacatcggccggtttctcggccaagcaccgcgtcaccctgatcaccggcgaccgtgtcgtcgtcgacgccaagggccgggttgtcggcctcgagcgggcgaaggggcgcgagcacatacccgtctcggtgcgcaaggccgacggccacaccctcgtggtgccggccgacgcggcccgcatgatcgccaccggcaagctcgaccagcggctcttcgacgtcaccgagttgaaccggtccgcgacccgcaaggcccagaagcagggcctgaaggtgatcgtgggctacaagggcacggcgagcgccgccaagtccgacgtgcgcgacgcgggcacgctccggcgcagcctcaagtcgctgaacgcggacgccgtacagacgcccaggacggacaccgccgagctgtgggacgcggtcaccaacggtgacgcgaccgcctccggcgtcgcgcacgtctggctcgacggcacccgcaaggccagcctcgacaagtccgtgccgcagatcggcgcccccacggcgtgggcggccgggtacgacggcaagggcgtcaagatcgccgtcctggacaccggtgtcgacgcgacccacccggacctcaaggaccaggtggccgagtccaagaacttctccgccgccgccgacgccgccgaccacttcggtcacggcacgcacgtcgcgtccatcgcggcgggcaccggcgccaagtccaacggcaagtacaagggtgtcgcgccgggcgcgacgatcctcaacggcaaggtcctcgacgacaccggctccggcgacgactccggcatcctggccggcatggagtgggcggccgagcagggcgccgacgtcgtcaacctgagcctgggcggcggcgacacccccgagatcgacccgctggaagcggaggtcaacaagctctccgaggagaagggcatcctcttcgcgatcgccgccggcaacgaaggcgagttcggcgagcagaccatcggctccccgggcagcgcggccgacgcgctcaccgtcggcgccgtgaacgacagcgacaagctggcgtccttctccagccgcggccccggcctggacggcgccatcaagcccgacgtcaccgcacccggcgtggacatcaccgccgccgcggcgccgggcagcgtcatcgaccaggaggtcggccagaagccggacggctacctcaccatctccggtacgtcgatggcgaccccgcatgtcgcgggcgccgccgcgatcctcaagcagcagcaccccaactggtcgttcgccgagctcaagggcgcgctgaccggctccgcgaagggcggcaagtacacgccgttccagcagggctcgggccgtatcgccgtcgacaaggcgatcaagcagtccgtgatcgccaacccgaactcggtgagcttcggcatccagcagtggccgcacaccgacgacaagccggtcacccagcagctcacctaccgcaacctcggcacgagtgacgtcacgctgaacctcgcgtcgacggcgaccaaccccaagggcgtcgccgctccgtcgggcttcttcaagctcggcgcgacgaaggtcacggtcccggcgggcggcaaggcctcggtcgacttcacggtcaacacgaagctgggcggcaccacggacggcgcgtactcggcgtacgtgacggccacgggcggcggccagaccgtgcgcacggcggccgcggtgcagcgcgaggtggagtcgtacgacgtcacgctcaagcacatcgaccgtgacggcaagccggccgtgaactacagcaccgacctgacgggcgtctcgggcctcgccgcggacaagtggttcgccccgtacgacgcctccgggacggtcaaggtccgtgtccccaagggcaacttcatcctgaacgccagcctcttcgcggacccggaggacttcaccaagggtgccgactggatcgcccagcccaagctgagcgtcaccaagaacaccacggtcaccgtcgacgcccgcaaggcgaagccggtggacatcaccgtgcccgacaagggcgccaagtcggccttcgcgtcgccggactacacggtcgaggccggcaacaacagctactcgtacggctggtggctggacacgtacgacaacttccgcaccgcgcacctcggcccgaaggtcaccgacggctccctgtcccagcagtgggaggggcactggaccaagggtgacgacgaggagtacgacaccaccgccagggccaaggtcacgcagctcgccaccggctacagcaagcactacaaggcgagcgagctggccacggtgaaggccggcctgggctcctccgtcaccggcaagaagggcgcgatcacggcctggggctggctgcccggcagctccggcgcctccgcgatcggcatccagcagacgctccccggcacccggacgctgcacctgtccacctcgggcggggtccgctggaccttcgagttcgagcagaccggcgggctcgacgccgacggcttcccgatcgccgaggcgtactactcgaccggcgactcgcagaagctcaccggcggcaagacctacgcgaagacgttcaacacggccgtgttcgggccgcgtaccggcggtgacttcagcctctaccgtgacggcaaccagatctacggctacgtgccgctgttcgccgacggcaagacgcacaccggttcgtcgaccttcagctcggtcaccacgaccctctaccgcaacggtacgaaggtcggctcgaacgacgacccgctgttcggcgagaagtacttcaaggtgccggccggttcggcgtcgtacaagctgacgacgtccgtgaagcgtgccgccaccgtcgcgaccgcgtcctcgcggatcgacgccagctggaccttcaagtccaagaaggcctccttcacgaagctgccgacgtcctcggcccgcttcgccgcgacgaccggcctggacagccgcgtcaccgccgacaagaaggtctcggtcccggtgaccgtccagggtgcggcagcgggcaagaacctcaagtcgctggcggtgtacgtgtcgtacgacggtggcaagaactggacgaagaccaccgtcaagaacggcaagatcagcgtcaagaacccggcgaaggacaagtccatctccttccgggccaagatcgccgacaagaagggcaacacgtcgacgatctcgatctacgacgcgtactacggtaag

SEQ ID NO: 3307 - DNA, 681 bp, Streptomyces avermitilis
  CDS (1)..(681)
atgtacgaactcagaggcgtcagcaagcgctatacgcggggcaaggacaccatcaacgccctcgacggcatcgacctgaccatcggcgacggcgaccggctcgtcatccagggccccaccggcggcggcaagtccaccctgctccagatgctcggcgggctcgacaagcccaccgcgggcagcatcgaactcgacggcaccgacctcgccaggctctccgaggccaagctcaccaaggtgcgcagcgagaacatcggcttcgtcttccagagcttcaacctcatcccgacgctcaccgcgcaggagaacgtcgagaccgccctcgtccccctcggggtgaaggtgaaggaccgccgggaacgggccgccgaggccctgaagtcggtgggtctgggggagcggctcggccatctgcccgccgagatgtcgggtggtcagcagcagcgcgtcgccatcgcccgcgcgctggtgaagcagcccaaggtgctgctcgccgacgaacccaccggcaacctcgacgagtcgatgcgcgacgagatcatggaggtgctggagaccatgtggaaggagtacgggctcactttcatcatggtcacccacgattcgtccctcgcgaagaaggccccgcgggtcgcgacgatccgcaaggggaagatcactgtcaaggagaacgcgggggcg

SEQ ID NO: 3308 - DNA, 1470 bp, Streptomyces avermitilis
  CDS (1)..(1470)
atgttcttcacctacctgaggcgcgaactgcgccgccgcagaaaggcggccctcgtcgtcgcctccggcctagcgctgggcatcgcactggtcatcgtggtcaactccgtgtcctccggcatggggaaggcacaggacaaggtccttcagtcgctctacggcctcggtacggacatgaccgtcaccaaggcggccagtgcctcggccgcgagctcccagcgcccccgcttcaacttcgacgcccgcggcgacgactccgacgcggagcagagcagcgaccgtgtcatggtccagggcttccagaccctggcgaccacgaccgtcggcaaggtcggcgcgcagcacggcgtgtccgacgccgtcggcggtctgagcctccaggtcgtcaaggtcagcggccagttcaagcagggccagttccagcaggaccagaacgccggcggcaatcagcagggtggccgcccgaacgcccaggcgtccccgcagggccgcgtcgagggcggcggcgccaacttcggcgtcaacagctactccgtctacggcaccgacgtcaccgagcccgccctcggcccgctgacctcctcgaagatcaccagcggccgtaccttcacgtcgtccgagacgaacgccaaggtcgtcgtcgccgacaagtcgtacgccaaggagcagaagctcgtcctcggtgacaccgtcaccatcaagagcgtcaagttcaaggtcatcggcatcgccacacccgacagcggcgacgcggcggcgaacctctacatcccgctcaagcgggcgcagacgctcggcgacgccaagaacaaggtcaccacgatctacgtcaaggcgtcggactcgcagcagatcgacgtcgtcaagtcgacgatccagaagaacatctcggggacgacggtcaccacctccgccgacctcgccaagaccgtctccggttccctgtccaccgcctccggcctcgccaagaacgtcggaaagtggctgtcgatcgcggtgctcgtggccgcgttcctggtcgcgggtctgctcacctcctccgccgtctcccgccgcgtgcgcgagttcggcaccctcaaggcgctcggctggaagtccggccgcgtgacccgccaggtcgtcggcgaggccatggtcaacggactggtcggcggcgccctcggtatcgccctcggcctcggcggcgcgtatgtcgtcaccgcgatcagcccgaccctccaggccgacatcggctccaccggcggcaacgcgggcggtcccggcggtggcggccccggcggtggcggcttcggcgggcccggccggcagacggcttccaaggcgctggaggtggcgctgaccgcgccggtcagcctgtccaccatcgtgatcgccgtcgccctggccgtcaccggcggtctggtcgcgggtgccttcggcggctggcgggcctcccggctgcgtcccgcggacgccctgcgccgcgtcgaa

SEQ ID NO: 3309 - DNA, 1248 bp, Streptomyces avermitilis
  CDS (1)..(1248)
atgacggacagtaaccgacgcaagggcctgagggctgcgtccgtactgctcggcggggtgctggtgctctctgcgtgcagcggaggcgacagcgaggccagtagcggcggtggcgactccacctcgcaggccaaggtcgacgaggctgccgccaagaaggcctccgaggcccagatcaagatcacgcccaaggacggctccgacaacgcctccatcaacaacgcggccaaggtcaccgtgagcaagggcacgctcacggacgtcaccatgaagaccgcggcgggcaccgccgtcgccggccggatatcggccgacaagaagagctggtcgcccaccggtcagctggagcggtcgacctcgtacaagatcaccgccacggcggacgactccgcgggccgcaccgcccacgagaacgcgtcgttcacgacggtctccccggccaacagcttcatcggcaacttcacgccggaggacggctccaccgtcggcgtcggcatgccggtctcgatcaacttcgacaaggcgatcaccgacaaggccgccgtgcagaaggggatcaccgtctcctccagcagcggtcaggaggtcgtcgggcactggttcagcgccaaccgcctggacttccgccccgaggactactggaagggcggctccaccgtcaccctgaagctgaacctcgacggggtcgagggcgcgaacggtgtgtacggcgtccagcagaagacggtcaccttcaaggtcggccgcaaccaggtctccgtcgtcgacgcccggaccaagaccatgaaggtcacgcgggacggcaagaccgtcaagaccatcccgatctccgcgggcggtcctgacaacaagacctaccagggccagatggtgatctccgagaagttcaaggagacccggatggacggctcgacggtcggcttcacgaagaaggacggcaagggcgagtacgacatcaaggacgtgccgcacgccatgcgcctgtcgaactccggcacgttcatccacggcaactactggggcgccaagtccatcttcggcgcggtgaacacgagccacggctgtgtcggcctgtccgacacgaagggtgcgggcgacccgaacacccccgccgcgtggttctacaacaacacgctgatcggtgacgtcgtggtcgtcaagaacaccggcgacaagacggtcgccccggacaacggcctcaacggctggaacctcggctgggccgcgtggaaggcgggttccgcggcc

SEQ ID NO: 3310 - DNA, 291 bp, Streptomyces avermitilis
  CDS (1)..(291)
gtggagatcggcgacgcggacgccgtgaccaaggccgccctggagcgcatcgcggatgacccggacatgccggacgacgagcgcgggcactccgagagcgccgtgacggaagacactgccgaagccctcgcgtatctcgtcgacccgttcgacctggtcagcgaggtgccgggggtcgaactcgcccaggcctcctggagcagcgagcagatctcctacgatcccgattcgccggaatgggacctcggcgaggatgatggcgcggaggacgacgaggaagacgtgctcggc

SEQ ID NO: 3311 - DNA, 342 bp, Streptomyces avermitilis
  CDS (1)..(342)
gtgtccgccgcacaccgatggtcgtccaccgcacgccgatccacgctgaccgccaccgccgcgggaaccctcctgtgcgccctgtggttcgtcccgtccgccaacgcgacccaggacacgtccgggcagcagcagacgtcgacgacggtcacacagacctccacgaacacggactcggactcggactccggtgcggggaccgattcgacgtccctggacgcccaactcgccgacaccggaagcatcgacaccaccccgtacctggtgggcggcaccctcttcctcggcctgggcgcgggcttcgtggcgtattcggtacgacgggaacgcatgacggcgtac

SEQ ID NO: 3312 - DNA, 1542 bp, Streptomyces avermitilis
  CDS (1)..(1542)
atggatatgcacactgtggtggtggggacgtccggggtgaccgcgtccgacgttctcgccgtggcgcgtggcggcgcccggatcgagctctccggggaggcggtgaccgccctcgccgcggcccgcggcatcgtggacgcgctggcggccaagccggagcccgtgtacggggtgagcaccggcttcggggccctggcgacccggcacatcagccaggagctgcgggcgcagctccagcgcaacatcgtccgctcgcacgccgccggcatgggtccgagggtggagcgggaggtcgtacgggcgctgatgttcctgcgactgaaaaccgtctgctcgggccacaccggcgtacggcccgaagtcgcgcagacgatggccgacatcctcaacgccgggatcaccccggtcgtgcacgagtacggctcgctcggctgctccggcgacctcgccccgctctcccactgcgccctgacgctgatgggcgagggcgacgcggagggcccggacggcaccgtccgtccggccggtgacctcctcgccgagcacggcatcacgccggtcgagctgcgcgagaaggagggcctggccctcctcaacggcaccgacggcatgctcggcatgctggtcatggccctcgccgacctggacgcgctctacaagtctgcggacatcacggcggccctctccctcgaggcactcctcggcaccgacaaggtgctcgcccccgaactgcacgccatccgcccgcaccccggtcagggcgcctcggccgccaacatgctggccgtactggcgggttccgagctcaccggccaccaccaggacgacgcgccgcgcgtccaggacgcgtactccgtgcgctgcgccccgcaggtcgccggcgccggccgggacaccctcgcccacgcccgcctcgtcgccgagcgcgagctggcgtcggcggtggacaacccggtggtgctccccgacgggcgcgtcgagtccaacggcaacttccacggtgccccggtcgcgtacgtcctcgacttcctcgcgatcgccgcggccgacctcgggtccatcgccgagcgccgcaccgaccggcttctcgacaagaaccgctcgcacgggctgccgccgttcctcgcggacgacgcgggcgtcgactccggcctgatgatcgcccagtacacgcaggcggccctggtcagcgagatgaagcggctcgcggtcccggcgtccgcggactcgatcccgtcctcggcgatgcaggaggaccacgtctcgatggggtggtcggccgcccgcaagctccgtacggcgatcgacaacctcacgcgcatcgtggcgatcgagctctacgccgccacccgcgccatcgaactccgcgagggtctgacccccgccccggcgtcgcaggcggtcatcacggccgtccgcaaggcgggcgtcgaaggcccaggaccggaccgcttcctggcccccgacctcgcggcggcggacgccttcgtgcgtgacggcagcctggtcacggcggcggagacggtcaccggaccgctggcg

SEQ ID NO: 3313 - DNA, 1089 bp, Streptomyces avermitilis
  CDS (1)..(1089)
atggcggcggcgcacaccccgcgggagtcctggcgggccgccgcgctcggtgcctgccgcgcgctcgccgggaacttcgccgcgctgtccgtgtgggaacgcgagcgcggccggctgcgggtcctcgccaacgtgggggaccgcgccttcgacgaggaggagttcccggacgacgaggcgtaccccgtgcaccagttcccggagatcaccgaattcctgcacgagcgctgggcgcgtggcggcgagcccaacgcctgggtggagacggccgaggggtcgacggcggggcgtgccgggtactgccaccagcgcgtcgccgccctgcgcaggagggggcgcggctgctgcgtcgtcgccccgatcgtgctgcacggccgcgcctggggcgagctgtatgtcgcccgcccggccggcgagcccgtcttcgaccgcgccgacgccgacttcgccaccgtactggcctccgtcgtggccgccggcctcgcccagaccgagcggctggaggaggcccggcggctcgcgtacaccgacgccctgaccggtctcgccaaccgccgcgccgtcgacgtgcgcctggacgaggcgatcgaacagcatcggcgggacggggtcgtcgtcagtctcgtggtctgtgatctcaacgggctcaagcgggtcaacgacacgcgcgggcatgccgtgggcgaccagctgctcgaacgcttcgggtccgtactgtccctgtgcggcgcgatgctcccgggcgccctcgccgcccggctcggcggtgacgagttctgtctgctggcggtcggcccggcggccgacgaggtggtccgggccgccggtgaactctgccgtcgcgcggccgatttggagctcggcgaaggggtcgcgtgcgggatcgcctcgacccaggacccgatcggtccggtccgctcgggccgccgtctcttccggctcgccgacgcggcccagtaccgcgccaaggccgtacgtgcgacgaagcccgtggtcgcggggcgggaggggcccgacgacccggtcgtccggctcgcggacgagccggcgccggccaaggcggagcgccgccgcttccggggccgccga

SEQ ID NO: 3314 - DNA, 810 bp, Streptomyces avermitilis
  CDS (1)..(810)
atggcggagcgagcggacgagcggcggttcggggaccacgtcgtcgtacggcggcacacgcgggggcaggtcgcggagctcgtcctcgaccggcccaaggccatgaacgccgtgtccacggacatggcccgcgcgatcgccggtgcctgcgaggcgctcgcccacgacacggacgtacgcgtggccgtgctgacgtccacccatgaacgtgccttctgcgtcggcgccgacctgaaggagcggaactccttctcggacgccgacctgctgcgccagcgcccggtcgcgcgcgccgcgtacaccggtgtcctggagctgccgatgcccacggtcgccgccgtgcacggcttcgcgctgggcggcggcttcgagctggcactgtcctgcgatctgatcgtggccgacggcacggcggtggtcggcctgcccgaggtgtccgtcggggtgatccccggcggcggcggtacccagctgctgccccgccgggtcggtgccgcccgcgcggccgagctgatcttctcggcgcggcggctgacgggggccgaggcaagggagttggggctggtcgacgagctggtggaagagggccaggaccgcacggaggcgctggccctggccttccgcatcgccgcgaactcaccggtcggcctgcgcgccgcgaagcgcgccctgcgcctcggccacgggctcgacctgcgggcgggcctggaggtcgaggacgcggcctggcgctcggtcgccttctccggcgaccgggccgaaggggtggcggccttcaacgagaagcgcaagccggagtggcccggcgag

SEQ ID NO: 3315 - DNA, 528 bp, Streptomyces avermitilis
  CDS (1)..(528)
gtgctgttcgccgtgggcgggctcgcactggccgccggggcgttgagcttcgtgcggctggcgcccgagtcggtcggcggcgggcccggcaccgcggaggccgcgcccccggtcgaggcgaccggcgacccggccgccagcgccgcggcggtcgtcggcgccaccccctcgggccgctcggggagccccggagggcgcggcgccaccgccgcgacgggcggcgcgagcgcgacaccgacctcccccgtcggctccggccacgccgcgacatcgccgtccggggtggccctcctgcccgcggcccccggcagcgtctcgacggcgccggggcagcggggcgcccccgcggcccgtacccctcgatcgaacccggcgcccaccgacgccacgactgagcccccgcccacggccaccacggcggccgcgcccggtcccgccccgagtgccagcacccacacgccacacccgcccggcctgtgcgtgccgctcgtcggactgtgcgtcaaccgggcggccgcggccgtccgt

SEQ ID NO: 3316 - DNA, 1215 bp, Streptomyces avermitilis
  CDS (1)..(1215)
gtgaccgtcgacgacacgggttcgggcaccggtgtacaccccgcccccgacggtgagccggggcctaccgccaggcctgtcagcgacgcgtcgcccgcgcgggtcgacgcgcacggtggccgtaccgatgcccacgaccgggtggacgggcacgaggagccggaggagaaccccctcgcgctgcgcctggaacagctcatcctcggggcggagcgccgctacacccccttccaggcggcccgcagcgcgggtgtctccatggagctggcgtcccgcttctggcgggccatgggctttgccgacatagggcaggccaaggcgctgacggaggcggacgtgctggcgctgcgccggctggccggtctggtcgaggcggggctgctgagcgaggccatggcggtccaggtcgcccgttccaccgggcagaccaccgcccggctcgccgagtggcagatcgactccttcctggaggggctgacggagccgccggagccgggcatgacccgcaccgaggtgacgtaccccctcgtcgagctgctcctgcccgagctggaggagttcctcgtctatgtctggcggcgccagctcgccgccgcgacgggccgggtcgtacaggccggggacgacgaggagatggtcgaccgccggctcgccgtcggcttcgcggacctggtcggcttcacccgcctgacccgccgcatggaggaggaggaactcggcgagctcgtcgaggccttcgagaccacggcggccgacctggtggccgcgcacgggggacggctcatcaagacgctgggcgacgaggtgctgtacgcggcggacgacgcgggtgtcgccgcggagatcgcgctccgcctcatcgagacgatggcgaacgacgagaccatgccggagctgcgggtgggtatcgccttcggcacggtgacgacccgcatgggcgacgtcttcggtacgacggtgaacctggccagccggctgacctcgatagccccccgggacgcggtcctggtcgacggggcgttcgcggaggagctgacgcgtacgcgtgaggcccccgcctcggaggcggaggcggccgaggccgcggccgccgcggagaaggagggcgaggagccgccgacgtaccgcttcgcgctccagccgatgtggcagcggccggtgcggggcctgggtgtggtcgagccgtggctgctcactcggcggagcggggagtcc

SEQ ID NO: 3317 - DNA, 873 bp, Streptomyces avermitilis
  CDS (1)..(873)
atgacgccgaaagatgcttctgacgcccatgacggtcgctggtccgatctggaccgtccgcccttgaacgccgcttccctgcggcgcgcgctggtgcgggaggggagcctgtggtcctcgctcgacgtcgtacccgtgaccggctcgaccaacaccgacctggccgcgcgggccgggacgctcgacgagggcgccgtcctcgtcgccgaggaacagaccgccgggcgcggccgtctcgaccggcagtggacggctccggcccgctccggcctcttcttctcggtactgctgaagccgtccgaggtgcccgtgcaccgctggggctggatcccgctgctcaccggagtcgcggtcgcgaccgggctctcccgtgcggcgggcgccgacacggcgctcaagtggcccaacgacctgctggtgagcgtgggcggccaggagcgcaaggccggcggcatcctcgccgagcgcacgggcgaggacggggtcgtggtcggcgtcggcgtcaacgtcacgctccacgaggacgaactgcccgtgcccgccgcgggctccctcaccctcgcgggcgcggtgagcacggaccgtgacccgctgctgcgggccgtgctgcgctcactggagcgctggtacggcacctggcgcgaggcggacggcgatccggcggtgagcggcctccaggaggcgtacgcggcgggctgcgcgacgctgggccggaccgtacgggccgagctgcccggcggccggtcgctcaccggggaggcggtggccgtggacggggacggccggctggtcctggccacggcggagggcgtgcagcagccggtgggggcgggcgacatcgtgcatctgcgaccggcgggagcgggagagatg

SEQ ID NO: 3318 - DNA, 1596 bp, Streptomyces avermitilis
  CDS (1)..(1596)
atgtccgagccggaagagctgcaccaccccgatatccacaccaccgcgggcaaactcgcggatctgcagcgccgcatccaggaggcgacgcacgccggctcggagcgcgccgtcgaaaagcagcacgccaagggcaagctgacggcccgtgagcggatcgcgctgctgctcgacgaggactccttcgtcgagctggacgagttcgcgcagcaccgctccacggacttcggcatggagaacaaccgcccgtacggagacggtgtcgtcaccgggtacgggaccgtggacggccgccccgtcgccgtgttctcgcaggacttcaccgtcttcggcggtgccctcggcgaggtcttcgggcagaagatcatgaaggcgatggacttcgccctgaagacgggctgtccggtcatcggcatcaacgactccggcggcgcccgtatccaggagggcgtctcggccctcggcatgtacggcgagatcttccgccgcaacacccatgcctcgggcgtgatcccgcagatcagcctggtcgtcggcccgtgcgcgggcggcgcggtctactcccccgcgatcaccgacttcacggtgatggtcgaccagacctcgcacatgttcatcacgggccccgacgtcatcaagacggtgacgggcgaggacgtcggcttcgaggagctgggcggcgcccgcacgcacaacgcggtgtcgggcgtggcccatcacatggcgggggaggagaaggacgcgatcgagtacgtcaagcagctgctgtcgtacctgccgtccaacaacctcagcgagccgccggccttcccggaggaggcggacctcgccctcaccgacgaggaccgcgagctggacaccctcgtacccgacagtgcgaaccagccgtacgacatgcacacggtgatcgaacacatcctggacgacgccgagttcctggagacgcagccgctgttcgcgccgaacatcctcaccggcttcggccgggtcgagggccacccggtgggcatcgtcgccaaccagccgatgcagttcgcgggctgcctcgacatcgacgcgtccgagaaggccgcccgcttcgtgcgcacctgcgacgcgttcaacgtcccggtgatcactttcgtggacgtgccgggcttcctgcccggtgtcggccaggagcacgacggcatcatccgccgcggcgccaagctgatctacgcgtacgccgaggcgaccgtcccgctgatcaccgtcatcacccgcaaggcgttcggcggcgcgtacgacgtcatgggctccaagcacctgggcgccgacctcaacctcgcctggccgaccgcccagatcgccgtgatgggcgcgcagggcgcggtcaacatcctgcaccgccgcaccatcgccgccacacccgaggaggagcgcgaggaggtccgccggcggctcatccaggagtacgaggacacgctgctcaacccctacacggcggccgagcgcggctacatcgacggcgtgatcatgccgtccgacacccgcgcccatgtcgtacgggggctgcgtcagctccgtacgaagcgggaatccctgcctccgaagaagcacggcaacatccccctc

SEQ ID NO: 3319 - DNA, 207 bp, Streptomyces avermitilis
  CDS (1)..(207)
gtgacgatcaaggtcatacggggcaatccgaccccggaggagctggccgccgcactggcggtggtgcgggcgcgcgccgcggcggcggcttcggtgccgtccggcgcgcccggaccgcgggactcctgggccgacccggcccgcatcgccgccgaccggctgccccagccgggcccgacgacgtggagccgcacgtactggcccggc

SEQ ID NO: 3320 - DNA, 1245 bp, Streptomyces avermitilis
  CDS (1)..(1245)
ttgctaccgtcacgacatcagctaaagggactccagttccctttaggtcgaaaaggcctgttcgaaaaggcctgttcggaaaggcctgttcggaagggcctgtggaaggaagtgtgtgccgtgttcaccaccgcctggaccgccccgccccagctccccagcgagggcttcacccccaactggtcgagggagggattctggcgccagtccctgcgccaggtcgtacgcctcaccgcgggcggcggccgggtccggatccggctgtcccacgcgtacgggacctcgccgctgaagatcgcgggcgccaccgtggcccgcacggccgcgggtgccgccgtcgaaccgggatcggtgcggcggctcaccttcggcggctcgggcgccgtggagatcccggcgcgcggtcaggtccgcagcgatgccgtcgaactcgcgtcggcggccggggaggcggtgaccgtcacgctgcatctcgacgccgtcaccggtccggcgaccttccacgcccaggcgttcacgagcagctaccgcggtgccggggaccggctggaggacgtacggggtgacggcttcggcgagtccaccgagtcctggtacttcctgacggccgtcgaggtcgacgccggccgcaccgacgccgtggccctcctcggcgactccgtcacggacggcttcggctccaccccgggcgcggaccgccgctggtccgacgctctcgccgggcgcaccggacggcccgtgctgaacgcgggcatcggcgggaacctgctgctgaacgactccgcctggtacggcgagaagggcgtccaccgcctgcgccgggacgtcctcggccacgaaggcgtcgacaccctcgtcgtcctcctcggcctcaacgacatcggcttcagcgagacggacgaacagccgacgtacaagccggcgccggtcgtcgaggcggacgaactgatcgccgggcaccgggagttgatccgccgctcccgcggacggctacgggttgtcggcgcgaccctgctccccttcggcggctccgaccactggggcgaacacgcggccaaggtgagccacgaggtgaacgagtggatccgccgctccggcgagtacgacgcggtcgtggacctcaaccgcgcgctggccgacccggcggacccgggccggctgcacccggcgtacgacttcggcgaccacctgcacccgaacgacgcggggtacgaggtgatggccgaagccgtcgcgggagtgctc

SEQ ID NO: 3321 - DNA, 144 bp, Streptomyces avermitilis
  CDS (1)..(144)
atgctgtggtccgaccccgagaacgagccgcccgaggagctgcggaagacgcaggacatgctgcggcggctgggttttctcatggcgctggccatgctgctcgcgatgatcgtcctcggcttcggatgcggggcgccgataccc

SEQ ID NO: 3322 - DNA, 618 bp, Streptomyces avermitilis
  CDS (1)..(618)
atgaccgatcagccgcgccgccgcctcgtgctcgcctcacagtcccccgcccggctcaacctgctgcggcaggccggcctcgaccccgaagtgatcgtgagcgggttcgacgaggaccgcctgagcgcaccgacccccgccgaactcgccctcgcgctggccgaggcgaaggcctccgtcgtggcggcgaagcccgaggtccagggcgcactggtgatcggctgcgactcggtgctcgacctggacggcgaggccctcggcaagcccgcggacgccgaggaggccaccgcccgctggaaggcgatgcgcggccgggcgggcaccctccagaccgggcactgcatctacgacacggcgagcaagcgctacgcctcggcgaccgcgtccaccgtcgtccgcttcggcgagccgacggacgaggagatcgccgcgtacgtcgcctccggcgaacccctccacgtggccggggcgttcaccctcgacggccgctcggcccccttcatcgagggcatcgacggcgaccacggcaacgtcatcggcatctccctgccgacggtgcgccgcctgctcggcgaactgggcgtcggcatcacgcagctgtggacgccccgggagaag

SEQ ID NO: 3323 - DNA, 522 bp, Streptomyces avermitilis
  CDS (1)..(522)
gtggggccggtggtgcgtagaccggtggcatgggtggtcgcggtcgtcctcttcgtggaggcgctcggcatcgcgctgctcaactggttcctcggggtgatcgtcgaccgccagcacatgtccctcgcggggctcgatccgaacgcgatgtccgtttcctcgaaggccggcggtgtggtcttcggtctctacttcgggctgtgcggcctcgtcgcgctgctggtcggcgtccgcgaccgctccccggccggcctcggccgcatcctgctgatcagcgtcgccgtggtgcatgggctgctgggcgcgttcgcgtgggggctggtgggccggagcgcgttcctgttcatgatgggggtgctcgggctcatcgtgctgctgctgatgacgtacgaccgccgggagggccccgcggacgccgtggacgccgacggcgaccccaaggggaacggcgaccccaagggtgacggcgacagcgtgagcccgggacccgcgccggtcacacccccggctcccagcaccccc

SEQ ID NO: 3324 - DNA, 1770 bp, Streptomyces avermitilis
  CDS (1)..(1770)
gtgcgcaaggtgttgatcgccaaccgtggcgaaatcgctgtccgcgtcgcccgggcctgccgtgacgccgggatcgcgagcgtggccgtgtacgcggagccggaccgggacgcgctgcacgtccgggcggccgacgaggcgttcgccctgggcggtgacaccccggccaccagttacctggacatcgccaaggtgctccaggccgccaaggattccggtgcggacgccatccacccgggttacggctttctttccgagaacgcggagttcgcccaggcggtcctggacgcgggcctcgtctggatcgggccgccgccgcaggccatccgcgacctcggcgacaaggtcgccgcccggcacatcgcgcagcgcgcgggtgcccccctcgtggcgggcacgcccgacccggtctccggcgccgacgaggtcgtcgcgttcgcccgggagcacggtctgccgatcgccatcaaggccgccttcggtggcggcgggcgcggtctgaaggtggcccgcaccctcgaagaggtccccgagctgtacgactcggcggtccgcgaggcggtcgccgcgttcggccgcggcgagtgcttcgtcgagcggtacctcgacaagccccggcacgtcgagacgcagtgcctggccgacacccacggcaacgtggtcgtcgtgtccacccgcgactgctccctccagcgccgtcaccagaagctggtcgaggaggccccggcgccgttcctgtcggacgcccaggtcgaggagctgtactcctcctccaaggcgatcctgaaggaggccggctacgtcggcgcgggcaccgtcgagttcctcgtcggtgtcgacggcaccatctccttcctcgaggtcaacacccgcctccaggtcgaacacccggtcaccgaggaggtcgccggcatcgacctcgtgcgggagatgttccgcatcgccgacggcgaggaactcggctacggcgaccccgagctgcgtggtcattccttcgagttccgtatcaacggcgaggacccgggccgcaacttcctgcccgcccccggcacggtgacgaccttcgccccgccgtcgggcccgggcgtgcgcctggacgccggcgtcgagtccggcagcgtgatcggccccgcctgggactccctgctcgccaagctgatcgtcaccggcgccacccgcgaacaggctctccagcgcgccgcccgcgccctggccgagttcaacgtcgagggcatggccaccgccatcccgttccaccgcgcggtggtcagggacccggcgttcgcccccgaactcaccggctccgccgaaccgttcacggtccacacccgctggatcgagaccgagttcgtcaacgagatcaagccgttcaccgtccccaccgacgcggacgccgaggaggagcccggtcgcgagaccgtcgtcgtcgaggtcggcggcaagcgcctggaagtctccctgccgtcctccctcggcatgtcgctggcccgcaccggcctcgcggcgggcgccaagcccaagcgccgcgcggccaagaagtccggcccggtggcctccggggacaccctcgcctccccgatgcagggcaccatcgtcaaggtcgccgtcgaggagggccaggaggtccaggaaggcgacctggtcgtcgtactcgaagcgatgaagatggaacagccgctgaacgcgcacaagtccggcaccatcaagggtctgggcgccgaggtcggcgcgtccatcacctccggcgccgccatctgcgagatcaaggac

SEQ ID NO: 3325 - DNA, 1071 bp, Streptomyces avermitilis
  CDS (1)..(1071)
gtgcgggcaggcgcagtactttcttctcaggacatcgaggaacatctcaggacttctcatggcgagagcagcgccgggagagtgtgcatggagatcagcggtgcggacgcgcaacgcgtactgacactggtacgaggaatcgaagaggccgactccgtcgaggagttccaggaacaggcgctgcccgggctgatggagctgatcccggccgacgcggcgcagagttaccggatagcggtcgacggcgtcggtctgtccaccctctcgctgccgacggactccttccacgaggacccgatggtcatctacgaccatcccctcgaccacccgctgaccgaggtcatgctccagacgccgaccccggaggcatggcgggtgagcgacgtggccggcgaccggcagtgggaacgcacccactgctacaacctggacttccgccccttcgggttacggcggcacctggtggcgtcggccgggtccgacatgtccgtggtcgagggctacgcactggtccgctccggccaggacttcaccgaacgggaacgcgacctgctcggcttcgcccagctccaactccgcgccgtgcacagggcgctgcgggagcgagcccggttgcggctgctggccgccgccgccctggaactggtcggcgggcacgaccggggtgtcgccgcactcgacgacggccgcccgtaccccctcaacgcggccgcggcccacctgctgccggccgtacggcacgatccccggctcggccgcaccgaaccgttcaccgcacgggacgtcgaggtgcgctacgtcgcccccgccgcacccggccttcccgcgctgctcctgctccgggacctcgggcgggggcgggccgtcgcccggctgttcggcgtgaccgaccaggagcaccggacgctgcggcacctcgacagcggcctcacggcgaccgagacggcccggcggatggggctgtcgccgaccaccgtgcggggctacatcgccgccctgcaccgcaagctcgaggccgggcacacggcggcgctgctgcgccggggacgggacctcggactgctcgccgac

SEQ ID NO: 3326 - DNA, 924 bp, Streptomyces avermitilis
  CDS (1)..(924)
atggtgcgagcgaatggggccgtgtcgctccgtgagctcgcccgcgtcgtccagacctccgaagtgaccgtacggcgggacgtgcgcgcactggaggcagaaggactcctcgaccgccggcacggcggtgcggtattgccgggcgggttcacgcgggagtccggctttccgcagaagtcacatctcgcgaccgccgagaagacggccatcgccgatctcgccgcgagtctcgtcgaagagggcgaggccatcgtggtgggggcggggaccacgacgcaggagctggcccgccggctcgcgcgggtgcccgggctcaccgtcgtcaccaactcgctgctggtggcccaggcgttggcccatgccaaccgggtggaggtcgtgatgaccggcggcactctgcgcggctccaactacgcactggtcggcagcggagccgagcagtccctgcaaggactgcgcgtgtcccgggccttcctctccgggagcggcctcaccgccgagcgcggcctgtccacctccaacatgctgtcggcgtccgtcgaccgcgcgctggtgcaggccgccgccgaggtcgtcgtgctcgccgaccacaccaagctcggcaccgacacgatgttccagaccgtgccgaccgatgtcatcacgcgcctggtcacggacgaaccgcccgcccacgacgaccgcgcggccaccgaactccaggccctcgccgaccagggcgtgcagatcgcggtcgccgggtcggcggcgggcgcgggaggcggcgatacggtcccggcggggcgtcagtcacgccgggacatgccgctccccggtccgcgccgcggccaggtcccgggcgccgggccgcagctgcgcagcaccacggccctgggcgagcagcagccgggagagcgggcgcgggtcgcggacctgcggcgccgc

SEQ ID NO: 3327 - DNA, 1425 bp, Streptomyces avermitilis
  CDS (1)..(1425)
gtgatcatcggtggcggacccggcggatatgaagcggcgctggtagccgcccagctcggcgcggaggtgaccgtcgtcgactgcgacggcctgggcggtgcgtcggtgctgaccgactgcgtgccgtccaagaccctcatcgccacggccgaggtgatgaccaccttcgactcgtcgtacgaggagctggggatcatcgtcgccgacgacaccccgcccatggagcaggcggcccgggtggtcggcgtcgacctcggcaaggtcaaccgccgtgtgaagcggctcgcgctcgcccagtcgcacgacatcacggcgtcggtgacccgtgccggggcccgggtcatgcgcgggcgcgggcggctcgacggcatgcagtccatcgacgggtcgcgcaaggtcgtcgtgcgggccgcggacggcgccgaggagaccctcgtcgccgacgccgtgctcatcgcgaccggcggtcacccccgtgagctgcccgacgcccagcccgacggcgagcggatcctgaactggacccaggtgtacgacctggacgagctgccggacgagctgatcgtggtcggttccggtgtcaccggtgccgagttcgccggtgcctatcaggcgctcgggtccaaggtcaccctcgtgtcgtcgcgggaccgggtgctgcccggcgaggaccccgacgccgccgccgtcctcgaggacgtcttccgccgccgcggcatgaacgtcatggcccgctcccgcgccgagtccgccaagcgcatcggcgaccgtgtcgaggtcaccctgtcggacggccgggtcatctccggttcgcactgtctgatggccgtcggcgccatacccaacagcagtgggatggggctggaggaggcgggggtcaagctccgcgactcgggtcacatctggaccgacaaggtgtccaggaccacggctccgggtgtgtacgccgccggtgacgtgaccggtgtcttcgccctcgcctcggtggcggcgatgcaggggcgtatcgccatgtaccacttcctgggcgacgccgtggccccgctgaacctgaagaccgtgtcgtcgaacgtcttcaccgaccccgagatcgcgacggtcggctacagccaggccgacgtcgacgcgggcaagatcgacgcccgggtcgtgaagctgccgctgctgcgcaacccgcgcgccaagatgcagggcatccgggacggcttcgtcaagatcttctgccggccgggcaccgggatcgtggtgggcggtgtggtggtcgcgccgcgcgcctcggaactgatccaccccatctcgatcgcggtcgacaacaatctgacggtcgagcagatcgcgaacgcgttcaccgtgtatccctccctttcgggctcgatcgccgaggtggcgcgacagctgcacacccgaaagacggccggcgacgcc

SEQ ID NO: 3328 - DNA, 435 bp, Streptomyces avermitilis
  CDS (1)..(435)
atgtcgctctacgccgcgtacgccggcaatctcgacccgcggctcatgacgcgccgcgccccgcattcgccgctgcgcgccaccggctggctcaacgactggcggctgacgttcggcggcgagcacatgggctgggagggcgcgctggcgacgatcgtcgaggccccgcgctcccaggtcttcgtggcgctgtacgacatcgccccgatggacgaggactccatggaccgctgggagggtgtcggcctcgacatctaccggcgcatgcgcgtacgcgtgcacaccctggagggcgaggaggccgcgtgggtgtacgtactgaacggctacgagggcggactgccctcggcacgctacctgggtgagctcgccgacgcggccgagtcggcgggggcaccgcacgattacgtgatggagctgcgcaagagaccgtgc

SEQ ID NO: 3329 - DNA, 822 bp, Streptomyces avermitilis
  CDS (1)..(822)
gtgaacgcatctcttcttccggacgacatccagggcgacccccacgccgccgccgacgccgccgccgcgcgcctgcgcgagctcacgggcgccgagacccacgacgtcgccctcgtgatgggctccggctgggcaccggccgtggacgccctgggcgcccccgaggccgagttccaggtcaccgagctgcccggcttcccgccgccggcggtcgagggacacggcggcaaggtccgctcgtacaagatcggcgacaagcgcgccctggtcttcctcggccgcacccacttctacgagggccgcggggtcgccgccgtcgcgcacggcgtacggaccgccgtcgccgccggctgcaagaccatcgtgctcaccaacggctgcggcggcctgcgcgagggcatgcgacccggccagcccgtcctgatcagcgaccacatcaacctgacggccacctcgccgatcatcggtgcgaacttcgtcgacctcaccgacctgtactcgccgcggctgcgcgcgctgtgcaaggaggtcgacccctccctggaggagggcgtctacgcgcagttccccggcccgcactacgagacgccggccgagatccgcatggcccgggtgatcggcgcggacctggtgggcatgtcgacggtcctggaagcgatcgccgcacgggaggcgggcgccgaggtgctgggcctctccctggtcaccaacctcgccgccggcatgacgggcgaacccctcaaccacgaggaggtcctccaggcgggccgcgactcggccacccggatgggcgcgctgctgacccaggtgctgaaccggctc

SEQ ID NO: 3330 - DNA, 1629 bp, Streptomyces avermitilis
  CDS (1)..(1629)
gtgcacgacgaactcatcgcacgggccaaggcgtggctggccgaggaccccgacgcggagacacgtgaggaactcgccaagctcatcgacgccgaggacgtcaccgagctcgccgcgcgcttcagcggcaccctccagttcggcaccgccgggctccgcggtgagctcggcgccggtcccatgcggatgaaccgcgccgtcgtgatccgtgccgccgccggcctcgccgcgtacctcaaggccaagggcgagcagggcggcctcgtcgtcatcggctacgacgcccgccacaagtccgccgacttcgcccgcgacaccgccgcggtcatgaccggcgcgggcctgcgcgcggcggtcctcccccgcccgctccccacgccggtcctcgcgtacgccataaggcacctgggcgccgtggccggcgtggaggtcaccgccagccacaacccgccgcgcgacaacggctacaaggtctacctcggcgacggctcccagatcgtccccccggcggacgcggagatcgccgcggagatcgacgccgtccgcgccctcgccgacgtcccccgcccggactccggctgggagacgctcgacgacagcgtcctgaacgcctacctggcgcgcaccgacgccgtactggccgagggctccccccgcaccgcccgcaccgtctacacggcgatgcacggcgtcggcaaggacgtcctcctcgccgccttcgcccgggccggcttcccggagcccgtcctcgtcgccgaacaggccgagccggatccggacttcccgaccgtcgccttccccaacccggaagagcccggcgcgatggatctcgccttcgcgaaggcccgtgagaccgaccccgacctgatcatcgccaacgacccggacgcggaccgctgcgccgtcgcggtcaagggcggcaccgactggcgcatgctccgcggcgacgaggtcggcgcgctgctcgcccagcacctggtcagccggggcgcgcgcgggacgttcgccgagtcgatcgtctcctcctccctgctcggccggatcgccgagaaggcgggcgtgccgtacgaggagaccctcaccggcttcaagtggatcgcccgcgtcgagggtctgcgctacggctacgaggaggcgctcggctactgcgtcgaccccgagggcgtacgcgacaaggacggcatcacggcggcgctcctgatcacggagctcgcctccgagctcaaggagcggggccgcacccttgtcgacttcctcgacgacatcgccgtggagcacggcctgcacgccacggaccagctctcggtccgggtggaggacctctccgtgatcgcgaacgcgatgcggcgcctgcgcgagcagccgccgacgcggctcgcgggcctggcgatcacccggtccgaggacctgaccaagggcacggaccggctgccgccgacggacggtctgcgctacacgctggacggcgcccgcgtcatcgtccgccccagcggtacggagccgaagctgaagtgctacctggaggtggtggtgccggtgggcacccgccaggacctccccgcggcccgcaccaaggccacgaacctcctggagacgatcaagcgggacctctccgaggcagcgggcatc

SEQ ID NO: 3331 - DNA, 1677 bp, Streptomyces avermitilis
  CDS (1)..(1677)
atgaacaaccctgtacagcagcccgtgctgcgcctgcccgagtccgccgtgcccgacgggtgccgtccctgggacggtgcgcaggcggcccgctgggcgggcgcgctgccgcccgggtggacgctggcgcacctccgtatgcgactggtgttcggggggacctgcctcggcgtgatcggcgcgttctggctgaccaccctcgcggatctgaagccgttcgtggccgcgctgctcccgctccagatcctgtggctgttgcggcggcccgaggtcgcacgggtctcggcgcccgtcctggtcgtggtgctgctgttgcaacggcccgggctgccctgggtctggtccgggcccgccgtactgctgctgatcgcgacctgggtggccgccgcggtgcggctgcacgcccgcggccggcaacgggagcgcgcgctcgccgccgccggtggcgtgacggccggggtgccgggtgcggaccggcggctggagcgcggggcgttcctcatcggtctcgggggagtgctcaccgtgctcggcgcggtgctcgtcgtgacctccgggctctggcagtcgggtgacgaccggctgggctccgccacggtcggctgcttcgtggccggtctcggtgtgaccgccctcgcctccggcgtactcggccgacggcgcgcggccgccctgggccgggcgcccgcaccggtgctgcgggtgctcgtgcgcgacgacgcggcggccgacacggaggtcttcgccgcggacgacgtgggggcgctgcggccgctgttcaccgtctccttgctggacatggacgacgacgaggacgaggacgaggacgacgtcgacggggacggcgtcgtcgacgaggaggagctggcggcgctcctcaagggcctcgacaccgacgtgcccggtccgctgcgcgaggccgtcctgtacggagcgccctacgacggtgccgaggtcgtcgtggtcagcgccgcccaggaggccggcgacccgcctctcgtggagcggtcgacggggccggtgcgtccgctgccggagggggcggcgcggcgtcgtatcgccgccgggaaggcgaaggccgggcgggaggcccggcggcaggccgtgtacgaggaacggcgggcggtggcggtcctggcggcggtacgggacggcggggggccggcccggcggtggagcgcggggtggctggaccggatcaccgtcgtggccgtcgtgctgtggggctgttacgcgctcgccggtgagagcggggtctggcggtacgtcatcggtgccggactgggtcttctcggggtgtgcctgctgcccggccacctcgcgtggcggatcaccgccgacgcggccgggctgtggttccgccggctgggccgctcccggcacatcgcctgggaccacatacgcgtcgtcgagtgcaagggcaccgaactgagggccgacagctatcgggccggcttcgaggagtggtcggtgtccgggccgcgatggccttggctggagcggaagttcgggctcatccacccgtacgagcgggtcgccgccgagatcaacgccatgtggcaggaccccgccctgcggccgaccgccgagagcggcgggccggagcgaggccgtggactgtggccggtggccgtggcgatcggggtggcgtgggcggcggcgctggtgttgctgccc

SEQ ID NO: 3332 - DNA, 654 bp, Streptomyces avermitilis
  CDS (1)..(654)
gtgaccatgacgaccccggatcaccagtcacccgtgccggactcctcggaaccttcgggatcccagtccagggaccggatctaccggtcgccctccggcatcgtgggcggtgtgctgctgctcgccctcgtgggctggctcggtgtcgacgcgctggtctcgggccacgggcgcacgccctggctggccctcgccacgctgatcctgctcgttccgctggtggtcgccttcacgctgcgccccgccgtcttcgcgaacgaggaccggctgcgcatccgcaaccccttccgcgtcatcacgctgccctggggcagcgtcgcctcgctgcgctccggctactccaacgaggtggtcgtcaagtccggcaccaagtaccagctgtgggcggtgcccgtctcgctgcgcgcccgcaagaaggcgacccggcagcagaaccgcgccgcggcgcaggcccgcaccggcgcggcggcggccctggacgccgggccccggcgcgcccagaccgaccaggtcatggacgacctgcgcgagctggccgaggcccacgagtcggcggagcgcgcgcagggagagccgagcgtgcgctgggcgtacgaggtgatggggccggcgatcgccggtgccgtggtgctggtgatcctgctcgcgacgggg

SEQ ID NO: 3333 - DNA, 987 bp, Streptomyces avermitilis
  CDS (1)..(987)
atgcccacctcccccaagctctcggcttcgctcgaccagggcggtgccccctcccacgcactcggcgacgtggccgcgtccgacagcacgctgcgccgcttcctccacgggctgcccggcgtcgacacggtcggcctcgaggcgcgcgccgcctcgctcggcacccgttccatcaagacgaccgcgaaggcgtacgcgatcgacctcgccatctcgatggtcgacctgacgacgctggaaggtgcggacaccccgggcaaggtccgggcgctcggcgccaaggcggtgcaccccgacccgaccgaccgcacgacgcccagcacggccgccgtctgcgtctatcccgacatggtggccaccgccaaggaagccgtcgccggctccggcgtgaaggtcgcctccgtcgccaccgccttcccggccggccgcgccgcgctggacgtgaagctggccgacgtgcgcgacgcgatcgccgcgggcgccgacgagatcgacatggtcatcgaccgcggggcgttcctcgcgggcaagtacatgaaggtgtacgacgagatcaccgccgtgaaggaggcctgcgggaccagcgcccgcctcaaggtcatcttcgagaccggcgagctctcgacgtacgacaacatccgccgcgcgagctggctcggcatgctggccggggcggacttcatcaagacctcgaccggcaaggtggcggtgaacgcgacgcccgcgaacaccctgctcatgctggaggcggtgcgcgacttccgtgcccagaccgggatccagatcggcgtgaagccggccggtggcatccgcaccaccaaggacgccgtcaagttcctcgttctggtcaacgagacggcgggcgcggactggctggacaaccactggttccgcttcggcgcctcctcgctcctgaacgacctgctgatgcagcgtcagaagctggccaccggccgctactccggccccgactacgtgacggtggac

SEQ ID NO: 3334 - DNA, 1434 bp, Streptomyces avermitilis
  CDS (1)..(1434)
atggcttccgcattcgaatacgcaccggcgcccgagtcccgctccgtcgtcgacatcgccccgtcgtacgggctcttcatcgacggcgagttcaccgaggccgccgacggcaaggtcttcaagacggtcagcccgagcaccgaagaggtcctctccgagatcgcccaggcgggcgaggcggacgtcgaccgggccgtgaaggccgcccgcaaggccttcgagaagtggtcggcgctgcccggctccgagcgcgccaagtacctgttccgtatcgcccggatcatccaggagcgctcccgcgagctcgccgtcctggagaccctggacaacggaaagcccatcaaggagacgagggacgccgacctccccctggtcgccgcgcacttcttctactacgcgggctgggccgacaagctcgaccacgccgggttcggcgcgaacccgcgcccgctgggcgtggccggccaggtcatcccctggaacttccccctcctgatgctggcgtggaagatcgccccggcgctcgcgaccggcaacacggtcgtcctgaagcccgccgagaccacgcccctgtcggcgttgttcttcgcggacatctgccgccaggcgggccttcccaagggcgtcgtcaacatcattcccgggtacggcgacgcgggcgccgccctcgtcgagcacccggacgtcaacaaggtcgccttcaccggctccacggccgtcggcaaggccatcgcgcgccaggtcgcgggcacggagaagaaggtcaccctcgaactgggcggcaagggcgccaacatcgtcttcgacgacgcccccatcgaccaggccgtcgagggcatcgtcaccggcatcttcttcaaccagggccaggtctgctgcgccgggtcccgtctcctcgtacaggagtcggtccaggacgagctgctcgactccctgaagcgccgcctgtccaccctccgcctcggcgacccgctggacaagaacacggacatcggcgcgatcaactcggccgagcagctgtcccgtatcacctcactcgtcgaccagggcgaggcggagggcgccgagcgctggtccccggcctgcgaactcccgtcgtccggctactggttcgcgccgacgctgttcaccaacgtcacccaggcgcacaccatcgcccgcgacgagatcttcggcccggtgctctccgtcctcagcttccgcaccccggacgaggccgtcgccaaggccaacaactcccagtacggcctctcggcgggcatctggaccgagaagggctcccggatcctggccgtcgcgagcaagctccgcgcgggcgtcatctgggccaacacgttcaacaagttcgacccgacctcgccgttcggcggttacaaggagtcgggcttcggccgcgagggcggccgtcacggcctggaggcgtacctcgatgtc

SEQ ID NO: 3335 - DNA, 906 bp, Streptomyces avermitilis
  CDS (1)..(906)
atgtctgagaagaccgacaagaccgagcagcagcgactgagtgtcttcaagacctacaagctgtacgtcggcgggaagttcccgcgttccgagagcggccgggtgtacgaggtgacggactcgaagggcaagtggctggcgaacgcgcccctttcctcccgcaaggacgcccgtgacgccgtggtggcggcccgcaaggccttcggcggctggtccggcgcgaccgcgtacaaccgcggccagatcctctaccgcgtcgccgagatgctggagggccgcaaggaccagttcgtgcgcgaggtcgcggacgccgaggggctgtcgaagtccaaggccgccgctgtcgtcgacgccgcgatcgaccgctgggtctggtacgcgggctggaccgacaagatcgcccaggtggtcggtggcggaaacccggtggcgggcccgttcttcaacctgtccaccccggagccgaccggcgtggtcaccgtcctggccccccaggagtcgtcgttcctgggcctggtctcggtgatcgccccggtgatcgcgaccggcaacacggtgatcgtgatcgcgagcgagaagtccccgctcccggcgctgtcgctgggcgaggtgctggccacgtccgacctgccgggcggcgtcgtcaacgtcctctccggcaagacggcggagatcgccgcccccctcgccgcccaccaggacgtcaacgcgatcgacctcgcgggcgccgacgacgagctggcgaaggaactggagatcgcggccgcggacaacctgaagcgggttctccgtccacagcctgtggattattcgcggaccccgggtaccgagcgcctgacggccttcctggagacgaagacggtctggcacccgacggggtcactgggcgcgtcgggctcctcctac

SEQ ID NO: 3336 - DNA, 393 bp, Streptomyces avermitilis
  CDS (1)..(393)
atggcacgacacgcctccctcccgaatccgaccgctcggcgtgccctggtcgctctcgcgaccgcggcactcggggcgggcgcggccacggcgtcggcgcaggccgcccccgccgtcgacgcgacgcacaaccggcccgcatcgacgggcgccatcgactcgcaggctgggctccggccgctcacgggcacggtcgggtacgtcacgggaccggtcgaggggctcaagcccaacccgctcgcgggcacgggcgtcgatccgctcgacaacggcgtcggcacccaggtcgccgacttcaagccgctctcgtcgaaggccctgacggggccgctcgcacaggcgccgtccgtcggaagcaccccggtgctcggtcgggcggcggggctgctgcac

SEQ ID NO: 3337 - DNA, 702 bp, Streptomyces avermitilis
  CDS (1)..(702)
ttgagatgtgatgtgcgctccaacggcgtcccgcggggtcggcgccgcccgcctgatgcctcagactggtgtctcgtgagtctccatcccccgatacctacccgcgtcgtgctgctctgcggcccttccggctcgggcaagtccctcgtcgccgcccgctccggcctgcccgtgctgcggctcgacgacttctacaaagagggcgacgacccgacgctgccgctggtggaggggagttcggacatcgactgggaccatccgctgtcgtgggacgcggacaccgccgtcgcggcgatcgccgagctgtgcgcgacgagccgtacgaccgtgccggtgtacgacatcgcgctgagcgcccgcaccggcgcggagacgctgcacatcgagcggacgccgctgttcatcgcggagggcatcttcgccgccgagatcgtggaccgctgccgcgagctgggccttctcgccgacgccctctgcctgacccgcggcccgctcaccaccttccgccgccgcttcctgcgcgacctcaaggaaggccgcaagtccatccccttcctcctgcgccgcggctggcgcctgatgcgcgccgaacgctcgatcgtcacccggcagacggccctcggcgcccacccctgcgaccgggacgaggcactgggccgcatggcggcagcggcggcgggacgctgcgcgaaggcgacggcc

SEQ ID NO: 3338 - DNA, 618 bp, Streptomyces avermitilis
  CDS (1)..(618)
atgacggtggttgacgcactcacggggggaagcggtacgggggtacaggctcacgggggagccgcgtacggggaggacacgggggagcgtcgctcggtgtcggaggcggagttcaccgcctacgtccaggagcgccgcgcctccctgtacgcaaccgcctaccacctcaccggcgaccgcttcgaggccgaggacctgctgcagagcgcgctgttctcgacgtaccgggcgtgggaccggatcagcgacaaggcggccgtcggcggctacctgcgtcgcaccatgaccaacctgcacatcagcgcgtggcgccgccgcaagctgaacgagtacccgaccgaggaactgccggagaccgccggtgacacggacgcgatgcgcggcaccgagctgcgcgccgtcctgtggcaggcgctggcccggctgccggaactccagcgcaccatgctggtcctccgttactacgagggccgcacggacccggagatcgcggagatcctcgacatcagtgtcggcacggtgaagtccagcatctggcggtcgctccgccggctgcgcgaggacgaggtcctcagcttcggccgtgacgaggaggagtccttcggggagcttgtcgcc

SEQ ID NO: 3339 - DNA, 675 bp, Streptomyces avermitilis
  CDS (1)..(675)
gtgccttccctgttgctgatcgaggacgacgacgccatccgtacggccctggagctctctttgactcgccagggacaccgtgtggccaccgctgccaccggcgaggacggtttgaagctgctgcgcgagcaacggccggacctgatcgtgctggacgtgatgctgccgggcatcgacgggttcgaggtgtgccggcgcatccggcgcacggaccagctgccgatcattctgctgaccgcgcgcaacgatgacatcgatgtggtggtcgggctggagtccggcgccgacgactatgtcgtgaagcccgtgcaggggcgggtgctcgacgcccggatccgggccgtgctgcggcgcggcgagcgcgaggccaacgactcggcgaccttcgggtccctggtcatcgaccgggcggccatgacggtcaccaagaacggcgaggacctgcaactgacgccgaccgagctgcggttgctcctcgaactgagcaggcggcccggccaggcgctgtcccgtcagcagctgctgcggctcgtctgggagcacgactacctcggcgactcacggctcgtggacgcgtgtgtgcagcggctgcgggccaaggtcgaggacgttccctcctcccccacgctcatccgtaccgtgcgcggggtcggctaccggctggactctcctcag

SEQ ID NO: 3340 - DNA, 1563 bp, Streptomyces avermitilis
  CDS (1)..(1563)
gtgaccaaaccgcaggacaagctccgcggctgggccgcggcccgcaaggcgatcctgtccggtctgcgcttcaccagcctgcggctgcgtctcgtcgtcgtcttcggcctggtggcgctcaccgccgccgtctcggcctccgggatcgcgtactggctcaaccgcgaggccgtgctcacccgcacccaggacgcggtgctgcgtgacttccagcaggagatgcagaaccgggcgagcgcgctgcccgtgcacccgacgcaggacgaactccagcacaccgccgggcagatgggaaccagcagccagcgcttcagcgtgctgctggtcgccgaggacgcgaacggcaagaccgtcaccggcaactccgacctggacaccttcacgctggaggacgtaccggagtccctgcgaacggcggtgaacaagaagcagtccgtgtcgggcggcaacaagcacgcgtaccacctgtactggcagcgggtcaccgaaggcggcaagccgtatctggtgggcggcgcgaaggtgatcggcggcggcccgaccggctacatgctcaagtcactagagccggaggccaaggacctcaactccctcgcctggtcgctgggcatcgcgacgggcctcgccctgatcggttcggcgctgctcgcgcaggccgccgcgacgaccgtcctgaagccggtgcaccgcctcggcatcgccgcccggcgcctcggcgagggcaagctcgacacccgtctgcgggtgtccggcaccgatgaactggccgatctgtcacggacgttcaaccggacggccgagtccctggagaagcgggtcgcggacatgagcgcccgtgacgaggcctcgcggcgcttcgtcgccgacatgtcccacgaactccgtacgcccctcacggcgatcaccgccgtcaccgaggtcctcgaggaggagctcgacgccgagacgggcagcgtggacccgatgatcgaaccggccgtacggctggtggtcagcgagacgcgccggctgaacgacctggtcgagaacctcatggaggtcacccgcttcgacgcgggcacggcacggctcgtcctcgaccacgtggacatcgccgaccagatcaccgcgtgcatcgacgcgcgcgcctggctggacgccgtcgatctcgacgccgagcgcggcaacatctgccgcctcgacccgcgccgcctcgacgtcatcctggcgaacctgatcggcaacgcgctcaagcacggcggctcgccggtccgcgtgtccgtccgtacggaggcggaggacctggtcatcgaggtgcgggaccacggtccgggcatccccgaggacgtcctgccgcacgtcttcgaccgcttctacaaggcgagcgcctcgcgcccccgttccgagggcagcggtctgggactgtccatcgcgctggagaacgcgcacatccacggcggcgagatcacggccgccaactccctgaagggcggcgccgtgttcacgctgcgtctgccccgcgacccgtcaccgctgatcgcggaggacgaggggcagaacgggcacggcacggagggcaacgcc

SEQ ID NO: 3341 - DNA, 627 bp, Streptomyces avermitilis
  CDS (1)..(627)
gtgggttcacgtccccggcccgcggcccgtccgcgtccctggctggccctcccgctgctggccgcgctgctcaccggttgcggtatccgggccacgcaggtcccgaccgacttcgggcccgcgccgtcgcgggtgccctgtgccctgtcggcgccggacctctccacccagggcagtcccggcatcccggtccaggtcttcctgctgtgcgcctcgcagttggtgacggtggaccgttcggtgcgcatcccggacggcacggcggaggccgggcgccgggtgctggtggcccaggggctgctcgacgaactcgcccggaccccgtcgtccgccgagaagcaggcgggctacacgagcgacgtgaacggcggcatcaaggtgagcgggccccgcgccaaggaccccgggaacaccttccggctgagcacgtcgccccggcggctcacctcgtacgcgctggcgcagctcgtctgcacgttcgccaactcggaggcgaccgccgccgacgacggcgcggtcatcctcggcggcccggacaccggttcaccgcgccgctacgagtgcacgacggaggtgcgctcccggccgggcacccaggagccaccgtcgaccgaggtcaagacaggc

SEQ ID NO: 3342 - DNA, 549 bp, Streptomyces avermitilis
  CDS (1)..(549)
gtgcagcgtcaaggctcaggcggcggcagtgccgtgatccgcgtccgtgtggcaggaggtgtcctcctggccgcacacctcatgctcgtcgtctggatcacgctgcgcccgctggacgttccctgggtgagccccgccaacctgcatcccttcgccggtatcagggccgatctcgccctgggcccgcgggaggcggtgcgccggatcggtgagggcctcgggctgctcgccccgctcggcgtgctgctgccgatggtggcggggcggctcgccgtctccccgctcgcctcgctgacccgtacggtcgccgcgggcgccctgatctcgctgggcatcgaactgctccagaccggggtgccgggacaggtcgtggacgtcgactccctgctgctcaacacggtgggcgtggccctggcccatctggcgatcgtgcccgcgggccgggcccggctccgccgccgggccgagacgcggcgccgtgcggccctgggccgggaggagctctctcagggtctgaccccgacgattcccagggtcgggatcgcaccg

SEQ ID NO: 3343 - DNA, 201 bp, Streptomyces avermitilis
  CDS (1)..(201)
atgaccgccatttcccgccccaccgacggccggatgatcggcggagtctgcgcagcgctggcacggcgcttcggcacctccgcgaccacgatgcgcgtgatcttcctgctgtcgtgcctgcttccgggcccgcagttcctgctctacatcgcgctgtggatcctgttcccgtcggagcacaaggccggccgtacggcctgg

SEQ ID NO: 3344 - DNA, 330 bp, Streptomyces avermitilis
  CDS (1)..(330)
atgaagcagtctgctgccaagactctcggtgtcgccgcgctcggtgccgccttcgccgccgcgggcgcgggcgtcgccagtgcggccccggccgtgccggacgcctcctcggcgctggacaccgtcacccgcacgctgccggcggacaacgtcacccaggtgctgcccggctcgcgtgaggcgctgagccagggtcagaacgcggtcggcgcgggtgtggccgcggccaagcccaccgcggccaaggccctcaatggcggtccggccgcgccggtcgccggactgctgggcgggctgccgctgaaggggctgcccaccacgacactgcgg

SEQ ID NO: 3345 - DNA, 1212 bp, Streptomyces avermitilis
  CDS (1)..(1212)
ttggatatcgacgcttcgtcgtgcccggagctctacgcgcgtagggcttatggtgcggaaatgacgagccagcaccagaacacccctagctcggaacagatccgccgggcgcccaaggtcctgctccacgatcacctcgacggggggctgcgccccggcacgatcgtcgaactcgcccgcgacgccgggtactccgggctccccgagaccgaccccgacaaactcggcatctggttccgcgaggccgccgactccggttcgctggagcggtatctggagaccttcgcccacacctgcgccgtcatgcagacccgtgcggcgctcgtgcgggtcgccgccgagtgcgccgaggacctcgccgcggacggggtcgtctacgccgaggtgcggtacgcgcccgagcagcacctggaggccgggctcagcctcgaagaggtcgtcgaggccgtcaacgagggcttccgggccggcgagcggcgggccaaggaggatggcaaccgcatccgggtcggcgcgctgctcaccgccatgcggcacgcggcccgcgccctggagatcgccgaactcgccaaccgctaccgggatgcgggcgtcgtcggattcgacatcgcgggcgccgaggcgggcttcccgcccacccggcacctcgacgcgttcgagtacctcaagcgcgagaacaaccacttcacgatccacgccggggaggccttcggtcttccgtcgatctggcaggccctccagtggtgcggcgccgaccggctcggtcacggcgtgcgcatcatcgacgacatccaggtgcgcgaggacggctcggtgaagctgggccgcctcgcctcgtatgtgcgcgacaagcgcatcccgctggagctgtgcccgagctccaacctccagacgggcgccgcgtcctcgtacgccgaccaccccatcgggctgctgcggcggctgcacttcagggccacggtgaacaccgacaaccggctgatgtcggggacgagtatgagccgcgaattcgagcaccttgtcgacgctttcggctacacgctcgatgacatggcctggttctccgtcaatgctatgaaatccgcattcattcctttcgatgaacgactggccatgatcaatgacgtcatcaagcctggatatgccgagctgaaatccgaatggctgttcaagcagacggcttccaccagcagttctgcggcatccgaggag

SEQ ID NO: 3346 - DNA, 762 bp, Streptomyces avermitilis
  CDS (1)..(762)
atggcacaccaagcgacgccggttcgcacggcccggctggggaggacgctcggcccggagccgacggcggtgagcggagtggtgctactgctcccgggcggcgacgaggcctccacccgcagaccgtcccccgtactcccgaccgcttccgtacgggcgctcgggcgccatctcgcgcgcgcgggacgcgacgaaggcctggtcacgcatgtggtgcactaccgctatcgcggctggaacggcagcgaggcgcatctggcgcacgacgcgtcctgggccgcgggcgaggtcgtacgccgctacggggacgtccccgtctgtctcgccggcgtggacatgggcgggcgggcggcgctgcgcgcgggcgggcacacagccgtcaactcggtgctggcgctcgctccctggctgccggaggaggacgtggccgcgccacccgaaccggtgaagcagctctccggacggcgcgtgctcctcgtgcacggcacgaacgaccagcgcaccgaccccgagctgtcgttccggctggcgtcccgggcgaagaagacgaaccgcgacatctgccgcttcgaagtgcactccgacggacacgggttgcatcagcaccggtccgaagtgctggcactggccgaggacttcgtcatgggcgtgctgttcgggcacgccttctcccgcccggtggaggacgcgctcgccgcgccgccgccgctggggctgcggatgccactggcggccgggttcgggcggtcgctgaagcggcgt

SEQ ID NO: 3347 - DNA, 951 bp, Streptomyces avermitilis
  CDS (1)..(951)
atggtgcatcagcagaggtcacaggcccacctgtcaccgtccagtgacacagaagacatcgtcgcattgctcgctccacgccttgcgtacttcgccggggtggcccgcaccgagcacgtcacccgggccgcgcaggagatgcaggtcccgcagtccaccctctcccgctccctggtccgcctcgagcaggacctgggcgtcgacctcttcgcccgccgcggccgcacggtctcgctcaccccggccggccgtacgttcctcgcctccgtcgagcgcgcgctcgccgagatcgagcgggccgccgacgaggtgcgcgccgacgccgacccggccaccggcaaggtcgccttcggctttctgcacaccatgggctccgagaccgtgcccgggctgatccgagccttccgcgccgatcatccgcgcgtccgcttcagcctcgtccagaactacggcgaggcgatgatcgagcggctgcgggccggggagttggacctctgtctgacctcgcccgtgccggacgcgcccgacctggtggcccgccggctcgacgagcagaagctgcggctcgtcgtcccggccgaccaccgcctcgccgcacgcaagcgcgtgcgcctcgccgaggccgccgacgagaccttcgtgaccctcgaacccggttacgggctgcgccgtatcaccgacgacgtctgccaggaggccggtttcagaccgcgcatcgccttcgagggcgaggaggcggagacgctacggggcctggtcgccgccgggctcggggtcgccctcctgccgccaccggccgtgccccgcccgggagttgtcgagctgacggtcacggccccgcgcgcggtccgcgagatcggcgtcgcctggctggacggccacccggacacaccgccggtggccgccttcaagaagttcctgctgtccagaaggggacatctgctgcccgac

SEQ ID NO: 3348 - DNA, 1290 bp, Streptomyces avermitilis
  CDS (1)..(1290)
atgccttccgccagtaccgaggcgcccgccaccgtgggcgccgtcccgtccgtttccgccaccgccgaccccgccgccgactcccgtatggccccgggcgggcccggttaccgccggatgagcttcgccctcttcctcgccggggtggcgaccttcgcgctcctctactccacccaggctctcctcccgctgatctcctccgacctcggggtgaccgcgagcgaggcgagctggacggtgtcggccgcgacgggcggcctggcgctgttcgtgctgccgatgagcgcgctgtcggagcggttcggacggcgtacgttgatgacggcgtcgctggcggtcgcggtctcggtgggtctgctggtccccttcgccccgtcgatcggcgcgctgatcgcgctgcgggcggtgcagggcgcggcgctggcgggcctgccggcgtcggcgacggcgtatctggccgaggaggtccgccccaaggcgctgatcaccgcgatcgggctgttcgtcgcgggcaacagcgtcggcggcatgagcggccgggtcatcaccggctgggtggcacaggagtggggctggcgggtcgccgtcggcacgatcgggttcctcgcggtggcctgcgcgttcgcgttccggctgctgcttccggccccgaagcacttcacgccgggctcgctgcggccccgcgtgctggcccgcacggtccgcgaccacctcgccgacccgctgctgtgccggctgtacgcgatcggcgcgctgttcatgatggtgttcggcggggtctacacggtgatcggctaccgcctcacggaggcgccgttctcgctgccgcagggcatcatcggctcggtcttcctggtgtacctggtgggtacggtctcggcgtcgacggccggacggctggtcgaccgcctcggtcggcggggctcgctgtacctggcgggcggtacgaccacggcgggcctgctgctgtccctggccggctccctggtgttcgtgctgctgggcctggtgctgatcacggcgggcttcttcgcggggcacgcggtggcgtcgtcggcggtgagccacacggcgaagcggggccgcgcccaggcctccgccctgtaccagtccgcgtactacatcggctccagcgcgggcagcacgctcggcgcggtcgccttccacgcgggcggctgggcgggcacggtcaccctgggcctgctcgcggtgctcggcgtcgtgacgatcacggtgttcggctcgcacgcggcacgggcgcaggcgcgacggagtccggtgccggcgcac

SEQ ID NO: 3349 - DNA, 1128 bp, Streptomyces avermitilis
  CDS (1)..(1128)
atggagttccaggtcgaacgcggggcgttcgccgaggcggtgggctgggcggcccgcgcactgcccgcgcgttcgccggtgccggtactgggcgggctgctgctgacggcggacgcggggcggctgagcgtctcggggttcgacttcgaggcggccgcgcgcatcgggaccgacgcggagacagtggcggaagggcaggtgctcgtcctcgggcgcaggctgctggacatctgccgggtgctgccggacggtccggtgagctgtgtgctggaggggacgcggttcacggtggaggcgggcggcacccggttcggcctgtcgacgctgccgcgcgaggagtacccggcgctgcccgtaccgcccgagccgtacggcagcgtggacgccgacgcgttcgcgagcgccgtctcccaggtcgccgtcgccgccggacgcgacgacaccctgccggtgctcaccggcgtacagctgcgcctggacggcgacgcgatgacgctggccgcgtcggaccgctaccgctatgccgtgcggacgctggggtggcagccggaggcggcggccgacggagtcgtggaggcgctgctgcccgcgcggcggctgctcgacatcgcgcgctcactggcccgctccggtgacgtccgcatcggcttcgaccgggcggccggcgggctgatcggcttcgagggcggtcggatgcgtacggtcgtacggctgctggaggggcggctgccgaagtacgggtcgctgttcgccgtggcgggggccgcggtcgccgaggtcgagtgcggggcgctggcggaggcggtacggcgggtcgcggtggtggcggaggcgaacagtccggtgcggctggacttctcggcgccggacgggacggtgctgctgggcgccgggtacggcgacgacgtggccgcgcagcggctgcccgccgtgctgagcggtgccgaagaggtcacggcggcgttcaacccggggtatctgctggacgcgctgaactccttcgaggcgccccgggtgcggctggagctgctgggggccggacagcggacgctgctcacggcggtggcggacggcggcgagccggacaccgcgcaccggcatctgctcatgtccgtgaggcaactggtc

SEQ ID NO: 3350 - DNA, 1002 bp, Streptomyces avermitilis
  CDS (1)..(1002)
atgagtgacggcacggcgacgacggacctggacgtccggctggagaagcaccgggtcgagctgaccgggtactgctatcggatgctcggctcctccttcgaggccgaggacgcggtgcaggacacgatggtccgcgcctggcggagctacgagaagttcgagggccgctccagcctccgctcctggctgtaccggatcgcgacgaatgtctgtctggacatgctgacggcgggcaacaagcgcgcccggcccatggacctgaccgactccacccccctcgcccaggccgcgctctccccgcgccccgacagcacctggctggagccgatgcccgacgtgcgcgtgctgccgacggcgagcgacccggccgaggcggccgtggccaaggagtccgtgcggctcgcgttcatggccgcgctccagcgactgccgcccaagcagcgggcggtgctgatcctgcgcgaggtgctggcgtggaaggcgagcgaggtcgcggagctgctcgacacctcggtcgcctcggtcaacagcgcgctccagcgggcgcgggcgacgctcgccgacagcgagggcgccgccgcggacgccgccgtgtccgacccgctcgacgaggagcagcagaagctgctggagcgctatgtggcggcgttcgaggggtacgacatggcggcgctgacggcgctgctgcacgaggacgcggtgatgacgatgccgccgttcgacctgtggctgtgcggcacgccggacatcaccggcttcatgaccacgctcggcgcggcctgcgcgggctcgcggctgctgccggtccaggtcaacggcctgccgggcttcgcccagtacaagccggacccggaggcgggcggtttcactccctgggcgctccaggtcctggagatctcagacggccggctcaccgggttccacttcttcctcgacacgaagcgctggttcccgctcttcggcctccccctccacctcgaagcggaggccgacgagatcgag

SEQ ID NO: 3351 - DNA, 384 bp, Streptomyces avermitilis
  CDS (1)..(384)
atgagttccaccgcccgccccggtctaccgaacgtggatgccatgacacccgcagtactggtcctgcccgccgccgtcagccaggacgccgtggcgaggctgtgcgaggacgtgcgcgcgctgctggagtccaccggcgcgggtgtggtcgtgtgcgacgcggctgcgctcgggccgccgggcctggcggccgtcgacgcgctggcccgcctggagctggccgcccgccggaccgggggccggatcagggtccgcgccccggctcccgccctgcgcgcgctactcgatctcgtcggcctccgcttcgaggtggagggggaggccgaagagcgggaaccagcgcttcgtgtcgaggaagaagtggaacccggtgagccggccgtc

SEQ ID NO: 3352 - DNA, 1281 bp, Streptomyces avermitilis
  CDS (1)..(1281)
atggccatggacgccatctccgtcatccgcaccaagcgtgaccgcggtgagctcagcgacgcgcagatcgactgggtcatcgacgcgtacacgcggggcgaggtcgccgactaccagatggccgccctcaacatggcgatcctgctcaacggcatgaaccgtcgcgagatcgcccgctggaccgccgcgatgatcgcgtcgggcgagcgcatggagttctcggcgctgtcccgcccgaccgccgacaagcactcgacgggcggcgtcggcgacaagatcacgctcccgctggcccccctcgtcgcggcctgcggcgcggccgtcccgcagctgtcgggccgcggcctcggccacaccggcggcacgctggacaagctggagtcgatccccggctggcgggccctgctgtccaacgaggagatgctgcacgtcctcgacacgacgggcgcggtgatctgcgcggcgggcgacggcctggccccggccgacaagaagctgtacgcgctccgggacgtcaccggcacggtcgaggcgatccccctgatcgcctcctcgatcatgtcgaagaagatcgcggagggcaccggctcgctggtcctggatgtgaaggtcggctccggcgccttcatgaagaccatcgaggacgcccgcgaactggcctccacgatggtgggcctgggcaccgatcacggcgtgaagacggtcgcgctcctgacggacatgtcgaccccgctgggcctgacggcgggcaacgccctcgaggtccgcgagtcggtggaggtgctggcgggcggcggcccggcggacgtcgtcgagctgaccgtcgcgctggcccgcgagatgctggacgcggccggtgtgaaggacgcggacccggcgaaggccctggccgacggctccgcgatggacgtgtggcgccgcatgatcgccgcgcagggcggcgacccggacgcgcagctgcccaccgcgcgcgagcggcacgtggtgacggccccgtcctcgggcgtcctgacccgcctggacgcgtacgacatcggcgtcgccgcctggcgtctgggcgccggacgcgcccgtaaggaggacccggtgcaggcgggcgcgggcatcgagatgcacgccaagccgggcgacacggtgaccgcgggccagcccctgctgaccctgcacacggacacccccgagcgtttcgagtacgcactggagtcggtggacggctcgtacgacatcgcgcccacgggcacggacttcaaggccacgccggtggtgctggagcgtatcgcc

SEQ ID NO: 3353 - DNA, 414 bp, Streptomyces avermitilis
  CDS (1)..(414)
gtgacgtccggcgccggcgccgggtccgcggccgtcgactgggaggccctgcgggccgtggcacgggacgccatgtcccgggcgtacgcgccgtattcgggctacccggtcggggtcgcggccctggtcgacgacggccgcacggtctccggctgcaatgtcgagaacgcctcgtacgggctcggcctgtgcgccgagtgcgggctggtctcacagctccagaacaccgggggcggccggctgacgcacttcacctgtgtcgacggccgcggcgagatcctcgtcccgtgcggtcgctgccgccagctgctgtacgagttcggcggcgccgagctgctgctggagacgccggccgggatcgtgccgctctccgagatgctgccgcaggccttcgggccgggccatctcacccag

SEQ ID NO: 3354 - DNA, 1251 bp, Streptomyces avermitilis
  CDS (1)..(1251)
gtgaccgtcgccaagccgcaggcgaagaagcccggcaagggcagccgccgcatgtccctcccggtactcctgctcgtcatcgcgggtgtgctggtcctgacctcggtcgtccgcctgatcaccggcgcggacggcatcacctcgaccggacagatgtccacggcgctgcgcctcgcggtgccgatcggcctcgcgggcctcggcggtctgtgggccgagcgcgcgggcgtcgtcaacatcggcctcgagggcatgatgatcctcggcacctggttcggcgcctgggccggttaccagtggggtccgtggaccggtgtcgccttcggcatcatcggcggcatgctcggcggcgtcctgcacgccatcgccacggtgacgttcaacgtcaaccacatcgtgtcgggtgtggcgatcaacatcctggcgctcggcaccacccgctacctctccaagttcaccttcgagaacgagccggggggctcctccaagcagtccccggggatcgactcgctgggcaccttcgacatcccaggcctgtccagcggcctgaacacactcaacgagaagcactggttcctggtctcggacatcgcgggcctgatcggcggtctggtcaccgacctgtcgccgctcaccgtggtcgcggtcgcgctcgtcccggccacctggtgggtgctgtggcgtacggccttcggcctgcgcctgcgctcctgcggtgagaacccggtggccgccgaatccctcggcgtcaacgtctacaagtacaagtacctggccgtgatcatctccggcggcttcgccggcctcggcggtgccttcctgtcgatcgtcgcctccaacgtctacctggacggccagaccgcgggccgcggctacatcggcctcgccgcgatgatcttcggcaactggatgccgggcggactcgcgctcggcgccggcctgttcggctacaccgacagcctcaacctgcgcggcggcaccaccaacgtccacgcgctgatcctgctgctggcgatcctgctggtcttcggggcggcgtatctgctgtggaagaagcggtacaccccggccgtggtcaccgccgtggtgtcggcgctgatgttcctctggtacacctccaccaacgaggtgcccaagcaggtcgtcagcgcgacgccgtacatcgtgacgctgctggtcctgtcgctgtccgcgcagagtctgcggatgccgaaggcggacggcatgccgtaccgccggggacagggcaag

SEQ ID NO: 3355 - DNA, 1128 bp, Streptomyces avermitilis
  CDS (1)..(1128)
atgaagaagttcgacaaggagcgcgtgctccttgcggtggccggcccggccatcgcgctcgtcgcggcgatcgccctgacatcgatcgtgctgctcgcctcgggccgcagcccgttcgagccgtactccctgatgctcgagcaggcgacgttctccgacgtccaggtgctgatcatcaaccaggcgtcgatgtactacatcgccgcgctcgcggtggccctcggcttccgcatgaacctgttcaacatcggcgtcgacggccagtaccgcctcggcgcggtgatgacggcggtggtcggcgcgcacatcgcgctgccgtccttcctccagatcccgctcctcatgctggtcgccatgctcaccggcgccttctgggccggcatcgccggtgtcctcaaggtcacccggggagtgagcgaggtcgtcgcgacgatcatgctcaacgcgatcgccaccagcctcatcggctacctcatgctcagcgacaacttcggtgtgcaggtcggcaacaacaacaccaccggcatcatgaaggagtccggctggatccccggcatcaacctcggcgcggacgtcggcgagatctacggcctggtcttcctcgcggtcgtcctgggcatcctgtactggatcgtgctcaaccgcacccgcttcggcttcgacctgcgcgccagcggcgcctccgagtccgccgccgcggcctccggcgtcgacgccaagcgcatggtgctcatcgcgatgctgatctccggcgccgtctcgggcctggccggtctgccgctgctgctcggcgacgtccacacctacagcctgagcttcccggccggcctcggcttcaccgccatcggcatcgcgctgctcggccgcaaccacccgggcggcatcgccctcgccgccctcctgtgggccttcctcgacaaggcgtccccggccctcgactacgccaccccggtggcgtacgagaaggagatcgccacgatcatgcagggcctgatcgtgttcgcggtcgtcatctcgtacgaggccgtacgcgtctggggcctgcgccgccagcagaagcgcgtcggcgccgagctggccgcggccgccgcccacaacaactccgagaagaaggaggtggctgcccga

SEQ ID NO: 3356 - DNA, 1581 bp, Streptomyces avermitilis
  CDS (1)..(1581)
gtggtggccaaccacgacatccacctgactgtccggaagggcacggtccacgccctcgtcggtgagaacggcgccgggaagtcgacactgatgaagatcctctacggcatgcagaagccggacgagggcacgatcgccgtcgacggtgagcaggtcgccttccacagccccgccgacgccatcgcccgcggcatcggcatggtgcaccagcacttcatgctcgccgacaacctcacggtcctggagaacgtcgtcctgggcagcgagaagctgtacggcatcggcggcggcgcccgtaagaagatccgcgagatctccgaccgctacgggctgaacgtgcgccccgacgtcctcgtcgaggacctcggtgtcgccgaccgccagcgcgtggagatcctcaaggtcctcttccgcggcgcccgcatcctgatcctggacgagcccaccgccgtactcgtgccgcaggaggtcgacgcactcttcgacaacctgcgcgagctcaagtccgagggcctcgccgtcatcttcatctcgcacaagctgggcgaggtgctgtcggtcgccgacgacatcaccgtcatccgccgcggcacgacggtcggcaccgccgttccgtccgagaccaccccccgccagctcgccgagctgatggtgggcagcgagctgccgacgccggagaccgccgagtccaccgtcacggacaagcccgtcatccaggtcaagggcctcacggtcttcgccggcggtgccgcctccctcggcgagttcgacgaaccgtcggccaccggtctgctcacggaggacacggccgagaccgccggcggggtgcggcgcgtcctcgacgacgtcaccttcaccatccacgcgggcgaggtcatgggcatcgccggtgtcgagggcaacggccagaccgagctcatcgacgcgctgatcggcctcaagcacgccgactccggctcgatcggcttcctgggcgaggacatcacgtcgtggcccacccgcaagcgccgcgagcagggcgtcggttacatccccgaggaccgccaccgccacggcctgctcctggagtccccgctctgggagaaccgcatcctcggccacgtcaccgagcggcccaacgcgaagggcttctggctcgacatcaagggcgcccaggacgacacgcgccggatcgtcgaggagtacgacgtccgtaccccgggcatcgacgtcaccgccgcctccctgtccggcggcaaccagcagaagctgatcgtcggccgcgagatgagccacaacccgcgcttcctgatcgccgcccaccccacccgcggtgtggacgtcggcgcgcaggccgcgatctgggaccagatccgcgaggcccgccgcgagggcctggccgtcctgctcatctcggccgacctggacgagctgatcggcctctcggacaccctcagggtgatctacaacggcaggctggtcgccgacgccgatcccgccaccatcacgcccgaagagctgggctcggccatgaccggcgccgcctccggccaccttgagcacgccgagtccgcagcggacttgggggaggacgagacccga

SEQ ID NO: 3357 - DNA, 2408 bp, Streptomyces avermitilis
  CDS (1)..(2406)
gtgcgtctgatatctcggaggacgagattctcccgagccgcggtgaccgtcgcggtcgtcgccctcgcggcagccggttgcggtaagtccagcaacgaggccgacagcggttcggacaagagctcgtccggctacaccggcaagggcatcggtctcgcgtacgacatcggcggcaaaggcgaccagtccttcaacgacgccgcgtacgccggattcgagaaggccgagaaggagttcaagatcggcggccgggacatcgagccgcaggacggcgagtcgaacgccgacaaggtccagcgtctggagcagctcgccaaggccggctacaacccggtcatcggtgtcggcttcgcctacgcccccgccgtcaaggaagccgccgcgaagtacccgaagaccaccttcggcatcatcgacgacgagcaggtcaaggcggacaacgtcgcggacctcgtcttccacgaggaggaggcctcctacctcgccggcgtcaccgccgccaagaccaccaagtcgaacgtcgtcggcttcatcggcggcgtggacgtcccgctgatccacaagttcgaggcgggcttcgcgcagggcgtcaaggacaccaagaagggtgtcacggtcaagtcgcagtacctgaccgagaccgccgccgagggcgggttctccagcccggacaagggcgaggccgcggccgagggccagatcggcgccaaggccgacgtcgtctacgccgccgcgggcctgtccggtcagggcgtcatccaggccgccgccgagcacaaggtgtgggcgatcggtgtcgactccgaccagtacaagcaggacgcgctggccaagtacaagaactccatcctcacctcggcgatgaaggacgtggccggcgcggtgtacaacctgtccaagtcggtgcacgacggcaagccgctgaccggtgtggtccgcgccaacctcaacaccggcggtgtcggcttggccgactccaacccgaccttcaaggacatcaccgacctgcacgccgcgctcaacaaggccaaggcggacatcatggacggacctgccagcatgcacactaggcgactgcccgttattatacagcaccagcgacgtgcgaaaaccctcgcacttacccaacttagtgcccttcatgcgacttcttcccgaccccgcccatgcggccgttccgccccgtccccgttgcctcccgcaagcggcgcgcagcgttccgtaatctgtggggcatctgtggccacagctcggtaacggaccggacagaaggggttttccgtctcgtctacgcgcgttacgctgcggcggaaccagcgcctggtttgggcgcttgcacaaaggagtcacgttccatgcgccgggtgtcccgaatcgcggttgcgggcgttgcgaccgctaccctcgccgtctctgttgccgcctgcggcaactcgtccagcgagtcctcgtccagcagcagcagcggcggcacggccaagggcgttgccctcgcctacgacgtcggcggcaagggcgaccagtccttcaatgacgctgccaccaccggtatggagaaggccggcaaggagttcaagaccgccaccacggccgtcgagccgcaggacggcgagtccgacgccgacaaggtgcagcgtctggagcagctcgccaagtccggctacaacccggtgatcggtgtcggcttcgcctacgcccccgccgtcaaggaagccgccgcgaagtacccgaagaccaccttcggcatcatcgacgacgagcaggtcaaggcggacaacgtcgcggacctcgtcttccacgaggaggaggcctcctacctcgccggcgtcaccgccgccaagaccaccaagtcgaacgtcgtcggcttcatcggcggcgtggacgtcccgctgatccacaagttcgaggcgggcttcgcgcagggcgtcaaggacaccaagaagggtgtcacggtcaagtcgcagtacctgaccgagaccgccgccgagggcgggttctccagcccggacaagggcgaggccgcggccgagggccagatcggcgccaaggccgacgtcgtctacgccgccgcgggcctgtccggccagggcgtcatcaaggccgccgccgcgcacaaggtgtcggcgatcggtgtcgactccgaccagtacaagcaggacgcgctggcgaagtacaagaactccatcctcacctcggcgatgaaggacgtggccggcgcggtgtacaacctcgccaagtcggtgcacgacggcaagccggagaccggtgtggtccgcgccagcctcagcaccggcggtgtcggcctggccgactccaacccgaccttcaagaacaacgccgccctgcaggccgcgctcaagaaggccgaggcgggcatcaaggacggttcgatcaaggtcaagaccaac

SEQ ID NO: 3358 - DNA, 1251 bp, Streptomyces avermitilis
  CDS (1)..(1251)
atgtcccgagagtccgaggccgatttccccggggacgcagagctccccggcgcgctgcccgaggcactgcgcgccgaactcgtggcgttccgccgcgacgtgcacatgcacccggagctcggcaaccaggagttccgcaccaccgcggccctcaaggcacgcctggagaaggccgacctccacccccgcgtgctcgacaccgggaccgggctcatctgtgacatcgggaacaccgccgagaccggcgacggggcgcaggccgccgacgccggcccgaggcccatgctcgccctgcgcgccgacatcgacgccctccccatcccggacgccaaggtcgactgcgcgtaccgctccacggtgccggaccgcgcccacgcctgcggccacgacgtccacaccaccgtggtcctcggcgccgggctcgtcctcgccgagctgcacagccaggggcgtctcccgtaccccgtgcggctgatcttccagcccgccgaggaggtcctgcccggaggcgcggtcgacgccatcgcgtcgggtgcgctggagggtgtggggcggatcatcggcgtgcactgcgacccccgggtcgacgccgggcgcatcgggctgcggcacggccccatcacctccgcctgcgaccggctcgaagtggcgctcaacggccccggcggccacaccgcgcgcccccacctcaccaccgacctcgtcaccgccgccgcccgcgtcgccaccgatgtgccggccctggtcgcccggcgcgtcgacgcgcgcagcggactcgcgctgacctggggacgtatcgagtccggccacgcctgcaacgtcatcccgcagcgcgcggagctgtccgggaccgtgcgctgcctggacctcaacgcctggcgggcggcacccgacctcgtgcacgcggccatcgacgagatcgccggtctctaccgcgccaagaccgagatcaactacgtccgcggggtgcccccggtcgtcaacgacccggccgtctccgacctgctgcacgacgccatgaccgcccgccgcggcccggactccgtcgaggacaccgagcagagcctcggcggcgaggacttctcctggtatctggagcacgtgcccggcgccatggcccgcctgggcgtccgcaagccgggcgagcgcgtcgtccgtgatctccaccagggcgacttcgacgtggacgagcacgccatcacggtcggcgtcgagctcttcaccgcggccgccctcctggacgccgcacgg

SEQ ID NO: 3359 - DNA, 1071 bp, Streptomyces avermitilis
  CDS (1)..(1071)
atgagcccccgcgccggatccgccggcccccacactctcgccttcgtcgagagtccggtacagctgttgaacgtcctcgaatgggcgtacacgaacgcgctgcacgaccccggcgcggggctcacgctcgtcgtcctctctcccacggacccgatgacccgcggccagctgcgccgtatggccgaactggcccgcgacgaggggtacgaggtccgctgggaggaggcgcggggcggtccgacggcgccgttccacacgatcggcggtctggcgggcgtgctgcgccgggcggaccggatcgtcatgggagaccccttctcccgctacgtacaactgctgctgacgatcacccgcgcccgtgaactggtcgtcgtggacgacggcacggcgacgatggagttcgtcgcccagctcgcccgcggcgaacgtctggtgcgctggcaccgcaagggcggccgaccgggcccgcgcgacctgctcttcgccccggtgtcgtcgtcggcgcgccgccggctgacgccgagcgcgcaccgcaccgtcgaggtgttctcgtcgatgccgatcgactcggcgcccgagggcgtcaaggtcacgcggaacgacttctcctggacccgcgtccgcttcggcccgccgcgcctgaccaagggcgccgacctggtgggcacgtccctggtggagacgggcgtggtggacggcgaccgctatctggaggcggtacgggccctggccaaggcgcacggcgcgacgcgctacttcgcccaccgccgcgagagcacggacaaactccgccgactggccgcggagacaggcctggagatcgtccgccccgaccttcccctggagctgatcgcccgccgtggcccgatcggccgtacgatcctgagcttcccctcgacggtggtccacacgctgccgctggcgctggccggcacggaggtccgcgtcgcggtctgcgacatcgacccgacatggctgacggagaacgcgtcaccgcgggcacaggggttcctgtcgggggtgacggggacggcgcgggacgtgcaccggctgtcggcggtgcgcatggcg

SEQ ID NO: 3360 - DNA, 933 bp, Streptomyces avermitilis
  CDS (1)..(933)
atgagcaactcccgtctgcgcagcttcggttccaagaccgccggcccgggccaccccgtctacgtcgtcggcgagatcggcatcaaccacaacggtgagctcgagaacgccttcaagctgatcgacgccgccgccgaggccggctgcgacgccgtcaagttccagaagcgcaccccggagatctgcaccccgcgcgaccagtgggacatcgagcgcgacaccccctggggccgcatgacctacatcgactaccgccaccgcgtggagttcggtgaggacgagtaccgccagatcgacgagtacgccaagagcaagaacatcgactggttcgcctccccgtgggacaccgaggccgtcgccttcctggagaagttcgacatccccgcccacaaggtggcctccgcgtccctgaccgacgacgagctgctccgcgccctgcgcggtacgggccgcacggtcatcctctccacgggcatgtcgaccccgaagcagatccgtcacgcggtagaggtcctcggctcggacaacatcctgctctgccacgccacctcgacgtacccggcgaaggccgaggagctcaacctccgcgtcatcaacaccctccaggccgagtacccgaacgtcccgatcggctactccggccacgagacgggcctgcagaccacgctcgccgcggtcgccctcggcgccacgttcgtcgagcgccacatcaccctcgaccgcgccatgtggggctccgaccaggccgcctccgtcgagccgcagggcctcacgcgcctggtccgtgacatccgcaccatcgaggcctccctcggcgacggcgtcaagaaggtctacgagtccgagctcggccccatgaagaagctgcgccgggtcccgggcgtcgtcgccgaggcggagatcgcggcggcggcgggcgagccggtagcggtt

SEQ ID NO: 3361 - DNA, 1296 bp, Streptomyces avermitilis
  CDS (1)..(1296)
atgtcccactcggaagcgggccaagcggcttcggtgcgccgtgtgctcgcggtgatccccgcgcgcggcggctccaagggcgtgcccgcgaagaacctgctgccggtcggcggcgtaccgctggtggcccgcgccgtccgcgagtgccgggcgacccggctcgtcacggacgtcgtcgtctccacggacgaccacgccatcgccgccgcggcccgcgaggccggcgccgaggtcgtgctgcggcccgccgccatcgccggcgacaccgccacctccgaggccgccgtcctgcacgccatggacacccatgaggccctgcacggcgcggcggtcgacgtggtcctgctggtgcagtgcaccagccccttcatcgtccgcgaggacgtggacggagtcgtccacgccatcgtcggcaagggcgcggacacggcgctgaccgtggcccccttccacggcttcgtgtggcgcgacgccgacgacgcccccggggcgctcggcgccgagcgcgccgccgtcgagggcggcacggacaccctggtcaccggcaccgccaccagcggcggctacggcatcaaccatgacaagtccttccgcccgcgccgtcaggaccgcccccaggacctcctggagacgggcgccgtctacggcatggacgcgacgggcttccgcgaggccaggcaccgcttcttcggccgcaccgagctggtccgcaccgacccggcccgggtcctggagatcgacgacccccacgacctcgcccgcgcccgggccctcgcgccgctcttcgacgcgaaccggcccggcgccctcccgaccgccgaagacatcgacgcggtcgtcctcgacttcgacggcacccagaccgacgacagggtgctgatcgactccgacggacgggagttcgtctccgtgcaccgcggggacggcctcggtatcgcggccctccgcaagagcggcctgacgatgctcatcctgtccacggaacagaacccggtcgtcgccgcccgggcccggaagctcaagattccggtcctgcacggcatcgaccggaaagacctcgcactgaagcagtggtgcgaggagcagggcatcgcgcccgagcgcgtgctctacgtcggcaacgacgtcaacgacctcccgtgcttcgccctcgtgggctggccggtggcggtcgcgagcgcccacgacgtcgtgcgcggcgccgcacgcgcggtcaccaccgtccccggcggcgacggcgcgatccgagagatcgccagctggatcctcggcccctctctcgactccctcgacaag

SEQ ID NO: 3362 - DNA, 1353 bp, Streptomyces avermitilis
  CDS (1)..(1353)
gtgccagcaagtactacgaagtccctgcgggtcgccgtcctggccgattccgatacccggtggaaatggggcgcgctcaccgcgaaccgcgtatcaccgaatgaatcggacattcggctcgacggcttcctgctgcggggccgtgccacccccaccccccgccagctcgaagaggtcggcgtccgcgcggactccctgcgcgaggtcaccgccgtcgagttcctgcgccatatgaagggggagacgtacgacatcgtcgtgctcgccctcgtcggcggcgccgtccaggcggtgctgcacggactcgggcacgcccggcagggacacgagaagcggcccgtggtcgtcaccggctatgtcggcgtcgtctacgagaagctcgccgacggcctcctgctgcgccacggcgcggacctcgtcctcgccaactcccgtcaggacgcggagcgtttcagggccgtgttcgagggagtgggcgccgacgcctcggcggtgaccgaggtggcgctgcccttcctcggcgggcggccctacgccgggaacgacccgtccgcacagcgggggagcaggccctacacggtggtcttcgccgcgcagccctccgtaccggagaggcggggggaccgtacgtacctgctgaaccggctggtccagcacgcccgcctgcacccggaccgcgaggtgctgctcaagctgcgctccaagccgggcgagcacaccacgcacatcgaggagctgccctaccagaagctggcgcagcggcttcccgacggtctcccggccaacttccgtctggtgtacggaaacatgggcgaggtcctcgaccgctccgacctgctcgtcacggtcagctccacggcggccctggagtccctgcaccgcggcatccccaccgtcgtcctgacggacctcggggtgcgcgaggcgctcggcaaccaccacttcgtgggctccggctgcctggcctcctgggaccagctcgacgccggccaccgaccgctgcccgaccccacgtgggtggcccggcagggcgtcgccgctgggggcaccccctctgggggagggtcgtacgagacggccttcgacgcggcacgcgaacggatcgccgggctgctggccgccggcgaactccccccgctggcgccctactacacacccgtcaccgcgcccggctacctccccggcatcctcgcccgccaccacctcgccccggacggcagcccgctgcccggagcgcccgccgccgacaaggagcccagccccgtacggcagatggtgcgccgggcggcccgcggcgcctaccgccacggagtgcagcgcgtggcgcccgtcatccggcggatgggggagctg

SEQ ID NO: 3363 - DNA, 978 bp, Streptomyces avermitilis
  CDS (1)..(978)
gtggtcaagctctccgtcatcgtgccgttctacaacgtgcagcaatacgcgcccgacaccctgaagagcctgcgtgcgaacgcgggcgacgacttcgaattcattctcgtcgacgactgctcgcgcgacgaaaccccggacatcctcgcgcgtgcggagcgcgagctcccgggcgcggtgcatgtcagacacgagaagaacggagggctcgcgaccgcacgcaacaccgggatagacaccgcgcgcggcgagtacctgacgttcctcgacggggacgactggctcgctcccggctatttcccccaactcctgtccgccatcgaggagttggggtgcgacttcgttcgtactgatcatgtccagtgcaccgcgcgggcccgcaccgtcaaccgggtgccgcacggccggcgcggtgtggtgatgaacccgcgcgacgcgatcctgcccgccgaccggtccacctccgtcgactacgcgtacgcctgggcgggcatctaccaccgccggctcgtcgaccgcgggctgctccacttcaccgacgggctgcgcaccgccgaggaccggccgtggatctggaagctgcaccgggaggccgaatccttcgccacggtgggactgctgggcgtcttctaccggcgcggtgtcgcctcctcgctgacccagatcggcgacgtacggcagctggatttcattcgcgcgttcgaccaggtggtggccgaaaccgcgaaggaccgtgacgcggataaattgctccccaaggcagttcgcacatattgcgcaatcatttcccaccatctgggatccatcgaaaggttcgagccaccggtggcacggaaactgaagtcgatgagcgccgtcgcactgcgccgtatgccgcaggacgtgctcgaagaggcactggactcgatggacatccagcgcgcctcacgcctgcgccggctgcgccgccgtcccgcgaccgccgcgggggtgcccgcg

SEQ ID NO: 3364 - DNA, 1332 bp, Streptomyces avermitilis
  CDS (1)..(1332)
gtgaccacccagatcttcctcgcgtcgacgctgtacggcgcggcgacgctcgccgcggcgctggacaccgagtgcttcgcccccgccgaccgccgtatcctgctcgtctcgaacaacgcggcgacgcccgagacgacgcccgccctggacgagatgcccggcttcgaccacctgcgcggccgcttcgacgacgtgatctcgtggaacgagaccatctcccccttccatccgggcggctgggccccgcggctcgatgacgtgccgctgtgggagcggcatctgcggctcgcctggcggctcggcgacgacgacgtggcactggccgtcgagtcgatccaggtcaaccccgcgctcggcatcgcgcagatcttcaccggcgcgcccgtcaccgtctacgcggacggcctgatgagctacggccccacccgcaacaagatcgacccgctggtcggcacgcgggtgacccggctgctccacctggacctggtgccgggcctcgagcccctgctgctcaccgagttcggcgtcgagcccgagatcgtgccgacggacgcgttctcgaaggtgctcggcgaactcgtggacaccggcgacaccttgccggccatcgacgaacccgccctcctgctcggccagtacctctccgccctaggcatcctgaccgccgaggaggaggagaacctccatgtgcggatgctgaagggcgcgatcgagctcggtcacacgcgggtggtcttcaagccgcacccgaccgcaccggcccgctggtcgcgtctgctggagaaggaggccgagaagctgggcgccgacctgacggtgctcgacaccccggtcctcgccgaggtcctctaccagcggatgcgccccgcgctggtcgtcggctgcttctccaccgcgctgctcaccgcgtccgcgctgtacggcctgccggtcgcccgcatcggcaccgagtccctcctcgaccggctgacgccgtacgagaacagcaaccgtgtccccgtcaccatcgtcgacgcgctgctgcccctgctgacggaccgcgcggcggtgaccgagcagcgacagggcctggacgtcgaggacctcaccagcctcgtacgagccgtcggctacgcgatgcagccgaagatctgccccggcctgcgcccggcggcggagcgctatctgacgcggcagctgaccccgcacacctggcgctacttcaagcggcgtcgcctcacctcgctggcgcttccgggcgccgtaccggcccagctggccttcatcccgcgcaacgccacggtgcgccgggtggcgcgccgtgcccgttcgctgaagcgggcgacgctcgga

SEQ ID NO: 3365 - DNA, 1146 bp, Streptomyces avermitilis
  CDS (1)..(1146)
gtgcccacaccgctcgagaagcccgctgcgacggcgcccgaggccgggcagggcgccgcgggtgtccccccgcggatcgttcccaaggcgcacgcgccgcggctgcgtgcgctcgacgggctgcggctcgtcgccgcgctgatggtcgccgcgtaccactacggcggccgggacggcgacgtcaccgcggcctggggcggctccccgcggcaccagttccccaccctgcactcgtggttcgcgtacggctgtctgggtgtgcagatcttcttcgtgatcagcggcttcgtgatctgcatgagcggctggggccggccgctgcgctcgttcttcgcctcgcgcgcgtcccgcctgctgccctcctactgggcggcggtgatcatcgtgacggcggtgttcgcgctgccgacggtcgcctacaaggcggtgtcgccgagcgacgcgctggtcaacctgacgatgctccagcaacccctgggcgtggaccgggtgctgggggtctgctggacgctgtgggcggagatccggttctacgcgctgttcgccctgtgcatcgtgctgccgggcgcgacccggcagcgggtgatcctgttctgcgcgagctggacgatggcggcggcgatcgcgcaggcggcggacgagccgctgctgaacctcgtgctgatgccggagtacgcgccgttcttcgtcggcggcatcgggctctacctggtccaccgcgaccggcgggacgcgtacgcctggggcatcgtgggcgtgagctggctgatcgggcagcactacgcggtgcgcggcctgtggcacgcgccgaacccggacttcttctcgtaccggccggcgtacggcatcgtcctgatcgtcacgctggggtacctggcggtcgcggccatcgcgctcggctggctgaatcgggtgaactggcgctggctgacggtggcgggcgccctgacgtacccgttctacctggtgcacgagcacctggggtgggtcgccatcaaggtctaccaccgggacctggggattccgtcgtacgggacgttcctgttgacggtcgcgaccatgctgctgctggcctggctgctgaaccggtatgtggaggagcggctggccccgaagctgcgtggggcgctgtcgaggccgcggccg

SEQ ID NO: 3366 - DNA, 648 bp, Streptomyces avermitilis
  CDS (1)..(648)
gtggttacccagagatcccccaagctggacaagaagcaggtcgtcgagaccgccctgcggctgctcaacgaggccggcctcgacgggctcaccctccgggccatcgccaaggagctgaacgtccaggcaccggccctgtactggcacttcaagaacaagcaggcgctgctcgacgagatggcgacggagatgtaccgccgcatgaccgagggcgcgcacctcgccccgggcgcctcctggcaggagcggctgctccacggcaaccgcgcgctgcgcaccgccctgctcggctaccgcgacggtgccaaggtcttcagcggctcccgcttcaccggcaccgaacacgcggtccagctggaagcgagcctgcgctccctggtcgaagcgggcttcgacctcccccaggccgtgcgcgccacctccacggcctacttcttcaccctcggcttcgtcaccgaggaacagggcgtcgagccgctgccgggggagcgccgcgagggctacgacgtcgacgagcgcgccgcgcgcatggccgacttccccctcgcggcggccgcgggcgccgagatcttccagaactacgaggagggcttcgaggaagggctgcgcctggtgatcgcggggatcgaggcgcggtacgggatcagg

SEQ ID NO: 3367 - DNA, 1434 bp, Streptomyces avermitilis
  CDS (1)..(1434)
atgcgacttaacggcgttaaggagactgtcgtgaacacggacgtactgatcgtcggtgccggtcccaccggactcgccctcggcgtcgacctggcccggcgcggggtgcgcgccctcgtcgtcgagcgggccgaaggcctgttccccgggtcccgcggcaaggggatccagccgcgcacgatggaggtgttcgacgatctcggtgtgctggacgcgatccgcgccgccggtggctcctaccccgtcgggatgatctggcaggacggcgagcgcgtgggtgagcatcagctgttcgacccggccgaggcgagcgacgactcgccgtacgccgagccgtggatggtcccgcagtggcgcactcaggagatcctgttcgcgcggctggaggagctcggcgggcgggtcggcttcgggcgcgaggtcgtcggcctccggcaggacgaggacggcgtgaccgcggagttcgcttcgggcaccgctgtccgcgcccggtacgcggtcgccgccgacgggggccgctccgccgtgcggcgcgcgctcggaatcggcatgaccggggagacggtggacccgaacccgatgctggtggcggacgtccggatcaccggtctggaccgcgacaactggcacatcttcccgccgcgcgaggacgacggctttctcgcgatctggccgctggcgggcgcggaggacttccaggtcgtggcccagttcccggagggcacggatgccgacctgtccctcgacggcatccgcaaggtcgtcgccacgcgctcgcacctcgcccccgccgaggtgaccgaggtgcgctgggcctccgacttccggccgcgggccgcgatggccgaccggttccgcgcgggccgcgtcttcctcgcgggcgacgccgcgcacgtccactcgcccgcgggcggacagggcctcaacaccagcgtccaggacgcgtacaacctgggctggaagctgggcgcggtgctgcgcggcggggctcccgtgtccctcctcgactcgtacgaggaggagcggctgcccgtcgccgcggacatgctcgggctgtccacccaggtccaccggggcgaggtgcggcgcggggaggcgacccggcagctcgggctcggctaccgggggtcctcgctcgcggtggagacgcgcgcgggcctcgcgcgggacgcgctgcatgcgggcgaccgcgcgccggacgggatccgtggcgacgtacggctgttcgacgcgttcagggggccgcactggacgctgctggcggtcggcacggaggcggaactgccgacgctcgccggtgcccgcacggtccggattccggcgtacgaggagtacggcgccggcgtcttcctcgtccggcccgacgggtatgtgggctgggcgggcaggacggcggcgggactgacggagtacgcggcccgggtggctgtcgcc

SEQ ID NO: 3368 - DNA, 651 bp, Streptomyces avermitilis
  CDS (1)..(651)
atgtttggtgtcaccgatctccccacctacctcgcaggccttgtcctgatcgtcctgctccccggtccgaactcgctgtacgtgttgtccgtcgccgcccgcaagggcgtacgcgccggatacacggcagccgcgggcgtctggtgcggtgacaccgtgctgatgacgctgtccgcggccggagtcgcctcgctgctccaggcgaacgccctgctgttcgggatcgtgaagtacgccggggccgggtatctgacctggctcgcgttcggcatgctgcgggccgcgtgggagatgtggcggacccgccgggaccgggcggacgcggcccgggcacccgtcgcgccggtcgccggagagcggcccttccggcgggcgttcgtcgtcagcctcttcaacccgaaggcgatcctgttcttcgtcgccttcttcgttcagttcgtcgacccggggtacgcctacccggccctgtccttcgtcgtcctcggcgccttcgcccagctggcgagcttcctgtacctcaccgcgctgatcttcagcggcacgaagctggcggccgccttccgccgacgcaagcggctctccgcgggggccacgaccgccgcgggcgccctcttcctgggcttcgccgtgaagctgacactggccggcgcc

SEQ ID NO: 3369 - DNA, 1578 bp, Streptomyces avermitilis
  CDS (1)..(1578)
atggcgcgcgagtcggagtccggactgcccatcgagccggtctacgggcctgaggcgctggagggctgggatccggcccagaagctggggacgcccggcgcgtaccccttcacacgtggtgtgtacccgtccatgtacacgggtcggccctggacgatgcggcagtacgccggcttcggcacggcggtggagtccaacgcgcgctacaagcagctgatcgcgaacggcacgatgggtctgtcggtcgcgttcgacctccccacccagatgggccacgactccgatgccccgatcgcgcacggcgaggtcggcaaggtgggcgtcgcgatcgactcggtcgaggacatgcgggtgctcctcggcgggatcccgctggacaaggtgtcgacgtcgatgacgatcaacgctccggccgcgctgctcctgctcatgtaccagctggtcggcgaggaacagggcgttccggcggaccggctgacgggcacgatccagaacgacgtcctcaaggagtacatcgcgcggggcacgtacatcttcccgcccaagccctccctgcggctgatcgccgacatcttcaagtactgcaagaccgagatcccgaagtggaacacgatctcgatctccggctaccacatggcggaggcgggcgcgtccccggcgcaggagatcgcgttcacgctggcggacggcatcgagtacgtccgtacggccgtggccgcgggcatggacgtggacgacttcgccccgcgcctgtccttcttcttcgtctcccgtacgacgatcctcgaagaggtcgccaagttccgtgcggccaggcggatctgggcccgcgtgatgcgcgacgagttcggcgccaagaaccccaagtcgctgatgctgcgcttccacacgcagacggccggcgtgcagctgacggcccagcagccggaggtgaacctggtccgggtggcggtccagggcctggccgcggtgctcggcggtacgcagtcgctgcacacgaactcgttcgacgaggcgatcgcgctgcccacggacaagtccgcgcgcctcgccctgcgcacccagcaggtgctggcgtacgagacggacgtcacggcgacggtcgaccccttcgcgggcagctacgtcgtcgagaagatgacggacgaggtggaggccgcgacggtcgagctgatggcgaaggtggaggagctgggcggcgcggtcaacgcgatcgagcgcggcttccagaagggcgagatcgagcgctccgcgtaccgcatcgcccaggagacggactcgggcgagcgggtggtggtcggcgtcaaccgcttccagctcgaggcggaagagccctacgagcccctccgtgtcgacccggccatcgaggcccagcaggcggaacgcctcgccaaactccgcgccgagcgcgaccggtcggccgtcgacgccgccctcgccgacctgaagaaggcggccgagggcacggacaacgtcctctacccgatgaaggacgccctgcgcgcccgcgccacggtgggcgaggtgtgcaacgcgctgcgggaggtctgggggacctacgtgccgtcggacgcgttc

SEQ ID NO: 3370 - DNA, 855 bp, Streptomyces avermitilis
  CDS (1)..(855)
atgcgtaccaagggcatggcgggaagatcgatggccgccctcgtggcgctcgtcgcggtctgcggctgcacggcacagggcgtggacgcggacggcaaacaccgctcacccgtgcacatcgacctcccgcgcaccccgacggcgagccacccgccgacggcgagccgcacaccggccggcgacaagccgagcggcacctccacgcccgtgcccgcgcccgcccccgccaaggtcctctggtcggcgggcgacaagggcacggccgtacgcgagttgcaggcccggctgcggcaggtcgcctggctgttcgacgggccgacggggacgtacgacgatctgaccgtcaccgcggtcaggggcttccagggcaaacgcgggctgccgcggaccggcgagacggacgccgtgacctggcagcggctggtgcggatgacgcacgagccgacgaagtgggagctgtacgcgctcggcgggcagccggccgccgcaccggacccgcgctgcatgacgggccgggcgctgtgcatcagcaagacgagccggacgctccgctggatgatcgacggaaagaccgtctcgacgatggcggtgcgcttcggcgcgcagtacacgcccacccgtgaaggtgtgttcagcgtctactggaagtcccgtcaccatgtgtcgacgctctacgactcacccatgccgtacgcgatgttcttcagcggcggccaggccgtgcactactcgtacgacttcgcggcccgcggctacgcgggcggctcgcacggctgcgtcaacgtacgggacgaggtgaagatcgcggcgctgttcgcgcaggtccgtaccggggacaaggtcgtcgtctactgg

SEQ ID NO: 3371 - DNA, 1095 bp, Streptomyces avermitilis
  CDS (1)..(1095)
gtgatggccgacgagcagtacaggtggctggaccgggacgccgcggagcggctgctgcggggagagtcgctggaagccgtcgacgccgacacccggaagcaggccgaacagctcgccgaggcgctgggcgcactggccgccgaccccctcccgaacagcgcggaactcccgggcgaggccgccgcgttggccgcgttccgcacggcccgtcagggcaggaacggcgaggagaaggtcctgggcggccgcgggcgtccgcacgccgtcgcccgcgccgcgcactccgccgacgccgggctcgtacgcctcgggcgccccgagcgggccgcccgccgtggtcggctgggccgtcccgtgcgcctgggggtggcggcggcgctggccgccgggatgatcggcggtgtcgcggcggccgccggaaccggagtgctgccgacgccgttcggcggtgacgagcccgggcccaccgcgtcggtgtcggccgccgtgacgcccgagcggccgctcggctcgtcgtcgccgggagccatcggggacggcggcggatccgaggcgccgacgcccgacggcaccagcggcgcgccggtccagggcggttcctcgcacgacgaggcggacaagggctccgcggcgagcgggcggcctggggcggacagcagccggaacccggcacgttcacgcgaatggtggagcgctgtgctctcgtcctgccgcgacgtgcgcggcggcaaggacgtgggcaccgagcggatgcgcagcctggaggaggcggccggcggcggcctccgggtgcacaagtactgcaagggcgtcctcgcctacgccgaagggcattcgggttcgggttcgggcgcgatcgaccccggcgacgacgagggctccggcagggacagcggcagcggcaggggtgacagggacggcaagggcgacggagacggcacgggcgacggggacaacggaggcaggggaggtgatggcgatggccatcacatactccccggcggcagcgcccccggcggcaacggcctgatcgtcaccccgtccccgtccccgtccccgtcgcggcacgcgctcacgtcgctggtcccgaggtcc

SEQ ID NO: 3372 - DNA, 711 bp, Streptomyces avermitilis
  CDS (1)..(711)
gtgctgggggacgacgcggagctgaccgccgcggtgcttgcggcacaggacggggacgagaccgcgttccggactgtgtaccgcgccgtgcatccacggctgctcggatacgtacggacgctggtcggcgacccggacgcggaggacgtcacctccgaggcctggttgcagatcgcccgggacctggagaggttcagcggtgacgcggaccggttccggggctgggcggcccggatcgcgcgcaaccgcgcgctcgatcacatacgcatgcgcgggcgccgtcccgcgatcggcggcgacgagaccgagctgaccggcaaacccggcgaggccgacaccgcgggcgaggcgatcgagtccctggccaccgaccgcaccctttctctgatagcccagctcccgcaggaccaggcggaggccgtcgtgctccgggtggtcgtcggcctcgacgccaagtccgccgcggacacgctcggcaagcgccccggagccgtccgtacggcggcgcaccgcggtctgaagcgcctcgccgagctgctcggcgccgacgacccggaatccccgggcggcctcgacgggctccccccgcagagggacccgcaaagagacccgcagcgggccccccaaagacccccacgaagagagccgcgcacccgcgcggtgacgtccgccggtgtgacgcatctgcgttcgcggacgcagaaggacatg

SEQ ID NO: 3373 - DNA, 681 bp, Streptomyces avermitilis
  CDS (1)..(681)
gtgggcgcggacatgggtgagcgaccggacggcggggcacgcctcgacgcgttcctcgccgccgccatgcgccccaaggcccttgacgccgaggccgaggcccgggccgtcgcagccttccgggtcgcgcgcgaacaggggacgcgcgcggcccggatccgacgccgcgacgactggcggccgaagggggagcgccgggcggggcgttcgctgcggaccacgttcgccgtggtggcggccgccctgacgctcggcggcgtggcggtggcggccgtcggcggggtgcccggcgacgcccccgagggacggccccgcccttcgagcgccgcgcctgccgcttcgtccgccgcgcccggggccgacacgggggttcggcccacgggcgcgcggagggcggacgagaagagcgatcagctcaatcagggcgatcggggcaatcggggcgatctgggccataaagggaagaagagcaagaaggtcaaggacgacaaatcatcgccaaagcctgtgaaatctgtgaaatcgacgaagtcgaacaagccggaaaaggccgataaggccgataaggtcgagaaagtcgcgaaggcagcaaaggccgacaaggccgacaaagccgacaaggcggagaaagccgtgaaggctgaagcgtccgcgaaggccgaaaaggcgacgaagtcgaag

SEQ ID NO: 3374 - DNA, 687 bp, Streptomyces avermitilis
  CDS (1)..(687)
ttgggggcgtggacacggccatcgtgtcgcacggcgtgcacgcggtacgaatcggtacgggcgaggacggtattgggccagggaggggaaccccgccgggtacgggcgaacgacggggagctgggtgcggctgtcgcgcgggcccagcggggggacgaggccgccttcgcggtggcgtaccgcatggtgcagccggggatgctcggctatctgcgcgggcttgtcggcaacgacgcggaggacgtcgcgtccgacgcctggctggagatcgcgcgcgacctcggccggttccgcggcgacggcgccggattccgcggctggaccgccaccatcgcccgtcaccgggccctcgatcatctgcgccgccagcgggtacggccccaggcgacggcgctcgagaacgacgtactggaactgcccggcacgcacgacacccccgaccaggccctggagtccctctccaccgagtacgccatcgaactggtcgtccggctgccgcgcgaccaggcggaggcggtgctgctgcgcgtggtcgtcggtctcgacgggcccgccgccgcccgcgtcctcggcaagcgtccgggcgcggtccgcaccgccgcccaccggggcctcaagcgcctcgcgcagcagctcgccgccgagggtgtgacggatgagggctcccggacgctgggggagtcggga

SEQ ID NO: 3375 - DNA, 2712 bp, Streptomyces avermitilis
  CDS (1)..(2712)
gtggggtatttgagtcgccgtaagacccatgcgtacaagccgctgagtctgaagcgaaggacatggctgacgttgggggccgttgtcgcgggcggggcgggtgtcgtgacgtacgccgtcgccagtccgagcggcgacgcggccgacgacgtcgcacgcggcaagcggcccgtcgaggtgcacgacctcgcgctgaaggccggcacgagcggcagccgggagctggcgcggaccaccaccgaggccttctcgatcgtgggcgtctcctggaccggggccgcccgcgagctcgacgggaccgcccaggtgcgcacgcgcggcaccgacaccggtgagtggagcggctggcggaacctggctcccgggctccccgtcgaccggacggagcccggggcgaagaacgcccgcggcgcatccgatccgctgtgggtcgggccgagcgacggcgtccaggcgcgcgtgctcgcggccgacggatcggcacgtgccgggctgcccgagggactcgaggtcaacctcgtcgacccgggcgtcaccacgacggaggccaggaacaaaggcctcgacaccagcggcaccggcaccggcaccgacctgagcaacgccgccttcgtcgcgaaggatccgtcccagacgccgaccggaaccccgtccgggtccgccaccgagacgggctccgagcccgccccggcccccggcgactccgactcggcctccgcgacggcgaccgcgacctcgaccgcgacgacaaccgcccccaccgcccccgcctcgaccgtcgcccggccgtcgatcgtgtcccgtacccgatggggcgccgacgagtcggcggtcgccggctcgccgcagtacatcgacaggatcagcgccgtcttcgtgcaccacacggccggctcgaacgactacagctgcgcccagtccgcgtcgctcgtgcgcggcatcatggcgtacgacatccaggtcgcccagcgcggcgacctcggctacaacttcctcgtcgacaagtgcggccggatcttcgagggccgtgccggcggcgccgacctgcccgtgcgcggcgaccacacctacggcttcaacggcgactcgaccggcatcgccgtcctcggtgacttcgagggcagcgcggcctcggccgcggccaagccgtcccggtccgccgtggagtccgtggcccgtctcgccgcgtggaagctcggccagtacggcggcaacccgagcggcaccgtcacgctgaccgccgacgccgacaccggcgtgtacgccaaggacgcccaggccaccctgaacgtgatctcgggcgggaaggacgcggccaccaccacgtcccccggcaagaacctgtacggcaagctgggcgaggtccggcggtacgcgtcgagcccgggccgcagctccgcgatcccgaccgccgactacaacggcgacggcgtcagcgacctggtcgccgccacgcccaagcagggcagcggctggctcacgctcgtgccgggcgggatcagcggtcccgtctccgcctcgaagctgaagctcaaccagggcagcacgggcgtgcccggcgccgccgagtccggcgaccagtggggcgcggccacggcctggggcgacatcaacggcgacggctacgcggacctcgcggtcggcgcgcccggcgaggacgacaccacgcacgccgaccgcggcgcggtgacgatcctgtacggcccgaagttcgacaccggcgccgacaccatggcgctcggcgacgactacaaccccaacagcgcgcacttcggcgcgaccgtcgcggtcggcgacttcaacgcggacggcaaggcggacgtgttcaccgcggccaccggcaccggcggcaactgggtggcccggttcgccaacggccaggagaccgcgggcgacatcaccaccgtctccggcgccctcgcctacgcggacgccgcctccggcgacttcaaccgggacggctacgcggacgtcgccctcacctaccgcgacgcgtccggcgtcggcagggtcacctggttcaagggctcgaaggccctcggcctgtccaaggtgtccacgctcaccgtcaagggcggccgctccctcgcggccggtgacgtgaacggcaacggctacgacgacatcgtcatcggccaaccgtccgcgagcgagtccggcggcagctccggcggccaggtcaccctggtccccggcgcgtccaccggcttcaccaccaccggcatgacgacggtccaccagggcacgacgggcgtcgagggcgcctcggagtccggggacgccttcggcacctcggtctcggtgggcgacgtcaacgccgacggttacgccgacgtgctgaccggcgccccgagcgaggacatcacccgcgacgcgaagaaccgctccaacgcgggctcggtctggctcctcaagggcgcctcgtccggcctcaccggcacgggctcgctcgccctgtcccaggacacggcgaacatcccgggctccacggagaccgacgacaagctgggctcggcgctctccctgagcgacgtcacgggtgacggctacgccgacctcacgatcggcgcggagggcgaggacaccggcaccggcaccctgctgtacgtgccggtgaccggcggcacggtcaccacggccaaggccgtctactacggcatcgctcagctgggcacgtcgacgggcggccggctggggcaggtcctgacgccg

SEQ ID NO: 3376 - DNA, 456 bp, Streptomyces avermitilis
  CDS (1)..(456)
gtggggcggtcctgcgccggtgtcgggaacccctccggaacgcgtgacgaatcctggccggaacgcgcttttccgggtgtgaacgttactgaggtgacccggccccaggccgcggcgaagcccgtccgctgggccgccgacgccgtcgcgaccatgcgcgagggcgcccggctgcggctcgactactcggcgcagagcctgtggcgcgtcgaccggatgatcgaagggatacgccgcgagggcgcgccgtacgccgccgtcgaggccgtgctgcgcggattcggcgcgtacacgggcgaggtggtggtccggcacaccggcggggagtggtggacgaccggcggcgaccactgggtgcgtacgcccgacgggcggctgtgggacccgatcgacgaggcccgccgctgctacctgggcgacggctcgctgcgcctgttgtgccgcgacgcggcggac

SEQ ID NO: 3377 - DNA, 558 bp, Streptomyces avermitilis
  CDS (1)..(558)
atgagcctggtggaactgatcgcggaggccgatgaacgggggctcgcggcgagcgggttggcttgtttggatcgttgcgtaccgctcctcgggggtgacgacgaggtcctgcggccgctgtgggcgagcctcgtggagggccgcgagtgggaggaacggctcacgaaggcacgggccgaactgggcgccgccgacgcggagccgaccgaggccgaggacgaggcctgcggactcgcccgccgcatgctcgacgccgtccccgcgcagcccgcggccggcgccctgcgtgagtgggccgacgcctgctcggtcgcagccctccagatccaccggctcctcgacgccgccgacgacggccccggcccggtctcggcccgccgcgagggccgtacggagggcatgtcgccgctcgtcgccgccgaactgcgccgccaggtcaccgtcctggaactcgtcgcgggccatggcgcgggcggactgcgccgggccctcgacgtgtcgacggaggggcggcgcgtgctgcgggcggtggtctcccgacgggcgcgcggccgggcc

SEQ ID NO: 3378 - DNA, 525 bp, Streptomyces avermitilis
  CDS (1)..(525)
atggcctactggggatacttcgtcgtgggcagaagcgagcggccgctcgcggagctgggcgccctgaccgcggcgtccggcatgacgctgttgcagacggcgcccggcggctggcaggtgtgggagtacccgagcggcgacggcgacgtcggcagcatgaacgcgctcgcccgggagaccggcgcgcccgccctgttcggatacgtcatgaacagcgtctgcgtggccgtagaggccgccgcgccgcagagcggtgcctggacgacctgtctcgcccgccgcgccatggccgggtacctggccggcggccccggtgacggcgagcaggaggggctcggtgtcgaggactacttcctcaccccgggcgaggccgccgaacgcgccgtcgcctgggccgcggaggccgggcacaccgtggcccccgggccgctcgcgcaggtgctgggcgtggaccccgacccctcggagccgttggccgaaaacctcttctttcgattcctcgaccgcctcggtgtggtgccgctg

SEQ ID NO: 3379 - DNA, 1059 bp, Streptomyces avermitilis
  CDS (1)..(1059)
gtggaccgtatgttccgcgtgccatgcgtgaggttctggggagagccccgtgtggctttcaccgaccacacacctgggggacgttccaccatgctctgcacgcgctgccggcaccgcgccgcgtcgacgcccgagggactctgcacgaactgcgcgaacggcacgacaacggagtcgacggtgcccgcgacaccggacgccgccgccggggcaccgcagccggccgcacccgcgtccccgaagcctgacgcacccgggttcgcgcagtccgacgggcccgggttcgcgccgcccggtgggcccgggtccgcgccgcccggtgcgctgccgacggctccgccgctcggtgcggcgcccctgtacgcgccgggcgggcagccgtcctggctgcggtcgccggtcgggctcgggagggccaccgcggcgctgctcggggtggtcatcgccgccgatgtgttcgccgtggtggcggacttcaacatgtacgacgtgtcgggtgccctcgccgacggcgaattcggcgcggggatgcaggacaaggccgaccgcgcggacgcgctctacgcggcggccggggtcgcgcaggtggccgccctcatcgcgaccatgatcgtcttcctggtctggttctaccgtgtgcgggtcaacgccgaggtgttcgcgcccgaccggcagagcaagtcgcgggggtgggccatcgggggctggttcgtaccggtggtgaacctgtggttcccgcgccggatcgctctcgacatctgggacgcgagcggccccgacgccctctgggacggcgacctcgccgccgcgccgcgcccctcgcgcgcccgcatcaacgcctggtgggcggtgtgggtcgtctcgctgctcgccgaccgcctcgcgtcgactgcctaccggaaggccgagacggctccggaaatccataaggccgcaggtcagatgctgttctccgacgtcgtcgacatggtggcggccgtcctcgccattctcttcgtcctgcgcctgacgcgcatgcaggacgagaaggcacggcggggcccggtatcggtcgaggtg

SEQ ID NO: 3380 - DNA, 1635 bp, Streptomyces avermitilis
  CDS (1)..(1635)
gtgagcggccgcaggcggcgcgtccccgaggggaggacgcccgtcaggcgcaacaggttgctgctgggtggcgggctgatcgtcgcgggcaccctcggggtgaccgccgtcctctggccctccggcggcagcgagccggccggtgcgcgggcgtccaccgcctcctcggccgccgccgcgacccgtacgccctccccgtcaccgacccgcgcctaccccttgtcgaaggcaccgcgcacgattcccgccgtacgggagcacacggccgcccgggggccgggctggcgtccggcgaagggcggccgggtcgtcgtgggcgacgcggcactggccgacgagggcaagctgaccgcgggcgagctggggctggcgtacgcgggccggaccggtgcccgggcgggagacgtggagctggcgctcgacaagggcaccggtggcccggagtcgtacaccctgaccgtgcggggcggccgggtgcggatagccgcccccgccgaggcgggcgtcttctacggcacccgcaccctcaagcaggcggtgcacggcggcggtacggcgcccgagggcgtcgtacgcgaccggccggccaagccccgacgcggcctcatgctcgacatcgcgcgcaagcacttcacggcgggctggatcgaggaccgcatacgggaactgggcgacctcaagtacaacgagctgggcctgcacttctccgacgaccagggcttccgtatcgagtcggcctcgcatccggagatcgtgtcccggcagcacctgaccaaggcggaggtccgcgggatcgtcgacctggcggcgagccggcacatcgccgtcgtgcccgagatcgactcgcccggtcacctgggcgcggtgatcgccgcgcaccccgacctccagctgcgcaacgcctcgggggtccccgcgcgcggggccgtcgacatctccaagcccgccgccgcgaccatcgtcgacgacctgctgaacgagtacgccgatctgttccccggcgcgtactggcacctcggcggcgacgagtaccaggcgctgatggtgtccgatccgtcggcctcctatccgcagctcgccgcggccgcccggaacaagtacggggcgaacgccaccgtcgcggacctcacgaccggctggctcaacggccgcgccgacaacatgcgcgcgcaccaccggacgatgcgggcgtggaacgacggcttctaccggtcggccggcacggtccggccggccaaggacatccaggtcgcctactggaccggcaaggagatcggcgcccggcagccggccgagtacctgagcgcgggccgcaagctcatcaactacaacgacgagtacctctactacgtgctcggccagccgcagaccttcgtctacccgacggggcagcggatctaccagcagtggaccccgcgcgtcgtgcgcggcagcacggccgtccccgcgcggtacgacgcccagatcctcggcggggtcttcgcggtgtggtgcgacctcgcggcctcgcagacccaggaccaggtcgccgccgggatccggatgccgctgcgggcgatgacccagaagctgtgggatccgcggacgccgacgctgtcctggacggagttccgggcgctggcgaggcagttgggc

SEQ ID NO: 3381 - DNA, 486 bp, Streptomyces avermitilis
  CDS (1)..(486)
atgggcctggagcgcttcaacggcgtccgcgtcgacgatgccgagcgcgccctcctcacctgctgccgcagtctgcgctgggcccgccgcgtcgccgaccaccggccctatccggacctcgacgcgctgctcgccgcggccgacgaggcggcgtacgacctggcgcccgccgatctcgccgaggcgctcgcgggcgagtcgctgaccctgctcccggacgacgcgtactccgtcgcgcacaccgcgctgagcgccgcgcacgccgcgtacgagagccgcttcgggcatgtgttcgtgatctgcctggacaacgccccgcccggggaagcactcgatcaggtgctggcgggcatccggtcacgattgacaaacgatcgcgaggaggaacgcgtcctggcggcggaggagctgcggcgactggcgcgcggacggctcgcccgcctggtgcgcgacttttccccgcggcccgcactccagcgcaccccg

SEQ ID NO: 3382 - DNA, 378 bp, Streptomyces avermitilis
  CDS (1)..(378)
gtgccggctggaacgctgtaccgcggccgggaaggaatgtggtcctgggtggctcatcgagtcaccggcgtcctcatcttcttcttcctgttcgtacacgtgctggacaccgctcttgtccgtgtctcccccgaggactacgacaaggtcgtgtccacgtacaagacgccgatcgtcgccgtgctggagtacggcctggtcgccgccatcctcttccacgcgctcaacggcctgcgtgtcatcgccgtcgacttctggtccaagggcccgcgctaccagaagcagatgctctggtccgtggtcgtcctgtggctcgtgctgatgatcggggcgatctaccccgtcctcggccacgccgctcgtgaactgttcgggagc

SEQ ID NO: 3383 - DNA, 480 bp, Streptomyces avermitilis
  CDS (1)..(480)
atgtccacgactgataccgccgcctccgggatcggccccgtagagggcgcctcgctgtacggcgtcgacaacccggcgcccgtcatcgagtcgccgcgcaagcggacgaagaagaccccgaagtccacccgtggcaacttcgagatgtacggctggctgttcatgcgcctgtccggcatcgtgctggtcgtcctggtcctcggccacctgctgatccagctcgtcctcgacggcggcgtctccaagatcggcttcgccttcgtggcaggccgctgggcgtccccgtggtggcaggtctgggacctggccatgctgtggctcgcgatgctgcacggcgccaacggcctgcgcacgatcatcaacgactacgcggagcgggcgaacacgcgcctgtggctgaagggcctgctgtacaccgccacggtgttcacgattctgctgggcacgctggtgatcttcaccttcgacccgaacatccgc

SEQ ID NO: 3384 - DNA, 1752 bp, Streptomyces avermitilis
  CDS (1)..(1752)
atgaagatccacaagtacgacaccgtcatcgtcggcgccggcggcgccggtatgcgcgccgccatcgaggcgacgaagcgcagccgcaccgccgtgctcacgaagctctaccccacccgctcccacacgggcgccgcgcagggcggcatggccgccgcgctggccaacgtggaggaggacaactgggagtggcacaccttcgacaccgtcaagggcggtgactacctggtcgaccaggacgccgccgagatcctggcgaaggaggccatcgacgccgtcctcgacctggagaagatgggccttcccttcaaccggacgcccgagggcaggatcgaccagcgccgcttcggcggtcactcccgcaaccacggcgaggcgccggtccgccggtcctgctacgcggccgaccgcaccggtcacatgatcctccagacgctgtaccagaactgcgtgaaggagggcgtggagttcttcaacgagttctacgtcctcgaccagctcatcgtcgaggaagacggcgtcaagaagtccgccggcgtcgtcgcgtacgagctggcgaccggcgagatccacgtcttccaggcgaaggccgtgatctacgcgtccggcggcaccggcaagttcttcaaggtgacgtcgaacgcgcacacgctgaccggtgacggccaggccgccgtctaccgtcgcgggctgccgctggaggacatggagttcttccagttccacccgaccggcatctggcgcatgggcatcctgctgacggagggcgcccgcggtgagggcggcatcctccgcaacaaggacggcgagcgcttcatggagaagtacgcgccggtcatgaaggacctcgcgtcccgtgacgtcgtgtcccgctccatctacacggagatccgtgagggccgcggctgcggtcccgagggcgaccacgtctacctcgacctcacgcacctcccgccggagcagctggacgccaagctcccggacatcacggagttcgcgcgtacgtacctcggcatcgagccctacacggacccgatcccgatccagcccaccgcgcactacgccatgggcggcatcccgacgaacgtcgagggtgaggtcctctcggacaacaccaccgtcgtcccgggcctgtacgcggccggcgaggtcgcctgtgtctccgtgcacggcgccaaccggctcggcaccaactcgctgctcgacatcaacgtcttcgggcgtcgcgcgggcatcgccgcggccgagtactcggcgaaggccggctacctcgagctgcccgaggaccctgccgcgcaggtcgtctcgcaggtcgagcgcctgcgcgcctccacgggcacggagcgggtcgccacgctgcgcctggagctccaggagaccatggacgcgaacgtcatggtgttccgcaccgagcagacgatcaagacggcggtcgagaagatcgcggagctgcgcgagcggtacctgaacgtctcgatccaggacaagggcaagcggttcaacacggacctcctcgaggccatcgagctgggcaacctgctcgacctggccgaggtcatggccgtctccgcgctcgcccgcaaggagtcccgcggcggtcactaccgcgaggactacccgaaccgcgacgacgtcaacttcatgcgccacaccatggcgtaccgcgaggtcggcgacgacggcaccgagtccatccgtctcgactacaagccggtcgtccagacccgctaccagccgatggagcgtaagtac

SEQ ID NO: 3385 - DNA, 771 bp, Streptomyces avermitilis
  CDS (1)..(771)
atggctaccccgaccctcgacaaggcggacagcaagcccgaggcgggcttcgccgactcgccgtacatcacggtcaccctccggatccgccgcttcaacccggagatctcggccgaggccgcctgggaagacttccagctggagatcgacccgaaggaacgcgtcctcgacgccctgcacaagatcaagtgggaccaggacggaagcctcaccttccgccgctcctgcgcgcacggcatctgcggctcggacgccatgcggatcaacggcaagaaccgtctggcctgcaagacgctgatcaaggacatcaaccccgagaagccgatcacggtcgaggccataaagggcctgacggtcctcaaggacctggtcgtcgacatggagccgttcttccaggcgtaccgggacgtgatgcccttcctgatcacgaaggacaccaacgagccgacgcgcgagcgacttcagtccgccgaggaccgcgagcgcttcgacgacaccacgaagtgcatcctgtgcgccgcgtgcacgtcgtcgtgcccggtgttctggaacgacggccagtacttcggtccggccgcgatcgtcaacgcccaccgcttcatcttcgactcgcgtgacgaggccggggagcagcgcctggagatcctcaacgacaaggacggcgtgtggcgctgccgcacgacgttcaactgcacggacgcctgcccgcgcggtatcgaggtcacgaaggcgatccaggaagtgaagcgggcgctgatcacgcgccgcttc

SEQ ID NO: 3386 - DNA, 261 bp, Streptomyces avermitilis
  CDS (1)..(261)
atgaccgtccccacccccgaagccccgttcggcgtcgacccgcagggccgcccgtactccgacaagtccaaggtcgttgccggcgtcctccagctcttcctgggcaccttcggcgccggccggttctacgtcggctccaccggcgtggccctcggccagctcttcacctgcggtggcctcggcctgtgggcgctgatcgacgcgatcctgttcttcacgagcaacgaccgcaccgacaagcagggccgcgtcctgcgcggc

SEQ ID NO: 3387 - DNA, 408 bp, Streptomyces avermitilis
  CDS (1)..(408)
gtggctgaaccggcccgcgcgccgctgagcttcctgcggcacccggcggcggcacccctcgcggtgctcgccgccggggccgccggtgcctgctacctctacaccaccgacccgcacgagccgggccatgtgctgccccgctgcccgctgcggctcgtcaccgggctgctctgcccggcctgcggcggcacccgcatggtgtacgacctgatgcacggtcacttcaccgcggcctggctcgacaacaggctgctgctgctcgcctccccgttcgcgctcgggctgttggcgcgctggttcctcgagggtgtgcgcggccggcggtggcggcccgaaccgagcgcgcgtacccaggcggtggtgctgctggtggcggtcgcgtgggtagtggtccgcaacctcgtccgg

SEQ ID NO: 3388 - DNA, 498 bp, Streptomyces avermitilis
  CDS (1)..(498)
gtgttcggcgtcctgtgcaccacaaccccggagtcaaccgccttgagtgagcagcccccgcagtccccgccccccaaccagccgcccgggtacggctatccgaacgccggcgcgaccccgcccggcggaccgaacccgtacgcggccggtcagccgggctcgtaccagcagccgggaggccagtacggctacggctaccagcagcccggatacccgccgggtgccgtcccgccgggcacgtacaccggcgaccccaacgccccctacggctacgacccctacggccgcccgtactccgacaagtcgaagatcgtggcgggtctcctccagctcttcctgggcagcttcggcgtcggacgcttctacatgggcagtgtcggcatcggcatagcccagctcttcacctgcgggggcctcggcatctgggcgctcatcgacggggtcatgctgctcgcgggcaacgaggccaaggaccagcacgggcggatcctgcgtggc

SEQ ID NO: 3389 - DNA, 2469 bp, Streptomyces avermitilis
  CDS (1)..(2469)
atggcgcaccacaccccgacgtcccacctggaacgcgcgcgcaaccagatcgcggccggtgacatgggccggctcgcccacgtggtcctcaaggccgccgagcacaaccgcggccactggggcggcggctgggccgagatactggagatcctgcgcgaactgccgaggcaggagcggctgcggctcgcgggcgccctggcgcagcggtgccaggagttcgacgagggctccgccggccggcgccacgcgctgaccctggcggcggtcgtctcccgcgacctgcccgacgaactgttctccgtggagcggctgaagcagctcgaccaactcgcccggcagcactcgttctggtacggatcgcggctggaggtcctggccgaggcggagctggcagcgggccgccccctcgcgcccgccgtcgtcgcggtcctgcgccgctcggccctggtcgcctaccgcgccgaccacctcaccgagctggccgggaagctcaccgaacccgtcctcaacgtcggcgaggagtgggccgagcgcgccctccaggacgccgccggccccgactggcaggccctgctcgcgcacgcgctcaccgccaccgcctccaagcccaccgccaagtgggacaagcgggcccacgagatcatcggggcgctcggcccggaccgcgtccgcgcggccgtactgtcctggctcaccctcgtcggccgcccccgcacgttcccgctggagagcgggacggcgtacgagccggaccacaaccacgcctacgacccctacaacgccaacgccctgcgcgggctcgcctggctggtctcgctgctgccgccgcaccccggcaccccgaggacgctcggcgcgctcgtcgagacctccctgaggaaggtcgccgggctcggcccccgcaaccccaaggtcgccaacgccggcgtcatcgcgctctcccgcatcgacagtgaggccgccctcgccgaactggcgcgcctggccacccgggtgacgtacaagaacaccgccaagctgctcgacacggcccttcagacccgggccaccgcgctcggcctgagccgcgaggagatcgaggagctggccgtgcccgggtacgggctcaccggggtcggccacgccgagcaccggttcggcgaggtcaccgcgctgctcgacgtgcacggcaccaaaaccgtgctcagctggcgcaacgccgcgggcaaggaggtcaggagcgtgcccgccgccgtgcgccgcgaccacgccgaggagctcaaggaactcaagaccgcggccaaggacatcgaccggatgctcagcgcgcagagcgagcggctcgaccggcagttcctcgcccggcgcacctgggcgtacgacgtctggcgcgagcggtacctcgaccacccgctggtcggcaccctggcccgccgcctcctgtggagcgtcgacggcacctccgtcgggttcgccgacggtgagccgcgcacgctcggcggcacccccgtcaaggccggctccgaggtcaccctctggcacccggtcggacgcgagcccgccgaggtcgtcgcctggcgggactggctggagcggcacgcgatcacccagcccttcaagcaggcccaccgcgaggtgtacctgctcacggacgccgagcgcacgacgggcacgtactcgaaccggttcgcggcccatgtcgtgcgccagcaccagttcaactccctcgcggcgatccggggctggcgcaacaagctgcgtctgtgcgtcgacgacgaggcaccgcccgccacccgcgagctgccccagtgggggctgcgcgccgagtactggatcgagggtgacggggaggagtacggcgaggacaccaccgagtccggcagctatctgcggctgcgcaccgaccaggtccgcttctacccgatcgacgccccggcgaactcggcgcactgctacggaggcgagtaccgcatgtggctgcgcgacggggcggaccccgtcgagcccgttccgctcaccgacatcccgcccctcgtgctgtccgaagtcctgcgcgacgtcgacctgttcgtcggcgtggccagcgtgggcaacgacccgacatggcaggacggcggccccggcggccgcttccaggagtactggacgtcctacggcttcggcgagctgaaccagagcgccgagacccgccgtgccctgctggaacgcctgataccccggctcgcgatcgcggaccgctgctcgatcgagggccggttcctgcacgtcaagggcgagcgccacacgtacaagatccacctgggctcgggcaacatcctgatgaccccgaacgaccagtacctgtgcatcgtcccgaaggcgagcgccgccgccccgggcaccggctatctccccttcgagggcgaccggacgctcgcggtcgtcctcagcaaggcgacgatgctcgcgaaggacacggagatcacggatccgacgatcctgagccaactg

SEQ ID NO: 3390 - DNA, 492 bp, Streptomyces avermitilis
  CDS (1)..(492)
gtgggggtcactcgatggggggaggcggtgggcattcccccaggtcccccagttctgatcgatccaggggcgttgtcagtggtgcctcgtactgtcggcggcatgggattggtgacgttcgtcgacgagacgaccagtgggaaccgtggcgggggctggggacttgagatcgccgaggagcggctcgcgttgcgcgagctgatccggcggcgggtcttccaggaggtcgccgagtacaacgcgcgtacgccgcaggtgttccaggggctcgtgcagcccgaggacaccgaacgcgtgctgaacggatacgcggtgcggccgggccggcggatcgaccccgaggcgcagacacgcctcgcgctgaaggccttcgcgggaaacgggttcctggtgctggtgggggaccgtcagatcaccggcctcgacgaggagatcgagctgacgctcggcaccgaggtcaccttcctgaagctcgtcgcgctggtgggtggc

SEQ ID NO: 3391 - DNA, 411 bp, Streptomyces avermitilis
  CDS (1)..(411)
atgtcagatgaccagtcgtacgagctgctcggtttcgacaacgtgctgttgcccgtcggggatctcgacgaggcggtggccttctacgagctggccgggttcccgctggccttccggctcgacgaggccgggatcgcgctgctgaaggtcgggggcgagacgcccggtgtgctgctgcggcaggaggacgagctgacgcgccgcccacccctgtgggcctcgccccgggtctggctggaggtccgggacgcccggatcgcggcccgcaccctggccggcgcgggcgtgacgcccctcgacgcccccttccccgtcgccaccggctggacggtcgaggtcgccgacccctggggcaacgtcatcggcttcaccgactacagcaagcgccccgagctcggccgccgttcggcg

SEQ ID NO: 3392 - DNA, 405 bp, Streptomyces avermitilis
  CDS (1)..(405)
atggacctcacagtcgtcgcgtacgtcatctacctgctggtcagcatcagcctgaccatctgggtggcacgcacgctgagccacaacgggcggatatttctcgccgacgtactgcacggcaacgagaagctcgccgacgccgtcaaccacctcctggtggtcggcttctacctcgtcaacctcggtttcgtcgcgctctacctgaacagtgacgacgagatcgccgacgcccgcggcatcttcgaggcactgtcgaccaagctcggcgtcgtgctgctcgtgctcggggtcatgcacctcggcaacgtgtacgtgctcaacaagatccgccggcgcggagtgatggagcgcgagcagctgccgcccgtcgccccgcagggctgggtcgccccgacgaccggggcg

SEQ ID NO: 3393 - DNA, 516 bp, Streptomyces avermitilis
  CDS (1)..(516)
gtgagcgggatgacctccccggccaccgccggcccggaccgggacgccgcgcgcgtcccggtccgcgggctcaccgtcctgtacgacgcccagtgctcgctctgcaccttcctgcgcgactggctcgtcaagcagcgtcagctcgtgcccctcgaactcctgccggcgggatccgaccgggccagggcgcgcttccccgcgctcgaccaccgggcgaccctcgacgagatcaccgtggtcggcgacagcggtcaggtgtaccgcggctccgccgcctgggtcgtgtgcctgtgggcgctgcgcgagcaacggccgctcgcccaccggctgagcaccccgcgcggggccgtgttcgccaggggcgcgatgctcgccgccgccaagtggcgcgagacccggcagggcgggcagtggggcggcggctcgtaccacgtgggcgacggctggacgtaccacccggcctccgggtggacctacagccctcccggctgtgacagcggcacctgctccactggt

SEQ ID NO: 3394 - DNA, 795 bp, Streptomyces avermitilis
  CDS (1)..(795)
gtgcccgcgaagaacgacagtcccgaaaccggccccccggccgaagagggcgccgccctcaccaagtccgagcagacccgcgccctgatcctggagaccgcgatgcggctgttccaggagcggggatacgacaagacgaccatgcgggccatcgccaaggaggccggggtctccgtcggcaacgcgtactactacttcgccggcaaggaacatctgatccagggcttctacgaccggatcgccgccgagcaccaggaggcggtccgggaggtgctggaccgcgagaccgatctggaggcccggatcggtggcgtactgaaggcctggctggacatcgccacgccgtaccacgagttcgcggtgcagttcttcaagaacgccgccgatccggacagcccgctcagccccttctccgccgagtcggagcacgcgcgcgtggaggccatcagcgtccaccgcgaggtgctggccgggacccggaccaaggtgccggacgagctgcgggacgtgctgcccgagctgatgtggctctcccagatggggctcgtcctgtactgggtcttcgaccgtacggaggggcgcgagcgcagctaccggctcgccgagcgcggcgcccgcctcacggcccgcggggtctccctggcccgcttccgcgtactgcggcccctcgtccgcgaggtgcacgagttgttcacggacttcctgccggggatgaccaacgcgctgccggatccggccaaggccaaaaagcggcaggggaacccaccgggggcgcccgcgtccgccgacgccccc

SEQ ID NO: 3395 - DNA, 2427 bp, Streptomyces avermitilis
  CDS (1)..(2427)
ttgagcgtgacggcattggcacggtggtgctatcggcaccggctggtggtcctgttgctgtgggtgggggcgctgttcggactgggcttcgcggcatccaccgcgggcacggactacgcgaacgtcttctcccttccgaacacggactccaagcgcgcgtacgacctgatggagaaggcgttcccggacagcgcgggcgacaccgacacggtcgtgtggaaggtcgacgggggaacggtcgaggacccgtccgtacggtcccggatccagcccgcgctcgacgagatcggccggatgaagggcgtcggcggggtcaccagcccgtacgcgggcacccagggggccgcccaggtcagcgggaacgggcggatcgcctacgcccagatcaccttcaccgagcaggcgaacgccgttcccaaggaactggtgcagaacgtcgtcgacaccgcgcagaaggcggaacgcggcggactccaggtcgagttgggcggtcaggcgatccagcgggtgcaggagccgcccaccggcatcgcggagatcgtcggcatcctggccgcggccgtcgtcctcttcctcgccttcggctcgctcttcgcgatgctgctgccgatcggcatcgcggtcttcggcgtcggcaccgggctgttctcgacgcagctgctcagccacgccacggacatccccgacctcgccccgctgctcgccacgctgatcgggctcggcgtcggcatcgactacgcgctgttcatcgtcacccggcaccggcgcggcatcctgcggggcatggcaccggaggagtcggtggtcaccgccctcaacacctcgggacgggcggtgctgttcgccggcggcacggtgtgcatcgcgctcgccgggatgctcgtgacgaacctgcgcttcctggacggcgtggtcatcggcacctcgctcaccgtcgtcctgagcgtgctcgcggccgtcaccctgctgcccgcgctgctcggtttcctcggcacccgggtgctcagccgccggcagcggcgcaggctcgcggccgaggggcccgagccggagcgggcgagcggactggcggcgcgctggtccacgaacgtccagcggcgcccgcgctcgatcgcggtgatggctctcgtcgtcatggccatcctcgcgattcccgtgctgtcgctgcggctcggcgccaccgaccagggcaacgaccaggcgtcgacgacgaccaggaaggcgtacgacctgctcgccgaggggttcgggccgggcttcaacggtccgctccaggtggtctcggacggcggtgacgcgaacgcgctcgtgcggggcatcgaggcgaccgacggggtggcgcgggtggccgcgctgccgcccgcgcggggcgtgacggtgatccaggtcgtccccaccacctcaccgcagtccgagcggacggaccggctcatcgacacgctgcgggagaaggtgatcccggacgccggcgcgaacgcccatgtcggtggcgtgaccgcgatctccaaggacttctcgtccgtgaccggcgagcggctgccctacttcatcgcgacgatcatcggcctcggcttcctgctgctgatgctcgccttccgctccctcgtcgtgccgctcacggccgcgctgatgaacctgatcgcggccgccgcgtccttcggggtgctcgtcgcgatcttccagtggggctggggcctggagctgctgggcctgggcaaggagggcccggtcaacgcgttcctgccggtcatcatgctgtccctgctcttcggcctctccatggactaccaggtgttcctggtgagccggatgcacgaggagtgggtccacacgaaggacaacgcgcgcgcggtccgcgtgggcctcgccgagaccagccgggtgatcaactccgcggccctgatcatggtctgtgtcttcctggccttcgtcctgagcggcgactcgggcgcggcgatggcgggcgtcggcctcgcggcggcggtcgcgctggacgcgttcatcctgcgtacggcgctggtgccggccgcgatgcatctgctgggcaacgccaactggtggctgcctgccggtctggagaagcggttgccgcatctcgcggtggagccgcaggaggacgccgtcgcggagccggccgccgagggcggtgcgacggtggtgcacggcttcgtccgtgacgcggagggcgggcccgtcgacagcgcgatcctcaccctcctcacgcccggcggccgccaggcggaccgggtgacgtcgctggccgacggctcgtacatcctctcggcgcccgcttcgggaacgtatctgctggcggtgacggccaccgcgtacgcggcccgcgcccggcacctgtccgtgggcaccgaaccgctggtgtacgacgtggagctgacggcggacgaggtggacgaggtggacgcggtgaac

SEQ ID NO: 3396 - DNA, 729 bp, Streptomyces avermitilis
  CDS (1)..(729)
atgaccgctcacgagggagccaccgtcctcgtcgtcgaggacgagccgagcatcgccgacgtcctcaccatcgccctgcgctaccaccgcttcgaggtgctgaccgcgggcaccgtccgccaggccctcaccctcgccgagcgcacccgcccccgggctcccggctccgcccgggccgggggaacccccatcgacctggcgctgctcgacgtgatgctgccggacggcgacggccgggcgctgggccgtgaactgcgcctgcggcagccggacctggcggtcgtcttcctcaccgcccgggacgcgcccgccgagatcgtgggcgcgctcggcttcggcgacgactacatcaccaagccgttcaacatcgacgaggtcgtcgcccgcatcacggccgtactgcgccgtacgcgccccgccgacgccctgccgcggcgcccgcccctgcgctacggcgacctggagctggacgagacgacgtacagcgcgcgccgcgccggccacacggtcgagctcaccccgaccgagtacgccctgctgcggttcctggtccgcaacggcgggcggatcgtgaccaaggagcaactcctgcgccatgtctggcagtacgagcacaccccggccgagtcgaccgtcgtcgagacgtacatcagctatctgcggcgcaagctcgaacccctcggtccgccggtgatccagacccggcggggcgtcggatacgggctcgcg

SEQ ID NO: 3397 - DNA, 1443 bp, Streptomyces avermitilis
  CDS (1)..(1443)
gtgagcgtccggcggccgcgccgccaccacggcatccactcgctgcgcggccagctgacgctcacgaacgtgggactgctcgccctcggcatcgtcgtggcgaccgccgtgagcatcatgggcatgcggcactatctgctcgaccagatcgacgcggagctgtcccagacccgtgactcgctgggcggttcacagctcacgttgcggcagatcgactcgctgagcacgctggcgttcgcccgcgacctgttcgtcccgcacaccgacgagacaccgaaaccggactcggtcttcgcggccgtcgacggccacgggaaggccgtcgccatcggcggcctcgagccgaccgccacccagcgtgcgctggccgaggcggtggacgacccgcgcggcctcgccgacgacaccgacccgcacgacgtgaccgtacgcggcgccccctaccgggcgacggcggtgcggctcgccgacggcacgttcgtgctgctcgccacctcgaccgacgcgctgcacaagggcaacgcgaaggcgctcaagctcgatatggccatcgggacactgctgttggcgctgctcgcgtgcctgacgatgttcagcgtgcgccgccggatgcggccgctcgaggacatggtggagacctcgtcggcgatcgccgagggtgatctgacccggcgggtgccgtccagccaccatccgacgcaggaggtcgagcagctgcgcctcgccctcaactccatgctgcaccaggtcgagtcggcgtaccggacgcgcgagcgcagcgcgtcccagctgcgccggttcgtgggcgacgcctcgcacgagctgcgtacgccgctgtcggcgatccgcggctatctccagctgtacgagaaggggatgctgagcgatcccgacgaacgtcggcgggcctgggaccggatgaacggcgaggtggaccgcatgggccggctcgtcgacgaactgctcaccctcgcccggctggaccagcggcccgaactccgtgtccgcaacgtcgacgtgacccgtctggtgcgggacgcggcacaggatctgcgggcccagcagccgggccgtccggtgaccgtgggcgcggacggcgcgctgctcgtacaggccgacgagtccggcctgcggcaggtgctgggcaacctcgtgggcaacgtacgcacgcatacggccgccgatgtgccggtgcggctcggggtggagcgcgcggacggggtcgtacggctgtgtgtggcggacgaggggccggggctcgccgaggacgacgcggcccgcatcttcgaccggttcttccgggcgggcggtggcgcgggcagtggtctggggatggcgatcgtgcagggtgtggtcacggcccacggcggcgacgtgacggtccgcacggcaccgggcgagggcctggcggtgacggtgacgctgccgacgcggggggaggaa

SEQ ID NO: 3398 - DNA, 1287 bp, Streptomyces avermitilis
  CDS (1)..(1287)
gtggtcgttgtcttcgtgctggtgggcctggccgtgctggtcgcgttcggggcactgcactggtacgcgtggcgccggctggtccgggacacgacgcgcggccccggcctcgcgcgccgcaccggcacggtggtgatcgtcaccggtcccgtgctgatgttcggggccctgatcgccgagcgcaccggcgcgcccttctggctccaacgggtgctggcgtggccgggcttcctgtggatggcgttctccctgtatctgctgctggcgttggtggcggccgagttcgtacggccgctggtgcggcggctggtggagcgcgaggcgcccgccgaggtcgccgtaccccagccggagcgcgtgccggcgggcacggcgggcacggccgcgacggagccggagccggaggtggagtccgcgccggagccgaagcggccggagccggcggggccgcctcgggccgcggccccctcccggcgtctgttcgtctcccgggtcgtcggcggagccgccgccgcggcggcggtcggcacggtcggctacggcacgtacggcgtcctgcgcggcccccgggtgaagcgcgtcacggtcccgctggccaagctgccgcgctcggcgcacggtttccggatcgcggtggtgagcgacatccacctgagcccggtcctgggccggggcttcgcccagcgcgtcgtcgacacgatcaactccacgcagccggacctcatcgcggtggtcggcgacctggtcgacggcagcgtgcaggacctgggcccggcggcggcaccgctctcccagctgaaggcgcggcacgggagctacttcgtcacgggcaaccacgagtacttctccggcgccgggcagtgggtcgaggaggtgcgccggctgggcctgaacccgctggagaacgcgcgcaccgagctgcccgccttcgacctcgcgggcgtcaacgacgtggcgggtgagagcgagggccagggcccggacttcgacagggccctgggcgaccgggacacgacccgggccgtcgtgctcctcgcccaccagccggtccagatccacgaggccgtccggcacgacgtggacctccagctctccggccacacccacggcggccagctctggcccggcagcctcgtcgcggccgccgccaacccgacggtcgcgggcctggagcgctacggcgacacgcagctgtacgtgtcacggggcgcgggagcgtggggcccgcccacccgggtgggcgcgccttcggacatcaccgtcgtcgaactggcgtcgaagcaggcg

SEQ ID NO: 3399 - DNA, 240 bp, Streptomyces avermitilis
  CDS (1)..(240)
atgaagctcagccgccccgtctcctggttcctgctcgccttcggggtgtggagctgggtcatctggatcactttcgtcaagaacctgtggaaggacggcagcgggctcgcgttcgacgacgcgggcgatccgacggcgtacttctgggtgcacctgacgctcgccgtcgtctcctttgtcttggggacggttgtcggggtcatcgggttgcgcggactgcgcgccttgcgccacaggtca

SEQ ID NO: 3400 - DNA, 1341 bp, Streptomyces avermitilis
  CDS (1)..(1341)
gtgcccgcctcgaacaggaccgccaggcgccgcctgccggtcacctccgccgcgctcctgtccttgctgaccctctcgctcaccgcgcccgcgaccgcgttcgcggacgggagcccggcggcgacccccacagcgaccccgacagggacccccacgacgaccccgaccgggaccccgacggcgacgctctcggccacgcccccgtccggcatgtcgaccatcggtggcgaccaactcggcagtcccgggacccaggtgaacctcggcagcggtgccccggtgatcccgaaggacatcaccgcacgctcctggatcgtcgccgacgccgagtccggagacgtcctggccgcccacaacgcgcactggcggctgcccccggcgagcaccctgaagatgctgttcgccgacacgctgctgcccaagttccccaagaacaccgagcacaaggtcgtcccctccgatctggcgggcatgggcgcgggctccagcgtggtcggcataaaggagaacgagacgtacacggtccacgacctgtggctcggcgtcttcctgcgctcgggcaacgacgccgtgcacgtcctgtcggcgatgaacaagggcgtcggccagacggtcgaggacatgcaggagcacgccagggagctccaggccctggacacgcacgtggtcagccccgacgggtacgacgccccgaggcaggtctcctcggcgtacgacctgacgctgttcgcccgctccgggctgcagaagaaggacttccgggagtactgcgcgaccgtgcgcgcgcagttcccgggcgagaccacgaagaagaagggcaagacgacccgcgggtccttcgagatccagaacaccaaccggctgctggccggcgacagcgacatcaccccgtaccagggcatcgcgggtgtgaagaacggcaacaccagcaacgcgggcgccaccttcaccggagtcgccgagcggaacggcaaggtgctcctcgtcacggtcatgaacccggagaagaacgagcacaacgaggtctacaaggagaccgccaagctgctggactggggcttcggcgcggcggacaaggtgacgccggtgggcgagttggtggccccgcagggcgcggacaccagcgcgcagccgggcgcgaacgcgcccgtctccccaggtgccggcgcggacaaggagtccgcgaagccggtggccgccgatctgaaggacggcggttcgagcggagtcgggatcgcgctggcggtcacgggcggggtgctcgtgctgctcgtggcgggcgggttcctggtcaaccgccgctggccgctgcccgatctggtacgtcgtcggacgcgccgc

SEQ ID NO: 3401 - DNA, 1032 bp, Streptomyces avermitilis
  CDS (1)..(1032)
gtgcgccggaatcggcccggcgctcgccactgtccagcgttttcggggtacccggaccctggctttccgagaggttcgaggcgttcgggatcttcgaggcgagggaagagtcggatcatggactggctgaaatcactccccggcatcgggccgttgatcgcgcgcctgatgaccactcacgcgtggcgttcgtacgagcgtctggaccgggtgaagtggacccagctcgccgccgcgatgaccttcatcagtttcgtggcgctcttcccgctgctgaccgtggccgccgcgatcggcgccgccgcgctcagcgaagagcagcagaagacgctccaggacaagctcgccgagcaggtgcccggcatctccgaccagctcgacatccacgcgctggtccagaacgcgggcacggtcggggtgatcgcgggcgccgtgctgctgttcaccggcatcggctgggtcggtgcgatgcgcgactgcctgcgcgcggtctgggagctggacgacgacgaggagaaccccttcctgcgcaagctcaaggacggcggtgtgctcctcggcctgggcggcgccgttctcgtcaccctcgccacgtccacggtcgcctcggccatggtgggctggacggccgaccggctcggcatcgagagggacggctggggcagcgtcctgctgcacatcaccgcgttcctcgtcgccgtactcgccgacttcctgctgctgctgtacgtcctgacgctgctgcccggcgtcgagccgacccggcgccggctcgtggtggccgcgctgatcggcgccgtcggcttcgaactgctgaaactgctgctcagcggctatatccagggcgtcgcgtcgaagagcatgtacggcgccttcggggtgcccgtcgcgctgctgctgtggatcaacttcacctcgaagctgctgctgttctgcgcggcctggacggcgacgccgagcgacggcccggcagaagaagaggtcagcggcgcgtccgacgacgtaccagatcgggcagcggccagcggcggt

SEQ ID NO: 3402 - DNA, 762 bp, Streptomyces avermitilis
  CDS (1)..(762)
gtggttttcatgaaggacgccttcggcgccccgcagtccctgttgatcctcggcggtacgtccgagatcgggctggccaccgcgcgccggatgatcgcccggcgcgcccgcacggtgtggctggccggacgcccctcccccgcgctggagcaggccgccgaagcgctgcgctcactgggcgcggacgcccgcaccgtcgccttcgacgcgctcgaccccgagtcccacgagaccgtgctcggcaaggtcttcgcggagggcgacatcgacatggtgctgttcgccttcggcgtgctcggcgaccaggccgacgacgaacgggacccggtggccgcggtgcgggtcgcgcagaccaactacacgggcgcggtctcggccggcctggtgtgcgcgcgggcgctccagacgcagggccacggctcgctggtggtgctctcctcgatcgccggcgagcgcgcctgccgctccgacttcatctacggctccagcaaggcgggcctggacacgttcacccagggcctgggcgacgcgctgcacggcaccggcgtgcacgtcatggtcgtacgacccggattcgtccgtacgcggatgacggccggcctggccgaggcgccgctggccaccaccccggaggccgtcgcgacggcgatcgaactggggctgcgccggcgctccgagacggtgtgggtgccgggggcgctgcgggcggtgatgtcggcgctgcggcatgtgccacgaccggtgttccggcgcctgccggtg

SEQ ID NO: 3403 - DNA, 579 bp, Streptomyces avermitilis
  CDS (1)..(579)
gtggggaccgtaacgatcggtgtgtcgatcgcggtcccggagccccacggcagcctgctccaggagcggcgcgcgggcttcggcgacgccgctgctcacggtatccccacgcatgtcacgctgctgccgccgacggaggtcgacgccgcggcgctgcccgcgatcgaggcgcatctcctcgaggtcgcgggcgccgggcggccgttcccgatgaagctgtccgggacgggtacgttccggccgctgtcgccggtggtcttcgtccaggtggccgagggcgccgaggcgtgcacctggttgcagaagcaggtccgtgacgcgtccgggccggtggcgcgcgagctccagttcccgtaccacccgcacgtcacggtggcgcacggcatcgaggacgaggcgatggaccgggcgtacgaggagctggcggactaccgggccgagtggccgtgcaccggcttcgcgctctacgagcagggcccggacggagtgtggcgcaaactccgggagttcaccttcggcggcccggtggtgcccccgcaggcgggcgcccccgcggagcggaactcgactccggcctgt

SEQ ID NO: 3404 - DNA, 1011 bp, Streptomyces avermitilis
  CDS (1)..(1011)
atggcctctgatcgtccccgcgtgctctccggaatccagcccaccgcaggctcgttccacctcggcaactacctcggcgccgtccgccagtgggtggccctccaggagtcccacgacgcgttctacatggtcgtcgacctgcacgcgatcaccgtcccgcaggatccggccgatctgcgcgccaacacccggctcgccgccgcgcagctgctcgccgcgggcctcgacccggagcgctgcacgctcttcgtccagagccacgtcccggagcacgcgcagctcgcctggatcatgaactgtctcaccggtttcggcgaggcctcccgcatgacccagttcaaggacaagtccgccaagcagggcgccgaccgcgcgagcgtcggcctgttcacgtacccggtcctccaggtcgccgacatcctgctgtaccaggccaacgaggtcccggtgggcgaggaccagcgccagcacatcgagctcacccgcgacctcgccgagcgcttcaacggccgcttcggcgagacgttcacggtcccgaagccgtacatcctcaaggagacggcgaagatcttcgatctccaggacccgtcgatcaagatgagcaagtcggcgtccacgcccaagggcctcatcaacctcctcgacgagccgaaggccaccgccaagaaggtcaagagcgcggtcaccgacaccgacaccgtcatcaggtatgacgcggagcacaagccgggtatcagcaatctgctgaccatctactcgaccctcaccggaaccggtatcccggaactcgaggagaagtacaccggcaagggctacggtgcgctgaagacggacctcgccgaggtcatggtcgacttcgtgaccccgttccgggagcgcacccagcagtacctggacgacccggagaccctcgactcgatcctggccaagggcgcggagaaggcgcgtgccgtggccgcggagacgctctcccaggcgtacgaccgggtgggcttcctgcccgccaagcac

SEQ ID NO: 3405 - DNA, 621 bp, Streptomyces avermitilis
  CDS (1)..(621)
gtgctcggggcgccgcaggccggggctctcggccgggacgacggtcatggtcgcgacataccggacctggcgctggtcatcgcgggcgggtcggggcggacggtcgtcctgcgctccgggcagcgggacttcgcccggatctggcagttgctggggccgatgaacgtcgggaccgagaaggtgccggacgcctgggcgcggggccgctacccgaaggtgcgggccaccgtggtgtggggcctgacgggcatcggcggctggccgtacaccgaccgggcgcccggcggggacgtcggcatcgagcggcaggaccaggtgttcctcgcggaggacgggacgccctgggtgcgtacggatccggcgccggacgtggcggacgacgacgtgcgctggcaccgggcgacgcgttcggtcttcgccgaggtgaacaggagcggtctgttcggggcggctcccgcgcccccggcggacgagggaccttcggcggtgcgctggggcgtgtgggggctcggcacgggactcgccctcggggtcggcggcaccctcctggtacgccgcacggcggcccggcgtgaaggtgccggaccgccgcgggagccacgacaggagctgatcgacctg

SEQ ID NO: 3406 - DNA, 1446 bp, Streptomyces avermitilis
  CDS (1)..(1446)
atgcccgagcagcccctttccaccgagtccaccgccttccgcagcgccctcgacgtgatccgggccgtggagccccgcgtcgccgacgccatcgggcaggagatcgccgaccagcgcgagatgctcaagctgatcgcctccgagaactacgcctctccggccaccctcctggccatgggcaactggttcagcgacaagtacgccgagggcacggtcggccgccgcttctacgccggctgccgcaacgtcgacaccgtcgaggcactcgccgccgagcacgcccgcgagctcttcggcgcccagcacgcctacgcccagccgcactccggcatcgacgccaacctcgtcgccttctgggccgtcctcgcggaccgggtggaggcccccgccctcgcgaaggcgggcgtccgcaacgtcaacgacctctccgacgccgactgggccgagctgcgccgcgccttcggcaaccagcgcatgctcggcatgtccctggacgccggcggccacctcacccacggcttccgcccgaacatctccggcaagatgttcgaccagcgctcctacggcaccgaccccgccaccggcctcatcgactacgaggccctgcgcacctccgcccgcgagttcaagccgctgatcatcgtcgccggctactccgcctacccccgcctcgtgaacttccggatcatgcgggagatcgccgacgaggtcggcgcgaccctgatggtcgacatggcgcacttcgccggcctcgtcgcgggcaaggtcctcaccggcgacttcgacccggtcccgcacgcccagatcgtgacgaccaccacgcacaagtcgctgcgcggcccgcgcggcggcatggtgctgtgcgacgactcgctcaaggaccaggtcgaccgcggctgcccgatggtcctcggtggcccccttccgcacgtcatggccgccaaggccgtcgcgctcgccgaggcccgccgccccgagttccgcgactacgcccaggccgtcgtcgacaactcccgcgccctcgccgagggcctggtgcgccgcggcgccaccctggtcaccggcggcaccgacaaccacctcaacctgatcgacgtcgcctcctcctacggcctcaccggccgccaggccgagaccgcgctgctcgactcgggcatcgtcaccaaccgcaacgcgatccccgccgaccccaacggcgcctggtacacctccggcatccgcatcggcacgcccgccctgaccacgcgcggcctcggcacggccgagatggacgagatcgcgggcctcatcgaccgcgtcctcaccaccaccgagcccggcaccaccgccaagggcgccccctccaaggcccagcacgtcctggacccgaagatcgcggacgagatcgcccaccgcgccggagacctgctgaccggcttcccgctctacccggagatcgacctcggc

SEQ ID NO: 3407 - DNA, 1251 bp, Streptomyces avermitilis
  CDS (1)..(1251)
atggggaggggggtcacccgtcgtcgtgcggtcggaaacggagtcctcgtgagcaccaccgaaacactcatcgcctcggccgacgcgcacagtgcgcacacctaccacccgctgccggtcgtcgtggcgacggcggacggggcctggatgacggacgtcgaggggcgccgctatctcgacctgctggccggatactcggcgctcaatttcggacacggccaccggcggctgatcgacgcggcgcgagcgcagctggagcgggtgacgctgacgtcgcgggcgttccaccacgaccggttcgccgccttctgcacccagttggcagagctgtgcggcatggagatggtgctgccgatgaacacgggcgcggaggcggtcgagacggccgtgaagacggcccggaagtggggctaccgggtgaagggcgtgcccgcggagatggcgaagatcgtcgtggcgggcaacaacttccacggccgtacgacgacgatcatcagcttctccacggatccggaggcgcgggcggacttcggtccgtacacaccgggcttcgagatcgtgccgtacggggatctgaccgcgatgcgttcggcgctcaccgagaacacggtggcggtgctgctcgagccgatccagggcgaggcgggggtgctggtgccgccggccggctacctggccggggtgcgggagctgacgcgggaccggaacgtcctgttcgtcgcggacgagatccagtcggggctcggccggacggggcgtacgttcgcctgtgagcacgagggggtcgtaccggatgtgtacgtcctggggaaggcgctcggcggcgggatcgtgccggtctcggcggtggtggcgtcgagcgaggtgctcggtgtgttccggcccggtgagcacggggcgacgttcggcggcaacccgctggcctgcgcggtggcgctggaggtgatcgcgatgctgcggtcgggcgagtaccaggcgcgggcggccgagctgggcgagcacctgcaccgggagctgggggtgctggccggcaccgggcgggtgacggcggtgcgcgggcgcgggctgtgggcgggcgtggacgtcgatccggcgtacggcacgggccgggagatctccgagaagctgatggaccggggtgtcctggtcaaggacacccacggctcgacgatccggatcgcgcccccactggtgatctccaaggaggacctggactgggggctggcccaactgcgtggcgtgctcggtgtc

SEQ ID NO: 3408 - DNA, 1185 bp, Streptomyces avermitilis
  CDS (1)..(1185)
atggaacgccgcaccatcgacccccgccccggctggcagcagaccgtcgaggcgcagggcctcatctacccgctcacccgctaccccgacgactccctgcgcccctactgggacgagagcgcgtactacgtcttctcgctgcccgaggtggaggcgctggaggagaccgtcgaggaactgcaccgcatgtgcctggcggcggccgcgcacatcgtcgagcagaatcgcttcgccgacctcggcatcgccgacccgcgcctcgccgcgctcgtcgccgaggcctggcaccggcgcgccgaactcccgtccgtctacggccggttcgacctccgctacgacggcacgggccccgccaagctcctcgagtacaacgccgacaccccgacctcgctcgtcgaggccgccggcccccagtggttctggatggaggaccgtttccccggcgccgaccagtggaactccctccacgaacggctcgtcgacgcctggaagaagcaggccgccctcctcccgccgggcagcccgctctacttcgcgcactccgccgccgacgaactcggcgaggacctgatgaccgtcgcctatctcaaggagaccgcggagcaggccggcctcgacaccgactggatctccatggaggagatcggctgggacccgctctccggccgcttcgtcgacaaccagctccacttcatccgcagctgcttcaagctgtacccctgggagtggctcaccggcgaccgcttcgccggccatgtcctggacaccctcgacaacggcggcggcacgggctccaccctgtggatcgaacccgcctggaagatgctgctcagcaacaaggccctgctggcgatcctctgggagctgtaccccggacacccgaacctgctccccgcctacctcgacggcccacgcgacctggcgaccgccaacggctacgtcgccaagccgctcctcggccgggagggcgcgggggtgacggtccacgcaccgggcgccgcccccgtcgtacgcgaggaagagccctgctgctaccaggagctggcacccctgcccgccttcgacggcaaccacgtcgtcctcggcgcctgggtcgtcgaggacgagtcggcgggcctcggcatccgcgagtcgtccgggctgatcacggacgagtacgcccgcttcctgccccatgtgatcctc

SEQ ID NO: 3409 - DNA, 360 bp, Streptomyces avermitilis
  CDS (1)..(360)
atggcgaactcacgacggcaactgcgctcgggcacggtcgtgctcggcggcatgggactcctcgcggcggcgctcaccgcctgctcgtcggacgaacccgacaagcgctgcgtcgaccgcgacagctacaacctcggcaagggcggctacaaggtcgtcgccgacaagaactgcaagacgggcagctccggcagcggcaaggtctcctcgggctacacctggtactacggcggcgacaggagcaagagccgcatcgactccggcagcttcaccaagccctccaagggttcgggcggttcgagcggcggtggcggcgtcgaccgcggcggcttcggcagcggcaagggcggctccggcggc

SEQ ID NO: 3410 - DNA, 822 bp, Streptomyces avermitilis
  CDS (1)..(822)
atgatgtgcgcgctcggcgcggcggtctgcttcggtacggcgacggtgttgcaggcgatcgccacccgggaggccgccaccacggggcccggcggggacgcggctctgttgctgcgggcgctgcggcagtggcggtatctggcgggcctggcgctggacgggctgggcttcctgctccagatcgcggcactgcggtcgattccgatctacgcggtcggcgcggccctggcggcgagcctcgcggtgacggcggtggtcgccgcacggctgttgcatgtgcggttgagcggggtcgagtgggccgcggtgggggtggtgtgcgcgggcctcggcatgctcgggctggcgtccggggcggagggcgaccgggccgggtcgacggcgctgaagtacgcgacgctcgcgacggcggtggcggtgctgctgctcgggctggtgggcgggcggatgtccgggcgggggcgggcgttggtcctcggcctcggggccggattcgggttcggggtcgtagcggtgtccgtacgcctgatcgacgacctcgcgcccgccactttgctgaccaatccggcgacgtacgcactgctcatcggcggaggcgccgcattcatcctgctgacctcggcgctgcaacgcggctcggtgacgacggccacggccggcctggtcatcggcgagaccgtcggaccggccctggtgggggtcatctggctgggtgaccgtacacgggagggcctgtcctggctggccgtgctgggcttcgtggtggcggtcgcgggggcgttggcgctgacacggttcggggaggcgccggtggaggagggg

SEQ ID NO: 3411 - DNA, 417 bp, Streptomyces avermitilis
  CDS (1)..(417)
atgcccgaaaccgactccgccgccgactcctgggagtactccctctacatcccccaggacctccgcgccgtcacggtctgccgccgcaccctccgtctggtcctcaccctccaccacctcacccacctcgccgacaccgccgaactcctcgcctcggagctggtctccaacgccgtactgcacaccaagggcccggcctgtctccgcgtccgttaccgggacggcctcctgcagatcggtgcctgggacgccgaccccgagccgcccgagccgcccggccggttggaggagttgaccgatgccgagagcggacgcgggttcgccctcgtgcgggcgtgctccgacgtatggggctggcagccgctgtcccggctcgggcatcggggcaagctggtctggtgcgaactgggggccgcg

SEQ ID NO: 3412 - DNA, 849 bp, Streptomyces avermitilis
  CDS (1)..(849)
atggcgacgcggcgacaccccacggcacggcaggcgcgcctgggctccgagctgcgcaaactccgggacgccgctgggctgaaggcgaccgcggccgcgaccctgctgggcgtgagctcggtccagatgagtcagatcgagtccggcatcgcaggagtcagcgaggaacgcatccgccgcctcgcggccaactacgcatgttccgacagcgcgttgatcgatgccttggtcgtcatggccacggaccggacccgtggctggtgggaggagtaccgaggtgtccttccggccgcctacctggacctctccgaactcgaccaccacgcgacgttccgccacgatgtggcggtcatccatgtgcctgggctcttccagacggaggactatgcccgtgcgctcttctcctatatgaacccggagttcccggagagcgaggtggaacaccgggtacaccaccggatgaagcggagggtcgtcatcgagggtcccacgcccattccgtacgaggccgtgatccacgaagcagcactccgcatcaaggtggccggccgacccgcttcgtgtgcccaactcacccgggttgcggagctgtccgaggaagagcacatcagcgtgcgggtcatcccgttcggcctggacgacttcgccggtgccggaagcgccatggtgtacgtgggtggcgcggtaccgcgcctggacactgtcgtacgcgacgctccgcacggcacggccttcgtcgattcggaagcccaactggaccactttcggacgctcttccgtagggtgaagggggaatcactggaccccggtcagtcacgtgacctcatccacaagctcatcaaggaactg

SEQ ID NO: 3413 - DNA, 198 bp, Streptomyces avermitilis
  CDS (1)..(198)
atggccacccgcctcaagtggcagaagtcgtccttctccggcggcggtgaaggcaacgactgcctcgaactcgcatccacccccaccaccctccacctccgcgagagcgacacccccaccacggtcctcaccaccacccccaccaccctcgcccacctcctggcaggcatacgcgcccacgccgttcccggccaggcg

SEQ ID NO: 3414 - DNA, 1434 bp, Streptomyces avermitilis
  CDS (1)..(1434)
atggcgaaatcttgggccactttcggggtcgatctccacgtcgagccgaccggacccggcatccgcagaggtctgacggaagccctccgcgaggcggtccgcggcgggcgcctcgcccccggcacccggctgccctcatcacggtcgctcgccgccgacctcggcatcgcccgcaacacggtcgcggaggcgtacgcggacctggtggcggagggttggctcaccgcccgccagggctcgggcacgagcgtcgcacggcgcccggtgccgacgcccaccgccgcctcggcccccggccgcccgacccgcgcccgcccggtgtacgacctggtccccggcacccccgacctgtcctccttcccccgcgccgcctggctgaaggcctcccgtcgcgcgctgaccgtcgccccgcacgaggccctccactacggcgacccgcgcggccgggtggaactgcgcaccgccctggccggctatctggcccgcgcccggggcgtccgcacggacccggagcacatcgtcatctgctccggcttcctgcacggcctgatgctgctcggccaggtgctgcgcgggcggggactgacctcgctggccgtggagtcgtacgggctcgacgcccactggcggctgctggaggcggccgggctgcgcacggtgccgctcggattcgacgaactgggcacgcgtacggaggagttggcggccggtgcgcagggtgggggtgcgctgggaggcgtacgggcggtgctgatgacgcccgcgcaccagttcccgatgggcgtaccgctgcaccccgaccggcgggcgcgggtggtggactgggcgcggcgcgacgacggtctgatcctggaggacgactacgacggggagttccgctacgaccgccagccggtcggcgccctccaggggctcgaccccgaccacgtcgtccatatgggcacggccagcaagtccctggcgccgggcctgcggctgggctggctggtgctgccgccggcgctcgccccggaggtggtcgcggcgaagggtggggtggactggtcgtgcggggtgctggaccagctcaccctggcggagttcatcgcgtcgggcgcctacgaccgccatattcgcgcgtcccggctgcgttaccggcggcgcagggacgccctggtggcgcggctcgccgaacaggcccccgggggccgggcgacgggcatcgcggcgggcctgcacgtggtgctgcgcctgccgccgggcaccgagcagtcgacgctgagggcggcggcctggcaggggctcgcggtgcacggcctcgaccgctaccgccacccggagtcgaccgccgagcggtccgacgcgctggtggtgggctacgggacaccaccggaccacgggtggtcgggggcgctggacgccttgtgcgcggcattgcctttcgacagtaccggc

SEQ ID NO: 3415 - DNA, 519 bp, Streptomyces avermitilis
  CDS (1)..(519)
atgacgacgaacgacaccaccaccgccacgaccacccccaccgccgagtacgcccccgagcacagcccccgcctgaactgggccaagctcgcccccgatgtgtacaaggccatgatccggctcgacacggcggctcagcggggcctcgacccgaagctgcgcgagctggtgaagatccgcgcctcgcagctcaaccactgcgcgttctgcctcgacatgcacaccaaggacgcgctggcggcgggcgagagcgtcgagcgggtcgtgcagctcagcgcgtgggacgagtcgcggcacttctacacggagaaggagctcgcggccctcgagctgaccgaggcggtcacggtgctcacggacggcttcgtgccggacgaggtgtacgagagggccgccaagcacttcgaggaggcggagctggcccagctgatcgccgcgatcacggtgatcaacgcgtggaaccggttcggggtgacctgccggctggtgccgggccactaccaggccgggcagcacaag

SEQ ID NO: 3416 - DNA, 714 bp, Streptomyces avermitilis
  CDS (1)..(714)
atggtgagcggcgtcgatctcttccgcgccctgcaccgcggccgcgtgcccggcgatccgctggtgctgcccggtccgtgggacgcggcgagcgcacgggtgttcgccgaggcggggttccccgcgctcgccacaccgagcgcgggagtcgccgcctcgctcggctacgaggacggggcgacgcccgccgacgagatgttcgcggcggtggcgcggatcgcacgggccgtcgacgtgccggtgtccgcggacatcgaggacgggtacgggctcgcgccccgggaactggtggagcggctcctggaggcgggtgtcgtcggctgcaatctggaggactcccacaggggagtgctccaggaccccgcccggcacgccgaccggctcgccgaggtgcgcgccgccgcgggcgaccggctcttcgtgaacgcccgcgtcgacaccttcgtgcgcggggtcacggatcccgcacgggccatccagcgggccgcgtcgtacgtcgccgcgggcgccgactgcgtctatccgatcggcgccccgacggacgtactgcccctgctgcggtcgggcatccaggggccggtcaacctgctcgcccggcccgggggcccctcgctcaccgcactcggtgaactcggcgccacccggatcacgttcggcccgggcctccagctgcgggcgacggaagcactgcgcgagatcgccgccgagctggcg

SEQ ID NO: 3417 - DNA, 972 bp, Streptomyces avermitilis
  CDS (1)..(972)
atgacgcgtcacatgactcggcgtacgaggatgacgacgatgacggcgggtcttgccgtgctgctgctcgcgaccggctgcggcgccgccgacatgaccaagcaggcctcgcccttcgcgggcgcgcagggcgccaagacggtgacgctgtccgtgcagtcctgggtgggcgcacagtcgaacgtcgccgtggcgcagtacctgctgcaacacaagctcggctaccgcgtcgacaccgtccaggtcgacgaagtgcccgcctgggacgcgctcagccagggccgggtcgacgcgttgctggaggactggggtcaccccgagcaggagaagcggtacgtccaggacaagaagacgatcgcgcccgccggcgggctcggggtgaccgggcacatcggctggtacgtcccgacgtacttcgccgagcagcacccggacgtcaccgactggaggaacctgaacaagtacgcctcccagctccgcaccgcggagagcggcggcaagggccagctcctggacggctccccgtcctacgtcaccaacgacaaggcgctggtgaacaacctgaagctgaactaccaggtcgtgttcgcgggttcggaggcggcgcagatcacccagatgcggcagttcgccaaggagaagaagcccttcctgacgtactggtacgcgccgcagtggctgttcaagaaggtcccgatgacggaggtgaagctgcccgcgtacaaggagggctgcgacgccgacgcgaagaaggtcgcgtgcgcctatccgcacacgcccctccagaagtacctgaacgccgatttcgcgaagagcggcggcaaggcggcgcggttcctgaagaagttcaagtggacgaccgaggaccagaacgaggtcgccctgatgatcgccgaccagaagctgacgcccgaggaggcggcgaagaagtgggtggacggccacgcttcgacgtggaaggcgtggctgtcg

SEQ ID NO: 3418 - DNA, 1941 bp, Streptomyces avermitilis
  CDS (1)..(1941)
atggccacagccaccgctgccgcctcccacgtcggcgtccccgccttcctcaggcgccgcgccgtccggaaactcgcgctcctcgcgctggccgcggccgtcctcgtcccgctcgccgacgcccgctgggcgagcgggacctggccgcacgcgctgaccgtcgacctcaccgagccgctcggcagggccagcgactggatcatcgacaaccgggacagccacccgctgttcctgtacttcttcggctacgtcagcaacgccgtcgtcctcgccgtgcgcggcgtctacctcgtgctgctcgcggcaggctgggccggtgtgacggccgccgccgcgctcgtcgcctggcgggtggccggagtccggctggcggccggcaccgccgtcgccttcctcgtctgcggtctgctcggcatgtgggtgcccaccatgcagacgctcgccctcatggtggtcgcggtcctcgcgtccgtcgtgctcggcgcgctcctcggcctcgccgccgggctctccgaccgcacccaccgcgccctgcggccgatcctggacaccatgcaggtgctgcccgccttcgcgtatctgctcccggtcgtcctcgtcttcggcatcggcgtccccgcggcggtcctcgccaccgtcgtctacgcggccccgcccatggcccggctcaccgcgctcggcctgcgcgacgccgacggcggtgtgctggaggccgtcgaatccctcggcgccacggcccgccagcgcctgctcaccgcccgtctgccgctggcccgcaaggaactgctcctcggcctcaaccagacgatcatgatggcgctgtccatggcggtcatcgcctccgtgatcggcgccggcggcctcggtgaccgcgtctaccaggcgctcgcctccgtggacgtgggcgccgccctcgccgcgggcatcccgatcgtgctgctcgcggtcgtcctggaccgggtgaccggtgcggcgggggaggggcccggcgccgacggctcccgccgcgccgggtgggcctacgcggccgccgcggccgtggccgtcgcgctcgccggccggttcacgcaccgcctggactggcccgacgcctggaccgtgcacatcgccgcgccggtgaaccgggtcgtcgactggatgaccgaccacctctactccggcgtcccctacctcggcggcaccgccgactgggcgggccacttcaccacctgggtcctggacccgctccgcgacggcctccagtggctgccctggtggtcggtgctgctcatcgtcgccgccctcgcctggctgatcggcacctggcgcaccgcgctcaccgccgtcctcgcgatggccgcgatcggcgtgctgggcgtctggaagccgtccctcgacaccctcgcgcaggtgctggcggccgtggccgtcaccctcgtcctgggcttcgcgacgggcgtcgccgccgcgcgcagcgaccgcgtcgaacggctgctgcgcccggtcctggacgtcttccagacgatgccgcagttcgtgtacctgatcccggtggtggcgctgttcggtgtcggccgggcgcccgcggtcgccgcggcggtggtctacgcgctgcccgccgtggtccgcatcacgacccaggggctgcgcgcggtcgacccggccgcgctggagtccgcccgctcgctgggtgccaccggtgggcagcagctgcgccaggtccagctcccgctggcccgcccggccctgctgctcgccgtcaaccagggcgtcgtcctggtcctcgccgtcgtcatcatcggcggtctggtaggcggcggcgcgctcggctacgacgtcgtgttcggcctggcccagggcgacctggcgaccggtctggtggccggcgcggcgatcgtctgcctcggcctgatgctcgaccgggtgacccagccgaccgggcgccgcgcgaagaagggagcg

SEQ ID NO: 3419 - DNA, 1167 bp, Streptomyces avermitilis
  CDS (1)..(1167)
gtgatgagtacgccgccgcagaacacgcgccccgtcttctccgtggacggcctgtggaaggtcttcggcccgaaggccgaacgcgtccccgccgaccccgaactcgccgcgctgagcgccgccgagctgagcgagcgcaccggctgcacggccgccgtccgcgacgtctcgttcgacgtgcacaagggcgaggtcttcgtcgtcatgggcctgtccggctccggcaagtccacgctcgtgcgctgtctgacccggctgatcgagccgaccgcgggcaccatcgccatcgacggcgaggacgtacgcgccatggacaggacccggctgcgcgaactgcgccgccaccgcgcgtccatggtcttccagcacttcggcctgttgccgcaccgcacggtcctcgacaacgtggcgtacggcctggagatccagggcctcggcaaggcggaacgccgcgagcgggccgccgaggtcgtcgccaaggtcggcctggaaggcatggagcagcgcaagcccggccagctgtccggcggtcagcagcagcgcgtgggcctggcccgggcgctcgccgtcgaccccgaggtcctcctcttcgacgagccgttcagcgcgctggacccgctgatccggcgcgacatgcaggaggaggtcgtccggctgcaccgcgaggagggccgcaccatggtcttcatcacccacgacctgaacgaggcgctccgcctgggcgaccgcatcgccctgatgcgcgacggccgcgtcgtccagctcggcacgcccgaggagatcgtcggctcgcccgccgacgactacgtacgcgagttcgtccgggacgtgccgcgcgagcaggtgatgacggtccgcacggcgatgcgcgccgcctccgccgaggaggcgggaagcggcccggccgtcgccccggacgcgacggtgtccgaggcgatcgaggcggtcgcgcgggcgggcagcccggcgcgggtcgtggactccgggcggtgcgtcggggtggtcgactccgaggcgctgctcgacgtggtcgccggcgtcggtgccagcggccccgcccccgcggtgacagcggttcccccgttcgagccgagccgggacttcggcaacgcgggcgccggcgcggcagaggcggcgccgggtgacgtcaccggcgaggaggtcgcc

SEQ ID NO: 3420 - DNA, 1548 bp, Streptomyces avermitilis
  CDS (1)..(1548)
atgcacgagaactcctatgagaactcccatgagaactcccgcgagtacgactacgtcgtcatcggtggcggcactgcgggctccgtcatcgcgtcccgcctgaccgaggatccggacgtcaccgtcgccgtcatcgagggcggccccagcgacgtcggccgcgacgacgtgctgaccctgcgccgctggatgggcctgctcggcggggaactggactacgactacccgaccaccgagcagccgcgcggcaactcgcacatccggcacagccgcgcccgcgtgctgggcggctgctcctcgcacaacacgctgatcgccttcaagccgctgccgtccgactgggacgagtgggaggcggcgggcgccgagggctggggcgcggtgccgatggaggcgtactacgcccggctgcgcaacaacatcgtccccgtcgacgagaaggaccggaacgcgatcgcccgcgacttcgtcgacgccgcccaggccgcgctcggcgtcccccgcgtcgagggcttcaacaagaaaccgttcaccgacggcaccggcttcttcgacctcgcctaccacccggagaacaacaagcggtcctccgcgtcggtcgcctacctccaccccttcctggaccgcccgaacctccacctcctcctggagacctgggcgtaccggctggagctggcgggcacccgggcgaccggcgtgcacgtgcgcaccaaggacggcgaggagatcctcgtacgggcccggaccgaggtcctgctgtgcgcgggcgcggtcgactcgccgcggctgctgatgcactcgggcatcggcccgaaggaggacctggagaagctcggcataccggtcgcgcacgatctgcccggcgtcggcgagaacctgctcgaccaccccgagtcggtgatcgtctgggagaccgacgggccgatcccggagaactccgcgatggactcggacgcgggcctgttcgtgcgccgcgaccccgaacacgcgggccccgacctgatgttccacttctaccagatccccttcacggacaaccccgagcgcctcggctacgaacgccccgagcacggcgtgtcgatgaccccgaacatccccaagccgaagagccgcggccgggtgtacctgaccagcgcggacccgtccgtcaagcccgccctcgacttccggtacttcaccgacgaggacgactacgacggccgtaccctcgtcgacggcatcaagatcgcccgcgagatcgcgaaaaccgaaccactcgcccgctggctcaagcgcgaggtctgtccaggtccggagatcacggacgacgaggagctgagcgcatacgcccggcaggtcgcgcacaccgtgtaccacccggcgggcacctgccgcatgggcgccacctccgacgaacacgccgtcgtcgaccccaagttgcgcatccgcggcctcgacggcatccgcatcgccgacgcgtccgtcttccccacgatgcccgccgtgaacccgatgatcggggtactcatggtcggggagaagtgcgccgacctgctgcggggtgacgcg

SEQ ID NO: 3421 - DNA, 1527 bp, Streptomyces avermitilis
  CDS (1)..(1527)
atggccggacagcaggcacggcaggcagggcagacgcagcggaccatccatgtcggcggggagtggcgcgaagccgactcccgcgccacgcgcgagatcctcgaccccgcggacgccaagccgttcgccgtcgtcgcggagggtgacgagcgggacgccgacgcggccgtcgccgccgcccggcgcgccttcgactcgggcgagtggccgcacacgcccgtcgccgagcgcgccgccctgctgcgccgcgtcgccgatctcctcgtgcgcgatcgggaatcgctgggcctgctggagagccgggacgcgggcaagaccctcgaagaggggcgcgtcgacatcgactgcgtcgcggacgccttccgctacttcgccgatctggtcgtcggcgagggtggcggccgggtcgtcgacgcgggttcgcccgacatccacagcgtcgtcgtgcacgagccggtcggcgtctgcgccatgatcacgccctggaactacccgctcctccaggccagttggaagatcgcgcccgccctcgccgccggcaacaccttcgtgatcaagccgagtgagatcactccgctgaccaccgccgccctcgtcgacctgctcgtcgaggccggagcgcccgccggtgtcgcgaacatcgtcaccggccccggccacaccgtcggcgcccggctcgccgagcaccccgacgtcgacctgatctccttcaccggcggactcgccagcggcaccaaggtcgcgcaggccgccgccgtcagcgtcaagaaggtcgcgctcgaactcggcggcaagaaccccaacgtcgtcttcgccgacgcctgcgcgaccgacgaggacttcgacaccgccgtcgaccaggccctcaacgccgccttcatccacagcggccaggtctgctcggcgggcggccgcctcatcgtcgaggaatccgtccgcgagcgcttcgtcgccgaactcgtccgcagggcgggccggatcaggctcggccgcggcaccgaggacggcgtcgagtgcggtccgctcgtctccgagcagcagcgcgacaaggtcgaggggtacgtggcctcggcactgtccgagggagcggtgctgcggaccggcggcaggcggcccgagccgagcgacgtcaggcccgcggccggctacttcttcgagccgaccgtcctcgaccagtgccaccgcgggatgaaggtcgtacgcgaggaggtcttcgggcccgtcctgaccgtcgagaccttccgcaccgaggacgaggccgtcgccctggccaacgacaccgagtacgggctcgccggcgccgtctggaccagcgacgccggccgcgcccgccgggtcgccggacgcctgcgccacggcaccgtctggatcaacgacttccacccctacctcccgcaggcggagtggggcggcttcggcaagagcggggtcgggcgcgagctgggacccgccggactcgccgagtaccgcgagaccaagcacgtctaccagaacctcgcgccgaagcccgtgcgctggttcgcaggc

SEQ ID NO: 3422 - DNA, 1236 bp, Streptomyces avermitilis
  CDS (1)..(1236)
gtgtgggtggggcagggggacgagatgcagcaacggcgggacccggacagacaacagtggagcggcgacgggcacgacgacgggcacggcggtggccacgacggcgggaacgacggcgggaacgacggcggcgagcgggcggagccgtcgcgcgacacgccgttgtggcagcgaccgcccgtacctccgtcggacgaggcaccggacaccccctggtgggcgggcgccgagacccaggcggcgggggtacggcctcccgcgccaccgtcgccgccgacggaagaaccgtgggccgcgcctccaacgccggaagaaccgtggtcctcgcctccgtctccgtcggcggaagaaccgtggtcctcgcccgcgcctgcgccgccggaagagccgtgggccgcgcccccgcccgcggaagagccgtggtccccgcctccgtcggcatcaaccccatggtcctcgcctcctccgcctcccccgcccgactcctggtcgtcccccgtccccgtcgtcggcggcggcacgccgcccggctcgggcgggtcccggcgcacgctcgtcctcgtcgcggtgctggcggtgctcgcgggcgccggggtgggggttcgggcgtgggtgctgacccgcgacgactccacggagcacacgggggcggcgggcgccgggccgtccgtgaccgtcaccgccacggcgacggccggggaggacgccgcggggcagggcggctccacgctgtccgacggcgacagcgtcggcacggacgcgcagccgtcgtccgccgcagcccagccgtcccccggctacagccgggccgtcgacccggtcggctacaccgtcgacgtgccgcaagggtgggtgcgtgaggagaaacggggagtcagcgccgaggtcgtcacctacgcctcaccggacgacggccgcacgctgaagctgttccaggtcgtcgagaacaccccggccgaatccctcgacctggcggagaacggtcccggcggattcgacgggctggcggatttccacgtcctcgaccggtcctccggcgcagactgggccaggctcgactaccgctacgacgacccgaagagcggcaccacgcaggtcatcgaccaccgcttcacagcggccgacggcacgctgtacgcgatccgttcgagcggcccctccggcctggacgtggccgagccgttcaccgtggccctgaactcgttctgcccgaccggggcgagctgcacgagcccc

SEQ ID NO: 3423 - DNA, 987 bp, Streptomyces avermitilis
  CDS (1)..(987)
atgacccgcactcccgtgaacgtcaccgtcaccggcgcggccggccagatcggttacgccctgctcttccgcatcgcctccggccagctgctcggcgcggacgtgccggtcaagctgcgtctcctggagatcaccccggcgctcaaggccgccgagggcacggcgatggagctcgacgactgcgccttcccgctccttcagggcatcgacatcacggacgacccgaacgtcgccttcgacggcaccaacgtcggtctgctcgtcggcgcccgcccccgcaccaagggcatggagcgcggcgacctgctctccgccaacggcggcatcttcaagccgcagggcaaggccatcaacgacaacgccgcggacgacgtcaagatcctcgtcgtcggcaacccggcgaacaccaacgcgctcatcgcgcaggccgccgccccggacgtaccggccgagcgcttcaccgcgatgacccgtctggaccacaaccgtgcgctgacccagctcgcgaagaagacgggcagcacggtcgccgacatcaagcgtctgacgatctggggcaaccactccgccacccagtacccggacatcttccacgcctcggtcgccggcaagaacgccgccgaggtcgtgaacgacgagaagtggctggccgaggacttcatcccgacggtcgccaagcgcggcgccgcgatcatcgaggcccgtggcgcgtcctccgccgcgtcggccgccaacgccgccatcgaccacgtgtacacctgggtcaacggcaccgcggacggcgactggacctccatgggcatcccgtcggacggttcctacggcgtcccggagggcctcatctcctccttcccggtcaccaccaaggacggccggtacgagatcgtccagggcctggagatcaacgagttctcccgcgcccgcatcgacgcctccgtcaaggagctcgaggaggagcgcgaggcggtccgcgccctcggcctcatc

SEQ ID NO: 3424 - DNA, 1260 bp, Streptomyces avermitilis
  CDS (1)..(1260)
atgcctcgttggaaggctttgccggatgaactcgatccgcaggtcagggagttcgcaagccagttgcgcaggctcgtcgaccgcagcgggctgagcatagccgcggtggccgaccgcacgggctacagcaagacgtcctgggagcgatacctcaacggccggctgctcgcgcccaagggcgccatcgtcgccctggccgaggtcaccggcaccaatcccattcatctgaccaccatgtgggagctggccgagcgcgcctggagccgctcggagatgcgccacgacatgacgatggaggcgatccggatatcccaggcgcgcgccgcgctcggggagtccggtgccccaccggcggcgggcaggaacggcaaggcggcgcgcggcgccacggtgctgcccggcgtggcgggcccggccggcgtctcgccgaccattccgccgcagccgacggccccggacgtccaggactcgtcgggcgaggcccggcggggcgccctgcggggcggctcctccggcggctcttccggtgcctccgccgcctcctcgggaggcaactcgtgggggctcgccgggtacgcgggcccggcacaggccgacgggcgcgcgcccgccgctcccaccgggcgctcgggctcgcccgagaaggggggacctcggtcgcccggggggccgggccggacgccggaggccgccgctcacggagcgccgggcggacagccgccacgggactccggtccccctgcggtcggctcgcccgacggggcgcggcgcaagcggcggctgacgatgttcctcgcgggcgtcgtcggcgcactcgtcgtgatcgcggcggccgtcttcctcacgaacaacggcggcgacaaggacaacgagaccgcgccgaagtcacccgcggcctcggcctccgccgaccccgacctgccggcgggcgtgaagtgcagcggcaagagctgcaccggcaaggacccggagaacatgggctgcggtggcgagttggccaagacctccaacagcgtcaccgtcggcacgaccctcgtcgaggtccgctacagcaagacctgcggcgcggcctgggcccgtatcacccgggccgtgccgggcgacgaggtcaccgtggcctcgggcgcgtcggcgaagcagaccggcacggtcgaggcggccgcggacaccgacgcgtacaccccgatggtggccgtgaaggacgccggcgaggcgaaggcctgcgtgaccctgaaggcgggccagaagggctgcaccacc

SEQ ID NO: 3425 - DNA, 510 bp, Streptomyces avermitilis
  CDS (1)..(510)
atgatgggtgcctggcagccgctgccggacgatctgccgccggaggtacggcacttcgtggagcagctgcggctcctcaaggaccgcacgggattgagcctggtcgcgctcggcgcacgcaccgcctacagcaagtcctcctggcagcgctacctcaacgcgacccagccgccgccccggcaggcggtcgccgcgctgtgccgggtcgcgggcctcgccgaaagcgaggccgaacgcttcggcgtgcgatgggagttggcggtccacgcctggccccgcccgccggcccccgcacccgctcacgccggcggaccgacgggcggaccgacgggcgagccgatgggcggaccggcccccggcgcgtacgaggacgatccgacgctcccttggtgggacgcgcgcgacaacgtccccgaaccccgctggtccccgacgcggctgctcgcggtcgccggcgtcatcgccgtcgccctcctgctctgcgtactcatcggcgccttcgcgctgacg

SEQ ID NO: 3426 - DNA, 534 bp, Streptomyces avermitilis
  CDS (1)..(534)
atgcgcaagcacatccgcacggcagcggtggcggcggttctggccgcgggcacggcactcgggtcgatcgcggccgtcggcacggccctggcctcagaggacacgggcttcgtcgacggcaaggccggtacccacgacgactggaacgacgaggggaccctcgccaaggacgacaccagcaacgcggtcgccctgtggcagacggtcctgtgggccgacggtgccaagtggaaggccaagaacgggacgctgaagtcgttcacccaggacgacatcaccggcgacttcaacagccggacggtctcggcgacgaagttctggcaggccggcaacggcctcaagcagaccggcaaggccgacggagcgtcgttctcgctcgcggacaacaacctgggctccgcgaacaagaagggcctcgtcatctacgacggcgtcatcgacgagaccgtccagttcaagcgcctgaccgtcgcgggcgtcacccagcaggtctacttcgtcaaggtcgacgacgagtgggtcgcggccgcgtac

SEQ ID NO: 3427 - DNA, 615 bp, Streptomyces avermitilis
  CDS (1)..(615)
gtggcggaacggggcatgggggagtgggcgccgctgcccgcggacctggggcgggaggcccgcgcgctggccgagtcctgccgtctcctcaaggaacgcaccggactcagcctggccgctctggcggagcggacccactattccaagtcctcctggcagcgctgtctcaacggccgccagataccgccccgttcggccctgcggttcctcgccgaggcggccggggccgacccggcccggctgctcggcctgcgtgaggcggtgctgcggtccggccggggtcccctagcgccgcccgggccccggcagccgtcggacgggcgtgggccgtcgcacgggcgcggggagcccgccgaggcggtgccgcaggaggcgatgcctcaggacgcgtcaccggcgtcaccggccgagtccggccggacagcgcgggaggagcggcgggccgggaagagtgtcccggcgtccgccgctcccacggccccgctcgcggcggcggtgcgccgctggcggctgatcgccgccgtactgctggcactgctcctcgccgtcaccggcacggccctggccgtcatcggccagggccgcaccgactgcgagccggtcacgacgaatcct

SEQ ID NO: 3428 - DNA, 627 bp, Streptomyces avermitilis
  CDS (1)..(627)
gtgcgggacgcgagcgtcgagggcgtgggcggcggcccggccgcggaggacgcgaacggcggaccggccgtgcgggacgcgagtggtgcgccggccacggaaggcgggccggccgcggatggcgagagtggcgcacccgccgtggcggaggcgagtggttcgccggtcgagcgggacgcgaatggcgggccggtcgtgctggacgccgtcagcgctcccgatgccgacgggaagccgcggcggaccacccgccgtttcccgtccttcacccgggacaccgcgcggcccgagggcggtggccgcgccgcgtcctcggacgcgcccgcgcccgcccgccagtggccgatcctcaccgtgctgaccgccgtcgggctcgggctgctgctcaccgcgctggacgtggtccgcttcggcacggtcctgatcggcgtggcgctgctcgccggcgccgcgatgcgctgggtgctgcccgatgtgggcatgctcgcggtccggtcgcggttcacggacatggtcacgtacggcgtgctgggcgtcgccatcgtgctgctcgcgatgatggctcagccgaacccgttgctggagatcccgttcctggacgacacgctgcacttcacgatccgtacg

SEQ ID NO: 3429 - DNA, 852 bp, Streptomyces avermitilis
  CDS (1)..(852)
atgaccgcccagattctcgatggcaaggccaccgcagccgcgatcaagtccgatctgaccgcccgcgtggcggccctcaaggaaaagggtgtgacgcccggcctcggcacgatcctcgtcggggacgaccccggcagccagaagtacgtcgcgggcaagcaccgcgactgcgcccaggtcggcatcgcctccatccagcgggagctgcccgcgaccgccacgcaggaggagatcgaggcggccgtacgcgagctgaacgaggacccggcctgcaccggctacatcgtccagctgccgctgcccaagggcatcgacgagaaccgcatcctggagctgatggacccggacaaggacgcggacggcctgcacccgatgaacctcggccgcctcgtcctgaacgagccggcccccctgccctgcaccccgaacggcgtcctcaccctgctccgccgctacggcgtggagatcaagggcgcggaggtcgtggtcgtcggccgcggcgtgaccatcgggcgtccgatgccgttgctgctgacgcggcgcagcgagaacgcgacggtcacgcagtgccacaccggtacgcgcgacctctcctcgcacctcaagcgcgccgacatcatcgtcgccgcggcgggttccgcgcacctgatccggcccgaggacgtgaagccgggcgcggccgtgctcgacgtcggtgtctcgcgcagcgccgagggcaagatcgtcggcgatgtccaccccggtgtcgccgaggtggccggctggatctccccgaacccgggcggcgtcggcccgatgacccgcgcccagctgctcgtcaatgtggtcgaggcggcggagcgcagtgtcggc
